United States Patent 11,421,016 (CANCER NEOEPITOPES) - sequence listing, part 24

SEQ ID NO: 1063685 - protein, 9 aa, Homo Sapiens
TPHIRAEPF

SEQ ID NO: 1063686 - protein, 9 aa, Homo Sapiens
QAAKTYGRN

SEQ ID NO: 1063687 - protein, 9 aa, Homo Sapiens
PTIKEKVML

SEQ ID NO: 1063688 - protein, 9 aa, Homo Sapiens
PGFLMDKAF

SEQ ID NO: 1063689 - protein, 9 aa, Homo Sapiens
MRVLLYLPA

SEQ ID NO: 1063690 - protein, 9 aa, Homo Sapiens
GEVGDSRTV

SEQ ID NO: 1063691 - protein, 9 aa, Homo Sapiens
LDRCFARHC

SEQ ID NO: 1063692 - protein, 9 aa, Homo Sapiens
QNITSTLHH

SEQ ID NO: 1063693 - protein, 9 aa, Homo Sapiens
PGPQGPFGQ

SEQ ID NO: 1063694 - protein, 9 aa, Homo Sapiens
IFYRLYSLL

SEQ ID NO: 1063695 - protein, 9 aa, Homo Sapiens
SSECFMDFV

SEQ ID NO: 1063696 - protein, 9 aa, Homo Sapiens
GIHQYPGVC

SEQ ID NO: 1063697 - protein, 9 aa, Homo Sapiens
KSTSLEPVK

SEQ ID NO: 1063698 - protein, 9 aa, Homo Sapiens
ASASAFTTT

SEQ ID NO: 1063699 - protein, 9 aa, Homo Sapiens
NFFLRRAVR

SEQ ID NO: 1063700 - protein, 9 aa, Homo Sapiens
TSEIEDQSI

SEQ ID NO: 1063701 - protein, 9 aa, Homo Sapiens
LSLSGPHLE

SEQ ID NO: 1063702 - protein, 9 aa, Homo Sapiens
NGFSTNEPS

SEQ ID NO: 1063703 - protein, 9 aa, Homo Sapiens
VHAGWCCHD

SEQ ID NO: 1063704 - protein, 9 aa, Homo Sapiens
SYLLLHASR

SEQ ID NO: 1063705 - protein, 9 aa, Homo Sapiens
GSSGYISSS

SEQ ID NO: 1063706 - protein, 9 aa, Homo Sapiens
DFSCTEHNE

SEQ ID NO: 1063707 - protein, 9 aa, Homo Sapiens
RAEPFQDLR

SEQ ID NO: 1063708 - protein, 9 aa, Homo Sapiens
AGAGIKDAN

SEQ ID NO: 1063709 - protein, 9 aa, Homo Sapiens
PSLSGASGG

SEQ ID NO: 1063710 - protein, 9 aa, Homo Sapiens
KARKTEARE

SEQ ID NO: 1063711 - protein, 9 aa, Homo Sapiens
IDLIFLKEI

SEQ ID NO: 1063712 - protein, 9 aa, Homo Sapiens
ELISSLCSC

SEQ ID NO: 1063713 - protein, 9 aa, Homo Sapiens
GIPVQQSVC

SEQ ID NO: 1063714 - protein, 9 aa, Homo Sapiens
LGMKGEAGP

SEQ ID NO: 1063715 - protein, 9 aa, Homo Sapiens
CSFKDQTPL

SEQ ID NO: 1063716 - protein, 9 aa, Homo Sapiens
VVAEAGNKT

SEQ ID NO: 1063717 - protein, 9 aa, Homo Sapiens
SLGLDPYVS

SEQ ID NO: 1063718 - protein, 9 aa, Homo Sapiens
LTMWYKNLS

SEQ ID NO: 1063719 - protein, 9 aa, Homo Sapiens
GCASTRVIM

SEQ ID NO: 1063720 - protein, 9 aa, Homo Sapiens
LTSFDGVPG

SEQ ID NO: 1063721 - protein, 9 aa, Homo Sapiens
PLQPPYSPG

SEQ ID NO: 1063722 - protein, 9 aa, Homo Sapiens
LKEKLNSEV

SEQ ID NO: 1063723 - protein, 9 aa, Homo Sapiens
LPTRQSASV

SEQ ID NO: 1063724 - protein, 9 aa, Homo Sapiens
HCKKYEQLK

SEQ ID NO: 1063725 - protein, 9 aa, Homo Sapiens
FSAVPDSIP

SEQ ID NO: 1063726 - protein, 9 aa, Homo Sapiens
PFISLGISI

SEQ ID NO: 1063727 - protein, 9 aa, Homo Sapiens
EYLHKNFRV

SEQ ID NO: 1063728 - protein, 9 aa, Homo Sapiens
AATCNNPGM

SEQ ID NO: 1063729 - protein, 9 aa, Homo Sapiens
TKCVSCPQR

SEQ ID NO: 1063730 - protein, 9 aa, Homo Sapiens
SYHPGNSCF

SEQ ID NO: 1063731 - protein, 9 aa, Homo Sapiens
LEKEEDRGQ

SEQ ID NO: 1063732 - protein, 9 aa, Homo Sapiens
DNPNKTAAN

SEQ ID NO: 1063733 - protein, 9 aa, Homo Sapiens
PKKKLELQI

SEQ ID NO: 1063734 - protein, 9 aa, Homo Sapiens
MFFFVSFKG

SEQ ID NO: 1063735 - protein, 9 aa, Homo Sapiens
ENIYFRHKI

SEQ ID NO: 1063736 - protein, 9 aa, Homo Sapiens
LVFRFGPHD

SEQ ID NO: 1063737 - protein, 9 aa, Homo Sapiens
LNETVVRLY

SEQ ID NO: 1063738 - protein, 9 aa, Homo Sapiens
LELERLKPA

SEQ ID NO: 1063739 - protein, 9 aa, Homo Sapiens
DSCNAGLED

SEQ ID NO: 1063740 - protein, 9 aa, Homo Sapiens
IFVYTQPPS

SEQ ID NO: 1063741 - protein, 9 aa, Homo Sapiens
VMSNLYFYK

SEQ ID NO: 1063742 - protein, 9 aa, Homo Sapiens
LMIRQQALA

SEQ ID NO: 1063743 - protein, 9 aa, Homo Sapiens
SFLREVESA

SEQ ID NO: 1063744 - protein, 9 aa, Homo Sapiens
TNVHSPLKY

SEQ ID NO: 1063745 - protein, 9 aa, Homo Sapiens
RIINESYNL

SEQ ID NO: 1063746 - protein, 9 aa, Homo Sapiens
VVSTISKEG

SEQ ID NO: 1063747 - protein, 9 aa, Homo Sapiens
IEVVGSSMS

SEQ ID NO: 1063748 - protein, 9 aa, Homo Sapiens
PEVTTMLLG

SEQ ID NO: 1063749 - protein, 9 aa, Homo Sapiens
LQKENRRLS

SEQ ID NO: 1063750 - protein, 9 aa, Homo Sapiens
WGGAMLGIP

SEQ ID NO: 1063751 - protein, 9 aa, Homo Sapiens
ETIQVKENG

SEQ ID NO: 1063752 - protein, 9 aa, Homo Sapiens
MKLSLEELL

SEQ ID NO: 1063753 - protein, 9 aa, Homo Sapiens
AFRKQSSDE

SEQ ID NO: 1063754 - protein, 9 aa, Homo Sapiens
FRRTNCAYV

SEQ ID NO: 1063755 - protein, 9 aa, Homo Sapiens
LSETRDLEE

SEQ ID NO: 1063756 - protein, 9 aa, Homo Sapiens
FFQTRMGDA

SEQ ID NO: 1063757 - protein, 9 aa, Homo Sapiens
YAGIDTDPK

SEQ ID NO: 1063758 - protein, 9 aa, Homo Sapiens
VLTTHKRMH

SEQ ID NO: 1063759 - protein, 9 aa, Homo Sapiens
PRETSLECT

SEQ ID NO: 1063760 - protein, 9 aa, Homo Sapiens
KSPSRESVV

SEQ ID NO: 1063761 - protein, 9 aa, Homo Sapiens
EGKDVPDYA

SEQ ID NO: 1063762 - protein, 9 aa, Homo Sapiens
SSPARVTWR

SEQ ID NO: 1063763 - protein, 9 aa, Homo Sapiens
YQKEMKANY

SEQ ID NO: 1063764 - protein, 9 aa, Homo Sapiens
QNLQKRQAP

SEQ ID NO: 1063765 - protein, 9 aa, Homo Sapiens
PCPLPVLDY

SEQ ID NO: 1063766 - protein, 9 aa, Homo Sapiens
NNPLSVLKQ

SEQ ID NO: 1063767 - protein, 9 aa, Homo Sapiens
SPTIISRLR

SEQ ID NO: 1063768 - protein, 9 aa, Homo Sapiens
KVDFRDALG

SEQ ID NO: 1063769 - protein, 9 aa, Homo Sapiens
TGFPGIEKA

SEQ ID NO: 1063770 - protein, 9 aa, Homo Sapiens
SLRVESDVQ

SEQ ID NO: 1063771 - protein, 9 aa, Homo Sapiens
GYNAWLLYE

SEQ ID NO: 1063772 - protein, 9 aa, Homo Sapiens
SQERKTEAT

SEQ ID NO: 1063773 - protein, 9 aa, Homo Sapiens
PFPCIPKSQ

SEQ ID NO: 1063774 - protein, 9 aa, Homo Sapiens
FRAQAGRRR

SEQ ID NO: 1063775 - protein, 9 aa, Homo Sapiens
LIAVHPFGL

SEQ ID NO: 1063776 - protein, 9 aa, Homo Sapiens
DSAHKPENP

SEQ ID NO: 1063777 - protein, 9 aa, Homo Sapiens
PRCLTPKPS

SEQ ID NO: 1063778 - protein, 9 aa, Homo Sapiens
ELKEKLNSE

SEQ ID NO: 1063779 - protein, 9 aa, Homo Sapiens
IIKEVHGND

SEQ ID NO: 1063780 - protein, 9 aa, Homo Sapiens
LLCGIDKFR

SEQ ID NO: 1063781 - protein, 9 aa, Homo Sapiens
GGDGVCSGC

SEQ ID NO: 1063782 - protein, 9 aa, Homo Sapiens
FSSEESKIQ

SEQ ID NO: 1063783 - protein, 9 aa, Homo Sapiens
YNFYDFQFC

SEQ ID NO: 1063784 - protein, 9 aa, Homo Sapiens
GSRPRSRIS

SEQ ID NO: 1063785 - protein, 9 aa, Homo Sapiens
QMFSINGSR

SEQ ID NO: 1063786 - protein, 9 aa, Homo Sapiens
IDGPPGGST

SEQ ID NO: 1063787 - protein, 9 aa, Homo Sapiens
IYDEKMSEL

SEQ ID NO: 1063788 - protein, 9 aa, Homo Sapiens
PATPRKEGT

SEQ ID NO: 1063789 - protein, 9 aa, Homo Sapiens
EPKPTPGAA

SEQ ID NO: 1063790 - protein, 9 aa, Homo Sapiens
AILKQNFRD

SEQ ID NO: 1063791 - protein, 9 aa, Homo Sapiens
LFGVLSNLP

SEQ ID NO: 1063792 - protein, 9 aa, Homo Sapiens
TNLRRQSRS

SEQ ID NO: 1063793 - protein, 9 aa, Homo Sapiens
LIAGKFLFY

SEQ ID NO: 1063794 - protein, 9 aa, Homo Sapiens
KPAAPLFGV

SEQ ID NO: 1063795 - protein, 9 aa, Homo Sapiens
LGTTATTEL

SEQ ID NO: 1063796 - protein, 9 aa, Homo Sapiens
SVSWIKGNS

SEQ ID NO: 1063797 - protein, 9 aa, Homo Sapiens
TNYIYSLSV

SEQ ID NO: 1063798 - protein, 9 aa, Homo Sapiens
KEPINVQVE

SEQ ID NO: 1063799 - protein, 9 aa, Homo Sapiens
LDLCGQRQD

SEQ ID NO: 1063800 - protein, 9 aa, Homo Sapiens
MPAILVNIH

SEQ ID NO: 1063801 - protein, 9 aa, Homo Sapiens
RKEVDMIKE

SEQ ID NO: 1063802 - protein, 9 aa, Homo Sapiens
YKDDEEKKK

SEQ ID NO: 1063803 - protein, 9 aa, Homo Sapiens
QHPEEVRGF

SEQ ID NO: 1063804 - protein, 9 aa, Homo Sapiens
FEPYEPSPT

SEQ ID NO: 1063805 - protein, 9 aa, Homo Sapiens
FPFSITLVL

SEQ ID NO: 1063806 - protein, 9 aa, Homo Sapiens
KRYLNLGGF

SEQ ID NO: 1063807 - protein, 9 aa, Homo Sapiens
VIFTLGETR

SEQ ID NO: 1063808 - protein, 9 aa, Homo Sapiens
VPESEFSGS

SEQ ID NO: 1063809 - protein, 9 aa, Homo Sapiens
TCVKTTGIV

SEQ ID NO: 1063810 - protein, 9 aa, Homo Sapiens
YNQVLLFSE

SEQ ID NO: 1063811 - protein, 9 aa, Homo Sapiens
EEYESESGS

SEQ ID NO: 1063812 - protein, 9 aa, Homo Sapiens
PSTNLFLIK

SEQ ID NO: 1063813 - protein, 9 aa, Homo Sapiens
CIPKSQFLV

SEQ ID NO: 1063814 - protein, 9 aa, Homo Sapiens
FEMFEADLE

SEQ ID NO: 1063815 - protein, 9 aa, Homo Sapiens
IFLAGKAGD

SEQ ID NO: 1063816 - protein, 9 aa, Homo Sapiens
VWKRDQKQR

SEQ ID NO: 1063817 - protein, 9 aa, Homo Sapiens
LANNSQLQN

SEQ ID NO: 1063818 - protein, 9 aa, Homo Sapiens
TDPGKKFLG

SEQ ID NO: 1063819 - protein, 9 aa, Homo Sapiens
VNLAPASPR

SEQ ID NO: 1063820 - protein, 9 aa, Homo Sapiens
FSLFSTFPL

SEQ ID NO: 1063821 - protein, 9 aa, Homo Sapiens
QLHLNLKKE

SEQ ID NO: 1063822 - protein, 9 aa, Homo Sapiens
LFWAVVFLL

SEQ ID NO: 1063823 - protein, 9 aa, Homo Sapiens
FLVLSIVVL

SEQ ID NO: 1063824 - protein, 9 aa, Homo Sapiens
LAGEIIEVK

SEQ ID NO: 1063825 - protein, 9 aa, Homo Sapiens
PKLRRRGLP

SEQ ID NO: 1063826 - protein, 9 aa, Homo Sapiens
FFAGCTAQH

SEQ ID NO: 1063827 - protein, 9 aa, Homo Sapiens
QGFPSSSPS

SEQ ID NO: 1063828 - protein, 9 aa, Homo Sapiens
SSADSLSMS

SEQ ID NO: 1063829 - protein, 9 aa, Homo Sapiens
RQAIQLSIK

SEQ ID NO: 1063830 - protein, 9 aa, Homo Sapiens
EMHREFMGS

SEQ ID NO: 1063831 - protein, 9 aa, Homo Sapiens
FFIRHLRSH

SEQ ID NO: 1063832 - protein, 9 aa, Homo Sapiens
IYIFLNGNC

SEQ ID NO: 1063833 - protein, 9 aa, Homo Sapiens
NASCTVNLG

SEQ ID NO: 1063834 - protein, 9 aa, Homo Sapiens
SVLEDNEDS

SEQ ID NO: 1063835 - protein, 9 aa, Homo Sapiens
VFQASKHIK

SEQ ID NO: 1063836 - protein, 9 aa, Homo Sapiens
YLNNSYVRK

SEQ ID NO: 1063837 - protein, 9 aa, Homo Sapiens
QKVANFYCD

SEQ ID NO: 1063838 - protein, 9 aa, Homo Sapiens
QSEMNLQIC

SEQ ID NO: 1063839 - protein, 9 aa, Homo Sapiens
KTIGKGYFA

SEQ ID NO: 1063840 - protein, 9 aa, Homo Sapiens
RAGVSGLAS

SEQ ID NO: 1063841 - protein, 9 aa, Homo Sapiens
HLAVEWGLQ

SEQ ID NO: 1063842 - protein, 9 aa, Homo Sapiens
EAFRNLVSV

SEQ ID NO: 1063843 - protein, 9 aa, Homo Sapiens
AASPSGMLT

SEQ ID NO: 1063844 - protein, 9 aa, Homo Sapiens
EGDMVWWPV

SEQ ID NO: 1063845 - protein, 9 aa, Homo Sapiens
STSLISGES

SEQ ID NO: 1063846 - protein, 9 aa, Homo Sapiens
LFLFAHKLH

SEQ ID NO: 1063847 - protein, 9 aa, Homo Sapiens
VHKTRNHLR

SEQ ID NO: 1063848 - protein, 9 aa, Homo Sapiens
GGEGKTGGF

SEQ ID NO: 1063849 - protein, 9 aa, Homo Sapiens
DCLQDPGEG

SEQ ID NO: 1063850 - protein, 9 aa, Homo Sapiens
GFYSCGCIA

SEQ ID NO: 1063851 - protein, 9 aa, Homo Sapiens
MVLSFMQHF

SEQ ID NO: 1063852 - protein, 9 aa, Homo Sapiens
LKAELEARQ

SEQ ID NO: 1063853 - protein, 9 aa, Homo Sapiens
PRKPAQPPR

SEQ ID NO: 1063854 - protein, 9 aa, Homo Sapiens
IELNQQLND

SEQ ID NO: 1063855 - protein, 9 aa, Homo Sapiens
QMAELRKPT

SEQ ID NO: 1063856 - protein, 9 aa, Homo Sapiens
LDVRAWLEG

SEQ ID NO: 1063857 - protein, 9 aa, Homo Sapiens
EGGGAAGGA

SEQ ID NO: 1063858 - protein, 9 aa, Homo Sapiens
MKHHTLPEV

SEQ ID NO: 1063859 - protein, 9 aa, Homo Sapiens
CKVLDANSC

SEQ ID NO: 1063860 - protein, 9 aa, Homo Sapiens
AASRQNSGE

SEQ ID NO: 1063861 - protein, 9 aa, Homo Sapiens
AGDTHNSYA

SEQ ID NO: 1063862 - protein, 9 aa, Homo Sapiens
LCNHPSWIF

SEQ ID NO: 1063863 - protein, 9 aa, Homo Sapiens
VDEAKSLCK

SEQ ID NO: 1063864 - protein, 9 aa, Homo Sapiens
VIPDEKFDP

SEQ ID NO: 1063865 - protein, 9 aa, Homo Sapiens
RMTSIICGF

SEQ ID NO: 1063866 - protein, 9 aa, Homo Sapiens
PNASDSESS

SEQ ID NO: 1063867 - protein, 9 aa, Homo Sapiens
DLTEIILLL

SEQ ID NO: 1063868 - protein, 9 aa, Homo Sapiens
LRVEKFLHQ

SEQ ID NO: 1063869 - protein, 9 aa, Homo Sapiens
VYNYYETDE

SEQ ID NO: 1063870 - protein, 9 aa, Homo Sapiens
KWDISGIFV

SEQ ID NO: 1063871 - protein, 9 aa, Homo Sapiens
ITKRKKMSL

SEQ ID NO: 1063872 - protein, 9 aa, Homo Sapiens
FYDLDALNK

SEQ ID NO: 1063873 - protein, 9 aa, Homo Sapiens
KSDNECKKS

SEQ ID NO: 1063874 - protein, 9 aa, Homo Sapiens
PIIYTLKNA

SEQ ID NO: 1063875 - protein, 9 aa, Homo Sapiens
SIERYDSHQ

SEQ ID NO: 1063876 - protein, 9 aa, Homo Sapiens
PIIYTLKNK

SEQ ID NO: 1063877 - protein, 9 aa, Homo Sapiens
LLGYPKTKA

SEQ ID NO: 1063878 - protein, 9 aa, Homo Sapiens
PGRELFYNQ

SEQ ID NO: 1063879 - protein, 9 aa, Homo Sapiens
QPLYSLPPA

SEQ ID NO: 1063880 - protein, 9 aa, Homo Sapiens
VVKIQKNTW

SEQ ID NO: 1063881 - protein, 9 aa, Homo Sapiens
HPNVFSLLG

SEQ ID NO: 1063882 - protein, 9 aa, Homo Sapiens
ELKIRNPAI

SEQ ID NO: 1063883 - protein, 9 aa, Homo Sapiens
GFQDCFFRN

SEQ ID NO: 1063884 - protein, 9 aa, Homo Sapiens
HQYPGVCYP

SEQ ID NO: 1063885 - protein, 9 aa, Homo Sapiens
AKDTQGQTN

SEQ ID NO: 1063886 - protein, 9 aa, Homo Sapiens
VPLYDQNHV

SEQ ID NO: 1063887 - protein, 9 aa, Homo Sapiens
HMFLLAQSH

SEQ ID NO: 1063888 - protein, 9 aa, Homo Sapiens
YTQIVSSVM

SEQ ID NO: 1063889 - protein, 9 aa, Homo Sapiens
ASDEPHEVL

SEQ ID NO: 1063890 - protein, 9 aa, Homo Sapiens
LFLLDGYNK

SEQ ID NO: 1063891 - protein, 9 aa, Homo Sapiens
PPTASPLPA

SEQ ID NO: 1063892 - protein, 9 aa, Homo Sapiens
LNGKNWEYI

SEQ ID NO: 1063893 - protein, 9 aa, Homo Sapiens
EIVSEPLED

SEQ ID NO: 1063894 - protein, 9 aa, Homo Sapiens
PELRGHFPF

SEQ ID NO: 1063895 - protein, 9 aa, Homo Sapiens
YVDVFRDLA

SEQ ID NO: 1063896 - protein, 9 aa, Homo Sapiens
VMNENDNVP

SEQ ID NO: 1063897 - protein, 9 aa, Homo Sapiens
QKLSCLGEN

SEQ ID NO: 1063898 - protein, 9 aa, Homo Sapiens
TLGFFFSDR

SEQ ID NO: 1063899 - protein, 9 aa, Homo Sapiens
LTGFPGIEK

SEQ ID NO: 1063900 - protein, 9 aa, Homo Sapiens
NGECFCADH

SEQ ID NO: 1063901 - protein, 9 aa, Homo Sapiens
KKRKGSKGC

SEQ ID NO: 1063902 - protein, 9 aa, Homo Sapiens
GGINFNECE

SEQ ID NO: 1063903 - protein, 9 aa, Homo Sapiens
FMDFVCPEK

SEQ ID NO: 1063904 - protein, 9 aa, Homo Sapiens
NPKASFENC

SEQ ID NO: 1063905 - protein, 9 aa, Homo Sapiens
KEGDEEIKF

SEQ ID NO: 1063906 - protein, 9 aa, Homo Sapiens
PELLGLTKK

SEQ ID NO: 1063907 - protein, 9 aa, Homo Sapiens
QKDDYCEAG

SEQ ID NO: 1063908 - protein, 9 aa, Homo Sapiens
GPRNVVYSI

SEQ ID NO: 1063909 - protein, 9 aa, Homo Sapiens
FLYSEKDEP

SEQ ID NO: 1063910 - protein, 9 aa, Homo Sapiens
EHSSAFYFT

SEQ ID NO: 1063911 - protein, 9 aa, Homo Sapiens
WAPFLLSTC

SEQ ID NO: 1063912 - protein, 9 aa, Homo Sapiens
SSRIKKVFY

SEQ ID NO: 1063913 - protein, 9 aa, Homo Sapiens
DCHFLPNKV

SEQ ID NO: 1063914 - protein, 9 aa, Homo Sapiens
YMTWVQPRV

SEQ ID NO: 1063915 - protein, 9 aa, Homo Sapiens
FWKHLVYKM

SEQ ID NO: 1063916 - protein, 9 aa, Homo Sapiens
FPPSSLVDS

SEQ ID NO: 1063917 - protein, 9 aa, Homo Sapiens
QVRNTVQEN

SEQ ID NO: 1063918 - protein, 9 aa, Homo Sapiens
LQKFISEIT

SEQ ID NO: 1063919 - protein, 9 aa, Homo Sapiens
GHNGLDEQP

SEQ ID NO: 1063920 - protein, 9 aa, Homo Sapiens
MLCGIGETP

SEQ ID NO: 1063921 - protein, 9 aa, Homo Sapiens
QGPKGSTRF

SEQ ID NO: 1063922 - protein, 9 aa, Homo Sapiens
DGTVSTILG

SEQ ID NO: 1063923 - protein, 9 aa, Homo Sapiens
TLSQGTLQW

SEQ ID NO: 1063924 - protein, 9 aa, Homo Sapiens
GRLCAKSPI

SEQ ID NO: 1063925 - protein, 9 aa, Homo Sapiens
LDDLFFHTL

SEQ ID NO: 1063926 - protein, 9 aa, Homo Sapiens
GDIPPEIVS

SEQ ID NO: 1063927 - protein, 9 aa, Homo Sapiens
DGPNDVSSQ

SEQ ID NO: 1063928 - protein, 9 aa, Homo Sapiens
HGLQMLKSF

SEQ ID NO: 1063929 - protein, 9 aa, Homo Sapiens
LPLLEMPEK

SEQ ID NO: 1063930 - protein, 9 aa, Homo Sapiens
IHTGEKLYV

SEQ ID NO: 1063931 - protein, 9 aa, Homo Sapiens
GCSSHPEDN

SEQ ID NO: 1063932 - protein, 9 aa, Homo Sapiens
LHQVRTETK

SEQ ID NO: 1063933 - protein, 9 aa, Homo Sapiens
LKELRDQRL

SEQ ID NO: 1063934 - protein, 9 aa, Homo Sapiens
GILWFEARK

SEQ ID NO: 1063935 - protein, 9 aa, Homo Sapiens
TYRELRLFK

SEQ ID NO: 1063936 - protein, 9 aa, Homo Sapiens
CFCADHLLK

SEQ ID NO: 1063937 - protein, 9 aa, Homo Sapiens
VSREQRFYK

SEQ ID NO: 1063938 - protein, 9 aa, Homo Sapiens
IGLSDFFYP

SEQ ID NO: 1063939 - protein, 9 aa, Homo Sapiens
SMYGNFEEA

SEQ ID NO: 1063940 - protein, 9 aa, Homo Sapiens
LREVVSIKK

SEQ ID NO: 1063941 - protein, 9 aa, Homo Sapiens
EYKAMAPAY

SEQ ID NO: 1063942 - protein, 9 aa, Homo Sapiens
KTKERVGKE

SEQ ID NO: 1063943 - protein, 9 aa, Homo Sapiens
NVKKLGKWV

SEQ ID NO: 1063944 - protein, 9 aa, Homo Sapiens
DCDNFQNRG

SEQ ID NO: 1063945 - protein, 9 aa, Homo Sapiens
ECFFLAFMA

SEQ ID NO: 1063946 - protein, 9 aa, Homo Sapiens
ASQCPIAGN

SEQ ID NO: 1063947 - protein, 9 aa, Homo Sapiens
KCNLYLLEE

SEQ ID NO: 1063948 - protein, 9 aa, Homo Sapiens
VNWWAFGVL

SEQ ID NO: 1063949 - protein, 9 aa, Homo Sapiens
PLSTPAAPK

SEQ ID NO: 1063950 - protein, 9 aa, Homo Sapiens
DQNHVTGAS

SEQ ID NO: 1063951 - protein, 9 aa, Homo Sapiens
HAHCRVRGG

SEQ ID NO: 1063952 - protein, 9 aa, Homo Sapiens
SHLHTLMYF

SEQ ID NO: 1063953 - protein, 9 aa, Homo Sapiens
VSIEGMIVL

SEQ ID NO: 1063954 - protein, 9 aa, Homo Sapiens
DDMTDCLSF

SEQ ID NO: 1063955 - protein, 9 aa, Homo Sapiens
KVFCHTAGL

SEQ ID NO: 1063956 - protein, 9 aa, Homo Sapiens
SPKDSPAHK

SEQ ID NO: 1063957 - protein, 9 aa, Homo Sapiens
NHFFCDISL

SEQ ID NO: 1063958 - protein, 9 aa, Homo Sapiens
NKLYALNDR

SEQ ID NO: 1063959 - protein, 9 aa, Homo Sapiens
KCLPKCPPK

SEQ ID NO: 1063960 - protein, 9 aa, Homo Sapiens
SESWPYSLT

SEQ ID NO: 1063961 - protein, 9 aa, Homo Sapiens
IINIAELRF

SEQ ID NO: 1063962 - protein, 9 aa, Homo Sapiens
ILPLGIFYI

SEQ ID NO: 1063963 - protein, 9 aa, Homo Sapiens
KAHAHCRVR

SEQ ID NO: 1063964 - protein, 9 aa, Homo Sapiens
VHMQRGILF

SEQ ID NO: 1063965 - protein, 9 aa, Homo Sapiens
EPQKGIQAE

SEQ ID NO: 1063966 - protein, 9 aa, Homo Sapiens
KCLPKCPPV

SEQ ID NO: 1063967 - protein, 9 aa, Homo Sapiens
HLLQQMDIL

SEQ ID NO: 1063968 - protein, 9 aa, Homo Sapiens
SCLPSQGEA

SEQ ID NO: 1063969 - protein, 9 aa, Homo Sapiens
PYFSSETFN

SEQ ID NO: 1063970 - protein, 9 aa, Homo Sapiens
NPCSFKDQT

SEQ ID NO: 1063971 - protein, 9 aa, Homo Sapiens
LQREKDALH

SEQ ID NO: 1063972 - protein, 9 aa, Homo Sapiens
LCKPGYKGK

SEQ ID NO: 1063973 - protein, 9 aa, Homo Sapiens
QRLSPASSV

SEQ ID NO: 1063974 - protein, 9 aa, Homo Sapiens
LDEPGVVSD

SEQ ID NO: 1063975 - protein, 9 aa, Homo Sapiens
FSQNSNTLT

SEQ ID NO: 1063976 - protein, 9 aa, Homo Sapiens
RASPALSTS

SEQ ID NO: 1063977 - protein, 9 aa, Homo Sapiens
SFMLILKGV

SEQ ID NO: 1063978 - protein, 9 aa, Homo Sapiens
FYTHILLTV

SEQ ID NO: 1063979 - protein, 9 aa, Homo Sapiens
PEVVQRLSP

SEQ ID NO: 1063980 - protein, 9 aa, Homo Sapiens
KVVYLVSQG

SEQ ID NO: 1063981 - protein, 9 aa, Homo Sapiens
YYVGMCGDR

SEQ ID NO: 1063982 - protein, 9 aa, Homo Sapiens
WSHCSEPLK

SEQ ID NO: 1063983 - protein, 9 aa, Homo Sapiens
LFDHLFFHY

SEQ ID NO: 1063984 - protein, 9 aa, Homo Sapiens
FCEGCKGFF

SEQ ID NO: 1063985 - protein, 9 aa, Homo Sapiens
SSSLAGPSS

SEQ ID NO: 1063986 - protein, 9 aa, Homo Sapiens
DHWNKMLAY

SEQ ID NO: 1063987 - protein, 9 aa, Homo Sapiens
EEKCCRKNC

SEQ ID NO: 1063988 - protein, 9 aa, Homo Sapiens
PRTSTNFLP

SEQ ID NO: 1063989 - protein, 9 aa, Homo Sapiens
AVPAAVPDD

SEQ ID NO: 1063990 - protein, 9 aa, Homo Sapiens
YFLQYSIQT

SEQ ID NO: 1063991 - protein, 9 aa, Homo Sapiens
QEDLDGNGR

SEQ ID NO: 1063992 - protein, 9 aa, Homo Sapiens
WLCLLKVLQ

SEQ ID NO: 1063993 - protein, 9 aa, Homo Sapiens
CKIDVTYFS

SEQ ID NO: 1063994 - protein, 9 aa, Homo Sapiens
CHCRRSCYL

SEQ ID NO: 1063995 - protein, 9 aa, Homo Sapiens
KCCPNVCET

SEQ ID NO: 1063996 - protein, 9 aa, Homo Sapiens
EIEDQSIMG

SEQ ID NO: 1063997 - protein, 9 aa, Homo Sapiens
PGFSGLSMD

SEQ ID NO: 1063998 - protein, 9 aa, Homo Sapiens
RIIYCNSNS

SEQ ID NO: 1063999 - protein, 9 aa, Homo Sapiens
WLRQIEEIY

SEQ ID NO: 1064000 - protein, 9 aa, Homo Sapiens
FSPLKIWDL

SEQ ID NO: 1064001 - protein, 9 aa, Homo Sapiens
ACPETRAQP

SEQ ID NO: 1064002 - protein, 9 aa, Homo Sapiens
YSYYPYLYC

SEQ ID NO: 1064003 - protein, 9 aa, Homo Sapiens
KFKPSPCEW

SEQ ID NO: 1064004 - protein, 9 aa, Homo Sapiens
IFMKNHFCK

SEQ ID NO: 1064005 - protein, 9 aa, Homo Sapiens
LRVKQTCQK

SEQ ID NO: 1064006 - protein, 9 aa, Homo Sapiens
SFTGCEIQS

SEQ ID NO: 1064007 - protein, 9 aa, Homo Sapiens
REKIVLNFT

SEQ ID NO: 1064008 - protein, 9 aa, Homo Sapiens
GMYQCGPAS

SEQ ID NO: 1064009 - protein, 9 aa, Homo Sapiens
EEAFRAQAG

SEQ ID NO: 1064010 - protein, 9 aa, Homo Sapiens
KKVFYNIGT

SEQ ID NO: 1064011 - protein, 9 aa, Homo Sapiens
KGWGAQALM

SEQ ID NO: 1064012 - protein, 9 aa, Homo Sapiens
EVPEESPFS

SEQ ID NO: 1064013 - protein, 9 aa, Homo Sapiens
REAQAFLRE

SEQ ID NO: 1064014 - protein, 9 aa, Homo Sapiens
MIIKGCEIL

SEQ ID NO: 1064015 - protein, 9 aa, Homo Sapiens
QVISSDTRS

SEQ ID NO: 1064016 - protein, 9 aa, Homo Sapiens
TWRSEGKKG

SEQ ID NO: 1064017 - protein, 9 aa, Homo Sapiens
DEKMSELSN

SEQ ID NO: 1064018 - protein, 9 aa, Homo Sapiens
SPGCRKISV

SEQ ID NO: 1064019 - protein, 9 aa, Homo Sapiens
KAAAPREGQ

SEQ ID NO: 1064020 - protein, 9 aa, Homo Sapiens
EEDKGLDSA

SEQ ID NO: 1064021 - protein, 9 aa, Homo Sapiens
EALLQVCCA

SEQ ID NO: 1064022 - protein, 9 aa, Homo Sapiens
VIIFVSHLH

SEQ ID NO: 1064023 - protein, 9 aa, Homo Sapiens
CPFDPQQLF

SEQ ID NO: 1064024 - protein, 9 aa, Homo Sapiens
CPNYPVIQW

SEQ ID NO: 1064025 - protein, 9 aa, Homo Sapiens
SIELNQQLN

SEQ ID NO: 1064026 - protein, 9 aa, Homo Sapiens
NLCSNSEDK

SEQ ID NO: 1064027 - protein, 9 aa, Homo Sapiens
LVCEEVIDF

SEQ ID NO: 1064028 - protein, 9 aa, Homo Sapiens
HKTLRKITD

SEQ ID NO: 1064029 - protein, 9 aa, Homo Sapiens
KLRYREDRL

SEQ ID NO: 1064030 - protein, 9 aa, Homo Sapiens
RPSSRSAVL

SEQ ID NO: 1064031 - protein, 9 aa, Homo Sapiens
NLKDFFRAY

SEQ ID NO: 1064032 - protein, 9 aa, Homo Sapiens
QKARLVDVD

SEQ ID NO: 1064033 - protein, 9 aa, Homo Sapiens
SLKNMDMNP

SEQ ID NO: 1064034 - protein, 9 aa, Homo Sapiens
FSSRDFQVT

SEQ ID NO: 1064035 - protein, 9 aa, Homo Sapiens
PRMNESSGL

SEQ ID NO: 1064036 - protein, 9 aa, Homo Sapiens
NCITRPPPS

SEQ ID NO: 1064037 - protein, 9 aa, Homo Sapiens
RRYSCAVVN

SEQ ID NO: 1064038 - protein, 9 aa, Homo Sapiens
ADVEERFYL

SEQ ID NO: 1064039 - protein, 9 aa, Homo Sapiens
RGILFVYDN

SEQ ID NO: 1064040 - protein, 9 aa, Homo Sapiens
LHSDVSSQK

SEQ ID NO: 1064041 - protein, 9 aa, Homo Sapiens
CNDENSCEG

SEQ ID NO: 1064042 - protein, 9 aa, Homo Sapiens
LIARGSLRA

SEQ ID NO: 1064043 - protein, 9 aa, Homo Sapiens
GTRSYMASE

SEQ ID NO: 1064044 - protein, 9 aa, Homo Sapiens
GFPESKGEP

SEQ ID NO: 1064045 - protein, 9 aa, Homo Sapiens
LHKKEAKDD

SEQ ID NO: 1064046 - protein, 9 aa, Homo Sapiens
LELVKRLEK

SEQ ID NO: 1064047 - protein, 9 aa, Homo Sapiens
CNNGEILYS

SEQ ID NO: 1064048 - protein, 9 aa, Homo Sapiens
DKLWRIHCL

SEQ ID NO: 1064049 - protein, 9 aa, Homo Sapiens
WNKMLAYPR

SEQ ID NO: 1064050 - protein, 9 aa, Homo Sapiens
HLESGWEEV

SEQ ID NO: 1064051 - protein, 9 aa, Homo Sapiens
AGDGKKHSI

SEQ ID NO: 1064052 - protein, 9 aa, Homo Sapiens
LGKDDMEFG

SEQ ID NO: 1064053 - protein, 9 aa, Homo Sapiens
KMIEEEVEA

SEQ ID NO: 1064054 - protein, 9 aa, Homo Sapiens
SVTPREKIV

SEQ ID NO: 1064055 - protein, 9 aa, Homo Sapiens
ISVQKLMGC

SEQ ID NO: 1064056 - protein, 9 aa, Homo Sapiens
KGTRTLLFA

SEQ ID NO: 1064057 - protein, 9 aa, Homo Sapiens
KKKYMLPLD

SEQ ID NO: 1064058 - protein, 9 aa, Homo Sapiens
TYQRTLLEF

SEQ ID NO: 1064059 - protein, 9 aa, Homo Sapiens
KFFQRCGHL

SEQ ID NO: 1064060 - protein, 9 aa, Homo Sapiens
DIMVYFKQH

SEQ ID NO: 1064061 - protein, 9 aa, Homo Sapiens
LSDYTALLV

SEQ ID NO: 1064062 - protein, 9 aa, Homo Sapiens
QPSSGPGQA

SEQ ID NO: 1064063 - protein, 9 aa, Homo Sapiens
FFLHDSVYF

SEQ ID NO: 1064064 - protein, 9 aa, Homo Sapiens
CRKVNTHIH

SEQ ID NO: 1064065 - protein, 9 aa, Homo Sapiens
LLVSVTSNP

SEQ ID NO: 1064066 - protein, 9 aa, Homo Sapiens
NEKQTSSLP

SEQ ID NO: 1064067 - protein, 9 aa, Homo Sapiens
QVKENGYVQ

SEQ ID NO: 1064068 - protein, 9 aa, Homo Sapiens
RLLCSSFQE

SEQ ID NO: 1064069 - protein, 9 aa, Homo Sapiens
DALYAAFLP

SEQ ID NO: 1064070 - protein, 9 aa, Homo Sapiens
LRFDELKIR

SEQ ID NO: 1064071 - protein, 9 aa, Homo Sapiens
AASGKELAV

SEQ ID NO: 1064072 - protein, 9 aa, Homo Sapiens
IFLVRLPFI

SEQ ID NO: 1064073 - protein, 9 aa, Homo Sapiens
PHVVSQWSR

SEQ ID NO: 1064074 - protein, 9 aa, Homo Sapiens
LENGSSGFR

SEQ ID NO: 1064075 - protein, 9 aa, Homo Sapiens
LVLSKLEGH

SEQ ID NO: 1064076 - protein, 9 aa, Homo Sapiens
QRYVPLEDQ

SEQ ID NO: 1064077 - protein, 9 aa, Homo Sapiens
HGYCTLGEV

SEQ ID NO: 1064078 - protein, 9 aa, Homo Sapiens
INLWRGRRC

SEQ ID NO: 1064079 - protein, 9 aa, Homo Sapiens
ESSWYDFPW

SEQ ID NO: 1064080 - protein, 9 aa, Homo Sapiens
SRPEACSDA

SEQ ID NO: 1064081 - protein, 9 aa, Homo Sapiens
ALVLYYVTG

SEQ ID NO: 1064082 - protein, 9 aa, Homo Sapiens
PPMVVDNLF

SEQ ID NO: 1064083 - protein, 9 aa, Homo Sapiens
QVKEEPLNS

SEQ ID NO: 1064084 - protein, 9 aa, Homo Sapiens
FTKKLRNSY

SEQ ID NO: 1064085 - protein, 9 aa, Homo Sapiens
SMQILGMSP

SEQ ID NO: 1064086 - protein, 9 aa, Homo Sapiens
LLKLKKKAS

SEQ ID NO: 1064087 - protein, 9 aa, Homo Sapiens
DSEKGKAPQ

SEQ ID NO: 1064088 - protein, 9 aa, Homo Sapiens
DAVQSLPPK

SEQ ID NO: 1064089 - protein, 9 aa, Homo Sapiens
DVKSASKRP

SEQ ID NO: 1064090 - protein, 9 aa, Homo Sapiens
KNMELSFKV

SEQ ID NO: 1064091 - protein, 9 aa, Homo Sapiens
MQPNSNLNV

SEQ ID NO: 1064092 - protein, 9 aa, Homo Sapiens
LFLFFIAIS

SEQ ID NO: 1064093 - protein, 9 aa, Homo Sapiens
RTPGEKNRA

SEQ ID NO: 1064094 - protein, 9 aa, Homo Sapiens
WIKGNSPLR

SEQ ID NO: 1064095 - protein, 9 aa, Homo Sapiens
ITPPSYVVD

SEQ ID NO: 1064096 - protein, 9 aa, Homo Sapiens
ELFDRIINE

SEQ ID NO: 1064097 - protein, 9 aa, Homo Sapiens
LKKKLDFKK

SEQ ID NO: 1064098 - protein, 9 aa, Homo Sapiens
SKKPEVPPT

SEQ ID NO: 1064099 - protein, 9 aa, Homo Sapiens
KKPGESLRI

SEQ ID NO: 1064100 - protein, 9 aa, Homo Sapiens
EDFIVKPDI

SEQ ID NO: 1064101 - protein, 9 aa, Homo Sapiens
KGISEQEEK

SEQ ID NO: 1064102 - protein, 9 aa, Homo Sapiens
DFLRQIVAA

SEQ ID NO: 1064103 - protein, 9 aa, Homo Sapiens
LPSLGPHYG

SEQ ID NO: 1064104 - protein, 9 aa, Homo Sapiens
RTLLMSVCL

SEQ ID NO: 1064105 - protein, 9 aa, Homo Sapiens
IADRLWPDS

SEQ ID NO: 1064106 - protein, 9 aa, Homo Sapiens
YLFGNFPKP

SEQ ID NO: 1064107 - protein, 9 aa, Homo Sapiens
LPLLANNSQ

SEQ ID NO: 1064108 - protein, 9 aa, Homo Sapiens
MKSSQYISM

SEQ ID NO: 1064109 - protein, 9 aa, Homo Sapiens
PLPADGLER

SEQ ID NO: 1064110 - protein, 9 aa, Homo Sapiens
VSFSTADPQ

SEQ ID NO: 1064111 - protein, 9 aa, Homo Sapiens
RNQKKEKLK

SEQ ID NO: 1064112 - protein, 9 aa, Homo Sapiens
DSPDSFSFL

SEQ ID NO: 1064113 - protein, 9 aa, Homo Sapiens
KKLDFKKIK

SEQ ID NO: 1064114 - protein, 9 aa, Homo Sapiens
FLCFSESIP

SEQ ID NO: 1064115 - protein, 9 aa, Homo Sapiens
AKLSCENIR

SEQ ID NO: 1064116 - protein, 9 aa, Homo Sapiens
SKEVHLAQL

SEQ ID NO: 1064117 - protein, 9 aa, Homo Sapiens
GFCYKIAVR

SEQ ID NO: 1064118 - protein, 9 aa, Homo Sapiens
LTILVRNIM

SEQ ID NO: 1064119 - protein, 9 aa, Homo Sapiens
PLYYPNVMN

SEQ ID NO: 1064120 - protein, 9 aa, Homo Sapiens
CPSCNGQVD

SEQ ID NO: 1064121 - protein, 9 aa, Homo Sapiens
TRLAELLAL

SEQ ID NO: 1064122 - protein, 9 aa, Homo Sapiens
SSDERSPSA

SEQ ID NO: 1064123 - protein, 9 aa, Homo Sapiens
SMAHHFRDA

SEQ ID NO: 1064124 - protein, 9 aa, Homo Sapiens
GIGKELSTP

SEQ ID NO: 1064125 - protein, 9 aa, Homo Sapiens
DAGRESKFN

SEQ ID NO: 1064126 - protein, 9 aa, Homo Sapiens
VPRPCLYSA

SEQ ID NO: 1064127 - protein, 9 aa, Homo Sapiens
LGVAPALPA

SEQ ID NO: 1064128 - protein, 9 aa, Homo Sapiens
PAPRMGRKK

SEQ ID NO: 1064129 - protein, 9 aa, Homo Sapiens
DSPRNFNIA

SEQ ID NO: 1064130 - protein, 9 aa, Homo Sapiens
SKISSILEK

SEQ ID NO: 1064131 - protein, 9 aa, Homo Sapiens
QTAAEVSKK

SEQ ID NO: 1064132 - protein, 9 aa, Homo Sapiens
QQCQQKYSP

SEQ ID NO: 1064133 - protein, 9 aa, Homo Sapiens
GALNHFSSR

SEQ ID NO: 1064134 - protein, 9 aa, Homo Sapiens
VQKHTDQIW

SEQ ID NO: 1064135 - protein, 9 aa, Homo Sapiens
YFLLPPLIN

SEQ ID NO: 1064136 - protein, 9 aa, Homo Sapiens
VLDSMLQEG

SEQ ID NO: 1064137 - protein, 9 aa, Homo Sapiens
RRQSRSFTC

SEQ ID NO: 1064138 - protein, 9 aa, Homo Sapiens
RVTWREDLT

SEQ ID NO: 1064139 - protein, 9 aa, Homo Sapiens
IEYLHKNFR

SEQ ID NO: 1064140 - protein, 9 aa, Homo Sapiens
KEIQSFNLE

SEQ ID NO: 1064141 - protein, 9 aa, Homo Sapiens
SVVLQLLNP

SEQ ID NO: 1064142 - protein, 9 aa, Homo Sapiens
KNSEKVYSC

SEQ ID NO: 1064143 - protein, 9 aa, Homo Sapiens
DENHCPLSA

SEQ ID NO: 1064144 - protein, 9 aa, Homo Sapiens
DKNGNQKLH

SEQ ID NO: 1064145 - protein, 9 aa, Homo Sapiens
DTFMFEGHN

SEQ ID NO: 1064146 - protein, 9 aa, Homo Sapiens
FRLLNPHSK

SEQ ID NO: 1064147 - protein, 9 aa, Homo Sapiens
STIKEEDTD

SEQ ID NO: 1064148 - protein, 9 aa, Homo Sapiens
ATSHPNSDS

SEQ ID NO: 1064149 - protein, 9 aa, Homo Sapiens
IMMNYVYKE

SEQ ID NO: 1064150 - protein, 9 aa, Homo Sapiens
QLKLDRPSM

SEQ ID NO: 1064151 - protein, 9 aa, Homo Sapiens
EELKKPEEE

SEQ ID NO: 1064152 - protein, 9 aa, Homo Sapiens
NLWRGRRCC

SEQ ID NO: 1064153 - protein, 9 aa, Homo Sapiens
LGRSCHRNC

SEQ ID NO: 1064154 - protein, 9 aa, Homo Sapiens
LFATCVFVL

SEQ ID NO: 1064155 - protein, 9 aa, Homo Sapiens
RNMFLENLV

SEQ ID NO: 1064156 - protein, 9 aa, Homo Sapiens
VVAFYAAIL

SEQ ID NO: 1064157 - protein, 9 aa, Homo Sapiens
GGSASINQI

SEQ ID NO: 1064158 - protein, 9 aa, Homo Sapiens
AFCSNRNFI

SEQ ID NO: 1064159 - protein, 9 aa, Homo Sapiens
EAKPSTASS

SEQ ID NO: 1064160 - protein, 9 aa, Homo Sapiens
TGEIFSVAL

SEQ ID NO: 1064161 - protein, 9 aa, Homo Sapiens
LDGYNKFKP

SEQ ID NO: 1064162 - protein, 9 aa, Homo Sapiens
LTQLQLEVE

SEQ ID NO: 1064163 - protein, 9 aa, Homo Sapiens
FKGRSGLGL

SEQ ID NO: 1064164 - protein, 9 aa, Homo Sapiens
ASYKLYWRN

SEQ ID NO: 1064165 - protein, 9 aa, Homo Sapiens
WRSTPDSVC

SEQ ID NO: 1064166 - protein, 9 aa, Homo Sapiens
PRFQASSFS

SEQ ID NO: 1064167 - protein, 9 aa, Homo Sapiens
PETAGESLD

SEQ ID NO: 1064168 - protein, 9 aa, Homo Sapiens
AVGGRNKLR

SEQ ID NO: 1064169 - protein, 9 aa, Homo Sapiens
SGPGNNVEP

SEQ ID NO: 1064170 - protein, 9 aa, Homo Sapiens
FLAKVVLLC

SEQ ID NO: 1064171 - protein, 9 aa, Homo Sapiens
STAASSLGP

SEQ ID NO: 1064172 - protein, 9 aa, Homo Sapiens
FFGGSASIN

SEQ ID NO: 1064173 - protein, 9 aa, Homo Sapiens
CKIVRRTIF

SEQ ID NO: 1064174 - protein, 9 aa, Homo Sapiens
LLEKDYFRL

SEQ ID NO: 1064175 - protein, 9 aa, Homo Sapiens
VSFFWYQQA

SEQ ID NO: 1064176 - protein, 9 aa, Homo Sapiens
LPVDKFLFV

SEQ ID NO: 1064177 - protein, 9 aa, Homo Sapiens
IYSGIKPFQ

SEQ ID NO: 1064178 - protein, 9 aa, Homo Sapiens
NYLNKVLPY

SEQ ID NO: 1064179 - protein, 9 aa, Homo Sapiens
PKVSSSQLN

SEQ ID NO: 1064180 - protein, 9 aa, Homo Sapiens
SHFCCVHRG

SEQ ID NO: 1064181 - protein, 9 aa, Homo Sapiens
MGHKFFQRC

SEQ ID NO: 1064182 - protein, 9 aa, Homo Sapiens
GSFSGQAQL

SEQ ID NO: 1064183 - protein, 9 aa, Homo Sapiens
GMCLELERL

SEQ ID NO: 1064184 - protein, 9 aa, Homo Sapiens
LPITEYLAS

SEQ ID NO: 1064185 - protein, 9 aa, Homo Sapiens
PIQAVEIKV

SEQ ID NO: 1064186 - protein, 9 aa, Homo Sapiens
KIRNTDTCY

SEQ ID NO: 1064187 - protein, 9 aa, Homo Sapiens
LKDSITRRQ

SEQ ID NO: 1064188 - protein, 9 aa, Homo Sapiens
MGLSDEEWQ

SEQ ID NO: 1064189 - protein, 9 aa, Homo Sapiens
VFLELFKNG

SEQ ID NO: 1064190 - protein, 9 aa, Homo Sapiens
FIYTLRNRN

SEQ ID NO: 1064191 - protein, 9 aa, Homo Sapiens
QGNKDLKKH

SEQ ID NO: 1064192 - protein, 9 aa, Homo Sapiens
PDYNKIFFK

SEQ ID NO: 1064193 - protein, 9 aa, Homo Sapiens
KYNRGRQKD

SEQ ID NO: 1064194 - protein, 9 aa, Homo Sapiens
EIFKEIKSS

SEQ ID NO: 1064195 - protein, 9 aa, Homo Sapiens
FHSKSTFSE

SEQ ID NO: 1064196 - protein, 9 aa, Homo Sapiens
ADGPNDVSS

SEQ ID NO: 1064197 - protein, 9 aa, Homo Sapiens
LSTPRSGKL

SEQ ID NO: 1064198 - protein, 9 aa, Homo Sapiens
GIMKTVRIL

SEQ ID NO: 1064199 - protein, 9 aa, Homo Sapiens
GGGPRNPDG

SEQ ID NO: 1064200 - protein, 9 aa, Homo Sapiens
RQSYGPFLE

SEQ ID NO: 1064201 - protein, 9 aa, Homo Sapiens
VSDALYAAF

SEQ ID NO: 1064202 - protein, 9 aa, Homo Sapiens
EPSRKNSTR

SEQ ID NO: 1064203 - protein, 9 aa, Homo Sapiens
MWREMGVSR

SEQ ID NO: 1064204 - protein, 9 aa, Homo Sapiens
GGTLLGVSF

SEQ ID NO: 1064205 - protein, 9 aa, Homo Sapiens
DSFYFEDFS

SEQ ID NO: 1064206 - protein, 9 aa, Homo Sapiens
GEGGVCLNE

SEQ ID NO: 1064207 - protein, 9 aa, Homo Sapiens
DVWSFEILL

SEQ ID NO: 1064208 - protein, 9 aa, Homo Sapiens
YLIVVDHSL

SEQ ID NO: 1064209 - protein, 9 aa, Homo Sapiens
ENKQPGCPK

SEQ ID NO: 1064210 - protein, 9 aa, Homo Sapiens
VENGFVSPP

SEQ ID NO: 1064211 - protein, 9 aa, Homo Sapiens
KQEMATAAS

SEQ ID NO: 1064212 - protein, 9 aa, Homo Sapiens
HSAAYNSTD

SEQ ID NO: 1064213 - protein, 9 aa, Homo Sapiens
VLYADREIL

SEQ ID NO: 1064214 - protein, 9 aa, Homo Sapiens
HPHHCNVIY

SEQ ID NO: 1064215 - protein, 9 aa, Homo Sapiens
EMPVGTKLT

SEQ ID NO: 1064216 - protein, 9 aa, Homo Sapiens
VNTKLCDEF

SEQ ID NO: 1064217 - protein, 9 aa, Homo Sapiens
FQVWLHHLN

SEQ ID NO: 1064218 - protein, 9 aa, Homo Sapiens
HRSSVSSSS

SEQ ID NO: 1064219 - protein, 9 aa, Homo Sapiens
CEIQSFFFL

SEQ ID NO: 1064220 - protein, 9 aa, Homo Sapiens
LAGKTSTDL

SEQ ID NO: 1064221 - protein, 9 aa, Homo Sapiens
NECLLILKF

SEQ ID NO: 1064222 - protein, 9 aa, Homo Sapiens
MQRGILFVY

SEQ ID NO: 1064223 - protein, 9 aa, Homo Sapiens
SGACTCLAG

SEQ ID NO: 1064224 - protein, 9 aa, Homo Sapiens
EPRRGFSFE

SEQ ID NO: 1064225 - protein, 9 aa, Homo Sapiens
SGLSFWSSE

SEQ ID NO: 1064226 - protein, 9 aa, Homo Sapiens
NLQYFLDQF

SEQ ID NO: 1064227 - protein, 9 aa, Homo Sapiens
YLSDIDLTY

SEQ ID NO: 1064228 - protein, 9 aa, Homo Sapiens
ADLDWDAFP

SEQ ID NO: 1064229 - protein, 9 aa, Homo Sapiens
AAPLFGVLS

SEQ ID NO: 1064230 - protein, 9 aa, Homo Sapiens
SPLVGPLQP

SEQ ID NO: 1064231 - protein, 9 aa, Homo Sapiens
PIQNSHYGQ

SEQ ID NO: 1064232 - protein, 9 aa, Homo Sapiens
RIYPGFLMD

SEQ ID NO: 1064233 - protein, 9 aa, Homo Sapiens
KSHKESHKE

SEQ ID NO: 1064234 - protein, 9 aa, Homo Sapiens
EGLRKVKKD

SEQ ID NO: 1064235 - protein, 9 aa, Homo Sapiens
SILRSLEVI

SEQ ID NO: 1064236 - protein, 9 aa, Homo Sapiens
RGEGAELAA

SEQ ID NO: 1064237 - protein, 9 aa, Homo Sapiens
SEDTELLSF

SEQ ID NO: 1064238 - protein, 9 aa, Homo Sapiens
ALRARFGMA

SEQ ID NO: 1064239 - protein, 9 aa, Homo Sapiens
ILWLAQLRY

SEQ ID NO: 1064240 - protein, 9 aa, Homo Sapiens
VINNQQETP

SEQ ID NO: 1064241 - protein, 9 aa, Homo Sapiens
GGLRYKAPR

SEQ ID NO: 1064242 - protein, 9 aa, Homo Sapiens
KAMAVKDII

SEQ ID NO: 1064243 - protein, 9 aa, Homo Sapiens
SPRTSTNFL

SEQ ID NO: 1064244 - protein, 9 aa, Homo Sapiens
TFCLKRETG

SEQ ID NO: 1064245 - protein, 9 aa, Homo Sapiens
NKPPFEFVS

SEQ ID NO: 1064246 - protein, 9 aa, Homo Sapiens
YNSTDGLAP

SEQ ID NO: 1064247 - protein, 9 aa, Homo Sapiens
PILGPAPIP

SEQ ID NO: 1064248 - protein, 9 aa, Homo Sapiens
DQIIGMTVI

SEQ ID NO: 1064249 - protein, 9 aa, Homo Sapiens
ISDSYLHTP

SEQ ID NO: 1064250 - protein, 9 aa, Homo Sapiens
PNPSSKLTS

SEQ ID NO: 1064251 - protein, 9 aa, Homo Sapiens
SPLEEMQPM

SEQ ID NO: 1064252 - protein, 9 aa, Homo Sapiens
LYGDIPCEL

SEQ ID NO: 1064253 - protein, 9 aa, Homo Sapiens
IDFLRTLYN

SEQ ID NO: 1064254 - protein, 9 aa, Homo Sapiens
LPSGLSFWS

SEQ ID NO: 1064255 - protein, 9 aa, Homo Sapiens
NEGVCSVVD

SEQ ID NO: 1064256 - protein, 9 aa, Homo Sapiens
ERMSSTRIQ

SEQ ID NO: 1064257 - protein, 9 aa, Homo Sapiens
TGDRCTDCL

SEQ ID NO: 1064258 - protein, 9 aa, Homo Sapiens
QMHTANLPH

SEQ ID NO: 1064259 - protein, 9 aa, Homo Sapiens
KFSLDEIAG

SEQ ID NO: 1064260 - protein, 9 aa, Homo Sapiens
FCHCAPCQG

SEQ ID NO: 1064261 - protein, 9 aa, Homo Sapiens
EETETIENL

SEQ ID NO: 1064262 - protein, 9 aa, Homo Sapiens
LKIIKIDGQ

SEQ ID NO: 1064263 - protein, 9 aa, Homo Sapiens
ARELTKAGA

SEQ ID NO: 1064264 - protein, 9 aa, Homo Sapiens
PRHIPGVVK

SEQ ID NO: 1064265 - protein, 9 aa, Homo Sapiens
KLVRTALME

SEQ ID NO: 1064266 - protein, 9 aa, Homo Sapiens
ASERLQGTH

SEQ ID NO: 1064267 - protein, 9 aa, Homo Sapiens
KKLRNSYSI

SEQ ID NO: 1064268 - protein, 9 aa, Homo Sapiens
LSLLSGLEV

SEQ ID NO: 1064269 - protein, 9 aa, Homo Sapiens
EFYPTFDPL

SEQ ID NO: 1064270 - protein, 9 aa, Homo Sapiens
ALEAHCKKY

SEQ ID NO: 1064271 - protein, 9 aa, Homo Sapiens
PRCPPKCLP

SEQ ID NO: 1064272 - protein, 9 aa, Homo Sapiens
RAPQTLPFA

SEQ ID NO: 1064273 - protein, 9 aa, Homo Sapiens
LYARNQAGE

SEQ ID NO: 1064274 - protein, 9 aa, Homo Sapiens
DQNVSDDPE

SEQ ID NO: 1064275 - protein, 9 aa, Homo Sapiens
IMTEDCLNE

SEQ ID NO: 1064276 - protein, 9 aa, Homo Sapiens
SSGFGFGSG

SEQ ID NO: 1064277 - protein, 9 aa, Homo Sapiens
FYIEDFAKF

SEQ ID NO: 1064278 - protein, 9 aa, Homo Sapiens
AAKHGTFVG

SEQ ID NO: 1064279 - protein, 9 aa, Homo Sapiens
SVEPKTGII

SEQ ID NO: 1064280 - protein, 9 aa, Homo Sapiens
DSNDADTTR

SEQ ID NO: 1064281 - protein, 9 aa, Homo Sapiens
AIITPRVRS

SEQ ID NO: 1064282 - protein, 9 aa, Homo Sapiens
EPPRQANHV

SEQ ID NO: 1064283 - protein, 9 aa, Homo Sapiens
VVRVDTDGG

SEQ ID NO: 1064284 - protein, 9 aa, Homo Sapiens
MPKILERSY

SEQ ID NO: 1064285 - protein, 9 aa, Homo Sapiens
LVGNGTYEQ

SEQ ID NO: 1064286 - protein, 9 aa, Homo Sapiens
YGLTDKEKA

SEQ ID NO: 1064287 - protein, 9 aa, Homo Sapiens
IRLLILSYA

SEQ ID NO: 1064288 - protein, 9 aa, Homo Sapiens
FTIFESCDR

SEQ ID NO: 1064289 - protein, 9 aa, Homo Sapiens
PGIVSSGNT

SEQ ID NO: 1064290 - protein, 9 aa, Homo Sapiens
RNLTMDTYV

SEQ ID NO: 1064291 - protein, 9 aa, Homo Sapiens
MELKKEIAN

SEQ ID NO: 1064292 - protein, 9 aa, Homo Sapiens
STPGATSSS

SEQ ID NO: 1064293 - protein, 9 aa, Homo Sapiens
QKRDFLVDN

SEQ ID NO: 1064294 - protein, 9 aa, Homo Sapiens
SLLQKVVYL

SEQ ID NO: 1064295 - protein, 9 aa, Homo Sapiens
PGSGFSSEE

SEQ ID NO: 1064296 - protein, 9 aa, Homo Sapiens
RGETSLKLI

SEQ ID NO: 1064297 - protein, 9 aa, Homo Sapiens
DITDRFRFA

SEQ ID NO: 1064298 - protein, 9 aa, Homo Sapiens
DAVKTVALN

SEQ ID NO: 1064299 - protein, 9 aa, Homo Sapiens
PLGSSGPPG

SEQ ID NO: 1064300 - protein, 9 aa, Homo Sapiens
PPHHILHQT

SEQ ID NO: 1064301 - protein, 9 aa, Homo Sapiens
RLLAKKRKE

SEQ ID NO: 1064302 - protein, 9 aa, Homo Sapiens
PTGNMPNTS

SEQ ID NO: 1064303 - protein, 9 aa, Homo Sapiens
IYRDFKPEN

SEQ ID NO: 1064304 - protein, 9 aa, Homo Sapiens
LVAVINNNS

SEQ ID NO: 1064305 - protein, 9 aa, Homo Sapiens
RVKKWLLSD

SEQ ID NO: 1064306 - protein, 9 aa, Homo Sapiens
ILLTIFRIK

SEQ ID NO: 1064307 - protein, 9 aa, Homo Sapiens
SGEKIPVFV

SEQ ID NO: 1064308 - protein, 9 aa, Homo Sapiens
SIQPTGNMP

SEQ ID NO: 1064309 - protein, 9 aa, Homo Sapiens
GLLQTYAFV

SEQ ID NO: 1064310 - protein, 9 aa, Homo Sapiens
FVSRFCADH

SEQ ID NO: 1064311 - protein, 9 aa, Homo Sapiens
VEIKGEDGD

SEQ ID NO: 1064312 - protein, 9 aa, Homo Sapiens
VIGESMYGN

SEQ ID NO: 1064313 - protein, 9 aa, Homo Sapiens
RKQKSKLGN

SEQ ID NO: 1064314 - protein, 9 aa, Homo Sapiens
LIEVRLTQD

SEQ ID NO: 1064315 - protein, 9 aa, Homo Sapiens
TEKNFRRLQ

SEQ ID NO: 1064316 - protein, 9 aa, Homo Sapiens
NAFRKQSSD

SEQ ID NO: 1064317 - protein, 9 aa, Homo Sapiens
YVGMCGDRA

SEQ ID NO: 1064318 - protein, 9 aa, Homo Sapiens
KRALHNAKC

SEQ ID NO: 1064319 - protein, 9 aa, Homo Sapiens
QENEATAKV

SEQ ID NO: 1064320 - protein, 9 aa, Homo Sapiens
DKLPPEEEL

SEQ ID NO: 1064321 - protein, 9 aa, Homo Sapiens
RRKFIFVQK

SEQ ID NO: 1064322 - protein, 9 aa, Homo Sapiens
TYLPVLDTA

SEQ ID NO: 1064323 - protein, 9 aa, Homo Sapiens
VVAAVPSLI

SEQ ID NO: 1064324 - protein, 9 aa, Homo Sapiens
QSREKSFIC

SEQ ID NO: 1064325 - protein, 9 aa, Homo Sapiens
IRDCLIQFI

SEQ ID NO: 1064326 - protein, 9 aa, Homo Sapiens
RTLLDDKND

SEQ ID NO: 1064327 - protein, 9 aa, Homo Sapiens
LGNSCDLEE

SEQ ID NO: 1064328 - protein, 9 aa, Homo Sapiens
NIPFEQLEI

SEQ ID NO: 1064329 - protein, 9 aa, Homo Sapiens
LEGPSLEWE

SEQ ID NO: 1064330 - protein, 9 aa, Homo Sapiens
VRLTQDPAK

SEQ ID NO: 1064331 - protein, 9 aa, Homo Sapiens
ATPSNARGQ

SEQ ID NO: 1064332 - protein, 9 aa, Homo Sapiens
FGTYFGLAA

SEQ ID NO: 1064333 - protein, 9 aa, Homo Sapiens
VLFATCVFV

SEQ ID NO: 1064334 - protein, 9 aa, Homo Sapiens
VTSKLDKKN

SEQ ID NO: 1064335 - protein, 9 aa, Homo Sapiens
FQNSGNTDI

SEQ ID NO: 1064336 - protein, 9 aa, Homo Sapiens
ITKDCQVSE

SEQ ID NO: 1064337 - protein, 9 aa, Homo Sapiens
GKWPSLSET

SEQ ID NO: 1064338 - protein, 9 aa, Homo Sapiens
TQEFPREGW

SEQ ID NO: 1064339 - protein, 9 aa, Homo Sapiens
REVRGGHGC

SEQ ID NO: 1064340 - protein, 9 aa, Homo Sapiens
IDMQPNSNL

SEQ ID NO: 1064341 - protein, 9 aa, Homo Sapiens
PAHAVVVRV

SEQ ID NO: 1064342 - protein, 9 aa, Homo Sapiens
GKKGQVLEC

SEQ ID NO: 1064343 - protein, 9 aa, Homo Sapiens
DWLFPKRCP

SEQ ID NO: 1064344 - protein, 9 aa, Homo Sapiens
PTPQPFCNG

SEQ ID NO: 1064345 - protein, 9 aa, Homo Sapiens
PKFKRKSIH

SEQ ID NO: 1064346 - protein, 9 aa, Homo Sapiens
MARSRLITT

SEQ ID NO: 1064347 - protein, 9 aa, Homo Sapiens
PVKLNDTGS

SEQ ID NO: 1064348 - protein, 9 aa, Homo Sapiens
TDYIFSERD

SEQ ID NO: 1064349 - protein, 9 aa, Homo Sapiens
CRSTRNLYA

SEQ ID NO: 1064350 - protein, 9 aa, Homo Sapiens
IFFTPECVT

SEQ ID NO: 1064351 - protein, 9 aa, Homo Sapiens
SGSKVDFRD

SEQ ID NO: 1064352 - protein, 9 aa, Homo Sapiens
LSSRSLSSN

SEQ ID NO: 1064353 - protein, 9 aa, Homo Sapiens
FFAIKSGQQ

SEQ ID NO: 1064354 - protein, 9 aa, Homo Sapiens
NGLLNFDIF

SEQ ID NO: 1064355 - protein, 9 aa, Homo Sapiens
GNGTYEQVY

SEQ ID NO: 1064356 - protein, 9 aa, Homo Sapiens
DQIGEMRMA

SEQ ID NO: 1064357 - protein, 9 aa, Homo Sapiens
ALEFLIISN

SEQ ID NO: 1064358 - protein, 9 aa, Homo Sapiens
QGDSAHKPE

SEQ ID NO: 1064359 - protein, 9 aa, Homo Sapiens
TACPLAEDS

SEQ ID NO: 1064360 - protein, 9 aa, Homo Sapiens
VFFNKPDSH

SEQ ID NO: 1064361 - protein, 9 aa, Homo Sapiens
LEKDYFRLL

SEQ ID NO: 1064362 - protein, 9 aa, Homo Sapiens
KIVRRTIFL

SEQ ID NO: 1064363 - protein, 9 aa, Homo Sapiens
EKIAEKCDR

SEQ ID NO: 1064364 - protein, 9 aa, Homo Sapiens
FSSSLAGPS

SEQ ID NO: 1064365 - protein, 9 aa, Homo Sapiens
LGAILKGVA

SEQ ID NO: 1064366 - protein, 9 aa, Homo Sapiens
QRHRKIYTG

SEQ ID NO: 1064367 - protein, 9 aa, Homo Sapiens
ILMLLLSTA

SEQ ID NO: 1064368 - protein, 9 aa, Homo Sapiens
EMNYVNRDL

SEQ ID NO: 1064369 - protein, 9 aa, Homo Sapiens
LEMPEKKDL

SEQ ID NO: 1064370 - protein, 9 aa, Homo Sapiens
AQPAAELGL

SEQ ID NO: 1064371 - protein, 9 aa, Homo Sapiens
TIVFIASIA

SEQ ID NO: 1064372 - protein, 9 aa, Homo Sapiens
NNNLGWPNE

SEQ ID NO: 1064373 - protein, 9 aa, Homo Sapiens
ISFTGCEIQ

SEQ ID NO: 1064374 - protein, 9 aa, Homo Sapiens
GSASINQIS

SEQ ID NO: 1064375 - protein, 9 aa, Homo Sapiens
LSSPAFAIS

SEQ ID NO: 1064376 - protein, 9 aa, Homo Sapiens
LCGHKKVDH

SEQ ID NO: 1064377 - protein, 9 aa, Homo Sapiens
EENGKPGEP

SEQ ID NO: 1064378 - protein, 9 aa, Homo Sapiens
HMKVKGEAP

SEQ ID NO: 1064379 - protein, 9 aa, Homo Sapiens
GPDGSILRI

SEQ ID NO: 1064380 - protein, 9 aa, Homo Sapiens
LPLSSLAGR

SEQ ID NO: 1064381 - protein, 9 aa, Homo Sapiens
GIRCYKSEN

SEQ ID NO: 1064382 - protein, 9 aa, Homo Sapiens
AREDPILVP

SEQ ID NO: 1064383 - protein, 9 aa, Homo Sapiens
PACKQFQRT

SEQ ID NO: 1064384 - protein, 9 aa, Homo Sapiens
EAVQLKCEY

SEQ ID NO: 1064385 - protein, 9 aa, Homo Sapiens
ISYPGRTNA

SEQ ID NO: 1064386 - protein, 9 aa, Homo Sapiens
KLVTTKNLD

SEQ ID NO: 1064387 - protein, 9 aa, Homo Sapiens
ETMAPSIKS

SEQ ID NO: 1064388 - protein, 9 aa, Homo Sapiens
KSFICTECG

SEQ ID NO: 1064389 - protein, 9 aa, Homo Sapiens
PALLTDGST

SEQ ID NO: 1064390 - protein, 9 aa, Homo Sapiens
MDQIGEMRM

SEQ ID NO: 1064391 - protein, 9 aa, Homo Sapiens
RGRPAQISL

SEQ ID NO: 1064392 - protein, 9 aa, Homo Sapiens
VALLDREAG

SEQ ID NO: 1064393 - protein, 9 aa, Homo Sapiens
FYGVFASEE

SEQ ID NO: 1064394 - protein, 9 aa, Homo Sapiens
NLGMKGEAG

SEQ ID NO: 1064395 - protein, 9 aa, Homo Sapiens
MGHPCLDLC

SEQ ID NO: 1064396 - protein, 9 aa, Homo Sapiens
FSAFKQASQ

SEQ ID NO: 1064397 - protein, 9 aa, Homo Sapiens
NQYQGNPLR

SEQ ID NO: 1064398 - protein, 9 aa, Homo Sapiens
LGEGELPVA

SEQ ID NO: 1064399 - protein, 9 aa, Homo Sapiens
PYDGIPASK

SEQ ID NO: 1064400 - protein, 9 aa, Homo Sapiens
ETVFTKKTI

SEQ ID NO: 1064401 - protein, 9 aa, Homo Sapiens
KFFLRCLEK

SEQ ID NO: 1064402 - protein, 9 aa, Homo Sapiens
IFLNGNCMK

SEQ ID NO: 1064403 - protein, 9 aa, Homo Sapiens
IQVQREEER

SEQ ID NO: 1064404 - protein, 9 aa, Homo Sapiens
RNPNNKYEP

SEQ ID NO: 1064405 - protein, 9 aa, Homo Sapiens
VYKMPIKKK

SEQ ID NO: 1064406 - protein, 9 aa, Homo Sapiens
ESKGEPGDI

SEQ ID NO: 1064407 - protein, 9 aa, Homo Sapiens
QDTENKYFK

SEQ ID NO: 1064408 - protein, 9 aa, Homo Sapiens
NHFSSRQPI

SEQ ID NO: 1064409 - protein, 9 aa, Homo Sapiens
YPGFLMDKA

SEQ ID NO: 1064410 - protein, 9 aa, Homo Sapiens
QVEKIKNFM

SEQ ID NO: 1064411 - protein, 9 aa, Homo Sapiens
PDEKFDPQN

SEQ ID NO: 1064412 - protein, 9 aa, Homo Sapiens
PDLLAGVNC

SEQ ID NO: 1064413 - protein, 9 aa, Homo Sapiens
QSSSVLSIL

SEQ ID NO: 1064414 - protein, 9 aa, Homo Sapiens
PKILERSYS

SEQ ID NO: 1064415 - protein, 9 aa, Homo Sapiens
SKMKHIRQA

SEQ ID NO: 1064416 - protein, 9 aa, Homo Sapiens
IKHQNQDTE

SEQ ID NO: 1064417 - protein, 9 aa, Homo Sapiens
PMVKSGSTF

SEQ ID NO: 1064418 - protein, 9 aa, Homo Sapiens
LLEGRFRRG

SEQ ID NO: 1064419 - protein, 9 aa, Homo Sapiens
FEAPFGLDL

SEQ ID NO: 1064420 - protein, 9 aa, Homo Sapiens
RANTQDTKN

SEQ ID NO: 1064421 - protein, 9 aa, Homo Sapiens
ALVAIGTYD

SEQ ID NO: 1064422 - protein, 9 aa, Homo Sapiens
LLPEPPKTG

SEQ ID NO: 1064423 - protein, 9 aa, Homo Sapiens
RSPASASLS

SEQ ID NO: 1064424 - protein, 9 aa, Homo Sapiens
STYLDPDTD

SEQ ID NO: 1064425 - protein, 9 aa, Homo Sapiens
GPLAYRDVP

SEQ ID NO: 1064426 - protein, 9 aa, Homo Sapiens
RLLLLHRAD

SEQ ID NO: 1064427 - protein, 9 aa, Homo Sapiens
YFLSSCKAE

SEQ ID NO: 1064428 - protein, 9 aa, Homo Sapiens
PYRQQSLAL

SEQ ID NO: 1064429 - protein, 9 aa, Homo Sapiens
LAITMKIFS

SEQ ID NO: 1064430 - protein, 9 aa, Homo Sapiens
KNVAPGIFK

SEQ ID NO: 1064431 - protein, 9 aa, Homo Sapiens
EDDFGLVKL

SEQ ID NO: 1064432 - protein, 9 aa, Homo Sapiens
VLASYKLYW

SEQ ID NO: 1064433 - protein, 9 aa, Homo Sapiens
GARNIEDDL

SEQ ID NO: 1064434 - protein, 9 aa, Homo Sapiens
SDFYPAIGN

SEQ ID NO: 1064435 - protein, 9 aa, Homo Sapiens
TKGCENVRV

SEQ ID NO: 1064436 - protein, 9 aa, Homo Sapiens
AKHKFSGFP

SEQ ID NO: 1064437 - protein, 9 aa, Homo Sapiens
QSHTRKIST

SEQ ID NO: 1064438 - protein, 9 aa, Homo Sapiens
IPNPTMCLE

SEQ ID NO: 1064439 - protein, 9 aa, Homo Sapiens
ADWLALIGG

SEQ ID NO: 1064440 - protein, 9 aa, Homo Sapiens
DLLRLHAQL

SEQ ID NO: 1064441 - protein, 9 aa, Homo Sapiens
YCPNYPVIQ

SEQ ID NO: 1064442 - protein, 9 aa, Homo Sapiens
AIFLKDDYF

SEQ ID NO: 1064443 - protein, 9 aa, Homo Sapiens
KGRSSKVHS

SEQ ID NO: 1064444 - protein, 9 aa, Homo Sapiens
TMKIFSKTY

SEQ ID NO: 1064445 - protein, 9 aa, Homo Sapiens
TIKWDISGI

SEQ ID NO: 1064446 - protein, 9 aa, Homo Sapiens
KSHLGIKKY

SEQ ID NO: 1064447 - protein, 9 aa, Homo Sapiens
KYNGSRPRK

SEQ ID NO: 1064448 - protein, 9 aa, Homo Sapiens
WYLDQIKRE

SEQ ID NO: 1064449 - protein, 9 aa, Homo Sapiens
EGKTGGFRS

SEQ ID NO: 1064450 - protein, 9 aa, Homo Sapiens
GKISYPGRT

SEQ ID NO: 1064451 - protein, 9 aa, Homo Sapiens
NVQVMTMGN

SEQ ID NO: 1064452 - protein, 9 aa, Homo Sapiens
GWFSVFYVY

SEQ ID NO: 1064453 - protein, 9 aa, Homo Sapiens
KVTLSYKSK

SEQ ID NO: 1064454 - protein, 9 aa, Homo Sapiens
LRQTTAKAV

SEQ ID NO: 1064455 - protein, 9 aa, Homo Sapiens
GYYNKDNKE

SEQ ID NO: 1064456 - protein, 9 aa, Homo Sapiens
EKWLNRNSS

SEQ ID NO: 1064457 - protein, 9 aa, Homo Sapiens
FFFSDRRAR

SEQ ID NO: 1064458 - protein, 9 aa, Homo Sapiens
GVPLYDQNH

SEQ ID NO: 1064459 - protein, 9 aa, Homo Sapiens
SSVFTSKLF

SEQ ID NO: 1064460 - protein, 9 aa, Homo Sapiens
STEKTFTIS

SEQ ID NO: 1064461 - protein, 9 aa, Homo Sapiens
RLAELLALE

SEQ ID NO: 1064462 - protein, 9 aa, Homo Sapiens
TPILPLGIF

SEQ ID NO: 1064463 - protein, 9 aa, Homo Sapiens
MAPTESTEE

SEQ ID NO: 1064464 - protein, 9 aa, Homo Sapiens
NSDGMYQCG

SEQ ID NO: 1064465 - protein, 9 aa, Homo Sapiens
AKYAQSQSH

SEQ ID NO: 1064466 - protein, 9 aa, Homo Sapiens
HLVYKMPIK

SEQ ID NO: 1064467 - protein, 9 aa, Homo Sapiens
APLSLYISI

SEQ ID NO: 1064468 - protein, 9 aa, Homo Sapiens
LKSVEHVSP

SEQ ID NO: 1064469 - protein, 9 aa, Homo Sapiens
GEGAELAAR

SEQ ID NO: 1064470 - protein, 9 aa, Homo Sapiens
KLCTRSENE

SEQ ID NO: 1064471 - protein, 9 aa, Homo Sapiens
IDTDPKLKY

SEQ ID NO: 1064472 - protein, 9 aa, Homo Sapiens
EGFTRTLKL

SEQ ID NO: 1064473 - protein, 9 aa, Homo Sapiens
NPFLVLSIV

SEQ ID NO: 1064474 - protein, 9 aa, Homo Sapiens
TSYSCPCTD

SEQ ID NO: 1064475 - protein, 9 aa, Homo Sapiens
ATECFFLAF

SEQ ID NO: 1064476 - protein, 9 aa, Homo Sapiens
HGAKLKIVS

SEQ ID NO: 1064477 - protein, 9 aa, Homo Sapiens
LVTLIENAI

SEQ ID NO: 1064478 - protein, 9 aa, Homo Sapiens
PEGLVTPAT

SEQ ID NO: 1064479 - protein, 9 aa, Homo Sapiens
VNSIAWSPE

SEQ ID NO: 1064480 - protein, 9 aa, Homo Sapiens
NWWAFGVLL

SEQ ID NO: 1064481 - protein, 9 aa, Homo Sapiens
SGYVDNPNK

SEQ ID NO: 1064482 - protein, 9 aa, Homo Sapiens
YFVLEISRN

SEQ ID NO: 1064483 - protein, 9 aa, Homo Sapiens
REDPILVPP

SEQ ID NO: 1064484 - protein, 9 aa, Homo Sapiens
EVTHQKRWT

SEQ ID NO: 1064485 - protein, 9 aa, Homo Sapiens
DCIQKVEVN

SEQ ID NO: 1064486 - protein, 9 aa, Homo Sapiens
DVSVIIKFL

SEQ ID NO: 1064487 - protein, 9 aa, Homo Sapiens
NYIFFMGCF

SEQ ID NO: 1064488 - protein, 9 aa, Homo Sapiens
CEESSPPPA

SEQ ID NO: 1064489 - protein, 9 aa, Homo Sapiens
DNPPKNETT

SEQ ID NO: 1064490 - protein, 9 aa, Homo Sapiens
RAQDASLSL

SEQ ID NO: 1064491 - protein, 9 aa, Homo Sapiens
GMSLGVKGF

SEQ ID NO: 1064492 - protein, 9 aa, Homo Sapiens
LQGKVKGSP

SEQ ID NO: 1064493 - protein, 9 aa, Homo Sapiens
ENVHTGEEL

SEQ ID NO: 1064494 - protein, 9 aa, Homo Sapiens
SSRSCAFSQ

SEQ ID NO: 1064495 - protein, 9 aa, Homo Sapiens
PEDTKSTAS

SEQ ID NO: 1064496 - protein, 9 aa, Homo Sapiens
NHIMASVWK

SEQ ID NO: 1064497 - protein, 9 aa, Homo Sapiens
INCEANLQA

SEQ ID NO: 1064498 - protein, 9 aa, Homo Sapiens
REDITLWGM

SEQ ID NO: 1064499 - protein, 9 aa, Homo Sapiens
GEEEDFIVK

SEQ ID NO: 1064500 - protein, 9 aa, Homo Sapiens
CWLATPTQT

SEQ ID NO: 1064501 - protein, 9 aa, Homo Sapiens
LVAMSWVFF

SEQ ID NO: 1064502 - protein, 9 aa, Homo Sapiens
FFQGDIWLL

SEQ ID NO: 1064503 - protein, 9 aa, Homo Sapiens
VNKAGTVST

SEQ ID NO: 1064504 - protein, 9 aa, Homo Sapiens
GGRGEDNAW

SEQ ID NO: 1064505 - protein, 9 aa, Homo Sapiens
ITWHLDLGG

SEQ ID NO: 1064506 - protein, 9 aa, Homo Sapiens
SGFMSFDNN

SEQ ID NO: 1064507 - protein, 9 aa, Homo Sapiens
GNLGIIELI

SEQ ID NO: 1064508 - protein, 9 aa, Homo Sapiens
FYTPKFVKG

SEQ ID NO: 1064509 - protein, 9 aa, Homo Sapiens
NKDNKENDE

SEQ ID NO: 1064510 - protein, 9 aa, Homo Sapiens
EMFSGDFTQ

SEQ ID NO: 1064511 - protein, 9 aa, Homo Sapiens
SNGQRREQQ

SEQ ID NO: 1064512 - protein, 9 aa, Homo Sapiens
ALFLFAHKL

SEQ ID NO: 1064513 - protein, 9 aa, Homo Sapiens
LQESVEDFL

SEQ ID NO: 1064514 - protein, 9 aa, Homo Sapiens
LLPGRLCAA

SEQ ID NO: 1064515 - protein, 9 aa, Homo Sapiens
EDQSIMGKF

SEQ ID NO: 1064516 - protein, 9 aa, Homo Sapiens
DLTQLQLEV

SEQ ID NO: 1064517 - protein, 9 aa, Homo Sapiens
QKQLGHHVG

SEQ ID NO: 1064518 - protein, 9 aa, Homo Sapiens
TDTEEEDTE

SEQ ID NO: 1064519 - protein, 9 aa, Homo Sapiens
SASVPLPPG

SEQ ID NO: 1064520 - protein, 9 aa, Homo Sapiens
IGNVKKLGK

SEQ ID NO: 1064521 - protein, 9 aa, Homo Sapiens
KGHVNNSAY

SEQ ID NO: 1064522 - protein, 9 aa, Homo Sapiens
PIYTGNISL

SEQ ID NO: 1064523 - protein, 9 aa, Homo Sapiens
YSNTRCDAG

SEQ ID NO: 1064524 - protein, 9 aa, Homo Sapiens
YSQKAIPAV

SEQ ID NO: 1064525 - protein, 9 aa, Homo Sapiens
ENKVCNCYE

SEQ ID NO: 1064526 - protein, 9 aa, Homo Sapiens
PARVPSPPP

SEQ ID NO: 1064527 - protein, 9 aa, Homo Sapiens
HQKRWTREL

SEQ ID NO: 1064528 - protein, 9 aa, Homo Sapiens
CNKKNNIAE

SEQ ID NO: 1064529 - protein, 9 aa, Homo Sapiens
TDSVKSPPL

SEQ ID NO: 1064530 - protein, 9 aa, Homo Sapiens
QKIYTGEKP

SEQ ID NO: 1064531 - protein, 9 aa, Homo Sapiens
QPPELQPLP

SEQ ID NO: 1064532 - protein, 9 aa, Homo Sapiens
TNFYGDLQK

SEQ ID NO: 1064533 - protein, 9 aa, Homo Sapiens
SNKTIYYEP

SEQ ID NO: 1064534 - protein, 9 aa, Homo Sapiens
FYFLPNPYF

SEQ ID NO: 1064535 - protein, 9 aa, Homo Sapiens
NNVEPPTIQ

SEQ ID NO: 1064536 - protein, 9 aa, Homo Sapiens
AAEDGWRSF

SEQ ID NO: 1064537 - protein, 9 aa, Homo Sapiens
YCCNYENCE

SEQ ID NO: 1064538 - protein, 9 aa, Homo Sapiens
GPILGPAPI

SEQ ID NO: 1064539 - protein, 9 aa, Homo Sapiens
SSHKIQHFF

SEQ ID NO: 1064540 - protein, 9 aa, Homo Sapiens
QRPTNLRRQ

SEQ ID NO: 1064541 - protein, 9 aa, Homo Sapiens
ALLTKPKVC

SEQ ID NO: 1064542 - protein, 9 aa, Homo Sapiens
SPSSVRLSP

SEQ ID NO: 1064543 - protein, 9 aa, Homo Sapiens
TLVVQNEEI

SEQ ID NO: 1064544 - protein, 9 aa, Homo Sapiens
DTRKLDKSR

SEQ ID NO: 1064545 - protein, 9 aa, Homo Sapiens
PETLERLVD

SEQ ID NO: 1064546 - protein, 9 aa, Homo Sapiens
LPKTFLNEK

SEQ ID NO: 1064547 - protein, 9 aa, Homo Sapiens
VACLKPALT

SEQ ID NO: 1064548 - protein, 9 aa, Homo Sapiens
TLSLSPSIC

SEQ ID NO: 1064549 - protein, 9 aa, Homo Sapiens
TMHGPLFQE

SEQ ID NO: 1064550 - protein, 9 aa, Homo Sapiens
TMWYKNLSG

SEQ ID NO: 1064551 - protein, 9 aa, Homo Sapiens
VEQKHEAER

SEQ ID NO: 1064552 - protein, 9 aa, Homo Sapiens
VVSLLGVTA

SEQ ID NO: 1064553 - protein, 9 aa, Homo Sapiens
ITKEDAVLP

SEQ ID NO: 1064554 - protein, 9 aa, Homo Sapiens
AIEGYRIGL

SEQ ID NO: 1064555 - protein, 9 aa, Homo Sapiens
RRHQCQARK

SEQ ID NO: 1064556 - protein, 9 aa, Homo Sapiens
RSSADSLSM

SEQ ID NO: 1064557 - protein, 9 aa, Homo Sapiens
GDLLFLFSS

SEQ ID NO: 1064558 - protein, 9 aa, Homo Sapiens
RSSADSLST

SEQ ID NO: 1064559 - protein, 9 aa, Homo Sapiens
YWDIMKYFD

SEQ ID NO: 1064560 - protein, 9 aa, Homo Sapiens
AEEYEDTMF

SEQ ID NO: 1064561 - protein, 9 aa, Homo Sapiens
TEKESFITP

SEQ ID NO: 1064562 - protein, 9 aa, Homo Sapiens
ALLDREAGS

SEQ ID NO: 1064563 - protein, 9 aa, Homo Sapiens
KAAETRNLQ

SEQ ID NO: 1064564 - protein, 9 aa, Homo Sapiens
TMALVLYYV

SEQ ID NO: 1064565 - protein, 9 aa, Homo Sapiens
SSISGAGLG

SEQ ID NO: 1064566 - protein, 9 aa, Homo Sapiens
MQSVGSQHS

SEQ ID NO: 1064567 - protein, 9 aa, Homo Sapiens
LFLGKVCPF

SEQ ID NO: 1064568 - protein, 9 aa, Homo Sapiens
YFLPVAQYI

SEQ ID NO: 1064569 - protein, 9 aa, Homo Sapiens
GSSRAIFFV

SEQ ID NO: 1064570 - protein, 9 aa, Homo Sapiens
PGLLIATSS

SEQ ID NO: 1064571 - protein, 9 aa, Homo Sapiens
EDNDKNYIH

SEQ ID NO: 1064572 - protein, 9 aa, Homo Sapiens
IEQPLYSLP

SEQ ID NO: 1064573 - protein, 9 aa, Homo Sapiens
RRLKRNQKK

SEQ ID NO: 1064574 - protein, 9 aa, Homo Sapiens
NYVYKERFP

SEQ ID NO: 1064575 - protein, 9 aa, Homo Sapiens
HKSLHSEDF

SEQ ID NO: 1064576 - protein, 9 aa, Homo Sapiens
IPKLRRRGL

SEQ ID NO: 1064577 - protein, 9 aa, Homo Sapiens
STRIQDNVD

SEQ ID NO: 1064578 - protein, 9 aa, Homo Sapiens
LQAKHNLLK

SEQ ID NO: 1064579 - protein, 9 aa, Homo Sapiens
TRNSSNMAK

SEQ ID NO: 1064580 - protein, 9 aa, Homo Sapiens
ISLTGNPVI

SEQ ID NO: 1064581 - protein, 9 aa, Homo Sapiens
EVKNEASCS

SEQ ID NO: 1064582 - protein, 9 aa, Homo Sapiens
STKEGKRNK

SEQ ID NO: 1064583 - protein, 9 aa, Homo Sapiens
SLVDQDPDC

SEQ ID NO: 1064584 - protein, 9 aa, Homo Sapiens
PKKKDGPVN

SEQ ID NO: 1064585 - protein, 9 aa, Homo Sapiens
SHIRTITSI

SEQ ID NO: 1064586 - protein, 9 aa, Homo Sapiens
FHCPEIPAI

SEQ ID NO: 1064587 - protein, 9 aa, Homo Sapiens
SRFCADHPF

SEQ ID NO: 1064588 - protein, 9 aa, Homo Sapiens
NSGNSESLS

SEQ ID NO: 1064589 - protein, 9 aa, Homo Sapiens
KNLSGLRQQ

SEQ ID NO: 1064590 - protein, 9 aa, Homo Sapiens
KALQAIITL

SEQ ID NO: 1064591 - protein, 9 aa, Homo Sapiens
MDKNCYEQM

SEQ ID NO: 1064592 - protein, 9 aa, Homo Sapiens
PSNSRPGTM

SEQ ID NO: 1064593 - protein, 9 aa, Homo Sapiens
RQMEIRRIF

SEQ ID NO: 1064594 - protein, 9 aa, Homo Sapiens
EEFDSHGDA

SEQ ID NO: 1064595 - protein, 9 aa, Homo Sapiens
EGPDRIGKT

SEQ ID NO: 1064596 - protein, 9 aa, Homo Sapiens
KITDQEHNV

SEQ ID NO: 1064597 - protein, 9 aa, Homo Sapiens
ATSFEELGP

SEQ ID NO: 1064598 - protein, 9 aa, Homo Sapiens
WKWPFDFFL

SEQ ID NO: 1064599 - protein, 9 aa, Homo Sapiens
PDQEDLDGN

SEQ ID NO: 1064600 - protein, 9 aa, Homo Sapiens
NECKECGKA

SEQ ID NO: 1064601 - protein, 9 aa, Homo Sapiens
VAKAEEWLF

SEQ ID NO: 1064602 - protein, 9 aa, Homo Sapiens
IIPPTSKTF

SEQ ID NO: 1064603 - protein, 9 aa, Homo Sapiens
AHWLARRLY

SEQ ID NO: 1064604 - protein, 9 aa, Homo Sapiens
VTEDDFGLV

SEQ ID NO: 1064605 - protein, 9 aa, Homo Sapiens
IKRDQAPFI

SEQ ID NO: 1064606 - protein, 9 aa, Homo Sapiens
HPPHPHHQQ

SEQ ID NO: 1064607 - protein, 9 aa, Homo Sapiens
RQEVNECNL

SEQ ID NO: 1064608 - protein, 9 aa, Homo Sapiens
VRTSYVLEE

SEQ ID NO: 1064609 - protein, 9 aa, Homo Sapiens
KVNTHIHAA

SEQ ID NO: 1064610 - protein, 9 aa, Homo Sapiens
GYQAATYLK

SEQ ID NO: 1064611 - protein, 9 aa, Homo Sapiens
AVEPILTSV

SEQ ID NO: 1064612 - protein, 9 aa, Homo Sapiens
FGRGQRIAE

SEQ ID NO: 1064613 - protein, 9 aa, Homo Sapiens
KPLPAPDDW

SEQ ID NO: 1064614 - protein, 9 aa, Homo Sapiens
LFLISLMFL

SEQ ID NO: 1064615 - protein, 9 aa, Homo Sapiens
KVSSSQLNR

SEQ ID NO: 1064616 - protein, 9 aa, Homo Sapiens
AITMKIFSK

SEQ ID NO: 1064617 - protein, 9 aa, Homo Sapiens
LLEDPVGRT

SEQ ID NO: 1064618 - protein, 9 aa, Homo Sapiens
PVEIKGEDG

SEQ ID NO: 1064619 - protein, 9 aa, Homo Sapiens
TGHLLEVPQ

SEQ ID NO: 1064620 - protein, 9 aa, Homo Sapiens
PYLDLIDED

SEQ ID NO: 1064621 - protein, 9 aa, Homo Sapiens
YFAKVKLAR

SEQ ID NO: 1064622 - protein, 9 aa, Homo Sapiens
SQSHSSSCR

SEQ ID NO: 1064623 - protein, 9 aa, Homo Sapiens
QRCVTPFHR

SEQ ID NO: 1064624 - protein, 9 aa, Homo Sapiens
GQAQLLRTL

SEQ ID NO: 1064625 - protein, 9 aa, Homo Sapiens
TRVLDKADS

SEQ ID NO: 1064626 - protein, 9 aa, Homo Sapiens
TKTQPHSHS

SEQ ID NO: 1064627 - protein, 9 aa, Homo Sapiens
LEVTGKNRY

SEQ ID NO: 1064628 - protein, 9 aa, Homo Sapiens
YSVVLGTFK

SEQ ID NO: 1064629 - protein, 9 aa, Homo Sapiens
RKLEKKKIL

SEQ ID NO: 1064630 - protein, 9 aa, Homo Sapiens
LRQMHTANL

SEQ ID NO: 1064631 - protein, 9 aa, Homo Sapiens
TGQENNLGE

SEQ ID NO: 1064632 - protein, 9 aa, Homo Sapiens
GKKHSITAV

SEQ ID NO: 1064633 - protein, 9 aa, Homo Sapiens
FSWMSYVSI

SEQ ID NO: 1064634 - protein, 9 aa, Homo Sapiens
NRCEKPIQN

SEQ ID NO: 1064635 - protein, 9 aa, Homo Sapiens
REYITCVIL

SEQ ID NO: 1064636 - protein, 9 aa, Homo Sapiens
GNLLLRGCK

SEQ ID NO: 1064637 - protein, 9 aa, Homo Sapiens
GNKNDEQDS

SEQ ID NO: 1064638 - protein, 9 aa, Homo Sapiens
YNAIFFTWD

SEQ ID NO: 1064639 - protein, 9 aa, Homo Sapiens
KPFSCSLLQ

SEQ ID NO: 1064640 - protein, 9 aa, Homo Sapiens
SNKRVAVIA

SEQ ID NO: 1064641 - protein, 9 aa, Homo Sapiens
SRPLHEEEA

SEQ ID NO: 1064642 - protein, 9 aa, Homo Sapiens
ALSPDTSVL

SEQ ID NO: 1064643 - protein, 9 aa, Homo Sapiens
LPRSQSMTI

SEQ ID NO: 1064644 - protein, 9 aa, Homo Sapiens
LLSPGTKAV

SEQ ID NO: 1064645 - protein, 9 aa, Homo Sapiens
LVSGNADFT

SEQ ID NO: 1064646 - protein, 9 aa, Homo Sapiens
KQSGKNQGY

SEQ ID NO: 1064647 - protein, 9 aa, Homo Sapiens
KLGHVVGFW

SEQ ID NO: 1064648 - protein, 9 aa, Homo Sapiens
AIERMIIKG

SEQ ID NO: 1064649 - protein, 9 aa, Homo Sapiens
AATLAKNME

SEQ ID NO: 1064650 - protein, 9 aa, Homo Sapiens
SGQTINIVT

SEQ ID NO: 1064651 - protein, 9 aa, Homo Sapiens
AKAEEWLFF

SEQ ID NO: 1064652 - protein, 9 aa, Homo Sapiens
FSDRRARTP

SEQ ID NO: 1064653 - protein, 9 aa, Homo Sapiens
LEYQKEMKA

SEQ ID NO: 1064654 - protein, 9 aa, Homo Sapiens
KRLMIKFCG

SEQ ID NO: 1064655 - protein, 9 aa, Homo Sapiens
VPPSEDTEL

SEQ ID NO: 1064656 - protein, 9 aa, Homo Sapiens
FGGSASINQ

SEQ ID NO: 1064657 - protein, 9 aa, Homo Sapiens
RDARQVWGF

SEQ ID NO: 1064658 - protein, 9 aa, Homo Sapiens
YIFLNGNCM

SEQ ID NO: 1064659 - protein, 9 aa, Homo Sapiens
LYLLRKYAV

SEQ ID NO: 1064660 - protein, 9 aa, Homo Sapiens
KECGKGFNC

SEQ ID NO: 1064661 - protein, 9 aa, Homo Sapiens
KISVLVQSK

SEQ ID NO: 1064662 - protein, 9 aa, Homo Sapiens
GPHYGRPMV

SEQ ID NO: 1064663 - protein, 9 aa, Homo Sapiens
AVISDSYLH

SEQ ID NO: 1064664 - protein, 9 aa, Homo Sapiens
QCQGLPCPE

SEQ ID NO: 1064665 - protein, 9 aa, Homo Sapiens
SKMFQSEVA

SEQ ID NO: 1064666 - protein, 9 aa, Homo Sapiens
PRAGSTPLA

SEQ ID NO: 1064667 - protein, 9 aa, Homo Sapiens
RHHPHAHHP

SEQ ID NO: 1064668 - protein, 9 aa, Homo Sapiens
TRLSDGNIY

SEQ ID NO: 1064669 - protein, 9 aa, Homo Sapiens
FLFYQRLFG

SEQ ID NO: 1064670 - protein, 9 aa, Homo Sapiens
RLMIKFCGE

SEQ ID NO: 1064671 - protein, 9 aa, Homo Sapiens
RSYSTEPNL

SEQ ID NO: 1064672 - protein, 9 aa, Homo Sapiens
SPILKHMLV

SEQ ID NO: 1064673 - protein, 9 aa, Homo Sapiens
FAPGNYDVN

SEQ ID NO: 1064674 - protein, 9 aa, Homo Sapiens
NVPSSLQAH

SEQ ID NO: 1064675 - protein, 9 aa, Homo Sapiens
FKGYAGADC

SEQ ID NO: 1064676 - protein, 9 aa, Homo Sapiens
WQPTSAPPA

SEQ ID NO: 1064677 - protein, 9 aa, Homo Sapiens
TKCDLWHLM

SEQ ID NO: 1064678 - protein, 9 aa, Homo Sapiens
CYCKLYEHL

SEQ ID NO: 1064679 - protein, 9 aa, Homo Sapiens
SADSLSTSS

SEQ ID NO: 1064680 - protein, 9 aa, Homo Sapiens
FRILELPDK

SEQ ID NO: 1064681 - protein, 9 aa, Homo Sapiens
CDLSRFIKL

SEQ ID NO: 1064682 - protein, 9 aa, Homo Sapiens
NKETDSVKS

SEQ ID NO: 1064683 - protein, 9 aa, Homo Sapiens
EIPKPLQLD

SEQ ID NO: 1064684 - protein, 9 aa, Homo Sapiens
LYDKVTHGY

SEQ ID NO: 1064685 - protein, 9 aa, Homo Sapiens
SGPHLETLY

SEQ ID NO: 1064686 - protein, 9 aa, Homo Sapiens
EVFSAFVTT

SEQ ID NO: 1064687 - protein, 9 aa, Homo Sapiens
MNEEQVHLE

SEQ ID NO: 1064688 - protein, 9 aa, Homo Sapiens
QMEIRRIFS

SEQ ID NO: 1064689 - protein, 9 aa, Homo Sapiens
RLENVGLYF

SEQ ID NO: 1064690 - protein, 9 aa, Homo Sapiens
IFPVVCTVE

SEQ ID NO: 1064691 - protein, 9 aa, Homo Sapiens
SDSSSEPKA

SEQ ID NO: 1064692 - protein, 9 aa, Homo Sapiens
RRKERISDN

SEQ ID NO: 1064693 - protein, 9 aa, Homo Sapiens
SYSTEPNLS

SEQ ID NO: 1064694 - protein, 9 aa, Homo Sapiens
LSLLFGWTP

SEQ ID NO: 1064695 - protein, 9 aa, Homo Sapiens
CASTRVIMS

SEQ ID NO: 1064696 - protein, 9 aa, Homo Sapiens
SLDIGICFI

SEQ ID NO: 1064697 - protein, 9 aa, Homo Sapiens
PSFLALSLS

SEQ ID NO: 1064698 - protein, 9 aa, Homo Sapiens
GFPGNLGMK

SEQ ID NO: 1064699 - protein, 9 aa, Homo Sapiens
EMATMKKEF

SEQ ID NO: 1064700 - protein, 9 aa, Homo Sapiens
MNDLETCVI

SEQ ID NO: 1064701 - protein, 9 aa, Homo Sapiens
SPGMTIDLF

SEQ ID NO: 1064702 - protein, 9 aa, Homo Sapiens
PDHFSPFSG

SEQ ID NO: 1064703 - protein, 9 aa, Homo Sapiens
QLSNSYNLE

SEQ ID NO: 1064704 - protein, 9 aa, Homo Sapiens
GILRVKQTC

SEQ ID NO: 1064705 - protein, 9 aa, Homo Sapiens
SFFWYQQAL

SEQ ID NO: 1064706 - protein, 9 aa, Homo Sapiens
EYFVQKADK

SEQ ID NO: 1064707 - protein, 9 aa, Homo Sapiens
ALVVWSHNG

SEQ ID NO: 1064708 - protein, 9 aa, Homo Sapiens
CSKCSNLYG

SEQ ID NO: 1064709 - protein, 9 aa, Homo Sapiens
GSLGEMGYF

SEQ ID NO: 1064710 - protein, 9 aa, Homo Sapiens
ILYTYSRGQ

SEQ ID NO: 1064711 - protein, 9 aa, Homo Sapiens
VIENKVCNC

SEQ ID NO: 1064712 - protein, 9 aa, Homo Sapiens
KQTAAEVSK

SEQ ID NO: 1064713 - protein, 9 aa, Homo Sapiens
LHTLMYFSI

SEQ ID NO: 1064714 - protein, 9 aa, Homo Sapiens
SFEILLWEI

SEQ ID NO: 1064715 - protein, 9 aa, Homo Sapiens
LMDIWTQKE

SEQ ID NO: 1064716 - protein, 9 aa, Homo Sapiens
PPSMGTQSG

SEQ ID NO: 1064717 - protein, 9 aa, Homo Sapiens
QSFSDAIYL

SEQ ID NO: 1064718 - protein, 9 aa, Homo Sapiens
DNLFEDMKD

SEQ ID NO: 1064719 - protein, 9 aa, Homo Sapiens
PHSKPNPKN

SEQ ID NO: 1064720 - protein, 9 aa, Homo Sapiens
VAKPKHKQT

SEQ ID NO: 1064721 - protein, 9 aa, Homo Sapiens
HQAVIFNIF

SEQ ID NO: 1064722 - protein, 9 aa, Homo Sapiens
GESGPGGCP

SEQ ID NO: 1064723 - protein, 9 aa, Homo Sapiens
ISMAHHFRD

SEQ ID NO: 1064724 - protein, 9 aa, Homo Sapiens
MGTISNVKT

SEQ ID NO: 1064725 - protein, 9 aa, Homo Sapiens
GFRLLNPHS

SEQ ID NO: 1064726 - protein, 9 aa, Homo Sapiens
MPMVPPLNF

SEQ ID NO: 1064727 - protein, 9 aa, Homo Sapiens
TSVPLLPKR

SEQ ID NO: 1064728 - protein, 9 aa, Homo Sapiens
ELRRTEHRA

SEQ ID NO: 1064729 - protein, 9 aa, Homo Sapiens
VSDSSSSSF

SEQ ID NO: 1064730 - protein, 9 aa, Homo Sapiens
EKIFCFQDT

SEQ ID NO: 1064731 - protein, 9 aa, Homo Sapiens
PLEYTVSHD

SEQ ID NO: 1064732 - protein, 9 aa, Homo Sapiens
QTNQTLTEK

SEQ ID NO: 1064733 - protein, 9 aa, Homo Sapiens
SNMRNDEIT

SEQ ID NO: 1064734 - protein, 9 aa, Homo Sapiens
DITDVCFFP

SEQ ID NO: 1064735 - protein, 9 aa, Homo Sapiens
SWQNFNDAS

SEQ ID NO: 1064736 - protein, 9 aa, Homo Sapiens
RWQVEEADD

SEQ ID NO: 1064737 - protein, 9 aa, Homo Sapiens
ELAWTSHLE

SEQ ID NO: 1064738 - protein, 9 aa, Homo Sapiens
SFGFFHLIR

SEQ ID NO: 1064739 - protein, 9 aa, Homo Sapiens
RQDLSTDSR

SEQ ID NO: 1064740 - protein, 9 aa, Homo Sapiens
FYKNGLFCT

SEQ ID NO: 1064741 - protein, 9 aa, Homo Sapiens
LLKWKKFSP

SEQ ID NO: 1064742 - protein, 9 aa, Homo Sapiens
LGVASLPPA

SEQ ID NO: 1064743 - protein, 9 aa, Homo Sapiens
LALEDKELE

SEQ ID NO: 1064744 - protein, 9 aa, Homo Sapiens
EYHLNPKTI

SEQ ID NO: 1064745 - protein, 9 aa, Homo Sapiens
AAEEFLWSL

SEQ ID NO: 1064746 - protein, 9 aa, Homo Sapiens
KRNEIKKNK

SEQ ID NO: 1064747 - protein, 9 aa, Homo Sapiens
RKHSTAFSE

SEQ ID NO: 1064748 - protein, 9 aa, Homo Sapiens
SFSTADPQG

SEQ ID NO: 1064749 - protein, 9 aa, Homo Sapiens
RYENCGHEN

SEQ ID NO: 1064750 - protein, 9 aa, Homo Sapiens
NYSLWSQSY

SEQ ID NO: 1064751 - protein, 9 aa, Homo Sapiens
DDRFQVNDF

SEQ ID NO: 1064752 - protein, 9 aa, Homo Sapiens
LLDAEPMKK

SEQ ID NO: 1064753 - protein, 9 aa, Homo Sapiens
KGPPVSPLP

SEQ ID NO: 1064754 - protein, 9 aa, Homo Sapiens
PSSAGEAGC

SEQ ID NO: 1064755 - protein, 9 aa, Homo Sapiens
LQTSPACQD

SEQ ID NO: 1064756 - protein, 9 aa, Homo Sapiens
GPLMFRGVG

SEQ ID NO: 1064757 - protein, 9 aa, Homo Sapiens
SSHLAVYQR

SEQ ID NO: 1064758 - protein, 9 aa, Homo Sapiens
VLAVRLKTP

SEQ ID NO: 1064759 - protein, 9 aa, Homo Sapiens
GEEFIRGHT

SEQ ID NO: 1064760 - protein, 9 aa, Homo Sapiens
VRGFWQTCG

SEQ ID NO: 1064761 - protein, 9 aa, Homo Sapiens
LQDLRTIYA

SEQ ID NO: 1064762 - protein, 9 aa, Homo Sapiens
ALFFSETCY

SEQ ID NO: 1064763 - protein, 9 aa, Homo Sapiens
LPMSRSQLL

SEQ ID NO: 1064764 - protein, 9 aa, Homo Sapiens
PVQQSVCTG

SEQ ID NO: 1064765 - protein, 9 aa, Homo Sapiens
EEQDNVYFL

SEQ ID NO: 1064766 - protein, 9 aa, Homo Sapiens
SITVSVCRR

SEQ ID NO: 1064767 - protein, 9 aa, Homo Sapiens
GVTYKNKED

SEQ ID NO: 1064768 - protein, 9 aa, Homo Sapiens
TVSAKKSAS

SEQ ID NO: 1064769 - protein, 9 aa, Homo Sapiens
GQLRELERK

SEQ ID NO: 1064770 - protein, 9 aa, Homo Sapiens
TANLSPSLV

SEQ ID NO: 1064771 - protein, 9 aa, Homo Sapiens
EVIIEISTR

SEQ ID NO: 1064772 - protein, 9 aa, Homo Sapiens
NEEWNEVLN

SEQ ID NO: 1064773 - protein, 9 aa, Homo Sapiens
TKKEWSQDF

SEQ ID NO: 1064774 - protein, 9 aa, Homo Sapiens
PGESGPGGC

SEQ ID NO: 1064775 - protein, 9 aa, Homo Sapiens
DLLKNLNSN

SEQ ID NO: 1064776 - protein, 9 aa, Homo Sapiens
HTPLYLTAE

SEQ ID NO: 1064777 - protein, 9 aa, Homo Sapiens
STILVVKIQ

SEQ ID NO: 1064778 - protein, 9 aa, Homo Sapiens
VMQGMVLSF

SEQ ID NO: 1064779 - protein, 9 aa, Homo Sapiens
SKVLLMEKD

SEQ ID NO: 1064780 - protein, 9 aa, Homo Sapiens
TLFKKKAGH

SEQ ID NO: 1064781 - protein, 9 aa, Homo Sapiens
GYFTFILYL

SEQ ID NO: 1064782 - protein, 9 aa, Homo Sapiens
DASRFLSLF

SEQ ID NO: 1064783 - protein, 9 aa, Homo Sapiens
TQSGCGLLV

SEQ ID NO: 1064784 - protein, 9 aa, Homo Sapiens
NSTDGLAPV

SEQ ID NO: 1064785 - protein, 9 aa, Homo Sapiens
ELFSEIFDA

SEQ ID NO: 1064786 - protein, 9 aa, Homo Sapiens
VMWREMGVS

SEQ ID NO: 1064787 - protein, 9 aa, Homo Sapiens
PVTAYNLYS

SEQ ID NO: 1064788 - protein, 9 aa, Homo Sapiens
REFMGSACG

SEQ ID NO: 1064789 - protein, 9 aa, Homo Sapiens
LSIKQAQTV

SEQ ID NO: 1064790 - protein, 9 aa, Homo Sapiens
RRTLNISHN

SEQ ID NO: 1064791 - protein, 9 aa, Homo Sapiens
GVRVRVVIF

SEQ ID NO: 1064792 - protein, 9 aa, Homo Sapiens
IYVNRTYDE

SEQ ID NO: 1064793 - protein, 9 aa, Homo Sapiens
EDGLSLLFG

SEQ ID NO: 1064794 - protein, 9 aa, Homo Sapiens
VTRDNPRTS

SEQ ID NO: 1064795 - protein, 9 aa, Homo Sapiens
MLQYISKPT

SEQ ID NO: 1064796 - protein, 9 aa, Homo Sapiens
EPVLDNSPP

SEQ ID NO: 1064797 - protein, 9 aa, Homo Sapiens
YVTPCTTSV

SEQ ID NO: 1064798 - protein, 9 aa, Homo Sapiens
SPVFFDNEM

SEQ ID NO: 1064799 - protein, 9 aa, Homo Sapiens
SLELYGTGL

SEQ ID NO: 1064800 - protein, 9 aa, Homo Sapiens
GQALPHLTL

SEQ ID NO: 1064801 - protein, 9 aa, Homo Sapiens
KCSNLYGTE

SEQ ID NO: 1064802 - protein, 9 aa, Homo Sapiens
THQKRWTRE

SEQ ID NO: 1064803 - protein, 9 aa, Homo Sapiens
NHIEVQAEK

SEQ ID NO: 1064804 - protein, 9 aa, Homo Sapiens
TSLVGKNYD

SEQ ID NO: 1064805 - protein, 9 aa, Homo Sapiens
TVMCSCLPG

SEQ ID NO: 1064806 - protein, 9 aa, Homo Sapiens
IHLIEKCLK

SEQ ID NO: 1064807 - protein, 9 aa, Homo Sapiens
MQKLNSRLA

SEQ ID NO: 1064808 - protein, 9 aa, Homo Sapiens
CYVRRHERT

SEQ ID NO: 1064809 - protein, 9 aa, Homo Sapiens
YMASERLQG

SEQ ID NO: 1064810 - protein, 9 aa, Homo Sapiens
HLFNGSLVD

SEQ ID NO: 1064811 - protein, 9 aa, Homo Sapiens
ICECRPRRK

SEQ ID NO: 1064812 - protein, 9 aa, Homo Sapiens
KYVLGDLVS

SEQ ID NO: 1064813 - protein, 9 aa, Homo Sapiens
LFWRQIRSG

SEQ ID NO: 1064814 - protein, 9 aa, Homo Sapiens
IFVCEKGSC

SEQ ID NO: 1064815 - protein, 9 aa, Homo Sapiens
KFLFLFHHT

SEQ ID NO: 1064816 - protein, 9 aa, Homo Sapiens
FYCWVCYRE

SEQ ID NO: 1064817 - protein, 9 aa, Homo Sapiens
SYRFLGEDV

SEQ ID NO: 1064818 - protein, 9 aa, Homo Sapiens
KGKGKKKRK

SEQ ID NO: 1064819 - protein, 9 aa, Homo Sapiens
DLLPTSIFL

SEQ ID NO: 1064820 - protein, 9 aa, Homo Sapiens
AGWCCHDGH

SEQ ID NO: 1064821 - protein, 9 aa, Homo Sapiens
SGFGAVTGV

SEQ ID NO: 1064822 - protein, 9 aa, Homo Sapiens
NFNFFLRRA

SEQ ID NO: 1064823 - protein, 9 aa, Homo Sapiens
NRTQFGEKN

SEQ ID NO: 1064824 - protein, 9 aa, Homo Sapiens
STFCMTAYS

SEQ ID NO: 1064825 - protein, 9 aa, Homo Sapiens
STKKMYEIK

SEQ ID NO: 1064826 - protein, 9 aa, Homo Sapiens
DLRFVDSNG

SEQ ID NO: 1064827 - protein, 9 aa, Homo Sapiens
SLEILYQSA

SEQ ID NO: 1064828 - protein, 9 aa, Homo Sapiens
GIEFSQIYY

SEQ ID NO: 1064829 - protein, 9 aa, Homo Sapiens
GSLSAAGPG

SEQ ID NO: 1064830 - protein, 9 aa, Homo Sapiens
GWRSFSLLE

SEQ ID NO: 1064831 - protein, 9 aa, Homo Sapiens
PRQANHVSR

SEQ ID NO: 1064832 - protein, 9 aa, Homo Sapiens
FSDGCQDIS

SEQ ID NO: 1064833 - protein, 9 aa, Homo Sapiens
ANEIHKKNL

SEQ ID NO: 1064834 - protein, 9 aa, Homo Sapiens
LLKNLNSNA

SEQ ID NO: 1064835 - protein, 9 aa, Homo Sapiens
ICLISIVLF

SEQ ID NO: 1064836 - protein, 9 aa, Homo Sapiens
ELPIPGDGS

SEQ ID NO: 1064837 - protein, 9 aa, Homo Sapiens
QTSSLPEPK

SEQ ID NO: 1064838 - protein, 9 aa, Homo Sapiens
VLNPLLVFI

SEQ ID NO: 1064839 - protein, 9 aa, Homo Sapiens
QCPRRWLPE

SEQ ID NO: 1064840 - protein, 9 aa, Homo Sapiens
AVTAPISGF

SEQ ID NO: 1064841 - protein, 9 aa, Homo Sapiens
EITTSKQST

SEQ ID NO: 1064842 - protein, 9 aa, Homo Sapiens
GLQPGKFYL

SEQ ID NO: 1064843 - protein, 9 aa, Homo Sapiens
PRNYGLTDK

SEQ ID NO: 1064844 - protein, 9 aa, Homo Sapiens
EKAILKQNF

SEQ ID NO: 1064845 - protein, 9 aa, Homo Sapiens
FGMASGDRA

SEQ ID NO: 1064846 - protein, 9 aa, Homo Sapiens
PLPFEFLPS

SEQ ID NO: 1064847 - protein, 9 aa, Homo Sapiens
QALPTVLVT

SEQ ID NO: 1064848 - protein, 9 aa, Homo Sapiens
LCQGSGSLA

SEQ ID NO: 1064849 - protein, 9 aa, Homo Sapiens
QPGTEYCLT

SEQ ID NO: 1064850 - protein, 9 aa, Homo Sapiens
ASPRQLTTP

SEQ ID NO: 1064851 - protein, 9 aa, Homo Sapiens
IVLIFQKPF

SEQ ID NO: 1064852 - protein, 9 aa, Homo Sapiens
FFFSTQAHV

SEQ ID NO: 1064853 - protein, 9 aa, Homo Sapiens
YEKKLKSFL

SEQ ID NO: 1064854 - protein, 9 aa, Homo Sapiens
EICECRPRR

SEQ ID NO: 1064855 - protein, 9 aa, Homo Sapiens
LPRRRFHQD

SEQ ID NO: 1064856 - protein, 9 aa, Homo Sapiens
LHLSVPKST

SEQ ID NO: 1064857 - protein, 9 aa, Homo Sapiens
SALRPHQSE

SEQ ID NO: 1064858 - protein, 9 aa, Homo Sapiens
IPCMLGAQG

SEQ ID NO: 1064859 - protein, 9 aa, Homo Sapiens
VTYFSFDYQ

SEQ ID NO: 1064860 - protein, 9 aa, Homo Sapiens
NQPVCGNEI

SEQ ID NO: 1064861 - protein, 9 aa, Homo Sapiens
LASAVLTDD

SEQ ID NO: 1064862 - protein, 9 aa, Homo Sapiens
PKEVYEDLE

SEQ ID NO: 1064863 - protein, 9 aa, Homo Sapiens
TLSPAQLDL

SEQ ID NO: 1064864 - protein, 9 aa, Homo Sapiens
STNIAFNIL

SEQ ID NO: 1064865 - protein, 9 aa, Homo Sapiens
VAILRSATR

SEQ ID NO: 1064866 - protein, 9 aa, Homo Sapiens
QELEATFQS

SEQ ID NO: 1064867 - protein, 9 aa, Homo Sapiens
YRLEGFWKS

SEQ ID NO: 1064868 - protein, 9 aa, Homo Sapiens
ADSLNICIN

SEQ ID NO: 1064869 - protein, 9 aa, Homo Sapiens
GRMQKEIDY

SEQ ID NO: 1064870 - protein, 9 aa, Homo Sapiens
NSGEASLPG

SEQ ID NO: 1064871 - protein, 9 aa, Homo Sapiens
EGMYIAEKI

SEQ ID NO: 1064872 - protein, 9 aa, Homo Sapiens
QWYKHGSLI

SEQ ID NO: 1064873 - protein, 9 aa, Homo Sapiens
CNCKCGQEE

SEQ ID NO: 1064874 - protein, 9 aa, Homo Sapiens
EYLKALVFV

SEQ ID NO: 1064875 - protein, 9 aa, Homo Sapiens
NTIVLEKAE

SEQ ID NO: 1064876 - protein, 9 aa, Homo Sapiens
LIENAIIIV

SEQ ID NO: 1064877 - protein, 9 aa, Homo Sapiens
LSERLGSWQ

SEQ ID NO: 1064878 - protein, 9 aa, Homo Sapiens
SVLNTIFTP

SEQ ID NO: 1064879 - protein, 9 aa, Homo Sapiens
RPPPQGGNK

SEQ ID NO: 1064880 - protein, 9 aa, Homo Sapiens
HIPGVVKVT

SEQ ID NO: 1064881 - protein, 9 aa, Homo Sapiens
SGTSLLQKV

SEQ ID NO: 1064882 - protein, 9 aa, Homo Sapiens
GVASIADRL

SEQ ID NO: 1064883 - protein, 9 aa, Homo Sapiens
GYISSSPTL

SEQ ID NO: 1064884 - protein, 9 aa, Homo Sapiens
YGLTLSAGN

SEQ ID NO: 1064885 - protein, 9 aa, Homo Sapiens
SLTCMLFFF

SEQ ID NO: 1064886 - protein, 9 aa, Homo Sapiens
SGVLASAVL

SEQ ID NO: 1064887 - protein, 9 aa, Homo Sapiens
RRIPNPTMC

SEQ ID NO: 1064888 - protein, 9 aa, Homo Sapiens
FLWAGVVVL

SEQ ID NO: 1064889 - protein, 9 aa, Homo Sapiens
YTYSRGQII

SEQ ID NO: 1064890 - protein, 9 aa, Homo Sapiens
PELLGSRPR

SEQ ID NO: 1064891 - protein, 9 aa, Homo Sapiens
PPVSPLPKV

SEQ ID NO: 1064892 - protein, 9 aa, Homo Sapiens
RLPSYTPPP

SEQ ID NO: 1064893 - protein, 9 aa, Homo Sapiens
AVLLKLHLD

SEQ ID NO: 1064894 - protein, 9 aa, Homo Sapiens
PLLCALHPQ

SEQ ID NO: 1064895 - protein, 9 aa, Homo Sapiens
RGSILRSLE

SEQ ID NO: 1064896 - protein, 9 aa, Homo Sapiens
RKLAPCILA

SEQ ID NO: 1064897 - protein, 9 aa, Homo Sapiens
LTPSTAAPA

SEQ ID NO: 1064898 - protein, 9 aa, Homo Sapiens
PVILKKARE

SEQ ID NO: 1064899 - protein, 9 aa, Homo Sapiens
SVKANGLPA

SEQ ID NO: 1064900 - protein, 9 aa, Homo Sapiens
FVDKNLDRM

SEQ ID NO: 1064901 - protein, 9 aa, Homo Sapiens
KSMKLKKEE

SEQ ID NO: 1064902 - protein, 9 aa, Homo Sapiens
SGIFVASVE

SEQ ID NO: 1064903 - protein, 9 aa, Homo Sapiens
TTMLLGLGM

SEQ ID NO: 1064904 - protein, 9 aa, Homo Sapiens
QFFVVETAG

SEQ ID NO: 1064905 - protein, 9 aa, Homo Sapiens
GDEESRESD

SEQ ID NO: 1064906 - protein, 9 aa, Homo Sapiens
NILKINENA

SEQ ID NO: 1064907 - protein, 9 aa, Homo Sapiens
CLTHLSETE

SEQ ID NO: 1064908 - protein, 9 aa, Homo Sapiens
DLPAPNNNP

SEQ ID NO: 1064909 - protein, 9 aa, Homo Sapiens
KGLDSAEGS

SEQ ID NO: 1064910 - protein, 9 aa, Homo Sapiens
AASLGSQES

SEQ ID NO: 1064911 - protein, 9 aa, Homo Sapiens
FHTVIFSLL

SEQ ID NO: 1064912 - protein, 9 aa, Homo Sapiens
CGYVTAYGP

SEQ ID NO: 1064913 - protein, 9 aa, Homo Sapiens
KGCENVRVS

SEQ ID NO: 1064914 - protein, 9 aa, Homo Sapiens
QEISRVLSA

SEQ ID NO: 1064915 - protein, 9 aa, Homo Sapiens
WAPALPAFL

SEQ ID NO: 1064916 - protein, 9 aa, Homo Sapiens
LKLTRVTVV

SEQ ID NO: 1064917 - protein, 9 aa, Homo Sapiens
PLNVIFLVN

SEQ ID NO: 1064918 - protein, 9 aa, Homo Sapiens
LEKRTISRP

SEQ ID NO: 1064919 - protein, 9 aa, Homo Sapiens
LQSARRLEF

SEQ ID NO: 1064920 - protein, 9 aa, Homo Sapiens
AKAAETRNL

SEQ ID NO: 1064921 - protein, 9 aa, Homo Sapiens
LLCVKLHNT

SEQ ID NO: 1064922 - protein, 9 aa, Homo Sapiens
FRAYTMDVI

SEQ ID NO: 1064923 - protein, 9 aa, Homo Sapiens
FYNIGTMFL

SEQ ID NO: 1064924 - protein, 9 aa, Homo Sapiens
YITCVILGV

SEQ ID NO: 1064925 - protein, 9 aa, Homo Sapiens
FLLHSPTFS

SEQ ID NO: 1064926 - protein, 9 aa, Homo Sapiens
FCYTCRGGS

SEQ ID NO: 1064927 - protein, 9 aa, Homo Sapiens
TEARELTKA

SEQ ID NO: 1064928 - protein, 9 aa, Homo Sapiens
LVSVTSNPR

SEQ ID NO: 1064929 - protein, 9 aa, Homo Sapiens
LLDVCNETC

SEQ ID NO: 1064930 - protein, 9 aa, Homo Sapiens
AFLVQNKTT

SEQ ID NO: 1064931 - protein, 9 aa, Homo Sapiens
RDKNAFPPT

SEQ ID NO: 1064932 - protein, 9 aa, Homo Sapiens
GVCSGCQGD

SEQ ID NO: 1064933 - protein, 9 aa, Homo Sapiens
LFYQGAAFP

SEQ ID NO: 1064934 - protein, 9 aa, Homo Sapiens
KNKTSVSAK

SEQ ID NO: 1064935 - protein, 9 aa, Homo Sapiens
SPEDSSIYF

SEQ ID NO: 1064936 - protein, 9 aa, Homo Sapiens
AHAVVVRVD

SEQ ID NO: 1064937 - protein, 9 aa, Homo Sapiens
SGEHVKLEE

SEQ ID NO: 1064938 - protein, 9 aa, Homo Sapiens
EEDEEPPRQ

SEQ ID NO: 1064939 - protein, 9 aa, Homo Sapiens
PALFIFMQA

SEQ ID NO: 1064940 - protein, 9 aa, Homo Sapiens
VLTTPCLTP

SEQ ID NO: 1064941 - protein, 9 aa, Homo Sapiens
LFTHQKIYT

SEQ ID NO: 1064942 - protein, 9 aa, Homo Sapiens
KETPKSSKP

SEQ ID NO: 1064943 - protein, 9 aa, Homo Sapiens
KQVISSDTR

SEQ ID NO: 1064944 - protein, 9 aa, Homo Sapiens
GPKGSTRFP

SEQ ID NO: 1064945 - protein, 9 aa, Homo Sapiens
SENFIWEPP

SEQ ID NO: 1064946 - protein, 9 aa, Homo Sapiens
LNHKGEATV

SEQ ID NO: 1064947 - protein, 9 aa, Homo Sapiens
DKNCYEQMK

SEQ ID NO: 1064948 - protein, 9 aa, Homo Sapiens
AAPTLIFEP

SEQ ID NO: 1064949 - protein, 9 aa, Homo Sapiens
LLPKVALAG

SEQ ID NO: 1064950 - protein, 9 aa, Homo Sapiens
LVHILLIKR

SEQ ID NO: 1064951 - protein, 9 aa, Homo Sapiens
QFLTGLYFI

SEQ ID NO: 1064952 - protein, 9 aa, Homo Sapiens
PDSIKFEIG

SEQ ID NO: 1064953 - protein, 9 aa, Homo Sapiens
KELYFCCLH

SEQ ID NO: 1064954 - protein, 9 aa, Homo Sapiens
LEQEVDDVM

SEQ ID NO: 1064955 - protein, 9 aa, Homo Sapiens
QSSTRCTLE

SEQ ID NO: 1064956 - protein, 9 aa, Homo Sapiens
IWLLADDMK

SEQ ID NO: 1064957 - protein, 9 aa, Homo Sapiens
AAFCECLRR

SEQ ID NO: 1064958 - protein, 9 aa, Homo Sapiens
APIKQAPAP

SEQ ID NO: 1064959 - protein, 9 aa, Homo Sapiens
KLNSRLASY

SEQ ID NO: 1064960 - protein, 9 aa, Homo Sapiens
EMHLLEGLV

SEQ ID NO: 1064961 - protein, 9 aa, Homo Sapiens
YEPSKEGQK

SEQ ID NO: 1064962 - protein, 9 aa, Homo Sapiens
YVINKEFCV

SEQ ID NO: 1064963 - protein, 9 aa, Homo Sapiens
PTIFSFSPR

SEQ ID NO: 1064964 - protein, 9 aa, Homo Sapiens
PGVQEEIQV

SEQ ID NO: 1064965 - protein, 9 aa, Homo Sapiens
IMTYYQEVL

SEQ ID NO: 1064966 - protein, 9 aa, Homo Sapiens
ETLYNNSTL

SEQ ID NO: 1064967 - protein, 9 aa, Homo Sapiens
CKHIPLYKW

SEQ ID NO: 1064968 - protein, 9 aa, Homo Sapiens
NETSLMLKW

SEQ ID NO: 1064969 - protein, 9 aa, Homo Sapiens
EINQAFSKR

SEQ ID NO: 1064970 - protein, 9 aa, Homo Sapiens
KKEKNLTKD

SEQ ID NO: 1064971 - protein, 9 aa, Homo Sapiens
IRPEQSKNE

SEQ ID NO: 1064972 - protein, 9 aa, Homo Sapiens
DNTFCMAIS

SEQ ID NO: 1064973 - protein, 9 aa, Homo Sapiens
DPNKGARQE

SEQ ID NO: 1064974 - protein, 9 aa, Homo Sapiens
KPLEWNTSL

SEQ ID NO: 1064975 - protein, 9 aa, Homo Sapiens
RHDQRHAEN

SEQ ID NO: 1064976 - protein, 9 aa, Homo Sapiens
VMYRFCTKN

SEQ ID NO: 1064977 - protein, 9 aa, Homo Sapiens
PSKEVHLAQ

SEQ ID NO: 1064978 - protein, 9 aa, Homo Sapiens
TIFESCDRI

SEQ ID NO: 1064979 - protein, 9 aa, Homo Sapiens
RLCAAALFV

SEQ ID NO: 1064980 - protein, 9 aa, Homo Sapiens
GAASGFGAV

SEQ ID NO: 1064981 - protein, 9 aa, Homo Sapiens
WKRDQKQRR

SEQ ID NO: 1064982 - protein, 9 aa, Homo Sapiens
DRVKSTAYF

SEQ ID NO: 1064983 - protein, 9 aa, Homo Sapiens
LRESSISGA

SEQ ID NO: 1064984 - protein, 9 aa, Homo Sapiens
PAAELGLGA

SEQ ID NO: 1064985 - protein, 9 aa, Homo Sapiens
EMNILIHLS

SEQ ID NO: 1064986 - protein, 9 aa, Homo Sapiens
RIFAGFQTR

SEQ ID NO: 1064987 - protein, 9 aa, Homo Sapiens
IVAARRERL

SEQ ID NO: 1064988 - protein, 9 aa, Homo Sapiens
PCPPDTQEN

SEQ ID NO: 1064989 - protein, 9 aa, Homo Sapiens
NAGSQIDRN

SEQ ID NO: 1064990 - protein, 9 aa, Homo Sapiens
PTISLTAPT

SEQ ID NO: 1064991 - protein, 9 aa, Homo Sapiens
EAQLRKLIF

SEQ ID NO: 1064992 - protein, 9 aa, Homo Sapiens
DKDEDEDGS

SEQ ID NO: 1064993 - protein, 9 aa, Homo Sapiens
EEFIRGHTL

SEQ ID NO: 1064994 - protein, 9 aa, Homo Sapiens
KWFHKNLSP

SEQ ID NO: 1064995 - protein, 9 aa, Homo Sapiens
TTVFSGVFM

SEQ ID NO: 1064996 - protein, 9 aa, Homo Sapiens
FSIMLTPKF

SEQ ID NO: 1064997 - protein, 9 aa, Homo Sapiens
MTIRTKPST

SEQ ID NO: 1064998 - protein, 9 aa, Homo Sapiens
EKILEPFHK

SEQ ID NO: 1064999 - protein, 9 aa, Homo Sapiens
FSHPNVFSL

SEQ ID NO: 1065000 - protein, 9 aa, Homo Sapiens
SRSCAFSQP

SEQ ID NO: 1065001 - protein, 9 aa, Homo Sapiens
ENKTTEISL

SEQ ID NO: 1065002 - protein, 9 aa, Homo Sapiens
QGLGRSCHR

SEQ ID NO: 1065003 - protein, 9 aa, Homo Sapiens
DENSCGLES

SEQ ID NO: 1065004 - protein, 9 aa, Homo Sapiens
TTLRNETLV

SEQ ID NO: 1065005 - protein, 9 aa, Homo Sapiens
FLHKEEKSY

SEQ ID NO: 1065006 - protein, 9 aa, Homo Sapiens
CVSKGLDIE

SEQ ID NO: 1065007 - protein, 9 aa, Homo Sapiens
GGYISKTNE

SEQ ID NO: 1065008 - protein, 9 aa, Homo Sapiens
AWFTYNNLC

SEQ ID NO: 1065009 - protein, 9 aa, Homo Sapiens
MKTVRILLY

SEQ ID NO: 1065010 - protein, 9 aa, Homo Sapiens
WFISPGSMV

SEQ ID NO: 1065011 - protein, 9 aa, Homo Sapiens
SDFFYPKRK

SEQ ID NO: 1065012 - protein, 9 aa, Homo Sapiens
PKRASCNCP

SEQ ID NO: 1065013 - protein, 9 aa, Homo Sapiens
KMKNILGHA

SEQ ID NO: 1065014 - protein, 9 aa, Homo Sapiens
PNPTLPQPQ

SEQ ID NO: 1065015 - protein, 9 aa, Homo Sapiens
VDIACRSIL

SEQ ID NO: 1065016 - protein, 9 aa, Homo Sapiens
GQRLKKRKT

SEQ ID NO: 1065017 - protein, 9 aa, Homo Sapiens
PPSSLVDST

SEQ ID NO: 1065018 - protein, 9 aa, Homo Sapiens
IFYGRDSGN

SEQ ID NO: 1065019 - protein, 9 aa, Homo Sapiens
EMVRHKILL

SEQ ID NO: 1065020 - protein, 9 aa, Homo Sapiens
DVSSQKNVA

SEQ ID NO: 1065021 - protein, 9 aa, Homo Sapiens
GRSCSSLAS

SEQ ID NO: 1065022 - protein, 9 aa, Homo Sapiens
VYRIIPPTS

SEQ ID NO: 1065023 - protein, 9 aa, Homo Sapiens
PLHQVPDAG

SEQ ID NO: 1065024 - protein, 9 aa, Homo Sapiens
LDGISETRE

SEQ ID NO: 1065025 - protein, 9 aa, Homo Sapiens
SEAFETTLE

SEQ ID NO: 1065026 - protein, 9 aa, Homo Sapiens
PPSPERTAD

SEQ ID NO: 1065027 - protein, 9 aa, Homo Sapiens
MAPDSKTTG

SEQ ID NO: 1065028 - protein, 9 aa, Homo Sapiens
DATQGQSRG

SEQ ID NO: 1065029 - protein, 9 aa, Homo Sapiens
CQEMHREFM

SEQ ID NO: 1065030 - protein, 9 aa, Homo Sapiens
RIDTILIQT

SEQ ID NO: 1065031 - protein, 9 aa, Homo Sapiens
IEGYRIGLP

SEQ ID NO: 1065032 - protein, 9 aa, Homo Sapiens
EEAKDVSSY

SEQ ID NO: 1065033 - protein, 9 aa, Homo Sapiens
TGKDKSLNP

SEQ ID NO: 1065034 - protein, 9 aa, Homo Sapiens
VDEFFASVL

SEQ ID NO: 1065035 - protein, 9 aa, Homo Sapiens
QRTPGEKNR

SEQ ID NO: 1065036 - protein, 9 aa, Homo Sapiens
NLLLNKWEN

SEQ ID NO: 1065037 - protein, 9 aa, Homo Sapiens
QNQPVCGNE

SEQ ID NO: 1065038 - protein, 9 aa, Homo Sapiens
TKTKERVGK

SEQ ID NO: 1065039 - protein, 9 aa, Homo Sapiens
AAPHPIDGP

SEQ ID NO: 1065040 - protein, 9 aa, Homo Sapiens
RSSGHCHSD

SEQ ID NO: 1065041 - protein, 9 aa, Homo Sapiens
FQVGKKFEE

SEQ ID NO: 1065042 - protein, 9 aa, Homo Sapiens
SGHCHSDVA

SEQ ID NO: 1065043 - protein, 9 aa, Homo Sapiens
RVAAPNLAD

SEQ ID NO: 1065044 - protein, 9 aa, Homo Sapiens
VCETKSCVA

SEQ ID NO: 1065045 - protein, 9 aa, Homo Sapiens
LNRPFDETT

SEQ ID NO: 1065046 - protein, 9 aa, Homo Sapiens
CPQRTYYHG

SEQ ID NO: 1065047 - protein, 9 aa, Homo Sapiens
TNLTCCVHN

SEQ ID NO: 1065048 - protein, 9 aa, Homo Sapiens
HMSSFHSFP

SEQ ID NO: 1065049 - protein, 9 aa, Homo Sapiens
KNLSPGKPI

SEQ ID NO: 1065050 - protein, 9 aa, Homo Sapiens
KWPSLSETP

SEQ ID NO: 1065051 - protein, 9 aa, Homo Sapiens
AKQTPFSEL

SEQ ID NO: 1065052 - protein, 9 aa, Homo Sapiens
CYLLRYTVI

SEQ ID NO: 1065053 - protein, 9 aa, Homo Sapiens
LTVETSVPL

SEQ ID NO: 1065054 - protein, 9 aa, Homo Sapiens
CLMPHLAQA

SEQ ID NO: 1065055 - protein, 9 aa, Homo Sapiens
NGEVKGRKA

SEQ ID NO: 1065056 - protein, 9 aa, Homo Sapiens
EYPLADIFD

SEQ ID NO: 1065057 - protein, 9 aa, Homo Sapiens
EPPKTGVSH

SEQ ID NO: 1065058 - protein, 9 aa, Homo Sapiens
DTLQNPAPL

SEQ ID NO: 1065059 - protein, 9 aa, Homo Sapiens
YDEKMSELS

SEQ ID NO: 1065060 - protein, 9 aa, Homo Sapiens
PLMFRGVGD

SEQ ID NO: 1065061 - protein, 9 aa, Homo Sapiens
FDCHFLPNK

SEQ ID NO: 1065062 - protein, 9 aa, Homo Sapiens
LFAHKLHPQ

SEQ ID NO: 1065063 - protein, 9 aa, Homo Sapiens
MNESSGLVS

SEQ ID NO: 1065064 - protein, 9 aa, Homo Sapiens
IIFPRGLEY

SEQ ID NO: 1065065 - protein, 9 aa, Homo Sapiens
ILERSYSTE

SEQ ID NO: 1065066 - protein, 9 aa, Homo Sapiens
SFKGKIVMY

SEQ ID NO: 1065067 - protein, 9 aa, Homo Sapiens
KKYKSMKLK

SEQ ID NO: 1065068 - protein, 9 aa, Homo Sapiens
NNVRKSDQR

SEQ ID NO: 1065069 - protein, 9 aa, Homo Sapiens
RGITEYNNQ

SEQ ID NO: 1065070 - protein, 9 aa, Homo Sapiens
TFIPVISQP

SEQ ID NO: 1065071 - protein, 9 aa, Homo Sapiens
KNGNQKLHH

SEQ ID NO: 1065072 - protein, 9 aa, Homo Sapiens
ADAMDTFEG

SEQ ID NO: 1065073 - protein, 9 aa, Homo Sapiens
FVLASYKLY

SEQ ID NO: 1065074 - protein, 9 aa, Homo Sapiens
SFLETELKN

SEQ ID NO: 1065075 - protein, 9 aa, Homo Sapiens
FAVVFSISV

SEQ ID NO: 1065076 - protein, 9 aa, Homo Sapiens
PSLICQKLD

SEQ ID NO: 1065077 - protein, 9 aa, Homo Sapiens
PAGGVIGEP

SEQ ID NO: 1065078 - protein, 9 aa, Homo Sapiens
RRPLGPSSC

SEQ ID NO: 1065079 - protein, 9 aa, Homo Sapiens
PLSVISVFY

SEQ ID NO: 1065080 - protein, 9 aa, Homo Sapiens
ERSPSASTP

SEQ ID NO: 1065081 - protein, 9 aa, Homo Sapiens
ELSCDKLPP

SEQ ID NO: 1065082 - protein, 9 aa, Homo Sapiens
PIVLIFQKP

SEQ ID NO: 1065083 - protein, 9 aa, Homo Sapiens
EKNVWEEMD

SEQ ID NO: 1065084 - protein, 9 aa, Homo Sapiens
SRFGLLPKV

SEQ ID NO: 1065085 - protein, 9 aa, Homo Sapiens
ENPYAGFFK

SEQ ID NO: 1065086 - protein, 9 aa, Homo Sapiens
HKKSHKESH

SEQ ID NO: 1065087 - protein, 9 aa, Homo Sapiens
QTIIHHHIS

SEQ ID NO: 1065088 - protein, 9 aa, Homo Sapiens
IKYKFILND

SEQ ID NO: 1065089 - protein, 9 aa, Homo Sapiens
SVLGLDNIH

SEQ ID NO: 1065090 - protein, 9 aa, Homo Sapiens
LKMMWSMHV

SEQ ID NO: 1065091 - protein, 9 aa, Homo Sapiens
QPAAELGLG

SEQ ID NO: 1065092 - protein, 9 aa, Homo Sapiens
FKKTSICKQ

SEQ ID NO: 1065093 - protein, 9 aa, Homo Sapiens
EQAFSLDIG

SEQ ID NO: 1065094 - protein, 9 aa, Homo Sapiens
VKGYFLAEG

SEQ ID NO: 1065095 - protein, 9 aa, Homo Sapiens
RTMAITSRH

SEQ ID NO: 1065096 - protein, 9 aa, Homo Sapiens
EKLRYREDR

SEQ ID NO: 1065097 - protein, 9 aa, Homo Sapiens
VHDSYEKQG

SEQ ID NO: 1065098 - protein, 9 aa, Homo Sapiens
SNEFSSRDF

SEQ ID NO: 1065099 - protein, 9 aa, Homo Sapiens
GSAMGGLEI

SEQ ID NO: 1065100 - protein, 9 aa, Homo Sapiens
QAKHNLLKQ

SEQ ID NO: 1065101 - protein, 9 aa, Homo Sapiens
LVSVTRVMY

SEQ ID NO: 1065102 - protein, 9 aa, Homo Sapiens
VIIYRAILG

SEQ ID NO: 1065103 - protein, 9 aa, Homo Sapiens
PVRGEHVMR

SEQ ID NO: 1065104 - protein, 9 aa, Homo Sapiens
LPGSHTEPQ

SEQ ID NO: 1065105 - protein, 9 aa, Homo Sapiens
ITRSKAKEL

SEQ ID NO: 1065106 - protein, 9 aa, Homo Sapiens
CRPRRSHFF

SEQ ID NO: 1065107 - protein, 9 aa, Homo Sapiens
LSSSYHNDA

SEQ ID NO: 1065108 - protein, 9 aa, Homo Sapiens
DRYGGGGYY

SEQ ID NO: 1065109 - protein, 9 aa, Homo Sapiens
IRPGKNSKN

SEQ ID NO: 1065110 - protein, 9 aa, Homo Sapiens
SKGVMLKND

SEQ ID NO: 1065111 - protein, 9 aa, Homo Sapiens
NEDCFGMWI

SEQ ID NO: 1065112 - protein, 9 aa, Homo Sapiens
KTTSTTLRY

SEQ ID NO: 1065113 - protein, 9 aa, Homo Sapiens
QLNKETDSV

SEQ ID NO: 1065114 - protein, 9 aa, Homo Sapiens
IVTYGKISY

SEQ ID NO: 1065115 - protein, 9 aa, Homo Sapiens
VCEESSPPP

SEQ ID NO: 1065116 - protein, 9 aa, Homo Sapiens
RVVMWREMG

SEQ ID NO: 1065117 - protein, 9 aa, Homo Sapiens
EELLGQRNR

SEQ ID NO: 1065118 - protein, 9 aa, Homo Sapiens
PFIYTLCNK

SEQ ID NO: 1065119 - protein, 9 aa, Homo Sapiens
KEEETEKAA

SEQ ID NO: 1065120 - protein, 9 aa, Homo Sapiens
GFGFELTFC

SEQ ID NO: 1065121 - protein, 9 aa, Homo Sapiens
QTPFSELGL

SEQ ID NO: 1065122 - protein, 9 aa, Homo Sapiens
PGLPSRMEP

SEQ ID NO: 1065123 - protein, 9 aa, Homo Sapiens
RLGVASLPP

SEQ ID NO: 1065124 - protein, 9 aa, Homo Sapiens
ADDLPPRPE

SEQ ID NO: 1065125 - protein, 9 aa, Homo Sapiens
VQFDLLHKY

SEQ ID NO: 1065126 - protein, 9 aa, Homo Sapiens
RFGKHLFPV

SEQ ID NO: 1065127 - protein, 9 aa, Homo Sapiens
RTHFMDFLG

SEQ ID NO: 1065128 - protein, 9 aa, Homo Sapiens
ITCVILGVI

SEQ ID NO: 1065129 - protein, 9 aa, Homo Sapiens
ANTLFWAVV

SEQ ID NO: 1065130 - protein, 9 aa, Homo Sapiens
TKAPRLLLW

SEQ ID NO: 1065131 - protein, 9 aa, Homo Sapiens
TAKVFFNKP

SEQ ID NO: 1065132 - protein, 9 aa, Homo Sapiens
CWDLMDQIG

SEQ ID NO: 1065133 - protein, 9 aa, Homo Sapiens
AGPGGLGNG

SEQ ID NO: 1065134 - protein, 9 aa, Homo Sapiens
EQLAYLWMK

SEQ ID NO: 1065135 - protein, 9 aa, Homo Sapiens
FLLDMVYRS

SEQ ID NO: 1065136 - protein, 9 aa, Homo Sapiens
FLVSSPCMA

SEQ ID NO: 1065137 - protein, 9 aa, Homo Sapiens
RDKFSGIVS

SEQ ID NO: 1065138 - protein, 9 aa, Homo Sapiens
ILEELEKGS

SEQ ID NO: 1065139 - protein, 9 aa, Homo Sapiens
RSSKALILH

SEQ ID NO: 1065140 - protein, 9 aa, Homo Sapiens
SAMKHIVIL

SEQ ID NO: 1065141 - protein, 9 aa, Homo Sapiens
FLPLLVYYY

SEQ ID NO: 1065142 - protein, 9 aa, Homo Sapiens
FDMADRVKT

SEQ ID NO: 1065143 - protein, 9 aa, Homo Sapiens
FRVDSAEFG

SEQ ID NO: 1065144 - protein, 9 aa, Homo Sapiens
TEHNECGSG

SEQ ID NO: 1065145 - protein, 9 aa, Homo Sapiens
KKLFGLDTL

SEQ ID NO: 1065146 - protein, 9 aa, Homo Sapiens
PQNASMSEF

SEQ ID NO: 1065147 - protein, 9 aa, Homo Sapiens
SVNPGLDEP

SEQ ID NO: 1065148 - protein, 9 aa, Homo Sapiens
LENLLLNKW

SEQ ID NO: 1065149 - protein, 9 aa, Homo Sapiens
CVCKSCQGK

SEQ ID NO: 1065150 - protein, 9 aa, Homo Sapiens
LNSSRRQYQ

SEQ ID NO: 1065151 - protein, 9 aa, Homo Sapiens
VRVMAIYKQ

SEQ ID NO: 1065152 - protein, 9 aa, Homo Sapiens
VQDLIRAVF

SEQ ID NO: 1065153 - protein, 9 aa, Homo Sapiens
TLPREVRGG

SEQ ID NO: 1065154 - protein, 9 aa, Homo Sapiens
CFQDTGLLL

SEQ ID NO: 1065155 - protein, 9 aa, Homo Sapiens
FGKSAMKHI

SEQ ID NO: 1065156 - protein, 9 aa, Homo Sapiens
PIRIVDGYE

SEQ ID NO: 1065157 - protein, 9 aa, Homo Sapiens
DDFCYCKVN

SEQ ID NO: 1065158 - protein, 9 aa, Homo Sapiens
LLSPKVRRL

SEQ ID NO: 1065159 - protein, 9 aa, Homo Sapiens
PEVFSAFVT

SEQ ID NO: 1065160 - protein, 9 aa, Homo Sapiens
TPMSLSSSQ

SEQ ID NO: 1065161 - protein, 9 aa, Homo Sapiens
PGSSGGGPR

SEQ ID NO: 1065162 - protein, 9 aa, Homo Sapiens
QEFILRASP

SEQ ID NO: 1065163 - protein, 9 aa, Homo Sapiens
LGDSGVFGN

SEQ ID NO: 1065164 - protein, 9 aa, Homo Sapiens
LDSANPTTW

SEQ ID NO: 1065165 - protein, 9 aa, Homo Sapiens
YPKTKAFIT

SEQ ID NO: 1065166 - protein, 9 aa, Homo Sapiens
VLEISRNTE

SEQ ID NO: 1065167 - protein, 9 aa, Homo Sapiens
ELFQNSGNT

SEQ ID NO: 1065168 - protein, 9 aa, Homo Sapiens
LSLHQRIYT

SEQ ID NO: 1065169 - protein, 9 aa, Homo Sapiens
RIPSLHLFL

SEQ ID NO: 1065170 - protein, 9 aa, Homo Sapiens
SSRSAVLRT

SEQ ID NO: 1065171 - protein, 9 aa, Homo Sapiens
QNGPRRLYA

SEQ ID NO: 1065172 - protein, 9 aa, Homo Sapiens
ILHKFVLKR

SEQ ID NO: 1065173 - protein, 9 aa, Homo Sapiens
NGTDNFRDP

SEQ ID NO: 1065174 - protein, 9 aa, Homo Sapiens
RIPWYFLSE

SEQ ID NO: 1065175 - protein, 9 aa, Homo Sapiens
SSHPEDNWM

SEQ ID NO: 1065176 - protein, 9 aa, Homo Sapiens
VSGVLASAV

SEQ ID NO: 1065177 - protein, 9 aa, Homo Sapiens
HIRTITSIV

SEQ ID NO: 1065178 - protein, 9 aa, Homo Sapiens
GSADTVRSS

SEQ ID NO: 1065179 - protein, 9 aa, Homo Sapiens
SLVCKALSG

SEQ ID NO: 1065180 - protein, 9 aa, Homo Sapiens
MIRPEQSKN

SEQ ID NO: 1065181 - protein, 9 aa, Homo Sapiens
FSGPSFPKN

SEQ ID NO: 1065182 - protein, 9 aa, Homo Sapiens
IENKVCNCY

SEQ ID NO: 1065183 - protein, 9 aa, Homo Sapiens
DRIINESYN

SEQ ID NO: 1065184 - protein, 9 aa, Homo Sapiens
KNWEYIQDP

SEQ ID NO: 1065185 - protein, 9 aa, Homo Sapiens
SLHSTFVCP

SEQ ID NO: 1065186 - protein, 9 aa, Homo Sapiens
SPLMLQYIS

SEQ ID NO: 1065187 - protein, 9 aa, Homo Sapiens
NLIDTELMD

SEQ ID NO: 1065188 - protein, 9 aa, Homo Sapiens
LTSNYIFFM

SEQ ID NO: 1065189 - protein, 9 aa, Homo Sapiens
TLGSTFNEN

SEQ ID NO: 1065190 - protein, 9 aa, Homo Sapiens
VVIFAFSLH

SEQ ID NO: 1065191 - protein, 9 aa, Homo Sapiens
PVVELWQKD

SEQ ID NO: 1065192 - protein, 9 aa, Homo Sapiens
YTLRNRNMK

SEQ ID NO: 1065193 - protein, 9 aa, Homo Sapiens
LYPALLTDG

SEQ ID NO: 1065194 - protein, 9 aa, Homo Sapiens
ARGGDRESS

SEQ ID NO: 1065195 - protein, 9 aa, Homo Sapiens
TARVVMWRE

SEQ ID NO: 1065196 - protein, 9 aa, Homo Sapiens
LPAKSTLIL

SEQ ID NO: 1065197 - protein, 9 aa, Homo Sapiens
MIAIEGGHA

SEQ ID NO: 1065198 - protein, 9 aa, Homo Sapiens
FDNYFEGAQ

SEQ ID NO: 1065199 - protein, 9 aa, Homo Sapiens
NIVSEKTIF

SEQ ID NO: 1065200 - protein, 9 aa, Homo Sapiens
RPRSRISVL

SEQ ID NO: 1065201 - protein, 9 aa, Homo Sapiens
QKAGPGETE

SEQ ID NO: 1065202 - protein, 9 aa, Homo Sapiens
RERSSRRER

SEQ ID NO: 1065203 - protein, 9 aa, Homo Sapiens
RLHAQLHCR

SEQ ID NO: 1065204 - protein, 9 aa, Homo Sapiens
NSQCTKVEK

SEQ ID NO: 1065205 - protein, 9 aa, Homo Sapiens
SLLSVYLKK

SEQ ID NO: 1065206 - protein, 9 aa, Homo Sapiens
KLCRLKLLA

SEQ ID NO: 1065207 - protein, 9 aa, Homo Sapiens
SLQFHILQL

SEQ ID NO: 1065208 - protein, 9 aa, Homo Sapiens
EKLSDISTR

SEQ ID NO: 1065209 - protein, 9 aa, Homo Sapiens
SLLTFFCVC

SEQ ID NO: 1065210 - protein, 9 aa, Homo Sapiens
PPNILNANL

SEQ ID NO: 1065211 - protein, 9 aa, Homo Sapiens
VFGQLAAVS

SEQ ID NO: 1065212 - protein, 9 aa, Homo Sapiens
YLLQKLSCL

SEQ ID NO: 1065213 - protein, 9 aa, Homo Sapiens
DEVHEQTEE

SEQ ID NO: 1065214 - protein, 9 aa, Homo Sapiens
PCSFKDQTP

SEQ ID NO: 1065215 - protein, 9 aa, Homo Sapiens
GCENVRVSG

SEQ ID NO: 1065216 - protein, 9 aa, Homo Sapiens
TVDQWKIDR

SEQ ID NO: 1065217 - protein, 9 aa, Homo Sapiens
RMQKGINFV

SEQ ID NO: 1065218 - protein, 9 aa, Homo Sapiens
LPAFWFNPF

SEQ ID NO: 1065219 - protein, 9 aa, Homo Sapiens
ELVCSAETH

SEQ ID NO: 1065220 - protein, 9 aa, Homo Sapiens
ANTSCQDGY

SEQ ID NO: 1065221 - protein, 9 aa, Homo Sapiens
VAIVRAGVS

SEQ ID NO: 1065222 - protein, 9 aa, Homo Sapiens
HCSEPLKLM

SEQ ID NO: 1065223 - protein, 9 aa, Homo Sapiens
QALREELEL

SEQ ID NO: 1065224 - protein, 9 aa, Homo Sapiens
SAVLLIGLP

SEQ ID NO: 1065225 - protein, 9 aa, Homo Sapiens
NETVVRLYQ

SEQ ID NO: 1065226 - protein, 9 aa, Homo Sapiens
RQYLPSGIE

SEQ ID NO: 1065227 - protein, 9 aa, Homo Sapiens
KEKVIDVDH

SEQ ID NO: 1065228 - protein, 9 aa, Homo Sapiens
PAFSNQTYS

SEQ ID NO: 1065229 - protein, 9 aa, Homo Sapiens
YGDIPCELI

SEQ ID NO: 1065230 - protein, 9 aa, Homo Sapiens
KENDEHEAG

SEQ ID NO: 1065231 - protein, 9 aa, Homo Sapiens
EIKEDSDIA

SEQ ID NO: 1065232 - protein, 9 aa, Homo Sapiens
LFIYIEKQL

SEQ ID NO: 1065233 - protein, 9 aa, Homo Sapiens
LETCVIQEV

SEQ ID NO: 1065234 - protein, 9 aa, Homo Sapiens
VPFILGLPP

SEQ ID NO: 1065235 - protein, 9 aa, Homo Sapiens
LLQKLSCLG

SEQ ID NO: 1065236 - protein, 9 aa, Homo Sapiens
CSSHPEDNW

SEQ ID NO: 1065237 - protein, 9 aa, Homo Sapiens
KIPVFVWMK

SEQ ID NO: 1065238 - protein, 9 aa, Homo Sapiens
KAREQDPLQ

SEQ ID NO: 1065239 - protein, 9 aa, Homo Sapiens
CLVQRMGRT

SEQ ID NO: 1065240 - protein, 9 aa, Homo Sapiens
NSESLSSKP

SEQ ID NO: 1065241 - protein, 9 aa, Homo Sapiens
LHSTFVCPS

SEQ ID NO: 1065242 - protein, 9 aa, Homo Sapiens
FPNCSAPLV

SEQ ID NO: 1065243 - protein, 9 aa, Homo Sapiens
WLGMESDLS

SEQ ID NO: 1065244 - protein, 9 aa, Homo Sapiens
KKYKYEVEK

SEQ ID NO: 1065245 - protein, 9 aa, Homo Sapiens
VYWETMSST

SEQ ID NO: 1065246 - protein, 9 aa, Homo Sapiens
HCGSRSQSS

SEQ ID NO: 1065247 - protein, 9 aa, Homo Sapiens
KFYVLLGEA

SEQ ID NO: 1065248 - protein, 9 aa, Homo Sapiens
EDPNFLEAI

SEQ ID NO: 1065249 - protein, 9 aa, Homo Sapiens
QQENLKRLK

SEQ ID NO: 1065250 - protein, 9 aa, Homo Sapiens
TDCVDQTWN

SEQ ID NO: 1065251 - protein, 9 aa, Homo Sapiens
PNRGRPTVA

SEQ ID NO: 1065252 - protein, 9 aa, Homo Sapiens
FLKEIMENP

SEQ ID NO: 1065253 - protein, 9 aa, Homo Sapiens
NAGLEDIQS

SEQ ID NO: 1065254 - protein, 9 aa, Homo Sapiens
TLVLDEGAE

SEQ ID NO: 1065255 - protein, 9 aa, Homo Sapiens
ISHNLHSLL

SEQ ID NO: 1065256 - protein, 9 aa, Homo Sapiens
VIEGNSEKA

SEQ ID NO: 1065257 - protein, 9 aa, Homo Sapiens
CMMTPKFKR

SEQ ID NO: 1065258 - protein, 9 aa, Homo Sapiens
DLMDQIGEM

SEQ ID NO: 1065259 - protein, 9 aa, Homo Sapiens
KSGQQAEPL

SEQ ID NO: 1065260 - protein, 9 aa, Homo Sapiens
DKDVFQGKE

SEQ ID NO: 1065261 - protein, 9 aa, Homo Sapiens
SAHGLNLQN

SEQ ID NO: 1065262 - protein, 9 aa, Homo Sapiens
AELAARRRS

SEQ ID NO: 1065263 - protein, 9 aa, Homo Sapiens
PLFVVLLIL

SEQ ID NO: 1065264 - protein, 9 aa, Homo Sapiens
PQAHTVGTE

SEQ ID NO: 1065265 - protein, 9 aa, Homo Sapiens
RAAPEGAQG

SEQ ID NO: 1065266 - protein, 9 aa, Homo Sapiens
ARNLDTGTN

SEQ ID NO: 1065267 - protein, 9 aa, Homo Sapiens
LPVSLPESP

SEQ ID NO: 1065268 - protein, 9 aa, Homo Sapiens
LYHSANQLS

SEQ ID NO: 1065269 - protein, 9 aa, Homo Sapiens
AKKAQAMCT

SEQ ID NO: 1065270 - protein, 9 aa, Homo Sapiens
CPYKDGALK

SEQ ID NO: 1065271 - protein, 9 aa, Homo Sapiens
SSSLLEFVS

SEQ ID NO: 1065272 - protein, 9 aa, Homo Sapiens
ALEKPICLT

SEQ ID NO: 1065273 - protein, 9 aa, Homo Sapiens
GLDEPGVVS

SEQ ID NO: 1065274 - protein, 9 aa, Homo Sapiens
PSPRSQGQR

SEQ ID NO: 1065275 - protein, 9 aa, Homo Sapiens
RRKDKTYPI

SEQ ID NO: 1065276 - protein, 9 aa, Homo Sapiens
NRTYAEINQ

SEQ ID NO: 1065277 - protein, 9 aa, Homo Sapiens
LGNIASKRE

SEQ ID NO: 1065278 - protein, 9 aa, Homo Sapiens
PSRCYFYDG

SEQ ID NO: 1065279 - protein, 9 aa, Homo Sapiens
EQTVLQLWD

SEQ ID NO: 1065280 - protein, 9 aa, Homo Sapiens
LGFQDSKFY

SEQ ID NO: 1065281 - protein, 9 aa, Homo Sapiens
HLFTETEII

SEQ ID NO: 1065282 - protein, 9 aa, Homo Sapiens
NDEIMLRLL

SEQ ID NO: 1065283 - protein, 9 aa, Homo Sapiens
ESDSLGQDM

SEQ ID NO: 1065284 - protein, 9 aa, Homo Sapiens
MSNRRNESA

SEQ ID NO: 1065285 - protein, 9 aa, Homo Sapiens
RGRPSQEPS

SEQ ID NO: 1065286 - protein, 9 aa, Homo Sapiens
ERKRPAPPC

SEQ ID NO: 1065287 - protein, 9 aa, Homo Sapiens
CSAPENPIF

SEQ ID NO: 1065288 - protein, 9 aa, Homo Sapiens
DLAADCINR

SEQ ID NO: 1065289 - protein, 9 aa, Homo Sapiens
WNEFSSRRP

SEQ ID NO: 1065290 - protein, 9 aa, Homo Sapiens
RGLQSDQNT

SEQ ID NO: 1065291 - protein, 9 aa, Homo Sapiens
GWRQCLLIS

SEQ ID NO: 1065292 - protein, 9 aa, Homo Sapiens
KCCRKNCLK

SEQ ID NO: 1065293 - protein, 9 aa, Homo Sapiens
QGKMREIEK

SEQ ID NO: 1065294 - protein, 9 aa, Homo Sapiens
VPGERREKG

SEQ ID NO: 1065295 - protein, 9 aa, Homo Sapiens
PGFSQNSNT

SEQ ID NO: 1065296 - protein, 9 aa, Homo Sapiens
KTNIQGMTE

SEQ ID NO: 1065297 - protein, 9 aa, Homo Sapiens
TLQNPAPLE

SEQ ID NO: 1065298 - protein, 9 aa, Homo Sapiens
QVMDLPTAR

SEQ ID NO: 1065299 - protein, 9 aa, Homo Sapiens
KLQKLDKSD

SEQ ID NO: 1065300 - protein, 9 aa, Homo Sapiens
SDVTSTTFS

SEQ ID NO: 1065301 - protein, 9 aa, Homo Sapiens
KISKRMFKE

SEQ ID NO: 1065302 - protein, 9 aa, Homo Sapiens
ARRAFATCF

SEQ ID NO: 1065303 - protein, 9 aa, Homo Sapiens
VDNPNKTAA

SEQ ID NO: 1065304 - protein, 9 aa, Homo Sapiens
GATCAMKWN

SEQ ID NO: 1065305 - protein, 9 aa, Homo Sapiens
QHMLIYSGI

SEQ ID NO: 1065306 - protein, 9 aa, Homo Sapiens
YPLEFHQRP

SEQ ID NO: 1065307 - protein, 9 aa, Homo Sapiens
RPSQEPSLA

SEQ ID NO: 1065308 - protein, 9 aa, Homo Sapiens
FSSHHQRFS

SEQ ID NO: 1065309 - protein, 9 aa, Homo Sapiens
GPLGSSGPP

SEQ ID NO: 1065310 - protein, 9 aa, Homo Sapiens
GIVSSSSCS

SEQ ID NO: 1065311 - protein, 9 aa, Homo Sapiens
GKASNRSSH

SEQ ID NO: 1065312 - protein, 9 aa, Homo Sapiens
SQACLLVLS

SEQ ID NO: 1065313 - protein, 9 aa, Homo Sapiens
VQRDAVKTV

SEQ ID NO: 1065314 - protein, 9 aa, Homo Sapiens
FISLGISIM

SEQ ID NO: 1065315 - protein, 9 aa, Homo Sapiens
LHDPGASAQ

SEQ ID NO: 1065316 - protein, 9 aa, Homo Sapiens
LKKKNLYLS

SEQ ID NO: 1065317 - protein, 9 aa, Homo Sapiens
NDLSDYTAL

SEQ ID NO: 1065318 - protein, 9 aa, Homo Sapiens
GEKIPVFVW

SEQ ID NO: 1065319 - protein, 9 aa, Homo Sapiens
LDIEGAAGG

SEQ ID NO: 1065320 - protein, 9 aa, Homo Sapiens
RQMHTANLP

SEQ ID NO: 1065321 - protein, 9 aa, Homo Sapiens
DTQGQTNVM

SEQ ID NO: 1065322 - protein, 9 aa, Homo Sapiens
DTPAEICAR

SEQ ID NO: 1065323 - protein, 9 aa, Homo Sapiens
AHCACGWQK

SEQ ID NO: 1065324 - protein, 9 aa, Homo Sapiens
FYQHQHQHQ

SEQ ID NO: 1065325 - protein, 9 aa, Homo Sapiens
ETTKKEWSQ

SEQ ID NO: 1065326 - protein, 9 aa, Homo Sapiens
KLRRRGLPV

SEQ ID NO: 1065327 - protein, 9 aa, Homo Sapiens
DEEIKFDIY

SEQ ID NO: 1065328 - protein, 9 aa, Homo Sapiens
SHPSYTNTP

SEQ ID NO: 1065329 - protein, 9 aa, Homo Sapiens
TVVLSPLNF

SEQ ID NO: 1065330 - protein, 9 aa, Homo Sapiens
GTSLLQKVV

SEQ ID NO: 1065331 - protein, 9 aa, Homo Sapiens
KLEKKKILV

SEQ ID NO: 1065332 - protein, 9 aa, Homo Sapiens
ESVFEKALM

SEQ ID NO: 1065333 - protein, 9 aa, Homo Sapiens
SRVLSAQRS

SEQ ID NO: 1065334 - protein, 9 aa, Homo Sapiens
PSPRPTPPP

SEQ ID NO: 1065335 - protein, 9 aa, Homo Sapiens
NSNLNVSKE

SEQ ID NO: 1065336 - protein, 9 aa, Homo Sapiens
GVWKLASMF

SEQ ID NO: 1065337 - protein, 9 aa, Homo Sapiens
QQIFMKNHF

SEQ ID NO: 1065338 - protein, 9 aa, Homo Sapiens
STRACEGQE

SEQ ID NO: 1065339 - protein, 9 aa, Homo Sapiens
DDVMRIFGG

SEQ ID NO: 1065340 - protein, 9 aa, Homo Sapiens
TLLGVSFQG

SEQ ID NO: 1065341 - protein, 9 aa, Homo Sapiens
GLSPHPRHL

SEQ ID NO: 1065342 - protein, 9 aa, Homo Sapiens
LDENKLKAL

SEQ ID NO: 1065343 - protein, 9 aa, Homo Sapiens
IKSKEGRAK

SEQ ID NO: 1065344 - protein, 9 aa, Homo Sapiens
LHIGTMNGC

SEQ ID NO: 1065345 - protein, 9 aa, Homo Sapiens
ENKNETLHN

SEQ ID NO: 1065346 - protein, 9 aa, Homo Sapiens
DLRRKSVLG

SEQ ID NO: 1065347 - protein, 9 aa, Homo Sapiens
TAQPPELQP

SEQ ID NO: 1065348 - protein, 9 aa, Homo Sapiens
QSMEDRMKC

SEQ ID NO: 1065349 - protein, 9 aa, Homo Sapiens
FFGLAMGTT

SEQ ID NO: 1065350 - protein, 9 aa, Homo Sapiens
QYIRAALSV

SEQ ID NO: 1065351 - protein, 9 aa, Homo Sapiens
ENAGLGNGG

SEQ ID NO: 1065352 - protein, 9 aa, Homo Sapiens
NELVMEILS

SEQ ID NO: 1065353 - protein, 9 aa, Homo Sapiens
TVDETILLL

SEQ ID NO: 1065354 - protein, 9 aa, Homo Sapiens
MKVPGSENK

SEQ ID NO: 1065355 - protein, 9 aa, Homo Sapiens
EAAKLKLQK

SEQ ID NO: 1065356 - protein, 9 aa, Homo Sapiens
VSRVDPKMR

SEQ ID NO: 1065357 - protein, 9 aa, Homo Sapiens
YLNLGGFIG

SEQ ID NO: 1065358 - protein, 9 aa, Homo Sapiens
LASMFKGVG

SEQ ID NO: 1065359 - protein, 9 aa, Homo Sapiens
GMVPESEFS

SEQ ID NO: 1065360 - protein, 9 aa, Homo Sapiens
TMQKLNSRL

SEQ ID NO: 1065361 - protein, 9 aa, Homo Sapiens
KQASQREDD

SEQ ID NO: 1065362 - protein, 9 aa, Homo Sapiens
ESQDSLSKE

SEQ ID NO: 1065363 - protein, 9 aa, Homo Sapiens
VNLTFTKDK

SEQ ID NO: 1065364 - protein, 9 aa, Homo Sapiens
RVLPDHTKP

SEQ ID NO: 1065365 - protein, 9 aa, Homo Sapiens
LRKPLIREN

SEQ ID NO: 1065366 - protein, 9 aa, Homo Sapiens
PTLREFTRP

SEQ ID NO: 1065367 - protein, 9 aa, Homo Sapiens
RHSQKRWER

SEQ ID NO: 1065368 - protein, 9 aa, Homo Sapiens
LFGTDYRNL

SEQ ID NO: 1065369 - protein, 9 aa, Homo Sapiens
QVGGGGRFQ

SEQ ID NO: 1065370 - protein, 9 aa, Homo Sapiens
AASDENHCP

SEQ ID NO: 1065371 - protein, 9 aa, Homo Sapiens
ACFVADNKK

SEQ ID NO: 1065372 - protein, 9 aa, Homo Sapiens
LDTMMASML

SEQ ID NO: 1065373 - protein, 9 aa, Homo Sapiens
SLAGRPGKP

SEQ ID NO: 1065374 - protein, 9 aa, Homo Sapiens
DVQERRAQE

SEQ ID NO: 1065375 - protein, 9 aa, Homo Sapiens
DNAVYECQA

SEQ ID NO: 1065376 - protein, 9 aa, Homo Sapiens
LVNIHSMNF

SEQ ID NO: 1065377 - protein, 9 aa, Homo Sapiens
NVIFLVNSG

SEQ ID NO: 1065378 - protein, 9 aa, Homo Sapiens
GSAASGASA

SEQ ID NO: 1065379 - protein, 9 aa, Homo Sapiens
VELWQKDSF

SEQ ID NO: 1065380 - protein, 9 aa, Homo Sapiens
FQRTPRGIP

SEQ ID NO: 1065381 - protein, 9 aa, Homo Sapiens
LWSGPGLEN

SEQ ID NO: 1065382 - protein, 9 aa, Homo Sapiens
KIKNFMDGK

SEQ ID NO: 1065383 - protein, 9 aa, Homo Sapiens
HDPQVAVDV

SEQ ID NO: 1065384 - protein, 9 aa, Homo Sapiens
GHPRPQEKN

SEQ ID NO: 1065385 - protein, 9 aa, Homo Sapiens
NTMCQFLTG

SEQ ID NO: 1065386 - protein, 9 aa, Homo Sapiens
GFTRTLKLC

SEQ ID NO: 1065387 - protein, 9 aa, Homo Sapiens
LWASLRLVA

SEQ ID NO: 1065388 - protein, 9 aa, Homo Sapiens
TQVYLSHIA

SEQ ID NO: 1065389 - protein, 9 aa, Homo Sapiens
RAVFGQLAA

SEQ ID NO: 1065390 - protein, 9 aa, Homo Sapiens
SRGVGEAVP

SEQ ID NO: 1065391 - protein, 9 aa, Homo Sapiens
RSSFFIRHL

SEQ ID NO: 1065392 - protein, 9 aa, Homo Sapiens
PSLQLPQYP

SEQ ID NO: 1065393 - protein, 9 aa, Homo Sapiens
LDPGSQCSL

SEQ ID NO: 1065394 - protein, 9 aa, Homo Sapiens
PKHLEQQKK

SEQ ID NO: 1065395 - protein, 9 aa, Homo Sapiens
YTRYHPIDY

SEQ ID NO: 1065396 - protein, 9 aa, Homo Sapiens
LQQKQANRS

SEQ ID NO: 1065397 - protein, 9 aa, Homo Sapiens
PGGLGNGLR

SEQ ID NO: 1065398 - protein, 9 aa, Homo Sapiens
SLNSSRRQY

SEQ ID NO: 1065399 - protein, 9 aa, Homo Sapiens
EKQYQCKVC

SEQ ID NO: 1065400 - protein, 9 aa, Homo Sapiens
EETTKKEWS

SEQ ID NO: 1065401 - protein, 9 aa, Homo Sapiens
QETRTYLFD

SEQ ID NO: 1065402 - protein, 9 aa, Homo Sapiens
DGTPEGLVT

SEQ ID NO: 1065403 - protein, 9 aa, Homo Sapiens
TLELSCDKL

SEQ ID NO: 1065404 - protein, 9 aa, Homo Sapiens
LRRTEHRAP

SEQ ID NO: 1065405 - protein, 9 aa, Homo Sapiens
VKKYLDVIS

SEQ ID NO: 1065406 - protein, 9 aa, Homo Sapiens
TTFARRAMD

SEQ ID NO: 1065407 - protein, 9 aa, Homo Sapiens
VDSNGELAP

SEQ ID NO: 1065408 - protein, 9 aa, Homo Sapiens
YNLYSHTSI

SEQ ID NO: 1065409 - protein, 9 aa, Homo Sapiens
LLRLHAQLH

SEQ ID NO: 1065410 - protein, 9 aa, Homo Sapiens
IVCKDGQWQ

SEQ ID NO: 1065411 - protein, 9 aa, Homo Sapiens
QISRNHSSI

SEQ ID NO: 1065412 - protein, 9 aa, Homo Sapiens
LEISRNTED

SEQ ID NO: 1065413 - protein, 9 aa, Homo Sapiens
LSPGMTIDL

SEQ ID NO: 1065414 - protein, 9 aa, Homo Sapiens
QIISFSTEV

SEQ ID NO: 1065415 - protein, 9 aa, Homo Sapiens
ALALTLQNI

SEQ ID NO: 1065416 - protein, 9 aa, Homo Sapiens
SCPERLRLV

SEQ ID NO: 1065417 - protein, 9 aa, Homo Sapiens
STGLCKLCG

SEQ ID NO: 1065418 - protein, 9 aa, Homo Sapiens
QQYKMVIEA

SEQ ID NO: 1065419 - protein, 9 aa, Homo Sapiens
VCSGCQGDS

SEQ ID NO: 1065420 - protein, 9 aa, Homo Sapiens
QIANFSSGN

SEQ ID NO: 1065421 - protein, 9 aa, Homo Sapiens
GLCKLCGQL

SEQ ID NO: 1065422 - protein, 9 aa, Homo Sapiens
VIIKFLGEE

SEQ ID NO: 1065423 - protein, 9 aa, Homo Sapiens
GMFFFVSFK

SEQ ID NO: 1065424 - protein, 9 aa, Homo Sapiens
ELGDSLLAE

SEQ ID NO: 1065425 - protein, 9 aa, Homo Sapiens
LPEPLNVIF

SEQ ID NO: 1065426 - protein, 9 aa, Homo Sapiens
RKGINVWKC

SEQ ID NO: 1065427 - protein, 9 aa, Homo Sapiens
GFGARIPLE

SEQ ID NO: 1065428 - protein, 9 aa, Homo Sapiens
NKDEKIQKS

SEQ ID NO: 1065429 - protein, 9 aa, Homo Sapiens
QERKNARSQ

SEQ ID NO: 1065430 - protein, 9 aa, Homo Sapiens
SAPENPIFR

SEQ ID NO: 1065431 - protein, 9 aa, Homo Sapiens
VLLLARDKD

SEQ ID NO: 1065432 - protein, 9 aa, Homo Sapiens
RSFPAPQDT

SEQ ID NO: 1065433 - protein, 9 aa, Homo Sapiens
YLMKSSFIL

SEQ ID NO: 1065434 - protein, 9 aa, Homo Sapiens
LIQLLKLHQ

SEQ ID NO: 1065435 - protein, 9 aa, Homo Sapiens
FFHLIRLLY

SEQ ID NO: 1065436 - protein, 9 aa, Homo Sapiens
GLKKSSFLE

SEQ ID NO: 1065437 - protein, 9 aa, Homo Sapiens
SPHPRVQIG

SEQ ID NO: 1065438 - protein, 9 aa, Homo Sapiens
SLPNSRPGK

SEQ ID NO: 1065439 - protein, 9 aa, Homo Sapiens
GSFRYFSRS

SEQ ID NO: 1065440 - protein, 9 aa, Homo Sapiens
LLSRERNFG

SEQ ID NO: 1065441 - protein, 9 aa, Homo Sapiens
VQGPLAYRD

SEQ ID NO: 1065442 - protein, 9 aa, Homo Sapiens
LHQSREKTE

SEQ ID NO: 1065443 - protein, 9 aa, Homo Sapiens
RDFKPENLI

SEQ ID NO: 1065444 - protein, 9 aa, Homo Sapiens
GTEISHLIK

SEQ ID NO: 1065445 - protein, 9 aa, Homo Sapiens
IDYYWWLRM

SEQ ID NO: 1065446 - protein, 9 aa, Homo Sapiens
KLCRANSWD

SEQ ID NO: 1065447 - protein, 9 aa, Homo Sapiens
SSQSKGVML

SEQ ID NO: 1065448 - protein, 9 aa, Homo Sapiens
MNKVMELKK

SEQ ID NO: 1065449 - protein, 9 aa, Homo Sapiens
ATRATAPPR

SEQ ID NO: 1065450 - protein, 9 aa, Homo Sapiens
GILPITEYL

SEQ ID NO: 1065451 - protein, 9 aa, Homo Sapiens
SSSEPKAPA

SEQ ID NO: 1065452 - protein, 9 aa, Homo Sapiens
PHPHHQQPP

SEQ ID NO: 1065453 - protein, 9 aa, Homo Sapiens
CPLSAASNS

SEQ ID NO: 1065454 - protein, 9 aa, Homo Sapiens
IIYTLKNKE

SEQ ID NO: 1065455 - protein, 9 aa, Homo Sapiens
AGDPRGPRG

SEQ ID NO: 1065456 - protein, 9 aa, Homo Sapiens
RRNKAFSTC

SEQ ID NO: 1065457 - protein, 9 aa, Homo Sapiens
TAIGSLRPP

SEQ ID NO: 1065458 - protein, 9 aa, Homo Sapiens
IYNIYSLLK

SEQ ID NO: 1065459 - protein, 9 aa, Homo Sapiens
LEDPNFLEA

SEQ ID NO: 1065460 - protein, 9 aa, Homo Sapiens
GDRCTDCLC

SEQ ID NO: 1065461 - protein, 9 aa, Homo Sapiens
AIKKQYTVR

SEQ ID NO: 1065462 - protein, 9 aa, Homo Sapiens
FFSPSLLKR

SEQ ID NO: 1065463 - protein, 9 aa, Homo Sapiens
QKKDQERPQ

SEQ ID NO: 1065464 - protein, 9 aa, Homo Sapiens
NAEQRGQPL

SEQ ID NO: 1065465 - protein, 9 aa, Homo Sapiens
MKYLGGGSA

SEQ ID NO: 1065466 - protein, 9 aa, Homo Sapiens
WDISGIFVA

SEQ ID NO: 1065467 - protein, 9 aa, Homo Sapiens
KLAAALALT

SEQ ID NO: 1065468 - protein, 9 aa, Homo Sapiens
WKRLMIKFC

SEQ ID NO: 1065469 - protein, 9 aa, Homo Sapiens
NDVLQILDV

SEQ ID NO: 1065470 - protein, 9 aa, Homo Sapiens
EKKVPVPPS

SEQ ID NO: 1065471 - protein, 9 aa, Homo Sapiens
LVNTAPLTR

SEQ ID NO: 1065472 - protein, 9 aa, Homo Sapiens
WNTFVENHK

SEQ ID NO: 1065473 - protein, 9 aa, Homo Sapiens
FQTRSQMLL

SEQ ID NO: 1065474 - protein, 9 aa, Homo Sapiens
NLIIRLEQD

SEQ ID NO: 1065475 - protein, 9 aa, Homo Sapiens
GQLAAVSRI

SEQ ID NO: 1065476 - protein, 9 aa, Homo Sapiens
SCPSCNGQV

SEQ ID NO: 1065477 - protein, 9 aa, Homo Sapiens
FDSHAQHLL

SEQ ID NO: 1065478 - protein, 9 aa, Homo Sapiens
QAKVQEEMS

SEQ ID NO: 1065479 - protein, 9 aa, Homo Sapiens
SDCGEEKTL

SEQ ID NO: 1065480 - protein, 9 aa, Homo Sapiens
EPPRKEQSE

SEQ ID NO: 1065481 - protein, 9 aa, Homo Sapiens
SKAKLRAER

SEQ ID NO: 1065482 - protein, 9 aa, Homo Sapiens
GYRIGLPQN

SEQ ID NO: 1065483 - protein, 9 aa, Homo Sapiens
VVVGICHTD

SEQ ID NO: 1065484 - protein, 9 aa, Homo Sapiens
LIVVDHSLH

SEQ ID NO: 1065485 - protein, 9 aa, Homo Sapiens
QAEGPSVQP

SEQ ID NO: 1065486 - protein, 9 aa, Homo Sapiens
QGDLKTTDF

SEQ ID NO: 1065487 - protein, 9 aa, Homo Sapiens
PPPSGFQMD

SEQ ID NO: 1065488 - protein, 9 aa, Homo Sapiens
CARFVSRFC

SEQ ID NO: 1065489 - protein, 9 aa, Homo Sapiens
RKATDRGMA

SEQ ID NO: 1065490 - protein, 9 aa, Homo Sapiens
PVEDQGVFT

SEQ ID NO: 1065491 - protein, 9 aa, Homo Sapiens
PSYLPADTV

SEQ ID NO: 1065492 - protein, 9 aa, Homo Sapiens
SKDQNVSDD

SEQ ID NO: 1065493 - protein, 9 aa, Homo Sapiens
EQIANFSSG

SEQ ID NO: 1065494 - protein, 9 aa, Homo Sapiens
VSFQAAFTS

SEQ ID NO: 1065495 - protein, 9 aa, Homo Sapiens
AYSNVTMVN

SEQ ID NO: 1065496 - protein, 9 aa, Homo Sapiens
SSFFSPTSS

SEQ ID NO: 1065497 - protein, 9 aa, Homo Sapiens
AKESGMALS

SEQ ID NO: 1065498 - protein, 9 aa, Homo Sapiens
NGMLAEKGA

SEQ ID NO: 1065499 - protein, 9 aa, Homo Sapiens
KDVFQGKEL

SEQ ID NO: 1065500 - protein, 9 aa, Homo Sapiens
CWVLRMVDG

SEQ ID NO: 1065501 - protein, 9 aa, Homo Sapiens
RNKLRQVLP

SEQ ID NO: 1065502 - protein, 9 aa, Homo Sapiens
PDHDADRHC

SEQ ID NO: 1065503 - protein, 9 aa, Homo Sapiens
AFMCPCYVR

SEQ ID NO: 1065504 - protein, 9 aa, Homo Sapiens
PAQTHPREF

SEQ ID NO: 1065505 - protein, 9 aa, Homo Sapiens
FGDFNFWLD

SEQ ID NO: 1065506 - protein, 9 aa, Homo Sapiens
KCRQMYYAP

SEQ ID NO: 1065507 - protein, 9 aa, Homo Sapiens
ICCVCKSCQ

SEQ ID NO: 1065508 - protein, 9 aa, Homo Sapiens
PTPSFRSPA

SEQ ID NO: 1065509 - protein, 9 aa, Homo Sapiens
DKSEKLELQ

SEQ ID NO: 1065510 - protein, 9 aa, Homo Sapiens
ITGILPITE

SEQ ID NO: 1065511 - protein, 9 aa, Homo Sapiens
QSLLEKFSI

SEQ ID NO: 1065512 - protein, 9 aa, Homo Sapiens
DLFFHTLCD

SEQ ID NO: 1065513 - protein, 9 aa, Homo Sapiens
FCEMLVFLK

SEQ ID NO: 1065514 - protein, 9 aa, Homo Sapiens
QESKQMYCV

SEQ ID NO: 1065515 - protein, 9 aa, Homo Sapiens
RKMYYSQKA

SEQ ID NO: 1065516 - protein, 9 aa, Homo Sapiens
TIVFCTPVH

SEQ ID NO: 1065517 - protein, 9 aa, Homo Sapiens
FNECENVSR

SEQ ID NO: 1065518 - protein, 9 aa, Homo Sapiens
AGSRVELAN

SEQ ID NO: 1065519 - protein, 9 aa, Homo Sapiens
VSVTPREKI

SEQ ID NO: 1065520 - protein, 9 aa, Homo Sapiens
RVMAIYKQS

SEQ ID NO: 1065521 - protein, 9 aa, Homo Sapiens
RGGDRESSE

SEQ ID NO: 1065522 - protein, 9 aa, Homo Sapiens
VLEFWPVKL

SEQ ID NO: 1065523 - protein, 9 aa, Homo Sapiens
KTEARELTK

SEQ ID NO: 1065524 - protein, 9 aa, Homo Sapiens
DVRDKFSGI

SEQ ID NO: 1065525 - protein, 9 aa, Homo Sapiens
SSKFQLDVA

SEQ ID NO: 1065526 - protein, 9 aa, Homo Sapiens
CTTTKDILF

SEQ ID NO: 1065527 - protein, 9 aa, Homo Sapiens
IMGILRVKQ

SEQ ID NO: 1065528 - protein, 9 aa, Homo Sapiens
IAETLENDI

SEQ ID NO: 1065529 - protein, 9 aa, Homo Sapiens
TIIILLLNP

SEQ ID NO: 1065530 - protein, 9 aa, Homo Sapiens
FVVPPTFQG

SEQ ID NO: 1065531 - protein, 9 aa, Homo Sapiens
LETRDETQL

SEQ ID NO: 1065532 - protein, 9 aa, Homo Sapiens
LRYKAPRVN

SEQ ID NO: 1065533 - protein, 9 aa, Homo Sapiens
QLQLEVEEA

SEQ ID NO: 1065534 - protein, 9 aa, Homo Sapiens
VHEQTEEMD

SEQ ID NO: 1065535 - protein, 9 aa, Homo Sapiens
KFDDLIFVE

SEQ ID NO: 1065536 - protein, 9 aa, Homo Sapiens
VGPGRELFY

SEQ ID NO: 1065537 - protein, 9 aa, Homo Sapiens
GSKEEPGPA

SEQ ID NO: 1065538 - protein, 9 aa, Homo Sapiens
VDWAPFLLS

SEQ ID NO: 1065539 - protein, 9 aa, Homo Sapiens
KMSVGYANG

SEQ ID NO: 1065540 - protein, 9 aa, Homo Sapiens
RIYTREKPY

SEQ ID NO: 1065541 - protein, 9 aa, Homo Sapiens
CLTLYTLLE

SEQ ID NO: 1065542 - protein, 9 aa, Homo Sapiens
AVPRMNESS

SEQ ID NO: 1065543 - protein, 9 aa, Homo Sapiens
KKKYSSPQK

SEQ ID NO: 1065544 - protein, 9 aa, Homo Sapiens
AVEEADQPI

SEQ ID NO: 1065545 - protein, 9 aa, Homo Sapiens
SELFTGIFF

SEQ ID NO: 1065546 - protein, 9 aa, Homo Sapiens
NVRKSDQRS

SEQ ID NO: 1065547 - protein, 9 aa, Homo Sapiens
LNCAKDMNL

SEQ ID NO: 1065548 - protein, 9 aa, Homo Sapiens
NKMANENQP

SEQ ID NO: 1065549 - protein, 9 aa, Homo Sapiens
KEELGQLQT

SEQ ID NO: 1065550 - protein, 9 aa, Homo Sapiens
SFSTYHAII

SEQ ID NO: 1065551 - protein, 9 aa, Homo Sapiens
VSGNADFTV

SEQ ID NO: 1065552 - protein, 9 aa, Homo Sapiens
KKDKRQNSL

SEQ ID NO: 1065553 - protein, 9 aa, Homo Sapiens
QPNSNLNVS

SEQ ID NO: 1065554 - protein, 9 aa, Homo Sapiens
SVLISWRVC

SEQ ID NO: 1065555 - protein, 9 aa, Homo Sapiens
TSTAASSLG

SEQ ID NO: 1065556 - protein, 9 aa, Homo Sapiens
GTSHLDPRK

SEQ ID NO: 1065557 - protein, 9 aa, Homo Sapiens
LLGEASYTQ

SEQ ID NO: 1065558 - protein, 9 aa, Homo Sapiens
SYLEDIPDP

SEQ ID NO: 1065559 - protein, 9 aa, Homo Sapiens
IKDYPDDAI

SEQ ID NO: 1065560 - protein, 9 aa, Homo Sapiens
FSFRVDEAK

SEQ ID NO: 1065561 - protein, 9 aa, Homo Sapiens
KEQEKAWKL

SEQ ID NO: 1065562 - protein, 9 aa, Homo Sapiens
RCAAWEEKE

SEQ ID NO: 1065563 - protein, 9 aa, Homo Sapiens
TECDFHPLP

SEQ ID NO: 1065564 - protein, 9 aa, Homo Sapiens
MKLEAIDSL

SEQ ID NO: 1065565 - protein, 9 aa, Homo Sapiens
SPTIFSFSP

SEQ ID NO: 1065566 - protein, 9 aa, Homo Sapiens
FYLLDVYVI

SEQ ID NO: 1065567 - protein, 9 aa, Homo Sapiens
KFVVLALAE

SEQ ID NO: 1065568 - protein, 9 aa, Homo Sapiens
ISTFIPVIS

SEQ ID NO: 1065569 - protein, 9 aa, Homo Sapiens
PAWQPTSAP

SEQ ID NO: 1065570 - protein, 9 aa, Homo Sapiens
LYGSDEHNV

SEQ ID NO: 1065571 - protein, 9 aa, Homo Sapiens
QQMNDLETC

SEQ ID NO: 1065572 - protein, 9 aa, Homo Sapiens
NRGRPTVAR

SEQ ID NO: 1065573 - protein, 9 aa, Homo Sapiens
VVLVRRLLL

SEQ ID NO: 1065574 - protein, 9 aa, Homo Sapiens
WFEARKISL

SEQ ID NO: 1065575 - protein, 9 aa, Homo Sapiens
GFNCGAHLI

SEQ ID NO: 1065576 - protein, 9 aa, Homo Sapiens
IPGVVKVTL

SEQ ID NO: 1065577 - protein, 9 aa, Homo Sapiens
EKIHNTGLL

SEQ ID NO: 1065578 - protein, 9 aa, Homo Sapiens
HMITYSEKR

SEQ ID NO: 1065579 - protein, 9 aa, Homo Sapiens
FEDFAHFIL

SEQ ID NO: 1065580 - protein, 9 aa, Homo Sapiens
YLDARDKNS

SEQ ID NO: 1065581 - protein, 9 aa, Homo Sapiens
VNRDLAARN

SEQ ID NO: 1065582 - protein, 9 aa, Homo Sapiens
LLSSENNLL

SEQ ID NO: 1065583 - protein, 9 aa, Homo Sapiens
SVFVLASYK

SEQ ID NO: 1065584 - protein, 9 aa, Homo Sapiens
STLREAEEE

SEQ ID NO: 1065585 - protein, 9 aa, Homo Sapiens
LEKFKPSPC

SEQ ID NO: 1065586 - protein, 9 aa, Homo Sapiens
IETVKNNFR

SEQ ID NO: 1065587 - protein, 9 aa, Homo Sapiens
LIHSGGNSD

SEQ ID NO: 1065588 - protein, 9 aa, Homo Sapiens
SFYGGHELS

SEQ ID NO: 1065589 - protein, 9 aa, Homo Sapiens
FYGFIVNTI

SEQ ID NO: 1065590 - protein, 9 aa, Homo Sapiens
ILKKAREFM

SEQ ID NO: 1065591 - protein, 9 aa, Homo Sapiens
RNVLVVFFG

SEQ ID NO: 1065592 - protein, 9 aa, Homo Sapiens
MLPDHFSPF

SEQ ID NO: 1065593 - protein, 9 aa, Homo Sapiens
LSPDTSVLV

SEQ ID NO: 1065594 - protein, 9 aa, Homo Sapiens
VSVENGFVS

SEQ ID NO: 1065595 - protein, 9 aa, Homo Sapiens
NGDSLEEPM

SEQ ID NO: 1065596 - protein, 9 aa, Homo Sapiens
GLLKWQQRF

SEQ ID NO: 1065597 - protein, 9 aa, Homo Sapiens
QVLLFSESP

SEQ ID NO: 1065598 - protein, 9 aa, Homo Sapiens
SMKFHQQMH

SEQ ID NO: 1065599 - protein, 9 aa, Homo Sapiens
LSLITSNLT

SEQ ID NO: 1065600 - protein, 9 aa, Homo Sapiens
TDYVEILSS

SEQ ID NO: 1065601 - protein, 9 aa, Homo Sapiens
RSPSASTPM

SEQ ID NO: 1065602 - protein, 9 aa, Homo Sapiens
RVSFQQCLS

SEQ ID NO: 1065603 - protein, 9 aa, Homo Sapiens
SFLPPARKQ

SEQ ID NO: 1065604 - protein, 9 aa, Homo Sapiens
EQISKVLLM

SEQ ID NO: 1065605 - protein, 9 aa, Homo Sapiens
HLFPLLENP

SEQ ID NO: 1065606 - protein, 9 aa, Homo Sapiens
VSLTLFLIS

SEQ ID NO: 1065607 - protein, 9 aa, Homo Sapiens
PTSAPPAPH

SEQ ID NO: 1065608 - protein, 9 aa, Homo Sapiens
VPGSENKKA

SEQ ID NO: 1065609 - protein, 9 aa, Homo Sapiens
VESVAQTAV

SEQ ID NO: 1065610 - protein, 9 aa, Homo Sapiens
NPKTITILF

SEQ ID NO: 1065611 - protein, 9 aa, Homo Sapiens
FGQLAAVSR

SEQ ID NO: 1065612 - protein, 9 aa, Homo Sapiens
IIQYQGIMK

SEQ ID NO: 1065613 - protein, 9 aa, Homo Sapiens
CCNYENCEK

SEQ ID NO: 1065614 - protein, 9 aa, Homo Sapiens
TFEIKKCNL

SEQ ID NO: 1065615 - protein, 9 aa, Homo Sapiens
AFEYLSKLQ

SEQ ID NO: 1065616 - protein, 9 aa, Homo Sapiens
RLIALLTKP

SEQ ID NO: 1065617 - protein, 9 aa, Homo Sapiens
GGDRESSEG

SEQ ID NO: 1065618 - protein, 9 aa, Homo Sapiens
ITVSVCRRK

SEQ ID NO: 1065619 - protein, 9 aa, Homo Sapiens
FSEASFLET

SEQ ID NO: 1065620 - protein, 9 aa, Homo Sapiens
LMRANTQDT

SEQ ID NO: 1065621 - protein, 9 aa, Homo Sapiens
NNFSTLMKH

SEQ ID NO: 1065622 - protein, 9 aa, Homo Sapiens
NRMIGELIS

SEQ ID NO: 1065623 - protein, 9 aa, Homo Sapiens
VCAYNPEAA

SEQ ID NO: 1065624 - protein, 9 aa, Homo Sapiens
PPAAFCLRC

SEQ ID NO: 1065625 - protein, 9 aa, Homo Sapiens
KGPRFEGNC

SEQ ID NO: 1065626 - protein, 9 aa, Homo Sapiens
QAFPGTSSA

SEQ ID NO: 1065627 - protein, 9 aa, Homo Sapiens
EGPIAQNQA

SEQ ID NO: 1065628 - protein, 9 aa, Homo Sapiens
NSHVFASSR

SEQ ID NO: 1065629 - protein, 9 aa, Homo Sapiens
VLVFTWQVN

SEQ ID NO: 1065630 - protein, 9 aa, Homo Sapiens
KHLDGFEGK

SEQ ID NO: 1065631 - protein, 9 aa, Homo Sapiens
KKNLLKALR

SEQ ID NO: 1065632 - protein, 9 aa, Homo Sapiens
QSGCGLLVI

SEQ ID NO: 1065633 - protein, 9 aa, Homo Sapiens
GKTFTCFSS

SEQ ID NO: 1065634 - protein, 9 aa, Homo Sapiens
LFSDDDLPH

SEQ ID NO: 1065635 - protein, 9 aa, Homo Sapiens
KYGDLYRAE

SEQ ID NO: 1065636 - protein, 9 aa, Homo Sapiens
DLEEEAPPP

SEQ ID NO: 1065637 - protein, 9 aa, Homo Sapiens
ICKSSFFLK

SEQ ID NO: 1065638 - protein, 9 aa, Homo Sapiens
CEYACCLQC

SEQ ID NO: 1065639 - protein, 9 aa, Homo Sapiens
AEAADDLPP

SEQ ID NO: 1065640 - protein, 9 aa, Homo Sapiens
IPKSQFLVL

SEQ ID NO: 1065641 - protein, 9 aa, Homo Sapiens
IVVVMRNMS

SEQ ID NO: 1065642 - protein, 9 aa, Homo Sapiens
RCTSHTSQA

SEQ ID NO: 1065643 - protein, 9 aa, Homo Sapiens
SPPISLAKV

SEQ ID NO: 1065644 - protein, 9 aa, Homo Sapiens
HRHFLGEDC

SEQ ID NO: 1065645 - protein, 9 aa, Homo Sapiens
PPPPLPPLS

SEQ ID NO: 1065646 - protein, 9 aa, Homo Sapiens
LLLKLKFGL

SEQ ID NO: 1065647 - protein, 9 aa, Homo Sapiens
SPRVPGLPS

SEQ ID NO: 1065648 - protein, 9 aa, Homo Sapiens
THPREFQKF

SEQ ID NO: 1065649 - protein, 9 aa, Homo Sapiens
ELTSETVFT

SEQ ID NO: 1065650 - protein, 9 aa, Homo Sapiens
CTQLHLNLK

SEQ ID NO: 1065651 - protein, 9 aa, Homo Sapiens
NDLETCVIQ

SEQ ID NO: 1065652 - protein, 9 aa, Homo Sapiens
VSEAVPRMN

SEQ ID NO: 1065653 - protein, 9 aa, Homo Sapiens
PFAIEGYRI

SEQ ID NO: 1065654 - protein, 9 aa, Homo Sapiens
YPAIGNICC

SEQ ID NO: 1065655 - protein, 9 aa, Homo Sapiens
KSSQYISMH

SEQ ID NO: 1065656 - protein, 9 aa, Homo Sapiens
SKHIKSEQG

SEQ ID NO: 1065657 - protein, 9 aa, Homo Sapiens
GILLAMAYN

SEQ ID NO: 1065658 - protein, 9 aa, Homo Sapiens
GQPQALMGS

SEQ ID NO: 1065659 - protein, 9 aa, Homo Sapiens
VEAEGALGV

SEQ ID NO: 1065660 - protein, 9 aa, Homo Sapiens
VLGKATTLV

SEQ ID NO: 1065661 - protein, 9 aa, Homo Sapiens
LSVRVQSGT

SEQ ID NO: 1065662 - protein, 9 aa, Homo Sapiens
ARQEGGGGA

SEQ ID NO: 1065663 - protein, 9 aa, Homo Sapiens
EHNECGSGQ

SEQ ID NO: 1065664 - protein, 9 aa, Homo Sapiens
EEVAWEALL

SEQ ID NO: 1065665 - protein, 9 aa, Homo Sapiens
GILLFLAKV

SEQ ID NO: 1065666 - protein, 9 aa, Homo Sapiens
GSRCCYSLE

SEQ ID NO: 1065667 - protein, 9 aa, Homo Sapiens
KICCNCKCG

SEQ ID NO: 1065668 - protein, 9 aa, Homo Sapiens
SITGILPIT

SEQ ID NO: 1065669 - protein, 9 aa, Homo Sapiens
STIEPKPFL

SEQ ID NO: 1065670 - protein, 9 aa, Homo Sapiens
ENDPETKNE

SEQ ID NO: 1065671 - protein, 9 aa, Homo Sapiens
AAAASVSST

SEQ ID NO: 1065672 - protein, 9 aa, Homo Sapiens
AFCECLRRV

SEQ ID NO: 1065673 - protein, 9 aa, Homo Sapiens
EKISKRMFK

SEQ ID NO: 1065674 - protein, 9 aa, Homo Sapiens
GNSCDLEEE

SEQ ID NO: 1065675 - protein, 9 aa, Homo Sapiens
GLTSPPVSC

SEQ ID NO: 1065676 - protein, 9 aa, Homo Sapiens
KKMEDTSLL

SEQ ID NO: 1065677 - protein, 9 aa, Homo Sapiens
KCEECSKVF

SEQ ID NO: 1065678 - protein, 9 aa, Homo Sapiens
KEKKDETDE

SEQ ID NO: 1065679 - protein, 9 aa, Homo Sapiens
FLFTSNSFS

SEQ ID NO: 1065680 - protein, 9 aa, Homo Sapiens
SDLEYYIIN

SEQ ID NO: 1065681 - protein, 9 aa, Homo Sapiens
TAAPTLIFE

SEQ ID NO: 1065682 - protein, 9 aa, Homo Sapiens
AILQTNQTL

SEQ ID NO: 1065683 - protein, 9 aa, Homo Sapiens
SLCSCDIPA

SEQ ID NO: 1065684 - protein, 9 aa, Homo Sapiens
TLNCSGEHV

SEQ ID NO: 1065685 - protein, 9 aa, Homo Sapiens
PFRDNRRSK

SEQ ID NO: 1065686 - protein, 9 aa, Homo Sapiens
LHDRELLRL

SEQ ID NO: 1065687 - protein, 9 aa, Homo Sapiens
PRSQGQRWI

SEQ ID NO: 1065688 - protein, 9 aa, Homo Sapiens
DHFSPFSGD

SEQ ID NO: 1065689 - protein, 9 aa, Homo Sapiens
WVPDCAFSR

SEQ ID NO: 1065690 - protein, 9 aa, Homo Sapiens
KMSELSNLT

SEQ ID NO: 1065691 - protein, 9 aa, Homo Sapiens
QKLSSIYNL

SEQ ID NO: 1065692 - protein, 9 aa, Homo Sapiens
IIFCEGCKG

SEQ ID NO: 1065693 - protein, 9 aa, Homo Sapiens
VNDIKKKLC

SEQ ID NO: 1065694 - protein, 9 aa, Homo Sapiens
MIFALFPKP

SEQ ID NO: 1065695 - protein, 9 aa, Homo Sapiens
KFSSDFKDF

SEQ ID NO: 1065696 - protein, 9 aa, Homo Sapiens
YLPSQVSSC

SEQ ID NO: 1065697 - protein, 9 aa, Homo Sapiens
SLNPINFIQ

SEQ ID NO: 1065698 - protein, 9 aa, Homo Sapiens
QPKENEAKP

SEQ ID NO: 1065699 - protein, 9 aa, Homo Sapiens
VSAEIMAMN

SEQ ID NO: 1065700 - protein, 9 aa, Homo Sapiens
VWLHHLNHK

SEQ ID NO: 1065701 - protein, 9 aa, Homo Sapiens
PRSSRWPVV

SEQ ID NO: 1065702 - protein, 9 aa, Homo Sapiens
GAPFQRGTP

SEQ ID NO: 1065703 - protein, 9 aa, Homo Sapiens
LTVSTRSSK

SEQ ID NO: 1065704 - protein, 9 aa, Homo Sapiens
NKESKKYRK

SEQ ID NO: 1065705 - protein, 9 aa, Homo Sapiens
LPPTISLTA

SEQ ID NO: 1065706 - protein, 9 aa, Homo Sapiens
GNFPKPDMC

SEQ ID NO: 1065707 - protein, 9 aa, Homo Sapiens
PISGHVSFF

SEQ ID NO: 1065708 - protein, 9 aa, Homo Sapiens
NDILGRHSQ

SEQ ID NO: 1065709 - protein, 9 aa, Homo Sapiens
LIDEDILYH

SEQ ID NO: 1065710 - protein, 9 aa, Homo Sapiens
KKSENSIED

SEQ ID NO: 1065711 - protein, 9 aa, Homo Sapiens
CFKGYAGAD

SEQ ID NO: 1065712 - protein, 9 aa, Homo Sapiens
KEFCVRTVC

SEQ ID NO: 1065713 - protein, 9 aa, Homo Sapiens
GMNRTRIIN

SEQ ID NO: 1065714 - protein, 9 aa, Homo Sapiens
DEIHLIEKC

SEQ ID NO: 1065715 - protein, 9 aa, Homo Sapiens
AKTHHQAVI

SEQ ID NO: 1065716 - protein, 9 aa, Homo Sapiens
EDQIIGMTV

SEQ ID NO: 1065717 - protein, 9 aa, Homo Sapiens
DFSHPNVFS

SEQ ID NO: 1065718 - protein, 9 aa, Homo Sapiens
SISLALPAL

SEQ ID NO: 1065719 - protein, 9 aa, Homo Sapiens
KNCCNKHLH

SEQ ID NO: 1065720 - protein, 9 aa, Homo Sapiens
TSKLDKKNN

SEQ ID NO: 1065721 - protein, 9 aa, Homo Sapiens
LTEKNFRRL

SEQ ID NO: 1065722 - protein, 9 aa, Homo Sapiens
YKSMKLKKE

SEQ ID NO: 1065723 - protein, 9 aa, Homo Sapiens
WPRRPAWPS

SEQ ID NO: 1065724 - protein, 9 aa, Homo Sapiens
ESSKGSSDE

SEQ ID NO: 1065725 - protein, 9 aa, Homo Sapiens
EPRVRLFVF

SEQ ID NO: 1065726 - protein, 9 aa, Homo Sapiens
PHRCLRGGR

SEQ ID NO: 1065727 - protein, 9 aa, Homo Sapiens
HGLRQDLET

SEQ ID NO: 1065728 - protein, 9 aa, Homo Sapiens
PGIEKAHHW

SEQ ID NO: 1065729 - protein, 9 aa, Homo Sapiens
QASLDPRSS

SEQ ID NO: 1065730 - protein, 9 aa, Homo Sapiens
DTDILWLAQ

SEQ ID NO: 1065731 - protein, 9 aa, Homo Sapiens
KNKFSLILE

SEQ ID NO: 1065732 - protein, 9 aa, Homo Sapiens
NMEDLPAPN

SEQ ID NO: 1065733 - protein, 9 aa, Homo Sapiens
SVLGKATTL

SEQ ID NO: 1065734 - protein, 9 aa, Homo Sapiens
CVPDKDTSC

SEQ ID NO: 1065735 - protein, 9 aa, Homo Sapiens
QSTPPAAFC

SEQ ID NO: 1065736 - protein, 9 aa, Homo Sapiens
VVLSPLNFC

SEQ ID NO: 1065737 - protein, 9 aa, Homo Sapiens
DGNSEIMEY

SEQ ID NO: 1065738 - protein, 9 aa, Homo Sapiens
YLDPSSRYD

SEQ ID NO: 1065739 - protein, 9 aa, Homo Sapiens
KEGHKVVGV

SEQ ID NO: 1065740 - protein, 9 aa, Homo Sapiens
SKLDKKNNA

SEQ ID NO: 1065741 - protein, 9 aa, Homo Sapiens
KLFKCKKCG

SEQ ID NO: 1065742 - protein, 9 aa, Homo Sapiens
SPRHSSTRF

SEQ ID NO: 1065743 - protein, 9 aa, Homo Sapiens
MQKGINFVK

SEQ ID NO: 1065744 - protein, 9 aa, Homo Sapiens
NKVCNCYEF

SEQ ID NO: 1065745 - protein, 9 aa, Homo Sapiens
KEIDYVKNK

SEQ ID NO: 1065746 - protein, 9 aa, Homo Sapiens
KRNQKKEKL

SEQ ID NO: 1065747 - protein, 9 aa, Homo Sapiens
SFQGTHVVT

SEQ ID NO: 1065748 - protein, 9 aa, Homo Sapiens
SKLNNTNIK

SEQ ID NO: 1065749 - protein, 9 aa, Homo Sapiens
LGPNPSSKL

SEQ ID NO: 1065750 - protein, 9 aa, Homo Sapiens
VLLDVRAWL

SEQ ID NO: 1065751 - protein, 9 aa, Homo Sapiens
ASRQNSGEA

SEQ ID NO: 1065752 - protein, 9 aa, Homo Sapiens
PGVLPAGGV

SEQ ID NO: 1065753 - protein, 9 aa, Homo Sapiens
RKPLIRENQ

SEQ ID NO: 1065754 - protein, 9 aa, Homo Sapiens
VLSILAPET

SEQ ID NO: 1065755 - protein, 9 aa, Homo Sapiens
TKSKLAARL

SEQ ID NO: 1065756 - protein, 9 aa, Homo Sapiens
RAGPHATAD

SEQ ID NO: 1065757 - protein, 9 aa, Homo Sapiens
TLVYRIIPP

SEQ ID NO: 1065758 - protein, 9 aa, Homo Sapiens
ESRESDSSP

SEQ ID NO: 1065759 - protein, 9 aa, Homo Sapiens
VAKHHSPVS

SEQ ID NO: 1065760 - protein, 9 aa, Homo Sapiens
SAAVVDASF

SEQ ID NO: 1065761 - protein, 9 aa, Homo Sapiens
MSGLMQPPY

SEQ ID NO: 1065762 - protein, 9 aa, Homo Sapiens
ALVFVGEIC

SEQ ID NO: 1065763 - protein, 9 aa, Homo Sapiens
IATASASAF

SEQ ID NO: 1065764 - protein, 9 aa, Homo Sapiens
SLLAEVLAF

SEQ ID NO: 1065765 - protein, 9 aa, Homo Sapiens
IQVLFMYGK

SEQ ID NO: 1065766 - protein, 9 aa, Homo Sapiens
PAVSSLSSP

SEQ ID NO: 1065767 - protein, 9 aa, Homo Sapiens
PSSCNNNPK

SEQ ID NO: 1065768 - protein, 9 aa, Homo Sapiens
PILVPPRGL

SEQ ID NO: 1065769 - protein, 9 aa, Homo Sapiens
LLIFFLHDS

SEQ ID NO: 1065770 - protein, 9 aa, Homo Sapiens
GGALNHFSS

SEQ ID NO: 1065771 - protein, 9 aa, Homo Sapiens
SSPCKTCEG

SEQ ID NO: 1065772 - protein, 9 aa, Homo Sapiens
TTNNVVQNF

SEQ ID NO: 1065773 - protein, 9 aa, Homo Sapiens
LVFVGEICQ

SEQ ID NO: 1065774 - protein, 9 aa, Homo Sapiens
NEATAKVKA

SEQ ID NO: 1065775 - protein, 9 aa, Homo Sapiens
DIRKSVNWR

SEQ ID NO: 1065776 - protein, 9 aa, Homo Sapiens
SVVFLYKGL

SEQ ID NO: 1065777 - protein, 9 aa, Homo Sapiens
VDNNLRFMI

SEQ ID NO: 1065778 - protein, 9 aa, Homo Sapiens
GKPFSCSLL

SEQ ID NO: 1065779 - protein, 9 aa, Homo Sapiens
QQIFRMFPK

SEQ ID NO: 1065780 - protein, 9 aa, Homo Sapiens
EVKHLSALL

SEQ ID NO: 1065781 - protein, 9 aa, Homo Sapiens
NIENKPPFE

SEQ ID NO: 1065782 - protein, 9 aa, Homo Sapiens
PIKQAPAPS

SEQ ID NO: 1065783 - protein, 9 aa, Homo Sapiens
PQENKNETL

SEQ ID NO: 1065784 - protein, 9 aa, Homo Sapiens
FFVSVIYKK

SEQ ID NO: 1065785 - protein, 9 aa, Homo Sapiens
AKVVLLCWI

SEQ ID NO: 1065786 - protein, 9 aa, Homo Sapiens
KSVNWREKG

SEQ ID NO: 1065787 - protein, 9 aa, Homo Sapiens
EAVPRMNES

SEQ ID NO: 1065788 - protein, 9 aa, Homo Sapiens
VRCELCPYK

SEQ ID NO: 1065789 - protein, 9 aa, Homo Sapiens
KLQPGSKCL

SEQ ID NO: 1065790 - protein, 9 aa, Homo Sapiens
RQNPRRVAG

SEQ ID NO: 1065791 - protein, 9 aa, Homo Sapiens
KKTKIFSLL

SEQ ID NO: 1065792 - protein, 9 aa, Homo Sapiens
RVDFGLSER

SEQ ID NO: 1065793 - protein, 9 aa, Homo Sapiens
RITSAERRN

SEQ ID NO: 1065794 - protein, 9 aa, Homo Sapiens
KKKVTKAKR

SEQ ID NO: 1065795 - protein, 9 aa, Homo Sapiens
TDPKLKYPK

SEQ ID NO: 1065796 - protein, 9 aa, Homo Sapiens
QQLLTMWYK

SEQ ID NO: 1065797 - protein, 9 aa, Homo Sapiens
FYFYDVTRN

SEQ ID NO: 1065798 - protein, 9 aa, Homo Sapiens
GSILRSLEV

SEQ ID NO: 1065799 - protein, 9 aa, Homo Sapiens
LEGFWKSEV

SEQ ID NO: 1065800 - protein, 9 aa, Homo Sapiens
DAEDKTPGA

SEQ ID NO: 1065801 - protein, 9 aa, Homo Sapiens
NHPGRTNSF

SEQ ID NO: 1065802 - protein, 9 aa, Homo Sapiens
TVGTEETPL

SEQ ID NO: 1065803 - protein, 9 aa, Homo Sapiens
QMSSEKGQA

SEQ ID NO: 1065804 - protein, 9 aa, Homo Sapiens
PSGMLTCRC

SEQ ID NO: 1065805 - protein, 9 aa, Homo Sapiens
LYDPQITAE

SEQ ID NO: 1065806 - protein, 9 aa, Homo Sapiens
KYNLPATID

SEQ ID NO: 1065807 - protein, 9 aa, Homo Sapiens
QDNGGSSGS

SEQ ID NO: 1065808 - protein, 9 aa, Homo Sapiens
YPALLTDGS

SEQ ID NO: 1065809 - protein, 9 aa, Homo Sapiens
KVQNLERAA

SEQ ID NO: 1065810 - protein, 9 aa, Homo Sapiens
WISMGHKFF

SEQ ID NO: 1065811 - protein, 9 aa, Homo Sapiens
ACKQFQRTP

SEQ ID NO: 1065812 - protein, 9 aa, Homo Sapiens
TSIGNGPLS

SEQ ID NO: 1065813 - protein, 9 aa, Homo Sapiens
CYEFLNGRV

SEQ ID NO: 1065814 - protein, 9 aa, Homo Sapiens
ERKKVPANP

SEQ ID NO: 1065815 - protein, 9 aa, Homo Sapiens
TGKLTTIGE

SEQ ID NO: 1065816 - protein, 9 aa, Homo Sapiens
FLPNKVKYV

SEQ ID NO: 1065817 - protein, 9 aa, Homo Sapiens
PSSAPGVNE

SEQ ID NO: 1065818 - protein, 9 aa, Homo Sapiens
IIKLPRRRF

SEQ ID NO: 1065819 - protein, 9 aa, Homo Sapiens
FLSLLILSC

SEQ ID NO: 1065820 - protein, 9 aa, Homo Sapiens
DRWQVEEAD

SEQ ID NO: 1065821 - protein, 9 aa, Homo Sapiens
DFPWGNAGE

SEQ ID NO: 1065822 - protein, 9 aa, Homo Sapiens
VLVTEEHVG

SEQ ID NO: 1065823 - protein, 9 aa, Homo Sapiens
NLCFSDLVF

SEQ ID NO: 1065824 - protein, 9 aa, Homo Sapiens
KMEIFEEKK

SEQ ID NO: 1065825 - protein, 9 aa, Homo Sapiens
VYEKLTMLN

SEQ ID NO: 1065826 - protein, 9 aa, Homo Sapiens
FQKAREKNP

SEQ ID NO: 1065827 - protein, 9 aa, Homo Sapiens
TVDRPDFYS

SEQ ID NO: 1065828 - protein, 9 aa, Homo Sapiens
HSSAKVWSR

SEQ ID NO: 1065829 - protein, 9 aa, Homo Sapiens
DTGPVAKKS

SEQ ID NO: 1065830 - protein, 9 aa, Homo Sapiens
DDLGIFKIS

SEQ ID NO: 1065831 - protein, 9 aa, Homo Sapiens
GAIHVVEEV

SEQ ID NO: 1065832 - protein, 9 aa, Homo Sapiens
TTGVLLFLI

SEQ ID NO: 1065833 - protein, 9 aa, Homo Sapiens
TYGKISYPG

SEQ ID NO: 1065834 - protein, 9 aa, Homo Sapiens
CYFYEGVCY

SEQ ID NO: 1065835 - protein, 9 aa, Homo Sapiens
MPDNMNFSD

SEQ ID NO: 1065836 - protein, 9 aa, Homo Sapiens
NLPEWCNGT

SEQ ID NO: 1065837 - protein, 9 aa, Homo Sapiens
AEDTTNSGE

SEQ ID NO: 1065838 - protein, 9 aa, Homo Sapiens
KSPICLVQR

SEQ ID NO: 1065839 - protein, 9 aa, Homo Sapiens
YLPKEMTQD

SEQ ID NO: 1065840 - protein, 9 aa, Homo Sapiens
FTKKTIFMQ

SEQ ID NO: 1065841 - protein, 9 aa, Homo Sapiens
WSGGLLQTY

SEQ ID NO: 1065842 - protein, 9 aa, Homo Sapiens
SKTGKLTTI

SEQ ID NO: 1065843 - protein, 9 aa, Homo Sapiens
LTQEFPREG

SEQ ID NO: 1065844 - protein, 9 aa, Homo Sapiens
VQVFHALRK

SEQ ID NO: 1065845 - protein, 9 aa, Homo Sapiens
LQLALFVNL

SEQ ID NO: 1065846 - protein, 9 aa, Homo Sapiens
GYQKQLGHH

SEQ ID NO: 1065847 - protein, 9 aa, Homo Sapiens
NQTGYLDPS

SEQ ID NO: 1065848 - protein, 9 aa, Homo Sapiens
VKGAKGTRT

SEQ ID NO: 1065849 - protein, 9 aa, Homo Sapiens
SADSEKGKA

SEQ ID NO: 1065850 - protein, 9 aa, Homo Sapiens
KAIILKQSG

SEQ ID NO: 1065851 - protein, 9 aa, Homo Sapiens
KKTEAKIAE

SEQ ID NO: 1065852 - protein, 9 aa, Homo Sapiens
PSLLKNKLS

SEQ ID NO: 1065853 - protein, 9 aa, Homo Sapiens
LSAQRSPET

SEQ ID NO: 1065854 - protein, 9 aa, Homo Sapiens
YVRENCKLL

SEQ ID NO: 1065855 - protein, 9 aa, Homo Sapiens
GEWRRLPWW

SEQ ID NO: 1065856 - protein, 9 aa, Homo Sapiens
KVMAGFFRG

SEQ ID NO: 1065857 - protein, 9 aa, Homo Sapiens
LVCSAETHS

SEQ ID NO: 1065858 - protein, 9 aa, Homo Sapiens
SELPGGDDL

SEQ ID NO: 1065859 - protein, 9 aa, Homo Sapiens
PKSPSRESV

SEQ ID NO: 1065860 - protein, 9 aa, Homo Sapiens
NEINYLNKV

SEQ ID NO: 1065861 - protein, 9 aa, Homo Sapiens
PQSARSASS

SEQ ID NO: 1065862 - protein, 9 aa, Homo Sapiens
QSTPKQTKS

SEQ ID NO: 1065863 - protein, 9 aa, Homo Sapiens
AGGVIGEPT

SEQ ID NO: 1065864 - protein, 9 aa, Homo Sapiens
VMVIKDSPH

SEQ ID NO: 1065865 - protein, 9 aa, Homo Sapiens
STLICQVLD

SEQ ID NO: 1065866 - protein, 9 aa, Homo Sapiens
GIQLKLDRP

SEQ ID NO: 1065867 - protein, 9 aa, Homo Sapiens
LFGRLSVDV

SEQ ID NO: 1065868 - protein, 9 aa, Homo Sapiens
HCVCISFGL

SEQ ID NO: 1065869 - protein, 9 aa, Homo Sapiens
CAGGDGVCS

SEQ ID NO: 1065870 - protein, 9 aa, Homo Sapiens
ILYEKKLKS

SEQ ID NO: 1065871 - protein, 9 aa, Homo Sapiens
PGPILGPAP

SEQ ID NO: 1065872 - protein, 9 aa, Homo Sapiens
STFPSLHDS

SEQ ID NO: 1065873 - protein, 9 aa, Homo Sapiens
RRLEQEVDD

SEQ ID NO: 1065874 - protein, 9 aa, Homo Sapiens
LRSLEVILR

SEQ ID NO: 1065875 - protein, 9 aa, Homo Sapiens
DTIRAFFVS

SEQ ID NO: 1065876 - protein, 9 aa, Homo Sapiens
AKPSTASSV

SEQ ID NO: 1065877 - protein, 9 aa, Homo Sapiens
KVLLMEKDQ

SEQ ID NO: 1065878 - protein, 9 aa, Homo Sapiens
SKLEGHTCE

SEQ ID NO: 1065879 - protein, 9 aa, Homo Sapiens
HFPFTSIIQ

SEQ ID NO: 1065880 - protein, 9 aa, Homo Sapiens
EVKIYFSIM

SEQ ID NO: 1065881 - protein, 9 aa, Homo Sapiens
SHLIKKGVL

SEQ ID NO: 1065882 - protein, 9 aa, Homo Sapiens
LITLVLDEG

SEQ ID NO: 1065883 - protein, 9 aa, Homo Sapiens
KPVKPFLFY

SEQ ID NO: 1065884 - protein, 9 aa, Homo Sapiens
PRHEYGFPG

SEQ ID NO: 1065885 - protein, 9 aa, Homo Sapiens
KGCEILLDT

SEQ ID NO: 1065886 - protein, 9 aa, Homo Sapiens
RTSSPNRVT

SEQ ID NO: 1065887 - protein, 9 aa, Homo Sapiens
FKFTIFESC

SEQ ID NO: 1065888 - protein, 9 aa, Homo Sapiens
IPSYLPADT

SEQ ID NO: 1065889 - protein, 9 aa, Homo Sapiens
EENSRKMTE

SEQ ID NO: 1065890 - protein, 9 aa, Homo Sapiens
FICSKIPIT

SEQ ID NO: 1065891 - protein, 9 aa, Homo Sapiens
SAEPALEFP

SEQ ID NO: 1065892 - protein, 9 aa, Homo Sapiens
KSLHSEDFL

SEQ ID NO: 1065893 - protein, 9 aa, Homo Sapiens
EGHCVIFYK

SEQ ID NO: 1065894 - protein, 9 aa, Homo Sapiens
VDASFVSPE

SEQ ID NO: 1065895 - protein, 9 aa, Homo Sapiens
RKERLYLLR

SEQ ID NO: 1065896 - protein, 9 aa, Homo Sapiens
RAKTGKYSL

SEQ ID NO: 1065897 - protein, 9 aa, Homo Sapiens
ETPKSSKPG

SEQ ID NO: 1065898 - protein, 9 aa, Homo Sapiens
GYFAKVKLA

SEQ ID NO: 1065899 - protein, 9 aa, Homo Sapiens
EKLDISKNS

SEQ ID NO: 1065900 - protein, 9 aa, Homo Sapiens
SLDALVKKK

SEQ ID NO: 1065901 - protein, 9 aa, Homo Sapiens
PAILPTNAM

SEQ ID NO: 1065902 - protein, 9 aa, Homo Sapiens
TFLCFSESI

SEQ ID NO: 1065903 - protein, 9 aa, Homo Sapiens
KGKGKQCED

SEQ ID NO: 1065904 - protein, 9 aa, Homo Sapiens
QKNCQGLGY

SEQ ID NO: 1065905 - protein, 9 aa, Homo Sapiens
VAHACYSST

SEQ ID NO: 1065906 - protein, 9 aa, Homo Sapiens
VPPLNFTMN

SEQ ID NO: 1065907 - protein, 9 aa, Homo Sapiens
DAASQESKY

SEQ ID NO: 1065908 - protein, 9 aa, Homo Sapiens
LEAIDSLNL

SEQ ID NO: 1065909 - protein, 9 aa, Homo Sapiens
FKDYSTAMD

SEQ ID NO: 1065910 - protein, 9 aa, Homo Sapiens
AKNDHYCTL

SEQ ID NO: 1065911 - protein, 9 aa, Homo Sapiens
GGLYVELHS

SEQ ID NO: 1065912 - protein, 9 aa, Homo Sapiens
CQVRTSYVL

SEQ ID NO: 1065913 - protein, 9 aa, Homo Sapiens
VRLSPAAAE

SEQ ID NO: 1065914 - protein, 9 aa, Homo Sapiens
YSNAQESKQ

SEQ ID NO: 1065915 - protein, 9 aa, Homo Sapiens
NISMVLFIY

SEQ ID NO: 1065916 - protein, 9 aa, Homo Sapiens
EIHKKNLLK

SEQ ID NO: 1065917 - protein, 9 aa, Homo Sapiens
NGKNWEYIQ

SEQ ID NO: 1065918 - protein, 9 aa, Homo Sapiens
WNVPDLLAG

SEQ ID NO: 1065919 - protein, 9 aa, Homo Sapiens
QNISIYLPS

SEQ ID NO: 1065920 - protein, 9 aa, Homo Sapiens
ERSSLLLLP

SEQ ID NO: 1065921 - protein, 9 aa, Homo Sapiens
CCKLKIIKI

SEQ ID NO: 1065922 - protein, 9 aa, Homo Sapiens
RDPMGSEGV

SEQ ID NO: 1065923 - protein, 9 aa, Homo Sapiens
SALWVSAEH

SEQ ID NO: 1065924 - protein, 9 aa, Homo Sapiens
THPICLFLD

SEQ ID NO: 1065925 - protein, 9 aa, Homo Sapiens
FFVNKLDPS

SEQ ID NO: 1065926 - protein, 9 aa, Homo Sapiens
WGACPLPSG

SEQ ID NO: 1065927 - protein, 9 aa, Homo Sapiens
NLNALDRYR

SEQ ID NO: 1065928 - protein, 9 aa, Homo Sapiens
LEDSSLSPV

SEQ ID NO: 1065929 - protein, 9 aa, Homo Sapiens
IVDEHETKI

SEQ ID NO: 1065930 - protein, 9 aa, Homo Sapiens
QPVCGNEIL

SEQ ID NO: 1065931 - protein, 9 aa, Homo Sapiens
LSISEDTPR

SEQ ID NO: 1065932 - protein, 9 aa, Homo Sapiens
RQTGPILEN

SEQ ID NO: 1065933 - protein, 9 aa, Homo Sapiens
KSELTGSSE

SEQ ID NO: 1065934 - protein, 9 aa, Homo Sapiens
QNDITPLHI

SEQ ID NO: 1065935 - protein, 9 aa, Homo Sapiens
RGPIPGPIL

SEQ ID NO: 1065936 - protein, 9 aa, Homo Sapiens
RDAEDKTPG

SEQ ID NO: 1065937 - protein, 9 aa, Homo Sapiens
HILHQTVTA

SEQ ID NO: 1065938 - protein, 9 aa, Homo Sapiens
PILEAAKLK

SEQ ID NO: 1065939 - protein, 9 aa, Homo Sapiens
KDYSTAMDT

SEQ ID NO: 1065940 - protein, 9 aa, Homo Sapiens
MESDLSLII

SEQ ID NO: 1065941 - protein, 9 aa, Homo Sapiens
LNLQNYILT

SEQ ID NO: 1065942 - protein, 9 aa, Homo Sapiens
IKNPLGTQD

SEQ ID NO: 1065943 - protein, 9 aa, Homo Sapiens
TVEKAAAPR

SEQ ID NO: 1065944 - protein, 9 aa, Homo Sapiens
LLLCGIDKF

SEQ ID NO: 1065945 - protein, 9 aa, Homo Sapiens
AQPLSENLP

SEQ ID NO: 1065946 - protein, 9 aa, Homo Sapiens
SASKRPSKD

SEQ ID NO: 1065947 - protein, 9 aa, Homo Sapiens
KFTIFESCD

SEQ ID NO: 1065948 - protein, 9 aa, Homo Sapiens
NKEDKLKDW

SEQ ID NO: 1065949 - protein, 9 aa, Homo Sapiens
LAEKQEDKA

SEQ ID NO: 1065950 - protein, 9 aa, Homo Sapiens
TSLSMQILG

SEQ ID NO: 1065951 - protein, 9 aa, Homo Sapiens
ITLLLMLIF

SEQ ID NO: 1065952 - protein, 9 aa, Homo Sapiens
ALFVNLLLL

SEQ ID NO: 1065953 - protein, 9 aa, Homo Sapiens
ELEETKSKL

SEQ ID NO: 1065954 - protein, 9 aa, Homo Sapiens
SNSGQGAPP

SEQ ID NO: 1065955 - protein, 9 aa, Homo Sapiens
SLWSQSYED

SEQ ID NO: 1065956 - protein, 9 aa, Homo Sapiens
SRQYKHLDG

SEQ ID NO: 1065957 - protein, 9 aa, Homo Sapiens
FFRGLQSDQ

SEQ ID NO: 1065958 - protein, 9 aa, Homo Sapiens
AWEEKELIT

SEQ ID NO: 1065959 - protein, 9 aa, Homo Sapiens
FCREQQHVM

SEQ ID NO: 1065960 - protein, 9 aa, Homo Sapiens
EPHEVLNFA

SEQ ID NO: 1065961 - protein, 9 aa, Homo Sapiens
LLESHIRTI

SEQ ID NO: 1065962 - protein, 9 aa, Homo Sapiens
ETRDLEEIS

SEQ ID NO: 1065963 - protein, 9 aa, Homo Sapiens
VQNSTLSES

SEQ ID NO: 1065964 - protein, 9 aa, Homo Sapiens
KKAVELWEK

SEQ ID NO: 1065965 - protein, 9 aa, Homo Sapiens
IKSGQQAEP

SEQ ID NO: 1065966 - protein, 9 aa, Homo Sapiens
SMAFALLAN

SEQ ID NO: 1065967 - protein, 9 aa, Homo Sapiens
KTCEGNATN

SEQ ID NO: 1065968 - protein, 9 aa, Homo Sapiens
AFSPPSGGG

SEQ ID NO: 1065969 - protein, 9 aa, Homo Sapiens
RPGEGGGAA

SEQ ID NO: 1065970 - protein, 9 aa, Homo Sapiens
SCVITKDCQ

SEQ ID NO: 1065971 - protein, 9 aa, Homo Sapiens
TILCLLPDD

SEQ ID NO: 1065972 - protein, 9 aa, Homo Sapiens
SCDLEEEAP

SEQ ID NO: 1065973 - protein, 9 aa, Homo Sapiens
IIFFFLALT

SEQ ID NO: 1065974 - protein, 9 aa, Homo Sapiens
KGLHLNSTT

SEQ ID NO: 1065975 - protein, 9 aa, Homo Sapiens
GKLLLFSSV

SEQ ID NO: 1065976 - protein, 9 aa, Homo Sapiens
SDLESSKGS

SEQ ID NO: 1065977 - protein, 9 aa, Homo Sapiens
MAASEPVVY

SEQ ID NO: 1065978 - protein, 9 aa, Homo Sapiens
QSYWEVGLF

SEQ ID NO: 1065979 - protein, 9 aa, Homo Sapiens
MYGGGTSLL

SEQ ID NO: 1065980 - protein, 9 aa, Homo Sapiens
MTAYSNVTM

SEQ ID NO: 1065981 - protein, 9 aa, Homo Sapiens
ARLGVASLP

SEQ ID NO: 1065982 - protein, 9 aa, Homo Sapiens
KNYDVTIQG

SEQ ID NO: 1065983 - protein, 9 aa, Homo Sapiens
MLMDFFVER

SEQ ID NO: 1065984 - protein, 9 aa, Homo Sapiens
SQSMLWLAD

SEQ ID NO: 1065985 - protein, 9 aa, Homo Sapiens
RTNDLSDYT

SEQ ID NO: 1065986 - protein, 9 aa, Homo Sapiens
VFCHTAGLK

SEQ ID NO: 1065987 - protein, 9 aa, Homo Sapiens
RTYAEINQA

SEQ ID NO: 1065988 - protein, 9 aa, Homo Sapiens
TSTDLVQLW

SEQ ID NO: 1065989 - protein, 9 aa, Homo Sapiens
MVPESEFSG

SEQ ID NO: 1065990 - protein, 9 aa, Homo Sapiens
VVELWQKDS

SEQ ID NO: 1065991 - protein, 9 aa, Homo Sapiens
IEKSIEILG

SEQ ID NO: 1065992 - protein, 9 aa, Homo Sapiens
ATQGQSRGL

SEQ ID NO: 1065993 - protein, 9 aa, Homo Sapiens
DYIFSERDN

SEQ ID NO: 1065994 - protein, 9 aa, Homo Sapiens
SAYVSFFFN

SEQ ID NO: 1065995 - protein, 9 aa, Homo Sapiens
RYLLAHFSP

SEQ ID NO: 1065996 - protein, 9 aa, Homo Sapiens
AASGALPGS

SEQ ID NO: 1065997 - protein, 9 aa, Homo Sapiens
ASGFGAVTG

SEQ ID NO: 1065998 - protein, 9 aa, Homo Sapiens
YCNSNSQIS

SEQ ID NO: 1065999 - protein, 9 aa, Homo Sapiens
EVWYILASS

SEQ ID NO: 1066000 - protein, 9 aa, Homo Sapiens
ILQKKEEAE

SEQ ID NO: 1066001 - protein, 9 aa, Homo Sapiens
NEILESNEE

SEQ ID NO: 1066002 - protein, 9 aa, Homo Sapiens
VLPMGLNGK

SEQ ID NO: 1066003 - protein, 9 aa, Homo Sapiens
GTVTTPADW

SEQ ID NO: 1066004 - protein, 9 aa, Homo Sapiens
TSWNRMIGE

SEQ ID NO: 1066005 - protein, 9 aa, Homo Sapiens
LQHFLSVFL

SEQ ID NO: 1066006 - protein, 9 aa, Homo Sapiens
EMLVFLKLA

SEQ ID NO: 1066007 - protein, 9 aa, Homo Sapiens
CPQNITSTL

SEQ ID NO: 1066008 - protein, 9 aa, Homo Sapiens
ASIVPFMRQ

SEQ ID NO: 1066009 - protein, 9 aa, Homo Sapiens
QDKDLPRPL

SEQ ID NO: 1066010 - protein, 9 aa, Homo Sapiens
FWLKMNSIV

SEQ ID NO: 1066011 - protein, 9 aa, Homo Sapiens
PGDQIVMII

SEQ ID NO: 1066012 - protein, 9 aa, Homo Sapiens
GDPRGPRGP

SEQ ID NO: 1066013 - protein, 9 aa, Homo Sapiens
WEAGHGENV

SEQ ID NO: 1066014 - protein, 9 aa, Homo Sapiens
EYGFPGILE

SEQ ID NO: 1066015 - protein, 9 aa, Homo Sapiens
LPGIYDIYS

SEQ ID NO: 1066016 - protein, 9 aa, Homo Sapiens
AKDMNLVKE

SEQ ID NO: 1066017 - protein, 9 aa, Homo Sapiens
CSNSEDKLQ

SEQ ID NO: 1066018 - protein, 9 aa, Homo Sapiens
QLTAKKICY

SEQ ID NO: 1066019 - protein, 9 aa, Homo Sapiens
ERVLVALKL

SEQ ID NO: 1066020 - protein, 9 aa, Homo Sapiens
EEYHLNPKT

SEQ ID NO: 1066021 - protein, 9 aa, Homo Sapiens
RSSRWPVVV

SEQ ID NO: 1066022 - protein, 9 aa, Homo Sapiens
GGKHQENKV

SEQ ID NO: 1066023 - protein, 9 aa, Homo Sapiens
PCENQKITL

SEQ ID NO: 1066024 - protein, 9 aa, Homo Sapiens
INWAQWKDF

SEQ ID NO: 1066025 - protein, 9 aa, Homo Sapiens
SEIQNQEID

SEQ ID NO: 1066026 - protein, 9 aa, Homo Sapiens
VDYNLKWNS

SEQ ID NO: 1066027 - protein, 9 aa, Homo Sapiens
IYKKRKLAE

SEQ ID NO: 1066028 - protein, 9 aa, Homo Sapiens
SVPQPRSSR

SEQ ID NO: 1066029 - protein, 9 aa, Homo Sapiens
KWNSSPPAC

SEQ ID NO: 1066030 - protein, 9 aa, Homo Sapiens
LTHQISKEY

SEQ ID NO: 1066031 - protein, 9 aa, Homo Sapiens
HFPYGPSPL

SEQ ID NO: 1066032 - protein, 9 aa, Homo Sapiens
VELANTSCQ

SEQ ID NO: 1066033 - protein, 9 aa, Homo Sapiens
SKIGDDNKN

SEQ ID NO: 1066034 - protein, 9 aa, Homo Sapiens
ATPRKEGTL

SEQ ID NO: 1066035 - protein, 9 aa, Homo Sapiens
KEGGIEFSQ

SEQ ID NO: 1066036 - protein, 9 aa, Homo Sapiens
AREDQIIGM

SEQ ID NO: 1066037 - protein, 9 aa, Homo Sapiens
MTEEVAWEA

SEQ ID NO: 1066038 - protein, 9 aa, Homo Sapiens
VHPFGLSLA

SEQ ID NO: 1066039 - protein, 9 aa, Homo Sapiens
PGGHLGSFN

SEQ ID NO: 1066040 - protein, 9 aa, Homo Sapiens
KAEEWLFFF

SEQ ID NO: 1066041 - protein, 9 aa, Homo Sapiens
LFQNSGNTD

SEQ ID NO: 1066042 - protein, 9 aa, Homo Sapiens
PLRVLYHFA

SEQ ID NO: 1066043 - protein, 9 aa, Homo Sapiens
KSKPGVQEE

SEQ ID NO: 1066044 - protein, 9 aa, Homo Sapiens
ENGFVSPPP

SEQ ID NO: 1066045 - protein, 9 aa, Homo Sapiens
KTGQSVDSG

SEQ ID NO: 1066046 - protein, 9 aa, Homo Sapiens
LLSPEDSRL

SEQ ID NO: 1066047 - protein, 9 aa, Homo Sapiens
NLSPSLVPA

SEQ ID NO: 1066048 - protein, 9 aa, Homo Sapiens
TPEHVVPYR

SEQ ID NO: 1066049 - protein, 9 aa, Homo Sapiens
NYVNRDLAA

SEQ ID NO: 1066050 - protein, 9 aa, Homo Sapiens
KERIEKYGA

SEQ ID NO: 1066051 - protein, 9 aa, Homo Sapiens
SVAATLYVR

SEQ ID NO: 1066052 - protein, 9 aa, Homo Sapiens
EGGVCLNEG

SEQ ID NO: 1066053 - protein, 9 aa, Homo Sapiens
KNSKNFERA

SEQ ID NO: 1066054 - protein, 9 aa, Homo Sapiens
LKHMLVDDD

SEQ ID NO: 1066055 - protein, 9 aa, Homo Sapiens
SWDLGPAQI

SEQ ID NO: 1066056 - protein, 9 aa, Homo Sapiens
HTNYIYSLS

SEQ ID NO: 1066057 - protein, 9 aa, Homo Sapiens
SITAPKMLM

SEQ ID NO: 1066058 - protein, 9 aa, Homo Sapiens
FPDYCIRDR

SEQ ID NO: 1066059 - protein, 9 aa, Homo Sapiens
KQVFLYSEK

SEQ ID NO: 1066060 - protein, 9 aa, Homo Sapiens
TPALEDSSL

SEQ ID NO: 1066061 - protein, 9 aa, Homo Sapiens
LEPFHKRFS

SEQ ID NO: 1066062 - protein, 9 aa, Homo Sapiens
VLLILYTIT

SEQ ID NO: 1066063 - protein, 9 aa, Homo Sapiens
PSIKSKKKR

SEQ ID NO: 1066064 - protein, 9 aa, Homo Sapiens
RSQTVMCSC

SEQ ID NO: 1066065 - protein, 9 aa, Homo Sapiens
EFSQIYYDR

SEQ ID NO: 1066066 - protein, 9 aa, Homo Sapiens
RSRKLLKPR

SEQ ID NO: 1066067 - protein, 9 aa, Homo Sapiens
SQSMTIMVL

SEQ ID NO: 1066068 - protein, 9 aa, Homo Sapiens
ETGFIPIPG

SEQ ID NO: 1066069 - protein, 9 aa, Homo Sapiens
VTRNPSSSW

SEQ ID NO: 1066070 - protein, 9 aa, Homo Sapiens
QYPGVCYPV

SEQ ID NO: 1066071 - protein, 9 aa, Homo Sapiens
NDFPCHHGK

SEQ ID NO: 1066072 - protein, 9 aa, Homo Sapiens
YKCEECSKV

SEQ ID NO: 1066073 - protein, 9 aa, Homo Sapiens
KLNPGPLYP

SEQ ID NO: 1066074 - protein, 9 aa, Homo Sapiens
EIIEVKDAK

SEQ ID NO: 1066075 - protein, 9 aa, Homo Sapiens
HYCTLVRTG

SEQ ID NO: 1066076 - protein, 9 aa, Homo Sapiens
NTRCDAGWL

SEQ ID NO: 1066077 - protein, 9 aa, Homo Sapiens
LDSISKLPE

SEQ ID NO: 1066078 - protein, 9 aa, Homo Sapiens
FNKQQYKMV

SEQ ID NO: 1066079 - protein, 9 aa, Homo Sapiens
RIEERLYYL

SEQ ID NO: 1066080 - protein, 9 aa, Homo Sapiens
RKHTSSGIL

SEQ ID NO: 1066081 - protein, 9 aa, Homo Sapiens
SETGDYCVQ

SEQ ID NO: 1066082 - protein, 9 aa, Homo Sapiens
LSDGNIYVL

SEQ ID NO: 1066083 - protein, 9 aa, Homo Sapiens
ERLVDPVTH

SEQ ID NO: 1066084 - protein, 9 aa, Homo Sapiens
VRAGVSGLA

SEQ ID NO: 1066085 - protein, 9 aa, Homo Sapiens
KESKAPERR

SEQ ID NO: 1066086 - protein, 9 aa, Homo Sapiens
LELPKTFLN

SEQ ID NO: 1066087 - protein, 9 aa, Homo Sapiens
SFTTKIKGL

SEQ ID NO: 1066088 - protein, 9 aa, Homo Sapiens
EADIHQSFR

SEQ ID NO: 1066089 - protein, 9 aa, Homo Sapiens
EMRKDSSGA

SEQ ID NO: 1066090 - protein, 9 aa, Homo Sapiens
EEEEESSKK

SEQ ID NO: 1066091 - protein, 9 aa, Homo Sapiens
LKEEETEKA

SEQ ID NO: 1066092 - protein, 9 aa, Homo Sapiens
LVSEVNIYN

SEQ ID NO: 1066093 - protein, 9 aa, Homo Sapiens
KRQNSLRFS

SEQ ID NO: 1066094 - protein, 9 aa, Homo Sapiens
FFFVSVIYK

SEQ ID NO: 1066095 - protein, 9 aa, Homo Sapiens
SVNWWAFGV

SEQ ID NO: 1066096 - protein, 9 aa, Homo Sapiens
HLLPEPPKT

SEQ ID NO: 1066097 - protein, 9 aa, Homo Sapiens
TRVIMSVNN

SEQ ID NO: 1066098 - protein, 9 aa, Homo Sapiens
SSRWPVVVA

SEQ ID NO: 1066099 - protein, 9 aa, Homo Sapiens
RQKDDYCEA

SEQ ID NO: 1066100 - protein, 9 aa, Homo Sapiens
KERISDNRD

SEQ ID NO: 1066101 - protein, 9 aa, Homo Sapiens
GMLTCRCPT

SEQ ID NO: 1066102 - protein, 9 aa, Homo Sapiens
GINFNECEN

SEQ ID NO: 1066103 - protein, 9 aa, Homo Sapiens
ASQESKYQL

SEQ ID NO: 1066104 - protein, 9 aa, Homo Sapiens
SYVVDLLDS

SEQ ID NO: 1066105 - protein, 9 aa, Homo Sapiens
RGGTSHLDP

SEQ ID NO: 1066106 - protein, 9 aa, Homo Sapiens
ASLDPRSSR

SEQ ID NO: 1066107 - protein, 9 aa, Homo Sapiens
RQDLETSFQ

SEQ ID NO: 1066108 - protein, 9 aa, Homo Sapiens
LRAWPASGH

SEQ ID NO: 1066109 - protein, 9 aa, Homo Sapiens
ITWNGLLLT

SEQ ID NO: 1066110 - protein, 9 aa, Homo Sapiens
GLSLWVEYE

SEQ ID NO: 1066111 - protein, 9 aa, Homo Sapiens
KKGQGNSDS

SEQ ID NO: 1066112 - protein, 9 aa, Homo Sapiens
SLSGASGGH

SEQ ID NO: 1066113 - protein, 9 aa, Homo Sapiens
AQTHPREFQ

SEQ ID NO: 1066114 - protein, 9 aa, Homo Sapiens
LSTSSLDLW

SEQ ID NO: 1066115 - protein, 9 aa, Homo Sapiens
PDYKDHQNE

SEQ ID NO: 1066116 - protein, 9 aa, Homo Sapiens
PGETSAEAC

SEQ ID NO: 1066117 - protein, 9 aa, Homo Sapiens
DELKIRNPA

SEQ ID NO: 1066118 - protein, 9 aa, Homo Sapiens
ACTCLAGWR

SEQ ID NO: 1066119 - protein, 9 aa, Homo Sapiens
LRKKKESSK

SEQ ID NO: 1066120 - protein, 9 aa, Homo Sapiens
AMKHIVILF

SEQ ID NO: 1066121 - protein, 9 aa, Homo Sapiens
YHTPLYLTA

SEQ ID NO: 1066122 - protein, 9 aa, Homo Sapiens
DALLKLGRL

SEQ ID NO: 1066123 - protein, 9 aa, Homo Sapiens
QAVEIKVES

SEQ ID NO: 1066124 - protein, 9 aa, Homo Sapiens
NSDEFKLFM

SEQ ID NO: 1066125 - protein, 9 aa, Homo Sapiens
VFIASIAVV

SEQ ID NO: 1066126 - protein, 9 aa, Homo Sapiens
ECFCADHLL

SEQ ID NO: 1066127 - protein, 9 aa, Homo Sapiens
KTLRKITDQ

SEQ ID NO: 1066128 - protein, 9 aa, Homo Sapiens
KLGALYRTL

SEQ ID NO: 1066129 - protein, 9 aa, Homo Sapiens
YKFILNDAL

SEQ ID NO: 1066130 - protein, 9 aa, Homo Sapiens
VSAAALVFG

SEQ ID NO: 1066131 - protein, 9 aa, Homo Sapiens
RNLDTGTNG

SEQ ID NO: 1066132 - protein, 9 aa, Homo Sapiens
RLEQDGIID

SEQ ID NO: 1066133 - protein, 9 aa, Homo Sapiens
YLLRKYAVK

SEQ ID NO: 1066134 - protein, 9 aa, Homo Sapiens
LPNSRPGKC

SEQ ID NO: 1066135 - protein, 9 aa, Homo Sapiens
LLPRVPWFI

SEQ ID NO: 1066136 - protein, 9 aa, Homo Sapiens
KTFLNEKAG

SEQ ID NO: 1066137 - protein, 9 aa, Homo Sapiens
TGPRETSLE

SEQ ID NO: 1066138 - protein, 9 aa, Homo Sapiens
RNPDGHSMS

SEQ ID NO: 1066139 - protein, 9 aa, Homo Sapiens
SLVDSTLAP

SEQ ID NO: 1066140 - protein, 9 aa, Homo Sapiens
SVSLPGLLI

SEQ ID NO: 1066141 - protein, 9 aa, Homo Sapiens
AVEWGLQNI

SEQ ID NO: 1066142 - protein, 9 aa, Homo Sapiens
GGGGYYEEY

SEQ ID NO: 1066143 - protein, 9 aa, Homo Sapiens
KTEEYPLAD

SEQ ID NO: 1066144 - protein, 9 aa, Homo Sapiens
VELSQRMLF

SEQ ID NO: 1066145 - protein, 9 aa, Homo Sapiens
DNPELSAFH

SEQ ID NO: 1066146 - protein, 9 aa, Homo Sapiens
GMPDHLFPL

SEQ ID NO: 1066147 - protein, 9 aa, Homo Sapiens
IGDLLDSMN

SEQ ID NO: 1066148 - protein, 9 aa, Homo Sapiens
VTVVENGLI

SEQ ID NO: 1066149 - protein, 9 aa, Homo Sapiens
KNMDMNPEC

SEQ ID NO: 1066150 - protein, 9 aa, Homo Sapiens
FRTEGPIAQ

SEQ ID NO: 1066151 - protein, 9 aa, Homo Sapiens
FDLLHKYQS

SEQ ID NO: 1066152 - protein, 9 aa, Homo Sapiens
DILETNFNA

SEQ ID NO: 1066153 - protein, 9 aa, Homo Sapiens
SGKRQIEST

SEQ ID NO: 1066154 - protein, 9 aa, Homo Sapiens
YSSTLGGQG

SEQ ID NO: 1066155 - protein, 9 aa, Homo Sapiens
KLNGPVIML

SEQ ID NO: 1066156 - protein, 9 aa, Homo Sapiens
HYQDFRTQL

SEQ ID NO: 1066157 - protein, 9 aa, Homo Sapiens
NSKRYYVAE

SEQ ID NO: 1066158 - protein, 9 aa, Homo Sapiens
ADPGEAGTD

SEQ ID NO: 1066159 - protein, 9 aa, Homo Sapiens
DFEGSKLKV

SEQ ID NO: 1066160 - protein, 9 aa, Homo Sapiens
HFILKQKSQ

SEQ ID NO: 1066161 - protein, 9 aa, Homo Sapiens
KKDETDEFF

SEQ ID NO: 1066162 - protein, 9 aa, Homo Sapiens
PSERRNKSG

SEQ ID NO: 1066163 - protein, 9 aa, Homo Sapiens
WRGPSPLFQ

SEQ ID NO: 1066164 - protein, 9 aa, Homo Sapiens
ILSYAGGLL

SEQ ID NO: 1066165 - protein, 9 aa, Homo Sapiens
FRVDEAKSL

SEQ ID NO: 1066166 - protein, 9 aa, Homo Sapiens
SVSSSSDGS

SEQ ID NO: 1066167 - protein, 9 aa, Homo Sapiens
SEDSSISFS

SEQ ID NO: 1066168 - protein, 9 aa, Homo Sapiens
FGGVAQAAG

SEQ ID NO: 1066169 - protein, 9 aa, Homo Sapiens
HKILLPGRD

SEQ ID NO: 1066170 - protein, 9 aa, Homo Sapiens
TTLPPETPS

SEQ ID NO: 1066171 - protein, 9 aa, Homo Sapiens
SGLLVGYKL

SEQ ID NO: 1066172 - protein, 9 aa, Homo Sapiens
NITKDTRLA

SEQ ID NO: 1066173 - protein, 9 aa, Homo Sapiens
IFEPYEPSP

SEQ ID NO: 1066174 - protein, 9 aa, Homo Sapiens
YNAELSQMQ

SEQ ID NO: 1066175 - protein, 9 aa, Homo Sapiens
SLQMAVGLF

SEQ ID NO: 1066176 - protein, 9 aa, Homo Sapiens
DIACRSILH

SEQ ID NO: 1066177 - protein, 9 aa, Homo Sapiens
LVVLLALLG

SEQ ID NO: 1066178 - protein, 9 aa, Homo Sapiens
VFTQLLAPS

SEQ ID NO: 1066179 - protein, 9 aa, Homo Sapiens
NLLRSPFIK

SEQ ID NO: 1066180 - protein, 9 aa, Homo Sapiens
TWTINGLML

SEQ ID NO: 1066181 - protein, 9 aa, Homo Sapiens
LLGLGMTVD

SEQ ID NO: 1066182 - protein, 9 aa, Homo Sapiens
LDNLFSKEG

SEQ ID NO: 1066183 - protein, 9 aa, Homo Sapiens
LPSPSKSMV

SEQ ID NO: 1066184 - protein, 9 aa, Homo Sapiens
FTLGETRAQ

SEQ ID NO: 1066185 - protein, 9 aa, Homo Sapiens
ASVAAVART

SEQ ID NO: 1066186 - protein, 9 aa, Homo Sapiens
RMVDGLLLT

SEQ ID NO: 1066187 - protein, 9 aa, Homo Sapiens
PWVLPMGLN

SEQ ID NO: 1066188 - protein, 9 aa, Homo Sapiens
ARERPRLGP

SEQ ID NO: 1066189 - protein, 9 aa, Homo Sapiens
QHQGLLSPG

SEQ ID NO: 1066190 - protein, 9 aa, Homo Sapiens
DFKQEMATA

SEQ ID NO: 1066191 - protein, 9 aa, Homo Sapiens
EQEETTKKE

SEQ ID NO: 1066192 - protein, 9 aa, Homo Sapiens
ASEEFLSYL

SEQ ID NO: 1066193 - protein, 9 aa, Homo Sapiens
WKIDVILDR

SEQ ID NO: 1066194 - protein, 9 aa, Homo Sapiens
KPTPNPRLQ

SEQ ID NO: 1066195 - protein, 9 aa, Homo Sapiens
QNQEIDEKF

SEQ ID NO: 1066196 - protein, 9 aa, Homo Sapiens
SLMLNHVKN

SEQ ID NO: 1066197 - protein, 9 aa, Homo Sapiens
LHLFLFTSN

SEQ ID NO: 1066198 - protein, 9 aa, Homo Sapiens
NVLVVFFGF

SEQ ID NO: 1066199 - protein, 9 aa, Homo Sapiens
ENGYVQSPR

SEQ ID NO: 1066200 - protein, 9 aa, Homo Sapiens
KKWDQFYSK

SEQ ID NO: 1066201 - protein, 9 aa, Homo Sapiens
KTTHRDLAR

SEQ ID NO: 1066202 - protein, 9 aa, Homo Sapiens
ISQNNLTKI

SEQ ID NO: 1066203 - protein, 9 aa, Homo Sapiens
TFSEPQKIS

SEQ ID NO: 1066204 - protein, 9 aa, Homo Sapiens
QEPKADGPN

SEQ ID NO: 1066205 - protein, 9 aa, Homo Sapiens
IFCSEDSSI

SEQ ID NO: 1066206 - protein, 9 aa, Homo Sapiens
CTQHITWNG

SEQ ID NO: 1066207 - protein, 9 aa, Homo Sapiens
DNKNLTFKL

SEQ ID NO: 1066208 - protein, 9 aa, Homo Sapiens
CTFGRGDTD

SEQ ID NO: 1066209 - protein, 9 aa, Homo Sapiens
TIYYLMKSS

SEQ ID NO: 1066210 - protein, 9 aa, Homo Sapiens
IKFLGEEVP

SEQ ID NO: 1066211 - protein, 9 aa, Homo Sapiens
SASPVENTS

SEQ ID NO: 1066212 - protein, 9 aa, Homo Sapiens
TLAELCCGL

SEQ ID NO: 1066213 - protein, 9 aa, Homo Sapiens
VYVNQNKFL

SEQ ID NO: 1066214 - protein, 9 aa, Homo Sapiens
VLPSPSKSM

SEQ ID NO: 1066215 - protein, 9 aa, Homo Sapiens
GLLTKSGTL

SEQ ID NO: 1066216 - protein, 9 aa, Homo Sapiens
IAPLPLPFE

SEQ ID NO: 1066217 - protein, 9 aa, Homo Sapiens
NQVEKFINN

SEQ ID NO: 1066218 - protein, 9 aa, Homo Sapiens
KDDMEFGED

SEQ ID NO: 1066219 - protein, 9 aa, Homo Sapiens
VTIRRREEA

SEQ ID NO: 1066220 - protein, 9 aa, Homo Sapiens
QTTAKAVQH

SEQ ID NO: 1066221 - protein, 9 aa, Homo Sapiens
HRQTARRTP

SEQ ID NO: 1066222 - protein, 9 aa, Homo Sapiens
KNTFTESAE

SEQ ID NO: 1066223 - protein, 9 aa, Homo Sapiens
CSSPCKTCE

SEQ ID NO: 1066224 - protein, 9 aa, Homo Sapiens
CPSQPPSFL

SEQ ID NO: 1066225 - protein, 9 aa, Homo Sapiens
CPLPGSSGG

SEQ ID NO: 1066226 - protein, 9 aa, Homo Sapiens
TSLAAPIIP

SEQ ID NO: 1066227 - protein, 9 aa, Homo Sapiens
ISKEYGVYL

SEQ ID NO: 1066228 - protein, 9 aa, Homo Sapiens
YFLAGEPRG

SEQ ID NO: 1066229 - protein, 9 aa, Homo Sapiens
VQVEFVSTG

SEQ ID NO: 1066230 - protein, 9 aa, Homo Sapiens
SFQQCLSGV

SEQ ID NO: 1066231 - protein, 9 aa, Homo Sapiens
FLTKLLNNF

SEQ ID NO: 1066232 - protein, 9 aa, Homo Sapiens
YPKTGLLII

SEQ ID NO: 1066233 - protein, 9 aa, Homo Sapiens
WGHHFSVNW

SEQ ID NO: 1066234 - protein, 9 aa, Homo Sapiens
SKELAKLRA

SEQ ID NO: 1066235 - protein, 9 aa, Homo Sapiens
LQMAVGLFL

SEQ ID NO: 1066236 - protein, 9 aa, Homo Sapiens
YKNLSGLRQ

SEQ ID NO: 1066237 - protein, 9 aa, Homo Sapiens
FFTPECVTG

SEQ ID NO: 1066238 - protein, 9 aa, Homo Sapiens
LFQKAREKN

SEQ ID NO: 1066239 - protein, 9 aa, Homo Sapiens
EFDTMQSSS

SEQ ID NO: 1066240 - protein, 9 aa, Homo Sapiens
YLPALLASL

SEQ ID NO: 1066241 - protein, 9 aa, Homo Sapiens
SAFCFLFNL

SEQ ID NO: 1066242 - protein, 9 aa, Homo Sapiens
EASDEPHEV

SEQ ID NO: 1066243 - protein, 9 aa, Homo Sapiens
LLDDKNDSL

SEQ ID NO: 1066244 - protein, 9 aa, Homo Sapiens
QIYPKTGLL

SEQ ID NO: 1066245 - protein, 9 aa, Homo Sapiens
LERLVDPVT

SEQ ID NO: 1066246 - protein, 9 aa, Homo Sapiens
VEDFLATVK

SEQ ID NO: 1066247 - protein, 9 aa, Homo Sapiens
RIKMVVVGI

SEQ ID NO: 1066248 - protein, 9 aa, Homo Sapiens
YNLKWNSDD

SEQ ID NO: 1066249 - protein, 9 aa, Homo Sapiens
KGMQEFILR

SEQ ID NO: 1066250 - protein, 9 aa, Homo Sapiens
YNKLQKQEK

SEQ ID NO: 1066251 - protein, 9 aa, Homo Sapiens
YKNGLFCTF

SEQ ID NO: 1066252 - protein, 9 aa, Homo Sapiens
DPDCRLCRF

SEQ ID NO: 1066253 - protein, 9 aa, Homo Sapiens
CHSRSDLKE

SEQ ID NO: 1066254 - protein, 9 aa, Homo Sapiens
PQCSYYTTK

SEQ ID NO: 1066255 - protein, 9 aa, Homo Sapiens
QRQPLRVLY

SEQ ID NO: 1066256 - protein, 9 aa, Homo Sapiens
RGSFTDVVT

SEQ ID NO: 1066257 - protein, 9 aa, Homo Sapiens
ILYDPQITA

SEQ ID NO: 1066258 - protein, 9 aa, Homo Sapiens
LAVEWGLQN

SEQ ID NO: 1066259 - protein, 9 aa, Homo Sapiens
EKTEEYPLA

SEQ ID NO: 1066260 - protein, 9 aa, Homo Sapiens
EPKGSPGFP

SEQ ID NO: 1066261 - protein, 9 aa, Homo Sapiens
ENLPSVICQ

SEQ ID NO: 1066262 - protein, 9 aa, Homo Sapiens
KKTCSATEA

SEQ ID NO: 1066263 - protein, 9 aa, Homo Sapiens
GERGQKGRP

SEQ ID NO: 1066264 - protein, 9 aa, Homo Sapiens
FFCVCTGPG

SEQ ID NO: 1066265 - protein, 9 aa, Homo Sapiens
KKRKRSRKK

SEQ ID NO: 1066266 - protein, 9 aa, Homo Sapiens
SAKNDHYCT

SEQ ID NO: 1066267 - protein, 9 aa, Homo Sapiens
ESHIRTITS

SEQ ID NO: 1066268 - protein, 9 aa, Homo Sapiens
PSLLSPKVR

SEQ ID NO: 1066269 - protein, 9 aa, Homo Sapiens
QHNNIAHMK

SEQ ID NO: 1066270 - protein, 9 aa, Homo Sapiens
RTWYLVSIP

SEQ ID NO: 1066271 - protein, 9 aa, Homo Sapiens
LMIQDKSFG

SEQ ID NO: 1066272 - protein, 9 aa, Homo Sapiens
DFGNTMCQF

SEQ ID NO: 1066273 - protein, 9 aa, Homo Sapiens
RLLAYLPKE

SEQ ID NO: 1066274 - protein, 9 aa, Homo Sapiens
HYVDVFRDL

SEQ ID NO: 1066275 - protein, 9 aa, Homo Sapiens
FEIFDFNNL

SEQ ID NO: 1066276 - protein, 9 aa, Homo Sapiens
CSIKLDNLN

SEQ ID NO: 1066277 - protein, 9 aa, Homo Sapiens
PSSCSTQNF

SEQ ID NO: 1066278 - protein, 9 aa, Homo Sapiens
NICDISCNK

SEQ ID NO: 1066279 - protein, 9 aa, Homo Sapiens
NCGEHPIFV

SEQ ID NO: 1066280 - protein, 9 aa, Homo Sapiens
EASLYSPSS

SEQ ID NO: 1066281 - protein, 9 aa, Homo Sapiens
PAKDRRAKE

SEQ ID NO: 1066282 - protein, 9 aa, Homo Sapiens
IRIYIFLNG

SEQ ID NO: 1066283 - protein, 9 aa, Homo Sapiens
DYTALLVDI

SEQ ID NO: 1066284 - protein, 9 aa, Homo Sapiens
NMTVLFKLD

SEQ ID NO: 1066285 - protein, 9 aa, Homo Sapiens
RREKGEAGE

SEQ ID NO: 1066286 - protein, 9 aa, Homo Sapiens
KIKEFYPTF

SEQ ID NO: 1066287 - protein, 9 aa, Homo Sapiens
AKSPLDIEG

SEQ ID NO: 1066288 - protein, 9 aa, Homo Sapiens
VFVWMKRMR

SEQ ID NO: 1066289 - protein, 9 aa, Homo Sapiens
PVSVPTASE

SEQ ID NO: 1066290 - protein, 9 aa, Homo Sapiens
EREETETIE

SEQ ID NO: 1066291 - protein, 9 aa, Homo Sapiens
NSSRRQYQE

SEQ ID NO: 1066292 - protein, 9 aa, Homo Sapiens
SMSYYQRPF

SEQ ID NO: 1066293 - protein, 9 aa, Homo Sapiens
EPMEEVQTL

SEQ ID NO: 1066294 - protein, 9 aa, Homo Sapiens
GNFFFPISV

SEQ ID NO: 1066295 - protein, 9 aa, Homo Sapiens
RHLKQIGNV

SEQ ID NO: 1066296 - protein, 9 aa, Homo Sapiens
IVLDSMLQE

SEQ ID NO: 1066297 - protein, 9 aa, Homo Sapiens
WLLYELQPA

SEQ ID NO: 1066298 - protein, 9 aa, Homo Sapiens
HASDCGEEK

SEQ ID NO: 1066299 - protein, 9 aa, Homo Sapiens
QFKIYDPQE

SEQ ID NO: 1066300 - protein, 9 aa, Homo Sapiens
ARWILMLLL

SEQ ID NO: 1066301 - protein, 9 aa, Homo Sapiens
LADIFDEDE

SEQ ID NO: 1066302 - protein, 9 aa, Homo Sapiens
PFLLSTCPG

SEQ ID NO: 1066303 - protein, 9 aa, Homo Sapiens
SPCSVSSQV

SEQ ID NO: 1066304 - protein, 9 aa, Homo Sapiens
KFLRKKKES

SEQ ID NO: 1066305 - protein, 9 aa, Homo Sapiens
FPGIQLKLD

SEQ ID NO: 1066306 - protein, 9 aa, Homo Sapiens
FIKHNNTLL

SEQ ID NO: 1066307 - protein, 9 aa, Homo Sapiens
EFEEFLAED

SEQ ID NO: 1066308 - protein, 9 aa, Homo Sapiens
PKRCPKIRE

SEQ ID NO: 1066309 - protein, 9 aa, Homo Sapiens
SGAQSLSTT

SEQ ID NO: 1066310 - protein, 9 aa, Homo Sapiens
FQRDKNAFP

SEQ ID NO: 1066311 - protein, 9 aa, Homo Sapiens
NEKSTMQKL

SEQ ID NO: 1066312 - protein, 9 aa, Homo Sapiens
PVQGPLAYR

SEQ ID NO: 1066313 - protein, 9 aa, Homo Sapiens
LAEKALDKA

SEQ ID NO: 1066314 - protein, 9 aa, Homo Sapiens
KTIYYEPLE

SEQ ID NO: 1066315 - protein, 9 aa, Homo Sapiens
DQSFENSDK

SEQ ID NO: 1066316 - protein, 9 aa, Homo Sapiens
GLQMLKSFQ

SEQ ID NO: 1066317 - protein, 9 aa, Homo Sapiens
QKEMKANYR

SEQ ID NO: 1066318 - protein, 9 aa, Homo Sapiens
KILKFVARN

SEQ ID NO: 1066319 - protein, 9 aa, Homo Sapiens
RTNCAYVVC

SEQ ID NO: 1066320 - protein, 9 aa, Homo Sapiens
KITKEDAVL

SEQ ID NO: 1066321 - protein, 9 aa, Homo Sapiens
LLSDAAKPF

SEQ ID NO: 1066322 - protein, 9 aa, Homo Sapiens
VESDDEKSL

SEQ ID NO: 1066323 - protein, 9 aa, Homo Sapiens
SGQQAEPLV

SEQ ID NO: 1066324 - protein, 9 aa, Homo Sapiens
VKSPEKTKS

SEQ ID NO: 1066325 - protein, 9 aa, Homo Sapiens
PWGLVFNNS

SEQ ID NO: 1066326 - protein, 9 aa, Homo Sapiens
NDIFYGRDS

SEQ ID NO: 1066327 - protein, 9 aa, Homo Sapiens
LTKHDNFHG

SEQ ID NO: 1066328 - protein, 9 aa, Homo Sapiens
TEKTFTISV

SEQ ID NO: 1066329 - protein, 9 aa, Homo Sapiens
FATSFEELG

SEQ ID NO: 1066330 - protein, 9 aa, Homo Sapiens
AQSSYLDAR

SEQ ID NO: 1066331 - protein, 9 aa, Homo Sapiens
LVQYFQQGL

SEQ ID NO: 1066332 - protein, 9 aa, Homo Sapiens
MMNYVYKER

SEQ ID NO: 1066333 - protein, 9 aa, Homo Sapiens
KGLVNDIKK

SEQ ID NO: 1066334 - protein, 9 aa, Homo Sapiens
LPEIDFRGG

SEQ ID NO: 1066335 - protein, 9 aa, Homo Sapiens
NETHHLFVS

SEQ ID NO: 1066336 - protein, 9 aa, Homo Sapiens
LYEAWAAIF

SEQ ID NO: 1066337 - protein, 9 aa, Homo Sapiens
PVPGIGKEL

SEQ ID NO: 1066338 - protein, 9 aa, Homo Sapiens
ANAAAWIFP

SEQ ID NO: 1066339 - protein, 9 aa, Homo Sapiens
KELTSETVF

SEQ ID NO: 1066340 - protein, 9 aa, Homo Sapiens
PGAPGFPES

SEQ ID NO: 1066341 - protein, 9 aa, Homo Sapiens
RTPSTFPSL

SEQ ID NO: 1066342 - protein, 9 aa, Homo Sapiens
PKGSTRFPG

SEQ ID NO: 1066343 - protein, 9 aa, Homo Sapiens
DLSLNPINF

SEQ ID NO: 1066344 - protein, 9 aa, Homo Sapiens
SAFYFTEWE

SEQ ID NO: 1066345 - protein, 9 aa, Homo Sapiens
CHFLPNKVK

SEQ ID NO: 1066346 - protein, 9 aa, Homo Sapiens
APERRVVVA

SEQ ID NO: 1066347 - protein, 9 aa, Homo Sapiens
QPPSHARYL

SEQ ID NO: 1066348 - protein, 9 aa, Homo Sapiens
GKGTYSLGS

SEQ ID NO: 1066349 - protein, 9 aa, Homo Sapiens
PGAPGGQAL

SEQ ID NO: 1066350 - protein, 9 aa, Homo Sapiens
IYNVNNGIQ

SEQ ID NO: 1066351 - protein, 9 aa, Homo Sapiens
PSQACLLVL

SEQ ID NO: 1066352 - protein, 9 aa, Homo Sapiens
KMRKKEEEA

SEQ ID NO: 1066353 - protein, 9 aa, Homo Sapiens
IVYMGWCKA

SEQ ID NO: 1066354 - protein, 9 aa, Homo Sapiens
GVTSSPAAP

SEQ ID NO: 1066355 - protein, 9 aa, Homo Sapiens
FLASASLRP

SEQ ID NO: 1066356 - protein, 9 aa, Homo Sapiens
QLYWKEGKD

SEQ ID NO: 1066357 - protein, 9 aa, Homo Sapiens
MMRCARFVS

SEQ ID NO: 1066358 - protein, 9 aa, Homo Sapiens
SYTQIVSSV

SEQ ID NO: 1066359 - protein, 9 aa, Homo Sapiens
RMGRKKGQG

SEQ ID NO: 1066360 - protein, 9 aa, Homo Sapiens
GKLPSPSPT

SEQ ID NO: 1066361 - protein, 9 aa, Homo Sapiens
KKQTTKKLT

SEQ ID NO: 1066362 - protein, 9 aa, Homo Sapiens
AMAYNRFIA

SEQ ID NO: 1066363 - protein, 9 aa, Homo Sapiens
IPGPILGPA

SEQ ID NO: 1066364 - protein, 9 aa, Homo Sapiens
DISDSPKKV

SEQ ID NO: 1066365 - protein, 9 aa, Homo Sapiens
PSAPRSVVF

SEQ ID NO: 1066366 - protein, 9 aa, Homo Sapiens
LERLKPASH

SEQ ID NO: 1066367 - protein, 9 aa, Homo Sapiens
CMKVPGSEN

SEQ ID NO: 1066368 - protein, 9 aa, Homo Sapiens
SMFKGVGLA

SEQ ID NO: 1066369 - protein, 9 aa, Homo Sapiens
PDTLCFQIC

SEQ ID NO: 1066370 - protein, 9 aa, Homo Sapiens
NQFMNSRMQ

SEQ ID NO: 1066371 - protein, 9 aa, Homo Sapiens
DGVQDLLLP

SEQ ID NO: 1066372 - protein, 9 aa, Homo Sapiens
AVDVLLQGA

SEQ ID NO: 1066373 - protein, 9 aa, Homo Sapiens
DISRTLGPS

SEQ ID NO: 1066374 - protein, 9 aa, Homo Sapiens
TFCMAISIP

SEQ ID NO: 1066375 - protein, 9 aa, Homo Sapiens
NSKMVKFLL

SEQ ID NO: 1066376 - protein, 9 aa, Homo Sapiens
QGVARLVLS

SEQ ID NO: 1066377 - protein, 9 aa, Homo Sapiens
APLSPTIKE

SEQ ID NO: 1066378 - protein, 9 aa, Homo Sapiens
VNVPSSLQA

SEQ ID NO: 1066379 - protein, 9 aa, Homo Sapiens
QKFLWAGVV

SEQ ID NO: 1066380 - protein, 9 aa, Homo Sapiens
SAEGVQKDP

SEQ ID NO: 1066381 - protein, 9 aa, Homo Sapiens
VMAGFFRGD

SEQ ID NO: 1066382 - protein, 9 aa, Homo Sapiens
NIPVTTSEN

SEQ ID NO: 1066383 - protein, 9 aa, Homo Sapiens
GGQALPHLT

SEQ ID NO: 1066384 - protein, 9 aa, Homo Sapiens
KSPIIIITT

SEQ ID NO: 1066385 - protein, 9 aa, Homo Sapiens
IKREQYITN

SEQ ID NO: 1066386 - protein, 9 aa, Homo Sapiens
IKHKRKLHI

SEQ ID NO: 1066387 - protein, 9 aa, Homo Sapiens
IWYFTMQVR

SEQ ID NO: 1066388 - protein, 9 aa, Homo Sapiens
KRIYTREKP

SEQ ID NO: 1066389 - protein, 9 aa, Homo Sapiens
EGVSLQYVF

SEQ ID NO: 1066390 - protein, 9 aa, Homo Sapiens
PSVKWEYCN

SEQ ID NO: 1066391 - protein, 9 aa, Homo Sapiens
EDNEDSRRF

SEQ ID NO: 1066392 - protein, 9 aa, Homo Sapiens
KRFGIPMDR

SEQ ID NO: 1066393 - protein, 9 aa, Homo Sapiens
GPPEENGKP

SEQ ID NO: 1066394 - protein, 9 aa, Homo Sapiens
IIYSVEKPY

SEQ ID NO: 1066395 - protein, 9 aa, Homo Sapiens
VLYFQPPSK

SEQ ID NO: 1066396 - protein, 9 aa, Homo Sapiens
KTAAILLQM

SEQ ID NO: 1066397 - protein, 9 aa, Homo Sapiens
EGLEAAPKS

SEQ ID NO: 1066398 - protein, 9 aa, Homo Sapiens
FVNLLLLIG

SEQ ID NO: 1066399 - protein, 9 aa, Homo Sapiens
IYIRNQQRW

SEQ ID NO: 1066400 - protein, 9 aa, Homo Sapiens
SGFSSEENE

SEQ ID NO: 1066401 - protein, 9 aa, Homo Sapiens
ESDLTQLQL

SEQ ID NO: 1066402 - protein, 9 aa, Homo Sapiens
FDGKDFEGS

SEQ ID NO: 1066403 - protein, 9 aa, Homo Sapiens
NQGYAGSTS

SEQ ID NO: 1066404 - protein, 9 aa, Homo Sapiens
KVCNDQNHY

SEQ ID NO: 1066405 - protein, 9 aa, Homo Sapiens
QTLKTPEKS

SEQ ID NO: 1066406 - protein, 9 aa, Homo Sapiens
VSGIPADVW

SEQ ID NO: 1066407 - protein, 9 aa, Homo Sapiens
ENFNKAKPI

SEQ ID NO: 1066408 - protein, 9 aa, Homo Sapiens
VQLMGNGFY

SEQ ID NO: 1066409 - protein, 9 aa, Homo Sapiens
DNIQIETVL

SEQ ID NO: 1066410 - protein, 9 aa, Homo Sapiens
RCVNHRQQS

SEQ ID NO: 1066411 - protein, 9 aa, Homo Sapiens
MLIFIVVTF

SEQ ID NO: 1066412 - protein, 9 aa, Homo Sapiens
FLQLIISYG

SEQ ID NO: 1066413 - protein, 9 aa, Homo Sapiens
LFRFCVVMG

SEQ ID NO: 1066414 - protein, 9 aa, Homo Sapiens
DVKNFHLPS

SEQ ID NO: 1066415 - protein, 9 aa, Homo Sapiens
ICQVLDAVY

SEQ ID NO: 1066416 - protein, 9 aa, Homo Sapiens
FVSVPGTLN

SEQ ID NO: 1066417 - protein, 9 aa, Homo Sapiens
LSDFESRYV

SEQ ID NO: 1066418 - protein, 9 aa, Homo Sapiens
DSEMKLQTS

SEQ ID NO: 1066419 - protein, 9 aa, Homo Sapiens
VQSREKSFI

SEQ ID NO: 1066420 - protein, 9 aa, Homo Sapiens
LFLHSESKV

SEQ ID NO: 1066421 - protein, 9 aa, Homo Sapiens
GNPVITASY

SEQ ID NO: 1066422 - protein, 9 aa, Homo Sapiens
RKGMQEFIL

SEQ ID NO: 1066423 - protein, 9 aa, Homo Sapiens
HTSTMALVL

SEQ ID NO: 1066424 - protein, 9 aa, Homo Sapiens
GKGYFAKVK

SEQ ID NO: 1066425 - protein, 9 aa, Homo Sapiens
EEVQRPPRG

SEQ ID NO: 1066426 - protein, 9 aa, Homo Sapiens
CHTAGLKPE

SEQ ID NO: 1066427 - protein, 9 aa, Homo Sapiens
SKCGKGTYS

SEQ ID NO: 1066428 - protein, 9 aa, Homo Sapiens
DGPSQPDPV

SEQ ID NO: 1066429 - protein, 9 aa, Homo Sapiens
PMVPPLNFT

SEQ ID NO: 1066430 - protein, 9 aa, Homo Sapiens
LNEGVCSVV

SEQ ID NO: 1066431 - protein, 9 aa, Homo Sapiens
EGFHFVCSG

SEQ ID NO: 1066432 - protein, 9 aa, Homo Sapiens
DPSPVPSSF

SEQ ID NO: 1066433 - protein, 9 aa, Homo Sapiens
GSGSSLSSS

SEQ ID NO: 1066434 - protein, 9 aa, Homo Sapiens
QRRPDFSYS

SEQ ID NO: 1066435 - protein, 9 aa, Homo Sapiens
CGSLFYTPK

SEQ ID NO: 1066436 - protein, 9 aa, Homo Sapiens
MSLPQPTPQ

SEQ ID NO: 1066437 - protein, 9 aa, Homo Sapiens
ALNDEIMLR

SEQ ID NO: 1066438 - protein, 9 aa, Homo Sapiens
ESSISGAGL

SEQ ID NO: 1066439 - protein, 9 aa, Homo Sapiens
WRQKKKMHE

SEQ ID NO: 1066440 - protein, 9 aa, Homo Sapiens
LRYREDRLK

SEQ ID NO: 1066441 - protein, 9 aa, Homo Sapiens
IKKVTWTIN

SEQ ID NO: 1066442 - protein, 9 aa, Homo Sapiens
DNKKMYVKG

SEQ ID NO: 1066443 - protein, 9 aa, Homo Sapiens
LAWTSHLES

SEQ ID NO: 1066444 - protein, 9 aa, Homo Sapiens
CAISPPQCP

SEQ ID NO: 1066445 - protein, 9 aa, Homo Sapiens
TGEKLYQCK

SEQ ID NO: 1066446 - protein, 9 aa, Homo Sapiens
ATTRHPELR

SEQ ID NO: 1066447 - protein, 9 aa, Homo Sapiens
FQTSMSGTL

SEQ ID NO: 1066448 - protein, 9 aa, Homo Sapiens
LLFLAKVVL

SEQ ID NO: 1066449 - protein, 9 aa, Homo Sapiens
VAQYIRAAL

SEQ ID NO: 1066450 - protein, 9 aa, Homo Sapiens
GLNIVTEDD

SEQ ID NO: 1066451 - protein, 9 aa, Homo Sapiens
PHRPAKLGA

SEQ ID NO: 1066452 - protein, 9 aa, Homo Sapiens
KSFQGTHVV

SEQ ID NO: 1066453 - protein, 9 aa, Homo Sapiens
APNLADCST

SEQ ID NO: 1066454 - protein, 9 aa, Homo Sapiens
LLITLVLDE

SEQ ID NO: 1066455 - protein, 9 aa, Homo Sapiens
ERLYYLITT

SEQ ID NO: 1066456 - protein, 9 aa, Homo Sapiens
LEKLDISKN

SEQ ID NO: 1066457 - protein, 9 aa, Homo Sapiens
FLAEGDMVW

SEQ ID NO: 1066458 - protein, 9 aa, Homo Sapiens
SVFTSKLFC

SEQ ID NO: 1066459 - protein, 9 aa, Homo Sapiens
ASPTIISRL

SEQ ID NO: 1066460 - protein, 9 aa, Homo Sapiens
ECASGYWGL

SEQ ID NO: 1066461 - protein, 9 aa, Homo Sapiens
PILENMWAI

SEQ ID NO: 1066462 - protein, 9 aa, Homo Sapiens
NNLRFMILM

SEQ ID NO: 1066463 - protein, 9 aa, Homo Sapiens
EKKHPESNQ

SEQ ID NO: 1066464 - protein, 9 aa, Homo Sapiens
DIPSLGLDP

SEQ ID NO: 1066465 - protein, 9 aa, Homo Sapiens
GTEETPLHL

SEQ ID NO: 1066466 - protein, 9 aa, Homo Sapiens
SRSQLLQNV

SEQ ID NO: 1066467 - protein, 9 aa, Homo Sapiens
GLQVLATKA

SEQ ID NO: 1066468 - protein, 9 aa, Homo Sapiens
EPAQTHPRE

SEQ ID NO: 1066469 - protein, 9 aa, Homo Sapiens
MESLLLDDY

SEQ ID NO: 1066470 - protein, 9 aa, Homo Sapiens
ACKIAKMPG

SEQ ID NO: 1066471 - protein, 9 aa, Homo Sapiens
DTTNKALGE

SEQ ID NO: 1066472 - protein, 9 aa, Homo Sapiens
DRLGWRQCL

SEQ ID NO: 1066473 - protein, 9 aa, Homo Sapiens
KLSDFESRY

SEQ ID NO: 1066474 - protein, 9 aa, Homo Sapiens
PAMLLISLF

SEQ ID NO: 1066475 - protein, 9 aa, Homo Sapiens
WRQTGPILE

SEQ ID NO: 1066476 - protein, 9 aa, Homo Sapiens
TIMLFIMFY

SEQ ID NO: 1066477 - protein, 9 aa, Homo Sapiens
SEGFHFVCS

SEQ ID NO: 1066478 - protein, 9 aa, Homo Sapiens
VTGYFTFIL

SEQ ID NO: 1066479 - protein, 9 aa, Homo Sapiens
KIQLTPQIA

SEQ ID NO: 1066480 - protein, 9 aa, Homo Sapiens
DPQAGKKLF

SEQ ID NO: 1066481 - protein, 9 aa, Homo Sapiens
MNTRSFSSD

SEQ ID NO: 1066482 - protein, 9 aa, Homo Sapiens
AQTAVAGPR

SEQ ID NO: 1066483 - protein, 9 aa, Homo Sapiens
RLDGFMAQK

SEQ ID NO: 1066484 - protein, 9 aa, Homo Sapiens
DLYVRVYLL

SEQ ID NO: 1066485 - protein, 9 aa, Homo Sapiens
SPQTVAPLS

SEQ ID NO: 1066486 - protein, 9 aa, Homo Sapiens
SKKEEEDQE

SEQ ID NO: 1066487 - protein, 9 aa, Homo Sapiens
DSQFSNFLD

SEQ ID NO: 1066488 - protein, 9 aa, Homo Sapiens
CSEDSSISF

SEQ ID NO: 1066489 - protein, 9 aa, Homo Sapiens
EDKNSFLRE

SEQ ID NO: 1066490 - protein, 9 aa, Homo Sapiens
YQNWRMYDV

SEQ ID NO: 1066491 - protein, 9 aa, Homo Sapiens
NFQAMTAER

SEQ ID NO: 1066492 - protein, 9 aa, Homo Sapiens
PPSELFDHL

SEQ ID NO: 1066493 - protein, 9 aa, Homo Sapiens
ESGKRQIES

SEQ ID NO: 1066494 - protein, 9 aa, Homo Sapiens
IQIPILISI

SEQ ID NO: 1066495 - protein, 9 aa, Homo Sapiens
FAAESQASE

SEQ ID NO: 1066496 - protein, 9 aa, Homo Sapiens
HGLATSHPN

SEQ ID NO: 1066497 - protein, 9 aa, Homo Sapiens
MMEAYPGLQ

SEQ ID NO: 1066498 - protein, 9 aa, Homo Sapiens
TVKGYFLAE

SEQ ID NO: 1066499 - protein, 9 aa, Homo Sapiens
VYFLPVAQY

SEQ ID NO: 1066500 - protein, 9 aa, Homo Sapiens
LSRFIKLAC

SEQ ID NO: 1066501 - protein, 9 aa, Homo Sapiens
KILDDIFAF

SEQ ID NO: 1066502 - protein, 9 aa, Homo Sapiens
SLSPVDSQQ

SEQ ID NO: 1066503 - protein, 9 aa, Homo Sapiens
PGWVDPQTW

SEQ ID NO: 1066504 - protein, 9 aa, Homo Sapiens
NLLASEEEI

SEQ ID NO: 1066505 - protein, 9 aa, Homo Sapiens
VSNGPFNNS

SEQ ID NO: 1066506 - protein, 9 aa, Homo Sapiens
SSCNLETRD

SEQ ID NO: 1066507 - protein, 9 aa, Homo Sapiens
SGIEHSMHM

SEQ ID NO: 1066508 - protein, 9 aa, Homo Sapiens
HLVFTAFDG

SEQ ID NO: 1066509 - protein, 9 aa, Homo Sapiens
LLEGLVGVQ

SEQ ID NO: 1066510 - protein, 9 aa, Homo Sapiens
GPILENMWA

SEQ ID NO: 1066511 - protein, 9 aa, Homo Sapiens
GYFNNNIAP

SEQ ID NO: 1066512 - protein, 9 aa, Homo Sapiens
ENERMSSTR

SEQ ID NO: 1066513 - protein, 9 aa, Homo Sapiens
KNCDLPAAD

SEQ ID NO: 1066514 - protein, 9 aa, Homo Sapiens
IYLGTFALI

SEQ ID NO: 1066515 - protein, 9 aa, Homo Sapiens
LNFTMNAAS

SEQ ID NO: 1066516 - protein, 9 aa, Homo Sapiens
ALVSLFFFR

SEQ ID NO: 1066517 - protein, 9 aa, Homo Sapiens
SRTSILNCE

SEQ ID NO: 1066518 - protein, 9 aa, Homo Sapiens
AIILKQSGK

SEQ ID NO: 1066519 - protein, 9 aa, Homo Sapiens
NCAKDMNLV

SEQ ID NO: 1066520 - protein, 9 aa, Homo Sapiens
EALISRQVP

SEQ ID NO: 1066521 - protein, 9 aa, Homo Sapiens
PYLVFIHTL

SEQ ID NO: 1066522 - protein, 9 aa, Homo Sapiens
CKIQFFLFA

SEQ ID NO: 1066523 - protein, 9 aa, Homo Sapiens
PRTAGLAVH

SEQ ID NO: 1066524 - protein, 9 aa, Homo Sapiens
RLPRHEYGF

SEQ ID NO: 1066525 - protein, 9 aa, Homo Sapiens
NIMTYYQEV

SEQ ID NO: 1066526 - protein, 9 aa, Homo Sapiens
YSIPKEAKH

SEQ ID NO: 1066527 - protein, 9 aa, Homo Sapiens
YVDGVKVHN

SEQ ID NO: 1066528 - protein, 9 aa, Homo Sapiens
PEHRQTARR

SEQ ID NO: 1066529 - protein, 9 aa, Homo Sapiens
VSPFHGGQY

SEQ ID NO: 1066530 - protein, 9 aa, Homo Sapiens
LRHSSAKVW

SEQ ID NO: 1066531 - protein, 9 aa, Homo Sapiens
PGRPGPLGS

SEQ ID NO: 1066532 - protein, 9 aa, Homo Sapiens
NSTTPTALV

SEQ ID NO: 1066533 - protein, 9 aa, Homo Sapiens
WPNELTVDK

SEQ ID NO: 1066534 - protein, 9 aa, Homo Sapiens
SMISVNPGL

SEQ ID NO: 1066535 - protein, 9 aa, Homo Sapiens
ADLLGAGTK

SEQ ID NO: 1066536 - protein, 9 aa, Homo Sapiens
CSLEKETKK

SEQ ID NO: 1066537 - protein, 9 aa, Homo Sapiens
SSVLTLILQ

SEQ ID NO: 1066538 - protein, 9 aa, Homo Sapiens
VKYLQKFIS

SEQ ID NO: 1066539 - protein, 9 aa, Homo Sapiens
KPTPGAAKP

SEQ ID NO: 1066540 - protein, 9 aa, Homo Sapiens
SFCHCAPCQ

SEQ ID NO: 1066541 - protein, 9 aa, Homo Sapiens
CRGNYPGPS

SEQ ID NO: 1066542 - protein, 9 aa, Homo Sapiens
MSQRAIFFA

SEQ ID NO: 1066543 - protein, 9 aa, Homo Sapiens
TSFLQLIIS

SEQ ID NO: 1066544 - protein, 9 aa, Homo Sapiens
GRPGPLGSS

SEQ ID NO: 1066545 - protein, 9 aa, Homo Sapiens
YPVIQWFWK

SEQ ID NO: 1066546 - protein, 9 aa, Homo Sapiens
QASSQSMLW

SEQ ID NO: 1066547 - protein, 9 aa, Homo Sapiens
GFHPLSPLF

SEQ ID NO: 1066548 - protein, 9 aa, Homo Sapiens
PHFSPTLRL

SEQ ID NO: 1066549 - protein, 9 aa, Homo Sapiens
KLRAERRAK

SEQ ID NO: 1066550 - protein, 9 aa, Homo Sapiens
ITEPGMVLD

SEQ ID NO: 1066551 - protein, 9 aa, Homo Sapiens
SQPPSFLAL

SEQ ID NO: 1066552 - protein, 9 aa, Homo Sapiens
ETKVQAKIC

SEQ ID NO: 1066553 - protein, 9 aa, Homo Sapiens
APELLVGFS

SEQ ID NO: 1066554 - protein, 9 aa, Homo Sapiens
ICTPLYYPN

SEQ ID NO: 1066555 - protein, 9 aa, Homo Sapiens
APRLPSYTP

SEQ ID NO: 1066556 - protein, 9 aa, Homo Sapiens
EKFSAVVRD

SEQ ID NO: 1066557 - protein, 9 aa, Homo Sapiens
ASQVASSLK

SEQ ID NO: 1066558 - protein, 9 aa, Homo Sapiens
DTIIMEEMP

SEQ ID NO: 1066559 - protein, 9 aa, Homo Sapiens
TPRVRSHLA

SEQ ID NO: 1066560 - protein, 9 aa, Homo Sapiens
HLVQYFQQG

SEQ ID NO: 1066561 - protein, 9 aa, Homo Sapiens
EMEIAIKRA

SEQ ID NO: 1066562 - protein, 9 aa, Homo Sapiens
KAVLQLLKQ

SEQ ID NO: 1066563 - protein, 9 aa, Homo Sapiens
KIDVILDRK

SEQ ID NO: 1066564 - protein, 9 aa, Homo Sapiens
YSYAAFCEC

SEQ ID NO: 1066565 - protein, 9 aa, Homo Sapiens
GPKEQKGEP

SEQ ID NO: 1066566 - protein, 9 aa, Homo Sapiens
NNVVQNFYN

SEQ ID NO: 1066567 - protein, 9 aa, Homo Sapiens
ELLRLNLLE

SEQ ID NO: 1066568 - protein, 9 aa, Homo Sapiens
KSKSKSPSL

SEQ ID NO: 1066569 - protein, 9 aa, Homo Sapiens
LPPPPAKKA

SEQ ID NO: 1066570 - protein, 9 aa, Homo Sapiens
TFEFYFLPN

SEQ ID NO: 1066571 - protein, 9 aa, Homo Sapiens
NETLVAFRG

SEQ ID NO: 1066572 - protein, 9 aa, Homo Sapiens
FRGQFVMKH

SEQ ID NO: 1066573 - protein, 9 aa, Homo Sapiens
FVDSNGELA

SEQ ID NO: 1066574 - protein, 9 aa, Homo Sapiens
YRFCTKNRE

SEQ ID NO: 1066575 - protein, 9 aa, Homo Sapiens
NFNKAKPIG

SEQ ID NO: 1066576 - protein, 9 aa, Homo Sapiens
NTGKTVAIF

SEQ ID NO: 1066577 - protein, 9 aa, Homo Sapiens
ARKQKSKLG

SEQ ID NO: 1066578 - protein, 9 aa, Homo Sapiens
FFRNRLMDT

SEQ ID NO: 1066579 - protein, 9 aa, Homo Sapiens
ETLQSDDDK

SEQ ID NO: 1066580 - protein, 9 aa, Homo Sapiens
SLINKFDLV

SEQ ID NO: 1066581 - protein, 9 aa, Homo Sapiens
GPRDPMGSE

SEQ ID NO: 1066582 - protein, 9 aa, Homo Sapiens
ELYLQCNMK

SEQ ID NO: 1066583 - protein, 9 aa, Homo Sapiens
DNSKRYYVA

SEQ ID NO: 1066584 - protein, 9 aa, Homo Sapiens
RKISVLVQS

SEQ ID NO: 1066585 - protein, 9 aa, Homo Sapiens
TVIFSLLNP

SEQ ID NO: 1066586 - protein, 9 aa, Homo Sapiens
AAFPNCSAP

SEQ ID NO: 1066587 - protein, 9 aa, Homo Sapiens
DFFSQGADL

SEQ ID NO: 1066588 - protein, 9 aa, Homo Sapiens
INKYGDLYR

SEQ ID NO: 1066589 - protein, 9 aa, Homo Sapiens
AQNWTLPQP

SEQ ID NO: 1066590 - protein, 9 aa, Homo Sapiens
KPGESLRIS

SEQ ID NO: 1066591 - protein, 9 aa, Homo Sapiens
LRLFKHLKH

SEQ ID NO: 1066592 - protein, 9 aa, Homo Sapiens
NLGLLTKSG

SEQ ID NO: 1066593 - protein, 9 aa, Homo Sapiens
PSFFISSGV

SEQ ID NO: 1066594 - protein, 9 aa, Homo Sapiens
QKDSFQEVI

SEQ ID NO: 1066595 - protein, 9 aa, Homo Sapiens
QMESLVDQD

SEQ ID NO: 1066596 - protein, 9 aa, Homo Sapiens
SPVVTHDFL

SEQ ID NO: 1066597 - protein, 9 aa, Homo Sapiens
KGNKGSKEE

SEQ ID NO: 1066598 - protein, 9 aa, Homo Sapiens
AGACKVNPL

SEQ ID NO: 1066599 - protein, 9 aa, Homo Sapiens
LLNTSVAPL

SEQ ID NO: 1066600 - protein, 9 aa, Homo Sapiens
AKLKLQKLD

SEQ ID NO: 1066601 - protein, 9 aa, Homo Sapiens
SVRLSPAAA

SEQ ID NO: 1066602 - protein, 9 aa, Homo Sapiens
KITQIEIWV

SEQ ID NO: 1066603 - protein, 9 aa, Homo Sapiens
MSPLSSRSL

SEQ ID NO: 1066604 - protein, 9 aa, Homo Sapiens
DFLRSELPD

SEQ ID NO: 1066605 - protein, 9 aa, Homo Sapiens
VAAHKKSHK

SEQ ID NO: 1066606 - protein, 9 aa, Homo Sapiens
AIEGGHAPE

SEQ ID NO: 1066607 - protein, 9 aa, Homo Sapiens
PLYSLPPAP

SEQ ID NO: 1066608 - protein, 9 aa, Homo Sapiens
QLHYSVSEA

SEQ ID NO: 1066609 - protein, 9 aa, Homo Sapiens
AYKFKKYVL

SEQ ID NO: 1066610 - protein, 9 aa, Homo Sapiens
TKGWGAQAL

SEQ ID NO: 1066611 - protein, 9 aa, Homo Sapiens
LWNLQKTVS

SEQ ID NO: 1066612 - protein, 9 aa, Homo Sapiens
GLPCPEPQE

SEQ ID NO: 1066613 - protein, 9 aa, Homo Sapiens
QTTDVISVC

SEQ ID NO: 1066614 - protein, 9 aa, Homo Sapiens
REEVYTVFA

SEQ ID NO: 1066615 - protein, 9 aa, Homo Sapiens
SGGTGFFLG

SEQ ID NO: 1066616 - protein, 9 aa, Homo Sapiens
RKITDQEHN

SEQ ID NO: 1066617 - protein, 9 aa, Homo Sapiens
RSKLQSQEW

SEQ ID NO: 1066618 - protein, 9 aa, Homo Sapiens
SKMVKFLLE

SEQ ID NO: 1066619 - protein, 9 aa, Homo Sapiens
TSPAGPKTL

SEQ ID NO: 1066620 - protein, 9 aa, Homo Sapiens
AMLDRESLY

SEQ ID NO: 1066621 - protein, 9 aa, Homo Sapiens
LRFQNNPLS

SEQ ID NO: 1066622 - protein, 9 aa, Homo Sapiens
NIKNSEKVY

SEQ ID NO: 1066623 - protein, 9 aa, Homo Sapiens
PILFYQGAA

SEQ ID NO: 1066624 - protein, 9 aa, Homo Sapiens
LSPVDSQQH

SEQ ID NO: 1066625 - protein, 9 aa, Homo Sapiens
TSNYIFFMG

SEQ ID NO: 1066626 - protein, 9 aa, Homo Sapiens
FYFEDFSNI

SEQ ID NO: 1066627 - protein, 9 aa, Homo Sapiens
AEPLLRNGD

SEQ ID NO: 1066628 - protein, 9 aa, Homo Sapiens
AADCINRLQ

SEQ ID NO: 1066629 - protein, 9 aa, Homo Sapiens
FSLLNPVIY

SEQ ID NO: 1066630 - protein, 9 aa, Homo Sapiens
KTFTISVTD

SEQ ID NO: 1066631 - protein, 9 aa, Homo Sapiens
WKIDRNSIQ

SEQ ID NO: 1066632 - protein, 9 aa, Homo Sapiens
EFFRHNKPV

SEQ ID NO: 1066633 - protein, 9 aa, Homo Sapiens
EGHNTTASG

SEQ ID NO: 1066634 - protein, 9 aa, Homo Sapiens
SKDIMVYFK

SEQ ID NO: 1066635 - protein, 9 aa, Homo Sapiens
SAMKKNKPK

SEQ ID NO: 1066636 - protein, 9 aa, Homo Sapiens
PNLADCSTD

SEQ ID NO: 1066637 - protein, 9 aa, Homo Sapiens
LREKLRYRE

SEQ ID NO: 1066638 - protein, 9 aa, Homo Sapiens
PCGTCSGAY

SEQ ID NO: 1066639 - protein, 9 aa, Homo Sapiens
KEDAPHCST

SEQ ID NO: 1066640 - protein, 9 aa, Homo Sapiens
SDEHNVCVP

SEQ ID NO: 1066641 - protein, 9 aa, Homo Sapiens
LFAISVTTE

SEQ ID NO: 1066642 - protein, 9 aa, Homo Sapiens
TKKSLDNRN

SEQ ID NO: 1066643 - protein, 9 aa, Homo Sapiens
QLDSRPLHE

SEQ ID NO: 1066644 - protein, 9 aa, Homo Sapiens
VSHLHTPMY

SEQ ID NO: 1066645 - protein, 9 aa, Homo Sapiens
GVPMESLLL

SEQ ID NO: 1066646 - protein, 9 aa, Homo Sapiens
SLLEKFSIE

SEQ ID NO: 1066647 - protein, 9 aa, Homo Sapiens
DFVCPEKCR

SEQ ID NO: 1066648 - protein, 9 aa, Homo Sapiens
GDGKISFEK

SEQ ID NO: 1066649 - protein, 9 aa, Homo Sapiens
QQPRLFGAR

SEQ ID NO: 1066650 - protein, 9 aa, Homo Sapiens
VGPYFSSET

SEQ ID NO: 1066651 - protein, 9 aa, Homo Sapiens
VKKTFFGVG

SEQ ID NO: 1066652 - protein, 9 aa, Homo Sapiens
LIFEVDSDG

SEQ ID NO: 1066653 - protein, 9 aa, Homo Sapiens
VKIQKNTWA

SEQ ID NO: 1066654 - protein, 9 aa, Homo Sapiens
VVLFATCVF

SEQ ID NO: 1066655 - protein, 9 aa, Homo Sapiens
TTNKALGEK

SEQ ID NO: 1066656 - protein, 9 aa, Homo Sapiens
FIKEFVIID

SEQ ID NO: 1066657 - protein, 9 aa, Homo Sapiens
KKYVLGDLV

SEQ ID NO: 1066658 - protein, 9 aa, Homo Sapiens
PILPLGIFY

SEQ ID NO: 1066659 - protein, 9 aa, Homo Sapiens
RTEGPIAQN

SEQ ID NO: 1066660 - protein, 9 aa, Homo Sapiens
STLSISPEM

SEQ ID NO: 1066661 - protein, 9 aa, Homo Sapiens
NKDEKSSTE

SEQ ID NO: 1066662 - protein, 9 aa, Homo Sapiens
QARKPPEQL

SEQ ID NO: 1066663 - protein, 9 aa, Homo Sapiens
FSFSPRLEN

SEQ ID NO: 1066664 - protein, 9 aa, Homo Sapiens
PSHARYLSQ

SEQ ID NO: 1066665 - protein, 9 aa, Homo Sapiens
FFPSIKPDT

SEQ ID NO: 1066666 - protein, 9 aa, Homo Sapiens
LLLNPFIYS

SEQ ID NO: 1066667 - protein, 9 aa, Homo Sapiens
RKQQATAII

SEQ ID NO: 1066668 - protein, 9 aa, Homo Sapiens
FLYKGLDGS

SEQ ID NO: 1066669 - protein, 9 aa, Homo Sapiens
GIFFSASYR

SEQ ID NO: 1066670 - protein, 9 aa, Homo Sapiens
DCNRFFRVD

SEQ ID NO: 1066671 - protein, 9 aa, Homo Sapiens
CIFVYTQPP

SEQ ID NO: 1066672 - protein, 9 aa, Homo Sapiens
DQAPFIFTS

SEQ ID NO: 1066673 - protein, 9 aa, Homo Sapiens
SEFLSIPAS

SEQ ID NO: 1066674 - protein, 9 aa, Homo Sapiens
EKETKKENM

SEQ ID NO: 1066675 - protein, 9 aa, Homo Sapiens
TDCLCPDGF

SEQ ID NO: 1066676 - protein, 9 aa, Homo Sapiens
ANFFLANPT

SEQ ID NO: 1066677 - protein, 9 aa, Homo Sapiens
GQKEGVFGW

SEQ ID NO: 1066678 - protein, 9 aa, Homo Sapiens
VFFLYALVR

SEQ ID NO: 1066679 - protein, 9 aa, Homo Sapiens
VVLTCDTPK

SEQ ID NO: 1066680 - protein, 9 aa, Homo Sapiens
TPGLQGLLG

SEQ ID NO: 1066681 - protein, 9 aa, Homo Sapiens
ELERKYAAN

SEQ ID NO: 1066682 - protein, 9 aa, Homo Sapiens
QQKVQKKID

SEQ ID NO: 1066683 - protein, 9 aa, Homo Sapiens
FARAVKVLK

SEQ ID NO: 1066684 - protein, 9 aa, Homo Sapiens
IRTKPSTRT

SEQ ID NO: 1066685 - protein, 9 aa, Homo Sapiens
LMTKWGEWD

SEQ ID NO: 1066686 - protein, 9 aa, Homo Sapiens
INIIEQRPE

SEQ ID NO: 1066687 - protein, 9 aa, Homo Sapiens
ERKSSDKRG

SEQ ID NO: 1066688 - protein, 9 aa, Homo Sapiens
DERMQCLMP

SEQ ID NO: 1066689 - protein, 9 aa, Homo Sapiens
FTVSVSEIC

SEQ ID NO: 1066690 - protein, 9 aa, Homo Sapiens
LLLARDKDG

SEQ ID NO: 1066691 - protein, 9 aa, Homo Sapiens
DNGGSSGST

SEQ ID NO: 1066692 - protein, 9 aa, Homo Sapiens
VVLLILYTI

SEQ ID NO: 1066693 - protein, 9 aa, Homo Sapiens
LKKAREFME

SEQ ID NO: 1066694 - protein, 9 aa, Homo Sapiens
SAASPTIFS

SEQ ID NO: 1066695 - protein, 9 aa, Homo Sapiens
SQNSNTLTP

SEQ ID NO: 1066696 - protein, 9 aa, Homo Sapiens
NTLFWAVVF

SEQ ID NO: 1066697 - protein, 9 aa, Homo Sapiens
NWTYVLAVH

SEQ ID NO: 1066698 - protein, 9 aa, Homo Sapiens
VPGMCFAFH

SEQ ID NO: 1066699 - protein, 9 aa, Homo Sapiens
ASAFTTTTV

SEQ ID NO: 1066700 - protein, 9 aa, Homo Sapiens
LISTNAEQR

SEQ ID NO: 1066701 - protein, 9 aa, Homo Sapiens
AEAGNKTEN

SEQ ID NO: 1066702 - protein, 9 aa, Homo Sapiens
LNGVKYKSE

SEQ ID NO: 1066703 - protein, 9 aa, Homo Sapiens
LLSLLGAEV

SEQ ID NO: 1066704 - protein, 9 aa, Homo Sapiens
GYPKTKAFI

SEQ ID NO: 1066705 - protein, 9 aa, Homo Sapiens
LKALVFVGE

SEQ ID NO: 1066706 - protein, 9 aa, Homo Sapiens
SFCGWGGAM

SEQ ID NO: 1066707 - protein, 9 aa, Homo Sapiens
RRQQAQRGE

SEQ ID NO: 1066708 - protein, 9 aa, Homo Sapiens
DFGLSERLG

SEQ ID NO: 1066709 - protein, 9 aa, Homo Sapiens
FAFSPPSGG

SEQ ID NO: 1066710 - protein, 9 aa, Homo Sapiens
LTGICPQNI

SEQ ID NO: 1066711 - protein, 9 aa, Homo Sapiens
TFTCFSSLI

SEQ ID NO: 1066712 - protein, 9 aa, Homo Sapiens
LWVEYEFRV

SEQ ID NO: 1066713 - protein, 9 aa, Homo Sapiens
KISLYSCIV

SEQ ID NO: 1066714 - protein, 9 aa, Homo Sapiens
LHIPLFFVF

SEQ ID NO: 1066715 - protein, 9 aa, Homo Sapiens
PGTAERPSL

SEQ ID NO: 1066716 - protein, 9 aa, Homo Sapiens
SSFSKAPPP

SEQ ID NO: 1066717 - protein, 9 aa, Homo Sapiens
QAQAASGKE

SEQ ID NO: 1066718 - protein, 9 aa, Homo Sapiens
KITDWMPDN

SEQ ID NO: 1066719 - protein, 9 aa, Homo Sapiens
LSIISYEIT

SEQ ID NO: 1066720 - protein, 9 aa, Homo Sapiens
CVLEFWPVK

SEQ ID NO: 1066721 - protein, 9 aa, Homo Sapiens
ILFLGLITI

SEQ ID NO: 1066722 - protein, 9 aa, Homo Sapiens
IPCELIGKP

SEQ ID NO: 1066723 - protein, 9 aa, Homo Sapiens
VFSLLGICL

SEQ ID NO: 1066724 - protein, 9 aa, Homo Sapiens
PFAPSRMSM

SEQ ID NO: 1066725 - protein, 9 aa, Homo Sapiens
VLQPHVPFI

SEQ ID NO: 1066726 - protein, 9 aa, Homo Sapiens
VNTSNMYPM

SEQ ID NO: 1066727 - protein, 9 aa, Homo Sapiens
ATTELKKLD

SEQ ID NO: 1066728 - protein, 9 aa, Homo Sapiens
ALDRYRRTA

SEQ ID NO: 1066729 - protein, 9 aa, Homo Sapiens
MWYKNLSGL

SEQ ID NO: 1066730 - protein, 9 aa, Homo Sapiens
IKGERGQKG

SEQ ID NO: 1066731 - protein, 9 aa, Homo Sapiens
VVSDGLPSS

SEQ ID NO: 1066732 - protein, 9 aa, Homo Sapiens
YQFFVVETA

SEQ ID NO: 1066733 - protein, 9 aa, Homo Sapiens
HKFSSDFKD

SEQ ID NO: 1066734 - protein, 9 aa, Homo Sapiens
KEERVVEVN

SEQ ID NO: 1066735 - protein, 9 aa, Homo Sapiens
LCFTMEVAK

SEQ ID NO: 1066736 - protein, 9 aa, Homo Sapiens
KQNFRDLVR

SEQ ID NO: 1066737 - protein, 9 aa, Homo Sapiens
LNKEELGQL

SEQ ID NO: 1066738 - protein, 9 aa, Homo Sapiens
AAYNSTDGL

SEQ ID NO: 1066739 - protein, 9 aa, Homo Sapiens
PKEQKGEPG

SEQ ID NO: 1066740 - protein, 9 aa, Homo Sapiens
FTFQAILLM

SEQ ID NO: 1066741 - protein, 9 aa, Homo Sapiens
QQTISCPER

SEQ ID NO: 1066742 - protein, 9 aa, Homo Sapiens
VLPDHTKPR

SEQ ID NO: 1066743 - protein, 9 aa, Homo Sapiens
RDVARLGVA

SEQ ID NO: 1066744 - protein, 9 aa, Homo Sapiens
RAIFFAGCT

SEQ ID NO: 1066745 - protein, 9 aa, Homo Sapiens
PNDSQMLAF

SEQ ID NO: 1066746 - protein, 9 aa, Homo Sapiens
EHVKLEEDV

SEQ ID NO: 1066747 - protein, 9 aa, Homo Sapiens
NPNKTAANI

SEQ ID NO: 1066748 - protein, 9 aa, Homo Sapiens
YISMHGKQI

SEQ ID NO: 1066749 - protein, 9 aa, Homo Sapiens
TQYKGHVNN

SEQ ID NO: 1066750 - protein, 9 aa, Homo Sapiens
QPQALMGSY

SEQ ID NO: 1066751 - protein, 9 aa, Homo Sapiens
KNSQLWADP

SEQ ID NO: 1066752 - protein, 9 aa, Homo Sapiens
KKPEEEFDS

SEQ ID NO: 1066753 - protein, 9 aa, Homo Sapiens
NLPLVKVLI

SEQ ID NO: 1066754 - protein, 9 aa, Homo Sapiens
EKKTKKEQK

SEQ ID NO: 1066755 - protein, 9 aa, Homo Sapiens
NLTFTKDKE

SEQ ID NO: 1066756 - protein, 9 aa, Homo Sapiens
DPQVAVDVL

SEQ ID NO: 1066757 - protein, 9 aa, Homo Sapiens
IWSHCSEPL

SEQ ID NO: 1066758 - protein, 9 aa, Homo Sapiens
RVPSPPPIA

SEQ ID NO: 1066759 - protein, 9 aa, Homo Sapiens
DRGMAPDSK

SEQ ID NO: 1066760 - protein, 9 aa, Homo Sapiens
KIGNQVEKF

SEQ ID NO: 1066761 - protein, 9 aa, Homo Sapiens
WVLPMGLNG

SEQ ID NO: 1066762 - protein, 9 aa, Homo Sapiens
KSTIYYNLC

SEQ ID NO: 1066763 - protein, 9 aa, Homo Sapiens
QDSKFYQAI

SEQ ID NO: 1066764 - protein, 9 aa, Homo Sapiens
LAPASPRQL

SEQ ID NO: 1066765 - protein, 9 aa, Homo Sapiens
YRIHVFHHG

SEQ ID NO: 1066766 - protein, 9 aa, Homo Sapiens
MGKRGDAAS

SEQ ID NO: 1066767 - protein, 9 aa, Homo Sapiens
YPGQGNNFY

SEQ ID NO: 1066768 - protein, 9 aa, Homo Sapiens
DQEDLDGNG

SEQ ID NO: 1066769 - protein, 9 aa, Homo Sapiens
GVSYVVQKP

SEQ ID NO: 1066770 - protein, 9 aa, Homo Sapiens
SPPRPIRVL

SEQ ID NO: 1066771 - protein, 9 aa, Homo Sapiens
LDEPPSVNT

SEQ ID NO: 1066772 - protein, 9 aa, Homo Sapiens
TDSLMLNHV

SEQ ID NO: 1066773 - protein, 9 aa, Homo Sapiens
FSFDYQNCT

SEQ ID NO: 1066774 - protein, 9 aa, Homo Sapiens
LMSLVLFYM

SEQ ID NO: 1066775 - protein, 9 aa, Homo Sapiens
VEMLMLNAY

SEQ ID NO: 1066776 - protein, 9 aa, Homo Sapiens
NSHPPHPHH

SEQ ID NO: 1066777 - protein, 9 aa, Homo Sapiens
RVDTDGGLI

SEQ ID NO: 1066778 - protein, 9 aa, Homo Sapiens
STPLAEDVQ

SEQ ID NO: 1066779 - protein, 9 aa, Homo Sapiens
SGKLPSPSP

SEQ ID NO: 1066780 - protein, 9 aa, Homo Sapiens
KAVELWEKA

SEQ ID NO: 1066781 - protein, 9 aa, Homo Sapiens
PLHEEEALP

SEQ ID NO: 1066782 - protein, 9 aa, Homo Sapiens
TNFLPMRPQ

SEQ ID NO: 1066783 - protein, 9 aa, Homo Sapiens
RLSPAAAEH

SEQ ID NO: 1066784 - protein, 9 aa, Homo Sapiens
TQFGEKNSQ

SEQ ID NO: 1066785 - protein, 9 aa, Homo Sapiens
NKRVAVIAD

SEQ ID NO: 1066786 - protein, 9 aa, Homo Sapiens
SVSEICISV

SEQ ID NO: 1066787 - protein, 9 aa, Homo Sapiens
KEVKHLSAL

SEQ ID NO: 1066788 - protein, 9 aa, Homo Sapiens
SCRSTRNLY

SEQ ID NO: 1066789 - protein, 9 aa, Homo Sapiens
PALSGTQVH

SEQ ID NO: 1066790 - protein, 9 aa, Homo Sapiens
NRKSTMFHA

SEQ ID NO: 1066791 - protein, 9 aa, Homo Sapiens
DEFFASVLT

SEQ ID NO: 1066792 - protein, 9 aa, Homo Sapiens
NPDFQRMPM

SEQ ID NO: 1066793 - protein, 9 aa, Homo Sapiens
NLLVQFKEG

SEQ ID NO: 1066794 - protein, 9 aa, Homo Sapiens
GNFVMVLLI

SEQ ID NO: 1066795 - protein, 9 aa, Homo Sapiens
ILVRNIMTY

SEQ ID NO: 1066796 - protein, 9 aa, Homo Sapiens
GTVFVPQRK

SEQ ID NO: 1066797 - protein, 9 aa, Homo Sapiens
WKKFSPGHV

SEQ ID NO: 1066798 - protein, 9 aa, Homo Sapiens
RELLDGAPG

SEQ ID NO: 1066799 - protein, 9 aa, Homo Sapiens
INEYNEIVK

SEQ ID NO: 1066800 - protein, 9 aa, Homo Sapiens
FTLGPVSPF

SEQ ID NO: 1066801 - protein, 9 aa, Homo Sapiens
FPVFGVTLF

SEQ ID NO: 1066802 - protein, 9 aa, Homo Sapiens
SDGKKEDEV

SEQ ID NO: 1066803 - protein, 9 aa, Homo Sapiens
DLYRELLDG

SEQ ID NO: 1066804 - protein, 9 aa, Homo Sapiens
MNSRMQLAK

SEQ ID NO: 1066805 - protein, 9 aa, Homo Sapiens
KKRFGIPMD

SEQ ID NO: 1066806 - protein, 9 aa, Homo Sapiens
CEGQRLKKR

SEQ ID NO: 1066807 - protein, 9 aa, Homo Sapiens
LGPVSPFHG

SEQ ID NO: 1066808 - protein, 9 aa, Homo Sapiens
VRNYWRGLF

SEQ ID NO: 1066809 - protein, 9 aa, Homo Sapiens
KVDHFFCEV

SEQ ID NO: 1066810 - protein, 9 aa, Homo Sapiens
EMESFGSLY

SEQ ID NO: 1066811 - protein, 9 aa, Homo Sapiens
ELAISGKLC

SEQ ID NO: 1066812 - protein, 9 aa, Homo Sapiens
SLLKRHEKS

SEQ ID NO: 1066813 - protein, 9 aa, Homo Sapiens
LNEREDTDL

SEQ ID NO: 1066814 - protein, 9 aa, Homo Sapiens
ITSAERRNK

SEQ ID NO: 1066815 - protein, 9 aa, Homo Sapiens
KVLIESGAD

SEQ ID NO: 1066816 - protein, 9 aa, Homo Sapiens
VCCASPSLA

SEQ ID NO: 1066817 - protein, 9 aa, Homo Sapiens
CQELGCYFY

SEQ ID NO: 1066818 - protein, 9 aa, Homo Sapiens
NCAYVVCAS

SEQ ID NO: 1066819 - protein, 9 aa, Homo Sapiens
TLQTVHFTF

SEQ ID NO: 1066820 - protein, 9 aa, Homo Sapiens
NVSTPGATS

SEQ ID NO: 1066821 - protein, 9 aa, Homo Sapiens
AKAIILKQS

SEQ ID NO: 1066822 - protein, 9 aa, Homo Sapiens
PCEFALVVV

SEQ ID NO: 1066823 - protein, 9 aa, Homo Sapiens
LYSFEDIST

SEQ ID NO: 1066824 - protein, 9 aa, Homo Sapiens
LKKSSFLES

SEQ ID NO: 1066825 - protein, 9 aa, Homo Sapiens
ATRMVQLVV

SEQ ID NO: 1066826 - protein, 9 aa, Homo Sapiens
LMLKWTPPR

SEQ ID NO: 1066827 - protein, 9 aa, Homo Sapiens
GSPLLCALH

SEQ ID NO: 1066828 - protein, 9 aa, Homo Sapiens
QLFGRLSVD

SEQ ID NO: 1066829 - protein, 9 aa, Homo Sapiens
LSLLFFREM

SEQ ID NO: 1066830 - protein, 9 aa, Homo Sapiens
AFPNCSAPL

SEQ ID NO: 1066831 - protein, 9 aa, Homo Sapiens
CYTTHGLKL

SEQ ID NO: 1066832 - protein, 9 aa, Homo Sapiens
FEIKKCNLY

SEQ ID NO: 1066833 - protein, 9 aa, Homo Sapiens
SEKTIFFAG

SEQ ID NO: 1066834 - protein, 9 aa, Homo Sapiens
SIPWVSGTS

SEQ ID NO: 1066835 - protein, 9 aa, Homo Sapiens
RVNNKHDDK

SEQ ID NO: 1066836 - protein, 9 aa, Homo Sapiens
DTILIQTNQ

SEQ ID NO: 1066837 - protein, 9 aa, Homo Sapiens
KIQRSKLQS

SEQ ID NO: 1066838 - protein, 9 aa, Homo Sapiens
SFLMGSLGE

SEQ ID NO: 1066839 - protein, 9 aa, Homo Sapiens
DTRSTVSFW

SEQ ID NO: 1066840 - protein, 9 aa, Homo Sapiens
GNVSSNTNS

SEQ ID NO: 1066841 - protein, 9 aa, Homo Sapiens
EEVKSPEKT

SEQ ID NO: 1066842 - protein, 9 aa, Homo Sapiens
LFAPPLSFS

SEQ ID NO: 1066843 - protein, 9 aa, Homo Sapiens
RCCYSLENG

SEQ ID NO: 1066844 - protein, 9 aa, Homo Sapiens
HWLARRLYH

SEQ ID NO: 1066845 - protein, 9 aa, Homo Sapiens
FKLQPMNFS

SEQ ID NO: 1066846 - protein, 9 aa, Homo Sapiens
LGSQESGLE

SEQ ID NO: 1066847 - protein, 9 aa, Homo Sapiens
LFYIRIFST

SEQ ID NO: 1066848 - protein, 9 aa, Homo Sapiens
VPHGADYEL

SEQ ID NO: 1066849 - protein, 9 aa, Homo Sapiens
VPPMSSIPE

SEQ ID NO: 1066850 - protein, 9 aa, Homo Sapiens
QVSPCSNRP

SEQ ID NO: 1066851 - protein, 9 aa, Homo Sapiens
EKLGTTATT

SEQ ID NO: 1066852 - protein, 9 aa, Homo Sapiens
KFRGSFTDV

SEQ ID NO: 1066853 - protein, 9 aa, Homo Sapiens
VTSTTFSRV

SEQ ID NO: 1066854 - protein, 9 aa, Homo Sapiens
SLDLSLNPI

SEQ ID NO: 1066855 - protein, 9 aa, Homo Sapiens
YVSFFFNRF

SEQ ID NO: 1066856 - protein, 9 aa, Homo Sapiens
QPTAAHFSA

SEQ ID NO: 1066857 - protein, 9 aa, Homo Sapiens
NLGGANMAE

SEQ ID NO: 1066858 - protein, 9 aa, Homo Sapiens
TPLRTVPDS

SEQ ID NO: 1066859 - protein, 9 aa, Homo Sapiens
LMCEGQRLK

SEQ ID NO: 1066860 - protein, 9 aa, Homo Sapiens
FREKGQGSR

SEQ ID NO: 1066861 - protein, 9 aa, Homo Sapiens
WQKDSFQEV

SEQ ID NO: 1066862 - protein, 9 aa, Homo Sapiens
KWVYVNEPV

SEQ ID NO: 1066863 - protein, 9 aa, Homo Sapiens
KRHMITYSE

SEQ ID NO: 1066864 - protein, 9 aa, Homo Sapiens
TRELPIPGD

SEQ ID NO: 1066865 - protein, 9 aa, Homo Sapiens
ILPITEYLA

SEQ ID NO: 1066866 - protein, 9 aa, Homo Sapiens
FLENLVQAC

SEQ ID NO: 1066867 - protein, 9 aa, Homo Sapiens
FSFLDSEMC

SEQ ID NO: 1066868 - protein, 9 aa, Homo Sapiens
KKSKDQNVS

SEQ ID NO: 1066869 - protein, 9 aa, Homo Sapiens
STERTLRLY

SEQ ID NO: 1066870 - protein, 9 aa, Homo Sapiens
GRSRKLLKP

SEQ ID NO: 1066871 - protein, 9 aa, Homo Sapiens
KYTAEPIND

SEQ ID NO: 1066872 - protein, 9 aa, Homo Sapiens
FEGNCPDGP

SEQ ID NO: 1066873 - protein, 9 aa, Homo Sapiens
KRKILDNKL

SEQ ID NO: 1066874 - protein, 9 aa, Homo Sapiens
AQVSPCSNR

SEQ ID NO: 1066875 - protein, 9 aa, Homo Sapiens
YCVQKGDLV

SEQ ID NO: 1066876 - protein, 9 aa, Homo Sapiens
FFYPKRKLL

SEQ ID NO: 1066877 - protein, 9 aa, Homo Sapiens
LADNNFVLI

SEQ ID NO: 1066878 - protein, 9 aa, Homo Sapiens
EVWKVLNLT

SEQ ID NO: 1066879 - protein, 9 aa, Homo Sapiens
FDKCLPHTS

SEQ ID NO: 1066880 - protein, 9 aa, Homo Sapiens
SSSNEQGLS

SEQ ID NO: 1066881 - protein, 9 aa, Homo Sapiens
WRQLTKKIQ

SEQ ID NO: 1066882 - protein, 9 aa, Homo Sapiens
DKEGADEAA

SEQ ID NO: 1066883 - protein, 9 aa, Homo Sapiens
KEEKSYLWR

SEQ ID NO: 1066884 - protein, 9 aa, Homo Sapiens
MRIIKYKFI

SEQ ID NO: 1066885 - protein, 9 aa, Homo Sapiens
SYRIHVFHH

SEQ ID NO: 1066886 - protein, 9 aa, Homo Sapiens
SAFKQASQR

SEQ ID NO: 1066887 - protein, 9 aa, Homo Sapiens
VTGVGICSS

SEQ ID NO: 1066888 - protein, 9 aa, Homo Sapiens
IAMKDESVL

SEQ ID NO: 1066889 - protein, 9 aa, Homo Sapiens
GSLAFVIQD

SEQ ID NO: 1066890 - protein, 9 aa, Homo Sapiens
HIEVQAEKL

SEQ ID NO: 1066891 - protein, 9 aa, Homo Sapiens
LPDQSFENS

SEQ ID NO: 1066892 - protein, 9 aa, Homo Sapiens
DNYYKLVTT

SEQ ID NO: 1066893 - protein, 9 aa, Homo Sapiens
ILMSLVLFY

SEQ ID NO: 1066894 - protein, 9 aa, Homo Sapiens
KCVCDPVSC

SEQ ID NO: 1066895 - protein, 9 aa, Homo Sapiens
LENRGLASR

SEQ ID NO: 1066896 - protein, 9 aa, Homo Sapiens
LTQTVVLSP

SEQ ID NO: 1066897 - protein, 9 aa, Homo Sapiens
FPVILKKAR

SEQ ID NO: 1066898 - protein, 9 aa, Homo Sapiens
NESLLTSFL

SEQ ID NO: 1066899 - protein, 9 aa, Homo Sapiens
LNSTTPTAL

SEQ ID NO: 1066900 - protein, 9 aa, Homo Sapiens
LVGIIRDCL

SEQ ID NO: 1066901 - protein, 9 aa, Homo Sapiens
LAPETAGES

SEQ ID NO: 1066902 - protein, 9 aa, Homo Sapiens
RQLTTPRTF

SEQ ID NO: 1066903 - protein, 9 aa, Homo Sapiens
DGKDFEGSK

SEQ ID NO: 1066904 - protein, 9 aa, Homo Sapiens
YTGEKPYTC

SEQ ID NO: 1066905 - protein, 9 aa, Homo Sapiens
SEAVPRMNE

SEQ ID NO: 1066906 - protein, 9 aa, Homo Sapiens
DELPNMLVY

SEQ ID NO: 1066907 - protein, 9 aa, Homo Sapiens
YTGEKPHEC

SEQ ID NO: 1066908 - protein, 9 aa, Homo Sapiens
QSSQVMDLP

SEQ ID NO: 1066909 - protein, 9 aa, Homo Sapiens
SCPQRTYYH

SEQ ID NO: 1066910 - protein, 9 aa, Homo Sapiens
GLPEIDFRG

SEQ ID NO: 1066911 - protein, 9 aa, Homo Sapiens
LRMTHTLSS

SEQ ID NO: 1066912 - protein, 9 aa, Homo Sapiens
ETKSCVAAR

SEQ ID NO: 1066913 - protein, 9 aa, Homo Sapiens
GMVDSRKNC

SEQ ID NO: 1066914 - protein, 9 aa, Homo Sapiens
LFLIHLVLL

SEQ ID NO: 1066915 - protein, 9 aa, Homo Sapiens
DSKEPEQLR

SEQ ID NO: 1066916 - protein, 9 aa, Homo Sapiens
TSELGDSLL

SEQ ID NO: 1066917 - protein, 9 aa, Homo Sapiens
IPWYFLSEA

SEQ ID NO: 1066918 - protein, 9 aa, Homo Sapiens
GADSQFSNF

SEQ ID NO: 1066919 - protein, 9 aa, Homo Sapiens
AKTGQSVDS

SEQ ID NO: 1066920 - protein, 9 aa, Homo Sapiens
STSAAEAKA

SEQ ID NO: 1066921 - protein, 9 aa, Homo Sapiens
HSAHREYIT

SEQ ID NO: 1066922 - protein, 9 aa, Homo Sapiens
DNFRDPAKN

SEQ ID NO: 1066923 - protein, 9 aa, Homo Sapiens
LNSKKLTYD

SEQ ID NO: 1066924 - protein, 9 aa, Homo Sapiens
EVTTMLLGL

SEQ ID NO: 1066925 - protein, 9 aa, Homo Sapiens
KPALEPRRG

SEQ ID NO: 1066926 - protein, 9 aa, Homo Sapiens
SHLGIKKYR

SEQ ID NO: 1066927 - protein, 9 aa, Homo Sapiens
HSPQIIFFF

SEQ ID NO: 1066928 - protein, 9 aa, Homo Sapiens
NGYGPGETG

SEQ ID NO: 1066929 - protein, 9 aa, Homo Sapiens
ILAITMKIF

SEQ ID NO: 1066930 - protein, 9 aa, Homo Sapiens
VLVFGLLFA

SEQ ID NO: 1066931 - protein, 9 aa, Homo Sapiens
WQQVDNNLR

SEQ ID NO: 1066932 - protein, 9 aa, Homo Sapiens
PISGMKKEA

SEQ ID NO: 1066933 - protein, 9 aa, Homo Sapiens
AQARPSLQL

SEQ ID NO: 1066934 - protein, 9 aa, Homo Sapiens
YARNQAGEI

SEQ ID NO: 1066935 - protein, 9 aa, Homo Sapiens
FWEKSSFQI

SEQ ID NO: 1066936 - protein, 9 aa, Homo Sapiens
AHKKSHKES

SEQ ID NO: 1066937 - protein, 9 aa, Homo Sapiens
ELLDGAPGS

SEQ ID NO: 1066938 - protein, 9 aa, Homo Sapiens
HHCNVIYNV

SEQ ID NO: 1066939 - protein, 9 aa, Homo Sapiens
DLTLELAGF

SEQ ID NO: 1066940 - protein, 9 aa, Homo Sapiens
NAGLGNGGL

SEQ ID NO: 1066941 - protein, 9 aa, Homo Sapiens
TLVDCSLLP

SEQ ID NO: 1066942 - protein, 9 aa, Homo Sapiens
AVFSPSFRE

SEQ ID NO: 1066943 - protein, 9 aa, Homo Sapiens
LRSIASETH

SEQ ID NO: 1066944 - protein, 9 aa, Homo Sapiens
FSDRKQDIG

SEQ ID NO: 1066945 - protein, 9 aa, Homo Sapiens
AEFLKIKVS

SEQ ID NO: 1066946 - protein, 9 aa, Homo Sapiens
HPGNSCFTT

SEQ ID NO: 1066947 - protein, 9 aa, Homo Sapiens
LGLLTKSGT

SEQ ID NO: 1066948 - protein, 9 aa, Homo Sapiens
YEQKVALHC

SEQ ID NO: 1066949 - protein, 9 aa, Homo Sapiens
SSRSLSSNP

SEQ ID NO: 1066950 - protein, 9 aa, Homo Sapiens
VVNLIIRLE

SEQ ID NO: 1066951 - protein, 9 aa, Homo Sapiens
CYSLENGSS

SEQ ID NO: 1066952 - protein, 9 aa, Homo Sapiens
KSQFLVLQT

SEQ ID NO: 1066953 - protein, 9 aa, Homo Sapiens
NSFERDSMY

SEQ ID NO: 1066954 - protein, 9 aa, Homo Sapiens
HRPAKLGAL

SEQ ID NO: 1066955 - protein, 9 aa, Homo Sapiens
YNGSRPRKE

SEQ ID NO: 1066956 - protein, 9 aa, Homo Sapiens
CLISIVLFY

SEQ ID NO: 1066957 - protein, 9 aa, Homo Sapiens
SESEARSPL

SEQ ID NO: 1066958 - protein, 9 aa, Homo Sapiens
QCGPASVQA

SEQ ID NO: 1066959 - protein, 9 aa, Homo Sapiens
QLLTMWYKN

SEQ ID NO: 1066960 - protein, 9 aa, Homo Sapiens
CLMTKWGEW

SEQ ID NO: 1066961 - protein, 9 aa, Homo Sapiens
QENNLGEEK

SEQ ID NO: 1066962 - protein, 9 aa, Homo Sapiens
GIAPLPLPF

SEQ ID NO: 1066963 - protein, 9 aa, Homo Sapiens
ALAGADFLD

SEQ ID NO: 1066964 - protein, 9 aa, Homo Sapiens
LTTLPPETP

SEQ ID NO: 1066965 - protein, 9 aa, Homo Sapiens
HLLVVLLAL

SEQ ID NO: 1066966 - protein, 9 aa, Homo Sapiens
IKVESSSLA

SEQ ID NO: 1066967 - protein, 9 aa, Homo Sapiens
RQRDWAAEA

SEQ ID NO: 1066968 - protein, 9 aa, Homo Sapiens
PGTRVRVMA

SEQ ID NO: 1066969 - protein, 9 aa, Homo Sapiens
SSASKSFTV

SEQ ID NO: 1066970 - protein, 9 aa, Homo Sapiens
EKESFITPL

SEQ ID NO: 1066971 - protein, 9 aa, Homo Sapiens
DKERIEKYG

SEQ ID NO: 1066972 - protein, 9 aa, Homo Sapiens
SLEEPMEEV

SEQ ID NO: 1066973 - protein, 9 aa, Homo Sapiens
YFSIMLTPK

SEQ ID NO: 1066974 - protein, 9 aa, Homo Sapiens
LTGNPVITA

SEQ ID NO: 1066975 - protein, 9 aa, Homo Sapiens
DHQGRSYLH

SEQ ID NO: 1066976 - protein, 9 aa, Homo Sapiens
ASNMRNDEI

SEQ ID NO: 1066977 - protein, 9 aa, Homo Sapiens
ILKNLAEEL

SEQ ID NO: 1066978 - protein, 9 aa, Homo Sapiens
IAHFFCDFL

SEQ ID NO: 1066979 - protein, 9 aa, Homo Sapiens
SKINKDEKS

SEQ ID NO: 1066980 - protein, 9 aa, Homo Sapiens
FFIAISGQV

SEQ ID NO: 1066981 - protein, 9 aa, Homo Sapiens
GHLLVVLLA

SEQ ID NO: 1066982 - protein, 9 aa, Homo Sapiens
SQKIDKFMA

SEQ ID NO: 1066983 - protein, 9 aa, Homo Sapiens
QKSVHCGPM

SEQ ID NO: 1066984 - protein, 9 aa, Homo Sapiens
SSDGKDQFS

SEQ ID NO: 1066985 - protein, 9 aa, Homo Sapiens
TPEADIHQS

SEQ ID NO: 1066986 - protein, 9 aa, Homo Sapiens
SSETFNPVS

SEQ ID NO: 1066987 - protein, 9 aa, Homo Sapiens
IVLFYIRIF

SEQ ID NO: 1066988 - protein, 9 aa, Homo Sapiens
WKKQLELVK

SEQ ID NO: 1066989 - protein, 9 aa, Homo Sapiens
SSCRTAPTN

SEQ ID NO: 1066990 - protein, 9 aa, Homo Sapiens
MGVLTFRNV

SEQ ID NO: 1066991 - protein, 9 aa, Homo Sapiens
TYVLAVHTE

SEQ ID NO: 1066992 - protein, 9 aa, Homo Sapiens
MSLIGDHQD

SEQ ID NO: 1066993 - protein, 9 aa, Homo Sapiens
AMFICSKIP

SEQ ID NO: 1066994 - protein, 9 aa, Homo Sapiens
PTSAFHFSG

SEQ ID NO: 1066995 - protein, 9 aa, Homo Sapiens
LGVKGFAGV

SEQ ID NO: 1066996 - protein, 9 aa, Homo Sapiens
YDLVNSCVS

SEQ ID NO: 1066997 - protein, 9 aa, Homo Sapiens
TREDPFIEK

SEQ ID NO: 1066998 - protein, 9 aa, Homo Sapiens
NNKHDDKYT

SEQ ID NO: 1066999 - protein, 9 aa, Homo Sapiens
IYLSDIDLT

SEQ ID NO: 1067000 - protein, 9 aa, Homo Sapiens
VSEKTIFFA

SEQ ID NO: 1067001 - protein, 9 aa, Homo Sapiens
IEVVEDTYP

SEQ ID NO: 1067002 - protein, 9 aa, Homo Sapiens
HQFDYGELV

SEQ ID NO: 1067003 - protein, 9 aa, Homo Sapiens
ELYGTGLRA

SEQ ID NO: 1067004 - protein, 9 aa, Homo Sapiens
YYSVKKTFF

SEQ ID NO: 1067005 - protein, 9 aa, Homo Sapiens
NQVYVLSEE

SEQ ID NO: 1067006 - protein, 9 aa, Homo Sapiens
NAQESKQMY

SEQ ID NO: 1067007 - protein, 9 aa, Homo Sapiens
QRTPVGIRY

SEQ ID NO: 1067008 - protein, 9 aa, Homo Sapiens
PWVTVLDPF

SEQ ID NO: 1067009 - protein, 9 aa, Homo Sapiens
KSRIQVLFM

SEQ ID NO: 1067010 - protein, 9 aa, Homo Sapiens
VEKDFNLAT

SEQ ID NO: 1067011 - protein, 9 aa, Homo Sapiens
SSSVLSILQ

SEQ ID NO: 1067012 - protein, 9 aa, Homo Sapiens
PYNSVFFLY

SEQ ID NO: 1067013 - protein, 9 aa, Homo Sapiens
YFLSEATVT

SEQ ID NO: 1067014 - protein, 9 aa, Homo Sapiens
LAREDDSFL

SEQ ID NO: 1067015 - protein, 9 aa, Homo Sapiens
KFIQELFES

SEQ ID NO: 1067016 - protein, 9 aa, Homo Sapiens
HNPLSQEAE

SEQ ID NO: 1067017 - protein, 9 aa, Homo Sapiens
VLLGEASYT

SEQ ID NO: 1067018 - protein, 9 aa, Homo Sapiens
FRGSFTDVV

SEQ ID NO: 1067019 - protein, 9 aa, Homo Sapiens
PPKCTPKCL

SEQ ID NO: 1067020 - protein, 9 aa, Homo Sapiens
KVFPGIQLK

SEQ ID NO: 1067021 - protein, 9 aa, Homo Sapiens
LLGNNQIYP

SEQ ID NO: 1067022 - protein, 9 aa, Homo Sapiens
AIWLPWGLV

SEQ ID NO: 1067023 - protein, 9 aa, Homo Sapiens
IVTEDDFGL

SEQ ID NO: 1067024 - protein, 9 aa, Homo Sapiens
GTRKLAPCI

SEQ ID NO: 1067025 - protein, 9 aa, Homo Sapiens
YQAINDAHQ

SEQ ID NO: 1067026 - protein, 9 aa, Homo Sapiens
KTNVHSPLK

SEQ ID NO: 1067027 - protein, 9 aa, Homo Sapiens
ASFVSPERD

SEQ ID NO: 1067028 - protein, 9 aa, Homo Sapiens
SGEGRLCAK

SEQ ID NO: 1067029 - protein, 9 aa, Homo Sapiens
ITDVCFFPE

SEQ ID NO: 1067030 - protein, 9 aa, Homo Sapiens
QLAYLWMKR

SEQ ID NO: 1067031 - protein, 9 aa, Homo Sapiens
SDIDLTYID

SEQ ID NO: 1067032 - protein, 9 aa, Homo Sapiens
CCPEYKCVC

SEQ ID NO: 1067033 - protein, 9 aa, Homo Sapiens
VGEAVPGAV

SEQ ID NO: 1067034 - protein, 9 aa, Homo Sapiens
GDSDINQLY

SEQ ID NO: 1067035 - protein, 9 aa, Homo Sapiens
IITPRVRSH

SEQ ID NO: 1067036 - protein, 9 aa, Homo Sapiens
KILERSYST

SEQ ID NO: 1067037 - protein, 9 aa, Homo Sapiens
GALPGSHTE

SEQ ID NO: 1067038 - protein, 9 aa, Homo Sapiens
LDTFQQMWI

SEQ ID NO: 1067039 - protein, 9 aa, Homo Sapiens
FHLLQQMDI

SEQ ID NO: 1067040 - protein, 9 aa, Homo Sapiens
ASFGFFHLI

SEQ ID NO: 1067041 - protein, 9 aa, Homo Sapiens
SKQMESYSC

SEQ ID NO: 1067042 - protein, 9 aa, Homo Sapiens
KKEVKHLSA

SEQ ID NO: 1067043 - protein, 9 aa, Homo Sapiens
CCYSLENGS

SEQ ID NO: 1067044 - protein, 9 aa, Homo Sapiens
KAPTFDKCL

SEQ ID NO: 1067045 - protein, 9 aa, Homo Sapiens
HCSTVEEDN

SEQ ID NO: 1067046 - protein, 9 aa, Homo Sapiens
KMLELPKTF

SEQ ID NO: 1067047 - protein, 9 aa, Homo Sapiens
PPCPATFPT

SEQ ID NO: 1067048 - protein, 9 aa, Homo Sapiens
FDKMSDMDC

SEQ ID NO: 1067049 - protein, 9 aa, Homo Sapiens
YGGGTSLLS

SEQ ID NO: 1067050 - protein, 9 aa, Homo Sapiens
YFGLAAISL

SEQ ID NO: 1067051 - protein, 9 aa, Homo Sapiens
PFLPPNTLQ

SEQ ID NO: 1067052 - protein, 9 aa, Homo Sapiens
LPGRDYIDQ

SEQ ID NO: 1067053 - protein, 9 aa, Homo Sapiens
HTKERPYGC

SEQ ID NO: 1067054 - protein, 9 aa, Homo Sapiens
TSAPPAPHA

SEQ ID NO: 1067055 - protein, 9 aa, Homo Sapiens
LFYTPKFVK

SEQ ID NO: 1067056 - protein, 9 aa, Homo Sapiens
GSGEAEEYE

SEQ ID NO: 1067057 - protein, 9 aa, Homo Sapiens
RQRQPLRVL

SEQ ID NO: 1067058 - protein, 9 aa, Homo Sapiens
DTEEKGHIT

SEQ ID NO: 1067059 - protein, 9 aa, Homo Sapiens
QYQIKKQIE

SEQ ID NO: 1067060 - protein, 9 aa, Homo Sapiens
GLPNHIMAS

SEQ ID NO: 1067061 - protein, 9 aa, Homo Sapiens
LTQDPAKPQ

SEQ ID NO: 1067062 - protein, 9 aa, Homo Sapiens
GMKSTYLDP

SEQ ID NO: 1067063 - protein, 9 aa, Homo Sapiens
FPIDPRIQM

SEQ ID NO: 1067064 - protein, 9 aa, Homo Sapiens
ECLLILKFV

SEQ ID NO: 1067065 - protein, 9 aa, Homo Sapiens
RQPLRVLYH

SEQ ID NO: 1067066 - protein, 9 aa, Homo Sapiens
LPVLDTAIA

SEQ ID NO: 1067067 - protein, 9 aa, Homo Sapiens
TSHLESGWE

SEQ ID NO: 1067068 - protein, 9 aa, Homo Sapiens
HNLHSLLPE

SEQ ID NO: 1067069 - protein, 9 aa, Homo Sapiens
GQKSVHCGP

SEQ ID NO: 1067070 - protein, 9 aa, Homo Sapiens
FFGFLLLFT

SEQ ID NO: 1067071 - protein, 9 aa, Homo Sapiens
STAYFSPQE

SEQ ID NO: 1067072 - protein, 9 aa, Homo Sapiens
QIRYSILEE

SEQ ID NO: 1067073 - protein, 9 aa, Homo Sapiens
VSSQKNVAP

SEQ ID NO: 1067074 - protein, 9 aa, Homo Sapiens
QSNRYPDMS

SEQ ID NO: 1067075 - protein, 9 aa, Homo Sapiens
FCLRCFLAG

SEQ ID NO: 1067076 - protein, 9 aa, Homo Sapiens
PMPLLNCAK

SEQ ID NO: 1067077 - protein, 9 aa, Homo Sapiens
LLDKDVFQG

SEQ ID NO: 1067078 - protein, 9 aa, Homo Sapiens
GVDISLTGN

SEQ ID NO: 1067079 - protein, 9 aa, Homo Sapiens
TREPEEITK

SEQ ID NO: 1067080 - protein, 9 aa, Homo Sapiens
FIKHKRKLH

SEQ ID NO: 1067081 - protein, 9 aa, Homo Sapiens
EDSPDSFSF

SEQ ID NO: 1067082 - protein, 9 aa, Homo Sapiens
TEEYPLADI

SEQ ID NO: 1067083 - protein, 9 aa, Homo Sapiens
HSRQYKHLD

SEQ ID NO: 1067084 - protein, 9 aa, Homo Sapiens
LSSPVEIKG

SEQ ID NO: 1067085 - protein, 9 aa, Homo Sapiens
SCCESLELK

SEQ ID NO: 1067086 - protein, 9 aa, Homo Sapiens
FINEVCMEA

SEQ ID NO: 1067087 - protein, 9 aa, Homo Sapiens
QGQTNVMVN

SEQ ID NO: 1067088 - protein, 9 aa, Homo Sapiens
RLITLFKKK

SEQ ID NO: 1067089 - protein, 9 aa, Homo Sapiens
IKSDLVEYF

SEQ ID NO: 1067090 - protein, 9 aa, Homo Sapiens
LFLFTSNSF

SEQ ID NO: 1067091 - protein, 9 aa, Homo Sapiens
PKSQFLVLQ

SEQ ID NO: 1067092 - protein, 9 aa, Homo Sapiens
MHPFRDNRR

SEQ ID NO: 1067093 - protein, 9 aa, Homo Sapiens
SPSDDKDMP

SEQ ID NO: 1067094 - protein, 9 aa, Homo Sapiens
YSIFYATSF

SEQ ID NO: 1067095 - protein, 9 aa, Homo Sapiens
SIPESSGCL

SEQ ID NO: 1067096 - protein, 9 aa, Homo Sapiens
PVGIRYRIA

SEQ ID NO: 1067097 - protein, 9 aa, Homo Sapiens
KSLEESSFG

SEQ ID NO: 1067098 - protein, 9 aa, Homo Sapiens
QSIMGKFVK

SEQ ID NO: 1067099 - protein, 9 aa, Homo Sapiens
CHDQEPHGA

SEQ ID NO: 1067100 - protein, 9 aa, Homo Sapiens
EARPHRCLR

SEQ ID NO: 1067101 - protein, 9 aa, Homo Sapiens
GTALYEAWA

SEQ ID NO: 1067102 - protein, 9 aa, Homo Sapiens
FPGNLGMKG

SEQ ID NO: 1067103 - protein, 9 aa, Homo Sapiens
KSEKRGSSK

SEQ ID NO: 1067104 - protein, 9 aa, Homo Sapiens
KFLFVFYTV

SEQ ID NO: 1067105 - protein, 9 aa, Homo Sapiens
ILHQTVTAQ

SEQ ID NO: 1067106 - protein, 9 aa, Homo Sapiens
RYRRTALIL

SEQ ID NO: 1067107 - protein, 9 aa, Homo Sapiens
RPKVMWHLF

SEQ ID NO: 1067108 - protein, 9 aa, Homo Sapiens
ARDKDGKEL

SEQ ID NO: 1067109 - protein, 9 aa, Homo Sapiens
YTDDEDKDE

SEQ ID NO: 1067110 - protein, 9 aa, Homo Sapiens
KQAPPQKVL

SEQ ID NO: 1067111 - protein, 9 aa, Homo Sapiens
PFQTSMSGT

SEQ ID NO: 1067112 - protein, 9 aa, Homo Sapiens
HNGGDVTFY

SEQ ID NO: 1067113 - protein, 9 aa, Homo Sapiens
SHIAWTEAC

SEQ ID NO: 1067114 - protein, 9 aa, Homo Sapiens
LKWNSDDYG

SEQ ID NO: 1067115 - protein, 9 aa, Homo Sapiens
FFSQGADLE

SEQ ID NO: 1067116 - protein, 9 aa, Homo Sapiens
AAAAAASVS

SEQ ID NO: 1067117 - protein, 9 aa, Homo Sapiens
KYKYEVEKL

SEQ ID NO: 1067118 - protein, 9 aa, Homo Sapiens
CHFGTPLLV

SEQ ID NO: 1067119 - protein, 9 aa, Homo Sapiens
KETNDNSKR

SEQ ID NO: 1067120 - protein, 9 aa, Homo Sapiens
LQNPAPLEC

SEQ ID NO: 1067121 - protein, 9 aa, Homo Sapiens
GLTKNFSFL

SEQ ID NO: 1067122 - protein, 9 aa, Homo Sapiens
GPIAQNQAS

SEQ ID NO: 1067123 - protein, 9 aa, Homo Sapiens
TTAQLYWKE

SEQ ID NO: 1067124 - protein, 9 aa, Homo Sapiens
SEEEITTSK

SEQ ID NO: 1067125 - protein, 9 aa, Homo Sapiens
NTSGDKIIT

SEQ ID NO: 1067126 - protein, 9 aa, Homo Sapiens
SPNHLPVGL

SEQ ID NO: 1067127 - protein, 9 aa, Homo Sapiens
AEVHIVKNG

SEQ ID NO: 1067128 - protein, 9 aa, Homo Sapiens
SFMQHFSEA

SEQ ID NO: 1067129 - protein, 9 aa, Homo Sapiens
SLFWRQIRS

SEQ ID NO: 1067130 - protein, 9 aa, Homo Sapiens
GPAPSPSLC

SEQ ID NO: 1067131 - protein, 9 aa, Homo Sapiens
KKGQVLECS

SEQ ID NO: 1067132 - protein, 9 aa, Homo Sapiens
LMEVSNLKV

SEQ ID NO: 1067133 - protein, 9 aa, Homo Sapiens
LFYTIIILL

SEQ ID NO: 1067134 - protein, 9 aa, Homo Sapiens
NARSQKNTK

SEQ ID NO: 1067135 - protein, 9 aa, Homo Sapiens
PEKSFTRSK

SEQ ID NO: 1067136 - protein, 9 aa, Homo Sapiens
EVYEDLEVT

SEQ ID NO: 1067137 - protein, 9 aa, Homo Sapiens
GRPQGLGRS

SEQ ID NO: 1067138 - protein, 9 aa, Homo Sapiens
VLVRRLLLL

SEQ ID NO: 1067139 - protein, 9 aa, Homo Sapiens
LSLEELLLR

SEQ ID NO: 1067140 - protein, 9 aa, Homo Sapiens
LLAKKRKEE

SEQ ID NO: 1067141 - protein, 9 aa, Homo Sapiens
FTSKLFCSL

SEQ ID NO: 1067142 - protein, 9 aa, Homo Sapiens
PQNITSTLH

SEQ ID NO: 1067143 - protein, 9 aa, Homo Sapiens
DQCCPEYKC

SEQ ID NO: 1067144 - protein, 9 aa, Homo Sapiens
TTKIHPSCV

SEQ ID NO: 1067145 - protein, 9 aa, Homo Sapiens
STPSPKEQP

SEQ ID NO: 1067146 - protein, 9 aa, Homo Sapiens
PSHSPEHRQ

SEQ ID NO: 1067147 - protein, 9 aa, Homo Sapiens
DKIIQLVVQ

SEQ ID NO: 1067148 - protein, 9 aa, Homo Sapiens
QESGLEQSS

SEQ ID NO: 1067149 - protein, 9 aa, Homo Sapiens
YIPFAPGNY

SEQ ID NO: 1067150 - protein, 9 aa, Homo Sapiens
KPQRPPPQG

SEQ ID NO: 1067151 - protein, 9 aa, Homo Sapiens
ESMEIEVKL

SEQ ID NO: 1067152 - protein, 9 aa, Homo Sapiens
GKLRFQNNP

SEQ ID NO: 1067153 - protein, 9 aa, Homo Sapiens
ANKLYALND

SEQ ID NO: 1067154 - protein, 9 aa, Homo Sapiens
RPEVKKEPS

SEQ ID NO: 1067155 - protein, 9 aa, Homo Sapiens
PVSPLPKVT

SEQ ID NO: 1067156 - protein, 9 aa, Homo Sapiens
AGNIIHSLI

SEQ ID NO: 1067157 - protein, 9 aa, Homo Sapiens
MGTQSGCGL

SEQ ID NO: 1067158 - protein, 9 aa, Homo Sapiens
KSSHLAVYQ

SEQ ID NO: 1067159 - protein, 9 aa, Homo Sapiens
GGRRRKKFG

SEQ ID NO: 1067160 - protein, 9 aa, Homo Sapiens
IFCFQDTGL

SEQ ID NO: 1067161 - protein, 9 aa, Homo Sapiens
LNPPTQKPL

SEQ ID NO: 1067162 - protein, 9 aa, Homo Sapiens
AAAVPAAVP

SEQ ID NO: 1067163 - protein, 9 aa, Homo Sapiens
YILDNDTVS

SEQ ID NO: 1067164 - protein, 9 aa, Homo Sapiens
ISRVLSAQR

SEQ ID NO: 1067165 - protein, 9 aa, Homo Sapiens
CCNFSNMWK

SEQ ID NO: 1067166 - protein, 9 aa, Homo Sapiens
VFLYSEKDE

SEQ ID NO: 1067167 - protein, 9 aa, Homo Sapiens
SQQSCAFHD

SEQ ID NO: 1067168 - protein, 9 aa, Homo Sapiens
SIWHQLAFQ

SEQ ID NO: 1067169 - protein, 9 aa, Homo Sapiens
YLMLIINAR

SEQ ID NO: 1067170 - protein, 9 aa, Homo Sapiens
ESKIQTDAN

SEQ ID NO: 1067171 - protein, 9 aa, Homo Sapiens
PFSITLVLR

SEQ ID NO: 1067172 - protein, 9 aa, Homo Sapiens
PPHIIYVPA

SEQ ID NO: 1067173 - protein, 9 aa, Homo Sapiens
RQSFEIHTN

SEQ ID NO: 1067174 - protein, 9 aa, Homo Sapiens
AKRLKLLQE

SEQ ID NO: 1067175 - protein, 9 aa, Homo Sapiens
NPINFIQPG

SEQ ID NO: 1067176 - protein, 9 aa, Homo Sapiens
SQGQRWIWF

SEQ ID NO: 1067177 - protein, 9 aa, Homo Sapiens
EEKMRKKEE

SEQ ID NO: 1067178 - protein, 9 aa, Homo Sapiens
SNCSNSVSS

SEQ ID NO: 1067179 - protein, 9 aa, Homo Sapiens
APPSPLTTL

SEQ ID NO: 1067180 - protein, 9 aa, Homo Sapiens
GSNFGHSSS

SEQ ID NO: 1067181 - protein, 9 aa, Homo Sapiens
SDSPKKVRK

SEQ ID NO: 1067182 - protein, 9 aa, Homo Sapiens
ENISLFACA

SEQ ID NO: 1067183 - protein, 9 aa, Homo Sapiens
MAYNRFIAI

SEQ ID NO: 1067184 - protein, 9 aa, Homo Sapiens
GSPGPAGSP

SEQ ID NO: 1067185 - protein, 9 aa, Homo Sapiens
SKRYYVAEK

SEQ ID NO: 1067186 - protein, 9 aa, Homo Sapiens
QQSGEIILC

SEQ ID NO: 1067187 - protein, 9 aa, Homo Sapiens
EEKLCRLKL

SEQ ID NO: 1067188 - protein, 9 aa, Homo Sapiens
KKMSLVKEK

SEQ ID NO: 1067189 - protein, 9 aa, Homo Sapiens
EPAKENLFI

SEQ ID NO: 1067190 - protein, 9 aa, Homo Sapiens
RSSVLTLIL

SEQ ID NO: 1067191 - protein, 9 aa, Homo Sapiens
RRSAWPLAK

SEQ ID NO: 1067192 - protein, 9 aa, Homo Sapiens
LTCMLFFFV

SEQ ID NO: 1067193 - protein, 9 aa, Homo Sapiens
SLIGLIPSC

SEQ ID NO: 1067194 - protein, 9 aa, Homo Sapiens
DILMSLVLF

SEQ ID NO: 1067195 - protein, 9 aa, Homo Sapiens
ALCQGSGSL

SEQ ID NO: 1067196 - protein, 9 aa, Homo Sapiens
KENIGGELV

SEQ ID NO: 1067197 - protein, 9 aa, Homo Sapiens
ARELFPGSF

SEQ ID NO: 1067198 - protein, 9 aa, Homo Sapiens
NCSGEHVKL

SEQ ID NO: 1067199 - protein, 9 aa, Homo Sapiens
SPGPAGSPG

SEQ ID NO: 1067200 - protein, 9 aa, Homo Sapiens
ELHHQRPKR

SEQ ID NO: 1067201 - protein, 9 aa, Homo Sapiens
LGLPPHAGA

SEQ ID NO: 1067202 - protein, 9 aa, Homo Sapiens
NQEIDEKFK

SEQ ID NO: 1067203 - protein, 9 aa, Homo Sapiens
TQSPTQPSS

SEQ ID NO: 1067204 - protein, 9 aa, Homo Sapiens
AQSHTRKIS

SEQ ID NO: 1067205 - protein, 9 aa, Homo Sapiens
QQDCSQCQE

SEQ ID NO: 1067206 - protein, 9 aa, Homo Sapiens
CNYENCEKA

SEQ ID NO: 1067207 - protein, 9 aa, Homo Sapiens
SNRYPDMST

SEQ ID NO: 1067208 - protein, 9 aa, Homo Sapiens
VDSASPVEN

SEQ ID NO: 1067209 - protein, 9 aa, Homo Sapiens
SKNKFSLIL

SEQ ID NO: 1067210 - protein, 9 aa, Homo Sapiens
FMAQKKRVE

SEQ ID NO: 1067211 - protein, 9 aa, Homo Sapiens
QALMGSYQR

SEQ ID NO: 1067212 - protein, 9 aa, Homo Sapiens
FSTFPLLPH

SEQ ID NO: 1067213 - protein, 9 aa, Homo Sapiens
QYPTPYPED

SEQ ID NO: 1067214 - protein, 9 aa, Homo Sapiens
VNCGYVTAY

SEQ ID NO: 1067215 - protein, 9 aa, Homo Sapiens
VMIIDEPVS

SEQ ID NO: 1067216 - protein, 9 aa, Homo Sapiens
KGRNWDYLR

SEQ ID NO: 1067217 - protein, 9 aa, Homo Sapiens
TAKKIVHRY

SEQ ID NO: 1067218 - protein, 9 aa, Homo Sapiens
KHLFPVAHV

SEQ ID NO: 1067219 - protein, 9 aa, Homo Sapiens
ALFIFMQAV

SEQ ID NO: 1067220 - protein, 9 aa, Homo Sapiens
GIVSDLFST

SEQ ID NO: 1067221 - protein, 9 aa, Homo Sapiens
LDVWGGKNM

SEQ ID NO: 1067222 - protein, 9 aa, Homo Sapiens
GTDCSIQDP

SEQ ID NO: 1067223 - protein, 9 aa, Homo Sapiens
HRFGKHLFP

SEQ ID NO: 1067224 - protein, 9 aa, Homo Sapiens
IISHRACII

SEQ ID NO: 1067225 - protein, 9 aa, Homo Sapiens
IAFNILNDT

SEQ ID NO: 1067226 - protein, 9 aa, Homo Sapiens
PGYKGKGKQ

SEQ ID NO: 1067227 - protein, 9 aa, Homo Sapiens
LSKFQNLQI

SEQ ID NO: 1067228 - protein, 9 aa, Homo Sapiens
GTEYCLTLY

SEQ ID NO: 1067229 - protein, 9 aa, Homo Sapiens
TFNVLAMYV

SEQ ID NO: 1067230 - protein, 9 aa, Homo Sapiens
TIFRIKSKE

SEQ ID NO: 1067231 - protein, 9 aa, Homo Sapiens
SQDSGKPRV

SEQ ID NO: 1067232 - protein, 9 aa, Homo Sapiens
FGDCDNFQN

SEQ ID NO: 1067233 - protein, 9 aa, Homo Sapiens
KFKKMSNRR

SEQ ID NO: 1067234 - protein, 9 aa, Homo Sapiens
PARKQKSKL

SEQ ID NO: 1067235 - protein, 9 aa, Homo Sapiens
LLTIFRIKS

SEQ ID NO: 1067236 - protein, 9 aa, Homo Sapiens
RQAKVQEEM

SEQ ID NO: 1067237 - protein, 9 aa, Homo Sapiens
YLDQIKREQ

SEQ ID NO: 1067238 - protein, 9 aa, Homo Sapiens
MKSIISAIV

SEQ ID NO: 1067239 - protein, 9 aa, Homo Sapiens
SMKLTSNRR

SEQ ID NO: 1067240 - protein, 9 aa, Homo Sapiens
QVLPPSALT

SEQ ID NO: 1067241 - protein, 9 aa, Homo Sapiens
YYFLSNLFF

SEQ ID NO: 1067242 - protein, 9 aa, Homo Sapiens
TCKDAGLVK

SEQ ID NO: 1067243 - protein, 9 aa, Homo Sapiens
GVKYVPSYG

SEQ ID NO: 1067244 - protein, 9 aa, Homo Sapiens
MVGSNQRQS

SEQ ID NO: 1067245 - protein, 9 aa, Homo Sapiens
MEVKNEASC

SEQ ID NO: 1067246 - protein, 9 aa, Homo Sapiens
FYRLYSLLY

SEQ ID NO: 1067247 - protein, 9 aa, Homo Sapiens
VKWEYCNLT

SEQ ID NO: 1067248 - protein, 9 aa, Homo Sapiens
LLNEECKVP

SEQ ID NO: 1067249 - protein, 9 aa, Homo Sapiens
ASIADRLWP

SEQ ID NO: 1067250 - protein, 9 aa, Homo Sapiens
LEDFFSQGA

SEQ ID NO: 1067251 - protein, 9 aa, Homo Sapiens
LDEFSDFDR

SEQ ID NO: 1067252 - protein, 9 aa, Homo Sapiens
PDDRFQVND

SEQ ID NO: 1067253 - protein, 9 aa, Homo Sapiens
DGEQTVLQL

SEQ ID NO: 1067254 - protein, 9 aa, Homo Sapiens
RSEYFCQDF

SEQ ID NO: 1067255 - protein, 9 aa, Homo Sapiens
VPQPRSSRW

SEQ ID NO: 1067256 - protein, 9 aa, Homo Sapiens
TTEDKPVES

SEQ ID NO: 1067257 - protein, 9 aa, Homo Sapiens
TFSCMDRMS

SEQ ID NO: 1067258 - protein, 9 aa, Homo Sapiens
VQERRAQES

SEQ ID NO: 1067259 - protein, 9 aa, Homo Sapiens
TVSEGQFDS

SEQ ID NO: 1067260 - protein, 9 aa, Homo Sapiens
LLYSVSMSL

SEQ ID NO: 1067261 - protein, 9 aa, Homo Sapiens
LRAGGAGQR

SEQ ID NO: 1067262 - protein, 9 aa, Homo Sapiens
CYNVRNLID

SEQ ID NO: 1067263 - protein, 9 aa, Homo Sapiens
SLTIQMESL

SEQ ID NO: 1067264 - protein, 9 aa, Homo Sapiens
PEPLNVIFL

SEQ ID NO: 1067265 - protein, 9 aa, Homo Sapiens
YQKQLGHHV

SEQ ID NO: 1067266 - protein, 9 aa, Homo Sapiens
QGNFFFPIS

SEQ ID NO: 1067267 - protein, 9 aa, Homo Sapiens
EPSRCYFYD

SEQ ID NO: 1067268 - protein, 9 aa, Homo Sapiens
LFQDSPEQE

SEQ ID NO: 1067269 - protein, 9 aa, Homo Sapiens
VKEEWQDKD

SEQ ID NO: 1067270 - protein, 9 aa, Homo Sapiens
FELTFCLKR

SEQ ID NO: 1067271 - protein, 9 aa, Homo Sapiens
FLALSLSPT

SEQ ID NO: 1067272 - protein, 9 aa, Homo Sapiens
SEIMEYFVQ

SEQ ID NO: 1067273 - protein, 9 aa, Homo Sapiens
PAVFSPSFR

SEQ ID NO: 1067274 - protein, 9 aa, Homo Sapiens
IILAFYLVH

SEQ ID NO: 1067275 - protein, 9 aa, Homo Sapiens
PEKTKSPLK

SEQ ID NO: 1067276 - protein, 9 aa, Homo Sapiens
FVYMCYEFV

SEQ ID NO: 1067277 - protein, 9 aa, Homo Sapiens
QRWTLGLLA

SEQ ID NO: 1067278 - protein, 9 aa, Homo Sapiens
KEEYQNKKK

SEQ ID NO: 1067279 - protein, 9 aa, Homo Sapiens
YNKGRNWDY

SEQ ID NO: 1067280 - protein, 9 aa, Homo Sapiens
FTKTASSLT

SEQ ID NO: 1067281 - protein, 9 aa, Homo Sapiens
FRGDKVISY

SEQ ID NO: 1067282 - protein, 9 aa, Homo Sapiens
SLLQLDQWM

SEQ ID NO: 1067283 - protein, 9 aa, Homo Sapiens
LKLILSTTG

SEQ ID NO: 1067284 - protein, 9 aa, Homo Sapiens
RLGEGRGGP

SEQ ID NO: 1067285 - protein, 9 aa, Homo Sapiens
DTGPTLEGG

SEQ ID NO: 1067286 - protein, 9 aa, Homo Sapiens
IYKVFCHTA

SEQ ID NO: 1067287 - protein, 9 aa, Homo Sapiens
TKHKIIYTG

SEQ ID NO: 1067288 - protein, 9 aa, Homo Sapiens
KGELSIISY

SEQ ID NO: 1067289 - protein, 9 aa, Homo Sapiens
TFYDNVQFD

SEQ ID NO: 1067290 - protein, 9 aa, Homo Sapiens
NHSAAYNST

SEQ ID NO: 1067291 - protein, 9 aa, Homo Sapiens
VTKYMSKGS

SEQ ID NO: 1067292 - protein, 9 aa, Homo Sapiens
YTQASGYNQ

SEQ ID NO: 1067293 - protein, 9 aa, Homo Sapiens
MEAYPGLQG

SEQ ID NO: 1067294 - protein, 9 aa, Homo Sapiens
PLNEREDTD

SEQ ID NO: 1067295 - protein, 9 aa, Homo Sapiens
SQKEINRKN

SEQ ID NO: 1067296 - protein, 9 aa, Homo Sapiens
SLSELYLQC

SEQ ID NO: 1067297 - protein, 9 aa, Homo Sapiens
PKMRIRFTS

SEQ ID NO: 1067298 - protein, 9 aa, Homo Sapiens
KAPERRVVV

SEQ ID NO: 1067299 - protein, 9 aa, Homo Sapiens
FEPGFMMTC

SEQ ID NO: 1067300 - protein, 9 aa, Homo Sapiens
HSQKKDQER

SEQ ID NO: 1067301 - protein, 9 aa, Homo Sapiens
ASMLCCHEA

SEQ ID NO: 1067302 - protein, 9 aa, Homo Sapiens
YKGLHLNST

SEQ ID NO: 1067303 - protein, 9 aa, Homo Sapiens
YDGIPASKI

SEQ ID NO: 1067304 - protein, 9 aa, Homo Sapiens
ITDTTAQLY

SEQ ID NO: 1067305 - protein, 9 aa, Homo Sapiens
VLEQRYRLL

SEQ ID NO: 1067306 - protein, 9 aa, Homo Sapiens
LLKKKLDFK

SEQ ID NO: 1067307 - protein, 9 aa, Homo Sapiens
EEGHDSKEP

SEQ ID NO: 1067308 - protein, 9 aa, Homo Sapiens
QLSSKMKHI

SEQ ID NO: 1067309 - protein, 9 aa, Homo Sapiens
QVLLTPVKS

SEQ ID NO: 1067310 - protein, 9 aa, Homo Sapiens
TIKDSVFKS

SEQ ID NO: 1067311 - protein, 9 aa, Homo Sapiens
TPPSYVVDL

SEQ ID NO: 1067312 - protein, 9 aa, Homo Sapiens
MKFHQQMHR

SEQ ID NO: 1067313 - protein, 9 aa, Homo Sapiens
MMNPETKAR

SEQ ID NO: 1067314 - protein, 9 aa, Homo Sapiens
LPQPTPQMA

SEQ ID NO: 1067315 - protein, 9 aa, Homo Sapiens
RERPRLGPS

SEQ ID NO: 1067316 - protein, 9 aa, Homo Sapiens
PESNQKSEN

SEQ ID NO: 1067317 - protein, 9 aa, Homo Sapiens
LDSMLQEGT

SEQ ID NO: 1067318 - protein, 9 aa, Homo Sapiens
PGDSDINQL

SEQ ID NO: 1067319 - protein, 9 aa, Homo Sapiens
VMMEAYPGL

SEQ ID NO: 1067320 - protein, 9 aa, Homo Sapiens
SFARSKAIY

SEQ ID NO: 1067321 - protein, 9 aa, Homo Sapiens
NGNQKLHHD

SEQ ID NO: 1067322 - protein, 9 aa, Homo Sapiens
RAIEQLAVM

SEQ ID NO: 1067323 - protein, 9 aa, Homo Sapiens
SCGLESECL

SEQ ID NO: 1067324 - protein, 9 aa, Homo Sapiens
HQRIHTKER

SEQ ID NO: 1067325 - protein, 9 aa, Homo Sapiens
LLPSPGSAA

SEQ ID NO: 1067326 - protein, 9 aa, Homo Sapiens
GQSRGLLRS

SEQ ID NO: 1067327 - protein, 9 aa, Homo Sapiens
PRSRISVLL

SEQ ID NO: 1067328 - protein, 9 aa, Homo Sapiens
EDKPVESMQ

SEQ ID NO: 1067329 - protein, 9 aa, Homo Sapiens
KMADSFFET

SEQ ID NO: 1067330 - protein, 9 aa, Homo Sapiens
AIITQLAEV

SEQ ID NO: 1067331 - protein, 9 aa, Homo Sapiens
TVLMELFQN

SEQ ID NO: 1067332 - protein, 9 aa, Homo Sapiens
GATTMDQKF

SEQ ID NO: 1067333 - protein, 9 aa, Homo Sapiens
VAPLSQDTS

SEQ ID NO: 1067334 - protein, 9 aa, Homo Sapiens
YDSHQNQWT

SEQ ID NO: 1067335 - protein, 9 aa, Homo Sapiens
RVDSAEFGD

SEQ ID NO: 1067336 - protein, 9 aa, Homo Sapiens
CPCYVRRHE

SEQ ID NO: 1067337 - protein, 9 aa, Homo Sapiens
REELELEGG

SEQ ID NO: 1067338 - protein, 9 aa, Homo Sapiens
DMADRVKTQ

SEQ ID NO: 1067339 - protein, 9 aa, Homo Sapiens
IVSSSSCSG

SEQ ID NO: 1067340 - protein, 9 aa, Homo Sapiens
NDKSISVQK

SEQ ID NO: 1067341 - protein, 9 aa, Homo Sapiens
DLGRLGHGD

SEQ ID NO: 1067342 - protein, 9 aa, Homo Sapiens
KESSKNIQQ

SEQ ID NO: 1067343 - protein, 9 aa, Homo Sapiens
PNELTVDKA

SEQ ID NO: 1067344 - protein, 9 aa, Homo Sapiens
RMVQLVVAS

SEQ ID NO: 1067345 - protein, 9 aa, Homo Sapiens
RTLRLYDRR

SEQ ID NO: 1067346 - protein, 9 aa, Homo Sapiens
GTAPNLPVS

SEQ ID NO: 1067347 - protein, 9 aa, Homo Sapiens
SILNCESAD

SEQ ID NO: 1067348 - protein, 9 aa, Homo Sapiens
RYTIIISHR

SEQ ID NO: 1067349 - protein, 9 aa, Homo Sapiens
KGQGNSDSD

SEQ ID NO: 1067350 - protein, 9 aa, Homo Sapiens
PLTTLPPET

SEQ ID NO: 1067351 - protein, 9 aa, Homo Sapiens
KVTWTINGL

SEQ ID NO: 1067352 - protein, 9 aa, Homo Sapiens
GMAPDSKTT

SEQ ID NO: 1067353 - protein, 9 aa, Homo Sapiens
QFGEKNSQL

SEQ ID NO: 1067354 - protein, 9 aa, Homo Sapiens
LEPRVRLFV

SEQ ID NO: 1067355 - protein, 9 aa, Homo Sapiens
RNRLMDTAR

SEQ ID NO: 1067356 - protein, 9 aa, Homo Sapiens
ALREELELE

SEQ ID NO: 1067357 - protein, 9 aa, Homo Sapiens
FSSHRSSVS

SEQ ID NO: 1067358 - protein, 9 aa, Homo Sapiens
LLLSSPVEI

SEQ ID NO: 1067359 - protein, 9 aa, Homo Sapiens
SCQGKKKKH

SEQ ID NO: 1067360 - protein, 9 aa, Homo Sapiens
HVSGACTCL

SEQ ID NO: 1067361 - protein, 9 aa, Homo Sapiens
RHFLGEDCI

SEQ ID NO: 1067362 - protein, 9 aa, Homo Sapiens
DSSSSSFSS

SEQ ID NO: 1067363 - protein, 9 aa, Homo Sapiens
MDSHPSYTN

SEQ ID NO: 1067364 - protein, 9 aa, Homo Sapiens
EAAKHGTFV

SEQ ID NO: 1067365 - protein, 9 aa, Homo Sapiens
RCQQIFMKN

SEQ ID NO: 1067366 - protein, 9 aa, Homo Sapiens
KLVCNDENS

SEQ ID NO: 1067367 - protein, 9 aa, Homo Sapiens
PNFFSHFSS

SEQ ID NO: 1067368 - protein, 9 aa, Homo Sapiens
TGNMPNTSI

SEQ ID NO: 1067369 - protein, 9 aa, Homo Sapiens
FRHNKPVNA

SEQ ID NO: 1067370 - protein, 9 aa, Homo Sapiens
TTAKVFFNK

SEQ ID NO: 1067371 - protein, 9 aa, Homo Sapiens
PLLPFIQTI

SEQ ID NO: 1067372 - protein, 9 aa, Homo Sapiens
MEDRMKCES

SEQ ID NO: 1067373 - protein, 9 aa, Homo Sapiens
RHCDVNKDE

SEQ ID NO: 1067374 - protein, 9 aa, Homo Sapiens
GHVSFFWYQ

SEQ ID NO: 1067375 - protein, 9 aa, Homo Sapiens
GGVRVRVVI

SEQ ID NO: 1067376 - protein, 9 aa, Homo Sapiens
LAYLPKEMT

SEQ ID NO: 1067377 - protein, 9 aa, Homo Sapiens
YLWMKRQKS

SEQ ID NO: 1067378 - protein, 9 aa, Homo Sapiens
LKLQKLDKS

SEQ ID NO: 1067379 - protein, 9 aa, Homo Sapiens
QVGQKQSSG

SEQ ID NO: 1067380 - protein, 9 aa, Homo Sapiens
PALLPSPGS

SEQ ID NO: 1067381 - protein, 9 aa, Homo Sapiens
ASGDTTCPG

SEQ ID NO: 1067382 - protein, 9 aa, Homo Sapiens
DAVNGYIED

SEQ ID NO: 1067383 - protein, 9 aa, Homo Sapiens
GGKFCEGFT

SEQ ID NO: 1067384 - protein, 9 aa, Homo Sapiens
QVWKRDQKQ

SEQ ID NO: 1067385 - protein, 9 aa, Homo Sapiens
LSFNTSGDK

SEQ ID NO: 1067386 - protein, 9 aa, Homo Sapiens
KPDMCVGES

SEQ ID NO: 1067387 - protein, 9 aa, Homo Sapiens
FEGHNTTAS

SEQ ID NO: 1067388 - protein, 9 aa, Homo Sapiens
ALEDKNSFL

SEQ ID NO: 1067389 - protein, 9 aa, Homo Sapiens
AAWEEKELI

SEQ ID NO: 1067390 - protein, 9 aa, Homo Sapiens
GKAFFSPSL

SEQ ID NO: 1067391 - protein, 9 aa, Homo Sapiens
SGGRSSALY

SEQ ID NO: 1067392 - protein, 9 aa, Homo Sapiens
SLLLPPPPA

SEQ ID NO: 1067393 - protein, 9 aa, Homo Sapiens
FYGDLQKAL

SEQ ID NO: 1067394 - protein, 9 aa, Homo Sapiens
MKGLNSFER

SEQ ID NO: 1067395 - protein, 9 aa, Homo Sapiens
EPGHETPMT

SEQ ID NO: 1067396 - protein, 9 aa, Homo Sapiens
NFLEAIDLR

SEQ ID NO: 1067397 - protein, 9 aa, Homo Sapiens
QSNLTSLLV

SEQ ID NO: 1067398 - protein, 9 aa, Homo Sapiens
IEKCLKFVV

SEQ ID NO: 1067399 - protein, 9 aa, Homo Sapiens
GDVTFYDVL

SEQ ID NO: 1067400 - protein, 9 aa, Homo Sapiens
VPLQPPYSP

SEQ ID NO: 1067401 - protein, 9 aa, Homo Sapiens
NVPALFIFM

SEQ ID NO: 1067402 - protein, 9 aa, Homo Sapiens
HREYITCVI

SEQ ID NO: 1067403 - protein, 9 aa, Homo Sapiens
KQTKSYNDM

SEQ ID NO: 1067404 - protein, 9 aa, Homo Sapiens
NADFTVKIW

SEQ ID NO: 1067405 - protein, 9 aa, Homo Sapiens
DISIILAEA

SEQ ID NO: 1067406 - protein, 9 aa, Homo Sapiens
VSSSSCSGP

SEQ ID NO: 1067407 - protein, 9 aa, Homo Sapiens
FQDCFFRNR

SEQ ID NO: 1067408 - protein, 9 aa, Homo Sapiens
KAFEEKQKE

SEQ ID NO: 1067409 - protein, 9 aa, Homo Sapiens
YSSSLLEFV

SEQ ID NO: 1067410 - protein, 9 aa, Homo Sapiens
NPFQTSMSG

SEQ ID NO: 1067411 - protein, 9 aa, Homo Sapiens
MITYSEKRP

SEQ ID NO: 1067412 - protein, 9 aa, Homo Sapiens
FNFWLDSKS

SEQ ID NO: 1067413 - protein, 9 aa, Homo Sapiens
KVEVNCKWI

SEQ ID NO: 1067414 - protein, 9 aa, Homo Sapiens
DGFWLTVET

SEQ ID NO: 1067415 - protein, 9 aa, Homo Sapiens
PTDPALSTP

SEQ ID NO: 1067416 - protein, 9 aa, Homo Sapiens
LLLNLTCSD

SEQ ID NO: 1067417 - protein, 9 aa, Homo Sapiens
PEGFRCECW

SEQ ID NO: 1067418 - protein, 9 aa, Homo Sapiens
LNVEFYTLK

SEQ ID NO: 1067419 - protein, 9 aa, Homo Sapiens
CFVSKTTHR

SEQ ID NO: 1067420 - protein, 9 aa, Homo Sapiens
PVALGLKKK

SEQ ID NO: 1067421 - protein, 9 aa, Homo Sapiens
KGINFVKRK

SEQ ID NO: 1067422 - protein, 9 aa, Homo Sapiens
GFGSGSGFG

SEQ ID NO: 1067423 - protein, 9 aa, Homo Sapiens
EGPSLEWET

SEQ ID NO: 1067424 - protein, 9 aa, Homo Sapiens
MENSHPPHP

SEQ ID NO: 1067425 - protein, 9 aa, Homo Sapiens
SLGQDMRRL

SEQ ID NO: 1067426 - protein, 9 aa, Homo Sapiens
SINNLKPET

SEQ ID NO: 1067427 - protein, 9 aa, Homo Sapiens
RVNIFLCQK

SEQ ID NO: 1067428 - protein, 9 aa, Homo Sapiens
NYKILEKFK

SEQ ID NO: 1067429 - protein, 9 aa, Homo Sapiens
YNPEAASAP

SEQ ID NO: 1067430 - protein, 9 aa, Homo Sapiens
VRGRPAQIS

SEQ ID NO: 1067431 - protein, 9 aa, Homo Sapiens
ENNLGEEKN

SEQ ID NO: 1067432 - protein, 9 aa, Homo Sapiens
DSSGAGLWL

SEQ ID NO: 1067433 - protein, 9 aa, Homo Sapiens
FGPHDQIMS

SEQ ID NO: 1067434 - protein, 9 aa, Homo Sapiens
YPFGVYVSL

SEQ ID NO: 1067435 - protein, 9 aa, Homo Sapiens
RPEVTHQKR

SEQ ID NO: 1067436 - protein, 9 aa, Homo Sapiens
VHFSGYQAA

SEQ ID NO: 1067437 - protein, 9 aa, Homo Sapiens
ANGLLNFDI

SEQ ID NO: 1067438 - protein, 9 aa, Homo Sapiens
LLDVRAWLE

SEQ ID NO: 1067439 - protein, 9 aa, Homo Sapiens
RLDIFPVVC

SEQ ID NO: 1067440 - protein, 9 aa, Homo Sapiens
FFIYLRPTA

SEQ ID NO: 1067441 - protein, 9 aa, Homo Sapiens
KAREKNPGQ

SEQ ID NO: 1067442 - protein, 9 aa, Homo Sapiens
GATSSSLEN

SEQ ID NO: 1067443 - protein, 9 aa, Homo Sapiens
FPGTSSAVL

SEQ ID NO: 1067444 - protein, 9 aa, Homo Sapiens
MAVYVEGKT

SEQ ID NO: 1067445 - protein, 9 aa, Homo Sapiens
GLTQVPGNP

SEQ ID NO: 1067446 - protein, 9 aa, Homo Sapiens
KNSLEDFFS

SEQ ID NO: 1067447 - protein, 9 aa, Homo Sapiens
RNQAGEIQV

SEQ ID NO: 1067448 - protein, 9 aa, Homo Sapiens
EFFLLEAQN

SEQ ID NO: 1067449 - protein, 9 aa, Homo Sapiens
VHRVFFRRR

SEQ ID NO: 1067450 - protein, 9 aa, Homo Sapiens
NPLRYSVLI

SEQ ID NO: 1067451 - protein, 9 aa, Homo Sapiens
YCTNLPPTS

SEQ ID NO: 1067452 - protein, 9 aa, Homo Sapiens
AEEKLCRLK

SEQ ID NO: 1067453 - protein, 9 aa, Homo Sapiens
YSVSEAAKH

SEQ ID NO: 1067454 - protein, 9 aa, Homo Sapiens
WVCYREGQV

SEQ ID NO: 1067455 - protein, 9 aa, Homo Sapiens
LGVWKLASM

SEQ ID NO: 1067456 - protein, 9 aa, Homo Sapiens
GYVDNPNKT

SEQ ID NO: 1067457 - protein, 9 aa, Homo Sapiens
RRAFATCFR

SEQ ID NO: 1067458 - protein, 9 aa, Homo Sapiens
KKKNLYLSC

SEQ ID NO: 1067459 - protein, 9 aa, Homo Sapiens
FFSQKGTLT

SEQ ID NO: 1067460 - protein, 9 aa, Homo Sapiens
NSSTAFQPL

SEQ ID NO: 1067461 - protein, 9 aa, Homo Sapiens
TLGKEERKT

SEQ ID NO: 1067462 - protein, 9 aa, Homo Sapiens
QSLSTTGGS

SEQ ID NO: 1067463 - protein, 9 aa, Homo Sapiens
SVGLEPISP

SEQ ID NO: 1067464 - protein, 9 aa, Homo Sapiens
LVQKHLTTP

SEQ ID NO: 1067465 - protein, 9 aa, Homo Sapiens
EKWVYVNEP

SEQ ID NO: 1067466 - protein, 9 aa, Homo Sapiens
SAPPGLQAS

SEQ ID NO: 1067467 - protein, 9 aa, Homo Sapiens
RIVDGYEQA

SEQ ID NO: 1067468 - protein, 9 aa, Homo Sapiens
WGEGDLGRL

SEQ ID NO: 1067469 - protein, 9 aa, Homo Sapiens
PVPPSKKPE

SEQ ID NO: 1067470 - protein, 9 aa, Homo Sapiens
FFTWDINDE

SEQ ID NO: 1067471 - protein, 9 aa, Homo Sapiens
VCWDLMDQI

SEQ ID NO: 1067472 - protein, 9 aa, Homo Sapiens
LPESQVLLT

SEQ ID NO: 1067473 - protein, 9 aa, Homo Sapiens
IQLLKLHQQ

SEQ ID NO: 1067474 - protein, 9 aa, Homo Sapiens
TDPALSTPA

SEQ ID NO: 1067475 - protein, 9 aa, Homo Sapiens
LKINENADG

SEQ ID NO: 1067476 - protein, 9 aa, Homo Sapiens
TQLQLEVEE

SEQ ID NO: 1067477 - protein, 9 aa, Homo Sapiens
LGPSSCMQL

SEQ ID NO: 1067478 - protein, 9 aa, Homo Sapiens
PAQVSPCSN

SEQ ID NO: 1067479 - protein, 9 aa, Homo Sapiens
KEFQKTKDE

SEQ ID NO: 1067480 - protein, 9 aa, Homo Sapiens
DRMKCESPE

SEQ ID NO: 1067481 - protein, 9 aa, Homo Sapiens
IYPKTGLLI

SEQ ID NO: 1067482 - protein, 9 aa, Homo Sapiens
PVSPFHGGQ

SEQ ID NO: 1067483 - protein, 9 aa, Homo Sapiens
GQSLRQRFN

SEQ ID NO: 1067484 - protein, 9 aa, Homo Sapiens
EKNPGQVHP

SEQ ID NO: 1067485 - protein, 9 aa, Homo Sapiens
GYAHRQSYG

SEQ ID NO: 1067486 - protein, 9 aa, Homo Sapiens
IHPIRIVDG

SEQ ID NO: 1067487 - protein, 9 aa, Homo Sapiens
PHSLEILYQ

SEQ ID NO: 1067488 - protein, 9 aa, Homo Sapiens
FNMTLVSSS

SEQ ID NO: 1067489 - protein, 9 aa, Homo Sapiens
NSVRKFLFL

SEQ ID NO: 1067490 - protein, 9 aa, Homo Sapiens
GINFVKRKI

SEQ ID NO: 1067491 - protein, 9 aa, Homo Sapiens
DVDIACRSI

SEQ ID NO: 1067492 - protein, 9 aa, Homo Sapiens
KSKSPSLLK

SEQ ID NO: 1067493 - protein, 9 aa, Homo Sapiens
ITGDTLRFW

SEQ ID NO: 1067494 - protein, 9 aa, Homo Sapiens
GFEPGFMMT

SEQ ID NO: 1067495 - protein, 9 aa, Homo Sapiens
KGLNSFERD

SEQ ID NO: 1067496 - protein, 9 aa, Homo Sapiens
HFVCSGEGI

SEQ ID NO: 1067497 - protein, 9 aa, Homo Sapiens
LLAECPSCR

SEQ ID NO: 1067498 - protein, 9 aa, Homo Sapiens
VSIPWVSGT

SEQ ID NO: 1067499 - protein, 9 aa, Homo Sapiens
SGLMQPPYE

SEQ ID NO: 1067500 - protein, 9 aa, Homo Sapiens
AAKAIILKQ

SEQ ID NO: 1067501 - protein, 9 aa, Homo Sapiens
KRVYMTWVQ

SEQ ID NO: 1067502 - protein, 9 aa, Homo Sapiens
LPQPRTLPS

SEQ ID NO: 1067503 - protein, 9 aa, Homo Sapiens
NRDLAARNI

SEQ ID NO: 1067504 - protein, 9 aa, Homo Sapiens
LTSFLKSVE

SEQ ID NO: 1067505 - protein, 9 aa, Homo Sapiens
AKYFPYLVF

SEQ ID NO: 1067506 - protein, 9 aa, Homo Sapiens
LVVQNEEIT

SEQ ID NO: 1067507 - protein, 9 aa, Homo Sapiens
LKPALEPRR

SEQ ID NO: 1067508 - protein, 9 aa, Homo Sapiens
REQAYHWYC

SEQ ID NO: 1067509 - protein, 9 aa, Homo Sapiens
PQTWLSFQG

SEQ ID NO: 1067510 - protein, 9 aa, Homo Sapiens
HHPFQGFRF

SEQ ID NO: 1067511 - protein, 9 aa, Homo Sapiens
NFSSGNFAK

SEQ ID NO: 1067512 - protein, 9 aa, Homo Sapiens
PELQPLPAS

SEQ ID NO: 1067513 - protein, 9 aa, Homo Sapiens
DFSKPFISL

SEQ ID NO: 1067514 - protein, 9 aa, Homo Sapiens
LLTFFCVCT

SEQ ID NO: 1067515 - protein, 9 aa, Homo Sapiens
PDQSFENSD

SEQ ID NO: 1067516 - protein, 9 aa, Homo Sapiens
YLSKLQELW

SEQ ID NO: 1067517 - protein, 9 aa, Homo Sapiens
DCGGDALNH

SEQ ID NO: 1067518 - protein, 9 aa, Homo Sapiens
KHEPGHETP

SEQ ID NO: 1067519 - protein, 9 aa, Homo Sapiens
IPESSGCLE

SEQ ID NO: 1067520 - protein, 9 aa, Homo Sapiens
ISLEPGDRD

SEQ ID NO: 1067521 - protein, 9 aa, Homo Sapiens
PPEDPRLFF

SEQ ID NO: 1067522 - protein, 9 aa, Homo Sapiens
SRVTSVLAG

SEQ ID NO: 1067523 - protein, 9 aa, Homo Sapiens
QTRKGPPVS

SEQ ID NO: 1067524 - protein, 9 aa, Homo Sapiens
APNLPVSLP

SEQ ID NO: 1067525 - protein, 9 aa, Homo Sapiens
GSENKKADV

SEQ ID NO: 1067526 - protein, 9 aa, Homo Sapiens
SNFGMSRVL

SEQ ID NO: 1067527 - protein, 9 aa, Homo Sapiens
MVALNVEFY

SEQ ID NO: 1067528 - protein, 9 aa, Homo Sapiens
LATKAPRLL

SEQ ID NO: 1067529 - protein, 9 aa, Homo Sapiens
LQPPYSPGP

SEQ ID NO: 1067530 - protein, 9 aa, Homo Sapiens
NKEFDKDYQ

SEQ ID NO: 1067531 - protein, 9 aa, Homo Sapiens
LAYNKITKE

SEQ ID NO: 1067532 - protein, 9 aa, Homo Sapiens
YFPVILKKA

SEQ ID NO: 1067533 - protein, 9 aa, Homo Sapiens
FIASIAVVS

SEQ ID NO: 1067534 - protein, 9 aa, Homo Sapiens
SRDRLDCGR

SEQ ID NO: 1067535 - protein, 9 aa, Homo Sapiens
VQAKICKMK

SEQ ID NO: 1067536 - protein, 9 aa, Homo Sapiens
RLQSEMNLQ

SEQ ID NO: 1067537 - protein, 9 aa, Homo Sapiens
AAKTYGRNK

SEQ ID NO: 1067538 - protein, 9 aa, Homo Sapiens
EFLSIPASL

SEQ ID NO: 1067539 - protein, 9 aa, Homo Sapiens
SIVPFMRQN

SEQ ID NO: 1067540 - protein, 9 aa, Homo Sapiens
LTQEFFRHN

SEQ ID NO: 1067541 - protein, 9 aa, Homo Sapiens
NLVFILDGS

SEQ ID NO: 1067542 - protein, 9 aa, Homo Sapiens
PAQNWTLPQ

SEQ ID NO: 1067543 - protein, 9 aa, Homo Sapiens
LTTPSSTAK

SEQ ID NO: 1067544 - protein, 9 aa, Homo Sapiens
EALCQLQKE

SEQ ID NO: 1067545 - protein, 9 aa, Homo Sapiens
LKNFWWLAV

SEQ ID NO: 1067546 - protein, 9 aa, Homo Sapiens
YLKALVFVG

SEQ ID NO: 1067547 - protein, 9 aa, Homo Sapiens
RAGALVVWS

SEQ ID NO: 1067548 - protein, 9 aa, Homo Sapiens
ENLKRLKDS

SEQ ID NO: 1067549 - protein, 9 aa, Homo Sapiens
FYLLCVPDK

SEQ ID NO: 1067550 - protein, 9 aa, Homo Sapiens
RFSLFLHSE

SEQ ID NO: 1067551 - protein, 9 aa, Homo Sapiens
VPFLLILIF

SEQ ID NO: 1067552 - protein, 9 aa, Homo Sapiens
ATWEAMETC

SEQ ID NO: 1067553 - protein, 9 aa, Homo Sapiens
DSQKSPICL

SEQ ID NO: 1067554 - protein, 9 aa, Homo Sapiens
DELDELFSS

SEQ ID NO: 1067555 - protein, 9 aa, Homo Sapiens
SYTNTPVSA

SEQ ID NO: 1067556 - protein, 9 aa, Homo Sapiens
EQDKEGADE

SEQ ID NO: 1067557 - protein, 9 aa, Homo Sapiens
TCATPSNAR

SEQ ID NO: 1067558 - protein, 9 aa, Homo Sapiens
LPQEKKAKI

SEQ ID NO: 1067559 - protein, 9 aa, Homo Sapiens
KLQMRVLAV

SEQ ID NO: 1067560 - protein, 9 aa, Homo Sapiens
CHEENDPET

SEQ ID NO: 1067561 - protein, 9 aa, Homo Sapiens
HIDPRQKEE

SEQ ID NO: 1067562 - protein, 9 aa, Homo Sapiens
KDYFRLLFQ

SEQ ID NO: 1067563 - protein, 9 aa, Homo Sapiens
TLYQFKKNP

SEQ ID NO: 1067564 - protein, 9 aa, Homo Sapiens
RTLNCSGEH

SEQ ID NO: 1067565 - protein, 9 aa, Homo Sapiens
ADIPWDISV

SEQ ID NO: 1067566 - protein, 9 aa, Homo Sapiens
SRQVPGMCF

SEQ ID NO: 1067567 - protein, 9 aa, Homo Sapiens
GPSSLPGFS

SEQ ID NO: 1067568 - protein, 9 aa, Homo Sapiens
ENFPDYCIR

SEQ ID NO: 1067569 - protein, 9 aa, Homo Sapiens
GSKQSTPKQ

SEQ ID NO: 1067570 - protein, 9 aa, Homo Sapiens
HWPNPETFN

SEQ ID NO: 1067571 - protein, 9 aa, Homo Sapiens
PLLNRPFDE

SEQ ID NO: 1067572 - protein, 9 aa, Homo Sapiens
TRVLGVKNL

SEQ ID NO: 1067573 - protein, 9 aa, Homo Sapiens
EINYLNKVL

SEQ ID NO: 1067574 - protein, 9 aa, Homo Sapiens
CLGLVPRED

SEQ ID NO: 1067575 - protein, 9 aa, Homo Sapiens
VDGEWRRLP

SEQ ID NO: 1067576 - protein, 9 aa, Homo Sapiens
SRVTLLANL

SEQ ID NO: 1067577 - protein, 9 aa, Homo Sapiens
CDVNKDEKI

SEQ ID NO: 1067578 - protein, 9 aa, Homo Sapiens
LGDLLGSMT

SEQ ID NO: 1067579 - protein, 9 aa, Homo Sapiens
KNGMLAEKG

SEQ ID NO: 1067580 - protein, 9 aa, Homo Sapiens
RNEKQTSSL

SEQ ID NO: 1067581 - protein, 9 aa, Homo Sapiens
EEEITTSKQ

SEQ ID NO: 1067582 - protein, 9 aa, Homo Sapiens
LLRMNSTTS

SEQ ID NO: 1067583 - protein, 9 aa, Homo Sapiens
NIVTANFVE

SEQ ID NO: 1067584 - protein, 9 aa, Homo Sapiens
FCDLSRFIK

SEQ ID NO: 1067585 - protein, 9 aa, Homo Sapiens
PSFLRLHLR

SEQ ID NO: 1067586 - protein, 9 aa, Homo Sapiens
HRVFFRRRS

SEQ ID NO: 1067587 - protein, 9 aa, Homo Sapiens
MYVLYADRE

SEQ ID NO: 1067588 - protein, 9 aa, Homo Sapiens
LVFTAFDGG

SEQ ID NO: 1067589 - protein, 9 aa, Homo Sapiens
SDINQLYHI

SEQ ID NO: 1067590 - protein, 9 aa, Homo Sapiens
YHPIDYYWW

SEQ ID NO: 1067591 - protein, 9 aa, Homo Sapiens
LPLLLPGRL

SEQ ID NO: 1067592 - protein, 9 aa, Homo Sapiens
FLCQKWNDP

SEQ ID NO: 1067593 - protein, 9 aa, Homo Sapiens
EDEEPPRQA

SEQ ID NO: 1067594 - protein, 9 aa, Homo Sapiens
YLRFSDTYL

SEQ ID NO: 1067595 - protein, 9 aa, Homo Sapiens
RFCSLHSTF

SEQ ID NO: 1067596 - protein, 9 aa, Homo Sapiens
DGFMAQKKR

SEQ ID NO: 1067597 - protein, 9 aa, Homo Sapiens
IIHSLIKSD

SEQ ID NO: 1067598 - protein, 9 aa, Homo Sapiens
FKQEMATAA

SEQ ID NO: 1067599 - protein, 9 aa, Homo Sapiens
ICKVLDANS

SEQ ID NO: 1067600 - protein, 9 aa, Homo Sapiens
NSNSQISCT

SEQ ID NO: 1067601 - protein, 9 aa, Homo Sapiens
LLLDDYVVP

SEQ ID NO: 1067602 - protein, 9 aa, Homo Sapiens
EEFQKEVSF

SEQ ID NO: 1067603 - protein, 9 aa, Homo Sapiens
KLAEKQEDK

SEQ ID NO: 1067604 - protein, 9 aa, Homo Sapiens
PGHSPQIIF

SEQ ID NO: 1067605 - protein, 9 aa, Homo Sapiens
DENYLMLII

SEQ ID NO: 1067606 - protein, 9 aa, Homo Sapiens
FLSEATVTL

SEQ ID NO: 1067607 - protein, 9 aa, Homo Sapiens
DALVKKKKL

SEQ ID NO: 1067608 - protein, 9 aa, Homo Sapiens
RETVFSYLE

SEQ ID NO: 1067609 - protein, 9 aa, Homo Sapiens
GHFSPLKIW

SEQ ID NO: 1067610 - protein, 9 aa, Homo Sapiens
QYKGHVNNS

SEQ ID NO: 1067611 - protein, 9 aa, Homo Sapiens
LTKKIQLTP

SEQ ID NO: 1067612 - protein, 9 aa, Homo Sapiens
SDNECKKSE

SEQ ID NO: 1067613 - protein, 9 aa, Homo Sapiens
FSPGHVIVE

SEQ ID NO: 1067614 - protein, 9 aa, Homo Sapiens
ILVPPRGLG

SEQ ID NO: 1067615 - protein, 9 aa, Homo Sapiens
LLGAGTKTT

SEQ ID NO: 1067616 - protein, 9 aa, Homo Sapiens
ASEEVSNSL

SEQ ID NO: 1067617 - protein, 9 aa, Homo Sapiens
DLIDEDILY

SEQ ID NO: 1067618 - protein, 9 aa, Homo Sapiens
IIDEPVSAA

SEQ ID NO: 1067619 - protein, 9 aa, Homo Sapiens
GRGGYISKT

SEQ ID NO: 1067620 - protein, 9 aa, Homo Sapiens
VPFVVPPTF

SEQ ID NO: 1067621 - protein, 9 aa, Homo Sapiens
QYFLDQFYM

SEQ ID NO: 1067622 - protein, 9 aa, Homo Sapiens
PQERKNARS

SEQ ID NO: 1067623 - protein, 9 aa, Homo Sapiens
LPAYKFKKY

SEQ ID NO: 1067624 - protein, 9 aa, Homo Sapiens
VTIKDSVFK

SEQ ID NO: 1067625 - protein, 9 aa, Homo Sapiens
HQDRLLELL

SEQ ID NO: 1067626 - protein, 9 aa, Homo Sapiens
QESKYQLVL

SEQ ID NO: 1067627 - protein, 9 aa, Homo Sapiens
KSVHCGPMF

SEQ ID NO: 1067628 - protein, 9 aa, Homo Sapiens
RDPRAGSTP

SEQ ID NO: 1067629 - protein, 9 aa, Homo Sapiens
TDWLFPKRC

SEQ ID NO: 1067630 - protein, 9 aa, Homo Sapiens
PILKHMLVD

SEQ ID NO: 1067631 - protein, 9 aa, Homo Sapiens
LPIPGDGSC

SEQ ID NO: 1067632 - protein, 9 aa, Homo Sapiens
GSPVVTHDF

SEQ ID NO: 1067633 - protein, 9 aa, Homo Sapiens
SSCDTQAVL

SEQ ID NO: 1067634 - protein, 9 aa, Homo Sapiens
PEIDFRGGP

SEQ ID NO: 1067635 - protein, 9 aa, Homo Sapiens
TYSTIEPKP

SEQ ID NO: 1067636 - protein, 9 aa, Homo Sapiens
LQFPFKELE

SEQ ID NO: 1067637 - protein, 9 aa, Homo Sapiens
TFVENHKRT

SEQ ID NO: 1067638 - protein, 9 aa, Homo Sapiens
FQPPSKPIR

SEQ ID NO: 1067639 - protein, 9 aa, Homo Sapiens
FTEPEKLLD

SEQ ID NO: 1067640 - protein, 9 aa, Homo Sapiens
HSGGNSDSR

SEQ ID NO: 1067641 - protein, 9 aa, Homo Sapiens
TQQDCSQCQ

SEQ ID NO: 1067642 - protein, 9 aa, Homo Sapiens
ISCCKPASN

SEQ ID NO: 1067643 - protein, 9 aa, Homo Sapiens
GVLTFRNVA

SEQ ID NO: 1067644 - protein, 9 aa, Homo Sapiens
APEENSRKM

SEQ ID NO: 1067645 - protein, 9 aa, Homo Sapiens
VFTAFDGGD

SEQ ID NO: 1067646 - protein, 9 aa, Homo Sapiens
KLAKLSDFE

SEQ ID NO: 1067647 - protein, 9 aa, Homo Sapiens
GRPRQARWI

SEQ ID NO: 1067648 - protein, 9 aa, Homo Sapiens
WCCHDGHYF

SEQ ID NO: 1067649 - protein, 9 aa, Homo Sapiens
TLICQVLDA

SEQ ID NO: 1067650 - protein, 9 aa, Homo Sapiens
SNMWKKSKI

SEQ ID NO: 1067651 - protein, 9 aa, Homo Sapiens
VAMSWVFFW

SEQ ID NO: 1067652 - protein, 9 aa, Homo Sapiens
KIFKTSYLE

SEQ ID NO: 1067653 - protein, 9 aa, Homo Sapiens
SSFQESTAG

SEQ ID NO: 1067654 - protein, 9 aa, Homo Sapiens
EIAYNAIFF

SEQ ID NO: 1067655 - protein, 9 aa, Homo Sapiens
LGTFALIGA

SEQ ID NO: 1067656 - protein, 9 aa, Homo Sapiens
IVFCTPVHL

SEQ ID NO: 1067657 - protein, 9 aa, Homo Sapiens
LSLLILSCN

SEQ ID NO: 1067658 - protein, 9 aa, Homo Sapiens
KKSQKESVL

SEQ ID NO: 1067659 - protein, 9 aa, Homo Sapiens
VVSTGLCKL

SEQ ID NO: 1067660 - protein, 9 aa, Homo Sapiens
DFNFWLDSK

SEQ ID NO: 1067661 - protein, 9 aa, Homo Sapiens
TPQPFCNGD

SEQ ID NO: 1067662 - protein, 9 aa, Homo Sapiens
PGEGFRCLC

SEQ ID NO: 1067663 - protein, 9 aa, Homo Sapiens
SNRSSHLTT

SEQ ID NO: 1067664 - protein, 9 aa, Homo Sapiens
TSTLPREVR

SEQ ID NO: 1067665 - protein, 9 aa, Homo Sapiens
DKPLISRTK

SEQ ID NO: 1067666 - protein, 9 aa, Homo Sapiens
TVRGRPAQI

SEQ ID NO: 1067667 - protein, 9 aa, Homo Sapiens
WPGVLPAGG

SEQ ID NO: 1067668 - protein, 9 aa, Homo Sapiens
NKTENENED

SEQ ID NO: 1067669 - protein, 9 aa, Homo Sapiens
NGYCPNYPV

SEQ ID NO: 1067670 - protein, 9 aa, Homo Sapiens
QEKIPKLRR

SEQ ID NO: 1067671 - protein, 9 aa, Homo Sapiens
SQREDDIAK

SEQ ID NO: 1067672 - protein, 9 aa, Homo Sapiens
NITISQNNL

SEQ ID NO: 1067673 - protein, 9 aa, Homo Sapiens
AATPGGLYV

SEQ ID NO: 1067674 - protein, 9 aa, Homo Sapiens
IFKKSASLM

SEQ ID NO: 1067675 - protein, 9 aa, Homo Sapiens
NKGARQEGG

SEQ ID NO: 1067676 - protein, 9 aa, Homo Sapiens
ASPALSTSS

SEQ ID NO: 1067677 - protein, 9 aa, Homo Sapiens
GEIIEVKDA

SEQ ID NO: 1067678 - protein, 9 aa, Homo Sapiens
HNDLTQYVI

SEQ ID NO: 1067679 - protein, 9 aa, Homo Sapiens
KDLYRELLD

SEQ ID NO: 1067680 - protein, 9 aa, Homo Sapiens
DLKTDYIFS

SEQ ID NO: 1067681 - protein, 9 aa, Homo Sapiens
LKFPIYFQG

SEQ ID NO: 1067682 - protein, 9 aa, Homo Sapiens
STDKEDGVQ

SEQ ID NO: 1067683 - protein, 9 aa, Homo Sapiens
IKDSPHTIP

SEQ ID NO: 1067684 - protein, 9 aa, Homo Sapiens
ASGPEGNVQ

SEQ ID NO: 1067685 - protein, 9 aa, Homo Sapiens
REQRFYKSL

SEQ ID NO: 1067686 - protein, 9 aa, Homo Sapiens
LFHTVIFSL

SEQ ID NO: 1067687 - protein, 9 aa, Homo Sapiens
LLGVLKELR

SEQ ID NO: 1067688 - protein, 9 aa, Homo Sapiens
SFLSGCCQH

SEQ ID NO: 1067689 - protein, 9 aa, Homo Sapiens
IAKLSCENI

SEQ ID NO: 1067690 - protein, 9 aa, Homo Sapiens
PGPVSQAFP

SEQ ID NO: 1067691 - protein, 9 aa, Homo Sapiens
TYSRKFAKE

SEQ ID NO: 1067692 - protein, 9 aa, Homo Sapiens
LQEKGLAWE

SEQ ID NO: 1067693 - protein, 9 aa, Homo Sapiens
FLAFMAYDR

SEQ ID NO: 1067694 - protein, 9 aa, Homo Sapiens
SFINEVCME

SEQ ID NO: 1067695 - protein, 9 aa, Homo Sapiens
KENLFIGVE

SEQ ID NO: 1067696 - protein, 9 aa, Homo Sapiens
MYQCGPASV

SEQ ID NO: 1067697 - protein, 9 aa, Homo Sapiens
SNVTMVNFT

SEQ ID NO: 1067698 - protein, 9 aa, Homo Sapiens
IPGDGSCQW

SEQ ID NO: 1067699 - protein, 9 aa, Homo Sapiens
WRMYDVLVL

SEQ ID NO: 1067700 - protein, 9 aa, Homo Sapiens
LPNRGRPTV

SEQ ID NO: 1067701 - protein, 9 aa, Homo Sapiens
PPKCLPKCP

SEQ ID NO: 1067702 - protein, 9 aa, Homo Sapiens
HLSVPKSTN

SEQ ID NO: 1067703 - protein, 9 aa, Homo Sapiens
STFHSKSTF

SEQ ID NO: 1067704 - protein, 9 aa, Homo Sapiens
MLVFPVFGV

SEQ ID NO: 1067705 - protein, 9 aa, Homo Sapiens
KNKNGSWGP

SEQ ID NO: 1067706 - protein, 9 aa, Homo Sapiens
IPTKLLGCV

SEQ ID NO: 1067707 - protein, 9 aa, Homo Sapiens
SRLSKASSQ

SEQ ID NO: 1067708 - protein, 9 aa, Homo Sapiens
GRLCAAALF

SEQ ID NO: 1067709 - protein, 9 aa, Homo Sapiens
AKMPGMNSV

SEQ ID NO: 1067710 - protein, 9 aa, Homo Sapiens
VPLPADGLE

SEQ ID NO: 1067711 - protein, 9 aa, Homo Sapiens
ILGPAPIPG

SEQ ID NO: 1067712 - protein, 9 aa, Homo Sapiens
SRLLAYLPK

SEQ ID NO: 1067713 - protein, 9 aa, Homo Sapiens
TEGGHFLLH

SEQ ID NO: 1067714 - protein, 9 aa, Homo Sapiens
AYNRFIAIC

SEQ ID NO: 1067715 - protein, 9 aa, Homo Sapiens
GVPGERREK

SEQ ID NO: 1067716 - protein, 9 aa, Homo Sapiens
EVREKGYEQ

SEQ ID NO: 1067717 - protein, 9 aa, Homo Sapiens
KKMELLIMT

SEQ ID NO: 1067718 - protein, 9 aa, Homo Sapiens
KGFNCGAHL

SEQ ID NO: 1067719 - protein, 9 aa, Homo Sapiens
VAAVPSLIP

SEQ ID NO: 1067720 - protein, 9 aa, Homo Sapiens
ADQCCPEYK

SEQ ID NO: 1067721 - protein, 9 aa, Homo Sapiens
QSSCCRPCC

SEQ ID NO: 1067722 - protein, 9 aa, Homo Sapiens
TNKRASQAG

SEQ ID NO: 1067723 - protein, 9 aa, Homo Sapiens
KGKLLLFSS

SEQ ID NO: 1067724 - protein, 9 aa, Homo Sapiens
YLKENIGGE

SEQ ID NO: 1067725 - protein, 9 aa, Homo Sapiens
KNLLRSPFI

SEQ ID NO: 1067726 - protein, 9 aa, Homo Sapiens
KKTAAILLQ

SEQ ID NO: 1067727 - protein, 9 aa, Homo Sapiens
VPPGAGPSG

SEQ ID NO: 1067728 - protein, 9 aa, Homo Sapiens
AVFYSCKAD

SEQ ID NO: 1067729 - protein, 9 aa, Homo Sapiens
FSYPCRRYS

SEQ ID NO: 1067730 - protein, 9 aa, Homo Sapiens
RSSVSSSSD

SEQ ID NO: 1067731 - protein, 9 aa, Homo Sapiens
RKTEATRGR

SEQ ID NO: 1067732 - protein, 9 aa, Homo Sapiens
CIACTLCEA

SEQ ID NO: 1067733 - protein, 9 aa, Homo Sapiens
RRAQESPKS

SEQ ID NO: 1067734 - protein, 9 aa, Homo Sapiens
GNNTHNNYE

SEQ ID NO: 1067735 - protein, 9 aa, Homo Sapiens
AFSEASFLE

SEQ ID NO: 1067736 - protein, 9 aa, Homo Sapiens
LERLALSPE

SEQ ID NO: 1067737 - protein, 9 aa, Homo Sapiens
VNPGLDEPP

SEQ ID NO: 1067738 - protein, 9 aa, Homo Sapiens
EEFLAEDWA

SEQ ID NO: 1067739 - protein, 9 aa, Homo Sapiens
ALTLSFGSS

SEQ ID NO: 1067740 - protein, 9 aa, Homo Sapiens
DFFLFKVAF

SEQ ID NO: 1067741 - protein, 9 aa, Homo Sapiens
QNGEQDKEG

SEQ ID NO: 1067742 - protein, 9 aa, Homo Sapiens
VSFQQCLSG

SEQ ID NO: 1067743 - protein, 9 aa, Homo Sapiens
SVSSLFLFL

SEQ ID NO: 1067744 - protein, 9 aa, Homo Sapiens
CQQIFMKNH

SEQ ID NO: 1067745 - protein, 9 aa, Homo Sapiens
GDIWLLADD

SEQ ID NO: 1067746 - protein, 9 aa, Homo Sapiens
EIFKFTTQK

SEQ ID NO: 1067747 - protein, 9 aa, Homo Sapiens
VVQNEEITA

SEQ ID NO: 1067748 - protein, 9 aa, Homo Sapiens
HVFHHGTGK

SEQ ID NO: 1067749 - protein, 9 aa, Homo Sapiens
GELFDRIIN

SEQ ID NO: 1067750 - protein, 9 aa, Homo Sapiens
ICLTHLSET

SEQ ID NO: 1067751 - protein, 9 aa, Homo Sapiens
KLLDKELDT

SEQ ID NO: 1067752 - protein, 9 aa, Homo Sapiens
YNYYETDES

SEQ ID NO: 1067753 - protein, 9 aa, Homo Sapiens
EPADRRRSA

SEQ ID NO: 1067754 - protein, 9 aa, Homo Sapiens
SIVDEHETK

SEQ ID NO: 1067755 - protein, 9 aa, Homo Sapiens
FSDYLELHI

SEQ ID NO: 1067756 - protein, 9 aa, Homo Sapiens
AELPRGSIL

SEQ ID NO: 1067757 - protein, 9 aa, Homo Sapiens
EKEGGIEFS

SEQ ID NO: 1067758 - protein, 9 aa, Homo Sapiens
HFCPLPGSS

SEQ ID NO: 1067759 - protein, 9 aa, Homo Sapiens
VVQWYKHGS

SEQ ID NO: 1067760 - protein, 9 aa, Homo Sapiens
HDPYRQQSL

SEQ ID NO: 1067761 - protein, 9 aa, Homo Sapiens
KRKGINVWK

SEQ ID NO: 1067762 - protein, 9 aa, Homo Sapiens
VLSILQSVS

SEQ ID NO: 1067763 - protein, 9 aa, Homo Sapiens
NPGPLYPAR

SEQ ID NO: 1067764 - protein, 9 aa, Homo Sapiens
YFSFDYQNC

SEQ ID NO: 1067765 - protein, 9 aa, Homo Sapiens
SDENHCPLS

SEQ ID NO: 1067766 - protein, 9 aa, Homo Sapiens
LITPARQRP

SEQ ID NO: 1067767 - protein, 9 aa, Homo Sapiens
NCLPVSNGP

SEQ ID NO: 1067768 - protein, 9 aa, Homo Sapiens
FALEFLIIS

SEQ ID NO: 1067769 - protein, 9 aa, Homo Sapiens
DVRIDTILI

SEQ ID NO: 1067770 - protein, 9 aa, Homo Sapiens
CRFNQEEGA

SEQ ID NO: 1067771 - protein, 9 aa, Homo Sapiens
PRHSSTRFH

SEQ ID NO: 1067772 - protein, 9 aa, Homo Sapiens
SGKPRVGKK

SEQ ID NO: 1067773 - protein, 9 aa, Homo Sapiens
YCKAFDVEP

SEQ ID NO: 1067774 - protein, 9 aa, Homo Sapiens
GVCYPVLTP

SEQ ID NO: 1067775 - protein, 9 aa, Homo Sapiens
KFLPISGMK

SEQ ID NO: 1067776 - protein, 9 aa, Homo Sapiens
NFSALLSTG

SEQ ID NO: 1067777 - protein, 9 aa, Homo Sapiens
TPSTAAPAV

SEQ ID NO: 1067778 - protein, 9 aa, Homo Sapiens
SLDTFQQMW

SEQ ID NO: 1067779 - protein, 9 aa, Homo Sapiens
RPGPLGSSG

SEQ ID NO: 1067780 - protein, 9 aa, Homo Sapiens
HGADYELLI

SEQ ID NO: 1067781 - protein, 9 aa, Homo Sapiens
HVRMKGLNS

SEQ ID NO: 1067782 - protein, 9 aa, Homo Sapiens
LRVNEYCFA

SEQ ID NO: 1067783 - protein, 9 aa, Homo Sapiens
LVLDEGAEK

SEQ ID NO: 1067784 - protein, 9 aa, Homo Sapiens
CLEKWLNRN

SEQ ID NO: 1067785 - protein, 9 aa, Homo Sapiens
HKEQFSDRK

SEQ ID NO: 1067786 - protein, 9 aa, Homo Sapiens
SDQNTIHKN

SEQ ID NO: 1067787 - protein, 9 aa, Homo Sapiens
RPQGLGRSC

SEQ ID NO: 1067788 - protein, 9 aa, Homo Sapiens
RIENIYFRH

SEQ ID NO: 1067789 - protein, 9 aa, Homo Sapiens
EVDVFLGTV

SEQ ID NO: 1067790 - protein, 9 aa, Homo Sapiens
QTFLCFSES

SEQ ID NO: 1067791 - protein, 9 aa, Homo Sapiens
QLLRTLRST

SEQ ID NO: 1067792 - protein, 9 aa, Homo Sapiens
CLSFINEVC

SEQ ID NO: 1067793 - protein, 9 aa, Homo Sapiens
SGIWSNPSL

SEQ ID NO: 1067794 - protein, 9 aa, Homo Sapiens
FVFTRLDGF

SEQ ID NO: 1067795 - protein, 9 aa, Homo Sapiens
YDFQFCGNK

SEQ ID NO: 1067796 - protein, 9 aa, Homo Sapiens
TLTPSPLEE

SEQ ID NO: 1067797 - protein, 9 aa, Homo Sapiens
VVKVSARNL

SEQ ID NO: 1067798 - protein, 9 aa, Homo Sapiens
LDFKQEMAT

SEQ ID NO: 1067799 - protein, 9 aa, Homo Sapiens
NQIYPKTGL

SEQ ID NO: 1067800 - protein, 9 aa, Homo Sapiens
HSDVSSQKN

SEQ ID NO: 1067801 - protein, 9 aa, Homo Sapiens
DRKVCNDQN

SEQ ID NO: 1067802 - protein, 9 aa, Homo Sapiens
KNTVCQFTT

SEQ ID NO: 1067803 - protein, 9 aa, Homo Sapiens
TTHMCCPSR

SEQ ID NO: 1067804 - protein, 9 aa, Homo Sapiens
RGRLEEPVS

SEQ ID NO: 1067805 - protein, 9 aa, Homo Sapiens
TVDLFSDDD

SEQ ID NO: 1067806 - protein, 9 aa, Homo Sapiens
NMYEVQSKK

SEQ ID NO: 1067807 - protein, 9 aa, Homo Sapiens
YRILLETKK

SEQ ID NO: 1067808 - protein, 9 aa, Homo Sapiens
DYSVGNLSF

SEQ ID NO: 1067809 - protein, 9 aa, Homo Sapiens
TYKNKEDKL

SEQ ID NO: 1067810 - protein, 9 aa, Homo Sapiens
QGLSRPLPS

SEQ ID NO: 1067811 - protein, 9 aa, Homo Sapiens
RQVEINLKQ

SEQ ID NO: 1067812 - protein, 9 aa, Homo Sapiens
LKQNFRDLV

SEQ ID NO: 1067813 - protein, 9 aa, Homo Sapiens
LSQRMLFNH

SEQ ID NO: 1067814 - protein, 9 aa, Homo Sapiens
PNSNLNVSK

SEQ ID NO: 1067815 - protein, 9 aa, Homo Sapiens
SKNSDIKQS

SEQ ID NO: 1067816 - protein, 9 aa, Homo Sapiens
FFGIVVTKP

SEQ ID NO: 1067817 - protein, 9 aa, Homo Sapiens
TGDTLRFWQ

SEQ ID NO: 1067818 - protein, 9 aa, Homo Sapiens
NLIVREHGI

SEQ ID NO: 1067819 - protein, 9 aa, Homo Sapiens
ETCKETFNL

SEQ ID NO: 1067820 - protein, 9 aa, Homo Sapiens
QGFPFFLRN

SEQ ID NO: 1067821 - protein, 9 aa, Homo Sapiens
FCLKRETGE

SEQ ID NO: 1067822 - protein, 9 aa, Homo Sapiens
TGLHYGIIF

SEQ ID NO: 1067823 - protein, 9 aa, Homo Sapiens
ILVRALCNG

SEQ ID NO: 1067824 - protein, 9 aa, Homo Sapiens
PILLVSENP

SEQ ID NO: 1067825 - protein, 9 aa, Homo Sapiens
QGPPGSPEP

SEQ ID NO: 1067826 - protein, 9 aa, Homo Sapiens
SFSIFLSNG

SEQ ID NO: 1067827 - protein, 9 aa, Homo Sapiens
IFLCQKWND

SEQ ID NO: 1067828 - protein, 9 aa, Homo Sapiens
GCVSKGLDI

SEQ ID NO: 1067829 - protein, 9 aa, Homo Sapiens
ALPGSHTEP

SEQ ID NO: 1067830 - protein, 9 aa, Homo Sapiens
YPGLGKKKE

SEQ ID NO: 1067831 - protein, 9 aa, Homo Sapiens
PAHKVTGSG

SEQ ID NO: 1067832 - protein, 9 aa, Homo Sapiens
FLMCLFCQP

SEQ ID NO: 1067833 - protein, 9 aa, Homo Sapiens
AFLGDDTLL

SEQ ID NO: 1067834 - protein, 9 aa, Homo Sapiens
KRENPNWLV

SEQ ID NO: 1067835 - protein, 9 aa, Homo Sapiens
DTAIGSLRP

SEQ ID NO: 1067836 - protein, 9 aa, Homo Sapiens
LNSEVEVHL

SEQ ID NO: 1067837 - protein, 9 aa, Homo Sapiens
MRAGPHATA

SEQ ID NO: 1067838 - protein, 9 aa, Homo Sapiens
LMTSELGDS

SEQ ID NO: 1067839 - protein, 9 aa, Homo Sapiens
HPHRHHPHA

SEQ ID NO: 1067840 - protein, 9 aa, Homo Sapiens
MVSIFCSED

SEQ ID NO: 1067841 - protein, 9 aa, Homo Sapiens
SYDLATDPL

SEQ ID NO: 1067842 - protein, 9 aa, Homo Sapiens
PLTRVPQHV

SEQ ID NO: 1067843 - protein, 9 aa, Homo Sapiens
PLFGVLSNL

SEQ ID NO: 1067844 - protein, 9 aa, Homo Sapiens
PKPSPALVP

SEQ ID NO: 1067845 - protein, 9 aa, Homo Sapiens
PRNFNIAGT

SEQ ID NO: 1067846 - protein, 9 aa, Homo Sapiens
LITSNLTRM

SEQ ID NO: 1067847 - protein, 9 aa, Homo Sapiens
PLPPLSDTP

SEQ ID NO: 1067848 - protein, 9 aa, Homo Sapiens
IEGGHAPEE

SEQ ID NO: 1067849 - protein, 9 aa, Homo Sapiens
EMEAIQVQR

SEQ ID NO: 1067850 - protein, 9 aa, Homo Sapiens
PIGHMKVKG

SEQ ID NO: 1067851 - protein, 9 aa, Homo Sapiens
DVSANFHSL

SEQ ID NO: 1067852 - protein, 9 aa, Homo Sapiens
FSLKKIQLQ

SEQ ID NO: 1067853 - protein, 9 aa, Homo Sapiens
SRAGALVVW

SEQ ID NO: 1067854 - protein, 9 aa, Homo Sapiens
DGKKEDEVK

SEQ ID NO: 1067855 - protein, 9 aa, Homo Sapiens
SFISNISNS

SEQ ID NO: 1067856 - protein, 9 aa, Homo Sapiens
ETTANTLFW

SEQ ID NO: 1067857 - protein, 9 aa, Homo Sapiens
WAYNCGEHP

SEQ ID NO: 1067858 - protein, 9 aa, Homo Sapiens
EARLEKEED

SEQ ID NO: 1067859 - protein, 9 aa, Homo Sapiens
VDAHTDTTN

SEQ ID NO: 1067860 - protein, 9 aa, Homo Sapiens
NHPSWIFTC

SEQ ID NO: 1067861 - protein, 9 aa, Homo Sapiens
AEIMAMNEE

SEQ ID NO: 1067862 - protein, 9 aa, Homo Sapiens
VSKKLHVAA

SEQ ID NO: 1067863 - protein, 9 aa, Homo Sapiens
TECFFLAFM

SEQ ID NO: 1067864 - protein, 9 aa, Homo Sapiens
SASLRKASA

SEQ ID NO: 1067865 - protein, 9 aa, Homo Sapiens
PAGRPKVLV

SEQ ID NO: 1067866 - protein, 9 aa, Homo Sapiens
MHELLRQME

SEQ ID NO: 1067867 - protein, 9 aa, Homo Sapiens
LFQQCYIFD

SEQ ID NO: 1067868 - protein, 9 aa, Homo Sapiens
AVQLKCEYA

SEQ ID NO: 1067869 - protein, 9 aa, Homo Sapiens
NFNECENVS

SEQ ID NO: 1067870 - protein, 9 aa, Homo Sapiens
NVIYNVNNG

SEQ ID NO: 1067871 - protein, 9 aa, Homo Sapiens
FSGDFTQSF

SEQ ID NO: 1067872 - protein, 9 aa, Homo Sapiens
LRLHAQLHC

SEQ ID NO: 1067873 - protein, 9 aa, Homo Sapiens
GAGCTLECQ

SEQ ID NO: 1067874 - protein, 9 aa, Homo Sapiens
AKAVLQLLK

SEQ ID NO: 1067875 - protein, 9 aa, Homo Sapiens
LPSYTPPPP

SEQ ID NO: 1067876 - protein, 9 aa, Homo Sapiens
VDMIKEALE

SEQ ID NO: 1067877 - protein, 9 aa, Homo Sapiens
VKYVPSYGP

SEQ ID NO: 1067878 - protein, 9 aa, Homo Sapiens
TTSYSCPCT

SEQ ID NO: 1067879 - protein, 9 aa, Homo Sapiens
KAFSDPSFL

SEQ ID NO: 1067880 - protein, 9 aa, Homo Sapiens
NYEKQKSYT

SEQ ID NO: 1067881 - protein, 9 aa, Homo Sapiens
NKFSLILEK

SEQ ID NO: 1067882 - protein, 9 aa, Homo Sapiens
PSLSETPTG

SEQ ID NO: 1067883 - protein, 9 aa, Homo Sapiens
RLCSSVCTN

SEQ ID NO: 1067884 - protein, 9 aa, Homo Sapiens
RNLLASEEE

SEQ ID NO: 1067885 - protein, 9 aa, Homo Sapiens
RWPQENKNE

SEQ ID NO: 1067886 - protein, 9 aa, Homo Sapiens
STDGLAPVE

SEQ ID NO: 1067887 - protein, 9 aa, Homo Sapiens
GCRLQFGVA

SEQ ID NO: 1067888 - protein, 9 aa, Homo Sapiens
RLGGLTQVP

SEQ ID NO: 1067889 - protein, 9 aa, Homo Sapiens
SMEIEVKLY

SEQ ID NO: 1067890 - protein, 9 aa, Homo Sapiens
SQPDHDADR

SEQ ID NO: 1067891 - protein, 9 aa, Homo Sapiens
FVYTQPPSA

SEQ ID NO: 1067892 - protein, 9 aa, Homo Sapiens
IFDFNNLEQ

SEQ ID NO: 1067893 - protein, 9 aa, Homo Sapiens
FFRGDKVIS

SEQ ID NO: 1067894 - protein, 9 aa, Homo Sapiens
CFGMWIEYL

SEQ ID NO: 1067895 - protein, 9 aa, Homo Sapiens
SLSEKKSAI

SEQ ID NO: 1067896 - protein, 9 aa, Homo Sapiens
LKISKINKD

SEQ ID NO: 1067897 - protein, 9 aa, Homo Sapiens
IFRIKSKEG

SEQ ID NO: 1067898 - protein, 9 aa, Homo Sapiens
SRKMTETQM

SEQ ID NO: 1067899 - protein, 9 aa, Homo Sapiens
EPVGIPRPS

SEQ ID NO: 1067900 - protein, 9 aa, Homo Sapiens
AILDAVNGY

SEQ ID NO: 1067901 - protein, 9 aa, Homo Sapiens
CICFKGYAG

SEQ ID NO: 1067902 - protein, 9 aa, Homo Sapiens
GFASLLTGI

SEQ ID NO: 1067903 - protein, 9 aa, Homo Sapiens
VTYKNKEDK

SEQ ID NO: 1067904 - protein, 9 aa, Homo Sapiens
TAAKAIILK

SEQ ID NO: 1067905 - protein, 9 aa, Homo Sapiens
ATTMDQKFL

SEQ ID NO: 1067906 - protein, 9 aa, Homo Sapiens
KTGVSHLYL

SEQ ID NO: 1067907 - protein, 9 aa, Homo Sapiens
FLSGCCQHQ

SEQ ID NO: 1067908 - protein, 9 aa, Homo Sapiens
STTKVTLGS

SEQ ID NO: 1067909 - protein, 9 aa, Homo Sapiens
PNKGARQEG

SEQ ID NO: 1067910 - protein, 9 aa, Homo Sapiens
CCPNVCETK

SEQ ID NO: 1067911 - protein, 9 aa, Homo Sapiens
CADNLLCVK

SEQ ID NO: 1067912 - protein, 9 aa, Homo Sapiens
STNEATNIT

SEQ ID NO: 1067913 - protein, 9 aa, Homo Sapiens
CNKEVRETL

SEQ ID NO: 1067914 - protein, 9 aa, Homo Sapiens
QNKMANENQ

SEQ ID NO: 1067915 - protein, 9 aa, Homo Sapiens
KNFLKVAAI

SEQ ID NO: 1067916 - protein, 9 aa, Homo Sapiens
AIKSGQQAE

SEQ ID NO: 1067917 - protein, 9 aa, Homo Sapiens
HDIRKSVNW

SEQ ID NO: 1067918 - protein, 9 aa, Homo Sapiens
MESIMTEDC

SEQ ID NO: 1067919 - protein, 9 aa, Homo Sapiens
IPGDPPAPP

SEQ ID NO: 1067920 - protein, 9 aa, Homo Sapiens
YNRFIAICN

SEQ ID NO: 1067921 - protein, 9 aa, Homo Sapiens
KEGKRNKLQ

SEQ ID NO: 1067922 - protein, 9 aa, Homo Sapiens
YLPSGIEHS

SEQ ID NO: 1067923 - protein, 9 aa, Homo Sapiens
FFSYLLLHA

SEQ ID NO: 1067924 - protein, 9 aa, Homo Sapiens
ETRNLQLNS

SEQ ID NO: 1067925 - protein, 9 aa, Homo Sapiens
YKLVTTKNL

SEQ ID NO: 1067926 - protein, 9 aa, Homo Sapiens
GFYMCQAHN

SEQ ID NO: 1067927 - protein, 9 aa, Homo Sapiens
ILKGVAAGS

SEQ ID NO: 1067928 - protein, 9 aa, Homo Sapiens
QEVEMLKCD

SEQ ID NO: 1067929 - protein, 9 aa, Homo Sapiens
CSAPLVPCR

SEQ ID NO: 1067930 - protein, 9 aa, Homo Sapiens
YFLDDPLSA

SEQ ID NO: 1067931 - protein, 9 aa, Homo Sapiens
SPDSGLAII

SEQ ID NO: 1067932 - protein, 9 aa, Homo Sapiens
SWNRMIGEL

SEQ ID NO: 1067933 - protein, 9 aa, Homo Sapiens
GPYFSSETF

SEQ ID NO: 1067934 - protein, 9 aa, Homo Sapiens
LLLHASRKT

SEQ ID NO: 1067935 - protein, 9 aa, Homo Sapiens
ENHCPLSAA

SEQ ID NO: 1067936 - protein, 9 aa, Homo Sapiens
AKVQNYCQE

SEQ ID NO: 1067937 - protein, 9 aa, Homo Sapiens
RFHQDALEG

SEQ ID NO: 1067938 - protein, 9 aa, Homo Sapiens
PPGSGSSLS

SEQ ID NO: 1067939 - protein, 9 aa, Homo Sapiens
QKKEKLKGP

SEQ ID NO: 1067940 - protein, 9 aa, Homo Sapiens
AQNKEFDKD

SEQ ID NO: 1067941 - protein, 9 aa, Homo Sapiens
KLNDTGSYF

SEQ ID NO: 1067942 - protein, 9 aa, Homo Sapiens
YSSIGDLLD

SEQ ID NO: 1067943 - protein, 9 aa, Homo Sapiens
QFSNFLDGL

SEQ ID NO: 1067944 - protein, 9 aa, Homo Sapiens
GVVSLLGVT

SEQ ID NO: 1067945 - protein, 9 aa, Homo Sapiens
TFQSNRYPD

SEQ ID NO: 1067946 - protein, 9 aa, Homo Sapiens
LRYSVLISW

SEQ ID NO: 1067947 - protein, 9 aa, Homo Sapiens
KYQLLYHSA

SEQ ID NO: 1067948 - protein, 9 aa, Homo Sapiens
SPNASDSES

SEQ ID NO: 1067949 - protein, 9 aa, Homo Sapiens
SKEEPGPAG

SEQ ID NO: 1067950 - protein, 9 aa, Homo Sapiens
MGWCKAREQ

SEQ ID NO: 1067951 - protein, 9 aa, Homo Sapiens
PHGKRFLIV

SEQ ID NO: 1067952 - protein, 9 aa, Homo Sapiens
KQQYKMVIE

SEQ ID NO: 1067953 - protein, 9 aa, Homo Sapiens
LHNAKCQKT

SEQ ID NO: 1067954 - protein, 9 aa, Homo Sapiens
QLSDLEKEK

SEQ ID NO: 1067955 - protein, 9 aa, Homo Sapiens
YKLGIISGA

SEQ ID NO: 1067956 - protein, 9 aa, Homo Sapiens
LHPPHHILH

SEQ ID NO: 1067957 - protein, 9 aa, Homo Sapiens
FLDSEMCKD

SEQ ID NO: 1067958 - protein, 9 aa, Homo Sapiens
TMLNRVVMA

SEQ ID NO: 1067959 - protein, 9 aa, Homo Sapiens
AFTTTTVTA

SEQ ID NO: 1067960 - protein, 9 aa, Homo Sapiens
PAYKFKKYV

SEQ ID NO: 1067961 - protein, 9 aa, Homo Sapiens
VSCPQRTYY

SEQ ID NO: 1067962 - protein, 9 aa, Homo Sapiens
SAFHCPEIP

SEQ ID NO: 1067963 - protein, 9 aa, Homo Sapiens
VIRLNASDW

SEQ ID NO: 1067964 - protein, 9 aa, Homo Sapiens
EFVSTGFHS

SEQ ID NO: 1067965 - protein, 9 aa, Homo Sapiens
KVDATQGQS

SEQ ID NO: 1067966 - protein, 9 aa, Homo Sapiens
TSKLFCSLQ

SEQ ID NO: 1067967 - protein, 9 aa, Homo Sapiens
FLPVAQYIR

SEQ ID NO: 1067968 - protein, 9 aa, Homo Sapiens
RPRTAGLAV

SEQ ID NO: 1067969 - protein, 9 aa, Homo Sapiens
HPLRYTNLI

SEQ ID NO: 1067970 - protein, 9 aa, Homo Sapiens
VVTHDFLRS

SEQ ID NO: 1067971 - protein, 9 aa, Homo Sapiens
SSLTTSRGR

SEQ ID NO: 1067972 - protein, 9 aa, Homo Sapiens
HSHGPCHSR

SEQ ID NO: 1067973 - protein, 9 aa, Homo Sapiens
STKTKERVG

SEQ ID NO: 1067974 - protein, 9 aa, Homo Sapiens
AVFSSIVGR

SEQ ID NO: 1067975 - protein, 9 aa, Homo Sapiens
VDHPKKRFG

SEQ ID NO: 1067976 - protein, 9 aa, Homo Sapiens
HYPGLGKKK

SEQ ID NO: 1067977 - protein, 9 aa, Homo Sapiens
GLPGPRDPM

SEQ ID NO: 1067978 - protein, 9 aa, Homo Sapiens
RFQVNDFPC

SEQ ID NO: 1067979 - protein, 9 aa, Homo Sapiens
GPDRIGKTT

SEQ ID NO: 1067980 - protein, 9 aa, Homo Sapiens
SPNSSLFGT

SEQ ID NO: 1067981 - protein, 9 aa, Homo Sapiens
PAPPCPATF

SEQ ID NO: 1067982 - protein, 9 aa, Homo Sapiens
RSVVFRLNG

SEQ ID NO: 1067983 - protein, 9 aa, Homo Sapiens
NFNDASPTY

SEQ ID NO: 1067984 - protein, 9 aa, Homo Sapiens
AFQHRPHNQ

SEQ ID NO: 1067985 - protein, 9 aa, Homo Sapiens
ELLEGRFRR

SEQ ID NO: 1067986 - protein, 9 aa, Homo Sapiens
PSGLSFWSS

SEQ ID NO: 1067987 - protein, 9 aa, Homo Sapiens
RRSCYLTEY

SEQ ID NO: 1067988 - protein, 9 aa, Homo Sapiens
SQCTKVEKD

SEQ ID NO: 1067989 - protein, 9 aa, Homo Sapiens
SVVGVTSSP

SEQ ID NO: 1067990 - protein, 9 aa, Homo Sapiens
PLFQEGKTN

SEQ ID NO: 1067991 - protein, 9 aa, Homo Sapiens
ARRIEERLY

SEQ ID NO: 1067992 - protein, 9 aa, Homo Sapiens
RRTPALPKP

SEQ ID NO: 1067993 - protein, 9 aa, Homo Sapiens
YVDYVNCGY

SEQ ID NO: 1067994 - protein, 9 aa, Homo Sapiens
PSVVDPNDS

SEQ ID NO: 1067995 - protein, 9 aa, Homo Sapiens
AFVGGLRYK

SEQ ID NO: 1067996 - protein, 9 aa, Homo Sapiens
SANPTTWLA

SEQ ID NO: 1067997 - protein, 9 aa, Homo Sapiens
YISILFLGL

SEQ ID NO: 1067998 - protein, 9 aa, Homo Sapiens
ETFNVLAMY

SEQ ID NO: 1067999 - protein, 9 aa, Homo Sapiens
AELQDNAVY

SEQ ID NO: 1068000 - protein, 9 aa, Homo Sapiens
YEKQKSYTL

SEQ ID NO: 1068001 - protein, 9 aa, Homo Sapiens
SSNMAKGWG

SEQ ID NO: 1068002 - protein, 9 aa, Homo Sapiens
RDMNGKSLN

SEQ ID NO: 1068003 - protein, 9 aa, Homo Sapiens
MVVVGICHT

SEQ ID NO: 1068004 - protein, 9 aa, Homo Sapiens
KEYLKALAT

SEQ ID NO: 1068005 - protein, 9 aa, Homo Sapiens
SNGELAPLR

SEQ ID NO: 1068006 - protein, 9 aa, Homo Sapiens
KKNPYLHPC

SEQ ID NO: 1068007 - protein, 9 aa, Homo Sapiens
VYVDSQLHT

SEQ ID NO: 1068008 - protein, 9 aa, Homo Sapiens
IWRVSVTPR

SEQ ID NO: 1068009 - protein, 9 aa, Homo Sapiens
AFSDPSFLR

SEQ ID NO: 1068010 - protein, 9 aa, Homo Sapiens
NSQAIKKVA

SEQ ID NO: 1068011 - protein, 9 aa, Homo Sapiens
KKCNLYLLE

SEQ ID NO: 1068012 - protein, 9 aa, Homo Sapiens
EVSKKLHVA

SEQ ID NO: 1068013 - protein, 9 aa, Homo Sapiens
LFDEFDSHA

SEQ ID NO: 1068014 - protein, 9 aa, Homo Sapiens
NHFFCEMLV

SEQ ID NO: 1068015 - protein, 9 aa, Homo Sapiens
KIGITYYLL

SEQ ID NO: 1068016 - protein, 9 aa, Homo Sapiens
VNIYNIYSL

SEQ ID NO: 1068017 - protein, 9 aa, Homo Sapiens
MSLWNVLGF

SEQ ID NO: 1068018 - protein, 9 aa, Homo Sapiens
TKKLGGREG

SEQ ID NO: 1068019 - protein, 9 aa, Homo Sapiens
KPSFTWGAS

SEQ ID NO: 1068020 - protein, 9 aa, Homo Sapiens
LFPKRCPKI

SEQ ID NO: 1068021 - protein, 9 aa, Homo Sapiens
SRIPAYEMM

SEQ ID NO: 1068022 - protein, 9 aa, Homo Sapiens
LHRGGTSHL

SEQ ID NO: 1068023 - protein, 9 aa, Homo Sapiens
FIDHQRTHT

SEQ ID NO: 1068024 - protein, 9 aa, Homo Sapiens
HKIIYSVEK

SEQ ID NO: 1068025 - protein, 9 aa, Homo Sapiens
FSEIFDALE

SEQ ID NO: 1068026 - protein, 9 aa, Homo Sapiens
VDEHETKIF

SEQ ID NO: 1068027 - protein, 9 aa, Homo Sapiens
FKSLEESSF

SEQ ID NO: 1068028 - protein, 9 aa, Homo Sapiens
PPYSPGPAP

SEQ ID NO: 1068029 - protein, 9 aa, Homo Sapiens
LFPGSFRGC

SEQ ID NO: 1068030 - protein, 9 aa, Homo Sapiens
NQRQSITSS

SEQ ID NO: 1068031 - protein, 9 aa, Homo Sapiens
DAPPNILNA

SEQ ID NO: 1068032 - protein, 9 aa, Homo Sapiens
KIQKNTWAS

SEQ ID NO: 1068033 - protein, 9 aa, Homo Sapiens
IFESCDRIK

SEQ ID NO: 1068034 - protein, 9 aa, Homo Sapiens
IIYVPAEQI

SEQ ID NO: 1068035 - protein, 9 aa, Homo Sapiens
RTCVKTTGI

SEQ ID NO: 1068036 - protein, 9 aa, Homo Sapiens
AQIISFSTE

SEQ ID NO: 1068037 - protein, 9 aa, Homo Sapiens
LEQQKKHLE

SEQ ID NO: 1068038 - protein, 9 aa, Homo Sapiens
PPPEQEEVQ

SEQ ID NO: 1068039 - protein, 9 aa, Homo Sapiens
ISAIVHYSP

SEQ ID NO: 1068040 - protein, 9 aa, Homo Sapiens
PEAEAADDL

SEQ ID NO: 1068041 - protein, 9 aa, Homo Sapiens
ALLDKDVFQ

SEQ ID NO: 1068042 - protein, 9 aa, Homo Sapiens
QEMTLRLEK

SEQ ID NO: 1068043 - protein, 9 aa, Homo Sapiens
KDMNLVKEN

SEQ ID NO: 1068044 - protein, 9 aa, Homo Sapiens
DLKMMWSMH

SEQ ID NO: 1068045 - protein, 9 aa, Homo Sapiens
FEQDPTTFA

SEQ ID NO: 1068046 - protein, 9 aa, Homo Sapiens
YRLLEPTLR

SEQ ID NO: 1068047 - protein, 9 aa, Homo Sapiens
VPSTSAAEA

SEQ ID NO: 1068048 - protein, 9 aa, Homo Sapiens
VAHVLLEEL

SEQ ID NO: 1068049 - protein, 9 aa, Homo Sapiens
IWEPPRKEQ

SEQ ID NO: 1068050 - protein, 9 aa, Homo Sapiens
ENPIFRFSS

SEQ ID NO: 1068051 - protein, 9 aa, Homo Sapiens
RHLFNGSLV

SEQ ID NO: 1068052 - protein, 9 aa, Homo Sapiens
EIRRIFSPF

SEQ ID NO: 1068053 - protein, 9 aa, Homo Sapiens
LVNDIKKKL

SEQ ID NO: 1068054 - protein, 9 aa, Homo Sapiens
RGQLDSRPL

SEQ ID NO: 1068055 - protein, 9 aa, Homo Sapiens
QDMRRLRQE

SEQ ID NO: 1068056 - protein, 9 aa, Homo Sapiens
EGDRGNLPD

SEQ ID NO: 1068057 - protein, 9 aa, Homo Sapiens
NEGPPGSPG

SEQ ID NO: 1068058 - protein, 9 aa, Homo Sapiens
KKQKKIPSE

SEQ ID NO: 1068059 - protein, 9 aa, Homo Sapiens
LSPAAAEHS

SEQ ID NO: 1068060 - protein, 9 aa, Homo Sapiens
GGVYVNQNK

SEQ ID NO: 1068061 - protein, 9 aa, Homo Sapiens
ERSYELVCS

SEQ ID NO: 1068062 - protein, 9 aa, Homo Sapiens
ASTYLNNSY

SEQ ID NO: 1068063 - protein, 9 aa, Homo Sapiens
SGQMQSVGS

SEQ ID NO: 1068064 - protein, 9 aa, Homo Sapiens
MAMSHEFKT

SEQ ID NO: 1068065 - protein, 9 aa, Homo Sapiens
KLQSQEWGK

SEQ ID NO: 1068066 - protein, 9 aa, Homo Sapiens
NATDDSALW

SEQ ID NO: 1068067 - protein, 9 aa, Homo Sapiens
PNFLEAIDL

SEQ ID NO: 1068068 - protein, 9 aa, Homo Sapiens
KHDSEMKLQ

SEQ ID NO: 1068069 - protein, 9 aa, Homo Sapiens
FLLPFSQPE

SEQ ID NO: 1068070 - protein, 9 aa, Homo Sapiens
VRVDTDGGL

SEQ ID NO: 1068071 - protein, 9 aa, Homo Sapiens
RIKSKEGRA

SEQ ID NO: 1068072 - protein, 9 aa, Homo Sapiens
GPVSQAFPG

SEQ ID NO: 1068073 - protein, 9 aa, Homo Sapiens
LSWQNFNDA

SEQ ID NO: 1068074 - protein, 9 aa, Homo Sapiens
LPGTGGPPE

SEQ ID NO: 1068075 - protein, 9 aa, Homo Sapiens
TYSNTRCDA

SEQ ID NO: 1068076 - protein, 9 aa, Homo Sapiens
TLAESMEIE

SEQ ID NO: 1068077 - protein, 9 aa, Homo Sapiens
RVYMTWVQP

SEQ ID NO: 1068078 - protein, 9 aa, Homo Sapiens
VWSRTAYLF

SEQ ID NO: 1068079 - protein, 9 aa, Homo Sapiens
VDPNDSQML

SEQ ID NO: 1068080 - protein, 9 aa, Homo Sapiens
VASFTTKIK

SEQ ID NO: 1068081 - protein, 9 aa, Homo Sapiens
RREDKTRTQ

SEQ ID NO: 1068082 - protein, 9 aa, Homo Sapiens
RLTASRSLV

SEQ ID NO: 1068083 - protein, 9 aa, Homo Sapiens
HEVLNFALS

SEQ ID NO: 1068084 - protein, 9 aa, Homo Sapiens
KRAARVSPI

SEQ ID NO: 1068085 - protein, 9 aa, Homo Sapiens
LHGPSNCSN

SEQ ID NO: 1068086 - protein, 9 aa, Homo Sapiens
SVAASTERT

SEQ ID NO: 1068087 - protein, 9 aa, Homo Sapiens
AHFILKQKS

SEQ ID NO: 1068088 - protein, 9 aa, Homo Sapiens
QMWFIYTLQ

SEQ ID NO: 1068089 - protein, 9 aa, Homo Sapiens
YPTPVELSQ

SEQ ID NO: 1068090 - protein, 9 aa, Homo Sapiens
TKTSFREKG

SEQ ID NO: 1068091 - protein, 9 aa, Homo Sapiens
NSEKALQAI

SEQ ID NO: 1068092 - protein, 9 aa, Homo Sapiens
TGTLEKLLA

SEQ ID NO: 1068093 - protein, 9 aa, Homo Sapiens
RNSYSIDNN

SEQ ID NO: 1068094 - protein, 9 aa, Homo Sapiens
YSFAFLIYL

SEQ ID NO: 1068095 - protein, 9 aa, Homo Sapiens
LPPRVCLKP

SEQ ID NO: 1068096 - protein, 9 aa, Homo Sapiens
FVQEKIPKL

SEQ ID NO: 1068097 - protein, 9 aa, Homo Sapiens
VRTHTGICP

SEQ ID NO: 1068098 - protein, 9 aa, Homo Sapiens
CSKCGKGTY

SEQ ID NO: 1068099 - protein, 9 aa, Homo Sapiens
DTYLPVLDT

SEQ ID NO: 1068100 - protein, 9 aa, Homo Sapiens
GVQKDPPEL

SEQ ID NO: 1068101 - protein, 9 aa, Homo Sapiens
GPVNPPAAT

SEQ ID NO: 1068102 - protein, 9 aa, Homo Sapiens
HFFCEMLVF

SEQ ID NO: 1068103 - protein, 9 aa, Homo Sapiens
LDGFEGKRI

SEQ ID NO: 1068104 - protein, 9 aa, Homo Sapiens
FLKDDYFVS

SEQ ID NO: 1068105 - protein, 9 aa, Homo Sapiens
KCDGLKMDS

SEQ ID NO: 1068106 - protein, 9 aa, Homo Sapiens
WTGSSCDTQ

SEQ ID NO: 1068107 - protein, 9 aa, Homo Sapiens
NHHQQTHTG

SEQ ID NO: 1068108 - protein, 9 aa, Homo Sapiens
PPVPGIGKE

SEQ ID NO: 1068109 - protein, 9 aa, Homo Sapiens
SAPSILNGF

SEQ ID NO: 1068110 - protein, 9 aa, Homo Sapiens
VASKKTFQI

SEQ ID NO: 1068111 - protein, 9 aa, Homo Sapiens
WLPWGLVFN

SEQ ID NO: 1068112 - protein, 9 aa, Homo Sapiens
SYYPYLYCV

SEQ ID NO: 1068113 - protein, 9 aa, Homo Sapiens
REEEAVLSR

SEQ ID NO: 1068114 - protein, 9 aa, Homo Sapiens
QSRSFTCNE

SEQ ID NO: 1068115 - protein, 9 aa, Homo Sapiens
LDLEKLSES

SEQ ID NO: 1068116 - protein, 9 aa, Homo Sapiens
FCVIDTIVF

SEQ ID NO: 1068117 - protein, 9 aa, Homo Sapiens
LFVSLYPGT

SEQ ID NO: 1068118 - protein, 9 aa, Homo Sapiens
AVFFFKKTV

SEQ ID NO: 1068119 - protein, 9 aa, Homo Sapiens
SLWVCVDNF

SEQ ID NO: 1068120 - protein, 9 aa, Homo Sapiens
VAFMGNFVM

SEQ ID NO: 1068121 - protein, 9 aa, Homo Sapiens
SMGFINCEA

SEQ ID NO: 1068122 - protein, 9 aa, Homo Sapiens
GFFQTRMGD

SEQ ID NO: 1068123 - protein, 9 aa, Homo Sapiens
ALWVSAEHL

SEQ ID NO: 1068124 - protein, 9 aa, Homo Sapiens
NKLQKQEKT

SEQ ID NO: 1068125 - protein, 9 aa, Homo Sapiens
LGKLRFQNN

SEQ ID NO: 1068126 - protein, 9 aa, Homo Sapiens
VGDYNFICS

SEQ ID NO: 1068127 - protein, 9 aa, Homo Sapiens
FQRTPGDPS

SEQ ID NO: 1068128 - protein, 9 aa, Homo Sapiens
EAWAAIFIA

SEQ ID NO: 1068129 - protein, 9 aa, Homo Sapiens
GFVSPPPFK

SEQ ID NO: 1068130 - protein, 9 aa, Homo Sapiens
QLKRHMITY

SEQ ID NO: 1068131 - protein, 9 aa, Homo Sapiens
FDVKNFHLP

SEQ ID NO: 1068132 - protein, 9 aa, Homo Sapiens
YENCEKAYT

SEQ ID NO: 1068133 - protein, 9 aa, Homo Sapiens
HGFYQSYID

SEQ ID NO: 1068134 - protein, 9 aa, Homo Sapiens
APTNLVFIL

SEQ ID NO: 1068135 - protein, 9 aa, Homo Sapiens
THNNYENVE

SEQ ID NO: 1068136 - protein, 9 aa, Homo Sapiens
RSYALVSLF

SEQ ID NO: 1068137 - protein, 9 aa, Homo Sapiens
NDWQRGRIL

SEQ ID NO: 1068138 - protein, 9 aa, Homo Sapiens
PATSTAASS

SEQ ID NO: 1068139 - protein, 9 aa, Homo Sapiens
KVSNFGMSR

SEQ ID NO: 1068140 - protein, 9 aa, Homo Sapiens
GTPLLVACA

SEQ ID NO: 1068141 - protein, 9 aa, Homo Sapiens
QSHSSSCRI

SEQ ID NO: 1068142 - protein, 9 aa, Homo Sapiens
LNLCFSDLV

SEQ ID NO: 1068143 - protein, 9 aa, Homo Sapiens
KSLNGKAIK

SEQ ID NO: 1068144 - protein, 9 aa, Homo Sapiens
IEDSAFFDC

SEQ ID NO: 1068145 - protein, 9 aa, Homo Sapiens
GEELLEGRF

SEQ ID NO: 1068146 - protein, 9 aa, Homo Sapiens
ETHHLFVSL

SEQ ID NO: 1068147 - protein, 9 aa, Homo Sapiens
LQMGTNKRA

SEQ ID NO: 1068148 - protein, 9 aa, Homo Sapiens
LLEFWKKTA

SEQ ID NO: 1068149 - protein, 9 aa, Homo Sapiens
SNEQGLSYS

SEQ ID NO: 1068150 - protein, 9 aa, Homo Sapiens
SCLLADNNF

SEQ ID NO: 1068151 - protein, 9 aa, Homo Sapiens
STTQINFWK

SEQ ID NO: 1068152 - protein, 9 aa, Homo Sapiens
IIRSSRSSK

SEQ ID NO: 1068153 - protein, 9 aa, Homo Sapiens
KCDLWHLMV

SEQ ID NO: 1068154 - protein, 9 aa, Homo Sapiens
PPPPGPPGS

SEQ ID NO: 1068155 - protein, 9 aa, Homo Sapiens
NQKKEKLKG

SEQ ID NO: 1068156 - protein, 9 aa, Homo Sapiens
LTLLSLKSE

SEQ ID NO: 1068157 - protein, 9 aa, Homo Sapiens
KERSFKSQD

SEQ ID NO: 1068158 - protein, 9 aa, Homo Sapiens
YSDCWLATP

SEQ ID NO: 1068159 - protein, 9 aa, Homo Sapiens
KVYVSDNIQ

SEQ ID NO: 1068160 - protein, 9 aa, Homo Sapiens
IASQCPIAG

SEQ ID NO: 1068161 - protein, 9 aa, Homo Sapiens
KKMAMSHEF

SEQ ID NO: 1068162 - protein, 9 aa, Homo Sapiens
LYGTEWDLK

SEQ ID NO: 1068163 - protein, 9 aa, Homo Sapiens
FKELPHFKL

SEQ ID NO: 1068164 - protein, 9 aa, Homo Sapiens
TLSLLSGLE

SEQ ID NO: 1068165 - protein, 9 aa, Homo Sapiens
QKILDDLFF

SEQ ID NO: 1068166 - protein, 9 aa, Homo Sapiens
EFDVKNFHL

SEQ ID NO: 1068167 - protein, 9 aa, Homo Sapiens
RHKILLPGR

SEQ ID NO: 1068168 - protein, 9 aa, Homo Sapiens
EVIFTLGET

SEQ ID NO: 1068169 - protein, 9 aa, Homo Sapiens
RVGMSVNAF

SEQ ID NO: 1068170 - protein, 9 aa, Homo Sapiens
TPREQGFPG

SEQ ID NO: 1068171 - protein, 9 aa, Homo Sapiens
HQGLLSPGM

SEQ ID NO: 1068172 - protein, 9 aa, Homo Sapiens
TWNSFLSGC

SEQ ID NO: 1068173 - protein, 9 aa, Homo Sapiens
IFFFLALTS

SEQ ID NO: 1068174 - protein, 9 aa, Homo Sapiens
LFLAKVVLL

SEQ ID NO: 1068175 - protein, 9 aa, Homo Sapiens
SQGLSWHND

SEQ ID NO: 1068176 - protein, 9 aa, Homo Sapiens
GSSDLYVRV

SEQ ID NO: 1068177 - protein, 9 aa, Homo Sapiens
CVSTSLISG

SEQ ID NO: 1068178 - protein, 9 aa, Homo Sapiens
PGTPGLQGL

SEQ ID NO: 1068179 - protein, 9 aa, Homo Sapiens
YPNGENKQP

SEQ ID NO: 1068180 - protein, 9 aa, Homo Sapiens
VLISQKLSS

SEQ ID NO: 1068181 - protein, 9 aa, Homo Sapiens
TFPSLHDSS

SEQ ID NO: 1068182 - protein, 9 aa, Homo Sapiens
VIQIPILIS

SEQ ID NO: 1068183 - protein, 9 aa, Homo Sapiens
PVPPSEDTE

SEQ ID NO: 1068184 - protein, 9 aa, Homo Sapiens
EALGEQLYQ

SEQ ID NO: 1068185 - protein, 9 aa, Homo Sapiens
RWGPEDRKM

SEQ ID NO: 1068186 - protein, 9 aa, Homo Sapiens
HTGEKLYQC

SEQ ID NO: 1068187 - protein, 9 aa, Homo Sapiens
MVQVSRDIF

SEQ ID NO: 1068188 - protein, 9 aa, Homo Sapiens
NSEIMEYFV

SEQ ID NO: 1068189 - protein, 9 aa, Homo Sapiens
GECFCADHL

SEQ ID NO: 1068190 - protein, 9 aa, Homo Sapiens
IKNLHDDFC

SEQ ID NO: 1068191 - protein, 9 aa, Homo Sapiens
VASNMRNDE

SEQ ID NO: 1068192 - protein, 9 aa, Homo Sapiens
YESPENRKS

SEQ ID NO: 1068193 - protein, 9 aa, Homo Sapiens
SSEPKPTPG

SEQ ID NO: 1068194 - protein, 9 aa, Homo Sapiens
TPKCLPKCP

SEQ ID NO: 1068195 - protein, 9 aa, Homo Sapiens
NQKKNLKEM

SEQ ID NO: 1068196 - protein, 9 aa, Homo Sapiens
LIDVNTEFL

SEQ ID NO: 1068197 - protein, 9 aa, Homo Sapiens
AHQLYGRLL

SEQ ID NO: 1068198 - protein, 9 aa, Homo Sapiens
SSPSSCNNN

SEQ ID NO: 1068199 - protein, 9 aa, Homo Sapiens
SILVRALCN

SEQ ID NO: 1068200 - protein, 9 aa, Homo Sapiens
KSITPPSYV

SEQ ID NO: 1068201 - protein, 9 aa, Homo Sapiens
TVRSSADSL

SEQ ID NO: 1068202 - protein, 9 aa, Homo Sapiens
AELRFETQL

SEQ ID NO: 1068203 - protein, 9 aa, Homo Sapiens
QISKVLLME

SEQ ID NO: 1068204 - protein, 9 aa, Homo Sapiens
EITKEPSAC

SEQ ID NO: 1068205 - protein, 9 aa, Homo Sapiens
AEDKTPGAV

SEQ ID NO: 1068206 - protein, 9 aa, Homo Sapiens
VNIPVTTSE

SEQ ID NO: 1068207 - protein, 9 aa, Homo Sapiens
TTMDQKFLW

SEQ ID NO: 1068208 - protein, 9 aa, Homo Sapiens
VSVPQPRSS

SEQ ID NO: 1068209 - protein, 9 aa, Homo Sapiens
YVEILSSDG

SEQ ID NO: 1068210 - protein, 9 aa, Homo Sapiens
HFRVAAPNL

SEQ ID NO: 1068211 - protein, 9 aa, Homo Sapiens
LSPAQLDLF

SEQ ID NO: 1068212 - protein, 9 aa, Homo Sapiens
AITSRHYLD

SEQ ID NO: 1068213 - protein, 9 aa, Homo Sapiens
GPSQPDPVS

SEQ ID NO: 1068214 - protein, 9 aa, Homo Sapiens
INVQVEFVS

SEQ ID NO: 1068215 - protein, 9 aa, Homo Sapiens
KGYFNNNIA

SEQ ID NO: 1068216 - protein, 9 aa, Homo Sapiens
VIFYKNGLF

SEQ ID NO: 1068217 - protein, 9 aa, Homo Sapiens
DDAPRAVFS

SEQ ID NO: 1068218 - protein, 9 aa, Homo Sapiens
RPNLDSANP

SEQ ID NO: 1068219 - protein, 9 aa, Homo Sapiens
LLPEPLNVI

SEQ ID NO: 1068220 - protein, 9 aa, Homo Sapiens
KLKSFLKSL

SEQ ID NO: 1068221 - protein, 9 aa, Homo Sapiens
EIPTPSVQW

SEQ ID NO: 1068222 - protein, 9 aa, Homo Sapiens
RNLQLNSAR

SEQ ID NO: 1068223 - protein, 9 aa, Homo Sapiens
PPPAPPARL

SEQ ID NO: 1068224 - protein, 9 aa, Homo Sapiens
ESFAAALMK

SEQ ID NO: 1068225 - protein, 9 aa, Homo Sapiens
LVNIPVTTS

SEQ ID NO: 1068226 - protein, 9 aa, Homo Sapiens
GLENRGLAS

SEQ ID NO: 1068227 - protein, 9 aa, Homo Sapiens
GSSNSSASG

SEQ ID NO: 1068228 - protein, 9 aa, Homo Sapiens
MSWVFFWIS

SEQ ID NO: 1068229 - protein, 9 aa, Homo Sapiens
DLEVTGKNR

SEQ ID NO: 1068230 - protein, 9 aa, Homo Sapiens
QLFFCADHI

SEQ ID NO: 1068231 - protein, 9 aa, Homo Sapiens
VMSQRAIFF

SEQ ID NO: 1068232 - protein, 9 aa, Homo Sapiens
DRIGKTTLL

SEQ ID NO: 1068233 - protein, 9 aa, Homo Sapiens
QDPVRNLHP

SEQ ID NO: 1068234 - protein, 9 aa, Homo Sapiens
SRPRKEWEM

SEQ ID NO: 1068235 - protein, 9 aa, Homo Sapiens
LGRDHWNKM

SEQ ID NO: 1068236 - protein, 9 aa, Homo Sapiens
QIEIWVMHE

SEQ ID NO: 1068237 - protein, 9 aa, Homo Sapiens
VFIFIPLFD

SEQ ID NO: 1068238 - protein, 9 aa, Homo Sapiens
NWMENIDVC

SEQ ID NO: 1068239 - protein, 9 aa, Homo Sapiens
LIYSGIKPF

SEQ ID NO: 1068240 - protein, 9 aa, Homo Sapiens
KELSLEDKS

SEQ ID NO: 1068241 - protein, 9 aa, Homo Sapiens
YAGFFKYVA

SEQ ID NO: 1068242 - protein, 9 aa, Homo Sapiens
ELASTTQIN

SEQ ID NO: 1068243 - protein, 9 aa, Homo Sapiens
LIAYSDLEY

SEQ ID NO: 1068244 - protein, 9 aa, Homo Sapiens
RPEVTTMLL

SEQ ID NO: 1068245 - protein, 9 aa, Homo Sapiens
SSQYISMHG

SEQ ID NO: 1068246 - protein, 9 aa, Homo Sapiens
SSDPPTSAF

SEQ ID NO: 1068247 - protein, 9 aa, Homo Sapiens
TPVGIRYRI

SEQ ID NO: 1068248 - protein, 9 aa, Homo Sapiens
LATVDETIL

SEQ ID NO: 1068249 - protein, 9 aa, Homo Sapiens
SKVFKYLCH

SEQ ID NO: 1068250 - protein, 9 aa, Homo Sapiens
LGSPSDDKD

SEQ ID NO: 1068251 - protein, 9 aa, Homo Sapiens
PQCKLNQEV

SEQ ID NO: 1068252 - protein, 9 aa, Homo Sapiens
KKKNEDCFG

SEQ ID NO: 1068253 - protein, 9 aa, Homo Sapiens
GYSTLSISP

SEQ ID NO: 1068254 - protein, 9 aa, Homo Sapiens
SRKATDRGM

SEQ ID NO: 1068255 - protein, 9 aa, Homo Sapiens
HAVDPDCRL

SEQ ID NO: 1068256 - protein, 9 aa, Homo Sapiens
DQFYMNRIS

SEQ ID NO: 1068257 - protein, 9 aa, Homo Sapiens
FKKNPYLHP

SEQ ID NO: 1068258 - protein, 9 aa, Homo Sapiens
EVEMLKCDG

SEQ ID NO: 1068259 - protein, 9 aa, Homo Sapiens
NCDLPAADS

SEQ ID NO: 1068260 - protein, 9 aa, Homo Sapiens
ARRRKRRKF

SEQ ID NO: 1068261 - protein, 9 aa, Homo Sapiens
SMGHKFFQR

SEQ ID NO: 1068262 - protein, 9 aa, Homo Sapiens
ISQKLSSIY

SEQ ID NO: 1068263 - protein, 9 aa, Homo Sapiens
FLVDNAEVE

SEQ ID NO: 1068264 - protein, 9 aa, Homo Sapiens
LEMKISFFE

SEQ ID NO: 1068265 - protein, 9 aa, Homo Sapiens
FDDKYLRKP

SEQ ID NO: 1068266 - protein, 9 aa, Homo Sapiens
EETKSKLAA

SEQ ID NO: 1068267 - protein, 9 aa, Homo Sapiens
SSLLEFVSV

SEQ ID NO: 1068268 - protein, 9 aa, Homo Sapiens
LQSEMNLQI

SEQ ID NO: 1068269 - protein, 9 aa, Homo Sapiens
LRKVKKDTR

SEQ ID NO: 1068270 - protein, 9 aa, Homo Sapiens
DADSKWNSS

SEQ ID NO: 1068271 - protein, 9 aa, Homo Sapiens
GIPASKISS

SEQ ID NO: 1068272 - protein, 9 aa, Homo Sapiens
MKPYPGTEK

SEQ ID NO: 1068273 - protein, 9 aa, Homo Sapiens
YFTFILYLE

SEQ ID NO: 1068274 - protein, 9 aa, Homo Sapiens
DLTHQISKE

SEQ ID NO: 1068275 - protein, 9 aa, Homo Sapiens
HYCHEENDP

SEQ ID NO: 1068276 - protein, 9 aa, Homo Sapiens
SLRADDLVS

SEQ ID NO: 1068277 - protein, 9 aa, Homo Sapiens
SGHVSFFWY

SEQ ID NO: 1068278 - protein, 9 aa, Homo Sapiens
SEPKAPAPR

SEQ ID NO: 1068279 - protein, 9 aa, Homo Sapiens
STDYHIFLV

SEQ ID NO: 1068280 - protein, 9 aa, Homo Sapiens
EPSVNLTYS

SEQ ID NO: 1068281 - protein, 9 aa, Homo Sapiens
ELQEKKTEA

SEQ ID NO: 1068282 - protein, 9 aa, Homo Sapiens
LVTEEHVGS

SEQ ID NO: 1068283 - protein, 9 aa, Homo Sapiens
KVCPFVHLS

SEQ ID NO: 1068284 - protein, 9 aa, Homo Sapiens
VETGGVQLC

SEQ ID NO: 1068285 - protein, 9 aa, Homo Sapiens
VSEICISVS

SEQ ID NO: 1068286 - protein, 9 aa, Homo Sapiens
PAPSTTTSA

SEQ ID NO: 1068287 - protein, 9 aa, Homo Sapiens
QKIRDRWQV

SEQ ID NO: 1068288 - protein, 9 aa, Homo Sapiens
CNADSLNIC

SEQ ID NO: 1068289 - protein, 9 aa, Homo Sapiens
PALEPRRGF

SEQ ID NO: 1068290 - protein, 9 aa, Homo Sapiens
KVLSVRVQS

SEQ ID NO: 1068291 - protein, 9 aa, Homo Sapiens
DGEVPKLPP

SEQ ID NO: 1068292 - protein, 9 aa, Homo Sapiens
LMIKFCGEE

SEQ ID NO: 1068293 - protein, 9 aa, Homo Sapiens
NVHTGEELL

SEQ ID NO: 1068294 - protein, 9 aa, Homo Sapiens
LSIVVLPQP

SEQ ID NO: 1068295 - protein, 9 aa, Homo Sapiens
LCAKSPIDC

SEQ ID NO: 1068296 - protein, 9 aa, Homo Sapiens
TYYIPPHGF

SEQ ID NO: 1068297 - protein, 9 aa, Homo Sapiens
LGLTKKVAR

SEQ ID NO: 1068298 - protein, 9 aa, Homo Sapiens
LWLCLLKVL

SEQ ID NO: 1068299 - protein, 9 aa, Homo Sapiens
AQGLSRPLP

SEQ ID NO: 1068300 - protein, 9 aa, Homo Sapiens
TYLGDPILY

SEQ ID NO: 1068301 - protein, 9 aa, Homo Sapiens
LKFRGSFTD

SEQ ID NO: 1068302 - protein, 9 aa, Homo Sapiens
TWASVHLHF

SEQ ID NO: 1068303 - protein, 9 aa, Homo Sapiens
AMSHEFKTE

SEQ ID NO: 1068304 - protein, 9 aa, Homo Sapiens
RVLDKADSP

SEQ ID NO: 1068305 - protein, 9 aa, Homo Sapiens
IYNSHTAYY

SEQ ID NO: 1068306 - protein, 9 aa, Homo Sapiens
GVGPGRELF

SEQ ID NO: 1068307 - protein, 9 aa, Homo Sapiens
KLKKEEFVT

SEQ ID NO: 1068308 - protein, 9 aa, Homo Sapiens
ERGGSCDPR

SEQ ID NO: 1068309 - protein, 9 aa, Homo Sapiens
DEKSSTEQL

SEQ ID NO: 1068310 - protein, 9 aa, Homo Sapiens
GALRARFGM

SEQ ID NO: 1068311 - protein, 9 aa, Homo Sapiens
GGAMLGIPA

SEQ ID NO: 1068312 - protein, 9 aa, Homo Sapiens
KAILKQNFR

SEQ ID NO: 1068313 - protein, 9 aa, Homo Sapiens
TDKYFFDRD

SEQ ID NO: 1068314 - protein, 9 aa, Homo Sapiens
PSTPAQTSL

SEQ ID NO: 1068315 - protein, 9 aa, Homo Sapiens
MPKEVYEDL

SEQ ID NO: 1068316 - protein, 9 aa, Homo Sapiens
RKRSDSRKY

SEQ ID NO: 1068317 - protein, 9 aa, Homo Sapiens
PGVVSDGLP

SEQ ID NO: 1068318 - protein, 9 aa, Homo Sapiens
TSGEGRLCA

SEQ ID NO: 1068319 - protein, 9 aa, Homo Sapiens
PCADNLLCV

SEQ ID NO: 1068320 - protein, 9 aa, Homo Sapiens
CPLPSGLLL

SEQ ID NO: 1068321 - protein, 9 aa, Homo Sapiens
DSSITGILP

SEQ ID NO: 1068322 - protein, 9 aa, Homo Sapiens
WASLVQKHL

SEQ ID NO: 1068323 - protein, 9 aa, Homo Sapiens
DNEDSRRFV

SEQ ID NO: 1068324 - protein, 9 aa, Homo Sapiens
DFYYSLKRT

SEQ ID NO: 1068325 - protein, 9 aa, Homo Sapiens
TPSFRSPAP

SEQ ID NO: 1068326 - protein, 9 aa, Homo Sapiens
ENVSYIKQP

SEQ ID NO: 1068327 - protein, 9 aa, Homo Sapiens
SIQVPQSMA

SEQ ID NO: 1068328 - protein, 9 aa, Homo Sapiens
FEWHAVDPD

SEQ ID NO: 1068329 - protein, 9 aa, Homo Sapiens
VALDFKQEM

SEQ ID NO: 1068330 - protein, 9 aa, Homo Sapiens
TLGETRAQS

SEQ ID NO: 1068331 - protein, 9 aa, Homo Sapiens
RFLGEDVSD

SEQ ID NO: 1068332 - protein, 9 aa, Homo Sapiens
PAPSPSLCL

SEQ ID NO: 1068333 - protein, 9 aa, Homo Sapiens
SDQAIITPR

SEQ ID NO: 1068334 - protein, 9 aa, Homo Sapiens
VCNDENSCE

SEQ ID NO: 1068335 - protein, 9 aa, Homo Sapiens
EKGNKGSKE

SEQ ID NO: 1068336 - protein, 9 aa, Homo Sapiens
QKLHHDMPL

SEQ ID NO: 1068337 - protein, 9 aa, Homo Sapiens
EKKDETDEF

SEQ ID NO: 1068338 - protein, 9 aa, Homo Sapiens
ESFRQSQSN

SEQ ID NO: 1068339 - protein, 9 aa, Homo Sapiens
IQVPQSMAF

SEQ ID NO: 1068340 - protein, 9 aa, Homo Sapiens
PITGDTLRF

SEQ ID NO: 1068341 - protein, 9 aa, Homo Sapiens
RTLVVQNEE

SEQ ID NO: 1068342 - protein, 9 aa, Homo Sapiens
GPQQPRGQL

SEQ ID NO: 1068343 - protein, 9 aa, Homo Sapiens
VLLKLHLDE

SEQ ID NO: 1068344 - protein, 9 aa, Homo Sapiens
YSYQCHGLR

SEQ ID NO: 1068345 - protein, 9 aa, Homo Sapiens
VSQAFPGTS

SEQ ID NO: 1068346 - protein, 9 aa, Homo Sapiens
TGIEVPPQF

SEQ ID NO: 1068347 - protein, 9 aa, Homo Sapiens
PLRYTNLIR

SEQ ID NO: 1068348 - protein, 9 aa, Homo Sapiens
SEKGQAKAV

SEQ ID NO: 1068349 - protein, 9 aa, Homo Sapiens
KENGYVQSP

SEQ ID NO: 1068350 - protein, 9 aa, Homo Sapiens
ERLYLLRKY

SEQ ID NO: 1068351 - protein, 9 aa, Homo Sapiens
ICCKLKIIK

SEQ ID NO: 1068352 - protein, 9 aa, Homo Sapiens
LTSKNKNGS

SEQ ID NO: 1068353 - protein, 9 aa, Homo Sapiens
KVARIGLTK

SEQ ID NO: 1068354 - protein, 9 aa, Homo Sapiens
MRVVHKTRN

SEQ ID NO: 1068355 - protein, 9 aa, Homo Sapiens
LSGDVLCSC

SEQ ID NO: 1068356 - protein, 9 aa, Homo Sapiens
NPTLLSLLG

SEQ ID NO: 1068357 - protein, 9 aa, Homo Sapiens
CPIAGNSCL

SEQ ID NO: 1068358 - protein, 9 aa, Homo Sapiens
RHNKPVNAE

SEQ ID NO: 1068359 - protein, 9 aa, Homo Sapiens
GEPFIRGEG

SEQ ID NO: 1068360 - protein, 9 aa, Homo Sapiens
GDTLRFWQL

SEQ ID NO: 1068361 - protein, 9 aa, Homo Sapiens
RAKETPKSS

SEQ ID NO: 1068362 - protein, 9 aa, Homo Sapiens
ECGKGFNCG

SEQ ID NO: 1068363 - protein, 9 aa, Homo Sapiens
AASGFGAVT

SEQ ID NO: 1068364 - protein, 9 aa, Homo Sapiens
PHIIYVPAE

SEQ ID NO: 1068365 - protein, 9 aa, Homo Sapiens
KESGMALSQ

SEQ ID NO: 1068366 - protein, 9 aa, Homo Sapiens
VYFENFPDY

SEQ ID NO: 1068367 - protein, 9 aa, Homo Sapiens
FFSDRRART

SEQ ID NO: 1068368 - protein, 9 aa, Homo Sapiens
WYLPPSGVK

SEQ ID NO: 1068369 - protein, 9 aa, Homo Sapiens
PLSRVTLLA

SEQ ID NO: 1068370 - protein, 9 aa, Homo Sapiens
ILHKDIGPC

SEQ ID NO: 1068371 - protein, 9 aa, Homo Sapiens
SKTMTSTYD

SEQ ID NO: 1068372 - protein, 9 aa, Homo Sapiens
KSLDDETVN

SEQ ID NO: 1068373 - protein, 9 aa, Homo Sapiens
DEPSRCYFY

SEQ ID NO: 1068374 - protein, 9 aa, Homo Sapiens
VSHDTDILW

SEQ ID NO: 1068375 - protein, 9 aa, Homo Sapiens
ADLGEMIFL

SEQ ID NO: 1068376 - protein, 9 aa, Homo Sapiens
VANFFLANP

SEQ ID NO: 1068377 - protein, 9 aa, Homo Sapiens
ALDSIFLAG

SEQ ID NO: 1068378 - protein, 9 aa, Homo Sapiens
GEMCSGHSQ

SEQ ID NO: 1068379 - protein, 9 aa, Homo Sapiens
SIFLQEWNI

SEQ ID NO: 1068380 - protein, 9 aa, Homo Sapiens
DEEWQLVLN

SEQ ID NO: 1068381 - protein, 9 aa, Homo Sapiens
STIYYNLCF

SEQ ID NO: 1068382 - protein, 9 aa, Homo Sapiens
GKIQRSKLQ

SEQ ID NO: 1068383 - protein, 9 aa, Homo Sapiens
KKRSLINKF

SEQ ID NO: 1068384 - protein, 9 aa, Homo Sapiens
LAPRLPSYT

SEQ ID NO: 1068385 - protein, 9 aa, Homo Sapiens
LFKHLKHEN

SEQ ID NO: 1068386 - protein, 9 aa, Homo Sapiens
APGGHLGSF

SEQ ID NO: 1068387 - protein, 9 aa, Homo Sapiens
FASCKYSPF

SEQ ID NO: 1068388 - protein, 9 aa, Homo Sapiens
AYSDLEYYI

SEQ ID NO: 1068389 - protein, 9 aa, Homo Sapiens
NNSSKNKFS

SEQ ID NO: 1068390 - protein, 9 aa, Homo Sapiens
RAVFSSIVG

SEQ ID NO: 1068391 - protein, 9 aa, Homo Sapiens
RRGEGAELA

SEQ ID NO: 1068392 - protein, 9 aa, Homo Sapiens
HSLEILYQS

SEQ ID NO: 1068393 - protein, 9 aa, Homo Sapiens
FTQLLAPSG

SEQ ID NO: 1068394 - protein, 9 aa, Homo Sapiens
FQRGTPGAG

SEQ ID NO: 1068395 - protein, 9 aa, Homo Sapiens
KKMSNRRNE

SEQ ID NO: 1068396 - protein, 9 aa, Homo Sapiens
KHLHMFTIW

SEQ ID NO: 1068397 - protein, 9 aa, Homo Sapiens
QLPQEKKAK

SEQ ID NO: 1068398 - protein, 9 aa, Homo Sapiens
LEVEEAVQE

SEQ ID NO: 1068399 - protein, 9 aa, Homo Sapiens
ELKNTVCQF

SEQ ID NO: 1068400 - protein, 9 aa, Homo Sapiens
FHFVCSGEG

SEQ ID NO: 1068401 - protein, 9 aa, Homo Sapiens
GQDCRIVLK

SEQ ID NO: 1068402 - protein, 9 aa, Homo Sapiens
EDLRKELYF

SEQ ID NO: 1068403 - protein, 9 aa, Homo Sapiens
KIFFKEQVP

SEQ ID NO: 1068404 - protein, 9 aa, Homo Sapiens
LLLHRADPD

SEQ ID NO: 1068405 - protein, 9 aa, Homo Sapiens
VDSAEFGDS

SEQ ID NO: 1068406 - protein, 9 aa, Homo Sapiens
GYKGENLMK

SEQ ID NO: 1068407 - protein, 9 aa, Homo Sapiens
ETLSGLTSK

SEQ ID NO: 1068408 - protein, 9 aa, Homo Sapiens
KRSLETSSY

SEQ ID NO: 1068409 - protein, 9 aa, Homo Sapiens
QRRKERISD

SEQ ID NO: 1068410 - protein, 9 aa, Homo Sapiens
IIAIFLFVS

SEQ ID NO: 1068411 - protein, 9 aa, Homo Sapiens
VERNEKQTS

SEQ ID NO: 1068412 - protein, 9 aa, Homo Sapiens
PPKNPFYDS

SEQ ID NO: 1068413 - protein, 9 aa, Homo Sapiens
GGLTQVPGN

SEQ ID NO: 1068414 - protein, 9 aa, Homo Sapiens
ETLKEYKAM

SEQ ID NO: 1068415 - protein, 9 aa, Homo Sapiens
IFQKPFCGP

SEQ ID NO: 1068416 - protein, 9 aa, Homo Sapiens
PSAVDSQKI

SEQ ID NO: 1068417 - protein, 9 aa, Homo Sapiens
KASNRSSHL

SEQ ID NO: 1068418 - protein, 9 aa, Homo Sapiens
EEEEQTKPL

SEQ ID NO: 1068419 - protein, 9 aa, Homo Sapiens
LPGHGASAP

SEQ ID NO: 1068420 - protein, 9 aa, Homo Sapiens
PMSSIPESS

SEQ ID NO: 1068421 - protein, 9 aa, Homo Sapiens
HLVFFGIVV

SEQ ID NO: 1068422 - protein, 9 aa, Homo Sapiens
FMKEDIKAL

SEQ ID NO: 1068423 - protein, 9 aa, Homo Sapiens
TKKIQLTPQ

SEQ ID NO: 1068424 - protein, 9 aa, Homo Sapiens
STEQAAWRY

SEQ ID NO: 1068425 - protein, 9 aa, Homo Sapiens
TPEGFRCEC

SEQ ID NO: 1068426 - protein, 9 aa, Homo Sapiens
SLDEIAGPG

SEQ ID NO: 1068427 - protein, 9 aa, Homo Sapiens
LYISINSDT

SEQ ID NO: 1068428 - protein, 9 aa, Homo Sapiens
STFHDVSVP

SEQ ID NO: 1068429 - protein, 9 aa, Homo Sapiens
FLAAGLMHS

SEQ ID NO: 1068430 - protein, 9 aa, Homo Sapiens
SELFDHLFF

SEQ ID NO: 1068431 - protein, 9 aa, Homo Sapiens
SLSAAGPGF

SEQ ID NO: 1068432 - protein, 9 aa, Homo Sapiens
ALGMVDSRK

SEQ ID NO: 1068433 - protein, 9 aa, Homo Sapiens
QPYGKSVNW

SEQ ID NO: 1068434 - protein, 9 aa, Homo Sapiens
YFLAEGDMV

SEQ ID NO: 1068435 - protein, 9 aa, Homo Sapiens
LTSFHTALK

SEQ ID NO: 1068436 - protein, 9 aa, Homo Sapiens
SSIERYDSH

SEQ ID NO: 1068437 - protein, 9 aa, Homo Sapiens
GEEKNGYVT

SEQ ID NO: 1068438 - protein, 9 aa, Homo Sapiens
HNLLKQTLG

SEQ ID NO: 1068439 - protein, 9 aa, Homo Sapiens
SPFIKLRRS

SEQ ID NO: 1068440 - protein, 9 aa, Homo Sapiens
IIAMKDESV

SEQ ID NO: 1068441 - protein, 9 aa, Homo Sapiens
VMRDFLHAQ

SEQ ID NO: 1068442 - protein, 9 aa, Homo Sapiens
GVWAYNCGE

SEQ ID NO: 1068443 - protein, 9 aa, Homo Sapiens
RLEGFWKSE

SEQ ID NO: 1068444 - protein, 9 aa, Homo Sapiens
LVFTWQVNI

SEQ ID NO: 1068445 - protein, 9 aa, Homo Sapiens
ANLSPSLVP

SEQ ID NO: 1068446 - protein, 9 aa, Homo Sapiens
NIYSLLKRY

SEQ ID NO: 1068447 - protein, 9 aa, Homo Sapiens
NLLEKDYFR

SEQ ID NO: 1068448 - protein, 9 aa, Homo Sapiens
KLASMFKGV

SEQ ID NO: 1068449 - protein, 9 aa, Homo Sapiens
GMQEFILRA

SEQ ID NO: 1068450 - protein, 9 aa, Homo Sapiens
SAQSSKLFT

SEQ ID NO: 1068451 - protein, 9 aa, Homo Sapiens
IERMIIKGC

SEQ ID NO: 1068452 - protein, 9 aa, Homo Sapiens
VRANKQEAV

SEQ ID NO: 1068453 - protein, 9 aa, Homo Sapiens
TLFAPPLSF

SEQ ID NO: 1068454 - protein, 9 aa, Homo Sapiens
SGLGGPRPV

SEQ ID NO: 1068455 - protein, 9 aa, Homo Sapiens
RTDSNKRVA

SEQ ID NO: 1068456 - protein, 9 aa, Homo Sapiens
VFSYLEDIP

SEQ ID NO: 1068457 - protein, 9 aa, Homo Sapiens
WCKAREQDP

SEQ ID NO: 1068458 - protein, 9 aa, Homo Sapiens
TGFFLGIGA

SEQ ID NO: 1068459 - protein, 9 aa, Homo Sapiens
PQLSSKMKH

SEQ ID NO: 1068460 - protein, 9 aa, Homo Sapiens
DLRKELYFC

SEQ ID NO: 1068461 - protein, 9 aa, Homo Sapiens
LGLSKFQNL

SEQ ID NO: 1068462 - protein, 9 aa, Homo Sapiens
EIFDFNNLE

SEQ ID NO: 1068463 - protein, 9 aa, Homo Sapiens
LRLSKHEPG

SEQ ID NO: 1068464 - protein, 9 aa, Homo Sapiens
FVDKDEHMQ

SEQ ID NO: 1068465 - protein, 9 aa, Homo Sapiens
MAITSRHYL

SEQ ID NO: 1068466 - protein, 9 aa, Homo Sapiens
LYLQCNMKF

SEQ ID NO: 1068467 - protein, 9 aa, Homo Sapiens
MHREFMGSA

SEQ ID NO: 1068468 - protein, 9 aa, Homo Sapiens
RYSPILKHM

SEQ ID NO: 1068469 - protein, 9 aa, Homo Sapiens
DILVLVFGL

SEQ ID NO: 1068470 - protein, 9 aa, Homo Sapiens
VMRNMSGRY

SEQ ID NO: 1068471 - protein, 9 aa, Homo Sapiens
EFFASVLTG

SEQ ID NO: 1068472 - protein, 9 aa, Homo Sapiens
TLGPVSPFH

SEQ ID NO: 1068473 - protein, 9 aa, Homo Sapiens
SEKLELQMA

SEQ ID NO: 1068474 - protein, 9 aa, Homo Sapiens
TKKVARHDV

SEQ ID NO: 1068475 - protein, 9 aa, Homo Sapiens
CERCSSPCK

SEQ ID NO: 1068476 - protein, 9 aa, Homo Sapiens
LESGWEEVS

SEQ ID NO: 1068477 - protein, 9 aa, Homo Sapiens
FPKMPYEPL

SEQ ID NO: 1068478 - protein, 9 aa, Homo Sapiens
YAGGLLHAL

SEQ ID NO: 1068479 - protein, 9 aa, Homo Sapiens
LCREPGTSL

SEQ ID NO: 1068480 - protein, 9 aa, Homo Sapiens
AIAQSSYLD

SEQ ID NO: 1068481 - protein, 9 aa, Homo Sapiens
CAYNPEAAS

SEQ ID NO: 1068482 - protein, 9 aa, Homo Sapiens
FINMSTLKY

SEQ ID NO: 1068483 - protein, 9 aa, Homo Sapiens
ADLIVTLKN

SEQ ID NO: 1068484 - protein, 9 aa, Homo Sapiens
FPGIEKAHH

SEQ ID NO: 1068485 - protein, 9 aa, Homo Sapiens
LIRNMFLEN

SEQ ID NO: 1068486 - protein, 9 aa, Homo Sapiens
SEMKLQTSP

SEQ ID NO: 1068487 - protein, 9 aa, Homo Sapiens
QIEEIYVGL

SEQ ID NO: 1068488 - protein, 9 aa, Homo Sapiens
SAFTTTTVT

SEQ ID NO: 1068489 - protein, 9 aa, Homo Sapiens
NPQSRPEAC

SEQ ID NO: 1068490 - protein, 9 aa, Homo Sapiens
SYTPPPPTV

SEQ ID NO: 1068491 - protein, 9 aa, Homo Sapiens
QTVLQLWDT

SEQ ID NO: 1068492 - protein, 9 aa, Homo Sapiens
QFVMKHHTL

SEQ ID NO: 1068493 - protein, 9 aa, Homo Sapiens
ICVPRQGKQ

SEQ ID NO: 1068494 - protein, 9 aa, Homo Sapiens
NKPKNNKDV

SEQ ID NO: 1068495 - protein, 9 aa, Homo Sapiens
PLAAFPNCS

SEQ ID NO: 1068496 - protein, 9 aa, Homo Sapiens
NAFFSIWHK

SEQ ID NO: 1068497 - protein, 9 aa, Homo Sapiens
ILYLETPKP

SEQ ID NO: 1068498 - protein, 9 aa, Homo Sapiens
IENKTTEIS

SEQ ID NO: 1068499 - protein, 9 aa, Homo Sapiens
LLRLWPVFS

SEQ ID NO: 1068500 - protein, 9 aa, Homo Sapiens
ILSPKRASC

SEQ ID NO: 1068501 - protein, 9 aa, Homo Sapiens
VRHCSAPEN

SEQ ID NO: 1068502 - protein, 9 aa, Homo Sapiens
FCTKNREWM

SEQ ID NO: 1068503 - protein, 9 aa, Homo Sapiens
SEIKLAKLS

SEQ ID NO: 1068504 - protein, 9 aa, Homo Sapiens
NTTASGLSW

SEQ ID NO: 1068505 - protein, 9 aa, Homo Sapiens
LLVKASGRE

SEQ ID NO: 1068506 - protein, 9 aa, Homo Sapiens
LLILSYAGG

SEQ ID NO: 1068507 - protein, 9 aa, Homo Sapiens
IFAFLVQNK

SEQ ID NO: 1068508 - protein, 9 aa, Homo Sapiens
MRDFLHAQK

SEQ ID NO: 1068509 - protein, 9 aa, Homo Sapiens
VPYRLGSPR

SEQ ID NO: 1068510 - protein, 9 aa, Homo Sapiens
VFEKALMSP

SEQ ID NO: 1068511 - protein, 9 aa, Homo Sapiens
LAACDFFQD

SEQ ID NO: 1068512 - protein, 9 aa, Homo Sapiens
LGQGLKFPI

SEQ ID NO: 1068513 - protein, 9 aa, Homo Sapiens
YQCRCQQIF

SEQ ID NO: 1068514 - protein, 9 aa, Homo Sapiens
EGRLCAKSP

SEQ ID NO: 1068515 - protein, 9 aa, Homo Sapiens
LNFDIFYNV

SEQ ID NO: 1068516 - protein, 9 aa, Homo Sapiens
SFFISSGVV

SEQ ID NO: 1068517 - protein, 9 aa, Homo Sapiens
LPTTMNYSL

SEQ ID NO: 1068518 - protein, 9 aa, Homo Sapiens
HTDTTNKAL

SEQ ID NO: 1068519 - protein, 9 aa, Homo Sapiens
GSIIVNVPS

SEQ ID NO: 1068520 - protein, 9 aa, Homo Sapiens
SDMDCTAIH

SEQ ID NO: 1068521 - protein, 9 aa, Homo Sapiens
LELAGFPSV

SEQ ID NO: 1068522 - protein, 9 aa, Homo Sapiens
PICLVQRMG

SEQ ID NO: 1068523 - protein, 9 aa, Homo Sapiens
ASVWKCLHL

SEQ ID NO: 1068524 - protein, 9 aa, Homo Sapiens
LVPDSIKFE

SEQ ID NO: 1068525 - protein, 9 aa, Homo Sapiens
PFWDSDNKI

SEQ ID NO: 1068526 - protein, 9 aa, Homo Sapiens
QKEGVFGWV

SEQ ID NO: 1068527 - protein, 9 aa, Homo Sapiens
LKNCDLPAA

SEQ ID NO: 1068528 - protein, 9 aa, Homo Sapiens
NPAVSSLSS

SEQ ID NO: 1068529 - protein, 9 aa, Homo Sapiens
AVQSLPPKN

SEQ ID NO: 1068530 - protein, 9 aa, Homo Sapiens
GLDVWGGKN

SEQ ID NO: 1068531 - protein, 9 aa, Homo Sapiens
LCAAALFVR

SEQ ID NO: 1068532 - protein, 9 aa, Homo Sapiens
GYNYAILAY

SEQ ID NO: 1068533 - protein, 9 aa, Homo Sapiens
NLERAALPA

SEQ ID NO: 1068534 - protein, 9 aa, Homo Sapiens
PPPPAGRPK

SEQ ID NO: 1068535 - protein, 9 aa, Homo Sapiens
KSCFELTSQ

SEQ ID NO: 1068536 - protein, 9 aa, Homo Sapiens
PSPLVGPLQ

SEQ ID NO: 1068537 - protein, 9 aa, Homo Sapiens
VKRKDLELV

SEQ ID NO: 1068538 - protein, 9 aa, Homo Sapiens
RPQQLFGRL

SEQ ID NO: 1068539 - protein, 9 aa, Homo Sapiens
GDWAGRSRK

SEQ ID NO: 1068540 - protein, 9 aa, Homo Sapiens
SLLALSCSD

SEQ ID NO: 1068541 - protein, 9 aa, Homo Sapiens
TPVELSQRM

SEQ ID NO: 1068542 - protein, 9 aa, Homo Sapiens
SGPSFPKND

SEQ ID NO: 1068543 - protein, 9 aa, Homo Sapiens
IPLYGSYTE

SEQ ID NO: 1068544 - protein, 9 aa, Homo Sapiens
YVNRTYDEQ

SEQ ID NO: 1068545 - protein, 9 aa, Homo Sapiens
NNQIYPKTG

SEQ ID NO: 1068546 - protein, 9 aa, Homo Sapiens
LDHLDLASA

SEQ ID NO: 1068547 - protein, 9 aa, Homo Sapiens
QLGCPSFFI

SEQ ID NO: 1068548 - protein, 9 aa, Homo Sapiens
STTHAFLAS

SEQ ID NO: 1068549 - protein, 9 aa, Homo Sapiens
ETAGESLDR

SEQ ID NO: 1068550 - protein, 9 aa, Homo Sapiens
SSLKETIYY

SEQ ID NO: 1068551 - protein, 9 aa, Homo Sapiens
VTFIWKFQR

SEQ ID NO: 1068552 - protein, 9 aa, Homo Sapiens
LPDHTKPRR

SEQ ID NO: 1068553 - protein, 9 aa, Homo Sapiens
QKIRDHCAE

SEQ ID NO: 1068554 - protein, 9 aa, Homo Sapiens
VSVSEICIS

SEQ ID NO: 1068555 - protein, 9 aa, Homo Sapiens
LFGARAEEA

SEQ ID NO: 1068556 - protein, 9 aa, Homo Sapiens
NKHLHMFTI

SEQ ID NO: 1068557 - protein, 9 aa, Homo Sapiens
AAHFSATPV

SEQ ID NO: 1068558 - protein, 9 aa, Homo Sapiens
EKYNLAIKD

SEQ ID NO: 1068559 - protein, 9 aa, Homo Sapiens
PEDRPGEGG

SEQ ID NO: 1068560 - protein, 9 aa, Homo Sapiens
SSRAIFFVG

SEQ ID NO: 1068561 - protein, 9 aa, Homo Sapiens
DAEPAKENL

SEQ ID NO: 1068562 - protein, 9 aa, Homo Sapiens
SDEPHEVLN

SEQ ID NO: 1068563 - protein, 9 aa, Homo Sapiens
DLLPGHGAS

SEQ ID NO: 1068564 - protein, 9 aa, Homo Sapiens
TQEFFRHNK

SEQ ID NO: 1068565 - protein, 9 aa, Homo Sapiens
DPRSSRDFI

SEQ ID NO: 1068566 - protein, 9 aa, Homo Sapiens
SSDFRTLLL

SEQ ID NO: 1068567 - protein, 9 aa, Homo Sapiens
EKVWKVEQK

SEQ ID NO: 1068568 - protein, 9 aa, Homo Sapiens
SHTGDTLFQ

SEQ ID NO: 1068569 - protein, 9 aa, Homo Sapiens
GNTKNFDNY

SEQ ID NO: 1068570 - protein, 9 aa, Homo Sapiens
GGRKGLLGQ

SEQ ID NO: 1068571 - protein, 9 aa, Homo Sapiens
IEASRYHKQ

SEQ ID NO: 1068572 - protein, 9 aa, Homo Sapiens
CGLWLWLCL

SEQ ID NO: 1068573 - protein, 9 aa, Homo Sapiens
LCSSVCTND

SEQ ID NO: 1068574 - protein, 9 aa, Homo Sapiens
KEEPGPAGS

SEQ ID NO: 1068575 - protein, 9 aa, Homo Sapiens
PLKIWDLNS

SEQ ID NO: 1068576 - protein, 9 aa, Homo Sapiens
PVREKKTKK

SEQ ID NO: 1068577 - protein, 9 aa, Homo Sapiens
VTYGKISYP

SEQ ID NO: 1068578 - protein, 9 aa, Homo Sapiens
KLKKKASLT

SEQ ID NO: 1068579 - protein, 9 aa, Homo Sapiens
PDFQRMPMQ

SEQ ID NO: 1068580 - protein, 9 aa, Homo Sapiens
EEHFQDDDD

SEQ ID NO: 1068581 - protein, 9 aa, Homo Sapiens
ESWKKFLRK

SEQ ID NO: 1068582 - protein, 9 aa, Homo Sapiens
NVSLLALSC

SEQ ID NO: 1068583 - protein, 9 aa, Homo Sapiens
VTAYNLYSH

SEQ ID NO: 1068584 - protein, 9 aa, Homo Sapiens
GNSVFGGAR

SEQ ID NO: 1068585 - protein, 9 aa, Homo Sapiens
NSSKKLRVK

SEQ ID NO: 1068586 - protein, 9 aa, Homo Sapiens
IRLPIFTLS

SEQ ID NO: 1068587 - protein, 9 aa, Homo Sapiens
LQKTVSAKK

SEQ ID NO: 1068588 - protein, 9 aa, Homo Sapiens
LFSTIKEED

SEQ ID NO: 1068589 - protein, 9 aa, Homo Sapiens
HAGLNIVTE

SEQ ID NO: 1068590 - protein, 9 aa, Homo Sapiens
SASKSFTVA

SEQ ID NO: 1068591 - protein, 9 aa, Homo Sapiens
SMNTRSFSS

SEQ ID NO: 1068592 - protein, 9 aa, Homo Sapiens
ERTLVVQNE

SEQ ID NO: 1068593 - protein, 9 aa, Homo Sapiens
GKLTTIGEL

SEQ ID NO: 1068594 - protein, 9 aa, Homo Sapiens
EDSSLSPVD

SEQ ID NO: 1068595 - protein, 9 aa, Homo Sapiens
NMNFSDVKQ

SEQ ID NO: 1068596 - protein, 9 aa, Homo Sapiens
GDYCVQKGD

SEQ ID NO: 1068597 - protein, 9 aa, Homo Sapiens
MVSNLVSQN

SEQ ID NO: 1068598 - protein, 9 aa, Homo Sapiens
LTFRNVALE

SEQ ID NO: 1068599 - protein, 9 aa, Homo Sapiens
KFKSVTIKD

SEQ ID NO: 1068600 - protein, 9 aa, Homo Sapiens
IGTMNGCRL

SEQ ID NO: 1068601 - protein, 9 aa, Homo Sapiens
TSAAEAKAA

SEQ ID NO: 1068602 - protein, 9 aa, Homo Sapiens
GLHFCFQTE

SEQ ID NO: 1068603 - protein, 9 aa, Homo Sapiens
LCTLSQGTL

SEQ ID NO: 1068604 - protein, 9 aa, Homo Sapiens
NCYEFLNGR

SEQ ID NO: 1068605 - protein, 9 aa, Homo Sapiens
VSVTSNPRH

SEQ ID NO: 1068606 - protein, 9 aa, Homo Sapiens
NLVCKVSNF

SEQ ID NO: 1068607 - protein, 9 aa, Homo Sapiens
THAFLASAS

SEQ ID NO: 1068608 - protein, 9 aa, Homo Sapiens
RQGPKGSTR

SEQ ID NO: 1068609 - protein, 9 aa, Homo Sapiens
QSVVFLYKG

SEQ ID NO: 1068610 - protein, 9 aa, Homo Sapiens
AFPASTDLL

SEQ ID NO: 1068611 - protein, 9 aa, Homo Sapiens
VAAPGGHLG

SEQ ID NO: 1068612 - protein, 9 aa, Homo Sapiens
LSVFLNNKK

SEQ ID NO: 1068613 - protein, 9 aa, Homo Sapiens
LVDGEVPKL

SEQ ID NO: 1068614 - protein, 9 aa, Homo Sapiens
ARTDGLWGL

SEQ ID NO: 1068615 - protein, 9 aa, Homo Sapiens
YFPLGLCLV

SEQ ID NO: 1068616 - protein, 9 aa, Homo Sapiens
ALDDIFFTP

SEQ ID NO: 1068617 - protein, 9 aa, Homo Sapiens
MKSTYLDPD

SEQ ID NO: 1068618 - protein, 9 aa, Homo Sapiens
IYIVTKYMS

SEQ ID NO: 1068619 - protein, 9 aa, Homo Sapiens
RPNTATFEA

SEQ ID NO: 1068620 - protein, 9 aa, Homo Sapiens
LKCEYACCL

SEQ ID NO: 1068621 - protein, 9 aa, Homo Sapiens
NEGNQIVLI

SEQ ID NO: 1068622 - protein, 9 aa, Homo Sapiens
CIPKLNEGN

SEQ ID NO: 1068623 - protein, 9 aa, Homo Sapiens
PRDPMGSEG

SEQ ID NO: 1068624 - protein, 9 aa, Homo Sapiens
PGLENRGLA

SEQ ID NO: 1068625 - protein, 9 aa, Homo Sapiens
EEKIKTYFL

SEQ ID NO: 1068626 - protein, 9 aa, Homo Sapiens
TAASSLGPL

SEQ ID NO: 1068627 - protein, 9 aa, Homo Sapiens
FLMRANTQD

SEQ ID NO: 1068628 - protein, 9 aa, Homo Sapiens
SPSTAIEQK

SEQ ID NO: 1068629 - protein, 9 aa, Homo Sapiens
TSIICGFLL

SEQ ID NO: 1068630 - protein, 9 aa, Homo Sapiens
EEAKYAQSQ

SEQ ID NO: 1068631 - protein, 9 aa, Homo Sapiens
HEEEALPLH

SEQ ID NO: 1068632 - protein, 9 aa, Homo Sapiens
AEEEAFRAQ

SEQ ID NO: 1068633 - protein, 9 aa, Homo Sapiens
IWTQKENIS

SEQ ID NO: 1068634 - protein, 9 aa, Homo Sapiens
MSSTRIQDN

SEQ ID NO: 1068635 - protein, 9 aa, Homo Sapiens
LAVHTEGNY

SEQ ID NO: 1068636 - protein, 9 aa, Homo Sapiens
YRVNIFLCQ

SEQ ID NO: 1068637 - protein, 9 aa, Homo Sapiens
LGLDNIHRA

SEQ ID NO: 1068638 - protein, 9 aa, Homo Sapiens
QSLYQFFVV

SEQ ID NO: 1068639 - protein, 9 aa, Homo Sapiens
ETHERKSSD

SEQ ID NO: 1068640 - protein, 9 aa, Homo Sapiens
LRKGMQEFI

SEQ ID NO: 1068641 - protein, 9 aa, Homo Sapiens
VAEAGNKTE

SEQ ID NO: 1068642 - protein, 9 aa, Homo Sapiens
LTLQNIGAM

SEQ ID NO: 1068643 - protein, 9 aa, Homo Sapiens
KTGMLSRVT

SEQ ID NO: 1068644 - protein, 9 aa, Homo Sapiens
RQVPGMCFA

SEQ ID NO: 1068645 - protein, 9 aa, Homo Sapiens
NQKIRDRWQ

SEQ ID NO: 1068646 - protein, 9 aa, Homo Sapiens
SHVCCNFSN

SEQ ID NO: 1068647 - protein, 9 aa, Homo Sapiens
GHNTTASGL

SEQ ID NO: 1068648 - protein, 9 aa, Homo Sapiens
ERDLVRLLS

SEQ ID NO: 1068649 - protein, 9 aa, Homo Sapiens
AINTVSFYG

SEQ ID NO: 1068650 - protein, 9 aa, Homo Sapiens
SSAKVWSRT

SEQ ID NO: 1068651 - protein, 9 aa, Homo Sapiens
PIFRTEGPI

SEQ ID NO: 1068652 - protein, 9 aa, Homo Sapiens
QLKEELAKA

SEQ ID NO: 1068653 - protein, 9 aa, Homo Sapiens
DDLIFVEEE

SEQ ID NO: 1068654 - protein, 9 aa, Homo Sapiens
LKAELLLLK

SEQ ID NO: 1068655 - protein, 9 aa, Homo Sapiens
IKLAKLSDF

SEQ ID NO: 1068656 - protein, 9 aa, Homo Sapiens
SPGRPGPLG

SEQ ID NO: 1068657 - protein, 9 aa, Homo Sapiens
LILYTITIF

SEQ ID NO: 1068658 - protein, 9 aa, Homo Sapiens
FKELEKRTI

SEQ ID NO: 1068659 - protein, 9 aa, Homo Sapiens
NSFFCPVYK

SEQ ID NO: 1068660 - protein, 9 aa, Homo Sapiens
RSAAVETAN

SEQ ID NO: 1068661 - protein, 9 aa, Homo Sapiens
QPPYSPGPA

SEQ ID NO: 1068662 - protein, 9 aa, Homo Sapiens
DMDCTAIHE

SEQ ID NO: 1068663 - protein, 9 aa, Homo Sapiens
LPTTELSSK

SEQ ID NO: 1068664 - protein, 9 aa, Homo Sapiens
AAKKAQAMC

SEQ ID NO: 1068665 - protein, 9 aa, Homo Sapiens
EEVSSHVEK

SEQ ID NO: 1068666 - protein, 9 aa, Homo Sapiens
YGRDSGNEM

SEQ ID NO: 1068667 - protein, 9 aa, Homo Sapiens
SRNTEDIPL

SEQ ID NO: 1068668 - protein, 9 aa, Homo Sapiens
CRIVLKSLE

SEQ ID NO: 1068669 - protein, 9 aa, Homo Sapiens
IFSALRTGA

SEQ ID NO: 1068670 - protein, 9 aa, Homo Sapiens
PVVQWYKHG

SEQ ID NO: 1068671 - protein, 9 aa, Homo Sapiens
RSKERSFKS

SEQ ID NO: 1068672 - protein, 9 aa, Homo Sapiens
SNNQSPTNS

SEQ ID NO: 1068673 - protein, 9 aa, Homo Sapiens
GCAFFIYLR

SEQ ID NO: 1068674 - protein, 9 aa, Homo Sapiens
VFFRRRSCP

SEQ ID NO: 1068675 - protein, 9 aa, Homo Sapiens
CGKASNRSS

SEQ ID NO: 1068676 - protein, 9 aa, Homo Sapiens
TPTGPPTYT

SEQ ID NO: 1068677 - protein, 9 aa, Homo Sapiens
PATLLYLVQ

SEQ ID NO: 1068678 - protein, 9 aa, Homo Sapiens
IIMKYLGGG

SEQ ID NO: 1068679 - protein, 9 aa, Homo Sapiens
DTVRSSADS

SEQ ID NO: 1068680 - protein, 9 aa, Homo Sapiens
ATKGCENVR

SEQ ID NO: 1068681 - protein, 9 aa, Homo Sapiens
LLIGLPNTQ

SEQ ID NO: 1068682 - protein, 9 aa, Homo Sapiens
PQHYGEPAE

SEQ ID NO: 1068683 - protein, 9 aa, Homo Sapiens
PIFTLSQRA

SEQ ID NO: 1068684 - protein, 9 aa, Homo Sapiens
LGTVREDVV

SEQ ID NO: 1068685 - protein, 9 aa, Homo Sapiens
AILVNIHSM

SEQ ID NO: 1068686 - protein, 9 aa, Homo Sapiens
NRVVMAGNC

SEQ ID NO: 1068687 - protein, 9 aa, Homo Sapiens
KLHHPFQGF

SEQ ID NO: 1068688 - protein, 9 aa, Homo Sapiens
FPSVPLVIG

SEQ ID NO: 1068689 - protein, 9 aa, Homo Sapiens
RAWLEGEIN

SEQ ID NO: 1068690 - protein, 9 aa, Homo Sapiens
NIAFNILND

SEQ ID NO: 1068691 - protein, 9 aa, Homo Sapiens
PLLSLRDEP

SEQ ID NO: 1068692 - protein, 9 aa, Homo Sapiens
DKFIQELFE

SEQ ID NO: 1068693 - protein, 9 aa, Homo Sapiens
ASSGSSASK

SEQ ID NO: 1068694 - protein, 9 aa, Homo Sapiens
PQKHRICVC

SEQ ID NO: 1068695 - protein, 9 aa, Homo Sapiens
FLYARNQAG

SEQ ID NO: 1068696 - protein, 9 aa, Homo Sapiens
LPPSELFDH

SEQ ID NO: 1068697 - protein, 9 aa, Homo Sapiens
SKLPEEDGR

SEQ ID NO: 1068698 - protein, 9 aa, Homo Sapiens
LWFEARKIS

SEQ ID NO: 1068699 - protein, 9 aa, Homo Sapiens
GSDGASPIW

SEQ ID NO: 1068700 - protein, 9 aa, Homo Sapiens
YAAWIPERF

SEQ ID NO: 1068701 - protein, 9 aa, Homo Sapiens
PEAGGINFN

SEQ ID NO: 1068702 - protein, 9 aa, Homo Sapiens
EETPLHLAA

SEQ ID NO: 1068703 - protein, 9 aa, Homo Sapiens
SCSLEKETK

SEQ ID NO: 1068704 - protein, 9 aa, Homo Sapiens
KVLGRPTTL

SEQ ID NO: 1068705 - protein, 9 aa, Homo Sapiens
LKTTDFSVQ

SEQ ID NO: 1068706 - protein, 9 aa, Homo Sapiens
HLKQIGNVK

SEQ ID NO: 1068707 - protein, 9 aa, Homo Sapiens
VNHRQQSLA

SEQ ID NO: 1068708 - protein, 9 aa, Homo Sapiens
GVALLNTSV

SEQ ID NO: 1068709 - protein, 9 aa, Homo Sapiens
IRLFDPAVP

SEQ ID NO: 1068710 - protein, 9 aa, Homo Sapiens
VVDHSLHEP

SEQ ID NO: 1068711 - protein, 9 aa, Homo Sapiens
WQNFNDASP

SEQ ID NO: 1068712 - protein, 9 aa, Homo Sapiens
WEKSSFQII

SEQ ID NO: 1068713 - protein, 9 aa, Homo Sapiens
KSASKRPSK

SEQ ID NO: 1068714 - protein, 9 aa, Homo Sapiens
LMGQAEIFY

SEQ ID NO: 1068715 - protein, 9 aa, Homo Sapiens
FLFAHKLHP

SEQ ID NO: 1068716 - protein, 9 aa, Homo Sapiens
DMISEPMDK

SEQ ID NO: 1068717 - protein, 9 aa, Homo Sapiens
NIHRAWRTF

SEQ ID NO: 1068718 - protein, 9 aa, Homo Sapiens
FSPFSGDIK

SEQ ID NO: 1068719 - protein, 9 aa, Homo Sapiens
LERDLVPED

SEQ ID NO: 1068720 - protein, 9 aa, Homo Sapiens
YPEKISSMV

SEQ ID NO: 1068721 - protein, 9 aa, Homo Sapiens
TFSRVDDHD

SEQ ID NO: 1068722 - protein, 9 aa, Homo Sapiens
LPVSNGPFN

SEQ ID NO: 1068723 - protein, 9 aa, Homo Sapiens
VISSDTRST

SEQ ID NO: 1068724 - protein, 9 aa, Homo Sapiens
SLVQKHLTT

SEQ ID NO: 1068725 - protein, 9 aa, Homo Sapiens
VYVEGKTCQ

SEQ ID NO: 1068726 - protein, 9 aa, Homo Sapiens
WDAFPGNDS

SEQ ID NO: 1068727 - protein, 9 aa, Homo Sapiens
FEAVELQDM

SEQ ID NO: 1068728 - protein, 9 aa, Homo Sapiens
SSAVLLIGL

SEQ ID NO: 1068729 - protein, 9 aa, Homo Sapiens
MAKRVAIVR

SEQ ID NO: 1068730 - protein, 9 aa, Homo Sapiens
LKKPEEEFD

SEQ ID NO: 1068731 - protein, 9 aa, Homo Sapiens
FHDVSVPQE

SEQ ID NO: 1068732 - protein, 9 aa, Homo Sapiens
LQLLNPLLG

SEQ ID NO: 1068733 - protein, 9 aa, Homo Sapiens
NLAFDMADR

SEQ ID NO: 1068734 - protein, 9 aa, Homo Sapiens
LFASVMTDE

SEQ ID NO: 1068735 - protein, 9 aa, Homo Sapiens
QKKNKLGPE

SEQ ID NO: 1068736 - protein, 9 aa, Homo Sapiens
YLVTLIENA

SEQ ID NO: 1068737 - protein, 9 aa, Homo Sapiens
CDKLPPEEE

SEQ ID NO: 1068738 - protein, 9 aa, Homo Sapiens
KAFCVDGEW

SEQ ID NO: 1068739 - protein, 9 aa, Homo Sapiens
NGKSLNGKA

SEQ ID NO: 1068740 - protein, 9 aa, Homo Sapiens
YCHEENDPE

SEQ ID NO: 1068741 - protein, 9 aa, Homo Sapiens
LWTDFCFLF

SEQ ID NO: 1068742 - protein, 9 aa, Homo Sapiens
LARETDKLW

SEQ ID NO: 1068743 - protein, 9 aa, Homo Sapiens
SLAAPIIPT

SEQ ID NO: 1068744 - protein, 9 aa, Homo Sapiens
LWNRSTPSA

SEQ ID NO: 1068745 - protein, 9 aa, Homo Sapiens
IIDEVHEQT

SEQ ID NO: 1068746 - protein, 9 aa, Homo Sapiens
PRVQIGDHS

SEQ ID NO: 1068747 - protein, 9 aa, Homo Sapiens
LFDPAVPVA

SEQ ID NO: 1068748 - protein, 9 aa, Homo Sapiens
IRIVDGYEQ

SEQ ID NO: 1068749 - protein, 9 aa, Homo Sapiens
FQASKHIKS

SEQ ID NO: 1068750 - protein, 9 aa, Homo Sapiens
HPFRDNRRS

SEQ ID NO: 1068751 - protein, 9 aa, Homo Sapiens
EKQTSSLPE

SEQ ID NO: 1068752 - protein, 9 aa, Homo Sapiens
ALLSPGTKA

SEQ ID NO: 1068753 - protein, 9 aa, Homo Sapiens
SSSPARVTW

SEQ ID NO: 1068754 - protein, 9 aa, Homo Sapiens
PSLFCKKMS

SEQ ID NO: 1068755 - protein, 9 aa, Homo Sapiens
KKNKPKNNK

SEQ ID NO: 1068756 - protein, 9 aa, Homo Sapiens
YIFFMGCFA

SEQ ID NO: 1068757 - protein, 9 aa, Homo Sapiens
LKKKASLTL

SEQ ID NO: 1068758 - protein, 9 aa, Homo Sapiens
GAYCCTGYK

SEQ ID NO: 1068759 - protein, 9 aa, Homo Sapiens
RLNASDWDE

SEQ ID NO: 1068760 - protein, 9 aa, Homo Sapiens
TKIHPSCVT

SEQ ID NO: 1068761 - protein, 9 aa, Homo Sapiens
LAIFAAESQ

SEQ ID NO: 1068762 - protein, 9 aa, Homo Sapiens
KLRQVLPTV

SEQ ID NO: 1068763 - protein, 9 aa, Homo Sapiens
KKFEEDLTG

SEQ ID NO: 1068764 - protein, 9 aa, Homo Sapiens
NWDYDTPAE

SEQ ID NO: 1068765 - protein, 9 aa, Homo Sapiens
ASINQISGK

SEQ ID NO: 1068766 - protein, 9 aa, Homo Sapiens
LRPENVFIS

SEQ ID NO: 1068767 - protein, 9 aa, Homo Sapiens
YTAEPINDS

SEQ ID NO: 1068768 - protein, 9 aa, Homo Sapiens
LSRVTLLAN

SEQ ID NO: 1068769 - protein, 9 aa, Homo Sapiens
YWGVLNSPV

SEQ ID NO: 1068770 - protein, 9 aa, Homo Sapiens
LWPRRPAWP

SEQ ID NO: 1068771 - protein, 9 aa, Homo Sapiens
GQFVMKHHT

SEQ ID NO: 1068772 - protein, 9 aa, Homo Sapiens
LYLIVVDHS

SEQ ID NO: 1068773 - protein, 9 aa, Homo Sapiens
KKLELQIGN

SEQ ID NO: 1068774 - protein, 9 aa, Homo Sapiens
VNNSGFYMC

SEQ ID NO: 1068775 - protein, 9 aa, Homo Sapiens
LAARQLQDL

SEQ ID NO: 1068776 - protein, 9 aa, Homo Sapiens
YKAMAPAYD

SEQ ID NO: 1068777 - protein, 9 aa, Homo Sapiens
LYYPNVMNM

SEQ ID NO: 1068778 - protein, 9 aa, Homo Sapiens
DYNKIFFKE

SEQ ID NO: 1068779 - protein, 9 aa, Homo Sapiens
DSVKSPPLP

SEQ ID NO: 1068780 - protein, 9 aa, Homo Sapiens
QMEGDRNVS

SEQ ID NO: 1068781 - protein, 9 aa, Homo Sapiens
PTTFARRAM

SEQ ID NO: 1068782 - protein, 9 aa, Homo Sapiens
EYKCVCDPV

SEQ ID NO: 1068783 - protein, 9 aa, Homo Sapiens
CPRMKGDWE

SEQ ID NO: 1068784 - protein, 9 aa, Homo Sapiens
LLRYTVIMN

SEQ ID NO: 1068785 - protein, 9 aa, Homo Sapiens
VLKFTTKIH

SEQ ID NO: 1068786 - protein, 9 aa, Homo Sapiens
TPSPVFLMR

SEQ ID NO: 1068787 - protein, 9 aa, Homo Sapiens
GGSLVCKAL

SEQ ID NO: 1068788 - protein, 9 aa, Homo Sapiens
VCEFVLSKG

SEQ ID NO: 1068789 - protein, 9 aa, Homo Sapiens
VTSVLAGLT

SEQ ID NO: 1068790 - protein, 9 aa, Homo Sapiens
LTITLVCEE

SEQ ID NO: 1068791 - protein, 9 aa, Homo Sapiens
FLKANMEEK

SEQ ID NO: 1068792 - protein, 9 aa, Homo Sapiens
TLLLMLIFL

SEQ ID NO: 1068793 - protein, 9 aa, Homo Sapiens
RSQGQRWIW

SEQ ID NO: 1068794 - protein, 9 aa, Homo Sapiens
RDRLDCGRP

SEQ ID NO: 1068795 - protein, 9 aa, Homo Sapiens
FILRASPSK

SEQ ID NO: 1068796 - protein, 9 aa, Homo Sapiens
RVRGGHWRW

SEQ ID NO: 1068797 - protein, 9 aa, Homo Sapiens
NYGLTDKEK

SEQ ID NO: 1068798 - protein, 9 aa, Homo Sapiens
IWKFQRTPG

SEQ ID NO: 1068799 - protein, 9 aa, Homo Sapiens
NLYMTLYDK

SEQ ID NO: 1068800 - protein, 9 aa, Homo Sapiens
RTEFYQHQH

SEQ ID NO: 1068801 - protein, 9 aa, Homo Sapiens
VEHAPAGQP

SEQ ID NO: 1068802 - protein, 9 aa, Homo Sapiens
DLWKCPSNK

SEQ ID NO: 1068803 - protein, 9 aa, Homo Sapiens
LLMIRQQAL

SEQ ID NO: 1068804 - protein, 9 aa, Homo Sapiens
TFLNEKAGE

SEQ ID NO: 1068805 - protein, 9 aa, Homo Sapiens
SFREKGQGS

SEQ ID NO: 1068806 - protein, 9 aa, Homo Sapiens
PGIGKELST

SEQ ID NO: 1068807 - protein, 9 aa, Homo Sapiens
LSTECDFHP

SEQ ID NO: 1068808 - protein, 9 aa, Homo Sapiens
SDKPQNFQI

SEQ ID NO: 1068809 - protein, 9 aa, Homo Sapiens
RSEADRDGL

SEQ ID NO: 1068810 - protein, 9 aa, Homo Sapiens
SFNTSGDKI

SEQ ID NO: 1068811 - protein, 9 aa, Homo Sapiens
EEEDKGLDS

SEQ ID NO: 1068812 - protein, 9 aa, Homo Sapiens
VQKLMGCLG

SEQ ID NO: 1068813 - protein, 9 aa, Homo Sapiens
STLKYLWLN

SEQ ID NO: 1068814 - protein, 9 aa, Homo Sapiens
LFMKEDIKA

SEQ ID NO: 1068815 - protein, 9 aa, Homo Sapiens
AGHGENVAL

SEQ ID NO: 1068816 - protein, 9 aa, Homo Sapiens
KQTLKTPEK

SEQ ID NO: 1068817 - protein, 9 aa, Homo Sapiens
EISRNTEDI

SEQ ID NO: 1068818 - protein, 9 aa, Homo Sapiens
DTFEGRRNN

SEQ ID NO: 1068819 - protein, 9 aa, Homo Sapiens
VRLIALLTK

SEQ ID NO: 1068820 - protein, 9 aa, Homo Sapiens
ILQSIQRSI

SEQ ID NO: 1068821 - protein, 9 aa, Homo Sapiens
LCVPDKDTS

SEQ ID NO: 1068822 - protein, 9 aa, Homo Sapiens
MPKMHLLFS

SEQ ID NO: 1068823 - protein, 9 aa, Homo Sapiens
EAFETTLEK

SEQ ID NO: 1068824 - protein, 9 aa, Homo Sapiens
NLTMDTYVN

SEQ ID NO: 1068825 - protein, 9 aa, Homo Sapiens
FIQTIMLFI

SEQ ID NO: 1068826 - protein, 9 aa, Homo Sapiens
FFETDTILE

SEQ ID NO: 1068827 - protein, 9 aa, Homo Sapiens
LSGPGNNVE

SEQ ID NO: 1068828 - protein, 9 aa, Homo Sapiens
VLAFTSIGN

SEQ ID NO: 1068829 - protein, 9 aa, Homo Sapiens
VTLKNGMLA

SEQ ID NO: 1068830 - protein, 9 aa, Homo Sapiens
DKADSPRHR

SEQ ID NO: 1068831 - protein, 9 aa, Homo Sapiens
YSSIRLFDP

SEQ ID NO: 1068832 - protein, 9 aa, Homo Sapiens
NGTPREQGF

SEQ ID NO: 1068833 - protein, 9 aa, Homo Sapiens
TGEKLYVCN

SEQ ID NO: 1068834 - protein, 9 aa, Homo Sapiens
SSNEQGLSY

SEQ ID NO: 1068835 - protein, 9 aa, Homo Sapiens
PASPTIISR

SEQ ID NO: 1068836 - protein, 9 aa, Homo Sapiens
GEMIFLLPF

SEQ ID NO: 1068837 - protein, 9 aa, Homo Sapiens
SDFRTLLLS

SEQ ID NO: 1068838 - protein, 9 aa, Homo Sapiens
TETEIILLM

SEQ ID NO: 1068839 - protein, 9 aa, Homo Sapiens
RAALEAHCK

SEQ ID NO: 1068840 - protein, 9 aa, Homo Sapiens
NTLAELCCG

SEQ ID NO: 1068841 - protein, 9 aa, Homo Sapiens
CPERLRLVG

SEQ ID NO: 1068842 - protein, 9 aa, Homo Sapiens
VQVMTMGND

SEQ ID NO: 1068843 - protein, 9 aa, Homo Sapiens
RKSVNWREK

SEQ ID NO: 1068844 - protein, 9 aa, Homo Sapiens
YPGVCYPVL

SEQ ID NO: 1068845 - protein, 9 aa, Homo Sapiens
SPGGAGERK

SEQ ID NO: 1068846 - protein, 9 aa, Homo Sapiens
QEKTEEYPL

SEQ ID NO: 1068847 - protein, 9 aa, Homo Sapiens
LKCGNIVVY

SEQ ID NO: 1068848 - protein, 9 aa, Homo Sapiens
AASFFFSTQ

SEQ ID NO: 1068849 - protein, 9 aa, Homo Sapiens
LVCAYNPEA

SEQ ID NO: 1068850 - protein, 9 aa, Homo Sapiens
RICRGNYPG

SEQ ID NO: 1068851 - protein, 9 aa, Homo Sapiens
WTLPRSQSM

SEQ ID NO: 1068852 - protein, 9 aa, Homo Sapiens
NEGFAMEQI

SEQ ID NO: 1068853 - protein, 9 aa, Homo Sapiens
TMQSSSTPI

SEQ ID NO: 1068854 - protein, 9 aa, Homo Sapiens
GLRQLLFSL

SEQ ID NO: 1068855 - protein, 9 aa, Homo Sapiens
NGFDHRKAM

SEQ ID NO: 1068856 - protein, 9 aa, Homo Sapiens
LAVHLKAMQ

SEQ ID NO: 1068857 - protein, 9 aa, Homo Sapiens
HFSVNWIAL

SEQ ID NO: 1068858 - protein, 9 aa, Homo Sapiens
AVVFSISVV

SEQ ID NO: 1068859 - protein, 9 aa, Homo Sapiens
LLLNKWENV

SEQ ID NO: 1068860 - protein, 9 aa, Homo Sapiens
FLFLSSSSL

SEQ ID NO: 1068861 - protein, 9 aa, Homo Sapiens
TKPKVCWSW

SEQ ID NO: 1068862 - protein, 9 aa, Homo Sapiens
LLLRGCKIR

SEQ ID NO: 1068863 - protein, 9 aa, Homo Sapiens
TERTLRLYD

SEQ ID NO: 1068864 - protein, 9 aa, Homo Sapiens
REVTMETSQ

SEQ ID NO: 1068865 - protein, 9 aa, Homo Sapiens
KKGELSIIS

SEQ ID NO: 1068866 - protein, 9 aa, Homo Sapiens
YHINQQIFR

SEQ ID NO: 1068867 - protein, 9 aa, Homo Sapiens
RRKSVLGKA

SEQ ID NO: 1068868 - protein, 9 aa, Homo Sapiens
GKKEDEVKK

SEQ ID NO: 1068869 - protein, 9 aa, Homo Sapiens
EESKIQTDA

SEQ ID NO: 1068870 - protein, 9 aa, Homo Sapiens
KIRKMQAFF

SEQ ID NO: 1068871 - protein, 9 aa, Homo Sapiens
SIVLFYIRI

SEQ ID NO: 1068872 - protein, 9 aa, Homo Sapiens
ATEEEVWKV

SEQ ID NO: 1068873 - protein, 9 aa, Homo Sapiens
LYCFVSKTT

SEQ ID NO: 1068874 - protein, 9 aa, Homo Sapiens
VRSVDLTSL

SEQ ID NO: 1068875 - protein, 9 aa, Homo Sapiens
QPWRPGIVS

SEQ ID NO: 1068876 - protein, 9 aa, Homo Sapiens
IDTYLLHMK

SEQ ID NO: 1068877 - protein, 9 aa, Homo Sapiens
SVPHGADYE

SEQ ID NO: 1068878 - protein, 9 aa, Homo Sapiens
FSSECFMDF

SEQ ID NO: 1068879 - protein, 9 aa, Homo Sapiens
GQLEERMIV

SEQ ID NO: 1068880 - protein, 9 aa, Homo Sapiens
NLKPETVYV

SEQ ID NO: 1068881 - protein, 9 aa, Homo Sapiens
QSLGQGLKF

SEQ ID NO: 1068882 - protein, 9 aa, Homo Sapiens
VRLYQKSAM

SEQ ID NO: 1068883 - protein, 9 aa, Homo Sapiens
YMGWCKARE

SEQ ID NO: 1068884 - protein, 9 aa, Homo Sapiens
IPKTKALKH

SEQ ID NO: 1068885 - protein, 9 aa, Homo Sapiens
LEERMIVTA

SEQ ID NO: 1068886 - protein, 9 aa, Homo Sapiens
KIPDNPKAS

SEQ ID NO: 1068887 - protein, 9 aa, Homo Sapiens
KKAGRPFCP

SEQ ID NO: 1068888 - protein, 9 aa, Homo Sapiens
YNCGEHPIF

SEQ ID NO: 1068889 - protein, 9 aa, Homo Sapiens
GNLWEKLRK

SEQ ID NO: 1068890 - protein, 9 aa, Homo Sapiens
VSNRVSIPW

SEQ ID NO: 1068891 - protein, 9 aa, Homo Sapiens
CQAAEEFLW

SEQ ID NO: 1068892 - protein, 9 aa, Homo Sapiens
IVMIIDEPV

SEQ ID NO: 1068893 - protein, 9 aa, Homo Sapiens
ALAEQISRN

SEQ ID NO: 1068894 - protein, 9 aa, Homo Sapiens
FQAAFTSGV

SEQ ID NO: 1068895 - protein, 9 aa, Homo Sapiens
SPPPIALAV

SEQ ID NO: 1068896 - protein, 9 aa, Homo Sapiens
AGFFRGDKV

SEQ ID NO: 1068897 - protein, 9 aa, Homo Sapiens
MSLRVYVPL

SEQ ID NO: 1068898 - protein, 9 aa, Homo Sapiens
GTDGYAAVC

SEQ ID NO: 1068899 - protein, 9 aa, Homo Sapiens
DFSFRVDEA

SEQ ID NO: 1068900 - protein, 9 aa, Homo Sapiens
PPARLPTTE

SEQ ID NO: 1068901 - protein, 9 aa, Homo Sapiens
PQKVLFRFC

SEQ ID NO: 1068902 - protein, 9 aa, Homo Sapiens
LGFYTSGFF

SEQ ID NO: 1068903 - protein, 9 aa, Homo Sapiens
HDQRHAENK

SEQ ID NO: 1068904 - protein, 9 aa, Homo Sapiens
KRLREQQKT

SEQ ID NO: 1068905 - protein, 9 aa, Homo Sapiens
IQETRTYLF

SEQ ID NO: 1068906 - protein, 9 aa, Homo Sapiens
SQFSNFLDG

SEQ ID NO: 1068907 - protein, 9 aa, Homo Sapiens
EMPEKKDLR

SEQ ID NO: 1068908 - protein, 9 aa, Homo Sapiens
ECGKTFTCF

SEQ ID NO: 1068909 - protein, 9 aa, Homo Sapiens
LQKKEEAEE

SEQ ID NO: 1068910 - protein, 9 aa, Homo Sapiens
EELLEGRFR

SEQ ID NO: 1068911 - protein, 9 aa, Homo Sapiens
AILRSATRM

SEQ ID NO: 1068912 - protein, 9 aa, Homo Sapiens
RGEDNAWII

SEQ ID NO: 1068913 - protein, 9 aa, Homo Sapiens
GASVLGLDN

SEQ ID NO: 1068914 - protein, 9 aa, Homo Sapiens
VISDSYLHT

SEQ ID NO: 1068915 - protein, 9 aa, Homo Sapiens
LYTWGEGDL

SEQ ID NO: 1068916 - protein, 9 aa, Homo Sapiens
TYPENGTDN

SEQ ID NO: 1068917 - protein, 9 aa, Homo Sapiens
GVAPFVEAF

SEQ ID NO: 1068918 - protein, 9 aa, Homo Sapiens
APPQHYGEP

SEQ ID NO: 1068919 - protein, 9 aa, Homo Sapiens
DPRGPRGPA

SEQ ID NO: 1068920 - protein, 9 aa, Homo Sapiens
GLEISLRRL

SEQ ID NO: 1068921 - protein, 9 aa, Homo Sapiens
SLSLCREPG

SEQ ID NO: 1068922 - protein, 9 aa, Homo Sapiens
NPETFNPER

SEQ ID NO: 1068923 - protein, 9 aa, Homo Sapiens
ASSEPKPTP

SEQ ID NO: 1068924 - protein, 9 aa, Homo Sapiens
VAQNKEFDK

SEQ ID NO: 1068925 - protein, 9 aa, Homo Sapiens
DPQQLFASV

SEQ ID NO: 1068926 - protein, 9 aa, Homo Sapiens
TFTKDKESY

SEQ ID NO: 1068927 - protein, 9 aa, Homo Sapiens
RKELYFCCL

SEQ ID NO: 1068928 - protein, 9 aa, Homo Sapiens
VESRLRKPP

SEQ ID NO: 1068929 - protein, 9 aa, Homo Sapiens
IERYDSHQN

SEQ ID NO: 1068930 - protein, 9 aa, Homo Sapiens
FQHRPHNQP

SEQ ID NO: 1068931 - protein, 9 aa, Homo Sapiens
EFGDSVVQY

SEQ ID NO: 1068932 - protein, 9 aa, Homo Sapiens
FRAENEKIK

SEQ ID NO: 1068933 - protein, 9 aa, Homo Sapiens
QNLQYFLDQ

SEQ ID NO: 1068934 - protein, 9 aa, Homo Sapiens
ALLKWKKFS

SEQ ID NO: 1068935 - protein, 9 aa, Homo Sapiens
NHIDPRQKE

SEQ ID NO: 1068936 - protein, 9 aa, Homo Sapiens
KLDNLNSKK

SEQ ID NO: 1068937 - protein, 9 aa, Homo Sapiens
FYCVCQQGF

SEQ ID NO: 1068938 - protein, 9 aa, Homo Sapiens
EVWHVHSLW

SEQ ID NO: 1068939 - protein, 9 aa, Homo Sapiens
WPQPVFLNP

SEQ ID NO: 1068940 - protein, 9 aa, Homo Sapiens
GDSGVFGNH

SEQ ID NO: 1068941 - protein, 9 aa, Homo Sapiens
GMVLSFMQH

SEQ ID NO: 1068942 - protein, 9 aa, Homo Sapiens
ILLGLSKFQ

SEQ ID NO: 1068943 - protein, 9 aa, Homo Sapiens
SLDNLFSKE

SEQ ID NO: 1068944 - protein, 9 aa, Homo Sapiens
WVVSNRVSI

SEQ ID NO: 1068945 - protein, 9 aa, Homo Sapiens
KKNEDCFGM

SEQ ID NO: 1068946 - protein, 9 aa, Homo Sapiens
PALHKSLHS

SEQ ID NO: 1068947 - protein, 9 aa, Homo Sapiens
TTICLIDVN

SEQ ID NO: 1068948 - protein, 9 aa, Homo Sapiens
DKKRPVIIY

SEQ ID NO: 1068949 - protein, 9 aa, Homo Sapiens
FLNDTMHRK

SEQ ID NO: 1068950 - protein, 9 aa, Homo Sapiens
GRKGLLGQR

SEQ ID NO: 1068951 - protein, 9 aa, Homo Sapiens
QVAVDVLLQ

SEQ ID NO: 1068952 - protein, 9 aa, Homo Sapiens
LVKKKKLQG

SEQ ID NO: 1068953 - protein, 9 aa, Homo Sapiens
SYSIDNNEL

SEQ ID NO: 1068954 - protein, 9 aa, Homo Sapiens
NALNSEINS

SEQ ID NO: 1068955 - protein, 9 aa, Homo Sapiens
PKTITILFV

SEQ ID NO: 1068956 - protein, 9 aa, Homo Sapiens
LKGTEISHL

SEQ ID NO: 1068957 - protein, 9 aa, Homo Sapiens
EVYTVFAPT

SEQ ID NO: 1068958 - protein, 9 aa, Homo Sapiens
SNDADTTRS

SEQ ID NO: 1068959 - protein, 9 aa, Homo Sapiens
ANEKSTMQK

SEQ ID NO: 1068960 - protein, 9 aa, Homo Sapiens
SPFHGGQYR

SEQ ID NO: 1068961 - protein, 9 aa, Homo Sapiens
KKKMELLIM

SEQ ID NO: 1068962 - protein, 9 aa, Homo Sapiens
QCLMEGSAF

SEQ ID NO: 1068963 - protein, 9 aa, Homo Sapiens
EPVKRSLET

SEQ ID NO: 1068964 - protein, 9 aa, Homo Sapiens
KRQKSGGNY

SEQ ID NO: 1068965 - protein, 9 aa, Homo Sapiens
SGDKIITGS

SEQ ID NO: 1068966 - protein, 9 aa, Homo Sapiens
AGIDTDPKL

SEQ ID NO: 1068967 - protein, 9 aa, Homo Sapiens
FWKSEVAAY

SEQ ID NO: 1068968 - protein, 9 aa, Homo Sapiens
RTARSEADR

SEQ ID NO: 1068969 - protein, 9 aa, Homo Sapiens
FEELGPATP

SEQ ID NO: 1068970 - protein, 9 aa, Homo Sapiens
QDFRTQLET

SEQ ID NO: 1068971 - protein, 9 aa, Homo Sapiens
QAHTVGTEE

SEQ ID NO: 1068972 - protein, 9 aa, Homo Sapiens
ARHCVCISF

SEQ ID NO: 1068973 - protein, 9 aa, Homo Sapiens
KWKGPQRQD

SEQ ID NO: 1068974 - protein, 9 aa, Homo Sapiens
LLSGLEVVT

SEQ ID NO: 1068975 - protein, 9 aa, Homo Sapiens
SVIIFVSHL

SEQ ID NO: 1068976 - protein, 9 aa, Homo Sapiens
PVIGLDKIL

SEQ ID NO: 1068977 - protein, 9 aa, Homo Sapiens
WTYVLAVHT

SEQ ID NO: 1068978 - protein, 9 aa, Homo Sapiens
MPVLEQYFH

SEQ ID NO: 1068979 - protein, 9 aa, Homo Sapiens
EAMIFALFP

SEQ ID NO: 1068980 - protein, 9 aa, Homo Sapiens
SLAGAQKLV

SEQ ID NO: 1068981 - protein, 9 aa, Homo Sapiens
QVPGNPVLA

SEQ ID NO: 1068982 - protein, 9 aa, Homo Sapiens
PGCRKISVL

SEQ ID NO: 1068983 - protein, 9 aa, Homo Sapiens
QGDGTVSTI

SEQ ID NO: 1068984 - protein, 9 aa, Homo Sapiens
KPGVQEEIQ

SEQ ID NO: 1068985 - protein, 9 aa, Homo Sapiens
SKIIFYRLY

SEQ ID NO: 1068986 - protein, 9 aa, Homo Sapiens
KSSSGNKND

SEQ ID NO: 1068987 - protein, 9 aa, Homo Sapiens
FIKLRRSKA

SEQ ID NO: 1068988 - protein, 9 aa, Homo Sapiens
IKNLLRSPF

SEQ ID NO: 1068989 - protein, 9 aa, Homo Sapiens
LDDSSNKTI

SEQ ID NO: 1068990 - protein, 9 aa, Homo Sapiens
DDTLVYRII

SEQ ID NO: 1068991 - protein, 9 aa, Homo Sapiens
HFTFEAVEL

SEQ ID NO: 1068992 - protein, 9 aa, Homo Sapiens
GFFHLIRLL

SEQ ID NO: 1068993 - protein, 9 aa, Homo Sapiens
GVRPSNSRP

SEQ ID NO: 1068994 - protein, 9 aa, Homo Sapiens
NQTYSTIEP

SEQ ID NO: 1068995 - protein, 9 aa, Homo Sapiens
SVRCTSHTS

SEQ ID NO: 1068996 - protein, 9 aa, Homo Sapiens
SLSSKPNQK

SEQ ID NO: 1068997 - protein, 9 aa, Homo Sapiens
KRASCNCPH

SEQ ID NO: 1068998 - protein, 9 aa, Homo Sapiens
CPFVHLSVM

SEQ ID NO: 1068999 - protein, 9 aa, Homo Sapiens
KEILEGPSL

SEQ ID NO: 1069000 - protein, 9 aa, Homo Sapiens
QLAFQHRPH

SEQ ID NO: 1069001 - protein, 9 aa, Homo Sapiens
EEVEAEGAL

SEQ ID NO: 1069002 - protein, 9 aa, Homo Sapiens
HGGKFCEGF

SEQ ID NO: 1069003 - protein, 9 aa, Homo Sapiens
ESTLKEGND

SEQ ID NO: 1069004 - protein, 9 aa, Homo Sapiens
IEKYGAFIR

SEQ ID NO: 1069005 - protein, 9 aa, Homo Sapiens
FDNEMHLKI

SEQ ID NO: 1069006 - protein, 9 aa, Homo Sapiens
DEHNVCVPK

SEQ ID NO: 1069007 - protein, 9 aa, Homo Sapiens
SCYKLTVPR

SEQ ID NO: 1069008 - protein, 9 aa, Homo Sapiens
PPPQAQAEG

SEQ ID NO: 1069009 - protein, 9 aa, Homo Sapiens
KSYKCEECS

SEQ ID NO: 1069010 - protein, 9 aa, Homo Sapiens
PEDVAKRGI

SEQ ID NO: 1069011 - protein, 9 aa, Homo Sapiens
DVPLPADGL

SEQ ID NO: 1069012 - protein, 9 aa, Homo Sapiens
CVDGEWRRL

SEQ ID NO: 1069013 - protein, 9 aa, Homo Sapiens
TLSFGSSFT

SEQ ID NO: 1069014 - protein, 9 aa, Homo Sapiens
FLFKVAFSR

SEQ ID NO: 1069015 - protein, 9 aa, Homo Sapiens
LVCKVSNFG

SEQ ID NO: 1069016 - protein, 9 aa, Homo Sapiens
SSHHQRFSI

SEQ ID NO: 1069017 - protein, 9 aa, Homo Sapiens
SLLGAEVCL

SEQ ID NO: 1069018 - protein, 9 aa, Homo Sapiens
LNHFFCEML

SEQ ID NO: 1069019 - protein, 9 aa, Homo Sapiens
HPPHHILHQ

SEQ ID NO: 1069020 - protein, 9 aa, Homo Sapiens
WQGMPDHLF

SEQ ID NO: 1069021 - protein, 9 aa, Homo Sapiens
SIASETHVV

SEQ ID NO: 1069022 - protein, 9 aa, Homo Sapiens
NFEEAFDHL

SEQ ID NO: 1069023 - protein, 9 aa, Homo Sapiens
EAERSSLLL

SEQ ID NO: 1069024 - protein, 9 aa, Homo Sapiens
KKICYQLRM

SEQ ID NO: 1069025 - protein, 9 aa, Homo Sapiens
GMCGDRAND

SEQ ID NO: 1069026 - protein, 9 aa, Homo Sapiens
VQKKYLVYR

SEQ ID NO: 1069027 - protein, 9 aa, Homo Sapiens
MSDMDCTAI

SEQ ID NO: 1069028 - protein, 9 aa, Homo Sapiens
GHCVIFYKN

SEQ ID NO: 1069029 - protein, 9 aa, Homo Sapiens
ESGELDFLK

SEQ ID NO: 1069030 - protein, 9 aa, Homo Sapiens
NSAFCFLFN

SEQ ID NO: 1069031 - protein, 9 aa, Homo Sapiens
QDSGKPRVG

SEQ ID NO: 1069032 - protein, 9 aa, Homo Sapiens
RSGEKIPVF

SEQ ID NO: 1069033 - protein, 9 aa, Homo Sapiens
PEKKDLRSS

SEQ ID NO: 1069034 - protein, 9 aa, Homo Sapiens
TKERPYGCS

SEQ ID NO: 1069035 - protein, 9 aa, Homo Sapiens
VDNAEVERL

SEQ ID NO: 1069036 - protein, 9 aa, Homo Sapiens
KPSVHVHNN

SEQ ID NO: 1069037 - protein, 9 aa, Homo Sapiens
IPYSVVQGE

SEQ ID NO: 1069038 - protein, 9 aa, Homo Sapiens
DIPPEIVSE

SEQ ID NO: 1069039 - protein, 9 aa, Homo Sapiens
GNYLLQKLS

SEQ ID NO: 1069040 - protein, 9 aa, Homo Sapiens
RASTARVVM

SEQ ID NO: 1069041 - protein, 9 aa, Homo Sapiens
AAASVSSTK

SEQ ID NO: 1069042 - protein, 9 aa, Homo Sapiens
DETGPPFYL

SEQ ID NO: 1069043 - protein, 9 aa, Homo Sapiens
NSTLSESTF

SEQ ID NO: 1069044 - protein, 9 aa, Homo Sapiens
AEGDMVWWP

SEQ ID NO: 1069045 - protein, 9 aa, Homo Sapiens
FFFVSFKGK

SEQ ID NO: 1069046 - protein, 9 aa, Homo Sapiens
KQYPTPYPE

SEQ ID NO: 1069047 - protein, 9 aa, Homo Sapiens
PFQRGTPGA

SEQ ID NO: 1069048 - protein, 9 aa, Homo Sapiens
NHVAAIYCK

SEQ ID NO: 1069049 - protein, 9 aa, Homo Sapiens
TVNLGGANM

SEQ ID NO: 1069050 - protein, 9 aa, Homo Sapiens
SPSFRELPP

SEQ ID NO: 1069051 - protein, 9 aa, Homo Sapiens
TIIISHRAC

SEQ ID NO: 1069052 - protein, 9 aa, Homo Sapiens
GGPRNPDGH

SEQ ID NO: 1069053 - protein, 9 aa, Homo Sapiens
PLDIEGAAG

SEQ ID NO: 1069054 - protein, 9 aa, Homo Sapiens
AHCKKYEQL

SEQ ID NO: 1069055 - protein, 9 aa, Homo Sapiens
EAAEVLSIS

SEQ ID NO: 1069056 - protein, 9 aa, Homo Sapiens
KMPLCGHKK

SEQ ID NO: 1069057 - protein, 9 aa, Homo Sapiens
PSELFDHLF

SEQ ID NO: 1069058 - protein, 9 aa, Homo Sapiens
DTDPKLKYP

SEQ ID NO: 1069059 - protein, 9 aa, Homo Sapiens
DPRLFFPSI

SEQ ID NO: 1069060 - protein, 9 aa, Homo Sapiens
NSKSEKRGS

SEQ ID NO: 1069061 - protein, 9 aa, Homo Sapiens
PAQTLSLLS

SEQ ID NO: 1069062 - protein, 9 aa, Homo Sapiens
LIIILAFYL

SEQ ID NO: 1069063 - protein, 9 aa, Homo Sapiens
NLRRQSRSF

SEQ ID NO: 1069064 - protein, 9 aa, Homo Sapiens
SWARERPRL

SEQ ID NO: 1069065 - protein, 9 aa, Homo Sapiens
ITLVLDEGA

SEQ ID NO: 1069066 - protein, 9 aa, Homo Sapiens
NESSGLVST

SEQ ID NO: 1069067 - protein, 9 aa, Homo Sapiens
KRDFLVDNA

SEQ ID NO: 1069068 - protein, 9 aa, Homo Sapiens
LRQIVAARR

SEQ ID NO: 1069069 - protein, 9 aa, Homo Sapiens
DVPSTSAAE

SEQ ID NO: 1069070 - protein, 9 aa, Homo Sapiens
PFYLKKYSV

SEQ ID NO: 1069071 - protein, 9 aa, Homo Sapiens
QATAIIKEV

SEQ ID NO: 1069072 - protein, 9 aa, Homo Sapiens
IHKKNLLKA

SEQ ID NO: 1069073 - protein, 9 aa, Homo Sapiens
KNDSLRYSA

SEQ ID NO: 1069074 - protein, 9 aa, Homo Sapiens
ATVVGLSLW

SEQ ID NO: 1069075 - protein, 9 aa, Homo Sapiens
LSEEKKQQE

SEQ ID NO: 1069076 - protein, 9 aa, Homo Sapiens
KVTKAKRLK

SEQ ID NO: 1069077 - protein, 9 aa, Homo Sapiens
ISIYLPSAM

SEQ ID NO: 1069078 - protein, 9 aa, Homo Sapiens
KMTETQMMI

SEQ ID NO: 1069079 - protein, 9 aa, Homo Sapiens
RALVAIGTY

SEQ ID NO: 1069080 - protein, 9 aa, Homo Sapiens
VYVSLCCFH

SEQ ID NO: 1069081 - protein, 9 aa, Homo Sapiens
QLLTWKETC

SEQ ID NO: 1069082 - protein, 9 aa, Homo Sapiens
TLAKNMELT

SEQ ID NO: 1069083 - protein, 9 aa, Homo Sapiens
AGLNIVTED

SEQ ID NO: 1069084 - protein, 9 aa, Homo Sapiens
KYFGTYFGL

SEQ ID NO: 1069085 - protein, 9 aa, Homo Sapiens
KELRDQRLA

SEQ ID NO: 1069086 - protein, 9 aa, Homo Sapiens
SFHFLFLSS

SEQ ID NO: 1069087 - protein, 9 aa, Homo Sapiens
PEAYLKENI

SEQ ID NO: 1069088 - protein, 9 aa, Homo Sapiens
TKLCDEFER

SEQ ID NO: 1069089 - protein, 9 aa, Homo Sapiens
TPAEICARN

SEQ ID NO: 1069090 - protein, 9 aa, Homo Sapiens
AICTPLYYP

SEQ ID NO: 1069091 - protein, 9 aa, Homo Sapiens
RTPVGIRYR

SEQ ID NO: 1069092 - protein, 9 aa, Homo Sapiens
FEILLWEIF

SEQ ID NO: 1069093 - protein, 9 aa, Homo Sapiens
GTFFINTKR

SEQ ID NO: 1069094 - protein, 9 aa, Homo Sapiens
SAMENQLRS

SEQ ID NO: 1069095 - protein, 9 aa, Homo Sapiens
HRHHPHAHH

SEQ ID NO: 1069096 - protein, 9 aa, Homo Sapiens
SELGLIPIY

SEQ ID NO: 1069097 - protein, 9 aa, Homo Sapiens
EEKLKTVEK

SEQ ID NO: 1069098 - protein, 9 aa, Homo Sapiens
LRVYVPLIT

SEQ ID NO: 1069099 - protein, 9 aa, Homo Sapiens
LCPYKDGAL

SEQ ID NO: 1069100 - protein, 9 aa, Homo Sapiens
LGLGAVVRS

SEQ ID NO: 1069101 - protein, 9 aa, Homo Sapiens
NPKPSFTWG

SEQ ID NO: 1069102 - protein, 9 aa, Homo Sapiens
LQMWFIYTL

SEQ ID NO: 1069103 - protein, 9 aa, Homo Sapiens
QIQPIILVA

SEQ ID NO: 1069104 - protein, 9 aa, Homo Sapiens
FDIYTLFFH

SEQ ID NO: 1069105 - protein, 9 aa, Homo Sapiens
ESRDKFIQE

SEQ ID NO: 1069106 - protein, 9 aa, Homo Sapiens
IPPHGFYQS

SEQ ID NO: 1069107 - protein, 9 aa, Homo Sapiens
NSPTDPALS

SEQ ID NO: 1069108 - protein, 9 aa, Homo Sapiens
KALVFVGEI

SEQ ID NO: 1069109 - protein, 9 aa, Homo Sapiens
TYNKGRNWD

SEQ ID NO: 1069110 - protein, 9 aa, Homo Sapiens
KENISLFAC

SEQ ID NO: 1069111 - protein, 9 aa, Homo Sapiens
YRVKKWLLS

SEQ ID NO: 1069112 - protein, 9 aa, Homo Sapiens
ALTQHKRIY

SEQ ID NO: 1069113 - protein, 9 aa, Homo Sapiens
VVEEVVKEV

SEQ ID NO: 1069114 - protein, 9 aa, Homo Sapiens
SSFLESLQT

SEQ ID NO: 1069115 - protein, 9 aa, Homo Sapiens
HQISKEYGV

SEQ ID NO: 1069116 - protein, 9 aa, Homo Sapiens
PEESPFSSH

SEQ ID NO: 1069117 - protein, 9 aa, Homo Sapiens
LQYISKPTS

SEQ ID NO: 1069118 - protein, 9 aa, Homo Sapiens
YNWTYVLAV

SEQ ID NO: 1069119 - protein, 9 aa, Homo Sapiens
LNQEVWYIL

SEQ ID NO: 1069120 - protein, 9 aa, Homo Sapiens
NSKIGDDNK

SEQ ID NO: 1069121 - protein, 9 aa, Homo Sapiens
AARRLVSTE

SEQ ID NO: 1069122 - protein, 9 aa, Homo Sapiens
DRLITLFKK

SEQ ID NO: 1069123 - protein, 9 aa, Homo Sapiens
SLHQRIYTG

SEQ ID NO: 1069124 - protein, 9 aa, Homo Sapiens
CQKWNDPRL

SEQ ID NO: 1069125 - protein, 9 aa, Homo Sapiens
DGMYQCGPA

SEQ ID NO: 1069126 - protein, 9 aa, Homo Sapiens
ETCVIQEVG

SEQ ID NO: 1069127 - protein, 9 aa, Homo Sapiens
VFASSRWQE

SEQ ID NO: 1069128 - protein, 9 aa, Homo Sapiens
PFEFLPSFP

SEQ ID NO: 1069129 - protein, 9 aa, Homo Sapiens
NLLTEETDF

SEQ ID NO: 1069130 - protein, 9 aa, Homo Sapiens
SVLLSEEDT

SEQ ID NO: 1069131 - protein, 9 aa, Homo Sapiens
PQALMGSYQ

SEQ ID NO: 1069132 - protein, 9 aa, Homo Sapiens
EVSSHVEKV

SEQ ID NO: 1069133 - protein, 9 aa, Homo Sapiens
QLTGFPGIE

SEQ ID NO: 1069134 - protein, 9 aa, Homo Sapiens
DSSSEPKAP

SEQ ID NO: 1069135 - protein, 9 aa, Homo Sapiens
KAGPGETEE

SEQ ID NO: 1069136 - protein, 9 aa, Homo Sapiens
KHIKSEQGN

SEQ ID NO: 1069137 - protein, 9 aa, Homo Sapiens
NGGSSGSTE

SEQ ID NO: 1069138 - protein, 9 aa, Homo Sapiens
DADSQQSCA

SEQ ID NO: 1069139 - protein, 9 aa, Homo Sapiens
EEEALPLHQ

SEQ ID NO: 1069140 - protein, 9 aa, Homo Sapiens
AFFSPSLLK

SEQ ID NO: 1069141 - protein, 9 aa, Homo Sapiens
IARGSLRAD

SEQ ID NO: 1069142 - protein, 9 aa, Homo Sapiens
KHNNTLLVK

SEQ ID NO: 1069143 - protein, 9 aa, Homo Sapiens
LYFFFKDPI

SEQ ID NO: 1069144 - protein, 9 aa, Homo Sapiens
SFPARVPSP

SEQ ID NO: 1069145 - protein, 9 aa, Homo Sapiens
QTHPREFQK

SEQ ID NO: 1069146 - protein, 9 aa, Homo Sapiens
YLGLFTDRA

SEQ ID NO: 1069147 - protein, 9 aa, Homo Sapiens
SCNAGLEDI

SEQ ID NO: 1069148 - protein, 9 aa, Homo Sapiens
ENVALPLKE

SEQ ID NO: 1069149 - protein, 9 aa, Homo Sapiens
ILLETKKSL

SEQ ID NO: 1069150 - protein, 9 aa, Homo Sapiens
SSRTARSEA

SEQ ID NO: 1069151 - protein, 9 aa, Homo Sapiens
DKFLFVFYT

SEQ ID NO: 1069152 - protein, 9 aa, Homo Sapiens
KGAFSENNA

SEQ ID NO: 1069153 - protein, 9 aa, Homo Sapiens
IEILGSGSN

SEQ ID NO: 1069154 - protein, 9 aa, Homo Sapiens
STRVIMSVN

SEQ ID NO: 1069155 - protein, 9 aa, Homo Sapiens
SRLRKPPGA

SEQ ID NO: 1069156 - protein, 9 aa, Homo Sapiens
KLEKLDISK

SEQ ID NO: 1069157 - protein, 9 aa, Homo Sapiens
SSLAGRPGK

SEQ ID NO: 1069158 - protein, 9 aa, Homo Sapiens
KTTDFSVQP

SEQ ID NO: 1069159 - protein, 9 aa, Homo Sapiens
LQTTDVISV

SEQ ID NO: 1069160 - protein, 9 aa, Homo Sapiens
CELCPYKDG

SEQ ID NO: 1069161 - protein, 9 aa, Homo Sapiens
AGNLGGSIY

SEQ ID NO: 1069162 - protein, 9 aa, Homo Sapiens
HNTTASGLS

SEQ ID NO: 1069163 - protein, 9 aa, Homo Sapiens
IMVYFKQHM

SEQ ID NO: 1069164 - protein, 9 aa, Homo Sapiens
LLAMAYNRF

SEQ ID NO: 1069165 - protein, 9 aa, Homo Sapiens
LLCSSFQES

SEQ ID NO: 1069166 - protein, 9 aa, Homo Sapiens
EPSVKANGL

SEQ ID NO: 1069167 - protein, 9 aa, Homo Sapiens
TDKEDGVQD

SEQ ID NO: 1069168 - protein, 9 aa, Homo Sapiens
VGNLGIIEL

SEQ ID NO: 1069169 - protein, 9 aa, Homo Sapiens
HRLVPLLNR

SEQ ID NO: 1069170 - protein, 9 aa, Homo Sapiens
IANFSSGNF

SEQ ID NO: 1069171 - protein, 9 aa, Homo Sapiens
EKEKLQREL

SEQ ID NO: 1069172 - protein, 9 aa, Homo Sapiens
FICSALEFT

SEQ ID NO: 1069173 - protein, 9 aa, Homo Sapiens
INQLYHIMM

SEQ ID NO: 1069174 - protein, 9 aa, Homo Sapiens
YLGIYLSDI

SEQ ID NO: 1069175 - protein, 9 aa, Homo Sapiens
IVLFFVYMC

SEQ ID NO: 1069176 - protein, 9 aa, Homo Sapiens
FFFKKTVLH

SEQ ID NO: 1069177 - protein, 9 aa, Homo Sapiens
LFTETEIIL

SEQ ID NO: 1069178 - protein, 9 aa, Homo Sapiens
LRGPELLGS

SEQ ID NO: 1069179 - protein, 9 aa, Homo Sapiens
KSTRIIYCN

SEQ ID NO: 1069180 - protein, 9 aa, Homo Sapiens
ESCLSPILL

SEQ ID NO: 1069181 - protein, 9 aa, Homo Sapiens
GHRCWVYIL

SEQ ID NO: 1069182 - protein, 9 aa, Homo Sapiens
SSALYFSAE

SEQ ID NO: 1069183 - protein, 9 aa, Homo Sapiens
WGGKNMELS

SEQ ID NO: 1069184 - protein, 9 aa, Homo Sapiens
VFPVFGVTL

SEQ ID NO: 1069185 - protein, 9 aa, Homo Sapiens
RKRLTASRS

SEQ ID NO: 1069186 - protein, 9 aa, Homo Sapiens
HTGICPYKC

SEQ ID NO: 1069187 - protein, 9 aa, Homo Sapiens
RPEACSDAG

SEQ ID NO: 1069188 - protein, 9 aa, Homo Sapiens
RRLGLIAVH

SEQ ID NO: 1069189 - protein, 9 aa, Homo Sapiens
PKPWPGRGG

SEQ ID NO: 1069190 - protein, 9 aa, Homo Sapiens
ILNGFDHRK

SEQ ID NO: 1069191 - protein, 9 aa, Homo Sapiens
HRADPDYNC

SEQ ID NO: 1069192 - protein, 9 aa, Homo Sapiens
MENQLRSDD

SEQ ID NO: 1069193 - protein, 9 aa, Homo Sapiens
LHMKKVGSG

SEQ ID NO: 1069194 - protein, 9 aa, Homo Sapiens
ENEDEDKDD

SEQ ID NO: 1069195 - protein, 9 aa, Homo Sapiens
VPHRPAKLG

SEQ ID NO: 1069196 - protein, 9 aa, Homo Sapiens
PLPQKRDRL

SEQ ID NO: 1069197 - protein, 9 aa, Homo Sapiens
EMKWFHKNL

SEQ ID NO: 1069198 - protein, 9 aa, Homo Sapiens
INQSFFFCV

SEQ ID NO: 1069199 - protein, 9 aa, Homo Sapiens
LVPEDETSN

SEQ ID NO: 1069200 - protein, 9 aa, Homo Sapiens
GIEVPPQFL

SEQ ID NO: 1069201 - protein, 9 aa, Homo Sapiens
MMASMLCCH

SEQ ID NO: 1069202 - protein, 9 aa, Homo Sapiens
LAYRDVPRP

SEQ ID NO: 1069203 - protein, 9 aa, Homo Sapiens
NNLTKIVPL

SEQ ID NO: 1069204 - protein, 9 aa, Homo Sapiens
LGNLLSGAI

SEQ ID NO: 1069205 - protein, 9 aa, Homo Sapiens
GVKRGSYYE

SEQ ID NO: 1069206 - protein, 9 aa, Homo Sapiens
VLSFMQHFS

SEQ ID NO: 1069207 - protein, 9 aa, Homo Sapiens
HINQQIFRM

SEQ ID NO: 1069208 - protein, 9 aa, Homo Sapiens
ASMSEFLSI

SEQ ID NO: 1069209 - protein, 9 aa, Homo Sapiens
ADGGPRVFF

SEQ ID NO: 1069210 - protein, 9 aa, Homo Sapiens
QLRKLIFEV

SEQ ID NO: 1069211 - protein, 9 aa, Homo Sapiens
HSDVATMLN

SEQ ID NO: 1069212 - protein, 9 aa, Homo Sapiens
YIILYTYSR

SEQ ID NO: 1069213 - protein, 9 aa, Homo Sapiens
KFLFLYLFL

SEQ ID NO: 1069214 - protein, 9 aa, Homo Sapiens
VVDPNDSQM

SEQ ID NO: 1069215 - protein, 9 aa, Homo Sapiens
KHRRIYTGE

SEQ ID NO: 1069216 - protein, 9 aa, Homo Sapiens
TLPPETPSS

SEQ ID NO: 1069217 - protein, 9 aa, Homo Sapiens
SLSFCGNQK

SEQ ID NO: 1069218 - protein, 9 aa, Homo Sapiens
TTAKAVQHF

SEQ ID NO: 1069219 - protein, 9 aa, Homo Sapiens
WGLQNIRVN

SEQ ID NO: 1069220 - protein, 9 aa, Homo Sapiens
RKRIYDEKM

SEQ ID NO: 1069221 - protein, 9 aa, Homo Sapiens
YDVLSMLSY

SEQ ID NO: 1069222 - protein, 9 aa, Homo Sapiens
AVLAGPGGL

SEQ ID NO: 1069223 - protein, 9 aa, Homo Sapiens
AHTVGTEET

SEQ ID NO: 1069224 - protein, 9 aa, Homo Sapiens
PRQSFEIHT

SEQ ID NO: 1069225 - protein, 9 aa, Homo Sapiens
YKLCTRSEN

SEQ ID NO: 1069226 - protein, 9 aa, Homo Sapiens
SPRNFNIAG

SEQ ID NO: 1069227 - protein, 9 aa, Homo Sapiens
RVILTSFDG

SEQ ID NO: 1069228 - protein, 9 aa, Homo Sapiens
RDDPSASAA

SEQ ID NO: 1069229 - protein, 9 aa, Homo Sapiens
FQESTAGSP

SEQ ID NO: 1069230 - protein, 9 aa, Homo Sapiens
FFCDISLLL

SEQ ID NO: 1069231 - protein, 9 aa, Homo Sapiens
IEFSQIYYD

SEQ ID NO: 1069232 - protein, 9 aa, Homo Sapiens
IPPLRLSVE

SEQ ID NO: 1069233 - protein, 9 aa, Homo Sapiens
VQEEEDKGL

SEQ ID NO: 1069234 - protein, 9 aa, Homo Sapiens
TEVRSLRVE

SEQ ID NO: 1069235 - protein, 9 aa, Homo Sapiens
YSPVTPSPP

SEQ ID NO: 1069236 - protein, 9 aa, Homo Sapiens
QRRKDKTYP

SEQ ID NO: 1069237 - protein, 9 aa, Homo Sapiens
DSASPVENT

SEQ ID NO: 1069238 - protein, 9 aa, Homo Sapiens
IIESFFPDE

SEQ ID NO: 1069239 - protein, 9 aa, Homo Sapiens
DPTAGAGIK

SEQ ID NO: 1069240 - protein, 9 aa, Homo Sapiens
SPSICGHLS

SEQ ID NO: 1069241 - protein, 9 aa, Homo Sapiens
IVILFTRKE

SEQ ID NO: 1069242 - protein, 9 aa, Homo Sapiens
SSSYHNDAR

SEQ ID NO: 1069243 - protein, 9 aa, Homo Sapiens
KNEINYLNK

SEQ ID NO: 1069244 - protein, 9 aa, Homo Sapiens
TNKESKKYR

SEQ ID NO: 1069245 - protein, 9 aa, Homo Sapiens
ESVLREGTL

SEQ ID NO: 1069246 - protein, 9 aa, Homo Sapiens
SISGAGLGV

SEQ ID NO: 1069247 - protein, 9 aa, Homo Sapiens
FRFGPHDQI

SEQ ID NO: 1069248 - protein, 9 aa, Homo Sapiens
ELDFLKANM

SEQ ID NO: 1069249 - protein, 9 aa, Homo Sapiens
HIPLFFVFL

SEQ ID NO: 1069250 - protein, 9 aa, Homo Sapiens
AGAQKLVGA

SEQ ID NO: 1069251 - protein, 9 aa, Homo Sapiens
TPPQQRCVT

SEQ ID NO: 1069252 - protein, 9 aa, Homo Sapiens
SSSSDGSIF

SEQ ID NO: 1069253 - protein, 9 aa, Homo Sapiens
AESQASESL

SEQ ID NO: 1069254 - protein, 9 aa, Homo Sapiens
RYHPIDYYW

SEQ ID NO: 1069255 - protein, 9 aa, Homo Sapiens
EEAEEEAFR

SEQ ID NO: 1069256 - protein, 9 aa, Homo Sapiens
CYQLRYTEE

SEQ ID NO: 1069257 - protein, 9 aa, Homo Sapiens
AFRAQAGRR

SEQ ID NO: 1069258 - protein, 9 aa, Homo Sapiens
EHETKIFKT

SEQ ID NO: 1069259 - protein, 9 aa, Homo Sapiens
NYAILAYAF

SEQ ID NO: 1069260 - protein, 9 aa, Homo Sapiens
WPVKLNDTG

SEQ ID NO: 1069261 - protein, 9 aa, Homo Sapiens
NTKLCDEFE

SEQ ID NO: 1069262 - protein, 9 aa, Homo Sapiens
LKDFFRAYT

SEQ ID NO: 1069263 - protein, 9 aa, Homo Sapiens
GLQNIRVNS

SEQ ID NO: 1069264 - protein, 9 aa, Homo Sapiens
WDMRRRLRE

SEQ ID NO: 1069265 - protein, 9 aa, Homo Sapiens
CNFNFFLRR

SEQ ID NO: 1069266 - protein, 9 aa, Homo Sapiens
HSITAVVGS

SEQ ID NO: 1069267 - protein, 9 aa, Homo Sapiens
LHPDVSANF

SEQ ID NO: 1069268 - protein, 9 aa, Homo Sapiens
CDLIIILAF

SEQ ID NO: 1069269 - protein, 9 aa, Homo Sapiens
ILRSLEVIL

SEQ ID NO: 1069270 - protein, 9 aa, Homo Sapiens
FRIKSKEGR

SEQ ID NO: 1069271 - protein, 9 aa, Homo Sapiens
SECQEMHRE

SEQ ID NO: 1069272 - protein, 9 aa, Homo Sapiens
SCVSGIPAD

SEQ ID NO: 1069273 - protein, 9 aa, Homo Sapiens
IQSLNSSRR

SEQ ID NO: 1069274 - protein, 9 aa, Homo Sapiens
GWFIKSTNE

SEQ ID NO: 1069275 - protein, 9 aa, Homo Sapiens
SYVRKALNI

SEQ ID NO: 1069276 - protein, 9 aa, Homo Sapiens
GKTALHIAA

SEQ ID NO: 1069277 - protein, 9 aa, Homo Sapiens
KPAGPRQNP

SEQ ID NO: 1069278 - protein, 9 aa, Homo Sapiens
TEEGHQDWK

SEQ ID NO: 1069279 - protein, 9 aa, Homo Sapiens
NRSTPSAKH

SEQ ID NO: 1069280 - protein, 9 aa, Homo Sapiens
LSLWVEYEF

SEQ ID NO: 1069281 - protein, 9 aa, Homo Sapiens
CLQDPGEGF

SEQ ID NO: 1069282 - protein, 9 aa, Homo Sapiens
QNEEITAHK

SEQ ID NO: 1069283 - protein, 9 aa, Homo Sapiens
SSIRLFDPA

SEQ ID NO: 1069284 - protein, 9 aa, Homo Sapiens
NFNANDIHE

SEQ ID NO: 1069285 - protein, 9 aa, Homo Sapiens
MTDAILQTN

SEQ ID NO: 1069286 - protein, 9 aa, Homo Sapiens
RRRPNLDSA

SEQ ID NO: 1069287 - protein, 9 aa, Homo Sapiens
HEIPTPSVQ

SEQ ID NO: 1069288 - protein, 9 aa, Homo Sapiens
VFTKKTIFM

SEQ ID NO: 1069289 - protein, 9 aa, Homo Sapiens
LGFFQNKNI

SEQ ID NO: 1069290 - protein, 9 aa, Homo Sapiens
MTNNSFFCP

SEQ ID NO: 1069291 - protein, 9 aa, Homo Sapiens
FFRHNKPVN

SEQ ID NO: 1069292 - protein, 9 aa, Homo Sapiens
FSLDIGICF

SEQ ID NO: 1069293 - protein, 9 aa, Homo Sapiens
SENIYEGQW

SEQ ID NO: 1069294 - protein, 9 aa, Homo Sapiens
NDVSSQPLW

SEQ ID NO: 1069295 - protein, 9 aa, Homo Sapiens
RNMKRGLQK

SEQ ID NO: 1069296 - protein, 9 aa, Homo Sapiens
LNGFDHRKA

SEQ ID NO: 1069297 - protein, 9 aa, Homo Sapiens
MLSRVTSVL

SEQ ID NO: 1069298 - protein, 9 aa, Homo Sapiens
IPLVLETCK

SEQ ID NO: 1069299 - protein, 9 aa, Homo Sapiens
SMLWLADLV

SEQ ID NO: 1069300 - protein, 9 aa, Homo Sapiens
LGATECFFL

SEQ ID NO: 1069301 - protein, 9 aa, Homo Sapiens
GNIASKRER

SEQ ID NO: 1069302 - protein, 9 aa, Homo Sapiens
VKSASKRPS

SEQ ID NO: 1069303 - protein, 9 aa, Homo Sapiens
ISVRPQQLF

SEQ ID NO: 1069304 - protein, 9 aa, Homo Sapiens
WAGTDCSIQ

SEQ ID NO: 1069305 - protein, 9 aa, Homo Sapiens
FELSKIIFY

SEQ ID NO: 1069306 - protein, 9 aa, Homo Sapiens
TALIQSLNS

SEQ ID NO: 1069307 - protein, 9 aa, Homo Sapiens
GFLMDKAFD

SEQ ID NO: 1069308 - protein, 9 aa, Homo Sapiens
FALVVVVPP

SEQ ID NO: 1069309 - protein, 9 aa, Homo Sapiens
LLILYTITI

SEQ ID NO: 1069310 - protein, 9 aa, Homo Sapiens
FYDGDGVCE

SEQ ID NO: 1069311 - protein, 9 aa, Homo Sapiens
PDKDDHLLS

SEQ ID NO: 1069312 - protein, 9 aa, Homo Sapiens
RKLLESHIR

SEQ ID NO: 1069313 - protein, 9 aa, Homo Sapiens
GNCPDGPRP

SEQ ID NO: 1069314 - protein, 9 aa, Homo Sapiens
LPAPDDWSS

SEQ ID NO: 1069315 - protein, 9 aa, Homo Sapiens
EAQAFLREQ

SEQ ID NO: 1069316 - protein, 9 aa, Homo Sapiens
YKFSGPSFP

SEQ ID NO: 1069317 - protein, 9 aa, Homo Sapiens
GGPLMFRGV

SEQ ID NO: 1069318 - protein, 9 aa, Homo Sapiens
NGEVIIEIS

SEQ ID NO: 1069319 - protein, 9 aa, Homo Sapiens
KSVLGKATT

SEQ ID NO: 1069320 - protein, 9 aa, Homo Sapiens
ASTARVVMW

SEQ ID NO: 1069321 - protein, 9 aa, Homo Sapiens
NQVLLFSES

SEQ ID NO: 1069322 - protein, 9 aa, Homo Sapiens
GPSPLFQQQ

SEQ ID NO: 1069323 - protein, 9 aa, Homo Sapiens
FFRAYTMDV

SEQ ID NO: 1069324 - protein, 9 aa, Homo Sapiens
SPLPKVTPT

SEQ ID NO: 1069325 - protein, 9 aa, Homo Sapiens
NGLLLTASL

SEQ ID NO: 1069326 - protein, 9 aa, Homo Sapiens
HFGTPLLVA

SEQ ID NO: 1069327 - protein, 9 aa, Homo Sapiens
YSVVQGEQI

SEQ ID NO: 1069328 - protein, 9 aa, Homo Sapiens
AQISLVAQN

SEQ ID NO: 1069329 - protein, 9 aa, Homo Sapiens
DGVWAYNCG

SEQ ID NO: 1069330 - protein, 9 aa, Homo Sapiens
AHSSRKLFL

SEQ ID NO: 1069331 - protein, 9 aa, Homo Sapiens
VLFKLDGGL

SEQ ID NO: 1069332 - protein, 9 aa, Homo Sapiens
KLDGEKETA

SEQ ID NO: 1069333 - protein, 9 aa, Homo Sapiens
VMELKKEIA

SEQ ID NO: 1069334 - protein, 9 aa, Homo Sapiens
VVSNRVSIP

SEQ ID NO: 1069335 - protein, 9 aa, Homo Sapiens
KSYSVYVYK

SEQ ID NO: 1069336 - protein, 9 aa, Homo Sapiens
QFKKNPYLH

SEQ ID NO: 1069337 - protein, 9 aa, Homo Sapiens
GAGPSGLGG

SEQ ID NO: 1069338 - protein, 9 aa, Homo Sapiens
DAAIWLGDL

SEQ ID NO: 1069339 - protein, 9 aa, Homo Sapiens
RLSPASSVS

SEQ ID NO: 1069340 - protein, 9 aa, Homo Sapiens
SVNAFRKQS

SEQ ID NO: 1069341 - protein, 9 aa, Homo Sapiens
SAVPDSIPQ

SEQ ID NO: 1069342 - protein, 9 aa, Homo Sapiens
KNKPKNNKD

SEQ ID NO: 1069343 - protein, 9 aa, Homo Sapiens
LQESIDVAS

SEQ ID NO: 1069344 - protein, 9 aa, Homo Sapiens
RILSGQKEG

SEQ ID NO: 1069345 - protein, 9 aa, Homo Sapiens
SAPGVNESP

SEQ ID NO: 1069346 - protein, 9 aa, Homo Sapiens
TMNGCRLQF

SEQ ID NO: 1069347 - protein, 9 aa, Homo Sapiens
TLFLISLMF

SEQ ID NO: 1069348 - protein, 9 aa, Homo Sapiens
QVYLSHIAW

SEQ ID NO: 1069349 - protein, 9 aa, Homo Sapiens
NNNIAPVEF

SEQ ID NO: 1069350 - protein, 9 aa, Homo Sapiens
SPDSFSFLD

SEQ ID NO: 1069351 - protein, 9 aa, Homo Sapiens
HLSKDDWRE

SEQ ID NO: 1069352 - protein, 9 aa, Homo Sapiens
KKRKEENAR

SEQ ID NO: 1069353 - protein, 9 aa, Homo Sapiens
ADSQQSCAF

SEQ ID NO: 1069354 - protein, 9 aa, Homo Sapiens
MEGEKKESL

SEQ ID NO: 1069355 - protein, 9 aa, Homo Sapiens
APRSVVFRL

SEQ ID NO: 1069356 - protein, 9 aa, Homo Sapiens
MASMLCCHE

SEQ ID NO: 1069357 - protein, 9 aa, Homo Sapiens
MKIFSKTYL

SEQ ID NO: 1069358 - protein, 9 aa, Homo Sapiens
QREDDIAKV

SEQ ID NO: 1069359 - protein, 9 aa, Homo Sapiens
PLPSGLLLP

SEQ ID NO: 1069360 - protein, 9 aa, Homo Sapiens
KKPHECDFC

SEQ ID NO: 1069361 - protein, 9 aa, Homo Sapiens
YGLTKNFSF

SEQ ID NO: 1069362 - protein, 9 aa, Homo Sapiens
SLHLEEDPN

SEQ ID NO: 1069363 - protein, 9 aa, Homo Sapiens
ERCIACTLC

SEQ ID NO: 1069364 - protein, 9 aa, Homo Sapiens
LFSSRDSNV

SEQ ID NO: 1069365 - protein, 9 aa, Homo Sapiens
VVMRNMSGR

SEQ ID NO: 1069366 - protein, 9 aa, Homo Sapiens
VENHKRTFK

SEQ ID NO: 1069367 - protein, 9 aa, Homo Sapiens
AWEARGGDR

SEQ ID NO: 1069368 - protein, 9 aa, Homo Sapiens
IAGKFLFYQ

SEQ ID NO: 1069369 - protein, 9 aa, Homo Sapiens
GNQKVANFY

SEQ ID NO: 1069370 - protein, 9 aa, Homo Sapiens
LDPFSGHTG

SEQ ID NO: 1069371 - protein, 9 aa, Homo Sapiens
NLLLISLVY

SEQ ID NO: 1069372 - protein, 9 aa, Homo Sapiens
APTKKLGGR

SEQ ID NO: 1069373 - protein, 9 aa, Homo Sapiens
IKNFLKVAA

SEQ ID NO: 1069374 - protein, 9 aa, Homo Sapiens
KDESVLREG

SEQ ID NO: 1069375 - protein, 9 aa, Homo Sapiens
LFRAMCQNG

SEQ ID NO: 1069376 - protein, 9 aa, Homo Sapiens
EKALMSPDT

SEQ ID NO: 1069377 - protein, 9 aa, Homo Sapiens
IAGNSCLVS

SEQ ID NO: 1069378 - protein, 9 aa, Homo Sapiens
IFLLPFSQP

SEQ ID NO: 1069379 - protein, 9 aa, Homo Sapiens
GILDLLNEE

SEQ ID NO: 1069380 - protein, 9 aa, Homo Sapiens
IISLKEEET

SEQ ID NO: 1069381 - protein, 9 aa, Homo Sapiens
DSSLSPVDS

SEQ ID NO: 1069382 - protein, 9 aa, Homo Sapiens
TNKALGEKL

SEQ ID NO: 1069383 - protein, 9 aa, Homo Sapiens
VLSGQTINI

SEQ ID NO: 1069384 - protein, 9 aa, Homo Sapiens
LTWKETCGH

SEQ ID NO: 1069385 - protein, 9 aa, Homo Sapiens
MYYFLSNLF

SEQ ID NO: 1069386 - protein, 9 aa, Homo Sapiens
SGGSLVCKA

SEQ ID NO: 1069387 - protein, 9 aa, Homo Sapiens
WEALLSFVD

SEQ ID NO: 1069388 - protein, 9 aa, Homo Sapiens
IAVHPFGLS

SEQ ID NO: 1069389 - protein, 9 aa, Homo Sapiens
FTHQKIYTG

SEQ ID NO: 1069390 - protein, 9 aa, Homo Sapiens
RQYWDILDG

SEQ ID NO: 1069391 - protein, 9 aa, Homo Sapiens
ITAPKMLMD

SEQ ID NO: 1069392 - protein, 9 aa, Homo Sapiens
SDTYLPVLD

SEQ ID NO: 1069393 - protein, 9 aa, Homo Sapiens
MKKNKPKNN

SEQ ID NO: 1069394 - protein, 9 aa, Homo Sapiens
RQSHCGSRS

SEQ ID NO: 1069395 - protein, 9 aa, Homo Sapiens
KELLSRTGK

SEQ ID NO: 1069396 - protein, 9 aa, Homo Sapiens
RLKDSITRR

SEQ ID NO: 1069397 - protein, 9 aa, Homo Sapiens
NTLGINLWR

SEQ ID NO: 1069398 - protein, 9 aa, Homo Sapiens
LRRLKRNQK

SEQ ID NO: 1069399 - protein, 9 aa, Homo Sapiens
WDEGANGAI

SEQ ID NO: 1069400 - protein, 9 aa, Homo Sapiens
SSKKLRVKN

SEQ ID NO: 1069401 - protein, 9 aa, Homo Sapiens
ECLAAKKAQ

SEQ ID NO: 1069402 - protein, 9 aa, Homo Sapiens
PKEDGITWT

SEQ ID NO: 1069403 - protein, 9 aa, Homo Sapiens
QMDLGDCIL

SEQ ID NO: 1069404 - protein, 9 aa, Homo Sapiens
LSLEMRKDS

SEQ ID NO: 1069405 - protein, 9 aa, Homo Sapiens
HACYSSTLG

SEQ ID NO: 1069406 - protein, 9 aa, Homo Sapiens
HVHFSGYQA

SEQ ID NO: 1069407 - protein, 9 aa, Homo Sapiens
PPGTRVRVM

SEQ ID NO: 1069408 - protein, 9 aa, Homo Sapiens
REQCLLSPE

SEQ ID NO: 1069409 - protein, 9 aa, Homo Sapiens
LPPLSDTPE

SEQ ID NO: 1069410 - protein, 9 aa, Homo Sapiens
TEPSVNLTY

SEQ ID NO: 1069411 - protein, 9 aa, Homo Sapiens
APEGAQGPG

SEQ ID NO: 1069412 - protein, 9 aa, Homo Sapiens
SRKLFLGAP

SEQ ID NO: 1069413 - protein, 9 aa, Homo Sapiens
SFPELFSEI

SEQ ID NO: 1069414 - protein, 9 aa, Homo Sapiens
QPHVVSQWS

SEQ ID NO: 1069415 - protein, 9 aa, Homo Sapiens
FVIIYSDCW

SEQ ID NO: 1069416 - protein, 9 aa, Homo Sapiens
VYVSDNIQI

SEQ ID NO: 1069417 - protein, 9 aa, Homo Sapiens
SEEVSNSLQ

SEQ ID NO: 1069418 - protein, 9 aa, Homo Sapiens
QIKKQIELK

SEQ ID NO: 1069419 - protein, 9 aa, Homo Sapiens
ILGLPPHAG

SEQ ID NO: 1069420 - protein, 9 aa, Homo Sapiens
RSRLGQKSV

SEQ ID NO: 1069421 - protein, 9 aa, Homo Sapiens
GGRARRQQA

SEQ ID NO: 1069422 - protein, 9 aa, Homo Sapiens
TRVRVMAIY

SEQ ID NO: 1069423 - protein, 9 aa, Homo Sapiens
RHSSAKVWS

SEQ ID NO: 1069424 - protein, 9 aa, Homo Sapiens
TPKQTKSYN

SEQ ID NO: 1069425 - protein, 9 aa, Homo Sapiens
PSNCSNSVS

SEQ ID NO: 1069426 - protein, 9 aa, Homo Sapiens
GDGTVSTIL

SEQ ID NO: 1069427 - protein, 9 aa, Homo Sapiens
SIIIEQPLY

SEQ ID NO: 1069428 - protein, 9 aa, Homo Sapiens
PGSEKWVYV

SEQ ID NO: 1069429 - protein, 9 aa, Homo Sapiens
TGLTSPPVS

SEQ ID NO: 1069430 - protein, 9 aa, Homo Sapiens
KEQKGEPGL

SEQ ID NO: 1069431 - protein, 9 aa, Homo Sapiens
QAEIFYAKT

SEQ ID NO: 1069432 - protein, 9 aa, Homo Sapiens
RVFFYQLSH

SEQ ID NO: 1069433 - protein, 9 aa, Homo Sapiens
FHPLSPLFH

SEQ ID NO: 1069434 - protein, 9 aa, Homo Sapiens
ELAARRRSH

SEQ ID NO: 1069435 - protein, 9 aa, Homo Sapiens
FFVSFKGKI

SEQ ID NO: 1069436 - protein, 9 aa, Homo Sapiens
LSVMYRFCT

SEQ ID NO: 1069437 - protein, 9 aa, Homo Sapiens
GSFTDVVTT

SEQ ID NO: 1069438 - protein, 9 aa, Homo Sapiens
NTLLVKASG

SEQ ID NO: 1069439 - protein, 9 aa, Homo Sapiens
ENQLRSDDP

SEQ ID NO: 1069440 - protein, 9 aa, Homo Sapiens
PHHILHQTV

SEQ ID NO: 1069441 - protein, 9 aa, Homo Sapiens
RGWEFRIIF

SEQ ID NO: 1069442 - protein, 9 aa, Homo Sapiens
EVHIVKNGG

SEQ ID NO: 1069443 - protein, 9 aa, Homo Sapiens
HDYGMLLLC

SEQ ID NO: 1069444 - protein, 9 aa, Homo Sapiens
RTLNISHNL

SEQ ID NO: 1069445 - protein, 9 aa, Homo Sapiens
RVCFGEGLP

SEQ ID NO: 1069446 - protein, 9 aa, Homo Sapiens
SILEELEKG

SEQ ID NO: 1069447 - protein, 9 aa, Homo Sapiens
VSDGLPSSE

SEQ ID NO: 1069448 - protein, 9 aa, Homo Sapiens
FLSSSSLSS

SEQ ID NO: 1069449 - protein, 9 aa, Homo Sapiens
GLVGVQGSL

SEQ ID NO: 1069450 - protein, 9 aa, Homo Sapiens
PKLKYPKGA

SEQ ID NO: 1069451 - protein, 9 aa, Homo Sapiens
DWAAEAKER

SEQ ID NO: 1069452 - protein, 9 aa, Homo Sapiens
IMAQLPQEK

SEQ ID NO: 1069453 - protein, 9 aa, Homo Sapiens
RETSLECTV

SEQ ID NO: 1069454 - protein, 9 aa, Homo Sapiens
WKSTIYYNL

SEQ ID NO: 1069455 - protein, 9 aa, Homo Sapiens
SISVQKLMG

SEQ ID NO: 1069456 - protein, 9 aa, Homo Sapiens
FFLDISCST

SEQ ID NO: 1069457 - protein, 9 aa, Homo Sapiens
IEGDWAGRS

SEQ ID NO: 1069458 - protein, 9 aa, Homo Sapiens
RNQIRVAII

SEQ ID NO: 1069459 - protein, 9 aa, Homo Sapiens
VTICDLIII

SEQ ID NO: 1069460 - protein, 9 aa, Homo Sapiens
LDCIQKVEV

SEQ ID NO: 1069461 - protein, 9 aa, Homo Sapiens
EVPPQFLRK

SEQ ID NO: 1069462 - protein, 9 aa, Homo Sapiens
FLLRNPNNK

SEQ ID NO: 1069463 - protein, 9 aa, Homo Sapiens
ELLGQRNRV

SEQ ID NO: 1069464 - protein, 9 aa, Homo Sapiens
FLEDPNFLE

SEQ ID NO: 1069465 - protein, 9 aa, Homo Sapiens
IDFSQEIPK

SEQ ID NO: 1069466 - protein, 9 aa, Homo Sapiens
AAQSSAAII

SEQ ID NO: 1069467 - protein, 9 aa, Homo Sapiens
LSILQSVSE

SEQ ID NO: 1069468 - protein, 9 aa, Homo Sapiens
RGPDGSILR

SEQ ID NO: 1069469 - protein, 9 aa, Homo Sapiens
EFALVVVVP

SEQ ID NO: 1069470 - protein, 9 aa, Homo Sapiens
TTAAAAAAS

SEQ ID NO: 1069471 - protein, 9 aa, Homo Sapiens
KKLKLDGEK

SEQ ID NO: 1069472 - protein, 9 aa, Homo Sapiens
FVLFEVISH

SEQ ID NO: 1069473 - protein, 9 aa, Homo Sapiens
SECFMDFVC

SEQ ID NO: 1069474 - protein, 9 aa, Homo Sapiens
IARSLETFT

SEQ ID NO: 1069475 - protein, 9 aa, Homo Sapiens
RSDLKETGI

SEQ ID NO: 1069476 - protein, 9 aa, Homo Sapiens
LCEECSEKI

SEQ ID NO: 1069477 - protein, 9 aa, Homo Sapiens
PLREVVSIK

SEQ ID NO: 1069478 - protein, 9 aa, Homo Sapiens
KDQNVSDDP

SEQ ID NO: 1069479 - protein, 9 aa, Homo Sapiens
SHLAVYQRI

SEQ ID NO: 1069480 - protein, 9 aa, Homo Sapiens
RTNHIGWMQ

SEQ ID NO: 1069481 - protein, 9 aa, Homo Sapiens
KFGRGQRIA

SEQ ID NO: 1069482 - protein, 9 aa, Homo Sapiens
TMEVAKHHS

SEQ ID NO: 1069483 - protein, 9 aa, Homo Sapiens
DLISTNAEQ

SEQ ID NO: 1069484 - protein, 9 aa, Homo Sapiens
EREVTMETS

SEQ ID NO: 1069485 - protein, 9 aa, Homo Sapiens
DFLEDPNFL

SEQ ID NO: 1069486 - protein, 9 aa, Homo Sapiens
FVTDSLMLN

SEQ ID NO: 1069487 - protein, 9 aa, Homo Sapiens
DLQEVEMLK

SEQ ID NO: 1069488 - protein, 9 aa, Homo Sapiens
KALDKAQEV

SEQ ID NO: 1069489 - protein, 9 aa, Homo Sapiens
ISMGHKFFQ

SEQ ID NO: 1069490 - protein, 9 aa, Homo Sapiens
QSLPPKNPF

SEQ ID NO: 1069491 - protein, 9 aa, Homo Sapiens
DFSQEIPKP

SEQ ID NO: 1069492 - protein, 9 aa, Homo Sapiens
NHFYCDNVS

SEQ ID NO: 1069493 - protein, 9 aa, Homo Sapiens
GAVASLPNR

SEQ ID NO: 1069494 - protein, 9 aa, Homo Sapiens
NALTQTVVL

SEQ ID NO: 1069495 - protein, 9 aa, Homo Sapiens
YTLCNKEVR

SEQ ID NO: 1069496 - protein, 9 aa, Homo Sapiens
VTPREKIVL

SEQ ID NO: 1069497 - protein, 9 aa, Homo Sapiens
SSKLTSNRR

SEQ ID NO: 1069498 - protein, 9 aa, Homo Sapiens
SLKKIQLQK

SEQ ID NO: 1069499 - protein, 9 aa, Homo Sapiens
FSGDIFHSQ

SEQ ID NO: 1069500 - protein, 9 aa, Homo Sapiens
HPTPPQQRC

SEQ ID NO: 1069501 - protein, 9 aa, Homo Sapiens
QETPVQSVM

SEQ ID NO: 1069502 - protein, 9 aa, Homo Sapiens
TALKLAVDQ

SEQ ID NO: 1069503 - protein, 9 aa, Homo Sapiens
AKKKTKIFS

SEQ ID NO: 1069504 - protein, 9 aa, Homo Sapiens
VDETILLLP

SEQ ID NO: 1069505 - protein, 9 aa, Homo Sapiens
DFLATVKVV

SEQ ID NO: 1069506 - protein, 9 aa, Homo Sapiens
DLDWDAFPG

SEQ ID NO: 1069507 - protein, 9 aa, Homo Sapiens
PIAGNSCLV

SEQ ID NO: 1069508 - protein, 9 aa, Homo Sapiens
IQGMTETPM

SEQ ID NO: 1069509 - protein, 9 aa, Homo Sapiens
REAAVLQKI

SEQ ID NO: 1069510 - protein, 9 aa, Homo Sapiens
QISLVAQNK

SEQ ID NO: 1069511 - protein, 9 aa, Homo Sapiens
KALQREIRM

SEQ ID NO: 1069512 - protein, 9 aa, Homo Sapiens
SSSCSGPPP

SEQ ID NO: 1069513 - protein, 9 aa, Homo Sapiens
MESLVDQDP

SEQ ID NO: 1069514 - protein, 9 aa, Homo Sapiens
SETRDLEEI

SEQ ID NO: 1069515 - protein, 9 aa, Homo Sapiens
DLSDYTALL

SEQ ID NO: 1069516 - protein, 9 aa, Homo Sapiens
EKIQKSELA

SEQ ID NO: 1069517 - protein, 9 aa, Homo Sapiens
LEFPTCCLL

SEQ ID NO: 1069518 - protein, 9 aa, Homo Sapiens
TAQTLRAWP

SEQ ID NO: 1069519 - protein, 9 aa, Homo Sapiens
VFYNIGTMF

SEQ ID NO: 1069520 - protein, 9 aa, Homo Sapiens
SPGRYSPIL

SEQ ID NO: 1069521 - protein, 9 aa, Homo Sapiens
CDKAFVRNL

SEQ ID NO: 1069522 - protein, 9 aa, Homo Sapiens
YVNCGYVTA

SEQ ID NO: 1069523 - protein, 9 aa, Homo Sapiens
QESIDVASF

SEQ ID NO: 1069524 - protein, 9 aa, Homo Sapiens
LQCSCSFHE

SEQ ID NO: 1069525 - protein, 9 aa, Homo Sapiens
SSLFLFLVL

SEQ ID NO: 1069526 - protein, 9 aa, Homo Sapiens
TFSDGCQDI

SEQ ID NO: 1069527 - protein, 9 aa, Homo Sapiens
KDILFMKED

SEQ ID NO: 1069528 - protein, 9 aa, Homo Sapiens
PSFMLILKG

SEQ ID NO: 1069529 - protein, 9 aa, Homo Sapiens
NCPDGPRPR

SEQ ID NO: 1069530 - protein, 9 aa, Homo Sapiens
HDSEMKLQT

SEQ ID NO: 1069531 - protein, 9 aa, Homo Sapiens
YALNDEIML

SEQ ID NO: 1069532 - protein, 9 aa, Homo Sapiens
TVIIREELC

SEQ ID NO: 1069533 - protein, 9 aa, Homo Sapiens
EPVKNPCSF

SEQ ID NO: 1069534 - protein, 9 aa, Homo Sapiens
QVCCASPSL

SEQ ID NO: 1069535 - protein, 9 aa, Homo Sapiens
PSICGHLSP

SEQ ID NO: 1069536 - protein, 9 aa, Homo Sapiens
KLFLGAPAA

SEQ ID NO: 1069537 - protein, 9 aa, Homo Sapiens
PEKKEVNFQ

SEQ ID NO: 1069538 - protein, 9 aa, Homo Sapiens
IHQYPGVCY

SEQ ID NO: 1069539 - protein, 9 aa, Homo Sapiens
FLFVFYTVC

SEQ ID NO: 1069540 - protein, 9 aa, Homo Sapiens
STLAPLTRR

SEQ ID NO: 1069541 - protein, 9 aa, Homo Sapiens
LVAIGTYDL

SEQ ID NO: 1069542 - protein, 9 aa, Homo Sapiens
GQRFSLFLH

SEQ ID NO: 1069543 - protein, 9 aa, Homo Sapiens
LHCRCPGSH

SEQ ID NO: 1069544 - protein, 9 aa, Homo Sapiens
DQHNNIAHM

SEQ ID NO: 1069545 - protein, 9 aa, Homo Sapiens
YHHQKMNTC

SEQ ID NO: 1069546 - protein, 9 aa, Homo Sapiens
DIRAALEAH

SEQ ID NO: 1069547 - protein, 9 aa, Homo Sapiens
ELELEGGET

SEQ ID NO: 1069548 - protein, 9 aa, Homo Sapiens
TDKEKAEEE

SEQ ID NO: 1069549 - protein, 9 aa, Homo Sapiens
SVRPQQLFG

SEQ ID NO: 1069550 - protein, 9 aa, Homo Sapiens
WEKASGKLR

SEQ ID NO: 1069551 - protein, 9 aa, Homo Sapiens
ECSEKIAGD

SEQ ID NO: 1069552 - protein, 9 aa, Homo Sapiens
RKFLFLFHH

SEQ ID NO: 1069553 - protein, 9 aa, Homo Sapiens
ELQALLFFL

SEQ ID NO: 1069554 - protein, 9 aa, Homo Sapiens
RSSKVHSSQ

SEQ ID NO: 1069555 - protein, 9 aa, Homo Sapiens
WTLSLSPSI

SEQ ID NO: 1069556 - protein, 9 aa, Homo Sapiens
LSGLTSKNK

SEQ ID NO: 1069557 - protein, 9 aa, Homo Sapiens
FQSNRYPDM

SEQ ID NO: 1069558 - protein, 9 aa, Homo Sapiens
TFARRAMDV

SEQ ID NO: 1069559 - protein, 9 aa, Homo Sapiens
RFSDTYLPV

SEQ ID NO: 1069560 - protein, 9 aa, Homo Sapiens
MMEDAEALG

SEQ ID NO: 1069561 - protein, 9 aa, Homo Sapiens
KKKEGEEEK

SEQ ID NO: 1069562 - protein, 9 aa, Homo Sapiens
PKASYDLAT

SEQ ID NO: 1069563 - protein, 9 aa, Homo Sapiens
TDPNKGARQ

SEQ ID NO: 1069564 - protein, 9 aa, Homo Sapiens
SAIAFQPVE

SEQ ID NO: 1069565 - protein, 9 aa, Homo Sapiens
FSTLMKHKI

SEQ ID NO: 1069566 - protein, 9 aa, Homo Sapiens
SRMSMKLTS

SEQ ID NO: 1069567 - protein, 9 aa, Homo Sapiens
SPLPLSSLA

SEQ ID NO: 1069568 - protein, 9 aa, Homo Sapiens
AAKPALTLS

SEQ ID NO: 1069569 - protein, 9 aa, Homo Sapiens
APSPSLCLR

SEQ ID NO: 1069570 - protein, 9 aa, Homo Sapiens
ESNPSVCEF

SEQ ID NO: 1069571 - protein, 9 aa, Homo Sapiens
PQLTAKKIC

SEQ ID NO: 1069572 - protein, 9 aa, Homo Sapiens
EDLDGNGRG

SEQ ID NO: 1069573 - protein, 9 aa, Homo Sapiens
AAHWLARRL

SEQ ID NO: 1069574 - protein, 9 aa, Homo Sapiens
ARTGIEVPP

SEQ ID NO: 1069575 - protein, 9 aa, Homo Sapiens
TLTAHKGRG

SEQ ID NO: 1069576 - protein, 9 aa, Homo Sapiens
ISDSPKKVR

SEQ ID NO: 1069577 - protein, 9 aa, Homo Sapiens
VDISLTGNP

SEQ ID NO: 1069578 - protein, 9 aa, Homo Sapiens
GVKYKSELT

SEQ ID NO: 1069579 - protein, 9 aa, Homo Sapiens
LLDGYNKFK

SEQ ID NO: 1069580 - protein, 9 aa, Homo Sapiens
VFVGEICQD

SEQ ID NO: 1069581 - protein, 9 aa, Homo Sapiens
ILVLVFGLL

SEQ ID NO: 1069582 - protein, 9 aa, Homo Sapiens
PDESQRVDF

SEQ ID NO: 1069583 - protein, 9 aa, Homo Sapiens
RTKDFKLEM

SEQ ID NO: 1069584 - protein, 9 aa, Homo Sapiens
RETDKLWRI

SEQ ID NO: 1069585 - protein, 9 aa, Homo Sapiens
QERKTEATR

SEQ ID NO: 1069586 - protein, 9 aa, Homo Sapiens
SVFFLYALV

SEQ ID NO: 1069587 - protein, 9 aa, Homo Sapiens
VAAPNLADC

SEQ ID NO: 1069588 - protein, 9 aa, Homo Sapiens
QVDNNLRFM

SEQ ID NO: 1069589 - protein, 9 aa, Homo Sapiens
VYMTWVQPR

SEQ ID NO: 1069590 - protein, 9 aa, Homo Sapiens
SISEDTPRG

SEQ ID NO: 1069591 - protein, 9 aa, Homo Sapiens
PLMLQYISK

SEQ ID NO: 1069592 - protein, 9 aa, Homo Sapiens
PRQARWILM

SEQ ID NO: 1069593 - protein, 9 aa, Homo Sapiens
KPINRRVSF

SEQ ID NO: 1069594 - protein, 9 aa, Homo Sapiens
PQPTAAHFS

SEQ ID NO: 1069595 - protein, 9 aa, Homo Sapiens
TEMEGEKKE

SEQ ID NO: 1069596 - protein, 9 aa, Homo Sapiens
TMDLSTSTL

SEQ ID NO: 1069597 - protein, 9 aa, Homo Sapiens
GGLADRLGW

SEQ ID NO: 1069598 - protein, 9 aa, Homo Sapiens
VTTMTIRTK

SEQ ID NO: 1069599 - protein, 9 aa, Homo Sapiens
LPSPGSAAS

SEQ ID NO: 1069600 - protein, 9 aa, Homo Sapiens
DPEKKEVNF

SEQ ID NO: 1069601 - protein, 9 aa, Homo Sapiens
QSFRSLLHT

SEQ ID NO: 1069602 - protein, 9 aa, Homo Sapiens
KLSESLASK

SEQ ID NO: 1069603 - protein, 9 aa, Homo Sapiens
QCKLNQEVW

SEQ ID NO: 1069604 - protein, 9 aa, Homo Sapiens
SRFLSLFWR

SEQ ID NO: 1069605 - protein, 9 aa, Homo Sapiens
IWLHDPGAS

SEQ ID NO: 1069606 - protein, 9 aa, Homo Sapiens
KKSSFLESL

SEQ ID NO: 1069607 - protein, 9 aa, Homo Sapiens
MERVSFSTA

SEQ ID NO: 1069608 - protein, 9 aa, Homo Sapiens
HPNPTLPQP

SEQ ID NO: 1069609 - protein, 9 aa, Homo Sapiens
FSPSLLKRH

SEQ ID NO: 1069610 - protein, 9 aa, Homo Sapiens
LISRQVPGM

SEQ ID NO: 1069611 - protein, 9 aa, Homo Sapiens
SPLKIWDLN

SEQ ID NO: 1069612 - protein, 9 aa, Homo Sapiens
PKHKQTDYR

SEQ ID NO: 1069613 - protein, 9 aa, Homo Sapiens
SPASASLSL

SEQ ID NO: 1069614 - protein, 9 aa, Homo Sapiens
ISSSPTLSS

SEQ ID NO: 1069615 - protein, 9 aa, Homo Sapiens
LDEIAGPGA

SEQ ID NO: 1069616 - protein, 9 aa, Homo Sapiens
CSNLYGTEW

SEQ ID NO: 1069617 - protein, 9 aa, Homo Sapiens
GLPPHAGAR

SEQ ID NO: 1069618 - protein, 9 aa, Homo Sapiens
NVCGKFFSQ

SEQ ID NO: 1069619 - protein, 9 aa, Homo Sapiens
AQAFLREQR

SEQ ID NO: 1069620 - protein, 9 aa, Homo Sapiens
HSSRKLFLG

SEQ ID NO: 1069621 - protein, 9 aa, Homo Sapiens
LFLHILESN

SEQ ID NO: 1069622 - protein, 9 aa, Homo Sapiens
GFMAQKKRV

SEQ ID NO: 1069623 - protein, 9 aa, Homo Sapiens
PPLSDTPET

SEQ ID NO: 1069624 - protein, 9 aa, Homo Sapiens
SRNHSSIVT

SEQ ID NO: 1069625 - protein, 9 aa, Homo Sapiens
AHFSATPVP

SEQ ID NO: 1069626 - protein, 9 aa, Homo Sapiens
RTEGGHFLL

SEQ ID NO: 1069627 - protein, 9 aa, Homo Sapiens
RWFKGRSSK

SEQ ID NO: 1069628 - protein, 9 aa, Homo Sapiens
FISPGSMVY

SEQ ID NO: 1069629 - protein, 9 aa, Homo Sapiens
VAYNCSMAK

SEQ ID NO: 1069630 - protein, 9 aa, Homo Sapiens
KLSDISTRY

SEQ ID NO: 1069631 - protein, 9 aa, Homo Sapiens
GPKTLKAQA

SEQ ID NO: 1069632 - protein, 9 aa, Homo Sapiens
CLKDNGAYC

SEQ ID NO: 1069633 - protein, 9 aa, Homo Sapiens
HAGWCCHDG

SEQ ID NO: 1069634 - protein, 9 aa, Homo Sapiens
SLALVGVTL

SEQ ID NO: 1069635 - protein, 9 aa, Homo Sapiens
PDNMNFSDV

SEQ ID NO: 1069636 - protein, 9 aa, Homo Sapiens
LERVLSQPP

SEQ ID NO: 1069637 - protein, 9 aa, Homo Sapiens
STTRVLDKA

SEQ ID NO: 1069638 - protein, 9 aa, Homo Sapiens
QAASGKELA

SEQ ID NO: 1069639 - protein, 9 aa, Homo Sapiens
PPSFLALSL

SEQ ID NO: 1069640 - protein, 9 aa, Homo Sapiens
LSDKPQNFQ

SEQ ID NO: 1069641 - protein, 9 aa, Homo Sapiens
PCIFVYTQP

SEQ ID NO: 1069642 - protein, 9 aa, Homo Sapiens
ATYRASLVS

SEQ ID NO: 1069643 - protein, 9 aa, Homo Sapiens
LYFCCLHWP

SEQ ID NO: 1069644 - protein, 9 aa, Homo Sapiens
ADTIRAFFV

SEQ ID NO: 1069645 - protein, 9 aa, Homo Sapiens
FNGSLVDGE

SEQ ID NO: 1069646 - protein, 9 aa, Homo Sapiens
PGQGNNFYV

SEQ ID NO: 1069647 - protein, 9 aa, Homo Sapiens
SYVVQKPGD

SEQ ID NO: 1069648 - protein, 9 aa, Homo Sapiens
ISLAGAQKL

SEQ ID NO: 1069649 - protein, 9 aa, Homo Sapiens
PPPPDLFPK

SEQ ID NO: 1069650 - protein, 9 aa, Homo Sapiens
VEKITESTA

SEQ ID NO: 1069651 - protein, 9 aa, Homo Sapiens
IIIEQPLYS

SEQ ID NO: 1069652 - protein, 9 aa, Homo Sapiens
YAFVTHPPI

SEQ ID NO: 1069653 - protein, 9 aa, Homo Sapiens
STTVNYFVL

SEQ ID NO: 1069654 - protein, 9 aa, Homo Sapiens
VSESWPYSL

SEQ ID NO: 1069655 - protein, 9 aa, Homo Sapiens
VPKLPPPLW

SEQ ID NO: 1069656 - protein, 9 aa, Homo Sapiens
YRTSSKFQL

SEQ ID NO: 1069657 - protein, 9 aa, Homo Sapiens
RQARWILML

SEQ ID NO: 1069658 - protein, 9 aa, Homo Sapiens
SWRTVFSSL

SEQ ID NO: 1069659 - protein, 9 aa, Homo Sapiens
LEEPMEEVQ

SEQ ID NO: 1069660 - protein, 9 aa, Homo Sapiens
HDSVYFPLG

SEQ ID NO: 1069661 - protein, 9 aa, Homo Sapiens
CDGLEIPDE

SEQ ID NO: 1069662 - protein, 9 aa, Homo Sapiens
IDVILDRKK

SEQ ID NO: 1069663 - protein, 9 aa, Homo Sapiens
EDSCLLPEL

SEQ ID NO: 1069664 - protein, 9 aa, Homo Sapiens
PKPSFTWGA

SEQ ID NO: 1069665 - protein, 9 aa, Homo Sapiens
DAWDMRRRL

SEQ ID NO: 1069666 - protein, 9 aa, Homo Sapiens
LSEKKSAIP

SEQ ID NO: 1069667 - protein, 9 aa, Homo Sapiens
PPTFQGRDW

SEQ ID NO: 1069668 - protein, 9 aa, Homo Sapiens
CATPSNARG

SEQ ID NO: 1069669 - protein, 9 aa, Homo Sapiens
SGDIFHSQG

SEQ ID NO: 1069670 - protein, 9 aa, Homo Sapiens
PTNLVFILD

SEQ ID NO: 1069671 - protein, 9 aa, Homo Sapiens
MCLFCQPLT

SEQ ID NO: 1069672 - protein, 9 aa, Homo Sapiens
ELHRHFLGE

SEQ ID NO: 1069673 - protein, 9 aa, Homo Sapiens
LRNQIRVAI

SEQ ID NO: 1069674 - protein, 9 aa, Homo Sapiens
ENFPVGTLL

SEQ ID NO: 1069675 - protein, 9 aa, Homo Sapiens
QRIKSQERK

SEQ ID NO: 1069676 - protein, 9 aa, Homo Sapiens
STNLFLIKI

SEQ ID NO: 1069677 - protein, 9 aa, Homo Sapiens
AENKPIKNE

SEQ ID NO: 1069678 - protein, 9 aa, Homo Sapiens
KAPRVNGAG

SEQ ID NO: 1069679 - protein, 9 aa, Homo Sapiens
GKKLFGLDT

SEQ ID NO: 1069680 - protein, 9 aa, Homo Sapiens
AFRVDSAEF

SEQ ID NO: 1069681 - protein, 9 aa, Homo Sapiens
NFYVFPGVA

SEQ ID NO: 1069682 - protein, 9 aa, Homo Sapiens
SAKVWSRTA

SEQ ID NO: 1069683 - protein, 9 aa, Homo Sapiens
EQSKNELVM

SEQ ID NO: 1069684 - protein, 9 aa, Homo Sapiens
SSAVLPSPS

SEQ ID NO: 1069685 - protein, 9 aa, Homo Sapiens
IPGHRCWVY

SEQ ID NO: 1069686 - protein, 9 aa, Homo Sapiens
KYRLKAELE

SEQ ID NO: 1069687 - protein, 9 aa, Homo Sapiens
LDKIYLIGR

SEQ ID NO: 1069688 - protein, 9 aa, Homo Sapiens
HDVNHPGRT

SEQ ID NO: 1069689 - protein, 9 aa, Homo Sapiens
TLIENAIII

SEQ ID NO: 1069690 - protein, 9 aa, Homo Sapiens
EEVYTVFAP

SEQ ID NO: 1069691 - protein, 9 aa, Homo Sapiens
FVGGLRYKA

SEQ ID NO: 1069692 - protein, 9 aa, Homo Sapiens
MRRLRQELL

SEQ ID NO: 1069693 - protein, 9 aa, Homo Sapiens
KILDDLFFH

SEQ ID NO: 1069694 - protein, 9 aa, Homo Sapiens
SGCDGLEIP

SEQ ID NO: 1069695 - protein, 9 aa, Homo Sapiens
DPKLHHPFQ

SEQ ID NO: 1069696 - protein, 9 aa, Homo Sapiens
HTKPRRKPE

SEQ ID NO: 1069697 - protein, 9 aa, Homo Sapiens
HLRRDSKKK

SEQ ID NO: 1069698 - protein, 9 aa, Homo Sapiens
SAALSLLLP

SEQ ID NO: 1069699 - protein, 9 aa, Homo Sapiens
VARLVLSKL

SEQ ID NO: 1069700 - protein, 9 aa, Homo Sapiens
LEQYFHPAE

SEQ ID NO: 1069701 - protein, 9 aa, Homo Sapiens
PTKKLGGRE

SEQ ID NO: 1069702 - protein, 9 aa, Homo Sapiens
HCRRSCYLT

SEQ ID NO: 1069703 - protein, 9 aa, Homo Sapiens
QARTLSAFF

SEQ ID NO: 1069704 - protein, 9 aa, Homo Sapiens
PMDKNCYEQ

SEQ ID NO: 1069705 - protein, 9 aa, Homo Sapiens
VSPSTAIEQ

SEQ ID NO: 1069706 - protein, 9 aa, Homo Sapiens
FFSSEESKI

SEQ ID NO: 1069707 - protein, 9 aa, Homo Sapiens
ILEAAKLKL

SEQ ID NO: 1069708 - protein, 9 aa, Homo Sapiens
SAERRNKAF

SEQ ID NO: 1069709 - protein, 9 aa, Homo Sapiens
APKSPSRES

SEQ ID NO: 1069710 - protein, 9 aa, Homo Sapiens
PRGPLNPDF

SEQ ID NO: 1069711 - protein, 9 aa, Homo Sapiens
SIMGKFVKV

SEQ ID NO: 1069712 - protein, 9 aa, Homo Sapiens
ELLLLKLKF

SEQ ID NO: 1069713 - protein, 9 aa, Homo Sapiens
GEQLLQLDE

SEQ ID NO: 1069714 - protein, 9 aa, Homo Sapiens
ISIILAEAI

SEQ ID NO: 1069715 - protein, 9 aa, Homo Sapiens
SIDVASFTT

SEQ ID NO: 1069716 - protein, 9 aa, Homo Sapiens
FIWEPPRKE

SEQ ID NO: 1069717 - protein, 9 aa, Homo Sapiens
QRGILFVYD

SEQ ID NO: 1069718 - protein, 9 aa, Homo Sapiens
SVFSPVERE

SEQ ID NO: 1069719 - protein, 9 aa, Homo Sapiens
AMKKNKPKN

SEQ ID NO: 1069720 - protein, 9 aa, Homo Sapiens
NLAIKDLKE

SEQ ID NO: 1069721 - protein, 9 aa, Homo Sapiens
RVTQVMRDF

SEQ ID NO: 1069722 - protein, 9 aa, Homo Sapiens
KPSKNPERE

SEQ ID NO: 1069723 - protein, 9 aa, Homo Sapiens
DDNKNLTFK

SEQ ID NO: 1069724 - protein, 9 aa, Homo Sapiens
VTNQNISIY

SEQ ID NO: 1069725 - protein, 9 aa, Homo Sapiens
KNPERELGD

SEQ ID NO: 1069726 - protein, 9 aa, Homo Sapiens
NVAVLPGIY

SEQ ID NO: 1069727 - protein, 9 aa, Homo Sapiens
PVVYGDIIV

SEQ ID NO: 1069728 - protein, 9 aa, Homo Sapiens
KTEAKIAEK

SEQ ID NO: 1069729 - protein, 9 aa, Homo Sapiens
EAEFKDYST

SEQ ID NO: 1069730 - protein, 9 aa, Homo Sapiens
FTYNNLCVS

SEQ ID NO: 1069731 - protein, 9 aa, Homo Sapiens
AALYAAWIP

SEQ ID NO: 1069732 - protein, 9 aa, Homo Sapiens
EERLYYLIT

SEQ ID NO: 1069733 - protein, 9 aa, Homo Sapiens
GPGLENRGL

SEQ ID NO: 1069734 - protein, 9 aa, Homo Sapiens
YIGVTYKNK

SEQ ID NO: 1069735 - protein, 9 aa, Homo Sapiens
VGPLQPPFP

SEQ ID NO: 1069736 - protein, 9 aa, Homo Sapiens
TASSLTTSR

SEQ ID NO: 1069737 - protein, 9 aa, Homo Sapiens
TGDLLPGHG

SEQ ID NO: 1069738 - protein, 9 aa, Homo Sapiens
KKIQLQKDP

SEQ ID NO: 1069739 - protein, 9 aa, Homo Sapiens
TSTAEEKLC

SEQ ID NO: 1069740 - protein, 9 aa, Homo Sapiens
TPPTPQPFC

SEQ ID NO: 1069741 - protein, 9 aa, Homo Sapiens
NGRGDICKD

SEQ ID NO: 1069742 - protein, 9 aa, Homo Sapiens
SRRERERSP

SEQ ID NO: 1069743 - protein, 9 aa, Homo Sapiens
LLEVPQRTN

SEQ ID NO: 1069744 - protein, 9 aa, Homo Sapiens
DHFSLFSTF

SEQ ID NO: 1069745 - protein, 9 aa, Homo Sapiens
GNNEGFAME

SEQ ID NO: 1069746 - protein, 9 aa, Homo Sapiens
ANSWDGEAG

SEQ ID NO: 1069747 - protein, 9 aa, Homo Sapiens
ENIYEGQWE

SEQ ID NO: 1069748 - protein, 9 aa, Homo Sapiens
SCVDGFEEP

SEQ ID NO: 1069749 - protein, 9 aa, Homo Sapiens
LEPVKRSLE

SEQ ID NO: 1069750 - protein, 9 aa, Homo Sapiens
IIKGCEILL

SEQ ID NO: 1069751 - protein, 9 aa, Homo Sapiens
DLPLPSELP

SEQ ID NO: 1069752 - protein, 9 aa, Homo Sapiens
GIIRDCLIQ

SEQ ID NO: 1069753 - protein, 9 aa, Homo Sapiens
TLLEFWKKT

SEQ ID NO: 1069754 - protein, 9 aa, Homo Sapiens
PASPRQLTT

SEQ ID NO: 1069755 - protein, 9 aa, Homo Sapiens
ELPNMLVYR

SEQ ID NO: 1069756 - protein, 9 aa, Homo Sapiens
LLRSPFIKL

SEQ ID NO: 1069757 - protein, 9 aa, Homo Sapiens
KIRIYIFLN

SEQ ID NO: 1069758 - protein, 9 aa, Homo Sapiens
LPSGFMSFD

SEQ ID NO: 1069759 - protein, 9 aa, Homo Sapiens
SSCSLEKET

SEQ ID NO: 1069760 - protein, 9 aa, Homo Sapiens
IYSVEKPYK

SEQ ID NO: 1069761 - protein, 9 aa, Homo Sapiens
DSPAHKVTG

SEQ ID NO: 1069762 - protein, 9 aa, Homo Sapiens
YVDNPNKTA

SEQ ID NO: 1069763 - protein, 9 aa, Homo Sapiens
SSMSYYQRP

SEQ ID NO: 1069764 - protein, 9 aa, Homo Sapiens
EEEFDSHGD

SEQ ID NO: 1069765 - protein, 9 aa, Homo Sapiens
LRYTNLIRP

SEQ ID NO: 1069766 - protein, 9 aa, Homo Sapiens
NPTLPQPQR

SEQ ID NO: 1069767 - protein, 9 aa, Homo Sapiens
DPKMRIRFT

SEQ ID NO: 1069768 - protein, 9 aa, Homo Sapiens
RDLWKCPSN

SEQ ID NO: 1069769 - protein, 9 aa, Homo Sapiens
LLGQRNRVE

SEQ ID NO: 1069770 - protein, 9 aa, Homo Sapiens
SEVSEESHK

SEQ ID NO: 1069771 - protein, 9 aa, Homo Sapiens
AFLVSSPCM

SEQ ID NO: 1069772 - protein, 9 aa, Homo Sapiens
IQELVRITH

SEQ ID NO: 1069773 - protein, 9 aa, Homo Sapiens
NITRSKAKE

SEQ ID NO: 1069774 - protein, 9 aa, Homo Sapiens
SSCNNNPKI

SEQ ID NO: 1069775 - protein, 9 aa, Homo Sapiens
KHKIIYSVE

SEQ ID NO: 1069776 - protein, 9 aa, Homo Sapiens
FTVKIWDIK

SEQ ID NO: 1069777 - protein, 9 aa, Homo Sapiens
MIKEALEKL

SEQ ID NO: 1069778 - protein, 9 aa, Homo Sapiens
PDGPSQPDP

SEQ ID NO: 1069779 - protein, 9 aa, Homo Sapiens
ELEDLLERI

SEQ ID NO: 1069780 - protein, 9 aa, Homo Sapiens
MKRGWEFRI

SEQ ID NO: 1069781 - protein, 9 aa, Homo Sapiens
FIPVISQPQ

SEQ ID NO: 1069782 - protein, 9 aa, Homo Sapiens
SEEGAACGE

SEQ ID NO: 1069783 - protein, 9 aa, Homo Sapiens
TLGYVISLA

SEQ ID NO: 1069784 - protein, 9 aa, Homo Sapiens
GGARAASAP

SEQ ID NO: 1069785 - protein, 9 aa, Homo Sapiens
DNWMENIDV

SEQ ID NO: 1069786 - protein, 9 aa, Homo Sapiens
LDSFFCDLS

SEQ ID NO: 1069787 - protein, 9 aa, Homo Sapiens
PTKLLGCVS

SEQ ID NO: 1069788 - protein, 9 aa, Homo Sapiens
KRNLEISGK

SEQ ID NO: 1069789 - protein, 9 aa, Homo Sapiens
ESESGSNSW

SEQ ID NO: 1069790 - protein, 9 aa, Homo Sapiens
GTCILSPKR

SEQ ID NO: 1069791 - protein, 9 aa, Homo Sapiens
MLIYSGIKP

SEQ ID NO: 1069792 - protein, 9 aa, Homo Sapiens
LFYMKDVCY

SEQ ID NO: 1069793 - protein, 9 aa, Homo Sapiens
SALVLGPLK

SEQ ID NO: 1069794 - protein, 9 aa, Homo Sapiens
SCPPGLEHL

SEQ ID NO: 1069795 - protein, 9 aa, Homo Sapiens
VIGKTYFQV

SEQ ID NO: 1069796 - protein, 9 aa, Homo Sapiens
QMNDLETCV

SEQ ID NO: 1069797 - protein, 9 aa, Homo Sapiens
EEWLFFFLW

SEQ ID NO: 1069798 - protein, 9 aa, Homo Sapiens
FKTTVFSGV

SEQ ID NO: 1069799 - protein, 9 aa, Homo Sapiens
GTLGKEERK

SEQ ID NO: 1069800 - protein, 9 aa, Homo Sapiens
RENPNWLVV

SEQ ID NO: 1069801 - protein, 9 aa, Homo Sapiens
HVLLEELHH

SEQ ID NO: 1069802 - protein, 9 aa, Homo Sapiens
KLNSNSVVL

SEQ ID NO: 1069803 - protein, 9 aa, Homo Sapiens
PLPGSSGGG

SEQ ID NO: 1069804 - protein, 9 aa, Homo Sapiens
RLFDPAVPV

SEQ ID NO: 1069805 - protein, 9 aa, Homo Sapiens
RNVSPVPPA

SEQ ID NO: 1069806 - protein, 9 aa, Homo Sapiens
SSDPLETRP

SEQ ID NO: 1069807 - protein, 9 aa, Homo Sapiens
ESSQKNTIV

SEQ ID NO: 1069808 - protein, 9 aa, Homo Sapiens
RQPHVVSQW

SEQ ID NO: 1069809 - protein, 9 aa, Homo Sapiens
DKATLENKW

SEQ ID NO: 1069810 - protein, 9 aa, Homo Sapiens
FARSKAIYV

SEQ ID NO: 1069811 - protein, 9 aa, Homo Sapiens
EKSFICTEC

SEQ ID NO: 1069812 - protein, 9 aa, Homo Sapiens
LDFLKANME

SEQ ID NO: 1069813 - protein, 9 aa, Homo Sapiens
EGNASCTVN

SEQ ID NO: 1069814 - protein, 9 aa, Homo Sapiens
ETCGHRDPG

SEQ ID NO: 1069815 - protein, 9 aa, Homo Sapiens
EEALPLHQV

SEQ ID NO: 1069816 - protein, 9 aa, Homo Sapiens
RFSDGRLCS

SEQ ID NO: 1069817 - protein, 9 aa, Homo Sapiens
VHSLWVCVD

SEQ ID NO: 1069818 - protein, 9 aa, Homo Sapiens
LTKHKIIYT

SEQ ID NO: 1069819 - protein, 9 aa, Homo Sapiens
VWTYSNTRC

SEQ ID NO: 1069820 - protein, 9 aa, Homo Sapiens
LTKHKIIYS

SEQ ID NO: 1069821 - protein, 9 aa, Homo Sapiens
ERGQKGRPG

SEQ ID NO: 1069822 - protein, 9 aa, Homo Sapiens
FGTPLLVAC

SEQ ID NO: 1069823 - protein, 9 aa, Homo Sapiens
TSAFHFSGL

SEQ ID NO: 1069824 - protein, 9 aa, Homo Sapiens
SSGGRSSAL

SEQ ID NO: 1069825 - protein, 9 aa, Homo Sapiens
QAEIENSLE

SEQ ID NO: 1069826 - protein, 9 aa, Homo Sapiens
TKHRRIYTG

SEQ ID NO: 1069827 - protein, 9 aa, Homo Sapiens
VPSEEGAAC

SEQ ID NO: 1069828 - protein, 9 aa, Homo Sapiens
SLQYVFNQG

SEQ ID NO: 1069829 - protein, 9 aa, Homo Sapiens
KSWTGQELS

SEQ ID NO: 1069830 - protein, 9 aa, Homo Sapiens
ERSQTVMCS

SEQ ID NO: 1069831 - protein, 9 aa, Homo Sapiens
ATDDSALWV

SEQ ID NO: 1069832 - protein, 9 aa, Homo Sapiens
FLGKVCPFV

SEQ ID NO: 1069833 - protein, 9 aa, Homo Sapiens
EGDRNVSPV

SEQ ID NO: 1069834 - protein, 9 aa, Homo Sapiens
LNLKEDKNQ

SEQ ID NO: 1069835 - protein, 9 aa, Homo Sapiens
FTISVTDIN

SEQ ID NO: 1069836 - protein, 9 aa, Homo Sapiens
STTFSRVDD

SEQ ID NO: 1069837 - protein, 9 aa, Homo Sapiens
KRKYKLRYR

SEQ ID NO: 1069838 - protein, 9 aa, Homo Sapiens
PVHDSYEKQ

SEQ ID NO: 1069839 - protein, 9 aa, Homo Sapiens
LWPVFSPLH

SEQ ID NO: 1069840 - protein, 9 aa, Homo Sapiens
RGPKEQKGE

SEQ ID NO: 1069841 - protein, 9 aa, Homo Sapiens
AKYYREPQK

SEQ ID NO: 1069842 - protein, 9 aa, Homo Sapiens
LLIKRLTFS

SEQ ID NO: 1069843 - protein, 9 aa, Homo Sapiens
SLALPALEA

SEQ ID NO: 1069844 - protein, 9 aa, Homo Sapiens
VEEEGAVST

SEQ ID NO: 1069845 - protein, 9 aa, Homo Sapiens
SEFSAFRAE

SEQ ID NO: 1069846 - protein, 9 aa, Homo Sapiens
PTLEGGLVA

SEQ ID NO: 1069847 - protein, 9 aa, Homo Sapiens
LVMNATLKN

SEQ ID NO: 1069848 - protein, 9 aa, Homo Sapiens
QKNVAPGIF

SEQ ID NO: 1069849 - protein, 9 aa, Homo Sapiens
REEAIKKQY

SEQ ID NO: 1069850 - protein, 9 aa, Homo Sapiens
AQMGQPQAL

SEQ ID NO: 1069851 - protein, 9 aa, Homo Sapiens
ESLLLDDYV

SEQ ID NO: 1069852 - protein, 9 aa, Homo Sapiens
FLSNGQRRE

SEQ ID NO: 1069853 - protein, 9 aa, Homo Sapiens
SSPEGTRKL

SEQ ID NO: 1069854 - protein, 9 aa, Homo Sapiens
NGPLSSDIQ

SEQ ID NO: 1069855 - protein, 9 aa, Homo Sapiens
EEALCQLQK

SEQ ID NO: 1069856 - protein, 9 aa, Homo Sapiens
KFSPGHVIV

SEQ ID NO: 1069857 - protein, 9 aa, Homo Sapiens
VVQGEQIQL

SEQ ID NO: 1069858 - protein, 9 aa, Homo Sapiens
EVDMIKEAL

SEQ ID NO: 1069859 - protein, 9 aa, Homo Sapiens
GNEGPPGSP

SEQ ID NO: 1069860 - protein, 9 aa, Homo Sapiens
PPSHARYLS

SEQ ID NO: 1069861 - protein, 9 aa, Homo Sapiens
KTAEHTGKG

SEQ ID NO: 1069862 - protein, 9 aa, Homo Sapiens
RALLRPVFV

SEQ ID NO: 1069863 - protein, 9 aa, Homo Sapiens
FRWPQENKN

SEQ ID NO: 1069864 - protein, 9 aa, Homo Sapiens
NKLGPETFL

SEQ ID NO: 1069865 - protein, 9 aa, Homo Sapiens
ILGRHSQKR

SEQ ID NO: 1069866 - protein, 9 aa, Homo Sapiens
PDVPSTSAA

SEQ ID NO: 1069867 - protein, 9 aa, Homo Sapiens
QVLDPRTTM

SEQ ID NO: 1069868 - protein, 9 aa, Homo Sapiens
GAASRQNSG

SEQ ID NO: 1069869 - protein, 9 aa, Homo Sapiens
SHTSQASHE

SEQ ID NO: 1069870 - protein, 9 aa, Homo Sapiens
ADNPELSAF

SEQ ID NO: 1069871 - protein, 9 aa, Homo Sapiens
VQEHGAKLK

SEQ ID NO: 1069872 - protein, 9 aa, Homo Sapiens
IDEVDKRVY

SEQ ID NO: 1069873 - protein, 9 aa, Homo Sapiens
PKKSQKESV

SEQ ID NO: 1069874 - protein, 9 aa, Homo Sapiens
HRQSYGPFL

SEQ ID NO: 1069875 - protein, 9 aa, Homo Sapiens
RDHQEVNTK

SEQ ID NO: 1069876 - protein, 9 aa, Homo Sapiens
FLFHHTKAN

SEQ ID NO: 1069877 - protein, 9 aa, Homo Sapiens
GLKLTRVTV

SEQ ID NO: 1069878 - protein, 9 aa, Homo Sapiens
PQSMAFALL

SEQ ID NO: 1069879 - protein, 9 aa, Homo Sapiens
LCGQLNTTC

SEQ ID NO: 1069880 - protein, 9 aa, Homo Sapiens
SSRDFIQCF

SEQ ID NO: 1069881 - protein, 9 aa, Homo Sapiens
QKQEKTCRA

SEQ ID NO: 1069882 - protein, 9 aa, Homo Sapiens
AQQRMPAIL

SEQ ID NO: 1069883 - protein, 9 aa, Homo Sapiens
PPPGKPQRP

SEQ ID NO: 1069884 - protein, 9 aa, Homo Sapiens
NLGEEKNGY

SEQ ID NO: 1069885 - protein, 9 aa, Homo Sapiens
LVFPVFGVT

SEQ ID NO: 1069886 - protein, 9 aa, Homo Sapiens
LGCPSFFIS

SEQ ID NO: 1069887 - protein, 9 aa, Homo Sapiens
GSDQAIITP

SEQ ID NO: 1069888 - protein, 9 aa, Homo Sapiens
TKSHLFRAM

SEQ ID NO: 1069889 - protein, 9 aa, Homo Sapiens
TAEHTGKGR

SEQ ID NO: 1069890 - protein, 9 aa, Homo Sapiens
NNIRSCCLA

SEQ ID NO: 1069891 - protein, 9 aa, Homo Sapiens
PELSAFHCP

SEQ ID NO: 1069892 - protein, 9 aa, Homo Sapiens
VVKVTLSYK

SEQ ID NO: 1069893 - protein, 9 aa, Homo Sapiens
GACPLPSGL

SEQ ID NO: 1069894 - protein, 9 aa, Homo Sapiens
AGYAHRQSY

SEQ ID NO: 1069895 - protein, 9 aa, Homo Sapiens
GLPDQSFEN

SEQ ID NO: 1069896 - protein, 9 aa, Homo Sapiens
KEPSACSRE

SEQ ID NO: 1069897 - protein, 9 aa, Homo Sapiens
RHPELRRTE

SEQ ID NO: 1069898 - protein, 9 aa, Homo Sapiens
FQDDDDGPV

SEQ ID NO: 1069899 - protein, 9 aa, Homo Sapiens
LRELQVQNS

SEQ ID NO: 1069900 - protein, 9 aa, Homo Sapiens
TWKETCGHR

SEQ ID NO: 1069901 - protein, 9 aa, Homo Sapiens
VILKKAREF

SEQ ID NO: 1069902 - protein, 9 aa, Homo Sapiens
SLDDETVNE

SEQ ID NO: 1069903 - protein, 9 aa, Homo Sapiens
LLKLKFGLI

SEQ ID NO: 1069904 - protein, 9 aa, Homo Sapiens
CNVIYNVNN

SEQ ID NO: 1069905 - protein, 9 aa, Homo Sapiens
AVAHACYSS

SEQ ID NO: 1069906 - protein, 9 aa, Homo Sapiens
SEASFLETS

SEQ ID NO: 1069907 - protein, 9 aa, Homo Sapiens
KQTTKKLTE

SEQ ID NO: 1069908 - protein, 9 aa, Homo Sapiens
TRKLAPCIL

SEQ ID NO: 1069909 - protein, 9 aa, Homo Sapiens
KICYQLRMS

SEQ ID NO: 1069910 - protein, 9 aa, Homo Sapiens
FTPQNDITP

SEQ ID NO: 1069911 - protein, 9 aa, Homo Sapiens
MTETPMVAA

SEQ ID NO: 1069912 - protein, 9 aa, Homo Sapiens
GLLIATSST

SEQ ID NO: 1069913 - protein, 9 aa, Homo Sapiens
LEDLAADCI

SEQ ID NO: 1069914 - protein, 9 aa, Homo Sapiens
NHIGWMQEF

SEQ ID NO: 1069915 - protein, 9 aa, Homo Sapiens
VNLIIRLEQ

SEQ ID NO: 1069916 - protein, 9 aa, Homo Sapiens
SYGPLDKWR

SEQ ID NO: 1069917 - protein, 9 aa, Homo Sapiens
KVKYVHNGC

SEQ ID NO: 1069918 - protein, 9 aa, Homo Sapiens
GQPKPVKPF

SEQ ID NO: 1069919 - protein, 9 aa, Homo Sapiens
PALEKPICL

SEQ ID NO: 1069920 - protein, 9 aa, Homo Sapiens
LLVGYKLGI

SEQ ID NO: 1069921 - protein, 9 aa, Homo Sapiens
ERREKGEAG

SEQ ID NO: 1069922 - protein, 9 aa, Homo Sapiens
TSSRTPSTF

SEQ ID NO: 1069923 - protein, 9 aa, Homo Sapiens
CSNRNFIDH

SEQ ID NO: 1069924 - protein, 9 aa, Homo Sapiens
HPLRYTIII

SEQ ID NO: 1069925 - protein, 9 aa, Homo Sapiens
VCFFPEKDH

SEQ ID NO: 1069926 - protein, 9 aa, Homo Sapiens
KDLKKHVLQ

SEQ ID NO: 1069927 - protein, 9 aa, Homo Sapiens
FYPNGENKQ

SEQ ID NO: 1069928 - protein, 9 aa, Homo Sapiens
EGQPWQTMA

SEQ ID NO: 1069929 - protein, 9 aa, Homo Sapiens
SPVFLMRAN

SEQ ID NO: 1069930 - protein, 9 aa, Homo Sapiens
PVPRPCLYS

SEQ ID NO: 1069931 - protein, 9 aa, Homo Sapiens
LQDPGEGFR

SEQ ID NO: 1069932 - protein, 9 aa, Homo Sapiens
EEEGSNKGA

SEQ ID NO: 1069933 - protein, 9 aa, Homo Sapiens
VKKPGESLR

SEQ ID NO: 1069934 - protein, 9 aa, Homo Sapiens
SPAYEESLE

SEQ ID NO: 1069935 - protein, 9 aa, Homo Sapiens
SCLLPELAI

SEQ ID NO: 1069936 - protein, 9 aa, Homo Sapiens
SFAFLIYLK

SEQ ID NO: 1069937 - protein, 9 aa, Homo Sapiens
FVFVKPLEW

SEQ ID NO: 1069938 - protein, 9 aa, Homo Sapiens
SSLPNSRPG

SEQ ID NO: 1069939 - protein, 9 aa, Homo Sapiens
YCEVCQQSG

SEQ ID NO: 1069940 - protein, 9 aa, Homo Sapiens
YCFAREDQI

SEQ ID NO: 1069941 - protein, 9 aa, Homo Sapiens
LLGLTKKVA

SEQ ID NO: 1069942 - protein, 9 aa, Homo Sapiens
LEKWLNRNS

SEQ ID NO: 1069943 - protein, 9 aa, Homo Sapiens
DINQLYHIM

SEQ ID NO: 1069944 - protein, 9 aa, Homo Sapiens
LWKIDVILD

SEQ ID NO: 1069945 - protein, 9 aa, Homo Sapiens
YLVFIHTLV

SEQ ID NO: 1069946 - protein, 9 aa, Homo Sapiens
GKAIWLPWG

SEQ ID NO: 1069947 - protein, 9 aa, Homo Sapiens
PYFVLEISR

SEQ ID NO: 1069948 - protein, 9 aa, Homo Sapiens
DLATDPLVS

SEQ ID NO: 1069949 - protein, 9 aa, Homo Sapiens
AHCRVRGGH

SEQ ID NO: 1069950 - protein, 9 aa, Homo Sapiens
THQISKEYG

SEQ ID NO: 1069951 - protein, 9 aa, Homo Sapiens
AKGTRTLLF

SEQ ID NO: 1069952 - protein, 9 aa, Homo Sapiens
GQTNVMVNT

SEQ ID NO: 1069953 - protein, 9 aa, Homo Sapiens
LNKWENVKI

SEQ ID NO: 1069954 - protein, 9 aa, Homo Sapiens
GYCTLGEVF

SEQ ID NO: 1069955 - protein, 9 aa, Homo Sapiens
DTERNLTMD

SEQ ID NO: 1069956 - protein, 9 aa, Homo Sapiens
SPGHSPLSG

SEQ ID NO: 1069957 - protein, 9 aa, Homo Sapiens
YRKMYRDMA

SEQ ID NO: 1069958 - protein, 9 aa, Homo Sapiens
TGKGRPAKL

SEQ ID NO: 1069959 - protein, 9 aa, Homo Sapiens
GREVSIEGM

SEQ ID NO: 1069960 - protein, 9 aa, Homo Sapiens
SVTIKDSVF

SEQ ID NO: 1069961 - protein, 9 aa, Homo Sapiens
EDKTPGAVN

SEQ ID NO: 1069962 - protein, 9 aa, Homo Sapiens
RKVKEEVEE

SEQ ID NO: 1069963 - protein, 9 aa, Homo Sapiens
EGTQHNPLS

SEQ ID NO: 1069964 - protein, 9 aa, Homo Sapiens
LKPSVHVHN

SEQ ID NO: 1069965 - protein, 9 aa, Homo Sapiens
PNPRLQSAR

SEQ ID NO: 1069966 - protein, 9 aa, Homo Sapiens
VSVDWAPFL

SEQ ID NO: 1069967 - protein, 9 aa, Homo Sapiens
VKKKKLQGK

SEQ ID NO: 1069968 - protein, 9 aa, Homo Sapiens
SSIPESSGC

SEQ ID NO: 1069969 - protein, 9 aa, Homo Sapiens
QLRELERKY

SEQ ID NO: 1069970 - protein, 9 aa, Homo Sapiens
MDLPTARPT

SEQ ID NO: 1069971 - protein, 9 aa, Homo Sapiens
MLNSTTVME

SEQ ID NO: 1069972 - protein, 9 aa, Homo Sapiens
AIVKVYNYY

SEQ ID NO: 1069973 - protein, 9 aa, Homo Sapiens
VIHWNSSKK

SEQ ID NO: 1069974 - protein, 9 aa, Homo Sapiens
SFERDSMYS

SEQ ID NO: 1069975 - protein, 9 aa, Homo Sapiens
EPVVYGDII

SEQ ID NO: 1069976 - protein, 9 aa, Homo Sapiens
SMSLRVYVP

SEQ ID NO: 1069977 - protein, 9 aa, Homo Sapiens
LLKLEKLDI

SEQ ID NO: 1069978 - protein, 9 aa, Homo Sapiens
MRRLGLVEE

SEQ ID NO: 1069979 - protein, 9 aa, Homo Sapiens
RKYKLRYRK

SEQ ID NO: 1069980 - protein, 9 aa, Homo Sapiens
SGNADFTVK

SEQ ID NO: 1069981 - protein, 8 aa, Homo Sapiens
NLDSIHRL

SEQ ID NO: 1069982 - protein, 9 aa, Homo Sapiens
GLRYKAPRV

SEQ ID NO: 1069983 - protein, 9 aa, Homo Sapiens
ARKISLYSC

SEQ ID NO: 1069984 - protein, 9 aa, Homo Sapiens
LMSPLSSRS

SEQ ID NO: 1069985 - protein, 9 aa, Homo Sapiens
SVVQGEQIQ

SEQ ID NO: 1069986 - protein, 9 aa, Homo Sapiens
ENMGFSCRQ

SEQ ID NO: 1069987 - protein, 9 aa, Homo Sapiens
TPVSFQAAF

SEQ ID NO: 1069988 - protein, 9 aa, Homo Sapiens
AQKAAKASG

SEQ ID NO: 1069989 - protein, 9 aa, Homo Sapiens
TNEKAILKQ

SEQ ID NO: 1069990 - protein, 9 aa, Homo Sapiens
FSERDNLVS

SEQ ID NO: 1069991 - protein, 9 aa, Homo Sapiens
ASMKFHQQM

SEQ ID NO: 1069992 - protein, 9 aa, Homo Sapiens
ISVFVLASY

SEQ ID NO: 1069993 - protein, 9 aa, Homo Sapiens
TMTIRTKPS

SEQ ID NO: 1069994 - protein, 9 aa, Homo Sapiens
VDREKQPSK

SEQ ID NO: 1069995 - protein, 9 aa, Homo Sapiens
FFLRNKVFI

SEQ ID NO: 1069996 - protein, 9 aa, Homo Sapiens
NLDTGTNGE

SEQ ID NO: 1069997 - protein, 9 aa, Homo Sapiens
TSHQRIHTK

SEQ ID NO: 1069998 - protein, 9 aa, Homo Sapiens
KVIHWNSSK

SEQ ID NO: 1069999 - protein, 9 aa, Homo Sapiens
MSLGVKGFA

SEQ ID NO: 1070000 - protein, 9 aa, Homo Sapiens
DNLNSKKLT

SEQ ID NO: 1070001 - protein, 9 aa, Homo Sapiens
LRQRFNRWN

SEQ ID NO: 1070002 - protein, 9 aa, Homo Sapiens
KSIEILGSG

SEQ ID NO: 1070003 - protein, 9 aa, Homo Sapiens
TAQLYWKEG

SEQ ID NO: 1070004 - protein, 9 aa, Homo Sapiens
DISMAHHFR

SEQ ID NO: 1070005 - protein, 9 aa, Homo Sapiens
HHFSVNWIA

SEQ ID NO: 1070006 - protein, 9 aa, Homo Sapiens
YDNVQFDLL

SEQ ID NO: 1070007 - protein, 9 aa, Homo Sapiens
RYDSHQNQW

SEQ ID NO: 1070008 - protein, 9 aa, Homo Sapiens
HAKTGQSVD

SEQ ID NO: 1070009 - protein, 9 aa, Homo Sapiens
KGQSLRQRF

SEQ ID NO: 1070010 - protein, 9 aa, Homo Sapiens
SNQTYSTIE

SEQ ID NO: 1070011 - protein, 9 aa, Homo Sapiens
RSSLLLLPP

SEQ ID NO: 1070012 - protein, 9 aa, Homo Sapiens
CFFRNRLMD

SEQ ID NO: 1070013 - protein, 9 aa, Homo Sapiens
QYALNDEIM

SEQ ID NO: 1070014 - protein, 9 aa, Homo Sapiens
LRRSGQMQS

SEQ ID NO: 1070015 - protein, 9 aa, Homo Sapiens
AKKDVLYFQ

SEQ ID NO: 1070016 - protein, 9 aa, Homo Sapiens
IDFSKPFIS

SEQ ID NO: 1070017 - protein, 9 aa, Homo Sapiens
NNIAPVEFT

SEQ ID NO: 1070018 - protein, 9 aa, Homo Sapiens
VKVHNAKTK

SEQ ID NO: 1070019 - protein, 9 aa, Homo Sapiens
RSFSLLEEK

SEQ ID NO: 1070020 - protein, 9 aa, Homo Sapiens
RCSSPCKTC

SEQ ID NO: 1070021 - protein, 9 aa, Homo Sapiens
WFVYQAAKT

SEQ ID NO: 1070022 - protein, 9 aa, Homo Sapiens
NNTHNNYEN

SEQ ID NO: 1070023 - protein, 9 aa, Homo Sapiens
IRGPKEQKG

SEQ ID NO: 1070024 - protein, 9 aa, Homo Sapiens
ARYWDIMKY

SEQ ID NO: 1070025 - protein, 9 aa, Homo Sapiens
DRKMYYSQK

SEQ ID NO: 1070026 - protein, 9 aa, Homo Sapiens
GTLEKLLAS

SEQ ID NO: 1070027 - protein, 9 aa, Homo Sapiens
PLRRAPKTL

SEQ ID NO: 1070028 - protein, 9 aa, Homo Sapiens
KVSTKKMYE

SEQ ID NO: 1070029 - protein, 9 aa, Homo Sapiens
LDRIFAGFQ

SEQ ID NO: 1070030 - protein, 9 aa, Homo Sapiens
FSDGRLCSS

SEQ ID NO: 1070031 - protein, 9 aa, Homo Sapiens
QHGFHLATV

SEQ ID NO: 1070032 - protein, 9 aa, Homo Sapiens
GRSPRSGSQ

SEQ ID NO: 1070033 - protein, 9 aa, Homo Sapiens
DFFYPKRKL

SEQ ID NO: 1070034 - protein, 9 aa, Homo Sapiens
EQRPELLTN

SEQ ID NO: 1070035 - protein, 9 aa, Homo Sapiens
LTILSEGLF

SEQ ID NO: 1070036 - protein, 9 aa, Homo Sapiens
LKGQSLRQR

SEQ ID NO: 1070037 - protein, 9 aa, Homo Sapiens
SLSPSICGH

SEQ ID NO: 1070038 - protein, 9 aa, Homo Sapiens
SSQWIESQA

SEQ ID NO: 1070039 - protein, 9 aa, Homo Sapiens
KPYPGTEKE

SEQ ID NO: 1070040 - protein, 9 aa, Homo Sapiens
GLYSKTMTS

SEQ ID NO: 1070041 - protein, 9 aa, Homo Sapiens
DIDNPPKNE

SEQ ID NO: 1070042 - protein, 9 aa, Homo Sapiens
RLRLVGSEV

SEQ ID NO: 1070043 - protein, 9 aa, Homo Sapiens
WTSHLESGW

SEQ ID NO: 1070044 - protein, 9 aa, Homo Sapiens
WLHDPGASA

SEQ ID NO: 1070045 - protein, 9 aa, Homo Sapiens
VHLHFFFAV

SEQ ID NO: 1070046 - protein, 9 aa, Homo Sapiens
KWDQFYSKV

SEQ ID NO: 1070047 - protein, 9 aa, Homo Sapiens
EGQRLKKRK

SEQ ID NO: 1070048 - protein, 9 aa, Homo Sapiens
HTVISLPTL

SEQ ID NO: 1070049 - protein, 9 aa, Homo Sapiens
LSWEAGHGE

SEQ ID NO: 1070050 - protein, 9 aa, Homo Sapiens
HKQTDYRRW

SEQ ID NO: 1070051 - protein, 9 aa, Homo Sapiens
VAICTPLYY

SEQ ID NO: 1070052 - protein, 9 aa, Homo Sapiens
TKDFKLEME

SEQ ID NO: 1070053 - protein, 9 aa, Homo Sapiens
ACQSLGTGI

SEQ ID NO: 1070054 - protein, 9 aa, Homo Sapiens
RHPPDDDLF

SEQ ID NO: 1070055 - protein, 9 aa, Homo Sapiens
TEGAIHVVE

SEQ ID NO: 1070056 - protein, 9 aa, Homo Sapiens
ESKYQLVLE

SEQ ID NO: 1070057 - protein, 9 aa, Homo Sapiens
LRPNTATFE

SEQ ID NO: 1070058 - protein, 9 aa, Homo Sapiens
KINIIEQRP

SEQ ID NO: 1070059 - protein, 9 aa, Homo Sapiens
KFRRTNCAY

SEQ ID NO: 1070060 - protein, 9 aa, Homo Sapiens
CSKIPITLD

SEQ ID NO: 1070061 - protein, 9 aa, Homo Sapiens
KRIIKKVQN

SEQ ID NO: 1070062 - protein, 9 aa, Homo Sapiens
AWNVPDLLA

SEQ ID NO: 1070063 - protein, 9 aa, Homo Sapiens
LSKRSPPIS

SEQ ID NO: 1070064 - protein, 9 aa, Homo Sapiens
QDKEGADEA

SEQ ID NO: 1070065 - protein, 9 aa, Homo Sapiens
NKLHGPSNC

SEQ ID NO: 1070066 - protein, 9 aa, Homo Sapiens
LGKVCPFVH

SEQ ID NO: 1070067 - protein, 9 aa, Homo Sapiens
MQTLHPDVS

SEQ ID NO: 1070068 - protein, 9 aa, Homo Sapiens
ENGTDNFRD

SEQ ID NO: 1070069 - protein, 9 aa, Homo Sapiens
TTKKLTETP

SEQ ID NO: 1070070 - protein, 9 aa, Homo Sapiens
LLRRIPNPT

SEQ ID NO: 1070071 - protein, 9 aa, Homo Sapiens
IVKVYNYYE

SEQ ID NO: 1070072 - protein, 9 aa, Homo Sapiens
EESDSSFKC

SEQ ID NO: 1070073 - protein, 9 aa, Homo Sapiens
PSVNLTYSA

SEQ ID NO: 1070074 - protein, 9 aa, Homo Sapiens
QAKICKMKV

SEQ ID NO: 1070075 - protein, 9 aa, Homo Sapiens
GDCDNFQNR

SEQ ID NO: 1070076 - protein, 9 aa, Homo Sapiens
VCLKPQRYR

SEQ ID NO: 1070077 - protein, 9 aa, Homo Sapiens
VSFFFNRFD

SEQ ID NO: 1070078 - protein, 9 aa, Homo Sapiens
SPHTSEFKR

SEQ ID NO: 1070079 - protein, 9 aa, Homo Sapiens
PSSKLTSNR

SEQ ID NO: 1070080 - protein, 9 aa, Homo Sapiens
EIVTYGKIS

SEQ ID NO: 1070081 - protein, 9 aa, Homo Sapiens
VSAAHFFSH

SEQ ID NO: 1070082 - protein, 9 aa, Homo Sapiens
LNPLLVFIF

SEQ ID NO: 1070083 - protein, 9 aa, Homo Sapiens
KSALHLSVP

SEQ ID NO: 1070084 - protein, 9 aa, Homo Sapiens
GAPGSGFSS

SEQ ID NO: 1070085 - protein, 9 aa, Homo Sapiens
HDSKEPEQL

SEQ ID NO: 1070086 - protein, 9 aa, Homo Sapiens
KHIYKKRKL

SEQ ID NO: 1070087 - protein, 9 aa, Homo Sapiens
ASVHLHFFF

SEQ ID NO: 1070088 - protein, 9 aa, Homo Sapiens
FFFRKLRLI

SEQ ID NO: 1070089 - protein, 9 aa, Homo Sapiens
GTKNCWTCI

SEQ ID NO: 1070090 - protein, 9 aa, Homo Sapiens
KEVDMIKEA

SEQ ID NO: 1070091 - protein, 9 aa, Homo Sapiens
VCNKKNNIA

SEQ ID NO: 1070092 - protein, 9 aa, Homo Sapiens
GERKKVPAN

SEQ ID NO: 1070093 - protein, 9 aa, Homo Sapiens
IQFFLFAIS

SEQ ID NO: 1070094 - protein, 9 aa, Homo Sapiens
VIEIDFLCS

SEQ ID NO: 1070095 - protein, 9 aa, Homo Sapiens
KTYLNKRKG

SEQ ID NO: 1070096 - protein, 9 aa, Homo Sapiens
TKVTLGSTF

SEQ ID NO: 1070097 - protein, 9 aa, Homo Sapiens
ALDFKQEMA

SEQ ID NO: 1070098 - protein, 9 aa, Homo Sapiens
ISTTRVLDK

SEQ ID NO: 1070099 - protein, 9 aa, Homo Sapiens
TSNPRHLHI

SEQ ID NO: 1070100 - protein, 9 aa, Homo Sapiens
HIAWTEACQ

SEQ ID NO: 1070101 - protein, 9 aa, Homo Sapiens
LLKLGRLSL

SEQ ID NO: 1070102 - protein, 9 aa, Homo Sapiens
KGNSPLREN

SEQ ID NO: 1070103 - protein, 9 aa, Homo Sapiens
KSDQRSPGI

SEQ ID NO: 1070104 - protein, 9 aa, Homo Sapiens
AQTLSLLSG

SEQ ID NO: 1070105 - protein, 9 aa, Homo Sapiens
QFMNSRMQL

SEQ ID NO: 1070106 - protein, 9 aa, Homo Sapiens
CQLQKENRR

SEQ ID NO: 1070107 - protein, 9 aa, Homo Sapiens
ALPSSALRP

SEQ ID NO: 1070108 - protein, 9 aa, Homo Sapiens
SQSKGVMLK

SEQ ID NO: 1070109 - protein, 9 aa, Homo Sapiens
PGNSCFTTT

SEQ ID NO: 1070110 - protein, 9 aa, Homo Sapiens
TKAVSTECT

SEQ ID NO: 1070111 - protein, 9 aa, Homo Sapiens
FYVLLGEAS

SEQ ID NO: 1070112 - protein, 9 aa, Homo Sapiens
QAIITPRVR

SEQ ID NO: 1070113 - protein, 9 aa, Homo Sapiens
LLIATSSTA

SEQ ID NO: 1070114 - protein, 9 aa, Homo Sapiens
SGYQAATYL

SEQ ID NO: 1070115 - protein, 9 aa, Homo Sapiens
GIVAHKLGH

SEQ ID NO: 1070116 - protein, 9 aa, Homo Sapiens
KRLTASRSL

SEQ ID NO: 1070117 - protein, 9 aa, Homo Sapiens
LGGSSDLYV

SEQ ID NO: 1070118 - protein, 9 aa, Homo Sapiens
PEVWHVHSL

SEQ ID NO: 1070119 - protein, 9 aa, Homo Sapiens
SGEQEGLQE

SEQ ID NO: 1070120 - protein, 9 aa, Homo Sapiens
LLQKVVYLV

SEQ ID NO: 1070121 - protein, 9 aa, Homo Sapiens
TNCAYVVCA

SEQ ID NO: 1070122 - protein, 9 aa, Homo Sapiens
LQPAVFSPS

SEQ ID NO: 1070123 - protein, 9 aa, Homo Sapiens
IELVTQRNC

SEQ ID NO: 1070124 - protein, 9 aa, Homo Sapiens
LRQFLSSEK

SEQ ID NO: 1070125 - protein, 9 aa, Homo Sapiens
FCEGFTRTL

SEQ ID NO: 1070126 - protein, 9 aa, Homo Sapiens
KLFCSLQTP

SEQ ID NO: 1070127 - protein, 9 aa, Homo Sapiens
TSSDERSPS

SEQ ID NO: 1070128 - protein, 9 aa, Homo Sapiens
SSQVMDLPT

SEQ ID NO: 1070129 - protein, 9 aa, Homo Sapiens
PKKVRKNFQ

SEQ ID NO: 1070130 - protein, 9 aa, Homo Sapiens
IKGLQPGKF

SEQ ID NO: 1070131 - protein, 9 aa, Homo Sapiens
SKVQEMTLR

SEQ ID NO: 1070132 - protein, 9 aa, Homo Sapiens
SKALILHAG

SEQ ID NO: 1070133 - protein, 9 aa, Homo Sapiens
SNGVADELP

SEQ ID NO: 1070134 - protein, 9 aa, Homo Sapiens
DRKQDIGMP

SEQ ID NO: 1070135 - protein, 9 aa, Homo Sapiens
GNASCTVNL

SEQ ID NO: 1070136 - protein, 9 aa, Homo Sapiens
QESVEDFLA

SEQ ID NO: 1070137 - protein, 9 aa, Homo Sapiens
HDSSITGIL

SEQ ID NO: 1070138 - protein, 9 aa, Homo Sapiens
NPFFSPPSP

SEQ ID NO: 1070139 - protein, 9 aa, Homo Sapiens
EIKKNKTSV

SEQ ID NO: 1070140 - protein, 9 aa, Homo Sapiens
NRNMKRGLQ

SEQ ID NO: 1070141 - protein, 9 aa, Homo Sapiens
GKNYKILEK

SEQ ID NO: 1070142 - protein, 9 aa, Homo Sapiens
PVWQTFSIL

SEQ ID NO: 1070143 - protein, 9 aa, Homo Sapiens
LLNRPFDET

SEQ ID NO: 1070144 - protein, 9 aa, Homo Sapiens
LVDPVTHPI

SEQ ID NO: 1070145 - protein, 9 aa, Homo Sapiens
HNGLDEQPG

SEQ ID NO: 1070146 - protein, 9 aa, Homo Sapiens
LFLVLLFVA

SEQ ID NO: 1070147 - protein, 9 aa, Homo Sapiens
SSESSWYDF

SEQ ID NO: 1070148 - protein, 9 aa, Homo Sapiens
NGVFVDKDE

SEQ ID NO: 1070149 - protein, 9 aa, Homo Sapiens
SFLQNPQTF

SEQ ID NO: 1070150 - protein, 9 aa, Homo Sapiens
AIQPGPRQT

SEQ ID NO: 1070151 - protein, 9 aa, Homo Sapiens
VEKIKNFMD

SEQ ID NO: 1070152 - protein, 9 aa, Homo Sapiens
LKEMKRGWE

SEQ ID NO: 1070153 - protein, 9 aa, Homo Sapiens
QCNADSLNI

SEQ ID NO: 1070154 - protein, 9 aa, Homo Sapiens
LLARDKDGK

SEQ ID NO: 1070155 - protein, 9 aa, Homo Sapiens
GSERSCGVT

SEQ ID NO: 1070156 - protein, 9 aa, Homo Sapiens
SVRKFLFLF

SEQ ID NO: 1070157 - protein, 9 aa, Homo Sapiens
NPPPHFSPT

SEQ ID NO: 1070158 - protein, 9 aa, Homo Sapiens
KNFRVEGLF

SEQ ID NO: 1070159 - protein, 9 aa, Homo Sapiens
VYKCDECSF

SEQ ID NO: 1070160 - protein, 9 aa, Homo Sapiens
PLSSRSLSS

SEQ ID NO: 1070161 - protein, 9 aa, Homo Sapiens
RKISLYSCI

SEQ ID NO: 1070162 - protein, 9 aa, Homo Sapiens
SSQLNRISS

SEQ ID NO: 1070163 - protein, 9 aa, Homo Sapiens
SPPVSCLPS

SEQ ID NO: 1070164 - protein, 9 aa, Homo Sapiens
AFFIYLRPT

SEQ ID NO: 1070165 - protein, 9 aa, Homo Sapiens
SNSHVFASS

SEQ ID NO: 1070166 - protein, 9 aa, Homo Sapiens
VVDNLFEDM

SEQ ID NO: 1070167 - protein, 9 aa, Homo Sapiens
FRGCGAFLR

SEQ ID NO: 1070168 - protein, 9 aa, Homo Sapiens
TLEKMVPSF

SEQ ID NO: 1070169 - protein, 9 aa, Homo Sapiens
SELPPGPVL

SEQ ID NO: 1070170 - protein, 9 aa, Homo Sapiens
LMKLSLEEL

SEQ ID NO: 1070171 - protein, 9 aa, Homo Sapiens
RKKAFEEKQ

SEQ ID NO: 1070172 - protein, 9 aa, Homo Sapiens
QCPIAGNSC

SEQ ID NO: 1070173 - protein, 9 aa, Homo Sapiens
LSRERNFGV

SEQ ID NO: 1070174 - protein, 9 aa, Homo Sapiens
LTPPQLSSK

SEQ ID NO: 1070175 - protein, 9 aa, Homo Sapiens
VLQKIRDHC

SEQ ID NO: 1070176 - protein, 9 aa, Homo Sapiens
TKEPSACSR

SEQ ID NO: 1070177 - protein, 9 aa, Homo Sapiens
CRRYSCAVV

SEQ ID NO: 1070178 - protein, 9 aa, Homo Sapiens
CVNTPEGFR

SEQ ID NO: 1070179 - protein, 9 aa, Homo Sapiens
KGSPSLRWQ

SEQ ID NO: 1070180 - protein, 9 aa, Homo Sapiens
IRPKASYDL

SEQ ID NO: 1070181 - protein, 9 aa, Homo Sapiens
FFSETCYTL

SEQ ID NO: 1070182 - protein, 9 aa, Homo Sapiens
KGTYSLGSG

SEQ ID NO: 1070183 - protein, 9 aa, Homo Sapiens
ESQVLLTPV

SEQ ID NO: 1070184 - protein, 9 aa, Homo Sapiens
LQVLATKAP

SEQ ID NO: 1070185 - protein, 9 aa, Homo Sapiens
CTLECQCVE

SEQ ID NO: 1070186 - protein, 9 aa, Homo Sapiens
IMEEMPVGT

SEQ ID NO: 1070187 - protein, 9 aa, Homo Sapiens
RFGPHDQIM

SEQ ID NO: 1070188 - protein, 9 aa, Homo Sapiens
TNFNANDIH

SEQ ID NO: 1070189 - protein, 9 aa, Homo Sapiens
LLSPGMTID

SEQ ID NO: 1070190 - protein, 9 aa, Homo Sapiens
FFSIWHKFS

SEQ ID NO: 1070191 - protein, 9 aa, Homo Sapiens
LAVCEESSP

SEQ ID NO: 1070192 - protein, 9 aa, Homo Sapiens
KNLQCFLHK

SEQ ID NO: 1070193 - protein, 9 aa, Homo Sapiens
ERVSFSTAD

SEQ ID NO: 1070194 - protein, 9 aa, Homo Sapiens
FSFLHLNSR

SEQ ID NO: 1070195 - protein, 9 aa, Homo Sapiens
QRRALLRPV

SEQ ID NO: 1070196 - protein, 9 aa, Homo Sapiens
PCHSRSDLK

SEQ ID NO: 1070197 - protein, 9 aa, Homo Sapiens
AVLQKIRDH

SEQ ID NO: 1070198 - protein, 9 aa, Homo Sapiens
MAVKDIISR

SEQ ID NO: 1070199 - protein, 9 aa, Homo Sapiens
AEPMKKLSS

SEQ ID NO: 1070200 - protein, 9 aa, Homo Sapiens
CSSFQESTA

SEQ ID NO: 1070201 - protein, 9 aa, Homo Sapiens
SQQLKGLRW

SEQ ID NO: 1070202 - protein, 9 aa, Homo Sapiens
FEKFSAVVR

SEQ ID NO: 1070203 - protein, 9 aa, Homo Sapiens
DHSLHEPMF

SEQ ID NO: 1070204 - protein, 9 aa, Homo Sapiens
SRPDCWAGS

SEQ ID NO: 1070205 - protein, 9 aa, Homo Sapiens
AVFGQLAAV

SEQ ID NO: 1070206 - protein, 9 aa, Homo Sapiens
QITKRKKMS

SEQ ID NO: 1070207 - protein, 9 aa, Homo Sapiens
SPLTEKKDD

SEQ ID NO: 1070208 - protein, 9 aa, Homo Sapiens
TTKGWGAQA

SEQ ID NO: 1070209 - protein, 9 aa, Homo Sapiens
SYSLNGKNW

SEQ ID NO: 1070210 - protein, 9 aa, Homo Sapiens
DSHLHTLMY

SEQ ID NO: 1070211 - protein, 9 aa, Homo Sapiens
DSETMHGPL

SEQ ID NO: 1070212 - protein, 9 aa, Homo Sapiens
GLTDWLFPK

SEQ ID NO: 1070213 - protein, 9 aa, Homo Sapiens
DKEGGGEMD

SEQ ID NO: 1070214 - protein, 9 aa, Homo Sapiens
MKRPRTAGL

SEQ ID NO: 1070215 - protein, 9 aa, Homo Sapiens
GNGRGDICK

SEQ ID NO: 1070216 - protein, 9 aa, Homo Sapiens
SVIGKTYFQ

SEQ ID NO: 1070217 - protein, 9 aa, Homo Sapiens
YVDSQLHTP

SEQ ID NO: 1070218 - protein, 9 aa, Homo Sapiens
RLEEPVSPN

SEQ ID NO: 1070219 - protein, 9 aa, Homo Sapiens
SLKSENDKL

SEQ ID NO: 1070220 - protein, 9 aa, Homo Sapiens
YLIEFGQWL

SEQ ID NO: 1070221 - protein, 9 aa, Homo Sapiens
EEQTDKYFF

SEQ ID NO: 1070222 - protein, 9 aa, Homo Sapiens
KKMSVGYAN

SEQ ID NO: 1070223 - protein, 9 aa, Homo Sapiens
FNQEEGAGD

SEQ ID NO: 1070224 - protein, 9 aa, Homo Sapiens
GSPSDDKDM

SEQ ID NO: 1070225 - protein, 9 aa, Homo Sapiens
LTLSFGSSF

SEQ ID NO: 1070226 - protein, 9 aa, Homo Sapiens
HKNFRVEGL

SEQ ID NO: 1070227 - protein, 9 aa, Homo Sapiens
NFRVEGLFR

SEQ ID NO: 1070228 - protein, 9 aa, Homo Sapiens
GDRASPALS

SEQ ID NO: 1070229 - protein, 9 aa, Homo Sapiens
GLHLTKHDN

SEQ ID NO: 1070230 - protein, 9 aa, Homo Sapiens
KLKTVEKAA

SEQ ID NO: 1070231 - protein, 9 aa, Homo Sapiens
TKEDAVLPV

SEQ ID NO: 1070232 - protein, 9 aa, Homo Sapiens
QQPWRPGIV

SEQ ID NO: 1070233 - protein, 9 aa, Homo Sapiens
DDKERIEKY

SEQ ID NO: 1070234 - protein, 9 aa, Homo Sapiens
LGKTLENLS

SEQ ID NO: 1070235 - protein, 9 aa, Homo Sapiens
GPRSFHRLY

SEQ ID NO: 1070236 - protein, 9 aa, Homo Sapiens
DGWRSFSLL

SEQ ID NO: 1070237 - protein, 9 aa, Homo Sapiens
IIYRDFKPE

SEQ ID NO: 1070238 - protein, 9 aa, Homo Sapiens
TSHPNSDSM

SEQ ID NO: 1070239 - protein, 9 aa, Homo Sapiens
PASKISSIL

SEQ ID NO: 1070240 - protein, 9 aa, Homo Sapiens
VIIYSDCWL

SEQ ID NO: 1070241 - protein, 9 aa, Homo Sapiens
EEFLLLGRE

SEQ ID NO: 1070242 - protein, 9 aa, Homo Sapiens
DQSESSDID

SEQ ID NO: 1070243 - protein, 9 aa, Homo Sapiens
HLNHKGEAT

SEQ ID NO: 1070244 - protein, 9 aa, Homo Sapiens
HSSLPNSRP

SEQ ID NO: 1070245 - protein, 9 aa, Homo Sapiens
TLENDIPET

SEQ ID NO: 1070246 - protein, 9 aa, Homo Sapiens
KSSFFLKLV

SEQ ID NO: 1070247 - protein, 9 aa, Homo Sapiens
PINVQVEFV

SEQ ID NO: 1070248 - protein, 9 aa, Homo Sapiens
NYRHLVFFG

SEQ ID NO: 1070249 - protein, 9 aa, Homo Sapiens
KGSIIVNVP

SEQ ID NO: 1070250 - protein, 9 aa, Homo Sapiens
KERDLWKCP

SEQ ID NO: 1070251 - protein, 9 aa, Homo Sapiens
LKLSLKCRV

SEQ ID NO: 1070252 - protein, 9 aa, Homo Sapiens
YVLSKDKCV

SEQ ID NO: 1070253 - protein, 9 aa, Homo Sapiens
TGSSDPLET

SEQ ID NO: 1070254 - protein, 9 aa, Homo Sapiens
GSLFYTPKF

SEQ ID NO: 1070255 - protein, 9 aa, Homo Sapiens
SSINGSETR

SEQ ID NO: 1070256 - protein, 9 aa, Homo Sapiens
NIVVYHVIV

SEQ ID NO: 1070257 - protein, 9 aa, Homo Sapiens
VHVHNNRPA

SEQ ID NO: 1070258 - protein, 9 aa, Homo Sapiens
AQITWHLDL

SEQ ID NO: 1070259 - protein, 9 aa, Homo Sapiens
DPGSQCSLE

SEQ ID NO: 1070260 - protein, 9 aa, Homo Sapiens
RFRFAILYS

SEQ ID NO: 1070261 - protein, 9 aa, Homo Sapiens
GTQHNPLSQ

SEQ ID NO: 1070262 - protein, 9 aa, Homo Sapiens
RNAGSQIDR

SEQ ID NO: 1070263 - protein, 9 aa, Homo Sapiens
GFFFSDRRA

SEQ ID NO: 1070264 - protein, 9 aa, Homo Sapiens
IVLPNDVLQ

SEQ ID NO: 1070265 - protein, 9 aa, Homo Sapiens
VFSSIVGRP

SEQ ID NO: 1070266 - protein, 9 aa, Homo Sapiens
QNPTLLSLL

SEQ ID NO: 1070267 - protein, 9 aa, Homo Sapiens
KTLEKIAEK

SEQ ID NO: 1070268 - protein, 9 aa, Homo Sapiens
DEEPPRQAN

SEQ ID NO: 1070269 - protein, 9 aa, Homo Sapiens
RNSSNMAKG

SEQ ID NO: 1070270 - protein, 9 aa, Homo Sapiens
PENNIRSCC

SEQ ID NO: 1070271 - protein, 9 aa, Homo Sapiens
FLFSSNSNL

SEQ ID NO: 1070272 - protein, 9 aa, Homo Sapiens
GCPSFFISS

SEQ ID NO: 1070273 - protein, 9 aa, Homo Sapiens
VFVPQRKLE

SEQ ID NO: 1070274 - protein, 9 aa, Homo Sapiens
YVESDDEKS

SEQ ID NO: 1070275 - protein, 9 aa, Homo Sapiens
KKSRQEINF

SEQ ID NO: 1070276 - protein, 9 aa, Homo Sapiens
TPLLVACAR

SEQ ID NO: 1070277 - protein, 9 aa, Homo Sapiens
APKMLMDFF

SEQ ID NO: 1070278 - protein, 9 aa, Homo Sapiens
SQSRDRLDC

SEQ ID NO: 1070279 - protein, 9 aa, Homo Sapiens
HSLIKSDLV

SEQ ID NO: 1070280 - protein, 9 aa, Homo Sapiens
GCYFYEGVC

SEQ ID NO: 1070281 - protein, 9 aa, Homo Sapiens
PNPETFNPE

SEQ ID NO: 1070282 - protein, 9 aa, Homo Sapiens
GWTGSSCDT

SEQ ID NO: 1070283 - protein, 9 aa, Homo Sapiens
GLVPREDQA

SEQ ID NO: 1070284 - protein, 9 aa, Homo Sapiens
FFASVLTGK

SEQ ID NO: 1070285 - protein, 9 aa, Homo Sapiens
MNGKSLNGK

SEQ ID NO: 1070286 - protein, 9 aa, Homo Sapiens
FCGKAFCHR

SEQ ID NO: 1070287 - protein, 9 aa, Homo Sapiens
QTKPLRRAP

SEQ ID NO: 1070288 - protein, 9 aa, Homo Sapiens
KDRRAKETP

SEQ ID NO: 1070289 - protein, 9 aa, Homo Sapiens
APGFPESKG

SEQ ID NO: 1070290 - protein, 9 aa, Homo Sapiens
YKYKQGYQK

SEQ ID NO: 1070291 - protein, 9 aa, Homo Sapiens
QYISKPTSR

SEQ ID NO: 1070292 - protein, 9 aa, Homo Sapiens
FSTNIAFNI

SEQ ID NO: 1070293 - protein, 9 aa, Homo Sapiens
VLIESGADV

SEQ ID NO: 1070294 - protein, 9 aa, Homo Sapiens
DHYCTLVRT

SEQ ID NO: 1070295 - protein, 9 aa, Homo Sapiens
IFLTKLLNN

SEQ ID NO: 1070296 - protein, 9 aa, Homo Sapiens
REPKAPTFD

SEQ ID NO: 1070297 - protein, 9 aa, Homo Sapiens
EGVQKDPPE

SEQ ID NO: 1070298 - protein, 9 aa, Homo Sapiens
DFAQDSFYF

SEQ ID NO: 1070299 - protein, 9 aa, Homo Sapiens
CFLFSSNSN

SEQ ID NO: 1070300 - protein, 9 aa, Homo Sapiens
ACRSILHKD

SEQ ID NO: 1070301 - protein, 9 aa, Homo Sapiens
YSPLVPDSI

SEQ ID NO: 1070302 - protein, 9 aa, Homo Sapiens
AQRAQSLEL

SEQ ID NO: 1070303 - protein, 9 aa, Homo Sapiens
GESMYGNFE

SEQ ID NO: 1070304 - protein, 9 aa, Homo Sapiens
EIENSLEDP

SEQ ID NO: 1070305 - protein, 9 aa, Homo Sapiens
SFPKNDVIV

SEQ ID NO: 1070306 - protein, 9 aa, Homo Sapiens
HSHSNPDCQ

SEQ ID NO: 1070307 - protein, 9 aa, Homo Sapiens
MGIAKLSCE

SEQ ID NO: 1070308 - protein, 9 aa, Homo Sapiens
KNLHDDFCY

SEQ ID NO: 1070309 - protein, 9 aa, Homo Sapiens
PSTAIEQKD

SEQ ID NO: 1070310 - protein, 9 aa, Homo Sapiens
CNAGLEDIQ

SEQ ID NO: 1070311 - protein, 9 aa, Homo Sapiens
VVCGSLFYT

SEQ ID NO: 1070312 - protein, 9 aa, Homo Sapiens
GMESDLSLI

SEQ ID NO: 1070313 - protein, 9 aa, Homo Sapiens
FGLSERLGS

SEQ ID NO: 1070314 - protein, 9 aa, Homo Sapiens
EKALQAIIT

SEQ ID NO: 1070315 - protein, 9 aa, Homo Sapiens
ALPAFLVSS

SEQ ID NO: 1070316 - protein, 9 aa, Homo Sapiens
CAAGAEPLL

SEQ ID NO: 1070317 - protein, 9 aa, Homo Sapiens
SEVSVGLEP

SEQ ID NO: 1070318 - protein, 9 aa, Homo Sapiens
LSKIIFYRL

SEQ ID NO: 1070319 - protein, 9 aa, Homo Sapiens
KSSDKRGDN

SEQ ID NO: 1070320 - protein, 9 aa, Homo Sapiens
LVIPGDPPA

SEQ ID NO: 1070321 - protein, 9 aa, Homo Sapiens
FEVDSDGDG

SEQ ID NO: 1070322 - protein, 9 aa, Homo Sapiens
LLSYVYFLL

SEQ ID NO: 1070323 - protein, 9 aa, Homo Sapiens
VLDPFSGHT

SEQ ID NO: 1070324 - protein, 9 aa, Homo Sapiens
NQKVANFYC

SEQ ID NO: 1070325 - protein, 9 aa, Homo Sapiens
NLGWPNELT

SEQ ID NO: 1070326 - protein, 9 aa, Homo Sapiens
ISEDTPRGH

SEQ ID NO: 1070327 - protein, 9 aa, Homo Sapiens
QNYCQEPYY

SEQ ID NO: 1070328 - protein, 9 aa, Homo Sapiens
DQGNFFFPI

SEQ ID NO: 1070329 - protein, 9 aa, Homo Sapiens
LLELMTEVF

SEQ ID NO: 1070330 - protein, 9 aa, Homo Sapiens
LGRPMCTLL

SEQ ID NO: 1070331 - protein, 9 aa, Homo Sapiens
LHNTSWNRM

SEQ ID NO: 1070332 - protein, 9 aa, Homo Sapiens
EQHPHRHHP

SEQ ID NO: 1070333 - protein, 9 aa, Homo Sapiens
KVSLMCEGQ

SEQ ID NO: 1070334 - protein, 9 aa, Homo Sapiens
EIDEKFKEC

SEQ ID NO: 1070335 - protein, 9 aa, Homo Sapiens
QTLHPDVSA

SEQ ID NO: 1070336 - protein, 9 aa, Homo Sapiens
VQYTGWFSV

SEQ ID NO: 1070337 - protein, 9 aa, Homo Sapiens
IRIKFTSDQ

SEQ ID NO: 1070338 - protein, 9 aa, Homo Sapiens
SGQAQLLRT

SEQ ID NO: 1070339 - protein, 9 aa, Homo Sapiens
AKKEPQKHS

SEQ ID NO: 1070340 - protein, 9 aa, Homo Sapiens
KKHLEHPEQ

SEQ ID NO: 1070341 - protein, 9 aa, Homo Sapiens
SSAVKRWVW

SEQ ID NO: 1070342 - protein, 9 aa, Homo Sapiens
PKLNEGNQI

SEQ ID NO: 1070343 - protein, 9 aa, Homo Sapiens
VYKGLHLNS

SEQ ID NO: 1070344 - protein, 9 aa, Homo Sapiens
ASEPVVYGD

SEQ ID NO: 1070345 - protein, 9 aa, Homo Sapiens
SYNKLQKQE

SEQ ID NO: 1070346 - protein, 9 aa, Homo Sapiens
KHTSSGILS

SEQ ID NO: 1070347 - protein, 9 aa, Homo Sapiens
QYQCKVCPK

SEQ ID NO: 1070348 - protein, 9 aa, Homo Sapiens
KNEKFINVM

SEQ ID NO: 1070349 - protein, 9 aa, Homo Sapiens
DGTALYEAW

SEQ ID NO: 1070350 - protein, 9 aa, Homo Sapiens
GRSPASASL

SEQ ID NO: 1070351 - protein, 9 aa, Homo Sapiens
SCNLETRDE

SEQ ID NO: 1070352 - protein, 9 aa, Homo Sapiens
KRVAIVRAG

SEQ ID NO: 1070353 - protein, 9 aa, Homo Sapiens
ERCSSPCKT

SEQ ID NO: 1070354 - protein, 9 aa, Homo Sapiens
YVLAVHTEG

SEQ ID NO: 1070355 - protein, 9 aa, Homo Sapiens
GSPEKARLS

SEQ ID NO: 1070356 - protein, 9 aa, Homo Sapiens
ESDDEKSLD

SEQ ID NO: 1070357 - protein, 9 aa, Homo Sapiens
SKSPSLLKN

SEQ ID NO: 1070358 - protein, 9 aa, Homo Sapiens
EKFKPSPCE

SEQ ID NO: 1070359 - protein, 9 aa, Homo Sapiens
PGVPGERRE

SEQ ID NO: 1070360 - protein, 9 aa, Homo Sapiens
STAIEQKDM

SEQ ID NO: 1070361 - protein, 9 aa, Homo Sapiens
QFHILQLFH

SEQ ID NO: 1070362 - protein, 9 aa, Homo Sapiens
FDFNNLEQL

SEQ ID NO: 1070363 - protein, 9 aa, Homo Sapiens
YNCRKVNTH

SEQ ID NO: 1070364 - protein, 9 aa, Homo Sapiens
IIFMVALNV

SEQ ID NO: 1070365 - protein, 9 aa, Homo Sapiens
SVNWIALVV

SEQ ID NO: 1070366 - protein, 9 aa, Homo Sapiens
QRAQSLELY

SEQ ID NO: 1070367 - protein, 9 aa, Homo Sapiens
EALDSIFLA

SEQ ID NO: 1070368 - protein, 9 aa, Homo Sapiens
DYGELVYHA

SEQ ID NO: 1070369 - protein, 9 aa, Homo Sapiens
ALCTLSQGT

SEQ ID NO: 1070370 - protein, 9 aa, Homo Sapiens
TEEKGHITY

SEQ ID NO: 1070371 - protein, 9 aa, Homo Sapiens
REPEEITKE

SEQ ID NO: 1070372 - protein, 9 aa, Homo Sapiens
SRIQVLFMY

SEQ ID NO: 1070373 - protein, 9 aa, Homo Sapiens
DVNKDEKIQ

SEQ ID NO: 1070374 - protein, 9 aa, Homo Sapiens
QGVSEAAHW

SEQ ID NO: 1070375 - protein, 9 aa, Homo Sapiens
GDRGNLPDD

SEQ ID NO: 1070376 - protein, 9 aa, Homo Sapiens
SGFGFGSGS

SEQ ID NO: 1070377 - protein, 9 aa, Homo Sapiens
HFFFAVGTL

SEQ ID NO: 1070378 - protein, 9 aa, Homo Sapiens
ERLCEQNKR

SEQ ID NO: 1070379 - protein, 9 aa, Homo Sapiens
SYGPFLERY

SEQ ID NO: 1070380 - protein, 9 aa, Homo Sapiens
CAQDNPINP

SEQ ID NO: 1070381 - protein, 9 aa, Homo Sapiens
PDGWKSTIY

SEQ ID NO: 1070382 - protein, 9 aa, Homo Sapiens
VQAQAASGK

SEQ ID NO: 1070383 - protein, 9 aa, Homo Sapiens
LTQHKRIYT

SEQ ID NO: 1070384 - protein, 9 aa, Homo Sapiens
YVEGKTCQI

SEQ ID NO: 1070385 - protein, 9 aa, Homo Sapiens
SNHSAAYNS

SEQ ID NO: 1070386 - protein, 9 aa, Homo Sapiens
NELTVDKAS

SEQ ID NO: 1070387 - protein, 9 aa, Homo Sapiens
EDSCNAGLE

SEQ ID NO: 1070388 - protein, 9 aa, Homo Sapiens
KIYLIGRDL

SEQ ID NO: 1070389 - protein, 9 aa, Homo Sapiens
RPEQSKNEL

SEQ ID NO: 1070390 - protein, 9 aa, Homo Sapiens
VVFDSNDAD

SEQ ID NO: 1070391 - protein, 9 aa, Homo Sapiens
GTGPRETSL

SEQ ID NO: 1070392 - protein, 9 aa, Homo Sapiens
SIASQCPIA

SEQ ID NO: 1070393 - protein, 9 aa, Homo Sapiens
FVMVLLIYL

SEQ ID NO: 1070394 - protein, 9 aa, Homo Sapiens
YRLYSLLYH

SEQ ID NO: 1070395 - protein, 9 aa, Homo Sapiens
SYRHYCTMF

SEQ ID NO: 1070396 - protein, 9 aa, Homo Sapiens
SPLFQQQRF

SEQ ID NO: 1070397 - protein, 9 aa, Homo Sapiens
MFLLAQSHT

SEQ ID NO: 1070398 - protein, 9 aa, Homo Sapiens
KCTPKCLPK

SEQ ID NO: 1070399 - protein, 9 aa, Homo Sapiens
FPGILEFFH

SEQ ID NO: 1070400 - protein, 9 aa, Homo Sapiens
EKCLKFVVS

SEQ ID NO: 1070401 - protein, 9 aa, Homo Sapiens
CEEVIDFSK

SEQ ID NO: 1070402 - protein, 9 aa, Homo Sapiens
AGDILVLVF

SEQ ID NO: 1070403 - protein, 9 aa, Homo Sapiens
LSFMQHFSE

SEQ ID NO: 1070404 - protein, 9 aa, Homo Sapiens
PVKNPCSFK

SEQ ID NO: 1070405 - protein, 9 aa, Homo Sapiens
LGIFYIEDF

SEQ ID NO: 1070406 - protein, 9 aa, Homo Sapiens
NNIAHMKAK

SEQ ID NO: 1070407 - protein, 9 aa, Homo Sapiens
KLSSIYNLV

SEQ ID NO: 1070408 - protein, 9 aa, Homo Sapiens
ELQDNAVYE

SEQ ID NO: 1070409 - protein, 9 aa, Homo Sapiens
YYKLVTTKN

SEQ ID NO: 1070410 - protein, 9 aa, Homo Sapiens
PDNPKASFE

SEQ ID NO: 1070411 - protein, 9 aa, Homo Sapiens
SRHSQVGQK

SEQ ID NO: 1070412 - protein, 9 aa, Homo Sapiens
DHLFPLLEN

SEQ ID NO: 1070413 - protein, 9 aa, Homo Sapiens
AKQEKIKME

SEQ ID NO: 1070414 - protein, 9 aa, Homo Sapiens
DEESDSSFK

SEQ ID NO: 1070415 - protein, 9 aa, Homo Sapiens
VLFFVYMCY

SEQ ID NO: 1070416 - protein, 9 aa, Homo Sapiens
EVFFSNIQE

SEQ ID NO: 1070417 - protein, 9 aa, Homo Sapiens
TIAAPHPID

SEQ ID NO: 1070418 - protein, 9 aa, Homo Sapiens
KDSPHTIPT

SEQ ID NO: 1070419 - protein, 9 aa, Homo Sapiens
VNQVVLFAT

SEQ ID NO: 1070420 - protein, 9 aa, Homo Sapiens
NEYNEIVKR

SEQ ID NO: 1070421 - protein, 9 aa, Homo Sapiens
PTFDKCLPH

SEQ ID NO: 1070422 - protein, 9 aa, Homo Sapiens
NLDSANPTT

SEQ ID NO: 1070423 - protein, 9 aa, Homo Sapiens
LIGRDLGPF

SEQ ID NO: 1070424 - protein, 9 aa, Homo Sapiens
AIREHQDRL

SEQ ID NO: 1070425 - protein, 9 aa, Homo Sapiens
RQEPEGLVG

SEQ ID NO: 1070426 - protein, 9 aa, Homo Sapiens
VFRLNGSSL

SEQ ID NO: 1070427 - protein, 9 aa, Homo Sapiens
YSLNGKNWE

SEQ ID NO: 1070428 - protein, 9 aa, Homo Sapiens
FITFSDGCQ

SEQ ID NO: 1070429 - protein, 9 aa, Homo Sapiens
NCIVYCTME

SEQ ID NO: 1070430 - protein, 9 aa, Homo Sapiens
VLRTCVKTT

SEQ ID NO: 1070431 - protein, 9 aa, Homo Sapiens
RKVCNDQNH

SEQ ID NO: 1070432 - protein, 9 aa, Homo Sapiens
SEVEVHLDC

SEQ ID NO: 1070433 - protein, 9 aa, Homo Sapiens
GYCPNYPVI

SEQ ID NO: 1070434 - protein, 9 aa, Homo Sapiens
PVTFIWKFQ

SEQ ID NO: 1070435 - protein, 9 aa, Homo Sapiens
NRPFDETTY

SEQ ID NO: 1070436 - protein, 9 aa, Homo Sapiens
RAASAPTGT

SEQ ID NO: 1070437 - protein, 9 aa, Homo Sapiens
LDPRKGSGD

SEQ ID NO: 1070438 - protein, 9 aa, Homo Sapiens
PSQEPSLAP

SEQ ID NO: 1070439 - protein, 9 aa, Homo Sapiens
NKLQPGSKC

SEQ ID NO: 1070440 - protein, 9 aa, Homo Sapiens
QQRKERLYL

SEQ ID NO: 1070441 - protein, 9 aa, Homo Sapiens
KKPNLRPIF

SEQ ID NO: 1070442 - protein, 9 aa, Homo Sapiens
IFSKTYLKM

SEQ ID NO: 1070443 - protein, 9 aa, Homo Sapiens
LDIFPVVCT

SEQ ID NO: 1070444 - protein, 9 aa, Homo Sapiens
HFYCDNVSL

SEQ ID NO: 1070445 - protein, 9 aa, Homo Sapiens
APFVEAFDK

SEQ ID NO: 1070446 - protein, 9 aa, Homo Sapiens
PGLGKKKEG

SEQ ID NO: 1070447 - protein, 9 aa, Homo Sapiens
DSAEFGDSV

SEQ ID NO: 1070448 - protein, 9 aa, Homo Sapiens
SYTFEFYFL

SEQ ID NO: 1070449 - protein, 9 aa, Homo Sapiens
GVFVDKDEH

SEQ ID NO: 1070450 - protein, 9 aa, Homo Sapiens
NSGFYMCQA

SEQ ID NO: 1070451 - protein, 9 aa, Homo Sapiens
LIFEPYEPS

SEQ ID NO: 1070452 - protein, 9 aa, Homo Sapiens
KKSCFELTS

SEQ ID NO: 1070453 - protein, 9 aa, Homo Sapiens
VHLILVFRF

SEQ ID NO: 1070454 - protein, 9 aa, Homo Sapiens
TQEGWNFQP

SEQ ID NO: 1070455 - protein, 9 aa, Homo Sapiens
THPNIWSHC

SEQ ID NO: 1070456 - protein, 9 aa, Homo Sapiens
RALHNAKCQ

SEQ ID NO: 1070457 - protein, 9 aa, Homo Sapiens
RNEIKKNKT

SEQ ID NO: 1070458 - protein, 9 aa, Homo Sapiens
RTHTQEKSY

SEQ ID NO: 1070459 - protein, 9 aa, Homo Sapiens
VSAHGLNLQ

SEQ ID NO: 1070460 - protein, 9 aa, Homo Sapiens
DDEEKKKKY

SEQ ID NO: 1070461 - protein, 9 aa, Homo Sapiens
VLSQPPKSS

SEQ ID NO: 1070462 - protein, 9 aa, Homo Sapiens
LAVRSVDLT

SEQ ID NO: 1070463 - protein, 9 aa, Homo Sapiens
HKIQHFFCD

SEQ ID NO: 1070464 - protein, 9 aa, Homo Sapiens
DEIAGPGAE

SEQ ID NO: 1070465 - protein, 9 aa, Homo Sapiens
TSFDGVPGS

SEQ ID NO: 1070466 - protein, 9 aa, Homo Sapiens
NSDDYGGVK

SEQ ID NO: 1070467 - protein, 9 aa, Homo Sapiens
ASSLGPLTD

SEQ ID NO: 1070468 - protein, 9 aa, Homo Sapiens
SPSSTLPRN

SEQ ID NO: 1070469 - protein, 9 aa, Homo Sapiens
LDQFYMNRI

SEQ ID NO: 1070470 - protein, 9 aa, Homo Sapiens
YKVDSPRNF

SEQ ID NO: 1070471 - protein, 9 aa, Homo Sapiens
HNAKCQKTV

SEQ ID NO: 1070472 - protein, 9 aa, Homo Sapiens
PGTEYCLTL

SEQ ID NO: 1070473 - protein, 9 aa, Homo Sapiens
DVAKRGITE

SEQ ID NO: 1070474 - protein, 9 aa, Homo Sapiens
GALVCAYNP

SEQ ID NO: 1070475 - protein, 9 aa, Homo Sapiens
SEVFFSNIQ

SEQ ID NO: 1070476 - protein, 9 aa, Homo Sapiens
ECKIQFFLF

SEQ ID NO: 1070477 - protein, 9 aa, Homo Sapiens
LGGSNSHVF

SEQ ID NO: 1070478 - protein, 9 aa, Homo Sapiens
TIYSLEMKI

SEQ ID NO: 1070479 - protein, 9 aa, Homo Sapiens
QASPPDDVD

SEQ ID NO: 1070480 - protein, 9 aa, Homo Sapiens
WNRMIGELI

SEQ ID NO: 1070481 - protein, 9 aa, Homo Sapiens
YAAFLPLLV

SEQ ID NO: 1070482 - protein, 9 aa, Homo Sapiens
SATLWNRST

SEQ ID NO: 1070483 - protein, 9 aa, Homo Sapiens
IRTITSIVK

SEQ ID NO: 1070484 - protein, 9 aa, Homo Sapiens
INRRVSFQQ

SEQ ID NO: 1070485 - protein, 9 aa, Homo Sapiens
DIYFLDDPL

SEQ ID NO: 1070486 - protein, 9 aa, Homo Sapiens
FSLMDCNRF

SEQ ID NO: 1070487 - protein, 9 aa, Homo Sapiens
AGERKKVPA

SEQ ID NO: 1070488 - protein, 9 aa, Homo Sapiens
PAAPLFGVL

SEQ ID NO: 1070489 - protein, 9 aa, Homo Sapiens
RREQCLLSP

SEQ ID NO: 1070490 - protein, 9 aa, Homo Sapiens
LGTVFVPQR

SEQ ID NO: 1070491 - protein, 9 aa, Homo Sapiens
EKRYEVPVP

SEQ ID NO: 1070492 - protein, 9 aa, Homo Sapiens
SLKEDYNQP

SEQ ID NO: 1070493 - protein, 9 aa, Homo Sapiens
KFNILKINE

SEQ ID NO: 1070494 - protein, 9 aa, Homo Sapiens
VDVRDKFSG

SEQ ID NO: 1070495 - protein, 9 aa, Homo Sapiens
LAEEKMRKK

SEQ ID NO: 1070496 - protein, 9 aa, Homo Sapiens
ADFLDSPPR

SEQ ID NO: 1070497 - protein, 9 aa, Homo Sapiens
QLDENKLKA

SEQ ID NO: 1070498 - protein, 9 aa, Homo Sapiens
LGADSQFSN

SEQ ID NO: 1070499 - protein, 9 aa, Homo Sapiens
FPSSSPSDD

SEQ ID NO: 1070500 - protein, 9 aa, Homo Sapiens
LEKIAEKCD

SEQ ID NO: 1070501 - protein, 9 aa, Homo Sapiens
RTLLEFWKK

SEQ ID NO: 1070502 - protein, 9 aa, Homo Sapiens
IRGEGAGFI

SEQ ID NO: 1070503 - protein, 9 aa, Homo Sapiens
VAHKLGHVV

SEQ ID NO: 1070504 - protein, 9 aa, Homo Sapiens
SALFFSETC

SEQ ID NO: 1070505 - protein, 9 aa, Homo Sapiens
DSDPEKKEV

SEQ ID NO: 1070506 - protein, 9 aa, Homo Sapiens
KWPFDFFLF

SEQ ID NO: 1070507 - protein, 9 aa, Homo Sapiens
AQAEGPSVQ

SEQ ID NO: 1070508 - protein, 9 aa, Homo Sapiens
DYAVLEMKA

SEQ ID NO: 1070509 - protein, 9 aa, Homo Sapiens
AYLQQKQAN

SEQ ID NO: 1070510 - protein, 9 aa, Homo Sapiens
EQLLQLDEN

SEQ ID NO: 1070511 - protein, 9 aa, Homo Sapiens
SLLKNKLSH

SEQ ID NO: 1070512 - protein, 9 aa, Homo Sapiens
HTLLSYVYF

SEQ ID NO: 1070513 - protein, 9 aa, Homo Sapiens
QTEMEAIQV

SEQ ID NO: 1070514 - protein, 9 aa, Homo Sapiens
SLYPGTTYS

SEQ ID NO: 1070515 - protein, 9 aa, Homo Sapiens
RLFKHLKHE

SEQ ID NO: 1070516 - protein, 9 aa, Homo Sapiens
DHLDLASAD

SEQ ID NO: 1070517 - protein, 9 aa, Homo Sapiens
NNQQETPVQ

SEQ ID NO: 1070518 - protein, 9 aa, Homo Sapiens
CSNSVSSLD

SEQ ID NO: 1070519 - protein, 9 aa, Homo Sapiens
LSRAGALVV

SEQ ID NO: 1070520 - protein, 9 aa, Homo Sapiens
VPRMNESSG

SEQ ID NO: 1070521 - protein, 9 aa, Homo Sapiens
AYEMMMESV

SEQ ID NO: 1070522 - protein, 9 aa, Homo Sapiens
IQQPRLFGA

SEQ ID NO: 1070523 - protein, 9 aa, Homo Sapiens
QLLKLHQQF

SEQ ID NO: 1070524 - protein, 9 aa, Homo Sapiens
LSPEDSRLW

SEQ ID NO: 1070525 - protein, 9 aa, Homo Sapiens
GLGRSCHRN

SEQ ID NO: 1070526 - protein, 9 aa, Homo Sapiens
LRSFPAPQD

SEQ ID NO: 1070527 - protein, 9 aa, Homo Sapiens
ASLQFHILQ

SEQ ID NO: 1070528 - protein, 9 aa, Homo Sapiens
NLHLQGKVK

SEQ ID NO: 1070529 - protein, 9 aa, Homo Sapiens
ILFMKEDIK

SEQ ID NO: 1070530 - protein, 9 aa, Homo Sapiens
KQMESYSCF

SEQ ID NO: 1070531 - protein, 9 aa, Homo Sapiens
VVLEGPDRI

SEQ ID NO: 1070532 - protein, 9 aa, Homo Sapiens
ICSALEFTK

SEQ ID NO: 1070533 - protein, 9 aa, Homo Sapiens
ERYDSHQNQ

SEQ ID NO: 1070534 - protein, 9 aa, Homo Sapiens
TAERPSLVC

SEQ ID NO: 1070535 - protein, 9 aa, Homo Sapiens
WGEEGHDSK

SEQ ID NO: 1070536 - protein, 9 aa, Homo Sapiens
FTFEAVELQ

SEQ ID NO: 1070537 - protein, 9 aa, Homo Sapiens
LYSVSMSLR

SEQ ID NO: 1070538 - protein, 9 aa, Homo Sapiens
QGDIWLLAD

SEQ ID NO: 1070539 - protein, 9 aa, Homo Sapiens
GELPWGWTQ

SEQ ID NO: 1070540 - protein, 9 aa, Homo Sapiens
VSARNLDTG

SEQ ID NO: 1070541 - protein, 9 aa, Homo Sapiens
GAILKGVAA

SEQ ID NO: 1070542 - protein, 9 aa, Homo Sapiens
CLRKRRGQA

SEQ ID NO: 1070543 - protein, 9 aa, Homo Sapiens
LNLKKEKNL

SEQ ID NO: 1070544 - protein, 9 aa, Homo Sapiens
PLIRENQPK

SEQ ID NO: 1070545 - protein, 9 aa, Homo Sapiens
CQPGYVLSK

SEQ ID NO: 1070546 - protein, 9 aa, Homo Sapiens
LSSIYNLVP

SEQ ID NO: 1070547 - protein, 9 aa, Homo Sapiens
QIRVAIILL

SEQ ID NO: 1070548 - protein, 9 aa, Homo Sapiens
NSRPGKCLP

SEQ ID NO: 1070549 - protein, 9 aa, Homo Sapiens
FFNKPDSHG

SEQ ID NO: 1070550 - protein, 9 aa, Homo Sapiens
STFSEPQKI

SEQ ID NO: 1070551 - protein, 9 aa, Homo Sapiens
LVAFMGNFV

SEQ ID NO: 1070552 - protein, 9 aa, Homo Sapiens
FCGWGGAML

SEQ ID NO: 1070553 - protein, 9 aa, Homo Sapiens
IYFRHKIYK

SEQ ID NO: 1070554 - protein, 9 aa, Homo Sapiens
LFLSALFFS

SEQ ID NO: 1070555 - protein, 9 aa, Homo Sapiens
SYSCPCTDN

SEQ ID NO: 1070556 - protein, 9 aa, Homo Sapiens
KNELVMEIL

SEQ ID NO: 1070557 - protein, 9 aa, Homo Sapiens
FQKEVSFCH

SEQ ID NO: 1070558 - protein, 9 aa, Homo Sapiens
SLICQKLDK

SEQ ID NO: 1070559 - protein, 9 aa, Homo Sapiens
KRASQAGMT

SEQ ID NO: 1070560 - protein, 9 aa, Homo Sapiens
VTFYDVLSM

SEQ ID NO: 1070561 - protein, 9 aa, Homo Sapiens
NLLLLIGSL

SEQ ID NO: 1070562 - protein, 9 aa, Homo Sapiens
AIEKSIEIL

SEQ ID NO: 1070563 - protein, 9 aa, Homo Sapiens
SRGLEPRVR

SEQ ID NO: 1070564 - protein, 9 aa, Homo Sapiens
RDWAAEAKE

SEQ ID NO: 1070565 - protein, 9 aa, Homo Sapiens
VMTMGNDTS

SEQ ID NO: 1070566 - protein, 9 aa, Homo Sapiens
IALLTKPKV

SEQ ID NO: 1070567 - protein, 9 aa, Homo Sapiens
DSFSFLDSE

SEQ ID NO: 1070568 - protein, 9 aa, Homo Sapiens
VPVEDNDKN

SEQ ID NO: 1070569 - protein, 9 aa, Homo Sapiens
VHTGEELLE

SEQ ID NO: 1070570 - protein, 9 aa, Homo Sapiens
VGLFLGASV

SEQ ID NO: 1070571 - protein, 9 aa, Homo Sapiens
RKTEARELT

SEQ ID NO: 1070572 - protein, 9 aa, Homo Sapiens
PAGPRQNPR

SEQ ID NO: 1070573 - protein, 9 aa, Homo Sapiens
DYNLKWNSD

SEQ ID NO: 1070574 - protein, 9 aa, Homo Sapiens
ECDFHPLPP

SEQ ID NO: 1070575 - protein, 9 aa, Homo Sapiens
MKVARIGLT

SEQ ID NO: 1070576 - protein, 9 aa, Homo Sapiens
LQKEKITQI

SEQ ID NO: 1070577 - protein, 9 aa, Homo Sapiens
AQLDLFYTQ

SEQ ID NO: 1070578 - protein, 9 aa, Homo Sapiens
KELAKLRAQ

SEQ ID NO: 1070579 - protein, 9 aa, Homo Sapiens
RFLSLFWRQ

SEQ ID NO: 1070580 - protein, 9 aa, Homo Sapiens
MSLVLFYMK

SEQ ID NO: 1070581 - protein, 9 aa, Homo Sapiens
VFFSNIQEI

SEQ ID NO: 1070582 - protein, 9 aa, Homo Sapiens
DEEKKKKYM

SEQ ID NO: 1070583 - protein, 9 aa, Homo Sapiens
VFVLASYKL

SEQ ID NO: 1070584 - protein, 9 aa, Homo Sapiens
FILGLPPHA

SEQ ID NO: 1070585 - protein, 9 aa, Homo Sapiens
SDPSFLRLH

SEQ ID NO: 1070586 - protein, 9 aa, Homo Sapiens
ISLRRLYLQ

SEQ ID NO: 1070587 - protein, 9 aa, Homo Sapiens
QMHRDEKPF

SEQ ID NO: 1070588 - protein, 9 aa, Homo Sapiens
AIFFTWDIN

SEQ ID NO: 1070589 - protein, 9 aa, Homo Sapiens
CQMFSINGS

SEQ ID NO: 1070590 - protein, 9 aa, Homo Sapiens
ARLVLSKLE

SEQ ID NO: 1070591 - protein, 9 aa, Homo Sapiens
ASKISSILE

SEQ ID NO: 1070592 - protein, 9 aa, Homo Sapiens
HSGILLDHQ

SEQ ID NO: 1070593 - protein, 9 aa, Homo Sapiens
IVRAGVSGL

SEQ ID NO: 1070594 - protein, 9 aa, Homo Sapiens
LHKNFRVEG

SEQ ID NO: 1070595 - protein, 9 aa, Homo Sapiens
RPLNIIYNS

SEQ ID NO: 1070596 - protein, 9 aa, Homo Sapiens
QMQSVGSQH

SEQ ID NO: 1070597 - protein, 9 aa, Homo Sapiens
SVMYRFCTK

SEQ ID NO: 1070598 - protein, 9 aa, Homo Sapiens
KRKFSLDEI

SEQ ID NO: 1070599 - protein, 9 aa, Homo Sapiens
HVCCNFSNM

SEQ ID NO: 1070600 - protein, 9 aa, Homo Sapiens
VITKDCQVS

SEQ ID NO: 1070601 - protein, 9 aa, Homo Sapiens
GLVEEFLLL

SEQ ID NO: 1070602 - protein, 9 aa, Homo Sapiens
SHCSEPLKL

SEQ ID NO: 1070603 - protein, 9 aa, Homo Sapiens
RKRPAPPCP

SEQ ID NO: 1070604 - protein, 9 aa, Homo Sapiens
LRSRLGQKS

SEQ ID NO: 1070605 - protein, 9 aa, Homo Sapiens
KILDNKLTE

SEQ ID NO: 1070606 - protein, 9 aa, Homo Sapiens
QDNPINPKK

SEQ ID NO: 1070607 - protein, 9 aa, Homo Sapiens
RYKEDAPHC

SEQ ID NO: 1070608 - protein, 9 aa, Homo Sapiens
LTDGSTGVE

SEQ ID NO: 1070609 - protein, 9 aa, Homo Sapiens
EVNIYNIYS

SEQ ID NO: 1070610 - protein, 9 aa, Homo Sapiens
AEVLSISED

SEQ ID NO: 1070611 - protein, 9 aa, Homo Sapiens
CICNGHADQ

SEQ ID NO: 1070612 - protein, 9 aa, Homo Sapiens
LFEMWNIIN

SEQ ID NO: 1070613 - protein, 9 aa, Homo Sapiens
QLEERMIVT

SEQ ID NO: 1070614 - protein, 9 aa, Homo Sapiens
KQKEQEEKE

SEQ ID NO: 1070615 - protein, 9 aa, Homo Sapiens
LYTITIFGN

SEQ ID NO: 1070616 - protein, 9 aa, Homo Sapiens
EKCCRKNCL

SEQ ID NO: 1070617 - protein, 9 aa, Homo Sapiens
KIPKLRRRG

SEQ ID NO: 1070618 - protein, 9 aa, Homo Sapiens
EGAGDTHNS

SEQ ID NO: 1070619 - protein, 9 aa, Homo Sapiens
AFLLDMVYR

SEQ ID NO: 1070620 - protein, 9 aa, Homo Sapiens
ATVHDVNHP

SEQ ID NO: 1070621 - protein, 9 aa, Homo Sapiens
ATRGGGAPF

SEQ ID NO: 1070622 - protein, 9 aa, Homo Sapiens
GSEKWVYVN

SEQ ID NO: 1070623 - protein, 9 aa, Homo Sapiens
SVIEIDFLC

SEQ ID NO: 1070624 - protein, 9 aa, Homo Sapiens
RWAPALPAF

SEQ ID NO: 1070625 - protein, 9 aa, Homo Sapiens
LRKLEKKKI

SEQ ID NO: 1070626 - protein, 9 aa, Homo Sapiens
PLPPTISLT

SEQ ID NO: 1070627 - protein, 9 aa, Homo Sapiens
CEPDILETN

SEQ ID NO: 1070628 - protein, 9 aa, Homo Sapiens
NVSYIKQPA

SEQ ID NO: 1070629 - protein, 9 aa, Homo Sapiens
KKIKSYHVE

SEQ ID NO: 1070630 - protein, 9 aa, Homo Sapiens
SAPRSVVFR

SEQ ID NO: 1070631 - protein, 9 aa, Homo Sapiens
PGTGGPPEE

SEQ ID NO: 1070632 - protein, 9 aa, Homo Sapiens
DSLMLNHVK

SEQ ID NO: 1070633 - protein, 9 aa, Homo Sapiens
AEKQEDKAT

SEQ ID NO: 1070634 - protein, 9 aa, Homo Sapiens
TLSLPESQV

SEQ ID NO: 1070635 - protein, 9 aa, Homo Sapiens
GEEQQSYGE

SEQ ID NO: 1070636 - protein, 9 aa, Homo Sapiens
PLSSPSSCN

SEQ ID NO: 1070637 - protein, 9 aa, Homo Sapiens
PAIREHQDR

SEQ ID NO: 1070638 - protein, 9 aa, Homo Sapiens
VIVEKITES

SEQ ID NO: 1070639 - protein, 9 aa, Homo Sapiens
CFARHCVCI

SEQ ID NO: 1070640 - protein, 9 aa, Homo Sapiens
NLKQYPTPY

SEQ ID NO: 1070641 - protein, 9 aa, Homo Sapiens
KFQRTPGDP

SEQ ID NO: 1070642 - protein, 9 aa, Homo Sapiens
PLPSELPGG

SEQ ID NO: 1070643 - protein, 9 aa, Homo Sapiens
KTLKHVSPN

SEQ ID NO: 1070644 - protein, 9 aa, Homo Sapiens
TTAAMLDRE

SEQ ID NO: 1070645 - protein, 9 aa, Homo Sapiens
PSSFSTYHA

SEQ ID NO: 1070646 - protein, 9 aa, Homo Sapiens
GNPPPHFSP

SEQ ID NO: 1070647 - protein, 9 aa, Homo Sapiens
PMELRGPEL

SEQ ID NO: 1070648 - protein, 9 aa, Homo Sapiens
NSNAVVIMV

SEQ ID NO: 1070649 - protein, 9 aa, Homo Sapiens
QSLELYGTG

SEQ ID NO: 1070650 - protein, 9 aa, Homo Sapiens
FFQDITLSD

SEQ ID NO: 1070651 - protein, 9 aa, Homo Sapiens
VKDIISRVR

SEQ ID NO: 1070652 - protein, 9 aa, Homo Sapiens
QVVESRLRK

SEQ ID NO: 1070653 - protein, 9 aa, Homo Sapiens
EKSFTRSKS

SEQ ID NO: 1070654 - protein, 9 aa, Homo Sapiens
VCSKCGKGT

SEQ ID NO: 1070655 - protein, 9 aa, Homo Sapiens
ASSYLWSSF

SEQ ID NO: 1070656 - protein, 9 aa, Homo Sapiens
KDSGRFDVS

SEQ ID NO: 1070657 - protein, 9 aa, Homo Sapiens
PRRGFSFEN

SEQ ID NO: 1070658 - protein, 9 aa, Homo Sapiens
LCTRSENED

SEQ ID NO: 1070659 - protein, 9 aa, Homo Sapiens
EHAPAGQPI

SEQ ID NO: 1070660 - protein, 9 aa, Homo Sapiens
PKKIYTGEK

SEQ ID NO: 1070661 - protein, 9 aa, Homo Sapiens
MFVRLFVDK

SEQ ID NO: 1070662 - protein, 9 aa, Homo Sapiens
TITLVCEEV

SEQ ID NO: 1070663 - protein, 9 aa, Homo Sapiens
MGNMLCGIG

SEQ ID NO: 1070664 - protein, 9 aa, Homo Sapiens
LGTGPRETS

SEQ ID NO: 1070665 - protein, 9 aa, Homo Sapiens
AREKNPGQV

SEQ ID NO: 1070666 - protein, 9 aa, Homo Sapiens
PQDSWRGPS

SEQ ID NO: 1070667 - protein, 9 aa, Homo Sapiens
NFVMVLLIY

SEQ ID NO: 1070668 - protein, 9 aa, Homo Sapiens
STSSDERSP

SEQ ID NO: 1070669 - protein, 9 aa, Homo Sapiens
KQDIGMPKK

SEQ ID NO: 1070670 - protein, 9 aa, Homo Sapiens
DPQEKRYEV

SEQ ID NO: 1070671 - protein, 9 aa, Homo Sapiens
DIPWDISVA

SEQ ID NO: 1070672 - protein, 9 aa, Homo Sapiens
VSVTRVMYC

SEQ ID NO: 1070673 - protein, 9 aa, Homo Sapiens
PEPGWVDPQ

SEQ ID NO: 1070674 - protein, 9 aa, Homo Sapiens
EKSHLGIKK

SEQ ID NO: 1070675 - protein, 9 aa, Homo Sapiens
GRELFYNQK

SEQ ID NO: 1070676 - protein, 9 aa, Homo Sapiens
MTDCLSFIN

SEQ ID NO: 1070677 - protein, 9 aa, Homo Sapiens
CLNEVKAAL

SEQ ID NO: 1070678 - protein, 9 aa, Homo Sapiens
FIFIPLFDF

SEQ ID NO: 1070679 - protein, 9 aa, Homo Sapiens
HKFVLKRRF

SEQ ID NO: 1070680 - protein, 9 aa, Homo Sapiens
TRHLFNGSL

SEQ ID NO: 1070681 - protein, 9 aa, Homo Sapiens
LQTVHFTFE

SEQ ID NO: 1070682 - protein, 9 aa, Homo Sapiens
NEAYTWTNL

SEQ ID NO: 1070683 - protein, 9 aa, Homo Sapiens
MDQKFLWAG

SEQ ID NO: 1070684 - protein, 9 aa, Homo Sapiens
VLEDNEDSR

SEQ ID NO: 1070685 - protein, 9 aa, Homo Sapiens
IKKMEDTSL

SEQ ID NO: 1070686 - protein, 9 aa, Homo Sapiens
TDWMPDNMN

SEQ ID NO: 1070687 - protein, 9 aa, Homo Sapiens
VFNRLDFSS

SEQ ID NO: 1070688 - protein, 9 aa, Homo Sapiens
VFCTPVHLV

SEQ ID NO: 1070689 - protein, 9 aa, Homo Sapiens
CPAQVSPCS

SEQ ID NO: 1070690 - protein, 9 aa, Homo Sapiens
AEINQAFSK

SEQ ID NO: 1070691 - protein, 9 aa, Homo Sapiens
VSPLPKVTP

SEQ ID NO: 1070692 - protein, 9 aa, Homo Sapiens
KKAREFMEL

SEQ ID NO: 1070693 - protein, 9 aa, Homo Sapiens
QSREKTEHA

SEQ ID NO: 1070694 - protein, 9 aa, Homo Sapiens
LFIKHKRKL

SEQ ID NO: 1070695 - protein, 9 aa, Homo Sapiens
STNEPSGDK

SEQ ID NO: 1070696 - protein, 9 aa, Homo Sapiens
FLGILLWLK

SEQ ID NO: 1070697 - protein, 9 aa, Homo Sapiens
LSSSSLSSS

SEQ ID NO: 1070698 - protein, 9 aa, Homo Sapiens
VKKNEPLHK

SEQ ID NO: 1070699 - protein, 9 aa, Homo Sapiens
GFHLATVCK

SEQ ID NO: 1070700 - protein, 9 aa, Homo Sapiens
LHFFFAVGT

SEQ ID NO: 1070701 - protein, 9 aa, Homo Sapiens
MIFLLPFSQ

SEQ ID NO: 1070702 - protein, 9 aa, Homo Sapiens
CKAEEGLNF

SEQ ID NO: 1070703 - protein, 9 aa, Homo Sapiens
RSPDYKDHQ

SEQ ID NO: 1070704 - protein, 9 aa, Homo Sapiens
KSTYLDPDT

SEQ ID NO: 1070705 - protein, 9 aa, Homo Sapiens
ADRRRSAWP

SEQ ID NO: 1070706 - protein, 9 aa, Homo Sapiens
AEIPSYLPA

SEQ ID NO: 1070707 - protein, 9 aa, Homo Sapiens
ESWPYSLTS

SEQ ID NO: 1070708 - protein, 9 aa, Homo Sapiens
GPEDVAKRG

SEQ ID NO: 1070709 - protein, 9 aa, Homo Sapiens
VQKDPPELS

SEQ ID NO: 1070710 - protein, 9 aa, Homo Sapiens
RKKIDMKTG

SEQ ID NO: 1070711 - protein, 9 aa, Homo Sapiens
AVKTVALNA

SEQ ID NO: 1070712 - protein, 9 aa, Homo Sapiens
GERREKGEA

SEQ ID NO: 1070713 - protein, 9 aa, Homo Sapiens
NSIPLVLET

SEQ ID NO: 1070714 - protein, 9 aa, Homo Sapiens
NNSFFCPVY

SEQ ID NO: 1070715 - protein, 9 aa, Homo Sapiens
NYLMLIINA

SEQ ID NO: 1070716 - protein, 9 aa, Homo Sapiens
HMCCPSRSS

SEQ ID NO: 1070717 - protein, 9 aa, Homo Sapiens
TATFEAPFG

SEQ ID NO: 1070718 - protein, 9 aa, Homo Sapiens
LTEFDVKNF

SEQ ID NO: 1070719 - protein, 9 aa, Homo Sapiens
SVHVHNNRP

SEQ ID NO: 1070720 - protein, 9 aa, Homo Sapiens
VKFKSVTIK

SEQ ID NO: 1070721 - protein, 9 aa, Homo Sapiens
NSFVLKNFS

SEQ ID NO: 1070722 - protein, 9 aa, Homo Sapiens
TPSPLEEMQ

SEQ ID NO: 1070723 - protein, 9 aa, Homo Sapiens
YSCAVVNIP

SEQ ID NO: 1070724 - protein, 9 aa, Homo Sapiens
GNMLCGIGE

SEQ ID NO: 1070725 - protein, 9 aa, Homo Sapiens
RPQEKNVWE

SEQ ID NO: 1070726 - protein, 9 aa, Homo Sapiens
SVVCGSLFY

SEQ ID NO: 1070727 - protein, 9 aa, Homo Sapiens
ALKLSLKCR

SEQ ID NO: 1070728 - protein, 9 aa, Homo Sapiens
ESNQKSENN

SEQ ID NO: 1070729 - protein, 9 aa, Homo Sapiens
LDPRSSRDF

SEQ ID NO: 1070730 - protein, 9 aa, Homo Sapiens
TARVLVIRA

SEQ ID NO: 1070731 - protein, 9 aa, Homo Sapiens
IIARSLETF

SEQ ID NO: 1070732 - protein, 9 aa, Homo Sapiens
KAGLLGVLK

SEQ ID NO: 1070733 - protein, 9 aa, Homo Sapiens
NFGHSSSYG

SEQ ID NO: 1070734 - protein, 9 aa, Homo Sapiens
GDSLEEPME

SEQ ID NO: 1070735 - protein, 9 aa, Homo Sapiens
RPTQKIPKT

SEQ ID NO: 1070736 - protein, 9 aa, Homo Sapiens
TPQNDITPL

SEQ ID NO: 1070737 - protein, 9 aa, Homo Sapiens
LQIVANFFL

SEQ ID NO: 1070738 - protein, 9 aa, Homo Sapiens
LQLFHCLHE

SEQ ID NO: 1070739 - protein, 9 aa, Homo Sapiens
ITDWMPDNM

SEQ ID NO: 1070740 - protein, 9 aa, Homo Sapiens
QQRRQRVCF

SEQ ID NO: 1070741 - protein, 9 aa, Homo Sapiens
HCRVRGGHW

SEQ ID NO: 1070742 - protein, 9 aa, Homo Sapiens
TAFRVDSAE

SEQ ID NO: 1070743 - protein, 9 aa, Homo Sapiens
SNIQEIEAE

SEQ ID NO: 1070744 - protein, 9 aa, Homo Sapiens
SSERDAEDK

SEQ ID NO: 1070745 - protein, 9 aa, Homo Sapiens
SANVAVLPG

SEQ ID NO: 1070746 - protein, 9 aa, Homo Sapiens
EEADQPITE

SEQ ID NO: 1070747 - protein, 9 aa, Homo Sapiens
AFEEKQKEQ

SEQ ID NO: 1070748 - protein, 9 aa, Homo Sapiens
IFLLVTAKG

SEQ ID NO: 1070749 - protein, 9 aa, Homo Sapiens
TIINGNPRQ

SEQ ID NO: 1070750 - protein, 9 aa, Homo Sapiens
QADEELLGQ

SEQ ID NO: 1070751 - protein, 9 aa, Homo Sapiens
DQKQRRQRP

SEQ ID NO: 1070752 - protein, 9 aa, Homo Sapiens
GKRNKLQPG

SEQ ID NO: 1070753 - protein, 9 aa, Homo Sapiens
NPSSKLTSN

SEQ ID NO: 1070754 - protein, 9 aa, Homo Sapiens
YVISLAGAQ

SEQ ID NO: 1070755 - protein, 9 aa, Homo Sapiens
WMPDNMNFS

SEQ ID NO: 1070756 - protein, 9 aa, Homo Sapiens
YKIAVRIKG

SEQ ID NO: 1070757 - protein, 9 aa, Homo Sapiens
PRPSSRSAV

SEQ ID NO: 1070758 - protein, 9 aa, Homo Sapiens
LIEFGQWLH

SEQ ID NO: 1070759 - protein, 9 aa, Homo Sapiens
LIVMKGAPE

SEQ ID NO: 1070760 - protein, 9 aa, Homo Sapiens
KFSGFPRVE

SEQ ID NO: 1070761 - protein, 9 aa, Homo Sapiens
TRMSSQPPD

SEQ ID NO: 1070762 - protein, 9 aa, Homo Sapiens
EKLNSEVEV

SEQ ID NO: 1070763 - protein, 9 aa, Homo Sapiens
CLFLDKVIM

SEQ ID NO: 1070764 - protein, 9 aa, Homo Sapiens
TFIWKFQRT

SEQ ID NO: 1070765 - protein, 9 aa, Homo Sapiens
FAREDQIIG

SEQ ID NO: 1070766 - protein, 9 aa, Homo Sapiens
LLNFDIFYN

SEQ ID NO: 1070767 - protein, 9 aa, Homo Sapiens
KPNLRPIFK

SEQ ID NO: 1070768 - protein, 9 aa, Homo Sapiens
PLYGSYTEM

SEQ ID NO: 1070769 - protein, 9 aa, Homo Sapiens
DLLERISDQ

SEQ ID NO: 1070770 - protein, 9 aa, Homo Sapiens
TGPVAKKSS

SEQ ID NO: 1070771 - protein, 9 aa, Homo Sapiens
TESAEARVG

SEQ ID NO: 1070772 - protein, 9 aa, Homo Sapiens
PPSTTHAFL

SEQ ID NO: 1070773 - protein, 9 aa, Homo Sapiens
HNYQNWRMY

SEQ ID NO: 1070774 - protein, 9 aa, Homo Sapiens
PNVCETKSC

SEQ ID NO: 1070775 - protein, 9 aa, Homo Sapiens
LLVSVTRNP

SEQ ID NO: 1070776 - protein, 9 aa, Homo Sapiens
EDKKKEFEE

SEQ ID NO: 1070777 - protein, 9 aa, Homo Sapiens
RATNRPDSL

SEQ ID NO: 1070778 - protein, 9 aa, Homo Sapiens
SSAGEAGCY

SEQ ID NO: 1070779 - protein, 9 aa, Homo Sapiens
MAAISTFIP

SEQ ID NO: 1070780 - protein, 9 aa, Homo Sapiens
LQYLSLLFF

SEQ ID NO: 1070781 - protein, 9 aa, Homo Sapiens
LIVLPNDVL

SEQ ID NO: 1070782 - protein, 9 aa, Homo Sapiens
STNAEQRGQ

SEQ ID NO: 1070783 - protein, 9 aa, Homo Sapiens
PTLQPAVFS

SEQ ID NO: 1070784 - protein, 9 aa, Homo Sapiens
SLEPGDRDV

SEQ ID NO: 1070785 - protein, 9 aa, Homo Sapiens
NKGRNWDYL

SEQ ID NO: 1070786 - protein, 9 aa, Homo Sapiens
PSILNGFDH

SEQ ID NO: 1070787 - protein, 9 aa, Homo Sapiens
QNKEFDKDY

SEQ ID NO: 1070788 - protein, 9 aa, Homo Sapiens
DTIVFIASI

SEQ ID NO: 1070789 - protein, 9 aa, Homo Sapiens
FLKSVEHVS

SEQ ID NO: 1070790 - protein, 9 aa, Homo Sapiens
PLRYSVLIS

SEQ ID NO: 1070791 - protein, 9 aa, Homo Sapiens
KRQIESTLK

SEQ ID NO: 1070792 - protein, 9 aa, Homo Sapiens
TVSVCRRKA

SEQ ID NO: 1070793 - protein, 9 aa, Homo Sapiens
CEANLQALI

SEQ ID NO: 1070794 - protein, 9 aa, Homo Sapiens
SDPPTSAFH

SEQ ID NO: 1070795 - protein, 9 aa, Homo Sapiens
HQPKCPENN

SEQ ID NO: 1070796 - protein, 9 aa, Homo Sapiens
SPGHVIVES

SEQ ID NO: 1070797 - protein, 9 aa, Homo Sapiens
TMPMVPPLN

SEQ ID NO: 1070798 - protein, 9 aa, Homo Sapiens
HSQVGQKQS

SEQ ID NO: 1070799 - protein, 9 aa, Homo Sapiens
QAAQSSAAI

SEQ ID NO: 1070800 - protein, 9 aa, Homo Sapiens
GLHLNSTTP

SEQ ID NO: 1070801 - protein, 9 aa, Homo Sapiens
EPLNVIFLV

SEQ ID NO: 1070802 - protein, 9 aa, Homo Sapiens
PPASIVPFM

SEQ ID NO: 1070803 - protein, 9 aa, Homo Sapiens
LHHLNHKGE

SEQ ID NO: 1070804 - protein, 9 aa, Homo Sapiens
EVENQYQGN

SEQ ID NO: 1070805 - protein, 9 aa, Homo Sapiens
GYHPTKSHL

SEQ ID NO: 1070806 - protein, 9 aa, Homo Sapiens
LASGGTGFF

SEQ ID NO: 1070807 - protein, 9 aa, Homo Sapiens
LVGNLGIIE

SEQ ID NO: 1070808 - protein, 9 aa, Homo Sapiens
ESLSSKPNQ

SEQ ID NO: 1070809 - protein, 9 aa, Homo Sapiens
LSSLAGRPG

SEQ ID NO: 1070810 - protein, 9 aa, Homo Sapiens
EERFYLGLF

SEQ ID NO: 1070811 - protein, 9 aa, Homo Sapiens
LPPSALTSE

SEQ ID NO: 1070812 - protein, 9 aa, Homo Sapiens
PSTAAPAVR

SEQ ID NO: 1070813 - protein, 9 aa, Homo Sapiens
RALPLLANN

SEQ ID NO: 1070814 - protein, 9 aa, Homo Sapiens
IPKPLQLDF

SEQ ID NO: 1070815 - protein, 9 aa, Homo Sapiens
RNIMTYYQE

SEQ ID NO: 1070816 - protein, 9 aa, Homo Sapiens
RPVIIYRAI

SEQ ID NO: 1070817 - protein, 9 aa, Homo Sapiens
PEKPSKNPE

SEQ ID NO: 1070818 - protein, 9 aa, Homo Sapiens
GPPTYTSTA

SEQ ID NO: 1070819 - protein, 9 aa, Homo Sapiens
PQREGYSHD

SEQ ID NO: 1070820 - protein, 9 aa, Homo Sapiens
HPFGLSLAR

SEQ ID NO: 1070821 - protein, 9 aa, Homo Sapiens
QLTFEMFEA

SEQ ID NO: 1070822 - protein, 9 aa, Homo Sapiens
VDKDEHMQV

SEQ ID NO: 1070823 - protein, 9 aa, Homo Sapiens
SKFQNLQIL

SEQ ID NO: 1070824 - protein, 9 aa, Homo Sapiens
LLLPGRLCA

SEQ ID NO: 1070825 - protein, 9 aa, Homo Sapiens
RMSMKLTSN

SEQ ID NO: 1070826 - protein, 9 aa, Homo Sapiens
NSTRWSTTA

SEQ ID NO: 1070827 - protein, 9 aa, Homo Sapiens
ANFIKEFVI

SEQ ID NO: 1070828 - protein, 9 aa, Homo Sapiens
SLTAPTSWT

SEQ ID NO: 1070829 - protein, 9 aa, Homo Sapiens
HVKEMYDHQ

SEQ ID NO: 1070830 - protein, 9 aa, Homo Sapiens
LNHFSSRQP

SEQ ID NO: 1070831 - protein, 9 aa, Homo Sapiens
VSLQYVFNQ

SEQ ID NO: 1070832 - protein, 9 aa, Homo Sapiens
LYKIGITYY

SEQ ID NO: 1070833 - protein, 9 aa, Homo Sapiens
VRKFLFLFH

SEQ ID NO: 1070834 - protein, 9 aa, Homo Sapiens
KNARSQKNT

SEQ ID NO: 1070835 - protein, 9 aa, Homo Sapiens
LTFEMFEAD

SEQ ID NO: 1070836 - protein, 9 aa, Homo Sapiens
FSYRHYCTM

SEQ ID NO: 1070837 - protein, 9 aa, Homo Sapiens
LAEELPQPR

SEQ ID NO: 1070838 - protein, 9 aa, Homo Sapiens
NLAGKTSTD

SEQ ID NO: 1070839 - protein, 9 aa, Homo Sapiens
RTHTGICPY

SEQ ID NO: 1070840 - protein, 9 aa, Homo Sapiens
VIVCNKKNN

SEQ ID NO: 1070841 - protein, 9 aa, Homo Sapiens
QTRVLGVKN

SEQ ID NO: 1070842 - protein, 9 aa, Homo Sapiens
EMIFLLPFS

SEQ ID NO: 1070843 - protein, 9 aa, Homo Sapiens
RPKVLVELI

SEQ ID NO: 1070844 - protein, 9 aa, Homo Sapiens
RQTKPCHDQ

SEQ ID NO: 1070845 - protein, 9 aa, Homo Sapiens
CLKKSTLDE

SEQ ID NO: 1070846 - protein, 9 aa, Homo Sapiens
NFDNYFEGA

SEQ ID NO: 1070847 - protein, 9 aa, Homo Sapiens
QEVNTKLCD

SEQ ID NO: 1070848 - protein, 9 aa, Homo Sapiens
SGHSQCSCG

SEQ ID NO: 1070849 - protein, 9 aa, Homo Sapiens
NLADCSTDP

SEQ ID NO: 1070850 - protein, 9 aa, Homo Sapiens
KGERGQKGR

SEQ ID NO: 1070851 - protein, 9 aa, Homo Sapiens
RRRKRRKFI

SEQ ID NO: 1070852 - protein, 9 aa, Homo Sapiens
QLLQNVSTV

SEQ ID NO: 1070853 - protein, 9 aa, Homo Sapiens
PDDDLFQDS

SEQ ID NO: 1070854 - protein, 9 aa, Homo Sapiens
LNDIFYGRD

SEQ ID NO: 1070855 - protein, 9 aa, Homo Sapiens
QETMAPSIK

SEQ ID NO: 1070856 - protein, 9 aa, Homo Sapiens
LEDKSPEYF

SEQ ID NO: 1070857 - protein, 9 aa, Homo Sapiens
NCSMAKKRT

SEQ ID NO: 1070858 - protein, 9 aa, Homo Sapiens
LTALAEQIS

SEQ ID NO: 1070859 - protein, 9 aa, Homo Sapiens
WRKICCNCK

SEQ ID NO: 1070860 - protein, 9 aa, Homo Sapiens
PCHDQEPHG

SEQ ID NO: 1070861 - protein, 9 aa, Homo Sapiens
QGPAPSPSL

SEQ ID NO: 1070862 - protein, 9 aa, Homo Sapiens
GLFAATFSA

SEQ ID NO: 1070863 - protein, 9 aa, Homo Sapiens
LNSFERDSM

SEQ ID NO: 1070864 - protein, 9 aa, Homo Sapiens
SDPEKKEVN

SEQ ID NO: 1070865 - protein, 9 aa, Homo Sapiens
LFFPTVCEL

SEQ ID NO: 1070866 - protein, 9 aa, Homo Sapiens
EGVCSVVDD

SEQ ID NO: 1070867 - protein, 9 aa, Homo Sapiens
RNQQRWTLG

SEQ ID NO: 1070868 - protein, 9 aa, Homo Sapiens
DLGHSRDSS

SEQ ID NO: 1070869 - protein, 9 aa, Homo Sapiens
SPVEIKGED

SEQ ID NO: 1070870 - protein, 9 aa, Homo Sapiens
SFSTNIAFN

SEQ ID NO: 1070871 - protein, 9 aa, Homo Sapiens
SASAAWSPV

SEQ ID NO: 1070872 - protein, 9 aa, Homo Sapiens
AAALALTLQ

SEQ ID NO: 1070873 - protein, 9 aa, Homo Sapiens
LKKKNEDCF

SEQ ID NO: 1070874 - protein, 9 aa, Homo Sapiens
RTPRGIPSS

SEQ ID NO: 1070875 - protein, 9 aa, Homo Sapiens
KDKRQNSLR

SEQ ID NO: 1070876 - protein, 9 aa, Homo Sapiens
LQVCCASPS

SEQ ID NO: 1070877 - protein, 9 aa, Homo Sapiens
VAWEALLSF

SEQ ID NO: 1070878 - protein, 9 aa, Homo Sapiens
FETDTILES

SEQ ID NO: 1070879 - protein, 9 aa, Homo Sapiens
GDGGEVGDS

SEQ ID NO: 1070880 - protein, 9 aa, Homo Sapiens
ILLPGRDYI

SEQ ID NO: 1070881 - protein, 9 aa, Homo Sapiens
LFGGSETNG

SEQ ID NO: 1070882 - protein, 9 aa, Homo Sapiens
ACDFFQDIT

SEQ ID NO: 1070883 - protein, 9 aa, Homo Sapiens
EIPSYLPAD

SEQ ID NO: 1070884 - protein, 9 aa, Homo Sapiens
GKSAMKHIV

SEQ ID NO: 1070885 - protein, 9 aa, Homo Sapiens
KYSYQAPLV

SEQ ID NO: 1070886 - protein, 9 aa, Homo Sapiens
LIKLQRRLS

SEQ ID NO: 1070887 - protein, 9 aa, Homo Sapiens
QNWRMYDVL

SEQ ID NO: 1070888 - protein, 9 aa, Homo Sapiens
MYIAEKIHN

SEQ ID NO: 1070889 - protein, 9 aa, Homo Sapiens
RGRHGSNFG

SEQ ID NO: 1070890 - protein, 9 aa, Homo Sapiens
CQGKKKKHD

SEQ ID NO: 1070891 - protein, 9 aa, Homo Sapiens
PYTRYHPID

SEQ ID NO: 1070892 - protein, 9 aa, Homo Sapiens
DGAKNLLSH

SEQ ID NO: 1070893 - protein, 9 aa, Homo Sapiens
FVFGDFNFW

SEQ ID NO: 1070894 - protein, 9 aa, Homo Sapiens
FRVLPDHTK

SEQ ID NO: 1070895 - protein, 9 aa, Homo Sapiens
MISVNPGLD

SEQ ID NO: 1070896 - protein, 9 aa, Homo Sapiens
KEWEMWHPT

SEQ ID NO: 1070897 - protein, 9 aa, Homo Sapiens
KKKTKIFSL

SEQ ID NO: 1070898 - protein, 9 aa, Homo Sapiens
PFIQTIMLF

SEQ ID NO: 1070899 - protein, 9 aa, Homo Sapiens
HLPLPAKST

SEQ ID NO: 1070900 - protein, 9 aa, Homo Sapiens
EALPLHQVP

SEQ ID NO: 1070901 - protein, 9 aa, Homo Sapiens
LASLDTFQQ

SEQ ID NO: 1070902 - protein, 9 aa, Homo Sapiens
CESLELKNT

SEQ ID NO: 1070903 - protein, 9 aa, Homo Sapiens
LQINAYLRK

SEQ ID NO: 1070904 - protein, 9 aa, Homo Sapiens
EFDSHGDAG

SEQ ID NO: 1070905 - protein, 9 aa, Homo Sapiens
DGATCAMKW

SEQ ID NO: 1070906 - protein, 9 aa, Homo Sapiens
WNSSAVLLI

SEQ ID NO: 1070907 - protein, 9 aa, Homo Sapiens
NPKKSRQEI

SEQ ID NO: 1070908 - protein, 9 aa, Homo Sapiens
FTTTTVTAV

SEQ ID NO: 1070909 - protein, 9 aa, Homo Sapiens
FVCEKGSCP

SEQ ID NO: 1070910 - protein, 9 aa, Homo Sapiens
LQVYWETMS

SEQ ID NO: 1070911 - protein, 9 aa, Homo Sapiens
LENRTKDFK

SEQ ID NO: 1070912 - protein, 9 aa, Homo Sapiens
KGMSLGVKG

SEQ ID NO: 1070913 - protein, 9 aa, Homo Sapiens
SHQRIHTKE

SEQ ID NO: 1070914 - protein, 9 aa, Homo Sapiens
YSVLISWRV

SEQ ID NO: 1070915 - protein, 9 aa, Homo Sapiens
LPFIQTIML

SEQ ID NO: 1070916 - protein, 9 aa, Homo Sapiens
NTHNNYENV

SEQ ID NO: 1070917 - protein, 9 aa, Homo Sapiens
TPRCPPKCL

SEQ ID NO: 1070918 - protein, 9 aa, Homo Sapiens
PFILGLPPH

SEQ ID NO: 1070919 - protein, 9 aa, Homo Sapiens
LSDVWSFEI

SEQ ID NO: 1070920 - protein, 9 aa, Homo Sapiens
SRLGQKSVH

SEQ ID NO: 1070921 - protein, 9 aa, Homo Sapiens
QPPKPGSEK

SEQ ID NO: 1070922 - protein, 9 aa, Homo Sapiens
YNSHTAYYP

SEQ ID NO: 1070923 - protein, 9 aa, Homo Sapiens
SIVEFFRPS

SEQ ID NO: 1070924 - protein, 9 aa, Homo Sapiens
RFYYQHNDQ

SEQ ID NO: 1070925 - protein, 9 aa, Homo Sapiens
TVETQNPFF

SEQ ID NO: 1070926 - protein, 9 aa, Homo Sapiens
TANFVELGD

SEQ ID NO: 1070927 - protein, 9 aa, Homo Sapiens
TEISHLIKK

SEQ ID NO: 1070928 - protein, 9 aa, Homo Sapiens
SETSLVGKN

SEQ ID NO: 1070929 - protein, 9 aa, Homo Sapiens
LYYLITTYL

SEQ ID NO: 1070930 - protein, 9 aa, Homo Sapiens
PFKELEKRT

SEQ ID NO: 1070931 - protein, 9 aa, Homo Sapiens
DVARLGVAS

SEQ ID NO: 1070932 - protein, 9 aa, Homo Sapiens
PVELSQRML

SEQ ID NO: 1070933 - protein, 9 aa, Homo Sapiens
FQSEVARRF

SEQ ID NO: 1070934 - protein, 9 aa, Homo Sapiens
LRNPNNKYE

SEQ ID NO: 1070935 - protein, 9 aa, Homo Sapiens
IYLPSAMPP

SEQ ID NO: 1070936 - protein, 9 aa, Homo Sapiens
LSYAGGLLH

SEQ ID NO: 1070937 - protein, 9 aa, Homo Sapiens
PQMAELRKP

SEQ ID NO: 1070938 - protein, 9 aa, Homo Sapiens
HANQTGYLD

SEQ ID NO: 1070939 - protein, 9 aa, Homo Sapiens
IMLLKLKKK

SEQ ID NO: 1070940 - protein, 9 aa, Homo Sapiens
SDGAKNLLS

SEQ ID NO: 1070941 - protein, 9 aa, Homo Sapiens
ETLHTVDLF

SEQ ID NO: 1070942 - protein, 9 aa, Homo Sapiens
GRSSALYFS

SEQ ID NO: 1070943 - protein, 9 aa, Homo Sapiens
QLDKGLVND

SEQ ID NO: 1070944 - protein, 9 aa, Homo Sapiens
RLDTMMASM

SEQ ID NO: 1070945 - protein, 9 aa, Homo Sapiens
SPSLLKRHE

SEQ ID NO: 1070946 - protein, 9 aa, Homo Sapiens
ERDLVPEDE

SEQ ID NO: 1070947 - protein, 9 aa, Homo Sapiens
KPSPALVPS

SEQ ID NO: 1070948 - protein, 9 aa, Homo Sapiens
ECNVCGKFF

SEQ ID NO: 1070949 - protein, 9 aa, Homo Sapiens
NLKRLKDSI

SEQ ID NO: 1070950 - protein, 9 aa, Homo Sapiens
LVPREDQAE

SEQ ID NO: 1070951 - protein, 9 aa, Homo Sapiens
KEGQKKGWL

SEQ ID NO: 1070952 - protein, 9 aa, Homo Sapiens
ESKAPERRV

SEQ ID NO: 1070953 - protein, 9 aa, Homo Sapiens
HGDLLFLFS

SEQ ID NO: 1070954 - protein, 9 aa, Homo Sapiens
VYSLWKIDV

SEQ ID NO: 1070955 - protein, 9 aa, Homo Sapiens
HLTKHDNFH

SEQ ID NO: 1070956 - protein, 9 aa, Homo Sapiens
EPKADGPND

SEQ ID NO: 1070957 - protein, 9 aa, Homo Sapiens
AGIKDANCW

SEQ ID NO: 1070958 - protein, 9 aa, Homo Sapiens
RIQDNVDQT

SEQ ID NO: 1070959 - protein, 9 aa, Homo Sapiens
GSKLWIIMK

SEQ ID NO: 1070960 - protein, 9 aa, Homo Sapiens
QHQFFAIKS

SEQ ID NO: 1070961 - protein, 9 aa, Homo Sapiens
QRVIINIAE

SEQ ID NO: 1070962 - protein, 9 aa, Homo Sapiens
VLTRKRSDS

SEQ ID NO: 1070963 - protein, 9 aa, Homo Sapiens
SLEWETKAQ

SEQ ID NO: 1070964 - protein, 9 aa, Homo Sapiens
GFRSDLDNL

SEQ ID NO: 1070965 - protein, 9 aa, Homo Sapiens
TTGGSGYKN

SEQ ID NO: 1070966 - protein, 9 aa, Homo Sapiens
KFCGEEGLD

SEQ ID NO: 1070967 - protein, 9 aa, Homo Sapiens
GGIKRDQAP

SEQ ID NO: 1070968 - protein, 9 aa, Homo Sapiens
SPEPKGSPG

SEQ ID NO: 1070969 - protein, 9 aa, Homo Sapiens
CYLTEYSYG

SEQ ID NO: 1070970 - protein, 9 aa, Homo Sapiens
IPLSVISVF

SEQ ID NO: 1070971 - protein, 9 aa, Homo Sapiens
PYLRTEFYQ

SEQ ID NO: 1070972 - protein, 9 aa, Homo Sapiens
TLRFDELKI

SEQ ID NO: 1070973 - protein, 9 aa, Homo Sapiens
EVVGSSMSL

SEQ ID NO: 1070974 - protein, 9 aa, Homo Sapiens
AICYLLRYT

SEQ ID NO: 1070975 - protein, 9 aa, Homo Sapiens
REFQKFPLP

SEQ ID NO: 1070976 - protein, 9 aa, Homo Sapiens
EDKKNYPSL

SEQ ID NO: 1070977 - protein, 9 aa, Homo Sapiens
LKLAVDQRE

SEQ ID NO: 1070978 - protein, 9 aa, Homo Sapiens
CILKLNTEI

SEQ ID NO: 1070979 - protein, 9 aa, Homo Sapiens
GLLNFDIFY

SEQ ID NO: 1070980 - protein, 9 aa, Homo Sapiens
EYCFAWVEA

SEQ ID NO: 1070981 - protein, 9 aa, Homo Sapiens
AGLERDLVP

SEQ ID NO: 1070982 - protein, 9 aa, Homo Sapiens
LKCRVDLLF

SEQ ID NO: 1070983 - protein, 9 aa, Homo Sapiens
GCTLECQCV

SEQ ID NO: 1070984 - protein, 9 aa, Homo Sapiens
PRKEWEMWH

SEQ ID NO: 1070985 - protein, 9 aa, Homo Sapiens
LVSKHMNKT

SEQ ID NO: 1070986 - protein, 9 aa, Homo Sapiens
GASKTGKKR

SEQ ID NO: 1070987 - protein, 9 aa, Homo Sapiens
LAFQHRPHN

SEQ ID NO: 1070988 - protein, 9 aa, Homo Sapiens
VLQLLNPLL

SEQ ID NO: 1070989 - protein, 9 aa, Homo Sapiens
LGSVQICVP

SEQ ID NO: 1070990 - protein, 9 aa, Homo Sapiens
PPLSNGGRA

SEQ ID NO: 1070991 - protein, 9 aa, Homo Sapiens
MKHIVILFT

SEQ ID NO: 1070992 - protein, 9 aa, Homo Sapiens
FSGHTGREA

SEQ ID NO: 1070993 - protein, 9 aa, Homo Sapiens
LYTHMDYNK

SEQ ID NO: 1070994 - protein, 9 aa, Homo Sapiens
ASPTIFSFS

SEQ ID NO: 1070995 - protein, 9 aa, Homo Sapiens
RRTALILAV

SEQ ID NO: 1070996 - protein, 9 aa, Homo Sapiens
LLRQTTAKA

SEQ ID NO: 1070997 - protein, 9 aa, Homo Sapiens
SRWPVVVAE

SEQ ID NO: 1070998 - protein, 9 aa, Homo Sapiens
VNPKNAFLP

SEQ ID NO: 1070999 - protein, 9 aa, Homo Sapiens
FEREEAIKK

SEQ ID NO: 1071000 - protein, 9 aa, Homo Sapiens
SRERSSRRE

SEQ ID NO: 1071001 - protein, 9 aa, Homo Sapiens
SFHTALKLA

SEQ ID NO: 1071002 - protein, 9 aa, Homo Sapiens
QSMAFALLA

SEQ ID NO: 1071003 - protein, 9 aa, Homo Sapiens
RGRGGYISK

SEQ ID NO: 1071004 - protein, 9 aa, Homo Sapiens
FLHSESKVL

SEQ ID NO: 1071005 - protein, 9 aa, Homo Sapiens
LRRQSRSFT

SEQ ID NO: 1071006 - protein, 9 aa, Homo Sapiens
KQTPFSELG

SEQ ID NO: 1071007 - protein, 9 aa, Homo Sapiens
LVGYKLGII

SEQ ID NO: 1071008 - protein, 9 aa, Homo Sapiens
QTLRAWPAS

SEQ ID NO: 1071009 - protein, 9 aa, Homo Sapiens
TLSTDYHIF

SEQ ID NO: 1071010 - protein, 9 aa, Homo Sapiens
FFCVAEMYI

SEQ ID NO: 1071011 - protein, 9 aa, Homo Sapiens
ALSETRDLE

SEQ ID NO: 1071012 - protein, 9 aa, Homo Sapiens
GPPGSGSSL

SEQ ID NO: 1071013 - protein, 9 aa, Homo Sapiens
TYFSFDYQN

SEQ ID NO: 1071014 - protein, 9 aa, Homo Sapiens
IRVIDISII

SEQ ID NO: 1071015 - protein, 9 aa, Homo Sapiens
EEKTLTFEA

SEQ ID NO: 1071016 - protein, 9 aa, Homo Sapiens
EQVLPPSAL

SEQ ID NO: 1071017 - protein, 9 aa, Homo Sapiens
TKNFSFLHL

SEQ ID NO: 1071018 - protein, 9 aa, Homo Sapiens
VDESFRQSQ

SEQ ID NO: 1071019 - protein, 9 aa, Homo Sapiens
PLAREDDSF

SEQ ID NO: 1071020 - protein, 9 aa, Homo Sapiens
APALEKPIC

SEQ ID NO: 1071021 - protein, 9 aa, Homo Sapiens
MENISMVLF

SEQ ID NO: 1071022 - protein, 9 aa, Homo Sapiens
QQVGGGGRF

SEQ ID NO: 1071023 - protein, 9 aa, Homo Sapiens
RYGGGGYYE

SEQ ID NO: 1071024 - protein, 9 aa, Homo Sapiens
SSPQKTRSE

SEQ ID NO: 1071025 - protein, 9 aa, Homo Sapiens
TNIKNSEKV

SEQ ID NO: 1071026 - protein, 9 aa, Homo Sapiens
APPSLSGAS

SEQ ID NO: 1071027 - protein, 9 aa, Homo Sapiens
FHTEIKEDS

SEQ ID NO: 1071028 - protein, 9 aa, Homo Sapiens
LKKIQLQKD

SEQ ID NO: 1071029 - protein, 9 aa, Homo Sapiens
RQLIADLVV

SEQ ID NO: 1071030 - protein, 9 aa, Homo Sapiens
NTLEGFASL

SEQ ID NO: 1071031 - protein, 9 aa, Homo Sapiens
QESPKSDCN

SEQ ID NO: 1071032 - protein, 9 aa, Homo Sapiens
ALKAPPSLS

SEQ ID NO: 1071033 - protein, 9 aa, Homo Sapiens
ADQHNNIAH

SEQ ID NO: 1071034 - protein, 9 aa, Homo Sapiens
NFFIVLFFV

SEQ ID NO: 1071035 - protein, 9 aa, Homo Sapiens
SIEGMIVLH

SEQ ID NO: 1071036 - protein, 9 aa, Homo Sapiens
PPPPPPQAQ

SEQ ID NO: 1071037 - protein, 9 aa, Homo Sapiens
GWGGAMLGI

SEQ ID NO: 1071038 - protein, 9 aa, Homo Sapiens
EPFHKRFSC

SEQ ID NO: 1071039 - protein, 9 aa, Homo Sapiens
PIDYYWWLR

SEQ ID NO: 1071040 - protein, 9 aa, Homo Sapiens
TTYQRTLLE

SEQ ID NO: 1071041 - protein, 9 aa, Homo Sapiens
QKRPPALSG

SEQ ID NO: 1071042 - protein, 9 aa, Homo Sapiens
AAPEAWLEN

SEQ ID NO: 1071043 - protein, 9 aa, Homo Sapiens
CPEPQEACS

SEQ ID NO: 1071044 - protein, 9 aa, Homo Sapiens
ILLAMAYNR

SEQ ID NO: 1071045 - protein, 9 aa, Homo Sapiens
KEPSVKANG

SEQ ID NO: 1071046 - protein, 9 aa, Homo Sapiens
YAEINQAFS

SEQ ID NO: 1071047 - protein, 9 aa, Homo Sapiens
LYELQPAAS

SEQ ID NO: 1071048 - protein, 9 aa, Homo Sapiens
PADGLERLA

SEQ ID NO: 1071049 - protein, 9 aa, Homo Sapiens
KFVFVKPLE

SEQ ID NO: 1071050 - protein, 9 aa, Homo Sapiens
LQKIILDQL

SEQ ID NO: 1071051 - protein, 9 aa, Homo Sapiens
LSSKPNQKK

SEQ ID NO: 1071052 - protein, 9 aa, Homo Sapiens
KKPRIDYPL

SEQ ID NO: 1071053 - protein, 9 aa, Homo Sapiens
FFLFLTIYL

SEQ ID NO: 1071054 - protein, 9 aa, Homo Sapiens
LSSAFVGLF

SEQ ID NO: 1071055 - protein, 9 aa, Homo Sapiens
THTQEKSYK

SEQ ID NO: 1071056 - protein, 9 aa, Homo Sapiens
TSSACKTHS

SEQ ID NO: 1071057 - protein, 9 aa, Homo Sapiens
MDFVCPEKC

SEQ ID NO: 1071058 - protein, 9 aa, Homo Sapiens
IDNPPKNET

SEQ ID NO: 1071059 - protein, 9 aa, Homo Sapiens
ITKTLEKIA

SEQ ID NO: 1071060 - protein, 9 aa, Homo Sapiens
QEKGLAWEE

SEQ ID NO: 1071061 - protein, 9 aa, Homo Sapiens
DAPRAVFSS

SEQ ID NO: 1071062 - protein, 9 aa, Homo Sapiens
GCKERDLWK

SEQ ID NO: 1071063 - protein, 9 aa, Homo Sapiens
FKEIKSSEL

SEQ ID NO: 1071064 - protein, 9 aa, Homo Sapiens
ATFEAPFGL

SEQ ID NO: 1071065 - protein, 9 aa, Homo Sapiens
LDSPLTEKK

SEQ ID NO: 1071066 - protein, 9 aa, Homo Sapiens
KSLDDSSNK

SEQ ID NO: 1071067 - protein, 9 aa, Homo Sapiens
EDTRKLDKS

SEQ ID NO: 1071068 - protein, 9 aa, Homo Sapiens
SCICNGHAD

SEQ ID NO: 1071069 - protein, 9 aa, Homo Sapiens
HFSATPVPV

SEQ ID NO: 1071070 - protein, 9 aa, Homo Sapiens
ELTVDKASS

SEQ ID NO: 1071071 - protein, 9 aa, Homo Sapiens
STRYAQYHH

SEQ ID NO: 1071072 - protein, 9 aa, Homo Sapiens
HHLHKTLRK

SEQ ID NO: 1071073 - protein, 9 aa, Homo Sapiens
TCFRSPFCE

SEQ ID NO: 1071074 - protein, 9 aa, Homo Sapiens
LYDQNHVTG

SEQ ID NO: 1071075 - protein, 9 aa, Homo Sapiens
PSPSLCLRV

SEQ ID NO: 1071076 - protein, 9 aa, Homo Sapiens
GPSNCSNSV

SEQ ID NO: 1071077 - protein, 9 aa, Homo Sapiens
LAGAQKLVG

SEQ ID NO: 1071078 - protein, 9 aa, Homo Sapiens
LVYVDSQLH

SEQ ID NO: 1071079 - protein, 9 aa, Homo Sapiens
IEERSQTVM

SEQ ID NO: 1071080 - protein, 9 aa, Homo Sapiens
RLTLVDCSL

SEQ ID NO: 1071081 - protein, 9 aa, Homo Sapiens
GRIVYDAWD

SEQ ID NO: 1071082 - protein, 9 aa, Homo Sapiens
SMSLIGDHQ

SEQ ID NO: 1071083 - protein, 9 aa, Homo Sapiens
RDHWNKMLA

SEQ ID NO: 1071084 - protein, 9 aa, Homo Sapiens
EPEVVQRLS

SEQ ID NO: 1071085 - protein, 9 aa, Homo Sapiens
ILEKFKPSP

SEQ ID NO: 1071086 - protein, 9 aa, Homo Sapiens
SKAKELLSR

SEQ ID NO: 1071087 - protein, 9 aa, Homo Sapiens
KLLRRYLTS

SEQ ID NO: 1071088 - protein, 9 aa, Homo Sapiens
VGGRNKLRQ

SEQ ID NO: 1071089 - protein, 9 aa, Homo Sapiens
SYYTTKGWG

SEQ ID NO: 1071090 - protein, 9 aa, Homo Sapiens
LYQFFVVET

SEQ ID NO: 1071091 - protein, 9 aa, Homo Sapiens
TTKDILFMK

SEQ ID NO: 1071092 - protein, 9 aa, Homo Sapiens
NVEPPTIQH

SEQ ID NO: 1071093 - protein, 9 aa, Homo Sapiens
HYSVSEAAK

SEQ ID NO: 1071094 - protein, 9 aa, Homo Sapiens
FYNCRKVNT

SEQ ID NO: 1071095 - protein, 9 aa, Homo Sapiens
ALWASLRLV

SEQ ID NO: 1071096 - protein, 9 aa, Homo Sapiens
ELYFCCLHW

SEQ ID NO: 1071097 - protein, 9 aa, Homo Sapiens
DEEMNILIH

SEQ ID NO: 1071098 - protein, 9 aa, Homo Sapiens
LADADSQQS

SEQ ID NO: 1071099 - protein, 9 aa, Homo Sapiens
AISGQVTEQ

SEQ ID NO: 1071100 - protein, 9 aa, Homo Sapiens
KPETVYVFQ

SEQ ID NO: 1071101 - protein, 9 aa, Homo Sapiens
AVKRWVWSD

SEQ ID NO: 1071102 - protein, 9 aa, Homo Sapiens
LEKPICLTH

SEQ ID NO: 1071103 - protein, 9 aa, Homo Sapiens
GASPIWYFT

SEQ ID NO: 1071104 - protein, 9 aa, Homo Sapiens
DKSISVQKL

SEQ ID NO: 1071105 - protein, 9 aa, Homo Sapiens
NSSNMAKGW

SEQ ID NO: 1071106 - protein, 9 aa, Homo Sapiens
FLRQIVAAR

SEQ ID NO: 1071107 - protein, 9 aa, Homo Sapiens
KKIVHRYYS

SEQ ID NO: 1071108 - protein, 9 aa, Homo Sapiens
VPYNSVFFL

SEQ ID NO: 1071109 - protein, 9 aa, Homo Sapiens
NLLKLEKLD

SEQ ID NO: 1071110 - protein, 9 aa, Homo Sapiens
YCFAWVEAD

SEQ ID NO: 1071111 - protein, 9 aa, Homo Sapiens
PLLVACARE

SEQ ID NO: 1071112 - protein, 9 aa, Homo Sapiens
RFAADIIFV

SEQ ID NO: 1071113 - protein, 9 aa, Homo Sapiens
ELLVGFSYN

SEQ ID NO: 1071114 - protein, 9 aa, Homo Sapiens
YSKTMTSTY

SEQ ID NO: 1071115 - protein, 9 aa, Homo Sapiens
NCKLLRRYL

SEQ ID NO: 1071116 - protein, 9 aa, Homo Sapiens
FLQEWNIPF

SEQ ID NO: 1071117 - protein, 9 aa, Homo Sapiens
IEKAHHWIF

SEQ ID NO: 1071118 - protein, 9 aa, Homo Sapiens
GIAKLSCEN

SEQ ID NO: 1071119 - protein, 9 aa, Homo Sapiens
YSHDSLPCL

SEQ ID NO: 1071120 - protein, 9 aa, Homo Sapiens
FENVQVMTM

SEQ ID NO: 1071121 - protein, 9 aa, Homo Sapiens
KVQNYCQEP

SEQ ID NO: 1071122 - protein, 9 aa, Homo Sapiens
LNYEKQKSY

SEQ ID NO: 1071123 - protein, 9 aa, Homo Sapiens
FDVSDIGSD

SEQ ID NO: 1071124 - protein, 9 aa, Homo Sapiens
LSWTVSEGQ

SEQ ID NO: 1071125 - protein, 9 aa, Homo Sapiens
NYCQEPYYQ

SEQ ID NO: 1071126 - protein, 9 aa, Homo Sapiens
NVEFYTLKK

SEQ ID NO: 1071127 - protein, 9 aa, Homo Sapiens
LRFSDTYLP

SEQ ID NO: 1071128 - protein, 9 aa, Homo Sapiens
SPKRASCNC

SEQ ID NO: 1071129 - protein, 9 aa, Homo Sapiens
SCPGRYLRA

SEQ ID NO: 1071130 - protein, 9 aa, Homo Sapiens
NPYLHPCVR

SEQ ID NO: 1071131 - protein, 9 aa, Homo Sapiens
KGKAPQKSY

SEQ ID NO: 1071132 - protein, 9 aa, Homo Sapiens
DYVEILSSD

SEQ ID NO: 1071133 - protein, 9 aa, Homo Sapiens
QFPFKELEK

SEQ ID NO: 1071134 - protein, 9 aa, Homo Sapiens
GTSFLQLII

SEQ ID NO: 1071135 - protein, 9 aa, Homo Sapiens
MNIPYSVVQ

SEQ ID NO: 1071136 - protein, 9 aa, Homo Sapiens
GGGYKGENL

SEQ ID NO: 1071137 - protein, 9 aa, Homo Sapiens
TFFSYLLLH

SEQ ID NO: 1071138 - protein, 9 aa, Homo Sapiens
KWQQRFRAK

SEQ ID NO: 1071139 - protein, 9 aa, Homo Sapiens
LRDKANQLV

SEQ ID NO: 1071140 - protein, 9 aa, Homo Sapiens
HVEKVFMAR

SEQ ID NO: 1071141 - protein, 9 aa, Homo Sapiens
QARSDDLTV

SEQ ID NO: 1071142 - protein, 9 aa, Homo Sapiens
FSDFLMCLF

SEQ ID NO: 1071143 - protein, 9 aa, Homo Sapiens
SYAGEKILE

SEQ ID NO: 1071144 - protein, 9 aa, Homo Sapiens
KEEAEEESL

SEQ ID NO: 1071145 - protein, 9 aa, Homo Sapiens
DKDDHLLSP

SEQ ID NO: 1071146 - protein, 9 aa, Homo Sapiens
LVDQDPDCL

SEQ ID NO: 1071147 - protein, 9 aa, Homo Sapiens
HRKIYTGEK

SEQ ID NO: 1071148 - protein, 9 aa, Homo Sapiens
LEELEKGSF

SEQ ID NO: 1071149 - protein, 9 aa, Homo Sapiens
NGVCICFKG

SEQ ID NO: 1071150 - protein, 9 aa, Homo Sapiens
WYFLSEATV

SEQ ID NO: 1071151 - protein, 9 aa, Homo Sapiens
STTGGSGYK

SEQ ID NO: 1071152 - protein, 9 aa, Homo Sapiens
KAKPIGFTM

SEQ ID NO: 1071153 - protein, 9 aa, Homo Sapiens
SWIFTCLCA

SEQ ID NO: 1071154 - protein, 9 aa, Homo Sapiens
IKEALEKLQ

SEQ ID NO: 1071155 - protein, 9 aa, Homo Sapiens
QGLKFPIYF

SEQ ID NO: 1071156 - protein, 9 aa, Homo Sapiens
RIGLPQNSP

SEQ ID NO: 1071157 - protein, 9 aa, Homo Sapiens
VAVSWTTNN

SEQ ID NO: 1071158 - protein, 9 aa, Homo Sapiens
GLSRPLPST

SEQ ID NO: 1071159 - protein, 9 aa, Homo Sapiens
LAPNCIVYC

SEQ ID NO: 1071160 - protein, 9 aa, Homo Sapiens
ADLKALQRE

SEQ ID NO: 1071161 - protein, 9 aa, Homo Sapiens
KLRFQNNPL

SEQ ID NO: 1071162 - protein, 9 aa, Homo Sapiens
GEEGHDSKE

SEQ ID NO: 1071163 - protein, 9 aa, Homo Sapiens
WNETLKEYK

SEQ ID NO: 1071164 - protein, 9 aa, Homo Sapiens
PRMKGDWET

SEQ ID NO: 1071165 - protein, 9 aa, Homo Sapiens
GEHVMRGTA

SEQ ID NO: 1071166 - protein, 9 aa, Homo Sapiens
SQCSCGDCL

SEQ ID NO: 1071167 - protein, 9 aa, Homo Sapiens
SVPLQPPYS

SEQ ID NO: 1071168 - protein, 9 aa, Homo Sapiens
CSTVEEDND

SEQ ID NO: 1071169 - protein, 9 aa, Homo Sapiens
CGIGETPIV

SEQ ID NO: 1071170 - protein, 9 aa, Homo Sapiens
IREELCVFL

SEQ ID NO: 1071171 - protein, 9 aa, Homo Sapiens
GSALYFFFK

SEQ ID NO: 1071172 - protein, 9 aa, Homo Sapiens
NDSQMLAFN

SEQ ID NO: 1071173 - protein, 9 aa, Homo Sapiens
YPPVPGIGK

SEQ ID NO: 1071174 - protein, 9 aa, Homo Sapiens
ISRGCASTR

SEQ ID NO: 1071175 - protein, 9 aa, Homo Sapiens
ESQASESLL

SEQ ID NO: 1071176 - protein, 9 aa, Homo Sapiens
DITSMNTRS

SEQ ID NO: 1071177 - protein, 9 aa, Homo Sapiens
TYRASLVSK

SEQ ID NO: 1071178 - protein, 9 aa, Homo Sapiens
PSISLALPA

SEQ ID NO: 1071179 - protein, 9 aa, Homo Sapiens
TPQMAELRK

SEQ ID NO: 1071180 - protein, 9 aa, Homo Sapiens
EAFMKVARI

SEQ ID NO: 1071181 - protein, 9 aa, Homo Sapiens
SWPYSLTSQ

SEQ ID NO: 1071182 - protein, 9 aa, Homo Sapiens
ILTSVHKKQ

SEQ ID NO: 1071183 - protein, 9 aa, Homo Sapiens
TAICYLLRY

SEQ ID NO: 1071184 - protein, 9 aa, Homo Sapiens
AIQKARLVD

SEQ ID NO: 1071185 - protein, 9 aa, Homo Sapiens
YYAPTDCAT

SEQ ID NO: 1071186 - protein, 9 aa, Homo Sapiens
QTVEDYPKT

SEQ ID NO: 1071187 - protein, 9 aa, Homo Sapiens
HFPSLFCKK

SEQ ID NO: 1071188 - protein, 9 aa, Homo Sapiens
NTHIHAAAC

SEQ ID NO: 1071189 - protein, 9 aa, Homo Sapiens
LDRYRRTAL

SEQ ID NO: 1071190 - protein, 9 aa, Homo Sapiens
YFLPNPYFR

SEQ ID NO: 1071191 - protein, 9 aa, Homo Sapiens
SPTQPSSGP

SEQ ID NO: 1071192 - protein, 9 aa, Homo Sapiens
CCRKNCLKL

SEQ ID NO: 1071193 - protein, 9 aa, Homo Sapiens
TLVSSSLIL

SEQ ID NO: 1071194 - protein, 9 aa, Homo Sapiens
EKEEDRGQQ

SEQ ID NO: 1071195 - protein, 9 aa, Homo Sapiens
LMQQIKDFT

SEQ ID NO: 1071196 - protein, 9 aa, Homo Sapiens
GPATLMSAN

SEQ ID NO: 1071197 - protein, 9 aa, Homo Sapiens
RKLETNLDI

SEQ ID NO: 1071198 - protein, 9 aa, Homo Sapiens
STPSKGSTA

SEQ ID NO: 1071199 - protein, 9 aa, Homo Sapiens
EAHPLVGRG

SEQ ID NO: 1071200 - protein, 9 aa, Homo Sapiens
WFVFRMYRV

SEQ ID NO: 1071201 - protein, 9 aa, Homo Sapiens
DLLLKMTLG

SEQ ID NO: 1071202 - protein, 9 aa, Homo Sapiens
FRHPFLAKY

SEQ ID NO: 1071203 - protein, 9 aa, Homo Sapiens
GTAISNAQL

SEQ ID NO: 1071204 - protein, 9 aa, Homo Sapiens
KLGDSWIVP

SEQ ID NO: 1071205 - protein, 9 aa, Homo Sapiens
LCCLGLCKL

SEQ ID NO: 1071206 - protein, 9 aa, Homo Sapiens
KFQNLQTEG

SEQ ID NO: 1071207 - protein, 9 aa, Homo Sapiens
AIFSVAFME

SEQ ID NO: 1071208 - protein, 9 aa, Homo Sapiens
ILAFWNEGY

SEQ ID NO: 1071209 - protein, 9 aa, Homo Sapiens
QFTSSGEFT

SEQ ID NO: 1071210 - protein, 9 aa, Homo Sapiens
ERRKKGSLP

SEQ ID NO: 1071211 - protein, 9 aa, Homo Sapiens
EGEDEHSQR

SEQ ID NO: 1071212 - protein, 9 aa, Homo Sapiens
SLERDQVAS

SEQ ID NO: 1071213 - protein, 9 aa, Homo Sapiens
NGPGRVNEL

SEQ ID NO: 1071214 - protein, 9 aa, Homo Sapiens
GDQLETIFG

SEQ ID NO: 1071215 - protein, 9 aa, Homo Sapiens
WDSTNPFSK

SEQ ID NO: 1071216 - protein, 9 aa, Homo Sapiens
KERKKHLTY

SEQ ID NO: 1071217 - protein, 9 aa, Homo Sapiens
MGPIPKDDF

SEQ ID NO: 1071218 - protein, 9 aa, Homo Sapiens
QRFIAELVP

SEQ ID NO: 1071219 - protein, 9 aa, Homo Sapiens
CELSSPIDQ

SEQ ID NO: 1071220 - protein, 9 aa, Homo Sapiens
MILLITYLG

SEQ ID NO: 1071221 - protein, 9 aa, Homo Sapiens
KLDALGRGV

SEQ ID NO: 1071222 - protein, 9 aa, Homo Sapiens
LTAKKEKLN

SEQ ID NO: 1071223 - protein, 9 aa, Homo Sapiens
SKSAKRWKF

SEQ ID NO: 1071224 - protein, 9 aa, Homo Sapiens
IRLINSQIL

SEQ ID NO: 1071225 - protein, 9 aa, Homo Sapiens
PRRIKLICV

SEQ ID NO: 1071226 - protein, 9 aa, Homo Sapiens
VGYILHKEE

SEQ ID NO: 1071227 - protein, 9 aa, Homo Sapiens
VKAETIPSL

SEQ ID NO: 1071228 - protein, 9 aa, Homo Sapiens
WSHSQFSDT

SEQ ID NO: 1071229 - protein, 9 aa, Homo Sapiens
GPKTLSQLA

SEQ ID NO: 1071230 - protein, 9 aa, Homo Sapiens
PHPEGLAEF

SEQ ID NO: 1071231 - protein, 9 aa, Homo Sapiens
LVSLGGSAL

SEQ ID NO: 1071232 - protein, 9 aa, Homo Sapiens
WPLYAPPRA

SEQ ID NO: 1071233 - protein, 9 aa, Homo Sapiens
EVLARDSVH

SEQ ID NO: 1071234 - protein, 9 aa, Homo Sapiens
IIKHFSQLK

SEQ ID NO: 1071235 - protein, 9 aa, Homo Sapiens
PSKEPSLGQ

SEQ ID NO: 1071236 - protein, 9 aa, Homo Sapiens
DDEEKSDEE

SEQ ID NO: 1071237 - protein, 9 aa, Homo Sapiens
PIWVTNQFQ

SEQ ID NO: 1071238 - protein, 9 aa, Homo Sapiens
STPSVYLEL

SEQ ID NO: 1071239 - protein, 9 aa, Homo Sapiens
FKKHQQEQK

SEQ ID NO: 1071240 - protein, 9 aa, Homo Sapiens
VSQESQGAS

SEQ ID NO: 1071241 - protein, 9 aa, Homo Sapiens
RGRLTERNV

SEQ ID NO: 1071242 - protein, 9 aa, Homo Sapiens
PTPYKWMRR

SEQ ID NO: 1071243 - protein, 9 aa, Homo Sapiens
LARWRKKIL

SEQ ID NO: 1071244 - protein, 9 aa, Homo Sapiens
RCSSSLCDH

SEQ ID NO: 1071245 - protein, 9 aa, Homo Sapiens
KHFDASDSS

SEQ ID NO: 1071246 - protein, 9 aa, Homo Sapiens
PELKEGYQC

SEQ ID NO: 1071247 - protein, 9 aa, Homo Sapiens
NFVKYQCHP

SEQ ID NO: 1071248 - protein, 9 aa, Homo Sapiens
PTPAKLDAY

SEQ ID NO: 1071249 - protein, 9 aa, Homo Sapiens
QPLPEIFIP

SEQ ID NO: 1071250 - protein, 9 aa, Homo Sapiens
PVVLSTAEA

SEQ ID NO: 1071251 - protein, 9 aa, Homo Sapiens
LANITILGS

SEQ ID NO: 1071252 - protein, 9 aa, Homo Sapiens
FVGRAFQQF

SEQ ID NO: 1071253 - protein, 9 aa, Homo Sapiens
QLTRFLAEE

SEQ ID NO: 1071254 - protein, 9 aa, Homo Sapiens
ANIVKVAIE

SEQ ID NO: 1071255 - protein, 9 aa, Homo Sapiens
PGALVPVPA

SEQ ID NO: 1071256 - protein, 9 aa, Homo Sapiens
NGLPATEKS

SEQ ID NO: 1071257 - protein, 9 aa, Homo Sapiens
ISVNPGLDE

SEQ ID NO: 1071258 - protein, 9 aa, Homo Sapiens
YLPFCGTAI

SEQ ID NO: 1071259 - protein, 9 aa, Homo Sapiens
DDECISMMT

SEQ ID NO: 1071260 - protein, 9 aa, Homo Sapiens
ADSPFEGFS

SEQ ID NO: 1071261 - protein, 9 aa, Homo Sapiens
TWPGVYSLP

SEQ ID NO: 1071262 - protein, 9 aa, Homo Sapiens
QTSNPPGSS

SEQ ID NO: 1071263 - protein, 9 aa, Homo Sapiens
AECFQFKAK

SEQ ID NO: 1071264 - protein, 9 aa, Homo Sapiens
KRKMKPESD

SEQ ID NO: 1071265 - protein, 9 aa, Homo Sapiens
MKKIALHTN

SEQ ID NO: 1071266 - protein, 9 aa, Homo Sapiens
QEDVLKIYD

SEQ ID NO: 1071267 - protein, 9 aa, Homo Sapiens
RSRNSGKDD

SEQ ID NO: 1071268 - protein, 9 aa, Homo Sapiens
EEVVIKRLA

SEQ ID NO: 1071269 - protein, 9 aa, Homo Sapiens
LQYWTVSQT

SEQ ID NO: 1071270 - protein, 9 aa, Homo Sapiens
RSLKKRMLI

SEQ ID NO: 1071271 - protein, 9 aa, Homo Sapiens
PSAGEKYKA

SEQ ID NO: 1071272 - protein, 9 aa, Homo Sapiens
SCLALEKEA

SEQ ID NO: 1071273 - protein, 9 aa, Homo Sapiens
PQAGPLSRP

SEQ ID NO: 1071274 - protein, 9 aa, Homo Sapiens
FKTALELCS

SEQ ID NO: 1071275 - protein, 9 aa, Homo Sapiens
NDSCLALEK

SEQ ID NO: 1071276 - protein, 9 aa, Homo Sapiens
NKLTDQIFE

SEQ ID NO: 1071277 - protein, 9 aa, Homo Sapiens
QPACCTFSQ

SEQ ID NO: 1071278 - protein, 9 aa, Homo Sapiens
QPVVPTHSG

SEQ ID NO: 1071279 - protein, 9 aa, Homo Sapiens
NPVLNQLQR

SEQ ID NO: 1071280 - protein, 9 aa, Homo Sapiens
LPVTLSIED

SEQ ID NO: 1071281 - protein, 9 aa, Homo Sapiens
LIPDLAMKT

SEQ ID NO: 1071282 - protein, 9 aa, Homo Sapiens
LPASCPDTS

SEQ ID NO: 1071283 - protein, 9 aa, Homo Sapiens
TTPGNNGVL

SEQ ID NO: 1071284 - protein, 9 aa, Homo Sapiens
LNYNNKSAF

SEQ ID NO: 1071285 - protein, 9 aa, Homo Sapiens
LNNLQDPFL

SEQ ID NO: 1071286 - protein, 9 aa, Homo Sapiens
YTGEKPYEC

SEQ ID NO: 1071287 - protein, 9 aa, Homo Sapiens
LPLVLLLNG

SEQ ID NO: 1071288 - protein, 9 aa, Homo Sapiens
NLNLLVVLN

SEQ ID NO: 1071289 - protein, 9 aa, Homo Sapiens
PTVKETLAD

SEQ ID NO: 1071290 - protein, 9 aa, Homo Sapiens
GLQNMENTC

SEQ ID NO: 1071291 - protein, 9 aa, Homo Sapiens
GIIKLKVFL

SEQ ID NO: 1071292 - protein, 9 aa, Homo Sapiens
EGWRRPAFP

SEQ ID NO: 1071293 - protein, 9 aa, Homo Sapiens
FVGFFAVYV

SEQ ID NO: 1071294 - protein, 9 aa, Homo Sapiens
VTLGENNKK

SEQ ID NO: 1071295 - protein, 9 aa, Homo Sapiens
SGQPRPEVT

SEQ ID NO: 1071296 - protein, 9 aa, Homo Sapiens
NSACSWFTE

SEQ ID NO: 1071297 - protein, 9 aa, Homo Sapiens
SASKKATVL

SEQ ID NO: 1071298 - protein, 9 aa, Homo Sapiens
ARWRKKILF

SEQ ID NO: 1071299 - protein, 9 aa, Homo Sapiens
RSFNPLEDN

SEQ ID NO: 1071300 - protein, 9 aa, Homo Sapiens
WSASRRLNS

SEQ ID NO: 1071301 - protein, 9 aa, Homo Sapiens
GQLTRFLAE

SEQ ID NO: 1071302 - protein, 9 aa, Homo Sapiens
KLEKEKETT

SEQ ID NO: 1071303 - protein, 9 aa, Homo Sapiens
THKKIYTGG

SEQ ID NO: 1071304 - protein, 9 aa, Homo Sapiens
PLLKRVQFE

SEQ ID NO: 1071305 - protein, 9 aa, Homo Sapiens
RPGKKQLYF

SEQ ID NO: 1071306 - protein, 9 aa, Homo Sapiens
TLYIHSLAP

SEQ ID NO: 1071307 - protein, 9 aa, Homo Sapiens
RGLFPRDAS

SEQ ID NO: 1071308 - protein, 9 aa, Homo Sapiens
PVGDIGFSG

SEQ ID NO: 1071309 - protein, 9 aa, Homo Sapiens
KKIVLKQEV

SEQ ID NO: 1071310 - protein, 9 aa, Homo Sapiens
PGAKGKPGD

SEQ ID NO: 1071311 - protein, 9 aa, Homo Sapiens
HLNDISACQ

SEQ ID NO: 1071312 - protein, 9 aa, Homo Sapiens
TYNTYAYVG

SEQ ID NO: 1071313 - protein, 9 aa, Homo Sapiens
NKTTIRLIN

SEQ ID NO: 1071314 - protein, 9 aa, Homo Sapiens
QLKKLLSLP

SEQ ID NO: 1071315 - protein, 9 aa, Homo Sapiens
PFCGTAISN

SEQ ID NO: 1071316 - protein, 9 aa, Homo Sapiens
EGGPKKTHP

SEQ ID NO: 1071317 - protein, 9 aa, Homo Sapiens
GIAEKQREK

SEQ ID NO: 1071318 - protein, 9 aa, Homo Sapiens
MTPFSTQVE

SEQ ID NO: 1071319 - protein, 9 aa, Homo Sapiens
SGLIRTQKN

SEQ ID NO: 1071320 - protein, 9 aa, Homo Sapiens
VADFYVAVS

SEQ ID NO: 1071321 - protein, 9 aa, Homo Sapiens
KSVDPGALE

SEQ ID NO: 1071322 - protein, 9 aa, Homo Sapiens
IPSHSSFIR

SEQ ID NO: 1071323 - protein, 9 aa, Homo Sapiens
TGLHTKLGK

SEQ ID NO: 1071324 - protein, 9 aa, Homo Sapiens
LGNTSVEKG

SEQ ID NO: 1071325 - protein, 9 aa, Homo Sapiens
ENQSGKGQN

SEQ ID NO: 1071326 - protein, 9 aa, Homo Sapiens
YFLAPVAVE

SEQ ID NO: 1071327 - protein, 9 aa, Homo Sapiens
FSGPEGPSG

SEQ ID NO: 1071328 - protein, 9 aa, Homo Sapiens
RAEALAAVN

SEQ ID NO: 1071329 - protein, 9 aa, Homo Sapiens
EILLPQPPE

SEQ ID NO: 1071330 - protein, 9 aa, Homo Sapiens
SRKFSSMDT

SEQ ID NO: 1071331 - protein, 9 aa, Homo Sapiens
WNKFLENKF

SEQ ID NO: 1071332 - protein, 9 aa, Homo Sapiens
SVLVISVCY

SEQ ID NO: 1071333 - protein, 9 aa, Homo Sapiens
DQSPLPPFT

SEQ ID NO: 1071334 - protein, 9 aa, Homo Sapiens
KTSNPSVSQ

SEQ ID NO: 1071335 - protein, 9 aa, Homo Sapiens
TLRPEIFKD

SEQ ID NO: 1071336 - protein, 9 aa, Homo Sapiens
GSQEMTGKK

SEQ ID NO: 1071337 - protein, 9 aa, Homo Sapiens
QLSEDVICL

SEQ ID NO: 1071338 - protein, 9 aa, Homo Sapiens
ATIVENVGS

SEQ ID NO: 1071339 - protein, 9 aa, Homo Sapiens
QGQTNPMLF

SEQ ID NO: 1071340 - protein, 9 aa, Homo Sapiens
TRRKVVILE

SEQ ID NO: 1071341 - protein, 9 aa, Homo Sapiens
SWDKILAFV

SEQ ID NO: 1071342 - protein, 9 aa, Homo Sapiens
LVTLTSCAG

SEQ ID NO: 1071343 - protein, 9 aa, Homo Sapiens
KQENSELRR

SEQ ID NO: 1071344 - protein, 9 aa, Homo Sapiens
RTAAGRPLP

SEQ ID NO: 1071345 - protein, 9 aa, Homo Sapiens
YKTLLMTAC

SEQ ID NO: 1071346 - protein, 9 aa, Homo Sapiens
NVGQFFSVS

SEQ ID NO: 1071347 - protein, 9 aa, Homo Sapiens
PYIPSSHFV

SEQ ID NO: 1071348 - protein, 9 aa, Homo Sapiens
QACVELLVK

SEQ ID NO: 1071349 - protein, 9 aa, Homo Sapiens
PSSGGGLPS

SEQ ID NO: 1071350 - protein, 9 aa, Homo Sapiens
SYMCFHVRF

SEQ ID NO: 1071351 - protein, 9 aa, Homo Sapiens
LSYMCFHVR

SEQ ID NO: 1071352 - protein, 9 aa, Homo Sapiens
HLLGGGTGS

SEQ ID NO: 1071353 - protein, 9 aa, Homo Sapiens
VDVKTDAQP

SEQ ID NO: 1071354 - protein, 9 aa, Homo Sapiens
LGVLHHKPI

SEQ ID NO: 1071355 - protein, 9 aa, Homo Sapiens
DKTDAPRQR

SEQ ID NO: 1071356 - protein, 9 aa, Homo Sapiens
DTWPGVYSL

SEQ ID NO: 1071357 - protein, 9 aa, Homo Sapiens
SLFHLVYVN

SEQ ID NO: 1071358 - protein, 9 aa, Homo Sapiens
CPPEPTLWI

SEQ ID NO: 1071359 - protein, 9 aa, Homo Sapiens
SCLVSSAWL

SEQ ID NO: 1071360 - protein, 9 aa, Homo Sapiens
GNKITKIVK

SEQ ID NO: 1071361 - protein, 9 aa, Homo Sapiens
LYGNKITKI

SEQ ID NO: 1071362 - protein, 9 aa, Homo Sapiens
VVLEPGQPL

SEQ ID NO: 1071363 - protein, 9 aa, Homo Sapiens
KLIYDHLLC

SEQ ID NO: 1071364 - protein, 9 aa, Homo Sapiens
GRGSSSSSS

SEQ ID NO: 1071365 - protein, 9 aa, Homo Sapiens
TAENFCALS

SEQ ID NO: 1071366 - protein, 9 aa, Homo Sapiens
KSNGYRDHS

SEQ ID NO: 1071367 - protein, 9 aa, Homo Sapiens
LLTPPASDG

SEQ ID NO: 1071368 - protein, 9 aa, Homo Sapiens
ALMKQRLAK

SEQ ID NO: 1071369 - protein, 9 aa, Homo Sapiens
KFMYTDWAN

SEQ ID NO: 1071370 - protein, 9 aa, Homo Sapiens
DDSGLPNNR

SEQ ID NO: 1071371 - protein, 9 aa, Homo Sapiens
FNIEEFDKL

SEQ ID NO: 1071372 - protein, 9 aa, Homo Sapiens
SIHPQGFRY

SEQ ID NO: 1071373 - protein, 9 aa, Homo Sapiens
DTILGASVQ

SEQ ID NO: 1071374 - protein, 9 aa, Homo Sapiens
QWSWILQRC

SEQ ID NO: 1071375 - protein, 9 aa, Homo Sapiens
LDYLSQGTD

SEQ ID NO: 1071376 - protein, 9 aa, Homo Sapiens
GNFGEPQIG

SEQ ID NO: 1071377 - protein, 9 aa, Homo Sapiens
SSHFVSGGQ

SEQ ID NO: 1071378 - protein, 9 aa, Homo Sapiens
RLCCVQEAL

SEQ ID NO: 1071379 - protein, 9 aa, Homo Sapiens
VKGQTESFH

SEQ ID NO: 1071380 - protein, 9 aa, Homo Sapiens
LTVASPDCQ

SEQ ID NO: 1071381 - protein, 9 aa, Homo Sapiens
LLLDRLRKH

SEQ ID NO: 1071382 - protein, 9 aa, Homo Sapiens
PYQSMPTST

SEQ ID NO: 1071383 - protein, 9 aa, Homo Sapiens
IADPTLKCF

SEQ ID NO: 1071384 - protein, 9 aa, Homo Sapiens
SSLLSHLPH

SEQ ID NO: 1071385 - protein, 9 aa, Homo Sapiens
KRLEEARLN

SEQ ID NO: 1071386 - protein, 9 aa, Homo Sapiens
TSAAPPIQS

SEQ ID NO: 1071387 - protein, 9 aa, Homo Sapiens
AAGRPLPGK

SEQ ID NO: 1071388 - protein, 9 aa, Homo Sapiens
RKKKNIAAQ

SEQ ID NO: 1071389 - protein, 9 aa, Homo Sapiens
PSENITNVE

SEQ ID NO: 1071390 - protein, 9 aa, Homo Sapiens
APILKALGT

SEQ ID NO: 1071391 - protein, 9 aa, Homo Sapiens
LGRADTALT

SEQ ID NO: 1071392 - protein, 9 aa, Homo Sapiens
SPAGFDKPI

SEQ ID NO: 1071393 - protein, 9 aa, Homo Sapiens
NKEQSGDGT

SEQ ID NO: 1071394 - protein, 9 aa, Homo Sapiens
LLRTLGLFC

SEQ ID NO: 1071395 - protein, 9 aa, Homo Sapiens
GLLSALLFI

SEQ ID NO: 1071396 - protein, 9 aa, Homo Sapiens
CSVCNSATG

SEQ ID NO: 1071397 - protein, 9 aa, Homo Sapiens
MLSASCSRL

SEQ ID NO: 1071398 - protein, 9 aa, Homo Sapiens
IWYQCHRPK

SEQ ID NO: 1071399 - protein, 9 aa, Homo Sapiens
VWFKNCRAK

SEQ ID NO: 1071400 - protein, 9 aa, Homo Sapiens
KSQYKTWQK

SEQ ID NO: 1071401 - protein, 9 aa, Homo Sapiens
EKIVNRQKL

SEQ ID NO: 1071402 - protein, 9 aa, Homo Sapiens
LHTKLGKIR

SEQ ID NO: 1071403 - protein, 9 aa, Homo Sapiens
HSACYYGHI

SEQ ID NO: 1071404 - protein, 9 aa, Homo Sapiens
FRPLFRPTQ

SEQ ID NO: 1071405 - protein, 9 aa, Homo Sapiens
AQQAFEEAW

SEQ ID NO: 1071406 - protein, 9 aa, Homo Sapiens
RKSDIKVLP

SEQ ID NO: 1071407 - protein, 9 aa, Homo Sapiens
LVFKKEKIV

SEQ ID NO: 1071408 - protein, 9 aa, Homo Sapiens
QTQSPGETF

SEQ ID NO: 1071409 - protein, 9 aa, Homo Sapiens
DYERSQTHY

SEQ ID NO: 1071410 - protein, 9 aa, Homo Sapiens
VREKFRKKI

SEQ ID NO: 1071411 - protein, 9 aa, Homo Sapiens
FPADFQRAV

SEQ ID NO: 1071412 - protein, 9 aa, Homo Sapiens
SSSFSEEEE

SEQ ID NO: 1071413 - protein, 9 aa, Homo Sapiens
IPSSEITYG

SEQ ID NO: 1071414 - protein, 9 aa, Homo Sapiens
AVFFVTNFT

SEQ ID NO: 1071415 - protein, 9 aa, Homo Sapiens
ACLPASCPD

SEQ ID NO: 1071416 - protein, 9 aa, Homo Sapiens
IRGPAYMLN

SEQ ID NO: 1071417 - protein, 9 aa, Homo Sapiens
LDEATSALN

SEQ ID NO: 1071418 - protein, 9 aa, Homo Sapiens
PRALQSVLG

SEQ ID NO: 1071419 - protein, 9 aa, Homo Sapiens
EQILKTEYE

SEQ ID NO: 1071420 - protein, 9 aa, Homo Sapiens
FPETWGTDT

SEQ ID NO: 1071421 - protein, 9 aa, Homo Sapiens
STKALAEFV

SEQ ID NO: 1071422 - protein, 9 aa, Homo Sapiens
GGKQFFLQC

SEQ ID NO: 1071423 - protein, 9 aa, Homo Sapiens
QEALVKRLW

SEQ ID NO: 1071424 - protein, 9 aa, Homo Sapiens
SSATYEKSC

SEQ ID NO: 1071425 - protein, 9 aa, Homo Sapiens
VDSTGHSFV

SEQ ID NO: 1071426 - protein, 9 aa, Homo Sapiens
LHIQDALPK

SEQ ID NO: 1071427 - protein, 9 aa, Homo Sapiens
PFRGFREIH

SEQ ID NO: 1071428 - protein, 9 aa, Homo Sapiens
VLRPSQFWG

SEQ ID NO: 1071429 - protein, 9 aa, Homo Sapiens
GFWLAIRIG

SEQ ID NO: 1071430 - protein, 9 aa, Homo Sapiens
TSWVKSPTG

SEQ ID NO: 1071431 - protein, 9 aa, Homo Sapiens
PGVTAFFCK

SEQ ID NO: 1071432 - protein, 9 aa, Homo Sapiens
VEKPLSQES

SEQ ID NO: 1071433 - protein, 9 aa, Homo Sapiens
RRNLDCFLL

SEQ ID NO: 1071434 - protein, 9 aa, Homo Sapiens
PILTLSGFS

SEQ ID NO: 1071435 - protein, 9 aa, Homo Sapiens
LISNSGHSL

SEQ ID NO: 1071436 - protein, 9 aa, Homo Sapiens
PPLHLPADV

SEQ ID NO: 1071437 - protein, 9 aa, Homo Sapiens
TTQFDAQEL

SEQ ID NO: 1071438 - protein, 9 aa, Homo Sapiens
SIDRFLKVV

SEQ ID NO: 1071439 - protein, 9 aa, Homo Sapiens
PSSLLQRLI

SEQ ID NO: 1071440 - protein, 9 aa, Homo Sapiens
FVFPPSLIT

SEQ ID NO: 1071441 - protein, 9 aa, Homo Sapiens
IGEKIAHFQ

SEQ ID NO: 1071442 - protein, 9 aa, Homo Sapiens
QPPEKELNK

SEQ ID NO: 1071443 - protein, 9 aa, Homo Sapiens
SDSESTERE

SEQ ID NO: 1071444 - protein, 9 aa, Homo Sapiens
CDPHPDKGT

SEQ ID NO: 1071445 - protein, 9 aa, Homo Sapiens
GVSIRTLAF

SEQ ID NO: 1071446 - protein, 9 aa, Homo Sapiens
GVPFSTNEP

SEQ ID NO: 1071447 - protein, 9 aa, Homo Sapiens
SSSSVDSDS

SEQ ID NO: 1071448 - protein, 9 aa, Homo Sapiens
EKQISVKCE

SEQ ID NO: 1071449 - protein, 9 aa, Homo Sapiens
RHSCICPGQ

SEQ ID NO: 1071450 - protein, 9 aa, Homo Sapiens
LRYILDWDL

SEQ ID NO: 1071451 - protein, 9 aa, Homo Sapiens
TAVTTLKGE

SEQ ID NO: 1071452 - protein, 9 aa, Homo Sapiens
GYHKPHISF

SEQ ID NO: 1071453 - protein, 9 aa, Homo Sapiens
RGCLLSLED

SEQ ID NO: 1071454 - protein, 9 aa, Homo Sapiens
PATLLTVGH

SEQ ID NO: 1071455 - protein, 9 aa, Homo Sapiens
AEFVGRAFQ

SEQ ID NO: 1071456 - protein, 9 aa, Homo Sapiens
DKALLAKRR

SEQ ID NO: 1071457 - protein, 9 aa, Homo Sapiens
FNFIPEVSV

SEQ ID NO: 1071458 - protein, 9 aa, Homo Sapiens
RPAFPGETA

SEQ ID NO: 1071459 - protein, 9 aa, Homo Sapiens
PAMVRSRNS

SEQ ID NO: 1071460 - protein, 9 aa, Homo Sapiens
SRHHENHLL

SEQ ID NO: 1071461 - protein, 9 aa, Homo Sapiens
LFNIDGFEE

SEQ ID NO: 1071462 - protein, 9 aa, Homo Sapiens
PPEFIFYNR

SEQ ID NO: 1071463 - protein, 9 aa, Homo Sapiens
AGGGTVPER

SEQ ID NO: 1071464 - protein, 9 aa, Homo Sapiens
QFPAAPILT

SEQ ID NO: 1071465 - protein, 9 aa, Homo Sapiens
VTLSIEDFE

SEQ ID NO: 1071466 - protein, 9 aa, Homo Sapiens
MVRSRNSGK

SEQ ID NO: 1071467 - protein, 9 aa, Homo Sapiens
DSFGDPLFP

SEQ ID NO: 1071468 - protein, 9 aa, Homo Sapiens
KRRQSQSRS

SEQ ID NO: 1071469 - protein, 9 aa, Homo Sapiens
GAVAHACNS

SEQ ID NO: 1071470 - protein, 9 aa, Homo Sapiens
ISSVVVLPI

SEQ ID NO: 1071471 - protein, 9 aa, Homo Sapiens
GLVQLVKSI

SEQ ID NO: 1071472 - protein, 9 aa, Homo Sapiens
NGGPALEAI

SEQ ID NO: 1071473 - protein, 9 aa, Homo Sapiens
AHAGQRVSQ

SEQ ID NO: 1071474 - protein, 9 aa, Homo Sapiens
CCTFSQSQQ

SEQ ID NO: 1071475 - protein, 9 aa, Homo Sapiens
KIVVVQSLD

SEQ ID NO: 1071476 - protein, 9 aa, Homo Sapiens
TYVSRANFL

SEQ ID NO: 1071477 - protein, 9 aa, Homo Sapiens
SLPEGEMKK

SEQ ID NO: 1071478 - protein, 9 aa, Homo Sapiens
NGVMQKSQD

SEQ ID NO: 1071479 - protein, 9 aa, Homo Sapiens
HLKKALDYI

SEQ ID NO: 1071480 - protein, 9 aa, Homo Sapiens
TFPGVTAFF

SEQ ID NO: 1071481 - protein, 9 aa, Homo Sapiens
IQDFHYGQS

SEQ ID NO: 1071482 - protein, 9 aa, Homo Sapiens
ACETVCKTR

SEQ ID NO: 1071483 - protein, 9 aa, Homo Sapiens
SPAFCASYN

SEQ ID NO: 1071484 - protein, 9 aa, Homo Sapiens
NRALSTLYI

SEQ ID NO: 1071485 - protein, 9 aa, Homo Sapiens
SDDSNSSLS

SEQ ID NO: 1071486 - protein, 9 aa, Homo Sapiens
SLTLIASTP

SEQ ID NO: 1071487 - protein, 9 aa, Homo Sapiens
AFKPGVRYD

SEQ ID NO: 1071488 - protein, 9 aa, Homo Sapiens
PLQPKKSKR

SEQ ID NO: 1071489 - protein, 9 aa, Homo Sapiens
FFWPRLRDA

SEQ ID NO: 1071490 - protein, 9 aa, Homo Sapiens
TADSFGDPL

SEQ ID NO: 1071491 - protein, 9 aa, Homo Sapiens
TELAPLGLL

SEQ ID NO: 1071492 - protein, 9 aa, Homo Sapiens
LPPCSISRD

SEQ ID NO: 1071493 - protein, 9 aa, Homo Sapiens
IDILYASNN

SEQ ID NO: 1071494 - protein, 9 aa, Homo Sapiens
GFIAGDLEP

SEQ ID NO: 1071495 - protein, 9 aa, Homo Sapiens
WAHAFLQRK

SEQ ID NO: 1071496 - protein, 9 aa, Homo Sapiens
GREKIFRPP

SEQ ID NO: 1071497 - protein, 9 aa, Homo Sapiens
NKQAALQAL

SEQ ID NO: 1071498 - protein, 9 aa, Homo Sapiens
AVESSLTET

SEQ ID NO: 1071499 - protein, 9 aa, Homo Sapiens
IIAHAGQRV

SEQ ID NO: 1071500 - protein, 9 aa, Homo Sapiens
KMKTKHKAY

SEQ ID NO: 1071501 - protein, 9 aa, Homo Sapiens
TELKVCKPN

SEQ ID NO: 1071502 - protein, 9 aa, Homo Sapiens
SYSLERDQV

SEQ ID NO: 1071503 - protein, 9 aa, Homo Sapiens
WLEFRKPSQ

SEQ ID NO: 1071504 - protein, 9 aa, Homo Sapiens
FQNQARELP

SEQ ID NO: 1071505 - protein, 9 aa, Homo Sapiens
QPFPNAQSS

SEQ ID NO: 1071506 - protein, 9 aa, Homo Sapiens
VREAQGEAG

SEQ ID NO: 1071507 - protein, 9 aa, Homo Sapiens
SKRQKEKPD

SEQ ID NO: 1071508 - protein, 9 aa, Homo Sapiens
ISVFDQDFG

SEQ ID NO: 1071509 - protein, 9 aa, Homo Sapiens
IHPQGFRYS

SEQ ID NO: 1071510 - protein, 9 aa, Homo Sapiens
DSIPLCQKC

SEQ ID NO: 1071511 - protein, 9 aa, Homo Sapiens
NSHSQNILP

SEQ ID NO: 1071512 - protein, 9 aa, Homo Sapiens
PSSHFVSGG

SEQ ID NO: 1071513 - protein, 9 aa, Homo Sapiens
RQRKLAPLS

SEQ ID NO: 1071514 - protein, 9 aa, Homo Sapiens
SLSVSPRVK

SEQ ID NO: 1071515 - protein, 9 aa, Homo Sapiens
YLGVLHHKP

SEQ ID NO: 1071516 - protein, 9 aa, Homo Sapiens
MENSVMVLL

SEQ ID NO: 1071517 - protein, 9 aa, Homo Sapiens
QGNNEETIL

SEQ ID NO: 1071518 - protein, 9 aa, Homo Sapiens
SGKGQNTLS

SEQ ID NO: 1071519 - protein, 9 aa, Homo Sapiens
VQEGVIQHI

SEQ ID NO: 1071520 - protein, 9 aa, Homo Sapiens
FTSSGEFTV

SEQ ID NO: 1071521 - protein, 9 aa, Homo Sapiens
SFHHGENKQ

SEQ ID NO: 1071522 - protein, 9 aa, Homo Sapiens
AAKASRKIA

SEQ ID NO: 1071523 - protein, 9 aa, Homo Sapiens
THQSHHCAP

SEQ ID NO: 1071524 - protein, 9 aa, Homo Sapiens
VFALSWSQE

SEQ ID NO: 1071525 - protein, 9 aa, Homo Sapiens
IIYADLRFV

SEQ ID NO: 1071526 - protein, 9 aa, Homo Sapiens
FYSKSELAQ

SEQ ID NO: 1071527 - protein, 9 aa, Homo Sapiens
FEGFSLKAG

SEQ ID NO: 1071528 - protein, 9 aa, Homo Sapiens
QQYNGRALE

SEQ ID NO: 1071529 - protein, 9 aa, Homo Sapiens
GLQPPGNIF

SEQ ID NO: 1071530 - protein, 9 aa, Homo Sapiens
QRDAWGPEA

SEQ ID NO: 1071531 - protein, 9 aa, Homo Sapiens
IKRLARGQG

SEQ ID NO: 1071532 - protein, 9 aa, Homo Sapiens
SSVVSLTVP

SEQ ID NO: 1071533 - protein, 9 aa, Homo Sapiens
WMGSSWQPS

SEQ ID NO: 1071534 - protein, 9 aa, Homo Sapiens
KYRDLFRDF

SEQ ID NO: 1071535 - protein, 9 aa, Homo Sapiens
LCDHERTHT

SEQ ID NO: 1071536 - protein, 9 aa, Homo Sapiens
SNYLSGSKS

SEQ ID NO: 1071537 - protein, 9 aa, Homo Sapiens
VAQMEQKQN

SEQ ID NO: 1071538 - protein, 9 aa, Homo Sapiens
FPGLPIWIR

SEQ ID NO: 1071539 - protein, 9 aa, Homo Sapiens
QEIVKKGQL

SEQ ID NO: 1071540 - protein, 9 aa, Homo Sapiens
GHTHLYNNR

SEQ ID NO: 1071541 - protein, 9 aa, Homo Sapiens
CNSATGKES

SEQ ID NO: 1071542 - protein, 9 aa, Homo Sapiens
DQAVVETMF

SEQ ID NO: 1071543 - protein, 9 aa, Homo Sapiens
GVIIYNITE

SEQ ID NO: 1071544 - protein, 9 aa, Homo Sapiens
QLDVKGSKL

SEQ ID NO: 1071545 - protein, 9 aa, Homo Sapiens
AFYIAGDAC

SEQ ID NO: 1071546 - protein, 9 aa, Homo Sapiens
CYFCLSTLF

SEQ ID NO: 1071547 - protein, 9 aa, Homo Sapiens
SDTESKGVE

SEQ ID NO: 1071548 - protein, 9 aa, Homo Sapiens
LGVLFLPLL

SEQ ID NO: 1071549 - protein, 9 aa, Homo Sapiens
FWPRLRDAD

SEQ ID NO: 1071550 - protein, 9 aa, Homo Sapiens
FIGFPEQIA

SEQ ID NO: 1071551 - protein, 9 aa, Homo Sapiens
EEQRLVYER

SEQ ID NO: 1071552 - protein, 9 aa, Homo Sapiens
FMYTDWANK

SEQ ID NO: 1071553 - protein, 9 aa, Homo Sapiens
QGQEACLTP

SEQ ID NO: 1071554 - protein, 9 aa, Homo Sapiens
DLLEKGFEA

SEQ ID NO: 1071555 - protein, 9 aa, Homo Sapiens
SAVFPAARP

SEQ ID NO: 1071556 - protein, 9 aa, Homo Sapiens
FSDVVAIAP

SEQ ID NO: 1071557 - protein, 9 aa, Homo Sapiens
DARNVLENK

SEQ ID NO: 1071558 - protein, 9 aa, Homo Sapiens
FFCRVKFPL

SEQ ID NO: 1071559 - protein, 9 aa, Homo Sapiens
ECSRDSFKV

SEQ ID NO: 1071560 - protein, 9 aa, Homo Sapiens
DAQVSKRHQ

SEQ ID NO: 1071561 - protein, 9 aa, Homo Sapiens
QRLVYEREL

SEQ ID NO: 1071562 - protein, 9 aa, Homo Sapiens
GTVTTGQTP

SEQ ID NO: 1071563 - protein, 9 aa, Homo Sapiens
GQRVSQTLR

SEQ ID NO: 1071564 - protein, 9 aa, Homo Sapiens
PECSVKGQT

SEQ ID NO: 1071565 - protein, 9 aa, Homo Sapiens
KEDEEGEEQ

SEQ ID NO: 1071566 - protein, 9 aa, Homo Sapiens
IQRVIRVPD

SEQ ID NO: 1071567 - protein, 9 aa, Homo Sapiens
PAEDPEEEE

SEQ ID NO: 1071568 - protein, 9 aa, Homo Sapiens
KKRKLETNL

SEQ ID NO: 1071569 - protein, 9 aa, Homo Sapiens
SQCDLSEIS

SEQ ID NO: 1071570 - protein, 9 aa, Homo Sapiens
WDQLGRQTD

SEQ ID NO: 1071571 - protein, 9 aa, Homo Sapiens
ITSKNTTDD

SEQ ID NO: 1071572 - protein, 9 aa, Homo Sapiens
HQLKKLLSL

SEQ ID NO: 1071573 - protein, 9 aa, Homo Sapiens
LGPGAAPLW

SEQ ID NO: 1071574 - protein, 9 aa, Homo Sapiens
GLEEPVSYK

SEQ ID NO: 1071575 - protein, 9 aa, Homo Sapiens
LTMVAVDRY

SEQ ID NO: 1071576 - protein, 9 aa, Homo Sapiens
YVQIPPIEK

SEQ ID NO: 1071577 - protein, 9 aa, Homo Sapiens
DISACQEIR

SEQ ID NO: 1071578 - protein, 9 aa, Homo Sapiens
KEELPLKEE

SEQ ID NO: 1071579 - protein, 9 aa, Homo Sapiens
EEYTGTNPL

SEQ ID NO: 1071580 - protein, 9 aa, Homo Sapiens
ISIDRFLKV

SEQ ID NO: 1071581 - protein, 9 aa, Homo Sapiens
DKRENSQSD

SEQ ID NO: 1071582 - protein, 9 aa, Homo Sapiens
DKEDYPASW

SEQ ID NO: 1071583 - protein, 9 aa, Homo Sapiens
LYVLIGTGT

SEQ ID NO: 1071584 - protein, 9 aa, Homo Sapiens
IVAIIIPEP

SEQ ID NO: 1071585 - protein, 9 aa, Homo Sapiens
CLETYDEPP

SEQ ID NO: 1071586 - protein, 9 aa, Homo Sapiens
EEPASDSHL

SEQ ID NO: 1071587 - protein, 9 aa, Homo Sapiens
EKMSNWNFL

SEQ ID NO: 1071588 - protein, 9 aa, Homo Sapiens
KPKKKRRQK

SEQ ID NO: 1071589 - protein, 9 aa, Homo Sapiens
QGTAEAAHE

SEQ ID NO: 1071590 - protein, 9 aa, Homo Sapiens
LRLSRKIRE

SEQ ID NO: 1071591 - protein, 9 aa, Homo Sapiens
SWLITKERN

SEQ ID NO: 1071592 - protein, 9 aa, Homo Sapiens
LTWLGVLFL

SEQ ID NO: 1071593 - protein, 9 aa, Homo Sapiens
HALSCMNQK

SEQ ID NO: 1071594 - protein, 9 aa, Homo Sapiens
TDTARSNSE

SEQ ID NO: 1071595 - protein, 9 aa, Homo Sapiens
VQYPAVSFS

SEQ ID NO: 1071596 - protein, 9 aa, Homo Sapiens
AFEEAWRRT

SEQ ID NO: 1071597 - protein, 9 aa, Homo Sapiens
DASSSLASL

SEQ ID NO: 1071598 - protein, 9 aa, Homo Sapiens
FQVQVTISA

SEQ ID NO: 1071599 - protein, 9 aa, Homo Sapiens
KRRSPGLLE

SEQ ID NO: 1071600 - protein, 9 aa, Homo Sapiens
GCTWRFRHL

SEQ ID NO: 1071601 - protein, 9 aa, Homo Sapiens
RRLTDLEIG

SEQ ID NO: 1071602 - protein, 9 aa, Homo Sapiens
QRPTPYKWM

SEQ ID NO: 1071603 - protein, 9 aa, Homo Sapiens
TLKKPQEPA

SEQ ID NO: 1071604 - protein, 9 aa, Homo Sapiens
LEEPVSYKG

SEQ ID NO: 1071605 - protein, 9 aa, Homo Sapiens
KGVNFTDIK

SEQ ID NO: 1071606 - protein, 9 aa, Homo Sapiens
LKKRMLIPS

SEQ ID NO: 1071607 - protein, 9 aa, Homo Sapiens
TCFCLLDNT

SEQ ID NO: 1071608 - protein, 9 aa, Homo Sapiens
SNMELPTPQ

SEQ ID NO: 1071609 - protein, 9 aa, Homo Sapiens
SPSARDGVY

SEQ ID NO: 1071610 - protein, 9 aa, Homo Sapiens
PAGGPGFSG

SEQ ID NO: 1071611 - protein, 9 aa, Homo Sapiens
CERPACQSE

SEQ ID NO: 1071612 - protein, 9 aa, Homo Sapiens
LMLVTLTSC

SEQ ID NO: 1071613 - protein, 9 aa, Homo Sapiens
SIESVMDPI

SEQ ID NO: 1071614 - protein, 9 aa, Homo Sapiens
YPDQITQNM

SEQ ID NO: 1071615 - protein, 9 aa, Homo Sapiens
QEKKASIKK

SEQ ID NO: 1071616 - protein, 9 aa, Homo Sapiens
HENVNVRIH

SEQ ID NO: 1071617 - protein, 9 aa, Homo Sapiens
QAPSNDASS

SEQ ID NO: 1071618 - protein, 9 aa, Homo Sapiens
PTHYPLCPE

SEQ ID NO: 1071619 - protein, 9 aa, Homo Sapiens
AGHLKKALD

SEQ ID NO: 1071620 - protein, 9 aa, Homo Sapiens
SFIVSVLVI

SEQ ID NO: 1071621 - protein, 9 aa, Homo Sapiens
KSQEPAFYI

SEQ ID NO: 1071622 - protein, 9 aa, Homo Sapiens
LWWTFDCSR

SEQ ID NO: 1071623 - protein, 9 aa, Homo Sapiens
SNYTDSFFK

SEQ ID NO: 1071624 - protein, 9 aa, Homo Sapiens
QRFHLPKKN

SEQ ID NO: 1071625 - protein, 9 aa, Homo Sapiens
GEAGIPGYP

SEQ ID NO: 1071626 - protein, 9 aa, Homo Sapiens
PSVSRVGYS

SEQ ID NO: 1071627 - protein, 9 aa, Homo Sapiens
SMISVNPGL

SEQ ID NO: 1071628 - protein, 9 aa, Homo Sapiens
KGDGEALGG

SEQ ID NO: 1071629 - protein, 9 aa, Homo Sapiens
SVYLELTDS

SEQ ID NO: 1071630 - protein, 9 aa, Homo Sapiens
DPSGAGASN

SEQ ID NO: 1071631 - protein, 9 aa, Homo Sapiens
CETVCKTRM

SEQ ID NO: 1071632 - protein, 9 aa, Homo Sapiens
FVAGFSRFL

SEQ ID NO: 1071633 - protein, 9 aa, Homo Sapiens
LGKLAPCGS

SEQ ID NO: 1071634 - protein, 9 aa, Homo Sapiens
TSRGDVNNQ

SEQ ID NO: 1071635 - protein, 9 aa, Homo Sapiens
NSSFHHGEN

SEQ ID NO: 1071636 - protein, 9 aa, Homo Sapiens
SSFAYVKKE

SEQ ID NO: 1071637 - protein, 9 aa, Homo Sapiens
PGFAPTHQS

SEQ ID NO: 1071638 - protein, 9 aa, Homo Sapiens
SCSDSCDFD

SEQ ID NO: 1071639 - protein, 9 aa, Homo Sapiens
NEIPEISES

SEQ ID NO: 1071640 - protein, 9 aa, Homo Sapiens
LPTFGEFLS

SEQ ID NO: 1071641 - protein, 9 aa, Homo Sapiens
CSISRDREE

SEQ ID NO: 1071642 - protein, 9 aa, Homo Sapiens
SSDEIDLPR

SEQ ID NO: 1071643 - protein, 9 aa, Homo Sapiens
SSMLTKCKI

SEQ ID NO: 1071644 - protein, 9 aa, Homo Sapiens
TLTFSYAAL

SEQ ID NO: 1071645 - protein, 9 aa, Homo Sapiens
PVSSWPRAQ

SEQ ID NO: 1071646 - protein, 9 aa, Homo Sapiens
EPFTSECLR

SEQ ID NO: 1071647 - protein, 9 aa, Homo Sapiens
LLKPLCRVW

SEQ ID NO: 1071648 - protein, 9 aa, Homo Sapiens
STLANITIL

SEQ ID NO: 1071649 - protein, 9 aa, Homo Sapiens
QKFLKELSK

SEQ ID NO: 1071650 - protein, 9 aa, Homo Sapiens
DLFHKNCML

SEQ ID NO: 1071651 - protein, 9 aa, Homo Sapiens
SRDASVSQE

SEQ ID NO: 1071652 - protein, 9 aa, Homo Sapiens
MAQPYASVQ

SEQ ID NO: 1071653 - protein, 9 aa, Homo Sapiens
KISSVLHGE

SEQ ID NO: 1071654 - protein, 9 aa, Homo Sapiens
RVLIDKGKW

SEQ ID NO: 1071655 - protein, 9 aa, Homo Sapiens
RFTPYKWYN

SEQ ID NO: 1071656 - protein, 9 aa, Homo Sapiens
DPDVGVNFL

SEQ ID NO: 1071657 - protein, 9 aa, Homo Sapiens
LVAGSQFLA

SEQ ID NO: 1071658 - protein, 9 aa, Homo Sapiens
KASRKIASE

SEQ ID NO: 1071659 - protein, 9 aa, Homo Sapiens
SQKRPWCSA

SEQ ID NO: 1071660 - protein, 9 aa, Homo Sapiens
VISTHQLKK

SEQ ID NO: 1071661 - protein, 9 aa, Homo Sapiens
NRTFKVIKA

SEQ ID NO: 1071662 - protein, 9 aa, Homo Sapiens
AAFVCSGLL

SEQ ID NO: 1071663 - protein, 9 aa, Homo Sapiens
TLLPVTLSI

SEQ ID NO: 1071664 - protein, 9 aa, Homo Sapiens
LMYLLAAVF

SEQ ID NO: 1071665 - protein, 9 aa, Homo Sapiens
LGTQKYPSP

SEQ ID NO: 1071666 - protein, 9 aa, Homo Sapiens
SVFISHNSC

SEQ ID NO: 1071667 - protein, 9 aa, Homo Sapiens
KKKTVITDE

SEQ ID NO: 1071668 - protein, 9 aa, Homo Sapiens
ERFLKQSHS

SEQ ID NO: 1071669 - protein, 9 aa, Homo Sapiens
VCSRYTEIC

SEQ ID NO: 1071670 - protein, 9 aa, Homo Sapiens
SYQKFLFET

SEQ ID NO: 1071671 - protein, 9 aa, Homo Sapiens
NDDCQIKKR

SEQ ID NO: 1071672 - protein, 9 aa, Homo Sapiens
LTSCMKALK

SEQ ID NO: 1071673 - protein, 9 aa, Homo Sapiens
KVVKNQKRE

SEQ ID NO: 1071674 - protein, 9 aa, Homo Sapiens
VWLTPPGSC

SEQ ID NO: 1071675 - protein, 9 aa, Homo Sapiens
QQQSGEFFF

SEQ ID NO: 1071676 - protein, 9 aa, Homo Sapiens
ENFCALSTG

SEQ ID NO: 1071677 - protein, 9 aa, Homo Sapiens
YGQGMNPAD

SEQ ID NO: 1071678 - protein, 9 aa, Homo Sapiens
LSAEEEHLV

SEQ ID NO: 1071679 - protein, 9 aa, Homo Sapiens
LRGLVQLVK

SEQ ID NO: 1071680 - protein, 9 aa, Homo Sapiens
KKTVITDEA

SEQ ID NO: 1071681 - protein, 9 aa, Homo Sapiens
LEEGNYFFD

SEQ ID NO: 1071682 - protein, 9 aa, Homo Sapiens
NEQQKNSFN

SEQ ID NO: 1071683 - protein, 9 aa, Homo Sapiens
YSFTPFMTV

SEQ ID NO: 1071684 - protein, 9 aa, Homo Sapiens
AGLLEVFLA

SEQ ID NO: 1071685 - protein, 9 aa, Homo Sapiens
TKRQISHGR

SEQ ID NO: 1071686 - protein, 9 aa, Homo Sapiens
DETLTDEKT

SEQ ID NO: 1071687 - protein, 9 aa, Homo Sapiens
GMGIILRIV

SEQ ID NO: 1071688 - protein, 9 aa, Homo Sapiens
CISMMTPSD

SEQ ID NO: 1071689 - protein, 9 aa, Homo Sapiens
VRVKAVLLE

SEQ ID NO: 1071690 - protein, 9 aa, Homo Sapiens
TCLQSESWV

SEQ ID NO: 1071691 - protein, 9 aa, Homo Sapiens
LEGKYLLSD

SEQ ID NO: 1071692 - protein, 9 aa, Homo Sapiens
PFWRRMTRT

SEQ ID NO: 1071693 - protein, 9 aa, Homo Sapiens
AWRRTREFE

SEQ ID NO: 1071694 - protein, 9 aa, Homo Sapiens
QKTAETEKG

SEQ ID NO: 1071695 - protein, 9 aa, Homo Sapiens
EGPGAHEKV

SEQ ID NO: 1071696 - protein, 9 aa, Homo Sapiens
WKDISLNER

SEQ ID NO: 1071697 - protein, 9 aa, Homo Sapiens
QSCLVSSAW

SEQ ID NO: 1071698 - protein, 9 aa, Homo Sapiens
LTERNVCGG

SEQ ID NO: 1071699 - protein, 9 aa, Homo Sapiens
YNEPQTALK

SEQ ID NO: 1071700 - protein, 9 aa, Homo Sapiens
VAVDGDLGQ

SEQ ID NO: 1071701 - protein, 9 aa, Homo Sapiens
SDLGKVCSA

SEQ ID NO: 1071702 - protein, 9 aa, Homo Sapiens
RGQPPEPSF

SEQ ID NO: 1071703 - protein, 9 aa, Homo Sapiens
QGAPWAKEL

SEQ ID NO: 1071704 - protein, 9 aa, Homo Sapiens
LSCMNQKHL

SEQ ID NO: 1071705 - protein, 9 aa, Homo Sapiens
LQGQMIWIE

SEQ ID NO: 1071706 - protein, 9 aa, Homo Sapiens
EMYVQGNAK

SEQ ID NO: 1071707 - protein, 9 aa, Homo Sapiens
PGKLVVEEA

SEQ ID NO: 1071708 - protein, 9 aa, Homo Sapiens
EQEALVKRL

SEQ ID NO: 1071709 - protein, 9 aa, Homo Sapiens
SYGFFLLFR

SEQ ID NO: 1071710 - protein, 9 aa, Homo Sapiens
GDRHSTQGD

SEQ ID NO: 1071711 - protein, 9 aa, Homo Sapiens
VVFDILAVL

SEQ ID NO: 1071712 - protein, 9 aa, Homo Sapiens
FTKRPLNEQ

SEQ ID NO: 1071713 - protein, 9 aa, Homo Sapiens
SPNGPTSGL

SEQ ID NO: 1071714 - protein, 9 aa, Homo Sapiens
GSDFSLSEP

SEQ ID NO: 1071715 - protein, 9 aa, Homo Sapiens
QVGHLQNLS

SEQ ID NO: 1071716 - protein, 9 aa, Homo Sapiens
LPKEEKKAL

SEQ ID NO: 1071717 - protein, 9 aa, Homo Sapiens
AITYGALFC

SEQ ID NO: 1071718 - protein, 9 aa, Homo Sapiens
MHSFWNTIV

SEQ ID NO: 1071719 - protein, 9 aa, Homo Sapiens
EDDDFEIGN

SEQ ID NO: 1071720 - protein, 9 aa, Homo Sapiens
LQLVWGGQA

SEQ ID NO: 1071721 - protein, 9 aa, Homo Sapiens
GRLTERNVC

SEQ ID NO: 1071722 - protein, 9 aa, Homo Sapiens
RVASFNDLD

SEQ ID NO: 1071723 - protein, 9 aa, Homo Sapiens
VEENLRRAP

SEQ ID NO: 1071724 - protein, 9 aa, Homo Sapiens
INFIFIMLL

SEQ ID NO: 1071725 - protein, 9 aa, Homo Sapiens
YCPNGLIFK

SEQ ID NO: 1071726 - protein, 9 aa, Homo Sapiens
DESQKVSQP

SEQ ID NO: 1071727 - protein, 9 aa, Homo Sapiens
FSTFNPEFV

SEQ ID NO: 1071728 - protein, 9 aa, Homo Sapiens
DIETKKELD

SEQ ID NO: 1071729 - protein, 9 aa, Homo Sapiens
LFILLLRLM

SEQ ID NO: 1071730 - protein, 9 aa, Homo Sapiens
MGIILRIVQ

SEQ ID NO: 1071731 - protein, 9 aa, Homo Sapiens
RQLSAACFV

SEQ ID NO: 1071732 - protein, 9 aa, Homo Sapiens
SITARKPLL

SEQ ID NO: 1071733 - protein, 9 aa, Homo Sapiens
DVYIENPHL

SEQ ID NO: 1071734 - protein, 9 aa, Homo Sapiens
FCHLHTVSQ

SEQ ID NO: 1071735 - protein, 9 aa, Homo Sapiens
RLVVLVKNN

SEQ ID NO: 1071736 - protein, 9 aa, Homo Sapiens
LAQLNGCRA

SEQ ID NO: 1071737 - protein, 9 aa, Homo Sapiens
PEFLQGADH

SEQ ID NO: 1071738 - protein, 9 aa, Homo Sapiens
KKKRRQKRG

SEQ ID NO: 1071739 - protein, 9 aa, Homo Sapiens
LKVNDESTE

SEQ ID NO: 1071740 - protein, 9 aa, Homo Sapiens
QGFQLTHLL

SEQ ID NO: 1071741 - protein, 9 aa, Homo Sapiens
MKKLDHCNI

SEQ ID NO: 1071742 - protein, 9 aa, Homo Sapiens
SSLFQTLEG

SEQ ID NO: 1071743 - protein, 9 aa, Homo Sapiens
EKGLHDLLH

SEQ ID NO: 1071744 - protein, 9 aa, Homo Sapiens
YNPAPYTLP

SEQ ID NO: 1071745 - protein, 9 aa, Homo Sapiens
IHLRRVGDS

SEQ ID NO: 1071746 - protein, 9 aa, Homo Sapiens
LPGLISRAD

SEQ ID NO: 1071747 - protein, 9 aa, Homo Sapiens
LAHPQLPVL

SEQ ID NO: 1071748 - protein, 9 aa, Homo Sapiens
RRASVYLEE

SEQ ID NO: 1071749 - protein, 9 aa, Homo Sapiens
SNETLAHFK

SEQ ID NO: 1071750 - protein, 9 aa, Homo Sapiens
TNPLYVGKL

SEQ ID NO: 1071751 - protein, 9 aa, Homo Sapiens
ILVLKYIFG

SEQ ID NO: 1071752 - protein, 9 aa, Homo Sapiens
EIDTIRYIF

SEQ ID NO: 1071753 - protein, 9 aa, Homo Sapiens
MFDSPKDNE

SEQ ID NO: 1071754 - protein, 9 aa, Homo Sapiens
SIATSTPSK

SEQ ID NO: 1071755 - protein, 9 aa, Homo Sapiens
YVGRFKFSE

SEQ ID NO: 1071756 - protein, 9 aa, Homo Sapiens
HPLINKRIY

SEQ ID NO: 1071757 - protein, 9 aa, Homo Sapiens
EKIEDIFFQ

SEQ ID NO: 1071758 - protein, 9 aa, Homo Sapiens
KLTMQAHDQ

SEQ ID NO: 1071759 - protein, 9 aa, Homo Sapiens
LISRADYAG

SEQ ID NO: 1071760 - protein, 9 aa, Homo Sapiens
AHPKATDAL

SEQ ID NO: 1071761 - protein, 9 aa, Homo Sapiens
RVLGIFGDV

SEQ ID NO: 1071762 - protein, 9 aa, Homo Sapiens
GGGRPTLFS

SEQ ID NO: 1071763 - protein, 9 aa, Homo Sapiens
KGQTESFHC

SEQ ID NO: 1071764 - protein, 9 aa, Homo Sapiens
KTAENFCAL

SEQ ID NO: 1071765 - protein, 9 aa, Homo Sapiens
FWKKENNLL

SEQ ID NO: 1071766 - protein, 9 aa, Homo Sapiens
PQFSATRTG

SEQ ID NO: 1071767 - protein, 9 aa, Homo Sapiens
CTLLSVGPQ

SEQ ID NO: 1071768 - protein, 9 aa, Homo Sapiens
SSSLLVHQR

SEQ ID NO: 1071769 - protein, 9 aa, Homo Sapiens
VAYCPLMLK

SEQ ID NO: 1071770 - protein, 9 aa, Homo Sapiens
GPQGITGPN

SEQ ID NO: 1071771 - protein, 9 aa, Homo Sapiens
RFMPDNINP

SEQ ID NO: 1071772 - protein, 9 aa, Homo Sapiens
AYDIQAAME

SEQ ID NO: 1071773 - protein, 9 aa, Homo Sapiens
KVDRTLKGT

SEQ ID NO: 1071774 - protein, 9 aa, Homo Sapiens
AIPHVVLGW

SEQ ID NO: 1071775 - protein, 9 aa, Homo Sapiens
QTPPEDNYP

SEQ ID NO: 1071776 - protein, 9 aa, Homo Sapiens
PPGLKQFSC

SEQ ID NO: 1071777 - protein, 9 aa, Homo Sapiens
NPAPYTLPP

SEQ ID NO: 1071778 - protein, 9 aa, Homo Sapiens
LPQKPQPFP

SEQ ID NO: 1071779 - protein, 9 aa, Homo Sapiens
NDCRNWSDE

SEQ ID NO: 1071780 - protein, 9 aa, Homo Sapiens
QYSVNNEIT

SEQ ID NO: 1071781 - protein, 9 aa, Homo Sapiens
LEKEKETTR

SEQ ID NO: 1071782 - protein, 9 aa, Homo Sapiens
GQGFSRHHE

SEQ ID NO: 1071783 - protein, 9 aa, Homo Sapiens
TTAQWFLHR

SEQ ID NO: 1071784 - protein, 9 aa, Homo Sapiens
FFRFIGVIL

SEQ ID NO: 1071785 - protein, 9 aa, Homo Sapiens
LTALYNLHM

SEQ ID NO: 1071786 - protein, 9 aa, Homo Sapiens
KRADLQLSL

SEQ ID NO: 1071787 - protein, 9 aa, Homo Sapiens
EKPIQDFHY

SEQ ID NO: 1071788 - protein, 9 aa, Homo Sapiens
SVDPGALEL

SEQ ID NO: 1071789 - protein, 9 aa, Homo Sapiens
FLMYLLAAV

SEQ ID NO: 1071790 - protein, 9 aa, Homo Sapiens
SQDDSTWWQ

SEQ ID NO: 1071791 - protein, 9 aa, Homo Sapiens
PEVWFAARS

SEQ ID NO: 1071792 - protein, 9 aa, Homo Sapiens
GEVKRSVPC

SEQ ID NO: 1071793 - protein, 9 aa, Homo Sapiens
GRSLPFWRR

SEQ ID NO: 1071794 - protein, 9 aa, Homo Sapiens
YLGNFGEPQ

SEQ ID NO: 1071795 - protein, 9 aa, Homo Sapiens
KISPPTPKL

SEQ ID NO: 1071796 - protein, 9 aa, Homo Sapiens
PEGKTRETV

SEQ ID NO: 1071797 - protein, 9 aa, Homo Sapiens
KRLWKRMDK

SEQ ID NO: 1071798 - protein, 9 aa, Homo Sapiens
SCQPACCTF

SEQ ID NO: 1071799 - protein, 9 aa, Homo Sapiens
SVFDQDFGV

SEQ ID NO: 1071800 - protein, 9 aa, Homo Sapiens
MPFEGPQQS

SEQ ID NO: 1071801 - protein, 9 aa, Homo Sapiens
LYKREKGIK

SEQ ID NO: 1071802 - protein, 9 aa, Homo Sapiens
HQTPPWREK

SEQ ID NO: 1071803 - protein, 9 aa, Homo Sapiens
DESRKSCIV

SEQ ID NO: 1071804 - protein, 9 aa, Homo Sapiens
RLCYNNTFE

SEQ ID NO: 1071805 - protein, 9 aa, Homo Sapiens
FSSELFCHL

SEQ ID NO: 1071806 - protein, 9 aa, Homo Sapiens
RAQENLNLL

SEQ ID NO: 1071807 - protein, 9 aa, Homo Sapiens
YMPFEGPQQ

SEQ ID NO: 1071808 - protein, 9 aa, Homo Sapiens
WYQGKINGI

SEQ ID NO: 1071809 - protein, 9 aa, Homo Sapiens
TRRQRSSQS

SEQ ID NO: 1071810 - protein, 9 aa, Homo Sapiens
DTESYLQTF

SEQ ID NO: 1071811 - protein, 9 aa, Homo Sapiens
AFVPETIHD

SEQ ID NO: 1071812 - protein, 9 aa, Homo Sapiens
LSSLLSHLP

SEQ ID NO: 1071813 - protein, 9 aa, Homo Sapiens
KPLGQDEIE

SEQ ID NO: 1071814 - protein, 9 aa, Homo Sapiens
ADSCFLTST

SEQ ID NO: 1071815 - protein, 9 aa, Homo Sapiens
PVLRLSRKI

SEQ ID NO: 1071816 - protein, 9 aa, Homo Sapiens
GEFFFLKDL

SEQ ID NO: 1071817 - protein, 9 aa, Homo Sapiens
GFYSKSQYK

SEQ ID NO: 1071818 - protein, 9 aa, Homo Sapiens
SMGPKPHLP

SEQ ID NO: 1071819 - protein, 9 aa, Homo Sapiens
VIHQMPDLT

SEQ ID NO: 1071820 - protein, 9 aa, Homo Sapiens
QGISEIQSC

SEQ ID NO: 1071821 - protein, 9 aa, Homo Sapiens
SVEIENQET

SEQ ID NO: 1071822 - protein, 9 aa, Homo Sapiens
RLTVASPDC

SEQ ID NO: 1071823 - protein, 9 aa, Homo Sapiens
TTRALDKTD

SEQ ID NO: 1071824 - protein, 9 aa, Homo Sapiens
MLTKCKIIH

SEQ ID NO: 1071825 - protein, 9 aa, Homo Sapiens
RTLLDYKGI

SEQ ID NO: 1071826 - protein, 9 aa, Homo Sapiens
IRVFGIAFS

SEQ ID NO: 1071827 - protein, 9 aa, Homo Sapiens
VTILSAKKK

SEQ ID NO: 1071828 - protein, 9 aa, Homo Sapiens
SRLEAGGGT

SEQ ID NO: 1071829 - protein, 9 aa, Homo Sapiens
GEVLEAVWY

SEQ ID NO: 1071830 - protein, 9 aa, Homo Sapiens
GTILKVNDE

SEQ ID NO: 1071831 - protein, 9 aa, Homo Sapiens
LVGRGTGKR

SEQ ID NO: 1071832 - protein, 9 aa, Homo Sapiens
DFYVAVSEI

SEQ ID NO: 1071833 - protein, 9 aa, Homo Sapiens
FDQSSSLLV

SEQ ID NO: 1071834 - protein, 9 aa, Homo Sapiens
VSLPWRAET

SEQ ID NO: 1071835 - protein, 9 aa, Homo Sapiens
GRQQRIAVK

SEQ ID NO: 1071836 - protein, 9 aa, Homo Sapiens
RRDETLTDE

SEQ ID NO: 1071837 - protein, 9 aa, Homo Sapiens
RKKDAQPGH

SEQ ID NO: 1071838 - protein, 9 aa, Homo Sapiens
PSKGGSSST

SEQ ID NO: 1071839 - protein, 9 aa, Homo Sapiens
TVPCRKQSN

SEQ ID NO: 1071840 - protein, 9 aa, Homo Sapiens
EAQGEAGPS

SEQ ID NO: 1071841 - protein, 9 aa, Homo Sapiens
FTESVKLNL

SEQ ID NO: 1071842 - protein, 9 aa, Homo Sapiens
KGSKLDLKG

SEQ ID NO: 1071843 - protein, 9 aa, Homo Sapiens
VHRLSATLE

SEQ ID NO: 1071844 - protein, 9 aa, Homo Sapiens
RRLLQLCLR

SEQ ID NO: 1071845 - protein, 9 aa, Homo Sapiens
ENLNGHMIP

SEQ ID NO: 1071846 - protein, 9 aa, Homo Sapiens
NEDIIEVLI

SEQ ID NO: 1071847 - protein, 9 aa, Homo Sapiens
ECPGREAEQ

SEQ ID NO: 1071848 - protein, 9 aa, Homo Sapiens
LSVLFSTIV

SEQ ID NO: 1071849 - protein, 9 aa, Homo Sapiens
GDGRKRQVS

SEQ ID NO: 1071850 - protein, 9 aa, Homo Sapiens
WVWSVDKGQ

SEQ ID NO: 1071851 - protein, 9 aa, Homo Sapiens
VTPGEKILK

SEQ ID NO: 1071852 - protein, 9 aa, Homo Sapiens
RKKYESKLK

SEQ ID NO: 1071853 - protein, 9 aa, Homo Sapiens
SIGSAFKSD

SEQ ID NO: 1071854 - protein, 9 aa, Homo Sapiens
GNPSIFSSL

SEQ ID NO: 1071855 - protein, 9 aa, Homo Sapiens
FWNEGYIMG

SEQ ID NO: 1071856 - protein, 9 aa, Homo Sapiens
TSNTSGKIW

SEQ ID NO: 1071857 - protein, 9 aa, Homo Sapiens
LQGFRDILH

SEQ ID NO: 1071858 - protein, 9 aa, Homo Sapiens
TLSGEIFGG

SEQ ID NO: 1071859 - protein, 9 aa, Homo Sapiens
ATSKPPYFF

SEQ ID NO: 1071860 - protein, 9 aa, Homo Sapiens
FPLSEVMNK

SEQ ID NO: 1071861 - protein, 9 aa, Homo Sapiens
PSLHGTRRH

SEQ ID NO: 1071862 - protein, 9 aa, Homo Sapiens
LLTVGHLQV

SEQ ID NO: 1071863 - protein, 9 aa, Homo Sapiens
VVLGFRENQ

SEQ ID NO: 1071864 - protein, 9 aa, Homo Sapiens
VFSRKSSSP

SEQ ID NO: 1071865 - protein, 9 aa, Homo Sapiens
KFPWRKMVH

SEQ ID NO: 1071866 - protein, 9 aa, Homo Sapiens
EHVQSFSEN

SEQ ID NO: 1071867 - protein, 9 aa, Homo Sapiens
FASVKESLQ

SEQ ID NO: 1071868 - protein, 9 aa, Homo Sapiens
KNMSKFLGE

SEQ ID NO: 1071869 - protein, 9 aa, Homo Sapiens
LLGKFSLVQ

SEQ ID NO: 1071870 - protein, 9 aa, Homo Sapiens
PEKDADWMH

SEQ ID NO: 1071871 - protein, 9 aa, Homo Sapiens
VDGLLRIGT

SEQ ID NO: 1071872 - protein, 9 aa, Homo Sapiens
EFFFLKDLK

SEQ ID NO: 1071873 - protein, 9 aa, Homo Sapiens
KHTRPIFSG

SEQ ID NO: 1071874 - protein, 9 aa, Homo Sapiens
DNLAERVGE

SEQ ID NO: 1071875 - protein, 9 aa, Homo Sapiens
QLLVSLGGS

SEQ ID NO: 1071876 - protein, 9 aa, Homo Sapiens
KNFRKQVNY

SEQ ID NO: 1071877 - protein, 9 aa, Homo Sapiens
GLVCVTQAE

SEQ ID NO: 1071878 - protein, 9 aa, Homo Sapiens
RPHSSLSLF

SEQ ID NO: 1071879 - protein, 9 aa, Homo Sapiens
PVQKYPGNQ

SEQ ID NO: 1071880 - protein, 9 aa, Homo Sapiens
VMSYDCYVA

SEQ ID NO: 1071881 - protein, 9 aa, Homo Sapiens
TSYPCFVSR

SEQ ID NO: 1071882 - protein, 9 aa, Homo Sapiens
LQFVATGAV

SEQ ID NO: 1071883 - protein, 9 aa, Homo Sapiens
SWQLPAAQC

SEQ ID NO: 1071884 - protein, 9 aa, Homo Sapiens
EENLAPWHP

SEQ ID NO: 1071885 - protein, 9 aa, Homo Sapiens
MDRQRRNFL

SEQ ID NO: 1071886 - protein, 9 aa, Homo Sapiens
KNGCSSSGA

SEQ ID NO: 1071887 - protein, 9 aa, Homo Sapiens
IQNVAANLC

SEQ ID NO: 1071888 - protein, 9 aa, Homo Sapiens
APLEPRLRP

SEQ ID NO: 1071889 - protein, 9 aa, Homo Sapiens
SLITAVAQP

SEQ ID NO: 1071890 - protein, 9 aa, Homo Sapiens
DCVPNVYRP

SEQ ID NO: 1071891 - protein, 9 aa, Homo Sapiens
GACKIYNST

SEQ ID NO: 1071892 - protein, 9 aa, Homo Sapiens
FSSEKIAIP

SEQ ID NO: 1071893 - protein, 9 aa, Homo Sapiens
CPGSCQSPP

SEQ ID NO: 1071894 - protein, 9 aa, Homo Sapiens
EAGLDVKAL

SEQ ID NO: 1071895 - protein, 9 aa, Homo Sapiens
FVKTYNTYA

SEQ ID NO: 1071896 - protein, 9 aa, Homo Sapiens
ESLTLVLPV

SEQ ID NO: 1071897 - protein, 9 aa, Homo Sapiens
VFYHRSYKL

SEQ ID NO: 1071898 - protein, 9 aa, Homo Sapiens
QLGNKYFRQ

SEQ ID NO: 1071899 - protein, 9 aa, Homo Sapiens
FGALRISGV

SEQ ID NO: 1071900 - protein, 9 aa, Homo Sapiens
VDILVVWDN

SEQ ID NO: 1071901 - protein, 9 aa, Homo Sapiens
TPGNPPLHL

SEQ ID NO: 1071902 - protein, 9 aa, Homo Sapiens
GKAFSWGLS

SEQ ID NO: 1071903 - protein, 9 aa, Homo Sapiens
SKTNTSFTI

SEQ ID NO: 1071904 - protein, 9 aa, Homo Sapiens
MTMKEEMAE

SEQ ID NO: 1071905 - protein, 9 aa, Homo Sapiens
LGAGGSSLS

SEQ ID NO: 1071906 - protein, 9 aa, Homo Sapiens
VQAFLSMKQ

SEQ ID NO: 1071907 - protein, 9 aa, Homo Sapiens
LLALNFLYS

SEQ ID NO: 1071908 - protein, 9 aa, Homo Sapiens
RYLGYLARM

SEQ ID NO: 1071909 - protein, 9 aa, Homo Sapiens
CVPNVYRPQ

SEQ ID NO: 1071910 - protein, 9 aa, Homo Sapiens
VAEGLLGSA

SEQ ID NO: 1071911 - protein, 9 aa, Homo Sapiens
FVGPVSPSR

SEQ ID NO: 1071912 - protein, 9 aa, Homo Sapiens
ASSLGPYLL

SEQ ID NO: 1071913 - protein, 9 aa, Homo Sapiens
LFGNSRLVL

SEQ ID NO: 1071914 - protein, 9 aa, Homo Sapiens
EKLNSEDDM

SEQ ID NO: 1071915 - protein, 9 aa, Homo Sapiens
FATIVENVG

SEQ ID NO: 1071916 - protein, 9 aa, Homo Sapiens
ACFVPSLQT

SEQ ID NO: 1071917 - protein, 9 aa, Homo Sapiens
MGTRFFFYV

SEQ ID NO: 1071918 - protein, 9 aa, Homo Sapiens
YHYGQGMNP

SEQ ID NO: 1071919 - protein, 9 aa, Homo Sapiens
FCSTMADEI

SEQ ID NO: 1071920 - protein, 9 aa, Homo Sapiens
KRFQSKSFL

SEQ ID NO: 1071921 - protein, 9 aa, Homo Sapiens
WVFVLSSML

SEQ ID NO: 1071922 - protein, 9 aa, Homo Sapiens
SLTETSEQI

SEQ ID NO: 1071923 - protein, 9 aa, Homo Sapiens
YVMLRLAIL

SEQ ID NO: 1071924 - protein, 9 aa, Homo Sapiens
FYSLEEQQV

SEQ ID NO: 1071925 - protein, 9 aa, Homo Sapiens
SMHPKLANA

SEQ ID NO: 1071926 - protein, 9 aa, Homo Sapiens
PMDEDSPSP

SEQ ID NO: 1071927 - protein, 9 aa, Homo Sapiens
DKISSVLHG

SEQ ID NO: 1071928 - protein, 9 aa, Homo Sapiens
LISKNIADP

SEQ ID NO: 1071929 - protein, 9 aa, Homo Sapiens
RSFCSTMAD

SEQ ID NO: 1071930 - protein, 9 aa, Homo Sapiens
RALTPMLNP

SEQ ID NO: 1071931 - protein, 9 aa, Homo Sapiens
VEIEFFRAS

SEQ ID NO: 1071932 - protein, 9 aa, Homo Sapiens
PCKKSVNKM

SEQ ID NO: 1071933 - protein, 9 aa, Homo Sapiens
RVRVKAHWL

SEQ ID NO: 1071934 - protein, 9 aa, Homo Sapiens
TVASPDCQQ

SEQ ID NO: 1071935 - protein, 8 aa, Homo Sapiens
GNCAKRPW

SEQ ID NO: 1071936 - protein, 9 aa, Homo Sapiens
LILLEPISQ

SEQ ID NO: 1071937 - protein, 9 aa, Homo Sapiens
AISYDRCAA

SEQ ID NO: 1071938 - protein, 9 aa, Homo Sapiens
EPGFYLDPP

SEQ ID NO: 1071939 - protein, 9 aa, Homo Sapiens
TREDKVKAL

SEQ ID NO: 1071940 - protein, 9 aa, Homo Sapiens
FLFSFIVSV

SEQ ID NO: 1071941 - protein, 9 aa, Homo Sapiens
VYGRELAYG

SEQ ID NO: 1071942 - protein, 9 aa, Homo Sapiens
MRLLECGVI

SEQ ID NO: 1071943 - protein, 9 aa, Homo Sapiens
KTKLDKREN

SEQ ID NO: 1071944 - protein, 9 aa, Homo Sapiens
PAGFDKPIL

SEQ ID NO: 1071945 - protein, 9 aa, Homo Sapiens
EIAGVNWKS

SEQ ID NO: 1071946 - protein, 9 aa, Homo Sapiens
RNEIPEISE

SEQ ID NO: 1071947 - protein, 9 aa, Homo Sapiens
AFLEHQKMK

SEQ ID NO: 1071948 - protein, 9 aa, Homo Sapiens
QNAPPLESP

SEQ ID NO: 1071949 - protein, 9 aa, Homo Sapiens
LNGSLNYNN

SEQ ID NO: 1071950 - protein, 9 aa, Homo Sapiens
KKERDRYIN

SEQ ID NO: 1071951 - protein, 9 aa, Homo Sapiens
GHALVMTRM

SEQ ID NO: 1071952 - protein, 9 aa, Homo Sapiens
VDIVTALRW

SEQ ID NO: 1071953 - protein, 9 aa, Homo Sapiens
VQMNHTFFP

SEQ ID NO: 1071954 - protein, 9 aa, Homo Sapiens
KDAQPGHHG

SEQ ID NO: 1071955 - protein, 9 aa, Homo Sapiens
AGIGEKIAH

SEQ ID NO: 1071956 - protein, 9 aa, Homo Sapiens
CSQSGSSGS

SEQ ID NO: 1071957 - protein, 9 aa, Homo Sapiens
SEISVSHVN

SEQ ID NO: 1071958 - protein, 9 aa, Homo Sapiens
DCSTDQEKK

SEQ ID NO: 1071959 - protein, 9 aa, Homo Sapiens
NLLVVLNLF

SEQ ID NO: 1071960 - protein, 9 aa, Homo Sapiens
SLQSDTLTF

SEQ ID NO: 1071961 - protein, 9 aa, Homo Sapiens
KGVTYSLTT

SEQ ID NO: 1071962 - protein, 9 aa, Homo Sapiens
LSGEIFGGQ

SEQ ID NO: 1071963 - protein, 9 aa, Homo Sapiens
PRTEFPETW

SEQ ID NO: 1071964 - protein, 9 aa, Homo Sapiens
HLAIIDILY

SEQ ID NO: 1071965 - protein, 9 aa, Homo Sapiens
RSGPSFLLR

SEQ ID NO: 1071966 - protein, 9 aa, Homo Sapiens
AGIGDQLET

SEQ ID NO: 1071967 - protein, 9 aa, Homo Sapiens
HSSDMLNYE

SEQ ID NO: 1071968 - protein, 9 aa, Homo Sapiens
EVMGPKNKH

SEQ ID NO: 1071969 - protein, 9 aa, Homo Sapiens
PLPSVSRVG

SEQ ID NO: 1071970 - protein, 9 aa, Homo Sapiens
FLKELSKTW

SEQ ID NO: 1071971 - protein, 9 aa, Homo Sapiens
PGAPSENIT

SEQ ID NO: 1071972 - protein, 9 aa, Homo Sapiens
SGRPIAELP

SEQ ID NO: 1071973 - protein, 9 aa, Homo Sapiens
QLEQVNHML

SEQ ID NO: 1071974 - protein, 9 aa, Homo Sapiens
VVYTTVRSP

SEQ ID NO: 1071975 - protein, 9 aa, Homo Sapiens
AQIFFLQGQ

SEQ ID NO: 1071976 - protein, 9 aa, Homo Sapiens
TSSVIPKLL

SEQ ID NO: 1071977 - protein, 9 aa, Homo Sapiens
KPWRTLKKP

SEQ ID NO: 1071978 - protein, 9 aa, Homo Sapiens
PWETGDTFS

SEQ ID NO: 1071979 - protein, 9 aa, Homo Sapiens
VAAVNGKRQ

SEQ ID NO: 1071980 - protein, 9 aa, Homo Sapiens
SCMCWQLEN

SEQ ID NO: 1071981 - protein, 9 aa, Homo Sapiens
KFTCHPVCR

SEQ ID NO: 1071982 - protein, 9 aa, Homo Sapiens
GDCVPNVYR

SEQ ID NO: 1071983 - protein, 9 aa, Homo Sapiens
CDLIESNYP

SEQ ID NO: 1071984 - protein, 9 aa, Homo Sapiens
CQGLGLVVS

SEQ ID NO: 1071985 - protein, 9 aa, Homo Sapiens
TYDETISDE

SEQ ID NO: 1071986 - protein, 9 aa, Homo Sapiens
SKATLEVVV

SEQ ID NO: 1071987 - protein, 9 aa, Homo Sapiens
QKVIPRTYE

SEQ ID NO: 1071988 - protein, 9 aa, Homo Sapiens
DISGPGEET

SEQ ID NO: 1071989 - protein, 9 aa, Homo Sapiens
AGLHKPRSS

SEQ ID NO: 1071990 - protein, 9 aa, Homo Sapiens
MKRHGILMS

SEQ ID NO: 1071991 - protein, 9 aa, Homo Sapiens
SWGLSLVKH

SEQ ID NO: 1071992 - protein, 9 aa, Homo Sapiens
TLKEELPLK

SEQ ID NO: 1071993 - protein, 9 aa, Homo Sapiens
KSQEKLSPS

SEQ ID NO: 1071994 - protein, 9 aa, Homo Sapiens
NSLPRLEIL

SEQ ID NO: 1071995 - protein, 9 aa, Homo Sapiens
SRLSVTLPH

SEQ ID NO: 1071996 - protein, 9 aa, Homo Sapiens
GPGYLPPPQ

SEQ ID NO: 1071997 - protein, 9 aa, Homo Sapiens
RKIIFHLKK

SEQ ID NO: 1071998 - protein, 9 aa, Homo Sapiens
LEGQTFFFK

SEQ ID NO: 1071999 - protein, 9 aa, Homo Sapiens
VEALTQRLA

SEQ ID NO: 1072000 - protein, 9 aa, Homo Sapiens
AQRPSPKAL

SEQ ID NO: 1072001 - protein, 9 aa, Homo Sapiens
THIHALSCM

SEQ ID NO: 1072002 - protein, 9 aa, Homo Sapiens
EKLLFNIDG

SEQ ID NO: 1072003 - protein, 9 aa, Homo Sapiens
KLLSAEIFS

SEQ ID NO: 1072004 - protein, 9 aa, Homo Sapiens
PLYQECILV

SEQ ID NO: 1072005 - protein, 9 aa, Homo Sapiens
LEVKEAGES

SEQ ID NO: 1072006 - protein, 9 aa, Homo Sapiens
RLFRTYRAA

SEQ ID NO: 1072007 - protein, 9 aa, Homo Sapiens
QFSATRTGL

SEQ ID NO: 1072008 - protein, 9 aa, Homo Sapiens
MKDNYYKTL

SEQ ID NO: 1072009 - protein, 9 aa, Homo Sapiens
LLSSRPTLR

SEQ ID NO: 1072010 - protein, 9 aa, Homo Sapiens
YYKTLLMTA

SEQ ID NO: 1072011 - protein, 9 aa, Homo Sapiens
FIRTVQGPP

SEQ ID NO: 1072012 - protein, 9 aa, Homo Sapiens
KTTTASPEG

SEQ ID NO: 1072013 - protein, 9 aa, Homo Sapiens
CRRYERTLS

SEQ ID NO: 1072014 - protein, 9 aa, Homo Sapiens
REKRRTCTL

SEQ ID NO: 1072015 - protein, 9 aa, Homo Sapiens
CLGAARSGC

SEQ ID NO: 1072016 - protein, 9 aa, Homo Sapiens
FLPLLPAVQ

SEQ ID NO: 1072017 - protein, 9 aa, Homo Sapiens
GVKRSSGEQ

SEQ ID NO: 1072018 - protein, 9 aa, Homo Sapiens
QAFEEAWRR

SEQ ID NO: 1072019 - protein, 9 aa, Homo Sapiens
AFSLNSNDV

SEQ ID NO: 1072020 - protein, 9 aa, Homo Sapiens
EWFRVFSRK

SEQ ID NO: 1072021 - protein, 9 aa, Homo Sapiens
SRKCGQHLV

SEQ ID NO: 1072022 - protein, 9 aa, Homo Sapiens
QRGFRYEKD

SEQ ID NO: 1072023 - protein, 9 aa, Homo Sapiens
TLQCPGSCQ

SEQ ID NO: 1072024 - protein, 9 aa, Homo Sapiens
GVKFSCSRM

SEQ ID NO: 1072025 - protein, 9 aa, Homo Sapiens
LGPRQVPVL

SEQ ID NO: 1072026 - protein, 9 aa, Homo Sapiens
LFLPLLPAV

SEQ ID NO: 1072027 - protein, 9 aa, Homo Sapiens
STVSNLPKE

SEQ ID NO: 1072028 - protein, 9 aa, Homo Sapiens
VETMFFLTS

SEQ ID NO: 1072029 - protein, 9 aa, Homo Sapiens
DQSSSLLVH

SEQ ID NO: 1072030 - protein, 9 aa, Homo Sapiens
FSDSKEGEG

SEQ ID NO: 1072031 - protein, 9 aa, Homo Sapiens
SKKATVLVR

SEQ ID NO: 1072032 - protein, 9 aa, Homo Sapiens
VLGKQNSNI

SEQ ID NO: 1072033 - protein, 9 aa, Homo Sapiens
STFTSNLVH

SEQ ID NO: 1072034 - protein, 9 aa, Homo Sapiens
SGPAFLALN

SEQ ID NO: 1072035 - protein, 9 aa, Homo Sapiens
PPNVISQAD

SEQ ID NO: 1072036 - protein, 9 aa, Homo Sapiens
GVQGRQPLI

SEQ ID NO: 1072037 - protein, 9 aa, Homo Sapiens
PEGDAQIDL

SEQ ID NO: 1072038 - protein, 9 aa, Homo Sapiens
YNCSRDQRS

SEQ ID NO: 1072039 - protein, 9 aa, Homo Sapiens
NERESVIQQ

SEQ ID NO: 1072040 - protein, 9 aa, Homo Sapiens
IGMILSRAI

SEQ ID NO: 1072041 - protein, 9 aa, Homo Sapiens
KIIKQLQNP

SEQ ID NO: 1072042 - protein, 9 aa, Homo Sapiens
LSPGTADFN

SEQ ID NO: 1072043 - protein, 9 aa, Homo Sapiens
EVEALTQRL

SEQ ID NO: 1072044 - protein, 9 aa, Homo Sapiens
ITDLRIQVC

SEQ ID NO: 1072045 - protein, 9 aa, Homo Sapiens
KEIKLYVQI

SEQ ID NO: 1072046 - protein, 9 aa, Homo Sapiens
MERRASVYL

SEQ ID NO: 1072047 - protein, 9 aa, Homo Sapiens
LLILSFIQD

SEQ ID NO: 1072048 - protein, 9 aa, Homo Sapiens
FEYLGNFGE

SEQ ID NO: 1072049 - protein, 9 aa, Homo Sapiens
DGFLLISQT

SEQ ID NO: 1072050 - protein, 9 aa, Homo Sapiens
ISDLLMRKS

SEQ ID NO: 1072051 - protein, 9 aa, Homo Sapiens
KILKNTKEQ

SEQ ID NO: 1072052 - protein, 9 aa, Homo Sapiens
SRVLLSEAA

SEQ ID NO: 1072053 - protein, 9 aa, Homo Sapiens
VIEATELKV

SEQ ID NO: 1072054 - protein, 9 aa, Homo Sapiens
DTHIHALSC

SEQ ID NO: 1072055 - protein, 9 aa, Homo Sapiens
NTNKSQEKL

SEQ ID NO: 1072056 - protein, 9 aa, Homo Sapiens
RFMSTLLNY

SEQ ID NO: 1072057 - protein, 9 aa, Homo Sapiens
CTDVLRNLF

SEQ ID NO: 1072058 - protein, 9 aa, Homo Sapiens
AFAFSLNSN

SEQ ID NO: 1072059 - protein, 9 aa, Homo Sapiens
GYRIGPAKV

SEQ ID NO: 1072060 - protein, 9 aa, Homo Sapiens
TSHSSVRRH

SEQ ID NO: 1072061 - protein, 9 aa, Homo Sapiens
VDTLLKELG

SEQ ID NO: 1072062 - protein, 9 aa, Homo Sapiens
KNNGEPPRS

SEQ ID NO: 1072063 - protein, 9 aa, Homo Sapiens
TKALAEFVG

SEQ ID NO: 1072064 - protein, 9 aa, Homo Sapiens
SDKELGSNS

SEQ ID NO: 1072065 - protein, 9 aa, Homo Sapiens
PPGPQAGPL

SEQ ID NO: 1072066 - protein, 9 aa, Homo Sapiens
PHEALFTIG

SEQ ID NO: 1072067 - protein, 9 aa, Homo Sapiens
WMDFVSSHS

SEQ ID NO: 1072068 - protein, 9 aa, Homo Sapiens
SFNHNVLGK

SEQ ID NO: 1072069 - protein, 9 aa, Homo Sapiens
DVKKLFLDN

SEQ ID NO: 1072070 - protein, 9 aa, Homo Sapiens
CFFLENGIE

SEQ ID NO: 1072071 - protein, 9 aa, Homo Sapiens
LNNQENTSV

SEQ ID NO: 1072072 - protein, 9 aa, Homo Sapiens
PQPLCTEVE

SEQ ID NO: 1072073 - protein, 9 aa, Homo Sapiens
TKQGQTNPM

SEQ ID NO: 1072074 - protein, 9 aa, Homo Sapiens
AAGSAQENN

SEQ ID NO: 1072075 - protein, 9 aa, Homo Sapiens
SFIQDKSKH

SEQ ID NO: 1072076 - protein, 9 aa, Homo Sapiens
ENPIQKKSE

SEQ ID NO: 1072077 - protein, 9 aa, Homo Sapiens
FYWPSREQP

SEQ ID NO: 1072078 - protein, 9 aa, Homo Sapiens
GGQGAPWAK

SEQ ID NO: 1072079 - protein, 9 aa, Homo Sapiens
QVFALSWSQ

SEQ ID NO: 1072080 - protein, 9 aa, Homo Sapiens
LTTHKKIYT

SEQ ID NO: 1072081 - protein, 9 aa, Homo Sapiens
PRLEILVAE

SEQ ID NO: 1072082 - protein, 9 aa, Homo Sapiens
SYALLGKLA

SEQ ID NO: 1072083 - protein, 9 aa, Homo Sapiens
SIHSNLLRC

SEQ ID NO: 1072084 - protein, 9 aa, Homo Sapiens
SDPQKDNRN

SEQ ID NO: 1072085 - protein, 9 aa, Homo Sapiens
EGVVDCAGI

SEQ ID NO: 1072086 - protein, 9 aa, Homo Sapiens
RVTLGENNK

SEQ ID NO: 1072087 - protein, 9 aa, Homo Sapiens
FLEEFRPEA

SEQ ID NO: 1072088 - protein, 9 aa, Homo Sapiens
IGSSVMAAL

SEQ ID NO: 1072089 - protein, 9 aa, Homo Sapiens
VDSASKKAT

SEQ ID NO: 1072090 - protein, 9 aa, Homo Sapiens
ATYEKSCQD

SEQ ID NO: 1072091 - protein, 9 aa, Homo Sapiens
LPEYGGKVC

SEQ ID NO: 1072092 - protein, 9 aa, Homo Sapiens
EVCNLLGAD

SEQ ID NO: 1072093 - protein, 9 aa, Homo Sapiens
LTGNSHSQN

SEQ ID NO: 1072094 - protein, 9 aa, Homo Sapiens
STSRGDVNN

SEQ ID NO: 1072095 - protein, 9 aa, Homo Sapiens
LVRLLTYLS

SEQ ID NO: 1072096 - protein, 9 aa, Homo Sapiens
LRSINLFGN

SEQ ID NO: 1072097 - protein, 9 aa, Homo Sapiens
YLLAAVFGY

SEQ ID NO: 1072098 - protein, 9 aa, Homo Sapiens
FSFLWAGPV

SEQ ID NO: 1072099 - protein, 9 aa, Homo Sapiens
APPGCPKKA

SEQ ID NO: 1072100 - protein, 9 aa, Homo Sapiens
YRIGPAKVE

SEQ ID NO: 1072101 - protein, 9 aa, Homo Sapiens
MGSSWQPSP

SEQ ID NO: 1072102 - protein, 9 aa, Homo Sapiens
DECCFQSCD

SEQ ID NO: 1072103 - protein, 9 aa, Homo Sapiens
HPRSSAHCS

SEQ ID NO: 1072104 - protein, 9 aa, Homo Sapiens
KAEPRPRFS

SEQ ID NO: 1072105 - protein, 9 aa, Homo Sapiens
GVPNLTQRL

SEQ ID NO: 1072106 - protein, 9 aa, Homo Sapiens
TRMVLLCGE

SEQ ID NO: 1072107 - protein, 9 aa, Homo Sapiens
GWEEARQRG

SEQ ID NO: 1072108 - protein, 9 aa, Homo Sapiens
EFSCADGQC

SEQ ID NO: 1072109 - protein, 9 aa, Homo Sapiens
LVYREDNPT

SEQ ID NO: 1072110 - protein, 9 aa, Homo Sapiens
ITDTARSNS

SEQ ID NO: 1072111 - protein, 9 aa, Homo Sapiens
YAPCGDLSR

SEQ ID NO: 1072112 - protein, 9 aa, Homo Sapiens
RVTVHGATP

SEQ ID NO: 1072113 - protein, 9 aa, Homo Sapiens
VGCDHQLRS

SEQ ID NO: 1072114 - protein, 9 aa, Homo Sapiens
TDSIPLCQK

SEQ ID NO: 1072115 - protein, 9 aa, Homo Sapiens
EAGLIVGTG

SEQ ID NO: 1072116 - protein, 9 aa, Homo Sapiens
STQVSGVGI

SEQ ID NO: 1072117 - protein, 9 aa, Homo Sapiens
SVKLNLEVN

SEQ ID NO: 1072118 - protein, 9 aa, Homo Sapiens
KRKGAKCLR

SEQ ID NO: 1072119 - protein, 9 aa, Homo Sapiens
GQEQGKEDE

SEQ ID NO: 1072120 - protein, 9 aa, Homo Sapiens
VIPLTDPEA

SEQ ID NO: 1072121 - protein, 9 aa, Homo Sapiens
VLIIAHWLS

SEQ ID NO: 1072122 - protein, 9 aa, Homo Sapiens
SSDILPMVG

SEQ ID NO: 1072123 - protein, 9 aa, Homo Sapiens
KTNIYGQKV

SEQ ID NO: 1072124 - protein, 9 aa, Homo Sapiens
RIVGRTASV

SEQ ID NO: 1072125 - protein, 9 aa, Homo Sapiens
RNAMIQGLF

SEQ ID NO: 1072126 - protein, 9 aa, Homo Sapiens
LAERVGEVL

SEQ ID NO: 1072127 - protein, 9 aa, Homo Sapiens
NCSCPAGKK

SEQ ID NO: 1072128 - protein, 9 aa, Homo Sapiens
SCEILAVIK

SEQ ID NO: 1072129 - protein, 9 aa, Homo Sapiens
ECFQFKAKL

SEQ ID NO: 1072130 - protein, 9 aa, Homo Sapiens
RILLDPYQS

SEQ ID NO: 1072131 - protein, 9 aa, Homo Sapiens
RRVFTPRTP

SEQ ID NO: 1072132 - protein, 9 aa, Homo Sapiens
APEGKTRET

SEQ ID NO: 1072133 - protein, 9 aa, Homo Sapiens
VNVRIHALT

SEQ ID NO: 1072134 - protein, 9 aa, Homo Sapiens
PCGDLSRML

SEQ ID NO: 1072135 - protein, 9 aa, Homo Sapiens
PASCSQELS

SEQ ID NO: 1072136 - protein, 9 aa, Homo Sapiens
KKGILEEYK

SEQ ID NO: 1072137 - protein, 9 aa, Homo Sapiens
SFEFCEEAD

SEQ ID NO: 1072138 - protein, 9 aa, Homo Sapiens
TNMKYLLLI

SEQ ID NO: 1072139 - protein, 9 aa, Homo Sapiens
QIPMLWEKM

SEQ ID NO: 1072140 - protein, 9 aa, Homo Sapiens
GQKDQLCFG

SEQ ID NO: 1072141 - protein, 9 aa, Homo Sapiens
PPSLASPDP

SEQ ID NO: 1072142 - protein, 9 aa, Homo Sapiens
WKLIRQKKK

SEQ ID NO: 1072143 - protein, 9 aa, Homo Sapiens
DNQLKDSEY

SEQ ID NO: 1072144 - protein, 9 aa, Homo Sapiens
GWVFVLSSM

SEQ ID NO: 1072145 - protein, 9 aa, Homo Sapiens
LMQELMTMK

SEQ ID NO: 1072146 - protein, 9 aa, Homo Sapiens
TYQFLQKYL

SEQ ID NO: 1072147 - protein, 9 aa, Homo Sapiens
HLHRHFVNP

SEQ ID NO: 1072148 - protein, 9 aa, Homo Sapiens
HKGVNFTDI

SEQ ID NO: 1072149 - protein, 9 aa, Homo Sapiens
YDERLCYNN

SEQ ID NO: 1072150 - protein, 9 aa, Homo Sapiens
PVDGSDKEL

SEQ ID NO: 1072151 - protein, 9 aa, Homo Sapiens
SHMKFHENY

SEQ ID NO: 1072152 - protein, 9 aa, Homo Sapiens
SVISLQALY

SEQ ID NO: 1072153 - protein, 9 aa, Homo Sapiens
SGLLLLPSS

SEQ ID NO: 1072154 - protein, 9 aa, Homo Sapiens
VNGSMGGPS

SEQ ID NO: 1072155 - protein, 9 aa, Homo Sapiens
AIIIPEPKG

SEQ ID NO: 1072156 - protein, 9 aa, Homo Sapiens
SLDFLVKSN

SEQ ID NO: 1072157 - protein, 9 aa, Homo Sapiens
AEIGIVTRN

SEQ ID NO: 1072158 - protein, 9 aa, Homo Sapiens
RPGLQYWTV

SEQ ID NO: 1072159 - protein, 9 aa, Homo Sapiens
AFPGETALG

SEQ ID NO: 1072160 - protein, 9 aa, Homo Sapiens
FNIKEGSRL

SEQ ID NO: 1072161 - protein, 9 aa, Homo Sapiens
YFIRNMEKS

SEQ ID NO: 1072162 - protein, 9 aa, Homo Sapiens
LRLPFCGHC

SEQ ID NO: 1072163 - protein, 9 aa, Homo Sapiens
KPALLAKEP

SEQ ID NO: 1072164 - protein, 9 aa, Homo Sapiens
LGHSQYSQA

SEQ ID NO: 1072165 - protein, 9 aa, Homo Sapiens
PLIFPSSLD

SEQ ID NO: 1072166 - protein, 9 aa, Homo Sapiens
EQSEESDQE

SEQ ID NO: 1072167 - protein, 9 aa, Homo Sapiens
GAVSPLSGK

SEQ ID NO: 1072168 - protein, 9 aa, Homo Sapiens
EGDVLPGLI

SEQ ID NO: 1072169 - protein, 9 aa, Homo Sapiens
LAYDIQAAM

SEQ ID NO: 1072170 - protein, 9 aa, Homo Sapiens
TSCAGVSVS

SEQ ID NO: 1072171 - protein, 9 aa, Homo Sapiens
SFNLLSKEC

SEQ ID NO: 1072172 - protein, 9 aa, Homo Sapiens
QEKAAFPGR

SEQ ID NO: 1072173 - protein, 9 aa, Homo Sapiens
GLLAPIIYY

SEQ ID NO: 1072174 - protein, 9 aa, Homo Sapiens
SCKRLHRIE

SEQ ID NO: 1072175 - protein, 9 aa, Homo Sapiens
GANYCGKKC

SEQ ID NO: 1072176 - protein, 9 aa, Homo Sapiens
FRENQETQG

SEQ ID NO: 1072177 - protein, 9 aa, Homo Sapiens
AAAFRHPFL

SEQ ID NO: 1072178 - protein, 9 aa, Homo Sapiens
CGGNHQNFT

SEQ ID NO: 1072179 - protein, 9 aa, Homo Sapiens
KAIQHENVN

SEQ ID NO: 1072180 - protein, 9 aa, Homo Sapiens
DSQVGHLQN

SEQ ID NO: 1072181 - protein, 9 aa, Homo Sapiens
VEKREDSGT

SEQ ID NO: 1072182 - protein, 9 aa, Homo Sapiens
VYSQRKKKN

SEQ ID NO: 1072183 - protein, 9 aa, Homo Sapiens
SSGKNCDVV

SEQ ID NO: 1072184 - protein, 9 aa, Homo Sapiens
LWSRMSNQF

SEQ ID NO: 1072185 - protein, 9 aa, Homo Sapiens
RAGHLKKAL

SEQ ID NO: 1072186 - protein, 9 aa, Homo Sapiens
QLQLFKLSH

SEQ ID NO: 1072187 - protein, 9 aa, Homo Sapiens
GGSWQLPAA

SEQ ID NO: 1072188 - protein, 9 aa, Homo Sapiens
VSRSLPEGE

SEQ ID NO: 1072189 - protein, 9 aa, Homo Sapiens
SGCKSLLGG

SEQ ID NO: 1072190 - protein, 9 aa, Homo Sapiens
LTCLQSESW

SEQ ID NO: 1072191 - protein, 9 aa, Homo Sapiens
PQSPIGPPG

SEQ ID NO: 1072192 - protein, 9 aa, Homo Sapiens
ARITHSPIV

SEQ ID NO: 1072193 - protein, 9 aa, Homo Sapiens
PRKSYSLER

SEQ ID NO: 1072194 - protein, 9 aa, Homo Sapiens
GLSPSQRLG

SEQ ID NO: 1072195 - protein, 9 aa, Homo Sapiens
LAVIKLACA

SEQ ID NO: 1072196 - protein, 9 aa, Homo Sapiens
AIGGTLHPY

SEQ ID NO: 1072197 - protein, 9 aa, Homo Sapiens
VQIPPIEKM

SEQ ID NO: 1072198 - protein, 9 aa, Homo Sapiens
TQRLEALRD

SEQ ID NO: 1072199 - protein, 9 aa, Homo Sapiens
IRTDPKINE

SEQ ID NO: 1072200 - protein, 9 aa, Homo Sapiens
KIKEDYFKK

SEQ ID NO: 1072201 - protein, 9 aa, Homo Sapiens
PLLGPRQVP

SEQ ID NO: 1072202 - protein, 9 aa, Homo Sapiens
LQTQSPGET

SEQ ID NO: 1072203 - protein, 9 aa, Homo Sapiens
GPFSIESVM

SEQ ID NO: 1072204 - protein, 9 aa, Homo Sapiens
GSLAANYGF

SEQ ID NO: 1072205 - protein, 9 aa, Homo Sapiens
EDYPASWRS

SEQ ID NO: 1072206 - protein, 9 aa, Homo Sapiens
SQRPMFSPI

SEQ ID NO: 1072207 - protein, 9 aa, Homo Sapiens
AIQHENVNV

SEQ ID NO: 1072208 - protein, 9 aa, Homo Sapiens
GCDHQLRST

SEQ ID NO: 1072209 - protein, 9 aa, Homo Sapiens
VPIASIACS

SEQ ID NO: 1072210 - protein, 9 aa, Homo Sapiens
FCALSTGEK

SEQ ID NO: 1072211 - protein, 9 aa, Homo Sapiens
FFAFKKNRL

SEQ ID NO: 1072212 - protein, 9 aa, Homo Sapiens
CSECRKAFF

SEQ ID NO: 1072213 - protein, 9 aa, Homo Sapiens
GVEWIANWL

SEQ ID NO: 1072214 - protein, 9 aa, Homo Sapiens
KKQLYFFGK

SEQ ID NO: 1072215 - protein, 9 aa, Homo Sapiens
VTNQFQENR

SEQ ID NO: 1072216 - protein, 9 aa, Homo Sapiens
HTIRIYIYM

SEQ ID NO: 1072217 - protein, 9 aa, Homo Sapiens
LTSLFSPNR

SEQ ID NO: 1072218 - protein, 9 aa, Homo Sapiens
AGRQQRIAV

SEQ ID NO: 1072219 - protein, 9 aa, Homo Sapiens
LGGPSLVSG

SEQ ID NO: 1072220 - protein, 9 aa, Homo Sapiens
WEERKESPD

SEQ ID NO: 1072221 - protein, 9 aa, Homo Sapiens
WVDPNQECS

SEQ ID NO: 1072222 - protein, 9 aa, Homo Sapiens
EGGKGEKEG

SEQ ID NO: 1072223 - protein, 9 aa, Homo Sapiens
EEKSQRLKV

SEQ ID NO: 1072224 - protein, 9 aa, Homo Sapiens
THSPIVSQV

SEQ ID NO: 1072225 - protein, 9 aa, Homo Sapiens
LIFFRFIGV

SEQ ID NO: 1072226 - protein, 9 aa, Homo Sapiens
VAVKIVSSK

SEQ ID NO: 1072227 - protein, 9 aa, Homo Sapiens
KVEVNISRK

SEQ ID NO: 1072228 - protein, 9 aa, Homo Sapiens
IIFLTMVAV

SEQ ID NO: 1072229 - protein, 9 aa, Homo Sapiens
KCNHSLVKK

SEQ ID NO: 1072230 - protein, 9 aa, Homo Sapiens
VALPKNVKL

SEQ ID NO: 1072231 - protein, 9 aa, Homo Sapiens
EELSRIHDP

SEQ ID NO: 1072232 - protein, 9 aa, Homo Sapiens
ISELRDNFL

SEQ ID NO: 1072233 - protein, 9 aa, Homo Sapiens
EILFYNVTD

SEQ ID NO: 1072234 - protein, 9 aa, Homo Sapiens
SPESVCSSV

SEQ ID NO: 1072235 - protein, 9 aa, Homo Sapiens
LQYSVNNEI

SEQ ID NO: 1072236 - protein, 9 aa, Homo Sapiens
CAKALGPSP

SEQ ID NO: 1072237 - protein, 9 aa, Homo Sapiens
IIIPEPKGK

SEQ ID NO: 1072238 - protein, 9 aa, Homo Sapiens
RLGHQRTSS

SEQ ID NO: 1072239 - protein, 9 aa, Homo Sapiens
YDSSASYKK

SEQ ID NO: 1072240 - protein, 9 aa, Homo Sapiens
RMLQVCQQE

SEQ ID NO: 1072241 - protein, 9 aa, Homo Sapiens
AKCLRFAPV

SEQ ID NO: 1072242 - protein, 9 aa, Homo Sapiens
KCRLLGKFS

SEQ ID NO: 1072243 - protein, 9 aa, Homo Sapiens
DPHPDKGTS

SEQ ID NO: 1072244 - protein, 9 aa, Homo Sapiens
KNTKEQRDL

SEQ ID NO: 1072245 - protein, 9 aa, Homo Sapiens
GQSLSVSPR

SEQ ID NO: 1072246 - protein, 9 aa, Homo Sapiens
TTVRSPGNV

SEQ ID NO: 1072247 - protein, 9 aa, Homo Sapiens
LLCCVAFSF

SEQ ID NO: 1072248 - protein, 9 aa, Homo Sapiens
LPKDHGTYT

SEQ ID NO: 1072249 - protein, 9 aa, Homo Sapiens
NPEVSFPRD

SEQ ID NO: 1072250 - protein, 9 aa, Homo Sapiens
FFYNGKKSV

SEQ ID NO: 1072251 - protein, 9 aa, Homo Sapiens
KQFFLQCDS

SEQ ID NO: 1072252 - protein, 9 aa, Homo Sapiens
IKCLKDEDL

SEQ ID NO: 1072253 - protein, 9 aa, Homo Sapiens
VDDEEDEEL

SEQ ID NO: 1072254 - protein, 9 aa, Homo Sapiens
LLKLARKII

SEQ ID NO: 1072255 - protein, 9 aa, Homo Sapiens
FERTRGSTA

SEQ ID NO: 1072256 - protein, 9 aa, Homo Sapiens
VAVSEIMPE

SEQ ID NO: 1072257 - protein, 9 aa, Homo Sapiens
LSAHSFVCS

SEQ ID NO: 1072258 - protein, 9 aa, Homo Sapiens
ITARKPLLR

SEQ ID NO: 1072259 - protein, 9 aa, Homo Sapiens
APPGAFSLE

SEQ ID NO: 1072260 - protein, 9 aa, Homo Sapiens
LRIGTVNCG

SEQ ID NO: 1072261 - protein, 9 aa, Homo Sapiens
LEAVLEAAG

SEQ ID NO: 1072262 - protein, 9 aa, Homo Sapiens
SAASQTYEC

SEQ ID NO: 1072263 - protein, 9 aa, Homo Sapiens
SRMSNQFLK

SEQ ID NO: 1072264 - protein, 9 aa, Homo Sapiens
KRHGILMSH

SEQ ID NO: 1072265 - protein, 9 aa, Homo Sapiens
QHVAQMEQK

SEQ ID NO: 1072266 - protein, 9 aa, Homo Sapiens
PSLVSGPAF

SEQ ID NO: 1072267 - protein, 9 aa, Homo Sapiens
SYTKNNLYV

SEQ ID NO: 1072268 - protein, 9 aa, Homo Sapiens
LLGNTSVEK

SEQ ID NO: 1072269 - protein, 9 aa, Homo Sapiens
PKINEGVLS

SEQ ID NO: 1072270 - protein, 9 aa, Homo Sapiens
NSSLSEVLR

SEQ ID NO: 1072271 - protein, 9 aa, Homo Sapiens
NIDGFEEII

SEQ ID NO: 1072272 - protein, 9 aa, Homo Sapiens
STTPLQNAP

SEQ ID NO: 1072273 - protein, 9 aa, Homo Sapiens
RVKGLQAYI

SEQ ID NO: 1072274 - protein, 9 aa, Homo Sapiens
SAEEEHLVK

SEQ ID NO: 1072275 - protein, 9 aa, Homo Sapiens
EEFSCADGQ

SEQ ID NO: 1072276 - protein, 9 aa, Homo Sapiens
RFYIQRNVI

SEQ ID NO: 1072277 - protein, 9 aa, Homo Sapiens
LKSLYLGVL

SEQ ID NO: 1072278 - protein, 9 aa, Homo Sapiens
CLNRVIIPS

SEQ ID NO: 1072279 - protein, 9 aa, Homo Sapiens
SDSKEGEGL

SEQ ID NO: 1072280 - protein, 9 aa, Homo Sapiens
SVNIERVKD

SEQ ID NO: 1072281 - protein, 9 aa, Homo Sapiens
VLVNYYIDP

SEQ ID NO: 1072282 - protein, 9 aa, Homo Sapiens
KRLRREPKS

SEQ ID NO: 1072283 - protein, 9 aa, Homo Sapiens
ASVSQESQG

SEQ ID NO: 1072284 - protein, 9 aa, Homo Sapiens
GPIPKDDFN

SEQ ID NO: 1072285 - protein, 9 aa, Homo Sapiens
VRSCMCWQL

SEQ ID NO: 1072286 - protein, 9 aa, Homo Sapiens
NYNLFSSAS

SEQ ID NO: 1072287 - protein, 9 aa, Homo Sapiens
HLCPGPPTA

SEQ ID NO: 1072288 - protein, 9 aa, Homo Sapiens
GYNFWIDAD

SEQ ID NO: 1072289 - protein, 9 aa, Homo Sapiens
LRNLFNTSP

SEQ ID NO: 1072290 - protein, 9 aa, Homo Sapiens
KERNCYEYV

SEQ ID NO: 1072291 - protein, 9 aa, Homo Sapiens
TSPAPTTVS

SEQ ID NO: 1072292 - protein, 9 aa, Homo Sapiens
NFAQSSSFS

SEQ ID NO: 1072293 - protein, 9 aa, Homo Sapiens
RPWHCRVEQ

SEQ ID NO: 1072294 - protein, 9 aa, Homo Sapiens
CKSYVITRA

SEQ ID NO: 1072295 - protein, 9 aa, Homo Sapiens
RVPSLDYLG

SEQ ID NO: 1072296 - protein, 9 aa, Homo Sapiens
RRQRSSQSE

SEQ ID NO: 1072297 - protein, 9 aa, Homo Sapiens
YIKGVDHIT

SEQ ID NO: 1072298 - protein, 9 aa, Homo Sapiens
SFPRDMIDL

SEQ ID NO: 1072299 - protein, 9 aa, Homo Sapiens
GYLARMNLL

SEQ ID NO: 1072300 - protein, 9 aa, Homo Sapiens
PYTLPPPPT

SEQ ID NO: 1072301 - protein, 9 aa, Homo Sapiens
QILKMIRQG

SEQ ID NO: 1072302 - protein, 9 aa, Homo Sapiens
QLSLFLLFL

SEQ ID NO: 1072303 - protein, 9 aa, Homo Sapiens
ARMNLLVAI

SEQ ID NO: 1072304 - protein, 9 aa, Homo Sapiens
IKSHLFFTP

SEQ ID NO: 1072305 - protein, 9 aa, Homo Sapiens
REALKRGKE

SEQ ID NO: 1072306 - protein, 9 aa, Homo Sapiens
LQCDEISMN

SEQ ID NO: 1072307 - protein, 9 aa, Homo Sapiens
STMADEIRF

SEQ ID NO: 1072308 - protein, 9 aa, Homo Sapiens
QLVQVVHDN

SEQ ID NO: 1072309 - protein, 9 aa, Homo Sapiens
VEVNISRKR

SEQ ID NO: 1072310 - protein, 9 aa, Homo Sapiens
LTQLHVKTW

SEQ ID NO: 1072311 - protein, 9 aa, Homo Sapiens
HKRIYTGEK

SEQ ID NO: 1072312 - protein, 9 aa, Homo Sapiens
SDDFFGQTI

SEQ ID NO: 1072313 - protein, 9 aa, Homo Sapiens
STNREHDLL

SEQ ID NO: 1072314 - protein, 9 aa, Homo Sapiens
KIPDAKSDD

SEQ ID NO: 1072315 - protein, 9 aa, Homo Sapiens
PRPIVPDPS

SEQ ID NO: 1072316 - protein, 9 aa, Homo Sapiens
GLKSMVSVA

SEQ ID NO: 1072317 - protein, 9 aa, Homo Sapiens
ILFTHVLPQ

SEQ ID NO: 1072318 - protein, 9 aa, Homo Sapiens
LLSPGTADF

SEQ ID NO: 1072319 - protein, 9 aa, Homo Sapiens
SLKKRMLIP

SEQ ID NO: 1072320 - protein, 9 aa, Homo Sapiens
KKNEKPAVK

SEQ ID NO: 1072321 - protein, 9 aa, Homo Sapiens
RRLIFTIGP

SEQ ID NO: 1072322 - protein, 9 aa, Homo Sapiens
GHFGEKLAI

SEQ ID NO: 1072323 - protein, 9 aa, Homo Sapiens
VESLTLVLP

SEQ ID NO: 1072324 - protein, 9 aa, Homo Sapiens
PIVSQVTER

SEQ ID NO: 1072325 - protein, 9 aa, Homo Sapiens
GPLTCLQSE

SEQ ID NO: 1072326 - protein, 9 aa, Homo Sapiens
HERMSSNRP

SEQ ID NO: 1072327 - protein, 9 aa, Homo Sapiens
LKEELPLKE

SEQ ID NO: 1072328 - protein, 9 aa, Homo Sapiens
PGSSTEEAQ

SEQ ID NO: 1072329 - protein, 9 aa, Homo Sapiens
SLKPHFYLY

SEQ ID NO: 1072330 - protein, 9 aa, Homo Sapiens
GDLSRMLQE

SEQ ID NO: 1072331 - protein, 9 aa, Homo Sapiens
AQPRPRGGS

SEQ ID NO: 1072332 - protein, 9 aa, Homo Sapiens
DGPIGIPFS

SEQ ID NO: 1072333 - protein, 9 aa, Homo Sapiens
CEKPYLRIS

SEQ ID NO: 1072334 - protein, 9 aa, Homo Sapiens
KRIYTGEKP

SEQ ID NO: 1072335 - protein, 9 aa, Homo Sapiens
ENEAAKNEV

SEQ ID NO: 1072336 - protein, 9 aa, Homo Sapiens
ASTSIPRRI

SEQ ID NO: 1072337 - protein, 9 aa, Homo Sapiens
CHTIRIYIY

SEQ ID NO: 1072338 - protein, 9 aa, Homo Sapiens
GYSWLITKE

SEQ ID NO: 1072339 - protein, 9 aa, Homo Sapiens
NGLRRFFRI

SEQ ID NO: 1072340 - protein, 9 aa, Homo Sapiens
LKVTYAADE

SEQ ID NO: 1072341 - protein, 9 aa, Homo Sapiens
PGIPGIEGP

SEQ ID NO: 1072342 - protein, 9 aa, Homo Sapiens
PESFRVPYN

SEQ ID NO: 1072343 - protein, 9 aa, Homo Sapiens
SFLWAGPVN

SEQ ID NO: 1072344 - protein, 9 aa, Homo Sapiens
VIPKLLVNL

SEQ ID NO: 1072345 - protein, 9 aa, Homo Sapiens
QSGKGQNTL

SEQ ID NO: 1072346 - protein, 9 aa, Homo Sapiens
LCCVQEALE

SEQ ID NO: 1072347 - protein, 9 aa, Homo Sapiens
MRINKQNAL

SEQ ID NO: 1072348 - protein, 9 aa, Homo Sapiens
QKKYLEYRQ

SEQ ID NO: 1072349 - protein, 9 aa, Homo Sapiens
KIENAMKTE

SEQ ID NO: 1072350 - protein, 9 aa, Homo Sapiens
THQFTSSGE

SEQ ID NO: 1072351 - protein, 9 aa, Homo Sapiens
ERCRHLPRP

SEQ ID NO: 1072352 - protein, 9 aa, Homo Sapiens
AAGKNCITI

SEQ ID NO: 1072353 - protein, 9 aa, Homo Sapiens
SGSCLHSLP

SEQ ID NO: 1072354 - protein, 9 aa, Homo Sapiens
ISRKRKGNC

SEQ ID NO: 1072355 - protein, 9 aa, Homo Sapiens
LTKAALSAH

SEQ ID NO: 1072356 - protein, 9 aa, Homo Sapiens
SFEKEKELV

SEQ ID NO: 1072357 - protein, 9 aa, Homo Sapiens
YLDPPQFVE

SEQ ID NO: 1072358 - protein, 9 aa, Homo Sapiens
SRLWAHAFL

SEQ ID NO: 1072359 - protein, 9 aa, Homo Sapiens
GCSSSGALR

SEQ ID NO: 1072360 - protein, 9 aa, Homo Sapiens
PNFQVLDNP

SEQ ID NO: 1072361 - protein, 9 aa, Homo Sapiens
PPMISWIGV

SEQ ID NO: 1072362 - protein, 9 aa, Homo Sapiens
YKWMRRSVA

SEQ ID NO: 1072363 - protein, 9 aa, Homo Sapiens
FEVAVNESS

SEQ ID NO: 1072364 - protein, 9 aa, Homo Sapiens
SMKQVKIFP

SEQ ID NO: 1072365 - protein, 9 aa, Homo Sapiens
STSWDQEIL

SEQ ID NO: 1072366 - protein, 9 aa, Homo Sapiens
GCALDKQDK

SEQ ID NO: 1072367 - protein, 9 aa, Homo Sapiens
TVPEHLDNI

SEQ ID NO: 1072368 - protein, 9 aa, Homo Sapiens
LCVKVDRTL

SEQ ID NO: 1072369 - protein, 9 aa, Homo Sapiens
RKGAKCLRF

SEQ ID NO: 1072370 - protein, 9 aa, Homo Sapiens
LENGYDFLE

SEQ ID NO: 1072371 - protein, 9 aa, Homo Sapiens
EEIEEGVRQ

SEQ ID NO: 1072372 - protein, 9 aa, Homo Sapiens
GLHSACYYG

SEQ ID NO: 1072373 - protein, 9 aa, Homo Sapiens
CHLHRHFVN

SEQ ID NO: 1072374 - protein, 9 aa, Homo Sapiens
DQDNHVTII

SEQ ID NO: 1072375 - protein, 9 aa, Homo Sapiens
SDQPSSDES

SEQ ID NO: 1072376 - protein, 9 aa, Homo Sapiens
LVKVVKNQK

SEQ ID NO: 1072377 - protein, 9 aa, Homo Sapiens
LRTALPTFG

SEQ ID NO: 1072378 - protein, 9 aa, Homo Sapiens
DKVKALLEE

SEQ ID NO: 1072379 - protein, 9 aa, Homo Sapiens
EQDGCDPSG

SEQ ID NO: 1072380 - protein, 9 aa, Homo Sapiens
LVTVVTGGA

SEQ ID NO: 1072381 - protein, 9 aa, Homo Sapiens
PVMASAPIL

SEQ ID NO: 1072382 - protein, 9 aa, Homo Sapiens
LLEVFLALV

SEQ ID NO: 1072383 - protein, 9 aa, Homo Sapiens
YTEDLLLEQ

SEQ ID NO: 1072384 - protein, 9 aa, Homo Sapiens
YLVNTATEY

SEQ ID NO: 1072385 - protein, 9 aa, Homo Sapiens
YTFSFIARV

SEQ ID NO: 1072386 - protein, 9 aa, Homo Sapiens
FYLDPPQFV

SEQ ID NO: 1072387 - protein, 9 aa, Homo Sapiens
YDSIEPHNA

SEQ ID NO: 1072388 - protein, 9 aa, Homo Sapiens
LNGCRAFIL

SEQ ID NO: 1072389 - protein, 9 aa, Homo Sapiens
LKRGKEVPA

SEQ ID NO: 1072390 - protein, 9 aa, Homo Sapiens
FSFFAFKKN

SEQ ID NO: 1072391 - protein, 9 aa, Homo Sapiens
SEVEKPLSQ

SEQ ID NO: 1072392 - protein, 9 aa, Homo Sapiens
RNGPGRVNE

SEQ ID NO: 1072393 - protein, 9 aa, Homo Sapiens
SKQPATLLT

SEQ ID NO: 1072394 - protein, 9 aa, Homo Sapiens
YTGTNPLYV

SEQ ID NO: 1072395 - protein, 9 aa, Homo Sapiens
LSSRPTLRT

SEQ ID NO: 1072396 - protein, 9 aa, Homo Sapiens
EKSDEEEKP

SEQ ID NO: 1072397 - protein, 9 aa, Homo Sapiens
LSNMLIKIL

SEQ ID NO: 1072398 - protein, 9 aa, Homo Sapiens
VTPVWWKDV

SEQ ID NO: 1072399 - protein, 9 aa, Homo Sapiens
RRYERTLSD

SEQ ID NO: 1072400 - protein, 9 aa, Homo Sapiens
LEMYVQGNA

SEQ ID NO: 1072401 - protein, 9 aa, Homo Sapiens
REHDLLSHE

SEQ ID NO: 1072402 - protein, 9 aa, Homo Sapiens
SGAIGPKGD

SEQ ID NO: 1072403 - protein, 9 aa, Homo Sapiens
NIRLVWQLA

SEQ ID NO: 1072404 - protein, 9 aa, Homo Sapiens
GDNLSQYRG

SEQ ID NO: 1072405 - protein, 9 aa, Homo Sapiens
SAPSWPLYA

SEQ ID NO: 1072406 - protein, 9 aa, Homo Sapiens
SVNNEITWH

SEQ ID NO: 1072407 - protein, 9 aa, Homo Sapiens
PDGALRSLE

SEQ ID NO: 1072408 - protein, 9 aa, Homo Sapiens
TYAYKGNDS

SEQ ID NO: 1072409 - protein, 9 aa, Homo Sapiens
GVLAPAAPP

SEQ ID NO: 1072410 - protein, 9 aa, Homo Sapiens
QMQLQNEAI

SEQ ID NO: 1072411 - protein, 8 aa, Homo Sapiens
KVNRETKR

SEQ ID NO: 1072412 - protein, 9 aa, Homo Sapiens
HCRVEQGVS

SEQ ID NO: 1072413 - protein, 9 aa, Homo Sapiens
GPPAPLIFP

SEQ ID NO: 1072414 - protein, 9 aa, Homo Sapiens
QSEPPVIEE

SEQ ID NO: 1072415 - protein, 9 aa, Homo Sapiens
GTIDMSVLP

SEQ ID NO: 1072416 - protein, 9 aa, Homo Sapiens
LKILQPGHT

SEQ ID NO: 1072417 - protein, 9 aa, Homo Sapiens
HSSLLSPVF

SEQ ID NO: 1072418 - protein, 9 aa, Homo Sapiens
RCAAQFFFF

SEQ ID NO: 1072419 - protein, 9 aa, Homo Sapiens
SRVTRRQRS

SEQ ID NO: 1072420 - protein, 9 aa, Homo Sapiens
QKDNRNTGI

SEQ ID NO: 1072421 - protein, 9 aa, Homo Sapiens
RASSRSPAF

SEQ ID NO: 1072422 - protein, 9 aa, Homo Sapiens
FMAAAVAAA

SEQ ID NO: 1072423 - protein, 9 aa, Homo Sapiens
YDIQAAMED

SEQ ID NO: 1072424 - protein, 9 aa, Homo Sapiens
FPDEKVCWT

SEQ ID NO: 1072425 - protein, 9 aa, Homo Sapiens
GLEGAMEMR

SEQ ID NO: 1072426 - protein, 9 aa, Homo Sapiens
EKEKETTRT

SEQ ID NO: 1072427 - protein, 9 aa, Homo Sapiens
RVIRVPDHT

SEQ ID NO: 1072428 - protein, 9 aa, Homo Sapiens
RGMVEIEFF

SEQ ID NO: 1072429 - protein, 9 aa, Homo Sapiens
PIVGPFYAV

SEQ ID NO: 1072430 - protein, 9 aa, Homo Sapiens
LNKEIPETT

SEQ ID NO: 1072431 - protein, 9 aa, Homo Sapiens
FQGISEIQS

SEQ ID NO: 1072432 - protein, 9 aa, Homo Sapiens
NNRFSSEKI

SEQ ID NO: 1072433 - protein, 9 aa, Homo Sapiens
SFRLTMALS

SEQ ID NO: 1072434 - protein, 9 aa, Homo Sapiens
IAEKQREKP

SEQ ID NO: 1072435 - protein, 9 aa, Homo Sapiens
AGVDGLPLQ

SEQ ID NO: 1072436 - protein, 9 aa, Homo Sapiens
SLVLLLLFL

SEQ ID NO: 1072437 - protein, 9 aa, Homo Sapiens
QAEAESWYR

SEQ ID NO: 1072438 - protein, 9 aa, Homo Sapiens
IPSSHFVSG

SEQ ID NO: 1072439 - protein, 9 aa, Homo Sapiens
VWYLHNCRI

SEQ ID NO: 1072440 - protein, 9 aa, Homo Sapiens
EKSNGYRDH

SEQ ID NO: 1072441 - protein, 9 aa, Homo Sapiens
DPLFPRTTQ

SEQ ID NO: 1072442 - protein, 9 aa, Homo Sapiens
SATLNISKQ

SEQ ID NO: 1072443 - protein, 9 aa, Homo Sapiens
KTEGSVLLQ

SEQ ID NO: 1072444 - protein, 9 aa, Homo Sapiens
AVKKLKRLT

SEQ ID NO: 1072445 - protein, 9 aa, Homo Sapiens
DPLLGPRQV

SEQ ID NO: 1072446 - protein, 9 aa, Homo Sapiens
AEGQDRQVP

SEQ ID NO: 1072447 - protein, 9 aa, Homo Sapiens
SPSLAHPQL

SEQ ID NO: 1072448 - protein, 9 aa, Homo Sapiens
PPSPQAPEG

SEQ ID NO: 1072449 - protein, 9 aa, Homo Sapiens
TSSPGAPNL

SEQ ID NO: 1072450 - protein, 9 aa, Homo Sapiens
HFILFQPVA

SEQ ID NO: 1072451 - protein, 9 aa, Homo Sapiens
ALSCMNQKH

SEQ ID NO: 1072452 - protein, 9 aa, Homo Sapiens
NLPGYFRCQ

SEQ ID NO: 1072453 - protein, 9 aa, Homo Sapiens
LKNFLEEFR

SEQ ID NO: 1072454 - protein, 9 aa, Homo Sapiens
SFNDLDFLK

SEQ ID NO: 1072455 - protein, 9 aa, Homo Sapiens
CGFQVARPQ

SEQ ID NO: 1072456 - protein, 9 aa, Homo Sapiens
YILHKEEEA

SEQ ID NO: 1072457 - protein, 9 aa, Homo Sapiens
TDSNKENDT

SEQ ID NO: 1072458 - protein, 9 aa, Homo Sapiens
QNGGIPQLL

SEQ ID NO: 1072459 - protein, 9 aa, Homo Sapiens
YHISQPIRL

SEQ ID NO: 1072460 - protein, 9 aa, Homo Sapiens
KGIRVFGIA

SEQ ID NO: 1072461 - protein, 9 aa, Homo Sapiens
YKIIRHKDV

SEQ ID NO: 1072462 - protein, 9 aa, Homo Sapiens
AILWLILFT

SEQ ID NO: 1072463 - protein, 9 aa, Homo Sapiens
AQVTYLLLP

SEQ ID NO: 1072464 - protein, 9 aa, Homo Sapiens
GTNAQVTYL

SEQ ID NO: 1072465 - protein, 9 aa, Homo Sapiens
LRAPTAAEQ

SEQ ID NO: 1072466 - protein, 9 aa, Homo Sapiens
MLRLAILGV

SEQ ID NO: 1072467 - protein, 9 aa, Homo Sapiens
PSFLRALHA

SEQ ID NO: 1072468 - protein, 9 aa, Homo Sapiens
PEQNVQKQK

SEQ ID NO: 1072469 - protein, 9 aa, Homo Sapiens
SPMPRESCE

SEQ ID NO: 1072470 - protein, 9 aa, Homo Sapiens
NKEGAAGVW

SEQ ID NO: 1072471 - protein, 9 aa, Homo Sapiens
QEEEQEKEG

SEQ ID NO: 1072472 - protein, 9 aa, Homo Sapiens
GNGRLEENE

SEQ ID NO: 1072473 - protein, 9 aa, Homo Sapiens
GGNHQNFTV

SEQ ID NO: 1072474 - protein, 9 aa, Homo Sapiens
LSAQNKGWD

SEQ ID NO: 1072475 - protein, 9 aa, Homo Sapiens
KHDKEDYPA

SEQ ID NO: 1072476 - protein, 9 aa, Homo Sapiens
LFSTGWSSL

SEQ ID NO: 1072477 - protein, 9 aa, Homo Sapiens
KDLSLYFVM

SEQ ID NO: 1072478 - protein, 9 aa, Homo Sapiens
STGWSSLDV

SEQ ID NO: 1072479 - protein, 9 aa, Homo Sapiens
LSLLVDDEE

SEQ ID NO: 1072480 - protein, 9 aa, Homo Sapiens
YFKKHQQEQ

SEQ ID NO: 1072481 - protein, 9 aa, Homo Sapiens
KKSVNKMLF

SEQ ID NO: 1072482 - protein, 9 aa, Homo Sapiens
PHSTTRNTT

SEQ ID NO: 1072483 - protein, 9 aa, Homo Sapiens
LSLFFLGPS

SEQ ID NO: 1072484 - protein, 9 aa, Homo Sapiens
DKFISVFYR

SEQ ID NO: 1072485 - protein, 9 aa, Homo Sapiens
MNRLSHPNN

SEQ ID NO: 1072486 - protein, 9 aa, Homo Sapiens
WRRPAFPGE

SEQ ID NO: 1072487 - protein, 9 aa, Homo Sapiens
LDWVMLVRG

SEQ ID NO: 1072488 - protein, 9 aa, Homo Sapiens
KGNDSIADS

SEQ ID NO: 1072489 - protein, 9 aa, Homo Sapiens
APLAGPCAP

SEQ ID NO: 1072490 - protein, 9 aa, Homo Sapiens
EGQDRQVPE

SEQ ID NO: 1072491 - protein, 9 aa, Homo Sapiens
GHQRTSSGG

SEQ ID NO: 1072492 - protein, 9 aa, Homo Sapiens
STNEPTDII

SEQ ID NO: 1072493 - protein, 9 aa, Homo Sapiens
ILRIVQDIF

SEQ ID NO: 1072494 - protein, 9 aa, Homo Sapiens
DGYSVRMNY

SEQ ID NO: 1072495 - protein, 9 aa, Homo Sapiens
LVSLPTKKE

SEQ ID NO: 1072496 - protein, 9 aa, Homo Sapiens
AFQSLWGNP

SEQ ID NO: 1072497 - protein, 9 aa, Homo Sapiens
AADPLESQA

SEQ ID NO: 1072498 - protein, 9 aa, Homo Sapiens
NGPITYSSD

SEQ ID NO: 1072499 - protein, 9 aa, Homo Sapiens
VGGSRGPPS

SEQ ID NO: 1072500 - protein, 9 aa, Homo Sapiens
TSQSCQTPD

SEQ ID NO: 1072501 - protein, 9 aa, Homo Sapiens
FRTYRAADG

SEQ ID NO: 1072502 - protein, 9 aa, Homo Sapiens
LLFHNFPLT

SEQ ID NO: 1072503 - protein, 9 aa, Homo Sapiens
TSNPPGSST

SEQ ID NO: 1072504 - protein, 9 aa, Homo Sapiens
ILGGSQVKK

SEQ ID NO: 1072505 - protein, 9 aa, Homo Sapiens
RRQMRKEVL

SEQ ID NO: 1072506 - protein, 9 aa, Homo Sapiens
LNSQSTSYL

SEQ ID NO: 1072507 - protein, 9 aa, Homo Sapiens
KLANAHNVI

SEQ ID NO: 1072508 - protein, 9 aa, Homo Sapiens
KQRIIRGSD

SEQ ID NO: 1072509 - protein, 9 aa, Homo Sapiens
VGYHKPHIS

SEQ ID NO: 1072510 - protein, 9 aa, Homo Sapiens
LSPGSLKRR

SEQ ID NO: 1072511 - protein, 9 aa, Homo Sapiens
TLVLPVDPH

SEQ ID NO: 1072512 - protein, 9 aa, Homo Sapiens
LEERGTFLV

SEQ ID NO: 1072513 - protein, 9 aa, Homo Sapiens
PTLLDSSHP

SEQ ID NO: 1072514 - protein, 9 aa, Homo Sapiens
GLLEVFLAL

SEQ ID NO: 1072515 - protein, 9 aa, Homo Sapiens
AVLEAAGEG

SEQ ID NO: 1072516 - protein, 9 aa, Homo Sapiens
RGFREIHHF

SEQ ID NO: 1072517 - protein, 9 aa, Homo Sapiens
LTVKKFLDL

SEQ ID NO: 1072518 - protein, 9 aa, Homo Sapiens
VVPCVLFVN

SEQ ID NO: 1072519 - protein, 9 aa, Homo Sapiens
YAVLKLEMN

SEQ ID NO: 1072520 - protein, 9 aa, Homo Sapiens
SPALSPSSV

SEQ ID NO: 1072521 - protein, 9 aa, Homo Sapiens
RPIVGPFYA

SEQ ID NO: 1072522 - protein, 9 aa, Homo Sapiens
DSNKENDTD

SEQ ID NO: 1072523 - protein, 9 aa, Homo Sapiens
VFYRALTPM

SEQ ID NO: 1072524 - protein, 9 aa, Homo Sapiens
VGRTASVRG

SEQ ID NO: 1072525 - protein, 9 aa, Homo Sapiens
DDFEIGNFV

SEQ ID NO: 1072526 - protein, 9 aa, Homo Sapiens
NHINWYIKG

SEQ ID NO: 1072527 - protein, 9 aa, Homo Sapiens
KLYVQIPPI

SEQ ID NO: 1072528 - protein, 9 aa, Homo Sapiens
PHRALSSLR

SEQ ID NO: 1072529 - protein, 9 aa, Homo Sapiens
GEIAGVNWK

SEQ ID NO: 1072530 - protein, 9 aa, Homo Sapiens
PVTLSIEDF

SEQ ID NO: 1072531 - protein, 9 aa, Homo Sapiens
EACPRGYKS

SEQ ID NO: 1072532 - protein, 9 aa, Homo Sapiens
PGEYNQHTK

SEQ ID NO: 1072533 - protein, 9 aa, Homo Sapiens
ADQFFTSPP

SEQ ID NO: 1072534 - protein, 9 aa, Homo Sapiens
SRYTEICLV

SEQ ID NO: 1072535 - protein, 9 aa, Homo Sapiens
QLSAACFVP

SEQ ID NO: 1072536 - protein, 9 aa, Homo Sapiens
DSVQKELII

SEQ ID NO: 1072537 - protein, 9 aa, Homo Sapiens
VLFSTGWSS

SEQ ID NO: 1072538 - protein, 9 aa, Homo Sapiens
LKSSATYEK

SEQ ID NO: 1072539 - protein, 9 aa, Homo Sapiens
NGYDFLEVT

SEQ ID NO: 1072540 - protein, 9 aa, Homo Sapiens
KVCGKTFTS

SEQ ID NO: 1072541 - protein, 9 aa, Homo Sapiens
HISFRYPKE

SEQ ID NO: 1072542 - protein, 9 aa, Homo Sapiens
RSRLWAHAF

SEQ ID NO: 1072543 - protein, 9 aa, Homo Sapiens
FFFTSPAVK

SEQ ID NO: 1072544 - protein, 9 aa, Homo Sapiens
PNNLRFMGV

SEQ ID NO: 1072545 - protein, 9 aa, Homo Sapiens
SFPGSSEYP

SEQ ID NO: 1072546 - protein, 9 aa, Homo Sapiens
PAVCFVIPL

SEQ ID NO: 1072547 - protein, 9 aa, Homo Sapiens
SWDQEILLP

SEQ ID NO: 1072548 - protein, 9 aa, Homo Sapiens
PADSPFEGF

SEQ ID NO: 1072549 - protein, 9 aa, Homo Sapiens
ARFTPYKWY

SEQ ID NO: 1072550 - protein, 9 aa, Homo Sapiens
RLSPVQCLG

SEQ ID NO: 1072551 - protein, 9 aa, Homo Sapiens
SEKNVVYER

SEQ ID NO: 1072552 - protein, 9 aa, Homo Sapiens
FASSLFQTL

SEQ ID NO: 1072553 - protein, 9 aa, Homo Sapiens
YRILEEPFR

SEQ ID NO: 1072554 - protein, 9 aa, Homo Sapiens
TDLAKTAPP

SEQ ID NO: 1072555 - protein, 9 aa, Homo Sapiens
FPGVTAFFC

SEQ ID NO: 1072556 - protein, 9 aa, Homo Sapiens
ESKGVEAEQ

SEQ ID NO: 1072557 - protein, 9 aa, Homo Sapiens
ATSGRSLPF

SEQ ID NO: 1072558 - protein, 9 aa, Homo Sapiens
ASFSSELFC

SEQ ID NO: 1072559 - protein, 9 aa, Homo Sapiens
HEHVQSFSE

SEQ ID NO: 1072560 - protein, 9 aa, Homo Sapiens
EPVSYKGVT

SEQ ID NO: 1072561 - protein, 9 aa, Homo Sapiens
LILVLKYIF

SEQ ID NO: 1072562 - protein, 9 aa, Homo Sapiens
ERVRRSPAF

SEQ ID NO: 1072563 - protein, 9 aa, Homo Sapiens
PEPAVESSL

SEQ ID NO: 1072564 - protein, 9 aa, Homo Sapiens
KIPNNTRTP

SEQ ID NO: 1072565 - protein, 9 aa, Homo Sapiens
AKELLAGWQ

SEQ ID NO: 1072566 - protein, 9 aa, Homo Sapiens
GLQYWTVSQ

SEQ ID NO: 1072567 - protein, 9 aa, Homo Sapiens
QEQIKQPTP

SEQ ID NO: 1072568 - protein, 9 aa, Homo Sapiens
WLNNQENTS

SEQ ID NO: 1072569 - protein, 9 aa, Homo Sapiens
QFLLGSRRG

SEQ ID NO: 1072570 - protein, 9 aa, Homo Sapiens
QSHHCAPAR

SEQ ID NO: 1072571 - protein, 9 aa, Homo Sapiens
RRSKSSADL

SEQ ID NO: 1072572 - protein, 9 aa, Homo Sapiens
DFVSSHSPL

SEQ ID NO: 1072573 - protein, 9 aa, Homo Sapiens
VKRKDAKHL

SEQ ID NO: 1072574 - protein, 9 aa, Homo Sapiens
SIFFQSCMA

SEQ ID NO: 1072575 - protein, 9 aa, Homo Sapiens
SKPRFLQEL

SEQ ID NO: 1072576 - protein, 9 aa, Homo Sapiens
CEAQDALLS

SEQ ID NO: 1072577 - protein, 9 aa, Homo Sapiens
EDQSSFNIE

SEQ ID NO: 1072578 - protein, 9 aa, Homo Sapiens
SPSLHIIVA

SEQ ID NO: 1072579 - protein, 9 aa, Homo Sapiens
EVWFAARSG

SEQ ID NO: 1072580 - protein, 9 aa, Homo Sapiens
LLVAFLLSR

SEQ ID NO: 1072581 - protein, 9 aa, Homo Sapiens
MGDPAQSPA

SEQ ID NO: 1072582 - protein, 9 aa, Homo Sapiens
EPPPRRVGP

SEQ ID NO: 1072583 - protein, 9 aa, Homo Sapiens
YRALTPMLN

SEQ ID NO: 1072584 - protein, 9 aa, Homo Sapiens
VLLLNGRPT

SEQ ID NO: 1072585 - protein, 9 aa, Homo Sapiens
QCHRPKYQS

SEQ ID NO: 1072586 - protein, 9 aa, Homo Sapiens
EDPLSGFGL

SEQ ID NO: 1072587 - protein, 9 aa, Homo Sapiens
VRCRRYERT

SEQ ID NO: 1072588 - protein, 9 aa, Homo Sapiens
LTPLSALLF

SEQ ID NO: 1072589 - protein, 9 aa, Homo Sapiens
SDLFGNHSL

SEQ ID NO: 1072590 - protein, 9 aa, Homo Sapiens
NSPSNMSPD

SEQ ID NO: 1072591 - protein, 9 aa, Homo Sapiens
IEGPRVIFI

SEQ ID NO: 1072592 - protein, 9 aa, Homo Sapiens
TFSDVVAIA

SEQ ID NO: 1072593 - protein, 9 aa, Homo Sapiens
DERLCYNNT

SEQ ID NO: 1072594 - protein, 9 aa, Homo Sapiens
SKFQHCGGP

SEQ ID NO: 1072595 - protein, 9 aa, Homo Sapiens
ALPKEDRLE

SEQ ID NO: 1072596 - protein, 9 aa, Homo Sapiens
VRLLTYLSG

SEQ ID NO: 1072597 - protein, 9 aa, Homo Sapiens
PATRVRPEA

SEQ ID NO: 1072598 - protein, 9 aa, Homo Sapiens
TILGSMALI

SEQ ID NO: 1072599 - protein, 9 aa, Homo Sapiens
HIGLFLFGF

SEQ ID NO: 1072600 - protein, 9 aa, Homo Sapiens
ARTAAGRPL

SEQ ID NO: 1072601 - protein, 9 aa, Homo Sapiens
NSEDDMGTD

SEQ ID NO: 1072602 - protein, 9 aa, Homo Sapiens
ILCFLAYDI

SEQ ID NO: 1072603 - protein, 9 aa, Homo Sapiens
GGRGSSSSS

SEQ ID NO: 1072604 - protein, 9 aa, Homo Sapiens
IPLLCWYQT

SEQ ID NO: 1072605 - protein, 9 aa, Homo Sapiens
KLNLELHTL

SEQ ID NO: 1072606 - protein, 9 aa, Homo Sapiens
SPSAHGAVT

SEQ ID NO: 1072607 - protein, 9 aa, Homo Sapiens
LSQMKKIVR

SEQ ID NO: 1072608 - protein, 9 aa, Homo Sapiens
SHYTEDLLL

SEQ ID NO: 1072609 - protein, 9 aa, Homo Sapiens
KYLLLIGAQ

SEQ ID NO: 1072610 - protein, 9 aa, Homo Sapiens
ISLKPHFYL

SEQ ID NO: 1072611 - protein, 9 aa, Homo Sapiens
QWFLHRKRH

SEQ ID NO: 1072612 - protein, 9 aa, Homo Sapiens
KAPMFFWPR

SEQ ID NO: 1072613 - protein, 9 aa, Homo Sapiens
RNRTATNMK

SEQ ID NO: 1072614 - protein, 9 aa, Homo Sapiens
NEKFQLPEQ

SEQ ID NO: 1072615 - protein, 9 aa, Homo Sapiens
LTQDLVQKK

SEQ ID NO: 1072616 - protein, 9 aa, Homo Sapiens
RTLKKPQEP

SEQ ID NO: 1072617 - protein, 9 aa, Homo Sapiens
KAFNISSML

SEQ ID NO: 1072618 - protein, 9 aa, Homo Sapiens
SPIVSQVTE

SEQ ID NO: 1072619 - protein, 9 aa, Homo Sapiens
KKKITDSEL

SEQ ID NO: 1072620 - protein, 9 aa, Homo Sapiens
DARPASAPG

SEQ ID NO: 1072621 - protein, 9 aa, Homo Sapiens
KVVYRCWEE

SEQ ID NO: 1072622 - protein, 9 aa, Homo Sapiens
RHSYHSSSD

SEQ ID NO: 1072623 - protein, 9 aa, Homo Sapiens
AGVKFSCSR

SEQ ID NO: 1072624 - protein, 9 aa, Homo Sapiens
ALLAKRRKM

SEQ ID NO: 1072625 - protein, 9 aa, Homo Sapiens
SPSNSFILS

SEQ ID NO: 1072626 - protein, 9 aa, Homo Sapiens
EARLNKEIP

SEQ ID NO: 1072627 - protein, 9 aa, Homo Sapiens
VLSATFRGV

SEQ ID NO: 1072628 - protein, 9 aa, Homo Sapiens
FGGHTISPS

SEQ ID NO: 1072629 - protein, 9 aa, Homo Sapiens
EVFPRNPPH

SEQ ID NO: 1072630 - protein, 9 aa, Homo Sapiens
WTAHLEMYV

SEQ ID NO: 1072631 - protein, 9 aa, Homo Sapiens
FQNLQTEGV

SEQ ID NO: 1072632 - protein, 9 aa, Homo Sapiens
PGTEKSTEE

SEQ ID NO: 1072633 - protein, 9 aa, Homo Sapiens
VVDCAGIDL

SEQ ID NO: 1072634 - protein, 9 aa, Homo Sapiens
QSSSFSAHW

SEQ ID NO: 1072635 - protein, 9 aa, Homo Sapiens
GAMEMRQIY

SEQ ID NO: 1072636 - protein, 9 aa, Homo Sapiens
SILLGPGAA

SEQ ID NO: 1072637 - protein, 9 aa, Homo Sapiens
HPDKGTSFD

SEQ ID NO: 1072638 - protein, 9 aa, Homo Sapiens
FSCEILAVI

SEQ ID NO: 1072639 - protein, 9 aa, Homo Sapiens
SLPTKKEES

SEQ ID NO: 1072640 - protein, 9 aa, Homo Sapiens
AQKVSRSLP

SEQ ID NO: 1072641 - protein, 9 aa, Homo Sapiens
HPVVLSTAE

SEQ ID NO: 1072642 - protein, 9 aa, Homo Sapiens
KGVGDNLAE

SEQ ID NO: 1072643 - protein, 9 aa, Homo Sapiens
VSSAWLFPV

SEQ ID NO: 1072644 - protein, 9 aa, Homo Sapiens
EGPVDGSDK

SEQ ID NO: 1072645 - protein, 9 aa, Homo Sapiens
LQVTAGRPG

SEQ ID NO: 1072646 - protein, 9 aa, Homo Sapiens
QGDGLLPAE

SEQ ID NO: 1072647 - protein, 9 aa, Homo Sapiens
ASRLPRGCL

SEQ ID NO: 1072648 - protein, 9 aa, Homo Sapiens
FRTPSGEVF

SEQ ID NO: 1072649 - protein, 9 aa, Homo Sapiens
NNGEPPRSA

SEQ ID NO: 1072650 - protein, 9 aa, Homo Sapiens
TSWDQEILL

SEQ ID NO: 1072651 - protein, 9 aa, Homo Sapiens
KKHGTQNKQ

SEQ ID NO: 1072652 - protein, 9 aa, Homo Sapiens
KAAGDASDQ

SEQ ID NO: 1072653 - protein, 9 aa, Homo Sapiens
APNLARATH

SEQ ID NO: 1072654 - protein, 9 aa, Homo Sapiens
LKDSEYTPV

SEQ ID NO: 1072655 - protein, 9 aa, Homo Sapiens
TFSQELTFK

SEQ ID NO: 1072656 - protein, 9 aa, Homo Sapiens
EKSQRLKVS

SEQ ID NO: 1072657 - protein, 9 aa, Homo Sapiens
IQKGLESGR

SEQ ID NO: 1072658 - protein, 9 aa, Homo Sapiens
SHVLWSRMS

SEQ ID NO: 1072659 - protein, 9 aa, Homo Sapiens
AWNKTNIYG

SEQ ID NO: 1072660 - protein, 9 aa, Homo Sapiens
PGEWKLCQD

SEQ ID NO: 1072661 - protein, 9 aa, Homo Sapiens
DEEKSDEEE

SEQ ID NO: 1072662 - protein, 9 aa, Homo Sapiens
WSSADSDSG

SEQ ID NO: 1072663 - protein, 9 aa, Homo Sapiens
PKNVKLAER

SEQ ID NO: 1072664 - protein, 9 aa, Homo Sapiens
PVEENLRRA

SEQ ID NO: 1072665 - protein, 9 aa, Homo Sapiens
KFEAKKESL

SEQ ID NO: 1072666 - protein, 9 aa, Homo Sapiens
SLPKDDSPQ

SEQ ID NO: 1072667 - protein, 9 aa, Homo Sapiens
GPLSRPPRY

SEQ ID NO: 1072668 - protein, 9 aa, Homo Sapiens
RTYEKCGHE

SEQ ID NO: 1072669 - protein, 9 aa, Homo Sapiens
SGLKSMVSV

SEQ ID NO: 1072670 - protein, 9 aa, Homo Sapiens
NKSQEKLSP

SEQ ID NO: 1072671 - protein, 9 aa, Homo Sapiens
YLARMNLLV

SEQ ID NO: 1072672 - protein, 9 aa, Homo Sapiens
GDPPLSSSM

SEQ ID NO: 1072673 - protein, 9 aa, Homo Sapiens
DSPKDNEKA

SEQ ID NO: 1072674 - protein, 9 aa, Homo Sapiens
LEDQDLDTF

SEQ ID NO: 1072675 - protein, 9 aa, Homo Sapiens
WSFQGHHPE

SEQ ID NO: 1072676 - protein, 9 aa, Homo Sapiens
QAEIYWVHL

SEQ ID NO: 1072677 - protein, 9 aa, Homo Sapiens
VFKKEKIVN

SEQ ID NO: 1072678 - protein, 9 aa, Homo Sapiens
VSRANFLGE

SEQ ID NO: 1072679 - protein, 9 aa, Homo Sapiens
NPDTQEIKE

SEQ ID NO: 1072680 - protein, 9 aa, Homo Sapiens
ILASWFIIF

SEQ ID NO: 1072681 - protein, 9 aa, Homo Sapiens
LQVCQQEGS

SEQ ID NO: 1072682 - protein, 9 aa, Homo Sapiens
VSGPAFLAL

SEQ ID NO: 1072683 - protein, 9 aa, Homo Sapiens
EMAAGYLPF

SEQ ID NO: 1072684 - protein, 9 aa, Homo Sapiens
PEKELNKYA

SEQ ID NO: 1072685 - protein, 9 aa, Homo Sapiens
AFCLDPEGS

SEQ ID NO: 1072686 - protein, 9 aa, Homo Sapiens
LFLQMEGHV

SEQ ID NO: 1072687 - protein, 9 aa, Homo Sapiens
YHRSYKLRP

SEQ ID NO: 1072688 - protein, 9 aa, Homo Sapiens
DKILLLVVG

SEQ ID NO: 1072689 - protein, 9 aa, Homo Sapiens
SMNSLFSVS

SEQ ID NO: 1072690 - protein, 9 aa, Homo Sapiens
QQSSSSKED

SEQ ID NO: 1072691 - protein, 9 aa, Homo Sapiens
PQKPKVSLS

SEQ ID NO: 1072692 - protein, 9 aa, Homo Sapiens
RFSSSDEID

SEQ ID NO: 1072693 - protein, 9 aa, Homo Sapiens
IVSQVTERS

SEQ ID NO: 1072694 - protein, 9 aa, Homo Sapiens
ITHVYNHLS

SEQ ID NO: 1072695 - protein, 9 aa, Homo Sapiens
ADGKLPSSA

SEQ ID NO: 1072696 - protein, 9 aa, Homo Sapiens
KDKDPVQIE

SEQ ID NO: 1072697 - protein, 9 aa, Homo Sapiens
ISRKYFFKA

SEQ ID NO: 1072698 - protein, 9 aa, Homo Sapiens
VRSRLWAHA

SEQ ID NO: 1072699 - protein, 9 aa, Homo Sapiens
GGAGEGPGY

SEQ ID NO: 1072700 - protein, 9 aa, Homo Sapiens
VNGSCIETS

SEQ ID NO: 1072701 - protein, 9 aa, Homo Sapiens
VLKGDNLSQ

SEQ ID NO: 1072702 - protein, 9 aa, Homo Sapiens
HTRPDQDNH

SEQ ID NO: 1072703 - protein, 9 aa, Homo Sapiens
TFIRTEPSL

SEQ ID NO: 1072704 - protein, 9 aa, Homo Sapiens
YLPEVVKPL

SEQ ID NO: 1072705 - protein, 9 aa, Homo Sapiens
KVLDLIVIP

SEQ ID NO: 1072706 - protein, 9 aa, Homo Sapiens
DGFYRSFEY

SEQ ID NO: 1072707 - protein, 9 aa, Homo Sapiens
DNYYKTLLM

SEQ ID NO: 1072708 - protein, 9 aa, Homo Sapiens
SYSGCAGDL

SEQ ID NO: 1072709 - protein, 9 aa, Homo Sapiens
LSVDELKIP

SEQ ID NO: 1072710 - protein, 9 aa, Homo Sapiens
FMVFSFIIG

SEQ ID NO: 1072711 - protein, 9 aa, Homo Sapiens
LKAWREDGF

SEQ ID NO: 1072712 - protein, 9 aa, Homo Sapiens
TPSKGSTAL

SEQ ID NO: 1072713 - protein, 9 aa, Homo Sapiens
RSQFTDLND

SEQ ID NO: 1072714 - protein, 9 aa, Homo Sapiens
KKIQHILDM

SEQ ID NO: 1072715 - protein, 9 aa, Homo Sapiens
YFFPSTNIT

SEQ ID NO: 1072716 - protein, 9 aa, Homo Sapiens
VFDQDFGVN

SEQ ID NO: 1072717 - protein, 9 aa, Homo Sapiens
PFTSECLRI

SEQ ID NO: 1072718 - protein, 9 aa, Homo Sapiens
AIKSFRTLR

SEQ ID NO: 1072719 - protein, 9 aa, Homo Sapiens
SPAPPPSAV

SEQ ID NO: 1072720 - protein, 9 aa, Homo Sapiens
ISLQALYMG

SEQ ID NO: 1072721 - protein, 9 aa, Homo Sapiens
GGIPQLLVS

SEQ ID NO: 1072722 - protein, 9 aa, Homo Sapiens
IFTWMEVQQ

SEQ ID NO: 1072723 - protein, 9 aa, Homo Sapiens
PRESCENAN

SEQ ID NO: 1072724 - protein, 9 aa, Homo Sapiens
MLNSFIYSL

SEQ ID NO: 1072725 - protein, 9 aa, Homo Sapiens
RGNTAAQMS

SEQ ID NO: 1072726 - protein, 9 aa, Homo Sapiens
DSASKKATV

SEQ ID NO: 1072727 - protein, 9 aa, Homo Sapiens
ANYCGKKCG

SEQ ID NO: 1072728 - protein, 9 aa, Homo Sapiens
SSFCSLQGD

SEQ ID NO: 1072729 - protein, 9 aa, Homo Sapiens
ASHDVGKEI

SEQ ID NO: 1072730 - protein, 9 aa, Homo Sapiens
KGSTALTSI

SEQ ID NO: 1072731 - protein, 9 aa, Homo Sapiens
HAGQRVSQT

SEQ ID NO: 1072732 - protein, 9 aa, Homo Sapiens
PPTPKLRPP

SEQ ID NO: 1072733 - protein, 9 aa, Homo Sapiens
GAPNLARAT

SEQ ID NO: 1072734 - protein, 9 aa, Homo Sapiens
NKFLENKFP

SEQ ID NO: 1072735 - protein, 9 aa, Homo Sapiens
YLLLPPQDP

SEQ ID NO: 1072736 - protein, 9 aa, Homo Sapiens
PLMAYSFQS

SEQ ID NO: 1072737 - protein, 9 aa, Homo Sapiens
PDGEEDETS

SEQ ID NO: 1072738 - protein, 9 aa, Homo Sapiens
KDYKSVEMV

SEQ ID NO: 1072739 - protein, 9 aa, Homo Sapiens
APLSKKVER

SEQ ID NO: 1072740 - protein, 9 aa, Homo Sapiens
EESPLQDAE

SEQ ID NO: 1072741 - protein, 9 aa, Homo Sapiens
YPVARFNKT

SEQ ID NO: 1072742 - protein, 9 aa, Homo Sapiens
IKDASPTEE

SEQ ID NO: 1072743 - protein, 9 aa, Homo Sapiens
EEGKPSCKR

SEQ ID NO: 1072744 - protein, 9 aa, Homo Sapiens
LLLLPSSGG

SEQ ID NO: 1072745 - protein, 9 aa, Homo Sapiens
SYFCEWLYN

SEQ ID NO: 1072746 - protein, 9 aa, Homo Sapiens
VLFLPLLPA

SEQ ID NO: 1072747 - protein, 9 aa, Homo Sapiens
NGCSSSGAL

SEQ ID NO: 1072748 - protein, 9 aa, Homo Sapiens
PLSEVMNKS

SEQ ID NO: 1072749 - protein, 9 aa, Homo Sapiens
LPFLFNIGL

SEQ ID NO: 1072750 - protein, 9 aa, Homo Sapiens
TEKSTEEGQ

SEQ ID NO: 1072751 - protein, 9 aa, Homo Sapiens
PLSRLRYNR

SEQ ID NO: 1072752 - protein, 9 aa, Homo Sapiens
TGCRELVWV

SEQ ID NO: 1072753 - protein, 9 aa, Homo Sapiens
GYPTPPATL

SEQ ID NO: 1072754 - protein, 9 aa, Homo Sapiens
IIPEPKGKE

SEQ ID NO: 1072755 - protein, 9 aa, Homo Sapiens
EPPQPPPSR

SEQ ID NO: 1072756 - protein, 9 aa, Homo Sapiens
ILKISKTQL

SEQ ID NO: 1072757 - protein, 9 aa, Homo Sapiens
KAAELDCRE

SEQ ID NO: 1072758 - protein, 9 aa, Homo Sapiens
PRPRGGSHD

SEQ ID NO: 1072759 - protein, 9 aa, Homo Sapiens
YFVMVGVHQ

SEQ ID NO: 1072760 - protein, 9 aa, Homo Sapiens
KRQGDYSKI

SEQ ID NO: 1072761 - protein, 9 aa, Homo Sapiens
KGAHYSNKV

SEQ ID NO: 1072762 - protein, 9 aa, Homo Sapiens
IIPSSEITY

SEQ ID NO: 1072763 - protein, 9 aa, Homo Sapiens
LKRKMKPES

SEQ ID NO: 1072764 - protein, 9 aa, Homo Sapiens
ILGSMALIF

SEQ ID NO: 1072765 - protein, 9 aa, Homo Sapiens
EELPLKEEV

SEQ ID NO: 1072766 - protein, 9 aa, Homo Sapiens
TDQLGNKYF

SEQ ID NO: 1072767 - protein, 9 aa, Homo Sapiens
PGHTHLYNN

SEQ ID NO: 1072768 - protein, 9 aa, Homo Sapiens
IFLTMVAVD

SEQ ID NO: 1072769 - protein, 9 aa, Homo Sapiens
PSEKNVVYE

SEQ ID NO: 1072770 - protein, 9 aa, Homo Sapiens
GPGSWYSKG

SEQ ID NO: 1072771 - protein, 9 aa, Homo Sapiens
PEAPSCCHL

SEQ ID NO: 1072772 - protein, 9 aa, Homo Sapiens
DSDSESTER

SEQ ID NO: 1072773 - protein, 9 aa, Homo Sapiens
VSKRKILQF

SEQ ID NO: 1072774 - protein, 9 aa, Homo Sapiens
YVMHSFWNT

SEQ ID NO: 1072775 - protein, 9 aa, Homo Sapiens
FPGETALGR

SEQ ID NO: 1072776 - protein, 9 aa, Homo Sapiens
ESQADVHWT

SEQ ID NO: 1072777 - protein, 9 aa, Homo Sapiens
YSGKRLRAV

SEQ ID NO: 1072778 - protein, 9 aa, Homo Sapiens
LLRLMAGPL

SEQ ID NO: 1072779 - protein, 9 aa, Homo Sapiens
TKRADLQLS

SEQ ID NO: 1072780 - protein, 9 aa, Homo Sapiens
FCLPKREVR

SEQ ID NO: 1072781 - protein, 9 aa, Homo Sapiens
GYILHKEEE

SEQ ID NO: 1072782 - protein, 9 aa, Homo Sapiens
FSFIIGRRH

SEQ ID NO: 1072783 - protein, 9 aa, Homo Sapiens
NSPSAASQT

SEQ ID NO: 1072784 - protein, 9 aa, Homo Sapiens
EFQDLLNMR

SEQ ID NO: 1072785 - protein, 9 aa, Homo Sapiens
QPYSDGGPV

SEQ ID NO: 1072786 - protein, 9 aa, Homo Sapiens
EEVARKGAD

SEQ ID NO: 1072787 - protein, 9 aa, Homo Sapiens
TQNKQAALQ

SEQ ID NO: 1072788 - protein, 9 aa, Homo Sapiens
VEPDDEEKS

SEQ ID NO: 1072789 - protein, 9 aa, Homo Sapiens
DLVQKKYLE

SEQ ID NO: 1072790 - protein, 9 aa, Homo Sapiens
GSKLDLKGP

SEQ ID NO: 1072791 - protein, 9 aa, Homo Sapiens
PALTELSLL

SEQ ID NO: 1072792 - protein, 9 aa, Homo Sapiens
LRNKQVIVL

SEQ ID NO: 1072793 - protein, 9 aa, Homo Sapiens
PPIQALQEH

SEQ ID NO: 1072794 - protein, 9 aa, Homo Sapiens
PRCQKLEQE

SEQ ID NO: 1072795 - protein, 9 aa, Homo Sapiens
SKIPKSSSD

SEQ ID NO: 1072796 - protein, 9 aa, Homo Sapiens
WCKECLPGA

SEQ ID NO: 1072797 - protein, 9 aa, Homo Sapiens
RSPAFCASY

SEQ ID NO: 1072798 - protein, 9 aa, Homo Sapiens
EKEELLKLA

SEQ ID NO: 1072799 - protein, 9 aa, Homo Sapiens
KFILLLQKI

SEQ ID NO: 1072800 - protein, 9 aa, Homo Sapiens
PHISFRYPK

SEQ ID NO: 1072801 - protein, 9 aa, Homo Sapiens
TTLKGETRQ

SEQ ID NO: 1072802 - protein, 9 aa, Homo Sapiens
GGGRRPCLG

SEQ ID NO: 1072803 - protein, 9 aa, Homo Sapiens
TSNLVHPTP

SEQ ID NO: 1072804 - protein, 9 aa, Homo Sapiens
LSPSSVTYP

SEQ ID NO: 1072805 - protein, 9 aa, Homo Sapiens
PPSPAGPAL

SEQ ID NO: 1072806 - protein, 9 aa, Homo Sapiens
ALYYLSFLR

SEQ ID NO: 1072807 - protein, 9 aa, Homo Sapiens
SNPNCVRMF

SEQ ID NO: 1072808 - protein, 9 aa, Homo Sapiens
SSAPSWPLY

SEQ ID NO: 1072809 - protein, 9 aa, Homo Sapiens
GSEGILGVI

SEQ ID NO: 1072810 - protein, 9 aa, Homo Sapiens
PSPVLRLSR

SEQ ID NO: 1072811 - protein, 9 aa, Homo Sapiens
YACSVCNSA

SEQ ID NO: 1072812 - protein, 9 aa, Homo Sapiens
GKERKKHLT

SEQ ID NO: 1072813 - protein, 9 aa, Homo Sapiens
IEEPASDSH

SEQ ID NO: 1072814 - protein, 9 aa, Homo Sapiens
LIFKDGGCV

SEQ ID NO: 1072815 - protein, 9 aa, Homo Sapiens
TSALNNDSE

SEQ ID NO: 1072816 - protein, 9 aa, Homo Sapiens
RKEVLEKRA

SEQ ID NO: 1072817 - protein, 9 aa, Homo Sapiens
VKAVLLEAT

SEQ ID NO: 1072818 - protein, 9 aa, Homo Sapiens
FYAVLKLEM

SEQ ID NO: 1072819 - protein, 9 aa, Homo Sapiens
SPISPPSPP

SEQ ID NO: 1072820 - protein, 9 aa, Homo Sapiens
APALCWRKT

SEQ ID NO: 1072821 - protein, 9 aa, Homo Sapiens
RLTDLEIGM

SEQ ID NO: 1072822 - protein, 9 aa, Homo Sapiens
RKMKPESDR

SEQ ID NO: 1072823 - protein, 9 aa, Homo Sapiens
IFRPPVEKW

SEQ ID NO: 1072824 - protein, 9 aa, Homo Sapiens
GYYQEGGGR

SEQ ID NO: 1072825 - protein, 9 aa, Homo Sapiens
CYVAVCRPL

SEQ ID NO: 1072826 - protein, 9 aa, Homo Sapiens
AESIPLRRQ

SEQ ID NO: 1072827 - protein, 9 aa, Homo Sapiens
FLQCDSDPE

SEQ ID NO: 1072828 - protein, 9 aa, Homo Sapiens
LLTQDLVQK

SEQ ID NO: 1072829 - protein, 9 aa, Homo Sapiens
LSEISVSHV

SEQ ID NO: 1072830 - protein, 9 aa, Homo Sapiens
AGGPGFSGA

SEQ ID NO: 1072831 - protein, 9 aa, Homo Sapiens
DLLMYIISN

SEQ ID NO: 1072832 - protein, 9 aa, Homo Sapiens
AKVESALVE

SEQ ID NO: 1072833 - protein, 9 aa, Homo Sapiens
SSSSSRPLT

SEQ ID NO: 1072834 - protein, 9 aa, Homo Sapiens
ILIFIVIFC

SEQ ID NO: 1072835 - protein, 9 aa, Homo Sapiens
YSGQLVQLM

SEQ ID NO: 1072836 - protein, 9 aa, Homo Sapiens
SHFVSGGQR

SEQ ID NO: 1072837 - protein, 9 aa, Homo Sapiens
KRRQKRGRF

SEQ ID NO: 1072838 - protein, 9 aa, Homo Sapiens
NKKMDSIVQ

SEQ ID NO: 1072839 - protein, 9 aa, Homo Sapiens
DLNWVVLNQ

SEQ ID NO: 1072840 - protein, 9 aa, Homo Sapiens
TEEKKEIKK

SEQ ID NO: 1072841 - protein, 9 aa, Homo Sapiens
SSTVLQTWQ

SEQ ID NO: 1072842 - protein, 9 aa, Homo Sapiens
KKSEYWFFV

SEQ ID NO: 1072843 - protein, 9 aa, Homo Sapiens
PTSLHSHNS

SEQ ID NO: 1072844 - protein, 9 aa, Homo Sapiens
KKYILAFWN

SEQ ID NO: 1072845 - protein, 9 aa, Homo Sapiens
PLNEQQKNS

SEQ ID NO: 1072846 - protein, 9 aa, Homo Sapiens
EIEFFRASG

SEQ ID NO: 1072847 - protein, 9 aa, Homo Sapiens
EWARMEKIM

SEQ ID NO: 1072848 - protein, 9 aa, Homo Sapiens
TLLKELGGE

SEQ ID NO: 1072849 - protein, 9 aa, Homo Sapiens
KRESDDFFG

SEQ ID NO: 1072850 - protein, 9 aa, Homo Sapiens
ELSNPCLKQ

SEQ ID NO: 1072851 - protein, 9 aa, Homo Sapiens
SCSAAGLHK

SEQ ID NO: 1072852 - protein, 9 aa, Homo Sapiens
VLLFSIEPE

SEQ ID NO: 1072853 - protein, 9 aa, Homo Sapiens
SAGEKYKAF

SEQ ID NO: 1072854 - protein, 9 aa, Homo Sapiens
FCASYNFSF

SEQ ID NO: 1072855 - protein, 9 aa, Homo Sapiens
KCLRFAPVS

SEQ ID NO: 1072856 - protein, 9 aa, Homo Sapiens
NRVIIPSSE

SEQ ID NO: 1072857 - protein, 9 aa, Homo Sapiens
SVADFAPRA

SEQ ID NO: 1072858 - protein, 9 aa, Homo Sapiens
TSNSTWMLG

SEQ ID NO: 1072859 - protein, 9 aa, Homo Sapiens
ILAEIGIVT

SEQ ID NO: 1072860 - protein, 9 aa, Homo Sapiens
EDIVAIIIP

SEQ ID NO: 1072861 - protein, 9 aa, Homo Sapiens
QIENEAAKN

SEQ ID NO: 1072862 - protein, 9 aa, Homo Sapiens
DKDVVNKGR

SEQ ID NO: 1072863 - protein, 9 aa, Homo Sapiens
WFNALCAAR

SEQ ID NO: 1072864 - protein, 9 aa, Homo Sapiens
STSLQESHI

SEQ ID NO: 1072865 - protein, 9 aa, Homo Sapiens
QGLGLVVSL

SEQ ID NO: 1072866 - protein, 9 aa, Homo Sapiens
SQDDECISM

SEQ ID NO: 1072867 - protein, 9 aa, Homo Sapiens
AAHALYSGQ

SEQ ID NO: 1072868 - protein, 9 aa, Homo Sapiens
SELFMGQLL

SEQ ID NO: 1072869 - protein, 9 aa, Homo Sapiens
VRTTKEGMI

SEQ ID NO: 1072870 - protein, 9 aa, Homo Sapiens
GSPLLRDQF

SEQ ID NO: 1072871 - protein, 9 aa, Homo Sapiens
IEVLISLFY

SEQ ID NO: 1072872 - protein, 9 aa, Homo Sapiens
IHEGCALDK

SEQ ID NO: 1072873 - protein, 9 aa, Homo Sapiens
EEGNYFFDG

SEQ ID NO: 1072874 - protein, 9 aa, Homo Sapiens
RLRQKVAMK

SEQ ID NO: 1072875 - protein, 9 aa, Homo Sapiens
SQKEYHHFV

SEQ ID NO: 1072876 - protein, 9 aa, Homo Sapiens
QSLPYQLLF

SEQ ID NO: 1072877 - protein, 9 aa, Homo Sapiens
PRGPSGAIG

SEQ ID NO: 1072878 - protein, 9 aa, Homo Sapiens
AFLQRKNDP

SEQ ID NO: 1072879 - protein, 9 aa, Homo Sapiens
EGDASSLGP

SEQ ID NO: 1072880 - protein, 9 aa, Homo Sapiens
VNHTMKVSC

SEQ ID NO: 1072881 - protein, 9 aa, Homo Sapiens
GEETEKTSN

SEQ ID NO: 1072882 - protein, 9 aa, Homo Sapiens
DLFDPWSLE

SEQ ID NO: 1072883 - protein, 9 aa, Homo Sapiens
IKVLFDVEQ

SEQ ID NO: 1072884 - protein, 9 aa, Homo Sapiens
FFFKKDKPL

SEQ ID NO: 1072885 - protein, 9 aa, Homo Sapiens
NGAHVNRVT

SEQ ID NO: 1072886 - protein, 9 aa, Homo Sapiens
VASVIYAKY

SEQ ID NO: 1072887 - protein, 9 aa, Homo Sapiens
SLQALYMGK

SEQ ID NO: 1072888 - protein, 9 aa, Homo Sapiens
LRRPRQLTR

SEQ ID NO: 1072889 - protein, 9 aa, Homo Sapiens
QKVSRSLPE

SEQ ID NO: 1072890 - protein, 9 aa, Homo Sapiens
TRLELPDQT

SEQ ID NO: 1072891 - protein, 9 aa, Homo Sapiens
WVTNQFQEN

SEQ ID NO: 1072892 - protein, 9 aa, Homo Sapiens
YDLNLCELT

SEQ ID NO: 1072893 - protein, 9 aa, Homo Sapiens
GTRRTVQMN

SEQ ID NO: 1072894 - protein, 9 aa, Homo Sapiens
THEVMGPKN

SEQ ID NO: 1072895 - protein, 9 aa, Homo Sapiens
KSMVSVAPS

SEQ ID NO: 1072896 - protein, 9 aa, Homo Sapiens
GLPLQGSDI

SEQ ID NO: 1072897 - protein, 9 aa, Homo Sapiens
LPSSGGGLP

SEQ ID NO: 1072898 - protein, 9 aa, Homo Sapiens
TCTLTLKKT

SEQ ID NO: 1072899 - protein, 9 aa, Homo Sapiens
QCCQKSEVL

SEQ ID NO: 1072900 - protein, 9 aa, Homo Sapiens
MFFLTSRTR

SEQ ID NO: 1072901 - protein, 9 aa, Homo Sapiens
PMSSKEAGL

SEQ ID NO: 1072902 - protein, 9 aa, Homo Sapiens
NEPSGRELT

SEQ ID NO: 1072903 - protein, 9 aa, Homo Sapiens
HFGEKLAIT

SEQ ID NO: 1072904 - protein, 9 aa, Homo Sapiens
LSLLLPGRP

SEQ ID NO: 1072905 - protein, 9 aa, Homo Sapiens
KKSLSEVLS

SEQ ID NO: 1072906 - protein, 9 aa, Homo Sapiens
GVFLRPYPF

SEQ ID NO: 1072907 - protein, 9 aa, Homo Sapiens
TRKRSYVCI

SEQ ID NO: 1072908 - protein, 9 aa, Homo Sapiens
LRAPFGTTS

SEQ ID NO: 1072909 - protein, 9 aa, Homo Sapiens
EGEMGNARR

SEQ ID NO: 1072910 - protein, 9 aa, Homo Sapiens
PGPRALQSV

SEQ ID NO: 1072911 - protein, 9 aa, Homo Sapiens
LTENTGTQA

SEQ ID NO: 1072912 - protein, 9 aa, Homo Sapiens
TAKAGTEPP

SEQ ID NO: 1072913 - protein, 9 aa, Homo Sapiens
VNRFWKEIY

SEQ ID NO: 1072914 - protein, 9 aa, Homo Sapiens
NEDTWPGVY

SEQ ID NO: 1072915 - protein, 9 aa, Homo Sapiens
GGPERELTM

SEQ ID NO: 1072916 - protein, 9 aa, Homo Sapiens
KKGILENQS

SEQ ID NO: 1072917 - protein, 9 aa, Homo Sapiens
SRKYFFKAV

SEQ ID NO: 1072918 - protein, 9 aa, Homo Sapiens
DGCDPSGAG

SEQ ID NO: 1072919 - protein, 9 aa, Homo Sapiens
AMAVASSSY

SEQ ID NO: 1072920 - protein, 9 aa, Homo Sapiens
TWSHSQFSD

SEQ ID NO: 1072921 - protein, 9 aa, Homo Sapiens
SILSHGIVA

SEQ ID NO: 1072922 - protein, 9 aa, Homo Sapiens
VGSQEMTGK

SEQ ID NO: 1072923 - protein, 9 aa, Homo Sapiens
FSFLYRKNY

SEQ ID NO: 1072924 - protein, 9 aa, Homo Sapiens
LSGLIRTQK

SEQ ID NO: 1072925 - protein, 9 aa, Homo Sapiens
NLFNTSPGV

SEQ ID NO: 1072926 - protein, 9 aa, Homo Sapiens
ASRQTRNKE

SEQ ID NO: 1072927 - protein, 9 aa, Homo Sapiens
GLGLVVSLI

SEQ ID NO: 1072928 - protein, 9 aa, Homo Sapiens
QVYVTFVVS

SEQ ID NO: 1072929 - protein, 9 aa, Homo Sapiens
RSVNKLTDQ

SEQ ID NO: 1072930 - protein, 9 aa, Homo Sapiens
LCLRLNRVL

SEQ ID NO: 1072931 - protein, 9 aa, Homo Sapiens
YDFETHCTL

SEQ ID NO: 1072932 - protein, 9 aa, Homo Sapiens
RWNYVSTLA

SEQ ID NO: 1072933 - protein, 9 aa, Homo Sapiens
LCAFKLTMQ

SEQ ID NO: 1072934 - protein, 9 aa, Homo Sapiens
SQTIPAIDP

SEQ ID NO: 1072935 - protein, 9 aa, Homo Sapiens
NVLGKNLKY

SEQ ID NO: 1072936 - protein, 9 aa, Homo Sapiens
KWYNPHPCN

SEQ ID NO: 1072937 - protein, 9 aa, Homo Sapiens
SRHSCICPG

SEQ ID NO: 1072938 - protein, 9 aa, Homo Sapiens
ARNVLENKL

SEQ ID NO: 1072939 - protein, 9 aa, Homo Sapiens
VQKYPGNQT

SEQ ID NO: 1072940 - protein, 9 aa, Homo Sapiens
PRSRRSRLS

SEQ ID NO: 1072941 - protein, 9 aa, Homo Sapiens
DFLAWKWSS

SEQ ID NO: 1072942 - protein, 9 aa, Homo Sapiens
DARALCEGR

SEQ ID NO: 1072943 - protein, 9 aa, Homo Sapiens
CRKQSNHTF

SEQ ID NO: 1072944 - protein, 9 aa, Homo Sapiens
ISKAIWLLW

SEQ ID NO: 1072945 - protein, 9 aa, Homo Sapiens
FGSSAGELE

SEQ ID NO: 1072946 - protein, 9 aa, Homo Sapiens
HQLRTMKFY

SEQ ID NO: 1072947 - protein, 9 aa, Homo Sapiens
DVDVKTDAQ

SEQ ID NO: 1072948 - protein, 9 aa, Homo Sapiens
NSEENFPDE

SEQ ID NO: 1072949 - protein, 9 aa, Homo Sapiens
QQQPAGFGA

SEQ ID NO: 1072950 - protein, 9 aa, Homo Sapiens
KTFTSHSSV

SEQ ID NO: 1072951 - protein, 9 aa, Homo Sapiens
EHMSNMEKK

SEQ ID NO: 1072952 - protein, 9 aa, Homo Sapiens
SCPDTSNIN

SEQ ID NO: 1072953 - protein, 9 aa, Homo Sapiens
HKGAHYSNK

SEQ ID NO: 1072954 - protein, 9 aa, Homo Sapiens
VDGLPLQGS

SEQ ID NO: 1072955 - protein, 9 aa, Homo Sapiens
DEVFEVLNG

SEQ ID NO: 1072956 - protein, 9 aa, Homo Sapiens
QKISFGDNC

SEQ ID NO: 1072957 - protein, 9 aa, Homo Sapiens
LIKAWEHCK

SEQ ID NO: 1072958 - protein, 9 aa, Homo Sapiens
PNGATGPPG

SEQ ID NO: 1072959 - protein, 9 aa, Homo Sapiens
PSLPKDDSP

SEQ ID NO: 1072960 - protein, 9 aa, Homo Sapiens
IKSFRTLRA

SEQ ID NO: 1072961 - protein, 9 aa, Homo Sapiens
RVRTLFRSQ

SEQ ID NO: 1072962 - protein, 9 aa, Homo Sapiens
LVCALSNIA

SEQ ID NO: 1072963 - protein, 9 aa, Homo Sapiens
RGKALGVYN

SEQ ID NO: 1072964 - protein, 9 aa, Homo Sapiens
FKKEKIVNR

SEQ ID NO: 1072965 - protein, 9 aa, Homo Sapiens
QQHPVVLST

SEQ ID NO: 1072966 - protein, 9 aa, Homo Sapiens
HNWMQALTS

SEQ ID NO: 1072967 - protein, 9 aa, Homo Sapiens
VPNVYRPQF

SEQ ID NO: 1072968 - protein, 9 aa, Homo Sapiens
FTDSKLYIS

SEQ ID NO: 1072969 - protein, 9 aa, Homo Sapiens
FEQILKTEY

SEQ ID NO: 1072970 - protein, 9 aa, Homo Sapiens
VGVNFLQSY

SEQ ID NO: 1072971 - protein, 9 aa, Homo Sapiens
AGPALSLGD

SEQ ID NO: 1072972 - protein, 9 aa, Homo Sapiens
YNGKKSVAH

SEQ ID NO: 1072973 - protein, 9 aa, Homo Sapiens
GYNPAPYTL

SEQ ID NO: 1072974 - protein, 9 aa, Homo Sapiens
GCRAFILPA

SEQ ID NO: 1072975 - protein, 9 aa, Homo Sapiens
LDSGGQRTS

SEQ ID NO: 1072976 - protein, 9 aa, Homo Sapiens
KCLKDEDLL

SEQ ID NO: 1072977 - protein, 9 aa, Homo Sapiens
VFVEWRAQS

SEQ ID NO: 1072978 - protein, 9 aa, Homo Sapiens
KYPSPLDPE

SEQ ID NO: 1072979 - protein, 9 aa, Homo Sapiens
KLAITYGAL

SEQ ID NO: 1072980 - protein, 9 aa, Homo Sapiens
HLSNMLIKI

SEQ ID NO: 1072981 - protein, 9 aa, Homo Sapiens
AWKWSSEKR

SEQ ID NO: 1072982 - protein, 9 aa, Homo Sapiens
VLHGELSCT

SEQ ID NO: 1072983 - protein, 9 aa, Homo Sapiens
GLISIDRFL

SEQ ID NO: 1072984 - protein, 9 aa, Homo Sapiens
GPSFTISKA

SEQ ID NO: 1072985 - protein, 9 aa, Homo Sapiens
GEVFFEGSV

SEQ ID NO: 1072986 - protein, 9 aa, Homo Sapiens
QKDQLCFGV

SEQ ID NO: 1072987 - protein, 9 aa, Homo Sapiens
RRAKTLASK

SEQ ID NO: 1072988 - protein, 9 aa, Homo Sapiens
KNRELQIMK

SEQ ID NO: 1072989 - protein, 9 aa, Homo Sapiens
SQFWGQPCT

SEQ ID NO: 1072990 - protein, 9 aa, Homo Sapiens
SCWAMAVAS

SEQ ID NO: 1072991 - protein, 9 aa, Homo Sapiens
ESLDSLSTC

SEQ ID NO: 1072992 - protein, 9 aa, Homo Sapiens
FCAPLEPRL

SEQ ID NO: 1072993 - protein, 9 aa, Homo Sapiens
FKFQVVEGP

SEQ ID NO: 1072994 - protein, 9 aa, Homo Sapiens
PRGRLTERN

SEQ ID NO: 1072995 - protein, 9 aa, Homo Sapiens
KAAMRHQRK

SEQ ID NO: 1072996 - protein, 9 aa, Homo Sapiens
EGCQCDSSF

SEQ ID NO: 1072997 - protein, 9 aa, Homo Sapiens
EVWLTPPGS

SEQ ID NO: 1072998 - protein, 9 aa, Homo Sapiens
RREALKRGK

SEQ ID NO: 1072999 - protein, 9 aa, Homo Sapiens
YRGQNNLTA

SEQ ID NO: 1073000 - protein, 9 aa, Homo Sapiens
VQENGQRIF

SEQ ID NO: 1073001 - protein, 9 aa, Homo Sapiens
GNPPLHLPA

SEQ ID NO: 1073002 - protein, 9 aa, Homo Sapiens
ALAEFVGRA

SEQ ID NO: 1073003 - protein, 9 aa, Homo Sapiens
SVEKGLHDL

SEQ ID NO: 1073004 - protein, 9 aa, Homo Sapiens
PNCVRMFGP

SEQ ID NO: 1073005 - protein, 9 aa, Homo Sapiens
KDISLNERE

SEQ ID NO: 1073006 - protein, 9 aa, Homo Sapiens
DVKGSKLDL

SEQ ID NO: 1073007 - protein, 9 aa, Homo Sapiens
WLLYELQPA

SEQ ID NO: 1073008 - protein, 9 aa, Homo Sapiens
IPGIEGPSG

SEQ ID NO: 1073009 - protein, 9 aa, Homo Sapiens
CYYGHIRLV

SEQ ID NO: 1073010 - protein, 9 aa, Homo Sapiens
GSQKEYHHF

SEQ ID NO: 1073011 - protein, 9 aa, Homo Sapiens
LFTESVKLN

SEQ ID NO: 1073012 - protein, 9 aa, Homo Sapiens
VVYRCWEEK

SEQ ID NO: 1073013 - protein, 9 aa, Homo Sapiens
WQLENIAQG

SEQ ID NO: 1073014 - protein, 9 aa, Homo Sapiens
ANSLIREFR

SEQ ID NO: 1073015 - protein, 9 aa, Homo Sapiens
GRGGGRRPC

SEQ ID NO: 1073016 - protein, 9 aa, Homo Sapiens
YRRVHTGEK

SEQ ID NO: 1073017 - protein, 9 aa, Homo Sapiens
QEGSREQED

SEQ ID NO: 1073018 - protein, 9 aa, Homo Sapiens
RRQSSQEKV

SEQ ID NO: 1073019 - protein, 9 aa, Homo Sapiens
VYHKHFDAS

SEQ ID NO: 1073020 - protein, 9 aa, Homo Sapiens
DGDGRVVKG

SEQ ID NO: 1073021 - protein, 9 aa, Homo Sapiens
DLARAPPGE

SEQ ID NO: 1073022 - protein, 9 aa, Homo Sapiens
KKTHPTVPG

SEQ ID NO: 1073023 - protein, 9 aa, Homo Sapiens
NYYKTLLMT

SEQ ID NO: 1073024 - protein, 9 aa, Homo Sapiens
LSSEITSLY

SEQ ID NO: 1073025 - protein, 9 aa, Homo Sapiens
SSRPTLRTS

SEQ ID NO: 1073026 - protein, 9 aa, Homo Sapiens
FLNLRTPRK

SEQ ID NO: 1073027 - protein, 9 aa, Homo Sapiens
SSKEDSPEL

SEQ ID NO: 1073028 - protein, 9 aa, Homo Sapiens
CLMDRHDFE

SEQ ID NO: 1073029 - protein, 9 aa, Homo Sapiens
FSRWNNLHR

SEQ ID NO: 1073030 - protein, 9 aa, Homo Sapiens
SELRDNFLK

SEQ ID NO: 1073031 - protein, 9 aa, Homo Sapiens
SKSYLSHIG

SEQ ID NO: 1073032 - protein, 9 aa, Homo Sapiens
TTLQPHLFL

SEQ ID NO: 1073033 - protein, 9 aa, Homo Sapiens
QSLFTRFVC

SEQ ID NO: 1073034 - protein, 9 aa, Homo Sapiens
HHEKMEMKN

SEQ ID NO: 1073035 - protein, 9 aa, Homo Sapiens
RKDAKHLIS

SEQ ID NO: 1073036 - protein, 9 aa, Homo Sapiens
LQRCQCVEQ

SEQ ID NO: 1073037 - protein, 9 aa, Homo Sapiens
EPTCEAGLI

SEQ ID NO: 1073038 - protein, 9 aa, Homo Sapiens
VPLPSVSRV

SEQ ID NO: 1073039 - protein, 9 aa, Homo Sapiens
STLLPVTLS

SEQ ID NO: 1073040 - protein, 9 aa, Homo Sapiens
LLSAEIFSD

SEQ ID NO: 1073041 - protein, 9 aa, Homo Sapiens
GDTGCRELV

SEQ ID NO: 1073042 - protein, 9 aa, Homo Sapiens
QQGSTNLAV

SEQ ID NO: 1073043 - protein, 9 aa, Homo Sapiens
TSTVSVKNI

SEQ ID NO: 1073044 - protein, 9 aa, Homo Sapiens
ELMKENLQT

SEQ ID NO: 1073045 - protein, 9 aa, Homo Sapiens
FKYGDLLMY

SEQ ID NO: 1073046 - protein, 9 aa, Homo Sapiens
NHHRSHSPL

SEQ ID NO: 1073047 - protein, 9 aa, Homo Sapiens
ILFQPVAGE

SEQ ID NO: 1073048 - protein, 9 aa, Homo Sapiens
KAPRFSSNI

SEQ ID NO: 1073049 - protein, 9 aa, Homo Sapiens
LFLGSSEGL

SEQ ID NO: 1073050 - protein, 9 aa, Homo Sapiens
APLIFPSSL

SEQ ID NO: 1073051 - protein, 9 aa, Homo Sapiens
FGNNSIFFQ

SEQ ID NO: 1073052 - protein, 9 aa, Homo Sapiens
GVTAFFCKA

SEQ ID NO: 1073053 - protein, 9 aa, Homo Sapiens
SSVPPERCR

SEQ ID NO: 1073054 - protein, 9 aa, Homo Sapiens
QQGRTLEPG

SEQ ID NO: 1073055 - protein, 9 aa, Homo Sapiens
HHENHLLYS

SEQ ID NO: 1073056 - protein, 9 aa, Homo Sapiens
FLLISQTWS

SEQ ID NO: 1073057 - protein, 9 aa, Homo Sapiens
CGVIIYNIT

SEQ ID NO: 1073058 - protein, 9 aa, Homo Sapiens
FQSKSFLSY

SEQ ID NO: 1073059 - protein, 9 aa, Homo Sapiens
YEKSCQDLQ

SEQ ID NO: 1073060 - protein, 9 aa, Homo Sapiens
DCTSWDQLG

SEQ ID NO: 1073061 - protein, 9 aa, Homo Sapiens
NPNCVRMFG

SEQ ID NO: 1073062 - protein, 9 aa, Homo Sapiens
PKIFMPDFD

SEQ ID NO: 1073063 - protein, 9 aa, Homo Sapiens
SRRIRPEFL

SEQ ID NO: 1073064 - protein, 9 aa, Homo Sapiens
WSKSYFCEW

SEQ ID NO: 1073065 - protein, 9 aa, Homo Sapiens
LENILPSVS

SEQ ID NO: 1073066 - protein, 9 aa, Homo Sapiens
KFRKKIIKQ

SEQ ID NO: 1073067 - protein, 9 aa, Homo Sapiens
QNFTVRADV

SEQ ID NO: 1073068 - protein, 9 aa, Homo Sapiens
KSTENVPRT

SEQ ID NO: 1073069 - protein, 9 aa, Homo Sapiens
KHGTQNKQA

SEQ ID NO: 1073070 - protein, 9 aa, Homo Sapiens
FSFEKLRQP

SEQ ID NO: 1073071 - protein, 9 aa, Homo Sapiens
LNLRTPRKL

SEQ ID NO: 1073072 - protein, 9 aa, Homo Sapiens
PQLDVKGSK

SEQ ID NO: 1073073 - protein, 9 aa, Homo Sapiens
QMTSTVSNL

SEQ ID NO: 1073074 - protein, 9 aa, Homo Sapiens
SLRLQNSTT

SEQ ID NO: 1073075 - protein, 9 aa, Homo Sapiens
TKKEESLLP

SEQ ID NO: 1073076 - protein, 9 aa, Homo Sapiens
QRIHTRKRS

SEQ ID NO: 1073077 - protein, 9 aa, Homo Sapiens
PSAPHGDGS

SEQ ID NO: 1073078 - protein, 9 aa, Homo Sapiens
PQTPSLHGT

SEQ ID NO: 1073079 - protein, 9 aa, Homo Sapiens
AAEQRKAFS

SEQ ID NO: 1073080 - protein, 9 aa, Homo Sapiens
ITLEEKLAP

SEQ ID NO: 1073081 - protein, 9 aa, Homo Sapiens
FFSFSFGFP

SEQ ID NO: 1073082 - protein, 9 aa, Homo Sapiens
KLKIVHSNW

SEQ ID NO: 1073083 - protein, 9 aa, Homo Sapiens
QYNCSRDQR

SEQ ID NO: 1073084 - protein, 9 aa, Homo Sapiens
DSDIQVLYG

SEQ ID NO: 1073085 - protein, 9 aa, Homo Sapiens
DPVSLCYTP

SEQ ID NO: 1073086 - protein, 9 aa, Homo Sapiens
KAETIPSLR

SEQ ID NO: 1073087 - protein, 9 aa, Homo Sapiens
QEKEGKQEE

SEQ ID NO: 1073088 - protein, 9 aa, Homo Sapiens
QLHKFSSPS

SEQ ID NO: 1073089 - protein, 9 aa, Homo Sapiens
LRPHSSLSL

SEQ ID NO: 1073090 - protein, 9 aa, Homo Sapiens
SSDESDDLS

SEQ ID NO: 1073091 - protein, 9 aa, Homo Sapiens
VCSAAARLD

SEQ ID NO: 1073092 - protein, 9 aa, Homo Sapiens
ERPGKKQLY

SEQ ID NO: 1073093 - protein, 9 aa, Homo Sapiens
HPKLANAHN

SEQ ID NO: 1073094 - protein, 9 aa, Homo Sapiens
TPMLNSFIY

SEQ ID NO: 1073095 - protein, 9 aa, Homo Sapiens
RRRVFTPRT

SEQ ID NO: 1073096 - protein, 9 aa, Homo Sapiens
PSDSFRQFL

SEQ ID NO: 1073097 - protein, 9 aa, Homo Sapiens
NGSMGGPSR

SEQ ID NO: 1073098 - protein, 9 aa, Homo Sapiens
IDMSVLPDA

SEQ ID NO: 1073099 - protein, 9 aa, Homo Sapiens
RLHTASDLF

SEQ ID NO: 1073100 - protein, 9 aa, Homo Sapiens
ARSGPSFLL

SEQ ID NO: 1073101 - protein, 9 aa, Homo Sapiens
FEANNFAML

SEQ ID NO: 1073102 - protein, 9 aa, Homo Sapiens
SPRLGHQRT

SEQ ID NO: 1073103 - protein, 9 aa, Homo Sapiens
NAPPLESPQ

SEQ ID NO: 1073104 - protein, 9 aa, Homo Sapiens
HNLEPYIES

SEQ ID NO: 1073105 - protein, 9 aa, Homo Sapiens
KEVLARDSV

SEQ ID NO: 1073106 - protein, 9 aa, Homo Sapiens
GNSSETSSE

SEQ ID NO: 1073107 - protein, 9 aa, Homo Sapiens
PEGPGAHEK

SEQ ID NO: 1073108 - protein, 9 aa, Homo Sapiens
GYLPPPQLN

SEQ ID NO: 1073109 - protein, 9 aa, Homo Sapiens
NITILGSMA

SEQ ID NO: 1073110 - protein, 9 aa, Homo Sapiens
VISQADTVI

SEQ ID NO: 1073111 - protein, 9 aa, Homo Sapiens
DLIESNYPI

SEQ ID NO: 1073112 - protein, 9 aa, Homo Sapiens
NGNSVLMKA

SEQ ID NO: 1073113 - protein, 9 aa, Homo Sapiens
AYSFQSPLG

SEQ ID NO: 1073114 - protein, 9 aa, Homo Sapiens
AHFKDYKSV

SEQ ID NO: 1073115 - protein, 9 aa, Homo Sapiens
PVEVAKVVY

SEQ ID NO: 1073116 - protein, 9 aa, Homo Sapiens
HLRRVGDSD

SEQ ID NO: 1073117 - protein, 9 aa, Homo Sapiens
GFAPTHQSH

SEQ ID NO: 1073118 - protein, 9 aa, Homo Sapiens
EAHYNCSFD

SEQ ID NO: 1073119 - protein, 9 aa, Homo Sapiens
AIRPSCPDT

SEQ ID NO: 1073120 - protein, 9 aa, Homo Sapiens
LNFLYSPKI

SEQ ID NO: 1073121 - protein, 9 aa, Homo Sapiens
RKMRLSPVQ

SEQ ID NO: 1073122 - protein, 9 aa, Homo Sapiens
PLLRDQFLL

SEQ ID NO: 1073123 - protein, 9 aa, Homo Sapiens
KAAFPGRRV

SEQ ID NO: 1073124 - protein, 9 aa, Homo Sapiens
VCINFIFIM

SEQ ID NO: 1073125 - protein, 9 aa, Homo Sapiens
FVATGAVRD

SEQ ID NO: 1073126 - protein, 9 aa, Homo Sapiens
HLQNLSALT

SEQ ID NO: 1073127 - protein, 9 aa, Homo Sapiens
FPKKKITDS

SEQ ID NO: 1073128 - protein, 9 aa, Homo Sapiens
NSTWMLGAS

SEQ ID NO: 1073129 - protein, 9 aa, Homo Sapiens
LSEVMNKSR

SEQ ID NO: 1073130 - protein, 9 aa, Homo Sapiens
QELVFFPKK

SEQ ID NO: 1073131 - protein, 9 aa, Homo Sapiens
TQEIKERDL

SEQ ID NO: 1073132 - protein, 9 aa, Homo Sapiens
PQFLVLILS

SEQ ID NO: 1073133 - protein, 9 aa, Homo Sapiens
SSSKEDSPE

SEQ ID NO: 1073134 - protein, 9 aa, Homo Sapiens
QDNHVTIIR

SEQ ID NO: 1073135 - protein, 9 aa, Homo Sapiens
EDNPTAVQI

SEQ ID NO: 1073136 - protein, 9 aa, Homo Sapiens
LRNVDLIDI

SEQ ID NO: 1073137 - protein, 9 aa, Homo Sapiens
CLTCFCLLD

SEQ ID NO: 1073138 - protein, 9 aa, Homo Sapiens
LENGIEQRN

SEQ ID NO: 1073139 - protein, 9 aa, Homo Sapiens
LFFETSFCV

SEQ ID NO: 1073140 - protein, 9 aa, Homo Sapiens
IEKKEMKIS

SEQ ID NO: 1073141 - protein, 9 aa, Homo Sapiens
RGPPGLQGD

SEQ ID NO: 1073142 - protein, 9 aa, Homo Sapiens
EALPHRALS

SEQ ID NO: 1073143 - protein, 9 aa, Homo Sapiens
FQTLEGKYL

SEQ ID NO: 1073144 - protein, 9 aa, Homo Sapiens
GVRIVSRSR

SEQ ID NO: 1073145 - protein, 9 aa, Homo Sapiens
HSNMELPTP

SEQ ID NO: 1073146 - protein, 9 aa, Homo Sapiens
KNRLPLFVK

SEQ ID NO: 1073147 - protein, 9 aa, Homo Sapiens
SSFIRTVQG

SEQ ID NO: 1073148 - protein, 9 aa, Homo Sapiens
FFGALRISG

SEQ ID NO: 1073149 - protein, 9 aa, Homo Sapiens
TMKEEMAEL

SEQ ID NO: 1073150 - protein, 9 aa, Homo Sapiens
EEPTFSTNE

SEQ ID NO: 1073151 - protein, 9 aa, Homo Sapiens
QWGTVCDNG

SEQ ID NO: 1073152 - protein, 9 aa, Homo Sapiens
AKTAPPPLC

SEQ ID NO: 1073153 - protein, 9 aa, Homo Sapiens
YSDGGPVPS

SEQ ID NO: 1073154 - protein, 9 aa, Homo Sapiens
SNGGPALEA

SEQ ID NO: 1073155 - protein, 9 aa, Homo Sapiens
DSRNSETLF

SEQ ID NO: 1073156 - protein, 9 aa, Homo Sapiens
AQRDAWGPE

SEQ ID NO: 1073157 - protein, 9 aa, Homo Sapiens
NNLYVLSTG

SEQ ID NO: 1073158 - protein, 9 aa, Homo Sapiens
NNRMTHLVP

SEQ ID NO: 1073159 - protein, 9 aa, Homo Sapiens
KFRDFAWET

SEQ ID NO: 1073160 - protein, 9 aa, Homo Sapiens
IWVTNQFQE

SEQ ID NO: 1073161 - protein, 9 aa, Homo Sapiens
SIPRRIKLI

SEQ ID NO: 1073162 - protein, 9 aa, Homo Sapiens
LVYVNAIAI

SEQ ID NO: 1073163 - protein, 9 aa, Homo Sapiens
NLDSLNNLQ

SEQ ID NO: 1073164 - protein, 9 aa, Homo Sapiens
SACPLPPPS

SEQ ID NO: 1073165 - protein, 9 aa, Homo Sapiens
TSGSMLGRA

SEQ ID NO: 1073166 - protein, 9 aa, Homo Sapiens
LNSEDDMGT

SEQ ID NO: 1073167 - protein, 9 aa, Homo Sapiens
LALSLGGTS

SEQ ID NO: 1073168 - protein, 9 aa, Homo Sapiens
IDLNWVVLN

SEQ ID NO: 1073169 - protein, 9 aa, Homo Sapiens
PEPTLWIRT

SEQ ID NO: 1073170 - protein, 9 aa, Homo Sapiens
LDLIVIPRS

SEQ ID NO: 1073171 - protein, 9 aa, Homo Sapiens
TKKVQKVPP

SEQ ID NO: 1073172 - protein, 9 aa, Homo Sapiens
YPIWYQCHR

SEQ ID NO: 1073173 - protein, 9 aa, Homo Sapiens
WYHLHGSQI

SEQ ID NO: 1073174 - protein, 9 aa, Homo Sapiens
ASLVQTVTS

SEQ ID NO: 1073175 - protein, 9 aa, Homo Sapiens
AVADKIKVL

SEQ ID NO: 1073176 - protein, 9 aa, Homo Sapiens
QGLQTPGPP

SEQ ID NO: 1073177 - protein, 9 aa, Homo Sapiens
ALVPMDFLE

SEQ ID NO: 1073178 - protein, 9 aa, Homo Sapiens
VRCAKALGP

SEQ ID NO: 1073179 - protein, 9 aa, Homo Sapiens
QLKSSATYE

SEQ ID NO: 1073180 - protein, 9 aa, Homo Sapiens
RTLEPGRQT

SEQ ID NO: 1073181 - protein, 9 aa, Homo Sapiens
TLHFSYCAS

SEQ ID NO: 1073182 - protein, 9 aa, Homo Sapiens
PGLSPSQRL

SEQ ID NO: 1073183 - protein, 9 aa, Homo Sapiens
RNMEKSYVN

SEQ ID NO: 1073184 - protein, 9 aa, Homo Sapiens
QSSPYHSQL

SEQ ID NO: 1073185 - protein, 9 aa, Homo Sapiens
QGRFLQGFR

SEQ ID NO: 1073186 - protein, 9 aa, Homo Sapiens
VKKGFNLPV

SEQ ID NO: 1073187 - protein, 9 aa, Homo Sapiens
PHSRRKMRL

SEQ ID NO: 1073188 - protein, 9 aa, Homo Sapiens
LCLSSSNEH

SEQ ID NO: 1073189 - protein, 9 aa, Homo Sapiens
SGQLVQLML

SEQ ID NO: 1073190 - protein, 9 aa, Homo Sapiens
VNLEAENNK

SEQ ID NO: 1073191 - protein, 9 aa, Homo Sapiens
ILVEVEGRA

SEQ ID NO: 1073192 - protein, 9 aa, Homo Sapiens
SSERFLKQS

SEQ ID NO: 1073193 - protein, 9 aa, Homo Sapiens
IILATSQSC

SEQ ID NO: 1073194 - protein, 9 aa, Homo Sapiens
TADFNISSL

SEQ ID NO: 1073195 - protein, 9 aa, Homo Sapiens
RPCERPACQ

SEQ ID NO: 1073196 - protein, 9 aa, Homo Sapiens
KHLLAMYPN

SEQ ID NO: 1073197 - protein, 9 aa, Homo Sapiens
SAPALQEKA

SEQ ID NO: 1073198 - protein, 9 aa, Homo Sapiens
LVFGSVFLF

SEQ ID NO: 1073199 - protein, 9 aa, Homo Sapiens
SAPILKALG

SEQ ID NO: 1073200 - protein, 9 aa, Homo Sapiens
SSMSLSLFV

SEQ ID NO: 1073201 - protein, 9 aa, Homo Sapiens
QPSCGRPAC

SEQ ID NO: 1073202 - protein, 9 aa, Homo Sapiens
EEEQEKEGK

SEQ ID NO: 1073203 - protein, 9 aa, Homo Sapiens
FTNQEVQEK

SEQ ID NO: 1073204 - protein, 9 aa, Homo Sapiens
KFGWEENKS

SEQ ID NO: 1073205 - protein, 9 aa, Homo Sapiens
DQSEPPVIE

SEQ ID NO: 1073206 - protein, 9 aa, Homo Sapiens
AFNISSMLT

SEQ ID NO: 1073207 - protein, 9 aa, Homo Sapiens
PGSCQSPPG

SEQ ID NO: 1073208 - protein, 9 aa, Homo Sapiens
FQSCDLRRL

SEQ ID NO: 1073209 - protein, 9 aa, Homo Sapiens
VGVVAEGLL

SEQ ID NO: 1073210 - protein, 9 aa, Homo Sapiens
WREIYDSIE

SEQ ID NO: 1073211 - protein, 9 aa, Homo Sapiens
RQKKKTVIT

SEQ ID NO: 1073212 - protein, 9 aa, Homo Sapiens
LALGQFNKE

SEQ ID NO: 1073213 - protein, 9 aa, Homo Sapiens
LEYQACVLE

SEQ ID NO: 1073214 - protein, 9 aa, Homo Sapiens
AAGYLPFFA

SEQ ID NO: 1073215 - protein, 9 aa, Homo Sapiens
TGWSSLDVL

SEQ ID NO: 1073216 - protein, 9 aa, Homo Sapiens
PQSREPLPR

SEQ ID NO: 1073217 - protein, 9 aa, Homo Sapiens
WLKNGLPAT

SEQ ID NO: 1073218 - protein, 9 aa, Homo Sapiens
STSYPCFVS

SEQ ID NO: 1073219 - protein, 9 aa, Homo Sapiens
MFLTSLFSP

SEQ ID NO: 1073220 - protein, 9 aa, Homo Sapiens
VWSFGVRLW

SEQ ID NO: 1073221 - protein, 9 aa, Homo Sapiens
YEQQPPEKE

SEQ ID NO: 1073222 - protein, 9 aa, Homo Sapiens
FSFSNTLLT

SEQ ID NO: 1073223 - protein, 9 aa, Homo Sapiens
ENNLLLQER

SEQ ID NO: 1073224 - protein, 9 aa, Homo Sapiens
YYKFFRDVS

SEQ ID NO: 1073225 - protein, 9 aa, Homo Sapiens
KKGPCQTYM

SEQ ID NO: 1073226 - protein, 9 aa, Homo Sapiens
MASAPILKA

SEQ ID NO: 1073227 - protein, 9 aa, Homo Sapiens
FLRYILDWD

SEQ ID NO: 1073228 - protein, 9 aa, Homo Sapiens
QPEDGADGK

SEQ ID NO: 1073229 - protein, 9 aa, Homo Sapiens
TIFYRSLPP

SEQ ID NO: 1073230 - protein, 9 aa, Homo Sapiens
AGKNCITIH

SEQ ID NO: 1073231 - protein, 9 aa, Homo Sapiens
FVEKLKNFN

SEQ ID NO: 1073232 - protein, 9 aa, Homo Sapiens
PSPKPALLA

SEQ ID NO: 1073233 - protein, 9 aa, Homo Sapiens
PGGEEARQG

SEQ ID NO: 1073234 - protein, 9 aa, Homo Sapiens
AIMTQWNRT

SEQ ID NO: 1073235 - protein, 9 aa, Homo Sapiens
FNNKENETI

SEQ ID NO: 1073236 - protein, 9 aa, Homo Sapiens
SAQENNQAC

SEQ ID NO: 1073237 - protein, 9 aa, Homo Sapiens
LGAPGVSIR

SEQ ID NO: 1073238 - protein, 9 aa, Homo Sapiens
TSTVSNLPK

SEQ ID NO: 1073239 - protein, 9 aa, Homo Sapiens
SLFSPNRQP

SEQ ID NO: 1073240 - protein, 9 aa, Homo Sapiens
RDSDIQVLY

SEQ ID NO: 1073241 - protein, 9 aa, Homo Sapiens
SNPPRYEFL

SEQ ID NO: 1073242 - protein, 9 aa, Homo Sapiens
IAGVNWKSG

SEQ ID NO: 1073243 - protein, 9 aa, Homo Sapiens
QRPMFSPIH

SEQ ID NO: 1073244 - protein, 9 aa, Homo Sapiens
ASDESVLFM

SEQ ID NO: 1073245 - protein, 9 aa, Homo Sapiens
ACGTGSCME

SEQ ID NO: 1073246 - protein, 9 aa, Homo Sapiens
LQNAPPLES

SEQ ID NO: 1073247 - protein, 9 aa, Homo Sapiens
EKRANLCLS

SEQ ID NO: 1073248 - protein, 9 aa, Homo Sapiens
FAPPGAFSL

SEQ ID NO: 1073249 - protein, 9 aa, Homo Sapiens
RKQNWELRE

SEQ ID NO: 1073250 - protein, 9 aa, Homo Sapiens
QDMFDSPKD

SEQ ID NO: 1073251 - protein, 9 aa, Homo Sapiens
NKQVIVLFI

SEQ ID NO: 1073252 - protein, 9 aa, Homo Sapiens
QTWSHLESI

SEQ ID NO: 1073253 - protein, 9 aa, Homo Sapiens
VNIERVKDF

SEQ ID NO: 1073254 - protein, 9 aa, Homo Sapiens
QGLEELCPK

SEQ ID NO: 1073255 - protein, 9 aa, Homo Sapiens
AHKTSSLDG

SEQ ID NO: 1073256 - protein, 9 aa, Homo Sapiens
QSMPTSTWA

SEQ ID NO: 1073257 - protein, 9 aa, Homo Sapiens
VLEKRAQKR

SEQ ID NO: 1073258 - protein, 9 aa, Homo Sapiens
KTLTSDVTQ

SEQ ID NO: 1073259 - protein, 9 aa, Homo Sapiens
YHKHFDASD

SEQ ID NO: 1073260 - protein, 9 aa, Homo Sapiens
ESWVLVGVV

SEQ ID NO: 1073261 - protein, 9 aa, Homo Sapiens
TWEKKELKS

SEQ ID NO: 1073262 - protein, 9 aa, Homo Sapiens
TWKPWRTLK

SEQ ID NO: 1073263 - protein, 9 aa, Homo Sapiens
SQELMKENL

SEQ ID NO: 1073264 - protein, 9 aa, Homo Sapiens
TEYEFDSPY

SEQ ID NO: 1073265 - protein, 9 aa, Homo Sapiens
CSRYTEICL

SEQ ID NO: 1073266 - protein, 9 aa, Homo Sapiens
FMEIKSFHE

SEQ ID NO: 1073267 - protein, 9 aa, Homo Sapiens
SALGLASAS

SEQ ID NO: 1073268 - protein, 9 aa, Homo Sapiens
LLSRKCGQH

SEQ ID NO: 1073269 - protein, 9 aa, Homo Sapiens
ARRRAAREV

SEQ ID NO: 1073270 - protein, 9 aa, Homo Sapiens
MENTCYVNA

SEQ ID NO: 1073271 - protein, 9 aa, Homo Sapiens
NCSRDQRST

SEQ ID NO: 1073272 - protein, 9 aa, Homo Sapiens
LRLAILGVP

SEQ ID NO: 1073273 - protein, 9 aa, Homo Sapiens
MWFVFRMYR

SEQ ID NO: 1073274 - protein, 9 aa, Homo Sapiens
LNSSQNPYL

SEQ ID NO: 1073275 - protein, 9 aa, Homo Sapiens
HFSTNCEAC

SEQ ID NO: 1073276 - protein, 9 aa, Homo Sapiens
QIKDFTKNV

SEQ ID NO: 1073277 - protein, 9 aa, Homo Sapiens
LFSPNRQPF

SEQ ID NO: 1073278 - protein, 9 aa, Homo Sapiens
FFLFVGFFA

SEQ ID NO: 1073279 - protein, 9 aa, Homo Sapiens
LFPRDASRP

SEQ ID NO: 1073280 - protein, 9 aa, Homo Sapiens
SEDHSSDML

SEQ ID NO: 1073281 - protein, 9 aa, Homo Sapiens
KLARKIILR

SEQ ID NO: 1073282 - protein, 9 aa, Homo Sapiens
CTSGSCLHS

SEQ ID NO: 1073283 - protein, 9 aa, Homo Sapiens
TEMANKHFE

SEQ ID NO: 1073284 - protein, 9 aa, Homo Sapiens
EVVWLKNGL

SEQ ID NO: 1073285 - protein, 9 aa, Homo Sapiens
ISGPGEETF

SEQ ID NO: 1073286 - protein, 9 aa, Homo Sapiens
NTTEMDIQK

SEQ ID NO: 1073287 - protein, 9 aa, Homo Sapiens
IKAGNGTID

SEQ ID NO: 1073288 - protein, 9 aa, Homo Sapiens
TKIVKGLFD

SEQ ID NO: 1073289 - protein, 9 aa, Homo Sapiens
TGVKSYECK

SEQ ID NO: 1073290 - protein, 9 aa, Homo Sapiens
CEECRKAFN

SEQ ID NO: 1073291 - protein, 9 aa, Homo Sapiens
ETGDTFSDV

SEQ ID NO: 1073292 - protein, 9 aa, Homo Sapiens
MRQIYTGLK

SEQ ID NO: 1073293 - protein, 9 aa, Homo Sapiens
QKPEEEIAM

SEQ ID NO: 1073294 - protein, 9 aa, Homo Sapiens
IRYIFNETE

SEQ ID NO: 1073295 - protein, 9 aa, Homo Sapiens
KTKSFLEEK

SEQ ID NO: 1073296 - protein, 9 aa, Homo Sapiens
TRSQAEAES

SEQ ID NO: 1073297 - protein, 9 aa, Homo Sapiens
GFQVARPQF

SEQ ID NO: 1073298 - protein, 9 aa, Homo Sapiens
FIRLLSYMC

SEQ ID NO: 1073299 - protein, 9 aa, Homo Sapiens
VGPFYAVLK

SEQ ID NO: 1073300 - protein, 9 aa, Homo Sapiens
KPPYFFSLL

SEQ ID NO: 1073301 - protein, 9 aa, Homo Sapiens
IAHAGQRVS

SEQ ID NO: 1073302 - protein, 9 aa, Homo Sapiens
LRVASFNDL

SEQ ID NO: 1073303 - protein, 9 aa, Homo Sapiens
GLKVTYAAD

SEQ ID NO: 1073304 - protein, 9 aa, Homo Sapiens
SGDSFSSCS

SEQ ID NO: 1073305 - protein, 9 aa, Homo Sapiens
MEFVDVIES

SEQ ID NO: 1073306 - protein, 9 aa, Homo Sapiens
QILILVLKY

SEQ ID NO: 1073307 - protein, 9 aa, Homo Sapiens
TALRWNYVS

SEQ ID NO: 1073308 - protein, 9 aa, Homo Sapiens
FACGTGSCM

SEQ ID NO: 1073309 - protein, 9 aa, Homo Sapiens
FKDLSLYFV

SEQ ID NO: 1073310 - protein, 9 aa, Homo Sapiens
SRPSFCRTP

SEQ ID NO: 1073311 - protein, 9 aa, Homo Sapiens
DEHSQRLNS

SEQ ID NO: 1073312 - protein, 9 aa, Homo Sapiens
IGNLVGALG

SEQ ID NO: 1073313 - protein, 9 aa, Homo Sapiens
SLLPTVLGH

SEQ ID NO: 1073314 - protein, 9 aa, Homo Sapiens
DVNLEAENN

SEQ ID NO: 1073315 - protein, 9 aa, Homo Sapiens
GDSFSSCSD

SEQ ID NO: 1073316 - protein, 9 aa, Homo Sapiens
LLQSQSMND

SEQ ID NO: 1073317 - protein, 9 aa, Homo Sapiens
RKKGSLPRP

SEQ ID NO: 1073318 - protein, 9 aa, Homo Sapiens
ALGVELFER

SEQ ID NO: 1073319 - protein, 9 aa, Homo Sapiens
PFSTNEPTD

SEQ ID NO: 1073320 - protein, 9 aa, Homo Sapiens
PILKALGTP

SEQ ID NO: 1073321 - protein, 9 aa, Homo Sapiens
RNAGVPPLG

SEQ ID NO: 1073322 - protein, 9 aa, Homo Sapiens
PKTRFQEQE

SEQ ID NO: 1073323 - protein, 9 aa, Homo Sapiens
HKNCMLKKE

SEQ ID NO: 1073324 - protein, 9 aa, Homo Sapiens
QFRASATAK

SEQ ID NO: 1073325 - protein, 9 aa, Homo Sapiens
PVSYKGVTY

SEQ ID NO: 1073326 - protein, 9 aa, Homo Sapiens
RIVGDIWWF

SEQ ID NO: 1073327 - protein, 9 aa, Homo Sapiens
PGLLISNSG

SEQ ID NO: 1073328 - protein, 9 aa, Homo Sapiens
TSAGDQYNC

SEQ ID NO: 1073329 - protein, 9 aa, Homo Sapiens
TISPSLHII

SEQ ID NO: 1073330 - protein, 9 aa, Homo Sapiens
VMAALLVTM

SEQ ID NO: 1073331 - protein, 9 aa, Homo Sapiens
GWSSLDVLL

SEQ ID NO: 1073332 - protein, 9 aa, Homo Sapiens
TTHKKIYTG

SEQ ID NO: 1073333 - protein, 9 aa, Homo Sapiens
MEALSKLDM

SEQ ID NO: 1073334 - protein, 9 aa, Homo Sapiens
EKKEMKISE

SEQ ID NO: 1073335 - protein, 9 aa, Homo Sapiens
VKEVDSTGH

SEQ ID NO: 1073336 - protein, 9 aa, Homo Sapiens
VVLSTNYAN

SEQ ID NO: 1073337 - protein, 9 aa, Homo Sapiens
LASARTTNS

SEQ ID NO: 1073338 - protein, 9 aa, Homo Sapiens
ILKNTKEQR

SEQ ID NO: 1073339 - protein, 9 aa, Homo Sapiens
ISWIGVSVS

SEQ ID NO: 1073340 - protein, 9 aa, Homo Sapiens
LSLFEDTPL

SEQ ID NO: 1073341 - protein, 9 aa, Homo Sapiens
VFIDFQLEN

SEQ ID NO: 1073342 - protein, 9 aa, Homo Sapiens
GMFNSSLYA

SEQ ID NO: 1073343 - protein, 9 aa, Homo Sapiens
KQKRSLKAT

SEQ ID NO: 1073344 - protein, 9 aa, Homo Sapiens
TMRPDLLLK

SEQ ID NO: 1073345 - protein, 9 aa, Homo Sapiens
ISQPIRLRN

SEQ ID NO: 1073346 - protein, 9 aa, Homo Sapiens
YLSFLRVLD

SEQ ID NO: 1073347 - protein, 9 aa, Homo Sapiens
PDCTSWDQL

SEQ ID NO: 1073348 - protein, 9 aa, Homo Sapiens
GNHQNFTVR

SEQ ID NO: 1073349 - protein, 9 aa, Homo Sapiens
LSEGPEDQA

SEQ ID NO: 1073350 - protein, 9 aa, Homo Sapiens
TNTTEILAT

SEQ ID NO: 1073351 - protein, 9 aa, Homo Sapiens
GWSHGYNFW

SEQ ID NO: 1073352 - protein, 9 aa, Homo Sapiens
AHSPPPGTP

SEQ ID NO: 1073353 - protein, 9 aa, Homo Sapiens
RKSCIVGMA

SEQ ID NO: 1073354 - protein, 9 aa, Homo Sapiens
AVAHACNSS

SEQ ID NO: 1073355 - protein, 9 aa, Homo Sapiens
NNFSDSKEG

SEQ ID NO: 1073356 - protein, 9 aa, Homo Sapiens
IRQIYYTEL

SEQ ID NO: 1073357 - protein, 9 aa, Homo Sapiens
SLDLHKGTK

SEQ ID NO: 1073358 - protein, 9 aa, Homo Sapiens
VLEAAGEGL

SEQ ID NO: 1073359 - protein, 9 aa, Homo Sapiens
GLQTPGPPP

SEQ ID NO: 1073360 - protein, 9 aa, Homo Sapiens
GFPHSFLLT

SEQ ID NO: 1073361 - protein, 9 aa, Homo Sapiens
GKGFSRWNN

SEQ ID NO: 1073362 - protein, 9 aa, Homo Sapiens
SWVKSPTGS

SEQ ID NO: 1073363 - protein, 9 aa, Homo Sapiens
KTFEELSRI

SEQ ID NO: 1073364 - protein, 9 aa, Homo Sapiens
SESRGELLL

SEQ ID NO: 1073365 - protein, 9 aa, Homo Sapiens
FPWLNNQEN

SEQ ID NO: 1073366 - protein, 9 aa, Homo Sapiens
LSEDPNWNV

SEQ ID NO: 1073367 - protein, 9 aa, Homo Sapiens
SSAGEVKRS

SEQ ID NO: 1073368 - protein, 9 aa, Homo Sapiens
LDLTYDETI

SEQ ID NO: 1073369 - protein, 9 aa, Homo Sapiens
HVKTWYQNR

SEQ ID NO: 1073370 - protein, 9 aa, Homo Sapiens
DQRPMDEDS

SEQ ID NO: 1073371 - protein, 9 aa, Homo Sapiens
GMIFESYGF

SEQ ID NO: 1073372 - protein, 9 aa, Homo Sapiens
MLIKIIGNL

SEQ ID NO: 1073373 - protein, 9 aa, Homo Sapiens
GPITYSSDI

SEQ ID NO: 1073374 - protein, 9 aa, Homo Sapiens
GEALGGGEE

SEQ ID NO: 1073375 - protein, 9 aa, Homo Sapiens
NRRAKKRKI

SEQ ID NO: 1073376 - protein, 9 aa, Homo Sapiens
LKNFNIKEG

SEQ ID NO: 1073377 - protein, 9 aa, Homo Sapiens
DLGMGVVFS

SEQ ID NO: 1073378 - protein, 9 aa, Homo Sapiens
ASLTASRGL

SEQ ID NO: 1073379 - protein, 9 aa, Homo Sapiens
TESYLQTFL

SEQ ID NO: 1073380 - protein, 9 aa, Homo Sapiens
DPSAQRLYA

SEQ ID NO: 1073381 - protein, 9 aa, Homo Sapiens
ILTKAALSA

SEQ ID NO: 1073382 - protein, 9 aa, Homo Sapiens
KIYFKNVHL

SEQ ID NO: 1073383 - protein, 9 aa, Homo Sapiens
NKENETILS

SEQ ID NO: 1073384 - protein, 9 aa, Homo Sapiens
EGGGRYHRG

SEQ ID NO: 1073385 - protein, 9 aa, Homo Sapiens
GDFGLATEK

SEQ ID NO: 1073386 - protein, 9 aa, Homo Sapiens
KKAYSAAGV

SEQ ID NO: 1073387 - protein, 9 aa, Homo Sapiens
PRSPRLGHQ

SEQ ID NO: 1073388 - protein, 9 aa, Homo Sapiens
VTELAPLGL

SEQ ID NO: 1073389 - protein, 9 aa, Homo Sapiens
QDRQVPEQF

SEQ ID NO: 1073390 - protein, 9 aa, Homo Sapiens
TFSFIARVR

SEQ ID NO: 1073391 - protein, 9 aa, Homo Sapiens
LLPAELEEL

SEQ ID NO: 1073392 - protein, 9 aa, Homo Sapiens
IKKNEKPAV

SEQ ID NO: 1073393 - protein, 9 aa, Homo Sapiens
LIEKKEMKI

SEQ ID NO: 1073394 - protein, 9 aa, Homo Sapiens
ISGVVEFSL

SEQ ID NO: 1073395 - protein, 9 aa, Homo Sapiens
NYWNVGQFF

SEQ ID NO: 1073396 - protein, 9 aa, Homo Sapiens
LSFADSCFL

SEQ ID NO: 1073397 - protein, 9 aa, Homo Sapiens
LKFKYGDLL

SEQ ID NO: 1073398 - protein, 9 aa, Homo Sapiens
VGHLQNLSA

SEQ ID NO: 1073399 - protein, 9 aa, Homo Sapiens
LTKCKIIHT

SEQ ID NO: 1073400 - protein, 9 aa, Homo Sapiens
LDMVQCVLS

SEQ ID NO: 1073401 - protein, 9 aa, Homo Sapiens
LDHRQLHKF

SEQ ID NO: 1073402 - protein, 9 aa, Homo Sapiens
YTLRKDGKK

SEQ ID NO: 1073403 - protein, 9 aa, Homo Sapiens
FEEKQRIIR

SEQ ID NO: 1073404 - protein, 9 aa, Homo Sapiens
EKCGHEKLQ

SEQ ID NO: 1073405 - protein, 9 aa, Homo Sapiens
LCGLLILAS

SEQ ID NO: 1073406 - protein, 9 aa, Homo Sapiens
GRALEENPP

SEQ ID NO: 1073407 - protein, 9 aa, Homo Sapiens
SRKRKGNCS

SEQ ID NO: 1073408 - protein, 9 aa, Homo Sapiens
NWLVVTVPT

SEQ ID NO: 1073409 - protein, 9 aa, Homo Sapiens
ISHELYQPC

SEQ ID NO: 1073410 - protein, 9 aa, Homo Sapiens
ETIFGKSIA

SEQ ID NO: 1073411 - protein, 9 aa, Homo Sapiens
PSNERPGKK

SEQ ID NO: 1073412 - protein, 9 aa, Homo Sapiens
EHQCDPKTG

SEQ ID NO: 1073413 - protein, 9 aa, Homo Sapiens
TLGENNKKK

SEQ ID NO: 1073414 - protein, 9 aa, Homo Sapiens
EVAKVVYRC

SEQ ID NO: 1073415 - protein, 9 aa, Homo Sapiens
VAAGMRPSI

SEQ ID NO: 1073416 - protein, 9 aa, Homo Sapiens
LEILVAEVQ

SEQ ID NO: 1073417 - protein, 9 aa, Homo Sapiens
DHEQLCAFK

SEQ ID NO: 1073418 - protein, 9 aa, Homo Sapiens
FSFIVSVLV

SEQ ID NO: 1073419 - protein, 9 aa, Homo Sapiens
TCVEKKDSK

SEQ ID NO: 1073420 - protein, 9 aa, Homo Sapiens
PSTANYNLF

SEQ ID NO: 1073421 - protein, 9 aa, Homo Sapiens
QEKKIEDVA

SEQ ID NO: 1073422 - protein, 9 aa, Homo Sapiens
VAIIIPEPK

SEQ ID NO: 1073423 - protein, 9 aa, Homo Sapiens
CDSPHSKPG

SEQ ID NO: 1073424 - protein, 9 aa, Homo Sapiens
PETFKKAVK

SEQ ID NO: 1073425 - protein, 9 aa, Homo Sapiens
GSGRGCHVR

SEQ ID NO: 1073426 - protein, 9 aa, Homo Sapiens
RKAFFSKRN

SEQ ID NO: 1073427 - protein, 9 aa, Homo Sapiens
TYPGPAVVF

SEQ ID NO: 1073428 - protein, 9 aa, Homo Sapiens
SNLPKEEKK

SEQ ID NO: 1073429 - protein, 9 aa, Homo Sapiens
KIYTGGKPY

SEQ ID NO: 1073430 - protein, 9 aa, Homo Sapiens
EELLKLARK

SEQ ID NO: 1073431 - protein, 9 aa, Homo Sapiens
CCQKSEVLE

SEQ ID NO: 1073432 - protein, 9 aa, Homo Sapiens
LRLMAGPLV

SEQ ID NO: 1073433 - protein, 9 aa, Homo Sapiens
KIKPRIVGR

SEQ ID NO: 1073434 - protein, 9 aa, Homo Sapiens
LSSAEDNSP

SEQ ID NO: 1073435 - protein, 9 aa, Homo Sapiens
EKSPETFKK

SEQ ID NO: 1073436 - protein, 9 aa, Homo Sapiens
LDPHFVLTE

SEQ ID NO: 1073437 - protein, 9 aa, Homo Sapiens
EKTYQFLQK

SEQ ID NO: 1073438 - protein, 9 aa, Homo Sapiens
LHSHNSSTH

SEQ ID NO: 1073439 - protein, 9 aa, Homo Sapiens
CPARKKAQE

SEQ ID NO: 1073440 - protein, 9 aa, Homo Sapiens
RACLPASCP

SEQ ID NO: 1073441 - protein, 9 aa, Homo Sapiens
WMEVQQTWS

SEQ ID NO: 1073442 - protein, 9 aa, Homo Sapiens
IENEAAKNE

SEQ ID NO: 1073443 - protein, 9 aa, Homo Sapiens
ARISFKTFS

SEQ ID NO: 1073444 - protein, 9 aa, Homo Sapiens
YKGVTYSLT

SEQ ID NO: 1073445 - protein, 9 aa, Homo Sapiens
IKTLRSKMG

SEQ ID NO: 1073446 - protein, 9 aa, Homo Sapiens
VTFVVSFYL

SEQ ID NO: 1073447 - protein, 9 aa, Homo Sapiens
EKRQKQEEM

SEQ ID NO: 1073448 - protein, 9 aa, Homo Sapiens
VIESNARWV

SEQ ID NO: 1073449 - protein, 9 aa, Homo Sapiens
AQEFISFRF

SEQ ID NO: 1073450 - protein, 9 aa, Homo Sapiens
LESEETRFH

SEQ ID NO: 1073451 - protein, 9 aa, Homo Sapiens
LERINVYYI

SEQ ID NO: 1073452 - protein, 9 aa, Homo Sapiens
KHIRTIHLR

SEQ ID NO: 1073453 - protein, 9 aa, Homo Sapiens
SRNEIPEIS

SEQ ID NO: 1073454 - protein, 9 aa, Homo Sapiens
KRWKTRLEL

SEQ ID NO: 1073455 - protein, 9 aa, Homo Sapiens
LRKLGQVVE

SEQ ID NO: 1073456 - protein, 9 aa, Homo Sapiens
VSLNGKLGD

SEQ ID NO: 1073457 - protein, 9 aa, Homo Sapiens
DSFFKFQVV

SEQ ID NO: 1073458 - protein, 9 aa, Homo Sapiens
NVDKALLAK

SEQ ID NO: 1073459 - protein, 9 aa, Homo Sapiens
HENHLLYSH

SEQ ID NO: 1073460 - protein, 9 aa, Homo Sapiens
QECSRDSFK

SEQ ID NO: 1073461 - protein, 9 aa, Homo Sapiens
FLSYAFSFL

SEQ ID NO: 1073462 - protein, 9 aa, Homo Sapiens
ENDTDEENT

SEQ ID NO: 1073463 - protein, 9 aa, Homo Sapiens
VPLTGDSET

SEQ ID NO: 1073464 - protein, 9 aa, Homo Sapiens
SLNNLQDPF

SEQ ID NO: 1073465 - protein, 9 aa, Homo Sapiens
PSPFMRAPG

SEQ ID NO: 1073466 - protein, 9 aa, Homo Sapiens
NLEAENNKT

SEQ ID NO: 1073467 - protein, 9 aa, Homo Sapiens
PKVDNRAVK

SEQ ID NO: 1073468 - protein, 9 aa, Homo Sapiens
ADVVDLFPE

SEQ ID NO: 1073469 - protein, 9 aa, Homo Sapiens
APLGLLLDR

SEQ ID NO: 1073470 - protein, 9 aa, Homo Sapiens
DHQLRSTVK

SEQ ID NO: 1073471 - protein, 9 aa, Homo Sapiens
VADFAPRAD

SEQ ID NO: 1073472 - protein, 9 aa, Homo Sapiens
PSLDYLGTV

SEQ ID NO: 1073473 - protein, 9 aa, Homo Sapiens
NNLLLQERV

SEQ ID NO: 1073474 - protein, 9 aa, Homo Sapiens
ILVSLPWVK

SEQ ID NO: 1073475 - protein, 9 aa, Homo Sapiens
IANWLVVTV

SEQ ID NO: 1073476 - protein, 9 aa, Homo Sapiens
SQFLAFLEP

SEQ ID NO: 1073477 - protein, 9 aa, Homo Sapiens
PSPISPPSP

SEQ ID NO: 1073478 - protein, 9 aa, Homo Sapiens
VDLFPETFE

SEQ ID NO: 1073479 - protein, 9 aa, Homo Sapiens
PKREVRGFS

SEQ ID NO: 1073480 - protein, 9 aa, Homo Sapiens
QGVKRSSGE

SEQ ID NO: 1073481 - protein, 9 aa, Homo Sapiens
KRWKFGWEE

SEQ ID NO: 1073482 - protein, 9 aa, Homo Sapiens
LFSIEPEDQ

SEQ ID NO: 1073483 - protein, 9 aa, Homo Sapiens
SPHSKPGAI

SEQ ID NO: 1073484 - protein, 9 aa, Homo Sapiens
EDSPSPGSS

SEQ ID NO: 1073485 - protein, 9 aa, Homo Sapiens
DINRDGKVN

SEQ ID NO: 1073486 - protein, 9 aa, Homo Sapiens
KPLYHYGQG

SEQ ID NO: 1073487 - protein, 9 aa, Homo Sapiens
VVMSYDCYV

SEQ ID NO: 1073488 - protein, 9 aa, Homo Sapiens
GTYQCEAQD

SEQ ID NO: 1073489 - protein, 9 aa, Homo Sapiens
GFRTPSGEV

SEQ ID NO: 1073490 - protein, 9 aa, Homo Sapiens
FFTQAALLN

SEQ ID NO: 1073491 - protein, 9 aa, Homo Sapiens
YILDWDLDP

SEQ ID NO: 1073492 - protein, 9 aa, Homo Sapiens
AVATGLHTK

SEQ ID NO: 1073493 - protein, 9 aa, Homo Sapiens
NSGKDDCAK

SEQ ID NO: 1073494 - protein, 9 aa, Homo Sapiens
TKCNHSLVK

SEQ ID NO: 1073495 - protein, 9 aa, Homo Sapiens
NLNSACSWF

SEQ ID NO: 1073496 - protein, 9 aa, Homo Sapiens
RLLECGVII

SEQ ID NO: 1073497 - protein, 9 aa, Homo Sapiens
LVQHQLIYT

SEQ ID NO: 1073498 - protein, 9 aa, Homo Sapiens
EHTRPDQDN

SEQ ID NO: 1073499 - protein, 9 aa, Homo Sapiens
PQVPLPSVS

SEQ ID NO: 1073500 - protein, 9 aa, Homo Sapiens
QNLVYSQRK

SEQ ID NO: 1073501 - protein, 9 aa, Homo Sapiens
DTEELSAEE

SEQ ID NO: 1073502 - protein, 9 aa, Homo Sapiens
LSSVEIENQ

SEQ ID NO: 1073503 - protein, 9 aa, Homo Sapiens
LVPTFPFGE

SEQ ID NO: 1073504 - protein, 9 aa, Homo Sapiens
IRDYVMLRL

SEQ ID NO: 1073505 - protein, 9 aa, Homo Sapiens
LHKPRSSFD

SEQ ID NO: 1073506 - protein, 9 aa, Homo Sapiens
GGLVILVIV

SEQ ID NO: 1073507 - protein, 9 aa, Homo Sapiens
AEESKPRFL

SEQ ID NO: 1073508 - protein, 9 aa, Homo Sapiens
DPAAVFFVT

SEQ ID NO: 1073509 - protein, 9 aa, Homo Sapiens
GQSGMFCAI

SEQ ID NO: 1073510 - protein, 9 aa, Homo Sapiens
KDAKHLISS

SEQ ID NO: 1073511 - protein, 9 aa, Homo Sapiens
KFSSKLSEY

SEQ ID NO: 1073512 - protein, 9 aa, Homo Sapiens
YVNAIAIAI

SEQ ID NO: 1073513 - protein, 9 aa, Homo Sapiens
LLQRLIPGS

SEQ ID NO: 1073514 - protein, 9 aa, Homo Sapiens
SFCRTPAWE

SEQ ID NO: 1073515 - protein, 9 aa, Homo Sapiens
EGDPESLDS

SEQ ID NO: 1073516 - protein, 9 aa, Homo Sapiens
TNAQVTYLL

SEQ ID NO: 1073517 - protein, 9 aa, Homo Sapiens
VAFLLSRVL

SEQ ID NO: 1073518 - protein, 9 aa, Homo Sapiens
LKAHFHPKR

SEQ ID NO: 1073519 - protein, 9 aa, Homo Sapiens
RVCDCVEVY

SEQ ID NO: 1073520 - protein, 9 aa, Homo Sapiens
ILFLGSSEG

SEQ ID NO: 1073521 - protein, 9 aa, Homo Sapiens
TQWNRTFKV

SEQ ID NO: 1073522 - protein, 9 aa, Homo Sapiens
SRFSILIKA

SEQ ID NO: 1073523 - protein, 9 aa, Homo Sapiens
RRTVQMNHT

SEQ ID NO: 1073524 - protein, 9 aa, Homo Sapiens
SGPGPSLRL

SEQ ID NO: 1073525 - protein, 9 aa, Homo Sapiens
LLSALLFIV

SEQ ID NO: 1073526 - protein, 9 aa, Homo Sapiens
YDVAVKIVS

SEQ ID NO: 1073527 - protein, 9 aa, Homo Sapiens
VNLPGYFRC

SEQ ID NO: 1073528 - protein, 9 aa, Homo Sapiens
VISTDAFKP

SEQ ID NO: 1073529 - protein, 9 aa, Homo Sapiens
DWANKENPE

SEQ ID NO: 1073530 - protein, 9 aa, Homo Sapiens
SQPSCPARK

SEQ ID NO: 1073531 - protein, 9 aa, Homo Sapiens
SFTNALTQI

SEQ ID NO: 1073532 - protein, 9 aa, Homo Sapiens
SGSRGFFCK

SEQ ID NO: 1073533 - protein, 9 aa, Homo Sapiens
IRNMEKSYV

SEQ ID NO: 1073534 - protein, 9 aa, Homo Sapiens
LPPPSPISP

SEQ ID NO: 1073535 - protein, 9 aa, Homo Sapiens
ENGLSEQKA

SEQ ID NO: 1073536 - protein, 9 aa, Homo Sapiens
LKRRRCAPL

SEQ ID NO: 1073537 - protein, 9 aa, Homo Sapiens
CQKSEVLER

SEQ ID NO: 1073538 - protein, 9 aa, Homo Sapiens
VQFAPPQNG

SEQ ID NO: 1073539 - protein, 9 aa, Homo Sapiens
GSSWQPSPQ

SEQ ID NO: 1073540 - protein, 9 aa, Homo Sapiens
GQCIPSSWV

SEQ ID NO: 1073541 - protein, 9 aa, Homo Sapiens
ENTGTQANV

SEQ ID NO: 1073542 - protein, 9 aa, Homo Sapiens
GGTSAAPPI

SEQ ID NO: 1073543 - protein, 9 aa, Homo Sapiens
NGSCIETSY

SEQ ID NO: 1073544 - protein, 9 aa, Homo Sapiens
PPDALIEPG

SEQ ID NO: 1073545 - protein, 9 aa, Homo Sapiens
GPVGDIGFS

SEQ ID NO: 1073546 - protein, 9 aa, Homo Sapiens
RFKDLSLYF

SEQ ID NO: 1073547 - protein, 9 aa, Homo Sapiens
SPVEVAKVV

SEQ ID NO: 1073548 - protein, 9 aa, Homo Sapiens
HRRHRGLIC

SEQ ID NO: 1073549 - protein, 9 aa, Homo Sapiens
ERLCYNNTF

SEQ ID NO: 1073550 - protein, 9 aa, Homo Sapiens
LPFFCRVKF

SEQ ID NO: 1073551 - protein, 9 aa, Homo Sapiens
WDPKISSEQ

SEQ ID NO: 1073552 - protein, 9 aa, Homo Sapiens
ATSTPSKGS

SEQ ID NO: 1073553 - protein, 9 aa, Homo Sapiens
HGSQIGTLR

SEQ ID NO: 1073554 - protein, 9 aa, Homo Sapiens
ASRGIKKKL

SEQ ID NO: 1073555 - protein, 9 aa, Homo Sapiens
RQGLQTPGP

SEQ ID NO: 1073556 - protein, 9 aa, Homo Sapiens
CITKWKEIV

SEQ ID NO: 1073557 - protein, 9 aa, Homo Sapiens
WAMAVASSS

SEQ ID NO: 1073558 - protein, 9 aa, Homo Sapiens
GFRENQETQ

SEQ ID NO: 1073559 - protein, 9 aa, Homo Sapiens
AQNKGWDSP

SEQ ID NO: 1073560 - protein, 9 aa, Homo Sapiens
RNLFNTSPG

SEQ ID NO: 1073561 - protein, 9 aa, Homo Sapiens
ARPASAPGA

SEQ ID NO: 1073562 - protein, 9 aa, Homo Sapiens
ILTTKESDR

SEQ ID NO: 1073563 - protein, 9 aa, Homo Sapiens
TKGGSDFSL

SEQ ID NO: 1073564 - protein, 9 aa, Homo Sapiens
NRVTVHGAT

SEQ ID NO: 1073565 - protein, 9 aa, Homo Sapiens
TFVYSQLPG

SEQ ID NO: 1073566 - protein, 9 aa, Homo Sapiens
LSQIRQIYY

SEQ ID NO: 1073567 - protein, 9 aa, Homo Sapiens
VGDIGFSGP

SEQ ID NO: 1073568 - protein, 9 aa, Homo Sapiens
LKLLMTLVF

SEQ ID NO: 1073569 - protein, 9 aa, Homo Sapiens
RMVLLCGEI

SEQ ID NO: 1073570 - protein, 9 aa, Homo Sapiens
VFGIAFSSA

SEQ ID NO: 1073571 - protein, 9 aa, Homo Sapiens
TTYFVTVAA

SEQ ID NO: 1073572 - protein, 9 aa, Homo Sapiens
ACYYGHIRL

SEQ ID NO: 1073573 - protein, 9 aa, Homo Sapiens
LDIETKKEL

SEQ ID NO: 1073574 - protein, 9 aa, Homo Sapiens
RRVKKDKDP

SEQ ID NO: 1073575 - protein, 9 aa, Homo Sapiens
ALMMSLPFL

SEQ ID NO: 1073576 - protein, 9 aa, Homo Sapiens
GGKVCYGLI

SEQ ID NO: 1073577 - protein, 9 aa, Homo Sapiens
AEEFGRLGS

SEQ ID NO: 1073578 - protein, 9 aa, Homo Sapiens
AGNGTIDMS

SEQ ID NO: 1073579 - protein, 9 aa, Homo Sapiens
EVSQRKAPP

SEQ ID NO: 1073580 - protein, 9 aa, Homo Sapiens
YGNSSETSS

SEQ ID NO: 1073581 - protein, 9 aa, Homo Sapiens
LEENEICDC

SEQ ID NO: 1073582 - protein, 9 aa, Homo Sapiens
CPLPPPSPI

SEQ ID NO: 1073583 - protein, 9 aa, Homo Sapiens
SPGKLVVEE

SEQ ID NO: 1073584 - protein, 9 aa, Homo Sapiens
WHTGTIFYR

SEQ ID NO: 1073585 - protein, 9 aa, Homo Sapiens
WILQRCQCV

SEQ ID NO: 1073586 - protein, 9 aa, Homo Sapiens
PLPQKPQPF

SEQ ID NO: 1073587 - protein, 9 aa, Homo Sapiens
DNNFSDSKE

SEQ ID NO: 1073588 - protein, 9 aa, Homo Sapiens
SLGGDGRKR

SEQ ID NO: 1073589 - protein, 9 aa, Homo Sapiens
TKNMKLEVV

SEQ ID NO: 1073590 - protein, 9 aa, Homo Sapiens
PPPSAVFPA

SEQ ID NO: 1073591 - protein, 9 aa, Homo Sapiens
TFLAGAAGP

SEQ ID NO: 1073592 - protein, 9 aa, Homo Sapiens
LLEETAGKG

SEQ ID NO: 1073593 - protein, 9 aa, Homo Sapiens
DLNKIAKKI

SEQ ID NO: 1073594 - protein, 9 aa, Homo Sapiens
HVVLGWNLP

SEQ ID NO: 1073595 - protein, 9 aa, Homo Sapiens
ILNLHSPTH

SEQ ID NO: 1073596 - protein, 9 aa, Homo Sapiens
NIYGQKVWG

SEQ ID NO: 1073597 - protein, 9 aa, Homo Sapiens
GKLGFWLAI

SEQ ID NO: 1073598 - protein, 9 aa, Homo Sapiens
RLELPDQTK

SEQ ID NO: 1073599 - protein, 9 aa, Homo Sapiens
KVKAEMKTL

SEQ ID NO: 1073600 - protein, 9 aa, Homo Sapiens
AEGLLGSAQ

SEQ ID NO: 1073601 - protein, 9 aa, Homo Sapiens
IDTIRYIFN

SEQ ID NO: 1073602 - protein, 9 aa, Homo Sapiens
RVKAVLLEA

SEQ ID NO: 1073603 - protein, 9 aa, Homo Sapiens
YTGCTWRFR

SEQ ID NO: 1073604 - protein, 9 aa, Homo Sapiens
QSSQEKVPS

SEQ ID NO: 1073605 - protein, 9 aa, Homo Sapiens
NSGGGSCSQ

SEQ ID NO: 1073606 - protein, 9 aa, Homo Sapiens
ALPHRALSS

SEQ ID NO: 1073607 - protein, 9 aa, Homo Sapiens
FSTVVSTAT

SEQ ID NO: 1073608 - protein, 9 aa, Homo Sapiens
AIIYADLRF

SEQ ID NO: 1073609 - protein, 9 aa, Homo Sapiens
KRPLNEQQK

SEQ ID NO: 1073610 - protein, 9 aa, Homo Sapiens
FRILLDPYQ

SEQ ID NO: 1073611 - protein, 9 aa, Homo Sapiens
YRPILAETY

SEQ ID NO: 1073612 - protein, 9 aa, Homo Sapiens
MVKIIESKH

SEQ ID NO: 1073613 - protein, 9 aa, Homo Sapiens
AAVNGKRQG

SEQ ID NO: 1073614 - protein, 9 aa, Homo Sapiens
LLTYLSGRP

SEQ ID NO: 1073615 - protein, 9 aa, Homo Sapiens
TYDCTATSN

SEQ ID NO: 1073616 - protein, 9 aa, Homo Sapiens
VAEITFDTF

SEQ ID NO: 1073617 - protein, 9 aa, Homo Sapiens
EKQRIIRGS

SEQ ID NO: 1073618 - protein, 9 aa, Homo Sapiens
CRNWSDEAN

SEQ ID NO: 1073619 - protein, 9 aa, Homo Sapiens
ELTEDPDLQ

SEQ ID NO: 1073620 - protein, 9 aa, Homo Sapiens
DVFHTFCQL

SEQ ID NO: 1073621 - protein, 9 aa, Homo Sapiens
KALGVYNRL

SEQ ID NO: 1073622 - protein, 9 aa, Homo Sapiens
YRVNNNLDH

SEQ ID NO: 1073623 - protein, 9 aa, Homo Sapiens
RFKLRRIKA

SEQ ID NO: 1073624 - protein, 9 aa, Homo Sapiens
HIAREVELK

SEQ ID NO: 1073625 - protein, 9 aa, Homo Sapiens
LIEPGIPRH

SEQ ID NO: 1073626 - protein, 9 aa, Homo Sapiens
GSLNYNNKS

SEQ ID NO: 1073627 - protein, 9 aa, Homo Sapiens
NITAATVAP

SEQ ID NO: 1073628 - protein, 9 aa, Homo Sapiens
TYKTLTSDV

SEQ ID NO: 1073629 - protein, 9 aa, Homo Sapiens
ALQEKAAFP

SEQ ID NO: 1073630 - protein, 9 aa, Homo Sapiens
SGPSFLLRY

SEQ ID NO: 1073631 - protein, 9 aa, Homo Sapiens
RDISGPGEE

SEQ ID NO: 1073632 - protein, 9 aa, Homo Sapiens
VSFSPQHLL

SEQ ID NO: 1073633 - protein, 9 aa, Homo Sapiens
VHLFLQMEG

SEQ ID NO: 1073634 - protein, 9 aa, Homo Sapiens
RRSRPSFCR

SEQ ID NO: 1073635 - protein, 9 aa, Homo Sapiens
VVKNQKREG

SEQ ID NO: 1073636 - protein, 9 aa, Homo Sapiens
LWEKMEYSA

SEQ ID NO: 1073637 - protein, 9 aa, Homo Sapiens
SEIMPELNR

SEQ ID NO: 1073638 - protein, 9 aa, Homo Sapiens
AEIFSDIHL

SEQ ID NO: 1073639 - protein, 9 aa, Homo Sapiens
GVSKFQHCG

SEQ ID NO: 1073640 - protein, 9 aa, Homo Sapiens
RPSQKRPWC

SEQ ID NO: 1073641 - protein, 9 aa, Homo Sapiens
KPRFLQELV

SEQ ID NO: 1073642 - protein, 9 aa, Homo Sapiens
LAMKTWLLL

SEQ ID NO: 1073643 - protein, 9 aa, Homo Sapiens
GGKGEKNTM

SEQ ID NO: 1073644 - protein, 9 aa, Homo Sapiens
APAPSFWSW

SEQ ID NO: 1073645 - protein, 9 aa, Homo Sapiens
SPDCQQPAA

SEQ ID NO: 1073646 - protein, 9 aa, Homo Sapiens
FSEPGAIKV

SEQ ID NO: 1073647 - protein, 9 aa, Homo Sapiens
YQCEAQDAL

SEQ ID NO: 1073648 - protein, 9 aa, Homo Sapiens
VKNILTTKE

SEQ ID NO: 1073649 - protein, 9 aa, Homo Sapiens
NRLSHPNNL

SEQ ID NO: 1073650 - protein, 9 aa, Homo Sapiens
EGKPSCKRL

SEQ ID NO: 1073651 - protein, 9 aa, Homo Sapiens
ETSTPGRNA

SEQ ID NO: 1073652 - protein, 9 aa, Homo Sapiens
IPSSWVCDQ

SEQ ID NO: 1073653 - protein, 9 aa, Homo Sapiens
AVNESSFVS

SEQ ID NO: 1073654 - protein, 9 aa, Homo Sapiens
KKVVVHLDT

SEQ ID NO: 1073655 - protein, 9 aa, Homo Sapiens
SHDVGKEIR

SEQ ID NO: 1073656 - protein, 9 aa, Homo Sapiens
LENPIQKKS

SEQ ID NO: 1073657 - protein, 9 aa, Homo Sapiens
TKDLGAPGV

SEQ ID NO: 1073658 - protein, 9 aa, Homo Sapiens
SCSQSGSSG

SEQ ID NO: 1073659 - protein, 9 aa, Homo Sapiens
PPEPTLWIR

SEQ ID NO: 1073660 - protein, 9 aa, Homo Sapiens
LSQGGHPEN

SEQ ID NO: 1073661 - protein, 9 aa, Homo Sapiens
GGPARISFK

SEQ ID NO: 1073662 - protein, 9 aa, Homo Sapiens
QSPEGGNPS

SEQ ID NO: 1073663 - protein, 9 aa, Homo Sapiens
GLYACSVCN

SEQ ID NO: 1073664 - protein, 9 aa, Homo Sapiens
PASHDVGKE

SEQ ID NO: 1073665 - protein, 9 aa, Homo Sapiens
ALLPPAEPL

SEQ ID NO: 1073666 - protein, 9 aa, Homo Sapiens
LYIHSLAPI

SEQ ID NO: 1073667 - protein, 9 aa, Homo Sapiens
IASTPSSPS

SEQ ID NO: 1073668 - protein, 9 aa, Homo Sapiens
GKEDEEGEE

SEQ ID NO: 1073669 - protein, 9 aa, Homo Sapiens
KVESALVEH

SEQ ID NO: 1073670 - protein, 9 aa, Homo Sapiens
LEELCPKGS

SEQ ID NO: 1073671 - protein, 9 aa, Homo Sapiens
DTGCRELVW

SEQ ID NO: 1073672 - protein, 9 aa, Homo Sapiens
VVDLFPETF

SEQ ID NO: 1073673 - protein, 9 aa, Homo Sapiens
IYADLRFVK

SEQ ID NO: 1073674 - protein, 9 aa, Homo Sapiens
CHLHTVSQI

SEQ ID NO: 1073675 - protein, 9 aa, Homo Sapiens
RPPGPAFQS

SEQ ID NO: 1073676 - protein, 9 aa, Homo Sapiens
HQKISFGDN

SEQ ID NO: 1073677 - protein, 9 aa, Homo Sapiens
LQKLQHVAQ

SEQ ID NO: 1073678 - protein, 9 aa, Homo Sapiens
QFQENRSSA

SEQ ID NO: 1073679 - protein, 9 aa, Homo Sapiens
RPRGGSHDA

SEQ ID NO: 1073680 - protein, 9 aa, Homo Sapiens
SNSQVFALS

SEQ ID NO: 1073681 - protein, 9 aa, Homo Sapiens
LPGTSNSML

SEQ ID NO: 1073682 - protein, 9 aa, Homo Sapiens
SSKRANICP

SEQ ID NO: 1073683 - protein, 9 aa, Homo Sapiens
NGGGQSGMF

SEQ ID NO: 1073684 - protein, 9 aa, Homo Sapiens
DGQCLLNTQ

SEQ ID NO: 1073685 - protein, 9 aa, Homo Sapiens
TDGDGRVVK

SEQ ID NO: 1073686 - protein, 9 aa, Homo Sapiens
VLPGLISRA

SEQ ID NO: 1073687 - protein, 9 aa, Homo Sapiens
DDDFEIGNF

SEQ ID NO: 1073688 - protein, 9 aa, Homo Sapiens
LMSNYSLPS

SEQ ID NO: 1073689 - protein, 9 aa, Homo Sapiens
NEVRFISLK

SEQ ID NO: 1073690 - protein, 9 aa, Homo Sapiens
SMDSFVVPL

SEQ ID NO: 1073691 - protein, 9 aa, Homo Sapiens
GLTQLHVKT

SEQ ID NO: 1073692 - protein, 9 aa, Homo Sapiens
PSFTISKAI

SEQ ID NO: 1073693 - protein, 9 aa, Homo Sapiens
TFTQKMGMT

SEQ ID NO: 1073694 - protein, 9 aa, Homo Sapiens
FGKFVEIQF

SEQ ID NO: 1073695 - protein, 9 aa, Homo Sapiens
MKTWLLLAV

SEQ ID NO: 1073696 - protein, 9 aa, Homo Sapiens
FHLAQEDVL

SEQ ID NO: 1073697 - protein, 9 aa, Homo Sapiens
KENSPSNMS

SEQ ID NO: 1073698 - protein, 9 aa, Homo Sapiens
SQREKKKLE

SEQ ID NO: 1073699 - protein, 9 aa, Homo Sapiens
DDFNERPAK

SEQ ID NO: 1073700 - protein, 9 aa, Homo Sapiens
KFSSPSHLL

SEQ ID NO: 1073701 - protein, 9 aa, Homo Sapiens
SNGYRDHSE

SEQ ID NO: 1073702 - protein, 9 aa, Homo Sapiens
YTGVKPYEC

SEQ ID NO: 1073703 - protein, 9 aa, Homo Sapiens
FHHGENKQN

SEQ ID NO: 1073704 - protein, 9 aa, Homo Sapiens
FSDPGVLSR

SEQ ID NO: 1073705 - protein, 9 aa, Homo Sapiens
YNFLTVKKF

SEQ ID NO: 1073706 - protein, 9 aa, Homo Sapiens
ALASGTRLV

SEQ ID NO: 1073707 - protein, 9 aa, Homo Sapiens
KIIESKHFQ

SEQ ID NO: 1073708 - protein, 9 aa, Homo Sapiens
DICPTNCHV

SEQ ID NO: 1073709 - protein, 9 aa, Homo Sapiens
MEKKIQHIL

SEQ ID NO: 1073710 - protein, 9 aa, Homo Sapiens
PGGPSFTIS

SEQ ID NO: 1073711 - protein, 9 aa, Homo Sapiens
GNYFFDGPS

SEQ ID NO: 1073712 - protein, 9 aa, Homo Sapiens
DLNLGVFNN

SEQ ID NO: 1073713 - protein, 9 aa, Homo Sapiens
SLALDINEL

SEQ ID NO: 1073714 - protein, 9 aa, Homo Sapiens
GTRLVLVLE

SEQ ID NO: 1073715 - protein, 9 aa, Homo Sapiens
EDGQIDQFH

SEQ ID NO: 1073716 - protein, 9 aa, Homo Sapiens
RYILDWDLD

SEQ ID NO: 1073717 - protein, 9 aa, Homo Sapiens
GVRLWEIVS

SEQ ID NO: 1073718 - protein, 9 aa, Homo Sapiens
SQEGVVDCA

SEQ ID NO: 1073719 - protein, 9 aa, Homo Sapiens
QSGMFCAIG

SEQ ID NO: 1073720 - protein, 9 aa, Homo Sapiens
IARKRRQSQ

SEQ ID NO: 1073721 - protein, 9 aa, Homo Sapiens
GLPHPRSSA

SEQ ID NO: 1073722 - protein, 9 aa, Homo Sapiens
EEPVSYKGV

SEQ ID NO: 1073723 - protein, 9 aa, Homo Sapiens
NSQVFALSW

SEQ ID NO: 1073724 - protein, 9 aa, Homo Sapiens
REKFRKKII

SEQ ID NO: 1073725 - protein, 9 aa, Homo Sapiens
SLNGKLGDS

SEQ ID NO: 1073726 - protein, 9 aa, Homo Sapiens
PPFMAAAVA

SEQ ID NO: 1073727 - protein, 9 aa, Homo Sapiens
PPTVKETLA

SEQ ID NO: 1073728 - protein, 9 aa, Homo Sapiens
KKDIARKRR

SEQ ID NO: 1073729 - protein, 9 aa, Homo Sapiens
EDPEEEEPV

SEQ ID NO: 1073730 - protein, 9 aa, Homo Sapiens
LLPSSGGGL

SEQ ID NO: 1073731 - protein, 9 aa, Homo Sapiens
SCSRLVILL

SEQ ID NO: 1073732 - protein, 9 aa, Homo Sapiens
YEMAAGYLP

SEQ ID NO: 1073733 - protein, 9 aa, Homo Sapiens
KKLFLDNSQ

SEQ ID NO: 1073734 - protein, 9 aa, Homo Sapiens
QTPSPAFCL

SEQ ID NO: 1073735 - protein, 9 aa, Homo Sapiens
NLQDPFLKN

SEQ ID NO: 1073736 - protein, 9 aa, Homo Sapiens
GRWFWEFVI

SEQ ID NO: 1073737 - protein, 9 aa, Homo Sapiens
VLELEERVR

SEQ ID NO: 1073738 - protein, 9 aa, Homo Sapiens
SNAHLNSSQ

SEQ ID NO: 1073739 - protein, 9 aa, Homo Sapiens
EQLVQVVHD

SEQ ID NO: 1073740 - protein, 9 aa, Homo Sapiens
FVFCPPDPH

SEQ ID NO: 1073741 - protein, 9 aa, Homo Sapiens
GDHDDSAIK

SEQ ID NO: 1073742 - protein, 9 aa, Homo Sapiens
QELLEDGQI

SEQ ID NO: 1073743 - protein, 9 aa, Homo Sapiens
SFSYCKSYV

SEQ ID NO: 1073744 - protein, 9 aa, Homo Sapiens
QSPQQIVHL

SEQ ID NO: 1073745 - protein, 9 aa, Homo Sapiens
YNNTFESLV

SEQ ID NO: 1073746 - protein, 9 aa, Homo Sapiens
SSETSSEAS

SEQ ID NO: 1073747 - protein, 9 aa, Homo Sapiens
SPLLKRVQF

SEQ ID NO: 1073748 - protein, 9 aa, Homo Sapiens
EEEEQPLPE

SEQ ID NO: 1073749 - protein, 9 aa, Homo Sapiens
PTKKEESLL

SEQ ID NO: 1073750 - protein, 9 aa, Homo Sapiens
LSFCLTSDL

SEQ ID NO: 1073751 - protein, 9 aa, Homo Sapiens
HIQDALPKD

SEQ ID NO: 1073752 - protein, 9 aa, Homo Sapiens
NKVAYCPLM

SEQ ID NO: 1073753 - protein, 9 aa, Homo Sapiens
DSAIKTLRS

SEQ ID NO: 1073754 - protein, 9 aa, Homo Sapiens
FPPSLITAV

SEQ ID NO: 1073755 - protein, 9 aa, Homo Sapiens
HRSYKLRPD

SEQ ID NO: 1073756 - protein, 9 aa, Homo Sapiens
RPSCCRTTC

SEQ ID NO: 1073757 - protein, 9 aa, Homo Sapiens
AKGKPGDAG

SEQ ID NO: 1073758 - protein, 9 aa, Homo Sapiens
DCLNRVIIP

SEQ ID NO: 1073759 - protein, 9 aa, Homo Sapiens
VNYYIDPAD

SEQ ID NO: 1073760 - protein, 9 aa, Homo Sapiens
PVNTHQEQI

SEQ ID NO: 1073761 - protein, 9 aa, Homo Sapiens
VQKELIIFN

SEQ ID NO: 1073762 - protein, 9 aa, Homo Sapiens
SRGTYKTLT

SEQ ID NO: 1073763 - protein, 9 aa, Homo Sapiens
KFCGKTFKF

SEQ ID NO: 1073764 - protein, 9 aa, Homo Sapiens
RVQVWFKNC

SEQ ID NO: 1073765 - protein, 9 aa, Homo Sapiens
KKCGKLQTI

SEQ ID NO: 1073766 - protein, 9 aa, Homo Sapiens
ERNVCGGQC

SEQ ID NO: 1073767 - protein, 9 aa, Homo Sapiens
IEWLEFRKP

SEQ ID NO: 1073768 - protein, 9 aa, Homo Sapiens
IYVGDFVRL

SEQ ID NO: 1073769 - protein, 9 aa, Homo Sapiens
TSSLERRKK

SEQ ID NO: 1073770 - protein, 9 aa, Homo Sapiens
NSFMRVREK

SEQ ID NO: 1073771 - protein, 9 aa, Homo Sapiens
DERPKTRFQ

SEQ ID NO: 1073772 - protein, 9 aa, Homo Sapiens
PEYLDAIGG

SEQ ID NO: 1073773 - protein, 9 aa, Homo Sapiens
APKVKAEMK

SEQ ID NO: 1073774 - protein, 9 aa, Homo Sapiens
TLEEKLAPT

SEQ ID NO: 1073775 - protein, 9 aa, Homo Sapiens
FWVERQTEG

SEQ ID NO: 1073776 - protein, 9 aa, Homo Sapiens
DEKLDYRKQ

SEQ ID NO: 1073777 - protein, 9 aa, Homo Sapiens
PQEETLDIS

SEQ ID NO: 1073778 - protein, 9 aa, Homo Sapiens
KKTDAHFVD

SEQ ID NO: 1073779 - protein, 9 aa, Homo Sapiens
LLGSPAGSF

SEQ ID NO: 1073780 - protein, 9 aa, Homo Sapiens
ETHCTLLSV

SEQ ID NO: 1073781 - protein, 9 aa, Homo Sapiens
NSNAHLNSS

SEQ ID NO: 1073782 - protein, 9 aa, Homo Sapiens
GAFSLEVPW

SEQ ID NO: 1073783 - protein, 9 aa, Homo Sapiens
YKQILKMIR

SEQ ID NO: 1073784 - protein, 9 aa, Homo Sapiens
KEVDSTGHS

SEQ ID NO: 1073785 - protein, 9 aa, Homo Sapiens
GPREDQGQD

SEQ ID NO: 1073786 - protein, 9 aa, Homo Sapiens
VFFVTNFTI

SEQ ID NO: 1073787 - protein, 9 aa, Homo Sapiens
IYYNIVLVP

SEQ ID NO: 1073788 - protein, 9 aa, Homo Sapiens
FSSSAPKLI

SEQ ID NO: 1073789 - protein, 9 aa, Homo Sapiens
NVTWLRNGA

SEQ ID NO: 1073790 - protein, 9 aa, Homo Sapiens
PIFSGQQIF

SEQ ID NO: 1073791 - protein, 9 aa, Homo Sapiens
FSYPVVSKG

SEQ ID NO: 1073792 - protein, 9 aa, Homo Sapiens
FLVLILSGK

SEQ ID NO: 1073793 - protein, 9 aa, Homo Sapiens
EETILSVDE

SEQ ID NO: 1073794 - protein, 9 aa, Homo Sapiens
TPPPYSFTP

SEQ ID NO: 1073795 - protein, 9 aa, Homo Sapiens
DPTLKCFDE

SEQ ID NO: 1073796 - protein, 9 aa, Homo Sapiens
EDKILHFAV

SEQ ID NO: 1073797 - protein, 9 aa, Homo Sapiens
VPSSNPPRY

SEQ ID NO: 1073798 - protein, 9 aa, Homo Sapiens
SGGSTNSSL

SEQ ID NO: 1073799 - protein, 9 aa, Homo Sapiens
ILEGYRPIL

SEQ ID NO: 1073800 - protein, 9 aa, Homo Sapiens
ESQKVSQPS

SEQ ID NO: 1073801 - protein, 9 aa, Homo Sapiens
HSDTFISLL

SEQ ID NO: 1073802 - protein, 9 aa, Homo Sapiens
KVAMKKLSR

SEQ ID NO: 1073803 - protein, 9 aa, Homo Sapiens
QNALCTPHS

SEQ ID NO: 1073804 - protein, 9 aa, Homo Sapiens
AGVPKGSPR

SEQ ID NO: 1073805 - protein, 9 aa, Homo Sapiens
LRFKNIRKK

SEQ ID NO: 1073806 - protein, 8 aa, Homo Sapiens
EAVSRVFP

SEQ ID NO: 1073807 - protein, 9 aa, Homo Sapiens
ADAELPRPL

SEQ ID NO: 1073808 - protein, 9 aa, Homo Sapiens
EQKLFIRHI

SEQ ID NO: 1073809 - protein, 9 aa, Homo Sapiens
EGSVLLQNL

SEQ ID NO: 1073810 - protein, 9 aa, Homo Sapiens
LKELGGERI

SEQ ID NO: 1073811 - protein, 9 aa, Homo Sapiens
FNHNVLGKN

SEQ ID NO: 1073812 - protein, 9 aa, Homo Sapiens
SCADGQCLL

SEQ ID NO: 1073813 - protein, 9 aa, Homo Sapiens
LKIVHSNWN

SEQ ID NO: 1073814 - protein, 9 aa, Homo Sapiens
DSSCVWVGW

SEQ ID NO: 1073815 - protein, 9 aa, Homo Sapiens
LMAGPLVLV

SEQ ID NO: 1073816 - protein, 9 aa, Homo Sapiens
KDSVLNIAT

SEQ ID NO: 1073817 - protein, 9 aa, Homo Sapiens
QKNVYFLQN

SEQ ID NO: 1073818 - protein, 9 aa, Homo Sapiens
IREEEKRQK

SEQ ID NO: 1073819 - protein, 9 aa, Homo Sapiens
IFHLKKERD

SEQ ID NO: 1073820 - protein, 9 aa, Homo Sapiens
ELEHFPGLP

SEQ ID NO: 1073821 - protein, 9 aa, Homo Sapiens
ERFKLRRIK

SEQ ID NO: 1073822 - protein, 9 aa, Homo Sapiens
LAQDARYRL

SEQ ID NO: 1073823 - protein, 9 aa, Homo Sapiens
TVSWDPKIS

SEQ ID NO: 1073824 - protein, 9 aa, Homo Sapiens
DEEGEEQGN

SEQ ID NO: 1073825 - protein, 9 aa, Homo Sapiens
FFKAVHTGM

SEQ ID NO: 1073826 - protein, 9 aa, Homo Sapiens
ISPPSASLV

SEQ ID NO: 1073827 - protein, 9 aa, Homo Sapiens
NSETLFFTQ

SEQ ID NO: 1073828 - protein, 9 aa, Homo Sapiens
NFENLNGHM

SEQ ID NO: 1073829 - protein, 9 aa, Homo Sapiens
LILASWFII

SEQ ID NO: 1073830 - protein, 9 aa, Homo Sapiens
PDLLLKMTL

SEQ ID NO: 1073831 - protein, 9 aa, Homo Sapiens
MTRTCTSSG

SEQ ID NO: 1073832 - protein, 9 aa, Homo Sapiens
LLLKMTLGG

SEQ ID NO: 1073833 - protein, 9 aa, Homo Sapiens
ENIAPTTDV

SEQ ID NO: 1073834 - protein, 9 aa, Homo Sapiens
PWCSATAQR

SEQ ID NO: 1073835 - protein, 9 aa, Homo Sapiens
LDYKGIHSG

SEQ ID NO: 1073836 - protein, 9 aa, Homo Sapiens
FHLKKERDR

SEQ ID NO: 1073837 - protein, 9 aa, Homo Sapiens
EKSYVNLNH

SEQ ID NO: 1073838 - protein, 9 aa, Homo Sapiens
QESSKIPKS

SEQ ID NO: 1073839 - protein, 9 aa, Homo Sapiens
KWDSTNPFS

SEQ ID NO: 1073840 - protein, 9 aa, Homo Sapiens
ELYNTKQGQ

SEQ ID NO: 1073841 - protein, 9 aa, Homo Sapiens
GVPMPDKYF

SEQ ID NO: 1073842 - protein, 9 aa, Homo Sapiens
IKENSPSNM

SEQ ID NO: 1073843 - protein, 9 aa, Homo Sapiens
KGGSLVGRN

SEQ ID NO: 1073844 - protein, 9 aa, Homo Sapiens
EQKPEEEIA

SEQ ID NO: 1073845 - protein, 9 aa, Homo Sapiens
TFHLAQEDV

SEQ ID NO: 1073846 - protein, 9 aa, Homo Sapiens
LLGGFQGCL

SEQ ID NO: 1073847 - protein, 9 aa, Homo Sapiens
QLWVELVVA

SEQ ID NO: 1073848 - protein, 9 aa, Homo Sapiens
ILCSYGRVL

SEQ ID NO: 1073849 - protein, 9 aa, Homo Sapiens
SFSENAAAS

SEQ ID NO: 1073850 - protein, 9 aa, Homo Sapiens
NFWVERQTE

SEQ ID NO: 1073851 - protein, 9 aa, Homo Sapiens
PPYFFSLLI

SEQ ID NO: 1073852 - protein, 9 aa, Homo Sapiens
SEDPNWNVT

SEQ ID NO: 1073853 - protein, 9 aa, Homo Sapiens
EMANKHFEI

SEQ ID NO: 1073854 - protein, 9 aa, Homo Sapiens
SAGDQYNCS

SEQ ID NO: 1073855 - protein, 9 aa, Homo Sapiens
RSGSPNQKL

SEQ ID NO: 1073856 - protein, 9 aa, Homo Sapiens
YAFSFLLQE

SEQ ID NO: 1073857 - protein, 9 aa, Homo Sapiens
ATYAYKGND

SEQ ID NO: 1073858 - protein, 9 aa, Homo Sapiens
LMAYSFQSP

SEQ ID NO: 1073859 - protein, 9 aa, Homo Sapiens
KREKGIKGI

SEQ ID NO: 1073860 - protein, 9 aa, Homo Sapiens
SPPTPKLRP

SEQ ID NO: 1073861 - protein, 9 aa, Homo Sapiens
FAGDDVPRA

SEQ ID NO: 1073862 - protein, 9 aa, Homo Sapiens
IKTEFENII

SEQ ID NO: 1073863 - protein, 9 aa, Homo Sapiens
KFISELRDN

SEQ ID NO: 1073864 - protein, 9 aa, Homo Sapiens
AGATREDKV

SEQ ID NO: 1073865 - protein, 9 aa, Homo Sapiens
FRLHAQYRP

SEQ ID NO: 1073866 - protein, 9 aa, Homo Sapiens
GQTFFFKKD

SEQ ID NO: 1073867 - protein, 9 aa, Homo Sapiens
LLVSLPTKK

SEQ ID NO: 1073868 - protein, 9 aa, Homo Sapiens
SFSLNHVPD

SEQ ID NO: 1073869 - protein, 9 aa, Homo Sapiens
EAIASFVKT

SEQ ID NO: 1073870 - protein, 9 aa, Homo Sapiens
FFQPERILF

SEQ ID NO: 1073871 - protein, 9 aa, Homo Sapiens
EHQRIYTGE

SEQ ID NO: 1073872 - protein, 9 aa, Homo Sapiens
IDQFHKALI

SEQ ID NO: 1073873 - protein, 9 aa, Homo Sapiens
LFDVEQNFH

SEQ ID NO: 1073874 - protein, 9 aa, Homo Sapiens
DVVNKTLKA

SEQ ID NO: 1073875 - protein, 9 aa, Homo Sapiens
SNKVYELAQ

SEQ ID NO: 1073876 - protein, 9 aa, Homo Sapiens
PIASIACSP

SEQ ID NO: 1073877 - protein, 9 aa, Homo Sapiens
LPFCGHCII

SEQ ID NO: 1073878 - protein, 9 aa, Homo Sapiens
ECKNASVFI

SEQ ID NO: 1073879 - protein, 9 aa, Homo Sapiens
ISAAAAFRH

SEQ ID NO: 1073880 - protein, 9 aa, Homo Sapiens
TFNPEFVHG

SEQ ID NO: 1073881 - protein, 9 aa, Homo Sapiens
SIDNSQDKL

SEQ ID NO: 1073882 - protein, 9 aa, Homo Sapiens
VTVNFENLN

SEQ ID NO: 1073883 - protein, 9 aa, Homo Sapiens
AKKRKINKK

SEQ ID NO: 1073884 - protein, 9 aa, Homo Sapiens
KAKSMEEFQ

SEQ ID NO: 1073885 - protein, 9 aa, Homo Sapiens
TYEKCGHEK

SEQ ID NO: 1073886 - protein, 9 aa, Homo Sapiens
IETKKELDS

SEQ ID NO: 1073887 - protein, 9 aa, Homo Sapiens
APHPEGLAE

SEQ ID NO: 1073888 - protein, 9 aa, Homo Sapiens
PWHCRVEQG

SEQ ID NO: 1073889 - protein, 9 aa, Homo Sapiens
WTVSQTGPV

SEQ ID NO: 1073890 - protein, 9 aa, Homo Sapiens
ASSYRLDLD

SEQ ID NO: 1073891 - protein, 9 aa, Homo Sapiens
TSILLGPGA

SEQ ID NO: 1073892 - protein, 9 aa, Homo Sapiens
SPFCSPFKN

SEQ ID NO: 1073893 - protein, 9 aa, Homo Sapiens
KIQFFLGGA

SEQ ID NO: 1073894 - protein, 9 aa, Homo Sapiens
DSGTGMGSS

SEQ ID NO: 1073895 - protein, 9 aa, Homo Sapiens
DGYKVAAAE

SEQ ID NO: 1073896 - protein, 9 aa, Homo Sapiens
ESEVEKPLS

SEQ ID NO: 1073897 - protein, 9 aa, Homo Sapiens
GQMIWIESM

SEQ ID NO: 1073898 - protein, 9 aa, Homo Sapiens
TGSRVTRRQ

SEQ ID NO: 1073899 - protein, 9 aa, Homo Sapiens
PFEGPQQSG

SEQ ID NO: 1073900 - protein, 9 aa, Homo Sapiens
HSYHSSSDA

SEQ ID NO: 1073901 - protein, 9 aa, Homo Sapiens
WTFDCSRSG

SEQ ID NO: 1073902 - protein, 9 aa, Homo Sapiens
QHDLNLGVF

SEQ ID NO: 1073903 - protein, 9 aa, Homo Sapiens
ALPKNVKLA

SEQ ID NO: 1073904 - protein, 9 aa, Homo Sapiens
SLVQTVTSA

SEQ ID NO: 1073905 - protein, 9 aa, Homo Sapiens
FFRASGNLV

SEQ ID NO: 1073906 - protein, 9 aa, Homo Sapiens
DESVLFMHK

SEQ ID NO: 1073907 - protein, 9 aa, Homo Sapiens
RLNSQSTSY

SEQ ID NO: 1073908 - protein, 9 aa, Homo Sapiens
PPCSISRDR

SEQ ID NO: 1073909 - protein, 9 aa, Homo Sapiens
DTFVYSQLP

SEQ ID NO: 1073910 - protein, 9 aa, Homo Sapiens
EVVIKRLAR

SEQ ID NO: 1073911 - protein, 9 aa, Homo Sapiens
SSDNSSFHH

SEQ ID NO: 1073912 - protein, 9 aa, Homo Sapiens
KAVLLEATF

SEQ ID NO: 1073913 - protein, 9 aa, Homo Sapiens
TFCQLDRLL

SEQ ID NO: 1073914 - protein, 9 aa, Homo Sapiens
CWQLENIAQ

SEQ ID NO: 1073915 - protein, 9 aa, Homo Sapiens
EKLAPTDVG

SEQ ID NO: 1073916 - protein, 9 aa, Homo Sapiens
IDEYEKSWR

SEQ ID NO: 1073917 - protein, 9 aa, Homo Sapiens
IMGSEGILG

SEQ ID NO: 1073918 - protein, 9 aa, Homo Sapiens
DSYALLGKL

SEQ ID NO: 1073919 - protein, 9 aa, Homo Sapiens
KVNDESTEG

SEQ ID NO: 1073920 - protein, 9 aa, Homo Sapiens
PTLWIRTHL

SEQ ID NO: 1073921 - protein, 9 aa, Homo Sapiens
DMKNQREEN

SEQ ID NO: 1073922 - protein, 9 aa, Homo Sapiens
PRTYEKCGH

SEQ ID NO: 1073923 - protein, 9 aa, Homo Sapiens
KNSKRLSSL

SEQ ID NO: 1073924 - protein, 9 aa, Homo Sapiens
RWACTSCWA

SEQ ID NO: 1073925 - protein, 9 aa, Homo Sapiens
ARLHGFSIL

SEQ ID NO: 1073926 - protein, 9 aa, Homo Sapiens
GSSWSSADS

SEQ ID NO: 1073927 - protein, 9 aa, Homo Sapiens
EFLQGADHR

SEQ ID NO: 1073928 - protein, 9 aa, Homo Sapiens
SRGMVEIEF

SEQ ID NO: 1073929 - protein, 9 aa, Homo Sapiens
RQFNLIPQR

SEQ ID NO: 1073930 - protein, 9 aa, Homo Sapiens
AELSTVLSS

SEQ ID NO: 1073931 - protein, 9 aa, Homo Sapiens
LMYIISNGI

SEQ ID NO: 1073932 - protein, 9 aa, Homo Sapiens
IRYLIKFSS

SEQ ID NO: 1073933 - protein, 9 aa, Homo Sapiens
CPKGSCVCG

SEQ ID NO: 1073934 - protein, 9 aa, Homo Sapiens
YTLLTLPND

SEQ ID NO: 1073935 - protein, 9 aa, Homo Sapiens
VSKISDILQ

SEQ ID NO: 1073936 - protein, 9 aa, Homo Sapiens
HKEEEATSM

SEQ ID NO: 1073937 - protein, 9 aa, Homo Sapiens
LKTEYEFDS

SEQ ID NO: 1073938 - protein, 9 aa, Homo Sapiens
TDVLIEIKN

SEQ ID NO: 1073939 - protein, 9 aa, Homo Sapiens
SDTWSHSQF

SEQ ID NO: 1073940 - protein, 9 aa, Homo Sapiens
SSYDRTAWV

SEQ ID NO: 1073941 - protein, 9 aa, Homo Sapiens
ALRVPSLDY

SEQ ID NO: 1073942 - protein, 9 aa, Homo Sapiens
QNLQTEGVN

SEQ ID NO: 1073943 - protein, 9 aa, Homo Sapiens
GEAMGWVFV

SEQ ID NO: 1073944 - protein, 9 aa, Homo Sapiens
VKSINEARY

SEQ ID NO: 1073945 - protein, 9 aa, Homo Sapiens
RTRSVNKLT

SEQ ID NO: 1073946 - protein, 9 aa, Homo Sapiens
VFRMYRVKG

SEQ ID NO: 1073947 - protein, 9 aa, Homo Sapiens
QKAQKKIWM

SEQ ID NO: 1073948 - protein, 9 aa, Homo Sapiens
YPCFVSRPC

SEQ ID NO: 1073949 - protein, 9 aa, Homo Sapiens
TLTSCAGVS

SEQ ID NO: 1073950 - protein, 9 aa, Homo Sapiens
LLVDDEEDE

SEQ ID NO: 1073951 - protein, 9 aa, Homo Sapiens
QEYYRGQNN

SEQ ID NO: 1073952 - protein, 9 aa, Homo Sapiens
SLGGSAAAV

SEQ ID NO: 1073953 - protein, 9 aa, Homo Sapiens
LKAKLNFFK

SEQ ID NO: 1073954 - protein, 9 aa, Homo Sapiens
RQVPVLGKE

SEQ ID NO: 1073955 - protein, 9 aa, Homo Sapiens
YGDLLMYII

SEQ ID NO: 1073956 - protein, 9 aa, Homo Sapiens
KKALDYIKN

SEQ ID NO: 1073957 - protein, 9 aa, Homo Sapiens
KVCKPNGKS

SEQ ID NO: 1073958 - protein, 9 aa, Homo Sapiens
PRQLSAACF

SEQ ID NO: 1073959 - protein, 9 aa, Homo Sapiens
NWNFLIFEL

SEQ ID NO: 1073960 - protein, 9 aa, Homo Sapiens
LFFLGPSTW

SEQ ID NO: 1073961 - protein, 9 aa, Homo Sapiens
AASLSAQNK

SEQ ID NO: 1073962 - protein, 9 aa, Homo Sapiens
DPQSREPLP

SEQ ID NO: 1073963 - protein, 9 aa, Homo Sapiens
YPASWRSEE

SEQ ID NO: 1073964 - protein, 9 aa, Homo Sapiens
APGRDKAAP

SEQ ID NO: 1073965 - protein, 9 aa, Homo Sapiens
VNTTEMDIQ

SEQ ID NO: 1073966 - protein, 9 aa, Homo Sapiens
SRIHDPKLH

SEQ ID NO: 1073967 - protein, 9 aa, Homo Sapiens
LTSCAGVSV

SEQ ID NO: 1073968 - protein, 9 aa, Homo Sapiens
KENEPSGRE

SEQ ID NO: 1073969 - protein, 9 aa, Homo Sapiens
GSDKELGSN

SEQ ID NO: 1073970 - protein, 9 aa, Homo Sapiens
PPQNEHTTI

SEQ ID NO: 1073971 - protein, 9 aa, Homo Sapiens
SLSEHQRIY

SEQ ID NO: 1073972 - protein, 9 aa, Homo Sapiens
HPLPPSYQK

SEQ ID NO: 1073973 - protein, 9 aa, Homo Sapiens
RISHELYQP

SEQ ID NO: 1073974 - protein, 9 aa, Homo Sapiens
DTNTTEILA

SEQ ID NO: 1073975 - protein, 9 aa, Homo Sapiens
FVRFFVKIV

SEQ ID NO: 1073976 - protein, 9 aa, Homo Sapiens
KKPQAPSND

SEQ ID NO: 1073977 - protein, 9 aa, Homo Sapiens
TQKYPSPLD

SEQ ID NO: 1073978 - protein, 9 aa, Homo Sapiens
LHFSYCASR

SEQ ID NO: 1073979 - protein, 9 aa, Homo Sapiens
KQEEMWRQE

SEQ ID NO: 1073980 - protein, 9 aa, Homo Sapiens
ATLEGLLQD

SEQ ID NO: 1073981 - protein, 9 aa, Homo Sapiens
PLQKYSSVP

SEQ ID NO: 1073982 - protein, 9 aa, Homo Sapiens
IPQLLVSLG

SEQ ID NO: 1073983 - protein, 9 aa, Homo Sapiens
DAEEFGRLG

SEQ ID NO: 1073984 - protein, 9 aa, Homo Sapiens
QDRPWAQGT

SEQ ID NO: 1073985 - protein, 9 aa, Homo Sapiens
AGGHLRPGI

SEQ ID NO: 1073986 - protein, 9 aa, Homo Sapiens
IESNARWVQ

SEQ ID NO: 1073987 - protein, 9 aa, Homo Sapiens
VHLQYPEGG

SEQ ID NO: 1073988 - protein, 9 aa, Homo Sapiens
AERLEGPFS

SEQ ID NO: 1073989 - protein, 9 aa, Homo Sapiens
PRPLLMLAQ

SEQ ID NO: 1073990 - protein, 9 aa, Homo Sapiens
LELEERVRR

SEQ ID NO: 1073991 - protein, 9 aa, Homo Sapiens
PEGGPARIS

SEQ ID NO: 1073992 - protein, 9 aa, Homo Sapiens
GARGACKIY

SEQ ID NO: 1073993 - protein, 9 aa, Homo Sapiens
RRIKANARE

SEQ ID NO: 1073994 - protein, 9 aa, Homo Sapiens
PILIPEITS

SEQ ID NO: 1073995 - protein, 9 aa, Homo Sapiens
NNRILAEKI

SEQ ID NO: 1073996 - protein, 9 aa, Homo Sapiens
QAVVETMFF

SEQ ID NO: 1073997 - protein, 9 aa, Homo Sapiens
QISEMDAPP

SEQ ID NO: 1073998 - protein, 9 aa, Homo Sapiens
YQQKFLKEL

SEQ ID NO: 1073999 - protein, 9 aa, Homo Sapiens
LAAGQFKTA

SEQ ID NO: 1074000 - protein, 9 aa, Homo Sapiens
SQEPAFYIA

SEQ ID NO: 1074001 - protein, 9 aa, Homo Sapiens
THQEQIKQP

SEQ ID NO: 1074002 - protein, 9 aa, Homo Sapiens
REKPLGQDE

SEQ ID NO: 1074003 - protein, 9 aa, Homo Sapiens
LSEHQRIYT

SEQ ID NO: 1074004 - protein, 9 aa, Homo Sapiens
LQLSSHSGL

SEQ ID NO: 1074005 - protein, 9 aa, Homo Sapiens
FVNGDLDRG

SEQ ID NO: 1074006 - protein, 9 aa, Homo Sapiens
FGMVLALAE

SEQ ID NO: 1074007 - protein, 9 aa, Homo Sapiens
LVNQGDADK

SEQ ID NO: 1074008 - protein, 9 aa, Homo Sapiens
FGCYFCLST

SEQ ID NO: 1074009 - protein, 9 aa, Homo Sapiens
VKKFLDLEQ

SEQ ID NO: 1074010 - protein, 9 aa, Homo Sapiens
IPPAIWNAE

SEQ ID NO: 1074011 - protein, 9 aa, Homo Sapiens
LCRQSSGKN

SEQ ID NO: 1074012 - protein, 9 aa, Homo Sapiens
FSFKKLVNF

SEQ ID NO: 1074013 - protein, 9 aa, Homo Sapiens
KDFTKNVLR

SEQ ID NO: 1074014 - protein, 9 aa, Homo Sapiens
RITHVYNHL

SEQ ID NO: 1074015 - protein, 9 aa, Homo Sapiens
HHKGVNFTD

SEQ ID NO: 1074016 - protein, 9 aa, Homo Sapiens
DSSHPVPTQ

SEQ ID NO: 1074017 - protein, 9 aa, Homo Sapiens
ILQRCQCVE

SEQ ID NO: 1074018 - protein, 9 aa, Homo Sapiens
KAHFHPKRR

SEQ ID NO: 1074019 - protein, 9 aa, Homo Sapiens
EVVLEPGQP

SEQ ID NO: 1074020 - protein, 9 aa, Homo Sapiens
ALSSLRDPG

SEQ ID NO: 1074021 - protein, 9 aa, Homo Sapiens
CDPKTGECL

SEQ ID NO: 1074022 - protein, 9 aa, Homo Sapiens
FEIGNFVKY

SEQ ID NO: 1074023 - protein, 9 aa, Homo Sapiens
QIRKDINFW

SEQ ID NO: 1074024 - protein, 9 aa, Homo Sapiens
EGAAYSGKR

SEQ ID NO: 1074025 - protein, 9 aa, Homo Sapiens
YLALFDNFS

SEQ ID NO: 1074026 - protein, 9 aa, Homo Sapiens
CFLAYDIQA

SEQ ID NO: 1074027 - protein, 9 aa, Homo Sapiens
LVFYHRSYK

SEQ ID NO: 1074028 - protein, 9 aa, Homo Sapiens
DTVYFSSSA

SEQ ID NO: 1074029 - protein, 9 aa, Homo Sapiens
RMNLLVAIC

SEQ ID NO: 1074030 - protein, 9 aa, Homo Sapiens
KKEHSTLTR

SEQ ID NO: 1074031 - protein, 9 aa, Homo Sapiens
RVSQTLRAM

SEQ ID NO: 1074032 - protein, 9 aa, Homo Sapiens
QQEGSREQE

SEQ ID NO: 1074033 - protein, 9 aa, Homo Sapiens
AQFDAEELT

SEQ ID NO: 1074034 - protein, 9 aa, Homo Sapiens
CYRVNNNLD

SEQ ID NO: 1074035 - protein, 9 aa, Homo Sapiens
INCSCPAGK

SEQ ID NO: 1074036 - protein, 9 aa, Homo Sapiens
PAVSFSPQH

SEQ ID NO: 1074037 - protein, 9 aa, Homo Sapiens
EGRPTGDAF

SEQ ID NO: 1074038 - protein, 9 aa, Homo Sapiens
QIPVAARDE

SEQ ID NO: 1074039 - protein, 9 aa, Homo Sapiens
YYIEATGGK

SEQ ID NO: 1074040 - protein, 9 aa, Homo Sapiens
RLLWKLRAT

SEQ ID NO: 1074041 - protein, 9 aa, Homo Sapiens
LDEPPSVNT

SEQ ID NO: 1074042 - protein, 9 aa, Homo Sapiens
AFTLRSINL

SEQ ID NO: 1074043 - protein, 9 aa, Homo Sapiens
VCKPNGKSN

SEQ ID NO: 1074044 - protein, 9 aa, Homo Sapiens
YNTKQGQTN

SEQ ID NO: 1074045 - protein, 9 aa, Homo Sapiens
AVNPESTQR

SEQ ID NO: 1074046 - protein, 9 aa, Homo Sapiens
DDWAAKKFP

SEQ ID NO: 1074047 - protein, 9 aa, Homo Sapiens
FDDNKLVKG

SEQ ID NO: 1074048 - protein, 9 aa, Homo Sapiens
DFENYNQQP

SEQ ID NO: 1074049 - protein, 9 aa, Homo Sapiens
PPANIVKVA

SEQ ID NO: 1074050 - protein, 9 aa, Homo Sapiens
PSHISSVVV

SEQ ID NO: 1074051 - protein, 9 aa, Homo Sapiens
PEALQTTGT

SEQ ID NO: 1074052 - protein, 9 aa, Homo Sapiens
TAVSALGLA

SEQ ID NO: 1074053 - protein, 9 aa, Homo Sapiens
EEKSDEEEK

SEQ ID NO: 1074054 - protein, 9 aa, Homo Sapiens
FAFLEHQKM

SEQ ID NO: 1074055 - protein, 9 aa, Homo Sapiens
GLGKNSEKN

SEQ ID NO: 1074056 - protein, 9 aa, Homo Sapiens
QSCQTPDDF

SEQ ID NO: 1074057 - protein, 9 aa, Homo Sapiens
RGRRDLARA

SEQ ID NO: 1074058 - protein, 9 aa, Homo Sapiens
GTYDCTATS

SEQ ID NO: 1074059 - protein, 9 aa, Homo Sapiens
DANVTWLRN

SEQ ID NO: 1074060 - protein, 9 aa, Homo Sapiens
KLCQDITGD

SEQ ID NO: 1074061 - protein, 9 aa, Homo Sapiens
QPTGKEPAL

SEQ ID NO: 1074062 - protein, 9 aa, Homo Sapiens
YPDLSDMLK

SEQ ID NO: 1074063 - protein, 9 aa, Homo Sapiens
LTTNPQEET

SEQ ID NO: 1074064 - protein, 9 aa, Homo Sapiens
IFIMLLNLA

SEQ ID NO: 1074065 - protein, 9 aa, Homo Sapiens
LSRMLQERG

SEQ ID NO: 1074066 - protein, 9 aa, Homo Sapiens
LNPFACHVL

SEQ ID NO: 1074067 - protein, 9 aa, Homo Sapiens
YRSEEIIKH

SEQ ID NO: 1074068 - protein, 9 aa, Homo Sapiens
IRCAMLNPS

SEQ ID NO: 1074069 - protein, 9 aa, Homo Sapiens
RSLPFWRRM

SEQ ID NO: 1074070 - protein, 9 aa, Homo Sapiens
TYLLLPPQD

SEQ ID NO: 1074071 - protein, 9 aa, Homo Sapiens
DVLRNLFNT

SEQ ID NO: 1074072 - protein, 9 aa, Homo Sapiens
LDYSKRDRN

SEQ ID NO: 1074073 - protein, 9 aa, Homo Sapiens
ARQFNLIPQ

SEQ ID NO: 1074074 - protein, 9 aa, Homo Sapiens
RSTVKEDNC

SEQ ID NO: 1074075 - protein, 9 aa, Homo Sapiens
QLFPLSRLR

SEQ ID NO: 1074076 - protein, 9 aa, Homo Sapiens
ELLKLARKI

SEQ ID NO: 1074077 - protein, 9 aa, Homo Sapiens
CLRLNRVLR

SEQ ID NO: 1074078 - protein, 9 aa, Homo Sapiens
PDFCLYKRE

SEQ ID NO: 1074079 - protein, 9 aa, Homo Sapiens
EDETSLQKP

SEQ ID NO: 1074080 - protein, 9 aa, Homo Sapiens
SEEPPEILS

SEQ ID NO: 1074081 - protein, 9 aa, Homo Sapiens
ESATNTNKS

SEQ ID NO: 1074082 - protein, 9 aa, Homo Sapiens
EGGPARISF

SEQ ID NO: 1074083 - protein, 9 aa, Homo Sapiens
LEHQKMKKS

SEQ ID NO: 1074084 - protein, 9 aa, Homo Sapiens
IFSPMPRES

SEQ ID NO: 1074085 - protein, 9 aa, Homo Sapiens
VNNQDAIQE

SEQ ID NO: 1074086 - protein, 9 aa, Homo Sapiens
GERLTSCMK

SEQ ID NO: 1074087 - protein, 9 aa, Homo Sapiens
SLPSPLPTY

SEQ ID NO: 1074088 - protein, 9 aa, Homo Sapiens
IIRGSDADI

SEQ ID NO: 1074089 - protein, 9 aa, Homo Sapiens
SSADSDSGH

SEQ ID NO: 1074090 - protein, 9 aa, Homo Sapiens
GTDARNVLE

SEQ ID NO: 1074091 - protein, 9 aa, Homo Sapiens
SKEAGLDVK

SEQ ID NO: 1074092 - protein, 9 aa, Homo Sapiens
DREIIFNNG

SEQ ID NO: 1074093 - protein, 9 aa, Homo Sapiens
MVDIVTALR

SEQ ID NO: 1074094 - protein, 9 aa, Homo Sapiens
SRMLQVCQQ

SEQ ID NO: 1074095 - protein, 9 aa, Homo Sapiens
TPSFSGDSF

SEQ ID NO: 1074096 - protein, 9 aa, Homo Sapiens
VMFLSVVAP

SEQ ID NO: 1074097 - protein, 9 aa, Homo Sapiens
EGRTTAQWF

SEQ ID NO: 1074098 - protein, 9 aa, Homo Sapiens
CKECKKAVR

SEQ ID NO: 1074099 - protein, 9 aa, Homo Sapiens
ASDLFGNHS

SEQ ID NO: 1074100 - protein, 9 aa, Homo Sapiens
FGDPLFPRT

SEQ ID NO: 1074101 - protein, 9 aa, Homo Sapiens
KTALELCSK

SEQ ID NO: 1074102 - protein, 9 aa, Homo Sapiens
THCTLLSVG

SEQ ID NO: 1074103 - protein, 9 aa, Homo Sapiens
YALHLQNKE

SEQ ID NO: 1074104 - protein, 9 aa, Homo Sapiens
CLLNPFACH

SEQ ID NO: 1074105 - protein, 9 aa, Homo Sapiens
FISELRDNF

SEQ ID NO: 1074106 - protein, 9 aa, Homo Sapiens
SLVLDSGGQ

SEQ ID NO: 1074107 - protein, 9 aa, Homo Sapiens
PIGIPFSDH

SEQ ID NO: 1074108 - protein, 9 aa, Homo Sapiens
KQECNEQRS

SEQ ID NO: 1074109 - protein, 9 aa, Homo Sapiens
KEYHHFVLM

SEQ ID NO: 1074110 - protein, 9 aa, Homo Sapiens
FGKERKKHL

SEQ ID NO: 1074111 - protein, 9 aa, Homo Sapiens
ALLGKLAPC

SEQ ID NO: 1074112 - protein, 9 aa, Homo Sapiens
KKENYNFLN

SEQ ID NO: 1074113 - protein, 9 aa, Homo Sapiens
YKERKKYES

SEQ ID NO: 1074114 - protein, 9 aa, Homo Sapiens
INLSLLVDD

SEQ ID NO: 1074115 - protein, 9 aa, Homo Sapiens
DRQVPEQFS

SEQ ID NO: 1074116 - protein, 9 aa, Homo Sapiens
EELEAQIFF

SEQ ID NO: 1074117 - protein, 9 aa, Homo Sapiens
GDDVPRAVF

SEQ ID NO: 1074118 - protein, 9 aa, Homo Sapiens
CVAFSFLWA

SEQ ID NO: 1074119 - protein, 9 aa, Homo Sapiens
PSGPSKGGS

SEQ ID NO: 1074120 - protein, 9 aa, Homo Sapiens
TEKKSKKTK

SEQ ID NO: 1074121 - protein, 9 aa, Homo Sapiens
FLLRTLGLF

SEQ ID NO: 1074122 - protein, 9 aa, Homo Sapiens
NVRIHALTS

SEQ ID NO: 1074123 - protein, 9 aa, Homo Sapiens
TSGERFPLS

SEQ ID NO: 1074124 - protein, 9 aa, Homo Sapiens
EKKGDGEAL

SEQ ID NO: 1074125 - protein, 9 aa, Homo Sapiens
ETFPGVTAF

SEQ ID NO: 1074126 - protein, 9 aa, Homo Sapiens
QGPRGPSGA

SEQ ID NO: 1074127 - protein, 9 aa, Homo Sapiens
YNFFLTTAI

SEQ ID NO: 1074128 - protein, 9 aa, Homo Sapiens
VNKLTDQIF

SEQ ID NO: 1074129 - protein, 9 aa, Homo Sapiens
IPGAPSENI

SEQ ID NO: 1074130 - protein, 9 aa, Homo Sapiens
LGYLARMNL

SEQ ID NO: 1074131 - protein, 9 aa, Homo Sapiens
LINKRIYTG

SEQ ID NO: 1074132 - protein, 9 aa, Homo Sapiens
NKIFLSVTA

SEQ ID NO: 1074133 - protein, 9 aa, Homo Sapiens
PFHDPYRQQ

SEQ ID NO: 1074134 - protein, 9 aa, Homo Sapiens
SHISSVVVL

SEQ ID NO: 1074135 - protein, 9 aa, Homo Sapiens
CILFLGSSE

SEQ ID NO: 1074136 - protein, 9 aa, Homo Sapiens
GRGPPSMCR

SEQ ID NO: 1074137 - protein, 9 aa, Homo Sapiens
DYKGIHSGE

SEQ ID NO: 1074138 - protein, 9 aa, Homo Sapiens
EFLIISNNG

SEQ ID NO: 1074139 - protein, 9 aa, Homo Sapiens
PPPPPSYSG

SEQ ID NO: 1074140 - protein, 9 aa, Homo Sapiens
PDKYFLAPV

SEQ ID NO: 1074141 - protein, 9 aa, Homo Sapiens
SCSQELSSA

SEQ ID NO: 1074142 - protein, 9 aa, Homo Sapiens
LTQIVALSP

SEQ ID NO: 1074143 - protein, 9 aa, Homo Sapiens
SGKIWQLLG

SEQ ID NO: 1074144 - protein, 9 aa, Homo Sapiens
LGFRENQET

SEQ ID NO: 1074145 - protein, 9 aa, Homo Sapiens
QSDTLTFSY

SEQ ID NO: 1074146 - protein, 9 aa, Homo Sapiens
NIWRLLPLP

SEQ ID NO: 1074147 - protein, 9 aa, Homo Sapiens
LKKPQEPAD

SEQ ID NO: 1074148 - protein, 9 aa, Homo Sapiens
RLLSGGRDC

SEQ ID NO: 1074149 - protein, 9 aa, Homo Sapiens
LPLVTLIVG

SEQ ID NO: 1074150 - protein, 9 aa, Homo Sapiens
CINFIFIML

SEQ ID NO: 1074151 - protein, 9 aa, Homo Sapiens
EALKRGKEV

SEQ ID NO: 1074152 - protein, 9 aa, Homo Sapiens
YPTSLIKTE

SEQ ID NO: 1074153 - protein, 9 aa, Homo Sapiens
FVHGHRKAV

SEQ ID NO: 1074154 - protein, 9 aa, Homo Sapiens
SENDLFHKN

SEQ ID NO: 1074155 - protein, 9 aa, Homo Sapiens
EVVSQDDST

SEQ ID NO: 1074156 - protein, 9 aa, Homo Sapiens
DGLLPAELE

SEQ ID NO: 1074157 - protein, 9 aa, Homo Sapiens
GIPGYPTPP

SEQ ID NO: 1074158 - protein, 9 aa, Homo Sapiens
EQEEEQEKE

SEQ ID NO: 1074159 - protein, 9 aa, Homo Sapiens
HSSDICPTN

SEQ ID NO: 1074160 - protein, 9 aa, Homo Sapiens
GPSLRLQNS

SEQ ID NO: 1074161 - protein, 9 aa, Homo Sapiens
KGFEANNFA

SEQ ID NO: 1074162 - protein, 9 aa, Homo Sapiens
YMCFHVRFI

SEQ ID NO: 1074163 - protein, 9 aa, Homo Sapiens
DPAQSPASK

SEQ ID NO: 1074164 - protein, 9 aa, Homo Sapiens
DKTFEELSR

SEQ ID NO: 1074165 - protein, 9 aa, Homo Sapiens
QPSPQGPPG

SEQ ID NO: 1074166 - protein, 9 aa, Homo Sapiens
SLVKKPFAA

SEQ ID NO: 1074167 - protein, 9 aa, Homo Sapiens
DDFYWPSRE

SEQ ID NO: 1074168 - protein, 9 aa, Homo Sapiens
DLTYDETIS

SEQ ID NO: 1074169 - protein, 9 aa, Homo Sapiens
HFGKERKKH

SEQ ID NO: 1074170 - protein, 9 aa, Homo Sapiens
CLTSDLVFH

SEQ ID NO: 1074171 - protein, 9 aa, Homo Sapiens
AVNGKRQGD

SEQ ID NO: 1074172 - protein, 9 aa, Homo Sapiens
QQQGYMPFE

SEQ ID NO: 1074173 - protein, 9 aa, Homo Sapiens
HPNNLRFMG

SEQ ID NO: 1074174 - protein, 9 aa, Homo Sapiens
PRQFFIEVL

SEQ ID NO: 1074175 - protein, 9 aa, Homo Sapiens
FALSWSQET

SEQ ID NO: 1074176 - protein, 9 aa, Homo Sapiens
FISLKPHFY

SEQ ID NO: 1074177 - protein, 9 aa, Homo Sapiens
TMAQPYASV

SEQ ID NO: 1074178 - protein, 9 aa, Homo Sapiens
NLLGADAVP

SEQ ID NO: 1074179 - protein, 9 aa, Homo Sapiens
SVWLITKIG

SEQ ID NO: 1074180 - protein, 9 aa, Homo Sapiens
RKHTRPIFS

SEQ ID NO: 1074181 - protein, 9 aa, Homo Sapiens
VSGCHLSLG

SEQ ID NO: 1074182 - protein, 9 aa, Homo Sapiens
SVSQSKNAP

SEQ ID NO: 1074183 - protein, 9 aa, Homo Sapiens
VYTTVRSPG

SEQ ID NO: 1074184 - protein, 9 aa, Homo Sapiens
RPSQFWGQP

SEQ ID NO: 1074185 - protein, 9 aa, Homo Sapiens
DDVPRAVFP

SEQ ID NO: 1074186 - protein, 9 aa, Homo Sapiens
FWKEIYVGD

SEQ ID NO: 1074187 - protein, 9 aa, Homo Sapiens
KNIADPTLK

SEQ ID NO: 1074188 - protein, 9 aa, Homo Sapiens
LGFHVLYQE

SEQ ID NO: 1074189 - protein, 9 aa, Homo Sapiens
SSVEIENQE

SEQ ID NO: 1074190 - protein, 9 aa, Homo Sapiens
ALAAVNIVS

SEQ ID NO: 1074191 - protein, 9 aa, Homo Sapiens
VTYLLLPPQ

SEQ ID NO: 1074192 - protein, 9 aa, Homo Sapiens
CLQNVDKAL

SEQ ID NO: 1074193 - protein, 9 aa, Homo Sapiens
LRPGLQYWT

SEQ ID NO: 1074194 - protein, 9 aa, Homo Sapiens
ILDHRQLHK

SEQ ID NO: 1074195 - protein, 9 aa, Homo Sapiens
PTLRTSTAV

SEQ ID NO: 1074196 - protein, 9 aa, Homo Sapiens
MRLSPVQCL

SEQ ID NO: 1074197 - protein, 9 aa, Homo Sapiens
EYFVKIQFF

SEQ ID NO: 1074198 - protein, 9 aa, Homo Sapiens
QGHVTILAD

SEQ ID NO: 1074199 - protein, 9 aa, Homo Sapiens
LPLSLRRLF

SEQ ID NO: 1074200 - protein, 9 aa, Homo Sapiens
TRFFFYVAL

SEQ ID NO: 1074201 - protein, 9 aa, Homo Sapiens
LFSSASMPQ

SEQ ID NO: 1074202 - protein, 9 aa, Homo Sapiens
QRTSSGGGG

SEQ ID NO: 1074203 - protein, 9 aa, Homo Sapiens
VQYFNVASV

SEQ ID NO: 1074204 - protein, 9 aa, Homo Sapiens
VPVVYTTVR

SEQ ID NO: 1074205 - protein, 9 aa, Homo Sapiens
VEQGVSFQQ

SEQ ID NO: 1074206 - protein, 9 aa, Homo Sapiens
SACYYGHIR

SEQ ID NO: 1074207 - protein, 9 aa, Homo Sapiens
MTFPFRGFR

SEQ ID NO: 1074208 - protein, 9 aa, Homo Sapiens
AAQVLIRFY

SEQ ID NO: 1074209 - protein, 9 aa, Homo Sapiens
NPYEQQPPE

SEQ ID NO: 1074210 - protein, 9 aa, Homo Sapiens
FFIEVLDIA

SEQ ID NO: 1074211 - protein, 9 aa, Homo Sapiens
TWEERKESP

SEQ ID NO: 1074212 - protein, 9 aa, Homo Sapiens
YKGNDSIAD

SEQ ID NO: 1074213 - protein, 9 aa, Homo Sapiens
SGKRRSPGL

SEQ ID NO: 1074214 - protein, 9 aa, Homo Sapiens
NKVYELAQV

SEQ ID NO: 1074215 - protein, 9 aa, Homo Sapiens
RLLQTQSPG

SEQ ID NO: 1074216 - protein, 9 aa, Homo Sapiens
DLSSATLNI

SEQ ID NO: 1074217 - protein, 9 aa, Homo Sapiens
GCKSLLGGF

SEQ ID NO: 1074218 - protein, 9 aa, Homo Sapiens
VASEFGQLT

SEQ ID NO: 1074219 - protein, 9 aa, Homo Sapiens
YHKPHISFR

SEQ ID NO: 1074220 - protein, 9 aa, Homo Sapiens
LTDPEALAL

SEQ ID NO: 1074221 - protein, 9 aa, Homo Sapiens
MDSFVVPLP

SEQ ID NO: 1074222 - protein, 9 aa, Homo Sapiens
QTCTPIFST

SEQ ID NO: 1074223 - protein, 9 aa, Homo Sapiens
QVPIASIAC

SEQ ID NO: 1074224 - protein, 9 aa, Homo Sapiens
NDSYALLGK

SEQ ID NO: 1074225 - protein, 9 aa, Homo Sapiens
LWGKAPCLS

SEQ ID NO: 1074226 - protein, 9 aa, Homo Sapiens
DLRVREEPL

SEQ ID NO: 1074227 - protein, 9 aa, Homo Sapiens
KTEYEFDSP

SEQ ID NO: 1074228 - protein, 9 aa, Homo Sapiens
HHTDVNLEA

SEQ ID NO: 1074229 - protein, 9 aa, Homo Sapiens
AGNVHQPTK

SEQ ID NO: 1074230 - protein, 9 aa, Homo Sapiens
AAEKLIYDH

SEQ ID NO: 1074231 - protein, 9 aa, Homo Sapiens
KPGDAGAKG

SEQ ID NO: 1074232 - protein, 9 aa, Homo Sapiens
LGQNAWLSY

SEQ ID NO: 1074233 - protein, 9 aa, Homo Sapiens
HRQLHKFSS

SEQ ID NO: 1074234 - protein, 9 aa, Homo Sapiens
HLPKKNPED

SEQ ID NO: 1074235 - protein, 9 aa, Homo Sapiens
LALLSPGTA

SEQ ID NO: 1074236 - protein, 9 aa, Homo Sapiens
QHQLIYTGV

SEQ ID NO: 1074237 - protein, 9 aa, Homo Sapiens
FSPNRQPFV

SEQ ID NO: 1074238 - protein, 9 aa, Homo Sapiens
CHNLIRRNL

SEQ ID NO: 1074239 - protein, 9 aa, Homo Sapiens
KKNISLEHL

SEQ ID NO: 1074240 - protein, 9 aa, Homo Sapiens
EFSGPLSVT

SEQ ID NO: 1074241 - protein, 9 aa, Homo Sapiens
RGLCIILGE

SEQ ID NO: 1074242 - protein, 9 aa, Homo Sapiens
FQGHVTILA

SEQ ID NO: 1074243 - protein, 9 aa, Homo Sapiens
PGAHEKVLP

SEQ ID NO: 1074244 - protein, 9 aa, Homo Sapiens
RAEVLKFVF

SEQ ID NO: 1074245 - protein, 9 aa, Homo Sapiens
LRRQSSQEK

SEQ ID NO: 1074246 - protein, 9 aa, Homo Sapiens
RGSDADIKN

SEQ ID NO: 1074247 - protein, 9 aa, Homo Sapiens
GYLDEKLDY

SEQ ID NO: 1074248 - protein, 9 aa, Homo Sapiens
ELEAEAVFW

SEQ ID NO: 1074249 - protein, 9 aa, Homo Sapiens
TLPNDTDGN

SEQ ID NO: 1074250 - protein, 9 aa, Homo Sapiens
PFKKENIRL

SEQ ID NO: 1074251 - protein, 9 aa, Homo Sapiens
TDLSGIEVI

SEQ ID NO: 1074252 - protein, 9 aa, Homo Sapiens
GDSTLLPVT

SEQ ID NO: 1074253 - protein, 9 aa, Homo Sapiens
CEHAYPDQI

SEQ ID NO: 1074254 - protein, 9 aa, Homo Sapiens
RPMFSPIHK

SEQ ID NO: 1074255 - protein, 9 aa, Homo Sapiens
NQPASFVVQ

SEQ ID NO: 1074256 - protein, 9 aa, Homo Sapiens
GDTPGSFKL

SEQ ID NO: 1074257 - protein, 9 aa, Homo Sapiens
LPRGCLLSL

SEQ ID NO: 1074258 - protein, 9 aa, Homo Sapiens
FSLNSNDVF

SEQ ID NO: 1074259 - protein, 9 aa, Homo Sapiens
CVLSLLPTV

SEQ ID NO: 1074260 - protein, 9 aa, Homo Sapiens
TECKNASVF

SEQ ID NO: 1074261 - protein, 9 aa, Homo Sapiens
KTFSQELTF

SEQ ID NO: 1074262 - protein, 9 aa, Homo Sapiens
TTRTELIAL

SEQ ID NO: 1074263 - protein, 9 aa, Homo Sapiens
KGESSGDPT

SEQ ID NO: 1074264 - protein, 9 aa, Homo Sapiens
ISQADTVIL

SEQ ID NO: 1074265 - protein, 9 aa, Homo Sapiens
SLTVVLSTN

SEQ ID NO: 1074266 - protein, 9 aa, Homo Sapiens
RWYCSGSNK

SEQ ID NO: 1074267 - protein, 9 aa, Homo Sapiens
PYRSEEIIK

SEQ ID NO: 1074268 - protein, 9 aa, Homo Sapiens
ILLLRLMAG

SEQ ID NO: 1074269 - protein, 9 aa, Homo Sapiens
PRSSAHCSS

SEQ ID NO: 1074270 - protein, 9 aa, Homo Sapiens
PYKWMRRSV

SEQ ID NO: 1074271 - protein, 9 aa, Homo Sapiens
LTHLLGGGT

SEQ ID NO: 1074272 - protein, 9 aa, Homo Sapiens
LIFIVIFCL

SEQ ID NO: 1074273 - protein, 9 aa, Homo Sapiens
KESPDKPGS

SEQ ID NO: 1074274 - protein, 9 aa, Homo Sapiens
SDLLMRKST

SEQ ID NO: 1074275 - protein, 9 aa, Homo Sapiens
KIRGGKQFF

SEQ ID NO: 1074276 - protein, 9 aa, Homo Sapiens
EAIARNPHK

SEQ ID NO: 1074277 - protein, 9 aa, Homo Sapiens
GFYLDPPQF

SEQ ID NO: 1074278 - protein, 9 aa, Homo Sapiens
HIYQQSRKN

SEQ ID NO: 1074279 - protein, 9 aa, Homo Sapiens
MDKQSSAGE

SEQ ID NO: 1074280 - protein, 9 aa, Homo Sapiens
DYSKRDRNF

SEQ ID NO: 1074281 - protein, 9 aa, Homo Sapiens
NSPFALKVQ

SEQ ID NO: 1074282 - protein, 9 aa, Homo Sapiens
PGAAPLWSA

SEQ ID NO: 1074283 - protein, 9 aa, Homo Sapiens
ATNMKYLLL

SEQ ID NO: 1074284 - protein, 9 aa, Homo Sapiens
QPLGALSKP

SEQ ID NO: 1074285 - protein, 9 aa, Homo Sapiens
GTKSESAES

SEQ ID NO: 1074286 - protein, 9 aa, Homo Sapiens
EASSYRLDL

SEQ ID NO: 1074287 - protein, 9 aa, Homo Sapiens
EGEGPATLM

SEQ ID NO: 1074288 - protein, 9 aa, Homo Sapiens
FKLTMQAHD

SEQ ID NO: 1074289 - protein, 9 aa, Homo Sapiens
HHGRVFLGS

SEQ ID NO: 1074290 - protein, 9 aa, Homo Sapiens
SESISFCKA

SEQ ID NO: 1074291 - protein, 9 aa, Homo Sapiens
RTRFTCLFV

SEQ ID NO: 1074292 - protein, 9 aa, Homo Sapiens
GRLGSTEWA

SEQ ID NO: 1074293 - protein, 9 aa, Homo Sapiens
TCTSSGRGP

SEQ ID NO: 1074294 - protein, 9 aa, Homo Sapiens
APSENITNV

SEQ ID NO: 1074295 - protein, 9 aa, Homo Sapiens
HNNRMTHLV

SEQ ID NO: 1074296 - protein, 9 aa, Homo Sapiens
CREREMQNL

SEQ ID NO: 1074297 - protein, 9 aa, Homo Sapiens
KGLESGRGR

SEQ ID NO: 1074298 - protein, 9 aa, Homo Sapiens
YISFCLPKR

SEQ ID NO: 1074299 - protein, 9 aa, Homo Sapiens
RGWKKKMVT

SEQ ID NO: 1074300 - protein, 9 aa, Homo Sapiens
LKKLLSLPP

SEQ ID NO: 1074301 - protein, 9 aa, Homo Sapiens
SSGAKSSSK

SEQ ID NO: 1074302 - protein, 9 aa, Homo Sapiens
WMACANKGI

SEQ ID NO: 1074303 - protein, 9 aa, Homo Sapiens
SCGGSKEGC

SEQ ID NO: 1074304 - protein, 9 aa, Homo Sapiens
RGGGRRPCL

SEQ ID NO: 1074305 - protein, 9 aa, Homo Sapiens
IVGIIKLKV

SEQ ID NO: 1074306 - protein, 9 aa, Homo Sapiens
DVTVNFENL

SEQ ID NO: 1074307 - protein, 9 aa, Homo Sapiens
KKIRNVDQS

SEQ ID NO: 1074308 - protein, 9 aa, Homo Sapiens
LASPDPEPR

SEQ ID NO: 1074309 - protein, 9 aa, Homo Sapiens
KKEMKISEL

SEQ ID NO: 1074310 - protein, 9 aa, Homo Sapiens
CFLTSTAPR

SEQ ID NO: 1074311 - protein, 9 aa, Homo Sapiens
NKHFEIAID

SEQ ID NO: 1074312 - protein, 9 aa, Homo Sapiens
SMEEFQDLL

SEQ ID NO: 1074313 - protein, 9 aa, Homo Sapiens
KSDDAWKVY

SEQ ID NO: 1074314 - protein, 9 aa, Homo Sapiens
LQTFLAGAA

SEQ ID NO: 1074315 - protein, 9 aa, Homo Sapiens
SPSQRLGGS

SEQ ID NO: 1074316 - protein, 9 aa, Homo Sapiens
NILEENIWR

SEQ ID NO: 1074317 - protein, 9 aa, Homo Sapiens
LWIRTHLSQ

SEQ ID NO: 1074318 - protein, 9 aa, Homo Sapiens
WPSREQPLE

SEQ ID NO: 1074319 - protein, 9 aa, Homo Sapiens
SQSKNAPKI

SEQ ID NO: 1074320 - protein, 9 aa, Homo Sapiens
QGFRYSKLS

SEQ ID NO: 1074321 - protein, 9 aa, Homo Sapiens
KWKEIVFDM

SEQ ID NO: 1074322 - protein, 9 aa, Homo Sapiens
QGYMPFEGP

SEQ ID NO: 1074323 - protein, 9 aa, Homo Sapiens
ASNTIQPTS

SEQ ID NO: 1074324 - protein, 9 aa, Homo Sapiens
TPQPGHALV

SEQ ID NO: 1074325 - protein, 9 aa, Homo Sapiens
LNDSKRFGI

SEQ ID NO: 1074326 - protein, 9 aa, Homo Sapiens
FCRMPPSCS

SEQ ID NO: 1074327 - protein, 9 aa, Homo Sapiens
FQVARPQFS

SEQ ID NO: 1074328 - protein, 9 aa, Homo Sapiens
SVLFMHKVC

SEQ ID NO: 1074329 - protein, 9 aa, Homo Sapiens
VRKRLLCLG

SEQ ID NO: 1074330 - protein, 9 aa, Homo Sapiens
GDPLFPRTT

SEQ ID NO: 1074331 - protein, 9 aa, Homo Sapiens
DTWSHSQFS

SEQ ID NO: 1074332 - protein, 9 aa, Homo Sapiens
LDSEVIQYQ

SEQ ID NO: 1074333 - protein, 9 aa, Homo Sapiens
RKAGVPKGS

SEQ ID NO: 1074334 - protein, 9 aa, Homo Sapiens
TSRGLKPRN

SEQ ID NO: 1074335 - protein, 9 aa, Homo Sapiens
MALRVPSLD

SEQ ID NO: 1074336 - protein, 9 aa, Homo Sapiens
VLPQTYLSI

SEQ ID NO: 1074337 - protein, 9 aa, Homo Sapiens
ATELKVCKP

SEQ ID NO: 1074338 - protein, 9 aa, Homo Sapiens
AAGQFKTAL

SEQ ID NO: 1074339 - protein, 9 aa, Homo Sapiens
IARFTPYKW

SEQ ID NO: 1074340 - protein, 9 aa, Homo Sapiens
DTGSKEKRL

SEQ ID NO: 1074341 - protein, 9 aa, Homo Sapiens
ILDWDLDPG

SEQ ID NO: 1074342 - protein, 9 aa, Homo Sapiens
QRATRGLLR

SEQ ID NO: 1074343 - protein, 9 aa, Homo Sapiens
AGRVCRWPP

SEQ ID NO: 1074344 - protein, 9 aa, Homo Sapiens
PEGMGIILR

SEQ ID NO: 1074345 - protein, 9 aa, Homo Sapiens
LYSLSALMK

SEQ ID NO: 1074346 - protein, 9 aa, Homo Sapiens
PGTPMAHSP

SEQ ID NO: 1074347 - protein, 9 aa, Homo Sapiens
DPPLSSSMS

SEQ ID NO: 1074348 - protein, 9 aa, Homo Sapiens
LTRARGAPS

SEQ ID NO: 1074349 - protein, 9 aa, Homo Sapiens
SNTIQPTSQ

SEQ ID NO: 1074350 - protein, 9 aa, Homo Sapiens
QTAQPSPSA

SEQ ID NO: 1074351 - protein, 9 aa, Homo Sapiens
EQRKAFSTC

SEQ ID NO: 1074352 - protein, 9 aa, Homo Sapiens
SFAYVKKED

SEQ ID NO: 1074353 - protein, 9 aa, Homo Sapiens
PMFFWPRLR

SEQ ID NO: 1074354 - protein, 9 aa, Homo Sapiens
AVSFSPQHL

SEQ ID NO: 1074355 - protein, 9 aa, Homo Sapiens
YCDSPHSKP

SEQ ID NO: 1074356 - protein, 9 aa, Homo Sapiens
NRFSVSETG

SEQ ID NO: 1074357 - protein, 9 aa, Homo Sapiens
GLTGNSHSQ

SEQ ID NO: 1074358 - protein, 9 aa, Homo Sapiens
GAQRPTPYK

SEQ ID NO: 1074359 - protein, 9 aa, Homo Sapiens
QGDFCQAMD

SEQ ID NO: 1074360 - protein, 9 aa, Homo Sapiens
PPGAFSLEV

SEQ ID NO: 1074361 - protein, 9 aa, Homo Sapiens
NPMKPALPS

SEQ ID NO: 1074362 - protein, 9 aa, Homo Sapiens
DAVNPESTQ

SEQ ID NO: 1074363 - protein, 9 aa, Homo Sapiens
GSTLGFHVL

SEQ ID NO: 1074364 - protein, 9 aa, Homo Sapiens
ASDLEAVLE

SEQ ID NO: 1074365 - protein, 9 aa, Homo Sapiens
RLVYERELE

SEQ ID NO: 1074366 - protein, 9 aa, Homo Sapiens
IKAWEHCKP

SEQ ID NO: 1074367 - protein, 9 aa, Homo Sapiens
LIYTGVKPY

SEQ ID NO: 1074368 - protein, 9 aa, Homo Sapiens
DEVEPDDEE

SEQ ID NO: 1074369 - protein, 9 aa, Homo Sapiens
ETILSVDEL

SEQ ID NO: 1074370 - protein, 9 aa, Homo Sapiens
EFRKSDIKV

SEQ ID NO: 1074371 - protein, 9 aa, Homo Sapiens
FSLNHVPDL

SEQ ID NO: 1074372 - protein, 9 aa, Homo Sapiens
DAPPPQNEH

SEQ ID NO: 1074373 - protein, 9 aa, Homo Sapiens
LGLLLDRLR

SEQ ID NO: 1074374 - protein, 9 aa, Homo Sapiens
RCEKPIQDF

SEQ ID NO: 1074375 - protein, 9 aa, Homo Sapiens
SSDAQVSKR

SEQ ID NO: 1074376 - protein, 9 aa, Homo Sapiens
GSGLLLLPS

SEQ ID NO: 1074377 - protein, 9 aa, Homo Sapiens
YTGEKPYTC

SEQ ID NO: 1074378 - protein, 9 aa, Homo Sapiens
GVEDIVAII

SEQ ID NO: 1074379 - protein, 9 aa, Homo Sapiens
TPKSVDPGA

SEQ ID NO: 1074380 - protein, 9 aa, Homo Sapiens
SQQLKAKLN

SEQ ID NO: 1074381 - protein, 9 aa, Homo Sapiens
GGPPVSSWP

SEQ ID NO: 1074382 - protein, 9 aa, Homo Sapiens
ARAPPGEVV

SEQ ID NO: 1074383 - protein, 9 aa, Homo Sapiens
YGAAGGKGE

SEQ ID NO: 1074384 - protein, 9 aa, Homo Sapiens
ACTSCWAMA

SEQ ID NO: 1074385 - protein, 9 aa, Homo Sapiens
YRSFEYIQD

SEQ ID NO: 1074386 - protein, 9 aa, Homo Sapiens
PSDTESKGV

SEQ ID NO: 1074387 - protein, 9 aa, Homo Sapiens
LNYHRSFIS

SEQ ID NO: 1074388 - protein, 9 aa, Homo Sapiens
FLTSLFSPN

SEQ ID NO: 1074389 - protein, 9 aa, Homo Sapiens
CDDQRPMDE

SEQ ID NO: 1074390 - protein, 9 aa, Homo Sapiens
RIGTVNCGD

SEQ ID NO: 1074391 - protein, 9 aa, Homo Sapiens
EGGPGLVST

SEQ ID NO: 1074392 - protein, 9 aa, Homo Sapiens
SLSFSFLSE

SEQ ID NO: 1074393 - protein, 9 aa, Homo Sapiens
AVSPLSGKR

SEQ ID NO: 1074394 - protein, 9 aa, Homo Sapiens
VNGKRQGDY

SEQ ID NO: 1074395 - protein, 9 aa, Homo Sapiens
EDQDLDTFL

SEQ ID NO: 1074396 - protein, 9 aa, Homo Sapiens
CPGREAEQG

SEQ ID NO: 1074397 - protein, 9 aa, Homo Sapiens
TLANITILG

SEQ ID NO: 1074398 - protein, 9 aa, Homo Sapiens
SSWVCDQDQ

SEQ ID NO: 1074399 - protein, 9 aa, Homo Sapiens
FTIGGNAEG

SEQ ID NO: 1074400 - protein, 9 aa, Homo Sapiens
KSSSKSGAQ

SEQ ID NO: 1074401 - protein, 9 aa, Homo Sapiens
KMEMKNIEK

SEQ ID NO: 1074402 - protein, 9 aa, Homo Sapiens
TASPEGSEA

SEQ ID NO: 1074403 - protein, 9 aa, Homo Sapiens
SSDICPTNC

SEQ ID NO: 1074404 - protein, 9 aa, Homo Sapiens
KNISLEHLL

SEQ ID NO: 1074405 - protein, 9 aa, Homo Sapiens
AWLLYELQP

SEQ ID NO: 1074406 - protein, 9 aa, Homo Sapiens
GILGVITEA

SEQ ID NO: 1074407 - protein, 9 aa, Homo Sapiens
DALRKQNWE

SEQ ID NO: 1074408 - protein, 9 aa, Homo Sapiens
SILPIKCLK

SEQ ID NO: 1074409 - protein, 9 aa, Homo Sapiens
YPLSSKRPK

SEQ ID NO: 1074410 - protein, 9 aa, Homo Sapiens
PSNTTGESD

SEQ ID NO: 1074411 - protein, 9 aa, Homo Sapiens
AAKNEVKEV

SEQ ID NO: 1074412 - protein, 9 aa, Homo Sapiens
SNWNFLIFE

SEQ ID NO: 1074413 - protein, 9 aa, Homo Sapiens
FERLECSED

SEQ ID NO: 1074414 - protein, 9 aa, Homo Sapiens
NTTLNGFYI

SEQ ID NO: 1074415 - protein, 9 aa, Homo Sapiens
PGYLPPPQL

SEQ ID NO: 1074416 - protein, 9 aa, Homo Sapiens
AELPRPLLM

SEQ ID NO: 1074417 - protein, 9 aa, Homo Sapiens
AAGGKGEKN

SEQ ID NO: 1074418 - protein, 9 aa, Homo Sapiens
RPSCPDTAP

SEQ ID NO: 1074419 - protein, 9 aa, Homo Sapiens
ECISMMTPS

SEQ ID NO: 1074420 - protein, 9 aa, Homo Sapiens
IPSGPSKGG

SEQ ID NO: 1074421 - protein, 9 aa, Homo Sapiens
RGKEVPADI

SEQ ID NO: 1074422 - protein, 9 aa, Homo Sapiens
NFFKTSIQI

SEQ ID NO: 1074423 - protein, 9 aa, Homo Sapiens
TANYNLFSS

SEQ ID NO: 1074424 - protein, 9 aa, Homo Sapiens
KKAAGDASD

SEQ ID NO: 1074425 - protein, 9 aa, Homo Sapiens
WLKEEYEES

SEQ ID NO: 1074426 - protein, 9 aa, Homo Sapiens
KNVVPCVLF

SEQ ID NO: 1074427 - protein, 9 aa, Homo Sapiens
TRCRKKDAQ

SEQ ID NO: 1074428 - protein, 9 aa, Homo Sapiens
PGPHSRRKM

SEQ ID NO: 1074429 - protein, 9 aa, Homo Sapiens
KGDQGVKRS

SEQ ID NO: 1074430 - protein, 9 aa, Homo Sapiens
RKLAPLSKK

SEQ ID NO: 1074431 - protein, 9 aa, Homo Sapiens
LFDPWSLER

SEQ ID NO: 1074432 - protein, 9 aa, Homo Sapiens
GFLLISQTW

SEQ ID NO: 1074433 - protein, 9 aa, Homo Sapiens
FDLGMGVVF

SEQ ID NO: 1074434 - protein, 9 aa, Homo Sapiens
KSPLLWDTK

SEQ ID NO: 1074435 - protein, 9 aa, Homo Sapiens
HGVAPLATY

SEQ ID NO: 1074436 - protein, 9 aa, Homo Sapiens
TPGNNGVLA

SEQ ID NO: 1074437 - protein, 9 aa, Homo Sapiens
GRDISGPGE

SEQ ID NO: 1074438 - protein, 9 aa, Homo Sapiens
KVAAAEGAG

SEQ ID NO: 1074439 - protein, 9 aa, Homo Sapiens
HEKMEMKNI

SEQ ID NO: 1074440 - protein, 9 aa, Homo Sapiens
EDQAVVETM

SEQ ID NO: 1074441 - protein, 9 aa, Homo Sapiens
QDPAAVFFV

SEQ ID NO: 1074442 - protein, 9 aa, Homo Sapiens
PHIQMNPYT

SEQ ID NO: 1074443 - protein, 9 aa, Homo Sapiens
LVQTVTSAE

SEQ ID NO: 1074444 - protein, 9 aa, Homo Sapiens
SLTTIGFEN

SEQ ID NO: 1074445 - protein, 9 aa, Homo Sapiens
SGPLSVTSH

SEQ ID NO: 1074446 - protein, 9 aa, Homo Sapiens
QREKKKLEA

SEQ ID NO: 1074447 - protein, 9 aa, Homo Sapiens
PLGALSKPM

SEQ ID NO: 1074448 - protein, 9 aa, Homo Sapiens
PALSPSSVT

SEQ ID NO: 1074449 - protein, 9 aa, Homo Sapiens
ISFRYPKEF

SEQ ID NO: 1074450 - protein, 9 aa, Homo Sapiens
GEYSFEKEK

SEQ ID NO: 1074451 - protein, 9 aa, Homo Sapiens
SFWNTIVKV

SEQ ID NO: 1074452 - protein, 9 aa, Homo Sapiens
KFEPNHVIF

SEQ ID NO: 1074453 - protein, 9 aa, Homo Sapiens
TQLHVKTWY

SEQ ID NO: 1074454 - protein, 9 aa, Homo Sapiens
DGKLPSSAR

SEQ ID NO: 1074455 - protein, 9 aa, Homo Sapiens
LEKMNNYWN

SEQ ID NO: 1074456 - protein, 9 aa, Homo Sapiens
GGNPSIFSS

SEQ ID NO: 1074457 - protein, 9 aa, Homo Sapiens
DGEKLGTEE

SEQ ID NO: 1074458 - protein, 9 aa, Homo Sapiens
FHYGQSERH

SEQ ID NO: 1074459 - protein, 9 aa, Homo Sapiens
LALAEGTHP

SEQ ID NO: 1074460 - protein, 9 aa, Homo Sapiens
LVAQKNFRK

SEQ ID NO: 1074461 - protein, 9 aa, Homo Sapiens
SVLGGRSHV

SEQ ID NO: 1074462 - protein, 9 aa, Homo Sapiens
VPSPFSTVV

SEQ ID NO: 1074463 - protein, 9 aa, Homo Sapiens
SPSFQVQVT

SEQ ID NO: 1074464 - protein, 9 aa, Homo Sapiens
PLLCWYQTP

SEQ ID NO: 1074465 - protein, 9 aa, Homo Sapiens
RDASVSQES

SEQ ID NO: 1074466 - protein, 9 aa, Homo Sapiens
KLDKRENSQ

SEQ ID NO: 1074467 - protein, 9 aa, Homo Sapiens
VQKKYLEYR

SEQ ID NO: 1074468 - protein, 9 aa, Homo Sapiens
SSASYKKEN

SEQ ID NO: 1074469 - protein, 9 aa, Homo Sapiens
TPSLHGTRR

SEQ ID NO: 1074470 - protein, 9 aa, Homo Sapiens
QGGHPENGN

SEQ ID NO: 1074471 - protein, 9 aa, Homo Sapiens
GRFLQGFRD

SEQ ID NO: 1074472 - protein, 9 aa, Homo Sapiens
TLEEIEEGV

SEQ ID NO: 1074473 - protein, 9 aa, Homo Sapiens
IIESKHFQY

SEQ ID NO: 1074474 - protein, 9 aa, Homo Sapiens
IVSFNHNVL

SEQ ID NO: 1074475 - protein, 9 aa, Homo Sapiens
FVLTELWPQ

SEQ ID NO: 1074476 - protein, 9 aa, Homo Sapiens
GVTFVPDIR

SEQ ID NO: 1074477 - protein, 9 aa, Homo Sapiens
EMTGKKEET

SEQ ID NO: 1074478 - protein, 9 aa, Homo Sapiens
GNTSVEKGL

SEQ ID NO: 1074479 - protein, 9 aa, Homo Sapiens
VWRGTNVNM

SEQ ID NO: 1074480 - protein, 9 aa, Homo Sapiens
QNAAGVKFS

SEQ ID NO: 1074481 - protein, 9 aa, Homo Sapiens
ALSKLDMLQ

SEQ ID NO: 1074482 - protein, 9 aa, Homo Sapiens
SGEETEKTS

SEQ ID NO: 1074483 - protein, 9 aa, Homo Sapiens
EEVCNLLGA

SEQ ID NO: 1074484 - protein, 9 aa, Homo Sapiens
VPSAEPEPI

SEQ ID NO: 1074485 - protein, 9 aa, Homo Sapiens
AKCNLSFCL

SEQ ID NO: 1074486 - protein, 9 aa, Homo Sapiens
QLEREDQRF

SEQ ID NO: 1074487 - protein, 9 aa, Homo Sapiens
TKKEHSTLT

SEQ ID NO: 1074488 - protein, 9 aa, Homo Sapiens
KAESFNLLS

SEQ ID NO: 1074489 - protein, 9 aa, Homo Sapiens
HMLNLTQEE

SEQ ID NO: 1074490 - protein, 9 aa, Homo Sapiens
SDTFISLLT

SEQ ID NO: 1074491 - protein, 9 aa, Homo Sapiens
SVLYPIWYQ

SEQ ID NO: 1074492 - protein, 9 aa, Homo Sapiens
YGHIRLVQF

SEQ ID NO: 1074493 - protein, 9 aa, Homo Sapiens
GDASSLGPY

SEQ ID NO: 1074494 - protein, 9 aa, Homo Sapiens
FWLAIRIGK

SEQ ID NO: 1074495 - protein, 9 aa, Homo Sapiens
YLSQLCEDP

SEQ ID NO: 1074496 - protein, 9 aa, Homo Sapiens
EAQLMTKHL

SEQ ID NO: 1074497 - protein, 9 aa, Homo Sapiens
EKKDSKARL

SEQ ID NO: 1074498 - protein, 9 aa, Homo Sapiens
SQEWFRVFS

SEQ ID NO: 1074499 - protein, 9 aa, Homo Sapiens
CSWFTEIGA

SEQ ID NO: 1074500 - protein, 9 aa, Homo Sapiens
YTKNNLYVL

SEQ ID NO: 1074501 - protein, 9 aa, Homo Sapiens
KVAFYNKIF

SEQ ID NO: 1074502 - protein, 9 aa, Homo Sapiens
LYMGKENLK

SEQ ID NO: 1074503 - protein, 9 aa, Homo Sapiens
ARKPLLRTE

SEQ ID NO: 1074504 - protein, 9 aa, Homo Sapiens
VRTLFRSQP

SEQ ID NO: 1074505 - protein, 9 aa, Homo Sapiens
RGRLPGERL

SEQ ID NO: 1074506 - protein, 9 aa, Homo Sapiens
GLDPHFVLT

SEQ ID NO: 1074507 - protein, 9 aa, Homo Sapiens
GTTSFRLTM

SEQ ID NO: 1074508 - protein, 9 aa, Homo Sapiens
HEGCALDKQ

SEQ ID NO: 1074509 - protein, 9 aa, Homo Sapiens
SAVLLFSIE

SEQ ID NO: 1074510 - protein, 9 aa, Homo Sapiens
SEGQCIPSS

SEQ ID NO: 1074511 - protein, 9 aa, Homo Sapiens
IPSLRKSFA

SEQ ID NO: 1074512 - protein, 9 aa, Homo Sapiens
CYGLIPEEF

SEQ ID NO: 1074513 - protein, 9 aa, Homo Sapiens
LRRELDKSL

SEQ ID NO: 1074514 - protein, 9 aa, Homo Sapiens
NWELREELR

SEQ ID NO: 1074515 - protein, 9 aa, Homo Sapiens
QSTNREHDL

SEQ ID NO: 1074516 - protein, 9 aa, Homo Sapiens
LVTPVWWKD

SEQ ID NO: 1074517 - protein, 9 aa, Homo Sapiens
LPGPQSPIG

SEQ ID NO: 1074518 - protein, 9 aa, Homo Sapiens
TACVYHKHF

SEQ ID NO: 1074519 - protein, 9 aa, Homo Sapiens
KPSRWDPQS

SEQ ID NO: 1074520 - protein, 9 aa, Homo Sapiens
TSLFSPNRQ

SEQ ID NO: 1074521 - protein, 9 aa, Homo Sapiens
VLPVDPHSL

SEQ ID NO: 1074522 - protein, 9 aa, Homo Sapiens
SSKEAGLDV

SEQ ID NO: 1074523 - protein, 9 aa, Homo Sapiens
PAKSKSCKF

SEQ ID NO: 1074524 - protein, 9 aa, Homo Sapiens
FRASATAKA

SEQ ID NO: 1074525 - protein, 9 aa, Homo Sapiens
DGQIFSAYP

SEQ ID NO: 1074526 - protein, 9 aa, Homo Sapiens
KDINFWVER

SEQ ID NO: 1074527 - protein, 9 aa, Homo Sapiens
PPPSPISPP

SEQ ID NO: 1074528 - protein, 9 aa, Homo Sapiens
ILKVNDEST

SEQ ID NO: 1074529 - protein, 9 aa, Homo Sapiens
LFDNFSWWL

SEQ ID NO: 1074530 - protein, 9 aa, Homo Sapiens
AEHQKISFG

SEQ ID NO: 1074531 - protein, 9 aa, Homo Sapiens
SFLSYKEFS

SEQ ID NO: 1074532 - protein, 9 aa, Homo Sapiens
SIACSPVSG

SEQ ID NO: 1074533 - protein, 9 aa, Homo Sapiens
KWATWVSWS

SEQ ID NO: 1074534 - protein, 9 aa, Homo Sapiens
WFEVQQTWS

SEQ ID NO: 1074535 - protein, 9 aa, Homo Sapiens
LPHRALSSL

SEQ ID NO: 1074536 - protein, 9 aa, Homo Sapiens
GAGATREDK

SEQ ID NO: 1074537 - protein, 9 aa, Homo Sapiens
VNSNAHLNS

SEQ ID NO: 1074538 - protein, 9 aa, Homo Sapiens
DFLENQEDI

SEQ ID NO: 1074539 - protein, 9 aa, Homo Sapiens
LFPLEFRLY

SEQ ID NO: 1074540 - protein, 9 aa, Homo Sapiens
GGGGGRGSS

SEQ ID NO: 1074541 - protein, 9 aa, Homo Sapiens
DGWSHGYNF

SEQ ID NO: 1074542 - protein, 9 aa, Homo Sapiens
RSRLSVTLP

SEQ ID NO: 1074543 - protein, 9 aa, Homo Sapiens
ESPAIISLT

SEQ ID NO: 1074544 - protein, 9 aa, Homo Sapiens
SLDGSDAAP

SEQ ID NO: 1074545 - protein, 9 aa, Homo Sapiens
RELQIMKKL

SEQ ID NO: 1074546 - protein, 9 aa, Homo Sapiens
AWARPPKLP

SEQ ID NO: 1074547 - protein, 9 aa, Homo Sapiens
GATMDGFYR

SEQ ID NO: 1074548 - protein, 9 aa, Homo Sapiens
GRDKAAPLN

SEQ ID NO: 1074549 - protein, 9 aa, Homo Sapiens
NVQKQKRSL

SEQ ID NO: 1074550 - protein, 9 aa, Homo Sapiens
YNAWLLYEL

SEQ ID NO: 1074551 - protein, 9 aa, Homo Sapiens
LVFKEANTL

SEQ ID NO: 1074552 - protein, 9 aa, Homo Sapiens
RIFAGQDSS

SEQ ID NO: 1074553 - protein, 9 aa, Homo Sapiens
GPQAGPLSR

SEQ ID NO: 1074554 - protein, 9 aa, Homo Sapiens
ATWEERKES

SEQ ID NO: 1074555 - protein, 9 aa, Homo Sapiens
ENGAHVNRV

SEQ ID NO: 1074556 - protein, 9 aa, Homo Sapiens
QGTSCPALS

SEQ ID NO: 1074557 - protein, 9 aa, Homo Sapiens
TERNVCGGQ

SEQ ID NO: 1074558 - protein, 9 aa, Homo Sapiens
HELNEEIGE

SEQ ID NO: 1074559 - protein, 9 aa, Homo Sapiens
VELVVATWV

SEQ ID NO: 1074560 - protein, 9 aa, Homo Sapiens
SPIKDASPT

SEQ ID NO: 1074561 - protein, 9 aa, Homo Sapiens
FNIDGFEEI

SEQ ID NO: 1074562 - protein, 9 aa, Homo Sapiens
SLQKPTSTR

SEQ ID NO: 1074563 - protein, 9 aa, Homo Sapiens
NYGFPDVGH

SEQ ID NO: 1074564 - protein, 9 aa, Homo Sapiens
ARPPKLPTF

SEQ ID NO: 1074565 - protein, 9 aa, Homo Sapiens
SPPGLLDTV

SEQ ID NO: 1074566 - protein, 9 aa, Homo Sapiens
RPRLRRPRQ

SEQ ID NO: 1074567 - protein, 9 aa, Homo Sapiens
TENTGTQAN

SEQ ID NO: 1074568 - protein, 9 aa, Homo Sapiens
SAAPPIQSR

SEQ ID NO: 1074569 - protein, 9 aa, Homo Sapiens
AVASSSYRT

SEQ ID NO: 1074570 - protein, 9 aa, Homo Sapiens
ARERWGLAQ

SEQ ID NO: 1074571 - protein, 9 aa, Homo Sapiens
KVQKVPPGL

SEQ ID NO: 1074572 - protein, 9 aa, Homo Sapiens
QAYNFFLTT

SEQ ID NO: 1074573 - protein, 9 aa, Homo Sapiens
NLPVLVFVQ

SEQ ID NO: 1074574 - protein, 9 aa, Homo Sapiens
RESDDFFGQ

SEQ ID NO: 1074575 - protein, 9 aa, Homo Sapiens
HVNRVTVHG

SEQ ID NO: 1074576 - protein, 9 aa, Homo Sapiens
QKEQPLSTA

SEQ ID NO: 1074577 - protein, 9 aa, Homo Sapiens
VVVQSLDGS

SEQ ID NO: 1074578 - protein, 9 aa, Homo Sapiens
PPSASLVQT

SEQ ID NO: 1074579 - protein, 9 aa, Homo Sapiens
PLFRPTQPL

SEQ ID NO: 1074580 - protein, 9 aa, Homo Sapiens
AEKQREKPL

SEQ ID NO: 1074581 - protein, 9 aa, Homo Sapiens
PACPHEKHL

SEQ ID NO: 1074582 - protein, 9 aa, Homo Sapiens
EILVAEVQA

SEQ ID NO: 1074583 - protein, 9 aa, Homo Sapiens
CSTMADEIR

SEQ ID NO: 1074584 - protein, 9 aa, Homo Sapiens
NPGLDEPPS

SEQ ID NO: 1074585 - protein, 9 aa, Homo Sapiens
LAVMSYDCF

SEQ ID NO: 1074586 - protein, 9 aa, Homo Sapiens
FLGSDRLVP

SEQ ID NO: 1074587 - protein, 9 aa, Homo Sapiens
NISNGGPAL

SEQ ID NO: 1074588 - protein, 9 aa, Homo Sapiens
LLGKLAPCG

SEQ ID NO: 1074589 - protein, 9 aa, Homo Sapiens
AYNFFLTTA

SEQ ID NO: 1074590 - protein, 9 aa, Homo Sapiens
SNSGGGSCS

SEQ ID NO: 1074591 - protein, 9 aa, Homo Sapiens
MVLQLPSKS

SEQ ID NO: 1074592 - protein, 9 aa, Homo Sapiens
AGRGGAGNV

SEQ ID NO: 1074593 - protein, 9 aa, Homo Sapiens
NAKKSPLLW

SEQ ID NO: 1074594 - protein, 9 aa, Homo Sapiens
VLAPAAPPS

SEQ ID NO: 1074595 - protein, 9 aa, Homo Sapiens
RLGTQKYPS

SEQ ID NO: 1074596 - protein, 9 aa, Homo Sapiens
GSNPNCVRM

SEQ ID NO: 1074597 - protein, 9 aa, Homo Sapiens
FLSVLFSTI

SEQ ID NO: 1074598 - protein, 9 aa, Homo Sapiens
KKHQQEQKQ

SEQ ID NO: 1074599 - protein, 9 aa, Homo Sapiens
QGITGPNGA

SEQ ID NO: 1074600 - protein, 9 aa, Homo Sapiens
VKEVLARDS

SEQ ID NO: 1074601 - protein, 9 aa, Homo Sapiens
GHMDRQRRN

SEQ ID NO: 1074602 - protein, 9 aa, Homo Sapiens
NPIEASSYR

SEQ ID NO: 1074603 - protein, 9 aa, Homo Sapiens
SATLEGLLQ

SEQ ID NO: 1074604 - protein, 9 aa, Homo Sapiens
VLSRATPDE

SEQ ID NO: 1074605 - protein, 9 aa, Homo Sapiens
VKAGSSSFS

SEQ ID NO: 1074606 - protein, 9 aa, Homo Sapiens
LADSSSSTA

SEQ ID NO: 1074607 - protein, 9 aa, Homo Sapiens
QGCGAVGDW

SEQ ID NO: 1074608 - protein, 9 aa, Homo Sapiens
KKYLEYRQV

SEQ ID NO: 1074609 - protein, 8 aa, Homo Sapiens
IWRSRAGA

SEQ ID NO: 1074610 - protein, 9 aa, Homo Sapiens
WTSLASAGS

SEQ ID NO: 1074611 - protein, 9 aa, Homo Sapiens
GFRYSKLSE

SEQ ID NO: 1074612 - protein, 9 aa, Homo Sapiens
GTPMAHSPP

SEQ ID NO: 1074613 - protein, 9 aa, Homo Sapiens
SVLFSTIVV

SEQ ID NO: 1074614 - protein, 9 aa, Homo Sapiens
NKLVKGVNF

SEQ ID NO: 1074615 - protein, 9 aa, Homo Sapiens
KVQISEMDA

SEQ ID NO: 1074616 - protein, 9 aa, Homo Sapiens
QEETLDISF

SEQ ID NO: 1074617 - protein, 9 aa, Homo Sapiens
VQACTSGSC

SEQ ID NO: 1074618 - protein, 9 aa, Homo Sapiens
LAPLGLLLD

SEQ ID NO: 1074619 - protein, 9 aa, Homo Sapiens
GDRLVQEGV

SEQ ID NO: 1074620 - protein, 9 aa, Homo Sapiens
PPSFFSSPL

SEQ ID NO: 1074621 - protein, 9 aa, Homo Sapiens
GFENIAPTT

SEQ ID NO: 1074622 - protein, 9 aa, Homo Sapiens
YLRLLQTQS

SEQ ID NO: 1074623 - protein, 9 aa, Homo Sapiens
KNNLYVLST

SEQ ID NO: 1074624 - protein, 9 aa, Homo Sapiens
VVEKDGFLL

SEQ ID NO: 1074625 - protein, 9 aa, Homo Sapiens
EYGGKVCYG

SEQ ID NO: 1074626 - protein, 9 aa, Homo Sapiens
PQREKVEMQ

SEQ ID NO: 1074627 - protein, 9 aa, Homo Sapiens
LMDRHDFEF

SEQ ID NO: 1074628 - protein, 9 aa, Homo Sapiens
KALGPSPYA

SEQ ID NO: 1074629 - protein, 9 aa, Homo Sapiens
YFLIIRMVL

SEQ ID NO: 1074630 - protein, 9 aa, Homo Sapiens
AYPRQITDG

SEQ ID NO: 1074631 - protein, 9 aa, Homo Sapiens
GRELAYGGH

SEQ ID NO: 1074632 - protein, 9 aa, Homo Sapiens
SRSGSNPNC

SEQ ID NO: 1074633 - protein, 9 aa, Homo Sapiens
GIVDECCFQ

SEQ ID NO: 1074634 - protein, 9 aa, Homo Sapiens
KQPVVPTHS

SEQ ID NO: 1074635 - protein, 9 aa, Homo Sapiens
HLNYHRSFI

SEQ ID NO: 1074636 - protein, 9 aa, Homo Sapiens
QRKAFSTCA

SEQ ID NO: 1074637 - protein, 9 aa, Homo Sapiens
PVENSHSLS

SEQ ID NO: 1074638 - protein, 9 aa, Homo Sapiens
ASRLEAGGG

SEQ ID NO: 1074639 - protein, 9 aa, Homo Sapiens
TEVVLCEDP

SEQ ID NO: 1074640 - protein, 9 aa, Homo Sapiens
GPGFSGAPG

SEQ ID NO: 1074641 - protein, 9 aa, Homo Sapiens
TTCVEKKDS

SEQ ID NO: 1074642 - protein, 9 aa, Homo Sapiens
SPACPHEKH

SEQ ID NO: 1074643 - protein, 9 aa, Homo Sapiens
LTLVLPVDP

SEQ ID NO: 1074644 - protein, 9 aa, Homo Sapiens
LDHIAREVE

SEQ ID NO: 1074645 - protein, 9 aa, Homo Sapiens
ERSPAPPPS

SEQ ID NO: 1074646 - protein, 9 aa, Homo Sapiens
VMKIPSAGE

SEQ ID NO: 1074647 - protein, 9 aa, Homo Sapiens
PSTNITAAT

SEQ ID NO: 1074648 - protein, 9 aa, Homo Sapiens
KECGNTFLL

SEQ ID NO: 1074649 - protein, 9 aa, Homo Sapiens
EVDSTGHSF

SEQ ID NO: 1074650 - protein, 9 aa, Homo Sapiens
CKMAQAWRL

SEQ ID NO: 1074651 - protein, 9 aa, Homo Sapiens
ACCTFSQSQ

SEQ ID NO: 1074652 - protein, 9 aa, Homo Sapiens
ASSLFQTLE

SEQ ID NO: 1074653 - protein, 9 aa, Homo Sapiens
PLPPFTPTP

SEQ ID NO: 1074654 - protein, 9 aa, Homo Sapiens
ASEFGQLTR

SEQ ID NO: 1074655 - protein, 9 aa, Homo Sapiens
LSRLRYNRS

SEQ ID NO: 1074656 - protein, 9 aa, Homo Sapiens
DSLATYAYK

SEQ ID NO: 1074657 - protein, 9 aa, Homo Sapiens
VRMNYTLRK

SEQ ID NO: 1074658 - protein, 9 aa, Homo Sapiens
NLSFLKLCY

SEQ ID NO: 1074659 - protein, 9 aa, Homo Sapiens
KINGISGNF

SEQ ID NO: 1074660 - protein, 9 aa, Homo Sapiens
MIIQRVIRV

SEQ ID NO: 1074661 - protein, 9 aa, Homo Sapiens
PPAKSKSCK

SEQ ID NO: 1074662 - protein, 9 aa, Homo Sapiens
PVLSATFRG

SEQ ID NO: 1074663 - protein, 9 aa, Homo Sapiens
GIILRIVQD

SEQ ID NO: 1074664 - protein, 9 aa, Homo Sapiens
SYVITRAFC

SEQ ID NO: 1074665 - protein, 9 aa, Homo Sapiens
KIWQLLGAP

SEQ ID NO: 1074666 - protein, 9 aa, Homo Sapiens
EWKVLVLTE

SEQ ID NO: 1074667 - protein, 9 aa, Homo Sapiens
RLWEIVSLG

SEQ ID NO: 1074668 - protein, 9 aa, Homo Sapiens
KSRSLKKRM

SEQ ID NO: 1074669 - protein, 9 aa, Homo Sapiens
FFPSTNITA

SEQ ID NO: 1074670 - protein, 9 aa, Homo Sapiens
AFHAHRDRE

SEQ ID NO: 1074671 - protein, 9 aa, Homo Sapiens
PWLNNQENT

SEQ ID NO: 1074672 - protein, 9 aa, Homo Sapiens
STNLAVYEN

SEQ ID NO: 1074673 - protein, 9 aa, Homo Sapiens
THCSPELKE

SEQ ID NO: 1074674 - protein, 9 aa, Homo Sapiens
KRSYVCIEC

SEQ ID NO: 1074675 - protein, 9 aa, Homo Sapiens
PPYSFTPFM

SEQ ID NO: 1074676 - protein, 9 aa, Homo Sapiens
PLPPPSPIS

SEQ ID NO: 1074677 - protein, 9 aa, Homo Sapiens
SGHRPPDCK

SEQ ID NO: 1074678 - protein, 9 aa, Homo Sapiens
RCTAIKYHI

SEQ ID NO: 1074679 - protein, 9 aa, Homo Sapiens
IHALSCMNQ

SEQ ID NO: 1074680 - protein, 9 aa, Homo Sapiens
KELFCELFP

SEQ ID NO: 1074681 - protein, 9 aa, Homo Sapiens
DLNDSKRFG

SEQ ID NO: 1074682 - protein, 9 aa, Homo Sapiens
SRSLKKRML

SEQ ID NO: 1074683 - protein, 9 aa, Homo Sapiens
CTSSGRGPP

SEQ ID NO: 1074684 - protein, 9 aa, Homo Sapiens
PPPPSPQAP

SEQ ID NO: 1074685 - protein, 9 aa, Homo Sapiens
SVFYRALTP

SEQ ID NO: 1074686 - protein, 9 aa, Homo Sapiens
FSAYPSQEG

SEQ ID NO: 1074687 - protein, 9 aa, Homo Sapiens
FYIQRNVIV

SEQ ID NO: 1074688 - protein, 9 aa, Homo Sapiens
AAPILTLSG

SEQ ID NO: 1074689 - protein, 9 aa, Homo Sapiens
ILYASNNVP

SEQ ID NO: 1074690 - protein, 9 aa, Homo Sapiens
NLSMDSFVV

SEQ ID NO: 1074691 - protein, 9 aa, Homo Sapiens
VQISEMDAP

SEQ ID NO: 1074692 - protein, 9 aa, Homo Sapiens
SIPLCQKCE

SEQ ID NO: 1074693 - protein, 9 aa, Homo Sapiens
FRSFSFEKL

SEQ ID NO: 1074694 - protein, 9 aa, Homo Sapiens
RYIFNETEV

SEQ ID NO: 1074695 - protein, 9 aa, Homo Sapiens
KLNFFKTSI

SEQ ID NO: 1074696 - protein, 9 aa, Homo Sapiens
WKSGYLVGI

SEQ ID NO: 1074697 - protein, 9 aa, Homo Sapiens
DSKRFGINT

SEQ ID NO: 1074698 - protein, 9 aa, Homo Sapiens
RSSAHCSSA

SEQ ID NO: 1074699 - protein, 9 aa, Homo Sapiens
FLHRKRHLA

SEQ ID NO: 1074700 - protein, 9 aa, Homo Sapiens
LIFELVEKM

SEQ ID NO: 1074701 - protein, 9 aa, Homo Sapiens
YILAFWNEG

SEQ ID NO: 1074702 - protein, 9 aa, Homo Sapiens
WALPHNWMQ

SEQ ID NO: 1074703 - protein, 9 aa, Homo Sapiens
ADFAPRADR

SEQ ID NO: 1074704 - protein, 9 aa, Homo Sapiens
WRRVLGIFG

SEQ ID NO: 1074705 - protein, 9 aa, Homo Sapiens
HALVMTRMD

SEQ ID NO: 1074706 - protein, 9 aa, Homo Sapiens
GATPQPGHA

SEQ ID NO: 1074707 - protein, 9 aa, Homo Sapiens
EYQQVPSSN

SEQ ID NO: 1074708 - protein, 9 aa, Homo Sapiens
QKQKRSLKA

SEQ ID NO: 1074709 - protein, 9 aa, Homo Sapiens
TFELEHFPG

SEQ ID NO: 1074710 - protein, 9 aa, Homo Sapiens
HSCICPGQY

SEQ ID NO: 1074711 - protein, 9 aa, Homo Sapiens
FQFKAKLAS

SEQ ID NO: 1074712 - protein, 9 aa, Homo Sapiens
KELGGERIL

SEQ ID NO: 1074713 - protein, 9 aa, Homo Sapiens
LQLCLRLNR

SEQ ID NO: 1074714 - protein, 9 aa, Homo Sapiens
FSENAAASL

SEQ ID NO: 1074715 - protein, 9 aa, Homo Sapiens
HGAVTSSLG

SEQ ID NO: 1074716 - protein, 9 aa, Homo Sapiens
IESMWCMVY

SEQ ID NO: 1074717 - protein, 9 aa, Homo Sapiens
GRPTLFSPE

SEQ ID NO: 1074718 - protein, 9 aa, Homo Sapiens
PSSNITLQN

SEQ ID NO: 1074719 - protein, 9 aa, Homo Sapiens
QPVPLNLPC

SEQ ID NO: 1074720 - protein, 9 aa, Homo Sapiens
IREQEKMIR

SEQ ID NO: 1074721 - protein, 9 aa, Homo Sapiens
LEAENNKTS

SEQ ID NO: 1074722 - protein, 9 aa, Homo Sapiens
SQSPEGGNP

SEQ ID NO: 1074723 - protein, 9 aa, Homo Sapiens
AKKIKLPGA

SEQ ID NO: 1074724 - protein, 9 aa, Homo Sapiens
FSYDLNLCE

SEQ ID NO: 1074725 - protein, 9 aa, Homo Sapiens
FIAGDLEPS

SEQ ID NO: 1074726 - protein, 9 aa, Homo Sapiens
AAHRLTHSS

SEQ ID NO: 1074727 - protein, 9 aa, Homo Sapiens
LEDNWKQEL

SEQ ID NO: 1074728 - protein, 9 aa, Homo Sapiens
GPVDGSDKE

SEQ ID NO: 1074729 - protein, 9 aa, Homo Sapiens
PPYNVRASE

SEQ ID NO: 1074730 - protein, 9 aa, Homo Sapiens
NMEKKIQHI

SEQ ID NO: 1074731 - protein, 9 aa, Homo Sapiens
RLARGQGGA

SEQ ID NO: 1074732 - protein, 9 aa, Homo Sapiens
IIRHKDVHK

SEQ ID NO: 1074733 - protein, 9 aa, Homo Sapiens
PAPYTLPPP

SEQ ID NO: 1074734 - protein, 9 aa, Homo Sapiens
VRWGNQLTQ

SEQ ID NO: 1074735 - protein, 9 aa, Homo Sapiens
PSLITAVAQ

SEQ ID NO: 1074736 - protein, 9 aa, Homo Sapiens
SKSQYKTWQ

SEQ ID NO: 1074737 - protein, 9 aa, Homo Sapiens
GEVIHQMPD

SEQ ID NO: 1074738 - protein, 9 aa, Homo Sapiens
KTHSSNSML

SEQ ID NO: 1074739 - protein, 9 aa, Homo Sapiens
VLFSTIVVT

SEQ ID NO: 1074740 - protein, 9 aa, Homo Sapiens
KWMDFVSSH

SEQ ID NO: 1074741 - protein, 9 aa, Homo Sapiens
VPAFAFSLN

SEQ ID NO: 1074742 - protein, 9 aa, Homo Sapiens
LGQFNKEGA

SEQ ID NO: 1074743 - protein, 9 aa, Homo Sapiens
EIEVLCKSL

SEQ ID NO: 1074744 - protein, 9 aa, Homo Sapiens
SSFHHGENK

SEQ ID NO: 1074745 - protein, 9 aa, Homo Sapiens
EVLEAVWYL

SEQ ID NO: 1074746 - protein, 9 aa, Homo Sapiens
QRVSQTLRA

SEQ ID NO: 1074747 - protein, 9 aa, Homo Sapiens
STSRDASVS

SEQ ID NO: 1074748 - protein, 9 aa, Homo Sapiens
LDGQIFSAY

SEQ ID NO: 1074749 - protein, 9 aa, Homo Sapiens
SLLVDDEED

SEQ ID NO: 1074750 - protein, 9 aa, Homo Sapiens
QQRIAVKSM

SEQ ID NO: 1074751 - protein, 9 aa, Homo Sapiens
PGLLDTVPR

SEQ ID NO: 1074752 - protein, 9 aa, Homo Sapiens
FTYNSFMRV

SEQ ID NO: 1074753 - protein, 9 aa, Homo Sapiens
GCQGQEACL

SEQ ID NO: 1074754 - protein, 9 aa, Homo Sapiens
NKENPETRR

SEQ ID NO: 1074755 - protein, 9 aa, Homo Sapiens
SHHCAPARP

SEQ ID NO: 1074756 - protein, 9 aa, Homo Sapiens
MAGPLVLVL

SEQ ID NO: 1074757 - protein, 9 aa, Homo Sapiens
RISFKTFSY

SEQ ID NO: 1074758 - protein, 9 aa, Homo Sapiens
LCEDPQRFD

SEQ ID NO: 1074759 - protein, 9 aa, Homo Sapiens
ARGACKIYN

SEQ ID NO: 1074760 - protein, 9 aa, Homo Sapiens
ACQGLGLVV

SEQ ID NO: 1074761 - protein, 9 aa, Homo Sapiens
VSYKGVTYS

SEQ ID NO: 1074762 - protein, 9 aa, Homo Sapiens
TQSPGETFR

SEQ ID NO: 1074763 - protein, 9 aa, Homo Sapiens
FSHKIIFFL

SEQ ID NO: 1074764 - protein, 9 aa, Homo Sapiens
RDILHRSES

SEQ ID NO: 1074765 - protein, 9 aa, Homo Sapiens
LERFKLRRI

SEQ ID NO: 1074766 - protein, 9 aa, Homo Sapiens
KCTTCVEKK

SEQ ID NO: 1074767 - protein, 9 aa, Homo Sapiens
SDNSSFHHG

SEQ ID NO: 1074768 - protein, 9 aa, Homo Sapiens
VGRFKFSEE

SEQ ID NO: 1074769 - protein, 9 aa, Homo Sapiens
GAPGVSIRT

SEQ ID NO: 1074770 - protein, 9 aa, Homo Sapiens
DWMHVRDNV

SEQ ID NO: 1074771 - protein, 9 aa, Homo Sapiens
QPQAYNFFL

SEQ ID NO: 1074772 - protein, 9 aa, Homo Sapiens
SFSFEKLRQ

SEQ ID NO: 1074773 - protein, 9 aa, Homo Sapiens
GQLLQLQPE

SEQ ID NO: 1074774 - protein, 9 aa, Homo Sapiens
TVCRLVTCV

SEQ ID NO: 1074775 - protein, 9 aa, Homo Sapiens
HKTSSLDGA

SEQ ID NO: 1074776 - protein, 9 aa, Homo Sapiens
GKDYPVARF

SEQ ID NO: 1074777 - protein, 9 aa, Homo Sapiens
LLRSPSSDL

SEQ ID NO: 1074778 - protein, 9 aa, Homo Sapiens
LCEGREKTT

SEQ ID NO: 1074779 - protein, 9 aa, Homo Sapiens
TDLNDSKRF

SEQ ID NO: 1074780 - protein, 9 aa, Homo Sapiens
FSYCKSYVI

SEQ ID NO: 1074781 - protein, 9 aa, Homo Sapiens
RRFFRINDQ

SEQ ID NO: 1074782 - protein, 9 aa, Homo Sapiens
DRHSTQGDQ

SEQ ID NO: 1074783 - protein, 9 aa, Homo Sapiens
KYESKLKQF

SEQ ID NO: 1074784 - protein, 9 aa, Homo Sapiens
ECKKAVRWG

SEQ ID NO: 1074785 - protein, 9 aa, Homo Sapiens
IFFVGPVSP

SEQ ID NO: 1074786 - protein, 9 aa, Homo Sapiens
KGLGKNSEK

SEQ ID NO: 1074787 - protein, 9 aa, Homo Sapiens
EKKELKSMK

SEQ ID NO: 1074788 - protein, 9 aa, Homo Sapiens
IRLVWQLAS

SEQ ID NO: 1074789 - protein, 9 aa, Homo Sapiens
KCEDAYPRQ

SEQ ID NO: 1074790 - protein, 9 aa, Homo Sapiens
NYTDSFFKF

SEQ ID NO: 1074791 - protein, 9 aa, Homo Sapiens
LEEKLAPTD

SEQ ID NO: 1074792 - protein, 9 aa, Homo Sapiens
SKLKQFTKI

SEQ ID NO: 1074793 - protein, 9 aa, Homo Sapiens
LPRLEILVA

SEQ ID NO: 1074794 - protein, 9 aa, Homo Sapiens
KKAVRWGNQ

SEQ ID NO: 1074795 - protein, 9 aa, Homo Sapiens
SHSSFIRTV

SEQ ID NO: 1074796 - protein, 9 aa, Homo Sapiens
LPLLPAVQI

SEQ ID NO: 1074797 - protein, 9 aa, Homo Sapiens
PRGPWRKLN

SEQ ID NO: 1074798 - protein, 9 aa, Homo Sapiens
YQQSRKNNS

SEQ ID NO: 1074799 - protein, 9 aa, Homo Sapiens
YTLPPPPTA

SEQ ID NO: 1074800 - protein, 9 aa, Homo Sapiens
VDTHIHALS

SEQ ID NO: 1074801 - protein, 9 aa, Homo Sapiens
TWQKMLAAT

SEQ ID NO: 1074802 - protein, 9 aa, Homo Sapiens
SILIKAWEH

SEQ ID NO: 1074803 - protein, 9 aa, Homo Sapiens
KDSEYTPVD

SEQ ID NO: 1074804 - protein, 9 aa, Homo Sapiens
QLETIFGKS

SEQ ID NO: 1074805 - protein, 9 aa, Homo Sapiens
PQQQGYMPF

SEQ ID NO: 1074806 - protein, 9 aa, Homo Sapiens
NMKGTKIGT

SEQ ID NO: 1074807 - protein, 9 aa, Homo Sapiens
TQWSWILQR

SEQ ID NO: 1074808 - protein, 9 aa, Homo Sapiens
FSFIARVRM

SEQ ID NO: 1074809 - protein, 9 aa, Homo Sapiens
KLGTEENLA

SEQ ID NO: 1074810 - protein, 9 aa, Homo Sapiens
LPGERLTSC

SEQ ID NO: 1074811 - protein, 9 aa, Homo Sapiens
QVNHMLNLT

SEQ ID NO: 1074812 - protein, 9 aa, Homo Sapiens
LFSGRDISG

SEQ ID NO: 1074813 - protein, 9 aa, Homo Sapiens
TGVFLRPYP

SEQ ID NO: 1074814 - protein, 9 aa, Homo Sapiens
QSEATFRLC

SEQ ID NO: 1074815 - protein, 9 aa, Homo Sapiens
ASIKKQKAK

SEQ ID NO: 1074816 - protein, 9 aa, Homo Sapiens
DALPKEDRL

SEQ ID NO: 1074817 - protein, 9 aa, Homo Sapiens
CAYEFAVDQ

SEQ ID NO: 1074818 - protein, 9 aa, Homo Sapiens
SGLPNNRFF

SEQ ID NO: 1074819 - protein, 9 aa, Homo Sapiens
ASTGDSTLL

SEQ ID NO: 1074820 - protein, 9 aa, Homo Sapiens
PQSKEAHIS

SEQ ID NO: 1074821 - protein, 9 aa, Homo Sapiens
FFGQTIIEV

SEQ ID NO: 1074822 - protein, 9 aa, Homo Sapiens
SVSETGTTY

SEQ ID NO: 1074823 - protein, 9 aa, Homo Sapiens
EATSALNND

SEQ ID NO: 1074824 - protein, 9 aa, Homo Sapiens
VCVTQAEIY

SEQ ID NO: 1074825 - protein, 9 aa, Homo Sapiens
TGQTPTSGP

SEQ ID NO: 1074826 - protein, 9 aa, Homo Sapiens
AHGAVTSSL

SEQ ID NO: 1074827 - protein, 9 aa, Homo Sapiens
PNKCNECGK

SEQ ID NO: 1074828 - protein, 9 aa, Homo Sapiens
MYGAHMYQA

SEQ ID NO: 1074829 - protein, 9 aa, Homo Sapiens
LGKQNSNIT

SEQ ID NO: 1074830 - protein, 9 aa, Homo Sapiens
YCKSYVITR

SEQ ID NO: 1074831 - protein, 9 aa, Homo Sapiens
KFLDLEQSG

SEQ ID NO: 1074832 - protein, 9 aa, Homo Sapiens
DKQDKDGNT

SEQ ID NO: 1074833 - protein, 9 aa, Homo Sapiens
AEITFDTFV

SEQ ID NO: 1074834 - protein, 9 aa, Homo Sapiens
TARSNSEAA

SEQ ID NO: 1074835 - protein, 9 aa, Homo Sapiens
ITKWKEIVF

SEQ ID NO: 1074836 - protein, 9 aa, Homo Sapiens
SQRKKKNIA

SEQ ID NO: 1074837 - protein, 9 aa, Homo Sapiens
LQIMKKLDH

SEQ ID NO: 1074838 - protein, 9 aa, Homo Sapiens
RNSETLFFT

SEQ ID NO: 1074839 - protein, 9 aa, Homo Sapiens
DDFCRMPPS

SEQ ID NO: 1074840 - protein, 9 aa, Homo Sapiens
PVFVEWRAQ

SEQ ID NO: 1074841 - protein, 9 aa, Homo Sapiens
LLGADAVPT

SEQ ID NO: 1074842 - protein, 9 aa, Homo Sapiens
VADKIKVLF

SEQ ID NO: 1074843 - protein, 9 aa, Homo Sapiens
DALIEPGIP

SEQ ID NO: 1074844 - protein, 9 aa, Homo Sapiens
GNTFLLDSE

SEQ ID NO: 1074845 - protein, 9 aa, Homo Sapiens
VPKMASNYL

SEQ ID NO: 1074846 - protein, 9 aa, Homo Sapiens
TAPPNVISQ

SEQ ID NO: 1074847 - protein, 9 aa, Homo Sapiens
LENWDPGTS

SEQ ID NO: 1074848 - protein, 9 aa, Homo Sapiens
LSMKQVKIF

SEQ ID NO: 1074849 - protein, 9 aa, Homo Sapiens
WNLPGGAWH

SEQ ID NO: 1074850 - protein, 9 aa, Homo Sapiens
EALVKRLWK

SEQ ID NO: 1074851 - protein, 9 aa, Homo Sapiens
TLRSINLFG

SEQ ID NO: 1074852 - protein, 9 aa, Homo Sapiens
KELIIFNRE

SEQ ID NO: 1074853 - protein, 9 aa, Homo Sapiens
DTFSDVVAI

SEQ ID NO: 1074854 - protein, 9 aa, Homo Sapiens
FSLSEPGPG

SEQ ID NO: 1074855 - protein, 9 aa, Homo Sapiens
IVSRSRTQL

SEQ ID NO: 1074856 - protein, 9 aa, Homo Sapiens
LLRCDCVIH

SEQ ID NO: 1074857 - protein, 9 aa, Homo Sapiens
AHYSNKVYE

SEQ ID NO: 1074858 - protein, 9 aa, Homo Sapiens
AVLLLNPLW

SEQ ID NO: 1074859 - protein, 9 aa, Homo Sapiens
KGADVIVNC

SEQ ID NO: 1074860 - protein, 9 aa, Homo Sapiens
SKEPSLGQE

SEQ ID NO: 1074861 - protein, 9 aa, Homo Sapiens
GHSKFTGEK

SEQ ID NO: 1074862 - protein, 9 aa, Homo Sapiens
NLPGSAEPP

SEQ ID NO: 1074863 - protein, 9 aa, Homo Sapiens
GRFKFSEER

SEQ ID NO: 1074864 - protein, 9 aa, Homo Sapiens
SLHGTRRHL

SEQ ID NO: 1074865 - protein, 9 aa, Homo Sapiens
SSYRTKKEH

SEQ ID NO: 1074866 - protein, 9 aa, Homo Sapiens
GLISRADYA

SEQ ID NO: 1074867 - protein, 9 aa, Homo Sapiens
PGEKILKNT

SEQ ID NO: 1074868 - protein, 9 aa, Homo Sapiens
VWLITKIGM

SEQ ID NO: 1074869 - protein, 9 aa, Homo Sapiens
IKPNLTKLC

SEQ ID NO: 1074870 - protein, 9 aa, Homo Sapiens
PNDTDGNHQ

SEQ ID NO: 1074871 - protein, 9 aa, Homo Sapiens
WFWEFVIAT

SEQ ID NO: 1074872 - protein, 9 aa, Homo Sapiens
QCDLSEISV

SEQ ID NO: 1074873 - protein, 9 aa, Homo Sapiens
KKKNKSFEM

SEQ ID NO: 1074874 - protein, 9 aa, Homo Sapiens
LQLSLFLLF

SEQ ID NO: 1074875 - protein, 9 aa, Homo Sapiens
SSLSLFFLG

SEQ ID NO: 1074876 - protein, 9 aa, Homo Sapiens
VICLMIENP

SEQ ID NO: 1074877 - protein, 9 aa, Homo Sapiens
YKTWQKKLA

SEQ ID NO: 1074878 - protein, 9 aa, Homo Sapiens
LAVAYATSG

SEQ ID NO: 1074879 - protein, 9 aa, Homo Sapiens
QQTRLLWKL

SEQ ID NO: 1074880 - protein, 9 aa, Homo Sapiens
VNPGLDEPP

SEQ ID NO: 1074881 - protein, 9 aa, Homo Sapiens
TAWVWSVDK

SEQ ID NO: 1074882 - protein, 9 aa, Homo Sapiens
APQEDMTPL

SEQ ID NO: 1074883 - protein, 9 aa, Homo Sapiens
EKIAKEIQV

SEQ ID NO: 1074884 - protein, 9 aa, Homo Sapiens
RRPCLGAAR

SEQ ID NO: 1074885 - protein, 9 aa, Homo Sapiens
LMLKFQFCS

SEQ ID NO: 1074886 - protein, 9 aa, Homo Sapiens
LLECGVIIY

SEQ ID NO: 1074887 - protein, 9 aa, Homo Sapiens
GTRFFFYVA

SEQ ID NO: 1074888 - protein, 9 aa, Homo Sapiens
RAAGSAQEN

SEQ ID NO: 1074889 - protein, 9 aa, Homo Sapiens
GPTSGLISV

SEQ ID NO: 1074890 - protein, 9 aa, Homo Sapiens
RGACKIYNS

SEQ ID NO: 1074891 - protein, 9 aa, Homo Sapiens
PVFVEWSEN

SEQ ID NO: 1074892 - protein, 9 aa, Homo Sapiens
YSSDILPMV

SEQ ID NO: 1074893 - protein, 9 aa, Homo Sapiens
RKEDLEDQD

SEQ ID NO: 1074894 - protein, 9 aa, Homo Sapiens
LHSACYYGH

SEQ ID NO: 1074895 - protein, 9 aa, Homo Sapiens
TMADEIRFS

SEQ ID NO: 1074896 - protein, 9 aa, Homo Sapiens
KLVKGVNFE

SEQ ID NO: 1074897 - protein, 9 aa, Homo Sapiens
PYKWYNPHP

SEQ ID NO: 1074898 - protein, 9 aa, Homo Sapiens
RTKKEHSTL

SEQ ID NO: 1074899 - protein, 9 aa, Homo Sapiens
LQLKKKNIM

SEQ ID NO: 1074900 - protein, 9 aa, Homo Sapiens
EVNISRKRK

SEQ ID NO: 1074901 - protein, 9 aa, Homo Sapiens
KISKTQLYV

SEQ ID NO: 1074902 - protein, 9 aa, Homo Sapiens
SYDCFTAIC

SEQ ID NO: 1074903 - protein, 9 aa, Homo Sapiens
QCDSSFLYN

SEQ ID NO: 1074904 - protein, 9 aa, Homo Sapiens
HLEMYVQGN

SEQ ID NO: 1074905 - protein, 9 aa, Homo Sapiens
WKEIVFDMV

SEQ ID NO: 1074906 - protein, 9 aa, Homo Sapiens
HFRLHAQYR

SEQ ID NO: 1074907 - protein, 9 aa, Homo Sapiens
HSSSERFLK

SEQ ID NO: 1074908 - protein, 9 aa, Homo Sapiens
KKLEAELAT

SEQ ID NO: 1074909 - protein, 9 aa, Homo Sapiens
LISVFDQDF

SEQ ID NO: 1074910 - protein, 9 aa, Homo Sapiens
TRRTVQMNH

SEQ ID NO: 1074911 - protein, 9 aa, Homo Sapiens
RNPHKIPNN

SEQ ID NO: 1074912 - protein, 9 aa, Homo Sapiens
GLYHVFQGI

SEQ ID NO: 1074913 - protein, 9 aa, Homo Sapiens
CKKAVRWGN

SEQ ID NO: 1074914 - protein, 9 aa, Homo Sapiens
LGATMDGFY

SEQ ID NO: 1074915 - protein, 9 aa, Homo Sapiens
RDLSTSLQE

SEQ ID NO: 1074916 - protein, 9 aa, Homo Sapiens
VSEIMPELN

SEQ ID NO: 1074917 - protein, 9 aa, Homo Sapiens
KSFLEEKDG

SEQ ID NO: 1074918 - protein, 9 aa, Homo Sapiens
FSTIVVTRL

SEQ ID NO: 1074919 - protein, 9 aa, Homo Sapiens
FFLQGQLND

SEQ ID NO: 1074920 - protein, 9 aa, Homo Sapiens
LGLWWTFDC

SEQ ID NO: 1074921 - protein, 9 aa, Homo Sapiens
GDQSPLPPF

SEQ ID NO: 1074922 - protein, 9 aa, Homo Sapiens
PPRQALLPP

SEQ ID NO: 1074923 - protein, 9 aa, Homo Sapiens
QSSGKNCDV

SEQ ID NO: 1074924 - protein, 9 aa, Homo Sapiens
LRLEGCVQG

SEQ ID NO: 1074925 - protein, 9 aa, Homo Sapiens
EVFLALVAP

SEQ ID NO: 1074926 - protein, 9 aa, Homo Sapiens
DLCKSPPQE

SEQ ID NO: 1074927 - protein, 9 aa, Homo Sapiens
LVFHSPGKL

SEQ ID NO: 1074928 - protein, 9 aa, Homo Sapiens
RRTAVTTLK

SEQ ID NO: 1074929 - protein, 9 aa, Homo Sapiens
VVAEGLLGS

SEQ ID NO: 1074930 - protein, 9 aa, Homo Sapiens
LPRSRRSRL

SEQ ID NO: 1074931 - protein, 9 aa, Homo Sapiens
GNVPVENLE

SEQ ID NO: 1074932 - protein, 9 aa, Homo Sapiens
LQNSTTWRD

SEQ ID NO: 1074933 - protein, 9 aa, Homo Sapiens
TAHYPTPAK

SEQ ID NO: 1074934 - protein, 9 aa, Homo Sapiens
EFSESHNIV

SEQ ID NO: 1074935 - protein, 9 aa, Homo Sapiens
IMYDIFSFK

SEQ ID NO: 1074936 - protein, 9 aa, Homo Sapiens
QEKYECVAT

SEQ ID NO: 1074937 - protein, 9 aa, Homo Sapiens
SLFEDTPLH

SEQ ID NO: 1074938 - protein, 9 aa, Homo Sapiens
SGRLFKGKK

SEQ ID NO: 1074939 - protein, 9 aa, Homo Sapiens
FFVGPVSPS

SEQ ID NO: 1074940 - protein, 9 aa, Homo Sapiens
AQPGVPLRK

SEQ ID NO: 1074941 - protein, 9 aa, Homo Sapiens
TVKEMQLER

SEQ ID NO: 1074942 - protein, 9 aa, Homo Sapiens
KDDFNERPA

SEQ ID NO: 1074943 - protein, 9 aa, Homo Sapiens
STVSVKNIL

SEQ ID NO: 1074944 - protein, 9 aa, Homo Sapiens
KEGKQEEGQ

SEQ ID NO: 1074945 - protein, 9 aa, Homo Sapiens
SCPAGKKGE

SEQ ID NO: 1074946 - protein, 9 aa, Homo Sapiens
HFVNPVLNQ

SEQ ID NO: 1074947 - protein, 9 aa, Homo Sapiens
RVREAQGEA

SEQ ID NO: 1074948 - protein, 9 aa, Homo Sapiens
KRTRSVNKL

SEQ ID NO: 1074949 - protein, 9 aa, Homo Sapiens
ECNSSYIVG

SEQ ID NO: 1074950 - protein, 9 aa, Homo Sapiens
TAPMSSKEA

SEQ ID NO: 1074951 - protein, 9 aa, Homo Sapiens
SLSPESVCS

SEQ ID NO: 1074952 - protein, 9 aa, Homo Sapiens
VKRSSGEQG

SEQ ID NO: 1074953 - protein, 9 aa, Homo Sapiens
GYMSERDES

SEQ ID NO: 1074954 - protein, 9 aa, Homo Sapiens
KILQFVATG

SEQ ID NO: 1074955 - protein, 9 aa, Homo Sapiens
RLWAHAFLQ

SEQ ID NO: 1074956 - protein, 9 aa, Homo Sapiens
KKDSKARLV

SEQ ID NO: 1074957 - protein, 9 aa, Homo Sapiens
AQENLNLLV

SEQ ID NO: 1074958 - protein, 9 aa, Homo Sapiens
YNKIFLSVT

SEQ ID NO: 1074959 - protein, 9 aa, Homo Sapiens
ETSYSPGSR

SEQ ID NO: 1074960 - protein, 9 aa, Homo Sapiens
PPKLPTFGE

SEQ ID NO: 1074961 - protein, 9 aa, Homo Sapiens
AAGVKFSCS

SEQ ID NO: 1074962 - protein, 9 aa, Homo Sapiens
PLRSPFCSP

SEQ ID NO: 1074963 - protein, 9 aa, Homo Sapiens
NPPRYEFLW

SEQ ID NO: 1074964 - protein, 9 aa, Homo Sapiens
YERSQTHYI

SEQ ID NO: 1074965 - protein, 9 aa, Homo Sapiens
VQKVPPGLP

SEQ ID NO: 1074966 - protein, 9 aa, Homo Sapiens
PAYMLNEKG

SEQ ID NO: 1074967 - protein, 9 aa, Homo Sapiens
VPSLDYLGT

SEQ ID NO: 1074968 - protein, 9 aa, Homo Sapiens
GIGDQLETI

SEQ ID NO: 1074969 - protein, 9 aa, Homo Sapiens
LVEVEGRAL

SEQ ID NO: 1074970 - protein, 9 aa, Homo Sapiens
IYMCLLWEQ

SEQ ID NO: 1074971 - protein, 9 aa, Homo Sapiens
ELEFFLFVG

SEQ ID NO: 1074972 - protein, 9 aa, Homo Sapiens
VTPMLNSFI

SEQ ID NO: 1074973 - protein, 9 aa, Homo Sapiens
VFPPFYLVN

SEQ ID NO: 1074974 - protein, 9 aa, Homo Sapiens
ELPRPLLML

SEQ ID NO: 1074975 - protein, 9 aa, Homo Sapiens
PSLRKSFAS

SEQ ID NO: 1074976 - protein, 9 aa, Homo Sapiens
DNYPDLSDM

SEQ ID NO: 1074977 - protein, 9 aa, Homo Sapiens
GEYNQHTKK

SEQ ID NO: 1074978 - protein, 9 aa, Homo Sapiens
AGKRIESSG

SEQ ID NO: 1074979 - protein, 9 aa, Homo Sapiens
AGIPGYPTP

SEQ ID NO: 1074980 - protein, 9 aa, Homo Sapiens
LPYQLLFHN

SEQ ID NO: 1074981 - protein, 9 aa, Homo Sapiens
QQCCQKSEV

SEQ ID NO: 1074982 - protein, 9 aa, Homo Sapiens
PASKDSTEM

SEQ ID NO: 1074983 - protein, 9 aa, Homo Sapiens
SSYIVGFYG

SEQ ID NO: 1074984 - protein, 9 aa, Homo Sapiens
SCRGGPPVS

SEQ ID NO: 1074985 - protein, 9 aa, Homo Sapiens
FSLLKSRAR

SEQ ID NO: 1074986 - protein, 9 aa, Homo Sapiens
DLCKNRLLS

SEQ ID NO: 1074987 - protein, 9 aa, Homo Sapiens
FLWAGPVNA

SEQ ID NO: 1074988 - protein, 9 aa, Homo Sapiens
DDQAQFDAE

SEQ ID NO: 1074989 - protein, 9 aa, Homo Sapiens
PIRWMPPEF

SEQ ID NO: 1074990 - protein, 9 aa, Homo Sapiens
CAMLNPSNR

SEQ ID NO: 1074991 - protein, 9 aa, Homo Sapiens
QNNLTAPVS

SEQ ID NO: 1074992 - protein, 9 aa, Homo Sapiens
SFEISKKKN

SEQ ID NO: 1074993 - protein, 9 aa, Homo Sapiens
KEVLEKRAQ

SEQ ID NO: 1074994 - protein, 9 aa, Homo Sapiens
CRKAFNRSS

SEQ ID NO: 1074995 - protein, 9 aa, Homo Sapiens
PLEIKKKNI

SEQ ID NO: 1074996 - protein, 9 aa, Homo Sapiens
KPSCKRLHR

SEQ ID NO: 1074997 - protein, 9 aa, Homo Sapiens
RGSSRAIFF

SEQ ID NO: 1074998 - protein, 9 aa, Homo Sapiens
RSTKGGSDF

SEQ ID NO: 1074999 - protein, 9 aa, Homo Sapiens
DQITQNMLC

SEQ ID NO: 1075000 - protein, 9 aa, Homo Sapiens
FVIATFIRE

SEQ ID NO: 1075001 - protein, 9 aa, Homo Sapiens
NYTLRKDGK

SEQ ID NO: 1075002 - protein, 9 aa, Homo Sapiens
NVTGVFLRP

SEQ ID NO: 1075003 - protein, 9 aa, Homo Sapiens
QRKKKNIAA

SEQ ID NO: 1075004 - protein, 9 aa, Homo Sapiens
NTQAQRFHL

SEQ ID NO: 1075005 - protein, 9 aa, Homo Sapiens
EKRLTVASP

SEQ ID NO: 1075006 - protein, 9 aa, Homo Sapiens
LGQVNHTMK

SEQ ID NO: 1075007 - protein, 9 aa, Homo Sapiens
IPSLPKDDS

SEQ ID NO: 1075008 - protein, 9 aa, Homo Sapiens
GSIQPYSDG

SEQ ID NO: 1075009 - protein, 9 aa, Homo Sapiens
IQVPISDVY

SEQ ID NO: 1075010 - protein, 9 aa, Homo Sapiens
DNINPCLCT

SEQ ID NO: 1075011 - protein, 9 aa, Homo Sapiens
GNITLEEKL

SEQ ID NO: 1075012 - protein, 9 aa, Homo Sapiens
VWVCHPRDL

SEQ ID NO: 1075013 - protein, 9 aa, Homo Sapiens
KREPPPRRV

SEQ ID NO: 1075014 - protein, 9 aa, Homo Sapiens
GYKQILKMI

SEQ ID NO: 1075015 - protein, 9 aa, Homo Sapiens
DSLSTCFGG

SEQ ID NO: 1075016 - protein, 9 aa, Homo Sapiens
PTSGERFPL

SEQ ID NO: 1075017 - protein, 9 aa, Homo Sapiens
HSLVKKPFA

SEQ ID NO: 1075018 - protein, 9 aa, Homo Sapiens
LSRGPKSII

SEQ ID NO: 1075019 - protein, 9 aa, Homo Sapiens
FCVLSLLPT

SEQ ID NO: 1075020 - protein, 9 aa, Homo Sapiens
RVEQGVSFQ

SEQ ID NO: 1075021 - protein, 9 aa, Homo Sapiens
KAIRPSCPD

SEQ ID NO: 1075022 - protein, 9 aa, Homo Sapiens
SDVDFYNKK

SEQ ID NO: 1075023 - protein, 9 aa, Homo Sapiens
NEPQTALKS

SEQ ID NO: 1075024 - protein, 9 aa, Homo Sapiens
RCQCVEQHI

SEQ ID NO: 1075025 - protein, 9 aa, Homo Sapiens
SACSWFTEI

SEQ ID NO: 1075026 - protein, 9 aa, Homo Sapiens
SGEPGQAGP

SEQ ID NO: 1075027 - protein, 9 aa, Homo Sapiens
GLSLVKHER

SEQ ID NO: 1075028 - protein, 9 aa, Homo Sapiens
VFFPKKKIT

SEQ ID NO: 1075029 - protein, 9 aa, Homo Sapiens
MNNYWNVGQ

SEQ ID NO: 1075030 - protein, 9 aa, Homo Sapiens
YIENPHLPP

SEQ ID NO: 1075031 - protein, 9 aa, Homo Sapiens
EESILSHGI

SEQ ID NO: 1075032 - protein, 9 aa, Homo Sapiens
PESLDSLST

SEQ ID NO: 1075033 - protein, 9 aa, Homo Sapiens
SIQPYSDGG

SEQ ID NO: 1075034 - protein, 9 aa, Homo Sapiens
YMSERDESQ

SEQ ID NO: 1075035 - protein, 9 aa, Homo Sapiens
KPNLTKLCK

SEQ ID NO: 1075036 - protein, 9 aa, Homo Sapiens
YQSYSSTFY

SEQ ID NO: 1075037 - protein, 9 aa, Homo Sapiens
ISHGRAPPD

SEQ ID NO: 1075038 - protein, 9 aa, Homo Sapiens
THVYNHLSS

SEQ ID NO: 1075039 - protein, 9 aa, Homo Sapiens
YQAECFQFK

SEQ ID NO: 1075040 - protein, 9 aa, Homo Sapiens
HQRKIPEEL

SEQ ID NO: 1075041 - protein, 9 aa, Homo Sapiens
HQFTSSGEF

SEQ ID NO: 1075042 - protein, 9 aa, Homo Sapiens
TQAEIYWVH

SEQ ID NO: 1075043 - protein, 9 aa, Homo Sapiens
HLPFFCRVK

SEQ ID NO: 1075044 - protein, 9 aa, Homo Sapiens
REPPPRRVG

SEQ ID NO: 1075045 - protein, 9 aa, Homo Sapiens
LIRTQKNEF

SEQ ID NO: 1075046 - protein, 9 aa, Homo Sapiens
QVNLTTSRL

SEQ ID NO: 1075047 - protein, 9 aa, Homo Sapiens
PAFPGETAL

SEQ ID NO: 1075048 - protein, 9 aa, Homo Sapiens
QQKTAETEK

SEQ ID NO: 1075049 - protein, 9 aa, Homo Sapiens
VRVKAHWLG

SEQ ID NO: 1075050 - protein, 9 aa, Homo Sapiens
AGGKGEKNT

SEQ ID NO: 1075051 - protein, 9 aa, Homo Sapiens
APPRAPALC

SEQ ID NO: 1075052 - protein, 9 aa, Homo Sapiens
QELMTMKEE

SEQ ID NO: 1075053 - protein, 9 aa, Homo Sapiens
NEEIGELLA

SEQ ID NO: 1075054 - protein, 9 aa, Homo Sapiens
EFGRLGSTE

SEQ ID NO: 1075055 - protein, 9 aa, Homo Sapiens
ELVFFPKKK

SEQ ID NO: 1075056 - protein, 9 aa, Homo Sapiens
SFFSSPLRP

SEQ ID NO: 1075057 - protein, 9 aa, Homo Sapiens
GPWGAPQED

SEQ ID NO: 1075058 - protein, 9 aa, Homo Sapiens
LAPIIYYNI

SEQ ID NO: 1075059 - protein, 9 aa, Homo Sapiens
MFVEKLKNF

SEQ ID NO: 1075060 - protein, 9 aa, Homo Sapiens
TFEELSRIH

SEQ ID NO: 1075061 - protein, 9 aa, Homo Sapiens
MTSTVSNLP

SEQ ID NO: 1075062 - protein, 9 aa, Homo Sapiens
EVKRSVPCD

SEQ ID NO: 1075063 - protein, 9 aa, Homo Sapiens
SRIHSREKP

SEQ ID NO: 1075064 - protein, 9 aa, Homo Sapiens
NFRKQVNYE

SEQ ID NO: 1075065 - protein, 9 aa, Homo Sapiens
LGNFGEPQI

SEQ ID NO: 1075066 - protein, 9 aa, Homo Sapiens
ALSAPAEVW

SEQ ID NO: 1075067 - protein, 9 aa, Homo Sapiens
SCQSPPGVL

SEQ ID NO: 1075068 - protein, 9 aa, Homo Sapiens
ELEIALVNQ

SEQ ID NO: 1075069 - protein, 9 aa, Homo Sapiens
EPTGYIRFK

SEQ ID NO: 1075070 - protein, 9 aa, Homo Sapiens
LFGNHSLGL

SEQ ID NO: 1075071 - protein, 9 aa, Homo Sapiens
GTNPLYVGK

SEQ ID NO: 1075072 - protein, 9 aa, Homo Sapiens
WDNTEGEYS

SEQ ID NO: 1075073 - protein, 9 aa, Homo Sapiens
NGATGPPGI

SEQ ID NO: 1075074 - protein, 9 aa, Homo Sapiens
EAMGWVFVL

SEQ ID NO: 1075075 - protein, 9 aa, Homo Sapiens
HAYPDQITQ

SEQ ID NO: 1075076 - protein, 9 aa, Homo Sapiens
FSVSLPLAK

SEQ ID NO: 1075077 - protein, 9 aa, Homo Sapiens
QIVALSPLN

SEQ ID NO: 1075078 - protein, 9 aa, Homo Sapiens
DPNFASPAG

SEQ ID NO: 1075079 - protein, 9 aa, Homo Sapiens
RPLPGKDVS

SEQ ID NO: 1075080 - protein, 9 aa, Homo Sapiens
QQSGEFFFL

SEQ ID NO: 1075081 - protein, 9 aa, Homo Sapiens
LCKNRLLSG

SEQ ID NO: 1075082 - protein, 9 aa, Homo Sapiens
DSEYTPVDD

SEQ ID NO: 1075083 - protein, 9 aa, Homo Sapiens
VFCPPDPHK

SEQ ID NO: 1075084 - protein, 9 aa, Homo Sapiens
DDQRPMDED

SEQ ID NO: 1075085 - protein, 9 aa, Homo Sapiens
TRVDSVSSA

SEQ ID NO: 1075086 - protein, 9 aa, Homo Sapiens
RQVPEQFSG

SEQ ID NO: 1075087 - protein, 9 aa, Homo Sapiens
LQCPGSCQS

SEQ ID NO: 1075088 - protein, 9 aa, Homo Sapiens
KEIVFDMVV

SEQ ID NO: 1075089 - protein, 9 aa, Homo Sapiens
PERELTMDL

SEQ ID NO: 1075090 - protein, 9 aa, Homo Sapiens
LEEEGAAYS

SEQ ID NO: 1075091 - protein, 9 aa, Homo Sapiens
KCANPVHGP

SEQ ID NO: 1075092 - protein, 9 aa, Homo Sapiens
YHLHGSQIG

SEQ ID NO: 1075093 - protein, 9 aa, Homo Sapiens
GTVHLVYRI

SEQ ID NO: 1075094 - protein, 9 aa, Homo Sapiens
YGAHMYQAE

SEQ ID NO: 1075095 - protein, 9 aa, Homo Sapiens
NFSDSKEGE

SEQ ID NO: 1075096 - protein, 9 aa, Homo Sapiens
RLLTYLSGR

SEQ ID NO: 1075097 - protein, 9 aa, Homo Sapiens
ITEFACGTG

SEQ ID NO: 1075098 - protein, 9 aa, Homo Sapiens
RDRNFTSFL

SEQ ID NO: 1075099 - protein, 9 aa, Homo Sapiens
LTWEKKELK

SEQ ID NO: 1075100 - protein, 9 aa, Homo Sapiens
SAKADLLQS

SEQ ID NO: 1075101 - protein, 9 aa, Homo Sapiens
ASARTTNST

SEQ ID NO: 1075102 - protein, 9 aa, Homo Sapiens
KHLISSSKT

SEQ ID NO: 1075103 - protein, 9 aa, Homo Sapiens
PRPEVTWYK

SEQ ID NO: 1075104 - protein, 9 aa, Homo Sapiens
GITGPNGAT

SEQ ID NO: 1075105 - protein, 9 aa, Homo Sapiens
CPRGYKSTQ

SEQ ID NO: 1075106 - protein, 9 aa, Homo Sapiens
DGEEDETSL

SEQ ID NO: 1075107 - protein, 9 aa, Homo Sapiens
VLTEHLDWV

SEQ ID NO: 1075108 - protein, 9 aa, Homo Sapiens
VDTGSKEKR

SEQ ID NO: 1075109 - protein, 9 aa, Homo Sapiens
NGRALEENP

SEQ ID NO: 1075110 - protein, 9 aa, Homo Sapiens
RLEENEICD

SEQ ID NO: 1075111 - protein, 9 aa, Homo Sapiens
KFQLPEQKL

SEQ ID NO: 1075112 - protein, 9 aa, Homo Sapiens
KIKVLFDVE

SEQ ID NO: 1075113 - protein, 9 aa, Homo Sapiens
GPKKTHPTV

SEQ ID NO: 1075114 - protein, 9 aa, Homo Sapiens
TDSFFKFQV

SEQ ID NO: 1075115 - protein, 9 aa, Homo Sapiens
QVLYGFLTV

SEQ ID NO: 1075116 - protein, 9 aa, Homo Sapiens
WGAPQEDMT

SEQ ID NO: 1075117 - protein, 9 aa, Homo Sapiens
RPCLGAARS

SEQ ID NO: 1075118 - protein, 9 aa, Homo Sapiens
DFEIGNFVK

SEQ ID NO: 1075119 - protein, 9 aa, Homo Sapiens
LRAGRQQRI

SEQ ID NO: 1075120 - protein, 9 aa, Homo Sapiens
ATLNISKQW

SEQ ID NO: 1075121 - protein, 9 aa, Homo Sapiens
ITGTLHQRF

SEQ ID NO: 1075122 - protein, 9 aa, Homo Sapiens
APKIFMPDF

SEQ ID NO: 1075123 - protein, 9 aa, Homo Sapiens
RGGAGNVHQ

SEQ ID NO: 1075124 - protein, 9 aa, Homo Sapiens
PMLWEKMEY

SEQ ID NO: 1075125 - protein, 9 aa, Homo Sapiens
ARLRQKVAM

SEQ ID NO: 1075126 - protein, 9 aa, Homo Sapiens
QFFIEVLDI

SEQ ID NO: 1075127 - protein, 9 aa, Homo Sapiens
FFTSPPPRD

SEQ ID NO: 1075128 - protein, 9 aa, Homo Sapiens
QPSCPARKK

SEQ ID NO: 1075129 - protein, 9 aa, Homo Sapiens
KRSSGEQGV

SEQ ID NO: 1075130 - protein, 9 aa, Homo Sapiens
PSEWTSLAS

SEQ ID NO: 1075131 - protein, 9 aa, Homo Sapiens
IDSFIGFPE

SEQ ID NO: 1075132 - protein, 9 aa, Homo Sapiens
PAQSPASKD

SEQ ID NO: 1075133 - protein, 9 aa, Homo Sapiens
DRCAAQFFF

SEQ ID NO: 1075134 - protein, 9 aa, Homo Sapiens
QDLLEKGFE

SEQ ID NO: 1075135 - protein, 9 aa, Homo Sapiens
SPKKDIARK

SEQ ID NO: 1075136 - protein, 9 aa, Homo Sapiens
LSPALSPSS

SEQ ID NO: 1075137 - protein, 9 aa, Homo Sapiens
LTLIASTPS

SEQ ID NO: 1075138 - protein, 9 aa, Homo Sapiens
PDTFFYNGK

SEQ ID NO: 1075139 - protein, 9 aa, Homo Sapiens
KVFPPFYLV

SEQ ID NO: 1075140 - protein, 9 aa, Homo Sapiens
KKSFVFPPS

SEQ ID NO: 1075141 - protein, 9 aa, Homo Sapiens
HLDVYIENP

SEQ ID NO: 1075142 - protein, 9 aa, Homo Sapiens
GWNLPGGAW

SEQ ID NO: 1075143 - protein, 9 aa, Homo Sapiens
RTRLVRKRL

SEQ ID NO: 1075144 - protein, 9 aa, Homo Sapiens
NETLAHFKD

SEQ ID NO: 1075145 - protein, 9 aa, Homo Sapiens
SRSLPEGEM

SEQ ID NO: 1075146 - protein, 9 aa, Homo Sapiens
DNPTAVQIH

SEQ ID NO: 1075147 - protein, 9 aa, Homo Sapiens
SHELYQPCP

SEQ ID NO: 1075148 - protein, 9 aa, Homo Sapiens
VCFVIPLTD

SEQ ID NO: 1075149 - protein, 9 aa, Homo Sapiens
VVWLKNGLP

SEQ ID NO: 1075150 - protein, 9 aa, Homo Sapiens
LFMGQLLQL

SEQ ID NO: 1075151 - protein, 9 aa, Homo Sapiens
VLLEATFLI

SEQ ID NO: 1075152 - protein, 9 aa, Homo Sapiens
SSPGAPNLA

SEQ ID NO: 1075153 - protein, 9 aa, Homo Sapiens
QAQFDAEEL

SEQ ID NO: 1075154 - protein, 9 aa, Homo Sapiens
FLLSSRPTL

SEQ ID NO: 1075155 - protein, 9 aa, Homo Sapiens
RVAAVNGKR

SEQ ID NO: 1075156 - protein, 9 aa, Homo Sapiens
PEGDASSLG

SEQ ID NO: 1075157 - protein, 9 aa, Homo Sapiens
EKKEIKKNE

SEQ ID NO: 1075158 - protein, 9 aa, Homo Sapiens
PEVSFPRDM

SEQ ID NO: 1075159 - protein, 9 aa, Homo Sapiens
VYLALFDNF

SEQ ID NO: 1075160 - protein, 9 aa, Homo Sapiens
QSLALLPRL

SEQ ID NO: 1075161 - protein, 9 aa, Homo Sapiens
NNQENTSVE

SEQ ID NO: 1075162 - protein, 9 aa, Homo Sapiens
PTFIRTEPS

SEQ ID NO: 1075163 - protein, 9 aa, Homo Sapiens
CHPRDLAAP

SEQ ID NO: 1075164 - protein, 9 aa, Homo Sapiens
LTDIEERVL

SEQ ID NO: 1075165 - protein, 9 aa, Homo Sapiens
SDMLNYEEY

SEQ ID NO: 1075166 - protein, 9 aa, Homo Sapiens
IPLTDPEAL

SEQ ID NO: 1075167 - protein, 9 aa, Homo Sapiens
KGPVQKYPG

SEQ ID NO: 1075168 - protein, 9 aa, Homo Sapiens
ADHGHGRNH

SEQ ID NO: 1075169 - protein, 9 aa, Homo Sapiens
ILKALGTPV

SEQ ID NO: 1075170 - protein, 9 aa, Homo Sapiens
LEAQIFFLQ

SEQ ID NO: 1075171 - protein, 9 aa, Homo Sapiens
RISLVLLLL

SEQ ID NO: 1075172 - protein, 9 aa, Homo Sapiens
YEEPTCEAG

SEQ ID NO: 1075173 - protein, 9 aa, Homo Sapiens
MEVQQTWSH

SEQ ID NO: 1075174 - protein, 9 aa, Homo Sapiens
FSAVPGDSM

SEQ ID NO: 1075175 - protein, 9 aa, Homo Sapiens
YSKGAFNGN

SEQ ID NO: 1075176 - protein, 9 aa, Homo Sapiens
EFRKPSQAD

SEQ ID NO: 1075177 - protein, 9 aa, Homo Sapiens
VLFVNGDLD

SEQ ID NO: 1075178 - protein, 9 aa, Homo Sapiens
PCRKQSNHT

SEQ ID NO: 1075179 - protein, 9 aa, Homo Sapiens
LHMWSQIKY

SEQ ID NO: 1075180 - protein, 9 aa, Homo Sapiens
TPGALVPVP

SEQ ID NO: 1075181 - protein, 9 aa, Homo Sapiens
REDQGQDGA

SEQ ID NO: 1075182 - protein, 9 aa, Homo Sapiens
AACFVPSLQ

SEQ ID NO: 1075183 - protein, 9 aa, Homo Sapiens
HAERISLVL

SEQ ID NO: 1075184 - protein, 9 aa, Homo Sapiens
GAAPPQPLG

SEQ ID NO: 1075185 - protein, 9 aa, Homo Sapiens
EEGKDYPVA

SEQ ID NO: 1075186 - protein, 9 aa, Homo Sapiens
ETTRTELIA

SEQ ID NO: 1075187 - protein, 9 aa, Homo Sapiens
AGLQILILV

SEQ ID NO: 1075188 - protein, 9 aa, Homo Sapiens
HQKMKKSLE

SEQ ID NO: 1075189 - protein, 9 aa, Homo Sapiens
LAKEPLEKQ

SEQ ID NO: 1075190 - protein, 9 aa, Homo Sapiens
GKGFDQSSS

SEQ ID NO: 1075191 - protein, 9 aa, Homo Sapiens
YPEGRPTGD

SEQ ID NO: 1075192 - protein, 9 aa, Homo Sapiens
LVQVVHDNQ

SEQ ID NO: 1075193 - protein, 9 aa, Homo Sapiens
LMALKNHFR

SEQ ID NO: 1075194 - protein, 9 aa, Homo Sapiens
FQLPEQKLF

SEQ ID NO: 1075195 - protein, 9 aa, Homo Sapiens
LESDFLTDS

SEQ ID NO: 1075196 - protein, 9 aa, Homo Sapiens
CANKGIFTQ

SEQ ID NO: 1075197 - protein, 9 aa, Homo Sapiens
ALYMGKENL

SEQ ID NO: 1075198 - protein, 9 aa, Homo Sapiens
TRLVRKRLL

SEQ ID NO: 1075199 - protein, 9 aa, Homo Sapiens
NFLTVKKFL

SEQ ID NO: 1075200 - protein, 9 aa, Homo Sapiens
LSLLPTVLG

SEQ ID NO: 1075201 - protein, 9 aa, Homo Sapiens
NSLSRTSTT

SEQ ID NO: 1075202 - protein, 9 aa, Homo Sapiens
AEESTLSCF

SEQ ID NO: 1075203 - protein, 9 aa, Homo Sapiens
QNVDKALLA

SEQ ID NO: 1075204 - protein, 9 aa, Homo Sapiens
MDFVSSHSP

SEQ ID NO: 1075205 - protein, 9 aa, Homo Sapiens
LLAKRRKMK

SEQ ID NO: 1075206 - protein, 9 aa, Homo Sapiens
RGTNVNMKT

SEQ ID NO: 1075207 - protein, 9 aa, Homo Sapiens
VPQFLVLIL

SEQ ID NO: 1075208 - protein, 9 aa, Homo Sapiens
DGLPLQGSD

SEQ ID NO: 1075209 - protein, 9 aa, Homo Sapiens
AGDDVPRAV

SEQ ID NO: 1075210 - protein, 9 aa, Homo Sapiens
PEDDQAQFD

SEQ ID NO: 1075211 - protein, 9 aa, Homo Sapiens
RKRSYVCIE

SEQ ID NO: 1075212 - protein, 9 aa, Homo Sapiens
TSLIKTEFE

SEQ ID NO: 1075213 - protein, 9 aa, Homo Sapiens
CSRPSCCRT

SEQ ID NO: 1075214 - protein, 9 aa, Homo Sapiens
CSSRKFSSM

SEQ ID NO: 1075215 - protein, 9 aa, Homo Sapiens
FSLEVPWKP

SEQ ID NO: 1075216 - protein, 9 aa, Homo Sapiens
VKETLADVQ

SEQ ID NO: 1075217 - protein, 9 aa, Homo Sapiens
SQCLHNQSR

SEQ ID NO: 1075218 - protein, 9 aa, Homo Sapiens
RIESSGSCQ

SEQ ID NO: 1075219 - protein, 9 aa, Homo Sapiens
TLLSVGPQP

SEQ ID NO: 1075220 - protein, 9 aa, Homo Sapiens
ILLLQKIIH

SEQ ID NO: 1075221 - protein, 9 aa, Homo Sapiens
LIIFNREKV

SEQ ID NO: 1075222 - protein, 9 aa, Homo Sapiens
SFGFPHSFL

SEQ ID NO: 1075223 - protein, 9 aa, Homo Sapiens
VELKKRVVQ

SEQ ID NO: 1075224 - protein, 9 aa, Homo Sapiens
PKKSKRQKE

SEQ ID NO: 1075225 - protein, 9 aa, Homo Sapiens
PTPVEENLR

SEQ ID NO: 1075226 - protein, 9 aa, Homo Sapiens
VQKEQPLST

SEQ ID NO: 1075227 - protein, 9 aa, Homo Sapiens
CQPSCGRPA

SEQ ID NO: 1075228 - protein, 9 aa, Homo Sapiens
LLAEHQKIS

SEQ ID NO: 1075229 - protein, 9 aa, Homo Sapiens
VKLNLEVNG

SEQ ID NO: 1075230 - protein, 9 aa, Homo Sapiens
SVNSIEFFS

SEQ ID NO: 1075231 - protein, 9 aa, Homo Sapiens
KDADWMHVR

SEQ ID NO: 1075232 - protein, 9 aa, Homo Sapiens
QKNEFLISP

SEQ ID NO: 1075233 - protein, 9 aa, Homo Sapiens
FTSSVIPKL

SEQ ID NO: 1075234 - protein, 9 aa, Homo Sapiens
EKVLPGDVR

SEQ ID NO: 1075235 - protein, 9 aa, Homo Sapiens
ETTYFVTVA

SEQ ID NO: 1075236 - protein, 9 aa, Homo Sapiens
SCIETSYSP

SEQ ID NO: 1075237 - protein, 9 aa, Homo Sapiens
AFVCSGLLG

SEQ ID NO: 1075238 - protein, 9 aa, Homo Sapiens
VDPDVGVNF

SEQ ID NO: 1075239 - protein, 9 aa, Homo Sapiens
FGNHSLGLP

SEQ ID NO: 1075240 - protein, 9 aa, Homo Sapiens
KNAPKITLS

SEQ ID NO: 1075241 - protein, 9 aa, Homo Sapiens
QPGHALVMT

SEQ ID NO: 1075242 - protein, 9 aa, Homo Sapiens
HAFLQRKND

SEQ ID NO: 1075243 - protein, 9 aa, Homo Sapiens
ILEEYKKEN

SEQ ID NO: 1075244 - protein, 9 aa, Homo Sapiens
VDRTLKGTQ

SEQ ID NO: 1075245 - protein, 9 aa, Homo Sapiens
GPERELTMD

SEQ ID NO: 1075246 - protein, 9 aa, Homo Sapiens
SALLFLFPG

SEQ ID NO: 1075247 - protein, 9 aa, Homo Sapiens
IYTGEKPYE

SEQ ID NO: 1075248 - protein, 9 aa, Homo Sapiens
LRIVQDIFN

SEQ ID NO: 1075249 - protein, 9 aa, Homo Sapiens
FKKDKPLCK

SEQ ID NO: 1075250 - protein, 9 aa, Homo Sapiens
SFLYRKNYS

SEQ ID NO: 1075251 - protein, 9 aa, Homo Sapiens
TIPHSTTRN

SEQ ID NO: 1075252 - protein, 9 aa, Homo Sapiens
MYDIFSFKK

SEQ ID NO: 1075253 - protein, 9 aa, Homo Sapiens
AGLQNMENT

SEQ ID NO: 1075254 - protein, 9 aa, Homo Sapiens
SAQKIYETL

SEQ ID NO: 1075255 - protein, 9 aa, Homo Sapiens
LTELSLLHN

SEQ ID NO: 1075256 - protein, 9 aa, Homo Sapiens
GIFTQISTL

SEQ ID NO: 1075257 - protein, 9 aa, Homo Sapiens
YVNGSMGGP

SEQ ID NO: 1075258 - protein, 9 aa, Homo Sapiens
AAVCINFIF

SEQ ID NO: 1075259 - protein, 9 aa, Homo Sapiens
IKDAVNPES

SEQ ID NO: 1075260 - protein, 9 aa, Homo Sapiens
DPNNIDEYE

SEQ ID NO: 1075261 - protein, 9 aa, Homo Sapiens
LQVSESLWL

SEQ ID NO: 1075262 - protein, 9 aa, Homo Sapiens
LSSTQSDTF

SEQ ID NO: 1075263 - protein, 9 aa, Homo Sapiens
TKLDKRENS

SEQ ID NO: 1075264 - protein, 9 aa, Homo Sapiens
TSGRSLPFW

SEQ ID NO: 1075265 - protein, 9 aa, Homo Sapiens
LTQDPIWKK

SEQ ID NO: 1075266 - protein, 9 aa, Homo Sapiens
RPCVFDFNF

SEQ ID NO: 1075267 - protein, 9 aa, Homo Sapiens
SLSLFFLGP

SEQ ID NO: 1075268 - protein, 9 aa, Homo Sapiens
FEVQQTWSH

SEQ ID NO: 1075269 - protein, 9 aa, Homo Sapiens
MFGMVLALA

SEQ ID NO: 1075270 - protein, 9 aa, Homo Sapiens
LLMTACASG

SEQ ID NO: 1075271 - protein, 9 aa, Homo Sapiens
ITLQNEIQE

SEQ ID NO: 1075272 - protein, 9 aa, Homo Sapiens
ESYLQTFLA

SEQ ID NO: 1075273 - protein, 9 aa, Homo Sapiens
LSALMKQRL

SEQ ID NO: 1075274 - protein, 9 aa, Homo Sapiens
RWDPQSREP

SEQ ID NO: 1075275 - protein, 9 aa, Homo Sapiens
FLQEKKASI

SEQ ID NO: 1075276 - protein, 9 aa, Homo Sapiens
YNILPEKEN

SEQ ID NO: 1075277 - protein, 9 aa, Homo Sapiens
LCPKGSCVC

SEQ ID NO: 1075278 - protein, 9 aa, Homo Sapiens
SKQECNEQR

SEQ ID NO: 1075279 - protein, 9 aa, Homo Sapiens
DQEKKIEDV

SEQ ID NO: 1075280 - protein, 9 aa, Homo Sapiens
ALPEGDASS

SEQ ID NO: 1075281 - protein, 9 aa, Homo Sapiens
NPGPRALQS

SEQ ID NO: 1075282 - protein, 9 aa, Homo Sapiens
VLSSLLSHL

SEQ ID NO: 1075283 - protein, 9 aa, Homo Sapiens
KVVVHLDTI

SEQ ID NO: 1075284 - protein, 9 aa, Homo Sapiens
GQTPTSGPD

SEQ ID NO: 1075285 - protein, 9 aa, Homo Sapiens
EETLDISFL

SEQ ID NO: 1075286 - protein, 9 aa, Homo Sapiens
FGPSPNGPT

SEQ ID NO: 1075287 - protein, 9 aa, Homo Sapiens
NIVSHGKNH

SEQ ID NO: 1075288 - protein, 9 aa, Homo Sapiens
LVSGPAFLA

SEQ ID NO: 1075289 - protein, 9 aa, Homo Sapiens
SHPLPPSYQ

SEQ ID NO: 1075290 - protein, 9 aa, Homo Sapiens
DLAMKTWLL

SEQ ID NO: 1075291 - protein, 9 aa, Homo Sapiens
LKGDNLSQY

SEQ ID NO: 1075292 - protein, 9 aa, Homo Sapiens
PSNSFILSG

SEQ ID NO: 1075293 - protein, 9 aa, Homo Sapiens
TLEGKYLLS

SEQ ID NO: 1075294 - protein, 9 aa, Homo Sapiens
SLEEEGAAY

SEQ ID NO: 1075295 - protein, 9 aa, Homo Sapiens
PQVTWSKAG

SEQ ID NO: 1075296 - protein, 9 aa, Homo Sapiens
ARYRLEMPE

SEQ ID NO: 1075297 - protein, 9 aa, Homo Sapiens
FSGPLSVTS

SEQ ID NO: 1075298 - protein, 9 aa, Homo Sapiens
YKRCGVTFV

SEQ ID NO: 1075299 - protein, 9 aa, Homo Sapiens
GYRPILAET

SEQ ID NO: 1075300 - protein, 9 aa, Homo Sapiens
KLLVNLWEP

SEQ ID NO: 1075301 - protein, 9 aa, Homo Sapiens
IPRRIKLIC

SEQ ID NO: 1075302 - protein, 9 aa, Homo Sapiens
TSGEETEKT

SEQ ID NO: 1075303 - protein, 9 aa, Homo Sapiens
MQELMTMKE

SEQ ID NO: 1075304 - protein, 9 aa, Homo Sapiens
GLFPLGQWP

SEQ ID NO: 1075305 - protein, 9 aa, Homo Sapiens
RVTRRQRSS

SEQ ID NO: 1075306 - protein, 9 aa, Homo Sapiens
PRAPALCWR

SEQ ID NO: 1075307 - protein, 9 aa, Homo Sapiens
FSEERAAEV

SEQ ID NO: 1075308 - protein, 9 aa, Homo Sapiens
REHASRNGP

SEQ ID NO: 1075309 - protein, 9 aa, Homo Sapiens
SFSSCSDHC

SEQ ID NO: 1075310 - protein, 9 aa, Homo Sapiens
NSEKNSTFR

SEQ ID NO: 1075311 - protein, 9 aa, Homo Sapiens
PTFGSSAGE

SEQ ID NO: 1075312 - protein, 9 aa, Homo Sapiens
ALDKTDAPR

SEQ ID NO: 1075313 - protein, 9 aa, Homo Sapiens
PIQKKSEYW

SEQ ID NO: 1075314 - protein, 9 aa, Homo Sapiens
SIAQSIDNS

SEQ ID NO: 1075315 - protein, 9 aa, Homo Sapiens
AFFSKRNLI

SEQ ID NO: 1075316 - protein, 9 aa, Homo Sapiens
EGPQVNLTT

SEQ ID NO: 1075317 - protein, 9 aa, Homo Sapiens
PQSCRAFKT

SEQ ID NO: 1075318 - protein, 9 aa, Homo Sapiens
PALSLLLPG

SEQ ID NO: 1075319 - protein, 9 aa, Homo Sapiens
RKAAELDCR

SEQ ID NO: 1075320 - protein, 9 aa, Homo Sapiens
AQEDVLKIY

SEQ ID NO: 1075321 - protein, 9 aa, Homo Sapiens
SGNIITDVL

SEQ ID NO: 1075322 - protein, 9 aa, Homo Sapiens
LAAVFGYLT

SEQ ID NO: 1075323 - protein, 9 aa, Homo Sapiens
EYPLSSKRP

SEQ ID NO: 1075324 - protein, 9 aa, Homo Sapiens
LTCFCLLDN

SEQ ID NO: 1075325 - protein, 9 aa, Homo Sapiens
KGEKEGEGE

SEQ ID NO: 1075326 - protein, 9 aa, Homo Sapiens
KFSEPGAIK

SEQ ID NO: 1075327 - protein, 9 aa, Homo Sapiens
STTLPADSY

SEQ ID NO: 1075328 - protein, 9 aa, Homo Sapiens
PYDSSASYK

SEQ ID NO: 1075329 - protein, 9 aa, Homo Sapiens
GFREIHHFF

SEQ ID NO: 1075330 - protein, 9 aa, Homo Sapiens
PMLNSFIYS

SEQ ID NO: 1075331 - protein, 9 aa, Homo Sapiens
VFKEANTLD

SEQ ID NO: 1075332 - protein, 9 aa, Homo Sapiens
GIEDSKATL

SEQ ID NO: 1075333 - protein, 9 aa, Homo Sapiens
TSAQKKMKT

SEQ ID NO: 1075334 - protein, 9 aa, Homo Sapiens
STLGFHVLY

SEQ ID NO: 1075335 - protein, 9 aa, Homo Sapiens
YYRRVHTGE

SEQ ID NO: 1075336 - protein, 9 aa, Homo Sapiens
SRSPAFCAS

SEQ ID NO: 1075337 - protein, 9 aa, Homo Sapiens
WRFRHLLHL

SEQ ID NO: 1075338 - protein, 9 aa, Homo Sapiens
TSLQKPTST

SEQ ID NO: 1075339 - protein, 9 aa, Homo Sapiens
FPLSRLRYN

SEQ ID NO: 1075340 - protein, 9 aa, Homo Sapiens
VLAVAYATS

SEQ ID NO: 1075341 - protein, 9 aa, Homo Sapiens
PKISSEQDY

SEQ ID NO: 1075342 - protein, 9 aa, Homo Sapiens
SSVDSDSES

SEQ ID NO: 1075343 - protein, 9 aa, Homo Sapiens
KLEAHYNCS

SEQ ID NO: 1075344 - protein, 9 aa, Homo Sapiens
IKQPTPLPP

SEQ ID NO: 1075345 - protein, 9 aa, Homo Sapiens
TKHKRIYTG

SEQ ID NO: 1075346 - protein, 9 aa, Homo Sapiens
ERPACQSES

SEQ ID NO: 1075347 - protein, 9 aa, Homo Sapiens
ILSHGIVAD

SEQ ID NO: 1075348 - protein, 9 aa, Homo Sapiens
PYEQQPPEK

SEQ ID NO: 1075349 - protein, 9 aa, Homo Sapiens
GVVFSLTSH

SEQ ID NO: 1075350 - protein, 9 aa, Homo Sapiens
RPSQRRSKS

SEQ ID NO: 1075351 - protein, 9 aa, Homo Sapiens
LLDPYQSMP

SEQ ID NO: 1075352 - protein, 9 aa, Homo Sapiens
VSCTPPFCC

SEQ ID NO: 1075353 - protein, 9 aa, Homo Sapiens
FCLDPEGSG

SEQ ID NO: 1075354 - protein, 9 aa, Homo Sapiens
QKKSEYWFF

SEQ ID NO: 1075355 - protein, 9 aa, Homo Sapiens
CGKTFTSHS

SEQ ID NO: 1075356 - protein, 9 aa, Homo Sapiens
ETNLDIKPS

SEQ ID NO: 1075357 - protein, 9 aa, Homo Sapiens
NLRTPRKLT

SEQ ID NO: 1075358 - protein, 9 aa, Homo Sapiens
LTRKEDLED

SEQ ID NO: 1075359 - protein, 9 aa, Homo Sapiens
VLRLSRKIR

SEQ ID NO: 1075360 - protein, 9 aa, Homo Sapiens
GNSHSQNIL

SEQ ID NO: 1075361 - protein, 9 aa, Homo Sapiens
RRVLGIFGD

SEQ ID NO: 1075362 - protein, 9 aa, Homo Sapiens
MCWQLENIA

SEQ ID NO: 1075363 - protein, 9 aa, Homo Sapiens
FFGNNSIFF

SEQ ID NO: 1075364 - protein, 9 aa, Homo Sapiens
LLPLVLLLN

SEQ ID NO: 1075365 - protein, 9 aa, Homo Sapiens
FYYKFFRDV

SEQ ID NO: 1075366 - protein, 9 aa, Homo Sapiens
ALSTLYIHS

SEQ ID NO: 1075367 - protein, 9 aa, Homo Sapiens
DGLLRIGTV

SEQ ID NO: 1075368 - protein, 9 aa, Homo Sapiens
RVSGCHLSL

SEQ ID NO: 1075369 - protein, 9 aa, Homo Sapiens
LKKERDRYI

SEQ ID NO: 1075370 - protein, 9 aa, Homo Sapiens
SVSLSFSFL

SEQ ID NO: 1075371 - protein, 9 aa, Homo Sapiens
SATNKFQNL

SEQ ID NO: 1075372 - protein, 9 aa, Homo Sapiens
VLLSEIVGI

SEQ ID NO: 1075373 - protein, 9 aa, Homo Sapiens
ALFDNFSWW

SEQ ID NO: 1075374 - protein, 9 aa, Homo Sapiens
YHVFQGISE

SEQ ID NO: 1075375 - protein, 9 aa, Homo Sapiens
GSQEQKPEE

SEQ ID NO: 1075376 - protein, 9 aa, Homo Sapiens
RKQSNHTFS

SEQ ID NO: 1075377 - protein, 9 aa, Homo Sapiens
TEKSNGYRD

SEQ ID NO: 1075378 - protein, 9 aa, Homo Sapiens
IFSVAFMEN

SEQ ID NO: 1075379 - protein, 9 aa, Homo Sapiens
QRPSPKALQ

SEQ ID NO: 1075380 - protein, 9 aa, Homo Sapiens
EATFRLCCV

SEQ ID NO: 1075381 - protein, 9 aa, Homo Sapiens
PSFFSSPLR

SEQ ID NO: 1075382 - protein, 9 aa, Homo Sapiens
QRPRLVAGS

SEQ ID NO: 1075383 - protein, 9 aa, Homo Sapiens
GLGLRGRPR

SEQ ID NO: 1075384 - protein, 9 aa, Homo Sapiens
QCLHNQSRL

SEQ ID NO: 1075385 - protein, 9 aa, Homo Sapiens
SRSSSLNIH

SEQ ID NO: 1075386 - protein, 9 aa, Homo Sapiens
PMPDKYFLA

SEQ ID NO: 1075387 - protein, 9 aa, Homo Sapiens
ILLLVVGNK

SEQ ID NO: 1075388 - protein, 9 aa, Homo Sapiens
KLEETVRHL

SEQ ID NO: 1075389 - protein, 9 aa, Homo Sapiens
PNFPQPQQK

SEQ ID NO: 1075390 - protein, 9 aa, Homo Sapiens
MDEGTDARN

SEQ ID NO: 1075391 - protein, 9 aa, Homo Sapiens
YLSQGTDLS

SEQ ID NO: 1075392 - protein, 9 aa, Homo Sapiens
GAGEGPGYL

SEQ ID NO: 1075393 - protein, 9 aa, Homo Sapiens
SNKENDTDE

SEQ ID NO: 1075394 - protein, 9 aa, Homo Sapiens
YQFLQKYLD

SEQ ID NO: 1075395 - protein, 9 aa, Homo Sapiens
ASCPDTSNI

SEQ ID NO: 1075396 - protein, 9 aa, Homo Sapiens
IPEKWMDFV

SEQ ID NO: 1075397 - protein, 9 aa, Homo Sapiens
GDKAISYDR

SEQ ID NO: 1075398 - protein, 9 aa, Homo Sapiens
HDVGKEIRV

SEQ ID NO: 1075399 - protein, 9 aa, Homo Sapiens
EKNSTFRNS

SEQ ID NO: 1075400 - protein, 9 aa, Homo Sapiens
LFSVSLPLA

SEQ ID NO: 1075401 - protein, 9 aa, Homo Sapiens
RVAEVKAES

SEQ ID NO: 1075402 - protein, 9 aa, Homo Sapiens
NTFLLDSEV

SEQ ID NO: 1075403 - protein, 9 aa, Homo Sapiens
LVFMVFSFI

SEQ ID NO: 1075404 - protein, 9 aa, Homo Sapiens
GHVTILADS

SEQ ID NO: 1075405 - protein, 9 aa, Homo Sapiens
SVFEGEGPA

SEQ ID NO: 1075406 - protein, 9 aa, Homo Sapiens
SIYDVWVCH

SEQ ID NO: 1075407 - protein, 9 aa, Homo Sapiens
DNRAVKSIN

SEQ ID NO: 1075408 - protein, 9 aa, Homo Sapiens
KLNSEDDMG

SEQ ID NO: 1075409 - protein, 9 aa, Homo Sapiens
HNVLGKNLK

SEQ ID NO: 1075410 - protein, 9 aa, Homo Sapiens
TLKGETRQL

SEQ ID NO: 1075411 - protein, 9 aa, Homo Sapiens
EMRQIYTGL

SEQ ID NO: 1075412 - protein, 9 aa, Homo Sapiens
RETSTPGRN

SEQ ID NO: 1075413 - protein, 9 aa, Homo Sapiens
KKNIMDLYV

SEQ ID NO: 1075414 - protein, 9 aa, Homo Sapiens
LGGTSAAPP

SEQ ID NO: 1075415 - protein, 9 aa, Homo Sapiens
KKENEMMKS

SEQ ID NO: 1075416 - protein, 9 aa, Homo Sapiens
QFFLQCDSD

SEQ ID NO: 1075417 - protein, 9 aa, Homo Sapiens
EENIWRLLP

SEQ ID NO: 1075418 - protein, 9 aa, Homo Sapiens
LCVDVRLKP

SEQ ID NO: 1075419 - protein, 9 aa, Homo Sapiens
RVREKFRKK

SEQ ID NO: 1075420 - protein, 9 aa, Homo Sapiens
FSLLKPLCR

SEQ ID NO: 1075421 - protein, 9 aa, Homo Sapiens
TVVTGGAVK

SEQ ID NO: 1075422 - protein, 9 aa, Homo Sapiens
PKGSPRPKA

SEQ ID NO: 1075423 - protein, 9 aa, Homo Sapiens
KDGGCVAPA

SEQ ID NO: 1075424 - protein, 9 aa, Homo Sapiens
DTMRPDLLL

SEQ ID NO: 1075425 - protein, 9 aa, Homo Sapiens
VAGSQFLAF

SEQ ID NO: 1075426 - protein, 9 aa, Homo Sapiens
DSTNPFSKD

SEQ ID NO: 1075427 - protein, 9 aa, Homo Sapiens
NVHLQYPEG

SEQ ID NO: 1075428 - protein, 9 aa, Homo Sapiens
ENIWRLLPL

SEQ ID NO: 1075429 - protein, 9 aa, Homo Sapiens
HGNSMNSLF

SEQ ID NO: 1075430 - protein, 9 aa, Homo Sapiens
SYKCNEGGK

SEQ ID NO: 1075431 - protein, 9 aa, Homo Sapiens
RPTLFSPEK

SEQ ID NO: 1075432 - protein, 9 aa, Homo Sapiens
RHQEYYRGQ

SEQ ID NO: 1075433 - protein, 9 aa, Homo Sapiens
GGKAFIKMS

SEQ ID NO: 1075434 - protein, 9 aa, Homo Sapiens
PKMASNYLS

SEQ ID NO: 1075435 - protein, 9 aa, Homo Sapiens
KNKHLDYLI

SEQ ID NO: 1075436 - protein, 9 aa, Homo Sapiens
FLIIRMVLQ

SEQ ID NO: 1075437 - protein, 9 aa, Homo Sapiens
AYLWCKECL

SEQ ID NO: 1075438 - protein, 9 aa, Homo Sapiens
VNFENLNGH

SEQ ID NO: 1075439 - protein, 9 aa, Homo Sapiens
STDQEFENF

SEQ ID NO: 1075440 - protein, 9 aa, Homo Sapiens
RKFEAKKES

SEQ ID NO: 1075441 - protein, 9 aa, Homo Sapiens
SFVVPLPNT

SEQ ID NO: 1075442 - protein, 9 aa, Homo Sapiens
HRLTHSSAR

SEQ ID NO: 1075443 - protein, 9 aa, Homo Sapiens
KLIRQKKKT

SEQ ID NO: 1075444 - protein, 9 aa, Homo Sapiens
KRQISHGRA

SEQ ID NO: 1075445 - protein, 9 aa, Homo Sapiens
PSQKRPWCS

SEQ ID NO: 1075446 - protein, 9 aa, Homo Sapiens
FSLTSHPLQ

SEQ ID NO: 1075447 - protein, 9 aa, Homo Sapiens
PPFCCQLHH

SEQ ID NO: 1075448 - protein, 9 aa, Homo Sapiens
NLIRRNLDC

SEQ ID NO: 1075449 - protein, 9 aa, Homo Sapiens
RGKTKSFLE

SEQ ID NO: 1075450 - protein, 9 aa, Homo Sapiens
HEKVLPGDV

SEQ ID NO: 1075451 - protein, 9 aa, Homo Sapiens
HSSFIRTVQ

SEQ ID NO: 1075452 - protein, 9 aa, Homo Sapiens
EPSLGQELP

SEQ ID NO: 1075453 - protein, 9 aa, Homo Sapiens
HTRPIFSGQ

SEQ ID NO: 1075454 - protein, 9 aa, Homo Sapiens
WGQPCTAPL

SEQ ID NO: 1075455 - protein, 9 aa, Homo Sapiens
TQDGTAQSN

SEQ ID NO: 1075456 - protein, 9 aa, Homo Sapiens
EMDAPPEGD

SEQ ID NO: 1075457 - protein, 9 aa, Homo Sapiens
SVHSNMELP

SEQ ID NO: 1075458 - protein, 9 aa, Homo Sapiens
DVLPGLISR

SEQ ID NO: 1075459 - protein, 9 aa, Homo Sapiens
IIFHLKKER

SEQ ID NO: 1075460 - protein, 9 aa, Homo Sapiens
DDFFGQTII

SEQ ID NO: 1075461 - protein, 9 aa, Homo Sapiens
STSCYCLLN

SEQ ID NO: 1075462 - protein, 9 aa, Homo Sapiens
CKFCGKTFK

SEQ ID NO: 1075463 - protein, 9 aa, Homo Sapiens
HFTPGNPPL

SEQ ID NO: 1075464 - protein, 9 aa, Homo Sapiens
VEKLKNFNI

SEQ ID NO: 1075465 - protein, 9 aa, Homo Sapiens
NKGRKSFPS

SEQ ID NO: 1075466 - protein, 9 aa, Homo Sapiens
FTCHPVCRS

SEQ ID NO: 1075467 - protein, 9 aa, Homo Sapiens
DTFFLDCTI

SEQ ID NO: 1075468 - protein, 9 aa, Homo Sapiens
MNIKAPKIF

SEQ ID NO: 1075469 - protein, 9 aa, Homo Sapiens
AARERWGLA

SEQ ID NO: 1075470 - protein, 9 aa, Homo Sapiens
NELKCADIN

SEQ ID NO: 1075471 - protein, 9 aa, Homo Sapiens
LPKKSLSEV

SEQ ID NO: 1075472 - protein, 9 aa, Homo Sapiens
ADWMHVRDN

SEQ ID NO: 1075473 - protein, 9 aa, Homo Sapiens
RTCTSSGRG

SEQ ID NO: 1075474 - protein, 9 aa, Homo Sapiens
IFGDVNNIQ

SEQ ID NO: 1075475 - protein, 9 aa, Homo Sapiens
GPARISFKT

SEQ ID NO: 1075476 - protein, 9 aa, Homo Sapiens
QLLDIETKK

SEQ ID NO: 1075477 - protein, 9 aa, Homo Sapiens
LCQKCETRV

SEQ ID NO: 1075478 - protein, 9 aa, Homo Sapiens
WLNGQSLSV

SEQ ID NO: 1075479 - protein, 9 aa, Homo Sapiens
SNDSCLALE

SEQ ID NO: 1075480 - protein, 9 aa, Homo Sapiens
ILQFVATGA

SEQ ID NO: 1075481 - protein, 9 aa, Homo Sapiens
NREHDLLSH

SEQ ID NO: 1075482 - protein, 9 aa, Homo Sapiens
SGKNCDVVV

SEQ ID NO: 1075483 - protein, 9 aa, Homo Sapiens
QVPVLGKEY

SEQ ID NO: 1075484 - protein, 9 aa, Homo Sapiens
SLFFFTSPA

SEQ ID NO: 1075485 - protein, 9 aa, Homo Sapiens
CSDGSESRG

SEQ ID NO: 1075486 - protein, 9 aa, Homo Sapiens
PQTYLSIKF

SEQ ID NO: 1075487 - protein, 9 aa, Homo Sapiens
PNVCAFPMK

SEQ ID NO: 1075488 - protein, 9 aa, Homo Sapiens
QTRNKEQSG

SEQ ID NO: 1075489 - protein, 9 aa, Homo Sapiens
SDPGVLSRA

SEQ ID NO: 1075490 - protein, 9 aa, Homo Sapiens
LAQEDVLKI

SEQ ID NO: 1075491 - protein, 9 aa, Homo Sapiens
PKLLDCFME

SEQ ID NO: 1075492 - protein, 9 aa, Homo Sapiens
IRLLSYMCF

SEQ ID NO: 1075493 - protein, 9 aa, Homo Sapiens
AVDTLLKEL

SEQ ID NO: 1075494 - protein, 9 aa, Homo Sapiens
KIVSSKAIS

SEQ ID NO: 1075495 - protein, 9 aa, Homo Sapiens
AQGTAEAAH

SEQ ID NO: 1075496 - protein, 9 aa, Homo Sapiens
PWAQGTAEA

SEQ ID NO: 1075497 - protein, 9 aa, Homo Sapiens
SFFKFQVVE

SEQ ID NO: 1075498 - protein, 9 aa, Homo Sapiens
GKPCPPIQA

SEQ ID NO: 1075499 - protein, 9 aa, Homo Sapiens
FIFYNRYTT

SEQ ID NO: 1075500 - protein, 9 aa, Homo Sapiens
PYSDGGPVP

SEQ ID NO: 1075501 - protein, 9 aa, Homo Sapiens
AFILAEIGI

SEQ ID NO: 1075502 - protein, 9 aa, Homo Sapiens
LSGKRRSPG

SEQ ID NO: 1075503 - protein, 9 aa, Homo Sapiens
SRPTLRTST

SEQ ID NO: 1075504 - protein, 9 aa, Homo Sapiens
AAVGVVAEG

SEQ ID NO: 1075505 - protein, 9 aa, Homo Sapiens
VVQAFLSMK

SEQ ID NO: 1075506 - protein, 9 aa, Homo Sapiens
TLGPQPLCT

SEQ ID NO: 1075507 - protein, 9 aa, Homo Sapiens
SPSNMSPDT

SEQ ID NO: 1075508 - protein, 9 aa, Homo Sapiens
YRLEMPESV

SEQ ID NO: 1075509 - protein, 9 aa, Homo Sapiens
TSLHSHNSS

SEQ ID NO: 1075510 - protein, 9 aa, Homo Sapiens
PCGEAHPKA

SEQ ID NO: 1075511 - protein, 9 aa, Homo Sapiens
GTTEELENW

SEQ ID NO: 1075512 - protein, 9 aa, Homo Sapiens
LLPVTLSIE

SEQ ID NO: 1075513 - protein, 9 aa, Homo Sapiens
VNLDSLNNL

SEQ ID NO: 1075514 - protein, 9 aa, Homo Sapiens
GVRQKKSSR

SEQ ID NO: 1075515 - protein, 9 aa, Homo Sapiens
GEILFYNVT

SEQ ID NO: 1075516 - protein, 9 aa, Homo Sapiens
LFDVDVKTD

SEQ ID NO: 1075517 - protein, 9 aa, Homo Sapiens
PANIVKVAI

SEQ ID NO: 1075518 - protein, 9 aa, Homo Sapiens
RDKAAPLNP

SEQ ID NO: 1075519 - protein, 9 aa, Homo Sapiens
KDNEKAFSK

SEQ ID NO: 1075520 - protein, 9 aa, Homo Sapiens
LALEKEANS

SEQ ID NO: 1075521 - protein, 9 aa, Homo Sapiens
SSSTVLQTW

SEQ ID NO: 1075522 - protein, 9 aa, Homo Sapiens
HTISPSLHI

SEQ ID NO: 1075523 - protein, 9 aa, Homo Sapiens
LPKNVQETK

SEQ ID NO: 1075524 - protein, 9 aa, Homo Sapiens
DLWIHHEKM

SEQ ID NO: 1075525 - protein, 9 aa, Homo Sapiens
SEEIIKHFS

SEQ ID NO: 1075526 - protein, 9 aa, Homo Sapiens
TYFVTVAAY

SEQ ID NO: 1075527 - protein, 9 aa, Homo Sapiens
PSSTERHKA

SEQ ID NO: 1075528 - protein, 9 aa, Homo Sapiens
DLNLCELTE

SEQ ID NO: 1075529 - protein, 9 aa, Homo Sapiens
IKRWKTRLE

SEQ ID NO: 1075530 - protein, 9 aa, Homo Sapiens
KEMKISELN

SEQ ID NO: 1075531 - protein, 9 aa, Homo Sapiens
TVCKTRMVL

SEQ ID NO: 1075532 - protein, 9 aa, Homo Sapiens
RMVLQLPSK

SEQ ID NO: 1075533 - protein, 9 aa, Homo Sapiens
DPSKQPATL

SEQ ID NO: 1075534 - protein, 9 aa, Homo Sapiens
GSGCKSLLG

SEQ ID NO: 1075535 - protein, 9 aa, Homo Sapiens
ARGPPGLQG

SEQ ID NO: 1075536 - protein, 9 aa, Homo Sapiens
SDLTSAQKK

SEQ ID NO: 1075537 - protein, 9 aa, Homo Sapiens
ASRDLSTSL

SEQ ID NO: 1075538 - protein, 9 aa, Homo Sapiens
AIKYHISQP

SEQ ID NO: 1075539 - protein, 9 aa, Homo Sapiens
HIHALSCMN

SEQ ID NO: 1075540 - protein, 9 aa, Homo Sapiens
FTKNMKLEV

SEQ ID NO: 1075541 - protein, 9 aa, Homo Sapiens
EISESISFC

SEQ ID NO: 1075542 - protein, 9 aa, Homo Sapiens
ENAMKTEGS

SEQ ID NO: 1075543 - protein, 9 aa, Homo Sapiens
SLCYTPSTV

SEQ ID NO: 1075544 - protein, 9 aa, Homo Sapiens
GGYVVLGFR

SEQ ID NO: 1075545 - protein, 9 aa, Homo Sapiens
IAKKIKLPG

SEQ ID NO: 1075546 - protein, 9 aa, Homo Sapiens
GRVVKGKHE

SEQ ID NO: 1075547 - protein, 9 aa, Homo Sapiens
DPESLDSLS

SEQ ID NO: 1075548 - protein, 9 aa, Homo Sapiens
VWDNTEGEY

SEQ ID NO: 1075549 - protein, 9 aa, Homo Sapiens
GPGLPAHKT

SEQ ID NO: 1075550 - protein, 9 aa, Homo Sapiens
FFLKDLKGR

SEQ ID NO: 1075551 - protein, 9 aa, Homo Sapiens
RLRGLVQLV

SEQ ID NO: 1075552 - protein, 9 aa, Homo Sapiens
LGLYHVFQG

SEQ ID NO: 1075553 - protein, 9 aa, Homo Sapiens
SLFLLFLGI

SEQ ID NO: 1075554 - protein, 9 aa, Homo Sapiens
DGTAQSNRD

SEQ ID NO: 1075555 - protein, 9 aa, Homo Sapiens
KRGKEVPAD

SEQ ID NO: 1075556 - protein, 9 aa, Homo Sapiens
RYSPSFQVQ

SEQ ID NO: 1075557 - protein, 9 aa, Homo Sapiens
GPSTANYNL

SEQ ID NO: 1075558 - protein, 9 aa, Homo Sapiens
VSIRTLAFN

SEQ ID NO: 1075559 - protein, 9 aa, Homo Sapiens
WLITGGSLG

SEQ ID NO: 1075560 - protein, 9 aa, Homo Sapiens
KCEECRKAF

SEQ ID NO: 1075561 - protein, 9 aa, Homo Sapiens
LEEQRLVYE

SEQ ID NO: 1075562 - protein, 9 aa, Homo Sapiens
SDVVAIAPD

SEQ ID NO: 1075563 - protein, 9 aa, Homo Sapiens
LEPGRQTRR

SEQ ID NO: 1075564 - protein, 9 aa, Homo Sapiens
PSHSSFIRT

SEQ ID NO: 1075565 - protein, 9 aa, Homo Sapiens
ASGTRLVLV

SEQ ID NO: 1075566 - protein, 9 aa, Homo Sapiens
DMVQCVLSS

SEQ ID NO: 1075567 - protein, 9 aa, Homo Sapiens
VWLQWQSQH

SEQ ID NO: 1075568 - protein, 9 aa, Homo Sapiens
DFGPREDQG

SEQ ID NO: 1075569 - protein, 9 aa, Homo Sapiens
VAAASAGLQ

SEQ ID NO: 1075570 - protein, 9 aa, Homo Sapiens
ATWVSWSAC

SEQ ID NO: 1075571 - protein, 9 aa, Homo Sapiens
LENQEDIHN

SEQ ID NO: 1075572 - protein, 9 aa, Homo Sapiens
PCVLALVQD

SEQ ID NO: 1075573 - protein, 9 aa, Homo Sapiens
LAAVGVVAE

SEQ ID NO: 1075574 - protein, 9 aa, Homo Sapiens
GNYNDFENY

SEQ ID NO: 1075575 - protein, 9 aa, Homo Sapiens
LRSTVKEDN

SEQ ID NO: 1075576 - protein, 9 aa, Homo Sapiens
YGVPFSTNE

SEQ ID NO: 1075577 - protein, 9 aa, Homo Sapiens
YEKSWRRKV

SEQ ID NO: 1075578 - protein, 9 aa, Homo Sapiens
GGGGRPTLF

SEQ ID NO: 1075579 - protein, 9 aa, Homo Sapiens
GQYIAIALN

SEQ ID NO: 1075580 - protein, 9 aa, Homo Sapiens
EENEICDCG

SEQ ID NO: 1075581 - protein, 9 aa, Homo Sapiens
MAEAIIYAD

SEQ ID NO: 1075582 - protein, 9 aa, Homo Sapiens
LGMGVVFSL

SEQ ID NO: 1075583 - protein, 9 aa, Homo Sapiens
IVSAQKIYE

SEQ ID NO: 1075584 - protein, 9 aa, Homo Sapiens
ENYNQQPSN

SEQ ID NO: 1075585 - protein, 9 aa, Homo Sapiens
ILGEKVLDL

SEQ ID NO: 1075586 - protein, 9 aa, Homo Sapiens
VSQRKAPPR

SEQ ID NO: 1075587 - protein, 9 aa, Homo Sapiens
PASAPGAAA

SEQ ID NO: 1075588 - protein, 9 aa, Homo Sapiens
TLPLVTLIV

SEQ ID NO: 1075589 - protein, 9 aa, Homo Sapiens
LAEGTDLAK

SEQ ID NO: 1075590 - protein, 9 aa, Homo Sapiens
EMQLEREDQ

SEQ ID NO: 1075591 - protein, 9 aa, Homo Sapiens
LLAPIIYYN

SEQ ID NO: 1075592 - protein, 9 aa, Homo Sapiens
NIDEYEKSW

SEQ ID NO: 1075593 - protein, 9 aa, Homo Sapiens
PPEDNYPDL

SEQ ID NO: 1075594 - protein, 9 aa, Homo Sapiens
SARPHPCPH

SEQ ID NO: 1075595 - protein, 9 aa, Homo Sapiens
RHQRKIPEE

SEQ ID NO: 1075596 - protein, 9 aa, Homo Sapiens
FGLWKSKED

SEQ ID NO: 1075597 - protein, 9 aa, Homo Sapiens
PCVLFVNGD

SEQ ID NO: 1075598 - protein, 9 aa, Homo Sapiens
QLGNWMFPA

SEQ ID NO: 1075599 - protein, 9 aa, Homo Sapiens
SQVAMQVLE

SEQ ID NO: 1075600 - protein, 9 aa, Homo Sapiens
RKLNLELHT

SEQ ID NO: 1075601 - protein, 9 aa, Homo Sapiens
YFSSSAPKL

SEQ ID NO: 1075602 - protein, 9 aa, Homo Sapiens
MDERPKTRF

SEQ ID NO: 1075603 - protein, 9 aa, Homo Sapiens
VTLKEELPL

SEQ ID NO: 1075604 - protein, 9 aa, Homo Sapiens
AEVLKFVFC

SEQ ID NO: 1075605 - protein, 9 aa, Homo Sapiens
LYVQIPPIE

SEQ ID NO: 1075606 - protein, 9 aa, Homo Sapiens
GPQLDVKGS

SEQ ID NO: 1075607 - protein, 9 aa, Homo Sapiens
STSSDNSSF

SEQ ID NO: 1075608 - protein, 9 aa, Homo Sapiens
AVFGYLTFY

SEQ ID NO: 1075609 - protein, 9 aa, Homo Sapiens
SGPSKGGSS

SEQ ID NO: 1075610 - protein, 9 aa, Homo Sapiens
LERDQVASV

SEQ ID NO: 1075611 - protein, 9 aa, Homo Sapiens
SSFEFCEEA

SEQ ID NO: 1075612 - protein, 9 aa, Homo Sapiens
GEVKSYSIE

SEQ ID NO: 1075613 - protein, 9 aa, Homo Sapiens
ISSVLHGEL

SEQ ID NO: 1075614 - protein, 9 aa, Homo Sapiens
RTKRQISHG

SEQ ID NO: 1075615 - protein, 9 aa, Homo Sapiens
QGERVAARE

SEQ ID NO: 1075616 - protein, 9 aa, Homo Sapiens
QIFSAYPSQ

SEQ ID NO: 1075617 - protein, 9 aa, Homo Sapiens
GGSECPQGM

SEQ ID NO: 1075618 - protein, 9 aa, Homo Sapiens
KNEKPAVKA

SEQ ID NO: 1075619 - protein, 9 aa, Homo Sapiens
SLFFLGPST

SEQ ID NO: 1075620 - protein, 9 aa, Homo Sapiens
EFFRASGNL

SEQ ID NO: 1075621 - protein, 9 aa, Homo Sapiens
DAWGPEAAK

SEQ ID NO: 1075622 - protein, 9 aa, Homo Sapiens
NVNVRIHAL

SEQ ID NO: 1075623 - protein, 9 aa, Homo Sapiens
LDKRENSQS

SEQ ID NO: 1075624 - protein, 9 aa, Homo Sapiens
DLAGKRIES

SEQ ID NO: 1075625 - protein, 9 aa, Homo Sapiens
SGRGCHVRS

SEQ ID NO: 1075626 - protein, 9 aa, Homo Sapiens
GDLEPSTIV

SEQ ID NO: 1075627 - protein, 9 aa, Homo Sapiens
GSLKRRRCA

SEQ ID NO: 1075628 - protein, 9 aa, Homo Sapiens
ETEKTSNPS

SEQ ID NO: 1075629 - protein, 9 aa, Homo Sapiens
LPSVSFEKS

SEQ ID NO: 1075630 - protein, 9 aa, Homo Sapiens
REVELKKRV

SEQ ID NO: 1075631 - protein, 9 aa, Homo Sapiens
ARKKAQELS

SEQ ID NO: 1075632 - protein, 9 aa, Homo Sapiens
ENKFPWRKM

SEQ ID NO: 1075633 - protein, 9 aa, Homo Sapiens
GRPGDDLRN

SEQ ID NO: 1075634 - protein, 9 aa, Homo Sapiens
HSQYSQALM

SEQ ID NO: 1075635 - protein, 9 aa, Homo Sapiens
LASAGSSDL

SEQ ID NO: 1075636 - protein, 9 aa, Homo Sapiens
FILLLQKII

SEQ ID NO: 1075637 - protein, 9 aa, Homo Sapiens
TFPFRGFRE

SEQ ID NO: 1075638 - protein, 9 aa, Homo Sapiens
PSKGESSGD

SEQ ID NO: 1075639 - protein, 9 aa, Homo Sapiens
PDQLPLSLR

SEQ ID NO: 1075640 - protein, 9 aa, Homo Sapiens
KKVQKVPPG

SEQ ID NO: 1075641 - protein, 9 aa, Homo Sapiens
ETMFFLTSR

SEQ ID NO: 1075642 - protein, 9 aa, Homo Sapiens
LSSHSGLRS

SEQ ID NO: 1075643 - protein, 9 aa, Homo Sapiens
AFSWGLSLV

SEQ ID NO: 1075644 - protein, 9 aa, Homo Sapiens
KLKEQLVQV

SEQ ID NO: 1075645 - protein, 9 aa, Homo Sapiens
TSSDNSSFH

SEQ ID NO: 1075646 - protein, 9 aa, Homo Sapiens
SLPRLEILV

SEQ ID NO: 1075647 - protein, 9 aa, Homo Sapiens
ANNRILAEK

SEQ ID NO: 1075648 - protein, 9 aa, Homo Sapiens
SRKSYIWPE

SEQ ID NO: 1075649 - protein, 9 aa, Homo Sapiens
FLQSYQLSP

SEQ ID NO: 1075650 - protein, 9 aa, Homo Sapiens
AHRDREIIF

SEQ ID NO: 1075651 - protein, 9 aa, Homo Sapiens
RNPGGEEAR

SEQ ID NO: 1075652 - protein, 9 aa, Homo Sapiens
VQGRGEAAW

SEQ ID NO: 1075653 - protein, 9 aa, Homo Sapiens
CGEAHPKAT

SEQ ID NO: 1075654 - protein, 9 aa, Homo Sapiens
WKSKEDNHS

SEQ ID NO: 1075655 - protein, 9 aa, Homo Sapiens
LGLISIDRF

SEQ ID NO: 1075656 - protein, 9 aa, Homo Sapiens
YNSFMRVRE

SEQ ID NO: 1075657 - protein, 9 aa, Homo Sapiens
VTGVFLRPY

SEQ ID NO: 1075658 - protein, 9 aa, Homo Sapiens
FYFAINHNP

SEQ ID NO: 1075659 - protein, 9 aa, Homo Sapiens
PSGEPGQAG

SEQ ID NO: 1075660 - protein, 9 aa, Homo Sapiens
PLYAPPRAP

SEQ ID NO: 1075661 - protein, 9 aa, Homo Sapiens
AKDGREGSR

SEQ ID NO: 1075662 - protein, 9 aa, Homo Sapiens
SYLSHIGLF

SEQ ID NO: 1075663 - protein, 9 aa, Homo Sapiens
PQGLPGPQS

SEQ ID NO: 1075664 - protein, 9 aa, Homo Sapiens
CDSSFLYNG

SEQ ID NO: 1075665 - protein, 9 aa, Homo Sapiens
TEMALRVPS

SEQ ID NO: 1075666 - protein, 9 aa, Homo Sapiens
QYAHLCPGP

SEQ ID NO: 1075667 - protein, 9 aa, Homo Sapiens
LDCREREMQ

SEQ ID NO: 1075668 - protein, 9 aa, Homo Sapiens
CDASPSKEE

SEQ ID NO: 1075669 - protein, 9 aa, Homo Sapiens
EYHHFVLMK

SEQ ID NO: 1075670 - protein, 9 aa, Homo Sapiens
PGHAPGRDK

SEQ ID NO: 1075671 - protein, 9 aa, Homo Sapiens
CEAGLIVGT

SEQ ID NO: 1075672 - protein, 9 aa, Homo Sapiens
EALGGGEEP

SEQ ID NO: 1075673 - protein, 9 aa, Homo Sapiens
ASSLSSLTE

SEQ ID NO: 1075674 - protein, 9 aa, Homo Sapiens
QLSFIRDIR

SEQ ID NO: 1075675 - protein, 9 aa, Homo Sapiens
KSYLSHIGL

SEQ ID NO: 1075676 - protein, 9 aa, Homo Sapiens
SIVLNGSLN

SEQ ID NO: 1075677 - protein, 9 aa, Homo Sapiens
ENGNSVLMK

SEQ ID NO: 1075678 - protein, 9 aa, Homo Sapiens
DFNFIPEVS

SEQ ID NO: 1075679 - protein, 9 aa, Homo Sapiens
ERESVIQQR

SEQ ID NO: 1075680 - protein, 9 aa, Homo Sapiens
EALAAVNIV

SEQ ID NO: 1075681 - protein, 9 aa, Homo Sapiens
LVLDSGGQR

SEQ ID NO: 1075682 - protein, 9 aa, Homo Sapiens
LEEIEEGVR

SEQ ID NO: 1075683 - protein, 9 aa, Homo Sapiens
ERDQVASVF

SEQ ID NO: 1075684 - protein, 9 aa, Homo Sapiens
FEEKLSPSY

SEQ ID NO: 1075685 - protein, 9 aa, Homo Sapiens
SVSQESQGA

SEQ ID NO: 1075686 - protein, 9 aa, Homo Sapiens
QRFIPFLNL

SEQ ID NO: 1075687 - protein, 9 aa, Homo Sapiens
NGPVLVCAL

SEQ ID NO: 1075688 - protein, 9 aa, Homo Sapiens
GSQQCCQKS

SEQ ID NO: 1075689 - protein, 9 aa, Homo Sapiens
SVKGQTESF

SEQ ID NO: 1075690 - protein, 9 aa, Homo Sapiens
KIIRHKDVH

SEQ ID NO: 1075691 - protein, 9 aa, Homo Sapiens
PEGGNPSIF

SEQ ID NO: 1075692 - protein, 9 aa, Homo Sapiens
QGDPGFEGE

SEQ ID NO: 1075693 - protein, 9 aa, Homo Sapiens
AENFCALST

SEQ ID NO: 1075694 - protein, 9 aa, Homo Sapiens
LYNLHMWSQ

SEQ ID NO: 1075695 - protein, 9 aa, Homo Sapiens
RTRGSTAYL

SEQ ID NO: 1075696 - protein, 9 aa, Homo Sapiens
DNDCRNWSD

SEQ ID NO: 1075697 - protein, 9 aa, Homo Sapiens
LVVMSYDCY

SEQ ID NO: 1075698 - protein, 9 aa, Homo Sapiens
GQFNKEGAA

SEQ ID NO: 1075699 - protein, 9 aa, Homo Sapiens
FNLPVLVFV

SEQ ID NO: 1075700 - protein, 9 aa, Homo Sapiens
ECSVKGQTE

SEQ ID NO: 1075701 - protein, 9 aa, Homo Sapiens
NFCALSTGE

SEQ ID NO: 1075702 - protein, 9 aa, Homo Sapiens
FQLTHLLGG

SEQ ID NO: 1075703 - protein, 9 aa, Homo Sapiens
LQESHITVA

SEQ ID NO: 1075704 - protein, 9 aa, Homo Sapiens
NPVHGPQNV

SEQ ID NO: 1075705 - protein, 9 aa, Homo Sapiens
GQEACLTPC

SEQ ID NO: 1075706 - protein, 9 aa, Homo Sapiens
ERSQTHYIT

SEQ ID NO: 1075707 - protein, 9 aa, Homo Sapiens
GVGDNLAER

SEQ ID NO: 1075708 - protein, 9 aa, Homo Sapiens
YSHMKFHEN

SEQ ID NO: 1075709 - protein, 9 aa, Homo Sapiens
HILNLHSPT

SEQ ID NO: 1075710 - protein, 9 aa, Homo Sapiens
AIGSGTEIL

SEQ ID NO: 1075711 - protein, 9 aa, Homo Sapiens
PGVLSRATP

SEQ ID NO: 1075712 - protein, 9 aa, Homo Sapiens
DRVRVKAHW

SEQ ID NO: 1075713 - protein, 9 aa, Homo Sapiens
ALKAAGGPP

SEQ ID NO: 1075714 - protein, 9 aa, Homo Sapiens
QSRKNNSNS

SEQ ID NO: 1075715 - protein, 9 aa, Homo Sapiens
CIILGESMY

SEQ ID NO: 1075716 - protein, 9 aa, Homo Sapiens
LHRHFVNPV

SEQ ID NO: 1075717 - protein, 9 aa, Homo Sapiens
PSKGSTALT

SEQ ID NO: 1075718 - protein, 9 aa, Homo Sapiens
KNAGEDPGL

SEQ ID NO: 1075719 - protein, 9 aa, Homo Sapiens
MYLPFCGTA

SEQ ID NO: 1075720 - protein, 9 aa, Homo Sapiens
LDLHKGTKS

SEQ ID NO: 1075721 - protein, 9 aa, Homo Sapiens
QRPCKKSVN

SEQ ID NO: 1075722 - protein, 9 aa, Homo Sapiens
FLVAQKNFR

SEQ ID NO: 1075723 - protein, 9 aa, Homo Sapiens
PGYFRCQCE

SEQ ID NO: 1075724 - protein, 9 aa, Homo Sapiens
PEYGGKVCY

SEQ ID NO: 1075725 - protein, 9 aa, Homo Sapiens
KGKHESYRI

SEQ ID NO: 1075726 - protein, 9 aa, Homo Sapiens
FSCSRMSAK

SEQ ID NO: 1075727 - protein, 9 aa, Homo Sapiens
SQRKAPPRP

SEQ ID NO: 1075728 - protein, 9 aa, Homo Sapiens
ERKKHLTYA

SEQ ID NO: 1075729 - protein, 9 aa, Homo Sapiens
AFKSDESST

SEQ ID NO: 1075730 - protein, 9 aa, Homo Sapiens
KSSKRANIC

SEQ ID NO: 1075731 - protein, 9 aa, Homo Sapiens
EGGKPCPPI

SEQ ID NO: 1075732 - protein, 9 aa, Homo Sapiens
NYNDFENYN

SEQ ID NO: 1075733 - protein, 9 aa, Homo Sapiens
WAKEQQKAK

SEQ ID NO: 1075734 - protein, 9 aa, Homo Sapiens
SGLLEETAG

SEQ ID NO: 1075735 - protein, 9 aa, Homo Sapiens
PFPNAQSSQ

SEQ ID NO: 1075736 - protein, 9 aa, Homo Sapiens
VYVTFVVSF

SEQ ID NO: 1075737 - protein, 9 aa, Homo Sapiens
PTFSTNENK

SEQ ID NO: 1075738 - protein, 9 aa, Homo Sapiens
SAHCSSAPS

SEQ ID NO: 1075739 - protein, 9 aa, Homo Sapiens
QDALLSQRS

SEQ ID NO: 1075740 - protein, 9 aa, Homo Sapiens
SLFFETSFC

SEQ ID NO: 1075741 - protein, 9 aa, Homo Sapiens
HTFGKFYYK

SEQ ID NO: 1075742 - protein, 9 aa, Homo Sapiens
IQKKSEYWF

SEQ ID NO: 1075743 - protein, 9 aa, Homo Sapiens
SPILNMKGT

SEQ ID NO: 1075744 - protein, 9 aa, Homo Sapiens
ALNFLYSPK

SEQ ID NO: 1075745 - protein, 9 aa, Homo Sapiens
RFLQELVSH

SEQ ID NO: 1075746 - protein, 9 aa, Homo Sapiens
LIKIIGNLV

SEQ ID NO: 1075747 - protein, 9 aa, Homo Sapiens
KMSNWNFLI

SEQ ID NO: 1075748 - protein, 9 aa, Homo Sapiens
FPRNPPHFR

SEQ ID NO: 1075749 - protein, 9 aa, Homo Sapiens
PASDGDGRT

SEQ ID NO: 1075750 - protein, 9 aa, Homo Sapiens
PLCPEAPSC

SEQ ID NO: 1075751 - protein, 9 aa, Homo Sapiens
MEKIMRPVE

SEQ ID NO: 1075752 - protein, 9 aa, Homo Sapiens
CRELVWVGE

SEQ ID NO: 1075753 - protein, 9 aa, Homo Sapiens
KFVEIQFNE

SEQ ID NO: 1075754 - protein, 9 aa, Homo Sapiens
AAKKFPKIS

SEQ ID NO: 1075755 - protein, 9 aa, Homo Sapiens
ATNKFQNLQ

SEQ ID NO: 1075756 - protein, 9 aa, Homo Sapiens
SVKHRKFEA

SEQ ID NO: 1075757 - protein, 9 aa, Homo Sapiens
VTWSKAGGH

SEQ ID NO: 1075758 - protein, 9 aa, Homo Sapiens
PAIISLTPP

SEQ ID NO: 1075759 - protein, 9 aa, Homo Sapiens
EMKTLVREK

SEQ ID NO: 1075760 - protein, 9 aa, Homo Sapiens
EGPGYLPPP

SEQ ID NO: 1075761 - protein, 9 aa, Homo Sapiens
KECKKAVRW

SEQ ID NO: 1075762 - protein, 9 aa, Homo Sapiens
LDRLLALNF

SEQ ID NO: 1075763 - protein, 9 aa, Homo Sapiens
CRWACTSCW

SEQ ID NO: 1075764 - protein, 9 aa, Homo Sapiens
LQNRGPKNS

SEQ ID NO: 1075765 - protein, 9 aa, Homo Sapiens
RWMPPEFIF

SEQ ID NO: 1075766 - protein, 9 aa, Homo Sapiens
PMKPALPSA

SEQ ID NO: 1075767 - protein, 9 aa, Homo Sapiens
IEASSYRLD

SEQ ID NO: 1075768 - protein, 9 aa, Homo Sapiens
LEGAMEMRQ

SEQ ID NO: 1075769 - protein, 9 aa, Homo Sapiens
PIFSTGSIK

SEQ ID NO: 1075770 - protein, 9 aa, Homo Sapiens
ESSHLARSG

SEQ ID NO: 1075771 - protein, 9 aa, Homo Sapiens
SGPESGQSS

SEQ ID NO: 1075772 - protein, 9 aa, Homo Sapiens
ICPTNCHVN

SEQ ID NO: 1075773 - protein, 9 aa, Homo Sapiens
VARKGADVI

SEQ ID NO: 1075774 - protein, 9 aa, Homo Sapiens
NEAICHHPA

SEQ ID NO: 1075775 - protein, 9 aa, Homo Sapiens
QRCQCVEQH

SEQ ID NO: 1075776 - protein, 9 aa, Homo Sapiens
SVESLTLVL

SEQ ID NO: 1075777 - protein, 9 aa, Homo Sapiens
VVGPVSLPW

SEQ ID NO: 1075778 - protein, 9 aa, Homo Sapiens
LQYPEGGKM

SEQ ID NO: 1075779 - protein, 9 aa, Homo Sapiens
SARNAGVPP

SEQ ID NO: 1075780 - protein, 9 aa, Homo Sapiens
LSHIGLFLF

SEQ ID NO: 1075781 - protein, 9 aa, Homo Sapiens
SGDPPLSSS

SEQ ID NO: 1075782 - protein, 9 aa, Homo Sapiens
TEELENWDP

SEQ ID NO: 1075783 - protein, 9 aa, Homo Sapiens
KALQKVKAA

SEQ ID NO: 1075784 - protein, 9 aa, Homo Sapiens
PGLDEPPSV

SEQ ID NO: 1075785 - protein, 9 aa, Homo Sapiens
SSSYDRTAW

SEQ ID NO: 1075786 - protein, 9 aa, Homo Sapiens
FAPYHFSFS

SEQ ID NO: 1075787 - protein, 9 aa, Homo Sapiens
SPQGPPGIP

SEQ ID NO: 1075788 - protein, 9 aa, Homo Sapiens
GEQGPRGPS

SEQ ID NO: 1075789 - protein, 9 aa, Homo Sapiens
ESQREKKKL

SEQ ID NO: 1075790 - protein, 9 aa, Homo Sapiens
KKRRQKRGR

SEQ ID NO: 1075791 - protein, 9 aa, Homo Sapiens
DRTKRQISH

SEQ ID NO: 1075792 - protein, 9 aa, Homo Sapiens
LEIKKKNIS

SEQ ID NO: 1075793 - protein, 9 aa, Homo Sapiens
SPIPGAPSE

SEQ ID NO: 1075794 - protein, 9 aa, Homo Sapiens
MITEFACGT

SEQ ID NO: 1075795 - protein, 9 aa, Homo Sapiens
DESDDLSES

SEQ ID NO: 1075796 - protein, 9 aa, Homo Sapiens
AFCASYNFS

SEQ ID NO: 1075797 - protein, 9 aa, Homo Sapiens
MKTEGSVLL

SEQ ID NO: 1075798 - protein, 9 aa, Homo Sapiens
SFSLVSVNI

SEQ ID NO: 1075799 - protein, 9 aa, Homo Sapiens
AGLFPLGQW

SEQ ID NO: 1075800 - protein, 9 aa, Homo Sapiens
FTYVSRANF

SEQ ID NO: 1075801 - protein, 9 aa, Homo Sapiens
QPGPPYNVR

SEQ ID NO: 1075802 - protein, 9 aa, Homo Sapiens
KFYFAINHN

SEQ ID NO: 1075803 - protein, 9 aa, Homo Sapiens
PIWKKIVFV

SEQ ID NO: 1075804 - protein, 9 aa, Homo Sapiens
ARQRGFRYE

SEQ ID NO: 1075805 - protein, 9 aa, Homo Sapiens
LMKENLQTG

SEQ ID NO: 1075806 - protein, 9 aa, Homo Sapiens
NFPQPQQKL

SEQ ID NO: 1075807 - protein, 9 aa, Homo Sapiens
QKEYHHFVL

SEQ ID NO: 1075808 - protein, 9 aa, Homo Sapiens
SGAKSSSKS

SEQ ID NO: 1075809 - protein, 9 aa, Homo Sapiens
SNRDYIPVE

SEQ ID NO: 1075810 - protein, 9 aa, Homo Sapiens
SVRMNYTLR

SEQ ID NO: 1075811 - protein, 9 aa, Homo Sapiens
LVCVTQAEI

SEQ ID NO: 1075812 - protein, 9 aa, Homo Sapiens
STEEGQSLD

SEQ ID NO: 1075813 - protein, 9 aa, Homo Sapiens
DVIESNARW

SEQ ID NO: 1075814 - protein, 9 aa, Homo Sapiens
VVGTTSSRV

SEQ ID NO: 1075815 - protein, 9 aa, Homo Sapiens
VDDFEEQKN

SEQ ID NO: 1075816 - protein, 9 aa, Homo Sapiens
HSSSDAQVS

SEQ ID NO: 1075817 - protein, 9 aa, Homo Sapiens
KKVVSLNGK

SEQ ID NO: 1075818 - protein, 9 aa, Homo Sapiens
SGQVTFSIL

SEQ ID NO: 1075819 - protein, 9 aa, Homo Sapiens
FVVPLPNTS

SEQ ID NO: 1075820 - protein, 9 aa, Homo Sapiens
RDNFLKFDD

SEQ ID NO: 1075821 - protein, 9 aa, Homo Sapiens
PKKDIARKR

SEQ ID NO: 1075822 - protein, 9 aa, Homo Sapiens
AFKTHSSNS

SEQ ID NO: 1075823 - protein, 9 aa, Homo Sapiens
GNNGVLAPA

SEQ ID NO: 1075824 - protein, 9 aa, Homo Sapiens
ILHKEEEAT

SEQ ID NO: 1075825 - protein, 9 aa, Homo Sapiens
SPASDLEAV

SEQ ID NO: 1075826 - protein, 9 aa, Homo Sapiens
GKQDGEAPL

SEQ ID NO: 1075827 - protein, 9 aa, Homo Sapiens
VRFSYPCTQ

SEQ ID NO: 1075828 - protein, 9 aa, Homo Sapiens
AVCFVIPLT

SEQ ID NO: 1075829 - protein, 9 aa, Homo Sapiens
RLPFCGHCI

SEQ ID NO: 1075830 - protein, 9 aa, Homo Sapiens
KGAKCLRFA

SEQ ID NO: 1075831 - protein, 9 aa, Homo Sapiens
HSPIVSQVT

SEQ ID NO: 1075832 - protein, 9 aa, Homo Sapiens
LECGVIIYN

SEQ ID NO: 1075833 - protein, 9 aa, Homo Sapiens
GHLQNLSAL

SEQ ID NO: 1075834 - protein, 9 aa, Homo Sapiens
EKRLRREPK

SEQ ID NO: 1075835 - protein, 9 aa, Homo Sapiens
VLGWNLPGG

SEQ ID NO: 1075836 - protein, 9 aa, Homo Sapiens
RGLIAAPQV

SEQ ID NO: 1075837 - protein, 9 aa, Homo Sapiens
FAWETGAIG

SEQ ID NO: 1075838 - protein, 9 aa, Homo Sapiens
KASIKKQKA

SEQ ID NO: 1075839 - protein, 9 aa, Homo Sapiens
KYHERMSSN

SEQ ID NO: 1075840 - protein, 9 aa, Homo Sapiens
TSYSPGSRV

SEQ ID NO: 1075841 - protein, 9 aa, Homo Sapiens
AYATSGRSL

SEQ ID NO: 1075842 - protein, 9 aa, Homo Sapiens
EHSTLTRKQ

SEQ ID NO: 1075843 - protein, 9 aa, Homo Sapiens
QTKKVQKVP

SEQ ID NO: 1075844 - protein, 9 aa, Homo Sapiens
QCEAQDALL

SEQ ID NO: 1075845 - protein, 9 aa, Homo Sapiens
RNWSDEANC

SEQ ID NO: 1075846 - protein, 9 aa, Homo Sapiens
STHQLKKLL

SEQ ID NO: 1075847 - protein, 9 aa, Homo Sapiens
SGLRSANRE

SEQ ID NO: 1075848 - protein, 9 aa, Homo Sapiens
PHNWMQALT

SEQ ID NO: 1075849 - protein, 9 aa, Homo Sapiens
VDVIESNAR

SEQ ID NO: 1075850 - protein, 9 aa, Homo Sapiens
EVYGRELAY

SEQ ID NO: 1075851 - protein, 9 aa, Homo Sapiens
WWKDVWLKE

SEQ ID NO: 1075852 - protein, 9 aa, Homo Sapiens
GRPLPGKDV

SEQ ID NO: 1075853 - protein, 9 aa, Homo Sapiens
KDNYYKTLL

SEQ ID NO: 1075854 - protein, 9 aa, Homo Sapiens
GDFCQAMDS

SEQ ID NO: 1075855 - protein, 9 aa, Homo Sapiens
MQSSPSLAH

SEQ ID NO: 1075856 - protein, 9 aa, Homo Sapiens
TGSKEKRLR

SEQ ID NO: 1075857 - protein, 9 aa, Homo Sapiens
KATLEVVVK

SEQ ID NO: 1075858 - protein, 9 aa, Homo Sapiens
KCNEGGKAF

SEQ ID NO: 1075859 - protein, 9 aa, Homo Sapiens
KSMEEFQDL

SEQ ID NO: 1075860 - protein, 9 aa, Homo Sapiens
LLSPVFVEW

SEQ ID NO: 1075861 - protein, 9 aa, Homo Sapiens
KILQPGHTH

SEQ ID NO: 1075862 - protein, 9 aa, Homo Sapiens
MANKHFEIA

SEQ ID NO: 1075863 - protein, 9 aa, Homo Sapiens
AKLTPTHLS

SEQ ID NO: 1075864 - protein, 9 aa, Homo Sapiens
QQPSEKNVV

SEQ ID NO: 1075865 - protein, 9 aa, Homo Sapiens
PTSAGDQYN

SEQ ID NO: 1075866 - protein, 9 aa, Homo Sapiens
SAQRLYACD

SEQ ID NO: 1075867 - protein, 9 aa, Homo Sapiens
PQTALKSLK

SEQ ID NO: 1075868 - protein, 9 aa, Homo Sapiens
KPCSDGSES

SEQ ID NO: 1075869 - protein, 9 aa, Homo Sapiens
KRPWCSATA

SEQ ID NO: 1075870 - protein, 9 aa, Homo Sapiens
VCMVQTRVD

SEQ ID NO: 1075871 - protein, 9 aa, Homo Sapiens
SSSKSGAQT

SEQ ID NO: 1075872 - protein, 9 aa, Homo Sapiens
FSGAPGAKG

SEQ ID NO: 1075873 - protein, 9 aa, Homo Sapiens
VLSQMKKIV

SEQ ID NO: 1075874 - protein, 9 aa, Homo Sapiens
TSGKIWQLL

SEQ ID NO: 1075875 - protein, 9 aa, Homo Sapiens
RKESPDKPG

SEQ ID NO: 1075876 - protein, 9 aa, Homo Sapiens
ETWKRNSCL

SEQ ID NO: 1075877 - protein, 9 aa, Homo Sapiens
ASNDSCLAL

SEQ ID NO: 1075878 - protein, 9 aa, Homo Sapiens
IAHWLSTVE

SEQ ID NO: 1075879 - protein, 9 aa, Homo Sapiens
KLLFNIDGF

SEQ ID NO: 1075880 - protein, 9 aa, Homo Sapiens
VLVLTENTG

SEQ ID NO: 1075881 - protein, 9 aa, Homo Sapiens
KAFSWGLSL

SEQ ID NO: 1075882 - protein, 9 aa, Homo Sapiens
VPSEWTSLA

SEQ ID NO: 1075883 - protein, 9 aa, Homo Sapiens
NGVLAPAAP

SEQ ID NO: 1075884 - protein, 9 aa, Homo Sapiens
LEKGFEANN

SEQ ID NO: 1075885 - protein, 9 aa, Homo Sapiens
GTIFYRSLP

SEQ ID NO: 1075886 - protein, 9 aa, Homo Sapiens
GGSGRGCHV

SEQ ID NO: 1075887 - protein, 9 aa, Homo Sapiens
CPHEKHLAA

SEQ ID NO: 1075888 - protein, 9 aa, Homo Sapiens
YFCYIFWKR

SEQ ID NO: 1075889 - protein, 9 aa, Homo Sapiens
AQDARYRLE

SEQ ID NO: 1075890 - protein, 9 aa, Homo Sapiens
LQKHDKEDY

SEQ ID NO: 1075891 - protein, 9 aa, Homo Sapiens
SFSSELFCH

SEQ ID NO: 1075892 - protein, 9 aa, Homo Sapiens
AQKEIVSAQ

SEQ ID NO: 1075893 - protein, 9 aa, Homo Sapiens
EKKSKKTKK

SEQ ID NO: 1075894 - protein, 9 aa, Homo Sapiens
QKVPPGLPS

SEQ ID NO: 1075895 - protein, 9 aa, Homo Sapiens
ANLCLSSSN

SEQ ID NO: 1075896 - protein, 9 aa, Homo Sapiens
RPEFLQGAD

SEQ ID NO: 1075897 - protein, 9 aa, Homo Sapiens
DTHCSPELK

SEQ ID NO: 1075898 - protein, 9 aa, Homo Sapiens
EVLCKSLAL

SEQ ID NO: 1075899 - protein, 9 aa, Homo Sapiens
PRLVAGSQF

SEQ ID NO: 1075900 - protein, 9 aa, Homo Sapiens
VTTGQTPTS

SEQ ID NO: 1075901 - protein, 9 aa, Homo Sapiens
SAEIFSDIH

SEQ ID NO: 1075902 - protein, 9 aa, Homo Sapiens
EEGEEQGNR

SEQ ID NO: 1075903 - protein, 9 aa, Homo Sapiens
RKCPRRRVF

SEQ ID NO: 1075904 - protein, 9 aa, Homo Sapiens
KGCQGQEAC

SEQ ID NO: 1075905 - protein, 9 aa, Homo Sapiens
IWIESMWCM

SEQ ID NO: 1075906 - protein, 9 aa, Homo Sapiens
GQLGNWMFP

SEQ ID NO: 1075907 - protein, 9 aa, Homo Sapiens
VEIENQETS

SEQ ID NO: 1075908 - protein, 9 aa, Homo Sapiens
ITVILKISK

SEQ ID NO: 1075909 - protein, 9 aa, Homo Sapiens
SKRANICPH

SEQ ID NO: 1075910 - protein, 9 aa, Homo Sapiens
LYLGVLHHK

SEQ ID NO: 1075911 - protein, 9 aa, Homo Sapiens
NLSLLVDDE

SEQ ID NO: 1075912 - protein, 9 aa, Homo Sapiens
EIFSPMPRE

SEQ ID NO: 1075913 - protein, 9 aa, Homo Sapiens
EIKERDLDS

SEQ ID NO: 1075914 - protein, 9 aa, Homo Sapiens
TRLLWKLRA

SEQ ID NO: 1075915 - protein, 9 aa, Homo Sapiens
SERDESQKV

SEQ ID NO: 1075916 - protein, 9 aa, Homo Sapiens
QLCEDPQRF

SEQ ID NO: 1075917 - protein, 9 aa, Homo Sapiens
LFQVNHKNK

SEQ ID NO: 1075918 - protein, 9 aa, Homo Sapiens
GHTISPSLH

SEQ ID NO: 1075919 - protein, 9 aa, Homo Sapiens
LAFVPETIH

SEQ ID NO: 1075920 - protein, 9 aa, Homo Sapiens
SLQPPPPGL

SEQ ID NO: 1075921 - protein, 9 aa, Homo Sapiens
IVTRSQAEA

SEQ ID NO: 1075922 - protein, 9 aa, Homo Sapiens
REEPLQVER

SEQ ID NO: 1075923 - protein, 9 aa, Homo Sapiens
IIFMYLKPQ

SEQ ID NO: 1075924 - protein, 9 aa, Homo Sapiens
EKAAFPGRR

SEQ ID NO: 1075925 - protein, 9 aa, Homo Sapiens
INPCLCTHL

SEQ ID NO: 1075926 - protein, 9 aa, Homo Sapiens
FQSLWGNPT

SEQ ID NO: 1075927 - protein, 9 aa, Homo Sapiens
PSFSGDSFS

SEQ ID NO: 1075928 - protein, 9 aa, Homo Sapiens
LAILWLILF

SEQ ID NO: 1075929 - protein, 9 aa, Homo Sapiens
GKWATWVSW

SEQ ID NO: 1075930 - protein, 9 aa, Homo Sapiens
GPVLVCALS

SEQ ID NO: 1075931 - protein, 9 aa, Homo Sapiens
TFFFKKDKP

SEQ ID NO: 1075932 - protein, 9 aa, Homo Sapiens
IKDFTKNVL

SEQ ID NO: 1075933 - protein, 9 aa, Homo Sapiens
DKYFLAPVA

SEQ ID NO: 1075934 - protein, 9 aa, Homo Sapiens
LKRESDDFF

SEQ ID NO: 1075935 - protein, 9 aa, Homo Sapiens
KDGFLLISQ

SEQ ID NO: 1075936 - protein, 9 aa, Homo Sapiens
FYNKIFLSV

SEQ ID NO: 1075937 - protein, 9 aa, Homo Sapiens
QLENGYDFL

SEQ ID NO: 1075938 - protein, 9 aa, Homo Sapiens
WNRTFKVIK

SEQ ID NO: 1075939 - protein, 9 aa, Homo Sapiens
MAAFVCSGL

SEQ ID NO: 1075940 - protein, 9 aa, Homo Sapiens
FTSHSSVRR

SEQ ID NO: 1075941 - protein, 9 aa, Homo Sapiens
LKNTKEQRD

SEQ ID NO: 1075942 - protein, 9 aa, Homo Sapiens
FEKLRQPSQ

SEQ ID NO: 1075943 - protein, 9 aa, Homo Sapiens
PVALPKNVK

SEQ ID NO: 1075944 - protein, 9 aa, Homo Sapiens
WTGNRGFIF

SEQ ID NO: 1075945 - protein, 9 aa, Homo Sapiens
SKEGCGSYG

SEQ ID NO: 1075946 - protein, 9 aa, Homo Sapiens
KQGSKDNLH

SEQ ID NO: 1075947 - protein, 9 aa, Homo Sapiens
LFLFPGPHK

SEQ ID NO: 1075948 - protein, 9 aa, Homo Sapiens
SRKNNSNSL

SEQ ID NO: 1075949 - protein, 9 aa, Homo Sapiens
RQGDYSKIE

SEQ ID NO: 1075950 - protein, 9 aa, Homo Sapiens
AADAELPRP

SEQ ID NO: 1075951 - protein, 9 aa, Homo Sapiens
SEATFRLCC

SEQ ID NO: 1075952 - protein, 9 aa, Homo Sapiens
PGFTETTAC

SEQ ID NO: 1075953 - protein, 9 aa, Homo Sapiens
SSNSGGGSC

SEQ ID NO: 1075954 - protein, 9 aa, Homo Sapiens
GREVFEFCP

SEQ ID NO: 1075955 - protein, 9 aa, Homo Sapiens
EFCITKWKE

SEQ ID NO: 1075956 - protein, 9 aa, Homo Sapiens
ILSVDELKI

SEQ ID NO: 1075957 - protein, 9 aa, Homo Sapiens
PLSLRRLFP

SEQ ID NO: 1075958 - protein, 9 aa, Homo Sapiens
DAKSDDAWK

SEQ ID NO: 1075959 - protein, 9 aa, Homo Sapiens
LQVLSQMKK

SEQ ID NO: 1075960 - protein, 9 aa, Homo Sapiens
DLSSFEFCE

SEQ ID NO: 1075961 - protein, 9 aa, Homo Sapiens
GLESGRGRQ

SEQ ID NO: 1075962 - protein, 9 aa, Homo Sapiens
VSALGLASA

SEQ ID NO: 1075963 - protein, 9 aa, Homo Sapiens
KDYPVARFN

SEQ ID NO: 1075964 - protein, 9 aa, Homo Sapiens
KISELNAKL

SEQ ID NO: 1075965 - protein, 9 aa, Homo Sapiens
IMVKIIESK

SEQ ID NO: 1075966 - protein, 9 aa, Homo Sapiens
RKKTDAHFV

SEQ ID NO: 1075967 - protein, 9 aa, Homo Sapiens
SSYRLDLDC

SEQ ID NO: 1075968 - protein, 9 aa, Homo Sapiens
SKEGEGLEE

SEQ ID NO: 1075969 - protein, 9 aa, Homo Sapiens
GPQVNLTTS

SEQ ID NO: 1075970 - protein, 9 aa, Homo Sapiens
YPTPAKLDA

SEQ ID NO: 1075971 - protein, 9 aa, Homo Sapiens
SCAGVSVSD

SEQ ID NO: 1075972 - protein, 9 aa, Homo Sapiens
QQKLFVAEN

SEQ ID NO: 1075973 - protein, 9 aa, Homo Sapiens
MPQPGPPYN

SEQ ID NO: 1075974 - protein, 9 aa, Homo Sapiens
LGQELPPGQ

SEQ ID NO: 1075975 - protein, 9 aa, Homo Sapiens
YNLFSSASM

SEQ ID NO: 1075976 - protein, 9 aa, Homo Sapiens
KPQPFPNAQ

SEQ ID NO: 1075977 - protein, 9 aa, Homo Sapiens
DLLRISHEL

SEQ ID NO: 1075978 - protein, 9 aa, Homo Sapiens
LSPVFVEWR

SEQ ID NO: 1075979 - protein, 9 aa, Homo Sapiens
WWGEAMGWV

SEQ ID NO: 1075980 - protein, 9 aa, Homo Sapiens
AEEEHLVKC

SEQ ID NO: 1075981 - protein, 9 aa, Homo Sapiens
EIGNFVKYQ

SEQ ID NO: 1075982 - protein, 9 aa, Homo Sapiens
SRRLTDLEI

SEQ ID NO: 1075983 - protein, 9 aa, Homo Sapiens
TGLHSACYY

SEQ ID NO: 1075984 - protein, 9 aa, Homo Sapiens
QENNQACNS

SEQ ID NO: 1075985 - protein, 9 aa, Homo Sapiens
VWWKDVWLK

SEQ ID NO: 1075986 - protein, 9 aa, Homo Sapiens
AAGSPLLRD

SEQ ID NO: 1075987 - protein, 9 aa, Homo Sapiens
LSLIDTVYF

SEQ ID NO: 1075988 - protein, 9 aa, Homo Sapiens
RHHENHLLY

SEQ ID NO: 1075989 - protein, 9 aa, Homo Sapiens
VGWHIQGSY

SEQ ID NO: 1075990 - protein, 9 aa, Homo Sapiens
GPSTPLSED

SEQ ID NO: 1075991 - protein, 9 aa, Homo Sapiens
NGHSKFTGE

SEQ ID NO: 1075992 - protein, 9 aa, Homo Sapiens
SWALVLLML

SEQ ID NO: 1075993 - protein, 9 aa, Homo Sapiens
PHFVLTELW

SEQ ID NO: 1075994 - protein, 9 aa, Homo Sapiens
VVHDNQILI

SEQ ID NO: 1075995 - protein, 9 aa, Homo Sapiens
RCALFQVNH

SEQ ID NO: 1075996 - protein, 9 aa, Homo Sapiens
KPCPPIQAL

SEQ ID NO: 1075997 - protein, 9 aa, Homo Sapiens
HFSYCASRI

SEQ ID NO: 1075998 - protein, 9 aa, Homo Sapiens
CQCDSSFLY

SEQ ID NO: 1075999 - protein, 9 aa, Homo Sapiens
AQLSFIRDI

SEQ ID NO: 1076000 - protein, 9 aa, Homo Sapiens
AFSGEYIPT

SEQ ID NO: 1076001 - protein, 9 aa, Homo Sapiens
FSTNCEACM

SEQ ID NO: 1076002 - protein, 9 aa, Homo Sapiens
VPCVLFVNG

SEQ ID NO: 1076003 - protein, 9 aa, Homo Sapiens
SYIVGFYGA

SEQ ID NO: 1076004 - protein, 9 aa, Homo Sapiens
PETFEVVEM

SEQ ID NO: 1076005 - protein, 9 aa, Homo Sapiens
WGPEAAKSA

SEQ ID NO: 1076006 - protein, 9 aa, Homo Sapiens
VVETMFFLT

SEQ ID NO: 1076007 - protein, 9 aa, Homo Sapiens
PEQKLFIRH

SEQ ID NO: 1076008 - protein, 9 aa, Homo Sapiens
HLKNFLEEF

SEQ ID NO: 1076009 - protein, 9 aa, Homo Sapiens
GTYKTLTSD

SEQ ID NO: 1076010 - protein, 9 aa, Homo Sapiens
VQCLGLPHP

SEQ ID NO: 1076011 - protein, 9 aa, Homo Sapiens
MPRESCENA

SEQ ID NO: 1076012 - protein, 9 aa, Homo Sapiens
FPQPQQKLF

SEQ ID NO: 1076013 - protein, 9 aa, Homo Sapiens
YTYGFNDIA

SEQ ID NO: 1076014 - protein, 9 aa, Homo Sapiens
IIDILYASN

SEQ ID NO: 1076015 - protein, 9 aa, Homo Sapiens
LEDQTSRGL

SEQ ID NO: 1076016 - protein, 9 aa, Homo Sapiens
GHLPFFCRV

SEQ ID NO: 1076017 - protein, 9 aa, Homo Sapiens
LRVRCAKAL

SEQ ID NO: 1076018 - protein, 9 aa, Homo Sapiens
RINKQNALC

SEQ ID NO: 1076019 - protein, 9 aa, Homo Sapiens
QTESFHCPP

SEQ ID NO: 1076020 - protein, 9 aa, Homo Sapiens
ALPHNWMQA

SEQ ID NO: 1076021 - protein, 9 aa, Homo Sapiens
GRGEGPQVN

SEQ ID NO: 1076022 - protein, 9 aa, Homo Sapiens
KKYESKLKQ

SEQ ID NO: 1076023 - protein, 9 aa, Homo Sapiens
PEGSEATTV

SEQ ID NO: 1076024 - protein, 9 aa, Homo Sapiens
TPGEKILKN

SEQ ID NO: 1076025 - protein, 9 aa, Homo Sapiens
HKHFDASDS

SEQ ID NO: 1076026 - protein, 9 aa, Homo Sapiens
ISSMLTKCK

SEQ ID NO: 1076027 - protein, 9 aa, Homo Sapiens
TASDLFDPW

SEQ ID NO: 1076028 - protein, 9 aa, Homo Sapiens
TEILATSGL

SEQ ID NO: 1076029 - protein, 9 aa, Homo Sapiens
GSFSILSDG

SEQ ID NO: 1076030 - protein, 9 aa, Homo Sapiens
DLFPETFEV

SEQ ID NO: 1076031 - protein, 9 aa, Homo Sapiens
PGFSGAPGA

SEQ ID NO: 1076032 - protein, 9 aa, Homo Sapiens
QPVRGSTFT

SEQ ID NO: 1076033 - protein, 9 aa, Homo Sapiens
KQEFSESHN

SEQ ID NO: 1076034 - protein, 9 aa, Homo Sapiens
PAMLLIFLL

SEQ ID NO: 1076035 - protein, 9 aa, Homo Sapiens
IEVYGRELA

SEQ ID NO: 1076036 - protein, 9 aa, Homo Sapiens
KAAGGPPEE

SEQ ID NO: 1076037 - protein, 9 aa, Homo Sapiens
VGAGLQNME

SEQ ID NO: 1076038 - protein, 9 aa, Homo Sapiens
EKFRKKIIK

SEQ ID NO: 1076039 - protein, 9 aa, Homo Sapiens
LATSQSCQT

SEQ ID NO: 1076040 - protein, 9 aa, Homo Sapiens
KPGAIDEVD

SEQ ID NO: 1076041 - protein, 9 aa, Homo Sapiens
DLLTPPASD

SEQ ID NO: 1076042 - protein, 9 aa, Homo Sapiens
LIRRNLDCF

SEQ ID NO: 1076043 - protein, 9 aa, Homo Sapiens
TEEGQSLDS

SEQ ID NO: 1076044 - protein, 9 aa, Homo Sapiens
LPTAPPNVI

SEQ ID NO: 1076045 - protein, 9 aa, Homo Sapiens
QEIANICSH

SEQ ID NO: 1076046 - protein, 9 aa, Homo Sapiens
VYCTRKKYH

SEQ ID NO: 1076047 - protein, 9 aa, Homo Sapiens
SVAPSSPKR

SEQ ID NO: 1076048 - protein, 9 aa, Homo Sapiens
WFSTVTVLK

SEQ ID NO: 1076049 - protein, 9 aa, Homo Sapiens
WAQGTAEAA

SEQ ID NO: 1076050 - protein, 9 aa, Homo Sapiens
FVPDIRRCQ

SEQ ID NO: 1076051 - protein, 9 aa, Homo Sapiens
KEPEPNFQV

SEQ ID NO: 1076052 - protein, 9 aa, Homo Sapiens
IQKCRRLKN

SEQ ID NO: 1076053 - protein, 9 aa, Homo Sapiens
CRTPAWEQQ

SEQ ID NO: 1076054 - protein, 9 aa, Homo Sapiens
GLGHSQYSQ

SEQ ID NO: 1076055 - protein, 9 aa, Homo Sapiens
NLSQYRGVN

SEQ ID NO: 1076056 - protein, 9 aa, Homo Sapiens
VGKEIRVAL

SEQ ID NO: 1076057 - protein, 9 aa, Homo Sapiens
KPYRSEEII

SEQ ID NO: 1076058 - protein, 9 aa, Homo Sapiens
LCKSPPQES

SEQ ID NO: 1076059 - protein, 9 aa, Homo Sapiens
ACLTPCPAI

SEQ ID NO: 1076060 - protein, 9 aa, Homo Sapiens
DRCALFQVN

SEQ ID NO: 1076061 - protein, 9 aa, Homo Sapiens
VEMERRASV

SEQ ID NO: 1076062 - protein, 9 aa, Homo Sapiens
EKLAITYGA

SEQ ID NO: 1076063 - protein, 9 aa, Homo Sapiens
GIFGDVNNI

SEQ ID NO: 1076064 - protein, 9 aa, Homo Sapiens
STCNGLRRF

SEQ ID NO: 1076065 - protein, 9 aa, Homo Sapiens
LGREKIFRP

SEQ ID NO: 1076066 - protein, 9 aa, Homo Sapiens
EGLLGSAQG

SEQ ID NO: 1076067 - protein, 9 aa, Homo Sapiens
SPKDNEKAF

SEQ ID NO: 1076068 - protein, 9 aa, Homo Sapiens
TSLELSSWS

SEQ ID NO: 1076069 - protein, 9 aa, Homo Sapiens
LICAYEFAV

SEQ ID NO: 1076070 - protein, 9 aa, Homo Sapiens
CPRRRVFTP

SEQ ID NO: 1076071 - protein, 9 aa, Homo Sapiens
KFVFCPPDP

SEQ ID NO: 1076072 - protein, 9 aa, Homo Sapiens
NIRYLIKFS

SEQ ID NO: 1076073 - protein, 9 aa, Homo Sapiens
KQCVTVHTE

SEQ ID NO: 1076074 - protein, 9 aa, Homo Sapiens
VSVKNILTT

SEQ ID NO: 1076075 - protein, 9 aa, Homo Sapiens
AVGDWGLFA

SEQ ID NO: 1076076 - protein, 9 aa, Homo Sapiens
DKQSSAGEV

SEQ ID NO: 1076077 - protein, 9 aa, Homo Sapiens
LGEVLEAVW

SEQ ID NO: 1076078 - protein, 9 aa, Homo Sapiens
LAGPCAPAT

SEQ ID NO: 1076079 - protein, 9 aa, Homo Sapiens
SLPFLFNIG

SEQ ID NO: 1076080 - protein, 9 aa, Homo Sapiens
QVKKGSYPW

SEQ ID NO: 1076081 - protein, 9 aa, Homo Sapiens
HQLRSTVKE

SEQ ID NO: 1076082 - protein, 9 aa, Homo Sapiens
GREAEQGGT

SEQ ID NO: 1076083 - protein, 9 aa, Homo Sapiens
MCFHVRFIN

SEQ ID NO: 1076084 - protein, 9 aa, Homo Sapiens
DLSEISVSH

SEQ ID NO: 1076085 - protein, 9 aa, Homo Sapiens
KQSSAGEVK

SEQ ID NO: 1076086 - protein, 9 aa, Homo Sapiens
SDVKKLFLD

SEQ ID NO: 1076087 - protein, 9 aa, Homo Sapiens
PSVYLELTD

SEQ ID NO: 1076088 - protein, 9 aa, Homo Sapiens
GLQGDPGFE

SEQ ID NO: 1076089 - protein, 9 aa, Homo Sapiens
AYAMMLSLF

SEQ ID NO: 1076090 - protein, 9 aa, Homo Sapiens
LNGKLGDSW

SEQ ID NO: 1076091 - protein, 9 aa, Homo Sapiens
GQLLRKKRL

SEQ ID NO: 1076092 - protein, 9 aa, Homo Sapiens
CLLSLEDLL

SEQ ID NO: 1076093 - protein, 9 aa, Homo Sapiens
VTALRWNYV

SEQ ID NO: 1076094 - protein, 9 aa, Homo Sapiens
EAGGGTVPE

SEQ ID NO: 1076095 - protein, 9 aa, Homo Sapiens
VCPPEPTLW

SEQ ID NO: 1076096 - protein, 9 aa, Homo Sapiens
TEENLAPWH

SEQ ID NO: 1076097 - protein, 9 aa, Homo Sapiens
CLCGLLILA

SEQ ID NO: 1076098 - protein, 9 aa, Homo Sapiens
QEHHTLRVQ

SEQ ID NO: 1076099 - protein, 9 aa, Homo Sapiens
IEIDTIRYI

SEQ ID NO: 1076100 - protein, 9 aa, Homo Sapiens
KLDMLQAEA

SEQ ID NO: 1076101 - protein, 9 aa, Homo Sapiens
LAEIGIVTR

SEQ ID NO: 1076102 - protein, 9 aa, Homo Sapiens
PEKLLFNID

SEQ ID NO: 1076103 - protein, 9 aa, Homo Sapiens
LETNLDIKP

SEQ ID NO: 1076104 - protein, 9 aa, Homo Sapiens
PAAVFFVTN

SEQ ID NO: 1076105 - protein, 9 aa, Homo Sapiens
TISDEEKIP

SEQ ID NO: 1076106 - protein, 9 aa, Homo Sapiens
NECQEIANI

SEQ ID NO: 1076107 - protein, 9 aa, Homo Sapiens
PQKDNRNTG

SEQ ID NO: 1076108 - protein, 9 aa, Homo Sapiens
ADCLNRVII

SEQ ID NO: 1076109 - protein, 9 aa, Homo Sapiens
VSLPWVKSS

SEQ ID NO: 1076110 - protein, 9 aa, Homo Sapiens
VPTHSGARL

SEQ ID NO: 1076111 - protein, 9 aa, Homo Sapiens
EHLDWVMLV

SEQ ID NO: 1076112 - protein, 9 aa, Homo Sapiens
TWSKAGGHL

SEQ ID NO: 1076113 - protein, 9 aa, Homo Sapiens
TKCANPVHG

SEQ ID NO: 1076114 - protein, 9 aa, Homo Sapiens
VLKLLMTLV

SEQ ID NO: 1076115 - protein, 9 aa, Homo Sapiens
NSTNALYVL

SEQ ID NO: 1076116 - protein, 9 aa, Homo Sapiens
VFAAGSPLL

SEQ ID NO: 1076117 - protein, 9 aa, Homo Sapiens
VPDPSAQRL

SEQ ID NO: 1076118 - protein, 9 aa, Homo Sapiens
EENLRRAPQ

SEQ ID NO: 1076119 - protein, 9 aa, Homo Sapiens
EAVWYLHNC

SEQ ID NO: 1076120 - protein, 9 aa, Homo Sapiens
AIMCDLCKS

SEQ ID NO: 1076121 - protein, 9 aa, Homo Sapiens
TVFRICVFN

SEQ ID NO: 1076122 - protein, 9 aa, Homo Sapiens
LSTIISLLF

SEQ ID NO: 1076123 - protein, 9 aa, Homo Sapiens
RPCKKSVNK

SEQ ID NO: 1076124 - protein, 9 aa, Homo Sapiens
VFLFAAENE

SEQ ID NO: 1076125 - protein, 9 aa, Homo Sapiens
TIYAPPQEL

SEQ ID NO: 1076126 - protein, 9 aa, Homo Sapiens
EECRKAFNR

SEQ ID NO: 1076127 - protein, 9 aa, Homo Sapiens
LLENPIQKK

SEQ ID NO: 1076128 - protein, 9 aa, Homo Sapiens
PYVNGSMGG

SEQ ID NO: 1076129 - protein, 9 aa, Homo Sapiens
PNTSDPQKD

SEQ ID NO: 1076130 - protein, 9 aa, Homo Sapiens
SNLSPIKDA

SEQ ID NO: 1076131 - protein, 9 aa, Homo Sapiens
FVKIVGHYS

SEQ ID NO: 1076132 - protein, 9 aa, Homo Sapiens
VDNRAVKSI

SEQ ID NO: 1076133 - protein, 9 aa, Homo Sapiens
GKNGYISSN

SEQ ID NO: 1076134 - protein, 9 aa, Homo Sapiens
MSNYSLPSP

SEQ ID NO: 1076135 - protein, 9 aa, Homo Sapiens
PHLDVYIEN

SEQ ID NO: 1076136 - protein, 9 aa, Homo Sapiens
VVNKTLKAW

SEQ ID NO: 1076137 - protein, 9 aa, Homo Sapiens
LRWNYVSTL

SEQ ID NO: 1076138 - protein, 9 aa, Homo Sapiens
APPQPLGAL

SEQ ID NO: 1076139 - protein, 9 aa, Homo Sapiens
GLLISNSGH

SEQ ID NO: 1076140 - protein, 9 aa, Homo Sapiens
LRTPRKLTP

SEQ ID NO: 1076141 - protein, 9 aa, Homo Sapiens
RGPDGALRS

SEQ ID NO: 1076142 - protein, 9 aa, Homo Sapiens
VFMVFSFII

SEQ ID NO: 1076143 - protein, 9 aa, Homo Sapiens
PQAYNFFLT

SEQ ID NO: 1076144 - protein, 9 aa, Homo Sapiens
MPPPRQALL

SEQ ID NO: 1076145 - protein, 9 aa, Homo Sapiens
FGPREDQGQ

SEQ ID NO: 1076146 - protein, 9 aa, Homo Sapiens
TLFSGRDIS

SEQ ID NO: 1076147 - protein, 9 aa, Homo Sapiens
RKLGQVVEC

SEQ ID NO: 1076148 - protein, 9 aa, Homo Sapiens
SNQFLKVDV

SEQ ID NO: 1076149 - protein, 9 aa, Homo Sapiens
LGALSKPMS

SEQ ID NO: 1076150 - protein, 9 aa, Homo Sapiens
SLWSASRRL

SEQ ID NO: 1076151 - protein, 9 aa, Homo Sapiens
TKKELDSYR

SEQ ID NO: 1076152 - protein, 9 aa, Homo Sapiens
GLLPAELEE

SEQ ID NO: 1076153 - protein, 9 aa, Homo Sapiens
DVRLKPCFL

SEQ ID NO: 1076154 - protein, 9 aa, Homo Sapiens
QAWARPPKL

SEQ ID NO: 1076155 - protein, 9 aa, Homo Sapiens
FIDFQLENG

SEQ ID NO: 1076156 - protein, 9 aa, Homo Sapiens
RRAAREVEA

SEQ ID NO: 1076157 - protein, 9 aa, Homo Sapiens
ALSDLGKVC

SEQ ID NO: 1076158 - protein, 9 aa, Homo Sapiens
GNFAQSSSF

SEQ ID NO: 1076159 - protein, 9 aa, Homo Sapiens
AKKFPKISR

SEQ ID NO: 1076160 - protein, 9 aa, Homo Sapiens
KEQLVQVVH

SEQ ID NO: 1076161 - protein, 9 aa, Homo Sapiens
PSMCRWACT

SEQ ID NO: 1076162 - protein, 9 aa, Homo Sapiens
EEELEAQIF

SEQ ID NO: 1076163 - protein, 9 aa, Homo Sapiens
FYLVNTATE

SEQ ID NO: 1076164 - protein, 9 aa, Homo Sapiens
NGPTSGLIS

SEQ ID NO: 1076165 - protein, 9 aa, Homo Sapiens
LGNKYFRQP

SEQ ID NO: 1076166 - protein, 9 aa, Homo Sapiens
VSVNIERVK

SEQ ID NO: 1076167 - protein, 9 aa, Homo Sapiens
TPDTFFYNG

SEQ ID NO: 1076168 - protein, 9 aa, Homo Sapiens
KSSATYEKS

SEQ ID NO: 1076169 - protein, 9 aa, Homo Sapiens
TIQKGLESG

SEQ ID NO: 1076170 - protein, 9 aa, Homo Sapiens
LTHSSARPH

SEQ ID NO: 1076171 - protein, 9 aa, Homo Sapiens
PAHKTSSLD

SEQ ID NO: 1076172 - protein, 9 aa, Homo Sapiens
FTSNLVHPT

SEQ ID NO: 1076173 - protein, 9 aa, Homo Sapiens
WAITIAGRI

SEQ ID NO: 1076174 - protein, 9 aa, Homo Sapiens
PEPNFQVLD

SEQ ID NO: 1076175 - protein, 9 aa, Homo Sapiens
CSAAGLHKP

SEQ ID NO: 1076176 - protein, 9 aa, Homo Sapiens
AHVNRVTVH

SEQ ID NO: 1076177 - protein, 9 aa, Homo Sapiens
KKNAGEDPG

SEQ ID NO: 1076178 - protein, 9 aa, Homo Sapiens
PGSLKRRRC

SEQ ID NO: 1076179 - protein, 9 aa, Homo Sapiens
RASPSHISS

SEQ ID NO: 1076180 - protein, 9 aa, Homo Sapiens
CKNRLLSGG

SEQ ID NO: 1076181 - protein, 9 aa, Homo Sapiens
YQLVAKLAK

SEQ ID NO: 1076182 - protein, 9 aa, Homo Sapiens
RQIYTGLKS

SEQ ID NO: 1076183 - protein, 9 aa, Homo Sapiens
IASIACSPV

SEQ ID NO: 1076184 - protein, 9 aa, Homo Sapiens
SSQAQQPSE

SEQ ID NO: 1076185 - protein, 9 aa, Homo Sapiens
NSSTHHPEV

SEQ ID NO: 1076186 - protein, 9 aa, Homo Sapiens
LDCFMEIKS

SEQ ID NO: 1076187 - protein, 9 aa, Homo Sapiens
DPIRCEKPY

SEQ ID NO: 1076188 - protein, 9 aa, Homo Sapiens
KSIYDVWVC

SEQ ID NO: 1076189 - protein, 9 aa, Homo Sapiens
TAQPSPSAR

SEQ ID NO: 1076190 - protein, 9 aa, Homo Sapiens
NFLQSYQLS

SEQ ID NO: 1076191 - protein, 9 aa, Homo Sapiens
FEIEVLCKS

SEQ ID NO: 1076192 - protein, 9 aa, Homo Sapiens
TIDEVFEVL

SEQ ID NO: 1076193 - protein, 9 aa, Homo Sapiens
VVLGWNLPG

SEQ ID NO: 1076194 - protein, 9 aa, Homo Sapiens
LQNMENTCY

SEQ ID NO: 1076195 - protein, 9 aa, Homo Sapiens
LLDKISSVL

SEQ ID NO: 1076196 - protein, 9 aa, Homo Sapiens
VLVCALSNI

SEQ ID NO: 1076197 - protein, 9 aa, Homo Sapiens
GVVDCAGID

SEQ ID NO: 1076198 - protein, 9 aa, Homo Sapiens
SGSGCKSLL

SEQ ID NO: 1076199 - protein, 9 aa, Homo Sapiens
QDGTAQSNR

SEQ ID NO: 1076200 - protein, 9 aa, Homo Sapiens
LAANYGFPD

SEQ ID NO: 1076201 - protein, 9 aa, Homo Sapiens
SATAKAGTE

SEQ ID NO: 1076202 - protein, 9 aa, Homo Sapiens
SLVSGPAFL

SEQ ID NO: 1076203 - protein, 9 aa, Homo Sapiens
PPPQTPSLH

SEQ ID NO: 1076204 - protein, 9 aa, Homo Sapiens
PVVPTHSGA

SEQ ID NO: 1076205 - protein, 9 aa, Homo Sapiens
CLPGAWRGL

SEQ ID NO: 1076206 - protein, 9 aa, Homo Sapiens
EEVKFSGTN

SEQ ID NO: 1076207 - protein, 9 aa, Homo Sapiens
SPAGPALSL

SEQ ID NO: 1076208 - protein, 9 aa, Homo Sapiens
GTFELEHFP

SEQ ID NO: 1076209 - protein, 9 aa, Homo Sapiens
IGGLVILVI

SEQ ID NO: 1076210 - protein, 9 aa, Homo Sapiens
GKPSCKRLH

SEQ ID NO: 1076211 - protein, 9 aa, Homo Sapiens
ADKIKVLFD

SEQ ID NO: 1076212 - protein, 9 aa, Homo Sapiens
EELCPKGSC

SEQ ID NO: 1076213 - protein, 9 aa, Homo Sapiens
NNKKKMKDC

SEQ ID NO: 1076214 - protein, 9 aa, Homo Sapiens
ESTLSCFAV

SEQ ID NO: 1076215 - protein, 9 aa, Homo Sapiens
SVVSLTVPS

SEQ ID NO: 1076216 - protein, 9 aa, Homo Sapiens
NLPGEYNQH

SEQ ID NO: 1076217 - protein, 9 aa, Homo Sapiens
SGKTSKFEP

SEQ ID NO: 1076218 - protein, 9 aa, Homo Sapiens
TNIYGQKVW

SEQ ID NO: 1076219 - protein, 9 aa, Homo Sapiens
WVCHPRDLA

SEQ ID NO: 1076220 - protein, 9 aa, Homo Sapiens
LCAARLQYL

SEQ ID NO: 1076221 - protein, 9 aa, Homo Sapiens
FALVFYHRS

SEQ ID NO: 1076222 - protein, 9 aa, Homo Sapiens
MLYGLQPPG

SEQ ID NO: 1076223 - protein, 9 aa, Homo Sapiens
LLSNSCILF

SEQ ID NO: 1076224 - protein, 9 aa, Homo Sapiens
AKLDAYAKK

SEQ ID NO: 1076225 - protein, 9 aa, Homo Sapiens
RIKENSPSN

SEQ ID NO: 1076226 - protein, 9 aa, Homo Sapiens
LQLFKLSHN

SEQ ID NO: 1076227 - protein, 9 aa, Homo Sapiens
ESKHFQYLV

SEQ ID NO: 1076228 - protein, 9 aa, Homo Sapiens
FWVTILSAK

SEQ ID NO: 1076229 - protein, 9 aa, Homo Sapiens
ASPIPGAPS

SEQ ID NO: 1076230 - protein, 9 aa, Homo Sapiens
GEVISTHQL

SEQ ID NO: 1076231 - protein, 9 aa, Homo Sapiens
LEENPPHLF

SEQ ID NO: 1076232 - protein, 9 aa, Homo Sapiens
LYTPGFPSF

SEQ ID NO: 1076233 - protein, 9 aa, Homo Sapiens
TVVLSTNYA

SEQ ID NO: 1076234 - protein, 9 aa, Homo Sapiens
NLEDPQQNQ

SEQ ID NO: 1076235 - protein, 9 aa, Homo Sapiens
PRFLQELVS

SEQ ID NO: 1076236 - protein, 9 aa, Homo Sapiens
RVRPEALQT

SEQ ID NO: 1076237 - protein, 9 aa, Homo Sapiens
WCSATAQRV

SEQ ID NO: 1076238 - protein, 9 aa, Homo Sapiens
RWRKKILFY

SEQ ID NO: 1076239 - protein, 9 aa, Homo Sapiens
PGERLTSCM

SEQ ID NO: 1076240 - protein, 9 aa, Homo Sapiens
YSLSALMKQ

SEQ ID NO: 1076241 - protein, 9 aa, Homo Sapiens
PRPPSPPPP

SEQ ID NO: 1076242 - protein, 9 aa, Homo Sapiens
MKILEDQTS

SEQ ID NO: 1076243 - protein, 9 aa, Homo Sapiens
MGPFSAVPG

SEQ ID NO: 1076244 - protein, 9 aa, Homo Sapiens
KAWEHCKPL

SEQ ID NO: 1076245 - protein, 9 aa, Homo Sapiens
RPLLMLAQN

SEQ ID NO: 1076246 - protein, 9 aa, Homo Sapiens
KGILEEYKK

SEQ ID NO: 1076247 - protein, 9 aa, Homo Sapiens
PSLAHPQLP

SEQ ID NO: 1076248 - protein, 9 aa, Homo Sapiens
TNAFSGEYI

SEQ ID NO: 1076249 - protein, 9 aa, Homo Sapiens
QFWGQPCTA

SEQ ID NO: 1076250 - protein, 9 aa, Homo Sapiens
RYKQEFSES

SEQ ID NO: 1076251 - protein, 9 aa, Homo Sapiens
AKLLSAEIF

SEQ ID NO: 1076252 - protein, 9 aa, Homo Sapiens
SSSDEIDLP

SEQ ID NO: 1076253 - protein, 9 aa, Homo Sapiens
QGSIIFLTM

SEQ ID NO: 1076254 - protein, 9 aa, Homo Sapiens
GAAGGKGEK

SEQ ID NO: 1076255 - protein, 9 aa, Homo Sapiens
RLSRKIREE

SEQ ID NO: 1076256 - protein, 9 aa, Homo Sapiens
AGYLPFFAD

SEQ ID NO: 1076257 - protein, 9 aa, Homo Sapiens
NNYWNVGQF

SEQ ID NO: 1076258 - protein, 9 aa, Homo Sapiens
VKKYILAFW

SEQ ID NO: 1076259 - protein, 9 aa, Homo Sapiens
QMNHTFFPG

SEQ ID NO: 1076260 - protein, 9 aa, Homo Sapiens
FLFNIGLLL

SEQ ID NO: 1076261 - protein, 9 aa, Homo Sapiens
SPAIISLTP

SEQ ID NO: 1076262 - protein, 9 aa, Homo Sapiens
FSILSDGVY

SEQ ID NO: 1076263 - protein, 9 aa, Homo Sapiens
VNTHQEQIK

SEQ ID NO: 1076264 - protein, 9 aa, Homo Sapiens
MPSSTERHK

SEQ ID NO: 1076265 - protein, 9 aa, Homo Sapiens
MKISELNAK

SEQ ID NO: 1076266 - protein, 9 aa, Homo Sapiens
SRINLSLLV

SEQ ID NO: 1076267 - protein, 9 aa, Homo Sapiens
EIIFNNGPT

SEQ ID NO: 1076268 - protein, 9 aa, Homo Sapiens
ITVTAVSAL

SEQ ID NO: 1076269 - protein, 9 aa, Homo Sapiens
VKIIESKHF

SEQ ID NO: 1076270 - protein, 9 aa, Homo Sapiens
SLCDHERTH

SEQ ID NO: 1076271 - protein, 9 aa, Homo Sapiens
VNGPITYSS

SEQ ID NO: 1076272 - protein, 9 aa, Homo Sapiens
ESSFVSFRP

SEQ ID NO: 1076273 - protein, 9 aa, Homo Sapiens
PSARDGVYV

SEQ ID NO: 1076274 - protein, 9 aa, Homo Sapiens
GLRGVSKFQ

SEQ ID NO: 1076275 - protein, 9 aa, Homo Sapiens
SKPPYFFSL

SEQ ID NO: 1076276 - protein, 9 aa, Homo Sapiens
VVKIPDAKS

SEQ ID NO: 1076277 - protein, 9 aa, Homo Sapiens
NPHKIPNNT

SEQ ID NO: 1076278 - protein, 9 aa, Homo Sapiens
TFTSHSSVR

SEQ ID NO: 1076279 - protein, 9 aa, Homo Sapiens
TEMDIQKCR

SEQ ID NO: 1076280 - protein, 9 aa, Homo Sapiens
DFAPRADRA

SEQ ID NO: 1076281 - protein, 9 aa, Homo Sapiens
RMGPFSAVP

SEQ ID NO: 1076282 - protein, 9 aa, Homo Sapiens
DFTKNVLRL

SEQ ID NO: 1076283 - protein, 9 aa, Homo Sapiens
SVFVRTTKE

SEQ ID NO: 1076284 - protein, 9 aa, Homo Sapiens
ACGGNHQNF

SEQ ID NO: 1076285 - protein, 9 aa, Homo Sapiens
LEEARLNKE

SEQ ID NO: 1076286 - protein, 9 aa, Homo Sapiens
QLPEQKLFI

SEQ ID NO: 1076287 - protein, 9 aa, Homo Sapiens
TRTCTSSGR

SEQ ID NO: 1076288 - protein, 9 aa, Homo Sapiens
NQKGGSECP

SEQ ID NO: 1076289 - protein, 9 aa, Homo Sapiens
FKNVHLQYP

SEQ ID NO: 1076290 - protein, 9 aa, Homo Sapiens
YTVPEHLDN

SEQ ID NO: 1076291 - protein, 9 aa, Homo Sapiens
GTGAFSGTR

SEQ ID NO: 1076292 - protein, 9 aa, Homo Sapiens
CGGSKEGCG

SEQ ID NO: 1076293 - protein, 9 aa, Homo Sapiens
WGEIQNVAA

SEQ ID NO: 1076294 - protein, 9 aa, Homo Sapiens
CLGLPHPRS

SEQ ID NO: 1076295 - protein, 9 aa, Homo Sapiens
MSNMEKKIQ

SEQ ID NO: 1076296 - protein, 9 aa, Homo Sapiens
PPPGLKQFS

SEQ ID NO: 1076297 - protein, 9 aa, Homo Sapiens
TAKKEKLNS

SEQ ID NO: 1076298 - protein, 9 aa, Homo Sapiens
RLFKGKKAH

SEQ ID NO: 1076299 - protein, 9 aa, Homo Sapiens
NKVIIPSLP

SEQ ID NO: 1076300 - protein, 9 aa, Homo Sapiens
HTVLIIAHW

SEQ ID NO: 1076301 - protein, 9 aa, Homo Sapiens
EMEALSKLD

SEQ ID NO: 1076302 - protein, 9 aa, Homo Sapiens
TTIRLINSQ

SEQ ID NO: 1076303 - protein, 9 aa, Homo Sapiens
PGFYLDPPQ

SEQ ID NO: 1076304 - protein, 9 aa, Homo Sapiens
KSAVLLFSI

SEQ ID NO: 1076305 - protein, 9 aa, Homo Sapiens
STNSSLKVS

SEQ ID NO: 1076306 - protein, 9 aa, Homo Sapiens
WGEASSLSS

SEQ ID NO: 1076307 - protein, 9 aa, Homo Sapiens
AVQKEQPLS

SEQ ID NO: 1076308 - protein, 9 aa, Homo Sapiens
LLDSEVIQY

SEQ ID NO: 1076309 - protein, 9 aa, Homo Sapiens
MGDAPPPQN

SEQ ID NO: 1076310 - protein, 9 aa, Homo Sapiens
GSPSNSFIL

SEQ ID NO: 1076311 - protein, 9 aa, Homo Sapiens
ETKKELDSY

SEQ ID NO: 1076312 - protein, 9 aa, Homo Sapiens
DIEERVLID

SEQ ID NO: 1076313 - protein, 9 aa, Homo Sapiens
RGGKQFFLQ

SEQ ID NO: 1076314 - protein, 9 aa, Homo Sapiens
RRNFLREAS

SEQ ID NO: 1076315 - protein, 9 aa, Homo Sapiens
LILSFIQDK

SEQ ID NO: 1076316 - protein, 9 aa, Homo Sapiens
YTRTRFTCL

SEQ ID NO: 1076317 - protein, 9 aa, Homo Sapiens
PLARLHGFS

SEQ ID NO: 1076318 - protein, 9 aa, Homo Sapiens
SDSAPHPEG

SEQ ID NO: 1076319 - protein, 9 aa, Homo Sapiens
KESQREKKK

SEQ ID NO: 1076320 - protein, 9 aa, Homo Sapiens
LCFLAYDIQ

SEQ ID NO: 1076321 - protein, 9 aa, Homo Sapiens
FKNIRKKTD

SEQ ID NO: 1076322 - protein, 9 aa, Homo Sapiens
FCLTSDLVF

SEQ ID NO: 1076323 - protein, 9 aa, Homo Sapiens
LPPSYQKFL

SEQ ID NO: 1076324 - protein, 9 aa, Homo Sapiens
LQEKKASIK

SEQ ID NO: 1076325 - protein, 9 aa, Homo Sapiens
RHSTQGDQE

SEQ ID NO: 1076326 - protein, 9 aa, Homo Sapiens
TSLHSLMYF

SEQ ID NO: 1076327 - protein, 9 aa, Homo Sapiens
DLIDIKVGS

SEQ ID NO: 1076328 - protein, 9 aa, Homo Sapiens
IGIVTRNED

SEQ ID NO: 1076329 - protein, 9 aa, Homo Sapiens
QFTDLNDSK

SEQ ID NO: 1076330 - protein, 9 aa, Homo Sapiens
FILLLRLMA

SEQ ID NO: 1076331 - protein, 9 aa, Homo Sapiens
QEGGGRYHR

SEQ ID NO: 1076332 - protein, 9 aa, Homo Sapiens
SKSYFCEWL

SEQ ID NO: 1076333 - protein, 9 aa, Homo Sapiens
YKTLTSDVT

SEQ ID NO: 1076334 - protein, 9 aa, Homo Sapiens
TPWTAHLEM

SEQ ID NO: 1076335 - protein, 9 aa, Homo Sapiens
LSATFRGVA

SEQ ID NO: 1076336 - protein, 9 aa, Homo Sapiens
LSVKHRKFE

SEQ ID NO: 1076337 - protein, 9 aa, Homo Sapiens
LYVGGMKKI

SEQ ID NO: 1076338 - protein, 9 aa, Homo Sapiens
MSKFLGEAS

SEQ ID NO: 1076339 - protein, 9 aa, Homo Sapiens
IGSVSQSKN

SEQ ID NO: 1076340 - protein, 9 aa, Homo Sapiens
RDREIIFNN

SEQ ID NO: 1076341 - protein, 9 aa, Homo Sapiens
FSDTIVSDG

SEQ ID NO: 1076342 - protein, 9 aa, Homo Sapiens
DIKRWKTRL

SEQ ID NO: 1076343 - protein, 9 aa, Homo Sapiens
DFCRMPPSC

SEQ ID NO: 1076344 - protein, 9 aa, Homo Sapiens
IPGSPSNSF

SEQ ID NO: 1076345 - protein, 9 aa, Homo Sapiens
GEGPATLMS

SEQ ID NO: 1076346 - protein, 9 aa, Homo Sapiens
LTSLELSSW

SEQ ID NO: 1076347 - protein, 9 aa, Homo Sapiens
GEKYKAFSI

SEQ ID NO: 1076348 - protein, 9 aa, Homo Sapiens
EGVRQKKSS

SEQ ID NO: 1076349 - protein, 9 aa, Homo Sapiens
YYRGQNNLT

SEQ ID NO: 1076350 - protein, 9 aa, Homo Sapiens
ETINLNSAC

SEQ ID NO: 1076351 - protein, 9 aa, Homo Sapiens
KKENIRLVW

SEQ ID NO: 1076352 - protein, 9 aa, Homo Sapiens
EVEKPLSQE

SEQ ID NO: 1076353 - protein, 9 aa, Homo Sapiens
YTPVDDRIS

SEQ ID NO: 1076354 - protein, 9 aa, Homo Sapiens
FLTDSESLI

SEQ ID NO: 1076355 - protein, 9 aa, Homo Sapiens
TNPQEETLD

SEQ ID NO: 1076356 - protein, 9 aa, Homo Sapiens
EDQTSRGLK

SEQ ID NO: 1076357 - protein, 9 aa, Homo Sapiens
GCSSRKFSS

SEQ ID NO: 1076358 - protein, 9 aa, Homo Sapiens
TGDRHSTQG

SEQ ID NO: 1076359 - protein, 9 aa, Homo Sapiens
LLLPPQDPH

SEQ ID NO: 1076360 - protein, 9 aa, Homo Sapiens
LAEGTHPGI

SEQ ID NO: 1076361 - protein, 9 aa, Homo Sapiens
EGPPAPLIF

SEQ ID NO: 1076362 - protein, 9 aa, Homo Sapiens
VEVAKVVYR

SEQ ID NO: 1076363 - protein, 9 aa, Homo Sapiens
HSPPPGTPM

SEQ ID NO: 1076364 - protein, 9 aa, Homo Sapiens
QKVAMKKLS

SEQ ID NO: 1076365 - protein, 9 aa, Homo Sapiens
GGTVPERNK

SEQ ID NO: 1076366 - protein, 9 aa, Homo Sapiens
HRALSSLRD

SEQ ID NO: 1076367 - protein, 9 aa, Homo Sapiens
RVCRWPPPH

SEQ ID NO: 1076368 - protein, 9 aa, Homo Sapiens
SQTYECLHK

SEQ ID NO: 1076369 - protein, 9 aa, Homo Sapiens
PNLTQRLEA

SEQ ID NO: 1076370 - protein, 9 aa, Homo Sapiens
FGVRLWEIV

SEQ ID NO: 1076371 - protein, 9 aa, Homo Sapiens
GCLLSLEDL

SEQ ID NO: 1076372 - protein, 9 aa, Homo Sapiens
LGAIGSGTE

SEQ ID NO: 1076373 - protein, 9 aa, Homo Sapiens
RTIHLRRVG

SEQ ID NO: 1076374 - protein, 9 aa, Homo Sapiens
VVKEVLARD

SEQ ID NO: 1076375 - protein, 9 aa, Homo Sapiens
SPGSLKRRR

SEQ ID NO: 1076376 - protein, 9 aa, Homo Sapiens
AQKKNAGED

SEQ ID NO: 1076377 - protein, 9 aa, Homo Sapiens
SYAFSFLLQ

SEQ ID NO: 1076378 - protein, 9 aa, Homo Sapiens
LPVLVFVQS

SEQ ID NO: 1076379 - protein, 9 aa, Homo Sapiens
STFIDGKLY

SEQ ID NO: 1076380 - protein, 9 aa, Homo Sapiens
AKVVYRCWE

SEQ ID NO: 1076381 - protein, 9 aa, Homo Sapiens
PSCSDSCDF

SEQ ID NO: 1076382 - protein, 9 aa, Homo Sapiens
HNSSTHHPE

SEQ ID NO: 1076383 - protein, 9 aa, Homo Sapiens
LFIKMLKRN

SEQ ID NO: 1076384 - protein, 9 aa, Homo Sapiens
VSYSLVFKE

SEQ ID NO: 1076385 - protein, 9 aa, Homo Sapiens
DSFRQFLLG

SEQ ID NO: 1076386 - protein, 9 aa, Homo Sapiens
YFFKAVHTG

SEQ ID NO: 1076387 - protein, 9 aa, Homo Sapiens
GAGNVHQPT

SEQ ID NO: 1076388 - protein, 9 aa, Homo Sapiens
LALNFLYSP

SEQ ID NO: 1076389 - protein, 9 aa, Homo Sapiens
LVLLLNGRP

SEQ ID NO: 1076390 - protein, 9 aa, Homo Sapiens
PPPRQALLP

SEQ ID NO: 1076391 - protein, 9 aa, Homo Sapiens
KEDRLETVE

SEQ ID NO: 1076392 - protein, 9 aa, Homo Sapiens
GPSNTTGES

SEQ ID NO: 1076393 - protein, 9 aa, Homo Sapiens
PVRGSTFTS

SEQ ID NO: 1076394 - protein, 9 aa, Homo Sapiens
DGDNDCRNW

SEQ ID NO: 1076395 - protein, 9 aa, Homo Sapiens
SLFTRFVCV

SEQ ID NO: 1076396 - protein, 9 aa, Homo Sapiens
DSFSSCSDH

SEQ ID NO: 1076397 - protein, 9 aa, Homo Sapiens
APLSRKSYI

SEQ ID NO: 1076398 - protein, 9 aa, Homo Sapiens
TVYFSSSAP

SEQ ID NO: 1076399 - protein, 9 aa, Homo Sapiens
HYPLCPEAP

SEQ ID NO: 1076400 - protein, 9 aa, Homo Sapiens
TQSCLVSSA

SEQ ID NO: 1076401 - protein, 9 aa, Homo Sapiens
PPDQLPLSL

SEQ ID NO: 1076402 - protein, 9 aa, Homo Sapiens
RKSLVLDSG

SEQ ID NO: 1076403 - protein, 9 aa, Homo Sapiens
IFTQISTLA

SEQ ID NO: 1076404 - protein, 9 aa, Homo Sapiens
IPHVVLGWN

SEQ ID NO: 1076405 - protein, 9 aa, Homo Sapiens
NGKLGDSWI

SEQ ID NO: 1076406 - protein, 9 aa, Homo Sapiens
ERNCYEYVD

SEQ ID NO: 1076407 - protein, 9 aa, Homo Sapiens
VLRNLFNTS

SEQ ID NO: 1076408 - protein, 9 aa, Homo Sapiens
CTPIFSTGS

SEQ ID NO: 1076409 - protein, 9 aa, Homo Sapiens
EAEEVCNLL

SEQ ID NO: 1076410 - protein, 9 aa, Homo Sapiens
SLTLVLPVD

SEQ ID NO: 1076411 - protein, 9 aa, Homo Sapiens
IEEGVRQKK

SEQ ID NO: 1076412 - protein, 9 aa, Homo Sapiens
YQTPTKPSS

SEQ ID NO: 1076413 - protein, 9 aa, Homo Sapiens
TDAQPQIVV

SEQ ID NO: 1076414 - protein, 9 aa, Homo Sapiens
DRPWAQGTA

SEQ ID NO: 1076415 - protein, 9 aa, Homo Sapiens
VKGPVQKYP

SEQ ID NO: 1076416 - protein, 9 aa, Homo Sapiens
VTVLKLLMT

SEQ ID NO: 1076417 - protein, 9 aa, Homo Sapiens
EGVIQHITN

SEQ ID NO: 1076418 - protein, 9 aa, Homo Sapiens
LHKFSSPSH

SEQ ID NO: 1076419 - protein, 9 aa, Homo Sapiens
DKVLYKCRK

SEQ ID NO: 1076420 - protein, 9 aa, Homo Sapiens
FFFLKDLKG

SEQ ID NO: 1076421 - protein, 9 aa, Homo Sapiens
SLERRKKGS

SEQ ID NO: 1076422 - protein, 9 aa, Homo Sapiens
PAILDALPK

SEQ ID NO: 1076423 - protein, 9 aa, Homo Sapiens
QRRLQLVWG

SEQ ID NO: 1076424 - protein, 9 aa, Homo Sapiens
GGVTNMQSI

SEQ ID NO: 1076425 - protein, 9 aa, Homo Sapiens
PRIVGRTAS

SEQ ID NO: 1076426 - protein, 9 aa, Homo Sapiens
QIFFLQGQL

SEQ ID NO: 1076427 - protein, 9 aa, Homo Sapiens
CGLLILSFI

SEQ ID NO: 1076428 - protein, 9 aa, Homo Sapiens
GFSRWNNLH

SEQ ID NO: 1076429 - protein, 9 aa, Homo Sapiens
TARKPLLRT

SEQ ID NO: 1076430 - protein, 9 aa, Homo Sapiens
KSFVFPPSL

SEQ ID NO: 1076431 - protein, 9 aa, Homo Sapiens
GQGAPWAKE

SEQ ID NO: 1076432 - protein, 9 aa, Homo Sapiens
ISFPGSSEY

SEQ ID NO: 1076433 - protein, 9 aa, Homo Sapiens
KSINEARYA

SEQ ID NO: 1076434 - protein, 9 aa, Homo Sapiens
YIESFINNL

SEQ ID NO: 1076435 - protein, 9 aa, Homo Sapiens
EEELDRVQE

SEQ ID NO: 1076436 - protein, 9 aa, Homo Sapiens
QQGYMPFEG

SEQ ID NO: 1076437 - protein, 9 aa, Homo Sapiens
YPYSLKKAY

SEQ ID NO: 1076438 - protein, 9 aa, Homo Sapiens
GGAVKKLKR

SEQ ID NO: 1076439 - protein, 9 aa, Homo Sapiens
PSKQPATLL

SEQ ID NO: 1076440 - protein, 9 aa, Homo Sapiens
EQEQEALVK

SEQ ID NO: 1076441 - protein, 9 aa, Homo Sapiens
SNLLRCDCV

SEQ ID NO: 1076442 - protein, 9 aa, Homo Sapiens
QLLPKNVQE

SEQ ID NO: 1076443 - protein, 9 aa, Homo Sapiens
VFGYLTFYE

SEQ ID NO: 1076444 - protein, 9 aa, Homo Sapiens
YAPPRAPAL

SEQ ID NO: 1076445 - protein, 9 aa, Homo Sapiens
TVHTEKKSK

SEQ ID NO: 1076446 - protein, 9 aa, Homo Sapiens
HLSSEITSL

SEQ ID NO: 1076447 - protein, 9 aa, Homo Sapiens
VNLTTSRLH

SEQ ID NO: 1076448 - protein, 9 aa, Homo Sapiens
HRCVNLPGY

SEQ ID NO: 1076449 - protein, 9 aa, Homo Sapiens
MTDRVPSPF

SEQ ID NO: 1076450 - protein, 9 aa, Homo Sapiens
SGTYQCEAQ

SEQ ID NO: 1076451 - protein, 9 aa, Homo Sapiens
YEKCGHEKL

SEQ ID NO: 1076452 - protein, 9 aa, Homo Sapiens
PLPPSYQKF

SEQ ID NO: 1076453 - protein, 9 aa, Homo Sapiens
SVSPRVKRP

SEQ ID NO: 1076454 - protein, 9 aa, Homo Sapiens
GAPWAKELL

SEQ ID NO: 1076455 - protein, 9 aa, Homo Sapiens
VILVIVGLT

SEQ ID NO: 1076456 - protein, 9 aa, Homo Sapiens
FVKIQFFLG

SEQ ID NO: 1076457 - protein, 9 aa, Homo Sapiens
PAVESSLTE

SEQ ID NO: 1076458 - protein, 9 aa, Homo Sapiens
CFQSCDLRR

SEQ ID NO: 1076459 - protein, 9 aa, Homo Sapiens
VGPVSLPWR

SEQ ID NO: 1076460 - protein, 9 aa, Homo Sapiens
QQPPPPPSP

SEQ ID NO: 1076461 - protein, 9 aa, Homo Sapiens
NYNNKSAFY

SEQ ID NO: 1076462 - protein, 9 aa, Homo Sapiens
GGSRGPPSQ

SEQ ID NO: 1076463 - protein, 9 aa, Homo Sapiens
AILDALPKE

SEQ ID NO: 1076464 - protein, 9 aa, Homo Sapiens
TCTDVLRNL

SEQ ID NO: 1076465 - protein, 9 aa, Homo Sapiens
NKKKMKDCQ

SEQ ID NO: 1076466 - protein, 9 aa, Homo Sapiens
TNKFQNLQT

SEQ ID NO: 1076467 - protein, 9 aa, Homo Sapiens
HDPYRQQSL

SEQ ID NO: 1076468 - protein, 9 aa, Homo Sapiens
EVNGHSKFT

SEQ ID NO: 1076469 - protein, 9 aa, Homo Sapiens
KVPSSPIFP

SEQ ID NO: 1076470 - protein, 9 aa, Homo Sapiens
LLLEQCMQD

SEQ ID NO: 1076471 - protein, 9 aa, Homo Sapiens
KKNRLPLFV

SEQ ID NO: 1076472 - protein, 9 aa, Homo Sapiens
LESGRGRQK

SEQ ID NO: 1076473 - protein, 9 aa, Homo Sapiens
LFFGNNSIF

SEQ ID NO: 1076474 - protein, 9 aa, Homo Sapiens
SSLYALHLQ

SEQ ID NO: 1076475 - protein, 9 aa, Homo Sapiens
EQRLVYERE

SEQ ID NO: 1076476 - protein, 9 aa, Homo Sapiens
LEFRKPSQA

SEQ ID NO: 1076477 - protein, 9 aa, Homo Sapiens
GKKEETKSE

SEQ ID NO: 1076478 - protein, 9 aa, Homo Sapiens
FVMVGVHQR

SEQ ID NO: 1076479 - protein, 9 aa, Homo Sapiens
FALEFLIIS

SEQ ID NO: 1076480 - protein, 9 aa, Homo Sapiens
STQLEQVNH

SEQ ID NO: 1076481 - protein, 9 aa, Homo Sapiens
CLYKREKGI

SEQ ID NO: 1076482 - protein, 9 aa, Homo Sapiens
QELSSAEDN

SEQ ID NO: 1076483 - protein, 9 aa, Homo Sapiens
PSPPGLLDT

SEQ ID NO: 1076484 - protein, 9 aa, Homo Sapiens
EAPEGKTRE

SEQ ID NO: 1076485 - protein, 9 aa, Homo Sapiens
KPRIVGRTA

SEQ ID NO: 1076486 - protein, 9 aa, Homo Sapiens
DEYEKSWRR

SEQ ID NO: 1076487 - protein, 9 aa, Homo Sapiens
HCSSAPSWP

SEQ ID NO: 1076488 - protein, 9 aa, Homo Sapiens
WGLSLVKHE

SEQ ID NO: 1076489 - protein, 9 aa, Homo Sapiens
LYACSVCNS

SEQ ID NO: 1076490 - protein, 9 aa, Homo Sapiens
KAGGHLRPG

SEQ ID NO: 1076491 - protein, 9 aa, Homo Sapiens
CVFNYYYLA

SEQ ID NO: 1076492 - protein, 9 aa, Homo Sapiens
LGKEIEAER

SEQ ID NO: 1076493 - protein, 9 aa, Homo Sapiens
QMAVHKLAE

SEQ ID NO: 1076494 - protein, 9 aa, Homo Sapiens
PIWYQCHRP

SEQ ID NO: 1076495 - protein, 9 aa, Homo Sapiens
NRGFIFVAG

SEQ ID NO: 1076496 - protein, 9 aa, Homo Sapiens
PYFFSLLIY

SEQ ID NO: 1076497 - protein, 9 aa, Homo Sapiens
PEKRANLCL

SEQ ID NO: 1076498 - protein, 9 aa, Homo Sapiens
LIKTEFENI

SEQ ID NO: 1076499 - protein, 9 aa, Homo Sapiens
TSWDQLGRQ

SEQ ID NO: 1076500 - protein, 9 aa, Homo Sapiens
FHLVYVNAI

SEQ ID NO: 1076501 - protein, 9 aa, Homo Sapiens
SGLTGNSHS

SEQ ID NO: 1076502 - protein, 9 aa, Homo Sapiens
HHQLRTMKF

SEQ ID NO: 1076503 - protein, 9 aa, Homo Sapiens
WVKSSHSMT

SEQ ID NO: 1076504 - protein, 9 aa, Homo Sapiens
AKSKSCKFC

SEQ ID NO: 1076505 - protein, 9 aa, Homo Sapiens
VLLLNPLWS

SEQ ID NO: 1076506 - protein, 9 aa, Homo Sapiens
LSHPNNLRF

SEQ ID NO: 1076507 - protein, 9 aa, Homo Sapiens
LVVWDNTEG

SEQ ID NO: 1076508 - protein, 9 aa, Homo Sapiens
KFQHCGGPC

SEQ ID NO: 1076509 - protein, 9 aa, Homo Sapiens
KNSEKNSTF

SEQ ID NO: 1076510 - protein, 9 aa, Homo Sapiens
GPEAAKSAV

SEQ ID NO: 1076511 - protein, 9 aa, Homo Sapiens
VARFNKTVQ

SEQ ID NO: 1076512 - protein, 9 aa, Homo Sapiens
CSPELKEGY

SEQ ID NO: 1076513 - protein, 9 aa, Homo Sapiens
FMPDFDLNL

SEQ ID NO: 1076514 - protein, 9 aa, Homo Sapiens
SNMEKKIQH

SEQ ID NO: 1076515 - protein, 9 aa, Homo Sapiens
FSFGFPHSF

SEQ ID NO: 1076516 - protein, 9 aa, Homo Sapiens
SSNPPRYEF

SEQ ID NO: 1076517 - protein, 9 aa, Homo Sapiens
EGAMEMRQI

SEQ ID NO: 1076518 - protein, 9 aa, Homo Sapiens
CKSSKRANI

SEQ ID NO: 1076519 - protein, 9 aa, Homo Sapiens
IKFSSKLSE

SEQ ID NO: 1076520 - protein, 9 aa, Homo Sapiens
SDPLLDEQA

SEQ ID NO: 1076521 - protein, 9 aa, Homo Sapiens
QVFTKRPLN

SEQ ID NO: 1076522 - protein, 9 aa, Homo Sapiens
WLRSPVQYF

SEQ ID NO: 1076523 - protein, 9 aa, Homo Sapiens
GQPQEVLVN

SEQ ID NO: 1076524 - protein, 9 aa, Homo Sapiens
PCLGAARSG

SEQ ID NO: 1076525 - protein, 9 aa, Homo Sapiens
IKERDLDSL

SEQ ID NO: 1076526 - protein, 9 aa, Homo Sapiens
TWVSWSACS

SEQ ID NO: 1076527 - protein, 9 aa, Homo Sapiens
AFLLSRVLL

SEQ ID NO: 1076528 - protein, 9 aa, Homo Sapiens
PPPQNEHTT

SEQ ID NO: 1076529 - protein, 9 aa, Homo Sapiens
QKELIIFNR

SEQ ID NO: 1076530 - protein, 9 aa, Homo Sapiens
PNVYRPQFC

SEQ ID NO: 1076531 - protein, 9 aa, Homo Sapiens
SNLKLEAHY

SEQ ID NO: 1076532 - protein, 9 aa, Homo Sapiens
ICMILLITY

SEQ ID NO: 1076533 - protein, 9 aa, Homo Sapiens
AYKGNDSIA

SEQ ID NO: 1076534 - protein, 9 aa, Homo Sapiens
KFTGEKEEG

SEQ ID NO: 1076535 - protein, 9 aa, Homo Sapiens
FSKDFYGTL

SEQ ID NO: 1076536 - protein, 9 aa, Homo Sapiens
KVTYAADEK

SEQ ID NO: 1076537 - protein, 9 aa, Homo Sapiens
AELDCRERE

SEQ ID NO: 1076538 - protein, 9 aa, Homo Sapiens
EGDAQIDLN

SEQ ID NO: 1076539 - protein, 9 aa, Homo Sapiens
LLQYSVNNE

SEQ ID NO: 1076540 - protein, 9 aa, Homo Sapiens
ADLSSATLN

SEQ ID NO: 1076541 - protein, 9 aa, Homo Sapiens
LLKELGGER

SEQ ID NO: 1076542 - protein, 9 aa, Homo Sapiens
DSKTIQKGL

SEQ ID NO: 1076543 - protein, 9 aa, Homo Sapiens
NGSIQPYSD

SEQ ID NO: 1076544 - protein, 9 aa, Homo Sapiens
VAKVVYRCW

SEQ ID NO: 1076545 - protein, 9 aa, Homo Sapiens
PFSTVVSTA

SEQ ID NO: 1076546 - protein, 9 aa, Homo Sapiens
VQSLDGSDA

SEQ ID NO: 1076547 - protein, 9 aa, Homo Sapiens
GKLTLPKKS

SEQ ID NO: 1076548 - protein, 9 aa, Homo Sapiens
SETSSEASY

SEQ ID NO: 1076549 - protein, 9 aa, Homo Sapiens
AMMLSLFED

SEQ ID NO: 1076550 - protein, 9 aa, Homo Sapiens
IKPRIVGRT

SEQ ID NO: 1076551 - protein, 9 aa, Homo Sapiens
LRLNRVLRH

SEQ ID NO: 1076552 - protein, 9 aa, Homo Sapiens
DVDILVVWD

SEQ ID NO: 1076553 - protein, 9 aa, Homo Sapiens
NIVKVAIEW

SEQ ID NO: 1076554 - protein, 9 aa, Homo Sapiens
STERHKAFS

SEQ ID NO: 1076555 - protein, 9 aa, Homo Sapiens
VMGPKNKHL

SEQ ID NO: 1076556 - protein, 9 aa, Homo Sapiens
NCQCFSGHR

SEQ ID NO: 1076557 - protein, 9 aa, Homo Sapiens
QSYKCNEGG

SEQ ID NO: 1076558 - protein, 9 aa, Homo Sapiens
ILLDPYQSM

SEQ ID NO: 1076559 - protein, 9 aa, Homo Sapiens
PQEDMTPLN

SEQ ID NO: 1076560 - protein, 9 aa, Homo Sapiens
NPQEETLDI

SEQ ID NO: 1076561 - protein, 9 aa, Homo Sapiens
SFTISKAIW

SEQ ID NO: 1076562 - protein, 9 aa, Homo Sapiens
RLNKEIPET

SEQ ID NO: 1076563 - protein, 9 aa, Homo Sapiens
LVKKPFAAK

SEQ ID NO: 1076564 - protein, 9 aa, Homo Sapiens
LVSYSLVFK

SEQ ID NO: 1076565 - protein, 9 aa, Homo Sapiens
LTDSNKEND

SEQ ID NO: 1076566 - protein, 9 aa, Homo Sapiens
PRRRVFTPR

SEQ ID NO: 1076567 - protein, 9 aa, Homo Sapiens
ELDCREREM

SEQ ID NO: 1076568 - protein, 9 aa, Homo Sapiens
RAFKTHSSN

SEQ ID NO: 1076569 - protein, 9 aa, Homo Sapiens
LFQTLEGKY

SEQ ID NO: 1076570 - protein, 9 aa, Homo Sapiens
LLEDGQIDQ

SEQ ID NO: 1076571 - protein, 9 aa, Homo Sapiens
ENNKKKMKD

SEQ ID NO: 1076572 - protein, 9 aa, Homo Sapiens
SHLFFTPVD

SEQ ID NO: 1076573 - protein, 9 aa, Homo Sapiens
RELTMDLHS

SEQ ID NO: 1076574 - protein, 9 aa, Homo Sapiens
WNFLIFELV

SEQ ID NO: 1076575 - protein, 9 aa, Homo Sapiens
RIVVEKDGF

SEQ ID NO: 1076576 - protein, 9 aa, Homo Sapiens
QVPSSNPPR

SEQ ID NO: 1076577 - protein, 9 aa, Homo Sapiens
YLSHIGLFL

SEQ ID NO: 1076578 - protein, 9 aa, Homo Sapiens
RDETLTDEK

SEQ ID NO: 1076579 - protein, 9 aa, Homo Sapiens
RLTIYAPPQ

SEQ ID NO: 1076580 - protein, 9 aa, Homo Sapiens
EGYRPILAE

SEQ ID NO: 1076581 - protein, 9 aa, Homo Sapiens
IHTRKRSYV

SEQ ID NO: 1076582 - protein, 9 aa, Homo Sapiens
QACTSGSCL

SEQ ID NO: 1076583 - protein, 9 aa, Homo Sapiens
VCLCEFKAY

SEQ ID NO: 1076584 - protein, 9 aa, Homo Sapiens
FSESHNIVI

SEQ ID NO: 1076585 - protein, 9 aa, Homo Sapiens
KRQKQEEMW

SEQ ID NO: 1076586 - protein, 9 aa, Homo Sapiens
PQLSEDVIC

SEQ ID NO: 1076587 - protein, 9 aa, Homo Sapiens
PLYHYGQGM

SEQ ID NO: 1076588 - protein, 9 aa, Homo Sapiens
PQDLLEKGF

SEQ ID NO: 1076589 - protein, 9 aa, Homo Sapiens
RDFGRQLEE

SEQ ID NO: 1076590 - protein, 9 aa, Homo Sapiens
MRFSARYNF

SEQ ID NO: 1076591 - protein, 9 aa, Homo Sapiens
MMSLPFLFN

SEQ ID NO: 1076592 - protein, 9 aa, Homo Sapiens
ITGLKVTYA

SEQ ID NO: 1076593 - protein, 9 aa, Homo Sapiens
HSNLLRCDC

SEQ ID NO: 1076594 - protein, 9 aa, Homo Sapiens
PSFLSYAFS

SEQ ID NO: 1076595 - protein, 9 aa, Homo Sapiens
EGGNPSIFS

SEQ ID NO: 1076596 - protein, 9 aa, Homo Sapiens
ACKIYNSTY

SEQ ID NO: 1076597 - protein, 9 aa, Homo Sapiens
VLYGFLTVS

SEQ ID NO: 1076598 - protein, 9 aa, Homo Sapiens
RGGSHDAEL

SEQ ID NO: 1076599 - protein, 9 aa, Homo Sapiens
ELSSAEDNS

SEQ ID NO: 1076600 - protein, 9 aa, Homo Sapiens
GKLPSSARA

SEQ ID NO: 1076601 - protein, 9 aa, Homo Sapiens
KSLQVAERL

SEQ ID NO: 1076602 - protein, 9 aa, Homo Sapiens
QFSDTIVSD

SEQ ID NO: 1076603 - protein, 9 aa, Homo Sapiens
EVLVNYYID

SEQ ID NO: 1076604 - protein, 9 aa, Homo Sapiens
VIVLFIKML

SEQ ID NO: 1076605 - protein, 9 aa, Homo Sapiens
TRYSPSFQV

SEQ ID NO: 1076606 - protein, 9 aa, Homo Sapiens
LADKKDCDA

SEQ ID NO: 1076607 - protein, 9 aa, Homo Sapiens
QALYYLSFL

SEQ ID NO: 1076608 - protein, 9 aa, Homo Sapiens
DPNQECSRD

SEQ ID NO: 1076609 - protein, 9 aa, Homo Sapiens
SDTFFLDCT

SEQ ID NO: 1076610 - protein, 9 aa, Homo Sapiens
LKESLRGKA

SEQ ID NO: 1076611 - protein, 9 aa, Homo Sapiens
GLRRFFRIN

SEQ ID NO: 1076612 - protein, 9 aa, Homo Sapiens
FIFVAGFSR

SEQ ID NO: 1076613 - protein, 9 aa, Homo Sapiens
CVEKKDSKA

SEQ ID NO: 1076614 - protein, 9 aa, Homo Sapiens
VSVAPSSPK

SEQ ID NO: 1076615 - protein, 9 aa, Homo Sapiens
PRFSSNIIV

SEQ ID NO: 1076616 - protein, 9 aa, Homo Sapiens
FILFQPVAG

SEQ ID NO: 1076617 - protein, 9 aa, Homo Sapiens
LMRLLECGV

SEQ ID NO: 1076618 - protein, 9 aa, Homo Sapiens
EAPSCCHLL

SEQ ID NO: 1076619 - protein, 9 aa, Homo Sapiens
ISESISFCK

SEQ ID NO: 1076620 - protein, 9 aa, Homo Sapiens
KKRMLIPSE

SEQ ID NO: 1076621 - protein, 9 aa, Homo Sapiens
GKEEGGPGL

SEQ ID NO: 1076622 - protein, 9 aa, Homo Sapiens
SHLNDISAC

SEQ ID NO: 1076623 - protein, 9 aa, Homo Sapiens
IVGCDHQLR

SEQ ID NO: 1076624 - protein, 9 aa, Homo Sapiens
FGLAILWLI

SEQ ID NO: 1076625 - protein, 9 aa, Homo Sapiens
ESVHSNMEL

SEQ ID NO: 1076626 - protein, 9 aa, Homo Sapiens
TSVEKGLHD

SEQ ID NO: 1076627 - protein, 9 aa, Homo Sapiens
HRKFEAKKE

SEQ ID NO: 1076628 - protein, 9 aa, Homo Sapiens
IILVFMVFS

SEQ ID NO: 1076629 - protein, 9 aa, Homo Sapiens
KPALPSAPH

SEQ ID NO: 1076630 - protein, 9 aa, Homo Sapiens
TSGLISVAI

SEQ ID NO: 1076631 - protein, 9 aa, Homo Sapiens
TVQMNHTFF

SEQ ID NO: 1076632 - protein, 9 aa, Homo Sapiens
LNGGGQSGM

SEQ ID NO: 1076633 - protein, 9 aa, Homo Sapiens
FLPVDKGGS

SEQ ID NO: 1076634 - protein, 9 aa, Homo Sapiens
GHSQYSQAL

SEQ ID NO: 1076635 - protein, 9 aa, Homo Sapiens
PWRTLKKPQ

SEQ ID NO: 1076636 - protein, 9 aa, Homo Sapiens
TTRTKCANP

SEQ ID NO: 1076637 - protein, 9 aa, Homo Sapiens
KRKHTRPIF

SEQ ID NO: 1076638 - protein, 9 aa, Homo Sapiens
KYFLAPVAV

SEQ ID NO: 1076639 - protein, 9 aa, Homo Sapiens
TYRAADGRR

SEQ ID NO: 1076640 - protein, 9 aa, Homo Sapiens
ITGPNGATG

SEQ ID NO: 1076641 - protein, 9 aa, Homo Sapiens
FGIAFSSAR

SEQ ID NO: 1076642 - protein, 9 aa, Homo Sapiens
WDKILAFVP

SEQ ID NO: 1076643 - protein, 9 aa, Homo Sapiens
QPASFVVQL

SEQ ID NO: 1076644 - protein, 9 aa, Homo Sapiens
DADWMHVRD

SEQ ID NO: 1076645 - protein, 9 aa, Homo Sapiens
SKAGGHLRP

SEQ ID NO: 1076646 - protein, 9 aa, Homo Sapiens
VFRICVFNY

SEQ ID NO: 1076647 - protein, 9 aa, Homo Sapiens
ITTLRPEIF

SEQ ID NO: 1076648 - protein, 9 aa, Homo Sapiens
PKPSRWDPQ

SEQ ID NO: 1076649 - protein, 9 aa, Homo Sapiens
TIVENVGSM

SEQ ID NO: 1076650 - protein, 9 aa, Homo Sapiens
INKQNALCT

SEQ ID NO: 1076651 - protein, 9 aa, Homo Sapiens
EDNWKQELT

SEQ ID NO: 1076652 - protein, 9 aa, Homo Sapiens
ELAPLGLLL

SEQ ID NO: 1076653 - protein, 9 aa, Homo Sapiens
PALLAKEPL

SEQ ID NO: 1076654 - protein, 9 aa, Homo Sapiens
SFLEEKDGA

SEQ ID NO: 1076655 - protein, 9 aa, Homo Sapiens
PIVPDPSAQ

SEQ ID NO: 1076656 - protein, 9 aa, Homo Sapiens
LMFERTRGS

SEQ ID NO: 1076657 - protein, 9 aa, Homo Sapiens
VPQIPMLWE

SEQ ID NO: 1076658 - protein, 9 aa, Homo Sapiens
GDTFSDVVA

SEQ ID NO: 1076659 - protein, 9 aa, Homo Sapiens
AWGEIQNVA

SEQ ID NO: 1076660 - protein, 9 aa, Homo Sapiens
YSKSELAQH

SEQ ID NO: 1076661 - protein, 9 aa, Homo Sapiens
VLVKNNGEP

SEQ ID NO: 1076662 - protein, 9 aa, Homo Sapiens
FKTHSSNSM

SEQ ID NO: 1076663 - protein, 9 aa, Homo Sapiens
EDDFYWPSR

SEQ ID NO: 1076664 - protein, 9 aa, Homo Sapiens
EIEWLEFRK

SEQ ID NO: 1076665 - protein, 9 aa, Homo Sapiens
EDKILLLVV

SEQ ID NO: 1076666 - protein, 9 aa, Homo Sapiens
IEVVLEPGQ

SEQ ID NO: 1076667 - protein, 9 aa, Homo Sapiens
RFISLKPHF

SEQ ID NO: 1076668 - protein, 9 aa, Homo Sapiens
LCTEKSNGY

SEQ ID NO: 1076669 - protein, 9 aa, Homo Sapiens
DFRPLFRPT

SEQ ID NO: 1076670 - protein, 9 aa, Homo Sapiens
SLSSLTEEA

SEQ ID NO: 1076671 - protein, 9 aa, Homo Sapiens
SWQPSPQGP

SEQ ID NO: 1076672 - protein, 9 aa, Homo Sapiens
NYSLPSPLP

SEQ ID NO: 1076673 - protein, 9 aa, Homo Sapiens
GKPTLQLKK

SEQ ID NO: 1076674 - protein, 9 aa, Homo Sapiens
LFFTPVDWA

SEQ ID NO: 1076675 - protein, 9 aa, Homo Sapiens
SLAANYGFP

SEQ ID NO: 1076676 - protein, 9 aa, Homo Sapiens
NKIAKKIKL

SEQ ID NO: 1076677 - protein, 9 aa, Homo Sapiens
EEKLAPTDV

SEQ ID NO: 1076678 - protein, 9 aa, Homo Sapiens
SSLLSPVFV

SEQ ID NO: 1076679 - protein, 9 aa, Homo Sapiens
QENLNLLVV

SEQ ID NO: 1076680 - protein, 9 aa, Homo Sapiens
KNELNEDKI

SEQ ID NO: 1076681 - protein, 9 aa, Homo Sapiens
ILILVLKYI

SEQ ID NO: 1076682 - protein, 9 aa, Homo Sapiens
VLIRFYIQR

SEQ ID NO: 1076683 - protein, 9 aa, Homo Sapiens
CSRLVILLI

SEQ ID NO: 1076684 - protein, 9 aa, Homo Sapiens
RDLARAPPG

SEQ ID NO: 1076685 - protein, 9 aa, Homo Sapiens
LLIFLLLAA

SEQ ID NO: 1076686 - protein, 9 aa, Homo Sapiens
PQVNLTTSR

SEQ ID NO: 1076687 - protein, 9 aa, Homo Sapiens
FRCSSSLCD

SEQ ID NO: 1076688 - protein, 9 aa, Homo Sapiens
LPGYFRCQC

SEQ ID NO: 1076689 - protein, 9 aa, Homo Sapiens
RSPVQYFCY

SEQ ID NO: 1076690 - protein, 9 aa, Homo Sapiens
QAAEIEWLE

SEQ ID NO: 1076691 - protein, 9 aa, Homo Sapiens
EITSKNTTD

SEQ ID NO: 1076692 - protein, 9 aa, Homo Sapiens
TSRDASVSQ

SEQ ID NO: 1076693 - protein, 9 aa, Homo Sapiens
GLCKLKIVH

SEQ ID NO: 1076694 - protein, 9 aa, Homo Sapiens
KEESLLPSL

SEQ ID NO: 1076695 - protein, 9 aa, Homo Sapiens
IFVAGFSRF

SEQ ID NO: 1076696 - protein, 9 aa, Homo Sapiens
ISFGDNCFK

SEQ ID NO: 1076697 - protein, 9 aa, Homo Sapiens
RQAEGEMGN

SEQ ID NO: 1076698 - protein, 9 aa, Homo Sapiens
KLKNFNIKE

SEQ ID NO: 1076699 - protein, 9 aa, Homo Sapiens
SSKIPKSSS

SEQ ID NO: 1076700 - protein, 9 aa, Homo Sapiens
SSRKFSSMD

SEQ ID NO: 1076701 - protein, 9 aa, Homo Sapiens
LPFFADQPI

SEQ ID NO: 1076702 - protein, 9 aa, Homo Sapiens
SLYLGVLHH

SEQ ID NO: 1076703 - protein, 9 aa, Homo Sapiens
MEEFQDLLN

SEQ ID NO: 1076704 - protein, 9 aa, Homo Sapiens
FEVYPTSLI

SEQ ID NO: 1076705 - protein, 9 aa, Homo Sapiens
KQKGYLDEK

SEQ ID NO: 1076706 - protein, 9 aa, Homo Sapiens
PDPSAQRLY

SEQ ID NO: 1076707 - protein, 9 aa, Homo Sapiens
ADDSGLPNN

SEQ ID NO: 1076708 - protein, 9 aa, Homo Sapiens
EDCQYSTSY

SEQ ID NO: 1076709 - protein, 9 aa, Homo Sapiens
KPNKCNECG

SEQ ID NO: 1076710 - protein, 9 aa, Homo Sapiens
LAEFVGRAF

SEQ ID NO: 1076711 - protein, 9 aa, Homo Sapiens
QRIAVKSMV

SEQ ID NO: 1076712 - protein, 9 aa, Homo Sapiens
ISSLFFFTS

SEQ ID NO: 1076713 - protein, 9 aa, Homo Sapiens
LNPLWSTAF

SEQ ID NO: 1076714 - protein, 9 aa, Homo Sapiens
HTDVNLEAE

SEQ ID NO: 1076715 - protein, 9 aa, Homo Sapiens
SSFSLVSVN

SEQ ID NO: 1076716 - protein, 9 aa, Homo Sapiens
PYHFSFSLD

SEQ ID NO: 1076717 - protein, 9 aa, Homo Sapiens
FSPQHLLPV

SEQ ID NO: 1076718 - protein, 9 aa, Homo Sapiens
GTTSSRVCD

SEQ ID NO: 1076719 - protein, 9 aa, Homo Sapiens
SFTPFMTVS

SEQ ID NO: 1076720 - protein, 9 aa, Homo Sapiens
PGAPSVLCS

SEQ ID NO: 1076721 - protein, 9 aa, Homo Sapiens
NEIQEGIPL

SEQ ID NO: 1076722 - protein, 9 aa, Homo Sapiens
LIISNNGLV

SEQ ID NO: 1076723 - protein, 9 aa, Homo Sapiens
EMKRIKENS

SEQ ID NO: 1076724 - protein, 9 aa, Homo Sapiens
TNSTAKRQF

SEQ ID NO: 1076725 - protein, 9 aa, Homo Sapiens
FSRSSSLNI

SEQ ID NO: 1076726 - protein, 9 aa, Homo Sapiens
AVLLFSIEP

SEQ ID NO: 1076727 - protein, 9 aa, Homo Sapiens
HVLPQTYLS

SEQ ID NO: 1076728 - protein, 9 aa, Homo Sapiens
GSPAEDPEE

SEQ ID NO: 1076729 - protein, 9 aa, Homo Sapiens
RENSQSDIK

SEQ ID NO: 1076730 - protein, 9 aa, Homo Sapiens
ALVKRLWKR

SEQ ID NO: 1076731 - protein, 9 aa, Homo Sapiens
PSCPDTAPP

SEQ ID NO: 1076732 - protein, 9 aa, Homo Sapiens
KCGKLQTIF

SEQ ID NO: 1076733 - protein, 9 aa, Homo Sapiens
KLGQVVECS

SEQ ID NO: 1076734 - protein, 9 aa, Homo Sapiens
KILLLVVGN

SEQ ID NO: 1076735 - protein, 9 aa, Homo Sapiens
RWSFQGHHP

SEQ ID NO: 1076736 - protein, 9 aa, Homo Sapiens
MEKKKIVLK

SEQ ID NO: 1076737 - protein, 9 aa, Homo Sapiens
KIFMPDFDL

SEQ ID NO: 1076738 - protein, 9 aa, Homo Sapiens
PPFYLVNTA

SEQ ID NO: 1076739 - protein, 9 aa, Homo Sapiens
SAQNKGWDS

SEQ ID NO: 1076740 - protein, 9 aa, Homo Sapiens
PPPPPTLLD

SEQ ID NO: 1076741 - protein, 9 aa, Homo Sapiens
PHSKPGAID

SEQ ID NO: 1076742 - protein, 9 aa, Homo Sapiens
LLRTEPQNN

SEQ ID NO: 1076743 - protein, 9 aa, Homo Sapiens
IQMNPYTVP

SEQ ID NO: 1076744 - protein, 9 aa, Homo Sapiens
ELQIMKKLD

SEQ ID NO: 1076745 - protein, 9 aa, Homo Sapiens
KDLLRISHE

SEQ ID NO: 1076746 - protein, 9 aa, Homo Sapiens
EPPTVKETL

SEQ ID NO: 1076747 - protein, 9 aa, Homo Sapiens
ANKENPETR

SEQ ID NO: 1076748 - protein, 9 aa, Homo Sapiens
RGTYKTLTS

SEQ ID NO: 1076749 - protein, 9 aa, Homo Sapiens
PPSYQKFLF

SEQ ID NO: 1076750 - protein, 9 aa, Homo Sapiens
ARPSQKRPW

SEQ ID NO: 1076751 - protein, 9 aa, Homo Sapiens
DTPGSFKLE

SEQ ID NO: 1076752 - protein, 9 aa, Homo Sapiens
VNHMLNLTQ

SEQ ID NO: 1076753 - protein, 9 aa, Homo Sapiens
DQTSRGLKP

SEQ ID NO: 1076754 - protein, 9 aa, Homo Sapiens
VKRKGAKCL

SEQ ID NO: 1076755 - protein, 9 aa, Homo Sapiens
VILEDNWKQ

SEQ ID NO: 1076756 - protein, 9 aa, Homo Sapiens
RVTLGPQPL

SEQ ID NO: 1076757 - protein, 9 aa, Homo Sapiens
CLFVEKFSI

SEQ ID NO: 1076758 - protein, 9 aa, Homo Sapiens
CKSLALDIN

SEQ ID NO: 1076759 - protein, 9 aa, Homo Sapiens
AKSDDAWKV

SEQ ID NO: 1076760 - protein, 9 aa, Homo Sapiens
DSSFLYNGQ

SEQ ID NO: 1076761 - protein, 9 aa, Homo Sapiens
FQLENGYDF

SEQ ID NO: 1076762 - protein, 9 aa, Homo Sapiens
QLIYTGVKP

SEQ ID NO: 1076763 - protein, 9 aa, Homo Sapiens
SVSFEKSNI

SEQ ID NO: 1076764 - protein, 9 aa, Homo Sapiens
LPFCGTAIS

SEQ ID NO: 1076765 - protein, 9 aa, Homo Sapiens
RALQSVLGG

SEQ ID NO: 1076766 - protein, 9 aa, Homo Sapiens
IHSSGLTGN

SEQ ID NO: 1076767 - protein, 9 aa, Homo Sapiens
WQKMLAATA

SEQ ID NO: 1076768 - protein, 9 aa, Homo Sapiens
ICLMIENPY

SEQ ID NO: 1076769 - protein, 9 aa, Homo Sapiens
KGGSDFSLS

SEQ ID NO: 1076770 - protein, 9 aa, Homo Sapiens
VQEKFEGLF

SEQ ID NO: 1076771 - protein, 9 aa, Homo Sapiens
KEDSPELKP

SEQ ID NO: 1076772 - protein, 9 aa, Homo Sapiens
HWRPSQRRS

SEQ ID NO: 1076773 - protein, 9 aa, Homo Sapiens
GGSLGGSAA

SEQ ID NO: 1076774 - protein, 9 aa, Homo Sapiens
VIPRTYEKC

SEQ ID NO: 1076775 - protein, 9 aa, Homo Sapiens
FFETSFCVD

SEQ ID NO: 1076776 - protein, 9 aa, Homo Sapiens
QGHLPFFCR

SEQ ID NO: 1076777 - protein, 9 aa, Homo Sapiens
NHMFLTSLF

SEQ ID NO: 1076778 - protein, 9 aa, Homo Sapiens
CGTAISNAQ

SEQ ID NO: 1076779 - protein, 9 aa, Homo Sapiens
VIATFIREM

SEQ ID NO: 1076780 - protein, 9 aa, Homo Sapiens
CGSQKEYHH

SEQ ID NO: 1076781 - protein, 9 aa, Homo Sapiens
KKPQEPADS

SEQ ID NO: 1076782 - protein, 9 aa, Homo Sapiens
SVMAALLVT

SEQ ID NO: 1076783 - protein, 9 aa, Homo Sapiens
RAAREVEAL

SEQ ID NO: 1076784 - protein, 9 aa, Homo Sapiens
SKLDLKGPK

SEQ ID NO: 1076785 - protein, 9 aa, Homo Sapiens
ASRGLIAAP

SEQ ID NO: 1076786 - protein, 9 aa, Homo Sapiens
SPVEKREDS

SEQ ID NO: 1076787 - protein, 9 aa, Homo Sapiens
QMGSPAEDP

SEQ ID NO: 1076788 - protein, 9 aa, Homo Sapiens
SFKKLVNFI

SEQ ID NO: 1076789 - protein, 9 aa, Homo Sapiens
GNNSIFFQS

SEQ ID NO: 1076790 - protein, 9 aa, Homo Sapiens
IEELGKEIE

SEQ ID NO: 1076791 - protein, 9 aa, Homo Sapiens
CQPACCTFS

SEQ ID NO: 1076792 - protein, 9 aa, Homo Sapiens
YNPGLKAGA

SEQ ID NO: 1076793 - protein, 9 aa, Homo Sapiens
SPGPHSRRK

SEQ ID NO: 1076794 - protein, 9 aa, Homo Sapiens
PWREKYKGQ

SEQ ID NO: 1076795 - protein, 9 aa, Homo Sapiens
PLEYSYGKY

SEQ ID NO: 1076796 - protein, 9 aa, Homo Sapiens
NQYGEVIHQ

SEQ ID NO: 1076797 - protein, 9 aa, Homo Sapiens
KYVCMVQTR

SEQ ID NO: 1076798 - protein, 9 aa, Homo Sapiens
DGALRSLES

SEQ ID NO: 1076799 - protein, 9 aa, Homo Sapiens
STFYSLEEQ

SEQ ID NO: 1076800 - protein, 9 aa, Homo Sapiens
SGQSSPYHS

SEQ ID NO: 1076801 - protein, 9 aa, Homo Sapiens
PPGCPKKAA

SEQ ID NO: 1076802 - protein, 9 aa, Homo Sapiens
NANIQRPCK

SEQ ID NO: 1076803 - protein, 9 aa, Homo Sapiens
EGTDLAKTA

SEQ ID NO: 1076804 - protein, 9 aa, Homo Sapiens
IDGKLYTGL

SEQ ID NO: 1076805 - protein, 9 aa, Homo Sapiens
GALQGDGLL

SEQ ID NO: 1076806 - protein, 9 aa, Homo Sapiens
LLFIVAWVI

SEQ ID NO: 1076807 - protein, 9 aa, Homo Sapiens
EVVNPRNPG

SEQ ID NO: 1076808 - protein, 9 aa, Homo Sapiens
ESLRGKALG

SEQ ID NO: 1076809 - protein, 9 aa, Homo Sapiens
SQGTDLSGI

SEQ ID NO: 1076810 - protein, 9 aa, Homo Sapiens
PGHALVMTR

SEQ ID NO: 1076811 - protein, 9 aa, Homo Sapiens
GGSTNSSLK

SEQ ID NO: 1076812 - protein, 9 aa, Homo Sapiens
ISEDDFYWP

SEQ ID NO: 1076813 - protein, 9 aa, Homo Sapiens
DSTWWQAKR

SEQ ID NO: 1076814 - protein, 9 aa, Homo Sapiens
AQSSSFSAH

SEQ ID NO: 1076815 - protein, 9 aa, Homo Sapiens
AGSFSILSD

SEQ ID NO: 1076816 - protein, 9 aa, Homo Sapiens
RVNNNLDHE

SEQ ID NO: 1076817 - protein, 9 aa, Homo Sapiens
AEVWLTPPG

SEQ ID NO: 1076818 - protein, 9 aa, Homo Sapiens
MPDKYFLAP

SEQ ID NO: 1076819 - protein, 9 aa, Homo Sapiens
EQVNHMLNL

SEQ ID NO: 1076820 - protein, 9 aa, Homo Sapiens
KEEEATSMQ

SEQ ID NO: 1076821 - protein, 9 aa, Homo Sapiens
CLVSSAWLF

SEQ ID NO: 1076822 - protein, 9 aa, Homo Sapiens
PRFSRLSRR

SEQ ID NO: 1076823 - protein, 9 aa, Homo Sapiens
SLLQRLIPG

SEQ ID NO: 1076824 - protein, 9 aa, Homo Sapiens
VIEEPASDS

SEQ ID NO: 1076825 - protein, 9 aa, Homo Sapiens
RNSGKDDCA

SEQ ID NO: 1076826 - protein, 9 aa, Homo Sapiens
YQECILVEV

SEQ ID NO: 1076827 - protein, 9 aa, Homo Sapiens
NSLIREFRK

SEQ ID NO: 1076828 - protein, 9 aa, Homo Sapiens
QEDMTPLNL

SEQ ID NO: 1076829 - protein, 9 aa, Homo Sapiens
AMIQGLFYG

SEQ ID NO: 1076830 - protein, 9 aa, Homo Sapiens
KREDSGTGM

SEQ ID NO: 1076831 - protein, 9 aa, Homo Sapiens
QNEHTTIID

SEQ ID NO: 1076832 - protein, 9 aa, Homo Sapiens
GIKGCSSRK

SEQ ID NO: 1076833 - protein, 9 aa, Homo Sapiens
TSDTSLHSL

SEQ ID NO: 1076834 - protein, 9 aa, Homo Sapiens
QSRLDPFFK

SEQ ID NO: 1076835 - protein, 9 aa, Homo Sapiens
VHPLESPAI

SEQ ID NO: 1076836 - protein, 9 aa, Homo Sapiens
KQVIVLFIK

SEQ ID NO: 1076837 - protein, 9 aa, Homo Sapiens
FDHHGRVFL

SEQ ID NO: 1076838 - protein, 9 aa, Homo Sapiens
PAFYIAGDA

SEQ ID NO: 1076839 - protein, 9 aa, Homo Sapiens
NKCNECGKA

SEQ ID NO: 1076840 - protein, 9 aa, Homo Sapiens
NFGLAILWL

SEQ ID NO: 1076841 - protein, 9 aa, Homo Sapiens
FLSMKQVKI

SEQ ID NO: 1076842 - protein, 9 aa, Homo Sapiens
TVTSRRLTD

SEQ ID NO: 1076843 - protein, 9 aa, Homo Sapiens
HKLAESIPL

SEQ ID NO: 1076844 - protein, 9 aa, Homo Sapiens
GTDLAKTAP

SEQ ID NO: 1076845 - protein, 9 aa, Homo Sapiens
RRDSDIQVL

SEQ ID NO: 1076846 - protein, 9 aa, Homo Sapiens
FLPKLLDCF

SEQ ID NO: 1076847 - protein, 9 aa, Homo Sapiens
DIKDAVNPE

SEQ ID NO: 1076848 - protein, 9 aa, Homo Sapiens
RALEENPPH

SEQ ID NO: 1076849 - protein, 9 aa, Homo Sapiens
GLHKPRSSF

SEQ ID NO: 1076850 - protein, 9 aa, Homo Sapiens
LVQEGVIQH

SEQ ID NO: 1076851 - protein, 9 aa, Homo Sapiens
DCWVVWKVY

SEQ ID NO: 1076852 - protein, 9 aa, Homo Sapiens
AREVELKKR

SEQ ID NO: 1076853 - protein, 9 aa, Homo Sapiens
SWDAEEFGR

SEQ ID NO: 1076854 - protein, 9 aa, Homo Sapiens
TFVPDIRRC

SEQ ID NO: 1076855 - protein, 9 aa, Homo Sapiens
IDTEELSAE

SEQ ID NO: 1076856 - protein, 9 aa, Homo Sapiens
MGSPAEDPE

SEQ ID NO: 1076857 - protein, 9 aa, Homo Sapiens
ARNPHKIPN

SEQ ID NO: 1076858 - protein, 9 aa, Homo Sapiens
GARGNTAAQ

SEQ ID NO: 1076859 - protein, 9 aa, Homo Sapiens
YPAVSFSPQ

SEQ ID NO: 1076860 - protein, 9 aa, Homo Sapiens
RLGSTEWAE

SEQ ID NO: 1076861 - protein, 9 aa, Homo Sapiens
SRLDPFFKQ

SEQ ID NO: 1076862 - protein, 9 aa, Homo Sapiens
PSSNPPRYE

SEQ ID NO: 1076863 - protein, 9 aa, Homo Sapiens
EYNGVMQKS

SEQ ID NO: 1076864 - protein, 9 aa, Homo Sapiens
EIVKKGQLP

SEQ ID NO: 1076865 - protein, 9 aa, Homo Sapiens
FRPPVEKWK

SEQ ID NO: 1076866 - protein, 9 aa, Homo Sapiens
PSFQVQVTI

SEQ ID NO: 1076867 - protein, 9 aa, Homo Sapiens
FEGPQQSGS

SEQ ID NO: 1076868 - protein, 9 aa, Homo Sapiens
FRMGPFSAV

SEQ ID NO: 1076869 - protein, 9 aa, Homo Sapiens
RLEAGGGTV

SEQ ID NO: 1076870 - protein, 9 aa, Homo Sapiens
FGWEENKSL

SEQ ID NO: 1076871 - protein, 9 aa, Homo Sapiens
EMFGMVLAL

SEQ ID NO: 1076872 - protein, 9 aa, Homo Sapiens
PCLKQENSE

SEQ ID NO: 1076873 - protein, 9 aa, Homo Sapiens
KAFFSKRNL

SEQ ID NO: 1076874 - protein, 9 aa, Homo Sapiens
AWGPEAAKS

SEQ ID NO: 1076875 - protein, 9 aa, Homo Sapiens
SLVFKEANT

SEQ ID NO: 1076876 - protein, 9 aa, Homo Sapiens
TLFFTQAAL

SEQ ID NO: 1076877 - protein, 9 aa, Homo Sapiens
FVNPVLNQL

SEQ ID NO: 1076878 - protein, 9 aa, Homo Sapiens
FKSDESSTE

SEQ ID NO: 1076879 - protein, 9 aa, Homo Sapiens
VTVHTEKKS

SEQ ID NO: 1076880 - protein, 9 aa, Homo Sapiens
FIPTLYHFS

SEQ ID NO: 1076881 - protein, 9 aa, Homo Sapiens
AQRATRGLL

SEQ ID NO: 1076882 - protein, 9 aa, Homo Sapiens
ERVGEVLLL

SEQ ID NO: 1076883 - protein, 9 aa, Homo Sapiens
SIKFILLLQ

SEQ ID NO: 1076884 - protein, 9 aa, Homo Sapiens
FGQLTRFLA

SEQ ID NO: 1076885 - protein, 9 aa, Homo Sapiens
SEATPVPLT

SEQ ID NO: 1076886 - protein, 9 aa, Homo Sapiens
QAIAVAEPF

SEQ ID NO: 1076887 - protein, 9 aa, Homo Sapiens
IESSGSCQG

SEQ ID NO: 1076888 - protein, 9 aa, Homo Sapiens
AISPPSASL

SEQ ID NO: 1076889 - protein, 9 aa, Homo Sapiens
KTYQFLQKY

SEQ ID NO: 1076890 - protein, 9 aa, Homo Sapiens
RKSTENVPR

SEQ ID NO: 1076891 - protein, 9 aa, Homo Sapiens
SLELSSWSA

SEQ ID NO: 1076892 - protein, 9 aa, Homo Sapiens
CTWRFRHLL

SEQ ID NO: 1076893 - protein, 9 aa, Homo Sapiens
GKRRSPGLL

SEQ ID NO: 1076894 - protein, 9 aa, Homo Sapiens
FEIAIDLEY

SEQ ID NO: 1076895 - protein, 9 aa, Homo Sapiens
QDSAEGQDR

SEQ ID NO: 1076896 - protein, 9 aa, Homo Sapiens
ESKPRFLQE

SEQ ID NO: 1076897 - protein, 9 aa, Homo Sapiens
RPSIQPVSD

SEQ ID NO: 1076898 - protein, 9 aa, Homo Sapiens
QNVAANLCV

SEQ ID NO: 1076899 - protein, 9 aa, Homo Sapiens
EKKIQHILD

SEQ ID NO: 1076900 - protein, 9 aa, Homo Sapiens
DHRQLHKFS

SEQ ID NO: 1076901 - protein, 9 aa, Homo Sapiens
VIILATSQS

SEQ ID NO: 1076902 - protein, 9 aa, Homo Sapiens
TIRIYIYMC

SEQ ID NO: 1076903 - protein, 9 aa, Homo Sapiens
RGLICAYEF

SEQ ID NO: 1076904 - protein, 9 aa, Homo Sapiens
KTRMVLLCG

SEQ ID NO: 1076905 - protein, 9 aa, Homo Sapiens
FQVLDNPAR

SEQ ID NO: 1076906 - protein, 9 aa, Homo Sapiens
HCIIPHTYC

SEQ ID NO: 1076907 - protein, 9 aa, Homo Sapiens
KLQGQMIWI

SEQ ID NO: 1076908 - protein, 9 aa, Homo Sapiens
KQNSNITQI

SEQ ID NO: 1076909 - protein, 9 aa, Homo Sapiens
DISLNERES

SEQ ID NO: 1076910 - protein, 9 aa, Homo Sapiens
FSYPCTQTE

SEQ ID NO: 1076911 - protein, 9 aa, Homo Sapiens
RMTRTCTSS

SEQ ID NO: 1076912 - protein, 9 aa, Homo Sapiens
MYTDWANKE

SEQ ID NO: 1076913 - protein, 9 aa, Homo Sapiens
FQVSARNAG

SEQ ID NO: 1076914 - protein, 9 aa, Homo Sapiens
SPFMRAPGP

SEQ ID NO: 1076915 - protein, 9 aa, Homo Sapiens
LIIRMVLQL

SEQ ID NO: 1076916 - protein, 9 aa, Homo Sapiens
NLTKLCKMA

SEQ ID NO: 1076917 - protein, 9 aa, Homo Sapiens
VFVRTTKEG

SEQ ID NO: 1076918 - protein, 9 aa, Homo Sapiens
LHVKTWYQN

SEQ ID NO: 1076919 - protein, 9 aa, Homo Sapiens
KFLKELSKT

SEQ ID NO: 1076920 - protein, 9 aa, Homo Sapiens
EYLDAIGGT

SEQ ID NO: 1076921 - protein, 9 aa, Homo Sapiens
YLDEKLDYR

SEQ ID NO: 1076922 - protein, 9 aa, Homo Sapiens
HGRVFLGSD

SEQ ID NO: 1076923 - protein, 9 aa, Homo Sapiens
VFPFIAILC

SEQ ID NO: 1076924 - protein, 9 aa, Homo Sapiens
FENIAPTTD

SEQ ID NO: 1076925 - protein, 9 aa, Homo Sapiens
DEKTYDAFV

SEQ ID NO: 1076926 - protein, 9 aa, Homo Sapiens
ENSPFALKV

SEQ ID NO: 1076927 - protein, 9 aa, Homo Sapiens
SLGLYHVFQ

SEQ ID NO: 1076928 - protein, 9 aa, Homo Sapiens
TEFCITKWK

SEQ ID NO: 1076929 - protein, 9 aa, Homo Sapiens
WGTVCDNGW

SEQ ID NO: 1076930 - protein, 9 aa, Homo Sapiens
RVKKDKDPV

SEQ ID NO: 1076931 - protein, 9 aa, Homo Sapiens
CSQELSSAE

SEQ ID NO: 1076932 - protein, 9 aa, Homo Sapiens
SRPCVFDFN

SEQ ID NO: 1076933 - protein, 9 aa, Homo Sapiens
FEEVARKGA

SEQ ID NO: 1076934 - protein, 9 aa, Homo Sapiens
PRPRFSRLS

SEQ ID NO: 1076935 - protein, 9 aa, Homo Sapiens
EYQACVLEK

SEQ ID NO: 1076936 - protein, 9 aa, Homo Sapiens
HSSATEFYL

SEQ ID NO: 1076937 - protein, 9 aa, Homo Sapiens
PFRKHGVAP

SEQ ID NO: 1076938 - protein, 9 aa, Homo Sapiens
LVKRLWKRM

SEQ ID NO: 1076939 - protein, 9 aa, Homo Sapiens
LTETSEQIR

SEQ ID NO: 1076940 - protein, 9 aa, Homo Sapiens
KVVAVDGDL

SEQ ID NO: 1076941 - protein, 9 aa, Homo Sapiens
MAGIGEKIA

SEQ ID NO: 1076942 - protein, 9 aa, Homo Sapiens
RPASAPGAA

SEQ ID NO: 1076943 - protein, 9 aa, Homo Sapiens
GMKKIALHT

SEQ ID NO: 1076944 - protein, 9 aa, Homo Sapiens
ILIEIDTIR

SEQ ID NO: 1076945 - protein, 9 aa, Homo Sapiens
KIFRPPVEK

SEQ ID NO: 1076946 - protein, 9 aa, Homo Sapiens
EETRFHHVA

SEQ ID NO: 1076947 - protein, 9 aa, Homo Sapiens
EPYIESFIN

SEQ ID NO: 1076948 - protein, 9 aa, Homo Sapiens
RWGEASSLS

SEQ ID NO: 1076949 - protein, 9 aa, Homo Sapiens
QNMENTCYV

SEQ ID NO: 1076950 - protein, 9 aa, Homo Sapiens
RKNGCSSSG

SEQ ID NO: 1076951 - protein, 9 aa, Homo Sapiens
NIKAPKIFM

SEQ ID NO: 1076952 - protein, 9 aa, Homo Sapiens
PKDHGTYTC

SEQ ID NO: 1076953 - protein, 9 aa, Homo Sapiens
DNEKAFSKT

SEQ ID NO: 1076954 - protein, 9 aa, Homo Sapiens
RDSVHSLLS

SEQ ID NO: 1076955 - protein, 9 aa, Homo Sapiens
TGKNGYISS

SEQ ID NO: 1076956 - protein, 9 aa, Homo Sapiens
QYSTSYPCF

SEQ ID NO: 1076957 - protein, 9 aa, Homo Sapiens
QGMNPADKP

SEQ ID NO: 1076958 - protein, 9 aa, Homo Sapiens
GAFLSVLFS

SEQ ID NO: 1076959 - protein, 9 aa, Homo Sapiens
NLFSSASMP

SEQ ID NO: 1076960 - protein, 9 aa, Homo Sapiens
KGVEAEQEK

SEQ ID NO: 1076961 - protein, 9 aa, Homo Sapiens
STDQEKKIE

SEQ ID NO: 1076962 - protein, 9 aa, Homo Sapiens
MHWLQKVQG

SEQ ID NO: 1076963 - protein, 9 aa, Homo Sapiens
EAKEIKLYV

SEQ ID NO: 1076964 - protein, 9 aa, Homo Sapiens
IGMIFESYG

SEQ ID NO: 1076965 - protein, 9 aa, Homo Sapiens
LRASPSHIS

SEQ ID NO: 1076966 - protein, 9 aa, Homo Sapiens
GTVPERNKS

SEQ ID NO: 1076967 - protein, 9 aa, Homo Sapiens
GGPGFSGAP

SEQ ID NO: 1076968 - protein, 9 aa, Homo Sapiens
LCWYQTPTK

SEQ ID NO: 1076969 - protein, 9 aa, Homo Sapiens
IRGGKQFFL

SEQ ID NO: 1076970 - protein, 9 aa, Homo Sapiens
EKVLDLIVI

SEQ ID NO: 1076971 - protein, 9 aa, Homo Sapiens
ECILVEVEG

SEQ ID NO: 1076972 - protein, 9 aa, Homo Sapiens
FLKESLRGK

SEQ ID NO: 1076973 - protein, 9 aa, Homo Sapiens
QKYSSVPFG

SEQ ID NO: 1076974 - protein, 9 aa, Homo Sapiens
VDLIDIKVG

SEQ ID NO: 1076975 - protein, 9 aa, Homo Sapiens
FVIPLTDPE

SEQ ID NO: 1076976 - protein, 9 aa, Homo Sapiens
KGFNLPVLV

SEQ ID NO: 1076977 - protein, 9 aa, Homo Sapiens
EKSRWSGSH

SEQ ID NO: 1076978 - protein, 9 aa, Homo Sapiens
NLSFCLTSD

SEQ ID NO: 1076979 - protein, 9 aa, Homo Sapiens
VGDNLAERV

SEQ ID NO: 1076980 - protein, 9 aa, Homo Sapiens
PEIMVKIIE

SEQ ID NO: 1076981 - protein, 9 aa, Homo Sapiens
DLQLSLFLL

SEQ ID NO: 1076982 - protein, 9 aa, Homo Sapiens
EKHLAALTA

SEQ ID NO: 1076983 - protein, 9 aa, Homo Sapiens
KNCRAKCRQ

SEQ ID NO: 1076984 - protein, 9 aa, Homo Sapiens
LCELTEDPD

SEQ ID NO: 1076985 - protein, 9 aa, Homo Sapiens
DDPLLGPRQ

SEQ ID NO: 1076986 - protein, 9 aa, Homo Sapiens
LLFNIDGFE

SEQ ID NO: 1076987 - protein, 9 aa, Homo Sapiens
ESAKADLLQ

SEQ ID NO: 1076988 - protein, 9 aa, Homo Sapiens
TTGQTPTSG

SEQ ID NO: 1076989 - protein, 9 aa, Homo Sapiens
CQGQEACLT

SEQ ID NO: 1076990 - protein, 9 aa, Homo Sapiens
SPSLPPCSI

SEQ ID NO: 1076991 - protein, 9 aa, Homo Sapiens
LYGLQPPGN

SEQ ID NO: 1076992 - protein, 9 aa, Homo Sapiens
NRGPDGALR

SEQ ID NO: 1076993 - protein, 9 aa, Homo Sapiens
HKFSSPSHL

SEQ ID NO: 1076994 - protein, 9 aa, Homo Sapiens
GDPAQSPAS

SEQ ID NO: 1076995 - protein, 9 aa, Homo Sapiens
RKCGQHLVE

SEQ ID NO: 1076996 - protein, 9 aa, Homo Sapiens
MKGTKIGTV

SEQ ID NO: 1076997 - protein, 9 aa, Homo Sapiens
APTHQSHHC

SEQ ID NO: 1076998 - protein, 9 aa, Homo Sapiens
LPLMAYSFQ

SEQ ID NO: 1076999 - protein, 9 aa, Homo Sapiens
EEARQGSRG

SEQ ID NO: 1077000 - protein, 9 aa, Homo Sapiens
ALAEGTHPG

SEQ ID NO: 1077001 - protein, 9 aa, Homo Sapiens
TRWSKSYFC

SEQ ID NO: 1077002 - protein, 9 aa, Homo Sapiens
QDDSTWWQA

SEQ ID NO: 1077003 - protein, 9 aa, Homo Sapiens
KGTKIGTVT

SEQ ID NO: 1077004 - protein, 9 aa, Homo Sapiens
ALLQPTTQF

SEQ ID NO: 1077005 - protein, 9 aa, Homo Sapiens
NTHQEQIKQ

SEQ ID NO: 1077006 - protein, 9 aa, Homo Sapiens
GSQFLAFLE

SEQ ID NO: 1077007 - protein, 9 aa, Homo Sapiens
SPPQESTKS

SEQ ID NO: 1077008 - protein, 9 aa, Homo Sapiens
WACTSCWAM

SEQ ID NO: 1077009 - protein, 9 aa, Homo Sapiens
GRFMPDNIN

SEQ ID NO: 1077010 - protein, 9 aa, Homo Sapiens
HTASDLFDP

SEQ ID NO: 1077011 - protein, 9 aa, Homo Sapiens
GKINGISGN

SEQ ID NO: 1077012 - protein, 9 aa, Homo Sapiens
GGPALEAIT

SEQ ID NO: 1077013 - protein, 9 aa, Homo Sapiens
VSSKAISRE

SEQ ID NO: 1077014 - protein, 9 aa, Homo Sapiens
LDFGGPERE

SEQ ID NO: 1077015 - protein, 9 aa, Homo Sapiens
PSPPPPPRD

SEQ ID NO: 1077016 - protein, 9 aa, Homo Sapiens
MVQTRVDSV

SEQ ID NO: 1077017 - protein, 9 aa, Homo Sapiens
EQKNVYFLQ

SEQ ID NO: 1077018 - protein, 9 aa, Homo Sapiens
TLRTSTAVE

SEQ ID NO: 1077019 - protein, 9 aa, Homo Sapiens
LEDARALCE

SEQ ID NO: 1077020 - protein, 9 aa, Homo Sapiens
SDICPTNCH

SEQ ID NO: 1077021 - protein, 9 aa, Homo Sapiens
SFSGDSFSS

SEQ ID NO: 1077022 - protein, 9 aa, Homo Sapiens
RGLLRSPSS

SEQ ID NO: 1077023 - protein, 9 aa, Homo Sapiens
YVADNNEKS

SEQ ID NO: 1077024 - protein, 9 aa, Homo Sapiens
RGQNNLTAP

SEQ ID NO: 1077025 - protein, 9 aa, Homo Sapiens
FEDFLAWKW

SEQ ID NO: 1077026 - protein, 9 aa, Homo Sapiens
KALLAKRRK

SEQ ID NO: 1077027 - protein, 9 aa, Homo Sapiens
ALLFIVAWV

SEQ ID NO: 1077028 - protein, 9 aa, Homo Sapiens
GDGEALGGG

SEQ ID NO: 1077029 - protein, 9 aa, Homo Sapiens
WEFVIATFI

SEQ ID NO: 1077030 - protein, 9 aa, Homo Sapiens
LCCVAFSFL

SEQ ID NO: 1077031 - protein, 9 aa, Homo Sapiens
RIMYDIFSF

SEQ ID NO: 1077032 - protein, 9 aa, Homo Sapiens
AIFFVGPVS

SEQ ID NO: 1077033 - protein, 9 aa, Homo Sapiens
GAGLFPLGQ

SEQ ID NO: 1077034 - protein, 9 aa, Homo Sapiens
EKEPGFYLD

SEQ ID NO: 1077035 - protein, 9 aa, Homo Sapiens
FSGTRTPDV

SEQ ID NO: 1077036 - protein, 9 aa, Homo Sapiens
HYPTPAKLD

SEQ ID NO: 1077037 - protein, 9 aa, Homo Sapiens
FSRHHENHL

SEQ ID NO: 1077038 - protein, 9 aa, Homo Sapiens
FPRDASRPH

SEQ ID NO: 1077039 - protein, 9 aa, Homo Sapiens
ITQSCLVSS

SEQ ID NO: 1077040 - protein, 9 aa, Homo Sapiens
VNQGDADKE

SEQ ID NO: 1077041 - protein, 9 aa, Homo Sapiens
HHDRKNGCS

SEQ ID NO: 1077042 - protein, 9 aa, Homo Sapiens
AQSLPYQLL

SEQ ID NO: 1077043 - protein, 9 aa, Homo Sapiens
NNQDAIQEK

SEQ ID NO: 1077044 - protein, 9 aa, Homo Sapiens
SESWVLVGV

SEQ ID NO: 1077045 - protein, 9 aa, Homo Sapiens
TDLRIQVCS

SEQ ID NO: 1077046 - protein, 9 aa, Homo Sapiens
AEDPEEEEP

SEQ ID NO: 1077047 - protein, 9 aa, Homo Sapiens
KFLENKFPW

SEQ ID NO: 1077048 - protein, 9 aa, Homo Sapiens
DMFDSPKDN

SEQ ID NO: 1077049 - protein, 9 aa, Homo Sapiens
PFCCQLHHA

SEQ ID NO: 1077050 - protein, 9 aa, Homo Sapiens
NLAVYENAR

SEQ ID NO: 1077051 - protein, 9 aa, Homo Sapiens
HPARTAAGR

SEQ ID NO: 1077052 - protein, 9 aa, Homo Sapiens
QGFIKFSEP

SEQ ID NO: 1077053 - protein, 9 aa, Homo Sapiens
CVRMFGPDK

SEQ ID NO: 1077054 - protein, 9 aa, Homo Sapiens
VDHIDSFIG

SEQ ID NO: 1077055 - protein, 9 aa, Homo Sapiens
TPLSEDPNW

SEQ ID NO: 1077056 - protein, 9 aa, Homo Sapiens
LSFSFLSEL

SEQ ID NO: 1077057 - protein, 9 aa, Homo Sapiens
RPRFSRLSR

SEQ ID NO: 1077058 - protein, 9 aa, Homo Sapiens
IPEISESIS

SEQ ID NO: 1077059 - protein, 9 aa, Homo Sapiens
LSAACFVPS

SEQ ID NO: 1077060 - protein, 9 aa, Homo Sapiens
LPTPGALVP

SEQ ID NO: 1077061 - protein, 9 aa, Homo Sapiens
PAAHALYSG

SEQ ID NO: 1077062 - protein, 9 aa, Homo Sapiens
KLAESIPLR

SEQ ID NO: 1077063 - protein, 9 aa, Homo Sapiens
WFQNRRAKK

SEQ ID NO: 1077064 - protein, 9 aa, Homo Sapiens
RLGGSSSAC

SEQ ID NO: 1077065 - protein, 9 aa, Homo Sapiens
KEIEAERAS

SEQ ID NO: 1077066 - protein, 9 aa, Homo Sapiens
NKGIFTQIS

SEQ ID NO: 1077067 - protein, 9 aa, Homo Sapiens
HKPHISFRY

SEQ ID NO: 1077068 - protein, 9 aa, Homo Sapiens
PGPSLRLQN

SEQ ID NO: 1077069 - protein, 9 aa, Homo Sapiens
GPALSLGDT

SEQ ID NO: 1077070 - protein, 9 aa, Homo Sapiens
AKVEVNISR

SEQ ID NO: 1077071 - protein, 9 aa, Homo Sapiens
LLQPTTQFD

SEQ ID NO: 1077072 - protein, 9 aa, Homo Sapiens
CGHCIIPHT

SEQ ID NO: 1077073 - protein, 9 aa, Homo Sapiens
LRSPFCSPF

SEQ ID NO: 1077074 - protein, 9 aa, Homo Sapiens
IWFEVQQTW

SEQ ID NO: 1077075 - protein, 9 aa, Homo Sapiens
LDVYIENPH

SEQ ID NO: 1077076 - protein, 9 aa, Homo Sapiens
STRCRKKDA

SEQ ID NO: 1077077 - protein, 9 aa, Homo Sapiens
IATSTPSKG

SEQ ID NO: 1077078 - protein, 9 aa, Homo Sapiens
LCTEVEDAQ

SEQ ID NO: 1077079 - protein, 9 aa, Homo Sapiens
MHAADPLES

SEQ ID NO: 1077080 - protein, 9 aa, Homo Sapiens
TRPIFSGQQ

SEQ ID NO: 1077081 - protein, 9 aa, Homo Sapiens
SLGGTSAAP

SEQ ID NO: 1077082 - protein, 9 aa, Homo Sapiens
SCILFLGSS

SEQ ID NO: 1077083 - protein, 9 aa, Homo Sapiens
PPVIEEPAS

SEQ ID NO: 1077084 - protein, 9 aa, Homo Sapiens
GPPGLQGDP

SEQ ID NO: 1077085 - protein, 9 aa, Homo Sapiens
LIAAPQVPL

SEQ ID NO: 1077086 - protein, 9 aa, Homo Sapiens
LKALGTPVL

SEQ ID NO: 1077087 - protein, 9 aa, Homo Sapiens
LFYNVTDGS

SEQ ID NO: 1077088 - protein, 9 aa, Homo Sapiens
LFMHKVCEA

SEQ ID NO: 1077089 - protein, 9 aa, Homo Sapiens
PKATDALGH

SEQ ID NO: 1077090 - protein, 9 aa, Homo Sapiens
EIKKNEKPA

SEQ ID NO: 1077091 - protein, 9 aa, Homo Sapiens
SVVSLFFET

SEQ ID NO: 1077092 - protein, 9 aa, Homo Sapiens
HSRGTYKTL

SEQ ID NO: 1077093 - protein, 9 aa, Homo Sapiens
RLLSYMCFH

SEQ ID NO: 1077094 - protein, 9 aa, Homo Sapiens
QTPGPPPSP

SEQ ID NO: 1077095 - protein, 9 aa, Homo Sapiens
VSFEKSNIG

SEQ ID NO: 1077096 - protein, 9 aa, Homo Sapiens
VMPPPRQAL

SEQ ID NO: 1077097 - protein, 9 aa, Homo Sapiens
CVTVHTEKK

SEQ ID NO: 1077098 - protein, 9 aa, Homo Sapiens
LSTLSGEIF

SEQ ID NO: 1077099 - protein, 9 aa, Homo Sapiens
EVKEAGESS

SEQ ID NO: 1077100 - protein, 9 aa, Homo Sapiens
NSASVSFSL

SEQ ID NO: 1077101 - protein, 9 aa, Homo Sapiens
LPKREVRGF

SEQ ID NO: 1077102 - protein, 9 aa, Homo Sapiens
EKKKLEAEL

SEQ ID NO: 1077103 - protein, 9 aa, Homo Sapiens
QYKTWQKKL

SEQ ID NO: 1077104 - protein, 9 aa, Homo Sapiens
RIIRGSDAD

SEQ ID NO: 1077105 - protein, 9 aa, Homo Sapiens
NGLLSALLF

SEQ ID NO: 1077106 - protein, 9 aa, Homo Sapiens
LRLGTQKYP

SEQ ID NO: 1077107 - protein, 9 aa, Homo Sapiens
ENGQRIFGG

SEQ ID NO: 1077108 - protein, 9 aa, Homo Sapiens
EEQPLPEIF

SEQ ID NO: 1077109 - protein, 9 aa, Homo Sapiens
ISQYSIPSS

SEQ ID NO: 1077110 - protein, 9 aa, Homo Sapiens
GRADTALTN

SEQ ID NO: 1077111 - protein, 9 aa, Homo Sapiens
CLALEKEAN

SEQ ID NO: 1077112 - protein, 9 aa, Homo Sapiens
QNRRAKKRK

SEQ ID NO: 1077113 - protein, 9 aa, Homo Sapiens
NQENTSVEV

SEQ ID NO: 1077114 - protein, 9 aa, Homo Sapiens
NVHQPTKGK

SEQ ID NO: 1077115 - protein, 9 aa, Homo Sapiens
IFMYLKPQS

SEQ ID NO: 1077116 - protein, 9 aa, Homo Sapiens
FASPAGFDK

SEQ ID NO: 1077117 - protein, 9 aa, Homo Sapiens
NRLLSGGRD

SEQ ID NO: 1077118 - protein, 9 aa, Homo Sapiens
NLQTGDLLS

SEQ ID NO: 1077119 - protein, 9 aa, Homo Sapiens
DRTLKGTQG

SEQ ID NO: 1077120 - protein, 9 aa, Homo Sapiens
PFIAILCSY

SEQ ID NO: 1077121 - protein, 9 aa, Homo Sapiens
ESLNATSQV

SEQ ID NO: 1077122 - protein, 9 aa, Homo Sapiens
LEAVWYLHN

SEQ ID NO: 1077123 - protein, 9 aa, Homo Sapiens
GSRGFFCKA

SEQ ID NO: 1077124 - protein, 9 aa, Homo Sapiens
IPSAGEKYK

SEQ ID NO: 1077125 - protein, 9 aa, Homo Sapiens
GLIAAPQVP

SEQ ID NO: 1077126 - protein, 9 aa, Homo Sapiens
WRLLPLPPL

SEQ ID NO: 1077127 - protein, 9 aa, Homo Sapiens
QSEESDQEK

SEQ ID NO: 1077128 - protein, 9 aa, Homo Sapiens
VKNQKREGL

SEQ ID NO: 1077129 - protein, 9 aa, Homo Sapiens
DRLLALNFL

SEQ ID NO: 1077130 - protein, 9 aa, Homo Sapiens
LKEEYEESP

SEQ ID NO: 1077131 - protein, 9 aa, Homo Sapiens
SWSYTKNNL

SEQ ID NO: 1077132 - protein, 9 aa, Homo Sapiens
AEAVFWAIT

SEQ ID NO: 1077133 - protein, 9 aa, Homo Sapiens
EILATSGLV

SEQ ID NO: 1077134 - protein, 9 aa, Homo Sapiens
LQPGHTHLY

SEQ ID NO: 1077135 - protein, 9 aa, Homo Sapiens
QARITHSPI

SEQ ID NO: 1077136 - protein, 9 aa, Homo Sapiens
FPPDALIEP

SEQ ID NO: 1077137 - protein, 9 aa, Homo Sapiens
EEGAAYSGK

SEQ ID NO: 1077138 - protein, 9 aa, Homo Sapiens
CFGVDSWSD

SEQ ID NO: 1077139 - protein, 9 aa, Homo Sapiens
NMEKATLPL

SEQ ID NO: 1077140 - protein, 9 aa, Homo Sapiens
YIWPEYCSR

SEQ ID NO: 1077141 - protein, 9 aa, Homo Sapiens
EDAYPRQIT

SEQ ID NO: 1077142 - protein, 9 aa, Homo Sapiens
ANPVHGPQN

SEQ ID NO: 1077143 - protein, 9 aa, Homo Sapiens
SPPPADSPF

SEQ ID NO: 1077144 - protein, 9 aa, Homo Sapiens
EVFEFCPEL

SEQ ID NO: 1077145 - protein, 9 aa, Homo Sapiens
FAFSLNSND

SEQ ID NO: 1077146 - protein, 9 aa, Homo Sapiens
ISGQPRPEV

SEQ ID NO: 1077147 - protein, 9 aa, Homo Sapiens
SFFGALRIS

SEQ ID NO: 1077148 - protein, 9 aa, Homo Sapiens
FFVTNFTII

SEQ ID NO: 1077149 - protein, 9 aa, Homo Sapiens
VLEPGQPLT

SEQ ID NO: 1077150 - protein, 9 aa, Homo Sapiens
SMNPDGYKV

SEQ ID NO: 1077151 - protein, 9 aa, Homo Sapiens
KMIREQEEK

SEQ ID NO: 1077152 - protein, 9 aa, Homo Sapiens
SGGSGRGCH

SEQ ID NO: 1077153 - protein, 9 aa, Homo Sapiens
GAPSENITN

SEQ ID NO: 1077154 - protein, 9 aa, Homo Sapiens
SGYNAWLLY

SEQ ID NO: 1077155 - protein, 9 aa, Homo Sapiens
QLIYQLVAK

SEQ ID NO: 1077156 - protein, 9 aa, Homo Sapiens
ELCLETYDE

SEQ ID NO: 1077157 - protein, 9 aa, Homo Sapiens
RKNNSNSLQ

SEQ ID NO: 1077158 - protein, 9 aa, Homo Sapiens
YKWYNPHPC

SEQ ID NO: 1077159 - protein, 9 aa, Homo Sapiens
QLQNEAICH

SEQ ID NO: 1077160 - protein, 9 aa, Homo Sapiens
STWWQAKRV

SEQ ID NO: 1077161 - protein, 9 aa, Homo Sapiens
FCRVKFPLT

SEQ ID NO: 1077162 - protein, 9 aa, Homo Sapiens
TDQEFENFK

SEQ ID NO: 1077163 - protein, 9 aa, Homo Sapiens
WSWILQRCQ

SEQ ID NO: 1077164 - protein, 9 aa, Homo Sapiens
PEGRPTGDA

SEQ ID NO: 1077165 - protein, 9 aa, Homo Sapiens
CLPASCPDT

SEQ ID NO: 1077166 - protein, 9 aa, Homo Sapiens
AAVNIVSHG

SEQ ID NO: 1077167 - protein, 9 aa, Homo Sapiens
REVNGHSKF

SEQ ID NO: 1077168 - protein, 9 aa, Homo Sapiens
QSILGEKVL

SEQ ID NO: 1077169 - protein, 9 aa, Homo Sapiens
DEKSQKKIR

SEQ ID NO: 1077170 - protein, 9 aa, Homo Sapiens
VQLVKSITL

SEQ ID NO: 1077171 - protein, 9 aa, Homo Sapiens
CGAVGDWGL

SEQ ID NO: 1077172 - protein, 9 aa, Homo Sapiens
PHEKHLAAL

SEQ ID NO: 1077173 - protein, 9 aa, Homo Sapiens
VGIIKLKVF

SEQ ID NO: 1077174 - protein, 9 aa, Homo Sapiens
SSSERFLKQ

SEQ ID NO: 1077175 - protein, 9 aa, Homo Sapiens
LARGQGGAY

SEQ ID NO: 1077176 - protein, 9 aa, Homo Sapiens
QYNGRALEE

SEQ ID NO: 1077177 - protein, 9 aa, Homo Sapiens
LEGLLQDHG

SEQ ID NO: 1077178 - protein, 9 aa, Homo Sapiens
IMKKLDHCN

SEQ ID NO: 1077179 - protein, 9 aa, Homo Sapiens
WKVLVLTEN

SEQ ID NO: 1077180 - protein, 9 aa, Homo Sapiens
RSRPSFCRT

SEQ ID NO: 1077181 - protein, 9 aa, Homo Sapiens
MNLLVAICL

SEQ ID NO: 1077182 - protein, 9 aa, Homo Sapiens
YFGCYFCLS

SEQ ID NO: 1077183 - protein, 9 aa, Homo Sapiens
KNEVKEVLQ

SEQ ID NO: 1077184 - protein, 9 aa, Homo Sapiens
AEGPVDGSD

SEQ ID NO: 1077185 - protein, 9 aa, Homo Sapiens
ETSFCVDFS

SEQ ID NO: 1077186 - protein, 9 aa, Homo Sapiens
RAADGRRQR

SEQ ID NO: 1077187 - protein, 9 aa, Homo Sapiens
GSKSYLSHI

SEQ ID NO: 1077188 - protein, 9 aa, Homo Sapiens
GFPVRFSYP

SEQ ID NO: 1077189 - protein, 9 aa, Homo Sapiens
YMCLLWEQG

SEQ ID NO: 1077190 - protein, 9 aa, Homo Sapiens
GLAILWLIL

SEQ ID NO: 1077191 - protein, 9 aa, Homo Sapiens
IPTSILLGP

SEQ ID NO: 1077192 - protein, 9 aa, Homo Sapiens
TGYIRFKKF

SEQ ID NO: 1077193 - protein, 9 aa, Homo Sapiens
LLQLCLRLN

SEQ ID NO: 1077194 - protein, 9 aa, Homo Sapiens
SHPNNLRFM

SEQ ID NO: 1077195 - protein, 9 aa, Homo Sapiens
FLYRKNYSQ

SEQ ID NO: 1077196 - protein, 9 aa, Homo Sapiens
LDHNKLDAL

SEQ ID NO: 1077197 - protein, 9 aa, Homo Sapiens
PPGSSTEEA

SEQ ID NO: 1077198 - protein, 9 aa, Homo Sapiens
LRCGSQKEY

SEQ ID NO: 1077199 - protein, 9 aa, Homo Sapiens
KLRPPRPLP

SEQ ID NO: 1077200 - protein, 9 aa, Homo Sapiens
LYALHLQNK

SEQ ID NO: 1077201 - protein, 9 aa, Homo Sapiens
MKIPSAGEK

SEQ ID NO: 1077202 - protein, 9 aa, Homo Sapiens
GSSEYPLSS

SEQ ID NO: 1077203 - protein, 9 aa, Homo Sapiens
QVWFKNCRA

SEQ ID NO: 1077204 - protein, 9 aa, Homo Sapiens
HKIPNNTRT

SEQ ID NO: 1077205 - protein, 9 aa, Homo Sapiens
SLEVKEAGE

SEQ ID NO: 1077206 - protein, 9 aa, Homo Sapiens
SRLFRTYRA

SEQ ID NO: 1077207 - protein, 9 aa, Homo Sapiens
CRVEQGVSF

SEQ ID NO: 1077208 - protein, 9 aa, Homo Sapiens
GQKAKSMEE

SEQ ID NO: 1077209 - protein, 9 aa, Homo Sapiens
DSFIGFPEQ

SEQ ID NO: 1077210 - protein, 9 aa, Homo Sapiens
EIENQETSD

SEQ ID NO: 1077211 - protein, 9 aa, Homo Sapiens
WANKENPET

SEQ ID NO: 1077212 - protein, 9 aa, Homo Sapiens
IEYNGVMQK

SEQ ID NO: 1077213 - protein, 9 aa, Homo Sapiens
TRLMFERTR

SEQ ID NO: 1077214 - protein, 9 aa, Homo Sapiens
VPMPDKYFL

SEQ ID NO: 1077215 - protein, 9 aa, Homo Sapiens
NCYTFNNKE

SEQ ID NO: 1077216 - protein, 9 aa, Homo Sapiens
RLFLHNNRM

SEQ ID NO: 1077217 - protein, 9 aa, Homo Sapiens
QTSRGLKPR

SEQ ID NO: 1077218 - protein, 9 aa, Homo Sapiens
KVIIPSLPK

SEQ ID NO: 1077219 - protein, 9 aa, Homo Sapiens
AEVKAESFN

SEQ ID NO: 1077220 - protein, 9 aa, Homo Sapiens
THSRIHSRE

SEQ ID NO: 1077221 - protein, 9 aa, Homo Sapiens
AAAIQVPIS

SEQ ID NO: 1077222 - protein, 9 aa, Homo Sapiens
ELEAQIFFL

SEQ ID NO: 1077223 - protein, 9 aa, Homo Sapiens
KGYLDEKLD

SEQ ID NO: 1077224 - protein, 9 aa, Homo Sapiens
QSLSVSPRV

SEQ ID NO: 1077225 - protein, 9 aa, Homo Sapiens
AHLVPTFPF

SEQ ID NO: 1077226 - protein, 9 aa, Homo Sapiens
FRVPYNPGL

SEQ ID NO: 1077227 - protein, 9 aa, Homo Sapiens
CQTTVCRLV

SEQ ID NO: 1077228 - protein, 9 aa, Homo Sapiens
FKKENIRLV

SEQ ID NO: 1077229 - protein, 9 aa, Homo Sapiens
SDEDQSSFN

SEQ ID NO: 1077230 - protein, 9 aa, Homo Sapiens
APPAPPSLA

SEQ ID NO: 1077231 - protein, 9 aa, Homo Sapiens
VYYLSQLCE

SEQ ID NO: 1077232 - protein, 9 aa, Homo Sapiens
KFSCSRMSA

SEQ ID NO: 1077233 - protein, 9 aa, Homo Sapiens
KELKSMKRK

SEQ ID NO: 1077234 - protein, 9 aa, Homo Sapiens
QTHYITVVA

SEQ ID NO: 1077235 - protein, 9 aa, Homo Sapiens
DVDFYNKKM

SEQ ID NO: 1077236 - protein, 9 aa, Homo Sapiens
NISQCDLSE

SEQ ID NO: 1077237 - protein, 9 aa, Homo Sapiens
EIGELLAKV

SEQ ID NO: 1077238 - protein, 9 aa, Homo Sapiens
SIQPVSDQW

SEQ ID NO: 1077239 - protein, 9 aa, Homo Sapiens
EEIIKHFSQ

SEQ ID NO: 1077240 - protein, 9 aa, Homo Sapiens
FISHNSCTA

SEQ ID NO: 1077241 - protein, 9 aa, Homo Sapiens
LRQPSQADT

SEQ ID NO: 1077242 - protein, 9 aa, Homo Sapiens
TLFDVAPPR

SEQ ID NO: 1077243 - protein, 9 aa, Homo Sapiens
DNSQDKLRR

SEQ ID NO: 1077244 - protein, 9 aa, Homo Sapiens
VILKISKTQ

SEQ ID NO: 1077245 - protein, 9 aa, Homo Sapiens
EVWLQWQSQ

SEQ ID NO: 1077246 - protein, 9 aa, Homo Sapiens
SLPYQLLFH

SEQ ID NO: 1077247 - protein, 9 aa, Homo Sapiens
VAARERWGL

SEQ ID NO: 1077248 - protein, 9 aa, Homo Sapiens
GKKQLYFFG

SEQ ID NO: 1077249 - protein, 9 aa, Homo Sapiens
KQGQTNPML

SEQ ID NO: 1077250 - protein, 9 aa, Homo Sapiens
KPQAPSNDA

SEQ ID NO: 1077251 - protein, 9 aa, Homo Sapiens
ATPVPLTGD

SEQ ID NO: 1077252 - protein, 9 aa, Homo Sapiens
TRFTCLFVE

SEQ ID NO: 1077253 - protein, 9 aa, Homo Sapiens
DHSSDMLNY

SEQ ID NO: 1077254 - protein, 9 aa, Homo Sapiens
PLVTLIVGC

SEQ ID NO: 1077255 - protein, 9 aa, Homo Sapiens
QQTWSHLES

SEQ ID NO: 1077256 - protein, 9 aa, Homo Sapiens
PEDETSNST

SEQ ID NO: 1077257 - protein, 9 aa, Homo Sapiens
KHSRGTYKT

SEQ ID NO: 1077258 - protein, 9 aa, Homo Sapiens
RTDPKINEG

SEQ ID NO: 1077259 - protein, 9 aa, Homo Sapiens
IVTALRWNY

SEQ ID NO: 1077260 - protein, 9 aa, Homo Sapiens
EKETTRTEL

SEQ ID NO: 1077261 - protein, 9 aa, Homo Sapiens
TFQNQAREL

SEQ ID NO: 1077262 - protein, 9 aa, Homo Sapiens
APPNVISQA

SEQ ID NO: 1077263 - protein, 9 aa, Homo Sapiens
GPQPLCTEV

SEQ ID NO: 1077264 - protein, 9 aa, Homo Sapiens
YCTRKKYHE

SEQ ID NO: 1077265 - protein, 9 aa, Homo Sapiens
RSPRLGHQR

SEQ ID NO: 1077266 - protein, 9 aa, Homo Sapiens
LSASCSRLV

SEQ ID NO: 1077267 - protein, 9 aa, Homo Sapiens
EKPNKCNEC

SEQ ID NO: 1077268 - protein, 9 aa, Homo Sapiens
EIAIDLEYF

SEQ ID NO: 1077269 - protein, 9 aa, Homo Sapiens
FRICVFNYY

SEQ ID NO: 1077270 - protein, 9 aa, Homo Sapiens
ESGQSSPYH

SEQ ID NO: 1077271 - protein, 9 aa, Homo Sapiens
ISLNERESV

SEQ ID NO: 1077272 - protein, 9 aa, Homo Sapiens
SAEGQDRQV

SEQ ID NO: 1077273 - protein, 9 aa, Homo Sapiens
CLRFAPVSS

SEQ ID NO: 1077274 - protein, 9 aa, Homo Sapiens
PKKAAGDAS

SEQ ID NO: 1077275 - protein, 9 aa, Homo Sapiens
FSGDSFSSC

SEQ ID NO: 1077276 - protein, 9 aa, Homo Sapiens
PDALWGKAP

SEQ ID NO: 1077277 - protein, 9 aa, Homo Sapiens
AIISLTPPT

SEQ ID NO: 1077278 - protein, 9 aa, Homo Sapiens
FKLRRIKAN

SEQ ID NO: 1077279 - protein, 9 aa, Homo Sapiens
DPIWKKIVF

SEQ ID NO: 1077280 - protein, 9 aa, Homo Sapiens
NKENDTDEE

SEQ ID NO: 1077281 - protein, 9 aa, Homo Sapiens
LFQQHPVVL

SEQ ID NO: 1077282 - protein, 9 aa, Homo Sapiens
KNCDVVVNT

SEQ ID NO: 1077283 - protein, 9 aa, Homo Sapiens
LAHFKDYKS

SEQ ID NO: 1077284 - protein, 9 aa, Homo Sapiens
LSEVRCRRY

SEQ ID NO: 1077285 - protein, 9 aa, Homo Sapiens
GSWYSKGAF

SEQ ID NO: 1077286 - protein, 9 aa, Homo Sapiens
IYDSIEPHN

SEQ ID NO: 1077287 - protein, 9 aa, Homo Sapiens
IDEVFEVLN

SEQ ID NO: 1077288 - protein, 9 aa, Homo Sapiens
LPEKENSPF

SEQ ID NO: 1077289 - protein, 9 aa, Homo Sapiens
VSGSRGFFC

SEQ ID NO: 1077290 - protein, 9 aa, Homo Sapiens
KLRQPSQAD

SEQ ID NO: 1077291 - protein, 9 aa, Homo Sapiens
FDQDFGVNG

SEQ ID NO: 1077292 - protein, 9 aa, Homo Sapiens
GRGCHVRSF

SEQ ID NO: 1077293 - protein, 9 aa, Homo Sapiens
SVCPTQIPV

SEQ ID NO: 1077294 - protein, 9 aa, Homo Sapiens
GCDPSGAGA

SEQ ID NO: 1077295 - protein, 9 aa, Homo Sapiens
KAWREDGFY

SEQ ID NO: 1077296 - protein, 9 aa, Homo Sapiens
QPHLFLDSA

SEQ ID NO: 1077297 - protein, 9 aa, Homo Sapiens
CLMIENPYE

SEQ ID NO: 1077298 - protein, 9 aa, Homo Sapiens
FNVASVIYA

SEQ ID NO: 1077299 - protein, 9 aa, Homo Sapiens
LIFATIVEN

SEQ ID NO: 1077300 - protein, 9 aa, Homo Sapiens
YATSGRSLP

SEQ ID NO: 1077301 - protein, 9 aa, Homo Sapiens
YLSGRPIAE

SEQ ID NO: 1077302 - protein, 9 aa, Homo Sapiens
KRENSQSDI

SEQ ID NO: 1077303 - protein, 9 aa, Homo Sapiens
AIASFVKTY

SEQ ID NO: 1077304 - protein, 9 aa, Homo Sapiens
YGRELAYGG

SEQ ID NO: 1077305 - protein, 9 aa, Homo Sapiens
LQPPPPGLK

SEQ ID NO: 1077306 - protein, 9 aa, Homo Sapiens
PAAAEVGGS

SEQ ID NO: 1077307 - protein, 9 aa, Homo Sapiens
TPECSVKGQ

SEQ ID NO: 1077308 - protein, 9 aa, Homo Sapiens
EGYMSERDE

SEQ ID NO: 1077309 - protein, 9 aa, Homo Sapiens
STIEYNGVM

SEQ ID NO: 1077310 - protein, 9 aa, Homo Sapiens
KPEVWFAAR

SEQ ID NO: 1077311 - protein, 9 aa, Homo Sapiens
RKILQFVAT

SEQ ID NO: 1077312 - protein, 9 aa, Homo Sapiens
LPSAPHGDG

SEQ ID NO: 1077313 - protein, 9 aa, Homo Sapiens
TIQPTSQTI

SEQ ID NO: 1077314 - protein, 9 aa, Homo Sapiens
LVDDEEDEE

SEQ ID NO: 1077315 - protein, 9 aa, Homo Sapiens
TPISSLFFF

SEQ ID NO: 1077316 - protein, 9 aa, Homo Sapiens
LIGMIFESY

SEQ ID NO: 1077317 - protein, 9 aa, Homo Sapiens
ALDKQDKDG

SEQ ID NO: 1077318 - protein, 9 aa, Homo Sapiens
VLCKSLALD

SEQ ID NO: 1077319 - protein, 9 aa, Homo Sapiens
DSGYNAWLL

SEQ ID NO: 1077320 - protein, 9 aa, Homo Sapiens
IEFFSFSNT

SEQ ID NO: 1077321 - protein, 9 aa, Homo Sapiens
NALYVLIGT

SEQ ID NO: 1077322 - protein, 9 aa, Homo Sapiens
YSDEDQSSF

SEQ ID NO: 1077323 - protein, 9 aa, Homo Sapiens
LRISHELYQ

SEQ ID NO: 1077324 - protein, 9 aa, Homo Sapiens
STPSSPSSS

SEQ ID NO: 1077325 - protein, 9 aa, Homo Sapiens
KKELDSYRL

SEQ ID NO: 1077326 - protein, 9 aa, Homo Sapiens
SEFSGPLSV

SEQ ID NO: 1077327 - protein, 9 aa, Homo Sapiens
LSLLDVMFL

SEQ ID NO: 1077328 - protein, 9 aa, Homo Sapiens
KKLSINHPS

SEQ ID NO: 1077329 - protein, 9 aa, Homo Sapiens
VNSIEFFSF

SEQ ID NO: 1077330 - protein, 9 aa, Homo Sapiens
SRQTRNKEQ

SEQ ID NO: 1077331 - protein, 9 aa, Homo Sapiens
GSSSFSEEE

SEQ ID NO: 1077332 - protein, 9 aa, Homo Sapiens
LLVVMSYDC

SEQ ID NO: 1077333 - protein, 9 aa, Homo Sapiens
CEDPQRFDD

SEQ ID NO: 1077334 - protein, 9 aa, Homo Sapiens
SFIARVRME

SEQ ID NO: 1077335 - protein, 9 aa, Homo Sapiens
LNLLVVLNL

SEQ ID NO: 1077336 - protein, 9 aa, Homo Sapiens
TTIGFENIA

SEQ ID NO: 1077337 - protein, 9 aa, Homo Sapiens
IMTQWNRTF

SEQ ID NO: 1077338 - protein, 9 aa, Homo Sapiens
DQSSFNIEE

SEQ ID NO: 1077339 - protein, 9 aa, Homo Sapiens
MAAFSHKII

SEQ ID NO: 1077340 - protein, 9 aa, Homo Sapiens
KLLDCFMEI

SEQ ID NO: 1077341 - protein, 9 aa, Homo Sapiens
RIAVKSMVL

SEQ ID NO: 1077342 - protein, 9 aa, Homo Sapiens
SCKFCGKTF

SEQ ID NO: 1077343 - protein, 9 aa, Homo Sapiens
REIIFNNGP

SEQ ID NO: 1077344 - protein, 9 aa, Homo Sapiens
LVKKYILAF

SEQ ID NO: 1077345 - protein, 9 aa, Homo Sapiens
PKKSLSEVL

SEQ ID NO: 1077346 - protein, 9 aa, Homo Sapiens
GKKAHGPAL

SEQ ID NO: 1077347 - protein, 9 aa, Homo Sapiens
KSLQSDTLT

SEQ ID NO: 1077348 - protein, 9 aa, Homo Sapiens
CKLKIVHSN

SEQ ID NO: 1077349 - protein, 9 aa, Homo Sapiens
GKNSEKNST

SEQ ID NO: 1077350 - protein, 9 aa, Homo Sapiens
IGSGTEILL

SEQ ID NO: 1077351 - protein, 9 aa, Homo Sapiens
HEKHLAALT

SEQ ID NO: 1077352 - protein, 9 aa, Homo Sapiens
ENSQSDIKC

SEQ ID NO: 1077353 - protein, 9 aa, Homo Sapiens
LRTLGLFCL

SEQ ID NO: 1077354 - protein, 9 aa, Homo Sapiens
ESRGELLLS

SEQ ID NO: 1077355 - protein, 9 aa, Homo Sapiens
NGEVKSYSI

SEQ ID NO: 1077356 - protein, 9 aa, Homo Sapiens
HRHFVNPVL

SEQ ID NO: 1077357 - protein, 9 aa, Homo Sapiens
ETSLQKPTS

SEQ ID NO: 1077358 - protein, 9 aa, Homo Sapiens
EGPWGAPQE

SEQ ID NO: 1077359 - protein, 9 aa, Homo Sapiens
NDSKRFGIN

SEQ ID NO: 1077360 - protein, 9 aa, Homo Sapiens
LATLPRETS

SEQ ID NO: 1077361 - protein, 9 aa, Homo Sapiens
KCADINRDG

SEQ ID NO: 1077362 - protein, 9 aa, Homo Sapiens
IENQETSDQ

SEQ ID NO: 1077363 - protein, 9 aa, Homo Sapiens
EDVICLMIE

SEQ ID NO: 1077364 - protein, 9 aa, Homo Sapiens
VPCRKQSNH

SEQ ID NO: 1077365 - protein, 9 aa, Homo Sapiens
EAENNKTSF

SEQ ID NO: 1077366 - protein, 9 aa, Homo Sapiens
GTLEEIEEG

SEQ ID NO: 1077367 - protein, 9 aa, Homo Sapiens
SSQLQYYRR

SEQ ID NO: 1077368 - protein, 9 aa, Homo Sapiens
QELLGFSLL

SEQ ID NO: 1077369 - protein, 9 aa, Homo Sapiens
PSGAIGPKG

SEQ ID NO: 1077370 - protein, 9 aa, Homo Sapiens
EVSDSAPHP

SEQ ID NO: 1077371 - protein, 9 aa, Homo Sapiens
GQNNLTAPV

SEQ ID NO: 1077372 - protein, 9 aa, Homo Sapiens
YFCEWLYNA

SEQ ID NO: 1077373 - protein, 9 aa, Homo Sapiens
IKQGSKDNL

SEQ ID NO: 1077374 - protein, 9 aa, Homo Sapiens
TASRGLIAA

SEQ ID NO: 1077375 - protein, 9 aa, Homo Sapiens
GGDTPGSFK

SEQ ID NO: 1077376 - protein, 9 aa, Homo Sapiens
NIERVKDFS

SEQ ID NO: 1077377 - protein, 9 aa, Homo Sapiens
AFKKNRLPL

SEQ ID NO: 1077378 - protein, 9 aa, Homo Sapiens
SDHSSDILS

SEQ ID NO: 1077379 - protein, 9 aa, Homo Sapiens
IVSKISDIL

SEQ ID NO: 1077380 - protein, 9 aa, Homo Sapiens
FKLVFGSVF

SEQ ID NO: 1077381 - protein, 9 aa, Homo Sapiens
RLTSCMKAL

SEQ ID NO: 1077382 - protein, 9 aa, Homo Sapiens
LYHYGQGMN

SEQ ID NO: 1077383 - protein, 9 aa, Homo Sapiens
RLQNSTTWR

SEQ ID NO: 1077384 - protein, 9 aa, Homo Sapiens
LFAFLEHQK

SEQ ID NO: 1077385 - protein, 9 aa, Homo Sapiens
NILPEKENS

SEQ ID NO: 1077386 - protein, 9 aa, Homo Sapiens
LSSFEFCEE

SEQ ID NO: 1077387 - protein, 9 aa, Homo Sapiens
LPFWRRMTR

SEQ ID NO: 1077388 - protein, 9 aa, Homo Sapiens
GCVQGRGEA

SEQ ID NO: 1077389 - protein, 9 aa, Homo Sapiens
RAAIKQGSK

SEQ ID NO: 1077390 - protein, 9 aa, Homo Sapiens
YPGPAVVFD

SEQ ID NO: 1077391 - protein, 9 aa, Homo Sapiens
RVLRRLFNL

SEQ ID NO: 1077392 - protein, 9 aa, Homo Sapiens
WREKYKGQV

SEQ ID NO: 1077393 - protein, 9 aa, Homo Sapiens
TWLAVSLKN

SEQ ID NO: 1077394 - protein, 9 aa, Homo Sapiens
AETVLVVRF

SEQ ID NO: 1077395 - protein, 9 aa, Homo Sapiens
SGEFFFLKD

SEQ ID NO: 1077396 - protein, 9 aa, Homo Sapiens
CYTFNNKEN

SEQ ID NO: 1077397 - protein, 9 aa, Homo Sapiens
SDLFDPWSL

SEQ ID NO: 1077398 - protein, 9 aa, Homo Sapiens
ADVFHTFCQ

SEQ ID NO: 1077399 - protein, 9 aa, Homo Sapiens
GSTNSSLKV

SEQ ID NO: 1077400 - protein, 9 aa, Homo Sapiens
DAYPRQITD

SEQ ID NO: 1077401 - protein, 9 aa, Homo Sapiens
ISPSLHIIV

SEQ ID NO: 1077402 - protein, 9 aa, Homo Sapiens
GRGRRDLAR

SEQ ID NO: 1077403 - protein, 9 aa, Homo Sapiens
FTNALTQIV

SEQ ID NO: 1077404 - protein, 9 aa, Homo Sapiens
KDNRNTGIV

SEQ ID NO: 1077405 - protein, 9 aa, Homo Sapiens
VFHSPGKLV

SEQ ID NO: 1077406 - protein, 9 aa, Homo Sapiens
CSVADFAPR

SEQ ID NO: 1077407 - protein, 9 aa, Homo Sapiens
LLITYLGRH

SEQ ID NO: 1077408 - protein, 9 aa, Homo Sapiens
DDFEEQKNV

SEQ ID NO: 1077409 - protein, 9 aa, Homo Sapiens
PILAETYVG

SEQ ID NO: 1077410 - protein, 9 aa, Homo Sapiens
RPIFSGQQI

SEQ ID NO: 1077411 - protein, 9 aa, Homo Sapiens
TTEELENWD

SEQ ID NO: 1077412 - protein, 9 aa, Homo Sapiens
YWVDPNQEC

SEQ ID NO: 1077413 - protein, 9 aa, Homo Sapiens
RHFVNPVLN

SEQ ID NO: 1077414 - protein, 9 aa, Homo Sapiens
DYPVARFNK

SEQ ID NO: 1077415 - protein, 9 aa, Homo Sapiens
KIPKSSSDK

SEQ ID NO: 1077416 - protein, 9 aa, Homo Sapiens
GKLDGQIFS

SEQ ID NO: 1077417 - protein, 9 aa, Homo Sapiens
ASCSRLVIL

SEQ ID NO: 1077418 - protein, 9 aa, Homo Sapiens
NRGPKNSKR

SEQ ID NO: 1077419 - protein, 9 aa, Homo Sapiens
DLGKVCSAA

SEQ ID NO: 1077420 - protein, 9 aa, Homo Sapiens
EDSGTGMGS

SEQ ID NO: 1077421 - protein, 9 aa, Homo Sapiens
PGSFKLEKS

SEQ ID NO: 1077422 - protein, 9 aa, Homo Sapiens
VPRAVFPSI

SEQ ID NO: 1077423 - protein, 9 aa, Homo Sapiens
KQDKDGNTA

SEQ ID NO: 1077424 - protein, 9 aa, Homo Sapiens
GLGGSWQLP

SEQ ID NO: 1077425 - protein, 9 aa, Homo Sapiens
VLILSGKSD

SEQ ID NO: 1077426 - protein, 9 aa, Homo Sapiens
TSQSPEGGN

SEQ ID NO: 1077427 - protein, 9 aa, Homo Sapiens
GNFVKYQCH

SEQ ID NO: 1077428 - protein, 9 aa, Homo Sapiens
RMITEFACG

SEQ ID NO: 1077429 - protein, 9 aa, Homo Sapiens
DCDASPSKE

SEQ ID NO: 1077430 - protein, 9 aa, Homo Sapiens
QQSRKNNSN

SEQ ID NO: 1077431 - protein, 9 aa, Homo Sapiens
RKSYSLERD

SEQ ID NO: 1077432 - protein, 9 aa, Homo Sapiens
LEEYKKENY

SEQ ID NO: 1077433 - protein, 9 aa, Homo Sapiens
LKKALDYIK

SEQ ID NO: 1077434 - protein, 9 aa, Homo Sapiens
TQPTGKEPA

SEQ ID NO: 1077435 - protein, 9 aa, Homo Sapiens
SASCSRLVI

SEQ ID NO: 1077436 - protein, 9 aa, Homo Sapiens
QEWFRVFSR

SEQ ID NO: 1077437 - protein, 9 aa, Homo Sapiens
HSGARLTPL

SEQ ID NO: 1077438 - protein, 9 aa, Homo Sapiens
EVGGSRGPP

SEQ ID NO: 1077439 - protein, 9 aa, Homo Sapiens
FALMMSLPF

SEQ ID NO: 1077440 - protein, 9 aa, Homo Sapiens
EDIKSHLFF

SEQ ID NO: 1077441 - protein, 9 aa, Homo Sapiens
TQIPVAARD

SEQ ID NO: 1077442 - protein, 9 aa, Homo Sapiens
VTLGPQPLC

SEQ ID NO: 1077443 - protein, 9 aa, Homo Sapiens
PKPHLPTHL

SEQ ID NO: 1077444 - protein, 9 aa, Homo Sapiens
WHIQGSYTY

SEQ ID NO: 1077445 - protein, 9 aa, Homo Sapiens
VLRRLFNLC

SEQ ID NO: 1077446 - protein, 9 aa, Homo Sapiens
SFRFASGGG

SEQ ID NO: 1077447 - protein, 9 aa, Homo Sapiens
NISLEHLLP

SEQ ID NO: 1077448 - protein, 9 aa, Homo Sapiens
FIARVRMEE

SEQ ID NO: 1077449 - protein, 9 aa, Homo Sapiens
PLLRTEPQN

SEQ ID NO: 1077450 - protein, 9 aa, Homo Sapiens
APVLSATFR

SEQ ID NO: 1077451 - protein, 9 aa, Homo Sapiens
ITYSSDILP

SEQ ID NO: 1077452 - protein, 9 aa, Homo Sapiens
GVKSYECKE

SEQ ID NO: 1077453 - protein, 9 aa, Homo Sapiens
SSVIPKLLV

SEQ ID NO: 1077454 - protein, 9 aa, Homo Sapiens
IQRPCKKSV

SEQ ID NO: 1077455 - protein, 9 aa, Homo Sapiens
QAFLSMKQV

SEQ ID NO: 1077456 - protein, 9 aa, Homo Sapiens
LFCHLHTVS

SEQ ID NO: 1077457 - protein, 9 aa, Homo Sapiens
FYSKSQYKT

SEQ ID NO: 1077458 - protein, 9 aa, Homo Sapiens
PPGNIFLPN

SEQ ID NO: 1077459 - protein, 9 aa, Homo Sapiens
GSKDNLHAV

SEQ ID NO: 1077460 - protein, 9 aa, Homo Sapiens
IGPSNTTGE

SEQ ID NO: 1077461 - protein, 9 aa, Homo Sapiens
KEKLNSEDD

SEQ ID NO: 1077462 - protein, 9 aa, Homo Sapiens
IHHEKMEMK

SEQ ID NO: 1077463 - protein, 9 aa, Homo Sapiens
IISNNGLVT

SEQ ID NO: 1077464 - protein, 9 aa, Homo Sapiens
LLLVVGNKS

SEQ ID NO: 1077465 - protein, 9 aa, Homo Sapiens
ISFRFASGG

SEQ ID NO: 1077466 - protein, 9 aa, Homo Sapiens
SSWSSADSD

SEQ ID NO: 1077467 - protein, 9 aa, Homo Sapiens
DGRVVKGKH

SEQ ID NO: 1077468 - protein, 9 aa, Homo Sapiens
ALYVGGMKK

SEQ ID NO: 1077469 - protein, 9 aa, Homo Sapiens
HRKRGRFPE

SEQ ID NO: 1077470 - protein, 9 aa, Homo Sapiens
SNSSLSEVL

SEQ ID NO: 1077471 - protein, 9 aa, Homo Sapiens
TQVFFLLRT

SEQ ID NO: 1077472 - protein, 9 aa, Homo Sapiens
EPRPRFSRL

SEQ ID NO: 1077473 - protein, 9 aa, Homo Sapiens
YNKKMDSIV

SEQ ID NO: 1077474 - protein, 9 aa, Homo Sapiens
LFEQILKTE

SEQ ID NO: 1077475 - protein, 9 aa, Homo Sapiens
TSSEASYGE

SEQ ID NO: 1077476 - protein, 9 aa, Homo Sapiens
SQLFPLSRL

SEQ ID NO: 1077477 - protein, 9 aa, Homo Sapiens
IRKDINFWV

SEQ ID NO: 1077478 - protein, 9 aa, Homo Sapiens
VLARDSVHS

SEQ ID NO: 1077479 - protein, 9 aa, Homo Sapiens
PVWWKDVWL

SEQ ID NO: 1077480 - protein, 9 aa, Homo Sapiens
RQRGFRYEK

SEQ ID NO: 1077481 - protein, 9 aa, Homo Sapiens
ASEFSGPLS

SEQ ID NO: 1077482 - protein, 9 aa, Homo Sapiens
VPAPAPSFW

SEQ ID NO: 1077483 - protein, 9 aa, Homo Sapiens
IDIKVGSVE

SEQ ID NO: 1077484 - protein, 9 aa, Homo Sapiens
ACPLPPPSP

SEQ ID NO: 1077485 - protein, 9 aa, Homo Sapiens
LHKGTKSES

SEQ ID NO: 1077486 - protein, 9 aa, Homo Sapiens
KKGDGEALG

SEQ ID NO: 1077487 - protein, 9 aa, Homo Sapiens
SKTTTASPE

SEQ ID NO: 1077488 - protein, 9 aa, Homo Sapiens
PSAQRLYAC

SEQ ID NO: 1077489 - protein, 9 aa, Homo Sapiens
PMAHSPPPG

SEQ ID NO: 1077490 - protein, 9 aa, Homo Sapiens
LLGPRQVPV

SEQ ID NO: 1077491 - protein, 9 aa, Homo Sapiens
KPRSSFDST

SEQ ID NO: 1077492 - protein, 9 aa, Homo Sapiens
PSSWVCDQD

SEQ ID NO: 1077493 - protein, 9 aa, Homo Sapiens
LNLPGSAEP

SEQ ID NO: 1077494 - protein, 9 aa, Homo Sapiens
RQGHLPFFC

SEQ ID NO: 1077495 - protein, 9 aa, Homo Sapiens
CPHEALFTI

SEQ ID NO: 1077496 - protein, 9 aa, Homo Sapiens
SETLFFTQA

SEQ ID NO: 1077497 - protein, 9 aa, Homo Sapiens
TYLSGRPIA

SEQ ID NO: 1077498 - protein, 9 aa, Homo Sapiens
EKKIEDVAS

SEQ ID NO: 1077499 - protein, 9 aa, Homo Sapiens
DIGFSGPEG

SEQ ID NO: 1077500 - protein, 9 aa, Homo Sapiens
GDARPASAP

SEQ ID NO: 1077501 - protein, 9 aa, Homo Sapiens
GAAYSGKRL

SEQ ID NO: 1077502 - protein, 9 aa, Homo Sapiens
RVAARERWG

SEQ ID NO: 1077503 - protein, 9 aa, Homo Sapiens
SSSVDSDSE

SEQ ID NO: 1077504 - protein, 9 aa, Homo Sapiens
DLKLTSEEK

SEQ ID NO: 1077505 - protein, 9 aa, Homo Sapiens
YRKNYSQRP

SEQ ID NO: 1077506 - protein, 9 aa, Homo Sapiens
VFTKRPLNE

SEQ ID NO: 1077507 - protein, 9 aa, Homo Sapiens
DEDKQHFIL

SEQ ID NO: 1077508 - protein, 9 aa, Homo Sapiens
AVRWGNQLT

SEQ ID NO: 1077509 - protein, 9 aa, Homo Sapiens
TNALTQIVA

SEQ ID NO: 1077510 - protein, 9 aa, Homo Sapiens
ELENWDPGT

SEQ ID NO: 1077511 - protein, 9 aa, Homo Sapiens
NLDCFLLLQ

SEQ ID NO: 1077512 - protein, 9 aa, Homo Sapiens
CALSNIAVD

SEQ ID NO: 1077513 - protein, 9 aa, Homo Sapiens
FLAWKWSSE

SEQ ID NO: 1077514 - protein, 9 aa, Homo Sapiens
YCGKKCGKL

SEQ ID NO: 1077515 - protein, 9 aa, Homo Sapiens
SPFEGFSLK

SEQ ID NO: 1077516 - protein, 9 aa, Homo Sapiens
WCTAFRFVP

SEQ ID NO: 1077517 - protein, 9 aa, Homo Sapiens
SSSSIGSAF

SEQ ID NO: 1077518 - protein, 9 aa, Homo Sapiens
EIYWVHLID

SEQ ID NO: 1077519 - protein, 9 aa, Homo Sapiens
KTYNTYAYV

SEQ ID NO: 1077520 - protein, 9 aa, Homo Sapiens
MKENLQTGD

SEQ ID NO: 1077521 - protein, 9 aa, Homo Sapiens
QRKAPPRPP

SEQ ID NO: 1077522 - protein, 9 aa, Homo Sapiens
VVQLNGARG

SEQ ID NO: 1077523 - protein, 9 aa, Homo Sapiens
LIPEITSKN

SEQ ID NO: 1077524 - protein, 9 aa, Homo Sapiens
AANYGFPDV

SEQ ID NO: 1077525 - protein, 9 aa, Homo Sapiens
TWRFRHLLH

SEQ ID NO: 1077526 - protein, 9 aa, Homo Sapiens
RAPMPMKRE

SEQ ID NO: 1077527 - protein, 9 aa, Homo Sapiens
SVTSWVKSP

SEQ ID NO: 1077528 - protein, 9 aa, Homo Sapiens
ILQPGHTHL

SEQ ID NO: 1077529 - protein, 9 aa, Homo Sapiens
LLTRKEDLE

SEQ ID NO: 1077530 - protein, 9 aa, Homo Sapiens
ELCPKGSCV

SEQ ID NO: 1077531 - protein, 9 aa, Homo Sapiens
RVKAHWLGC

SEQ ID NO: 1077532 - protein, 9 aa, Homo Sapiens
CEWLYNALW

SEQ ID NO: 1077533 - protein, 9 aa, Homo Sapiens
ETLTDEKTY

SEQ ID NO: 1077534 - protein, 9 aa, Homo Sapiens
SFIGFPEQI

SEQ ID NO: 1077535 - protein, 9 aa, Homo Sapiens
SDSFRQFLL

SEQ ID NO: 1077536 - protein, 9 aa, Homo Sapiens
PFYAVLKLE

SEQ ID NO: 1077537 - protein, 9 aa, Homo Sapiens
KTLVREKGV

SEQ ID NO: 1077538 - protein, 9 aa, Homo Sapiens
YTFNNKENE

SEQ ID NO: 1077539 - protein, 9 aa, Homo Sapiens
SGTNFDEII

SEQ ID NO: 1077540 - protein, 9 aa, Homo Sapiens
EPNFQVLDN

SEQ ID NO: 1077541 - protein, 9 aa, Homo Sapiens
RSLGDLSEG

SEQ ID NO: 1077542 - protein, 9 aa, Homo Sapiens
RAGRQQRIA

SEQ ID NO: 1077543 - protein, 9 aa, Homo Sapiens
PLCTEVEDA

SEQ ID NO: 1077544 - protein, 9 aa, Homo Sapiens
QSESWVLVG

SEQ ID NO: 1077545 - protein, 9 aa, Homo Sapiens
IGDFGLATE

SEQ ID NO: 1077546 - protein, 9 aa, Homo Sapiens
VLLLLFLQS

SEQ ID NO: 1077547 - protein, 9 aa, Homo Sapiens
ISFKTFSYV

SEQ ID NO: 1077548 - protein, 9 aa, Homo Sapiens
FFSFSNTLL

SEQ ID NO: 1077549 - protein, 9 aa, Homo Sapiens
SHLARSGPS

SEQ ID NO: 1077550 - protein, 9 aa, Homo Sapiens
FRGFREIHH

SEQ ID NO: 1077551 - protein, 9 aa, Homo Sapiens
NGGIPQLLV

SEQ ID NO: 1077552 - protein, 9 aa, Homo Sapiens
ELLAKVEQL

SEQ ID NO: 1077553 - protein, 9 aa, Homo Sapiens
SSPISSKCV

SEQ ID NO: 1077554 - protein, 9 aa, Homo Sapiens
SHSGLRSAN

SEQ ID NO: 1077555 - protein, 9 aa, Homo Sapiens
QPSPSARDG

SEQ ID NO: 1077556 - protein, 9 aa, Homo Sapiens
DCKSSKRAN

SEQ ID NO: 1077557 - protein, 9 aa, Homo Sapiens
IPMLWEKME

SEQ ID NO: 1077558 - protein, 9 aa, Homo Sapiens
NSTAKRQFV

SEQ ID NO: 1077559 - protein, 9 aa, Homo Sapiens
RWFWEFVIA

SEQ ID NO: 1077560 - protein, 9 aa, Homo Sapiens
LKQEVKTLN

SEQ ID NO: 1077561 - protein, 9 aa, Homo Sapiens
LFIVAWVIG

SEQ ID NO: 1077562 - protein, 9 aa, Homo Sapiens
KVDTHIHAL

SEQ ID NO: 1077563 - protein, 9 aa, Homo Sapiens
LTSAQKKMK

SEQ ID NO: 1077564 - protein, 9 aa, Homo Sapiens
TLYNGKLGF

SEQ ID NO: 1077565 - protein, 9 aa, Homo Sapiens
LNSLPRLEI

SEQ ID NO: 1077566 - protein, 9 aa, Homo Sapiens
GPDGALRSL

SEQ ID NO: 1077567 - protein, 9 aa, Homo Sapiens
DIQAAMEDE

SEQ ID NO: 1077568 - protein, 9 aa, Homo Sapiens
MGPKNKHLD

SEQ ID NO: 1077569 - protein, 9 aa, Homo Sapiens
VNNEITWHV

SEQ ID NO: 1077570 - protein, 9 aa, Homo Sapiens
LIDIKVGSV

SEQ ID NO: 1077571 - protein, 9 aa, Homo Sapiens
PEFVHGHRK

SEQ ID NO: 1077572 - protein, 9 aa, Homo Sapiens
APMSSKEAG

SEQ ID NO: 1077573 - protein, 9 aa, Homo Sapiens
GVLHHKPIN

SEQ ID NO: 1077574 - protein, 9 aa, Homo Sapiens
PWVPAPAPS

SEQ ID NO: 1077575 - protein, 9 aa, Homo Sapiens
GDQGVKRSS

SEQ ID NO: 1077576 - protein, 9 aa, Homo Sapiens
KSLLGGFQG

SEQ ID NO: 1077577 - protein, 9 aa, Homo Sapiens
SLLKPLCRV

SEQ ID NO: 1077578 - protein, 9 aa, Homo Sapiens
SPEVVWLKN

SEQ ID NO: 1077579 - protein, 9 aa, Homo Sapiens
DKKDCDASP

SEQ ID NO: 1077580 - protein, 9 aa, Homo Sapiens
PSWPLYAPP

SEQ ID NO: 1077581 - protein, 9 aa, Homo Sapiens
ISDEEKIPK

SEQ ID NO: 1077582 - protein, 9 aa, Homo Sapiens
LFLHNNRMT

SEQ ID NO: 1077583 - protein, 9 aa, Homo Sapiens
QVTYLLLPP

SEQ ID NO: 1077584 - protein, 9 aa, Homo Sapiens
PKVSLSPPW

SEQ ID NO: 1077585 - protein, 9 aa, Homo Sapiens
IIEVLISLF

SEQ ID NO: 1077586 - protein, 9 aa, Homo Sapiens
YSFQSPLGA

SEQ ID NO: 1077587 - protein, 9 aa, Homo Sapiens
GSRHSCICP

SEQ ID NO: 1077588 - protein, 9 aa, Homo Sapiens
SKEDNHSKR

SEQ ID NO: 1077589 - protein, 9 aa, Homo Sapiens
LGLRGRPRL

SEQ ID NO: 1077590 - protein, 9 aa, Homo Sapiens
ECRKAFFSK

SEQ ID NO: 1077591 - protein, 9 aa, Homo Sapiens
PGVPLRKLG

SEQ ID NO: 1077592 - protein, 9 aa, Homo Sapiens
RNLSMDSFV

SEQ ID NO: 1077593 - protein, 9 aa, Homo Sapiens
SFSLDFLVK

SEQ ID NO: 1077594 - protein, 9 aa, Homo Sapiens
RGYKSTQVS

SEQ ID NO: 1077595 - protein, 9 aa, Homo Sapiens
TEFACGTGS

SEQ ID NO: 1077596 - protein, 9 aa, Homo Sapiens
YYNIVLVPV

SEQ ID NO: 1077597 - protein, 9 aa, Homo Sapiens
ENSTNALYV

SEQ ID NO: 1077598 - protein, 9 aa, Homo Sapiens
TELSLLHNR

SEQ ID NO: 1077599 - protein, 9 aa, Homo Sapiens
GPHSSDPLL

SEQ ID NO: 1077600 - protein, 9 aa, Homo Sapiens
LQKVQGLCT

SEQ ID NO: 1077601 - protein, 9 aa, Homo Sapiens
CAARLQYLK

SEQ ID NO: 1077602 - protein, 9 aa, Homo Sapiens
DYPASWRSE

SEQ ID NO: 1077603 - protein, 9 aa, Homo Sapiens
DIQKCRRLK

SEQ ID NO: 1077604 - protein, 9 aa, Homo Sapiens
PGSWYSKGA

SEQ ID NO: 1077605 - protein, 9 aa, Homo Sapiens
SYTFSFIAR

SEQ ID NO: 1077606 - protein, 9 aa, Homo Sapiens
EKIAHFQKE

SEQ ID NO: 1077607 - protein, 9 aa, Homo Sapiens
RQITDGMVC

SEQ ID NO: 1077608 - protein, 9 aa, Homo Sapiens
TTPLQNAPP

SEQ ID NO: 1077609 - protein, 9 aa, Homo Sapiens
SKLCFHQRI

SEQ ID NO: 1077610 - protein, 9 aa, Homo Sapiens
DEATSALNN

SEQ ID NO: 1077611 - protein, 9 aa, Homo Sapiens
CIISGQPRP

SEQ ID NO: 1077612 - protein, 9 aa, Homo Sapiens
VMAGIGEKI

SEQ ID NO: 1077613 - protein, 9 aa, Homo Sapiens
VQRRLQLVW

SEQ ID NO: 1077614 - protein, 9 aa, Homo Sapiens
SGRELTKED

SEQ ID NO: 1077615 - protein, 9 aa, Homo Sapiens
RPAGEVAVP

SEQ ID NO: 1077616 - protein, 9 aa, Homo Sapiens
DIQVLYGFL

SEQ ID NO: 1077617 - protein, 9 aa, Homo Sapiens
RVRCAKALG

SEQ ID NO: 1077618 - protein, 9 aa, Homo Sapiens
FTDIKLNSS

SEQ ID NO: 1077619 - protein, 9 aa, Homo Sapiens
PEIFKDLHQ

SEQ ID NO: 1077620 - protein, 9 aa, Homo Sapiens
IALVNQGDA

SEQ ID NO: 1077621 - protein, 9 aa, Homo Sapiens
FVRTTKEGM

SEQ ID NO: 1077622 - protein, 9 aa, Homo Sapiens
VQHQLIYTG

SEQ ID NO: 1077623 - protein, 9 aa, Homo Sapiens
PARTAAGRP

SEQ ID NO: 1077624 - protein, 9 aa, Homo Sapiens
APSFWSWLL

SEQ ID NO: 1077625 - protein, 9 aa, Homo Sapiens
SSYTFSFIA

SEQ ID NO: 1077626 - protein, 9 aa, Homo Sapiens
AGDLEPSTI

SEQ ID NO: 1077627 - protein, 9 aa, Homo Sapiens
EVLEKRAQK

SEQ ID NO: 1077628 - protein, 9 aa, Homo Sapiens
LVQDVGRLE

SEQ ID NO: 1077629 - protein, 9 aa, Homo Sapiens
YRQQSLALL

SEQ ID NO: 1077630 - protein, 9 aa, Homo Sapiens
LTLPKKSLS

SEQ ID NO: 1077631 - protein, 9 aa, Homo Sapiens
LHNNRMTHL

SEQ ID NO: 1077632 - protein, 9 aa, Homo Sapiens
KSCIVGMAT

SEQ ID NO: 1077633 - protein, 9 aa, Homo Sapiens
LFPLGQWPG

SEQ ID NO: 1077634 - protein, 9 aa, Homo Sapiens
GTDLSGIEV

SEQ ID NO: 1077635 - protein, 9 aa, Homo Sapiens
QSLGLTQLH

SEQ ID NO: 1077636 - protein, 9 aa, Homo Sapiens
QCLGLPHPR

SEQ ID NO: 1077637 - protein, 9 aa, Homo Sapiens
KERKKYESK

SEQ ID NO: 1077638 - protein, 9 aa, Homo Sapiens
MQACVELLV

SEQ ID NO: 1077639 - protein, 9 aa, Homo Sapiens
VDVRLKPCF

SEQ ID NO: 1077640 - protein, 9 aa, Homo Sapiens
PPPPTLLDS

SEQ ID NO: 1077641 - protein, 9 aa, Homo Sapiens
QSCRAFKTH

SEQ ID NO: 1077642 - protein, 9 aa, Homo Sapiens
YHFSTNCEA

SEQ ID NO: 1077643 - protein, 9 aa, Homo Sapiens
QPPPPPSPQ

SEQ ID NO: 1077644 - protein, 9 aa, Homo Sapiens
MLSLFEDTP

SEQ ID NO: 1077645 - protein, 9 aa, Homo Sapiens
RWKFGWEEN

SEQ ID NO: 1077646 - protein, 9 aa, Homo Sapiens
YLPQVPLPS

SEQ ID NO: 1077647 - protein, 9 aa, Homo Sapiens
SRGLKPRNH

SEQ ID NO: 1077648 - protein, 9 aa, Homo Sapiens
INFWVERQT

SEQ ID NO: 1077649 - protein, 9 aa, Homo Sapiens
PPEKELNKY

SEQ ID NO: 1077650 - protein, 9 aa, Homo Sapiens
REDSGTGMG

SEQ ID NO: 1077651 - protein, 9 aa, Homo Sapiens
YLPPPQLNG

SEQ ID NO: 1077652 - protein, 9 aa, Homo Sapiens
EKIFRPPVE

SEQ ID NO: 1077653 - protein, 9 aa, Homo Sapiens
RFKNIRKKT

SEQ ID NO: 1077654 - protein, 9 aa, Homo Sapiens
DAELPRPLL

SEQ ID NO: 1077655 - protein, 9 aa, Homo Sapiens
AQENNQACN

SEQ ID NO: 1077656 - protein, 9 aa, Homo Sapiens
KNCMLKKEI

SEQ ID NO: 1077657 - protein, 9 aa, Homo Sapiens
NVISQADTV

SEQ ID NO: 1077658 - protein, 9 aa, Homo Sapiens
ISLVLLLLF

SEQ ID NO: 1077659 - protein, 9 aa, Homo Sapiens
GAGVPNLTQ

SEQ ID NO: 1077660 - protein, 9 aa, Homo Sapiens
GAGRVCRWP

SEQ ID NO: 1077661 - protein, 9 aa, Homo Sapiens
KIFYSKSEL

SEQ ID NO: 1077662 - protein, 9 aa, Homo Sapiens
APPSLASPD

SEQ ID NO: 1077663 - protein, 9 aa, Homo Sapiens
QKVQGLCTL

SEQ ID NO: 1077664 - protein, 9 aa, Homo Sapiens
DTFALEFLI

SEQ ID NO: 1077665 - protein, 9 aa, Homo Sapiens
SFISWGIIN

SEQ ID NO: 1077666 - protein, 9 aa, Homo Sapiens
PLQPVPLNL

SEQ ID NO: 1077667 - protein, 9 aa, Homo Sapiens
AVAYATSGR

SEQ ID NO: 1077668 - protein, 9 aa, Homo Sapiens
PVMAGIGEK

SEQ ID NO: 1077669 - protein, 9 aa, Homo Sapiens
YHRSFISWG

SEQ ID NO: 1077670 - protein, 9 aa, Homo Sapiens
SATNTNKSQ

SEQ ID NO: 1077671 - protein, 9 aa, Homo Sapiens
LPKKNPEDQ

SEQ ID NO: 1077672 - protein, 9 aa, Homo Sapiens
ALVFYHRSY

SEQ ID NO: 1077673 - protein, 9 aa, Homo Sapiens
TSLASAGSS

SEQ ID NO: 1077674 - protein, 9 aa, Homo Sapiens
FWAITIAGR

SEQ ID NO: 1077675 - protein, 9 aa, Homo Sapiens
VDDAGAAEF

SEQ ID NO: 1077676 - protein, 9 aa, Homo Sapiens
AGEKYKAFS

SEQ ID NO: 1077677 - protein, 9 aa, Homo Sapiens
YRAADGRRQ

SEQ ID NO: 1077678 - protein, 9 aa, Homo Sapiens
ELGLLIFFR

SEQ ID NO: 1077679 - protein, 9 aa, Homo Sapiens
VVQSLDGSD

SEQ ID NO: 1077680 - protein, 9 aa, Homo Sapiens
FEGEGPATL

SEQ ID NO: 1077681 - protein, 9 aa, Homo Sapiens
ETVCKTRMV

SEQ ID NO: 1077682 - protein, 9 aa, Homo Sapiens
GNYYCSVTS

SEQ ID NO: 1077683 - protein, 9 aa, Homo Sapiens
DQLESEETR

SEQ ID NO: 1077684 - protein, 9 aa, Homo Sapiens
GGNFAQSSS

SEQ ID NO: 1077685 - protein, 9 aa, Homo Sapiens
QEACLTPCP

SEQ ID NO: 1077686 - protein, 9 aa, Homo Sapiens
WRRTREFED

SEQ ID NO: 1077687 - protein, 9 aa, Homo Sapiens
IVLKQEVKT

SEQ ID NO: 1077688 - protein, 9 aa, Homo Sapiens
TSTSWDQEI

SEQ ID NO: 1077689 - protein, 9 aa, Homo Sapiens
GSLGGSAAA

SEQ ID NO: 1077690 - protein, 9 aa, Homo Sapiens
YDCYVAVCR

SEQ ID NO: 1077691 - protein, 9 aa, Homo Sapiens
SAAGLHKPR

SEQ ID NO: 1077692 - protein, 9 aa, Homo Sapiens
PAGSFSILS

SEQ ID NO: 1077693 - protein, 9 aa, Homo Sapiens
AMLNPSNRC

SEQ ID NO: 1077694 - protein, 9 aa, Homo Sapiens
SVPQIPMLW

SEQ ID NO: 1077695 - protein, 9 aa, Homo Sapiens
AAAVAAASA

SEQ ID NO: 1077696 - protein, 9 aa, Homo Sapiens
PQIPMLWEK

SEQ ID NO: 1077697 - protein, 9 aa, Homo Sapiens
SPLPTPGAL

SEQ ID NO: 1077698 - protein, 9 aa, Homo Sapiens
LIEMEALSK

SEQ ID NO: 1077699 - protein, 9 aa, Homo Sapiens
RCAKALGPS

SEQ ID NO: 1077700 - protein, 9 aa, Homo Sapiens
DLLQSQSMN

SEQ ID NO: 1077701 - protein, 9 aa, Homo Sapiens
IRGSDADIK

SEQ ID NO: 1077702 - protein, 9 aa, Homo Sapiens
GRRDLARAP

SEQ ID NO: 1077703 - protein, 9 aa, Homo Sapiens
CVLFVNGDL

SEQ ID NO: 1077704 - protein, 9 aa, Homo Sapiens
HAPGRDKAA

SEQ ID NO: 1077705 - protein, 9 aa, Homo Sapiens
KGKDLLRIS

SEQ ID NO: 1077706 - protein, 9 aa, Homo Sapiens
LLGPGAAPL

SEQ ID NO: 1077707 - protein, 9 aa, Homo Sapiens
FCLSTLFTI

SEQ ID NO: 1077708 - protein, 9 aa, Homo Sapiens
QPLSTAEIT

SEQ ID NO: 1077709 - protein, 9 aa, Homo Sapiens
GVPLRKLGQ

SEQ ID NO: 1077710 - protein, 9 aa, Homo Sapiens
AKLRRELDK

SEQ ID NO: 1077711 - protein, 9 aa, Homo Sapiens
GDGDDSSVV

SEQ ID NO: 1077712 - protein, 9 aa, Homo Sapiens
EVKAETIPS

SEQ ID NO: 1077713 - protein, 9 aa, Homo Sapiens
SQFSDTIVS

SEQ ID NO: 1077714 - protein, 9 aa, Homo Sapiens
LGWNLPGGA

SEQ ID NO: 1077715 - protein, 9 aa, Homo Sapiens
LLLNPLWST

SEQ ID NO: 1077716 - protein, 9 aa, Homo Sapiens
DPCGEAHPK

SEQ ID NO: 1077717 - protein, 9 aa, Homo Sapiens
DSSPSAHGA

SEQ ID NO: 1077718 - protein, 9 aa, Homo Sapiens
SKDFYGTLI

SEQ ID NO: 1077719 - protein, 9 aa, Homo Sapiens
MGSEGILGV

SEQ ID NO: 1077720 - protein, 9 aa, Homo Sapiens
NKEIPETTR

SEQ ID NO: 1077721 - protein, 9 aa, Homo Sapiens
RLMFERTRG

SEQ ID NO: 1077722 - protein, 9 aa, Homo Sapiens
RLEGCVQGR

SEQ ID NO: 1077723 - protein, 9 aa, Homo Sapiens
SASLVQTVT

SEQ ID NO: 1077724 - protein, 9 aa, Homo Sapiens
REKIFRPPV

SEQ ID NO: 1077725 - protein, 9 aa, Homo Sapiens
LNGRPTRAD

SEQ ID NO: 1077726 - protein, 9 aa, Homo Sapiens
EFFSFSNTL

SEQ ID NO: 1077727 - protein, 9 aa, Homo Sapiens
HPGLLISNS

SEQ ID NO: 1077728 - protein, 9 aa, Homo Sapiens
LNSACSWFT

SEQ ID NO: 1077729 - protein, 9 aa, Homo Sapiens
PCLCGLLIL

SEQ ID NO: 1077730 - protein, 9 aa, Homo Sapiens
PEVVWLKNG

SEQ ID NO: 1077731 - protein, 9 aa, Homo Sapiens
ERKESPDKP

SEQ ID NO: 1077732 - protein, 9 aa, Homo Sapiens
EAGIPGYPT

SEQ ID NO: 1077733 - protein, 9 aa, Homo Sapiens
GNGTIDMSV

SEQ ID NO: 1077734 - protein, 9 aa, Homo Sapiens
LVPMDFLEN

SEQ ID NO: 1077735 - protein, 9 aa, Homo Sapiens
FCGHCIIPH

SEQ ID NO: 1077736 - protein, 9 aa, Homo Sapiens
LQGDPGFEG

SEQ ID NO: 1077737 - protein, 9 aa, Homo Sapiens
YQCHRPKYQ

SEQ ID NO: 1077738 - protein, 9 aa, Homo Sapiens
LSALLFLFP

SEQ ID NO: 1077739 - protein, 9 aa, Homo Sapiens
IACSPVSGC

SEQ ID NO: 1077740 - protein, 9 aa, Homo Sapiens
EDIKRWKTR

SEQ ID NO: 1077741 - protein, 9 aa, Homo Sapiens
REVFEFCPE

SEQ ID NO: 1077742 - protein, 9 aa, Homo Sapiens
SLIREFRKS

SEQ ID NO: 1077743 - protein, 9 aa, Homo Sapiens
ESVCPTQIP

SEQ ID NO: 1077744 - protein, 9 aa, Homo Sapiens
PAARWSFQG

SEQ ID NO: 1077745 - protein, 9 aa, Homo Sapiens
KGFSRWNNL

SEQ ID NO: 1077746 - protein, 9 aa, Homo Sapiens
NFPDEKVCW

SEQ ID NO: 1077747 - protein, 9 aa, Homo Sapiens
QEGVVDCAG

SEQ ID NO: 1077748 - protein, 9 aa, Homo Sapiens
TNEPTDIIP

SEQ ID NO: 1077749 - protein, 9 aa, Homo Sapiens
GRYKQEFSE

SEQ ID NO: 1077750 - protein, 9 aa, Homo Sapiens
LSFIQDKSK

SEQ ID NO: 1077751 - protein, 9 aa, Homo Sapiens
YEAGEILFY

SEQ ID NO: 1077752 - protein, 9 aa, Homo Sapiens
ELRDNFLKF

SEQ ID NO: 1077753 - protein, 9 aa, Homo Sapiens
GNNEETILS

SEQ ID NO: 1077754 - protein, 9 aa, Homo Sapiens
GWKKKMVTS

SEQ ID NO: 1077755 - protein, 9 aa, Homo Sapiens
CKIYNSTYL

SEQ ID NO: 1077756 - protein, 9 aa, Homo Sapiens
RCGVTFVPD

SEQ ID NO: 1077757 - protein, 9 aa, Homo Sapiens
EATFLIDYM

SEQ ID NO: 1077758 - protein, 9 aa, Homo Sapiens
PGTGAFSGT

SEQ ID NO: 1077759 - protein, 9 aa, Homo Sapiens
VYERELEQL

SEQ ID NO: 1077760 - protein, 9 aa, Homo Sapiens
QVTWSKAGG

SEQ ID NO: 1077761 - protein, 9 aa, Homo Sapiens
HIDPNFASP

SEQ ID NO: 1077762 - protein, 9 aa, Homo Sapiens
SMRFSARYN

SEQ ID NO: 1077763 - protein, 9 aa, Homo Sapiens
QRRNFLREA

SEQ ID NO: 1077764 - protein, 9 aa, Homo Sapiens
PYSLKKAYS

SEQ ID NO: 1077765 - protein, 9 aa, Homo Sapiens
TTLPADSYQ

SEQ ID NO: 1077766 - protein, 9 aa, Homo Sapiens
VTSRRLTDL

SEQ ID NO: 1077767 - protein, 9 aa, Homo Sapiens
QDGEAPLAG

SEQ ID NO: 1077768 - protein, 9 aa, Homo Sapiens
DTAKLLSAE

SEQ ID NO: 1077769 - protein, 9 aa, Homo Sapiens
RIGPAKVES

SEQ ID NO: 1077770 - protein, 9 aa, Homo Sapiens
EESKPRFLQ

SEQ ID NO: 1077771 - protein, 9 aa, Homo Sapiens
ACTSGSCLH

SEQ ID NO: 1077772 - protein, 9 aa, Homo Sapiens
LYCLTCFCL

SEQ ID NO: 1077773 - protein, 9 aa, Homo Sapiens
IREFRKSDI

SEQ ID NO: 1077774 - protein, 9 aa, Homo Sapiens
RAPPGEVVG

SEQ ID NO: 1077775 - protein, 9 aa, Homo Sapiens
IYTGVKPYE

SEQ ID NO: 1077776 - protein, 9 aa, Homo Sapiens
RDYVMLRLA

SEQ ID NO: 1077777 - protein, 9 aa, Homo Sapiens
TFEYLGNFG

SEQ ID NO: 1077778 - protein, 9 aa, Homo Sapiens
PESGQSSPY

SEQ ID NO: 1077779 - protein, 9 aa, Homo Sapiens
VLGFRENQE

SEQ ID NO: 1077780 - protein, 9 aa, Homo Sapiens
TSQTIPAID

SEQ ID NO: 1077781 - protein, 9 aa, Homo Sapiens
TQSDTFFLD

SEQ ID NO: 1077782 - protein, 9 aa, Homo Sapiens
SLIKTEFEN

SEQ ID NO: 1077783 - protein, 9 aa, Homo Sapiens
NMKYLLLIG

SEQ ID NO: 1077784 - protein, 9 aa, Homo Sapiens
EKPLGQDEI

SEQ ID NO: 1077785 - protein, 9 aa, Homo Sapiens
CKSQRPMFS

SEQ ID NO: 1077786 - protein, 9 aa, Homo Sapiens
CLGLCKLKI

SEQ ID NO: 1077787 - protein, 9 aa, Homo Sapiens
FGEKLAITY

SEQ ID NO: 1077788 - protein, 9 aa, Homo Sapiens
PAPPPSAVF

SEQ ID NO: 1077789 - protein, 9 aa, Homo Sapiens
PPADSPFEG

SEQ ID NO: 1077790 - protein, 9 aa, Homo Sapiens
WNKTNIYGQ

SEQ ID NO: 1077791 - protein, 9 aa, Homo Sapiens
APTTVSEAP

SEQ ID NO: 1077792 - protein, 9 aa, Homo Sapiens
ANICSHGQC

SEQ ID NO: 1077793 - protein, 9 aa, Homo Sapiens
TFFYNGKKS

SEQ ID NO: 1077794 - protein, 9 aa, Homo Sapiens
FDHRKRGRF

SEQ ID NO: 1077795 - protein, 9 aa, Homo Sapiens
VKVVKNQKR

SEQ ID NO: 1077796 - protein, 9 aa, Homo Sapiens
NHSLVKKPF

SEQ ID NO: 1077797 - protein, 9 aa, Homo Sapiens
EYKKENYNF

SEQ ID NO: 1077798 - protein, 9 aa, Homo Sapiens
KATLPLVTL

SEQ ID NO: 1077799 - protein, 9 aa, Homo Sapiens
LPAHKTSSL

SEQ ID NO: 1077800 - protein, 9 aa, Homo Sapiens
KAALGLGGS

SEQ ID NO: 1077801 - protein, 9 aa, Homo Sapiens
TLSCFAVRG

SEQ ID NO: 1077802 - protein, 9 aa, Homo Sapiens
QEQGKEDEE

SEQ ID NO: 1077803 - protein, 9 aa, Homo Sapiens
AQRPTPYKW

SEQ ID NO: 1077804 - protein, 9 aa, Homo Sapiens
VCNSATGKE

SEQ ID NO: 1077805 - protein, 9 aa, Homo Sapiens
IFESYGFFL

SEQ ID NO: 1077806 - protein, 9 aa, Homo Sapiens
IMRPVEVRK

SEQ ID NO: 1077807 - protein, 9 aa, Homo Sapiens
TYLGRHRKK

SEQ ID NO: 1077808 - protein, 9 aa, Homo Sapiens
PVDKGGSLV

SEQ ID NO: 1077809 - protein, 9 aa, Homo Sapiens
MTQWNRTFK

SEQ ID NO: 1077810 - protein, 9 aa, Homo Sapiens
VFSLTSHPL

SEQ ID NO: 1077811 - protein, 9 aa, Homo Sapiens
THLSVKGEK

SEQ ID NO: 1077812 - protein, 9 aa, Homo Sapiens
TIRTDPKIN

SEQ ID NO: 1077813 - protein, 9 aa, Homo Sapiens
TSKFEPNHV

SEQ ID NO: 1077814 - protein, 9 aa, Homo Sapiens
CSSSLCDHE

SEQ ID NO: 1077815 - protein, 9 aa, Homo Sapiens
QVPISDVYQ

SEQ ID NO: 1077816 - protein, 9 aa, Homo Sapiens
LEGEHILNL

SEQ ID NO: 1077817 - protein, 9 aa, Homo Sapiens
VRLWEIVSL

SEQ ID NO: 1077818 - protein, 9 aa, Homo Sapiens
PASDLEAVL

SEQ ID NO: 1077819 - protein, 9 aa, Homo Sapiens
HRVLRRLFN

SEQ ID NO: 1077820 - protein, 9 aa, Homo Sapiens
GRQPLIEGP

SEQ ID NO: 1077821 - protein, 9 aa, Homo Sapiens
ESDFLTDSE

SEQ ID NO: 1077822 - protein, 9 aa, Homo Sapiens
SWDQLGRQT

SEQ ID NO: 1077823 - protein, 9 aa, Homo Sapiens
CLKQENSEL

SEQ ID NO: 1077824 - protein, 9 aa, Homo Sapiens
LFSTIVVTR

SEQ ID NO: 1077825 - protein, 9 aa, Homo Sapiens
IEEKCRLLG

SEQ ID NO: 1077826 - protein, 9 aa, Homo Sapiens
PFPPDALIE

SEQ ID NO: 1077827 - protein, 9 aa, Homo Sapiens
VLFMHKVCE

SEQ ID NO: 1077828 - protein, 9 aa, Homo Sapiens
GKEIEAERA

SEQ ID NO: 1077829 - protein, 9 aa, Homo Sapiens
EFPETWGTD

SEQ ID NO: 1077830 - protein, 9 aa, Homo Sapiens
RLEEARLNK

SEQ ID NO: 1077831 - protein, 9 aa, Homo Sapiens
EYCDSPHSK

SEQ ID NO: 1077832 - protein, 9 aa, Homo Sapiens
KKGEMGVAG

SEQ ID NO: 1077833 - protein, 9 aa, Homo Sapiens
CEESVCPTQ

SEQ ID NO: 1077834 - protein, 9 aa, Homo Sapiens
LFKLSHNEV

SEQ ID NO: 1077835 - protein, 9 aa, Homo Sapiens
ILAFVPETI

SEQ ID NO: 1077836 - protein, 9 aa, Homo Sapiens
KKMKTKHKA

SEQ ID NO: 1077837 - protein, 9 aa, Homo Sapiens
VEIQFNEKS

SEQ ID NO: 1077838 - protein, 9 aa, Homo Sapiens
VESSLTETS

SEQ ID NO: 1077839 - protein, 9 aa, Homo Sapiens
RCQKLEQEV

SEQ ID NO: 1077840 - protein, 9 aa, Homo Sapiens
LPGEWKLCQ

SEQ ID NO: 1077841 - protein, 9 aa, Homo Sapiens
QREENGFPD

SEQ ID NO: 1077842 - protein, 9 aa, Homo Sapiens
SPPPGTPMA

SEQ ID NO: 1077843 - protein, 9 aa, Homo Sapiens
DEDSPSPGS

SEQ ID NO: 1077844 - protein, 9 aa, Homo Sapiens
PLESPAIIS

SEQ ID NO: 1077845 - protein, 9 aa, Homo Sapiens
SLRVRCAKA

SEQ ID NO: 1077846 - protein, 9 aa, Homo Sapiens
PKSIISLAG

SEQ ID NO: 1077847 - protein, 9 aa, Homo Sapiens
TGDKDVVNK

SEQ ID NO: 1077848 - protein, 9 aa, Homo Sapiens
AEEGKDYPV

SEQ ID NO: 1077849 - protein, 9 aa, Homo Sapiens
HVTILADSS

SEQ ID NO: 1077850 - protein, 9 aa, Homo Sapiens
KKIKEDYFK

SEQ ID NO: 1077851 - protein, 9 aa, Homo Sapiens
HPKRRNHLK

SEQ ID NO: 1077852 - protein, 9 aa, Homo Sapiens
SPETFKKAV

SEQ ID NO: 1077853 - protein, 9 aa, Homo Sapiens
DFGRQLEEK

SEQ ID NO: 1077854 - protein, 9 aa, Homo Sapiens
LHKEEEATS

SEQ ID NO: 1077855 - protein, 9 aa, Homo Sapiens
SHKIIFFLV

SEQ ID NO: 1077856 - protein, 9 aa, Homo Sapiens
MGPKTLSQL

SEQ ID NO: 1077857 - protein, 9 aa, Homo Sapiens
KIFLSVTAI

SEQ ID NO: 1077858 - protein, 9 aa, Homo Sapiens
EIKAGNGTI

SEQ ID NO: 1077859 - protein, 9 aa, Homo Sapiens
VKKPFAAKD

SEQ ID NO: 1077860 - protein, 9 aa, Homo Sapiens
FTISKAIWL

SEQ ID NO: 1077861 - protein, 9 aa, Homo Sapiens
FDCSTDQEK

SEQ ID NO: 1077862 - protein, 9 aa, Homo Sapiens
PVFRLARWR

SEQ ID NO: 1077863 - protein, 9 aa, Homo Sapiens
FGGPERELT

SEQ ID NO: 1077864 - protein, 9 aa, Homo Sapiens
INRDGKVNF

SEQ ID NO: 1077865 - protein, 9 aa, Homo Sapiens
RKKAQELSD

SEQ ID NO: 1077866 - protein, 9 aa, Homo Sapiens
KEGCGSYGC

SEQ ID NO: 1077867 - protein, 9 aa, Homo Sapiens
LLLQKIIHL

SEQ ID NO: 1077868 - protein, 9 aa, Homo Sapiens
QEFISFRFA

SEQ ID NO: 1077869 - protein, 9 aa, Homo Sapiens
IFFQSCMAQ

SEQ ID NO: 1077870 - protein, 9 aa, Homo Sapiens
KALAEFVGR

SEQ ID NO: 1077871 - protein, 9 aa, Homo Sapiens
NASVFISHN

SEQ ID NO: 1077872 - protein, 9 aa, Homo Sapiens
GEAPLAGPC

SEQ ID NO: 1077873 - protein, 9 aa, Homo Sapiens
KLAPTDVGL

SEQ ID NO: 1077874 - protein, 9 aa, Homo Sapiens
VVSFYLVAG

SEQ ID NO: 1077875 - protein, 9 aa, Homo Sapiens
LRGVSKFQH

SEQ ID NO: 1077876 - protein, 9 aa, Homo Sapiens
NLGVFNNQE

SEQ ID NO: 1077877 - protein, 9 aa, Homo Sapiens
FPFGETEVY

SEQ ID NO: 1077878 - protein, 9 aa, Homo Sapiens
QIRQIYYTE

SEQ ID NO: 1077879 - protein, 9 aa, Homo Sapiens
SSVVVLPIT

SEQ ID NO: 1077880 - protein, 9 aa, Homo Sapiens
SYFIRNMEK

SEQ ID NO: 1077881 - protein, 9 aa, Homo Sapiens
ALYVLIGTG

SEQ ID NO: 1077882 - protein, 9 aa, Homo Sapiens
PDEKVCWTS

SEQ ID NO: 1077883 - protein, 9 aa, Homo Sapiens
KQHFILFQP

SEQ ID NO: 1077884 - protein, 9 aa, Homo Sapiens
QEQEALVKR

SEQ ID NO: 1077885 - protein, 9 aa, Homo Sapiens
IHSNLLRCD

SEQ ID NO: 1077886 - protein, 9 aa, Homo Sapiens
MLNEKGTSL

SEQ ID NO: 1077887 - protein, 9 aa, Homo Sapiens
RKKHLTYAE

SEQ ID NO: 1077888 - protein, 9 aa, Homo Sapiens
GSTNLAVYE

SEQ ID NO: 1077889 - protein, 9 aa, Homo Sapiens
FVYSQLPGQ

SEQ ID NO: 1077890 - protein, 9 aa, Homo Sapiens
KILHFAVAE

SEQ ID NO: 1077891 - protein, 9 aa, Homo Sapiens
NLTQRLEAL

SEQ ID NO: 1077892 - protein, 9 aa, Homo Sapiens
KTVITDEAQ

SEQ ID NO: 1077893 - protein, 9 aa, Homo Sapiens
VTHQFTSSG

SEQ ID NO: 1077894 - protein, 9 aa, Homo Sapiens
NPYTVPEHL

SEQ ID NO: 1077895 - protein, 9 aa, Homo Sapiens
LSSATLNIS

SEQ ID NO: 1077896 - protein, 9 aa, Homo Sapiens
PEFIFYNRY

SEQ ID NO: 1077897 - protein, 9 aa, Homo Sapiens
TDWANKENP

SEQ ID NO: 1077898 - protein, 9 aa, Homo Sapiens
FCPPDPHKG

SEQ ID NO: 1077899 - protein, 9 aa, Homo Sapiens
KQNWELREE

SEQ ID NO: 1077900 - protein, 9 aa, Homo Sapiens
TSQVAMQVL

SEQ ID NO: 1077901 - protein, 9 aa, Homo Sapiens
PREDQGQDG

SEQ ID NO: 1077902 - protein, 9 aa, Homo Sapiens
QPYASVQFA

SEQ ID NO: 1077903 - protein, 9 aa, Homo Sapiens
TQLWVELVV

SEQ ID NO: 1077904 - protein, 9 aa, Homo Sapiens
SPGYQGPSG

SEQ ID NO: 1077905 - protein, 9 aa, Homo Sapiens
LLIFFRFIG

SEQ ID NO: 1077906 - protein, 9 aa, Homo Sapiens
IPTLYHFST

SEQ ID NO: 1077907 - protein, 9 aa, Homo Sapiens
RPKTRFQEQ

SEQ ID NO: 1077908 - protein, 9 aa, Homo Sapiens
APSWPLYAP

SEQ ID NO: 1077909 - protein, 9 aa, Homo Sapiens
LGDLSEGPE

SEQ ID NO: 1077910 - protein, 9 aa, Homo Sapiens
RTATNMKYL

SEQ ID NO: 1077911 - protein, 9 aa, Homo Sapiens
MNRAPQRQH

SEQ ID NO: 1077912 - protein, 9 aa, Homo Sapiens
MLIKILNER

SEQ ID NO: 1077913 - protein, 9 aa, Homo Sapiens
KATVLVRGP

SEQ ID NO: 1077914 - protein, 9 aa, Homo Sapiens
TRFVCVGVP

SEQ ID NO: 1077915 - protein, 9 aa, Homo Sapiens
CRQSSGKNC

SEQ ID NO: 1077916 - protein, 9 aa, Homo Sapiens
TPYKWMRRS

SEQ ID NO: 1077917 - protein, 9 aa, Homo Sapiens
VLTELWPQE

SEQ ID NO: 1077918 - protein, 9 aa, Homo Sapiens
HEQLCAFKL

SEQ ID NO: 1077919 - protein, 9 aa, Homo Sapiens
GILMSHVAR

SEQ ID NO: 1077920 - protein, 9 aa, Homo Sapiens
VQETKIQSI

SEQ ID NO: 1077921 - protein, 9 aa, Homo Sapiens
RLAILGVPV

SEQ ID NO: 1077922 - protein, 9 aa, Homo Sapiens
KPYLRISDN

SEQ ID NO: 1077923 - protein, 9 aa, Homo Sapiens
SLQGDFCQA

SEQ ID NO: 1077924 - protein, 9 aa, Homo Sapiens
TLWIRTHLS

SEQ ID NO: 1077925 - protein, 9 aa, Homo Sapiens
VEDIVAIII

SEQ ID NO: 1077926 - protein, 9 aa, Homo Sapiens
PSAASQTYE

SEQ ID NO: 1077927 - protein, 9 aa, Homo Sapiens
TLKAWREDG

SEQ ID NO: 1077928 - protein, 9 aa, Homo Sapiens
MDIQKCRRL

SEQ ID NO: 1077929 - protein, 9 aa, Homo Sapiens
EKREDSGTG

SEQ ID NO: 1077930 - protein, 9 aa, Homo Sapiens
PKPALLAKE

SEQ ID NO: 1077931 - protein, 9 aa, Homo Sapiens
AAVAAASAG

SEQ ID NO: 1077932 - protein, 9 aa, Homo Sapiens
LVLILSGKS

SEQ ID NO: 1077933 - protein, 9 aa, Homo Sapiens
DSLNNLQDP

SEQ ID NO: 1077934 - protein, 9 aa, Homo Sapiens
SSGEFTVFA

SEQ ID NO: 1077935 - protein, 9 aa, Homo Sapiens
PKVKAEMKT

SEQ ID NO: 1077936 - protein, 9 aa, Homo Sapiens
KEVPADILT

SEQ ID NO: 1077937 - protein, 9 aa, Homo Sapiens
WYLHNCRIA

SEQ ID NO: 1077938 - protein, 9 aa, Homo Sapiens
SEGPEDQAV

SEQ ID NO: 1077939 - protein, 9 aa, Homo Sapiens
EKCRLLGKF

SEQ ID NO: 1077940 - protein, 9 aa, Homo Sapiens
LSNSCILFL

SEQ ID NO: 1077941 - protein, 9 aa, Homo Sapiens
RTQKNEFLI

SEQ ID NO: 1077942 - protein, 9 aa, Homo Sapiens
RTAVTTLKG

SEQ ID NO: 1077943 - protein, 9 aa, Homo Sapiens
CRAFKTHSS

SEQ ID NO: 1077944 - protein, 9 aa, Homo Sapiens
QPLIEGPRV

SEQ ID NO: 1077945 - protein, 9 aa, Homo Sapiens
GTSAAPPIQ

SEQ ID NO: 1077946 - protein, 9 aa, Homo Sapiens
AGFGAVYAA

SEQ ID NO: 1077947 - protein, 9 aa, Homo Sapiens
SSFSEEEES

SEQ ID NO: 1077948 - protein, 9 aa, Homo Sapiens
SCLHSLPIT

SEQ ID NO: 1077949 - protein, 9 aa, Homo Sapiens
EVELKKRVV

SEQ ID NO: 1077950 - protein, 9 aa, Homo Sapiens
SDESDDLSE

SEQ ID NO: 1077951 - protein, 9 aa, Homo Sapiens
HIDSFIGFP

SEQ ID NO: 1077952 - protein, 9 aa, Homo Sapiens
LPLDVENIQ

SEQ ID NO: 1077953 - protein, 9 aa, Homo Sapiens
MVFMGARGN

SEQ ID NO: 1077954 - protein, 9 aa, Homo Sapiens
VEKGLHDLL

SEQ ID NO: 1077955 - protein, 9 aa, Homo Sapiens
SQNTDKTFQ

SEQ ID NO: 1077956 - protein, 9 aa, Homo Sapiens
TFNNKENET

SEQ ID NO: 1077957 - protein, 9 aa, Homo Sapiens
KVCSAAARL

SEQ ID NO: 1077958 - protein, 9 aa, Homo Sapiens
AKVEPPTVK

SEQ ID NO: 1077959 - protein, 9 aa, Homo Sapiens
SYKLRPDRE

SEQ ID NO: 1077960 - protein, 9 aa, Homo Sapiens
YGEVIHQMP

SEQ ID NO: 1077961 - protein, 9 aa, Homo Sapiens
YDIFSFKKL

SEQ ID NO: 1077962 - protein, 9 aa, Homo Sapiens
TTVPKMASN

SEQ ID NO: 1077963 - protein, 9 aa, Homo Sapiens
PLSALLFLF

SEQ ID NO: 1077964 - protein, 9 aa, Homo Sapiens
QQKAKDGRE

SEQ ID NO: 1077965 - protein, 9 aa, Homo Sapiens
TIGPSNTTG

SEQ ID NO: 1077966 - protein, 9 aa, Homo Sapiens
SMLGRADTA

SEQ ID NO: 1077967 - protein, 9 aa, Homo Sapiens
PVLVCALSN

SEQ ID NO: 1077968 - protein, 9 aa, Homo Sapiens
TPTHLSVKG

SEQ ID NO: 1077969 - protein, 9 aa, Homo Sapiens
VKGKHESYR

SEQ ID NO: 1077970 - protein, 9 aa, Homo Sapiens
AALLVTMGI

SEQ ID NO: 1077971 - protein, 9 aa, Homo Sapiens
NPASNDSCL

SEQ ID NO: 1077972 - protein, 9 aa, Homo Sapiens
NLPCLPDSG

SEQ ID NO: 1077973 - protein, 9 aa, Homo Sapiens
PLSEDPNWN

SEQ ID NO: 1077974 - protein, 9 aa, Homo Sapiens
ERELTMDLH

SEQ ID NO: 1077975 - protein, 9 aa, Homo Sapiens
YISLEYRSI

SEQ ID NO: 1077976 - protein, 9 aa, Homo Sapiens
TQDPIWKKI

SEQ ID NO: 1077977 - protein, 9 aa, Homo Sapiens
FRGKTKSFL

SEQ ID NO: 1077978 - protein, 9 aa, Homo Sapiens
RGAGRVCRW

SEQ ID NO: 1077979 - protein, 9 aa, Homo Sapiens
KRRNHLKKA

SEQ ID NO: 1077980 - protein, 9 aa, Homo Sapiens
MYRVKGLQA

SEQ ID NO: 1077981 - protein, 9 aa, Homo Sapiens
PPSYSGCAG

SEQ ID NO: 1077982 - protein, 9 aa, Homo Sapiens
KCPRRRVFT

SEQ ID NO: 1077983 - protein, 9 aa, Homo Sapiens
DVIEVVLEP

SEQ ID NO: 1077984 - protein, 9 aa, Homo Sapiens
SVCNSATGK

SEQ ID NO: 1077985 - protein, 9 aa, Homo Sapiens
EILAVIKLA

SEQ ID NO: 1077986 - protein, 9 aa, Homo Sapiens
GGTTEELEN

SEQ ID NO: 1077987 - protein, 9 aa, Homo Sapiens
FNALCAARL

SEQ ID NO: 1077988 - protein, 9 aa, Homo Sapiens
TFALEFLII

SEQ ID NO: 1077989 - protein, 9 aa, Homo Sapiens
MLQVCQQEG

SEQ ID NO: 1077990 - protein, 9 aa, Homo Sapiens
FLLLAAGLM

SEQ ID NO: 1077991 - protein, 9 aa, Homo Sapiens
RFSARYNFT

SEQ ID NO: 1077992 - protein, 9 aa, Homo Sapiens
VPPDQLPLS

SEQ ID NO: 1077993 - protein, 9 aa, Homo Sapiens
PDAQKKKEE

SEQ ID NO: 1077994 - protein, 9 aa, Homo Sapiens
AHYPTPAKL

SEQ ID NO: 1077995 - protein, 9 aa, Homo Sapiens
AGLDPHFVL

SEQ ID NO: 1077996 - protein, 9 aa, Homo Sapiens
PGDDLRNTK

SEQ ID NO: 1077997 - protein, 9 aa, Homo Sapiens
YRLDLDCGA

SEQ ID NO: 1077998 - protein, 9 aa, Homo Sapiens
IVGMATMIL

SEQ ID NO: 1077999 - protein, 9 aa, Homo Sapiens
TWGTDTPPA

SEQ ID NO: 1078000 - protein, 9 aa, Homo Sapiens
EVSPPDANV

SEQ ID NO: 1078001 - protein, 9 aa, Homo Sapiens
EQPLSTAEI

SEQ ID NO: 1078002 - protein, 9 aa, Homo Sapiens
RKIASEYKY

SEQ ID NO: 1078003 - protein, 9 aa, Homo Sapiens
STNPFSKDF

SEQ ID NO: 1078004 - protein, 9 aa, Homo Sapiens
LHLPADVDP

SEQ ID NO: 1078005 - protein, 9 aa, Homo Sapiens
MFHPMGPPS

SEQ ID NO: 1078006 - protein, 9 aa, Homo Sapiens
QILKTEYEF

SEQ ID NO: 1078007 - protein, 9 aa, Homo Sapiens
YSNKVYELA

SEQ ID NO: 1078008 - protein, 9 aa, Homo Sapiens
KSPETFKKA

SEQ ID NO: 1078009 - protein, 9 aa, Homo Sapiens
LAELSTVLS

SEQ ID NO: 1078010 - protein, 9 aa, Homo Sapiens
QGKEDEEGE

SEQ ID NO: 1078011 - protein, 9 aa, Homo Sapiens
NAHLNSSQN

SEQ ID NO: 1078012 - protein, 9 aa, Homo Sapiens
LHSLMYFLL

SEQ ID NO: 1078013 - protein, 9 aa, Homo Sapiens
TPSVYLELT

SEQ ID NO: 1078014 - protein, 9 aa, Homo Sapiens
IVVEKDGFL

SEQ ID NO: 1078015 - protein, 9 aa, Homo Sapiens
KEELLKLAR

SEQ ID NO: 1078016 - protein, 9 aa, Homo Sapiens
GLWKSKEDN

SEQ ID NO: 1078017 - protein, 9 aa, Homo Sapiens
SASTGDSTL

SEQ ID NO: 1078018 - protein, 9 aa, Homo Sapiens
VSESLWLHA

SEQ ID NO: 1078019 - protein, 9 aa, Homo Sapiens
RIHTAEKPN

SEQ ID NO: 1078020 - protein, 9 aa, Homo Sapiens
VTQAEIYWV

SEQ ID NO: 1078021 - protein, 9 aa, Homo Sapiens
FSQSQQGCC

SEQ ID NO: 1078022 - protein, 9 aa, Homo Sapiens
NDFENYNQQ

SEQ ID NO: 1078023 - protein, 9 aa, Homo Sapiens
SAHGAVTSS

SEQ ID NO: 1078024 - protein, 9 aa, Homo Sapiens
LPKDDSPQL

SEQ ID NO: 1078025 - protein, 9 aa, Homo Sapiens
LVLVLELLP

SEQ ID NO: 1078026 - protein, 9 aa, Homo Sapiens
IPKLLVNLW

SEQ ID NO: 1078027 - protein, 9 aa, Homo Sapiens
GSQVKKGSY

SEQ ID NO: 1078028 - protein, 9 aa, Homo Sapiens
DSSASYKKE

SEQ ID NO: 1078029 - protein, 9 aa, Homo Sapiens
IQCRADQFF

SEQ ID NO: 1078030 - protein, 9 aa, Homo Sapiens
PPFTPTPPC

SEQ ID NO: 1078031 - protein, 9 aa, Homo Sapiens
TAIKYHISQ

SEQ ID NO: 1078032 - protein, 9 aa, Homo Sapiens
ALNNDSEKV

SEQ ID NO: 1078033 - protein, 9 aa, Homo Sapiens
QCVLSSSSH

SEQ ID NO: 1078034 - protein, 9 aa, Homo Sapiens
ERISLVLLL

SEQ ID NO: 1078035 - protein, 9 aa, Homo Sapiens
FSILERHHL

SEQ ID NO: 1078036 - protein, 9 aa, Homo Sapiens
NISSMLTKC

SEQ ID NO: 1078037 - protein, 9 aa, Homo Sapiens
IVVQAFLSM

SEQ ID NO: 1078038 - protein, 9 aa, Homo Sapiens
RSINLFGNS

SEQ ID NO: 1078039 - protein, 9 aa, Homo Sapiens
VRFFVKIVG

SEQ ID NO: 1078040 - protein, 9 aa, Homo Sapiens
SKAIWLLWG

SEQ ID NO: 1078041 - protein, 9 aa, Homo Sapiens
RPFRKHGVA

SEQ ID NO: 1078042 - protein, 9 aa, Homo Sapiens
PGTYNEPQT

SEQ ID NO: 1078043 - protein, 9 aa, Homo Sapiens
TRTKCANPV

SEQ ID NO: 1078044 - protein, 9 aa, Homo Sapiens
CVLEKQISV

SEQ ID NO: 1078045 - protein, 9 aa, Homo Sapiens
KTHPTVPGI

SEQ ID NO: 1078046 - protein, 9 aa, Homo Sapiens
NAFSGEYIP

SEQ ID NO: 1078047 - protein, 9 aa, Homo Sapiens
KDKVLYKCR

SEQ ID NO: 1078048 - protein, 9 aa, Homo Sapiens
FNDLDFLKQ

SEQ ID NO: 1078049 - protein, 9 aa, Homo Sapiens
NALCAARLQ

SEQ ID NO: 1078050 - protein, 9 aa, Homo Sapiens
KKGFNLPVL

SEQ ID NO: 1078051 - protein, 9 aa, Homo Sapiens
RFGLWKSKE

SEQ ID NO: 1078052 - protein, 9 aa, Homo Sapiens
PGRGGSSWS

SEQ ID NO: 1078053 - protein, 9 aa, Homo Sapiens
NLLRCDCVI

SEQ ID NO: 1078054 - protein, 9 aa, Homo Sapiens
SKNIADPTL

SEQ ID NO: 1078055 - protein, 9 aa, Homo Sapiens
SFQSPLGAP

SEQ ID NO: 1078056 - protein, 9 aa, Homo Sapiens
KSDDSNSSL

SEQ ID NO: 1078057 - protein, 9 aa, Homo Sapiens
AFPMKKGPC

SEQ ID NO: 1078058 - protein, 9 aa, Homo Sapiens
VVTGGAVKK

SEQ ID NO: 1078059 - protein, 9 aa, Homo Sapiens
TFVVSFYLV

SEQ ID NO: 1078060 - protein, 9 aa, Homo Sapiens
ENNQACNST

SEQ ID NO: 1078061 - protein, 9 aa, Homo Sapiens
KPEEEIAME

SEQ ID NO: 1078062 - protein, 9 aa, Homo Sapiens
QMLYGLQPP

SEQ ID NO: 1078063 - protein, 9 aa, Homo Sapiens
LSTTPLQNA

SEQ ID NO: 1078064 - protein, 9 aa, Homo Sapiens
LWRRVLGIF

SEQ ID NO: 1078065 - protein, 9 aa, Homo Sapiens
CGSCGGSKE

SEQ ID NO: 1078066 - protein, 9 aa, Homo Sapiens
GEIFGGQGN

SEQ ID NO: 1078067 - protein, 9 aa, Homo Sapiens
SPLPTYHVL

SEQ ID NO: 1078068 - protein, 9 aa, Homo Sapiens
EDQGQDGAA

SEQ ID NO: 1078069 - protein, 9 aa, Homo Sapiens
AIRGPAYML

SEQ ID NO: 1078070 - protein, 9 aa, Homo Sapiens
PTHSGARLT

SEQ ID NO: 1078071 - protein, 9 aa, Homo Sapiens
SDILPMVGP

SEQ ID NO: 1078072 - protein, 9 aa, Homo Sapiens
CFCLLDNTC

SEQ ID NO: 1078073 - protein, 9 aa, Homo Sapiens
VLDSGGQRT

SEQ ID NO: 1078074 - protein, 9 aa, Homo Sapiens
EFENFKTLH

SEQ ID NO: 1078075 - protein, 9 aa, Homo Sapiens
KKCEDAYPR

SEQ ID NO: 1078076 - protein, 9 aa, Homo Sapiens
ENSHSLSPE

SEQ ID NO: 1078077 - protein, 9 aa, Homo Sapiens
NKLDALGRG

SEQ ID NO: 1078078 - protein, 9 aa, Homo Sapiens
DRLVQEGVI

SEQ ID NO: 1078079 - protein, 9 aa, Homo Sapiens
VDSDSESTE

SEQ ID NO: 1078080 - protein, 9 aa, Homo Sapiens
EEEHLVKCL

SEQ ID NO: 1078081 - protein, 9 aa, Homo Sapiens
FSFSFGFPH

SEQ ID NO: 1078082 - protein, 9 aa, Homo Sapiens
VCDCVEVYL

SEQ ID NO: 1078083 - protein, 9 aa, Homo Sapiens
TGGSLGGSA

SEQ ID NO: 1078084 - protein, 9 aa, Homo Sapiens
KRIESSGSC

SEQ ID NO: 1078085 - protein, 9 aa, Homo Sapiens
DAGAAEFQR

SEQ ID NO: 1078086 - protein, 9 aa, Homo Sapiens
AGIDLREFP

SEQ ID NO: 1078087 - protein, 9 aa, Homo Sapiens
NATSQVAMQ

SEQ ID NO: 1078088 - protein, 9 aa, Homo Sapiens
LSVTLPHII

SEQ ID NO: 1078089 - protein, 9 aa, Homo Sapiens
VSFNHNVLG

SEQ ID NO: 1078090 - protein, 9 aa, Homo Sapiens
KGIFTQIST

SEQ ID NO: 1078091 - protein, 9 aa, Homo Sapiens
DALWGKAPC

SEQ ID NO: 1078092 - protein, 9 aa, Homo Sapiens
WIANWLVVT

SEQ ID NO: 1078093 - protein, 9 aa, Homo Sapiens
PGNPPLHLP

SEQ ID NO: 1078094 - protein, 9 aa, Homo Sapiens
SLPWVKSSH

SEQ ID NO: 1078095 - protein, 9 aa, Homo Sapiens
LPRPLLMLA

SEQ ID NO: 1078096 - protein, 9 aa, Homo Sapiens
VQVTISADK

SEQ ID NO: 1078097 - protein, 9 aa, Homo Sapiens
IEVLCKSLA

SEQ ID NO: 1078098 - protein, 9 aa, Homo Sapiens
ITFDTFVYS

SEQ ID NO: 1078099 - protein, 9 aa, Homo Sapiens
EDNHSKRSH

SEQ ID NO: 1078100 - protein, 9 aa, Homo Sapiens
EWTSLASAG

SEQ ID NO: 1078101 - protein, 9 aa, Homo Sapiens
FYRSLPPAA

SEQ ID NO: 1078102 - protein, 9 aa, Homo Sapiens
IVGDIWWFF

SEQ ID NO: 1078103 - protein, 9 aa, Homo Sapiens
QVARPQFSA

SEQ ID NO: 1078104 - protein, 9 aa, Homo Sapiens
PEILSDNVV

SEQ ID NO: 1078105 - protein, 9 aa, Homo Sapiens
NNDSEKVVQ

SEQ ID NO: 1078106 - protein, 9 aa, Homo Sapiens
QSVLGGRSH

SEQ ID NO: 1078107 - protein, 9 aa, Homo Sapiens
CRKAFFSKR

SEQ ID NO: 1078108 - protein, 9 aa, Homo Sapiens
FFLQCDSDP

SEQ ID NO: 1078109 - protein, 9 aa, Homo Sapiens
AEEDKILLL

SEQ ID NO: 1078110 - protein, 9 aa, Homo Sapiens
AGQRVSQTL

SEQ ID NO: 1078111 - protein, 9 aa, Homo Sapiens
GCPKKAAGD

SEQ ID NO: 1078112 - protein, 9 aa, Homo Sapiens
QEVQEKFEG

SEQ ID NO: 1078113 - protein, 9 aa, Homo Sapiens
DPKTGECLC

SEQ ID NO: 1078114 - protein, 9 aa, Homo Sapiens
ELRPGLQYW

SEQ ID NO: 1078115 - protein, 9 aa, Homo Sapiens
QSSFNIEEF

SEQ ID NO: 1078116 - protein, 9 aa, Homo Sapiens
KSLALDINE

SEQ ID NO: 1078117 - protein, 9 aa, Homo Sapiens
SNYSLPSPL

SEQ ID NO: 1078118 - protein, 9 aa, Homo Sapiens
GLFTYVSRA

SEQ ID NO: 1078119 - protein, 9 aa, Homo Sapiens
ALPSAPHGD

SEQ ID NO: 1078120 - protein, 9 aa, Homo Sapiens
SLNIHQRTH

SEQ ID NO: 1078121 - protein, 9 aa, Homo Sapiens
SAEPEPIPK

SEQ ID NO: 1078122 - protein, 9 aa, Homo Sapiens
TKYILCKKK

SEQ ID NO: 1078123 - protein, 9 aa, Homo Sapiens
AERVGEVLL

SEQ ID NO: 1078124 - protein, 9 aa, Homo Sapiens
LGEKVLDLI

SEQ ID NO: 1078125 - protein, 9 aa, Homo Sapiens
GEASSLSSL

SEQ ID NO: 1078126 - protein, 9 aa, Homo Sapiens
RKKYHERMS

SEQ ID NO: 1078127 - protein, 9 aa, Homo Sapiens
KNGYISSNY

SEQ ID NO: 1078128 - protein, 9 aa, Homo Sapiens
SVIPKLLVN

SEQ ID NO: 1078129 - protein, 9 aa, Homo Sapiens
RLHGFSILE

SEQ ID NO: 1078130 - protein, 9 aa, Homo Sapiens
ITGGSLGGS

SEQ ID NO: 1078131 - protein, 9 aa, Homo Sapiens
KSQRLKVSE

SEQ ID NO: 1078132 - protein, 9 aa, Homo Sapiens
RRKKGSLPR

SEQ ID NO: 1078133 - protein, 9 aa, Homo Sapiens
TTEMDIQKC

SEQ ID NO: 1078134 - protein, 9 aa, Homo Sapiens
DVGRLECPP

SEQ ID NO: 1078135 - protein, 9 aa, Homo Sapiens
PFCGHCIIP

SEQ ID NO: 1078136 - protein, 9 aa, Homo Sapiens
LALAQLNGC

SEQ ID NO: 1078137 - protein, 9 aa, Homo Sapiens
WALVLLMLF

SEQ ID NO: 1078138 - protein, 9 aa, Homo Sapiens
RGGSSWSSA

SEQ ID NO: 1078139 - protein, 9 aa, Homo Sapiens
VVAVDGDLG

SEQ ID NO: 1078140 - protein, 9 aa, Homo Sapiens
PGATPQPGH

SEQ ID NO: 1078141 - protein, 9 aa, Homo Sapiens
LQSDTLTFS

SEQ ID NO: 1078142 - protein, 9 aa, Homo Sapiens
LGLLIFFRF

SEQ ID NO: 1078143 - protein, 9 aa, Homo Sapiens
KKHLTYAEF

SEQ ID NO: 1078144 - protein, 9 aa, Homo Sapiens
WRKTVRVKA

SEQ ID NO: 1078145 - protein, 9 aa, Homo Sapiens
NVLENKLLP

SEQ ID NO: 1078146 - protein, 9 aa, Homo Sapiens
FENYNQQPS

SEQ ID NO: 1078147 - protein, 9 aa, Homo Sapiens
LSEIVGIIK

SEQ ID NO: 1078148 - protein, 9 aa, Homo Sapiens
TTSTSWDQE

SEQ ID NO: 1078149 - protein, 9 aa, Homo Sapiens
KESLRGKAL

SEQ ID NO: 1078150 - protein, 9 aa, Homo Sapiens
FVEWRAQSE

SEQ ID NO: 1078151 - protein, 9 aa, Homo Sapiens
CRMPPSCSD

SEQ ID NO: 1078152 - protein, 9 aa, Homo Sapiens
LPRETSTPG

SEQ ID NO: 1078153 - protein, 9 aa, Homo Sapiens
ESRKSCIVG

SEQ ID NO: 1078154 - protein, 9 aa, Homo Sapiens
PMGINNRFS

SEQ ID NO: 1078155 - protein, 9 aa, Homo Sapiens
IHGNYSCSL

SEQ ID NO: 1078156 - protein, 9 aa, Homo Sapiens
PRGYKSTQV

SEQ ID NO: 1078157 - protein, 9 aa, Homo Sapiens
TEFPETWGT

SEQ ID NO: 1078158 - protein, 9 aa, Homo Sapiens
QDARYRLEM

SEQ ID NO: 1078159 - protein, 9 aa, Homo Sapiens
TKIGMILSR

SEQ ID NO: 1078160 - protein, 9 aa, Homo Sapiens
AALGLGGSW

SEQ ID NO: 1078161 - protein, 9 aa, Homo Sapiens
DSVLNIATE

SEQ ID NO: 1078162 - protein, 9 aa, Homo Sapiens
PLESQADVH

SEQ ID NO: 1078163 - protein, 9 aa, Homo Sapiens
ICVFNYYYL

SEQ ID NO: 1078164 - protein, 9 aa, Homo Sapiens
SQAEAESWY

SEQ ID NO: 1078165 - protein, 9 aa, Homo Sapiens
HWLSTVEHA

SEQ ID NO: 1078166 - protein, 9 aa, Homo Sapiens
FHPMGPPSP

SEQ ID NO: 1078167 - protein, 9 aa, Homo Sapiens
GKQNSNITQ

SEQ ID NO: 1078168 - protein, 9 aa, Homo Sapiens
EALFTIGGN

SEQ ID NO: 1078169 - protein, 9 aa, Homo Sapiens
LCLETYDEP

SEQ ID NO: 1078170 - protein, 9 aa, Homo Sapiens
PSLGGDGRK

SEQ ID NO: 1078171 - protein, 9 aa, Homo Sapiens
QSCDLRRLE

SEQ ID NO: 1078172 - protein, 9 aa, Homo Sapiens
MASNYLSGS

SEQ ID NO: 1078173 - protein, 9 aa, Homo Sapiens
VLYPIWYQC

SEQ ID NO: 1078174 - protein, 9 aa, Homo Sapiens
EDKVKALLE

SEQ ID NO: 1078175 - protein, 9 aa, Homo Sapiens
DFCLYKREK

SEQ ID NO: 1078176 - protein, 9 aa, Homo Sapiens
TVNFENLNG

SEQ ID NO: 1078177 - protein, 9 aa, Homo Sapiens
LLALLSPGT

SEQ ID NO: 1078178 - protein, 9 aa, Homo Sapiens
SDLTVTSRR

SEQ ID NO: 1078179 - protein, 9 aa, Homo Sapiens
CVQGRGEAA

SEQ ID NO: 1078180 - protein, 9 aa, Homo Sapiens
YSLEEQQVC

SEQ ID NO: 1078181 - protein, 9 aa, Homo Sapiens
YVITRAFCL

SEQ ID NO: 1078182 - protein, 9 aa, Homo Sapiens
HQSGLLEET

SEQ ID NO: 1078183 - protein, 9 aa, Homo Sapiens
EIVSAQKIY

SEQ ID NO: 1078184 - protein, 9 aa, Homo Sapiens
SPLSGKRRS

SEQ ID NO: 1078185 - protein, 9 aa, Homo Sapiens
SAPHPEGLA

SEQ ID NO: 1078186 - protein, 9 aa, Homo Sapiens
LEFLIISNN

SEQ ID NO: 1078187 - protein, 9 aa, Homo Sapiens
THRVLRRLF

SEQ ID NO: 1078188 - protein, 9 aa, Homo Sapiens
NTSFTIFEK

SEQ ID NO: 1078189 - protein, 9 aa, Homo Sapiens
LTPPASDGD

SEQ ID NO: 1078190 - protein, 9 aa, Homo Sapiens
NFFLTTAIG

SEQ ID NO: 1078191 - protein, 9 aa, Homo Sapiens
FKKTHRVLR

SEQ ID NO: 1078192 - protein, 9 aa, Homo Sapiens
LLEATFLID

SEQ ID NO: 1078193 - protein, 9 aa, Homo Sapiens
DNDDCQIKK

SEQ ID NO: 1078194 - protein, 9 aa, Homo Sapiens
AAIQVPISD

SEQ ID NO: 1078195 - protein, 9 aa, Homo Sapiens
LGSLEVKEA

SEQ ID NO: 1078196 - protein, 9 aa, Homo Sapiens
FGEPQIGGF

SEQ ID NO: 1078197 - protein, 9 aa, Homo Sapiens
NSIFFQSCM

SEQ ID NO: 1078198 - protein, 9 aa, Homo Sapiens
HWLQKVQGL

SEQ ID NO: 1078199 - protein, 9 aa, Homo Sapiens
SLSRTSTTL

SEQ ID NO: 1078200 - protein, 9 aa, Homo Sapiens
KPCFLRWDE

SEQ ID NO: 1078201 - protein, 9 aa, Homo Sapiens
YSKRDRNFT

SEQ ID NO: 1078202 - protein, 9 aa, Homo Sapiens
AVGAGLFPL

SEQ ID NO: 1078203 - protein, 9 aa, Homo Sapiens
DASSLGPYL

SEQ ID NO: 1078204 - protein, 9 aa, Homo Sapiens
LLGFSLLKP

SEQ ID NO: 1078205 - protein, 9 aa, Homo Sapiens
PDLWIHHEK

SEQ ID NO: 1078206 - protein, 9 aa, Homo Sapiens
WIESMWCMV

SEQ ID NO: 1078207 - protein, 9 aa, Homo Sapiens
SGCHLSLGP

SEQ ID NO: 1078208 - protein, 9 aa, Homo Sapiens
LNILEENIW

SEQ ID NO: 1078209 - protein, 9 aa, Homo Sapiens
PFSAVPGDS

SEQ ID NO: 1078210 - protein, 9 aa, Homo Sapiens
YCPRCQKLE

SEQ ID NO: 1078211 - protein, 9 aa, Homo Sapiens
QEDTLFDVA

SEQ ID NO: 1078212 - protein, 9 aa, Homo Sapiens
YPVVSKGKA

SEQ ID NO: 1078213 - protein, 9 aa, Homo Sapiens
LLFAELKEK

SEQ ID NO: 1078214 - protein, 9 aa, Homo Sapiens
AVTTLKGET

SEQ ID NO: 1078215 - protein, 9 aa, Homo Sapiens
TPTSLHSHN

SEQ ID NO: 1078216 - protein, 9 aa, Homo Sapiens
WGGQAEKLG

SEQ ID NO: 1078217 - protein, 9 aa, Homo Sapiens
SVPVVYTTV

SEQ ID NO: 1078218 - protein, 9 aa, Homo Sapiens
NLPKEEKKA

SEQ ID NO: 1078219 - protein, 9 aa, Homo Sapiens
NMEKSYVNL

SEQ ID NO: 1078220 - protein, 9 aa, Homo Sapiens
FSSCSDHCI

SEQ ID NO: 1078221 - protein, 9 aa, Homo Sapiens
NTFESLVLN

SEQ ID NO: 1078222 - protein, 9 aa, Homo Sapiens
FLHNNRMTH

SEQ ID NO: 1078223 - protein, 9 aa, Homo Sapiens
LGKFSLVQK

SEQ ID NO: 1078224 - protein, 9 aa, Homo Sapiens
LISDLLMRK

SEQ ID NO: 1078225 - protein, 9 aa, Homo Sapiens
GEEDETSLQ

SEQ ID NO: 1078226 - protein, 9 aa, Homo Sapiens
LLAKEPLEK

SEQ ID NO: 1078227 - protein, 9 aa, Homo Sapiens
ILVVWDNTE

SEQ ID NO: 1078228 - protein, 9 aa, Homo Sapiens
GFSGAPGAK

SEQ ID NO: 1078229 - protein, 9 aa, Homo Sapiens
WAKELLAGW

SEQ ID NO: 1078230 - protein, 9 aa, Homo Sapiens
LARSLGDLS

SEQ ID NO: 1078231 - protein, 9 aa, Homo Sapiens
NPSNRCLKD

SEQ ID NO: 1078232 - protein, 9 aa, Homo Sapiens
SPMASMGPK

SEQ ID NO: 1078233 - protein, 9 aa, Homo Sapiens
LIEIDTIRY

SEQ ID NO: 1078234 - protein, 9 aa, Homo Sapiens
VTRRQRSSQ

SEQ ID NO: 1078235 - protein, 9 aa, Homo Sapiens
SYPVVSKGK

SEQ ID NO: 1078236 - protein, 9 aa, Homo Sapiens
IEATGGKYV

SEQ ID NO: 1078237 - protein, 9 aa, Homo Sapiens
VLIEIKNCQ

SEQ ID NO: 1078238 - protein, 9 aa, Homo Sapiens
IKKKNISLE

SEQ ID NO: 1078239 - protein, 9 aa, Homo Sapiens
SSSIGSAFK

SEQ ID NO: 1078240 - protein, 9 aa, Homo Sapiens
PFYFYVADN

SEQ ID NO: 1078241 - protein, 9 aa, Homo Sapiens
EKIREQEKM

SEQ ID NO: 1078242 - protein, 9 aa, Homo Sapiens
QTWQKMLAA

SEQ ID NO: 1078243 - protein, 9 aa, Homo Sapiens
FRKSDIKVL

SEQ ID NO: 1078244 - protein, 9 aa, Homo Sapiens
ELGKEIEAE

SEQ ID NO: 1078245 - protein, 9 aa, Homo Sapiens
TSSRVCDCV

SEQ ID NO: 1078246 - protein, 9 aa, Homo Sapiens
CPAGKKGEM

SEQ ID NO: 1078247 - protein, 9 aa, Homo Sapiens
AGDGDDSSV

SEQ ID NO: 1078248 - protein, 9 aa, Homo Sapiens
PTRLMFERT

SEQ ID NO: 1078249 - protein, 9 aa, Homo Sapiens
DLGAPGVSI

SEQ ID NO: 1078250 - protein, 9 aa, Homo Sapiens
CPELVNDDD

SEQ ID NO: 1078251 - protein, 9 aa, Homo Sapiens
RTCTLTLKK

SEQ ID NO: 1078252 - protein, 9 aa, Homo Sapiens
SARTTNSTA

SEQ ID NO: 1078253 - protein, 9 aa, Homo Sapiens
FAQSSSFSA

SEQ ID NO: 1078254 - protein, 9 aa, Homo Sapiens
AEEFTYNSF

SEQ ID NO: 1078255 - protein, 9 aa, Homo Sapiens
SSLGPYLLP

SEQ ID NO: 1078256 - protein, 9 aa, Homo Sapiens
SLLLPGRPC

SEQ ID NO: 1078257 - protein, 9 aa, Homo Sapiens
LVSLPWVKS

SEQ ID NO: 1078258 - protein, 9 aa, Homo Sapiens
LDIKPSNVE

SEQ ID NO: 1078259 - protein, 9 aa, Homo Sapiens
GDQYNCSRD

SEQ ID NO: 1078260 - protein, 9 aa, Homo Sapiens
GTVKEMQLE

SEQ ID NO: 1078261 - protein, 9 aa, Homo Sapiens
GSKEGCGSY

SEQ ID NO: 1078262 - protein, 9 aa, Homo Sapiens
RTAWVWSVD

SEQ ID NO: 1078263 - protein, 9 aa, Homo Sapiens
LQNEIQEGI

SEQ ID NO: 1078264 - protein, 9 aa, Homo Sapiens
QKRPWCSAT

SEQ ID NO: 1078265 - protein, 9 aa, Homo Sapiens
WIGVSVSSP

SEQ ID NO: 1078266 - protein, 9 aa, Homo Sapiens
QKPYRSEEI

SEQ ID NO: 1078267 - protein, 9 aa, Homo Sapiens
DLTKHKRIY

SEQ ID NO: 1078268 - protein, 9 aa, Homo Sapiens
EETEKTSNP

SEQ ID NO: 1078269 - protein, 9 aa, Homo Sapiens
IYAIFGMSS

SEQ ID NO: 1078270 - protein, 9 aa, Homo Sapiens
TTLRPEIFK

SEQ ID NO: 1078271 - protein, 9 aa, Homo Sapiens
RQSSGKNCD

SEQ ID NO: 1078272 - protein, 9 aa, Homo Sapiens
EDLEDQDLD

SEQ ID NO: 1078273 - protein, 9 aa, Homo Sapiens
FLCRQSSGK

SEQ ID NO: 1078274 - protein, 9 aa, Homo Sapiens
CIIPHTYCE

SEQ ID NO: 1078275 - protein, 9 aa, Homo Sapiens
FVDVIESNA

SEQ ID NO: 1078276 - protein, 9 aa, Homo Sapiens
WNNLHRHSE

SEQ ID NO: 1078277 - protein, 9 aa, Homo Sapiens
EKENEPSGR

SEQ ID NO: 1078278 - protein, 9 aa, Homo Sapiens
GKLYTGLTA

SEQ ID NO: 1078279 - protein, 9 aa, Homo Sapiens
LSVVSLFFE

SEQ ID NO: 1078280 - protein, 9 aa, Homo Sapiens
WFKNCRAKC

SEQ ID NO: 1078281 - protein, 9 aa, Homo Sapiens
RMEKIMRPV

SEQ ID NO: 1078282 - protein, 9 aa, Homo Sapiens
EKLIYDHLL

SEQ ID NO: 1078283 - protein, 9 aa, Homo Sapiens
KEDNHSKRS

SEQ ID NO: 1078284 - protein, 9 aa, Homo Sapiens
SFGVEWIAN

SEQ ID NO: 1078285 - protein, 9 aa, Homo Sapiens
RLVRKRLLC

SEQ ID NO: 1078286 - protein, 9 aa, Homo Sapiens
HLSVKGEKE

SEQ ID NO: 1078287 - protein, 9 aa, Homo Sapiens
TLPRETSTP

SEQ ID NO: 1078288 - protein, 9 aa, Homo Sapiens
VTKYILCKK

SEQ ID NO: 1078289 - protein, 9 aa, Homo Sapiens
YWPSREQPL

SEQ ID NO: 1078290 - protein, 9 aa, Homo Sapiens
WRPSQRRSK

SEQ ID NO: 1078291 - protein, 9 aa, Homo Sapiens
RQLHKFSSP

SEQ ID NO: 1078292 - protein, 9 aa, Homo Sapiens
PQNEHTTII

SEQ ID NO: 1078293 - protein, 9 aa, Homo Sapiens
GYQGPSGEP

SEQ ID NO: 1078294 - protein, 9 aa, Homo Sapiens
CKNASVFIS

SEQ ID NO: 1078295 - protein, 9 aa, Homo Sapiens
TLQNRGPKN

SEQ ID NO: 1078296 - protein, 9 aa, Homo Sapiens
IQVCSCRNS

SEQ ID NO: 1078297 - protein, 9 aa, Homo Sapiens
DCSRSGLGL

SEQ ID NO: 1078298 - protein, 9 aa, Homo Sapiens
QVLSQMKKI

SEQ ID NO: 1078299 - protein, 9 aa, Homo Sapiens
LVYRILEEP

SEQ ID NO: 1078300 - protein, 9 aa, Homo Sapiens
SPAPTTVSE

SEQ ID NO: 1078301 - protein, 9 aa, Homo Sapiens
SRGIKKKLS

SEQ ID NO: 1078302 - protein, 9 aa, Homo Sapiens
GKRIESSGS

SEQ ID NO: 1078303 - protein, 9 aa, Homo Sapiens
KRGRFPESS

SEQ ID NO: 1078304 - protein, 9 aa, Homo Sapiens
LKNGLPATE

SEQ ID NO: 1078305 - protein, 9 aa, Homo Sapiens
KTDAPRQRL

SEQ ID NO: 1078306 - protein, 9 aa, Homo Sapiens
MSWALVLLM

SEQ ID NO: 1078307 - protein, 9 aa, Homo Sapiens
GFRCSSSLC

SEQ ID NO: 1078308 - protein, 9 aa, Homo Sapiens
GLCIILGES

SEQ ID NO: 1078309 - protein, 9 aa, Homo Sapiens
QRFSEAFFY

SEQ ID NO: 1078310 - protein, 9 aa, Homo Sapiens
IGELLAKVE

SEQ ID NO: 1078311 - protein, 9 aa, Homo Sapiens
RDPNNIDEY

SEQ ID NO: 1078312 - protein, 9 aa, Homo Sapiens
TNSSLKVSP

SEQ ID NO: 1078313 - protein, 9 aa, Homo Sapiens
DKILAFVPE

SEQ ID NO: 1078314 - protein, 9 aa, Homo Sapiens
LFTIGGNAE

SEQ ID NO: 1078315 - protein, 9 aa, Homo Sapiens
SLEVPWKPV

SEQ ID NO: 1078316 - protein, 9 aa, Homo Sapiens
ILPSVSFEK

SEQ ID NO: 1078317 - protein, 9 aa, Homo Sapiens
TSLTTIGFE

SEQ ID NO: 1078318 - protein, 9 aa, Homo Sapiens
GLICAYEFA

SEQ ID NO: 1078319 - protein, 9 aa, Homo Sapiens
LQTEGVNAV

SEQ ID NO: 1078320 - protein, 9 aa, Homo Sapiens
MLTALYNLH

SEQ ID NO: 1078321 - protein, 9 aa, Homo Sapiens
KRRQMRKEV

SEQ ID NO: 1078322 - protein, 9 aa, Homo Sapiens
RGIKKKLSI

SEQ ID NO: 1078323 - protein, 9 aa, Homo Sapiens
GRLEENEIC

SEQ ID NO: 1078324 - protein, 9 aa, Homo Sapiens
GGDGRKRQV

SEQ ID NO: 1078325 - protein, 9 aa, Homo Sapiens
RSPFCSPFK

SEQ ID NO: 1078326 - protein, 9 aa, Homo Sapiens
QSDVDFYNK

SEQ ID NO: 1078327 - protein, 9 aa, Homo Sapiens
AEEVCNLLG

SEQ ID NO: 1078328 - protein, 9 aa, Homo Sapiens
KIMRPVEVR

SEQ ID NO: 1078329 - protein, 9 aa, Homo Sapiens
RMNYTLRKD

SEQ ID NO: 1078330 - protein, 9 aa, Homo Sapiens
CIDPIRCEK

SEQ ID NO: 1078331 - protein, 9 aa, Homo Sapiens
SRATPDEAA

SEQ ID NO: 1078332 - protein, 9 aa, Homo Sapiens
VGFFAVYVA

SEQ ID NO: 1078333 - protein, 9 aa, Homo Sapiens
PFEGFSLKA

SEQ ID NO: 1078334 - protein, 9 aa, Homo Sapiens
MEKSYVNLN

SEQ ID NO: 1078335 - protein, 9 aa, Homo Sapiens
SSRAIFFVG

SEQ ID NO: 1078336 - protein, 9 aa, Homo Sapiens
ILLEPISQY

SEQ ID NO: 1078337 - protein, 9 aa, Homo Sapiens
LIKILNERP

SEQ ID NO: 1078338 - protein, 9 aa, Homo Sapiens
MCDLCKSPP

SEQ ID NO: 1078339 - protein, 9 aa, Homo Sapiens
WRKKILFYC

SEQ ID NO: 1078340 - protein, 9 aa, Homo Sapiens
LFSHLNDIS

SEQ ID NO: 1078341 - protein, 9 aa, Homo Sapiens
PSYSGCAGD

SEQ ID NO: 1078342 - protein, 9 aa, Homo Sapiens
IQFNEKSSV

SEQ ID NO: 1078343 - protein, 9 aa, Homo Sapiens
NDISACQEI

SEQ ID NO: 1078344 - protein, 9 aa, Homo Sapiens
PVSLCYTPS

SEQ ID NO: 1078345 - protein, 9 aa, Homo Sapiens
RALDKTDAP

SEQ ID NO: 1078346 - protein, 9 aa, Homo Sapiens
LFLQKYLDA

SEQ ID NO: 1078347 - protein, 9 aa, Homo Sapiens
QVQVTISAD

SEQ ID NO: 1078348 - protein, 9 aa, Homo Sapiens
QQIVHLFLQ

SEQ ID NO: 1078349 - protein, 9 aa, Homo Sapiens
VDKALLAKR

SEQ ID NO: 1078350 - protein, 9 aa, Homo Sapiens
NWKDISLNE

SEQ ID NO: 1078351 - protein, 9 aa, Homo Sapiens
LELVSVEQT

SEQ ID NO: 1078352 - protein, 9 aa, Homo Sapiens
NGQSLSVSP

SEQ ID NO: 1078353 - protein, 9 aa, Homo Sapiens
FQRGKQTPA

SEQ ID NO: 1078354 - protein, 9 aa, Homo Sapiens
MKTLVREKG

SEQ ID NO: 1078355 - protein, 9 aa, Homo Sapiens
NQPRFSSSD

SEQ ID NO: 1078356 - protein, 9 aa, Homo Sapiens
LVLKYIFGL

SEQ ID NO: 1078357 - protein, 9 aa, Homo Sapiens
STSIPRRIK

SEQ ID NO: 1078358 - protein, 9 aa, Homo Sapiens
VLALAEGTH

SEQ ID NO: 1078359 - protein, 9 aa, Homo Sapiens
VYSLPHFKP

SEQ ID NO: 1078360 - protein, 9 aa, Homo Sapiens
RQSSQEKVP

SEQ ID NO: 1078361 - protein, 9 aa, Homo Sapiens
ALRRAKTLA

SEQ ID NO: 1078362 - protein, 9 aa, Homo Sapiens
FPPFYLVNT

SEQ ID NO: 1078363 - protein, 9 aa, Homo Sapiens
MQSIPPAIW

SEQ ID NO: 1078364 - protein, 9 aa, Homo Sapiens
PPPPPSPQA

SEQ ID NO: 1078365 - protein, 9 aa, Homo Sapiens
TQLEQVNHM

SEQ ID NO: 1078366 - protein, 9 aa, Homo Sapiens
ELTFKCHRR

SEQ ID NO: 1078367 - protein, 9 aa, Homo Sapiens
HQNFTVRAD

SEQ ID NO: 1078368 - protein, 9 aa, Homo Sapiens
DETSNSTWM

SEQ ID NO: 1078369 - protein, 9 aa, Homo Sapiens
IRTQKNEFL

SEQ ID NO: 1078370 - protein, 9 aa, Homo Sapiens
LQGDFCQAM

SEQ ID NO: 1078371 - protein, 9 aa, Homo Sapiens
EGQSLDSLI

SEQ ID NO: 1078372 - protein, 9 aa, Homo Sapiens
TAFFCKAHG

SEQ ID NO: 1078373 - protein, 9 aa, Homo Sapiens
EKEGKQEEG

SEQ ID NO: 1078374 - protein, 9 aa, Homo Sapiens
SKLYISLEY

SEQ ID NO: 1078375 - protein, 9 aa, Homo Sapiens
SQESEVEKP

SEQ ID NO: 1078376 - protein, 9 aa, Homo Sapiens
FPFIAILCS

SEQ ID NO: 1078377 - protein, 9 aa, Homo Sapiens
EKTSNPSVS

SEQ ID NO: 1078378 - protein, 9 aa, Homo Sapiens
NDTDGNHQV

SEQ ID NO: 1078379 - protein, 9 aa, Homo Sapiens
AMKKLSRPF

SEQ ID NO: 1078380 - protein, 9 aa, Homo Sapiens
CHKRGKVFN

SEQ ID NO: 1078381 - protein, 9 aa, Homo Sapiens
SKCVSRRRF

SEQ ID NO: 1078382 - protein, 9 aa, Homo Sapiens
APMPMKREP

SEQ ID NO: 1078383 - protein, 9 aa, Homo Sapiens
CLTPCPAIS

SEQ ID NO: 1078384 - protein, 9 aa, Homo Sapiens
QRPMDEDSP

SEQ ID NO: 1078385 - protein, 9 aa, Homo Sapiens
TLKGTQGVV

SEQ ID NO: 1078386 - protein, 9 aa, Homo Sapiens
WLITKERNC

SEQ ID NO: 1078387 - protein, 9 aa, Homo Sapiens
LTELWPQEA

SEQ ID NO: 1078388 - protein, 9 aa, Homo Sapiens
CPALSLLLP

SEQ ID NO: 1078389 - protein, 9 aa, Homo Sapiens
GSYTYGFND

SEQ ID NO: 1078390 - protein, 9 aa, Homo Sapiens
ITDTLSPAL

SEQ ID NO: 1078391 - protein, 9 aa, Homo Sapiens
ISRADYAGG

SEQ ID NO: 1078392 - protein, 9 aa, Homo Sapiens
LLCWYQTPT

SEQ ID NO: 1078393 - protein, 9 aa, Homo Sapiens
ESIPLRRQV

SEQ ID NO: 1078394 - protein, 9 aa, Homo Sapiens
RPEIFKDLH

SEQ ID NO: 1078395 - protein, 9 aa, Homo Sapiens
VDLGTILKV

SEQ ID NO: 1078396 - protein, 9 aa, Homo Sapiens
APFGTTSFR

SEQ ID NO: 1078397 - protein, 9 aa, Homo Sapiens
FMSTLLNYD

SEQ ID NO: 1078398 - protein, 9 aa, Homo Sapiens
QAALQALKR

SEQ ID NO: 1078399 - protein, 9 aa, Homo Sapiens
DVGKEIRVA

SEQ ID NO: 1078400 - protein, 9 aa, Homo Sapiens
ALVQDVGRL

SEQ ID NO: 1078401 - protein, 9 aa, Homo Sapiens
EVRFISLKP

SEQ ID NO: 1078402 - protein, 9 aa, Homo Sapiens
GSAAGKNCI

SEQ ID NO: 1078403 - protein, 9 aa, Homo Sapiens
HALGLGHSQ

SEQ ID NO: 1078404 - protein, 9 aa, Homo Sapiens
DKQHFILFQ

SEQ ID NO: 1078405 - protein, 9 aa, Homo Sapiens
QSFSENAAA

SEQ ID NO: 1078406 - protein, 9 aa, Homo Sapiens
LSYHKKIYT

SEQ ID NO: 1078407 - protein, 9 aa, Homo Sapiens
KLTSEEKSQ

SEQ ID NO: 1078408 - protein, 9 aa, Homo Sapiens
TLAHFKDYK

SEQ ID NO: 1078409 - protein, 9 aa, Homo Sapiens
GNCYTFNNK

SEQ ID NO: 1078410 - protein, 9 aa, Homo Sapiens
ACSPVSGCA

SEQ ID NO: 1078411 - protein, 9 aa, Homo Sapiens
LIRQKKKTV

SEQ ID NO: 1078412 - protein, 9 aa, Homo Sapiens
GPESGQSSP

SEQ ID NO: 1078413 - protein, 9 aa, Homo Sapiens
QTFLAGAAG

SEQ ID NO: 1078414 - protein, 9 aa, Homo Sapiens
IKEDYFKKH

SEQ ID NO: 1078415 - protein, 9 aa, Homo Sapiens
QFDAEELTS

SEQ ID NO: 1078416 - protein, 9 aa, Homo Sapiens
EKYKAFSIC

SEQ ID NO: 1078417 - protein, 9 aa, Homo Sapiens
SFVFPPSLI

SEQ ID NO: 1078418 - protein, 9 aa, Homo Sapiens
FDFNFIPEV

SEQ ID NO: 1078419 - protein, 9 aa, Homo Sapiens
SYPCFVSRP

SEQ ID NO: 1078420 - protein, 9 aa, Homo Sapiens
MDEDSPSPG

SEQ ID NO: 1078421 - protein, 9 aa, Homo Sapiens
QSSSLLVHQ

SEQ ID NO: 1078422 - protein, 9 aa, Homo Sapiens
HKKIYTGEK

SEQ ID NO: 1078423 - protein, 9 aa, Homo Sapiens
LNRVIIPSS

SEQ ID NO: 1078424 - protein, 9 aa, Homo Sapiens
KTLSQLAGK

SEQ ID NO: 1078425 - protein, 9 aa, Homo Sapiens
RKRLLCLGW

SEQ ID NO: 1078426 - protein, 9 aa, Homo Sapiens
KDVWLKEGF

SEQ ID NO: 1078427 - protein, 9 aa, Homo Sapiens
KYFFKAVHT

SEQ ID NO: 1078428 - protein, 9 aa, Homo Sapiens
LEATFLIDY

SEQ ID NO: 1078429 - protein, 9 aa, Homo Sapiens
RFPLSEVMN

SEQ ID NO: 1078430 - protein, 9 aa, Homo Sapiens
KLDYRKQAL

SEQ ID NO: 1078431 - protein, 9 aa, Homo Sapiens
EGCALDKQD

SEQ ID NO: 1078432 - protein, 9 aa, Homo Sapiens
TPPFCCQLH

SEQ ID NO: 1078433 - protein, 9 aa, Homo Sapiens
FLENGIEQR

SEQ ID NO: 1078434 - protein, 9 aa, Homo Sapiens
LPGAPSVLC

SEQ ID NO: 1078435 - protein, 9 aa, Homo Sapiens
WSHGYNFWI

SEQ ID NO: 1078436 - protein, 9 aa, Homo Sapiens
RMYRVKGLQ

SEQ ID NO: 1078437 - protein, 9 aa, Homo Sapiens
FSGTNFDEI

SEQ ID NO: 1078438 - protein, 9 aa, Homo Sapiens
EVKFSGTNF

SEQ ID NO: 1078439 - protein, 9 aa, Homo Sapiens
GENPEVSFP

SEQ ID NO: 1078440 - protein, 9 aa, Homo Sapiens
PLPTPGALV

SEQ ID NO: 1078441 - protein, 9 aa, Homo Sapiens
PGLGLRGRP

SEQ ID NO: 1078442 - protein, 9 aa, Homo Sapiens
YVAVSEIMP

SEQ ID NO: 1078443 - protein, 9 aa, Homo Sapiens
EKGFEANNF

SEQ ID NO: 1078444 - protein, 9 aa, Homo Sapiens
SVLCSSSSD

SEQ ID NO: 1078445 - protein, 9 aa, Homo Sapiens
GAKCLRFAP

SEQ ID NO: 1078446 - protein, 9 aa, Homo Sapiens
LDRVQERLA

SEQ ID NO: 1078447 - protein, 9 aa, Homo Sapiens
SQMKKIVRI

SEQ ID NO: 1078448 - protein, 9 aa, Homo Sapiens
IPRTYEKCG

SEQ ID NO: 1078449 - protein, 9 aa, Homo Sapiens
QLVWRGTNV

SEQ ID NO: 1078450 - protein, 9 aa, Homo Sapiens
RGFIFVAGF

SEQ ID NO: 1078451 - protein, 9 aa, Homo Sapiens
HGHGRNHHR

SEQ ID NO: 1078452 - protein, 9 aa, Homo Sapiens
PNKVIIPSL

SEQ ID NO: 1078453 - protein, 9 aa, Homo Sapiens
SATSKPPYF

SEQ ID NO: 1078454 - protein, 9 aa, Homo Sapiens
SLDVLLHSL

SEQ ID NO: 1078455 - protein, 9 aa, Homo Sapiens
WATWVSWSA

SEQ ID NO: 1078456 - protein, 9 aa, Homo Sapiens
SLKVSPKLA

SEQ ID NO: 1078457 - protein, 9 aa, Homo Sapiens
EKREHASRN

SEQ ID NO: 1078458 - protein, 9 aa, Homo Sapiens
RRELDKSLQ

SEQ ID NO: 1078459 - protein, 9 aa, Homo Sapiens
QAAEAHPLV

SEQ ID NO: 1078460 - protein, 9 aa, Homo Sapiens
NQSGKGQNT

SEQ ID NO: 1078461 - protein, 9 aa, Homo Sapiens
NRTPSDVKK

SEQ ID NO: 1078462 - protein, 9 aa, Homo Sapiens
SSSMSLSLF

SEQ ID NO: 1078463 - protein, 9 aa, Homo Sapiens
GFAGDDVPR

SEQ ID NO: 1078464 - protein, 9 aa, Homo Sapiens
SKGGSSSTM

SEQ ID NO: 1078465 - protein, 9 aa, Homo Sapiens
VCYGLIPEE

SEQ ID NO: 1078466 - protein, 9 aa, Homo Sapiens
FCLLDNTCS

SEQ ID NO: 1078467 - protein, 9 aa, Homo Sapiens
DTFFYNGKK

SEQ ID NO: 1078468 - protein, 9 aa, Homo Sapiens
AHSPILNMK

SEQ ID NO: 1078469 - protein, 9 aa, Homo Sapiens
CLPKREVRG

SEQ ID NO: 1078470 - protein, 9 aa, Homo Sapiens
LFFFTSPAV

SEQ ID NO: 1078471 - protein, 9 aa, Homo Sapiens
GDLGQNAWL

SEQ ID NO: 1078472 - protein, 9 aa, Homo Sapiens
TSEEKSQRL

SEQ ID NO: 1078473 - protein, 9 aa, Homo Sapiens
SQRRSKSSA

SEQ ID NO: 1078474 - protein, 9 aa, Homo Sapiens
MRNAMIQGL

SEQ ID NO: 1078475 - protein, 9 aa, Homo Sapiens
RHRGLICAY

SEQ ID NO: 1078476 - protein, 9 aa, Homo Sapiens
AAYSGKRLR

SEQ ID NO: 1078477 - protein, 9 aa, Homo Sapiens
GEDEHSQRL

SEQ ID NO: 1078478 - protein, 9 aa, Homo Sapiens
DYVMLRLAI

SEQ ID NO: 1078479 - protein, 9 aa, Homo Sapiens
NNSIFFQSC

SEQ ID NO: 1078480 - protein, 9 aa, Homo Sapiens
LRTSTAVEV

SEQ ID NO: 1078481 - protein, 9 aa, Homo Sapiens
PTALTSLEL

SEQ ID NO: 1078482 - protein, 9 aa, Homo Sapiens
WISEDDFYW

SEQ ID NO: 1078483 - protein, 9 aa, Homo Sapiens
AFLSVLFST

SEQ ID NO: 1078484 - protein, 9 aa, Homo Sapiens
MHPKLANAH

SEQ ID NO: 1078485 - protein, 9 aa, Homo Sapiens
EKDADWMHV

SEQ ID NO: 1078486 - protein, 9 aa, Homo Sapiens
YCLTCFCLL

SEQ ID NO: 1078487 - protein, 9 aa, Homo Sapiens
VLHHKPINR

SEQ ID NO: 1078488 - protein, 9 aa, Homo Sapiens
CRLLGKFSL

SEQ ID NO: 1078489 - protein, 9 aa, Homo Sapiens
NHLSSEITS

SEQ ID NO: 1078490 - protein, 9 aa, Homo Sapiens
VYLELTDSC

SEQ ID NO: 1078491 - protein, 9 aa, Homo Sapiens
AGVNWKSGY

SEQ ID NO: 1078492 - protein, 9 aa, Homo Sapiens
KAQKKIWMF

SEQ ID NO: 1078493 - protein, 9 aa, Homo Sapiens
HCTLLSVGP

SEQ ID NO: 1078494 - protein, 9 aa, Homo Sapiens
VVVHLDTIL

SEQ ID NO: 1078495 - protein, 9 aa, Homo Sapiens
QLSSHSGLR

SEQ ID NO: 1078496 - protein, 9 aa, Homo Sapiens
GKIFYSKSE

SEQ ID NO: 1078497 - protein, 9 aa, Homo Sapiens
CLNGGGQSG

SEQ ID NO: 1078498 - protein, 9 aa, Homo Sapiens
SEYPLSSKR

SEQ ID NO: 1078499 - protein, 9 aa, Homo Sapiens
SKGVEAEQE

SEQ ID NO: 1078500 - protein, 9 aa, Homo Sapiens
ATSQSCQTP

SEQ ID NO: 1078501 - protein, 9 aa, Homo Sapiens
PETWKRNSC

SEQ ID NO: 1078502 - protein, 9 aa, Homo Sapiens
CFVIPLTDP

SEQ ID NO: 1078503 - protein, 9 aa, Homo Sapiens
IKLACADIS

SEQ ID NO: 1078504 - protein, 9 aa, Homo Sapiens
TSIPRRIKL

SEQ ID NO: 1078505 - protein, 9 aa, Homo Sapiens
GPGLVSTPD

SEQ ID NO: 1078506 - protein, 9 aa, Homo Sapiens
MCRWACTSC

SEQ ID NO: 1078507 - protein, 9 aa, Homo Sapiens
GEGDTGCRE

SEQ ID NO: 1078508 - protein, 9 aa, Homo Sapiens
NVDHIDSFI

SEQ ID NO: 1078509 - protein, 9 aa, Homo Sapiens
AHLNYHRSF

SEQ ID NO: 1078510 - protein, 9 aa, Homo Sapiens
PNFASPAGF

SEQ ID NO: 1078511 - protein, 9 aa, Homo Sapiens
GILENQSGK

SEQ ID NO: 1078512 - protein, 9 aa, Homo Sapiens
RSLPEGEMK

SEQ ID NO: 1078513 - protein, 9 aa, Homo Sapiens
LSHSDTFIS

SEQ ID NO: 1078514 - protein, 9 aa, Homo Sapiens
PYNPGLKAG

SEQ ID NO: 1078515 - protein, 9 aa, Homo Sapiens
GQGMNPADK

SEQ ID NO: 1078516 - protein, 9 aa, Homo Sapiens
ELDKSLQVA

SEQ ID NO: 1078517 - protein, 9 aa, Homo Sapiens
SLLKSRARA

SEQ ID NO: 1078518 - protein, 9 aa, Homo Sapiens
MKRIKENSP

SEQ ID NO: 1078519 - protein, 9 aa, Homo Sapiens
LTASRGLIA

SEQ ID NO: 1078520 - protein, 9 aa, Homo Sapiens
MPPEFIFYN

SEQ ID NO: 1078521 - protein, 9 aa, Homo Sapiens
PRETSTPGR

SEQ ID NO: 1078522 - protein, 9 aa, Homo Sapiens
TAPLSRKSY

SEQ ID NO: 1078523 - protein, 9 aa, Homo Sapiens
PSLPPCSIS

SEQ ID NO: 1078524 - protein, 9 aa, Homo Sapiens
PDGYKVAAA

SEQ ID NO: 1078525 - protein, 9 aa, Homo Sapiens
WAAKKFPKI

SEQ ID NO: 1078526 - protein, 9 aa, Homo Sapiens
NSIEFFSFS

SEQ ID NO: 1078527 - protein, 9 aa, Homo Sapiens
QCLDFRPLF

SEQ ID NO: 1078528 - protein, 9 aa, Homo Sapiens
PPPPQTPSL

SEQ ID NO: 1078529 - protein, 9 aa, Homo Sapiens
VLYGNKITK

SEQ ID NO: 1078530 - protein, 9 aa, Homo Sapiens
KEAGLDVKA

SEQ ID NO: 1078531 - protein, 9 aa, Homo Sapiens
QKKKEERQE

SEQ ID NO: 1078532 - protein, 9 aa, Homo Sapiens
AWCTAFRFV

SEQ ID NO: 1078533 - protein, 9 aa, Homo Sapiens
SVQKELIIF

SEQ ID NO: 1078534 - protein, 9 aa, Homo Sapiens
IESNYPIVL

SEQ ID NO: 1078535 - protein, 9 aa, Homo Sapiens
FSEEEESED

SEQ ID NO: 1078536 - protein, 9 aa, Homo Sapiens
GKEIRVALS

SEQ ID NO: 1078537 - protein, 9 aa, Homo Sapiens
PVQCLGLPH

SEQ ID NO: 1078538 - protein, 9 aa, Homo Sapiens
YKREKGIKG

SEQ ID NO: 1078539 - protein, 9 aa, Homo Sapiens
HPMGPPSPF

SEQ ID NO: 1078540 - protein, 9 aa, Homo Sapiens
GKDLLRISH

SEQ ID NO: 1078541 - protein, 9 aa, Homo Sapiens
GVTNMQSIP

SEQ ID NO: 1078542 - protein, 9 aa, Homo Sapiens
DDSNSSLSE

SEQ ID NO: 1078543 - protein, 9 aa, Homo Sapiens
AAELDCRER

SEQ ID NO: 1078544 - protein, 9 aa, Homo Sapiens
LGHCFFLEN

SEQ ID NO: 1078545 - protein, 9 aa, Homo Sapiens
KNQKREGLI

SEQ ID NO: 1078546 - protein, 9 aa, Homo Sapiens
SLKKAYSAA

SEQ ID NO: 1078547 - protein, 9 aa, Homo Sapiens
WVMLVRGGG

SEQ ID NO: 1078548 - protein, 9 aa, Homo Sapiens
FELEHFPGL

SEQ ID NO: 1078549 - protein, 9 aa, Homo Sapiens
GMPSSTERH

SEQ ID NO: 1078550 - protein, 9 aa, Homo Sapiens
RQRSSQSEN

SEQ ID NO: 1078551 - protein, 9 aa, Homo Sapiens
SATWEERKE

SEQ ID NO: 1078552 - protein, 9 aa, Homo Sapiens
SSLLQRLIP

SEQ ID NO: 1078553 - protein, 9 aa, Homo Sapiens
QIVHLFLQM

SEQ ID NO: 1078554 - protein, 9 aa, Homo Sapiens
SQQCCQKSE

SEQ ID NO: 1078555 - protein, 9 aa, Homo Sapiens
YILTKAALS

SEQ ID NO: 1078556 - protein, 9 aa, Homo Sapiens
AAGMRPSIQ

SEQ ID NO: 1078557 - protein, 9 aa, Homo Sapiens
GIPQLLVSL

SEQ ID NO: 1078558 - protein, 9 aa, Homo Sapiens
WFRVFSRKS

SEQ ID NO: 1078559 - protein, 9 aa, Homo Sapiens
RERWGLAQH

SEQ ID NO: 1078560 - protein, 9 aa, Homo Sapiens
TIEYNGVMQ

SEQ ID NO: 1078561 - protein, 9 aa, Homo Sapiens
KETLADVQP

SEQ ID NO: 1078562 - protein, 9 aa, Homo Sapiens
CTEKSNGYR

SEQ ID NO: 1078563 - protein, 9 aa, Homo Sapiens
SSGRGPPSM

SEQ ID NO: 1078564 - protein, 9 aa, Homo Sapiens
GSGNYNDFE

SEQ ID NO: 1078565 - protein, 9 aa, Homo Sapiens
KTFQNQARE

SEQ ID NO: 1078566 - protein, 9 aa, Homo Sapiens
LLEPISQYS

SEQ ID NO: 1078567 - protein, 9 aa, Homo Sapiens
DKSDDSNSS

SEQ ID NO: 1078568 - protein, 9 aa, Homo Sapiens
DSTGHSFVL

SEQ ID NO: 1078569 - protein, 9 aa, Homo Sapiens
SQVYVTFVV

SEQ ID NO: 1078570 - protein, 9 aa, Homo Sapiens
NKQNALCTP

SEQ ID NO: 1078571 - protein, 9 aa, Homo Sapiens
YRSGPESGQ

SEQ ID NO: 1078572 - protein, 9 aa, Homo Sapiens
TSDQPSSDE

SEQ ID NO: 1078573 - protein, 9 aa, Homo Sapiens
YNLHMWSQI

SEQ ID NO: 1078574 - protein, 9 aa, Homo Sapiens
SLGPYLLPS

SEQ ID NO: 1078575 - protein, 9 aa, Homo Sapiens
ALGLASASS

SEQ ID NO: 1078576 - protein, 9 aa, Homo Sapiens
EIRVALSNI

SEQ ID NO: 1078577 - protein, 9 aa, Homo Sapiens
GVSVSSPGP

SEQ ID NO: 1078578 - protein, 9 aa, Homo Sapiens
LSTLYIHSL

SEQ ID NO: 1078579 - protein, 9 aa, Homo Sapiens
DCREREMQN

SEQ ID NO: 1078580 - protein, 9 aa, Homo Sapiens
PSSARGLFP

SEQ ID NO: 1078581 - protein, 9 aa, Homo Sapiens
DDSTWWQAK

SEQ ID NO: 1078582 - protein, 9 aa, Homo Sapiens
WYTLLTLPN

SEQ ID NO: 1078583 - protein, 9 aa, Homo Sapiens
IEVLDIAGF

SEQ ID NO: 1078584 - protein, 9 aa, Homo Sapiens
NMCELSSPI

SEQ ID NO: 1078585 - protein, 9 aa, Homo Sapiens
FREIHHFFC

SEQ ID NO: 1078586 - protein, 9 aa, Homo Sapiens
LSNPCLKQE

SEQ ID NO: 1078587 - protein, 9 aa, Homo Sapiens
GETPKSVDP

SEQ ID NO: 1078588 - protein, 9 aa, Homo Sapiens
VLFKKTHRV

SEQ ID NO: 1078589 - protein, 9 aa, Homo Sapiens
LLKRVQFEE

SEQ ID NO: 1078590 - protein, 9 aa, Homo Sapiens
EDIFFQPER

SEQ ID NO: 1078591 - protein, 9 aa, Homo Sapiens
DQLGNKYFR

SEQ ID NO: 1078592 - protein, 9 aa, Homo Sapiens
VTACQGLGL

SEQ ID NO: 1078593 - protein, 9 aa, Homo Sapiens
TLQPHLFLD

SEQ ID NO: 1078594 - protein, 9 aa, Homo Sapiens
GDLLMYIIS

SEQ ID NO: 1078595 - protein, 9 aa, Homo Sapiens
HGTQNKQAA

SEQ ID NO: 1078596 - protein, 9 aa, Homo Sapiens
IFSFLYRKN

SEQ ID NO: 1078597 - protein, 9 aa, Homo Sapiens
VASFNDLDF

SEQ ID NO: 1078598 - protein, 9 aa, Homo Sapiens
GKAPCLSPQ

SEQ ID NO: 1078599 - protein, 9 aa, Homo Sapiens
RIEELGKEI

SEQ ID NO: 1078600 - protein, 9 aa, Homo Sapiens
EFACGTGSC

SEQ ID NO: 1078601 - protein, 9 aa, Homo Sapiens
LFLQEKKAS

SEQ ID NO: 1078602 - protein, 9 aa, Homo Sapiens
DSSVVSLTV

SEQ ID NO: 1078603 - protein, 9 aa, Homo Sapiens
ILAEKIAKE

SEQ ID NO: 1078604 - protein, 9 aa, Homo Sapiens
IEMEALSKL

SEQ ID NO: 1078605 - protein, 9 aa, Homo Sapiens
ILMSHVARQ

SEQ ID NO: 1078606 - protein, 9 aa, Homo Sapiens
EFGQLTRFL

SEQ ID NO: 1078607 - protein, 9 aa, Homo Sapiens
SEVRCRRYE

SEQ ID NO: 1078608 - protein, 9 aa, Homo Sapiens
IDRFLKVVK

SEQ ID NO: 1078609 - protein, 9 aa, Homo Sapiens
SGSNPNCVR

SEQ ID NO: 1078610 - protein, 9 aa, Homo Sapiens
AAFRHPFLA

SEQ ID NO: 1078611 - protein, 9 aa, Homo Sapiens
QCPGSCQSP

SEQ ID NO: 1078612 - protein, 9 aa, Homo Sapiens
PAKLDAYAK

SEQ ID NO: 1078613 - protein, 9 aa, Homo Sapiens
DKGGSLVGR

SEQ ID NO: 1078614 - protein, 9 aa, Homo Sapiens
LTVSWDPKI

SEQ ID NO: 1078615 - protein, 9 aa, Homo Sapiens
LKPHFYLYL

SEQ ID NO: 1078616 - protein, 9 aa, Homo Sapiens
LCYNNTFES

SEQ ID NO: 1078617 - protein, 9 aa, Homo Sapiens
INKRIYTGE

SEQ ID NO: 1078618 - protein, 9 aa, Homo Sapiens
TRKSLVLDS

SEQ ID NO: 1078619 - protein, 9 aa, Homo Sapiens
QTSITLHFS

SEQ ID NO: 1078620 - protein, 9 aa, Homo Sapiens
EAHPKATDA

SEQ ID NO: 1078621 - protein, 9 aa, Homo Sapiens
DSGTYDCTA

SEQ ID NO: 1078622 - protein, 9 aa, Homo Sapiens
TSSGEFTVF

SEQ ID NO: 1078623 - protein, 9 aa, Homo Sapiens
LDALPKEDR

SEQ ID NO: 1078624 - protein, 9 aa, Homo Sapiens
AEAHPLVGR

SEQ ID NO: 1078625 - protein, 9 aa, Homo Sapiens
EPRLRPGPG

SEQ ID NO: 1078626 - protein, 9 aa, Homo Sapiens
DLISKNIAD

SEQ ID NO: 1078627 - protein, 9 aa, Homo Sapiens
PGGNFAQSS

SEQ ID NO: 1078628 - protein, 9 aa, Homo Sapiens
EERKESPDK

SEQ ID NO: 1078629 - protein, 9 aa, Homo Sapiens
RRPAFPGET

SEQ ID NO: 1078630 - protein, 9 aa, Homo Sapiens
GKIWQLLGA

SEQ ID NO: 1078631 - protein, 9 aa, Homo Sapiens
ELDRVQERL

SEQ ID NO: 1078632 - protein, 9 aa, Homo Sapiens
IALNGALQL

SEQ ID NO: 1078633 - protein, 9 aa, Homo Sapiens
ASRRIRPEF

SEQ ID NO: 1078634 - protein, 9 aa, Homo Sapiens
FIKFSEPGA

SEQ ID NO: 1078635 - protein, 9 aa, Homo Sapiens
ALKRGKEVP

SEQ ID NO: 1078636 - protein, 9 aa, Homo Sapiens
QPLQPVPLN

SEQ ID NO: 1078637 - protein, 9 aa, Homo Sapiens
VDKGGSLVG

SEQ ID NO: 1078638 - protein, 9 aa, Homo Sapiens
ALGGPSLVS

SEQ ID NO: 1078639 - protein, 9 aa, Homo Sapiens
CYCLLNPFA

SEQ ID NO: 1078640 - protein, 9 aa, Homo Sapiens
ASDGDGRTA

SEQ ID NO: 1078641 - protein, 9 aa, Homo Sapiens
EYSYGKYRD

SEQ ID NO: 1078642 - protein, 9 aa, Homo Sapiens
TVTTGQTPT

SEQ ID NO: 1078643 - protein, 9 aa, Homo Sapiens
SPLHSSDIC

SEQ ID NO: 1078644 - protein, 9 aa, Homo Sapiens
ATRVRPEAL

SEQ ID NO: 1078645 - protein, 9 aa, Homo Sapiens
LYHFSTNCE

SEQ ID NO: 1078646 - protein, 9 aa, Homo Sapiens
QSSQAQQPS

SEQ ID NO: 1078647 - protein, 9 aa, Homo Sapiens
PGPGLGLRG

SEQ ID NO: 1078648 - protein, 9 aa, Homo Sapiens
FYNKKMDSI

SEQ ID NO: 1078649 - protein, 9 aa, Homo Sapiens
EECEHAYPD

SEQ ID NO: 1078650 - protein, 9 aa, Homo Sapiens
CKSLLGGFQ

SEQ ID NO: 1078651 - protein, 9 aa, Homo Sapiens
AASGKTSKF

SEQ ID NO: 1078652 - protein, 9 aa, Homo Sapiens
VYPTSLIKT

SEQ ID NO: 1078653 - protein, 9 aa, Homo Sapiens
HVFQGISEI

SEQ ID NO: 1078654 - protein, 9 aa, Homo Sapiens
RPACQSESS

SEQ ID NO: 1078655 - protein, 9 aa, Homo Sapiens
ADLGREKIF

SEQ ID NO: 1078656 - protein, 9 aa, Homo Sapiens
EATELKVCK

SEQ ID NO: 1078657 - protein, 9 aa, Homo Sapiens
HGIEDSKAT

SEQ ID NO: 1078658 - protein, 9 aa, Homo Sapiens
MEQMQLQNE

SEQ ID NO: 1078659 - protein, 9 aa, Homo Sapiens
PRPWHCRVE

SEQ ID NO: 1078660 - protein, 9 aa, Homo Sapiens
MFPADFQRA

SEQ ID NO: 1078661 - protein, 9 aa, Homo Sapiens
MGPKPHLPT

SEQ ID NO: 1078662 - protein, 9 aa, Homo Sapiens
YSPPPPPPS

SEQ ID NO: 1078663 - protein, 9 aa, Homo Sapiens
SPLRSPFCS

SEQ ID NO: 1078664 - protein, 9 aa, Homo Sapiens
VFRMGPFSA

SEQ ID NO: 1078665 - protein, 9 aa, Homo Sapiens
QKPKVSLSP

SEQ ID NO: 1078666 - protein, 9 aa, Homo Sapiens
SNLSFLKLC

SEQ ID NO: 1078667 - protein, 9 aa, Homo Sapiens
GSKTTTASP

SEQ ID NO: 1078668 - protein, 9 aa, Homo Sapiens
SDFSLSEPG

SEQ ID NO: 1078669 - protein, 9 aa, Homo Sapiens
LETIFGKSI

SEQ ID NO: 1078670 - protein, 9 aa, Homo Sapiens
HCSPELKEG

SEQ ID NO: 1078671 - protein, 9 aa, Homo Sapiens
LRVPSLDYL

SEQ ID NO: 1078672 - protein, 9 aa, Homo Sapiens
EFCPELVND

SEQ ID NO: 1078673 - protein, 9 aa, Homo Sapiens
YPRQITDGM

SEQ ID NO: 1078674 - protein, 9 aa, Homo Sapiens
EAQDALLSQ

SEQ ID NO: 1078675 - protein, 9 aa, Homo Sapiens
QIMKKLDHC

SEQ ID NO: 1078676 - protein, 9 aa, Homo Sapiens
EGNYFFDGP

SEQ ID NO: 1078677 - protein, 9 aa, Homo Sapiens
FDPWSLERP

SEQ ID NO: 1078678 - protein, 9 aa, Homo Sapiens
SAAQKKNAG

SEQ ID NO: 1078679 - protein, 9 aa, Homo Sapiens
GWRRPAFPG

SEQ ID NO: 1078680 - protein, 9 aa, Homo Sapiens
NPTAVQIHN

SEQ ID NO: 1078681 - protein, 9 aa, Homo Sapiens
IRFYIQRNV

SEQ ID NO: 1078682 - protein, 9 aa, Homo Sapiens
GKLGDSWIV

SEQ ID NO: 1078683 - protein, 9 aa, Homo Sapiens
WKEIYVGDF

SEQ ID NO: 1078684 - protein, 9 aa, Homo Sapiens
PAVVFDILA

SEQ ID NO: 1078685 - protein, 9 aa, Homo Sapiens
VDCAGIDLR

SEQ ID NO: 1078686 - protein, 9 aa, Homo Sapiens
QNEIQEGIP

SEQ ID NO: 1078687 - protein, 9 aa, Homo Sapiens
FSYCASRIV

SEQ ID NO: 1078688 - protein, 9 aa, Homo Sapiens
HSKPGAIDE

SEQ ID NO: 1078689 - protein, 9 aa, Homo Sapiens
FRFVPGGVY

SEQ ID NO: 1078690 - protein, 9 aa, Homo Sapiens
ENFPDEKVC

SEQ ID NO: 1078691 - protein, 9 aa, Homo Sapiens
SMLTKCKII

SEQ ID NO: 1078692 - protein, 9 aa, Homo Sapiens
VPNLTQRLE

SEQ ID NO: 1078693 - protein, 9 aa, Homo Sapiens
TKWKEIVFD

SEQ ID NO: 1078694 - protein, 9 aa, Homo Sapiens
DRVPSPFST

SEQ ID NO: 1078695 - protein, 9 aa, Homo Sapiens
LGSPAGSFS

SEQ ID NO: 1078696 - protein, 9 aa, Homo Sapiens
ILWLILFTP

SEQ ID NO: 1078697 - protein, 9 aa, Homo Sapiens
LKNTHQSGL

SEQ ID NO: 1078698 - protein, 9 aa, Homo Sapiens
MEEPTFSTN

SEQ ID NO: 1078699 - protein, 9 aa, Homo Sapiens
FEELSRIHD

SEQ ID NO: 1078700 - protein, 9 aa, Homo Sapiens
HAHRDREII

SEQ ID NO: 1078701 - protein, 9 aa, Homo Sapiens
RFSYPCTQT

SEQ ID NO: 1078702 - protein, 9 aa, Homo Sapiens
EPSFLRALH

SEQ ID NO: 1078703 - protein, 9 aa, Homo Sapiens
EQEKEGKQE

SEQ ID NO: 1078704 - protein, 9 aa, Homo Sapiens
TLYHFSTNC

SEQ ID NO: 1078705 - protein, 9 aa, Homo Sapiens
GDAPPPQNE

SEQ ID NO: 1078706 - protein, 9 aa, Homo Sapiens
NIAHLKNFL

SEQ ID NO: 1078707 - protein, 9 aa, Homo Sapiens
QTTVCRLVT

SEQ ID NO: 1078708 - protein, 9 aa, Homo Sapiens
RWSKSYFCE

SEQ ID NO: 1078709 - protein, 9 aa, Homo Sapiens
GEIQNVAAN

SEQ ID NO: 1078710 - protein, 9 aa, Homo Sapiens
KNVHLQYPE

SEQ ID NO: 1078711 - protein, 9 aa, Homo Sapiens
SFGVRLWEI

SEQ ID NO: 1078712 - protein, 9 aa, Homo Sapiens
KPLQKYSSV

SEQ ID NO: 1078713 - protein, 9 aa, Homo Sapiens
SGQYIAIAL

SEQ ID NO: 1078714 - protein, 9 aa, Homo Sapiens
PATLMSANY

SEQ ID NO: 1078715 - protein, 9 aa, Homo Sapiens
LSELPYQWE

SEQ ID NO: 1078716 - protein, 9 aa, Homo Sapiens
KSTDQEFEN

SEQ ID NO: 1078717 - protein, 9 aa, Homo Sapiens
RRKVVILED

SEQ ID NO: 1078718 - protein, 9 aa, Homo Sapiens
LRPEIFKDL

SEQ ID NO: 1078719 - protein, 9 aa, Homo Sapiens
PALPSAPHG

SEQ ID NO: 1078720 - protein, 9 aa, Homo Sapiens
MHGIEDSKA

SEQ ID NO: 1078721 - protein, 9 aa, Homo Sapiens
PSPQGPPGI

SEQ ID NO: 1078722 - protein, 9 aa, Homo Sapiens
SFQVQVTIS

SEQ ID NO: 1078723 - protein, 9 aa, Homo Sapiens
KAPKIFMPD

SEQ ID NO: 1078724 - protein, 9 aa, Homo Sapiens
NQSRLDPFF

SEQ ID NO: 1078725 - protein, 9 aa, Homo Sapiens
GEAHPKATD

SEQ ID NO: 1078726 - protein, 9 aa, Homo Sapiens
PVCPPEPTL

SEQ ID NO: 1078727 - protein, 9 aa, Homo Sapiens
EVFTNQEVQ

SEQ ID NO: 1078728 - protein, 9 aa, Homo Sapiens
STGHSFVLV

SEQ ID NO: 1078729 - protein, 9 aa, Homo Sapiens
AGEVKRSVP

SEQ ID NO: 1078730 - protein, 9 aa, Homo Sapiens
LSLTLIAST

SEQ ID NO: 1078731 - protein, 9 aa, Homo Sapiens
NLMALKNHF

SEQ ID NO: 1078732 - protein, 9 aa, Homo Sapiens
KNVKLAERS

SEQ ID NO: 1078733 - protein, 9 aa, Homo Sapiens
LEPISQYSI

SEQ ID NO: 1078734 - protein, 9 aa, Homo Sapiens
MKREPPPRR

SEQ ID NO: 1078735 - protein, 9 aa, Homo Sapiens
GPFYAVLKL

SEQ ID NO: 1078736 - protein, 9 aa, Homo Sapiens
KSYIWPEYC

SEQ ID NO: 1078737 - protein, 9 aa, Homo Sapiens
GCGAVGDWG

SEQ ID NO: 1078738 - protein, 9 aa, Homo Sapiens
TQIVALSPL

SEQ ID NO: 1078739 - protein, 9 aa, Homo Sapiens
RSPLRSPFC

SEQ ID NO: 1078740 - protein, 9 aa, Homo Sapiens
ILLRNVDLI

SEQ ID NO: 1078741 - protein, 9 aa, Homo Sapiens
ADINRDGKV

SEQ ID NO: 1078742 - protein, 9 aa, Homo Sapiens
SEWTSLASA

SEQ ID NO: 1078743 - protein, 9 aa, Homo Sapiens
LMTKHLLAM

SEQ ID NO: 1078744 - protein, 9 aa, Homo Sapiens
TNPFSKDFY

SEQ ID NO: 1078745 - protein, 9 aa, Homo Sapiens
TVISTDAFK

SEQ ID NO: 1078746 - protein, 9 aa, Homo Sapiens
SGAPGAKGE

SEQ ID NO: 1078747 - protein, 9 aa, Homo Sapiens
PGYPTPPAT

SEQ ID NO: 1078748 - protein, 9 aa, Homo Sapiens
DRTAWVWSV

SEQ ID NO: 1078749 - protein, 9 aa, Homo Sapiens
CSPFKNFGH

SEQ ID NO: 1078750 - protein, 9 aa, Homo Sapiens
SLASPDPEP

SEQ ID NO: 1078751 - protein, 9 aa, Homo Sapiens
IISGQPRPE

SEQ ID NO: 1078752 - protein, 9 aa, Homo Sapiens
SGGGSCSQS

SEQ ID NO: 1078753 - protein, 9 aa, Homo Sapiens
QSPGETFRG

SEQ ID NO: 1078754 - protein, 9 aa, Homo Sapiens
TEQDGCDPS

SEQ ID NO: 1078755 - protein, 9 aa, Homo Sapiens
GATREDKVK

SEQ ID NO: 1078756 - protein, 9 aa, Homo Sapiens
ENVNVRIHA

SEQ ID NO: 1078757 - protein, 9 aa, Homo Sapiens
QDFGVNGQV

SEQ ID NO: 1078758 - protein, 9 aa, Homo Sapiens
TGAFSGTRT

SEQ ID NO: 1078759 - protein, 9 aa, Homo Sapiens
SEYTPVDDR

SEQ ID NO: 1078760 - protein, 9 aa, Homo Sapiens
RFGGHTISP

SEQ ID NO: 1078761 - protein, 9 aa, Homo Sapiens
PKKKRRQKR

SEQ ID NO: 1078762 - protein, 9 aa, Homo Sapiens
NHMLNLTQE

SEQ ID NO: 1078763 - protein, 9 aa, Homo Sapiens
PNLARATHN

SEQ ID NO: 1078764 - protein, 9 aa, Homo Sapiens
RESCENANT

SEQ ID NO: 1078765 - protein, 9 aa, Homo Sapiens
EIYVGDFVR

SEQ ID NO: 1078766 - protein, 9 aa, Homo Sapiens
RGLRGVSKF

SEQ ID NO: 1078767 - protein, 9 aa, Homo Sapiens
FASTFIDGK

SEQ ID NO: 1078768 - protein, 9 aa, Homo Sapiens
LSPVFVEWS

SEQ ID NO: 1078769 - protein, 9 aa, Homo Sapiens
ALSNIAVDQ

SEQ ID NO: 1078770 - protein, 9 aa, Homo Sapiens
IKAPMFFWP

SEQ ID NO: 1078771 - protein, 9 aa, Homo Sapiens
NVYRPQFCL

SEQ ID NO: 1078772 - protein, 9 aa, Homo Sapiens
DQEKYECVA

SEQ ID NO: 1078773 - protein, 9 aa, Homo Sapiens
CMCWQLENI

SEQ ID NO: 1078774 - protein, 9 aa, Homo Sapiens
MGTFELEHF

SEQ ID NO: 1078775 - protein, 9 aa, Homo Sapiens
ELIIFNREK

SEQ ID NO: 1078776 - protein, 9 aa, Homo Sapiens
TRTRFTCLF

SEQ ID NO: 1078777 - protein, 9 aa, Homo Sapiens
LHGELSCTT

SEQ ID NO: 1078778 - protein, 9 aa, Homo Sapiens
QGKINGISG

SEQ ID NO: 1078779 - protein, 9 aa, Homo Sapiens
ILATSGLVP

SEQ ID NO: 1078780 - protein, 9 aa, Homo Sapiens
LCSYGRVLL

SEQ ID NO: 1078781 - protein, 9 aa, Homo Sapiens
IFFQPERIL

SEQ ID NO: 1078782 - protein, 9 aa, Homo Sapiens
EMERRASVY

SEQ ID NO: 1078783 - protein, 9 aa, Homo Sapiens
ETLAHFKDY

SEQ ID NO: 1078784 - protein, 9 aa, Homo Sapiens
LIDTVYFSS

SEQ ID NO: 1078785 - protein, 9 aa, Homo Sapiens
FQDRPWAQG

SEQ ID NO: 1078786 - protein, 9 aa, Homo Sapiens
PGAPNLARA

SEQ ID NO: 1078787 - protein, 9 aa, Homo Sapiens
ATLDYERSQ

SEQ ID NO: 1078788 - protein, 9 aa, Homo Sapiens
TVTVLKLLM

SEQ ID NO: 1078789 - protein, 9 aa, Homo Sapiens
KSIISLAGG

SEQ ID NO: 1078790 - protein, 9 aa, Homo Sapiens
QQRIHTRKR

SEQ ID NO: 1078791 - protein, 9 aa, Homo Sapiens
SRGDVNNQD

SEQ ID NO: 1078792 - protein, 9 aa, Homo Sapiens
SDTLLESDF

SEQ ID NO: 1078793 - protein, 9 aa, Homo Sapiens
NAEESTLSC

SEQ ID NO: 1078794 - protein, 9 aa, Homo Sapiens
NPFSKDFYG

SEQ ID NO: 1078795 - protein, 9 aa, Homo Sapiens
SEETRFHHV

SEQ ID NO: 1078796 - protein, 9 aa, Homo Sapiens
STTRALDKT

SEQ ID NO: 1078797 - protein, 9 aa, Homo Sapiens
KEEYEESPL

SEQ ID NO: 1078798 - protein, 9 aa, Homo Sapiens
RQKRGRFHP

SEQ ID NO: 1078799 - protein, 9 aa, Homo Sapiens
HPVCRSLIQ

SEQ ID NO: 1078800 - protein, 9 aa, Homo Sapiens
WMPPEFIFY

SEQ ID NO: 1078801 - protein, 9 aa, Homo Sapiens
TPFSTQVEE

SEQ ID NO: 1078802 - protein, 9 aa, Homo Sapiens
PLMLKFQFC

SEQ ID NO: 1078803 - protein, 9 aa, Homo Sapiens
KKKNIMDLY

SEQ ID NO: 1078804 - protein, 9 aa, Homo Sapiens
MSERDESQK

SEQ ID NO: 1078805 - protein, 9 aa, Homo Sapiens
LSAPALQEK

SEQ ID NO: 1078806 - protein, 9 aa, Homo Sapiens
NKFQNLQTE

SEQ ID NO: 1078807 - protein, 9 aa, Homo Sapiens
GPSGEPGQA

SEQ ID NO: 1078808 - protein, 9 aa, Homo Sapiens
LDKSDDSNS

SEQ ID NO: 1078809 - protein, 9 aa, Homo Sapiens
KKDKDPVQI

SEQ ID NO: 1078810 - protein, 9 aa, Homo Sapiens
NTTEILATS

SEQ ID NO: 1078811 - protein, 9 aa, Homo Sapiens
KKGSLPRPS

SEQ ID NO: 1078812 - protein, 9 aa, Homo Sapiens
QYFNVASVI

SEQ ID NO: 1078813 - protein, 9 aa, Homo Sapiens
SSGSGCKSL

SEQ ID NO: 1078814 - protein, 9 aa, Homo Sapiens
KAEMKTLVR

SEQ ID NO: 1078815 - protein, 9 aa, Homo Sapiens
APPPQNEHT

SEQ ID NO: 1078816 - protein, 9 aa, Homo Sapiens
IPEITSKNT

SEQ ID NO: 1078817 - protein, 9 aa, Homo Sapiens
SLGLTQLHV

SEQ ID NO: 1078818 - protein, 9 aa, Homo Sapiens
EEFQDLLNM

SEQ ID NO: 1078819 - protein, 9 aa, Homo Sapiens
PSLGQELPP

SEQ ID NO: 1078820 - protein, 9 aa, Homo Sapiens
GPRGPSGAI

SEQ ID NO: 1078821 - protein, 9 aa, Homo Sapiens
HRRLLQLCL

SEQ ID NO: 1078822 - protein, 9 aa, Homo Sapiens
SYHSSSDAQ

SEQ ID NO: 1078823 - protein, 9 aa, Homo Sapiens
MPPSCSDSC

SEQ ID NO: 1078824 - protein, 9 aa, Homo Sapiens
AVASEFGQL

SEQ ID NO: 1078825 - protein, 9 aa, Homo Sapiens
FQPERILFI

SEQ ID NO: 1078826 - protein, 9 aa, Homo Sapiens
PQQKLFVAE

SEQ ID NO: 1078827 - protein, 9 aa, Homo Sapiens
SLVSVNIER

SEQ ID NO: 1078828 - protein, 9 aa, Homo Sapiens
FPHSFLLTV

SEQ ID NO: 1078829 - protein, 9 aa, Homo Sapiens
RQQRIAVKS

SEQ ID NO: 1078830 - protein, 9 aa, Homo Sapiens
GRGRGYYQE

SEQ ID NO: 1078831 - protein, 9 aa, Homo Sapiens
GCQCDSSFL

SEQ ID NO: 1078832 - protein, 9 aa, Homo Sapiens
QPRPEVTWY

SEQ ID NO: 1078833 - protein, 9 aa, Homo Sapiens
GDWGLFALY

SEQ ID NO: 1078834 - protein, 9 aa, Homo Sapiens
FLENQEDIH

SEQ ID NO: 1078835 - protein, 9 aa, Homo Sapiens
ARSDPVSLC

SEQ ID NO: 1078836 - protein, 9 aa, Homo Sapiens
RLLCLGWGL

SEQ ID NO: 1078837 - protein, 9 aa, Homo Sapiens
LELSSWSAS

SEQ ID NO: 1078838 - protein, 9 aa, Homo Sapiens
KGRKSFPSG

SEQ ID NO: 1078839 - protein, 9 aa, Homo Sapiens
ELFCELFPL

SEQ ID NO: 1078840 - protein, 9 aa, Homo Sapiens
ICAYEFAVD

SEQ ID NO: 1078841 - protein, 9 aa, Homo Sapiens
CCQPSCGRP

SEQ ID NO: 1078842 - protein, 9 aa, Homo Sapiens
AVSLKNIDI

SEQ ID NO: 1078843 - protein, 9 aa, Homo Sapiens
IIGNLVGAL

SEQ ID NO: 1078844 - protein, 9 aa, Homo Sapiens
TMRINKQNA

SEQ ID NO: 1078845 - protein, 9 aa, Homo Sapiens
PAFQSLWGN

SEQ ID NO: 1078846 - protein, 9 aa, Homo Sapiens
DRVQERLAT

SEQ ID NO: 1078847 - protein, 9 aa, Homo Sapiens
TWLGVLFLP

SEQ ID NO: 1078848 - protein, 9 aa, Homo Sapiens
THHKGVNFT

SEQ ID NO: 1078849 - protein, 9 aa, Homo Sapiens
GWALPHNWM

SEQ ID NO: 1078850 - protein, 9 aa, Homo Sapiens
VAFSFLWAG

SEQ ID NO: 1078851 - protein, 9 aa, Homo Sapiens
KHKRIYTGE

SEQ ID NO: 1078852 - protein, 9 aa, Homo Sapiens
ASPDCQQPA

SEQ ID NO: 1078853 - protein, 9 aa, Homo Sapiens
KKKMKDCQL

SEQ ID NO: 1078854 - protein, 9 aa, Homo Sapiens
HFSFSLDFL

SEQ ID NO: 1078855 - protein, 9 aa, Homo Sapiens
EELENWDPG

SEQ ID NO: 1078856 - protein, 9 aa, Homo Sapiens
DFCQAMDSF

SEQ ID NO: 1078857 - protein, 9 aa, Homo Sapiens
LVDDFEEQK

SEQ ID NO: 1078858 - protein, 9 aa, Homo Sapiens
KVAYCPLML

SEQ ID NO: 1078859 - protein, 9 aa, Homo Sapiens
VSVSSPGPT

SEQ ID NO: 1078860 - protein, 9 aa, Homo Sapiens
GFSILERHH

SEQ ID NO: 1078861 - protein, 9 aa, Homo Sapiens
KTNTSFTIF

SEQ ID NO: 1078862 - protein, 9 aa, Homo Sapiens
NSFIYSLRN

SEQ ID NO: 1078863 - protein, 9 aa, Homo Sapiens
KYQAECFQF

SEQ ID NO: 1078864 - protein, 9 aa, Homo Sapiens
YLQTFLAGA

SEQ ID NO: 1078865 - protein, 9 aa, Homo Sapiens
HSTQGDQEA

SEQ ID NO: 1078866 - protein, 9 aa, Homo Sapiens
LCFGVDSWS

SEQ ID NO: 1078867 - protein, 9 aa, Homo Sapiens
TPAKLDAYA

SEQ ID NO: 1078868 - protein, 9 aa, Homo Sapiens
GQSSPYHSQ

SEQ ID NO: 1078869 - protein, 9 aa, Homo Sapiens
ECGVIIYNI

SEQ ID NO: 1078870 - protein, 9 aa, Homo Sapiens
QLRTMKFYF

SEQ ID NO: 1078871 - protein, 9 aa, Homo Sapiens
TNALYVLIG

SEQ ID NO: 1078872 - protein, 9 aa, Homo Sapiens
TEGSVLLQN

SEQ ID NO: 1078873 - protein, 9 aa, Homo Sapiens
IRPTFIRTE

SEQ ID NO: 1078874 - protein, 9 aa, Homo Sapiens
TASDLFGNH

SEQ ID NO: 1078875 - protein, 9 aa, Homo Sapiens
SQELSSAED

SEQ ID NO: 1078876 - protein, 9 aa, Homo Sapiens
TKSFLEEKD

SEQ ID NO: 1078877 - protein, 9 aa, Homo Sapiens
MDFLENQED

SEQ ID NO: 1078878 - protein, 9 aa, Homo Sapiens
SRGLIAAPQ

SEQ ID NO: 1078879 - protein, 9 aa, Homo Sapiens
TESKGVEAE

SEQ ID NO: 1078880 - protein, 9 aa, Homo Sapiens
THSGARLTP

SEQ ID NO: 1078881 - protein, 9 aa, Homo Sapiens
TLSYHKKIY

SEQ ID NO: 1078882 - protein, 9 aa, Homo Sapiens
HIQMNPYTV

SEQ ID NO: 1078883 - protein, 9 aa, Homo Sapiens
PCERPACQS

SEQ ID NO: 1078884 - protein, 9 aa, Homo Sapiens
AEKIAKEIQ

SEQ ID NO: 1078885 - protein, 9 aa, Homo Sapiens
AFSLEVPWK

SEQ ID NO: 1078886 - protein, 9 aa, Homo Sapiens
EGLLQDHGS

SEQ ID NO: 1078887 - protein, 9 aa, Homo Sapiens
RPMDEDSPS

SEQ ID NO: 1078888 - protein, 9 aa, Homo Sapiens
SAEESKPRF

SEQ ID NO: 1078889 - protein, 9 aa, Homo Sapiens
SQVFALSWS

SEQ ID NO: 1078890 - protein, 9 aa, Homo Sapiens
AGSQFLAFL

SEQ ID NO: 1078891 - protein, 9 aa, Homo Sapiens
EFISFRFAS

SEQ ID NO: 1078892 - protein, 9 aa, Homo Sapiens
QEFENFKTL

SEQ ID NO: 1078893 - protein, 9 aa, Homo Sapiens
WQPSPQGPP

SEQ ID NO: 1078894 - protein, 9 aa, Homo Sapiens
IKAPKIFMP

SEQ ID NO: 1078895 - protein, 9 aa, Homo Sapiens
LLISNSGHS

SEQ ID NO: 1078896 - protein, 9 aa, Homo Sapiens
YTDWANKEN

SEQ ID NO: 1078897 - protein, 9 aa, Homo Sapiens
NDLFPWLNN

SEQ ID NO: 1078898 - protein, 9 aa, Homo Sapiens
DPKINEGVL

SEQ ID NO: 1078899 - protein, 9 aa, Homo Sapiens
YNHLSSEIT

SEQ ID NO: 1078900 - protein, 9 aa, Homo Sapiens
SFCLTSDLV

SEQ ID NO: 1078901 - protein, 9 aa, Homo Sapiens
RFIGVILFS

SEQ ID NO: 1078902 - protein, 9 aa, Homo Sapiens
FKLEKSNLS

SEQ ID NO: 1078903 - protein, 9 aa, Homo Sapiens
ERFPLSEVM

SEQ ID NO: 1078904 - protein, 9 aa, Homo Sapiens
CNRGPDGAL

SEQ ID NO: 1078905 - protein, 9 aa, Homo Sapiens
RVFGIAFSS

SEQ ID NO: 1078906 - protein, 9 aa, Homo Sapiens
NEKKGDGEA

SEQ ID NO: 1078907 - protein, 9 aa, Homo Sapiens
TLPKKSLSE

SEQ ID NO: 1078908 - protein, 9 aa, Homo Sapiens
LSYKEFSAL

SEQ ID NO: 1078909 - protein, 9 aa, Homo Sapiens
PIQDFHYGQ

SEQ ID NO: 1078910 - protein, 9 aa, Homo Sapiens
DSTLELVSV

SEQ ID NO: 1078911 - protein, 9 aa, Homo Sapiens
SCGARGACK

SEQ ID NO: 1078912 - protein, 9 aa, Homo Sapiens
SMSLSLFVL

SEQ ID NO: 1078913 - protein, 9 aa, Homo Sapiens
AVNYAPLNL

SEQ ID NO: 1078914 - protein, 9 aa, Homo Sapiens
VKAEMKTLV

SEQ ID NO: 1078915 - protein, 9 aa, Homo Sapiens
QRSFCSTMA

SEQ ID NO: 1078916 - protein, 9 aa, Homo Sapiens
NSMLPLDVE

SEQ ID NO: 1078917 - protein, 9 aa, Homo Sapiens
EALQTTGTA

SEQ ID NO: 1078918 - protein, 9 aa, Homo Sapiens
SSTFYSLEE

SEQ ID NO: 1078919 - protein, 9 aa, Homo Sapiens
SRKIASEYK

SEQ ID NO: 1078920 - protein, 9 aa, Homo Sapiens
PPSKEPSLG

SEQ ID NO: 1078921 - protein, 9 aa, Homo Sapiens
LPVCSVADF

SEQ ID NO: 1078922 - protein, 9 aa, Homo Sapiens
GQPPEPSFL

SEQ ID NO: 1078923 - protein, 9 aa, Homo Sapiens
AFAPPGAFS

SEQ ID NO: 1078924 - protein, 9 aa, Homo Sapiens
PFSTQVEEL

SEQ ID NO: 1078925 - protein, 9 aa, Homo Sapiens
HKKIYTGGK

SEQ ID NO: 1078926 - protein, 9 aa, Homo Sapiens
TLQNEIQEG

SEQ ID NO: 1078927 - protein, 9 aa, Homo Sapiens
LGMPSSTER

SEQ ID NO: 1078928 - protein, 9 aa, Homo Sapiens
LGLASASSV

SEQ ID NO: 1078929 - protein, 9 aa, Homo Sapiens
MSSFAYVKK

SEQ ID NO: 1078930 - protein, 9 aa, Homo Sapiens
QEMTGKKEE

SEQ ID NO: 1078931 - protein, 9 aa, Homo Sapiens
KNVQETKIQ

SEQ ID NO: 1078932 - protein, 9 aa, Homo Sapiens
PSPAGPALS

SEQ ID NO: 1078933 - protein, 9 aa, Homo Sapiens
VRLKPCFLR

SEQ ID NO: 1078934 - protein, 9 aa, Homo Sapiens
TPKLRPPRP

SEQ ID NO: 1078935 - protein, 9 aa, Homo Sapiens
VTTLKGETR

SEQ ID NO: 1078936 - protein, 9 aa, Homo Sapiens
AHPLVGRGT

SEQ ID NO: 1078937 - protein, 9 aa, Homo Sapiens
RALCEGREK

SEQ ID NO: 1078938 - protein, 9 aa, Homo Sapiens
RKVVILEDN

SEQ ID NO: 1078939 - protein, 9 aa, Homo Sapiens
FLEKENEPS

SEQ ID NO: 1078940 - protein, 9 aa, Homo Sapiens
FPNAQSSQA

SEQ ID NO: 1078941 - protein, 9 aa, Homo Sapiens
TPSPVLRLS

SEQ ID NO: 1078942 - protein, 9 aa, Homo Sapiens
ECCFQSCDL

SEQ ID NO: 1078943 - protein, 9 aa, Homo Sapiens
SEESDQEKY

SEQ ID NO: 1078944 - protein, 9 aa, Homo Sapiens
NGYRDHSES

SEQ ID NO: 1078945 - protein, 9 aa, Homo Sapiens
LDVKGSKLD

SEQ ID NO: 1078946 - protein, 9 aa, Homo Sapiens
AQPKAPRFS

SEQ ID NO: 1078947 - protein, 9 aa, Homo Sapiens
SRNLSMDSF

SEQ ID NO: 1078948 - protein, 9 aa, Homo Sapiens
LAETYVGGT

SEQ ID NO: 1078949 - protein, 9 aa, Homo Sapiens
KSLYLGVLH

SEQ ID NO: 1078950 - protein, 9 aa, Homo Sapiens
GDNLAERVG

SEQ ID NO: 1078951 - protein, 9 aa, Homo Sapiens
DEEEVKFSG

SEQ ID NO: 1078952 - protein, 9 aa, Homo Sapiens
QPRFSSSDE

SEQ ID NO: 1078953 - protein, 9 aa, Homo Sapiens
GKTKSFLEE

SEQ ID NO: 1078954 - protein, 9 aa, Homo Sapiens
DRVTQPTGK

SEQ ID NO: 1078955 - protein, 9 aa, Homo Sapiens
LCKMAQAWR

SEQ ID NO: 1078956 - protein, 9 aa, Homo Sapiens
LLSLEDLLY

SEQ ID NO: 1078957 - protein, 9 aa, Homo Sapiens
PHSTRCRKK

SEQ ID NO: 1078958 - protein, 9 aa, Homo Sapiens
GVYSLPHFK

SEQ ID NO: 1078959 - protein, 9 aa, Homo Sapiens
SGPGEETFD

SEQ ID NO: 1078960 - protein, 9 aa, Homo Sapiens
TMTFPFRGF

SEQ ID NO: 1078961 - protein, 9 aa, Homo Sapiens
VNPESTQRP

SEQ ID NO: 1078962 - protein, 9 aa, Homo Sapiens
VLLQKLQHV

SEQ ID NO: 1078963 - protein, 9 aa, Homo Sapiens
RSFSFEKLR

SEQ ID NO: 1078964 - protein, 9 aa, Homo Sapiens
QALYMGKEN

SEQ ID NO: 1078965 - protein, 9 aa, Homo Sapiens
YSTSYPCFV

SEQ ID NO: 1078966 - protein, 9 aa, Homo Sapiens
MLNPSNRCL

SEQ ID NO: 1078967 - protein, 9 aa, Homo Sapiens
ELLGFSLLK

SEQ ID NO: 1078968 - protein, 9 aa, Homo Sapiens
DGAGATRED

SEQ ID NO: 1078969 - protein, 9 aa, Homo Sapiens
QTRVDSVSS

SEQ ID NO: 1078970 - protein, 9 aa, Homo Sapiens
RFITQSCLV

SEQ ID NO: 1078971 - protein, 9 aa, Homo Sapiens
RNVLENKLL

SEQ ID NO: 1078972 - protein, 9 aa, Homo Sapiens
LSTRIVGDI

SEQ ID NO: 1078973 - protein, 9 aa, Homo Sapiens
LTDEKTYDA

SEQ ID NO: 1078974 - protein, 9 aa, Homo Sapiens
VENSHSLSP

SEQ ID NO: 1078975 - protein, 9 aa, Homo Sapiens
YAIFGMSSF

SEQ ID NO: 1078976 - protein, 9 aa, Homo Sapiens
MGINNRFSS

SEQ ID NO: 1078977 - protein, 9 aa, Homo Sapiens
DETISDEEK

SEQ ID NO: 1078978 - protein, 9 aa, Homo Sapiens
PPSNLSPIK

SEQ ID NO: 1078979 - protein, 9 aa, Homo Sapiens
HLDTILGAS

SEQ ID NO: 1078980 - protein, 9 aa, Homo Sapiens
QKFLFETQA

SEQ ID NO: 1078981 - protein, 9 aa, Homo Sapiens
FAPTHQSHH

SEQ ID NO: 1078982 - protein, 9 aa, Homo Sapiens
QKSEVLERQ

SEQ ID NO: 1078983 - protein, 9 aa, Homo Sapiens
DVGVNFLQS

SEQ ID NO: 1078984 - protein, 9 aa, Homo Sapiens
KEQSGDGTR

SEQ ID NO: 1078985 - protein, 9 aa, Homo Sapiens
IEGPSGPIG

SEQ ID NO: 1078986 - protein, 9 aa, Homo Sapiens
VGTTSSRVC

SEQ ID NO: 1078987 - protein, 9 aa, Homo Sapiens
LGALQGDGL

SEQ ID NO: 1078988 - protein, 9 aa, Homo Sapiens
SLSPPWNRI

SEQ ID NO: 1078989 - protein, 9 aa, Homo Sapiens
QIYYTELEK

SEQ ID NO: 1078990 - protein, 9 aa, Homo Sapiens
KLNGPETWK

SEQ ID NO: 1078991 - protein, 9 aa, Homo Sapiens
GTSNSMLPL

SEQ ID NO: 1078992 - protein, 9 aa, Homo Sapiens
QNLSALTVD

SEQ ID NO: 1078993 - protein, 9 aa, Homo Sapiens
PSPKALQKV

SEQ ID NO: 1078994 - protein, 9 aa, Homo Sapiens
PGRDKAAPL

SEQ ID NO: 1078995 - protein, 9 aa, Homo Sapiens
WKFGWEENK

SEQ ID NO: 1078996 - protein, 9 aa, Homo Sapiens
GPRALQSVL

SEQ ID NO: 1078997 - protein, 9 aa, Homo Sapiens
LNWVVLNQG

SEQ ID NO: 1078998 - protein, 9 aa, Homo Sapiens
SFLRALHAD

SEQ ID NO: 1078999 - protein, 9 aa, Homo Sapiens
GGGTVPERN

SEQ ID NO: 1079000 - protein, 9 aa, Homo Sapiens
KIIFHLKKE

SEQ ID NO: 1079001 - protein, 9 aa, Homo Sapiens
LSKLDMLQA

SEQ ID NO: 1079002 - protein, 9 aa, Homo Sapiens
SYCASRIVD

SEQ ID NO: 1079003 - protein, 9 aa, Homo Sapiens
LVWGGQAEK

SEQ ID NO: 1079004 - protein, 9 aa, Homo Sapiens
HGFSILERH

SEQ ID NO: 1079005 - protein, 9 aa, Homo Sapiens
LLSPGSLKR

SEQ ID NO: 1079006 - protein, 9 aa, Homo Sapiens
IPHSTTRNT

SEQ ID NO: 1079007 - protein, 9 aa, Homo Sapiens
PLTDPEALA

SEQ ID NO: 1079008 - protein, 9 aa, Homo Sapiens
SSFNIEEFD

SEQ ID NO: 1079009 - protein, 9 aa, Homo Sapiens
CPLEEGNYF

SEQ ID NO: 1079010 - protein, 9 aa, Homo Sapiens
SQYSIPSSY

SEQ ID NO: 1079011 - protein, 9 aa, Homo Sapiens
TEKGTVQIQ

SEQ ID NO: 1079012 - protein, 9 aa, Homo Sapiens
RRIRPEFLQ

SEQ ID NO: 1079013 - protein, 9 aa, Homo Sapiens
VVNKGRKSF

SEQ ID NO: 1079014 - protein, 9 aa, Homo Sapiens
LMRKSTENV

SEQ ID NO: 1079015 - protein, 9 aa, Homo Sapiens
ALTSLELSS

SEQ ID NO: 1079016 - protein, 9 aa, Homo Sapiens
GKTRETVEN

SEQ ID NO: 1079017 - protein, 9 aa, Homo Sapiens
VCQQEGSRE

SEQ ID NO: 1079018 - protein, 9 aa, Homo Sapiens
FRYSKLSEG

SEQ ID NO: 1079019 - protein, 9 aa, Homo Sapiens
QKEIPFYFY

SEQ ID NO: 1079020 - protein, 9 aa, Homo Sapiens
AVMSYDCFT

SEQ ID NO: 1079021 - protein, 9 aa, Homo Sapiens
RPLFRPTQP

SEQ ID NO: 1079022 - protein, 9 aa, Homo Sapiens
EEQEKEGKQ

SEQ ID NO: 1079023 - protein, 9 aa, Homo Sapiens
LVILIFIVI

SEQ ID NO: 1079024 - protein, 9 aa, Homo Sapiens
NPLWSTAFK

SEQ ID NO: 1079025 - protein, 9 aa, Homo Sapiens
CIETSYSPG

SEQ ID NO: 1079026 - protein, 9 aa, Homo Sapiens
LPKLLDCFM

SEQ ID NO: 1079027 - protein, 9 aa, Homo Sapiens
WMFPADFQR

SEQ ID NO: 1079028 - protein, 9 aa, Homo Sapiens
ELFMGQLLQ

SEQ ID NO: 1079029 - protein, 9 aa, Homo Sapiens
ITAATVAPS

SEQ ID NO: 1079030 - protein, 9 aa, Homo Sapiens
VASSSYRTK

SEQ ID NO: 1079031 - protein, 9 aa, Homo Sapiens
CNSSYIVGF

SEQ ID NO: 1079032 - protein, 9 aa, Homo Sapiens
VNISRKRKG

SEQ ID NO: 1079033 - protein, 9 aa, Homo Sapiens
EIALVNQGD

SEQ ID NO: 1079034 - protein, 9 aa, Homo Sapiens
PGIEGPSGP

SEQ ID NO: 1079035 - protein, 9 aa, Homo Sapiens
LVKGVNFEA

SEQ ID NO: 1079036 - protein, 9 aa, Homo Sapiens
IRFKKFLPV

SEQ ID NO: 1079037 - protein, 9 aa, Homo Sapiens
AQIDLNWVV

SEQ ID NO: 1079038 - protein, 9 aa, Homo Sapiens
QDRWGEASS

SEQ ID NO: 1079039 - protein, 9 aa, Homo Sapiens
HISQPIRLR

SEQ ID NO: 1079040 - protein, 9 aa, Homo Sapiens
GPSKGGSSS

SEQ ID NO: 1079041 - protein, 9 aa, Homo Sapiens
PRGGSHDAE

SEQ ID NO: 1079042 - protein, 9 aa, Homo Sapiens
LVVLVKNNG

SEQ ID NO: 1079043 - protein, 9 aa, Homo Sapiens
FDCSRSGLG

SEQ ID NO: 1079044 - protein, 9 aa, Homo Sapiens
PMASMGPKP

SEQ ID NO: 1079045 - protein, 9 aa, Homo Sapiens
LPGEYNQHT

SEQ ID NO: 1079046 - protein, 9 aa, Homo Sapiens
LDRTKRQIS

SEQ ID NO: 1079047 - protein, 9 aa, Homo Sapiens
DHIDSFIGF

SEQ ID NO: 1079048 - protein, 9 aa, Homo Sapiens
FLKVVKPFG

SEQ ID NO: 1079049 - protein, 9 aa, Homo Sapiens
GKGEKNTMM

SEQ ID NO: 1079050 - protein, 9 aa, Homo Sapiens
LLDVMFLSV

SEQ ID NO: 1079051 - protein, 9 aa, Homo Sapiens
YLIKFSSKL

SEQ ID NO: 1079052 - protein, 9 aa, Homo Sapiens
IEPGIPRHA

SEQ ID NO: 1079053 - protein, 9 aa, Homo Sapiens
VKPLRNPEL

SEQ ID NO: 1079054 - protein, 9 aa, Homo Sapiens
SLLDVMFLS

SEQ ID NO: 1079055 - protein, 9 aa, Homo Sapiens
EEEEEEQPL

SEQ ID NO: 1079056 - protein, 9 aa, Homo Sapiens
GFSRHHENH

SEQ ID NO: 1079057 - protein, 9 aa, Homo Sapiens
GCYFCLSTL

SEQ ID NO: 1079058 - protein, 9 aa, Homo Sapiens
CKPKKKRRQ

SEQ ID NO: 1079059 - protein, 9 aa, Homo Sapiens
RFFRINDQR

SEQ ID NO: 1079060 - protein, 9 aa, Homo Sapiens
CSSAPSWPL

SEQ ID NO: 1079061 - protein, 9 aa, Homo Sapiens
SRVCDCVEV

SEQ ID NO: 1079062 - protein, 9 aa, Homo Sapiens
CAGIDLREF

SEQ ID NO: 1079063 - protein, 9 aa, Homo Sapiens
GEWKLCQDI

SEQ ID NO: 1079064 - protein, 9 aa, Homo Sapiens
TFSTNENKM

SEQ ID NO: 1079065 - protein, 9 aa, Homo Sapiens
IVKKGQLPI

SEQ ID NO: 1079066 - protein, 9 aa, Homo Sapiens
KSKEDNHSK

SEQ ID NO: 1079067 - protein, 9 aa, Homo Sapiens
LRGKALGVY

SEQ ID NO: 1079068 - protein, 9 aa, Homo Sapiens
FSSSDEIDL

SEQ ID NO: 1079069 - protein, 9 aa, Homo Sapiens
SYDCYVAVC

SEQ ID NO: 1079070 - protein, 9 aa, Homo Sapiens
IGGNAEGQP

SEQ ID NO: 1079071 - protein, 9 aa, Homo Sapiens
AAREVEALT

SEQ ID NO: 1079072 - protein, 9 aa, Homo Sapiens
LSPVQCLGL

SEQ ID NO: 1079073 - protein, 9 aa, Homo Sapiens
KIGMILSRA

SEQ ID NO: 1079074 - protein, 9 aa, Homo Sapiens
VPVENLEDP

SEQ ID NO: 1079075 - protein, 9 aa, Homo Sapiens
SMLPLDVEN

SEQ ID NO: 1079076 - protein, 9 aa, Homo Sapiens
DVICLMIEN

SEQ ID NO: 1079077 - protein, 9 aa, Homo Sapiens
NTSDPQKDN

SEQ ID NO: 1079078 - protein, 9 aa, Homo Sapiens
DDSAIKTLR

SEQ ID NO: 1079079 - protein, 9 aa, Homo Sapiens
KIPSAGEKY

SEQ ID NO: 1079080 - protein, 9 aa, Homo Sapiens
WWLNGQSLS

SEQ ID NO: 1079081 - protein, 9 aa, Homo Sapiens
YIRPTFIRT

SEQ ID NO: 1079082 - protein, 9 aa, Homo Sapiens
QPGAKGKPG

SEQ ID NO: 1079083 - protein, 9 aa, Homo Sapiens
SKGAFNGNE

SEQ ID NO: 1079084 - protein, 9 aa, Homo Sapiens
DGEKEPGFY

SEQ ID NO: 1079085 - protein, 9 aa, Homo Sapiens
TVSVKNILT

SEQ ID NO: 1079086 - protein, 9 aa, Homo Sapiens
IRIFAGQDS

SEQ ID NO: 1079087 - protein, 9 aa, Homo Sapiens
HPLVGRGTG

SEQ ID NO: 1079088 - protein, 9 aa, Homo Sapiens
EELSAEEEH

SEQ ID NO: 1079089 - protein, 9 aa, Homo Sapiens
VTNMQSIPP

SEQ ID NO: 1079090 - protein, 9 aa, Homo Sapiens
ALPKDHGTY

SEQ ID NO: 1079091 - protein, 9 aa, Homo Sapiens
AAEVGGSRG

SEQ ID NO: 1079092 - protein, 9 aa, Homo Sapiens
AYENRVKDM

SEQ ID NO: 1079093 - protein, 9 aa, Homo Sapiens
QPSSDESDD

SEQ ID NO: 1079094 - protein, 9 aa, Homo Sapiens
GLEELCPKG

SEQ ID NO: 1079095 - protein, 9 aa, Homo Sapiens
FTLRSINLF

SEQ ID NO: 1079096 - protein, 9 aa, Homo Sapiens
LLDIETKKE

SEQ ID NO: 1079097 - protein, 9 aa, Homo Sapiens
RMTHLVPGT

SEQ ID NO: 1079098 - protein, 9 aa, Homo Sapiens
SKLDMLQAE

SEQ ID NO: 1079099 - protein, 9 aa, Homo Sapiens
FQNRRAKKR

SEQ ID NO: 1079100 - protein, 9 aa, Homo Sapiens
LPNSASVSF

SEQ ID NO: 1079101 - protein, 9 aa, Homo Sapiens
VVWDNTEGE

SEQ ID NO: 1079102 - protein, 9 aa, Homo Sapiens
NVCAFPMKK

SEQ ID NO: 1079103 - protein, 9 aa, Homo Sapiens
ELQVTAGRP

SEQ ID NO: 1079104 - protein, 9 aa, Homo Sapiens
GHCIIPHTY

SEQ ID NO: 1079105 - protein, 9 aa, Homo Sapiens
NRSCNQKGG

SEQ ID NO: 1079106 - protein, 9 aa, Homo Sapiens
LLLNGRPTR

SEQ ID NO: 1079107 - protein, 9 aa, Homo Sapiens
MYQAEFPMS

SEQ ID NO: 1079108 - protein, 9 aa, Homo Sapiens
LSLGGTSAA

SEQ ID NO: 1079109 - protein, 9 aa, Homo Sapiens
RLMAGPLVL

SEQ ID NO: 1079110 - protein, 9 aa, Homo Sapiens
QSNRDYIPV

SEQ ID NO: 1079111 - protein, 9 aa, Homo Sapiens
TNQEVQEKF

SEQ ID NO: 1079112 - protein, 9 aa, Homo Sapiens
RGFFCKAGG

SEQ ID NO: 1079113 - protein, 9 aa, Homo Sapiens
PAFCASYNF

SEQ ID NO: 1079114 - protein, 9 aa, Homo Sapiens
SRNSGKDDC

SEQ ID NO: 1079115 - protein, 9 aa, Homo Sapiens
GFQLTHLLG

SEQ ID NO: 1079116 - protein, 9 aa, Homo Sapiens
RSQTHYITV

SEQ ID NO: 1079117 - protein, 9 aa, Homo Sapiens
LEKEAAEKL

SEQ ID NO: 1079118 - protein, 9 aa, Homo Sapiens
KQESSKIPK

SEQ ID NO: 1079119 - protein, 9 aa, Homo Sapiens
ISIHSNLLR

SEQ ID NO: 1079120 - protein, 9 aa, Homo Sapiens
KTSKFEPNH

SEQ ID NO: 1079121 - protein, 9 aa, Homo Sapiens
TFDCSRSGL

SEQ ID NO: 1079122 - protein, 9 aa, Homo Sapiens
SGLYACSVC

SEQ ID NO: 1079123 - protein, 9 aa, Homo Sapiens
AAQKKNAGE

SEQ ID NO: 1079124 - protein, 9 aa, Homo Sapiens
LLLPSSGGG

SEQ ID NO: 1079125 - protein, 9 aa, Homo Sapiens
DWVMLVRGG

SEQ ID NO: 1079126 - protein, 9 aa, Homo Sapiens
LSLLHNRLS

SEQ ID NO: 1079127 - protein, 9 aa, Homo Sapiens
RLLQLCLRL

SEQ ID NO: 1079128 - protein, 9 aa, Homo Sapiens
SVAFMENSV

SEQ ID NO: 1079129 - protein, 9 aa, Homo Sapiens
CAKCNLSFC

SEQ ID NO: 1079130 - protein, 9 aa, Homo Sapiens
VATGLHTKL

SEQ ID NO: 1079131 - protein, 9 aa, Homo Sapiens
DQDFGVNGQ

SEQ ID NO: 1079132 - protein, 9 aa, Homo Sapiens
YLDFGGPER

SEQ ID NO: 1079133 - protein, 9 aa, Homo Sapiens
LEGYRPILA

SEQ ID NO: 1079134 - protein, 9 aa, Homo Sapiens
TCEAGLIVG

SEQ ID NO: 1079135 - protein, 9 aa, Homo Sapiens
VKIQFFLGG

SEQ ID NO: 1079136 - protein, 9 aa, Homo Sapiens
QFVATGAVR

SEQ ID NO: 1079137 - protein, 9 aa, Homo Sapiens
RTYRAADGR

SEQ ID NO: 1079138 - protein, 9 aa, Homo Sapiens
DTDIKDAVN

SEQ ID NO: 1079139 - protein, 9 aa, Homo Sapiens
SGPEGPSGK

SEQ ID NO: 1079140 - protein, 9 aa, Homo Sapiens
KSCKFCGKT

SEQ ID NO: 1079141 - protein, 9 aa, Homo Sapiens
PLHSSDICP

SEQ ID NO: 1079142 - protein, 9 aa, Homo Sapiens
PCSISRDRE

SEQ ID NO: 1079143 - protein, 9 aa, Homo Sapiens
DRFLKVVKP

SEQ ID NO: 1079144 - protein, 9 aa, Homo Sapiens
VYSTVFRIC

SEQ ID NO: 1079145 - protein, 9 aa, Homo Sapiens
YIEATGGKY

SEQ ID NO: 1079146 - protein, 9 aa, Homo Sapiens
PEKENSPFA

SEQ ID NO: 1079147 - protein, 9 aa, Homo Sapiens
AQKNFRKQV

SEQ ID NO: 1079148 - protein, 9 aa, Homo Sapiens
DQGVKRSSG

SEQ ID NO: 1079149 - protein, 9 aa, Homo Sapiens
MGNARRPEK

SEQ ID NO: 1079150 - protein, 9 aa, Homo Sapiens
LSGRPIAEL

SEQ ID NO: 1079151 - protein, 9 aa, Homo Sapiens
WWTFDCSRS

SEQ ID NO: 1079152 - protein, 9 aa, Homo Sapiens
TTPISSLFF

SEQ ID NO: 1079153 - protein, 9 aa, Homo Sapiens
LLSGGRDCQ

SEQ ID NO: 1079154 - protein, 9 aa, Homo Sapiens
AGSPLLRDQ

SEQ ID NO: 1079155 - protein, 9 aa, Homo Sapiens
KAGNGTIDM

SEQ ID NO: 1079156 - protein, 9 aa, Homo Sapiens
LFHKNCMLK

SEQ ID NO: 1079157 - protein, 9 aa, Homo Sapiens
DLGREKIFR

SEQ ID NO: 1079158 - protein, 9 aa, Homo Sapiens
ALAQLNGCR

SEQ ID NO: 1079159 - protein, 9 aa, Homo Sapiens
NQHTKKQME

SEQ ID NO: 1079160 - protein, 9 aa, Homo Sapiens
HQLIYTGVK

SEQ ID NO: 1079161 - protein, 9 aa, Homo Sapiens
PKKPLQKYS

SEQ ID NO: 1079162 - protein, 9 aa, Homo Sapiens
TFFLDCTIR

SEQ ID NO: 1079163 - protein, 9 aa, Homo Sapiens
LITKERNCY

SEQ ID NO: 1079164 - protein, 9 aa, Homo Sapiens
EVPAFAFSL

SEQ ID NO: 1079165 - protein, 9 aa, Homo Sapiens
LYNGKLGFW

SEQ ID NO: 1079166 - protein, 9 aa, Homo Sapiens
SRKSRSLKK

SEQ ID NO: 1079167 - protein, 9 aa, Homo Sapiens
QFFTSPPPR

SEQ ID NO: 1079168 - protein, 9 aa, Homo Sapiens
RRAKKRKIN

SEQ ID NO: 1079169 - protein, 9 aa, Homo Sapiens
PIQALQEHR

SEQ ID NO: 1079170 - protein, 9 aa, Homo Sapiens
YWTVSQTGP

SEQ ID NO: 1079171 - protein, 9 aa, Homo Sapiens
GPPSPFMRA

SEQ ID NO: 1079172 - protein, 9 aa, Homo Sapiens
KRKINKKKL

SEQ ID NO: 1079173 - protein, 9 aa, Homo Sapiens
SLHSHNSST

SEQ ID NO: 1079174 - protein, 9 aa, Homo Sapiens
YVCMVQTRV

SEQ ID NO: 1079175 - protein, 9 aa, Homo Sapiens
ELDCWVVWK

SEQ ID NO: 1079176 - protein, 9 aa, Homo Sapiens
GAPQEDMTP

SEQ ID NO: 1079177 - protein, 9 aa, Homo Sapiens
GDGLLPAEL

SEQ ID NO: 1079178 - protein, 9 aa, Homo Sapiens
KLFLDNSQS

SEQ ID NO: 1079179 - protein, 9 aa, Homo Sapiens
LFVNGDLDR

SEQ ID NO: 1079180 - protein, 9 aa, Homo Sapiens
LHFGKERKK

SEQ ID NO: 1079181 - protein, 9 aa, Homo Sapiens
NLARATHNP

SEQ ID NO: 1079182 - protein, 9 aa, Homo Sapiens
RLARWRKKI

SEQ ID NO: 1079183 - protein, 9 aa, Homo Sapiens
SSWQPSPQG

SEQ ID NO: 1079184 - protein, 9 aa, Homo Sapiens
LSTSLQESH

SEQ ID NO: 1079185 - protein, 9 aa, Homo Sapiens
STNCEACMK

SEQ ID NO: 1079186 - protein, 9 aa, Homo Sapiens
FHDPYRQQS

SEQ ID NO: 1079187 - protein, 9 aa, Homo Sapiens
LLAAVFGYL

SEQ ID NO: 1079188 - protein, 9 aa, Homo Sapiens
HESLNATSQ

SEQ ID NO: 1079189 - protein, 9 aa, Homo Sapiens
LIEIKNCQK

SEQ ID NO: 1079190 - protein, 9 aa, Homo Sapiens
KEANTLDQD

SEQ ID NO: 1079191 - protein, 9 aa, Homo Sapiens
IFIVIFCLE

SEQ ID NO: 1079192 - protein, 9 aa, Homo Sapiens
RFEDFLAWK

SEQ ID NO: 1079193 - protein, 9 aa, Homo Sapiens
TAGRPGDDL

SEQ ID NO: 1079194 - protein, 9 aa, Homo Sapiens
RTVQMNHTF

SEQ ID NO: 1079195 - protein, 9 aa, Homo Sapiens
PQQIVHLFL

SEQ ID NO: 1079196 - protein, 9 aa, Homo Sapiens
GEKILKNTK

SEQ ID NO: 1079197 - protein, 9 aa, Homo Sapiens
TADHGHGRN

SEQ ID NO: 1079198 - protein, 9 aa, Homo Sapiens
EEEEGKPSC

SEQ ID NO: 1079199 - protein, 9 aa, Homo Sapiens
VEEELDRVQ

SEQ ID NO: 1079200 - protein, 9 aa, Homo Sapiens
TPSPAFCLD

SEQ ID NO: 1079201 - protein, 9 aa, Homo Sapiens
SFSILSDGV

SEQ ID NO: 1079202 - protein, 9 aa, Homo Sapiens
STPLSEDPN

SEQ ID NO: 1079203 - protein, 9 aa, Homo Sapiens
LNISKQWSN

SEQ ID NO: 1079204 - protein, 9 aa, Homo Sapiens
NPHLPPSLG

SEQ ID NO: 1079205 - protein, 9 aa, Homo Sapiens
HNLPGEYNQ

SEQ ID NO: 1079206 - protein, 9 aa, Homo Sapiens
TSSGRGPPS

SEQ ID NO: 1079207 - protein, 9 aa, Homo Sapiens
AAMRHQRKI

SEQ ID NO: 1079208 - protein, 9 aa, Homo Sapiens
PQEVLVNYY

SEQ ID NO: 1079209 - protein, 9 aa, Homo Sapiens
PWTAHLEMY

SEQ ID NO: 1079210 - protein, 9 aa, Homo Sapiens
TTTASPEGS

SEQ ID NO: 1079211 - protein, 9 aa, Homo Sapiens
SRSSQLQYY

SEQ ID NO: 1079212 - protein, 9 aa, Homo Sapiens
SPFSTVVST

SEQ ID NO: 1079213 - protein, 9 aa, Homo Sapiens
MGQLLQLQP

SEQ ID NO: 1079214 - protein, 9 aa, Homo Sapiens
GPKPHLPTH

SEQ ID NO: 1079215 - protein, 9 aa, Homo Sapiens
LYASNNVPK

SEQ ID NO: 1079216 - protein, 9 aa, Homo Sapiens
QQPPEKELN

SEQ ID NO: 1079217 - protein, 9 aa, Homo Sapiens
VCALSNIAV

SEQ ID NO: 1079218 - protein, 9 aa, Homo Sapiens
KKSKRQKEK

SEQ ID NO: 1079219 - protein, 9 aa, Homo Sapiens
PALCWRKTV

SEQ ID NO: 1079220 - protein, 9 aa, Homo Sapiens
WELREELRG

SEQ ID NO: 1079221 - protein, 9 aa, Homo Sapiens
REKPYKCET

SEQ ID NO: 1079222 - protein, 9 aa, Homo Sapiens
ETRKSLVLD

SEQ ID NO: 1079223 - protein, 9 aa, Homo Sapiens
SNPPGSSTE

SEQ ID NO: 1079224 - protein, 9 aa, Homo Sapiens
TDRVPSPFS

SEQ ID NO: 1079225 - protein, 9 aa, Homo Sapiens
FWYHLHGSQ

SEQ ID NO: 1079226 - protein, 9 aa, Homo Sapiens
QTRLLWKLR

SEQ ID NO: 1079227 - protein, 9 aa, Homo Sapiens
SEGPWGAPQ

SEQ ID NO: 1079228 - protein, 9 aa, Homo Sapiens
DQLPLSLRR

SEQ ID NO: 1079229 - protein, 9 aa, Homo Sapiens
NYHRSFISW

SEQ ID NO: 1079230 - protein, 9 aa, Homo Sapiens
HAADPLESQ

SEQ ID NO: 1079231 - protein, 9 aa, Homo Sapiens
REAEQGGTA

SEQ ID NO: 1079232 - protein, 9 aa, Homo Sapiens
VQRFSEAFF

SEQ ID NO: 1079233 - protein, 9 aa, Homo Sapiens
LRIQVCSCR

SEQ ID NO: 1079234 - protein, 9 aa, Homo Sapiens
PPASDGDGR

SEQ ID NO: 1079235 - protein, 9 aa, Homo Sapiens
ASGLKSMVS

SEQ ID NO: 1079236 - protein, 9 aa, Homo Sapiens
ANITILGSM

SEQ ID NO: 1079237 - protein, 9 aa, Homo Sapiens
NKSDSGTYD

SEQ ID NO: 1079238 - protein, 9 aa, Homo Sapiens
SYFLIIRMV

SEQ ID NO: 1079239 - protein, 9 aa, Homo Sapiens
PVEKREDSG

SEQ ID NO: 1079240 - protein, 9 aa, Homo Sapiens
FPGSSEYPL

SEQ ID NO: 1079241 - protein, 9 aa, Homo Sapiens
KSKRQKEKP

SEQ ID NO: 1079242 - protein, 9 aa, Homo Sapiens
DVWSFGVRL

SEQ ID NO: 1079243 - protein, 9 aa, Homo Sapiens
CCLFTESVK

SEQ ID NO: 1079244 - protein, 9 aa, Homo Sapiens
GTQNKQAAL

SEQ ID NO: 1079245 - protein, 9 aa, Homo Sapiens
SSELFCHLH

SEQ ID NO: 1079246 - protein, 9 aa, Homo Sapiens
HLVQHQLIY

SEQ ID NO: 1079247 - protein, 9 aa, Homo Sapiens
VSKFQHCGG

SEQ ID NO: 1079248 - protein, 9 aa, Homo Sapiens
RRIKLICVT

SEQ ID NO: 1079249 - protein, 9 aa, Homo Sapiens
VKNNGEPPR

SEQ ID NO: 1079250 - protein, 9 aa, Homo Sapiens
NEAAKNEVK

SEQ ID NO: 1079251 - protein, 9 aa, Homo Sapiens
EEPPEILSD

SEQ ID NO: 1079252 - protein, 9 aa, Homo Sapiens
GLKDKVLYK

SEQ ID NO: 1079253 - protein, 9 aa, Homo Sapiens
ESFEISKKK

SEQ ID NO: 1079254 - protein, 9 aa, Homo Sapiens
SLDSLSTCF

SEQ ID NO: 1079255 - protein, 9 aa, Homo Sapiens
LGHQRTSSG

SEQ ID NO: 1079256 - protein, 9 aa, Homo Sapiens
KGWDSPICT

SEQ ID NO: 1079257 - protein, 9 aa, Homo Sapiens
KNASVFISH

SEQ ID NO: 1079258 - protein, 9 aa, Homo Sapiens
LMMSLPFLF

SEQ ID NO: 1079259 - protein, 9 aa, Homo Sapiens
SPLPPFTPT

SEQ ID NO: 1079260 - protein, 9 aa, Homo Sapiens
HSFWNTIVK

SEQ ID NO: 1079261 - protein, 9 aa, Homo Sapiens
YNFWIDADH

SEQ ID NO: 1079262 - protein, 9 aa, Homo Sapiens
FSVAFMENS

SEQ ID NO: 1079263 - protein, 9 aa, Homo Sapiens
PDVGVNFLQ

SEQ ID NO: 1079264 - protein, 9 aa, Homo Sapiens
LSTLFTITC

SEQ ID NO: 1079265 - protein, 9 aa, Homo Sapiens
SAKKKYPEY

SEQ ID NO: 1079266 - protein, 9 aa, Homo Sapiens
PISQYSIPS

SEQ ID NO: 1079267 - protein, 9 aa, Homo Sapiens
RIHDPKLHH

SEQ ID NO: 1079268 - protein, 9 aa, Homo Sapiens
VKFSCSRMS

SEQ ID NO: 1079269 - protein, 9 aa, Homo Sapiens
AGVIGGLVI

SEQ ID NO: 1079270 - protein, 9 aa, Homo Sapiens
ALYNLHMWS

SEQ ID NO: 1079271 - protein, 9 aa, Homo Sapiens
EAGEILFYN

SEQ ID NO: 1079272 - protein, 9 aa, Homo Sapiens
AVIKLACAD

SEQ ID NO: 1079273 - protein, 9 aa, Homo Sapiens
RKVSGSRGF

SEQ ID NO: 1079274 - protein, 9 aa, Homo Sapiens
RNYPYSLKK

SEQ ID NO: 1079275 - protein, 9 aa, Homo Sapiens
ICLVNGKTP

SEQ ID NO: 1079276 - protein, 9 aa, Homo Sapiens
LAPLSKKVE

SEQ ID NO: 1079277 - protein, 9 aa, Homo Sapiens
GPGAAPLWS

SEQ ID NO: 1079278 - protein, 9 aa, Homo Sapiens
MISWIGVSV

SEQ ID NO: 1079279 - protein, 9 aa, Homo Sapiens
TRKRTLLDY

SEQ ID NO: 1079280 - protein, 9 aa, Homo Sapiens
PEDGADGKL

SEQ ID NO: 1079281 - protein, 9 aa, Homo Sapiens
ARPQFSATR

SEQ ID NO: 1079282 - protein, 9 aa, Homo Sapiens
GKFSLVQKE

SEQ ID NO: 1079283 - protein, 9 aa, Homo Sapiens
IVDWFNALC

SEQ ID NO: 1079284 - protein, 9 aa, Homo Sapiens
RASDESVLF

SEQ ID NO: 1079285 - protein, 9 aa, Homo Sapiens
LLEERGTFL

SEQ ID NO: 1079286 - protein, 9 aa, Homo Sapiens
VNFTDIKLN

SEQ ID NO: 1079287 - protein, 9 aa, Homo Sapiens
PDKGTSFDL

SEQ ID NO: 1079288 - protein, 9 aa, Homo Sapiens
RASEFSGPL

SEQ ID NO: 1079289 - protein, 9 aa, Homo Sapiens
QGRQPLIEG

SEQ ID NO: 1079290 - protein, 9 aa, Homo Sapiens
QLPLSLRRL

SEQ ID NO: 1079291 - protein, 9 aa, Homo Sapiens
VVRFMSTLL

SEQ ID NO: 1079292 - protein, 9 aa, Homo Sapiens
LSLYFVMVG

SEQ ID NO: 1079293 - protein, 9 aa, Homo Sapiens
QDVGRLECP

SEQ ID NO: 1079294 - protein, 9 aa, Homo Sapiens
SGEGGPKKT

SEQ ID NO: 1079295 - protein, 9 aa, Homo Sapiens
TLEGLLQDH

SEQ ID NO: 1079296 - protein, 9 aa, Homo Sapiens
PPERCRHLP

SEQ ID NO: 1079297 - protein, 9 aa, Homo Sapiens
MADEIRFSL

SEQ ID NO: 1079298 - protein, 9 aa, Homo Sapiens
IPVFRLARW

SEQ ID NO: 1079299 - protein, 9 aa, Homo Sapiens
GKGEKEGEG

SEQ ID NO: 1079300 - protein, 9 aa, Homo Sapiens
QPSEKNVVY

SEQ ID NO: 1079301 - protein, 9 aa, Homo Sapiens
KLRRIKANA

SEQ ID NO: 1079302 - protein, 9 aa, Homo Sapiens
PNGTRGWKK

SEQ ID NO: 1079303 - protein, 9 aa, Homo Sapiens
PPEPSFLRA

SEQ ID NO: 1079304 - protein, 9 aa, Homo Sapiens
ETSNSTWML

SEQ ID NO: 1079305 - protein, 9 aa, Homo Sapiens
RPTLRTSTA

SEQ ID NO: 1079306 - protein, 9 aa, Homo Sapiens
ALCWRKTVR

SEQ ID NO: 1079307 - protein, 9 aa, Homo Sapiens
TTSSRVCDC

SEQ ID NO: 1079308 - protein, 9 aa, Homo Sapiens
FMENSVMVL

SEQ ID NO: 1079309 - protein, 9 aa, Homo Sapiens
LYVLSTGFM

SEQ ID NO: 1079310 - protein, 9 aa, Homo Sapiens
TPSGEVFFE

SEQ ID NO: 1079311 - protein, 9 aa, Homo Sapiens
RSYKLRPDR

SEQ ID NO: 1079312 - protein, 9 aa, Homo Sapiens
LPEDDQAQF

SEQ ID NO: 1079313 - protein, 9 aa, Homo Sapiens
DIVTRSQAE

SEQ ID NO: 1079314 - protein, 9 aa, Homo Sapiens
GKLVVEEAP

SEQ ID NO: 1079315 - protein, 9 aa, Homo Sapiens
NECGKIFYS

SEQ ID NO: 1079316 - protein, 9 aa, Homo Sapiens
QNQPRFSSS

SEQ ID NO: 1079317 - protein, 9 aa, Homo Sapiens
DVLIEIKNC

SEQ ID NO: 1079318 - protein, 9 aa, Homo Sapiens
SSSSHAACS

SEQ ID NO: 1079319 - protein, 9 aa, Homo Sapiens
SPASKDSTE

SEQ ID NO: 1079320 - protein, 9 aa, Homo Sapiens
FSTNENKMK

SEQ ID NO: 1079321 - protein, 9 aa, Homo Sapiens
LQWQSQHHG

SEQ ID NO: 1079322 - protein, 9 aa, Homo Sapiens
YSLERDQVA

SEQ ID NO: 1079323 - protein, 9 aa, Homo Sapiens
YALAAGQFK

SEQ ID NO: 1079324 - protein, 9 aa, Homo Sapiens
SSSSKEDSP

SEQ ID NO: 1079325 - protein, 9 aa, Homo Sapiens
QDSSCVWVG

SEQ ID NO: 1079326 - protein, 9 aa, Homo Sapiens
RFGKFVEIQ

SEQ ID NO: 1079327 - protein, 9 aa, Homo Sapiens
SSSSQLFPL

SEQ ID NO: 1079328 - protein, 9 aa, Homo Sapiens
FFSKRNLIV

SEQ ID NO: 1079329 - protein, 9 aa, Homo Sapiens
GPPYNVRAS

SEQ ID NO: 1079330 - protein, 9 aa, Homo Sapiens
ILSVKHRKF

SEQ ID NO: 1079331 - protein, 9 aa, Homo Sapiens
SLIDTVYFS

SEQ ID NO: 1079332 - protein, 9 aa, Homo Sapiens
RFKKFLPVM

SEQ ID NO: 1079333 - protein, 9 aa, Homo Sapiens
STANYNLFS

SEQ ID NO: 1079334 - protein, 9 aa, Homo Sapiens
SSSLCDHER

SEQ ID NO: 1079335 - protein, 9 aa, Homo Sapiens
GDFGPREDQ

SEQ ID NO: 1079336 - protein, 9 aa, Homo Sapiens
EAFVRFFVK

SEQ ID NO: 1079337 - protein, 9 aa, Homo Sapiens
QSIDNSQDK

SEQ ID NO: 1079338 - protein, 9 aa, Homo Sapiens
EAIIYADLR

SEQ ID NO: 1079339 - protein, 9 aa, Homo Sapiens
EGCVQGRGE

SEQ ID NO: 1079340 - protein, 9 aa, Homo Sapiens
GSCQSPPGV

SEQ ID NO: 1079341 - protein, 9 aa, Homo Sapiens
RKLEDARAL

SEQ ID NO: 1079342 - protein, 9 aa, Homo Sapiens
GQCLLNTQW

SEQ ID NO: 1079343 - protein, 9 aa, Homo Sapiens
LATSGLVPG

SEQ ID NO: 1079344 - protein, 9 aa, Homo Sapiens
RLVTCVPRC

SEQ ID NO: 1079345 - protein, 9 aa, Homo Sapiens
EKDGFLLIS

SEQ ID NO: 1079346 - protein, 9 aa, Homo Sapiens
TAKLLSAEI

SEQ ID NO: 1079347 - protein, 9 aa, Homo Sapiens
KAYRHGISR

SEQ ID NO: 1079348 - protein, 9 aa, Homo Sapiens
QPLCTEVED

SEQ ID NO: 1079349 - protein, 9 aa, Homo Sapiens
ALLSPGSLK

SEQ ID NO: 1079350 - protein, 9 aa, Homo Sapiens
WVTILSAKK

SEQ ID NO: 1079351 - protein, 9 aa, Homo Sapiens
TFTIDEVFE

SEQ ID NO: 1079352 - protein, 9 aa, Homo Sapiens
AHEKVLPGD

SEQ ID NO: 1079353 - protein, 9 aa, Homo Sapiens
RCRKKDAQP

SEQ ID NO: 1079354 - protein, 9 aa, Homo Sapiens
SLATYAYKG

SEQ ID NO: 1079355 - protein, 9 aa, Homo Sapiens
EQSYKCNEG

SEQ ID NO: 1079356 - protein, 9 aa, Homo Sapiens
IQPTSQTIP

SEQ ID NO: 1079357 - protein, 9 aa, Homo Sapiens
MKPALPSAP

SEQ ID NO: 1079358 - protein, 9 aa, Homo Sapiens
ALVPVPAAT

SEQ ID NO: 1079359 - protein, 9 aa, Homo Sapiens
TWLRSPVQY

SEQ ID NO: 1079360 - protein, 9 aa, Homo Sapiens
DPGVLSRAT

SEQ ID NO: 1079361 - protein, 9 aa, Homo Sapiens
LVFFPKKKI

SEQ ID NO: 1079362 - protein, 9 aa, Homo Sapiens
LLCLGWGLP

SEQ ID NO: 1079363 - protein, 9 aa, Homo Sapiens
FLSVVAPKV

SEQ ID NO: 1079364 - protein, 9 aa, Homo Sapiens
LCPEAPSCC

SEQ ID NO: 1079365 - protein, 9 aa, Homo Sapiens
FIEVLDIAG

SEQ ID NO: 1079366 - protein, 9 aa, Homo Sapiens
CGKKCGKLQ

SEQ ID NO: 1079367 - protein, 9 aa, Homo Sapiens
EKKASIKKQ

SEQ ID NO: 1079368 - protein, 9 aa, Homo Sapiens
MLGRADTAL

SEQ ID NO: 1079369 - protein, 9 aa, Homo Sapiens
LALSTLSGE

SEQ ID NO: 1079370 - protein, 9 aa, Homo Sapiens
IIKLKVFLS

SEQ ID NO: 1079371 - protein, 9 aa, Homo Sapiens
WLASTFTQK

SEQ ID NO: 1079372 - protein, 9 aa, Homo Sapiens
AKLNFFKTS

SEQ ID NO: 1079373 - protein, 9 aa, Homo Sapiens
TYDEPPQPP

SEQ ID NO: 1079374 - protein, 9 aa, Homo Sapiens
VIEVVLEPG

SEQ ID NO: 1079375 - protein, 9 aa, Homo Sapiens
IAGDLEPST

SEQ ID NO: 1079376 - protein, 9 aa, Homo Sapiens
KIYNSTYLG

SEQ ID NO: 1079377 - protein, 9 aa, Homo Sapiens
CKFTCHPVC

SEQ ID NO: 1079378 - protein, 9 aa, Homo Sapiens
RCGSQKEYH

SEQ ID NO: 1079379 - protein, 9 aa, Homo Sapiens
PTPKLRPPR

SEQ ID NO: 1079380 - protein, 9 aa, Homo Sapiens
LSPESVCSS

SEQ ID NO: 1079381 - protein, 9 aa, Homo Sapiens
SKSELAQHQ

SEQ ID NO: 1079382 - protein, 9 aa, Homo Sapiens
AAGLHKPRS

SEQ ID NO: 1079383 - protein, 9 aa, Homo Sapiens
QYYRRVHTG

SEQ ID NO: 1079384 - protein, 9 aa, Homo Sapiens
DMLTALYNL

SEQ ID NO: 1079385 - protein, 9 aa, Homo Sapiens
PRLRRPRQL

SEQ ID NO: 1079386 - protein, 9 aa, Homo Sapiens
EKMNNYWNV

SEQ ID NO: 1079387 - protein, 9 aa, Homo Sapiens
LADRVRVKA

SEQ ID NO: 1079388 - protein, 9 aa, Homo Sapiens
KSFLSYKEF

SEQ ID NO: 1079389 - protein, 9 aa, Homo Sapiens
MPPPANIVK

SEQ ID NO: 1079390 - protein, 9 aa, Homo Sapiens
NFLIFELVE

SEQ ID NO: 1079391 - protein, 9 aa, Homo Sapiens
KKGSYPWQV

SEQ ID NO: 1079392 - protein, 9 aa, Homo Sapiens
YCSGSNKAY

SEQ ID NO: 1079393 - protein, 9 aa, Homo Sapiens
GERVAARER

SEQ ID NO: 1079394 - protein, 9 aa, Homo Sapiens
TTACMPTGL

SEQ ID NO: 1079395 - protein, 9 aa, Homo Sapiens
GRRRKNMSK

SEQ ID NO: 1079396 - protein, 9 aa, Homo Sapiens
INVYYIEAT

SEQ ID NO: 1079397 - protein, 9 aa, Homo Sapiens
AENNKTSFN

SEQ ID NO: 1079398 - protein, 9 aa, Homo Sapiens
GEMGNARRP

SEQ ID NO: 1079399 - protein, 9 aa, Homo Sapiens
FILAEIGIV

SEQ ID NO: 1079400 - protein, 9 aa, Homo Sapiens
YLWCKECLP

SEQ ID NO: 1079401 - protein, 9 aa, Homo Sapiens
LQYYRRVHT

SEQ ID NO: 1079402 - protein, 9 aa, Homo Sapiens
FFPKKKITD

SEQ ID NO: 1079403 - protein, 9 aa, Homo Sapiens
FGVPSAEPE

SEQ ID NO: 1079404 - protein, 9 aa, Homo Sapiens
QKMGMTKKK

SEQ ID NO: 1079405 - protein, 9 aa, Homo Sapiens
ANKGIFTQI

SEQ ID NO: 1079406 - protein, 9 aa, Homo Sapiens
NTFEYLGNF

SEQ ID NO: 1079407 - protein, 9 aa, Homo Sapiens
KIREQEKMI

SEQ ID NO: 1079408 - protein, 9 aa, Homo Sapiens
ESRPCVFDF

SEQ ID NO: 1079409 - protein, 9 aa, Homo Sapiens
VVTPMLNSF

SEQ ID NO: 1079410 - protein, 9 aa, Homo Sapiens
SDGGPVPSE

SEQ ID NO: 1079411 - protein, 9 aa, Homo Sapiens
LTPTHLSVK

SEQ ID NO: 1079412 - protein, 9 aa, Homo Sapiens
AENSTNALY

SEQ ID NO: 1079413 - protein, 9 aa, Homo Sapiens
NKFPWRKMV

SEQ ID NO: 1079414 - protein, 9 aa, Homo Sapiens
LTYDETISD

SEQ ID NO: 1079415 - protein, 9 aa, Homo Sapiens
HAQEFISFR

SEQ ID NO: 1079416 - protein, 9 aa, Homo Sapiens
QVLHECNSS

SEQ ID NO: 1079417 - protein, 9 aa, Homo Sapiens
PSPQAPEGS

SEQ ID NO: 1079418 - protein, 9 aa, Homo Sapiens
QPEKLLFNI

SEQ ID NO: 1079419 - protein, 9 aa, Homo Sapiens
AHYNCSFDY

SEQ ID NO: 1079420 - protein, 9 aa, Homo Sapiens
LDFLKQLEM

SEQ ID NO: 1079421 - protein, 9 aa, Homo Sapiens
LSCFAVRGQ

SEQ ID NO: 1079422 - protein, 9 aa, Homo Sapiens
ENTCYVNAS

SEQ ID NO: 1079423 - protein, 9 aa, Homo Sapiens
PKSVDPGAL

SEQ ID NO: 1079424 - protein, 9 aa, Homo Sapiens
TSCWAMAVA

SEQ ID NO: 1079425 - protein, 9 aa, Homo Sapiens
QNMCELSSP

SEQ ID NO: 1079426 - protein, 9 aa, Homo Sapiens
PIGDCVPNV

SEQ ID NO: 1079427 - protein, 9 aa, Homo Sapiens
RPIVPDPSA

SEQ ID NO: 1079428 - protein, 9 aa, Homo Sapiens
RHGILMSHV

SEQ ID NO: 1079429 - protein, 9 aa, Homo Sapiens
DFHYGQSER

SEQ ID NO: 1079430 - protein, 9 aa, Homo Sapiens
AAAFILAEI

SEQ ID NO: 1079431 - protein, 9 aa, Homo Sapiens
ASTFIDGKL

SEQ ID NO: 1079432 - protein, 9 aa, Homo Sapiens
DAIGGTLHP

SEQ ID NO: 1079433 - protein, 9 aa, Homo Sapiens
FAAGSPLLR

SEQ ID NO: 1079434 - protein, 9 aa, Homo Sapiens
QRIFGGPPP

SEQ ID NO: 1079435 - protein, 9 aa, Homo Sapiens
MKVFPPFYL

SEQ ID NO: 1079436 - protein, 9 aa, Homo Sapiens
IFPSSLDYQ

SEQ ID NO: 1079437 - protein, 9 aa, Homo Sapiens
RNAIMTQWN

SEQ ID NO: 1079438 - protein, 9 aa, Homo Sapiens
GSGTEILLA

SEQ ID NO: 1079439 - protein, 9 aa, Homo Sapiens
AAPALTELS

SEQ ID NO: 1079440 - protein, 9 aa, Homo Sapiens
ASKDSTEMS

SEQ ID NO: 1079441 - protein, 9 aa, Homo Sapiens
GDKDVVNKG

SEQ ID NO: 1079442 - protein, 9 aa, Homo Sapiens
CICPGQYNP

SEQ ID NO: 1079443 - protein, 9 aa, Homo Sapiens
NGLSEQKAQ

SEQ ID NO: 1079444 - protein, 9 aa, Homo Sapiens
LWKSKEDNH

SEQ ID NO: 1079445 - protein, 9 aa, Homo Sapiens
KDIARKRRQ

SEQ ID NO: 1079446 - protein, 9 aa, Homo Sapiens
SGGFPVRFS

SEQ ID NO: 1079447 - protein, 9 aa, Homo Sapiens
GMQACVELL

SEQ ID NO: 1079448 - protein, 9 aa, Homo Sapiens
LTSTAPRLI

SEQ ID NO: 1079449 - protein, 9 aa, Homo Sapiens
FSPIHKSEK

SEQ ID NO: 1079450 - protein, 9 aa, Homo Sapiens
ASVFISHNS

SEQ ID NO: 1079451 - protein, 9 aa, Homo Sapiens
VFRLARWRK

SEQ ID NO: 1079452 - protein, 9 aa, Homo Sapiens
CLHNQSRLD

SEQ ID NO: 1079453 - protein, 9 aa, Homo Sapiens
RFSSEKIAI

SEQ ID NO: 1079454 - protein, 9 aa, Homo Sapiens
RIHTRKRSY

SEQ ID NO: 1079455 - protein, 9 aa, Homo Sapiens
EDTWPGVYS

SEQ ID NO: 1079456 - protein, 9 aa, Homo Sapiens
RQQGRTLEP

SEQ ID NO: 1079457 - protein, 9 aa, Homo Sapiens
RGPWRKLNL

SEQ ID NO: 1079458 - protein, 9 aa, Homo Sapiens
NLLENPIQK

SEQ ID NO: 1079459 - protein, 9 aa, Homo Sapiens
TTSFRLTMA

SEQ ID NO: 1079460 - protein, 9 aa, Homo Sapiens
EEEQPLPEI

SEQ ID NO: 1079461 - protein, 9 aa, Homo Sapiens
RGLVQLVKS

SEQ ID NO: 1079462 - protein, 9 aa, Homo Sapiens
SRGAGRVCR

SEQ ID NO: 1079463 - protein, 9 aa, Homo Sapiens
VLQTWQKML

SEQ ID NO: 1079464 - protein, 9 aa, Homo Sapiens
VYREDNPTA

SEQ ID NO: 1079465 - protein, 9 aa, Homo Sapiens
FRQFLLGSR

SEQ ID NO: 1079466 - protein, 9 aa, Homo Sapiens
ELVKKGFNL

SEQ ID NO: 1079467 - protein, 9 aa, Homo Sapiens
PKNSKRLSS

SEQ ID NO: 1079468 - protein, 9 aa, Homo Sapiens
QNKGWDSPI

SEQ ID NO: 1079469 - protein, 9 aa, Homo Sapiens
AVKGPVQKY

SEQ ID NO: 1079470 - protein, 9 aa, Homo Sapiens
NLRRAPQLN

SEQ ID NO: 1079471 - protein, 9 aa, Homo Sapiens
PSLRLQNST

SEQ ID NO: 1079472 - protein, 9 aa, Homo Sapiens
PTTQFDAQE

SEQ ID NO: 1079473 - protein, 9 aa, Homo Sapiens
CEKSAVLLF

SEQ ID NO: 1079474 - protein, 9 aa, Homo Sapiens
SSLNIHQRT

SEQ ID NO: 1079475 - protein, 9 aa, Homo Sapiens
YVGDFVRLR

SEQ ID NO: 1079476 - protein, 9 aa, Homo Sapiens
MYSKTNTSF

SEQ ID NO: 1079477 - protein, 9 aa, Homo Sapiens
LAPTDVGLH

SEQ ID NO: 1079478 - protein, 9 aa, Homo Sapiens
SPVFVEWSE

SEQ ID NO: 1079479 - protein, 9 aa, Homo Sapiens
HTGTIFYRS

SEQ ID NO: 1079480 - protein, 9 aa, Homo Sapiens
FNDFDHRKR

SEQ ID NO: 1079481 - protein, 9 aa, Homo Sapiens
VLNGSLNYN

SEQ ID NO: 1079482 - protein, 9 aa, Homo Sapiens
FGSVFLFAA

SEQ ID NO: 1079483 - protein, 9 aa, Homo Sapiens
SRMITEFAC

SEQ ID NO: 1079484 - protein, 9 aa, Homo Sapiens
LLDSSHPVP

SEQ ID NO: 1079485 - protein, 9 aa, Homo Sapiens
SVLHGELSC

SEQ ID NO: 1079486 - protein, 9 aa, Homo Sapiens
SPEGSEATT

SEQ ID NO: 1079487 - protein, 9 aa, Homo Sapiens
KDVVNKGRK

SEQ ID NO: 1079488 - protein, 9 aa, Homo Sapiens
LPIPSITWE

SEQ ID NO: 1079489 - protein, 9 aa, Homo Sapiens
CCLGLCKLK

SEQ ID NO: 1079490 - protein, 9 aa, Homo Sapiens
SPVLRLSRK

SEQ ID NO: 1079491 - protein, 9 aa, Homo Sapiens
GSNKAYRHG

SEQ ID NO: 1079492 - protein, 9 aa, Homo Sapiens
PGCPKKAAG

SEQ ID NO: 1079493 - protein, 9 aa, Homo Sapiens
FTVRADVWE

SEQ ID NO: 1079494 - protein, 9 aa, Homo Sapiens
IKHSRGTYK

SEQ ID NO: 1079495 - protein, 9 aa, Homo Sapiens
MYLLAAVFG

SEQ ID NO: 1079496 - protein, 9 aa, Homo Sapiens
SEPPVIEEP

SEQ ID NO: 1079497 - protein, 9 aa, Homo Sapiens
YIRFKKFLP

SEQ ID NO: 1079498 - protein, 9 aa, Homo Sapiens
RLPRGCLLS

SEQ ID NO: 1079499 - protein, 9 aa, Homo Sapiens
KFSGTNFDE

SEQ ID NO: 1079500 - protein, 9 aa, Homo Sapiens
NDLDFLKQL

SEQ ID NO: 1079501 - protein, 9 aa, Homo Sapiens
LKGTQGVVT

SEQ ID NO: 1079502 - protein, 9 aa, Homo Sapiens
KLEDARALC

SEQ ID NO: 1079503 - protein, 9 aa, Homo Sapiens
STLSGEIFG

SEQ ID NO: 1079504 - protein, 9 aa, Homo Sapiens
CILFTHVLP

SEQ ID NO: 1079505 - protein, 9 aa, Homo Sapiens
LKLARKIIL

SEQ ID NO: 1079506 - protein, 9 aa, Homo Sapiens
KENSPFALK

SEQ ID NO: 1079507 - protein, 9 aa, Homo Sapiens
RTPSDVKKL

SEQ ID NO: 1079508 - protein, 9 aa, Homo Sapiens
EDEHSQRLN

SEQ ID NO: 1079509 - protein, 9 aa, Homo Sapiens
EHFPGLPIW

SEQ ID NO: 1079510 - protein, 9 aa, Homo Sapiens
SIISLAGGL

SEQ ID NO: 1079511 - protein, 9 aa, Homo Sapiens
TFDTFVYSQ

SEQ ID NO: 1079512 - protein, 9 aa, Homo Sapiens
IFSTGSIKG

SEQ ID NO: 1079513 - protein, 9 aa, Homo Sapiens
NHKNKELYS

SEQ ID NO: 1079514 - protein, 9 aa, Homo Sapiens
SDSGTYDCT

SEQ ID NO: 1079515 - protein, 9 aa, Homo Sapiens
KAEEDKILL

SEQ ID NO: 1079516 - protein, 9 aa, Homo Sapiens
RILEEPFRS

SEQ ID NO: 1079517 - protein, 9 aa, Homo Sapiens
CQKCETRVL

SEQ ID NO: 1079518 - protein, 9 aa, Homo Sapiens
YYLSQLCED

SEQ ID NO: 1079519 - protein, 9 aa, Homo Sapiens
GENNKKKMK

SEQ ID NO: 1079520 - protein, 9 aa, Homo Sapiens
NKRIYTGEK

SEQ ID NO: 1079521 - protein, 9 aa, Homo Sapiens
DIFSFLYRK

SEQ ID NO: 1079522 - protein, 9 aa, Homo Sapiens
AAVASEFGQ

SEQ ID NO: 1079523 - protein, 9 aa, Homo Sapiens
NWMQALTSC

SEQ ID NO: 1079524 - protein, 9 aa, Homo Sapiens
AAEIEWLEF

SEQ ID NO: 1079525 - protein, 9 aa, Homo Sapiens
PLSGKRRSP

SEQ ID NO: 1079526 - protein, 9 aa, Homo Sapiens
APGDFGPRE

SEQ ID NO: 1079527 - protein, 9 aa, Homo Sapiens
NNGVLAPAA

SEQ ID NO: 1079528 - protein, 9 aa, Homo Sapiens
GIPGIEGPS

SEQ ID NO: 1079529 - protein, 9 aa, Homo Sapiens
DAQKKKEER

SEQ ID NO: 1079530 - protein, 9 aa, Homo Sapiens
HMSNMEKKI

SEQ ID NO: 1079531 - protein, 9 aa, Homo Sapiens
LNGPETWKR

SEQ ID NO: 1079532 - protein, 9 aa, Homo Sapiens
KTLLMTACA

SEQ ID NO: 1079533 - protein, 9 aa, Homo Sapiens
PLGLLLDRL

SEQ ID NO: 1079534 - protein, 9 aa, Homo Sapiens
TLHQRFIAE

SEQ ID NO: 1079535 - protein, 9 aa, Homo Sapiens
SCYCLLNPF

SEQ ID NO: 1079536 - protein, 9 aa, Homo Sapiens
NITLQNEIQ

SEQ ID NO: 1079537 - protein, 9 aa, Homo Sapiens
SLTASRGLI

SEQ ID NO: 1079538 - protein, 9 aa, Homo Sapiens
LITGGSLGG

SEQ ID NO: 1079539 - protein, 9 aa, Homo Sapiens
LMYFLLGNL

SEQ ID NO: 1079540 - protein, 9 aa, Homo Sapiens
LAGKRIESS

SEQ ID NO: 1079541 - protein, 9 aa, Homo Sapiens
PAPAPSFWS

SEQ ID NO: 1079542 - protein, 9 aa, Homo Sapiens
PPQTPSLHG

SEQ ID NO: 1079543 - protein, 9 aa, Homo Sapiens
FIAILCSYG

SEQ ID NO: 1079544 - protein, 9 aa, Homo Sapiens
IHCLNGGGQ

SEQ ID NO: 1079545 - protein, 9 aa, Homo Sapiens
ATLLTVGHL

SEQ ID NO: 1079546 - protein, 9 aa, Homo Sapiens
LQPVPLNLP

SEQ ID NO: 1079547 - protein, 9 aa, Homo Sapiens
ALGLGGSWQ

SEQ ID NO: 1079548 - protein, 9 aa, Homo Sapiens
DPHFVLTEL

SEQ ID NO: 1079549 - protein, 9 aa, Homo Sapiens
QDIFSFLYR

SEQ ID NO: 1079550 - protein, 9 aa, Homo Sapiens
TALTSLELS

SEQ ID NO: 1079551 - protein, 9 aa, Homo Sapiens
IVSVLVISV

SEQ ID NO: 1079552 - protein, 9 aa, Homo Sapiens
EGILGVITE

SEQ ID NO: 1079553 - protein, 9 aa, Homo Sapiens
AQLMTKHLL

SEQ ID NO: 1079554 - protein, 9 aa, Homo Sapiens
QKLEQEVIS

SEQ ID NO: 1079555 - protein, 9 aa, Homo Sapiens
SVLRPSQFW

SEQ ID NO: 1079556 - protein, 9 aa, Homo Sapiens
GLKQFSCLS

SEQ ID NO: 1079557 - protein, 9 aa, Homo Sapiens
EVQTKKVQK

SEQ ID NO: 1079558 - protein, 9 aa, Homo Sapiens
TTASPEGSE

SEQ ID NO: 1079559 - protein, 9 aa, Homo Sapiens
DECISMMTP

SEQ ID NO: 1079560 - protein, 9 aa, Homo Sapiens
IISLAGGLP

SEQ ID NO: 1079561 - protein, 9 aa, Homo Sapiens
LYNTKQGQT

SEQ ID NO: 1079562 - protein, 9 aa, Homo Sapiens
IPKDDFNER

SEQ ID NO: 1079563 - protein, 9 aa, Homo Sapiens
HTRKRSYVC

SEQ ID NO: 1079564 - protein, 9 aa, Homo Sapiens
KAYENRVKD

SEQ ID NO: 1079565 - protein, 9 aa, Homo Sapiens
QLVWGGQAE

SEQ ID NO: 1079566 - protein, 9 aa, Homo Sapiens
GSCSQSGSS

SEQ ID NO: 1079567 - protein, 9 aa, Homo Sapiens
YFQQGSTNL

SEQ ID NO: 1079568 - protein, 9 aa, Homo Sapiens
TLQLKKKNI

SEQ ID NO: 1079569 - protein, 9 aa, Homo Sapiens
FLRALHADP

SEQ ID NO: 1079570 - protein, 9 aa, Homo Sapiens
RAIFFVGPV

SEQ ID NO: 1079571 - protein, 9 aa, Homo Sapiens
NLLLQERVK

SEQ ID NO: 1079572 - protein, 9 aa, Homo Sapiens
GLTPETTYF

SEQ ID NO: 1079573 - protein, 9 aa, Homo Sapiens
CTTVPKMAS

SEQ ID NO: 1079574 - protein, 9 aa, Homo Sapiens
GGEEARQGS

SEQ ID NO: 1079575 - protein, 9 aa, Homo Sapiens
PCSDGSESR

SEQ ID NO: 1079576 - protein, 9 aa, Homo Sapiens
QPTSQTIPA

SEQ ID NO: 1079577 - protein, 9 aa, Homo Sapiens
KLVVEEAPP

SEQ ID NO: 1079578 - protein, 9 aa, Homo Sapiens
TWKRNSCLR

SEQ ID NO: 1079579 - protein, 9 aa, Homo Sapiens
DPAAHALYS

SEQ ID NO: 1079580 - protein, 9 aa, Homo Sapiens
LKEGYQCPP

SEQ ID NO: 1079581 - protein, 9 aa, Homo Sapiens
RGGPPVSSW

SEQ ID NO: 1079582 - protein, 9 aa, Homo Sapiens
FFKKDKPLC

SEQ ID NO: 1079583 - protein, 9 aa, Homo Sapiens
KLPSSARAG

SEQ ID NO: 1079584 - protein, 9 aa, Homo Sapiens
DRKNGCSSS

SEQ ID NO: 1079585 - protein, 9 aa, Homo Sapiens
KVQHDLNLG

SEQ ID NO: 1079586 - protein, 9 aa, Homo Sapiens
FSFLLQESP

SEQ ID NO: 1079587 - protein, 9 aa, Homo Sapiens
CLKDEDLLE

SEQ ID NO: 1079588 - protein, 9 aa, Homo Sapiens
VSEAPGPLP

SEQ ID NO: 1079589 - protein, 9 aa, Homo Sapiens
SSRPLTRAR

SEQ ID NO: 1079590 - protein, 9 aa, Homo Sapiens
PNVISQADT

SEQ ID NO: 1079591 - protein, 9 aa, Homo Sapiens
IVHLFLQME

SEQ ID NO: 1079592 - protein, 9 aa, Homo Sapiens
INLFGNSRL

SEQ ID NO: 1079593 - protein, 9 aa, Homo Sapiens
QWLKEEYEE

SEQ ID NO: 1079594 - protein, 9 aa, Homo Sapiens
GIIAHAGQR

SEQ ID NO: 1079595 - protein, 9 aa, Homo Sapiens
LISIDRFLK

SEQ ID NO: 1079596 - protein, 9 aa, Homo Sapiens
NMLIKILNE

SEQ ID NO: 1079597 - protein, 9 aa, Homo Sapiens
GQVNHTMKV

SEQ ID NO: 1079598 - protein, 9 aa, Homo Sapiens
GQEAPEGKT

SEQ ID NO: 1079599 - protein, 9 aa, Homo Sapiens
ECIPDCTSW

SEQ ID NO: 1079600 - protein, 9 aa, Homo Sapiens
SQYRGVNIR

SEQ ID NO: 1079601 - protein, 9 aa, Homo Sapiens
TEHLDWVML

SEQ ID NO: 1079602 - protein, 9 aa, Homo Sapiens
KKKEERQEA

SEQ ID NO: 1079603 - protein, 9 aa, Homo Sapiens
LLMRLLECG

SEQ ID NO: 1079604 - protein, 9 aa, Homo Sapiens
DALPKDHGT

SEQ ID NO: 1079605 - protein, 9 aa, Homo Sapiens
QYPAVSFSP

SEQ ID NO: 1079606 - protein, 9 aa, Homo Sapiens
LSLYVMHSF

SEQ ID NO: 1079607 - protein, 9 aa, Homo Sapiens
PLCQKCETR

SEQ ID NO: 1079608 - protein, 9 aa, Homo Sapiens
HKVQHDLNL

SEQ ID NO: 1079609 - protein, 9 aa, Homo Sapiens
LGVELFERL

SEQ ID NO: 1079610 - protein, 9 aa, Homo Sapiens
QELTFKCHR

SEQ ID NO: 1079611 - protein, 9 aa, Homo Sapiens
EDGADGKLP

SEQ ID NO: 1079612 - protein, 9 aa, Homo Sapiens
DIARKRRQS

SEQ ID NO: 1079613 - protein, 9 aa, Homo Sapiens
IRVPDHTCK

SEQ ID NO: 1079614 - protein, 9 aa, Homo Sapiens
RGPAYMLNE

SEQ ID NO: 1079615 - protein, 9 aa, Homo Sapiens
LFFTQAALL

SEQ ID NO: 1079616 - protein, 9 aa, Homo Sapiens
EEEEEQPLP

SEQ ID NO: 1079617 - protein, 9 aa, Homo Sapiens
SELGAIKSF

SEQ ID NO: 1079618 - protein, 9 aa, Homo Sapiens
FLIISNNGL

SEQ ID NO: 1079619 - protein, 9 aa, Homo Sapiens
TRNKEQSGD

SEQ ID NO: 1079620 - protein, 9 aa, Homo Sapiens
WKPWRTLKK

SEQ ID NO: 1079621 - protein, 9 aa, Homo Sapiens
PYTVPEHLD

SEQ ID NO: 1079622 - protein, 9 aa, Homo Sapiens
EKPLSQESQ

SEQ ID NO: 1079623 - protein, 9 aa, Homo Sapiens
DVKEVDSTG

SEQ ID NO: 1079624 - protein, 9 aa, Homo Sapiens
HLGTGDLYT

SEQ ID NO: 1079625 - protein, 9 aa, Homo Sapiens
VCSVADFAP

SEQ ID NO: 1079626 - protein, 9 aa, Homo Sapiens
CQKLEETVR

SEQ ID NO: 1079627 - protein, 9 aa, Homo Sapiens
ELLFLRYIL

SEQ ID NO: 1079628 - protein, 9 aa, Homo Sapiens
PLEPRLRPG

SEQ ID NO: 1079629 - protein, 9 aa, Homo Sapiens
KGRYKQEFS

SEQ ID NO: 1079630 - protein, 9 aa, Homo Sapiens
KENLQTGDL

SEQ ID NO: 1079631 - protein, 9 aa, Homo Sapiens
NALCTPHSH

SEQ ID NO: 1079632 - protein, 9 aa, Homo Sapiens
YNQHTKKQM

SEQ ID NO: 1079633 - protein, 9 aa, Homo Sapiens
PAPLIFPSS

SEQ ID NO: 1079634 - protein, 9 aa, Homo Sapiens
MDAPPEGDQ

SEQ ID NO: 1079635 - protein, 9 aa, Homo Sapiens
LNLELHTLQ

SEQ ID NO: 1079636 - protein, 9 aa, Homo Sapiens
MRHQRKIPE

SEQ ID NO: 1079637 - protein, 9 aa, Homo Sapiens
GVEMERRAS

SEQ ID NO: 1079638 - protein, 9 aa, Homo Sapiens
DKDPVQIEG

SEQ ID NO: 1079639 - protein, 9 aa, Homo Sapiens
SQEQKPEEE

SEQ ID NO: 1079640 - protein, 9 aa, Homo Sapiens
LPVDPHSLR

SEQ ID NO: 1079641 - protein, 9 aa, Homo Sapiens
HEVMGPKNK

SEQ ID NO: 1079642 - protein, 9 aa, Homo Sapiens
MFNSSLYAL

SEQ ID NO: 1079643 - protein, 9 aa, Homo Sapiens
STAKRQFVQ

SEQ ID NO: 1079644 - protein, 9 aa, Homo Sapiens
NQGDADKEI

SEQ ID NO: 1079645 - protein, 9 aa, Homo Sapiens
IVLFIKMLK

SEQ ID NO: 1079646 - protein, 9 aa, Homo Sapiens
GSPAGSFSI

SEQ ID NO: 1079647 - protein, 9 aa, Homo Sapiens
SCFAVRGQA

SEQ ID NO: 1079648 - protein, 9 aa, Homo Sapiens
KTHSRIHSR

SEQ ID NO: 1079649 - protein, 9 aa, Homo Sapiens
SLPWRAETF

SEQ ID NO: 1079650 - protein, 9 aa, Homo Sapiens
RMPPSCSDS

SEQ ID NO: 1079651 - protein, 9 aa, Homo Sapiens
EQIKQPTPL

SEQ ID NO: 1079652 - protein, 9 aa, Homo Sapiens
TMDGFYRSF

SEQ ID NO: 1079653 - protein, 9 aa, Homo Sapiens
PQPQQKLFV

SEQ ID NO: 1079654 - protein, 9 aa, Homo Sapiens
NYPIVLGPN

SEQ ID NO: 1079655 - protein, 9 aa, Homo Sapiens
QREKPLGQD

SEQ ID NO: 1079656 - protein, 9 aa, Homo Sapiens
YLPAPEVFP

SEQ ID NO: 1079657 - protein, 9 aa, Homo Sapiens
TAQSNRDYI

SEQ ID NO: 1079658 - protein, 9 aa, Homo Sapiens
KSSSDKVAG

SEQ ID NO: 1079659 - protein, 9 aa, Homo Sapiens
LKKAYSAAG

SEQ ID NO: 1079660 - protein, 9 aa, Homo Sapiens
FGFPHSFLL

SEQ ID NO: 1079661 - protein, 9 aa, Homo Sapiens
SIKKQKAKR

SEQ ID NO: 1079662 - protein, 9 aa, Homo Sapiens
TRFQEQEVL

SEQ ID NO: 1079663 - protein, 9 aa, Homo Sapiens
IHTAEKPNK

SEQ ID NO: 1079664 - protein, 9 aa, Homo Sapiens
KFLGEASIP

SEQ ID NO: 1079665 - protein, 9 aa, Homo Sapiens
AKRWKFGWE

SEQ ID NO: 1079666 - protein, 9 aa, Homo Sapiens
GFNLPVLVF

SEQ ID NO: 1079667 - protein, 9 aa, Homo Sapiens
EAICHHPAA

SEQ ID NO: 1079668 - protein, 9 aa, Homo Sapiens
PQPFPNAQS

SEQ ID NO: 1079669 - protein, 9 aa, Homo Sapiens
FHAHRDREI

SEQ ID NO: 1079670 - protein, 9 aa, Homo Sapiens
HLFFTPVDW

SEQ ID NO: 1079671 - protein, 9 aa, Homo Sapiens
KCCLFTESV

SEQ ID NO: 1079672 - protein, 9 aa, Homo Sapiens
MRFEDFLAW

SEQ ID NO: 1079673 - protein, 9 aa, Homo Sapiens
IFLLLAAGL

SEQ ID NO: 1079674 - protein, 9 aa, Homo Sapiens
PFLFNIGLL

SEQ ID NO: 1079675 - protein, 9 aa, Homo Sapiens
LSNIAVDQL

SEQ ID NO: 1079676 - protein, 9 aa, Homo Sapiens
AAAGVDGLP

SEQ ID NO: 1079677 - protein, 9 aa, Homo Sapiens
EWKLCQDIT

SEQ ID NO: 1079678 - protein, 9 aa, Homo Sapiens
QCLLNTQWQ

SEQ ID NO: 1079679 - protein, 9 aa, Homo Sapiens
HQEQIKQPT

SEQ ID NO: 1079680 - protein, 9 aa, Homo Sapiens
VFFEVAVNE

SEQ ID NO: 1079681 - protein, 9 aa, Homo Sapiens
ALKNHFRLH

SEQ ID NO: 1079682 - protein, 9 aa, Homo Sapiens
NAIAIAIVG

SEQ ID NO: 1079683 - protein, 9 aa, Homo Sapiens
ALAAGQFKT

SEQ ID NO: 1079684 - protein, 9 aa, Homo Sapiens
QKKVVVHLD

SEQ ID NO: 1079685 - protein, 9 aa, Homo Sapiens
DFQLENGYD

SEQ ID NO: 1079686 - protein, 9 aa, Homo Sapiens
PSPLPTYHV

SEQ ID NO: 1079687 - protein, 9 aa, Homo Sapiens
APALTELSL

SEQ ID NO: 1079688 - protein, 9 aa, Homo Sapiens
DTESKGVEA

SEQ ID NO: 1079689 - protein, 9 aa, Homo Sapiens
EGDTGCREL

SEQ ID NO: 1079690 - protein, 9 aa, Homo Sapiens
DEVKAETIP

SEQ ID NO: 1079691 - protein, 9 aa, Homo Sapiens
GDLRVRTLF

SEQ ID NO: 1079692 - protein, 9 aa, Homo Sapiens
WRKLNLELH

SEQ ID NO: 1079693 - protein, 9 aa, Homo Sapiens
LLDCFMEIK

SEQ ID NO: 1079694 - protein, 9 aa, Homo Sapiens
ALSTRIVGD

SEQ ID NO: 1079695 - protein, 9 aa, Homo Sapiens
APILTLSGF

SEQ ID NO: 1079696 - protein, 9 aa, Homo Sapiens
CSRSGLGLG

SEQ ID NO: 1079697 - protein, 9 aa, Homo Sapiens
RFNDFDHRK

SEQ ID NO: 1079698 - protein, 9 aa, Homo Sapiens
YKSTDQEFE

SEQ ID NO: 1079699 - protein, 9 aa, Homo Sapiens
GKFYYKFFR

SEQ ID NO: 1079700 - protein, 9 aa, Homo Sapiens
TKLGKIRSQ

SEQ ID NO: 1079701 - protein, 9 aa, Homo Sapiens
DWFNALCAA

SEQ ID NO: 1079702 - protein, 9 aa, Homo Sapiens
FSTQVEELL

SEQ ID NO: 1079703 - protein, 9 aa, Homo Sapiens
RLEILVAEV

SEQ ID NO: 1079704 - protein, 9 aa, Homo Sapiens
NRFWKEIYV

SEQ ID NO: 1079705 - protein, 9 aa, Homo Sapiens
KLPRQFFIE

SEQ ID NO: 1079706 - protein, 9 aa, Homo Sapiens
TFSQSQQGC

SEQ ID NO: 1079707 - protein, 9 aa, Homo Sapiens
SQSCQTPDD

SEQ ID NO: 1079708 - protein, 9 aa, Homo Sapiens
SDGDGRTAP

SEQ ID NO: 1079709 - protein, 9 aa, Homo Sapiens
FSLDFLVKS

SEQ ID NO: 1079710 - protein, 9 aa, Homo Sapiens
LDKQDKDGN

SEQ ID NO: 1079711 - protein, 9 aa, Homo Sapiens
TSGSCLHSL

SEQ ID NO: 1079712 - protein, 9 aa, Homo Sapiens
STNALYVLI

SEQ ID NO: 1079713 - protein, 9 aa, Homo Sapiens
LKAAGGPPE

SEQ ID NO: 1079714 - protein, 9 aa, Homo Sapiens
ERPPRPPSP

SEQ ID NO: 1079715 - protein, 9 aa, Homo Sapiens
PKSSSDKVA

SEQ ID NO: 1079716 - protein, 9 aa, Homo Sapiens
LKNELNEDK

SEQ ID NO: 1079717 - protein, 9 aa, Homo Sapiens
QVCQQEGSR

SEQ ID NO: 1079718 - protein, 9 aa, Homo Sapiens
IRKKTDAHF

SEQ ID NO: 1079719 - protein, 9 aa, Homo Sapiens
NAWLLYELQ

SEQ ID NO: 1079720 - protein, 9 aa, Homo Sapiens
HQRFIAELV

SEQ ID NO: 1079721 - protein, 9 aa, Homo Sapiens
GVLSRATPD

SEQ ID NO: 1079722 - protein, 9 aa, Homo Sapiens
PHPAMLLIF

SEQ ID NO: 1079723 - protein, 9 aa, Homo Sapiens
GDIWWFFTL

SEQ ID NO: 1079724 - protein, 9 aa, Homo Sapiens
RADTALTNT

SEQ ID NO: 1079725 - protein, 9 aa, Homo Sapiens
YLLGFPGSQ

SEQ ID NO: 1079726 - protein, 9 aa, Homo Sapiens
LEQCMQDSF

SEQ ID NO: 1079727 - protein, 9 aa, Homo Sapiens
SPPDANVTW

SEQ ID NO: 1079728 - protein, 9 aa, Homo Sapiens
NRTATNMKY

SEQ ID NO: 1079729 - protein, 9 aa, Homo Sapiens
EHQKISFGD

SEQ ID NO: 1079730 - protein, 9 aa, Homo Sapiens
GDLYTPGFP

SEQ ID NO: 1079731 - protein, 9 aa, Homo Sapiens
RLVAGSQFL

SEQ ID NO: 1079732 - protein, 9 aa, Homo Sapiens
AEWARMEKI

SEQ ID NO: 1079733 - protein, 9 aa, Homo Sapiens
WKWSSEKRF

SEQ ID NO: 1079734 - protein, 9 aa, Homo Sapiens
PGLQGDPGF

SEQ ID NO: 1079735 - protein, 9 aa, Homo Sapiens
FSGHRPPDC

SEQ ID NO: 1079736 - protein, 9 aa, Homo Sapiens
CGKAFSWGL

SEQ ID NO: 1079737 - protein, 9 aa, Homo Sapiens
SLKRRRCAP

SEQ ID NO: 1079738 - protein, 9 aa, Homo Sapiens
HGILMSHVA

SEQ ID NO: 1079739 - protein, 9 aa, Homo Sapiens
GYMPFEGPQ

SEQ ID NO: 1079740 - protein, 9 aa, Homo Sapiens
QLNGCRAFI

SEQ ID NO: 1079741 - protein, 9 aa, Homo Sapiens
RRKMRLSPV

SEQ ID NO: 1079742 - protein, 9 aa, Homo Sapiens
FSRLSRRSS

SEQ ID NO: 1079743 - protein, 9 aa, Homo Sapiens
FRAAIKQGS

SEQ ID NO: 1079744 - protein, 9 aa, Homo Sapiens
QGQMIWIES

SEQ ID NO: 1079745 - protein, 9 aa, Homo Sapiens
TDKTFQNQA

SEQ ID NO: 1079746 - protein, 9 aa, Homo Sapiens
SRWNNLHRH

SEQ ID NO: 1079747 - protein, 9 aa, Homo Sapiens
AKASRKIAS

SEQ ID NO: 1079748 - protein, 9 aa, Homo Sapiens
FTPRTPFPS

SEQ ID NO: 1079749 - protein, 9 aa, Homo Sapiens
LIRFYIQRN

SEQ ID NO: 1079750 - protein, 9 aa, Homo Sapiens
YIYMCLLWE

SEQ ID NO: 1079751 - protein, 9 aa, Homo Sapiens
LYISLEYRS

SEQ ID NO: 1079752 - protein, 9 aa, Homo Sapiens
GDPESLDSL

SEQ ID NO: 1079753 - protein, 9 aa, Homo Sapiens
WRGTNVNMK

SEQ ID NO: 1079754 - protein, 9 aa, Homo Sapiens
LPEQKLFIR

SEQ ID NO: 1079755 - protein, 9 aa, Homo Sapiens
AYMLNEKGT

SEQ ID NO: 1079756 - protein, 9 aa, Homo Sapiens
ERLECSEDN

SEQ ID NO: 1079757 - protein, 9 aa, Homo Sapiens
GKVCSAAAR

SEQ ID NO: 1079758 - protein, 9 aa, Homo Sapiens
EKYECVATN

SEQ ID NO: 1079759 - protein, 9 aa, Homo Sapiens
HASRNGPGR

SEQ ID NO: 1079760 - protein, 9 aa, Homo Sapiens
GAQTPSPAF

SEQ ID NO: 1079761 - protein, 9 aa, Homo Sapiens
PHPDKGTSF

SEQ ID NO: 1079762 - protein, 9 aa, Homo Sapiens
DGDLGQNAW

SEQ ID NO: 1079763 - protein, 9 aa, Homo Sapiens
ILPEKENSP

SEQ ID NO: 1079764 - protein, 8 aa, Homo Sapiens
NLGVSMLR

SEQ ID NO: 1079765 - protein, 9 aa, Homo Sapiens
IENAMKTEG

SEQ ID NO: 1079766 - protein, 9 aa, Homo Sapiens
LDPYQSMPT

SEQ ID NO: 1079767 - protein, 9 aa, Homo Sapiens
MRPAGEVAV

SEQ ID NO: 1079768 - protein, 9 aa, Homo Sapiens
QSSSSKEDS

SEQ ID NO: 1079769 - protein, 9 aa, Homo Sapiens
KVDNRAVKS

SEQ ID NO: 1079770 - protein, 9 aa, Homo Sapiens
SGNEDIIEV

SEQ ID NO: 1079771 - protein, 9 aa, Homo Sapiens
KQEVKTLND

SEQ ID NO: 1079772 - protein, 9 aa, Homo Sapiens
KTRFQEQEV

SEQ ID NO: 1079773 - protein, 9 aa, Homo Sapiens
KKLDHCNIV

SEQ ID NO: 1079774 - protein, 9 aa, Homo Sapiens
KATDALGHL

SEQ ID NO: 1079775 - protein, 9 aa, Homo Sapiens
IAREVELKK

SEQ ID NO: 1079776 - protein, 9 aa, Homo Sapiens
MGPPSPFMR

SEQ ID NO: 1079777 - protein, 9 aa, Homo Sapiens
VPDPGTGAF

SEQ ID NO: 1079778 - protein, 9 aa, Homo Sapiens
HFVLTELWP

SEQ ID NO: 1079779 - protein, 9 aa, Homo Sapiens
GFSRSSSLN

SEQ ID NO: 1079780 - protein, 9 aa, Homo Sapiens
ASIACSPVS

SEQ ID NO: 1079781 - protein, 9 aa, Homo Sapiens
TYEKSCQDL

SEQ ID NO: 1079782 - protein, 9 aa, Homo Sapiens
VHTGEKLYK

SEQ ID NO: 1079783 - protein, 9 aa, Homo Sapiens
KNFNIKEGS

SEQ ID NO: 1079784 - protein, 9 aa, Homo Sapiens
IFGMSSFAY

SEQ ID NO: 1079785 - protein, 9 aa, Homo Sapiens
HAHLGTGDL

SEQ ID NO: 1079786 - protein, 9 aa, Homo Sapiens
VSPPDANVT

SEQ ID NO: 1079787 - protein, 9 aa, Homo Sapiens
YFCLSTLFT

SEQ ID NO: 1079788 - protein, 9 aa, Homo Sapiens
KLTLPKKSL

SEQ ID NO: 1079789 - protein, 9 aa, Homo Sapiens
SPGAPNLAR

SEQ ID NO: 1079790 - protein, 9 aa, Homo Sapiens
MSYDCFTAI

SEQ ID NO: 1079791 - protein, 9 aa, Homo Sapiens
MVQCVLSSS

SEQ ID NO: 1079792 - protein, 9 aa, Homo Sapiens
AQLLSRKCG

SEQ ID NO: 1079793 - protein, 9 aa, Homo Sapiens
QFKTALELC

SEQ ID NO: 1079794 - protein, 9 aa, Homo Sapiens
GFFCKAGGT

SEQ ID NO: 1079795 - protein, 9 aa, Homo Sapiens
SYSLVFKEA

SEQ ID NO: 1079796 - protein, 9 aa, Homo Sapiens
VKENGEVKS

SEQ ID NO: 1079797 - protein, 9 aa, Homo Sapiens
MTTLQPHLF

SEQ ID NO: 1079798 - protein, 9 aa, Homo Sapiens
RMLQERGLP

SEQ ID NO: 1079799 - protein, 9 aa, Homo Sapiens
VLVFKKEKI

SEQ ID NO: 1079800 - protein, 9 aa, Homo Sapiens
KNHFRLHAQ

SEQ ID NO: 1079801 - protein, 9 aa, Homo Sapiens
LAADAELPR

SEQ ID NO: 1079802 - protein, 9 aa, Homo Sapiens
AMGWVFVLS

SEQ ID NO: 1079803 - protein, 9 aa, Homo Sapiens
VQSFSENAA

SEQ ID NO: 1079804 - protein, 9 aa, Homo Sapiens
FFCKAHGFY

SEQ ID NO: 1079805 - protein, 9 aa, Homo Sapiens
DTFTIDEVF

SEQ ID NO: 1079806 - protein, 9 aa, Homo Sapiens
VKAHWLGCF

SEQ ID NO: 1079807 - protein, 9 aa, Homo Sapiens
LDGSDAAPQ

SEQ ID NO: 1079808 - protein, 9 aa, Homo Sapiens
GPSGAIGPK

SEQ ID NO: 1079809 - protein, 9 aa, Homo Sapiens
YDLNKIAKK

SEQ ID NO: 1079810 - protein, 9 aa, Homo Sapiens
SYSIEMSRE

SEQ ID NO: 1079811 - protein, 9 aa, Homo Sapiens
LVAKLAKAQ

SEQ ID NO: 1079812 - protein, 9 aa, Homo Sapiens
NIADPTLKC

SEQ ID NO: 1079813 - protein, 9 aa, Homo Sapiens
TNTSFTIFE

SEQ ID NO: 1079814 - protein, 9 aa, Homo Sapiens
TLLTLPNDT

SEQ ID NO: 1079815 - protein, 9 aa, Homo Sapiens
REFRKSDIK

SEQ ID NO: 1079816 - protein, 9 aa, Homo Sapiens
FTPTPPCAE

SEQ ID NO: 1079817 - protein, 9 aa, Homo Sapiens
PALSLGDTA

SEQ ID NO: 1079818 - protein, 9 aa, Homo Sapiens
PKLRPPRPL

SEQ ID NO: 1079819 - protein, 9 aa, Homo Sapiens
QCDPKTGEC

SEQ ID NO: 1079820 - protein, 9 aa, Homo Sapiens
ASFVKTYNT

SEQ ID NO: 1079821 - protein, 9 aa, Homo Sapiens
QKRSLKATS

SEQ ID NO: 1079822 - protein, 9 aa, Homo Sapiens
LSPPWNRIF

SEQ ID NO: 1079823 - protein, 9 aa, Homo Sapiens
DARYRLEMP

SEQ ID NO: 1079824 - protein, 9 aa, Homo Sapiens
RPGDARPAS

SEQ ID NO: 1079825 - protein, 9 aa, Homo Sapiens
AHFHPKRRN

SEQ ID NO: 1079826 - protein, 9 aa, Homo Sapiens
GAKSSSKSG

SEQ ID NO: 1079827 - protein, 9 aa, Homo Sapiens
KITVILKIS

SEQ ID NO: 1079828 - protein, 9 aa, Homo Sapiens
IRHKDVHKK

SEQ ID NO: 1079829 - protein, 9 aa, Homo Sapiens
AGDQYNCSR

SEQ ID NO: 1079830 - protein, 9 aa, Homo Sapiens
EVFEVLNGL

SEQ ID NO: 1079831 - protein, 9 aa, Homo Sapiens
ESEETRFHH

SEQ ID NO: 1079832 - protein, 9 aa, Homo Sapiens
SMGGPSRRS

SEQ ID NO: 1079833 - protein, 9 aa, Homo Sapiens
LSTAEITRL

SEQ ID NO: 1079834 - protein, 9 aa, Homo Sapiens
EQRSFCSTM

SEQ ID NO: 1079835 - protein, 9 aa, Homo Sapiens
FVVQLNGAR

SEQ ID NO: 1079836 - protein, 9 aa, Homo Sapiens
DTQEIKERD

SEQ ID NO: 1079837 - protein, 9 aa, Homo Sapiens
LAPLQPKKS

SEQ ID NO: 1079838 - protein, 9 aa, Homo Sapiens
RNKQVIVLF

SEQ ID NO: 1079839 - protein, 9 aa, Homo Sapiens
TQIVITDTA

SEQ ID NO: 1079840 - protein, 9 aa, Homo Sapiens
GEAECPGRE

SEQ ID NO: 1079841 - protein, 9 aa, Homo Sapiens
AEIYWVHLI

SEQ ID NO: 1079842 - protein, 9 aa, Homo Sapiens
AQVLIRFYI

SEQ ID NO: 1079843 - protein, 9 aa, Homo Sapiens
KVCYGLIPE

SEQ ID NO: 1079844 - protein, 9 aa, Homo Sapiens
NGSLNYNNK

SEQ ID NO: 1079845 - protein, 9 aa, Homo Sapiens
ESKLKQFTK

SEQ ID NO: 1079846 - protein, 9 aa, Homo Sapiens
NFNIKEGSR

SEQ ID NO: 1079847 - protein, 9 aa, Homo Sapiens
GGFPVRFSY

SEQ ID NO: 1079848 - protein, 9 aa, Homo Sapiens
SSNYVAPAD

SEQ ID NO: 1079849 - protein, 9 aa, Homo Sapiens
QECILVEVE

SEQ ID NO: 1079850 - protein, 9 aa, Homo Sapiens
AKITVILKI

SEQ ID NO: 1079851 - protein, 9 aa, Homo Sapiens
GPPSMCRWA

SEQ ID NO: 1079852 - protein, 9 aa, Homo Sapiens
VKKDKDPVQ

SEQ ID NO: 1079853 - protein, 9 aa, Homo Sapiens
EGQCIPSSW

SEQ ID NO: 1079854 - protein, 9 aa, Homo Sapiens
PQPGPPYNV

SEQ ID NO: 1079855 - protein, 9 aa, Homo Sapiens
LNYEEYCTA

SEQ ID NO: 1079856 - protein, 9 aa, Homo Sapiens
GSLEVKEAG

SEQ ID NO: 1079857 - protein, 9 aa, Homo Sapiens
KRTLLDYKG

SEQ ID NO: 1079858 - protein, 9 aa, Homo Sapiens
FFQDRPWAQ

SEQ ID NO: 1079859 - protein, 9 aa, Homo Sapiens
NFLREASIM

SEQ ID NO: 1079860 - protein, 9 aa, Homo Sapiens
VKRLWKRMD

SEQ ID NO: 1079861 - protein, 9 aa, Homo Sapiens
LKPCFLRWD

SEQ ID NO: 1079862 - protein, 9 aa, Homo Sapiens
SEMDAPPEG

SEQ ID NO: 1079863 - protein, 9 aa, Homo Sapiens
EVPYVNGSM

SEQ ID NO: 1079864 - protein, 9 aa, Homo Sapiens
QISHGRAPP

SEQ ID NO: 1079865 - protein, 9 aa, Homo Sapiens
EVISTHQLK

SEQ ID NO: 1079866 - protein, 9 aa, Homo Sapiens
SYRTKKEHS

SEQ ID NO: 1079867 - protein, 9 aa, Homo Sapiens
CGNTFLLDS

SEQ ID NO: 1079868 - protein, 9 aa, Homo Sapiens
IILRIVQDI

SEQ ID NO: 1079869 - protein, 9 aa, Homo Sapiens
MTNITDLRI

SEQ ID NO: 1079870 - protein, 9 aa, Homo Sapiens
GEKNTMMRS

SEQ ID NO: 1079871 - protein, 9 aa, Homo Sapiens
LPIKCLKDE

SEQ ID NO: 1079872 - protein, 9 aa, Homo Sapiens
MAAAVAAAS

SEQ ID NO: 1079873 - protein, 9 aa, Homo Sapiens
PFLNTQNMC

SEQ ID NO: 1079874 - protein, 9 aa, Homo Sapiens
ITKERNCYE

SEQ ID NO: 1079875 - protein, 9 aa, Homo Sapiens
NTDQLGNKY

SEQ ID NO: 1079876 - protein, 9 aa, Homo Sapiens
ASMGPKPHL

SEQ ID NO: 1079877 - protein, 9 aa, Homo Sapiens
VFEVLNGLQ

SEQ ID NO: 1079878 - protein, 9 aa, Homo Sapiens
EEATSMQLW

SEQ ID NO: 1079879 - protein, 9 aa, Homo Sapiens
NSQSDIKCH

SEQ ID NO: 1079880 - protein, 9 aa, Homo Sapiens
ARISAAAAF

SEQ ID NO: 1079881 - protein, 9 aa, Homo Sapiens
FIFIMLLNL

SEQ ID NO: 1079882 - protein, 9 aa, Homo Sapiens
QLVKSITLP

SEQ ID NO: 1079883 - protein, 9 aa, Homo Sapiens
EDPQRFDDF

SEQ ID NO: 1079884 - protein, 9 aa, Homo Sapiens
AEKLIYDHL

SEQ ID NO: 1079885 - protein, 9 aa, Homo Sapiens
QKYLDAIKK

SEQ ID NO: 1079886 - protein, 9 aa, Homo Sapiens
YDEPPQPPP

SEQ ID NO: 1079887 - protein, 9 aa, Homo Sapiens
PMKREPPPR

SEQ ID NO: 1079888 - protein, 9 aa, Homo Sapiens
DETSLQKPT

SEQ ID NO: 1079889 - protein, 9 aa, Homo Sapiens
LARVVDSTL

SEQ ID NO: 1079890 - protein, 9 aa, Homo Sapiens
HYTEDLLLE

SEQ ID NO: 1079891 - protein, 9 aa, Homo Sapiens
LLRDQFLLN

SEQ ID NO: 1079892 - protein, 9 aa, Homo Sapiens
SVFLFAAEN

SEQ ID NO: 1079893 - protein, 9 aa, Homo Sapiens
SQPEKLLFN

SEQ ID NO: 1079894 - protein, 9 aa, Homo Sapiens
EERGTFLVT

SEQ ID NO: 1079895 - protein, 9 aa, Homo Sapiens
NQIPSHSSF

SEQ ID NO: 1079896 - protein, 9 aa, Homo Sapiens
LPHNWMQAL

SEQ ID NO: 1079897 - protein, 9 aa, Homo Sapiens
KISDILQCD

SEQ ID NO: 1079898 - protein, 9 aa, Homo Sapiens
GGGDTPGSF

SEQ ID NO: 1079899 - protein, 9 aa, Homo Sapiens
GSSVMAALL

SEQ ID NO: 1079900 - protein, 9 aa, Homo Sapiens
THLLGGGTG

SEQ ID NO: 1079901 - protein, 9 aa, Homo Sapiens
GFYRSFEYI

SEQ ID NO: 1079902 - protein, 9 aa, Homo Sapiens
WIHHEKMEM

SEQ ID NO: 1079903 - protein, 9 aa, Homo Sapiens
VKEMQLERE

SEQ ID NO: 1079904 - protein, 9 aa, Homo Sapiens
NPSSLLQRL

SEQ ID NO: 1079905 - protein, 9 aa, Homo Sapiens
LSLFLLFLG

SEQ ID NO: 1079906 - protein, 9 aa, Homo Sapiens
ALIPDLAMK

SEQ ID NO: 1079907 - protein, 9 aa, Homo Sapiens
HFHPKRRNH

SEQ ID NO: 1079908 - protein, 9 aa, Homo Sapiens
IYEMAAGYL

SEQ ID NO: 1079909 - protein, 9 aa, Homo Sapiens
YLFSHLNDI

SEQ ID NO: 1079910 - protein, 9 aa, Homo Sapiens
TNTNKSQEK

SEQ ID NO: 1079911 - protein, 9 aa, Homo Sapiens
GRLFKGKKA

SEQ ID NO: 1079912 - protein, 9 aa, Homo Sapiens
HFDASDSSS

SEQ ID NO: 1079913 - protein, 9 aa, Homo Sapiens
LNEKGTSLT

SEQ ID NO: 1079914 - protein, 9 aa, Homo Sapiens
VSLFFETSF

SEQ ID NO: 1079915 - protein, 9 aa, Homo Sapiens
TIRLINSQI

SEQ ID NO: 1079916 - protein, 9 aa, Homo Sapiens
SRNSETLFF

SEQ ID NO: 1079917 - protein, 9 aa, Homo Sapiens
EIFSDIHLL

SEQ ID NO: 1079918 - protein, 9 aa, Homo Sapiens
DFDHHGRVF

SEQ ID NO: 1079919 - protein, 9 aa, Homo Sapiens
SWDPKISSE

SEQ ID NO: 1079920 - protein, 9 aa, Homo Sapiens
NLQTEGVNA

SEQ ID NO: 1079921 - protein, 9 aa, Homo Sapiens
GTEKSTEEG

SEQ ID NO: 1079922 - protein, 9 aa, Homo Sapiens
VVSQDDSTW

SEQ ID NO: 1079923 - protein, 9 aa, Homo Sapiens
ELALGQFNK

SEQ ID NO: 1079924 - protein, 9 aa, Homo Sapiens
TSITLHFSY

SEQ ID NO: 1079925 - protein, 9 aa, Homo Sapiens
FLEEKDGAS

SEQ ID NO: 1079926 - protein, 9 aa, Homo Sapiens
NMKLEVVNP

SEQ ID NO: 1079927 - protein, 9 aa, Homo Sapiens
YASVQFAPP

SEQ ID NO: 1079928 - protein, 9 aa, Homo Sapiens
SDAQVSKRH

SEQ ID NO: 1079929 - protein, 9 aa, Homo Sapiens
TRLVLVLEL

SEQ ID NO: 1079930 - protein, 9 aa, Homo Sapiens
DIVAIIIPE

SEQ ID NO: 1079931 - protein, 9 aa, Homo Sapiens
RQQQPAGFG

SEQ ID NO: 1079932 - protein, 9 aa, Homo Sapiens
QHFILFQPV

SEQ ID NO: 1079933 - protein, 9 aa, Homo Sapiens
DSPFEGFSL

SEQ ID NO: 1079934 - protein, 9 aa, Homo Sapiens
VFVLSSMLC

SEQ ID NO: 1079935 - protein, 9 aa, Homo Sapiens
FGKLDGQIF

SEQ ID NO: 1079936 - protein, 9 aa, Homo Sapiens
TLGAGGSSL

SEQ ID NO: 1079937 - protein, 9 aa, Homo Sapiens
YMLNEKGTS

SEQ ID NO: 1079938 - protein, 9 aa, Homo Sapiens
IIYYNIVLV

SEQ ID NO: 1079939 - protein, 9 aa, Homo Sapiens
LRSPVQYFC

SEQ ID NO: 1079940 - protein, 9 aa, Homo Sapiens
QEVLVNYYI

SEQ ID NO: 1079941 - protein, 9 aa, Homo Sapiens
GLLLLPSSG

SEQ ID NO: 1079942 - protein, 9 aa, Homo Sapiens
VSFSLNHVP

SEQ ID NO: 1079943 - protein, 9 aa, Homo Sapiens
PKDNEKAFS

SEQ ID NO: 1079944 - protein, 9 aa, Homo Sapiens
TFKKAVKAI

SEQ ID NO: 1079945 - protein, 9 aa, Homo Sapiens
CSVKGQTES

SEQ ID NO: 1079946 - protein, 9 aa, Homo Sapiens
PIPKDDFNE

SEQ ID NO: 1079947 - protein, 9 aa, Homo Sapiens
PKSLQSDTL

SEQ ID NO: 1079948 - protein, 9 aa, Homo Sapiens
RRKNMSKFL

SEQ ID NO: 1079949 - protein, 9 aa, Homo Sapiens
GATNFGLAI

SEQ ID NO: 1079950 - protein, 9 aa, Homo Sapiens
LNLPCLPDS

SEQ ID NO: 1079951 - protein, 9 aa, Homo Sapiens
TRSVNKLTD

SEQ ID NO: 1079952 - protein, 9 aa, Homo Sapiens
AFSFLLQES

SEQ ID NO: 1079953 - protein, 9 aa, Homo Sapiens
QKPQPFPNA

SEQ ID NO: 1079954 - protein, 9 aa, Homo Sapiens
CEVSPPDAN

SEQ ID NO: 1079955 - protein, 9 aa, Homo Sapiens
QGRPSEVWL

SEQ ID NO: 1079956 - protein, 9 aa, Homo Sapiens
TLGSLEVKE

SEQ ID NO: 1079957 - protein, 9 aa, Homo Sapiens
EVQEKFEGL

SEQ ID NO: 1079958 - protein, 9 aa, Homo Sapiens
HSNRALSTL

SEQ ID NO: 1079959 - protein, 9 aa, Homo Sapiens
DTLTFSYAA

SEQ ID NO: 1079960 - protein, 9 aa, Homo Sapiens
VFMGARGNT

SEQ ID NO: 1079961 - protein, 9 aa, Homo Sapiens
KEQPLSTAE

SEQ ID NO: 1079962 - protein, 9 aa, Homo Sapiens
KLTPTHLSV

SEQ ID NO: 1079963 - protein, 9 aa, Homo Sapiens
YSLPSPLPT

SEQ ID NO: 1079964 - protein, 9 aa, Homo Sapiens
LENGAHVNR

SEQ ID NO: 1079965 - protein, 9 aa, Homo Sapiens
PFFCRVKFP

SEQ ID NO: 1079966 - protein, 9 aa, Homo Sapiens
KINEGVLSI

SEQ ID NO: 1079967 - protein, 9 aa, Homo Sapiens
MAVHKLAES

SEQ ID NO: 1079968 - protein, 9 aa, Homo Sapiens
RPTFIRTEP

SEQ ID NO: 1079969 - protein, 9 aa, Homo Sapiens
GSRKSRSLK

SEQ ID NO: 1079970 - protein, 9 aa, Homo Sapiens
LVWRGTNVN

SEQ ID NO: 1079971 - protein, 9 aa, Homo Sapiens
MVLALAEGT

SEQ ID NO: 1079972 - protein, 9 aa, Homo Sapiens
FTSECLRIE

SEQ ID NO: 1079973 - protein, 9 aa, Homo Sapiens
QKYQAECFQ

SEQ ID NO: 1079974 - protein, 9 aa, Homo Sapiens
SCRAFKTHS

SEQ ID NO: 1079975 - protein, 9 aa, Homo Sapiens
IEDSKATLE

SEQ ID NO: 1079976 - protein, 9 aa, Homo Sapiens
QEAAAPSKG

SEQ ID NO: 1079977 - protein, 9 aa, Homo Sapiens
QLLFHNFPL

SEQ ID NO: 1079978 - protein, 9 aa, Homo Sapiens
MRKSTENVP

SEQ ID NO: 1079979 - protein, 9 aa, Homo Sapiens
LKKKNIMDL

SEQ ID NO: 1079980 - protein, 9 aa, Homo Sapiens
RAPFGTTSF

SEQ ID NO: 1079981 - protein, 9 aa, Homo Sapiens
PSSDESDDL

SEQ ID NO: 1079982 - protein, 9 aa, Homo Sapiens
YYTGCTWRF

SEQ ID NO: 1079983 - protein, 9 aa, Homo Sapiens
QELENRCQK

SEQ ID NO: 1079984 - protein, 9 aa, Homo Sapiens
GKFVEIQFN

SEQ ID NO: 1079985 - protein, 9 aa, Homo Sapiens
LDTILGASV

SEQ ID NO: 1079986 - protein, 9 aa, Homo Sapiens
SFRYPKEFQ

SEQ ID NO: 1079987 - protein, 9 aa, Homo Sapiens
KTGECLCYE

SEQ ID NO: 1079988 - protein, 9 aa, Homo Sapiens
LARATHNPV

SEQ ID NO: 1079989 - protein, 9 aa, Homo Sapiens
VGDWGLFAL

SEQ ID NO: 1079990 - protein, 9 aa, Homo Sapiens
HNLIRRNLD

SEQ ID NO: 1079991 - protein, 9 aa, Homo Sapiens
GFTETTACM

SEQ ID NO: 1079992 - protein, 9 aa, Homo Sapiens
IKGCSSRKF

SEQ ID NO: 1079993 - protein, 9 aa, Homo Sapiens
ALYSGQLVQ

SEQ ID NO: 1079994 - protein, 9 aa, Homo Sapiens
STLFTITCS

SEQ ID NO: 1079995 - protein, 9 aa, Homo Sapiens
GFEANNFAM

SEQ ID NO: 1079996 - protein, 9 aa, Homo Sapiens
DHHGRVFLG

SEQ ID NO: 1079997 - protein, 9 aa, Homo Sapiens
KNRLLSGGR

SEQ ID NO: 1079998 - protein, 9 aa, Homo Sapiens
CADINRDGK

SEQ ID NO: 1079999 - protein, 9 aa, Homo Sapiens
VLGYKQILK

SEQ ID NO: 1080000 - protein, 9 aa, Homo Sapiens
NPCLCTHLI

SEQ ID NO: 1080001 - protein, 9 aa, Homo Sapiens
KEHSTLTRK

SEQ ID NO: 1080002 - protein, 9 aa, Homo Sapiens
KEDYPASWR

SEQ ID NO: 1080003 - protein, 9 aa, Homo Sapiens
MCELSSPID

SEQ ID NO: 1080004 - protein, 9 aa, Homo Sapiens
PQGFRYSKL

SEQ ID NO: 1080005 - protein, 9 aa, Homo Sapiens
EDSKATLEV

SEQ ID NO: 1080006 - protein, 9 aa, Homo Sapiens
LEPGQPLTK

SEQ ID NO: 1080007 - protein, 9 aa, Homo Sapiens
PTPWTAHLE

SEQ ID NO: 1080008 - protein, 9 aa, Homo Sapiens
NRILAEKIA

SEQ ID NO: 1080009 - protein, 9 aa, Homo Sapiens
FFCKAGGTL

SEQ ID NO: 1080010 - protein, 9 aa, Homo Sapiens
ACVLEKQIS

SEQ ID NO: 1080011 - protein, 9 aa, Homo Sapiens
PQPLGALSK

SEQ ID NO: 1080012 - protein, 9 aa, Homo Sapiens
NGCRAFILP

SEQ ID NO: 1080013 - protein, 9 aa, Homo Sapiens
VKTYNTYAY

SEQ ID NO: 1080014 - protein, 9 aa, Homo Sapiens
PAQRATRGL

SEQ ID NO: 1080015 - protein, 9 aa, Homo Sapiens
DELPGAPSV

SEQ ID NO: 1080016 - protein, 9 aa, Homo Sapiens
QELMKENLQ

SEQ ID NO: 1080017 - protein, 9 aa, Homo Sapiens
FLAYDIQAA

SEQ ID NO: 1080018 - protein, 9 aa, Homo Sapiens
YNGKLGFWL

SEQ ID NO: 1080019 - protein, 9 aa, Homo Sapiens
ELGAIKSFR

SEQ ID NO: 1080020 - protein, 9 aa, Homo Sapiens
QGSKDNLHA

SEQ ID NO: 1080021 - protein, 9 aa, Homo Sapiens
QKYPGNQTT

SEQ ID NO: 1080022 - protein, 9 aa, Homo Sapiens
TRVREAQGE

SEQ ID NO: 1080023 - protein, 9 aa, Homo Sapiens
LEPSTIVGS

SEQ ID NO: 1080024 - protein, 9 aa, Homo Sapiens
IQFFLGGAP

SEQ ID NO: 1080025 - protein, 9 aa, Homo Sapiens
TGDLRVRTL

SEQ ID NO: 1080026 - protein, 9 aa, Homo Sapiens
GTVCDNGWN

SEQ ID NO: 1080027 - protein, 9 aa, Homo Sapiens
CRLRGLVQL

SEQ ID NO: 1080028 - protein, 9 aa, Homo Sapiens
AKALGPSPY

SEQ ID NO: 1080029 - protein, 9 aa, Homo Sapiens
DEKVCWTSG

SEQ ID NO: 1080030 - protein, 9 aa, Homo Sapiens
TIRYIFNET

SEQ ID NO: 1080031 - protein, 9 aa, Homo Sapiens
YHKKIYTGE

SEQ ID NO: 1080032 - protein, 9 aa, Homo Sapiens
PARKKAQEL

SEQ ID NO: 1080033 - protein, 9 aa, Homo Sapiens
PWRKLNLEL

SEQ ID NO: 1080034 - protein, 9 aa, Homo Sapiens
IFSFFAFKK

SEQ ID NO: 1080035 - protein, 9 aa, Homo Sapiens
LSIEDFELE

SEQ ID NO: 1080036 - protein, 9 aa, Homo Sapiens
LFRPTQPLR

SEQ ID NO: 1080037 - protein, 9 aa, Homo Sapiens
LAIIDILYA

SEQ ID NO: 1080038 - protein, 9 aa, Homo Sapiens
YNCSFDYVE

SEQ ID NO: 1080039 - protein, 9 aa, Homo Sapiens
LSTNYANSY

SEQ ID NO: 1080040 - protein, 9 aa, Homo Sapiens
CALFQVNHK

SEQ ID NO: 1080041 - protein, 9 aa, Homo Sapiens
TCNGLRRFF

SEQ ID NO: 1080042 - protein, 9 aa, Homo Sapiens
SIEPHNAKF

SEQ ID NO: 1080043 - protein, 9 aa, Homo Sapiens
AQWFLHRKR

SEQ ID NO: 1080044 - protein, 9 aa, Homo Sapiens
NSKVAFYNK

SEQ ID NO: 1080045 - protein, 9 aa, Homo Sapiens
ILKTEYEFD

SEQ ID NO: 1080046 - protein, 9 aa, Homo Sapiens
KELEIALVN

SEQ ID NO: 1080047 - protein, 9 aa, Homo Sapiens
IESFINNLR

SEQ ID NO: 1080048 - protein, 9 aa, Homo Sapiens
EQQKAKDGR

SEQ ID NO: 1080049 - protein, 9 aa, Homo Sapiens
TGTIFYRSL

SEQ ID NO: 1080050 - protein, 9 aa, Homo Sapiens
ILSRGPKSI

SEQ ID NO: 1080051 - protein, 9 aa, Homo Sapiens
GPRQVPVLG

SEQ ID NO: 1080052 - protein, 9 aa, Homo Sapiens
PSEVWLQWQ

SEQ ID NO: 1080053 - protein, 9 aa, Homo Sapiens
NGKRQGDYS

SEQ ID NO: 1080054 - protein, 9 aa, Homo Sapiens
ALQSVLGGR

SEQ ID NO: 1080055 - protein, 9 aa, Homo Sapiens
MVAVDRYFR

SEQ ID NO: 1080056 - protein, 9 aa, Homo Sapiens
SRRASEFSG

SEQ ID NO: 1080057 - protein, 9 aa, Homo Sapiens
NSSLYALHL

SEQ ID NO: 1080058 - protein, 9 aa, Homo Sapiens
SLPFWRRMT

SEQ ID NO: 1080059 - protein, 9 aa, Homo Sapiens
NSSQNPYLI

SEQ ID NO: 1080060 - protein, 9 aa, Homo Sapiens
LDVMFLSVV

SEQ ID NO: 1080061 - protein, 9 aa, Homo Sapiens
EKTYDAFVS

SEQ ID NO: 1080062 - protein, 9 aa, Homo Sapiens
EDRISRKYF

SEQ ID NO: 1080063 - protein, 9 aa, Homo Sapiens
ISMMTPSDI

SEQ ID NO: 1080064 - protein, 9 aa, Homo Sapiens
LFVGFFAVY

SEQ ID NO: 1080065 - protein, 9 aa, Homo Sapiens
CAFPMKKGP

SEQ ID NO: 1080066 - protein, 9 aa, Homo Sapiens
ILPSDTESK

SEQ ID NO: 1080067 - protein, 9 aa, Homo Sapiens
QPAGFGAVY

SEQ ID NO: 1080068 - protein, 9 aa, Homo Sapiens
LKQFSCLSF

SEQ ID NO: 1080069 - protein, 9 aa, Homo Sapiens
AQKKKEERQ

SEQ ID NO: 1080070 - protein, 9 aa, Homo Sapiens
VTAFFCKAH

SEQ ID NO: 1080071 - protein, 9 aa, Homo Sapiens
FYNGKKSVA

SEQ ID NO: 1080072 - protein, 9 aa, Homo Sapiens
ALFTIGGNA

SEQ ID NO: 1080073 - protein, 9 aa, Homo Sapiens
LERRKKGSL

SEQ ID NO: 1080074 - protein, 9 aa, Homo Sapiens
PQPGHALVM

SEQ ID NO: 1080075 - protein, 9 aa, Homo Sapiens
KSQCLHNQS

SEQ ID NO: 1080076 - protein, 9 aa, Homo Sapiens
RNTTLNGFY

SEQ ID NO: 1080077 - protein, 9 aa, Homo Sapiens
RGEGPQVNL

SEQ ID NO: 1080078 - protein, 9 aa, Homo Sapiens
LGLTQLHVK

SEQ ID NO: 1080079 - protein, 9 aa, Homo Sapiens
AVAEPFTSE

SEQ ID NO: 1080080 - protein, 9 aa, Homo Sapiens
IQALQEHRL

SEQ ID NO: 1080081 - protein, 9 aa, Homo Sapiens
FWGQPCTAP

SEQ ID NO: 1080082 - protein, 9 aa, Homo Sapiens
FGQTIIEVR

SEQ ID NO: 1080083 - protein, 9 aa, Homo Sapiens
EGCGSYGCS

SEQ ID NO: 1080084 - protein, 9 aa, Homo Sapiens
AEGTDLAKT

SEQ ID NO: 1080085 - protein, 9 aa, Homo Sapiens
SYHKKIYTG

SEQ ID NO: 1080086 - protein, 9 aa, Homo Sapiens
LNRFSVSET

SEQ ID NO: 1080087 - protein, 9 aa, Homo Sapiens
LIEGPRVIF

SEQ ID NO: 1080088 - protein, 9 aa, Homo Sapiens
ATNTNKSQE

SEQ ID NO: 1080089 - protein, 9 aa, Homo Sapiens
LCEDPLSGF

SEQ ID NO: 1080090 - protein, 9 aa, Homo Sapiens
APCGDLSRM

SEQ ID NO: 1080091 - protein, 9 aa, Homo Sapiens
ADKKDCDAS

SEQ ID NO: 1080092 - protein, 9 aa, Homo Sapiens
KFKYGDLLM

SEQ ID NO: 1080093 - protein, 9 aa, Homo Sapiens
TAEKPNKCN

SEQ ID NO: 1080094 - protein, 9 aa, Homo Sapiens
KETRKSLVL

SEQ ID NO: 1080095 - protein, 9 aa, Homo Sapiens
DLSEGPEDQ

SEQ ID NO: 1080096 - protein, 9 aa, Homo Sapiens
RVREEPLQV

SEQ ID NO: 1080097 - protein, 9 aa, Homo Sapiens
WKTRLELPD

SEQ ID NO: 1080098 - protein, 9 aa, Homo Sapiens
NPDGYKVAA

SEQ ID NO: 1080099 - protein, 9 aa, Homo Sapiens
SGTEILLAV

SEQ ID NO: 1080100 - protein, 9 aa, Homo Sapiens
PTHLSVKGE

SEQ ID NO: 1080101 - protein, 9 aa, Homo Sapiens
KSGYLVGIK

SEQ ID NO: 1080102 - protein, 9 aa, Homo Sapiens
KAKDGREGS

SEQ ID NO: 1080103 - protein, 9 aa, Homo Sapiens
VYIENPHLP

SEQ ID NO: 1080104 - protein, 9 aa, Homo Sapiens
FPLPLMAYS

SEQ ID NO: 1080105 - protein, 9 aa, Homo Sapiens
NFIFIMLLN

SEQ ID NO: 1080106 - protein, 9 aa, Homo Sapiens
QPPEPSFLR

SEQ ID NO: 1080107 - protein, 9 aa, Homo Sapiens
EESVCPTQI

SEQ ID NO: 1080108 - protein, 9 aa, Homo Sapiens
LSMDSFVVP

SEQ ID NO: 1080109 - protein, 9 aa, Homo Sapiens
HKPRSSFDS

SEQ ID NO: 1080110 - protein, 9 aa, Homo Sapiens
RYRLEMPES

SEQ ID NO: 1080111 - protein, 9 aa, Homo Sapiens
KNTHQSGLL

SEQ ID NO: 1080112 - protein, 9 aa, Homo Sapiens
PENGNSVLM

SEQ ID NO: 1080113 - protein, 9 aa, Homo Sapiens
SHSQFSDTI

SEQ ID NO: 1080114 - protein, 9 aa, Homo Sapiens
SASRQTRNK

SEQ ID NO: 1080115 - protein, 9 aa, Homo Sapiens
LATYAYKGN

SEQ ID NO: 1080116 - protein, 9 aa, Homo Sapiens
AVVETMFFL

SEQ ID NO: 1080117 - protein, 9 aa, Homo Sapiens
REAQGEAGP

SEQ ID NO: 1080118 - protein, 9 aa, Homo Sapiens
VVKPLRNPE

SEQ ID NO: 1080119 - protein, 9 aa, Homo Sapiens
ILQCDEISM

SEQ ID NO: 1080120 - protein, 9 aa, Homo Sapiens
FFSLLIYMA

SEQ ID NO: 1080121 - protein, 9 aa, Homo Sapiens
KAGSSSFSE

SEQ ID NO: 1080122 - protein, 9 aa, Homo Sapiens
EGPFSIESV

SEQ ID NO: 1080123 - protein, 9 aa, Homo Sapiens
DGEAPLAGP

SEQ ID NO: 1080124 - protein, 9 aa, Homo Sapiens
EEKQRIIRG

SEQ ID NO: 1080125 - protein, 9 aa, Homo Sapiens
CVLSSSSHA

SEQ ID NO: 1080126 - protein, 9 aa, Homo Sapiens
YAPPQELGP

SEQ ID NO: 1080127 - protein, 9 aa, Homo Sapiens
MFERTRGST

SEQ ID NO: 1080128 - protein, 9 aa, Homo Sapiens
NGAAGPHSS

SEQ ID NO: 1080129 - protein, 9 aa, Homo Sapiens
TTVCRLVTC

SEQ ID NO: 1080130 - protein, 9 aa, Homo Sapiens
LSRKCGQHL

SEQ ID NO: 1080131 - protein, 9 aa, Homo Sapiens
HQEYYRGQN

SEQ ID NO: 1080132 - protein, 9 aa, Homo Sapiens
AVVFRMGPF

SEQ ID NO: 1080133 - protein, 9 aa, Homo Sapiens
GKAEPRPRF

SEQ ID NO: 1080134 - protein, 9 aa, Homo Sapiens
GRTLEPGRQ

SEQ ID NO: 1080135 - protein, 9 aa, Homo Sapiens
GYKVAAAEG

SEQ ID NO: 1080136 - protein, 9 aa, Homo Sapiens
LHWRPSQRR

SEQ ID NO: 1080137 - protein, 9 aa, Homo Sapiens
DDAGAAEFQ

SEQ ID NO: 1080138 - protein, 9 aa, Homo Sapiens
DNTEGEYSN

SEQ ID NO: 1080139 - protein, 9 aa, Homo Sapiens
NVRASEVRA

SEQ ID NO: 1080140 - protein, 9 aa, Homo Sapiens
SKFEPNHVI

SEQ ID NO: 1080141 - protein, 9 aa, Homo Sapiens
ENLRRAPQL

SEQ ID NO: 1080142 - protein, 9 aa, Homo Sapiens
NGPETWKRN

SEQ ID NO: 1080143 - protein, 9 aa, Homo Sapiens
MGWVFVLSS

SEQ ID NO: 1080144 - protein, 9 aa, Homo Sapiens
SFSPQHLLP

SEQ ID NO: 1080145 - protein, 9 aa, Homo Sapiens
QEPAFYIAG

SEQ ID NO: 1080146 - protein, 9 aa, Homo Sapiens
EISKKKNKS

SEQ ID NO: 1080147 - protein, 9 aa, Homo Sapiens
ELFERLECS

SEQ ID NO: 1080148 - protein, 9 aa, Homo Sapiens
GGMKKIALH

SEQ ID NO: 1080149 - protein, 9 aa, Homo Sapiens
GPFSAVPGD

SEQ ID NO: 1080150 - protein, 9 aa, Homo Sapiens
GRRPCLGAA

SEQ ID NO: 1080151 - protein, 9 aa, Homo Sapiens
AGRPGDDLR

SEQ ID NO: 1080152 - protein, 9 aa, Homo Sapiens
PTLFSPEKA

SEQ ID NO: 1080153 - protein, 9 aa, Homo Sapiens
LKPQSKEAH

SEQ ID NO: 1080154 - protein, 9 aa, Homo Sapiens
FIMGSEGIL

SEQ ID NO: 1080155 - protein, 9 aa, Homo Sapiens
TYSSDILPM

SEQ ID NO: 1080156 - protein, 9 aa, Homo Sapiens
CSSSGALRG

SEQ ID NO: 1080157 - protein, 9 aa, Homo Sapiens
IQPYSDGGP

SEQ ID NO: 1080158 - protein, 9 aa, Homo Sapiens
NKHLDYLIQ

SEQ ID NO: 1080159 - protein, 9 aa, Homo Sapiens
DCRNWSDEA

SEQ ID NO: 1080160 - protein, 9 aa, Homo Sapiens
AAFSHKIIF

SEQ ID NO: 1080161 - protein, 9 aa, Homo Sapiens
IPLCQKCET

SEQ ID NO: 1080162 - protein, 9 aa, Homo Sapiens
YPKKPLQKY

SEQ ID NO: 1080163 - protein, 9 aa, Homo Sapiens
KAAKASRKI

SEQ ID NO: 1080164 - protein, 9 aa, Homo Sapiens
RICVFNYYY

SEQ ID NO: 1080165 - protein, 9 aa, Homo Sapiens
GQPRPEVTW

SEQ ID NO: 1080166 - protein, 9 aa, Homo Sapiens
GQDSSCVWV

SEQ ID NO: 1080167 - protein, 9 aa, Homo Sapiens
VCGNGRLEE

SEQ ID NO: 1080168 - protein, 9 aa, Homo Sapiens
EVVKPLRNP

SEQ ID NO: 1080169 - protein, 9 aa, Homo Sapiens
LHGSQIGTL

SEQ ID NO: 1080170 - protein, 9 aa, Homo Sapiens
LVRKRLLCL

SEQ ID NO: 1080171 - protein, 9 aa, Homo Sapiens
RRMTRTCTS

SEQ ID NO: 1080172 - protein, 9 aa, Homo Sapiens
AWETGAIGQ

SEQ ID NO: 1080173 - protein, 9 aa, Homo Sapiens
GYISSNYVA

SEQ ID NO: 1080174 - protein, 9 aa, Homo Sapiens
KTAETEKGT

SEQ ID NO: 1080175 - protein, 9 aa, Homo Sapiens
SNSCILFLG

SEQ ID NO: 1080176 - protein, 9 aa, Homo Sapiens
PQCLDFRPL

SEQ ID NO: 1080177 - protein, 9 aa, Homo Sapiens
REVRGFSYK

SEQ ID NO: 1080178 - protein, 9 aa, Homo Sapiens
PLVLLLNGR

SEQ ID NO: 1080179 - protein, 9 aa, Homo Sapiens
QKGDQGVKR

SEQ ID NO: 1080180 - protein, 9 aa, Homo Sapiens
FFLLRTLGL

SEQ ID NO: 1080181 - protein, 9 aa, Homo Sapiens
LEPYIESFI

SEQ ID NO: 1080182 - protein, 9 aa, Homo Sapiens
SGSAAGKNC

SEQ ID NO: 1080183 - protein, 9 aa, Homo Sapiens
ASNYLSGSK

SEQ ID NO: 1080184 - protein, 9 aa, Homo Sapiens
RDELPGAPS

SEQ ID NO: 1080185 - protein, 9 aa, Homo Sapiens
SFLSYAFSF

SEQ ID NO: 1080186 - protein, 9 aa, Homo Sapiens
SFVVQLNGA

SEQ ID NO: 1080187 - protein, 9 aa, Homo Sapiens
MDVIEVVLE

SEQ ID NO: 1080188 - protein, 9 aa, Homo Sapiens
TPMAHSPPP

SEQ ID NO: 1080189 - protein, 9 aa, Homo Sapiens
QLCFGVDSW

SEQ ID NO: 1080190 - protein, 9 aa, Homo Sapiens
PPSMCRWAC

SEQ ID NO: 1080191 - protein, 9 aa, Homo Sapiens
NFWIDADHP

SEQ ID NO: 1080192 - protein, 9 aa, Homo Sapiens
VDGDLGQNA

SEQ ID NO: 1080193 - protein, 9 aa, Homo Sapiens
QGFSRHHEN

SEQ ID NO: 1080194 - protein, 9 aa, Homo Sapiens
FGVEWIANW

SEQ ID NO: 1080195 - protein, 9 aa, Homo Sapiens
FSSNIIVTN

SEQ ID NO: 1080196 - protein, 9 aa, Homo Sapiens
LAPPAPPSL

SEQ ID NO: 1080197 - protein, 9 aa, Homo Sapiens
LNMKGTKIG

SEQ ID NO: 1080198 - protein, 9 aa, Homo Sapiens
KPRKSYSLE

SEQ ID NO: 1080199 - protein, 9 aa, Homo Sapiens
TLIGSLAAN

SEQ ID NO: 1080200 - protein, 9 aa, Homo Sapiens
QSREPLPRP

SEQ ID NO: 1080201 - protein, 9 aa, Homo Sapiens
NTSGKIWQL

SEQ ID NO: 1080202 - protein, 9 aa, Homo Sapiens
DQEFENFKT

SEQ ID NO: 1080203 - protein, 9 aa, Homo Sapiens
EGEHILNLH

SEQ ID NO: 1080204 - protein, 9 aa, Homo Sapiens
KGTSFDLIG

SEQ ID NO: 1080205 - protein, 9 aa, Homo Sapiens
GIPFSDHSS

SEQ ID NO: 1080206 - protein, 9 aa, Homo Sapiens
QIKQPTPLP

SEQ ID NO: 1080207 - protein, 9 aa, Homo Sapiens
TAFRFVPGG

SEQ ID NO: 1080208 - protein, 9 aa, Homo Sapiens
SSVMAALLV

SEQ ID NO: 1080209 - protein, 9 aa, Homo Sapiens
EIPFYFYVA

SEQ ID NO: 1080210 - protein, 9 aa, Homo Sapiens
ISTCNGLRR

SEQ ID NO: 1080211 - protein, 9 aa, Homo Sapiens
HECNSSYIV

SEQ ID NO: 1080212 - protein, 9 aa, Homo Sapiens
GLIRTQKNE

SEQ ID NO: 1080213 - protein, 9 aa, Homo Sapiens
ISQEWFRVF

SEQ ID NO: 1080214 - protein, 9 aa, Homo Sapiens
MLKRKMKPE

SEQ ID NO: 1080215 - protein, 9 aa, Homo Sapiens
SSAHCSSAP

SEQ ID NO: 1080216 - protein, 9 aa, Homo Sapiens
PGKKQLYFF

SEQ ID NO: 1080217 - protein, 9 aa, Homo Sapiens
DHIAREVEL

SEQ ID NO: 1080218 - protein, 9 aa, Homo Sapiens
GGKGEKEGE

SEQ ID NO: 1080219 - protein, 9 aa, Homo Sapiens
GGPGLPAHK

SEQ ID NO: 1080220 - protein, 9 aa, Homo Sapiens
EHAFDDNKL

SEQ ID NO: 1080221 - protein, 9 aa, Homo Sapiens
SNSTWMLGA

SEQ ID NO: 1080222 - protein, 9 aa, Homo Sapiens
WSSLDVLLH

SEQ ID NO: 1080223 - protein, 9 aa, Homo Sapiens
NPGGEEARQ

SEQ ID NO: 1080224 - protein, 9 aa, Homo Sapiens
FDNFSWWLV

SEQ ID NO: 1080225 - protein, 9 aa, Homo Sapiens
AASQTYECL

SEQ ID NO: 1080226 - protein, 9 aa, Homo Sapiens
VRFISLKPH

SEQ ID NO: 1080227 - protein, 9 aa, Homo Sapiens
KFISVFYRA

SEQ ID NO: 1080228 - protein, 9 aa, Homo Sapiens
ALRISGVVE

SEQ ID NO: 1080229 - protein, 9 aa, Homo Sapiens
HTKLGKIRS

SEQ ID NO: 1080230 - protein, 9 aa, Homo Sapiens
RPQFSATRT

SEQ ID NO: 1080231 - protein, 9 aa, Homo Sapiens
QGLPGPQSP

SEQ ID NO: 1080232 - protein, 9 aa, Homo Sapiens
GPSSARGLF

SEQ ID NO: 1080233 - protein, 9 aa, Homo Sapiens
GLSGLIRTQ

SEQ ID NO: 1080234 - protein, 9 aa, Homo Sapiens
AIQVPISDV

SEQ ID NO: 1080235 - protein, 9 aa, Homo Sapiens
FHPKRRNHL

SEQ ID NO: 1080236 - protein, 9 aa, Homo Sapiens
LPTFGSSAG

SEQ ID NO: 1080237 - protein, 9 aa, Homo Sapiens
DGTVHLVYR

SEQ ID NO: 1080238 - protein, 9 aa, Homo Sapiens
ETISDEEKI

SEQ ID NO: 1080239 - protein, 9 aa, Homo Sapiens
GLLILASWF

SEQ ID NO: 1080240 - protein, 9 aa, Homo Sapiens
DGQPGAKGK

SEQ ID NO: 1080241 - protein, 9 aa, Homo Sapiens
SILGEKVLD

SEQ ID NO: 1080242 - protein, 9 aa, Homo Sapiens
DQLCFGVDS

SEQ ID NO: 1080243 - protein, 9 aa, Homo Sapiens
SKEKEELLK

SEQ ID NO: 1080244 - protein, 9 aa, Homo Sapiens
LSRKIREES

SEQ ID NO: 1080245 - protein, 9 aa, Homo Sapiens
TSKPPYFFS

SEQ ID NO: 1080246 - protein, 9 aa, Homo Sapiens
NKGWDSPIC

SEQ ID NO: 1080247 - protein, 9 aa, Homo Sapiens
RIYIYMCLL

SEQ ID NO: 1080248 - protein, 9 aa, Homo Sapiens
GEGPQVNLT

SEQ ID NO: 1080249 - protein, 9 aa, Homo Sapiens
SRWDPQSRE

SEQ ID NO: 1080250 - protein, 9 aa, Homo Sapiens
KLEVVNPRN

SEQ ID NO: 1080251 - protein, 9 aa, Homo Sapiens
ELEERVRRS

SEQ ID NO: 1080252 - protein, 9 aa, Homo Sapiens
CFHQRIHTG

SEQ ID NO: 1080253 - protein, 9 aa, Homo Sapiens
IAENSTNAL

SEQ ID NO: 1080254 - protein, 9 aa, Homo Sapiens
QPATLLTVG

SEQ ID NO: 1080255 - protein, 9 aa, Homo Sapiens
PQGITGPNG

SEQ ID NO: 1080256 - protein, 9 aa, Homo Sapiens
GRPACCISS

SEQ ID NO: 1080257 - protein, 9 aa, Homo Sapiens
QRSSQSENS

SEQ ID NO: 1080258 - protein, 9 aa, Homo Sapiens
VFTPRTPFP

SEQ ID NO: 1080259 - protein, 9 aa, Homo Sapiens
TPLQNAPPL

SEQ ID NO: 1080260 - protein, 9 aa, Homo Sapiens
YRVKGLQAY

SEQ ID NO: 1080261 - protein, 9 aa, Homo Sapiens
SPQQIVHLF

SEQ ID NO: 1080262 - protein, 9 aa, Homo Sapiens
MDALRKQNW

SEQ ID NO: 1080263 - protein, 9 aa, Homo Sapiens
LYFVMVGVH

SEQ ID NO: 1080264 - protein, 9 aa, Homo Sapiens
DLLMRKSTE

SEQ ID NO: 1080265 - protein, 9 aa, Homo Sapiens
QQPQAYNFF

SEQ ID NO: 1080266 - protein, 9 aa, Homo Sapiens
SSSSSSRPL

SEQ ID NO: 1080267 - protein, 9 aa, Homo Sapiens
SCGRPACCI

SEQ ID NO: 1080268 - protein, 9 aa, Homo Sapiens
ATRGLLRSP

SEQ ID NO: 1080269 - protein, 9 aa, Homo Sapiens
TLLDYKGIH

SEQ ID NO: 1080270 - protein, 9 aa, Homo Sapiens
VEDIKSHLF

SEQ ID NO: 1080271 - protein, 9 aa, Homo Sapiens
TEELSAEEE

SEQ ID NO: 1080272 - protein, 9 aa, Homo Sapiens
ALRKQNWEL

SEQ ID NO: 1080273 - protein, 9 aa, Homo Sapiens
KWMRRSVAA

SEQ ID NO: 1080274 - protein, 9 aa, Homo Sapiens
PLQEDTLFD

SEQ ID NO: 1080275 - protein, 9 aa, Homo Sapiens
NRFSSEKIA

SEQ ID NO: 1080276 - protein, 9 aa, Homo Sapiens
VKHRKFEAK

SEQ ID NO: 1080277 - protein, 9 aa, Homo Sapiens
PDAKSDDAW

SEQ ID NO: 1080278 - protein, 9 aa, Homo Sapiens
FKFSEERAA

SEQ ID NO: 1080279 - protein, 9 aa, Homo Sapiens
EFSSGAKSS

SEQ ID NO: 1080280 - protein, 9 aa, Homo Sapiens
NNLQDPFLK

SEQ ID NO: 1080281 - protein, 9 aa, Homo Sapiens
MIFESYGFF

SEQ ID NO: 1080282 - protein, 9 aa, Homo Sapiens
KQILKMIRQ

SEQ ID NO: 1080283 - protein, 9 aa, Homo Sapiens
SPGPGLGLR

SEQ ID NO: 1080284 - protein, 9 aa, Homo Sapiens
KLDGQIFSA

SEQ ID NO: 1080285 - protein, 9 aa, Homo Sapiens
VKKGSYPWQ

SEQ ID NO: 1080286 - protein, 9 aa, Homo Sapiens
LTSNTSGKI

SEQ ID NO: 1080287 - protein, 9 aa, Homo Sapiens
ATGLHTKLG

SEQ ID NO: 1080288 - protein, 9 aa, Homo Sapiens
SPSPPGLLD

SEQ ID NO: 1080289 - protein, 9 aa, Homo Sapiens
WETGAIGQE

SEQ ID NO: 1080290 - protein, 9 aa, Homo Sapiens
LQPTTQFDA

SEQ ID NO: 1080291 - protein, 9 aa, Homo Sapiens
LNATSQVAM

SEQ ID NO: 1080292 - protein, 9 aa, Homo Sapiens
ISSKCVSRR

SEQ ID NO: 1080293 - protein, 9 aa, Homo Sapiens
WLITKIGMI

SEQ ID NO: 1080294 - protein, 9 aa, Homo Sapiens
NPFACHVLL

SEQ ID NO: 1080295 - protein, 9 aa, Homo Sapiens
GANFGVPSA

SEQ ID NO: 1080296 - protein, 9 aa, Homo Sapiens
RTTKEGMIR

SEQ ID NO: 1080297 - protein, 9 aa, Homo Sapiens
TVLIIAHWL

SEQ ID NO: 1080298 - protein, 9 aa, Homo Sapiens
STGDSTLLP

SEQ ID NO: 1080299 - protein, 9 aa, Homo Sapiens
PYNVRASEV

SEQ ID NO: 1080300 - protein, 9 aa, Homo Sapiens
FGLATEKSR

SEQ ID NO: 1080301 - protein, 9 aa, Homo Sapiens
WKLRATLDE

SEQ ID NO: 1080302 - protein, 9 aa, Homo Sapiens
LKSMVSVAP

SEQ ID NO: 1080303 - protein, 9 aa, Homo Sapiens
RSSSLNIHQ

SEQ ID NO: 1080304 - protein, 9 aa, Homo Sapiens
LIREFRKSD

SEQ ID NO: 1080305 - protein, 9 aa, Homo Sapiens
FTQKMGMTK

SEQ ID NO: 1080306 - protein, 9 aa, Homo Sapiens
NQDAIQEKF

SEQ ID NO: 1080307 - protein, 9 aa, Homo Sapiens
KRKDAKHLI

SEQ ID NO: 1080308 - protein, 9 aa, Homo Sapiens
RELDKSLQV

SEQ ID NO: 1080309 - protein, 9 aa, Homo Sapiens
RPDQDNHVT

SEQ ID NO: 1080310 - protein, 9 aa, Homo Sapiens
VPTFPFGET

SEQ ID NO: 1080311 - protein, 9 aa, Homo Sapiens
EYLGNFGEP

SEQ ID NO: 1080312 - protein, 9 aa, Homo Sapiens
SFSFGFPHS

SEQ ID NO: 1080313 - protein, 9 aa, Homo Sapiens
LINSQILTN

SEQ ID NO: 1080314 - protein, 9 aa, Homo Sapiens
LQPHLFLDS

SEQ ID NO: 1080315 - protein, 9 aa, Homo Sapiens
IRSGITGLK

SEQ ID NO: 1080316 - protein, 9 aa, Homo Sapiens
YTCDPHPDK

SEQ ID NO: 1080317 - protein, 9 aa, Homo Sapiens
LDENWYQGK

SEQ ID NO: 1080318 - protein, 9 aa, Homo Sapiens
SAPGAAARV

SEQ ID NO: 1080319 - protein, 9 aa, Homo Sapiens
SIIFLTMVA

SEQ ID NO: 1080320 - protein, 9 aa, Homo Sapiens
EQNVQKQKR

SEQ ID NO: 1080321 - protein, 9 aa, Homo Sapiens
QPKKSKRQK

SEQ ID NO: 1080322 - protein, 9 aa, Homo Sapiens
LARAPPGEV

SEQ ID NO: 1080323 - protein, 9 aa, Homo Sapiens
ASSRSPAFC

SEQ ID NO: 1080324 - protein, 9 aa, Homo Sapiens
VVILEDNWK

SEQ ID NO: 1080325 - protein, 9 aa, Homo Sapiens
RLPGERLTS

SEQ ID NO: 1080326 - protein, 9 aa, Homo Sapiens
TWMEVQQTW

SEQ ID NO: 1080327 - protein, 9 aa, Homo Sapiens
AFDDNKLVK

SEQ ID NO: 1080328 - protein, 9 aa, Homo Sapiens
LESMRFSAR

SEQ ID NO: 1080329 - protein, 9 aa, Homo Sapiens
EGGKAFIKM

SEQ ID NO: 1080330 - protein, 9 aa, Homo Sapiens
DIFSFKKLV

SEQ ID NO: 1080331 - protein, 9 aa, Homo Sapiens
YFFDGPSLQ

SEQ ID NO: 1080332 - protein, 9 aa, Homo Sapiens
EAVLEAAGE

SEQ ID NO: 1080333 - protein, 9 aa, Homo Sapiens
KLSHNEVEI

SEQ ID NO: 1080334 - protein, 9 aa, Homo Sapiens
HPSFLSYAF

SEQ ID NO: 1080335 - protein, 9 aa, Homo Sapiens
GSRVTRRQR

SEQ ID NO: 1080336 - protein, 9 aa, Homo Sapiens
VCRLVTCVP

SEQ ID NO: 1080337 - protein, 9 aa, Homo Sapiens
FSPVEVAKV

SEQ ID NO: 1080338 - protein, 9 aa, Homo Sapiens
YNVRASEVR

SEQ ID NO: 1080339 - protein, 9 aa, Homo Sapiens
VPILIPEIT

SEQ ID NO: 1080340 - protein, 9 aa, Homo Sapiens
ECRKAFNRS

SEQ ID NO: 1080341 - protein, 9 aa, Homo Sapiens
GAKGKPGDA

SEQ ID NO: 1080342 - protein, 9 aa, Homo Sapiens
EEYKKENYN

SEQ ID NO: 1080343 - protein, 9 aa, Homo Sapiens
SGEGDTGCR

SEQ ID NO: 1080344 - protein, 9 aa, Homo Sapiens
QLPIPSITW

SEQ ID NO: 1080345 - protein, 9 aa, Homo Sapiens
QNKQAALQA

SEQ ID NO: 1080346 - protein, 9 aa, Homo Sapiens
YQGPSGEPG

SEQ ID NO: 1080347 - protein, 9 aa, Homo Sapiens
KEPALSNLG

SEQ ID NO: 1080348 - protein, 9 aa, Homo Sapiens
AQDALLSQR

SEQ ID NO: 1080349 - protein, 9 aa, Homo Sapiens
FFQSCMAQL

SEQ ID NO: 1080350 - protein, 9 aa, Homo Sapiens
GIKKKLSIN

SEQ ID NO: 1080351 - protein, 9 aa, Homo Sapiens
VYVGRFKFS

SEQ ID NO: 1080352 - protein, 9 aa, Homo Sapiens
MNTQLWVEL

SEQ ID NO: 1080353 - protein, 9 aa, Homo Sapiens
VNRVTVHGA

SEQ ID NO: 1080354 - protein, 9 aa, Homo Sapiens
PPAPLIFPS

SEQ ID NO: 1080355 - protein, 9 aa, Homo Sapiens
EESTLSCFA

SEQ ID NO: 1080356 - protein, 9 aa, Homo Sapiens
CCFQSCDLR

SEQ ID NO: 1080357 - protein, 9 aa, Homo Sapiens
VSWDPKISS

SEQ ID NO: 1080358 - protein, 9 aa, Homo Sapiens
QSLDGSDAA

SEQ ID NO: 1080359 - protein, 9 aa, Homo Sapiens
VSARNAGVP

SEQ ID NO: 1080360 - protein, 9 aa, Homo Sapiens
NFASPAGFD

SEQ ID NO: 1080361 - protein, 9 aa, Homo Sapiens
RRNHLKKAK

SEQ ID NO: 1080362 - protein, 9 aa, Homo Sapiens
PDPGTGAFS

SEQ ID NO: 1080363 - protein, 9 aa, Homo Sapiens
LAESIPLRR

SEQ ID NO: 1080364 - protein, 9 aa, Homo Sapiens
KPLLRTEPQ

SEQ ID NO: 1080365 - protein, 9 aa, Homo Sapiens
PFGETEVYD

SEQ ID NO: 1080366 - protein, 9 aa, Homo Sapiens
RPYPFGIDP

SEQ ID NO: 1080367 - protein, 9 aa, Homo Sapiens
YNDFENYNQ

SEQ ID NO: 1080368 - protein, 9 aa, Homo Sapiens
LSQLAGKWQ

SEQ ID NO: 1080369 - protein, 9 aa, Homo Sapiens
EFVDVIESN

SEQ ID NO: 1080370 - protein, 9 aa, Homo Sapiens
RGVSKFQHC

SEQ ID NO: 1080371 - protein, 9 aa, Homo Sapiens
NLHSPTHID

SEQ ID NO: 1080372 - protein, 9 aa, Homo Sapiens
YTTVRSPGN

SEQ ID NO: 1080373 - protein, 9 aa, Homo Sapiens
QGKGIRVFG

SEQ ID NO: 1080374 - protein, 9 aa, Homo Sapiens
YYTELEKYE

SEQ ID NO: 1080375 - protein, 9 aa, Homo Sapiens
GPKNKHLDY

SEQ ID NO: 1080376 - protein, 9 aa, Homo Sapiens
RSKSSADLD

SEQ ID NO: 1080377 - protein, 9 aa, Homo Sapiens
VSDSAPHPE

SEQ ID NO: 1080378 - protein, 9 aa, Homo Sapiens
DFSLSEPGP

SEQ ID NO: 1080379 - protein, 9 aa, Homo Sapiens
YDETISDEE

SEQ ID NO: 1080380 - protein, 9 aa, Homo Sapiens
FTGEKEEGE

SEQ ID NO: 1080381 - protein, 9 aa, Homo Sapiens
AAVFFVTNF

SEQ ID NO: 1080382 - protein, 9 aa, Homo Sapiens
KTLASKRRK

SEQ ID NO: 1080383 - protein, 9 aa, Homo Sapiens
VDEEEVKFS

SEQ ID NO: 1080384 - protein, 9 aa, Homo Sapiens
GKKCGKLQT

SEQ ID NO: 1080385 - protein, 9 aa, Homo Sapiens
DAQPQIVVL

SEQ ID NO: 1080386 - protein, 9 aa, Homo Sapiens
VAIKAPMFF

SEQ ID NO: 1080387 - protein, 9 aa, Homo Sapiens
AIIDILYAS

SEQ ID NO: 1080388 - protein, 9 aa, Homo Sapiens
ILDALPKED

SEQ ID NO: 1080389 - protein, 9 aa, Homo Sapiens
VPYVNGSMG

SEQ ID NO: 1080390 - protein, 9 aa, Homo Sapiens
PDQITQNML

SEQ ID NO: 1080391 - protein, 9 aa, Homo Sapiens
YDVWVCHPR

SEQ ID NO: 1080392 - protein, 9 aa, Homo Sapiens
VNKTLKAWR

SEQ ID NO: 1080393 - protein, 9 aa, Homo Sapiens
LQPKKSKRQ

SEQ ID NO: 1080394 - protein, 9 aa, Homo Sapiens
TSKQNPSSL

SEQ ID NO: 1080395 - protein, 9 aa, Homo Sapiens
EFSTFNPEF

SEQ ID NO: 1080396 - protein, 9 aa, Homo Sapiens
GSMLGRADT

SEQ ID NO: 1080397 - protein, 9 aa, Homo Sapiens
GAHVNRVTV

SEQ ID NO: 1080398 - protein, 9 aa, Homo Sapiens
EGQTFFFKK

SEQ ID NO: 1080399 - protein, 9 aa, Homo Sapiens
PMPRESCEN

SEQ ID NO: 1080400 - protein, 9 aa, Homo Sapiens
FYVAVSEIM

SEQ ID NO: 1080401 - protein, 9 aa, Homo Sapiens
KYILAFWNE

SEQ ID NO: 1080402 - protein, 9 aa, Homo Sapiens
EHQKMKKSL

SEQ ID NO: 1080403 - protein, 9 aa, Homo Sapiens
VPSFLPVDK

SEQ ID NO: 1080404 - protein, 9 aa, Homo Sapiens
ENAAASLTY

SEQ ID NO: 1080405 - protein, 9 aa, Homo Sapiens
GGSSLSHKH

SEQ ID NO: 1080406 - protein, 9 aa, Homo Sapiens
ERQQGRTLE

SEQ ID NO: 1080407 - protein, 9 aa, Homo Sapiens
KADLLQSQS

SEQ ID NO: 1080408 - protein, 9 aa, Homo Sapiens
KKEETKSEP

SEQ ID NO: 1080409 - protein, 9 aa, Homo Sapiens
ALDKSDDSN

SEQ ID NO: 1080410 - protein, 9 aa, Homo Sapiens
SRGPPSQPL

SEQ ID NO: 1080411 - protein, 9 aa, Homo Sapiens
VSETGTTYS

SEQ ID NO: 1080412 - protein, 9 aa, Homo Sapiens
FTIDEVFEV

SEQ ID NO: 1080413 - protein, 9 aa, Homo Sapiens
PAAPILTLS

SEQ ID NO: 1080414 - protein, 9 aa, Homo Sapiens
DLDFLKQLE

SEQ ID NO: 1080415 - protein, 9 aa, Homo Sapiens
ATNFGLAIL

SEQ ID NO: 1080416 - protein, 9 aa, Homo Sapiens
DSESTEREL

SEQ ID NO: 1080417 - protein, 9 aa, Homo Sapiens
REDKVKALL

SEQ ID NO: 1080418 - protein, 9 aa, Homo Sapiens
ERKKYESKL

SEQ ID NO: 1080419 - protein, 9 aa, Homo Sapiens
GRGGAGNVH

SEQ ID NO: 1080420 - protein, 9 aa, Homo Sapiens
APPPSAVFP

SEQ ID NO: 1080421 - protein, 9 aa, Homo Sapiens
APAPRPRLR

SEQ ID NO: 1080422 - protein, 9 aa, Homo Sapiens
TLLESDFLT

SEQ ID NO: 1080423 - protein, 9 aa, Homo Sapiens
VNFLQSYQL

SEQ ID NO: 1080424 - protein, 9 aa, Homo Sapiens
AVGVVAEGL

SEQ ID NO: 1080425 - protein, 9 aa, Homo Sapiens
EEKCRLLGK

SEQ ID NO: 1080426 - protein, 9 aa, Homo Sapiens
FVTVAAYTT

SEQ ID NO: 1080427 - protein, 9 aa, Homo Sapiens
LGYKQILKM

SEQ ID NO: 1080428 - protein, 9 aa, Homo Sapiens
GRLPGERLT

SEQ ID NO: 1080429 - protein, 9 aa, Homo Sapiens
TGDSTLLPV

SEQ ID NO: 1080430 - protein, 9 aa, Homo Sapiens
HFKDYKSVE

SEQ ID NO: 1080431 - protein, 9 aa, Homo Sapiens
PEVFPRNPP

SEQ ID NO: 1080432 - protein, 9 aa, Homo Sapiens
SGRSLPFWR

SEQ ID NO: 1080433 - protein, 9 aa, Homo Sapiens
EKATLPLVT

SEQ ID NO: 1080434 - protein, 9 aa, Homo Sapiens
FLFPSLPLL

SEQ ID NO: 1080435 - protein, 9 aa, Homo Sapiens
IDPIRCEKP

SEQ ID NO: 1080436 - protein, 9 aa, Homo Sapiens
VYVNAIAIA

SEQ ID NO: 1080437 - protein, 9 aa, Homo Sapiens
GGAGVPNLT

SEQ ID NO: 1080438 - protein, 9 aa, Homo Sapiens
LYAPPRAPA

SEQ ID NO: 1080439 - protein, 9 aa, Homo Sapiens
FEGWEEARQ

SEQ ID NO: 1080440 - protein, 9 aa, Homo Sapiens
LVTEQDGCD

SEQ ID NO: 1080441 - protein, 9 aa, Homo Sapiens
CNLSFCLTS

SEQ ID NO: 1080442 - protein, 9 aa, Homo Sapiens
AAFILAEIG

SEQ ID NO: 1080443 - protein, 9 aa, Homo Sapiens
PNTVPCRKQ

SEQ ID NO: 1080444 - protein, 9 aa, Homo Sapiens
YNIVLVPVV

SEQ ID NO: 1080445 - protein, 9 aa, Homo Sapiens
IYAPPQELG

SEQ ID NO: 1080446 - protein, 9 aa, Homo Sapiens
ISYTTNAFS

SEQ ID NO: 1080447 - protein, 9 aa, Homo Sapiens
RQEAAAPSK

SEQ ID NO: 1080448 - protein, 9 aa, Homo Sapiens
QKRGRFHPG

SEQ ID NO: 1080449 - protein, 9 aa, Homo Sapiens
QHPVVLSTA

SEQ ID NO: 1080450 - protein, 9 aa, Homo Sapiens
GAVKKLKRL

SEQ ID NO: 1080451 - protein, 9 aa, Homo Sapiens
RFVPGGVYA

SEQ ID NO: 1080452 - protein, 9 aa, Homo Sapiens
FTIRTDPKI

SEQ ID NO: 1080453 - protein, 9 aa, Homo Sapiens
GLYCLTCFC

SEQ ID NO: 1080454 - protein, 9 aa, Homo Sapiens
NGRLEENEI

SEQ ID NO: 1080455 - protein, 9 aa, Homo Sapiens
GEKEPGFYL

SEQ ID NO: 1080456 - protein, 9 aa, Homo Sapiens
VFTNQEVQE

SEQ ID NO: 1080457 - protein, 9 aa, Homo Sapiens
FIAELVPKC

SEQ ID NO: 1080458 - protein, 9 aa, Homo Sapiens
YDHLSNMLI

SEQ ID NO: 1080459 - protein, 9 aa, Homo Sapiens
WPGVYSLPH

SEQ ID NO: 1080460 - protein, 9 aa, Homo Sapiens
AFRFVPGGV

SEQ ID NO: 1080461 - protein, 9 aa, Homo Sapiens
GKLAPCGST

SEQ ID NO: 1080462 - protein, 9 aa, Homo Sapiens
MIREQEEKI

SEQ ID NO: 1080463 - protein, 9 aa, Homo Sapiens
LFRSQPAYP

SEQ ID NO: 1080464 - protein, 9 aa, Homo Sapiens
VTLTSCAGV

SEQ ID NO: 1080465 - protein, 9 aa, Homo Sapiens
AHWLSTVEH

SEQ ID NO: 1080466 - protein, 9 aa, Homo Sapiens
VSLPTKKEE

SEQ ID NO: 1080467 - protein, 9 aa, Homo Sapiens
LLMYIISNG

SEQ ID NO: 1080468 - protein, 9 aa, Homo Sapiens
VISLQALYM

SEQ ID NO: 1080469 - protein, 9 aa, Homo Sapiens
STFTQKMGM

SEQ ID NO: 1080470 - protein, 9 aa, Homo Sapiens
GPALEAITD

SEQ ID NO: 1080471 - protein, 9 aa, Homo Sapiens
NYYCSVTSW

SEQ ID NO: 1080472 - protein, 9 aa, Homo Sapiens
CDSSPSAHG

SEQ ID NO: 1080473 - protein, 9 aa, Homo Sapiens
FSRRASEFS

SEQ ID NO: 1080474 - protein, 9 aa, Homo Sapiens
KLCKMAQAW

SEQ ID NO: 1080475 - protein, 9 aa, Homo Sapiens
ARIEELGKE

SEQ ID NO: 1080476 - protein, 9 aa, Homo Sapiens
FKLSHNEVE

SEQ ID NO: 1080477 - protein, 9 aa, Homo Sapiens
CSGSNKAYR

SEQ ID NO: 1080478 - protein, 9 aa, Homo Sapiens
ERKAAELDC

SEQ ID NO: 1080479 - protein, 9 aa, Homo Sapiens
HNKLDALGR

SEQ ID NO: 1080480 - protein, 9 aa, Homo Sapiens
VVKGKHESY

SEQ ID NO: 1080481 - protein, 9 aa, Homo Sapiens
NQFQENRSS

SEQ ID NO: 1080482 - protein, 9 aa, Homo Sapiens
DFFGQTIIE

SEQ ID NO: 1080483 - protein, 9 aa, Homo Sapiens
LLESDFLTD

SEQ ID NO: 1080484 - protein, 9 aa, Homo Sapiens
FHKNCMLKK

SEQ ID NO: 1080485 - protein, 9 aa, Homo Sapiens
FIRDIRRRG

SEQ ID NO: 1080486 - protein, 9 aa, Homo Sapiens
CPTQIPVAA

SEQ ID NO: 1080487 - protein, 9 aa, Homo Sapiens
DFEEQKNVY

SEQ ID NO: 1080488 - protein, 9 aa, Homo Sapiens
GAAEFQRGK

SEQ ID NO: 1080489 - protein, 9 aa, Homo Sapiens
PSFWSWLLW

SEQ ID NO: 1080490 - protein, 9 aa, Homo Sapiens
KKATVLVRG

SEQ ID NO: 1080491 - protein, 9 aa, Homo Sapiens
EASRGIKKK

SEQ ID NO: 1080492 - protein, 9 aa, Homo Sapiens
AKQLVWRGT

SEQ ID NO: 1080493 - protein, 9 aa, Homo Sapiens
LSDLGKVCS

SEQ ID NO: 1080494 - protein, 9 aa, Homo Sapiens
ATGDRHSTQ

SEQ ID NO: 1080495 - protein, 9 aa, Homo Sapiens
EAQIFFLQG

SEQ ID NO: 1080496 - protein, 9 aa, Homo Sapiens
GLLRSPSSD

SEQ ID NO: 1080497 - protein, 9 aa, Homo Sapiens
CGDLSRMLQ

SEQ ID NO: 1080498 - protein, 9 aa, Homo Sapiens
PIEASSYRL

SEQ ID NO: 1080499 - protein, 9 aa, Homo Sapiens
AKKEKLNSE

SEQ ID NO: 1080500 - protein, 9 aa, Homo Sapiens
CVNLPGYFR

SEQ ID NO: 1080501 - protein, 9 aa, Homo Sapiens
YPSDSFRQF

SEQ ID NO: 1080502 - protein, 9 aa, Homo Sapiens
GRGGSSWSS

SEQ ID NO: 1080503 - protein, 9 aa, Homo Sapiens
LNPSNRCLK

SEQ ID NO: 1080504 - protein, 9 aa, Homo Sapiens
LKDEDLLEQ

SEQ ID NO: 1080505 - protein, 9 aa, Homo Sapiens
GGPKKTHPT

SEQ ID NO: 1080506 - protein, 9 aa, Homo Sapiens
QGPSGEPGQ

SEQ ID NO: 1080507 - protein, 9 aa, Homo Sapiens
FAGQDSSCV

SEQ ID NO: 1080508 - protein, 9 aa, Homo Sapiens
LLDTMRPDL

SEQ ID NO: 1080509 - protein, 9 aa, Homo Sapiens
MSYDCYVAV

SEQ ID NO: 1080510 - protein, 9 aa, Homo Sapiens
HMDRQRRNF

SEQ ID NO: 1080511 - protein, 9 aa, Homo Sapiens
QGRTLEPGR

SEQ ID NO: 1080512 - protein, 9 aa, Homo Sapiens
PHPRSSAHC

SEQ ID NO: 1080513 - protein, 9 aa, Homo Sapiens
DAFKPGVRY

SEQ ID NO: 1080514 - protein, 9 aa, Homo Sapiens
KEPSLGQEL

SEQ ID NO: 1080515 - protein, 9 aa, Homo Sapiens
LQKYQAECF

SEQ ID NO: 1080516 - protein, 9 aa, Homo Sapiens
KTIQKGLES

SEQ ID NO: 1080517 - protein, 9 aa, Homo Sapiens
IITDVLIEI

SEQ ID NO: 1080518 - protein, 9 aa, Homo Sapiens
PKGPSTPLS

SEQ ID NO: 1080519 - protein, 9 aa, Homo Sapiens
GPGAHEKVL

SEQ ID NO: 1080520 - protein, 9 aa, Homo Sapiens
YSQDDECIS

SEQ ID NO: 1080521 - protein, 9 aa, Homo Sapiens
VCNLLGADA

SEQ ID NO: 1080522 - protein, 9 aa, Homo Sapiens
KLGKIRSQM

SEQ ID NO: 1080523 - protein, 9 aa, Homo Sapiens
DKTFQNQAR

SEQ ID NO: 1080524 - protein, 9 aa, Homo Sapiens
IFGGPPPGW

SEQ ID NO: 1080525 - protein, 9 aa, Homo Sapiens
KEAAEKLIY

SEQ ID NO: 1080526 - protein, 9 aa, Homo Sapiens
EILSDNVVN

SEQ ID NO: 1080527 - protein, 9 aa, Homo Sapiens
PLAGPCAPA

SEQ ID NO: 1080528 - protein, 9 aa, Homo Sapiens
PGPQAGPLS

SEQ ID NO: 1080529 - protein, 9 aa, Homo Sapiens
GAAGPHSSD

SEQ ID NO: 1080530 - protein, 9 aa, Homo Sapiens
RTPSGEVFF

SEQ ID NO: 1080531 - protein, 9 aa, Homo Sapiens
PLEDNDDCQ

SEQ ID NO: 1080532 - protein, 9 aa, Homo Sapiens
SRAIFFVGP

SEQ ID NO: 1080533 - protein, 9 aa, Homo Sapiens
PDQDNHVTI

SEQ ID NO: 1080534 - protein, 9 aa, Homo Sapiens
KDPVQIEGE

SEQ ID NO: 1080535 - protein, 9 aa, Homo Sapiens
PTSGLISVA

SEQ ID NO: 1080536 - protein, 9 aa, Homo Sapiens
VDGSDKELG

SEQ ID NO: 1080537 - protein, 9 aa, Homo Sapiens
ESVISLQAL

SEQ ID NO: 1080538 - protein, 9 aa, Homo Sapiens
QACVLEKQI

SEQ ID NO: 1080539 - protein, 9 aa, Homo Sapiens
PPRGRLTER

SEQ ID NO: 1080540 - protein, 9 aa, Homo Sapiens
FSTGWSSLD

SEQ ID NO: 1080541 - protein, 9 aa, Homo Sapiens
SGNYNDFEN

SEQ ID NO: 1080542 - protein, 9 aa, Homo Sapiens
FRFIGVILF

SEQ ID NO: 1080543 - protein, 9 aa, Homo Sapiens
PLLWDTKSE

SEQ ID NO: 1080544 - protein, 9 aa, Homo Sapiens
TKAALSAHS

SEQ ID NO: 1080545 - protein, 9 aa, Homo Sapiens
FSSKLSEYQ

SEQ ID NO: 1080546 - protein, 9 aa, Homo Sapiens
GKYRDLFRD

SEQ ID NO: 1080547 - protein, 9 aa, Homo Sapiens
WERQQGRTL

SEQ ID NO: 1080548 - protein, 9 aa, Homo Sapiens
GSVSQSKNA

SEQ ID NO: 1080549 - protein, 9 aa, Homo Sapiens
ESVLFMHKV

SEQ ID NO: 1080550 - protein, 9 aa, Homo Sapiens
KKIKLPGAF

SEQ ID NO: 1080551 - protein, 9 aa, Homo Sapiens
TKLCKMAQA

SEQ ID NO: 1080552 - protein, 9 aa, Homo Sapiens
VVSKGKARI

SEQ ID NO: 1080553 - protein, 9 aa, Homo Sapiens
GELESMRFS

SEQ ID NO: 1080554 - protein, 9 aa, Homo Sapiens
LWAHAFLQR

SEQ ID NO: 1080555 - protein, 9 aa, Homo Sapiens
PTSILLGPG

SEQ ID NO: 1080556 - protein, 9 aa, Homo Sapiens
STAEITRLA

SEQ ID NO: 1080557 - protein, 9 aa, Homo Sapiens
TTKEGMIRV

SEQ ID NO: 1080558 - protein, 9 aa, Homo Sapiens
QQVPSSNPP

SEQ ID NO: 1080559 - protein, 9 aa, Homo Sapiens
VLIFATIVE

SEQ ID NO: 1080560 - protein, 9 aa, Homo Sapiens
IWTPDTFFY

SEQ ID NO: 1080561 - protein, 9 aa, Homo Sapiens
ILNMKGTKI

SEQ ID NO: 1080562 - protein, 9 aa, Homo Sapiens
GQLPIPSIT

SEQ ID NO: 1080563 - protein, 9 aa, Homo Sapiens
KENNLLLQE

SEQ ID NO: 1080564 - protein, 9 aa, Homo Sapiens
RSRRSRLSV

SEQ ID NO: 1080565 - protein, 9 aa, Homo Sapiens
AEVGGSRGP

SEQ ID NO: 1080566 - protein, 9 aa, Homo Sapiens
GGRPTLFSP

SEQ ID NO: 1080567 - protein, 9 aa, Homo Sapiens
LAEEFTYNS

SEQ ID NO: 1080568 - protein, 9 aa, Homo Sapiens
ELSLLHNRL

SEQ ID NO: 1080569 - protein, 9 aa, Homo Sapiens
EHAYPDQIT

SEQ ID NO: 1080570 - protein, 9 aa, Homo Sapiens
VSAQKIYET

SEQ ID NO: 1080571 - protein, 9 aa, Homo Sapiens
RNSDMKNQR

SEQ ID NO: 1080572 - protein, 9 aa, Homo Sapiens
FSILIKAWE

SEQ ID NO: 1080573 - protein, 9 aa, Homo Sapiens
IISLTPPTT

SEQ ID NO: 1080574 - protein, 9 aa, Homo Sapiens
NNLDHEYQP

SEQ ID NO: 1080575 - protein, 9 aa, Homo Sapiens
HDLLSHEQK

SEQ ID NO: 1080576 - protein, 9 aa, Homo Sapiens
PGLISRADY

SEQ ID NO: 1080577 - protein, 9 aa, Homo Sapiens
TVRSPGNVN

SEQ ID NO: 1080578 - protein, 9 aa, Homo Sapiens
FSHLNDISA

SEQ ID NO: 1080579 - protein, 9 aa, Homo Sapiens
VCGKTFTSH

SEQ ID NO: 1080580 - protein, 9 aa, Homo Sapiens
LGPAPGSAV

SEQ ID NO: 1080581 - protein, 9 aa, Homo Sapiens
GYNAWLLYE

SEQ ID NO: 1080582 - protein, 9 aa, Homo Sapiens
SISRDREEK

SEQ ID NO: 1080583 - protein, 9 aa, Homo Sapiens
AQQPSEKNV

SEQ ID NO: 1080584 - protein, 9 aa, Homo Sapiens
HYSNKVYEL

SEQ ID NO: 1080585 - protein, 9 aa, Homo Sapiens
VKIPDAKSD

SEQ ID NO: 1080586 - protein, 9 aa, Homo Sapiens
ALPTFGSSA

SEQ ID NO: 1080587 - protein, 9 aa, Homo Sapiens
LKVSPKLAP

SEQ ID NO: 1080588 - protein, 9 aa, Homo Sapiens
ADLQLSLFL

SEQ ID NO: 1080589 - protein, 9 aa, Homo Sapiens
NTGFLQTLG

SEQ ID NO: 1080590 - protein, 9 aa, Homo Sapiens
PGLQYWTVS

SEQ ID NO: 1080591 - protein, 9 aa, Homo Sapiens
SNSFILSGS

SEQ ID NO: 1080592 - protein, 9 aa, Homo Sapiens
TVVDSASKK

SEQ ID NO: 1080593 - protein, 9 aa, Homo Sapiens
SHNEVEIEK

SEQ ID NO: 1080594 - protein, 9 aa, Homo Sapiens
ITKIVKGLF

SEQ ID NO: 1080595 - protein, 9 aa, Homo Sapiens
GQTESFHCP

SEQ ID NO: 1080596 - protein, 9 aa, Homo Sapiens
FIDGKLYTG

SEQ ID NO: 1080597 - protein, 9 aa, Homo Sapiens
VVPTHSGAR

SEQ ID NO: 1080598 - protein, 9 aa, Homo Sapiens
TLISVFDQD

SEQ ID NO: 1080599 - protein, 9 aa, Homo Sapiens
FKDYKSVEM

SEQ ID NO: 1080600 - protein, 9 aa, Homo Sapiens
TFAWNKTNI

SEQ ID NO: 1080601 - protein, 9 aa, Homo Sapiens
ENEICDCGT

SEQ ID NO: 1080602 - protein, 9 aa, Homo Sapiens
VLDNPARVM

SEQ ID NO: 1080603 - protein, 9 aa, Homo Sapiens
LTEHLDWVM

SEQ ID NO: 1080604 - protein, 9 aa, Homo Sapiens
RPSFCRTPA

SEQ ID NO: 1080605 - protein, 9 aa, Homo Sapiens
QVVHDNQIL

SEQ ID NO: 1080606 - protein, 9 aa, Homo Sapiens
ILAVIKLAC

SEQ ID NO: 1080607 - protein, 9 aa, Homo Sapiens
CDLCKSPPQ

SEQ ID NO: 1080608 - protein, 9 aa, Homo Sapiens
TQFDAQELR

SEQ ID NO: 1080609 - protein, 9 aa, Homo Sapiens
ITLISVFDQ

SEQ ID NO: 1080610 - protein, 9 aa, Homo Sapiens
RTHNLEPYI

SEQ ID NO: 1080611 - protein, 9 aa, Homo Sapiens
MEMRQIYTG

SEQ ID NO: 1080612 - protein, 9 aa, Homo Sapiens
GIEVYGREL

SEQ ID NO: 1080613 - protein, 9 aa, Homo Sapiens
DLVTPVWWK

SEQ ID NO: 1080614 - protein, 9 aa, Homo Sapiens
RVFTPRTPF

SEQ ID NO: 1080615 - protein, 9 aa, Homo Sapiens
IIQRVIRVP

SEQ ID NO: 1080616 - protein, 9 aa, Homo Sapiens
EQLCAFKLT

SEQ ID NO: 1080617 - protein, 9 aa, Homo Sapiens
NFLKFDDKF

SEQ ID NO: 1080618 - protein, 9 aa, Homo Sapiens
HINWYIKGV

SEQ ID NO: 1080619 - protein, 9 aa, Homo Sapiens
YALLGKLAP

SEQ ID NO: 1080620 - protein, 9 aa, Homo Sapiens
DVNSNAHLN

SEQ ID NO: 1080621 - protein, 9 aa, Homo Sapiens
IILGESMYS

SEQ ID NO: 1080622 - protein, 9 aa, Homo Sapiens
SFTIFEKAR

SEQ ID NO: 1080623 - protein, 9 aa, Homo Sapiens
NFGVPSAEP

SEQ ID NO: 1080624 - protein, 9 aa, Homo Sapiens
NQEVQEKFE

SEQ ID NO: 1080625 - protein, 9 aa, Homo Sapiens
RQTRNKEQS

SEQ ID NO: 1080626 - protein, 9 aa, Homo Sapiens
SCPALSLLL

SEQ ID NO: 1080627 - protein, 9 aa, Homo Sapiens
AMVRSRNSG

SEQ ID NO: 1080628 - protein, 9 aa, Homo Sapiens
GELADKKDC

SEQ ID NO: 1080629 - protein, 9 aa, Homo Sapiens
PSVSFEKSN

SEQ ID NO: 1080630 - protein, 9 aa, Homo Sapiens
GVPSAEPEP

SEQ ID NO: 1080631 - protein, 9 aa, Homo Sapiens
GESMYSVRL

SEQ ID NO: 1080632 - protein, 9 aa, Homo Sapiens
RRACLPASC

SEQ ID NO: 1080633 - protein, 9 aa, Homo Sapiens
FAARSGSPN

SEQ ID NO: 1080634 - protein, 9 aa, Homo Sapiens
FQHCGGPCW

SEQ ID NO: 1080635 - protein, 9 aa, Homo Sapiens
PAGKKGEMG

SEQ ID NO: 1080636 - protein, 9 aa, Homo Sapiens
HFVSGGQRP

SEQ ID NO: 1080637 - protein, 9 aa, Homo Sapiens
IAILCSYGR

SEQ ID NO: 1080638 - protein, 9 aa, Homo Sapiens
AMEMRQIYT

SEQ ID NO: 1080639 - protein, 9 aa, Homo Sapiens
DRQRRNFLR

SEQ ID NO: 1080640 - protein, 9 aa, Homo Sapiens
REKKKLEAE

SEQ ID NO: 1080641 - protein, 9 aa, Homo Sapiens
ASAAQKKNA

SEQ ID NO: 1080642 - protein, 9 aa, Homo Sapiens
NHTFFPGYR

SEQ ID NO: 1080643 - protein, 9 aa, Homo Sapiens
DPQKDNRNT

SEQ ID NO: 1080644 - protein, 9 aa, Homo Sapiens
PPSPISPPS

SEQ ID NO: 1080645 - protein, 9 aa, Homo Sapiens
TVCDNGWNT

SEQ ID NO: 1080646 - protein, 9 aa, Homo Sapiens
CRADQFFTS

SEQ ID NO: 1080647 - protein, 9 aa, Homo Sapiens
GNEDIIEVL

SEQ ID NO: 1080648 - protein, 9 aa, Homo Sapiens
IVSSKAISR

SEQ ID NO: 1080649 - protein, 9 aa, Homo Sapiens
GLLRIGTVN

SEQ ID NO: 1080650 - protein, 9 aa, Homo Sapiens
ENSPSNMSP

SEQ ID NO: 1080651 - protein, 9 aa, Homo Sapiens
ESFNLLSKE

SEQ ID NO: 1080652 - protein, 9 aa, Homo Sapiens
FGDVNNIQS

SEQ ID NO: 1080653 - protein, 9 aa, Homo Sapiens
ENLEDPQQN

SEQ ID NO: 1080654 - protein, 9 aa, Homo Sapiens
IAQSIDNSQ

SEQ ID NO: 1080655 - protein, 9 aa, Homo Sapiens
MTKHLLAMY

SEQ ID NO: 1080656 - protein, 9 aa, Homo Sapiens
GGSQVKKGS

SEQ ID NO: 1080657 - protein, 9 aa, Homo Sapiens
LCYTPSTVS

SEQ ID NO: 1080658 - protein, 9 aa, Homo Sapiens
SSSQLFPLS

SEQ ID NO: 1080659 - protein, 9 aa, Homo Sapiens
KKITDSELI

SEQ ID NO: 1080660 - protein, 9 aa, Homo Sapiens
LGFWLAIRI

SEQ ID NO: 1080661 - protein, 9 aa, Homo Sapiens
DKGTSFDLI

SEQ ID NO: 1080662 - protein, 9 aa, Homo Sapiens
QRLGGSSSA

SEQ ID NO: 1080663 - protein, 9 aa, Homo Sapiens
QVNHTMKVS

SEQ ID NO: 1080664 - protein, 9 aa, Homo Sapiens
SSTEEAQPS

SEQ ID NO: 1080665 - protein, 9 aa, Homo Sapiens
RTEFPETWG

SEQ ID NO: 1080666 - protein, 9 aa, Homo Sapiens
PDLAMKTWL

SEQ ID NO: 1080667 - protein, 9 aa, Homo Sapiens
LENKFPWRK

SEQ ID NO: 1080668 - protein, 9 aa, Homo Sapiens
EERVRRSPA

SEQ ID NO: 1080669 - protein, 9 aa, Homo Sapiens
ALSAHSFVC

SEQ ID NO: 1080670 - protein, 9 aa, Homo Sapiens
VGAGLFPLG

SEQ ID NO: 1080671 - protein, 9 aa, Homo Sapiens
ILRLGTQKY

SEQ ID NO: 1080672 - protein, 9 aa, Homo Sapiens
EELDRVQER

SEQ ID NO: 1080673 - protein, 9 aa, Homo Sapiens
RVPYNPGLK

SEQ ID NO: 1080674 - protein, 9 aa, Homo Sapiens
PVRFSYPCT

SEQ ID NO: 1080675 - protein, 9 aa, Homo Sapiens
TLEPGRQTR

SEQ ID NO: 1080676 - protein, 9 aa, Homo Sapiens
SQLCEDPQR

SEQ ID NO: 1080677 - protein, 9 aa, Homo Sapiens
SGTVTTGQT

SEQ ID NO: 1080678 - protein, 9 aa, Homo Sapiens
NVASVIYAK

SEQ ID NO: 1080679 - protein, 9 aa, Homo Sapiens
KKAHGPALL

SEQ ID NO: 1080680 - protein, 9 aa, Homo Sapiens
PAPSFWSWL

SEQ ID NO: 1080681 - protein, 9 aa, Homo Sapiens
DCYVAVCRP

SEQ ID NO: 1080682 - protein, 9 aa, Homo Sapiens
SVPFQALYY

SEQ ID NO: 1080683 - protein, 9 aa, Homo Sapiens
KAALSAHSF

SEQ ID NO: 1080684 - protein, 9 aa, Homo Sapiens
NFLEEFRPE

SEQ ID NO: 1080685 - protein, 9 aa, Homo Sapiens
QSKEAHISD

SEQ ID NO: 1080686 - protein, 9 aa, Homo Sapiens
EYEKSWRRK

SEQ ID NO: 1080687 - protein, 9 aa, Homo Sapiens
LTPETTYFV

SEQ ID NO: 1080688 - protein, 9 aa, Homo Sapiens
SRNGPGRVN

SEQ ID NO: 1080689 - protein, 9 aa, Homo Sapiens
VLKQEVKTL

SEQ ID NO: 1080690 - protein, 9 aa, Homo Sapiens
LFEDTPLHT

SEQ ID NO: 1080691 - protein, 9 aa, Homo Sapiens
HRLSATLEG

SEQ ID NO: 1080692 - protein, 9 aa, Homo Sapiens
GEEARQGSR

SEQ ID NO: 1080693 - protein, 9 aa, Homo Sapiens
EKEKELVEL

SEQ ID NO: 1080694 - protein, 9 aa, Homo Sapiens
LSRTSTTLP

SEQ ID NO: 1080695 - protein, 9 aa, Homo Sapiens
TQKMGMTKK

SEQ ID NO: 1080696 - protein, 9 aa, Homo Sapiens
ISPPTPKLR

SEQ ID NO: 1080697 - protein, 9 aa, Homo Sapiens
KDGREGSRL

SEQ ID NO: 1080698 - protein, 9 aa, Homo Sapiens
VAFYNKIFL

SEQ ID NO: 1080699 - protein, 9 aa, Homo Sapiens
VLEAVWYLH

SEQ ID NO: 1080700 - protein, 9 aa, Homo Sapiens
FSTNEPTDI

SEQ ID NO: 1080701 - protein, 9 aa, Homo Sapiens
LRRNPGGEE

SEQ ID NO: 1080702 - protein, 9 aa, Homo Sapiens
AERISLVLL

SEQ ID NO: 1080703 - protein, 9 aa, Homo Sapiens
ILATSQSCQ

SEQ ID NO: 1080704 - protein, 9 aa, Homo Sapiens
FSPMPRESC

SEQ ID NO: 1080705 - protein, 9 aa, Homo Sapiens
DTIRYIFNE

SEQ ID NO: 1080706 - protein, 9 aa, Homo Sapiens
PIKCLKDED

SEQ ID NO: 1080707 - protein, 9 aa, Homo Sapiens
PGDFGPRED

SEQ ID NO: 1080708 - protein, 9 aa, Homo Sapiens
RVVDSTLEL

SEQ ID NO: 1080709 - protein, 9 aa, Homo Sapiens
EQGVSFQQS

SEQ ID NO: 1080710 - protein, 9 aa, Homo Sapiens
KVSGSRGFF

SEQ ID NO: 1080711 - protein, 9 aa, Homo Sapiens
YSYGKYRDL

SEQ ID NO: 1080712 - protein, 9 aa, Homo Sapiens
GNKTTIRLI

SEQ ID NO: 1080713 - protein, 9 aa, Homo Sapiens
KSAKRWKFG

SEQ ID NO: 1080714 - protein, 9 aa, Homo Sapiens
AGFAGDDVP

SEQ ID NO: 1080715 - protein, 9 aa, Homo Sapiens
KVLPGDVRQ

SEQ ID NO: 1080716 - protein, 9 aa, Homo Sapiens
VENGLSEQK

SEQ ID NO: 1080717 - protein, 9 aa, Homo Sapiens
SFNIEEFDK

SEQ ID NO: 1080718 - protein, 9 aa, Homo Sapiens
AKEQQKAKD

SEQ ID NO: 1080719 - protein, 9 aa, Homo Sapiens
PNGLIFKDG

SEQ ID NO: 1080720 - protein, 9 aa, Homo Sapiens
EAAKSAVGT

SEQ ID NO: 1080721 - protein, 9 aa, Homo Sapiens
LDEKLDYRK

SEQ ID NO: 1080722 - protein, 9 aa, Homo Sapiens
ALEEQRLVY

SEQ ID NO: 1080723 - protein, 9 aa, Homo Sapiens
AGSSSFSEE

SEQ ID NO: 1080724 - protein, 9 aa, Homo Sapiens
EDARALCEG

SEQ ID NO: 1080725 - protein, 9 aa, Homo Sapiens
SDGSESRGE

SEQ ID NO: 1080726 - protein, 9 aa, Homo Sapiens
ENRCQKLEE

SEQ ID NO: 1080727 - protein, 9 aa, Homo Sapiens
PSGEGGPKK

SEQ ID NO: 1080728 - protein, 9 aa, Homo Sapiens
PEITSKNTT

SEQ ID NO: 1080729 - protein, 9 aa, Homo Sapiens
CPLMLKFQF

SEQ ID NO: 1080730 - protein, 9 aa, Homo Sapiens
ALWGKAPCL

SEQ ID NO: 1080731 - protein, 9 aa, Homo Sapiens
MAALLVTMG

SEQ ID NO: 1080732 - protein, 9 aa, Homo Sapiens
LKQENSELR

SEQ ID NO: 1080733 - protein, 9 aa, Homo Sapiens
PKSPGPHSR

SEQ ID NO: 1080734 - protein, 9 aa, Homo Sapiens
GLLIFFRFI

SEQ ID NO: 1080735 - protein, 9 aa, Homo Sapiens
YDCFTAICK

SEQ ID NO: 1080736 - protein, 9 aa, Homo Sapiens
IYGFPPSFF

SEQ ID NO: 1080737 - protein, 9 aa, Homo Sapiens
TAISNAQLF

SEQ ID NO: 1080738 - protein, 9 aa, Homo Sapiens
EKALRRAKT

SEQ ID NO: 1080739 - protein, 9 aa, Homo Sapiens
FENLNGHMI

SEQ ID NO: 1080740 - protein, 9 aa, Homo Sapiens
PLPGEWKLC

SEQ ID NO: 1080741 - protein, 9 aa, Homo Sapiens
QLSEAQLSF

SEQ ID NO: 1080742 - protein, 9 aa, Homo Sapiens
PSAHGAVTS

SEQ ID NO: 1080743 - protein, 9 aa, Homo Sapiens
LSIKFILLL

SEQ ID NO: 1080744 - protein, 9 aa, Homo Sapiens
VENVGSMIS

SEQ ID NO: 1080745 - protein, 9 aa, Homo Sapiens
KKMDSIVQC

SEQ ID NO: 1080746 - protein, 9 aa, Homo Sapiens
ETWGTDTPP

SEQ ID NO: 1080747 - protein, 9 aa, Homo Sapiens
SQEMTGKKE

SEQ ID NO: 1080748 - protein, 9 aa, Homo Sapiens
KSQRPMFSP

SEQ ID NO: 1080749 - protein, 9 aa, Homo Sapiens
SQYKTWQKK

SEQ ID NO: 1080750 - protein, 9 aa, Homo Sapiens
KMRLSPVQC

SEQ ID NO: 1080751 - protein, 9 aa, Homo Sapiens
ITYKIIRHK

SEQ ID NO: 1080752 - protein, 9 aa, Homo Sapiens
ACSVCNSAT

SEQ ID NO: 1080753 - protein, 9 aa, Homo Sapiens
HAFDDNKLV

SEQ ID NO: 1080754 - protein, 9 aa, Homo Sapiens
RALHLDHNK

SEQ ID NO: 1080755 - protein, 9 aa, Homo Sapiens
QEQKPEEEI

SEQ ID NO: 1080756 - protein, 9 aa, Homo Sapiens
RKDINFWVE

SEQ ID NO: 1080757 - protein, 9 aa, Homo Sapiens
LTKLCKMAQ

SEQ ID NO: 1080758 - protein, 9 aa, Homo Sapiens
HSSGLTGNS

SEQ ID NO: 1080759 - protein, 9 aa, Homo Sapiens
TVTAVSALG

SEQ ID NO: 1080760 - protein, 9 aa, Homo Sapiens
GKALGVYNR

SEQ ID NO: 1080761 - protein, 9 aa, Homo Sapiens
QVLDNPARV

SEQ ID NO: 1080762 - protein, 9 aa, Homo Sapiens
PMISWIGVS

SEQ ID NO: 1080763 - protein, 9 aa, Homo Sapiens
SINLFGNSR

SEQ ID NO: 1080764 - protein, 9 aa, Homo Sapiens
LVPVPAATG

SEQ ID NO: 1080765 - protein, 9 aa, Homo Sapiens
KKDCDASPS

SEQ ID NO: 1080766 - protein, 9 aa, Homo Sapiens
LGKNSEKNS

SEQ ID NO: 1080767 - protein, 9 aa, Homo Sapiens
LTLQCPGSC

SEQ ID NO: 1080768 - protein, 9 aa, Homo Sapiens
LIGSLAANY

SEQ ID NO: 1080769 - protein, 9 aa, Homo Sapiens
PSPFSTVVS

SEQ ID NO: 1080770 - protein, 9 aa, Homo Sapiens
TVPKMASNY

SEQ ID NO: 1080771 - protein, 9 aa, Homo Sapiens
IFAGQDSSC

SEQ ID NO: 1080772 - protein, 9 aa, Homo Sapiens
LGESMYSVR

SEQ ID NO: 1080773 - protein, 9 aa, Homo Sapiens
PSPACPHEK

SEQ ID NO: 1080774 - protein, 9 aa, Homo Sapiens
KLRRELDKS

SEQ ID NO: 1080775 - protein, 9 aa, Homo Sapiens
SMMTPSDIT

SEQ ID NO: 1080776 - protein, 9 aa, Homo Sapiens
KSTQVSGVG

SEQ ID NO: 1080777 - protein, 9 aa, Homo Sapiens
PVIEEPASD

SEQ ID NO: 1080778 - protein, 9 aa, Homo Sapiens
IVADCAVVG

SEQ ID NO: 1080779 - protein, 9 aa, Homo Sapiens
EQQPPEKEL

SEQ ID NO: 1080780 - protein, 9 aa, Homo Sapiens
VEPPTVKET

SEQ ID NO: 1080781 - protein, 9 aa, Homo Sapiens
QKKKTVITD

SEQ ID NO: 1080782 - protein, 9 aa, Homo Sapiens
RSGSNPNCV

SEQ ID NO: 1080783 - protein, 9 aa, Homo Sapiens
SQAQQPSEK

SEQ ID NO: 1080784 - protein, 9 aa, Homo Sapiens
KKYHERMSS

SEQ ID NO: 1080785 - protein, 9 aa, Homo Sapiens
RSFISWGII

SEQ ID NO: 1080786 - protein, 9 aa, Homo Sapiens
STFNPEFVH

SEQ ID NO: 1080787 - protein, 9 aa, Homo Sapiens
FRLCCVQEA

SEQ ID NO: 1080788 - protein, 9 aa, Homo Sapiens
TYNEPQTAL

SEQ ID NO: 1080789 - protein, 9 aa, Homo Sapiens
NSSLKVSPK

SEQ ID NO: 1080790 - protein, 9 aa, Homo Sapiens
SFMRVREKT

SEQ ID NO: 1080791 - protein, 9 aa, Homo Sapiens
DFYWPSREQ

SEQ ID NO: 1080792 - protein, 9 aa, Homo Sapiens
NLSPIKDAS

SEQ ID NO: 1080793 - protein, 9 aa, Homo Sapiens
SRSRTQLFS

SEQ ID NO: 1080794 - protein, 9 aa, Homo Sapiens
GRQGHLPFF

SEQ ID NO: 1080795 - protein, 9 aa, Homo Sapiens
LGGSQVKKG

SEQ ID NO: 1080796 - protein, 9 aa, Homo Sapiens
CPRCQKLEQ

SEQ ID NO: 1080797 - protein, 9 aa, Homo Sapiens
DCTATSNMG

SEQ ID NO: 1080798 - protein, 9 aa, Homo Sapiens
LETYDEPPQ

SEQ ID NO: 1080799 - protein, 9 aa, Homo Sapiens
PGPAFQSLW

SEQ ID NO: 1080800 - protein, 9 aa, Homo Sapiens
AKAGTEPPG

SEQ ID NO: 1080801 - protein, 9 aa, Homo Sapiens
EITWHVIAQ

SEQ ID NO: 1080802 - protein, 9 aa, Homo Sapiens
EFVIATFIR

SEQ ID NO: 1080803 - protein, 9 aa, Homo Sapiens
IESVHSNME

SEQ ID NO: 1080804 - protein, 9 aa, Homo Sapiens
WDQEILLPQ

SEQ ID NO: 1080805 - protein, 9 aa, Homo Sapiens
STLSCFAVR

SEQ ID NO: 1080806 - protein, 9 aa, Homo Sapiens
VEGDPESLD

SEQ ID NO: 1080807 - protein, 9 aa, Homo Sapiens
YLDAIGGTL

SEQ ID NO: 1080808 - protein, 9 aa, Homo Sapiens
LGLTQDPIW

SEQ ID NO: 1080809 - protein, 9 aa, Homo Sapiens
LQSQSMNDS

SEQ ID NO: 1080810 - protein, 9 aa, Homo Sapiens
TRQREKRRT

SEQ ID NO: 1080811 - protein, 9 aa, Homo Sapiens
TSFTIFEKA

SEQ ID NO: 1080812 - protein, 9 aa, Homo Sapiens
AEIEWLEFR

SEQ ID NO: 1080813 - protein, 9 aa, Homo Sapiens
DKIKVLFDV

SEQ ID NO: 1080814 - protein, 9 aa, Homo Sapiens
AHLNSSQNP

SEQ ID NO: 1080815 - protein, 9 aa, Homo Sapiens
AKSSSKSGA

SEQ ID NO: 1080816 - protein, 9 aa, Homo Sapiens
EARQGSRGG

SEQ ID NO: 1080817 - protein, 9 aa, Homo Sapiens
NRELQIMKK

SEQ ID NO: 1080818 - protein, 9 aa, Homo Sapiens
PYASVQFAP

SEQ ID NO: 1080819 - protein, 9 aa, Homo Sapiens
KHLTYAEFT

SEQ ID NO: 1080820 - protein, 9 aa, Homo Sapiens
PRQALLPPA

SEQ ID NO: 1080821 - protein, 9 aa, Homo Sapiens
SDESRKSCI

SEQ ID NO: 1080822 - protein, 9 aa, Homo Sapiens
PRQVPVLGK

SEQ ID NO: 1080823 - protein, 9 aa, Homo Sapiens
ATQTCTPIF

SEQ ID NO: 1080824 - protein, 9 aa, Homo Sapiens
WKDVWLKEG

SEQ ID NO: 1080825 - protein, 9 aa, Homo Sapiens
VQYFCYIFW

SEQ ID NO: 1080826 - protein, 9 aa, Homo Sapiens
SLSAQNKGW

SEQ ID NO: 1080827 - protein, 9 aa, Homo Sapiens
HRLVVLVKN

SEQ ID NO: 1080828 - protein, 9 aa, Homo Sapiens
HRFGGHTIS

SEQ ID NO: 1080829 - protein, 9 aa, Homo Sapiens
EQGKEDEEG

SEQ ID NO: 1080830 - protein, 9 aa, Homo Sapiens
KTTIRLINS

SEQ ID NO: 1080831 - protein, 9 aa, Homo Sapiens
IDTVYFSSS

SEQ ID NO: 1080832 - protein, 9 aa, Homo Sapiens
THNLEPYIE

SEQ ID NO: 1080833 - protein, 9 aa, Homo Sapiens
TVKETLADV

SEQ ID NO: 1080834 - protein, 9 aa, Homo Sapiens
SHGYNFWID

SEQ ID NO: 1080835 - protein, 9 aa, Homo Sapiens
WRAETFGGF

SEQ ID NO: 1080836 - protein, 9 aa, Homo Sapiens
RGPKSIISL

SEQ ID NO: 1080837 - protein, 9 aa, Homo Sapiens
DNKLVKGVN

SEQ ID NO: 1080838 - protein, 9 aa, Homo Sapiens
YCSVTSWVK

SEQ ID NO: 1080839 - protein, 9 aa, Homo Sapiens
FTRFVCVGV

SEQ ID NO: 1080840 - protein, 9 aa, Homo Sapiens
SALEEQRLV

SEQ ID NO: 1080841 - protein, 9 aa, Homo Sapiens
EIANICSHG

SEQ ID NO: 1080842 - protein, 9 aa, Homo Sapiens
FEKEKELVE

SEQ ID NO: 1080843 - protein, 9 aa, Homo Sapiens
TKNSTIEYN

SEQ ID NO: 1080844 - protein, 9 aa, Homo Sapiens
SQMGSPAED

SEQ ID NO: 1080845 - protein, 9 aa, Homo Sapiens
TTRNTTLNG

SEQ ID NO: 1080846 - protein, 9 aa, Homo Sapiens
SEKNSTFRN

SEQ ID NO: 1080847 - protein, 9 aa, Homo Sapiens
AARAGHLKK

SEQ ID NO: 1080848 - protein, 9 aa, Homo Sapiens
IVVVQSLDG

SEQ ID NO: 1080849 - protein, 9 aa, Homo Sapiens
CAFKLTMQA

SEQ ID NO: 1080850 - protein, 9 aa, Homo Sapiens
VTEQDGCDP

SEQ ID NO: 1080851 - protein, 9 aa, Homo Sapiens
LSTVLSSLL

SEQ ID NO: 1080852 - protein, 9 aa, Homo Sapiens
FLQELVSHM

SEQ ID NO: 1080853 - protein, 9 aa, Homo Sapiens
VMHSFWNTI

SEQ ID NO: 1080854 - protein, 9 aa, Homo Sapiens
FVFRMYRVK

SEQ ID NO: 1080855 - protein, 9 aa, Homo Sapiens
DSTLLPVTD

SEQ ID NO: 1080856 - protein, 9 aa, Homo Sapiens
SSGGGLPSA

SEQ ID NO: 1080857 - protein, 9 aa, Homo Sapiens
SSAEDNSPM

SEQ ID NO: 1080858 - protein, 9 aa, Homo Sapiens
KNNSNSLQV

SEQ ID NO: 1080859 - protein, 9 aa, Homo Sapiens
ILGVITEAT

SEQ ID NO: 1080860 - protein, 9 aa, Homo Sapiens
LLNPFACHV

SEQ ID NO: 1080861 - protein, 9 aa, Homo Sapiens
DEPPQPPPS

SEQ ID NO: 1080862 - protein, 9 aa, Homo Sapiens
SKPGAIDEV

SEQ ID NO: 1080863 - protein, 9 aa, Homo Sapiens
AWVWSVDKG

SEQ ID NO: 1080864 - protein, 9 aa, Homo Sapiens
WLTPPGSCG

SEQ ID NO: 1080865 - protein, 9 aa, Homo Sapiens
DSCLALEKE

SEQ ID NO: 1080866 - protein, 9 aa, Homo Sapiens
SSNITLQNE

SEQ ID NO: 1080867 - protein, 9 aa, Homo Sapiens
SKRKILQFV

SEQ ID NO: 1080868 - protein, 9 aa, Homo Sapiens
ASPEGSEAT

SEQ ID NO: 1080869 - protein, 9 aa, Homo Sapiens
SSQLFPLSR

SEQ ID NO: 1080870 - protein, 9 aa, Homo Sapiens
GILRLGTQK

SEQ ID NO: 1080871 - protein, 9 aa, Homo Sapiens
SPPPPPRDG

SEQ ID NO: 1080872 - protein, 9 aa, Homo Sapiens
VSQGLKDKV

SEQ ID NO: 1080873 - protein, 9 aa, Homo Sapiens
NGIEQRNTL

SEQ ID NO: 1080874 - protein, 9 aa, Homo Sapiens
DLSLYFVMV

SEQ ID NO: 1080875 - protein, 9 aa, Homo Sapiens
ATEKSRWSG

SEQ ID NO: 1080876 - protein, 9 aa, Homo Sapiens
LVKSITLPV

SEQ ID NO: 1080877 - protein, 9 aa, Homo Sapiens
LNEQQKNSF

SEQ ID NO: 1080878 - protein, 9 aa, Homo Sapiens
ENGSIQPYS

SEQ ID NO: 1080879 - protein, 9 aa, Homo Sapiens
GPPVSSWPR

SEQ ID NO: 1080880 - protein, 9 aa, Homo Sapiens
SDTLTFSYA

SEQ ID NO: 1080881 - protein, 9 aa, Homo Sapiens
GKEVPADIL

SEQ ID NO: 1080882 - protein, 9 aa, Homo Sapiens
GQPGAKGKP

SEQ ID NO: 1080883 - protein, 9 aa, Homo Sapiens
KVLVLTENT

SEQ ID NO: 1080884 - protein, 9 aa, Homo Sapiens
CGLLILASW

SEQ ID NO: 1080885 - protein, 9 aa, Homo Sapiens
IVITDTARS

SEQ ID NO: 1080886 - protein, 9 aa, Homo Sapiens
MMLSLFEDT

SEQ ID NO: 1080887 - protein, 9 aa, Homo Sapiens
DHGHGRNHH

SEQ ID NO: 1080888 - protein, 9 aa, Homo Sapiens
LYQECILVE

SEQ ID NO: 1080889 - protein, 9 aa, Homo Sapiens
GQIFSAYPS

SEQ ID NO: 1080890 - protein, 9 aa, Homo Sapiens
DTFISLLTE

SEQ ID NO: 1080891 - protein, 9 aa, Homo Sapiens
SLSALMKQR

SEQ ID NO: 1080892 - protein, 9 aa, Homo Sapiens
IEEVVIKRL

SEQ ID NO: 1080893 - protein, 9 aa, Homo Sapiens
DLHKGTKSE

SEQ ID NO: 1080894 - protein, 9 aa, Homo Sapiens
LPAPEVFPR

SEQ ID NO: 1080895 - protein, 9 aa, Homo Sapiens
RGSSSSSSG

SEQ ID NO: 1080896 - protein, 9 aa, Homo Sapiens
QSQSMNDSE

SEQ ID NO: 1080897 - protein, 9 aa, Homo Sapiens
SAQKKMKTK

SEQ ID NO: 1080898 - protein, 9 aa, Homo Sapiens
MVKAGSSSF

SEQ ID NO: 1080899 - protein, 9 aa, Homo Sapiens
KVYELAQVL

SEQ ID NO: 1080900 - protein, 9 aa, Homo Sapiens
ENILPSVSF

SEQ ID NO: 1080901 - protein, 9 aa, Homo Sapiens
NGTRGWKKK

SEQ ID NO: 1080902 - protein, 9 aa, Homo Sapiens
NPCLKQENS

SEQ ID NO: 1080903 - protein, 9 aa, Homo Sapiens
YTDSFFKFQ

SEQ ID NO: 1080904 - protein, 9 aa, Homo Sapiens
EAGPSLELP

SEQ ID NO: 1080905 - protein, 9 aa, Homo Sapiens
NLNGHMIPI

SEQ ID NO: 1080906 - protein, 9 aa, Homo Sapiens
FFLTTAIGD

SEQ ID NO: 1080907 - protein, 9 aa, Homo Sapiens
RPWAQGTAE

SEQ ID NO: 1080908 - protein, 9 aa, Homo Sapiens
MGPGSWYSK

SEQ ID NO: 1080909 - protein, 9 aa, Homo Sapiens
TNITDLRIQ

SEQ ID NO: 1080910 - protein, 9 aa, Homo Sapiens
NIITDVLIE

SEQ ID NO: 1080911 - protein, 9 aa, Homo Sapiens
RTALPTFGS

SEQ ID NO: 1080912 - protein, 9 aa, Homo Sapiens
GSAQENNQA

SEQ ID NO: 1080913 - protein, 9 aa, Homo Sapiens
NAAGVKFSC

SEQ ID NO: 1080914 - protein, 9 aa, Homo Sapiens
SGVVEFSLC

SEQ ID NO: 1080915 - protein, 9 aa, Homo Sapiens
KEIYVGDFV

SEQ ID NO: 1080916 - protein, 9 aa, Homo Sapiens
VPSGETPKS

SEQ ID NO: 1080917 - protein, 9 aa, Homo Sapiens
AREVEALTQ

SEQ ID NO: 1080918 - protein, 9 aa, Homo Sapiens
NNRFFAVRP

SEQ ID NO: 1080919 - protein, 9 aa, Homo Sapiens
EKKKIVLKQ

SEQ ID NO: 1080920 - protein, 9 aa, Homo Sapiens
TMKFYFAIN

SEQ ID NO: 1080921 - protein, 9 aa, Homo Sapiens
NSSYIVGFY

SEQ ID NO: 1080922 - protein, 9 aa, Homo Sapiens
MQAQLLSRK

SEQ ID NO: 1080923 - protein, 9 aa, Homo Sapiens
FRLARWRKK

SEQ ID NO: 1080924 - protein, 9 aa, Homo Sapiens
LGIFGDVNN

SEQ ID NO: 1080925 - protein, 9 aa, Homo Sapiens
RRRKNMSKF

SEQ ID NO: 1080926 - protein, 9 aa, Homo Sapiens
LLTLPNDTD

SEQ ID NO: 1080927 - protein, 9 aa, Homo Sapiens
IPDCTSWDQ

SEQ ID NO: 1080928 - protein, 9 aa, Homo Sapiens
GLPNNRFFA

SEQ ID NO: 1080929 - protein, 9 aa, Homo Sapiens
IMCDLCKSP

SEQ ID NO: 1080930 - protein, 9 aa, Homo Sapiens
ILSFIQDKS

SEQ ID NO: 1080931 - protein, 9 aa, Homo Sapiens
QFNLIPQRE

SEQ ID NO: 1080932 - protein, 9 aa, Homo Sapiens
EEQKNVYFL

SEQ ID NO: 1080933 - protein, 9 aa, Homo Sapiens
SSPSAHGAV

SEQ ID NO: 1080934 - protein, 9 aa, Homo Sapiens
QRRSKSSAD

SEQ ID NO: 1080935 - protein, 9 aa, Homo Sapiens
SYDLNLCEL

SEQ ID NO: 1080936 - protein, 9 aa, Homo Sapiens
HYGQGMNPA

SEQ ID NO: 1080937 - protein, 9 aa, Homo Sapiens
VVVKEVLAR

SEQ ID NO: 1080938 - protein, 9 aa, Homo Sapiens
FISVFYRAL

SEQ ID NO: 1080939 - protein, 9 aa, Homo Sapiens
RLIFTIGPS

SEQ ID NO: 1080940 - protein, 9 aa, Homo Sapiens
GTNVNMKTN

SEQ ID NO: 1080941 - protein, 9 aa, Homo Sapiens
ETSSEASYG

SEQ ID NO: 1080942 - protein, 9 aa, Homo Sapiens
RLSPGPGLG

SEQ ID NO: 1080943 - protein, 9 aa, Homo Sapiens
KEGAAGVWK

SEQ ID NO: 1080944 - protein, 9 aa, Homo Sapiens
STEEAQPST

SEQ ID NO: 1080945 - protein, 9 aa, Homo Sapiens
TTEVVLCED

SEQ ID NO: 1080946 - protein, 9 aa, Homo Sapiens
GAPSVLCSS

SEQ ID NO: 1080947 - protein, 9 aa, Homo Sapiens
AQTPSPAFC

SEQ ID NO: 1080948 - protein, 9 aa, Homo Sapiens
LTLPNDTDG

SEQ ID NO: 1080949 - protein, 9 aa, Homo Sapiens
EVKSYSIEM

SEQ ID NO: 1080950 - protein, 9 aa, Homo Sapiens
IGSAFKSDE

SEQ ID NO: 1080951 - protein, 9 aa, Homo Sapiens
RRQKRGRFH

SEQ ID NO: 1080952 - protein, 9 aa, Homo Sapiens
TPETTYFVT

SEQ ID NO: 1080953 - protein, 9 aa, Homo Sapiens
AVFWAITIA

SEQ ID NO: 1080954 - protein, 9 aa, Homo Sapiens
GGLFTYVSR

SEQ ID NO: 1080955 - protein, 9 aa, Homo Sapiens
KDTNTTEIL

SEQ ID NO: 1080956 - protein, 9 aa, Homo Sapiens
ILPIKCLKD

SEQ ID NO: 1080957 - protein, 9 aa, Homo Sapiens
LPWRAETFG

SEQ ID NO: 1080958 - protein, 9 aa, Homo Sapiens
KVSLSPPWN

SEQ ID NO: 1080959 - protein, 9 aa, Homo Sapiens
FDTFVYSQL

SEQ ID NO: 1080960 - protein, 9 aa, Homo Sapiens
EEEGKPSCK

SEQ ID NO: 1080961 - protein, 9 aa, Homo Sapiens
ESILSHGIV

SEQ ID NO: 1080962 - protein, 9 aa, Homo Sapiens
AVSALGLAS

SEQ ID NO: 1080963 - protein, 9 aa, Homo Sapiens
LVILVIVGL

SEQ ID NO: 1080964 - protein, 9 aa, Homo Sapiens
PLTRARGAP

SEQ ID NO: 1080965 - protein, 9 aa, Homo Sapiens
FFKFQVVEG

SEQ ID NO: 1080966 - protein, 9 aa, Homo Sapiens
ESWDKILAF

SEQ ID NO: 1080967 - protein, 9 aa, Homo Sapiens
RQALLPPAE

SEQ ID NO: 1080968 - protein, 9 aa, Homo Sapiens
SELFCHLHT

SEQ ID NO: 1080969 - protein, 9 aa, Homo Sapiens
LVVSLIGIA

SEQ ID NO: 1080970 - protein, 9 aa, Homo Sapiens
CWRKTVRVK

SEQ ID NO: 1080971 - protein, 9 aa, Homo Sapiens
NHSSATEFY

SEQ ID NO: 1080972 - protein, 9 aa, Homo Sapiens
CANPVHGPQ

SEQ ID NO: 1080973 - protein, 9 aa, Homo Sapiens
DYFKKHQQE

SEQ ID NO: 1080974 - protein, 9 aa, Homo Sapiens
DLRVRTLFR

SEQ ID NO: 1080975 - protein, 9 aa, Homo Sapiens
DPEGMGIIL

SEQ ID NO: 1080976 - protein, 9 aa, Homo Sapiens
ISTHQLKKL

SEQ ID NO: 1080977 - protein, 9 aa, Homo Sapiens
CQQEGSREQ

SEQ ID NO: 1080978 - protein, 9 aa, Homo Sapiens
QKLQHVAQM

SEQ ID NO: 1080979 - protein, 9 aa, Homo Sapiens
IATFIREML

SEQ ID NO: 1080980 - protein, 9 aa, Homo Sapiens
KISSEQDYT

SEQ ID NO: 1080981 - protein, 9 aa, Homo Sapiens
VLSTNYANS

SEQ ID NO: 1080982 - protein, 9 aa, Homo Sapiens
PSCPARKKA

SEQ ID NO: 1080983 - protein, 9 aa, Homo Sapiens
IFYSKSELA

SEQ ID NO: 1080984 - protein, 9 aa, Homo Sapiens
SALLFIVAW

SEQ ID NO: 1080985 - protein, 9 aa, Homo Sapiens
NPCLCGLLI

SEQ ID NO: 1080986 - protein, 9 aa, Homo Sapiens
QKCETRVLA

SEQ ID NO: 1080987 - protein, 9 aa, Homo Sapiens
SEYFVKIQF

SEQ ID NO: 1080988 - protein, 9 aa, Homo Sapiens
PTAPPNVIS

SEQ ID NO: 1080989 - protein, 9 aa, Homo Sapiens
LARDSVHSL

SEQ ID NO: 1080990 - protein, 9 aa, Homo Sapiens
ELDYLSQGT

SEQ ID NO: 1080991 - protein, 9 aa, Homo Sapiens
AKADLLQSQ

SEQ ID NO: 1080992 - protein, 9 aa, Homo Sapiens
VGNKTTIRL

SEQ ID NO: 1080993 - protein, 9 aa, Homo Sapiens
QKLEETVRH

SEQ ID NO: 1080994 - protein, 9 aa, Homo Sapiens
QTLEGKYLL

SEQ ID NO: 1080995 - protein, 9 aa, Homo Sapiens
GHPENGNSV

SEQ ID NO: 1080996 - protein, 9 aa, Homo Sapiens
QSSAGEVKR

SEQ ID NO: 1080997 - protein, 9 aa, Homo Sapiens
RKFSSMDTF

SEQ ID NO: 1080998 - protein, 9 aa, Homo Sapiens
TPLSALLFL

SEQ ID NO: 1080999 - protein, 9 aa, Homo Sapiens
DHDDSAIKT

SEQ ID NO: 1081000 - protein, 9 aa, Homo Sapiens
IFKDGGCVA

SEQ ID NO: 1081001 - protein, 9 aa, Homo Sapiens
QKEIVSAQK

SEQ ID NO: 1081002 - protein, 9 aa, Homo Sapiens
SFSNTLLTS

SEQ ID NO: 1081003 - protein, 9 aa, Homo Sapiens
GGQSGMFCA

SEQ ID NO: 1081004 - protein, 9 aa, Homo Sapiens
VKVDRTLKG

SEQ ID NO: 1081005 - protein, 9 aa, Homo Sapiens
GFPPSFFSS

SEQ ID NO: 1081006 - protein, 9 aa, Homo Sapiens
VWGGQAEKL

SEQ ID NO: 1081007 - protein, 9 aa, Homo Sapiens
PCVFDFNFI

SEQ ID NO: 1081008 - protein, 9 aa, Homo Sapiens
NNNLDHEYQ

SEQ ID NO: 1081009 - protein, 9 aa, Homo Sapiens
PPPANIVKV

SEQ ID NO: 1081010 - protein, 9 aa, Homo Sapiens
CPKKAAGDA

SEQ ID NO: 1081011 - protein, 9 aa, Homo Sapiens
SEKIEDIFF

SEQ ID NO: 1081012 - protein, 9 aa, Homo Sapiens
FTCLFVEKF

SEQ ID NO: 1081013 - protein, 9 aa, Homo Sapiens
QVLGKQNSN

SEQ ID NO: 1081014 - protein, 9 aa, Homo Sapiens
LSALLFIVA

SEQ ID NO: 1081015 - protein, 9 aa, Homo Sapiens
AAPSKGESS

SEQ ID NO: 1081016 - protein, 9 aa, Homo Sapiens
GPGPSLRLQ

SEQ ID NO: 1081017 - protein, 9 aa, Homo Sapiens
RRTCTLTLK

SEQ ID NO: 1081018 - protein, 9 aa, Homo Sapiens
DIVTALRWN

SEQ ID NO: 1081019 - protein, 9 aa, Homo Sapiens
QKYPSPLDP

SEQ ID NO: 1081020 - protein, 9 aa, Homo Sapiens
HYNCSFDYV

SEQ ID NO: 1081021 - protein, 9 aa, Homo Sapiens
GYLPFFADQ

SEQ ID NO: 1081022 - protein, 9 aa, Homo Sapiens
DRNECQEIA

SEQ ID NO: 1081023 - protein, 9 aa, Homo Sapiens
DNFSWWLVN

SEQ ID NO: 1081024 - protein, 9 aa, Homo Sapiens
CGARGACKI

SEQ ID NO: 1081025 - protein, 9 aa, Homo Sapiens
PLNLPCLPD

SEQ ID NO: 1081026 - protein, 9 aa, Homo Sapiens
NGWNTTAST

SEQ ID NO: 1081027 - protein, 9 aa, Homo Sapiens
PACQSESSS

SEQ ID NO: 1081028 - protein, 9 aa, Homo Sapiens
VTVVTGGAV

SEQ ID NO: 1081029 - protein, 9 aa, Homo Sapiens
KNGLPATEK

SEQ ID NO: 1081030 - protein, 9 aa, Homo Sapiens
PTQIPVAAR

SEQ ID NO: 1081031 - protein, 9 aa, Homo Sapiens
EERVLIDKG

SEQ ID NO: 1081032 - protein, 9 aa, Homo Sapiens
SMYGAHMYQ

SEQ ID NO: 1081033 - protein, 9 aa, Homo Sapiens
SEAQLSFIR

SEQ ID NO: 1081034 - protein, 9 aa, Homo Sapiens
YENRVKDMF

SEQ ID NO: 1081035 - protein, 9 aa, Homo Sapiens
AAGPHSSDP

SEQ ID NO: 1081036 - protein, 9 aa, Homo Sapiens
LNIATEIKE

SEQ ID NO: 1081037 - protein, 9 aa, Homo Sapiens
HSGLRSANR

SEQ ID NO: 1081038 - protein, 9 aa, Homo Sapiens
KEKIVNRQK

SEQ ID NO: 1081039 - protein, 9 aa, Homo Sapiens
YIQRNVIVI

SEQ ID NO: 1081040 - protein, 9 aa, Homo Sapiens
PKIVVVQSL

SEQ ID NO: 1081041 - protein, 9 aa, Homo Sapiens
CQLDRLLPK

SEQ ID NO: 1081042 - protein, 9 aa, Homo Sapiens
MLVTLTSCA

SEQ ID NO: 1081043 - protein, 9 aa, Homo Sapiens
GGSKEGCGS

SEQ ID NO: 1081044 - protein, 9 aa, Homo Sapiens
MFLSVVAPK

SEQ ID NO: 1081045 - protein, 9 aa, Homo Sapiens
TFLLDSEVI

SEQ ID NO: 1081046 - protein, 9 aa, Homo Sapiens
FTWMEVQQT

SEQ ID NO: 1081047 - protein, 9 aa, Homo Sapiens
SLHSLMYFL

SEQ ID NO: 1081048 - protein, 9 aa, Homo Sapiens
QGEAECPGR

SEQ ID NO: 1081049 - protein, 9 aa, Homo Sapiens
NGQRIFGGP

SEQ ID NO: 1081050 - protein, 9 aa, Homo Sapiens
FQQGSTNLA

SEQ ID NO: 1081051 - protein, 9 aa, Homo Sapiens
VPKVQISEM

SEQ ID NO: 1081052 - protein, 9 aa, Homo Sapiens
DIPEKWMDF

SEQ ID NO: 1081053 - protein, 9 aa, Homo Sapiens
YKVAAAEGA

SEQ ID NO: 1081054 - protein, 9 aa, Homo Sapiens
TALPTFGSS

SEQ ID NO: 1081055 - protein, 9 aa, Homo Sapiens
ASAPGAAAR

SEQ ID NO: 1081056 - protein, 9 aa, Homo Sapiens
TDEKTYDAF

SEQ ID NO: 1081057 - protein, 9 aa, Homo Sapiens
SKEDSPELK

SEQ ID NO: 1081058 - protein, 9 aa, Homo Sapiens
KEIVSAQKI

SEQ ID NO: 1081059 - protein, 9 aa, Homo Sapiens
KLKVEAPAS

SEQ ID NO: 1081060 - protein, 9 aa, Homo Sapiens
ANFGVPSAE

SEQ ID NO: 1081061 - protein, 9 aa, Homo Sapiens
GVPKGSPRP

SEQ ID NO: 1081062 - protein, 9 aa, Homo Sapiens
GVLFLPLLP

SEQ ID NO: 1081063 - protein, 9 aa, Homo Sapiens
ARTTNSTAK

SEQ ID NO: 1081064 - protein, 9 aa, Homo Sapiens
SSLDVLLHS

SEQ ID NO: 1081065 - protein, 9 aa, Homo Sapiens
SSIGSAFKS

SEQ ID NO: 1081066 - protein, 9 aa, Homo Sapiens
ATPQPGHAL

SEQ ID NO: 1081067 - protein, 9 aa, Homo Sapiens
LLPPAEPLG

SEQ ID NO: 1081068 - protein, 9 aa, Homo Sapiens
IVALSPLNF

SEQ ID NO: 1081069 - protein, 9 aa, Homo Sapiens
FCPELVNDD

SEQ ID NO: 1081070 - protein, 9 aa, Homo Sapiens
LEIALVNQG

SEQ ID NO: 1081071 - protein, 9 aa, Homo Sapiens
IRIYIYMCL

SEQ ID NO: 1081072 - protein, 9 aa, Homo Sapiens
TFIDGKLYT

SEQ ID NO: 1081073 - protein, 9 aa, Homo Sapiens
QSYSSTFYS

SEQ ID NO: 1081074 - protein, 9 aa, Homo Sapiens
GIPSGPSKG

SEQ ID NO: 1081075 - protein, 9 aa, Homo Sapiens
ELIEKKEMK

SEQ ID NO: 1081076 - protein, 9 aa, Homo Sapiens
KHFEIAIDL

SEQ ID NO: 1081077 - protein, 9 aa, Homo Sapiens
SSKLSEYQD

SEQ ID NO: 1081078 - protein, 9 aa, Homo Sapiens
KELVELLAR

SEQ ID NO: 1081079 - protein, 9 aa, Homo Sapiens
VPLNLPCLP

SEQ ID NO: 1081080 - protein, 9 aa, Homo Sapiens
GSNSQVFAL

SEQ ID NO: 1081081 - protein, 9 aa, Homo Sapiens
VVIKRLARG

SEQ ID NO: 1081082 - protein, 9 aa, Homo Sapiens
VPEKDADWM

SEQ ID NO: 1081083 - protein, 9 aa, Homo Sapiens
LNGHMIPIG

SEQ ID NO: 1081084 - protein, 9 aa, Homo Sapiens
YLGYLARMN

SEQ ID NO: 1081085 - protein, 9 aa, Homo Sapiens
LRQKVAMKK

SEQ ID NO: 1081086 - protein, 9 aa, Homo Sapiens
YTTNAFSGE

SEQ ID NO: 1081087 - protein, 9 aa, Homo Sapiens
TACMPTGLA

SEQ ID NO: 1081088 - protein, 9 aa, Homo Sapiens
HYAAASGMQ

SEQ ID NO: 1081089 - protein, 9 aa, Homo Sapiens
FSKRNLIVH

SEQ ID NO: 1081090 - protein, 9 aa, Homo Sapiens
YPTPPATLP

SEQ ID NO: 1081091 - protein, 9 aa, Homo Sapiens
NRCQKLEET

SEQ ID NO: 1081092 - protein, 9 aa, Homo Sapiens
CTFSQSQQG

SEQ ID NO: 1081093 - protein, 9 aa, Homo Sapiens
SSSYRTKKE

SEQ ID NO: 1081094 - protein, 9 aa, Homo Sapiens
MQNAAGVKF

SEQ ID NO: 1081095 - protein, 9 aa, Homo Sapiens
LHSSDICPT

SEQ ID NO: 1081096 - protein, 9 aa, Homo Sapiens
TCDPHPDKG

SEQ ID NO: 1081097 - protein, 9 aa, Homo Sapiens
VEKDGFLLI

SEQ ID NO: 1081098 - protein, 9 aa, Homo Sapiens
ASPAGFDKP

SEQ ID NO: 1081099 - protein, 9 aa, Homo Sapiens
HQSHHCAPA

SEQ ID NO: 1081100 - protein, 9 aa, Homo Sapiens
QVSESLWLH

SEQ ID NO: 1081101 - protein, 9 aa, Homo Sapiens
PLVGRGTGK

SEQ ID NO: 1081102 - protein, 9 aa, Homo Sapiens
VLCEDPLSG

SEQ ID NO: 1081103 - protein, 9 aa, Homo Sapiens
ERINVYYIE

SEQ ID NO: 1081104 - protein, 9 aa, Homo Sapiens
RALSSLRDP

SEQ ID NO: 1081105 - protein, 9 aa, Homo Sapiens
EMALRVPSL

SEQ ID NO: 1081106 - protein, 9 aa, Homo Sapiens
AYCPLMLKF

SEQ ID NO: 1081107 - protein, 9 aa, Homo Sapiens
ALSLGGTSA

SEQ ID NO: 1081108 - protein, 9 aa, Homo Sapiens
ENFKTLHMD

SEQ ID NO: 1081109 - protein, 9 aa, Homo Sapiens
DVVDLFPET

SEQ ID NO: 1081110 - protein, 9 aa, Homo Sapiens
YTACVYHKH

SEQ ID NO: 1081111 - protein, 9 aa, Homo Sapiens
AAGVIGGLV

SEQ ID NO: 1081112 - protein, 9 aa, Homo Sapiens
SSQEKVPSS

SEQ ID NO: 1081113 - protein, 9 aa, Homo Sapiens
SSGSAAGKN

SEQ ID NO: 1081114 - protein, 9 aa, Homo Sapiens
CLFTESVKL

SEQ ID NO: 1081115 - protein, 9 aa, Homo Sapiens
SSLCDHERT

SEQ ID NO: 1081116 - protein, 9 aa, Homo Sapiens
HCFFLENGI

SEQ ID NO: 1081117 - protein, 9 aa, Homo Sapiens
NKAYRHGIS

SEQ ID NO: 1081118 - protein, 9 aa, Homo Sapiens
SLGQELPPG

SEQ ID NO: 1081119 - protein, 9 aa, Homo Sapiens
HSTTRNTTL

SEQ ID NO: 1081120 - protein, 9 aa, Homo Sapiens
PHSSLSLFF

SEQ ID NO: 1081121 - protein, 9 aa, Homo Sapiens
KITKIVKGL

SEQ ID NO: 1081122 - protein, 9 aa, Homo Sapiens
ALLSPGTAD

SEQ ID NO: 1081123 - protein, 9 aa, Homo Sapiens
AILCSYGRV

SEQ ID NO: 1081124 - protein, 9 aa, Homo Sapiens
FNKEGAAGV

SEQ ID NO: 1081125 - protein, 9 aa, Homo Sapiens
RKSYIWPEY

SEQ ID NO: 1081126 - protein, 9 aa, Homo Sapiens
AGPLSRPPR

SEQ ID NO: 1081127 - protein, 9 aa, Homo Sapiens
HFPGLPIWI

SEQ ID NO: 1081128 - protein, 9 aa, Homo Sapiens
NPLYVGKLH

SEQ ID NO: 1081129 - protein, 9 aa, Homo Sapiens
GNRGFIFVA

SEQ ID NO: 1081130 - protein, 9 aa, Homo Sapiens
GSVFLFAAE

SEQ ID NO: 1081131 - protein, 9 aa, Homo Sapiens
TVLSSLLSH

SEQ ID NO: 1081132 - protein, 9 aa, Homo Sapiens
QTPTSGPDA

SEQ ID NO: 1081133 - protein, 9 aa, Homo Sapiens
GTAQSNRDY

SEQ ID NO: 1081134 - protein, 9 aa, Homo Sapiens
SASVSFSLN

SEQ ID NO: 1081135 - protein, 9 aa, Homo Sapiens
DPYQSMPTS

SEQ ID NO: 1081136 - protein, 9 aa, Homo Sapiens
TNTGFLQTL

SEQ ID NO: 1081137 - protein, 9 aa, Homo Sapiens
FGNCQCFSG

SEQ ID NO: 1081138 - protein, 9 aa, Homo Sapiens
AGKKGEMGV

SEQ ID NO: 1081139 - protein, 9 aa, Homo Sapiens
NTHQSGLLE

SEQ ID NO: 1081140 - protein, 9 aa, Homo Sapiens
AVDGDLGQN

SEQ ID NO: 1081141 - protein, 9 aa, Homo Sapiens
QEILLPQPP

SEQ ID NO: 1081142 - protein, 9 aa, Homo Sapiens
AEMKTLVRE

SEQ ID NO: 1081143 - protein, 9 aa, Homo Sapiens
CRWPPPHWL

SEQ ID NO: 1081144 - protein, 9 aa, Homo Sapiens
GYLRLLQTQ

SEQ ID NO: 1081145 - protein, 9 aa, Homo Sapiens
RALQLSSHS

SEQ ID NO: 1081146 - protein, 9 aa, Homo Sapiens
SSSFSAHWR

SEQ ID NO: 1081147 - protein, 9 aa, Homo Sapiens
EFQRGKQTP

SEQ ID NO: 1081148 - protein, 9 aa, Homo Sapiens
GTLHQRFIA

SEQ ID NO: 1081149 - protein, 9 aa, Homo Sapiens
KQDGEAPLA

SEQ ID NO: 1081150 - protein, 9 aa, Homo Sapiens
LDTMRPDLL

SEQ ID NO: 1081151 - protein, 9 aa, Homo Sapiens
VFPRNPPHF

SEQ ID NO: 1081152 - protein, 9 aa, Homo Sapiens
NFTDIKLNS

SEQ ID NO: 1081153 - protein, 9 aa, Homo Sapiens
NLVGALGNL

SEQ ID NO: 1081154 - protein, 9 aa, Homo Sapiens
WFAARSGSP

SEQ ID NO: 1081155 - protein, 9 aa, Homo Sapiens
AEAIIYADL

SEQ ID NO: 1081156 - protein, 9 aa, Homo Sapiens
ASATAKAGT

SEQ ID NO: 1081157 - protein, 9 aa, Homo Sapiens
VCRWPPPHW

SEQ ID NO: 1081158 - protein, 9 aa, Homo Sapiens
DYLSQGTDL

SEQ ID NO: 1081159 - protein, 9 aa, Homo Sapiens
VVFSLTSHP

SEQ ID NO: 1081160 - protein, 9 aa, Homo Sapiens
SSFSAHWRN

SEQ ID NO: 1081161 - protein, 9 aa, Homo Sapiens
HPEQNVQKQ

SEQ ID NO: 1081162 - protein, 9 aa, Homo Sapiens
NHNVLGKNL

SEQ ID NO: 1081163 - protein, 9 aa, Homo Sapiens
PEKWMDFVS

SEQ ID NO: 1081164 - protein, 9 aa, Homo Sapiens
QEGVIQHIT

SEQ ID NO: 1081165 - protein, 9 aa, Homo Sapiens
DWLITGGSL

SEQ ID NO: 1081166 - protein, 9 aa, Homo Sapiens
ELADKKDCD

SEQ ID NO: 1081167 - protein, 9 aa, Homo Sapiens
LYPIWYQCH

SEQ ID NO: 1081168 - protein, 9 aa, Homo Sapiens
QFEEKLSPS

SEQ ID NO: 1081169 - protein, 9 aa, Homo Sapiens
CDHERTHTG

SEQ ID NO: 1081170 - protein, 9 aa, Homo Sapiens
LDSLNNLQD

SEQ ID NO: 1081171 - protein, 9 aa, Homo Sapiens
HVLWSRMSN

SEQ ID NO: 1081172 - protein, 9 aa, Homo Sapiens
QSVPVVYTT

SEQ ID NO: 1081173 - protein, 9 aa, Homo Sapiens
VYRILEEPF

SEQ ID NO: 1081174 - protein, 9 aa, Homo Sapiens
ECQEIANIC

SEQ ID NO: 1081175 - protein, 9 aa, Homo Sapiens
TRVRPEALQ

SEQ ID NO: 1081176 - protein, 9 aa, Homo Sapiens
VHTEKKSKK

SEQ ID NO: 1081177 - protein, 9 aa, Homo Sapiens
LNGALQLAS

SEQ ID NO: 1081178 - protein, 9 aa, Homo Sapiens
KGSLPRPSA

SEQ ID NO: 1081179 - protein, 9 aa, Homo Sapiens
ATAKAGTEP

SEQ ID NO: 1081180 - protein, 9 aa, Homo Sapiens
AFYNKIFLS

SEQ ID NO: 1081181 - protein, 9 aa, Homo Sapiens
RISRKYFFK

SEQ ID NO: 1081182 - protein, 9 aa, Homo Sapiens
FRKKIIKQL

SEQ ID NO: 1081183 - protein, 9 aa, Homo Sapiens
KTLKAWRED

SEQ ID NO: 1081184 - protein, 9 aa, Homo Sapiens
EEPTCEAGL

SEQ ID NO: 1081185 - protein, 9 aa, Homo Sapiens
EPPVIEEPA

SEQ ID NO: 1081186 - protein, 9 aa, Homo Sapiens
DQAQFDAEE

SEQ ID NO: 1081187 - protein, 9 aa, Homo Sapiens
EEGQSLDSL

SEQ ID NO: 1081188 - protein, 9 aa, Homo Sapiens
EEKKEIKKN

SEQ ID NO: 1081189 - protein, 9 aa, Homo Sapiens
RSDPVSLCY

SEQ ID NO: 1081190 - protein, 9 aa, Homo Sapiens
ALCEGREKT

SEQ ID NO: 1081191 - protein, 9 aa, Homo Sapiens
GCRELVWVG

SEQ ID NO: 1081192 - protein, 9 aa, Homo Sapiens
DFDHRKRGR

SEQ ID NO: 1081193 - protein, 9 aa, Homo Sapiens
KKEESLLPS

SEQ ID NO: 1081194 - protein, 9 aa, Homo Sapiens
AQSNRDYIP

SEQ ID NO: 1081195 - protein, 9 aa, Homo Sapiens
KLFEQILKT

SEQ ID NO: 1081196 - protein, 9 aa, Homo Sapiens
QKKMKTKHK

SEQ ID NO: 1081197 - protein, 9 aa, Homo Sapiens
QSKNAPKIT

SEQ ID NO: 1081198 - protein, 9 aa, Homo Sapiens
QESEVEKPL

SEQ ID NO: 1081199 - protein, 9 aa, Homo Sapiens
TVLVVRFMS

SEQ ID NO: 1081200 - protein, 9 aa, Homo Sapiens
PKALQKVKA

SEQ ID NO: 1081201 - protein, 9 aa, Homo Sapiens
HGKWATWVS

SEQ ID NO: 1081202 - protein, 9 aa, Homo Sapiens
PVVSKGKAR

SEQ ID NO: 1081203 - protein, 9 aa, Homo Sapiens
ERPKTRFQE

SEQ ID NO: 1081204 - protein, 9 aa, Homo Sapiens
NEITWHVIA

SEQ ID NO: 1081205 - protein, 9 aa, Homo Sapiens
SHGIVADCA

SEQ ID NO: 1081206 - protein, 9 aa, Homo Sapiens
LEVVNPRNP

SEQ ID NO: 1081207 - protein, 9 aa, Homo Sapiens
SKSCKFCGK

SEQ ID NO: 1081208 - protein, 9 aa, Homo Sapiens
GPETWKRNS

SEQ ID NO: 1081209 - protein, 9 aa, Homo Sapiens
QTFFFKKDK

SEQ ID NO: 1081210 - protein, 9 aa, Homo Sapiens
SLQESHITV

SEQ ID NO: 1081211 - protein, 9 aa, Homo Sapiens
HQQRIHTRK

SEQ ID NO: 1081212 - protein, 9 aa, Homo Sapiens
DKFRDFAWE

SEQ ID NO: 1081213 - protein, 9 aa, Homo Sapiens
ESFRVPYNP

SEQ ID NO: 1081214 - protein, 9 aa, Homo Sapiens
FSTLANITI

SEQ ID NO: 1081215 - protein, 9 aa, Homo Sapiens
TSTTLPADS

SEQ ID NO: 1081216 - protein, 9 aa, Homo Sapiens
LLLSNSCIL

SEQ ID NO: 1081217 - protein, 9 aa, Homo Sapiens
QTYECLHKV

SEQ ID NO: 1081218 - protein, 9 aa, Homo Sapiens
DVPRAVFPS

SEQ ID NO: 1081219 - protein, 9 aa, Homo Sapiens
NILTTKESD

SEQ ID NO: 1081220 - protein, 9 aa, Homo Sapiens
QIDQFHKAL

SEQ ID NO: 1081221 - protein, 9 aa, Homo Sapiens
VTQPTGKEP

SEQ ID NO: 1081222 - protein, 9 aa, Homo Sapiens
ILLGPGAAP

SEQ ID NO: 1081223 - protein, 9 aa, Homo Sapiens
TAQWFLHRK

SEQ ID NO: 1081224 - protein, 9 aa, Homo Sapiens
FTKNVLRLL

SEQ ID NO: 1081225 - protein, 9 aa, Homo Sapiens
FDILAVLIR

SEQ ID NO: 1081226 - protein, 9 aa, Homo Sapiens
NTIQPTSQT

SEQ ID NO: 1081227 - protein, 9 aa, Homo Sapiens
DSMLTWEKK

SEQ ID NO: 1081228 - protein, 9 aa, Homo Sapiens
RPGDDLRNT

SEQ ID NO: 1081229 - protein, 9 aa, Homo Sapiens
SDILQCDEI

SEQ ID NO: 1081230 - protein, 9 aa, Homo Sapiens
RSCNQKGGS

SEQ ID NO: 1081231 - protein, 9 aa, Homo Sapiens
REKYKGQVN

SEQ ID NO: 1081232 - protein, 9 aa, Homo Sapiens
LNFFKTSIQ

SEQ ID NO: 1081233 - protein, 9 aa, Homo Sapiens
MATQTCTPI

SEQ ID NO: 1081234 - protein, 9 aa, Homo Sapiens
MFLFPSLPL

SEQ ID NO: 1081235 - protein, 9 aa, Homo Sapiens
PEPSFLRAL

SEQ ID NO: 1081236 - protein, 9 aa, Homo Sapiens
SFQGHVTIL

SEQ ID NO: 1081237 - protein, 9 aa, Homo Sapiens
ETTEVVLCE

SEQ ID NO: 1081238 - protein, 9 aa, Homo Sapiens
SSKSGAQTP

SEQ ID NO: 1081239 - protein, 9 aa, Homo Sapiens
NWYQGKING

SEQ ID NO: 1081240 - protein, 9 aa, Homo Sapiens
THLYNNRYA

SEQ ID NO: 1081241 - protein, 9 aa, Homo Sapiens
QLQYYRRVH

SEQ ID NO: 1081242 - protein, 9 aa, Homo Sapiens
AFFCKAHGF

SEQ ID NO: 1081243 - protein, 9 aa, Homo Sapiens
LSLVKHERV

SEQ ID NO: 1081244 - protein, 9 aa, Homo Sapiens
AGRPLPGKD

SEQ ID NO: 1081245 - protein, 9 aa, Homo Sapiens
REQEKMIRE

SEQ ID NO: 1081246 - protein, 9 aa, Homo Sapiens
VPISDVYQT

SEQ ID NO: 1081247 - protein, 9 aa, Homo Sapiens
SLYVMHSFW

SEQ ID NO: 1081248 - protein, 9 aa, Homo Sapiens
NFTVRADVW

SEQ ID NO: 1081249 - protein, 9 aa, Homo Sapiens
GRTASVRGE

SEQ ID NO: 1081250 - protein, 9 aa, Homo Sapiens
GVVAEGLLG

SEQ ID NO: 1081251 - protein, 9 aa, Homo Sapiens
DHNKLDALG

SEQ ID NO: 1081252 - protein, 9 aa, Homo Sapiens
DQLETIFGK

SEQ ID NO: 1081253 - protein, 9 aa, Homo Sapiens
NLCLSSSNE

SEQ ID NO: 1081254 - protein, 9 aa, Homo Sapiens
AYSGKRLRA

SEQ ID NO: 1081255 - protein, 9 aa, Homo Sapiens
SVQACTSGS

SEQ ID NO: 1081256 - protein, 9 aa, Homo Sapiens
VSKGKARIR

SEQ ID NO: 1081257 - protein, 9 aa, Homo Sapiens
KLQHVAQME

SEQ ID NO: 1081258 - protein, 9 aa, Homo Sapiens
DNIAHLKNF

SEQ ID NO: 1081259 - protein, 9 aa, Homo Sapiens
SLPPCSISR

SEQ ID NO: 1081260 - protein, 9 aa, Homo Sapiens
GGSCSQSGS

SEQ ID NO: 1081261 - protein, 9 aa, Homo Sapiens
LALVQDVGR

SEQ ID NO: 1081262 - protein, 9 aa, Homo Sapiens
AGEILFYNV

SEQ ID NO: 1081263 - protein, 9 aa, Homo Sapiens
SSPSLAHPQ

SEQ ID NO: 1081264 - protein, 9 aa, Homo Sapiens
HLSEVRCRR

SEQ ID NO: 1081265 - protein, 9 aa, Homo Sapiens
PHKIPNNTR

SEQ ID NO: 1081266 - protein, 9 aa, Homo Sapiens
LSAKKKYPE

SEQ ID NO: 1081267 - protein, 9 aa, Homo Sapiens
VRRSPAFNL

SEQ ID NO: 1081268 - protein, 9 aa, Homo Sapiens
RVFSRKSSS

SEQ ID NO: 1081269 - protein, 9 aa, Homo Sapiens
SRPSCCRTT

SEQ ID NO: 1081270 - protein, 9 aa, Homo Sapiens
LWIHHEKME

SEQ ID NO: 1081271 - protein, 9 aa, Homo Sapiens
PLWSTAFKG

SEQ ID NO: 1081272 - protein, 9 aa, Homo Sapiens
AWREDGFYP

SEQ ID NO: 1081273 - protein, 9 aa, Homo Sapiens
YLSIKFILL

SEQ ID NO: 1081274 - protein, 9 aa, Homo Sapiens
PFMAAAVAA

SEQ ID NO: 1081275 - protein, 9 aa, Homo Sapiens
MAKLKVEAP

SEQ ID NO: 1081276 - protein, 9 aa, Homo Sapiens
ADGELESMR

SEQ ID NO: 1081277 - protein, 9 aa, Homo Sapiens
LTFSYAALA

SEQ ID NO: 1081278 - protein, 9 aa, Homo Sapiens
PAPPSLASP

SEQ ID NO: 1081279 - protein, 9 aa, Homo Sapiens
ESDDLSESE

SEQ ID NO: 1081280 - protein, 9 aa, Homo Sapiens
AGLIVGTGS

SEQ ID NO: 1081281 - protein, 9 aa, Homo Sapiens
LVLLLLFLQ

SEQ ID NO: 1081282 - protein, 9 aa, Homo Sapiens
VEWIANWLV

SEQ ID NO: 1081283 - protein, 9 aa, Homo Sapiens
EEEKRQKQE

SEQ ID NO: 1081284 - protein, 9 aa, Homo Sapiens
SESLWLHAP

SEQ ID NO: 1081285 - protein, 9 aa, Homo Sapiens
RFQSKSFLS

SEQ ID NO: 1081286 - protein, 9 aa, Homo Sapiens
VSVLVILIF

SEQ ID NO: 1081287 - protein, 9 aa, Homo Sapiens
QAEGEMGNA

SEQ ID NO: 1081288 - protein, 9 aa, Homo Sapiens
CLSTIISLL

SEQ ID NO: 1081289 - protein, 9 aa, Homo Sapiens
PPSAVFPAA

SEQ ID NO: 1081290 - protein, 9 aa, Homo Sapiens
ATSALNNDS

SEQ ID NO: 1081291 - protein, 9 aa, Homo Sapiens
GRPSEVWLQ

SEQ ID NO: 1081292 - protein, 9 aa, Homo Sapiens
GYSVRMNYT

SEQ ID NO: 1081293 - protein, 9 aa, Homo Sapiens
YSLPHFKPE

SEQ ID NO: 1081294 - protein, 9 aa, Homo Sapiens
FFTSPAVKR

SEQ ID NO: 1081295 - protein, 9 aa, Homo Sapiens
IRPEFLQGA

SEQ ID NO: 1081296 - protein, 9 aa, Homo Sapiens
WETGDTFSD

SEQ ID NO: 1081297 - protein, 9 aa, Homo Sapiens
AVVFDILAV

SEQ ID NO: 1081298 - protein, 9 aa, Homo Sapiens
IMDVIEVVL

SEQ ID NO: 1081299 - protein, 9 aa, Homo Sapiens
PSAEPEPIP

SEQ ID NO: 1081300 - protein, 9 aa, Homo Sapiens
FCLYKREKG

SEQ ID NO: 1081301 - protein, 9 aa, Homo Sapiens
LKGETRQLV

SEQ ID NO: 1081302 - protein, 9 aa, Homo Sapiens
TSDPQKDNR

SEQ ID NO: 1081303 - protein, 9 aa, Homo Sapiens
DYNFLTVKK

SEQ ID NO: 1081304 - protein, 9 aa, Homo Sapiens
LVAFLLSRV

SEQ ID NO: 1081305 - protein, 9 aa, Homo Sapiens
TVHLVYRIL

SEQ ID NO: 1081306 - protein, 9 aa, Homo Sapiens
ELFPLEFRL

SEQ ID NO: 1081307 - protein, 9 aa, Homo Sapiens
KKFLDLEQS

SEQ ID NO: 1081308 - protein, 9 aa, Homo Sapiens
ISFCLPKRE

SEQ ID NO: 1081309 - protein, 9 aa, Homo Sapiens
VLDLIVIPR

SEQ ID NO: 1081310 - protein, 9 aa, Homo Sapiens
GQRIFGGPP

SEQ ID NO: 1081311 - protein, 9 aa, Homo Sapiens
PAASQYAHL

SEQ ID NO: 1081312 - protein, 9 aa, Homo Sapiens
LSLGPAPGS

SEQ ID NO: 1081313 - protein, 9 aa, Homo Sapiens
LRRAKTLAS

SEQ ID NO: 1081314 - protein, 9 aa, Homo Sapiens
QIPSHSSFI

SEQ ID NO: 1081315 - protein, 9 aa, Homo Sapiens
QQPAGFGAV

SEQ ID NO: 1081316 - protein, 9 aa, Homo Sapiens
QGFRDILHR

SEQ ID NO: 1081317 - protein, 9 aa, Homo Sapiens
VSLCYTPST

SEQ ID NO: 1081318 - protein, 9 aa, Homo Sapiens
ESDQEKYEC

SEQ ID NO: 1081319 - protein, 9 aa, Homo Sapiens
SQEKVPSSP

SEQ ID NO: 1081320 - protein, 9 aa, Homo Sapiens
PGSSEYPLS

SEQ ID NO: 1081321 - protein, 9 aa, Homo Sapiens
SRMLQERGL

SEQ ID NO: 1081322 - protein, 9 aa, Homo Sapiens
VTILADSSS

SEQ ID NO: 1081323 - protein, 9 aa, Homo Sapiens
SSLLVHQRV

SEQ ID NO: 1081324 - protein, 9 aa, Homo Sapiens
VLNIATEIK

SEQ ID NO: 1081325 - protein, 9 aa, Homo Sapiens
PHVVLGWNL

SEQ ID NO: 1081326 - protein, 9 aa, Homo Sapiens
DWAAKKFPK

SEQ ID NO: 1081327 - protein, 9 aa, Homo Sapiens
GVELFERLE

SEQ ID NO: 1081328 - protein, 9 aa, Homo Sapiens
SPISSKCVS

SEQ ID NO: 1081329 - protein, 9 aa, Homo Sapiens
TIPSLRKSF

SEQ ID NO: 1081330 - protein, 9 aa, Homo Sapiens
QQSLALLPR

SEQ ID NO: 1081331 - protein, 9 aa, Homo Sapiens
LFLRYILDW

SEQ ID NO: 1081332 - protein, 9 aa, Homo Sapiens
IYFKNVHLQ

SEQ ID NO: 1081333 - protein, 9 aa, Homo Sapiens
SNYPIVLGP

SEQ ID NO: 1081334 - protein, 9 aa, Homo Sapiens
ACPHEKHLA

SEQ ID NO: 1081335 - protein, 9 aa, Homo Sapiens
WLGVLFLPL

SEQ ID NO: 1081336 - protein, 9 aa, Homo Sapiens
QMRKEVLEK

SEQ ID NO: 1081337 - protein, 9 aa, Homo Sapiens
FFLENGIEQ

SEQ ID NO: 1081338 - protein, 9 aa, Homo Sapiens
MAAGYLPFF

SEQ ID NO: 1081339 - protein, 9 aa, Homo Sapiens
IGFENIAPT

SEQ ID NO: 1081340 - protein, 9 aa, Homo Sapiens
NSRPCERPA

SEQ ID NO: 1081341 - protein, 9 aa, Homo Sapiens
GAGGSSLSH

SEQ ID NO: 1081342 - protein, 9 aa, Homo Sapiens
VTAVSALGL

SEQ ID NO: 1081343 - protein, 9 aa, Homo Sapiens
LHECNSSYI

SEQ ID NO: 1081344 - protein, 9 aa, Homo Sapiens
SPQHLLPVS

SEQ ID NO: 1081345 - protein, 9 aa, Homo Sapiens
NCVRMFGPD

SEQ ID NO: 1081346 - protein, 9 aa, Homo Sapiens
LPVDKGGSL

SEQ ID NO: 1081347 - protein, 9 aa, Homo Sapiens
HGYNFWIDA

SEQ ID NO: 1081348 - protein, 9 aa, Homo Sapiens
TTNSTAKRQ

SEQ ID NO: 1081349 - protein, 9 aa, Homo Sapiens
ITDVLIEIK

SEQ ID NO: 1081350 - protein, 9 aa, Homo Sapiens
PWGAPQEDM

SEQ ID NO: 1081351 - protein, 9 aa, Homo Sapiens
MSSKEAGLD

SEQ ID NO: 1081352 - protein, 9 aa, Homo Sapiens
VLALVQDVG

SEQ ID NO: 1081353 - protein, 9 aa, Homo Sapiens
FSWWLVNTA

SEQ ID NO: 1081354 - protein, 9 aa, Homo Sapiens
QKKIRNVDQ

SEQ ID NO: 1081355 - protein, 9 aa, Homo Sapiens
CCTLDYSKR

SEQ ID NO: 1081356 - protein, 9 aa, Homo Sapiens
FISLLTEEK

SEQ ID NO: 1081357 - protein, 9 aa, Homo Sapiens
TKRPLNEQQ

SEQ ID NO: 1081358 - protein, 9 aa, Homo Sapiens
FQENRSSAA

SEQ ID NO: 1081359 - protein, 9 aa, Homo Sapiens
YKCNEGGKA

SEQ ID NO: 1081360 - protein, 9 aa, Homo Sapiens
KNIRKKTDA

SEQ ID NO: 1081361 - protein, 9 aa, Homo Sapiens
PAAWGEIQN

SEQ ID NO: 1081362 - protein, 9 aa, Homo Sapiens
LGADAVPTL

SEQ ID NO: 1081363 - protein, 9 aa, Homo Sapiens
SLNATSQVA

SEQ ID NO: 1081364 - protein, 9 aa, Homo Sapiens
TRALDKTDA

SEQ ID NO: 1081365 - protein, 9 aa, Homo Sapiens
AEKPNKCNE

SEQ ID NO: 1081366 - protein, 9 aa, Homo Sapiens
RQPLIEGPR

SEQ ID NO: 1081367 - protein, 9 aa, Homo Sapiens
LVKKGFNLP

SEQ ID NO: 1081368 - protein, 9 aa, Homo Sapiens
PKLANAHNV

SEQ ID NO: 1081369 - protein, 9 aa, Homo Sapiens
DAQKEIVSA

SEQ ID NO: 1081370 - protein, 9 aa, Homo Sapiens
GTEILLAVT

SEQ ID NO: 1081371 - protein, 9 aa, Homo Sapiens
FISFRFASG

SEQ ID NO: 1081372 - protein, 9 aa, Homo Sapiens
APTAAEQRK

SEQ ID NO: 1081373 - protein, 9 aa, Homo Sapiens
PPLSSSMSL

SEQ ID NO: 1081374 - protein, 9 aa, Homo Sapiens
RLSHPNNLR

SEQ ID NO: 1081375 - protein, 9 aa, Homo Sapiens
TERHKAFST

SEQ ID NO: 1081376 - protein, 9 aa, Homo Sapiens
ALTQIVALS

SEQ ID NO: 1081377 - protein, 9 aa, Homo Sapiens
QDDECISMM

SEQ ID NO: 1081378 - protein, 9 aa, Homo Sapiens
SSLFFFTSP

SEQ ID NO: 1081379 - protein, 9 aa, Homo Sapiens
VYRPQFCLS

SEQ ID NO: 1081380 - protein, 9 aa, Homo Sapiens
HSQFSDTIV

SEQ ID NO: 1081381 - protein, 9 aa, Homo Sapiens
MVEIEFFRA

SEQ ID NO: 1081382 - protein, 9 aa, Homo Sapiens
YYQEGGGRY

SEQ ID NO: 1081383 - protein, 9 aa, Homo Sapiens
AFKLTMQAH

SEQ ID NO: 1081384 - protein, 9 aa, Homo Sapiens
IQDALPKDH

SEQ ID NO: 1081385 - protein, 9 aa, Homo Sapiens
YSKTNTSFT

SEQ ID NO: 1081386 - protein, 9 aa, Homo Sapiens
EAEAVFWAI

SEQ ID NO: 1081387 - protein, 9 aa, Homo Sapiens
CKSPPQEST

SEQ ID NO: 1081388 - protein, 9 aa, Homo Sapiens
PPGLLDTVP

SEQ ID NO: 1081389 - protein, 9 aa, Homo Sapiens
LEAGGGTVP

SEQ ID NO: 1081390 - protein, 9 aa, Homo Sapiens
FHSPGKLVV

SEQ ID NO: 1081391 - protein, 9 aa, Homo Sapiens
LEVVSQDDS

SEQ ID NO: 1081392 - protein, 9 aa, Homo Sapiens
RNFLREASI

SEQ ID NO: 1081393 - protein, 9 aa, Homo Sapiens
STQSDTFFL

SEQ ID NO: 1081394 - protein, 9 aa, Homo Sapiens
DFGGPEREL

SEQ ID NO: 1081395 - protein, 9 aa, Homo Sapiens
SFCSLQGDF

SEQ ID NO: 1081396 - protein, 9 aa, Homo Sapiens
IVENVGSMI

SEQ ID NO: 1081397 - protein, 9 aa, Homo Sapiens
LEDNDDCQI

SEQ ID NO: 1081398 - protein, 9 aa, Homo Sapiens
DSKLYISLE

SEQ ID NO: 1081399 - protein, 9 aa, Homo Sapiens
LQSVLGGRS

SEQ ID NO: 1081400 - protein, 9 aa, Homo Sapiens
WTPDTFFYN

SEQ ID NO: 1081401 - protein, 9 aa, Homo Sapiens
TINLNSACS

SEQ ID NO: 1081402 - protein, 9 aa, Homo Sapiens
IKAAKASRK

SEQ ID NO: 1081403 - protein, 9 aa, Homo Sapiens
EEFTYNSFM

SEQ ID NO: 1081404 - protein, 9 aa, Homo Sapiens
SFLKLCYTT

SEQ ID NO: 1081405 - protein, 9 aa, Homo Sapiens
EKIMRPVEV

SEQ ID NO: 1081406 - protein, 9 aa, Homo Sapiens
SGEYIPTVF

SEQ ID NO: 1081407 - protein, 9 aa, Homo Sapiens
NCKFTCHPV

SEQ ID NO: 1081408 - protein, 9 aa, Homo Sapiens
EVEPDDEEK

SEQ ID NO: 1081409 - protein, 9 aa, Homo Sapiens
YLPFFADQP

SEQ ID NO: 1081410 - protein, 9 aa, Homo Sapiens
DCQYSTSYP

SEQ ID NO: 1081411 - protein, 9 aa, Homo Sapiens
VCKTRMVLL

SEQ ID NO: 1081412 - protein, 9 aa, Homo Sapiens
STDAFKPGV

SEQ ID NO: 1081413 - protein, 9 aa, Homo Sapiens
IYIYMCLLW

SEQ ID NO: 1081414 - protein, 9 aa, Homo Sapiens
SLYALHLQN

SEQ ID NO: 1081415 - protein, 9 aa, Homo Sapiens
IRTEPSLGV

SEQ ID NO: 1081416 - protein, 9 aa, Homo Sapiens
PMKKGPCQT

SEQ ID NO: 1081417 - protein, 9 aa, Homo Sapiens
KKNKSFEMS

SEQ ID NO: 1081418 - protein, 9 aa, Homo Sapiens
QYIAIALNG

SEQ ID NO: 1081419 - protein, 9 aa, Homo Sapiens
IKILNERPE

SEQ ID NO: 1081420 - protein, 9 aa, Homo Sapiens
TCTPIFSTG

SEQ ID NO: 1081421 - protein, 9 aa, Homo Sapiens
AVLMQELMT

SEQ ID NO: 1081422 - protein, 9 aa, Homo Sapiens
DTARSNSEA

SEQ ID NO: 1081423 - protein, 9 aa, Homo Sapiens
QRLHSGEQM

SEQ ID NO: 1081424 - protein, 9 aa, Homo Sapiens
GTLGSLEVK

SEQ ID NO: 1081425 - protein, 9 aa, Homo Sapiens
RPATRVRPE

SEQ ID NO: 1081426 - protein, 9 aa, Homo Sapiens
SGEFTVFAE

SEQ ID NO: 1081427 - protein, 9 aa, Homo Sapiens
PGSRHSCIC

SEQ ID NO: 1081428 - protein, 9 aa, Homo Sapiens
QALLPPAEP

SEQ ID NO: 1081429 - protein, 9 aa, Homo Sapiens
GYKSTQVSG

SEQ ID NO: 1081430 - protein, 9 aa, Homo Sapiens
TGAAPPQPL

SEQ ID NO: 1081431 - protein, 9 aa, Homo Sapiens
HPEGLAEFQ

SEQ ID NO: 1081432 - protein, 9 aa, Homo Sapiens
ALGLGHSQY

SEQ ID NO: 1081433 - protein, 9 aa, Homo Sapiens
KKSPLLWDT

SEQ ID NO: 1081434 - protein, 9 aa, Homo Sapiens
DRWGEASSL

SEQ ID NO: 1081435 - protein, 9 aa, Homo Sapiens
GVNFLQSYQ

SEQ ID NO: 1081436 - protein, 9 aa, Homo Sapiens
LQSESWVLV

SEQ ID NO: 1081437 - protein, 9 aa, Homo Sapiens
KKEERQEAL

SEQ ID NO: 1081438 - protein, 9 aa, Homo Sapiens
RALAQDARY

SEQ ID NO: 1081439 - protein, 9 aa, Homo Sapiens
TPIFSTGSI

SEQ ID NO: 1081440 - protein, 9 aa, Homo Sapiens
GNIITDVLI

SEQ ID NO: 1081441 - protein, 9 aa, Homo Sapiens
KPQVTWSKA

SEQ ID NO: 1081442 - protein, 9 aa, Homo Sapiens
MGARGNTAA

SEQ ID NO: 1081443 - protein, 9 aa, Homo Sapiens
ILTDIEERV

SEQ ID NO: 1081444 - protein, 9 aa, Homo Sapiens
EACLTPCPA

SEQ ID NO: 1081445 - protein, 9 aa, Homo Sapiens
VNIVSHGKN

SEQ ID NO: 1081446 - protein, 9 aa, Homo Sapiens
AFRHPFLAK

SEQ ID NO: 1081447 - protein, 9 aa, Homo Sapiens
KHRKFEAKK

SEQ ID NO: 1081448 - protein, 9 aa, Homo Sapiens
EDNYPDLSD

SEQ ID NO: 1081449 - protein, 9 aa, Homo Sapiens
FETHCTLLS

SEQ ID NO: 1081450 - protein, 9 aa, Homo Sapiens
SQYSQALMA

SEQ ID NO: 1081451 - protein, 9 aa, Homo Sapiens
MNSLFSVSL

SEQ ID NO: 1081452 - protein, 9 aa, Homo Sapiens
QRKIIFHLK

SEQ ID NO: 1081453 - protein, 9 aa, Homo Sapiens
NSQDKLRRH

SEQ ID NO: 1081454 - protein, 9 aa, Homo Sapiens
PCPSLGGDG

SEQ ID NO: 1081455 - protein, 9 aa, Homo Sapiens
NDASSSLAS

SEQ ID NO: 1081456 - protein, 9 aa, Homo Sapiens
DLTVTSRRL

SEQ ID NO: 1081457 - protein, 9 aa, Homo Sapiens
SSEKIAIPG

SEQ ID NO: 1081458 - protein, 9 aa, Homo Sapiens
KTSSLDGAA

SEQ ID NO: 1081459 - protein, 9 aa, Homo Sapiens
KPTLQLKKK

SEQ ID NO: 1081460 - protein, 9 aa, Homo Sapiens
EARQRGFRY

SEQ ID NO: 1081461 - protein, 9 aa, Homo Sapiens
GMSSFAYVK

SEQ ID NO: 1081462 - protein, 9 aa, Homo Sapiens
EKLDYRKQA

SEQ ID NO: 1081463 - protein, 9 aa, Homo Sapiens
TGNSHSQNI

SEQ ID NO: 1081464 - protein, 9 aa, Homo Sapiens
LKISKTQLY

SEQ ID NO: 1081465 - protein, 9 aa, Homo Sapiens
LVNYYIDPA

SEQ ID NO: 1081466 - protein, 9 aa, Homo Sapiens
SKNAPKITL

SEQ ID NO: 1081467 - protein, 9 aa, Homo Sapiens
INWYIKGVD

SEQ ID NO: 1081468 - protein, 9 aa, Homo Sapiens
TRGWKKKMV

SEQ ID NO: 1081469 - protein, 9 aa, Homo Sapiens
DFYNKKMDS

SEQ ID NO: 1081470 - protein, 9 aa, Homo Sapiens
SNKAYRHGI

SEQ ID NO: 1081471 - protein, 9 aa, Homo Sapiens
KQSNHTFSS

SEQ ID NO: 1081472 - protein, 9 aa, Homo Sapiens
FMPDNINPC

SEQ ID NO: 1081473 - protein, 9 aa, Homo Sapiens
RGPSGAIGP

SEQ ID NO: 1081474 - protein, 9 aa, Homo Sapiens
QEKMIREQE

SEQ ID NO: 1081475 - protein, 9 aa, Homo Sapiens
MAYSFQSPL

SEQ ID NO: 1081476 - protein, 9 aa, Homo Sapiens
ILLITYLGR

SEQ ID NO: 1081477 - protein, 9 aa, Homo Sapiens
LMTMKEEMA

SEQ ID NO: 1081478 - protein, 9 aa, Homo Sapiens
GKNCITIHS

SEQ ID NO: 1081479 - protein, 9 aa, Homo Sapiens
TAMQMTPFS

SEQ ID NO: 1081480 - protein, 9 aa, Homo Sapiens
PSNDASSSL

SEQ ID NO: 1081481 - protein, 9 aa, Homo Sapiens
HRGLICAYE

SEQ ID NO: 1081482 - protein, 9 aa, Homo Sapiens
NISKQWSNV

SEQ ID NO: 1081483 - protein, 9 aa, Homo Sapiens
EGYCPRCQK

SEQ ID NO: 1081484 - protein, 9 aa, Homo Sapiens
RQQTRLLWK

SEQ ID NO: 1081485 - protein, 9 aa, Homo Sapiens
KSHLFFTPV

SEQ ID NO: 1081486 - protein, 9 aa, Homo Sapiens
LLEQCMQDS

SEQ ID NO: 1081487 - protein, 9 aa, Homo Sapiens
QMIWIESMW

SEQ ID NO: 1081488 - protein, 9 aa, Homo Sapiens
ASQYAHLCP

SEQ ID NO: 1081489 - protein, 9 aa, Homo Sapiens
RTASVRGEW

SEQ ID NO: 1081490 - protein, 9 aa, Homo Sapiens
EGMGIILRI

SEQ ID NO: 1081491 - protein, 9 aa, Homo Sapiens
KKKLEAELA

SEQ ID NO: 1081492 - protein, 9 aa, Homo Sapiens
THVLPQTYL

SEQ ID NO: 1081493 - protein, 9 aa, Homo Sapiens
RVRRSPAFN

SEQ ID NO: 1081494 - protein, 9 aa, Homo Sapiens
TGENPEVSF

SEQ ID NO: 1081495 - protein, 9 aa, Homo Sapiens
IARNPHKIP

SEQ ID NO: 1081496 - protein, 9 aa, Homo Sapiens
MNPYTVPEH

SEQ ID NO: 1081497 - protein, 9 aa, Homo Sapiens
NGFRTPSGE

SEQ ID NO: 1081498 - protein, 9 aa, Homo Sapiens
QRIIRGSDA

SEQ ID NO: 1081499 - protein, 9 aa, Homo Sapiens
KDCDASPSK

SEQ ID NO: 1081500 - protein, 9 aa, Homo Sapiens
VFGSVFLFA

SEQ ID NO: 1081501 - protein, 9 aa, Homo Sapiens
LQFQVSARN

SEQ ID NO: 1081502 - protein, 9 aa, Homo Sapiens
NSMNSLFSV

SEQ ID NO: 1081503 - protein, 9 aa, Homo Sapiens
LTTRTKCAN

SEQ ID NO: 1081504 - protein, 9 aa, Homo Sapiens
VKSSHSMTM

SEQ ID NO: 1081505 - protein, 9 aa, Homo Sapiens
NWHTGTIFY

SEQ ID NO: 1081506 - protein, 9 aa, Homo Sapiens
PRPRLRRPR

SEQ ID NO: 1081507 - protein, 9 aa, Homo Sapiens
VAVKGPVQK

SEQ ID NO: 1081508 - protein, 9 aa, Homo Sapiens
QMYLPFCGT

SEQ ID NO: 1081509 - protein, 9 aa, Homo Sapiens
YNGRALEEN

SEQ ID NO: 1081510 - protein, 9 aa, Homo Sapiens
CPSLGGDGR

SEQ ID NO: 1081511 - protein, 9 aa, Homo Sapiens
AGQFKTALE

SEQ ID NO: 1081512 - protein, 9 aa, Homo Sapiens
QPGHTHLYN

SEQ ID NO: 1081513 - protein, 9 aa, Homo Sapiens
TILADSSSS

SEQ ID NO: 1081514 - protein, 9 aa, Homo Sapiens
ESMYSVRLF

SEQ ID NO: 1081515 - protein, 9 aa, Homo Sapiens
YFKNVHLQY

SEQ ID NO: 1081516 - protein, 9 aa, Homo Sapiens
SSEASYGEV

SEQ ID NO: 1081517 - protein, 9 aa, Homo Sapiens
MDCKSSKRA

SEQ ID NO: 1081518 - protein, 9 aa, Homo Sapiens
VDWFNALCA

SEQ ID NO: 1081519 - protein, 9 aa, Homo Sapiens
YTEICLVNG

SEQ ID NO: 1081520 - protein, 9 aa, Homo Sapiens
RTTAQWFLH

SEQ ID NO: 1081521 - protein, 9 aa, Homo Sapiens
CFMEIKSFH

SEQ ID NO: 1081522 - protein, 9 aa, Homo Sapiens
QNSNITQIP

SEQ ID NO: 1081523 - protein, 9 aa, Homo Sapiens
FLLGSRRGR

SEQ ID NO: 1081524 - protein, 9 aa, Homo Sapiens
LAFWNEGYI

SEQ ID NO: 1081525 - protein, 9 aa, Homo Sapiens
TYKIIRHKD

SEQ ID NO: 1081526 - protein, 9 aa, Homo Sapiens
SKKKNKSFE

SEQ ID NO: 1081527 - protein, 9 aa, Homo Sapiens
QFNEKSSVV

SEQ ID NO: 1081528 - protein, 9 aa, Homo Sapiens
LGGSAAAVS

SEQ ID NO: 1081529 - protein, 9 aa, Homo Sapiens
FLLSRVLLS

SEQ ID NO: 1081530 - protein, 9 aa, Homo Sapiens
YKQEFSESH

SEQ ID NO: 1081531 - protein, 9 aa, Homo Sapiens
QCVTVHTEK

SEQ ID NO: 1081532 - protein, 9 aa, Homo Sapiens
GMGVVFSLT

SEQ ID NO: 1081533 - protein, 9 aa, Homo Sapiens
DEGTDARNV

SEQ ID NO: 1081534 - protein, 9 aa, Homo Sapiens
TDQEKKIED

SEQ ID NO: 1081535 - protein, 9 aa, Homo Sapiens
CADGQCLLN

SEQ ID NO: 1081536 - protein, 9 aa, Homo Sapiens
RPEVTWYKN

SEQ ID NO: 1081537 - protein, 9 aa, Homo Sapiens
ALFQVNHKN

SEQ ID NO: 1081538 - protein, 9 aa, Homo Sapiens
VSQDDSTWW

SEQ ID NO: 1081539 - protein, 9 aa, Homo Sapiens
LQHVAQMEQ

SEQ ID NO: 1081540 - protein, 9 aa, Homo Sapiens
SFRVPYNPG

SEQ ID NO: 1081541 - protein, 9 aa, Homo Sapiens
KKEKLNSED

SEQ ID NO: 1081542 - protein, 9 aa, Homo Sapiens
FVSSHSPLS

SEQ ID NO: 1081543 - protein, 9 aa, Homo Sapiens
LEENIWRLL

SEQ ID NO: 1081544 - protein, 9 aa, Homo Sapiens
QNWELREEL

SEQ ID NO: 1081545 - protein, 9 aa, Homo Sapiens
AIKAPMFFW

SEQ ID NO: 1081546 - protein, 9 aa, Homo Sapiens
RILAEKIAK

SEQ ID NO: 1081547 - protein, 9 aa, Homo Sapiens
LRLQNSTTW

SEQ ID NO: 1081548 - protein, 9 aa, Homo Sapiens
PLRKLGQVV

SEQ ID NO: 1081549 - protein, 9 aa, Homo Sapiens
KEEGGPGLV

SEQ ID NO: 1081550 - protein, 9 aa, Homo Sapiens
ATFRGVAGA

SEQ ID NO: 1081551 - protein, 9 aa, Homo Sapiens
GFSGPEGPS

SEQ ID NO: 1081552 - protein, 9 aa, Homo Sapiens
IPQREKVEM

SEQ ID NO: 1081553 - protein, 9 aa, Homo Sapiens
AGQKDQLCF

SEQ ID NO: 1081554 - protein, 9 aa, Homo Sapiens
AVKSINEAR

SEQ ID NO: 1081555 - protein, 9 aa, Homo Sapiens
LEERVRRSP

SEQ ID NO: 1081556 - protein, 9 aa, Homo Sapiens
FLYSLSALM

SEQ ID NO: 1081557 - protein, 9 aa, Homo Sapiens
VKAESFNLL

SEQ ID NO: 1081558 - protein, 9 aa, Homo Sapiens
ENVGSMISN

SEQ ID NO: 1081559 - protein, 9 aa, Homo Sapiens
KQPATLLTV

SEQ ID NO: 1081560 - protein, 9 aa, Homo Sapiens
VNPVLNQLQ

SEQ ID NO: 1081561 - protein, 9 aa, Homo Sapiens
KAVRWGNQL

SEQ ID NO: 1081562 - protein, 9 aa, Homo Sapiens
LSLRRLFPT

SEQ ID NO: 1081563 - protein, 9 aa, Homo Sapiens
FKNCRAKCR

SEQ ID NO: 1081564 - protein, 9 aa, Homo Sapiens
FSLVSVNIE

SEQ ID NO: 1081565 - protein, 9 aa, Homo Sapiens
LSQESEVEK

SEQ ID NO: 1081566 - protein, 9 aa, Homo Sapiens
TLKRQRKLA

SEQ ID NO: 1081567 - protein, 9 aa, Homo Sapiens
LRPGPGPGP

SEQ ID NO: 1081568 - protein, 9 aa, Homo Sapiens
LGENNKKKM

SEQ ID NO: 1081569 - protein, 9 aa, Homo Sapiens
MGGPSRRSA

SEQ ID NO: 1081570 - protein, 9 aa, Homo Sapiens
SATYEKSCQ

SEQ ID NO: 1081571 - protein, 9 aa, Homo Sapiens
TAPAPRPRL

SEQ ID NO: 1081572 - protein, 9 aa, Homo Sapiens
SSSRPLTRA

SEQ ID NO: 1081573 - protein, 9 aa, Homo Sapiens
LFVEKFSID

SEQ ID NO: 1081574 - protein, 9 aa, Homo Sapiens
EEGGKGEKE

SEQ ID NO: 1081575 - protein, 9 aa, Homo Sapiens
SARDGVYVS

SEQ ID NO: 1081576 - protein, 9 aa, Homo Sapiens
PLINKRIYT

SEQ ID NO: 1081577 - protein, 9 aa, Homo Sapiens
VTYPEGRPT

SEQ ID NO: 1081578 - protein, 9 aa, Homo Sapiens
KLCFHQRIH

SEQ ID NO: 1081579 - protein, 9 aa, Homo Sapiens
LQTPGPPPS

SEQ ID NO: 1081580 - protein, 9 aa, Homo Sapiens
FPLEIKKKN

SEQ ID NO: 1081581 - protein, 9 aa, Homo Sapiens
LMSHVARQI

SEQ ID NO: 1081582 - protein, 9 aa, Homo Sapiens
SHTFGKFYY

SEQ ID NO: 1081583 - protein, 9 aa, Homo Sapiens
GQTPPEDNY

SEQ ID NO: 1081584 - protein, 9 aa, Homo Sapiens
LLKSRARAL

SEQ ID NO: 1081585 - protein, 9 aa, Homo Sapiens
DGADGKLPS

SEQ ID NO: 1081586 - protein, 9 aa, Homo Sapiens
HDRKNGCSS

SEQ ID NO: 1081587 - protein, 9 aa, Homo Sapiens
EDDQAQFDA

SEQ ID NO: 1081588 - protein, 9 aa, Homo Sapiens
PPWREKYKG

SEQ ID NO: 1081589 - protein, 9 aa, Homo Sapiens
GIVADCAVV

SEQ ID NO: 1081590 - protein, 9 aa, Homo Sapiens
FPSSLDYQY

SEQ ID NO: 1081591 - protein, 9 aa, Homo Sapiens
KSDSGTYDC

SEQ ID NO: 1081592 - protein, 9 aa, Homo Sapiens
SFEKSNIGI

SEQ ID NO: 1081593 - protein, 9 aa, Homo Sapiens
IFSFKKLVN

SEQ ID NO: 1081594 - protein, 9 aa, Homo Sapiens
SQESQGASP

SEQ ID NO: 1081595 - protein, 9 aa, Homo Sapiens
AQLNGCRAF

SEQ ID NO: 1081596 - protein, 9 aa, Homo Sapiens
YQEGGGRYH

SEQ ID NO: 1081597 - protein, 9 aa, Homo Sapiens
EHSQRLNSH

SEQ ID NO: 1081598 - protein, 9 aa, Homo Sapiens
CGWALPHNW

SEQ ID NO: 1081599 - protein, 9 aa, Homo Sapiens
RYERTLSDC

SEQ ID NO: 1081600 - protein, 9 aa, Homo Sapiens
CFQFKAKLA

SEQ ID NO: 1081601 - protein, 9 aa, Homo Sapiens
KENDTDEEN

SEQ ID NO: 1081602 - protein, 9 aa, Homo Sapiens
IPKTAENFC

SEQ ID NO: 1081603 - protein, 9 aa, Homo Sapiens
WYGNSSETS

SEQ ID NO: 1081604 - protein, 9 aa, Homo Sapiens
ETFKKAVKA

SEQ ID NO: 1081605 - protein, 9 aa, Homo Sapiens
CWYQTPTKP

SEQ ID NO: 1081606 - protein, 9 aa, Homo Sapiens
FNISSMLTK

SEQ ID NO: 1081607 - protein, 9 aa, Homo Sapiens
ANKHFEIAI

SEQ ID NO: 1081608 - protein, 9 aa, Homo Sapiens
KYSSVPFGS

SEQ ID NO: 1081609 - protein, 9 aa, Homo Sapiens
SGRGPPSMC

SEQ ID NO: 1081610 - protein, 9 aa, Homo Sapiens
KIALHTNRQ

SEQ ID NO: 1081611 - protein, 9 aa, Homo Sapiens
LSQMGSPAE

SEQ ID NO: 1081612 - protein, 9 aa, Homo Sapiens
HSLSPESVC

SEQ ID NO: 1081613 - protein, 9 aa, Homo Sapiens
VNGHSKFTG

SEQ ID NO: 1081614 - protein, 9 aa, Homo Sapiens
FYRSFEYIQ

SEQ ID NO: 1081615 - protein, 9 aa, Homo Sapiens
FFLDCTIRG

SEQ ID NO: 1081616 - protein, 9 aa, Homo Sapiens
ENLNLLVVL

SEQ ID NO: 1081617 - protein, 9 aa, Homo Sapiens
KDPDAQKKK

SEQ ID NO: 1081618 - protein, 9 aa, Homo Sapiens
EALSKLDML

SEQ ID NO: 1081619 - protein, 9 aa, Homo Sapiens
KSYSLERDQ

SEQ ID NO: 1081620 - protein, 9 aa, Homo Sapiens
LKELSKTWI

SEQ ID NO: 1081621 - protein, 9 aa, Homo Sapiens
MLWEKMEYS

SEQ ID NO: 1081622 - protein, 9 aa, Homo Sapiens
NTVPCRKQS

SEQ ID NO: 1081623 - protein, 9 aa, Homo Sapiens
ELNEEIGEL

SEQ ID NO: 1081624 - protein, 9 aa, Homo Sapiens
SDFLTDSES

SEQ ID NO: 1081625 - protein, 9 aa, Homo Sapiens
IGFSYPVVS

SEQ ID NO: 1081626 - protein, 9 aa, Homo Sapiens
EIMVKIIES

SEQ ID NO: 1081627 - protein, 9 aa, Homo Sapiens
TILSVDELK

SEQ ID NO: 1081628 - protein, 9 aa, Homo Sapiens
RITHSPIVS

SEQ ID NO: 1081629 - protein, 9 aa, Homo Sapiens
STVFRICVF

SEQ ID NO: 1081630 - protein, 9 aa, Homo Sapiens
PVSLPWRAE

SEQ ID NO: 1081631 - protein, 9 aa, Homo Sapiens
HMFLTSLFS

SEQ ID NO: 1081632 - protein, 9 aa, Homo Sapiens
MSLPFLFNI

SEQ ID NO: 1081633 - protein, 9 aa, Homo Sapiens
ALQGDGLLP

SEQ ID NO: 1081634 - protein, 9 aa, Homo Sapiens
RAPTAAEQR

SEQ ID NO: 1081635 - protein, 9 aa, Homo Sapiens
ITYGALFCE

SEQ ID NO: 1081636 - protein, 9 aa, Homo Sapiens
EDTESYLQT

SEQ ID NO: 1081637 - protein, 9 aa, Homo Sapiens
NKTLKAWRE

SEQ ID NO: 1081638 - protein, 9 aa, Homo Sapiens
ELKCADINR

SEQ ID NO: 1081639 - protein, 9 aa, Homo Sapiens
AYPDQITQN

SEQ ID NO: 1081640 - protein, 9 aa, Homo Sapiens
WRTLKKPQE

SEQ ID NO: 1081641 - protein, 9 aa, Homo Sapiens
KVVILEDNW

SEQ ID NO: 1081642 - protein, 9 aa, Homo Sapiens
NNLHRHSEK

SEQ ID NO: 1081643 - protein, 9 aa, Homo Sapiens
RVDSVSSAA

SEQ ID NO: 1081644 - protein, 9 aa, Homo Sapiens
HLVYRILEE

SEQ ID NO: 1081645 - protein, 9 aa, Homo Sapiens
FTDLNDSKR

SEQ ID NO: 1081646 - protein, 9 aa, Homo Sapiens
ETYDEPPQP

SEQ ID NO: 1081647 - protein, 9 aa, Homo Sapiens
PSGRELTKE

SEQ ID NO: 1081648 - protein, 9 aa, Homo Sapiens
GHAPGRDKA

SEQ ID NO: 1081649 - protein, 9 aa, Homo Sapiens
NQGKGIRVF

SEQ ID NO: 1081650 - protein, 9 aa, Homo Sapiens
CTPPFCCQL

SEQ ID NO: 1081651 - protein, 9 aa, Homo Sapiens
QPPGNIFLP

SEQ ID NO: 1081652 - protein, 9 aa, Homo Sapiens
ALSTLSGEI

SEQ ID NO: 1081653 - protein, 9 aa, Homo Sapiens
EYYRGQNNL

SEQ ID NO: 1081654 - protein, 9 aa, Homo Sapiens
KQSHSSMER

SEQ ID NO: 1081655 - protein, 9 aa, Homo Sapiens
NTKQGQTNP

SEQ ID NO: 1081656 - protein, 9 aa, Homo Sapiens
KAGFAGDDV

SEQ ID NO: 1081657 - protein, 9 aa, Homo Sapiens
ALLAKEPLE

SEQ ID NO: 1081658 - protein, 9 aa, Homo Sapiens
QREKRRTCT

SEQ ID NO: 1081659 - protein, 9 aa, Homo Sapiens
IKYHISQPI

SEQ ID NO: 1081660 - protein, 9 aa, Homo Sapiens
RQQSSSSKE

SEQ ID NO: 1081661 - protein, 9 aa, Homo Sapiens
YSPSFQVQV

SEQ ID NO: 1081662 - protein, 9 aa, Homo Sapiens
HFEIAIDLE

SEQ ID NO: 1081663 - protein, 9 aa, Homo Sapiens
GPKSIISLA

SEQ ID NO: 1081664 - protein, 9 aa, Homo Sapiens
FLTMVAVDR

SEQ ID NO: 1081665 - protein, 9 aa, Homo Sapiens
VSTWLAVSL

SEQ ID NO: 1081666 - protein, 9 aa, Homo Sapiens
DGSQEQKPE

SEQ ID NO: 1081667 - protein, 9 aa, Homo Sapiens
SRPLTRARG

SEQ ID NO: 1081668 - protein, 9 aa, Homo Sapiens
IQVLYGFLT

SEQ ID NO: 1081669 - protein, 9 aa, Homo Sapiens
MYLKPQSKE

SEQ ID NO: 1081670 - protein, 9 aa, Homo Sapiens
FPFRGFREI

SEQ ID NO: 1081671 - protein, 9 aa, Homo Sapiens
GEKVLDLIV

SEQ ID NO: 1081672 - protein, 9 aa, Homo Sapiens
SQIRQIYYT

SEQ ID NO: 1081673 - protein, 9 aa, Homo Sapiens
SKGSTALTS

SEQ ID NO: 1081674 - protein, 9 aa, Homo Sapiens
GPSLVSGPA

SEQ ID NO: 1081675 - protein, 9 aa, Homo Sapiens
RVQERLATA

SEQ ID NO: 1081676 - protein, 9 aa, Homo Sapiens
PEVVKPLRN

SEQ ID NO: 1081677 - protein, 9 aa, Homo Sapiens
KRDRNFTSF

SEQ ID NO: 1081678 - protein, 9 aa, Homo Sapiens
SPAFCLDPE

SEQ ID NO: 1081679 - protein, 9 aa, Homo Sapiens
AALSAHSFV

SEQ ID NO: 1081680 - protein, 9 aa, Homo Sapiens
AVEVPAFAF

SEQ ID NO: 1081681 - protein, 9 aa, Homo Sapiens
GRAQENLNL

SEQ ID NO: 1081682 - protein, 9 aa, Homo Sapiens
NMELPTPQT

SEQ ID NO: 1081683 - protein, 9 aa, Homo Sapiens
EEASRGIKK

SEQ ID NO: 1081684 - protein, 9 aa, Homo Sapiens
LPWVKSSHS

SEQ ID NO: 1081685 - protein, 9 aa, Homo Sapiens
IFFRFIGVI

SEQ ID NO: 1081686 - protein, 9 aa, Homo Sapiens
TDVNLEAEN

SEQ ID NO: 1081687 - protein, 9 aa, Homo Sapiens
DLTSAQKKM

SEQ ID NO: 1081688 - protein, 9 aa, Homo Sapiens
NFGNCQCFS

SEQ ID NO: 1081689 - protein, 9 aa, Homo Sapiens
IKKKLSINH

SEQ ID NO: 1081690 - protein, 9 aa, Homo Sapiens
THHDRKNGC

SEQ ID NO: 1081691 - protein, 9 aa, Homo Sapiens
GAHLVPTFP

SEQ ID NO: 1081692 - protein, 9 aa, Homo Sapiens
NNSNSLQVK

SEQ ID NO: 1081693 - protein, 9 aa, Homo Sapiens
KQNPSSLLQ

SEQ ID NO: 1081694 - protein, 9 aa, Homo Sapiens
CDNGWNTTA

SEQ ID NO: 1081695 - protein, 9 aa, Homo Sapiens
SIEFFSFSN

SEQ ID NO: 1081696 - protein, 9 aa, Homo Sapiens
NLAERVGEV

SEQ ID NO: 1081697 - protein, 9 aa, Homo Sapiens
QSGEFFFLK

SEQ ID NO: 1081698 - protein, 9 aa, Homo Sapiens
MPMKREPPP

SEQ ID NO: 1081699 - protein, 9 aa, Homo Sapiens
EILLAVTII

SEQ ID NO: 1081700 - protein, 9 aa, Homo Sapiens
GALRISGVV

SEQ ID NO: 1081701 - protein, 9 aa, Homo Sapiens
NRFFAVRPE

SEQ ID NO: 1081702 - protein, 9 aa, Homo Sapiens
CYTPSTVSR

SEQ ID NO: 1081703 - protein, 9 aa, Homo Sapiens
VLMQELMTM

SEQ ID NO: 1081704 - protein, 9 aa, Homo Sapiens
RIRPEFLQG

SEQ ID NO: 1081705 - protein, 9 aa, Homo Sapiens
YHFSFSLDF

SEQ ID NO: 1081706 - protein, 9 aa, Homo Sapiens
VAVNESSFV

SEQ ID NO: 1081707 - protein, 9 aa, Homo Sapiens
STNITAATV

SEQ ID NO: 1081708 - protein, 9 aa, Homo Sapiens
GYFRCQCEP

SEQ ID NO: 1081709 - protein, 9 aa, Homo Sapiens
VFFLLRTLG

SEQ ID NO: 1081710 - protein, 9 aa, Homo Sapiens
LVSTPDNRK

SEQ ID NO: 1081711 - protein, 9 aa, Homo Sapiens
FIMLLNLAY

SEQ ID NO: 1081712 - protein, 9 aa, Homo Sapiens
ACANKGIFT

SEQ ID NO: 1081713 - protein, 9 aa, Homo Sapiens
IDFQLENGY

SEQ ID NO: 1081714 - protein, 9 aa, Homo Sapiens
SFADSCFLT

SEQ ID NO: 1081715 - protein, 9 aa, Homo Sapiens
VKFSGTNFD

SEQ ID NO: 1081716 - protein, 9 aa, Homo Sapiens
LSSSSHAAC

SEQ ID NO: 1081717 - protein, 9 aa, Homo Sapiens
AHALYSGQL

SEQ ID NO: 1081718 - protein, 9 aa, Homo Sapiens
PKVQISEMD

SEQ ID NO: 1081719 - protein, 9 aa, Homo Sapiens
TIDMSVLPD

SEQ ID NO: 1081720 - protein, 9 aa, Homo Sapiens
ATLPRETST

SEQ ID NO: 1081721 - protein, 9 aa, Homo Sapiens
WKLCQDITG

SEQ ID NO: 1081722 - protein, 9 aa, Homo Sapiens
VHKLAESIP

SEQ ID NO: 1081723 - protein, 9 aa, Homo Sapiens
DENWYQGKI

SEQ ID NO: 1081724 - protein, 9 aa, Homo Sapiens
KTDAQPQIV

SEQ ID NO: 1081725 - protein, 9 aa, Homo Sapiens
CYNNTFESL

SEQ ID NO: 1081726 - protein, 9 aa, Homo Sapiens
FLRPYPFGI

SEQ ID NO: 1081727 - protein, 9 aa, Homo Sapiens
ERLEGPFSI

SEQ ID NO: 1081728 - protein, 9 aa, Homo Sapiens
KESATNTNK

SEQ ID NO: 1081729 - protein, 9 aa, Homo Sapiens
LRRVGDSDY

SEQ ID NO: 1081730 - protein, 9 aa, Homo Sapiens
PMFSPIHKS

SEQ ID NO: 1081731 - protein, 9 aa, Homo Sapiens
FCRTPAWEQ

SEQ ID NO: 1081732 - protein, 9 aa, Homo Sapiens
FRDFAWETG

SEQ ID NO: 1081733 - protein, 9 aa, Homo Sapiens
ISNSGHSLI

SEQ ID NO: 1081734 - protein, 9 aa, Homo Sapiens
RPLNEQQKN

SEQ ID NO: 1081735 - protein, 9 aa, Homo Sapiens
LPQTYLSIK

SEQ ID NO: 1081736 - protein, 9 aa, Homo Sapiens
VGDIWWFFT

SEQ ID NO: 1081737 - protein, 9 aa, Homo Sapiens
LPKEDRLET

SEQ ID NO: 1081738 - protein, 9 aa, Homo Sapiens
IGFSGPEGP

SEQ ID NO: 1081739 - protein, 9 aa, Homo Sapiens
EKLKNFNIK

SEQ ID NO: 1081740 - protein, 9 aa, Homo Sapiens
QLFKLSHNE

SEQ ID NO: 1081741 - protein, 9 aa, Homo Sapiens
LKAIRPSCP

SEQ ID NO: 1081742 - protein, 9 aa, Homo Sapiens
PSQFWGQPC

SEQ ID NO: 1081743 - protein, 9 aa, Homo Sapiens
NFLYSPKIE

SEQ ID NO: 1081744 - protein, 9 aa, Homo Sapiens
RILTDIEER

SEQ ID NO: 1081745 - protein, 9 aa, Homo Sapiens
TQAQRFHLP

SEQ ID NO: 1081746 - protein, 9 aa, Homo Sapiens
KAHGPALLT

SEQ ID NO: 1081747 - protein, 9 aa, Homo Sapiens
TFYSLEEQQ

SEQ ID NO: 1081748 - protein, 9 aa, Homo Sapiens
SMCRWACTS

SEQ ID NO: 1081749 - protein, 9 aa, Homo Sapiens
RCVNLPGYF

SEQ ID NO: 1081750 - protein, 9 aa, Homo Sapiens
YQACVLEKQ

SEQ ID NO: 1081751 - protein, 9 aa, Homo Sapiens
CKEGEDEHS

SEQ ID NO: 1081752 - protein, 9 aa, Homo Sapiens
QTPPWREKY

SEQ ID NO: 1081753 - protein, 9 aa, Homo Sapiens
LAILGVPVP

SEQ ID NO: 1081754 - protein, 9 aa, Homo Sapiens
ISTDAFKPG

SEQ ID NO: 1081755 - protein, 9 aa, Homo Sapiens
TSRFSILIK

SEQ ID NO: 1081756 - protein, 9 aa, Homo Sapiens
TDIEERVLI

SEQ ID NO: 1081757 - protein, 9 aa, Homo Sapiens
TILSAKKKY

SEQ ID NO: 1081758 - protein, 9 aa, Homo Sapiens
TQNMCELSS

SEQ ID NO: 1081759 - protein, 9 aa, Homo Sapiens
FGAVYAALE

SEQ ID NO: 1081760 - protein, 9 aa, Homo Sapiens
MNYTLRKDG

SEQ ID NO: 1081761 - protein, 9 aa, Homo Sapiens
IGDQLETIF

SEQ ID NO: 1081762 - protein, 9 aa, Homo Sapiens
PRGCLLSLE

SEQ ID NO: 1081763 - protein, 9 aa, Homo Sapiens
GDDSSVVSL

SEQ ID NO: 1081764 - protein, 9 aa, Homo Sapiens
PSTPLSEDP

SEQ ID NO: 1081765 - protein, 9 aa, Homo Sapiens
LQPPGNIFL

SEQ ID NO: 1081766 - protein, 9 aa, Homo Sapiens
LKEQLVQVV

SEQ ID NO: 1081767 - protein, 9 aa, Homo Sapiens
IDEKSQKKI

SEQ ID NO: 1081768 - protein, 9 aa, Homo Sapiens
GPAYMLNEK

SEQ ID NO: 1081769 - protein, 9 aa, Homo Sapiens
TRIVGDIWW

SEQ ID NO: 1081770 - protein, 9 aa, Homo Sapiens
GDVLPGLIS

SEQ ID NO: 1081771 - protein, 9 aa, Homo Sapiens
RLVLVLELL

SEQ ID NO: 1081772 - protein, 9 aa, Homo Sapiens
KPLSQESQV

SEQ ID NO: 1081773 - protein, 9 aa, Homo Sapiens
SVLVILIFI

SEQ ID NO: 1081774 - protein, 9 aa, Homo Sapiens
SENAAASLT

SEQ ID NO: 1081775 - protein, 9 aa, Homo Sapiens
TEKTSNPSV

SEQ ID NO: 1081776 - protein, 9 aa, Homo Sapiens
SLGDLSEGP

SEQ ID NO: 1081777 - protein, 9 aa, Homo Sapiens
AKHLISSSK

SEQ ID NO: 1081778 - protein, 9 aa, Homo Sapiens
FCITKWKEI

SEQ ID NO: 1081779 - protein, 9 aa, Homo Sapiens
LAEHQKISF

SEQ ID NO: 1081780 - protein, 9 aa, Homo Sapiens
EIQNVAANL

SEQ ID NO: 1081781 - protein, 9 aa, Homo Sapiens
HVFCVLSLL

SEQ ID NO: 1081782 - protein, 9 aa, Homo Sapiens
PPTLLDSSH

SEQ ID NO: 1081783 - protein, 9 aa, Homo Sapiens
EVLKFVFCP

SEQ ID NO: 1081784 - protein, 9 aa, Homo Sapiens
YHSSSDAQV

SEQ ID NO: 1081785 - protein, 9 aa, Homo Sapiens
DSAPHPEGL

SEQ ID NO: 1081786 - protein, 9 aa, Homo Sapiens
ESLWLHAPS

SEQ ID NO: 1081787 - protein, 9 aa, Homo Sapiens
AMVFMGARG

SEQ ID NO: 1081788 - protein, 9 aa, Homo Sapiens
LEQVNHMLN

SEQ ID NO: 1081789 - protein, 9 aa, Homo Sapiens
YSLRVRCAK

SEQ ID NO: 1081790 - protein, 9 aa, Homo Sapiens
THQLKKLLS

SEQ ID NO: 1081791 - protein, 9 aa, Homo Sapiens
RFLKQSHSS

SEQ ID NO: 1081792 - protein, 9 aa, Homo Sapiens
LTSEEKSQR

SEQ ID NO: 1081793 - protein, 9 aa, Homo Sapiens
EVQQTWSHL

SEQ ID NO: 1081794 - protein, 9 aa, Homo Sapiens
FVTYPEGRP

SEQ ID NO: 1081795 - protein, 9 aa, Homo Sapiens
VRPIVGPFY

SEQ ID NO: 1081796 - protein, 9 aa, Homo Sapiens
FNLIPQREK

SEQ ID NO: 1081797 - protein, 9 aa, Homo Sapiens
LLLLFLQSF

SEQ ID NO: 1081798 - protein, 9 aa, Homo Sapiens
YDRTAWVWS

SEQ ID NO: 1081799 - protein, 9 aa, Homo Sapiens
WKKENNLLL

SEQ ID NO: 1081800 - protein, 9 aa, Homo Sapiens
MEIFSPMPR

SEQ ID NO: 1081801 - protein, 9 aa, Homo Sapiens
IYQLVAKLA

SEQ ID NO: 1081802 - protein, 9 aa, Homo Sapiens
RGVRIVSRS

SEQ ID NO: 1081803 - protein, 9 aa, Homo Sapiens
KKKLSINHP

SEQ ID NO: 1081804 - protein, 9 aa, Homo Sapiens
HSTRCRKKD

SEQ ID NO: 1081805 - protein, 9 aa, Homo Sapiens
VCPTQIPVA

SEQ ID NO: 1081806 - protein, 9 aa, Homo Sapiens
EKSAVLLFS

SEQ ID NO: 1081807 - protein, 9 aa, Homo Sapiens
SYDRCAAQF

SEQ ID NO: 1081808 - protein, 9 aa, Homo Sapiens
WGEAMGWVF

SEQ ID NO: 1081809 - protein, 9 aa, Homo Sapiens
EYTGTNPLY

SEQ ID NO: 1081810 - protein, 9 aa, Homo Sapiens
TFTSNLVHP

SEQ ID NO: 1081811 - protein, 9 aa, Homo Sapiens
AHMYQAEFP

SEQ ID NO: 1081812 - protein, 9 aa, Homo Sapiens
RASATAKAG

SEQ ID NO: 1081813 - protein, 9 aa, Homo Sapiens
GPAFQSLWG

SEQ ID NO: 1081814 - protein, 9 aa, Homo Sapiens
PDDEEKSDE

SEQ ID NO: 1081815 - protein, 9 aa, Homo Sapiens
LLGGGTGSG

SEQ ID NO: 1081816 - protein, 9 aa, Homo Sapiens
KLVFGSVFL

SEQ ID NO: 1081817 - protein, 9 aa, Homo Sapiens
FFDGPSLQP

SEQ ID NO: 1081818 - protein, 9 aa, Homo Sapiens
NELNEDKIL

SEQ ID NO: 1081819 - protein, 9 aa, Homo Sapiens
GGGRGSSSS

SEQ ID NO: 1081820 - protein, 9 aa, Homo Sapiens
VHLVYRILE

SEQ ID NO: 1081821 - protein, 9 aa, Homo Sapiens
SWIGVSVSS

SEQ ID NO: 1081822 - protein, 9 aa, Homo Sapiens
GLIFKDGGC

SEQ ID NO: 1081823 - protein, 9 aa, Homo Sapiens
KTHRVLRRL

SEQ ID NO: 1081824 - protein, 9 aa, Homo Sapiens
GGSHDAELL

SEQ ID NO: 1081825 - protein, 9 aa, Homo Sapiens
IGVSVSSPG

SEQ ID NO: 1081826 - protein, 9 aa, Homo Sapiens
GCHVRSFTR

SEQ ID NO: 1081827 - protein, 9 aa, Homo Sapiens
HGRNHHRSH

SEQ ID NO: 1081828 - protein, 9 aa, Homo Sapiens
FYFYVADNN

SEQ ID NO: 1081829 - protein, 9 aa, Homo Sapiens
ENSVMVLLI

SEQ ID NO: 1081830 - protein, 9 aa, Homo Sapiens
HTHLYNNRY

SEQ ID NO: 1081831 - protein, 9 aa, Homo Sapiens
LSAEIFSDI

SEQ ID NO: 1081832 - protein, 9 aa, Homo Sapiens
DLATLPRET

SEQ ID NO: 1081833 - protein, 9 aa, Homo Sapiens
PHSFLLTVM

SEQ ID NO: 1081834 - protein, 9 aa, Homo Sapiens
KDHGTYTCL

SEQ ID NO: 1081835 - protein, 9 aa, Homo Sapiens
CKRLHRIET

SEQ ID NO: 1081836 - protein, 9 aa, Homo Sapiens
PQLLVSLGG

SEQ ID NO: 1081837 - protein, 9 aa, Homo Sapiens
QDFHYGQSE

SEQ ID NO: 1081838 - protein, 9 aa, Homo Sapiens
PDANVTWLR

SEQ ID NO: 1081839 - protein, 9 aa, Homo Sapiens
LLNGRPTRA

SEQ ID NO: 1081840 - protein, 9 aa, Homo Sapiens
YSKSQYKTW

SEQ ID NO: 1081841 - protein, 9 aa, Homo Sapiens
TGTLHQRFI

SEQ ID NO: 1081842 - protein, 9 aa, Homo Sapiens
GCCYRVNNN

SEQ ID NO: 1081843 - protein, 9 aa, Homo Sapiens
FDGWSHGYN

SEQ ID NO: 1081844 - protein, 9 aa, Homo Sapiens
FADSCFLTS

SEQ ID NO: 1081845 - protein, 9 aa, Homo Sapiens
ARNAGVPPL

SEQ ID NO: 1081846 - protein, 9 aa, Homo Sapiens
YGNKITKIV

SEQ ID NO: 1081847 - protein, 9 aa, Homo Sapiens
MAGQKDQLC

SEQ ID NO: 1081848 - protein, 9 aa, Homo Sapiens
KELLAGWQS

SEQ ID NO: 1081849 - protein, 9 aa, Homo Sapiens
CVDVRLKPC

SEQ ID NO: 1081850 - protein, 9 aa, Homo Sapiens
SCQTPDDFV

SEQ ID NO: 1081851 - protein, 9 aa, Homo Sapiens
WYQTPTKPS

SEQ ID NO: 1081852 - protein, 9 aa, Homo Sapiens
FGKFYYKFF

SEQ ID NO: 1081853 - protein, 9 aa, Homo Sapiens
NEVKEVLQA

SEQ ID NO: 1081854 - protein, 9 aa, Homo Sapiens
SFRQFLLGS

SEQ ID NO: 1081855 - protein, 9 aa, Homo Sapiens
VKIVSSKAI

SEQ ID NO: 1081856 - protein, 9 aa, Homo Sapiens
QLMTKHLLA

SEQ ID NO: 1081857 - protein, 9 aa, Homo Sapiens
AEGEMGNAR

SEQ ID NO: 1081858 - protein, 9 aa, Homo Sapiens
FENFKTLHM

SEQ ID NO: 1081859 - protein, 9 aa, Homo Sapiens
FDSPKDNEK

SEQ ID NO: 1081860 - protein, 9 aa, Homo Sapiens
SQVKKGSYP

SEQ ID NO: 1081861 - protein, 9 aa, Homo Sapiens
EKILKNTKE

SEQ ID NO: 1081862 - protein, 9 aa, Homo Sapiens
VNQPASFVV

SEQ ID NO: 1081863 - protein, 9 aa, Homo Sapiens
TDVLRNLFN

SEQ ID NO: 1081864 - protein, 9 aa, Homo Sapiens
PETTYFVTV

SEQ ID NO: 1081865 - protein, 9 aa, Homo Sapiens
WSFGVRLWE

SEQ ID NO: 1081866 - protein, 9 aa, Homo Sapiens
RQISHGRAP

SEQ ID NO: 1081867 - protein, 9 aa, Homo Sapiens
EIKLYVQIP

SEQ ID NO: 1081868 - protein, 9 aa, Homo Sapiens
CGVTFVPDI

SEQ ID NO: 1081869 - protein, 9 aa, Homo Sapiens
HSPILNMKG

SEQ ID NO: 1081870 - protein, 9 aa, Homo Sapiens
PAPRPRLRR

SEQ ID NO: 1081871 - protein, 9 aa, Homo Sapiens
HQRTSSGGG

SEQ ID NO: 1081872 - protein, 9 aa, Homo Sapiens
IVFAAGSPL

SEQ ID NO: 1081873 - protein, 9 aa, Homo Sapiens
IKFILLLQK

SEQ ID NO: 1081874 - protein, 9 aa, Homo Sapiens
KEGEGLEES

SEQ ID NO: 1081875 - protein, 9 aa, Homo Sapiens
EAAKNEVKE

SEQ ID NO: 1081876 - protein, 9 aa, Homo Sapiens
EIFGGQGNS

SEQ ID NO: 1081877 - protein, 9 aa, Homo Sapiens
ELNEDKILH

SEQ ID NO: 1081878 - protein, 9 aa, Homo Sapiens
SSNIIVTNG

SEQ ID NO: 1081879 - protein, 9 aa, Homo Sapiens
IGDCVPNVY

SEQ ID NO: 1081880 - protein, 9 aa, Homo Sapiens
NITLEEKLA

SEQ ID NO: 1081881 - protein, 9 aa, Homo Sapiens
EREDQRFAL

SEQ ID NO: 1081882 - protein, 9 aa, Homo Sapiens
KIAKEIQVI

SEQ ID NO: 1081883 - protein, 9 aa, Homo Sapiens
LAEKIAKEI

SEQ ID NO: 1081884 - protein, 9 aa, Homo Sapiens
FPSTNITAA

SEQ ID NO: 1081885 - protein, 9 aa, Homo Sapiens
SGMQACVEL

SEQ ID NO: 1081886 - protein, 9 aa, Homo Sapiens
ARKRRQSQS

SEQ ID NO: 1081887 - protein, 9 aa, Homo Sapiens
LAVYENARE

SEQ ID NO: 1081888 - protein, 9 aa, Homo Sapiens
KQNALCTPH

SEQ ID NO: 1081889 - protein, 9 aa, Homo Sapiens
QIVVQAFLS

SEQ ID NO: 1081890 - protein, 9 aa, Homo Sapiens
KIRNVDQSL

SEQ ID NO: 1081891 - protein, 9 aa, Homo Sapiens
LSEQKAQKK

SEQ ID NO: 1081892 - protein, 9 aa, Homo Sapiens
KILEDQTSR

SEQ ID NO: 1081893 - protein, 9 aa, Homo Sapiens
LGGSWQLPA

SEQ ID NO: 1081894 - protein, 9 aa, Homo Sapiens
TVSQGLKDK

SEQ ID NO: 1081895 - protein, 9 aa, Homo Sapiens
LNLHSPTHI

SEQ ID NO: 1081896 - protein, 9 aa, Homo Sapiens
MLPLDVENI

SEQ ID NO: 1081897 - protein, 9 aa, Homo Sapiens
PKAPRFSSN

SEQ ID NO: 1081898 - protein, 9 aa, Homo Sapiens
KQAALQALK

SEQ ID NO: 1081899 - protein, 9 aa, Homo Sapiens
GSHDAELLE

SEQ ID NO: 1081900 - protein, 9 aa, Homo Sapiens
CPNGLIFKD

SEQ ID NO: 1081901 - protein, 9 aa, Homo Sapiens
QGTDLSGIE

SEQ ID NO: 1081902 - protein, 9 aa, Homo Sapiens
QPQQKLFVA

SEQ ID NO: 1081903 - protein, 9 aa, Homo Sapiens
MSNQFLKVD

SEQ ID NO: 1081904 - protein, 9 aa, Homo Sapiens
GNAEESTLS

SEQ ID NO: 1081905 - protein, 9 aa, Homo Sapiens
LEKENEPSG

SEQ ID NO: 1081906 - protein, 9 aa, Homo Sapiens
TEICLVNGK

SEQ ID NO: 1081907 - protein, 9 aa, Homo Sapiens
TFRLCCVQE

SEQ ID NO: 1081908 - protein, 9 aa, Homo Sapiens
SRRLNSQST

SEQ ID NO: 1081909 - protein, 9 aa, Homo Sapiens
INEKFQLPE

SEQ ID NO: 1081910 - protein, 9 aa, Homo Sapiens
FSWGLSLVK

SEQ ID NO: 1081911 - protein, 9 aa, Homo Sapiens
TLELVSVEQ

SEQ ID NO: 1081912 - protein, 9 aa, Homo Sapiens
NRMTHLVPG

SEQ ID NO: 1081913 - protein, 9 aa, Homo Sapiens
QSKSFLSYK

SEQ ID NO: 1081914 - protein, 9 aa, Homo Sapiens
KNSTFRNSF

SEQ ID NO: 1081915 - protein, 9 aa, Homo Sapiens
LAKTAPPPL

SEQ ID NO: 1081916 - protein, 9 aa, Homo Sapiens
SQVGHLQNL

SEQ ID NO: 1081917 - protein, 9 aa, Homo Sapiens
SEIVGIIKL

SEQ ID NO: 1081918 - protein, 9 aa, Homo Sapiens
LVLLMLFVY

SEQ ID NO: 1081919 - protein, 9 aa, Homo Sapiens
SAAGKNCIT

SEQ ID NO: 1081920 - protein, 9 aa, Homo Sapiens
PTSLIKTEF

SEQ ID NO: 1081921 - protein, 9 aa, Homo Sapiens
GLPAHKTSS

SEQ ID NO: 1081922 - protein, 9 aa, Homo Sapiens
VVNPRNPGE

SEQ ID NO: 1081923 - protein, 9 aa, Homo Sapiens
NSFILSGSL

SEQ ID NO: 1081924 - protein, 9 aa, Homo Sapiens
LTTIGFENI

SEQ ID NO: 1081925 - protein, 9 aa, Homo Sapiens
FPVRFSYPC

SEQ ID NO: 1081926 - protein, 9 aa, Homo Sapiens
QDPIWKKIV

SEQ ID NO: 1081927 - protein, 9 aa, Homo Sapiens
YQQVPSSNP

SEQ ID NO: 1081928 - protein, 9 aa, Homo Sapiens
ALVNQGDAD

SEQ ID NO: 1081929 - protein, 9 aa, Homo Sapiens
VFSFIIGRR

SEQ ID NO: 1081930 - protein, 9 aa, Homo Sapiens
RFSRLSRRS

SEQ ID NO: 1081931 - protein, 9 aa, Homo Sapiens
EHILNLHSP

SEQ ID NO: 1081932 - protein, 9 aa, Homo Sapiens
TRGLLRSPS

SEQ ID NO: 1081933 - protein, 9 aa, Homo Sapiens
ILSAKKKYP

SEQ ID NO: 1081934 - protein, 9 aa, Homo Sapiens
HSHNSSTHH

SEQ ID NO: 1081935 - protein, 9 aa, Homo Sapiens
EYWVDPNQE

SEQ ID NO: 1081936 - protein, 9 aa, Homo Sapiens
SPVFVEWRA

SEQ ID NO: 1081937 - protein, 9 aa, Homo Sapiens
AEPFTSECL

SEQ ID NO: 1081938 - protein, 9 aa, Homo Sapiens
GRVCRWPPP

SEQ ID NO: 1081939 - protein, 9 aa, Homo Sapiens
TLGFHVLYQ

SEQ ID NO: 1081940 - protein, 9 aa, Homo Sapiens
KEMQLERED

SEQ ID NO: 1081941 - protein, 9 aa, Homo Sapiens
ILEDQTSRG

SEQ ID NO: 1081942 - protein, 9 aa, Homo Sapiens
SDEIDLPRE

SEQ ID NO: 1081943 - protein, 9 aa, Homo Sapiens
TVSEAPGPL

SEQ ID NO: 1081944 - protein, 9 aa, Homo Sapiens
SYPCTQTEL

SEQ ID NO: 1081945 - protein, 9 aa, Homo Sapiens
FKKFLPVMT

SEQ ID NO: 1081946 - protein, 9 aa, Homo Sapiens
SSATLNISK

SEQ ID NO: 1081947 - protein, 9 aa, Homo Sapiens
LDSLSTCFG

SEQ ID NO: 1081948 - protein, 9 aa, Homo Sapiens
FSRKSSSPA

SEQ ID NO: 1081949 - protein, 9 aa, Homo Sapiens
KTAPPPLCA

SEQ ID NO: 1081950 - protein, 9 aa, Homo Sapiens
LKDKVLYKC

SEQ ID NO: 1081951 - protein, 9 aa, Homo Sapiens
ENLQTGDLL

SEQ ID NO: 1081952 - protein, 9 aa, Homo Sapiens
REIYDSIEP

SEQ ID NO: 1081953 - protein, 9 aa, Homo Sapiens
VVSLFFETS

SEQ ID NO: 1081954 - protein, 9 aa, Homo Sapiens
GPAGGPGFS

SEQ ID NO: 1081955 - protein, 9 aa, Homo Sapiens
LPQVPLPSV

SEQ ID NO: 1081956 - protein, 9 aa, Homo Sapiens
EDEEGEEQG

SEQ ID NO: 1081957 - protein, 9 aa, Homo Sapiens
PPPTLLDSS

SEQ ID NO: 1081958 - protein, 9 aa, Homo Sapiens
FPAAPILTL

SEQ ID NO: 1081959 - protein, 9 aa, Homo Sapiens
STRIVGDIW

SEQ ID NO: 1081960 - protein, 9 aa, Homo Sapiens
KREHASRNG

SEQ ID NO: 1081961 - protein, 9 aa, Homo Sapiens
MNHTFFPGY

SEQ ID NO: 1081962 - protein, 9 aa, Homo Sapiens
TAAGRPLPG

SEQ ID NO: 1081963 - protein, 9 aa, Homo Sapiens
LEVFLALVA

SEQ ID NO: 1081964 - protein, 9 aa, Homo Sapiens
DRISRKYFF

SEQ ID NO: 1081965 - protein, 9 aa, Homo Sapiens
VQQTWSHLE

SEQ ID NO: 1081966 - protein, 9 aa, Homo Sapiens
FYHRSYKLR

SEQ ID NO: 1081967 - protein, 9 aa, Homo Sapiens
NWSDEANCT

SEQ ID NO: 1081968 - protein, 9 aa, Homo Sapiens
RRHRGLICA

SEQ ID NO: 1081969 - protein, 9 aa, Homo Sapiens
WEEARQRGF

SEQ ID NO: 1081970 - protein, 9 aa, Homo Sapiens
IGSLSMHPK

SEQ ID NO: 1081971 - protein, 9 aa, Homo Sapiens
IFSAYPSQE

SEQ ID NO: 1081972 - protein, 9 aa, Homo Sapiens
KLETNLDIK

SEQ ID NO: 1081973 - protein, 9 aa, Homo Sapiens
SPSAASQTY

SEQ ID NO: 1081974 - protein, 9 aa, Homo Sapiens
FITQSCLVS

SEQ ID NO: 1081975 - protein, 9 aa, Homo Sapiens
YSSTFYSLE

SEQ ID NO: 1081976 - protein, 9 aa, Homo Sapiens
NAQVTYLLL

SEQ ID NO: 1081977 - protein, 9 aa, Homo Sapiens
ITKIGMILS

SEQ ID NO: 1081978 - protein, 9 aa, Homo Sapiens
ELFCHLHTV

SEQ ID NO: 1081979 - protein, 9 aa, Homo Sapiens
SKEKRLRRE

SEQ ID NO: 1081980 - protein, 9 aa, Homo Sapiens
DSKATLEVV

SEQ ID NO: 1081981 - protein, 9 aa, Homo Sapiens
GSPSPPGLL

SEQ ID NO: 1081982 - protein, 9 aa, Homo Sapiens
KCGQHLVEA

SEQ ID NO: 1081983 - protein, 9 aa, Homo Sapiens
AQAVGAGLF

SEQ ID NO: 1081984 - protein, 9 aa, Homo Sapiens
LFDVAPPRD

SEQ ID NO: 1081985 - protein, 9 aa, Homo Sapiens
CDLSEISVS

SEQ ID NO: 1081986 - protein, 9 aa, Homo Sapiens
DSVLVFKKE

SEQ ID NO: 1081987 - protein, 9 aa, Homo Sapiens
KAISYDRCA

SEQ ID NO: 1081988 - protein, 9 aa, Homo Sapiens
KENIRLVWQ

SEQ ID NO: 1081989 - protein, 9 aa, Homo Sapiens
RPILAETYV

SEQ ID NO: 1081990 - protein, 9 aa, Homo Sapiens
NGKLGFWLA

SEQ ID NO: 1081991 - protein, 9 aa, Homo Sapiens
GEGPGYLPP

SEQ ID NO: 1081992 - protein, 9 aa, Homo Sapiens
LEEYTGTNP

SEQ ID NO: 1081993 - protein, 9 aa, Homo Sapiens
TFISLLTEE

SEQ ID NO: 1081994 - protein, 9 aa, Homo Sapiens
DNRSCNQKG

SEQ ID NO: 1081995 - protein, 9 aa, Homo Sapiens
HLAQEDVLK

SEQ ID NO: 1081996 - protein, 9 aa, Homo Sapiens
WKELFCELF

SEQ ID NO: 1081997 - protein, 9 aa, Homo Sapiens
QDLVQKKYL

SEQ ID NO: 1081998 - protein, 9 aa, Homo Sapiens
PFYLVNTAT

SEQ ID NO: 1081999 - protein, 9 aa, Homo Sapiens
LLSRVLLSE

SEQ ID NO: 1082000 - protein, 9 aa, Homo Sapiens
RTLKGTQGV

SEQ ID NO: 1082001 - protein, 9 aa, Homo Sapiens
LFERLECSE

SEQ ID NO: 1082002 - protein, 9 aa, Homo Sapiens
PKTGECLCY

SEQ ID NO: 1082003 - protein, 9 aa, Homo Sapiens
EPTLWIRTH

SEQ ID NO: 1082004 - protein, 9 aa, Homo Sapiens
ELPTPQTFR

SEQ ID NO: 1082005 - protein, 9 aa, Homo Sapiens
MALKNHFRL

SEQ ID NO: 1082006 - protein, 9 aa, Homo Sapiens
FVCVGVPTV

SEQ ID NO: 1082007 - protein, 9 aa, Homo Sapiens
EFVGRAFQQ

SEQ ID NO: 1082008 - protein, 9 aa, Homo Sapiens
FLSYKEFSA

SEQ ID NO: 1082009 - protein, 9 aa, Homo Sapiens
ELSRIHDPK

SEQ ID NO: 1082010 - protein, 9 aa, Homo Sapiens
FSPSLPPCS

SEQ ID NO: 1082011 - protein, 9 aa, Homo Sapiens
RADLQLSLF

SEQ ID NO: 1082012 - protein, 9 aa, Homo Sapiens
SAHSFVCSL

SEQ ID NO: 1082013 - protein, 9 aa, Homo Sapiens
AQPYASVQF

SEQ ID NO: 1082014 - protein, 9 aa, Homo Sapiens
SSGLTGNSH

SEQ ID NO: 1082015 - protein, 9 aa, Homo Sapiens
SVNKLTDQI

SEQ ID NO: 1082016 - protein, 9 aa, Homo Sapiens
ARSNSEAAW

SEQ ID NO: 1082017 - protein, 9 aa, Homo Sapiens
SLEGQTFFF

SEQ ID NO: 1082018 - protein, 9 aa, Homo Sapiens
LLRIGTVNC

SEQ ID NO: 1082019 - protein, 9 aa, Homo Sapiens
LWSASRRLN

SEQ ID NO: 1082020 - protein, 9 aa, Homo Sapiens
DAKHLISSS

SEQ ID NO: 1082021 - protein, 9 aa, Homo Sapiens
YLTSNTSGK

SEQ ID NO: 1082022 - protein, 9 aa, Homo Sapiens
MIGSVSQSK

SEQ ID NO: 1082023 - protein, 9 aa, Homo Sapiens
NINPCLCTH

SEQ ID NO: 1082024 - protein, 9 aa, Homo Sapiens
ARLNKEIPE

SEQ ID NO: 1082025 - protein, 9 aa, Homo Sapiens
ITYLGRHRK

SEQ ID NO: 1082026 - protein, 9 aa, Homo Sapiens
TLLTVGHLQ

SEQ ID NO: 1082027 - protein, 9 aa, Homo Sapiens
TGKEPALSN

SEQ ID NO: 1082028 - protein, 9 aa, Homo Sapiens
SLFAFLEHQ

SEQ ID NO: 1082029 - protein, 9 aa, Homo Sapiens
RVTQPTGKE

SEQ ID NO: 1082030 - protein, 9 aa, Homo Sapiens
GDIGFSGPE

SEQ ID NO: 1082031 - protein, 9 aa, Homo Sapiens
SFKLEKSNL

SEQ ID NO: 1082032 - protein, 9 aa, Homo Sapiens
TLFRSQPAY

SEQ ID NO: 1082033 - protein, 9 aa, Homo Sapiens
SQRLNSHSH

SEQ ID NO: 1082034 - protein, 9 aa, Homo Sapiens
SSDMLNYEE

SEQ ID NO: 1082035 - protein, 9 aa, Homo Sapiens
EPGIPRHAR

SEQ ID NO: 1082036 - protein, 9 aa, Homo Sapiens
APAARWSFQ

SEQ ID NO: 1082037 - protein, 9 aa, Homo Sapiens
NPESTQRPN

SEQ ID NO: 1082038 - protein, 9 aa, Homo Sapiens
QRIPVALPK

SEQ ID NO: 1082039 - protein, 9 aa, Homo Sapiens
RTLGLFCLV

SEQ ID NO: 1082040 - protein, 9 aa, Homo Sapiens
ISTTRALDK

SEQ ID NO: 1082041 - protein, 9 aa, Homo Sapiens
EEAWRRTRE

SEQ ID NO: 1082042 - protein, 9 aa, Homo Sapiens
SAKRWKFGW

SEQ ID NO: 1082043 - protein, 9 aa, Homo Sapiens
ERWGLAQHV

SEQ ID NO: 1082044 - protein, 9 aa, Homo Sapiens
SFFAFKKNR

SEQ ID NO: 1082045 - protein, 9 aa, Homo Sapiens
SFIRTVQGP

SEQ ID NO: 1082046 - protein, 9 aa, Homo Sapiens
IRWMPPEFI

SEQ ID NO: 1082047 - protein, 9 aa, Homo Sapiens
LEEKDGASS

SEQ ID NO: 1082048 - protein, 9 aa, Homo Sapiens
TISKAIWLL

SEQ ID NO: 1082049 - protein, 9 aa, Homo Sapiens
EYSFEKEKE

SEQ ID NO: 1082050 - protein, 9 aa, Homo Sapiens
PASFVVQLN

SEQ ID NO: 1082051 - protein, 9 aa, Homo Sapiens
KNMKLEVVN

SEQ ID NO: 1082052 - protein, 9 aa, Homo Sapiens
LDCWVVWKV

SEQ ID NO: 1082053 - protein, 9 aa, Homo Sapiens
APALQEKAA

SEQ ID NO: 1082054 - protein, 9 aa, Homo Sapiens
SDPVSLCYT

SEQ ID NO: 1082055 - protein, 9 aa, Homo Sapiens
ISYDRCAAQ

SEQ ID NO: 1082056 - protein, 9 aa, Homo Sapiens
KPQSKEAHI

SEQ ID NO: 1082057 - protein, 9 aa, Homo Sapiens
TGDTFSDVV

SEQ ID NO: 1082058 - protein, 9 aa, Homo Sapiens
WARMEKIMR

SEQ ID NO: 1082059 - protein, 9 aa, Homo Sapiens
RQREKRRTC

SEQ ID NO: 1082060 - protein, 9 aa, Homo Sapiens
YVVLGFREN

SEQ ID NO: 1082061 - protein, 9 aa, Homo Sapiens
NCRAKCRQQ

SEQ ID NO: 1082062 - protein, 9 aa, Homo Sapiens
KFYYKFFRD

SEQ ID NO: 1082063 - protein, 9 aa, Homo Sapiens
AHRLTHSSA

SEQ ID NO: 1082064 - protein, 9 aa, Homo Sapiens
TATNMKYLL

SEQ ID NO: 1082065 - protein, 9 aa, Homo Sapiens
VNWKSGYLV

SEQ ID NO: 1082066 - protein, 9 aa, Homo Sapiens
SKGKARIRV

SEQ ID NO: 1082067 - protein, 9 aa, Homo Sapiens
LSYFLIIRM

SEQ ID NO: 1082068 - protein, 9 aa, Homo Sapiens
SFSFLSELP

SEQ ID NO: 1082069 - protein, 9 aa, Homo Sapiens
GSELFMGQL

SEQ ID NO: 1082070 - protein, 9 aa, Homo Sapiens
EKLGTEENL

SEQ ID NO: 1082071 - protein, 9 aa, Homo Sapiens
FPKISRASK

SEQ ID NO: 1082072 - protein, 9 aa, Homo Sapiens
CSLQGDFCQ

SEQ ID NO: 1082073 - protein, 9 aa, Homo Sapiens
GQDRQVPEQ

SEQ ID NO: 1082074 - protein, 9 aa, Homo Sapiens
AFSFLWAGP

SEQ ID NO: 1082075 - protein, 9 aa, Homo Sapiens
ARAGHLKKA

SEQ ID NO: 1082076 - protein, 9 aa, Homo Sapiens
TIISLLFAE

SEQ ID NO: 1082077 - protein, 9 aa, Homo Sapiens
PGAFSLEVP

SEQ ID NO: 1082078 - protein, 9 aa, Homo Sapiens
PGPQSPIGP

SEQ ID NO: 1082079 - protein, 9 aa, Homo Sapiens
RLTHSSARP

SEQ ID NO: 1082080 - protein, 9 aa, Homo Sapiens
GLLILSFIQ

SEQ ID NO: 1082081 - protein, 9 aa, Homo Sapiens
TSNSMLPLD

SEQ ID NO: 1082082 - protein, 9 aa, Homo Sapiens
LRRPPGPAF

SEQ ID NO: 1082083 - protein, 9 aa, Homo Sapiens
LVTHRQGLQ

SEQ ID NO: 1082084 - protein, 9 aa, Homo Sapiens
FRVFSRKSS

SEQ ID NO: 1082085 - protein, 9 aa, Homo Sapiens
DSKEGEGLE

SEQ ID NO: 1082086 - protein, 9 aa, Homo Sapiens
ESVKLNLEV

SEQ ID NO: 1082087 - protein, 9 aa, Homo Sapiens
PISDVYQTY

SEQ ID NO: 1082088 - protein, 9 aa, Homo Sapiens
MLKFQFCSR

SEQ ID NO: 1082089 - protein, 9 aa, Homo Sapiens
ACVYHKHFD

SEQ ID NO: 1082090 - protein, 9 aa, Homo Sapiens
PVQYFCYIF

SEQ ID NO: 1082091 - protein, 9 aa, Homo Sapiens
VYFSSSAPK

SEQ ID NO: 1082092 - protein, 9 aa, Homo Sapiens
AFMENSVMV

SEQ ID NO: 1082093 - protein, 9 aa, Homo Sapiens
SFVKTYNTY

SEQ ID NO: 1082094 - protein, 9 aa, Homo Sapiens
KKASIKKQK

SEQ ID NO: 1082095 - protein, 9 aa, Homo Sapiens
TGTNPLYVG

SEQ ID NO: 1082096 - protein, 9 aa, Homo Sapiens
ALEFLIISN

SEQ ID NO: 1082097 - protein, 9 aa, Homo Sapiens
HLVYVNAIA

SEQ ID NO: 1082098 - protein, 9 aa, Homo Sapiens
PVPLNLPCL

SEQ ID NO: 1082099 - protein, 9 aa, Homo Sapiens
APMFFWPRL

SEQ ID NO: 1082100 - protein, 9 aa, Homo Sapiens
PILNMKGTK

SEQ ID NO: 1082101 - protein, 9 aa, Homo Sapiens
LSATLEGLL

SEQ ID NO: 1082102 - protein, 9 aa, Homo Sapiens
QWNRTFKVI

SEQ ID NO: 1082103 - protein, 9 aa, Homo Sapiens
NGLIFKDGG

SEQ ID NO: 1082104 - protein, 9 aa, Homo Sapiens
TYLSIKFIL

SEQ ID NO: 1082105 - protein, 9 aa, Homo Sapiens
PRLGHQRTS

SEQ ID NO: 1082106 - protein, 9 aa, Homo Sapiens
NSDMKNQRE

SEQ ID NO: 1082107 - protein, 9 aa, Homo Sapiens
KRCGVTFVP

SEQ ID NO: 1082108 - protein, 9 aa, Homo Sapiens
GLDEPPSVN

SEQ ID NO: 1082109 - protein, 9 aa, Homo Sapiens
DSCFLTSTA

SEQ ID NO: 1082110 - protein, 9 aa, Homo Sapiens
EQPLPEIFI

SEQ ID NO: 1082111 - protein, 9 aa, Homo Sapiens
QKNFRKQVN

SEQ ID NO: 1082112 - protein, 9 aa, Homo Sapiens
FKAYENRVK

SEQ ID NO: 1082113 - protein, 9 aa, Homo Sapiens
RVPDHTCKK

SEQ ID NO: 1082114 - protein, 9 aa, Homo Sapiens
IVDECCFQS

SEQ ID NO: 1082115 - protein, 9 aa, Homo Sapiens
VDPNQECSR

SEQ ID NO: 1082116 - protein, 9 aa, Homo Sapiens
KKPFAAKDE

SEQ ID NO: 1082117 - protein, 9 aa, Homo Sapiens
RSRTQLFSL

SEQ ID NO: 1082118 - protein, 9 aa, Homo Sapiens
ISLLFAELK

SEQ ID NO: 1082119 - protein, 9 aa, Homo Sapiens
QRIYTGEKP

SEQ ID NO: 1082120 - protein, 9 aa, Homo Sapiens
SWYSKGAFN

SEQ ID NO: 1082121 - protein, 9 aa, Homo Sapiens
SPEGGNPSI

SEQ ID NO: 1082122 - protein, 9 aa, Homo Sapiens
EENFPDEKV

SEQ ID NO: 1082123 - protein, 9 aa, Homo Sapiens
YYCSVTSWV

SEQ ID NO: 1082124 - protein, 9 aa, Homo Sapiens
FEDTPLHTP

SEQ ID NO: 1082125 - protein, 9 aa, Homo Sapiens
MLTWEKKEL

SEQ ID NO: 1082126 - protein, 9 aa, Homo Sapiens
GGSSWSSAD

SEQ ID NO: 1082127 - protein, 9 aa, Homo Sapiens
FGSELFMGQ

SEQ ID NO: 1082128 - protein, 9 aa, Homo Sapiens
GNSMNSLFS

SEQ ID NO: 1082129 - protein, 9 aa, Homo Sapiens
APRPRLRRP

SEQ ID NO: 1082130 - protein, 9 aa, Homo Sapiens
FGRLGSTEW

SEQ ID NO: 1082131 - protein, 9 aa, Homo Sapiens
VRSRNSGKD

SEQ ID NO: 1082132 - protein, 9 aa, Homo Sapiens
KFSSMDTFE

SEQ ID NO: 1082133 - protein, 9 aa, Homo Sapiens
RFLQGFRDI

SEQ ID NO: 1082134 - protein, 9 aa, Homo Sapiens
DTLLKELGG

SEQ ID NO: 1082135 - protein, 9 aa, Homo Sapiens
FAPVLSATF

SEQ ID NO: 1082136 - protein, 9 aa, Homo Sapiens
ALSLGDTAL

SEQ ID NO: 1082137 - protein, 9 aa, Homo Sapiens
RKPLLRTEP

SEQ ID NO: 1082138 - protein, 9 aa, Homo Sapiens
PTGKEPALS

SEQ ID NO: 1082139 - protein, 9 aa, Homo Sapiens
LDWDLDPGR

SEQ ID NO: 1082140 - protein, 9 aa, Homo Sapiens
VSLSFSFLS

SEQ ID NO: 1082141 - protein, 9 aa, Homo Sapiens
SSSLNIHQR

SEQ ID NO: 1082142 - protein, 9 aa, Homo Sapiens
LFKKTHRVL

SEQ ID NO: 1082143 - protein, 9 aa, Homo Sapiens
CSPVSGCAL

SEQ ID NO: 1082144 - protein, 9 aa, Homo Sapiens
ELENRCQKL

SEQ ID NO: 1082145 - protein, 9 aa, Homo Sapiens
KEPGFYLDP

SEQ ID NO: 1082146 - protein, 9 aa, Homo Sapiens
VMSYDCFTA

SEQ ID NO: 1082147 - protein, 9 aa, Homo Sapiens
LGAIKSFRT

SEQ ID NO: 1082148 - protein, 9 aa, Homo Sapiens
HSRRKMRLS

SEQ ID NO: 1082149 - protein, 9 aa, Homo Sapiens
NLRFMGVCV

SEQ ID NO: 1082150 - protein, 9 aa, Homo Sapiens
FWRRMTRTC

SEQ ID NO: 1082151 - protein, 9 aa, Homo Sapiens
PALEAITDK

SEQ ID NO: 1082152 - protein, 9 aa, Homo Sapiens
STVTVLKLL

SEQ ID NO: 1082153 - protein, 9 aa, Homo Sapiens
DKAISYDRC

SEQ ID NO: 1082154 - protein, 9 aa, Homo Sapiens
EQGPRGPSG

SEQ ID NO: 1082155 - protein, 9 aa, Homo Sapiens
SFLSELPYQ

SEQ ID NO: 1082156 - protein, 9 aa, Homo Sapiens
QPGVPLRKL

SEQ ID NO: 1082157 - protein, 9 aa, Homo Sapiens
LRPPRPLPV

SEQ ID NO: 1082158 - protein, 9 aa, Homo Sapiens
NNIDEYEKS

SEQ ID NO: 1082159 - protein, 9 aa, Homo Sapiens
EKWMDFVSS

SEQ ID NO: 1082160 - protein, 9 aa, Homo Sapiens
IEERVLIDK

SEQ ID NO: 1082161 - protein, 9 aa, Homo Sapiens
SADVFHTFC

SEQ ID NO: 1082162 - protein, 9 aa, Homo Sapiens
VRFMSTLLN

SEQ ID NO: 1082163 - protein, 9 aa, Homo Sapiens
KKKNIAAQR

SEQ ID NO: 1082164 - protein, 9 aa, Homo Sapiens
FYIAGDACL

SEQ ID NO: 1082165 - protein, 9 aa, Homo Sapiens
EGTDARNVL

SEQ ID NO: 1082166 - protein, 9 aa, Homo Sapiens
LEKQISVKC

SEQ ID NO: 1082167 - protein, 9 aa, Homo Sapiens
TETTACMPT

SEQ ID NO: 1082168 - protein, 9 aa, Homo Sapiens
TQQPQAYNF

SEQ ID NO: 1082169 - protein, 9 aa, Homo Sapiens
SATFRGVAG

SEQ ID NO: 1082170 - protein, 9 aa, Homo Sapiens
TGNRGFIFV

SEQ ID NO: 1082171 - protein, 9 aa, Homo Sapiens
IFTIGPSNT

SEQ ID NO: 1082172 - protein, 9 aa, Homo Sapiens
CNGLRRFFR

SEQ ID NO: 1082173 - protein, 9 aa, Homo Sapiens
RAVKSINEA

SEQ ID NO: 1082174 - protein, 9 aa, Homo Sapiens
GFFAVYVAT

SEQ ID NO: 1082175 - protein, 9 aa, Homo Sapiens
ETKIQSIQP

SEQ ID NO: 1082176 - protein, 9 aa, Homo Sapiens
PKKKITDSE

SEQ ID NO: 1082177 - protein, 9 aa, Homo Sapiens
ICPGQYNPS

SEQ ID NO: 1082178 - protein, 9 aa, Homo Sapiens
FDAQKEIVS

SEQ ID NO: 1082179 - protein, 9 aa, Homo Sapiens
ALVYREDNP

SEQ ID NO: 1082180 - protein, 9 aa, Homo Sapiens
GDAQIDLNW

SEQ ID NO: 1082181 - protein, 9 aa, Homo Sapiens
RFSILIKAW

SEQ ID NO: 1082182 - protein, 9 aa, Homo Sapiens
EEGVRQKKS

SEQ ID NO: 1082183 - protein, 9 aa, Homo Sapiens
IGNFVKYQC

SEQ ID NO: 1082184 - protein, 9 aa, Homo Sapiens
REEEKRQKQ

SEQ ID NO: 1082185 - protein, 9 aa, Homo Sapiens
CGKIFYSKS

SEQ ID NO: 1082186 - protein, 9 aa, Homo Sapiens
RPSPKALQK

SEQ ID NO: 1082187 - protein, 9 aa, Homo Sapiens
PGEAGIPGY

SEQ ID NO: 1082188 - protein, 9 aa, Homo Sapiens
YLGRHRKKA

SEQ ID NO: 1082189 - protein, 9 aa, Homo Sapiens
QDALPKDHG

SEQ ID NO: 1082190 - protein, 9 aa, Homo Sapiens
EENPPHLFA

SEQ ID NO: 1082191 - protein, 9 aa, Homo Sapiens
TLTDEKTYD

SEQ ID NO: 1082192 - protein, 9 aa, Homo Sapiens
LSSSMSLSL

SEQ ID NO: 1082193 - protein, 9 aa, Homo Sapiens
SPPWNRIFK

SEQ ID NO: 1082194 - protein, 9 aa, Homo Sapiens
NANHINWYI

SEQ ID NO: 1082195 - protein, 9 aa, Homo Sapiens
KEKRLRREP

SEQ ID NO: 1082196 - protein, 9 aa, Homo Sapiens
FAPRADRAP

SEQ ID NO: 1082197 - protein, 9 aa, Homo Sapiens
LSAPAEVWL

SEQ ID NO: 1082198 - protein, 9 aa, Homo Sapiens
SSFLYNGQA

SEQ ID NO: 1082199 - protein, 9 aa, Homo Sapiens
KSYVNLNHH

SEQ ID NO: 1082200 - protein, 9 aa, Homo Sapiens
KLRAGRQQR

SEQ ID NO: 1082201 - protein, 9 aa, Homo Sapiens
PARGPPGLQ

SEQ ID NO: 1082202 - protein, 9 aa, Homo Sapiens
APSKGESSG

SEQ ID NO: 1082203 - protein, 9 aa, Homo Sapiens
LNEEIGELL

SEQ ID NO: 1082204 - protein, 9 aa, Homo Sapiens
LAVSLKNID

SEQ ID NO: 1082205 - protein, 9 aa, Homo Sapiens
SLFQTLEGK

SEQ ID NO: 1082206 - protein, 9 aa, Homo Sapiens
SERPPRPPS

SEQ ID NO: 1082207 - protein, 9 aa, Homo Sapiens
DTDEENTEV

SEQ ID NO: 1082208 - protein, 9 aa, Homo Sapiens
KPIQDFHYG

SEQ ID NO: 1082209 - protein, 9 aa, Homo Sapiens
RPQSCRAFK

SEQ ID NO: 1082210 - protein, 9 aa, Homo Sapiens
EFTYNSFMR

SEQ ID NO: 1082211 - protein, 9 aa, Homo Sapiens
FSDHSSDIL

SEQ ID NO: 1082212 - protein, 9 aa, Homo Sapiens
PLFPRTTQI

SEQ ID NO: 1082213 - protein, 9 aa, Homo Sapiens
FMYLKPQSK

SEQ ID NO: 1082214 - protein, 9 aa, Homo Sapiens
ARWSFQGHH

SEQ ID NO: 1082215 - protein, 9 aa, Homo Sapiens
PAPTTVSEA

SEQ ID NO: 1082216 - protein, 9 aa, Homo Sapiens
KGSCVCGSV

SEQ ID NO: 1082217 - protein, 9 aa, Homo Sapiens
ELPLKEEVA

SEQ ID NO: 1082218 - protein, 9 aa, Homo Sapiens
IRTIHLRRV

SEQ ID NO: 1082219 - protein, 9 aa, Homo Sapiens
RVVKGKHES

SEQ ID NO: 1082220 - protein, 9 aa, Homo Sapiens
TRETVENLP

SEQ ID NO: 1082221 - protein, 9 aa, Homo Sapiens
SGSMLGRAD

SEQ ID NO: 1082222 - protein, 9 aa, Homo Sapiens
RQWLKEEYE

SEQ ID NO: 1082223 - protein, 9 aa, Homo Sapiens
PSCKRLHRI

SEQ ID NO: 1082224 - protein, 9 aa, Homo Sapiens
IVLNGSLNY

SEQ ID NO: 1082225 - protein, 9 aa, Homo Sapiens
THPGLLISN

SEQ ID NO: 1082226 - protein, 9 aa, Homo Sapiens
VMLRLAILG

SEQ ID NO: 1082227 - protein, 9 aa, Homo Sapiens
VSLSPPWNR

SEQ ID NO: 1082228 - protein, 9 aa, Homo Sapiens
STQGDQEAP

SEQ ID NO: 1082229 - protein, 9 aa, Homo Sapiens
SGVEMERRA

SEQ ID NO: 1082230 - protein, 9 aa, Homo Sapiens
DLYTPGFPS

SEQ ID NO: 1082231 - protein, 9 aa, Homo Sapiens
SRLPRGCLL

SEQ ID NO: 1082232 - protein, 9 aa, Homo Sapiens
HISSVVVLP

SEQ ID NO: 1082233 - protein, 9 aa, Homo Sapiens
TNFGLAILW

SEQ ID NO: 1082234 - protein, 9 aa, Homo Sapiens
TFGKFYYKF

SEQ ID NO: 1082235 - protein, 9 aa, Homo Sapiens
GSCLHSLPI

SEQ ID NO: 1082236 - protein, 9 aa, Homo Sapiens
NWMFPADFQ

SEQ ID NO: 1082237 - protein, 9 aa, Homo Sapiens
GEKLAITYG

SEQ ID NO: 1082238 - protein, 9 aa, Homo Sapiens
FNSSLYALH

SEQ ID NO: 1082239 - protein, 9 aa, Homo Sapiens
ESNYPIVLG

SEQ ID NO: 1082240 - protein, 9 aa, Homo Sapiens
SCFLTSTAP

SEQ ID NO: 1082241 - protein, 9 aa, Homo Sapiens
PTHQSHHCA

SEQ ID NO: 1082242 - protein, 9 aa, Homo Sapiens
YSFEKEKEL

SEQ ID NO: 1082243 - protein, 9 aa, Homo Sapiens
YQGKINGIS

SEQ ID NO: 1082244 - protein, 9 aa, Homo Sapiens
VRPEALQTT

SEQ ID NO: 1082245 - protein, 9 aa, Homo Sapiens
PSPNGPTSG

SEQ ID NO: 1082246 - protein, 9 aa, Homo Sapiens
PLMQQIKDF

SEQ ID NO: 1082247 - protein, 9 aa, Homo Sapiens
LEREDQRFA

SEQ ID NO: 1082248 - protein, 9 aa, Homo Sapiens
SVLNIATEI

SEQ ID NO: 1082249 - protein, 9 aa, Homo Sapiens
RKSQEPAFY

SEQ ID NO: 1082250 - protein, 9 aa, Homo Sapiens
HSSDPLLDE

SEQ ID NO: 1082251 - protein, 9 aa, Homo Sapiens
KEDLEDQDL

SEQ ID NO: 1082252 - protein, 9 aa, Homo Sapiens
FAFKKNRLP

SEQ ID NO: 1082253 - protein, 9 aa, Homo Sapiens
TMFFLTSRT

SEQ ID NO: 1082254 - protein, 9 aa, Homo Sapiens
KGGSSSTMY

SEQ ID NO: 1082255 - protein, 9 aa, Homo Sapiens
SHDAELLEV

SEQ ID NO: 1082256 - protein, 9 aa, Homo Sapiens
LPLKEEVAP

SEQ ID NO: 1082257 - protein, 9 aa, Homo Sapiens
LLRNVDLID

SEQ ID NO: 1082258 - protein, 9 aa, Homo Sapiens
QALVYREDN

SEQ ID NO: 1082259 - protein, 9 aa, Homo Sapiens
CSAAARLDQ

SEQ ID NO: 1082260 - protein, 9 aa, Homo Sapiens
LSHGIVADC

SEQ ID NO: 1082261 - protein, 9 aa, Homo Sapiens
AMKTEGSVL

SEQ ID NO: 1082262 - protein, 9 aa, Homo Sapiens
LEPRLRPGP

SEQ ID NO: 1082263 - protein, 9 aa, Homo Sapiens
TYECLHKVG

SEQ ID NO: 1082264 - protein, 9 aa, Homo Sapiens
RMSNQFLKV

SEQ ID NO: 1082265 - protein, 9 aa, Homo Sapiens
AKLAKAQPT

SEQ ID NO: 1082266 - protein, 9 aa, Homo Sapiens
RCRHLPRPN

SEQ ID NO: 1082267 - protein, 9 aa, Homo Sapiens
NNEITWHVI

SEQ ID NO: 1082268 - protein, 9 aa, Homo Sapiens
LSQYRGVNI

SEQ ID NO: 1082269 - protein, 9 aa, Homo Sapiens
GGHPENGNS

SEQ ID NO: 1082270 - protein, 9 aa, Homo Sapiens
VQTKKVQKV

SEQ ID NO: 1082271 - protein, 9 aa, Homo Sapiens
IYTGEKPYT

SEQ ID NO: 1082272 - protein, 9 aa, Homo Sapiens
PIPGAPSEN

SEQ ID NO: 1082273 - protein, 9 aa, Homo Sapiens
APEVFPRNP

SEQ ID NO: 1082274 - protein, 9 aa, Homo Sapiens
TCSRPSCCR

SEQ ID NO: 1082275 - protein, 9 aa, Homo Sapiens
SVPPERCRH

SEQ ID NO: 1082276 - protein, 9 aa, Homo Sapiens
SIPPAIWNA

SEQ ID NO: 1082277 - protein, 9 aa, Homo Sapiens
KGAFNGNEK

SEQ ID NO: 1082278 - protein, 9 aa, Homo Sapiens
QVPLPSVSR

SEQ ID NO: 1082279 - protein, 9 aa, Homo Sapiens
GKVCYGLIP

SEQ ID NO: 1082280 - protein, 9 aa, Homo Sapiens
PLHLPADVD

SEQ ID NO: 1082281 - protein, 9 aa, Homo Sapiens
TTEILATSG

SEQ ID NO: 1082282 - protein, 9 aa, Homo Sapiens
GRGYYQEGG

SEQ ID NO: 1082283 - protein, 9 aa, Homo Sapiens
SKRDRNFTS

SEQ ID NO: 1082284 - protein, 9 aa, Homo Sapiens
PIIYYNIVL

SEQ ID NO: 1082285 - protein, 9 aa, Homo Sapiens
TYPEGRPTG

SEQ ID NO: 1082286 - protein, 9 aa, Homo Sapiens
LLGLTQDPI

SEQ ID NO: 1082287 - protein, 9 aa, Homo Sapiens
WEKMEYSAQ

SEQ ID NO: 1082288 - protein, 9 aa, Homo Sapiens
AHLCPGPPT

SEQ ID NO: 1082289 - protein, 9 aa, Homo Sapiens
FLYSPKIEV

SEQ ID NO: 1082290 - protein, 9 aa, Homo Sapiens
TACQGLGLV

SEQ ID NO: 1082291 - protein, 9 aa, Homo Sapiens
MELPTPQTF

SEQ ID NO: 1082292 - protein, 9 aa, Homo Sapiens
QAQRFHLPK

SEQ ID NO: 1082293 - protein, 9 aa, Homo Sapiens
APSNDASSS

SEQ ID NO: 1082294 - protein, 9 aa, Homo Sapiens
IEATELKVC

SEQ ID NO: 1082295 - protein, 9 aa, Homo Sapiens
QAQLLSRKC

SEQ ID NO: 1082296 - protein, 9 aa, Homo Sapiens
SALMKQRLA

SEQ ID NO: 1082297 - protein, 9 aa, Homo Sapiens
LATEKSRWS

SEQ ID NO: 1082298 - protein, 9 aa, Homo Sapiens
HAVDTLLKE

SEQ ID NO: 1082299 - protein, 9 aa, Homo Sapiens
RKPLYHYGQ

SEQ ID NO: 1082300 - protein, 9 aa, Homo Sapiens
HLHGSQIGT

SEQ ID NO: 1082301 - protein, 9 aa, Homo Sapiens
EGWEEARQR

SEQ ID NO: 1082302 - protein, 9 aa, Homo Sapiens
QEKVPSSPI

SEQ ID NO: 1082303 - protein, 9 aa, Homo Sapiens
AAAPSKGES

SEQ ID NO: 1082304 - protein, 9 aa, Homo Sapiens
SSLRDPGQQ

SEQ ID NO: 1082305 - protein, 9 aa, Homo Sapiens
WLQWQSQHH

SEQ ID NO: 1082306 - protein, 9 aa, Homo Sapiens
VQGRQPLIE

SEQ ID NO: 1082307 - protein, 9 aa, Homo Sapiens
LNERESVIQ

SEQ ID NO: 1082308 - protein, 9 aa, Homo Sapiens
SQFTDLNDS

SEQ ID NO: 1082309 - protein, 9 aa, Homo Sapiens
KLYTGLTAD

SEQ ID NO: 1082310 - protein, 9 aa, Homo Sapiens
GVDGLPLQG

SEQ ID NO: 1082311 - protein, 9 aa, Homo Sapiens
VLEKQISVK

SEQ ID NO: 1082312 - protein, 9 aa, Homo Sapiens
RFFVKIVGH

SEQ ID NO: 1082313 - protein, 9 aa, Homo Sapiens
ALSLLLPGR

SEQ ID NO: 1082314 - protein, 9 aa, Homo Sapiens
GLQILILVL

SEQ ID NO: 1082315 - protein, 9 aa, Homo Sapiens
ATSQVAMQV

SEQ ID NO: 1082316 - protein, 9 aa, Homo Sapiens
DQPSSDESD

SEQ ID NO: 1082317 - protein, 9 aa, Homo Sapiens
LHGTRRHLP

SEQ ID NO: 1082318 - protein, 9 aa, Homo Sapiens
IGSLAANYG

SEQ ID NO: 1082319 - protein, 9 aa, Homo Sapiens
LARSGPSFL

SEQ ID NO: 1082320 - protein, 9 aa, Homo Sapiens
PAGPALSLG

SEQ ID NO: 1082321 - protein, 9 aa, Homo Sapiens
WLPEKRANL

SEQ ID NO: 1082322 - protein, 9 aa, Homo Sapiens
FKCHRRLHT

SEQ ID NO: 1082323 - protein, 9 aa, Homo Sapiens
CALSTGEKG

SEQ ID NO: 1082324 - protein, 9 aa, Homo Sapiens
GTADFNISS

SEQ ID NO: 1082325 - protein, 9 aa, Homo Sapiens
ETLFFTQAA

SEQ ID NO: 1082326 - protein, 9 aa, Homo Sapiens
SFIIGRRHC

SEQ ID NO: 1082327 - protein, 9 aa, Homo Sapiens
CLSTLFTIT

SEQ ID NO: 1082328 - protein, 9 aa, Homo Sapiens
DSPHSKPGA

SEQ ID NO: 1082329 - protein, 9 aa, Homo Sapiens
ALAQDARYR

SEQ ID NO: 1082330 - protein, 9 aa, Homo Sapiens
VVDSTLELV

SEQ ID NO: 1082331 - protein, 9 aa, Homo Sapiens
DQYNCSRDQ

SEQ ID NO: 1082332 - protein, 9 aa, Homo Sapiens
YIAIALNGA

SEQ ID NO: 1082333 - protein, 9 aa, Homo Sapiens
KPHISFRYP

SEQ ID NO: 1082334 - protein, 9 aa, Homo Sapiens
ILFYNVTDG

SEQ ID NO: 1082335 - protein, 9 aa, Homo Sapiens
ANHINWYIK

SEQ ID NO: 1082336 - protein, 9 aa, Homo Sapiens
SGKDDCAKE

SEQ ID NO: 1082337 - protein, 9 aa, Homo Sapiens
IVPDPSAQR

SEQ ID NO: 1082338 - protein, 9 aa, Homo Sapiens
PNSSYTFSF

SEQ ID NO: 1082339 - protein, 9 aa, Homo Sapiens
MNPDGYKVA

SEQ ID NO: 1082340 - protein, 9 aa, Homo Sapiens
QSPIGPPGE

SEQ ID NO: 1082341 - protein, 9 aa, Homo Sapiens
LQNLSALTV

SEQ ID NO: 1082342 - protein, 9 aa, Homo Sapiens
DHESLNATS

SEQ ID NO: 1082343 - protein, 9 aa, Homo Sapiens
SLLVHQRVH

SEQ ID NO: 1082344 - protein, 9 aa, Homo Sapiens
KAAPLNPGM

SEQ ID NO: 1082345 - protein, 9 aa, Homo Sapiens
ITHSPIVSQ

SEQ ID NO: 1082346 - protein, 9 aa, Homo Sapiens
RIKLICVTE

SEQ ID NO: 1082347 - protein, 9 aa, Homo Sapiens
GKKGEMGVA

SEQ ID NO: 1082348 - protein, 9 aa, Homo Sapiens
GSWQLPAAQ

SEQ ID NO: 1082349 - protein, 9 aa, Homo Sapiens
DINFWVERQ

SEQ ID NO: 1082350 - protein, 9 aa, Homo Sapiens
IPFLNLRTP

SEQ ID NO: 1082351 - protein, 9 aa, Homo Sapiens
KKFPKISRA

SEQ ID NO: 1082352 - protein, 9 aa, Homo Sapiens
GSQIGTLRL

SEQ ID NO: 1082353 - protein, 9 aa, Homo Sapiens
KGTKSESAE

SEQ ID NO: 1082354 - protein, 9 aa, Homo Sapiens
PLRFKNIRK

SEQ ID NO: 1082355 - protein, 9 aa, Homo Sapiens
ARVVDSTLE

SEQ ID NO: 1082356 - protein, 9 aa, Homo Sapiens
SPGTADFNI

SEQ ID NO: 1082357 - protein, 9 aa, Homo Sapiens
FLIFELVEK

SEQ ID NO: 1082358 - protein, 9 aa, Homo Sapiens
SASYKKENE

SEQ ID NO: 1082359 - protein, 9 aa, Homo Sapiens
KRKILQFVA

SEQ ID NO: 1082360 - protein, 9 aa, Homo Sapiens
PPQPLGALS

SEQ ID NO: 1082361 - protein, 9 aa, Homo Sapiens
ELAYGGHPY

SEQ ID NO: 1082362 - protein, 9 aa, Homo Sapiens
SAFKSDESS

SEQ ID NO: 1082363 - protein, 9 aa, Homo Sapiens
VPKGSPRPK

SEQ ID NO: 1082364 - protein, 9 aa, Homo Sapiens
MKKLSRPFQ

SEQ ID NO: 1082365 - protein, 9 aa, Homo Sapiens
VELFERLEC

SEQ ID NO: 1082366 - protein, 9 aa, Homo Sapiens
CLCEFKAYE

SEQ ID NO: 1082367 - protein, 9 aa, Homo Sapiens
NQFPAAPIL

SEQ ID NO: 1082368 - protein, 9 aa, Homo Sapiens
EMGNARRPE

SEQ ID NO: 1082369 - protein, 9 aa, Homo Sapiens
PPPYSFTPF

SEQ ID NO: 1082370 - protein, 9 aa, Homo Sapiens
ECGNTFLLD

SEQ ID NO: 1082371 - protein, 9 aa, Homo Sapiens
HVYNHLSSE

SEQ ID NO: 1082372 - protein, 9 aa, Homo Sapiens
CMILLITYL

SEQ ID NO: 1082373 - protein, 9 aa, Homo Sapiens
MKYLLLIGA

SEQ ID NO: 1082374 - protein, 9 aa, Homo Sapiens
VDSTLELVS

SEQ ID NO: 1082375 - protein, 9 aa, Homo Sapiens
PGANFGVPS

SEQ ID NO: 1082376 - protein, 9 aa, Homo Sapiens
VLSLLPTVL

SEQ ID NO: 1082377 - protein, 9 aa, Homo Sapiens
VAYATSGRS

SEQ ID NO: 1082378 - protein, 9 aa, Homo Sapiens
VLFIKMLKR

SEQ ID NO: 1082379 - protein, 9 aa, Homo Sapiens
NLCELTEDP

SEQ ID NO: 1082380 - protein, 9 aa, Homo Sapiens
LYVMHSFWN

SEQ ID NO: 1082381 - protein, 9 aa, Homo Sapiens
AEFQRGKQT

SEQ ID NO: 1082382 - protein, 9 aa, Homo Sapiens
LGTEENLAP

SEQ ID NO: 1082383 - protein, 9 aa, Homo Sapiens
ESDDFFGQT

SEQ ID NO: 1082384 - protein, 9 aa, Homo Sapiens
IGTVNCGDD

SEQ ID NO: 1082385 - protein, 9 aa, Homo Sapiens
KGDNLSQYR

SEQ ID NO: 1082386 - protein, 9 aa, Homo Sapiens
AQSPASKDS

SEQ ID NO: 1082387 - protein, 9 aa, Homo Sapiens
KFPKISRAS

SEQ ID NO: 1082388 - protein, 9 aa, Homo Sapiens
SQTHYITVV

SEQ ID NO: 1082389 - protein, 9 aa, Homo Sapiens
SPPSASLVQ

SEQ ID NO: 1082390 - protein, 9 aa, Homo Sapiens
LDSSHPVPT

SEQ ID NO: 1082391 - protein, 9 aa, Homo Sapiens
LLQTQSPGE

SEQ ID NO: 1082392 - protein, 9 aa, Homo Sapiens
ERVAARERW

SEQ ID NO: 1082393 - protein, 9 aa, Homo Sapiens
TNLAVYENA

SEQ ID NO: 1082394 - protein, 9 aa, Homo Sapiens
GPVQKYPGN

SEQ ID NO: 1082395 - protein, 9 aa, Homo Sapiens
RIKANARER

SEQ ID NO: 1082396 - protein, 9 aa, Homo Sapiens
ESFEEVARK

SEQ ID NO: 1082397 - protein, 9 aa, Homo Sapiens
KLYISLEYR

SEQ ID NO: 1082398 - protein, 9 aa, Homo Sapiens
LLMRKSTEN

SEQ ID NO: 1082399 - protein, 9 aa, Homo Sapiens
SARGLFPRD

SEQ ID NO: 1082400 - protein, 9 aa, Homo Sapiens
RDAWGPEAA

SEQ ID NO: 1082401 - protein, 9 aa, Homo Sapiens
TEDLLLEQC

SEQ ID NO: 1082402 - protein, 9 aa, Homo Sapiens
RVQFEEKLS

SEQ ID NO: 1082403 - protein, 9 aa, Homo Sapiens
KQLVWRGTN

SEQ ID NO: 1082404 - protein, 9 aa, Homo Sapiens
RLPGFTETT

SEQ ID NO: 1082405 - protein, 9 aa, Homo Sapiens
TPVPLTGDS

SEQ ID NO: 1082406 - protein, 9 aa, Homo Sapiens
PYQLLFHNF

SEQ ID NO: 1082407 - protein, 9 aa, Homo Sapiens
IGLFLFGFL

SEQ ID NO: 1082408 - protein, 9 aa, Homo Sapiens
GSQVYVTFV

SEQ ID NO: 1082409 - protein, 9 aa, Homo Sapiens
FSGEYIPTV

SEQ ID NO: 1082410 - protein, 9 aa, Homo Sapiens
PKLLVNLWE

SEQ ID NO: 1082411 - protein, 9 aa, Homo Sapiens
QLCLRLNRV

SEQ ID NO: 1082412 - protein, 9 aa, Homo Sapiens
MGAAGLLEV

SEQ ID NO: 1082413 - protein, 9 aa, Homo Sapiens
LSEDVICLM

SEQ ID NO: 1082414 - protein, 9 aa, Homo Sapiens
NHQNFTVRA

SEQ ID NO: 1082415 - protein, 9 aa, Homo Sapiens
HQCDPKTGE

SEQ ID NO: 1082416 - protein, 9 aa, Homo Sapiens
NNLRFMGVC

SEQ ID NO: 1082417 - protein, 9 aa, Homo Sapiens
PLTGDSETA

SEQ ID NO: 1082418 - protein, 9 aa, Homo Sapiens
IRNVDQSLI

SEQ ID NO: 1082419 - protein, 9 aa, Homo Sapiens
ENAKKSPLL

SEQ ID NO: 1082420 - protein, 9 aa, Homo Sapiens
TFRGVAGAL

SEQ ID NO: 1082421 - protein, 9 aa, Homo Sapiens
RVIIPSSEI

SEQ ID NO: 1082422 - protein, 9 aa, Homo Sapiens
MPDNINPCL

SEQ ID NO: 1082423 - protein, 9 aa, Homo Sapiens
EELGKEIEA

SEQ ID NO: 1082424 - protein, 9 aa, Homo Sapiens
SEERAAEVR

SEQ ID NO: 1082425 - protein, 9 aa, Homo Sapiens
RSGPESGQS

SEQ ID NO: 1082426 - protein, 9 aa, Homo Sapiens
NGTIDMSVL

SEQ ID NO: 1082427 - protein, 9 aa, Homo Sapiens
RIQVCSCRN

SEQ ID NO: 1082428 - protein, 9 aa, Homo Sapiens
TSLQESHIT

SEQ ID NO: 1082429 - protein, 9 aa, Homo Sapiens
SPLLWDTKS

SEQ ID NO: 1082430 - protein, 9 aa, Homo Sapiens
PQAPSNDAS

SEQ ID NO: 1082431 - protein, 9 aa, Homo Sapiens
PLIEGPRVI

SEQ ID NO: 1082432 - protein, 9 aa, Homo Sapiens
KEIPFYFYV

SEQ ID NO: 1082433 - protein, 9 aa, Homo Sapiens
RTTNSTAKR

SEQ ID NO: 1082434 - protein, 9 aa, Homo Sapiens
LLVFHSPGK

SEQ ID NO: 1082435 - protein, 9 aa, Homo Sapiens
PISSKCVSR

SEQ ID NO: 1082436 - protein, 9 aa, Homo Sapiens
AECPGREAE

SEQ ID NO: 1082437 - protein, 9 aa, Homo Sapiens
WIPLLCWYQ

SEQ ID NO: 1082438 - protein, 9 aa, Homo Sapiens
KFSEERAAE

SEQ ID NO: 1082439 - protein, 9 aa, Homo Sapiens
CTAIKYHIS

SEQ ID NO: 1082440 - protein, 9 aa, Homo Sapiens
QSEGQCIPS

SEQ ID NO: 1082441 - protein, 9 aa, Homo Sapiens
GFRDILHRS

SEQ ID NO: 1082442 - protein, 9 aa, Homo Sapiens
FCGLLILSF

SEQ ID NO: 1082443 - protein, 9 aa, Homo Sapiens
RLVWQLASL

SEQ ID NO: 1082444 - protein, 9 aa, Homo Sapiens
DSLDLHKGT

SEQ ID NO: 1082445 - protein, 9 aa, Homo Sapiens
SRRSRLSVT

SEQ ID NO: 1082446 - protein, 9 aa, Homo Sapiens
VSNLPKEEK

SEQ ID NO: 1082447 - protein, 9 aa, Homo Sapiens
LRDNFLKFD

SEQ ID NO: 1082448 - protein, 9 aa, Homo Sapiens
NPEFVHGHR

SEQ ID NO: 1082449 - protein, 9 aa, Homo Sapiens
KKAQELSDW

SEQ ID NO: 1082450 - protein, 9 aa, Homo Sapiens
DPGTGAFSG

SEQ ID NO: 1082451 - protein, 9 aa, Homo Sapiens
SFIYSLRNR

SEQ ID NO: 1082452 - protein, 9 aa, Homo Sapiens
EDKQHFILF

SEQ ID NO: 1082453 - protein, 9 aa, Homo Sapiens
LARMNLLVA

SEQ ID NO: 1082454 - protein, 9 aa, Homo Sapiens
DEDQSSFNI

SEQ ID NO: 1082455 - protein, 9 aa, Homo Sapiens
HSKFTGEKE

SEQ ID NO: 1082456 - protein, 9 aa, Homo Sapiens
GSRGPPSQP

SEQ ID NO: 1082457 - protein, 9 aa, Homo Sapiens
TPPWREKYK

SEQ ID NO: 1082458 - protein, 9 aa, Homo Sapiens
LSEAQLSFI

SEQ ID NO: 1082459 - protein, 9 aa, Homo Sapiens
PTSQTIPAI

SEQ ID NO: 1082460 - protein, 9 aa, Homo Sapiens
ALEAITDKI

SEQ ID NO: 1082461 - protein, 9 aa, Homo Sapiens
ADTALTNTY

SEQ ID NO: 1082462 - protein, 9 aa, Homo Sapiens
STWLAVSLK

SEQ ID NO: 1082463 - protein, 9 aa, Homo Sapiens
QKAKSMEEF

SEQ ID NO: 1082464 - protein, 9 aa, Homo Sapiens
YISSNYVAP

SEQ ID NO: 1082465 - protein, 9 aa, Homo Sapiens
DYEAGEILF

SEQ ID NO: 1082466 - protein, 9 aa, Homo Sapiens
VIARFTPYK

SEQ ID NO: 1082467 - protein, 9 aa, Homo Sapiens
KVSRSLPEG

SEQ ID NO: 1082468 - protein, 9 aa, Homo Sapiens
LNSFIYSLR

SEQ ID NO: 1082469 - protein, 9 aa, Homo Sapiens
ENGEVKSYS

SEQ ID NO: 1082470 - protein, 9 aa, Homo Sapiens
EAAEKLIYD

SEQ ID NO: 1082471 - protein, 9 aa, Homo Sapiens
AEALAAVNI

SEQ ID NO: 1082472 - protein, 9 aa, Homo Sapiens
FPLEFRLYL

SEQ ID NO: 1082473 - protein, 9 aa, Homo Sapiens
FCGTAISNA

SEQ ID NO: 1082474 - protein, 9 aa, Homo Sapiens
PKTAENFCA

SEQ ID NO: 1082475 - protein, 9 aa, Homo Sapiens
LQGDGLLPA

SEQ ID NO: 1082476 - protein, 9 aa, Homo Sapiens
KIVLKQEVK

SEQ ID NO: 1082477 - protein, 9 aa, Homo Sapiens
QAECFQFKA

SEQ ID NO: 1082478 - protein, 9 aa, Homo Sapiens
LGFSLLKPL

SEQ ID NO: 1082479 - protein, 9 aa, Homo Sapiens
KRLTVASPD

SEQ ID NO: 1082480 - protein, 9 aa, Homo Sapiens
DHRKRGRFP

SEQ ID NO: 1082481 - protein, 9 aa, Homo Sapiens
MEKATLPLV

SEQ ID NO: 1082482 - protein, 9 aa, Homo Sapiens
GMRPSIQPV

SEQ ID NO: 1082483 - protein, 9 aa, Homo Sapiens
RSCMCWQLE

SEQ ID NO: 1082484 - protein, 9 aa, Homo Sapiens
RLLALNFLY

SEQ ID NO: 1082485 - protein, 9 aa, Homo Sapiens
QYQDPAAVF

SEQ ID NO: 1082486 - protein, 9 aa, Homo Sapiens
GLLEETAGK

SEQ ID NO: 1082487 - protein, 9 aa, Homo Sapiens
HGIVADCAV

SEQ ID NO: 1082488 - protein, 9 aa, Homo Sapiens
YPTPPPYSF

SEQ ID NO: 1082489 - protein, 9 aa, Homo Sapiens
RFLKVVKPF

SEQ ID NO: 1082490 - protein, 9 aa, Homo Sapiens
FPLGQWPGI

SEQ ID NO: 1082491 - protein, 9 aa, Homo Sapiens
TSTPSKGST

SEQ ID NO: 1082492 - protein, 9 aa, Homo Sapiens
PAVNYAPLN

SEQ ID NO: 1082493 - protein, 9 aa, Homo Sapiens
DLEDQDLDT

SEQ ID NO: 1082494 - protein, 9 aa, Homo Sapiens
ENGIEQRNT

SEQ ID NO: 1082495 - protein, 9 aa, Homo Sapiens
GKGIRVFGI

SEQ ID NO: 1082496 - protein, 9 aa, Homo Sapiens
GAVGDWGLF

SEQ ID NO: 1082497 - protein, 9 aa, Homo Sapiens
PKGSCVCGS

SEQ ID NO: 1082498 - protein, 9 aa, Homo Sapiens
VVLKGDNLS

SEQ ID NO: 1082499 - protein, 9 aa, Homo Sapiens
ESSKIPKSS

SEQ ID NO: 1082500 - protein, 9 aa, Homo Sapiens
FIRNMEKSY

SEQ ID NO: 1082501 - protein, 9 aa, Homo Sapiens
YSVRMNYTL

SEQ ID NO: 1082502 - protein, 9 aa, Homo Sapiens
LEGPFSIES

SEQ ID NO: 1082503 - protein, 9 aa, Homo Sapiens
VDECCFQSC

SEQ ID NO: 1082504 - protein, 9 aa, Homo Sapiens
LTFLVAQKN

SEQ ID NO: 1082505 - protein, 9 aa, Homo Sapiens
QKGYLDEKL

SEQ ID NO: 1082506 - protein, 9 aa, Homo Sapiens
DILVVWDNT

SEQ ID NO: 1082507 - protein, 9 aa, Homo Sapiens
WSYTKNNLY

SEQ ID NO: 1082508 - protein, 9 aa, Homo Sapiens
KAGTEPPGR

SEQ ID NO: 1082509 - protein, 9 aa, Homo Sapiens
LGLVVSLIG

SEQ ID NO: 1082510 - protein, 9 aa, Homo Sapiens
RDFAWETGA

SEQ ID NO: 1082511 - protein, 9 aa, Homo Sapiens
GSTFTSNLV

SEQ ID NO: 1082512 - protein, 9 aa, Homo Sapiens
QYWTVSQTG

SEQ ID NO: 1082513 - protein, 9 aa, Homo Sapiens
AKLKVEAPA

SEQ ID NO: 1082514 - protein, 9 aa, Homo Sapiens
GSPGYQGPS

SEQ ID NO: 1082515 - protein, 9 aa, Homo Sapiens
LGGSNSQVF

SEQ ID NO: 1082516 - protein, 9 aa, Homo Sapiens
CDHQLRSTV

SEQ ID NO: 1082517 - protein, 9 aa, Homo Sapiens
ADFYVAVSE

SEQ ID NO: 1082518 - protein, 9 aa, Homo Sapiens
KRANLCLSS

SEQ ID NO: 1082519 - protein, 9 aa, Homo Sapiens
QKQEEMWRQ

SEQ ID NO: 1082520 - protein, 9 aa, Homo Sapiens
LSFLKLCYT

SEQ ID NO: 1082521 - protein, 9 aa, Homo Sapiens
AGGSSLSHK

SEQ ID NO: 1082522 - protein, 9 aa, Homo Sapiens
LEAEAVFWA

SEQ ID NO: 1082523 - protein, 9 aa, Homo Sapiens
LDKTDAPRQ

SEQ ID NO: 1082524 - protein, 9 aa, Homo Sapiens
QTALKSLKK

SEQ ID NO: 1082525 - protein, 9 aa, Homo Sapiens
WNVGQFFSV

SEQ ID NO: 1082526 - protein, 9 aa, Homo Sapiens
SPIHKSEKF

SEQ ID NO: 1082527 - protein, 9 aa, Homo Sapiens
QLRSTVKED

SEQ ID NO: 1082528 - protein, 9 aa, Homo Sapiens
FSTVTVLKL

SEQ ID NO: 1082529 - protein, 9 aa, Homo Sapiens
KECLPGAWR

SEQ ID NO: 1082530 - protein, 9 aa, Homo Sapiens
QEKFEGLFR

SEQ ID NO: 1082531 - protein, 9 aa, Homo Sapiens
GPNGATGPP

SEQ ID NO: 1082532 - protein, 9 aa, Homo Sapiens
EIIKHFSQL

SEQ ID NO: 1082533 - protein, 9 aa, Homo Sapiens
GTGDLYTPG

SEQ ID NO: 1082534 - protein, 9 aa, Homo Sapiens
ERDESQKVS

SEQ ID NO: 1082535 - protein, 9 aa, Homo Sapiens
TILKVNDES

SEQ ID NO: 1082536 - protein, 9 aa, Homo Sapiens
FEPNHVIFK

SEQ ID NO: 1082537 - protein, 9 aa, Homo Sapiens
MQLQNEAIC

SEQ ID NO: 1082538 - protein, 9 aa, Homo Sapiens
RQFLLGSRR

SEQ ID NO: 1082539 - protein, 9 aa, Homo Sapiens
SGEIFGGQG

SEQ ID NO: 1082540 - protein, 9 aa, Homo Sapiens
VARPQFSAT

SEQ ID NO: 1082541 - protein, 9 aa, Homo Sapiens
PHLFLDSAD

SEQ ID NO: 1082542 - protein, 9 aa, Homo Sapiens
AKSMEEFQD

SEQ ID NO: 1082543 - protein, 9 aa, Homo Sapiens
NVDLIDIKV

SEQ ID NO: 1082544 - protein, 9 aa, Homo Sapiens
ARGLFPRDA

SEQ ID NO: 1082545 - protein, 9 aa, Homo Sapiens
HLFLQMEGH

SEQ ID NO: 1082546 - protein, 9 aa, Homo Sapiens
HIQGSYTYG

SEQ ID NO: 1082547 - protein, 9 aa, Homo Sapiens
QFQVSARNA

SEQ ID NO: 1082548 - protein, 9 aa, Homo Sapiens
GWHIQGSYT

SEQ ID NO: 1082549 - protein, 9 aa, Homo Sapiens
KKIYTGGKP

SEQ ID NO: 1082550 - protein, 9 aa, Homo Sapiens
VCHPRDLAA

SEQ ID NO: 1082551 - protein, 9 aa, Homo Sapiens
GDNNFSDSK

SEQ ID NO: 1082552 - protein, 9 aa, Homo Sapiens
LRVREEPLQ

SEQ ID NO: 1082553 - protein, 9 aa, Homo Sapiens
LVSVNIERV

SEQ ID NO: 1082554 - protein, 9 aa, Homo Sapiens
HTGVKSYEC

SEQ ID NO: 1082555 - protein, 9 aa, Homo Sapiens
FDVAPPRDM

SEQ ID NO: 1082556 - protein, 9 aa, Homo Sapiens
PFQALYYLS

SEQ ID NO: 1082557 - protein, 9 aa, Homo Sapiens
KVIPRTYEK

SEQ ID NO: 1082558 - protein, 9 aa, Homo Sapiens
SQYAHLCPG

SEQ ID NO: 1082559 - protein, 9 aa, Homo Sapiens
GLEGEHILN

SEQ ID NO: 1082560 - protein, 9 aa, Homo Sapiens
LTFKCHRRL

SEQ ID NO: 1082561 - protein, 9 aa, Homo Sapiens
KPKVSLSPP

SEQ ID NO: 1082562 - protein, 9 aa, Homo Sapiens
ITILGSMAL

SEQ ID NO: 1082563 - protein, 9 aa, Homo Sapiens
LRPSQFWGQ

SEQ ID NO: 1082564 - protein, 9 aa, Homo Sapiens
SVQFAPPQN

SEQ ID NO: 1082565 - protein, 9 aa, Homo Sapiens
SQLQYYRRV

SEQ ID NO: 1082566 - protein, 9 aa, Homo Sapiens
SEDVICLMI

SEQ ID NO: 1082567 - protein, 9 aa, Homo Sapiens
LEDPQQNQE

SEQ ID NO: 1082568 - protein, 9 aa, Homo Sapiens
RELAYGGHP

SEQ ID NO: 1082569 - protein, 9 aa, Homo Sapiens
AFVRFFVKI

SEQ ID NO: 1082570 - protein, 9 aa, Homo Sapiens
AVSEIMPEL

SEQ ID NO: 1082571 - protein, 9 aa, Homo Sapiens
GQTNPMLFH

SEQ ID NO: 1082572 - protein, 9 aa, Homo Sapiens
SEPGAIKVP

SEQ ID NO: 1082573 - protein, 9 aa, Homo Sapiens
GCHLSLGPA

SEQ ID NO: 1082574 - protein, 9 aa, Homo Sapiens
SSVLHGELS

SEQ ID NO: 1082575 - protein, 9 aa, Homo Sapiens
APGTYNEPQ

SEQ ID NO: 1082576 - protein, 9 aa, Homo Sapiens
EKFQLPEQK

SEQ ID NO: 1082577 - protein, 9 aa, Homo Sapiens
EHDLLSHEQ

SEQ ID NO: 1082578 - protein, 9 aa, Homo Sapiens
GLATEKSRW

SEQ ID NO: 1082579 - protein, 9 aa, Homo Sapiens
NITDLRIQV

SEQ ID NO: 1082580 - protein, 9 aa, Homo Sapiens
YFRCQCEPG

SEQ ID NO: 1082581 - protein, 9 aa, Homo Sapiens
RGCHVRSFT

SEQ ID NO: 1082582 - protein, 9 aa, Homo Sapiens
GSSRAIFFV

SEQ ID NO: 1082583 - protein, 9 aa, Homo Sapiens
NIQRPCKKS

SEQ ID NO: 1082584 - protein, 9 aa, Homo Sapiens
LLEKGFEAN

SEQ ID NO: 1082585 - protein, 9 aa, Homo Sapiens
QGSTNLAVY

SEQ ID NO: 1082586 - protein, 9 aa, Homo Sapiens
NDTDEENTE

SEQ ID NO: 1082587 - protein, 9 aa, Homo Sapiens
DKILHFAVA

SEQ ID NO: 1082588 - protein, 9 aa, Homo Sapiens
LWDTKSEPR

SEQ ID NO: 1082589 - protein, 9 aa, Homo Sapiens
LFNTSPGVP

SEQ ID NO: 1082590 - protein, 9 aa, Homo Sapiens
LPPRLTIYA

SEQ ID NO: 1082591 - protein, 9 aa, Homo Sapiens
LEDGQIDQF

SEQ ID NO: 1082592 - protein, 9 aa, Homo Sapiens
VVSCTPPFC

SEQ ID NO: 1082593 - protein, 9 aa, Homo Sapiens
IDNSQDKLR

SEQ ID NO: 1082594 - protein, 9 aa, Homo Sapiens
SPKALQKVK

SEQ ID NO: 1082595 - protein, 9 aa, Homo Sapiens
MTGKKEETK

SEQ ID NO: 1082596 - protein, 9 aa, Homo Sapiens
IVGPFYAVL

SEQ ID NO: 1082597 - protein, 9 aa, Homo Sapiens
PFLNLRTPR

SEQ ID NO: 1082598 - protein, 9 aa, Homo Sapiens
VSVLVISVC

SEQ ID NO: 1082599 - protein, 9 aa, Homo Sapiens
TVNCGDDRM

SEQ ID NO: 1082600 - protein, 9 aa, Homo Sapiens
RFHLPKKNP

SEQ ID NO: 1082601 - protein, 9 aa, Homo Sapiens
RFSSNIIVT

SEQ ID NO: 1082602 - protein, 9 aa, Homo Sapiens
QSPASKDST

SEQ ID NO: 1082603 - protein, 9 aa, Homo Sapiens
WKKKMVTSS

SEQ ID NO: 1082604 - protein, 9 aa, Homo Sapiens
KFQVVEGPP

SEQ ID NO: 1082605 - protein, 9 aa, Homo Sapiens
LTVVLSTNY

SEQ ID NO: 1082606 - protein, 9 aa, Homo Sapiens
KEAGESSSR

SEQ ID NO: 1082607 - protein, 9 aa, Homo Sapiens
LGLGHSQYS

SEQ ID NO: 1082608 - protein, 9 aa, Homo Sapiens
KRQRKLAPL

SEQ ID NO: 1082609 - protein, 9 aa, Homo Sapiens
FILSGSLDY

SEQ ID NO: 1082610 - protein, 9 aa, Homo Sapiens
NGRPTRADS

SEQ ID NO: 1082611 - protein, 9 aa, Homo Sapiens
VSGGSGRGC

SEQ ID NO: 1082612 - protein, 9 aa, Homo Sapiens
LFTRFVCVG

SEQ ID NO: 1082613 - protein, 9 aa, Homo Sapiens
GPSPNGPTS

SEQ ID NO: 1082614 - protein, 9 aa, Homo Sapiens
HIRTIHLRR

SEQ ID NO: 1082615 - protein, 9 aa, Homo Sapiens
GTQKYPSPL

SEQ ID NO: 1082616 - protein, 9 aa, Homo Sapiens
LLDYKGIHS

SEQ ID NO: 1082617 - protein, 9 aa, Homo Sapiens
ENPHLPPSL

SEQ ID NO: 1082618 - protein, 9 aa, Homo Sapiens
FFFYVALCL

SEQ ID NO: 1082619 - protein, 9 aa, Homo Sapiens
LIYQLVAKL

SEQ ID NO: 1082620 - protein, 9 aa, Homo Sapiens
ITLHFSYCA

SEQ ID NO: 1082621 - protein, 9 aa, Homo Sapiens
SGQSTNREH

SEQ ID NO: 1082622 - protein, 9 aa, Homo Sapiens
EYNQHTKKQ

SEQ ID NO: 1082623 - protein, 9 aa, Homo Sapiens
GHLKKALDY

SEQ ID NO: 1082624 - protein, 9 aa, Homo Sapiens
EHHTLRVQR

SEQ ID NO: 1082625 - protein, 9 aa, Homo Sapiens
DPDAQKKKE

SEQ ID NO: 1082626 - protein, 9 aa, Homo Sapiens
FEFCPELVN

SEQ ID NO: 1082627 - protein, 9 aa, Homo Sapiens
MNISQCDLS

SEQ ID NO: 1082628 - protein, 9 aa, Homo Sapiens
ISPLHSSDI

SEQ ID NO: 1082629 - protein, 9 aa, Homo Sapiens
PGDARPASA

SEQ ID NO: 1082630 - protein, 9 aa, Homo Sapiens
YWNVGQFFS

SEQ ID NO: 1082631 - protein, 9 aa, Homo Sapiens
PTGYIRFKK

SEQ ID NO: 1082632 - protein, 9 aa, Homo Sapiens
GFHVLYQED

SEQ ID NO: 1082633 - protein, 9 aa, Homo Sapiens
FYRALTPML

SEQ ID NO: 1082634 - protein, 9 aa, Homo Sapiens
GYCPRCQKL

SEQ ID NO: 1082635 - protein, 9 aa, Homo Sapiens
GINNRFSSE

SEQ ID NO: 1082636 - protein, 9 aa, Homo Sapiens
PMGPPSPFM

SEQ ID NO: 1082637 - protein, 9 aa, Homo Sapiens
LPEGEMKKG

SEQ ID NO: 1082638 - protein, 9 aa, Homo Sapiens
TEILLAVTI

SEQ ID NO: 1082639 - protein, 9 aa, Homo Sapiens
VLFDVEQNF

SEQ ID NO: 1082640 - protein, 9 aa, Homo Sapiens
IKLYVQIPP

SEQ ID NO: 1082641 - protein, 9 aa, Homo Sapiens
RISGVVEFS

SEQ ID NO: 1082642 - protein, 9 aa, Homo Sapiens
TFKCHRRLH

SEQ ID NO: 1082643 - protein, 9 aa, Homo Sapiens
QRKIPEELS

SEQ ID NO: 1082644 - protein, 9 aa, Homo Sapiens
QPTTQFDAQ

SEQ ID NO: 1082645 - protein, 9 aa, Homo Sapiens
EPPEILSDN

SEQ ID NO: 1082646 - protein, 9 aa, Homo Sapiens
SDESVLFMH

SEQ ID NO: 1082647 - protein, 9 aa, Homo Sapiens
KSSHSMTMT

SEQ ID NO: 1082648 - protein, 9 aa, Homo Sapiens
EQKAQKKIW

SEQ ID NO: 1082649 - protein, 9 aa, Homo Sapiens
YSWLITKER

SEQ ID NO: 1082650 - protein, 9 aa, Homo Sapiens
SSKAISREV

SEQ ID NO: 1082651 - protein, 9 aa, Homo Sapiens
RGSTFTSNL

SEQ ID NO: 1082652 - protein, 9 aa, Homo Sapiens
HDLNLGVFN

SEQ ID NO: 1082653 - protein, 9 aa, Homo Sapiens
IPFSDHSSD

SEQ ID NO: 1082654 - protein, 9 aa, Homo Sapiens
TVKKFLDLE

SEQ ID NO: 1082655 - protein, 9 aa, Homo Sapiens
NVTHQFTSS

SEQ ID NO: 1082656 - protein, 9 aa, Homo Sapiens
WFLHRKRHL

SEQ ID NO: 1082657 - protein, 9 aa, Homo Sapiens
WLSTVEHAH

SEQ ID NO: 1082658 - protein, 9 aa, Homo Sapiens
RIPVALPKN

SEQ ID NO: 1082659 - protein, 9 aa, Homo Sapiens
PFSDHSSDI

SEQ ID NO: 1082660 - protein, 9 aa, Homo Sapiens
CEHQCDPKT

SEQ ID NO: 1082661 - protein, 9 aa, Homo Sapiens
NLELHTLQD

SEQ ID NO: 1082662 - protein, 9 aa, Homo Sapiens
FTHVLPQTY

SEQ ID NO: 1082663 - protein, 9 aa, Homo Sapiens
LCKLKIVHS

SEQ ID NO: 1082664 - protein, 9 aa, Homo Sapiens
LSPIKDASP

SEQ ID NO: 1082665 - protein, 9 aa, Homo Sapiens
APRFSSNII

SEQ ID NO: 1082666 - protein, 9 aa, Homo Sapiens
LDKSLQVAE

SEQ ID NO: 1082667 - protein, 9 aa, Homo Sapiens
EPDDEEKSD

SEQ ID NO: 1082668 - protein, 9 aa, Homo Sapiens
LVLPVDPHS

SEQ ID NO: 1082669 - protein, 9 aa, Homo Sapiens
TENSKLCFH

SEQ ID NO: 1082670 - protein, 9 aa, Homo Sapiens
VKIVGHYSL

SEQ ID NO: 1082671 - protein, 9 aa, Homo Sapiens
DNLSQYRGV

SEQ ID NO: 1082672 - protein, 9 aa, Homo Sapiens
NNTFESLVL

SEQ ID NO: 1082673 - protein, 9 aa, Homo Sapiens
SPVQYFCYI

SEQ ID NO: 1082674 - protein, 9 aa, Homo Sapiens
MFSPIHKSE

SEQ ID NO: 1082675 - protein, 9 aa, Homo Sapiens
SYSSTFYSL

SEQ ID NO: 1082676 - protein, 9 aa, Homo Sapiens
TGDLYTPGF

SEQ ID NO: 1082677 - protein, 9 aa, Homo Sapiens
VQVVHDNQI

SEQ ID NO: 1082678 - protein, 9 aa, Homo Sapiens
HLQYPEGGK

SEQ ID NO: 1082679 - protein, 9 aa, Homo Sapiens
RPDLLLKMT

SEQ ID NO: 1082680 - protein, 9 aa, Homo Sapiens
APLPGEWKL

SEQ ID NO: 1082681 - protein, 9 aa, Homo Sapiens
ISLLTEEKH

SEQ ID NO: 1082682 - protein, 9 aa, Homo Sapiens
SVKNILTTK

SEQ ID NO: 1082683 - protein, 9 aa, Homo Sapiens
NPPLHLPAD

SEQ ID NO: 1082684 - protein, 9 aa, Homo Sapiens
LALFDNFSW

SEQ ID NO: 1082685 - protein, 9 aa, Homo Sapiens
WYIKGVDHI

SEQ ID NO: 1082686 - protein, 9 aa, Homo Sapiens
GTSCPALSL

SEQ ID NO: 1082687 - protein, 9 aa, Homo Sapiens
LPPPPTAQT

SEQ ID NO: 1082688 - protein, 9 aa, Homo Sapiens
LNTQNMCEL

SEQ ID NO: 1082689 - protein, 9 aa, Homo Sapiens
GNLVGALGN

SEQ ID NO: 1082690 - protein, 9 aa, Homo Sapiens
RFIPFLNLR

SEQ ID NO: 1082691 - protein, 9 aa, Homo Sapiens
DVKTDAQPQ

SEQ ID NO: 1082692 - protein, 9 aa, Homo Sapiens
HLNRFSVSE

SEQ ID NO: 1082693 - protein, 9 aa, Homo Sapiens
LLQKLQHVA

SEQ ID NO: 1082694 - protein, 9 aa, Homo Sapiens
RTFHLAQED

SEQ ID NO: 1082695 - protein, 9 aa, Homo Sapiens
VEVEGRALP

SEQ ID NO: 1082696 - protein, 9 aa, Homo Sapiens
IGGTLHPYQ

SEQ ID NO: 1082697 - protein, 9 aa, Homo Sapiens
MAVASSSYR

SEQ ID NO: 1082698 - protein, 9 aa, Homo Sapiens
FFEVAVNES

SEQ ID NO: 1082699 - protein, 9 aa, Homo Sapiens
IASFVKTYN

SEQ ID NO: 1082700 - protein, 9 aa, Homo Sapiens
LVYSQRKKK

SEQ ID NO: 1082701 - protein, 9 aa, Homo Sapiens
WKRNSCLRR

SEQ ID NO: 1082702 - protein, 9 aa, Homo Sapiens
SFGDPLFPR

SEQ ID NO: 1082703 - protein, 9 aa, Homo Sapiens
SAPAARWSF

SEQ ID NO: 1082704 - protein, 9 aa, Homo Sapiens
GSIIFLTMV

SEQ ID NO: 1082705 - protein, 9 aa, Homo Sapiens
MSNWNFLIF

SEQ ID NO: 1082706 - protein, 9 aa, Homo Sapiens
GPIGIPFSD

SEQ ID NO: 1082707 - protein, 9 aa, Homo Sapiens
FKGKKAHGP

SEQ ID NO: 1082708 - protein, 9 aa, Homo Sapiens
FKKNRLPLF

SEQ ID NO: 1082709 - protein, 9 aa, Homo Sapiens
SPQAPEGSQ

SEQ ID NO: 1082710 - protein, 9 aa, Homo Sapiens
SHNSSTHHP

SEQ ID NO: 1082711 - protein, 9 aa, Homo Sapiens
MIWIESMWC

SEQ ID NO: 1082712 - protein, 9 aa, Homo Sapiens
AKCTTCVEK

SEQ ID NO: 1082713 - protein, 9 aa, Homo Sapiens
SNERPGKKQ

SEQ ID NO: 1082714 - protein, 9 aa, Homo Sapiens
APSVLCSSS

SEQ ID NO: 1082715 - protein, 9 aa, Homo Sapiens
QVFFLLRTL

SEQ ID NO: 1082716 - protein, 9 aa, Homo Sapiens
VEKKDSKAR

SEQ ID NO: 1082717 - protein, 9 aa, Homo Sapiens
AHLKNFLEE

SEQ ID NO: 1082718 - protein, 9 aa, Homo Sapiens
FKDGGCVAP

SEQ ID NO: 1082719 - protein, 9 aa, Homo Sapiens
ILVFMVFSF

SEQ ID NO: 1082720 - protein, 9 aa, Homo Sapiens
DSGLPNNRF

SEQ ID NO: 1082721 - protein, 9 aa, Homo Sapiens
AQRFHLPKK

SEQ ID NO: 1082722 - protein, 9 aa, Homo Sapiens
KALRRAKTL

SEQ ID NO: 1082723 - protein, 9 aa, Homo Sapiens
WMHVRDNVK

SEQ ID NO: 1082724 - protein, 9 aa, Homo Sapiens
PKDDFNERP

SEQ ID NO: 1082725 - protein, 9 aa, Homo Sapiens
FTIFEKARH

SEQ ID NO: 1082726 - protein, 9 aa, Homo Sapiens
GTYNEPQTA

SEQ ID NO: 1082727 - protein, 9 aa, Homo Sapiens
PLPLMAYSF

SEQ ID NO: 1082728 - protein, 9 aa, Homo Sapiens
PIRCEKPYL

SEQ ID NO: 1082729 - protein, 9 aa, Homo Sapiens
NIRKKTDAH

SEQ ID NO: 1082730 - protein, 9 aa, Homo Sapiens
PGPPYNVRA

SEQ ID NO: 1082731 - protein, 9 aa, Homo Sapiens
QKMKKSLET

SEQ ID NO: 1082732 - protein, 9 aa, Homo Sapiens
EDYFKKHQQ

SEQ ID NO: 1082733 - protein, 9 aa, Homo Sapiens
RQKQEEMWR

SEQ ID NO: 1082734 - protein, 9 aa, Homo Sapiens
LFSPEKAPP

SEQ ID NO: 1082735 - protein, 9 aa, Homo Sapiens
KLAKAQPTH

SEQ ID NO: 1082736 - protein, 9 aa, Homo Sapiens
FLTVKKFLD

SEQ ID NO: 1082737 - protein, 9 aa, Homo Sapiens
DFNERPAKS

SEQ ID NO: 1082738 - protein, 9 aa, Homo Sapiens
NYPYSLKKA

SEQ ID NO: 1082739 - protein, 9 aa, Homo Sapiens
PMDFLENQE

SEQ ID NO: 1082740 - protein, 9 aa, Homo Sapiens
PRLRPGPGP

SEQ ID NO: 1082741 - protein, 9 aa, Homo Sapiens
CSTDQEKKI

SEQ ID NO: 1082742 - protein, 9 aa, Homo Sapiens
GSRGAGRVC

SEQ ID NO: 1082743 - protein, 9 aa, Homo Sapiens
TFLVAQKNF

SEQ ID NO: 1082744 - protein, 9 aa, Homo Sapiens
ANIQRPCKK

SEQ ID NO: 1082745 - protein, 9 aa, Homo Sapiens
KIVKGLFDG

SEQ ID NO: 1082746 - protein, 9 aa, Homo Sapiens
WVPAPAPSF

SEQ ID NO: 1082747 - protein, 9 aa, Homo Sapiens
LKFVFCPPD

SEQ ID NO: 1082748 - protein, 9 aa, Homo Sapiens
TPTSGPDAP

SEQ ID NO: 1082749 - protein, 9 aa, Homo Sapiens
QSGLLEETA

SEQ ID NO: 1082750 - protein, 9 aa, Homo Sapiens
KEKELVELL

SEQ ID NO: 1082751 - protein, 9 aa, Homo Sapiens
TLSIEDFEL

SEQ ID NO: 1082752 - protein, 9 aa, Homo Sapiens
EDLLLEQCM

SEQ ID NO: 1082753 - protein, 9 aa, Homo Sapiens
CCYRVNNNL

SEQ ID NO: 1082754 - protein, 9 aa, Homo Sapiens
TDAFKPGVR

SEQ ID NO: 1082755 - protein, 9 aa, Homo Sapiens
LCDLIESNY

SEQ ID NO: 1082756 - protein, 9 aa, Homo Sapiens
ILEDNWKQE

SEQ ID NO: 1082757 - protein, 9 aa, Homo Sapiens
HLNSSQNPY

SEQ ID NO: 1082758 - protein, 9 aa, Homo Sapiens
AKKSPLLWD

SEQ ID NO: 1082759 - protein, 9 aa, Homo Sapiens
SESTERELL

SEQ ID NO: 1082760 - protein, 9 aa, Homo Sapiens
TLNISKQWS

SEQ ID NO: 1082761 - protein, 9 aa, Homo Sapiens
VLEEYTGTN

SEQ ID NO: 1082762 - protein, 9 aa, Homo Sapiens
KEGEDEHSQ

SEQ ID NO: 1082763 - protein, 9 aa, Homo Sapiens
CAPLEPRLR

SEQ ID NO: 1082764 - protein, 9 aa, Homo Sapiens
GGHTISPSL

SEQ ID NO: 1082765 - protein, 9 aa, Homo Sapiens
LAGIGDQLE

SEQ ID NO: 1082766 - protein, 9 aa, Homo Sapiens
HLKKERDRY

SEQ ID NO: 1082767 - protein, 9 aa, Homo Sapiens
SFEKLRQPS

SEQ ID NO: 1082768 - protein, 9 aa, Homo Sapiens
LYRKNYSQR

SEQ ID NO: 1082769 - protein, 9 aa, Homo Sapiens
YAPLNLPGS

SEQ ID NO: 1082770 - protein, 9 aa, Homo Sapiens
SGYRIGPAK

SEQ ID NO: 1082771 - protein, 9 aa, Homo Sapiens
RANLCLSSS

SEQ ID NO: 1082772 - protein, 9 aa, Homo Sapiens
KTRETVENL

SEQ ID NO: 1082773 - protein, 9 aa, Homo Sapiens
AGEGPGYLP

SEQ ID NO: 1082774 - protein, 9 aa, Homo Sapiens
KDAVNPEST

SEQ ID NO: 1082775 - protein, 9 aa, Homo Sapiens
EPAVESSLT

SEQ ID NO: 1082776 - protein, 9 aa, Homo Sapiens
VQTRVDSVS

SEQ ID NO: 1082777 - protein, 9 aa, Homo Sapiens
LITYLGRHR

SEQ ID NO: 1082778 - protein, 9 aa, Homo Sapiens
PNNRFFAVR

SEQ ID NO: 1082779 - protein, 9 aa, Homo Sapiens
FRGVAGALR

SEQ ID NO: 1082780 - protein, 9 aa, Homo Sapiens
TLLMTACAS

SEQ ID NO: 1082781 - protein, 9 aa, Homo Sapiens
ISSNYVAPA

SEQ ID NO: 1082782 - protein, 9 aa, Homo Sapiens
RCAMLNPSN

SEQ ID NO: 1082783 - protein, 9 aa, Homo Sapiens
EVRSCMCWQ

SEQ ID NO: 1082784 - protein, 9 aa, Homo Sapiens
GAHEKVLPG

SEQ ID NO: 1082785 - protein, 9 aa, Homo Sapiens
SGREVFEFC

SEQ ID NO: 1082786 - protein, 9 aa, Homo Sapiens
GGSNSQVFA

SEQ ID NO: 1082787 - protein, 9 aa, Homo Sapiens
LQKYSSVPF

SEQ ID NO: 1082788 - protein, 9 aa, Homo Sapiens
VFPPSLITA

SEQ ID NO: 1082789 - protein, 9 aa, Homo Sapiens
LPNDTDGNH

SEQ ID NO: 1082790 - protein, 9 aa, Homo Sapiens
IEPHNAKFP

SEQ ID NO: 1082791 - protein, 9 aa, Homo Sapiens
RSGVEMERR

SEQ ID NO: 1082792 - protein, 9 aa, Homo Sapiens
ALSPSSVTY

SEQ ID NO: 1082793 - protein, 9 aa, Homo Sapiens
VVDSASKKA

SEQ ID NO: 1082794 - protein, 9 aa, Homo Sapiens
PNVTGVFLR

SEQ ID NO: 1082795 - protein, 9 aa, Homo Sapiens
FHLPKKNPE

SEQ ID NO: 1082796 - protein, 9 aa, Homo Sapiens
ASPSHISSV

SEQ ID NO: 1082797 - protein, 9 aa, Homo Sapiens
EEEGAAYSG

SEQ ID NO: 1082798 - protein, 9 aa, Homo Sapiens
LLQKIIHLL

SEQ ID NO: 1082799 - protein, 9 aa, Homo Sapiens
ARSGSPNQK

SEQ ID NO: 1082800 - protein, 9 aa, Homo Sapiens
QHENVNVRI

SEQ ID NO: 1082801 - protein, 9 aa, Homo Sapiens
SKFTGEKEE

SEQ ID NO: 1082802 - protein, 9 aa, Homo Sapiens
GPPGIPGIE

SEQ ID NO: 1082803 - protein, 9 aa, Homo Sapiens
RFHHVAQAR

SEQ ID NO: 1082804 - protein, 9 aa, Homo Sapiens
FSIESVMDP

SEQ ID NO: 1082805 - protein, 9 aa, Homo Sapiens
NTQNMCELS

SEQ ID NO: 1082806 - protein, 9 aa, Homo Sapiens
DCFTAICKP

SEQ ID NO: 1082807 - protein, 9 aa, Homo Sapiens
TVLKLLMTL

SEQ ID NO: 1082808 - protein, 9 aa, Homo Sapiens
NEETILSVD

SEQ ID NO: 1082809 - protein, 9 aa, Homo Sapiens
PYIESFINN

SEQ ID NO: 1082810 - protein, 9 aa, Homo Sapiens
KCNLSFCLT

SEQ ID NO: 1082811 - protein, 9 aa, Homo Sapiens
GHAVDTLLK

SEQ ID NO: 1082812 - protein, 9 aa, Homo Sapiens
LVSSAWLFP

SEQ ID NO: 1082813 - protein, 9 aa, Homo Sapiens
LVGALGNLT

SEQ ID NO: 1082814 - protein, 9 aa, Homo Sapiens
MSATGDRHS

SEQ ID NO: 1082815 - protein, 9 aa, Homo Sapiens
RPLTRARGA

SEQ ID NO: 1082816 - protein, 9 aa, Homo Sapiens
PGVYSLPHF

SEQ ID NO: 1082817 - protein, 9 aa, Homo Sapiens
ALHLDHNKL

SEQ ID NO: 1082818 - protein, 9 aa, Homo Sapiens
RRASEFSGP

SEQ ID NO: 1082819 - protein, 9 aa, Homo Sapiens
LWLHAPSLK

SEQ ID NO: 1082820 - protein, 9 aa, Homo Sapiens
GIDVKEVDS

SEQ ID NO: 1082821 - protein, 9 aa, Homo Sapiens
QEAPEGKTR

SEQ ID NO: 1082822 - protein, 9 aa, Homo Sapiens
DFGLATEKS

SEQ ID NO: 1082823 - protein, 9 aa, Homo Sapiens
NLIPQREKV

SEQ ID NO: 1082824 - protein, 9 aa, Homo Sapiens
KKPLQKYSS

SEQ ID NO: 1082825 - protein, 9 aa, Homo Sapiens
FLQGADHRP

SEQ ID NO: 1082826 - protein, 9 aa, Homo Sapiens
PTLQLKKKN

SEQ ID NO: 1082827 - protein, 9 aa, Homo Sapiens
KRVQFEEKL

SEQ ID NO: 1082828 - protein, 9 aa, Homo Sapiens
YAHLCPGPP

SEQ ID NO: 1082829 - protein, 9 aa, Homo Sapiens
VCDSSPSAH

SEQ ID NO: 1082830 - protein, 9 aa, Homo Sapiens
GIRVFGIAF

SEQ ID NO: 1082831 - protein, 9 aa, Homo Sapiens
ENWDPGTSA

SEQ ID NO: 1082832 - protein, 9 aa, Homo Sapiens
PLQNAPPLE

SEQ ID NO: 1082833 - protein, 9 aa, Homo Sapiens
SEFGQLTRF

SEQ ID NO: 1082834 - protein, 9 aa, Homo Sapiens
SKFLGEASI

SEQ ID NO: 1082835 - protein, 9 aa, Homo Sapiens
LCIILGESM

SEQ ID NO: 1082836 - protein, 9 aa, Homo Sapiens
WYSKGAFNG

SEQ ID NO: 1082837 - protein, 9 aa, Homo Sapiens
ILADSSSST

SEQ ID NO: 1082838 - protein, 9 aa, Homo Sapiens
FKEANTLDQ

SEQ ID NO: 1082839 - protein, 9 aa, Homo Sapiens
YPLCPEAPS

SEQ ID NO: 1082840 - protein, 9 aa, Homo Sapiens
EVRCRRYER

SEQ ID NO: 1082841 - protein, 9 aa, Homo Sapiens
RPEALQTTG

SEQ ID NO: 1082842 - protein, 9 aa, Homo Sapiens
QLKKKNIMD

SEQ ID NO: 1082843 - protein, 9 aa, Homo Sapiens
PLNLPGSAE

SEQ ID NO: 1082844 - protein, 9 aa, Homo Sapiens
MQMTPFSTQ

SEQ ID NO: 1082845 - protein, 9 aa, Homo Sapiens
YKCEECRKA

SEQ ID NO: 1082846 - protein, 9 aa, Homo Sapiens
NVVPCVLFV

SEQ ID NO: 1082847 - protein, 9 aa, Homo Sapiens
MQLEREDQR

SEQ ID NO: 1082848 - protein, 9 aa, Homo Sapiens
STLYIHSLA

SEQ ID NO: 1082849 - protein, 9 aa, Homo Sapiens
TRPTALTSL

SEQ ID NO: 1082850 - protein, 9 aa, Homo Sapiens
TDSKLYISL

SEQ ID NO: 1082851 - protein, 9 aa, Homo Sapiens
ISEMDAPPE

SEQ ID NO: 1082852 - protein, 9 aa, Homo Sapiens
SKTIQKGLE

SEQ ID NO: 1082853 - protein, 9 aa, Homo Sapiens
YSTVFRICV

SEQ ID NO: 1082854 - protein, 9 aa, Homo Sapiens
ASGKTSKFE

SEQ ID NO: 1082855 - protein, 9 aa, Homo Sapiens
CMKRHGILM

SEQ ID NO: 1082856 - protein, 9 aa, Homo Sapiens
KKELKSMKR

SEQ ID NO: 1082857 - protein, 9 aa, Homo Sapiens
SLNERESVI

SEQ ID NO: 1082858 - protein, 9 aa, Homo Sapiens
GLDLRVREE

SEQ ID NO: 1082859 - protein, 9 aa, Homo Sapiens
VQDVGRLEC

SEQ ID NO: 1082860 - protein, 9 aa, Homo Sapiens
LLWDTKSEP

SEQ ID NO: 1082861 - protein, 9 aa, Homo Sapiens
KDFWKKENN

SEQ ID NO: 1082862 - protein, 9 aa, Homo Sapiens
CEEADFSPS

SEQ ID NO: 1082863 - protein, 9 aa, Homo Sapiens
PQKPQPFPN

SEQ ID NO: 1082864 - protein, 9 aa, Homo Sapiens
SSRVCDCVE

SEQ ID NO: 1082865 - protein, 9 aa, Homo Sapiens
CAWCTAFRF

SEQ ID NO: 1082866 - protein, 9 aa, Homo Sapiens
KENETILST

SEQ ID NO: 1082867 - protein, 9 aa, Homo Sapiens
LAAVNIVSH

SEQ ID NO: 1082868 - protein, 9 aa, Homo Sapiens
EVVLCEDPL

SEQ ID NO: 1082869 - protein, 9 aa, Homo Sapiens
DIFFQPERI

SEQ ID NO: 1082870 - protein, 9 aa, Homo Sapiens
KLAPCGSTD

SEQ ID NO: 1082871 - protein, 9 aa, Homo Sapiens
KSKSCKFCG

SEQ ID NO: 1082872 - protein, 9 aa, Homo Sapiens
LSRIHDPKL

SEQ ID NO: 1082873 - protein, 9 aa, Homo Sapiens
DGQIDQFHK

SEQ ID NO: 1082874 - protein, 9 aa, Homo Sapiens
TAETEKGTV

SEQ ID NO: 1082875 - protein, 9 aa, Homo Sapiens
LRTEPQNNP

SEQ ID NO: 1082876 - protein, 9 aa, Homo Sapiens
TIGFENIAP

SEQ ID NO: 1082877 - protein, 9 aa, Homo Sapiens
MRKEVLEKR

SEQ ID NO: 1082878 - protein, 9 aa, Homo Sapiens
ALLVTMGIV

SEQ ID NO: 1082879 - protein, 9 aa, Homo Sapiens
NQTHPGLLI

SEQ ID NO: 1082880 - protein, 9 aa, Homo Sapiens
PYSFTPFMT

SEQ ID NO: 1082881 - protein, 9 aa, Homo Sapiens
TEKSRWSGS

SEQ ID NO: 1082882 - protein, 9 aa, Homo Sapiens
FSVSETGTT

SEQ ID NO: 1082883 - protein, 9 aa, Homo Sapiens
RASVYLEEG

SEQ ID NO: 1082884 - protein, 9 aa, Homo Sapiens
CDGDNDCRN

SEQ ID NO: 1082885 - protein, 9 aa, Homo Sapiens
VDFYNKKMD

SEQ ID NO: 1082886 - protein, 9 aa, Homo Sapiens
PGMFNSSLY

SEQ ID NO: 1082887 - protein, 9 aa, Homo Sapiens
SLRGKALGV

SEQ ID NO: 1082888 - protein, 9 aa, Homo Sapiens
RRDLARAPP

SEQ ID NO: 1082889 - protein, 9 aa, Homo Sapiens
LFPWLNNQE

SEQ ID NO: 1082890 - protein, 9 aa, Homo Sapiens
VIRVPDHTC

SEQ ID NO: 1082891 - protein, 9 aa, Homo Sapiens
SEENFPDEK

SEQ ID NO: 1082892 - protein, 9 aa, Homo Sapiens
ILQVLSQMK

SEQ ID NO: 1082893 - protein, 9 aa, Homo Sapiens
SFNPLEDND

SEQ ID NO: 1082894 - protein, 9 aa, Homo Sapiens
FLFAAENEQ

SEQ ID NO: 1082895 - protein, 9 aa, Homo Sapiens
IHTGVKSYE

SEQ ID NO: 1082896 - protein, 9 aa, Homo Sapiens
EGNQYGEVI

SEQ ID NO: 1082897 - protein, 9 aa, Homo Sapiens
LQKYLDAIK

SEQ ID NO: 1082898 - protein, 9 aa, Homo Sapiens
TVILKISKT

SEQ ID NO: 1082899 - protein, 9 aa, Homo Sapiens
GSMGGPSRR

SEQ ID NO: 1082900 - protein, 9 aa, Homo Sapiens
CFSGHRPPD

SEQ ID NO: 1082901 - protein, 9 aa, Homo Sapiens
KKKNISLEH

SEQ ID NO: 1082902 - protein, 9 aa, Homo Sapiens
SSSDAQVSK

SEQ ID NO: 1082903 - protein, 9 aa, Homo Sapiens
EMDIQKCRR

SEQ ID NO: 1082904 - protein, 9 aa, Homo Sapiens
GQSTNREHD

SEQ ID NO: 1082905 - protein, 9 aa, Homo Sapiens
SLSMHPKLA

SEQ ID NO: 1082906 - protein, 9 aa, Homo Sapiens
YFVTVAAYT

SEQ ID NO: 1082907 - protein, 9 aa, Homo Sapiens
FETSFCVDF

SEQ ID NO: 1082908 - protein, 9 aa, Homo Sapiens
IPKSSSDKV

SEQ ID NO: 1082909 - protein, 9 aa, Homo Sapiens
TSCRGGPPV

SEQ ID NO: 1082910 - protein, 9 aa, Homo Sapiens
FSGRDISGP

SEQ ID NO: 1082911 - protein, 9 aa, Homo Sapiens
CFTAICKPL

SEQ ID NO: 1082912 - protein, 9 aa, Homo Sapiens
LHGFSILER

SEQ ID NO: 1082913 - protein, 9 aa, Homo Sapiens
CQEIANICS

SEQ ID NO: 1082914 - protein, 9 aa, Homo Sapiens
SQGLKDKVL

SEQ ID NO: 1082915 - protein, 9 aa, Homo Sapiens
EIGIVTRNE

SEQ ID NO: 1082916 - protein, 9 aa, Homo Sapiens
FMGQLLQLQ

SEQ ID NO: 1082917 - protein, 9 aa, Homo Sapiens
TKHLLAMYP

SEQ ID NO: 1082918 - protein, 9 aa, Homo Sapiens
SRAAGSAQE

SEQ ID NO: 1082919 - protein, 9 aa, Homo Sapiens
TIGGNAEGQ

SEQ ID NO: 1082920 - protein, 9 aa, Homo Sapiens
DNVDHIDSF

SEQ ID NO: 1082921 - protein, 9 aa, Homo Sapiens
NGNVPVENL

SEQ ID NO: 1082922 - protein, 9 aa, Homo Sapiens
NSSETSSEA

SEQ ID NO: 1082923 - protein, 9 aa, Homo Sapiens
STVLSSLLS

SEQ ID NO: 1082924 - protein, 9 aa, Homo Sapiens
MLNYEEYCT

SEQ ID NO: 1082925 - protein, 9 aa, Homo Sapiens
GHGRNHHRS

SEQ ID NO: 1082926 - protein, 9 aa, Homo Sapiens
TPPSPAGPA

SEQ ID NO: 1082927 - protein, 9 aa, Homo Sapiens
KMASNYLSG

SEQ ID NO: 1082928 - protein, 9 aa, Homo Sapiens
GSRLFRTYR

SEQ ID NO: 1082929 - protein, 9 aa, Homo Sapiens
QGSYTYGFN

SEQ ID NO: 1082930 - protein, 9 aa, Homo Sapiens
RTMKFYFAI

SEQ ID NO: 1082931 - protein, 9 aa, Homo Sapiens
CNQKGGSEC

SEQ ID NO: 1082932 - protein, 9 aa, Homo Sapiens
AAAAFRHPF

SEQ ID NO: 1082933 - protein, 9 aa, Homo Sapiens
PAFCLDPEG

SEQ ID NO: 1082934 - protein, 9 aa, Homo Sapiens
CELFPLEFR

SEQ ID NO: 1082935 - protein, 9 aa, Homo Sapiens
ESVFEGEGP

SEQ ID NO: 1082936 - protein, 9 aa, Homo Sapiens
VFLGSDRLV

SEQ ID NO: 1082937 - protein, 9 aa, Homo Sapiens
WSRMSNQFL

SEQ ID NO: 1082938 - protein, 9 aa, Homo Sapiens
KKEKIVNRQ

SEQ ID NO: 1082939 - protein, 9 aa, Homo Sapiens
KPHLPTHLS

SEQ ID NO: 1082940 - protein, 9 aa, Homo Sapiens
TESSHLARS

SEQ ID NO: 1082941 - protein, 9 aa, Homo Sapiens
WGKAPCLSP

SEQ ID NO: 1082942 - protein, 9 aa, Homo Sapiens
CNLLGADAV

SEQ ID NO: 1082943 - protein, 9 aa, Homo Sapiens
GVIGGLVIL

SEQ ID NO: 1082944 - protein, 9 aa, Homo Sapiens
PPPPGLKQF

SEQ ID NO: 1082945 - protein, 9 aa, Homo Sapiens
LDYERSQTH

SEQ ID NO: 1082946 - protein, 9 aa, Homo Sapiens
CQSPPGVLR

SEQ ID NO: 1082947 - protein, 9 aa, Homo Sapiens
PGREAEQGG

SEQ ID NO: 1082948 - protein, 9 aa, Homo Sapiens
AKEIKLYVQ

SEQ ID NO: 1082949 - protein, 9 aa, Homo Sapiens
AIKTLRSKM

SEQ ID NO: 1082950 - protein, 9 aa, Homo Sapiens
SSCVWVGWV

SEQ ID NO: 1082951 - protein, 9 aa, Homo Sapiens
KIAHFQKEL

SEQ ID NO: 1082952 - protein, 9 aa, Homo Sapiens
SDTSLHSLM

SEQ ID NO: 1082953 - protein, 9 aa, Homo Sapiens
IFATIVENV

SEQ ID NO: 1082954 - protein, 9 aa, Homo Sapiens
FTENSKLCF

SEQ ID NO: 1082955 - protein, 9 aa, Homo Sapiens
YSLVFKEAN

SEQ ID NO: 1082956 - protein, 9 aa, Homo Sapiens
LPLEYSYGK

SEQ ID NO: 1082957 - protein, 9 aa, Homo Sapiens
VLWSRMSNQ

SEQ ID NO: 1082958 - protein, 9 aa, Homo Sapiens
LLYELQPAA

SEQ ID NO: 1082959 - protein, 9 aa, Homo Sapiens
PEGLAEFQE

SEQ ID NO: 1082960 - protein, 9 aa, Homo Sapiens
RKRTLLDYK

SEQ ID NO: 1082961 - protein, 9 aa, Homo Sapiens
GSLSMHPKL

SEQ ID NO: 1082962 - protein, 9 aa, Homo Sapiens
HLLAMYPNL

SEQ ID NO: 1082963 - protein, 9 aa, Homo Sapiens
KNVYFLQNA

SEQ ID NO: 1082964 - protein, 9 aa, Homo Sapiens
KLTDQIFEG

SEQ ID NO: 1082965 - protein, 9 aa, Homo Sapiens
RSPAPPPSA

SEQ ID NO: 1082966 - protein, 9 aa, Homo Sapiens
EEPLQVERT

SEQ ID NO: 1082967 - protein, 9 aa, Homo Sapiens
FWEFVIATF

SEQ ID NO: 1082968 - protein, 9 aa, Homo Sapiens
IDPNFASPA

SEQ ID NO: 1082969 - protein, 9 aa, Homo Sapiens
GNQYGEVIH

SEQ ID NO: 1082970 - protein, 9 aa, Homo Sapiens
KKAVKAIIS

SEQ ID NO: 1082971 - protein, 9 aa, Homo Sapiens
EVKAESFNL

SEQ ID NO: 1082972 - protein, 9 aa, Homo Sapiens
AASGMQACV

SEQ ID NO: 1082973 - protein, 9 aa, Homo Sapiens
CKAAMRHQR

SEQ ID NO: 1082974 - protein, 9 aa, Homo Sapiens
SFILSGSLD

SEQ ID NO: 1082975 - protein, 9 aa, Homo Sapiens
MKFYFAINH

SEQ ID NO: 1082976 - protein, 9 aa, Homo Sapiens
ETPKSVDPG

SEQ ID NO: 1082977 - protein, 9 aa, Homo Sapiens
LPSVSRVGY

SEQ ID NO: 1082978 - protein, 9 aa, Homo Sapiens
LADGSQEQK

SEQ ID NO: 1082979 - protein, 9 aa, Homo Sapiens
ILIKAWEHC

SEQ ID NO: 1082980 - protein, 9 aa, Homo Sapiens
PGSPSNSFI

SEQ ID NO: 1082981 - protein, 9 aa, Homo Sapiens
VSRSRTQLF

SEQ ID NO: 1082982 - protein, 9 aa, Homo Sapiens
VYNHLSSEI

SEQ ID NO: 1082983 - protein, 9 aa, Homo Sapiens
RSSGEQGVK

SEQ ID NO: 1082984 - protein, 9 aa, Homo Sapiens
TQDLVQKKY

SEQ ID NO: 1082985 - protein, 9 aa, Homo Sapiens
SKQNPSSLL

SEQ ID NO: 1082986 - protein, 9 aa, Homo Sapiens
LISSSKTLL

SEQ ID NO: 1082987 - protein, 9 aa, Homo Sapiens
ILKMIRQGK

SEQ ID NO: 1082988 - protein, 9 aa, Homo Sapiens
CVLALVQDV

SEQ ID NO: 1082989 - protein, 9 aa, Homo Sapiens
QKHDKEDYP

SEQ ID NO: 1082990 - protein, 9 aa, Homo Sapiens
PVCRSLIQL

SEQ ID NO: 1082991 - protein, 9 aa, Homo Sapiens
HSQRLNSHS

SEQ ID NO: 1082992 - protein, 9 aa, Homo Sapiens
CRAKCRQQQ

SEQ ID NO: 1082993 - protein, 9 aa, Homo Sapiens
IFSGQQIFA

SEQ ID NO: 1082994 - protein, 9 aa, Homo Sapiens
RAYLWCKEC

SEQ ID NO: 1082995 - protein, 9 aa, Homo Sapiens
ERTRGSTAY

SEQ ID NO: 1082996 - protein, 9 aa, Homo Sapiens
LEYSYGKYR

SEQ ID NO: 1082997 - protein, 9 aa, Homo Sapiens
CWAMAVASS

SEQ ID NO: 1082998 - protein, 9 aa, Homo Sapiens
SCPDTAPPS

SEQ ID NO: 1082999 - protein, 9 aa, Homo Sapiens
THRQGLQTP

SEQ ID NO: 1083000 - protein, 9 aa, Homo Sapiens
HEHTRPDQD

SEQ ID NO: 1083001 - protein, 9 aa, Homo Sapiens
YIPSSHFVS

SEQ ID NO: 1083002 - protein, 9 aa, Homo Sapiens
PPGPAFQSL

SEQ ID NO: 1083003 - protein, 9 aa, Homo Sapiens
AVLLEATFL

SEQ ID NO: 1083004 - protein, 9 aa, Homo Sapiens
SSTERHKAF

SEQ ID NO: 1083005 - protein, 9 aa, Homo Sapiens
LIYGFPPSF

SEQ ID NO: 1083006 - protein, 9 aa, Homo Sapiens
SYTYGFNDI

SEQ ID NO: 1083007 - protein, 9 aa, Homo Sapiens
AIQCRADQF

SEQ ID NO: 1083008 - protein, 9 aa, Homo Sapiens
GFGAVYAAL

SEQ ID NO: 1083009 - protein, 9 aa, Homo Sapiens
SYRLDLDCG

SEQ ID NO: 1083010 - protein, 9 aa, Homo Sapiens
CLQSESWVL

SEQ ID NO: 1083011 - protein, 9 aa, Homo Sapiens
PGVSIRTLA

SEQ ID NO: 1083012 - protein, 9 aa, Homo Sapiens
QTHPGLLIS

SEQ ID NO: 1083013 - protein, 9 aa, Homo Sapiens
LSQLCEDPQ

SEQ ID NO: 1083014 - protein, 9 aa, Homo Sapiens
STTRNTTLN

SEQ ID NO: 1083015 - protein, 9 aa, Homo Sapiens
SCICPGQYN

SEQ ID NO: 1083016 - protein, 9 aa, Homo Sapiens
AFSGTRTPD

SEQ ID NO: 1083017 - protein, 9 aa, Homo Sapiens
AAVFGYLTF

SEQ ID NO: 1083018 - protein, 9 aa, Homo Sapiens
RFQEQEVLE

SEQ ID NO: 1083019 - protein, 9 aa, Homo Sapiens
HLSLGPAPG

SEQ ID NO: 1083020 - protein, 9 aa, Homo Sapiens
FYVADNNEK

SEQ ID NO: 1083021 - protein, 9 aa, Homo Sapiens
LASGTRLVL

SEQ ID NO: 1083022 - protein, 9 aa, Homo Sapiens
TPGSFKLEK

SEQ ID NO: 1083023 - protein, 9 aa, Homo Sapiens
FEEAWRRTR

SEQ ID NO: 1083024 - protein, 9 aa, Homo Sapiens
FCCQLHHAE

SEQ ID NO: 1083025 - protein, 9 aa, Homo Sapiens
ALQKVKAAI

SEQ ID NO: 1083026 - protein, 9 aa, Homo Sapiens
KTWQKKLAE

SEQ ID NO: 1083027 - protein, 9 aa, Homo Sapiens
DNGLLSALL

SEQ ID NO: 1083028 - protein, 9 aa, Homo Sapiens
NEDKILHFA

SEQ ID NO: 1083029 - protein, 9 aa, Homo Sapiens
KRGKLTLPK

SEQ ID NO: 1083030 - protein, 9 aa, Homo Sapiens
TLSQLAGKW

SEQ ID NO: 1083031 - protein, 9 aa, Homo Sapiens
SELKAIRPS

SEQ ID NO: 1083032 - protein, 9 aa, Homo Sapiens
DLGTILKVN

SEQ ID NO: 1083033 - protein, 9 aa, Homo Sapiens
ENGYDFLEV

SEQ ID NO: 1083034 - protein, 9 aa, Homo Sapiens
EPISQYSIP

SEQ ID NO: 1083035 - protein, 9 aa, Homo Sapiens
RNKEQSGDG

SEQ ID NO: 1083036 - protein, 9 aa, Homo Sapiens
LKLTSEEKS

SEQ ID NO: 1083037 - protein, 9 aa, Homo Sapiens
SDSEEPPEI

SEQ ID NO: 1083038 - protein, 9 aa, Homo Sapiens
QFFLGGAPT

SEQ ID NO: 1083039 - protein, 9 aa, Homo Sapiens
GRNHHRSHS

SEQ ID NO: 1083040 - protein, 9 aa, Homo Sapiens
YLCTEKSNG

SEQ ID NO: 1083041 - protein, 9 aa, Homo Sapiens
CTLDYSKRD

SEQ ID NO: 1083042 - protein, 9 aa, Homo Sapiens
LIESNYPIV

SEQ ID NO: 1083043 - protein, 9 aa, Homo Sapiens
LQILILVLK

SEQ ID NO: 1083044 - protein, 9 aa, Homo Sapiens
SQIGTLRLA

SEQ ID NO: 1083045 - protein, 9 aa, Homo Sapiens
SVSFSLNHV

SEQ ID NO: 1083046 - protein, 9 aa, Homo Sapiens
ENEPSGREL

SEQ ID NO: 1083047 - protein, 9 aa, Homo Sapiens
RAKKRKINK

SEQ ID NO: 1083048 - protein, 9 aa, Homo Sapiens
KGILENQSG

SEQ ID NO: 1083049 - protein, 9 aa, Homo Sapiens
LSSLRDPGQ

SEQ ID NO: 1083050 - protein, 9 aa, Homo Sapiens
SWILQRCQC

SEQ ID NO: 1083051 - protein, 9 aa, Homo Sapiens
IRQKKKTVI

SEQ ID NO: 1083052 - protein, 9 aa, Homo Sapiens
WHCRVEQGV

SEQ ID NO: 1083053 - protein, 9 aa, Homo Sapiens
VNKGRKSFP

SEQ ID NO: 1083054 - protein, 9 aa, Homo Sapiens
PLRNPELVA

SEQ ID NO: 1083055 - protein, 9 aa, Homo Sapiens
GYRDHSESS

SEQ ID NO: 1083056 - protein, 9 aa, Homo Sapiens
ESIAQSIDN

SEQ ID NO: 1083057 - protein, 9 aa, Homo Sapiens
LLNPLWSTA

SEQ ID NO: 1083058 - protein, 9 aa, Homo Sapiens
CEDPLSGFG

SEQ ID NO: 1083059 - protein, 9 aa, Homo Sapiens
ARALCEGRE

SEQ ID NO: 1083060 - protein, 9 aa, Homo Sapiens
LEFFLFVGF

SEQ ID NO: 1083061 - protein, 9 aa, Homo Sapiens
RTQDGTAQS

SEQ ID NO: 1083062 - protein, 9 aa, Homo Sapiens
LCHNLIRRN

SEQ ID NO: 1083063 - protein, 9 aa, Homo Sapiens
FIVIFCLET

SEQ ID NO: 1083064 - protein, 9 aa, Homo Sapiens
DCFMEIKSF

SEQ ID NO: 1083065 - protein, 9 aa, Homo Sapiens
ENQEDIHNL

SEQ ID NO: 1083066 - protein, 9 aa, Homo Sapiens
QARIEELGK

SEQ ID NO: 1083067 - protein, 9 aa, Homo Sapiens
ELSKTWIRS

SEQ ID NO: 1083068 - protein, 9 aa, Homo Sapiens
LVKNNGEPP

SEQ ID NO: 1083069 - protein, 9 aa, Homo Sapiens
MVQENGQRI

SEQ ID NO: 1083070 - protein, 9 aa, Homo Sapiens
SHGRAPPDG

SEQ ID NO: 1083071 - protein, 9 aa, Homo Sapiens
LQTWQKMLA

SEQ ID NO: 1083072 - protein, 9 aa, Homo Sapiens
YYLSFLRVL

SEQ ID NO: 1083073 - protein, 9 aa, Homo Sapiens
YFYVADNNE

SEQ ID NO: 1083074 - protein, 9 aa, Homo Sapiens
FCSLQGDFC

SEQ ID NO: 1083075 - protein, 9 aa, Homo Sapiens
QCLSTIISL

SEQ ID NO: 1083076 - protein, 9 aa, Homo Sapiens
PSGEVFFEG

SEQ ID NO: 1083077 - protein, 9 aa, Homo Sapiens
FLFPGPHKL

SEQ ID NO: 1083078 - protein, 9 aa, Homo Sapiens
NCITIHSAT

SEQ ID NO: 1083079 - protein, 9 aa, Homo Sapiens
GDLLTPPAS

SEQ ID NO: 1083080 - protein, 9 aa, Homo Sapiens
NMSKFLGEA

SEQ ID NO: 1083081 - protein, 9 aa, Homo Sapiens
VENLEDPQQ

SEQ ID NO: 1083082 - protein, 9 aa, Homo Sapiens
YDDIVTRSQ

SEQ ID NO: 1083083 - protein, 9 aa, Homo Sapiens
SGTYDCTAT

SEQ ID NO: 1083084 - protein, 9 aa, Homo Sapiens
PLSLYVMHS

SEQ ID NO: 1083085 - protein, 9 aa, Homo Sapiens
VKGSKLDLK

SEQ ID NO: 1083086 - protein, 9 aa, Homo Sapiens
DLGQNAWLS

SEQ ID NO: 1083087 - protein, 9 aa, Homo Sapiens
ALQLSSHSG

SEQ ID NO: 1083088 - protein, 9 aa, Homo Sapiens
QIDLNWVVL

SEQ ID NO: 1083089 - protein, 9 aa, Homo Sapiens
VFISHNSCT

SEQ ID NO: 1083090 - protein, 9 aa, Homo Sapiens
DTLSPALSP

SEQ ID NO: 1083091 - protein, 9 aa, Homo Sapiens
CTSWDQLGR

SEQ ID NO: 1083092 - protein, 9 aa, Homo Sapiens
KHGVAPLAT

SEQ ID NO: 1083093 - protein, 9 aa, Homo Sapiens
LCWRKTVRV

SEQ ID NO: 1083094 - protein, 9 aa, Homo Sapiens
HFIMGSEGI

SEQ ID NO: 1083095 - protein, 9 aa, Homo Sapiens
AIKQGSKDN

SEQ ID NO: 1083096 - protein, 9 aa, Homo Sapiens
NLDIKPSNV

SEQ ID NO: 1083097 - protein, 9 aa, Homo Sapiens
GGGQSGMFC

SEQ ID NO: 1083098 - protein, 9 aa, Homo Sapiens
TFGSSAGEL

SEQ ID NO: 1083099 - protein, 9 aa, Homo Sapiens
LHFWVTILS

SEQ ID NO: 1083100 - protein, 9 aa, Homo Sapiens
PTPPPYSFT

SEQ ID NO: 1083101 - protein, 9 aa, Homo Sapiens
KKEIKKNEK

SEQ ID NO: 1083102 - protein, 9 aa, Homo Sapiens
RGPKNSKRL

SEQ ID NO: 1083103 - protein, 9 aa, Homo Sapiens
LKNHFRLHA

SEQ ID NO: 1083104 - protein, 9 aa, Homo Sapiens
EDETSNSTW

SEQ ID NO: 1083105 - protein, 9 aa, Homo Sapiens
LQNVDKALL

SEQ ID NO: 1083106 - protein, 9 aa, Homo Sapiens
PLSTAEITR

SEQ ID NO: 1083107 - protein, 9 aa, Homo Sapiens
DILYASNNV

SEQ ID NO: 1083108 - protein, 9 aa, Homo Sapiens
ELKEGYQCP

SEQ ID NO: 1083109 - protein, 9 aa, Homo Sapiens
QLLSRKCGQ

SEQ ID NO: 1083110 - protein, 9 aa, Homo Sapiens
NNEETILSV

SEQ ID NO: 1083111 - protein, 9 aa, Homo Sapiens
EEARQRGFR

SEQ ID NO: 1083112 - protein, 9 aa, Homo Sapiens
ETFEVVEMV

SEQ ID NO: 1083113 - protein, 9 aa, Homo Sapiens
QQIKDFTKN

SEQ ID NO: 1083114 - protein, 9 aa, Homo Sapiens
VAFMENSVM

SEQ ID NO: 1083115 - protein, 9 aa, Homo Sapiens
QCFSGHRPP

SEQ ID NO: 1083116 - protein, 9 aa, Homo Sapiens
DVPILIPEI

SEQ ID NO: 1083117 - protein, 9 aa, Homo Sapiens
YREDNPTAV

SEQ ID NO: 1083118 - protein, 9 aa, Homo Sapiens
NSLFSVSLP

SEQ ID NO: 1083119 - protein, 9 aa, Homo Sapiens
LKCADINRD

SEQ ID NO: 1083120 - protein, 9 aa, Homo Sapiens
PSMNPDGYK

SEQ ID NO: 1083121 - protein, 9 aa, Homo Sapiens
LQEDTLFDV

SEQ ID NO: 1083122 - protein, 9 aa, Homo Sapiens
HTAEKPNKC

SEQ ID NO: 1083123 - protein, 9 aa, Homo Sapiens
ALLFLFPGP

SEQ ID NO: 1083124 - protein, 9 aa, Homo Sapiens
NVPVENLED

SEQ ID NO: 1083125 - protein, 9 aa, Homo Sapiens
SDLEAVLEA

SEQ ID NO: 1083126 - protein, 9 aa, Homo Sapiens
PSPSARDGV

SEQ ID NO: 1083127 - protein, 9 aa, Homo Sapiens
PRLTIYAPP

SEQ ID NO: 1083128 - protein, 9 aa, Homo Sapiens
LTQRLEALR

SEQ ID NO: 1083129 - protein, 9 aa, Homo Sapiens
FQALYYLSF

SEQ ID NO: 1083130 - protein, 9 aa, Homo Sapiens
TSCYCLLNP

SEQ ID NO: 1083131 - protein, 9 aa, Homo Sapiens
LVEEELDRV

SEQ ID NO: 1083132 - protein, 9 aa, Homo Sapiens
LPGFTETTA

SEQ ID NO: 1083133 - protein, 9 aa, Homo Sapiens
TRKKYHERM

SEQ ID NO: 1083134 - protein, 9 aa, Homo Sapiens
LARLHGFSI

SEQ ID NO: 1083135 - protein, 9 aa, Homo Sapiens
LDYEAGEIL

SEQ ID NO: 1083136 - protein, 9 aa, Homo Sapiens
ILVAEVQAW

SEQ ID NO: 1083137 - protein, 9 aa, Homo Sapiens
LCEFKAYEN

SEQ ID NO: 1083138 - protein, 9 aa, Homo Sapiens
VEVPAFAFS

SEQ ID NO: 1083139 - protein, 9 aa, Homo Sapiens
SVLVFKKEK

SEQ ID NO: 1083140 - protein, 9 aa, Homo Sapiens
QLLQLQPEP

SEQ ID NO: 1083141 - protein, 9 aa, Homo Sapiens
KYGDLLMYI

SEQ ID NO: 1083142 - protein, 9 aa, Homo Sapiens
FRHLLHLLR

SEQ ID NO: 1083143 - protein, 9 aa, Homo Sapiens
LIIAHWLST

SEQ ID NO: 1083144 - protein, 9 aa, Homo Sapiens
MVFSFIIGR

SEQ ID NO: 1083145 - protein, 9 aa, Homo Sapiens
KNSTIEYNG

SEQ ID NO: 1083146 - protein, 9 aa, Homo Sapiens
PDQGFIKFS

SEQ ID NO: 1083147 - protein, 9 aa, Homo Sapiens
HQRLHSGEQ

SEQ ID NO: 1083148 - protein, 9 aa, Homo Sapiens
KAPCLSPQH

SEQ ID NO: 1083149 - protein, 9 aa, Homo Sapiens
TSCPALSLL

SEQ ID NO: 1083150 - protein, 9 aa, Homo Sapiens
SERFLKQSH

SEQ ID NO: 1083151 - protein, 9 aa, Homo Sapiens
ACSWFTEIG

SEQ ID NO: 1083152 - protein, 9 aa, Homo Sapiens
CGTGSCMEP

SEQ ID NO: 1083153 - protein, 9 aa, Homo Sapiens
ASVSFSLNH

SEQ ID NO: 1083154 - protein, 9 aa, Homo Sapiens
DDIVTRSQA

SEQ ID NO: 1083155 - protein, 9 aa, Homo Sapiens
PKTLSQLAG

SEQ ID NO: 1083156 - protein, 9 aa, Homo Sapiens
EYTPVDDRI

SEQ ID NO: 1083157 - protein, 9 aa, Homo Sapiens
LLLRLMAGP

SEQ ID NO: 1083158 - protein, 9 aa, Homo Sapiens
DGSDKELGS

SEQ ID NO: 1083159 - protein, 9 aa, Homo Sapiens
LGGSSSACS

SEQ ID NO: 1083160 - protein, 9 aa, Homo Sapiens
TVSNLPKEE

SEQ ID NO: 1083161 - protein, 9 aa, Homo Sapiens
EKENSPFAL

SEQ ID NO: 1083162 - protein, 9 aa, Homo Sapiens
PYRQQSLAL

SEQ ID NO: 1083163 - protein, 9 aa, Homo Sapiens
VWFAARSGS

SEQ ID NO: 1083164 - protein, 9 aa, Homo Sapiens
SSHLARSGP

SEQ ID NO: 1083165 - protein, 9 aa, Homo Sapiens
FQGHHPESL

SEQ ID NO: 1083166 - protein, 9 aa, Homo Sapiens
FMGARGNTA

SEQ ID NO: 1083167 - protein, 9 aa, Homo Sapiens
ETIPSLRKS

SEQ ID NO: 1083168 - protein, 9 aa, Homo Sapiens
LSFIRDIRR

SEQ ID NO: 1083169 - protein, 9 aa, Homo Sapiens
KYHISQPIR

SEQ ID NO: 1083170 - protein, 9 aa, Homo Sapiens
PLSIHPQGF

SEQ ID NO: 1083171 - protein, 9 aa, Homo Sapiens
RRLQLVWGG

SEQ ID NO: 1083172 - protein, 9 aa, Homo Sapiens
SYKGVTYSL

SEQ ID NO: 1083173 - protein, 9 aa, Homo Sapiens
LLRISHELY

SEQ ID NO: 1083174 - protein, 9 aa, Homo Sapiens
CALDKQDKD

SEQ ID NO: 1083175 - protein, 9 aa, Homo Sapiens
MRPSIQPVS

SEQ ID NO: 1083176 - protein, 9 aa, Homo Sapiens
GSSTEEAQP

SEQ ID NO: 1083177 - protein, 9 aa, Homo Sapiens
VPFSTNEPT

SEQ ID NO: 1083178 - protein, 9 aa, Homo Sapiens
KKGQLPIPS

SEQ ID NO: 1083179 - protein, 9 aa, Homo Sapiens
EKEAAEKLI

SEQ ID NO: 1083180 - protein, 9 aa, Homo Sapiens
KMKPESDRP

SEQ ID NO: 1083181 - protein, 9 aa, Homo Sapiens
IPVALPKNV

SEQ ID NO: 1083182 - protein, 9 aa, Homo Sapiens
HPLESPAII

SEQ ID NO: 1083183 - protein, 9 aa, Homo Sapiens
HLISSSKTL

SEQ ID NO: 1083184 - protein, 9 aa, Homo Sapiens
ASRKIASEY

SEQ ID NO: 1083185 - protein, 9 aa, Homo Sapiens
ISQCDLSEI

SEQ ID NO: 1083186 - protein, 9 aa, Homo Sapiens
KGKKAHGPA

SEQ ID NO: 1083187 - protein, 9 aa, Homo Sapiens
NEGGKAFIK

SEQ ID NO: 1083188 - protein, 9 aa, Homo Sapiens
IFLFSFIVS

SEQ ID NO: 1083189 - protein, 9 aa, Homo Sapiens
LLSYMCFHV

SEQ ID NO: 1083190 - protein, 9 aa, Homo Sapiens
KMNNYWNVG

SEQ ID NO: 1083191 - protein, 9 aa, Homo Sapiens
LFHLVYVNA

SEQ ID NO: 1083192 - protein, 9 aa, Homo Sapiens
YVSRANFLG

SEQ ID NO: 1083193 - protein, 9 aa, Homo Sapiens
VTFVPDIRR

SEQ ID NO: 1083194 - protein, 9 aa, Homo Sapiens
TPYKWYNPH

SEQ ID NO: 1083195 - protein, 9 aa, Homo Sapiens
RALSTLYIH

SEQ ID NO: 1083196 - protein, 9 aa, Homo Sapiens
EKNTMMRSH

SEQ ID NO: 1083197 - protein, 9 aa, Homo Sapiens
ARTFHLAQE

SEQ ID NO: 1083198 - protein, 9 aa, Homo Sapiens
AAEFQRGKQ

SEQ ID NO: 1083199 - protein, 9 aa, Homo Sapiens
FLAPVAVEL

SEQ ID NO: 1083200 - protein, 9 aa, Homo Sapiens
WHEHTRPDQ

SEQ ID NO: 1083201 - protein, 9 aa, Homo Sapiens
ENIRLVWQL

SEQ ID NO: 1083202 - protein, 9 aa, Homo Sapiens
EEQEEEQEK

SEQ ID NO: 1083203 - protein, 9 aa, Homo Sapiens
PSCGRPACC

SEQ ID NO: 1083204 - protein, 9 aa, Homo Sapiens
PASNDSCLA

SEQ ID NO: 1083205 - protein, 9 aa, Homo Sapiens
LPKNVKLAE

SEQ ID NO: 1083206 - protein, 9 aa, Homo Sapiens
SGSNKAYRH

SEQ ID NO: 1083207 - protein, 9 aa, Homo Sapiens
RLSATLEGL

SEQ ID NO: 1083208 - protein, 9 aa, Homo Sapiens
LQEKAAFPG

SEQ ID NO: 1083209 - protein, 9 aa, Homo Sapiens
GLWWTFDCS

SEQ ID NO: 1083210 - protein, 9 aa, Homo Sapiens
FVSGGQRPV

SEQ ID NO: 1083211 - protein, 9 aa, Homo Sapiens
FCAWCTAFR

SEQ ID NO: 1083212 - protein, 9 aa, Homo Sapiens
TNVNMKTNN

SEQ ID NO: 1083213 - protein, 9 aa, Homo Sapiens
VLVILIFIV

SEQ ID NO: 1083214 - protein, 9 aa, Homo Sapiens
PLQVSESLW

SEQ ID NO: 1083215 - protein, 9 aa, Homo Sapiens
YQSMPTSTW

SEQ ID NO: 1083216 - protein, 9 aa, Homo Sapiens
EVSFPRDMI

SEQ ID NO: 1083217 - protein, 9 aa, Homo Sapiens
RKSRSLKKR

SEQ ID NO: 1083218 - protein, 9 aa, Homo Sapiens
GDLSEGPED

SEQ ID NO: 1083219 - protein, 9 aa, Homo Sapiens
LLFLFPGPH

SEQ ID NO: 1083220 - protein, 9 aa, Homo Sapiens
VFCVLSLLP

SEQ ID NO: 1083221 - protein, 9 aa, Homo Sapiens
PGYQGPSGE

SEQ ID NO: 1083222 - protein, 9 aa, Homo Sapiens
MQQIKDFTK

SEQ ID NO: 1083223 - protein, 9 aa, Homo Sapiens
LRNPELVAR

SEQ ID NO: 1083224 - protein, 9 aa, Homo Sapiens
ARLSPGPGL

SEQ ID NO: 1083225 - protein, 9 aa, Homo Sapiens
PSASLVQTV

SEQ ID NO: 1083226 - protein, 9 aa, Homo Sapiens
NAIMTQWNR

SEQ ID NO: 1083227 - protein, 9 aa, Homo Sapiens
RKNMSKFLG

SEQ ID NO: 1083228 - protein, 9 aa, Homo Sapiens
TPPEDNYPD

SEQ ID NO: 1083229 - protein, 9 aa, Homo Sapiens
DFETHCTLL

SEQ ID NO: 1083230 - protein, 9 aa, Homo Sapiens
WEKKELKSM

SEQ ID NO: 1083231 - protein, 9 aa, Homo Sapiens
IRCEKPYLR

SEQ ID NO: 1083232 - protein, 9 aa, Homo Sapiens
RNECQEIAN

SEQ ID NO: 1083233 - protein, 9 aa, Homo Sapiens
QMTPFSTQV

SEQ ID NO: 1083234 - protein, 9 aa, Homo Sapiens
ILGESMYSV

SEQ ID NO: 1083235 - protein, 9 aa, Homo Sapiens
QENGQRIFG

SEQ ID NO: 1083236 - protein, 9 aa, Homo Sapiens
NESSFVSFR

SEQ ID NO: 1083237 - protein, 9 aa, Homo Sapiens
ARSLGDLSE

SEQ ID NO: 1083238 - protein, 9 aa, Homo Sapiens
ATDLAGKRI

SEQ ID NO: 1083239 - protein, 9 aa, Homo Sapiens
SKGESSGDP

SEQ ID NO: 1083240 - protein, 9 aa, Homo Sapiens
RANFLGEII

SEQ ID NO: 1083241 - protein, 9 aa, Homo Sapiens
EWIANWLVV

SEQ ID NO: 1083242 - protein, 9 aa, Homo Sapiens
VCDNGWNTT

SEQ ID NO: 1083243 - protein, 9 aa, Homo Sapiens
ASKKATVLV

SEQ ID NO: 1083244 - protein, 9 aa, Homo Sapiens
GITGLKVTY

SEQ ID NO: 1083245 - protein, 9 aa, Homo Sapiens
FISWGIINA

SEQ ID NO: 1083246 - protein, 9 aa, Homo Sapiens
AVCINFIFI

SEQ ID NO: 1083247 - protein, 9 aa, Homo Sapiens
NLDHEYQPR

SEQ ID NO: 1083248 - protein, 9 aa, Homo Sapiens
KLDAYAKKV

SEQ ID NO: 1083249 - protein, 9 aa, Homo Sapiens
IEDIFFQPE

SEQ ID NO: 1083250 - protein, 9 aa, Homo Sapiens
LENQSGKGQ

SEQ ID NO: 1083251 - protein, 9 aa, Homo Sapiens
PAGFGAVYA

SEQ ID NO: 1083252 - protein, 9 aa, Homo Sapiens
FCEWLYNAL

SEQ ID NO: 1083253 - protein, 9 aa, Homo Sapiens
NYPDLSDML

SEQ ID NO: 1083254 - protein, 9 aa, Homo Sapiens
PSQRLGGSS

SEQ ID NO: 1083255 - protein, 9 aa, Homo Sapiens
THYPLCPEA

SEQ ID NO: 1083256 - protein, 9 aa, Homo Sapiens
KKIIKQLQN

SEQ ID NO: 1083257 - protein, 9 aa, Homo Sapiens
SEQKAQKKI

SEQ ID NO: 1083258 - protein, 9 aa, Homo Sapiens
FNPEFVHGH

SEQ ID NO: 1083259 - protein, 9 aa, Homo Sapiens
NYFFDGPSL

SEQ ID NO: 1083260 - protein, 9 aa, Homo Sapiens
ANVTWLRNG

SEQ ID NO: 1083261 - protein, 9 aa, Homo Sapiens
SCIVGMATM

SEQ ID NO: 1083262 - protein, 9 aa, Homo Sapiens
LCEKSAVLL

SEQ ID NO: 1083263 - protein, 9 aa, Homo Sapiens
LDAIGGTLH

SEQ ID NO: 1083264 - protein, 9 aa, Homo Sapiens
KGTVQIQEG

SEQ ID NO: 1083265 - protein, 9 aa, Homo Sapiens
SECRKAFFS

SEQ ID NO: 1083266 - protein, 9 aa, Homo Sapiens
CQKLEQEVI

SEQ ID NO: 1083267 - protein, 9 aa, Homo Sapiens
KLFVAENNG

SEQ ID NO: 1083268 - protein, 9 aa, Homo Sapiens
NALTQIVAL

SEQ ID NO: 1083269 - protein, 9 aa, Homo Sapiens
QLESEETRF

SEQ ID NO: 1083270 - protein, 9 aa, Homo Sapiens
SALNNDSEK

SEQ ID NO: 1083271 - protein, 9 aa, Homo Sapiens
FLNTQNMCE

SEQ ID NO: 1083272 - protein, 9 aa, Homo Sapiens
FSFLSELPY

SEQ ID NO: 1083273 - protein, 9 aa, Homo Sapiens
WDAEEFGRL

SEQ ID NO: 1083274 - protein, 9 aa, Homo Sapiens
PQCCQPSCG

SEQ ID NO: 1083275 - protein, 9 aa, Homo Sapiens
ISNGGPALE

SEQ ID NO: 1083276 - protein, 9 aa, Homo Sapiens
MFSLLKSRA

SEQ ID NO: 1083277 - protein, 9 aa, Homo Sapiens
YQLLFHNFP

SEQ ID NO: 1083278 - protein, 9 aa, Homo Sapiens
AIAVAEPFT

SEQ ID NO: 1083279 - protein, 9 aa, Homo Sapiens
VFDFNFIPE

SEQ ID NO: 1083280 - protein, 9 aa, Homo Sapiens
HRSFISWGI

SEQ ID NO: 1083281 - protein, 9 aa, Homo Sapiens
REDNPTAVQ

SEQ ID NO: 1083282 - protein, 9 aa, Homo Sapiens
HTLRVQRFS

SEQ ID NO: 1083283 - protein, 9 aa, Homo Sapiens
EPEPNFQVL

SEQ ID NO: 1083284 - protein, 9 aa, Homo Sapiens
EWREIYDSI

SEQ ID NO: 1083285 - protein, 9 aa, Homo Sapiens
PAAAGVDGL

SEQ ID NO: 1083286 - protein, 9 aa, Homo Sapiens
YVGGMKKIA

SEQ ID NO: 1083287 - protein, 9 aa, Homo Sapiens
VRGSTFTSN

SEQ ID NO: 1083288 - protein, 9 aa, Homo Sapiens
LLFSIEPED

SEQ ID NO: 1083289 - protein, 9 aa, Homo Sapiens
LVLTENTGT

SEQ ID NO: 1083290 - protein, 9 aa, Homo Sapiens
LKLEAHYNC

SEQ ID NO: 1083291 - protein, 9 aa, Homo Sapiens
QSPLPPFTP

SEQ ID NO: 1083292 - protein, 9 aa, Homo Sapiens
QDGCDPSGA

SEQ ID NO: 1083293 - protein, 9 aa, Homo Sapiens
LPLQGSDIQ

SEQ ID NO: 1083294 - protein, 9 aa, Homo Sapiens
IKGVDHITN

SEQ ID NO: 1083295 - protein, 9 aa, Homo Sapiens
PERCRHLPR

SEQ ID NO: 1083296 - protein, 9 aa, Homo Sapiens
SAPAEVWLT

SEQ ID NO: 1083297 - protein, 9 aa, Homo Sapiens
TNKSQEKLS

SEQ ID NO: 1083298 - protein, 9 aa, Homo Sapiens
LHLDHNKLD

SEQ ID NO: 1083299 - protein, 9 aa, Homo Sapiens
RDESQKVSQ

SEQ ID NO: 1083300 - protein, 9 aa, Homo Sapiens
HDKEDYPAS

SEQ ID NO: 1083301 - protein, 9 aa, Homo Sapiens
QFNKEGAAG

SEQ ID NO: 1083302 - protein, 9 aa, Homo Sapiens
NQECSRDSF

SEQ ID NO: 1083303 - protein, 9 aa, Homo Sapiens
SCNQKGGSE

SEQ ID NO: 1083304 - protein, 9 aa, Homo Sapiens
HSSLSLFFL

SEQ ID NO: 1083305 - protein, 9 aa, Homo Sapiens
EDFLAWKWS

SEQ ID NO: 1083306 - protein, 9 aa, Homo Sapiens
VRIVSRSRT

SEQ ID NO: 1083307 - protein, 9 aa, Homo Sapiens
AESFNLLSK

SEQ ID NO: 1083308 - protein, 9 aa, Homo Sapiens
GLVILVIVG

SEQ ID NO: 1083309 - protein, 9 aa, Homo Sapiens
PPGIPGIEG

SEQ ID NO: 1083310 - protein, 9 aa, Homo Sapiens
DAQIDLNWV

SEQ ID NO: 1083311 - protein, 9 aa, Homo Sapiens
KIQHILDME

SEQ ID NO: 1083312 - protein, 9 aa, Homo Sapiens
GELLAKVEQ

SEQ ID NO: 1083313 - protein, 9 aa, Homo Sapiens
HPPDFEMII

SEQ ID NO: 1083314 - protein, 9 aa, Homo Sapiens
IKANARERN

SEQ ID NO: 1083315 - protein, 9 aa, Homo Sapiens
ARKGADVIV

SEQ ID NO: 1083316 - protein, 9 aa, Homo Sapiens
KKIVRITWS

SEQ ID NO: 1083317 - protein, 9 aa, Homo Sapiens
SGERFPLSE

SEQ ID NO: 1083318 - protein, 9 aa, Homo Sapiens
CCVQEALEV

SEQ ID NO: 1083319 - protein, 9 aa, Homo Sapiens
HKGTKSESA

SEQ ID NO: 1083320 - protein, 9 aa, Homo Sapiens
AALGVELFE

SEQ ID NO: 1083321 - protein, 9 aa, Homo Sapiens
RTLFRSQPA

SEQ ID NO: 1083322 - protein, 9 aa, Homo Sapiens
THQSGLLEE

SEQ ID NO: 1083323 - protein, 9 aa, Homo Sapiens
EKMIREQEE

SEQ ID NO: 1083324 - protein, 9 aa, Homo Sapiens
LESQADVHW

SEQ ID NO: 1083325 - protein, 9 aa, Homo Sapiens
FTPGNPPLH

SEQ ID NO: 1083326 - protein, 9 aa, Homo Sapiens
EDNDDCQIK

SEQ ID NO: 1083327 - protein, 9 aa, Homo Sapiens
TPSSPSSSG

SEQ ID NO: 1083328 - protein, 9 aa, Homo Sapiens
FLSELPYQW

SEQ ID NO: 1083329 - protein, 9 aa, Homo Sapiens
PSFLPVDKG

SEQ ID NO: 1083330 - protein, 9 aa, Homo Sapiens
VMHGIEDSK

SEQ ID NO: 1083331 - protein, 9 aa, Homo Sapiens
GDGRVVKGK

SEQ ID NO: 1083332 - protein, 9 aa, Homo Sapiens
KKTHRVLRR

SEQ ID NO: 1083333 - protein, 9 aa, Homo Sapiens
RLCVDVRLK

SEQ ID NO: 1083334 - protein, 9 aa, Homo Sapiens
DLSRMLQER

SEQ ID NO: 1083335 - protein, 9 aa, Homo Sapiens
SRDLSTSLQ

SEQ ID NO: 1083336 - protein, 9 aa, Homo Sapiens
GFDQSSSLL

SEQ ID NO: 1083337 - protein, 9 aa, Homo Sapiens
GILEEYKKE

SEQ ID NO: 1083338 - protein, 9 aa, Homo Sapiens
KIVGHYSLF

SEQ ID NO: 1083339 - protein, 9 aa, Homo Sapiens
AGSAQENNQ

SEQ ID NO: 1083340 - protein, 9 aa, Homo Sapiens
ENEKKGDGE

SEQ ID NO: 1083341 - protein, 9 aa, Homo Sapiens
PRRTAVTTL

SEQ ID NO: 1083342 - protein, 9 aa, Homo Sapiens
YCPLMLKFQ

SEQ ID NO: 1083343 - protein, 9 aa, Homo Sapiens
EEYEESPLQ

SEQ ID NO: 1083344 - protein, 9 aa, Homo Sapiens
RWKTRLELP

SEQ ID NO: 1083345 - protein, 9 aa, Homo Sapiens
VPDHTCKKE

SEQ ID NO: 1083346 - protein, 9 aa, Homo Sapiens
IYGDRLVQE

SEQ ID NO: 1083347 - protein, 9 aa, Homo Sapiens
LRISGVVEF

SEQ ID NO: 1083348 - protein, 9 aa, Homo Sapiens
WYLPAPEVF

SEQ ID NO: 1083349 - protein, 9 aa, Homo Sapiens
EESDQEKYE

SEQ ID NO: 1083350 - protein, 9 aa, Homo Sapiens
PLIGMIFES

SEQ ID NO: 1083351 - protein, 9 aa, Homo Sapiens
GALVPVPAA

SEQ ID NO: 1083352 - protein, 9 aa, Homo Sapiens
REKGIKGIP

SEQ ID NO: 1083353 - protein, 9 aa, Homo Sapiens
IPFYFYVAD

SEQ ID NO: 1083354 - protein, 9 aa, Homo Sapiens
LGGDGRKRQ

SEQ ID NO: 1083355 - protein, 9 aa, Homo Sapiens
TYQCEAQDA

SEQ ID NO: 1083356 - protein, 9 aa, Homo Sapiens
LAWKWSSEK

SEQ ID NO: 1083357 - protein, 9 aa, Homo Sapiens
INLNSACSW

SEQ ID NO: 1083358 - protein, 9 aa, Homo Sapiens
SDQEKYECV

SEQ ID NO: 1083359 - protein, 9 aa, Homo Sapiens
GGRRPCLGA

SEQ ID NO: 1083360 - protein, 9 aa, Homo Sapiens
QSDTFFLDC

SEQ ID NO: 1083361 - protein, 9 aa, Homo Sapiens
SRKSCIVGM

SEQ ID NO: 1083362 - protein, 9 aa, Homo Sapiens
NFSWWLVNT

SEQ ID NO: 1083363 - protein, 9 aa, Homo Sapiens
RRVGDSDYS

SEQ ID NO: 1083364 - protein, 9 aa, Homo Sapiens
YFVKIQFFL

SEQ ID NO: 1083365 - protein, 9 aa, Homo Sapiens
IVGRTASVR

SEQ ID NO: 1083366 - protein, 9 aa, Homo Sapiens
LGLCKLKIV

SEQ ID NO: 1083367 - protein, 9 aa, Homo Sapiens
LAYGGHPYP

SEQ ID NO: 1083368 - protein, 9 aa, Homo Sapiens
QVIVLFIKM

SEQ ID NO: 1083369 - protein, 9 aa, Homo Sapiens
SDMKNQREE

SEQ ID NO: 1083370 - protein, 9 aa, Homo Sapiens
GAGRGGAGN

SEQ ID NO: 1083371 - protein, 9 aa, Homo Sapiens
RWNNLHRHS

SEQ ID NO: 1083372 - protein, 9 aa, Homo Sapiens
GPYIPSSHF

SEQ ID NO: 1083373 - protein, 9 aa, Homo Sapiens
LRVRTLFRS

SEQ ID NO: 1083374 - protein, 9 aa, Homo Sapiens
VPIWVTNQF

SEQ ID NO: 1083375 - protein, 9 aa, Homo Sapiens
CGNGRLEEN

SEQ ID NO: 1083376 - protein, 9 aa, Homo Sapiens
NPGLKAGAL

SEQ ID NO: 1083377 - protein, 9 aa, Homo Sapiens
CIVGMATMI

SEQ ID NO: 1083378 - protein, 9 aa, Homo Sapiens
GPAKVESAL

SEQ ID NO: 1083379 - protein, 9 aa, Homo Sapiens
GRVFLGSDR

SEQ ID NO: 1083380 - protein, 9 aa, Homo Sapiens
ASLSAQNKG

SEQ ID NO: 1083381 - protein, 9 aa, Homo Sapiens
MALKAAGGP

SEQ ID NO: 1083382 - protein, 9 aa, Homo Sapiens
QNTDKTFQN

SEQ ID NO: 1083383 - protein, 9 aa, Homo Sapiens
SENITNVEV

SEQ ID NO: 1083384 - protein, 9 aa, Homo Sapiens
TGGAVKKLK

SEQ ID NO: 1083385 - protein, 9 aa, Homo Sapiens
IQVLGKQNS

SEQ ID NO: 1083386 - protein, 9 aa, Homo Sapiens
MACANKGIF

SEQ ID NO: 1083387 - protein, 9 aa, Homo Sapiens
RTEPSLGVK

SEQ ID NO: 1083388 - protein, 9 aa, Homo Sapiens
SLLGGFQGC

SEQ ID NO: 1083389 - protein, 9 aa, Homo Sapiens
TPPRGRLTE

SEQ ID NO: 1083390 - protein, 9 aa, Homo Sapiens
EVAVNESSF

SEQ ID NO: 1083391 - protein, 9 aa, Homo Sapiens
VLKFVFCPP

SEQ ID NO: 1083392 - protein, 9 aa, Homo Sapiens
SPVQCLGLP

SEQ ID NO: 1083393 - protein, 9 aa, Homo Sapiens
EKVCWTSGW

SEQ ID NO: 1083394 - protein, 9 aa, Homo Sapiens
QNVQKQKRS

SEQ ID NO: 1083395 - protein, 9 aa, Homo Sapiens
VLTENTGTQ

SEQ ID NO: 1083396 - protein, 9 aa, Homo Sapiens
RKRRQSQSR

SEQ ID NO: 1083397 - protein, 9 aa, Homo Sapiens
IQHENVNVR

SEQ ID NO: 1083398 - protein, 9 aa, Homo Sapiens
LYGFLTVST

SEQ ID NO: 1083399 - protein, 9 aa, Homo Sapiens
EGKTRETVE

SEQ ID NO: 1083400 - protein, 9 aa, Homo Sapiens
DLEAVLEAA

SEQ ID NO: 1083401 - protein, 9 aa, Homo Sapiens
NSNITQIPE

SEQ ID NO: 1083402 - protein, 9 aa, Homo Sapiens
RRNPGGEEA

SEQ ID NO: 1083403 - protein, 9 aa, Homo Sapiens
FSFSLDFLV

SEQ ID NO: 1083404 - protein, 9 aa, Homo Sapiens
PDTQEIKER

SEQ ID NO: 1083405 - protein, 9 aa, Homo Sapiens
NLFGNSRLV

SEQ ID NO: 1083406 - protein, 9 aa, Homo Sapiens
RAKVEVNIS

SEQ ID NO: 1083407 - protein, 9 aa, Homo Sapiens
KIIGNLVGA

SEQ ID NO: 1083408 - protein, 9 aa, Homo Sapiens
LSPGPGLGL

SEQ ID NO: 1083409 - protein, 9 aa, Homo Sapiens
LNLGVFNNQ

SEQ ID NO: 1083410 - protein, 9 aa, Homo Sapiens
PITYSSDIL

SEQ ID NO: 1083411 - protein, 9 aa, Homo Sapiens
RKHGVAPLA

SEQ ID NO: 1083412 - protein, 9 aa, Homo Sapiens
LDFRPLFRP

SEQ ID NO: 1083413 - protein, 9 aa, Homo Sapiens
EFKAYENRV

SEQ ID NO: 1083414 - protein, 9 aa, Homo Sapiens
ETEKGTVQI

SEQ ID NO: 1083415 - protein, 9 aa, Homo Sapiens
ADGSQEQKP

SEQ ID NO: 1083416 - protein, 9 aa, Homo Sapiens
PPSLITAVA

SEQ ID NO: 1083417 - protein, 9 aa, Homo Sapiens
ACPRGYKST

SEQ ID NO: 1083418 - protein, 9 aa, Homo Sapiens
QTPSLHGTR

SEQ ID NO: 1083419 - protein, 9 aa, Homo Sapiens
LLSVGPQPL

SEQ ID NO: 1083420 - protein, 9 aa, Homo Sapiens
EIEEGVRQK

SEQ ID NO: 1083421 - protein, 9 aa, Homo Sapiens
CVGVPTVDL

SEQ ID NO: 1083422 - protein, 9 aa, Homo Sapiens
MVSVAPSSP

SEQ ID NO: 1083423 - protein, 9 aa, Homo Sapiens
LVVRFMSTL

SEQ ID NO: 1083424 - protein, 9 aa, Homo Sapiens
MRPDLLLKM

SEQ ID NO: 1083425 - protein, 9 aa, Homo Sapiens
CVYHKHFDA

SEQ ID NO: 1083426 - protein, 9 aa, Homo Sapiens
EITFDTFVY

SEQ ID NO: 1083427 - protein, 9 aa, Homo Sapiens
ALIEPGIPR

SEQ ID NO: 1083428 - protein, 9 aa, Homo Sapiens
SYCKSYVIT

SEQ ID NO: 1083429 - protein, 9 aa, Homo Sapiens
KVEPPTVKE

SEQ ID NO: 1083430 - protein, 9 aa, Homo Sapiens
IETSYSPGS

SEQ ID NO: 1083431 - protein, 9 aa, Homo Sapiens
STIVVTRLP

SEQ ID NO: 1083432 - protein, 9 aa, Homo Sapiens
DMLNYEEYC

SEQ ID NO: 1083433 - protein, 9 aa, Homo Sapiens
EEKRQKQEE

SEQ ID NO: 1083434 - protein, 9 aa, Homo Sapiens
MFASVKESL

SEQ ID NO: 1083435 - protein, 9 aa, Homo Sapiens
LAPAAPPSA

SEQ ID NO: 1083436 - protein, 9 aa, Homo Sapiens
CVVSCTPPF

SEQ ID NO: 1083437 - protein, 9 aa, Homo Sapiens
PVARFNKTV

SEQ ID NO: 1083438 - protein, 9 aa, Homo Sapiens
NLSALTVDT

SEQ ID NO: 1083439 - protein, 9 aa, Homo Sapiens
PVCSVADFA

SEQ ID NO: 1083440 - protein, 9 aa, Homo Sapiens
ERNYPYSLK

SEQ ID NO: 1083441 - protein, 9 aa, Homo Sapiens
EAAAPSKGE

SEQ ID NO: 1083442 - protein, 9 aa, Homo Sapiens
QPRPRGGSH

SEQ ID NO: 1083443 - protein, 9 aa, Homo Sapiens
HPKATDALG

SEQ ID NO: 1083444 - protein, 9 aa, Homo Sapiens
VIYAKYKLH

SEQ ID NO: 1083445 - protein, 9 aa, Homo Sapiens
RATRGLLRS

SEQ ID NO: 1083446 - protein, 9 aa, Homo Sapiens
KEGMIRVRK

SEQ ID NO: 1083447 - protein, 9 aa, Homo Sapiens
SCPARKKAQ

SEQ ID NO: 1083448 - protein, 9 aa, Homo Sapiens
KEIRVALSN

SEQ ID NO: 1083449 - protein, 9 aa, Homo Sapiens
PAEVWLTPP

SEQ ID NO: 1083450 - protein, 9 aa, Homo Sapiens
PISSLFFFT

SEQ ID NO: 1083451 - protein, 9 aa, Homo Sapiens
KYLDAIKKF

SEQ ID NO: 1083452 - protein, 9 aa, Homo Sapiens
YQKFLFETQ

SEQ ID NO: 1083453 - protein, 9 aa, Homo Sapiens
LWKLRATLD

SEQ ID NO: 1083454 - protein, 9 aa, Homo Sapiens
QIVITDTAR

SEQ ID NO: 1083455 - protein, 9 aa, Homo Sapiens
FSQELTFKC

SEQ ID NO: 1083456 - protein, 9 aa, Homo Sapiens
IAHLKNFLE

SEQ ID NO: 1083457 - protein, 9 aa, Homo Sapiens
GNARRPEKR

SEQ ID NO: 1083458 - protein, 9 aa, Homo Sapiens
LYYLSFLRV

SEQ ID NO: 1083459 - protein, 9 aa, Homo Sapiens
LSVKGEKEE

SEQ ID NO: 1083460 - protein, 9 aa, Homo Sapiens
PFTPTPPCA

SEQ ID NO: 1083461 - protein, 9 aa, Homo Sapiens
GTEENLAPW

SEQ ID NO: 1083462 - protein, 9 aa, Homo Sapiens
KNFLEEFRP

SEQ ID NO: 1083463 - protein, 9 aa, Homo Sapiens
STKGGSDFS

SEQ ID NO: 1083464 - protein, 9 aa, Homo Sapiens
PSQRRSKSS

SEQ ID NO: 1083465 - protein, 9 aa, Homo Sapiens
KENGEVKSY

SEQ ID NO: 1083466 - protein, 9 aa, Homo Sapiens
GIEGPSGPI

SEQ ID NO: 1083467 - protein, 9 aa, Homo Sapiens
SYIWPEYCS

SEQ ID NO: 1083468 - protein, 9 aa, Homo Sapiens
GEKIAHFQK

SEQ ID NO: 1083469 - protein, 9 aa, Homo Sapiens
GDNDCRNWS

SEQ ID NO: 1083470 - protein, 9 aa, Homo Sapiens
IKIIGNLVG

SEQ ID NO: 1083471 - protein, 9 aa, Homo Sapiens
SSRSPAFCA

SEQ ID NO: 1083472 - protein, 9 aa, Homo Sapiens
PEDNYPDLS

SEQ ID NO: 1083473 - protein, 9 aa, Homo Sapiens
LPSDTESKG

SEQ ID NO: 1083474 - protein, 9 aa, Homo Sapiens
NKESQREKK

SEQ ID NO: 1083475 - protein, 9 aa, Homo Sapiens
IPGYPTPPA

SEQ ID NO: 1083476 - protein, 9 aa, Homo Sapiens
FPMKKGPCQ

SEQ ID NO: 1083477 - protein, 9 aa, Homo Sapiens
RQFFIEVLD

SEQ ID NO: 1083478 - protein, 9 aa, Homo Sapiens
ELKKRVVQV

SEQ ID NO: 1083479 - protein, 9 aa, Homo Sapiens
KAGVPKGSP

SEQ ID NO: 1083480 - protein, 9 aa, Homo Sapiens
QYFCYIFWK

SEQ ID NO: 1083481 - protein, 9 aa, Homo Sapiens
YESKLKQFT

SEQ ID NO: 1083482 - protein, 9 aa, Homo Sapiens
EWLEFRKPS

SEQ ID NO: 1083483 - protein, 9 aa, Homo Sapiens
TFPFGETEV

SEQ ID NO: 1083484 - protein, 9 aa, Homo Sapiens
GGLDLRVRE

SEQ ID NO: 1083485 - protein, 9 aa, Homo Sapiens
EQMQLQNEA

SEQ ID NO: 1083486 - protein, 9 aa, Homo Sapiens
KSYVITRAF

SEQ ID NO: 1083487 - protein, 9 aa, Homo Sapiens
FKKAVKAII

SEQ ID NO: 1083488 - protein, 9 aa, Homo Sapiens
SVSRVGYSH

SEQ ID NO: 1083489 - protein, 9 aa, Homo Sapiens
EKYKGQVNL

SEQ ID NO: 1083490 - protein, 9 aa, Homo Sapiens
VSWSACSVS

SEQ ID NO: 1083491 - protein, 9 aa, Homo Sapiens
SMLTWEKKE

SEQ ID NO: 1083492 - protein, 9 aa, Homo Sapiens
REISIHSNL

SEQ ID NO: 1083493 - protein, 9 aa, Homo Sapiens
RLRRPRQLT

SEQ ID NO: 1083494 - protein, 9 aa, Homo Sapiens
GPAVVFDIL

SEQ ID NO: 1083495 - protein, 9 aa, Homo Sapiens
ESENDLFHK

SEQ ID NO: 1083496 - protein, 9 aa, Homo Sapiens
PNLTKLCKM

SEQ ID NO: 1083497 - protein, 9 aa, Homo Sapiens
YGGKVCYGL

SEQ ID NO: 1083498 - protein, 9 aa, Homo Sapiens
FVVSFYLVA

SEQ ID NO: 1083499 - protein, 9 aa, Homo Sapiens
IFMPDFDLN

SEQ ID NO: 1083500 - protein, 9 aa, Homo Sapiens
KSTEEGQSL

SEQ ID NO: 1083501 - protein, 9 aa, Homo Sapiens
YRPTPVEEN

SEQ ID NO: 1083502 - protein, 9 aa, Homo Sapiens
AAAEVGGSR

SEQ ID NO: 1083503 - protein, 9 aa, Homo Sapiens
YKSTQVSGV

SEQ ID NO: 1083504 - protein, 9 aa, Homo Sapiens
AEPRPRFSR

SEQ ID NO: 1083505 - protein, 9 aa, Homo Sapiens
LLSEIVGII

SEQ ID NO: 1083506 - protein, 9 aa, Homo Sapiens
SPSHISSVV

SEQ ID NO: 1083507 - protein, 9 aa, Homo Sapiens
RTNTGFLQT

SEQ ID NO: 1083508 - protein, 9 aa, Homo Sapiens
LPEGDASSL

SEQ ID NO: 1083509 - protein, 9 aa, Homo Sapiens
TMVAVDRYF

SEQ ID NO: 1083510 - protein, 9 aa, Homo Sapiens
LLFLRYILD

SEQ ID NO: 1083511 - protein, 9 aa, Homo Sapiens
LGLGGSWQL

SEQ ID NO: 1083512 - protein, 9 aa, Homo Sapiens
QPPPPGLKQ

SEQ ID NO: 1083513 - protein, 9 aa, Homo Sapiens
GKPGDAGAK

SEQ ID NO: 1083514 - protein, 9 aa, Homo Sapiens
RILGGSQVK

SEQ ID NO: 1083515 - protein, 9 aa, Homo Sapiens
GAAGLLEVF

SEQ ID NO: 1083516 - protein, 9 aa, Homo Sapiens
VAEVKAESF

SEQ ID NO: 1083517 - protein, 9 aa, Homo Sapiens
YTFAWNKTN

SEQ ID NO: 1083518 - protein, 9 aa, Homo Sapiens
AHVFCVLSL

SEQ ID NO: 1083519 - protein, 9 aa, Homo Sapiens
MKLEVVNPR

SEQ ID NO: 1083520 - protein, 9 aa, Homo Sapiens
LRKQNWELR

SEQ ID NO: 1083521 - protein, 9 aa, Homo Sapiens
EAECPGREA

SEQ ID NO: 1083522 - protein, 9 aa, Homo Sapiens
FESYGFFLL

SEQ ID NO: 1083523 - protein, 9 aa, Homo Sapiens
EASAAQKKN

SEQ ID NO: 1083524 - protein, 9 aa, Homo Sapiens
IKFSEPGAI

SEQ ID NO: 1083525 - protein, 9 aa, Homo Sapiens
PGSQQCCQK

SEQ ID NO: 1083526 - protein, 9 aa, Homo Sapiens
SQGGHPENG

SEQ ID NO: 1083527 - protein, 9 aa, Homo Sapiens
SHLAIIDIL

SEQ ID NO: 1083528 - protein, 9 aa, Homo Sapiens
VREEPLQVE

SEQ ID NO: 1083529 - protein, 9 aa, Homo Sapiens
TLASKRRKT

SEQ ID NO: 1083530 - protein, 9 aa, Homo Sapiens
RSSQLQYYR

SEQ ID NO: 1083531 - protein, 9 aa, Homo Sapiens
LFVTYPEGR

SEQ ID NO: 1083532 - protein, 9 aa, Homo Sapiens
TQTCTPIFS

SEQ ID NO: 1083533 - protein, 9 aa, Homo Sapiens
ASFVVQLNG

SEQ ID NO: 1083534 - protein, 9 aa, Homo Sapiens
ENSKLCFHQ

SEQ ID NO: 1083535 - protein, 9 aa, Homo Sapiens
KRNSCLRRT

SEQ ID NO: 1083536 - protein, 9 aa, Homo Sapiens
PAPEVFPRN

SEQ ID NO: 1083537 - protein, 9 aa, Homo Sapiens
KELSKTWIR

SEQ ID NO: 1083538 - protein, 9 aa, Homo Sapiens
AARSGSPNQ

SEQ ID NO: 1083539 - protein, 9 aa, Homo Sapiens
PLPPRLTIY

SEQ ID NO: 1083540 - protein, 9 aa, Homo Sapiens
SFEEVARKG

SEQ ID NO: 1083541 - protein, 9 aa, Homo Sapiens
CQCFSGHRP

SEQ ID NO: 1083542 - protein, 9 aa, Homo Sapiens
SLLRYRTNT

SEQ ID NO: 1083543 - protein, 9 aa, Homo Sapiens
RSEEIIKHF

SEQ ID NO: 1083544 - protein, 9 aa, Homo Sapiens
RNLDCFLLL

SEQ ID NO: 1083545 - protein, 9 aa, Homo Sapiens
SPLARLHGF

SEQ ID NO: 1083546 - protein, 9 aa, Homo Sapiens
QTPTKPSSL

SEQ ID NO: 1083547 - protein, 9 aa, Homo Sapiens
NLYVLSTGF

SEQ ID NO: 1083548 - protein, 9 aa, Homo Sapiens
NDFDHRKRG

SEQ ID NO: 1083549 - protein, 9 aa, Homo Sapiens
AMQMTPFST

SEQ ID NO: 1083550 - protein, 9 aa, Homo Sapiens
CKKSVNKML

SEQ ID NO: 1083551 - protein, 9 aa, Homo Sapiens
SGTRLVLVL

SEQ ID NO: 1083552 - protein, 9 aa, Homo Sapiens
RPPKLPTFG

SEQ ID NO: 1083553 - protein, 9 aa, Homo Sapiens
PAKVESALV

SEQ ID NO: 1083554 - protein, 9 aa, Homo Sapiens
LKQSHSSME

SEQ ID NO: 1083555 - protein, 9 aa, Homo Sapiens
RADQFFTSP

SEQ ID NO: 1083556 - protein, 9 aa, Homo Sapiens
CDLSSFEFC

SEQ ID NO: 1083557 - protein, 9 aa, Homo Sapiens
GVNWKSGYL

SEQ ID NO: 1083558 - protein, 9 aa, Homo Sapiens
PLTCLQSES

SEQ ID NO: 1083559 - protein, 9 aa, Homo Sapiens
VQKQKRSLK

SEQ ID NO: 1083560 - protein, 9 aa, Homo Sapiens
QQKFLKELS

SEQ ID NO: 1083561 - protein, 9 aa, Homo Sapiens
TQKNEFLIS

SEQ ID NO: 1083562 - protein, 9 aa, Homo Sapiens
GYVVLGFRE

SEQ ID NO: 1083563 - protein, 9 aa, Homo Sapiens
GAIGSGTEI

SEQ ID NO: 1083564 - protein, 9 aa, Homo Sapiens
PKRRNHLKK

SEQ ID NO: 1083565 - protein, 9 aa, Homo Sapiens
QLTHLLGGG

SEQ ID NO: 1083566 - protein, 9 aa, Homo Sapiens
EEIGELLAK

SEQ ID NO: 1083567 - protein, 9 aa, Homo Sapiens
VLISLFYGV

SEQ ID NO: 1083568 - protein, 9 aa, Homo Sapiens
FFLGGAPTE

SEQ ID NO: 1083569 - protein, 9 aa, Homo Sapiens
LFKGKKAHG

SEQ ID NO: 1083570 - protein, 9 aa, Homo Sapiens
EPQTALKSL

SEQ ID NO: 1083571 - protein, 9 aa, Homo Sapiens
FSPEKAPPV

SEQ ID NO: 1083572 - protein, 9 aa, Homo Sapiens
GAHMYQAEF

SEQ ID NO: 1083573 - protein, 9 aa, Homo Sapiens
LRPYPFGID

SEQ ID NO: 1083574 - protein, 9 aa, Homo Sapiens
LRVQRFSEA

SEQ ID NO: 1083575 - protein, 9 aa, Homo Sapiens
GGGGRGSSS

SEQ ID NO: 1083576 - protein, 9 aa, Homo Sapiens
PSNLSPIKD

SEQ ID NO: 1083577 - protein, 9 aa, Homo Sapiens
TKNNLYVLS

SEQ ID NO: 1083578 - protein, 9 aa, Homo Sapiens
KVLYKCRKC

SEQ ID NO: 1083579 - protein, 9 aa, Homo Sapiens
DTLFDVAPP

SEQ ID NO: 1083580 - protein, 9 aa, Homo Sapiens
VSFPRDMID

SEQ ID NO: 1083581 - protein, 9 aa, Homo Sapiens
DILQCDEIS

SEQ ID NO: 1083582 - protein, 9 aa, Homo Sapiens
GFIKFSEPG

SEQ ID NO: 1083583 - protein, 9 aa, Homo Sapiens
TLIASTPSS

SEQ ID NO: 1083584 - protein, 9 aa, Homo Sapiens
SPAEDPEEE

SEQ ID NO: 1083585 - protein, 9 aa, Homo Sapiens
RSMYGAHMY

SEQ ID NO: 1083586 - protein, 9 aa, Homo Sapiens
RLRTALPTF

SEQ ID NO: 1083587 - protein, 9 aa, Homo Sapiens
RGANYCGKK

SEQ ID NO: 1083588 - protein, 9 aa, Homo Sapiens
PRQITDGMV

SEQ ID NO: 1083589 - protein, 9 aa, Homo Sapiens
AGVPNLTQR

SEQ ID NO: 1083590 - protein, 9 aa, Homo Sapiens
NFQVLDNPA

SEQ ID NO: 1083591 - protein, 9 aa, Homo Sapiens
FTPYKWYNP

SEQ ID NO: 1083592 - protein, 9 aa, Homo Sapiens
AGQDSSCVW

SEQ ID NO: 1083593 - protein, 9 aa, Homo Sapiens
VPNTVPCRK

SEQ ID NO: 1083594 - protein, 9 aa, Homo Sapiens
YSVNNEITW

SEQ ID NO: 1083595 - protein, 9 aa, Homo Sapiens
KAKLNFFKT

SEQ ID NO: 1083596 - protein, 9 aa, Homo Sapiens
GPVSLPWRA

SEQ ID NO: 1083597 - protein, 9 aa, Homo Sapiens
SEGILGVIT

SEQ ID NO: 1083598 - protein, 9 aa, Homo Sapiens
TSFRLTMAL

SEQ ID NO: 1083599 - protein, 9 aa, Homo Sapiens
RVPSPFSTV

SEQ ID NO: 1083600 - protein, 9 aa, Homo Sapiens
RFFFYVALC

SEQ ID NO: 1083601 - protein, 9 aa, Homo Sapiens
LPEKRANLC

SEQ ID NO: 1083602 - protein, 9 aa, Homo Sapiens
AMKTWLLLA

SEQ ID NO: 1083603 - protein, 9 aa, Homo Sapiens
GNCQCFSGH

SEQ ID NO: 1083604 - protein, 9 aa, Homo Sapiens
SASRRLNSQ

SEQ ID NO: 1083605 - protein, 9 aa, Homo Sapiens
ANYNLFSSA

SEQ ID NO: 1083606 - protein, 9 aa, Homo Sapiens
YGLQPPGNI

SEQ ID NO: 1083607 - protein, 9 aa, Homo Sapiens
LPTRLMFER

SEQ ID NO: 1083608 - protein, 9 aa, Homo Sapiens
LLAMYPNLG

SEQ ID NO: 1083609 - protein, 9 aa, Homo Sapiens
GLLLDRLRK

SEQ ID NO: 1083610 - protein, 9 aa, Homo Sapiens
VKTDAQPQI

SEQ ID NO: 1083611 - protein, 9 aa, Homo Sapiens
LITKIGMIL

SEQ ID NO: 1083612 - protein, 9 aa, Homo Sapiens
EKELNKYAS

SEQ ID NO: 1083613 - protein, 9 aa, Homo Sapiens
WYCSGSNKA

SEQ ID NO: 1083614 - protein, 9 aa, Homo Sapiens
RGRGYYQEG

SEQ ID NO: 1083615 - protein, 9 aa, Homo Sapiens
RGYYQEGGG

SEQ ID NO: 1083616 - protein, 9 aa, Homo Sapiens
KAMEFVDVI

SEQ ID NO: 1083617 - protein, 9 aa, Homo Sapiens
ADLLQSQSM

SEQ ID NO: 1083618 - protein, 9 aa, Homo Sapiens
PLSRKSYIW

SEQ ID NO: 1083619 - protein, 9 aa, Homo Sapiens
RAKTLASKR

SEQ ID NO: 1083620 - protein, 9 aa, Homo Sapiens
GNVHQPTKG

SEQ ID NO: 1083621 - protein, 9 aa, Homo Sapiens
VTGGAVKKL

SEQ ID NO: 1083622 - protein, 9 aa, Homo Sapiens
RELVWVGEP

SEQ ID NO: 1083623 - protein, 9 aa, Homo Sapiens
SFLYNGQAC

SEQ ID NO: 1083624 - protein, 9 aa, Homo Sapiens
CRIMYDIFS

SEQ ID NO: 1083625 - protein, 9 aa, Homo Sapiens
SLYFVMVGV

SEQ ID NO: 1083626 - protein, 9 aa, Homo Sapiens
NDLFHKNCM

SEQ ID NO: 1083627 - protein, 9 aa, Homo Sapiens
EAPLAGPCA

SEQ ID NO: 1083628 - protein, 9 aa, Homo Sapiens
KPHFYLYLS

SEQ ID NO: 1083629 - protein, 9 aa, Homo Sapiens
NYYIDPADA

SEQ ID NO: 1083630 - protein, 9 aa, Homo Sapiens
SKDNLHAVF

SEQ ID NO: 1083631 - protein, 9 aa, Homo Sapiens
ILILLEPIS

SEQ ID NO: 1083632 - protein, 9 aa, Homo Sapiens
GFSYPVVSK

SEQ ID NO: 1083633 - protein, 9 aa, Homo Sapiens
PASCPDTSN

SEQ ID NO: 1083634 - protein, 9 aa, Homo Sapiens
WSKAGGHLR

SEQ ID NO: 1083635 - protein, 9 aa, Homo Sapiens
GHCFFLENG

SEQ ID NO: 1083636 - protein, 9 aa, Homo Sapiens
LEAITDKIF

SEQ ID NO: 1083637 - protein, 9 aa, Homo Sapiens
VVLCEDPLS

SEQ ID NO: 1083638 - protein, 9 aa, Homo Sapiens
ERHKAFSTC

SEQ ID NO: 1083639 - protein, 9 aa, Homo Sapiens
QLVAKLAKA

SEQ ID NO: 1083640 - protein, 9 aa, Homo Sapiens
NLVYSQRKK

SEQ ID NO: 1083641 - protein, 9 aa, Homo Sapiens
IAIALNGAL

SEQ ID NO: 1083642 - protein, 9 aa, Homo Sapiens
LLWKLRATL

SEQ ID NO: 1083643 - protein, 9 aa, Homo Sapiens
PCEHQCDPK

SEQ ID NO: 1083644 - protein, 9 aa, Homo Sapiens
VMASAPILK

SEQ ID NO: 1083645 - protein, 9 aa, Homo Sapiens
KRRTCTLTL

SEQ ID NO: 1083646 - protein, 9 aa, Homo Sapiens
FEFCEEADF

SEQ ID NO: 1083647 - protein, 9 aa, Homo Sapiens
LSVVAPKVI

SEQ ID NO: 1083648 - protein, 9 aa, Homo Sapiens
EIKKKNISL

SEQ ID NO: 1083649 - protein, 9 aa, Homo Sapiens
YKGIHSGEK

SEQ ID NO: 1083650 - protein, 9 aa, Homo Sapiens
DSEATPVPL

SEQ ID NO: 1083651 - protein, 9 aa, Homo Sapiens
DVNNQDAIQ

SEQ ID NO: 1083652 - protein, 9 aa, Homo Sapiens
AEGCQCDSS

SEQ ID NO: 1083653 - protein, 9 aa, Homo Sapiens
TDTLSPALS

SEQ ID NO: 1083654 - protein, 9 aa, Homo Sapiens
SAIKTLRSK

SEQ ID NO: 1083655 - protein, 9 aa, Homo Sapiens
MDRHDFEFP

SEQ ID NO: 1083656 - protein, 9 aa, Homo Sapiens
NHFRLHAQY

SEQ ID NO: 1083657 - protein, 9 aa, Homo Sapiens
FTETTACMP

SEQ ID NO: 1083658 - protein, 9 aa, Homo Sapiens
SAAAAFRHP

SEQ ID NO: 1083659 - protein, 9 aa, Homo Sapiens
GLHTKLGKI

SEQ ID NO: 1083660 - protein, 9 aa, Homo Sapiens
IESKHFQYL

SEQ ID NO: 1083661 - protein, 9 aa, Homo Sapiens
CEILAVIKL

SEQ ID NO: 1083662 - protein, 9 aa, Homo Sapiens
DVAVKIVSS

SEQ ID NO: 1083663 - protein, 9 aa, Homo Sapiens
ASCSQELSS

SEQ ID NO: 1083664 - protein, 9 aa, Homo Sapiens
DLPEDDQAQ

SEQ ID NO: 1083665 - protein, 9 aa, Homo Sapiens
KSLVLDSGG

SEQ ID NO: 1083666 - protein, 9 aa, Homo Sapiens
IFYRSLPPA

SEQ ID NO: 1083667 - protein, 9 aa, Homo Sapiens
STLELVSVE

SEQ ID NO: 1083668 - protein, 9 aa, Homo Sapiens
CNHSLVKKP

SEQ ID NO: 1083669 - protein, 9 aa, Homo Sapiens
PRRVKKDKD

SEQ ID NO: 1083670 - protein, 9 aa, Homo Sapiens
HQRIYTGEK

SEQ ID NO: 1083671 - protein, 9 aa, Homo Sapiens
RKAFNRSSI

SEQ ID NO: 1083672 - protein, 9 aa, Homo Sapiens
NLTTSRLHT

SEQ ID NO: 1083673 - protein, 9 aa, Homo Sapiens
EEFGRLGST

SEQ ID NO: 1083674 - protein, 9 aa, Homo Sapiens
AHAFLQRKN

SEQ ID NO: 1083675 - protein, 9 aa, Homo Sapiens
NRAVKSINE

SEQ ID NO: 1083676 - protein, 9 aa, Homo Sapiens
RRLNSQSTS

SEQ ID NO: 1083677 - protein, 9 aa, Homo Sapiens
KKRKINKKK

SEQ ID NO: 1083678 - protein, 9 aa, Homo Sapiens
QSIPPAIWN

SEQ ID NO: 1083679 - protein, 9 aa, Homo Sapiens
LGTILKVND

SEQ ID NO: 1083680 - protein, 9 aa, Homo Sapiens
TLRCGSQKE

SEQ ID NO: 1083681 - protein, 9 aa, Homo Sapiens
GEAGPSLEL

SEQ ID NO: 1083682 - protein, 9 aa, Homo Sapiens
LGNWMFPAD

SEQ ID NO: 1083683 - protein, 9 aa, Homo Sapiens
YSLKKAYSA

SEQ ID NO: 1083684 - protein, 9 aa, Homo Sapiens
PLRLEGCVQ

SEQ ID NO: 1083685 - protein, 9 aa, Homo Sapiens
SNTSGKIWQ

SEQ ID NO: 1083686 - protein, 9 aa, Homo Sapiens
KKFLPVMTE

SEQ ID NO: 1083687 - protein, 9 aa, Homo Sapiens
ISIWFEVQQ

SEQ ID NO: 1083688 - protein, 9 aa, Homo Sapiens
AAASGMQAC

SEQ ID NO: 1083689 - protein, 9 aa, Homo Sapiens
SLKNIDITE

SEQ ID NO: 1083690 - protein, 9 aa, Homo Sapiens
TPRTEFPET

SEQ ID NO: 1083691 - protein, 9 aa, Homo Sapiens
LGKVCSAAA

SEQ ID NO: 1083692 - protein, 9 aa, Homo Sapiens
FLENKFPWR

SEQ ID NO: 1083693 - protein, 9 aa, Homo Sapiens
VQLQLFKLS

SEQ ID NO: 1083694 - protein, 9 aa, Homo Sapiens
EICLVNGKT

SEQ ID NO: 1083695 - protein, 9 aa, Homo Sapiens
EEEVKFSGT

SEQ ID NO: 1083696 - protein, 9 aa, Homo Sapiens
ALEENPPHL

SEQ ID NO: 1083697 - protein, 9 aa, Homo Sapiens
QQLKAKLNF

SEQ ID NO: 1083698 - protein, 9 aa, Homo Sapiens
KIAKKIKLP

SEQ ID NO: 1083699 - protein, 9 aa, Homo Sapiens
PSRWDPQSR

SEQ ID NO: 1083700 - protein, 9 aa, Homo Sapiens
ENPEVSFPR

SEQ ID NO: 1083701 - protein, 9 aa, Homo Sapiens
QYSQALMAP

SEQ ID NO: 1083702 - protein, 9 aa, Homo Sapiens
AAIKQGSKD

SEQ ID NO: 1083703 - protein, 9 aa, Homo Sapiens
EKSQKKIRN

SEQ ID NO: 1083704 - protein, 9 aa, Homo Sapiens
KEERQEALR

SEQ ID NO: 1083705 - protein, 9 aa, Homo Sapiens
LTLSGFSMT

SEQ ID NO: 1083706 - protein, 9 aa, Homo Sapiens
ILEENIWRL

SEQ ID NO: 1083707 - protein, 9 aa, Homo Sapiens
EIYDSIEPH

SEQ ID NO: 1083708 - protein, 9 aa, Homo Sapiens
AVKIVSSKA

SEQ ID NO: 1083709 - protein, 9 aa, Homo Sapiens
YKKENYNFL

SEQ ID NO: 1083710 - protein, 9 aa, Homo Sapiens
SRTQLFSLN

SEQ ID NO: 1083711 - protein, 9 aa, Homo Sapiens
NQMLYGLQP

SEQ ID NO: 1083712 - protein, 9 aa, Homo Sapiens
SCTPPFCCQ

SEQ ID NO: 1083713 - protein, 9 aa, Homo Sapiens
DQFFTSPPP

SEQ ID NO: 1083714 - protein, 9 aa, Homo Sapiens
AETIPSLRK

SEQ ID NO: 1083715 - protein, 9 aa, Homo Sapiens
APGVSIRTL

SEQ ID NO: 1083716 - protein, 9 aa, Homo Sapiens
QRRSRPSFC

SEQ ID NO: 1083717 - protein, 9 aa, Homo Sapiens
LAMVFMGAR

SEQ ID NO: 1083718 - protein, 9 aa, Homo Sapiens
FVPETIHDE

SEQ ID NO: 1083719 - protein, 9 aa, Homo Sapiens
AEQRKAFST

SEQ ID NO: 1083720 - protein, 9 aa, Homo Sapiens
LIFTIGPSN

SEQ ID NO: 1083721 - protein, 9 aa, Homo Sapiens
NWYIKGVDH

SEQ ID NO: 1083722 - protein, 9 aa, Homo Sapiens
VVHLDTILG

SEQ ID NO: 1083723 - protein, 9 aa, Homo Sapiens
IHGKWATWV

SEQ ID NO: 1083724 - protein, 9 aa, Homo Sapiens
SVIYAKYKL

SEQ ID NO: 1083725 - protein, 9 aa, Homo Sapiens
GGPSLVSGP

SEQ ID NO: 1083726 - protein, 9 aa, Homo Sapiens
DPLESQADV

SEQ ID NO: 1083727 - protein, 9 aa, Homo Sapiens
RQAAEAHPL

SEQ ID NO: 1083728 - protein, 9 aa, Homo Sapiens
ALRWNYVST

SEQ ID NO: 1083729 - protein, 9 aa, Homo Sapiens
RLDLDCGAP

SEQ ID NO: 1083730 - protein, 9 aa, Homo Sapiens
GLSEQKAQK

SEQ ID NO: 1083731 - protein, 9 aa, Homo Sapiens
APAEVWLTP

SEQ ID NO: 1083732 - protein, 9 aa, Homo Sapiens
HVQSFSENA

SEQ ID NO: 1083733 - protein, 9 aa, Homo Sapiens
PWRAETFGG

SEQ ID NO: 1083734 - protein, 9 aa, Homo Sapiens
FMHKVCEAG

SEQ ID NO: 1083735 - protein, 9 aa, Homo Sapiens
MKKGPCQTY

SEQ ID NO: 1083736 - protein, 9 aa, Homo Sapiens
SWPLYAPPR

SEQ ID NO: 1083737 - protein, 9 aa, Homo Sapiens
SGARLTPLV

SEQ ID NO: 1083738 - protein, 9 aa, Homo Sapiens
HTASDLFGN

SEQ ID NO: 1083739 - protein, 9 aa, Homo Sapiens
LTYLSGRPI

SEQ ID NO: 1083740 - protein, 9 aa, Homo Sapiens
IGPAKVESA

SEQ ID NO: 1083741 - protein, 9 aa, Homo Sapiens
EEGGPGLVS

SEQ ID NO: 1083742 - protein, 9 aa, Homo Sapiens
GKRQGDYSK

SEQ ID NO: 1083743 - protein, 9 aa, Homo Sapiens
ECEHAYPDQ

SEQ ID NO: 1083744 - protein, 9 aa, Homo Sapiens
SNPCLKQEN

SEQ ID NO: 1083745 - protein, 9 aa, Homo Sapiens
LTVTSRRLT

SEQ ID NO: 1083746 - protein, 9 aa, Homo Sapiens
PPPSPQAPE

SEQ ID NO: 1083747 - protein, 9 aa, Homo Sapiens
EKELVELLA

SEQ ID NO: 1083748 - protein, 9 aa, Homo Sapiens
HDDSAIKTL

SEQ ID NO: 1083749 - protein, 9 aa, Homo Sapiens
RRPPGPAFQ

SEQ ID NO: 1083750 - protein, 9 aa, Homo Sapiens
IIAHWLSTV

SEQ ID NO: 1083751 - protein, 9 aa, Homo Sapiens
VHSNMELPT

SEQ ID NO: 1083752 - protein, 9 aa, Homo Sapiens
IRMVLQLPS

SEQ ID NO: 1083753 - protein, 9 aa, Homo Sapiens
KISFGDNCF

SEQ ID NO: 1083754 - protein, 9 aa, Homo Sapiens
VSLKNIDIT

SEQ ID NO: 1083755 - protein, 9 aa, Homo Sapiens
SSEYPLSSK

SEQ ID NO: 1083756 - protein, 9 aa, Homo Sapiens
PFSKDFYGT

SEQ ID NO: 1083757 - protein, 9 aa, Homo Sapiens
YHERMSSNR

SEQ ID NO: 1083758 - protein, 9 aa, Homo Sapiens
ALVLLMLFV

SEQ ID NO: 1083759 - protein, 9 aa, Homo Sapiens
QCIPSSWVC

SEQ ID NO: 1083760 - protein, 9 aa, Homo Sapiens
RPWCSATAQ

SEQ ID NO: 1083761 - protein, 9 aa, Homo Sapiens
SRANFLGEI

SEQ ID NO: 1083762 - protein, 9 aa, Homo Sapiens
VIGGLVILV

SEQ ID NO: 1083763 - protein, 9 aa, Homo Sapiens
CFVPSLQTS

SEQ ID NO: 1083764 - protein, 9 aa, Homo Sapiens
EKQREKPLG

SEQ ID NO: 1083765 - protein, 9 aa, Homo Sapiens
STQVEELLC

SEQ ID NO: 1083766 - protein, 9 aa, Homo Sapiens
LHNQSRLDP

SEQ ID NO: 1083767 - protein, 9 aa, Homo Sapiens
DLRIQVCSC

SEQ ID NO: 1083768 - protein, 9 aa, Homo Sapiens
PKKTHPTVP

SEQ ID NO: 1083769 - protein, 9 aa, Homo Sapiens
PEISESISF

SEQ ID NO: 1083770 - protein, 9 aa, Homo Sapiens
RTKCANPVH

SEQ ID NO: 1083771 - protein, 9 aa, Homo Sapiens
ETVLVVRFM

SEQ ID NO: 1083772 - protein, 9 aa, Homo Sapiens
SQRLGGSSS

SEQ ID NO: 1083773 - protein, 9 aa, Homo Sapiens
TRNTTLNGF

SEQ ID NO: 1083774 - protein, 9 aa, Homo Sapiens
KKIEDVASH

SEQ ID NO: 1083775 - protein, 9 aa, Homo Sapiens
GVNFTDIKL

SEQ ID NO: 1083776 - protein, 9 aa, Homo Sapiens
STNYANSYR

SEQ ID NO: 1083777 - protein, 9 aa, Homo Sapiens
KSQKKIRNV

SEQ ID NO: 1083778 - protein, 9 aa, Homo Sapiens
GNKYFRQPP

SEQ ID NO: 1083779 - protein, 9 aa, Homo Sapiens
SSILPIKCL

SEQ ID NO: 1083780 - protein, 9 aa, Homo Sapiens
RVLELEERV

SEQ ID NO: 1083781 - protein, 9 aa, Homo Sapiens
GGPGLVSTP

SEQ ID NO: 1083782 - protein, 9 aa, Homo Sapiens
HRQGLQTPG

SEQ ID NO: 1083783 - protein, 9 aa, Homo Sapiens
GSESRGELL

SEQ ID NO: 1083784 - protein, 9 aa, Homo Sapiens
FVEIQFNEK

SEQ ID NO: 1083785 - protein, 9 aa, Homo Sapiens
LFPRTTQIL

SEQ ID NO: 1083786 - protein, 9 aa, Homo Sapiens
PPEILSDNV

SEQ ID NO: 1083787 - protein, 9 aa, Homo Sapiens
PPGLQGDPG

SEQ ID NO: 1083788 - protein, 9 aa, Homo Sapiens
SSTQSDTFF

SEQ ID NO: 1083789 - protein, 9 aa, Homo Sapiens
TGLKVTYAA

SEQ ID NO: 1083790 - protein, 9 aa, Homo Sapiens
SLAHPQLPV

SEQ ID NO: 1083791 - protein, 9 aa, Homo Sapiens
LFTYVSRAN

SEQ ID NO: 1083792 - protein, 9 aa, Homo Sapiens
VAPLATYMR

SEQ ID NO: 1083793 - protein, 9 aa, Homo Sapiens
CTRKKYHER

SEQ ID NO: 1083794 - protein, 9 aa, Homo Sapiens
ATFRLCCVQ

SEQ ID NO: 1083795 - protein, 9 aa, Homo Sapiens
MDGFYRSFE

SEQ ID NO: 1083796 - protein, 9 aa, Homo Sapiens
AVWYLHNCR

SEQ ID NO: 1083797 - protein, 9 aa, Homo Sapiens
EVFFEGSVA

SEQ ID NO: 1083798 - protein, 9 aa, Homo Sapiens
STIISLLFA

SEQ ID NO: 1083799 - protein, 9 aa, Homo Sapiens
ASAPILKAL

SEQ ID NO: 1083800 - protein, 9 aa, Homo Sapiens
GAIKSFRTL

SEQ ID NO: 1083801 - protein, 9 aa, Homo Sapiens
EQEKMIREQ

SEQ ID NO: 1083802 - protein, 9 aa, Homo Sapiens
PDALIEPGI

SEQ ID NO: 1083803 - protein, 9 aa, Homo Sapiens
KKENNLLLQ

SEQ ID NO: 1083804 - protein, 9 aa, Homo Sapiens
DSAEGQDRQ

SEQ ID NO: 1083805 - protein, 9 aa, Homo Sapiens
FRKHGVAPL

SEQ ID NO: 1083806 - protein, 9 aa, Homo Sapiens
FGMSSFAYV

SEQ ID NO: 1083807 - protein, 9 aa, Homo Sapiens
MEVSQRKAP

SEQ ID NO: 1083808 - protein, 9 aa, Homo Sapiens
KYVLGYKQI

SEQ ID NO: 1083809 - protein, 9 aa, Homo Sapiens
FLKLCYTTV

SEQ ID NO: 1083810 - protein, 9 aa, Homo Sapiens
QMKKIVRIT

SEQ ID NO: 1083811 - protein, 9 aa, Homo Sapiens
CEKPIQDFH

SEQ ID NO: 1083812 - protein, 9 aa, Homo Sapiens
PFCSPFKNF

SEQ ID NO: 1083813 - protein, 9 aa, Homo Sapiens
PNSASVSFS

SEQ ID NO: 1083814 - protein, 9 aa, Homo Sapiens
SITLHFSYC

SEQ ID NO: 1083815 - protein, 9 aa, Homo Sapiens
KGGSECPQG

SEQ ID NO: 1083816 - protein, 9 aa, Homo Sapiens
PGNNGVLAP

SEQ ID NO: 1083817 - protein, 9 aa, Homo Sapiens
KRKLETNLD

SEQ ID NO: 1083818 - protein, 9 aa, Homo Sapiens
QPEYLDAIG

SEQ ID NO: 1083819 - protein, 9 aa, Homo Sapiens
GFIFVAGFS

SEQ ID NO: 1083820 - protein, 9 aa, Homo Sapiens
IEFFRASGN

SEQ ID NO: 1083821 - protein, 9 aa, Homo Sapiens
FHAQEFISF

SEQ ID NO: 1083822 - protein, 9 aa, Homo Sapiens
TGPNGATGP

SEQ ID NO: 1083823 - protein, 9 aa, Homo Sapiens
RKKIIKQLQ

SEQ ID NO: 1083824 - protein, 9 aa, Homo Sapiens
CDPSGAGAS

SEQ ID NO: 1083825 - protein, 9 aa, Homo Sapiens
RFTENSKLC

SEQ ID NO: 1083826 - protein, 9 aa, Homo Sapiens
NWDPGTSAL

SEQ ID NO: 1083827 - protein, 9 aa, Homo Sapiens
NVYYIEATG

SEQ ID NO: 1083828 - protein, 9 aa, Homo Sapiens
RRRAAREVE

SEQ ID NO: 1083829 - protein, 9 aa, Homo Sapiens
APLNLPGSA

SEQ ID NO: 1083830 - protein, 9 aa, Homo Sapiens
RKGADVIVN

SEQ ID NO: 1083831 - protein, 9 aa, Homo Sapiens
FKPGVRYDF

SEQ ID NO: 1083832 - protein, 9 aa, Homo Sapiens
CILVEVEGR

SEQ ID NO: 1083833 - protein, 9 aa, Homo Sapiens
QAVGAGLFP

SEQ ID NO: 1083834 - protein, 9 aa, Homo Sapiens
SFLYSLSAL

SEQ ID NO: 1083835 - protein, 9 aa, Homo Sapiens
SAKLTPTHL

SEQ ID NO: 1083836 - protein, 9 aa, Homo Sapiens
HNQSRLDPF

SEQ ID NO: 1083837 - protein, 9 aa, Homo Sapiens
KNCITIHSA

SEQ ID NO: 1083838 - protein, 9 aa, Homo Sapiens
DSFVVPLPN

SEQ ID NO: 1083839 - protein, 9 aa, Homo Sapiens
LVQLVKSIT

SEQ ID NO: 1083840 - protein, 9 aa, Homo Sapiens
QMNPYTVPE

SEQ ID NO: 1083841 - protein, 9 aa, Homo Sapiens
EVYPTSLIK

SEQ ID NO: 1083842 - protein, 9 aa, Homo Sapiens
PLSSSMSLS

SEQ ID NO: 1083843 - protein, 9 aa, Homo Sapiens
DSEEPPEIL

SEQ ID NO: 1083844 - protein, 9 aa, Homo Sapiens
RAARAGHLK

SEQ ID NO: 1083845 - protein, 9 aa, Homo Sapiens
WGLFALYPK

SEQ ID NO: 1083846 - protein, 9 aa, Homo Sapiens
RCIISGQPR

SEQ ID NO: 1083847 - protein, 9 aa, Homo Sapiens
GMVEIEFFR

SEQ ID NO: 1083848 - protein, 9 aa, Homo Sapiens
SNITQIPEY

SEQ ID NO: 1083849 - protein, 9 aa, Homo Sapiens
LIYDHLLCF

SEQ ID NO: 1083850 - protein, 9 aa, Homo Sapiens
ILSGKSDDE

SEQ ID NO: 1083851 - protein, 9 aa, Homo Sapiens
NEHTTIIDR

SEQ ID NO: 1083852 - protein, 9 aa, Homo Sapiens
TDIKDAVNP

SEQ ID NO: 1083853 - protein, 9 aa, Homo Sapiens
HPQGFRYSK

SEQ ID NO: 1083854 - protein, 9 aa, Homo Sapiens
LRRFFRIND

SEQ ID NO: 1083855 - protein, 9 aa, Homo Sapiens
VIKRLARGQ

SEQ ID NO: 1083856 - protein, 9 aa, Homo Sapiens
ELVVATWVG

SEQ ID NO: 1083857 - protein, 9 aa, Homo Sapiens
PTTVSEAPG

SEQ ID NO: 1083858 - protein, 9 aa, Homo Sapiens
TNQFQENRS

SEQ ID NO: 1083859 - protein, 9 aa, Homo Sapiens
KGLHDLLHP

SEQ ID NO: 1083860 - protein, 9 aa, Homo Sapiens
EISIHSNLL

SEQ ID NO: 1083861 - protein, 9 aa, Homo Sapiens
NARRPEKRG

SEQ ID NO: 1083862 - protein, 9 aa, Homo Sapiens
PPSCSDSCD

SEQ ID NO: 1083863 - protein, 9 aa, Homo Sapiens
PMPMKREPP

SEQ ID NO: 1083864 - protein, 9 aa, Homo Sapiens
PKNVQETKI

SEQ ID NO: 1083865 - protein, 9 aa, Homo Sapiens
GEHILNLHS

SEQ ID NO: 1083866 - protein, 9 aa, Homo Sapiens
YQDPAAVFF

SEQ ID NO: 1083867 - protein, 9 aa, Homo Sapiens
SQKKIRNVD

SEQ ID NO: 1083868 - protein, 9 aa, Homo Sapiens
ASVWLITKI

SEQ ID NO: 1083869 - protein, 9 aa, Homo Sapiens
GPWRKLNLE

SEQ ID NO: 1083870 - protein, 9 aa, Homo Sapiens
KGGYVVLGF

SEQ ID NO: 1083871 - protein, 9 aa, Homo Sapiens
YGFPPSFFS

SEQ ID NO: 1083872 - protein, 9 aa, Homo Sapiens
CRLVTCVPR

SEQ ID NO: 1083873 - protein, 9 aa, Homo Sapiens
RIVSRSRTQ

SEQ ID NO: 1083874 - protein, 9 aa, Homo Sapiens
GLVSTPDNR

SEQ ID NO: 1083875 - protein, 9 aa, Homo Sapiens
LFQPVAGEN

SEQ ID NO: 1083876 - protein, 9 aa, Homo Sapiens
DGELESMRF

SEQ ID NO: 1083877 - protein, 9 aa, Homo Sapiens
SSLLRYRTN

SEQ ID NO: 1083878 - protein, 9 aa, Homo Sapiens
TPVEENLRR

SEQ ID NO: 1083879 - protein, 9 aa, Homo Sapiens
SLGPAPGSA

SEQ ID NO: 1083880 - protein, 9 aa, Homo Sapiens
VFQGISEIQ

SEQ ID NO: 1083881 - protein, 9 aa, Homo Sapiens
PCPPIQALQ

SEQ ID NO: 1083882 - protein, 9 aa, Homo Sapiens
AVHKLAESI

SEQ ID NO: 1083883 - protein, 9 aa, Homo Sapiens
RIFGGPPPG

SEQ ID NO: 1083884 - protein, 9 aa, Homo Sapiens
DGKLYTGLT

SEQ ID NO: 1083885 - protein, 9 aa, Homo Sapiens
SRGFFCKAG

SEQ ID NO: 1083886 - protein, 9 aa, Homo Sapiens
WARPPKLPT

SEQ ID NO: 1083887 - protein, 9 aa, Homo Sapiens
FLKQSHSSM

SEQ ID NO: 1083888 - protein, 9 aa, Homo Sapiens
GSCIETSYS

SEQ ID NO: 1083889 - protein, 9 aa, Homo Sapiens
HMYQAEFPM

SEQ ID NO: 1083890 - protein, 9 aa, Homo Sapiens
SKISDILQC

SEQ ID NO: 1083891 - protein, 9 aa, Homo Sapiens
DFLTDSESL

SEQ ID NO: 1083892 - protein, 9 aa, Homo Sapiens
ASYKKENEM

SEQ ID NO: 1083893 - protein, 9 aa, Homo Sapiens
LSKTWIRSL

SEQ ID NO: 1083894 - protein, 9 aa, Homo Sapiens
KEGYQCPPG

SEQ ID NO: 1083895 - protein, 9 aa, Homo Sapiens
ASRRLNSQS

SEQ ID NO: 1083896 - protein, 9 aa, Homo Sapiens
FAWNKTNIY

SEQ ID NO: 1083897 - protein, 9 aa, Homo Sapiens
LEGCVQGRG

SEQ ID NO: 1083898 - protein, 9 aa, Homo Sapiens
QTYLSIKFI

SEQ ID NO: 1083899 - protein, 9 aa, Homo Sapiens
TPVWWKDVW

SEQ ID NO: 1083900 - protein, 9 aa, Homo Sapiens
KGQLPIPSI

SEQ ID NO: 1083901 - protein, 9 aa, Homo Sapiens
KRIKENSPS

SEQ ID NO: 1083902 - protein, 9 aa, Homo Sapiens
YPPFMAAAV

SEQ ID NO: 1083903 - protein, 9 aa, Homo Sapiens
LSIHPQGFR

SEQ ID NO: 1083904 - protein, 9 aa, Homo Sapiens
FSCADGQCL

SEQ ID NO: 1083905 - protein, 9 aa, Homo Sapiens
SSSSRPLTR

SEQ ID NO: 1083906 - protein, 9 aa, Homo Sapiens
QAQQPSEKN

SEQ ID NO: 1083907 - protein, 9 aa, Homo Sapiens
GGPSFTISK

SEQ ID NO: 1083908 - protein, 9 aa, Homo Sapiens
ECKECKKAV

SEQ ID NO: 1083909 - protein, 9 aa, Homo Sapiens
CHPVCRSLI

SEQ ID NO: 1083910 - protein, 9 aa, Homo Sapiens
LKLCYTTVV

SEQ ID NO: 1083911 - protein, 9 aa, Homo Sapiens
CPPIQALQE

SEQ ID NO: 1083912 - protein, 9 aa, Homo Sapiens
FDVDVKTDA

SEQ ID NO: 1083913 - protein, 9 aa, Homo Sapiens
NSCILFLGS

SEQ ID NO: 1083914 - protein, 9 aa, Homo Sapiens
FLTSTAPRL

SEQ ID NO: 1083915 - protein, 9 aa, Homo Sapiens
LQKVKAAIA

SEQ ID NO: 1083916 - protein, 9 aa, Homo Sapiens
HTEKKSKKT

SEQ ID NO: 1083917 - protein, 9 aa, Homo Sapiens
EPTFSTNEN

SEQ ID NO: 1083918 - protein, 9 aa, Homo Sapiens
SSLKVSPKL

SEQ ID NO: 1083919 - protein, 9 aa, Homo Sapiens
QLCAFKLTM

SEQ ID NO: 1083920 - protein, 9 aa, Homo Sapiens
RPRLVAGSQ

SEQ ID NO: 1083921 - protein, 9 aa, Homo Sapiens
RLEGPFSIE

SEQ ID NO: 1083922 - protein, 9 aa, Homo Sapiens
ECLPGAWRG

SEQ ID NO: 1083923 - protein, 9 aa, Homo Sapiens
IFFLQGQLN

SEQ ID NO: 1083924 - protein, 9 aa, Homo Sapiens
GAGLQNMEN

SEQ ID NO: 1083925 - protein, 9 aa, Homo Sapiens
LVFPFIAIL

SEQ ID NO: 1083926 - protein, 9 aa, Homo Sapiens
NAGVPPLGS

SEQ ID NO: 1083927 - protein, 9 aa, Homo Sapiens
EKRRTCTLT

SEQ ID NO: 1083928 - protein, 9 aa, Homo Sapiens
LILSGKSDD

SEQ ID NO: 1083929 - protein, 9 aa, Homo Sapiens
SLEYRSISL

SEQ ID NO: 1083930 - protein, 9 aa, Homo Sapiens
SHIGLFLFG

SEQ ID NO: 1083931 - protein, 9 aa, Homo Sapiens
LLVVLNLFK

SEQ ID NO: 1083932 - protein, 9 aa, Homo Sapiens
SRTSTTLPA

SEQ ID NO: 1083933 - protein, 9 aa, Homo Sapiens
SFCSTMADE

SEQ ID NO: 1083934 - protein, 9 aa, Homo Sapiens
ANYGFPDVG

SEQ ID NO: 1083935 - protein, 9 aa, Homo Sapiens
VQHDLNLGV

SEQ ID NO: 1083936 - protein, 9 aa, Homo Sapiens
TLDYERSQT

SEQ ID NO: 1083937 - protein, 9 aa, Homo Sapiens
LDKISSVLH

SEQ ID NO: 1083938 - protein, 9 aa, Homo Sapiens
VTSWVKSPT

SEQ ID NO: 1083939 - protein, 9 aa, Homo Sapiens
LSGKSDDEV

SEQ ID NO: 1083940 - protein, 9 aa, Homo Sapiens
LVQKKYLEY

SEQ ID NO: 1083941 - protein, 9 aa, Homo Sapiens
ADSFGDPLF

SEQ ID NO: 1083942 - protein, 9 aa, Homo Sapiens
SETGTTYSQ

SEQ ID NO: 1083943 - protein, 9 aa, Homo Sapiens
QDGEKLGTE

SEQ ID NO: 1083944 - protein, 9 aa, Homo Sapiens
SNDASSSLA

SEQ ID NO: 1083945 - protein, 9 aa, Homo Sapiens
LIASTPSSP

SEQ ID NO: 1083946 - protein, 9 aa, Homo Sapiens
KSEVLERQM

SEQ ID NO: 1083947 - protein, 9 aa, Homo Sapiens
LCFHQRIHT

SEQ ID NO: 1083948 - protein, 9 aa, Homo Sapiens
ETGTTYSQS

SEQ ID NO: 1083949 - protein, 9 aa, Homo Sapiens
ASVQFAPPQ

SEQ ID NO: 1083950 - protein, 9 aa, Homo Sapiens
LNGQSLSVS

SEQ ID NO: 1083951 - protein, 9 aa, Homo Sapiens
GTRGWKKKM

SEQ ID NO: 1083952 - protein, 9 aa, Homo Sapiens
HSPGKLVVE

SEQ ID NO: 1083953 - protein, 9 aa, Homo Sapiens
IPDAKSDDA

SEQ ID NO: 1083954 - protein, 9 aa, Homo Sapiens
CGRPACCIS

SEQ ID NO: 1083955 - protein, 9 aa, Homo Sapiens
AQKKMKTKH

SEQ ID NO: 1083956 - protein, 9 aa, Homo Sapiens
EFIFYNRYT

SEQ ID NO: 1083957 - protein, 9 aa, Homo Sapiens
PSNRCLKDT

SEQ ID NO: 1083958 - protein, 9 aa, Homo Sapiens
HCLNGGGQS

SEQ ID NO: 1083959 - protein, 9 aa, Homo Sapiens
REVEALTQR

SEQ ID NO: 1083960 - protein, 9 aa, Homo Sapiens
AARWSFQGH

SEQ ID NO: 1083961 - protein, 9 aa, Homo Sapiens
FEEQKNVYF

SEQ ID NO: 1083962 - protein, 9 aa, Homo Sapiens
EAWRRTREF

SEQ ID NO: 1083963 - protein, 9 aa, Homo Sapiens
EATPVPLTG

SEQ ID NO: 1083964 - protein, 9 aa, Homo Sapiens
APYTLPPPP

SEQ ID NO: 1083965 - protein, 9 aa, Homo Sapiens
SSARGLFPR

SEQ ID NO: 1083966 - protein, 9 aa, Homo Sapiens
LNEDKILHF

SEQ ID NO: 1083967 - protein, 9 aa, Homo Sapiens
RISAAAAFR

SEQ ID NO: 1083968 - protein, 9 aa, Homo Sapiens
PLSRPPRYS

SEQ ID NO: 1083969 - protein, 9 aa, Homo Sapiens
DDNKLVKGV

SEQ ID NO: 1083970 - protein, 9 aa, Homo Sapiens
VFEFCPELV

SEQ ID NO: 1083971 - protein, 9 aa, Homo Sapiens
SPKPALLAK

SEQ ID NO: 1083972 - protein, 9 aa, Homo Sapiens
ILENQSGKG

SEQ ID NO: 1083973 - protein, 9 aa, Homo Sapiens
PKLPTFGEF

SEQ ID NO: 1083974 - protein, 9 aa, Homo Sapiens
GFSLLKPLC

SEQ ID NO: 1083975 - protein, 9 aa, Homo Sapiens
PVENLEDPQ

SEQ ID NO: 1083976 - protein, 9 aa, Homo Sapiens
SFSDPGVLS

SEQ ID NO: 1083977 - protein, 9 aa, Homo Sapiens
DLTTNPQEE

SEQ ID NO: 1083978 - protein, 9 aa, Homo Sapiens
CEFKAYENR

SEQ ID NO: 1083979 - protein, 9 aa, Homo Sapiens
RLTERNVCG

SEQ ID NO: 1083980 - protein, 9 aa, Homo Sapiens
KSHEESHKK

SEQ ID NO: 1083981 - protein, 9 aa, Homo Sapiens
ATLPLVTLI

SEQ ID NO: 1083982 - protein, 9 aa, Homo Sapiens
PFGTTSFRL

SEQ ID NO: 1083983 - protein, 9 aa, Homo Sapiens
IAVAEPFTS

SEQ ID NO: 1083984 - protein, 9 aa, Homo Sapiens
PPPPSYSGC

SEQ ID NO: 1083985 - protein, 9 aa, Homo Sapiens
VNAIAIAIV

SEQ ID NO: 1083986 - protein, 9 aa, Homo Sapiens
KGKPGDAGA

SEQ ID NO: 1083987 - protein, 9 aa, Homo Sapiens
RLVILLIFR

SEQ ID NO: 1083988 - protein, 9 aa, Homo Sapiens
RCQKLEETV

SEQ ID NO: 1083989 - protein, 9 aa, Homo Sapiens
ADPLESQAD

SEQ ID NO: 1083990 - protein, 9 aa, Homo Sapiens
LHTASDLFG

SEQ ID NO: 1083991 - protein, 9 aa, Homo Sapiens
LHTASDLFD

SEQ ID NO: 1083992 - protein, 9 aa, Homo Sapiens
DKSLQVAER

SEQ ID NO: 1083993 - protein, 9 aa, Homo Sapiens
RTSTTLPAD

SEQ ID NO: 1083994 - protein, 9 aa, Homo Sapiens
QKGGSECPQ

SEQ ID NO: 1083995 - protein, 9 aa, Homo Sapiens
LSRPPRYSS

SEQ ID NO: 1083996 - protein, 9 aa, Homo Sapiens
NFGEPQIGG

SEQ ID NO: 1083997 - protein, 9 aa, Homo Sapiens
SLLTEEKHH

SEQ ID NO: 1083998 - protein, 9 aa, Homo Sapiens
MDLCKNRLL

SEQ ID NO: 1083999 - protein, 9 aa, Homo Sapiens
ISVFYRALT

SEQ ID NO: 1084000 - protein, 9 aa, Homo Sapiens
SLASAGSSD

SEQ ID NO: 1084001 - protein, 9 aa, Homo Sapiens
EVLISLFYG

SEQ ID NO: 1084002 - protein, 9 aa, Homo Sapiens
DLAKTAPPP

SEQ ID NO: 1084003 - protein, 9 aa, Homo Sapiens
VITDTARSN

SEQ ID NO: 1084004 - protein, 9 aa, Homo Sapiens
YAYKGNDSI

SEQ ID NO: 1084005 - protein, 9 aa, Homo Sapiens
EKVPSSPIF

SEQ ID NO: 1084006 - protein, 9 aa, Homo Sapiens
FCQLDRLLP

SEQ ID NO: 1084007 - protein, 9 aa, Homo Sapiens
RGQLGNWMF

SEQ ID NO: 1084008 - protein, 9 aa, Homo Sapiens
PSLASPDPE

SEQ ID NO: 1084009 - protein, 9 aa, Homo Sapiens
GLFPRDASR

SEQ ID NO: 1084010 - protein, 9 aa, Homo Sapiens
IQGSYTYGF

SEQ ID NO: 1084011 - protein, 9 aa, Homo Sapiens
ETTACMPTG

SEQ ID NO: 1084012 - protein, 9 aa, Homo Sapiens
MKKIVRITW

SEQ ID NO: 1084013 - protein, 9 aa, Homo Sapiens
SRRKMRLSP

SEQ ID NO: 1084014 - protein, 9 aa, Homo Sapiens
ADRVRVKAH

SEQ ID NO: 1084015 - protein, 9 aa, Homo Sapiens
RKIPEELSL

SEQ ID NO: 1084016 - protein, 9 aa, Homo Sapiens
DLEPSTIVG

SEQ ID NO: 1084017 - protein, 9 aa, Homo Sapiens
VKSYECKEC

SEQ ID NO: 1084018 - protein, 9 aa, Homo Sapiens
LSGGRDCQV

SEQ ID NO: 1084019 - protein, 9 aa, Homo Sapiens
AVAAASAGL

SEQ ID NO: 1084020 - protein, 9 aa, Homo Sapiens
RLRREPKSR

SEQ ID NO: 1084021 - protein, 9 aa, Homo Sapiens
DQGFIKFSE

SEQ ID NO: 1084022 - protein, 9 aa, Homo Sapiens
ESMRFSARY

SEQ ID NO: 1084023 - protein, 9 aa, Homo Sapiens
FCSPFKNFG

SEQ ID NO: 1084024 - protein, 9 aa, Homo Sapiens
RLQLVWGGQ

SEQ ID NO: 1084025 - protein, 9 aa, Homo Sapiens
DTLLESDFL

SEQ ID NO: 1084026 - protein, 9 aa, Homo Sapiens
QRKLAPLSK

SEQ ID NO: 1084027 - protein, 9 aa, Homo Sapiens
KRLLCLGWG

SEQ ID NO: 1084028 - protein, 9 aa, Homo Sapiens
VVFRMGPFS

SEQ ID NO: 1084029 - protein, 9 aa, Homo Sapiens
CELTEDPDL

SEQ ID NO: 1084030 - protein, 9 aa, Homo Sapiens
EPSGRELTK

SEQ ID NO: 1084031 - protein, 9 aa, Homo Sapiens
LMKQRLAKH

SEQ ID NO: 1084032 - protein, 9 aa, Homo Sapiens
PSDVKKLFL

SEQ ID NO: 1084033 - protein, 9 aa, Homo Sapiens
EVLDIAGFE

SEQ ID NO: 1084034 - protein, 9 aa, Homo Sapiens
SVNPGLDEP

SEQ ID NO: 1084035 - protein, 9 aa, Homo Sapiens
ANTDQLGNK

SEQ ID NO: 1084036 - protein, 9 aa, Homo Sapiens
DLLLEQCMQ

SEQ ID NO: 1084037 - protein, 9 aa, Homo Sapiens
VPYNPGLKA

SEQ ID NO: 1084038 - protein, 9 aa, Homo Sapiens
MKNQREENG

SEQ ID NO: 1084039 - protein, 9 aa, Homo Sapiens
HLARSGPSF

SEQ ID NO: 1084040 - protein, 9 aa, Homo Sapiens
GKEPALSNL

SEQ ID NO: 1084041 - protein, 9 aa, Homo Sapiens
EHASRNGPG

SEQ ID NO: 1084042 - protein, 9 aa, Homo Sapiens
PGPAVVFDI

SEQ ID NO: 1084043 - protein, 9 aa, Homo Sapiens
LYSGQLVQL

SEQ ID NO: 1084044 - protein, 9 aa, Homo Sapiens
ALTELSLLH

SEQ ID NO: 1084045 - protein, 9 aa, Homo Sapiens
AVNIVSHGK

SEQ ID NO: 1084046 - protein, 9 aa, Homo Sapiens
DPKISSEQD

SEQ ID NO: 1084047 - protein, 9 aa, Homo Sapiens
AFSHKIIFF

SEQ ID NO: 1084048 - protein, 9 aa, Homo Sapiens
NRDGKVNFS

SEQ ID NO: 1084049 - protein, 9 aa, Homo Sapiens
NYCGKKCGK

SEQ ID NO: 1084050 - protein, 9 aa, Homo Sapiens
INNRFSSEK

SEQ ID NO: 1084051 - protein, 9 aa, Homo Sapiens
EKSCQDLQR

SEQ ID NO: 1084052 - protein, 9 aa, Homo Sapiens
LKRQRKLAP

SEQ ID NO: 1084053 - protein, 9 aa, Homo Sapiens
DIIEVLISL

SEQ ID NO: 1084054 - protein, 9 aa, Homo Sapiens
LFHNFPLTC

SEQ ID NO: 1084055 - protein, 9 aa, Homo Sapiens
GDVNNQDAI

SEQ ID NO: 1084056 - protein, 9 aa, Homo Sapiens
ESYGFFLLF

SEQ ID NO: 1084057 - protein, 9 aa, Homo Sapiens
GSLADRVRV

SEQ ID NO: 1084058 - protein, 9 aa, Homo Sapiens
VFDILAVLI

SEQ ID NO: 1084059 - protein, 9 aa, Homo Sapiens
AAPPQPLGA

SEQ ID NO: 1084060 - protein, 9 aa, Homo Sapiens
LLILASWFI

SEQ ID NO: 1084061 - protein, 9 aa, Homo Sapiens
SPPSKEPSL

SEQ ID NO: 1084062 - protein, 9 aa, Homo Sapiens
SLLFAELKE

SEQ ID NO: 1084063 - protein, 9 aa, Homo Sapiens
RQMRKEVLE

SEQ ID NO: 1084064 - protein, 9 aa, Homo Sapiens
SPAGSFSIL

SEQ ID NO: 1084065 - protein, 9 aa, Homo Sapiens
AETEKGTVQ

SEQ ID NO: 1084066 - protein, 9 aa, Homo Sapiens
KRLARGQGG

SEQ ID NO: 1084067 - protein, 9 aa, Homo Sapiens
PSAVFPAAR

SEQ ID NO: 1084068 - protein, 9 aa, Homo Sapiens
EIQFNEKSS

SEQ ID NO: 1084069 - protein, 9 aa, Homo Sapiens
YTELEKYEQ

SEQ ID NO: 1084070 - protein, 9 aa, Homo Sapiens
KLPTFGEFL

SEQ ID NO: 1084071 - protein, 9 aa, Homo Sapiens
GPKNSKRLS

SEQ ID NO: 1084072 - protein, 9 aa, Homo Sapiens
CSVTSWVKS

SEQ ID NO: 1084073 - protein, 9 aa, Homo Sapiens
KSYSIEMSR

SEQ ID NO: 1084074 - protein, 9 aa, Homo Sapiens
RCRRYERTL

SEQ ID NO: 1084075 - protein, 9 aa, Homo Sapiens
SLLHNRLSE

SEQ ID NO: 1084076 - protein, 9 aa, Homo Sapiens
LENRCQKLE

SEQ ID NO: 1084077 - protein, 9 aa, Homo Sapiens
KYPGNQTTC

SEQ ID NO: 1084078 - protein, 9 aa, Homo Sapiens
CTAFRFVPG

SEQ ID NO: 1084079 - protein, 9 aa, Homo Sapiens
EPSTIVGSA

SEQ ID NO: 1084080 - protein, 9 aa, Homo Sapiens
QGEAGPSLE

SEQ ID NO: 1084081 - protein, 9 aa, Homo Sapiens
VLGIFGDVN

SEQ ID NO: 1084082 - protein, 9 aa, Homo Sapiens
DLSTTPLQN

SEQ ID NO: 1084083 - protein, 9 aa, Homo Sapiens
QCRADQFFT

SEQ ID NO: 1084084 - protein, 9 aa, Homo Sapiens
GTLQNRGPK

SEQ ID NO: 1084085 - protein, 9 aa, Homo Sapiens
GTQVFFLLR

SEQ ID NO: 1084086 - protein, 9 aa, Homo Sapiens
KQLYFFGKN

SEQ ID NO: 1084087 - protein, 9 aa, Homo Sapiens
VHLDTILGA

SEQ ID NO: 1084088 - protein, 9 aa, Homo Sapiens
RPTPVEENL

SEQ ID NO: 1084089 - protein, 9 aa, Homo Sapiens
EKLRQPSQA

SEQ ID NO: 1084090 - protein, 9 aa, Homo Sapiens
DWGLFALYP

SEQ ID NO: 1084091 - protein, 9 aa, Homo Sapiens
RYTEICLVN

SEQ ID NO: 1084092 - protein, 9 aa, Homo Sapiens
PTLYHFSTN

SEQ ID NO: 1084093 - protein, 9 aa, Homo Sapiens
KREVRGFSY

SEQ ID NO: 1084094 - protein, 9 aa, Homo Sapiens
AGPHSSDPL

SEQ ID NO: 1084095 - protein, 9 aa, Homo Sapiens
QETKIQSIQ

SEQ ID NO: 1084096 - protein, 9 aa, Homo Sapiens
PETWGTDTP

SEQ ID NO: 1084097 - protein, 9 aa, Homo Sapiens
KKDAQPGHH

SEQ ID NO: 1084098 - protein, 9 aa, Homo Sapiens
AHLEMYVQG

SEQ ID NO: 1084099 - protein, 9 aa, Homo Sapiens
MQLFQQHPV

SEQ ID NO: 1084100 - protein, 9 aa, Homo Sapiens
PPAAWGEIQ

SEQ ID NO: 1084101 - protein, 9 aa, Homo Sapiens
ASGMQACVE

SEQ ID NO: 1084102 - protein, 9 aa, Homo Sapiens
TSRRLTDLE

SEQ ID NO: 1084103 - protein, 9 aa, Homo Sapiens
SAPHGDGSF

SEQ ID NO: 1084104 - protein, 9 aa, Homo Sapiens
KRQQTRLLW

SEQ ID NO: 1084105 - protein, 9 aa, Homo Sapiens
KVVSLNGKL

SEQ ID NO: 1084106 - protein, 9 aa, Homo Sapiens
GKTSKFEPN

SEQ ID NO: 1084107 - protein, 9 aa, Homo Sapiens
TDARNVLEN

SEQ ID NO: 1084108 - protein, 9 aa, Homo Sapiens
ASDLFDPWS

SEQ ID NO: 1084109 - protein, 9 aa, Homo Sapiens
HEALFTIGG

SEQ ID NO: 1084110 - protein, 9 aa, Homo Sapiens
FLLDSEVIQ

SEQ ID NO: 1084111 - protein, 9 aa, Homo Sapiens
FPETFEVVE

SEQ ID NO: 1084112 - protein, 9 aa, Homo Sapiens
ILTLSGFSM

SEQ ID NO: 1084113 - protein, 9 aa, Homo Sapiens
PIKDASPTE

SEQ ID NO: 1084114 - protein, 9 aa, Homo Sapiens
SDVWSFGVR

SEQ ID NO: 1084115 - protein, 9 aa, Homo Sapiens
VPLRKLGQV

SEQ ID NO: 1084116 - protein, 9 aa, Homo Sapiens
TYNSFMRVR

SEQ ID NO: 1084117 - protein, 9 aa, Homo Sapiens
NEGNQYGEV

SEQ ID NO: 1084118 - protein, 9 aa, Homo Sapiens
LASTFTQKM

SEQ ID NO: 1084119 - protein, 9 aa, Homo Sapiens
TSATWEERK

SEQ ID NO: 1084120 - protein, 9 aa, Homo Sapiens
MISVNPGLD

SEQ ID NO: 1084121 - protein, 9 aa, Homo Sapiens
LCKSLALDI

SEQ ID NO: 1084122 - protein, 9 aa, Homo Sapiens
PSPAFCLDP

SEQ ID NO: 1084123 - protein, 9 aa, Homo Sapiens
CLLDNTCSV

SEQ ID NO: 1084124 - protein, 9 aa, Homo Sapiens
RVFLGSDRL

SEQ ID NO: 1084125 - protein, 9 aa, Homo Sapiens
TDLAGKRIE

SEQ ID NO: 1084126 - protein, 9 aa, Homo Sapiens
QPQEVLVNY

SEQ ID NO: 1084127 - protein, 9 aa, Homo Sapiens
LIFPSSLDY

SEQ ID NO: 1084128 - protein, 9 aa, Homo Sapiens
PSYQKFLFE

SEQ ID NO: 1084129 - protein, 9 aa, Homo Sapiens
FEISKKKNK

SEQ ID NO: 1084130 - protein, 9 aa, Homo Sapiens
CKVCGKTFT

SEQ ID NO: 1084131 - protein, 9 aa, Homo Sapiens
ARDSVHSLL

SEQ ID NO: 1084132 - protein, 9 aa, Homo Sapiens
YPGLVKVVK

SEQ ID NO: 1084133 - protein, 9 aa, Homo Sapiens
RHLPRPNIT

SEQ ID NO: 1084134 - protein, 9 aa, Homo Sapiens
QYGEVIHQM

SEQ ID NO: 1084135 - protein, 9 aa, Homo Sapiens
PARISFKTF

SEQ ID NO: 1084136 - protein, 9 aa, Homo Sapiens
MTHLVPGTF

SEQ ID NO: 1084137 - protein, 9 aa, Homo Sapiens
IWKKIVFVI

SEQ ID NO: 1084138 - protein, 9 aa, Homo Sapiens
EIVGIIKLK

SEQ ID NO: 1084139 - protein, 9 aa, Homo Sapiens
TKSESAESL

SEQ ID NO: 1084140 - protein, 9 aa, Homo Sapiens
GVPSEWTSL

SEQ ID NO: 1084141 - protein, 9 aa, Homo Sapiens
GVAPLATYM

SEQ ID NO: 1084142 - protein, 9 aa, Homo Sapiens
GLTQDPIWK

SEQ ID NO: 1084143 - protein, 9 aa, Homo Sapiens
QEFSESHNI

SEQ ID NO: 1084144 - protein, 9 aa, Homo Sapiens
ASTPSSPSS

SEQ ID NO: 1084145 - protein, 9 aa, Homo Sapiens
ATMDGFYRS

SEQ ID NO: 1084146 - protein, 9 aa, Homo Sapiens
KSPGPHSRR

SEQ ID NO: 1084147 - protein, 9 aa, Homo Sapiens
VNESSFVSF

SEQ ID NO: 1084148 - protein, 9 aa, Homo Sapiens
VGGMKKIAL

SEQ ID NO: 1084149 - protein, 9 aa, Homo Sapiens
IRRNLDCFL

SEQ ID NO: 1084150 - protein, 9 aa, Homo Sapiens
AAGLQILIL

SEQ ID NO: 1084151 - protein, 9 aa, Homo Sapiens
CFTSSVIPK

SEQ ID NO: 1084152 - protein, 9 aa, Homo Sapiens
DVWVCHPRD

SEQ ID NO: 1084153 - protein, 9 aa, Homo Sapiens
LPRQFFIEV

SEQ ID NO: 1084154 - protein, 9 aa, Homo Sapiens
LLVSLGGSA

SEQ ID NO: 1084155 - protein, 9 aa, Homo Sapiens
HLDHNKLDA

SEQ ID NO: 1084156 - protein, 9 aa, Homo Sapiens
TLLDSSHPV

SEQ ID NO: 1084157 - protein, 9 aa, Homo Sapiens
GFHAQEFIS

SEQ ID NO: 1084158 - protein, 9 aa, Homo Sapiens
HFWVTILSA

SEQ ID NO: 1084159 - protein, 9 aa, Homo Sapiens
SYDRTAWVW

SEQ ID NO: 1084160 - protein, 9 aa, Homo Sapiens
AAGVDGLPL

SEQ ID NO: 1084161 - protein, 9 aa, Homo Sapiens
KDQLCFGVD

SEQ ID NO: 1084162 - protein, 9 aa, Homo Sapiens
GGKPCPPIQ

SEQ ID NO: 1084163 - protein, 9 aa, Homo Sapiens
EKMEMKNIE

SEQ ID NO: 1084164 - protein, 9 aa, Homo Sapiens
PTCEAGLIV

SEQ ID NO: 1084165 - protein, 9 aa, Homo Sapiens
HTAPMSSKE

SEQ ID NO: 1084166 - protein, 9 aa, Homo Sapiens
KSYFCEWLY

SEQ ID NO: 1084167 - protein, 9 aa, Homo Sapiens
NPPGSSTEE

SEQ ID NO: 1084168 - protein, 9 aa, Homo Sapiens
NMENTCYVN

SEQ ID NO: 1084169 - protein, 9 aa, Homo Sapiens
SAACFVPSL

SEQ ID NO: 1084170 - protein, 9 aa, Homo Sapiens
SEAPGPLPS

SEQ ID NO: 1084171 - protein, 9 aa, Homo Sapiens
RGKLTLPKK

SEQ ID NO: 1084172 - protein, 9 aa, Homo Sapiens
DDSSVVSLT

SEQ ID NO: 1084173 - protein, 9 aa, Homo Sapiens
FIVSVLVIS

SEQ ID NO: 1084174 - protein, 9 aa, Homo Sapiens
KDLGAPGVS

SEQ ID NO: 1084175 - protein, 9 aa, Homo Sapiens
PPSPFMRAP

SEQ ID NO: 1084176 - protein, 9 aa, Homo Sapiens
PPGTPMAHS

SEQ ID NO: 1084177 - protein, 9 aa, Homo Sapiens
HSSARPHPC

SEQ ID NO: 1084178 - protein, 9 aa, Homo Sapiens
NLTTHKKIY

SEQ ID NO: 1084179 - protein, 9 aa, Homo Sapiens
DGDDSSVVS

SEQ ID NO: 1084180 - protein, 9 aa, Homo Sapiens
PPRLTIYAP

SEQ ID NO: 1084181 - protein, 9 aa, Homo Sapiens
TWMLGASQL

SEQ ID NO: 1084182 - protein, 9 aa, Homo Sapiens
SMVSVAPSS

SEQ ID NO: 1084183 - protein, 9 aa, Homo Sapiens
TCQTTVCRL

SEQ ID NO: 1084184 - protein, 9 aa, Homo Sapiens
SSLSSLTEE

SEQ ID NO: 1084185 - protein, 9 aa, Homo Sapiens
PPDFCLYKR

SEQ ID NO: 1084186 - protein, 9 aa, Homo Sapiens
KSPPQESTK

SEQ ID NO: 1084187 - protein, 9 aa, Homo Sapiens
VIIPSLPKD

SEQ ID NO: 1084188 - protein, 9 aa, Homo Sapiens
SGITGLKVT

SEQ ID NO: 1084189 - protein, 9 aa, Homo Sapiens
YDCTATSNM

SEQ ID NO: 1084190 - protein, 9 aa, Homo Sapiens
DFAWETGAI

SEQ ID NO: 1084191 - protein, 9 aa, Homo Sapiens
AYEEPTCEA

SEQ ID NO: 1084192 - protein, 9 aa, Homo Sapiens
SSLTETSEQ

SEQ ID NO: 1084193 - protein, 9 aa, Homo Sapiens
TPSDVKKLF

SEQ ID NO: 1084194 - protein, 9 aa, Homo Sapiens
PSFCRTPAW

SEQ ID NO: 1084195 - protein, 9 aa, Homo Sapiens
LQELLGFSL

SEQ ID NO: 1084196 - protein, 9 aa, Homo Sapiens
DLFPWLNNQ

SEQ ID NO: 1084197 - protein, 9 aa, Homo Sapiens
QLFQQHPVV

SEQ ID NO: 1084198 - protein, 9 aa, Homo Sapiens
IENPHLPPS

SEQ ID NO: 1084199 - protein, 9 aa, Homo Sapiens
NAMKTEGSV

SEQ ID NO: 1084200 - protein, 9 aa, Homo Sapiens
STEMALRVP

SEQ ID NO: 1084201 - protein, 9 aa, Homo Sapiens
LPEVVKPLR

SEQ ID NO: 1084202 - protein, 9 aa, Homo Sapiens
TAGDGDDSS

SEQ ID NO: 1084203 - protein, 9 aa, Homo Sapiens
PEAAKSAVG

SEQ ID NO: 1084204 - protein, 9 aa, Homo Sapiens
CGKGFSRWN

SEQ ID NO: 1084205 - protein, 9 aa, Homo Sapiens
RSGITGLKV

SEQ ID NO: 1084206 - protein, 9 aa, Homo Sapiens
CSCPAGKKG

SEQ ID NO: 1084207 - protein, 9 aa, Homo Sapiens
LRTMKFYFA

SEQ ID NO: 1084208 - protein, 9 aa, Homo Sapiens
EEDKILLLV

SEQ ID NO: 1084209 - protein, 9 aa, Homo Sapiens
SQELTFKCH

SEQ ID NO: 1084210 - protein, 9 aa, Homo Sapiens
VPPERCRHL

SEQ ID NO: 1084211 - protein, 9 aa, Homo Sapiens
SSARPHPCP

SEQ ID NO: 1084212 - protein, 9 aa, Homo Sapiens
ALGQFNKEG

SEQ ID NO: 1084213 - protein, 9 aa, Homo Sapiens
EKPYLRISD

SEQ ID NO: 1084214 - protein, 9 aa, Homo Sapiens
LLVTMGIVN

SEQ ID NO: 1084215 - protein, 9 aa, Homo Sapiens
ANWLVVTVP

SEQ ID NO: 1084216 - protein, 9 aa, Homo Sapiens
LWCKECLPG

SEQ ID NO: 1084217 - protein, 9 aa, Homo Sapiens
SNSMLPLDV

SEQ ID NO: 1084218 - protein, 9 aa, Homo Sapiens
SATGDRHST

SEQ ID NO: 1084219 - protein, 9 aa, Homo Sapiens
DLFGNHSLG

SEQ ID NO: 1084220 - protein, 9 aa, Homo Sapiens
LNDISACQE

SEQ ID NO: 1084221 - protein, 9 aa, Homo Sapiens
KGCSSRKFS

SEQ ID NO: 1084222 - protein, 9 aa, Homo Sapiens
PACCTFSQS

SEQ ID NO: 1084223 - protein, 9 aa, Homo Sapiens
LRLLQTQSP

SEQ ID NO: 1084224 - protein, 9 aa, Homo Sapiens
FTSGEETEK

SEQ ID NO: 1084225 - protein, 9 aa, Homo Sapiens
GGGSCSQSG

SEQ ID NO: 1084226 - protein, 9 aa, Homo Sapiens
GLVKVVKNQ

SEQ ID NO: 1084227 - protein, 9 aa, Homo Sapiens
CRHLPRPNI

SEQ ID NO: 1084228 - protein, 9 aa, Homo Sapiens
IANICSHGQ

SEQ ID NO: 1084229 - protein, 9 aa, Homo Sapiens
CHLSLGPAP

SEQ ID NO: 1084230 - protein, 9 aa, Homo Sapiens
EAQLSFIRD

SEQ ID NO: 1084231 - protein, 9 aa, Homo Sapiens
KLEQEVISL

SEQ ID NO: 1084232 - protein, 9 aa, Homo Sapiens
CFHVRFINP

SEQ ID NO: 1084233 - protein, 9 aa, Homo Sapiens
LSYAFSFLL

SEQ ID NO: 1084234 - protein, 9 aa, Homo Sapiens
SLADRVRVK

SEQ ID NO: 1084235 - protein, 9 aa, Homo Sapiens
ARMEKIMRP

SEQ ID NO: 1084236 - protein, 9 aa, Homo Sapiens
TLPPPPTAQ

SEQ ID NO: 1084237 - protein, 9 aa, Homo Sapiens
SIWFEVQQT

SEQ ID NO: 1084238 - protein, 9 aa, Homo Sapiens
GQTAQPSPS

SEQ ID NO: 1084239 - protein, 9 aa, Homo Sapiens
RLINSQILT

SEQ ID NO: 1084240 - protein, 9 aa, Homo Sapiens
GVEDIKSHL

SEQ ID NO: 1084241 - protein, 9 aa, Homo Sapiens
FRMYRVKGL

SEQ ID NO: 1084242 - protein, 9 aa, Homo Sapiens
SRLVILLIF

SEQ ID NO: 1084243 - protein, 9 aa, Homo Sapiens
SDIQVLYGF

SEQ ID NO: 1084244 - protein, 9 aa, Homo Sapiens
PSVLCSSSS

SEQ ID NO: 1084245 - protein, 9 aa, Homo Sapiens
YSQRKKKNI

SEQ ID NO: 1084246 - protein, 9 aa, Homo Sapiens
VFLRPYPFG

SEQ ID NO: 1084247 - protein, 9 aa, Homo Sapiens
KEKETTRTE

SEQ ID NO: 1084248 - protein, 9 aa, Homo Sapiens
AKNEVKEVL

SEQ ID NO: 1084249 - protein, 9 aa, Homo Sapiens
ELSTVLSSL

SEQ ID NO: 1084250 - protein, 9 aa, Homo Sapiens
PNNIDEYEK

SEQ ID NO: 1084251 - protein, 9 aa, Homo Sapiens
VYYIEATGG

SEQ ID NO: 1084252 - protein, 9 aa, Homo Sapiens
IPDLAMKTW

SEQ ID NO: 1084253 - protein, 9 aa, Homo Sapiens
CVKVDRTLK

SEQ ID NO: 1084254 - protein, 9 aa, Homo Sapiens
HTFCQLDRL

SEQ ID NO: 1084255 - protein, 9 aa, Homo Sapiens
ADPTLKCFD

SEQ ID NO: 1084256 - protein, 9 aa, Homo Sapiens
AMRHQRKIP

SEQ ID NO: 1084257 - protein, 9 aa, Homo Sapiens
NKITKIVKG

SEQ ID NO: 1084258 - protein, 9 aa, Homo Sapiens
QHTKKQMET

SEQ ID NO: 1084259 - protein, 9 aa, Homo Sapiens
LSHNEVEIE

SEQ ID NO: 1084260 - protein, 9 aa, Homo Sapiens
ELKAIRPSC

SEQ ID NO: 1084261 - protein, 9 aa, Homo Sapiens
SYGKYRDLF

SEQ ID NO: 1084262 - protein, 9 aa, Homo Sapiens
ASFNDLDFL

SEQ ID NO: 1084263 - protein, 9 aa, Homo Sapiens
NLTVSWDPK

SEQ ID NO: 1084264 - protein, 9 aa, Homo Sapiens
APWAKELLA

SEQ ID NO: 1084265 - protein, 9 aa, Homo Sapiens
FHTFCQLDR

SEQ ID NO: 1084266 - protein, 9 aa, Homo Sapiens
SFKTFSYVY

SEQ ID NO: 1084267 - protein, 9 aa, Homo Sapiens
EIPEISESI

SEQ ID NO: 1084268 - protein, 9 aa, Homo Sapiens
PGLKQFSCL

SEQ ID NO: 1084269 - protein, 9 aa, Homo Sapiens
SGEVFFEGS

SEQ ID NO: 1084270 - protein, 9 aa, Homo Sapiens
QGLKDKVLY

SEQ ID NO: 1084271 - protein, 9 aa, Homo Sapiens
TLRVQRFSE

SEQ ID NO: 1084272 - protein, 9 aa, Homo Sapiens
GKTFTSHSS

SEQ ID NO: 1084273 - protein, 9 aa, Homo Sapiens
LYHVFQGIS

SEQ ID NO: 1084274 - protein, 9 aa, Homo Sapiens
TVIPMLNPI

SEQ ID NO: 1084275 - protein, 9 aa, Homo Sapiens
GIGEKIAHF

SEQ ID NO: 1084276 - protein, 9 aa, Homo Sapiens
GKNCDVVVN

SEQ ID NO: 1084277 - protein, 9 aa, Homo Sapiens
CTSCWAMAV

SEQ ID NO: 1084278 - protein, 9 aa, Homo Sapiens
NAMIQGLFY

SEQ ID NO: 1084279 - protein, 9 aa, Homo Sapiens
KYFRQPPPR

SEQ ID NO: 1084280 - protein, 9 aa, Homo Sapiens
PGTSNSMLP

SEQ ID NO: 1084281 - protein, 9 aa, Homo Sapiens
VIIPSSEIT

SEQ ID NO: 1084282 - protein, 9 aa, Homo Sapiens
VMALLQPTT

SEQ ID NO: 1084283 - protein, 9 aa, Homo Sapiens
AQSIDNSQD

SEQ ID NO: 1084284 - protein, 9 aa, Homo Sapiens
VLVVRFMST

SEQ ID NO: 1084285 - protein, 9 aa, Homo Sapiens
LYIRPTFIR

SEQ ID NO: 1084286 - protein, 9 aa, Homo Sapiens
RQRRNFLRE

SEQ ID NO: 1084287 - protein, 9 aa, Homo Sapiens
EFVHGHRKA

SEQ ID NO: 1084288 - protein, 9 aa, Homo Sapiens
APLQPKKSK

SEQ ID NO: 1084289 - protein, 9 aa, Homo Sapiens
RGPPSMCRW

SEQ ID NO: 1084290 - protein, 9 aa, Homo Sapiens
DHLSNMLIK

SEQ ID NO: 1084291 - protein, 9 aa, Homo Sapiens
WRRMTRTCT

SEQ ID NO: 1084292 - protein, 9 aa, Homo Sapiens
TIHLRRVGD

SEQ ID NO: 1084293 - protein, 9 aa, Homo Sapiens
NPLEDNDDC

SEQ ID NO: 1084294 - protein, 9 aa, Homo Sapiens
SFCLPKREV

SEQ ID NO: 1084295 - protein, 9 aa, Homo Sapiens
PTPGALVPV

SEQ ID NO: 1084296 - protein, 9 aa, Homo Sapiens
CRKKDAQPG

SEQ ID NO: 1084297 - protein, 9 aa, Homo Sapiens
LSVSPRVKR

SEQ ID NO: 1084298 - protein, 9 aa, Homo Sapiens
APLATYMRI

SEQ ID NO: 1084299 - protein, 9 aa, Homo Sapiens
PTAAEQRKA

SEQ ID NO: 1084300 - protein, 9 aa, Homo Sapiens
DIKSHLFFT

SEQ ID NO: 1084301 - protein, 9 aa, Homo Sapiens
SKVAFYNKI

SEQ ID NO: 1084302 - protein, 9 aa, Homo Sapiens
ATREDKVKA

SEQ ID NO: 1084303 - protein, 9 aa, Homo Sapiens
GPRRVKKDK

SEQ ID NO: 1084304 - protein, 9 aa, Homo Sapiens
CTTCVEKKD

SEQ ID NO: 1084305 - protein, 9 aa, Homo Sapiens
CVTQAEIYW

SEQ ID NO: 1084306 - protein, 9 aa, Homo Sapiens
KEKRLTVAS

SEQ ID NO: 1084307 - protein, 9 aa, Homo Sapiens
GAHYSNKVY

SEQ ID NO: 1084308 - protein, 9 aa, Homo Sapiens
RQPEYLDAI

SEQ ID NO: 1084309 - protein, 9 aa, Homo Sapiens
QVTAGRPGD

SEQ ID NO: 1084310 - protein, 9 aa, Homo Sapiens
DSNSSLSEV

SEQ ID NO: 1084311 - protein, 9 aa, Homo Sapiens
NERPGKKQL

SEQ ID NO: 1084312 - protein, 9 aa, Homo Sapiens
YNGVMQKSQ

SEQ ID NO: 1084313 - protein, 9 aa, Homo Sapiens
LDSVQKELI

SEQ ID NO: 1084314 - protein, 9 aa, Homo Sapiens
PNQECSRDS

SEQ ID NO: 1084315 - protein, 9 aa, Homo Sapiens
KEDYFKKHQ

SEQ ID NO: 1084316 - protein, 9 aa, Homo Sapiens
LVPEKDADW

SEQ ID NO: 1084317 - protein, 9 aa, Homo Sapiens
TSTPGRNAL

SEQ ID NO: 1084318 - protein, 9 aa, Homo Sapiens
SLMYFLLGN

SEQ ID NO: 1084319 - protein, 9 aa, Homo Sapiens
YAMMLSLFE

SEQ ID NO: 1084320 - protein, 9 aa, Homo Sapiens
DTGENPEVS

SEQ ID NO: 1084321 - protein, 9 aa, Homo Sapiens
EDTLFDVAP

SEQ ID NO: 1084322 - protein, 9 aa, Homo Sapiens
GPHSRRKMR

SEQ ID NO: 1084323 - protein, 9 aa, Homo Sapiens
AIFGMSSFA

SEQ ID NO: 1084324 - protein, 9 aa, Homo Sapiens
RQKVAMKKL

SEQ ID NO: 1084325 - protein, 9 aa, Homo Sapiens
SYSPGSRVI

SEQ ID NO: 1084326 - protein, 9 aa, Homo Sapiens
EKSTEEGQS

SEQ ID NO: 1084327 - protein, 9 aa, Homo Sapiens
GKQFFLQCD

SEQ ID NO: 1084328 - protein, 9 aa, Homo Sapiens
NMQSIPPAI

SEQ ID NO: 1084329 - protein, 9 aa, Homo Sapiens
LLMLVTLTS

SEQ ID NO: 1084330 - protein, 9 aa, Homo Sapiens
GSAFKSDES

SEQ ID NO: 1084331 - protein, 9 aa, Homo Sapiens
RQIYYTELE

SEQ ID NO: 1084332 - protein, 9 aa, Homo Sapiens
NRAPQRQHR

SEQ ID NO: 1084333 - protein, 9 aa, Homo Sapiens
ENDLFHKNC

SEQ ID NO: 1084334 - protein, 9 aa, Homo Sapiens
HHTLRVQRF

SEQ ID NO: 1084335 - protein, 9 aa, Homo Sapiens
QNEAICHHP

SEQ ID NO: 1084336 - protein, 9 aa, Homo Sapiens
PWAKELLAG

SEQ ID NO: 1084337 - protein, 9 aa, Homo Sapiens
REENGFPDS

SEQ ID NO: 1084338 - protein, 9 aa, Homo Sapiens
LLPKNVQET

SEQ ID NO: 1084339 - protein, 9 aa, Homo Sapiens
ISDILQCDE

SEQ ID NO: 1084340 - protein, 9 aa, Homo Sapiens
LEAHYNCSF

SEQ ID NO: 1084341 - protein, 9 aa, Homo Sapiens
WDPQSREPL

SEQ ID NO: 1084342 - protein, 9 aa, Homo Sapiens
ENWYQGKIN

SEQ ID NO: 1084343 - protein, 9 aa, Homo Sapiens
ERLTSCMKA

SEQ ID NO: 1084344 - protein, 9 aa, Homo Sapiens
AGMRPSIQP

SEQ ID NO: 1084345 - protein, 9 aa, Homo Sapiens
ASRNGPGRV

SEQ ID NO: 1084346 - protein, 9 aa, Homo Sapiens
SRGPKSIIS

SEQ ID NO: 1084347 - protein, 9 aa, Homo Sapiens
AAGLLEVFL

SEQ ID NO: 1084348 - protein, 9 aa, Homo Sapiens
TALYNLHMW

SEQ ID NO: 1084349 - protein, 9 aa, Homo Sapiens
SKSFLSYKE

SEQ ID NO: 1084350 - protein, 9 aa, Homo Sapiens
LEHFPGLPI

SEQ ID NO: 1084351 - protein, 9 aa, Homo Sapiens
ILAETYVGG

SEQ ID NO: 1084352 - protein, 9 aa, Homo Sapiens
SRPCERPAC

SEQ ID NO: 1084353 - protein, 9 aa, Homo Sapiens
KPGVRYDFR

SEQ ID NO: 1084354 - protein, 9 aa, Homo Sapiens
QKLFVAENN

SEQ ID NO: 1084355 - protein, 9 aa, Homo Sapiens
ISACQEIRD

SEQ ID NO: 1084356 - protein, 9 aa, Homo Sapiens
GEGGPKKTH

SEQ ID NO: 1084357 - protein, 9 aa, Homo Sapiens
HLVPTFPFG

SEQ ID NO: 1084358 - protein, 9 aa, Homo Sapiens
CIPSSWVCD

SEQ ID NO: 1084359 - protein, 9 aa, Homo Sapiens
YEVRSCMCW

SEQ ID NO: 1084360 - protein, 9 aa, Homo Sapiens
CKTRMVLLC

SEQ ID NO: 1084361 - protein, 9 aa, Homo Sapiens
SLWLHAPSL

SEQ ID NO: 1084362 - protein, 9 aa, Homo Sapiens
LKPCSDGSE

SEQ ID NO: 1084363 - protein, 9 aa, Homo Sapiens
YEESPLQDA

SEQ ID NO: 1084364 - protein, 9 aa, Homo Sapiens
YGDRLVQEG

SEQ ID NO: 1084365 - protein, 9 aa, Homo Sapiens
AIALNGALQ

SEQ ID NO: 1084366 - protein, 9 aa, Homo Sapiens
PGLVKVVKN

SEQ ID NO: 1084367 - protein, 9 aa, Homo Sapiens
HSQELMKEN

SEQ ID NO: 1084368 - protein, 9 aa, Homo Sapiens
DASVSQESQ

SEQ ID NO: 1084369 - protein, 9 aa, Homo Sapiens
QKCRRLKNP

SEQ ID NO: 1084370 - protein, 9 aa, Homo Sapiens
APLQVSESL

SEQ ID NO: 1084371 - protein, 9 aa, Homo Sapiens
RPTPYKWMR

SEQ ID NO: 1084372 - protein, 9 aa, Homo Sapiens
YRTKKEHST

SEQ ID NO: 1084373 - protein, 9 aa, Homo Sapiens
SYTTNAFSG

SEQ ID NO: 1084374 - protein, 9 aa, Homo Sapiens
LSMHPKLAN

SEQ ID NO: 1084375 - protein, 9 aa, Homo Sapiens
GQIDQFHKA

SEQ ID NO: 1084376 - protein, 9 aa, Homo Sapiens
HGFIAGDLE

SEQ ID NO: 1084377 - protein, 9 aa, Homo Sapiens
INEGVLSIV

SEQ ID NO: 1084378 - protein, 9 aa, Homo Sapiens
KTWLLLAVS

SEQ ID NO: 1084379 - protein, 9 aa, Homo Sapiens
KPLRNPELV

SEQ ID NO: 1084380 - protein, 9 aa, Homo Sapiens
QLKAKLNFF

SEQ ID NO: 1084381 - protein, 9 aa, Homo Sapiens
FCELFPLEF

SEQ ID NO: 1084382 - protein, 9 aa, Homo Sapiens
KDASPTEEL

SEQ ID NO: 1084383 - protein, 9 aa, Homo Sapiens
GAFSGTRTP

SEQ ID NO: 1084384 - protein, 9 aa, Homo Sapiens
KYKGQVNLH

SEQ ID NO: 1084385 - protein, 9 aa, Homo Sapiens
TCHPVCRSL

SEQ ID NO: 1084386 - protein, 9 aa, Homo Sapiens
RLSVTLPHI

SEQ ID NO: 1084387 - protein, 9 aa, Homo Sapiens
RLLGKFSLV

SEQ ID NO: 1084388 - protein, 9 aa, Homo Sapiens
NTSVEKGLH

SEQ ID NO: 1084389 - protein, 9 aa, Homo Sapiens
QFLQKYLDA

SEQ ID NO: 1084390 - protein, 9 aa, Homo Sapiens
APSPKPALL

SEQ ID NO: 1084391 - protein, 9 aa, Homo Sapiens
NQLKDSEYT

SEQ ID NO: 1084392 - protein, 9 aa, Homo Sapiens
EAVFWAITI

SEQ ID NO: 1084393 - protein, 9 aa, Homo Sapiens
KLAPLSKKV

SEQ ID NO: 1084394 - protein, 9 aa, Homo Sapiens
RFSVSETGT

SEQ ID NO: 1084395 - protein, 9 aa, Homo Sapiens
EKGTVQIQE

SEQ ID NO: 1084396 - protein, 9 aa, Homo Sapiens
PSGETPKSV

SEQ ID NO: 1084397 - protein, 9 aa, Homo Sapiens
VCAFPMKKG

SEQ ID NO: 1084398 - protein, 9 aa, Homo Sapiens
YCLLNPFAC

SEQ ID NO: 1084399 - protein, 9 aa, Homo Sapiens
NILPSVSFE

SEQ ID NO: 1084400 - protein, 9 aa, Homo Sapiens
GADGKLPSS

SEQ ID NO: 1084401 - protein, 9 aa, Homo Sapiens
LIVSFNHNV

SEQ ID NO: 1084402 - protein, 9 aa, Homo Sapiens
PVPLTGDSE

SEQ ID NO: 1084403 - protein, 9 aa, Homo Sapiens
DLSTSLQES

SEQ ID NO: 1084404 - protein, 9 aa, Homo Sapiens
FGTTSFRLT

SEQ ID NO: 1084405 - protein, 9 aa, Homo Sapiens
NWKSGYLVG

SEQ ID NO: 1084406 - protein, 9 aa, Homo Sapiens
TVPCPSLGG

SEQ ID NO: 1084407 - protein, 9 aa, Homo Sapiens
LSRVLLSEA

SEQ ID NO: 1084408 - protein, 9 aa, Homo Sapiens
SNMLIKILN

SEQ ID NO: 1084409 - protein, 9 aa, Homo Sapiens
VFWAITIAG

SEQ ID NO: 1084410 - protein, 9 aa, Homo Sapiens
ELSAEEEHL

SEQ ID NO: 1084411 - protein, 9 aa, Homo Sapiens
LRSMYGAHM

SEQ ID NO: 1084412 - protein, 9 aa, Homo Sapiens
TDPKINEGV

SEQ ID NO: 1084413 - protein, 9 aa, Homo Sapiens
NYAPLNLPG

SEQ ID NO: 1084414 - protein, 9 aa, Homo Sapiens
TPPASDGDG

SEQ ID NO: 1084415 - protein, 9 aa, Homo Sapiens
SFGDNCFKC

SEQ ID NO: 1084416 - protein, 9 aa, Homo Sapiens
ASVIYAKYK

SEQ ID NO: 1084417 - protein, 9 aa, Homo Sapiens
NQREENGFP

SEQ ID NO: 1084418 - protein, 9 aa, Homo Sapiens
KNKSFEMSS

SEQ ID NO: 1084419 - protein, 9 aa, Homo Sapiens
PAPPGCPKK

SEQ ID NO: 1084420 - protein, 9 aa, Homo Sapiens
FCEEADFSP

SEQ ID NO: 1084421 - protein, 9 aa, Homo Sapiens
MALLQPTTQ

SEQ ID NO: 1084422 - protein, 9 aa, Homo Sapiens
SGTGMGSSL

SEQ ID NO: 1084423 - protein, 9 aa, Homo Sapiens
GSKEKRLRR

SEQ ID NO: 1084424 - protein, 9 aa, Homo Sapiens
FPWRKMVHG

SEQ ID NO: 1084425 - protein, 9 aa, Homo Sapiens
CPEAPSCCH

SEQ ID NO: 1084426 - protein, 9 aa, Homo Sapiens
PFSIESVMD

SEQ ID NO: 1084427 - protein, 9 aa, Homo Sapiens
SEVWLQWQS

SEQ ID NO: 1084428 - protein, 9 aa, Homo Sapiens
TRKEDLEDQ

SEQ ID NO: 1084429 - protein, 9 aa, Homo Sapiens
WMQALTSCE

SEQ ID NO: 1084430 - protein, 9 aa, Homo Sapiens
RFRHLLHLL

SEQ ID NO: 1084431 - protein, 9 aa, Homo Sapiens
YVTFVVSFY

SEQ ID NO: 1084432 - protein, 9 aa, Homo Sapiens
LSNLSFLKL

SEQ ID NO: 1084433 - protein, 9 aa, Homo Sapiens
AAWGEIQNV

SEQ ID NO: 1084434 - protein, 9 aa, Homo Sapiens
LGLPHPRSS

SEQ ID NO: 1084435 - protein, 9 aa, Homo Sapiens
FLFVGFFAV

SEQ ID NO: 1084436 - protein, 9 aa, Homo Sapiens
LNNDSEKVV

SEQ ID NO: 1084437 - protein, 9 aa, Homo Sapiens
FNERPAKST

SEQ ID NO: 1084438 - protein, 9 aa, Homo Sapiens
FLQKYLDAI

SEQ ID NO: 1084439 - protein, 9 aa, Homo Sapiens
SIEDFELEV

SEQ ID NO: 1084440 - protein, 9 aa, Homo Sapiens
SFWYHLHGS

SEQ ID NO: 1084441 - protein, 9 aa, Homo Sapiens
FSFSYCKSY

SEQ ID NO: 1084442 - protein, 9 aa, Homo Sapiens
ARGNTAAQM

SEQ ID NO: 1084443 - protein, 9 aa, Homo Sapiens
KGPSTPLSE

SEQ ID NO: 1084444 - protein, 9 aa, Homo Sapiens
APYHFSFSL

SEQ ID NO: 1084445 - protein, 9 aa, Homo Sapiens
RDKFRDFAW

SEQ ID NO: 1084446 - protein, 9 aa, Homo Sapiens
MLGMPSSTE

SEQ ID NO: 1084447 - protein, 9 aa, Homo Sapiens
KIEDIFFQP

SEQ ID NO: 1084448 - protein, 9 aa, Homo Sapiens
PPDANVTWL

SEQ ID NO: 1084449 - protein, 9 aa, Homo Sapiens
SLNYNNKSA

SEQ ID NO: 1084450 - protein, 9 aa, Homo Sapiens
LNLCELTED

SEQ ID NO: 1084451 - protein, 9 aa, Homo Sapiens
NYANSYRGF

SEQ ID NO: 1084452 - protein, 9 aa, Homo Sapiens
FSSGAKSSS

SEQ ID NO: 1084453 - protein, 9 aa, Homo Sapiens
SPLQEDTLF

SEQ ID NO: 1084454 - protein, 9 aa, Homo Sapiens
PTFPFGETE

SEQ ID NO: 1084455 - protein, 9 aa, Homo Sapiens
SGRDISGPG

SEQ ID NO: 1084456 - protein, 9 aa, Homo Sapiens
YDRCAAQFF

SEQ ID NO: 1084457 - protein, 9 aa, Homo Sapiens
LFPLSRLRY

SEQ ID NO: 1084458 - protein, 9 aa, Homo Sapiens
HSRIHSREK

SEQ ID NO: 1084459 - protein, 9 aa, Homo Sapiens
GSFKLEKSN

SEQ ID NO: 1084460 - protein, 9 aa, Homo Sapiens
DSIEPHNAK

SEQ ID NO: 1084461 - protein, 9 aa, Homo Sapiens
PHPPDFEMI

SEQ ID NO: 1084462 - protein, 9 aa, Homo Sapiens
RKYFFKAVH

SEQ ID NO: 1084463 - protein, 9 aa, Homo Sapiens
MASMGPKPH

SEQ ID NO: 1084464 - protein, 9 aa, Homo Sapiens
TLPADSYQI

SEQ ID NO: 1084465 - protein, 9 aa, Homo Sapiens
VAKLAKAQP

SEQ ID NO: 1084466 - protein, 9 aa, Homo Sapiens
CPGQYNPSF

SEQ ID NO: 1084467 - protein, 9 aa, Homo Sapiens
RFVCVGVPT

SEQ ID NO: 1084468 - protein, 9 aa, Homo Sapiens
EPAFYIAGD

SEQ ID NO: 1084469 - protein, 9 aa, Homo Sapiens
SFQGHHPES

SEQ ID NO: 1084470 - protein, 9 aa, Homo Sapiens
SSLERRKKG

SEQ ID NO: 1084471 - protein, 9 aa, Homo Sapiens
LLPTVLGHM

SEQ ID NO: 1084472 - protein, 9 aa, Homo Sapiens
KEQQKAKDG

SEQ ID NO: 1084473 - protein, 9 aa, Homo Sapiens
IRPSCPDTA

SEQ ID NO: 1084474 - protein, 9 aa, Homo Sapiens
VQVWFKNCR

SEQ ID NO: 1084475 - protein, 9 aa, Homo Sapiens
FEVLNGLQA

SEQ ID NO: 1084476 - protein, 9 aa, Homo Sapiens
ILIPEITSK

SEQ ID NO: 1084477 - protein, 9 aa, Homo Sapiens
STVLQTWQK

SEQ ID NO: 1084478 - protein, 9 aa, Homo Sapiens
RSQAEAESW

SEQ ID NO: 1084479 - protein, 9 aa, Homo Sapiens
RYLIKFSSK

SEQ ID NO: 1084480 - protein, 9 aa, Homo Sapiens
NKTNIYGQK

SEQ ID NO: 1084481 - protein, 9 aa, Homo Sapiens
TNYANSYRG

SEQ ID NO: 1084482 - protein, 9 aa, Homo Sapiens
TNMQSIPPA

SEQ ID NO: 1084483 - protein, 9 aa, Homo Sapiens
KIASEYKYK

SEQ ID NO: 1084484 - protein, 9 aa, Homo Sapiens
VILIFIVIF

SEQ ID NO: 1084485 - protein, 9 aa, Homo Sapiens
YIAGDACLQ

SEQ ID NO: 1084486 - protein, 9 aa, Homo Sapiens
KKKMVTSSE

SEQ ID NO: 1084487 - protein, 9 aa, Homo Sapiens
PDNINPCLC

SEQ ID NO: 1084488 - protein, 9 aa, Homo Sapiens
ALNGALQLA

SEQ ID NO: 1084489 - protein, 9 aa, Homo Sapiens
SNRALSTLY

SEQ ID NO: 1084490 - protein, 9 aa, Homo Sapiens
RGDVNNQDA

SEQ ID NO: 1084491 - protein, 9 aa, Homo Sapiens
CLDFRPLFR

SEQ ID NO: 1084492 - protein, 9 aa, Homo Sapiens
KEIKKNEKP

SEQ ID NO: 1084493 - protein, 9 aa, Homo Sapiens
RKNYSQRPL

SEQ ID NO: 1084494 - protein, 9 aa, Homo Sapiens
WVSWSACSV

SEQ ID NO: 1084495 - protein, 9 aa, Homo Sapiens
PGSPSPPGL

SEQ ID NO: 1084496 - protein, 9 aa, Homo Sapiens
GLVVSLIGI

SEQ ID NO: 1084497 - protein, 9 aa, Homo Sapiens
PRFSSSDEI

SEQ ID NO: 1084498 - protein, 9 aa, Homo Sapiens
LQGFQLTHL

SEQ ID NO: 1084499 - protein, 9 aa, Homo Sapiens
FVKRKGAKC

SEQ ID NO: 1084500 - protein, 9 aa, Homo Sapiens
LQALYMGKE

SEQ ID NO: 1084501 - protein, 9 aa, Homo Sapiens
PPAPPSLAS

SEQ ID NO: 1084502 - protein, 9 aa, Homo Sapiens
PALQEKAAF

SEQ ID NO: 1084503 - protein, 9 aa, Homo Sapiens
EGPATLMSA

SEQ ID NO: 1084504 - protein, 9 aa, Homo Sapiens
PEGEMKKGL

SEQ ID NO: 1084505 - protein, 9 aa, Homo Sapiens
VSPLSGKRR

SEQ ID NO: 1084506 - protein, 9 aa, Homo Sapiens
MLLIFLLLA

SEQ ID NO: 1084507 - protein, 9 aa, Homo Sapiens
FIRTEPSLG

SEQ ID NO: 1084508 - protein, 9 aa, Homo Sapiens
PPRAPALCW

SEQ ID NO: 1084509 - protein, 9 aa, Homo Sapiens
DNGWNTTAS

SEQ ID NO: 1084510 - protein, 9 aa, Homo Sapiens
LYELQPAAS

SEQ ID NO: 1084511 - protein, 9 aa, Homo Sapiens
CKECLPGAW

SEQ ID NO: 1084512 - protein, 9 aa, Homo Sapiens
VTAGRPGDD

SEQ ID NO: 1084513 - protein, 9 aa, Homo Sapiens
PLEEGNYFF

SEQ ID NO: 1084514 - protein, 9 aa, Homo Sapiens
PLKEEVAPK

SEQ ID NO: 1084515 - protein, 9 aa, Homo Sapiens
GTDSIPLCQ

SEQ ID NO: 1084516 - protein, 9 aa, Homo Sapiens
PPPSYSGCA

SEQ ID NO: 1084517 - protein, 9 aa, Homo Sapiens
AHCSSAPSW

SEQ ID NO: 1084518 - protein, 9 aa, Homo Sapiens
TKERNCYEY

SEQ ID NO: 1084519 - protein, 9 aa, Homo Sapiens
TNWHTGTIF

SEQ ID NO: 1084520 - protein, 9 aa, Homo Sapiens
EDHSSDMLN

SEQ ID NO: 1084521 - protein, 9 aa, Homo Sapiens
VFHTFCQLD

SEQ ID NO: 1084522 - protein, 9 aa, Homo Sapiens
SGETPKSVD

SEQ ID NO: 1084523 - protein, 9 aa, Homo Sapiens
PHSSDPLLD

SEQ ID NO: 1084524 - protein, 9 aa, Homo Sapiens
VPFQALYYL

SEQ ID NO: 1084525 - protein, 9 aa, Homo Sapiens
LFPETFEVV

SEQ ID NO: 1084526 - protein, 9 aa, Homo Sapiens
TRPDQDNHV

SEQ ID NO: 1084527 - protein, 9 aa, Homo Sapiens
QNPSSLLQR

SEQ ID NO: 1084528 - protein, 9 aa, Homo Sapiens
ATGKNGYIS

SEQ ID NO: 1084529 - protein, 9 aa, Homo Sapiens
VAHACNSST

SEQ ID NO: 1084530 - protein, 9 aa, Homo Sapiens
RCEKPYLRI

SEQ ID NO: 1084531 - protein, 9 aa, Homo Sapiens
SHSLSPESV

SEQ ID NO: 1084532 - protein, 9 aa, Homo Sapiens
ILSDNVVNI

SEQ ID NO: 1084533 - protein, 9 aa, Homo Sapiens
YPIVLGPNN

SEQ ID NO: 1084534 - protein, 9 aa, Homo Sapiens
SDDAWKVYY

SEQ ID NO: 1084535 - protein, 9 aa, Homo Sapiens
EGKDYPVAR

SEQ ID NO: 1084536 - protein, 9 aa, Homo Sapiens
PPVSSWPRA

SEQ ID NO: 1084537 - protein, 9 aa, Homo Sapiens
LVTCVPRCT

SEQ ID NO: 1084538 - protein, 9 aa, Homo Sapiens
LESPAIISL

SEQ ID NO: 1084539 - protein, 9 aa, Homo Sapiens
DCAGIDLRE

SEQ ID NO: 1084540 - protein, 9 aa, Homo Sapiens
RRSRLSVTL

SEQ ID NO: 1084541 - protein, 9 aa, Homo Sapiens
LGVFNNQEN

SEQ ID NO: 1084542 - protein, 9 aa, Homo Sapiens
IYQQSRKNN

SEQ ID NO: 1084543 - protein, 9 aa, Homo Sapiens
TKEGMIRVR

SEQ ID NO: 1084544 - protein, 9 aa, Homo Sapiens
IKLICVTEV

SEQ ID NO: 1084545 - protein, 9 aa, Homo Sapiens
LCQDITGDI

SEQ ID NO: 1084546 - protein, 9 aa, Homo Sapiens
EVLTEHLDW

SEQ ID NO: 1084547 - protein, 9 aa, Homo Sapiens
QPKAPRFSS

SEQ ID NO: 1084548 - protein, 9 aa, Homo Sapiens
ELKVCKPNG

SEQ ID NO: 1084549 - protein, 9 aa, Homo Sapiens
KQREKPLGQ

SEQ ID NO: 1084550 - protein, 9 aa, Homo Sapiens
EVARKGADV

SEQ ID NO: 1084551 - protein, 9 aa, Homo Sapiens
LDLRVREEP

SEQ ID NO: 1084552 - protein, 9 aa, Homo Sapiens
VKKGQLPIP

SEQ ID NO: 1084553 - protein, 9 aa, Homo Sapiens
TLSPALSPS

SEQ ID NO: 1084554 - protein, 9 aa, Homo Sapiens
CVFDFNFIP

SEQ ID NO: 1084555 - protein, 9 aa, Homo Sapiens
VSSWPRAQG

SEQ ID NO: 1084556 - protein, 9 aa, Homo Sapiens
DNSSFHHGE

SEQ ID NO: 1084557 - protein, 9 aa, Homo Sapiens
TNLDIKPSN

SEQ ID NO: 1084558 - protein, 9 aa, Homo Sapiens
YFNVASVIY

SEQ ID NO: 1084559 - protein, 9 aa, Homo Sapiens
LPSPLPTYH

SEQ ID NO: 1084560 - protein, 9 aa, Homo Sapiens
DPYRQQSLA

SEQ ID NO: 1084561 - protein, 9 aa, Homo Sapiens
VLSSSSHAA

SEQ ID NO: 1084562 - protein, 9 aa, Homo Sapiens
VAMKKLSRP

SEQ ID NO: 1084563 - protein, 9 aa, Homo Sapiens
IYDVWVCHP

SEQ ID NO: 1084564 - protein, 9 aa, Homo Sapiens
VAEPFTSEC

SEQ ID NO: 1084565 - protein, 9 aa, Homo Sapiens
IIPSLPKDD

SEQ ID NO: 1084566 - protein, 9 aa, Homo Sapiens
SNRCLKDTD

SEQ ID NO: 1084567 - protein, 9 aa, Homo Sapiens
KAVKAIISC

SEQ ID NO: 1084568 - protein, 9 aa, Homo Sapiens
FQEQEVLER

SEQ ID NO: 1084569 - protein, 9 aa, Homo Sapiens
TTVSEAPGP

SEQ ID NO: 1084570 - protein, 9 aa, Homo Sapiens
VCRSLIQLD

SEQ ID NO: 1084571 - protein, 9 aa, Homo Sapiens
ASSSYRTKK

SEQ ID NO: 1084572 - protein, 9 aa, Homo Sapiens
ALCAARLQY

SEQ ID NO: 1084573 - protein, 9 aa, Homo Sapiens
LAITYGALF

SEQ ID NO: 1084574 - protein, 9 aa, Homo Sapiens
EDIIEVLIS

SEQ ID NO: 1084575 - protein, 9 aa, Homo Sapiens
ASTFTQKMG

SEQ ID NO: 1084576 - protein, 9 aa, Homo Sapiens
VKEAGESSS

SEQ ID NO: 1084577 - protein, 9 aa, Homo Sapiens
LWSTAFKGE

SEQ ID NO: 1084578 - protein, 9 aa, Homo Sapiens
CCVAFSFLW

SEQ ID NO: 1084579 - protein, 9 aa, Homo Sapiens
QVNHKNKEL

SEQ ID NO: 1084580 - protein, 9 aa, Homo Sapiens
IDVKEVDST

SEQ ID NO: 1084581 - protein, 9 aa, Homo Sapiens
ESHTFGKFY

SEQ ID NO: 1084582 - protein, 9 aa, Homo Sapiens
EYEESPLQD

SEQ ID NO: 1084583 - protein, 9 aa, Homo Sapiens
AILCFLAYD

SEQ ID NO: 1084584 - protein, 9 aa, Homo Sapiens
NVQETKIQS

SEQ ID NO: 1084585 - protein, 9 aa, Homo Sapiens
AAEAHPLVG

SEQ ID NO: 1084586 - protein, 9 aa, Homo Sapiens
TTNAFSGEY

SEQ ID NO: 1084587 - protein, 9 aa, Homo Sapiens
GEKLGTEEN

SEQ ID NO: 1084588 - protein, 9 aa, Homo Sapiens
LTHHKGVNF

SEQ ID NO: 1084589 - protein, 9 aa, Homo Sapiens
NPIQKKSEY

SEQ ID NO: 1084590 - protein, 9 aa, Homo Sapiens
FEAKKESLP

SEQ ID NO: 1084591 - protein, 9 aa, Homo Sapiens
SEEKSQRLK

SEQ ID NO: 1084592 - protein, 9 aa, Homo Sapiens
SCMKRHGIL

SEQ ID NO: 1084593 - protein, 9 aa, Homo Sapiens
RFKFSEERA

SEQ ID NO: 1084594 - protein, 9 aa, Homo Sapiens
RKRGRFPES

SEQ ID NO: 1084595 - protein, 9 aa, Homo Sapiens
THSSARPHP

SEQ ID NO: 1084596 - protein, 9 aa, Homo Sapiens
TAAEQRKAF

SEQ ID NO: 1084597 - protein, 9 aa, Homo Sapiens
FFSSPLRPF

SEQ ID NO: 1084598 - protein, 9 aa, Homo Sapiens
VNYAPLNLP

SEQ ID NO: 1084599 - protein, 9 aa, Homo Sapiens
VNHKNKELY

SEQ ID NO: 1084600 - protein, 9 aa, Homo Sapiens
LCPGPPTAG

SEQ ID NO: 1084601 - protein, 9 aa, Homo Sapiens
HVAQMEQKQ

SEQ ID NO: 1084602 - protein, 9 aa, Homo Sapiens
KTRLELPDQ

SEQ ID NO: 1084603 - protein, 9 aa, Homo Sapiens
ISKKKNKSF

SEQ ID NO: 1084604 - protein, 9 aa, Homo Sapiens
QGRGEAAWN

SEQ ID NO: 1084605 - protein, 9 aa, Homo Sapiens
YKKENEMMK

SEQ ID NO: 1084606 - protein, 9 aa, Homo Sapiens
TTMRINKQN

SEQ ID NO: 1084607 - protein, 9 aa, Homo Sapiens
RINVYYIEA

SEQ ID NO: 1084608 - protein, 9 aa, Homo Sapiens
ISKNIADPT

SEQ ID NO: 1084609 - protein, 9 aa, Homo Sapiens
QKGLESGRG

SEQ ID NO: 1084610 - protein, 9 aa, Homo Sapiens
AFWNEGYIM

SEQ ID NO: 1084611 - protein, 9 aa, Homo Sapiens
SPELKEGYQ

SEQ ID NO: 1084612 - protein, 9 aa, Homo Sapiens
FLSNLSFLK

SEQ ID NO: 1084613 - protein, 9 aa, Homo Sapiens
CWVVWKVYF

SEQ ID NO: 1084614 - protein, 9 aa, Homo Sapiens
SEHQRIYTG

SEQ ID NO: 1084615 - protein, 9 aa, Homo Sapiens
KLCYTTVVV

SEQ ID NO: 1084616 - protein, 9 aa, Homo Sapiens
NGYISSNYV

SEQ ID NO: 1084617 - protein, 9 aa, Homo Sapiens
HRDREIIFN

SEQ ID NO: 1084618 - protein, 9 aa, Homo Sapiens
LVTLIVGCG

SEQ ID NO: 1084619 - protein, 9 aa, Homo Sapiens
KIKLPGAFI

SEQ ID NO: 1084620 - protein, 9 aa, Homo Sapiens
PAFAFSLNS

SEQ ID NO: 1084621 - protein, 9 aa, Homo Sapiens
MIQGLFYGS

SEQ ID NO: 1084622 - protein, 9 aa, Homo Sapiens
LSRKSYIWP

SEQ ID NO: 1084623 - protein, 9 aa, Homo Sapiens
ASQTYECLH

SEQ ID NO: 1084624 - protein, 9 aa, Homo Sapiens
LKRVQFEEK

SEQ ID NO: 1084625 - protein, 9 aa, Homo Sapiens
MAHSPPPGT

SEQ ID NO: 1084626 - protein, 9 aa, Homo Sapiens
HSLMYFLLG

SEQ ID NO: 1084627 - protein, 9 aa, Homo Sapiens
SGDHDDSAI

SEQ ID NO: 1084628 - protein, 9 aa, Homo Sapiens
VVLVKNNGE

SEQ ID NO: 1084629 - protein, 9 aa, Homo Sapiens
GVPPDQLPL

SEQ ID NO: 1084630 - protein, 9 aa, Homo Sapiens
PWVKSSHSM

SEQ ID NO: 1084631 - protein, 9 aa, Homo Sapiens
LNKIAKKIK

SEQ ID NO: 1084632 - protein, 9 aa, Homo Sapiens
YFFSLLIYM

SEQ ID NO: 1084633 - protein, 9 aa, Homo Sapiens
GGSDFSLSE

SEQ ID NO: 1084634 - protein, 9 aa, Homo Sapiens
QEIKERDLD

SEQ ID NO: 1084635 - protein, 9 aa, Homo Sapiens
NLEPYIESF

SEQ ID NO: 1084636 - protein, 9 aa, Homo Sapiens
LVYERELEQ

SEQ ID NO: 1084637 - protein, 9 aa, Homo Sapiens
VKSYSIEMS

SEQ ID NO: 1084638 - protein, 9 aa, Homo Sapiens
LIKFSSKLS

SEQ ID NO: 1084639 - protein, 9 aa, Homo Sapiens
LSPSQRLGG

SEQ ID NO: 1084640 - protein, 9 aa, Homo Sapiens
NSKLCFHQR

SEQ ID NO: 1084641 - protein, 9 aa, Homo Sapiens
NCITTLRPE

SEQ ID NO: 1084642 - protein, 9 aa, Homo Sapiens
FLEHQKMKK

SEQ ID NO: 1084643 - protein, 9 aa, Homo Sapiens
NSHSLSPES

SEQ ID NO: 1084644 - protein, 9 aa, Homo Sapiens
EEARLNKEI

SEQ ID NO: 1084645 - protein, 9 aa, Homo Sapiens
SSKCVSRRR

SEQ ID NO: 1084646 - protein, 9 aa, Homo Sapiens
RFWKEIYVG

SEQ ID NO: 1084647 - protein, 9 aa, Homo Sapiens
SDDWAAKKF

SEQ ID NO: 1084648 - protein, 9 aa, Homo Sapiens
GILFVTYPE

SEQ ID NO: 1084649 - protein, 9 aa, Homo Sapiens
TNREHDLLS

SEQ ID NO: 1084650 - protein, 9 aa, Homo Sapiens
GERFPLSEV

SEQ ID NO: 1084651 - protein, 9 aa, Homo Sapiens
AALLSPGSL

SEQ ID NO: 1084652 - protein, 9 aa, Homo Sapiens
CIPDCTSWD

SEQ ID NO: 1084653 - protein, 9 aa, Homo Sapiens
LGTGDLYTP

SEQ ID NO: 1084654 - protein, 9 aa, Homo Sapiens
TGCTWRFRH

SEQ ID NO: 1084655 - protein, 9 aa, Homo Sapiens
AMLLIFLLL

SEQ ID NO: 1084656 - protein, 9 aa, Homo Sapiens
FQQHPVVLS

SEQ ID NO: 1084657 - protein, 9 aa, Homo Sapiens
SAGEVKRSV

SEQ ID NO: 1084658 - protein, 9 aa, Homo Sapiens
PPPADSPFE

SEQ ID NO: 1084659 - protein, 9 aa, Homo Sapiens
WYQCHRPKY

SEQ ID NO: 1084660 - protein, 9 aa, Homo Sapiens
LKVCKPNGK

SEQ ID NO: 1084661 - protein, 9 aa, Homo Sapiens
GRRACLPAS

SEQ ID NO: 1084662 - protein, 9 aa, Homo Sapiens
QTPSPVLRL

SEQ ID NO: 1084663 - protein, 9 aa, Homo Sapiens
RFTCLFVEK

SEQ ID NO: 1084664 - protein, 9 aa, Homo Sapiens
VTHRQGLQT

SEQ ID NO: 1084665 - protein, 9 aa, Homo Sapiens
LSRATPDEA

SEQ ID NO: 1084666 - protein, 9 aa, Homo Sapiens
FLQGFRDIL

SEQ ID NO: 1084667 - protein, 9 aa, Homo Sapiens
AASQYAHLC

SEQ ID NO: 1084668 - protein, 9 aa, Homo Sapiens
NEPTDIIPR

SEQ ID NO: 1084669 - protein, 9 aa, Homo Sapiens
FTIGPSNTT

SEQ ID NO: 1084670 - protein, 9 aa, Homo Sapiens
QKGRYKQEF

SEQ ID NO: 1084671 - protein, 9 aa, Homo Sapiens
LKEEVAPKE

SEQ ID NO: 1084672 - protein, 9 aa, Homo Sapiens
QQAFEEAWR

SEQ ID NO: 1084673 - protein, 9 aa, Homo Sapiens
QNRGPKNSK

SEQ ID NO: 1084674 - protein, 9 aa, Homo Sapiens
PGLPAHKTS

SEQ ID NO: 1084675 - protein, 9 aa, Homo Sapiens
GPQSPIGPP

SEQ ID NO: 1084676 - protein, 9 aa, Homo Sapiens
VKKLFLDNS

SEQ ID NO: 1084677 - protein, 9 aa, Homo Sapiens
TTNPQEETL

SEQ ID NO: 1084678 - protein, 9 aa, Homo Sapiens
GQFKTALEL

SEQ ID NO: 1084679 - protein, 9 aa, Homo Sapiens
ISLEYRSIS

SEQ ID NO: 1084680 - protein, 9 aa, Homo Sapiens
DSTKALAEF

SEQ ID NO: 1084681 - protein, 9 aa, Homo Sapiens
NLHMWSQIK

SEQ ID NO: 1084682 - protein, 9 aa, Homo Sapiens
SFIRDIRRR

SEQ ID NO: 1084683 - protein, 9 aa, Homo Sapiens
LSQGTDLSG

SEQ ID NO: 1084684 - protein, 9 aa, Homo Sapiens
PGLVSTPDN

SEQ ID NO: 1084685 - protein, 9 aa, Homo Sapiens
VPCPSLGGD

SEQ ID NO: 1084686 - protein, 9 aa, Homo Sapiens
TGKKEETKS

SEQ ID NO: 1084687 - protein, 9 aa, Homo Sapiens
EDSPELKPR

SEQ ID NO: 1084688 - protein, 9 aa, Homo Sapiens
EVIHQMPDL

SEQ ID NO: 1084689 - protein, 9 aa, Homo Sapiens
QAGPLSRPP

SEQ ID NO: 1084690 - protein, 9 aa, Homo Sapiens
KAVLLLNPL

SEQ ID NO: 1084691 - protein, 9 aa, Homo Sapiens
TAHLEMYVQ

SEQ ID NO: 1084692 - protein, 9 aa, Homo Sapiens
RQQSLALLP

SEQ ID NO: 1084693 - protein, 9 aa, Homo Sapiens
RAPALCWRK

SEQ ID NO: 1084694 - protein, 9 aa, Homo Sapiens
YLKPQSKEA

SEQ ID NO: 1084695 - protein, 9 aa, Homo Sapiens
WLAVSLKNI

SEQ ID NO: 1084696 - protein, 9 aa, Homo Sapiens
SYLQTFLAG

SEQ ID NO: 1084697 - protein, 9 aa, Homo Sapiens
KHLAALTAA

SEQ ID NO: 1084698 - protein, 9 aa, Homo Sapiens
SPLLRDQFL

SEQ ID NO: 1084699 - protein, 9 aa, Homo Sapiens
DMKVFPPFY

SEQ ID NO: 1084700 - protein, 9 aa, Homo Sapiens
KGEKNTMMR

SEQ ID NO: 1084701 - protein, 9 aa, Homo Sapiens
QFLVLILSG

SEQ ID NO: 1084702 - protein, 9 aa, Homo Sapiens
RPTALTSLE

SEQ ID NO: 1084703 - protein, 9 aa, Homo Sapiens
SKRTRSVNK

SEQ ID NO: 1084704 - protein, 9 aa, Homo Sapiens
PSVFVRTTK

SEQ ID NO: 1084705 - protein, 9 aa, Homo Sapiens
LRRIKANAR

SEQ ID NO: 1084706 - protein, 9 aa, Homo Sapiens
FRDILHRSE

SEQ ID NO: 1084707 - protein, 9 aa, Homo Sapiens
DTSLHSLMY

SEQ ID NO: 1084708 - protein, 9 aa, Homo Sapiens
ASQNTDKTF

SEQ ID NO: 1084709 - protein, 9 aa, Homo Sapiens
RLKPCFLRW

SEQ ID NO: 1084710 - protein, 9 aa, Homo Sapiens
SNITLQNEI

SEQ ID NO: 1084711 - protein, 9 aa, Homo Sapiens
ECGKIFYSK

SEQ ID NO: 1084712 - protein, 9 aa, Homo Sapiens
GYPTPPPYS

SEQ ID NO: 1084713 - protein, 9 aa, Homo Sapiens
EEDETSLQK

SEQ ID NO: 1084714 - protein, 9 aa, Homo Sapiens
MEVQTKKVQ

SEQ ID NO: 1084715 - protein, 9 aa, Homo Sapiens
APIIYYNIV

SEQ ID NO: 1084716 - protein, 9 aa, Homo Sapiens
CNEGGKAFI

SEQ ID NO: 1084717 - protein, 9 aa, Homo Sapiens
LKNIDITEH

SEQ ID NO: 1084718 - protein, 9 aa, Homo Sapiens
SEGWRRPAF

SEQ ID NO: 1084719 - protein, 9 aa, Homo Sapiens
NLKLEAHYN

SEQ ID NO: 1084720 - protein, 9 aa, Homo Sapiens
IISLLFAEL

SEQ ID NO: 1084721 - protein, 9 aa, Homo Sapiens
KKIALHTNR

SEQ ID NO: 1084722 - protein, 9 aa, Homo Sapiens
VYGVPFSTN

SEQ ID NO: 1084723 - protein, 9 aa, Homo Sapiens
SEDDFYWPS

SEQ ID NO: 1084724 - protein, 9 aa, Homo Sapiens
GNWMFPADF

SEQ ID NO: 1084725 - protein, 9 aa, Homo Sapiens
KKKIVLKQE

SEQ ID NO: 1084726 - protein, 9 aa, Homo Sapiens
WVELVVATW

SEQ ID NO: 1084727 - protein, 9 aa, Homo Sapiens
LHHKPINRR

SEQ ID NO: 1084728 - protein, 9 aa, Homo Sapiens
LQQQSGEFF

SEQ ID NO: 1084729 - protein, 9 aa, Homo Sapiens
DVVNKGRKS

SEQ ID NO: 1084730 - protein, 9 aa, Homo Sapiens
YSTPSVYLE

SEQ ID NO: 1084731 - protein, 9 aa, Homo Sapiens
LIFLLLAAG

SEQ ID NO: 1084732 - protein, 9 aa, Homo Sapiens
DVMFLSVVA

SEQ ID NO: 1084733 - protein, 9 aa, Homo Sapiens
EFFLFVGFF

SEQ ID NO: 1084734 - protein, 9 aa, Homo Sapiens
HALYSGQLV

SEQ ID NO: 1084735 - protein, 9 aa, Homo Sapiens
QRVIRVPDH

SEQ ID NO: 1084736 - protein, 9 aa, Homo Sapiens
AHLGTGDLY

SEQ ID NO: 1084737 - protein, 9 aa, Homo Sapiens
LVWQLASLV

SEQ ID NO: 1084738 - protein, 9 aa, Homo Sapiens
LPNNRFFAV

SEQ ID NO: 1084739 - protein, 9 aa, Homo Sapiens
DKELGSNSP

SEQ ID NO: 1084740 - protein, 9 aa, Homo Sapiens
GSCGGSKEG

SEQ ID NO: 1084741 - protein, 9 aa, Homo Sapiens
SSHSGLRSA

SEQ ID NO: 1084742 - protein, 9 aa, Homo Sapiens
NTDKTFQNQ

SEQ ID NO: 1084743 - protein, 9 aa, Homo Sapiens
DIWWFFTLI

SEQ ID NO: 1084744 - protein, 9 aa, Homo Sapiens
VMNTQLWVE

SEQ ID NO: 1084745 - protein, 9 aa, Homo Sapiens
PVVYTTVRS

SEQ ID NO: 1084746 - protein, 9 aa, Homo Sapiens
PGTADFNIS

SEQ ID NO: 1084747 - protein, 9 aa, Homo Sapiens
FNPLEDNDD

SEQ ID NO: 1084748 - protein, 9 aa, Homo Sapiens
VAQKNFRKQ

SEQ ID NO: 1084749 - protein, 9 aa, Homo Sapiens
LFCELFPLE

SEQ ID NO: 1084750 - protein, 9 aa, Homo Sapiens
ADGQCLLNT

SEQ ID NO: 1084751 - protein, 9 aa, Homo Sapiens
CRGGPPVSS

SEQ ID NO: 1084752 - protein, 9 aa, Homo Sapiens
GRTTAQWFL

SEQ ID NO: 1084753 - protein, 9 aa, Homo Sapiens
QENSELRRT

SEQ ID NO: 1084754 - protein, 9 aa, Homo Sapiens
CLVNGKTPC

SEQ ID NO: 1084755 - protein, 9 aa, Homo Sapiens
YYGHIRLVQ

SEQ ID NO: 1084756 - protein, 9 aa, Homo Sapiens
ERVLIDKGK

SEQ ID NO: 1084757 - protein, 9 aa, Homo Sapiens
ILFVTYPEG

SEQ ID NO: 1084758 - protein, 9 aa, Homo Sapiens
KETTRTELI

SEQ ID NO: 1084759 - protein, 9 aa, Homo Sapiens
VLHECNSSY

SEQ ID NO: 1084760 - protein, 9 aa, Homo Sapiens
STWMLGASQ

SEQ ID NO: 1084761 - protein, 9 aa, Homo Sapiens
LPHPRSSAH

SEQ ID NO: 1084762 - protein, 9 aa, Homo Sapiens
SFLPVDKGG

SEQ ID NO: 1084763 - protein, 9 aa, Homo Sapiens
QVSARNAGV

SEQ ID NO: 1084764 - protein, 9 aa, Homo Sapiens
MFFWPRLRD

SEQ ID NO: 1084765 - protein, 9 aa, Homo Sapiens
SHSDTFISL

SEQ ID NO: 1084766 - protein, 9 aa, Homo Sapiens
KNQREENGF

SEQ ID NO: 1084767 - protein, 9 aa, Homo Sapiens
LGIPSGPSK

SEQ ID NO: 1084768 - protein, 9 aa, Homo Sapiens
VSQSKNAPK

SEQ ID NO: 1084769 - protein, 9 aa, Homo Sapiens
SPIGPPGEK

SEQ ID NO: 1084770 - protein, 9 aa, Homo Sapiens
QTNPMLFHL

SEQ ID NO: 1084771 - protein, 9 aa, Homo Sapiens
VLVLELLPG

SEQ ID NO: 1084772 - protein, 9 aa, Homo Sapiens
KILAFVPET

SEQ ID NO: 1084773 - protein, 9 aa, Homo Sapiens
PKEDRLETV

SEQ ID NO: 1084774 - protein, 9 aa, Homo Sapiens
FVCSGLLGP

SEQ ID NO: 1084775 - protein, 9 aa, Homo Sapiens
IYYTELEKY

SEQ ID NO: 1084776 - protein, 9 aa, Homo Sapiens
NKYFRQPPP

SEQ ID NO: 1084777 - protein, 9 aa, Homo Sapiens
LHQRFIAEL

SEQ ID NO: 1084778 - protein, 9 aa, Homo Sapiens
HLDSVQKEL

SEQ ID NO: 1084779 - protein, 9 aa, Homo Sapiens
RLVQEGVIQ

SEQ ID NO: 1084780 - protein, 9 aa, Homo Sapiens
VNNNLDHEY

SEQ ID NO: 1084781 - protein, 9 aa, Homo Sapiens
GTVNCGDDR

SEQ ID NO: 1084782 - protein, 9 aa, Homo Sapiens
RVQRFSEAF

SEQ ID NO: 1084783 - protein, 9 aa, Homo Sapiens
YGKYRDLFR

SEQ ID NO: 1084784 - protein, 9 aa, Homo Sapiens
VQERLATAL

SEQ ID NO: 1084785 - protein, 9 aa, Homo Sapiens
LQDPFLKNM

SEQ ID NO: 1084786 - protein, 9 aa, Homo Sapiens
TVLQTWQKM

SEQ ID NO: 1084787 - protein, 9 aa, Homo Sapiens
DGSESRGEL

SEQ ID NO: 1084788 - protein, 9 aa, Homo Sapiens
GLPGPQSPI

SEQ ID NO: 1084789 - protein, 9 aa, Homo Sapiens
LGPQPLCTE

SEQ ID NO: 1084790 - protein, 9 aa, Homo Sapiens
VQFEEKLSP

SEQ ID NO: 1084791 - protein, 9 aa, Homo Sapiens
DFWKKENNL

SEQ ID NO: 1084792 - protein, 9 aa, Homo Sapiens
KELDSYRLD

SEQ ID NO: 1084793 - protein, 9 aa, Homo Sapiens
LPTKKEESL

SEQ ID NO: 1084794 - protein, 9 aa, Homo Sapiens
QLKDSEYTP

SEQ ID NO: 1084795 - protein, 9 aa, Homo Sapiens
VFEGEGPAT

SEQ ID NO: 1084796 - protein, 9 aa, Homo Sapiens
VVLSTAEAK

SEQ ID NO: 1084797 - protein, 9 aa, Homo Sapiens
VVSLNGKLG

SEQ ID NO: 1084798 - protein, 9 aa, Homo Sapiens
LTGDSETAP

SEQ ID NO: 1084799 - protein, 9 aa, Homo Sapiens
RFIAELVPK

SEQ ID NO: 1084800 - protein, 9 aa, Homo Sapiens
QCCQPSCGR

SEQ ID NO: 1084801 - protein, 9 aa, Homo Sapiens
IWRLLPLPP

SEQ ID NO: 1084802 - protein, 9 aa, Homo Sapiens
WLQKVQGLC

SEQ ID NO: 1084803 - protein, 9 aa, Homo Sapiens
TLDYSKRDR

SEQ ID NO: 1084804 - protein, 9 aa, Homo Sapiens
SQADVHWTH

SEQ ID NO: 1084805 - protein, 9 aa, Homo Sapiens
DNFLKFDDK

SEQ ID NO: 1084806 - protein, 9 aa, Homo Sapiens
NTQLWVELV

SEQ ID NO: 1084807 - protein, 9 aa, Homo Sapiens
IIRMVLQLP

SEQ ID NO: 1084808 - protein, 9 aa, Homo Sapiens
YSSVPFGSK

SEQ ID NO: 1084809 - protein, 9 aa, Homo Sapiens
KNILTTKES

SEQ ID NO: 1084810 - protein, 9 aa, Homo Sapiens
GKRKHTRPI

SEQ ID NO: 1084811 - protein, 9 aa, Homo Sapiens
GYIRFKKFL

SEQ ID NO: 1084812 - protein, 9 aa, Homo Sapiens
HLDWVMLVR

SEQ ID NO: 1084813 - protein, 9 aa, Homo Sapiens
PSIQPVSDQ

SEQ ID NO: 1084814 - protein, 9 aa, Homo Sapiens
DQIRKDINF

SEQ ID NO: 1084815 - protein, 9 aa, Homo Sapiens
SLLSPVFVE

SEQ ID NO: 1084816 - protein, 9 aa, Homo Sapiens
DAKITVILK

SEQ ID NO: 1084817 - protein, 9 aa, Homo Sapiens
CITTLRPEI

SEQ ID NO: 1084818 - protein, 9 aa, Homo Sapiens
EMKISELNA

SEQ ID NO: 1084819 - protein, 9 aa, Homo Sapiens
TLFSPEKAP

SEQ ID NO: 1084820 - protein, 9 aa, Homo Sapiens
GPGLGLRGR

SEQ ID NO: 1084821 - protein, 9 aa, Homo Sapiens
EFCEEADFS

SEQ ID NO: 1084822 - protein, 9 aa, Homo Sapiens
NSSYTFSFI

SEQ ID NO: 1084823 - protein, 9 aa, Homo Sapiens
RLRPGPGPG

SEQ ID NO: 1084824 - protein, 9 aa, Homo Sapiens
KYFFPSTNI

SEQ ID NO: 1084825 - protein, 9 aa, Homo Sapiens
HPAMLLIFL

SEQ ID NO: 1084826 - protein, 9 aa, Homo Sapiens
QKKNAGEDP

SEQ ID NO: 1084827 - protein, 9 aa, Homo Sapiens
SFWSWLLWF

SEQ ID NO: 1084828 - protein, 9 aa, Homo Sapiens
VKAEEDKIL

SEQ ID NO: 1084829 - protein, 9 aa, Homo Sapiens
DGEALGGGE

SEQ ID NO: 1084830 - protein, 9 aa, Homo Sapiens
NISRKRKGN

SEQ ID NO: 1084831 - protein, 9 aa, Homo Sapiens
AQPSPSARD

SEQ ID NO: 1084832 - protein, 9 aa, Homo Sapiens
DQEILLPQP

SEQ ID NO: 1084833 - protein, 9 aa, Homo Sapiens
LWVELVVAT

SEQ ID NO: 1084834 - protein, 9 aa, Homo Sapiens
TNITAATVA

SEQ ID NO: 1084835 - protein, 9 aa, Homo Sapiens
AGAAEFQRG

SEQ ID NO: 1084836 - protein, 9 aa, Homo Sapiens
ELLEDGQID

SEQ ID NO: 1084837 - protein, 9 aa, Homo Sapiens
VASPDCQQP

SEQ ID NO: 1084838 - protein, 9 aa, Homo Sapiens
FQVNHKNKE

SEQ ID NO: 1084839 - protein, 9 aa, Homo Sapiens
PKNKHLDYL

SEQ ID NO: 1084840 - protein, 9 aa, Homo Sapiens
QKAKDGREG

SEQ ID NO: 1084841 - protein, 9 aa, Homo Sapiens
VQCVLSSSS

SEQ ID NO: 1084842 - protein, 9 aa, Homo Sapiens
ELPGAPSVL

SEQ ID NO: 1084843 - protein, 9 aa, Homo Sapiens
MGVVFSLTS

SEQ ID NO: 1084844 - protein, 9 aa, Homo Sapiens
FVPSLQTSD

SEQ ID NO: 1084845 - protein, 9 aa, Homo Sapiens
PNGPTSGLI

SEQ ID NO: 1084846 - protein, 9 aa, Homo Sapiens
KCVSRRRFP

SEQ ID NO: 1084847 - protein, 9 aa, Homo Sapiens
ELMTMKEEM

SEQ ID NO: 1084848 - protein, 9 aa, Homo Sapiens
AQGEAGPSL

SEQ ID NO: 1084849 - protein, 9 aa, Homo Sapiens
GGAGNVHQP

SEQ ID NO: 1084850 - protein, 9 aa, Homo Sapiens
MWFSTVTVL

SEQ ID NO: 1084851 - protein, 9 aa, Homo Sapiens
QYKRCGVTF

SEQ ID NO: 1084852 - protein, 9 aa, Homo Sapiens
KKMVTSSEA

SEQ ID NO: 1084853 - protein, 9 aa, Homo Sapiens
CRAFILPAM

SEQ ID NO: 1084854 - protein, 9 aa, Homo Sapiens
YAAASGMQA

SEQ ID NO: 1084855 - protein, 9 aa, Homo Sapiens
DKAAPLNPG

SEQ ID NO: 1084856 - protein, 9 aa, Homo Sapiens
WRQQQPAGF

SEQ ID NO: 1084857 - protein, 9 aa, Homo Sapiens
YVLGYKQIL

SEQ ID NO: 1084858 - protein, 9 aa, Homo Sapiens
SLFSVSLPL

SEQ ID NO: 1084859 - protein, 9 aa, Homo Sapiens
AKTLASKRR

SEQ ID NO: 1084860 - protein, 9 aa, Homo Sapiens
SSDPLLDEQ

SEQ ID NO: 1084861 - protein, 9 aa, Homo Sapiens
GMVLALAEG

SEQ ID NO: 1084862 - protein, 9 aa, Homo Sapiens
LFRTYRAAD

SEQ ID NO: 1084863 - protein, 9 aa, Homo Sapiens
DVDLGTILK

SEQ ID NO: 1084864 - protein, 9 aa, Homo Sapiens
SYKKENEMM

SEQ ID NO: 1084865 - protein, 9 aa, Homo Sapiens
EDVLKIYDG

SEQ ID NO: 1084866 - protein, 9 aa, Homo Sapiens
NSTIEYNGV

SEQ ID NO: 1084867 - protein, 9 aa, Homo Sapiens
KGFDQSSSL

SEQ ID NO: 1084868 - protein, 9 aa, Homo Sapiens
STLLPVTDT

SEQ ID NO: 1084869 - protein, 9 aa, Homo Sapiens
DNRNTGIVF

SEQ ID NO: 1084870 - protein, 9 aa, Homo Sapiens
LFTHVLPQT

SEQ ID NO: 1084871 - protein, 9 aa, Homo Sapiens
HEASAAQKK

SEQ ID NO: 1084872 - protein, 9 aa, Homo Sapiens
KVNQPASFV

SEQ ID NO: 1084873 - protein, 9 aa, Homo Sapiens
LPPFTPTPP

SEQ ID NO: 1084874 - protein, 9 aa, Homo Sapiens
QLHVKTWYQ

SEQ ID NO: 1084875 - protein, 9 aa, Homo Sapiens
RNHHRSHSP

SEQ ID NO: 1084876 - protein, 9 aa, Homo Sapiens
TCLFVEKFS

SEQ ID NO: 1084877 - protein, 9 aa, Homo Sapiens
LLIVSFNHN

SEQ ID NO: 1084878 - protein, 9 aa, Homo Sapiens
KLGFWLAIR

SEQ ID NO: 1084879 - protein, 9 aa, Homo Sapiens
ERRASVYLE

SEQ ID NO: 1084880 - protein, 9 aa, Homo Sapiens
CQYSTSYPC

SEQ ID NO: 1084881 - protein, 9 aa, Homo Sapiens
NNKENETIL

SEQ ID NO: 1084882 - protein, 9 aa, Homo Sapiens
HPENGNSVL

SEQ ID NO: 1084883 - protein, 9 aa, Homo Sapiens
LTIYAPPQE

SEQ ID NO: 1084884 - protein, 9 aa, Homo Sapiens
SNSRPCERP

SEQ ID NO: 1084885 - protein, 9 aa, Homo Sapiens
VTRSQAEAE

SEQ ID NO: 1084886 - protein, 9 aa, Homo Sapiens
SFSEEEESE

SEQ ID NO: 1084887 - protein, 9 aa, Homo Sapiens
EEEATSMQL

SEQ ID NO: 1084888 - protein, 9 aa, Homo Sapiens
FPPSFFSSP

SEQ ID NO: 1084889 - protein, 9 aa, Homo Sapiens
VWLKNGLPA

SEQ ID NO: 1084890 - protein, 9 aa, Homo Sapiens
LQNEAICHH

SEQ ID NO: 1084891 - protein, 9 aa, Homo Sapiens
AMEFVDVIE

SEQ ID NO: 1084892 - protein, 9 aa, Homo Sapiens
EASSLSSLT

SEQ ID NO: 1084893 - protein, 9 aa, Homo Sapiens
RVLLSEAAK

SEQ ID NO: 1084894 - protein, 9 aa, Homo Sapiens
TESVKLNLE

SEQ ID NO: 1084895 - protein, 9 aa, Homo Sapiens
QVLIRFYIQ

SEQ ID NO: 1084896 - protein, 9 aa, Homo Sapiens
FIPFLNLRT

SEQ ID NO: 1084897 - protein, 9 aa, Homo Sapiens
ELESMRFSA

SEQ ID NO: 1084898 - protein, 9 aa, Homo Sapiens
TRTELIALR

SEQ ID NO: 1084899 - protein, 9 aa, Homo Sapiens
ESSLTETSE

SEQ ID NO: 1084900 - protein, 9 aa, Homo Sapiens
LIPQREKVE

SEQ ID NO: 1084901 - protein, 9 aa, Homo Sapiens
RNVDLIDIK

SEQ ID NO: 1084902 - protein, 9 aa, Homo Sapiens
VPMDFLENQ

SEQ ID NO: 1084903 - protein, 9 aa, Homo Sapiens
NPSIFSSLP

SEQ ID NO: 1084904 - protein, 9 aa, Homo Sapiens
QSSPSLAHP

SEQ ID NO: 1084905 - protein, 9 aa, Homo Sapiens
AIARNPHKI

SEQ ID NO: 1084906 - protein, 9 aa, Homo Sapiens
IGIPFSDHS

SEQ ID NO: 1084907 - protein, 9 aa, Homo Sapiens
SWSSADSDS

SEQ ID NO: 1084908 - protein, 9 aa, Homo Sapiens
RPSEVWLQW

SEQ ID NO: 1084909 - protein, 9 aa, Homo Sapiens
CMVQTRVDS

SEQ ID NO: 1084910 - protein, 9 aa, Homo Sapiens
RINLSLLVD

SEQ ID NO: 1084911 - protein, 9 aa, Homo Sapiens
VCVGVPTVD

SEQ ID NO: 1084912 - protein, 9 aa, Homo Sapiens
SQLAGKWQV

SEQ ID NO: 1084913 - protein, 9 aa, Homo Sapiens
AFLSMKQVK

SEQ ID NO: 1084914 - protein, 9 aa, Homo Sapiens
KVLFDVEQN

SEQ ID NO: 1084915 - protein, 9 aa, Homo Sapiens
IQPVSDQWP

SEQ ID NO: 1084916 - protein, 9 aa, Homo Sapiens
LDLTTNPQE

SEQ ID NO: 1084917 - protein, 9 aa, Homo Sapiens
FSGQFTTPP

SEQ ID NO: 1084918 - protein, 9 aa, Homo Sapiens
LLSTTPLSL

SEQ ID NO: 1084919 - protein, 9 aa, Homo Sapiens
EAEAGGCFW

SEQ ID NO: 1084920 - protein, 9 aa, Homo Sapiens
CLFGFFILL

SEQ ID NO: 1084921 - protein, 9 aa, Homo Sapiens
DTFFSSDGY

SEQ ID NO: 1084922 - protein, 9 aa, Homo Sapiens
VTSLALKIN

SEQ ID NO: 1084923 - protein, 9 aa, Homo Sapiens
RQQLCSRRH

SEQ ID NO: 1084924 - protein, 9 aa, Homo Sapiens
SLALKINAE

SEQ ID NO: 1084925 - protein, 9 aa, Homo Sapiens
TVNIIIVGQ

SEQ ID NO: 1084926 - protein, 9 aa, Homo Sapiens
YDAEIEDIT

SEQ ID NO: 1084927 - protein, 9 aa, Homo Sapiens
VVSTFAMVK

SEQ ID NO: 1084928 - protein, 9 aa, Homo Sapiens
VIFKASAYT

SEQ ID NO: 1084929 - protein, 9 aa, Homo Sapiens
NIVASMYQQ

SEQ ID NO: 1084930 - protein, 9 aa, Homo Sapiens
VKGESILIR

SEQ ID NO: 1084931 - protein, 9 aa, Homo Sapiens
CLNMGVAID

SEQ ID NO: 1084932 - protein, 9 aa, Homo Sapiens
HRKSCDTLD

SEQ ID NO: 1084933 - protein, 9 aa, Homo Sapiens
RRPYPCQFC

SEQ ID NO: 1084934 - protein, 9 aa, Homo Sapiens
LAAQRNYCS

SEQ ID NO: 1084935 - protein, 9 aa, Homo Sapiens
NYCSKNEIE

SEQ ID NO: 1084936 - protein, 9 aa, Homo Sapiens
YDYIGSEMM

SEQ ID NO: 1084937 - protein, 9 aa, Homo Sapiens
SHTDIRPLS

SEQ ID NO: 1084938 - protein, 9 aa, Homo Sapiens
FSAVFVLPT

SEQ ID NO: 1084939 - protein, 9 aa, Homo Sapiens
LKINAETLV

SEQ ID NO: 1084940 - protein, 9 aa, Homo Sapiens
QSSSPFRGN

SEQ ID NO: 1084941 - protein, 9 aa, Homo Sapiens
INVESQLAE

SEQ ID NO: 1084942 - protein, 9 aa, Homo Sapiens
YDACIPQLW

SEQ ID NO: 1084943 - protein, 9 aa, Homo Sapiens
MKLTLPESL

SEQ ID NO: 1084944 - protein, 9 aa, Homo Sapiens
PNLPPSATR

SEQ ID NO: 1084945 - protein, 9 aa, Homo Sapiens
QYDAEIEDI

SEQ ID NO: 1084946 - protein, 9 aa, Homo Sapiens
VKNEYADAQ

SEQ ID NO: 1084947 - protein, 9 aa, Homo Sapiens
YAVFDLMEE

SEQ ID NO: 1084948 - protein, 9 aa, Homo Sapiens
KRPKSQVFE

SEQ ID NO: 1084949 - protein, 9 aa, Homo Sapiens
NSLLTRCLE

SEQ ID NO: 1084950 - protein, 9 aa, Homo Sapiens
VSRSHLGMV

SEQ ID NO: 1084951 - protein, 9 aa, Homo Sapiens
HPACSTDSS

SEQ ID NO: 1084952 - protein, 9 aa, Homo Sapiens
TVSQYPETE

SEQ ID NO: 1084953 - protein, 9 aa, Homo Sapiens
FSQRNTSTG

SEQ ID NO: 1084954 - protein, 9 aa, Homo Sapiens
WIDQSFNAV

SEQ ID NO: 1084955 - protein, 9 aa, Homo Sapiens
VLEAEAGGC

SEQ ID NO: 1084956 - protein, 9 aa, Homo Sapiens
PGALGNFSL

SEQ ID NO: 1084957 - protein, 9 aa, Homo Sapiens
DDLFPIKPV

SEQ ID NO: 1084958 - protein, 9 aa, Homo Sapiens
TSSPVVSSH

SEQ ID NO: 1084959 - protein, 9 aa, Homo Sapiens
PVEFYYENM

SEQ ID NO: 1084960 - protein, 9 aa, Homo Sapiens
SCDTLDISV

SEQ ID NO: 1084961 - protein, 9 aa, Homo Sapiens
LSQVQSLII

SEQ ID NO: 1084962 - protein, 9 aa, Homo Sapiens
RRLTVEESG

SEQ ID NO: 1084963 - protein, 9 aa, Homo Sapiens
RARKHLAEH

SEQ ID NO: 1084964 - protein, 9 aa, Homo Sapiens
NIKLRAHRQ

SEQ ID NO: 1084965 - protein, 9 aa, Homo Sapiens
HCWPQNSTA

SEQ ID NO: 1084966 - protein, 9 aa, Homo Sapiens
WASFCLLVV

SEQ ID NO: 1084967 - protein, 9 aa, Homo Sapiens
QSRQQLCSR

SEQ ID NO: 1084968 - protein, 9 aa, Homo Sapiens
IIIVGQSHL

SEQ ID NO: 1084969 - protein, 9 aa, Homo Sapiens
LPSFPGSRP

SEQ ID NO: 1084970 - protein, 9 aa, Homo Sapiens
KSRRSLTNS

SEQ ID NO: 1084971 - protein, 9 aa, Homo Sapiens
IILQLEQEK

SEQ ID NO: 1084972 - protein, 9 aa, Homo Sapiens
AALNRDNEI

SEQ ID NO: 1084973 - protein, 9 aa, Homo Sapiens
DVTSSLGGG

SEQ ID NO: 1084974 - protein, 9 aa, Homo Sapiens
CSPRCGIFA

SEQ ID NO: 1084975 - protein, 9 aa, Homo Sapiens
QGFFFSLTM

SEQ ID NO: 1084976 - protein, 9 aa, Homo Sapiens
FFSLTMLNP

SEQ ID NO: 1084977 - protein, 9 aa, Homo Sapiens
TVFYIHILQ

SEQ ID NO: 1084978 - protein, 9 aa, Homo Sapiens
SQEVTCAQL

SEQ ID NO: 1084979 - protein, 9 aa, Homo Sapiens
YTYSVCSAL

SEQ ID NO: 1084980 - protein, 9 aa, Homo Sapiens
MAVFFLIGS

SEQ ID NO: 1084981 - protein, 9 aa, Homo Sapiens
VSKKYKLYF

SEQ ID NO: 1084982 - protein, 9 aa, Homo Sapiens
DDDVGDYDD

SEQ ID NO: 1084983 - protein, 9 aa, Homo Sapiens
TFFSSDGYG

SEQ ID NO: 1084984 - protein, 9 aa, Homo Sapiens
EPNTKLFSA

SEQ ID NO: 1084985 - protein, 9 aa, Homo Sapiens
STSGTTWIL

SEQ ID NO: 1084986 - protein, 9 aa, Homo Sapiens
PNTKLFSAV

SEQ ID NO: 1084987 - protein, 9 aa, Homo Sapiens
RQESAIFNE

SEQ ID NO: 1084988 - protein, 9 aa, Homo Sapiens
QWIDQSFNA

SEQ ID NO: 1084989 - protein, 9 aa, Homo Sapiens
TSSLGGGGD

SEQ ID NO: 1084990 - protein, 9 aa, Homo Sapiens
TPVFLDFPV

SEQ ID NO: 1084991 - protein, 9 aa, Homo Sapiens
NSNWVVVFK

SEQ ID NO: 1084992 - protein, 9 aa, Homo Sapiens
TIFEAPPLG

SEQ ID NO: 1084993 - protein, 9 aa, Homo Sapiens
GDDLFPIKP

SEQ ID NO: 1084994 - protein, 9 aa, Homo Sapiens
FTITPVFLD

SEQ ID NO: 1084995 - protein, 9 aa, Homo Sapiens
RGVTSLALK

SEQ ID NO: 1084996 - protein, 9 aa, Homo Sapiens
SRVKEFMIQ

SEQ ID NO: 1084997 - protein, 9 aa, Homo Sapiens
QPLPPSPRM

SEQ ID NO: 1084998 - protein, 9 aa, Homo Sapiens
SLAGAALEP

SEQ ID NO: 1084999 - protein, 9 aa, Homo Sapiens
PTEALSHLC

SEQ ID NO: 1085000 - protein, 9 aa, Homo Sapiens
SLGPGPGKL

SEQ ID NO: 1085001 - protein, 9 aa, Homo Sapiens
WQAPIGGDF

SEQ ID NO: 1085002 - protein, 9 aa, Homo Sapiens
YLDLKGAPP

SEQ ID NO: 1085003 - protein, 9 aa, Homo Sapiens
PVNLAVLTL

SEQ ID NO: 1085004 - protein, 9 aa, Homo Sapiens
GVLPSFPGS

SEQ ID NO: 1085005 - protein, 9 aa, Homo Sapiens
SPTEPNSKT

SEQ ID NO: 1085006 - protein, 9 aa, Homo Sapiens
VNYTTIECE

SEQ ID NO: 1085007 - protein, 9 aa, Homo Sapiens
FYIHILQAV

SEQ ID NO: 1085008 - protein, 9 aa, Homo Sapiens
NPHSRFSLW

SEQ ID NO: 1085009 - protein, 9 aa, Homo Sapiens
KLYFWNIIT

SEQ ID NO: 1085010 - protein, 9 aa, Homo Sapiens
DCRTESWRE

SEQ ID NO: 1085011 - protein, 9 aa, Homo Sapiens
PLGERSFFC

SEQ ID NO: 1085012 - protein, 9 aa, Homo Sapiens
NRIMTLIQK

SEQ ID NO: 1085013 - protein, 9 aa, Homo Sapiens
SNTTSSPLE

SEQ ID NO: 1085014 - protein, 9 aa, Homo Sapiens
GPYHTSPII

SEQ ID NO: 1085015 - protein, 9 aa, Homo Sapiens
TRVIFKASA

SEQ ID NO: 1085016 - protein, 9 aa, Homo Sapiens
FGFFILLPE

SEQ ID NO: 1085017 - protein, 9 aa, Homo Sapiens
WLVLEAEAG

SEQ ID NO: 1085018 - protein, 9 aa, Homo Sapiens
EDTLTLFSF

SEQ ID NO: 1085019 - protein, 9 aa, Homo Sapiens
QEVTCAQLD

SEQ ID NO: 1085020 - protein, 9 aa, Homo Sapiens
ESILIRLFL

SEQ ID NO: 1085021 - protein, 9 aa, Homo Sapiens
FYYENMHAS

SEQ ID NO: 1085022 - protein, 9 aa, Homo Sapiens
SSTSGTTWI

SEQ ID NO: 1085023 - protein, 9 aa, Homo Sapiens
AGEIFSEKK

SEQ ID NO: 1085024 - protein, 9 aa, Homo Sapiens
EHIAKPLKD

SEQ ID NO: 1085025 - protein, 9 aa, Homo Sapiens
SFPGSRPGC

SEQ ID NO: 1085026 - protein, 9 aa, Homo Sapiens
ARKERARKH

SEQ ID NO: 1085027 - protein, 9 aa, Homo Sapiens
FLVVNIVAS

SEQ ID NO: 1085028 - protein, 9 aa, Homo Sapiens
SNIITECCK

SEQ ID NO: 1085029 - protein, 9 aa, Homo Sapiens
PAHALRARL

SEQ ID NO: 1085030 - protein, 9 aa, Homo Sapiens
TQALGRPPG

SEQ ID NO: 1085031 - protein, 9 aa, Homo Sapiens
NRMIGELIS

SEQ ID NO: 1085032 - protein, 9 aa, Homo Sapiens
YVTKIKEVQ

SEQ ID NO: 1085033 - protein, 9 aa, Homo Sapiens
EEQKDEGVY

SEQ ID NO: 1085034 - protein, 9 aa, Homo Sapiens
GTSSLPRHP

SEQ ID NO: 1085035 - protein, 9 aa, Homo Sapiens
KCLNMGVAI

SEQ ID NO: 1085036 - protein, 9 aa, Homo Sapiens
DTIFEAPPL

SEQ ID NO: 1085037 - protein, 9 aa, Homo Sapiens
RPDFFKAPL

SEQ ID NO: 1085038 - protein, 9 aa, Homo Sapiens
EKELWREGR

SEQ ID NO: 1085039 - protein, 9 aa, Homo Sapiens
PSEKIRSQD

SEQ ID NO: 1085040 - protein, 9 aa, Homo Sapiens
QLHNTSWNR

SEQ ID NO: 1085041 - protein, 9 aa, Homo Sapiens
ATNSNWVVV

SEQ ID NO: 1085042 - protein, 9 aa, Homo Sapiens
DIRPLSGGL

SEQ ID NO: 1085043 - protein, 9 aa, Homo Sapiens
PFVPVEFYY

SEQ ID NO: 1085044 - protein, 9 aa, Homo Sapiens
CEKTFSCQS

SEQ ID NO: 1085045 - protein, 9 aa, Homo Sapiens
PYFSGQFTT

SEQ ID NO: 1085046 - protein, 9 aa, Homo Sapiens
WNSQGAVSV

SEQ ID NO: 1085047 - protein, 9 aa, Homo Sapiens
FVPVEFYYE

SEQ ID NO: 1085048 - protein, 9 aa, Homo Sapiens
VTVESHRKS

SEQ ID NO: 1085049 - protein, 9 aa, Homo Sapiens
TLMWSDHLK

SEQ ID NO: 1085050 - protein, 9 aa, Homo Sapiens
SQYPETELY

SEQ ID NO: 1085051 - protein, 9 aa, Homo Sapiens
LTMTRAMEE

SEQ ID NO: 1085052 - protein, 9 aa, Homo Sapiens
ILFLMAVFF

SEQ ID NO: 1085053 - protein, 9 aa, Homo Sapiens
IHSDRRPYP

SEQ ID NO: 1085054 - protein, 9 aa, Homo Sapiens
REEQEEEEG

SEQ ID NO: 1085055 - protein, 9 aa, Homo Sapiens
VMTEEQKDE

SEQ ID NO: 1085056 - protein, 9 aa, Homo Sapiens
CCVPVCCHC

SEQ ID NO: 1085057 - protein, 9 aa, Homo Sapiens
FKASAYTGM

SEQ ID NO: 1085058 - protein, 9 aa, Homo Sapiens
SPVVSSHPP

SEQ ID NO: 1085059 - protein, 9 aa, Homo Sapiens
SSGQHIPKN

SEQ ID NO: 1085060 - protein, 9 aa, Homo Sapiens
PACVLITLG

SEQ ID NO: 1085061 - protein, 9 aa, Homo Sapiens
LIEHLKVHT

SEQ ID NO: 1085062 - protein, 9 aa, Homo Sapiens
VTGHDHHNA

SEQ ID NO: 1085063 - protein, 9 aa, Homo Sapiens
SCCVPVCCH

SEQ ID NO: 1085064 - protein, 9 aa, Homo Sapiens
LTLSEQGVL

SEQ ID NO: 1085065 - protein, 9 aa, Homo Sapiens
QGRRLTVEE

SEQ ID NO: 1085066 - protein, 9 aa, Homo Sapiens
NMYDACIPQ

SEQ ID NO: 1085067 - protein, 9 aa, Homo Sapiens
TGHDHHNAD

SEQ ID NO: 1085068 - protein, 9 aa, Homo Sapiens
KSGYGKYPG

SEQ ID NO: 1085069 - protein, 9 aa, Homo Sapiens
ALLKSSAPP

SEQ ID NO: 1085070 - protein, 9 aa, Homo Sapiens
PGINSDELV

SEQ ID NO: 1085071 - protein, 9 aa, Homo Sapiens
LSGEENRVQ

SEQ ID NO: 1085072 - protein, 9 aa, Homo Sapiens
SVNSGETFS

SEQ ID NO: 1085073 - protein, 9 aa, Homo Sapiens
VVNIVASMY

SEQ ID NO: 1085074 - protein, 9 aa, Homo Sapiens
VPVLAAQRN

SEQ ID NO: 1085075 - protein, 9 aa, Homo Sapiens
EIFSEKKYR

SEQ ID NO: 1085076 - protein, 9 aa, Homo Sapiens
ASFCLLVVY

SEQ ID NO: 1085077 - protein, 9 aa, Homo Sapiens
SMIATINPA

SEQ ID NO: 1085078 - protein, 9 aa, Homo Sapiens
LALKINAET

SEQ ID NO: 1085079 - protein, 9 aa, Homo Sapiens
VGDYDDDHP

SEQ ID NO: 1085080 - protein, 9 aa, Homo Sapiens
RKDCGDDLF

SEQ ID NO: 1085081 - protein, 9 aa, Homo Sapiens
LFSFSGETV

SEQ ID NO: 1085082 - protein, 9 aa, Homo Sapiens
IDCYHQLDR

SEQ ID NO: 1085083 - protein, 9 aa, Homo Sapiens
LFGICQIKA

SEQ ID NO: 1085084 - protein, 9 aa, Homo Sapiens
GTYQALDKL

SEQ ID NO: 1085085 - protein, 9 aa, Homo Sapiens
PTQALGRPP

SEQ ID NO: 1085086 - protein, 9 aa, Homo Sapiens
RDCHLCPLP

SEQ ID NO: 1085087 - protein, 9 aa, Homo Sapiens
EINIDECAS

SEQ ID NO: 1085088 - protein, 9 aa, Homo Sapiens
HSRFSLWQD

SEQ ID NO: 1085089 - protein, 9 aa, Homo Sapiens
SSSLKSMAV

SEQ ID NO: 1085090 - protein, 9 aa, Homo Sapiens
FDFRVDKIR

SEQ ID NO: 1085091 - protein, 9 aa, Homo Sapiens
CANILGYVV

SEQ ID NO: 1085092 - protein, 9 aa, Homo Sapiens
PQERMMKSD

SEQ ID NO: 1085093 - protein, 9 aa, Homo Sapiens
SLFGICQIK

SEQ ID NO: 1085094 - protein, 9 aa, Homo Sapiens
RKSRRSLTN

SEQ ID NO: 1085095 - protein, 9 aa, Homo Sapiens
VFRGVTSLA

SEQ ID NO: 1085096 - protein, 9 aa, Homo Sapiens
PSVGRLSGH

SEQ ID NO: 1085097 - protein, 9 aa, Homo Sapiens
LKSGYGKYP

SEQ ID NO: 1085098 - protein, 9 aa, Homo Sapiens
DACIPQLWK

SEQ ID NO: 1085099 - protein, 9 aa, Homo Sapiens
VFEEEGKEV

SEQ ID NO: 1085100 - protein, 9 aa, Homo Sapiens
EVQHESINK

SEQ ID NO: 1085101 - protein, 9 aa, Homo Sapiens
LKSSAPPIT

SEQ ID NO: 1085102 - protein, 9 aa, Homo Sapiens
STDIWVLWH

SEQ ID NO: 1085103 - protein, 9 aa, Homo Sapiens
NPTQSPGYS

SEQ ID NO: 1085104 - protein, 9 aa, Homo Sapiens
LSPDQFVGI

SEQ ID NO: 1085105 - protein, 9 aa, Homo Sapiens
FQMRLVYLD

SEQ ID NO: 1085106 - protein, 9 aa, Homo Sapiens
RVRWCRPDC

SEQ ID NO: 1085107 - protein, 9 aa, Homo Sapiens
TRTRESLLD

SEQ ID NO: 1085108 - protein, 9 aa, Homo Sapiens
KEAPKMLRN

SEQ ID NO: 1085109 - protein, 9 aa, Homo Sapiens
LGPGPGKLA

SEQ ID NO: 1085110 - protein, 9 aa, Homo Sapiens
GVTSLALKI

SEQ ID NO: 1085111 - protein, 9 aa, Homo Sapiens
YPETELYAV

SEQ ID NO: 1085112 - protein, 9 aa, Homo Sapiens
PWNSLLTRC

SEQ ID NO: 1085113 - protein, 9 aa, Homo Sapiens
VSSHPPVQQ

SEQ ID NO: 1085114 - protein, 9 aa, Homo Sapiens
IKGDPGLPG

SEQ ID NO: 1085115 - protein, 9 aa, Homo Sapiens
SSGAVSTRV

SEQ ID NO: 1085116 - protein, 9 aa, Homo Sapiens
RGDLDRPED

SEQ ID NO: 1085117 - protein, 9 aa, Homo Sapiens
EMPQYGSRH

SEQ ID NO: 1085118 - protein, 9 aa, Homo Sapiens
LGGGGDPRQ

SEQ ID NO: 1085119 - protein, 9 aa, Homo Sapiens
ACVLITLGD

SEQ ID NO: 1085120 - protein, 9 aa, Homo Sapiens
CNPSDTFFS

SEQ ID NO: 1085121 - protein, 9 aa, Homo Sapiens
IVSKKYKLY

SEQ ID NO: 1085122 - protein, 9 aa, Homo Sapiens
STVNIIIVG

SEQ ID NO: 1085123 - protein, 9 aa, Homo Sapiens
DFRVDKIRL

SEQ ID NO: 1085124 - protein, 9 aa, Homo Sapiens
ILQLEQEKE

SEQ ID NO: 1085125 - protein, 9 aa, Homo Sapiens
LIFYVHDRR

SEQ ID NO: 1085126 - protein, 9 aa, Homo Sapiens
IRPLSGGLI

SEQ ID NO: 1085127 - protein, 9 aa, Homo Sapiens
SRSHLGMVK

SEQ ID NO: 1085128 - protein, 9 aa, Homo Sapiens
QSNLSGEEN

SEQ ID NO: 1085129 - protein, 9 aa, Homo Sapiens
VTCAQLDHW

SEQ ID NO: 1085130 - protein, 9 aa, Homo Sapiens
KLFSAVFVL

SEQ ID NO: 1085131 - protein, 9 aa, Homo Sapiens
PYHTSPIIG

SEQ ID NO: 1085132 - protein, 9 aa, Homo Sapiens
RPPQAPLPP

SEQ ID NO: 1085133 - protein, 9 aa, Homo Sapiens
ETKALQDSW

SEQ ID NO: 1085134 - protein, 9 aa, Homo Sapiens
DHHNADLKP

SEQ ID NO: 1085135 - protein, 9 aa, Homo Sapiens
FDLMEEKSY

SEQ ID NO: 1085136 - protein, 9 aa, Homo Sapiens
PVKGESILI

SEQ ID NO: 1085137 - protein, 9 aa, Homo Sapiens
VTSSLGGGG

SEQ ID NO: 1085138 - protein, 9 aa, Homo Sapiens
HLKVHTKKT

SEQ ID NO: 1085139 - protein, 9 aa, Homo Sapiens
NLPPSATRE

SEQ ID NO: 1085140 - protein, 9 aa, Homo Sapiens
MMKSDYIVM

SEQ ID NO: 1085141 - protein, 9 aa, Homo Sapiens
AALTFPTRM

SEQ ID NO: 1085142 - protein, 9 aa, Homo Sapiens
AQRNYCSKN

SEQ ID NO: 1085143 - protein, 9 aa, Homo Sapiens
MAYDCYVAT

SEQ ID NO: 1085144 - protein, 9 aa, Homo Sapiens
LKVHTKKTA

SEQ ID NO: 1085145 - protein, 9 aa, Homo Sapiens
VNIIIVGQS

SEQ ID NO: 1085146 - protein, 9 aa, Homo Sapiens
GDYDDDHPG

SEQ ID NO: 1085147 - protein, 9 aa, Homo Sapiens
CLQEADHTV

SEQ ID NO: 1085148 - protein, 9 aa, Homo Sapiens
PSFPGSRPG

SEQ ID NO: 1085149 - protein, 9 aa, Homo Sapiens
AEYLKYCQF

SEQ ID NO: 1085150 - protein, 9 aa, Homo Sapiens
PACSTDSSV

SEQ ID NO: 1085151 - protein, 9 aa, Homo Sapiens
SCLFGFFIL

SEQ ID NO: 1085152 - protein, 9 aa, Homo Sapiens
PPQERVLLV

SEQ ID NO: 1085153 - protein, 9 aa, Homo Sapiens
HTATVRAKK

SEQ ID NO: 1085154 - protein, 9 aa, Homo Sapiens
HGGKGLLFY

SEQ ID NO: 1085155 - protein, 9 aa, Homo Sapiens
AINTTVSQY

SEQ ID NO: 1085156 - protein, 9 aa, Homo Sapiens
QSVNSGETF

SEQ ID NO: 1085157 - protein, 9 aa, Homo Sapiens
TTIECETSP

SEQ ID NO: 1085158 - protein, 9 aa, Homo Sapiens
IPPTFSPAH

SEQ ID NO: 1085159 - protein, 9 aa, Homo Sapiens
RPAGSEHSG

SEQ ID NO: 1085160 - protein, 9 aa, Homo Sapiens
APKMLRNPT

SEQ ID NO: 1085161 - protein, 9 aa, Homo Sapiens
PPSATRERP

SEQ ID NO: 1085162 - protein, 9 aa, Homo Sapiens
TYQALDKLL

SEQ ID NO: 1085163 - protein, 9 aa, Homo Sapiens
KRGDLDRPE

SEQ ID NO: 1085164 - protein, 9 aa, Homo Sapiens
NDFNSEFYN

SEQ ID NO: 1085165 - protein, 9 aa, Homo Sapiens
SLIINVESQ

SEQ ID NO: 1085166 - protein, 9 aa, Homo Sapiens
TRVRWCRPD

SEQ ID NO: 1085167 - protein, 9 aa, Homo Sapiens
VSQYPETEL

SEQ ID NO: 1085168 - protein, 9 aa, Homo Sapiens
ETFSIWKLN

SEQ ID NO: 1085169 - protein, 9 aa, Homo Sapiens
KLAARSPVL

SEQ ID NO: 1085170 - protein, 9 aa, Homo Sapiens
QATRVIFKA

SEQ ID NO: 1085171 - protein, 9 aa, Homo Sapiens
QKDEGVYTC

SEQ ID NO: 1085172 - protein, 9 aa, Homo Sapiens
LVYLKLIFY

SEQ ID NO: 1085173 - protein, 9 aa, Homo Sapiens
LITLGDSKA

SEQ ID NO: 1085174 - protein, 9 aa, Homo Sapiens
NKDFLPDAI

SEQ ID NO: 1085175 - protein, 9 aa, Homo Sapiens
VCTDSHTDI

SEQ ID NO: 1085176 - protein, 9 aa, Homo Sapiens
SGTSSLPRH

SEQ ID NO: 1085177 - protein, 9 aa, Homo Sapiens
ATRVIFKAS

SEQ ID NO: 1085178 - protein, 9 aa, Homo Sapiens
KLSPDQFVG

SEQ ID NO: 1085179 - protein, 9 aa, Homo Sapiens
RVLLVVFTR

SEQ ID NO: 1085180 - protein, 9 aa, Homo Sapiens
IMLITVFYI

SEQ ID NO: 1085181 - protein, 9 aa, Homo Sapiens
ESCFVAQAG

SEQ ID NO: 1085182 - protein, 9 aa, Homo Sapiens
TEKSRWSGS

SEQ ID NO: 1085183 - protein, 9 aa, Homo Sapiens
NSEFYNSTW

SEQ ID NO: 1085184 - protein, 9 aa, Homo Sapiens
AAPVKNEYA

SEQ ID NO: 1085185 - protein, 9 aa, Homo Sapiens
CGIFAPPSR

SEQ ID NO: 1085186 - protein, 9 aa, Homo Sapiens
FLMAVFFLI

SEQ ID NO: 1085187 - protein, 9 aa, Homo Sapiens
SCFVAQAGV

SEQ ID NO: 1085188 - protein, 9 aa, Homo Sapiens
EGAPRPPQA

SEQ ID NO: 1085189 - protein, 9 aa, Homo Sapiens
EIINETFEY

SEQ ID NO: 1085190 - protein, 9 aa, Homo Sapiens
RTRESLLDT

SEQ ID NO: 1085191 - protein, 9 aa, Homo Sapiens
FFSQRNTST

SEQ ID NO: 1085192 - protein, 9 aa, Homo Sapiens
LDKLLKSED

SEQ ID NO: 1085193 - protein, 9 aa, Homo Sapiens
TESWREGRI

SEQ ID NO: 1085194 - protein, 9 aa, Homo Sapiens
KALYDYIGS

SEQ ID NO: 1085195 - protein, 9 aa, Homo Sapiens
GAPRDASDS

SEQ ID NO: 1085196 - protein, 9 aa, Homo Sapiens
RNYCSKNEI

SEQ ID NO: 1085197 - protein, 9 aa, Homo Sapiens
AVLFWQWID

SEQ ID NO: 1085198 - protein, 9 aa, Homo Sapiens
KFISDRKSR

SEQ ID NO: 1085199 - protein, 9 aa, Homo Sapiens
ITLGDSKAV

SEQ ID NO: 1085200 - protein, 9 aa, Homo Sapiens
LLKPTCGKK

SEQ ID NO: 1085201 - protein, 9 aa, Homo Sapiens
IAAVFEIVI

SEQ ID NO: 1085202 - protein, 9 aa, Homo Sapiens
RAFCVWEQA

SEQ ID NO: 1085203 - protein, 9 aa, Homo Sapiens
SSLGPGPGK

SEQ ID NO: 1085204 - protein, 9 aa, Homo Sapiens
QEADHTVGF

SEQ ID NO: 1085205 - protein, 9 aa, Homo Sapiens
EEYLAHSSH

SEQ ID NO: 1085206 - protein, 9 aa, Homo Sapiens
SSHPVDTDE

SEQ ID NO: 1085207 - protein, 9 aa, Homo Sapiens
GKLVQGRRL

SEQ ID NO: 1085208 - protein, 9 aa, Homo Sapiens
VINKTPLPI

SEQ ID NO: 1085209 - protein, 9 aa, Homo Sapiens
TVQSLACLQ

SEQ ID NO: 1085210 - protein, 9 aa, Homo Sapiens
VVIAAVFEI

SEQ ID NO: 1085211 - protein, 9 aa, Homo Sapiens
QSLIINVES

SEQ ID NO: 1085212 - protein, 9 aa, Homo Sapiens
DSYAELLDA

SEQ ID NO: 1085213 - protein, 9 aa, Homo Sapiens
SNLSGEENR

SEQ ID NO: 1085214 - protein, 9 aa, Homo Sapiens
PKMLRNPTD

SEQ ID NO: 1085215 - protein, 9 aa, Homo Sapiens
EQEVSSSLK

SEQ ID NO: 1085216 - protein, 9 aa, Homo Sapiens
REWLPPNRS

SEQ ID NO: 1085217 - protein, 9 aa, Homo Sapiens
HDHHNADLK

SEQ ID NO: 1085218 - protein, 9 aa, Homo Sapiens
VIAAVFEIV

SEQ ID NO: 1085219 - protein, 9 aa, Homo Sapiens
PFQMRLVYL

SEQ ID NO: 1085220 - protein, 9 aa, Homo Sapiens
STSTPSSTS

SEQ ID NO: 1085221 - protein, 9 aa, Homo Sapiens
HLLIHSDRR

SEQ ID NO: 1085222 - protein, 9 aa, Homo Sapiens
SCKPKPIGE

SEQ ID NO: 1085223 - protein, 9 aa, Homo Sapiens
FRGVTSLAL

SEQ ID NO: 1085224 - protein, 9 aa, Homo Sapiens
PTFSPAHSS

SEQ ID NO: 1085225 - protein, 9 aa, Homo Sapiens
LIPSVQLPS

SEQ ID NO: 1085226 - protein, 9 aa, Homo Sapiens
PVVPQRAPL

SEQ ID NO: 1085227 - protein, 9 aa, Homo Sapiens
FSCQSALNV

SEQ ID NO: 1085228 - protein, 9 aa, Homo Sapiens
ILIRLFLAG

SEQ ID NO: 1085229 - protein, 9 aa, Homo Sapiens
SNWVVVFKA

SEQ ID NO: 1085230 - protein, 9 aa, Homo Sapiens
GIKGDPGLP

SEQ ID NO: 1085231 - protein, 9 aa, Homo Sapiens
DTLTLFSFS

SEQ ID NO: 1085232 - protein, 9 aa, Homo Sapiens
FWASFCLLV

SEQ ID NO: 1085233 - protein, 9 aa, Homo Sapiens
IVASMYQQL

SEQ ID NO: 1085234 - protein, 9 aa, Homo Sapiens
EKIMKLTLP

SEQ ID NO: 1085235 - protein, 9 aa, Homo Sapiens
SPRCGIFAP

SEQ ID NO: 1085236 - protein, 9 aa, Homo Sapiens
VNIVASMYQ

SEQ ID NO: 1085237 - protein, 9 aa, Homo Sapiens
PIPPRDCHL

SEQ ID NO: 1085238 - protein, 9 aa, Homo Sapiens
ERARKERAR

SEQ ID NO: 1085239 - protein, 9 aa, Homo Sapiens
NIIIVGQSH

SEQ ID NO: 1085240 - protein, 9 aa, Homo Sapiens
PTCGKKVSL

SEQ ID NO: 1085241 - protein, 9 aa, Homo Sapiens
SQVQSLIIN

SEQ ID NO: 1085242 - protein, 9 aa, Homo Sapiens
NSQGAVSVP

SEQ ID NO: 1085243 - protein, 9 aa, Homo Sapiens
TLPESLKAY

SEQ ID NO: 1085244 - protein, 9 aa, Homo Sapiens
TTSSPLETM

SEQ ID NO: 1085245 - protein, 9 aa, Homo Sapiens
YTTIECETS

SEQ ID NO: 1085246 - protein, 9 aa, Homo Sapiens
FISDRKSRR

SEQ ID NO: 1085247 - protein, 9 aa, Homo Sapiens
TDIWVLWHD

SEQ ID NO: 1085248 - protein, 9 aa, Homo Sapiens
GSSDISGDP

SEQ ID NO: 1085249 - protein, 9 aa, Homo Sapiens
INPAADNYE

SEQ ID NO: 1085250 - protein, 9 aa, Homo Sapiens
PIGELAREI

SEQ ID NO: 1085251 - protein, 9 aa, Homo Sapiens
GYGKYPGIN

SEQ ID NO: 1085252 - protein, 9 aa, Homo Sapiens
RMIGELISK

SEQ ID NO: 1085253 - protein, 9 aa, Homo Sapiens
KINAETLVG

SEQ ID NO: 1085254 - protein, 9 aa, Homo Sapiens
YQALDKLLK

SEQ ID NO: 1085255 - protein, 9 aa, Homo Sapiens
IFKASAYTG

SEQ ID NO: 1085256 - protein, 9 aa, Homo Sapiens
NALLKSSAP

SEQ ID NO: 1085257 - protein, 9 aa, Homo Sapiens
PPGALGNFS

SEQ ID NO: 1085258 - protein, 9 aa, Homo Sapiens
PRDASDSLA

SEQ ID NO: 1085259 - protein, 9 aa, Homo Sapiens
AVFFLIGSL

SEQ ID NO: 1085260 - protein, 9 aa, Homo Sapiens
LHNTSWNRM

SEQ ID NO: 1085261 - protein, 9 aa, Homo Sapiens
INAETLVGL

SEQ ID NO: 1085262 - protein, 9 aa, Homo Sapiens
LTVMTEEQK

SEQ ID NO: 1085263 - protein, 9 aa, Homo Sapiens
LNMGVAIDC

SEQ ID NO: 1085264 - protein, 9 aa, Homo Sapiens
NAALTFPTR

SEQ ID NO: 1085265 - protein, 9 aa, Homo Sapiens
SKKYKLYFW

SEQ ID NO: 1085266 - protein, 9 aa, Homo Sapiens
RTESWREGR

SEQ ID NO: 1085267 - protein, 9 aa, Homo Sapiens
ACLQEADHT

SEQ ID NO: 1085268 - protein, 9 aa, Homo Sapiens
LAVLTLSEQ

SEQ ID NO: 1085269 - protein, 9 aa, Homo Sapiens
NPNLPPSAT

SEQ ID NO: 1085270 - protein, 9 aa, Homo Sapiens
KIFVTGGSL

SEQ ID NO: 1085271 - protein, 9 aa, Homo Sapiens
EHEVETKAL

SEQ ID NO: 1085272 - protein, 9 aa, Homo Sapiens
SRHRLLPPA

SEQ ID NO: 1085273 - protein, 9 aa, Homo Sapiens
LLPIPPRDC

SEQ ID NO: 1085274 - protein, 9 aa, Homo Sapiens
LFWASFCLL

SEQ ID NO: 1085275 - protein, 9 aa, Homo Sapiens
TLNAALTFP

SEQ ID NO: 1085276 - protein, 9 aa, Homo Sapiens
AETLVGLVS

SEQ ID NO: 1085277 - protein, 9 aa, Homo Sapiens
QESSRVKEF

SEQ ID NO: 1085278 - protein, 9 aa, Homo Sapiens
TNSNWVVVF

SEQ ID NO: 1085279 - protein, 9 aa, Homo Sapiens
PQYGSRHRL

SEQ ID NO: 1085280 - protein, 9 aa, Homo Sapiens
LFGFFILLP

SEQ ID NO: 1085281 - protein, 9 aa, Homo Sapiens
VLITLGDSK

SEQ ID NO: 1085282 - protein, 9 aa, Homo Sapiens
TVMTEEQKD

SEQ ID NO: 1085283 - protein, 9 aa, Homo Sapiens
FVLYLDTPV

SEQ ID NO: 1085284 - protein, 9 aa, Homo Sapiens
LFYAGLSPA

SEQ ID NO: 1085285 - protein, 9 aa, Homo Sapiens
QAPLPPHDS

SEQ ID NO: 1085286 - protein, 9 aa, Homo Sapiens
LKDDELSWQ

SEQ ID NO: 1085287 - protein, 9 aa, Homo Sapiens
LKDVVMANS

SEQ ID NO: 1085288 - protein, 9 aa, Homo Sapiens
QYFSCSPRC

SEQ ID NO: 1085289 - protein, 9 aa, Homo Sapiens
IKKLCSRKD

SEQ ID NO: 1085290 - protein, 9 aa, Homo Sapiens
INETFEYGS

SEQ ID NO: 1085291 - protein, 9 aa, Homo Sapiens
KEFMIQDGP

SEQ ID NO: 1085292 - protein, 9 aa, Homo Sapiens
TATVRAKKI

SEQ ID NO: 1085293 - protein, 9 aa, Homo Sapiens
QNLHCWPQN

SEQ ID NO: 1085294 - protein, 9 aa, Homo Sapiens
KWQCIECKF

SEQ ID NO: 1085295 - protein, 9 aa, Homo Sapiens
KLTLPESLK

SEQ ID NO: 1085296 - protein, 9 aa, Homo Sapiens
AEERLHPDP

SEQ ID NO: 1085297 - protein, 9 aa, Homo Sapiens
LHHTTIMSS

SEQ ID NO: 1085298 - protein, 9 aa, Homo Sapiens
LATEKSRWS

SEQ ID NO: 1085299 - protein, 9 aa, Homo Sapiens
AEIEDITLD

SEQ ID NO: 1085300 - protein, 9 aa, Homo Sapiens
RESLLDTTN

SEQ ID NO: 1085301 - protein, 9 aa, Homo Sapiens
LEEILDETN

SEQ ID NO: 1085302 - protein, 9 aa, Homo Sapiens
DLFPIKPVP

SEQ ID NO: 1085303 - protein, 9 aa, Homo Sapiens
EEILDETNR

SEQ ID NO: 1085304 - protein, 9 aa, Homo Sapiens
SNPHSRFSL

SEQ ID NO: 1085305 - protein, 9 aa, Homo Sapiens
AETPHKLQF

SEQ ID NO: 1085306 - protein, 9 aa, Homo Sapiens
MKLPWNSLL

SEQ ID NO: 1085307 - protein, 9 aa, Homo Sapiens
GVHHAAGQV

SEQ ID NO: 1085308 - protein, 9 aa, Homo Sapiens
VYSSGTVCL

SEQ ID NO: 1085309 - protein, 9 aa, Homo Sapiens
VKINNDFNS

SEQ ID NO: 1085310 - protein, 9 aa, Homo Sapiens
MGVAIDCYH

SEQ ID NO: 1085311 - protein, 9 aa, Homo Sapiens
SHHESCFVA

SEQ ID NO: 1085312 - protein, 9 aa, Homo Sapiens
PSVQLPSSG

SEQ ID NO: 1085313 - protein, 9 aa, Homo Sapiens
DQRGCCWNS

SEQ ID NO: 1085314 - protein, 9 aa, Homo Sapiens
RCGIFAPPS

SEQ ID NO: 1085315 - protein, 9 aa, Homo Sapiens
LRPAGSEHS

SEQ ID NO: 1085316 - protein, 9 aa, Homo Sapiens
VGRLSGHPS

SEQ ID NO: 1085317 - protein, 9 aa, Homo Sapiens
AVSTRVRWC

SEQ ID NO: 1085318 - protein, 9 aa, Homo Sapiens
VASMYQQLG

SEQ ID NO: 1085319 - protein, 9 aa, Homo Sapiens
RDASDSLAG

SEQ ID NO: 1085320 - protein, 9 aa, Homo Sapiens
SQCQGFFFS

SEQ ID NO: 1085321 - protein, 9 aa, Homo Sapiens
SGDPNNEYK

SEQ ID NO: 1085322 - protein, 9 aa, Homo Sapiens
FFLIGSLIP

SEQ ID NO: 1085323 - protein, 9 aa, Homo Sapiens
YGCAQKSRP

SEQ ID NO: 1085324 - protein, 9 aa, Homo Sapiens
FWQWIDQSF

SEQ ID NO: 1085325 - protein, 9 aa, Homo Sapiens
VQSLACLQE

SEQ ID NO: 1085326 - protein, 9 aa, Homo Sapiens
KLVQGRRLT

SEQ ID NO: 1085327 - protein, 9 aa, Homo Sapiens
EAEERLHPD

SEQ ID NO: 1085328 - protein, 9 aa, Homo Sapiens
KAGEIFSEK

SEQ ID NO: 1085329 - protein, 9 aa, Homo Sapiens
PQAPLPPHD

SEQ ID NO: 1085330 - protein, 9 aa, Homo Sapiens
SSLKSMAVE

SEQ ID NO: 1085331 - protein, 9 aa, Homo Sapiens
ISYSNTTSS

SEQ ID NO: 1085332 - protein, 9 aa, Homo Sapiens
TEALSHLCS

SEQ ID NO: 1085333 - protein, 9 aa, Homo Sapiens
CGKKVSLPN

SEQ ID NO: 1085334 - protein, 9 aa, Homo Sapiens
PPQAPLPPH

SEQ ID NO: 1085335 - protein, 9 aa, Homo Sapiens
PGLNGIKGD

SEQ ID NO: 1085336 - protein, 9 aa, Homo Sapiens
VRAKKIFVT

SEQ ID NO: 1085337 - protein, 9 aa, Homo Sapiens
LSNPHSRFS

SEQ ID NO: 1085338 - protein, 9 aa, Homo Sapiens
PIIGQFSGT

SEQ ID NO: 1085339 - protein, 9 aa, Homo Sapiens
VYLKLIFYV

SEQ ID NO: 1085340 - protein, 9 aa, Homo Sapiens
CCWNSQGAV

SEQ ID NO: 1085341 - protein, 9 aa, Homo Sapiens
TCGKKVSLP

SEQ ID NO: 1085342 - protein, 9 aa, Homo Sapiens
VPVEFYYEN

SEQ ID NO: 1085343 - protein, 9 aa, Homo Sapiens
RGNPTQSPG

SEQ ID NO: 1085344 - protein, 9 aa, Homo Sapiens
HRLLPPAGQ

SEQ ID NO: 1085345 - protein, 9 aa, Homo Sapiens
IMTLIQKKT

SEQ ID NO: 1085346 - protein, 9 aa, Homo Sapiens
EHLKVHTKK

SEQ ID NO: 1085347 - protein, 9 aa, Homo Sapiens
KPLKDVVMA

SEQ ID NO: 1085348 - protein, 9 aa, Homo Sapiens
TDSHTDIRP

SEQ ID NO: 1085349 - protein, 9 aa, Homo Sapiens
IRPDFFKAP

SEQ ID NO: 1085350 - protein, 9 aa, Homo Sapiens
IECKFCILC

SEQ ID NO: 1085351 - protein, 9 aa, Homo Sapiens
TLSEQGVLD

SEQ ID NO: 1085352 - protein, 9 aa, Homo Sapiens
LPPSATRER

SEQ ID NO: 1085353 - protein, 9 aa, Homo Sapiens
EEQEEEEGS

SEQ ID NO: 1085354 - protein, 9 aa, Homo Sapiens
GRRLTVEES

SEQ ID NO: 1085355 - protein, 9 aa, Homo Sapiens
PVLAAQRNY

SEQ ID NO: 1085356 - protein, 9 aa, Homo Sapiens
SNALLKSSA

SEQ ID NO: 1085357 - protein, 9 aa, Homo Sapiens
VFLDFPVHG

SEQ ID NO: 1085358 - protein, 9 aa, Homo Sapiens
YLVTVLRNV

SEQ ID NO: 1085359 - protein, 9 aa, Homo Sapiens
CIPQLWKRV

SEQ ID NO: 1085360 - protein, 9 aa, Homo Sapiens
IGELAREIG

SEQ ID NO: 1085361 - protein, 9 aa, Homo Sapiens
FFILLPEIV

SEQ ID NO: 1085362 - protein, 9 aa, Homo Sapiens
MAEKDTIFE

SEQ ID NO: 1085363 - protein, 9 aa, Homo Sapiens
MRLVYLDLK

SEQ ID NO: 1085364 - protein, 9 aa, Homo Sapiens
ACSTDSSVT

SEQ ID NO: 1085365 - protein, 9 aa, Homo Sapiens
IINVESQLA

SEQ ID NO: 1085366 - protein, 9 aa, Homo Sapiens
CQFPFQRLD

SEQ ID NO: 1085367 - protein, 9 aa, Homo Sapiens
WVLWHDAEN

SEQ ID NO: 1085368 - protein, 9 aa, Homo Sapiens
NYTTIECET

SEQ ID NO: 1085369 - protein, 9 aa, Homo Sapiens
TSGTTWILT

SEQ ID NO: 1085370 - protein, 9 aa, Homo Sapiens
INTTVSQYP

SEQ ID NO: 1085371 - protein, 9 aa, Homo Sapiens
MQGVINKTP

SEQ ID NO: 1085372 - protein, 9 aa, Homo Sapiens
GLNGIKGDP

SEQ ID NO: 1085373 - protein, 9 aa, Homo Sapiens
QCIECKFCI

SEQ ID NO: 1085374 - protein, 9 aa, Homo Sapiens
NIRPDFFKA

SEQ ID NO: 1085375 - protein, 9 aa, Homo Sapiens
VKEFMIQDG

SEQ ID NO: 1085376 - protein, 9 aa, Homo Sapiens
FVAQAGVQW

SEQ ID NO: 1085377 - protein, 9 aa, Homo Sapiens
YSNTTSSPL

SEQ ID NO: 1085378 - protein, 9 aa, Homo Sapiens
PSSGQHIPK

SEQ ID NO: 1085379 - protein, 9 aa, Homo Sapiens
ESSRVKEFM

SEQ ID NO: 1085380 - protein, 9 aa, Homo Sapiens
INKTPLPID

SEQ ID NO: 1085381 - protein, 9 aa, Homo Sapiens
RMMKSDYIV

SEQ ID NO: 1085382 - protein, 9 aa, Homo Sapiens
LVVNIVASM

SEQ ID NO: 1085383 - protein, 9 aa, Homo Sapiens
LFERATNSN

SEQ ID NO: 1085384 - protein, 9 aa, Homo Sapiens
VGLVSIFFS

SEQ ID NO: 1085385 - protein, 9 aa, Homo Sapiens
LKPTCGKKV

SEQ ID NO: 1085386 - protein, 9 aa, Homo Sapiens
EYLKYCQFP

SEQ ID NO: 1085387 - protein, 9 aa, Homo Sapiens
LVTVLRNVL

SEQ ID NO: 1085388 - protein, 9 aa, Homo Sapiens
PKSQVFEEE

SEQ ID NO: 1085389 - protein, 9 aa, Homo Sapiens
AICKPLHHT

SEQ ID NO: 1085390 - protein, 9 aa, Homo Sapiens
ALSHLCSLI

SEQ ID NO: 1085391 - protein, 9 aa, Homo Sapiens
PPAHALRAR

SEQ ID NO: 1085392 - protein, 9 aa, Homo Sapiens
RLTVEESGT

SEQ ID NO: 1085393 - protein, 9 aa, Homo Sapiens
YLKLIFYVH

SEQ ID NO: 1085394 - protein, 9 aa, Homo Sapiens
ERMMKSDYI

SEQ ID NO: 1085395 - protein, 9 aa, Homo Sapiens
FRVDKIRLL

SEQ ID NO: 1085396 - protein, 9 aa, Homo Sapiens
FKAPLAYVK

SEQ ID NO: 1085397 - protein, 9 aa, Homo Sapiens
ALKINAETL

SEQ ID NO: 1085398 - protein, 9 aa, Homo Sapiens
KVLSVNYTT

SEQ ID NO: 1085399 - protein, 9 aa, Homo Sapiens
GADFTLKVE

SEQ ID NO: 1085400 - protein, 9 aa, Homo Sapiens
EFMIQDGPF

SEQ ID NO: 1085401 - protein, 9 aa, Homo Sapiens
LSVNYTTIE

SEQ ID NO: 1085402 - protein, 9 aa, Homo Sapiens
GLLKPTCGK

SEQ ID NO: 1085403 - protein, 9 aa, Homo Sapiens
LKSMAVEES

SEQ ID NO: 1085404 - protein, 9 aa, Homo Sapiens
KLIFYVHDR

SEQ ID NO: 1085405 - protein, 9 aa, Homo Sapiens
LIFVLYLDT

SEQ ID NO: 1085406 - protein, 9 aa, Homo Sapiens
TSWNRMIGE

SEQ ID NO: 1085407 - protein, 9 aa, Homo Sapiens
ALDNMYDAC

SEQ ID NO: 1085408 - protein, 9 aa, Homo Sapiens
LEAEAGGCF

SEQ ID NO: 1085409 - protein, 9 aa, Homo Sapiens
PSPRMGSPG

SEQ ID NO: 1085410 - protein, 9 aa, Homo Sapiens
TSAALNRDN

SEQ ID NO: 1085411 - protein, 9 aa, Homo Sapiens
TLVGLVSIF

SEQ ID NO: 1085412 - protein, 9 aa, Homo Sapiens
LQFVEEPMV

SEQ ID NO: 1085413 - protein, 9 aa, Homo Sapiens
RIVVSRSHL

SEQ ID NO: 1085414 - protein, 9 aa, Homo Sapiens
CAQLDHWAL

SEQ ID NO: 1085415 - protein, 9 aa, Homo Sapiens
DISGDPNNE

SEQ ID NO: 1085416 - protein, 9 aa, Homo Sapiens
GHDHHNADL

SEQ ID NO: 1085417 - protein, 9 aa, Homo Sapiens
SSRVKEFMI

SEQ ID NO: 1085418 - protein, 9 aa, Homo Sapiens
STDSSVTTC

SEQ ID NO: 1085419 - protein, 9 aa, Homo Sapiens
RMGSPGPHA

SEQ ID NO: 1085420 - protein, 9 aa, Homo Sapiens
KIKEVQHES

SEQ ID NO: 1085421 - protein, 9 aa, Homo Sapiens
LTSAALNRD

SEQ ID NO: 1085422 - protein, 9 aa, Homo Sapiens
VQSLIINVE

SEQ ID NO: 1085423 - protein, 9 aa, Homo Sapiens
HSSHPVDTD

SEQ ID NO: 1085424 - protein, 9 aa, Homo Sapiens
GLATEKSRW

SEQ ID NO: 1085425 - protein, 9 aa, Homo Sapiens
GELAREIGL

SEQ ID NO: 1085426 - protein, 9 aa, Homo Sapiens
LIHSDRRPY

SEQ ID NO: 1085427 - protein, 9 aa, Homo Sapiens
EGVLPSFPG

SEQ ID NO: 1085428 - protein, 9 aa, Homo Sapiens
RLHGGKGLL

SEQ ID NO: 1085429 - protein, 9 aa, Homo Sapiens
NAIKKLCSR

SEQ ID NO: 1085430 - protein, 9 aa, Homo Sapiens
PAAPVKNEY

SEQ ID NO: 1085431 - protein, 9 aa, Homo Sapiens
LLIHSDRRP

SEQ ID NO: 1085432 - protein, 9 aa, Homo Sapiens
EDITLDHLT

SEQ ID NO: 1085433 - protein, 9 aa, Homo Sapiens
AVFDLMEEK

SEQ ID NO: 1085434 - protein, 9 aa, Homo Sapiens
LMAVFFLIG

SEQ ID NO: 1085435 - protein, 9 aa, Homo Sapiens
ESLPSVGRL

SEQ ID NO: 1085436 - protein, 9 aa, Homo Sapiens
GVFRGVTSL

SEQ ID NO: 1085437 - protein, 9 aa, Homo Sapiens
YDCYVATCC

SEQ ID NO: 1085438 - protein, 9 aa, Homo Sapiens
HLGMVKQVA

SEQ ID NO: 1085439 - protein, 9 aa, Homo Sapiens
VRWCRPDCR

SEQ ID NO: 1085440 - protein, 9 aa, Homo Sapiens
KLDSYAELL

SEQ ID NO: 1085441 - protein, 9 aa, Homo Sapiens
DIMLITVFY

SEQ ID NO: 1085442 - protein, 9 aa, Homo Sapiens
TLRPAGSEH

SEQ ID NO: 1085443 - protein, 9 aa, Homo Sapiens
LFSAVFVLP

SEQ ID NO: 1085444 - protein, 9 aa, Homo Sapiens
MKSDYIVMP

SEQ ID NO: 1085445 - protein, 9 aa, Homo Sapiens
TLTLFSFSG

SEQ ID NO: 1085446 - protein, 9 aa, Homo Sapiens
LFHPNVYSS

SEQ ID NO: 1085447 - protein, 9 aa, Homo Sapiens
SSVTTCWDC

SEQ ID NO: 1085448 - protein, 9 aa, Homo Sapiens
QTSMIATIN

SEQ ID NO: 1085449 - protein, 9 aa, Homo Sapiens
NIITECCKL

SEQ ID NO: 1085450 - protein, 9 aa, Homo Sapiens
SAWRFYVTN

SEQ ID NO: 1085451 - protein, 9 aa, Homo Sapiens
GETFSIWKL

SEQ ID NO: 1085452 - protein, 9 aa, Homo Sapiens
PSDTFFSSD

SEQ ID NO: 1085453 - protein, 9 aa, Homo Sapiens
RAPLGERSF

SEQ ID NO: 1085454 - protein, 9 aa, Homo Sapiens
NTSWNRMIG

SEQ ID NO: 1085455 - protein, 9 aa, Homo Sapiens
PLKDVVMAN

SEQ ID NO: 1085456 - protein, 9 aa, Homo Sapiens
NKESLIEHL

SEQ ID NO: 1085457 - protein, 9 aa, Homo Sapiens
LHCWPQNST

SEQ ID NO: 1085458 - protein, 9 aa, Homo Sapiens
PPTFSPAHS

SEQ ID NO: 1085459 - protein, 9 aa, Homo Sapiens
TPQSVNSGE

SEQ ID NO: 1085460 - protein, 9 aa, Homo Sapiens
CTAENPSEK

SEQ ID NO: 1085461 - protein, 9 aa, Homo Sapiens
CQIKAFGLS

SEQ ID NO: 1085462 - protein, 9 aa, Homo Sapiens
KDCGDDLFP

SEQ ID NO: 1085463 - protein, 9 aa, Homo Sapiens
LVSIFFSQR

SEQ ID NO: 1085464 - protein, 9 aa, Homo Sapiens
LPPSPRMGS

SEQ ID NO: 1085465 - protein, 9 aa, Homo Sapiens
TSTPSSTSG

SEQ ID NO: 1085466 - protein, 9 aa, Homo Sapiens
AQSNLSGEE

SEQ ID NO: 1085467 - protein, 9 aa, Homo Sapiens
FEIVIYRVV

SEQ ID NO: 1085468 - protein, 9 aa, Homo Sapiens
RIMTLIQKK

SEQ ID NO: 1085469 - protein, 9 aa, Homo Sapiens
SLACLQEAD

SEQ ID NO: 1085470 - protein, 9 aa, Homo Sapiens
QSGTSSLPR

SEQ ID NO: 1085471 - protein, 9 aa, Homo Sapiens
SLIEHLKVH

SEQ ID NO: 1085472 - protein, 9 aa, Homo Sapiens
HIAKPLKDV

SEQ ID NO: 1085473 - protein, 9 aa, Homo Sapiens
LPSVGRLSG

SEQ ID NO: 1085474 - protein, 9 aa, Homo Sapiens
LQEADHTVG

SEQ ID NO: 1085475 - protein, 9 aa, Homo Sapiens
NSKTGNPRH

SEQ ID NO: 1085476 - protein, 9 aa, Homo Sapiens
QERMMKSDY

SEQ ID NO: 1085477 - protein, 9 aa, Homo Sapiens
QSHHESCFV

SEQ ID NO: 1085478 - protein, 9 aa, Homo Sapiens
CFVAQAGVQ

SEQ ID NO: 1085479 - protein, 9 aa, Homo Sapiens
PVLRVFDFR

SEQ ID NO: 1085480 - protein, 9 aa, Homo Sapiens
HSQCQGFFF

SEQ ID NO: 1085481 - protein, 9 aa, Homo Sapiens
KLEEILDET

SEQ ID NO: 1085482 - protein, 9 aa, Homo Sapiens
LSNIITECC

SEQ ID NO: 1085483 - protein, 9 aa, Homo Sapiens
KLQFTFTSE

SEQ ID NO: 1085484 - protein, 9 aa, Homo Sapiens
LGDSKAVLP

SEQ ID NO: 1085485 - protein, 9 aa, Homo Sapiens
LDSYAELLD

SEQ ID NO: 1085486 - protein, 9 aa, Homo Sapiens
GWGWLVLEA

SEQ ID NO: 1085487 - protein, 9 aa, Homo Sapiens
GICQIKAFG

SEQ ID NO: 1085488 - protein, 9 aa, Homo Sapiens
IEDITLDHL

SEQ ID NO: 1085489 - protein, 9 aa, Homo Sapiens
VAICKPLHH

SEQ ID NO: 1085490 - protein, 9 aa, Homo Sapiens
KGYKLSPDQ

SEQ ID NO: 1085491 - protein, 9 aa, Homo Sapiens
ELLTLPYFS

SEQ ID NO: 1085492 - protein, 9 aa, Homo Sapiens
SQGAVSVPW

SEQ ID NO: 1085493 - protein, 9 aa, Homo Sapiens
SQQDTLSNI

SEQ ID NO: 1085494 - protein, 9 aa, Homo Sapiens
EVTCAQLDH

SEQ ID NO: 1085495 - protein, 9 aa, Homo Sapiens
HTIPPTFSP

SEQ ID NO: 1085496 - protein, 9 aa, Homo Sapiens
ERARKHLAE

SEQ ID NO: 1085497 - protein, 9 aa, Homo Sapiens
LLTLPYFSG

SEQ ID NO: 1085498 - protein, 9 aa, Homo Sapiens
QKSRPGVYT

SEQ ID NO: 1085499 - protein, 9 aa, Homo Sapiens
VQGRRLTVE

SEQ ID NO: 1085500 - protein, 9 aa, Homo Sapiens
ATVRAKKIF

SEQ ID NO: 1085501 - protein, 9 aa, Homo Sapiens
GRPGLNGIK

SEQ ID NO: 1085502 - protein, 9 aa, Homo Sapiens
ASDSLAGAA

SEQ ID NO: 1085503 - protein, 9 aa, Homo Sapiens
VLRVFDFRV

SEQ ID NO: 1085504 - protein, 9 aa, Homo Sapiens
SRFSLWQDL

SEQ ID NO: 1085505 - protein, 9 aa, Homo Sapiens
TKALQDSWL

SEQ ID NO: 1085506 - protein, 9 aa, Homo Sapiens
LVQGRRLTV

SEQ ID NO: 1085507 - protein, 9 aa, Homo Sapiens
VVSSHPPVQ

SEQ ID NO: 1085508 - protein, 9 aa, Homo Sapiens
ISDRKSRRS

SEQ ID NO: 1085509 - protein, 9 aa, Homo Sapiens
IKEVQHESI

SEQ ID NO: 1085510 - protein, 9 aa, Homo Sapiens
EAVRRAFCV

SEQ ID NO: 1085511 - protein, 9 aa, Homo Sapiens
PVFLDFPVH

SEQ ID NO: 1085512 - protein, 9 aa, Homo Sapiens
DFFKAPLAY

SEQ ID NO: 1085513 - protein, 9 aa, Homo Sapiens
QYPETELYA

SEQ ID NO: 1085514 - protein, 9 aa, Homo Sapiens
DFGLATEKS

SEQ ID NO: 1085515 - protein, 9 aa, Homo Sapiens
SVNYTTIEC

SEQ ID NO: 1085516 - protein, 9 aa, Homo Sapiens
SYSNTTSSP

SEQ ID NO: 1085517 - protein, 9 aa, Homo Sapiens
LVYLDLKGA

SEQ ID NO: 1085518 - protein, 9 aa, Homo Sapiens
APVKGESIL

SEQ ID NO: 1085519 - protein, 9 aa, Homo Sapiens
VLFWQWIDQ

SEQ ID NO: 1085520 - protein, 9 aa, Homo Sapiens
EILDETNRL

SEQ ID NO: 1085521 - protein, 9 aa, Homo Sapiens
VGTYQALDK

SEQ ID NO: 1085522 - protein, 9 aa, Homo Sapiens
GFFFSLTML

SEQ ID NO: 1085523 - protein, 9 aa, Homo Sapiens
EKDTIFEAP

SEQ ID NO: 1085524 - protein, 9 aa, Homo Sapiens
TVRAKKIFV

SEQ ID NO: 1085525 - protein, 9 aa, Homo Sapiens
DIWVLWHDA

SEQ ID NO: 1085526 - protein, 9 aa, Homo Sapiens
SDISGDPNN

SEQ ID NO: 1085527 - protein, 9 aa, Homo Sapiens
GKKVSLPNK

SEQ ID NO: 1085528 - protein, 9 aa, Homo Sapiens
DETNRLAAQ

SEQ ID NO: 1085529 - protein, 9 aa, Homo Sapiens
VESHRKSCD

SEQ ID NO: 1085530 - protein, 9 aa, Homo Sapiens
ILAEYLKYC

SEQ ID NO: 1085531 - protein, 9 aa, Homo Sapiens
IPPRDCHLC

SEQ ID NO: 1085532 - protein, 9 aa, Homo Sapiens
DAEIEDITL

SEQ ID NO: 1085533 - protein, 9 aa, Homo Sapiens
DELSWQAPI

SEQ ID NO: 1085534 - protein, 9 aa, Homo Sapiens
SVGRLSGHP

SEQ ID NO: 1085535 - protein, 9 aa, Homo Sapiens
KAVRAARQG

SEQ ID NO: 1085536 - protein, 9 aa, Homo Sapiens
TWNKDFLPD

SEQ ID NO: 1085537 - protein, 9 aa, Homo Sapiens
QSAWRFYVT

SEQ ID NO: 1085538 - protein, 9 aa, Homo Sapiens
AARQGADFT

SEQ ID NO: 1085539 - protein, 9 aa, Homo Sapiens
TCAQLDHWA

SEQ ID NO: 1085540 - protein, 9 aa, Homo Sapiens
NLTLRPAGS

SEQ ID NO: 1085541 - protein, 9 aa, Homo Sapiens
SEAEERLHP

SEQ ID NO: 1085542 - protein, 9 aa, Homo Sapiens
EEKSYVFRV

SEQ ID NO: 1085543 - protein, 9 aa, Homo Sapiens
RQGADFTLK

SEQ ID NO: 1085544 - protein, 9 aa, Homo Sapiens
KEVQHESIN

SEQ ID NO: 1085545 - protein, 9 aa, Homo Sapiens
GYGCAQKSR

SEQ ID NO: 1085546 - protein, 9 aa, Homo Sapiens
SDRRPYPCQ

SEQ ID NO: 1085547 - protein, 9 aa, Homo Sapiens
LRARLAVPG

SEQ ID NO: 1085548 - protein, 9 aa, Homo Sapiens
MDVTSSLGG

SEQ ID NO: 1085549 - protein, 9 aa, Homo Sapiens
DDDDDVGDY

SEQ ID NO: 1085550 - protein, 9 aa, Homo Sapiens
ASMYQQLGT

SEQ ID NO: 1085551 - protein, 9 aa, Homo Sapiens
HKLQFTFTS

SEQ ID NO: 1085552 - protein, 9 aa, Homo Sapiens
WGYGCAQKS

SEQ ID NO: 1085553 - protein, 9 aa, Homo Sapiens
KYPGINSDE

SEQ ID NO: 1085554 - protein, 9 aa, Homo Sapiens
WCLFWASFC

SEQ ID NO: 1085555 - protein, 9 aa, Homo Sapiens
EAPKMLRNP

SEQ ID NO: 1085556 - protein, 9 aa, Homo Sapiens
LLDTTNFSK

SEQ ID NO: 1085557 - protein, 9 aa, Homo Sapiens
KLRAHRQES

SEQ ID NO: 1085558 - protein, 9 aa, Homo Sapiens
HEVETKALQ

SEQ ID NO: 1085559 - protein, 9 aa, Homo Sapiens
RARKERARK

SEQ ID NO: 1085560 - protein, 9 aa, Homo Sapiens
DVGDYDDDH

SEQ ID NO: 1085561 - protein, 9 aa, Homo Sapiens
VFYIHILQA

SEQ ID NO: 1085562 - protein, 9 aa, Homo Sapiens
TSSLPRHPA

SEQ ID NO: 1085563 - protein, 9 aa, Homo Sapiens
SSSPFRGNP

SEQ ID NO: 1085564 - protein, 9 aa, Homo Sapiens
SLLQFVEEP

SEQ ID NO: 1085565 - protein, 9 aa, Homo Sapiens
AVRRAFCVW

SEQ ID NO: 1085566 - protein, 9 aa, Homo Sapiens
QLHQQQQQE

SEQ ID NO: 1085567 - protein, 9 aa, Homo Sapiens
LQYDAEIED

SEQ ID NO: 1085568 - protein, 9 aa, Homo Sapiens
CSLISLHLK

SEQ ID NO: 1085569 - protein, 9 aa, Homo Sapiens
TINPAADNY

SEQ ID NO: 1085570 - protein, 9 aa, Homo Sapiens
MGSPGPHAH

SEQ ID NO: 1085571 - protein, 9 aa, Homo Sapiens
MPQYGSRHR

SEQ ID NO: 1085572 - protein, 9 aa, Homo Sapiens
LQFTFTSEP

SEQ ID NO: 1085573 - protein, 9 aa, Homo Sapiens
DDELSWQAP

SEQ ID NO: 1085574 - protein, 9 aa, Homo Sapiens
SDTFFSSDG

SEQ ID NO: 1085575 - protein, 9 aa, Homo Sapiens
RNVLIILAI

SEQ ID NO: 1085576 - protein, 9 aa, Homo Sapiens
RFSLWQDLP

SEQ ID NO: 1085577 - protein, 9 aa, Homo Sapiens
LGERSFFCP

SEQ ID NO: 1085578 - protein, 9 aa, Homo Sapiens
VEPNTKLFS

SEQ ID NO: 1085579 - protein, 9 aa, Homo Sapiens
HPNVYSSGT

SEQ ID NO: 1085580 - protein, 9 aa, Homo Sapiens
AQMKNAIKK

SEQ ID NO: 1085581 - protein, 9 aa, Homo Sapiens
EENRVQVLK

SEQ ID NO: 1085582 - protein, 9 aa, Homo Sapiens
KESLIEHLK

SEQ ID NO: 1085583 - protein, 9 aa, Homo Sapiens
WRFYVTNLS

SEQ ID NO: 1085584 - protein, 9 aa, Homo Sapiens
TSTDIWVLW

SEQ ID NO: 1085585 - protein, 9 aa, Homo Sapiens
TDIRPLSGG

SEQ ID NO: 1085586 - protein, 9 aa, Homo Sapiens
KIMKLTLPE

SEQ ID NO: 1085587 - protein, 9 aa, Homo Sapiens
LMWSDHLKR

SEQ ID NO: 1085588 - protein, 9 aa, Homo Sapiens
PVKNEYADA

SEQ ID NO: 1085589 - protein, 9 aa, Homo Sapiens
LGMVKQVAL

SEQ ID NO: 1085590 - protein, 9 aa, Homo Sapiens
CKFCILCGT

SEQ ID NO: 1085591 - protein, 9 aa, Homo Sapiens
LTSTDIWVL

SEQ ID NO: 1085592 - protein, 9 aa, Homo Sapiens
ILDETNRLA

SEQ ID NO: 1085593 - protein, 9 aa, Homo Sapiens
AVLTLSEQG

SEQ ID NO: 1085594 - protein, 9 aa, Homo Sapiens
MLITVFYIH

SEQ ID NO: 1085595 - protein, 9 aa, Homo Sapiens
PKPIGELAR

SEQ ID NO: 1085596 - protein, 9 aa, Homo Sapiens
LSNIRPDFF

SEQ ID NO: 1085597 - protein, 9 aa, Homo Sapiens
FSCSPRCGI

SEQ ID NO: 1085598 - protein, 9 aa, Homo Sapiens
KPTCGKKVS

SEQ ID NO: 1085599 - protein, 9 aa, Homo Sapiens
FPTRMDAVA

SEQ ID NO: 1085600 - protein, 9 aa, Homo Sapiens
IEVLSNALL

SEQ ID NO: 1085601 - protein, 9 aa, Homo Sapiens
SNIRPDFFK

SEQ ID NO: 1085602 - protein, 9 aa, Homo Sapiens
FYVTNLSRT

SEQ ID NO: 1085603 - protein, 9 aa, Homo Sapiens
AAQRNYCSK

SEQ ID NO: 1085604 - protein, 9 aa, Homo Sapiens
WNRMIGELI

SEQ ID NO: 1085605 - protein, 9 aa, Homo Sapiens
QEIINETFE

SEQ ID NO: 1085606 - protein, 9 aa, Homo Sapiens
SEKIRSQDV

SEQ ID NO: 1085607 - protein, 9 aa, Homo Sapiens
KPKPIGELA

SEQ ID NO: 1085608 - protein, 9 aa, Homo Sapiens
LSTTPLSLA

SEQ ID NO: 1085609 - protein, 9 aa, Homo Sapiens
FNSEFYNST

SEQ ID NO: 1085610 - protein, 9 aa, Homo Sapiens
NAETLVGLV

SEQ ID NO: 1085611 - protein, 9 aa, Homo Sapiens
LSGHPSSGK

SEQ ID NO: 1085612 - protein, 9 aa, Homo Sapiens
QMRLVYLDL

SEQ ID NO: 1085613 - protein, 9 aa, Homo Sapiens
PRDCHLCPL

SEQ ID NO: 1085614 - protein, 9 aa, Homo Sapiens
CLFWASFCL

SEQ ID NO: 1085615 - protein, 9 aa, Homo Sapiens
GCAQKSRPG

SEQ ID NO: 1085616 - protein, 9 aa, Homo Sapiens
LTVEESGTG

SEQ ID NO: 1085617 - protein, 9 aa, Homo Sapiens
NTTSSPLET

SEQ ID NO: 1085618 - protein, 9 aa, Homo Sapiens
INNDFNSEF

SEQ ID NO: 1085619 - protein, 9 aa, Homo Sapiens
DYIGSEMMA

SEQ ID NO: 1085620 - protein, 9 aa, Homo Sapiens
TLFSFSGET

SEQ ID NO: 1085621 - protein, 9 aa, Homo Sapiens
YIILQLEQE

SEQ ID NO: 1085622 - protein, 9 aa, Homo Sapiens
NWVVVFKAL

SEQ ID NO: 1085623 - protein, 9 aa, Homo Sapiens
FLDFPVHGM

SEQ ID NO: 1085624 - protein, 9 aa, Homo Sapiens
IFYVHDRRK

SEQ ID NO: 1085625 - protein, 9 aa, Homo Sapiens
VEFYYENMH

SEQ ID NO: 1085626 - protein, 9 aa, Homo Sapiens
LSNALLKSS

SEQ ID NO: 1085627 - protein, 9 aa, Homo Sapiens
GSGSQSGTS

SEQ ID NO: 1085628 - protein, 9 aa, Homo Sapiens
RPKSQVFEE

SEQ ID NO: 1085629 - protein, 9 aa, Homo Sapiens
YYENMHASF

SEQ ID NO: 1085630 - protein, 9 aa, Homo Sapiens
PNVYSSGTV

SEQ ID NO: 1085631 - protein, 9 aa, Homo Sapiens
AENPSEKIR

SEQ ID NO: 1085632 - protein, 9 aa, Homo Sapiens
PNPNLPPSA

SEQ ID NO: 1085633 - protein, 9 aa, Homo Sapiens
IKAFGLSDI

SEQ ID NO: 1085634 - protein, 9 aa, Homo Sapiens
QYGSRHRLL

SEQ ID NO: 1085635 - protein, 9 aa, Homo Sapiens
SFCAKYTYS

SEQ ID NO: 1085636 - protein, 9 aa, Homo Sapiens
EDCRTESWR

SEQ ID NO: 1085637 - protein, 9 aa, Homo Sapiens
YFSGQFTTP

SEQ ID NO: 1085638 - protein, 9 aa, Homo Sapiens
VTNLSRTDL

SEQ ID NO: 1085639 - protein, 9 aa, Homo Sapiens
HQQQQQEPW

SEQ ID NO: 1085640 - protein, 9 aa, Homo Sapiens
KPIGELARE

SEQ ID NO: 1085641 - protein, 9 aa, Homo Sapiens
LAEYLKYCQ

SEQ ID NO: 1085642 - protein, 9 aa, Homo Sapiens
APLGERSFF

SEQ ID NO: 1085643 - protein, 9 aa, Homo Sapiens
SRQQLCSRR

SEQ ID NO: 1085644 - protein, 9 aa, Homo Sapiens
SCSPRCGIF

SEQ ID NO: 1085645 - protein, 9 aa, Homo Sapiens
NTTVSQYPE

SEQ ID NO: 1085646 - protein, 9 aa, Homo Sapiens
QLCSRRHPP

SEQ ID NO: 1085647 - protein, 9 aa, Homo Sapiens
VSIFFSQRN

SEQ ID NO: 1085648 - protein, 9 aa, Homo Sapiens
SPIIGQFSG

SEQ ID NO: 1085649 - protein, 9 aa, Homo Sapiens
PPTWNKDFL

SEQ ID NO: 1085650 - protein, 9 aa, Homo Sapiens
SSLPRHPAI

SEQ ID NO: 1085651 - protein, 9 aa, Homo Sapiens
QGVINKTPL

SEQ ID NO: 1085652 - protein, 9 aa, Homo Sapiens
EWLPPNRSV

SEQ ID NO: 1085653 - protein, 9 aa, Homo Sapiens
LDNMYDACI

SEQ ID NO: 1085654 - protein, 9 aa, Homo Sapiens
PEGVLPSFP

SEQ ID NO: 1085655 - protein, 9 aa, Homo Sapiens
FVSGSSDIS

SEQ ID NO: 1085656 - protein, 9 aa, Homo Sapiens
VPVCCHCKI

SEQ ID NO: 1085657 - protein, 9 aa, Homo Sapiens
VEKALYDYI

SEQ ID NO: 1085658 - protein, 9 aa, Homo Sapiens
YLKYCQFPF

SEQ ID NO: 1085659 - protein, 9 aa, Homo Sapiens
KKIFVTGGS

SEQ ID NO: 1085660 - protein, 9 aa, Homo Sapiens
SYAELLDAT

SEQ ID NO: 1085661 - protein, 9 aa, Homo Sapiens
SVCSALLDP

SEQ ID NO: 1085662 - protein, 9 aa, Homo Sapiens
GYVVSTFAM

SEQ ID NO: 1085663 - protein, 9 aa, Homo Sapiens
LLQFVEEPM

SEQ ID NO: 1085664 - protein, 9 aa, Homo Sapiens
IINETFEYG

SEQ ID NO: 1085665 - protein, 9 aa, Homo Sapiens
SILIRLFLA

SEQ ID NO: 1085666 - protein, 9 aa, Homo Sapiens
TTVSQYPET

SEQ ID NO: 1085667 - protein, 9 aa, Homo Sapiens
QFVEEPMVH

SEQ ID NO: 1085668 - protein, 9 aa, Homo Sapiens
FCLLVVYLQ

SEQ ID NO: 1085669 - protein, 9 aa, Homo Sapiens
DASDSLAGA

SEQ ID NO: 1085670 - protein, 9 aa, Homo Sapiens
GYKLSPDQF

SEQ ID NO: 1085671 - protein, 9 aa, Homo Sapiens
SDSLAGAAL

SEQ ID NO: 1085672 - protein, 9 aa, Homo Sapiens
LYFWNIITI

SEQ ID NO: 1085673 - protein, 9 aa, Homo Sapiens
EVSSSLKSM

SEQ ID NO: 1085674 - protein, 9 aa, Homo Sapiens
LRAHRQESA

SEQ ID NO: 1085675 - protein, 9 aa, Homo Sapiens
TKIKEVQHE

SEQ ID NO: 1085676 - protein, 9 aa, Homo Sapiens
PQRAPLGER

SEQ ID NO: 1085677 - protein, 9 aa, Homo Sapiens
EERLHPDPL

SEQ ID NO: 1085678 - protein, 9 aa, Homo Sapiens
PTEPNSKTG

SEQ ID NO: 1085679 - protein, 9 aa, Homo Sapiens
FLIGSLIPT

SEQ ID NO: 1085680 - protein, 9 aa, Homo Sapiens
TSSPLETMT

SEQ ID NO: 1085681 - protein, 9 aa, Homo Sapiens
ALRARLAVP

SEQ ID NO: 1085682 - protein, 9 aa, Homo Sapiens
VTLIFVLYL

SEQ ID NO: 1085683 - protein, 9 aa, Homo Sapiens
NGIKGDPGL

SEQ ID NO: 1085684 - protein, 9 aa, Homo Sapiens
TEPNSKTGN

SEQ ID NO: 1085685 - protein, 9 aa, Homo Sapiens
TPHKLQFTF

SEQ ID NO: 1085686 - protein, 9 aa, Homo Sapiens
MEEKSYVFR

SEQ ID NO: 1085687 - protein, 9 aa, Homo Sapiens
SSLGGGGDP

SEQ ID NO: 1085688 - protein, 9 aa, Homo Sapiens
VSPKKEAPK

SEQ ID NO: 1085689 - protein, 9 aa, Homo Sapiens
GEIFSEKKY

SEQ ID NO: 1085690 - protein, 9 aa, Homo Sapiens
NVYSSGTVC

SEQ ID NO: 1085691 - protein, 9 aa, Homo Sapiens
HPQQESEAE

SEQ ID NO: 1085692 - protein, 9 aa, Homo Sapiens
SECEKTFSC

SEQ ID NO: 1085693 - protein, 9 aa, Homo Sapiens
ETPHKLQFT

SEQ ID NO: 1085694 - protein, 9 aa, Homo Sapiens
QEKELWREG

SEQ ID NO: 1085695 - protein, 9 aa, Homo Sapiens
AVFEIVIYR

SEQ ID NO: 1085696 - protein, 9 aa, Homo Sapiens
DCYVATCCP

SEQ ID NO: 1085697 - protein, 9 aa, Homo Sapiens
SSPLETMTA

SEQ ID NO: 1085698 - protein, 9 aa, Homo Sapiens
RLSGHPSSG

SEQ ID NO: 1085699 - protein, 9 aa, Homo Sapiens
QEVSSSLKS

SEQ ID NO: 1085700 - protein, 9 aa, Homo Sapiens
VRRAFCVWE

SEQ ID NO: 1085701 - protein, 9 aa, Homo Sapiens
RLVYLDLKG

SEQ ID NO: 1085702 - protein, 9 aa, Homo Sapiens
KGWGWLVLE

SEQ ID NO: 1085703 - protein, 9 aa, Homo Sapiens
RLAVPGRAC

SEQ ID NO: 1085704 - protein, 9 aa, Homo Sapiens
YEDTLTLFS

SEQ ID NO: 1085705 - protein, 9 aa, Homo Sapiens
MTEEQKDEG

SEQ ID NO: 1085706 - protein, 9 aa, Homo Sapiens
LPSSGQHIP

SEQ ID NO: 1085707 - protein, 9 aa, Homo Sapiens
PPAAPVKNE

SEQ ID NO: 1085708 - protein, 9 aa, Homo Sapiens
KTFSCQSAL

SEQ ID NO: 1085709 - protein, 9 aa, Homo Sapiens
FCAKYTYSV

SEQ ID NO: 1085710 - protein, 9 aa, Homo Sapiens
VAIDCYHQL

SEQ ID NO: 1085711 - protein, 9 aa, Homo Sapiens
LASREWLPP

SEQ ID NO: 1085712 - protein, 9 aa, Homo Sapiens
CIECKFCIL

SEQ ID NO: 1085713 - protein, 9 aa, Homo Sapiens
LAHSSHPVD

SEQ ID NO: 1085714 - protein, 9 aa, Homo Sapiens
FCVWEQATP

SEQ ID NO: 1085715 - protein, 9 aa, Homo Sapiens
FILLPEIVM

SEQ ID NO: 1085716 - protein, 9 aa, Homo Sapiens
SGYGKYPGI

SEQ ID NO: 1085717 - protein, 9 aa, Homo Sapiens
PLSLALGDK

SEQ ID NO: 1085718 - protein, 9 aa, Homo Sapiens
NNDFNSEFY

SEQ ID NO: 1085719 - protein, 9 aa, Homo Sapiens
GEEYLAHSS

SEQ ID NO: 1085720 - protein, 9 aa, Homo Sapiens
KLLKSEDSH

SEQ ID NO: 1085721 - protein, 9 aa, Homo Sapiens
TFPTRMDAV

SEQ ID NO: 1085722 - protein, 9 aa, Homo Sapiens
SLGGGGDPR

SEQ ID NO: 1085723 - protein, 9 aa, Homo Sapiens
ITPVFLDFP

SEQ ID NO: 1085724 - protein, 9 aa, Homo Sapiens
PSPTEPNSK

SEQ ID NO: 1085725 - protein, 9 aa, Homo Sapiens
RVRPPQERV

SEQ ID NO: 1085726 - protein, 9 aa, Homo Sapiens
EKALYDYIG

SEQ ID NO: 1085727 - protein, 9 aa, Homo Sapiens
NPSEKIRSQ

SEQ ID NO: 1085728 - protein, 9 aa, Homo Sapiens
CVWEQATPL

SEQ ID NO: 1085729 - protein, 9 aa, Homo Sapiens
HKGYKLSPD

SEQ ID NO: 1085730 - protein, 9 aa, Homo Sapiens
QQLCSRRHP

SEQ ID NO: 1085731 - protein, 9 aa, Homo Sapiens
TITPVFLDF

SEQ ID NO: 1085732 - protein, 9 aa, Homo Sapiens
PPRDCHLCP

SEQ ID NO: 1085733 - protein, 9 aa, Homo Sapiens
MIATINPAA

SEQ ID NO: 1085734 - protein, 9 aa, Homo Sapiens
RAKKIFVTG

SEQ ID NO: 1085735 - protein, 9 aa, Homo Sapiens
QEEEEGSWR

SEQ ID NO: 1085736 - protein, 9 aa, Homo Sapiens
KYKLYFWNI

SEQ ID NO: 1085737 - protein, 9 aa, Homo Sapiens
ICKPLHHTT

SEQ ID NO: 1085738 - protein, 9 aa, Homo Sapiens
LQLEQEKEL

SEQ ID NO: 1085739 - protein, 9 aa, Homo Sapiens
VQHESINKF

SEQ ID NO: 1085740 - protein, 9 aa, Homo Sapiens
VVPQRAPLG

SEQ ID NO: 1085741 - protein, 9 aa, Homo Sapiens
LLHKGYKLS

SEQ ID NO: 1085742 - protein, 9 aa, Homo Sapiens
KKLCSRKDI

SEQ ID NO: 1085743 - protein, 9 aa, Homo Sapiens
GVINKTPLP

SEQ ID NO: 1085744 - protein, 9 aa, Homo Sapiens
EYLAHSSHP

SEQ ID NO: 1085745 - protein, 9 aa, Homo Sapiens
QLPSSGQHI

SEQ ID NO: 1085746 - protein, 9 aa, Homo Sapiens
TTPLSLALG

SEQ ID NO: 1085747 - protein, 9 aa, Homo Sapiens
NLAVLTLSE

SEQ ID NO: 1085748 - protein, 9 aa, Homo Sapiens
VRAARQGAD

SEQ ID NO: 1085749 - protein, 9 aa, Homo Sapiens
STPSSTSGT

SEQ ID NO: 1085750 - protein, 9 aa, Homo Sapiens
VPACVLITL

SEQ ID NO: 1085751 - protein, 9 aa, Homo Sapiens
QGADFTLKV

SEQ ID NO: 1085752 - protein, 9 aa, Homo Sapiens
LVLEAEAGG

SEQ ID NO: 1085753 - protein, 9 aa, Homo Sapiens
TLSNIITEC

SEQ ID NO: 1085754 - protein, 9 aa, Homo Sapiens
HNTSWNRMI

SEQ ID NO: 1085755 - protein, 9 aa, Homo Sapiens
EKSYVFRVL

SEQ ID NO: 1085756 - protein, 9 aa, Homo Sapiens
LNRDNEIIL

SEQ ID NO: 1085757 - protein, 9 aa, Homo Sapiens
LHGGKGLLF

SEQ ID NO: 1085758 - protein, 9 aa, Homo Sapiens
PSATRERPP

SEQ ID NO: 1085759 - protein, 9 aa, Homo Sapiens
SREWLPPNR

SEQ ID NO: 1085760 - protein, 9 aa, Homo Sapiens
MYDACIPQL

SEQ ID NO: 1085761 - protein, 9 aa, Homo Sapiens
ILGYVVSTF

SEQ ID NO: 1085762 - protein, 9 aa, Homo Sapiens
IFEAPPLGT

SEQ ID NO: 1085763 - protein, 9 aa, Homo Sapiens
CAQKSRPGV

SEQ ID NO: 1085764 - protein, 9 aa, Homo Sapiens
KERARKHLA

SEQ ID NO: 1085765 - protein, 9 aa, Homo Sapiens
KTPLPIDLY

SEQ ID NO: 1085766 - protein, 9 aa, Homo Sapiens
FHPNVYSSG

SEQ ID NO: 1085767 - protein, 9 aa, Homo Sapiens
DRRPYPCQF

SEQ ID NO: 1085768 - protein, 9 aa, Homo Sapiens
TDSSVTTCW

SEQ ID NO: 1085769 - protein, 9 aa, Homo Sapiens
QLEQEKELW

SEQ ID NO: 1085770 - protein, 9 aa, Homo Sapiens
TIPPTFSPA

SEQ ID NO: 1085771 - protein, 9 aa, Homo Sapiens
FGICQIKAF

SEQ ID NO: 1085772 - protein, 9 aa, Homo Sapiens
ALTFPTRMD

SEQ ID NO: 1085773 - protein, 9 aa, Homo Sapiens
VSTRVRWCR

SEQ ID NO: 1085774 - protein, 9 aa, Homo Sapiens
VLAAQRNYC

SEQ ID NO: 1085775 - protein, 9 aa, Homo Sapiens
LNHKLDSYA

SEQ ID NO: 1085776 - protein, 9 aa, Homo Sapiens
QCQGFFFSL

SEQ ID NO: 1085777 - protein, 9 aa, Homo Sapiens
GCCWNSQGA

SEQ ID NO: 1085778 - protein, 9 aa, Homo Sapiens
SVTTCWDCT

SEQ ID NO: 1085779 - protein, 9 aa, Homo Sapiens
LDRPEDQVL

SEQ ID NO: 1085780 - protein, 9 aa, Homo Sapiens
IPSVQLPSS

SEQ ID NO: 1085781 - protein, 9 aa, Homo Sapiens
AGSEHSGLY

SEQ ID NO: 1085782 - protein, 9 aa, Homo Sapiens
FERATNSNW

SEQ ID NO: 1085783 - protein, 9 aa, Homo Sapiens
LVGLVSIFF

SEQ ID NO: 1085784 - protein, 9 aa, Homo Sapiens
AHRQESAIF

SEQ ID NO: 1085785 - protein, 9 aa, Homo Sapiens
WNSLLTRCL

SEQ ID NO: 1085786 - protein, 9 aa, Homo Sapiens
PLHHTTIMS

SEQ ID NO: 1085787 - protein, 9 aa, Homo Sapiens
IATINPAAD

SEQ ID NO: 1085788 - protein, 9 aa, Homo Sapiens
IMKLTLPES

SEQ ID NO: 1085789 - protein, 9 aa, Homo Sapiens
LTLRPAGSE

SEQ ID NO: 1085790 - protein, 9 aa, Homo Sapiens
VLTLSEQGV

SEQ ID NO: 1085791 - protein, 9 aa, Homo Sapiens
QELKQEIIN

SEQ ID NO: 1085792 - protein, 9 aa, Homo Sapiens
YCTAENPSE

SEQ ID NO: 1085793 - protein, 9 aa, Homo Sapiens
KYCQFPFQR

SEQ ID NO: 1085794 - protein, 9 aa, Homo Sapiens
IFFSQRNTS

SEQ ID NO: 1085795 - protein, 9 aa, Homo Sapiens
FVEEPMVHL

SEQ ID NO: 1085796 - protein, 9 aa, Homo Sapiens
CTSSPVVSS

SEQ ID NO: 1085797 - protein, 9 aa, Homo Sapiens
YPGINSDEL

SEQ ID NO: 1085798 - protein, 9 aa, Homo Sapiens
SHLCSLISL

SEQ ID NO: 1085799 - protein, 9 aa, Homo Sapiens
NKPPAAPVK

SEQ ID NO: 1085800 - protein, 9 aa, Homo Sapiens
ELKQEIINE

SEQ ID NO: 1085801 - protein, 9 aa, Homo Sapiens
LPIPPRDCH

SEQ ID NO: 1085802 - protein, 9 aa, Homo Sapiens
IIGQFSGTD

SEQ ID NO: 1085803 - protein, 9 aa, Homo Sapiens
EVETKALQD

SEQ ID NO: 1085804 - protein, 9 aa, Homo Sapiens
VTKIKEVQH

SEQ ID NO: 1085805 - protein, 9 aa, Homo Sapiens
LYDYIGSEM

SEQ ID NO: 1085806 - protein, 9 aa, Homo Sapiens
NRDNEIILS

SEQ ID NO: 1085807 - protein, 9 aa, Homo Sapiens
AEERARKER

SEQ ID NO: 1085808 - protein, 9 aa, Homo Sapiens
CSTDSSVTT

SEQ ID NO: 1085809 - protein, 9 aa, Homo Sapiens
KGESILIRL

SEQ ID NO: 1085810 - protein, 9 aa, Homo Sapiens
PAGSEHSGL

SEQ ID NO: 1085811 - protein, 9 aa, Homo Sapiens
FPGSRPGCQ

SEQ ID NO: 1085812 - protein, 9 aa, Homo Sapiens
ALGRPPGAL

SEQ ID NO: 1085813 - protein, 9 aa, Homo Sapiens
LRNVLIILA

SEQ ID NO: 1085814 - protein, 9 aa, Homo Sapiens
FSLWQDLPE

SEQ ID NO: 1085815 - protein, 9 aa, Homo Sapiens
SYVTKIKEV

SEQ ID NO: 1085816 - protein, 9 aa, Homo Sapiens
KDFLPDAIP

SEQ ID NO: 1085817 - protein, 9 aa, Homo Sapiens
GWLVLEAEA

SEQ ID NO: 1085818 - protein, 9 aa, Homo Sapiens
LEQEKELWR

SEQ ID NO: 1085819 - protein, 9 aa, Homo Sapiens
IGSEMMAVT

SEQ ID NO: 1085820 - protein, 9 aa, Homo Sapiens
HPQERMMKS

SEQ ID NO: 1085821 - protein, 9 aa, Homo Sapiens
QCEINIDEC

SEQ ID NO: 1085822 - protein, 9 aa, Homo Sapiens
YIGSEMMAV

SEQ ID NO: 1085823 - protein, 9 aa, Homo Sapiens
HLCSLISLH

SEQ ID NO: 1085824 - protein, 9 aa, Homo Sapiens
SDRKSRRSL

SEQ ID NO: 1085825 - protein, 9 aa, Homo Sapiens
VYLDLKGAP

SEQ ID NO: 1085826 - protein, 9 aa, Homo Sapiens
QQESEAEER

SEQ ID NO: 1085827 - protein, 9 aa, Homo Sapiens
IWVLWHDAE

SEQ ID NO: 1085828 - protein, 9 aa, Homo Sapiens
DKLLKSEDS

SEQ ID NO: 1085829 - protein, 9 aa, Homo Sapiens
NLHCWPQNS

SEQ ID NO: 1085830 - protein, 9 aa, Homo Sapiens
FSEKKYRQH

SEQ ID NO: 1085831 - protein, 9 aa, Homo Sapiens
TAENPSEKI

SEQ ID NO: 1085832 - protein, 9 aa, Homo Sapiens
WPSPTEPNS

SEQ ID NO: 1085833 - protein, 9 aa, Homo Sapiens
GSEHSGLYS

SEQ ID NO: 1085834 - protein, 9 aa, Homo Sapiens
GEENRVQVL

SEQ ID NO: 1085835 - protein, 9 aa, Homo Sapiens
NLSGEENRV

SEQ ID NO: 1085836 - protein, 9 aa, Homo Sapiens
TVLRNVLII

SEQ ID NO: 1085837 - protein, 9 aa, Homo Sapiens
GKLAARSPV

SEQ ID NO: 1085838 - protein, 9 aa, Homo Sapiens
GSCLFGFFI

SEQ ID NO: 1085839 - protein, 9 aa, Homo Sapiens
TFSPAHSST

SEQ ID NO: 1085840 - protein, 9 aa, Homo Sapiens
TSLALKINA

SEQ ID NO: 1085841 - protein, 9 aa, Homo Sapiens
GDFGLATEK

SEQ ID NO: 1085842 - protein, 9 aa, Homo Sapiens
DNMYDACIP

SEQ ID NO: 1085843 - protein, 9 aa, Homo Sapiens
PCTSSPVVS

SEQ ID NO: 1085844 - protein, 9 aa, Homo Sapiens
SHPVDTDEC

SEQ ID NO: 1085845 - protein, 9 aa, Homo Sapiens
VPQRAPLGE

SEQ ID NO: 1085846 - protein, 9 aa, Homo Sapiens
KLPWNSLLT

SEQ ID NO: 1085847 - protein, 9 aa, Homo Sapiens
NIDECASHP

SEQ ID NO: 1085848 - protein, 9 aa, Homo Sapiens
SEHSGLYSC

SEQ ID NO: 1085849 - protein, 9 aa, Homo Sapiens
LSSSLLQFV

SEQ ID NO: 1085850 - protein, 9 aa, Homo Sapiens
VETKALQDS

SEQ ID NO: 1085851 - protein, 9 aa, Homo Sapiens
EERARKERA

SEQ ID NO: 1085852 - protein, 9 aa, Homo Sapiens
DLMEEKSYV

SEQ ID NO: 1085853 - protein, 9 aa, Homo Sapiens
LMEEKSYVF

SEQ ID NO: 1085854 - protein, 9 aa, Homo Sapiens
SHLGMVKQV

SEQ ID NO: 1085855 - protein, 9 aa, Homo Sapiens
VLSNALLKS

SEQ ID NO: 1085856 - protein, 9 aa, Homo Sapiens
YGKYPGINS

SEQ ID NO: 1085857 - protein, 9 aa, Homo Sapiens
KGTQCEINI

SEQ ID NO: 1085858 - protein, 9 aa, Homo Sapiens
LITVFYIHI

SEQ ID NO: 1085859 - protein, 9 aa, Homo Sapiens
YSSGTVCLS

SEQ ID NO: 1085860 - protein, 9 aa, Homo Sapiens
ESTPPTWNK

SEQ ID NO: 1085861 - protein, 9 aa, Homo Sapiens
PFRGNPTQS

SEQ ID NO: 1085862 - protein, 9 aa, Homo Sapiens
LIRLFLAGY

SEQ ID NO: 1085863 - protein, 9 aa, Homo Sapiens
SQVFEEEGK

SEQ ID NO: 1085864 - protein, 9 aa, Homo Sapiens
CVLITLGDS

SEQ ID NO: 1085865 - protein, 9 aa, Homo Sapiens
APVKNEYAD

SEQ ID NO: 1085866 - protein, 9 aa, Homo Sapiens
WQCIECKFC

SEQ ID NO: 1085867 - protein, 9 aa, Homo Sapiens
KSRPGVYTK

SEQ ID NO: 1085868 - protein, 9 aa, Homo Sapiens
SWNRMIGEL

SEQ ID NO: 1085869 - protein, 9 aa, Homo Sapiens
FSPAHSSTP

SEQ ID NO: 1085870 - protein, 9 aa, Homo Sapiens
ALTSTDIWV

SEQ ID NO: 1085871 - protein, 9 aa, Homo Sapiens
SSHPPVQQV

SEQ ID NO: 1085872 - protein, 9 aa, Homo Sapiens
LPWNSLLTR

SEQ ID NO: 1085873 - protein, 9 aa, Homo Sapiens
FGLATEKSR

SEQ ID NO: 1085874 - protein, 9 aa, Homo Sapiens
VQLPSSGQH

SEQ ID NO: 1085875 - protein, 9 aa, Homo Sapiens
EAQSNLSGE

SEQ ID NO: 1085876 - protein, 9 aa, Homo Sapiens
VLSVNYTTI

SEQ ID NO: 1085877 - protein, 9 aa, Homo Sapiens
CCFEDCRTE

SEQ ID NO: 1085878 - protein, 9 aa, Homo Sapiens
HSDRRPYPC

SEQ ID NO: 1085879 - protein, 9 aa, Homo Sapiens
IFVLYLDTP

SEQ ID NO: 1085880 - protein, 9 aa, Homo Sapiens
PPNRSVNNV

SEQ ID NO: 1085881 - protein, 9 aa, Homo Sapiens
ERVLLVVFT

SEQ ID NO: 1085882 - protein, 9 aa, Homo Sapiens
HTDIRPLSG

SEQ ID NO: 1085883 - protein, 9 aa, Homo Sapiens
DSSVTTCWD

SEQ ID NO: 1085884 - protein, 9 aa, Homo Sapiens
LKYCQFPFQ

SEQ ID NO: 1085885 - protein, 9 aa, Homo Sapiens
TSMQGVINK

SEQ ID NO: 1085886 - protein, 9 aa, Homo Sapiens
QVQSLIINV

SEQ ID NO: 1085887 - protein, 9 aa, Homo Sapiens
PRCGIFAPP

SEQ ID NO: 1085888 - protein, 9 aa, Homo Sapiens
VFLVVNIVA

SEQ ID NO: 1085889 - protein, 9 aa, Homo Sapiens
AKKIFVTGG

SEQ ID NO: 1085890 - protein, 9 aa, Homo Sapiens
NMGVAIDCY

SEQ ID NO: 1085891 - protein, 9 aa, Homo Sapiens
RAARQGADF

SEQ ID NO: 1085892 - protein, 9 aa, Homo Sapiens
VEQEVSSSL

SEQ ID NO: 1085893 - protein, 9 aa, Homo Sapiens
RFYVTNLSR

SEQ ID NO: 1085894 - protein, 9 aa, Homo Sapiens
SLWQDLPEI

SEQ ID NO: 1085895 - protein, 9 aa, Homo Sapiens
RVKEFMIQD

SEQ ID NO: 1085896 - protein, 9 aa, Homo Sapiens
KSDYIVMPR

SEQ ID NO: 1085897 - protein, 9 aa, Homo Sapiens
AGSSQEVTC

SEQ ID NO: 1085898 - protein, 9 aa, Homo Sapiens
FFSSDGYGV

SEQ ID NO: 1085899 - protein, 9 aa, Homo Sapiens
PVVSSHPPV

SEQ ID NO: 1085900 - protein, 9 aa, Homo Sapiens
GFFILLPEI

SEQ ID NO: 1085901 - protein, 9 aa, Homo Sapiens
SPKKEAPKM

SEQ ID NO: 1085902 - protein, 9 aa, Homo Sapiens
PFTITPVFL

SEQ ID NO: 1085903 - protein, 9 aa, Homo Sapiens
KQEIINETF

SEQ ID NO: 1085904 - protein, 9 aa, Homo Sapiens
SLNHKLDSY

SEQ ID NO: 1085905 - protein, 9 aa, Homo Sapiens
SWQAPIGGD

SEQ ID NO: 1085906 - protein, 9 aa, Homo Sapiens
PLFHPNVYS

SEQ ID NO: 1085907 - protein, 9 aa, Homo Sapiens
KPPAAPVKN

SEQ ID NO: 1085908 - protein, 9 aa, Homo Sapiens
AQEHEVETK

SEQ ID NO: 1085909 - protein, 9 aa, Homo Sapiens
YAELLDATQ

SEQ ID NO: 1085910 - protein, 9 aa, Homo Sapiens
ATINPAADN

SEQ ID NO: 1085911 - protein, 9 aa, Homo Sapiens
QDTLSNIIT

SEQ ID NO: 1085912 - protein, 9 aa, Homo Sapiens
GSQSGTSSL

SEQ ID NO: 1085913 - protein, 9 aa, Homo Sapiens
RVIFKASAY

SEQ ID NO: 1085914 - protein, 9 aa, Homo Sapiens
STPPTWNKD

SEQ ID NO: 1085915 - protein, 9 aa, Homo Sapiens
QRAPLGERS

SEQ ID NO: 1085916 - protein, 9 aa, Homo Sapiens
EKSRWSGSH

SEQ ID NO: 1085917 - protein, 9 aa, Homo Sapiens
LSHLCSLIS

SEQ ID NO: 1085918 - protein, 9 aa, Homo Sapiens
TVESHRKSC

SEQ ID NO: 1085919 - protein, 9 aa, Homo Sapiens
GPGKLAARS

SEQ ID NO: 1085920 - protein, 9 aa, Homo Sapiens
MKNAIKKLC

SEQ ID NO: 1085921 - protein, 9 aa, Homo Sapiens
KINNDFNSE

SEQ ID NO: 1085922 - protein, 9 aa, Homo Sapiens
WPQNSTAIA

SEQ ID NO: 1085923 - protein, 9 aa, Homo Sapiens
ELAREIGLL

SEQ ID NO: 1085924 - protein, 9 aa, Homo Sapiens
LQSRQQLCS

SEQ ID NO: 1085925 - protein, 9 aa, Homo Sapiens
LDFPVHGME

SEQ ID NO: 1085926 - protein, 9 aa, Homo Sapiens
LTFPTRMDA

SEQ ID NO: 1085927 - protein, 9 aa, Homo Sapiens
GSSQEVTCA

SEQ ID NO: 1085928 - protein, 9 aa, Homo Sapiens
LFLMAVFFL

SEQ ID NO: 1085929 - protein, 9 aa, Homo Sapiens
ETLNAALTF

SEQ ID NO: 1085930 - protein, 9 aa, Homo Sapiens
VNSGETFSI

SEQ ID NO: 1085931 - protein, 9 aa, Homo Sapiens
VFDFRVDKI

SEQ ID NO: 1085932 - protein, 9 aa, Homo Sapiens
NTKLFSAVF

SEQ ID NO: 1085933 - protein, 9 aa, Homo Sapiens
LDETNRLAA

SEQ ID NO: 1085934 - protein, 9 aa, Homo Sapiens
KSQVFEEEG

SEQ ID NO: 1085935 - protein, 9 aa, Homo Sapiens
RATNSNWVV

SEQ ID NO: 1085936 - protein, 9 aa, Homo Sapiens
HALRARLAV

SEQ ID NO: 1085937 - protein, 9 aa, Homo Sapiens
AELLTLPYF

SEQ ID NO: 1085938 - protein, 9 aa, Homo Sapiens
EEGAPRPPQ

SEQ ID NO: 1085939 - protein, 9 aa, Homo Sapiens
GKGLLFYAG

SEQ ID NO: 1085940 - protein, 9 aa, Homo Sapiens
ALYDYIGSE

SEQ ID NO: 1085941 - protein, 9 aa, Homo Sapiens
EIVIYRVVT

SEQ ID NO: 1085942 - protein, 9 aa, Homo Sapiens
PRMGSPGPH

SEQ ID NO: 1085943 - protein, 9 aa, Homo Sapiens
SKFISDRKS

SEQ ID NO: 1085944 - protein, 9 aa, Homo Sapiens
KQELKQEII

SEQ ID NO: 1085945 - protein, 9 aa, Homo Sapiens
LRVFDFRVD

SEQ ID NO: 1085946 - protein, 9 aa, Homo Sapiens
LKRGDLDRP

SEQ ID NO: 1085947 - protein, 9 aa, Homo Sapiens
ESEAEERLH

SEQ ID NO: 1085948 - protein, 9 aa, Homo Sapiens
AYDCYVATC

SEQ ID NO: 1085949 - protein, 9 aa, Homo Sapiens
LSWQAPIGG

SEQ ID NO: 1085950 - protein, 9 aa, Homo Sapiens
MEAVRRAFC

SEQ ID NO: 1085951 - protein, 9 aa, Homo Sapiens
WQWIDQSFN

SEQ ID NO: 1085952 - protein, 9 aa, Homo Sapiens
SGEENRVQV

SEQ ID NO: 1085953 - protein, 9 aa, Homo Sapiens
SRPGVYTKV

SEQ ID NO: 1085954 - protein, 9 aa, Homo Sapiens
EQKDEGVYT

SEQ ID NO: 1085955 - protein, 9 aa, Homo Sapiens
TIECETSPA

SEQ ID NO: 1085956 - protein, 9 aa, Homo Sapiens
VLLVVFTRS

SEQ ID NO: 1085957 - protein, 9 aa, Homo Sapiens
TPLSLALGD

SEQ ID NO: 1085958 - protein, 9 aa, Homo Sapiens
GAVSTRVRW

SEQ ID NO: 1085959 - protein, 9 aa, Homo Sapiens
ARLAVPGRA

SEQ ID NO: 1085960 - protein, 9 aa, Homo Sapiens
SWPSPTEPN

SEQ ID NO: 1085961 - protein, 9 aa, Homo Sapiens
AWRFYVTNL

SEQ ID NO: 1085962 - protein, 9 aa, Homo Sapiens
YVVSTFAMV

SEQ ID NO: 1085963 - protein, 9 aa, Homo Sapiens
KKYKLYFWN

SEQ ID NO: 1085964 - protein, 9 aa, Homo Sapiens
WCANILGYV

SEQ ID NO: 1085965 - protein, 9 aa, Homo Sapiens
FSLTMLNPL

SEQ ID NO: 1085966 - protein, 9 aa, Homo Sapiens
HTTIMSSRI

SEQ ID NO: 1085967 - protein, 9 aa, Homo Sapiens
AQKSRPGVY

SEQ ID NO: 1085968 - protein, 9 aa, Homo Sapiens
STRTRESLL

SEQ ID NO: 1085969 - protein, 9 aa, Homo Sapiens
IIVGQSHLD

SEQ ID NO: 1085970 - protein, 9 aa, Homo Sapiens
ESLIEHLKV

SEQ ID NO: 1085971 - protein, 9 aa, Homo Sapiens
YVTNLSRTD

SEQ ID NO: 1085972 - protein, 9 aa, Homo Sapiens
AKKAGEIFS

SEQ ID NO: 1085973 - protein, 9 aa, Homo Sapiens
KDEGVYTCI

SEQ ID NO: 1085974 - protein, 9 aa, Homo Sapiens
PPSPRMGSP

SEQ ID NO: 1085975 - protein, 9 aa, Homo Sapiens
HHNADLKPI

SEQ ID NO: 1085976 - protein, 9 aa, Homo Sapiens
HHESCFVAQ

SEQ ID NO: 1085977 - protein, 9 aa, Homo Sapiens
QVFEEEGKE

SEQ ID NO: 1085978 - protein, 9 aa, Homo Sapiens
RPPGALGNF

SEQ ID NO: 1085979 - protein, 9 aa, Homo Sapiens
VMKLPWNSL

SEQ ID NO: 1085980 - protein, 9 aa, Homo Sapiens
DFNSEFYNS

SEQ ID NO: 1085981 - protein, 9 aa, Homo Sapiens
YVHDRRKMK

SEQ ID NO: 1085982 - protein, 9 aa, Homo Sapiens
VTVLRNVLI

SEQ ID NO: 1085983 - protein, 9 aa, Homo Sapiens
QIKAFGLSD

SEQ ID NO: 1085984 - protein, 9 aa, Homo Sapiens
IDQSFNAVV

SEQ ID NO: 1085985 - protein, 9 aa, Homo Sapiens
HESCFVAQA

SEQ ID NO: 1085986 - protein, 9 aa, Homo Sapiens
WNKDFLPDA

SEQ ID NO: 1085987 - protein, 9 aa, Homo Sapiens
FSSDGYGVD

SEQ ID NO: 1085988 - protein, 9 aa, Homo Sapiens
KAKKAGEIF

SEQ ID NO: 1085989 - protein, 9 aa, Homo Sapiens
LHQQQQQEP

SEQ ID NO: 1085990 - protein, 9 aa, Homo Sapiens
SSSLLQFVE

SEQ ID NO: 1085991 - protein, 9 aa, Homo Sapiens
ACIPQLWKR

SEQ ID NO: 1085992 - protein, 9 aa, Homo Sapiens
AHSSHPVDT

SEQ ID NO: 1085993 - protein, 9 aa, Homo Sapiens
SLKSMAVEE

SEQ ID NO: 1085994 - protein, 9 aa, Homo Sapiens
PQQESEAEE

SEQ ID NO: 1085995 - protein, 9 aa, Homo Sapiens
GESILIRLF

SEQ ID NO: 1085996 - protein, 9 aa, Homo Sapiens
LCSRRHPPT

SEQ ID NO: 1085997 - protein, 9 aa, Homo Sapiens
EEHIAKPLK

SEQ ID NO: 1085998 - protein, 9 aa, Homo Sapiens
SSDGYGVDQ

SEQ ID NO: 1085999 - protein, 9 aa, Homo Sapiens
ESTRTRESL

SEQ ID NO: 1086000 - protein, 9 aa, Homo Sapiens
FKGTQCEIN

SEQ ID NO: 1086001 - protein, 9 aa, Homo Sapiens
QLTSAALNR

SEQ ID NO: 1086002 - protein, 9 aa, Homo Sapiens
PSSTSGTTW

SEQ ID NO: 1086003 - protein, 9 aa, Homo Sapiens
PDFFKAPLA

SEQ ID NO: 1086004 - protein, 9 aa, Homo Sapiens
RPGLNGIKG

SEQ ID NO: 1086005 - protein, 9 aa, Homo Sapiens
CEINIDECA

SEQ ID NO: 1086006 - protein, 9 aa, Homo Sapiens
TRESLLDTT

SEQ ID NO: 1086007 - protein, 9 aa, Homo Sapiens
QALGRPPGA

SEQ ID NO: 1086008 - protein, 9 aa, Homo Sapiens
FYVHDRRKM

SEQ ID NO: 1086009 - protein, 9 aa, Homo Sapiens
SGSQSGTSS

SEQ ID NO: 1086010 - protein, 9 aa, Homo Sapiens
CVPVCCHCK

SEQ ID NO: 1086011 - protein, 9 aa, Homo Sapiens
LNGIKGDPG

SEQ ID NO: 1086012 - protein, 9 aa, Homo Sapiens
RSHLGMVKQ

SEQ ID NO: 1086013 - protein, 9 aa, Homo Sapiens
DDVGDYDDD

SEQ ID NO: 1086014 - protein, 9 aa, Homo Sapiens
VDSTVNIII

SEQ ID NO: 1086015 - protein, 9 aa, Homo Sapiens
CTDSHTDIR

SEQ ID NO: 1086016 - protein, 9 aa, Homo Sapiens
GPVNLAVLT

SEQ ID NO: 1086017 - protein, 9 aa, Homo Sapiens
SEFYNSTWS

SEQ ID NO: 1086018 - protein, 9 aa, Homo Sapiens
YCQFPFQRL

SEQ ID NO: 1086019 - protein, 9 aa, Homo Sapiens
RIVSKKYKL

SEQ ID NO: 1086020 - protein, 9 aa, Homo Sapiens
IQNLHCWPQ

SEQ ID NO: 1086021 - protein, 9 aa, Homo Sapiens
HHTTIMSSR

SEQ ID NO: 1086022 - protein, 9 aa, Homo Sapiens
YDDDHPGME

SEQ ID NO: 1086023 - protein, 9 aa, Homo Sapiens
TLGDSKAVL

SEQ ID NO: 1086024 - protein, 9 aa, Homo Sapiens
QRNYCSKNE

SEQ ID NO: 1086025 - protein, 9 aa, Homo Sapiens
QVTGHDHHN

SEQ ID NO: 1086026 - protein, 9 aa, Homo Sapiens
QLQSRQQLC

SEQ ID NO: 1086027 - protein, 9 aa, Homo Sapiens
FEDCRTESW

SEQ ID NO: 1086028 - protein, 9 aa, Homo Sapiens
VFFLIGSLI

SEQ ID NO: 1086029 - protein, 9 aa, Homo Sapiens
AGSCLFGFF

SEQ ID NO: 1086030 - protein, 9 aa, Homo Sapiens
WLPPNRSVN

SEQ ID NO: 1086031 - protein, 9 aa, Homo Sapiens
EQEEEEGSW

SEQ ID NO: 1086032 - protein, 9 aa, Homo Sapiens
VHHAAGQVG

SEQ ID NO: 1086033 - protein, 9 aa, Homo Sapiens
KNAIKKLCS

SEQ ID NO: 1086034 - protein, 9 aa, Homo Sapiens
LLKSSAPPI

SEQ ID NO: 1086035 - protein, 9 aa, Homo Sapiens
KYTYSVCSA

SEQ ID NO: 1086036 - protein, 9 aa, Homo Sapiens
IFSEKKYRQ

SEQ ID NO: 1086037 - protein, 9 aa, Homo Sapiens
FSFSGETVF

SEQ ID NO: 1086038 - protein, 9 aa, Homo Sapiens
TVMKLPWNS

SEQ ID NO: 1086039 - protein, 9 aa, Homo Sapiens
VFEIVIYRV

SEQ ID NO: 1086040 - protein, 9 aa, Homo Sapiens
VNIKLRAHR

SEQ ID NO: 1086041 - protein, 9 aa, Homo Sapiens
PNRSVNNVV

SEQ ID NO: 1086042 - protein, 9 aa, Homo Sapiens
CHLCPLPGS

SEQ ID NO: 1086043 - protein, 9 aa, Homo Sapiens
GRPPGALGN

SEQ ID NO: 1086044 - protein, 9 aa, Homo Sapiens
AVRAARQGA

SEQ ID NO: 1086045 - protein, 9 aa, Homo Sapiens
IITECCKLT

SEQ ID NO: 1086046 - protein, 9 aa, Homo Sapiens
SSPFRGNPT

SEQ ID NO: 1086047 - protein, 9 aa, Homo Sapiens
CSRRHPPTP

SEQ ID NO: 1086048 - protein, 9 aa, Homo Sapiens
NSGETFSIW

SEQ ID NO: 1086049 - protein, 9 aa, Homo Sapiens
REKIMKLTL

SEQ ID NO: 1086050 - protein, 9 aa, Homo Sapiens
RDNEIILSP

SEQ ID NO: 1086051 - protein, 9 aa, Homo Sapiens
NAQMKNAIK

SEQ ID NO: 1086052 - protein, 9 aa, Homo Sapiens
CLLHKGYKL

SEQ ID NO: 1086053 - protein, 9 aa, Homo Sapiens
GLVSIFFSQ

SEQ ID NO: 1086054 - protein, 9 aa, Homo Sapiens
SFCLLVVYL

SEQ ID NO: 1086055 - protein, 9 aa, Homo Sapiens
APRDASDSL

SEQ ID NO: 1086056 - protein, 9 aa, Homo Sapiens
ECEKTFSCQ

SEQ ID NO: 1086057 - protein, 9 aa, Homo Sapiens
VNLAVLTLS

SEQ ID NO: 1086058 - protein, 9 aa, Homo Sapiens
RKSCDTLDI

SEQ ID NO: 1086059 - protein, 9 aa, Homo Sapiens
SGAVSTRVR

SEQ ID NO: 1086060 - protein, 9 aa, Homo Sapiens
GPEGVLPSF

SEQ ID NO: 1086061 - protein, 9 aa, Homo Sapiens
SFSGETVFM

SEQ ID NO: 1086062 - protein, 9 aa, Homo Sapiens
SLKRGDLDR

SEQ ID NO: 1086063 - protein, 9 aa, Homo Sapiens
VPFVPVEFY

SEQ ID NO: 1086064 - protein, 9 aa, Homo Sapiens
ERATNSNWV

SEQ ID NO: 1086065 - protein, 9 aa, Homo Sapiens
VLYLDTPVV

SEQ ID NO: 1086066 - protein, 9 aa, Homo Sapiens
HNADLKPID

SEQ ID NO: 1086067 - protein, 9 aa, Homo Sapiens
SGETFSIWK

SEQ ID NO: 1086068 - protein, 9 aa, Homo Sapiens
YFSCSPRCG

SEQ ID NO: 1086069 - protein, 9 aa, Homo Sapiens
IQSAWRFYV

SEQ ID NO: 1086070 - protein, 9 aa, Homo Sapiens
TPSSTSGTT

SEQ ID NO: 1086071 - protein, 9 aa, Homo Sapiens
CAKYTYSVC

SEQ ID NO: 1086072 - protein, 9 aa, Homo Sapiens
DPVLRVFDF

SEQ ID NO: 1086073 - protein, 9 aa, Homo Sapiens
RARLAVPGR

SEQ ID NO: 1086074 - protein, 9 aa, Homo Sapiens
SPRMGSPGP

SEQ ID NO: 1086075 - protein, 9 aa, Homo Sapiens
KDDELSWQA

SEQ ID NO: 1086076 - protein, 9 aa, Homo Sapiens
ENPSEKIRS

SEQ ID NO: 1086077 - protein, 9 aa, Homo Sapiens
RAHRQESAI

SEQ ID NO: 1086078 - protein, 9 aa, Homo Sapiens
NKTPLPIDL

SEQ ID NO: 1086079 - protein, 9 aa, Homo Sapiens
LFPIKPVPS

SEQ ID NO: 1086080 - protein, 9 aa, Homo Sapiens
GTQCEINID

SEQ ID NO: 1086081 - protein, 9 aa, Homo Sapiens
QQDTLSNII

SEQ ID NO: 1086082 - protein, 9 aa, Homo Sapiens
LTLPYFSGQ

SEQ ID NO: 1086083 - protein, 9 aa, Homo Sapiens
KAFGLSDIT

SEQ ID NO: 1086084 - protein, 9 aa, Homo Sapiens
YLDTPVVKS

SEQ ID NO: 1086085 - protein, 9 aa, Homo Sapiens
KSCDTLDIS

SEQ ID NO: 1086086 - protein, 9 aa, Homo Sapiens
EFYYENMHA

SEQ ID NO: 1086087 - protein, 9 aa, Homo Sapiens
FFFSLTMLN

SEQ ID NO: 1086088 - protein, 9 aa, Homo Sapiens
PPNPNLPPS

SEQ ID NO: 1086089 - protein, 9 aa, Homo Sapiens
ESLLDTTNF

SEQ ID NO: 1086090 - protein, 9 aa, Homo Sapiens
YHTSPIIGQ

SEQ ID NO: 1086091 - protein, 9 aa, Homo Sapiens
GRLSGHPSS

SEQ ID NO: 1086092 - protein, 9 aa, Homo Sapiens
GSLKRGDLD

SEQ ID NO: 1086093 - protein, 9 aa, Homo Sapiens
LFWQWIDQS

SEQ ID NO: 1086094 - protein, 9 aa, Homo Sapiens
AHALRARLA

SEQ ID NO: 1086095 - protein, 9 aa, Homo Sapiens
GNPTQSPGY

SEQ ID NO: 1086096 - protein, 9 aa, Homo Sapiens
ESWREGRIH

SEQ ID NO: 1086097 - protein, 9 aa, Homo Sapiens
NPSDTFFSS

SEQ ID NO: 1086098 - protein, 9 aa, Homo Sapiens
QRGCCWNSQ

SEQ ID NO: 1086099 - protein, 9 aa, Homo Sapiens
NSKFISDRK

SEQ ID NO: 1086100 - protein, 9 aa, Homo Sapiens
HTVMKLPWN

SEQ ID NO: 1086101 - protein, 9 aa, Homo Sapiens
RHRLLPPAG

SEQ ID NO: 1086102 - protein, 9 aa, Homo Sapiens
VRPPQERVL

SEQ ID NO: 1086103 - protein, 9 aa, Homo Sapiens
ATEKSRWSG

SEQ ID NO: 1086104 - protein, 9 aa, Homo Sapiens
GPGPGKLAA

SEQ ID NO: 1086105 - protein, 9 aa, Homo Sapiens
ECKFCILCG

SEQ ID NO: 1086106 - protein, 9 aa, Homo Sapiens
VSGSSDISG

SEQ ID NO: 1086107 - protein, 9 aa, Homo Sapiens
DTLSNIITE

SEQ ID NO: 1086108 - protein, 9 aa, Homo Sapiens
PQERVLLVV

SEQ ID NO: 1086109 - protein, 9 aa, Homo Sapiens
SIFFSQRNT

SEQ ID NO: 1086110 - protein, 9 aa, Homo Sapiens
NHKLDSYAE

SEQ ID NO: 1086111 - protein, 9 aa, Homo Sapiens
GAPRPPQAP

SEQ ID NO: 1086112 - protein, 9 aa, Homo Sapiens
YGSRHRLLP

SEQ ID NO: 1086113 - protein, 9 aa, Homo Sapiens
SAALNRDNE

SEQ ID NO: 1086114 - protein, 9 aa, Homo Sapiens
CKPLHHTTI

SEQ ID NO: 1086115 - protein, 9 aa, Homo Sapiens
EPNSKTGNP

SEQ ID NO: 1086116 - protein, 9 aa, Homo Sapiens
QERVLLVVF

SEQ ID NO: 1086117 - protein, 9 aa, Homo Sapiens
IEHLKVHTK

SEQ ID NO: 1086118 - protein, 9 aa, Homo Sapiens
NGPYHTSPI

SEQ ID NO: 1086119 - protein, 9 aa, Homo Sapiens
LCSLISLHL

SEQ ID NO: 1086120 - protein, 9 aa, Homo Sapiens
RWCLFWASF

SEQ ID NO: 1086121 - protein, 9 aa, Homo Sapiens
NILGYVVST

SEQ ID NO: 1086122 - protein, 9 aa, Homo Sapiens
DRKSRRSLT

SEQ ID NO: 1086123 - protein, 9 aa, Homo Sapiens
KKVSLPNKA

SEQ ID NO: 1086124 - protein, 9 aa, Homo Sapiens
CFEDCRTES

SEQ ID NO: 1086125 - protein, 9 aa, Homo Sapiens
SLLDTTNFS

SEQ ID NO: 1086126 - protein, 9 aa, Homo Sapiens
LGYVVSTFA

SEQ ID NO: 1086127 - protein, 9 aa, Homo Sapiens
ANILGYVVS

SEQ ID NO: 1086128 - protein, 9 aa, Homo Sapiens
RRAFCVWEQ

SEQ ID NO: 1086129 - protein, 9 aa, Homo Sapiens
LPYFSGQFT

SEQ ID NO: 1086130 - protein, 9 aa, Homo Sapiens
KPLHHTTIM

SEQ ID NO: 1086131 - protein, 9 aa, Homo Sapiens
KNEYADAQL

SEQ ID NO: 1086132 - protein, 9 aa, Homo Sapiens
NQESSRVKE

SEQ ID NO: 1086133 - protein, 9 aa, Homo Sapiens
SMYLVTVLR

SEQ ID NO: 1086134 - protein, 9 aa, Homo Sapiens
TLSSSLLQF

SEQ ID NO: 1086135 - protein, 9 aa, Homo Sapiens
MLTMTRAME

SEQ ID NO: 1086136 - protein, 9 aa, Homo Sapiens
IVGQSHLDS

SEQ ID NO: 1086137 - protein, 9 aa, Homo Sapiens
ETLVGLVSI

SEQ ID NO: 1086138 - protein, 9 aa, Homo Sapiens
SSLLQFVEE

SEQ ID NO: 1086139 - protein, 9 aa, Homo Sapiens
APRPPQAPL

SEQ ID NO: 1086140 - protein, 9 aa, Homo Sapiens
QALDKLLKS

SEQ ID NO: 1086141 - protein, 9 aa, Homo Sapiens
IGDFGLATE

SEQ ID NO: 1086142 - protein, 9 aa, Homo Sapiens
LDIMLITVF

SEQ ID NO: 1086143 - protein, 9 aa, Homo Sapiens
RVFDFRVDK

SEQ ID NO: 1086144 - protein, 9 aa, Homo Sapiens
GDLDRPEDQ

SEQ ID NO: 1086145 - protein, 9 aa, Homo Sapiens
GGKGLLFYA

SEQ ID NO: 1086146 - protein, 9 aa, Homo Sapiens
QESEAEERL

SEQ ID NO: 1086147 - protein, 9 aa, Homo Sapiens
DKIQNLHCW

SEQ ID NO: 1086148 - protein, 9 aa, Homo Sapiens
VLWHDAENQ

SEQ ID NO: 1086149 - protein, 9 aa, Homo Sapiens
LIINVESQL

SEQ ID NO: 1086150 - protein, 9 aa, Homo Sapiens
CRTESWREG

SEQ ID NO: 1086151 - protein, 9 aa, Homo Sapiens
DCHLCPLPG

SEQ ID NO: 1086152 - protein, 9 aa, Homo Sapiens
EIEDITLDH

SEQ ID NO: 1086153 - protein, 9 aa, Homo Sapiens
QMKNAIKKL

SEQ ID NO: 1086154 - protein, 9 aa, Homo Sapiens
SVQLPSSGQ

SEQ ID NO: 1086155 - protein, 9 aa, Homo Sapiens
ELSWQAPIG

SEQ ID NO: 1086156 - protein, 9 aa, Homo Sapiens
VFDLMEEKS

SEQ ID NO: 1086157 - protein, 9 aa, Homo Sapiens
FCILCGTSE

SEQ ID NO: 1086158 - protein, 9 aa, Homo Sapiens
CQGFFFSLT

SEQ ID NO: 1086159 - protein, 9 aa, Homo Sapiens
SPAHSSTPP

SEQ ID NO: 1086160 - protein, 9 aa, Homo Sapiens
TLPYFSGQF

SEQ ID NO: 1086161 - protein, 9 aa, Homo Sapiens
TEEQKDEGV

SEQ ID NO: 1086162 - protein, 9 aa, Homo Sapiens
ILAVMAYDC

SEQ ID NO: 1086163 - protein, 9 aa, Homo Sapiens
TKLFSAVFV

SEQ ID NO: 1086164 - protein, 9 aa, Homo Sapiens
HQATRVIFK

SEQ ID NO: 1086165 - protein, 9 aa, Homo Sapiens
DQSFNAVVN

SEQ ID NO: 1086166 - protein, 9 aa, Homo Sapiens
HRQESAIFN

SEQ ID NO: 1086167 - protein, 9 aa, Homo Sapiens
LTLFSFSGE

SEQ ID NO: 1086168 - protein, 9 aa, Homo Sapiens
DLDRPEDQV

SEQ ID NO: 1086169 - protein, 9 aa, Homo Sapiens
ARQGADFTL

SEQ ID NO: 1086170 - protein, 9 aa, Homo Sapiens
SCQSALNVH

SEQ ID NO: 1086171 - protein, 9 aa, Homo Sapiens
NVSPKKEAP

SEQ ID NO: 1086172 - protein, 9 aa, Homo Sapiens
CKPKPIGEL

SEQ ID NO: 1086173 - protein, 9 aa, Homo Sapiens
PHKLQFTFT

SEQ ID NO: 1086174 - protein, 9 aa, Homo Sapiens
THLLIHSDR

SEQ ID NO: 1086175 - protein, 9 aa, Homo Sapiens
CYVATCCPL

SEQ ID NO: 1086176 - protein, 9 aa, Homo Sapiens
PGRPGLNGI

SEQ ID NO: 1086177 - protein, 9 aa, Homo Sapiens
AKYTYSVCS

SEQ ID NO: 1086178 - protein, 9 aa, Homo Sapiens
CGDDLFPIK

SEQ ID NO: 1086179 - protein, 9 aa, Homo Sapiens
KKAGEIFSE

SEQ ID NO: 1086180 - protein, 9 aa, Homo Sapiens
GKYPGINSD

SEQ ID NO: 1086181 - protein, 9 aa, Homo Sapiens
YSVCSALLD

SEQ ID NO: 1086182 - protein, 9 aa, Homo Sapiens
EEEHIAKPL

SEQ ID NO: 1086183 - protein, 9 aa, Homo Sapiens
SSQEVTCAQ

SEQ ID NO: 1086184 - protein, 9 aa, Homo Sapiens
VSSSLKSMA

SEQ ID NO: 1086185 - protein, 9 aa, Homo Sapiens
LTLPESLKA

SEQ ID NO: 1086186 - protein, 9 aa, Homo Sapiens
PKKEAPKML

SEQ ID NO: 1086187 - protein, 9 aa, Homo Sapiens
DSHTDIRPL

SEQ ID NO: 1086188 - protein, 9 aa, Homo Sapiens
LACLQEADH

SEQ ID NO: 1086189 - protein, 9 aa, Homo Sapiens
ALNRDNEII

SEQ ID NO: 1086190 - protein, 9 aa, Homo Sapiens
TLIFVLYLD

SEQ ID NO: 1086191 - protein, 9 aa, Homo Sapiens
LKRPKSQVF

SEQ ID NO: 1086192 - protein, 9 aa, Homo Sapiens
ASREWLPPN

SEQ ID NO: 1086193 - protein, 9 aa, Homo Sapiens
PGPGKLAAR

SEQ ID NO: 1086194 - protein, 9 aa, Homo Sapiens
IVVSRSHLG

SEQ ID NO: 1086195 - protein, 9 aa, Homo Sapiens
ETNRLAAQL

SEQ ID NO: 1086196 - protein, 9 aa, Homo Sapiens
QLKDDELSW

SEQ ID NO: 1086197 - protein, 9 aa, Homo Sapiens
GVAIDCYHQ

SEQ ID NO: 1086198 - protein, 9 aa, Homo Sapiens
SHTIPPTFS

SEQ ID NO: 1086199 - protein, 9 aa, Homo Sapiens
SGSSDISGD

SEQ ID NO: 1086200 - protein, 9 aa, Homo Sapiens
AAVFEIVIY

SEQ ID NO: 1086201 - protein, 9 aa, Homo Sapiens
CWNSQGAVS

SEQ ID NO: 1086202 - protein, 9 aa, Homo Sapiens
LPPNRSVNN

SEQ ID NO: 1086203 - protein, 9 aa, Homo Sapiens
KDTIFEAPP

SEQ ID NO: 1086204 - protein, 9 aa, Homo Sapiens
AEKDTIFEA

SEQ ID NO: 1086205 - protein, 9 aa, Homo Sapiens
FEEEGKEVE

SEQ ID NO: 1086206 - protein, 9 aa, Homo Sapiens
YKLYFWNII

SEQ ID NO: 1086207 - protein, 9 aa, Homo Sapiens
PGKLAARSP

SEQ ID NO: 1086208 - protein, 9 aa, Homo Sapiens
WGWLVLEAE

SEQ ID NO: 1086209 - protein, 9 aa, Homo Sapiens
ALDKLLKSE

SEQ ID NO: 1086210 - protein, 9 aa, Homo Sapiens
DYDDDHPGM

SEQ ID NO: 1086211 - protein, 9 aa, Homo Sapiens
PNSKTGNPR

SEQ ID NO: 1086212 - protein, 9 aa, Homo Sapiens
YKLSPDQFV

SEQ ID NO: 1086213 - protein, 9 aa, Homo Sapiens
VLRNVLIIL

SEQ ID NO: 1086214 - protein, 9 aa, Homo Sapiens
LLFYAGLSP

SEQ ID NO: 1086215 - protein, 9 aa, Homo Sapiens
AKPLKDVVM

SEQ ID NO: 1086216 - protein, 9 aa, Homo Sapiens
VHPQERMMK

SEQ ID NO: 1086217 - protein, 9 aa, Homo Sapiens
EVLSNALLK

SEQ ID NO: 1086218 - protein, 9 aa, Homo Sapiens
QSLACLQEA

SEQ ID NO: 1086219 - protein, 9 aa, Homo Sapiens
HKLDSYAEL

SEQ ID NO: 1086220 - protein, 9 aa, Homo Sapiens
QDMAEKDTI

SEQ ID NO: 1086221 - protein, 9 aa, Homo Sapiens
STRVRWCRP

SEQ ID NO: 1086222 - protein, 9 aa, Homo Sapiens
LGRPPGALG

SEQ ID NO: 1086223 - protein, 9 aa, Homo Sapiens
EQEKELWRE

SEQ ID NO: 1086224 - protein, 9 aa, Homo Sapiens
HTSPIIGQF

SEQ ID NO: 1086225 - protein, 9 aa, Homo Sapiens
LLQYDAEIE

SEQ ID NO: 1086226 - protein, 9 aa, Homo Sapiens
TPFQMRLVY

SEQ ID NO: 1086227 - protein, 9 aa, Homo Sapiens
DMAEKDTIF

SEQ ID NO: 1086228 - protein, 9 aa, Homo Sapiens
AGSLKRGDL

SEQ ID NO: 1086229 - protein, 9 aa, Homo Sapiens
TYSVCSALL

SEQ ID NO: 1086230 - protein, 9 aa, Homo Sapiens
KALQDSWLQ

SEQ ID NO: 1086231 - protein, 9 aa, Homo Sapiens
LYLDTPVVK

SEQ ID NO: 1086232 - protein, 9 aa, Homo Sapiens
DSTVNIIIV

SEQ ID NO: 1086233 - protein, 9 aa, Homo Sapiens
QEHEVETKA

SEQ ID NO: 1086234 - protein, 9 aa, Homo Sapiens
LREKIMKLT

SEQ ID NO: 1086235 - protein, 9 aa, Homo Sapiens
PTWNKDFLP

SEQ ID NO: 1086236 - protein, 9 aa, Homo Sapiens
KGLLFYAGL

SEQ ID NO: 1086237 - protein, 9 aa, Homo Sapiens
SMQGVINKT

SEQ ID NO: 1086238 - protein, 9 aa, Homo Sapiens
LQSHHESCF

SEQ ID NO: 1086239 - protein, 9 aa, Homo Sapiens
TSMIATINP

SEQ ID NO: 1086240 - protein, 9 aa, Homo Sapiens
LHKGYKLSP

SEQ ID NO: 1086241 - protein, 9 aa, Homo Sapiens
TQCEINIDE

SEQ ID NO: 1086242 - protein, 9 aa, Homo Sapiens
FRGNPTQSP

SEQ ID NO: 1086243 - protein, 9 aa, Homo Sapiens
DDDDVGDYD

SEQ ID NO: 1086244 - protein, 9 aa, Homo Sapiens
GSRHRLLPP

SEQ ID NO: 1086245 - protein, 9 aa, Homo Sapiens
PHSRFSLWQ

SEQ ID NO: 1086246 - protein, 9 aa, Homo Sapiens
VVSRSHLGM

SEQ ID NO: 1086247 - protein, 9 aa, Homo Sapiens
VLPSFPGSR

SEQ ID NO: 1086248 - protein, 9 aa, Homo Sapiens
ESHRKSCDT

SEQ ID NO: 1086249 - protein, 9 aa, Homo Sapiens
SGTTWILTE

SEQ ID NO: 1086250 - protein, 9 aa, Homo Sapiens
SPLETMTAQ

SEQ ID NO: 1086251 - protein, 9 aa, Homo Sapiens
AFCVWEQAT

SEQ ID NO: 1086252 - protein, 9 aa, Homo Sapiens
AIDCYHQLD

SEQ ID NO: 1086253 - protein, 9 aa, Homo Sapiens
LDTPVVKSS

SEQ ID NO: 1086254 - protein, 9 aa, Homo Sapiens
CWPQNSTAI

SEQ ID NO: 1086255 - protein, 9 aa, Homo Sapiens
YLAHSSHPV

SEQ ID NO: 1086256 - protein, 9 aa, Homo Sapiens
SHRKSCDTL

SEQ ID NO: 1086257 - protein, 9 aa, Homo Sapiens
ICQIKAFGL

SEQ ID NO: 1086258 - protein, 9 aa, Homo Sapiens
TFSCQSALN

SEQ ID NO: 1086259 - protein, 9 aa, Homo Sapiens
STTPLSLAL

SEQ ID NO: 1086260 - protein, 9 aa, Homo Sapiens
SAVFVLPTH

SEQ ID NO: 1086261 - protein, 9 aa, Homo Sapiens
INIDECASH

SEQ ID NO: 1086262 - protein, 9 aa, Homo Sapiens
PLPPSPRMG

SEQ ID NO: 1086263 - protein, 9 aa, Homo Sapiens
RPPQERVLL

SEQ ID NO: 1086264 - protein, 9 aa, Homo Sapiens
ISGDPNNEY

SEQ ID NO: 1086265 - protein, 9 aa, Homo Sapiens
SSGTVCLSI

SEQ ID NO: 1086266 - protein, 9 aa, Homo Sapiens
SQSGTSSLP

SEQ ID NO: 1086267 - protein, 9 aa, Homo Sapiens
FPIKPVPSG

SEQ ID NO: 1086268 - protein, 9 aa, Homo Sapiens
PQSVNSGET

SEQ ID NO: 1086269 - protein, 9 aa, Homo Sapiens
KIQNLHCWP

SEQ ID NO: 1086270 - protein, 9 aa, Homo Sapiens
TSPIIGQFS

SEQ ID NO: 1086271 - protein, 9 aa, Homo Sapiens
QQVTGHDHH

SEQ ID NO: 1086272 - protein, 9 aa, Homo Sapiens
EKTFSCQSA

SEQ ID NO: 1086273 - protein, 9 aa, Homo Sapiens
NPAADNYEE

SEQ ID NO: 1086274 - protein, 9 aa, Homo Sapiens
FFKAPLAYV

SEQ ID NO: 1086275 - protein, 9 aa, Homo Sapiens
PRPPQAPLP

SEQ ID NO: 1086276 - protein, 9 aa, Homo Sapiens
KKEAPKMLR

SEQ ID NO: 1086277 - protein, 9 aa, Homo Sapiens
RGCCWNSQG

SEQ ID NO: 1086278 - protein, 9 aa, Homo Sapiens
EKIRSQDVH

SEQ ID NO: 1086279 - protein, 9 aa, Homo Sapiens
LNAALTFPT

SEQ ID NO: 1086280 - protein, 9 aa, Homo Sapiens
TNRLAAQLE

SEQ ID NO: 1086281 - protein, 9 aa, Homo Sapiens
ITVFYIHIL

SEQ ID NO: 1086282 - protein, 9 aa, Homo Sapiens
IKLRAHRQE

SEQ ID NO: 1086283 - protein, 9 aa, Homo Sapiens
SATRERPPG

SEQ ID NO: 1086284 - protein, 9 aa, Homo Sapiens
CVVIAAVFE

SEQ ID NO: 1086285 - protein, 9 aa, Homo Sapiens
LKLIFYVHD

SEQ ID NO: 1086286 - protein, 9 aa, Homo Sapiens
SSDISGDPN

SEQ ID NO: 1086287 - protein, 9 aa, Homo Sapiens
TPPTWNKDF

SEQ ID NO: 1086288 - protein, 9 aa, Homo Sapiens
DSLAGAALE

SEQ ID NO: 1086289 - protein, 9 aa, Homo Sapiens
RKERARKHL

SEQ ID NO: 1086290 - protein, 9 aa, Homo Sapiens
SPFRGNPTQ

SEQ ID NO: 1086291 - protein, 9 aa, Homo Sapiens
AIKKLCSRK

SEQ ID NO: 1086292 - protein, 9 aa, Homo Sapiens
LKQEIINET

SEQ ID NO: 1086293 - protein, 9 aa, Homo Sapiens
SLPSVGRLS

SEQ ID NO: 1086294 - protein, 9 aa, Homo Sapiens
DCGDDLFPI

SEQ ID NO: 1086295 - protein, 9 aa, Homo Sapiens
KFCILCGTS

SEQ ID NO: 1086296 - protein, 9 aa, Homo Sapiens
IAKPLKDVV

SEQ ID NO: 1086297 - protein, 9 aa, Homo Sapiens
EALSHLCSL

SEQ ID NO: 1086298 - protein, 9 aa, Homo Sapiens
GLLFYAGLS

SEQ ID NO: 1086299 - protein, 9 aa, Homo Sapiens
SSPVVSSHP

SEQ ID NO: 1086300 - protein, 9 aa, Homo Sapiens
QHQATRVIF

SEQ ID NO: 1086301 - protein, 9 aa, Homo Sapiens
TKPKDSGVV

SEQ ID NO: 1086302 - protein, 9 aa, Homo Sapiens
VTGATTYRL

SEQ ID NO: 1086303 - protein, 9 aa, Homo Sapiens
EAPLKEAPA

SEQ ID NO: 1086304 - protein, 9 aa, Homo Sapiens
APAPEEESK

SEQ ID NO: 1086305 - protein, 9 aa, Homo Sapiens
MRSHIGYEL

SEQ ID NO: 1086306 - protein, 9 aa, Homo Sapiens
SSQLDGEAR

SEQ ID NO: 1086307 - protein, 9 aa, Homo Sapiens
SSSHAASSH

SEQ ID NO: 1086308 - protein, 9 aa, Homo Sapiens
IVKDKNRGP

SEQ ID NO: 1086309 - protein, 9 aa, Homo Sapiens
KGVQPKQVT

SEQ ID NO: 1086310 - protein, 9 aa, Homo Sapiens
EKIQKIRYR

SEQ ID NO: 1086311 - protein, 9 aa, Homo Sapiens
DYFLEDTTP

SEQ ID NO: 1086312 - protein, 9 aa, Homo Sapiens
ASSHGLVNS

SEQ ID NO: 1086313 - protein, 9 aa, Homo Sapiens
DVATTQSPT

SEQ ID NO: 1086314 - protein, 9 aa, Homo Sapiens
RLPLQNGRV

SEQ ID NO: 1086315 - protein, 9 aa, Homo Sapiens
TENMDKDEK

SEQ ID NO: 1086316 - protein, 9 aa, Homo Sapiens
AAPDPATRQ

SEQ ID NO: 1086317 - protein, 9 aa, Homo Sapiens
PHYFEEPDA

SEQ ID NO: 1086318 - protein, 9 aa, Homo Sapiens
VGVHEIRIE

SEQ ID NO: 1086319 - protein, 9 aa, Homo Sapiens
YFLLLKYRA

SEQ ID NO: 1086320 - protein, 9 aa, Homo Sapiens
RPRGAPPST

SEQ ID NO: 1086321 - protein, 9 aa, Homo Sapiens
SEEEFFRHI

SEQ ID NO: 1086322 - protein, 9 aa, Homo Sapiens
VQCSEQWIS

SEQ ID NO: 1086323 - protein, 9 aa, Homo Sapiens
LTVLFTLLH

SEQ ID NO: 1086324 - protein, 9 aa, Homo Sapiens
LDCNYYYKP

SEQ ID NO: 1086325 - protein, 9 aa, Homo Sapiens
AYPGISKLA

SEQ ID NO: 1086326 - protein, 9 aa, Homo Sapiens
TESLVPSSL

SEQ ID NO: 1086327 - protein, 9 aa, Homo Sapiens
LLQPLKGKN

SEQ ID NO: 1086328 - protein, 9 aa, Homo Sapiens
CNPCGLHFR

SEQ ID NO: 1086329 - protein, 9 aa, Homo Sapiens
YEAGTKPKD

SEQ ID NO: 1086330 - protein, 9 aa, Homo Sapiens
FLEGTKGGQ

SEQ ID NO: 1086331 - protein, 9 aa, Homo Sapiens
DETAQEFVD

SEQ ID NO: 1086332 - protein, 9 aa, Homo Sapiens
SARFEEALY

SEQ ID NO: 1086333 - protein, 9 aa, Homo Sapiens
LIQEQFYHQ

SEQ ID NO: 1086334 - protein, 9 aa, Homo Sapiens
GFSGLHGLN

SEQ ID NO: 1086335 - protein, 9 aa, Homo Sapiens
DKKTTVTDA

SEQ ID NO: 1086336 - protein, 9 aa, Homo Sapiens
SRQPPLASC

SEQ ID NO: 1086337 - protein, 9 aa, Homo Sapiens
FFLEVSFTT

SEQ ID NO: 1086338 - protein, 9 aa, Homo Sapiens
AVLQSMSGT

SEQ ID NO: 1086339 - protein, 9 aa, Homo Sapiens
TGTSVSAPI

SEQ ID NO: 1086340 - protein, 9 aa, Homo Sapiens
YGKNYKILE

SEQ ID NO: 1086341 - protein, 9 aa, Homo Sapiens
ALPKHVLIN

SEQ ID NO: 1086342 - protein, 9 aa, Homo Sapiens
VPTHRFSSF

SEQ ID NO: 1086343 - protein, 9 aa, Homo Sapiens
NILKWAANS

SEQ ID NO: 1086344 - protein, 9 aa, Homo Sapiens
GRIQLITEL

SEQ ID NO: 1086345 - protein, 9 aa, Homo Sapiens
RKIVNLSIP

SEQ ID NO: 1086346 - protein, 9 aa, Homo Sapiens
TGKGMDEME

SEQ ID NO: 1086347 - protein, 9 aa, Homo Sapiens
PAQAGEKPL

SEQ ID NO: 1086348 - protein, 9 aa, Homo Sapiens
SATIDFIVK

SEQ ID NO: 1086349 - protein, 9 aa, Homo Sapiens
VGLEEEEGE

SEQ ID NO: 1086350 - protein, 9 aa, Homo Sapiens
DKDEKWSFC

SEQ ID NO: 1086351 - protein, 9 aa, Homo Sapiens
TKDAVDAER

SEQ ID NO: 1086352 - protein, 9 aa, Homo Sapiens
SPTSEADEF

SEQ ID NO: 1086353 - protein, 9 aa, Homo Sapiens
QKLGKKTET

SEQ ID NO: 1086354 - protein, 9 aa, Homo Sapiens
LLVSMGHWL

SEQ ID NO: 1086355 - protein, 9 aa, Homo Sapiens
TTDVEKIQK

SEQ ID NO: 1086356 - protein, 9 aa, Homo Sapiens
RKVAELVYF

SEQ ID NO: 1086357 - protein, 9 aa, Homo Sapiens
WSFFQEQKC

SEQ ID NO: 1086358 - protein, 9 aa, Homo Sapiens
EGDLGNRHE

SEQ ID NO: 1086359 - protein, 9 aa, Homo Sapiens
FVPGGHNLY

SEQ ID NO: 1086360 - protein, 9 aa, Homo Sapiens
KITNTQAFR

SEQ ID NO: 1086361 - protein, 9 aa, Homo Sapiens
ISKCNKLKS

SEQ ID NO: 1086362 - protein, 9 aa, Homo Sapiens
EIRAPPDWV

SEQ ID NO: 1086363 - protein, 9 aa, Homo Sapiens
GKKTETTGG

SEQ ID NO: 1086364 - protein, 9 aa, Homo Sapiens
VGERFSLGV

SEQ ID NO: 1086365 - protein, 9 aa, Homo Sapiens
SPVVMAQIT

SEQ ID NO: 1086366 - protein, 9 aa, Homo Sapiens
YWCEVAPED

SEQ ID NO: 1086367 - protein, 9 aa, Homo Sapiens
KTSTTDVAT

SEQ ID NO: 1086368 - protein, 9 aa, Homo Sapiens
VLNILESTQ

SEQ ID NO: 1086369 - protein, 9 aa, Homo Sapiens
QKEIDSENI

SEQ ID NO: 1086370 - protein, 9 aa, Homo Sapiens
DKNSTAGES

SEQ ID NO: 1086371 - protein, 9 aa, Homo Sapiens
QHNRTTKNY

SEQ ID NO: 1086372 - protein, 9 aa, Homo Sapiens
EPGGAGGGG

SEQ ID NO: 1086373 - protein, 9 aa, Homo Sapiens
WLQHRETVT

SEQ ID NO: 1086374 - protein, 9 aa, Homo Sapiens
RLCAKFYAD

SEQ ID NO: 1086375 - protein, 9 aa, Homo Sapiens
SPPGVGLEE

SEQ ID NO: 1086376 - protein, 9 aa, Homo Sapiens
QPHSDAKVP

SEQ ID NO: 1086377 - protein, 9 aa, Homo Sapiens
WESVTSSIA

SEQ ID NO: 1086378 - protein, 9 aa, Homo Sapiens
RYGVSCVHD

SEQ ID NO: 1086379 - protein, 9 aa, Homo Sapiens
RDSKRFQIS

SEQ ID NO: 1086380 - protein, 9 aa, Homo Sapiens
TGAASKSFS

SEQ ID NO: 1086381 - protein, 9 aa, Homo Sapiens
ILESTQASL

SEQ ID NO: 1086382 - protein, 9 aa, Homo Sapiens
VFIQQGYAE

SEQ ID NO: 1086383 - protein, 9 aa, Homo Sapiens
NLEKAEEKT

SEQ ID NO: 1086384 - protein, 9 aa, Homo Sapiens
VNDKKKKKA

SEQ ID NO: 1086385 - protein, 9 aa, Homo Sapiens
LGGNEKQRK

SEQ ID NO: 1086386 - protein, 9 aa, Homo Sapiens
LESNSSPEL

SEQ ID NO: 1086387 - protein, 9 aa, Homo Sapiens
SLPRLLAMV

SEQ ID NO: 1086388 - protein, 9 aa, Homo Sapiens
GAKWNPRTR

SEQ ID NO: 1086389 - protein, 9 aa, Homo Sapiens
KGVLESYFQ

SEQ ID NO: 1086390 - protein, 9 aa, Homo Sapiens
RGCRLPFIS

SEQ ID NO: 1086391 - protein, 9 aa, Homo Sapiens
HHHHHLHHH

SEQ ID NO: 1086392 - protein, 9 aa, Homo Sapiens
LCGGTNIIK

SEQ ID NO: 1086393 - protein, 9 aa, Homo Sapiens
NLAGEEDRI

SEQ ID NO: 1086394 - protein, 9 aa, Homo Sapiens
SLVQLILFS

SEQ ID NO: 1086395 - protein, 9 aa, Homo Sapiens
SEYVSVPDY

SEQ ID NO: 1086396 - protein, 9 aa, Homo Sapiens
QLFQGDQIC

SEQ ID NO: 1086397 - protein, 9 aa, Homo Sapiens
LHLNVTAKA

SEQ ID NO: 1086398 - protein, 9 aa, Homo Sapiens
HWTSENSHE

SEQ ID NO: 1086399 - protein, 9 aa, Homo Sapiens
PSYILVVMS

SEQ ID NO: 1086400 - protein, 9 aa, Homo Sapiens
DMNSKQNDS

SEQ ID NO: 1086401 - protein, 9 aa, Homo Sapiens
REGLTPSNG

SEQ ID NO: 1086402 - protein, 9 aa, Homo Sapiens
EMEINFHEE

SEQ ID NO: 1086403 - protein, 9 aa, Homo Sapiens
PYIPPHAVL

SEQ ID NO: 1086404 - protein, 9 aa, Homo Sapiens
VFTTPERQT

SEQ ID NO: 1086405 - protein, 9 aa, Homo Sapiens
ICDVHVNSK

SEQ ID NO: 1086406 - protein, 9 aa, Homo Sapiens
WKHLVYKMP

SEQ ID NO: 1086407 - protein, 9 aa, Homo Sapiens
PLKEAPAEA

SEQ ID NO: 1086408 - protein, 9 aa, Homo Sapiens
KEEYSAMRD

SEQ ID NO: 1086409 - protein, 9 aa, Homo Sapiens
FTESKSKIS

SEQ ID NO: 1086410 - protein, 9 aa, Homo Sapiens
DDPFGASAT

SEQ ID NO: 1086411 - protein, 9 aa, Homo Sapiens
VDQEIPHLE

SEQ ID NO: 1086412 - protein, 9 aa, Homo Sapiens
LFQRSSQAL

SEQ ID NO: 1086413 - protein, 9 aa, Homo Sapiens
PSAEGGKEV

SEQ ID NO: 1086414 - protein, 9 aa, Homo Sapiens
TNLAGEEDR

SEQ ID NO: 1086415 - protein, 9 aa, Homo Sapiens
TLNFFIQFY

SEQ ID NO: 1086416 - protein, 9 aa, Homo Sapiens
TSQGPAQRS

SEQ ID NO: 1086417 - protein, 9 aa, Homo Sapiens
LAANKGYLP

SEQ ID NO: 1086418 - protein, 9 aa, Homo Sapiens
LLPILRKFI

SEQ ID NO: 1086419 - protein, 9 aa, Homo Sapiens
DVMVKFGAI

SEQ ID NO: 1086420 - protein, 9 aa, Homo Sapiens
HSRILFQRS

SEQ ID NO: 1086421 - protein, 9 aa, Homo Sapiens
IGFDRYVAI

SEQ ID NO: 1086422 - protein, 9 aa, Homo Sapiens
SYPAKSLVE

SEQ ID NO: 1086423 - protein, 9 aa, Homo Sapiens
CVIELGGIV

SEQ ID NO: 1086424 - protein, 9 aa, Homo Sapiens
FFERERTGL

SEQ ID NO: 1086425 - protein, 9 aa, Homo Sapiens
GRLPLQNGR

SEQ ID NO: 1086426 - protein, 9 aa, Homo Sapiens
DAINIRDVF

SEQ ID NO: 1086427 - protein, 9 aa, Homo Sapiens
LYNLRNKDV

SEQ ID NO: 1086428 - protein, 9 aa, Homo Sapiens
DAVFLDLFD

SEQ ID NO: 1086429 - protein, 9 aa, Homo Sapiens
TGLQLPNTL

SEQ ID NO: 1086430 - protein, 9 aa, Homo Sapiens
RETVTETEE

SEQ ID NO: 1086431 - protein, 9 aa, Homo Sapiens
SRETQTSEI

SEQ ID NO: 1086432 - protein, 9 aa, Homo Sapiens
LNPLLYNLR

SEQ ID NO: 1086433 - protein, 9 aa, Homo Sapiens
TGLCFGGQW

SEQ ID NO: 1086434 - protein, 9 aa, Homo Sapiens
FLGEPVFPQ

SEQ ID NO: 1086435 - protein, 9 aa, Homo Sapiens
PRSRQRISR

SEQ ID NO: 1086436 - protein, 9 aa, Homo Sapiens
CVQSSAGLN

SEQ ID NO: 1086437 - protein, 9 aa, Homo Sapiens
NNFSPKVEL

SEQ ID NO: 1086438 - protein, 9 aa, Homo Sapiens
KWNPRTRTI

SEQ ID NO: 1086439 - protein, 9 aa, Homo Sapiens
ENGMRLDVL

SEQ ID NO: 1086440 - protein, 9 aa, Homo Sapiens
KPWSNQTFS

SEQ ID NO: 1086441 - protein, 9 aa, Homo Sapiens
KQLAVNLTS

SEQ ID NO: 1086442 - protein, 9 aa, Homo Sapiens
PLSSPSPAS

SEQ ID NO: 1086443 - protein, 9 aa, Homo Sapiens
FEQDGISKT

SEQ ID NO: 1086444 - protein, 9 aa, Homo Sapiens
AQEFVDEFA

SEQ ID NO: 1086445 - protein, 9 aa, Homo Sapiens
LISSWGRTE

SEQ ID NO: 1086446 - protein, 9 aa, Homo Sapiens
LESLQIAFQ

SEQ ID NO: 1086447 - protein, 9 aa, Homo Sapiens
TYAAIEDKY

SEQ ID NO: 1086448 - protein, 9 aa, Homo Sapiens
EDLSSAFDH

SEQ ID NO: 1086449 - protein, 9 aa, Homo Sapiens
KMWIFSNLR

SEQ ID NO: 1086450 - protein, 9 aa, Homo Sapiens
YGLGETFDS

SEQ ID NO: 1086451 - protein, 9 aa, Homo Sapiens
KDEKWSFCA

SEQ ID NO: 1086452 - protein, 9 aa, Homo Sapiens
QPLKGKNIS

SEQ ID NO: 1086453 - protein, 9 aa, Homo Sapiens
ENALVDDVI

SEQ ID NO: 1086454 - protein, 9 aa, Homo Sapiens
LALRDFDRA

SEQ ID NO: 1086455 - protein, 9 aa, Homo Sapiens
VSVPDYFLE

SEQ ID NO: 1086456 - protein, 9 aa, Homo Sapiens
LGHINFYPN

SEQ ID NO: 1086457 - protein, 9 aa, Homo Sapiens
GDLGLISSW

SEQ ID NO: 1086458 - protein, 9 aa, Homo Sapiens
KPTCQISHL

SEQ ID NO: 1086459 - protein, 9 aa, Homo Sapiens
KSFSLLSAE

SEQ ID NO: 1086460 - protein, 9 aa, Homo Sapiens
PPEAPHSGK

SEQ ID NO: 1086461 - protein, 9 aa, Homo Sapiens
HWYTGKGMD

SEQ ID NO: 1086462 - protein, 9 aa, Homo Sapiens
EIPHLETPL

SEQ ID NO: 1086463 - protein, 9 aa, Homo Sapiens
SSWSNQTSG

SEQ ID NO: 1086464 - protein, 9 aa, Homo Sapiens
VQLLQDLDY

SEQ ID NO: 1086465 - protein, 9 aa, Homo Sapiens
TVNKEVFGQ

SEQ ID NO: 1086466 - protein, 9 aa, Homo Sapiens
GYLPVVQIL

SEQ ID NO: 1086467 - protein, 9 aa, Homo Sapiens
QAIFGSKDV

SEQ ID NO: 1086468 - protein, 9 aa, Homo Sapiens
GTRVPSEAP

SEQ ID NO: 1086469 - protein, 9 aa, Homo Sapiens
TQEELLANT

SEQ ID NO: 1086470 - protein, 9 aa, Homo Sapiens
PGGPHYILC

SEQ ID NO: 1086471 - protein, 9 aa, Homo Sapiens
RGYPENPGI

SEQ ID NO: 1086472 - protein, 9 aa, Homo Sapiens
LPPVSMVHG

SEQ ID NO: 1086473 - protein, 9 aa, Homo Sapiens
EIHGNLVMN

SEQ ID NO: 1086474 - protein, 9 aa, Homo Sapiens
MDEVLNILE

SEQ ID NO: 1086475 - protein, 9 aa, Homo Sapiens
QRGFFNLNR

SEQ ID NO: 1086476 - protein, 9 aa, Homo Sapiens
ATCDTCHFS

SEQ ID NO: 1086477 - protein, 9 aa, Homo Sapiens
SSTSSWSNQ

SEQ ID NO: 1086478 - protein, 9 aa, Homo Sapiens
SSGKELRVI

SEQ ID NO: 1086479 - protein, 9 aa, Homo Sapiens
SSAGLNGFN

SEQ ID NO: 1086480 - protein, 9 aa, Homo Sapiens
RFIDRATSL

SEQ ID NO: 1086481 - protein, 9 aa, Homo Sapiens
NDKKKKKAS

SEQ ID NO: 1086482 - protein, 9 aa, Homo Sapiens
GRLMPWVLD

SEQ ID NO: 1086483 - protein, 9 aa, Homo Sapiens
YAAIEDKYV

SEQ ID NO: 1086484 - protein, 9 aa, Homo Sapiens
PSSDSLDQL

SEQ ID NO: 1086485 - protein, 9 aa, Homo Sapiens
RPGRLPLQN

SEQ ID NO: 1086486 - protein, 9 aa, Homo Sapiens
FHSFINPGK

SEQ ID NO: 1086487 - protein, 9 aa, Homo Sapiens
LRVEILPTE

SEQ ID NO: 1086488 - protein, 9 aa, Homo Sapiens
KEIFENWLI

SEQ ID NO: 1086489 - protein, 9 aa, Homo Sapiens
NDSLLVVAG

SEQ ID NO: 1086490 - protein, 9 aa, Homo Sapiens
LEAIVAPKD

SEQ ID NO: 1086491 - protein, 9 aa, Homo Sapiens
SGYKTETPF

SEQ ID NO: 1086492 - protein, 9 aa, Homo Sapiens
SLGVGQVNA

SEQ ID NO: 1086493 - protein, 9 aa, Homo Sapiens
HCRVIGYSY

SEQ ID NO: 1086494 - protein, 9 aa, Homo Sapiens
DQICLRLHR

SEQ ID NO: 1086495 - protein, 9 aa, Homo Sapiens
QRTLDLNSP

SEQ ID NO: 1086496 - protein, 9 aa, Homo Sapiens
RFEEALYNS

SEQ ID NO: 1086497 - protein, 9 aa, Homo Sapiens
LEFLGNGNK

SEQ ID NO: 1086498 - protein, 9 aa, Homo Sapiens
SSHGLVNSH

SEQ ID NO: 1086499 - protein, 9 aa, Homo Sapiens
ARYSSQLDG

SEQ ID NO: 1086500 - protein, 9 aa, Homo Sapiens
LIFFEGCMT

SEQ ID NO: 1086501 - protein, 9 aa, Homo Sapiens
GTPVAQMTK

SEQ ID NO: 1086502 - protein, 9 aa, Homo Sapiens
SSRQPPLAS

SEQ ID NO: 1086503 - protein, 9 aa, Homo Sapiens
EIESPTDDH

SEQ ID NO: 1086504 - protein, 9 aa, Homo Sapiens
KCNKLKSQQ

SEQ ID NO: 1086505 - protein, 9 aa, Homo Sapiens
ERAEKAASM

SEQ ID NO: 1086506 - protein, 9 aa, Homo Sapiens
NLIQNSGLL

SEQ ID NO: 1086507 - protein, 9 aa, Homo Sapiens
HRIYTGEKP

SEQ ID NO: 1086508 - protein, 9 aa, Homo Sapiens
HSFINPGKI

SEQ ID NO: 1086509 - protein, 9 aa, Homo Sapiens
AFLFLGPMT

SEQ ID NO: 1086510 - protein, 9 aa, Homo Sapiens
KKKKASVMI

SEQ ID NO: 1086511 - protein, 9 aa, Homo Sapiens
EVGSGQLCY

SEQ ID NO: 1086512 - protein, 9 aa, Homo Sapiens
HVNSKTQLK

SEQ ID NO: 1086513 - protein, 9 aa, Homo Sapiens
RKGRIQLIT

SEQ ID NO: 1086514 - protein, 9 aa, Homo Sapiens
MAKYDLSAT

SEQ ID NO: 1086515 - protein, 9 aa, Homo Sapiens
GNGNKLEWE

SEQ ID NO: 1086516 - protein, 9 aa, Homo Sapiens
RLQTKSGEL

SEQ ID NO: 1086517 - protein, 9 aa, Homo Sapiens
EQTVVLQVQ

SEQ ID NO: 1086518 - protein, 9 aa, Homo Sapiens
NEGKEFPSC

SEQ ID NO: 1086519 - protein, 9 aa, Homo Sapiens
EVAPEDGQV

SEQ ID NO: 1086520 - protein, 9 aa, Homo Sapiens
MQKIVQTDK

SEQ ID NO: 1086521 - protein, 9 aa, Homo Sapiens
SYREEKAVS

SEQ ID NO: 1086522 - protein, 9 aa, Homo Sapiens
VISGYGLGE

SEQ ID NO: 1086523 - protein, 9 aa, Homo Sapiens
RNEETCKMA

SEQ ID NO: 1086524 - protein, 9 aa, Homo Sapiens
QAREVKREV

SEQ ID NO: 1086525 - protein, 9 aa, Homo Sapiens
NSKQNDSDC

SEQ ID NO: 1086526 - protein, 9 aa, Homo Sapiens
TSNVGDQET

SEQ ID NO: 1086527 - protein, 9 aa, Homo Sapiens
NFTQKEWAL

SEQ ID NO: 1086528 - protein, 9 aa, Homo Sapiens
TFFQVSELV

SEQ ID NO: 1086529 - protein, 9 aa, Homo Sapiens
KISSKIDAS

SEQ ID NO: 1086530 - protein, 9 aa, Homo Sapiens
KGYLPVVQI

SEQ ID NO: 1086531 - protein, 9 aa, Homo Sapiens
LGKMWIFSN

SEQ ID NO: 1086532 - protein, 9 aa, Homo Sapiens
FMNRTVSEI

SEQ ID NO: 1086533 - protein, 9 aa, Homo Sapiens
DVQALCDMV

SEQ ID NO: 1086534 - protein, 9 aa, Homo Sapiens
IELGGIVGD

SEQ ID NO: 1086535 - protein, 9 aa, Homo Sapiens
FQISWKHAT

SEQ ID NO: 1086536 - protein, 9 aa, Homo Sapiens
TKNYPNAGL

SEQ ID NO: 1086537 - protein, 9 aa, Homo Sapiens
EILPTESLV

SEQ ID NO: 1086538 - protein, 9 aa, Homo Sapiens
LAVILEISL

SEQ ID NO: 1086539 - protein, 9 aa, Homo Sapiens
AQAGEKPLG

SEQ ID NO: 1086540 - protein, 9 aa, Homo Sapiens
AAESQRKGS

SEQ ID NO: 1086541 - protein, 9 aa, Homo Sapiens
KYTCVATNL

SEQ ID NO: 1086542 - protein, 9 aa, Homo Sapiens
LLRPLSSTG

SEQ ID NO: 1086543 - protein, 9 aa, Homo Sapiens
LLVILNDEA

SEQ ID NO: 1086544 - protein, 9 aa, Homo Sapiens
DASRFLFPF

SEQ ID NO: 1086545 - protein, 9 aa, Homo Sapiens
HDDPFGASA

SEQ ID NO: 1086546 - protein, 9 aa, Homo Sapiens
LLKVRPIER

SEQ ID NO: 1086547 - protein, 9 aa, Homo Sapiens
MYFFLRNFF

SEQ ID NO: 1086548 - protein, 9 aa, Homo Sapiens
IFFVPGGHN

SEQ ID NO: 1086549 - protein, 9 aa, Homo Sapiens
EEEFFRHIP

SEQ ID NO: 1086550 - protein, 9 aa, Homo Sapiens
IQLITELGF

SEQ ID NO: 1086551 - protein, 9 aa, Homo Sapiens
EFTFLCDPW

SEQ ID NO: 1086552 - protein, 9 aa, Homo Sapiens
EDIAVDWIG

SEQ ID NO: 1086553 - protein, 9 aa, Homo Sapiens
FADDKNSTA

SEQ ID NO: 1086554 - protein, 9 aa, Homo Sapiens
ETVISYRCF

SEQ ID NO: 1086555 - protein, 9 aa, Homo Sapiens
RSLEEMSLQ

SEQ ID NO: 1086556 - protein, 9 aa, Homo Sapiens
PSSLRLHLK

SEQ ID NO: 1086557 - protein, 9 aa, Homo Sapiens
STRMSVKPV

SEQ ID NO: 1086558 - protein, 9 aa, Homo Sapiens
VSLNSQIKN

SEQ ID NO: 1086559 - protein, 9 aa, Homo Sapiens
FRLSLEETE

SEQ ID NO: 1086560 - protein, 9 aa, Homo Sapiens
RNWIKHARP

SEQ ID NO: 1086561 - protein, 9 aa, Homo Sapiens
SSDSLDQLA

SEQ ID NO: 1086562 - protein, 9 aa, Homo Sapiens
EVSNSKLVL

SEQ ID NO: 1086563 - protein, 9 aa, Homo Sapiens
CCPQNWLSE

SEQ ID NO: 1086564 - protein, 9 aa, Homo Sapiens
ILFLPMEGG

SEQ ID NO: 1086565 - protein, 9 aa, Homo Sapiens
GIKGVLESY

SEQ ID NO: 1086566 - protein, 9 aa, Homo Sapiens
KVPFCSKPT

SEQ ID NO: 1086567 - protein, 9 aa, Homo Sapiens
YCWATSFQQ

SEQ ID NO: 1086568 - protein, 9 aa, Homo Sapiens
RNEYGLRIG

SEQ ID NO: 1086569 - protein, 9 aa, Homo Sapiens
TNQAAGQEK

SEQ ID NO: 1086570 - protein, 9 aa, Homo Sapiens
IRPQFSWHD

SEQ ID NO: 1086571 - protein, 9 aa, Homo Sapiens
SCAIEVYKI

SEQ ID NO: 1086572 - protein, 9 aa, Homo Sapiens
IQEREKQFQ

SEQ ID NO: 1086573 - protein, 9 aa, Homo Sapiens
LYATVFSVS

SEQ ID NO: 1086574 - protein, 9 aa, Homo Sapiens
EKPHWTSEN

SEQ ID NO: 1086575 - protein, 9 aa, Homo Sapiens
LKSQQENQR

SEQ ID NO: 1086576 - protein, 9 aa, Homo Sapiens
PATRQNGPR

SEQ ID NO: 1086577 - protein, 9 aa, Homo Sapiens
KAARLVLTQ

SEQ ID NO: 1086578 - protein, 9 aa, Homo Sapiens
LLNSPASAA

SEQ ID NO: 1086579 - protein, 9 aa, Homo Sapiens
RDVQALCDM

SEQ ID NO: 1086580 - protein, 9 aa, Homo Sapiens
LVERLENDS

SEQ ID NO: 1086581 - protein, 9 aa, Homo Sapiens
VFDVNDNAP

SEQ ID NO: 1086582 - protein, 9 aa, Homo Sapiens
TTAELRSEI

SEQ ID NO: 1086583 - protein, 9 aa, Homo Sapiens
LKDTDPFAC

SEQ ID NO: 1086584 - protein, 9 aa, Homo Sapiens
KIRYRSKLK

SEQ ID NO: 1086585 - protein, 9 aa, Homo Sapiens
TFLCDPWNW

SEQ ID NO: 1086586 - protein, 9 aa, Homo Sapiens
EEMSLQRGF

SEQ ID NO: 1086587 - protein, 9 aa, Homo Sapiens
GPEDDLDLE

SEQ ID NO: 1086588 - protein, 9 aa, Homo Sapiens
KTETPFSPE

SEQ ID NO: 1086589 - protein, 9 aa, Homo Sapiens
ETDGKKLRI

SEQ ID NO: 1086590 - protein, 9 aa, Homo Sapiens
LAFQAVDKC

SEQ ID NO: 1086591 - protein, 9 aa, Homo Sapiens
LDLEPFSLP

SEQ ID NO: 1086592 - protein, 9 aa, Homo Sapiens
CQECPSCPS

SEQ ID NO: 1086593 - protein, 9 aa, Homo Sapiens
IVSQKPAGT

SEQ ID NO: 1086594 - protein, 9 aa, Homo Sapiens
VYVMRTLAS

SEQ ID NO: 1086595 - protein, 9 aa, Homo Sapiens
RETGIFFVT

SEQ ID NO: 1086596 - protein, 9 aa, Homo Sapiens
SVLMIFPQL

SEQ ID NO: 1086597 - protein, 9 aa, Homo Sapiens
SSMEMEDAL

SEQ ID NO: 1086598 - protein, 9 aa, Homo Sapiens
PAKSFTEIS

SEQ ID NO: 1086599 - protein, 9 aa, Homo Sapiens
TVFETAFGM

SEQ ID NO: 1086600 - protein, 9 aa, Homo Sapiens
VSVQWETVF

SEQ ID NO: 1086601 - protein, 9 aa, Homo Sapiens
KLRKKEQKQ

SEQ ID NO: 1086602 - protein, 9 aa, Homo Sapiens
VSAPIVAGI

SEQ ID NO: 1086603 - protein, 9 aa, Homo Sapiens
YSNRNVCLF

SEQ ID NO: 1086604 - protein, 9 aa, Homo Sapiens
APIVAGIIA

SEQ ID NO: 1086605 - protein, 9 aa, Homo Sapiens
PLHPERLSP

SEQ ID NO: 1086606 - protein, 9 aa, Homo Sapiens
FEMEINFHE

SEQ ID NO: 1086607 - protein, 9 aa, Homo Sapiens
LFLPMEGGD

SEQ ID NO: 1086608 - protein, 9 aa, Homo Sapiens
WCEVAPEDG

SEQ ID NO: 1086609 - protein, 9 aa, Homo Sapiens
MLPEEDPTW

SEQ ID NO: 1086610 - protein, 9 aa, Homo Sapiens
LHSEEKPHW

SEQ ID NO: 1086611 - protein, 9 aa, Homo Sapiens
LGNRHEPRE

SEQ ID NO: 1086612 - protein, 9 aa, Homo Sapiens
YNLRNKDVK

SEQ ID NO: 1086613 - protein, 9 aa, Homo Sapiens
GGPHYILCW

SEQ ID NO: 1086614 - protein, 9 aa, Homo Sapiens
TCISYIIVV

SEQ ID NO: 1086615 - protein, 9 aa, Homo Sapiens
LIEGQRCNV

SEQ ID NO: 1086616 - protein, 9 aa, Homo Sapiens
LGGTKALLL

SEQ ID NO: 1086617 - protein, 9 aa, Homo Sapiens
VVPTHRFSS

SEQ ID NO: 1086618 - protein, 9 aa, Homo Sapiens
SYIIVVVLF

SEQ ID NO: 1086619 - protein, 9 aa, Homo Sapiens
DTEDWVRLA

SEQ ID NO: 1086620 - protein, 9 aa, Homo Sapiens
TDVEKIQKI

SEQ ID NO: 1086621 - protein, 9 aa, Homo Sapiens
HEIRIEFIN

SEQ ID NO: 1086622 - protein, 9 aa, Homo Sapiens
VLECSLKFV

SEQ ID NO: 1086623 - protein, 9 aa, Homo Sapiens
KEWALLGPS

SEQ ID NO: 1086624 - protein, 9 aa, Homo Sapiens
RTPSRTVFF

SEQ ID NO: 1086625 - protein, 9 aa, Homo Sapiens
PFQRCSCFL

SEQ ID NO: 1086626 - protein, 9 aa, Homo Sapiens
EYGLRIGGN

SEQ ID NO: 1086627 - protein, 9 aa, Homo Sapiens
ELTSNVGDQ

SEQ ID NO: 1086628 - protein, 9 aa, Homo Sapiens
TDVATTQSP

SEQ ID NO: 1086629 - protein, 9 aa, Homo Sapiens
CKKSGGKYN

SEQ ID NO: 1086630 - protein, 9 aa, Homo Sapiens
PDLVYVMRT

SEQ ID NO: 1086631 - protein, 9 aa, Homo Sapiens
WIILSLTWF

SEQ ID NO: 1086632 - protein, 9 aa, Homo Sapiens
CWATSFQQH

SEQ ID NO: 1086633 - protein, 9 aa, Homo Sapiens
PGYQLLRCR

SEQ ID NO: 1086634 - protein, 9 aa, Homo Sapiens
QISSGKELR

SEQ ID NO: 1086635 - protein, 9 aa, Homo Sapiens
GYPENPGIL

SEQ ID NO: 1086636 - protein, 9 aa, Homo Sapiens
QSAWLTMLP

SEQ ID NO: 1086637 - protein, 9 aa, Homo Sapiens
LAASTSFLG

SEQ ID NO: 1086638 - protein, 9 aa, Homo Sapiens
VRDLYEIFL

SEQ ID NO: 1086639 - protein, 9 aa, Homo Sapiens
RRCDTQNKD

SEQ ID NO: 1086640 - protein, 9 aa, Homo Sapiens
FGSKDVGSS

SEQ ID NO: 1086641 - protein, 9 aa, Homo Sapiens
KFTPPKSKK

SEQ ID NO: 1086642 - protein, 9 aa, Homo Sapiens
DTCHFSILG

SEQ ID NO: 1086643 - protein, 9 aa, Homo Sapiens
EVAILNTSV

SEQ ID NO: 1086644 - protein, 9 aa, Homo Sapiens
YDSSDEPIA

SEQ ID NO: 1086645 - protein, 9 aa, Homo Sapiens
KKKQQEGAV

SEQ ID NO: 1086646 - protein, 9 aa, Homo Sapiens
SVPDYFLED

SEQ ID NO: 1086647 - protein, 9 aa, Homo Sapiens
HYFEEPDAF

SEQ ID NO: 1086648 - protein, 9 aa, Homo Sapiens
VILHFVPCI

SEQ ID NO: 1086649 - protein, 9 aa, Homo Sapiens
DILDTAGKE

SEQ ID NO: 1086650 - protein, 9 aa, Homo Sapiens
DSAKCTEEE

SEQ ID NO: 1086651 - protein, 9 aa, Homo Sapiens
LPMEGGDSG

SEQ ID NO: 1086652 - protein, 9 aa, Homo Sapiens
KPALVLMKL

SEQ ID NO: 1086653 - protein, 9 aa, Homo Sapiens
STPAGYLEL

SEQ ID NO: 1086654 - protein, 9 aa, Homo Sapiens
CGGTNIIKL

SEQ ID NO: 1086655 - protein, 9 aa, Homo Sapiens
LKAKAPLET

SEQ ID NO: 1086656 - protein, 9 aa, Homo Sapiens
FTEISTDFD

SEQ ID NO: 1086657 - protein, 9 aa, Homo Sapiens
RSPPGVGLE

SEQ ID NO: 1086658 - protein, 9 aa, Homo Sapiens
VQPKQVTCH

SEQ ID NO: 1086659 - protein, 9 aa, Homo Sapiens
PPSYILVVM

SEQ ID NO: 1086660 - protein, 9 aa, Homo Sapiens
IKFSNLIQN

SEQ ID NO: 1086661 - protein, 9 aa, Homo Sapiens
PPKFPAEPP

SEQ ID NO: 1086662 - protein, 9 aa, Homo Sapiens
GSHRLNRAE

SEQ ID NO: 1086663 - protein, 9 aa, Homo Sapiens
HSYPAKSLV

SEQ ID NO: 1086664 - protein, 9 aa, Homo Sapiens
EEKLRKKEQ

SEQ ID NO: 1086665 - protein, 9 aa, Homo Sapiens
VVSQNRLAE

SEQ ID NO: 1086666 - protein, 9 aa, Homo Sapiens
ETSLSSAIK

SEQ ID NO: 1086667 - protein, 9 aa, Homo Sapiens
TRVPSEAPG

SEQ ID NO: 1086668 - protein, 9 aa, Homo Sapiens
GTSVSAPIV

SEQ ID NO: 1086669 - protein, 9 aa, Homo Sapiens
RSLPGLAPC

SEQ ID NO: 1086670 - protein, 9 aa, Homo Sapiens
ISRVLSAQR

SEQ ID NO: 1086671 - protein, 9 aa, Homo Sapiens
VGFISWAGT

SEQ ID NO: 1086672 - protein, 9 aa, Homo Sapiens
QKRQNLGSV

SEQ ID NO: 1086673 - protein, 9 aa, Homo Sapiens
QYLCVQSSA

SEQ ID NO: 1086674 - protein, 9 aa, Homo Sapiens
PEEESKQTE

SEQ ID NO: 1086675 - protein, 9 aa, Homo Sapiens
PNALTVTAQ

SEQ ID NO: 1086676 - protein, 9 aa, Homo Sapiens
ALAAPAPAP

SEQ ID NO: 1086677 - protein, 9 aa, Homo Sapiens
RITGTSSRR

SEQ ID NO: 1086678 - protein, 9 aa, Homo Sapiens
SRLHLPGVM

SEQ ID NO: 1086679 - protein, 9 aa, Homo Sapiens
NKLKEVVSQ

SEQ ID NO: 1086680 - protein, 9 aa, Homo Sapiens
FCSKPTSAS

SEQ ID NO: 1086681 - protein, 9 aa, Homo Sapiens
KILENLCGG

SEQ ID NO: 1086682 - protein, 9 aa, Homo Sapiens
QTDKITNTQ

SEQ ID NO: 1086683 - protein, 9 aa, Homo Sapiens
LPKHVLINW

SEQ ID NO: 1086684 - protein, 9 aa, Homo Sapiens
LVQLILFSR

SEQ ID NO: 1086685 - protein, 9 aa, Homo Sapiens
EFPSCAIEV

SEQ ID NO: 1086686 - protein, 9 aa, Homo Sapiens
PSLVQLILF

SEQ ID NO: 1086687 - protein, 9 aa, Homo Sapiens
ELAAVFTTP

SEQ ID NO: 1086688 - protein, 9 aa, Homo Sapiens
SFFLDKVVS

SEQ ID NO: 1086689 - protein, 9 aa, Homo Sapiens
DWVKAVASV

SEQ ID NO: 1086690 - protein, 9 aa, Homo Sapiens
GNLVMNACV

SEQ ID NO: 1086691 - protein, 9 aa, Homo Sapiens
CAKFYADPV

SEQ ID NO: 1086692 - protein, 9 aa, Homo Sapiens
PRARRAYRP

SEQ ID NO: 1086693 - protein, 9 aa, Homo Sapiens
QTREFISLP

SEQ ID NO: 1086694 - protein, 9 aa, Homo Sapiens
SAPIVAGII

SEQ ID NO: 1086695 - protein, 9 aa, Homo Sapiens
LSSPSPASG

SEQ ID NO: 1086696 - protein, 9 aa, Homo Sapiens
PRVLEIIDF

SEQ ID NO: 1086697 - protein, 9 aa, Homo Sapiens
SQQQQQQGL

SEQ ID NO: 1086698 - protein, 9 aa, Homo Sapiens
RQPPLASCS

SEQ ID NO: 1086699 - protein, 9 aa, Homo Sapiens
GQLIFFEGC

SEQ ID NO: 1086700 - protein, 9 aa, Homo Sapiens
VLSAQRSPE

SEQ ID NO: 1086701 - protein, 9 aa, Homo Sapiens
DLEPFSLPE

SEQ ID NO: 1086702 - protein, 9 aa, Homo Sapiens
SRTVFFERE

SEQ ID NO: 1086703 - protein, 9 aa, Homo Sapiens
FLGPMTLLL

SEQ ID NO: 1086704 - protein, 9 aa, Homo Sapiens
FEEPDAFNP

SEQ ID NO: 1086705 - protein, 9 aa, Homo Sapiens
WWIILSLTW

SEQ ID NO: 1086706 - protein, 9 aa, Homo Sapiens
EKVACCSLE

SEQ ID NO: 1086707 - protein, 9 aa, Homo Sapiens
IFAAETVAA

SEQ ID NO: 1086708 - protein, 9 aa, Homo Sapiens
FWRSSLLDV

SEQ ID NO: 1086709 - protein, 9 aa, Homo Sapiens
EQYYDSSDE

SEQ ID NO: 1086710 - protein, 9 aa, Homo Sapiens
SMIYPKEVP

SEQ ID NO: 1086711 - protein, 9 aa, Homo Sapiens
YQSAWLTML

SEQ ID NO: 1086712 - protein, 9 aa, Homo Sapiens
KHLVYKMPI

SEQ ID NO: 1086713 - protein, 9 aa, Homo Sapiens
LITELGFWT

SEQ ID NO: 1086714 - protein, 9 aa, Homo Sapiens
VLMIFPQLG

SEQ ID NO: 1086715 - protein, 9 aa, Homo Sapiens
PRHQVLEGL

SEQ ID NO: 1086716 - protein, 9 aa, Homo Sapiens
IKGVLESYF

SEQ ID NO: 1086717 - protein, 9 aa, Homo Sapiens
TLNTLIYAN

SEQ ID NO: 1086718 - protein, 9 aa, Homo Sapiens
FSNLIQNSG

SEQ ID NO: 1086719 - protein, 9 aa, Homo Sapiens
LDLCLLEDE

SEQ ID NO: 1086720 - protein, 9 aa, Homo Sapiens
CFLLAAIGF

SEQ ID NO: 1086721 - protein, 9 aa, Homo Sapiens
RSYREEKAV

SEQ ID NO: 1086722 - protein, 9 aa, Homo Sapiens
VVLNNDGLS

SEQ ID NO: 1086723 - protein, 9 aa, Homo Sapiens
PPRSITLRK

SEQ ID NO: 1086724 - protein, 9 aa, Homo Sapiens
TCKEIFNMY

SEQ ID NO: 1086725 - protein, 9 aa, Homo Sapiens
QNSGLLSVI

SEQ ID NO: 1086726 - protein, 9 aa, Homo Sapiens
APSEMPGNE

SEQ ID NO: 1086727 - protein, 9 aa, Homo Sapiens
NRTTKNYPN

SEQ ID NO: 1086728 - protein, 9 aa, Homo Sapiens
KLVLEAVKI

SEQ ID NO: 1086729 - protein, 9 aa, Homo Sapiens
KKTETTGGA

SEQ ID NO: 1086730 - protein, 9 aa, Homo Sapiens
DSSRDSYFS

SEQ ID NO: 1086731 - protein, 9 aa, Homo Sapiens
KYKMRVAAL

SEQ ID NO: 1086732 - protein, 9 aa, Homo Sapiens
RAPPEAPHS

SEQ ID NO: 1086733 - protein, 9 aa, Homo Sapiens
EIGKTLAKK

SEQ ID NO: 1086734 - protein, 9 aa, Homo Sapiens
YSSTSSWSN

SEQ ID NO: 1086735 - protein, 9 aa, Homo Sapiens
LLNPLLYNL

SEQ ID NO: 1086736 - protein, 9 aa, Homo Sapiens
QQHVRIHNG

SEQ ID NO: 1086737 - protein, 9 aa, Homo Sapiens
PPHAVLCLE

SEQ ID NO: 1086738 - protein, 9 aa, Homo Sapiens
RAYRPRDQA

SEQ ID NO: 1086739 - protein, 9 aa, Homo Sapiens
RERRYGVSC

SEQ ID NO: 1086740 - protein, 9 aa, Homo Sapiens
YNLNSGAVK

SEQ ID NO: 1086741 - protein, 9 aa, Homo Sapiens
MLVGERFSL

SEQ ID NO: 1086742 - protein, 9 aa, Homo Sapiens
AVILEISLR

SEQ ID NO: 1086743 - protein, 9 aa, Homo Sapiens
TEVICSQGG

SEQ ID NO: 1086744 - protein, 9 aa, Homo Sapiens
LAAVTEVIC

SEQ ID NO: 1086745 - protein, 9 aa, Homo Sapiens
DENKDVSME

SEQ ID NO: 1086746 - protein, 9 aa, Homo Sapiens
EWVHWHKGR

SEQ ID NO: 1086747 - protein, 9 aa, Homo Sapiens
EVKILENLC

SEQ ID NO: 1086748 - protein, 9 aa, Homo Sapiens
LQTKSGELS

SEQ ID NO: 1086749 - protein, 9 aa, Homo Sapiens
GLCFGGQWA

SEQ ID NO: 1086750 - protein, 9 aa, Homo Sapiens
QEKKGKAGN

SEQ ID NO: 1086751 - protein, 9 aa, Homo Sapiens
YTGKGMDEM

SEQ ID NO: 1086752 - protein, 9 aa, Homo Sapiens
PFLKKILYA

SEQ ID NO: 1086753 - protein, 9 aa, Homo Sapiens
AWLTMLPEE

SEQ ID NO: 1086754 - protein, 9 aa, Homo Sapiens
HNRTTKNYP

SEQ ID NO: 1086755 - protein, 9 aa, Homo Sapiens
RPRHQVLEG

SEQ ID NO: 1086756 - protein, 9 aa, Homo Sapiens
PHQHNRTTK

SEQ ID NO: 1086757 - protein, 9 aa, Homo Sapiens
VIGSSLGSS

SEQ ID NO: 1086758 - protein, 9 aa, Homo Sapiens
GLVISGYGL

SEQ ID NO: 1086759 - protein, 9 aa, Homo Sapiens
FPAAIDFFQ

SEQ ID NO: 1086760 - protein, 9 aa, Homo Sapiens
YIRFYMELP

SEQ ID NO: 1086761 - protein, 9 aa, Homo Sapiens
ISRLHLPGV

SEQ ID NO: 1086762 - protein, 9 aa, Homo Sapiens
FQQHVRIHN

SEQ ID NO: 1086763 - protein, 9 aa, Homo Sapiens
QAASMIYPK

SEQ ID NO: 1086764 - protein, 9 aa, Homo Sapiens
PGRPRSKQE

SEQ ID NO: 1086765 - protein, 9 aa, Homo Sapiens
KAPLETSPG

SEQ ID NO: 1086766 - protein, 9 aa, Homo Sapiens
VFLGEPVFP

SEQ ID NO: 1086767 - protein, 9 aa, Homo Sapiens
QGKEIFENW

SEQ ID NO: 1086768 - protein, 9 aa, Homo Sapiens
KQLSDVSSE

SEQ ID NO: 1086769 - protein, 9 aa, Homo Sapiens
NLCGGTNII

SEQ ID NO: 1086770 - protein, 9 aa, Homo Sapiens
SKTQLKQHI

SEQ ID NO: 1086771 - protein, 9 aa, Homo Sapiens
IVAPKDVGE

SEQ ID NO: 1086772 - protein, 9 aa, Homo Sapiens
MEINFHEEW

SEQ ID NO: 1086773 - protein, 9 aa, Homo Sapiens
LEGHEGKIS

SEQ ID NO: 1086774 - protein, 9 aa, Homo Sapiens
PQFSWHDDP

SEQ ID NO: 1086775 - protein, 9 aa, Homo Sapiens
KSQQENQRM

SEQ ID NO: 1086776 - protein, 9 aa, Homo Sapiens
GIFFVPGGH

SEQ ID NO: 1086777 - protein, 9 aa, Homo Sapiens
PLETSPGAA

SEQ ID NO: 1086778 - protein, 9 aa, Homo Sapiens
SMGHWLPKP

SEQ ID NO: 1086779 - protein, 9 aa, Homo Sapiens
AASMIYPKE

SEQ ID NO: 1086780 - protein, 9 aa, Homo Sapiens
QSARSLPGL

SEQ ID NO: 1086781 - protein, 9 aa, Homo Sapiens
EVVLNNDGL

SEQ ID NO: 1086782 - protein, 9 aa, Homo Sapiens
CVATNLAGE

SEQ ID NO: 1086783 - protein, 9 aa, Homo Sapiens
EHKKELFKS

SEQ ID NO: 1086784 - protein, 9 aa, Homo Sapiens
TSLSSAIKY

SEQ ID NO: 1086785 - protein, 9 aa, Homo Sapiens
QRIYLGGNE

SEQ ID NO: 1086786 - protein, 9 aa, Homo Sapiens
LVLTVKEKY

SEQ ID NO: 1086787 - protein, 9 aa, Homo Sapiens
EVLNILEST

SEQ ID NO: 1086788 - protein, 9 aa, Homo Sapiens
STLNFFIQF

SEQ ID NO: 1086789 - protein, 9 aa, Homo Sapiens
YFEEPDAFN

SEQ ID NO: 1086790 - protein, 9 aa, Homo Sapiens
PPYSPTSQG

SEQ ID NO: 1086791 - protein, 9 aa, Homo Sapiens
SGTMAKPPG

SEQ ID NO: 1086792 - protein, 9 aa, Homo Sapiens
TSTESHGAL

SEQ ID NO: 1086793 - protein, 9 aa, Homo Sapiens
TQTSEIESP

SEQ ID NO: 1086794 - protein, 9 aa, Homo Sapiens
FAAETVAAW

SEQ ID NO: 1086795 - protein, 9 aa, Homo Sapiens
HAASSHGLV

SEQ ID NO: 1086796 - protein, 9 aa, Homo Sapiens
KRFQGRKIV

SEQ ID NO: 1086797 - protein, 9 aa, Homo Sapiens
ESVTSSIAG

SEQ ID NO: 1086798 - protein, 9 aa, Homo Sapiens
NQTFFQVSE

SEQ ID NO: 1086799 - protein, 9 aa, Homo Sapiens
IRDVFIQQG

SEQ ID NO: 1086800 - protein, 9 aa, Homo Sapiens
RLVGFEVGD

SEQ ID NO: 1086801 - protein, 9 aa, Homo Sapiens
AVFLDLFDA

SEQ ID NO: 1086802 - protein, 9 aa, Homo Sapiens
TSSWSNQTS

SEQ ID NO: 1086803 - protein, 9 aa, Homo Sapiens
CDVHVNSKT

SEQ ID NO: 1086804 - protein, 9 aa, Homo Sapiens
HQDEAEGDL

SEQ ID NO: 1086805 - protein, 9 aa, Homo Sapiens
DVFIQQGYA

SEQ ID NO: 1086806 - protein, 9 aa, Homo Sapiens
KDTDPFACA

SEQ ID NO: 1086807 - protein, 9 aa, Homo Sapiens
GGSLFMELG

SEQ ID NO: 1086808 - protein, 9 aa, Homo Sapiens
ISWKHATRH

SEQ ID NO: 1086809 - protein, 9 aa, Homo Sapiens
GVLNDFYKC

SEQ ID NO: 1086810 - protein, 9 aa, Homo Sapiens
MAKQLSDVS

SEQ ID NO: 1086811 - protein, 9 aa, Homo Sapiens
APTTTTPEK

SEQ ID NO: 1086812 - protein, 9 aa, Homo Sapiens
PVETVISYR

SEQ ID NO: 1086813 - protein, 9 aa, Homo Sapiens
LLFGGVECF

SEQ ID NO: 1086814 - protein, 9 aa, Homo Sapiens
HLNLIWNRI

SEQ ID NO: 1086815 - protein, 9 aa, Homo Sapiens
YFILLFGGV

SEQ ID NO: 1086816 - protein, 9 aa, Homo Sapiens
EGTFQGLIF

SEQ ID NO: 1086817 - protein, 9 aa, Homo Sapiens
AKYDLSATI

SEQ ID NO: 1086818 - protein, 9 aa, Homo Sapiens
RTYAAIEDK

SEQ ID NO: 1086819 - protein, 9 aa, Homo Sapiens
SQKPAGTPM

SEQ ID NO: 1086820 - protein, 9 aa, Homo Sapiens
KNRGPTLEV

SEQ ID NO: 1086821 - protein, 9 aa, Homo Sapiens
DVEKIQKIR

SEQ ID NO: 1086822 - protein, 9 aa, Homo Sapiens
SHQSSGPGR

SEQ ID NO: 1086823 - protein, 9 aa, Homo Sapiens
PASKAHPVA

SEQ ID NO: 1086824 - protein, 9 aa, Homo Sapiens
EEEEDWSRE

SEQ ID NO: 1086825 - protein, 9 aa, Homo Sapiens
RLDVLYLHL

SEQ ID NO: 1086826 - protein, 9 aa, Homo Sapiens
YITPAVYKE

SEQ ID NO: 1086827 - protein, 9 aa, Homo Sapiens
VGEFTFLCD

SEQ ID NO: 1086828 - protein, 9 aa, Homo Sapiens
KNSTAGESE

SEQ ID NO: 1086829 - protein, 9 aa, Homo Sapiens
DDLDLEPFS

SEQ ID NO: 1086830 - protein, 9 aa, Homo Sapiens
LIWNRITEV

SEQ ID NO: 1086831 - protein, 9 aa, Homo Sapiens
SHARYSSQL

SEQ ID NO: 1086832 - protein, 9 aa, Homo Sapiens
ILHKPTCQI

SEQ ID NO: 1086833 - protein, 9 aa, Homo Sapiens
GTENATNGV

SEQ ID NO: 1086834 - protein, 9 aa, Homo Sapiens
LKPVQQITK

SEQ ID NO: 1086835 - protein, 9 aa, Homo Sapiens
GNASPVQAV

SEQ ID NO: 1086836 - protein, 9 aa, Homo Sapiens
TCDTCHFSI

SEQ ID NO: 1086837 - protein, 9 aa, Homo Sapiens
CSTSRERSF

SEQ ID NO: 1086838 - protein, 9 aa, Homo Sapiens
LENDSLLVV

SEQ ID NO: 1086839 - protein, 9 aa, Homo Sapiens
RAEKAASMS

SEQ ID NO: 1086840 - protein, 9 aa, Homo Sapiens
EDGQVQKQS

SEQ ID NO: 1086841 - protein, 9 aa, Homo Sapiens
PLAERANKG

SEQ ID NO: 1086842 - protein, 9 aa, Homo Sapiens
KGRLVFALE

SEQ ID NO: 1086843 - protein, 9 aa, Homo Sapiens
LLLTPLPPG

SEQ ID NO: 1086844 - protein, 9 aa, Homo Sapiens
FKISIKSRD

SEQ ID NO: 1086845 - protein, 9 aa, Homo Sapiens
GFISWAGTY

SEQ ID NO: 1086846 - protein, 9 aa, Homo Sapiens
ASSIWWIIL

SEQ ID NO: 1086847 - protein, 9 aa, Homo Sapiens
FLPPVSMVH

SEQ ID NO: 1086848 - protein, 9 aa, Homo Sapiens
GFPGFSGLH

SEQ ID NO: 1086849 - protein, 9 aa, Homo Sapiens
VGITSPCFN

SEQ ID NO: 1086850 - protein, 9 aa, Homo Sapiens
LHLPGVMMS

SEQ ID NO: 1086851 - protein, 9 aa, Homo Sapiens
DALKHMFRQ

SEQ ID NO: 1086852 - protein, 9 aa, Homo Sapiens
FKFLAAGTH

SEQ ID NO: 1086853 - protein, 9 aa, Homo Sapiens
EIYRTERDK

SEQ ID NO: 1086854 - protein, 9 aa, Homo Sapiens
LLDVVDRNN

SEQ ID NO: 1086855 - protein, 9 aa, Homo Sapiens
GYEAGTKPK

SEQ ID NO: 1086856 - protein, 9 aa, Homo Sapiens
FFQEQKCIR

SEQ ID NO: 1086857 - protein, 9 aa, Homo Sapiens
DPHYFEEPD

SEQ ID NO: 1086858 - protein, 9 aa, Homo Sapiens
NLEVVLNND

SEQ ID NO: 1086859 - protein, 9 aa, Homo Sapiens
TVLVFDVND

SEQ ID NO: 1086860 - protein, 9 aa, Homo Sapiens
FFRHIPPYP

SEQ ID NO: 1086861 - protein, 9 aa, Homo Sapiens
CLRPRVLEI

SEQ ID NO: 1086862 - protein, 9 aa, Homo Sapiens
VGAVVPTHR

SEQ ID NO: 1086863 - protein, 9 aa, Homo Sapiens
RATGLCFGG

SEQ ID NO: 1086864 - protein, 9 aa, Homo Sapiens
DSGYKTETP

SEQ ID NO: 1086865 - protein, 9 aa, Homo Sapiens
SLFRGAVAS

SEQ ID NO: 1086866 - protein, 9 aa, Homo Sapiens
VQCPKRPDT

SEQ ID NO: 1086867 - protein, 9 aa, Homo Sapiens
VFVVLETTE

SEQ ID NO: 1086868 - protein, 9 aa, Homo Sapiens
ETWRETGIF

SEQ ID NO: 1086869 - protein, 9 aa, Homo Sapiens
PKQEKGKKK

SEQ ID NO: 1086870 - protein, 9 aa, Homo Sapiens
ANKGYLPVV

SEQ ID NO: 1086871 - protein, 9 aa, Homo Sapiens
LVSMGHWLP

SEQ ID NO: 1086872 - protein, 9 aa, Homo Sapiens
PVSMVHGAT

SEQ ID NO: 1086873 - protein, 9 aa, Homo Sapiens
SRSFMASIQ

SEQ ID NO: 1086874 - protein, 9 aa, Homo Sapiens
IVSQFSGTM

SEQ ID NO: 1086875 - protein, 9 aa, Homo Sapiens
VPDYFLEDT

SEQ ID NO: 1086876 - protein, 9 aa, Homo Sapiens
STSRERSFQ

SEQ ID NO: 1086877 - protein, 9 aa, Homo Sapiens
SSQQPPSYG

SEQ ID NO: 1086878 - protein, 9 aa, Homo Sapiens
LGNGNKLEW

SEQ ID NO: 1086879 - protein, 9 aa, Homo Sapiens
SGEEQRSYR

SEQ ID NO: 1086880 - protein, 9 aa, Homo Sapiens
IRRIFKITT

SEQ ID NO: 1086881 - protein, 9 aa, Homo Sapiens
KKLKVEDEP

SEQ ID NO: 1086882 - protein, 9 aa, Homo Sapiens
LRIGGNEGI

SEQ ID NO: 1086883 - protein, 9 aa, Homo Sapiens
KKSGGKYNL

SEQ ID NO: 1086884 - protein, 9 aa, Homo Sapiens
NVAYPGISK

SEQ ID NO: 1086885 - protein, 9 aa, Homo Sapiens
QKIVQTDKI

SEQ ID NO: 1086886 - protein, 9 aa, Homo Sapiens
LEVVLNNDG

SEQ ID NO: 1086887 - protein, 9 aa, Homo Sapiens
VRVQYLKDT

SEQ ID NO: 1086888 - protein, 9 aa, Homo Sapiens
RSSLLDVVD

SEQ ID NO: 1086889 - protein, 9 aa, Homo Sapiens
RLHLKIHTG

SEQ ID NO: 1086890 - protein, 9 aa, Homo Sapiens
KISIKSRDT

SEQ ID NO: 1086891 - protein, 9 aa, Homo Sapiens
CAGVLIYPL

SEQ ID NO: 1086892 - protein, 9 aa, Homo Sapiens
VYFLLLKYR

SEQ ID NO: 1086893 - protein, 9 aa, Homo Sapiens
SNSSPELGD

SEQ ID NO: 1086894 - protein, 9 aa, Homo Sapiens
TLALRDFDR

SEQ ID NO: 1086895 - protein, 9 aa, Homo Sapiens
VGDQETSSE

SEQ ID NO: 1086896 - protein, 9 aa, Homo Sapiens
APLLVILND

SEQ ID NO: 1086897 - protein, 9 aa, Homo Sapiens
ALGGTKALL

SEQ ID NO: 1086898 - protein, 9 aa, Homo Sapiens
NFFFLEVSF

SEQ ID NO: 1086899 - protein, 9 aa, Homo Sapiens
EDKYVQQKD

SEQ ID NO: 1086900 - protein, 9 aa, Homo Sapiens
EAPHSGKRS

SEQ ID NO: 1086901 - protein, 9 aa, Homo Sapiens
QAAGQEKKG

SEQ ID NO: 1086902 - protein, 9 aa, Homo Sapiens
KQDHGQLIF

SEQ ID NO: 1086903 - protein, 9 aa, Homo Sapiens
VLYLHLYCT

SEQ ID NO: 1086904 - protein, 9 aa, Homo Sapiens
LPLCQECPS

SEQ ID NO: 1086905 - protein, 9 aa, Homo Sapiens
DSTCGMNGV

SEQ ID NO: 1086906 - protein, 9 aa, Homo Sapiens
TVLFTLLHV

SEQ ID NO: 1086907 - protein, 9 aa, Homo Sapiens
AVFTTPERQ

SEQ ID NO: 1086908 - protein, 9 aa, Homo Sapiens
AAETVAAWL

SEQ ID NO: 1086909 - protein, 9 aa, Homo Sapiens
KDLIRRKVE

SEQ ID NO: 1086910 - protein, 9 aa, Homo Sapiens
VLDCTPFIA

SEQ ID NO: 1086911 - protein, 9 aa, Homo Sapiens
EPDAFNPDH

SEQ ID NO: 1086912 - protein, 9 aa, Homo Sapiens
CYSVPEEAK

SEQ ID NO: 1086913 - protein, 9 aa, Homo Sapiens
EALYNSIEA

SEQ ID NO: 1086914 - protein, 9 aa, Homo Sapiens
KKRFQGRKI

SEQ ID NO: 1086915 - protein, 9 aa, Homo Sapiens
GQKFGSHPG

SEQ ID NO: 1086916 - protein, 9 aa, Homo Sapiens
PFISSTTCG

SEQ ID NO: 1086917 - protein, 9 aa, Homo Sapiens
EKNKDETSA

SEQ ID NO: 1086918 - protein, 9 aa, Homo Sapiens
PKFPAEPPA

SEQ ID NO: 1086919 - protein, 9 aa, Homo Sapiens
RGTRVPSEA

SEQ ID NO: 1086920 - protein, 9 aa, Homo Sapiens
VMVKFGAIL

SEQ ID NO: 1086921 - protein, 9 aa, Homo Sapiens
EEDWSREER

SEQ ID NO: 1086922 - protein, 9 aa, Homo Sapiens
APPEAPHSG

SEQ ID NO: 1086923 - protein, 9 aa, Homo Sapiens
LRSGSHCSP

SEQ ID NO: 1086924 - protein, 9 aa, Homo Sapiens
PPIVSQFSG

SEQ ID NO: 1086925 - protein, 9 aa, Homo Sapiens
LAGPAELEL

SEQ ID NO: 1086926 - protein, 9 aa, Homo Sapiens
AVTEVICSQ

SEQ ID NO: 1086927 - protein, 9 aa, Homo Sapiens
AFQTREFIS

SEQ ID NO: 1086928 - protein, 9 aa, Homo Sapiens
LGSVGQKYS

SEQ ID NO: 1086929 - protein, 9 aa, Homo Sapiens
IWNRITEVG

SEQ ID NO: 1086930 - protein, 9 aa, Homo Sapiens
GITSPCFNL

SEQ ID NO: 1086931 - protein, 9 aa, Homo Sapiens
SSRRTDVRY

SEQ ID NO: 1086932 - protein, 9 aa, Homo Sapiens
MRLDVLYLH

SEQ ID NO: 1086933 - protein, 9 aa, Homo Sapiens
LMIFPQLGP

SEQ ID NO: 1086934 - protein, 9 aa, Homo Sapiens
QNLEKAEEK

SEQ ID NO: 1086935 - protein, 9 aa, Homo Sapiens
METLNTLIY

SEQ ID NO: 1086936 - protein, 9 aa, Homo Sapiens
GSKDVGSSS

SEQ ID NO: 1086937 - protein, 9 aa, Homo Sapiens
IFGSKDVGS

SEQ ID NO: 1086938 - protein, 9 aa, Homo Sapiens
CPRHHCALD

SEQ ID NO: 1086939 - protein, 9 aa, Homo Sapiens
SPASGCDNA

SEQ ID NO: 1086940 - protein, 9 aa, Homo Sapiens
QDTIISKGI

SEQ ID NO: 1086941 - protein, 9 aa, Homo Sapiens
IFLPRTRPA

SEQ ID NO: 1086942 - protein, 9 aa, Homo Sapiens
DVFKFLAAG

SEQ ID NO: 1086943 - protein, 9 aa, Homo Sapiens
VKPVSSEIY

SEQ ID NO: 1086944 - protein, 9 aa, Homo Sapiens
GERFSLGVG

SEQ ID NO: 1086945 - protein, 9 aa, Homo Sapiens
ALYNSIEAS

SEQ ID NO: 1086946 - protein, 9 aa, Homo Sapiens
INIRDVFIQ

SEQ ID NO: 1086947 - protein, 9 aa, Homo Sapiens
VNSKTQLKQ

SEQ ID NO: 1086948 - protein, 9 aa, Homo Sapiens
KFGSHPGSV

SEQ ID NO: 1086949 - protein, 9 aa, Homo Sapiens
RFLFPFWRQ

SEQ ID NO: 1086950 - protein, 9 aa, Homo Sapiens
PDWVKAVAS

SEQ ID NO: 1086951 - protein, 9 aa, Homo Sapiens
ALDSGNASP

SEQ ID NO: 1086952 - protein, 9 aa, Homo Sapiens
SLRDEDDTK

SEQ ID NO: 1086953 - protein, 9 aa, Homo Sapiens
ATLAKLSSS

SEQ ID NO: 1086954 - protein, 9 aa, Homo Sapiens
LLLLLTPLP

SEQ ID NO: 1086955 - protein, 9 aa, Homo Sapiens
EKAASMSSP

SEQ ID NO: 1086956 - protein, 9 aa, Homo Sapiens
RVAALTHVG

SEQ ID NO: 1086957 - protein, 9 aa, Homo Sapiens
GRKIVNLSI

SEQ ID NO: 1086958 - protein, 9 aa, Homo Sapiens
LILLSPETY

SEQ ID NO: 1086959 - protein, 9 aa, Homo Sapiens
LHKPTCQIS

SEQ ID NO: 1086960 - protein, 9 aa, Homo Sapiens
SAWLTMLPE

SEQ ID NO: 1086961 - protein, 9 aa, Homo Sapiens
FMETLNTLI

SEQ ID NO: 1086962 - protein, 9 aa, Homo Sapiens
GQHESGSEK

SEQ ID NO: 1086963 - protein, 9 aa, Homo Sapiens
DINKERNEE

SEQ ID NO: 1086964 - protein, 9 aa, Homo Sapiens
ELLILLSPE

SEQ ID NO: 1086965 - protein, 9 aa, Homo Sapiens
EEASPPPKF

SEQ ID NO: 1086966 - protein, 9 aa, Homo Sapiens
NQKLEVTQT

SEQ ID NO: 1086967 - protein, 9 aa, Homo Sapiens
SLIEGQRCN

SEQ ID NO: 1086968 - protein, 9 aa, Homo Sapiens
DPKLAVLMT

SEQ ID NO: 1086969 - protein, 9 aa, Homo Sapiens
DWEVGVHEI

SEQ ID NO: 1086970 - protein, 9 aa, Homo Sapiens
HHRIYTGEK

SEQ ID NO: 1086971 - protein, 9 aa, Homo Sapiens
VICSQGGKE

SEQ ID NO: 1086972 - protein, 9 aa, Homo Sapiens
WLSEGDEGE

SEQ ID NO: 1086973 - protein, 9 aa, Homo Sapiens
TTGLQLPNT

SEQ ID NO: 1086974 - protein, 9 aa, Homo Sapiens
HLETPLYVA

SEQ ID NO: 1086975 - protein, 9 aa, Homo Sapiens
KPGDSGYKT

SEQ ID NO: 1086976 - protein, 9 aa, Homo Sapiens
NICSICQEL

SEQ ID NO: 1086977 - protein, 9 aa, Homo Sapiens
LTKEVAILN

SEQ ID NO: 1086978 - protein, 9 aa, Homo Sapiens
EVLECSLKF

SEQ ID NO: 1086979 - protein, 9 aa, Homo Sapiens
AQMTKDAVD

SEQ ID NO: 1086980 - protein, 9 aa, Homo Sapiens
IYTLTVLEN

SEQ ID NO: 1086981 - protein, 9 aa, Homo Sapiens
SGVSTLGSA

SEQ ID NO: 1086982 - protein, 9 aa, Homo Sapiens
TPAQAGEKP

SEQ ID NO: 1086983 - protein, 9 aa, Homo Sapiens
YPENPGILG

SEQ ID NO: 1086984 - protein, 9 aa, Homo Sapiens
EAWSTHNTV

SEQ ID NO: 1086985 - protein, 9 aa, Homo Sapiens
QDHGQLIFF

SEQ ID NO: 1086986 - protein, 9 aa, Homo Sapiens
ADEFVSRLS

SEQ ID NO: 1086987 - protein, 9 aa, Homo Sapiens
IVAGIIALA

SEQ ID NO: 1086988 - protein, 9 aa, Homo Sapiens
KTDQNLEKA

SEQ ID NO: 1086989 - protein, 9 aa, Homo Sapiens
SRAWASKDT

SEQ ID NO: 1086990 - protein, 9 aa, Homo Sapiens
STSSWSNQT

SEQ ID NO: 1086991 - protein, 9 aa, Homo Sapiens
HPERLSPDG

SEQ ID NO: 1086992 - protein, 9 aa, Homo Sapiens
DLFDACGLI

SEQ ID NO: 1086993 - protein, 9 aa, Homo Sapiens
VGSGQLCYS

SEQ ID NO: 1086994 - protein, 9 aa, Homo Sapiens
ILIQEQFYH

SEQ ID NO: 1086995 - protein, 9 aa, Homo Sapiens
HRETVTETE

SEQ ID NO: 1086996 - protein, 9 aa, Homo Sapiens
YSTPAGYLE

SEQ ID NO: 1086997 - protein, 9 aa, Homo Sapiens
CHFSILGDG

SEQ ID NO: 1086998 - protein, 9 aa, Homo Sapiens
GKKKQQEGA

SEQ ID NO: 1086999 - protein, 9 aa, Homo Sapiens
IYTGEKPYA

SEQ ID NO: 1087000 - protein, 9 aa, Homo Sapiens
FFVTSVTRL

SEQ ID NO: 1087001 - protein, 9 aa, Homo Sapiens
LEEFSMKRS

SEQ ID NO: 1087002 - protein, 9 aa, Homo Sapiens
TTSKRENIF

SEQ ID NO: 1087003 - protein, 9 aa, Homo Sapiens
PRTPSRTVF

SEQ ID NO: 1087004 - protein, 9 aa, Homo Sapiens
LQTSFPVET

SEQ ID NO: 1087005 - protein, 9 aa, Homo Sapiens
RVQYLKDTD

SEQ ID NO: 1087006 - protein, 9 aa, Homo Sapiens
LEPFSLPEL

SEQ ID NO: 1087007 - protein, 9 aa, Homo Sapiens
VSCVHDMDS

SEQ ID NO: 1087008 - protein, 9 aa, Homo Sapiens
ENMDKDEKW

SEQ ID NO: 1087009 - protein, 9 aa, Homo Sapiens
ATEKVACCS

SEQ ID NO: 1087010 - protein, 9 aa, Homo Sapiens
FILLFGGVE

SEQ ID NO: 1087011 - protein, 9 aa, Homo Sapiens
ISVRTMPTS

SEQ ID NO: 1087012 - protein, 9 aa, Homo Sapiens
GCRLPFISS

SEQ ID NO: 1087013 - protein, 9 aa, Homo Sapiens
TVRVQYLKD

SEQ ID NO: 1087014 - protein, 9 aa, Homo Sapiens
GELESMEFS

SEQ ID NO: 1087015 - protein, 9 aa, Homo Sapiens
LIFPPSYIL

SEQ ID NO: 1087016 - protein, 9 aa, Homo Sapiens
DLNSPRDFI

SEQ ID NO: 1087017 - protein, 9 aa, Homo Sapiens
NFYPNGGNK

SEQ ID NO: 1087018 - protein, 9 aa, Homo Sapiens
MALAASTSF

SEQ ID NO: 1087019 - protein, 9 aa, Homo Sapiens
SMEFSARYN

SEQ ID NO: 1087020 - protein, 9 aa, Homo Sapiens
EIDQGEKNK

SEQ ID NO: 1087021 - protein, 9 aa, Homo Sapiens
SSDFESSSD

SEQ ID NO: 1087022 - protein, 9 aa, Homo Sapiens
NDMNSKQND

SEQ ID NO: 1087023 - protein, 9 aa, Homo Sapiens
GSETSLSSA

SEQ ID NO: 1087024 - protein, 9 aa, Homo Sapiens
VIGYSYYSI

SEQ ID NO: 1087025 - protein, 9 aa, Homo Sapiens
LPCAGVLIY

SEQ ID NO: 1087026 - protein, 9 aa, Homo Sapiens
APEDGQVQK

SEQ ID NO: 1087027 - protein, 9 aa, Homo Sapiens
PEQSANILK

SEQ ID NO: 1087028 - protein, 9 aa, Homo Sapiens
VLQSMSGTE

SEQ ID NO: 1087029 - protein, 9 aa, Homo Sapiens
EPVFPQTLA

SEQ ID NO: 1087030 - protein, 9 aa, Homo Sapiens
RSQQQQQQG

SEQ ID NO: 1087031 - protein, 9 aa, Homo Sapiens
LNILESTQA

SEQ ID NO: 1087032 - protein, 9 aa, Homo Sapiens
ETPLYVACM

SEQ ID NO: 1087033 - protein, 9 aa, Homo Sapiens
KQKLGKKTE

SEQ ID NO: 1087034 - protein, 9 aa, Homo Sapiens
LELAAVFTT

SEQ ID NO: 1087035 - protein, 9 aa, Homo Sapiens
NVTAKAFSP

SEQ ID NO: 1087036 - protein, 9 aa, Homo Sapiens
SLERCSSVM

SEQ ID NO: 1087037 - protein, 9 aa, Homo Sapiens
ENVCCPQNW

SEQ ID NO: 1087038 - protein, 9 aa, Homo Sapiens
PVFLEGTKG

SEQ ID NO: 1087039 - protein, 9 aa, Homo Sapiens
PWVLDCTPF

SEQ ID NO: 1087040 - protein, 9 aa, Homo Sapiens
SENICSICQ

SEQ ID NO: 1087041 - protein, 9 aa, Homo Sapiens
LDNQKLEVT

SEQ ID NO: 1087042 - protein, 9 aa, Homo Sapiens
MNRTVSEIM

SEQ ID NO: 1087043 - protein, 9 aa, Homo Sapiens
KREAPAPEE

SEQ ID NO: 1087044 - protein, 9 aa, Homo Sapiens
DRKFQHFNL

SEQ ID NO: 1087045 - protein, 9 aa, Homo Sapiens
QFYNNASND

SEQ ID NO: 1087046 - protein, 9 aa, Homo Sapiens
TKSGELSRL

SEQ ID NO: 1087047 - protein, 9 aa, Homo Sapiens
GRRAEKPPQ

SEQ ID NO: 1087048 - protein, 9 aa, Homo Sapiens
HESGSEKSS

SEQ ID NO: 1087049 - protein, 9 aa, Homo Sapiens
VQWETVFET

SEQ ID NO: 1087050 - protein, 9 aa, Homo Sapiens
LNTLIYANR

SEQ ID NO: 1087051 - protein, 9 aa, Homo Sapiens
AYSGSSDFE

SEQ ID NO: 1087052 - protein, 9 aa, Homo Sapiens
TSYQSAGDS

SEQ ID NO: 1087053 - protein, 9 aa, Homo Sapiens
PSEIRAPPD

SEQ ID NO: 1087054 - protein, 9 aa, Homo Sapiens
VTVRVQYLK

SEQ ID NO: 1087055 - protein, 9 aa, Homo Sapiens
KAASMSSPG

SEQ ID NO: 1087056 - protein, 9 aa, Homo Sapiens
AARQRAEAK

SEQ ID NO: 1087057 - protein, 9 aa, Homo Sapiens
VKTSTTDVA

SEQ ID NO: 1087058 - protein, 9 aa, Homo Sapiens
AFMNRTVSE

SEQ ID NO: 1087059 - protein, 9 aa, Homo Sapiens
RERSFQAGE

SEQ ID NO: 1087060 - protein, 9 aa, Homo Sapiens
FCIFAAETV

SEQ ID NO: 1087061 - protein, 9 aa, Homo Sapiens
IEKKGSDKK

SEQ ID NO: 1087062 - protein, 9 aa, Homo Sapiens
WATSFQQHV

SEQ ID NO: 1087063 - protein, 9 aa, Homo Sapiens
ENLCGGTNI

SEQ ID NO: 1087064 - protein, 9 aa, Homo Sapiens
EISQQQWLG

SEQ ID NO: 1087065 - protein, 9 aa, Homo Sapiens
DSGNASPVQ

SEQ ID NO: 1087066 - protein, 9 aa, Homo Sapiens
AKWNPRTRT

SEQ ID NO: 1087067 - protein, 9 aa, Homo Sapiens
DLDYLHGHH

SEQ ID NO: 1087068 - protein, 9 aa, Homo Sapiens
ASTGHTTPF

SEQ ID NO: 1087069 - protein, 9 aa, Homo Sapiens
PLASCSLAG

SEQ ID NO: 1087070 - protein, 9 aa, Homo Sapiens
LRPRVLEII

SEQ ID NO: 1087071 - protein, 9 aa, Homo Sapiens
IISKGIERG

SEQ ID NO: 1087072 - protein, 9 aa, Homo Sapiens
LEISLRLRL

SEQ ID NO: 1087073 - protein, 9 aa, Homo Sapiens
QQITKYQLL

SEQ ID NO: 1087074 - protein, 9 aa, Homo Sapiens
SKLKFEQDG

SEQ ID NO: 1087075 - protein, 9 aa, Homo Sapiens
LELEEELEA

SEQ ID NO: 1087076 - protein, 9 aa, Homo Sapiens
LHVPGYQLL

SEQ ID NO: 1087077 - protein, 9 aa, Homo Sapiens
WLHGLLRIF

SEQ ID NO: 1087078 - protein, 9 aa, Homo Sapiens
GLAREYGSS

SEQ ID NO: 1087079 - protein, 9 aa, Homo Sapiens
KPHWTSENS

SEQ ID NO: 1087080 - protein, 9 aa, Homo Sapiens
LETKWSFFQ

SEQ ID NO: 1087081 - protein, 9 aa, Homo Sapiens
QHHSYPAKS

SEQ ID NO: 1087082 - protein, 9 aa, Homo Sapiens
TLDLNSPRD

SEQ ID NO: 1087083 - protein, 9 aa, Homo Sapiens
LYELLILLS

SEQ ID NO: 1087084 - protein, 9 aa, Homo Sapiens
EFSMKRSSE

SEQ ID NO: 1087085 - protein, 9 aa, Homo Sapiens
ASMSSPGAQ

SEQ ID NO: 1087086 - protein, 9 aa, Homo Sapiens
AKLSSSLET

SEQ ID NO: 1087087 - protein, 9 aa, Homo Sapiens
GPMTLLLLA

SEQ ID NO: 1087088 - protein, 9 aa, Homo Sapiens
YFLEDTTPV

SEQ ID NO: 1087089 - protein, 9 aa, Homo Sapiens
VSRETQTSE

SEQ ID NO: 1087090 - protein, 9 aa, Homo Sapiens
VLENALVDD

SEQ ID NO: 1087091 - protein, 9 aa, Homo Sapiens
ILCYPASKA

SEQ ID NO: 1087092 - protein, 9 aa, Homo Sapiens
LDWEVGVHE

SEQ ID NO: 1087093 - protein, 9 aa, Homo Sapiens
LSAQRSPET

SEQ ID NO: 1087094 - protein, 9 aa, Homo Sapiens
SGLHGLNGL

SEQ ID NO: 1087095 - protein, 9 aa, Homo Sapiens
LTFTVNKEV

SEQ ID NO: 1087096 - protein, 9 aa, Homo Sapiens
ALENSRVAY

SEQ ID NO: 1087097 - protein, 9 aa, Homo Sapiens
QLSDVSSEC

SEQ ID NO: 1087098 - protein, 9 aa, Homo Sapiens
FETAFGMRG

SEQ ID NO: 1087099 - protein, 9 aa, Homo Sapiens
VIYTLTVLE

SEQ ID NO: 1087100 - protein, 9 aa, Homo Sapiens
MLHSEEKPH

SEQ ID NO: 1087101 - protein, 9 aa, Homo Sapiens
ALRDFDRAL

SEQ ID NO: 1087102 - protein, 9 aa, Homo Sapiens
WISFQNKCF

SEQ ID NO: 1087103 - protein, 9 aa, Homo Sapiens
IGKTLAKKS

SEQ ID NO: 1087104 - protein, 9 aa, Homo Sapiens
CIFAAETVA

SEQ ID NO: 1087105 - protein, 9 aa, Homo Sapiens
SIRRIFKIT

SEQ ID NO: 1087106 - protein, 9 aa, Homo Sapiens
GAPGREPGG

SEQ ID NO: 1087107 - protein, 9 aa, Homo Sapiens
DSLLVVAGD

SEQ ID NO: 1087108 - protein, 9 aa, Homo Sapiens
KFFQMLSFL

SEQ ID NO: 1087109 - protein, 9 aa, Homo Sapiens
KAKAPLETS

SEQ ID NO: 1087110 - protein, 9 aa, Homo Sapiens
EDWVRLAEM

SEQ ID NO: 1087111 - protein, 9 aa, Homo Sapiens
VALKAKAPL

SEQ ID NO: 1087112 - protein, 9 aa, Homo Sapiens
KEAPLKEAP

SEQ ID NO: 1087113 - protein, 9 aa, Homo Sapiens
QLQQSLHTK

SEQ ID NO: 1087114 - protein, 9 aa, Homo Sapiens
APPDWVKAV

SEQ ID NO: 1087115 - protein, 9 aa, Homo Sapiens
HAVLCLEVT

SEQ ID NO: 1087116 - protein, 9 aa, Homo Sapiens
TQKEWALLG

SEQ ID NO: 1087117 - protein, 9 aa, Homo Sapiens
CLRLHRGAI

SEQ ID NO: 1087118 - protein, 9 aa, Homo Sapiens
NDSDCTLDG

SEQ ID NO: 1087119 - protein, 9 aa, Homo Sapiens
VNLTSVLAL

SEQ ID NO: 1087120 - protein, 9 aa, Homo Sapiens
SLLVVAGDH

SEQ ID NO: 1087121 - protein, 9 aa, Homo Sapiens
LAAIGFDRY

SEQ ID NO: 1087122 - protein, 9 aa, Homo Sapiens
ENLGMILLI

SEQ ID NO: 1087123 - protein, 9 aa, Homo Sapiens
KLKEVVSQN

SEQ ID NO: 1087124 - protein, 9 aa, Homo Sapiens
SKLAPQVHN

SEQ ID NO: 1087125 - protein, 9 aa, Homo Sapiens
FLTNGSVFV

SEQ ID NO: 1087126 - protein, 9 aa, Homo Sapiens
RLENDSLLV

SEQ ID NO: 1087127 - protein, 9 aa, Homo Sapiens
SIKSRDTLQ

SEQ ID NO: 1087128 - protein, 9 aa, Homo Sapiens
HSGKRSCQK

SEQ ID NO: 1087129 - protein, 9 aa, Homo Sapiens
LHTKAEAEA

SEQ ID NO: 1087130 - protein, 9 aa, Homo Sapiens
EASPPPKFP

SEQ ID NO: 1087131 - protein, 9 aa, Homo Sapiens
REVKREVLE

SEQ ID NO: 1087132 - protein, 9 aa, Homo Sapiens
REYGSSLKA

SEQ ID NO: 1087133 - protein, 9 aa, Homo Sapiens
GGNEKQRKN

SEQ ID NO: 1087134 - protein, 9 aa, Homo Sapiens
VKREVLECS

SEQ ID NO: 1087135 - protein, 9 aa, Homo Sapiens
EDVFKFLAA

SEQ ID NO: 1087136 - protein, 9 aa, Homo Sapiens
GGGSLFMEL

SEQ ID NO: 1087137 - protein, 9 aa, Homo Sapiens
SKLVLEAVK

SEQ ID NO: 1087138 - protein, 9 aa, Homo Sapiens
LVLETYIKK

SEQ ID NO: 1087139 - protein, 9 aa, Homo Sapiens
SLLDVVDRN

SEQ ID NO: 1087140 - protein, 9 aa, Homo Sapiens
FISTQNGSH

SEQ ID NO: 1087141 - protein, 9 aa, Homo Sapiens
CVGEFTFLC

SEQ ID NO: 1087142 - protein, 9 aa, Homo Sapiens
NGVLWAHDL

SEQ ID NO: 1087143 - protein, 9 aa, Homo Sapiens
DDDGTHLSL

SEQ ID NO: 1087144 - protein, 9 aa, Homo Sapiens
VKGRVLFNG

SEQ ID NO: 1087145 - protein, 9 aa, Homo Sapiens
LSKEDLSSA

SEQ ID NO: 1087146 - protein, 9 aa, Homo Sapiens
SIWWIILSL

SEQ ID NO: 1087147 - protein, 9 aa, Homo Sapiens
LLHVFIIVP

SEQ ID NO: 1087148 - protein, 9 aa, Homo Sapiens
TGIFFVTSV

SEQ ID NO: 1087149 - protein, 9 aa, Homo Sapiens
EEVSNSKLV

SEQ ID NO: 1087150 - protein, 9 aa, Homo Sapiens
PKVPFCSKP

SEQ ID NO: 1087151 - protein, 9 aa, Homo Sapiens
LGSAGHDII

SEQ ID NO: 1087152 - protein, 9 aa, Homo Sapiens
WNPRTRTIN

SEQ ID NO: 1087153 - protein, 9 aa, Homo Sapiens
LVRDLYEIF

SEQ ID NO: 1087154 - protein, 9 aa, Homo Sapiens
LHPERLSPD

SEQ ID NO: 1087155 - protein, 9 aa, Homo Sapiens
KGFPGFSGL

SEQ ID NO: 1087156 - protein, 9 aa, Homo Sapiens
HEGKISKIS

SEQ ID NO: 1087157 - protein, 9 aa, Homo Sapiens
YPKEVPPEA

SEQ ID NO: 1087158 - protein, 9 aa, Homo Sapiens
VLFNGQDPV

SEQ ID NO: 1087159 - protein, 9 aa, Homo Sapiens
VEDIAVDWI

SEQ ID NO: 1087160 - protein, 9 aa, Homo Sapiens
GVTGATTYR

SEQ ID NO: 1087161 - protein, 9 aa, Homo Sapiens
RSITLRKPS

SEQ ID NO: 1087162 - protein, 9 aa, Homo Sapiens
DKGVLNDFY

SEQ ID NO: 1087163 - protein, 9 aa, Homo Sapiens
IFPPSYILV

SEQ ID NO: 1087164 - protein, 9 aa, Homo Sapiens
YTQVSQKRG

SEQ ID NO: 1087165 - protein, 9 aa, Homo Sapiens
VSMGHWLPK

SEQ ID NO: 1087166 - protein, 9 aa, Homo Sapiens
LLHDILHKP

SEQ ID NO: 1087167 - protein, 9 aa, Homo Sapiens
EFLGNGNKL

SEQ ID NO: 1087168 - protein, 9 aa, Homo Sapiens
KDVGEGEEE

SEQ ID NO: 1087169 - protein, 9 aa, Homo Sapiens
PRYLHQGKD

SEQ ID NO: 1087170 - protein, 9 aa, Homo Sapiens
KVSLNSQIK

SEQ ID NO: 1087171 - protein, 9 aa, Homo Sapiens
FFLRNFFFL

SEQ ID NO: 1087172 - protein, 9 aa, Homo Sapiens
YVSVPDYFL

SEQ ID NO: 1087173 - protein, 9 aa, Homo Sapiens
LCAKFYADP

SEQ ID NO: 1087174 - protein, 9 aa, Homo Sapiens
FLFLGPMTL

SEQ ID NO: 1087175 - protein, 9 aa, Homo Sapiens
HGLELAAVF

SEQ ID NO: 1087176 - protein, 9 aa, Homo Sapiens
QCSEQWISF

SEQ ID NO: 1087177 - protein, 9 aa, Homo Sapiens
ALLDPGTPD

SEQ ID NO: 1087178 - protein, 9 aa, Homo Sapiens
LQHRETVTE

SEQ ID NO: 1087179 - protein, 9 aa, Homo Sapiens
LLPQTLLNS

SEQ ID NO: 1087180 - protein, 9 aa, Homo Sapiens
TSTLAFQTE

SEQ ID NO: 1087181 - protein, 9 aa, Homo Sapiens
KKEQKQRDR

SEQ ID NO: 1087182 - protein, 9 aa, Homo Sapiens
GLLRIFGAA

SEQ ID NO: 1087183 - protein, 9 aa, Homo Sapiens
AASSGVSTL

SEQ ID NO: 1087184 - protein, 9 aa, Homo Sapiens
TFRLLVSMG

SEQ ID NO: 1087185 - protein, 9 aa, Homo Sapiens
LEPWRPGTA

SEQ ID NO: 1087186 - protein, 9 aa, Homo Sapiens
FGAAQFQGG

SEQ ID NO: 1087187 - protein, 9 aa, Homo Sapiens
LGLDLCLLE

SEQ ID NO: 1087188 - protein, 9 aa, Homo Sapiens
NIFPDYPLT

SEQ ID NO: 1087189 - protein, 9 aa, Homo Sapiens
KDASRFLFP

SEQ ID NO: 1087190 - protein, 9 aa, Homo Sapiens
VQQITKYQL

SEQ ID NO: 1087191 - protein, 9 aa, Homo Sapiens
TGHTTPFPV

SEQ ID NO: 1087192 - protein, 9 aa, Homo Sapiens
DTQNKDRSV

SEQ ID NO: 1087193 - protein, 9 aa, Homo Sapiens
VLTQEELLA

SEQ ID NO: 1087194 - protein, 9 aa, Homo Sapiens
RGPLPLLRP

SEQ ID NO: 1087195 - protein, 9 aa, Homo Sapiens
FNLVLETYI

SEQ ID NO: 1087196 - protein, 9 aa, Homo Sapiens
KNFCEYYGK

SEQ ID NO: 1087197 - protein, 9 aa, Homo Sapiens
RFYMELPGS

SEQ ID NO: 1087198 - protein, 9 aa, Homo Sapiens
PGRRAEKPP

SEQ ID NO: 1087199 - protein, 9 aa, Homo Sapiens
HINFYPNGG

SEQ ID NO: 1087200 - protein, 9 aa, Homo Sapiens
SVIIAKNES

SEQ ID NO: 1087201 - protein, 9 aa, Homo Sapiens
TTPFPVTDT

SEQ ID NO: 1087202 - protein, 9 aa, Homo Sapiens
EVVSQNRLA

SEQ ID NO: 1087203 - protein, 9 aa, Homo Sapiens
KLKSQQENQ

SEQ ID NO: 1087204 - protein, 9 aa, Homo Sapiens
QVLEGLHRL

SEQ ID NO: 1087205 - protein, 9 aa, Homo Sapiens
RANKGFGIV

SEQ ID NO: 1087206 - protein, 9 aa, Homo Sapiens
SLLHDILHK

SEQ ID NO: 1087207 - protein, 9 aa, Homo Sapiens
LFMELGVST

SEQ ID NO: 1087208 - protein, 9 aa, Homo Sapiens
ADPAVQPTF

SEQ ID NO: 1087209 - protein, 9 aa, Homo Sapiens
FLDKVVSVF

SEQ ID NO: 1087210 - protein, 9 aa, Homo Sapiens
KRVLAEKLA

SEQ ID NO: 1087211 - protein, 9 aa, Homo Sapiens
AKRVLAEKL

SEQ ID NO: 1087212 - protein, 9 aa, Homo Sapiens
RVLFNGQDP

SEQ ID NO: 1087213 - protein, 9 aa, Homo Sapiens
KQMRATGLC

SEQ ID NO: 1087214 - protein, 9 aa, Homo Sapiens
KIVNLSIPL

SEQ ID NO: 1087215 - protein, 9 aa, Homo Sapiens
WLPLNQTFF

SEQ ID NO: 1087216 - protein, 9 aa, Homo Sapiens
APKDVGEGE

SEQ ID NO: 1087217 - protein, 9 aa, Homo Sapiens
RLRPRHQVL

SEQ ID NO: 1087218 - protein, 9 aa, Homo Sapiens
LRKKEQKQR

SEQ ID NO: 1087219 - protein, 9 aa, Homo Sapiens
LPPPYSPTS

SEQ ID NO: 1087220 - protein, 9 aa, Homo Sapiens
KRLFFSSIF

SEQ ID NO: 1087221 - protein, 9 aa, Homo Sapiens
FPSCAIEVY

SEQ ID NO: 1087222 - protein, 9 aa, Homo Sapiens
SPGAPGREP

SEQ ID NO: 1087223 - protein, 9 aa, Homo Sapiens
AFLHWYTGK

SEQ ID NO: 1087224 - protein, 9 aa, Homo Sapiens
VLLHLNLIW

SEQ ID NO: 1087225 - protein, 9 aa, Homo Sapiens
TFTVNKEVF

SEQ ID NO: 1087226 - protein, 9 aa, Homo Sapiens
GGTKALLLG

SEQ ID NO: 1087227 - protein, 9 aa, Homo Sapiens
SEMPGNEVP

SEQ ID NO: 1087228 - protein, 9 aa, Homo Sapiens
LDSGNASPV

SEQ ID NO: 1087229 - protein, 9 aa, Homo Sapiens
MEFSARYNF

SEQ ID NO: 1087230 - protein, 9 aa, Homo Sapiens
ILHVPGYQL

SEQ ID NO: 1087231 - protein, 9 aa, Homo Sapiens
FSMKRSSEN

SEQ ID NO: 1087232 - protein, 9 aa, Homo Sapiens
MKRSSENTY

SEQ ID NO: 1087233 - protein, 9 aa, Homo Sapiens
LDALKHMFR

SEQ ID NO: 1087234 - protein, 9 aa, Homo Sapiens
DQDKLAEEI

SEQ ID NO: 1087235 - protein, 9 aa, Homo Sapiens
RAESQYLLV

SEQ ID NO: 1087236 - protein, 9 aa, Homo Sapiens
TNCFLLAAI

SEQ ID NO: 1087237 - protein, 9 aa, Homo Sapiens
PSQISYPVS

SEQ ID NO: 1087238 - protein, 9 aa, Homo Sapiens
HLVYKMPIK

SEQ ID NO: 1087239 - protein, 9 aa, Homo Sapiens
SSLKAYTPV

SEQ ID NO: 1087240 - protein, 9 aa, Homo Sapiens
TEHKKELFK

SEQ ID NO: 1087241 - protein, 9 aa, Homo Sapiens
LCLALLLEP

SEQ ID NO: 1087242 - protein, 9 aa, Homo Sapiens
EINFHEEWL

SEQ ID NO: 1087243 - protein, 9 aa, Homo Sapiens
IFPQLGPVQ

SEQ ID NO: 1087244 - protein, 9 aa, Homo Sapiens
EKGKKKQQE

SEQ ID NO: 1087245 - protein, 9 aa, Homo Sapiens
DKHDDVMVK

SEQ ID NO: 1087246 - protein, 9 aa, Homo Sapiens
ELVTSKIVL

SEQ ID NO: 1087247 - protein, 9 aa, Homo Sapiens
YTASDFIEE

SEQ ID NO: 1087248 - protein, 9 aa, Homo Sapiens
LDENKDVSM

SEQ ID NO: 1087249 - protein, 9 aa, Homo Sapiens
LIYPLWVIT

SEQ ID NO: 1087250 - protein, 9 aa, Homo Sapiens
LHDILHKPT

SEQ ID NO: 1087251 - protein, 9 aa, Homo Sapiens
EKKGSDKKT

SEQ ID NO: 1087252 - protein, 9 aa, Homo Sapiens
GNEVPVEEH

SEQ ID NO: 1087253 - protein, 9 aa, Homo Sapiens
CRRCDTQNK

SEQ ID NO: 1087254 - protein, 9 aa, Homo Sapiens
RTRPAGVFE

SEQ ID NO: 1087255 - protein, 9 aa, Homo Sapiens
LSLEETELE

SEQ ID NO: 1087256 - protein, 9 aa, Homo Sapiens
DSENICSIC

SEQ ID NO: 1087257 - protein, 9 aa, Homo Sapiens
ITELGFWTV

SEQ ID NO: 1087258 - protein, 9 aa, Homo Sapiens
AGDSKEDEL

SEQ ID NO: 1087259 - protein, 9 aa, Homo Sapiens
TSVLDCNYY

SEQ ID NO: 1087260 - protein, 9 aa, Homo Sapiens
DKYVQQKDE

SEQ ID NO: 1087261 - protein, 9 aa, Homo Sapiens
GVHEIRIEF

SEQ ID NO: 1087262 - protein, 9 aa, Homo Sapiens
RRAYRPRDQ

SEQ ID NO: 1087263 - protein, 9 aa, Homo Sapiens
LHLNLIWNR

SEQ ID NO: 1087264 - protein, 9 aa, Homo Sapiens
IFPDYPLTL

SEQ ID NO: 1087265 - protein, 9 aa, Homo Sapiens
TPPIVSQFS

SEQ ID NO: 1087266 - protein, 9 aa, Homo Sapiens
RSGSHCSPD

SEQ ID NO: 1087267 - protein, 9 aa, Homo Sapiens
LGPMTLLLL

SEQ ID NO: 1087268 - protein, 9 aa, Homo Sapiens
EGGKEVLTI

SEQ ID NO: 1087269 - protein, 9 aa, Homo Sapiens
EEKWSPELP

SEQ ID NO: 1087270 - protein, 9 aa, Homo Sapiens
FPVETVISY

SEQ ID NO: 1087271 - protein, 9 aa, Homo Sapiens
AENVYDCQV

SEQ ID NO: 1087272 - protein, 9 aa, Homo Sapiens
SLEEMSLQR

SEQ ID NO: 1087273 - protein, 9 aa, Homo Sapiens
SANILKWAA

SEQ ID NO: 1087274 - protein, 9 aa, Homo Sapiens
STSFLGCYA

SEQ ID NO: 1087275 - protein, 9 aa, Homo Sapiens
SPSPASGCD

SEQ ID NO: 1087276 - protein, 9 aa, Homo Sapiens
ALTHVGESS

SEQ ID NO: 1087277 - protein, 9 aa, Homo Sapiens
ILFSRIIHM

SEQ ID NO: 1087278 - protein, 9 aa, Homo Sapiens
TAELRSEIS

SEQ ID NO: 1087279 - protein, 9 aa, Homo Sapiens
HSSPTSEAD

SEQ ID NO: 1087280 - protein, 9 aa, Homo Sapiens
SGPGRQGSG

SEQ ID NO: 1087281 - protein, 9 aa, Homo Sapiens
IFNMYYFES

SEQ ID NO: 1087282 - protein, 9 aa, Homo Sapiens
GLGETFDSN

SEQ ID NO: 1087283 - protein, 9 aa, Homo Sapiens
DSSDEPIAE

SEQ ID NO: 1087284 - protein, 9 aa, Homo Sapiens
SLKAYTPVV

SEQ ID NO: 1087285 - protein, 9 aa, Homo Sapiens
VNKEVFGQI

SEQ ID NO: 1087286 - protein, 9 aa, Homo Sapiens
PSRTVFFER

SEQ ID NO: 1087287 - protein, 9 aa, Homo Sapiens
DNKNNFSPK

SEQ ID NO: 1087288 - protein, 9 aa, Homo Sapiens
SDSSQQPPS

SEQ ID NO: 1087289 - protein, 9 aa, Homo Sapiens
YHCNPCGLH

SEQ ID NO: 1087290 - protein, 9 aa, Homo Sapiens
ITGTSSRRT

SEQ ID NO: 1087291 - protein, 9 aa, Homo Sapiens
SENSHEGKI

SEQ ID NO: 1087292 - protein, 9 aa, Homo Sapiens
SPERAESQY

SEQ ID NO: 1087293 - protein, 9 aa, Homo Sapiens
QLCLALLLE

SEQ ID NO: 1087294 - protein, 9 aa, Homo Sapiens
SPHSRSFMA

SEQ ID NO: 1087295 - protein, 9 aa, Homo Sapiens
KDSGVVPVG

SEQ ID NO: 1087296 - protein, 9 aa, Homo Sapiens
KIPRGFRFH

SEQ ID NO: 1087297 - protein, 9 aa, Homo Sapiens
KDVSMEFLH

SEQ ID NO: 1087298 - protein, 9 aa, Homo Sapiens
SVFVVLETT

SEQ ID NO: 1087299 - protein, 9 aa, Homo Sapiens
REAPAPEEE

SEQ ID NO: 1087300 - protein, 9 aa, Homo Sapiens
EEPLNPDYV

SEQ ID NO: 1087301 - protein, 9 aa, Homo Sapiens
PPDWVKAVA

SEQ ID NO: 1087302 - protein, 9 aa, Homo Sapiens
IGFCIFAAE

SEQ ID NO: 1087303 - protein, 9 aa, Homo Sapiens
ETAQEFVDE

SEQ ID NO: 1087304 - protein, 9 aa, Homo Sapiens
SHGALSISP

SEQ ID NO: 1087305 - protein, 9 aa, Homo Sapiens
EKLRKKEQK

SEQ ID NO: 1087306 - protein, 9 aa, Homo Sapiens
VCPFLKKIL

SEQ ID NO: 1087307 - protein, 9 aa, Homo Sapiens
SKSKLKFEQ

SEQ ID NO: 1087308 - protein, 9 aa, Homo Sapiens
FSDRHLTQY

SEQ ID NO: 1087309 - protein, 9 aa, Homo Sapiens
NLGSVGQKY

SEQ ID NO: 1087310 - protein, 9 aa, Homo Sapiens
QVQPHSDAK

SEQ ID NO: 1087311 - protein, 9 aa, Homo Sapiens
LDNVEDIAV

SEQ ID NO: 1087312 - protein, 9 aa, Homo Sapiens
RQRISRDLA

SEQ ID NO: 1087313 - protein, 9 aa, Homo Sapiens
NRTVSEIMW

SEQ ID NO: 1087314 - protein, 9 aa, Homo Sapiens
LDRCYSTPA

SEQ ID NO: 1087315 - protein, 9 aa, Homo Sapiens
LTPSNGILR

SEQ ID NO: 1087316 - protein, 9 aa, Homo Sapiens
LAAPAPAPA

SEQ ID NO: 1087317 - protein, 9 aa, Homo Sapiens
DLSSAFDHS

SEQ ID NO: 1087318 - protein, 9 aa, Homo Sapiens
IFLQMKRVT

SEQ ID NO: 1087319 - protein, 9 aa, Homo Sapiens
QENERKQSP

SEQ ID NO: 1087320 - protein, 9 aa, Homo Sapiens
GSSDFESSS

SEQ ID NO: 1087321 - protein, 9 aa, Homo Sapiens
PAGYLELTD

SEQ ID NO: 1087322 - protein, 9 aa, Homo Sapiens
PKDSGVVPV

SEQ ID NO: 1087323 - protein, 9 aa, Homo Sapiens
FMELGVSTD

SEQ ID NO: 1087324 - protein, 9 aa, Homo Sapiens
ASRFLFPFW

SEQ ID NO: 1087325 - protein, 9 aa, Homo Sapiens
GKFFQMLSF

SEQ ID NO: 1087326 - protein, 9 aa, Homo Sapiens
KEGSNRQWN

SEQ ID NO: 1087327 - protein, 9 aa, Homo Sapiens
LPGLAPCLK

SEQ ID NO: 1087328 - protein, 9 aa, Homo Sapiens
TFSGLTPKD

SEQ ID NO: 1087329 - protein, 9 aa, Homo Sapiens
QLAVNLTSV

SEQ ID NO: 1087330 - protein, 9 aa, Homo Sapiens
HTWLESLQI

SEQ ID NO: 1087331 - protein, 9 aa, Homo Sapiens
QIAFQQHRR

SEQ ID NO: 1087332 - protein, 9 aa, Homo Sapiens
SDTEDWVRL

SEQ ID NO: 1087333 - protein, 9 aa, Homo Sapiens
LEELTSNVG

SEQ ID NO: 1087334 - protein, 9 aa, Homo Sapiens
SAKCTEEEK

SEQ ID NO: 1087335 - protein, 9 aa, Homo Sapiens
QTPAQAGEK

SEQ ID NO: 1087336 - protein, 9 aa, Homo Sapiens
GGVECFLLG

SEQ ID NO: 1087337 - protein, 9 aa, Homo Sapiens
QGDQICLRL

SEQ ID NO: 1087338 - protein, 9 aa, Homo Sapiens
GSLTSVLDC

SEQ ID NO: 1087339 - protein, 9 aa, Homo Sapiens
PLGHINFYP

SEQ ID NO: 1087340 - protein, 9 aa, Homo Sapiens
ELGGIVGDI

SEQ ID NO: 1087341 - protein, 9 aa, Homo Sapiens
RENIFPDYP

SEQ ID NO: 1087342 - protein, 9 aa, Homo Sapiens
DQPYKVSLN

SEQ ID NO: 1087343 - protein, 9 aa, Homo Sapiens
FNRGPLPLL

SEQ ID NO: 1087344 - protein, 9 aa, Homo Sapiens
SNRNVCLFF

SEQ ID NO: 1087345 - protein, 9 aa, Homo Sapiens
ISLPRLLAM

SEQ ID NO: 1087346 - protein, 9 aa, Homo Sapiens
LAAVFTTPE

SEQ ID NO: 1087347 - protein, 9 aa, Homo Sapiens
LRPRHQVLE

SEQ ID NO: 1087348 - protein, 9 aa, Homo Sapiens
NGNKLEWED

SEQ ID NO: 1087349 - protein, 9 aa, Homo Sapiens
FSLLSAETM

SEQ ID NO: 1087350 - protein, 9 aa, Homo Sapiens
ILCWTSPQV

SEQ ID NO: 1087351 - protein, 9 aa, Homo Sapiens
IVNLSIPLS

SEQ ID NO: 1087352 - protein, 9 aa, Homo Sapiens
AEKAASMSS

SEQ ID NO: 1087353 - protein, 9 aa, Homo Sapiens
LLLLLLTPL

SEQ ID NO: 1087354 - protein, 9 aa, Homo Sapiens
WVLDCTPFI

SEQ ID NO: 1087355 - protein, 9 aa, Homo Sapiens
YYDSSDEPI

SEQ ID NO: 1087356 - protein, 9 aa, Homo Sapiens
CQNDCQLTS

SEQ ID NO: 1087357 - protein, 9 aa, Homo Sapiens
FLGNGNKLE

SEQ ID NO: 1087358 - protein, 9 aa, Homo Sapiens
QALCDMVRK

SEQ ID NO: 1087359 - protein, 9 aa, Homo Sapiens
APSAAPALA

SEQ ID NO: 1087360 - protein, 9 aa, Homo Sapiens
NGSVFVVLE

SEQ ID NO: 1087361 - protein, 9 aa, Homo Sapiens
DCNYYYKPS

SEQ ID NO: 1087362 - protein, 9 aa, Homo Sapiens
FINPGKIPR

SEQ ID NO: 1087363 - protein, 9 aa, Homo Sapiens
AGIYLLAFQ

SEQ ID NO: 1087364 - protein, 9 aa, Homo Sapiens
IARKNHPQF

SEQ ID NO: 1087365 - protein, 9 aa, Homo Sapiens
LEGLHRLSL

SEQ ID NO: 1087366 - protein, 9 aa, Homo Sapiens
EEMEAEAAA

SEQ ID NO: 1087367 - protein, 9 aa, Homo Sapiens
LAKLSSSLE

SEQ ID NO: 1087368 - protein, 9 aa, Homo Sapiens
ELLQPLKGK

SEQ ID NO: 1087369 - protein, 9 aa, Homo Sapiens
RHQVLEGLH

SEQ ID NO: 1087370 - protein, 9 aa, Homo Sapiens
LAERANKGF

SEQ ID NO: 1087371 - protein, 9 aa, Homo Sapiens
EFVDEFAMR

SEQ ID NO: 1087372 - protein, 9 aa, Homo Sapiens
SMKRSSENT

SEQ ID NO: 1087373 - protein, 9 aa, Homo Sapiens
MEGGDSGVY

SEQ ID NO: 1087374 - protein, 9 aa, Homo Sapiens
SQGPAQRSP

SEQ ID NO: 1087375 - protein, 9 aa, Homo Sapiens
KEVAILNTS

SEQ ID NO: 1087376 - protein, 9 aa, Homo Sapiens
RAFMNRTVS

SEQ ID NO: 1087377 - protein, 9 aa, Homo Sapiens
NPGKIPRGF

SEQ ID NO: 1087378 - protein, 9 aa, Homo Sapiens
VVMAQITEA

SEQ ID NO: 1087379 - protein, 9 aa, Homo Sapiens
LGPTSTESH

SEQ ID NO: 1087380 - protein, 9 aa, Homo Sapiens
HHHLHHHQR

SEQ ID NO: 1087381 - protein, 9 aa, Homo Sapiens
ETLNTLIYA

SEQ ID NO: 1087382 - protein, 9 aa, Homo Sapiens
PKLAVLMTN

SEQ ID NO: 1087383 - protein, 9 aa, Homo Sapiens
SLGSSMEME

SEQ ID NO: 1087384 - protein, 9 aa, Homo Sapiens
KRQNLGSVG

SEQ ID NO: 1087385 - protein, 9 aa, Homo Sapiens
FLKKILYAT

SEQ ID NO: 1087386 - protein, 9 aa, Homo Sapiens
SQKRGRDPN

SEQ ID NO: 1087387 - protein, 9 aa, Homo Sapiens
IVLRKDLDN

SEQ ID NO: 1087388 - protein, 9 aa, Homo Sapiens
FCPQDTIIS

SEQ ID NO: 1087389 - protein, 9 aa, Homo Sapiens
PKKVKEKRI

SEQ ID NO: 1087390 - protein, 9 aa, Homo Sapiens
VAYPGISKL

SEQ ID NO: 1087391 - protein, 9 aa, Homo Sapiens
FLALGGTKA

SEQ ID NO: 1087392 - protein, 9 aa, Homo Sapiens
AKKSRGLFS

SEQ ID NO: 1087393 - protein, 9 aa, Homo Sapiens
RPFDSFFLD

SEQ ID NO: 1087394 - protein, 9 aa, Homo Sapiens
EAPSEMPGN

SEQ ID NO: 1087395 - protein, 9 aa, Homo Sapiens
VSQKPAGTP

SEQ ID NO: 1087396 - protein, 9 aa, Homo Sapiens
EKQFQLQST

SEQ ID NO: 1087397 - protein, 9 aa, Homo Sapiens
PAELELEEE

SEQ ID NO: 1087398 - protein, 9 aa, Homo Sapiens
GIFFVTSVT

SEQ ID NO: 1087399 - protein, 9 aa, Homo Sapiens
LCQECPSCP

SEQ ID NO: 1087400 - protein, 9 aa, Homo Sapiens
LFQGDQICL

SEQ ID NO: 1087401 - protein, 9 aa, Homo Sapiens
EGGGSLFME

SEQ ID NO: 1087402 - protein, 9 aa, Homo Sapiens
YLLAFQAVD

SEQ ID NO: 1087403 - protein, 9 aa, Homo Sapiens
QFSWHDDPF

SEQ ID NO: 1087404 - protein, 9 aa, Homo Sapiens
IQAFALGQK

SEQ ID NO: 1087405 - protein, 9 aa, Homo Sapiens
EPLGHINFY

SEQ ID NO: 1087406 - protein, 9 aa, Homo Sapiens
NRNVCLFFL

SEQ ID NO: 1087407 - protein, 9 aa, Homo Sapiens
EEEMEAEAA

SEQ ID NO: 1087408 - protein, 9 aa, Homo Sapiens
KSGELSRLL

SEQ ID NO: 1087409 - protein, 9 aa, Homo Sapiens
GDLGNRHEP

SEQ ID NO: 1087410 - protein, 9 aa, Homo Sapiens
LRLHLKIHT

SEQ ID NO: 1087411 - protein, 9 aa, Homo Sapiens
KAFSPSLLA

SEQ ID NO: 1087412 - protein, 9 aa, Homo Sapiens
IHGNLVMNA

SEQ ID NO: 1087413 - protein, 9 aa, Homo Sapiens
PSCAIEVYK

SEQ ID NO: 1087414 - protein, 9 aa, Homo Sapiens
WTSENSHEG

SEQ ID NO: 1087415 - protein, 9 aa, Homo Sapiens
RCYSTPAGY

SEQ ID NO: 1087416 - protein, 9 aa, Homo Sapiens
KEIDSENIC

SEQ ID NO: 1087417 - protein, 9 aa, Homo Sapiens
FFLAVILEI

SEQ ID NO: 1087418 - protein, 9 aa, Homo Sapiens
APSAEGGKE

SEQ ID NO: 1087419 - protein, 9 aa, Homo Sapiens
TPVAQMTKD

SEQ ID NO: 1087420 - protein, 9 aa, Homo Sapiens
EVKREVLEC

SEQ ID NO: 1087421 - protein, 9 aa, Homo Sapiens
ELPGSGNTL

SEQ ID NO: 1087422 - protein, 9 aa, Homo Sapiens
ITVLVFDVN

SEQ ID NO: 1087423 - protein, 9 aa, Homo Sapiens
LSKGVQPKQ

SEQ ID NO: 1087424 - protein, 9 aa, Homo Sapiens
GDSKEDELY

SEQ ID NO: 1087425 - protein, 9 aa, Homo Sapiens
DKQKLGKKT

SEQ ID NO: 1087426 - protein, 9 aa, Homo Sapiens
GRPRSKQEA

SEQ ID NO: 1087427 - protein, 9 aa, Homo Sapiens
MTKDAVDAE

SEQ ID NO: 1087428 - protein, 9 aa, Homo Sapiens
QSMSGTENA

SEQ ID NO: 1087429 - protein, 9 aa, Homo Sapiens
QEIPHLETP

SEQ ID NO: 1087430 - protein, 9 aa, Homo Sapiens
LAGEEDRIF

SEQ ID NO: 1087431 - protein, 9 aa, Homo Sapiens
IQEQFYHQR

SEQ ID NO: 1087432 - protein, 9 aa, Homo Sapiens
ECGKFFQML

SEQ ID NO: 1087433 - protein, 9 aa, Homo Sapiens
DKNRGPTLE

SEQ ID NO: 1087434 - protein, 9 aa, Homo Sapiens
EDLRVGFIS

SEQ ID NO: 1087435 - protein, 9 aa, Homo Sapiens
PGISVLMIF

SEQ ID NO: 1087436 - protein, 9 aa, Homo Sapiens
IPPHAVLCL

SEQ ID NO: 1087437 - protein, 9 aa, Homo Sapiens
VSMVHGATP

SEQ ID NO: 1087438 - protein, 9 aa, Homo Sapiens
LEKAEEKTK

SEQ ID NO: 1087439 - protein, 9 aa, Homo Sapiens
LFPDSNLEV

SEQ ID NO: 1087440 - protein, 9 aa, Homo Sapiens
PLPLLRPLS

SEQ ID NO: 1087441 - protein, 9 aa, Homo Sapiens
PRTRPAGVF

SEQ ID NO: 1087442 - protein, 9 aa, Homo Sapiens
EILTDNNIS

SEQ ID NO: 1087443 - protein, 9 aa, Homo Sapiens
EKPYHCNPC

SEQ ID NO: 1087444 - protein, 9 aa, Homo Sapiens
NLIRHHRIY

SEQ ID NO: 1087445 - protein, 9 aa, Homo Sapiens
MKEEDVFKF

SEQ ID NO: 1087446 - protein, 9 aa, Homo Sapiens
STAYLQWSN

SEQ ID NO: 1087447 - protein, 9 aa, Homo Sapiens
EAGIYLLAF

SEQ ID NO: 1087448 - protein, 9 aa, Homo Sapiens
DTIISKGIE

SEQ ID NO: 1087449 - protein, 9 aa, Homo Sapiens
ISPVVMAQI

SEQ ID NO: 1087450 - protein, 9 aa, Homo Sapiens
CRVIGYSYY

SEQ ID NO: 1087451 - protein, 9 aa, Homo Sapiens
EWKQLESDL

SEQ ID NO: 1087452 - protein, 9 aa, Homo Sapiens
YPLWVITAA

SEQ ID NO: 1087453 - protein, 9 aa, Homo Sapiens
ISYIIVVVL

SEQ ID NO: 1087454 - protein, 9 aa, Homo Sapiens
DTFRLLVSM

SEQ ID NO: 1087455 - protein, 9 aa, Homo Sapiens
KGAPKEAPL

SEQ ID NO: 1087456 - protein, 9 aa, Homo Sapiens
SQRKGSISE

SEQ ID NO: 1087457 - protein, 9 aa, Homo Sapiens
KSKSKLKFE

SEQ ID NO: 1087458 - protein, 9 aa, Homo Sapiens
IYLLAFQAV

SEQ ID NO: 1087459 - protein, 9 aa, Homo Sapiens
QTYLSQLFY

SEQ ID NO: 1087460 - protein, 9 aa, Homo Sapiens
EEEEMEAEA

SEQ ID NO: 1087461 - protein, 9 aa, Homo Sapiens
NHPQFLAYI

SEQ ID NO: 1087462 - protein, 9 aa, Homo Sapiens
LFNGQDPVK

SEQ ID NO: 1087463 - protein, 9 aa, Homo Sapiens
VEEEVSNSK

SEQ ID NO: 1087464 - protein, 9 aa, Homo Sapiens
TYLSQLFYH

SEQ ID NO: 1087465 - protein, 9 aa, Homo Sapiens
KIIQISSGK

SEQ ID NO: 1087466 - protein, 9 aa, Homo Sapiens
VPSSDSLDQ

SEQ ID NO: 1087467 - protein, 9 aa, Homo Sapiens
VPFCSKPTS

SEQ ID NO: 1087468 - protein, 9 aa, Homo Sapiens
ANILKWAAN

SEQ ID NO: 1087469 - protein, 9 aa, Homo Sapiens
EMAKYDLSA

SEQ ID NO: 1087470 - protein, 9 aa, Homo Sapiens
DNQKLEVTQ

SEQ ID NO: 1087471 - protein, 9 aa, Homo Sapiens
EEDLDALKH

SEQ ID NO: 1087472 - protein, 9 aa, Homo Sapiens
LKEAPAEAP

SEQ ID NO: 1087473 - protein, 9 aa, Homo Sapiens
NDKHDDVMV

SEQ ID NO: 1087474 - protein, 9 aa, Homo Sapiens
EMPGNEVPV

SEQ ID NO: 1087475 - protein, 9 aa, Homo Sapiens
QGPDLNSKA

SEQ ID NO: 1087476 - protein, 9 aa, Homo Sapiens
IILSLTWFL

SEQ ID NO: 1087477 - protein, 9 aa, Homo Sapiens
IVQTDKITN

SEQ ID NO: 1087478 - protein, 9 aa, Homo Sapiens
EHSRILFQR

SEQ ID NO: 1087479 - protein, 9 aa, Homo Sapiens
ASCQSSPMA

SEQ ID NO: 1087480 - protein, 9 aa, Homo Sapiens
EKEERPLRG

SEQ ID NO: 1087481 - protein, 9 aa, Homo Sapiens
RDFDRALLR

SEQ ID NO: 1087482 - protein, 9 aa, Homo Sapiens
PTHRFSSFK

SEQ ID NO: 1087483 - protein, 9 aa, Homo Sapiens
LLDILSKGV

SEQ ID NO: 1087484 - protein, 9 aa, Homo Sapiens
LKKILYATV

SEQ ID NO: 1087485 - protein, 9 aa, Homo Sapiens
LTPLPPGAP

SEQ ID NO: 1087486 - protein, 9 aa, Homo Sapiens
SGKRSCQKS

SEQ ID NO: 1087487 - protein, 9 aa, Homo Sapiens
ALLLEPWRP

SEQ ID NO: 1087488 - protein, 9 aa, Homo Sapiens
SFPVETVIS

SEQ ID NO: 1087489 - protein, 9 aa, Homo Sapiens
IPHLETPLY

SEQ ID NO: 1087490 - protein, 9 aa, Homo Sapiens
HFSILGDGN

SEQ ID NO: 1087491 - protein, 9 aa, Homo Sapiens
EKKKLKVED

SEQ ID NO: 1087492 - protein, 9 aa, Homo Sapiens
LIFLPRTRP

SEQ ID NO: 1087493 - protein, 9 aa, Homo Sapiens
TVFFERERT

SEQ ID NO: 1087494 - protein, 9 aa, Homo Sapiens
DPATRQNGP

SEQ ID NO: 1087495 - protein, 9 aa, Homo Sapiens
EVSPHSRSF

SEQ ID NO: 1087496 - protein, 9 aa, Homo Sapiens
AVNLTSVLA

SEQ ID NO: 1087497 - protein, 9 aa, Homo Sapiens
ISSGKELRV

SEQ ID NO: 1087498 - protein, 9 aa, Homo Sapiens
LVFALETDG

SEQ ID NO: 1087499 - protein, 9 aa, Homo Sapiens
SAVCALENS

SEQ ID NO: 1087500 - protein, 9 aa, Homo Sapiens
SKQMRATGL

SEQ ID NO: 1087501 - protein, 9 aa, Homo Sapiens
MQWLDENKD

SEQ ID NO: 1087502 - protein, 9 aa, Homo Sapiens
SHGQCVICL

SEQ ID NO: 1087503 - protein, 9 aa, Homo Sapiens
NQTSGSDIT

SEQ ID NO: 1087504 - protein, 9 aa, Homo Sapiens
QFSGTMAKP

SEQ ID NO: 1087505 - protein, 9 aa, Homo Sapiens
AAIDFFQDA

SEQ ID NO: 1087506 - protein, 9 aa, Homo Sapiens
TSKRENIFP

SEQ ID NO: 1087507 - protein, 9 aa, Homo Sapiens
VILEISLRL

SEQ ID NO: 1087508 - protein, 9 aa, Homo Sapiens
FHVATSTLL

SEQ ID NO: 1087509 - protein, 9 aa, Homo Sapiens
PAQGKEIFE

SEQ ID NO: 1087510 - protein, 9 aa, Homo Sapiens
LGVGQVNAT

SEQ ID NO: 1087511 - protein, 9 aa, Homo Sapiens
QGKDNESDC

SEQ ID NO: 1087512 - protein, 9 aa, Homo Sapiens
SGYGLGETF

SEQ ID NO: 1087513 - protein, 9 aa, Homo Sapiens
TLGSAGHDI

SEQ ID NO: 1087514 - protein, 9 aa, Homo Sapiens
GHYTQVSQK

SEQ ID NO: 1087515 - protein, 9 aa, Homo Sapiens
ACCSLERCS

SEQ ID NO: 1087516 - protein, 9 aa, Homo Sapiens
VQPHSDAKV

SEQ ID NO: 1087517 - protein, 9 aa, Homo Sapiens
LKEVVSQNR

SEQ ID NO: 1087518 - protein, 9 aa, Homo Sapiens
PEGGGSLFM

SEQ ID NO: 1087519 - protein, 9 aa, Homo Sapiens
LKQFRLSLE

SEQ ID NO: 1087520 - protein, 9 aa, Homo Sapiens
FQTREFISL

SEQ ID NO: 1087521 - protein, 9 aa, Homo Sapiens
PHWTSENSH

SEQ ID NO: 1087522 - protein, 9 aa, Homo Sapiens
RVIGYSYYS

SEQ ID NO: 1087523 - protein, 9 aa, Homo Sapiens
KTQHHSYPA

SEQ ID NO: 1087524 - protein, 9 aa, Homo Sapiens
RPDTLWQCP

SEQ ID NO: 1087525 - protein, 9 aa, Homo Sapiens
ELRSEISVQ

SEQ ID NO: 1087526 - protein, 9 aa, Homo Sapiens
IQNSGLLSV

SEQ ID NO: 1087527 - protein, 9 aa, Homo Sapiens
KKKKKASVM

SEQ ID NO: 1087528 - protein, 9 aa, Homo Sapiens
KQFRLSLEE

SEQ ID NO: 1087529 - protein, 9 aa, Homo Sapiens
HQSSGPGRQ

SEQ ID NO: 1087530 - protein, 9 aa, Homo Sapiens
SILGDGNAT

SEQ ID NO: 1087531 - protein, 9 aa, Homo Sapiens
LLTPLPPGA

SEQ ID NO: 1087532 - protein, 9 aa, Homo Sapiens
FLAVILEIS

SEQ ID NO: 1087533 - protein, 9 aa, Homo Sapiens
PAVQPTFRV

SEQ ID NO: 1087534 - protein, 9 aa, Homo Sapiens
PLKGKNIST

SEQ ID NO: 1087535 - protein, 9 aa, Homo Sapiens
VPMPLLVLS

SEQ ID NO: 1087536 - protein, 9 aa, Homo Sapiens
STLLKVRPI

SEQ ID NO: 1087537 - protein, 9 aa, Homo Sapiens
MTNSNVRHS

SEQ ID NO: 1087538 - protein, 9 aa, Homo Sapiens
KGRIQLITE

SEQ ID NO: 1087539 - protein, 9 aa, Homo Sapiens
RNKRGSRAW

SEQ ID NO: 1087540 - protein, 9 aa, Homo Sapiens
TPSNGILRI

SEQ ID NO: 1087541 - protein, 9 aa, Homo Sapiens
RTINDFSYL

SEQ ID NO: 1087542 - protein, 9 aa, Homo Sapiens
LALGGTKAL

SEQ ID NO: 1087543 - protein, 9 aa, Homo Sapiens
KRGRDPNPK

SEQ ID NO: 1087544 - protein, 9 aa, Homo Sapiens
MESIRRIFK

SEQ ID NO: 1087545 - protein, 9 aa, Homo Sapiens
RIYLGGNEK

SEQ ID NO: 1087546 - protein, 9 aa, Homo Sapiens
GRVLFNGQD

SEQ ID NO: 1087547 - protein, 9 aa, Homo Sapiens
PVSQGAYYI

SEQ ID NO: 1087548 - protein, 9 aa, Homo Sapiens
KQNDSDCTL

SEQ ID NO: 1087549 - protein, 9 aa, Homo Sapiens
HSEEKPHWT

SEQ ID NO: 1087550 - protein, 9 aa, Homo Sapiens
DKKKKKASV

SEQ ID NO: 1087551 - protein, 9 aa, Homo Sapiens
AQEKKKLKV

SEQ ID NO: 1087552 - protein, 9 aa, Homo Sapiens
DFFQDAVKC

SEQ ID NO: 1087553 - protein, 9 aa, Homo Sapiens
RARRAYRPR

SEQ ID NO: 1087554 - protein, 9 aa, Homo Sapiens
SALGLDLCL

SEQ ID NO: 1087555 - protein, 9 aa, Homo Sapiens
ARRAYRPRD

SEQ ID NO: 1087556 - protein, 9 aa, Homo Sapiens
EEIYRTERD

SEQ ID NO: 1087557 - protein, 9 aa, Homo Sapiens
LIRRKVEKV

SEQ ID NO: 1087558 - protein, 9 aa, Homo Sapiens
DEMAKYDLS

SEQ ID NO: 1087559 - protein, 9 aa, Homo Sapiens
NMDKDEKWS

SEQ ID NO: 1087560 - protein, 9 aa, Homo Sapiens
SEIMWGYKD

SEQ ID NO: 1087561 - protein, 9 aa, Homo Sapiens
IQKIRYRSK

SEQ ID NO: 1087562 - protein, 9 aa, Homo Sapiens
TLRKPSGNH

SEQ ID NO: 1087563 - protein, 9 aa, Homo Sapiens
KKFTPPKSK

SEQ ID NO: 1087564 - protein, 9 aa, Homo Sapiens
NKEVFGQIT

SEQ ID NO: 1087565 - protein, 9 aa, Homo Sapiens
LDLNSPRDF

SEQ ID NO: 1087566 - protein, 9 aa, Homo Sapiens
SKAHPVAVA

SEQ ID NO: 1087567 - protein, 9 aa, Homo Sapiens
LGSSMEMED

SEQ ID NO: 1087568 - protein, 9 aa, Homo Sapiens
SLHTKAEAE

SEQ ID NO: 1087569 - protein, 9 aa, Homo Sapiens
SVQWETVFE

SEQ ID NO: 1087570 - protein, 9 aa, Homo Sapiens
QTEQKLKCE

SEQ ID NO: 1087571 - protein, 9 aa, Homo Sapiens
LETDGKKLR

SEQ ID NO: 1087572 - protein, 9 aa, Homo Sapiens
NISLIEGQR

SEQ ID NO: 1087573 - protein, 9 aa, Homo Sapiens
SFSLLSAET

SEQ ID NO: 1087574 - protein, 9 aa, Homo Sapiens
FSRIIHMLR

SEQ ID NO: 1087575 - protein, 9 aa, Homo Sapiens
RLVLTVKEK

SEQ ID NO: 1087576 - protein, 9 aa, Homo Sapiens
LDILDTAGK

SEQ ID NO: 1087577 - protein, 9 aa, Homo Sapiens
FHEEWLEVL

SEQ ID NO: 1087578 - protein, 9 aa, Homo Sapiens
VFLEGTKGG

SEQ ID NO: 1087579 - protein, 9 aa, Homo Sapiens
KHIKDNKNN

SEQ ID NO: 1087580 - protein, 9 aa, Homo Sapiens
MNSKQNDSD

SEQ ID NO: 1087581 - protein, 9 aa, Homo Sapiens
NKDRSVSSS

SEQ ID NO: 1087582 - protein, 9 aa, Homo Sapiens
NVQCPKRPD

SEQ ID NO: 1087583 - protein, 9 aa, Homo Sapiens
AGTKPKDSG

SEQ ID NO: 1087584 - protein, 9 aa, Homo Sapiens
EAHFFFFFF

SEQ ID NO: 1087585 - protein, 9 aa, Homo Sapiens
FCLRPRVLE

SEQ ID NO: 1087586 - protein, 9 aa, Homo Sapiens
RQKISFKIS

SEQ ID NO: 1087587 - protein, 9 aa, Homo Sapiens
FYHQRTLAM

SEQ ID NO: 1087588 - protein, 9 aa, Homo Sapiens
REKQFQLQS

SEQ ID NO: 1087589 - protein, 9 aa, Homo Sapiens
ITSPCFNLF

SEQ ID NO: 1087590 - protein, 9 aa, Homo Sapiens
ALCDMVRKE

SEQ ID NO: 1087591 - protein, 9 aa, Homo Sapiens
VSEEEFFRH

SEQ ID NO: 1087592 - protein, 9 aa, Homo Sapiens
EEQRIYLGG

SEQ ID NO: 1087593 - protein, 9 aa, Homo Sapiens
HELVTSKIV

SEQ ID NO: 1087594 - protein, 9 aa, Homo Sapiens
YYDETAQEF

SEQ ID NO: 1087595 - protein, 9 aa, Homo Sapiens
SNVGDQETS

SEQ ID NO: 1087596 - protein, 9 aa, Homo Sapiens
EEPDAFNPD

SEQ ID NO: 1087597 - protein, 9 aa, Homo Sapiens
QKISFKISI

SEQ ID NO: 1087598 - protein, 9 aa, Homo Sapiens
LKHMFRQLR

SEQ ID NO: 1087599 - protein, 9 aa, Homo Sapiens
QVRPRCGRL

SEQ ID NO: 1087600 - protein, 9 aa, Homo Sapiens
EQSANILKW

SEQ ID NO: 1087601 - protein, 9 aa, Homo Sapiens
SGSEKSSGF

SEQ ID NO: 1087602 - protein, 9 aa, Homo Sapiens
SHRLNRAEV

SEQ ID NO: 1087603 - protein, 9 aa, Homo Sapiens
AVNFTQKEW

SEQ ID NO: 1087604 - protein, 9 aa, Homo Sapiens
PSTMTGDLQ

SEQ ID NO: 1087605 - protein, 9 aa, Homo Sapiens
ITLRKPSGN

SEQ ID NO: 1087606 - protein, 9 aa, Homo Sapiens
LYLHLYCTF

SEQ ID NO: 1087607 - protein, 9 aa, Homo Sapiens
SVTSSIAGV

SEQ ID NO: 1087608 - protein, 9 aa, Homo Sapiens
EGSNRQWNY

SEQ ID NO: 1087609 - protein, 9 aa, Homo Sapiens
PEKEERPLR

SEQ ID NO: 1087610 - protein, 9 aa, Homo Sapiens
GKISKISFN

SEQ ID NO: 1087611 - protein, 9 aa, Homo Sapiens
RMSVKPVSS

SEQ ID NO: 1087612 - protein, 9 aa, Homo Sapiens
NESLQIRYK

SEQ ID NO: 1087613 - protein, 9 aa, Homo Sapiens
DSFFLDKVV

SEQ ID NO: 1087614 - protein, 9 aa, Homo Sapiens
IAHKVGITS

SEQ ID NO: 1087615 - protein, 9 aa, Homo Sapiens
HHHHLHHHQ

SEQ ID NO: 1087616 - protein, 9 aa, Homo Sapiens
AGYLELTDS

SEQ ID NO: 1087617 - protein, 9 aa, Homo Sapiens
KDRSVSSSS

SEQ ID NO: 1087618 - protein, 9 aa, Homo Sapiens
ACQIPCQND

SEQ ID NO: 1087619 - protein, 9 aa, Homo Sapiens
HHFPAAIDF

SEQ ID NO: 1087620 - protein, 9 aa, Homo Sapiens
SKKEGSNRQ

SEQ ID NO: 1087621 - protein, 9 aa, Homo Sapiens
AEAKRVLAE

SEQ ID NO: 1087622 - protein, 9 aa, Homo Sapiens
APEEESKQT

SEQ ID NO: 1087623 - protein, 9 aa, Homo Sapiens
RAEKPPQRP

SEQ ID NO: 1087624 - protein, 9 aa, Homo Sapiens
LPFISSTTC

SEQ ID NO: 1087625 - protein, 9 aa, Homo Sapiens
ALLLLLLTP

SEQ ID NO: 1087626 - protein, 9 aa, Homo Sapiens
ERRYGVSCV

SEQ ID NO: 1087627 - protein, 9 aa, Homo Sapiens
HGLLRIFGA

SEQ ID NO: 1087628 - protein, 9 aa, Homo Sapiens
NSKTDQNLE

SEQ ID NO: 1087629 - protein, 9 aa, Homo Sapiens
GTSSRRTDV

SEQ ID NO: 1087630 - protein, 9 aa, Homo Sapiens
PKEAPLKEA

SEQ ID NO: 1087631 - protein, 9 aa, Homo Sapiens
EGKEFPSCA

SEQ ID NO: 1087632 - protein, 9 aa, Homo Sapiens
APALAAPAP

SEQ ID NO: 1087633 - protein, 9 aa, Homo Sapiens
KQEAWSTHN

SEQ ID NO: 1087634 - protein, 9 aa, Homo Sapiens
AWASKDTSK

SEQ ID NO: 1087635 - protein, 9 aa, Homo Sapiens
KVKEKRIIL

SEQ ID NO: 1087636 - protein, 9 aa, Homo Sapiens
QEPLGHINF

SEQ ID NO: 1087637 - protein, 9 aa, Homo Sapiens
KKGSDKKTT

SEQ ID NO: 1087638 - protein, 9 aa, Homo Sapiens
HTKAEAEAP

SEQ ID NO: 1087639 - protein, 9 aa, Homo Sapiens
ESGSEKSSG

SEQ ID NO: 1087640 - protein, 9 aa, Homo Sapiens
QPTFRVLVG

SEQ ID NO: 1087641 - protein, 9 aa, Homo Sapiens
SAEGGKEVL

SEQ ID NO: 1087642 - protein, 9 aa, Homo Sapiens
LVLTQEELL

SEQ ID NO: 1087643 - protein, 9 aa, Homo Sapiens
TWVQGPDLN

SEQ ID NO: 1087644 - protein, 9 aa, Homo Sapiens
DSYFSDRHL

SEQ ID NO: 1087645 - protein, 9 aa, Homo Sapiens
KDETSADLV

SEQ ID NO: 1087646 - protein, 9 aa, Homo Sapiens
RKPSGNHTP

SEQ ID NO: 1087647 - protein, 9 aa, Homo Sapiens
ESQYLLVSN

SEQ ID NO: 1087648 - protein, 9 aa, Homo Sapiens
SKRFQISWK

SEQ ID NO: 1087649 - protein, 9 aa, Homo Sapiens
ILDTAGKEE

SEQ ID NO: 1087650 - protein, 9 aa, Homo Sapiens
RSFQAGELI

SEQ ID NO: 1087651 - protein, 9 aa, Homo Sapiens
DVLYLHLYC

SEQ ID NO: 1087652 - protein, 9 aa, Homo Sapiens
IDFFQDAVK

SEQ ID NO: 1087653 - protein, 9 aa, Homo Sapiens
ESHGALSIS

SEQ ID NO: 1087654 - protein, 9 aa, Homo Sapiens
GEKNKDETS

SEQ ID NO: 1087655 - protein, 9 aa, Homo Sapiens
AVYKECQQS

SEQ ID NO: 1087656 - protein, 9 aa, Homo Sapiens
TSKIVLRKD

SEQ ID NO: 1087657 - protein, 9 aa, Homo Sapiens
MVSLPLRSG

SEQ ID NO: 1087658 - protein, 9 aa, Homo Sapiens
LPGISVLMI

SEQ ID NO: 1087659 - protein, 9 aa, Homo Sapiens
SYQSAGDSK

SEQ ID NO: 1087660 - protein, 9 aa, Homo Sapiens
DSDCTLDGF

SEQ ID NO: 1087661 - protein, 9 aa, Homo Sapiens
KALSTCISY

SEQ ID NO: 1087662 - protein, 9 aa, Homo Sapiens
TSEIESPTD

SEQ ID NO: 1087663 - protein, 9 aa, Homo Sapiens
QAAQEKKKL

SEQ ID NO: 1087664 - protein, 9 aa, Homo Sapiens
ARPGRRAEK

SEQ ID NO: 1087665 - protein, 9 aa, Homo Sapiens
KISKISFNP

SEQ ID NO: 1087666 - protein, 9 aa, Homo Sapiens
GSVKTSTTD

SEQ ID NO: 1087667 - protein, 9 aa, Homo Sapiens
EEHSRILFQ

SEQ ID NO: 1087668 - protein, 9 aa, Homo Sapiens
SSLGSSMEM

SEQ ID NO: 1087669 - protein, 9 aa, Homo Sapiens
NWLQHRETV

SEQ ID NO: 1087670 - protein, 9 aa, Homo Sapiens
SSAFDHSPN

SEQ ID NO: 1087671 - protein, 9 aa, Homo Sapiens
PHSGKRSCQ

SEQ ID NO: 1087672 - protein, 9 aa, Homo Sapiens
DLNSKAGLR

SEQ ID NO: 1087673 - protein, 9 aa, Homo Sapiens
PEVPKKVKE

SEQ ID NO: 1087674 - protein, 9 aa, Homo Sapiens
PKRLFFSSI

SEQ ID NO: 1087675 - protein, 9 aa, Homo Sapiens
LPNTLPVSG

SEQ ID NO: 1087676 - protein, 9 aa, Homo Sapiens
GSLFMELGV

SEQ ID NO: 1087677 - protein, 9 aa, Homo Sapiens
SRILFQRSS

SEQ ID NO: 1087678 - protein, 9 aa, Homo Sapiens
LQNGRVAHH

SEQ ID NO: 1087679 - protein, 9 aa, Homo Sapiens
TLESNSSPE

SEQ ID NO: 1087680 - protein, 9 aa, Homo Sapiens
IQEPLGHIN

SEQ ID NO: 1087681 - protein, 9 aa, Homo Sapiens
PPSTMTGDL

SEQ ID NO: 1087682 - protein, 9 aa, Homo Sapiens
PLLVILNDE

SEQ ID NO: 1087683 - protein, 9 aa, Homo Sapiens
KPKDSGVVP

SEQ ID NO: 1087684 - protein, 9 aa, Homo Sapiens
KKELFKSPE

SEQ ID NO: 1087685 - protein, 9 aa, Homo Sapiens
ASDFIEEIY

SEQ ID NO: 1087686 - protein, 9 aa, Homo Sapiens
AENMPVFLE

SEQ ID NO: 1087687 - protein, 9 aa, Homo Sapiens
SMDEVLNIL

SEQ ID NO: 1087688 - protein, 9 aa, Homo Sapiens
ANKGFGIVF

SEQ ID NO: 1087689 - protein, 9 aa, Homo Sapiens
KEVLTIEVK

SEQ ID NO: 1087690 - protein, 9 aa, Homo Sapiens
GPGRQGSGS

SEQ ID NO: 1087691 - protein, 9 aa, Homo Sapiens
EQRIYLGGN

SEQ ID NO: 1087692 - protein, 9 aa, Homo Sapiens
EKTKKQASH

SEQ ID NO: 1087693 - protein, 9 aa, Homo Sapiens
LMPWVLDCT

SEQ ID NO: 1087694 - protein, 9 aa, Homo Sapiens
QPFQRCSCF

SEQ ID NO: 1087695 - protein, 9 aa, Homo Sapiens
NALVDDVIL

SEQ ID NO: 1087696 - protein, 9 aa, Homo Sapiens
KVGITSPCF

SEQ ID NO: 1087697 - protein, 9 aa, Homo Sapiens
AQVRPRCGR

SEQ ID NO: 1087698 - protein, 9 aa, Homo Sapiens
ASVAEKTKK

SEQ ID NO: 1087699 - protein, 9 aa, Homo Sapiens
LLRIFGAAQ

SEQ ID NO: 1087700 - protein, 9 aa, Homo Sapiens
RREGLTPSN

SEQ ID NO: 1087701 - protein, 9 aa, Homo Sapiens
QWLDENKDV

SEQ ID NO: 1087702 - protein, 9 aa, Homo Sapiens
VAEDPAKSF

SEQ ID NO: 1087703 - protein, 9 aa, Homo Sapiens
RVGFISWAG

SEQ ID NO: 1087704 - protein, 9 aa, Homo Sapiens
YGSSLKAYT

SEQ ID NO: 1087705 - protein, 9 aa, Homo Sapiens
ASCSLAGAS

SEQ ID NO: 1087706 - protein, 9 aa, Homo Sapiens
SMEMEDALS

SEQ ID NO: 1087707 - protein, 9 aa, Homo Sapiens
EQWISFQNK

SEQ ID NO: 1087708 - protein, 9 aa, Homo Sapiens
PHLETPLYV

SEQ ID NO: 1087709 - protein, 9 aa, Homo Sapiens
FDVNDNAPA

SEQ ID NO: 1087710 - protein, 9 aa, Homo Sapiens
GPTSTESHG

SEQ ID NO: 1087711 - protein, 9 aa, Homo Sapiens
NPALLDPGT

SEQ ID NO: 1087712 - protein, 9 aa, Homo Sapiens
ATEHKKELF

SEQ ID NO: 1087713 - protein, 9 aa, Homo Sapiens
RPQFSWHDD

SEQ ID NO: 1087714 - protein, 9 aa, Homo Sapiens
YPVSQGAYY

SEQ ID NO: 1087715 - protein, 9 aa, Homo Sapiens
KMRVAALTH

SEQ ID NO: 1087716 - protein, 9 aa, Homo Sapiens
PRSKQEAWS

SEQ ID NO: 1087717 - protein, 9 aa, Homo Sapiens
PRPGRLPLQ

SEQ ID NO: 1087718 - protein, 9 aa, Homo Sapiens
SQYLLVSNG

SEQ ID NO: 1087719 - protein, 9 aa, Homo Sapiens
KTQLKQHIS

SEQ ID NO: 1087720 - protein, 9 aa, Homo Sapiens
EEWKQLESD

SEQ ID NO: 1087721 - protein, 9 aa, Homo Sapiens
KEQKQRDRE

SEQ ID NO: 1087722 - protein, 9 aa, Homo Sapiens
YILVVMSKL

SEQ ID NO: 1087723 - protein, 9 aa, Homo Sapiens
LMTNSNVRH

SEQ ID NO: 1087724 - protein, 9 aa, Homo Sapiens
LVGERFSLG

SEQ ID NO: 1087725 - protein, 9 aa, Homo Sapiens
GKELRVIQE

SEQ ID NO: 1087726 - protein, 9 aa, Homo Sapiens
ATRQNGPRG

SEQ ID NO: 1087727 - protein, 9 aa, Homo Sapiens
RGSRAWASK

SEQ ID NO: 1087728 - protein, 9 aa, Homo Sapiens
TAQEFVDEF

SEQ ID NO: 1087729 - protein, 9 aa, Homo Sapiens
TLAFQTEQK

SEQ ID NO: 1087730 - protein, 9 aa, Homo Sapiens
SGKELRVIQ

SEQ ID NO: 1087731 - protein, 9 aa, Homo Sapiens
SCSLAGASC

SEQ ID NO: 1087732 - protein, 9 aa, Homo Sapiens
HHHHHHHLH

SEQ ID NO: 1087733 - protein, 9 aa, Homo Sapiens
PDSNLEVVL

SEQ ID NO: 1087734 - protein, 9 aa, Homo Sapiens
KYVQQKDEQ

SEQ ID NO: 1087735 - protein, 9 aa, Homo Sapiens
PLLYNLRNK

SEQ ID NO: 1087736 - protein, 9 aa, Homo Sapiens
PLNISLIEG

SEQ ID NO: 1087737 - protein, 9 aa, Homo Sapiens
QCPKRPDTL

SEQ ID NO: 1087738 - protein, 9 aa, Homo Sapiens
TLLNSPASA

SEQ ID NO: 1087739 - protein, 9 aa, Homo Sapiens
KYNLNSGAV

SEQ ID NO: 1087740 - protein, 9 aa, Homo Sapiens
LKFEQDGIS

SEQ ID NO: 1087741 - protein, 9 aa, Homo Sapiens
RLPFISSTT

SEQ ID NO: 1087742 - protein, 9 aa, Homo Sapiens
CPQDTIISK

SEQ ID NO: 1087743 - protein, 9 aa, Homo Sapiens
SARSLPGLA

SEQ ID NO: 1087744 - protein, 9 aa, Homo Sapiens
ENERKQSPE

SEQ ID NO: 1087745 - protein, 9 aa, Homo Sapiens
DNLLPILRK

SEQ ID NO: 1087746 - protein, 9 aa, Homo Sapiens
RFQGRKIVN

SEQ ID NO: 1087747 - protein, 9 aa, Homo Sapiens
YRPRDQAAA

SEQ ID NO: 1087748 - protein, 9 aa, Homo Sapiens
YGVSCVHDM

SEQ ID NO: 1087749 - protein, 9 aa, Homo Sapiens
RLRDVQALC

SEQ ID NO: 1087750 - protein, 9 aa, Homo Sapiens
VPAQGKEIF

SEQ ID NO: 1087751 - protein, 9 aa, Homo Sapiens
NVGDQETSS

SEQ ID NO: 1087752 - protein, 9 aa, Homo Sapiens
AARLVLTQE

SEQ ID NO: 1087753 - protein, 9 aa, Homo Sapiens
LLLEPWRPG

SEQ ID NO: 1087754 - protein, 9 aa, Homo Sapiens
RHHRIYTGE

SEQ ID NO: 1087755 - protein, 9 aa, Homo Sapiens
LEQYYDSSD

SEQ ID NO: 1087756 - protein, 9 aa, Homo Sapiens
PSEMPGNEV

SEQ ID NO: 1087757 - protein, 9 aa, Homo Sapiens
LLQTYLSQL

SEQ ID NO: 1087758 - protein, 9 aa, Homo Sapiens
KKFSSKKKK

SEQ ID NO: 1087759 - protein, 9 aa, Homo Sapiens
DNVQCPKRP

SEQ ID NO: 1087760 - protein, 9 aa, Homo Sapiens
ARQRAEAKR

SEQ ID NO: 1087761 - protein, 9 aa, Homo Sapiens
KQEKGKKKQ

SEQ ID NO: 1087762 - protein, 9 aa, Homo Sapiens
PIVAGIIAL

SEQ ID NO: 1087763 - protein, 9 aa, Homo Sapiens
FTLLHVFII

SEQ ID NO: 1087764 - protein, 9 aa, Homo Sapiens
VLMTNSNVR

SEQ ID NO: 1087765 - protein, 9 aa, Homo Sapiens
ILFQRSSQA

SEQ ID NO: 1087766 - protein, 9 aa, Homo Sapiens
TEEEKWSPE

SEQ ID NO: 1087767 - protein, 9 aa, Homo Sapiens
SGSPERAES

SEQ ID NO: 1087768 - protein, 9 aa, Homo Sapiens
VQALCDMVR

SEQ ID NO: 1087769 - protein, 9 aa, Homo Sapiens
YLGGNEKQR

SEQ ID NO: 1087770 - protein, 9 aa, Homo Sapiens
ENICSICQE

SEQ ID NO: 1087771 - protein, 9 aa, Homo Sapiens
GGIVGDIES

SEQ ID NO: 1087772 - protein, 9 aa, Homo Sapiens
DLKISSKID

SEQ ID NO: 1087773 - protein, 9 aa, Homo Sapiens
FFQVSELVL

SEQ ID NO: 1087774 - protein, 9 aa, Homo Sapiens
KPSGNHTPP

SEQ ID NO: 1087775 - protein, 9 aa, Homo Sapiens
LRNFFFLEV

SEQ ID NO: 1087776 - protein, 9 aa, Homo Sapiens
LLCPRHHCA

SEQ ID NO: 1087777 - protein, 9 aa, Homo Sapiens
CDTCHFSIL

SEQ ID NO: 1087778 - protein, 9 aa, Homo Sapiens
SLEETELEK

SEQ ID NO: 1087779 - protein, 9 aa, Homo Sapiens
INKERNEET

SEQ ID NO: 1087780 - protein, 9 aa, Homo Sapiens
GGDSGVYQC

SEQ ID NO: 1087781 - protein, 9 aa, Homo Sapiens
VFPQTLAAT

SEQ ID NO: 1087782 - protein, 9 aa, Homo Sapiens
WLESLQIAF

SEQ ID NO: 1087783 - protein, 9 aa, Homo Sapiens
WEVGSGQLC

SEQ ID NO: 1087784 - protein, 9 aa, Homo Sapiens
KVAELVYFL

SEQ ID NO: 1087785 - protein, 9 aa, Homo Sapiens
FPPSYILVV

SEQ ID NO: 1087786 - protein, 9 aa, Homo Sapiens
TDNNISHGQ

SEQ ID NO: 1087787 - protein, 9 aa, Homo Sapiens
RFQISWKHA

SEQ ID NO: 1087788 - protein, 9 aa, Homo Sapiens
RNFFFLEVS

SEQ ID NO: 1087789 - protein, 9 aa, Homo Sapiens
SNLEVVLNN

SEQ ID NO: 1087790 - protein, 9 aa, Homo Sapiens
IYANRARNI

SEQ ID NO: 1087791 - protein, 9 aa, Homo Sapiens
GLAGPAELE

SEQ ID NO: 1087792 - protein, 9 aa, Homo Sapiens
IYPLWVITA

SEQ ID NO: 1087793 - protein, 9 aa, Homo Sapiens
PSAAPALAA

SEQ ID NO: 1087794 - protein, 9 aa, Homo Sapiens
KPVQQITKY

SEQ ID NO: 1087795 - protein, 9 aa, Homo Sapiens
QGLIFLRIL

SEQ ID NO: 1087796 - protein, 9 aa, Homo Sapiens
ENWLQHRET

SEQ ID NO: 1087797 - protein, 9 aa, Homo Sapiens
TPEQSANIL

SEQ ID NO: 1087798 - protein, 8 aa, Homo Sapiens
EKILILLL

SEQ ID NO: 1087799 - protein, 9 aa, Homo Sapiens
EAPAPEEES

SEQ ID NO: 1087800 - protein, 9 aa, Homo Sapiens
SQFSGTMAK

SEQ ID NO: 1087801 - protein, 9 aa, Homo Sapiens
LIFCLRPRV

SEQ ID NO: 1087802 - protein, 9 aa, Homo Sapiens
SDPKLAVLM

SEQ ID NO: 1087803 - protein, 9 aa, Homo Sapiens
GVSCVHDMD

SEQ ID NO: 1087804 - protein, 9 aa, Homo Sapiens
TLAKKSRGL

SEQ ID NO: 1087805 - protein, 9 aa, Homo Sapiens
LCYPASKAH

SEQ ID NO: 1087806 - protein, 9 aa, Homo Sapiens
LNSPASAAV

SEQ ID NO: 1087807 - protein, 9 aa, Homo Sapiens
WWEAHFFFF

SEQ ID NO: 1087808 - protein, 9 aa, Homo Sapiens
LSDVSSECD

SEQ ID NO: 1087809 - protein, 9 aa, Homo Sapiens
VEQEISRVL

SEQ ID NO: 1087810 - protein, 9 aa, Homo Sapiens
FFVPGGHNL

SEQ ID NO: 1087811 - protein, 9 aa, Homo Sapiens
EEYIRFYME

SEQ ID NO: 1087812 - protein, 9 aa, Homo Sapiens
LLYNLRNKD

SEQ ID NO: 1087813 - protein, 9 aa, Homo Sapiens
WTSFLLGVN

SEQ ID NO: 1087814 - protein, 9 aa, Homo Sapiens
SPTSQGPAQ

SEQ ID NO: 1087815 - protein, 9 aa, Homo Sapiens
ISLIEGQRC

SEQ ID NO: 1087816 - protein, 9 aa, Homo Sapiens
SSPTSEADE

SEQ ID NO: 1087817 - protein, 9 aa, Homo Sapiens
SQLFYHLRE

SEQ ID NO: 1087818 - protein, 9 aa, Homo Sapiens
RCDTQNKDR

SEQ ID NO: 1087819 - protein, 9 aa, Homo Sapiens
KQSPEKPRS

SEQ ID NO: 1087820 - protein, 9 aa, Homo Sapiens
SNRQWNYAC

SEQ ID NO: 1087821 - protein, 9 aa, Homo Sapiens
EGLTPSNGI

SEQ ID NO: 1087822 - protein, 9 aa, Homo Sapiens
LSVIIAKNE

SEQ ID NO: 1087823 - protein, 9 aa, Homo Sapiens
ARITGTSSR

SEQ ID NO: 1087824 - protein, 9 aa, Homo Sapiens
LFLGPMTLL

SEQ ID NO: 1087825 - protein, 9 aa, Homo Sapiens
KFQHFNLVL

SEQ ID NO: 1087826 - protein, 9 aa, Homo Sapiens
AKAPLETSP

SEQ ID NO: 1087827 - protein, 9 aa, Homo Sapiens
NISHGQCVI

SEQ ID NO: 1087828 - protein, 9 aa, Homo Sapiens
SFLLGVNIQ

SEQ ID NO: 1087829 - protein, 9 aa, Homo Sapiens
EIFLQMKRV

SEQ ID NO: 1087830 - protein, 9 aa, Homo Sapiens
SDFESSSDS

SEQ ID NO: 1087831 - protein, 9 aa, Homo Sapiens
HVYYTTAEL

SEQ ID NO: 1087832 - protein, 9 aa, Homo Sapiens
MVQLLQDLD

SEQ ID NO: 1087833 - protein, 9 aa, Homo Sapiens
QLESDLWLI

SEQ ID NO: 1087834 - protein, 9 aa, Homo Sapiens
TPLPPGAPP

SEQ ID NO: 1087835 - protein, 9 aa, Homo Sapiens
PIGSETSLS

SEQ ID NO: 1087836 - protein, 9 aa, Homo Sapiens
VTKVDKVVA

SEQ ID NO: 1087837 - protein, 9 aa, Homo Sapiens
VLNDFYKCI

SEQ ID NO: 1087838 - protein, 9 aa, Homo Sapiens
LRVGFISWA

SEQ ID NO: 1087839 - protein, 9 aa, Homo Sapiens
GDQICLRLH

SEQ ID NO: 1087840 - protein, 9 aa, Homo Sapiens
GVQPKQVTC

SEQ ID NO: 1087841 - protein, 9 aa, Homo Sapiens
FKIVSQKPA

SEQ ID NO: 1087842 - protein, 9 aa, Homo Sapiens
PEDDLDLEP

SEQ ID NO: 1087843 - protein, 9 aa, Homo Sapiens
FESSSDSEG

SEQ ID NO: 1087844 - protein, 9 aa, Homo Sapiens
TPAVYKECQ

SEQ ID NO: 1087845 - protein, 9 aa, Homo Sapiens
LQDLDYLHG

SEQ ID NO: 1087846 - protein, 9 aa, Homo Sapiens
VALTKEVAI

SEQ ID NO: 1087847 - protein, 9 aa, Homo Sapiens
FQTEQKLKC

SEQ ID NO: 1087848 - protein, 9 aa, Homo Sapiens
DQNLEKAEE

SEQ ID NO: 1087849 - protein, 9 aa, Homo Sapiens
QWETVFETA

SEQ ID NO: 1087850 - protein, 9 aa, Homo Sapiens
SSPELGDIS

SEQ ID NO: 1087851 - protein, 9 aa, Homo Sapiens
EAEGDLGNR

SEQ ID NO: 1087852 - protein, 9 aa, Homo Sapiens
QTSEIESPT

SEQ ID NO: 1087853 - protein, 9 aa, Homo Sapiens
EKAEEKTKV

SEQ ID NO: 1087854 - protein, 9 aa, Homo Sapiens
KKASVMIQN

SEQ ID NO: 1087855 - protein, 9 aa, Homo Sapiens
SLNSQIKNL

SEQ ID NO: 1087856 - protein, 9 aa, Homo Sapiens
TDQNLEKAE

SEQ ID NO: 1087857 - protein, 9 aa, Homo Sapiens
EDPNCAGIK

SEQ ID NO: 1087858 - protein, 9 aa, Homo Sapiens
KELRVIQES

SEQ ID NO: 1087859 - protein, 9 aa, Homo Sapiens
EEALYNSIE

SEQ ID NO: 1087860 - protein, 9 aa, Homo Sapiens
TKPALVLMK

SEQ ID NO: 1087861 - protein, 9 aa, Homo Sapiens
ISSKIDASL

SEQ ID NO: 1087862 - protein, 9 aa, Homo Sapiens
PEAPHSGKR

SEQ ID NO: 1087863 - protein, 9 aa, Homo Sapiens
ALKHMFRQL

SEQ ID NO: 1087864 - protein, 9 aa, Homo Sapiens
SYPVSQGAY

SEQ ID NO: 1087865 - protein, 9 aa, Homo Sapiens
RATSLRDED

SEQ ID NO: 1087866 - protein, 9 aa, Homo Sapiens
GPLNISLIE

SEQ ID NO: 1087867 - protein, 9 aa, Homo Sapiens
FGGVECFLL

SEQ ID NO: 1087868 - protein, 9 aa, Homo Sapiens
PSILHVPGY

SEQ ID NO: 1087869 - protein, 9 aa, Homo Sapiens
VAVNFTQKE

SEQ ID NO: 1087870 - protein, 9 aa, Homo Sapiens
SMVHGATPA

SEQ ID NO: 1087871 - protein, 9 aa, Homo Sapiens
PGLPGDPIA

SEQ ID NO: 1087872 - protein, 9 aa, Homo Sapiens
TLLKVRPIE

SEQ ID NO: 1087873 - protein, 9 aa, Homo Sapiens
QSSGPGRQG

SEQ ID NO: 1087874 - protein, 9 aa, Homo Sapiens
SMASSIWWI

SEQ ID NO: 1087875 - protein, 9 aa, Homo Sapiens
GFSDSSQQP

SEQ ID NO: 1087876 - protein, 9 aa, Homo Sapiens
VHWHKGRLC

SEQ ID NO: 1087877 - protein, 9 aa, Homo Sapiens
EKWSFCADT

SEQ ID NO: 1087878 - protein, 9 aa, Homo Sapiens
SEEDLDALK

SEQ ID NO: 1087879 - protein, 9 aa, Homo Sapiens
TWTSFLLGV

SEQ ID NO: 1087880 - protein, 9 aa, Homo Sapiens
RIFKITTQF

SEQ ID NO: 1087881 - protein, 9 aa, Homo Sapiens
VKILENLCG

SEQ ID NO: 1087882 - protein, 9 aa, Homo Sapiens
ADFADDKNS

SEQ ID NO: 1087883 - protein, 9 aa, Homo Sapiens
FTPPKSKKF

SEQ ID NO: 1087884 - protein, 9 aa, Homo Sapiens
DGDLGLISS

SEQ ID NO: 1087885 - protein, 9 aa, Homo Sapiens
QQSLHTKAE

SEQ ID NO: 1087886 - protein, 9 aa, Homo Sapiens
ARLVLTQEE

SEQ ID NO: 1087887 - protein, 9 aa, Homo Sapiens
ERKQSPEKP

SEQ ID NO: 1087888 - protein, 9 aa, Homo Sapiens
PHAVLCLEV

SEQ ID NO: 1087889 - protein, 9 aa, Homo Sapiens
SCPSPCGKY

SEQ ID NO: 1087890 - protein, 9 aa, Homo Sapiens
DPEGGGSLF

SEQ ID NO: 1087891 - protein, 9 aa, Homo Sapiens
IFSKKEGSN

SEQ ID NO: 1087892 - protein, 9 aa, Homo Sapiens
FSDSSQQPP

SEQ ID NO: 1087893 - protein, 9 aa, Homo Sapiens
EVICSQGGK

SEQ ID NO: 1087894 - protein, 9 aa, Homo Sapiens
ISRDLAMCV

SEQ ID NO: 1087895 - protein, 9 aa, Homo Sapiens
AINIRDVFI

SEQ ID NO: 1087896 - protein, 9 aa, Homo Sapiens
PIVSQFSGT

SEQ ID NO: 1087897 - protein, 9 aa, Homo Sapiens
ILLFGGVEC

SEQ ID NO: 1087898 - protein, 9 aa, Homo Sapiens
STGHTTPFP

SEQ ID NO: 1087899 - protein, 9 aa, Homo Sapiens
EKPLGVGSV

SEQ ID NO: 1087900 - protein, 9 aa, Homo Sapiens
GEKPYHCNP

SEQ ID NO: 1087901 - protein, 9 aa, Homo Sapiens
FDAVFLDLF

SEQ ID NO: 1087902 - protein, 9 aa, Homo Sapiens
TFQGLIFLR

SEQ ID NO: 1087903 - protein, 9 aa, Homo Sapiens
FKITTQFGV

SEQ ID NO: 1087904 - protein, 9 aa, Homo Sapiens
PAVYKECQQ

SEQ ID NO: 1087905 - protein, 9 aa, Homo Sapiens
TSFPVETVI

SEQ ID NO: 1087906 - protein, 9 aa, Homo Sapiens
IGSETSLSS

SEQ ID NO: 1087907 - protein, 9 aa, Homo Sapiens
STMTGDLQP

SEQ ID NO: 1087908 - protein, 9 aa, Homo Sapiens
SLFMELGVS

SEQ ID NO: 1087909 - protein, 9 aa, Homo Sapiens
SSDEPIAEA

SEQ ID NO: 1087910 - protein, 9 aa, Homo Sapiens
ADDKNSTAG

SEQ ID NO: 1087911 - protein, 9 aa, Homo Sapiens
SGSSDFESS

SEQ ID NO: 1087912 - protein, 9 aa, Homo Sapiens
GVGLEEEEG

SEQ ID NO: 1087913 - protein, 9 aa, Homo Sapiens
SLQIAFQQH

SEQ ID NO: 1087914 - protein, 9 aa, Homo Sapiens
LENALVDDV

SEQ ID NO: 1087915 - protein, 9 aa, Homo Sapiens
HDPHYFEEP

SEQ ID NO: 1087916 - protein, 9 aa, Homo Sapiens
ALETDGKKL

SEQ ID NO: 1087917 - protein, 9 aa, Homo Sapiens
KMPIKKKEM

SEQ ID NO: 1087918 - protein, 9 aa, Homo Sapiens
HEEWLEVLG

SEQ ID NO: 1087919 - protein, 9 aa, Homo Sapiens
HVATSTLLK

SEQ ID NO: 1087920 - protein, 9 aa, Homo Sapiens
SDKKTTVTD

SEQ ID NO: 1087921 - protein, 9 aa, Homo Sapiens
KDDLDNVED

SEQ ID NO: 1087922 - protein, 9 aa, Homo Sapiens
RALKQFRLS

SEQ ID NO: 1087923 - protein, 9 aa, Homo Sapiens
KKKLKVEDE

SEQ ID NO: 1087924 - protein, 9 aa, Homo Sapiens
SVLALYRSI

SEQ ID NO: 1087925 - protein, 9 aa, Homo Sapiens
NEVPVEEHF

SEQ ID NO: 1087926 - protein, 9 aa, Homo Sapiens
PVKTQHHSY

SEQ ID NO: 1087927 - protein, 9 aa, Homo Sapiens
SSGPGRQGS

SEQ ID NO: 1087928 - protein, 9 aa, Homo Sapiens
GISVLMIFP

SEQ ID NO: 1087929 - protein, 9 aa, Homo Sapiens
YECDEWQML

SEQ ID NO: 1087930 - protein, 9 aa, Homo Sapiens
LYEIFLQMK

SEQ ID NO: 1087931 - protein, 9 aa, Homo Sapiens
DEAEGDLGN

SEQ ID NO: 1087932 - protein, 9 aa, Homo Sapiens
NFNRGPLPL

SEQ ID NO: 1087933 - protein, 9 aa, Homo Sapiens
IDQGEKNKD

SEQ ID NO: 1087934 - protein, 9 aa, Homo Sapiens
GIYLLAFQA

SEQ ID NO: 1087935 - protein, 9 aa, Homo Sapiens
AYEELLDNQ

SEQ ID NO: 1087936 - protein, 9 aa, Homo Sapiens
SAENVYDCQ

SEQ ID NO: 1087937 - protein, 9 aa, Homo Sapiens
SKKFSSKKK

SEQ ID NO: 1087938 - protein, 9 aa, Homo Sapiens
ISEAEWVHW

SEQ ID NO: 1087939 - protein, 9 aa, Homo Sapiens
LCPRHHCAL

SEQ ID NO: 1087940 - protein, 9 aa, Homo Sapiens
ARSLPGLAP

SEQ ID NO: 1087941 - protein, 9 aa, Homo Sapiens
QHVTKVDKV

SEQ ID NO: 1087942 - protein, 9 aa, Homo Sapiens
PQDTIISKG

SEQ ID NO: 1087943 - protein, 9 aa, Homo Sapiens
PHSRSFMAS

SEQ ID NO: 1087944 - protein, 9 aa, Homo Sapiens
SILRGIFFV

SEQ ID NO: 1087945 - protein, 9 aa, Homo Sapiens
RDSYFSDRH

SEQ ID NO: 1087946 - protein, 9 aa, Homo Sapiens
LTQEELLAN

SEQ ID NO: 1087947 - protein, 9 aa, Homo Sapiens
EEEEEDWSR

SEQ ID NO: 1087948 - protein, 9 aa, Homo Sapiens
VYYTTAELR

SEQ ID NO: 1087949 - protein, 9 aa, Homo Sapiens
SKQNDSDCT

SEQ ID NO: 1087950 - protein, 9 aa, Homo Sapiens
PSAAESQRK

SEQ ID NO: 1087951 - protein, 9 aa, Homo Sapiens
GKMWIFSNL

SEQ ID NO: 1087952 - protein, 9 aa, Homo Sapiens
PEIHGNLVM

SEQ ID NO: 1087953 - protein, 9 aa, Homo Sapiens
DNESDCRSG

SEQ ID NO: 1087954 - protein, 9 aa, Homo Sapiens
LDTAGKEEY

SEQ ID NO: 1087955 - protein, 9 aa, Homo Sapiens
KNKDETSAD

SEQ ID NO: 1087956 - protein, 9 aa, Homo Sapiens
VKDKNRGPT

SEQ ID NO: 1087957 - protein, 9 aa, Homo Sapiens
GYSYYSIKW

SEQ ID NO: 1087958 - protein, 9 aa, Homo Sapiens
FPQTLAATL

SEQ ID NO: 1087959 - protein, 9 aa, Homo Sapiens
FVVLETTEK

SEQ ID NO: 1087960 - protein, 9 aa, Homo Sapiens
GRGTRVPSE

SEQ ID NO: 1087961 - protein, 9 aa, Homo Sapiens
ETVTETEEI

SEQ ID NO: 1087962 - protein, 9 aa, Homo Sapiens
TVLENLGMI

SEQ ID NO: 1087963 - protein, 9 aa, Homo Sapiens
HNITVLVFD

SEQ ID NO: 1087964 - protein, 9 aa, Homo Sapiens
IFFEGCMTQ

SEQ ID NO: 1087965 - protein, 9 aa, Homo Sapiens
LNDFYKCIY

SEQ ID NO: 1087966 - protein, 9 aa, Homo Sapiens
LNVTAKAFS

SEQ ID NO: 1087967 - protein, 9 aa, Homo Sapiens
LGEEWKQLE

SEQ ID NO: 1087968 - protein, 9 aa, Homo Sapiens
VFLALGGTK

SEQ ID NO: 1087969 - protein, 9 aa, Homo Sapiens
PFVPSAENV

SEQ ID NO: 1087970 - protein, 9 aa, Homo Sapiens
TSVSAPIVA

SEQ ID NO: 1087971 - protein, 9 aa, Homo Sapiens
YTTAELRSE

SEQ ID NO: 1087972 - protein, 9 aa, Homo Sapiens
PGKIPRGFR

SEQ ID NO: 1087973 - protein, 9 aa, Homo Sapiens
EKWSPELPV

SEQ ID NO: 1087974 - protein, 9 aa, Homo Sapiens
ARKNHPQFL

SEQ ID NO: 1087975 - protein, 9 aa, Homo Sapiens
KEEDVFKFL

SEQ ID NO: 1087976 - protein, 9 aa, Homo Sapiens
FTQKEWALL

SEQ ID NO: 1087977 - protein, 9 aa, Homo Sapiens
RAEAKRVLA

SEQ ID NO: 1087978 - protein, 9 aa, Homo Sapiens
LSQLFYHLR

SEQ ID NO: 1087979 - protein, 9 aa, Homo Sapiens
WSNQTFSGL

SEQ ID NO: 1087980 - protein, 9 aa, Homo Sapiens
LTSNVGDQE

SEQ ID NO: 1087981 - protein, 9 aa, Homo Sapiens
YLHQGKDNE

SEQ ID NO: 1087982 - protein, 9 aa, Homo Sapiens
IEEIYRTER

SEQ ID NO: 1087983 - protein, 9 aa, Homo Sapiens
HLAANKGYL

SEQ ID NO: 1087984 - protein, 9 aa, Homo Sapiens
TTKNYPNAG

SEQ ID NO: 1087985 - protein, 9 aa, Homo Sapiens
TVVLQVQPH

SEQ ID NO: 1087986 - protein, 9 aa, Homo Sapiens
TLLLLAGYG

SEQ ID NO: 1087987 - protein, 9 aa, Homo Sapiens
PPRGIQEVT

SEQ ID NO: 1087988 - protein, 9 aa, Homo Sapiens
ERLENDSLL

SEQ ID NO: 1087989 - protein, 9 aa, Homo Sapiens
TENATNGVQ

SEQ ID NO: 1087990 - protein, 9 aa, Homo Sapiens
PCAGVLIYP

SEQ ID NO: 1087991 - protein, 9 aa, Homo Sapiens
NILESTQAS

SEQ ID NO: 1087992 - protein, 9 aa, Homo Sapiens
RSRQRISRD

SEQ ID NO: 1087993 - protein, 9 aa, Homo Sapiens
GRLQTKSGE

SEQ ID NO: 1087994 - protein, 9 aa, Homo Sapiens
IYLGGNEKQ

SEQ ID NO: 1087995 - protein, 9 aa, Homo Sapiens
DMEEEPLNP

SEQ ID NO: 1087996 - protein, 9 aa, Homo Sapiens
LFDACGLIV

SEQ ID NO: 1087997 - protein, 9 aa, Homo Sapiens
RRIFKITTQ

SEQ ID NO: 1087998 - protein, 9 aa, Homo Sapiens
RTRTINDFS

SEQ ID NO: 1087999 - protein, 9 aa, Homo Sapiens
KDNESDCRS

SEQ ID NO: 1088000 - protein, 9 aa, Homo Sapiens
EIFENWLIQ

SEQ ID NO: 1088001 - protein, 9 aa, Homo Sapiens
EAIVAPKDV

SEQ ID NO: 1088002 - protein, 9 aa, Homo Sapiens
VILNDEALA

SEQ ID NO: 1088003 - protein, 9 aa, Homo Sapiens
GSVFVVLET

SEQ ID NO: 1088004 - protein, 9 aa, Homo Sapiens
ELELEEELE

SEQ ID NO: 1088005 - protein, 9 aa, Homo Sapiens
FCEYYGKNY

SEQ ID NO: 1088006 - protein, 9 aa, Homo Sapiens
ERFSLGVGQ

SEQ ID NO: 1088007 - protein, 9 aa, Homo Sapiens
VLTVKEKYP

SEQ ID NO: 1088008 - protein, 9 aa, Homo Sapiens
GLISSWGRT

SEQ ID NO: 1088009 - protein, 9 aa, Homo Sapiens
FKSPEKHFI

SEQ ID NO: 1088010 - protein, 9 aa, Homo Sapiens
DDSSRDSYF

SEQ ID NO: 1088011 - protein, 9 aa, Homo Sapiens
SWLEEFSMK

SEQ ID NO: 1088012 - protein, 9 aa, Homo Sapiens
IAGVSYNSP

SEQ ID NO: 1088013 - protein, 9 aa, Homo Sapiens
IGYSYYSIK

SEQ ID NO: 1088014 - protein, 9 aa, Homo Sapiens
PERLSPDGH

SEQ ID NO: 1088015 - protein, 9 aa, Homo Sapiens
WHALDSGNA

SEQ ID NO: 1088016 - protein, 9 aa, Homo Sapiens
SILIQEQFY

SEQ ID NO: 1088017 - protein, 9 aa, Homo Sapiens
PDYFLEDTT

SEQ ID NO: 1088018 - protein, 9 aa, Homo Sapiens
SVKPVSSEI

SEQ ID NO: 1088019 - protein, 9 aa, Homo Sapiens
QYLKDTDPF

SEQ ID NO: 1088020 - protein, 9 aa, Homo Sapiens
SFINPGKIP

SEQ ID NO: 1088021 - protein, 9 aa, Homo Sapiens
GREPGGAGG

SEQ ID NO: 1088022 - protein, 9 aa, Homo Sapiens
QRSYREEKA

SEQ ID NO: 1088023 - protein, 9 aa, Homo Sapiens
QSANILKWA

SEQ ID NO: 1088024 - protein, 9 aa, Homo Sapiens
MDKDEKWSF

SEQ ID NO: 1088025 - protein, 9 aa, Homo Sapiens
LFRGAVASC

SEQ ID NO: 1088026 - protein, 9 aa, Homo Sapiens
GVLIYPLWV

SEQ ID NO: 1088027 - protein, 9 aa, Homo Sapiens
LKVRPIERC

SEQ ID NO: 1088028 - protein, 9 aa, Homo Sapiens
NLLPILRKF

SEQ ID NO: 1088029 - protein, 9 aa, Homo Sapiens
RLLVSMGHW

SEQ ID NO: 1088030 - protein, 9 aa, Homo Sapiens
SQAIFGSKD

SEQ ID NO: 1088031 - protein, 9 aa, Homo Sapiens
HVLINWVGE

SEQ ID NO: 1088032 - protein, 9 aa, Homo Sapiens
ESKSKISVR

SEQ ID NO: 1088033 - protein, 9 aa, Homo Sapiens
ERANKGFGI

SEQ ID NO: 1088034 - protein, 9 aa, Homo Sapiens
SSRDSYFSD

SEQ ID NO: 1088035 - protein, 9 aa, Homo Sapiens
DEWQMLHSE

SEQ ID NO: 1088036 - protein, 9 aa, Homo Sapiens
ALKAKAPLE

SEQ ID NO: 1088037 - protein, 9 aa, Homo Sapiens
VLQVQPHSD

SEQ ID NO: 1088038 - protein, 9 aa, Homo Sapiens
YLGKMWIFS

SEQ ID NO: 1088039 - protein, 9 aa, Homo Sapiens
AKSFTEIST

SEQ ID NO: 1088040 - protein, 9 aa, Homo Sapiens
VSNSKLVLE

SEQ ID NO: 1088041 - protein, 9 aa, Homo Sapiens
ELLCPRHHC

SEQ ID NO: 1088042 - protein, 9 aa, Homo Sapiens
KVVAQSLVF

SEQ ID NO: 1088043 - protein, 9 aa, Homo Sapiens
DYMVDGQPL

SEQ ID NO: 1088044 - protein, 9 aa, Homo Sapiens
HIVKDKNRG

SEQ ID NO: 1088045 - protein, 9 aa, Homo Sapiens
LLILLSPET

SEQ ID NO: 1088046 - protein, 9 aa, Homo Sapiens
PLQNGRVAH

SEQ ID NO: 1088047 - protein, 9 aa, Homo Sapiens
KGFGIVFSN

SEQ ID NO: 1088048 - protein, 9 aa, Homo Sapiens
AGEKPLGVG

SEQ ID NO: 1088049 - protein, 9 aa, Homo Sapiens
GQGFSDSSQ

SEQ ID NO: 1088050 - protein, 9 aa, Homo Sapiens
RCSCFLSEQ

SEQ ID NO: 1088051 - protein, 9 aa, Homo Sapiens
TREFISLPR

SEQ ID NO: 1088052 - protein, 9 aa, Homo Sapiens
DEEEEEDWS

SEQ ID NO: 1088053 - protein, 9 aa, Homo Sapiens
MTPEQSANI

SEQ ID NO: 1088054 - protein, 9 aa, Homo Sapiens
FALGQKFGS

SEQ ID NO: 1088055 - protein, 9 aa, Homo Sapiens
PRTRTINDF

SEQ ID NO: 1088056 - protein, 9 aa, Homo Sapiens
IYPKEVPPE

SEQ ID NO: 1088057 - protein, 9 aa, Homo Sapiens
LRSEISVQP

SEQ ID NO: 1088058 - protein, 9 aa, Homo Sapiens
QNDCQLTSW

SEQ ID NO: 1088059 - protein, 9 aa, Homo Sapiens
YLQWSNLKA

SEQ ID NO: 1088060 - protein, 9 aa, Homo Sapiens
NFFIQFYNN

SEQ ID NO: 1088061 - protein, 9 aa, Homo Sapiens
ISKLAPQVH

SEQ ID NO: 1088062 - protein, 9 aa, Homo Sapiens
VFETAFGMR

SEQ ID NO: 1088063 - protein, 9 aa, Homo Sapiens
VQTDKITNT

SEQ ID NO: 1088064 - protein, 9 aa, Homo Sapiens
LENLGMILL

SEQ ID NO: 1088065 - protein, 9 aa, Homo Sapiens
ENDSLLVVA

SEQ ID NO: 1088066 - protein, 9 aa, Homo Sapiens
PYLEQYYDS

SEQ ID NO: 1088067 - protein, 9 aa, Homo Sapiens
GTKALLLGF

SEQ ID NO: 1088068 - protein, 9 aa, Homo Sapiens
AEDPAKSFT

SEQ ID NO: 1088069 - protein, 9 aa, Homo Sapiens
RLVFALETD

SEQ ID NO: 1088070 - protein, 9 aa, Homo Sapiens
STMVSLPLR

SEQ ID NO: 1088071 - protein, 9 aa, Homo Sapiens
SSIWWIILS

SEQ ID NO: 1088072 - protein, 9 aa, Homo Sapiens
EYYGKNYKI

SEQ ID NO: 1088073 - protein, 9 aa, Homo Sapiens
REFISLPRL

SEQ ID NO: 1088074 - protein, 9 aa, Homo Sapiens
ISSWGRTEK

SEQ ID NO: 1088075 - protein, 9 aa, Homo Sapiens
KWSFFQEQK

SEQ ID NO: 1088076 - protein, 9 aa, Homo Sapiens
WAAPDPATR

SEQ ID NO: 1088077 - protein, 9 aa, Homo Sapiens
TQRGRLQTK

SEQ ID NO: 1088078 - protein, 9 aa, Homo Sapiens
SLPLRSGSH

SEQ ID NO: 1088079 - protein, 9 aa, Homo Sapiens
QKLEVTQTT

SEQ ID NO: 1088080 - protein, 9 aa, Homo Sapiens
FPVCPPRGI

SEQ ID NO: 1088081 - protein, 9 aa, Homo Sapiens
KISRLHLPG

SEQ ID NO: 1088082 - protein, 9 aa, Homo Sapiens
NITVLVFDV

SEQ ID NO: 1088083 - protein, 9 aa, Homo Sapiens
RGIFFVPGG

SEQ ID NO: 1088084 - protein, 9 aa, Homo Sapiens
FADMEEEPL

SEQ ID NO: 1088085 - protein, 9 aa, Homo Sapiens
GAYSGSSDF

SEQ ID NO: 1088086 - protein, 9 aa, Homo Sapiens
SRDSYFSDR

SEQ ID NO: 1088087 - protein, 9 aa, Homo Sapiens
PKDVGEGEE

SEQ ID NO: 1088088 - protein, 9 aa, Homo Sapiens
RRKVEKVKK

SEQ ID NO: 1088089 - protein, 9 aa, Homo Sapiens
LLKPVQQIT

SEQ ID NO: 1088090 - protein, 9 aa, Homo Sapiens
LNPSDTEDW

SEQ ID NO: 1088091 - protein, 9 aa, Homo Sapiens
AAIEDKYVQ

SEQ ID NO: 1088092 - protein, 9 aa, Homo Sapiens
DLGLISSWG

SEQ ID NO: 1088093 - protein, 9 aa, Homo Sapiens
QNWLSEGDE

SEQ ID NO: 1088094 - protein, 9 aa, Homo Sapiens
YFSDRHLTQ

SEQ ID NO: 1088095 - protein, 9 aa, Homo Sapiens
ESILRGIFF

SEQ ID NO: 1088096 - protein, 9 aa, Homo Sapiens
NWLSEGDEG

SEQ ID NO: 1088097 - protein, 9 aa, Homo Sapiens
RGLAGPAEL

SEQ ID NO: 1088098 - protein, 9 aa, Homo Sapiens
WNRITEVGL

SEQ ID NO: 1088099 - protein, 9 aa, Homo Sapiens
VYKMPIKKK

SEQ ID NO: 1088100 - protein, 9 aa, Homo Sapiens
GLAPCLKHF

SEQ ID NO: 1088101 - protein, 9 aa, Homo Sapiens
VLDCNYYYK

SEQ ID NO: 1088102 - protein, 9 aa, Homo Sapiens
LLAAIGFDR

SEQ ID NO: 1088103 - protein, 9 aa, Homo Sapiens
TSPCFNLFA

SEQ ID NO: 1088104 - protein, 9 aa, Homo Sapiens
TSHITVVIL

SEQ ID NO: 1088105 - protein, 9 aa, Homo Sapiens
PSDTEDWVR

SEQ ID NO: 1088106 - protein, 9 aa, Homo Sapiens
DHGQLIFFE

SEQ ID NO: 1088107 - protein, 9 aa, Homo Sapiens
PALAAPAPA

SEQ ID NO: 1088108 - protein, 9 aa, Homo Sapiens
QITKYQLLL

SEQ ID NO: 1088109 - protein, 9 aa, Homo Sapiens
ISYPVSQGA

SEQ ID NO: 1088110 - protein, 9 aa, Homo Sapiens
YDLSATIDF

SEQ ID NO: 1088111 - protein, 9 aa, Homo Sapiens
AQGKEIFEN

SEQ ID NO: 1088112 - protein, 9 aa, Homo Sapiens
ALGQKFGSH

SEQ ID NO: 1088113 - protein, 9 aa, Homo Sapiens
YPGISKLAP

SEQ ID NO: 1088114 - protein, 9 aa, Homo Sapiens
SAGLNGFNV

SEQ ID NO: 1088115 - protein, 9 aa, Homo Sapiens
RPRSKQEAW

SEQ ID NO: 1088116 - protein, 9 aa, Homo Sapiens
LQSMSGTEN

SEQ ID NO: 1088117 - protein, 9 aa, Homo Sapiens
VHIVKDKNR

SEQ ID NO: 1088118 - protein, 9 aa, Homo Sapiens
GEPVFPQTL

SEQ ID NO: 1088119 - protein, 9 aa, Homo Sapiens
PILRKFIAS

SEQ ID NO: 1088120 - protein, 9 aa, Homo Sapiens
PQTLLNSPA

SEQ ID NO: 1088121 - protein, 9 aa, Homo Sapiens
MTLLLLAGY

SEQ ID NO: 1088122 - protein, 9 aa, Homo Sapiens
IQFYNNASN

SEQ ID NO: 1088123 - protein, 9 aa, Homo Sapiens
APHSGKRSC

SEQ ID NO: 1088124 - protein, 9 aa, Homo Sapiens
KPAGTPMFL

SEQ ID NO: 1088125 - protein, 9 aa, Homo Sapiens
TTDVATTQS

SEQ ID NO: 1088126 - protein, 9 aa, Homo Sapiens
GKEFPSCAI

SEQ ID NO: 1088127 - protein, 9 aa, Homo Sapiens
KQASHLGGA

SEQ ID NO: 1088128 - protein, 9 aa, Homo Sapiens
FTVNKEVFG

SEQ ID NO: 1088129 - protein, 9 aa, Homo Sapiens
DKITNTQAF

SEQ ID NO: 1088130 - protein, 9 aa, Homo Sapiens
LTVTAQVRP

SEQ ID NO: 1088131 - protein, 9 aa, Homo Sapiens
NSPASAAVL

SEQ ID NO: 1088132 - protein, 9 aa, Homo Sapiens
VAPKDVGEG

SEQ ID NO: 1088133 - protein, 9 aa, Homo Sapiens
QSAGDSKED

SEQ ID NO: 1088134 - protein, 9 aa, Homo Sapiens
KPGLPGLPG

SEQ ID NO: 1088135 - protein, 9 aa, Homo Sapiens
HRKGRIQLI

SEQ ID NO: 1088136 - protein, 9 aa, Homo Sapiens
QEEEEMEAE

SEQ ID NO: 1088137 - protein, 9 aa, Homo Sapiens
TSLRDEDDT

SEQ ID NO: 1088138 - protein, 9 aa, Homo Sapiens
GTHLSLISN

SEQ ID NO: 1088139 - protein, 9 aa, Homo Sapiens
LCDPWNWLD

SEQ ID NO: 1088140 - protein, 9 aa, Homo Sapiens
KKVKEKRII

SEQ ID NO: 1088141 - protein, 9 aa, Homo Sapiens
TGTSSRRTD

SEQ ID NO: 1088142 - protein, 9 aa, Homo Sapiens
QTFSGLTPK

SEQ ID NO: 1088143 - protein, 9 aa, Homo Sapiens
HIGYELFEK

SEQ ID NO: 1088144 - protein, 9 aa, Homo Sapiens
RVLEIIDFF

SEQ ID NO: 1088145 - protein, 9 aa, Homo Sapiens
DCTPFIALA

SEQ ID NO: 1088146 - protein, 9 aa, Homo Sapiens
LDPGTPDQH

SEQ ID NO: 1088147 - protein, 9 aa, Homo Sapiens
LDLFDACGL

SEQ ID NO: 1088148 - protein, 9 aa, Homo Sapiens
QSSAGLNGF

SEQ ID NO: 1088149 - protein, 9 aa, Homo Sapiens
GKSKSKLKF

SEQ ID NO: 1088150 - protein, 9 aa, Homo Sapiens
NLNSGAVKN

SEQ ID NO: 1088151 - protein, 9 aa, Homo Sapiens
ATSFQQHVR

SEQ ID NO: 1088152 - protein, 9 aa, Homo Sapiens
VTFWRSSLL

SEQ ID NO: 1088153 - protein, 9 aa, Homo Sapiens
SNQTFSGLT

SEQ ID NO: 1088154 - protein, 9 aa, Homo Sapiens
RQNLGSVGQ

SEQ ID NO: 1088155 - protein, 9 aa, Homo Sapiens
TPPKSKKFS

SEQ ID NO: 1088156 - protein, 9 aa, Homo Sapiens
RPGRRAEKP

SEQ ID NO: 1088157 - protein, 9 aa, Homo Sapiens
FNEGKEFPS

SEQ ID NO: 1088158 - protein, 9 aa, Homo Sapiens
PPSHARYSS

SEQ ID NO: 1088159 - protein, 9 aa, Homo Sapiens
LNSPRDFID

SEQ ID NO: 1088160 - protein, 9 aa, Homo Sapiens
VDKQKLGKK

SEQ ID NO: 1088161 - protein, 9 aa, Homo Sapiens
AKNESLQIR

SEQ ID NO: 1088162 - protein, 9 aa, Homo Sapiens
WLEEFSMKR

SEQ ID NO: 1088163 - protein, 9 aa, Homo Sapiens
LSISEIQNQ

SEQ ID NO: 1088164 - protein, 9 aa, Homo Sapiens
ASTSFLGCY

SEQ ID NO: 1088165 - protein, 9 aa, Homo Sapiens
SCFLSEQPH

SEQ ID NO: 1088166 - protein, 9 aa, Homo Sapiens
LPILRKFIA

SEQ ID NO: 1088167 - protein, 9 aa, Homo Sapiens
LQQSLHTKA

SEQ ID NO: 1088168 - protein, 9 aa, Homo Sapiens
RIFGAAQFQ

SEQ ID NO: 1088169 - protein, 9 aa, Homo Sapiens
TPEKEERPL

SEQ ID NO: 1088170 - protein, 9 aa, Homo Sapiens
KCGIIDQDK

SEQ ID NO: 1088171 - protein, 9 aa, Homo Sapiens
GAPKEAPLK

SEQ ID NO: 1088172 - protein, 9 aa, Homo Sapiens
LAREYGSSL

SEQ ID NO: 1088173 - protein, 9 aa, Homo Sapiens
RLFFSSIFK

SEQ ID NO: 1088174 - protein, 9 aa, Homo Sapiens
DIAVDWIGN

SEQ ID NO: 1088175 - protein, 9 aa, Homo Sapiens
YKCIYKGRS

SEQ ID NO: 1088176 - protein, 9 aa, Homo Sapiens
PTESLVPSS

SEQ ID NO: 1088177 - protein, 9 aa, Homo Sapiens
FIQQGYAEL

SEQ ID NO: 1088178 - protein, 9 aa, Homo Sapiens
VCVIELGGI

SEQ ID NO: 1088179 - protein, 9 aa, Homo Sapiens
CLYIARKNH

SEQ ID NO: 1088180 - protein, 9 aa, Homo Sapiens
NTQTLESNS

SEQ ID NO: 1088181 - protein, 9 aa, Homo Sapiens
KPLGVGSVA

SEQ ID NO: 1088182 - protein, 9 aa, Homo Sapiens
NTLIYANRA

SEQ ID NO: 1088183 - protein, 9 aa, Homo Sapiens
WRETGIFFV

SEQ ID NO: 1088184 - protein, 9 aa, Homo Sapiens
LIFLRILDL

SEQ ID NO: 1088185 - protein, 9 aa, Homo Sapiens
RGAPPSTMT

SEQ ID NO: 1088186 - protein, 9 aa, Homo Sapiens
LYNSIEASL

SEQ ID NO: 1088187 - protein, 9 aa, Homo Sapiens
TSFLLGVNI

SEQ ID NO: 1088188 - protein, 9 aa, Homo Sapiens
LSSAFDHSP

SEQ ID NO: 1088189 - protein, 9 aa, Homo Sapiens
SEEKPHWTS

SEQ ID NO: 1088190 - protein, 9 aa, Homo Sapiens
SVAEKTKKQ

SEQ ID NO: 1088191 - protein, 9 aa, Homo Sapiens
TKAEAEAPR

SEQ ID NO: 1088192 - protein, 9 aa, Homo Sapiens
AASSHGLVN

SEQ ID NO: 1088193 - protein, 9 aa, Homo Sapiens
KEVFGQITE

SEQ ID NO: 1088194 - protein, 9 aa, Homo Sapiens
FQEQKCIRS

SEQ ID NO: 1088195 - protein, 9 aa, Homo Sapiens
ETQTSEIES

SEQ ID NO: 1088196 - protein, 9 aa, Homo Sapiens
TCGMNGVLW

SEQ ID NO: 1088197 - protein, 9 aa, Homo Sapiens
SKSFSLLSA

SEQ ID NO: 1088198 - protein, 9 aa, Homo Sapiens
NKDVSMEFL

SEQ ID NO: 1088199 - protein, 9 aa, Homo Sapiens
QPPSHARYS

SEQ ID NO: 1088200 - protein, 9 aa, Homo Sapiens
ICLRLHRGA

SEQ ID NO: 1088201 - protein, 9 aa, Homo Sapiens
NCAGIKGVL

SEQ ID NO: 1088202 - protein, 9 aa, Homo Sapiens
QAFALGQKF

SEQ ID NO: 1088203 - protein, 9 aa, Homo Sapiens
ILYATVFSV

SEQ ID NO: 1088204 - protein, 9 aa, Homo Sapiens
TSSRRTDVR

SEQ ID NO: 1088205 - protein, 9 aa, Homo Sapiens
TQHHSYPAK

SEQ ID NO: 1088206 - protein, 9 aa, Homo Sapiens
QKPAGTPMF

SEQ ID NO: 1088207 - protein, 9 aa, Homo Sapiens
LHGLLRIFG

SEQ ID NO: 1088208 - protein, 9 aa, Homo Sapiens
VKEKRIILP

SEQ ID NO: 1088209 - protein, 9 aa, Homo Sapiens
HARYSSQLD

SEQ ID NO: 1088210 - protein, 9 aa, Homo Sapiens
LKISSKIDA

SEQ ID NO: 1088211 - protein, 9 aa, Homo Sapiens
PLLRPLSST

SEQ ID NO: 1088212 - protein, 9 aa, Homo Sapiens
DLTFTVNKE

SEQ ID NO: 1088213 - protein, 9 aa, Homo Sapiens
CYPASKAHP

SEQ ID NO: 1088214 - protein, 9 aa, Homo Sapiens
KLGKKTETT

SEQ ID NO: 1088215 - protein, 9 aa, Homo Sapiens
LTNGSVFVV

SEQ ID NO: 1088216 - protein, 9 aa, Homo Sapiens
HQVLEGLHR

SEQ ID NO: 1088217 - protein, 9 aa, Homo Sapiens
ERPRGAPPS

SEQ ID NO: 1088218 - protein, 9 aa, Homo Sapiens
QMRATGLCF

SEQ ID NO: 1088219 - protein, 9 aa, Homo Sapiens
RTVFFERER

SEQ ID NO: 1088220 - protein, 9 aa, Homo Sapiens
FKCQECGKF

SEQ ID NO: 1088221 - protein, 9 aa, Homo Sapiens
KNYPNAGLI

SEQ ID NO: 1088222 - protein, 9 aa, Homo Sapiens
QECPSCPSP

SEQ ID NO: 1088223 - protein, 9 aa, Homo Sapiens
KLSSSLETF

SEQ ID NO: 1088224 - protein, 9 aa, Homo Sapiens
AYLQWSNLK

SEQ ID NO: 1088225 - protein, 9 aa, Homo Sapiens
KKILYATVF

SEQ ID NO: 1088226 - protein, 9 aa, Homo Sapiens
GISKLAPQV

SEQ ID NO: 1088227 - protein, 9 aa, Homo Sapiens
MEEEPLNPD

SEQ ID NO: 1088228 - protein, 9 aa, Homo Sapiens
CPSCPSPCG

SEQ ID NO: 1088229 - protein, 9 aa, Homo Sapiens
QDEAEGDLG

SEQ ID NO: 1088230 - protein, 9 aa, Homo Sapiens
HTTPFPVTD

SEQ ID NO: 1088231 - protein, 9 aa, Homo Sapiens
GLPGLPGDP

SEQ ID NO: 1088232 - protein, 9 aa, Homo Sapiens
SNSKLVLEA

SEQ ID NO: 1088233 - protein, 9 aa, Homo Sapiens
DRCYSTPAG

SEQ ID NO: 1088234 - protein, 9 aa, Homo Sapiens
GSSMEMEDA

SEQ ID NO: 1088235 - protein, 9 aa, Homo Sapiens
TDKITNTQA

SEQ ID NO: 1088236 - protein, 9 aa, Homo Sapiens
AKLEGHEGK

SEQ ID NO: 1088237 - protein, 9 aa, Homo Sapiens
ETLLQTYLS

SEQ ID NO: 1088238 - protein, 9 aa, Homo Sapiens
CDEWQMLHS

SEQ ID NO: 1088239 - protein, 9 aa, Homo Sapiens
RISRDLAMC

SEQ ID NO: 1088240 - protein, 9 aa, Homo Sapiens
LVILNDEAL

SEQ ID NO: 1088241 - protein, 9 aa, Homo Sapiens
FQHFNLVLE

SEQ ID NO: 1088242 - protein, 9 aa, Homo Sapiens
GLPRHRPKR

SEQ ID NO: 1088243 - protein, 9 aa, Homo Sapiens
GEGVPDLVY

SEQ ID NO: 1088244 - protein, 9 aa, Homo Sapiens
KSGGKYNLN

SEQ ID NO: 1088245 - protein, 9 aa, Homo Sapiens
FISSTTCGR

SEQ ID NO: 1088246 - protein, 9 aa, Homo Sapiens
PGISKLAPQ

SEQ ID NO: 1088247 - protein, 9 aa, Homo Sapiens
DGTHLSLIS

SEQ ID NO: 1088248 - protein, 9 aa, Homo Sapiens
YSYYSIKWY

SEQ ID NO: 1088249 - protein, 9 aa, Homo Sapiens
WETVFETAF

SEQ ID NO: 1088250 - protein, 9 aa, Homo Sapiens
TQNGSHRLN

SEQ ID NO: 1088251 - protein, 9 aa, Homo Sapiens
PALLDPGTP

SEQ ID NO: 1088252 - protein, 9 aa, Homo Sapiens
PHYILCWTS

SEQ ID NO: 1088253 - protein, 9 aa, Homo Sapiens
LGKKTETTG

SEQ ID NO: 1088254 - protein, 9 aa, Homo Sapiens
PGVGLEEEE

SEQ ID NO: 1088255 - protein, 9 aa, Homo Sapiens
AIEDKYVQQ

SEQ ID NO: 1088256 - protein, 9 aa, Homo Sapiens
SILHVPGYQ

SEQ ID NO: 1088257 - protein, 9 aa, Homo Sapiens
PMEGGDSGV

SEQ ID NO: 1088258 - protein, 9 aa, Homo Sapiens
RILFQRSSQ

SEQ ID NO: 1088259 - protein, 9 aa, Homo Sapiens
AGIKGVLES

SEQ ID NO: 1088260 - protein, 9 aa, Homo Sapiens
IWWIILSLT

SEQ ID NO: 1088261 - protein, 9 aa, Homo Sapiens
SAFDHSPNK

SEQ ID NO: 1088262 - protein, 9 aa, Homo Sapiens
LIRHHRIYT

SEQ ID NO: 1088263 - protein, 9 aa, Homo Sapiens
EYVSVPDYF

SEQ ID NO: 1088264 - protein, 9 aa, Homo Sapiens
TVVILHFVP

SEQ ID NO: 1088265 - protein, 9 aa, Homo Sapiens
MWIFSNLRC

SEQ ID NO: 1088266 - protein, 9 aa, Homo Sapiens
KHVLINWVG

SEQ ID NO: 1088267 - protein, 9 aa, Homo Sapiens
LAFQTEQKL

SEQ ID NO: 1088268 - protein, 9 aa, Homo Sapiens
FLPRTRPAG

SEQ ID NO: 1088269 - protein, 9 aa, Homo Sapiens
YGLRIGGNE

SEQ ID NO: 1088270 - protein, 9 aa, Homo Sapiens
KENWLQHRE

SEQ ID NO: 1088271 - protein, 9 aa, Homo Sapiens
PRGCRLPFI

SEQ ID NO: 1088272 - protein, 9 aa, Homo Sapiens
QEISRVLSA

SEQ ID NO: 1088273 - protein, 9 aa, Homo Sapiens
KIVSQKPAG

SEQ ID NO: 1088274 - protein, 9 aa, Homo Sapiens
REKISPVVM

SEQ ID NO: 1088275 - protein, 9 aa, Homo Sapiens
GLGTCKEIF

SEQ ID NO: 1088276 - protein, 9 aa, Homo Sapiens
IKDNKNNFS

SEQ ID NO: 1088277 - protein, 9 aa, Homo Sapiens
GSPGAPGRE

SEQ ID NO: 1088278 - protein, 9 aa, Homo Sapiens
FFLDKVVSV

SEQ ID NO: 1088279 - protein, 9 aa, Homo Sapiens
CKEIFNMYY

SEQ ID NO: 1088280 - protein, 9 aa, Homo Sapiens
AYRPRDQAA

SEQ ID NO: 1088281 - protein, 9 aa, Homo Sapiens
ATLALRDFD

SEQ ID NO: 1088282 - protein, 9 aa, Homo Sapiens
WSNQTSGSD

SEQ ID NO: 1088283 - protein, 9 aa, Homo Sapiens
VLENLGMIL

SEQ ID NO: 1088284 - protein, 9 aa, Homo Sapiens
HHCALDPKA

SEQ ID NO: 1088285 - protein, 9 aa, Homo Sapiens
SLQRGFFNL

SEQ ID NO: 1088286 - protein, 9 aa, Homo Sapiens
KIQKIRYRS

SEQ ID NO: 1088287 - protein, 9 aa, Homo Sapiens
YYTTAELRS

SEQ ID NO: 1088288 - protein, 9 aa, Homo Sapiens
VASCQSSPM

SEQ ID NO: 1088289 - protein, 9 aa, Homo Sapiens
EGHEGKISK

SEQ ID NO: 1088290 - protein, 9 aa, Homo Sapiens
VDNVQCPKR

SEQ ID NO: 1088291 - protein, 9 aa, Homo Sapiens
MASSIWWII

SEQ ID NO: 1088292 - protein, 9 aa, Homo Sapiens
NKRGSRAWA

SEQ ID NO: 1088293 - protein, 9 aa, Homo Sapiens
VERLENDSL

SEQ ID NO: 1088294 - protein, 9 aa, Homo Sapiens
SFQNKCFLK

SEQ ID NO: 1088295 - protein, 9 aa, Homo Sapiens
LETSPGAAA

SEQ ID NO: 1088296 - protein, 9 aa, Homo Sapiens
HQAASMIYP

SEQ ID NO: 1088297 - protein, 9 aa, Homo Sapiens
VTAKAFSPS

SEQ ID NO: 1088298 - protein, 9 aa, Homo Sapiens
FGQHESGSE

SEQ ID NO: 1088299 - protein, 9 aa, Homo Sapiens
IKEVLCDYM

SEQ ID NO: 1088300 - protein, 9 aa, Homo Sapiens
SMSSPGAQS

SEQ ID NO: 1088301 - protein, 9 aa, Homo Sapiens
GLRLVGFEV

SEQ ID NO: 1088302 - protein, 9 aa, Homo Sapiens
PVCPPRGIQ

SEQ ID NO: 1088303 - protein, 9 aa, Homo Sapiens
QRISRDLAM

SEQ ID NO: 1088304 - protein, 9 aa, Homo Sapiens
RKQSPEKPR

SEQ ID NO: 1088305 - protein, 9 aa, Homo Sapiens
RGIQEVTVN

SEQ ID NO: 1088306 - protein, 9 aa, Homo Sapiens
IAKNESLQI

SEQ ID NO: 1088307 - protein, 9 aa, Homo Sapiens
EVLCDYMVD

SEQ ID NO: 1088308 - protein, 9 aa, Homo Sapiens
VSQNRLAEI

SEQ ID NO: 1088309 - protein, 9 aa, Homo Sapiens
FIQFYNNAS

SEQ ID NO: 1088310 - protein, 9 aa, Homo Sapiens
PLCQECPSC

SEQ ID NO: 1088311 - protein, 9 aa, Homo Sapiens
EKKGKAGNV

SEQ ID NO: 1088312 - protein, 9 aa, Homo Sapiens
PPGVGLEEE

SEQ ID NO: 1088313 - protein, 9 aa, Homo Sapiens
WATWTSFLL

SEQ ID NO: 1088314 - protein, 9 aa, Homo Sapiens
AEKTKKQAS

SEQ ID NO: 1088315 - protein, 9 aa, Homo Sapiens
NEYGLRIGG

SEQ ID NO: 1088316 - protein, 9 aa, Homo Sapiens
LPGLPGDPI

SEQ ID NO: 1088317 - protein, 9 aa, Homo Sapiens
VPEVPKKVK

SEQ ID NO: 1088318 - protein, 9 aa, Homo Sapiens
QISWKHATR

SEQ ID NO: 1088319 - protein, 9 aa, Homo Sapiens
MAPSAEGGK

SEQ ID NO: 1088320 - protein, 9 aa, Homo Sapiens
LTSTLAFQT

SEQ ID NO: 1088321 - protein, 9 aa, Homo Sapiens
RRYGVSCVH

SEQ ID NO: 1088322 - protein, 9 aa, Homo Sapiens
TKWSFFQEQ

SEQ ID NO: 1088323 - protein, 9 aa, Homo Sapiens
PVQQITKYQ

SEQ ID NO: 1088324 - protein, 9 aa, Homo Sapiens
ALSTCISYI

SEQ ID NO: 1088325 - protein, 9 aa, Homo Sapiens
TEKVACCSL

SEQ ID NO: 1088326 - protein, 9 aa, Homo Sapiens
VCCPQNWLS

SEQ ID NO: 1088327 - protein, 9 aa, Homo Sapiens
YPAKSLVEQ

SEQ ID NO: 1088328 - protein, 9 aa, Homo Sapiens
HLHHHQRLA

SEQ ID NO: 1088329 - protein, 9 aa, Homo Sapiens
LLDNQKLEV

SEQ ID NO: 1088330 - protein, 9 aa, Homo Sapiens
GRLVFALET

SEQ ID NO: 1088331 - protein, 9 aa, Homo Sapiens
LDILSKGVQ

SEQ ID NO: 1088332 - protein, 9 aa, Homo Sapiens
KSKKFSSKK

SEQ ID NO: 1088333 - protein, 9 aa, Homo Sapiens
YYGKNYKIL

SEQ ID NO: 1088334 - protein, 9 aa, Homo Sapiens
SVRTMPTST

SEQ ID NO: 1088335 - protein, 9 aa, Homo Sapiens
LIYANRARN

SEQ ID NO: 1088336 - protein, 9 aa, Homo Sapiens
YELLILLSP

SEQ ID NO: 1088337 - protein, 9 aa, Homo Sapiens
ATGAASKSF

SEQ ID NO: 1088338 - protein, 9 aa, Homo Sapiens
ENVYDCQVE

SEQ ID NO: 1088339 - protein, 9 aa, Homo Sapiens
STLAFQTEQ

SEQ ID NO: 1088340 - protein, 9 aa, Homo Sapiens
TSPRLCAKF

SEQ ID NO: 1088341 - protein, 9 aa, Homo Sapiens
KEVLCDYMV

SEQ ID NO: 1088342 - protein, 9 aa, Homo Sapiens
PTSTESHGA

SEQ ID NO: 1088343 - protein, 9 aa, Homo Sapiens
EISRVLSAQ

SEQ ID NO: 1088344 - protein, 9 aa, Homo Sapiens
LHQGKDNES

SEQ ID NO: 1088345 - protein, 9 aa, Homo Sapiens
FLSEQPHGQ

SEQ ID NO: 1088346 - protein, 9 aa, Homo Sapiens
PYHCNPCGL

SEQ ID NO: 1088347 - protein, 9 aa, Homo Sapiens
LGTCKEIFN

SEQ ID NO: 1088348 - protein, 9 aa, Homo Sapiens
KDNKNNFSP

SEQ ID NO: 1088349 - protein, 9 aa, Homo Sapiens
ADMEEEPLN

SEQ ID NO: 1088350 - protein, 9 aa, Homo Sapiens
KRPDTLWQC

SEQ ID NO: 1088351 - protein, 9 aa, Homo Sapiens
SVVNDKKKK

SEQ ID NO: 1088352 - protein, 9 aa, Homo Sapiens
EEQRSYREE

SEQ ID NO: 1088353 - protein, 9 aa, Homo Sapiens
YREEKAVSF

SEQ ID NO: 1088354 - protein, 9 aa, Homo Sapiens
DVVSEEEFF

SEQ ID NO: 1088355 - protein, 9 aa, Homo Sapiens
PERAESQYL

SEQ ID NO: 1088356 - protein, 9 aa, Homo Sapiens
SDSLDQLAI

SEQ ID NO: 1088357 - protein, 9 aa, Homo Sapiens
GLRIGGNEG

SEQ ID NO: 1088358 - protein, 9 aa, Homo Sapiens
FLLGVNIQI

SEQ ID NO: 1088359 - protein, 9 aa, Homo Sapiens
LESDLWLIE

SEQ ID NO: 1088360 - protein, 9 aa, Homo Sapiens
NKLKSQQEN

SEQ ID NO: 1088361 - protein, 9 aa, Homo Sapiens
IRHHRIYTG

SEQ ID NO: 1088362 - protein, 9 aa, Homo Sapiens
VEKVKKKLR

SEQ ID NO: 1088363 - protein, 9 aa, Homo Sapiens
LNLIWNRIT

SEQ ID NO: 1088364 - protein, 9 aa, Homo Sapiens
GKEEYSAMR

SEQ ID NO: 1088365 - protein, 9 aa, Homo Sapiens
GKIPRGFRF

SEQ ID NO: 1088366 - protein, 9 aa, Homo Sapiens
SELLCPRHH

SEQ ID NO: 1088367 - protein, 9 aa, Homo Sapiens
ECLYIARKN

SEQ ID NO: 1088368 - protein, 9 aa, Homo Sapiens
GSGQLCYSV

SEQ ID NO: 1088369 - protein, 9 aa, Homo Sapiens
ESIRRIFKI

SEQ ID NO: 1088370 - protein, 9 aa, Homo Sapiens
YDDDGTHLS

SEQ ID NO: 1088371 - protein, 9 aa, Homo Sapiens
QPYKVSLNS

SEQ ID NO: 1088372 - protein, 9 aa, Homo Sapiens
NKGYLPVVQ

SEQ ID NO: 1088373 - protein, 9 aa, Homo Sapiens
LPTESLVPS

SEQ ID NO: 1088374 - protein, 9 aa, Homo Sapiens
LTRHMRSHI

SEQ ID NO: 1088375 - protein, 9 aa, Homo Sapiens
ESLVPSSLV

SEQ ID NO: 1088376 - protein, 9 aa, Homo Sapiens
HHLHHHQRL

SEQ ID NO: 1088377 - protein, 9 aa, Homo Sapiens
FATSPRLCA

SEQ ID NO: 1088378 - protein, 9 aa, Homo Sapiens
WEADPAVQP

SEQ ID NO: 1088379 - protein, 9 aa, Homo Sapiens
ISIKSRDTL

SEQ ID NO: 1088380 - protein, 9 aa, Homo Sapiens
DQENERKQS

SEQ ID NO: 1088381 - protein, 9 aa, Homo Sapiens
YKMRVAALT

SEQ ID NO: 1088382 - protein, 9 aa, Homo Sapiens
FQGRKIVNL

SEQ ID NO: 1088383 - protein, 9 aa, Homo Sapiens
THLSLISNL

SEQ ID NO: 1088384 - protein, 9 aa, Homo Sapiens
FPGFSGLHG

SEQ ID NO: 1088385 - protein, 9 aa, Homo Sapiens
RPRVLEIID

SEQ ID NO: 1088386 - protein, 9 aa, Homo Sapiens
LAYATLAKL

SEQ ID NO: 1088387 - protein, 9 aa, Homo Sapiens
KITTQFGVM

SEQ ID NO: 1088388 - protein, 9 aa, Homo Sapiens
NDEALAFSC

SEQ ID NO: 1088389 - protein, 9 aa, Homo Sapiens
GQLCYSVPE

SEQ ID NO: 1088390 - protein, 9 aa, Homo Sapiens
FLFPFWRQI

SEQ ID NO: 1088391 - protein, 9 aa, Homo Sapiens
PSAENVYDC

SEQ ID NO: 1088392 - protein, 9 aa, Homo Sapiens
TTTPEKEER

SEQ ID NO: 1088393 - protein, 9 aa, Homo Sapiens
AREYGSSLK

SEQ ID NO: 1088394 - protein, 9 aa, Homo Sapiens
HTAFLPPVS

SEQ ID NO: 1088395 - protein, 9 aa, Homo Sapiens
VLVFDVNDN

SEQ ID NO: 1088396 - protein, 9 aa, Homo Sapiens
GHINFYPNG

SEQ ID NO: 1088397 - protein, 9 aa, Homo Sapiens
MGRGTRVPS

SEQ ID NO: 1088398 - protein, 9 aa, Homo Sapiens
AEGGKEVLT

SEQ ID NO: 1088399 - protein, 9 aa, Homo Sapiens
IAFKIVSQK

SEQ ID NO: 1088400 - protein, 9 aa, Homo Sapiens
HRFSSFKFI

SEQ ID NO: 1088401 - protein, 9 aa, Homo Sapiens
LLHLNLIWN

SEQ ID NO: 1088402 - protein, 9 aa, Homo Sapiens
SDFIEEIYR

SEQ ID NO: 1088403 - protein, 9 aa, Homo Sapiens
NFCEYYGKN

SEQ ID NO: 1088404 - protein, 9 aa, Homo Sapiens
FLRNFFFLE

SEQ ID NO: 1088405 - protein, 9 aa, Homo Sapiens
QRCSCFLSE

SEQ ID NO: 1088406 - protein, 9 aa, Homo Sapiens
LYDDDGTHL

SEQ ID NO: 1088407 - protein, 9 aa, Homo Sapiens
PGFPVCPPR

SEQ ID NO: 1088408 - protein, 9 aa, Homo Sapiens
PSMDEVLNI

SEQ ID NO: 1088409 - protein, 9 aa, Homo Sapiens
SGQLCYSVP

SEQ ID NO: 1088410 - protein, 9 aa, Homo Sapiens
SHIGYELFE

SEQ ID NO: 1088411 - protein, 9 aa, Homo Sapiens
MRVAALTHV

SEQ ID NO: 1088412 - protein, 9 aa, Homo Sapiens
TAQVRPRCG

SEQ ID NO: 1088413 - protein, 9 aa, Homo Sapiens
KHMFRQLRF

SEQ ID NO: 1088414 - protein, 9 aa, Homo Sapiens
LEEMSLQRG

SEQ ID NO: 1088415 - protein, 9 aa, Homo Sapiens
QECGKFFQM

SEQ ID NO: 1088416 - protein, 9 aa, Homo Sapiens
FTFLCDPWN

SEQ ID NO: 1088417 - protein, 9 aa, Homo Sapiens
NFHEEWLEV

SEQ ID NO: 1088418 - protein, 9 aa, Homo Sapiens
GIVGDIESM

SEQ ID NO: 1088419 - protein, 9 aa, Homo Sapiens
GFCIFAAET

SEQ ID NO: 1088420 - protein, 9 aa, Homo Sapiens
ITVVILHFV

SEQ ID NO: 1088421 - protein, 9 aa, Homo Sapiens
RRAEKPPQR

SEQ ID NO: 1088422 - protein, 9 aa, Homo Sapiens
LCFGGQWAQ

SEQ ID NO: 1088423 - protein, 9 aa, Homo Sapiens
KGRVLFNGQ

SEQ ID NO: 1088424 - protein, 9 aa, Homo Sapiens
YEIFLQMKR

SEQ ID NO: 1088425 - protein, 9 aa, Homo Sapiens
DVAVNFTQK

SEQ ID NO: 1088426 - protein, 9 aa, Homo Sapiens
FSGLHGLNG

SEQ ID NO: 1088427 - protein, 9 aa, Homo Sapiens
NLTSVLALY

SEQ ID NO: 1088428 - protein, 9 aa, Homo Sapiens
SYYSIKWYK

SEQ ID NO: 1088429 - protein, 9 aa, Homo Sapiens
DVHVNSKTQ

SEQ ID NO: 1088430 - protein, 9 aa, Homo Sapiens
QKRGRDPNP

SEQ ID NO: 1088431 - protein, 9 aa, Homo Sapiens
FRGAVASCQ

SEQ ID NO: 1088432 - protein, 9 aa, Homo Sapiens
GNKLEWEDD

SEQ ID NO: 1088433 - protein, 9 aa, Homo Sapiens
EKISPVVMA

SEQ ID NO: 1088434 - protein, 9 aa, Homo Sapiens
ENMPVFLEG

SEQ ID NO: 1088435 - protein, 9 aa, Homo Sapiens
LHTWLESLQ

SEQ ID NO: 1088436 - protein, 9 aa, Homo Sapiens
YDETAQEFV

SEQ ID NO: 1088437 - protein, 9 aa, Homo Sapiens
LLSPETYEG

SEQ ID NO: 1088438 - protein, 9 aa, Homo Sapiens
AEDLRVGFI

SEQ ID NO: 1088439 - protein, 9 aa, Homo Sapiens
AFQTEQKLK

SEQ ID NO: 1088440 - protein, 9 aa, Homo Sapiens
LPGDPIALP

SEQ ID NO: 1088441 - protein, 9 aa, Homo Sapiens
CFLSEQPHG

SEQ ID NO: 1088442 - protein, 9 aa, Homo Sapiens
KLEGHEGKI

SEQ ID NO: 1088443 - protein, 9 aa, Homo Sapiens
EEFSMKRSS

SEQ ID NO: 1088444 - protein, 9 aa, Homo Sapiens
LETPLYVAC

SEQ ID NO: 1088445 - protein, 9 aa, Homo Sapiens
LAKKSRGLF

SEQ ID NO: 1088446 - protein, 9 aa, Homo Sapiens
HITVVILHF

SEQ ID NO: 1088447 - protein, 9 aa, Homo Sapiens
QEFVDEFAM

SEQ ID NO: 1088448 - protein, 9 aa, Homo Sapiens
GSEKSSGFG

SEQ ID NO: 1088449 - protein, 9 aa, Homo Sapiens
VATSTLLKV

SEQ ID NO: 1088450 - protein, 9 aa, Homo Sapiens
DSSQQPPSY

SEQ ID NO: 1088451 - protein, 9 aa, Homo Sapiens
QMPRARRAY

SEQ ID NO: 1088452 - protein, 9 aa, Homo Sapiens
ECDEWQMLH

SEQ ID NO: 1088453 - protein, 9 aa, Homo Sapiens
VIIAKNESL

SEQ ID NO: 1088454 - protein, 9 aa, Homo Sapiens
FSWHDDPFG

SEQ ID NO: 1088455 - protein, 9 aa, Homo Sapiens
KAEAEAPRA

SEQ ID NO: 1088456 - protein, 9 aa, Homo Sapiens
SEIRAPPDW

SEQ ID NO: 1088457 - protein, 9 aa, Homo Sapiens
AYATLAKLS

SEQ ID NO: 1088458 - protein, 9 aa, Homo Sapiens
SFKISIKSR

SEQ ID NO: 1088459 - protein, 9 aa, Homo Sapiens
KTKKQASHL

SEQ ID NO: 1088460 - protein, 9 aa, Homo Sapiens
EADFADDKN

SEQ ID NO: 1088461 - protein, 9 aa, Homo Sapiens
EARLVLTVK

SEQ ID NO: 1088462 - protein, 9 aa, Homo Sapiens
LVYFLLLKY

SEQ ID NO: 1088463 - protein, 9 aa, Homo Sapiens
PRGAPPSTM

SEQ ID NO: 1088464 - protein, 9 aa, Homo Sapiens
HIKDNKNNF

SEQ ID NO: 1088465 - protein, 9 aa, Homo Sapiens
CPQNWLSEG

SEQ ID NO: 1088466 - protein, 9 aa, Homo Sapiens
HRPKRLFFS

SEQ ID NO: 1088467 - protein, 9 aa, Homo Sapiens
RHHCALDPK

SEQ ID NO: 1088468 - protein, 9 aa, Homo Sapiens
NFSPKVELA

SEQ ID NO: 1088469 - protein, 9 aa, Homo Sapiens
FPDYPLTLL

SEQ ID NO: 1088470 - protein, 9 aa, Homo Sapiens
DILHKPTCQ

SEQ ID NO: 1088471 - protein, 9 aa, Homo Sapiens
GKYNLNSGA

SEQ ID NO: 1088472 - protein, 9 aa, Homo Sapiens
GEEQRSYRE

SEQ ID NO: 1088473 - protein, 9 aa, Homo Sapiens
TEQKLKCEC

SEQ ID NO: 1088474 - protein, 9 aa, Homo Sapiens
LNSKAGLRT

SEQ ID NO: 1088475 - protein, 9 aa, Homo Sapiens
SWGRTEKRD

SEQ ID NO: 1088476 - protein, 9 aa, Homo Sapiens
IDRATSLRD

SEQ ID NO: 1088477 - protein, 9 aa, Homo Sapiens
GKGMDEMEF

SEQ ID NO: 1088478 - protein, 9 aa, Homo Sapiens
MELPGSGNT

SEQ ID NO: 1088479 - protein, 9 aa, Homo Sapiens
DSNLEVVLN

SEQ ID NO: 1088480 - protein, 9 aa, Homo Sapiens
AERAEKAAS

SEQ ID NO: 1088481 - protein, 9 aa, Homo Sapiens
PGRLPLQNG

SEQ ID NO: 1088482 - protein, 9 aa, Homo Sapiens
VVILHFVPC

SEQ ID NO: 1088483 - protein, 9 aa, Homo Sapiens
GEEWKQLES

SEQ ID NO: 1088484 - protein, 9 aa, Homo Sapiens
SRRTDVRYG

SEQ ID NO: 1088485 - protein, 9 aa, Homo Sapiens
YTLTVLENL

SEQ ID NO: 1088486 - protein, 9 aa, Homo Sapiens
LCWTSPQVI

SEQ ID NO: 1088487 - protein, 9 aa, Homo Sapiens
CEYYGKNYK

SEQ ID NO: 1088488 - protein, 9 aa, Homo Sapiens
ATSLRDEDD

SEQ ID NO: 1088489 - protein, 9 aa, Homo Sapiens
LLETKWSFF

SEQ ID NO: 1088490 - protein, 9 aa, Homo Sapiens
GKEVLTIEV

SEQ ID NO: 1088491 - protein, 9 aa, Homo Sapiens
VGFEVGDRT

SEQ ID NO: 1088492 - protein, 9 aa, Homo Sapiens
TASDFIEEI

SEQ ID NO: 1088493 - protein, 9 aa, Homo Sapiens
HDILHKPTC

SEQ ID NO: 1088494 - protein, 9 aa, Homo Sapiens
EMSLQRGFF

SEQ ID NO: 1088495 - protein, 9 aa, Homo Sapiens
WLDENKDVS

SEQ ID NO: 1088496 - protein, 9 aa, Homo Sapiens
ATSTLLKVR

SEQ ID NO: 1088497 - protein, 9 aa, Homo Sapiens
EKPYECDEW

SEQ ID NO: 1088498 - protein, 9 aa, Homo Sapiens
MPWVLDCTP

SEQ ID NO: 1088499 - protein, 9 aa, Homo Sapiens
DQEIPHLET

SEQ ID NO: 1088500 - protein, 9 aa, Homo Sapiens
HKPTCQISH

SEQ ID NO: 1088501 - protein, 9 aa, Homo Sapiens
LYSAVCALE

SEQ ID NO: 1088502 - protein, 9 aa, Homo Sapiens
LVYVMRTLA

SEQ ID NO: 1088503 - protein, 9 aa, Homo Sapiens
EADEFVSRL

SEQ ID NO: 1088504 - protein, 9 aa, Homo Sapiens
ERLSPDGHE

SEQ ID NO: 1088505 - protein, 9 aa, Homo Sapiens
EGLRLVGFE

SEQ ID NO: 1088506 - protein, 9 aa, Homo Sapiens
CDYMVDGQP

SEQ ID NO: 1088507 - protein, 9 aa, Homo Sapiens
FQGLIFLRI

SEQ ID NO: 1088508 - protein, 9 aa, Homo Sapiens
HLSLISNLP

SEQ ID NO: 1088509 - protein, 9 aa, Homo Sapiens
PRHHCALDP

SEQ ID NO: 1088510 - protein, 9 aa, Homo Sapiens
NASPVQAVF

SEQ ID NO: 1088511 - protein, 9 aa, Homo Sapiens
SKGIERGSM

SEQ ID NO: 1088512 - protein, 9 aa, Homo Sapiens
IFGAAQFQG

SEQ ID NO: 1088513 - protein, 9 aa, Homo Sapiens
SRVLSAQRS

SEQ ID NO: 1088514 - protein, 9 aa, Homo Sapiens
KNNFSPKVE

SEQ ID NO: 1088515 - protein, 9 aa, Homo Sapiens
IDSENICSI

SEQ ID NO: 1088516 - protein, 9 aa, Homo Sapiens
LGLISSWGR

SEQ ID NO: 1088517 - protein, 9 aa, Homo Sapiens
NKGFGIVFS

SEQ ID NO: 1088518 - protein, 9 aa, Homo Sapiens
KPYECDEWQ

SEQ ID NO: 1088519 - protein, 9 aa, Homo Sapiens
SQAALPKHV

SEQ ID NO: 1088520 - protein, 9 aa, Homo Sapiens
AEGDLGNRH

SEQ ID NO: 1088521 - protein, 9 aa, Homo Sapiens
LQPLKGKNI

SEQ ID NO: 1088522 - protein, 9 aa, Homo Sapiens
LALLLEPWR

SEQ ID NO: 1088523 - protein, 9 aa, Homo Sapiens
DGQVQKQSP

SEQ ID NO: 1088524 - protein, 9 aa, Homo Sapiens
WDSTRMSVK

SEQ ID NO: 1088525 - protein, 9 aa, Homo Sapiens
VVNDKKKKK

SEQ ID NO: 1088526 - protein, 9 aa, Homo Sapiens
YIPPHAVLC

SEQ ID NO: 1088527 - protein, 9 aa, Homo Sapiens
DSQAALPKH

SEQ ID NO: 1088528 - protein, 9 aa, Homo Sapiens
ASPPPKFPA

SEQ ID NO: 1088529 - protein, 9 aa, Homo Sapiens
QDTVKGRVL

SEQ ID NO: 1088530 - protein, 9 aa, Homo Sapiens
TSTLLKVRP

SEQ ID NO: 1088531 - protein, 9 aa, Homo Sapiens
LAVNLTSVL

SEQ ID NO: 1088532 - protein, 9 aa, Homo Sapiens
DLSATIDFI

SEQ ID NO: 1088533 - protein, 9 aa, Homo Sapiens
GHEGKISKI

SEQ ID NO: 1088534 - protein, 9 aa, Homo Sapiens
LHLAANKGY

SEQ ID NO: 1088535 - protein, 9 aa, Homo Sapiens
FPAEPPAPE

SEQ ID NO: 1088536 - protein, 9 aa, Homo Sapiens
RDLYEIFLQ

SEQ ID NO: 1088537 - protein, 9 aa, Homo Sapiens
LASCSLAGA

SEQ ID NO: 1088538 - protein, 9 aa, Homo Sapiens
KKQASHLGG

SEQ ID NO: 1088539 - protein, 9 aa, Homo Sapiens
SPRLCAKFY

SEQ ID NO: 1088540 - protein, 9 aa, Homo Sapiens
FYNNASNDT

SEQ ID NO: 1088541 - protein, 9 aa, Homo Sapiens
LYIARKNHP

SEQ ID NO: 1088542 - protein, 9 aa, Homo Sapiens
GLQLPNTLP

SEQ ID NO: 1088543 - protein, 9 aa, Homo Sapiens
PNTLPVSGN

SEQ ID NO: 1088544 - protein, 9 aa, Homo Sapiens
ARFEEALYN

SEQ ID NO: 1088545 - protein, 9 aa, Homo Sapiens
KREEKLRKK

SEQ ID NO: 1088546 - protein, 9 aa, Homo Sapiens
TAYLQWSNL

SEQ ID NO: 1088547 - protein, 9 aa, Homo Sapiens
IRRKVEKVK

SEQ ID NO: 1088548 - protein, 9 aa, Homo Sapiens
QDKLAEEIE

SEQ ID NO: 1088549 - protein, 9 aa, Homo Sapiens
KTTVTDAKE

SEQ ID NO: 1088550 - protein, 9 aa, Homo Sapiens
QGFSDSSQQ

SEQ ID NO: 1088551 - protein, 9 aa, Homo Sapiens
YQSAGDSKE

SEQ ID NO: 1088552 - protein, 9 aa, Homo Sapiens
VLCDYMVDG

SEQ ID NO: 1088553 - protein, 9 aa, Homo Sapiens
HHSYPAKSL

SEQ ID NO: 1088554 - protein, 9 aa, Homo Sapiens
LGGIVGDIE

SEQ ID NO: 1088555 - protein, 9 aa, Homo Sapiens
GSDKKTTVT

SEQ ID NO: 1088556 - protein, 9 aa, Homo Sapiens
KEDLSSAFD

SEQ ID NO: 1088557 - protein, 9 aa, Homo Sapiens
IDQDKLAEE

SEQ ID NO: 1088558 - protein, 9 aa, Homo Sapiens
VFALETDGK

SEQ ID NO: 1088559 - protein, 9 aa, Homo Sapiens
FLCDPWNWL

SEQ ID NO: 1088560 - protein, 9 aa, Homo Sapiens
APPSTMTGD

SEQ ID NO: 1088561 - protein, 9 aa, Homo Sapiens
DQGEKNKDE

SEQ ID NO: 1088562 - protein, 9 aa, Homo Sapiens
FIDRATSLR

SEQ ID NO: 1088563 - protein, 9 aa, Homo Sapiens
PGLAPCLKH

SEQ ID NO: 1088564 - protein, 9 aa, Homo Sapiens
KGKKKQQEG

SEQ ID NO: 1088565 - protein, 9 aa, Homo Sapiens
FLQMKRVTC

SEQ ID NO: 1088566 - protein, 9 aa, Homo Sapiens
GFGQGFSDS

SEQ ID NO: 1088567 - protein, 9 aa, Homo Sapiens
ISVLMIFPQ

SEQ ID NO: 1088568 - protein, 9 aa, Homo Sapiens
PALVLMKLT

SEQ ID NO: 1088569 - protein, 9 aa, Homo Sapiens
DWKPEIHGN

SEQ ID NO: 1088570 - protein, 9 aa, Homo Sapiens
DLVYVMRTL

SEQ ID NO: 1088571 - protein, 9 aa, Homo Sapiens
QGRKIVNLS

SEQ ID NO: 1088572 - protein, 9 aa, Homo Sapiens
LFFLAVILE

SEQ ID NO: 1088573 - protein, 9 aa, Homo Sapiens
QNRLAEIPY

SEQ ID NO: 1088574 - protein, 9 aa, Homo Sapiens
TEDWVRLAE

SEQ ID NO: 1088575 - protein, 9 aa, Homo Sapiens
VIELGGIVG

SEQ ID NO: 1088576 - protein, 9 aa, Homo Sapiens
KSFTEISTD

SEQ ID NO: 1088577 - protein, 9 aa, Homo Sapiens
TSEADEFVS

SEQ ID NO: 1088578 - protein, 9 aa, Homo Sapiens
KQLESDLWL

SEQ ID NO: 1088579 - protein, 9 aa, Homo Sapiens
NLIWNRITE

SEQ ID NO: 1088580 - protein, 9 aa, Homo Sapiens
DFIEEIYRT

SEQ ID NO: 1088581 - protein, 9 aa, Homo Sapiens
FQAVDKCQS

SEQ ID NO: 1088582 - protein, 9 aa, Homo Sapiens
TNGSVFVVL

SEQ ID NO: 1088583 - protein, 9 aa, Homo Sapiens
MRATGLCFG

SEQ ID NO: 1088584 - protein, 9 aa, Homo Sapiens
GVSTLGSAG

SEQ ID NO: 1088585 - protein, 9 aa, Homo Sapiens
KSKLKFEQD

SEQ ID NO: 1088586 - protein, 9 aa, Homo Sapiens
EIDSENICS

SEQ ID NO: 1088587 - protein, 9 aa, Homo Sapiens
TTTTPEKEE

SEQ ID NO: 1088588 - protein, 9 aa, Homo Sapiens
QHRETVTET

SEQ ID NO: 1088589 - protein, 9 aa, Homo Sapiens
NGSHRLNRA

SEQ ID NO: 1088590 - protein, 9 aa, Homo Sapiens
KLAVLMTNS

SEQ ID NO: 1088591 - protein, 9 aa, Homo Sapiens
INFYPNGGN

SEQ ID NO: 1088592 - protein, 9 aa, Homo Sapiens
KELFKSPEK

SEQ ID NO: 1088593 - protein, 9 aa, Homo Sapiens
SYQSAWLTM

SEQ ID NO: 1088594 - protein, 9 aa, Homo Sapiens
ATGLCFGGQ

SEQ ID NO: 1088595 - protein, 9 aa, Homo Sapiens
PFCSKPTSA

SEQ ID NO: 1088596 - protein, 9 aa, Homo Sapiens
VSEIMWGYK

SEQ ID NO: 1088597 - protein, 9 aa, Homo Sapiens
SRSPPGVGL

SEQ ID NO: 1088598 - protein, 9 aa, Homo Sapiens
FSILGDGNA

SEQ ID NO: 1088599 - protein, 9 aa, Homo Sapiens
LWDINKERN

SEQ ID NO: 1088600 - protein, 9 aa, Homo Sapiens
KKGKAGNVK

SEQ ID NO: 1088601 - protein, 9 aa, Homo Sapiens
SAAPALAAP

SEQ ID NO: 1088602 - protein, 9 aa, Homo Sapiens
NDFYKCIYK

SEQ ID NO: 1088603 - protein, 9 aa, Homo Sapiens
FVDEFAMRY

SEQ ID NO: 1088604 - protein, 9 aa, Homo Sapiens
SAGDSKEDE

SEQ ID NO: 1088605 - protein, 9 aa, Homo Sapiens
RFSLGVGQV

SEQ ID NO: 1088606 - protein, 9 aa, Homo Sapiens
PLLVLSISE

SEQ ID NO: 1088607 - protein, 9 aa, Homo Sapiens
KRFQISWKH

SEQ ID NO: 1088608 - protein, 9 aa, Homo Sapiens
ETVFETAFG

SEQ ID NO: 1088609 - protein, 9 aa, Homo Sapiens
HCALDPKAL

SEQ ID NO: 1088610 - protein, 9 aa, Homo Sapiens
HQGKDNESD

SEQ ID NO: 1088611 - protein, 9 aa, Homo Sapiens
ASMIYPKEV

SEQ ID NO: 1088612 - protein, 9 aa, Homo Sapiens
CEVAPEDGQ

SEQ ID NO: 1088613 - protein, 9 aa, Homo Sapiens
LHLKIHTGE

SEQ ID NO: 1088614 - protein, 9 aa, Homo Sapiens
ILPTESLVP

SEQ ID NO: 1088615 - protein, 9 aa, Homo Sapiens
VCALENSRV

SEQ ID NO: 1088616 - protein, 9 aa, Homo Sapiens
MPLLVLSIS

SEQ ID NO: 1088617 - protein, 9 aa, Homo Sapiens
CFATSPRLC

SEQ ID NO: 1088618 - protein, 9 aa, Homo Sapiens
PEDGQVQKQ

SEQ ID NO: 1088619 - protein, 9 aa, Homo Sapiens
GEKPLGVGS

SEQ ID NO: 1088620 - protein, 9 aa, Homo Sapiens
FPVTDTSSA

SEQ ID NO: 1088621 - protein, 9 aa, Homo Sapiens
LCDYMVDGQ

SEQ ID NO: 1088622 - protein, 9 aa, Homo Sapiens
KEVVSQNRL

SEQ ID NO: 1088623 - protein, 9 aa, Homo Sapiens
SNQTSGSDI

SEQ ID NO: 1088624 - protein, 9 aa, Homo Sapiens
TRMSVKPVS

SEQ ID NO: 1088625 - protein, 9 aa, Homo Sapiens
LHHHQRLAG

SEQ ID NO: 1088626 - protein, 9 aa, Homo Sapiens
VVSEEEFFR

SEQ ID NO: 1088627 - protein, 9 aa, Homo Sapiens
WKQLESDLW

SEQ ID NO: 1088628 - protein, 9 aa, Homo Sapiens
NMPVFLEGT

SEQ ID NO: 1088629 - protein, 9 aa, Homo Sapiens
SMEEARLVL

SEQ ID NO: 1088630 - protein, 9 aa, Homo Sapiens
AERANKGFG

SEQ ID NO: 1088631 - protein, 9 aa, Homo Sapiens
AASMSSPGA

SEQ ID NO: 1088632 - protein, 9 aa, Homo Sapiens
GLIFLRILD

SEQ ID NO: 1088633 - protein, 9 aa, Homo Sapiens
CSLERCSSV

SEQ ID NO: 1088634 - protein, 9 aa, Homo Sapiens
REEKAVSFL

SEQ ID NO: 1088635 - protein, 9 aa, Homo Sapiens
CGIIDQDKL

SEQ ID NO: 1088636 - protein, 9 aa, Homo Sapiens
ILTDNNISH

SEQ ID NO: 1088637 - protein, 9 aa, Homo Sapiens
SITLRKPSG

SEQ ID NO: 1088638 - protein, 9 aa, Homo Sapiens
CSCFLSEQP

SEQ ID NO: 1088639 - protein, 9 aa, Homo Sapiens
HVPGYQLLR

SEQ ID NO: 1088640 - protein, 9 aa, Homo Sapiens
LVGFEVGDR

SEQ ID NO: 1088641 - protein, 9 aa, Homo Sapiens
AIGFDRYVA

SEQ ID NO: 1088642 - protein, 9 aa, Homo Sapiens
NPRSRQRIS

SEQ ID NO: 1088643 - protein, 9 aa, Homo Sapiens
GGKEVLTIE

SEQ ID NO: 1088644 - protein, 9 aa, Homo Sapiens
EKVKKKLRK

SEQ ID NO: 1088645 - protein, 9 aa, Homo Sapiens
YLEQYYDSS

SEQ ID NO: 1088646 - protein, 9 aa, Homo Sapiens
GSRAWASKD

SEQ ID NO: 1088647 - protein, 9 aa, Homo Sapiens
MSGTENATN

SEQ ID NO: 1088648 - protein, 9 aa, Homo Sapiens
EGVPDLVYV

SEQ ID NO: 1088649 - protein, 9 aa, Homo Sapiens
DSLDQLAIQ

SEQ ID NO: 1088650 - protein, 9 aa, Homo Sapiens
DKVVAQSLV

SEQ ID NO: 1088651 - protein, 9 aa, Homo Sapiens
LPFVPSAEN

SEQ ID NO: 1088652 - protein, 9 aa, Homo Sapiens
EPWRPGTAE

SEQ ID NO: 1088653 - protein, 9 aa, Homo Sapiens
GIIDQDKLA

SEQ ID NO: 1088654 - protein, 9 aa, Homo Sapiens
VFKFLAAGT

SEQ ID NO: 1088655 - protein, 9 aa, Homo Sapiens
HKKELFKSP

SEQ ID NO: 1088656 - protein, 9 aa, Homo Sapiens
AFALGQKFG

SEQ ID NO: 1088657 - protein, 9 aa, Homo Sapiens
ELSKEDLSS

SEQ ID NO: 1088658 - protein, 9 aa, Homo Sapiens
KQFQLQSTR

SEQ ID NO: 1088659 - protein, 9 aa, Homo Sapiens
YIREKISPV

SEQ ID NO: 1088660 - protein, 9 aa, Homo Sapiens
DLCLLEDEL

SEQ ID NO: 1088661 - protein, 9 aa, Homo Sapiens
KPEIHGNLV

SEQ ID NO: 1088662 - protein, 9 aa, Homo Sapiens
SCVHDMDSV

SEQ ID NO: 1088663 - protein, 9 aa, Homo Sapiens
TRHMRSHIG

SEQ ID NO: 1088664 - protein, 9 aa, Homo Sapiens
ERAESQYLL

SEQ ID NO: 1088665 - protein, 9 aa, Homo Sapiens
QTLLNSPAS

SEQ ID NO: 1088666 - protein, 9 aa, Homo Sapiens
FFQMLSFLT

SEQ ID NO: 1088667 - protein, 9 aa, Homo Sapiens
FYKCIYKGR

SEQ ID NO: 1088668 - protein, 9 aa, Homo Sapiens
LENSRVAYA

SEQ ID NO: 1088669 - protein, 9 aa, Homo Sapiens
APLETSPGA

SEQ ID NO: 1088670 - protein, 9 aa, Homo Sapiens
TQVSQKRGR

SEQ ID NO: 1088671 - protein, 9 aa, Homo Sapiens
ILNDEALAF

SEQ ID NO: 1088672 - protein, 9 aa, Homo Sapiens
FLLAAIGFD

SEQ ID NO: 1088673 - protein, 9 aa, Homo Sapiens
NCEEHSRIL

SEQ ID NO: 1088674 - protein, 9 aa, Homo Sapiens
KLAEEIELN

SEQ ID NO: 1088675 - protein, 9 aa, Homo Sapiens
QFSALGLDL

SEQ ID NO: 1088676 - protein, 9 aa, Homo Sapiens
IFSNLRCGT

SEQ ID NO: 1088677 - protein, 9 aa, Homo Sapiens
GKDNESDCR

SEQ ID NO: 1088678 - protein, 9 aa, Homo Sapiens
KKSRGLFSA

SEQ ID NO: 1088679 - protein, 9 aa, Homo Sapiens
KFWKHLVYK

SEQ ID NO: 1088680 - protein, 9 aa, Homo Sapiens
CRLPFISST

SEQ ID NO: 1088681 - protein, 9 aa, Homo Sapiens
GFPVCPPRG

SEQ ID NO: 1088682 - protein, 9 aa, Homo Sapiens
KRSSENTYK

SEQ ID NO: 1088683 - protein, 9 aa, Homo Sapiens
EQEISRVLS

SEQ ID NO: 1088684 - protein, 9 aa, Homo Sapiens
DTAGKEEYS

SEQ ID NO: 1088685 - protein, 9 aa, Homo Sapiens
MPGNEVPVE

SEQ ID NO: 1088686 - protein, 9 aa, Homo Sapiens
KIVLRKDLD

SEQ ID NO: 1088687 - protein, 9 aa, Homo Sapiens
RSHIGYELF

SEQ ID NO: 1088688 - protein, 9 aa, Homo Sapiens
GFEVGDRTL

SEQ ID NO: 1088689 - protein, 9 aa, Homo Sapiens
DTVKGRVLF

SEQ ID NO: 1088690 - protein, 9 aa, Homo Sapiens
RLVLTQEEL

SEQ ID NO: 1088691 - protein, 9 aa, Homo Sapiens
GGLGTCKEI

SEQ ID NO: 1088692 - protein, 9 aa, Homo Sapiens
TLIYANRAR

SEQ ID NO: 1088693 - protein, 9 aa, Homo Sapiens
EEEDWSREE

SEQ ID NO: 1088694 - protein, 9 aa, Homo Sapiens
EDDLDLEPF

SEQ ID NO: 1088695 - protein, 9 aa, Homo Sapiens
TFWRSSLLD

SEQ ID NO: 1088696 - protein, 9 aa, Homo Sapiens
PSSSHAASS

SEQ ID NO: 1088697 - protein, 9 aa, Homo Sapiens
LFKSPEKHF

SEQ ID NO: 1088698 - protein, 9 aa, Homo Sapiens
LLDPGTPDQ

SEQ ID NO: 1088699 - protein, 9 aa, Homo Sapiens
GMNGVLWAH

SEQ ID NO: 1088700 - protein, 9 aa, Homo Sapiens
VEKIQKIRY

SEQ ID NO: 1088701 - protein, 9 aa, Homo Sapiens
FIEEIYRTE

SEQ ID NO: 1088702 - protein, 9 aa, Homo Sapiens
LDVLYLHLY

SEQ ID NO: 1088703 - protein, 9 aa, Homo Sapiens
NPSDTEDWV

SEQ ID NO: 1088704 - protein, 9 aa, Homo Sapiens
PSHARYSSQ

SEQ ID NO: 1088705 - protein, 9 aa, Homo Sapiens
RLSLEETEL

SEQ ID NO: 1088706 - protein, 9 aa, Homo Sapiens
YLPVVQILL

SEQ ID NO: 1088707 - protein, 9 aa, Homo Sapiens
TAKAFSPSL

SEQ ID NO: 1088708 - protein, 9 aa, Homo Sapiens
CAGIKGVLE

SEQ ID NO: 1088709 - protein, 9 aa, Homo Sapiens
QNLGSVGQK

SEQ ID NO: 1088710 - protein, 9 aa, Homo Sapiens
CPFLKKILY

SEQ ID NO: 1088711 - protein, 9 aa, Homo Sapiens
INFHEEWLE

SEQ ID NO: 1088712 - protein, 9 aa, Homo Sapiens
LNFFIQFYN

SEQ ID NO: 1088713 - protein, 9 aa, Homo Sapiens
ECPSCPSPC

SEQ ID NO: 1088714 - protein, 9 aa, Homo Sapiens
GPKGFPGFS

SEQ ID NO: 1088715 - protein, 9 aa, Homo Sapiens
KISFKISIK

SEQ ID NO: 1088716 - protein, 9 aa, Homo Sapiens
FISLPRLLA

SEQ ID NO: 1088717 - protein, 9 aa, Homo Sapiens
YKTETPFSP

SEQ ID NO: 1088718 - protein, 9 aa, Homo Sapiens
VFFERERTG

SEQ ID NO: 1088719 - protein, 9 aa, Homo Sapiens
LQIAFQQHR

SEQ ID NO: 1088720 - protein, 9 aa, Homo Sapiens
SSHAASSHG

SEQ ID NO: 1088721 - protein, 9 aa, Homo Sapiens
LCYSVPEEA

SEQ ID NO: 1088722 - protein, 9 aa, Homo Sapiens
LGEPVFPQT

SEQ ID NO: 1088723 - protein, 9 aa, Homo Sapiens
EEESKQTEK

SEQ ID NO: 1088724 - protein, 9 aa, Homo Sapiens
DDVILTVSA

SEQ ID NO: 1088725 - protein, 9 aa, Homo Sapiens
FPFWRQIRS

SEQ ID NO: 1088726 - protein, 9 aa, Homo Sapiens
ALVDDVILT

SEQ ID NO: 1088727 - protein, 9 aa, Homo Sapiens
AALTHVGES

SEQ ID NO: 1088728 - protein, 9 aa, Homo Sapiens
CWEADPAVQ

SEQ ID NO: 1088729 - protein, 9 aa, Homo Sapiens
DFYKCIYKG

SEQ ID NO: 1088730 - protein, 9 aa, Homo Sapiens
INPGKIPRG

SEQ ID NO: 1088731 - protein, 9 aa, Homo Sapiens
YNSIEASLR

SEQ ID NO: 1088732 - protein, 9 aa, Homo Sapiens
TWLESLQIA

SEQ ID NO: 1088733 - protein, 9 aa, Homo Sapiens
HNQRTLDLN

SEQ ID NO: 1088734 - protein, 9 aa, Homo Sapiens
DEKWSFCAD

SEQ ID NO: 1088735 - protein, 9 aa, Homo Sapiens
SYLLKPVQQ

SEQ ID NO: 1088736 - protein, 9 aa, Homo Sapiens
HQHNRTTKN

SEQ ID NO: 1088737 - protein, 9 aa, Homo Sapiens
FQVSELVLN

SEQ ID NO: 1088738 - protein, 9 aa, Homo Sapiens
VQLILFSRI

SEQ ID NO: 1088739 - protein, 9 aa, Homo Sapiens
WDINKERNE

SEQ ID NO: 1088740 - protein, 9 aa, Homo Sapiens
EEDVFKFLA

SEQ ID NO: 1088741 - protein, 9 aa, Homo Sapiens
QVSQKRGRD

SEQ ID NO: 1088742 - protein, 9 aa, Homo Sapiens
SSGVSTLGS

SEQ ID NO: 1088743 - protein, 9 aa, Homo Sapiens
PYECDEWQM

SEQ ID NO: 1088744 - protein, 9 aa, Homo Sapiens
FSLGVGQVN

SEQ ID NO: 1088745 - protein, 9 aa, Homo Sapiens
GYKTETPFS

SEQ ID NO: 1088746 - protein, 9 aa, Homo Sapiens
YIIVVVLFF

SEQ ID NO: 1088747 - protein, 9 aa, Homo Sapiens
PGAPGREPG

SEQ ID NO: 1088748 - protein, 9 aa, Homo Sapiens
SSPSPASGC

SEQ ID NO: 1088749 - protein, 9 aa, Homo Sapiens
SNLKASDTA

SEQ ID NO: 1088750 - protein, 9 aa, Homo Sapiens
KRGSRAWAS

SEQ ID NO: 1088751 - protein, 9 aa, Homo Sapiens
ATWTSFLLG

SEQ ID NO: 1088752 - protein, 9 aa, Homo Sapiens
LNPDYVEVD

SEQ ID NO: 1088753 - protein, 9 aa, Homo Sapiens
HALDSGNAS

SEQ ID NO: 1088754 - protein, 9 aa, Homo Sapiens
LQWSNLKAS

SEQ ID NO: 1088755 - protein, 9 aa, Homo Sapiens
SAAESQRKG

SEQ ID NO: 1088756 - protein, 9 aa, Homo Sapiens
QEREKQFQL

SEQ ID NO: 1088757 - protein, 9 aa, Homo Sapiens
PPKSKKFSS

SEQ ID NO: 1088758 - protein, 9 aa, Homo Sapiens
SSIAGVSYN

SEQ ID NO: 1088759 - protein, 9 aa, Homo Sapiens
LQAAQEKKK

SEQ ID NO: 1088760 - protein, 9 aa, Homo Sapiens
YATLAKLSS

SEQ ID NO: 1088761 - protein, 9 aa, Homo Sapiens
QACQIPCQN

SEQ ID NO: 1088762 - protein, 9 aa, Homo Sapiens
GEFTFLCDP

SEQ ID NO: 1088763 - protein, 9 aa, Homo Sapiens
IGSLTSVLD

SEQ ID NO: 1088764 - protein, 9 aa, Homo Sapiens
YTGEKPYAC

SEQ ID NO: 1088765 - protein, 9 aa, Homo Sapiens
VSLPLRSGS

SEQ ID NO: 1088766 - protein, 9 aa, Homo Sapiens
YLCVQSSAG

SEQ ID NO: 1088767 - protein, 9 aa, Homo Sapiens
DLIRRKVEK

SEQ ID NO: 1088768 - protein, 9 aa, Homo Sapiens
CSQGGKETE

SEQ ID NO: 1088769 - protein, 9 aa, Homo Sapiens
IEDKYVQQK

SEQ ID NO: 1088770 - protein, 9 aa, Homo Sapiens
DEVLNILES

SEQ ID NO: 1088771 - protein, 9 aa, Homo Sapiens
PYKVSLNSQ

SEQ ID NO: 1088772 - protein, 9 aa, Homo Sapiens
CGMNGVLWA

SEQ ID NO: 1088773 - protein, 9 aa, Homo Sapiens
KGVLNDFYK

SEQ ID NO: 1088774 - protein, 9 aa, Homo Sapiens
SPETYEGNL

SEQ ID NO: 1088775 - protein, 9 aa, Homo Sapiens
FDSFFLDKV

SEQ ID NO: 1088776 - protein, 9 aa, Homo Sapiens
LFGGVECFL

SEQ ID NO: 1088777 - protein, 9 aa, Homo Sapiens
CFDAVFLDL

SEQ ID NO: 1088778 - protein, 9 aa, Homo Sapiens
CSKPTSASL

SEQ ID NO: 1088779 - protein, 9 aa, Homo Sapiens
LESMEFSAR

SEQ ID NO: 1088780 - protein, 9 aa, Homo Sapiens
IIDQDKLAE

SEQ ID NO: 1088781 - protein, 9 aa, Homo Sapiens
TLLQTYLSQ

SEQ ID NO: 1088782 - protein, 9 aa, Homo Sapiens
CPPRGIQEV

SEQ ID NO: 1088783 - protein, 9 aa, Homo Sapiens
LQVQPHSDA

SEQ ID NO: 1088784 - protein, 9 aa, Homo Sapiens
RKGSISEDE

SEQ ID NO: 1088785 - protein, 9 aa, Homo Sapiens
LTSVLALYR

SEQ ID NO: 1088786 - protein, 9 aa, Homo Sapiens
KEVSPHSRS

SEQ ID NO: 1088787 - protein, 9 aa, Homo Sapiens
WSNLKASDT

SEQ ID NO: 1088788 - protein, 9 aa, Homo Sapiens
TRTINDFSY

SEQ ID NO: 1088789 - protein, 9 aa, Homo Sapiens
SSLRLHLKI

SEQ ID NO: 1088790 - protein, 9 aa, Homo Sapiens
PVFLGEPVF

SEQ ID NO: 1088791 - protein, 9 aa, Homo Sapiens
SEADEFVSR

SEQ ID NO: 1088792 - protein, 9 aa, Homo Sapiens
AKQLSDVSS

SEQ ID NO: 1088793 - protein, 9 aa, Homo Sapiens
SFFQEQKCI

SEQ ID NO: 1088794 - protein, 9 aa, Homo Sapiens
ENPGILGPP

SEQ ID NO: 1088795 - protein, 9 aa, Homo Sapiens
GSHQSSGPG

SEQ ID NO: 1088796 - protein, 9 aa, Homo Sapiens
DSTRMSVKP

SEQ ID NO: 1088797 - protein, 9 aa, Homo Sapiens
PLNPDYVEV

SEQ ID NO: 1088798 - protein, 9 aa, Homo Sapiens
SKIDASLSE

SEQ ID NO: 1088799 - protein, 9 aa, Homo Sapiens
VSQFSGTMA

SEQ ID NO: 1088800 - protein, 9 aa, Homo Sapiens
AEKPPQRPA

SEQ ID NO: 1088801 - protein, 9 aa, Homo Sapiens
PPPYSPTSQ

SEQ ID NO: 1088802 - protein, 9 aa, Homo Sapiens
EDWSREERL

SEQ ID NO: 1088803 - protein, 9 aa, Homo Sapiens
DKLAEEIEL

SEQ ID NO: 1088804 - protein, 9 aa, Homo Sapiens
KKQQEGAVL

SEQ ID NO: 1088805 - protein, 9 aa, Homo Sapiens
VVLQVQPHS

SEQ ID NO: 1088806 - protein, 9 aa, Homo Sapiens
SQISYPVSQ

SEQ ID NO: 1088807 - protein, 9 aa, Homo Sapiens
VKNFCEYYG

SEQ ID NO: 1088808 - protein, 9 aa, Homo Sapiens
EVPKKVKEK

SEQ ID NO: 1088809 - protein, 9 aa, Homo Sapiens
RLSPDGHEL

SEQ ID NO: 1088810 - protein, 9 aa, Homo Sapiens
KDQPYKVSL

SEQ ID NO: 1088811 - protein, 9 aa, Homo Sapiens
HMRSHIGYE

SEQ ID NO: 1088812 - protein, 9 aa, Homo Sapiens
SGTENATNG

SEQ ID NO: 1088813 - protein, 9 aa, Homo Sapiens
QNKDRSVSS

SEQ ID NO: 1088814 - protein, 9 aa, Homo Sapiens
SEKSSGFGQ

SEQ ID NO: 1088815 - protein, 9 aa, Homo Sapiens
KHDDVMVKF

SEQ ID NO: 1088816 - protein, 9 aa, Homo Sapiens
KPPQRPAKV

SEQ ID NO: 1088817 - protein, 9 aa, Homo Sapiens
GKEIFENWL

SEQ ID NO: 1088818 - protein, 9 aa, Homo Sapiens
LAVLMTNSN

SEQ ID NO: 1088819 - protein, 9 aa, Homo Sapiens
SKGVQPKQV

SEQ ID NO: 1088820 - protein, 9 aa, Homo Sapiens
KEGVALTKE

SEQ ID NO: 1088821 - protein, 9 aa, Homo Sapiens
SRKVAELVY

SEQ ID NO: 1088822 - protein, 9 aa, Homo Sapiens
PLLNPLLYN

SEQ ID NO: 1088823 - protein, 9 aa, Homo Sapiens
LVFDVNDNA

SEQ ID NO: 1088824 - protein, 9 aa, Homo Sapiens
PTSEADEFV

SEQ ID NO: 1088825 - protein, 9 aa, Homo Sapiens
FSGTMAKPP

SEQ ID NO: 1088826 - protein, 9 aa, Homo Sapiens
NQAAGQEKK

SEQ ID NO: 1088827 - protein, 9 aa, Homo Sapiens
KLEWEDDTP

SEQ ID NO: 1088828 - protein, 9 aa, Homo Sapiens
YQHVTKVDK

SEQ ID NO: 1088829 - protein, 9 aa, Homo Sapiens
KVACCSLER

SEQ ID NO: 1088830 - protein, 9 aa, Homo Sapiens
NQTFSGLTP

SEQ ID NO: 1088831 - protein, 9 aa, Homo Sapiens
EADPAVQPT

SEQ ID NO: 1088832 - protein, 9 aa, Homo Sapiens
ALKQFRLSL

SEQ ID NO: 1088833 - protein, 9 aa, Homo Sapiens
GLEEEEGEG

SEQ ID NO: 1088834 - protein, 9 aa, Homo Sapiens
LSSAIKYVG

SEQ ID NO: 1088835 - protein, 9 aa, Homo Sapiens
EEARLVLTV

SEQ ID NO: 1088836 - protein, 9 aa, Homo Sapiens
WVQGPDLNS

SEQ ID NO: 1088837 - protein, 9 aa, Homo Sapiens
GHTTPFPVT

SEQ ID NO: 1088838 - protein, 9 aa, Homo Sapiens
SYILVVMSK

SEQ ID NO: 1088839 - protein, 9 aa, Homo Sapiens
RKKEQKQRD

SEQ ID NO: 1088840 - protein, 9 aa, Homo Sapiens
QGILCYPAS

SEQ ID NO: 1088841 - protein, 9 aa, Homo Sapiens
ASSGVSTLG

SEQ ID NO: 1088842 - protein, 9 aa, Homo Sapiens
EAEWVHWHK

SEQ ID NO: 1088843 - protein, 9 aa, Homo Sapiens
LHVFIIVPA

SEQ ID NO: 1088844 - protein, 9 aa, Homo Sapiens
KREVLECSL

SEQ ID NO: 1088845 - protein, 9 aa, Homo Sapiens
SYFSDRHLT

SEQ ID NO: 1088846 - protein, 9 aa, Homo Sapiens
VLIYPLWVI

SEQ ID NO: 1088847 - protein, 9 aa, Homo Sapiens
NERKQSPEK

SEQ ID NO: 1088848 - protein, 9 aa, Homo Sapiens
QNDSDCTLD

SEQ ID NO: 1088849 - protein, 9 aa, Homo Sapiens
WVGVTGATT

SEQ ID NO: 1088850 - protein, 9 aa, Homo Sapiens
GLELAAVFT

SEQ ID NO: 1088851 - protein, 9 aa, Homo Sapiens
GSPERAESQ

SEQ ID NO: 1088852 - protein, 9 aa, Homo Sapiens
VPDLVYVMR

SEQ ID NO: 1088853 - protein, 9 aa, Homo Sapiens
HGPLHPERL

SEQ ID NO: 1088854 - protein, 9 aa, Homo Sapiens
AGKEEYSAM

SEQ ID NO: 1088855 - protein, 9 aa, Homo Sapiens
FPDSNLEVV

SEQ ID NO: 1088856 - protein, 9 aa, Homo Sapiens
YSGSSDFES

SEQ ID NO: 1088857 - protein, 9 aa, Homo Sapiens
SRFLFPFWR

SEQ ID NO: 1088858 - protein, 9 aa, Homo Sapiens
YQLLRCRDR

SEQ ID NO: 1088859 - protein, 9 aa, Homo Sapiens
KLKFEQDGI

SEQ ID NO: 1088860 - protein, 9 aa, Homo Sapiens
LTHVGESSL

SEQ ID NO: 1088861 - protein, 9 aa, Homo Sapiens
LTVLENLGM

SEQ ID NO: 1088862 - protein, 9 aa, Homo Sapiens
QISYPVSQG

SEQ ID NO: 1088863 - protein, 9 aa, Homo Sapiens
AESQRKGSI

SEQ ID NO: 1088864 - protein, 9 aa, Homo Sapiens
HWHKGRLCL

SEQ ID NO: 1088865 - protein, 9 aa, Homo Sapiens
WSREERLPS

SEQ ID NO: 1088866 - protein, 9 aa, Homo Sapiens
VAELVYFLL

SEQ ID NO: 1088867 - protein, 9 aa, Homo Sapiens
EEFFRHIPP

SEQ ID NO: 1088868 - protein, 9 aa, Homo Sapiens
PPPKFPAEP

SEQ ID NO: 1088869 - protein, 9 aa, Homo Sapiens
YTCVATNLA

SEQ ID NO: 1088870 - protein, 9 aa, Homo Sapiens
ALTVTAQVR

SEQ ID NO: 1088871 - protein, 9 aa, Homo Sapiens
CYSTPAGYL

SEQ ID NO: 1088872 - protein, 9 aa, Homo Sapiens
GPLHPERLS

SEQ ID NO: 1088873 - protein, 9 aa, Homo Sapiens
AGPAELELE

SEQ ID NO: 1088874 - protein, 9 aa, Homo Sapiens
LTVKEKYPV

SEQ ID NO: 1088875 - protein, 9 aa, Homo Sapiens
LLVLSISEI

SEQ ID NO: 1088876 - protein, 9 aa, Homo Sapiens
NLVLETYIK

SEQ ID NO: 1088877 - protein, 9 aa, Homo Sapiens
LPLQNGRVA

SEQ ID NO: 1088878 - protein, 9 aa, Homo Sapiens
RKFQHFNLV

SEQ ID NO: 1088879 - protein, 9 aa, Homo Sapiens
AESQYLLVS

SEQ ID NO: 1088880 - protein, 9 aa, Homo Sapiens
TQNKDRSVS

SEQ ID NO: 1088881 - protein, 9 aa, Homo Sapiens
TVTAQVRPR

SEQ ID NO: 1088882 - protein, 9 aa, Homo Sapiens
RPKRLFFSS

SEQ ID NO: 1088883 - protein, 9 aa, Homo Sapiens
CQECGKFFQ

SEQ ID NO: 1088884 - protein, 9 aa, Homo Sapiens
VSPHSRSFM

SEQ ID NO: 1088885 - protein, 9 aa, Homo Sapiens
PMPLLVLSI

SEQ ID NO: 1088886 - protein, 9 aa, Homo Sapiens
FRLLVSMGH

SEQ ID NO: 1088887 - protein, 9 aa, Homo Sapiens
QHVRIHNGE

SEQ ID NO: 1088888 - protein, 9 aa, Homo Sapiens
PDPATRQNG

SEQ ID NO: 1088889 - protein, 9 aa, Homo Sapiens
NARITGTSS

SEQ ID NO: 1088890 - protein, 9 aa, Homo Sapiens
KFPAEPPAP

SEQ ID NO: 1088891 - protein, 9 aa, Homo Sapiens
PWWEAHFFF

SEQ ID NO: 1088892 - protein, 9 aa, Homo Sapiens
VAPEDGQVQ

SEQ ID NO: 1088893 - protein, 9 aa, Homo Sapiens
SHAASSHGL

SEQ ID NO: 1088894 - protein, 9 aa, Homo Sapiens
PQNWLSEGD

SEQ ID NO: 1088895 - protein, 9 aa, Homo Sapiens
PELLQPLKG

SEQ ID NO: 1088896 - protein, 9 aa, Homo Sapiens
FFEGCMTQL

SEQ ID NO: 1088897 - protein, 9 aa, Homo Sapiens
VLEIIDFFR

SEQ ID NO: 1088898 - protein, 9 aa, Homo Sapiens
TLAKLSSSL

SEQ ID NO: 1088899 - protein, 9 aa, Homo Sapiens
HVFIIVPAI

SEQ ID NO: 1088900 - protein, 9 aa, Homo Sapiens
QKDQPYKVS

SEQ ID NO: 1088901 - protein, 9 aa, Homo Sapiens
LEEEEGEGY

SEQ ID NO: 1088902 - protein, 9 aa, Homo Sapiens
RIQLITELG

SEQ ID NO: 1088903 - protein, 9 aa, Homo Sapiens
KGSDKKTTV

SEQ ID NO: 1088904 - protein, 9 aa, Homo Sapiens
QGEKNKDET

SEQ ID NO: 1088905 - protein, 9 aa, Homo Sapiens
EGTKGGQDI

SEQ ID NO: 1088906 - protein, 9 aa, Homo Sapiens
TLTVLENLG

SEQ ID NO: 1088907 - protein, 9 aa, Homo Sapiens
PSPASGCDN

SEQ ID NO: 1088908 - protein, 9 aa, Homo Sapiens
ALGPTSTES

SEQ ID NO: 1088909 - protein, 9 aa, Homo Sapiens
PCQNDCQLT

SEQ ID NO: 1088910 - protein, 9 aa, Homo Sapiens
PKSKKFSSK

SEQ ID NO: 1088911 - protein, 9 aa, Homo Sapiens
SLRLHLKIH

SEQ ID NO: 1088912 - protein, 9 aa, Homo Sapiens
FLRILDLSR

SEQ ID NO: 1088913 - protein, 9 aa, Homo Sapiens
CEEHSRILF

SEQ ID NO: 1088914 - protein, 9 aa, Homo Sapiens
DPAKSFTEI

SEQ ID NO: 1088915 - protein, 9 aa, Homo Sapiens
LFSRIIHML

SEQ ID NO: 1088916 - protein, 9 aa, Homo Sapiens
WRSSLLDVV

SEQ ID NO: 1088917 - protein, 9 aa, Homo Sapiens
SLDQLAIQT

SEQ ID NO: 1088918 - protein, 9 aa, Homo Sapiens
LEQKRQNLG

SEQ ID NO: 1088919 - protein, 9 aa, Homo Sapiens
HYILCWTSP

SEQ ID NO: 1088920 - protein, 9 aa, Homo Sapiens
PENPGILGP

SEQ ID NO: 1088921 - protein, 9 aa, Homo Sapiens
IFENWLIQV

SEQ ID NO: 1088922 - protein, 9 aa, Homo Sapiens
PPKVPFCSK

SEQ ID NO: 1088923 - protein, 9 aa, Homo Sapiens
RNVCLFFLL

SEQ ID NO: 1088924 - protein, 9 aa, Homo Sapiens
LHQAASMIY

SEQ ID NO: 1088925 - protein, 9 aa, Homo Sapiens
RVLENALVD

SEQ ID NO: 1088926 - protein, 9 aa, Homo Sapiens
SETSLSSAI

SEQ ID NO: 1088927 - protein, 9 aa, Homo Sapiens
SEIESPTDD

SEQ ID NO: 1088928 - protein, 9 aa, Homo Sapiens
KPVSSEIYN

SEQ ID NO: 1088929 - protein, 9 aa, Homo Sapiens
SRRREGLTP

SEQ ID NO: 1088930 - protein, 9 aa, Homo Sapiens
TSSIAGVSY

SEQ ID NO: 1088931 - protein, 9 aa, Homo Sapiens
RQRAEAKRV

SEQ ID NO: 1088932 - protein, 9 aa, Homo Sapiens
WHDDPFGAS

SEQ ID NO: 1088933 - protein, 9 aa, Homo Sapiens
MVVPSSDSL

SEQ ID NO: 1088934 - protein, 9 aa, Homo Sapiens
KVDKVVAQS

SEQ ID NO: 1088935 - protein, 9 aa, Homo Sapiens
AAVFTTPER

SEQ ID NO: 1088936 - protein, 9 aa, Homo Sapiens
GDQETSSEE

SEQ ID NO: 1088937 - protein, 9 aa, Homo Sapiens
LTDNNISHG

SEQ ID NO: 1088938 - protein, 9 aa, Homo Sapiens
ESLQIRYKL

SEQ ID NO: 1088939 - protein, 9 aa, Homo Sapiens
ILENLCGGT

SEQ ID NO: 1088940 - protein, 9 aa, Homo Sapiens
TTYRLAWGR

SEQ ID NO: 1088941 - protein, 9 aa, Homo Sapiens
RSKQEAWST

SEQ ID NO: 1088942 - protein, 9 aa, Homo Sapiens
SEQWISFQN

SEQ ID NO: 1088943 - protein, 9 aa, Homo Sapiens
PMTLLLLAG

SEQ ID NO: 1088944 - protein, 9 aa, Homo Sapiens
WVHWHKGRL

SEQ ID NO: 1088945 - protein, 9 aa, Homo Sapiens
YMVDGQPLA

SEQ ID NO: 1088946 - protein, 9 aa, Homo Sapiens
IGYELFEKP

SEQ ID NO: 1088947 - protein, 9 aa, Homo Sapiens
FEVGDRTLP

SEQ ID NO: 1088948 - protein, 9 aa, Homo Sapiens
RYSSQLDGE

SEQ ID NO: 1088949 - protein, 9 aa, Homo Sapiens
NKNNFSPKV

SEQ ID NO: 1088950 - protein, 9 aa, Homo Sapiens
ASKSFSLLS

SEQ ID NO: 1088951 - protein, 9 aa, Homo Sapiens
YHQRTLAMS

SEQ ID NO: 1088952 - protein, 9 aa, Homo Sapiens
IQISSGKEL

SEQ ID NO: 1088953 - protein, 9 aa, Homo Sapiens
VPKQEKGKK

SEQ ID NO: 1088954 - protein, 9 aa, Homo Sapiens
FISWAGTYL

SEQ ID NO: 1088955 - protein, 9 aa, Homo Sapiens
GNEKQRKNF

SEQ ID NO: 1088956 - protein, 9 aa, Homo Sapiens
LSTCISYII

SEQ ID NO: 1088957 - protein, 9 aa, Homo Sapiens
KNHPQFLAY

SEQ ID NO: 1088958 - protein, 9 aa, Homo Sapiens
WQMLHSEEK

SEQ ID NO: 1088959 - protein, 9 aa, Homo Sapiens
GPAELELEE

SEQ ID NO: 1088960 - protein, 9 aa, Homo Sapiens
AELELEEEL

SEQ ID NO: 1088961 - protein, 9 aa, Homo Sapiens
LALIFLPRT

SEQ ID NO: 1088962 - protein, 9 aa, Homo Sapiens
EPFSLPELP

SEQ ID NO: 1088963 - protein, 9 aa, Homo Sapiens
LRKPSGNHT

SEQ ID NO: 1088964 - protein, 9 aa, Homo Sapiens
AGVSYNSPS

SEQ ID NO: 1088965 - protein, 9 aa, Homo Sapiens
HGPLNISLI

SEQ ID NO: 1088966 - protein, 9 aa, Homo Sapiens
AAVTEVICS

SEQ ID NO: 1088967 - protein, 9 aa, Homo Sapiens
IIAKNESLQ

SEQ ID NO: 1088968 - protein, 9 aa, Homo Sapiens
DDKNSTAGE

SEQ ID NO: 1088969 - protein, 9 aa, Homo Sapiens
FSKKEGSNR

SEQ ID NO: 1088970 - protein, 9 aa, Homo Sapiens
LNISLIEGQ

SEQ ID NO: 1088971 - protein, 9 aa, Homo Sapiens
AVVPTHRFS

SEQ ID NO: 1088972 - protein, 9 aa, Homo Sapiens
IREKISPVV

SEQ ID NO: 1088973 - protein, 9 aa, Homo Sapiens
NSKLVLEAV

SEQ ID NO: 1088974 - protein, 9 aa, Homo Sapiens
PGRQGSGSG

SEQ ID NO: 1088975 - protein, 9 aa, Homo Sapiens
KGMDEMEFT

SEQ ID NO: 1088976 - protein, 9 aa, Homo Sapiens
LPELLQPLK

SEQ ID NO: 1088977 - protein, 9 aa, Homo Sapiens
AFLPPVSMV

SEQ ID NO: 1088978 - protein, 9 aa, Homo Sapiens
SVSAPIVAG

SEQ ID NO: 1088979 - protein, 9 aa, Homo Sapiens
GATTYRLAW

SEQ ID NO: 1088980 - protein, 9 aa, Homo Sapiens
KDVGSSSYV

SEQ ID NO: 1088981 - protein, 9 aa, Homo Sapiens
SKEDELYEA

SEQ ID NO: 1088982 - protein, 9 aa, Homo Sapiens
GLTPSNGIL

SEQ ID NO: 1088983 - protein, 9 aa, Homo Sapiens
MPRARRAYR

SEQ ID NO: 1088984 - protein, 9 aa, Homo Sapiens
SGNASPVQA

SEQ ID NO: 1088985 - protein, 9 aa, Homo Sapiens
ALAASTSFL

SEQ ID NO: 1088986 - protein, 9 aa, Homo Sapiens
ISGYGLGET

SEQ ID NO: 1088987 - protein, 9 aa, Homo Sapiens
QTFFQVSEL

SEQ ID NO: 1088988 - protein, 9 aa, Homo Sapiens
DNNISHGQC

SEQ ID NO: 1088989 - protein, 9 aa, Homo Sapiens
IDASLSEVL

SEQ ID NO: 1088990 - protein, 9 aa, Homo Sapiens
PGREPGGAG

SEQ ID NO: 1088991 - protein, 9 aa, Homo Sapiens
AYLGKMWIF

SEQ ID NO: 1088992 - protein, 9 aa, Homo Sapiens
GTKPKDSGV

SEQ ID NO: 1088993 - protein, 9 aa, Homo Sapiens
AGVLIYPLW

SEQ ID NO: 1088994 - protein, 9 aa, Homo Sapiens
YLLKPVQQI

SEQ ID NO: 1088995 - protein, 9 aa, Homo Sapiens
EVKNFCEYY

SEQ ID NO: 1088996 - protein, 9 aa, Homo Sapiens
STESHGALS

SEQ ID NO: 1088997 - protein, 9 aa, Homo Sapiens
QSLHTKAEA

SEQ ID NO: 1088998 - protein, 9 aa, Homo Sapiens
KDAVDAERL

SEQ ID NO: 1088999 - protein, 9 aa, Homo Sapiens
LHGPLHPER

SEQ ID NO: 1089000 - protein, 9 aa, Homo Sapiens
SKRENIFPD

SEQ ID NO: 1089001 - protein, 9 aa, Homo Sapiens
FVPSAENVY

SEQ ID NO: 1089002 - protein, 9 aa, Homo Sapiens
VECFLLGAM

SEQ ID NO: 1089003 - protein, 9 aa, Homo Sapiens
RTVSEIMWG

SEQ ID NO: 1089004 - protein, 9 aa, Homo Sapiens
HCNPCGLHF

SEQ ID NO: 1089005 - protein, 9 aa, Homo Sapiens
LDCTPFIAL

SEQ ID NO: 1089006 - protein, 9 aa, Homo Sapiens
RRREGLTPS

SEQ ID NO: 1089007 - protein, 9 aa, Homo Sapiens
NSKTQLKQH

SEQ ID NO: 1089008 - protein, 9 aa, Homo Sapiens
LIQNSGLLS

SEQ ID NO: 1089009 - protein, 9 aa, Homo Sapiens
PLRSGSHCS

SEQ ID NO: 1089010 - protein, 9 aa, Homo Sapiens
IHCRVIGYS

SEQ ID NO: 1089011 - protein, 9 aa, Homo Sapiens
REPGGAGGG

SEQ ID NO: 1089012 - protein, 9 aa, Homo Sapiens
EYIRFYMEL

SEQ ID NO: 1089013 - protein, 9 aa, Homo Sapiens
TWRETGIFF

SEQ ID NO: 1089014 - protein, 9 aa, Homo Sapiens
LNQTFFQVS

SEQ ID NO: 1089015 - protein, 9 aa, Homo Sapiens
FQLQSTRGN

SEQ ID NO: 1089016 - protein, 9 aa, Homo Sapiens
KPYITPAVY

SEQ ID NO: 1089017 - protein, 9 aa, Homo Sapiens
FLHWYTGKG

SEQ ID NO: 1089018 - protein, 9 aa, Homo Sapiens
TSTTDVATT

SEQ ID NO: 1089019 - protein, 9 aa, Homo Sapiens
LLGEEWKQL

SEQ ID NO: 1089020 - protein, 9 aa, Homo Sapiens
HVTKVDKVV

SEQ ID NO: 1089021 - protein, 9 aa, Homo Sapiens
TLLHVFIIV

SEQ ID NO: 1089022 - protein, 9 aa, Homo Sapiens
SFLGCYALC

SEQ ID NO: 1089023 - protein, 9 aa, Homo Sapiens
GDNLLPILR

SEQ ID NO: 1089024 - protein, 9 aa, Homo Sapiens
LLEPWRPGT

SEQ ID NO: 1089025 - protein, 9 aa, Homo Sapiens
ISFKISIKS

SEQ ID NO: 1089026 - protein, 9 aa, Homo Sapiens
SGGKYNLNS

SEQ ID NO: 1089027 - protein, 9 aa, Homo Sapiens
ENSHEGKIL

SEQ ID NO: 1089028 - protein, 9 aa, Homo Sapiens
KCQECGKFF

SEQ ID NO: 1089029 - protein, 9 aa, Homo Sapiens
PPVSMVHGA

SEQ ID NO: 1089030 - protein, 9 aa, Homo Sapiens
VQYLKDTDP

SEQ ID NO: 1089031 - protein, 9 aa, Homo Sapiens
EDLDALKHM

SEQ ID NO: 1089032 - protein, 9 aa, Homo Sapiens
HGQLIFFEG

SEQ ID NO: 1089033 - protein, 9 aa, Homo Sapiens
RFSSFKFIP

SEQ ID NO: 1089034 - protein, 9 aa, Homo Sapiens
CNKLKSQQE

SEQ ID NO: 1089035 - protein, 9 aa, Homo Sapiens
LVVMSKLSD

SEQ ID NO: 1089036 - protein, 9 aa, Homo Sapiens
QEKKKLKVE

SEQ ID NO: 1089037 - protein, 9 aa, Homo Sapiens
VATNLAGEE

SEQ ID NO: 1089038 - protein, 9 aa, Homo Sapiens
NLHLNVTAK

SEQ ID NO: 1089039 - protein, 9 aa, Homo Sapiens
EKPPQRPAK

SEQ ID NO: 1089040 - protein, 9 aa, Homo Sapiens
AEWVHWHKG

SEQ ID NO: 1089041 - protein, 9 aa, Homo Sapiens
THRFSSFKF

SEQ ID NO: 1089042 - protein, 9 aa, Homo Sapiens
KGKNISTVL

SEQ ID NO: 1089043 - protein, 9 aa, Homo Sapiens
QLIFFEGCM

SEQ ID NO: 1089044 - protein, 9 aa, Homo Sapiens
PKRPDTLWQ

SEQ ID NO: 1089045 - protein, 9 aa, Homo Sapiens
GKPGLPGLP

SEQ ID NO: 1089046 - protein, 9 aa, Homo Sapiens
RGAVASCQS

SEQ ID NO: 1089047 - protein, 9 aa, Homo Sapiens
PAAIDFFQD

SEQ ID NO: 1089048 - protein, 9 aa, Homo Sapiens
SKISVRTMP

SEQ ID NO: 1089049 - protein, 9 aa, Homo Sapiens
VSQKRGRDP

SEQ ID NO: 1089050 - protein, 9 aa, Homo Sapiens
SMSGTENAT

SEQ ID NO: 1089051 - protein, 9 aa, Homo Sapiens
ILRGIFFVP

SEQ ID NO: 1089052 - protein, 9 aa, Homo Sapiens
YARPFDSFF

SEQ ID NO: 1089053 - protein, 9 aa, Homo Sapiens
VGVTGATTY

SEQ ID NO: 1089054 - protein, 9 aa, Homo Sapiens
PRSITLRKP

SEQ ID NO: 1089055 - protein, 9 aa, Homo Sapiens
AKAFSPSLL

SEQ ID NO: 1089056 - protein, 9 aa, Homo Sapiens
LGVNIQIVG

SEQ ID NO: 1089057 - protein, 9 aa, Homo Sapiens
DLRVGFISW

SEQ ID NO: 1089058 - protein, 9 aa, Homo Sapiens
RTTKNYPNA

SEQ ID NO: 1089059 - protein, 9 aa, Homo Sapiens
QIPCQNDCQ

SEQ ID NO: 1089060 - protein, 9 aa, Homo Sapiens
FLPMEGGDS

SEQ ID NO: 1089061 - protein, 9 aa, Homo Sapiens
KNESLQIRY

SEQ ID NO: 1089062 - protein, 9 aa, Homo Sapiens
ELQAAQEKK

SEQ ID NO: 1089063 - protein, 9 aa, Homo Sapiens
ERSFQAGEL

SEQ ID NO: 1089064 - protein, 9 aa, Homo Sapiens
DWVRLAEMS

SEQ ID NO: 1089065 - protein, 9 aa, Homo Sapiens
QYYDSSDEP

SEQ ID NO: 1089066 - protein, 9 aa, Homo Sapiens
LDQLAIQTK

SEQ ID NO: 1089067 - protein, 9 aa, Homo Sapiens
SSLLDVVDR

SEQ ID NO: 1089068 - protein, 9 aa, Homo Sapiens
CCSLERCSS

SEQ ID NO: 1089069 - protein, 9 aa, Homo Sapiens
DPNCAGIKG

SEQ ID NO: 1089070 - protein, 9 aa, Homo Sapiens
PDLNSKAGL

SEQ ID NO: 1089071 - protein, 9 aa, Homo Sapiens
ILHFVPCIY

SEQ ID NO: 1089072 - protein, 9 aa, Homo Sapiens
LPRTRPAGV

SEQ ID NO: 1089073 - protein, 9 aa, Homo Sapiens
CSEQWISFQ

SEQ ID NO: 1089074 - protein, 9 aa, Homo Sapiens
REVRNEYGL

SEQ ID NO: 1089075 - protein, 9 aa, Homo Sapiens
KERNEETCK

SEQ ID NO: 1089076 - protein, 9 aa, Homo Sapiens
VHVNSKTQL

SEQ ID NO: 1089077 - protein, 9 aa, Homo Sapiens
KRENIFPDY

SEQ ID NO: 1089078 - protein, 9 aa, Homo Sapiens
PKHVLINWV

SEQ ID NO: 1089079 - protein, 9 aa, Homo Sapiens
LENLCGGTN

SEQ ID NO: 1089080 - protein, 9 aa, Homo Sapiens
ILEISLRLR

SEQ ID NO: 1089081 - protein, 9 aa, Homo Sapiens
NIRDVFIQQ

SEQ ID NO: 1089082 - protein, 9 aa, Homo Sapiens
AKCTEEEKW

SEQ ID NO: 1089083 - protein, 9 aa, Homo Sapiens
SKTDQNLEK

SEQ ID NO: 1089084 - protein, 9 aa, Homo Sapiens
VCPPRGIQE

SEQ ID NO: 1089085 - protein, 9 aa, Homo Sapiens
DLDNVEDIA

SEQ ID NO: 1089086 - protein, 9 aa, Homo Sapiens
KKTTVTDAK

SEQ ID NO: 1089087 - protein, 9 aa, Homo Sapiens
LGETFDSNL

SEQ ID NO: 1089088 - protein, 9 aa, Homo Sapiens
TKVDKVVAQ

SEQ ID NO: 1089089 - protein, 9 aa, Homo Sapiens
QWISFQNKC

SEQ ID NO: 1089090 - protein, 9 aa, Homo Sapiens
SPASAAVLP

SEQ ID NO: 1089091 - protein, 9 aa, Homo Sapiens
EEWLEVLGC

SEQ ID NO: 1089092 - protein, 9 aa, Homo Sapiens
KKDASRFLF

SEQ ID NO: 1089093 - protein, 9 aa, Homo Sapiens
YLKDTDPFA

SEQ ID NO: 1089094 - protein, 9 aa, Homo Sapiens
SRQRISRDL

SEQ ID NO: 1089095 - protein, 9 aa, Homo Sapiens
GVECFLLGA

SEQ ID NO: 1089096 - protein, 9 aa, Homo Sapiens
GPLPLLRPL

SEQ ID NO: 1089097 - protein, 9 aa, Homo Sapiens
VNFTQKEWA

SEQ ID NO: 1089098 - protein, 9 aa, Homo Sapiens
EQFYHQRTL

SEQ ID NO: 1089099 - protein, 9 aa, Homo Sapiens
IGSSLGSSM

SEQ ID NO: 1089100 - protein, 9 aa, Homo Sapiens
NVCCPQNWL

SEQ ID NO: 1089101 - protein, 9 aa, Homo Sapiens
NVYDCQVEH

SEQ ID NO: 1089102 - protein, 9 aa, Homo Sapiens
AVLCLEVTL

SEQ ID NO: 1089103 - protein, 9 aa, Homo Sapiens
VRNEYGLRI

SEQ ID NO: 1089104 - protein, 9 aa, Homo Sapiens
VVPSSDSLD

SEQ ID NO: 1089105 - protein, 9 aa, Homo Sapiens
SKSKISVRT

SEQ ID NO: 1089106 - protein, 9 aa, Homo Sapiens
LTMLPEEDP

SEQ ID NO: 1089107 - protein, 9 aa, Homo Sapiens
GPDLNSKAG

SEQ ID NO: 1089108 - protein, 9 aa, Homo Sapiens
NPLLYNLRN

SEQ ID NO: 1089109 - protein, 9 aa, Homo Sapiens
FVDKQKLGK

SEQ ID NO: 1089110 - protein, 9 aa, Homo Sapiens
EHNQRTLDL

SEQ ID NO: 1089111 - protein, 9 aa, Homo Sapiens
APLKEAPAE

SEQ ID NO: 1089112 - protein, 9 aa, Homo Sapiens
ESLQIAFQQ

SEQ ID NO: 1089113 - protein, 9 aa, Homo Sapiens
QMLHSEEKP

SEQ ID NO: 1089114 - protein, 9 aa, Homo Sapiens
SWHDDPFGA

SEQ ID NO: 1089115 - protein, 9 aa, Homo Sapiens
APKEAPLKE

SEQ ID NO: 1089116 - protein, 9 aa, Homo Sapiens
CTEEEKWSP

SEQ ID NO: 1089117 - protein, 9 aa, Homo Sapiens
SQEEEEMEA

SEQ ID NO: 1089118 - protein, 9 aa, Homo Sapiens
HDDVMVKFG

SEQ ID NO: 1089119 - protein, 9 aa, Homo Sapiens
KCTEEEKWS

SEQ ID NO: 1089120 - protein, 9 aa, Homo Sapiens
TEIGKTLAK

SEQ ID NO: 1089121 - protein, 9 aa, Homo Sapiens
RISKCNKLK

SEQ ID NO: 1089122 - protein, 9 aa, Homo Sapiens
QTSFPVETV

SEQ ID NO: 1089123 - protein, 9 aa, Homo Sapiens
VFLDLFDAC

SEQ ID NO: 1089124 - protein, 9 aa, Homo Sapiens
SKEDLSSAF

SEQ ID NO: 1089125 - protein, 9 aa, Homo Sapiens
TSFLGCYAL

SEQ ID NO: 1089126 - protein, 9 aa, Homo Sapiens
SCSTSRERS

SEQ ID NO: 1089127 - protein, 9 aa, Homo Sapiens
EESKQTEKD

SEQ ID NO: 1089128 - protein, 9 aa, Homo Sapiens
LQLPNTLPV

SEQ ID NO: 1089129 - protein, 9 aa, Homo Sapiens
LPQTLLNSP

SEQ ID NO: 1089130 - protein, 9 aa, Homo Sapiens
EELLDNQKL

SEQ ID NO: 1089131 - protein, 9 aa, Homo Sapiens
HLNPSDTED

SEQ ID NO: 1089132 - protein, 9 aa, Homo Sapiens
GARGNPALL

SEQ ID NO: 1089133 - protein, 9 aa, Homo Sapiens
QAATLALRD

SEQ ID NO: 1089134 - protein, 9 aa, Homo Sapiens
FFQDAVKCL

SEQ ID NO: 1089135 - protein, 9 aa, Homo Sapiens
VYKECQQSN

SEQ ID NO: 1089136 - protein, 9 aa, Homo Sapiens
PWSNQTFSG

SEQ ID NO: 1089137 - protein, 9 aa, Homo Sapiens
CQIPCQNDC

SEQ ID NO: 1089138 - protein, 9 aa, Homo Sapiens
SLPGLAPCL

SEQ ID NO: 1089139 - protein, 9 aa, Homo Sapiens
VVPAQGKEI

SEQ ID NO: 1089140 - protein, 9 aa, Homo Sapiens
QRGRLQTKS

SEQ ID NO: 1089141 - protein, 9 aa, Homo Sapiens
VMQWLDENK

SEQ ID NO: 1089142 - protein, 9 aa, Homo Sapiens
SRERSFQAG

SEQ ID NO: 1089143 - protein, 9 aa, Homo Sapiens
NYDSTCGMN

SEQ ID NO: 1089144 - protein, 9 aa, Homo Sapiens
EQKRQNLGS

SEQ ID NO: 1089145 - protein, 9 aa, Homo Sapiens
KVEKVKKKL

SEQ ID NO: 1089146 - protein, 9 aa, Homo Sapiens
YDSTCGMNG

SEQ ID NO: 1089147 - protein, 9 aa, Homo Sapiens
KEERPLRGD

SEQ ID NO: 1089148 - protein, 9 aa, Homo Sapiens
GVPDLVYVM

SEQ ID NO: 1089149 - protein, 9 aa, Homo Sapiens
NRQWNYACM

SEQ ID NO: 1089150 - protein, 9 aa, Homo Sapiens
VLSISEIQN

SEQ ID NO: 1089151 - protein, 9 aa, Homo Sapiens
VTEVICSQG

SEQ ID NO: 1089152 - protein, 9 aa, Homo Sapiens
NRGPLPLLR

SEQ ID NO: 1089153 - protein, 9 aa, Homo Sapiens
EAKRVLAEK

SEQ ID NO: 1089154 - protein, 9 aa, Homo Sapiens
LFTLLHVFI

SEQ ID NO: 1089155 - protein, 9 aa, Homo Sapiens
ISFQNKCFL

SEQ ID NO: 1089156 - protein, 9 aa, Homo Sapiens
AVQPTFRVL

SEQ ID NO: 1089157 - protein, 9 aa, Homo Sapiens
GTTGLQLPN

SEQ ID NO: 1089158 - protein, 9 aa, Homo Sapiens
NLVMNACVV

SEQ ID NO: 1089159 - protein, 9 aa, Homo Sapiens
CALENSRVA

SEQ ID NO: 1089160 - protein, 9 aa, Homo Sapiens
VEILPTESL

SEQ ID NO: 1089161 - protein, 9 aa, Homo Sapiens
QFRLSLEET

SEQ ID NO: 1089162 - protein, 9 aa, Homo Sapiens
DFADDKNST

SEQ ID NO: 1089163 - protein, 9 aa, Homo Sapiens
APDPATRQN

SEQ ID NO: 1089164 - protein, 9 aa, Homo Sapiens
AELRSEISV

SEQ ID NO: 1089165 - protein, 9 aa, Homo Sapiens
NCFLLAAIG

SEQ ID NO: 1089166 - protein, 9 aa, Homo Sapiens
FEEALYNSI

SEQ ID NO: 1089167 - protein, 9 aa, Homo Sapiens
RTLDLNSPR

SEQ ID NO: 1089168 - protein, 9 aa, Homo Sapiens
KYDLSATID

SEQ ID NO: 1089169 - protein, 9 aa, Homo Sapiens
VAALTHVGE

SEQ ID NO: 1089170 - protein, 9 aa, Homo Sapiens
LVTSKIVLR

SEQ ID NO: 1089171 - protein, 9 aa, Homo Sapiens
TVSEIMWGY

SEQ ID NO: 1089172 - protein, 9 aa, Homo Sapiens
DDGTHLSLI

SEQ ID NO: 1089173 - protein, 9 aa, Homo Sapiens
ELLDNQKLE

SEQ ID NO: 1089174 - protein, 9 aa, Homo Sapiens
KKKASVMIQ

SEQ ID NO: 1089175 - protein, 9 aa, Homo Sapiens
QHFNLVLET

SEQ ID NO: 1089176 - protein, 9 aa, Homo Sapiens
TIISKGIER

SEQ ID NO: 1089177 - protein, 9 aa, Homo Sapiens
QNGSHRLNR

SEQ ID NO: 1089178 - protein, 9 aa, Homo Sapiens
SIAGVSYNS

SEQ ID NO: 1089179 - protein, 9 aa, Homo Sapiens
VDKVVAQSL

SEQ ID NO: 1089180 - protein, 9 aa, Homo Sapiens
SKIVLRKDL

SEQ ID NO: 1089181 - protein, 9 aa, Homo Sapiens
STCGMNGVL

SEQ ID NO: 1089182 - protein, 9 aa, Homo Sapiens
IPCQNDCQL

SEQ ID NO: 1089183 - protein, 9 aa, Homo Sapiens
KILYATVFS

SEQ ID NO: 1089184 - protein, 9 aa, Homo Sapiens
AANKGYLPV

SEQ ID NO: 1089185 - protein, 9 aa, Homo Sapiens
KAEDLRVGF

SEQ ID NO: 1089186 - protein, 9 aa, Homo Sapiens
PKGFPGFSG

SEQ ID NO: 1089187 - protein, 9 aa, Homo Sapiens
ISKGIERGS

SEQ ID NO: 1089188 - protein, 9 aa, Homo Sapiens
LLLLTPLPP

SEQ ID NO: 1089189 - protein, 9 aa, Homo Sapiens
PYSPTSQGP

SEQ ID NO: 1089190 - protein, 9 aa, Homo Sapiens
RVEILPTES

SEQ ID NO: 1089191 - protein, 9 aa, Homo Sapiens
GTFQGLIFL

SEQ ID NO: 1089192 - protein, 9 aa, Homo Sapiens
ALVLMKLTF

SEQ ID NO: 1089193 - protein, 9 aa, Homo Sapiens
SEAEWVHWH

SEQ ID NO: 1089194 - protein, 9 aa, Homo Sapiens
ERNEETCKM

SEQ ID NO: 1089195 - protein, 9 aa, Homo Sapiens
MSLQRGFFN

SEQ ID NO: 1089196 - protein, 9 aa, Homo Sapiens
FALETDGKK

SEQ ID NO: 1089197 - protein, 9 aa, Homo Sapiens
VTSKIVLRK

SEQ ID NO: 1089198 - protein, 9 aa, Homo Sapiens
LAPCLKHFP

SEQ ID NO: 1089199 - protein, 9 aa, Homo Sapiens
PTSQGPAQR

SEQ ID NO: 1089200 - protein, 9 aa, Homo Sapiens
STLGSAGHD

SEQ ID NO: 1089201 - protein, 9 aa, Homo Sapiens
NNISHGQCV

SEQ ID NO: 1089202 - protein, 9 aa, Homo Sapiens
SFQAGELIL

SEQ ID NO: 1089203 - protein, 9 aa, Homo Sapiens
STCISYIIV

SEQ ID NO: 1089204 - protein, 9 aa, Homo Sapiens
LCVQSSAGL

SEQ ID NO: 1089205 - protein, 9 aa, Homo Sapiens
ARGNPALLD

SEQ ID NO: 1089206 - protein, 9 aa, Homo Sapiens
PRHRPKRLF

SEQ ID NO: 1089207 - protein, 9 aa, Homo Sapiens
GAPPSTMTG

SEQ ID NO: 1089208 - protein, 9 aa, Homo Sapiens
SWSNQTSGS

SEQ ID NO: 1089209 - protein, 9 aa, Homo Sapiens
KEKRIILPK

SEQ ID NO: 1089210 - protein, 9 aa, Homo Sapiens
DEVHIVKDK

SEQ ID NO: 1089211 - protein, 9 aa, Homo Sapiens
NPRTRTIND

SEQ ID NO: 1089212 - protein, 9 aa, Homo Sapiens
CGKFFQMLS

SEQ ID NO: 1089213 - protein, 9 aa, Homo Sapiens
LRDFDRALL

SEQ ID NO: 1089214 - protein, 9 aa, Homo Sapiens
VDDVILTVS

SEQ ID NO: 1089215 - protein, 9 aa, Homo Sapiens
YLSQLFYHL

SEQ ID NO: 1089216 - protein, 9 aa, Homo Sapiens
ISHGQCVIC

SEQ ID NO: 1089217 - protein, 9 aa, Homo Sapiens
DSKEDELYE

SEQ ID NO: 1089218 - protein, 9 aa, Homo Sapiens
VSTLGSAGH

SEQ ID NO: 1089219 - protein, 9 aa, Homo Sapiens
EAGTKPKDS

SEQ ID NO: 1089220 - protein, 9 aa, Homo Sapiens
ASGCDNAIP

SEQ ID NO: 1089221 - protein, 9 aa, Homo Sapiens
DDVMVKFGA

SEQ ID NO: 1089222 - protein, 9 aa, Homo Sapiens
RAPPDWVKA

SEQ ID NO: 1089223 - protein, 9 aa, Homo Sapiens
DSQAIFGSK

SEQ ID NO: 1089224 - protein, 9 aa, Homo Sapiens
LRDVQALCD

SEQ ID NO: 1089225 - protein, 9 aa, Homo Sapiens
FWKHLVYKM

SEQ ID NO: 1089226 - protein, 9 aa, Homo Sapiens
VKFGAILAQ

SEQ ID NO: 1089227 - protein, 9 aa, Homo Sapiens
QPPLASCSL

SEQ ID NO: 1089228 - protein, 9 aa, Homo Sapiens
QKIRYRSKL

SEQ ID NO: 1089229 - protein, 9 aa, Homo Sapiens
NVEDIAVDW

SEQ ID NO: 1089230 - protein, 9 aa, Homo Sapiens
FLDLFDACG

SEQ ID NO: 1089231 - protein, 9 aa, Homo Sapiens
FGQGFSDSS

SEQ ID NO: 1089232 - protein, 9 aa, Homo Sapiens
TYMVQLLQD

SEQ ID NO: 1089233 - protein, 9 aa, Homo Sapiens
SPYIPPHAV

SEQ ID NO: 1089234 - protein, 9 aa, Homo Sapiens
STTDVATTQ

SEQ ID NO: 1089235 - protein, 9 aa, Homo Sapiens
ELVYFLLLK

SEQ ID NO: 1089236 - protein, 9 aa, Homo Sapiens
QEKGKKKQQ

SEQ ID NO: 1089237 - protein, 9 aa, Homo Sapiens
HISEAEWVH

SEQ ID NO: 1089238 - protein, 9 aa, Homo Sapiens
RGRLQTKSG

SEQ ID NO: 1089239 - protein, 9 aa, Homo Sapiens
ILRKFIASF

SEQ ID NO: 1089240 - protein, 9 aa, Homo Sapiens
EDPAKSFTE

SEQ ID NO: 1089241 - protein, 9 aa, Homo Sapiens
MIYPKEVPP

SEQ ID NO: 1089242 - protein, 9 aa, Homo Sapiens
EELTSNVGD

SEQ ID NO: 1089243 - protein, 9 aa, Homo Sapiens
QMKEEDVFK

SEQ ID NO: 1089244 - protein, 9 aa, Homo Sapiens
SWKHATRHS

SEQ ID NO: 1089245 - protein, 9 aa, Homo Sapiens
NPCGLHFRH

SEQ ID NO: 1089246 - protein, 9 aa, Homo Sapiens
GYGLGETFD

SEQ ID NO: 1089247 - protein, 9 aa, Homo Sapiens
EIRIEFINE

SEQ ID NO: 1089248 - protein, 9 aa, Homo Sapiens
LRGIFFVPG

SEQ ID NO: 1089249 - protein, 9 aa, Homo Sapiens
LNDEALAFS

SEQ ID NO: 1089250 - protein, 9 aa, Homo Sapiens
ATNLAGEED

SEQ ID NO: 1089251 - protein, 9 aa, Homo Sapiens
EVGVHEIRI

SEQ ID NO: 1089252 - protein, 9 aa, Homo Sapiens
AIFGSKDVG

SEQ ID NO: 1089253 - protein, 9 aa, Homo Sapiens
NSKAGLRTC

SEQ ID NO: 1089254 - protein, 9 aa, Homo Sapiens
RVLSAQRSP

SEQ ID NO: 1089255 - protein, 9 aa, Homo Sapiens
LRIFGAAQF

SEQ ID NO: 1089256 - protein, 9 aa, Homo Sapiens
AAGQEKKGK

SEQ ID NO: 1089257 - protein, 9 aa, Homo Sapiens
EPLNPDYVE

SEQ ID NO: 1089258 - protein, 9 aa, Homo Sapiens
GVALTKEVA

SEQ ID NO: 1089259 - protein, 9 aa, Homo Sapiens
LILFSRIIH

SEQ ID NO: 1089260 - protein, 9 aa, Homo Sapiens
LAPLLVILN

SEQ ID NO: 1089261 - protein, 9 aa, Homo Sapiens
ELFKSPEKH

SEQ ID NO: 1089262 - protein, 9 aa, Homo Sapiens
TPFPVTDTS

SEQ ID NO: 1089263 - protein, 9 aa, Homo Sapiens
PFDSFFLDK

SEQ ID NO: 1089264 - protein, 9 aa, Homo Sapiens
VHEIRIEFI

SEQ ID NO: 1089265 - protein, 9 aa, Homo Sapiens
LTSVLDCNY

SEQ ID NO: 1089266 - protein, 9 aa, Homo Sapiens
HGNLVMNAC

SEQ ID NO: 1089267 - protein, 9 aa, Homo Sapiens
FLGCYALCG

SEQ ID NO: 1089268 - protein, 9 aa, Homo Sapiens
VPKKVKEKR

SEQ ID NO: 1089269 - protein, 9 aa, Homo Sapiens
YMELPGSGN

SEQ ID NO: 1089270 - protein, 9 aa, Homo Sapiens
TESKSKISV

SEQ ID NO: 1089271 - protein, 9 aa, Homo Sapiens
SLTSVLDCN

SEQ ID NO: 1089272 - protein, 9 aa, Homo Sapiens
DLYEIFLQM

SEQ ID NO: 1089273 - protein, 9 aa, Homo Sapiens
LVYKMPIKK

SEQ ID NO: 1089274 - protein, 9 aa, Homo Sapiens
TESHGALSI

SEQ ID NO: 1089275 - protein, 9 aa, Homo Sapiens
AHKVGITSP

SEQ ID NO: 1089276 - protein, 9 aa, Homo Sapiens
DNVEDIAVD

SEQ ID NO: 1089277 - protein, 9 aa, Homo Sapiens
PLGQRGYPE

SEQ ID NO: 1089278 - protein, 9 aa, Homo Sapiens
GQEKKGKAG

SEQ ID NO: 1089279 - protein, 9 aa, Homo Sapiens
HYTQVSQKR

SEQ ID NO: 1089280 - protein, 9 aa, Homo Sapiens
TMVSLPLRS

SEQ ID NO: 1089281 - protein, 9 aa, Homo Sapiens
TKEVAILNT

SEQ ID NO: 1089282 - protein, 9 aa, Homo Sapiens
FQRCSCFLS

SEQ ID NO: 1089283 - protein, 9 aa, Homo Sapiens
QNGRVAHHG

SEQ ID NO: 1089284 - protein, 9 aa, Homo Sapiens
AVLMTNSNV

SEQ ID NO: 1089285 - protein, 9 aa, Homo Sapiens
HNVAYPGIS

SEQ ID NO: 1089286 - protein, 9 aa, Homo Sapiens
KEFPSCAIE

SEQ ID NO: 1089287 - protein, 9 aa, Homo Sapiens
RQNGPRGLY

SEQ ID NO: 1089288 - protein, 9 aa, Homo Sapiens
PTTTTPEKE

SEQ ID NO: 1089289 - protein, 9 aa, Homo Sapiens
LGQKFGSHP

SEQ ID NO: 1089290 - protein, 9 aa, Homo Sapiens
LKGKNISTV

SEQ ID NO: 1089291 - protein, 9 aa, Homo Sapiens
GDSGYKTET

SEQ ID NO: 1089292 - protein, 9 aa, Homo Sapiens
ILALIFLPR

SEQ ID NO: 1089293 - protein, 9 aa, Homo Sapiens
PFPVTDTSS

SEQ ID NO: 1089294 - protein, 9 aa, Homo Sapiens
CDMVRKEYP

SEQ ID NO: 1089295 - protein, 9 aa, Homo Sapiens
DLGNRHEPR

SEQ ID NO: 1089296 - protein, 9 aa, Homo Sapiens
IFLRILDLS

SEQ ID NO: 1089297 - protein, 9 aa, Homo Sapiens
AALPKHVLI

SEQ ID NO: 1089298 - protein, 9 aa, Homo Sapiens
NLKASDTAM

SEQ ID NO: 1089299 - protein, 9 aa, Homo Sapiens
ETGIFFVTS

SEQ ID NO: 1089300 - protein, 9 aa, Homo Sapiens
GLPGDPIAL

SEQ ID NO: 1089301 - protein, 9 aa, Homo Sapiens
CVHDMDSVS

SEQ ID NO: 1089302 - protein, 9 aa, Homo Sapiens
TSRERSFQA

SEQ ID NO: 1089303 - protein, 9 aa, Homo Sapiens
LSLISNLPN

SEQ ID NO: 1089304 - protein, 9 aa, Homo Sapiens
WILFLPMEG

SEQ ID NO: 1089305 - protein, 9 aa, Homo Sapiens
MSVKPVSSE

SEQ ID NO: 1089306 - protein, 9 aa, Homo Sapiens
LRLVGFEVG

SEQ ID NO: 1089307 - protein, 9 aa, Homo Sapiens
NKDETSADL

SEQ ID NO: 1089308 - protein, 9 aa, Homo Sapiens
RHMRSHIGY

SEQ ID NO: 1089309 - protein, 9 aa, Homo Sapiens
FTTPERQTL

SEQ ID NO: 1089310 - protein, 9 aa, Homo Sapiens
APGREPGGA

SEQ ID NO: 1089311 - protein, 9 aa, Homo Sapiens
QLCYSVPEE

SEQ ID NO: 1089312 - protein, 9 aa, Homo Sapiens
ESQRKGSIS

SEQ ID NO: 1089313 - protein, 9 aa, Homo Sapiens
KDKNRGPTL

SEQ ID NO: 1089314 - protein, 9 aa, Homo Sapiens
ELESMEFSA

SEQ ID NO: 1089315 - protein, 9 aa, Homo Sapiens
CTSHITVVI

SEQ ID NO: 1089316 - protein, 9 aa, Homo Sapiens
GYQLLRCRD

SEQ ID NO: 1089317 - protein, 9 aa, Homo Sapiens
NRGDNLLPI

SEQ ID NO: 1089318 - protein, 9 aa, Homo Sapiens
NKERNEETC

SEQ ID NO: 1089319 - protein, 9 aa, Homo Sapiens
VAEKTKKQA

SEQ ID NO: 1089320 - protein, 9 aa, Homo Sapiens
WASKDTSKL

SEQ ID NO: 1089321 - protein, 9 aa, Homo Sapiens
LPLNQTFFQ

SEQ ID NO: 1089322 - protein, 9 aa, Homo Sapiens
QRAEAKRVL

SEQ ID NO: 1089323 - protein, 9 aa, Homo Sapiens
PPLASCSLA

SEQ ID NO: 1089324 - protein, 9 aa, Homo Sapiens
SRDLAMCVT

SEQ ID NO: 1089325 - protein, 9 aa, Homo Sapiens
SCQSSPMAR

SEQ ID NO: 1089326 - protein, 9 aa, Homo Sapiens
SKCNKLKSQ

SEQ ID NO: 1089327 - protein, 9 aa, Homo Sapiens
YKMPIKKKE

SEQ ID NO: 1089328 - protein, 9 aa, Homo Sapiens
SQNRLAEIP

SEQ ID NO: 1089329 - protein, 9 aa, Homo Sapiens
CVTFWRSSL

SEQ ID NO: 1089330 - protein, 9 aa, Homo Sapiens
SGLTPKDGA

SEQ ID NO: 1089331 - protein, 9 aa, Homo Sapiens
ETKWSFFQE

SEQ ID NO: 1089332 - protein, 9 aa, Homo Sapiens
FSGLTPKDG

SEQ ID NO: 1089333 - protein, 9 aa, Homo Sapiens
CDTQNKDRS

SEQ ID NO: 1089334 - protein, 9 aa, Homo Sapiens
YVMRTLASE

SEQ ID NO: 1089335 - protein, 9 aa, Homo Sapiens
MEEARLVLT

SEQ ID NO: 1089336 - protein, 9 aa, Homo Sapiens
VQPTFRVLV

SEQ ID NO: 1089337 - protein, 9 aa, Homo Sapiens
QHESGSEKS

SEQ ID NO: 1089338 - protein, 9 aa, Homo Sapiens
ARLVLTVKE

SEQ ID NO: 1089339 - protein, 9 aa, Homo Sapiens
KISPVVMAQ

SEQ ID NO: 1089340 - protein, 9 aa, Homo Sapiens
ADGELESME

SEQ ID NO: 1089341 - protein, 9 aa, Homo Sapiens
NKLEWEDDT

SEQ ID NO: 1089342 - protein, 9 aa, Homo Sapiens
YILCWTSPQ

SEQ ID NO: 1089343 - protein, 9 aa, Homo Sapiens
TQTLESNSS

SEQ ID NO: 1089344 - protein, 9 aa, Homo Sapiens
QKFGSHPGS

SEQ ID NO: 1089345 - protein, 9 aa, Homo Sapiens
ILVVMSKLS

SEQ ID NO: 1089346 - protein, 9 aa, Homo Sapiens
REEKLRKKE

SEQ ID NO: 1089347 - protein, 9 aa, Homo Sapiens
EEKPHWTSE

SEQ ID NO: 1089348 - protein, 9 aa, Homo Sapiens
DEFVSRLST

SEQ ID NO: 1089349 - protein, 9 aa, Homo Sapiens
VACCSLERC

SEQ ID NO: 1089350 - protein, 9 aa, Homo Sapiens
EEEVSNSKL

SEQ ID NO: 1089351 - protein, 9 aa, Homo Sapiens
EEEKWSPEL

SEQ ID NO: 1089352 - protein, 9 aa, Homo Sapiens
QLQSTRGNL

SEQ ID NO: 1089353 - protein, 9 aa, Homo Sapiens
WIFSNLRCG

SEQ ID NO: 1089354 - protein, 9 aa, Homo Sapiens
GAASKSFSL

SEQ ID NO: 1089355 - protein, 9 aa, Homo Sapiens
WEVGVHEIR

SEQ ID NO: 1089356 - protein, 9 aa, Homo Sapiens
QEELLANTE

SEQ ID NO: 1089357 - protein, 9 aa, Homo Sapiens
HSRSFMASI

SEQ ID NO: 1089358 - protein, 9 aa, Homo Sapiens
AVCALENSR

SEQ ID NO: 1089359 - protein, 9 aa, Homo Sapiens
CISYIIVVV

SEQ ID NO: 1089360 - protein, 9 aa, Homo Sapiens
TTENMDKDE

SEQ ID NO: 1089361 - protein, 9 aa, Homo Sapiens
HRLNRAEVP

SEQ ID NO: 1089362 - protein, 9 aa, Homo Sapiens
AETVAAWLT

SEQ ID NO: 1089363 - protein, 9 aa, Homo Sapiens
EISLRLRLS

SEQ ID NO: 1089364 - protein, 9 aa, Homo Sapiens
LFPFWRQIR

SEQ ID NO: 1089365 - protein, 9 aa, Homo Sapiens
AAQEKKKLK

SEQ ID NO: 1089366 - protein, 9 aa, Homo Sapiens
PLNQTFFQV

SEQ ID NO: 1089367 - protein, 9 aa, Homo Sapiens
QFYHQRTLA

SEQ ID NO: 1089368 - protein, 9 aa, Homo Sapiens
YFFLRNFFF

SEQ ID NO: 1089369 - protein, 9 aa, Homo Sapiens
RAWASKDTS

SEQ ID NO: 1089370 - protein, 9 aa, Homo Sapiens
LPGVMMSHS

SEQ ID NO: 1089371 - protein, 9 aa, Homo Sapiens
DRATSLRDE

SEQ ID NO: 1089372 - protein, 9 aa, Homo Sapiens
FRHIPPYPQ

SEQ ID NO: 1089373 - protein, 9 aa, Homo Sapiens
KLEAIVAPK

SEQ ID NO: 1089374 - protein, 9 aa, Homo Sapiens
SPRGCRLPF

SEQ ID NO: 1089375 - protein, 9 aa, Homo Sapiens
EFSARYNFT

SEQ ID NO: 1089376 - protein, 9 aa, Homo Sapiens
RDVFIQQGY

SEQ ID NO: 1089377 - protein, 9 aa, Homo Sapiens
DPAVQPTFR

SEQ ID NO: 1089378 - protein, 9 aa, Homo Sapiens
ILEQKRQNL

SEQ ID NO: 1089379 - protein, 9 aa, Homo Sapiens
LPLLRPLSS

SEQ ID NO: 1089380 - protein, 9 aa, Homo Sapiens
GSSLGSSME

SEQ ID NO: 1089381 - protein, 9 aa, Homo Sapiens
GDEEEEEDW

SEQ ID NO: 1089382 - protein, 9 aa, Homo Sapiens
FPLAERANK

SEQ ID NO: 1089383 - protein, 9 aa, Homo Sapiens
LHDPHYFEE

SEQ ID NO: 1089384 - protein, 9 aa, Homo Sapiens
TSFQQHVRI

SEQ ID NO: 1089385 - protein, 9 aa, Homo Sapiens
KTLAKKSRG

SEQ ID NO: 1089386 - protein, 9 aa, Homo Sapiens
QRKGSISED

SEQ ID NO: 1089387 - protein, 9 aa, Homo Sapiens
GAVASCQSS

SEQ ID NO: 1089388 - protein, 9 aa, Homo Sapiens
HFPAAIDFF

SEQ ID NO: 1089389 - protein, 9 aa, Homo Sapiens
KEIFNMYYF

SEQ ID NO: 1089390 - protein, 9 aa, Homo Sapiens
GQRGYPENP

SEQ ID NO: 1089391 - protein, 9 aa, Homo Sapiens
VSQGAYYIP

SEQ ID NO: 1089392 - protein, 9 aa, Homo Sapiens
GKTLAKKSR

SEQ ID NO: 1089393 - protein, 9 aa, Homo Sapiens
LSSSLETFF

SEQ ID NO: 1089394 - protein, 9 aa, Homo Sapiens
KFSNLIQNS

SEQ ID NO: 1089395 - protein, 9 aa, Homo Sapiens
RLHLPGVMM

SEQ ID NO: 1089396 - protein, 9 aa, Homo Sapiens
ETVAAWLTG

SEQ ID NO: 1089397 - protein, 9 aa, Homo Sapiens
QWSNLKASD

SEQ ID NO: 1089398 - protein, 9 aa, Homo Sapiens
DLDLEPFSL

SEQ ID NO: 1089399 - protein, 9 aa, Homo Sapiens
EVHIVKDKN

SEQ ID NO: 1089400 - protein, 9 aa, Homo Sapiens
YMVQLLQDL

SEQ ID NO: 1089401 - protein, 9 aa, Homo Sapiens
ELQTSFPVE

SEQ ID NO: 1089402 - protein, 9 aa, Homo Sapiens
IEGQRCNVL

SEQ ID NO: 1089403 - protein, 9 aa, Homo Sapiens
ASKAHPVAV

SEQ ID NO: 1089404 - protein, 9 aa, Homo Sapiens
AREVKREVL

SEQ ID NO: 1089405 - protein, 9 aa, Homo Sapiens
CIKEVLCDY

SEQ ID NO: 1089406 - protein, 9 aa, Homo Sapiens
QLITELGFW

SEQ ID NO: 1089407 - protein, 9 aa, Homo Sapiens
VTAQVRPRC

SEQ ID NO: 1089408 - protein, 9 aa, Homo Sapiens
PGDSGYKTE

SEQ ID NO: 1089409 - protein, 9 aa, Homo Sapiens
VLWDINKER

SEQ ID NO: 1089410 - protein, 9 aa, Homo Sapiens
EGGDSGVYQ

SEQ ID NO: 1089411 - protein, 9 aa, Homo Sapiens
LVLSISEIQ

SEQ ID NO: 1089412 - protein, 9 aa, Homo Sapiens
KISVRTMPT

SEQ ID NO: 1089413 - protein, 9 aa, Homo Sapiens
STQNGSHRL

SEQ ID NO: 1089414 - protein, 9 aa, Homo Sapiens
TDQENERKQ

SEQ ID NO: 1089415 - protein, 9 aa, Homo Sapiens
VKTQHHSYP

SEQ ID NO: 1089416 - protein, 9 aa, Homo Sapiens
LGQRGYPEN

SEQ ID NO: 1089417 - protein, 9 aa, Homo Sapiens
LDLTFTVNK

SEQ ID NO: 1089418 - protein, 9 aa, Homo Sapiens
ENKDVSMEF

SEQ ID NO: 1089419 - protein, 9 aa, Homo Sapiens
IFCLRPRVL

SEQ ID NO: 1089420 - protein, 9 aa, Homo Sapiens
QTVVLQVQP

SEQ ID NO: 1089421 - protein, 9 aa, Homo Sapiens
PNCAGIKGV

SEQ ID NO: 1089422 - protein, 9 aa, Homo Sapiens
PEGLRLVGF

SEQ ID NO: 1089423 - protein, 9 aa, Homo Sapiens
LPSSSHAAS

SEQ ID NO: 1089424 - protein, 9 aa, Homo Sapiens
GMRLDVLYL

SEQ ID NO: 1089425 - protein, 9 aa, Homo Sapiens
LSATIDFIV

SEQ ID NO: 1089426 - protein, 9 aa, Homo Sapiens
ARPFDSFFL

SEQ ID NO: 1089427 - protein, 9 aa, Homo Sapiens
GPPKVPFCS

SEQ ID NO: 1089428 - protein, 9 aa, Homo Sapiens
TRQNGPRGL

SEQ ID NO: 1089429 - protein, 9 aa, Homo Sapiens
AFKIVSQKP

SEQ ID NO: 1089430 - protein, 9 aa, Homo Sapiens
FQGDQICLR

SEQ ID NO: 1089431 - protein, 9 aa, Homo Sapiens
PGFSGLHGL

SEQ ID NO: 1089432 - protein, 9 aa, Homo Sapiens
HLNVTAKAF

SEQ ID NO: 1089433 - protein, 9 aa, Homo Sapiens
TPSRTVFFE

SEQ ID NO: 1089434 - protein, 9 aa, Homo Sapiens
LVISGYGLG

SEQ ID NO: 1089435 - protein, 9 aa, Homo Sapiens
AASKSFSLL

SEQ ID NO: 1089436 - protein, 9 aa, Homo Sapiens
TAFLPPVSM

SEQ ID NO: 1089437 - protein, 9 aa, Homo Sapiens
PGNEVPVEE

SEQ ID NO: 1089438 - protein, 9 aa, Homo Sapiens
DFESSSDSE

SEQ ID NO: 1089439 - protein, 9 aa, Homo Sapiens
TYRLAWGRS

SEQ ID NO: 1089440 - protein, 9 aa, Homo Sapiens
MNGVLWAHD

SEQ ID NO: 1089441 - protein, 9 aa, Homo Sapiens
VAQMTKDAV

SEQ ID NO: 1089442 - protein, 9 aa, Homo Sapiens
LDLKISSKI

SEQ ID NO: 1089443 - protein, 9 aa, Homo Sapiens
ESMEFSARY

SEQ ID NO: 1089444 - protein, 9 aa, Homo Sapiens
VPGYQLLRC

SEQ ID NO: 1089445 - protein, 9 aa, Homo Sapiens
GPHYILCWT

SEQ ID NO: 1089446 - protein, 9 aa, Homo Sapiens
ITPAVYKEC

SEQ ID NO: 1089447 - protein, 9 aa, Homo Sapiens
LSPETYEGN

SEQ ID NO: 1089448 - protein, 9 aa, Homo Sapiens
TKALLLGFM

SEQ ID NO: 1089449 - protein, 9 aa, Homo Sapiens
GAVVPTHRF

SEQ ID NO: 1089450 - protein, 9 aa, Homo Sapiens
QRGYPENPG

SEQ ID NO: 1089451 - protein, 9 aa, Homo Sapiens
MEAEAAAAA

SEQ ID NO: 1089452 - protein, 9 aa, Homo Sapiens
GTCKEIFNM

SEQ ID NO: 1089453 - protein, 9 aa, Homo Sapiens
ATTYRLAWG

SEQ ID NO: 1089454 - protein, 9 aa, Homo Sapiens
LQYLCVQSS

SEQ ID NO: 1089455 - protein, 9 aa, Homo Sapiens
SPPPKFPAE

SEQ ID NO: 1089456 - protein, 9 aa, Homo Sapiens
RLMPWVLDC

SEQ ID NO: 1089457 - protein, 9 aa, Homo Sapiens
TTPEKEERP

SEQ ID NO: 1089458 - protein, 9 aa, Homo Sapiens
VLRKDLDNA

SEQ ID NO: 1089459 - protein, 9 aa, Homo Sapiens
AASTSFLGC

SEQ ID NO: 1089460 - protein, 9 aa, Homo Sapiens
PVFPQTLAA

SEQ ID NO: 1089461 - protein, 9 aa, Homo Sapiens
QEAWSTHNT

SEQ ID NO: 1089462 - protein, 9 aa, Homo Sapiens
LLQDLDYLH

SEQ ID NO: 1089463 - protein, 9 aa, Homo Sapiens
PRGIQEVTV

SEQ ID NO: 1089464 - protein, 9 aa, Homo Sapiens
QFQLQSTRG

SEQ ID NO: 1089465 - protein, 9 aa, Homo Sapiens
LHWYTGKGM

SEQ ID NO: 1089466 - protein, 9 aa, Homo Sapiens
FYMELPGSG

SEQ ID NO: 1089467 - protein, 9 aa, Homo Sapiens
DDLDNVEDI

SEQ ID NO: 1089468 - protein, 9 aa, Homo Sapiens
ETDQENERK

SEQ ID NO: 1089469 - protein, 9 aa, Homo Sapiens
TKKQASHLG

SEQ ID NO: 1089470 - protein, 9 aa, Homo Sapiens
EFFRHIPPY

SEQ ID NO: 1089471 - protein, 9 aa, Homo Sapiens
DGELESMEF

SEQ ID NO: 1089472 - protein, 9 aa, Homo Sapiens
WLTMLPEED

SEQ ID NO: 1089473 - protein, 9 aa, Homo Sapiens
RHRPKRLFF

SEQ ID NO: 1089474 - protein, 9 aa, Homo Sapiens
VQGPDLNSK

SEQ ID NO: 1089475 - protein, 9 aa, Homo Sapiens
ICSQGGKET

SEQ ID NO: 1089476 - protein, 9 aa, Homo Sapiens
AIDFFQDAV

SEQ ID NO: 1089477 - protein, 9 aa, Homo Sapiens
AIVAPKDVG

SEQ ID NO: 1089478 - protein, 9 aa, Homo Sapiens
YSSQLDGEA

SEQ ID NO: 1089479 - protein, 9 aa, Homo Sapiens
QAALPKHVL

SEQ ID NO: 1089480 - protein, 9 aa, Homo Sapiens
ATSPRLCAK

SEQ ID NO: 1089481 - protein, 9 aa, Homo Sapiens
QLILFSRII

SEQ ID NO: 1089482 - protein, 9 aa, Homo Sapiens
MVKFGAILA

SEQ ID NO: 1089483 - protein, 9 aa, Homo Sapiens
TCVATNLAG

SEQ ID NO: 1089484 - protein, 9 aa, Homo Sapiens
KPYHCNPCG

SEQ ID NO: 1089485 - protein, 9 aa, Homo Sapiens
LQMKEEDVF

SEQ ID NO: 1089486 - protein, 9 aa, Homo Sapiens
LCDMVRKEY

SEQ ID NO: 1089487 - protein, 9 aa, Homo Sapiens
ILSKGVQPK

SEQ ID NO: 1089488 - protein, 9 aa, Homo Sapiens
LALLLLLLT

SEQ ID NO: 1089489 - protein, 9 aa, Homo Sapiens
EGKISKISF

SEQ ID NO: 1089490 - protein, 9 aa, Homo Sapiens
YIARKNHPQ

SEQ ID NO: 1089491 - protein, 9 aa, Homo Sapiens
SKDVGSSSY

SEQ ID NO: 1089492 - protein, 9 aa, Homo Sapiens
SSAIKYVGK

SEQ ID NO: 1089493 - protein, 9 aa, Homo Sapiens
IRFYMELPG

SEQ ID NO: 1089494 - protein, 9 aa, Homo Sapiens
KGPPKVPFC

SEQ ID NO: 1089495 - protein, 9 aa, Homo Sapiens
WKPEIHGNL

SEQ ID NO: 1089496 - protein, 9 aa, Homo Sapiens
EGVALTKEV

SEQ ID NO: 1089497 - protein, 9 aa, Homo Sapiens
LVDDVILTV

SEQ ID NO: 1089498 - protein, 9 aa, Homo Sapiens
SSWGRTEKR

SEQ ID NO: 1089499 - protein, 9 aa, Homo Sapiens
QEQFYHQRT

SEQ ID NO: 1089500 - protein, 9 aa, Homo Sapiens
EKSSGFGQH

SEQ ID NO: 1089501 - protein, 9 aa, Homo Sapiens
TVKGRVLFN

SEQ ID NO: 1089502 - protein, 9 aa, Homo Sapiens
MIFPQLGPV

SEQ ID NO: 1089503 - protein, 9 aa, Homo Sapiens
WEAHFFFFF

SEQ ID NO: 1089504 - protein, 9 aa, Homo Sapiens
ALTKEVAIL

SEQ ID NO: 1089505 - protein, 9 aa, Homo Sapiens
YKECQQSNE

SEQ ID NO: 1089506 - protein, 9 aa, Homo Sapiens
GGKYNLNSG

SEQ ID NO: 1089507 - protein, 9 aa, Homo Sapiens
KFLTNGSVF

SEQ ID NO: 1089508 - protein, 9 aa, Homo Sapiens
YSAVCALEN

SEQ ID NO: 1089509 - protein, 9 aa, Homo Sapiens
YKVSLNSQI

SEQ ID NO: 1089510 - protein, 9 aa, Homo Sapiens
ENIFPDYPL

SEQ ID NO: 1089511 - protein, 9 aa, Homo Sapiens
NDCQLTSWS

SEQ ID NO: 1089512 - protein, 9 aa, Homo Sapiens
FLKISRLHL

SEQ ID NO: 1089513 - protein, 9 aa, Homo Sapiens
AELVYFLLL

SEQ ID NO: 1089514 - protein, 9 aa, Homo Sapiens
SFMASIQYG

SEQ ID NO: 1089515 - protein, 9 aa, Homo Sapiens
RSFMASIQY

SEQ ID NO: 1089516 - protein, 9 aa, Homo Sapiens
AGQEKKGKA

SEQ ID NO: 1089517 - protein, 9 aa, Homo Sapiens
RKVEKVKKK

SEQ ID NO: 1089518 - protein, 9 aa, Homo Sapiens
PRLCAKFYA

SEQ ID NO: 1089519 - protein, 9 aa, Homo Sapiens
KKEGSNRQW

SEQ ID NO: 1089520 - protein, 9 aa, Homo Sapiens
QKEWALLGP

SEQ ID NO: 1089521 - protein, 9 aa, Homo Sapiens
KFEQDGISK

SEQ ID NO: 1089522 - protein, 9 aa, Homo Sapiens
SSKIDASLS

SEQ ID NO: 1089523 - protein, 9 aa, Homo Sapiens
DGKPGLPGL

SEQ ID NO: 1089524 - protein, 9 aa, Homo Sapiens
PYITPAVYK

SEQ ID NO: 1089525 - protein, 9 aa, Homo Sapiens
LCLLEDELD

SEQ ID NO: 1089526 - protein, 9 aa, Homo Sapiens
TGATTYRLA

SEQ ID NO: 1089527 - protein, 9 aa, Homo Sapiens
LPRHRPKRL

SEQ ID NO: 1089528 - protein, 9 aa, Homo Sapiens
HKVGITSPC

SEQ ID NO: 1089529 - protein, 9 aa, Homo Sapiens
RSRRREGLT

SEQ ID NO: 1089530 - protein, 9 aa, Homo Sapiens
SKQEAWSTH

SEQ ID NO: 1089531 - protein, 9 aa, Homo Sapiens
PSCPSPCGK

SEQ ID NO: 1089532 - protein, 9 aa, Homo Sapiens
YEELLDNQK

SEQ ID NO: 1089533 - protein, 9 aa, Homo Sapiens
PVVMAQITE

SEQ ID NO: 1089534 - protein, 9 aa, Homo Sapiens
LEGTKGGQD

SEQ ID NO: 1089535 - protein, 9 aa, Homo Sapiens
TCHFSILGD

SEQ ID NO: 1089536 - protein, 9 aa, Homo Sapiens
ENSRVAYAL

SEQ ID NO: 1089537 - protein, 9 aa, Homo Sapiens
AAPSAAPAL

SEQ ID NO: 1089538 - protein, 9 aa, Homo Sapiens
VLEGLHRLS

SEQ ID NO: 1089539 - protein, 9 aa, Homo Sapiens
TAGKEEYSA

SEQ ID NO: 1089540 - protein, 9 aa, Homo Sapiens
VLCLEVTLK

SEQ ID NO: 1089541 - protein, 9 aa, Homo Sapiens
IFFVTSVTR

SEQ ID NO: 1089542 - protein, 9 aa, Homo Sapiens
QTLESNSSP

SEQ ID NO: 1089543 - protein, 9 aa, Homo Sapiens
RETQTSEIE

SEQ ID NO: 1089544 - protein, 9 aa, Homo Sapiens
KIDASLSEV

SEQ ID NO: 1089545 - protein, 9 aa, Homo Sapiens
EPSAAESQR

SEQ ID NO: 1089546 - protein, 9 aa, Homo Sapiens
NSGLLSVIT

SEQ ID NO: 1089547 - protein, 9 aa, Homo Sapiens
EREKQFQLQ

SEQ ID NO: 1089548 - protein, 9 aa, Homo Sapiens
GLDLCLLED

SEQ ID NO: 1089549 - protein, 9 aa, Homo Sapiens
SGCDNAIPL

SEQ ID NO: 1089550 - protein, 9 aa, Homo Sapiens
EEEPLNPDY

SEQ ID NO: 1089551 - protein, 9 aa, Homo Sapiens
ALGLDLCLL

SEQ ID NO: 1089552 - protein, 9 aa, Homo Sapiens
YWHALDSGN

SEQ ID NO: 1089553 - protein, 9 aa, Homo Sapiens
RGNPALLDP

SEQ ID NO: 1089554 - protein, 9 aa, Homo Sapiens
QICLRLHRG

SEQ ID NO: 1089555 - protein, 9 aa, Homo Sapiens
HLPGVMMSH

SEQ ID NO: 1089556 - protein, 9 aa, Homo Sapiens
VETVISYRC

SEQ ID NO: 1089557 - protein, 9 aa, Homo Sapiens
IIQISSGKE

SEQ ID NO: 1089558 - protein, 9 aa, Homo Sapiens
CLALLLEPW

SEQ ID NO: 1089559 - protein, 9 aa, Homo Sapiens
SHITVVILH

SEQ ID NO: 1089560 - protein, 9 aa, Homo Sapiens
QLPNTLPVS

SEQ ID NO: 1089561 - protein, 9 aa, Homo Sapiens
PASGCDNAI

SEQ ID NO: 1089562 - protein, 9 aa, Homo Sapiens
GILCYPASK

SEQ ID NO: 1089563 - protein, 9 aa, Homo Sapiens
ILLSPETYE

SEQ ID NO: 1089564 - protein, 9 aa, Homo Sapiens
QAGEKPLGV

SEQ ID NO: 1089565 - protein, 9 aa, Homo Sapiens
SLSSAIKYV

SEQ ID NO: 1089566 - protein, 9 aa, Homo Sapiens
SFTEISTDF

SEQ ID NO: 1089567 - protein, 9 aa, Homo Sapiens
CWTSPQVIK

SEQ ID NO: 1089568 - protein, 9 aa, Homo Sapiens
VQSSAGLNG

SEQ ID NO: 1089569 - protein, 9 aa, Homo Sapiens
IPSQISYPV

SEQ ID NO: 1089570 - protein, 9 aa, Homo Sapiens
NSSPELGDI

SEQ ID NO: 1089571 - protein, 9 aa, Homo Sapiens
EQRSYREEK

SEQ ID NO: 1089572 - protein, 9 aa, Homo Sapiens
EMEAEAAAA

SEQ ID NO: 1089573 - protein, 9 aa, Homo Sapiens
MPVFLEGTK

SEQ ID NO: 1089574 - protein, 9 aa, Homo Sapiens
TSENSHEGK

SEQ ID NO: 1089575 - protein, 9 aa, Homo Sapiens
HHHHHHLHH

SEQ ID NO: 1089576 - protein, 9 aa, Homo Sapiens
LVPMPLLVL

SEQ ID NO: 1089577 - protein, 9 aa, Homo Sapiens
LQTYLSQLF

SEQ ID NO: 1089578 - protein, 9 aa, Homo Sapiens
SVLDCNYYY

SEQ ID NO: 1089579 - protein, 9 aa, Homo Sapiens
YSPTSQGPA

SEQ ID NO: 1089580 - protein, 9 aa, Homo Sapiens
SVKTSTTDV

SEQ ID NO: 1089581 - protein, 9 aa, Homo Sapiens
LLGVNIQIV

SEQ ID NO: 1089582 - protein, 9 aa, Homo Sapiens
VPSAENVYD

SEQ ID NO: 1089583 - protein, 9 aa, Homo Sapiens
EIFNMYYFE

SEQ ID NO: 1089584 - protein, 9 aa, Homo Sapiens
REVLECSLK

SEQ ID NO: 1089585 - protein, 9 aa, Homo Sapiens
ALIFLPRTR

SEQ ID NO: 1089586 - protein, 9 aa, Homo Sapiens
LQRGFFNLN

SEQ ID NO: 1089587 - protein, 9 aa, Homo Sapiens
SGSHQSSGP

SEQ ID NO: 1089588 - protein, 9 aa, Homo Sapiens
GQAATLALR

SEQ ID NO: 1089589 - protein, 9 aa, Homo Sapiens
VLFTLLHVF

SEQ ID NO: 1089590 - protein, 9 aa, Homo Sapiens
QTKSGELSR

SEQ ID NO: 1089591 - protein, 9 aa, Homo Sapiens
ESNSSPELG

SEQ ID NO: 1089592 - protein, 9 aa, Homo Sapiens
DSKRFQISW

SEQ ID NO: 1089593 - protein, 9 aa, Homo Sapiens
TSVLALYRS

SEQ ID NO: 1089594 - protein, 9 aa, Homo Sapiens
YPASKAHPV

SEQ ID NO: 1089595 - protein, 9 aa, Homo Sapiens
LKISRLHLP

SEQ ID NO: 1089596 - protein, 9 aa, Homo Sapiens
HPWWEAHFF

SEQ ID NO: 1089597 - protein, 9 aa, Homo Sapiens
QLLQDLDYL

SEQ ID NO: 1089598 - protein, 9 aa, Homo Sapiens
PVAQMTKDA

SEQ ID NO: 1089599 - protein, 9 aa, Homo Sapiens
NLRNKDVKG

SEQ ID NO: 1089600 - protein, 9 aa, Homo Sapiens
LLAFQAVDK

SEQ ID NO: 1089601 - protein, 9 aa, Homo Sapiens
HFNLVLETY

SEQ ID NO: 1089602 - protein, 9 aa, Homo Sapiens
RYLHQGKDN

SEQ ID NO: 1089603 - protein, 9 aa, Homo Sapiens
KQKEIDSEN

SEQ ID NO: 1089604 - protein, 9 aa, Homo Sapiens
IRAPPDWVK

SEQ ID NO: 1089605 - protein, 9 aa, Homo Sapiens
SEADFADDK

SEQ ID NO: 1089606 - protein, 9 aa, Homo Sapiens
CPKRPDTLW

SEQ ID NO: 1089607 - protein, 9 aa, Homo Sapiens
VTSSIAGVS

SEQ ID NO: 1089608 - protein, 9 aa, Homo Sapiens
LRDEDDTKA

SEQ ID NO: 1089609 - protein, 9 aa, Homo Sapiens
KALLLGFMS

SEQ ID NO: 1089610 - protein, 9 aa, Homo Sapiens
TMLPEEDPT

SEQ ID NO: 1089611 - protein, 9 aa, Homo Sapiens
NGMRLDVLY

SEQ ID NO: 1089612 - protein, 9 aa, Homo Sapiens
DILSKGVQP

SEQ ID NO: 1089613 - protein, 9 aa, Homo Sapiens
IVGDIESMP

SEQ ID NO: 1089614 - protein, 9 aa, Homo Sapiens
IFKITTQFG

SEQ ID NO: 1089615 - protein, 9 aa, Homo Sapiens
PKPGDSGYK

SEQ ID NO: 1089616 - protein, 9 aa, Homo Sapiens
EVRNEYGLR

SEQ ID NO: 1089617 - protein, 9 aa, Homo Sapiens
SFQQHVRIH

SEQ ID NO: 1089618 - protein, 9 aa, Homo Sapiens
QDLDYLHGH

SEQ ID NO: 1089619 - protein, 9 aa, Homo Sapiens
ILKWAANSF

SEQ ID NO: 1089620 - protein, 9 aa, Homo Sapiens
EHNITVLVF

SEQ ID NO: 1089621 - protein, 9 aa, Homo Sapiens
HAYLGKMWI

SEQ ID NO: 1089622 - protein, 9 aa, Homo Sapiens
TPAGYLELT

SEQ ID NO: 1089623 - protein, 9 aa, Homo Sapiens
RGDNLLPIL

SEQ ID NO: 1089624 - protein, 9 aa, Homo Sapiens
SNLIQNSGL

SEQ ID NO: 1089625 - protein, 9 aa, Homo Sapiens
FFIQFYNNA

SEQ ID NO: 1089626 - protein, 9 aa, Homo Sapiens
LPLRSGSHC

SEQ ID NO: 1089627 - protein, 9 aa, Homo Sapiens
AAIGFDRYV

SEQ ID NO: 1089628 - protein, 9 aa, Homo Sapiens
KIVQTDKIT

SEQ ID NO: 1089629 - protein, 9 aa, Homo Sapiens
EYGSSLKAY

SEQ ID NO: 1089630 - protein, 9 aa, Homo Sapiens
RKNHPQFLA

SEQ ID NO: 1089631 - protein, 9 aa, Homo Sapiens
DWSREERLP

SEQ ID NO: 1089632 - protein, 9 aa, Homo Sapiens
AFQAVDKCQ

SEQ ID NO: 1089633 - protein, 9 aa, Homo Sapiens
GNPALLDPG

SEQ ID NO: 1089634 - protein, 9 aa, Homo Sapiens
GSSLKAYTP

SEQ ID NO: 1089635 - protein, 9 aa, Homo Sapiens
PAPEEESKQ

SEQ ID NO: 1089636 - protein, 9 aa, Homo Sapiens
DLDALKHMF

SEQ ID NO: 1089637 - protein, 9 aa, Homo Sapiens
KSKISVRTM

SEQ ID NO: 1089638 - protein, 9 aa, Homo Sapiens
QMTKDAVDA

SEQ ID NO: 1089639 - protein, 9 aa, Homo Sapiens
GSNRQWNYA

SEQ ID NO: 1089640 - protein, 9 aa, Homo Sapiens
AVASCQSSP

SEQ ID NO: 1089641 - protein, 9 aa, Homo Sapiens
CDPWNWLDF

SEQ ID NO: 1089642 - protein, 9 aa, Homo Sapiens
WYTGKGMDE

SEQ ID NO: 1089643 - protein, 9 aa, Homo Sapiens
EFISLPRLL

SEQ ID NO: 1089644 - protein, 9 aa, Homo Sapiens
EWQMLHSEE

SEQ ID NO: 1089645 - protein, 9 aa, Homo Sapiens
ISTQNGSHR

SEQ ID NO: 1089646 - protein, 9 aa, Homo Sapiens
NALTVTAQV

SEQ ID NO: 1089647 - protein, 9 aa, Homo Sapiens
FSALGLDLC

SEQ ID NO: 1089648 - protein, 9 aa, Homo Sapiens
FFFLEVSFT

SEQ ID NO: 1089649 - protein, 9 aa, Homo Sapiens
NQRTLDLNS

SEQ ID NO: 1089650 - protein, 9 aa, Homo Sapiens
SPCFNLFAL

SEQ ID NO: 1089651 - protein, 9 aa, Homo Sapiens
AATLALRDF

SEQ ID NO: 1089652 - protein, 9 aa, Homo Sapiens
MGHWLPKPN

SEQ ID NO: 1089653 - protein, 9 aa, Homo Sapiens
GEKEKLLAE

SEQ ID NO: 1089654 - protein, 9 aa, Homo Sapiens
HSASQDSQD

SEQ ID NO: 1089655 - protein, 9 aa, Homo Sapiens
FHLLWRQAV

SEQ ID NO: 1089656 - protein, 9 aa, Homo Sapiens
PGYKESTNA

SEQ ID NO: 1089657 - protein, 9 aa, Homo Sapiens
LPRNSGAGS

SEQ ID NO: 1089658 - protein, 9 aa, Homo Sapiens
YTVTRPEQL

SEQ ID NO: 1089659 - protein, 9 aa, Homo Sapiens
LRDPQSLPA

SEQ ID NO: 1089660 - protein, 9 aa, Homo Sapiens
AWTADIFHL

SEQ ID NO: 1089661 - protein, 9 aa, Homo Sapiens
GGNQIGHFT

SEQ ID NO: 1089662 - protein, 9 aa, Homo Sapiens
TSRLGALKM

SEQ ID NO: 1089663 - protein, 9 aa, Homo Sapiens
RHSASQDSQ

SEQ ID NO: 1089664 - protein, 9 aa, Homo Sapiens
HNSASCWGQ

SEQ ID NO: 1089665 - protein, 9 aa, Homo Sapiens
ASVANVACG

SEQ ID NO: 1089666 - protein, 9 aa, Homo Sapiens
WWVAVYTLC

SEQ ID NO: 1089667 - protein, 9 aa, Homo Sapiens
DHEFVQFHP

SEQ ID NO: 1089668 - protein, 9 aa, Homo Sapiens
AMMGMMDEE

SEQ ID NO: 1089669 - protein, 9 aa, Homo Sapiens
PLEGHDSTR

SEQ ID NO: 1089670 - protein, 9 aa, Homo Sapiens
PQTREFIQE

SEQ ID NO: 1089671 - protein, 9 aa, Homo Sapiens
PPPLPPSPP

SEQ ID NO: 1089672 - protein, 9 aa, Homo Sapiens
GSSTPVFFM

SEQ ID NO: 1089673 - protein, 9 aa, Homo Sapiens
ASCWGQGGK

SEQ ID NO: 1089674 - protein, 9 aa, Homo Sapiens
TAQYLLSFE

SEQ ID NO: 1089675 - protein, 9 aa, Homo Sapiens
GTRSATSNS

SEQ ID NO: 1089676 - protein, 9 aa, Homo Sapiens
EFIQESDPM

SEQ ID NO: 1089677 - protein, 9 aa, Homo Sapiens
ADLEPAFCL

SEQ ID NO: 1089678 - protein, 9 aa, Homo Sapiens
ENPLSRTHS

SEQ ID NO: 1089679 - protein, 9 aa, Homo Sapiens
WGSSDGGVL

SEQ ID NO: 1089680 - protein, 9 aa, Homo Sapiens
RMLLMLRKM

SEQ ID NO: 1089681 - protein, 9 aa, Homo Sapiens
LHTKDRKHG

SEQ ID NO: 1089682 - protein, 9 aa, Homo Sapiens
FELTTPQTR

SEQ ID NO: 1089683 - protein, 9 aa, Homo Sapiens
GSLQTSSSG

SEQ ID NO: 1089684 - protein, 9 aa, Homo Sapiens
AVLWLLRDP

SEQ ID NO: 1089685 - protein, 9 aa, Homo Sapiens
LYILRMSFV

SEQ ID NO: 1089686 - protein, 9 aa, Homo Sapiens
MPGMNSIHK

SEQ ID NO: 1089687 - protein, 9 aa, Homo Sapiens
VNMWDPLNR

SEQ ID NO: 1089688 - protein, 9 aa, Homo Sapiens
PSQKRYVGY

SEQ ID NO: 1089689 - protein, 9 aa, Homo Sapiens
GRGGMSGGH

SEQ ID NO: 1089690 - protein, 9 aa, Homo Sapiens
ILRMSKVPT

SEQ ID NO: 1089691 - protein, 9 aa, Homo Sapiens
AQPTVSTGG

SEQ ID NO: 1089692 - protein, 9 aa, Homo Sapiens
RKDLRPGYK

SEQ ID NO: 1089693 - protein, 9 aa, Homo Sapiens
SQDSQDTIR

SEQ ID NO: 1089694 - protein, 9 aa, Homo Sapiens
DTMCRYQVY

SEQ ID NO: 1089695 - protein, 9 aa, Homo Sapiens
LELVFALRA

SEQ ID NO: 1089696 - protein, 9 aa, Homo Sapiens
GAEAGARAE

SEQ ID NO: 1089697 - protein, 9 aa, Homo Sapiens
PVNSEEMVL

SEQ ID NO: 1089698 - protein, 9 aa, Homo Sapiens
VPASAPHPC

SEQ ID NO: 1089699 - protein, 9 aa, Homo Sapiens
LDKLLWHDN

SEQ ID NO: 1089700 - protein, 9 aa, Homo Sapiens
ILSVAAEDQ

SEQ ID NO: 1089701 - protein, 9 aa, Homo Sapiens
SAVNVENPL

SEQ ID NO: 1089702 - protein, 9 aa, Homo Sapiens
QYLLSFELL

SEQ ID NO: 1089703 - protein, 9 aa, Homo Sapiens
DIFHLLWRQ

SEQ ID NO: 1089704 - protein, 9 aa, Homo Sapiens
AQKFELTTP

SEQ ID NO: 1089705 - protein, 9 aa, Homo Sapiens
PQEAEEFCH

SEQ ID NO: 1089706 - protein, 9 aa, Homo Sapiens
GSSDGGVLV

SEQ ID NO: 1089707 - protein, 9 aa, Homo Sapiens
SRSRLWNAQ

SEQ ID NO: 1089708 - protein, 9 aa, Homo Sapiens
SCLNSSLKC

SEQ ID NO: 1089709 - protein, 9 aa, Homo Sapiens
TLCFVLAAL

SEQ ID NO: 1089710 - protein, 9 aa, Homo Sapiens
ARATRPLPL

SEQ ID NO: 1089711 - protein, 9 aa, Homo Sapiens
SLIGGNQIG

SEQ ID NO: 1089712 - protein, 9 aa, Homo Sapiens
IGHFTIHPK

SEQ ID NO: 1089713 - protein, 9 aa, Homo Sapiens
RILDWCSTI

SEQ ID NO: 1089714 - protein, 9 aa, Homo Sapiens
VGACGVGKS

SEQ ID NO: 1089715 - protein, 9 aa, Homo Sapiens
AKLLLPVAG

SEQ ID NO: 1089716 - protein, 9 aa, Homo Sapiens
HSMKVEVMT

SEQ ID NO: 1089717 - protein, 9 aa, Homo Sapiens
VNVENPLSR

SEQ ID NO: 1089718 - protein, 9 aa, Homo Sapiens
CWSMRMRMI

SEQ ID NO: 1089719 - protein, 9 aa, Homo Sapiens
IRIRVLQEN

SEQ ID NO: 1089720 - protein, 9 aa, Homo Sapiens
RAQILSLVA

SEQ ID NO: 1089721 - protein, 9 aa, Homo Sapiens
SEEMVLQAL

SEQ ID NO: 1089722 - protein, 9 aa, Homo Sapiens
VQVTFSPGL

SEQ ID NO: 1089723 - protein, 9 aa, Homo Sapiens
PPGRRRNPG

SEQ ID NO: 1089724 - protein, 9 aa, Homo Sapiens
PERILDWCS

SEQ ID NO: 1089725 - protein, 9 aa, Homo Sapiens
ALHTLQLLV

SEQ ID NO: 1089726 - protein, 9 aa, Homo Sapiens
SESTAFGEE

SEQ ID NO: 1089727 - protein, 9 aa, Homo Sapiens
DSAALWNEF

SEQ ID NO: 1089728 - protein, 9 aa, Homo Sapiens
RLSEKPPCS

SEQ ID NO: 1089729 - protein, 9 aa, Homo Sapiens
SCCDPQGTR

SEQ ID NO: 1089730 - protein, 9 aa, Homo Sapiens
HQQQQQEPW

SEQ ID NO: 1089731 - protein, 9 aa, Homo Sapiens
EVVRHCPHH

SEQ ID NO: 1089732 - protein, 9 aa, Homo Sapiens
LLLTVGVSA

SEQ ID NO: 1089733 - protein, 9 aa, Homo Sapiens
MNAKKAAAN

SEQ ID NO: 1089734 - protein, 9 aa, Homo Sapiens
FGIVQGSLQ

SEQ ID NO: 1089735 - protein, 9 aa, Homo Sapiens
RLGALKMHI

SEQ ID NO: 1089736 - protein, 9 aa, Homo Sapiens
SCETPKLPT

SEQ ID NO: 1089737 - protein, 9 aa, Homo Sapiens
EGFSSGIRG

SEQ ID NO: 1089738 - protein, 9 aa, Homo Sapiens
YEQVAPCAS

SEQ ID NO: 1089739 - protein, 9 aa, Homo Sapiens
LLWHDNKPH

SEQ ID NO: 1089740 - protein, 9 aa, Homo Sapiens
WNAQEKMVY

SEQ ID NO: 1089741 - protein, 9 aa, Homo Sapiens
RFTRGRNAM

SEQ ID NO: 1089742 - protein, 9 aa, Homo Sapiens
RSERPYKCS

SEQ ID NO: 1089743 - protein, 9 aa, Homo Sapiens
KAIYAEMSH

SEQ ID NO: 1089744 - protein, 9 aa, Homo Sapiens
RILARKAGV

SEQ ID NO: 1089745 - protein, 9 aa, Homo Sapiens
RAEAGAGAE

SEQ ID NO: 1089746 - protein, 9 aa, Homo Sapiens
PFSTVRLLH

SEQ ID NO: 1089747 - protein, 9 aa, Homo Sapiens
AARQITQET

SEQ ID NO: 1089748 - protein, 9 aa, Homo Sapiens
SMNPASVGG

SEQ ID NO: 1089749 - protein, 9 aa, Homo Sapiens
PGQEKHEHA

SEQ ID NO: 1089750 - protein, 9 aa, Homo Sapiens
TTHALDETD

SEQ ID NO: 1089751 - protein, 9 aa, Homo Sapiens
HMTEVVRHC

SEQ ID NO: 1089752 - protein, 9 aa, Homo Sapiens
RTFVPSSSE

SEQ ID NO: 1089753 - protein, 9 aa, Homo Sapiens
SAIQGDTEE

SEQ ID NO: 1089754 - protein, 9 aa, Homo Sapiens
RHQMTHRSE

SEQ ID NO: 1089755 - protein, 9 aa, Homo Sapiens
RYTVTRPEQ

SEQ ID NO: 1089756 - protein, 9 aa, Homo Sapiens
KEYTSRLGA

SEQ ID NO: 1089757 - protein, 9 aa, Homo Sapiens
VRMLLMLRK

SEQ ID NO: 1089758 - protein, 9 aa, Homo Sapiens
RQSFYQMRS

SEQ ID NO: 1089759 - protein, 9 aa, Homo Sapiens
LEAVPFASV

SEQ ID NO: 1089760 - protein, 9 aa, Homo Sapiens
KFELTTPQT

SEQ ID NO: 1089761 - protein, 9 aa, Homo Sapiens
LWMGEKEKL

SEQ ID NO: 1089762 - protein, 9 aa, Homo Sapiens
QFKLVYKTR

SEQ ID NO: 1089763 - protein, 9 aa, Homo Sapiens
CRECRPRGS

SEQ ID NO: 1089764 - protein, 9 aa, Homo Sapiens
STGGHTHTP

SEQ ID NO: 1089765 - protein, 9 aa, Homo Sapiens
VQSLHSNDS

SEQ ID NO: 1089766 - protein, 9 aa, Homo Sapiens
SNFGSVEMC

SEQ ID NO: 1089767 - protein, 9 aa, Homo Sapiens
LDPTASPFC

SEQ ID NO: 1089768 - protein, 9 aa, Homo Sapiens
LRSQTLSYI

SEQ ID NO: 1089769 - protein, 9 aa, Homo Sapiens
GFSFFPASA

SEQ ID NO: 1089770 - protein, 9 aa, Homo Sapiens
EFHNIFLKE

SEQ ID NO: 1089771 - protein, 9 aa, Homo Sapiens
NPKDYSWAD

SEQ ID NO: 1089772 - protein, 9 aa, Homo Sapiens
WINLGLWAA

SEQ ID NO: 1089773 - protein, 9 aa, Homo Sapiens
PGPYRRSKS

SEQ ID NO: 1089774 - protein, 9 aa, Homo Sapiens
LLRDPQSLP

SEQ ID NO: 1089775 - protein, 9 aa, Homo Sapiens
ERILDWCST

SEQ ID NO: 1089776 - protein, 9 aa, Homo Sapiens
CCDPQGTRS

SEQ ID NO: 1089777 - protein, 9 aa, Homo Sapiens
GPTSNNHAK

SEQ ID NO: 1089778 - protein, 9 aa, Homo Sapiens
IQQKVRMLL

SEQ ID NO: 1089779 - protein, 9 aa, Homo Sapiens
AAGFLLPGG

SEQ ID NO: 1089780 - protein, 9 aa, Homo Sapiens
RQITQETFD

SEQ ID NO: 1089781 - protein, 9 aa, Homo Sapiens
TVRLLHFFS

SEQ ID NO: 1089782 - protein, 9 aa, Homo Sapiens
SSPSRTILR

SEQ ID NO: 1089783 - protein, 9 aa, Homo Sapiens
LRAQILSLV

SEQ ID NO: 1089784 - protein, 9 aa, Homo Sapiens
DDEDCERRM

SEQ ID NO: 1089785 - protein, 9 aa, Homo Sapiens
LDWCSTILV

SEQ ID NO: 1089786 - protein, 9 aa, Homo Sapiens
IQESDPMSV

SEQ ID NO: 1089787 - protein, 9 aa, Homo Sapiens
LEGHDSTRD

SEQ ID NO: 1089788 - protein, 9 aa, Homo Sapiens
YQVYQGVCM

SEQ ID NO: 1089789 - protein, 9 aa, Homo Sapiens
KSPGPYRRS

SEQ ID NO: 1089790 - protein, 9 aa, Homo Sapiens
NVENPLSRT

SEQ ID NO: 1089791 - protein, 9 aa, Homo Sapiens
CYPLLLSHR

SEQ ID NO: 1089792 - protein, 9 aa, Homo Sapiens
DLLTAQYLL

SEQ ID NO: 1089793 - protein, 9 aa, Homo Sapiens
SSSPSALPC

SEQ ID NO: 1089794 - protein, 9 aa, Homo Sapiens
IPTEKRTIP

SEQ ID NO: 1089795 - protein, 9 aa, Homo Sapiens
SQLHTVNMW

SEQ ID NO: 1089796 - protein, 9 aa, Homo Sapiens
PTIPTEKRT

SEQ ID NO: 1089797 - protein, 9 aa, Homo Sapiens
DAPSLSQAE

SEQ ID NO: 1089798 - protein, 9 aa, Homo Sapiens
RSRLWNAQE

SEQ ID NO: 1089799 - protein, 9 aa, Homo Sapiens
AALDLSMNP

SEQ ID NO: 1089800 - protein, 9 aa, Homo Sapiens
EVEEGRAWI

SEQ ID NO: 1089801 - protein, 9 aa, Homo Sapiens
ATLRRLEPP

SEQ ID NO: 1089802 - protein, 9 aa, Homo Sapiens
ESTAFGEER

SEQ ID NO: 1089803 - protein, 9 aa, Homo Sapiens
LHELANLSH

SEQ ID NO: 1089804 - protein, 9 aa, Homo Sapiens
TPQMVKYIE

SEQ ID NO: 1089805 - protein, 9 aa, Homo Sapiens
MAARQITQE

SEQ ID NO: 1089806 - protein, 9 aa, Homo Sapiens
ALRVLAEVE

SEQ ID NO: 1089807 - protein, 9 aa, Homo Sapiens
SASPYAGTG

SEQ ID NO: 1089808 - protein, 9 aa, Homo Sapiens
ESDPMSVTN

SEQ ID NO: 1089809 - protein, 9 aa, Homo Sapiens
RIPRPSRSS

SEQ ID NO: 1089810 - protein, 9 aa, Homo Sapiens
AKQCNECGK

SEQ ID NO: 1089811 - protein, 9 aa, Homo Sapiens
DYSWADIRC

SEQ ID NO: 1089812 - protein, 9 aa, Homo Sapiens
FCLMDFAIE

SEQ ID NO: 1089813 - protein, 9 aa, Homo Sapiens
SIHKKNPPS

SEQ ID NO: 1089814 - protein, 9 aa, Homo Sapiens
YLCPECGKR

SEQ ID NO: 1089815 - protein, 9 aa, Homo Sapiens
RGRGHGRGW

SEQ ID NO: 1089816 - protein, 9 aa, Homo Sapiens
IPRPSRSSP

SEQ ID NO: 1089817 - protein, 9 aa, Homo Sapiens
IPLTIPEMH

SEQ ID NO: 1089818 - protein, 9 aa, Homo Sapiens
NNHAKKGHC

SEQ ID NO: 1089819 - protein, 9 aa, Homo Sapiens
HELANLSHS

SEQ ID NO: 1089820 - protein, 9 aa, Homo Sapiens
LARKAGVAP

SEQ ID NO: 1089821 - protein, 9 aa, Homo Sapiens
SARTFVPSS

SEQ ID NO: 1089822 - protein, 9 aa, Homo Sapiens
SVAAEDQVF

SEQ ID NO: 1089823 - protein, 9 aa, Homo Sapiens
SHQCHALQE

SEQ ID NO: 1089824 - protein, 9 aa, Homo Sapiens
PYAGTGFPP

SEQ ID NO: 1089825 - protein, 9 aa, Homo Sapiens
EMMSQAMMG

SEQ ID NO: 1089826 - protein, 9 aa, Homo Sapiens
WHDNKPHHY

SEQ ID NO: 1089827 - protein, 9 aa, Homo Sapiens
SRTHSSSYT

SEQ ID NO: 1089828 - protein, 9 aa, Homo Sapiens
RYKTIWINL

SEQ ID NO: 1089829 - protein, 9 aa, Homo Sapiens
GPSSSSKPK

SEQ ID NO: 1089830 - protein, 9 aa, Homo Sapiens
CQHLHTKDR

SEQ ID NO: 1089831 - protein, 9 aa, Homo Sapiens
QQKVRMLLM

SEQ ID NO: 1089832 - protein, 9 aa, Homo Sapiens
QAAAHQRYT

SEQ ID NO: 1089833 - protein, 9 aa, Homo Sapiens
DSQDTIRGH

SEQ ID NO: 1089834 - protein, 9 aa, Homo Sapiens
ERAGSKQYN

SEQ ID NO: 1089835 - protein, 9 aa, Homo Sapiens
LSHSLANIQ

SEQ ID NO: 1089836 - protein, 9 aa, Homo Sapiens
QIGHFTIHP

SEQ ID NO: 1089837 - protein, 9 aa, Homo Sapiens
MYIQQKVRM

SEQ ID NO: 1089838 - protein, 9 aa, Homo Sapiens
SPGPYRRSK

SEQ ID NO: 1089839 - protein, 9 aa, Homo Sapiens
QNWWCHMQP

SEQ ID NO: 1089840 - protein, 9 aa, Homo Sapiens
KLVVVGACG

SEQ ID NO: 1089841 - protein, 9 aa, Homo Sapiens
RQGYTIHIL

SEQ ID NO: 1089842 - protein, 9 aa, Homo Sapiens
DKEYTSRLG

SEQ ID NO: 1089843 - protein, 9 aa, Homo Sapiens
QVTFSPGLE

SEQ ID NO: 1089844 - protein, 9 aa, Homo Sapiens
QKPSLRSQT

SEQ ID NO: 1089845 - protein, 9 aa, Homo Sapiens
ALSATLHFS

SEQ ID NO: 1089846 - protein, 9 aa, Homo Sapiens
AVYTLCFVL

SEQ ID NO: 1089847 - protein, 9 aa, Homo Sapiens
HTGANFTLR

SEQ ID NO: 1089848 - protein, 9 aa, Homo Sapiens
CERRMECLD

SEQ ID NO: 1089849 - protein, 9 aa, Homo Sapiens
ISAIQGDTE

SEQ ID NO: 1089850 - protein, 9 aa, Homo Sapiens
KMPGMNSIH

SEQ ID NO: 1089851 - protein, 9 aa, Homo Sapiens
ISSGVQILT

SEQ ID NO: 1089852 - protein, 9 aa, Homo Sapiens
GDPGAVPAS

SEQ ID NO: 1089853 - protein, 9 aa, Homo Sapiens
NFRQSFYQM

SEQ ID NO: 1089854 - protein, 9 aa, Homo Sapiens
AIQGDTEEA

SEQ ID NO: 1089855 - protein, 9 aa, Homo Sapiens
SLHSNDSGV

SEQ ID NO: 1089856 - protein, 9 aa, Homo Sapiens
NLEKKASSE

SEQ ID NO: 1089857 - protein, 9 aa, Homo Sapiens
FVPSSSENT

SEQ ID NO: 1089858 - protein, 9 aa, Homo Sapiens
ANFRRCCWY

SEQ ID NO: 1089859 - protein, 9 aa, Homo Sapiens
GACGVGKSA

SEQ ID NO: 1089860 - protein, 9 aa, Homo Sapiens
AFCLMDFAI

SEQ ID NO: 1089861 - protein, 9 aa, Homo Sapiens
SLSELEAQI

SEQ ID NO: 1089862 - protein, 9 aa, Homo Sapiens
PVFQLGVKL

SEQ ID NO: 1089863 - protein, 9 aa, Homo Sapiens
MSGGHSRLH

SEQ ID NO: 1089864 - protein, 9 aa, Homo Sapiens
KHEHASRDG

SEQ ID NO: 1089865 - protein, 9 aa, Homo Sapiens
PFASVANVA

SEQ ID NO: 1089866 - protein, 9 aa, Homo Sapiens
TAASMKMNA

SEQ ID NO: 1089867 - protein, 9 aa, Homo Sapiens
EVTRLATLR

SEQ ID NO: 1089868 - protein, 9 aa, Homo Sapiens
EMHLPYTII

SEQ ID NO: 1089869 - protein, 9 aa, Homo Sapiens
SPSALPCAQ

SEQ ID NO: 1089870 - protein, 9 aa, Homo Sapiens
DFTIQLLNE

SEQ ID NO: 1089871 - protein, 9 aa, Homo Sapiens
ASIGSPKRE

SEQ ID NO: 1089872 - protein, 9 aa, Homo Sapiens
LSRTHSSSY

SEQ ID NO: 1089873 - protein, 9 aa, Homo Sapiens
LISAIQGDT

SEQ ID NO: 1089874 - protein, 9 aa, Homo Sapiens
LANLSHSLA

SEQ ID NO: 1089875 - protein, 9 aa, Homo Sapiens
QGDTEEAKK

SEQ ID NO: 1089876 - protein, 9 aa, Homo Sapiens
SQAQSSHTE

SEQ ID NO: 1089877 - protein, 9 aa, Homo Sapiens
QKRYVGYFA

SEQ ID NO: 1089878 - protein, 9 aa, Homo Sapiens
SIGSPKREQ

SEQ ID NO: 1089879 - protein, 9 aa, Homo Sapiens
HCPHHERCS

SEQ ID NO: 1089880 - protein, 9 aa, Homo Sapiens
LERILARKA

SEQ ID NO: 1089881 - protein, 9 aa, Homo Sapiens
LDPGDPGAV

SEQ ID NO: 1089882 - protein, 9 aa, Homo Sapiens
QAEGLVSPV

SEQ ID NO: 1089883 - protein, 9 aa, Homo Sapiens
TRYKTIWIN

SEQ ID NO: 1089884 - protein, 9 aa, Homo Sapiens
SSKPKLKRK

SEQ ID NO: 1089885 - protein, 9 aa, Homo Sapiens
GRNAMSAVN

SEQ ID NO: 1089886 - protein, 9 aa, Homo Sapiens
DWCSTILVQ

SEQ ID NO: 1089887 - protein, 9 aa, Homo Sapiens
PPAAGFITL

SEQ ID NO: 1089888 - protein, 9 aa, Homo Sapiens
PLSRTHSSS

SEQ ID NO: 1089889 - protein, 9 aa, Homo Sapiens
SWAARATRP

SEQ ID NO: 1089890 - protein, 9 aa, Homo Sapiens
RLWNAQEKM

SEQ ID NO: 1089891 - protein, 9 aa, Homo Sapiens
SVWRLWSWA

SEQ ID NO: 1089892 - protein, 9 aa, Homo Sapiens
CLSCLNSSL

SEQ ID NO: 1089893 - protein, 9 aa, Homo Sapiens
MTEVVRHCP

SEQ ID NO: 1089894 - protein, 9 aa, Homo Sapiens
RKKVMLKEI

SEQ ID NO: 1089895 - protein, 9 aa, Homo Sapiens
EAKTRLSMR

SEQ ID NO: 1089896 - protein, 9 aa, Homo Sapiens
YAGTGFPPT

SEQ ID NO: 1089897 - protein, 9 aa, Homo Sapiens
AAICEPLCY

SEQ ID NO: 1089898 - protein, 9 aa, Homo Sapiens
GCVQVTFSP

SEQ ID NO: 1089899 - protein, 9 aa, Homo Sapiens
SYCDYCSLR

SEQ ID NO: 1089900 - protein, 9 aa, Homo Sapiens
EVVKAPCGA

SEQ ID NO: 1089901 - protein, 9 aa, Homo Sapiens
SPKREQNKS

SEQ ID NO: 1089902 - protein, 9 aa, Homo Sapiens
ESFTNTCES

SEQ ID NO: 1089903 - protein, 9 aa, Homo Sapiens
KREQNKSTE

SEQ ID NO: 1089904 - protein, 9 aa, Homo Sapiens
AVPASVPTA

SEQ ID NO: 1089905 - protein, 9 aa, Homo Sapiens
NLVRCLSCL

SEQ ID NO: 1089906 - protein, 9 aa, Homo Sapiens
RLYVPYEQV

SEQ ID NO: 1089907 - protein, 9 aa, Homo Sapiens
YIRRFTRGR

SEQ ID NO: 1089908 - protein, 9 aa, Homo Sapiens
WVAVYTLCF

SEQ ID NO: 1089909 - protein, 9 aa, Homo Sapiens
ADIRCPFEK

SEQ ID NO: 1089910 - protein, 9 aa, Homo Sapiens
QILRMSKVP

SEQ ID NO: 1089911 - protein, 9 aa, Homo Sapiens
TANSFVGTP

SEQ ID NO: 1089912 - protein, 9 aa, Homo Sapiens
EVQSLHSND

SEQ ID NO: 1089913 - protein, 9 aa, Homo Sapiens
IRSVWRLWS

SEQ ID NO: 1089914 - protein, 9 aa, Homo Sapiens
MMGMMDEEG

SEQ ID NO: 1089915 - protein, 9 aa, Homo Sapiens
PKLKRKEAL

SEQ ID NO: 1089916 - protein, 9 aa, Homo Sapiens
AGDLTSLGL

SEQ ID NO: 1089917 - protein, 9 aa, Homo Sapiens
KRTIPTEKP

SEQ ID NO: 1089918 - protein, 9 aa, Homo Sapiens
SSGLQGCVQ

SEQ ID NO: 1089919 - protein, 9 aa, Homo Sapiens
TPKLPTKTS

SEQ ID NO: 1089920 - protein, 9 aa, Homo Sapiens
RLATLRRLE

SEQ ID NO: 1089921 - protein, 9 aa, Homo Sapiens
FRQSFYQMR

SEQ ID NO: 1089922 - protein, 9 aa, Homo Sapiens
AFGEERESI

SEQ ID NO: 1089923 - protein, 9 aa, Homo Sapiens
PEQPGQEKH

SEQ ID NO: 1089924 - protein, 9 aa, Homo Sapiens
QGVETPSQK

SEQ ID NO: 1089925 - protein, 9 aa, Homo Sapiens
LWLLRDPQS

SEQ ID NO: 1089926 - protein, 9 aa, Homo Sapiens
VDLLTAQYL

SEQ ID NO: 1089927 - protein, 9 aa, Homo Sapiens
LVYKTRDVP

SEQ ID NO: 1089928 - protein, 9 aa, Homo Sapiens
CRPRGSCAP

SEQ ID NO: 1089929 - protein, 9 aa, Homo Sapiens
GEVVKAPCG

SEQ ID NO: 1089930 - protein, 9 aa, Homo Sapiens
SASCWGQGG

SEQ ID NO: 1089931 - protein, 9 aa, Homo Sapiens
TAAKQCNEC

SEQ ID NO: 1089932 - protein, 9 aa, Homo Sapiens
PGSKPSMKG

SEQ ID NO: 1089933 - protein, 9 aa, Homo Sapiens
LRRLYILRM

SEQ ID NO: 1089934 - protein, 9 aa, Homo Sapiens
LLSQAQSSH

SEQ ID NO: 1089935 - protein, 9 aa, Homo Sapiens
LDQWRDSAA

SEQ ID NO: 1089936 - protein, 9 aa, Homo Sapiens
TFVPSSSEN

SEQ ID NO: 1089937 - protein, 9 aa, Homo Sapiens
GNLSFGWVC

SEQ ID NO: 1089938 - protein, 9 aa, Homo Sapiens
TTKSPGPYR

SEQ ID NO: 1089939 - protein, 9 aa, Homo Sapiens
TADIFHLLW

SEQ ID NO: 1089940 - protein, 9 aa, Homo Sapiens
LLAEMEMPD

SEQ ID NO: 1089941 - protein, 9 aa, Homo Sapiens
LALHTLQLL

SEQ ID NO: 1089942 - protein, 9 aa, Homo Sapiens
DPGAVPASV

SEQ ID NO: 1089943 - protein, 9 aa, Homo Sapiens
PTPQMVKYI

SEQ ID NO: 1089944 - protein, 9 aa, Homo Sapiens
TRLATLRRL

SEQ ID NO: 1089945 - protein, 9 aa, Homo Sapiens
TSNSRHPPG

SEQ ID NO: 1089946 - protein, 9 aa, Homo Sapiens
SQAEGLVSP

SEQ ID NO: 1089947 - protein, 9 aa, Homo Sapiens
SERPYKCSE

SEQ ID NO: 1089948 - protein, 9 aa, Homo Sapiens
RRNPGSKPS

SEQ ID NO: 1089949 - protein, 9 aa, Homo Sapiens
CLYPGTIKK

SEQ ID NO: 1089950 - protein, 9 aa, Homo Sapiens
EITKQEKDF

SEQ ID NO: 1089951 - protein, 9 aa, Homo Sapiens
YTSRLGALK

SEQ ID NO: 1089952 - protein, 9 aa, Homo Sapiens
ASRSRLWNA

SEQ ID NO: 1089953 - protein, 9 aa, Homo Sapiens
ELANLSHSL

SEQ ID NO: 1089954 - protein, 9 aa, Homo Sapiens
ECRPRGSCA

SEQ ID NO: 1089955 - protein, 9 aa, Homo Sapiens
IGGNQIGHF

SEQ ID NO: 1089956 - protein, 9 aa, Homo Sapiens
RMRMIRSVW

SEQ ID NO: 1089957 - protein, 9 aa, Homo Sapiens
CEPLCYPLL

SEQ ID NO: 1089958 - protein, 9 aa, Homo Sapiens
KQEKDFLWS

SEQ ID NO: 1089959 - protein, 9 aa, Homo Sapiens
HDSTRDEIK

SEQ ID NO: 1089960 - protein, 9 aa, Homo Sapiens
GRPMYQHQM

SEQ ID NO: 1089961 - protein, 9 aa, Homo Sapiens
LPVAGDLTS

SEQ ID NO: 1089962 - protein, 9 aa, Homo Sapiens
TLSWRRVIP

SEQ ID NO: 1089963 - protein, 9 aa, Homo Sapiens
PQSLPASNA

SEQ ID NO: 1089964 - protein, 9 aa, Homo Sapiens
EMSHQCHAL

SEQ ID NO: 1089965 - protein, 9 aa, Homo Sapiens
NSGAGSSSG

SEQ ID NO: 1089966 - protein, 9 aa, Homo Sapiens
DLSMNPASV

SEQ ID NO: 1089967 - protein, 9 aa, Homo Sapiens
PAAGFITLG

SEQ ID NO: 1089968 - protein, 9 aa, Homo Sapiens
SATLHFSRL

SEQ ID NO: 1089969 - protein, 9 aa, Homo Sapiens
YILRMSFVK

SEQ ID NO: 1089970 - protein, 9 aa, Homo Sapiens
PRKRGGLAG

SEQ ID NO: 1089971 - protein, 9 aa, Homo Sapiens
KERHTLSWR

SEQ ID NO: 1089972 - protein, 9 aa, Homo Sapiens
TILRRKASG

SEQ ID NO: 1089973 - protein, 9 aa, Homo Sapiens
LSYIRRFTR

SEQ ID NO: 1089974 - protein, 9 aa, Homo Sapiens
SFGWVCETL

SEQ ID NO: 1089975 - protein, 9 aa, Homo Sapiens
LSFGWVCET

SEQ ID NO: 1089976 - protein, 9 aa, Homo Sapiens
SNFRQSFYQ

SEQ ID NO: 1089977 - protein, 9 aa, Homo Sapiens
TREFIQESD

SEQ ID NO: 1089978 - protein, 9 aa, Homo Sapiens
EKQGCSRKS

SEQ ID NO: 1089979 - protein, 9 aa, Homo Sapiens
RHPPGRRRN

SEQ ID NO: 1089980 - protein, 9 aa, Homo Sapiens
AIYAEMSHQ

SEQ ID NO: 1089981 - protein, 9 aa, Homo Sapiens
SPSRTILRR

SEQ ID NO: 1089982 - protein, 9 aa, Homo Sapiens
SRLGALKMH

SEQ ID NO: 1089983 - protein, 9 aa, Homo Sapiens
PTLNLHELS

SEQ ID NO: 1089984 - protein, 9 aa, Homo Sapiens
HKYFSNLMS

SEQ ID NO: 1089985 - protein, 9 aa, Homo Sapiens
DQVFMNPSH

SEQ ID NO: 1089986 - protein, 9 aa, Homo Sapiens
YSWADIRCP

SEQ ID NO: 1089987 - protein, 9 aa, Homo Sapiens
LPVFQLGVK

SEQ ID NO: 1089988 - protein, 9 aa, Homo Sapiens
LEAQILRMS

SEQ ID NO: 1089989 - protein, 9 aa, Homo Sapiens
GFHSMKVEV

SEQ ID NO: 1089990 - protein, 9 aa, Homo Sapiens
GYTIHILLW

SEQ ID NO: 1089991 - protein, 9 aa, Homo Sapiens
GELQRLLNS

SEQ ID NO: 1089992 - protein, 9 aa, Homo Sapiens
TKQEKDFLW

SEQ ID NO: 1089993 - protein, 9 aa, Homo Sapiens
SSSGGSGEN

SEQ ID NO: 1089994 - protein, 9 aa, Homo Sapiens
CAQPTVSTG

SEQ ID NO: 1089995 - protein, 9 aa, Homo Sapiens
TNVQKPSLR

SEQ ID NO: 1089996 - protein, 9 aa, Homo Sapiens
ISASPYAGT

SEQ ID NO: 1089997 - protein, 9 aa, Homo Sapiens
QWRDSAALW

SEQ ID NO: 1089998 - protein, 9 aa, Homo Sapiens
IHILLWTFV

SEQ ID NO: 1089999 - protein, 9 aa, Homo Sapiens
KPSLRSQTL

SEQ ID NO: 1090000 - protein, 9 aa, Homo Sapiens
LGSSTPVFF

SEQ ID NO: 1090001 - protein, 9 aa, Homo Sapiens
NLSFGWVCE

SEQ ID NO: 1090002 - protein, 9 aa, Homo Sapiens
RERFQNLEK

SEQ ID NO: 1090003 - protein, 9 aa, Homo Sapiens
LSVAAEDQV

SEQ ID NO: 1090004 - protein, 9 aa, Homo Sapiens
KSNFGSVEM

SEQ ID NO: 1090005 - protein, 9 aa, Homo Sapiens
GAGTEDEEE

SEQ ID NO: 1090006 - protein, 9 aa, Homo Sapiens
DQWRDSAAL

SEQ ID NO: 1090007 - protein, 9 aa, Homo Sapiens
YKLVVVGAC

SEQ ID NO: 1090008 - protein, 9 aa, Homo Sapiens
RECRPRGSC

SEQ ID NO: 1090009 - protein, 9 aa, Homo Sapiens
IRVLQENGR

SEQ ID NO: 1090010 - protein, 9 aa, Homo Sapiens
MRSARTFVP

SEQ ID NO: 1090011 - protein, 9 aa, Homo Sapiens
PGMNSIHKK

SEQ ID NO: 1090012 - protein, 9 aa, Homo Sapiens
KAGVAPLAT

SEQ ID NO: 1090013 - protein, 9 aa, Homo Sapiens
ICEPLCYPL

SEQ ID NO: 1090014 - protein, 9 aa, Homo Sapiens
LGPTSNNHA

SEQ ID NO: 1090015 - protein, 9 aa, Homo Sapiens
FEMPPPSPT

SEQ ID NO: 1090016 - protein, 9 aa, Homo Sapiens
SCWGQGGKK

SEQ ID NO: 1090017 - protein, 9 aa, Homo Sapiens
QPGTCPGGT

SEQ ID NO: 1090018 - protein, 9 aa, Homo Sapiens
IWINLGLWA

SEQ ID NO: 1090019 - protein, 9 aa, Homo Sapiens
SLRSQTLSY

SEQ ID NO: 1090020 - protein, 9 aa, Homo Sapiens
NAKKAAANF

SEQ ID NO: 1090021 - protein, 9 aa, Homo Sapiens
KLLWHDNKP

SEQ ID NO: 1090022 - protein, 9 aa, Homo Sapiens
TGEISTTHA

SEQ ID NO: 1090023 - protein, 9 aa, Homo Sapiens
MSQAMMGMM

SEQ ID NO: 1090024 - protein, 9 aa, Homo Sapiens
TGCCNCPPG

SEQ ID NO: 1090025 - protein, 9 aa, Homo Sapiens
TEKRTIPTE

SEQ ID NO: 1090026 - protein, 9 aa, Homo Sapiens
FKGLDPTAS

SEQ ID NO: 1090027 - protein, 9 aa, Homo Sapiens
SFYQMRSKQ

SEQ ID NO: 1090028 - protein, 9 aa, Homo Sapiens
VYKTRDVPL

SEQ ID NO: 1090029 - protein, 9 aa, Homo Sapiens
RMVIHKYFS

SEQ ID NO: 1090030 - protein, 9 aa, Homo Sapiens
LYVPYEQVA

SEQ ID NO: 1090031 - protein, 9 aa, Homo Sapiens
MCRYQVYQG

SEQ ID NO: 1090032 - protein, 9 aa, Homo Sapiens
LHTLQLLVF

SEQ ID NO: 1090033 - protein, 9 aa, Homo Sapiens
SGFSFFPAS

SEQ ID NO: 1090034 - protein, 9 aa, Homo Sapiens
VFALRAKLL

SEQ ID NO: 1090035 - protein, 9 aa, Homo Sapiens
QYNAAIAFT

SEQ ID NO: 1090036 - protein, 9 aa, Homo Sapiens
STTHALDET

SEQ ID NO: 1090037 - protein, 9 aa, Homo Sapiens
RFQNLEKKA

SEQ ID NO: 1090038 - protein, 9 aa, Homo Sapiens
ITLGRLAKA

SEQ ID NO: 1090039 - protein, 9 aa, Homo Sapiens
LWNAQEKMV

SEQ ID NO: 1090040 - protein, 9 aa, Homo Sapiens
GLPCQDHEF

SEQ ID NO: 1090041 - protein, 9 aa, Homo Sapiens
KAAANFRRC

SEQ ID NO: 1090042 - protein, 9 aa, Homo Sapiens
NGLIDFTIQ

SEQ ID NO: 1090043 - protein, 9 aa, Homo Sapiens
RVLAEVEEG

SEQ ID NO: 1090044 - protein, 9 aa, Homo Sapiens
LSWAARATR

SEQ ID NO: 1090045 - protein, 9 aa, Homo Sapiens
LLLCQASCW

SEQ ID NO: 1090046 - protein, 9 aa, Homo Sapiens
IYAEMSHQC

SEQ ID NO: 1090047 - protein, 9 aa, Homo Sapiens
LSWRRVIPL

SEQ ID NO: 1090048 - protein, 9 aa, Homo Sapiens
LGVKLRDKE

SEQ ID NO: 1090049 - protein, 9 aa, Homo Sapiens
LQGCVQVTF

SEQ ID NO: 1090050 - protein, 9 aa, Homo Sapiens
LAGRKRERP

SEQ ID NO: 1090051 - protein, 9 aa, Homo Sapiens
CETLQKKVL

SEQ ID NO: 1090052 - protein, 9 aa, Homo Sapiens
SGLQGCVQV

SEQ ID NO: 1090053 - protein, 9 aa, Homo Sapiens
DCERRMECL

SEQ ID NO: 1090054 - protein, 9 aa, Homo Sapiens
PRGSCAPCG

SEQ ID NO: 1090055 - protein, 9 aa, Homo Sapiens
LQRLLNSLE

SEQ ID NO: 1090056 - protein, 9 aa, Homo Sapiens
VRHCPHHER

SEQ ID NO: 1090057 - protein, 9 aa, Homo Sapiens
FFMSSPISR

SEQ ID NO: 1090058 - protein, 9 aa, Homo Sapiens
IARKLDRYS

SEQ ID NO: 1090059 - protein, 9 aa, Homo Sapiens
HTVNMWDPL

SEQ ID NO: 1090060 - protein, 9 aa, Homo Sapiens
VVVGACGVG

SEQ ID NO: 1090061 - protein, 9 aa, Homo Sapiens
RSSPSRTIL

SEQ ID NO: 1090062 - protein, 9 aa, Homo Sapiens
KEKLLAEME

SEQ ID NO: 1090063 - protein, 9 aa, Homo Sapiens
QEKHEHASR

SEQ ID NO: 1090064 - protein, 9 aa, Homo Sapiens
SNNHAKKGH

SEQ ID NO: 1090065 - protein, 9 aa, Homo Sapiens
DGGVLVSGP

SEQ ID NO: 1090066 - protein, 9 aa, Homo Sapiens
GGEAVGTGE

SEQ ID NO: 1090067 - protein, 9 aa, Homo Sapiens
LRVLAEVEE

SEQ ID NO: 1090068 - protein, 9 aa, Homo Sapiens
TALSCCDPQ

SEQ ID NO: 1090069 - protein, 9 aa, Homo Sapiens
CSKSYCDYC

SEQ ID NO: 1090070 - protein, 9 aa, Homo Sapiens
QRYTVTRPE

SEQ ID NO: 1090071 - protein, 9 aa, Homo Sapiens
LPPSPPPQP

SEQ ID NO: 1090072 - protein, 9 aa, Homo Sapiens
HLHTKDRKH

SEQ ID NO: 1090073 - protein, 9 aa, Homo Sapiens
WRTRYKTIW

SEQ ID NO: 1090074 - protein, 9 aa, Homo Sapiens
SEERIPRPS

SEQ ID NO: 1090075 - protein, 9 aa, Homo Sapiens
RRRNPGSKP

SEQ ID NO: 1090076 - protein, 9 aa, Homo Sapiens
LLEHSELAL

SEQ ID NO: 1090077 - protein, 9 aa, Homo Sapiens
FASVANVAC

SEQ ID NO: 1090078 - protein, 9 aa, Homo Sapiens
EEMVLQALH

SEQ ID NO: 1090079 - protein, 9 aa, Homo Sapiens
LTVGVSAGR

SEQ ID NO: 1090080 - protein, 9 aa, Homo Sapiens
NFRRCCWYC

SEQ ID NO: 1090081 - protein, 9 aa, Homo Sapiens
EGRPMYQHQ

SEQ ID NO: 1090082 - protein, 9 aa, Homo Sapiens
LSCLNSSLK

SEQ ID NO: 1090083 - protein, 9 aa, Homo Sapiens
AAAHQRYTV

SEQ ID NO: 1090084 - protein, 9 aa, Homo Sapiens
HPCPLQEVE

SEQ ID NO: 1090085 - protein, 9 aa, Homo Sapiens
LKDVFKGLD

SEQ ID NO: 1090086 - protein, 9 aa, Homo Sapiens
LATLRRLEP

SEQ ID NO: 1090087 - protein, 9 aa, Homo Sapiens
VVKAPCGAG

SEQ ID NO: 1090088 - protein, 9 aa, Homo Sapiens
SQTLSYIRR

SEQ ID NO: 1090089 - protein, 9 aa, Homo Sapiens
SGGHSRLHL

SEQ ID NO: 1090090 - protein, 9 aa, Homo Sapiens
VVGACGVGK

SEQ ID NO: 1090091 - protein, 9 aa, Homo Sapiens
REQNKSTEH

SEQ ID NO: 1090092 - protein, 9 aa, Homo Sapiens
EKLLAEMEM

SEQ ID NO: 1090093 - protein, 9 aa, Homo Sapiens
QDSQDTIRG

SEQ ID NO: 1090094 - protein, 9 aa, Homo Sapiens
RDPQSLPAS

SEQ ID NO: 1090095 - protein, 9 aa, Homo Sapiens
LVSGPSASD

SEQ ID NO: 1090096 - protein, 9 aa, Homo Sapiens
SSENTALSC

SEQ ID NO: 1090097 - protein, 9 aa, Homo Sapiens
GDLTSLGLH

SEQ ID NO: 1090098 - protein, 9 aa, Homo Sapiens
RHTLSWRRV

SEQ ID NO: 1090099 - protein, 9 aa, Homo Sapiens
YQHQMSEPN

SEQ ID NO: 1090100 - protein, 9 aa, Homo Sapiens
TKSPGPYRR

SEQ ID NO: 1090101 - protein, 9 aa, Homo Sapiens
PPSPTLNLH

SEQ ID NO: 1090102 - protein, 9 aa, Homo Sapiens
LLCQASCWS

SEQ ID NO: 1090103 - protein, 9 aa, Homo Sapiens
FPASAVSTA

SEQ ID NO: 1090104 - protein, 9 aa, Homo Sapiens
LHQQQQQEP

SEQ ID NO: 1090105 - protein, 9 aa, Homo Sapiens
LRLVRIARK

SEQ ID NO: 1090106 - protein, 9 aa, Homo Sapiens
QTREFIQES

SEQ ID NO: 1090107 - protein, 9 aa, Homo Sapiens
FCHTGANFT

SEQ ID NO: 1090108 - protein, 9 aa, Homo Sapiens
DDLRRLYIL

SEQ ID NO: 1090109 - protein, 9 aa, Homo Sapiens
HPGLGGEAV

SEQ ID NO: 1090110 - protein, 9 aa, Homo Sapiens
GLDPTASPF

SEQ ID NO: 1090111 - protein, 9 aa, Homo Sapiens
EKRTIPTEK

SEQ ID NO: 1090112 - protein, 9 aa, Homo Sapiens
SSSKPKLKR

SEQ ID NO: 1090113 - protein, 9 aa, Homo Sapiens
KTIWINLGL

SEQ ID NO: 1090114 - protein, 9 aa, Homo Sapiens
RMIRSVWRL

SEQ ID NO: 1090115 - protein, 9 aa, Homo Sapiens
VCETLQKKV

SEQ ID NO: 1090116 - protein, 9 aa, Homo Sapiens
HEFVQFHPT

SEQ ID NO: 1090117 - protein, 9 aa, Homo Sapiens
LLTAQYLLS

SEQ ID NO: 1090118 - protein, 9 aa, Homo Sapiens
LSQAQSSHT

SEQ ID NO: 1090119 - protein, 9 aa, Homo Sapiens
LRQGYTIHI

SEQ ID NO: 1090120 - protein, 9 aa, Homo Sapiens
RGGLAGRKR

SEQ ID NO: 1090121 - protein, 9 aa, Homo Sapiens
VQGSLQTSS

SEQ ID NO: 1090122 - protein, 9 aa, Homo Sapiens
RRFTRGRNA

SEQ ID NO: 1090123 - protein, 9 aa, Homo Sapiens
EIGEKQGCS

SEQ ID NO: 1090124 - protein, 9 aa, Homo Sapiens
GRGHGRGWG

SEQ ID NO: 1090125 - protein, 9 aa, Homo Sapiens
SSHNSASCW

SEQ ID NO: 1090126 - protein, 9 aa, Homo Sapiens
LCPECGKRF

SEQ ID NO: 1090127 - protein, 9 aa, Homo Sapiens
QQLGKSNFG

SEQ ID NO: 1090128 - protein, 9 aa, Homo Sapiens
RKRGGLAGR

SEQ ID NO: 1090129 - protein, 9 aa, Homo Sapiens
EQVAPCASC

SEQ ID NO: 1090130 - protein, 9 aa, Homo Sapiens
AQILSLVAG

SEQ ID NO: 1090131 - protein, 9 aa, Homo Sapiens
AGFITLGRL

SEQ ID NO: 1090132 - protein, 9 aa, Homo Sapiens
FFSGFSFFP

SEQ ID NO: 1090133 - protein, 9 aa, Homo Sapiens
YPGTIKKAK

SEQ ID NO: 1090134 - protein, 9 aa, Homo Sapiens
SSSSKPKLK

SEQ ID NO: 1090135 - protein, 9 aa, Homo Sapiens
LCQASCWSM

SEQ ID NO: 1090136 - protein, 9 aa, Homo Sapiens
LQENGRLQS

SEQ ID NO: 1090137 - protein, 9 aa, Homo Sapiens
MTHRSERPY

SEQ ID NO: 1090138 - protein, 9 aa, Homo Sapiens
CSKYSSRHK

SEQ ID NO: 1090139 - protein, 9 aa, Homo Sapiens
NSEEMVLQA

SEQ ID NO: 1090140 - protein, 9 aa, Homo Sapiens
ASMKMNAKK

SEQ ID NO: 1090141 - protein, 9 aa, Homo Sapiens
QTLSYIRRF

SEQ ID NO: 1090142 - protein, 9 aa, Homo Sapiens
HFFSGFSFF

SEQ ID NO: 1090143 - protein, 9 aa, Homo Sapiens
VANVACGEG

SEQ ID NO: 1090144 - protein, 9 aa, Homo Sapiens
AAMRSARTF

SEQ ID NO: 1090145 - protein, 9 aa, Homo Sapiens
DLRRLYILR

SEQ ID NO: 1090146 - protein, 9 aa, Homo Sapiens
ECQHLHTKD

SEQ ID NO: 1090147 - protein, 9 aa, Homo Sapiens
EPAFCLMDF

SEQ ID NO: 1090148 - protein, 9 aa, Homo Sapiens
LLAFGIVQG

SEQ ID NO: 1090149 - protein, 9 aa, Homo Sapiens
SQDTIRGHP

SEQ ID NO: 1090150 - protein, 9 aa, Homo Sapiens
TSSSGLQGC

SEQ ID NO: 1090151 - protein, 9 aa, Homo Sapiens
SMKVEVMTE

SEQ ID NO: 1090152 - protein, 9 aa, Homo Sapiens
VDDLRRLYI

SEQ ID NO: 1090153 - protein, 9 aa, Homo Sapiens
IFHLLWRQA

SEQ ID NO: 1090154 - protein, 9 aa, Homo Sapiens
RPRGSCAPC

SEQ ID NO: 1090155 - protein, 9 aa, Homo Sapiens
AAEDQVFMN

SEQ ID NO: 1090156 - protein, 9 aa, Homo Sapiens
YTLCFVLAA

SEQ ID NO: 1090157 - protein, 9 aa, Homo Sapiens
LPQCLYPGT

SEQ ID NO: 1090158 - protein, 9 aa, Homo Sapiens
TEAKTRLSM

SEQ ID NO: 1090159 - protein, 9 aa, Homo Sapiens
RRLYILRMS

SEQ ID NO: 1090160 - protein, 9 aa, Homo Sapiens
MLLMLRKMG

SEQ ID NO: 1090161 - protein, 9 aa, Homo Sapiens
IRHQMTHRS

SEQ ID NO: 1090162 - protein, 9 aa, Homo Sapiens
QHLHTKDRK

SEQ ID NO: 1090163 - protein, 9 aa, Homo Sapiens
QSSHTEPDL

SEQ ID NO: 1090164 - protein, 9 aa, Homo Sapiens
IRRFTRGRN

SEQ ID NO: 1090165 - protein, 9 aa, Homo Sapiens
PYEQVAPCA

SEQ ID NO: 1090166 - protein, 9 aa, Homo Sapiens
AMRSARTFV

SEQ ID NO: 1090167 - protein, 9 aa, Homo Sapiens
VKAPCGAGT

SEQ ID NO: 1090168 - protein, 9 aa, Homo Sapiens
PCPLQEVEM

SEQ ID NO: 1090169 - protein, 9 aa, Homo Sapiens
AARATRPLP

SEQ ID NO: 1090170 - protein, 9 aa, Homo Sapiens
LLPVAGDLT

SEQ ID NO: 1090171 - protein, 9 aa, Homo Sapiens
ELTTPQTRE

SEQ ID NO: 1090172 - protein, 9 aa, Homo Sapiens
EAEEFCHTG

SEQ ID NO: 1090173 - protein, 9 aa, Homo Sapiens
VKYIELTPK

SEQ ID NO: 1090174 - protein, 9 aa, Homo Sapiens
TIQLLNELS

SEQ ID NO: 1090175 - protein, 9 aa, Homo Sapiens
LSATLHFSR

SEQ ID NO: 1090176 - protein, 9 aa, Homo Sapiens
GWVCETLQK

SEQ ID NO: 1090177 - protein, 9 aa, Homo Sapiens
GGVLVSGPS

SEQ ID NO: 1090178 - protein, 9 aa, Homo Sapiens
ERILARKAG

SEQ ID NO: 1090179 - protein, 9 aa, Homo Sapiens
HNIFLKELE

SEQ ID NO: 1090180 - protein, 9 aa, Homo Sapiens
TRSATSNSR

SEQ ID NO: 1090181 - protein, 9 aa, Homo Sapiens
SGPSSSSKP

SEQ ID NO: 1090182 - protein, 9 aa, Homo Sapiens
VLWLLRDPQ

SEQ ID NO: 1090183 - protein, 9 aa, Homo Sapiens
NQIGHFTIH

SEQ ID NO: 1090184 - protein, 9 aa, Homo Sapiens
VRIARKLDR

SEQ ID NO: 1090185 - protein, 9 aa, Homo Sapiens
GLIDFTIQL

SEQ ID NO: 1090186 - protein, 9 aa, Homo Sapiens
EEGRAWINP

SEQ ID NO: 1090187 - protein, 9 aa, Homo Sapiens
VHTAAKQCN

SEQ ID NO: 1090188 - protein, 9 aa, Homo Sapiens
KGLDPTASP

SEQ ID NO: 1090189 - protein, 9 aa, Homo Sapiens
EHSELALHT

SEQ ID NO: 1090190 - protein, 9 aa, Homo Sapiens
FSPGLELVF

SEQ ID NO: 1090191 - protein, 9 aa, Homo Sapiens
FGSASMAST

SEQ ID NO: 1090192 - protein, 9 aa, Homo Sapiens
LDLSMNPAS

SEQ ID NO: 1090193 - protein, 9 aa, Homo Sapiens
TCESTTTMS

SEQ ID NO: 1090194 - protein, 9 aa, Homo Sapiens
EHPGLGGEA

SEQ ID NO: 1090195 - protein, 9 aa, Homo Sapiens
RDVPLIRIE

SEQ ID NO: 1090196 - protein, 9 aa, Homo Sapiens
AQILRMSKV

SEQ ID NO: 1090197 - protein, 9 aa, Homo Sapiens
GEKQGCSRK

SEQ ID NO: 1090198 - protein, 9 aa, Homo Sapiens
KQGCSRKSS

SEQ ID NO: 1090199 - protein, 9 aa, Homo Sapiens
DYGHWYDRK

SEQ ID NO: 1090200 - protein, 9 aa, Homo Sapiens
QASCWSMRM

SEQ ID NO: 1090201 - protein, 9 aa, Homo Sapiens
SVTNVQKPS

SEQ ID NO: 1090202 - protein, 9 aa, Homo Sapiens
RATRPLPLF

SEQ ID NO: 1090203 - protein, 9 aa, Homo Sapiens
PGTIKKAKG

SEQ ID NO: 1090204 - protein, 9 aa, Homo Sapiens
TRGRNAMSA

SEQ ID NO: 1090205 - protein, 9 aa, Homo Sapiens
GHDSTRDEI

SEQ ID NO: 1090206 - protein, 9 aa, Homo Sapiens
NPLSRTHSS

SEQ ID NO: 1090207 - protein, 9 aa, Homo Sapiens
RIARKLDRY

SEQ ID NO: 1090208 - protein, 9 aa, Homo Sapiens
GIRGRGHGR

SEQ ID NO: 1090209 - protein, 9 aa, Homo Sapiens
APCGAGTED

SEQ ID NO: 1090210 - protein, 9 aa, Homo Sapiens
EISTTHALD

SEQ ID NO: 1090211 - protein, 9 aa, Homo Sapiens
SFFPASAVS

SEQ ID NO: 1090212 - protein, 9 aa, Homo Sapiens
RKAGVAPLA

SEQ ID NO: 1090213 - protein, 9 aa, Homo Sapiens
SVDLLTAQY

SEQ ID NO: 1090214 - protein, 9 aa, Homo Sapiens
SKSFANTSY

SEQ ID NO: 1090215 - protein, 9 aa, Homo Sapiens
HQCHALQED

SEQ ID NO: 1090216 - protein, 9 aa, Homo Sapiens
QCLYPGTIK

SEQ ID NO: 1090217 - protein, 9 aa, Homo Sapiens
KDLRPGYKE

SEQ ID NO: 1090218 - protein, 9 aa, Homo Sapiens
RSVWRLWSW

SEQ ID NO: 1090219 - protein, 9 aa, Homo Sapiens
LVAGFDSLY

SEQ ID NO: 1090220 - protein, 9 aa, Homo Sapiens
GPRKRGGLA

SEQ ID NO: 1090221 - protein, 9 aa, Homo Sapiens
PSRSSPSRT

SEQ ID NO: 1090222 - protein, 9 aa, Homo Sapiens
ELDQWRDSA

SEQ ID NO: 1090223 - protein, 9 aa, Homo Sapiens
RTILRRKAS

SEQ ID NO: 1090224 - protein, 9 aa, Homo Sapiens
LVFALRAKL

SEQ ID NO: 1090225 - protein, 9 aa, Homo Sapiens
NTCESTTTM

SEQ ID NO: 1090226 - protein, 9 aa, Homo Sapiens
PEMHLPYTI

SEQ ID NO: 1090227 - protein, 9 aa, Homo Sapiens
RYLLLCQAS

SEQ ID NO: 1090228 - protein, 9 aa, Homo Sapiens
WAARATRPL

SEQ ID NO: 1090229 - protein, 9 aa, Homo Sapiens
LKPVNSEEM

SEQ ID NO: 1090230 - protein, 9 aa, Homo Sapiens
LTRMVIHKY

SEQ ID NO: 1090231 - protein, 9 aa, Homo Sapiens
AQSSHTEPD

SEQ ID NO: 1090232 - protein, 9 aa, Homo Sapiens
ITKQEKDFL

SEQ ID NO: 1090233 - protein, 9 aa, Homo Sapiens
HCSKSFANT

SEQ ID NO: 1090234 - protein, 9 aa, Homo Sapiens
QGSLQTSSS

SEQ ID NO: 1090235 - protein, 9 aa, Homo Sapiens
VGAEAGARA

SEQ ID NO: 1090236 - protein, 9 aa, Homo Sapiens
GLQGCVQVT

SEQ ID NO: 1090237 - protein, 9 aa, Homo Sapiens
QVAPCASCP

SEQ ID NO: 1090238 - protein, 9 aa, Homo Sapiens
VNPLLSQAQ

SEQ ID NO: 1090239 - protein, 9 aa, Homo Sapiens
MSAVNVENP

SEQ ID NO: 1090240 - protein, 9 aa, Homo Sapiens
PMYQHQMSE

SEQ ID NO: 1090241 - protein, 9 aa, Homo Sapiens
TGFHSMKVE

SEQ ID NO: 1090242 - protein, 9 aa, Homo Sapiens
LSEKPPCSK

SEQ ID NO: 1090243 - protein, 9 aa, Homo Sapiens
PYRRSKSPA

SEQ ID NO: 1090244 - protein, 9 aa, Homo Sapiens
VETRKDLRP

SEQ ID NO: 1090245 - protein, 9 aa, Homo Sapiens
YRRSKSPAS

SEQ ID NO: 1090246 - protein, 9 aa, Homo Sapiens
ASIVEQNWW

SEQ ID NO: 1090247 - protein, 9 aa, Homo Sapiens
TEEAKKRLE

SEQ ID NO: 1090248 - protein, 9 aa, Homo Sapiens
PTSEERIPR

SEQ ID NO: 1090249 - protein, 9 aa, Homo Sapiens
EKNLPVFQL

SEQ ID NO: 1090250 - protein, 9 aa, Homo Sapiens
IRGRGHGRG

SEQ ID NO: 1090251 - protein, 9 aa, Homo Sapiens
FSTVRLLHF

SEQ ID NO: 1090252 - protein, 9 aa, Homo Sapiens
ERLLLTVGV

SEQ ID NO: 1090253 - protein, 9 aa, Homo Sapiens
DLTSLGLHG

SEQ ID NO: 1090254 - protein, 9 aa, Homo Sapiens
ASQDSQDTI

SEQ ID NO: 1090255 - protein, 9 aa, Homo Sapiens
AAANFRRCC

SEQ ID NO: 1090256 - protein, 9 aa, Homo Sapiens
QVYQGVCME

SEQ ID NO: 1090257 - protein, 9 aa, Homo Sapiens
QSLHSNDSG

SEQ ID NO: 1090258 - protein, 9 aa, Homo Sapiens
CGVGKSALT

SEQ ID NO: 1090259 - protein, 9 aa, Homo Sapiens
VAGFDSLYF

SEQ ID NO: 1090260 - protein, 9 aa, Homo Sapiens
PSPPPQPPP

SEQ ID NO: 1090261 - protein, 9 aa, Homo Sapiens
YKTRDVPLI

SEQ ID NO: 1090262 - protein, 9 aa, Homo Sapiens
DASRSRLWN

SEQ ID NO: 1090263 - protein, 9 aa, Homo Sapiens
GSKQYNAAI

SEQ ID NO: 1090264 - protein, 9 aa, Homo Sapiens
PLTIPEMHL

SEQ ID NO: 1090265 - protein, 9 aa, Homo Sapiens
FFPASAVST

SEQ ID NO: 1090266 - protein, 9 aa, Homo Sapiens
AEMSHQCHA

SEQ ID NO: 1090267 - protein, 9 aa, Homo Sapiens
IVQGSLQTS

SEQ ID NO: 1090268 - protein, 9 aa, Homo Sapiens
REFIQESDP

SEQ ID NO: 1090269 - protein, 9 aa, Homo Sapiens
SLGLHGLLA

SEQ ID NO: 1090270 - protein, 9 aa, Homo Sapiens
KVRMLLMLR

SEQ ID NO: 1090271 - protein, 9 aa, Homo Sapiens
VPYEQVAPC

SEQ ID NO: 1090272 - protein, 9 aa, Homo Sapiens
RNSGAGSSS

SEQ ID NO: 1090273 - protein, 9 aa, Homo Sapiens
NAMSAVNVE

SEQ ID NO: 1090274 - protein, 9 aa, Homo Sapiens
NSIHKKNPP

SEQ ID NO: 1090275 - protein, 9 aa, Homo Sapiens
YFSNLMSQD

SEQ ID NO: 1090276 - protein, 9 aa, Homo Sapiens
DSGELQRLL

SEQ ID NO: 1090277 - protein, 9 aa, Homo Sapiens
GKERHTLSW

SEQ ID NO: 1090278 - protein, 9 aa, Homo Sapiens
SPGLELVFA

SEQ ID NO: 1090279 - protein, 9 aa, Homo Sapiens
HGRDSGELQ

SEQ ID NO: 1090280 - protein, 9 aa, Homo Sapiens
YQMRSKQFP

SEQ ID NO: 1090281 - protein, 9 aa, Homo Sapiens
AFGIVQGSL

SEQ ID NO: 1090282 - protein, 9 aa, Homo Sapiens
GRCDPHTGC

SEQ ID NO: 1090283 - protein, 9 aa, Homo Sapiens
LTSLGLHGL

SEQ ID NO: 1090284 - protein, 9 aa, Homo Sapiens
VQKPSLRSQ

SEQ ID NO: 1090285 - protein, 9 aa, Homo Sapiens
QMVKYIELT

SEQ ID NO: 1090286 - protein, 9 aa, Homo Sapiens
HGLLALSSS

SEQ ID NO: 1090287 - protein, 9 aa, Homo Sapiens
PSALPCAQP

SEQ ID NO: 1090288 - protein, 9 aa, Homo Sapiens
AGFLLPGGL

SEQ ID NO: 1090289 - protein, 9 aa, Homo Sapiens
EKKASSEGG

SEQ ID NO: 1090290 - protein, 9 aa, Homo Sapiens
PLCYPLLLS

SEQ ID NO: 1090291 - protein, 9 aa, Homo Sapiens
DPQGTRSAT

SEQ ID NO: 1090292 - protein, 9 aa, Homo Sapiens
WLLRDPQSL

SEQ ID NO: 1090293 - protein, 9 aa, Homo Sapiens
TPQTREFIQ

SEQ ID NO: 1090294 - protein, 9 aa, Homo Sapiens
QPGQEKHEH

SEQ ID NO: 1090295 - protein, 9 aa, Homo Sapiens
TIKKAKGAD

SEQ ID NO: 1090296 - protein, 9 aa, Homo Sapiens
ATRPLPLFL

SEQ ID NO: 1090297 - protein, 9 aa, Homo Sapiens
SRLWNAQEK

SEQ ID NO: 1090298 - protein, 9 aa, Homo Sapiens
LEVQSLHSN

SEQ ID NO: 1090299 - protein, 9 aa, Homo Sapiens
TFSPGLELV

SEQ ID NO: 1090300 - protein, 9 aa, Homo Sapiens
YEVTRLATL

SEQ ID NO: 1090301 - protein, 9 aa, Homo Sapiens
WYDRKKVML

SEQ ID NO: 1090302 - protein, 9 aa, Homo Sapiens
QLHTVNMWD

SEQ ID NO: 1090303 - protein, 9 aa, Homo Sapiens
QEAEEFCHT

SEQ ID NO: 1090304 - protein, 9 aa, Homo Sapiens
LHFSRLCSL

SEQ ID NO: 1090305 - protein, 9 aa, Homo Sapiens
LLRQGYTIH

SEQ ID NO: 1090306 - protein, 9 aa, Homo Sapiens
GDSLLAFGI

SEQ ID NO: 1090307 - protein, 9 aa, Homo Sapiens
SDGGVLVSG

SEQ ID NO: 1090308 - protein, 9 aa, Homo Sapiens
SWADIRCPF

SEQ ID NO: 1090309 - protein, 9 aa, Homo Sapiens
ATLHFSRLC

SEQ ID NO: 1090310 - protein, 9 aa, Homo Sapiens
KRGGLAGRK

SEQ ID NO: 1090311 - protein, 9 aa, Homo Sapiens
MMSQAMMGM

SEQ ID NO: 1090312 - protein, 9 aa, Homo Sapiens
SLKDVFKGL

SEQ ID NO: 1090313 - protein, 9 aa, Homo Sapiens
PPPPLPPSP

SEQ ID NO: 1090314 - protein, 9 aa, Homo Sapiens
FTRGRNAMS

SEQ ID NO: 1090315 - protein, 9 aa, Homo Sapiens
QHMTEVVRH

SEQ ID NO: 1090316 - protein, 9 aa, Homo Sapiens
FTIQLLNEL

SEQ ID NO: 1090317 - protein, 9 aa, Homo Sapiens
AASSESTAF

SEQ ID NO: 1090318 - protein, 9 aa, Homo Sapiens
SMKGLTEAK

SEQ ID NO: 1090319 - protein, 9 aa, Homo Sapiens
QKVRMLLML

SEQ ID NO: 1090320 - protein, 9 aa, Homo Sapiens
HTHTPLPFS

SEQ ID NO: 1090321 - protein, 9 aa, Homo Sapiens
CDYCSLRRH

SEQ ID NO: 1090322 - protein, 9 aa, Homo Sapiens
LSQAEGLVS

SEQ ID NO: 1090323 - protein, 9 aa, Homo Sapiens
IGEKQGCSR

SEQ ID NO: 1090324 - protein, 9 aa, Homo Sapiens
QHQMSEPNI

SEQ ID NO: 1090325 - protein, 9 aa, Homo Sapiens
QGYTIHILL

SEQ ID NO: 1090326 - protein, 9 aa, Homo Sapiens
VAAEDQVFM

SEQ ID NO: 1090327 - protein, 9 aa, Homo Sapiens
TLNLHELSG

SEQ ID NO: 1090328 - protein, 9 aa, Homo Sapiens
STANSFVGT

SEQ ID NO: 1090329 - protein, 9 aa, Homo Sapiens
CDPQGTRSA

SEQ ID NO: 1090330 - protein, 9 aa, Homo Sapiens
GIVQGSLQT

SEQ ID NO: 1090331 - protein, 9 aa, Homo Sapiens
QMTHRSERP

SEQ ID NO: 1090332 - protein, 9 aa, Homo Sapiens
GLELVFALR

SEQ ID NO: 1090333 - protein, 9 aa, Homo Sapiens
PGAVPASVP

SEQ ID NO: 1090334 - protein, 9 aa, Homo Sapiens
VYTLCFVLA

SEQ ID NO: 1090335 - protein, 9 aa, Homo Sapiens
GMNSIHKKN

SEQ ID NO: 1090336 - protein, 9 aa, Homo Sapiens
QNLEKKASS

SEQ ID NO: 1090337 - protein, 9 aa, Homo Sapiens
AANFRRCCW

SEQ ID NO: 1090338 - protein, 9 aa, Homo Sapiens
LRLSEKPPC

SEQ ID NO: 1090339 - protein, 9 aa, Homo Sapiens
VAGDLTSLG

SEQ ID NO: 1090340 - protein, 9 aa, Homo Sapiens
DRKHGRKGK

SEQ ID NO: 1090341 - protein, 9 aa, Homo Sapiens
TMCRYQVYQ

SEQ ID NO: 1090342 - protein, 9 aa, Homo Sapiens
TRPLPLFLG

SEQ ID NO: 1090343 - protein, 9 aa, Homo Sapiens
NLPVFQLGV

SEQ ID NO: 1090344 - protein, 9 aa, Homo Sapiens
FQLGVKLRD

SEQ ID NO: 1090345 - protein, 9 aa, Homo Sapiens
QLGVKLRDK

SEQ ID NO: 1090346 - protein, 9 aa, Homo Sapiens
PSPTLNLHE

SEQ ID NO: 1090347 - protein, 9 aa, Homo Sapiens
GQEKHEHAS

SEQ ID NO: 1090348 - protein, 9 aa, Homo Sapiens
TSEERIPRP

SEQ ID NO: 1090349 - protein, 9 aa, Homo Sapiens
CSKSFANTS

SEQ ID NO: 1090350 - protein, 9 aa, Homo Sapiens
LLRLVRIAR

SEQ ID NO: 1090351 - protein, 9 aa, Homo Sapiens
GSPKREQNK

SEQ ID NO: 1090352 - protein, 9 aa, Homo Sapiens
DSNFRQSFY

SEQ ID NO: 1090353 - protein, 9 aa, Homo Sapiens
TTPQTREFI

SEQ ID NO: 1090354 - protein, 9 aa, Homo Sapiens
EGLVSPVVA

SEQ ID NO: 1090355 - protein, 9 aa, Homo Sapiens
QEIYEFHNI

SEQ ID NO: 1090356 - protein, 9 aa, Homo Sapiens
GSKPSMKGL

SEQ ID NO: 1090357 - protein, 9 aa, Homo Sapiens
VFFMSSPIS

SEQ ID NO: 1090358 - protein, 9 aa, Homo Sapiens
NAAIAFTLA

SEQ ID NO: 1090359 - protein, 9 aa, Homo Sapiens
FITLGRLAK

SEQ ID NO: 1090360 - protein, 9 aa, Homo Sapiens
QPTVSTGGH

SEQ ID NO: 1090361 - protein, 9 aa, Homo Sapiens
STAASMKMN

SEQ ID NO: 1090362 - protein, 9 aa, Homo Sapiens
VVRHCPHHE

SEQ ID NO: 1090363 - protein, 9 aa, Homo Sapiens
AGTGFPPTF

SEQ ID NO: 1090364 - protein, 9 aa, Homo Sapiens
SGIRGRGHG

SEQ ID NO: 1090365 - protein, 9 aa, Homo Sapiens
FKLVYKTRD

SEQ ID NO: 1090366 - protein, 9 aa, Homo Sapiens
QDHEFVQFH

SEQ ID NO: 1090367 - protein, 9 aa, Homo Sapiens
NPGSKPSMK

SEQ ID NO: 1090368 - protein, 9 aa, Homo Sapiens
EGHDSTRDE

SEQ ID NO: 1090369 - protein, 9 aa, Homo Sapiens
LLLPVAGDL

SEQ ID NO: 1090370 - protein, 9 aa, Homo Sapiens
SQKRYVGYF

SEQ ID NO: 1090371 - protein, 9 aa, Homo Sapiens
LQQLGKSNF

SEQ ID NO: 1090372 - protein, 9 aa, Homo Sapiens
RPMYQHQMS

SEQ ID NO: 1090373 - protein, 9 aa, Homo Sapiens
AEVEEGRAW

SEQ ID NO: 1090374 - protein, 9 aa, Homo Sapiens
YTIHILLWT

SEQ ID NO: 1090375 - protein, 9 aa, Homo Sapiens
CSLRRHYEV

SEQ ID NO: 1090376 - protein, 9 aa, Homo Sapiens
ADIFHLLWR

SEQ ID NO: 1090377 - protein, 9 aa, Homo Sapiens
AAAALDLSM

SEQ ID NO: 1090378 - protein, 9 aa, Homo Sapiens
LGKSNFGSV

SEQ ID NO: 1090379 - protein, 9 aa, Homo Sapiens
RSATSNSRH

SEQ ID NO: 1090380 - protein, 9 aa, Homo Sapiens
AAALDLSMN

SEQ ID NO: 1090381 - protein, 9 aa, Homo Sapiens
GGLAGRKRE

SEQ ID NO: 1090382 - protein, 9 aa, Homo Sapiens
CLERILARK

SEQ ID NO: 1090383 - protein, 9 aa, Homo Sapiens
RDEIKDDAL

SEQ ID NO: 1090384 - protein, 9 aa, Homo Sapiens
EDQVFMNPS

SEQ ID NO: 1090385 - protein, 9 aa, Homo Sapiens
PKDYSWADI

SEQ ID NO: 1090386 - protein, 9 aa, Homo Sapiens
LLALSSSPS

SEQ ID NO: 1090387 - protein, 9 aa, Homo Sapiens
ASAVSTAAS

SEQ ID NO: 1090388 - protein, 9 aa, Homo Sapiens
CGAGTEDEE

SEQ ID NO: 1090389 - protein, 9 aa, Homo Sapiens
HTGCCNCPP

SEQ ID NO: 1090390 - protein, 9 aa, Homo Sapiens
LEHSELALH

SEQ ID NO: 1090391 - protein, 9 aa, Homo Sapiens
GHWYDRKKV

SEQ ID NO: 1090392 - protein, 9 aa, Homo Sapiens
KMNAKKAAA

SEQ ID NO: 1090393 - protein, 9 aa, Homo Sapiens
DPLSEITKQ

SEQ ID NO: 1090394 - protein, 9 aa, Homo Sapiens
GFLLPGGLG

SEQ ID NO: 1090395 - protein, 9 aa, Homo Sapiens
PGLELVFAL

SEQ ID NO: 1090396 - protein, 9 aa, Homo Sapiens
ERHTLSWRR

SEQ ID NO: 1090397 - protein, 9 aa, Homo Sapiens
RNPGSKPSM

SEQ ID NO: 1090398 - protein, 9 aa, Homo Sapiens
FYQMRSKQF

SEQ ID NO: 1090399 - protein, 9 aa, Homo Sapiens
WRDSAALWN

SEQ ID NO: 1090400 - protein, 9 aa, Homo Sapiens
GLHGLLALS

SEQ ID NO: 1090401 - protein, 9 aa, Homo Sapiens
RIRVLQENG

SEQ ID NO: 1090402 - protein, 9 aa, Homo Sapiens
LLTVGVSAG

SEQ ID NO: 1090403 - protein, 9 aa, Homo Sapiens
FMSSPISRR

SEQ ID NO: 1090404 - protein, 9 aa, Homo Sapiens
IVEQNWWCH

SEQ ID NO: 1090405 - protein, 9 aa, Homo Sapiens
TSLGLHGLL

SEQ ID NO: 1090406 - protein, 9 aa, Homo Sapiens
ARERFQNLE

SEQ ID NO: 1090407 - protein, 9 aa, Homo Sapiens
TLHFSRLCS

SEQ ID NO: 1090408 - protein, 9 aa, Homo Sapiens
ATLEVQSLH

SEQ ID NO: 1090409 - protein, 9 aa, Homo Sapiens
TVSTGGHTH

SEQ ID NO: 1090410 - protein, 9 aa, Homo Sapiens
HQMTHRSER

SEQ ID NO: 1090411 - protein, 9 aa, Homo Sapiens
TAFGEERES

SEQ ID NO: 1090412 - protein, 9 aa, Homo Sapiens
STRDEIKDD

SEQ ID NO: 1090413 - protein, 9 aa, Homo Sapiens
AAKQCNECG

SEQ ID NO: 1090414 - protein, 9 aa, Homo Sapiens
KERLLLTVG

SEQ ID NO: 1090415 - protein, 9 aa, Homo Sapiens
PSLRSQTLS

SEQ ID NO: 1090416 - protein, 9 aa, Homo Sapiens
THALDETDA

SEQ ID NO: 1090417 - protein, 9 aa, Homo Sapiens
MVLQALHQY

SEQ ID NO: 1090418 - protein, 9 aa, Homo Sapiens
SEKPPCSKY

SEQ ID NO: 1090419 - protein, 9 aa, Homo Sapiens
SFANTSYLA

SEQ ID NO: 1090420 - protein, 9 aa, Homo Sapiens
NSRHPPGRR

SEQ ID NO: 1090421 - protein, 9 aa, Homo Sapiens
VGVSAGRQM

SEQ ID NO: 1090422 - protein, 9 aa, Homo Sapiens
AAASSESTA

SEQ ID NO: 1090423 - protein, 9 aa, Homo Sapiens
MNPASVGGR

SEQ ID NO: 1090424 - protein, 9 aa, Homo Sapiens
HTAAKQCNE

SEQ ID NO: 1090425 - protein, 9 aa, Homo Sapiens
SYLDKLLWH

SEQ ID NO: 1090426 - protein, 9 aa, Homo Sapiens
GRDSGELQR

SEQ ID NO: 1090427 - protein, 9 aa, Homo Sapiens
HEIGEKQGC

SEQ ID NO: 1090428 - protein, 9 aa, Homo Sapiens
TLRRLEPPG

SEQ ID NO: 1090429 - protein, 9 aa, Homo Sapiens
EEFCHTGAN

SEQ ID NO: 1090430 - protein, 9 aa, Homo Sapiens
GKSNFGSVE

SEQ ID NO: 1090431 - protein, 9 aa, Homo Sapiens
DEDCERRME

SEQ ID NO: 1090432 - protein, 9 aa, Homo Sapiens
QGCSRKSSG

SEQ ID NO: 1090433 - protein, 9 aa, Homo Sapiens
APERILDWC

SEQ ID NO: 1090434 - protein, 9 aa, Homo Sapiens
ASPYAGTGF

SEQ ID NO: 1090435 - protein, 9 aa, Homo Sapiens
SPPAAGFIT

SEQ ID NO: 1090436 - protein, 9 aa, Homo Sapiens
DVFKGLDPT

SEQ ID NO: 1090437 - protein, 9 aa, Homo Sapiens
EKHEHASRD

SEQ ID NO: 1090438 - protein, 9 aa, Homo Sapiens
SAALWNEFL

SEQ ID NO: 1090439 - protein, 9 aa, Homo Sapiens
ILARKAGVA

SEQ ID NO: 1090440 - protein, 9 aa, Homo Sapiens
MKGLTEAKT

SEQ ID NO: 1090441 - protein, 9 aa, Homo Sapiens
CYEVTRLAT

SEQ ID NO: 1090442 - protein, 9 aa, Homo Sapiens
LGLHGLLAL

SEQ ID NO: 1090443 - protein, 9 aa, Homo Sapiens
YEFHNIFLK

SEQ ID NO: 1090444 - protein, 9 aa, Homo Sapiens
GHSRLHLID

SEQ ID NO: 1090445 - protein, 9 aa, Homo Sapiens
LSEITKQEK

SEQ ID NO: 1090446 - protein, 9 aa, Homo Sapiens
SGELQRLLN

SEQ ID NO: 1090447 - protein, 9 aa, Homo Sapiens
KQYNAAIAF

SEQ ID NO: 1090448 - protein, 9 aa, Homo Sapiens
PGLGGEAVG

SEQ ID NO: 1090449 - protein, 9 aa, Homo Sapiens
SIVEQNWWC

SEQ ID NO: 1090450 - protein, 9 aa, Homo Sapiens
AGSKQYNAA

SEQ ID NO: 1090451 - protein, 9 aa, Homo Sapiens
LEWWVAVYT

SEQ ID NO: 1090452 - protein, 9 aa, Homo Sapiens
GHTHTPLPF

SEQ ID NO: 1090453 - protein, 9 aa, Homo Sapiens
YKTIWINLG

SEQ ID NO: 1090454 - protein, 9 aa, Homo Sapiens
RTRYKTIWI

SEQ ID NO: 1090455 - protein, 9 aa, Homo Sapiens
TIWINLGLW

SEQ ID NO: 1090456 - protein, 9 aa, Homo Sapiens
SSGIRGRGH

SEQ ID NO: 1090457 - protein, 9 aa, Homo Sapiens
AESFTNTCE

SEQ ID NO: 1090458 - protein, 9 aa, Homo Sapiens
VENPLSRTH

SEQ ID NO: 1090459 - protein, 9 aa, Homo Sapiens
MGMMDEEGN

SEQ ID NO: 1090460 - protein, 9 aa, Homo Sapiens
KDRKHGRKG

SEQ ID NO: 1090461 - protein, 9 aa, Homo Sapiens
NWWCHMQPC

SEQ ID NO: 1090462 - protein, 9 aa, Homo Sapiens
RCDPHTGCC

SEQ ID NO: 1090463 - protein, 9 aa, Homo Sapiens
TVNMWDPLN

SEQ ID NO: 1090464 - protein, 9 aa, Homo Sapiens
GTGFPPTFA

SEQ ID NO: 1090465 - protein, 9 aa, Homo Sapiens
SRTILRRKA

SEQ ID NO: 1090466 - protein, 9 aa, Homo Sapiens
HDNKPHHYS

SEQ ID NO: 1090467 - protein, 9 aa, Homo Sapiens
EVMTEATKV

SEQ ID NO: 1090468 - protein, 9 aa, Homo Sapiens
LSLVAGFDS

SEQ ID NO: 1090469 - protein, 9 aa, Homo Sapiens
KNLPVFQLG

SEQ ID NO: 1090470 - protein, 9 aa, Homo Sapiens
LGGEAVGTG

SEQ ID NO: 1090471 - protein, 9 aa, Homo Sapiens
PQPGTCPGG

SEQ ID NO: 1090472 - protein, 9 aa, Homo Sapiens
VLAEVEEGR

SEQ ID NO: 1090473 - protein, 9 aa, Homo Sapiens
AVNVENPLS

SEQ ID NO: 1090474 - protein, 9 aa, Homo Sapiens
PKLPTKTSS

SEQ ID NO: 1090475 - protein, 9 aa, Homo Sapiens
MSVTNVQKP

SEQ ID NO: 1090476 - protein, 9 aa, Homo Sapiens
DSLLAFGIV

SEQ ID NO: 1090477 - protein, 9 aa, Homo Sapiens
TPSQKRYVG

SEQ ID NO: 1090478 - protein, 9 aa, Homo Sapiens
FGWVCETLQ

SEQ ID NO: 1090479 - protein, 9 aa, Homo Sapiens
AEDQVFMNP

SEQ ID NO: 1090480 - protein, 9 aa, Homo Sapiens
AKQKETEME

SEQ ID NO: 1090481 - protein, 9 aa, Homo Sapiens
FHSMKVEVM

SEQ ID NO: 1090482 - protein, 9 aa, Homo Sapiens
GTIKKAKGA

SEQ ID NO: 1090483 - protein, 9 aa, Homo Sapiens
MWDPLNRVL

SEQ ID NO: 1090484 - protein, 9 aa, Homo Sapiens
LHFFSGFSF

SEQ ID NO: 1090485 - protein, 9 aa, Homo Sapiens
THRSERPYK

SEQ ID NO: 1090486 - protein, 9 aa, Homo Sapiens
SKQYNAAIA

SEQ ID NO: 1090487 - protein, 9 aa, Homo Sapiens
KLLLPVAGD

SEQ ID NO: 1090488 - protein, 9 aa, Homo Sapiens
AASMKMNAK

SEQ ID NO: 1090489 - protein, 9 aa, Homo Sapiens
GLAGRKRER

SEQ ID NO: 1090490 - protein, 9 aa, Homo Sapiens
YPQPGTCPG

SEQ ID NO: 1090491 - protein, 9 aa, Homo Sapiens
EKPPCSKYS

SEQ ID NO: 1090492 - protein, 9 aa, Homo Sapiens
LRAKLLLPV

SEQ ID NO: 1090493 - protein, 9 aa, Homo Sapiens
SQAMMGMMD

SEQ ID NO: 1090494 - protein, 9 aa, Homo Sapiens
RGSCAPCGG

SEQ ID NO: 1090495 - protein, 9 aa, Homo Sapiens
ARAEAGAGA

SEQ ID NO: 1090496 - protein, 9 aa, Homo Sapiens
SEITKQEKD

SEQ ID NO: 1090497 - protein, 9 aa, Homo Sapiens
MVIHKYFSN

SEQ ID NO: 1090498 - protein, 9 aa, Homo Sapiens
VETPSQKRY

SEQ ID NO: 1090499 - protein, 9 aa, Homo Sapiens
GGHTHTPLP

SEQ ID NO: 1090500 - protein, 9 aa, Homo Sapiens
RNAMSAVNV

SEQ ID NO: 1090501 - protein, 9 aa, Homo Sapiens
RDSAALWNE

SEQ ID NO: 1090502 - protein, 9 aa, Homo Sapiens
SLQTSSSGL

SEQ ID NO: 1090503 - protein, 9 aa, Homo Sapiens
KDVFKGLDP

SEQ ID NO: 1090504 - protein, 9 aa, Homo Sapiens
MRMRMIRSV

SEQ ID NO: 1090505 - protein, 9 aa, Homo Sapiens
SSPSALPCA

SEQ ID NO: 1090506 - protein, 9 aa, Homo Sapiens
EQNWWCHMQ

SEQ ID NO: 1090507 - protein, 9 aa, Homo Sapiens
LSCCDPQGT

SEQ ID NO: 1090508 - protein, 9 aa, Homo Sapiens
PSLSQAEGL

SEQ ID NO: 1090509 - protein, 9 aa, Homo Sapiens
HTPLPFSTV

SEQ ID NO: 1090510 - protein, 9 aa, Homo Sapiens
QGTRSATSN

SEQ ID NO: 1090511 - protein, 9 aa, Homo Sapiens
YAAICEPLC

SEQ ID NO: 1090512 - protein, 9 aa, Homo Sapiens
ERIPRPSRS

SEQ ID NO: 1090513 - protein, 9 aa, Homo Sapiens
VSTGGHTHT

SEQ ID NO: 1090514 - protein, 9 aa, Homo Sapiens
CSRKSSGTP

SEQ ID NO: 1090515 - protein, 9 aa, Homo Sapiens
HFSRLCSLR

SEQ ID NO: 1090516 - protein, 9 aa, Homo Sapiens
VEEGRAWIN

SEQ ID NO: 1090517 - protein, 9 aa, Homo Sapiens
MYQHQMSEP

SEQ ID NO: 1090518 - protein, 9 aa, Homo Sapiens
RCRECRPRG

SEQ ID NO: 1090519 - protein, 9 aa, Homo Sapiens
TSNNHAKKG

SEQ ID NO: 1090520 - protein, 9 aa, Homo Sapiens
QCNECGKFF

SEQ ID NO: 1090521 - protein, 9 aa, Homo Sapiens
TNTCESTTT

SEQ ID NO: 1090522 - protein, 9 aa, Homo Sapiens
KLPTKTSSG

SEQ ID NO: 1090523 - protein, 9 aa, Homo Sapiens
SRHPPGRRR

SEQ ID NO: 1090524 - protein, 9 aa, Homo Sapiens
LAEVEEGRA

SEQ ID NO: 1090525 - protein, 9 aa, Homo Sapiens
MHLPYTIIT

SEQ ID NO: 1090526 - protein, 9 aa, Homo Sapiens
TKERLLLTV

SEQ ID NO: 1090527 - protein, 9 aa, Homo Sapiens
ELALHTLQL

SEQ ID NO: 1090528 - protein, 9 aa, Homo Sapiens
ALSSSPSAL

SEQ ID NO: 1090529 - protein, 9 aa, Homo Sapiens
LPTKTSSGQ

SEQ ID NO: 1090530 - protein, 9 aa, Homo Sapiens
PGDPGAVPA

SEQ ID NO: 1090531 - protein, 9 aa, Homo Sapiens
PMSVTNVQK

SEQ ID NO: 1090532 - protein, 9 aa, Homo Sapiens
YLLLCQASC

SEQ ID NO: 1090533 - protein, 9 aa, Homo Sapiens
LWSWAAMRS

SEQ ID NO: 1090534 - protein, 9 aa, Homo Sapiens
AICEPLCYP

SEQ ID NO: 1090535 - protein, 9 aa, Homo Sapiens
YCSLRRHYE

SEQ ID NO: 1090536 - protein, 9 aa, Homo Sapiens
GKMPYPQPG

SEQ ID NO: 1090537 - protein, 9 aa, Homo Sapiens
TRKDLRPGY

SEQ ID NO: 1090538 - protein, 9 aa, Homo Sapiens
TGGHTHTPL

SEQ ID NO: 1090539 - protein, 9 aa, Homo Sapiens
EFCHTGANF

SEQ ID NO: 1090540 - protein, 9 aa, Homo Sapiens
EYTSRLGAL

SEQ ID NO: 1090541 - protein, 9 aa, Homo Sapiens
SLSQAEGLV

SEQ ID NO: 1090542 - protein, 9 aa, Homo Sapiens
HQMSEPNIP

SEQ ID NO: 1090543 - protein, 9 aa, Homo Sapiens
VWRLWSWAA

SEQ ID NO: 1090544 - protein, 9 aa, Homo Sapiens
LVRIARKLD

SEQ ID NO: 1090545 - protein, 9 aa, Homo Sapiens
VFQLGVKLR

SEQ ID NO: 1090546 - protein, 9 aa, Homo Sapiens
LSELEAQIL

SEQ ID NO: 1090547 - protein, 9 aa, Homo Sapiens
GVLVSGPSA

SEQ ID NO: 1090548 - protein, 9 aa, Homo Sapiens
PGRRRNPGS

SEQ ID NO: 1090549 - protein, 9 aa, Homo Sapiens
EMVLQALHQ

SEQ ID NO: 1090550 - protein, 9 aa, Homo Sapiens
SALPCAQPT

SEQ ID NO: 1090551 - protein, 9 aa, Homo Sapiens
QAMMGMMDE

SEQ ID NO: 1090552 - protein, 9 aa, Homo Sapiens
VPASVPTAP

SEQ ID NO: 1090553 - protein, 9 aa, Homo Sapiens
ANLSHSLAN

SEQ ID NO: 1090554 - protein, 9 aa, Homo Sapiens
MPYPQPGTC

SEQ ID NO: 1090555 - protein, 9 aa, Homo Sapiens
TVGVSAGRQ

SEQ ID NO: 1090556 - protein, 9 aa, Homo Sapiens
GAKQKETEM

SEQ ID NO: 1090557 - protein, 9 aa, Homo Sapiens
KGLTEAKTR

SEQ ID NO: 1090558 - protein, 9 aa, Homo Sapiens
SVANVACGE

SEQ ID NO: 1090559 - protein, 9 aa, Homo Sapiens
PTSNNHAKK

SEQ ID NO: 1090560 - protein, 9 aa, Homo Sapiens
QEHPGLGGE

SEQ ID NO: 1090561 - protein, 9 aa, Homo Sapiens
SMRMRMIRS

SEQ ID NO: 1090562 - protein, 9 aa, Homo Sapiens
GAPERILDW

SEQ ID NO: 1090563 - protein, 9 aa, Homo Sapiens
PYPQPGTCP

SEQ ID NO: 1090564 - protein, 9 aa, Homo Sapiens
EERIPRPSR

SEQ ID NO: 1090565 - protein, 9 aa, Homo Sapiens
KKAAANFRR

SEQ ID NO: 1090566 - protein, 9 aa, Homo Sapiens
PRNSGAGSS

SEQ ID NO: 1090567 - protein, 9 aa, Homo Sapiens
LEPAFCLMD

SEQ ID NO: 1090568 - protein, 9 aa, Homo Sapiens
MRMIRSVWR

SEQ ID NO: 1090569 - protein, 9 aa, Homo Sapiens
LIGGNQIGH

SEQ ID NO: 1090570 - protein, 9 aa, Homo Sapiens
PPCSKYSSR

SEQ ID NO: 1090571 - protein, 9 aa, Homo Sapiens
LQTSSSGLQ

SEQ ID NO: 1090572 - protein, 9 aa, Homo Sapiens
RHCPHHERC

SEQ ID NO: 1090573 - protein, 9 aa, Homo Sapiens
ASMASTANS

SEQ ID NO: 1090574 - protein, 9 aa, Homo Sapiens
CDKEYTSRL

SEQ ID NO: 1090575 - protein, 9 aa, Homo Sapiens
SMASTANSF

SEQ ID NO: 1090576 - protein, 9 aa, Homo Sapiens
LPCQDHEFV

SEQ ID NO: 1090577 - protein, 9 aa, Homo Sapiens
DGDSLLAFG

SEQ ID NO: 1090578 - protein, 9 aa, Homo Sapiens
PTVSTGGHT

SEQ ID NO: 1090579 - protein, 9 aa, Homo Sapiens
YSLIGGNQI

SEQ ID NO: 1090580 - protein, 9 aa, Homo Sapiens
RPTPQMVKY

SEQ ID NO: 1090581 - protein, 9 aa, Homo Sapiens
HALDETDAP

SEQ ID NO: 1090582 - protein, 9 aa, Homo Sapiens
FTNTCESTT

SEQ ID NO: 1090583 - protein, 9 aa, Homo Sapiens
GVPWAAGFL

SEQ ID NO: 1090584 - protein, 9 aa, Homo Sapiens
LHGLLALSS

SEQ ID NO: 1090585 - protein, 9 aa, Homo Sapiens
SELALHTLQ

SEQ ID NO: 1090586 - protein, 9 aa, Homo Sapiens
RLLLTVGVS

SEQ ID NO: 1090587 - protein, 9 aa, Homo Sapiens
RDSGELQRL

SEQ ID NO: 1090588 - protein, 9 aa, Homo Sapiens
APHPCPLQE

SEQ ID NO: 1090589 - protein, 9 aa, Homo Sapiens
EAQILRMSK

SEQ ID NO: 1090590 - protein, 9 aa, Homo Sapiens
HPPGRRRNP

SEQ ID NO: 1090591 - protein, 9 aa, Homo Sapiens
TPVFFMSSP

SEQ ID NO: 1090592 - protein, 9 aa, Homo Sapiens
TRDVPLIRI

SEQ ID NO: 1090593 - protein, 9 aa, Homo Sapiens
FHNIFLKEL

SEQ ID NO: 1090594 - protein, 9 aa, Homo Sapiens
PQCLYPGTI

SEQ ID NO: 1090595 - protein, 9 aa, Homo Sapiens
KKVMLKEIH

SEQ ID NO: 1090596 - protein, 9 aa, Homo Sapiens
PSMKGLTEA

SEQ ID NO: 1090597 - protein, 9 aa, Homo Sapiens
ETPSQKRYV

SEQ ID NO: 1090598 - protein, 9 aa, Homo Sapiens
LWHDNKPHH

SEQ ID NO: 1090599 - protein, 9 aa, Homo Sapiens
ELQRLLNSL

SEQ ID NO: 1090600 - protein, 9 aa, Homo Sapiens
DPHTGCCNC

SEQ ID NO: 1090601 - protein, 9 aa, Homo Sapiens
LPCAQPTVS

SEQ ID NO: 1090602 - protein, 9 aa, Homo Sapiens
DLRPGYKES

SEQ ID NO: 1090603 - protein, 9 aa, Homo Sapiens
FQNLEKKAS

SEQ ID NO: 1090604 - protein, 9 aa, Homo Sapiens
LRCRECRPR

SEQ ID NO: 1090605 - protein, 9 aa, Homo Sapiens
HSRLHLIDL

SEQ ID NO: 1090606 - protein, 9 aa, Homo Sapiens
SKPKLKRKE

SEQ ID NO: 1090607 - protein, 9 aa, Homo Sapiens
DPMSVTNVQ

SEQ ID NO: 1090608 - protein, 9 aa, Homo Sapiens
ALPCAQPTV

SEQ ID NO: 1090609 - protein, 9 aa, Homo Sapiens
RELDQWRDS

SEQ ID NO: 1090610 - protein, 9 aa, Homo Sapiens
RPGYKESTN

SEQ ID NO: 1090611 - protein, 9 aa, Homo Sapiens
GLTEAKTRL

SEQ ID NO: 1090612 - protein, 9 aa, Homo Sapiens
DADLEPAFC

SEQ ID NO: 1090613 - protein, 9 aa, Homo Sapiens
LIDFTIQLL

SEQ ID NO: 1090614 - protein, 9 aa, Homo Sapiens
DSTRDEIKD

SEQ ID NO: 1090615 - protein, 9 aa, Homo Sapiens
MGEKEKLLA

SEQ ID NO: 1090616 - protein, 9 aa, Homo Sapiens
LLHFFSGFS

SEQ ID NO: 1090617 - protein, 9 aa, Homo Sapiens
KYFSNLMSQ

SEQ ID NO: 1090618 - protein, 9 aa, Homo Sapiens
DTEEAKKRL

SEQ ID NO: 1090619 - protein, 9 aa, Homo Sapiens
AEEFCHTGA

SEQ ID NO: 1090620 - protein, 9 aa, Homo Sapiens
ETPKLPTKT

SEQ ID NO: 1090621 - protein, 9 aa, Homo Sapiens
HWYDRKKVM

SEQ ID NO: 1090622 - protein, 9 aa, Homo Sapiens
VNSEEMVLQ

SEQ ID NO: 1090623 - protein, 9 aa, Homo Sapiens
AHQRYTVTR

SEQ ID NO: 1090624 - protein, 9 aa, Homo Sapiens
IDFTIQLLN

SEQ ID NO: 1090625 - protein, 9 aa, Homo Sapiens
MSISSGVQI

SEQ ID NO: 1090626 - protein, 9 aa, Homo Sapiens
AAHQRYTVT

SEQ ID NO: 1090627 - protein, 9 aa, Homo Sapiens
SRSSPSRTI

SEQ ID NO: 1090628 - protein, 9 aa, Homo Sapiens
VRCLSCLNS

SEQ ID NO: 1090629 - protein, 9 aa, Homo Sapiens
FSSGIRGRG

SEQ ID NO: 1090630 - protein, 9 aa, Homo Sapiens
VFKGLDPTA

SEQ ID NO: 1090631 - protein, 9 aa, Homo Sapiens
WRRVIPLPQ

SEQ ID NO: 1090632 - protein, 9 aa, Homo Sapiens
STPVFFMSS

SEQ ID NO: 1090633 - protein, 9 aa, Homo Sapiens
EAVPFASVA

SEQ ID NO: 1090634 - protein, 9 aa, Homo Sapiens
VAPCASCPD

SEQ ID NO: 1090635 - protein, 9 aa, Homo Sapiens
RDPLSEITK

SEQ ID NO: 1090636 - protein, 9 aa, Homo Sapiens
YLLSFELLD

SEQ ID NO: 1090637 - protein, 9 aa, Homo Sapiens
EMPPPSPTL

SEQ ID NO: 1090638 - protein, 9 aa, Homo Sapiens
WSMRMRMIR

SEQ ID NO: 1090639 - protein, 9 aa, Homo Sapiens
FSRLCSLRI

SEQ ID NO: 1090640 - protein, 9 aa, Homo Sapiens
GNQIGHFTI

SEQ ID NO: 1090641 - protein, 9 aa, Homo Sapiens
SLVAGFDSL

SEQ ID NO: 1090642 - protein, 9 aa, Homo Sapiens
YNAAIAFTL

SEQ ID NO: 1090643 - protein, 9 aa, Homo Sapiens
PCSKYSSRH

SEQ ID NO: 1090644 - protein, 9 aa, Homo Sapiens
PQEHPGLGG

SEQ ID NO: 1090645 - protein, 9 aa, Homo Sapiens
SKSYCDYCS

SEQ ID NO: 1090646 - protein, 9 aa, Homo Sapiens
VEVMTEATK

SEQ ID NO: 1090647 - protein, 9 aa, Homo Sapiens
KLVYKTRDV

SEQ ID NO: 1090648 - protein, 9 aa, Homo Sapiens
LSMNPASVG

SEQ ID NO: 1090649 - protein, 9 aa, Homo Sapiens
RLLRLVRIA

SEQ ID NO: 1090650 - protein, 9 aa, Homo Sapiens
ASCWSMRMR

SEQ ID NO: 1090651 - protein, 9 aa, Homo Sapiens
VLQENGRLQ

SEQ ID NO: 1090652 - protein, 9 aa, Homo Sapiens
PVAGDLTSL

SEQ ID NO: 1090653 - protein, 9 aa, Homo Sapiens
NSASCWGQG

SEQ ID NO: 1090654 - protein, 9 aa, Homo Sapiens
FNPKDYSWA

SEQ ID NO: 1090655 - protein, 9 aa, Homo Sapiens
RAGSKQYNA

SEQ ID NO: 1090656 - protein, 9 aa, Homo Sapiens
FLLPGGLGS

SEQ ID NO: 1090657 - protein, 9 aa, Homo Sapiens
HRSERPYKC

SEQ ID NO: 1090658 - protein, 9 aa, Homo Sapiens
TIPTEKRTI

SEQ ID NO: 1090659 - protein, 9 aa, Homo Sapiens
KSFANTSYL

SEQ ID NO: 1090660 - protein, 9 aa, Homo Sapiens
MKVEVMTEA

SEQ ID NO: 1090661 - protein, 9 aa, Homo Sapiens
WMGEKEKLL

SEQ ID NO: 1090662 - protein, 9 aa, Homo Sapiens
GSASMASTA

SEQ ID NO: 1090663 - protein, 9 aa, Homo Sapiens
WRLWSWAAM

SEQ ID NO: 1090664 - protein, 9 aa, Homo Sapiens
PCQDHEFVQ

SEQ ID NO: 1090665 - protein, 9 aa, Homo Sapiens
KYIELTPKL

SEQ ID NO: 1090666 - protein, 9 aa, Homo Sapiens
VEQNWWCHM

SEQ ID NO: 1090667 - protein, 9 aa, Homo Sapiens
PKREQNKST

SEQ ID NO: 1090668 - protein, 9 aa, Homo Sapiens
KQCNECGKF

SEQ ID NO: 1090669 - protein, 9 aa, Homo Sapiens
ISTTHALDE

SEQ ID NO: 1090670 - protein, 9 aa, Homo Sapiens
RLVRIARKL

SEQ ID NO: 1090671 - protein, 9 aa, Homo Sapiens
TGFPPTFAI

SEQ ID NO: 1090672 - protein, 9 aa, Homo Sapiens
MKMNAKKAA

SEQ ID NO: 1090673 - protein, 9 aa, Homo Sapiens
LTIPEMHLP

SEQ ID NO: 1090674 - protein, 9 aa, Homo Sapiens
SDPMSVTNV

SEQ ID NO: 1090675 - protein, 9 aa, Homo Sapiens
EPLCYPLLL

SEQ ID NO: 1090676 - protein, 9 aa, Homo Sapiens
GFSSGIRGR

SEQ ID NO: 1090677 - protein, 9 aa, Homo Sapiens
QAWTADIFH

SEQ ID NO: 1090678 - protein, 9 aa, Homo Sapiens
QILSLVAGF

SEQ ID NO: 1090679 - protein, 9 aa, Homo Sapiens
WVCETLQKK

SEQ ID NO: 1090680 - protein, 9 aa, Homo Sapiens
AVSTAASMK

SEQ ID NO: 1090681 - protein, 9 aa, Homo Sapiens
PHTGCCNCP

SEQ ID NO: 1090682 - protein, 9 aa, Homo Sapiens
ASSHNSASC

SEQ ID NO: 1090683 - protein, 9 aa, Homo Sapiens
ILSLVAGFD

SEQ ID NO: 1090684 - protein, 9 aa, Homo Sapiens
EKEKLLAEM

SEQ ID NO: 1090685 - protein, 9 aa, Homo Sapiens
TRDEIKDDA

SEQ ID NO: 1090686 - protein, 9 aa, Homo Sapiens
SMKMNAKKA

SEQ ID NO: 1090687 - protein, 9 aa, Homo Sapiens
VPWAAGFLL

SEQ ID NO: 1090688 - protein, 9 aa, Homo Sapiens
LTTPQTREF

SEQ ID NO: 1090689 - protein, 9 aa, Homo Sapiens
CHTGANFTL

SEQ ID NO: 1090690 - protein, 9 aa, Homo Sapiens
PQGTRSATS

SEQ ID NO: 1090691 - protein, 9 aa, Homo Sapiens
MNSIHKKNP

SEQ ID NO: 1090692 - protein, 9 aa, Homo Sapiens
VAVYTLCFV

SEQ ID NO: 1090693 - protein, 9 aa, Homo Sapiens
RYQVYQGVC

SEQ ID NO: 1090694 - protein, 9 aa, Homo Sapiens
PLLSQAQSS

SEQ ID NO: 1090695 - protein, 9 aa, Homo Sapiens
MVKYIELTP

SEQ ID NO: 1090696 - protein, 9 aa, Homo Sapiens
CQDHEFVQF

SEQ ID NO: 1090697 - protein, 9 aa, Homo Sapiens
VIHKYFSNL

SEQ ID NO: 1090698 - protein, 9 aa, Homo Sapiens
ALDLSMNPA

SEQ ID NO: 1090699 - protein, 9 aa, Homo Sapiens
GMSGGHSRL

SEQ ID NO: 1090700 - protein, 9 aa, Homo Sapiens
VTFSPGLEL

SEQ ID NO: 1090701 - protein, 9 aa, Homo Sapiens
WAAMRSART

SEQ ID NO: 1090702 - protein, 9 aa, Homo Sapiens
RSARTFVPS

SEQ ID NO: 1090703 - protein, 9 aa, Homo Sapiens
TKDRKHGRK

SEQ ID NO: 1090704 - protein, 9 aa, Homo Sapiens
AQYLLSFEL

SEQ ID NO: 1090705 - protein, 9 aa, Homo Sapiens
IYEFHNIFL

SEQ ID NO: 1090706 - protein, 9 aa, Homo Sapiens
SHNSASCWG

SEQ ID NO: 1090707 - protein, 9 aa, Homo Sapiens
PLPFSTVRL

SEQ ID NO: 1090708 - protein, 9 aa, Homo Sapiens
INGLIDFTI

SEQ ID NO: 1090709 - protein, 9 aa, Homo Sapiens
PVFFMSSPI

SEQ ID NO: 1090710 - protein, 9 aa, Homo Sapiens
WCSTILVQG

SEQ ID NO: 1090711 - protein, 9 aa, Homo Sapiens
FSFFPASAV

SEQ ID NO: 1090712 - protein, 9 aa, Homo Sapiens
GGHSRLHLI

SEQ ID NO: 1090713 - protein, 9 aa, Homo Sapiens
KTRDVPLIR

SEQ ID NO: 1090714 - protein, 9 aa, Homo Sapiens
GRRRNPGSK

SEQ ID NO: 1090715 - protein, 9 aa, Homo Sapiens
ATSNSRHPP

SEQ ID NO: 1090716 - protein, 9 aa, Homo Sapiens
KPSMKGLTE

SEQ ID NO: 1090717 - protein, 9 aa, Homo Sapiens
PLPPSPPPQ

SEQ ID NO: 1090718 - protein, 9 aa, Homo Sapiens
VTNVQKPSL

SEQ ID NO: 1090719 - protein, 9 aa, Homo Sapiens
SAPHPCPLQ

SEQ ID NO: 1090720 - protein, 9 aa, Homo Sapiens
RPSRSSPSR

SEQ ID NO: 1090721 - protein, 9 aa, Homo Sapiens
SATSNSRHP

SEQ ID NO: 1090722 - protein, 9 aa, Homo Sapiens
LPFSTVRLL

SEQ ID NO: 1090723 - protein, 9 aa, Homo Sapiens
CQASCWSMR

SEQ ID NO: 1090724 - protein, 9 aa, Homo Sapiens
EIYEFHNIF

SEQ ID NO: 1090725 - protein, 9 aa, Homo Sapiens
VSTAASMKM

SEQ ID NO: 1090726 - protein, 9 aa, Homo Sapiens
EWWVAVYTL

SEQ ID NO: 1090727 - protein, 9 aa, Homo Sapiens
GVDDLRRLY

SEQ ID NO: 1090728 - protein, 9 aa, Homo Sapiens
PSCETPKLP

SEQ ID NO: 1090729 - protein, 9 aa, Homo Sapiens
EQPGQEKHE

SEQ ID NO: 1090730 - protein, 9 aa, Homo Sapiens
SASQDSQDT

SEQ ID NO: 1090731 - protein, 9 aa, Homo Sapiens
HLPYTIITT

SEQ ID NO: 1090732 - protein, 9 aa, Homo Sapiens
NVQKPSLRS

SEQ ID NO: 1090733 - protein, 9 aa, Homo Sapiens
SSSENTALS

SEQ ID NO: 1090734 - protein, 9 aa, Homo Sapiens
FSGFSFFPA

SEQ ID NO: 1090735 - protein, 9 aa, Homo Sapiens
QSFYQMRSK

SEQ ID NO: 1090736 - protein, 9 aa, Homo Sapiens
YAEMSHQCH

SEQ ID NO: 1090737 - protein, 9 aa, Homo Sapiens
ENTALSCCD

SEQ ID NO: 1090738 - protein, 9 aa, Homo Sapiens
SASMASTAN

SEQ ID NO: 1090739 - protein, 9 aa, Homo Sapiens
LSSSPSALP

SEQ ID NO: 1090740 - protein, 9 aa, Homo Sapiens
LEMMSQAMM

SEQ ID NO: 1090741 - protein, 9 aa, Homo Sapiens
ILDWCSTIL

SEQ ID NO: 1090742 - protein, 9 aa, Homo Sapiens
STTKSPGPY

SEQ ID NO: 1090743 - protein, 9 aa, Homo Sapiens
LNSSLKCGF

SEQ ID NO: 1090744 - protein, 9 aa, Homo Sapiens
CVQVTFSPG

SEQ ID NO: 1090745 - protein, 9 aa, Homo Sapiens
ELEAQILRM

SEQ ID NO: 1090746 - protein, 9 aa, Homo Sapiens
TEVVRHCPH

SEQ ID NO: 1090747 - protein, 9 aa, Homo Sapiens
ERFQNLEKK

SEQ ID NO: 1090748 - protein, 9 aa, Homo Sapiens
ACGVGKSAL

SEQ ID NO: 1090749 - protein, 9 aa, Homo Sapiens
LYPGTIKKA

SEQ ID NO: 1090750 - protein, 9 aa, Homo Sapiens
NLSHSLANI

SEQ ID NO: 1090751 - protein, 9 aa, Homo Sapiens
SPPPQPPPP

SEQ ID NO: 1090752 - protein, 9 aa, Homo Sapiens
CRYQVYQGV

SEQ ID NO: 1090753 - protein, 9 aa, Homo Sapiens
GCSRKSSGT

SEQ ID NO: 1090754 - protein, 9 aa, Homo Sapiens
LCYPLLLSH

SEQ ID NO: 1090755 - protein, 9 aa, Homo Sapiens
YGHWYDRKK

SEQ ID NO: 1090756 - protein, 9 aa, Homo Sapiens
ETRKDLRPG

SEQ ID NO: 1090757 - protein, 9 aa, Homo Sapiens
NTALSCCDP

SEQ ID NO: 1090758 - protein, 9 aa, Homo Sapiens
HTKDRKHGR

SEQ ID NO: 1090759 - protein, 9 aa, Homo Sapiens
GLGGEAVGT

SEQ ID NO: 1090760 - protein, 9 aa, Homo Sapiens
MSHQCHALQ

SEQ ID NO: 1090761 - protein, 9 aa, Homo Sapiens
WDPLNRVLA

SEQ ID NO: 1090762 - protein, 9 aa, Homo Sapiens
NHAKKGHCH

SEQ ID NO: 1090763 - protein, 9 aa, Homo Sapiens
EDCERRMEC

SEQ ID NO: 1090764 - protein, 9 aa, Homo Sapiens
HTLSWRRVI

SEQ ID NO: 1090765 - protein, 9 aa, Homo Sapiens
QDASRSRLW

SEQ ID NO: 1090766 - protein, 9 aa, Homo Sapiens
KDYSWADIR

SEQ ID NO: 1090767 - protein, 9 aa, Homo Sapiens
VTRLATLRR

SEQ ID NO: 1090768 - protein, 9 aa, Homo Sapiens
SSESTAFGE

SEQ ID NO: 1090769 - protein, 9 aa, Homo Sapiens
PPSPPPQPP

SEQ ID NO: 1090770 - protein, 9 aa, Homo Sapiens
AEGLVSPVV

SEQ ID NO: 1090771 - protein, 9 aa, Homo Sapiens
RAKLLLPVA

SEQ ID NO: 1090772 - protein, 9 aa, Homo Sapiens
IPEMHLPYT

SEQ ID NO: 1090773 - protein, 9 aa, Homo Sapiens
ARTFVPSSS

SEQ ID NO: 1090774 - protein, 9 aa, Homo Sapiens
LHTVNMWDP

SEQ ID NO: 1090775 - protein, 9 aa, Homo Sapiens
NPLLSQAQS

SEQ ID NO: 1090776 - protein, 9 aa, Homo Sapiens
TRMVIHKYF

SEQ ID NO: 1090777 - protein, 9 aa, Homo Sapiens
WTADIFHLL

SEQ ID NO: 1090778 - protein, 9 aa, Homo Sapiens
CETPKLPTK

SEQ ID NO: 1090779 - protein, 9 aa, Homo Sapiens
HSNDSGVYR

SEQ ID NO: 1090780 - protein, 9 aa, Homo Sapiens
RGGMSGGHS

SEQ ID NO: 1090781 - protein, 9 aa, Homo Sapiens
TIHILLWTF

SEQ ID NO: 1090782 - protein, 9 aa, Homo Sapiens
CVGAEAGAR

SEQ ID NO: 1090783 - protein, 9 aa, Homo Sapiens
PSSSENTAL

SEQ ID NO: 1090784 - protein, 9 aa, Homo Sapiens
SWAAMRSAR

SEQ ID NO: 1090785 - protein, 9 aa, Homo Sapiens
YLDKLLWHD

SEQ ID NO: 1090786 - protein, 9 aa, Homo Sapiens
VPFASVANV

SEQ ID NO: 1090787 - protein, 9 aa, Homo Sapiens
SSSGLQGCV

SEQ ID NO: 1090788 - protein, 9 aa, Homo Sapiens
PCGAGTEDE

SEQ ID NO: 1090789 - protein, 9 aa, Homo Sapiens
QENGRLQSM

SEQ ID NO: 1090790 - protein, 9 aa, Homo Sapiens
YIQQKVRML

SEQ ID NO: 1090791 - protein, 9 aa, Homo Sapiens
QESDPMSVT

SEQ ID NO: 1090792 - protein, 9 aa, Homo Sapiens
SWRRVIPLP

SEQ ID NO: 1090793 - protein, 9 aa, Homo Sapiens
STAFGEERE

SEQ ID NO: 1090794 - protein, 9 aa, Homo Sapiens
GDTEEAKKR

SEQ ID NO: 1090795 - protein, 9 aa, Homo Sapiens
CLMDFAIER

SEQ ID NO: 1090796 - protein, 9 aa, Homo Sapiens
QAQSSHTEP

SEQ ID NO: 1090797 - protein, 9 aa, Homo Sapiens
GARAEAGAG

SEQ ID NO: 1090798 - protein, 9 aa, Homo Sapiens
QLGKSNFGS

SEQ ID NO: 1090799 - protein, 9 aa, Homo Sapiens
QTSSSGLQG

SEQ ID NO: 1090800 - protein, 9 aa, Homo Sapiens
PRPTPQMVK

SEQ ID NO: 1090801 - protein, 9 aa, Homo Sapiens
CLNSSLKCG

SEQ ID NO: 1090802 - protein, 9 aa, Homo Sapiens
HSELALHTL

SEQ ID NO: 1090803 - protein, 9 aa, Homo Sapiens
QRLLNSLEC

SEQ ID NO: 1090804 - protein, 9 aa, Homo Sapiens
LVRCLSCLN

SEQ ID NO: 1090805 - protein, 9 aa, Homo Sapiens
TLSYIRRFT

SEQ ID NO: 1090806 - protein, 9 aa, Homo Sapiens
KVEVMTEAT

SEQ ID NO: 1090807 - protein, 9 aa, Homo Sapiens
PSSSSKPKL

SEQ ID NO: 1090808 - protein, 9 aa, Homo Sapiens
NMWDPLNRV

SEQ ID NO: 1090809 - protein, 9 aa, Homo Sapiens
IQGDTEEAK

SEQ ID NO: 1090810 - protein, 9 aa, Homo Sapiens
SCWSMRMRM

SEQ ID NO: 1090811 - protein, 9 aa, Homo Sapiens
TKMPGMNSI

SEQ ID NO: 1090812 - protein, 9 aa, Homo Sapiens
QLHQQQQQE

SEQ ID NO: 1090813 - protein, 9 aa, Homo Sapiens
WADIRCPFE

SEQ ID NO: 1090814 - protein, 9 aa, Homo Sapiens
FSGKMPYPQ

SEQ ID NO: 1090815 - protein, 9 aa, Homo Sapiens
ARLLRLVRI

SEQ ID NO: 1090816 - protein, 9 aa, Homo Sapiens
PASAPHPCP

SEQ ID NO: 1090817 - protein, 9 aa, Homo Sapiens
KMPYPQPGT

SEQ ID NO: 1090818 - protein, 9 aa, Homo Sapiens
GEISTTHAL

SEQ ID NO: 1090819 - protein, 9 aa, Homo Sapiens
PAFCLMDFA

SEQ ID NO: 1090820 - protein, 9 aa, Homo Sapiens
RLYILRMSF

SEQ ID NO: 1090821 - protein, 9 aa, Homo Sapiens
APSLSQAEG

SEQ ID NO: 1090822 - protein, 9 aa, Homo Sapiens
SFTNTCEST

SEQ ID NO: 1090823 - protein, 9 aa, Homo Sapiens
YDRKKVMLK

SEQ ID NO: 1090824 - protein, 9 aa, Homo Sapiens
DPQSLPASN

SEQ ID NO: 1090825 - protein, 9 aa, Homo Sapiens
LHSNDSGVY

SEQ ID NO: 1090826 - protein, 9 aa, Homo Sapiens
KFLQQLGKS

SEQ ID NO: 1090827 - protein, 9 aa, Homo Sapiens
DPGDPGAVP

SEQ ID NO: 1090828 - protein, 9 aa, Homo Sapiens
NINGLIDFT

SEQ ID NO: 1090829 - protein, 9 aa, Homo Sapiens
SGKMPYPQP

SEQ ID NO: 1090830 - protein, 9 aa, Homo Sapiens
SISSGVQIL

SEQ ID NO: 1090831 - protein, 9 aa, Homo Sapiens
SHSLANIQL

SEQ ID NO: 1090832 - protein, 9 aa, Homo Sapiens
LVVVGACGV

SEQ ID NO: 1090833 - protein, 9 aa, Homo Sapiens
AAGFITLGR

SEQ ID NO: 1090834 - protein, 9 aa, Homo Sapiens
CPLQEVEME

SEQ ID NO: 1090835 - protein, 9 aa, Homo Sapiens
GLLALSSSP

SEQ ID NO: 1090836 - protein, 9 aa, Homo Sapiens
RCLSCLNSS

SEQ ID NO: 1090837 - protein, 9 aa, Homo Sapiens
MPPPSPTLN

SEQ ID NO: 1090838 - protein, 9 aa, Homo Sapiens
KSYCDYCSL

SEQ ID NO: 1090839 - protein, 9 aa, Homo Sapiens
GPYRRSKSP

SEQ ID NO: 1090840 - protein, 9 aa, Homo Sapiens
PCAQPTVST

SEQ ID NO: 1090841 - protein, 9 aa, Homo Sapiens
ASAPHPCPL

SEQ ID NO: 1090842 - protein, 9 aa, Homo Sapiens
YCDYCSLRR

SEQ ID NO: 1090843 - protein, 9 aa, Homo Sapiens
YVPYEQVAP

SEQ ID NO: 1090844 - protein, 9 aa, Homo Sapiens
RAGLPCQDH

SEQ ID NO: 1090845 - protein, 9 aa, Homo Sapiens
VLVSGPSAS

SEQ ID NO: 1090846 - protein, 9 aa, Homo Sapiens
FIQESDPMS

SEQ ID NO: 1090847 - protein, 9 aa, Homo Sapiens
KPTIPTEKR

SEQ ID NO: 1090848 - protein, 9 aa, Homo Sapiens
PASAVSTAA

SEQ ID NO: 1090849 - protein, 9 aa, Homo Sapiens
TLEVQSLHS

SEQ ID NO: 1090850 - protein, 9 aa, Homo Sapiens
VPSSSENTA

SEQ ID NO: 1090851 - protein, 9 aa, Homo Sapiens
VRLLHFFSG

SEQ ID NO: 1090852 - protein, 9 aa, Homo Sapiens
LTAQYLLSF

SEQ ID NO: 1090853 - protein, 9 aa, Homo Sapiens
GGMSGGHSR

SEQ ID NO: 1090854 - protein, 9 aa, Homo Sapiens
GSPPAAGFI

SEQ ID NO: 1090855 - protein, 9 aa, Homo Sapiens
LAFGIVQGS

SEQ ID NO: 1090856 - protein, 9 aa, Homo Sapiens
AKKAAANFR

SEQ ID NO: 1090857 - protein, 9 aa, Homo Sapiens
VYQGVCMEV

SEQ ID NO: 1090858 - protein, 9 aa, Homo Sapiens
KAPCGAGTE

SEQ ID NO: 1090859 - protein, 9 aa, Homo Sapiens
PTKTSSGQK

SEQ ID NO: 1090860 - protein, 9 aa, Homo Sapiens
SELEAQILR

SEQ ID NO: 1090861 - protein, 9 aa, Homo Sapiens
PPPSPTLNL

SEQ ID NO: 1090862 - protein, 9 aa, Homo Sapiens
SGAGSSSGG

SEQ ID NO: 1090863 - protein, 9 aa, Homo Sapiens
PLSEITKQE

SEQ ID NO: 1090864 - protein, 9 aa, Homo Sapiens
YQGVCMEVS

SEQ ID NO: 1090865 - protein, 9 aa, Homo Sapiens
KLLAEMEMP

SEQ ID NO: 1090866 - protein, 9 aa, Homo Sapiens
DYCSLRRHY

SEQ ID NO: 1090867 - protein, 9 aa, Homo Sapiens
STVRLLHFF

SEQ ID NO: 1090868 - protein, 9 aa, Homo Sapiens
CDPHTGCCN

SEQ ID NO: 1090869 - protein, 9 aa, Homo Sapiens
LALSSSPSA

SEQ ID NO: 1090870 - protein, 9 aa, Homo Sapiens
SYIRRFTRG

SEQ ID NO: 1090871 - protein, 9 aa, Homo Sapiens
AGSSSGGSG

SEQ ID NO: 1090872 - protein, 9 aa, Homo Sapiens
GVETPSQKR

SEQ ID NO: 1090873 - protein, 9 aa, Homo Sapiens
AVPFASVAN

SEQ ID NO: 1090874 - protein, 9 aa, Homo Sapiens
GCCNCPPGL

SEQ ID NO: 1090875 - protein, 9 aa, Homo Sapiens
KPVNSEEMV

SEQ ID NO: 1090876 - protein, 9 aa, Homo Sapiens
HEHASRDGP

SEQ ID NO: 1090877 - protein, 9 aa, Homo Sapiens
VDASIVEQN

SEQ ID NO: 1090878 - protein, 9 aa, Homo Sapiens
AGPRKRGGL

SEQ ID NO: 1090879 - protein, 9 aa, Homo Sapiens
KPKLKRKEA

SEQ ID NO: 1090880 - protein, 9 aa, Homo Sapiens
SLLAFGIVQ

SEQ ID NO: 1090881 - protein, 9 aa, Homo Sapiens
MIRSVWRLW

SEQ ID NO: 1090882 - protein, 9 aa, Homo Sapiens
ARQITQETF

SEQ ID NO: 1090883 - protein, 9 aa, Homo Sapiens
RGRNAMSAV

SEQ ID NO: 1090884 - protein, 9 aa, Homo Sapiens
TPQEHPGLG

SEQ ID NO: 1090885 - protein, 9 aa, Homo Sapiens
PPLPPSPPP

SEQ ID NO: 1090886 - protein, 9 aa, Homo Sapiens
LAESFTNTC

SEQ ID NO: 1090887 - protein, 9 aa, Homo Sapiens
WAAGFLLPG

SEQ ID NO: 1090888 - protein, 9 aa, Homo Sapiens
GSSSGGSGE

SEQ ID NO: 1090889 - protein, 9 aa, Homo Sapiens
ERRMECLDE

SEQ ID NO: 1090890 - protein, 9 aa, Homo Sapiens
SPTLNLHEL

SEQ ID NO: 1090891 - protein, 9 aa, Homo Sapiens
AKKGHCHQE

SEQ ID NO: 1090892 - protein, 9 aa, Homo Sapiens
THTPLPFST

SEQ ID NO: 1090893 - protein, 9 aa, Homo Sapiens
IGSPKREQN

SEQ ID NO: 1090894 - protein, 9 aa, Homo Sapiens
TIPEMHLPY

SEQ ID NO: 1090895 - protein, 9 aa, Homo Sapiens
IHKYFSNLM

SEQ ID NO: 1090896 - protein, 9 aa, Homo Sapiens
DRKKVMLKE

SEQ ID NO: 1090897 - protein, 9 aa, Homo Sapiens
ARKAGVAPL

SEQ ID NO: 1090898 - protein, 9 aa, Homo Sapiens
RLLHFFSGF

SEQ ID NO: 1090899 - protein, 9 aa, Homo Sapiens
GAVPASVPT

SEQ ID NO: 1090900 - protein, 9 aa, Homo Sapiens
ALSWAARAT

SEQ ID NO: 1090901 - protein, 9 aa, Homo Sapiens
RVLQENGRL

SEQ ID NO: 1090902 - protein, 9 aa, Homo Sapiens
FLQQLGKSN

SEQ ID NO: 1090903 - protein, 9 aa, Homo Sapiens
HQRYTVTRP

SEQ ID NO: 1090904 - protein, 9 aa, Homo Sapiens
LALSATLHF

SEQ ID NO: 1090905 - protein, 9 aa, Homo Sapiens
IHKKNPPSL

SEQ ID NO: 1090906 - protein, 9 aa, Homo Sapiens
SRHSASQDS

SEQ ID NO: 1090907 - protein, 9 aa, Homo Sapiens
RLWSWAAMR

SEQ ID NO: 1090908 - protein, 9 aa, Homo Sapiens
SKPSMKGLT

SEQ ID NO: 1090909 - protein, 9 aa, Homo Sapiens
LRPGYKEST

SEQ ID NO: 1090910 - protein, 9 aa, Homo Sapiens
HAKKGHCHQ

SEQ ID NO: 1090911 - protein, 9 aa, Homo Sapiens
YTGEISTTH

SEQ ID NO: 1090912 - protein, 9 aa, Homo Sapiens
CCNCPPGLS

SEQ ID NO: 1090913 - protein, 9 aa, Homo Sapiens
VGVPWAAGF

SEQ ID NO: 1090914 - protein, 9 aa, Homo Sapiens
GFITLGRLA

SEQ ID NO: 1090915 - protein, 9 aa, Homo Sapiens
LEKKASSEG

SEQ ID NO: 1090916 - protein, 9 aa, Homo Sapiens
ALRAKLLLP

SEQ ID NO: 1090917 - protein, 9 aa, Homo Sapiens
AMSAVNVEN

SEQ ID NO: 1090918 - protein, 9 aa, Homo Sapiens
RTIPTEKPT

SEQ ID NO: 1090919 - protein, 9 aa, Homo Sapiens
PWAAGFLLP

SEQ ID NO: 1090920 - protein, 9 aa, Homo Sapiens
SSTPVFFMS

SEQ ID NO: 1090921 - protein, 9 aa, Homo Sapiens
DASIVEQNW

SEQ ID NO: 1090922 - protein, 9 aa, Homo Sapiens
LTEAKTRLS

SEQ ID NO: 1090923 - protein, 9 aa, Homo Sapiens
ELVFALRAK

SEQ ID NO: 1090924 - protein, 9 aa, Homo Sapiens
SENTALSCC

SEQ ID NO: 1090925 - protein, 9 aa, Homo Sapiens
MASTANSFV

SEQ ID NO: 1090926 - protein, 9 aa, Homo Sapiens
DKLLWHDNK

SEQ ID NO: 1090927 - protein, 9 aa, Homo Sapiens
KPPCSKYSS

SEQ ID NO: 1090928 - protein, 9 aa, Homo Sapiens
AGLPCQDHE

SEQ ID NO: 1090929 - protein, 9 aa, Homo Sapiens
RSQTLSYIR

SEQ ID NO: 1090930 - protein, 9 aa, Homo Sapiens
PQMVKYIEL

SEQ ID NO: 1090931 - protein, 9 aa, Homo Sapiens
PHPCPLQEV

SEQ ID NO: 1090932 - protein, 9 aa, Homo Sapiens
SSDGGVLVS

SEQ ID NO: 1090933 - protein, 9 aa, Homo Sapiens
GAGSSSGGS

SEQ ID NO: 1090934 - protein, 9 aa, Homo Sapiens
PTEKRTIPT

SEQ ID NO: 1090935 - protein, 9 aa, Homo Sapiens
QKFELTTPQ

SEQ ID NO: 1090936 - protein, 9 aa, Homo Sapiens
AILSVAAED

SEQ ID NO: 1090937 - protein, 9 aa, Homo Sapiens
QGCVQVTFS

SEQ ID NO: 1090938 - protein, 9 aa, Homo Sapiens
EQNKSTEHY

SEQ ID NO: 1090939 - protein, 9 aa, Homo Sapiens
REGRPMYQH

SEQ ID NO: 1090940 - protein, 9 aa, Homo Sapiens
YCDKEYTSR

SEQ ID NO: 1090941 - protein, 9 aa, Homo Sapiens
TPLPFSTVR

SEQ ID NO: 1090942 - protein, 9 aa, Homo Sapiens
WSWAAMRSA

SEQ ID NO: 1090943 - protein, 9 aa, Homo Sapiens
HILLWTFVQ

SEQ ID NO: 1090944 - protein, 9 aa, Homo Sapiens
FALRAKLLL

SEQ ID NO: 1090945 - protein, 9 aa, Homo Sapiens
DLEPAFCLM

SEQ ID NO: 1090946 - protein, 9 aa, Homo Sapiens
SAVSTAASM

SEQ ID NO: 1090947 - protein, 9 aa, Homo Sapiens
PRPSRSSPS

SEQ ID NO: 1090948 - protein, 9 aa, Homo Sapiens
QQAAAHQRY

SEQ ID NO: 1090949 - protein, 9 aa, Homo Sapiens
KQAWTADIF

SEQ ID NO: 1090950 - protein, 9 aa, Homo Sapiens
QITQETFDA

SEQ ID NO: 1090951 - protein, 9 aa, Homo Sapiens
SNSRHPPGR

SEQ ID NO: 1090952 - protein, 9 aa, Homo Sapiens
SPYAGTGFP

SEQ ID NO: 1090953 - protein, 9 aa, Homo Sapiens
CESTTTMST

SEQ ID NO: 1090954 - protein, 9 aa, Homo Sapiens
ALSCCDPQG

SEQ ID NO: 1090955 - protein, 9 aa, Homo Sapiens
PSRTILRRK

SEQ ID NO: 1090956 - protein, 9 aa, Homo Sapiens
ASTANSFVG

SEQ ID NO: 1090957 - protein, 9 aa, Homo Sapiens
ASSESTAFG

SEQ ID NO: 1090958 - protein, 9 aa, Homo Sapiens
KRYVGYFAQ

SEQ ID NO: 1090959 - protein, 9 aa, Homo Sapiens
WSFIRPVSF

SEQ ID NO: 1090960 - protein, 9 aa, Homo Sapiens
KDAQQDHNL

SEQ ID NO: 1090961 - protein, 9 aa, Homo Sapiens
EVSTLMKDT

SEQ ID NO: 1090962 - protein, 9 aa, Homo Sapiens
EFSRLRFQE

SEQ ID NO: 1090963 - protein, 9 aa, Homo Sapiens
WGEPFYRNG

SEQ ID NO: 1090964 - protein, 9 aa, Homo Sapiens
LLYDELASG

SEQ ID NO: 1090965 - protein, 9 aa, Homo Sapiens
DNRPKGKHA

SEQ ID NO: 1090966 - protein, 9 aa, Homo Sapiens
EAKEISVAD

SEQ ID NO: 1090967 - protein, 9 aa, Homo Sapiens
LEGPSGLVP

SEQ ID NO: 1090968 - protein, 9 aa, Homo Sapiens
SKGVVTVPY

SEQ ID NO: 1090969 - protein, 9 aa, Homo Sapiens
HLLRQGSKF

SEQ ID NO: 1090970 - protein, 9 aa, Homo Sapiens
SSKKFDNRP

SEQ ID NO: 1090971 - protein, 9 aa, Homo Sapiens
LRFQEFVYQ

SEQ ID NO: 1090972 - protein, 9 aa, Homo Sapiens
QLSLFLLKL

SEQ ID NO: 1090973 - protein, 9 aa, Homo Sapiens
FQEFVYQEA

SEQ ID NO: 1090974 - protein, 9 aa, Homo Sapiens
NNHLPHPLY

SEQ ID NO: 1090975 - protein, 9 aa, Homo Sapiens
LSSKKIAVL

SEQ ID NO: 1090976 - protein, 9 aa, Homo Sapiens
QSLMVQCRD

SEQ ID NO: 1090977 - protein, 9 aa, Homo Sapiens
QPHRQLPGQ

SEQ ID NO: 1090978 - protein, 9 aa, Homo Sapiens
LVAQTGSYP

SEQ ID NO: 1090979 - protein, 9 aa, Homo Sapiens
LYPFSLLFP

SEQ ID NO: 1090980 - protein, 9 aa, Homo Sapiens
QLRAQISDN

SEQ ID NO: 1090981 - protein, 9 aa, Homo Sapiens
DSNSSGERE

SEQ ID NO: 1090982 - protein, 9 aa, Homo Sapiens
IRRTPDGTE

SEQ ID NO: 1090983 - protein, 9 aa, Homo Sapiens
GLGAQLEVG

SEQ ID NO: 1090984 - protein, 9 aa, Homo Sapiens
AELSIIAVG

SEQ ID NO: 1090985 - protein, 9 aa, Homo Sapiens
YTDLVEAVK

SEQ ID NO: 1090986 - protein, 9 aa, Homo Sapiens
IQTVQRRKT

SEQ ID NO: 1090987 - protein, 9 aa, Homo Sapiens
YGGSGPPWN

SEQ ID NO: 1090988 - protein, 9 aa, Homo Sapiens
AQTGSYPAG

SEQ ID NO: 1090989 - protein, 9 aa, Homo Sapiens
GTEPKKGDA

SEQ ID NO: 1090990 - protein, 9 aa, Homo Sapiens
VWETFDPDA

SEQ ID NO: 1090991 - protein, 9 aa, Homo Sapiens
ERQSAQQPH

SEQ ID NO: 1090992 - protein, 9 aa, Homo Sapiens
MNVEIMWLA

SEQ ID NO: 1090993 - protein, 9 aa, Homo Sapiens
PLIQTVQRR

SEQ ID NO: 1090994 - protein, 9 aa, Homo Sapiens
GLVFLSLVL

SEQ ID NO: 1090995 - protein, 9 aa, Homo Sapiens
RLARIRVAN

SEQ ID NO: 1090996 - protein, 9 aa, Homo Sapiens
LQAACTPCS

SEQ ID NO: 1090997 - protein, 9 aa, Homo Sapiens
PASFVPMPG

SEQ ID NO: 1090998 - protein, 9 aa, Homo Sapiens
SSGEREIQR

SEQ ID NO: 1090999 - protein, 9 aa, Homo Sapiens
GEPFYRNGQ

SEQ ID NO: 1091000 - protein, 9 aa, Homo Sapiens
SIMGSDPNV

SEQ ID NO: 1091001 - protein, 9 aa, Homo Sapiens
HPGGGVSDA

SEQ ID NO: 1091002 - protein, 9 aa, Homo Sapiens
SLTPRAQVP

SEQ ID NO: 1091003 - protein, 9 aa, Homo Sapiens
TCEEPVASV

SEQ ID NO: 1091004 - protein, 9 aa, Homo Sapiens
RAQVPDILK

SEQ ID NO: 1091005 - protein, 9 aa, Homo Sapiens
LIQTVQRRK

SEQ ID NO: 1091006 - protein, 9 aa, Homo Sapiens
PFSLLFPYS

SEQ ID NO: 1091007 - protein, 9 aa, Homo Sapiens
SKLLSVGTH

SEQ ID NO: 1091008 - protein, 9 aa, Homo Sapiens
MVQCRDLEN

SEQ ID NO: 1091009 - protein, 9 aa, Homo Sapiens
PCSSPENSH

SEQ ID NO: 1091010 - protein, 9 aa, Homo Sapiens
NGDVELSGL

SEQ ID NO: 1091011 - protein, 9 aa, Homo Sapiens
SHWGVTVTT

SEQ ID NO: 1091012 - protein, 9 aa, Homo Sapiens
QGQQNEAST

SEQ ID NO: 1091013 - protein, 9 aa, Homo Sapiens
KILLEFVVD

SEQ ID NO: 1091014 - protein, 9 aa, Homo Sapiens
SKKRMNVEI

SEQ ID NO: 1091015 - protein, 9 aa, Homo Sapiens
VCANMVGTF

SEQ ID NO: 1091016 - protein, 9 aa, Homo Sapiens
SKHLLRQGS

SEQ ID NO: 1091017 - protein, 9 aa, Homo Sapiens
SNEFNSQNL

SEQ ID NO: 1091018 - protein, 9 aa, Homo Sapiens
LIQDFSPVI

SEQ ID NO: 1091019 - protein, 9 aa, Homo Sapiens
GHQLPNRWL

SEQ ID NO: 1091020 - protein, 9 aa, Homo Sapiens
HSHSCCQSL

SEQ ID NO: 1091021 - protein, 9 aa, Homo Sapiens
GEKGDHGPP

SEQ ID NO: 1091022 - protein, 9 aa, Homo Sapiens
RQILKECKE

SEQ ID NO: 1091023 - protein, 9 aa, Homo Sapiens
YPLELYEWV

SEQ ID NO: 1091024 - protein, 9 aa, Homo Sapiens
GPAAAVFLV

SEQ ID NO: 1091025 - protein, 9 aa, Homo Sapiens
RDTVSLYKR

SEQ ID NO: 1091026 - protein, 9 aa, Homo Sapiens
DACNRRKCH

SEQ ID NO: 1091027 - protein, 9 aa, Homo Sapiens
EKKHPGGGV

SEQ ID NO: 1091028 - protein, 9 aa, Homo Sapiens
WLNGDVELS

SEQ ID NO: 1091029 - protein, 9 aa, Homo Sapiens
PNIHLETCE

SEQ ID NO: 1091030 - protein, 9 aa, Homo Sapiens
KHLLRQGSK

SEQ ID NO: 1091031 - protein, 9 aa, Homo Sapiens
IAVLTKDDG

SEQ ID NO: 1091032 - protein, 9 aa, Homo Sapiens
FTVWQVQQH

SEQ ID NO: 1091033 - protein, 9 aa, Homo Sapiens
IEATLERIK

SEQ ID NO: 1091034 - protein, 9 aa, Homo Sapiens
DAQLKALSS

SEQ ID NO: 1091035 - protein, 9 aa, Homo Sapiens
TSQDMGNTQ

SEQ ID NO: 1091036 - protein, 9 aa, Homo Sapiens
LRGLYPALW

SEQ ID NO: 1091037 - protein, 9 aa, Homo Sapiens
GEPGNPGPI

SEQ ID NO: 1091038 - protein, 9 aa, Homo Sapiens
LRPVAPAMS

SEQ ID NO: 1091039 - protein, 9 aa, Homo Sapiens
VWPNESLSG

SEQ ID NO: 1091040 - protein, 9 aa, Homo Sapiens
TIDIKNFDG

SEQ ID NO: 1091041 - protein, 9 aa, Homo Sapiens
TTQPSQSPS

SEQ ID NO: 1091042 - protein, 9 aa, Homo Sapiens
GKDGEKGDH

SEQ ID NO: 1091043 - protein, 9 aa, Homo Sapiens
TTCCQVGKT

SEQ ID NO: 1091044 - protein, 9 aa, Homo Sapiens
TVQRRKTPP

SEQ ID NO: 1091045 - protein, 9 aa, Homo Sapiens
STSQCPPCK

SEQ ID NO: 1091046 - protein, 9 aa, Homo Sapiens
PAKILLEFV

SEQ ID NO: 1091047 - protein, 9 aa, Homo Sapiens
EEMLDTEDQ

SEQ ID NO: 1091048 - protein, 9 aa, Homo Sapiens
LTLRRNCWK

SEQ ID NO: 1091049 - protein, 9 aa, Homo Sapiens
PNVRAGAVD

SEQ ID NO: 1091050 - protein, 9 aa, Homo Sapiens
SERTTTSPR

SEQ ID NO: 1091051 - protein, 9 aa, Homo Sapiens
LSGLGAQLE

SEQ ID NO: 1091052 - protein, 9 aa, Homo Sapiens
GGRTPWRCK

SEQ ID NO: 1091053 - protein, 9 aa, Homo Sapiens
RCSALFQIL

SEQ ID NO: 1091054 - protein, 9 aa, Homo Sapiens
QDHNLDIEK

SEQ ID NO: 1091055 - protein, 9 aa, Homo Sapiens
ETCEEPVAS

SEQ ID NO: 1091056 - protein, 9 aa, Homo Sapiens
LYDELASGA

SEQ ID NO: 1091057 - protein, 9 aa, Homo Sapiens
QEFVYQEAA

SEQ ID NO: 1091058 - protein, 9 aa, Homo Sapiens
IPKDAASIT

SEQ ID NO: 1091059 - protein, 9 aa, Homo Sapiens
WGPHFKRLG

SEQ ID NO: 1091060 - protein, 9 aa, Homo Sapiens
EEKKKILLN

SEQ ID NO: 1091061 - protein, 9 aa, Homo Sapiens
SLRVFLVAQ

SEQ ID NO: 1091062 - protein, 9 aa, Homo Sapiens
HFLHHNVVT

SEQ ID NO: 1091063 - protein, 9 aa, Homo Sapiens
IDIKNFDGK

SEQ ID NO: 1091064 - protein, 9 aa, Homo Sapiens
EKDGLRGLY

SEQ ID NO: 1091065 - protein, 9 aa, Homo Sapiens
GRRPAAGRR

SEQ ID NO: 1091066 - protein, 9 aa, Homo Sapiens
YFNAAALDY

SEQ ID NO: 1091067 - protein, 9 aa, Homo Sapiens
PHPLYPSLL

SEQ ID NO: 1091068 - protein, 9 aa, Homo Sapiens
KILLNLSCQ

SEQ ID NO: 1091069 - protein, 9 aa, Homo Sapiens
KMLPSFIRR

SEQ ID NO: 1091070 - protein, 9 aa, Homo Sapiens
HHNVVTPTG

SEQ ID NO: 1091071 - protein, 9 aa, Homo Sapiens
KERPVPAKG

SEQ ID NO: 1091072 - protein, 9 aa, Homo Sapiens
SHFLHHNVV

SEQ ID NO: 1091073 - protein, 9 aa, Homo Sapiens
TQDQYVSIM

SEQ ID NO: 1091074 - protein, 9 aa, Homo Sapiens
CPTRNTTQV

SEQ ID NO: 1091075 - protein, 9 aa, Homo Sapiens
HEFLCDLIH

SEQ ID NO: 1091076 - protein, 9 aa, Homo Sapiens
YMIWLDRMM

SEQ ID NO: 1091077 - protein, 9 aa, Homo Sapiens
QLGSSSWPG

SEQ ID NO: 1091078 - protein, 9 aa, Homo Sapiens
WSPSLDWRR

SEQ ID NO: 1091079 - protein, 9 aa, Homo Sapiens
DSARKELRW

SEQ ID NO: 1091080 - protein, 9 aa, Homo Sapiens
GVDLHHAND

SEQ ID NO: 1091081 - protein, 9 aa, Homo Sapiens
KGVYPKYWI

SEQ ID NO: 1091082 - protein, 9 aa, Homo Sapiens
LRAQISDNT

SEQ ID NO: 1091083 - protein, 9 aa, Homo Sapiens
LEKDGLRGL

SEQ ID NO: 1091084 - protein, 9 aa, Homo Sapiens
ATSQDMGNT

SEQ ID NO: 1091085 - protein, 9 aa, Homo Sapiens
VGSGSHFLH

SEQ ID NO: 1091086 - protein, 9 aa, Homo Sapiens
KVCRNYFSK

SEQ ID NO: 1091087 - protein, 9 aa, Homo Sapiens
AQVPDILKV

SEQ ID NO: 1091088 - protein, 9 aa, Homo Sapiens
NPGPIGTLG

SEQ ID NO: 1091089 - protein, 9 aa, Homo Sapiens
RLHSHSCCQ

SEQ ID NO: 1091090 - protein, 9 aa, Homo Sapiens
TVTTQPSQS

SEQ ID NO: 1091091 - protein, 9 aa, Homo Sapiens
HWGVTVTTQ

SEQ ID NO: 1091092 - protein, 9 aa, Homo Sapiens
IMGSDPNVR

SEQ ID NO: 1091093 - protein, 9 aa, Homo Sapiens
TLATSSPRP

SEQ ID NO: 1091094 - protein, 9 aa, Homo Sapiens
YLEAVLSVS

SEQ ID NO: 1091095 - protein, 9 aa, Homo Sapiens
YQHGANHHF

SEQ ID NO: 1091096 - protein, 9 aa, Homo Sapiens
FKLIYLDLT

SEQ ID NO: 1091097 - protein, 9 aa, Homo Sapiens
ILDLYYTTT

SEQ ID NO: 1091098 - protein, 9 aa, Homo Sapiens
NSQNLVNDD

SEQ ID NO: 1091099 - protein, 9 aa, Homo Sapiens
PGGGVSDAS

SEQ ID NO: 1091100 - protein, 9 aa, Homo Sapiens
YIIGAHVGE

SEQ ID NO: 1091101 - protein, 9 aa, Homo Sapiens
SSSKASQDQ

SEQ ID NO: 1091102 - protein, 9 aa, Homo Sapiens
IWTPNTRLH

SEQ ID NO: 1091103 - protein, 9 aa, Homo Sapiens
ISNEFNSQN

SEQ ID NO: 1091104 - protein, 9 aa, Homo Sapiens
LYKRTLEQR

SEQ ID NO: 1091105 - protein, 9 aa, Homo Sapiens
VWQVQQHQG

SEQ ID NO: 1091106 - protein, 9 aa, Homo Sapiens
KKWPRLGDL

SEQ ID NO: 1091107 - protein, 9 aa, Homo Sapiens
TQVGSGSHF

SEQ ID NO: 1091108 - protein, 9 aa, Homo Sapiens
LDWRRPPSP

SEQ ID NO: 1091109 - protein, 9 aa, Homo Sapiens
DLIHAHQLS

SEQ ID NO: 1091110 - protein, 9 aa, Homo Sapiens
QNVVSASLG

SEQ ID NO: 1091111 - protein, 9 aa, Homo Sapiens
EVTSRLKVG

SEQ ID NO: 1091112 - protein, 9 aa, Homo Sapiens
RGLYPALWK

SEQ ID NO: 1091113 - protein, 9 aa, Homo Sapiens
GNPGPIGTL

SEQ ID NO: 1091114 - protein, 9 aa, Homo Sapiens
AAVLHMRSK

SEQ ID NO: 1091115 - protein, 9 aa, Homo Sapiens
KALRGGAGA

SEQ ID NO: 1091116 - protein, 9 aa, Homo Sapiens
CTKAQYLAA

SEQ ID NO: 1091117 - protein, 9 aa, Homo Sapiens
LVGAQGTFG

SEQ ID NO: 1091118 - protein, 9 aa, Homo Sapiens
LEEMLDTED

SEQ ID NO: 1091119 - protein, 9 aa, Homo Sapiens
YDIVEPEEL

SEQ ID NO: 1091120 - protein, 9 aa, Homo Sapiens
KLLSVGTHY

SEQ ID NO: 1091121 - protein, 9 aa, Homo Sapiens
TKFYTDLVE

SEQ ID NO: 1091122 - protein, 9 aa, Homo Sapiens
LYHILYQHG

SEQ ID NO: 1091123 - protein, 9 aa, Homo Sapiens
VTSWGRAVG

SEQ ID NO: 1091124 - protein, 9 aa, Homo Sapiens
GPSGLVPEP

SEQ ID NO: 1091125 - protein, 9 aa, Homo Sapiens
CTPCSSPEN

SEQ ID NO: 1091126 - protein, 9 aa, Homo Sapiens
TTFLIECAQ

SEQ ID NO: 1091127 - protein, 9 aa, Homo Sapiens
AQLKALSSC

SEQ ID NO: 1091128 - protein, 9 aa, Homo Sapiens
IENVQSLMV

SEQ ID NO: 1091129 - protein, 9 aa, Homo Sapiens
AYLEAVLSV

SEQ ID NO: 1091130 - protein, 9 aa, Homo Sapiens
DSRTSALCF

SEQ ID NO: 1091131 - protein, 9 aa, Homo Sapiens
MRSKEARKK

SEQ ID NO: 1091132 - protein, 9 aa, Homo Sapiens
LGIPSSTGR

SEQ ID NO: 1091133 - protein, 9 aa, Homo Sapiens
QKLTSTPRE

SEQ ID NO: 1091134 - protein, 9 aa, Homo Sapiens
PRARGAGGG

SEQ ID NO: 1091135 - protein, 9 aa, Homo Sapiens
YEVWETFDP

SEQ ID NO: 1091136 - protein, 9 aa, Homo Sapiens
AHSQHCYAG

SEQ ID NO: 1091137 - protein, 9 aa, Homo Sapiens
WSSKTLNSW

SEQ ID NO: 1091138 - protein, 9 aa, Homo Sapiens
VSNDACNRR

SEQ ID NO: 1091139 - protein, 9 aa, Homo Sapiens
IGAHVGETS

SEQ ID NO: 1091140 - protein, 9 aa, Homo Sapiens
KEREHREKE

SEQ ID NO: 1091141 - protein, 9 aa, Homo Sapiens
AELPAKILL

SEQ ID NO: 1091142 - protein, 9 aa, Homo Sapiens
SQPHHLWGE

SEQ ID NO: 1091143 - protein, 9 aa, Homo Sapiens
HNLDIEKIT

SEQ ID NO: 1091144 - protein, 9 aa, Homo Sapiens
VEPEELAEN

SEQ ID NO: 1091145 - protein, 9 aa, Homo Sapiens
LTPERDAYL

SEQ ID NO: 1091146 - protein, 9 aa, Homo Sapiens
KHEANDYWR

SEQ ID NO: 1091147 - protein, 9 aa, Homo Sapiens
GERKSGAFR

SEQ ID NO: 1091148 - protein, 9 aa, Homo Sapiens
MRWADAVQN

SEQ ID NO: 1091149 - protein, 9 aa, Homo Sapiens
VGGLASENM

SEQ ID NO: 1091150 - protein, 9 aa, Homo Sapiens
EKVTQLLGP

SEQ ID NO: 1091151 - protein, 9 aa, Homo Sapiens
YAKRDLAAV

SEQ ID NO: 1091152 - protein, 9 aa, Homo Sapiens
WQVQQHQGN

SEQ ID NO: 1091153 - protein, 9 aa, Homo Sapiens
LLWNVRLVS

SEQ ID NO: 1091154 - protein, 9 aa, Homo Sapiens
CSALFQILF

SEQ ID NO: 1091155 - protein, 9 aa, Homo Sapiens
SQRGRLFTL

SEQ ID NO: 1091156 - protein, 9 aa, Homo Sapiens
WRRPPSPRI

SEQ ID NO: 1091157 - protein, 9 aa, Homo Sapiens
WTPNTRLHS

SEQ ID NO: 1091158 - protein, 9 aa, Homo Sapiens
YLECTKAQY

SEQ ID NO: 1091159 - protein, 9 aa, Homo Sapiens
AACTPCSSP

SEQ ID NO: 1091160 - protein, 9 aa, Homo Sapiens
FLAVDSQLG

SEQ ID NO: 1091161 - protein, 9 aa, Homo Sapiens
WPRLGDLGG

SEQ ID NO: 1091162 - protein, 9 aa, Homo Sapiens
EVCARVAMN

SEQ ID NO: 1091163 - protein, 9 aa, Homo Sapiens
TDSRTSALC

SEQ ID NO: 1091164 - protein, 9 aa, Homo Sapiens
DQTDSRTSA

SEQ ID NO: 1091165 - protein, 9 aa, Homo Sapiens
SDWGPHFKR

SEQ ID NO: 1091166 - protein, 9 aa, Homo Sapiens
DNTTHPISY

SEQ ID NO: 1091167 - protein, 9 aa, Homo Sapiens
ISIEVYQIA

SEQ ID NO: 1091168 - protein, 9 aa, Homo Sapiens
AILLYDELA

SEQ ID NO: 1091169 - protein, 9 aa, Homo Sapiens
NLSILDLYY

SEQ ID NO: 1091170 - protein, 9 aa, Homo Sapiens
CKECKKNLQ

SEQ ID NO: 1091171 - protein, 9 aa, Homo Sapiens
PLVRSPPVW

SEQ ID NO: 1091172 - protein, 9 aa, Homo Sapiens
LVKGVYPKY

SEQ ID NO: 1091173 - protein, 9 aa, Homo Sapiens
ERKSGAFRL

SEQ ID NO: 1091174 - protein, 9 aa, Homo Sapiens
TNDGPALTK

SEQ ID NO: 1091175 - protein, 9 aa, Homo Sapiens
RKSGAFRLV

SEQ ID NO: 1091176 - protein, 9 aa, Homo Sapiens
AEQHENEMF

SEQ ID NO: 1091177 - protein, 9 aa, Homo Sapiens
KECKKNLQA

SEQ ID NO: 1091178 - protein, 9 aa, Homo Sapiens
EHRGHQLPN

SEQ ID NO: 1091179 - protein, 9 aa, Homo Sapiens
HLCFLYPFS

SEQ ID NO: 1091180 - protein, 9 aa, Homo Sapiens
SSKKWPRLG

SEQ ID NO: 1091181 - protein, 9 aa, Homo Sapiens
AHQLSLFLL

SEQ ID NO: 1091182 - protein, 9 aa, Homo Sapiens
GWSSSKKWP

SEQ ID NO: 1091183 - protein, 9 aa, Homo Sapiens
HAVRGQRHQ

SEQ ID NO: 1091184 - protein, 9 aa, Homo Sapiens
SKEARKKAF

SEQ ID NO: 1091185 - protein, 9 aa, Homo Sapiens
YVTRRRRIE

SEQ ID NO: 1091186 - protein, 9 aa, Homo Sapiens
TNLSILDLY

SEQ ID NO: 1091187 - protein, 9 aa, Homo Sapiens
EPFYRNGQY

SEQ ID NO: 1091188 - protein, 9 aa, Homo Sapiens
KAVLGIPSS

SEQ ID NO: 1091189 - protein, 9 aa, Homo Sapiens
TLERIKRED

SEQ ID NO: 1091190 - protein, 9 aa, Homo Sapiens
DLVEAVKDI

SEQ ID NO: 1091191 - protein, 9 aa, Homo Sapiens
RKAGISVGS

SEQ ID NO: 1091192 - protein, 9 aa, Homo Sapiens
QRGRLFTLF

SEQ ID NO: 1091193 - protein, 9 aa, Homo Sapiens
PAHKDGFTQ

SEQ ID NO: 1091194 - protein, 9 aa, Homo Sapiens
RYDSNSSGE

SEQ ID NO: 1091195 - protein, 9 aa, Homo Sapiens
RGRLFTLFL

SEQ ID NO: 1091196 - protein, 9 aa, Homo Sapiens
PGRRPAAGR

SEQ ID NO: 1091197 - protein, 9 aa, Homo Sapiens
LETCEEPVA

SEQ ID NO: 1091198 - protein, 9 aa, Homo Sapiens
LAEQHENEM

SEQ ID NO: 1091199 - protein, 9 aa, Homo Sapiens
WWGEPFYRN

SEQ ID NO: 1091200 - protein, 9 aa, Homo Sapiens
GVSVLLNFS

SEQ ID NO: 1091201 - protein, 9 aa, Homo Sapiens
VDSARKELR

SEQ ID NO: 1091202 - protein, 9 aa, Homo Sapiens
KNGERKSGA

SEQ ID NO: 1091203 - protein, 9 aa, Homo Sapiens
CEEPVASVQ

SEQ ID NO: 1091204 - protein, 9 aa, Homo Sapiens
WPGIQGQQN

SEQ ID NO: 1091205 - protein, 9 aa, Homo Sapiens
NMRWADAVQ

SEQ ID NO: 1091206 - protein, 9 aa, Homo Sapiens
ISSVEEIPK

SEQ ID NO: 1091207 - protein, 9 aa, Homo Sapiens
EEEGIPFTA

SEQ ID NO: 1091208 - protein, 9 aa, Homo Sapiens
AKRDLAAVP

SEQ ID NO: 1091209 - protein, 9 aa, Homo Sapiens
TTSVSNDAC

SEQ ID NO: 1091210 - protein, 9 aa, Homo Sapiens
WVRMGPSSS

SEQ ID NO: 1091211 - protein, 9 aa, Homo Sapiens
SKASQDQKL

SEQ ID NO: 1091212 - protein, 9 aa, Homo Sapiens
VSIMGSDPN

SEQ ID NO: 1091213 - protein, 9 aa, Homo Sapiens
GPALTKADV

SEQ ID NO: 1091214 - protein, 9 aa, Homo Sapiens
CLAYFNAAA

SEQ ID NO: 1091215 - protein, 9 aa, Homo Sapiens
KLIFTHEHR

SEQ ID NO: 1091216 - protein, 9 aa, Homo Sapiens
QNLVNDDDA

SEQ ID NO: 1091217 - protein, 9 aa, Homo Sapiens
EVKSLIQDF

SEQ ID NO: 1091218 - protein, 9 aa, Homo Sapiens
FIRRTPDGT

SEQ ID NO: 1091219 - protein, 9 aa, Homo Sapiens
LFDYPTLSQ

SEQ ID NO: 1091220 - protein, 9 aa, Homo Sapiens
AINTVTYEW

SEQ ID NO: 1091221 - protein, 9 aa, Homo Sapiens
IQNVVSASL

SEQ ID NO: 1091222 - protein, 9 aa, Homo Sapiens
DWRRPPSPR

SEQ ID NO: 1091223 - protein, 9 aa, Homo Sapiens
SIMIAEDGG

SEQ ID NO: 1091224 - protein, 9 aa, Homo Sapiens
TFDPDATQF

SEQ ID NO: 1091225 - protein, 9 aa, Homo Sapiens
LMKDTVLMR

SEQ ID NO: 1091226 - protein, 9 aa, Homo Sapiens
LRVFLVAQT

SEQ ID NO: 1091227 - protein, 9 aa, Homo Sapiens
NYPLELYEW

SEQ ID NO: 1091228 - protein, 9 aa, Homo Sapiens
ISDNTTHPI

SEQ ID NO: 1091229 - protein, 9 aa, Homo Sapiens
VDPEEKKKI

SEQ ID NO: 1091230 - protein, 9 aa, Homo Sapiens
AETLATSSP

SEQ ID NO: 1091231 - protein, 9 aa, Homo Sapiens
VLGIPSSTG

SEQ ID NO: 1091232 - protein, 9 aa, Homo Sapiens
QWMLYMIWL

SEQ ID NO: 1091233 - protein, 9 aa, Homo Sapiens
SNAELSIIA

SEQ ID NO: 1091234 - protein, 9 aa, Homo Sapiens
GGQLPANLS

SEQ ID NO: 1091235 - protein, 9 aa, Homo Sapiens
VRVLWPLRA

SEQ ID NO: 1091236 - protein, 9 aa, Homo Sapiens
NDGPALTKA

SEQ ID NO: 1091237 - protein, 9 aa, Homo Sapiens
VGETSWVTL

SEQ ID NO: 1091238 - protein, 9 aa, Homo Sapiens
QLEGPSGLV

SEQ ID NO: 1091239 - protein, 9 aa, Homo Sapiens
ANTGSSNAY

SEQ ID NO: 1091240 - protein, 9 aa, Homo Sapiens
KKIAVLTKD

SEQ ID NO: 1091241 - protein, 9 aa, Homo Sapiens
HLPHPLYPS

SEQ ID NO: 1091242 - protein, 9 aa, Homo Sapiens
NIHLETCEE

SEQ ID NO: 1091243 - protein, 9 aa, Homo Sapiens
ELWSRRKAG

SEQ ID NO: 1091244 - protein, 9 aa, Homo Sapiens
SKKIAVLTK

SEQ ID NO: 1091245 - protein, 9 aa, Homo Sapiens
ELYEWVRMG

SEQ ID NO: 1091246 - protein, 9 aa, Homo Sapiens
THEHRGHQL

SEQ ID NO: 1091247 - protein, 9 aa, Homo Sapiens
AVLGIPSST

SEQ ID NO: 1091248 - protein, 9 aa, Homo Sapiens
LDLTSNNLT

SEQ ID NO: 1091249 - protein, 9 aa, Homo Sapiens
ESDLVGAQG

SEQ ID NO: 1091250 - protein, 9 aa, Homo Sapiens
VTDRCSALF

SEQ ID NO: 1091251 - protein, 9 aa, Homo Sapiens
ESKGVVTVP

SEQ ID NO: 1091252 - protein, 9 aa, Homo Sapiens
GGQGPYQAT

SEQ ID NO: 1091253 - protein, 9 aa, Homo Sapiens
PKDAASITM

SEQ ID NO: 1091254 - protein, 9 aa, Homo Sapiens
SVADLQENY

SEQ ID NO: 1091255 - protein, 9 aa, Homo Sapiens
QQGLVFLSL

SEQ ID NO: 1091256 - protein, 9 aa, Homo Sapiens
AALAGFLFT

SEQ ID NO: 1091257 - protein, 9 aa, Homo Sapiens
LIECAQDLD

SEQ ID NO: 1091258 - protein, 9 aa, Homo Sapiens
LRGGAGAAV

SEQ ID NO: 1091259 - protein, 9 aa, Homo Sapiens
KGVVTVPYS

SEQ ID NO: 1091260 - protein, 9 aa, Homo Sapiens
GVTVTTQPS

SEQ ID NO: 1091261 - protein, 9 aa, Homo Sapiens
SVEEIPKDA

SEQ ID NO: 1091262 - protein, 9 aa, Homo Sapiens
AQLEVGCLG

SEQ ID NO: 1091263 - protein, 9 aa, Homo Sapiens
NNWDVCANM

SEQ ID NO: 1091264 - protein, 9 aa, Homo Sapiens
WDVCANMVG

SEQ ID NO: 1091265 - protein, 9 aa, Homo Sapiens
VADLQENYI

SEQ ID NO: 1091266 - protein, 9 aa, Homo Sapiens
LGKELAEQH

SEQ ID NO: 1091267 - protein, 9 aa, Homo Sapiens
TPCSSPENS

SEQ ID NO: 1091268 - protein, 9 aa, Homo Sapiens
VKVCRNYFS

SEQ ID NO: 1091269 - protein, 9 aa, Homo Sapiens
SQCPPCKPV

SEQ ID NO: 1091270 - protein, 9 aa, Homo Sapiens
SFLLLWNVR

SEQ ID NO: 1091271 - protein, 9 aa, Homo Sapiens
ASTSQCPPC

SEQ ID NO: 1091272 - protein, 9 aa, Homo Sapiens
YEKVTQLLG

SEQ ID NO: 1091273 - protein, 9 aa, Homo Sapiens
QHEFLCDLI

SEQ ID NO: 1091274 - protein, 9 aa, Homo Sapiens
SPPVWPNES

SEQ ID NO: 1091275 - protein, 9 aa, Homo Sapiens
KDTVLMRQP

SEQ ID NO: 1091276 - protein, 9 aa, Homo Sapiens
NLSSLFVKC

SEQ ID NO: 1091277 - protein, 9 aa, Homo Sapiens
CCQVGKTLR

SEQ ID NO: 1091278 - protein, 9 aa, Homo Sapiens
DPNVRAGAV

SEQ ID NO: 1091279 - protein, 9 aa, Homo Sapiens
GLDAPLFGV

SEQ ID NO: 1091280 - protein, 9 aa, Homo Sapiens
EAAAAAETL

SEQ ID NO: 1091281 - protein, 9 aa, Homo Sapiens
QEEEGIPFT

SEQ ID NO: 1091282 - protein, 9 aa, Homo Sapiens
SRTSALCFY

SEQ ID NO: 1091283 - protein, 9 aa, Homo Sapiens
AAHSQHCYA

SEQ ID NO: 1091284 - protein, 9 aa, Homo Sapiens
PVLIRCPTR

SEQ ID NO: 1091285 - protein, 9 aa, Homo Sapiens
LQLEGPSGL

SEQ ID NO: 1091286 - protein, 9 aa, Homo Sapiens
HSCCQSLFD

SEQ ID NO: 1091287 - protein, 9 aa, Homo Sapiens
SGAFRLVFQ

SEQ ID NO: 1091288 - protein, 9 aa, Homo Sapiens
NKIIRLILY

SEQ ID NO: 1091289 - protein, 9 aa, Homo Sapiens
VFLVAQTGS

SEQ ID NO: 1091290 - protein, 9 aa, Homo Sapiens
VRSPPVWPN

SEQ ID NO: 1091291 - protein, 9 aa, Homo Sapiens
LLSVGTHYF

SEQ ID NO: 1091292 - protein, 9 aa, Homo Sapiens
ASQDQKLTS

SEQ ID NO: 1091293 - protein, 9 aa, Homo Sapiens
EIPKDAASI

SEQ ID NO: 1091294 - protein, 9 aa, Homo Sapiens
GAHVGETSW

SEQ ID NO: 1091295 - protein, 9 aa, Homo Sapiens
HEANDYWRQ

SEQ ID NO: 1091296 - protein, 9 aa, Homo Sapiens
STMTVSRWN

SEQ ID NO: 1091297 - protein, 9 aa, Homo Sapiens
TFLIECAQD

SEQ ID NO: 1091298 - protein, 9 aa, Homo Sapiens
KGEMVKVCR

SEQ ID NO: 1091299 - protein, 9 aa, Homo Sapiens
SSKKIAVLT

SEQ ID NO: 1091300 - protein, 9 aa, Homo Sapiens
LNLSCQSCT

SEQ ID NO: 1091301 - protein, 9 aa, Homo Sapiens
HELVAECGG

SEQ ID NO: 1091302 - protein, 9 aa, Homo Sapiens
MIWLDRMME

SEQ ID NO: 1091303 - protein, 9 aa, Homo Sapiens
PHYDIVEPE

SEQ ID NO: 1091304 - protein, 9 aa, Homo Sapiens
CSFIQNVVS

SEQ ID NO: 1091305 - protein, 9 aa, Homo Sapiens
LYQHGANHH

SEQ ID NO: 1091306 - protein, 9 aa, Homo Sapiens
YYLECTKAQ

SEQ ID NO: 1091307 - protein, 9 aa, Homo Sapiens
QTDSRTSAL

SEQ ID NO: 1091308 - protein, 9 aa, Homo Sapiens
TDRCSALFQ

SEQ ID NO: 1091309 - protein, 9 aa, Homo Sapiens
ELFQFWYGG

SEQ ID NO: 1091310 - protein, 9 aa, Homo Sapiens
RTPWRCKER

SEQ ID NO: 1091311 - protein, 9 aa, Homo Sapiens
IPFTAIREA

SEQ ID NO: 1091312 - protein, 9 aa, Homo Sapiens
SIEVYQIAD

SEQ ID NO: 1091313 - protein, 9 aa, Homo Sapiens
AVRGQRHQR

SEQ ID NO: 1091314 - protein, 9 aa, Homo Sapiens
VFQQGLVFL

SEQ ID NO: 1091315 - protein, 9 aa, Homo Sapiens
AAVFLVNMV

SEQ ID NO: 1091316 - protein, 9 aa, Homo Sapiens
VLHMRSKEA

SEQ ID NO: 1091317 - protein, 9 aa, Homo Sapiens
RLQEEEGIP

SEQ ID NO: 1091318 - protein, 9 aa, Homo Sapiens
LIHAHQLSL

SEQ ID NO: 1091319 - protein, 9 aa, Homo Sapiens
RLKCYHSQT

SEQ ID NO: 1091320 - protein, 9 aa, Homo Sapiens
RPLIQTVQR

SEQ ID NO: 1091321 - protein, 9 aa, Homo Sapiens
REHREKERQ

SEQ ID NO: 1091322 - protein, 9 aa, Homo Sapiens
QIIEATLER

SEQ ID NO: 1091323 - protein, 9 aa, Homo Sapiens
LRNTIDIKN

SEQ ID NO: 1091324 - protein, 9 aa, Homo Sapiens
NHHFLAVDS

SEQ ID NO: 1091325 - protein, 9 aa, Homo Sapiens
AMNDKICKQ

SEQ ID NO: 1091326 - protein, 9 aa, Homo Sapiens
SYEKVTQLL

SEQ ID NO: 1091327 - protein, 9 aa, Homo Sapiens
GIQGQQNEA

SEQ ID NO: 1091328 - protein, 9 aa, Homo Sapiens
FFIFYYLEC

SEQ ID NO: 1091329 - protein, 9 aa, Homo Sapiens
LERIKREDF

SEQ ID NO: 1091330 - protein, 9 aa, Homo Sapiens
AVIEGAAPG

SEQ ID NO: 1091331 - protein, 9 aa, Homo Sapiens
KKNLQAACT

SEQ ID NO: 1091332 - protein, 9 aa, Homo Sapiens
YFIWSFIRP

SEQ ID NO: 1091333 - protein, 9 aa, Homo Sapiens
SKQHRLKCY

SEQ ID NO: 1091334 - protein, 9 aa, Homo Sapiens
AFTVWQVQQ

SEQ ID NO: 1091335 - protein, 9 aa, Homo Sapiens
GPYQATSQD

SEQ ID NO: 1091336 - protein, 9 aa, Homo Sapiens
ARKELRWRD

SEQ ID NO: 1091337 - protein, 9 aa, Homo Sapiens
NDYWRQLQS

SEQ ID NO: 1091338 - protein, 9 aa, Homo Sapiens
KEAVIEGAA

SEQ ID NO: 1091339 - protein, 9 aa, Homo Sapiens
GVPASFVPM

SEQ ID NO: 1091340 - protein, 9 aa, Homo Sapiens
GTGPGRKRG

SEQ ID NO: 1091341 - protein, 9 aa, Homo Sapiens
AAAAETLAT

SEQ ID NO: 1091342 - protein, 9 aa, Homo Sapiens
SGSHFLHHN

SEQ ID NO: 1091343 - protein, 9 aa, Homo Sapiens
WGEDQTDSR

SEQ ID NO: 1091344 - protein, 9 aa, Homo Sapiens
DGEKGDHGP

SEQ ID NO: 1091345 - protein, 9 aa, Homo Sapiens
QRRKTPPFP

SEQ ID NO: 1091346 - protein, 9 aa, Homo Sapiens
ELVKGVYPK

SEQ ID NO: 1091347 - protein, 9 aa, Homo Sapiens
KNFDGKSLL

SEQ ID NO: 1091348 - protein, 9 aa, Homo Sapiens
AQISDNTTH

SEQ ID NO: 1091349 - protein, 9 aa, Homo Sapiens
RMNVEIMWL

SEQ ID NO: 1091350 - protein, 9 aa, Homo Sapiens
HLETCEEPV

SEQ ID NO: 1091351 - protein, 9 aa, Homo Sapiens
TLRRNCWKE

SEQ ID NO: 1091352 - protein, 9 aa, Homo Sapiens
SSKASQDQK

SEQ ID NO: 1091353 - protein, 9 aa, Homo Sapiens
WSHLCFLYP

SEQ ID NO: 1091354 - protein, 9 aa, Homo Sapiens
TRNTTQVGS

SEQ ID NO: 1091355 - protein, 9 aa, Homo Sapiens
ILYIIGAHV

SEQ ID NO: 1091356 - protein, 9 aa, Homo Sapiens
DHGPPGPAG

SEQ ID NO: 1091357 - protein, 9 aa, Homo Sapiens
EANDYWRQL

SEQ ID NO: 1091358 - protein, 9 aa, Homo Sapiens
LKCYHSQTY

SEQ ID NO: 1091359 - protein, 9 aa, Homo Sapiens
VVTPTGVWQ

SEQ ID NO: 1091360 - protein, 9 aa, Homo Sapiens
CSSPENSHW

SEQ ID NO: 1091361 - protein, 9 aa, Homo Sapiens
AKQIIEATL

SEQ ID NO: 1091362 - protein, 9 aa, Homo Sapiens
GSNVSFSCD

SEQ ID NO: 1091363 - protein, 9 aa, Homo Sapiens
SVDSARKEL

SEQ ID NO: 1091364 - protein, 9 aa, Homo Sapiens
RCPTRNTTQ

SEQ ID NO: 1091365 - protein, 9 aa, Homo Sapiens
GRWSPSLDW

SEQ ID NO: 1091366 - protein, 9 aa, Homo Sapiens
DQKLTSTPR

SEQ ID NO: 1091367 - protein, 9 aa, Homo Sapiens
QPHHLWGED

SEQ ID NO: 1091368 - protein, 9 aa, Homo Sapiens
CWNEHPRAR

SEQ ID NO: 1091369 - protein, 9 aa, Homo Sapiens
QLPNRWLNG

SEQ ID NO: 1091370 - protein, 9 aa, Homo Sapiens
SLMVQCRDL

SEQ ID NO: 1091371 - protein, 9 aa, Homo Sapiens
HRGHQLPNR

SEQ ID NO: 1091372 - protein, 9 aa, Homo Sapiens
KKILLNLSC

SEQ ID NO: 1091373 - protein, 9 aa, Homo Sapiens
HQLPNRWLN

SEQ ID NO: 1091374 - protein, 9 aa, Homo Sapiens
NRWLNGDVE

SEQ ID NO: 1091375 - protein, 9 aa, Homo Sapiens
NVVSASLGS

SEQ ID NO: 1091376 - protein, 9 aa, Homo Sapiens
HHANDSEGI

SEQ ID NO: 1091377 - protein, 9 aa, Homo Sapiens
DGLRGLYPA

SEQ ID NO: 1091378 - protein, 9 aa, Homo Sapiens
SSSWPGIQG

SEQ ID NO: 1091379 - protein, 9 aa, Homo Sapiens
LPHPLYPSL

SEQ ID NO: 1091380 - protein, 9 aa, Homo Sapiens
EATLERIKR

SEQ ID NO: 1091381 - protein, 9 aa, Homo Sapiens
ILKECKEKD

SEQ ID NO: 1091382 - protein, 9 aa, Homo Sapiens
AAETLATSS

SEQ ID NO: 1091383 - protein, 9 aa, Homo Sapiens
RTTTSPRRL

SEQ ID NO: 1091384 - protein, 9 aa, Homo Sapiens
EVYQIADVL

SEQ ID NO: 1091385 - protein, 9 aa, Homo Sapiens
VAQTGSYPA

SEQ ID NO: 1091386 - protein, 9 aa, Homo Sapiens
QNEASTSQC

SEQ ID NO: 1091387 - protein, 9 aa, Homo Sapiens
DWVCLAYFN

SEQ ID NO: 1091388 - protein, 9 aa, Homo Sapiens
VYQIADVLI

SEQ ID NO: 1091389 - protein, 9 aa, Homo Sapiens
FIFYYLECT

SEQ ID NO: 1091390 - protein, 9 aa, Homo Sapiens
KDGLRGLYP

SEQ ID NO: 1091391 - protein, 9 aa, Homo Sapiens
DKICKQINI

SEQ ID NO: 1091392 - protein, 9 aa, Homo Sapiens
CWRQILKEC

SEQ ID NO: 1091393 - protein, 9 aa, Homo Sapiens
NVSFSCDGE

SEQ ID NO: 1091394 - protein, 9 aa, Homo Sapiens
HLIKGVSVL

SEQ ID NO: 1091395 - protein, 9 aa, Homo Sapiens
VPASFVPMP

SEQ ID NO: 1091396 - protein, 9 aa, Homo Sapiens
FWYGGSGPP

SEQ ID NO: 1091397 - protein, 9 aa, Homo Sapiens
IIAVGPDFS

SEQ ID NO: 1091398 - protein, 9 aa, Homo Sapiens
VTRRRRIEI

SEQ ID NO: 1091399 - protein, 9 aa, Homo Sapiens
ALAGFLFTV

SEQ ID NO: 1091400 - protein, 9 aa, Homo Sapiens
NSEGEVTSR

SEQ ID NO: 1091401 - protein, 9 aa, Homo Sapiens
EEAAAAAET

SEQ ID NO: 1091402 - protein, 9 aa, Homo Sapiens
SIIAVGPDF

SEQ ID NO: 1091403 - protein, 9 aa, Homo Sapiens
WGRAVGCVS

SEQ ID NO: 1091404 - protein, 9 aa, Homo Sapiens
AECICQAIE

SEQ ID NO: 1091405 - protein, 9 aa, Homo Sapiens
LVLKAVLGI

SEQ ID NO: 1091406 - protein, 9 aa, Homo Sapiens
YQATSQDMG

SEQ ID NO: 1091407 - protein, 9 aa, Homo Sapiens
EQHENEMFD

SEQ ID NO: 1091408 - protein, 9 aa, Homo Sapiens
SLLFPYSSI

SEQ ID NO: 1091409 - protein, 9 aa, Homo Sapiens
LTKADVGFA

SEQ ID NO: 1091410 - protein, 9 aa, Homo Sapiens
LAVDSQLGS

SEQ ID NO: 1091411 - protein, 9 aa, Homo Sapiens
VSDASPEAG

SEQ ID NO: 1091412 - protein, 9 aa, Homo Sapiens
GKELAEQHE

SEQ ID NO: 1091413 - protein, 9 aa, Homo Sapiens
GEVTSRLKV

SEQ ID NO: 1091414 - protein, 9 aa, Homo Sapiens
IQGQQNEAS

SEQ ID NO: 1091415 - protein, 9 aa, Homo Sapiens
RFQEFVYQE

SEQ ID NO: 1091416 - protein, 9 aa, Homo Sapiens
GAQGTFGSS

SEQ ID NO: 1091417 - protein, 9 aa, Homo Sapiens
ASELFQFWY

SEQ ID NO: 1091418 - protein, 9 aa, Homo Sapiens
ECICQAIEA

SEQ ID NO: 1091419 - protein, 9 aa, Homo Sapiens
VPYSDIGLL

SEQ ID NO: 1091420 - protein, 9 aa, Homo Sapiens
QGCWRQILK

SEQ ID NO: 1091421 - protein, 9 aa, Homo Sapiens
DLYYTTTTV

SEQ ID NO: 1091422 - protein, 9 aa, Homo Sapiens
ILTNPVAAI

SEQ ID NO: 1091423 - protein, 9 aa, Homo Sapiens
WRQILKECK

SEQ ID NO: 1091424 - protein, 9 aa, Homo Sapiens
LPGQQPQQP

SEQ ID NO: 1091425 - protein, 9 aa, Homo Sapiens
QDFSPVIQD

SEQ ID NO: 1091426 - protein, 9 aa, Homo Sapiens
PWWGEPFYR

SEQ ID NO: 1091427 - protein, 9 aa, Homo Sapiens
DHNLDIEKI

SEQ ID NO: 1091428 - protein, 9 aa, Homo Sapiens
TLAAFTVWQ

SEQ ID NO: 1091429 - protein, 9 aa, Homo Sapiens
KQIIEATLE

SEQ ID NO: 1091430 - protein, 9 aa, Homo Sapiens
RKRGRKHRE

SEQ ID NO: 1091431 - protein, 9 aa, Homo Sapiens
GVSSKKFDN

SEQ ID NO: 1091432 - protein, 9 aa, Homo Sapiens
AAVQRERQS

SEQ ID NO: 1091433 - protein, 9 aa, Homo Sapiens
SLYKRTLEQ

SEQ ID NO: 1091434 - protein, 9 aa, Homo Sapiens
FLYPFSLLF

SEQ ID NO: 1091435 - protein, 9 aa, Homo Sapiens
SCWSHLCFL

SEQ ID NO: 1091436 - protein, 9 aa, Homo Sapiens
CARVAMNRQ

SEQ ID NO: 1091437 - protein, 9 aa, Homo Sapiens
TPERDAYLE

SEQ ID NO: 1091438 - protein, 9 aa, Homo Sapiens
ENVQSLMVQ

SEQ ID NO: 1091439 - protein, 9 aa, Homo Sapiens
MTVSRWNPI

SEQ ID NO: 1091440 - protein, 9 aa, Homo Sapiens
PHFKRLGEL

SEQ ID NO: 1091441 - protein, 9 aa, Homo Sapiens
RERQSAQQP

SEQ ID NO: 1091442 - protein, 9 aa, Homo Sapiens
DIVEPEELA

SEQ ID NO: 1091443 - protein, 9 aa, Homo Sapiens
NEASTSQCP

SEQ ID NO: 1091444 - protein, 9 aa, Homo Sapiens
RRPAAGRRA

SEQ ID NO: 1091445 - protein, 9 aa, Homo Sapiens
ICKQININN

SEQ ID NO: 1091446 - protein, 9 aa, Homo Sapiens
TKADVGFAM

SEQ ID NO: 1091447 - protein, 9 aa, Homo Sapiens
GSQSKHLLR

SEQ ID NO: 1091448 - protein, 9 aa, Homo Sapiens
YEWVRMGPS

SEQ ID NO: 1091449 - protein, 9 aa, Homo Sapiens
QSKHLLRQG

SEQ ID NO: 1091450 - protein, 9 aa, Homo Sapiens
SQLGSSSWP

SEQ ID NO: 1091451 - protein, 9 aa, Homo Sapiens
CDKDAQQDH

SEQ ID NO: 1091452 - protein, 9 aa, Homo Sapiens
VKMLPSFIR

SEQ ID NO: 1091453 - protein, 9 aa, Homo Sapiens
VFLVNMVIG

SEQ ID NO: 1091454 - protein, 9 aa, Homo Sapiens
SQLNQAVAN

SEQ ID NO: 1091455 - protein, 9 aa, Homo Sapiens
GRKHREKKE

SEQ ID NO: 1091456 - protein, 9 aa, Homo Sapiens
ARIRVANTG

SEQ ID NO: 1091457 - protein, 9 aa, Homo Sapiens
TTCGITDFL

SEQ ID NO: 1091458 - protein, 9 aa, Homo Sapiens
LARIRVANT

SEQ ID NO: 1091459 - protein, 9 aa, Homo Sapiens
VLWPLRAIN

SEQ ID NO: 1091460 - protein, 9 aa, Homo Sapiens
HHLWGEDQT

SEQ ID NO: 1091461 - protein, 9 aa, Homo Sapiens
IYLDLTSNN

SEQ ID NO: 1091462 - protein, 9 aa, Homo Sapiens
CGITDFLST

SEQ ID NO: 1091463 - protein, 9 aa, Homo Sapiens
IRKPMLAAL

SEQ ID NO: 1091464 - protein, 9 aa, Homo Sapiens
RAQISDNTT

SEQ ID NO: 1091465 - protein, 9 aa, Homo Sapiens
NTENRALHE

SEQ ID NO: 1091466 - protein, 9 aa, Homo Sapiens
NIQSKKRMN

SEQ ID NO: 1091467 - protein, 9 aa, Homo Sapiens
SRLRFQEFV

SEQ ID NO: 1091468 - protein, 9 aa, Homo Sapiens
FIWSFIRPV

SEQ ID NO: 1091469 - protein, 9 aa, Homo Sapiens
KNLQAACTP

SEQ ID NO: 1091470 - protein, 9 aa, Homo Sapiens
RNTTQVGSG

SEQ ID NO: 1091471 - protein, 9 aa, Homo Sapiens
RGHQLPNRW

SEQ ID NO: 1091472 - protein, 9 aa, Homo Sapiens
VPMPGSLKR

SEQ ID NO: 1091473 - protein, 9 aa, Homo Sapiens
ACTPCSSPE

SEQ ID NO: 1091474 - protein, 9 aa, Homo Sapiens
ELRWRDPEL

SEQ ID NO: 1091475 - protein, 9 aa, Homo Sapiens
RGQRHQRRA

SEQ ID NO: 1091476 - protein, 9 aa, Homo Sapiens
LIVYAKRDL

SEQ ID NO: 1091477 - protein, 9 aa, Homo Sapiens
ETFDPDATQ

SEQ ID NO: 1091478 - protein, 9 aa, Homo Sapiens
ISFLLLWNV

SEQ ID NO: 1091479 - protein, 9 aa, Homo Sapiens
FLLLWNVRL

SEQ ID NO: 1091480 - protein, 9 aa, Homo Sapiens
MRFLHITGN

SEQ ID NO: 1091481 - protein, 9 aa, Homo Sapiens
VSLYKRTLE

SEQ ID NO: 1091482 - protein, 9 aa, Homo Sapiens
ALSSCWSHL

SEQ ID NO: 1091483 - protein, 9 aa, Homo Sapiens
IQSKKRMNV

SEQ ID NO: 1091484 - protein, 9 aa, Homo Sapiens
SDLEEMLDT

SEQ ID NO: 1091485 - protein, 9 aa, Homo Sapiens
AHAVRGQRH

SEQ ID NO: 1091486 - protein, 9 aa, Homo Sapiens
LEAVLSVSN

SEQ ID NO: 1091487 - protein, 9 aa, Homo Sapiens
IQDFSPVIQ

SEQ ID NO: 1091488 - protein, 9 aa, Homo Sapiens
EPGNPGPIG

SEQ ID NO: 1091489 - protein, 9 aa, Homo Sapiens
LVFQQGLVF

SEQ ID NO: 1091490 - protein, 9 aa, Homo Sapiens
SCCQSLFDY

SEQ ID NO: 1091491 - protein, 9 aa, Homo Sapiens
PVWPNESLS

SEQ ID NO: 1091492 - protein, 9 aa, Homo Sapiens
ERTTTSPRR

SEQ ID NO: 1091493 - protein, 9 aa, Homo Sapiens
SLFLLKLIF

SEQ ID NO: 1091494 - protein, 9 aa, Homo Sapiens
VISNEFNSQ

SEQ ID NO: 1091495 - protein, 9 aa, Homo Sapiens
CPTTCGITD

SEQ ID NO: 1091496 - protein, 9 aa, Homo Sapiens
LPIHAGHYT

SEQ ID NO: 1091497 - protein, 9 aa, Homo Sapiens
AHAHAVRGQ

SEQ ID NO: 1091498 - protein, 9 aa, Homo Sapiens
RNSEGEVTS

SEQ ID NO: 1091499 - protein, 9 aa, Homo Sapiens
ASGADASAT

SEQ ID NO: 1091500 - protein, 9 aa, Homo Sapiens
KRTLEQRAK

SEQ ID NO: 1091501 - protein, 9 aa, Homo Sapiens
ASENMRWAD

SEQ ID NO: 1091502 - protein, 9 aa, Homo Sapiens
AEREEPLDA

SEQ ID NO: 1091503 - protein, 9 aa, Homo Sapiens
GQQPQQPGR

SEQ ID NO: 1091504 - protein, 9 aa, Homo Sapiens
QSLFVTSWG

SEQ ID NO: 1091505 - protein, 9 aa, Homo Sapiens
CQSLFDYPT

SEQ ID NO: 1091506 - protein, 9 aa, Homo Sapiens
SCDGETRVP

SEQ ID NO: 1091507 - protein, 9 aa, Homo Sapiens
RIQGCWRQI

SEQ ID NO: 1091508 - protein, 9 aa, Homo Sapiens
LMVQCRDLE

SEQ ID NO: 1091509 - protein, 9 aa, Homo Sapiens
WNVRLVSCL

SEQ ID NO: 1091510 - protein, 9 aa, Homo Sapiens
GGSSSGGSS

SEQ ID NO: 1091511 - protein, 9 aa, Homo Sapiens
VELSGLGAQ

SEQ ID NO: 1091512 - protein, 9 aa, Homo Sapiens
LFQFWYGGS

SEQ ID NO: 1091513 - protein, 9 aa, Homo Sapiens
KELAEQHEN

SEQ ID NO: 1091514 - protein, 9 aa, Homo Sapiens
QLLGPIREF

SEQ ID NO: 1091515 - protein, 9 aa, Homo Sapiens
FDYPTLSQP

SEQ ID NO: 1091516 - protein, 9 aa, Homo Sapiens
SELFQFWYG

SEQ ID NO: 1091517 - protein, 9 aa, Homo Sapiens
KAGISVGSR

SEQ ID NO: 1091518 - protein, 9 aa, Homo Sapiens
SEAFHLIKG

SEQ ID NO: 1091519 - protein, 9 aa, Homo Sapiens
REKERQVSE

SEQ ID NO: 1091520 - protein, 9 aa, Homo Sapiens
EKGDHGPPG

SEQ ID NO: 1091521 - protein, 9 aa, Homo Sapiens
HRQLPGQQP

SEQ ID NO: 1091522 - protein, 9 aa, Homo Sapiens
HILYQHGAN

SEQ ID NO: 1091523 - protein, 9 aa, Homo Sapiens
PHHLWGEDQ

SEQ ID NO: 1091524 - protein, 9 aa, Homo Sapiens
HLWGEDQTD

SEQ ID NO: 1091525 - protein, 9 aa, Homo Sapiens
KFDNRPKGK

SEQ ID NO: 1091526 - protein, 9 aa, Homo Sapiens
SGFWIWSSK

SEQ ID NO: 1091527 - protein, 9 aa, Homo Sapiens
LLNLSCQSC

SEQ ID NO: 1091528 - protein, 9 aa, Homo Sapiens
KRDLAAVPA

SEQ ID NO: 1091529 - protein, 9 aa, Homo Sapiens
RELWSRRKA

SEQ ID NO: 1091530 - protein, 9 aa, Homo Sapiens
AQQPHRQLP

SEQ ID NO: 1091531 - protein, 9 aa, Homo Sapiens
PYSDIGLLY

SEQ ID NO: 1091532 - protein, 9 aa, Homo Sapiens
MNDKICKQI

SEQ ID NO: 1091533 - protein, 9 aa, Homo Sapiens
VDSQLGSSS

SEQ ID NO: 1091534 - protein, 9 aa, Homo Sapiens
QSLFDYPTL

SEQ ID NO: 1091535 - protein, 9 aa, Homo Sapiens
KKGDAEGPG

SEQ ID NO: 1091536 - protein, 9 aa, Homo Sapiens
FQFWYGGSG

SEQ ID NO: 1091537 - protein, 9 aa, Homo Sapiens
GELVKGVYP

SEQ ID NO: 1091538 - protein, 9 aa, Homo Sapiens
RQSAQQPHR

SEQ ID NO: 1091539 - protein, 9 aa, Homo Sapiens
NDACNRRKC

SEQ ID NO: 1091540 - protein, 9 aa, Homo Sapiens
RSPPVWPNE

SEQ ID NO: 1091541 - protein, 9 aa, Homo Sapiens
GSGSHFLHH

SEQ ID NO: 1091542 - protein, 9 aa, Homo Sapiens
SHLCFLYPF

SEQ ID NO: 1091543 - protein, 9 aa, Homo Sapiens
QLNQAVANK

SEQ ID NO: 1091544 - protein, 9 aa, Homo Sapiens
SFIQNVVSA

SEQ ID NO: 1091545 - protein, 9 aa, Homo Sapiens
QCPPCKPVL

SEQ ID NO: 1091546 - protein, 9 aa, Homo Sapiens
IPSSTGRHK

SEQ ID NO: 1091547 - protein, 9 aa, Homo Sapiens
EPSIYATPA

SEQ ID NO: 1091548 - protein, 9 aa, Homo Sapiens
SFVPMPGSL

SEQ ID NO: 1091549 - protein, 9 aa, Homo Sapiens
IKNFDGKSL

SEQ ID NO: 1091550 - protein, 9 aa, Homo Sapiens
RIRVANTGS

SEQ ID NO: 1091551 - protein, 9 aa, Homo Sapiens
FDNRPKGKH

SEQ ID NO: 1091552 - protein, 9 aa, Homo Sapiens
LKLIFTHEH

SEQ ID NO: 1091553 - protein, 9 aa, Homo Sapiens
ISRSDLEEM

SEQ ID NO: 1091554 - protein, 9 aa, Homo Sapiens
NLQAACTPC

SEQ ID NO: 1091555 - protein, 9 aa, Homo Sapiens
YRRPLRPVA

SEQ ID NO: 1091556 - protein, 9 aa, Homo Sapiens
TSQCPPCKP

SEQ ID NO: 1091557 - protein, 9 aa, Homo Sapiens
SGEREIQRT

SEQ ID NO: 1091558 - protein, 9 aa, Homo Sapiens
LVEAVKDIP

SEQ ID NO: 1091559 - protein, 9 aa, Homo Sapiens
EFHFNRYVT

SEQ ID NO: 1091560 - protein, 9 aa, Homo Sapiens
FIQNVVSAS

SEQ ID NO: 1091561 - protein, 9 aa, Homo Sapiens
HVGETSWVT

SEQ ID NO: 1091562 - protein, 9 aa, Homo Sapiens
TGGGQLPAN

SEQ ID NO: 1091563 - protein, 9 aa, Homo Sapiens
LHHNVVTPT

SEQ ID NO: 1091564 - protein, 9 aa, Homo Sapiens
QGPYQATSQ

SEQ ID NO: 1091565 - protein, 9 aa, Homo Sapiens
GDHGPPGPA

SEQ ID NO: 1091566 - protein, 9 aa, Homo Sapiens
ELSGLGAQL

SEQ ID NO: 1091567 - protein, 9 aa, Homo Sapiens
FMRFLHITG

SEQ ID NO: 1091568 - protein, 9 aa, Homo Sapiens
LQEEEGIPF

SEQ ID NO: 1091569 - protein, 9 aa, Homo Sapiens
YVSIMIAED

SEQ ID NO: 1091570 - protein, 9 aa, Homo Sapiens
HAHAVRGQR

SEQ ID NO: 1091571 - protein, 9 aa, Homo Sapiens
YSSIWTPNT

SEQ ID NO: 1091572 - protein, 9 aa, Homo Sapiens
HMRSKEARK

SEQ ID NO: 1091573 - protein, 9 aa, Homo Sapiens
YCPTTCGIT

SEQ ID NO: 1091574 - protein, 9 aa, Homo Sapiens
FIRPVSFVI

SEQ ID NO: 1091575 - protein, 9 aa, Homo Sapiens
GPHFKRLGE

SEQ ID NO: 1091576 - protein, 9 aa, Homo Sapiens
DRCWNEHPR

SEQ ID NO: 1091577 - protein, 9 aa, Homo Sapiens
PMPGSLKRG

SEQ ID NO: 1091578 - protein, 9 aa, Homo Sapiens
DYLSDWGPH

SEQ ID NO: 1091579 - protein, 9 aa, Homo Sapiens
QVPDILKVL

SEQ ID NO: 1091580 - protein, 9 aa, Homo Sapiens
PGTTFLIEC

SEQ ID NO: 1091581 - protein, 9 aa, Homo Sapiens
QDQSQRGRL

SEQ ID NO: 1091582 - protein, 9 aa, Homo Sapiens
LPANLSSLF

SEQ ID NO: 1091583 - protein, 9 aa, Homo Sapiens
NYFIWSFIR

SEQ ID NO: 1091584 - protein, 9 aa, Homo Sapiens
LGAQLEVGC

SEQ ID NO: 1091585 - protein, 9 aa, Homo Sapiens
ALRGGAGAA

SEQ ID NO: 1091586 - protein, 9 aa, Homo Sapiens
LTPRAQVPD

SEQ ID NO: 1091587 - protein, 9 aa, Homo Sapiens
KKFDNRPKG

SEQ ID NO: 1091588 - protein, 9 aa, Homo Sapiens
SQSKHLLRQ

SEQ ID NO: 1091589 - protein, 9 aa, Homo Sapiens
LIYLDLTSN

SEQ ID NO: 1091590 - protein, 9 aa, Homo Sapiens
HGANHHFLA

SEQ ID NO: 1091591 - protein, 9 aa, Homo Sapiens
PNVTTCCQV

SEQ ID NO: 1091592 - protein, 9 aa, Homo Sapiens
HREKERQVS

SEQ ID NO: 1091593 - protein, 9 aa, Homo Sapiens
TPNTRLHSH

SEQ ID NO: 1091594 - protein, 9 aa, Homo Sapiens
DGETRVPLW

SEQ ID NO: 1091595 - protein, 9 aa, Homo Sapiens
WIWSSKTLN

SEQ ID NO: 1091596 - protein, 9 aa, Homo Sapiens
RYVTRRRRI

SEQ ID NO: 1091597 - protein, 9 aa, Homo Sapiens
SSCWSHLCF

SEQ ID NO: 1091598 - protein, 9 aa, Homo Sapiens
FSTVKEAVI

SEQ ID NO: 1091599 - protein, 9 aa, Homo Sapiens
IFYYLECTK

SEQ ID NO: 1091600 - protein, 9 aa, Homo Sapiens
LKNGERKSG

SEQ ID NO: 1091601 - protein, 9 aa, Homo Sapiens
YLDLTSNNL

SEQ ID NO: 1091602 - protein, 9 aa, Homo Sapiens
DLEEMLDTE

SEQ ID NO: 1091603 - protein, 9 aa, Homo Sapiens
LWGEDQTDS

SEQ ID NO: 1091604 - protein, 9 aa, Homo Sapiens
NGERKSGAF

SEQ ID NO: 1091605 - protein, 9 aa, Homo Sapiens
VLIRCPTRN

SEQ ID NO: 1091606 - protein, 9 aa, Homo Sapiens
CKKNLQAAC

SEQ ID NO: 1091607 - protein, 9 aa, Homo Sapiens
VLKAVLGIP

SEQ ID NO: 1091608 - protein, 9 aa, Homo Sapiens
DYPTLSQPH

SEQ ID NO: 1091609 - protein, 9 aa, Homo Sapiens
HYTCSARNS

SEQ ID NO: 1091610 - protein, 9 aa, Homo Sapiens
AKHEANDYW

SEQ ID NO: 1091611 - protein, 9 aa, Homo Sapiens
PSFIRRTPD

SEQ ID NO: 1091612 - protein, 9 aa, Homo Sapiens
MVKVCRNYF

SEQ ID NO: 1091613 - protein, 9 aa, Homo Sapiens
LLKNGERKS

SEQ ID NO: 1091614 - protein, 9 aa, Homo Sapiens
SKKWPRLGD

SEQ ID NO: 1091615 - protein, 9 aa, Homo Sapiens
GVYPKYWIY

SEQ ID NO: 1091616 - protein, 9 aa, Homo Sapiens
GLASENMRW

SEQ ID NO: 1091617 - protein, 9 aa, Homo Sapiens
WLDRMMEDA

SEQ ID NO: 1091618 - protein, 9 aa, Homo Sapiens
NVQSLMVQC

SEQ ID NO: 1091619 - protein, 9 aa, Homo Sapiens
IVYAKRDLA

SEQ ID NO: 1091620 - protein, 9 aa, Homo Sapiens
WSSSKKWPR

SEQ ID NO: 1091621 - protein, 9 aa, Homo Sapiens
PERDAYLEA

SEQ ID NO: 1091622 - protein, 9 aa, Homo Sapiens
EHPRARGAG

SEQ ID NO: 1091623 - protein, 9 aa, Homo Sapiens
LSSCWSHLC

SEQ ID NO: 1091624 - protein, 9 aa, Homo Sapiens
GFWIWSSKT

SEQ ID NO: 1091625 - protein, 9 aa, Homo Sapiens
PLLQLEGPS

SEQ ID NO: 1091626 - protein, 9 aa, Homo Sapiens
RVFLVAQTG

SEQ ID NO: 1091627 - protein, 9 aa, Homo Sapiens
TPTGVWQHE

SEQ ID NO: 1091628 - protein, 9 aa, Homo Sapiens
LSLFLLKLI

SEQ ID NO: 1091629 - protein, 9 aa, Homo Sapiens
TVSLYKRTL

SEQ ID NO: 1091630 - protein, 9 aa, Homo Sapiens
ELSTMTVSR

SEQ ID NO: 1091631 - protein, 9 aa, Homo Sapiens
TVRVLWPLR

SEQ ID NO: 1091632 - protein, 9 aa, Homo Sapiens
FNRYVTRRR

SEQ ID NO: 1091633 - protein, 9 aa, Homo Sapiens
SNTENRALH

SEQ ID NO: 1091634 - protein, 9 aa, Homo Sapiens
LIRCPTRNT

SEQ ID NO: 1091635 - protein, 9 aa, Homo Sapiens
RPVAPAMSI

SEQ ID NO: 1091636 - protein, 9 aa, Homo Sapiens
LIISQLNQA

SEQ ID NO: 1091637 - protein, 9 aa, Homo Sapiens
EEVCARVAM

SEQ ID NO: 1091638 - protein, 9 aa, Homo Sapiens
QQPQQPGRR

SEQ ID NO: 1091639 - protein, 9 aa, Homo Sapiens
TSPRRLLDY

SEQ ID NO: 1091640 - protein, 9 aa, Homo Sapiens
IFTHEHRGH

SEQ ID NO: 1091641 - protein, 9 aa, Homo Sapiens
IQGCWRQIL

SEQ ID NO: 1091642 - protein, 9 aa, Homo Sapiens
CCQSLFDYP

SEQ ID NO: 1091643 - protein, 9 aa, Homo Sapiens
QIQELIISQ

SEQ ID NO: 1091644 - protein, 9 aa, Homo Sapiens
LASGADASA

SEQ ID NO: 1091645 - protein, 9 aa, Homo Sapiens
LSIIAVGPD

SEQ ID NO: 1091646 - protein, 9 aa, Homo Sapiens
QPSQSPSPI

SEQ ID NO: 1091647 - protein, 9 aa, Homo Sapiens
RRAHAHAVR

SEQ ID NO: 1091648 - protein, 9 aa, Homo Sapiens
ECKECKKNL

SEQ ID NO: 1091649 - protein, 9 aa, Homo Sapiens
DLTSNNLTS

SEQ ID NO: 1091650 - protein, 9 aa, Homo Sapiens
DWGPHFKRL

SEQ ID NO: 1091651 - protein, 9 aa, Homo Sapiens
KVTQLLGPI

SEQ ID NO: 1091652 - protein, 9 aa, Homo Sapiens
RLRFQEFVY

SEQ ID NO: 1091653 - protein, 9 aa, Homo Sapiens
PANLSSLFV

SEQ ID NO: 1091654 - protein, 9 aa, Homo Sapiens
FNSQNLVND

SEQ ID NO: 1091655 - protein, 9 aa, Homo Sapiens
NLSCQSCTF

SEQ ID NO: 1091656 - protein, 9 aa, Homo Sapiens
TVPYSDIGL

SEQ ID NO: 1091657 - protein, 9 aa, Homo Sapiens
CFLYPFSLL

SEQ ID NO: 1091658 - protein, 9 aa, Homo Sapiens
DSQLGSSSW

SEQ ID NO: 1091659 - protein, 9 aa, Homo Sapiens
FYEVWETFD

SEQ ID NO: 1091660 - protein, 9 aa, Homo Sapiens
YQIADVLIR

SEQ ID NO: 1091661 - protein, 9 aa, Homo Sapiens
RPLRPVAPA

SEQ ID NO: 1091662 - protein, 9 aa, Homo Sapiens
KASQDQKLT

SEQ ID NO: 1091663 - protein, 9 aa, Homo Sapiens
PLRNTIDIK

SEQ ID NO: 1091664 - protein, 9 aa, Homo Sapiens
NWDVCANMV

SEQ ID NO: 1091665 - protein, 9 aa, Homo Sapiens
HPRARGAGG

SEQ ID NO: 1091666 - protein, 9 aa, Homo Sapiens
AVTDRCSAL

SEQ ID NO: 1091667 - protein, 9 aa, Homo Sapiens
VANTGSSNA

SEQ ID NO: 1091668 - protein, 9 aa, Homo Sapiens
GDAEGPGGK

SEQ ID NO: 1091669 - protein, 9 aa, Homo Sapiens
RDAYLEAVL

SEQ ID NO: 1091670 - protein, 9 aa, Homo Sapiens
EWVRMGPSS

SEQ ID NO: 1091671 - protein, 9 aa, Homo Sapiens
RVLWPLRAI

SEQ ID NO: 1091672 - protein, 9 aa, Homo Sapiens
DLHHANDSE

SEQ ID NO: 1091673 - protein, 9 aa, Homo Sapiens
PGNPGPIGT

SEQ ID NO: 1091674 - protein, 9 aa, Homo Sapiens
SQDQKLTST

SEQ ID NO: 1091675 - protein, 9 aa, Homo Sapiens
FSCDGETRV

SEQ ID NO: 1091676 - protein, 9 aa, Homo Sapiens
YPTLSQPHH

SEQ ID NO: 1091677 - protein, 9 aa, Homo Sapiens
GRKRGRKHR

SEQ ID NO: 1091678 - protein, 9 aa, Homo Sapiens
LRELWSRRK

SEQ ID NO: 1091679 - protein, 9 aa, Homo Sapiens
AHKDGFTQD

SEQ ID NO: 1091680 - protein, 9 aa, Homo Sapiens
RPVSFVIVV

SEQ ID NO: 1091681 - protein, 9 aa, Homo Sapiens
SPENSHWGV

SEQ ID NO: 1091682 - protein, 9 aa, Homo Sapiens
RPNVTTCCQ

SEQ ID NO: 1091683 - protein, 9 aa, Homo Sapiens
IHAHQLSLF

SEQ ID NO: 1091684 - protein, 9 aa, Homo Sapiens
IRLQEEEGI

SEQ ID NO: 1091685 - protein, 9 aa, Homo Sapiens
FYYLECTKA

SEQ ID NO: 1091686 - protein, 9 aa, Homo Sapiens
HPLYPSLLS

SEQ ID NO: 1091687 - protein, 9 aa, Homo Sapiens
KGNLGAECI

SEQ ID NO: 1091688 - protein, 9 aa, Homo Sapiens
RDLAAVPAS

SEQ ID NO: 1091689 - protein, 9 aa, Homo Sapiens
PYSSIWTPN

SEQ ID NO: 1091690 - protein, 9 aa, Homo Sapiens
LNGDVELSG

SEQ ID NO: 1091691 - protein, 9 aa, Homo Sapiens
VKGVYPKYW

SEQ ID NO: 1091692 - protein, 9 aa, Homo Sapiens
GRRAHAHAV

SEQ ID NO: 1091693 - protein, 9 aa, Homo Sapiens
LGPIREFLD

SEQ ID NO: 1091694 - protein, 9 aa, Homo Sapiens
FHFNRYVTR

SEQ ID NO: 1091695 - protein, 9 aa, Homo Sapiens
LTSNNLTSI

SEQ ID NO: 1091696 - protein, 9 aa, Homo Sapiens
KEFHFNRYV

SEQ ID NO: 1091697 - protein, 9 aa, Homo Sapiens
LYEWVRMGP

SEQ ID NO: 1091698 - protein, 9 aa, Homo Sapiens
LVPHYDIVE

SEQ ID NO: 1091699 - protein, 9 aa, Homo Sapiens
IRTVRVLWP

SEQ ID NO: 1091700 - protein, 9 aa, Homo Sapiens
TGPGRKRGR

SEQ ID NO: 1091701 - protein, 9 aa, Homo Sapiens
RRKTPPFPE

SEQ ID NO: 1091702 - protein, 9 aa, Homo Sapiens
QELIISQLN

SEQ ID NO: 1091703 - protein, 9 aa, Homo Sapiens
RKPMLAALA

SEQ ID NO: 1091704 - protein, 9 aa, Homo Sapiens
LAAHSQHCY

SEQ ID NO: 1091705 - protein, 9 aa, Homo Sapiens
TNPVAAINT

SEQ ID NO: 1091706 - protein, 9 aa, Homo Sapiens
GVWQHEFLC

SEQ ID NO: 1091707 - protein, 9 aa, Homo Sapiens
FFISIEVYQ

SEQ ID NO: 1091708 - protein, 9 aa, Homo Sapiens
MPGSLKRGL

SEQ ID NO: 1091709 - protein, 9 aa, Homo Sapiens
VSSKKFDNR

SEQ ID NO: 1091710 - protein, 9 aa, Homo Sapiens
PMLAALAGF

SEQ ID NO: 1091711 - protein, 9 aa, Homo Sapiens
PWRCKERPV

SEQ ID NO: 1091712 - protein, 9 aa, Homo Sapiens
MLAALAGFL

SEQ ID NO: 1091713 - protein, 9 aa, Homo Sapiens
AEEVCARVA

SEQ ID NO: 1091714 - protein, 9 aa, Homo Sapiens
IIEATLERI

SEQ ID NO: 1091715 - protein, 9 aa, Homo Sapiens
SHSCCQSLF

SEQ ID NO: 1091716 - protein, 9 aa, Homo Sapiens
MIAEDGGSP

SEQ ID NO: 1091717 - protein, 9 aa, Homo Sapiens
HAGHYTCSA

SEQ ID NO: 1091718 - protein, 9 aa, Homo Sapiens
HEAKEISVA

SEQ ID NO: 1091719 - protein, 9 aa, Homo Sapiens
VLAVTDRCS

SEQ ID NO: 1091720 - protein, 9 aa, Homo Sapiens
KLIYLDLTS

SEQ ID NO: 1091721 - protein, 9 aa, Homo Sapiens
RWLNGDVEL

SEQ ID NO: 1091722 - protein, 9 aa, Homo Sapiens
AAAVFLVNM

SEQ ID NO: 1091723 - protein, 9 aa, Homo Sapiens
FISIEVYQI

SEQ ID NO: 1091724 - protein, 9 aa, Homo Sapiens
PFYRNGQYV

SEQ ID NO: 1091725 - protein, 9 aa, Homo Sapiens
QQPGRRPAA

SEQ ID NO: 1091726 - protein, 9 aa, Homo Sapiens
PGSQSKHLL

SEQ ID NO: 1091727 - protein, 9 aa, Homo Sapiens
SLFVTSWGR

SEQ ID NO: 1091728 - protein, 9 aa, Homo Sapiens
SNDACNRRK

SEQ ID NO: 1091729 - protein, 9 aa, Homo Sapiens
LTNPVAAIN

SEQ ID NO: 1091730 - protein, 9 aa, Homo Sapiens
QSLYHILYQ

SEQ ID NO: 1091731 - protein, 9 aa, Homo Sapiens
SFIRPVSFV

SEQ ID NO: 1091732 - protein, 9 aa, Homo Sapiens
HFKRLGELY

SEQ ID NO: 1091733 - protein, 9 aa, Homo Sapiens
FYRNGQYVG

SEQ ID NO: 1091734 - protein, 9 aa, Homo Sapiens
EMVKVCRNY

SEQ ID NO: 1091735 - protein, 9 aa, Homo Sapiens
FVTSWGRAV

SEQ ID NO: 1091736 - protein, 9 aa, Homo Sapiens
NSSGEREIQ

SEQ ID NO: 1091737 - protein, 9 aa, Homo Sapiens
SSGGSSSGG

SEQ ID NO: 1091738 - protein, 9 aa, Homo Sapiens
EPKKGDAEG

SEQ ID NO: 1091739 - protein, 9 aa, Homo Sapiens
PTRNTTQVG

SEQ ID NO: 1091740 - protein, 9 aa, Homo Sapiens
LYIIGAHVG

SEQ ID NO: 1091741 - protein, 9 aa, Homo Sapiens
VVKMLPSFI

SEQ ID NO: 1091742 - protein, 9 aa, Homo Sapiens
SLIQDFSPV

SEQ ID NO: 1091743 - protein, 9 aa, Homo Sapiens
LYPALWKVS

SEQ ID NO: 1091744 - protein, 9 aa, Homo Sapiens
YLSDWGPHF

SEQ ID NO: 1091745 - protein, 9 aa, Homo Sapiens
SWGRAVGCV

SEQ ID NO: 1091746 - protein, 9 aa, Homo Sapiens
PGRKRGRKH

SEQ ID NO: 1091747 - protein, 9 aa, Homo Sapiens
NNKIIRLIL

SEQ ID NO: 1091748 - protein, 9 aa, Homo Sapiens
HENEMFDYE

SEQ ID NO: 1091749 - protein, 9 aa, Homo Sapiens
PCKPVLIRC

SEQ ID NO: 1091750 - protein, 9 aa, Homo Sapiens
SGLGAQLEV

SEQ ID NO: 1091751 - protein, 9 aa, Homo Sapiens
VCLAYFNAA

SEQ ID NO: 1091752 - protein, 9 aa, Homo Sapiens
GEDQTDSRT

SEQ ID NO: 1091753 - protein, 9 aa, Homo Sapiens
DAYLEAVLS

SEQ ID NO: 1091754 - protein, 9 aa, Homo Sapiens
VWQHEFLCD

SEQ ID NO: 1091755 - protein, 9 aa, Homo Sapiens
AHVGETSWV

SEQ ID NO: 1091756 - protein, 9 aa, Homo Sapiens
FWIWSSKTL

SEQ ID NO: 1091757 - protein, 9 aa, Homo Sapiens
LYMIWLDRM

SEQ ID NO: 1091758 - protein, 9 aa, Homo Sapiens
LNNWDVCAN

SEQ ID NO: 1091759 - protein, 9 aa, Homo Sapiens
GRTPWRCKE

SEQ ID NO: 1091760 - protein, 9 aa, Homo Sapiens
DFSPVIQDH

SEQ ID NO: 1091761 - protein, 9 aa, Homo Sapiens
AFRLVFQQG

SEQ ID NO: 1091762 - protein, 9 aa, Homo Sapiens
EGEVTSRLK

SEQ ID NO: 1091763 - protein, 9 aa, Homo Sapiens
LPSFIRRTP

SEQ ID NO: 1091764 - protein, 9 aa, Homo Sapiens
AGRRAHAHA

SEQ ID NO: 1091765 - protein, 9 aa, Homo Sapiens
IIGAHVGET

SEQ ID NO: 1091766 - protein, 9 aa, Homo Sapiens
NRPKGKHAS

SEQ ID NO: 1091767 - protein, 9 aa, Homo Sapiens
LHSHSCCQS

SEQ ID NO: 1091768 - protein, 9 aa, Homo Sapiens
VLMLAAHSQ

SEQ ID NO: 1091769 - protein, 9 aa, Homo Sapiens
CRPNVTTCC

SEQ ID NO: 1091770 - protein, 9 aa, Homo Sapiens
VTQLLGPIR

SEQ ID NO: 1091771 - protein, 9 aa, Homo Sapiens
GNLGAECIC

SEQ ID NO: 1091772 - protein, 9 aa, Homo Sapiens
NVRLVSCLR

SEQ ID NO: 1091773 - protein, 9 aa, Homo Sapiens
VGPAAAVFL

SEQ ID NO: 1091774 - protein, 9 aa, Homo Sapiens
EHREKERQV

SEQ ID NO: 1091775 - protein, 9 aa, Homo Sapiens
RWSPSLDWR

SEQ ID NO: 1091776 - protein, 9 aa, Homo Sapiens
YGVDLHHAN

SEQ ID NO: 1091777 - protein, 9 aa, Homo Sapiens
FLVAQTGSY

SEQ ID NO: 1091778 - protein, 9 aa, Homo Sapiens
VYPKYWIYV

SEQ ID NO: 1091779 - protein, 9 aa, Homo Sapiens
SWPGIQGQQ

SEQ ID NO: 1091780 - protein, 9 aa, Homo Sapiens
AKILLEFVV

SEQ ID NO: 1091781 - protein, 9 aa, Homo Sapiens
SCSFIQNVV

SEQ ID NO: 1091782 - protein, 9 aa, Homo Sapiens
ANLSSLFVK

SEQ ID NO: 1091783 - protein, 9 aa, Homo Sapiens
RRPLRPVAP

SEQ ID NO: 1091784 - protein, 9 aa, Homo Sapiens
AGAAVQRER

SEQ ID NO: 1091785 - protein, 9 aa, Homo Sapiens
GTTFLIECA

SEQ ID NO: 1091786 - protein, 9 aa, Homo Sapiens
EEGIPFTAI

SEQ ID NO: 1091787 - protein, 9 aa, Homo Sapiens
LCFLYPFSL

SEQ ID NO: 1091788 - protein, 9 aa, Homo Sapiens
QSPGSQSKH

SEQ ID NO: 1091789 - protein, 9 aa, Homo Sapiens
TCGITDFLS

SEQ ID NO: 1091790 - protein, 9 aa, Homo Sapiens
GANHHFLAV

SEQ ID NO: 1091791 - protein, 9 aa, Homo Sapiens
LEFSRLRFQ

SEQ ID NO: 1091792 - protein, 9 aa, Homo Sapiens
AVQRERQSA

SEQ ID NO: 1091793 - protein, 9 aa, Homo Sapiens
LIRKPMLAA

SEQ ID NO: 1091794 - protein, 9 aa, Homo Sapiens
CKERPVPAK

SEQ ID NO: 1091795 - protein, 9 aa, Homo Sapiens
AAEEVCARV

SEQ ID NO: 1091796 - protein, 9 aa, Homo Sapiens
LKAVLGIPS

SEQ ID NO: 1091797 - protein, 9 aa, Homo Sapiens
PLRPVAPAM

SEQ ID NO: 1091798 - protein, 9 aa, Homo Sapiens
EASTSQCPP

SEQ ID NO: 1091799 - protein, 9 aa, Homo Sapiens
TSGFWIWSS

SEQ ID NO: 1091800 - protein, 9 aa, Homo Sapiens
DAQQDHNLD

SEQ ID NO: 1091801 - protein, 9 aa, Homo Sapiens
PTTCGITDF

SEQ ID NO: 1091802 - protein, 9 aa, Homo Sapiens
VVSASLGST

SEQ ID NO: 1091803 - protein, 9 aa, Homo Sapiens
KWPRLGDLG

SEQ ID NO: 1091804 - protein, 9 aa, Homo Sapiens
AIRTVRVLW

SEQ ID NO: 1091805 - protein, 9 aa, Homo Sapiens
LAALAGFLF

SEQ ID NO: 1091806 - protein, 9 aa, Homo Sapiens
KKRMNVEIM

SEQ ID NO: 1091807 - protein, 9 aa, Homo Sapiens
SILDLYYTT

SEQ ID NO: 1091808 - protein, 9 aa, Homo Sapiens
WPLRAINRV

SEQ ID NO: 1091809 - protein, 9 aa, Homo Sapiens
HANDSEGID

SEQ ID NO: 1091810 - protein, 9 aa, Homo Sapiens
VPDILKVLT

SEQ ID NO: 1091811 - protein, 9 aa, Homo Sapiens
QPGRRPAAG

SEQ ID NO: 1091812 - protein, 9 aa, Homo Sapiens
MKEREHREK

SEQ ID NO: 1091813 - protein, 9 aa, Homo Sapiens
PGIQGQQNE

SEQ ID NO: 1091814 - protein, 9 aa, Homo Sapiens
VNAMNDKIC

SEQ ID NO: 1091815 - protein, 9 aa, Homo Sapiens
QRERQSAQQ

SEQ ID NO: 1091816 - protein, 9 aa, Homo Sapiens
NHLPHPLYP

SEQ ID NO: 1091817 - protein, 9 aa, Homo Sapiens
TPWRCKERP

SEQ ID NO: 1091818 - protein, 9 aa, Homo Sapiens
TENRALHEL

SEQ ID NO: 1091819 - protein, 9 aa, Homo Sapiens
DKDAQQDHN

SEQ ID NO: 1091820 - protein, 9 aa, Homo Sapiens
HGPPGPAGL

SEQ ID NO: 1091821 - protein, 9 aa, Homo Sapiens
CICQAIEAY

SEQ ID NO: 1091822 - protein, 9 aa, Homo Sapiens
PAAGRRAHA

SEQ ID NO: 1091823 - protein, 9 aa, Homo Sapiens
LFVTSWGRA

SEQ ID NO: 1091824 - protein, 9 aa, Homo Sapiens
EEIPKDAAS

SEQ ID NO: 1091825 - protein, 9 aa, Homo Sapiens
GHYTCSARN

SEQ ID NO: 1091826 - protein, 9 aa, Homo Sapiens
LASENMRWA

SEQ ID NO: 1091827 - protein, 9 aa, Homo Sapiens
QSKKRMNVE

SEQ ID NO: 1091828 - protein, 9 aa, Homo Sapiens
DAEGPGGKE

SEQ ID NO: 1091829 - protein, 9 aa, Homo Sapiens
ENRALHELV

SEQ ID NO: 1091830 - protein, 9 aa, Homo Sapiens
AVFLVNMVI

SEQ ID NO: 1091831 - protein, 9 aa, Homo Sapiens
GEMVKVCRN

SEQ ID NO: 1091832 - protein, 9 aa, Homo Sapiens
MLAAHSQHC

SEQ ID NO: 1091833 - protein, 9 aa, Homo Sapiens
EGIPFTAIR

SEQ ID NO: 1091834 - protein, 9 aa, Homo Sapiens
WPWWGEPFY

SEQ ID NO: 1091835 - protein, 9 aa, Homo Sapiens
RNTIDIKNF

SEQ ID NO: 1091836 - protein, 9 aa, Homo Sapiens
PSIYATPAI

SEQ ID NO: 1091837 - protein, 9 aa, Homo Sapiens
TLMKDTVLM

SEQ ID NO: 1091838 - protein, 9 aa, Homo Sapiens
LSILDLYYT

SEQ ID NO: 1091839 - protein, 9 aa, Homo Sapiens
QYVSIMIAE

SEQ ID NO: 1091840 - protein, 9 aa, Homo Sapiens
RKELRWRDP

SEQ ID NO: 1091841 - protein, 9 aa, Homo Sapiens
AKEISVADL

SEQ ID NO: 1091842 - protein, 9 aa, Homo Sapiens
GCWRQILKE

SEQ ID NO: 1091843 - protein, 9 aa, Homo Sapiens
LVFLSLVLH

SEQ ID NO: 1091844 - protein, 9 aa, Homo Sapiens
HTKFYTDLV

SEQ ID NO: 1091845 - protein, 9 aa, Homo Sapiens
PTLSQPHHL

SEQ ID NO: 1091846 - protein, 9 aa, Homo Sapiens
IRCPTRNTT

SEQ ID NO: 1091847 - protein, 9 aa, Homo Sapiens
LQDQSQRGR

SEQ ID NO: 1091848 - protein, 9 aa, Homo Sapiens
CANMVGTFT

SEQ ID NO: 1091849 - protein, 9 aa, Homo Sapiens
MPAHKDGFT

SEQ ID NO: 1091850 - protein, 9 aa, Homo Sapiens
RYRRPLRPV

SEQ ID NO: 1091851 - protein, 9 aa, Homo Sapiens
KQHRLKCYH

SEQ ID NO: 1091852 - protein, 9 aa, Homo Sapiens
VSFSCDGET

SEQ ID NO: 1091853 - protein, 9 aa, Homo Sapiens
GAFRLVFQQ

SEQ ID NO: 1091854 - protein, 9 aa, Homo Sapiens
GVVTVPYSD

SEQ ID NO: 1091855 - protein, 9 aa, Homo Sapiens
SEGEVTSRL

SEQ ID NO: 1091856 - protein, 9 aa, Homo Sapiens
LGAECICQA

SEQ ID NO: 1091857 - protein, 9 aa, Homo Sapiens
PSLDWRRPP

SEQ ID NO: 1091858 - protein, 9 aa, Homo Sapiens
SNSSGEREI

SEQ ID NO: 1091859 - protein, 9 aa, Homo Sapiens
LDLYYTTTT

SEQ ID NO: 1091860 - protein, 9 aa, Homo Sapiens
KIAVLTKDD

SEQ ID NO: 1091861 - protein, 9 aa, Homo Sapiens
ILYQHGANH

SEQ ID NO: 1091862 - protein, 9 aa, Homo Sapiens
GMHTVNSKL

SEQ ID NO: 1091863 - protein, 9 aa, Homo Sapiens
LHMRSKEAR

SEQ ID NO: 1091864 - protein, 9 aa, Homo Sapiens
ILLEFVVDS

SEQ ID NO: 1091865 - protein, 9 aa, Homo Sapiens
EREHREKER

SEQ ID NO: 1091866 - protein, 9 aa, Homo Sapiens
TMTVSRWNP

SEQ ID NO: 1091867 - protein, 9 aa, Homo Sapiens
PHRQLPGQQ

SEQ ID NO: 1091868 - protein, 9 aa, Homo Sapiens
EFNSQNLVN

SEQ ID NO: 1091869 - protein, 9 aa, Homo Sapiens
QSAQQPHRQ

SEQ ID NO: 1091870 - protein, 9 aa, Homo Sapiens
QATSQDMGN

SEQ ID NO: 1091871 - protein, 9 aa, Homo Sapiens
VVTVPYSDI

SEQ ID NO: 1091872 - protein, 9 aa, Homo Sapiens
IVEPEELAE

SEQ ID NO: 1091873 - protein, 9 aa, Homo Sapiens
GQRHQRRAA

SEQ ID NO: 1091874 - protein, 9 aa, Homo Sapiens
EISVADLQE

SEQ ID NO: 1091875 - protein, 9 aa, Homo Sapiens
FLLKLIFTH

SEQ ID NO: 1091876 - protein, 9 aa, Homo Sapiens
LWPLRAINR

SEQ ID NO: 1091877 - protein, 9 aa, Homo Sapiens
SKKFDNRPK

SEQ ID NO: 1091878 - protein, 9 aa, Homo Sapiens
FQQGLVFLS

SEQ ID NO: 1091879 - protein, 9 aa, Homo Sapiens
VSRWNPIIR

SEQ ID NO: 1091880 - protein, 9 aa, Homo Sapiens
KICKQININ

SEQ ID NO: 1091881 - protein, 9 aa, Homo Sapiens
EVWETFDPD

SEQ ID NO: 1091882 - protein, 9 aa, Homo Sapiens
CYHSQTYGN

SEQ ID NO: 1091883 - protein, 9 aa, Homo Sapiens
FVGPAAAVF

SEQ ID NO: 1091884 - protein, 9 aa, Homo Sapiens
KGVSVLLNF

SEQ ID NO: 1091885 - protein, 9 aa, Homo Sapiens
MLDTEDQVE

SEQ ID NO: 1091886 - protein, 9 aa, Homo Sapiens
RGRKHREKK

SEQ ID NO: 1091887 - protein, 9 aa, Homo Sapiens
VIEGAAPGT

SEQ ID NO: 1091888 - protein, 9 aa, Homo Sapiens
KQAAEEVCA

SEQ ID NO: 1091889 - protein, 9 aa, Homo Sapiens
LGSSSWPGI

SEQ ID NO: 1091890 - protein, 9 aa, Homo Sapiens
QHENEMFDY

SEQ ID NO: 1091891 - protein, 9 aa, Homo Sapiens
LEFVVDSQK

SEQ ID NO: 1091892 - protein, 9 aa, Homo Sapiens
FSRLRFQEF

SEQ ID NO: 1091893 - protein, 9 aa, Homo Sapiens
IRVANTGSS

SEQ ID NO: 1091894 - protein, 9 aa, Homo Sapiens
GDVELSGLG

SEQ ID NO: 1091895 - protein, 9 aa, Homo Sapiens
GAGAAVQRE

SEQ ID NO: 1091896 - protein, 9 aa, Homo Sapiens
IFSNAELSI

SEQ ID NO: 1091897 - protein, 9 aa, Homo Sapiens
SFIRRTPDG

SEQ ID NO: 1091898 - protein, 9 aa, Homo Sapiens
AAINTVTYE

SEQ ID NO: 1091899 - protein, 9 aa, Homo Sapiens
PYQATSQDM

SEQ ID NO: 1091900 - protein, 9 aa, Homo Sapiens
VFFISIEVY

SEQ ID NO: 1091901 - protein, 9 aa, Homo Sapiens
ANDSEGIDI

SEQ ID NO: 1091902 - protein, 9 aa, Homo Sapiens
LKALRGGAG

SEQ ID NO: 1091903 - protein, 9 aa, Homo Sapiens
KSLIQDFSP

SEQ ID NO: 1091904 - protein, 9 aa, Homo Sapiens
LCDLIHAHQ

SEQ ID NO: 1091905 - protein, 9 aa, Homo Sapiens
SIWTPNTRL

SEQ ID NO: 1091906 - protein, 9 aa, Homo Sapiens
CKPVLIRCP

SEQ ID NO: 1091907 - protein, 9 aa, Homo Sapiens
SDLVGAQGT

SEQ ID NO: 1091908 - protein, 9 aa, Homo Sapiens
NDKICKQIN

SEQ ID NO: 1091909 - protein, 9 aa, Homo Sapiens
SKQAAEEVC

SEQ ID NO: 1091910 - protein, 9 aa, Homo Sapiens
YDSNSSGER

SEQ ID NO: 1091911 - protein, 9 aa, Homo Sapiens
ELSIIAVGP

SEQ ID NO: 1091912 - protein, 9 aa, Homo Sapiens
LLLWNVRLV

SEQ ID NO: 1091913 - protein, 9 aa, Homo Sapiens
QLPANLSSL

SEQ ID NO: 1091914 - protein, 9 aa, Homo Sapiens
TDFLSTYQT

SEQ ID NO: 1091915 - protein, 9 aa, Homo Sapiens
CTTSVSNDA

SEQ ID NO: 1091916 - protein, 9 aa, Homo Sapiens
STLMKDTVL

SEQ ID NO: 1091917 - protein, 9 aa, Homo Sapiens
AEPSIYATP

SEQ ID NO: 1091918 - protein, 9 aa, Homo Sapiens
MHTVNSKLL

SEQ ID NO: 1091919 - protein, 9 aa, Homo Sapiens
DVELSGLGA

SEQ ID NO: 1091920 - protein, 9 aa, Homo Sapiens
PTGVWQHEF

SEQ ID NO: 1091921 - protein, 9 aa, Homo Sapiens
NEFNSQNLV

SEQ ID NO: 1091922 - protein, 9 aa, Homo Sapiens
RALHELVAE

SEQ ID NO: 1091923 - protein, 9 aa, Homo Sapiens
DLLKNGERK

SEQ ID NO: 1091924 - protein, 9 aa, Homo Sapiens
EKKKILLNL

SEQ ID NO: 1091925 - protein, 9 aa, Homo Sapiens
TLSQPHHLW

SEQ ID NO: 1091926 - protein, 9 aa, Homo Sapiens
IEVYQIADV

SEQ ID NO: 1091927 - protein, 9 aa, Homo Sapiens
SPSLDWRRP

SEQ ID NO: 1091928 - protein, 9 aa, Homo Sapiens
GLYPALWKV

SEQ ID NO: 1091929 - protein, 9 aa, Homo Sapiens
QDQKLTSTP

SEQ ID NO: 1091930 - protein, 9 aa, Homo Sapiens
TQLLGPIRE

SEQ ID NO: 1091931 - protein, 9 aa, Homo Sapiens
VYAKRDLAA

SEQ ID NO: 1091932 - protein, 9 aa, Homo Sapiens
KGDAEGPGG

SEQ ID NO: 1091933 - protein, 9 aa, Homo Sapiens
CAQDLDVGT

SEQ ID NO: 1091934 - protein, 9 aa, Homo Sapiens
HSQHCYAGS

SEQ ID NO: 1091935 - protein, 9 aa, Homo Sapiens
ASKQHRLKC

SEQ ID NO: 1091936 - protein, 9 aa, Homo Sapiens
IHLETCEEP

SEQ ID NO: 1091937 - protein, 9 aa, Homo Sapiens
TRLHSHSCC

SEQ ID NO: 1091938 - protein, 9 aa, Homo Sapiens
EAFHLIKGV

SEQ ID NO: 1091939 - protein, 9 aa, Homo Sapiens
TSNNLTSIS

SEQ ID NO: 1091940 - protein, 9 aa, Homo Sapiens
AVLAVTDRC

SEQ ID NO: 1091941 - protein, 9 aa, Homo Sapiens
YHILYQHGA

SEQ ID NO: 1091942 - protein, 9 aa, Homo Sapiens
VQSLMVQCR

SEQ ID NO: 1091943 - protein, 9 aa, Homo Sapiens
LFLLKLIFT

SEQ ID NO: 1091944 - protein, 9 aa, Homo Sapiens
ELIISQLNQ

SEQ ID NO: 1091945 - protein, 9 aa, Homo Sapiens
TTQVGSGSH

SEQ ID NO: 1091946 - protein, 9 aa, Homo Sapiens
NSKLLSVGT

SEQ ID NO: 1091947 - protein, 9 aa, Homo Sapiens
FLHHNVVTP

SEQ ID NO: 1091948 - protein, 9 aa, Homo Sapiens
ITDFLSTYQ

SEQ ID NO: 1091949 - protein, 9 aa, Homo Sapiens
RSDLEEMLD

SEQ ID NO: 1091950 - protein, 9 aa, Homo Sapiens
CDGETRVPL

SEQ ID NO: 1091951 - protein, 9 aa, Homo Sapiens
QNIQSKKRM

SEQ ID NO: 1091952 - protein, 9 aa, Homo Sapiens
TGVWQHEFL

SEQ ID NO: 1091953 - protein, 9 aa, Homo Sapiens
QHRLKCYHS

SEQ ID NO: 1091954 - protein, 9 aa, Homo Sapiens
ASFVPMPGS

SEQ ID NO: 1091955 - protein, 9 aa, Homo Sapiens
TVKEAVIEG

SEQ ID NO: 1091956 - protein, 9 aa, Homo Sapiens
QQNEASTSQ

SEQ ID NO: 1091957 - protein, 9 aa, Homo Sapiens
GSSSWPGIQ

SEQ ID NO: 1091958 - protein, 9 aa, Homo Sapiens
PLELYEWVR

SEQ ID NO: 1091959 - protein, 9 aa, Homo Sapiens
SLFDYPTLS

SEQ ID NO: 1091960 - protein, 9 aa, Homo Sapiens
QRHQRRAAF

SEQ ID NO: 1091961 - protein, 9 aa, Homo Sapiens
LAYFNAAAL

SEQ ID NO: 1091962 - protein, 9 aa, Homo Sapiens
NVVTPTGVW

SEQ ID NO: 1091963 - protein, 9 aa, Homo Sapiens
VKEAVIEGA

SEQ ID NO: 1091964 - protein, 9 aa, Homo Sapiens
QQPHRQLPG

SEQ ID NO: 1091965 - protein, 9 aa, Homo Sapiens
ELASGADAS

SEQ ID NO: 1091966 - protein, 9 aa, Homo Sapiens
HAHQLSLFL

SEQ ID NO: 1091967 - protein, 9 aa, Homo Sapiens
IWSFIRPVS

SEQ ID NO: 1091968 - protein, 9 aa, Homo Sapiens
YKRTLEQRA

SEQ ID NO: 1091969 - protein, 9 aa, Homo Sapiens
LMVLMLAAH

SEQ ID NO: 1091970 - protein, 9 aa, Homo Sapiens
LFPYSSIWT

SEQ ID NO: 1091971 - protein, 9 aa, Homo Sapiens
SLGQSLYHI

SEQ ID NO: 1091972 - protein, 9 aa, Homo Sapiens
RCKERPVPA

SEQ ID NO: 1091973 - protein, 9 aa, Homo Sapiens
SLDWRRPPS

SEQ ID NO: 1091974 - protein, 9 aa, Homo Sapiens
RSKEARKKA

SEQ ID NO: 1091975 - protein, 9 aa, Homo Sapiens
NVTTCCQVG

SEQ ID NO: 1091976 - protein, 9 aa, Homo Sapiens
VSIMIAEDG

SEQ ID NO: 1091977 - protein, 9 aa, Homo Sapiens
RRDTVSLYK

SEQ ID NO: 1091978 - protein, 9 aa, Homo Sapiens
VLIVYAKRD

SEQ ID NO: 1091979 - protein, 9 aa, Homo Sapiens
FLCDLIHAH

SEQ ID NO: 1091980 - protein, 9 aa, Homo Sapiens
PNRWLNGDV

SEQ ID NO: 1091981 - protein, 9 aa, Homo Sapiens
KGDHGPPGP

SEQ ID NO: 1091982 - protein, 9 aa, Homo Sapiens
GGAGAAVQR

SEQ ID NO: 1091983 - protein, 9 aa, Homo Sapiens
LQSLFVTSW

SEQ ID NO: 1091984 - protein, 9 aa, Homo Sapiens
PGPIGTLGA

SEQ ID NO: 1091985 - protein, 9 aa, Homo Sapiens
TVWQVQQHQ

SEQ ID NO: 1091986 - protein, 9 aa, Homo Sapiens
SPGSQSKHL

SEQ ID NO: 1091987 - protein, 9 aa, Homo Sapiens
IECAQDLDV

SEQ ID NO: 1091988 - protein, 9 aa, Homo Sapiens
QFWYGGSGP

SEQ ID NO: 1091989 - protein, 9 aa, Homo Sapiens
CWSHLCFLY

SEQ ID NO: 1091990 - protein, 9 aa, Homo Sapiens
PPVWPNESL

SEQ ID NO: 1091991 - protein, 9 aa, Homo Sapiens
KRMNVEIMW

SEQ ID NO: 1091992 - protein, 9 aa, Homo Sapiens
SQNLVNDDD

SEQ ID NO: 1091993 - protein, 9 aa, Homo Sapiens
LLGPIREFL

SEQ ID NO: 1091994 - protein, 9 aa, Homo Sapiens
NVRAGAVDV

SEQ ID NO: 1091995 - protein, 9 aa, Homo Sapiens
LWNVRLVSC

SEQ ID NO: 1091996 - protein, 9 aa, Homo Sapiens
QTGSYPAGS

SEQ ID NO: 1091997 - protein, 9 aa, Homo Sapiens
DVCANMVGT

SEQ ID NO: 1091998 - protein, 9 aa, Homo Sapiens
TPRAQVPDI

SEQ ID NO: 1091999 - protein, 9 aa, Homo Sapiens
WMLYMIWLD

SEQ ID NO: 1092000 - protein, 9 aa, Homo Sapiens
AGTEPKKGD

SEQ ID NO: 1092001 - protein, 9 aa, Homo Sapiens
ANDYWRQLQ

SEQ ID NO: 1092002 - protein, 9 aa, Homo Sapiens
QISDNTTHP

SEQ ID NO: 1092003 - protein, 9 aa, Homo Sapiens
IKGVSVLLN

SEQ ID NO: 1092004 - protein, 9 aa, Homo Sapiens
VTPTGVWQH

SEQ ID NO: 1092005 - protein, 9 aa, Homo Sapiens
VGAQGTFGS

SEQ ID NO: 1092006 - protein, 9 aa, Homo Sapiens
GQLPANLSS

SEQ ID NO: 1092007 - protein, 9 aa, Homo Sapiens
VQRERQSAQ

SEQ ID NO: 1092008 - protein, 9 aa, Homo Sapiens
PENSHWGVT

SEQ ID NO: 1092009 - protein, 9 aa, Homo Sapiens
AVLTKDDGK

SEQ ID NO: 1092010 - protein, 9 aa, Homo Sapiens
ECAQDLDVG

SEQ ID NO: 1092011 - protein, 9 aa, Homo Sapiens
NPVAAINTV

SEQ ID NO: 1092012 - protein, 9 aa, Homo Sapiens
PKKGDAEGP

SEQ ID NO: 1092013 - protein, 9 aa, Homo Sapiens
SRSDLEEML

SEQ ID NO: 1092014 - protein, 9 aa, Homo Sapiens
TSWGRAVGC

SEQ ID NO: 1092015 - protein, 9 aa, Homo Sapiens
SIYATPAIH

SEQ ID NO: 1092016 - protein, 9 aa, Homo Sapiens
QDQYVSIMI

SEQ ID NO: 1092017 - protein, 9 aa, Homo Sapiens
STLAAFTVW

SEQ ID NO: 1092018 - protein, 9 aa, Homo Sapiens
KFYTDLVEA

SEQ ID NO: 1092019 - protein, 9 aa, Homo Sapiens
IHAGHYTCS

SEQ ID NO: 1092020 - protein, 9 aa, Homo Sapiens
QVGSGSHFL

SEQ ID NO: 1092021 - protein, 9 aa, Homo Sapiens
IWLDRMMED

SEQ ID NO: 1092022 - protein, 9 aa, Homo Sapiens
DELASGADA

SEQ ID NO: 1092023 - protein, 9 aa, Homo Sapiens
KDGFTQDAF

SEQ ID NO: 1092024 - protein, 9 aa, Homo Sapiens
AFHLIKGVS

SEQ ID NO: 1092025 - protein, 9 aa, Homo Sapiens
CKQININNP

SEQ ID NO: 1092026 - protein, 9 aa, Homo Sapiens
ALPIHAGHY

SEQ ID NO: 1092027 - protein, 9 aa, Homo Sapiens
MLYMIWLDR

SEQ ID NO: 1092028 - protein, 9 aa, Homo Sapiens
NTTHPISYY

SEQ ID NO: 1092029 - protein, 9 aa, Homo Sapiens
TTSPRRLLD

SEQ ID NO: 1092030 - protein, 9 aa, Homo Sapiens
AAAETLATS

SEQ ID NO: 1092031 - protein, 9 aa, Homo Sapiens
QLPGQQPQQ

SEQ ID NO: 1092032 - protein, 9 aa, Homo Sapiens
LKALSSCWS

SEQ ID NO: 1092033 - protein, 9 aa, Homo Sapiens
GAAVQRERQ

SEQ ID NO: 1092034 - protein, 9 aa, Homo Sapiens
SFSCDGETR

SEQ ID NO: 1092035 - protein, 9 aa, Homo Sapiens
ALTKADVGF

SEQ ID NO: 1092036 - protein, 9 aa, Homo Sapiens
KALSSCWSH

SEQ ID NO: 1092037 - protein, 9 aa, Homo Sapiens
SSPENSHWG

SEQ ID NO: 1092038 - protein, 9 aa, Homo Sapiens
HHFLAVDSQ

SEQ ID NO: 1092039 - protein, 9 aa, Homo Sapiens
CDLIHAHQL

SEQ ID NO: 1092040 - protein, 9 aa, Homo Sapiens
SSIWTPNTR

SEQ ID NO: 1092041 - protein, 9 aa, Homo Sapiens
PEEKKKILL

SEQ ID NO: 1092042 - protein, 9 aa, Homo Sapiens
QAAEEVCAR

SEQ ID NO: 1092043 - protein, 9 aa, Homo Sapiens
YYTTTTVPH

SEQ ID NO: 1092044 - protein, 9 aa, Homo Sapiens
QALPIHAGH

SEQ ID NO: 1092045 - protein, 9 aa, Homo Sapiens
TEPKKGDAE

SEQ ID NO: 1092046 - protein, 9 aa, Homo Sapiens
LHEAKEISV

SEQ ID NO: 1092047 - protein, 9 aa, Homo Sapiens
TDLVEAVKD

SEQ ID NO: 1092048 - protein, 9 aa, Homo Sapiens
RHTKFYTDL

SEQ ID NO: 1092049 - protein, 9 aa, Homo Sapiens
SNVSFSCDG

SEQ ID NO: 1092050 - protein, 9 aa, Homo Sapiens
PVAPAMSIS

SEQ ID NO: 1092051 - protein, 9 aa, Homo Sapiens
FLIECAQDL

SEQ ID NO: 1092052 - protein, 9 aa, Homo Sapiens
MGSDPNVRA

SEQ ID NO: 1092053 - protein, 9 aa, Homo Sapiens
NTRLHSHSC

SEQ ID NO: 1092054 - protein, 9 aa, Homo Sapiens
IMIAEDGGS

SEQ ID NO: 1092055 - protein, 9 aa, Homo Sapiens
ISVADLQEN

SEQ ID NO: 1092056 - protein, 9 aa, Homo Sapiens
WRCKERPVP

SEQ ID NO: 1092057 - protein, 9 aa, Homo Sapiens
RPAAGRRAH

SEQ ID NO: 1092058 - protein, 9 aa, Homo Sapiens
GVSDASPEA

SEQ ID NO: 1092059 - protein, 9 aa, Homo Sapiens
ISQLNQAVA

SEQ ID NO: 1092060 - protein, 9 aa, Homo Sapiens
WRQLQSLTC

SEQ ID NO: 1092061 - protein, 9 aa, Homo Sapiens
YLSSKKIAV

SEQ ID NO: 1092062 - protein, 9 aa, Homo Sapiens
YDELASGAD

SEQ ID NO: 1092063 - protein, 9 aa, Homo Sapiens
VTVPYSDIG

SEQ ID NO: 1092064 - protein, 9 aa, Homo Sapiens
KPVLIRCPT

SEQ ID NO: 1092065 - protein, 9 aa, Homo Sapiens
GGGQLPANL

SEQ ID NO: 1092066 - protein, 9 aa, Homo Sapiens
GRLFTLFLN

SEQ ID NO: 1092067 - protein, 9 aa, Homo Sapiens
ASLTPRAQV

SEQ ID NO: 1092068 - protein, 9 aa, Homo Sapiens
SLYHILYQH

SEQ ID NO: 1092069 - protein, 9 aa, Homo Sapiens
HTVNSKLLS

SEQ ID NO: 1092070 - protein, 9 aa, Homo Sapiens
AVLHMRSKE

SEQ ID NO: 1092071 - protein, 9 aa, Homo Sapiens
RLVFQQGLV

SEQ ID NO: 1092072 - protein, 9 aa, Homo Sapiens
SGGSSSGGS

SEQ ID NO: 1092073 - protein, 9 aa, Homo Sapiens
YECKECKKN

SEQ ID NO: 1092074 - protein, 9 aa, Homo Sapiens
KRGRKHREK

SEQ ID NO: 1092075 - protein, 9 aa, Homo Sapiens
WPNESLSGS

SEQ ID NO: 1092076 - protein, 9 aa, Homo Sapiens
HQLSLFLLK

SEQ ID NO: 1092077 - protein, 9 aa, Homo Sapiens
HKDGFTQDA

SEQ ID NO: 1092078 - protein, 9 aa, Homo Sapiens
LMLAAHSQH

SEQ ID NO: 1092079 - protein, 9 aa, Homo Sapiens
LSQPHHLWG

SEQ ID NO: 1092080 - protein, 9 aa, Homo Sapiens
ERDAYLEAV

SEQ ID NO: 1092081 - protein, 9 aa, Homo Sapiens
QHGANHHFL

SEQ ID NO: 1092082 - protein, 9 aa, Homo Sapiens
SSVEEIPKD

SEQ ID NO: 1092083 - protein, 9 aa, Homo Sapiens
HRLKCYHSQ

SEQ ID NO: 1092084 - protein, 9 aa, Homo Sapiens
ETLATSSPR

SEQ ID NO: 1092085 - protein, 9 aa, Homo Sapiens
LWSRRKAGI

SEQ ID NO: 1092086 - protein, 9 aa, Homo Sapiens
IWSSKTLNS

SEQ ID NO: 1092087 - protein, 9 aa, Homo Sapiens
GAQLEVGCL

SEQ ID NO: 1092088 - protein, 9 aa, Homo Sapiens
HFNRYVTRR

SEQ ID NO: 1092089 - protein, 9 aa, Homo Sapiens
MKDTVLMRQ

SEQ ID NO: 1092090 - protein, 9 aa, Homo Sapiens
ANHHFLAVD

SEQ ID NO: 1092091 - protein, 9 aa, Homo Sapiens
GPGRKRGRK

SEQ ID NO: 1092092 - protein, 9 aa, Homo Sapiens
EMFYEVWET

SEQ ID NO: 1092093 - protein, 9 aa, Homo Sapiens
NTIDIKNFD

SEQ ID NO: 1092094 - protein, 9 aa, Homo Sapiens
CPPCKPVLI

SEQ ID NO: 1092095 - protein, 9 aa, Homo Sapiens
GAECICQAI

SEQ ID NO: 1092096 - protein, 9 aa, Homo Sapiens
TVNSKLLSV

SEQ ID NO: 1092097 - protein, 9 aa, Homo Sapiens
ELAEQHENE

SEQ ID NO: 1092098 - protein, 9 aa, Homo Sapiens
RAHAHAVRG

SEQ ID NO: 1092099 - protein, 9 aa, Homo Sapiens
LSTMTVSRW

SEQ ID NO: 1092100 - protein, 9 aa, Homo Sapiens
MLPSFIRRT

SEQ ID NO: 1092101 - protein, 9 aa, Homo Sapiens
RRLLDYHEC

SEQ ID NO: 1092102 - protein, 9 aa, Homo Sapiens
VAAINTVTY

SEQ ID NO: 1092103 - protein, 9 aa, Homo Sapiens
VDLHHANDS

SEQ ID NO: 1092104 - protein, 9 aa, Homo Sapiens
TSVSNDACN

SEQ ID NO: 1092105 - protein, 9 aa, Homo Sapiens
ELPAKILLE

SEQ ID NO: 1092106 - protein, 9 aa, Homo Sapiens
KHPGGGVSD

SEQ ID NO: 1092107 - protein, 9 aa, Homo Sapiens
TSRLKVGPK

SEQ ID NO: 1092108 - protein, 9 aa, Homo Sapiens
LPAKILLEF

SEQ ID NO: 1092109 - protein, 9 aa, Homo Sapiens
WQHEFLCDL

SEQ ID NO: 1092110 - protein, 9 aa, Homo Sapiens
LSMKEREHR

SEQ ID NO: 1092111 - protein, 9 aa, Homo Sapiens
GTNDGPALT

SEQ ID NO: 1092112 - protein, 9 aa, Homo Sapiens
VKSLIQDFS

SEQ ID NO: 1092113 - protein, 9 aa, Homo Sapiens
LISFLLLWN

SEQ ID NO: 1092114 - protein, 9 aa, Homo Sapiens
GIPFTAIRE

SEQ ID NO: 1092115 - protein, 9 aa, Homo Sapiens
GITDFLSTY

SEQ ID NO: 1092116 - protein, 9 aa, Homo Sapiens
HNVVTPTGV

SEQ ID NO: 1092117 - protein, 9 aa, Homo Sapiens
QQWMLYMIW

SEQ ID NO: 1092118 - protein, 9 aa, Homo Sapiens
FLVNMVIGI

SEQ ID NO: 1092119 - protein, 9 aa, Homo Sapiens
NDSEGIDIM

SEQ ID NO: 1092120 - protein, 9 aa, Homo Sapiens
LIKGVSVLL

SEQ ID NO: 1092121 - protein, 9 aa, Homo Sapiens
NRALHELVA

SEQ ID NO: 1092122 - protein, 9 aa, Homo Sapiens
QSQRGRLFT

SEQ ID NO: 1092123 - protein, 9 aa, Homo Sapiens
TQPSQSPSP

SEQ ID NO: 1092124 - protein, 9 aa, Homo Sapiens
FSNAELSII

SEQ ID NO: 1092125 - protein, 9 aa, Homo Sapiens
IGTLGAEGL

SEQ ID NO: 1092126 - protein, 9 aa, Homo Sapiens
SRRKAGISV

SEQ ID NO: 1092127 - protein, 9 aa, Homo Sapiens
ALHELVAEC

SEQ ID NO: 1092128 - protein, 9 aa, Homo Sapiens
KDAASITMR

SEQ ID NO: 1092129 - protein, 9 aa, Homo Sapiens
IEGAAPGTV

SEQ ID NO: 1092130 - protein, 9 aa, Homo Sapiens
TCCQVGKTL

SEQ ID NO: 1092131 - protein, 9 aa, Homo Sapiens
SSSKKWPRL

SEQ ID NO: 1092132 - protein, 9 aa, Homo Sapiens
SENMRWADA

SEQ ID NO: 1092133 - protein, 9 aa, Homo Sapiens
AAFTVWQVQ

SEQ ID NO: 1092134 - protein, 9 aa, Homo Sapiens
QTVQRRKTP

SEQ ID NO: 1092135 - protein, 9 aa, Homo Sapiens
FRLVFQQGL

SEQ ID NO: 1092136 - protein, 9 aa, Homo Sapiens
GSDPNVRAG

SEQ ID NO: 1092137 - protein, 9 aa, Homo Sapiens
HYDIVEPEE

SEQ ID NO: 1092138 - protein, 9 aa, Homo Sapiens
NMVGTFTDT

SEQ ID NO: 1092139 - protein, 9 aa, Homo Sapiens
PAAAVFLVN

SEQ ID NO: 1092140 - protein, 9 aa, Homo Sapiens
PIGTLGAEG

SEQ ID NO: 1092141 - protein, 9 aa, Homo Sapiens
KSGAFRLVF

SEQ ID NO: 1092142 - protein, 9 aa, Homo Sapiens
VAPAMSISL

SEQ ID NO: 1092143 - protein, 9 aa, Homo Sapiens
ENMRWADAV

SEQ ID NO: 1092144 - protein, 9 aa, Homo Sapiens
DQYVSIMIA

SEQ ID NO: 1092145 - protein, 9 aa, Homo Sapiens
YPFSLLFPY

SEQ ID NO: 1092146 - protein, 9 aa, Homo Sapiens
VEEIPKDAA

SEQ ID NO: 1092147 - protein, 9 aa, Homo Sapiens
PALTKADVG

SEQ ID NO: 1092148 - protein, 9 aa, Homo Sapiens
PSCSFIQNV

SEQ ID NO: 1092149 - protein, 9 aa, Homo Sapiens
LECTKAQYL

SEQ ID NO: 1092150 - protein, 9 aa, Homo Sapiens
VTTCCQVGK

SEQ ID NO: 1092151 - protein, 9 aa, Homo Sapiens
IRPVSFVIV

SEQ ID NO: 1092152 - protein, 9 aa, Homo Sapiens
FVPMPGSLK

SEQ ID NO: 1092153 - protein, 9 aa, Homo Sapiens
YKGEMVKVC

SEQ ID NO: 1092154 - protein, 9 aa, Homo Sapiens
STVKEAVIE

SEQ ID NO: 1092155 - protein, 9 aa, Homo Sapiens
LYPSLLSSL

SEQ ID NO: 1092156 - protein, 9 aa, Homo Sapiens
LIFTHEHRG

SEQ ID NO: 1092157 - protein, 9 aa, Homo Sapiens
RKGNLGAEC

SEQ ID NO: 1092158 - protein, 9 aa, Homo Sapiens
IQELIISQL

SEQ ID NO: 1092159 - protein, 9 aa, Homo Sapiens
LRWRDPELP

SEQ ID NO: 1092160 - protein, 9 aa, Homo Sapiens
LYYTTTTVP

SEQ ID NO: 1092161 - protein, 9 aa, Homo Sapiens
VCRNYFSKL

SEQ ID NO: 1092162 - protein, 9 aa, Homo Sapiens
SLVPHYDIV

SEQ ID NO: 1092163 - protein, 9 aa, Homo Sapiens
KELRWRDPE

SEQ ID NO: 1092164 - protein, 9 aa, Homo Sapiens
AYFNAAALD

SEQ ID NO: 1092165 - protein, 9 aa, Homo Sapiens
QILKECKEK

SEQ ID NO: 1092166 - protein, 9 aa, Homo Sapiens
AVDSQLGSS

SEQ ID NO: 1092167 - protein, 9 aa, Homo Sapiens
PRAQVPDIL

SEQ ID NO: 1092168 - protein, 9 aa, Homo Sapiens
AAAAAETLA

SEQ ID NO: 1092169 - protein, 9 aa, Homo Sapiens
YPSLLSSLP

SEQ ID NO: 1092170 - protein, 9 aa, Homo Sapiens
LLEFVVDSQ

SEQ ID NO: 1092171 - protein, 9 aa, Homo Sapiens
RRKAGISVG

SEQ ID NO: 1092172 - protein, 9 aa, Homo Sapiens
DIKNFDGKS

SEQ ID NO: 1092173 - protein, 9 aa, Homo Sapiens
FSLLFPYSS

SEQ ID NO: 1092174 - protein, 9 aa, Homo Sapiens
LLFPYSSIW

SEQ ID NO: 1092175 - protein, 9 aa, Homo Sapiens
WYGGSGPPW

SEQ ID NO: 1092176 - protein, 9 aa, Homo Sapiens
EFLCDLIHA

SEQ ID NO: 1092177 - protein, 9 aa, Homo Sapiens
SMKEREHRE

SEQ ID NO: 1092178 - protein, 9 aa, Homo Sapiens
PPCKPVLIR

SEQ ID NO: 1092179 - protein, 9 aa, Homo Sapiens
DTVLMRQPG

SEQ ID NO: 1092180 - protein, 9 aa, Homo Sapiens
LVRSPPVWP

SEQ ID NO: 1092181 - protein, 9 aa, Homo Sapiens
AQGTFGSSE

SEQ ID NO: 1092182 - protein, 9 aa, Homo Sapiens
AEVKSLIQD

SEQ ID NO: 1092183 - protein, 9 aa, Homo Sapiens
SSKTLNSWR

SEQ ID NO: 1092184 - protein, 9 aa, Homo Sapiens
KRYDSNSSG

SEQ ID NO: 1092185 - protein, 9 aa, Homo Sapiens
VQRRKTPPF

SEQ ID NO: 1092186 - protein, 9 aa, Homo Sapiens
LLQLEGPSG

SEQ ID NO: 1092187 - protein, 9 aa, Homo Sapiens
GIPSSTGRH

SEQ ID NO: 1092188 - protein, 9 aa, Homo Sapiens
GQQNEASTS

SEQ ID NO: 1092189 - protein, 9 aa, Homo Sapiens
EDQTDSRTS

SEQ ID NO: 1092190 - protein, 9 aa, Homo Sapiens
VRGQRHQRR

SEQ ID NO: 1092191 - protein, 9 aa, Homo Sapiens
PRRLLDYHE

SEQ ID NO: 1092192 - protein, 9 aa, Homo Sapiens
NAELSIIAV

SEQ ID NO: 1092193 - protein, 9 aa, Homo Sapiens
NLGAECICQ

SEQ ID NO: 1092194 - protein, 9 aa, Homo Sapiens
ILLNLSCQS

SEQ ID NO: 1092195 - protein, 9 aa, Homo Sapiens
GSHFLHHNV

SEQ ID NO: 1092196 - protein, 9 aa, Homo Sapiens
GGLASENMR

SEQ ID NO: 1092197 - protein, 9 aa, Homo Sapiens
LSDWGPHFK

SEQ ID NO: 1092198 - protein, 9 aa, Homo Sapiens
NTTQVGSGS

SEQ ID NO: 1092199 - protein, 9 aa, Homo Sapiens
KKHPGGGVS

SEQ ID NO: 1092200 - protein, 9 aa, Homo Sapiens
WVCLAYFNA

SEQ ID NO: 1092201 - protein, 9 aa, Homo Sapiens
VLTKDDGKM

SEQ ID NO: 1092202 - protein, 9 aa, Homo Sapiens
SAQQPHRQL

SEQ ID NO: 1092203 - protein, 9 aa, Homo Sapiens
KDGEKGDHG

SEQ ID NO: 1092204 - protein, 9 aa, Homo Sapiens
ECKKNLQAA

SEQ ID NO: 1092205 - protein, 9 aa, Homo Sapiens
DQSQRGRLF

SEQ ID NO: 1092206 - protein, 9 aa, Homo Sapiens
PIHAGHYTC

SEQ ID NO: 1092207 - protein, 9 aa, Homo Sapiens
WGVTVTTQP

SEQ ID NO: 1092208 - protein, 9 aa, Homo Sapiens
WETFDPDAT

SEQ ID NO: 1092209 - protein, 9 aa, Homo Sapiens
TVSRWNPII

SEQ ID NO: 1092210 - protein, 9 aa, Homo Sapiens
PNTRLHSHS

SEQ ID NO: 1092211 - protein, 9 aa, Homo Sapiens
PKYWIYVCA

SEQ ID NO: 1092212 - protein, 9 aa, Homo Sapiens
AGHYTCSAR

SEQ ID NO: 1092213 - protein, 9 aa, Homo Sapiens
CQVGKTLRI

SEQ ID NO: 1092214 - protein, 9 aa, Homo Sapiens
ENSHWGVTV

SEQ ID NO: 1092215 - protein, 9 aa, Homo Sapiens
FYTDLVEAV

SEQ ID NO: 1092216 - protein, 9 aa, Homo Sapiens
CFMRFLHIT

SEQ ID NO: 1092217 - protein, 9 aa, Homo Sapiens
MVLMLAAHS

SEQ ID NO: 1092218 - protein, 9 aa, Homo Sapiens
WNEHPRARG

SEQ ID NO: 1092219 - protein, 9 aa, Homo Sapiens
QGLVFLSLV

SEQ ID NO: 1092220 - protein, 9 aa, Homo Sapiens
MFYEVWETF

SEQ ID NO: 1092221 - protein, 9 aa, Homo Sapiens
KPMLAALAG

SEQ ID NO: 1092222 - protein, 9 aa, Homo Sapiens
LHELVAECG

SEQ ID NO: 1092223 - protein, 9 aa, Homo Sapiens
PGQQPQQPG

SEQ ID NO: 1092224 - protein, 9 aa, Homo Sapiens
QLKALSSCW

SEQ ID NO: 1092225 - protein, 9 aa, Homo Sapiens
GQGPYQATS

SEQ ID NO: 1092226 - protein, 9 aa, Homo Sapiens
RQLPGQQPQ

SEQ ID NO: 1092227 - protein, 9 aa, Homo Sapiens
VCARVAMNR

SEQ ID NO: 1092228 - protein, 9 aa, Homo Sapiens
SRLKVGPKM

SEQ ID NO: 1092229 - protein, 9 aa, Homo Sapiens
DTVSLYKRT

SEQ ID NO: 1092230 - protein, 9 aa, Homo Sapiens
DRCSALFQI

SEQ ID NO: 1092231 - protein, 9 aa, Homo Sapiens
SDNTTHPIS

SEQ ID NO: 1092232 - protein, 9 aa, Homo Sapiens
VPHYDIVEP

SEQ ID NO: 1092233 - protein, 9 aa, Homo Sapiens
SPRRLLDYH

SEQ ID NO: 1092234 - protein, 9 aa, Homo Sapiens
PPLLQLEGP

SEQ ID NO: 1092235 - protein, 9 aa, Homo Sapiens
DPEEKKKIL

SEQ ID NO: 1092236 - protein, 9 aa, Homo Sapiens
QAACTPCSS

SEQ ID NO: 1092237 - protein, 9 aa, Homo Sapiens
FHLIKGVSV

SEQ ID NO: 1092238 - protein, 9 aa, Homo Sapiens
RGGAGAAVQ

SEQ ID NO: 1092239 - protein, 9 aa, Homo Sapiens
RTVRVLWPL

SEQ ID NO: 1092240 - protein, 9 aa, Homo Sapiens
QGTFGSSEW

SEQ ID NO: 1092241 - protein, 9 aa, Homo Sapiens
SDPNVRAGA

SEQ ID NO: 1092242 - protein, 9 aa, Homo Sapiens
YWRQLQSLT

SEQ ID NO: 1092243 - protein, 9 aa, Homo Sapiens
GGGVSDASP

SEQ ID NO: 1092244 - protein, 9 aa, Homo Sapiens
IISQLNQAV

SEQ ID NO: 1092245 - protein, 9 aa, Homo Sapiens
RCWNEHPRA

SEQ ID NO: 1092246 - protein, 9 aa, Homo Sapiens
KEISVADLQ

SEQ ID NO: 1092247 - protein, 9 aa, Homo Sapiens
ILLYDELAS

SEQ ID NO: 1092248 - protein, 9 aa, Homo Sapiens
RLFTLFLNN

SEQ ID NO: 1092249 - protein, 9 aa, Homo Sapiens
GGVSDASPE

SEQ ID NO: 1092250 - protein, 9 aa, Homo Sapiens
ACNRRKCHK

SEQ ID NO: 1092251 - protein, 9 aa, Homo Sapiens
LELYEWVRM

SEQ ID NO: 1092252 - protein, 9 aa, Homo Sapiens
LWPWWGEPF

SEQ ID NO: 1092253 - protein, 9 aa, Homo Sapiens
EAVIEGAAP

SEQ ID NO: 1092254 - protein, 9 aa, Homo Sapiens
DYWRQLQSL

SEQ ID NO: 1092255 - protein, 9 aa, Homo Sapiens
LLKLIFTHE

SEQ ID NO: 1092256 - protein, 9 aa, Homo Sapiens
DLVGAQGTF

SEQ ID NO: 1092257 - protein, 9 aa, Homo Sapiens
EEPVASVQA

SEQ ID NO: 1092258 - protein, 9 aa, Homo Sapiens
PVAAINTVT

SEQ ID NO: 1092259 - protein, 9 aa, Homo Sapiens
EEVSTLMKD

SEQ ID NO: 1092260 - protein, 9 aa, Homo Sapiens
KKKILLNLS

SEQ ID NO: 1092261 - protein, 9 aa, Homo Sapiens
QPQQPGRRP

SEQ ID NO: 1092262 - protein, 9 aa, Homo Sapiens
VQCRDLENH

SEQ ID NO: 1092263 - protein, 9 aa, Homo Sapiens
GQSLYHILY

SEQ ID NO: 1092264 - protein, 9 aa, Homo Sapiens
VTSRLKVGP

SEQ ID NO: 1092265 - protein, 9 aa, Homo Sapiens
PLYPSLLSS

SEQ ID NO: 1092266 - protein, 9 aa, Homo Sapiens
GLRGLYPAL

SEQ ID NO: 1092267 - protein, 9 aa, Homo Sapiens
EMLDTEDQV

SEQ ID NO: 1092268 - protein, 9 aa, Homo Sapiens
SARKELRWR

SEQ ID NO: 1092269 - protein, 9 aa, Homo Sapiens
NEHPRARGA

SEQ ID NO: 1092270 - protein, 9 aa, Homo Sapiens
AAGRRAHAH

SEQ ID NO: 1092271 - protein, 9 aa, Homo Sapiens
QQDHNLDIE

SEQ ID NO: 1092272 - protein, 9 aa, Homo Sapiens
PQQPGRRPA

SEQ ID NO: 1092273 - protein, 9 aa, Homo Sapiens
CRNYFSKLW

SEQ ID NO: 1092274 - protein, 9 aa, Homo Sapiens
RARGAGGGR

SEQ ID NO: 1092275 - protein, 9 aa, Homo Sapiens
TKRYDSNSS

SEQ ID NO: 1092276 - protein, 9 aa, Homo Sapiens
LPNRWLNGD

SEQ ID NO: 1092277 - protein, 9 aa, Homo Sapiens
LAAFTVWQV

SEQ ID NO: 1092278 - protein, 9 aa, Homo Sapiens
FPYSSIWTP

SEQ ID NO: 1092279 - protein, 9 aa, Homo Sapiens
KCYHSQTYG

SEQ ID NO: 1092280 - protein, 9 aa, Homo Sapiens
HFLAVDSQL

SEQ ID NO: 1092281 - protein, 9 aa, Homo Sapiens
SSWPGIQGQ

SEQ ID NO: 1092282 - protein, 9 aa, Homo Sapiens
VTVTTQPSQ

SEQ ID NO: 1092283 - protein, 9 aa, Homo Sapiens
NAMNDKICK

SEQ ID NO: 1092284 - protein, 9 aa, Homo Sapiens
NRYVTRRRR

SEQ ID NO: 1092285 - protein, 9 aa, Homo Sapiens
LAEREEPLD

SEQ ID NO: 1092286 - protein, 9 aa, Homo Sapiens
EGPSGLVPE

SEQ ID NO: 1092287 - protein, 9 aa, Homo Sapiens
KEARKKAFA

SEQ ID NO: 1092288 - protein, 9 aa, Homo Sapiens
EESDLVGAQ

SEQ ID NO: 1092289 - protein, 9 aa, Homo Sapiens
YPKYWIYVC

SEQ ID NO: 1092290 - protein, 9 aa, Homo Sapiens
GGWSSSKKW

SEQ ID NO: 1092291 - protein, 9 aa, Homo Sapiens
SKTLNSWRK

SEQ ID NO: 1092292 - protein, 9 aa, Homo Sapiens
TTTSPRRLL

SEQ ID NO: 1092293 - protein, 9 aa, Homo Sapiens
VTTQPSQSP

SEQ ID NO: 1092294 - protein, 9 aa, Homo Sapiens
ATLERIKRE

SEQ ID NO: 1092295 - protein, 9 aa, Homo Sapiens
DVLIVYAKR

SEQ ID NO: 1092296 - protein, 9 aa, Homo Sapiens
ANMVGTFTD

SEQ ID NO: 1092297 - protein, 9 aa, Homo Sapiens
AQQDHNLDI

SEQ ID NO: 1092298 - protein, 9 aa, Homo Sapiens
HEHRGHQLP

SEQ ID NO: 1092299 - protein, 9 aa, Homo Sapiens
NSHWGVTVT

SEQ ID NO: 1092300 - protein, 9 aa, Homo Sapiens
SVSNDACNR

SEQ ID NO: 1092301 - protein, 9 aa, Homo Sapiens
LHHANDSEG

SEQ ID NO: 1092302 - protein, 9 aa, Homo Sapiens
FTHEHRGHQ

SEQ ID NO: 1092303 - protein, 9 aa, Homo Sapiens
GPIGTLGAE

SEQ ID NO: 1092304 - protein, 9 aa, Homo Sapiens
KIIRLILYR

SEQ ID NO: 1092305 - protein, 9 aa, Homo Sapiens
LGQSLYHIL

SEQ ID NO: 1092306 - protein, 9 aa, Homo Sapiens
ECTKAQYLA

SEQ ID NO: 1092307 - protein, 9 aa, Homo Sapiens
NTGSSNAYL

SEQ ID NO: 1092308 - protein, 9 aa, Homo Sapiens
VNSKLLSVG

SEQ ID NO: 1092309 - protein, 9 aa, Homo Sapiens
WSRRKAGIS

SEQ ID NO: 1092310 - protein, 9 aa, Homo Sapiens
VSTLMKDTV

SEQ ID NO: 1092311 - protein, 9 aa, Homo Sapiens
LAVTDRCSA

SEQ ID NO: 1092312 - protein, 9 aa, Homo Sapiens
RVANTGSSN

SEQ ID NO: 1092313 - protein, 9 aa, Homo Sapiens
DGPALTKAD

SEQ ID NO: 1092314 - protein, 9 aa, Homo Sapiens
LKRTVQSIE

SEQ ID NO: 1092315 - protein, 9 aa, Homo Sapiens
RPNGHLTHS

SEQ ID NO: 1092316 - protein, 9 aa, Homo Sapiens
ARYAAPRVH

SEQ ID NO: 1092317 - protein, 9 aa, Homo Sapiens
KKFTHFDEV

SEQ ID NO: 1092318 - protein, 9 aa, Homo Sapiens
LMLLREVLP

SEQ ID NO: 1092319 - protein, 9 aa, Homo Sapiens
AQWIGILNS

SEQ ID NO: 1092320 - protein, 9 aa, Homo Sapiens
SGTAPTVRS

SEQ ID NO: 1092321 - protein, 9 aa, Homo Sapiens
GRHKRVRTW

SEQ ID NO: 1092322 - protein, 9 aa, Homo Sapiens
PNLSMAQGR

SEQ ID NO: 1092323 - protein, 9 aa, Homo Sapiens
ALISNGCQV

SEQ ID NO: 1092324 - protein, 9 aa, Homo Sapiens
VFTSAIASM

SEQ ID NO: 1092325 - protein, 9 aa, Homo Sapiens
NISQDDYLL

SEQ ID NO: 1092326 - protein, 9 aa, Homo Sapiens
HVAVPPTVH

SEQ ID NO: 1092327 - protein, 9 aa, Homo Sapiens
MIKHYEAKV

SEQ ID NO: 1092328 - protein, 9 aa, Homo Sapiens
DYSVSWYQQ

SEQ ID NO: 1092329 - protein, 9 aa, Homo Sapiens
MGVSILYTL

SEQ ID NO: 1092330 - protein, 9 aa, Homo Sapiens
TRSRGHGRG

SEQ ID NO: 1092331 - protein, 9 aa, Homo Sapiens
KELPADLGM

SEQ ID NO: 1092332 - protein, 9 aa, Homo Sapiens
NLVVASPSL

SEQ ID NO: 1092333 - protein, 9 aa, Homo Sapiens
TVVVRPYVE

SEQ ID NO: 1092334 - protein, 9 aa, Homo Sapiens
YTLPPPLHQ

SEQ ID NO: 1092335 - protein, 9 aa, Homo Sapiens
SQSVQMFVT

SEQ ID NO: 1092336 - protein, 9 aa, Homo Sapiens
SSGQSISDS

SEQ ID NO: 1092337 - protein, 9 aa, Homo Sapiens
SPVRYRRMI

SEQ ID NO: 1092338 - protein, 9 aa, Homo Sapiens
YYKDSLHCK

SEQ ID NO: 1092339 - protein, 9 aa, Homo Sapiens
GKIVALNMG

SEQ ID NO: 1092340 - protein, 9 aa, Homo Sapiens
RLSTKVWET

SEQ ID NO: 1092341 - protein, 9 aa, Homo Sapiens
WNVPLLMLV

SEQ ID NO: 1092342 - protein, 9 aa, Homo Sapiens
QDGGSPPHS

SEQ ID NO: 1092343 - protein, 9 aa, Homo Sapiens
GSTTSSTVT

SEQ ID NO: 1092344 - protein, 9 aa, Homo Sapiens
KCRVPPVSL

SEQ ID NO: 1092345 - protein, 9 aa, Homo Sapiens
CLVFLLSLL

SEQ ID NO: 1092346 - protein, 9 aa, Homo Sapiens
RIGVDLVMK

SEQ ID NO: 1092347 - protein, 9 aa, Homo Sapiens
KKSVNLNKR

SEQ ID NO: 1092348 - protein, 9 aa, Homo Sapiens
EFTPTPASP

SEQ ID NO: 1092349 - protein, 9 aa, Homo Sapiens
KVFSACYTI

SEQ ID NO: 1092350 - protein, 9 aa, Homo Sapiens
LGIQGSRIH

SEQ ID NO: 1092351 - protein, 9 aa, Homo Sapiens
AVRALCDHS

SEQ ID NO: 1092352 - protein, 9 aa, Homo Sapiens
VEDPEMGLC

SEQ ID NO: 1092353 - protein, 9 aa, Homo Sapiens
IDWSLAEFY

SEQ ID NO: 1092354 - protein, 9 aa, Homo Sapiens
VATAINEYN

SEQ ID NO: 1092355 - protein, 9 aa, Homo Sapiens
SLHMLSVKA

SEQ ID NO: 1092356 - protein, 9 aa, Homo Sapiens
LSTKVWETV

SEQ ID NO: 1092357 - protein, 9 aa, Homo Sapiens
RVTPYQEKI

SEQ ID NO: 1092358 - protein, 9 aa, Homo Sapiens
KSKEELTEH

SEQ ID NO: 1092359 - protein, 9 aa, Homo Sapiens
APNLRYVPY

SEQ ID NO: 1092360 - protein, 9 aa, Homo Sapiens
IRDYSVSWY

SEQ ID NO: 1092361 - protein, 9 aa, Homo Sapiens
VAVNSTQEE

SEQ ID NO: 1092362 - protein, 9 aa, Homo Sapiens
VPLLMLVWK

SEQ ID NO: 1092363 - protein, 9 aa, Homo Sapiens
FATFMEYFC

SEQ ID NO: 1092364 - protein, 9 aa, Homo Sapiens
GHLTHSVLF

SEQ ID NO: 1092365 - protein, 9 aa, Homo Sapiens
PHSTTGTVH

SEQ ID NO: 1092366 - protein, 9 aa, Homo Sapiens
AVRRVIEVL

SEQ ID NO: 1092367 - protein, 9 aa, Homo Sapiens
VPPTVHITY

SEQ ID NO: 1092368 - protein, 9 aa, Homo Sapiens
QEGPFFMDF

SEQ ID NO: 1092369 - protein, 9 aa, Homo Sapiens
QNLLPYKIA

SEQ ID NO: 1092370 - protein, 9 aa, Homo Sapiens
GDFMCRFIR

SEQ ID NO: 1092371 - protein, 9 aa, Homo Sapiens
IQLSEVDKS

SEQ ID NO: 1092372 - protein, 9 aa, Homo Sapiens
AHSHTLWLH

SEQ ID NO: 1092373 - protein, 9 aa, Homo Sapiens
EYFCLEKIF

SEQ ID NO: 1092374 - protein, 9 aa, Homo Sapiens
VLLKRTVQS

SEQ ID NO: 1092375 - protein, 9 aa, Homo Sapiens
SSGILDVLH

SEQ ID NO: 1092376 - protein, 9 aa, Homo Sapiens
IASMFTCNH

SEQ ID NO: 1092377 - protein, 9 aa, Homo Sapiens
IDSTKSRSW

SEQ ID NO: 1092378 - protein, 9 aa, Homo Sapiens
GKSPCVLFL

SEQ ID NO: 1092379 - protein, 9 aa, Homo Sapiens
KPSWDDQVE

SEQ ID NO: 1092380 - protein, 9 aa, Homo Sapiens
ESKDSAFEG

SEQ ID NO: 1092381 - protein, 9 aa, Homo Sapiens
LDRGFRTTW

SEQ ID NO: 1092382 - protein, 9 aa, Homo Sapiens
NRARIVAPL

SEQ ID NO: 1092383 - protein, 9 aa, Homo Sapiens
LIRALPIIK

SEQ ID NO: 1092384 - protein, 9 aa, Homo Sapiens
GRFTQGHQP

SEQ ID NO: 1092385 - protein, 9 aa, Homo Sapiens
RRVRAASAG

SEQ ID NO: 1092386 - protein, 9 aa, Homo Sapiens
TPHQKERAA

SEQ ID NO: 1092387 - protein, 9 aa, Homo Sapiens
IVATVENED

SEQ ID NO: 1092388 - protein, 9 aa, Homo Sapiens
KANLLFKGC

SEQ ID NO: 1092389 - protein, 9 aa, Homo Sapiens
LGSTLHSRG

SEQ ID NO: 1092390 - protein, 9 aa, Homo Sapiens
KGSQSVQMF

SEQ ID NO: 1092391 - protein, 9 aa, Homo Sapiens
SYPEEEGDL

SEQ ID NO: 1092392 - protein, 9 aa, Homo Sapiens
RVIEVLMNS

SEQ ID NO: 1092393 - protein, 9 aa, Homo Sapiens
CRVPPVSLL

SEQ ID NO: 1092394 - protein, 9 aa, Homo Sapiens
DLTVKIGNF

SEQ ID NO: 1092395 - protein, 9 aa, Homo Sapiens
IEDGKTKTT

SEQ ID NO: 1092396 - protein, 9 aa, Homo Sapiens
WSLAEFYHP

SEQ ID NO: 1092397 - protein, 9 aa, Homo Sapiens
FMCRFIRFS

SEQ ID NO: 1092398 - protein, 9 aa, Homo Sapiens
KAKSKYKEK

SEQ ID NO: 1092399 - protein, 9 aa, Homo Sapiens
STTSSTVTS

SEQ ID NO: 1092400 - protein, 9 aa, Homo Sapiens
SLLTRSPLK

SEQ ID NO: 1092401 - protein, 9 aa, Homo Sapiens
KLRLIDWSL

SEQ ID NO: 1092402 - protein, 9 aa, Homo Sapiens
AVNSTQEEW

SEQ ID NO: 1092403 - protein, 9 aa, Homo Sapiens
DPLGIQGSR

SEQ ID NO: 1092404 - protein, 9 aa, Homo Sapiens
AGNSGCDFK

SEQ ID NO: 1092405 - protein, 9 aa, Homo Sapiens
KTLLHFWLP

SEQ ID NO: 1092406 - protein, 9 aa, Homo Sapiens
PAQWIGILN

SEQ ID NO: 1092407 - protein, 9 aa, Homo Sapiens
LKVSQNWIV

SEQ ID NO: 1092408 - protein, 9 aa, Homo Sapiens
SSSSRRSGT

SEQ ID NO: 1092409 - protein, 9 aa, Homo Sapiens
ASSGILDVL

SEQ ID NO: 1092410 - protein, 9 aa, Homo Sapiens
EVESLHSSV

SEQ ID NO: 1092411 - protein, 9 aa, Homo Sapiens
PPSKRKMIH

SEQ ID NO: 1092412 - protein, 9 aa, Homo Sapiens
RHEWLCVRV

SEQ ID NO: 1092413 - protein, 9 aa, Homo Sapiens
DCSTGPFSR

SEQ ID NO: 1092414 - protein, 9 aa, Homo Sapiens
WTISPPSKR

SEQ ID NO: 1092415 - protein, 9 aa, Homo Sapiens
ATLLIIIRF

SEQ ID NO: 1092416 - protein, 9 aa, Homo Sapiens
PKIQKEITR

SEQ ID NO: 1092417 - protein, 9 aa, Homo Sapiens
TCCILTDSE

SEQ ID NO: 1092418 - protein, 9 aa, Homo Sapiens
MGVFDDDDD

SEQ ID NO: 1092419 - protein, 9 aa, Homo Sapiens
SRSLHMLSV

SEQ ID NO: 1092420 - protein, 9 aa, Homo Sapiens
ETNRARIVA

SEQ ID NO: 1092421 - protein, 9 aa, Homo Sapiens
TEAPGPPKE

SEQ ID NO: 1092422 - protein, 9 aa, Homo Sapiens
HHTFYNELH

SEQ ID NO: 1092423 - protein, 9 aa, Homo Sapiens
PPVSLLQLE

SEQ ID NO: 1092424 - protein, 9 aa, Homo Sapiens
PHQKERAAS

SEQ ID NO: 1092425 - protein, 9 aa, Homo Sapiens
NFGLATVKS

SEQ ID NO: 1092426 - protein, 9 aa, Homo Sapiens
VQVCDSCHA

SEQ ID NO: 1092427 - protein, 9 aa, Homo Sapiens
MIAEDDIVS

SEQ ID NO: 1092428 - protein, 9 aa, Homo Sapiens
PSKRKMIHE

SEQ ID NO: 1092429 - protein, 9 aa, Homo Sapiens
GVFDDDDDV

SEQ ID NO: 1092430 - protein, 9 aa, Homo Sapiens
PIPTPPLRS

SEQ ID NO: 1092431 - protein, 9 aa, Homo Sapiens
FYNELHVAP

SEQ ID NO: 1092432 - protein, 9 aa, Homo Sapiens
EDLTVKIGN

SEQ ID NO: 1092433 - protein, 9 aa, Homo Sapiens
QKEITRVIG

SEQ ID NO: 1092434 - protein, 9 aa, Homo Sapiens
NTEGYISEE

SEQ ID NO: 1092435 - protein, 9 aa, Homo Sapiens
ARMTFCVYS

SEQ ID NO: 1092436 - protein, 9 aa, Homo Sapiens
MNISQDDYL

SEQ ID NO: 1092437 - protein, 9 aa, Homo Sapiens
WEHRSIRGF

SEQ ID NO: 1092438 - protein, 9 aa, Homo Sapiens
KIFAEISYP

SEQ ID NO: 1092439 - protein, 9 aa, Homo Sapiens
AATQKTSSL

SEQ ID NO: 1092440 - protein, 9 aa, Homo Sapiens
CEMVLNKKR

SEQ ID NO: 1092441 - protein, 9 aa, Homo Sapiens
EDAHSHTLW

SEQ ID NO: 1092442 - protein, 9 aa, Homo Sapiens
EDPSPCART

SEQ ID NO: 1092443 - protein, 9 aa, Homo Sapiens
RRSGTAPTV

SEQ ID NO: 1092444 - protein, 9 aa, Homo Sapiens
PMIAEDDIV

SEQ ID NO: 1092445 - protein, 9 aa, Homo Sapiens
KTKIESLLG

SEQ ID NO: 1092446 - protein, 9 aa, Homo Sapiens
GRCRLELWL

SEQ ID NO: 1092447 - protein, 9 aa, Homo Sapiens
ELHVAPEEH

SEQ ID NO: 1092448 - protein, 9 aa, Homo Sapiens
SNGCQVSYC

SEQ ID NO: 1092449 - protein, 9 aa, Homo Sapiens
NELHVAPEE

SEQ ID NO: 1092450 - protein, 9 aa, Homo Sapiens
HEWLCVRVD

SEQ ID NO: 1092451 - protein, 9 aa, Homo Sapiens
QPRAHTESK

SEQ ID NO: 1092452 - protein, 9 aa, Homo Sapiens
SPPSKRKMI

SEQ ID NO: 1092453 - protein, 9 aa, Homo Sapiens
ALNMGVSIL

SEQ ID NO: 1092454 - protein, 9 aa, Homo Sapiens
QAKNHWMIK

SEQ ID NO: 1092455 - protein, 9 aa, Homo Sapiens
VKEDCVFYQ

SEQ ID NO: 1092456 - protein, 9 aa, Homo Sapiens
PRAPKSSPV

SEQ ID NO: 1092457 - protein, 9 aa, Homo Sapiens
MNPEKSQEE

SEQ ID NO: 1092458 - protein, 9 aa, Homo Sapiens
ISPPSKRKM

SEQ ID NO: 1092459 - protein, 9 aa, Homo Sapiens
KRKMIHELL

SEQ ID NO: 1092460 - protein, 9 aa, Homo Sapiens
AAGPRGILL

SEQ ID NO: 1092461 - protein, 9 aa, Homo Sapiens
ASWPTCGST

SEQ ID NO: 1092462 - protein, 9 aa, Homo Sapiens
LCVRVDPFT

SEQ ID NO: 1092463 - protein, 9 aa, Homo Sapiens
SGQSISDSV

SEQ ID NO: 1092464 - protein, 9 aa, Homo Sapiens
YRRVRAASA

SEQ ID NO: 1092465 - protein, 9 aa, Homo Sapiens
VKIGNFGLA

SEQ ID NO: 1092466 - protein, 9 aa, Homo Sapiens
ILTDSESSS

SEQ ID NO: 1092467 - protein, 9 aa, Homo Sapiens
VMKTCFSPN

SEQ ID NO: 1092468 - protein, 9 aa, Homo Sapiens
KSEPIRRKG

SEQ ID NO: 1092469 - protein, 9 aa, Homo Sapiens
RDYSVSWYQ

SEQ ID NO: 1092470 - protein, 9 aa, Homo Sapiens
FSGHYHSLC

SEQ ID NO: 1092471 - protein, 9 aa, Homo Sapiens
SRRSGTAPT

SEQ ID NO: 1092472 - protein, 9 aa, Homo Sapiens
CVDSNWIVG

SEQ ID NO: 1092473 - protein, 9 aa, Homo Sapiens
VNSTQEEWS

SEQ ID NO: 1092474 - protein, 9 aa, Homo Sapiens
NNPEPRFGG

SEQ ID NO: 1092475 - protein, 9 aa, Homo Sapiens
YDNDKRSSC

SEQ ID NO: 1092476 - protein, 9 aa, Homo Sapiens
RYAAPRVHI

SEQ ID NO: 1092477 - protein, 9 aa, Homo Sapiens
PSWDDQVEE

SEQ ID NO: 1092478 - protein, 9 aa, Homo Sapiens
KIQKEITRV

SEQ ID NO: 1092479 - protein, 9 aa, Homo Sapiens
SRGPPGSRK

SEQ ID NO: 1092480 - protein, 9 aa, Homo Sapiens
VSSSLALCQ

SEQ ID NO: 1092481 - protein, 9 aa, Homo Sapiens
RAIGRRTSW

SEQ ID NO: 1092482 - protein, 9 aa, Homo Sapiens
SVATAINEY

SEQ ID NO: 1092483 - protein, 9 aa, Homo Sapiens
KNHWMIKTA

SEQ ID NO: 1092484 - protein, 9 aa, Homo Sapiens
SACYTILTP

SEQ ID NO: 1092485 - protein, 9 aa, Homo Sapiens
KPGQGPAIP

SEQ ID NO: 1092486 - protein, 9 aa, Homo Sapiens
LQEDSSPPL

SEQ ID NO: 1092487 - protein, 9 aa, Homo Sapiens
HAIWYIVGI

SEQ ID NO: 1092488 - protein, 9 aa, Homo Sapiens
SVLQHPEGD

SEQ ID NO: 1092489 - protein, 9 aa, Homo Sapiens
IQGSEPSSG

SEQ ID NO: 1092490 - protein, 9 aa, Homo Sapiens
LLQNLLPYK

SEQ ID NO: 1092491 - protein, 9 aa, Homo Sapiens
STKSRSWDG

SEQ ID NO: 1092492 - protein, 9 aa, Homo Sapiens
VPPVSLLQL

SEQ ID NO: 1092493 - protein, 9 aa, Homo Sapiens
QGSRIHKEK

SEQ ID NO: 1092494 - protein, 9 aa, Homo Sapiens
DVMCSPMIA

SEQ ID NO: 1092495 - protein, 9 aa, Homo Sapiens
HSAARPDQL

SEQ ID NO: 1092496 - protein, 9 aa, Homo Sapiens
DCSTGKCLE

SEQ ID NO: 1092497 - protein, 9 aa, Homo Sapiens
AALELDGRC

SEQ ID NO: 1092498 - protein, 9 aa, Homo Sapiens
LMTSVPLKV

SEQ ID NO: 1092499 - protein, 9 aa, Homo Sapiens
SFYLDPQLQ

SEQ ID NO: 1092500 - protein, 9 aa, Homo Sapiens
HQKERAASP

SEQ ID NO: 1092501 - protein, 9 aa, Homo Sapiens
LIIIRFTSW

SEQ ID NO: 1092502 - protein, 9 aa, Homo Sapiens
EAGNSGCDF

SEQ ID NO: 1092503 - protein, 9 aa, Homo Sapiens
PPMTVSPRV

SEQ ID NO: 1092504 - protein, 9 aa, Homo Sapiens
VVASPSLPE

SEQ ID NO: 1092505 - protein, 9 aa, Homo Sapiens
MEYFCLEKI

SEQ ID NO: 1092506 - protein, 9 aa, Homo Sapiens
RYARKSEPI

SEQ ID NO: 1092507 - protein, 9 aa, Homo Sapiens
AAQTVIFVA

SEQ ID NO: 1092508 - protein, 9 aa, Homo Sapiens
TLPPPLHQT

SEQ ID NO: 1092509 - protein, 9 aa, Homo Sapiens
LHSSVATAI

SEQ ID NO: 1092510 - protein, 9 aa, Homo Sapiens
KRDCGSTRA

SEQ ID NO: 1092511 - protein, 9 aa, Homo Sapiens
EEPVLFLHA

SEQ ID NO: 1092512 - protein, 9 aa, Homo Sapiens
KIGNFGLAT

SEQ ID NO: 1092513 - protein, 9 aa, Homo Sapiens
EPAQWIGIL

SEQ ID NO: 1092514 - protein, 9 aa, Homo Sapiens
DKAKSKYKE

SEQ ID NO: 1092515 - protein, 9 aa, Homo Sapiens
SSPKPVQVC

SEQ ID NO: 1092516 - protein, 9 aa, Homo Sapiens
LTVAGNIII

SEQ ID NO: 1092517 - protein, 9 aa, Homo Sapiens
SKKTLLHFW

SEQ ID NO: 1092518 - protein, 9 aa, Homo Sapiens
VATVENEDP

SEQ ID NO: 1092519 - protein, 9 aa, Homo Sapiens
SEPSSGPLS

SEQ ID NO: 1092520 - protein, 9 aa, Homo Sapiens
TFMEYFCLE

SEQ ID NO: 1092521 - protein, 9 aa, Homo Sapiens
AYLSKRQEL

SEQ ID NO: 1092522 - protein, 9 aa, Homo Sapiens
ALSQTGFSY

SEQ ID NO: 1092523 - protein, 9 aa, Homo Sapiens
LSTAQYYQE

SEQ ID NO: 1092524 - protein, 9 aa, Homo Sapiens
SSPVRYRRM

SEQ ID NO: 1092525 - protein, 9 aa, Homo Sapiens
CGSTTSSTV

SEQ ID NO: 1092526 - protein, 9 aa, Homo Sapiens
QEPYYRRVR

SEQ ID NO: 1092527 - protein, 9 aa, Homo Sapiens
DGGSPPHST

SEQ ID NO: 1092528 - protein, 9 aa, Homo Sapiens
DLVMKTCFS

SEQ ID NO: 1092529 - protein, 9 aa, Homo Sapiens
GHYHSLCKA

SEQ ID NO: 1092530 - protein, 9 aa, Homo Sapiens
TVRSPPGQH

SEQ ID NO: 1092531 - protein, 9 aa, Homo Sapiens
QHPASWPTC

SEQ ID NO: 1092532 - protein, 9 aa, Homo Sapiens
AAAEAALSQ

SEQ ID NO: 1092533 - protein, 9 aa, Homo Sapiens
NLLLRKDAC

SEQ ID NO: 1092534 - protein, 9 aa, Homo Sapiens
PEMGLCLLP

SEQ ID NO: 1092535 - protein, 9 aa, Homo Sapiens
NIYWEHRSI

SEQ ID NO: 1092536 - protein, 9 aa, Homo Sapiens
ENMSLQHEQ

SEQ ID NO: 1092537 - protein, 9 aa, Homo Sapiens
SKRQELISE

SEQ ID NO: 1092538 - protein, 9 aa, Homo Sapiens
ITRVIGTQV

SEQ ID NO: 1092539 - protein, 9 aa, Homo Sapiens
ARRGLPVLP

SEQ ID NO: 1092540 - protein, 9 aa, Homo Sapiens
QDPLGIQGS

SEQ ID NO: 1092541 - protein, 9 aa, Homo Sapiens
ISNGCQVSY

SEQ ID NO: 1092542 - protein, 9 aa, Homo Sapiens
LVMKTCFSP

SEQ ID NO: 1092543 - protein, 9 aa, Homo Sapiens
SLALCQCIA

SEQ ID NO: 1092544 - protein, 9 aa, Homo Sapiens
STVTSGRRA

SEQ ID NO: 1092545 - protein, 9 aa, Homo Sapiens
RLHTPRYFL

SEQ ID NO: 1092546 - protein, 9 aa, Homo Sapiens
TVGKKSVNL

SEQ ID NO: 1092547 - protein, 9 aa, Homo Sapiens
DSKPSWDDQ

SEQ ID NO: 1092548 - protein, 9 aa, Homo Sapiens
SPPLRCALC

SEQ ID NO: 1092549 - protein, 9 aa, Homo Sapiens
LIDWSLAEF

SEQ ID NO: 1092550 - protein, 9 aa, Homo Sapiens
DACSWSTGM

SEQ ID NO: 1092551 - protein, 9 aa, Homo Sapiens
RVARYAAPR

SEQ ID NO: 1092552 - protein, 9 aa, Homo Sapiens
LQAKNHWMI

SEQ ID NO: 1092553 - protein, 9 aa, Homo Sapiens
RCVEDPEMG

SEQ ID NO: 1092554 - protein, 9 aa, Homo Sapiens
MGLCLLPLT

SEQ ID NO: 1092555 - protein, 9 aa, Homo Sapiens
MTERLGHGY

SEQ ID NO: 1092556 - protein, 9 aa, Homo Sapiens
DGRCRLELW

SEQ ID NO: 1092557 - protein, 9 aa, Homo Sapiens
EVTMNISQD

SEQ ID NO: 1092558 - protein, 9 aa, Homo Sapiens
SDIQEPYYR

SEQ ID NO: 1092559 - protein, 9 aa, Homo Sapiens
RLETCISDR

SEQ ID NO: 1092560 - protein, 9 aa, Homo Sapiens
PLRCALCIG

SEQ ID NO: 1092561 - protein, 9 aa, Homo Sapiens
ERQQQQDCE

SEQ ID NO: 1092562 - protein, 9 aa, Homo Sapiens
QEKIYMTLS

SEQ ID NO: 1092563 - protein, 9 aa, Homo Sapiens
LKPGQGPAI

SEQ ID NO: 1092564 - protein, 9 aa, Homo Sapiens
PPKEPLLGE

SEQ ID NO: 1092565 - protein, 9 aa, Homo Sapiens
DGTKLSGKE

SEQ ID NO: 1092566 - protein, 9 aa, Homo Sapiens
LDFLEKFSG

SEQ ID NO: 1092567 - protein, 9 aa, Homo Sapiens
LPSHDSSVV

SEQ ID NO: 1092568 - protein, 9 aa, Homo Sapiens
SSGPIPTPP

SEQ ID NO: 1092569 - protein, 9 aa, Homo Sapiens
RLTAVMKRR

SEQ ID NO: 1092570 - protein, 9 aa, Homo Sapiens
LYILTVAGN

SEQ ID NO: 1092571 - protein, 9 aa, Homo Sapiens
SSEAGNSGC

SEQ ID NO: 1092572 - protein, 9 aa, Homo Sapiens
KYKEKSDKE

SEQ ID NO: 1092573 - protein, 9 aa, Homo Sapiens
RARIVAPLL

SEQ ID NO: 1092574 - protein, 9 aa, Homo Sapiens
LNTEGYISE

SEQ ID NO: 1092575 - protein, 9 aa, Homo Sapiens
SIEACIANF

SEQ ID NO: 1092576 - protein, 9 aa, Homo Sapiens
EFDPMCALF

SEQ ID NO: 1092577 - protein, 9 aa, Homo Sapiens
FSRASTLTA

SEQ ID NO: 1092578 - protein, 9 aa, Homo Sapiens
PETCCILTD

SEQ ID NO: 1092579 - protein, 9 aa, Homo Sapiens
PTPPLRSTP

SEQ ID NO: 1092580 - protein, 9 aa, Homo Sapiens
VAPLLILDK

SEQ ID NO: 1092581 - protein, 9 aa, Homo Sapiens
GMEEAPHES

SEQ ID NO: 1092582 - protein, 9 aa, Homo Sapiens
VARYAAPRV

SEQ ID NO: 1092583 - protein, 9 aa, Homo Sapiens
VDLVMKTCF

SEQ ID NO: 1092584 - protein, 9 aa, Homo Sapiens
FGDFMCRFI

SEQ ID NO: 1092585 - protein, 9 aa, Homo Sapiens
ISSGPIPTP

SEQ ID NO: 1092586 - protein, 9 aa, Homo Sapiens
ACSWSTGMQ

SEQ ID NO: 1092587 - protein, 9 aa, Homo Sapiens
NRARMTFCV

SEQ ID NO: 1092588 - protein, 9 aa, Homo Sapiens
KDSLHCKWI

SEQ ID NO: 1092589 - protein, 9 aa, Homo Sapiens
GESKDSAFE

SEQ ID NO: 1092590 - protein, 9 aa, Homo Sapiens
RALCDHSAA

SEQ ID NO: 1092591 - protein, 9 aa, Homo Sapiens
RLIDWSLAE

SEQ ID NO: 1092592 - protein, 9 aa, Homo Sapiens
YQYEPYLWD

SEQ ID NO: 1092593 - protein, 9 aa, Homo Sapiens
HTLWLHLAT

SEQ ID NO: 1092594 - protein, 9 aa, Homo Sapiens
QSISDSVPL

SEQ ID NO: 1092595 - protein, 9 aa, Homo Sapiens
VFSACYTIL

SEQ ID NO: 1092596 - protein, 9 aa, Homo Sapiens
GNFGLATVK

SEQ ID NO: 1092597 - protein, 9 aa, Homo Sapiens
SPCVLFLFY

SEQ ID NO: 1092598 - protein, 9 aa, Homo Sapiens
RDVRARRGL

SEQ ID NO: 1092599 - protein, 9 aa, Homo Sapiens
EPDPEFDPM

SEQ ID NO: 1092600 - protein, 9 aa, Homo Sapiens
TSVPLKVSQ

SEQ ID NO: 1092601 - protein, 9 aa, Homo Sapiens
PSSGPLSVF

SEQ ID NO: 1092602 - protein, 9 aa, Homo Sapiens
KEDCVFYQR

SEQ ID NO: 1092603 - protein, 9 aa, Homo Sapiens
EISYPEEEG

SEQ ID NO: 1092604 - protein, 9 aa, Homo Sapiens
RRGLPVLPL

SEQ ID NO: 1092605 - protein, 9 aa, Homo Sapiens
AQTVIFVAT

SEQ ID NO: 1092606 - protein, 9 aa, Homo Sapiens
VVAAFVLPG

SEQ ID NO: 1092607 - protein, 9 aa, Homo Sapiens
SGTARQTDD

SEQ ID NO: 1092608 - protein, 9 aa, Homo Sapiens
DPEFDPMCA

SEQ ID NO: 1092609 - protein, 9 aa, Homo Sapiens
HMLSVKASH

SEQ ID NO: 1092610 - protein, 9 aa, Homo Sapiens
GLCRLSTKV

SEQ ID NO: 1092611 - protein, 9 aa, Homo Sapiens
ENEDPSPCA

SEQ ID NO: 1092612 - protein, 9 aa, Homo Sapiens
QTVIFVATG

SEQ ID NO: 1092613 - protein, 9 aa, Homo Sapiens
DTVVVRPYV

SEQ ID NO: 1092614 - protein, 9 aa, Homo Sapiens
YFCLEKIFK

SEQ ID NO: 1092615 - protein, 9 aa, Homo Sapiens
SQHPALISN

SEQ ID NO: 1092616 - protein, 9 aa, Homo Sapiens
QDDYLLGIP

SEQ ID NO: 1092617 - protein, 9 aa, Homo Sapiens
PVSLMFWKD

SEQ ID NO: 1092618 - protein, 9 aa, Homo Sapiens
LPETCCILT

SEQ ID NO: 1092619 - protein, 9 aa, Homo Sapiens
LLLRKDACS

SEQ ID NO: 1092620 - protein, 9 aa, Homo Sapiens
GSTLHSRGP

SEQ ID NO: 1092621 - protein, 9 aa, Homo Sapiens
LREVLPSHD

SEQ ID NO: 1092622 - protein, 9 aa, Homo Sapiens
TQGHQPCKC

SEQ ID NO: 1092623 - protein, 9 aa, Homo Sapiens
IFAEISYPE

SEQ ID NO: 1092624 - protein, 9 aa, Homo Sapiens
RSWDGRGPG

SEQ ID NO: 1092625 - protein, 9 aa, Homo Sapiens
STKVWETVQ

SEQ ID NO: 1092626 - protein, 9 aa, Homo Sapiens
MLSVKASHY

SEQ ID NO: 1092627 - protein, 9 aa, Homo Sapiens
TENFVAPEV

SEQ ID NO: 1092628 - protein, 9 aa, Homo Sapiens
PPLRCALCI

SEQ ID NO: 1092629 - protein, 9 aa, Homo Sapiens
HPEGDYAIA

SEQ ID NO: 1092630 - protein, 9 aa, Homo Sapiens
SLLGNSLVL

SEQ ID NO: 1092631 - protein, 9 aa, Homo Sapiens
GQGPAIPPP

SEQ ID NO: 1092632 - protein, 9 aa, Homo Sapiens
EALYGSELN

SEQ ID NO: 1092633 - protein, 9 aa, Homo Sapiens
MDLIDLTPH

SEQ ID NO: 1092634 - protein, 9 aa, Homo Sapiens
CNNPEPRFG

SEQ ID NO: 1092635 - protein, 9 aa, Homo Sapiens
EGPFFMDFN

SEQ ID NO: 1092636 - protein, 9 aa, Homo Sapiens
KGKSPCVLF

SEQ ID NO: 1092637 - protein, 9 aa, Homo Sapiens
GIQGSRIHK

SEQ ID NO: 1092638 - protein, 9 aa, Homo Sapiens
SKRKMIHEL

SEQ ID NO: 1092639 - protein, 9 aa, Homo Sapiens
EDGKTKTTF

SEQ ID NO: 1092640 - protein, 9 aa, Homo Sapiens
SSSSSRRSG

SEQ ID NO: 1092641 - protein, 9 aa, Homo Sapiens
PASPALQYL

SEQ ID NO: 1092642 - protein, 9 aa, Homo Sapiens
VTPYQEKIY

SEQ ID NO: 1092643 - protein, 9 aa, Homo Sapiens
VFIHQPRAH

SEQ ID NO: 1092644 - protein, 9 aa, Homo Sapiens
LWDPVAYPK

SEQ ID NO: 1092645 - protein, 9 aa, Homo Sapiens
QLKRGETVK

SEQ ID NO: 1092646 - protein, 9 aa, Homo Sapiens
LDVLHCVLV

SEQ ID NO: 1092647 - protein, 9 aa, Homo Sapiens
TVVDPVSLM

SEQ ID NO: 1092648 - protein, 9 aa, Homo Sapiens
HPASWPTCG

SEQ ID NO: 1092649 - protein, 9 aa, Homo Sapiens
YISEEVADS

SEQ ID NO: 1092650 - protein, 9 aa, Homo Sapiens
RVPPVSLLQ

SEQ ID NO: 1092651 - protein, 9 aa, Homo Sapiens
APKSSPVRY

SEQ ID NO: 1092652 - protein, 9 aa, Homo Sapiens
PMCALFYCI

SEQ ID NO: 1092653 - protein, 9 aa, Homo Sapiens
DSAFEGGTF

SEQ ID NO: 1092654 - protein, 9 aa, Homo Sapiens
DLSKKTLLH

SEQ ID NO: 1092655 - protein, 9 aa, Homo Sapiens
IGAGSEGWV

SEQ ID NO: 1092656 - protein, 9 aa, Homo Sapiens
TMNISQDDY

SEQ ID NO: 1092657 - protein, 9 aa, Homo Sapiens
IQKEITRVI

SEQ ID NO: 1092658 - protein, 9 aa, Homo Sapiens
KFSGHYHSL

SEQ ID NO: 1092659 - protein, 9 aa, Homo Sapiens
PNGHLTHSV

SEQ ID NO: 1092660 - protein, 9 aa, Homo Sapiens
SRNSNFVTI

SEQ ID NO: 1092661 - protein, 9 aa, Homo Sapiens
DRGAYLSKR

SEQ ID NO: 1092662 - protein, 9 aa, Homo Sapiens
STRAGTDND

SEQ ID NO: 1092663 - protein, 9 aa, Homo Sapiens
PEFDPMCAL

SEQ ID NO: 1092664 - protein, 9 aa, Homo Sapiens
SSLALCQCI

SEQ ID NO: 1092665 - protein, 9 aa, Homo Sapiens
VKASHYRRH

SEQ ID NO: 1092666 - protein, 9 aa, Homo Sapiens
QGHQPCKCK

SEQ ID NO: 1092667 - protein, 9 aa, Homo Sapiens
AKDTVVVRP

SEQ ID NO: 1092668 - protein, 9 aa, Homo Sapiens
IKHYEAKVY

SEQ ID NO: 1092669 - protein, 9 aa, Homo Sapiens
KRRVTSQRK

SEQ ID NO: 1092670 - protein, 9 aa, Homo Sapiens
VYDNHAIWY

SEQ ID NO: 1092671 - protein, 9 aa, Homo Sapiens
IAGESKDSA

SEQ ID NO: 1092672 - protein, 9 aa, Homo Sapiens
PVQVCDSCH

SEQ ID NO: 1092673 - protein, 9 aa, Homo Sapiens
AFVLPGAGG

SEQ ID NO: 1092674 - protein, 9 aa, Homo Sapiens
LLREVLPSH

SEQ ID NO: 1092675 - protein, 9 aa, Homo Sapiens
DLIDLTPHQ

SEQ ID NO: 1092676 - protein, 9 aa, Homo Sapiens
FLALYILTV

SEQ ID NO: 1092677 - protein, 9 aa, Homo Sapiens
WKIKLNYTL

SEQ ID NO: 1092678 - protein, 9 aa, Homo Sapiens
VQSIEACIA

SEQ ID NO: 1092679 - protein, 9 aa, Homo Sapiens
DVRARRGLP

SEQ ID NO: 1092680 - protein, 9 aa, Homo Sapiens
LHMLSVKAS

SEQ ID NO: 1092681 - protein, 9 aa, Homo Sapiens
DVLHCVLVE

SEQ ID NO: 1092682 - protein, 9 aa, Homo Sapiens
YQEKIYMTL

SEQ ID NO: 1092683 - protein, 9 aa, Homo Sapiens
VRPYVEDQE

SEQ ID NO: 1092684 - protein, 9 aa, Homo Sapiens
GCVDSNWIV

SEQ ID NO: 1092685 - protein, 9 aa, Homo Sapiens
NLLFKGCVD

SEQ ID NO: 1092686 - protein, 9 aa, Homo Sapiens
GKKSVNLNK

SEQ ID NO: 1092687 - protein, 9 aa, Homo Sapiens
ARIVAPLLI

SEQ ID NO: 1092688 - protein, 9 aa, Homo Sapiens
CRQATVNVS

SEQ ID NO: 1092689 - protein, 9 aa, Homo Sapiens
GILLTRTGT

SEQ ID NO: 1092690 - protein, 9 aa, Homo Sapiens
VMHRVARYA

SEQ ID NO: 1092691 - protein, 9 aa, Homo Sapiens
RYFLLANLS

SEQ ID NO: 1092692 - protein, 9 aa, Homo Sapiens
GRRAIGRRT

SEQ ID NO: 1092693 - protein, 9 aa, Homo Sapiens
TISPPSKRK

SEQ ID NO: 1092694 - protein, 9 aa, Homo Sapiens
QYYQELYEI

SEQ ID NO: 1092695 - protein, 9 aa, Homo Sapiens
RIQGSEPSS

SEQ ID NO: 1092696 - protein, 9 aa, Homo Sapiens
STRSRGHGR

SEQ ID NO: 1092697 - protein, 9 aa, Homo Sapiens
SGRRAIGRR

SEQ ID NO: 1092698 - protein, 9 aa, Homo Sapiens
PYVEDQEFH

SEQ ID NO: 1092699 - protein, 9 aa, Homo Sapiens
YQRIRSRNI

SEQ ID NO: 1092700 - protein, 9 aa, Homo Sapiens
PGQGPAIPP

SEQ ID NO: 1092701 - protein, 9 aa, Homo Sapiens
VGKKSVNLN

SEQ ID NO: 1092702 - protein, 9 aa, Homo Sapiens
SELNCIIHF

SEQ ID NO: 1092703 - protein, 9 aa, Homo Sapiens
TSAIASMFT

SEQ ID NO: 1092704 - protein, 9 aa, Homo Sapiens
EKFSGHYHS

SEQ ID NO: 1092705 - protein, 9 aa, Homo Sapiens
PEAPPLDRG

SEQ ID NO: 1092706 - protein, 9 aa, Homo Sapiens
MFVTLSNVL

SEQ ID NO: 1092707 - protein, 9 aa, Homo Sapiens
VALNMGVSI

SEQ ID NO: 1092708 - protein, 9 aa, Homo Sapiens
PEATLLIII

SEQ ID NO: 1092709 - protein, 9 aa, Homo Sapiens
TDSESSSSS

SEQ ID NO: 1092710 - protein, 9 aa, Homo Sapiens
LEESDCSTG

SEQ ID NO: 1092711 - protein, 9 aa, Homo Sapiens
LIYALAIVI

SEQ ID NO: 1092712 - protein, 9 aa, Homo Sapiens
GPRGILLTR

SEQ ID NO: 1092713 - protein, 9 aa, Homo Sapiens
LQNLLPYKI

SEQ ID NO: 1092714 - protein, 9 aa, Homo Sapiens
LPSSPKPVQ

SEQ ID NO: 1092715 - protein, 9 aa, Homo Sapiens
PVKLENMSL

SEQ ID NO: 1092716 - protein, 9 aa, Homo Sapiens
ELDGRCRLE

SEQ ID NO: 1092717 - protein, 9 aa, Homo Sapiens
WLGSTLHSR

SEQ ID NO: 1092718 - protein, 9 aa, Homo Sapiens
LLGNSLVLW

SEQ ID NO: 1092719 - protein, 9 aa, Homo Sapiens
RFIEDGKTK

SEQ ID NO: 1092720 - protein, 9 aa, Homo Sapiens
RFGGKYCTG

SEQ ID NO: 1092721 - protein, 9 aa, Homo Sapiens
HTPRYFLLA

SEQ ID NO: 1092722 - protein, 9 aa, Homo Sapiens
GFRTTWLST

SEQ ID NO: 1092723 - protein, 9 aa, Homo Sapiens
TFCVYSILG

SEQ ID NO: 1092724 - protein, 9 aa, Homo Sapiens
GAYLSKRQE

SEQ ID NO: 1092725 - protein, 9 aa, Homo Sapiens
APFRPNGHL

SEQ ID NO: 1092726 - protein, 9 aa, Homo Sapiens
QGPAIPPPL

SEQ ID NO: 1092727 - protein, 9 aa, Homo Sapiens
PVSLLQLEK

SEQ ID NO: 1092728 - protein, 9 aa, Homo Sapiens
AEAALSQTG

SEQ ID NO: 1092729 - protein, 9 aa, Homo Sapiens
LTPHQKERA

SEQ ID NO: 1092730 - protein, 9 aa, Homo Sapiens
QHPEGDYAI

SEQ ID NO: 1092731 - protein, 9 aa, Homo Sapiens
MDFNSIIPI

SEQ ID NO: 1092732 - protein, 9 aa, Homo Sapiens
AEDKAKSKY

SEQ ID NO: 1092733 - protein, 9 aa, Homo Sapiens
RNSNFVTIG

SEQ ID NO: 1092734 - protein, 9 aa, Homo Sapiens
ALAIVINVD

SEQ ID NO: 1092735 - protein, 9 aa, Homo Sapiens
VWDCSTGKC

SEQ ID NO: 1092736 - protein, 9 aa, Homo Sapiens
EGDYAIASS

SEQ ID NO: 1092737 - protein, 9 aa, Homo Sapiens
MTVGKKSVN

SEQ ID NO: 1092738 - protein, 9 aa, Homo Sapiens
QELYEILEL

SEQ ID NO: 1092739 - protein, 9 aa, Homo Sapiens
LSMAQGRHK

SEQ ID NO: 1092740 - protein, 9 aa, Homo Sapiens
VRYRRMIAV

SEQ ID NO: 1092741 - protein, 9 aa, Homo Sapiens
TPASPALQY

SEQ ID NO: 1092742 - protein, 9 aa, Homo Sapiens
SPKPVQVCD

SEQ ID NO: 1092743 - protein, 9 aa, Homo Sapiens
HCKWIIEAK

SEQ ID NO: 1092744 - protein, 9 aa, Homo Sapiens
SRGHGRGDS

SEQ ID NO: 1092745 - protein, 9 aa, Homo Sapiens
ESLLGRLEK

SEQ ID NO: 1092746 - protein, 9 aa, Homo Sapiens
CFVPKSPPM

SEQ ID NO: 1092747 - protein, 9 aa, Homo Sapiens
SKDSAFEGG

SEQ ID NO: 1092748 - protein, 9 aa, Homo Sapiens
CSTGKCLET

SEQ ID NO: 1092749 - protein, 9 aa, Homo Sapiens
HRVARYAAP

SEQ ID NO: 1092750 - protein, 9 aa, Homo Sapiens
WLHLATRAD

SEQ ID NO: 1092751 - protein, 9 aa, Homo Sapiens
LNCIIHFPS

SEQ ID NO: 1092752 - protein, 9 aa, Homo Sapiens
RQQQQDCEE

SEQ ID NO: 1092753 - protein, 9 aa, Homo Sapiens
ALPIIKSQL

SEQ ID NO: 1092754 - protein, 9 aa, Homo Sapiens
EATLLIIIR

SEQ ID NO: 1092755 - protein, 9 aa, Homo Sapiens
PILLQNLLP

SEQ ID NO: 1092756 - protein, 9 aa, Homo Sapiens
KKTLLHFWL

SEQ ID NO: 1092757 - protein, 9 aa, Homo Sapiens
GPLVYDNHA

SEQ ID NO: 1092758 - protein, 9 aa, Homo Sapiens
RMVKVWDCS

SEQ ID NO: 1092759 - protein, 9 aa, Homo Sapiens
NEDPSPCAR

SEQ ID NO: 1092760 - protein, 9 aa, Homo Sapiens
PKSSPVRYR

SEQ ID NO: 1092761 - protein, 9 aa, Homo Sapiens
MLLREVLPS

SEQ ID NO: 1092762 - protein, 9 aa, Homo Sapiens
CCILTDSES

SEQ ID NO: 1092763 - protein, 9 aa, Homo Sapiens
TTSSTVTSG

SEQ ID NO: 1092764 - protein, 9 aa, Homo Sapiens
GKKFTHFDE

SEQ ID NO: 1092765 - protein, 9 aa, Homo Sapiens
ASMFTCNHT

SEQ ID NO: 1092766 - protein, 9 aa, Homo Sapiens
DSLHCKWII

SEQ ID NO: 1092767 - protein, 9 aa, Homo Sapiens
IEVLMNSKV

SEQ ID NO: 1092768 - protein, 9 aa, Homo Sapiens
PHESDDQRQ

SEQ ID NO: 1092769 - protein, 9 aa, Homo Sapiens
IPTPPLRST

SEQ ID NO: 1092770 - protein, 9 aa, Homo Sapiens
TLWLHLATR

SEQ ID NO: 1092771 - protein, 9 aa, Homo Sapiens
QHLDSEEEA

SEQ ID NO: 1092772 - protein, 9 aa, Homo Sapiens
GPIPTPPLR

SEQ ID NO: 1092773 - protein, 9 aa, Homo Sapiens
SDDQRQVPL

SEQ ID NO: 1092774 - protein, 9 aa, Homo Sapiens
SSVATAINE

SEQ ID NO: 1092775 - protein, 9 aa, Homo Sapiens
VENEDPSPC

SEQ ID NO: 1092776 - protein, 9 aa, Homo Sapiens
VRSPPGQHP

SEQ ID NO: 1092777 - protein, 9 aa, Homo Sapiens
GILDVLHCV

SEQ ID NO: 1092778 - protein, 9 aa, Homo Sapiens
RMTFCVYSI

SEQ ID NO: 1092779 - protein, 9 aa, Homo Sapiens
SKYKEKSDK

SEQ ID NO: 1092780 - protein, 9 aa, Homo Sapiens
HQPRAHTES

SEQ ID NO: 1092781 - protein, 9 aa, Homo Sapiens
LEASSGILD

SEQ ID NO: 1092782 - protein, 9 aa, Homo Sapiens
ELESEPVMQ

SEQ ID NO: 1092783 - protein, 9 aa, Homo Sapiens
PVRYRRMIA

SEQ ID NO: 1092784 - protein, 9 aa, Homo Sapiens
FEDVAVNST

SEQ ID NO: 1092785 - protein, 9 aa, Homo Sapiens
LMTERLGHG

SEQ ID NO: 1092786 - protein, 9 aa, Homo Sapiens
KRTVQSIEA

SEQ ID NO: 1092787 - protein, 9 aa, Homo Sapiens
VDPVSLMFW

SEQ ID NO: 1092788 - protein, 9 aa, Homo Sapiens
QGDMQGPPG

SEQ ID NO: 1092789 - protein, 9 aa, Homo Sapiens
PGAEAAPNL

SEQ ID NO: 1092790 - protein, 9 aa, Homo Sapiens
DGKTKTTFF

SEQ ID NO: 1092791 - protein, 9 aa, Homo Sapiens
LDGRCRLEL

SEQ ID NO: 1092792 - protein, 9 aa, Homo Sapiens
LEKFSGHYH

SEQ ID NO: 1092793 - protein, 9 aa, Homo Sapiens
QRIRSRNIP

SEQ ID NO: 1092794 - protein, 9 aa, Homo Sapiens
DRGFRTTWL

SEQ ID NO: 1092795 - protein, 9 aa, Homo Sapiens
QGSEPSSGP

SEQ ID NO: 1092796 - protein, 9 aa, Homo Sapiens
ATFMEYFCL

SEQ ID NO: 1092797 - protein, 9 aa, Homo Sapiens
HESDDQRQV

SEQ ID NO: 1092798 - protein, 9 aa, Homo Sapiens
MCALFYCIS

SEQ ID NO: 1092799 - protein, 9 aa, Homo Sapiens
VLPSHDSSV

SEQ ID NO: 1092800 - protein, 9 aa, Homo Sapiens
PPILLQNLL

SEQ ID NO: 1092801 - protein, 9 aa, Homo Sapiens
GTAPTVRSP

SEQ ID NO: 1092802 - protein, 9 aa, Homo Sapiens
GSQSVQMFV

SEQ ID NO: 1092803 - protein, 9 aa, Homo Sapiens
SISDSVPLE

SEQ ID NO: 1092804 - protein, 9 aa, Homo Sapiens
PRLTAVMKR

SEQ ID NO: 1092805 - protein, 9 aa, Homo Sapiens
VTMNISQDD

SEQ ID NO: 1092806 - protein, 9 aa, Homo Sapiens
VMQVTVGSA

SEQ ID NO: 1092807 - protein, 9 aa, Homo Sapiens
PQGDMQGPP

SEQ ID NO: 1092808 - protein, 9 aa, Homo Sapiens
TVKIGNFGL

SEQ ID NO: 1092809 - protein, 9 aa, Homo Sapiens
RGILLTRTG

SEQ ID NO: 1092810 - protein, 9 aa, Homo Sapiens
ETCCILTDS

SEQ ID NO: 1092811 - protein, 9 aa, Homo Sapiens
EAPFRPNGH

SEQ ID NO: 1092812 - protein, 9 aa, Homo Sapiens
SPPMTVSPR

SEQ ID NO: 1092813 - protein, 9 aa, Homo Sapiens
PCYTENFVA

SEQ ID NO: 1092814 - protein, 9 aa, Homo Sapiens
GLNRARMTF

SEQ ID NO: 1092815 - protein, 9 aa, Homo Sapiens
PKSPPMTVS

SEQ ID NO: 1092816 - protein, 9 aa, Homo Sapiens
RRYARKSEP

SEQ ID NO: 1092817 - protein, 9 aa, Homo Sapiens
DPVSLMFWK

SEQ ID NO: 1092818 - protein, 9 aa, Homo Sapiens
SSSRRSGTA

SEQ ID NO: 1092819 - protein, 9 aa, Homo Sapiens
YLIRALPII

SEQ ID NO: 1092820 - protein, 9 aa, Homo Sapiens
NAAQTVIFV

SEQ ID NO: 1092821 - protein, 9 aa, Homo Sapiens
PKQEGPFFM

SEQ ID NO: 1092822 - protein, 9 aa, Homo Sapiens
WPPILLQNL

SEQ ID NO: 1092823 - protein, 9 aa, Homo Sapiens
NGCQVSYCV

SEQ ID NO: 1092824 - protein, 9 aa, Homo Sapiens
CRFIRFSFH

SEQ ID NO: 1092825 - protein, 9 aa, Homo Sapiens
PPGQHPASW

SEQ ID NO: 1092826 - protein, 9 aa, Homo Sapiens
RFTQGHQPC

SEQ ID NO: 1092827 - protein, 9 aa, Homo Sapiens
PFRPNGHLT

SEQ ID NO: 1092828 - protein, 9 aa, Homo Sapiens
FVTIGAGSE

SEQ ID NO: 1092829 - protein, 9 aa, Homo Sapiens
TPCYTENFV

SEQ ID NO: 1092830 - protein, 9 aa, Homo Sapiens
TVAGNIIIV

SEQ ID NO: 1092831 - protein, 9 aa, Homo Sapiens
SLLQLEKCC

SEQ ID NO: 1092832 - protein, 9 aa, Homo Sapiens
ITPWNVPLL

SEQ ID NO: 1092833 - protein, 9 aa, Homo Sapiens
ESSSSSRRS

SEQ ID NO: 1092834 - protein, 9 aa, Homo Sapiens
THFDEVRLE

SEQ ID NO: 1092835 - protein, 9 aa, Homo Sapiens
TKVWETVQR

SEQ ID NO: 1092836 - protein, 9 aa, Homo Sapiens
NPNLSMAQG

SEQ ID NO: 1092837 - protein, 9 aa, Homo Sapiens
AKVYIPPII

SEQ ID NO: 1092838 - protein, 9 aa, Homo Sapiens
VTSGRRAIG

SEQ ID NO: 1092839 - protein, 9 aa, Homo Sapiens
MKCRVPPVS

SEQ ID NO: 1092840 - protein, 9 aa, Homo Sapiens
WPTCGSTTS

SEQ ID NO: 1092841 - protein, 9 aa, Homo Sapiens
EKMTVGKKS

SEQ ID NO: 1092842 - protein, 9 aa, Homo Sapiens
EASSGILDV

SEQ ID NO: 1092843 - protein, 9 aa, Homo Sapiens
VKVWDCSTG

SEQ ID NO: 1092844 - protein, 9 aa, Homo Sapiens
SVSWYQQRA

SEQ ID NO: 1092845 - protein, 9 aa, Homo Sapiens
RSSCRQATV

SEQ ID NO: 1092846 - protein, 9 aa, Homo Sapiens
SDRDCASSS

SEQ ID NO: 1092847 - protein, 9 aa, Homo Sapiens
YGSELNCII

SEQ ID NO: 1092848 - protein, 9 aa, Homo Sapiens
FDSKPSWDD

SEQ ID NO: 1092849 - protein, 9 aa, Homo Sapiens
LLIIIRFTS

SEQ ID NO: 1092850 - protein, 9 aa, Homo Sapiens
HTFYNELHV

SEQ ID NO: 1092851 - protein, 9 aa, Homo Sapiens
YLWDPVAYP

SEQ ID NO: 1092852 - protein, 9 aa, Homo Sapiens
SDRGAYLSK

SEQ ID NO: 1092853 - protein, 9 aa, Homo Sapiens
ASPALQYLE

SEQ ID NO: 1092854 - protein, 9 aa, Homo Sapiens
WDCSTGKCL

SEQ ID NO: 1092855 - protein, 9 aa, Homo Sapiens
TPTPASPAL

SEQ ID NO: 1092856 - protein, 9 aa, Homo Sapiens
STGRFTQGH

SEQ ID NO: 1092857 - protein, 9 aa, Homo Sapiens
ISQDDYLLG

SEQ ID NO: 1092858 - protein, 9 aa, Homo Sapiens
HADEDFVSY

SEQ ID NO: 1092859 - protein, 9 aa, Homo Sapiens
SRIHKEKSL

SEQ ID NO: 1092860 - protein, 9 aa, Homo Sapiens
VETNRARIV

SEQ ID NO: 1092861 - protein, 9 aa, Homo Sapiens
QERQQQQDC

SEQ ID NO: 1092862 - protein, 9 aa, Homo Sapiens
VRFPPPIIK

SEQ ID NO: 1092863 - protein, 9 aa, Homo Sapiens
LDSEEEAPR

SEQ ID NO: 1092864 - protein, 9 aa, Homo Sapiens
PSLPETCCI

SEQ ID NO: 1092865 - protein, 9 aa, Homo Sapiens
VQDGGSPPH

SEQ ID NO: 1092866 - protein, 9 aa, Homo Sapiens
HVAPEEHPI

SEQ ID NO: 1092867 - protein, 9 aa, Homo Sapiens
LHSRGPPGS

SEQ ID NO: 1092868 - protein, 9 aa, Homo Sapiens
IDLTPHQKE

SEQ ID NO: 1092869 - protein, 9 aa, Homo Sapiens
YWEHRSIRG

SEQ ID NO: 1092870 - protein, 9 aa, Homo Sapiens
LNYTLPPPL

SEQ ID NO: 1092871 - protein, 9 aa, Homo Sapiens
TQIKTKIES

SEQ ID NO: 1092872 - protein, 9 aa, Homo Sapiens
IYWEHRSIR

SEQ ID NO: 1092873 - protein, 9 aa, Homo Sapiens
AFSRASTLT

SEQ ID NO: 1092874 - protein, 9 aa, Homo Sapiens
LLTPCYTEN

SEQ ID NO: 1092875 - protein, 9 aa, Homo Sapiens
PTVHITYHA

SEQ ID NO: 1092876 - protein, 9 aa, Homo Sapiens
LNMGVSILY

SEQ ID NO: 1092877 - protein, 9 aa, Homo Sapiens
LHCKWIIEA

SEQ ID NO: 1092878 - protein, 9 aa, Homo Sapiens
IYQYEPYLW

SEQ ID NO: 1092879 - protein, 9 aa, Homo Sapiens
NMSLQHEQR

SEQ ID NO: 1092880 - protein, 9 aa, Homo Sapiens
QKRDCGSTR

SEQ ID NO: 1092881 - protein, 9 aa, Homo Sapiens
HSHTLWLHL

SEQ ID NO: 1092882 - protein, 9 aa, Homo Sapiens
TDPKVSSSL

SEQ ID NO: 1092883 - protein, 9 aa, Homo Sapiens
AKSKYKEKS

SEQ ID NO: 1092884 - protein, 9 aa, Homo Sapiens
CGAITPWNV

SEQ ID NO: 1092885 - protein, 9 aa, Homo Sapiens
EESDCSTGP

SEQ ID NO: 1092886 - protein, 9 aa, Homo Sapiens
AAEAALSQT

SEQ ID NO: 1092887 - protein, 9 aa, Homo Sapiens
SEPVMQVTV

SEQ ID NO: 1092888 - protein, 9 aa, Homo Sapiens
LPLLVVAAF

SEQ ID NO: 1092889 - protein, 9 aa, Homo Sapiens
KLENMSLQH

SEQ ID NO: 1092890 - protein, 9 aa, Homo Sapiens
QVCDSCHAL

SEQ ID NO: 1092891 - protein, 9 aa, Homo Sapiens
STGPFSRAR

SEQ ID NO: 1092892 - protein, 9 aa, Homo Sapiens
KSKYKEKSD

SEQ ID NO: 1092893 - protein, 9 aa, Homo Sapiens
ESEPVMQVT

SEQ ID NO: 1092894 - protein, 9 aa, Homo Sapiens
FFMDFNSII

SEQ ID NO: 1092895 - protein, 9 aa, Homo Sapiens
LDPQLQPHC

SEQ ID NO: 1092896 - protein, 9 aa, Homo Sapiens
QGRHKRVRT

SEQ ID NO: 1092897 - protein, 9 aa, Homo Sapiens
LSKRQELIS

SEQ ID NO: 1092898 - protein, 9 aa, Homo Sapiens
PSHDSSVVP

SEQ ID NO: 1092899 - protein, 9 aa, Homo Sapiens
QMFVTLSNV

SEQ ID NO: 1092900 - protein, 9 aa, Homo Sapiens
GPAAGPRGI

SEQ ID NO: 1092901 - protein, 9 aa, Homo Sapiens
LCDHSAARP

SEQ ID NO: 1092902 - protein, 9 aa, Homo Sapiens
GTEAPGPPK

SEQ ID NO: 1092903 - protein, 9 aa, Homo Sapiens
RPYVEDQEF

SEQ ID NO: 1092904 - protein, 9 aa, Homo Sapiens
LRDVRARRG

SEQ ID NO: 1092905 - protein, 9 aa, Homo Sapiens
APTVRSPPG

SEQ ID NO: 1092906 - protein, 9 aa, Homo Sapiens
KSRSWDGRG

SEQ ID NO: 1092907 - protein, 9 aa, Homo Sapiens
DVRFPPPII

SEQ ID NO: 1092908 - protein, 9 aa, Homo Sapiens
DMQGPPGPQ

SEQ ID NO: 1092909 - protein, 9 aa, Homo Sapiens
LLNRVTPYQ

SEQ ID NO: 1092910 - protein, 9 aa, Homo Sapiens
NLRYVPYGA

SEQ ID NO: 1092911 - protein, 9 aa, Homo Sapiens
RDCASSSGS

SEQ ID NO: 1092912 - protein, 9 aa, Homo Sapiens
SSCRQATVN

SEQ ID NO: 1092913 - protein, 9 aa, Homo Sapiens
TLPVLNAAQ

SEQ ID NO: 1092914 - protein, 9 aa, Homo Sapiens
DPEMGLCLL

SEQ ID NO: 1092915 - protein, 9 aa, Homo Sapiens
TVHITYHAH

SEQ ID NO: 1092916 - protein, 9 aa, Homo Sapiens
FLEKFSGHY

SEQ ID NO: 1092917 - protein, 9 aa, Homo Sapiens
EAAPNLRYV

SEQ ID NO: 1092918 - protein, 9 aa, Homo Sapiens
VPKSPPMTV

SEQ ID NO: 1092919 - protein, 9 aa, Homo Sapiens
SKEELTEHI

SEQ ID NO: 1092920 - protein, 9 aa, Homo Sapiens
CRLSTKVWE

SEQ ID NO: 1092921 - protein, 9 aa, Homo Sapiens
EKGSQSVQM

SEQ ID NO: 1092922 - protein, 9 aa, Homo Sapiens
ARQTDDAAP

SEQ ID NO: 1092923 - protein, 9 aa, Homo Sapiens
ILTVAGNII

SEQ ID NO: 1092924 - protein, 9 aa, Homo Sapiens
PASWPTCGS

SEQ ID NO: 1092925 - protein, 9 aa, Homo Sapiens
IQGSRIHKE

SEQ ID NO: 1092926 - protein, 9 aa, Homo Sapiens
RGHGRGDSC

SEQ ID NO: 1092927 - protein, 9 aa, Homo Sapiens
SRASTLTAH

SEQ ID NO: 1092928 - protein, 9 aa, Homo Sapiens
AIWYIVGIV

SEQ ID NO: 1092929 - protein, 9 aa, Homo Sapiens
TPWNVPLLM

SEQ ID NO: 1092930 - protein, 9 aa, Homo Sapiens
LPIIKSQLN

SEQ ID NO: 1092931 - protein, 9 aa, Homo Sapiens
DPKIQKEIT

SEQ ID NO: 1092932 - protein, 9 aa, Homo Sapiens
RGSTRSRGH

SEQ ID NO: 1092933 - protein, 9 aa, Homo Sapiens
PLGIQGSRI

SEQ ID NO: 1092934 - protein, 9 aa, Homo Sapiens
DSSPPLRCA

SEQ ID NO: 1092935 - protein, 9 aa, Homo Sapiens
SMAQGRHKR

SEQ ID NO: 1092936 - protein, 9 aa, Homo Sapiens
VVVRPYVED

SEQ ID NO: 1092937 - protein, 9 aa, Homo Sapiens
LNKKRHIQQ

SEQ ID NO: 1092938 - protein, 9 aa, Homo Sapiens
RGFRTTWLS

SEQ ID NO: 1092939 - protein, 9 aa, Homo Sapiens
VLQHPEGDY

SEQ ID NO: 1092940 - protein, 9 aa, Homo Sapiens
QSVQMFVTL

SEQ ID NO: 1092941 - protein, 9 aa, Homo Sapiens
DSTKSRSWD

SEQ ID NO: 1092942 - protein, 9 aa, Homo Sapiens
MEEAPHESD

SEQ ID NO: 1092943 - protein, 9 aa, Homo Sapiens
PKPVQVCDS

SEQ ID NO: 1092944 - protein, 9 aa, Homo Sapiens
GDLKPGQGP

SEQ ID NO: 1092945 - protein, 9 aa, Homo Sapiens
EPVMQVTVG

SEQ ID NO: 1092946 - protein, 9 aa, Homo Sapiens
DRFIEDGKT

SEQ ID NO: 1092947 - protein, 9 aa, Homo Sapiens
PTVRSPPGQ

SEQ ID NO: 1092948 - protein, 9 aa, Homo Sapiens
TAVMKRRVT

SEQ ID NO: 1092949 - protein, 9 aa, Homo Sapiens
MTSVPLKVS

SEQ ID NO: 1092950 - protein, 9 aa, Homo Sapiens
KDTVVVRPY

SEQ ID NO: 1092951 - protein, 9 aa, Homo Sapiens
PWNVPLLML

SEQ ID NO: 1092952 - protein, 9 aa, Homo Sapiens
RASTLTAHK

SEQ ID NO: 1092953 - protein, 9 aa, Homo Sapiens
NPEKSQEES

SEQ ID NO: 1092954 - protein, 9 aa, Homo Sapiens
ELYEILELA

SEQ ID NO: 1092955 - protein, 9 aa, Homo Sapiens
SEEEAPRPT

SEQ ID NO: 1092956 - protein, 9 aa, Homo Sapiens
LHTPRYFLL

SEQ ID NO: 1092957 - protein, 9 aa, Homo Sapiens
SGPIPTPPL

SEQ ID NO: 1092958 - protein, 9 aa, Homo Sapiens
SLQHEQRAK

SEQ ID NO: 1092959 - protein, 9 aa, Homo Sapiens
LESEPVMQV

SEQ ID NO: 1092960 - protein, 9 aa, Homo Sapiens
LKRGETVKA

SEQ ID NO: 1092961 - protein, 9 aa, Homo Sapiens
QSIEACIAN

SEQ ID NO: 1092962 - protein, 9 aa, Homo Sapiens
NSGCDFKHA

SEQ ID NO: 1092963 - protein, 9 aa, Homo Sapiens
KTSSLLTRS

SEQ ID NO: 1092964 - protein, 9 aa, Homo Sapiens
PPLDRGFRT

SEQ ID NO: 1092965 - protein, 9 aa, Homo Sapiens
SVMHRVARY

SEQ ID NO: 1092966 - protein, 9 aa, Homo Sapiens
KGCVDSNWI

SEQ ID NO: 1092967 - protein, 9 aa, Homo Sapiens
WEKGKSPCV

SEQ ID NO: 1092968 - protein, 9 aa, Homo Sapiens
PPGAEAAPN

SEQ ID NO: 1092969 - protein, 9 aa, Homo Sapiens
FTPTPASPA

SEQ ID NO: 1092970 - protein, 9 aa, Homo Sapiens
CSPMIAEDD

SEQ ID NO: 1092971 - protein, 9 aa, Homo Sapiens
LVYDNHAIW

SEQ ID NO: 1092972 - protein, 9 aa, Homo Sapiens
QDRHEWLCV

SEQ ID NO: 1092973 - protein, 9 aa, Homo Sapiens
SSTVTSGRR

SEQ ID NO: 1092974 - protein, 9 aa, Homo Sapiens
AEAAPNLRY

SEQ ID NO: 1092975 - protein, 9 aa, Homo Sapiens
GAITPWNVP

SEQ ID NO: 1092976 - protein, 9 aa, Homo Sapiens
VRALCDHSA

SEQ ID NO: 1092977 - protein, 9 aa, Homo Sapiens
VRRVIEVLM

SEQ ID NO: 1092978 - protein, 9 aa, Homo Sapiens
KSSPVRYRR

SEQ ID NO: 1092979 - protein, 9 aa, Homo Sapiens
VESLHSSVA

SEQ ID NO: 1092980 - protein, 9 aa, Homo Sapiens
VTIRDYSVS

SEQ ID NO: 1092981 - protein, 9 aa, Homo Sapiens
AAPNLRYVP

SEQ ID NO: 1092982 - protein, 9 aa, Homo Sapiens
TKLSGKELP

SEQ ID NO: 1092983 - protein, 9 aa, Homo Sapiens
EPYYRRVRA

SEQ ID NO: 1092984 - protein, 9 aa, Homo Sapiens
CVLFLFYED

SEQ ID NO: 1092985 - protein, 9 aa, Homo Sapiens
ALYILTVAG

SEQ ID NO: 1092986 - protein, 9 aa, Homo Sapiens
PLDRGFRTT

SEQ ID NO: 1092987 - protein, 9 aa, Homo Sapiens
EKGKSPCVL

SEQ ID NO: 1092988 - protein, 9 aa, Homo Sapiens
APPLDRGFR

SEQ ID NO: 1092989 - protein, 9 aa, Homo Sapiens
PRYFLLANL

SEQ ID NO: 1092990 - protein, 9 aa, Homo Sapiens
SSLLTRSPL

SEQ ID NO: 1092991 - protein, 9 aa, Homo Sapiens
TQKTSSLLT

SEQ ID NO: 1092992 - protein, 9 aa, Homo Sapiens
VSLLQLEKC

SEQ ID NO: 1092993 - protein, 9 aa, Homo Sapiens
SSFYLDPQL

SEQ ID NO: 1092994 - protein, 9 aa, Homo Sapiens
MAQGRHKRV

SEQ ID NO: 1092995 - protein, 9 aa, Homo Sapiens
VFDDDDDVR

SEQ ID NO: 1092996 - protein, 9 aa, Homo Sapiens
TLLIIIRFT

SEQ ID NO: 1092997 - protein, 9 aa, Homo Sapiens
ALYGSELNC

SEQ ID NO: 1092998 - protein, 9 aa, Homo Sapiens
FYQRIRSRN

SEQ ID NO: 1092999 - protein, 9 aa, Homo Sapiens
KLSGKELPA

SEQ ID NO: 1093000 - protein, 9 aa, Homo Sapiens
SDSRLHTPR

SEQ ID NO: 1093001 - protein, 9 aa, Homo Sapiens
KRGETVKAE

SEQ ID NO: 1093002 - protein, 9 aa, Homo Sapiens
GPAIPPPLP

SEQ ID NO: 1093003 - protein, 9 aa, Homo Sapiens
MVLNKKRHI

SEQ ID NO: 1093004 - protein, 9 aa, Homo Sapiens
MCSPMIAED

SEQ ID NO: 1093005 - protein, 9 aa, Homo Sapiens
ILDVLHCVL

SEQ ID NO: 1093006 - protein, 9 aa, Homo Sapiens
QYEPYLWDP

SEQ ID NO: 1093007 - protein, 9 aa, Homo Sapiens
KRSSCRQAT

SEQ ID NO: 1093008 - protein, 9 aa, Homo Sapiens
SGKELPADL

SEQ ID NO: 1093009 - protein, 9 aa, Homo Sapiens
PYYRRVRAA

SEQ ID NO: 1093010 - protein, 9 aa, Homo Sapiens
IESLLGRLE

SEQ ID NO: 1093011 - protein, 9 aa, Homo Sapiens
PDPEFDPMC

SEQ ID NO: 1093012 - protein, 9 aa, Homo Sapiens
LYGSELNCI

SEQ ID NO: 1093013 - protein, 9 aa, Homo Sapiens
LENMSLQHE

SEQ ID NO: 1093014 - protein, 9 aa, Homo Sapiens
AEISYPEEE

SEQ ID NO: 1093015 - protein, 9 aa, Homo Sapiens
VAGNIIIVT

SEQ ID NO: 1093016 - protein, 9 aa, Homo Sapiens
VDILMTERL

SEQ ID NO: 1093017 - protein, 9 aa, Homo Sapiens
ATVENEDPS

SEQ ID NO: 1093018 - protein, 9 aa, Homo Sapiens
AQGRHKRVR

SEQ ID NO: 1093019 - protein, 9 aa, Homo Sapiens
TLQAKNHWM

SEQ ID NO: 1093020 - protein, 9 aa, Homo Sapiens
YEPYLWDPV

SEQ ID NO: 1093021 - protein, 9 aa, Homo Sapiens
EDKAKSKYK

SEQ ID NO: 1093022 - protein, 9 aa, Homo Sapiens
TCISDRDCA

SEQ ID NO: 1093023 - protein, 9 aa, Homo Sapiens
WDDQVEEEG

SEQ ID NO: 1093024 - protein, 9 aa, Homo Sapiens
PTPASPALQ

SEQ ID NO: 1093025 - protein, 9 aa, Homo Sapiens
LETCISDRD

SEQ ID NO: 1093026 - protein, 9 aa, Homo Sapiens
EDPEMGLCL

SEQ ID NO: 1093027 - protein, 9 aa, Homo Sapiens
PVMQVTVGS

SEQ ID NO: 1093028 - protein, 9 aa, Homo Sapiens
QNIYWEHRS

SEQ ID NO: 1093029 - protein, 9 aa, Homo Sapiens
GNSGCDFKH

SEQ ID NO: 1093030 - protein, 9 aa, Homo Sapiens
HFWLPFGFI

SEQ ID NO: 1093031 - protein, 9 aa, Homo Sapiens
LLRKDACSW

SEQ ID NO: 1093032 - protein, 9 aa, Homo Sapiens
GIISSGPIP

SEQ ID NO: 1093033 - protein, 9 aa, Homo Sapiens
VSLMFWKDE

SEQ ID NO: 1093034 - protein, 9 aa, Homo Sapiens
DPQLQPHCE

SEQ ID NO: 1093035 - protein, 9 aa, Homo Sapiens
LRLIDWSLA

SEQ ID NO: 1093036 - protein, 9 aa, Homo Sapiens
YYQELYEIL

SEQ ID NO: 1093037 - protein, 9 aa, Homo Sapiens
LSGKELPAD

SEQ ID NO: 1093038 - protein, 9 aa, Homo Sapiens
TKSRSWDGR

SEQ ID NO: 1093039 - protein, 9 aa, Homo Sapiens
LDLNTEGYI

SEQ ID NO: 1093040 - protein, 9 aa, Homo Sapiens
HTESKEALA

SEQ ID NO: 1093041 - protein, 9 aa, Homo Sapiens
HLDSEEEAP

SEQ ID NO: 1093042 - protein, 9 aa, Homo Sapiens
ILLQNLLPY

SEQ ID NO: 1093043 - protein, 9 aa, Homo Sapiens
DLEESDCST

SEQ ID NO: 1093044 - protein, 9 aa, Homo Sapiens
CYTENFVAP

SEQ ID NO: 1093045 - protein, 9 aa, Homo Sapiens
EAPHESDDQ

SEQ ID NO: 1093046 - protein, 9 aa, Homo Sapiens
HGRGDSCFY

SEQ ID NO: 1093047 - protein, 9 aa, Homo Sapiens
ISDRDCASS

SEQ ID NO: 1093048 - protein, 9 aa, Homo Sapiens
WDPVAYPKV

SEQ ID NO: 1093049 - protein, 9 aa, Homo Sapiens
PRFGGKYCT

SEQ ID NO: 1093050 - protein, 9 aa, Homo Sapiens
RALPIIKSQ

SEQ ID NO: 1093051 - protein, 9 aa, Homo Sapiens
DFLEKFSGH

SEQ ID NO: 1093052 - protein, 9 aa, Homo Sapiens
KSPPMTVSP

SEQ ID NO: 1093053 - protein, 9 aa, Homo Sapiens
IIKSQLNKE

SEQ ID NO: 1093054 - protein, 9 aa, Homo Sapiens
RGAYLSKRQ

SEQ ID NO: 1093055 - protein, 9 aa, Homo Sapiens
LDVMCSPMI

SEQ ID NO: 1093056 - protein, 9 aa, Homo Sapiens
LLTRSPLKS

SEQ ID NO: 1093057 - protein, 9 aa, Homo Sapiens
MCRFIRFSF

SEQ ID NO: 1093058 - protein, 9 aa, Homo Sapiens
QTVSGTARQ

SEQ ID NO: 1093059 - protein, 9 aa, Homo Sapiens
GPPPQGDMQ

SEQ ID NO: 1093060 - protein, 9 aa, Homo Sapiens
MTFCVYSIL

SEQ ID NO: 1093061 - protein, 9 aa, Homo Sapiens
IVAPLLILD

SEQ ID NO: 1093062 - protein, 9 aa, Homo Sapiens
PGRPSSGQS

SEQ ID NO: 1093063 - protein, 9 aa, Homo Sapiens
IGVDLVMKT

SEQ ID NO: 1093064 - protein, 9 aa, Homo Sapiens
VLNAAQTVI

SEQ ID NO: 1093065 - protein, 9 aa, Homo Sapiens
PPPQGDMQG

SEQ ID NO: 1093066 - protein, 9 aa, Homo Sapiens
RPSSGQSIS

SEQ ID NO: 1093067 - protein, 9 aa, Homo Sapiens
PYQEKIYMT

SEQ ID NO: 1093068 - protein, 9 aa, Homo Sapiens
VVRPYVEDQ

SEQ ID NO: 1093069 - protein, 9 aa, Homo Sapiens
LFLHADEDF

SEQ ID NO: 1093070 - protein, 9 aa, Homo Sapiens
PPHSTTGTV

SEQ ID NO: 1093071 - protein, 9 aa, Homo Sapiens
EKIFAEISY

SEQ ID NO: 1093072 - protein, 9 aa, Homo Sapiens
SLHSSVATA

SEQ ID NO: 1093073 - protein, 9 aa, Homo Sapiens
SQDDYLLGI

SEQ ID NO: 1093074 - protein, 9 aa, Homo Sapiens
ILEPAQWIG

SEQ ID NO: 1093075 - protein, 9 aa, Homo Sapiens
ATQKTSSLL

SEQ ID NO: 1093076 - protein, 9 aa, Homo Sapiens
CDHSAARPD

SEQ ID NO: 1093077 - protein, 9 aa, Homo Sapiens
KHYEAKVYI

SEQ ID NO: 1093078 - protein, 9 aa, Homo Sapiens
GEMIKHYEA

SEQ ID NO: 1093079 - protein, 9 aa, Homo Sapiens
VLNKKRHIQ

SEQ ID NO: 1093080 - protein, 9 aa, Homo Sapiens
VKEAVDILM

SEQ ID NO: 1093081 - protein, 9 aa, Homo Sapiens
KRQELISEV

SEQ ID NO: 1093082 - protein, 9 aa, Homo Sapiens
DYAIASSSD

SEQ ID NO: 1093083 - protein, 9 aa, Homo Sapiens
FCLEKIFKE

SEQ ID NO: 1093084 - protein, 9 aa, Homo Sapiens
EPVLFLHAD

SEQ ID NO: 1093085 - protein, 9 aa, Homo Sapiens
GSEPSSGPL

SEQ ID NO: 1093086 - protein, 9 aa, Homo Sapiens
DPMCALFYC

SEQ ID NO: 1093087 - protein, 9 aa, Homo Sapiens
PCVLFLFYE

SEQ ID NO: 1093088 - protein, 9 aa, Homo Sapiens
CVRVDPFTD

SEQ ID NO: 1093089 - protein, 9 aa, Homo Sapiens
HSTTGTVHV

SEQ ID NO: 1093090 - protein, 9 aa, Homo Sapiens
EAPGPPKEP

SEQ ID NO: 1093091 - protein, 9 aa, Homo Sapiens
DLKPGQGPA

SEQ ID NO: 1093092 - protein, 9 aa, Homo Sapiens
EAPPLDRGF

SEQ ID NO: 1093093 - protein, 9 aa, Homo Sapiens
AVMKRRVTS

SEQ ID NO: 1093094 - protein, 9 aa, Homo Sapiens
PKVSSSLAL

SEQ ID NO: 1093095 - protein, 9 aa, Homo Sapiens
QHPALISNG

SEQ ID NO: 1093096 - protein, 9 aa, Homo Sapiens
SRLHTPRYF

SEQ ID NO: 1093097 - protein, 9 aa, Homo Sapiens
RFPPPIIKI

SEQ ID NO: 1093098 - protein, 9 aa, Homo Sapiens
ISYPEEEGD

SEQ ID NO: 1093099 - protein, 9 aa, Homo Sapiens
VSGTARQTD

SEQ ID NO: 1093100 - protein, 9 aa, Homo Sapiens
YDNHAIWYI

SEQ ID NO: 1093101 - protein, 9 aa, Homo Sapiens
DSEEEEEEM

SEQ ID NO: 1093102 - protein, 9 aa, Homo Sapiens
REVLPSHDS

SEQ ID NO: 1093103 - protein, 9 aa, Homo Sapiens
WWEKGKSPC

SEQ ID NO: 1093104 - protein, 9 aa, Homo Sapiens
KSPCVLFLF

SEQ ID NO: 1093105 - protein, 9 aa, Homo Sapiens
DSRLHTPRY

SEQ ID NO: 1093106 - protein, 9 aa, Homo Sapiens
YKEKSDKEH

SEQ ID NO: 1093107 - protein, 9 aa, Homo Sapiens
QLSEVDKSK

SEQ ID NO: 1093108 - protein, 9 aa, Homo Sapiens
TKIESLLGR

SEQ ID NO: 1093109 - protein, 9 aa, Homo Sapiens
AHTESKEAL

SEQ ID NO: 1093110 - protein, 9 aa, Homo Sapiens
KIESLLGRL

SEQ ID NO: 1093111 - protein, 9 aa, Homo Sapiens
CLEKIFKEL

SEQ ID NO: 1093112 - protein, 9 aa, Homo Sapiens
PVLNAAQTV

SEQ ID NO: 1093113 - protein, 9 aa, Homo Sapiens
CGLNRARMT

SEQ ID NO: 1093114 - protein, 9 aa, Homo Sapiens
CISDRDCAS

SEQ ID NO: 1093115 - protein, 9 aa, Homo Sapiens
CKWIIEAKP

SEQ ID NO: 1093116 - protein, 9 aa, Homo Sapiens
GAEAAPNLR

SEQ ID NO: 1093117 - protein, 9 aa, Homo Sapiens
VQMFVTLSN

SEQ ID NO: 1093118 - protein, 9 aa, Homo Sapiens
NCIIHFPSK

SEQ ID NO: 1093119 - protein, 9 aa, Homo Sapiens
GQHPASWPT

SEQ ID NO: 1093120 - protein, 9 aa, Homo Sapiens
IKDKVFSAC

SEQ ID NO: 1093121 - protein, 9 aa, Homo Sapiens
LNRVTPYQE

SEQ ID NO: 1093122 - protein, 9 aa, Homo Sapiens
TSGRRAIGR

SEQ ID NO: 1093123 - protein, 9 aa, Homo Sapiens
IISSGPIPT

SEQ ID NO: 1093124 - protein, 9 aa, Homo Sapiens
DLTPHQKER

SEQ ID NO: 1093125 - protein, 9 aa, Homo Sapiens
EWLCVRVDP

SEQ ID NO: 1093126 - protein, 9 aa, Homo Sapiens
SSGPLSVFT

SEQ ID NO: 1093127 - protein, 9 aa, Homo Sapiens
TARQTDDAA

SEQ ID NO: 1093128 - protein, 9 aa, Homo Sapiens
VRVDPFTDH

SEQ ID NO: 1093129 - protein, 9 aa, Homo Sapiens
KTKTTFFKR

SEQ ID NO: 1093130 - protein, 9 aa, Homo Sapiens
AVDILMTER

SEQ ID NO: 1093131 - protein, 9 aa, Homo Sapiens
ERCVEDPEM

SEQ ID NO: 1093132 - protein, 9 aa, Homo Sapiens
PQLQPHCEL

SEQ ID NO: 1093133 - protein, 9 aa, Homo Sapiens
AIGRRTSWA

SEQ ID NO: 1093134 - protein, 9 aa, Homo Sapiens
RCRLELWLR

SEQ ID NO: 1093135 - protein, 9 aa, Homo Sapiens
YYRRVRAAS

SEQ ID NO: 1093136 - protein, 9 aa, Homo Sapiens
SEAGNSGCD

SEQ ID NO: 1093137 - protein, 9 aa, Homo Sapiens
CKGKKFTHF

SEQ ID NO: 1093138 - protein, 9 aa, Homo Sapiens
FDPMCALFY

SEQ ID NO: 1093139 - protein, 9 aa, Homo Sapiens
NHWMIKTAK

SEQ ID NO: 1093140 - protein, 9 aa, Homo Sapiens
ESDDQRQVP

SEQ ID NO: 1093141 - protein, 9 aa, Homo Sapiens
LTPCYTENF

SEQ ID NO: 1093142 - protein, 9 aa, Homo Sapiens
TLLHFWLPF

SEQ ID NO: 1093143 - protein, 9 aa, Homo Sapiens
RAPKSSPVR

SEQ ID NO: 1093144 - protein, 9 aa, Homo Sapiens
RGLPVLPLP

SEQ ID NO: 1093145 - protein, 9 aa, Homo Sapiens
AKNHWMIKT

SEQ ID NO: 1093146 - protein, 9 aa, Homo Sapiens
SWDGRGPGA

SEQ ID NO: 1093147 - protein, 9 aa, Homo Sapiens
LPVLNAAQT

SEQ ID NO: 1093148 - protein, 9 aa, Homo Sapiens
LLQEDSSPP

SEQ ID NO: 1093149 - protein, 9 aa, Homo Sapiens
TAQYYQELY

SEQ ID NO: 1093150 - protein, 9 aa, Homo Sapiens
KVSSSLALC

SEQ ID NO: 1093151 - protein, 9 aa, Homo Sapiens
SSSLALCQC

SEQ ID NO: 1093152 - protein, 9 aa, Homo Sapiens
GPPKEPLLG

SEQ ID NO: 1093153 - protein, 9 aa, Homo Sapiens
DSESSSSSR

SEQ ID NO: 1093154 - protein, 9 aa, Homo Sapiens
SGILDVLHC

SEQ ID NO: 1093155 - protein, 9 aa, Homo Sapiens
EITRVIGTQ

SEQ ID NO: 1093156 - protein, 9 aa, Homo Sapiens
IFGDFMCRF

SEQ ID NO: 1093157 - protein, 9 aa, Homo Sapiens
PPQGDMQGP

SEQ ID NO: 1093158 - protein, 9 aa, Homo Sapiens
DCGSTRAGT

SEQ ID NO: 1093159 - protein, 9 aa, Homo Sapiens
SVKASHYRR

SEQ ID NO: 1093160 - protein, 9 aa, Homo Sapiens
RGETVKAEA

SEQ ID NO: 1093161 - protein, 9 aa, Homo Sapiens
ESLHSSVAT

SEQ ID NO: 1093162 - protein, 9 aa, Homo Sapiens
QELESEPVM

SEQ ID NO: 1093163 - protein, 9 aa, Homo Sapiens
PNLRYVPYG

SEQ ID NO: 1093164 - protein, 9 aa, Homo Sapiens
LNAAQTVIF

SEQ ID NO: 1093165 - protein, 9 aa, Homo Sapiens
PEPRFGGKY

SEQ ID NO: 1093166 - protein, 9 aa, Homo Sapiens
DKRSSCRQA

SEQ ID NO: 1093167 - protein, 9 aa, Homo Sapiens
YILTVAGNI

SEQ ID NO: 1093168 - protein, 9 aa, Homo Sapiens
AVPPTVHIT

SEQ ID NO: 1093169 - protein, 9 aa, Homo Sapiens
HLTHSVLFT

SEQ ID NO: 1093170 - protein, 9 aa, Homo Sapiens
EHRSIRGFI

SEQ ID NO: 1093171 - protein, 9 aa, Homo Sapiens
RKLRLIDWS

SEQ ID NO: 1093172 - protein, 9 aa, Homo Sapiens
YLSKRQELI

SEQ ID NO: 1093173 - protein, 9 aa, Homo Sapiens
RAAAEAALS

SEQ ID NO: 1093174 - protein, 9 aa, Homo Sapiens
TSSTVTSGR

SEQ ID NO: 1093175 - protein, 9 aa, Homo Sapiens
PGQHPASWP

SEQ ID NO: 1093176 - protein, 9 aa, Homo Sapiens
DFDSKPSWD

SEQ ID NO: 1093177 - protein, 9 aa, Homo Sapiens
TPYQEKIYM

SEQ ID NO: 1093178 - protein, 9 aa, Homo Sapiens
SLHCKWIIE

SEQ ID NO: 1093179 - protein, 9 aa, Homo Sapiens
VLDVMCSPM

SEQ ID NO: 1093180 - protein, 9 aa, Homo Sapiens
PIIKSQLNK

SEQ ID NO: 1093181 - protein, 9 aa, Homo Sapiens
QRIQGSEPS

SEQ ID NO: 1093182 - protein, 9 aa, Homo Sapiens
SAIASMFTC

SEQ ID NO: 1093183 - protein, 9 aa, Homo Sapiens
KERRYARKS

SEQ ID NO: 1093184 - protein, 9 aa, Homo Sapiens
ALELDGRCR

SEQ ID NO: 1093185 - protein, 9 aa, Homo Sapiens
EMVLNKKRH

SEQ ID NO: 1093186 - protein, 9 aa, Homo Sapiens
ANLLFKGCV

SEQ ID NO: 1093187 - protein, 9 aa, Homo Sapiens
HSRGPPGSR

SEQ ID NO: 1093188 - protein, 9 aa, Homo Sapiens
SLGPPPQGD

SEQ ID NO: 1093189 - protein, 9 aa, Homo Sapiens
FDGTKLSGK

SEQ ID NO: 1093190 - protein, 9 aa, Homo Sapiens
QEDSSPPLR

SEQ ID NO: 1093191 - protein, 9 aa, Homo Sapiens
KWIIEAKPG

SEQ ID NO: 1093192 - protein, 9 aa, Homo Sapiens
DSEEEAPRP

SEQ ID NO: 1093193 - protein, 9 aa, Homo Sapiens
SPMIAEDDI

SEQ ID NO: 1093194 - protein, 9 aa, Homo Sapiens
PLLVVAAFV

SEQ ID NO: 1093195 - protein, 9 aa, Homo Sapiens
CSTGPFSRA

SEQ ID NO: 1093196 - protein, 9 aa, Homo Sapiens
GRPSSGQSI

SEQ ID NO: 1093197 - protein, 9 aa, Homo Sapiens
PPTVHITYH

SEQ ID NO: 1093198 - protein, 9 aa, Homo Sapiens
SDCSTGPFS

SEQ ID NO: 1093199 - protein, 9 aa, Homo Sapiens
SMFTCNHTP

SEQ ID NO: 1093200 - protein, 9 aa, Homo Sapiens
KQEGPFFMD

SEQ ID NO: 1093201 - protein, 9 aa, Homo Sapiens
FVPKSPPMT

SEQ ID NO: 1093202 - protein, 9 aa, Homo Sapiens
NNLLLRKDA

SEQ ID NO: 1093203 - protein, 9 aa, Homo Sapiens
TIGAGSEGW

SEQ ID NO: 1093204 - protein, 9 aa, Homo Sapiens
WDGRGPGAP

SEQ ID NO: 1093205 - protein, 9 aa, Homo Sapiens
GQSISDSVP

SEQ ID NO: 1093206 - protein, 9 aa, Homo Sapiens
IKLNYTLPP

SEQ ID NO: 1093207 - protein, 9 aa, Homo Sapiens
NPEPRFGGK

SEQ ID NO: 1093208 - protein, 9 aa, Homo Sapiens
SSHSSEAGN

SEQ ID NO: 1093209 - protein, 9 aa, Homo Sapiens
HLWPPILLQ

SEQ ID NO: 1093210 - protein, 9 aa, Homo Sapiens
RQTDDAAPT

SEQ ID NO: 1093211 - protein, 9 aa, Homo Sapiens
QHVTIRDYS

SEQ ID NO: 1093212 - protein, 9 aa, Homo Sapiens
LRKDACSWS

SEQ ID NO: 1093213 - protein, 9 aa, Homo Sapiens
RARMTFCVY

SEQ ID NO: 1093214 - protein, 9 aa, Homo Sapiens
AWKIKLNYT

SEQ ID NO: 1093215 - protein, 9 aa, Homo Sapiens
GPFFMDFNS

SEQ ID NO: 1093216 - protein, 9 aa, Homo Sapiens
ALCDHSAAR

SEQ ID NO: 1093217 - protein, 9 aa, Homo Sapiens
GETVKAEAF

SEQ ID NO: 1093218 - protein, 9 aa, Homo Sapiens
YKCSCEMVL

SEQ ID NO: 1093219 - protein, 9 aa, Homo Sapiens
NSNFVTIGA

SEQ ID NO: 1093220 - protein, 9 aa, Homo Sapiens
GKELPADLG

SEQ ID NO: 1093221 - protein, 9 aa, Homo Sapiens
KIVALNMGV

SEQ ID NO: 1093222 - protein, 9 aa, Homo Sapiens
NSTQEEWSL

SEQ ID NO: 1093223 - protein, 9 aa, Homo Sapiens
EVDKSKEEL

SEQ ID NO: 1093224 - protein, 9 aa, Homo Sapiens
FTQGHQPCK

SEQ ID NO: 1093225 - protein, 9 aa, Homo Sapiens
KDKVFSACY

SEQ ID NO: 1093226 - protein, 9 aa, Homo Sapiens
PQNIYWEHR

SEQ ID NO: 1093227 - protein, 9 aa, Homo Sapiens
TKTTFFKRG

SEQ ID NO: 1093228 - protein, 9 aa, Homo Sapiens
EPRFGGKYC

SEQ ID NO: 1093229 - protein, 9 aa, Homo Sapiens
SKPSWDDQV

SEQ ID NO: 1093230 - protein, 9 aa, Homo Sapiens
IKTKIESLL

SEQ ID NO: 1093231 - protein, 9 aa, Homo Sapiens
VMKRRVTSQ

SEQ ID NO: 1093232 - protein, 9 aa, Homo Sapiens
PAAGPRGIL

SEQ ID NO: 1093233 - protein, 9 aa, Homo Sapiens
PTCGSTTSS

SEQ ID NO: 1093234 - protein, 9 aa, Homo Sapiens
SEEEEEEMA

SEQ ID NO: 1093235 - protein, 9 aa, Homo Sapiens
FTSAIASMF

SEQ ID NO: 1093236 - protein, 9 aa, Homo Sapiens
STLHSRGPP

SEQ ID NO: 1093237 - protein, 9 aa, Homo Sapiens
GSPPHSTTG

SEQ ID NO: 1093238 - protein, 9 aa, Homo Sapiens
IGRRTSWAH

SEQ ID NO: 1093239 - protein, 9 aa, Homo Sapiens
YSVSWYQQR

SEQ ID NO: 1093240 - protein, 9 aa, Homo Sapiens
KIKLNYTLP

SEQ ID NO: 1093241 - protein, 9 aa, Homo Sapiens
HSSVATAIN

SEQ ID NO: 1093242 - protein, 9 aa, Homo Sapiens
GYISEEVAD

SEQ ID NO: 1093243 - protein, 9 aa, Homo Sapiens
IHQPRAHTE

SEQ ID NO: 1093244 - protein, 9 aa, Homo Sapiens
NYTLPPPLH

SEQ ID NO: 1093245 - protein, 9 aa, Homo Sapiens
MQVTVGSAK

SEQ ID NO: 1093246 - protein, 9 aa, Homo Sapiens
HQPCKCKAC

SEQ ID NO: 1093247 - protein, 9 aa, Homo Sapiens
SRSWDGRGP

SEQ ID NO: 1093248 - protein, 9 aa, Homo Sapiens
TIRDYSVSW

SEQ ID NO: 1093249 - protein, 9 aa, Homo Sapiens
CVEDPEMGL

SEQ ID NO: 1093250 - protein, 9 aa, Homo Sapiens
NGHLTHSVL

SEQ ID NO: 1093251 - protein, 9 aa, Homo Sapiens
KGKKFTHFD

SEQ ID NO: 1093252 - protein, 9 aa, Homo Sapiens
EVLMNSKVT

SEQ ID NO: 1093253 - protein, 9 aa, Homo Sapiens
RLCNNPEPR

SEQ ID NO: 1093254 - protein, 9 aa, Homo Sapiens
NLSMAQGRH

SEQ ID NO: 1093255 - protein, 9 aa, Homo Sapiens
EPYLWDPVA

SEQ ID NO: 1093256 - protein, 9 aa, Homo Sapiens
APHESDDQR

SEQ ID NO: 1093257 - protein, 9 aa, Homo Sapiens
DCVFYQRIR

SEQ ID NO: 1093258 - protein, 9 aa, Homo Sapiens
HPALISNGC

SEQ ID NO: 1093259 - protein, 9 aa, Homo Sapiens
VKAEAFDSV

SEQ ID NO: 1093260 - protein, 9 aa, Homo Sapiens
PVLFLHADE

SEQ ID NO: 1093261 - protein, 9 aa, Homo Sapiens
MKRRVTSQR

SEQ ID NO: 1093262 - protein, 9 aa, Homo Sapiens
ACYTILTPL

SEQ ID NO: 1093263 - protein, 9 aa, Homo Sapiens
KMTVGKKSV

SEQ ID NO: 1093264 - protein, 9 aa, Homo Sapiens
VTIGAGSEG

SEQ ID NO: 1093265 - protein, 9 aa, Homo Sapiens
YAAPRVHIL

SEQ ID NO: 1093266 - protein, 9 aa, Homo Sapiens
MGLCRLSTK

SEQ ID NO: 1093267 - protein, 9 aa, Homo Sapiens
GGSPPHSTT

SEQ ID NO: 1093268 - protein, 9 aa, Homo Sapiens
EAVDILMTE

SEQ ID NO: 1093269 - protein, 9 aa, Homo Sapiens
KEPLLGELT

SEQ ID NO: 1093270 - protein, 9 aa, Homo Sapiens
RKMIHELLD

SEQ ID NO: 1093271 - protein, 9 aa, Homo Sapiens
LISNGCQVS

SEQ ID NO: 1093272 - protein, 9 aa, Homo Sapiens
LGPPPQGDM

SEQ ID NO: 1093273 - protein, 9 aa, Homo Sapiens
LHVAPEEHP

SEQ ID NO: 1093274 - protein, 9 aa, Homo Sapiens
CILTDSESS

SEQ ID NO: 1093275 - protein, 9 aa, Homo Sapiens
LQHPEGDYA

SEQ ID NO: 1093276 - protein, 9 aa, Homo Sapiens
LRAAAEAAL

SEQ ID NO: 1093277 - protein, 9 aa, Homo Sapiens
LVVASPSLP

SEQ ID NO: 1093278 - protein, 9 aa, Homo Sapiens
SPVKLENMS

SEQ ID NO: 1093279 - protein, 9 aa, Homo Sapiens
DNDKRSSCR

SEQ ID NO: 1093280 - protein, 9 aa, Homo Sapiens
STGKCLETL

SEQ ID NO: 1093281 - protein, 9 aa, Homo Sapiens
RSPPGQHPA

SEQ ID NO: 1093282 - protein, 9 aa, Homo Sapiens
LTVKIGNFG

SEQ ID NO: 1093283 - protein, 9 aa, Homo Sapiens
SLAEFYHPG

SEQ ID NO: 1093284 - protein, 9 aa, Homo Sapiens
CRLELWLRS

SEQ ID NO: 1093285 - protein, 9 aa, Homo Sapiens
NFVTIGAGS

SEQ ID NO: 1093286 - protein, 9 aa, Homo Sapiens
EDCVFYQRI

SEQ ID NO: 1093287 - protein, 9 aa, Homo Sapiens
DILMTERLG

SEQ ID NO: 1093288 - protein, 9 aa, Homo Sapiens
SPSLPETCC

SEQ ID NO: 1093289 - protein, 9 aa, Homo Sapiens
QLQPHCELQ

SEQ ID NO: 1093290 - protein, 9 aa, Homo Sapiens
IQEPYYRRV

SEQ ID NO: 1093291 - protein, 9 aa, Homo Sapiens
VRARRGLPV

SEQ ID NO: 1093292 - protein, 9 aa, Homo Sapiens
ISEEVADSR

SEQ ID NO: 1093293 - protein, 9 aa, Homo Sapiens
SLMFWKDEA

SEQ ID NO: 1093294 - protein, 9 aa, Homo Sapiens
HGDLKPGQG

SEQ ID NO: 1093295 - protein, 9 aa, Homo Sapiens
AFEGGTFKR

SEQ ID NO: 1093296 - protein, 9 aa, Homo Sapiens
NNLVVASPS

SEQ ID NO: 1093297 - protein, 9 aa, Homo Sapiens
SGHYHSLCK

SEQ ID NO: 1093298 - protein, 9 aa, Homo Sapiens
YALAIVINV

SEQ ID NO: 1093299 - protein, 9 aa, Homo Sapiens
EEFTPTPAS

SEQ ID NO: 1093300 - protein, 9 aa, Homo Sapiens
FKGCVDSNW

SEQ ID NO: 1093301 - protein, 9 aa, Homo Sapiens
DKSKEELTE

SEQ ID NO: 1093302 - protein, 9 aa, Homo Sapiens
IYALAIVIN

SEQ ID NO: 1093303 - protein, 9 aa, Homo Sapiens
NHAIWYIVG

SEQ ID NO: 1093304 - protein, 9 aa, Homo Sapiens
FVLPGAGGT

SEQ ID NO: 1093305 - protein, 9 aa, Homo Sapiens
FRPNGHLTH

SEQ ID NO: 1093306 - protein, 9 aa, Homo Sapiens
YARKSEPIR

SEQ ID NO: 1093307 - protein, 9 aa, Homo Sapiens
APGPPKEPL

SEQ ID NO: 1093308 - protein, 9 aa, Homo Sapiens
LLFKGCVDS

SEQ ID NO: 1093309 - protein, 9 aa, Homo Sapiens
GDMQGPPGP

SEQ ID NO: 1093310 - protein, 9 aa, Homo Sapiens
SPPHSTTGT

SEQ ID NO: 1093311 - protein, 9 aa, Homo Sapiens
TRAGTDNDP

SEQ ID NO: 1093312 - protein, 9 aa, Homo Sapiens
SHSSEAGNS

SEQ ID NO: 1093313 - protein, 9 aa, Homo Sapiens
MVKVWDCST

SEQ ID NO: 1093314 - protein, 9 aa, Homo Sapiens
KCSCEMVLN

SEQ ID NO: 1093315 - protein, 9 aa, Homo Sapiens
EMIKHYEAK

SEQ ID NO: 1093316 - protein, 9 aa, Homo Sapiens
ERRYARKSE

SEQ ID NO: 1093317 - protein, 9 aa, Homo Sapiens
SLPETCCIL

SEQ ID NO: 1093318 - protein, 9 aa, Homo Sapiens
RKSEPIRRK

SEQ ID NO: 1093319 - protein, 9 aa, Homo Sapiens
TVSGTARQT

SEQ ID NO: 1093320 - protein, 9 aa, Homo Sapiens
LLLTPCYTE

SEQ ID NO: 1093321 - protein, 9 aa, Homo Sapiens
EMGLCLLPL

SEQ ID NO: 1093322 - protein, 9 aa, Homo Sapiens
RDCGSTRAG

SEQ ID NO: 1093323 - protein, 9 aa, Homo Sapiens
RKDACSWST

SEQ ID NO: 1093324 - protein, 9 aa, Homo Sapiens
ASPSLPETC

SEQ ID NO: 1093325 - protein, 9 aa, Homo Sapiens
QLRDVRARR

SEQ ID NO: 1093326 - protein, 9 aa, Homo Sapiens
LLKRTVQSI

SEQ ID NO: 1093327 - protein, 9 aa, Homo Sapiens
EDSSPPLRC

SEQ ID NO: 1093328 - protein, 9 aa, Homo Sapiens
EGYISEEVA

SEQ ID NO: 1093329 - protein, 9 aa, Homo Sapiens
RARRGLPVL

SEQ ID NO: 1093330 - protein, 9 aa, Homo Sapiens
LALYILTVA

SEQ ID NO: 1093331 - protein, 9 aa, Homo Sapiens
SWPTCGSTT

SEQ ID NO: 1093332 - protein, 9 aa, Homo Sapiens
LCRLSTKVW

SEQ ID NO: 1093333 - protein, 9 aa, Homo Sapiens
LWLHLATRA

SEQ ID NO: 1093334 - protein, 9 aa, Homo Sapiens
TAPTVRSPP

SEQ ID NO: 1093335 - protein, 9 aa, Homo Sapiens
EDVAVNSTQ

SEQ ID NO: 1093336 - protein, 9 aa, Homo Sapiens
KSVNLNKRD

SEQ ID NO: 1093337 - protein, 9 aa, Homo Sapiens
TCGSTTSST

SEQ ID NO: 1093338 - protein, 9 aa, Homo Sapiens
RRVIEVLMN

SEQ ID NO: 1093339 - protein, 9 aa, Homo Sapiens
NLMTSVPLK

SEQ ID NO: 1093340 - protein, 9 aa, Homo Sapiens
KQERQQQQD

SEQ ID NO: 1093341 - protein, 9 aa, Homo Sapiens
GDYAIASSS

SEQ ID NO: 1093342 - protein, 9 aa, Homo Sapiens
HDVRFPPPI

SEQ ID NO: 1093343 - protein, 9 aa, Homo Sapiens
TPRYFLLAN

SEQ ID NO: 1093344 - protein, 9 aa, Homo Sapiens
NDKRSSCRQ

SEQ ID NO: 1093345 - protein, 9 aa, Homo Sapiens
VLFLHADED

SEQ ID NO: 1093346 - protein, 9 aa, Homo Sapiens
EPSSGPLSV

SEQ ID NO: 1093347 - protein, 9 aa, Homo Sapiens
RRAIGRRTS

SEQ ID NO: 1093348 - protein, 9 aa, Homo Sapiens
ENFVAPEVL

SEQ ID NO: 1093349 - protein, 9 aa, Homo Sapiens
LMFWKDEAF

SEQ ID NO: 1093350 - protein, 9 aa, Homo Sapiens
EAALSQTGF

SEQ ID NO: 1093351 - protein, 9 aa, Homo Sapiens
ESDCSTGPF

SEQ ID NO: 1093352 - protein, 9 aa, Homo Sapiens
QWIGILNSN

SEQ ID NO: 1093353 - protein, 9 aa, Homo Sapiens
SNFVTIGAG

SEQ ID NO: 1093354 - protein, 9 aa, Homo Sapiens
GILNSNEHL

SEQ ID NO: 1093355 - protein, 9 aa, Homo Sapiens
FYLDPQLQP

SEQ ID NO: 1093356 - protein, 9 aa, Homo Sapiens
DLNTEGYIS

SEQ ID NO: 1093357 - protein, 9 aa, Homo Sapiens
KEAVDILMT

SEQ ID NO: 1093358 - protein, 9 aa, Homo Sapiens
RSRGHGRGD

SEQ ID NO: 1093359 - protein, 9 aa, Homo Sapiens
WIFGDFMCR

SEQ ID NO: 1093360 - protein, 9 aa, Homo Sapiens
YPEEEGDLA

SEQ ID NO: 1093361 - protein, 9 aa, Homo Sapiens
RTVQSIEAC

SEQ ID NO: 1093362 - protein, 9 aa, Homo Sapiens
SEVDKSKEE

SEQ ID NO: 1093363 - protein, 9 aa, Homo Sapiens
SSRRSGTAP

SEQ ID NO: 1093364 - protein, 9 aa, Homo Sapiens
TNRARIVAP

SEQ ID NO: 1093365 - protein, 9 aa, Homo Sapiens
VAAFVLPGA

SEQ ID NO: 1093366 - protein, 9 aa, Homo Sapiens
AITPWNVPL

SEQ ID NO: 1093367 - protein, 9 aa, Homo Sapiens
VPLKVSQNW

SEQ ID NO: 1093368 - protein, 9 aa, Homo Sapiens
YEAKVYIPP

SEQ ID NO: 1093369 - protein, 9 aa, Homo Sapiens
TFYNELHVA

SEQ ID NO: 1093370 - protein, 9 aa, Homo Sapiens
CVFYQRIRS

SEQ ID NO: 1093371 - protein, 9 aa, Homo Sapiens
WIGILNSNE

SEQ ID NO: 1093372 - protein, 9 aa, Homo Sapiens
VIEVLMNSK

SEQ ID NO: 1093373 - protein, 9 aa, Homo Sapiens
QKTSSLLTR

SEQ ID NO: 1093374 - protein, 9 aa, Homo Sapiens
DRHEWLCVR

SEQ ID NO: 1093375 - protein, 9 aa, Homo Sapiens
RSGTAPTVR

SEQ ID NO: 1093376 - protein, 9 aa, Homo Sapiens
RSLHMLSVK

SEQ ID NO: 1093377 - protein, 9 aa, Homo Sapiens
LCNNPEPRF

SEQ ID NO: 1093378 - protein, 9 aa, Homo Sapiens
HVTIRDYSV

SEQ ID NO: 1093379 - protein, 9 aa, Homo Sapiens
IRALPIIKS

SEQ ID NO: 1093380 - protein, 9 aa, Homo Sapiens
PSSGQSISD

SEQ ID NO: 1093381 - protein, 9 aa, Homo Sapiens
LTQIKTKIE

SEQ ID NO: 1093382 - protein, 9 aa, Homo Sapiens
GMGLCRLST

SEQ ID NO: 1093383 - protein, 9 aa, Homo Sapiens
ERIGVDLVM

SEQ ID NO: 1093384 - protein, 9 aa, Homo Sapiens
AGPRGILLT

SEQ ID NO: 1093385 - protein, 9 aa, Homo Sapiens
LSQTGFSYD

SEQ ID NO: 1093386 - protein, 9 aa, Homo Sapiens
FGKIVALNM

SEQ ID NO: 1093387 - protein, 9 aa, Homo Sapiens
GTARQTDDA

SEQ ID NO: 1093388 - protein, 9 aa, Homo Sapiens
SWDDQVEEE

SEQ ID NO: 1093389 - protein, 9 aa, Homo Sapiens
TVTSGRRAI

SEQ ID NO: 1093390 - protein, 9 aa, Homo Sapiens
IGNFGLATV

SEQ ID NO: 1093391 - protein, 9 aa, Homo Sapiens
PETLQAKNH

SEQ ID NO: 1093392 - protein, 9 aa, Homo Sapiens
ELNCIIHFP

SEQ ID NO: 1093393 - protein, 9 aa, Homo Sapiens
PLVYDNHAI

SEQ ID NO: 1093394 - protein, 9 aa, Homo Sapiens
FSACYTILT

SEQ ID NO: 1093395 - protein, 9 aa, Homo Sapiens
KFTHFDEVR

SEQ ID NO: 1093396 - protein, 9 aa, Homo Sapiens
LEPAQWIGI

SEQ ID NO: 1093397 - protein, 9 aa, Homo Sapiens
VKLENMSLQ

SEQ ID NO: 1093398 - protein, 9 aa, Homo Sapiens
ARKSEPIRR

SEQ ID NO: 1093399 - protein, 9 aa, Homo Sapiens
YQELYEILE

SEQ ID NO: 1093400 - protein, 9 aa, Homo Sapiens
RSIRGFIWW

SEQ ID NO: 1093401 - protein, 9 aa, Homo Sapiens
EVLPSHDSS

SEQ ID NO: 1093402 - protein, 9 aa, Homo Sapiens
DKVFSACYT

SEQ ID NO: 1093403 - protein, 9 aa, Homo Sapiens
TRVIGTQVY

SEQ ID NO: 1093404 - protein, 9 aa, Homo Sapiens
PDLEESDCS

SEQ ID NO: 1093405 - protein, 9 aa, Homo Sapiens
MHRVARYAA

SEQ ID NO: 1093406 - protein, 9 aa, Homo Sapiens
PRGILLTRT

SEQ ID NO: 1093407 - protein, 9 aa, Homo Sapiens
LALCQCIAI

SEQ ID NO: 1093408 - protein, 9 aa, Homo Sapiens
VLMNSKVTE

SEQ ID NO: 1093409 - protein, 9 aa, Homo Sapiens
NMGVSILYT

SEQ ID NO: 1093410 - protein, 9 aa, Homo Sapiens
TNLMTSVPL

SEQ ID NO: 1093411 - protein, 9 aa, Homo Sapiens
PGPPKEPLL

SEQ ID NO: 1093412 - protein, 9 aa, Homo Sapiens
KPVQVCDSC

SEQ ID NO: 1093413 - protein, 9 aa, Homo Sapiens
IIRFTSWQT

SEQ ID NO: 1093414 - protein, 9 aa, Homo Sapiens
STQEEWSLL

SEQ ID NO: 1093415 - protein, 9 aa, Homo Sapiens
WLCVRVDPF

SEQ ID NO: 1093416 - protein, 9 aa, Homo Sapiens
HCKGKKFTH

SEQ ID NO: 1093417 - protein, 9 aa, Homo Sapiens
SVPLKVSQN

SEQ ID NO: 1093418 - protein, 9 aa, Homo Sapiens
TERIGVDLV

SEQ ID NO: 1093419 - protein, 9 aa, Homo Sapiens
QIKTKIESL

SEQ ID NO: 1093420 - protein, 9 aa, Homo Sapiens
SVNLNKRDM

SEQ ID NO: 1093421 - protein, 9 aa, Homo Sapiens
FMEYFCLEK

SEQ ID NO: 1093422 - protein, 9 aa, Homo Sapiens
KEITRVIGT

SEQ ID NO: 1093423 - protein, 9 aa, Homo Sapiens
DFMCRFIRF

SEQ ID NO: 1093424 - protein, 9 aa, Homo Sapiens
ETCISDRDC

SEQ ID NO: 1093425 - protein, 9 aa, Homo Sapiens
LFKGCVDSN

SEQ ID NO: 1093426 - protein, 9 aa, Homo Sapiens
YNELHVAPE

SEQ ID NO: 1093427 - protein, 9 aa, Homo Sapiens
DWSLAEFYH

SEQ ID NO: 1093428 - protein, 9 aa, Homo Sapiens
TVQSIEACI

SEQ ID NO: 1093429 - protein, 9 aa, Homo Sapiens
HYEAKVYIP

SEQ ID NO: 1093430 - protein, 9 aa, Homo Sapiens
PYLWDPVAY

SEQ ID NO: 1093431 - protein, 9 aa, Homo Sapiens
AQYYQELYE

SEQ ID NO: 1093432 - protein, 9 aa, Homo Sapiens
PEGDYAIAS

SEQ ID NO: 1093433 - protein, 9 aa, Homo Sapiens
KLNYTLPPP

SEQ ID NO: 1093434 - protein, 9 aa, Homo Sapiens
LAIVINVDH

SEQ ID NO: 1093435 - protein, 9 aa, Homo Sapiens
RFIRFSFHF

SEQ ID NO: 1093436 - protein, 9 aa, Homo Sapiens
PTVVDPVSL

SEQ ID NO: 1093437 - protein, 9 aa, Homo Sapiens
AAFVLPGAG

SEQ ID NO: 1093438 - protein, 9 aa, Homo Sapiens
AALSQTGFS

SEQ ID NO: 1093439 - protein, 9 aa, Homo Sapiens
EEAPHESDD

SEQ ID NO: 1093440 - protein, 9 aa, Homo Sapiens
ILLTRTGTR

SEQ ID NO: 1093441 - protein, 9 aa, Homo Sapiens
ILMTERLGH

SEQ ID NO: 1093442 - protein, 9 aa, Homo Sapiens
RIVAPLLIL

SEQ ID NO: 1093443 - protein, 9 aa, Homo Sapiens
NVPLLMLVW

SEQ ID NO: 1093444 - protein, 9 aa, Homo Sapiens
LSKKTLLHF

SEQ ID NO: 1093445 - protein, 9 aa, Homo Sapiens
GKTKTTFFK

SEQ ID NO: 1093446 - protein, 9 aa, Homo Sapiens
SESSSSSRR

SEQ ID NO: 1093447 - protein, 9 aa, Homo Sapiens
LSVKASHYR

SEQ ID NO: 1093448 - protein, 9 aa, Homo Sapiens
SEPIRRKGN

SEQ ID NO: 1093449 - protein, 9 aa, Homo Sapiens
FDDDDDVRQ

SEQ ID NO: 1093450 - protein, 9 aa, Homo Sapiens
GVDLVMKTC

SEQ ID NO: 1093451 - protein, 9 aa, Homo Sapiens
LTDSESSSS

SEQ ID NO: 1093452 - protein, 9 aa, Homo Sapiens
SSPPLRCAL

SEQ ID NO: 1093453 - protein, 9 aa, Homo Sapiens
LGNSLVLWV

SEQ ID NO: 1093454 - protein, 9 aa, Homo Sapiens
LVVAAFVLP

SEQ ID NO: 1093455 - protein, 9 aa, Homo Sapiens
TLHSRGPPG

SEQ ID NO: 1093456 - protein, 9 aa, Homo Sapiens
RAHTESKEA

SEQ ID NO: 1093457 - protein, 9 aa, Homo Sapiens
TEGYISEEV

SEQ ID NO: 1093458 - protein, 9 aa, Homo Sapiens
EAKVYIPPI

SEQ ID NO: 1093459 - protein, 9 aa, Homo Sapiens
LMNSKVTEA

SEQ ID NO: 1093460 - protein, 9 aa, Homo Sapiens
RAGTDNDPN

SEQ ID NO: 1093461 - protein, 9 aa, Homo Sapiens
IGILNSNEH

SEQ ID NO: 1093462 - protein, 9 aa, Homo Sapiens
HSSEAGNSG

SEQ ID NO: 1093463 - protein, 9 aa, Homo Sapiens
PFFMDFNSI

SEQ ID NO: 1093464 - protein, 9 aa, Homo Sapiens
AIASMFTCN

SEQ ID NO: 1093465 - protein, 9 aa, Homo Sapiens
KDACSWSTG

SEQ ID NO: 1093466 - protein, 9 aa, Homo Sapiens
HWMIKTAKK

SEQ ID NO: 1093467 - protein, 9 aa, Homo Sapiens
MSLQHEQRA

SEQ ID NO: 1093468 - protein, 9 aa, Homo Sapiens
SAARPDQLS

SEQ ID NO: 1093469 - protein, 9 aa, Homo Sapiens
DVAVNSTQE

SEQ ID NO: 1093470 - protein, 9 aa, Homo Sapiens
TSSLLTRSP

SEQ ID NO: 1093471 - protein, 9 aa, Homo Sapiens
DRDCASSSG

SEQ ID NO: 1093472 - protein, 9 aa, Homo Sapiens
FIHQPRAHT

SEQ ID NO: 1093473 - protein, 9 aa, Homo Sapiens
VAVPPTVHI

SEQ ID NO: 1093474 - protein, 9 aa, Homo Sapiens
FIEDGKTKT

SEQ ID NO: 1093475 - protein, 9 aa, Homo Sapiens
DNHAIWYIV

SEQ ID NO: 1093476 - protein, 9 aa, Homo Sapiens
LTAVMKRRV

SEQ ID NO: 1093477 - protein, 9 aa, Homo Sapiens
LLHFWLPFG

SEQ ID NO: 1093478 - protein, 9 aa, Homo Sapiens
VFYQRIRSR

SEQ ID NO: 1093479 - protein, 9 aa, Homo Sapiens
PEHVAVPPT

SEQ ID NO: 1093480 - protein, 9 aa, Homo Sapiens
TGRFTQGHQ

SEQ ID NO: 1093481 - protein, 9 aa, Homo Sapiens
FAEISYPEE

SEQ ID NO: 1093482 - protein, 9 aa, Homo Sapiens
PALISNGCQ

SEQ ID NO: 1093483 - protein, 9 aa, Homo Sapiens
HRSIRGFIW

SEQ ID NO: 1093484 - protein, 9 aa, Homo Sapiens
SCEMVLNKK

SEQ ID NO: 1093485 - protein, 9 aa, Homo Sapiens
SHTLWLHLA

SEQ ID NO: 1093486 - protein, 9 aa, Homo Sapiens
HFDEVRLEI

SEQ ID NO: 1093487 - protein, 9 aa, Homo Sapiens
KDSAFEGGT

SEQ ID NO: 1093488 - protein, 9 aa, Homo Sapiens
IYLIRALPI

SEQ ID NO: 1093489 - protein, 9 aa, Homo Sapiens
FTHFDEVRL

SEQ ID NO: 1093490 - protein, 9 aa, Homo Sapiens
SPPGQHPAS

SEQ ID NO: 1093491 - protein, 9 aa, Homo Sapiens
FLHADEDFV

SEQ ID NO: 1093492 - protein, 9 aa, Homo Sapiens
STAQYYQEL

SEQ ID NO: 1093493 - protein, 9 aa, Homo Sapiens
ETVKAEAFD

SEQ ID NO: 1093494 - protein, 9 aa, Homo Sapiens
VVDPVSLMF

SEQ ID NO: 1093495 - protein, 9 aa, Homo Sapiens
LVFTSAIAS

SEQ ID NO: 1093496 - protein, 9 aa, Homo Sapiens
YLDPQLQPH

SEQ ID NO: 1093497 - protein, 9 aa, Homo Sapiens
CGSTRAGTD

SEQ ID NO: 1093498 - protein, 9 aa, Homo Sapiens
NRVTPYQEK

SEQ ID NO: 1093499 - protein, 9 aa, Homo Sapiens
CSCEMVLNK

SEQ ID NO: 1093500 - protein, 9 aa, Homo Sapiens
DAHSHTLWL

SEQ ID NO: 1093501 - protein, 9 aa, Homo Sapiens
RWLGSTLHS

SEQ ID NO: 1093502 - protein, 9 aa, Homo Sapiens
GSTRSRGHG

SEQ ID NO: 1093503 - protein, 9 aa, Homo Sapiens
IIIRFTSWQ

SEQ ID NO: 1093504 - protein, 9 aa, Homo Sapiens
LIDLTPHQK

SEQ ID NO: 1093505 - protein, 9 aa, Homo Sapiens
LHFWLPFGF

SEQ ID NO: 1093506 - protein, 9 aa, Homo Sapiens
DDQVEEEGE

SEQ ID NO: 1093507 - protein, 9 aa, Homo Sapiens
SCRQATVNV

SEQ ID NO: 1093508 - protein, 9 aa, Homo Sapiens
AGESKDSAF

SEQ ID NO: 1093509 - protein, 9 aa, Homo Sapiens
TVKAEAFDS

SEQ ID NO: 1093510 - protein, 9 aa, Homo Sapiens
YTENFVAPE

SEQ ID NO: 1093511 - protein, 9 aa, Homo Sapiens
GSRIHKEKS

SEQ ID NO: 1093512 - protein, 9 aa, Homo Sapiens
REEPVLFLH

SEQ ID NO: 1093513 - protein, 9 aa, Homo Sapiens
VMCSPMIAE

SEQ ID NO: 1093514 - protein, 9 aa, Homo Sapiens
AQTVSGTAR

SEQ ID NO: 1093515 - protein, 9 aa, Homo Sapiens
VDKSKEELT

SEQ ID NO: 1093516 - protein, 9 aa, Homo Sapiens
SVQMFVTLS

SEQ ID NO: 1093517 - protein, 9 aa, Homo Sapiens
LNRARMTFC

SEQ ID NO: 1093518 - protein, 9 aa, Homo Sapiens
GSTRAGTDN

SEQ ID NO: 1093519 - protein, 9 aa, Homo Sapiens
TVENEDPSP

SEQ ID NO: 1093520 - protein, 9 aa, Homo Sapiens
FMDFNSIIP

SEQ ID NO: 1093521 - protein, 9 aa, Homo Sapiens
DPKVSSSLA

SEQ ID NO: 1093522 - protein, 9 aa, Homo Sapiens
PRAHTESKE

SEQ ID NO: 1093523 - protein, 9 aa, Homo Sapiens
DHSAARPDQ

SEQ ID NO: 1093524 - protein, 9 aa, Homo Sapiens
GHGRGDSCF

SEQ ID NO: 1093525 - protein, 9 aa, Homo Sapiens
SPALQYLES

SEQ ID NO: 1093526 - protein, 9 aa, Homo Sapiens
LHADEDFVS

SEQ ID NO: 1093527 - protein, 9 aa, Homo Sapiens
KAEAFDSVT

SEQ ID NO: 1093528 - protein, 9 aa, Homo Sapiens
AFEDVAVNS

SEQ ID NO: 1093529 - protein, 9 aa, Homo Sapiens
PSSPKPVQV

SEQ ID NO: 1093530 - protein, 9 aa, Homo Sapiens
LWPPILLQN

SEQ ID NO: 1093531 - protein, 9 aa, Homo Sapiens
LSEVDKSKE

SEQ ID NO: 1093532 - protein, 9 aa, Homo Sapiens
LELDGRCRL

SEQ ID NO: 1093533 - protein, 9 aa, Homo Sapiens
DPSPCARTG

SEQ ID NO: 1093534 - protein, 9 aa, Homo Sapiens
ETLQAKNHW

SEQ ID NO: 1093535 - protein, 9 aa, Homo Sapiens
DIQEPYYRR

SEQ ID NO: 1093536 - protein, 9 aa, Homo Sapiens
GTKLSGKEL

SEQ ID NO: 1093537 - protein, 9 aa, Homo Sapiens
AIVINVDHS

SEQ ID NO: 1093538 - protein, 9 aa, Homo Sapiens
CYTILTPLL

SEQ ID NO: 1093539 - protein, 9 aa, Homo Sapiens
KVWDCSTGK

SEQ ID NO: 1093540 - protein, 9 aa, Homo Sapiens
PLKVSQNWI

SEQ ID NO: 1093541 - protein, 9 aa, Homo Sapiens
SAFEGGTFK

SEQ ID NO: 1093542 - protein, 9 aa, Homo Sapiens
IVALNMGVS

SEQ ID NO: 1093543 - protein, 9 aa, Homo Sapiens
LPEATLLII

SEQ ID NO: 1093544 - protein, 9 aa, Homo Sapiens
YKDSLHCKW

SEQ ID NO: 1093545 - protein, 9 aa, Homo Sapiens
VASPSLPET

SEQ ID NO: 1093546 - protein, 9 aa, Homo Sapiens
EHVAVPPTV

SEQ ID NO: 1093547 - protein, 9 aa, Homo Sapiens
PKEPLLGEL

SEQ ID NO: 1093548 - protein, 9 aa, Homo Sapiens
GHQPCKCKA

SEQ ID NO: 1093549 - protein, 9 aa, Homo Sapiens
GSELNCIIH

SEQ ID NO: 1093550 - protein, 9 aa, Homo Sapiens
LLVVAAFVL

SEQ ID NO: 1093551 - protein, 9 aa, Homo Sapiens
DDYLLGIPK

SEQ ID NO: 1093552 - protein, 9 aa, Homo Sapiens
PKPYVEGED

SEQ ID NO: 1093553 - protein, 9 aa, Homo Sapiens
LRGSWGWAH

SEQ ID NO: 1093554 - protein, 9 aa, Homo Sapiens
DRPSAGAPS

SEQ ID NO: 1093555 - protein, 9 aa, Homo Sapiens
SMAACPEAP

SEQ ID NO: 1093556 - protein, 9 aa, Homo Sapiens
KGQHKEVEV

SEQ ID NO: 1093557 - protein, 9 aa, Homo Sapiens
STCAGNSSQ

SEQ ID NO: 1093558 - protein, 9 aa, Homo Sapiens
CLLDNVCIA

SEQ ID NO: 1093559 - protein, 9 aa, Homo Sapiens
AGFRAARAA

SEQ ID NO: 1093560 - protein, 9 aa, Homo Sapiens
NLSVDKYMD

SEQ ID NO: 1093561 - protein, 9 aa, Homo Sapiens
SLHPLAPMP

SEQ ID NO: 1093562 - protein, 9 aa, Homo Sapiens
GRRQRSHHE

SEQ ID NO: 1093563 - protein, 9 aa, Homo Sapiens
TNETPDNCE

SEQ ID NO: 1093564 - protein, 9 aa, Homo Sapiens
VLLHSGLGS

SEQ ID NO: 1093565 - protein, 9 aa, Homo Sapiens
HTGEKPSVC

SEQ ID NO: 1093566 - protein, 9 aa, Homo Sapiens
LGGAGKHGE

SEQ ID NO: 1093567 - protein, 9 aa, Homo Sapiens
PPGPPMARL

SEQ ID NO: 1093568 - protein, 9 aa, Homo Sapiens
MPLKKFTMT

SEQ ID NO: 1093569 - protein, 9 aa, Homo Sapiens
RCTACHTAL

SEQ ID NO: 1093570 - protein, 9 aa, Homo Sapiens
WRTAPLKPK

SEQ ID NO: 1093571 - protein, 9 aa, Homo Sapiens
TTTLKWKQE

SEQ ID NO: 1093572 - protein, 9 aa, Homo Sapiens
GSKMVSKIY

SEQ ID NO: 1093573 - protein, 9 aa, Homo Sapiens
HTKYCSRFV

SEQ ID NO: 1093574 - protein, 9 aa, Homo Sapiens
GLAPGASSA

SEQ ID NO: 1093575 - protein, 9 aa, Homo Sapiens
PVTLQDQHF

SEQ ID NO: 1093576 - protein, 9 aa, Homo Sapiens
CRVTQPHLP

SEQ ID NO: 1093577 - protein, 9 aa, Homo Sapiens
SRIHSGATT

SEQ ID NO: 1093578 - protein, 9 aa, Homo Sapiens
ALLAKKGEI

SEQ ID NO: 1093579 - protein, 9 aa, Homo Sapiens
EERERERES

SEQ ID NO: 1093580 - protein, 9 aa, Homo Sapiens
CHVGTGARA

SEQ ID NO: 1093581 - protein, 9 aa, Homo Sapiens
IKDLCQRAS

SEQ ID NO: 1093582 - protein, 9 aa, Homo Sapiens
SSTCAGNSS

SEQ ID NO: 1093583 - protein, 9 aa, Homo Sapiens
NFLSKTVQP

SEQ ID NO: 1093584 - protein, 9 aa, Homo Sapiens
SWGWAHPQQ

SEQ ID NO: 1093585 - protein, 9 aa, Homo Sapiens
KSPAEAKST

SEQ ID NO: 1093586 - protein, 9 aa, Homo Sapiens
DSEYNFENT

SEQ ID NO: 1093587 - protein, 9 aa, Homo Sapiens
GTKGRCTAC

SEQ ID NO: 1093588 - protein, 9 aa, Homo Sapiens
FTITWTLSG

SEQ ID NO: 1093589 - protein, 9 aa, Homo Sapiens
WLFQQRQNF

SEQ ID NO: 1093590 - protein, 9 aa, Homo Sapiens
AARASAGTR

SEQ ID NO: 1093591 - protein, 9 aa, Homo Sapiens
LPLPQLLLS

SEQ ID NO: 1093592 - protein, 9 aa, Homo Sapiens
SGQWMPLKK

SEQ ID NO: 1093593 - protein, 9 aa, Homo Sapiens
LHPLAPMPS

SEQ ID NO: 1093594 - protein, 9 aa, Homo Sapiens
YVLLHSGLG

SEQ ID NO: 1093595 - protein, 9 aa, Homo Sapiens
ETVSLHPLA

SEQ ID NO: 1093596 - protein, 9 aa, Homo Sapiens
LVTIAPGRS

SEQ ID NO: 1093597 - protein, 9 aa, Homo Sapiens
GINDSKDMP

SEQ ID NO: 1093598 - protein, 9 aa, Homo Sapiens
MPIQTPRGR

SEQ ID NO: 1093599 - protein, 9 aa, Homo Sapiens
GGEAQQVEV

SEQ ID NO: 1093600 - protein, 9 aa, Homo Sapiens
ASQQAMLAG

SEQ ID NO: 1093601 - protein, 9 aa, Homo Sapiens
SQDDLELDY

SEQ ID NO: 1093602 - protein, 9 aa, Homo Sapiens
LPNLITTRR

SEQ ID NO: 1093603 - protein, 9 aa, Homo Sapiens
ALDRDEKTA

SEQ ID NO: 1093604 - protein, 9 aa, Homo Sapiens
PLVDTLGAE

SEQ ID NO: 1093605 - protein, 9 aa, Homo Sapiens
IPEWRKDIC

SEQ ID NO: 1093606 - protein, 9 aa, Homo Sapiens
PPGTPMTHP

SEQ ID NO: 1093607 - protein, 9 aa, Homo Sapiens
SGEEGLAPG

SEQ ID NO: 1093608 - protein, 9 aa, Homo Sapiens
LKDPYVEHF

SEQ ID NO: 1093609 - protein, 9 aa, Homo Sapiens
NVFPGAPQR

SEQ ID NO: 1093610 - protein, 9 aa, Homo Sapiens
RQMPIQTPR

SEQ ID NO: 1093611 - protein, 9 aa, Homo Sapiens
PGASSAARA

SEQ ID NO: 1093612 - protein, 9 aa, Homo Sapiens
QLLQQQQQT

SEQ ID NO: 1093613 - protein, 9 aa, Homo Sapiens
HLCFLPQST

SEQ ID NO: 1093614 - protein, 9 aa, Homo Sapiens
TQPHLPRAL

SEQ ID NO: 1093615 - protein, 9 aa, Homo Sapiens
AETVSLHPL

SEQ ID NO: 1093616 - protein, 9 aa, Homo Sapiens
TSTGRRQRS

SEQ ID NO: 1093617 - protein, 9 aa, Homo Sapiens
RELKDQSEE

SEQ ID NO: 1093618 - protein, 9 aa, Homo Sapiens
KDPYVEHFC

SEQ ID NO: 1093619 - protein, 9 aa, Homo Sapiens
GQCACLPEF

SEQ ID NO: 1093620 - protein, 9 aa, Homo Sapiens
NIDHPLTKP

SEQ ID NO: 1093621 - protein, 9 aa, Homo Sapiens
LPQQQQLLP

SEQ ID NO: 1093622 - protein, 9 aa, Homo Sapiens
ERERESLGG

SEQ ID NO: 1093623 - protein, 9 aa, Homo Sapiens
TCAGNSSQS

SEQ ID NO: 1093624 - protein, 9 aa, Homo Sapiens
SQQAMLAGS

SEQ ID NO: 1093625 - protein, 9 aa, Homo Sapiens
VLGSQARRA

SEQ ID NO: 1093626 - protein, 9 aa, Homo Sapiens
SKNVTKEEL

SEQ ID NO: 1093627 - protein, 9 aa, Homo Sapiens
FSFVLGSQA

SEQ ID NO: 1093628 - protein, 9 aa, Homo Sapiens
LPSGTKGRC

SEQ ID NO: 1093629 - protein, 9 aa, Homo Sapiens
KLPENKPPW

SEQ ID NO: 1093630 - protein, 9 aa, Homo Sapiens
RSHHEQARD

SEQ ID NO: 1093631 - protein, 9 aa, Homo Sapiens
NWPKPYVEG

SEQ ID NO: 1093632 - protein, 9 aa, Homo Sapiens
KHGEMSMSM

SEQ ID NO: 1093633 - protein, 9 aa, Homo Sapiens
AEPEAGPVW

SEQ ID NO: 1093634 - protein, 9 aa, Homo Sapiens
TLMFKDQMQ

SEQ ID NO: 1093635 - protein, 9 aa, Homo Sapiens
YPSRLSVGT

SEQ ID NO: 1093636 - protein, 9 aa, Homo Sapiens
EDPQARQMP

SEQ ID NO: 1093637 - protein, 9 aa, Homo Sapiens
YIRELKDQS

SEQ ID NO: 1093638 - protein, 9 aa, Homo Sapiens
ACLPEFSGD

SEQ ID NO: 1093639 - protein, 9 aa, Homo Sapiens
YTTSMAMPI

SEQ ID NO: 1093640 - protein, 9 aa, Homo Sapiens
IEFIDPATF

SEQ ID NO: 1093641 - protein, 9 aa, Homo Sapiens
HPLTKPSSK

SEQ ID NO: 1093642 - protein, 9 aa, Homo Sapiens
TKPSSKRDH

SEQ ID NO: 1093643 - protein, 9 aa, Homo Sapiens
PEPLIQDNP

SEQ ID NO: 1093644 - protein, 9 aa, Homo Sapiens
DEDFLDFDE

SEQ ID NO: 1093645 - protein, 9 aa, Homo Sapiens
TTLKWKQED

SEQ ID NO: 1093646 - protein, 9 aa, Homo Sapiens
FLGEMKKNA

SEQ ID NO: 1093647 - protein, 9 aa, Homo Sapiens
CHTALGRGS

SEQ ID NO: 1093648 - protein, 9 aa, Homo Sapiens
VTLRAAIPI

SEQ ID NO: 1093649 - protein, 9 aa, Homo Sapiens
QGLPSSRLA

SEQ ID NO: 1093650 - protein, 9 aa, Homo Sapiens
TNFHSSLAE

SEQ ID NO: 1093651 - protein, 9 aa, Homo Sapiens
QCRVTQPHL

SEQ ID NO: 1093652 - protein, 9 aa, Homo Sapiens
AKSTVKEEA

SEQ ID NO: 1093653 - protein, 9 aa, Homo Sapiens
ASNKLPSLP

SEQ ID NO: 1093654 - protein, 9 aa, Homo Sapiens
KLPNLITTR

SEQ ID NO: 1093655 - protein, 9 aa, Homo Sapiens
VTQPHLPRA

SEQ ID NO: 1093656 - protein, 9 aa, Homo Sapiens
LLPPQQPPP

SEQ ID NO: 1093657 - protein, 9 aa, Homo Sapiens
PGPPMARLP

SEQ ID NO: 1093658 - protein, 9 aa, Homo Sapiens
YTSAYLIEV

SEQ ID NO: 1093659 - protein, 9 aa, Homo Sapiens
LKKFTMTLF

SEQ ID NO: 1093660 - protein, 9 aa, Homo Sapiens
VVLSPNWPK

SEQ ID NO: 1093661 - protein, 9 aa, Homo Sapiens
RRQRSHHEQ

SEQ ID NO: 1093662 - protein, 9 aa, Homo Sapiens
EEGLAPGAS

SEQ ID NO: 1093663 - protein, 9 aa, Homo Sapiens
IMAALKKML

SEQ ID NO: 1093664 - protein, 9 aa, Homo Sapiens
DQPQGSPDY

SEQ ID NO: 1093665 - protein, 9 aa, Homo Sapiens
FQQRQNFSW

SEQ ID NO: 1093666 - protein, 9 aa, Homo Sapiens
TIAPGRSIS

SEQ ID NO: 1093667 - protein, 9 aa, Homo Sapiens
EGLAPGASS

SEQ ID NO: 1093668 - protein, 9 aa, Homo Sapiens
LSVGTVPRS

SEQ ID NO: 1093669 - protein, 9 aa, Homo Sapiens
PSAGAPSPP

SEQ ID NO: 1093670 - protein, 9 aa, Homo Sapiens
MAMPILPLP

SEQ ID NO: 1093671 - protein, 9 aa, Homo Sapiens
ITTRRFLFT

SEQ ID NO: 1093672 - protein, 9 aa, Homo Sapiens
KSTVKEEAK

SEQ ID NO: 1093673 - protein, 9 aa, Homo Sapiens
ASRGSPRAG

SEQ ID NO: 1093674 - protein, 9 aa, Homo Sapiens
PEVIKDLCQ

SEQ ID NO: 1093675 - protein, 9 aa, Homo Sapiens
RIHSGATTT

SEQ ID NO: 1093676 - protein, 9 aa, Homo Sapiens
KPPWYLQND

SEQ ID NO: 1093677 - protein, 9 aa, Homo Sapiens
LEMWFCVPF

SEQ ID NO: 1093678 - protein, 9 aa, Homo Sapiens
ERESLGGAG

SEQ ID NO: 1093679 - protein, 9 aa, Homo Sapiens
LLPSGTKGR

SEQ ID NO: 1093680 - protein, 9 aa, Homo Sapiens
KKGEIAKNL

SEQ ID NO: 1093681 - protein, 9 aa, Homo Sapiens
TQEPEELAR

SEQ ID NO: 1093682 - protein, 9 aa, Homo Sapiens
KTVHTKYCS

SEQ ID NO: 1093683 - protein, 9 aa, Homo Sapiens
NITNETPDN

SEQ ID NO: 1093684 - protein, 9 aa, Homo Sapiens
APGASSAAR

SEQ ID NO: 1093685 - protein, 9 aa, Homo Sapiens
PSSRLATQP

SEQ ID NO: 1093686 - protein, 9 aa, Homo Sapiens
SHIKDEFQT

SEQ ID NO: 1093687 - protein, 9 aa, Homo Sapiens
GIYNNKGDG

SEQ ID NO: 1093688 - protein, 9 aa, Homo Sapiens
RKDICNVIK

SEQ ID NO: 1093689 - protein, 9 aa, Homo Sapiens
QDDLELDYN

SEQ ID NO: 1093690 - protein, 9 aa, Homo Sapiens
PKLPNLITT

SEQ ID NO: 1093691 - protein, 9 aa, Homo Sapiens
PLAPMPSKT

SEQ ID NO: 1093692 - protein, 9 aa, Homo Sapiens
PVVCSYFAQ

SEQ ID NO: 1093693 - protein, 9 aa, Homo Sapiens
LFLQTFEKP

SEQ ID NO: 1093694 - protein, 9 aa, Homo Sapiens
HRNVFPGAP

SEQ ID NO: 1093695 - protein, 9 aa, Homo Sapiens
VVCSYFAQD

SEQ ID NO: 1093696 - protein, 9 aa, Homo Sapiens
TNKKTVHTK

SEQ ID NO: 1093697 - protein, 9 aa, Homo Sapiens
TSLIMAALK

SEQ ID NO: 1093698 - protein, 9 aa, Homo Sapiens
IRELKDQSE

SEQ ID NO: 1093699 - protein, 9 aa, Homo Sapiens
LLAKKGEIA

SEQ ID NO: 1093700 - protein, 9 aa, Homo Sapiens
AFAVGSDGL

SEQ ID NO: 1093701 - protein, 9 aa, Homo Sapiens
GQWMPLKKF

SEQ ID NO: 1093702 - protein, 9 aa, Homo Sapiens
AAAAEEEDA

SEQ ID NO: 1093703 - protein, 9 aa, Homo Sapiens
EAGPVWGDV

SEQ ID NO: 1093704 - protein, 9 aa, Homo Sapiens
SPPPPSTSI

SEQ ID NO: 1093705 - protein, 9 aa, Homo Sapiens
SRLSVGTVP

SEQ ID NO: 1093706 - protein, 9 aa, Homo Sapiens
RQRSHHEQA

SEQ ID NO: 1093707 - protein, 9 aa, Homo Sapiens
GKHGEMSMS

SEQ ID NO: 1093708 - protein, 9 aa, Homo Sapiens
QTNSSHIKD

SEQ ID NO: 1093709 - protein, 9 aa, Homo Sapiens
TLSGQWMPL

SEQ ID NO: 1093710 - protein, 9 aa, Homo Sapiens
MYTTSMAMP

SEQ ID NO: 1093711 - protein, 9 aa, Homo Sapiens
PSPPPPSTS

SEQ ID NO: 1093712 - protein, 9 aa, Homo Sapiens
KDLCQRASY

SEQ ID NO: 1093713 - protein, 9 aa, Homo Sapiens
ALGTDESLL

SEQ ID NO: 1093714 - protein, 9 aa, Homo Sapiens
LRGGEAQQV

SEQ ID NO: 1093715 - protein, 9 aa, Homo Sapiens
GFRAARAAE

SEQ ID NO: 1093716 - protein, 9 aa, Homo Sapiens
GLLVTIAPG

SEQ ID NO: 1093717 - protein, 9 aa, Homo Sapiens
MVSKIYLTR

SEQ ID NO: 1093718 - protein, 9 aa, Homo Sapiens
KAPPHRLCG

SEQ ID NO: 1093719 - protein, 9 aa, Homo Sapiens
IAPGRSISQ

SEQ ID NO: 1093720 - protein, 9 aa, Homo Sapiens
ESLGGAGKH

SEQ ID NO: 1093721 - protein, 9 aa, Homo Sapiens
FAVGSDGLC

SEQ ID NO: 1093722 - protein, 9 aa, Homo Sapiens
SMFLHYICT

SEQ ID NO: 1093723 - protein, 9 aa, Homo Sapiens
PEAGPVWGD

SEQ ID NO: 1093724 - protein, 9 aa, Homo Sapiens
HLEHAAKQA

SEQ ID NO: 1093725 - protein, 9 aa, Homo Sapiens
RKKAPPHRL

SEQ ID NO: 1093726 - protein, 9 aa, Homo Sapiens
TSKNVTKEE

SEQ ID NO: 1093727 - protein, 9 aa, Homo Sapiens
HYGDQPQGS

SEQ ID NO: 1093728 - protein, 9 aa, Homo Sapiens
IFMWLFQQR

SEQ ID NO: 1093729 - protein, 9 aa, Homo Sapiens
LSKTVQPEP

SEQ ID NO: 1093730 - protein, 9 aa, Homo Sapiens
FIDPATFLG

SEQ ID NO: 1093731 - protein, 9 aa, Homo Sapiens
TKGRCTACH

SEQ ID NO: 1093732 - protein, 9 aa, Homo Sapiens
GSQARRAGV

SEQ ID NO: 1093733 - protein, 9 aa, Homo Sapiens
PPPGTPMTH

SEQ ID NO: 1093734 - protein, 9 aa, Homo Sapiens
FPGAPQRPP

SEQ ID NO: 1093735 - protein, 9 aa, Homo Sapiens
QCFACNKFG

SEQ ID NO: 1093736 - protein, 9 aa, Homo Sapiens
DFLGEMKKN

SEQ ID NO: 1093737 - protein, 9 aa, Homo Sapiens
PITTTLKWK

SEQ ID NO: 1093738 - protein, 9 aa, Homo Sapiens
SLAETVSLH

SEQ ID NO: 1093739 - protein, 9 aa, Homo Sapiens
RKPVTLQDQ

SEQ ID NO: 1093740 - protein, 9 aa, Homo Sapiens
AEDPQARQM

SEQ ID NO: 1093741 - protein, 9 aa, Homo Sapiens
MSMSMAACP

SEQ ID NO: 1093742 - protein, 9 aa, Homo Sapiens
KLPSLPLSK

SEQ ID NO: 1093743 - protein, 9 aa, Homo Sapiens
SAMSGLYHP

SEQ ID NO: 1093744 - protein, 9 aa, Homo Sapiens
PQGSPDYGS

SEQ ID NO: 1093745 - protein, 9 aa, Homo Sapiens
TKEELEDWL

SEQ ID NO: 1093746 - protein, 9 aa, Homo Sapiens
NLITTRRFL

SEQ ID NO: 1093747 - protein, 9 aa, Homo Sapiens
KKKLVQHLE

SEQ ID NO: 1093748 - protein, 9 aa, Homo Sapiens
QPHLPRALM

SEQ ID NO: 1093749 - protein, 9 aa, Homo Sapiens
ACHTALGRG

SEQ ID NO: 1093750 - protein, 9 aa, Homo Sapiens
VPVFAVGNQ

SEQ ID NO: 1093751 - protein, 9 aa, Homo Sapiens
EAGSCHVGT

SEQ ID NO: 1093752 - protein, 9 aa, Homo Sapiens
VAAAAAAGG

SEQ ID NO: 1093753 - protein, 9 aa, Homo Sapiens
ETYQCRVTQ

SEQ ID NO: 1093754 - protein, 9 aa, Homo Sapiens
NKKTVHTKY

SEQ ID NO: 1093755 - protein, 9 aa, Homo Sapiens
ARAAEPEAG

SEQ ID NO: 1093756 - protein, 9 aa, Homo Sapiens
DLDLIFMWL

SEQ ID NO: 1093757 - protein, 9 aa, Homo Sapiens
PDRGSSPSR

SEQ ID NO: 1093758 - protein, 9 aa, Homo Sapiens
KYMDSFGRT

SEQ ID NO: 1093759 - protein, 9 aa, Homo Sapiens
TLHRNVFPG

SEQ ID NO: 1093760 - protein, 9 aa, Homo Sapiens
QARQMPIQT

SEQ ID NO: 1093761 - protein, 9 aa, Homo Sapiens
EEEDAAPGA

SEQ ID NO: 1093762 - protein, 9 aa, Homo Sapiens
LPSLPLSKM

SEQ ID NO: 1093763 - protein, 9 aa, Homo Sapiens
PLYPSRLSV

SEQ ID NO: 1093764 - protein, 9 aa, Homo Sapiens
ILPLPQLLL

SEQ ID NO: 1093765 - protein, 9 aa, Homo Sapiens
MERPMSQDD

SEQ ID NO: 1093766 - protein, 9 aa, Homo Sapiens
GRKKAPPHR

SEQ ID NO: 1093767 - protein, 9 aa, Homo Sapiens
GTMGLLVTI

SEQ ID NO: 1093768 - protein, 9 aa, Homo Sapiens
NDSKDMPEE

SEQ ID NO: 1093769 - protein, 9 aa, Homo Sapiens
FAVGNQGNV

SEQ ID NO: 1093770 - protein, 9 aa, Homo Sapiens
VPSQPPAAS

SEQ ID NO: 1093771 - protein, 9 aa, Homo Sapiens
HTALGRGSL

SEQ ID NO: 1093772 - protein, 9 aa, Homo Sapiens
MSMAACPEA

SEQ ID NO: 1093773 - protein, 9 aa, Homo Sapiens
LLQQQQQTQ

SEQ ID NO: 1093774 - protein, 9 aa, Homo Sapiens
TACHTALGR

SEQ ID NO: 1093775 - protein, 9 aa, Homo Sapiens
PAASRGSPR

SEQ ID NO: 1093776 - protein, 9 aa, Homo Sapiens
LPSSRLATQ

SEQ ID NO: 1093777 - protein, 9 aa, Homo Sapiens
LGTDESLLN

SEQ ID NO: 1093778 - protein, 9 aa, Homo Sapiens
LQQQQQTQV

SEQ ID NO: 1093779 - protein, 9 aa, Homo Sapiens
MARLPPGPP

SEQ ID NO: 1093780 - protein, 9 aa, Homo Sapiens
AAEPEAGPV

SEQ ID NO: 1093781 - protein, 9 aa, Homo Sapiens
VVPKRKPVT

SEQ ID NO: 1093782 - protein, 9 aa, Homo Sapiens
SNKLPSLPL

SEQ ID NO: 1093783 - protein, 9 aa, Homo Sapiens
SYSSSSSAK

SEQ ID NO: 1093784 - protein, 9 aa, Homo Sapiens
MEEHVPEQT

SEQ ID NO: 1093785 - protein, 9 aa, Homo Sapiens
PPPATSHKA

SEQ ID NO: 1093786 - protein, 9 aa, Homo Sapiens
HVKGQHKEV

SEQ ID NO: 1093787 - protein, 9 aa, Homo Sapiens
LEDMEEHVP

SEQ ID NO: 1093788 - protein, 9 aa, Homo Sapiens
NKLPSLPLS

SEQ ID NO: 1093789 - protein, 9 aa, Homo Sapiens
LSGQWMPLK

SEQ ID NO: 1093790 - protein, 9 aa, Homo Sapiens
SKTLKDPYV

SEQ ID NO: 1093791 - protein, 9 aa, Homo Sapiens
VFPGAPQRP

SEQ ID NO: 1093792 - protein, 9 aa, Homo Sapiens
PYVEHFCFI

SEQ ID NO: 1093793 - protein, 9 aa, Homo Sapiens
WYLQNDHLR

SEQ ID NO: 1093794 - protein, 9 aa, Homo Sapiens
LRAAIPIIP

SEQ ID NO: 1093795 - protein, 9 aa, Homo Sapiens
CAGFRAARA

SEQ ID NO: 1093796 - protein, 9 aa, Homo Sapiens
HELFLQTFE

SEQ ID NO: 1093797 - protein, 9 aa, Homo Sapiens
LCFLPQSTL

SEQ ID NO: 1093798 - protein, 9 aa, Homo Sapiens
PMDGTYGLL

SEQ ID NO: 1093799 - protein, 9 aa, Homo Sapiens
RVTQPHLPR

SEQ ID NO: 1093800 - protein, 9 aa, Homo Sapiens
LPLSKMYTT

SEQ ID NO: 1093801 - protein, 9 aa, Homo Sapiens
FHSSLAETV

SEQ ID NO: 1093802 - protein, 9 aa, Homo Sapiens
ATSHKAAAW

SEQ ID NO: 1093803 - protein, 9 aa, Homo Sapiens
TDESLLNRL

SEQ ID NO: 1093804 - protein, 9 aa, Homo Sapiens
FLPQSTLMF

SEQ ID NO: 1093805 - protein, 9 aa, Homo Sapiens
WPKPYVEGE

SEQ ID NO: 1093806 - protein, 9 aa, Homo Sapiens
TTRRFLFTI

SEQ ID NO: 1093807 - protein, 9 aa, Homo Sapiens
GRSRCKASN

SEQ ID NO: 1093808 - protein, 9 aa, Homo Sapiens
CPQPSPSLP

SEQ ID NO: 1093809 - protein, 9 aa, Homo Sapiens
NETPDNCEM

SEQ ID NO: 1093810 - protein, 9 aa, Homo Sapiens
TPMTHPPPP

SEQ ID NO: 1093811 - protein, 9 aa, Homo Sapiens
VLFSSASYS

SEQ ID NO: 1093812 - protein, 9 aa, Homo Sapiens
RPMSQDDLE

SEQ ID NO: 1093813 - protein, 9 aa, Homo Sapiens
PQPSPSLPA

SEQ ID NO: 1093814 - protein, 9 aa, Homo Sapiens
PWYLQNDHL

SEQ ID NO: 1093815 - protein, 9 aa, Homo Sapiens
TLKDPYVEH

SEQ ID NO: 1093816 - protein, 9 aa, Homo Sapiens
RSRCKASNA

SEQ ID NO: 1093817 - protein, 9 aa, Homo Sapiens
SSCPQPSPS

SEQ ID NO: 1093818 - protein, 9 aa, Homo Sapiens
GRGSLSSSS

SEQ ID NO: 1093819 - protein, 9 aa, Homo Sapiens
PQINDALGT

SEQ ID NO: 1093820 - protein, 9 aa, Homo Sapiens
CFLPQSTLM

SEQ ID NO: 1093821 - protein, 9 aa, Homo Sapiens
RGGGHPSRT

SEQ ID NO: 1093822 - protein, 9 aa, Homo Sapiens
VTIAPGRSI

SEQ ID NO: 1093823 - protein, 9 aa, Homo Sapiens
GETQEPEEL

SEQ ID NO: 1093824 - protein, 9 aa, Homo Sapiens
GSSTCAGNS

SEQ ID NO: 1093825 - protein, 9 aa, Homo Sapiens
TTLHRNVFP

SEQ ID NO: 1093826 - protein, 9 aa, Homo Sapiens
SSSSCPQPS

SEQ ID NO: 1093827 - protein, 9 aa, Homo Sapiens
LPEFSGDRC

SEQ ID NO: 1093828 - protein, 9 aa, Homo Sapiens
QQVEVPAGR

SEQ ID NO: 1093829 - protein, 9 aa, Homo Sapiens
PAGPGETQE

SEQ ID NO: 1093830 - protein, 9 aa, Homo Sapiens
HKAAAWTSS

SEQ ID NO: 1093831 - protein, 9 aa, Homo Sapiens
QTTLHRNVF

SEQ ID NO: 1093832 - protein, 9 aa, Homo Sapiens
YGLLPSGTK

SEQ ID NO: 1093833 - protein, 9 aa, Homo Sapiens
THPPPPGTP

SEQ ID NO: 1093834 - protein, 9 aa, Homo Sapiens
RAAIPIIPS

SEQ ID NO: 1093835 - protein, 9 aa, Homo Sapiens
INDSKDMPE

SEQ ID NO: 1093836 - protein, 9 aa, Homo Sapiens
IAKNLKTFL

SEQ ID NO: 1093837 - protein, 9 aa, Homo Sapiens
GASSAARAS

SEQ ID NO: 1093838 - protein, 9 aa, Homo Sapiens
KGRCTACHT

SEQ ID NO: 1093839 - protein, 9 aa, Homo Sapiens
GLTAQQRRR

SEQ ID NO: 1093840 - protein, 9 aa, Homo Sapiens
RGSSPSRVP

SEQ ID NO: 1093841 - protein, 9 aa, Homo Sapiens
PEWRKDICN

SEQ ID NO: 1093842 - protein, 9 aa, Homo Sapiens
DPQTNSSHI

SEQ ID NO: 1093843 - protein, 9 aa, Homo Sapiens
AGKHGEMSM

SEQ ID NO: 1093844 - protein, 9 aa, Homo Sapiens
PSRTVALDR

SEQ ID NO: 1093845 - protein, 9 aa, Homo Sapiens
CACLPEFSG

SEQ ID NO: 1093846 - protein, 9 aa, Homo Sapiens
PEFSGDRCQ

SEQ ID NO: 1093847 - protein, 9 aa, Homo Sapiens
REAGSCHVG

SEQ ID NO: 1093848 - protein, 9 aa, Homo Sapiens
EFIDPATFL

SEQ ID NO: 1093849 - protein, 9 aa, Homo Sapiens
GGGHPSRTV

SEQ ID NO: 1093850 - protein, 9 aa, Homo Sapiens
LPILVPLVD

SEQ ID NO: 1093851 - protein, 9 aa, Homo Sapiens
IEVELKEQL

SEQ ID NO: 1093852 - protein, 9 aa, Homo Sapiens
IYNNKGDGP

SEQ ID NO: 1093853 - protein, 9 aa, Homo Sapiens
GEMSMSMAA

SEQ ID NO: 1093854 - protein, 9 aa, Homo Sapiens
AIPIIPSLG

SEQ ID NO: 1093855 - protein, 9 aa, Homo Sapiens
LFQQRQNFS

SEQ ID NO: 1093856 - protein, 9 aa, Homo Sapiens
MVTEPPVVC

SEQ ID NO: 1093857 - protein, 9 aa, Homo Sapiens
TFEKPTQIY

SEQ ID NO: 1093858 - protein, 9 aa, Homo Sapiens
YADVPAVLA

SEQ ID NO: 1093859 - protein, 9 aa, Homo Sapiens
IHTGEKPSV

SEQ ID NO: 1093860 - protein, 9 aa, Homo Sapiens
QQAAPRTNF

SEQ ID NO: 1093861 - protein, 9 aa, Homo Sapiens
LAPMPSKTC

SEQ ID NO: 1093862 - protein, 9 aa, Homo Sapiens
AAEEEDAAP

SEQ ID NO: 1093863 - protein, 9 aa, Homo Sapiens
VHTKYCSRF

SEQ ID NO: 1093864 - protein, 9 aa, Homo Sapiens
GTYGLLPSG

SEQ ID NO: 1093865 - protein, 9 aa, Homo Sapiens
QPEPLIQDN

SEQ ID NO: 1093866 - protein, 9 aa, Homo Sapiens
VLSPNWPKP

SEQ ID NO: 1093867 - protein, 9 aa, Homo Sapiens
ARASAGTRT

SEQ ID NO: 1093868 - protein, 9 aa, Homo Sapiens
LVQHLEHAA

SEQ ID NO: 1093869 - protein, 9 aa, Homo Sapiens
LDRDEKTAY

SEQ ID NO: 1093870 - protein, 9 aa, Homo Sapiens
EYQCFACNK

SEQ ID NO: 1093871 - protein, 9 aa, Homo Sapiens
AIKKKLVQH

SEQ ID NO: 1093872 - protein, 9 aa, Homo Sapiens
PKRKPVTLQ

SEQ ID NO: 1093873 - protein, 9 aa, Homo Sapiens
AVGSDGLCC

SEQ ID NO: 1093874 - protein, 9 aa, Homo Sapiens
AGLTAQQRR

SEQ ID NO: 1093875 - protein, 9 aa, Homo Sapiens
FLFTITWTL

SEQ ID NO: 1093876 - protein, 9 aa, Homo Sapiens
STLMFKDQM

SEQ ID NO: 1093877 - protein, 9 aa, Homo Sapiens
LKDQSEELK

SEQ ID NO: 1093878 - protein, 9 aa, Homo Sapiens
GEEGLAPGA

SEQ ID NO: 1093879 - protein, 9 aa, Homo Sapiens
IQTSLIMAA

SEQ ID NO: 1093880 - protein, 9 aa, Homo Sapiens
GAGKHGEMS

SEQ ID NO: 1093881 - protein, 9 aa, Homo Sapiens
AHSLRGSWG

SEQ ID NO: 1093882 - protein, 9 aa, Homo Sapiens
ETNKKTVHT

SEQ ID NO: 1093883 - protein, 9 aa, Homo Sapiens
HRRLPILVP

SEQ ID NO: 1093884 - protein, 9 aa, Homo Sapiens
AASQQAMLA

SEQ ID NO: 1093885 - protein, 9 aa, Homo Sapiens
RASAGTRTW

SEQ ID NO: 1093886 - protein, 9 aa, Homo Sapiens
TNSSHIKDE

SEQ ID NO: 1093887 - protein, 9 aa, Homo Sapiens
LLHSGLGSP

SEQ ID NO: 1093888 - protein, 9 aa, Homo Sapiens
ERERERESL

SEQ ID NO: 1093889 - protein, 9 aa, Homo Sapiens
PMERPMSQD

SEQ ID NO: 1093890 - protein, 9 aa, Homo Sapiens
PAEAKSTVK

SEQ ID NO: 1093891 - protein, 9 aa, Homo Sapiens
AGAPSPPPP

SEQ ID NO: 1093892 - protein, 9 aa, Homo Sapiens
QSEELKAEV

SEQ ID NO: 1093893 - protein, 9 aa, Homo Sapiens
SSHIKDEFQ

SEQ ID NO: 1093894 - protein, 9 aa, Homo Sapiens
VPAVLAKYD

SEQ ID NO: 1093895 - protein, 9 aa, Homo Sapiens
TRRFLFTIT

SEQ ID NO: 1093896 - protein, 9 aa, Homo Sapiens
GQHKEVEVF

SEQ ID NO: 1093897 - protein, 9 aa, Homo Sapiens
QGSPDYGSC

SEQ ID NO: 1093898 - protein, 9 aa, Homo Sapiens
DRGSKMVSK

SEQ ID NO: 1093899 - protein, 9 aa, Homo Sapiens
RDEKTAYQL

SEQ ID NO: 1093900 - protein, 9 aa, Homo Sapiens
LGRKKAPPH

SEQ ID NO: 1093901 - protein, 9 aa, Homo Sapiens
DPGWRTAPL

SEQ ID NO: 1093902 - protein, 9 aa, Homo Sapiens
ERPMSQDDL

SEQ ID NO: 1093903 - protein, 9 aa, Homo Sapiens
SAFAVGSDG

SEQ ID NO: 1093904 - protein, 9 aa, Homo Sapiens
IDPATFLGL

SEQ ID NO: 1093905 - protein, 9 aa, Homo Sapiens
AYLIEVELK

SEQ ID NO: 1093906 - protein, 9 aa, Homo Sapiens
SLGGAGKHG

SEQ ID NO: 1093907 - protein, 9 aa, Homo Sapiens
QQLLPPQQP

SEQ ID NO: 1093908 - protein, 9 aa, Homo Sapiens
LFSSASYSS

SEQ ID NO: 1093909 - protein, 9 aa, Homo Sapiens
DVSPDRGSS

SEQ ID NO: 1093910 - protein, 9 aa, Homo Sapiens
QRCAGFRAA

SEQ ID NO: 1093911 - protein, 9 aa, Homo Sapiens
LGSQARRAG

SEQ ID NO: 1093912 - protein, 9 aa, Homo Sapiens
KKTVHTKYC

SEQ ID NO: 1093913 - protein, 9 aa, Homo Sapiens
SDEDFLDFD

SEQ ID NO: 1093914 - protein, 9 aa, Homo Sapiens
RGGEAQQVE

SEQ ID NO: 1093915 - protein, 9 aa, Homo Sapiens
PLKKFTMTL

SEQ ID NO: 1093916 - protein, 9 aa, Homo Sapiens
DLEDMEEHV

SEQ ID NO: 1093917 - protein, 9 aa, Homo Sapiens
TKYCSRFVH

SEQ ID NO: 1093918 - protein, 9 aa, Homo Sapiens
IASVPVFAV

SEQ ID NO: 1093919 - protein, 9 aa, Homo Sapiens
PPWYLQNDH

SEQ ID NO: 1093920 - protein, 9 aa, Homo Sapiens
FEVKVGIYN

SEQ ID NO: 1093921 - protein, 9 aa, Homo Sapiens
FVLGSQARR

SEQ ID NO: 1093922 - protein, 9 aa, Homo Sapiens
SVCNECGKS

SEQ ID NO: 1093923 - protein, 9 aa, Homo Sapiens
ILVPLVDTL

SEQ ID NO: 1093924 - protein, 9 aa, Homo Sapiens
NCLLDNVCI

SEQ ID NO: 1093925 - protein, 9 aa, Homo Sapiens
GSCHVGTGA

SEQ ID NO: 1093926 - protein, 9 aa, Homo Sapiens
EWRKDICNV

SEQ ID NO: 1093927 - protein, 9 aa, Homo Sapiens
TDGRSRCKA

SEQ ID NO: 1093928 - protein, 9 aa, Homo Sapiens
PSRLSVGTV

SEQ ID NO: 1093929 - protein, 9 aa, Homo Sapiens
LLVTIAPGR

SEQ ID NO: 1093930 - protein, 9 aa, Homo Sapiens
LSPNWPKPY

SEQ ID NO: 1093931 - protein, 9 aa, Homo Sapiens
DFLDFDEKT

SEQ ID NO: 1093932 - protein, 9 aa, Homo Sapiens
RNVFPGAPQ

SEQ ID NO: 1093933 - protein, 9 aa, Homo Sapiens
AMPILPLPQ

SEQ ID NO: 1093934 - protein, 9 aa, Homo Sapiens
RCAGFRAAR

SEQ ID NO: 1093935 - protein, 9 aa, Homo Sapiens
RQNFSWLEM

SEQ ID NO: 1093936 - protein, 9 aa, Homo Sapiens
VFAVGNQGN

SEQ ID NO: 1093937 - protein, 9 aa, Homo Sapiens
IDHPLTKPS

SEQ ID NO: 1093938 - protein, 9 aa, Homo Sapiens
QGPPDPGWR

SEQ ID NO: 1093939 - protein, 9 aa, Homo Sapiens
EMSMSMAAC

SEQ ID NO: 1093940 - protein, 9 aa, Homo Sapiens
LYPSRLSVG

SEQ ID NO: 1093941 - protein, 9 aa, Homo Sapiens
SLRGSWGWA

SEQ ID NO: 1093942 - protein, 9 aa, Homo Sapiens
TITWTLSGQ

SEQ ID NO: 1093943 - protein, 9 aa, Homo Sapiens
GLLPSGTKG

SEQ ID NO: 1093944 - protein, 9 aa, Homo Sapiens
ANCLLDNVC

SEQ ID NO: 1093945 - protein, 9 aa, Homo Sapiens
YQGLPSSRL

SEQ ID NO: 1093946 - protein, 9 aa, Homo Sapiens
AKSDLEDME

SEQ ID NO: 1093947 - protein, 9 aa, Homo Sapiens
PATSHKAAA

SEQ ID NO: 1093948 - protein, 9 aa, Homo Sapiens
LQAYADVPA

SEQ ID NO: 1093949 - protein, 9 aa, Homo Sapiens
PPAASAMSG

SEQ ID NO: 1093950 - protein, 9 aa, Homo Sapiens
TGRRQRSHH

SEQ ID NO: 1093951 - protein, 9 aa, Homo Sapiens
ASYSSSSSA

SEQ ID NO: 1093952 - protein, 9 aa, Homo Sapiens
KIISYVLLH

SEQ ID NO: 1093953 - protein, 9 aa, Homo Sapiens
CAHSLRGSW

SEQ ID NO: 1093954 - protein, 9 aa, Homo Sapiens
TGEKPSVCN

SEQ ID NO: 1093955 - protein, 9 aa, Homo Sapiens
EDMEEHVPE

SEQ ID NO: 1093956 - protein, 9 aa, Homo Sapiens
EYNFENTQD

SEQ ID NO: 1093957 - protein, 9 aa, Homo Sapiens
YGDQPQGSP

SEQ ID NO: 1093958 - protein, 9 aa, Homo Sapiens
KDICNVIKR

SEQ ID NO: 1093959 - protein, 9 aa, Homo Sapiens
DICNVIKRA

SEQ ID NO: 1093960 - protein, 9 aa, Homo Sapiens
GSLSSSSCP

SEQ ID NO: 1093961 - protein, 9 aa, Homo Sapiens
DRDEKTAYQ

SEQ ID NO: 1093962 - protein, 9 aa, Homo Sapiens
QHLEHAAKQ

SEQ ID NO: 1093963 - protein, 9 aa, Homo Sapiens
SADQQAAPR

SEQ ID NO: 1093964 - protein, 9 aa, Homo Sapiens
DGRSRCKAS

SEQ ID NO: 1093965 - protein, 9 aa, Homo Sapiens
LSADQQAAP

SEQ ID NO: 1093966 - protein, 9 aa, Homo Sapiens
TALGRGSLS

SEQ ID NO: 1093967 - protein, 9 aa, Homo Sapiens
WGWAHPQQH

SEQ ID NO: 1093968 - protein, 9 aa, Homo Sapiens
KPVTLQDQH

SEQ ID NO: 1093969 - protein, 9 aa, Homo Sapiens
CQRASYISQ

SEQ ID NO: 1093970 - protein, 9 aa, Homo Sapiens
PPDPGWRTA

SEQ ID NO: 1093971 - protein, 9 aa, Homo Sapiens
YMDSFGRTL

SEQ ID NO: 1093972 - protein, 9 aa, Homo Sapiens
LHSGLGSPT

SEQ ID NO: 1093973 - protein, 9 aa, Homo Sapiens
KVGIYNNKG

SEQ ID NO: 1093974 - protein, 9 aa, Homo Sapiens
ALWNITNET

SEQ ID NO: 1093975 - protein, 9 aa, Homo Sapiens
PAASAMSGL

SEQ ID NO: 1093976 - protein, 9 aa, Homo Sapiens
RDPPPATSH

SEQ ID NO: 1093977 - protein, 9 aa, Homo Sapiens
MGLLVTIAP

SEQ ID NO: 1093978 - protein, 9 aa, Homo Sapiens
ATFLGLTHL

SEQ ID NO: 1093979 - protein, 9 aa, Homo Sapiens
PMPSKTCHH

SEQ ID NO: 1093980 - protein, 9 aa, Homo Sapiens
SKMVSKIYL

SEQ ID NO: 1093981 - protein, 9 aa, Homo Sapiens
APSPPPPST

SEQ ID NO: 1093982 - protein, 9 aa, Homo Sapiens
DEKTAYQLQ

SEQ ID NO: 1093983 - protein, 9 aa, Homo Sapiens
PMARLPPGP

SEQ ID NO: 1093984 - protein, 9 aa, Homo Sapiens
KPSVCNECG

SEQ ID NO: 1093985 - protein, 9 aa, Homo Sapiens
NANCLLDNV

SEQ ID NO: 1093986 - protein, 9 aa, Homo Sapiens
TRMALDRDE

SEQ ID NO: 1093987 - protein, 9 aa, Homo Sapiens
QTSLIMAAL

SEQ ID NO: 1093988 - protein, 9 aa, Homo Sapiens
NFENTQDFV

SEQ ID NO: 1093989 - protein, 9 aa, Homo Sapiens
FITDGRSRC

SEQ ID NO: 1093990 - protein, 9 aa, Homo Sapiens
PPHRLCGRF

SEQ ID NO: 1093991 - protein, 9 aa, Homo Sapiens
ITDGRSRCK

SEQ ID NO: 1093992 - protein, 9 aa, Homo Sapiens
YQCFACNKF

SEQ ID NO: 1093993 - protein, 9 aa, Homo Sapiens
KRKPVTLQD

SEQ ID NO: 1093994 - protein, 9 aa, Homo Sapiens
AQQRRRSSV

SEQ ID NO: 1093995 - protein, 9 aa, Homo Sapiens
LTAQQRRRS

SEQ ID NO: 1093996 - protein, 9 aa, Homo Sapiens
DKYMDSFGR

SEQ ID NO: 1093997 - protein, 9 aa, Homo Sapiens
SSPSRVPQA

SEQ ID NO: 1093998 - protein, 9 aa, Homo Sapiens
KTLKDPYVE

SEQ ID NO: 1093999 - protein, 9 aa, Homo Sapiens
CKASNAGSA

SEQ ID NO: 1094000 - protein, 9 aa, Homo Sapiens
SCPQPSPSL

SEQ ID NO: 1094001 - protein, 9 aa, Homo Sapiens
QPLPQQQQL

SEQ ID NO: 1094002 - protein, 9 aa, Homo Sapiens
MALDRDEKT

SEQ ID NO: 1094003 - protein, 9 aa, Homo Sapiens
RGINDSKDM

SEQ ID NO: 1094004 - protein, 9 aa, Homo Sapiens
SWLEMWFCV

SEQ ID NO: 1094005 - protein, 9 aa, Homo Sapiens
WWAGLTAQQ

SEQ ID NO: 1094006 - protein, 9 aa, Homo Sapiens
PMTHPPPPG

SEQ ID NO: 1094007 - protein, 9 aa, Homo Sapiens
PSVCNECGK

SEQ ID NO: 1094008 - protein, 9 aa, Homo Sapiens
SYQGLPSSR

SEQ ID NO: 1094009 - protein, 9 aa, Homo Sapiens
SMSMAACPE

SEQ ID NO: 1094010 - protein, 9 aa, Homo Sapiens
RGSPRAGAP

SEQ ID NO: 1094011 - protein, 9 aa, Homo Sapiens
VELKEQLRK

SEQ ID NO: 1094012 - protein, 9 aa, Homo Sapiens
EDAAPGAEG

SEQ ID NO: 1094013 - protein, 9 aa, Homo Sapiens
GGAGKHGEM

SEQ ID NO: 1094014 - protein, 9 aa, Homo Sapiens
APRTNFHSS

SEQ ID NO: 1094015 - protein, 9 aa, Homo Sapiens
RAAEPEAGP

SEQ ID NO: 1094016 - protein, 9 aa, Homo Sapiens
MPILPLPQL

SEQ ID NO: 1094017 - protein, 9 aa, Homo Sapiens
LPQSTLMFK

SEQ ID NO: 1094018 - protein, 9 aa, Homo Sapiens
QPSPSLPAS

SEQ ID NO: 1094019 - protein, 9 aa, Homo Sapiens
YVEHFCFII

SEQ ID NO: 1094020 - protein, 9 aa, Homo Sapiens
DAAPGAEGG

SEQ ID NO: 1094021 - protein, 9 aa, Homo Sapiens
FSWLEMWFC

SEQ ID NO: 1094022 - protein, 9 aa, Homo Sapiens
YLDSRIHSG

SEQ ID NO: 1094023 - protein, 9 aa, Homo Sapiens
AAIPIIPSL

SEQ ID NO: 1094024 - protein, 9 aa, Homo Sapiens
VGIYNNKGD

SEQ ID NO: 1094025 - protein, 9 aa, Homo Sapiens
TWTLSGQWM

SEQ ID NO: 1094026 - protein, 9 aa, Homo Sapiens
KTVQPEPLI

SEQ ID NO: 1094027 - protein, 9 aa, Homo Sapiens
AKKGEIAKN

SEQ ID NO: 1094028 - protein, 9 aa, Homo Sapiens
AGPGETQEP

SEQ ID NO: 1094029 - protein, 9 aa, Homo Sapiens
VKVGIYNNK

SEQ ID NO: 1094030 - protein, 9 aa, Homo Sapiens
DLDSDEDFL

SEQ ID NO: 1094031 - protein, 9 aa, Homo Sapiens
DSDEDFLDF

SEQ ID NO: 1094032 - protein, 9 aa, Homo Sapiens
SQFRYQRCA

SEQ ID NO: 1094033 - protein, 9 aa, Homo Sapiens
PENKPPWYL

SEQ ID NO: 1094034 - protein, 9 aa, Homo Sapiens
SYLDSRIHS

SEQ ID NO: 1094035 - protein, 9 aa, Homo Sapiens
SPRAGAPAS

SEQ ID NO: 1094036 - protein, 9 aa, Homo Sapiens
LLLSADQQA

SEQ ID NO: 1094037 - protein, 9 aa, Homo Sapiens
TVHTKYCSR

SEQ ID NO: 1094038 - protein, 9 aa, Homo Sapiens
WRKDICNVI

SEQ ID NO: 1094039 - protein, 9 aa, Homo Sapiens
HPLAPMPSK

SEQ ID NO: 1094040 - protein, 9 aa, Homo Sapiens
ELKDQSEEL

SEQ ID NO: 1094041 - protein, 9 aa, Homo Sapiens
TRGGGHPSR

SEQ ID NO: 1094042 - protein, 9 aa, Homo Sapiens
QHKEVEVFK

SEQ ID NO: 1094043 - protein, 9 aa, Homo Sapiens
LDSDEDFLD

SEQ ID NO: 1094044 - protein, 9 aa, Homo Sapiens
LWNITNETP

SEQ ID NO: 1094045 - protein, 9 aa, Homo Sapiens
GPGETQEPE

SEQ ID NO: 1094046 - protein, 9 aa, Homo Sapiens
YSSSSSAKA

SEQ ID NO: 1094047 - protein, 9 aa, Homo Sapiens
LAPGASSAA

SEQ ID NO: 1094048 - protein, 9 aa, Homo Sapiens
HGEMSMSMA

SEQ ID NO: 1094049 - protein, 9 aa, Homo Sapiens
EVKVGIYNN

SEQ ID NO: 1094050 - protein, 9 aa, Homo Sapiens
CTACHTALG

SEQ ID NO: 1094051 - protein, 9 aa, Homo Sapiens
PNLITTRRF

SEQ ID NO: 1094052 - protein, 9 aa, Homo Sapiens
SLPASNKLP

SEQ ID NO: 1094053 - protein, 9 aa, Homo Sapiens
KWKQEDVSA

SEQ ID NO: 1094054 - protein, 9 aa, Homo Sapiens
EKPSVCNEC

SEQ ID NO: 1094055 - protein, 9 aa, Homo Sapiens
IENVNANCL

SEQ ID NO: 1094056 - protein, 9 aa, Homo Sapiens
SLIMAALKK

SEQ ID NO: 1094057 - protein, 9 aa, Homo Sapiens
GPPDPGWRT

SEQ ID NO: 1094058 - protein, 9 aa, Homo Sapiens
KPYVEGEDC

SEQ ID NO: 1094059 - protein, 9 aa, Homo Sapiens
QPPAASAMS

SEQ ID NO: 1094060 - protein, 9 aa, Homo Sapiens
QAMLAGSAR

SEQ ID NO: 1094061 - protein, 9 aa, Homo Sapiens
MWLFQQRQN

SEQ ID NO: 1094062 - protein, 9 aa, Homo Sapiens
DPQARQMPI

SEQ ID NO: 1094063 - protein, 9 aa, Homo Sapiens
VQPEPLIQD

SEQ ID NO: 1094064 - protein, 9 aa, Homo Sapiens
SEYNFENTQ

SEQ ID NO: 1094065 - protein, 9 aa, Homo Sapiens
AGSCHVGTG

SEQ ID NO: 1094066 - protein, 9 aa, Homo Sapiens
PPPPGTPMT

SEQ ID NO: 1094067 - protein, 9 aa, Homo Sapiens
SVLFSSASY

SEQ ID NO: 1094068 - protein, 9 aa, Homo Sapiens
VIKDLCQRA

SEQ ID NO: 1094069 - protein, 9 aa, Homo Sapiens
QQAMLAGSA

SEQ ID NO: 1094070 - protein, 9 aa, Homo Sapiens
TSMAMPILP

SEQ ID NO: 1094071 - protein, 9 aa, Homo Sapiens
FMWLFQQRQ

SEQ ID NO: 1094072 - protein, 9 aa, Homo Sapiens
GVTLRAAIP

SEQ ID NO: 1094073 - protein, 9 aa, Homo Sapiens
SLGRKKAPP

SEQ ID NO: 1094074 - protein, 9 aa, Homo Sapiens
TYQCRVTQP

SEQ ID NO: 1094075 - protein, 9 aa, Homo Sapiens
LSMFLHYIC

SEQ ID NO: 1094076 - protein, 9 aa, Homo Sapiens
STVKEEAKS

SEQ ID NO: 1094077 - protein, 9 aa, Homo Sapiens
LPENKPPWY

SEQ ID NO: 1094078 - protein, 9 aa, Homo Sapiens
KIYLTRLLA

SEQ ID NO: 1094079 - protein, 9 aa, Homo Sapiens
SKMYTTSMA

SEQ ID NO: 1094080 - protein, 9 aa, Homo Sapiens
YDFLGEMKK

SEQ ID NO: 1094081 - protein, 9 aa, Homo Sapiens
CLSMFLHYI

SEQ ID NO: 1094082 - protein, 9 aa, Homo Sapiens
MPEEYLSSI

SEQ ID NO: 1094083 - protein, 9 aa, Homo Sapiens
RFLFTITWT

SEQ ID NO: 1094084 - protein, 9 aa, Homo Sapiens
QPQGSPDYG

SEQ ID NO: 1094085 - protein, 9 aa, Homo Sapiens
GAPSPPPPS

SEQ ID NO: 1094086 - protein, 9 aa, Homo Sapiens
RLPILVPLV

SEQ ID NO: 1094087 - protein, 9 aa, Homo Sapiens
LAASQQAML

SEQ ID NO: 1094088 - protein, 9 aa, Homo Sapiens
KMVSKIYLT

SEQ ID NO: 1094089 - protein, 9 aa, Homo Sapiens
EAAAAEEED

SEQ ID NO: 1094090 - protein, 9 aa, Homo Sapiens
DLIFMWLFQ

SEQ ID NO: 1094091 - protein, 9 aa, Homo Sapiens
VEHFCFIIR

SEQ ID NO: 1094092 - protein, 9 aa, Homo Sapiens
SIQTSLIMA

SEQ ID NO: 1094093 - protein, 9 aa, Homo Sapiens
SPSLPASNK

SEQ ID NO: 1094094 - protein, 9 aa, Homo Sapiens
DPYVEHFCF

SEQ ID NO: 1094095 - protein, 9 aa, Homo Sapiens
ENKPPWYLQ

SEQ ID NO: 1094096 - protein, 9 aa, Homo Sapiens
VLIASVPVF

SEQ ID NO: 1094097 - protein, 9 aa, Homo Sapiens
PQTNSSHIK

SEQ ID NO: 1094098 - protein, 9 aa, Homo Sapiens
LPASNKLPS

SEQ ID NO: 1094099 - protein, 9 aa, Homo Sapiens
FELAASQQA

SEQ ID NO: 1094100 - protein, 9 aa, Homo Sapiens
ADHELFLQT

SEQ ID NO: 1094101 - protein, 9 aa, Homo Sapiens
GEAQQVEVP

SEQ ID NO: 1094102 - protein, 9 aa, Homo Sapiens
ELLPGSSTC

SEQ ID NO: 1094103 - protein, 9 aa, Homo Sapiens
FSSASYSSS

SEQ ID NO: 1094104 - protein, 9 aa, Homo Sapiens
EIAKNLKTF

SEQ ID NO: 1094105 - protein, 9 aa, Homo Sapiens
EFSFVLGSQ

SEQ ID NO: 1094106 - protein, 9 aa, Homo Sapiens
SSAARASAG

SEQ ID NO: 1094107 - protein, 9 aa, Homo Sapiens
FLQTFEKPT

SEQ ID NO: 1094108 - protein, 9 aa, Homo Sapiens
KKLVQHLEH

SEQ ID NO: 1094109 - protein, 9 aa, Homo Sapiens
SPAEAKSTV

SEQ ID NO: 1094110 - protein, 9 aa, Homo Sapiens
ITTTLKWKQ

SEQ ID NO: 1094111 - protein, 9 aa, Homo Sapiens
NDALGTDES

SEQ ID NO: 1094112 - protein, 9 aa, Homo Sapiens
STRMALDRD

SEQ ID NO: 1094113 - protein, 9 aa, Homo Sapiens
LITTRRFLF

SEQ ID NO: 1094114 - protein, 9 aa, Homo Sapiens
CLPEFSGDR

SEQ ID NO: 1094115 - protein, 9 aa, Homo Sapiens
STSKNVTKE

SEQ ID NO: 1094116 - protein, 9 aa, Homo Sapiens
RLSVGTVPR

SEQ ID NO: 1094117 - protein, 9 aa, Homo Sapiens
LGRGSLSSS

SEQ ID NO: 1094118 - protein, 9 aa, Homo Sapiens
HIKDEFQTL

SEQ ID NO: 1094119 - protein, 9 aa, Homo Sapiens
GWRTAPLKP

SEQ ID NO: 1094120 - protein, 9 aa, Homo Sapiens
ASAMSGLYH

SEQ ID NO: 1094121 - protein, 9 aa, Homo Sapiens
PFEVKVGIY

SEQ ID NO: 1094122 - protein, 9 aa, Homo Sapiens
SYVLLHSGL

SEQ ID NO: 1094123 - protein, 9 aa, Homo Sapiens
SKTVQPEPL

SEQ ID NO: 1094124 - protein, 9 aa, Homo Sapiens
LAKSDLEDM

SEQ ID NO: 1094125 - protein, 9 aa, Homo Sapiens
LKCLSMFLH

SEQ ID NO: 1094126 - protein, 9 aa, Homo Sapiens
QSYLDSRIH

SEQ ID NO: 1094127 - protein, 9 aa, Homo Sapiens
GLPSSRLAT

SEQ ID NO: 1094128 - protein, 9 aa, Homo Sapiens
KLKCLSMFL

SEQ ID NO: 1094129 - protein, 9 aa, Homo Sapiens
SLSSSSCPQ

SEQ ID NO: 1094130 - protein, 9 aa, Homo Sapiens
CFACNKFGT

SEQ ID NO: 1094131 - protein, 9 aa, Homo Sapiens
HSLRGSWGW

SEQ ID NO: 1094132 - protein, 9 aa, Homo Sapiens
QARRAGVIS

SEQ ID NO: 1094133 - protein, 9 aa, Homo Sapiens
MPSKTCHHK

SEQ ID NO: 1094134 - protein, 9 aa, Homo Sapiens
RCKASNAGS

SEQ ID NO: 1094135 - protein, 9 aa, Homo Sapiens
QCACLPEFS

SEQ ID NO: 1094136 - protein, 9 aa, Homo Sapiens
SFVLGSQAR

SEQ ID NO: 1094137 - protein, 9 aa, Homo Sapiens
MFLHYICTL

SEQ ID NO: 1094138 - protein, 9 aa, Homo Sapiens
DSKDMPEEY

SEQ ID NO: 1094139 - protein, 9 aa, Homo Sapiens
GSAFAVGSD

SEQ ID NO: 1094140 - protein, 9 aa, Homo Sapiens
LDLIFMWLF

SEQ ID NO: 1094141 - protein, 9 aa, Homo Sapiens
SDLEDMEEH

SEQ ID NO: 1094142 - protein, 9 aa, Homo Sapiens
NVNANCLLD

SEQ ID NO: 1094143 - protein, 9 aa, Homo Sapiens
PPMARLPPG

SEQ ID NO: 1094144 - protein, 9 aa, Homo Sapiens
AASRGSPRA

SEQ ID NO: 1094145 - protein, 9 aa, Homo Sapiens
PQSTLMFKD

SEQ ID NO: 1094146 - protein, 9 aa, Homo Sapiens
RERESLGGA

SEQ ID NO: 1094147 - protein, 9 aa, Homo Sapiens
QLLPPQQPP

SEQ ID NO: 1094148 - protein, 9 aa, Homo Sapiens
GEIAKNLKT

SEQ ID NO: 1094149 - protein, 9 aa, Homo Sapiens
TEPPVVCSY

SEQ ID NO: 1094150 - protein, 9 aa, Homo Sapiens
RGSWGWAHP

SEQ ID NO: 1094151 - protein, 9 aa, Homo Sapiens
EPEAGPVWG

SEQ ID NO: 1094152 - protein, 9 aa, Homo Sapiens
IPIIPSLGL

SEQ ID NO: 1094153 - protein, 9 aa, Homo Sapiens
MDGTYGLLP

SEQ ID NO: 1094154 - protein, 9 aa, Homo Sapiens
VTKEELEDW

SEQ ID NO: 1094155 - protein, 9 aa, Homo Sapiens
FAHVKGQHK

SEQ ID NO: 1094156 - protein, 9 aa, Homo Sapiens
SKIYLTRLL

SEQ ID NO: 1094157 - protein, 9 aa, Homo Sapiens
SRTVALDRL

SEQ ID NO: 1094158 - protein, 9 aa, Homo Sapiens
PLPQQQQLL

SEQ ID NO: 1094159 - protein, 9 aa, Homo Sapiens
EAKSTVKEE

SEQ ID NO: 1094160 - protein, 9 aa, Homo Sapiens
TFLGLTHLE

SEQ ID NO: 1094161 - protein, 9 aa, Homo Sapiens
YSIQTSLIM

SEQ ID NO: 1094162 - protein, 9 aa, Homo Sapiens
VGSDGLCCQ

SEQ ID NO: 1094163 - protein, 9 aa, Homo Sapiens
YDRGSAFAV

SEQ ID NO: 1094164 - protein, 9 aa, Homo Sapiens
QQSYLDSRI

SEQ ID NO: 1094165 - protein, 9 aa, Homo Sapiens
SRCKASNAG

SEQ ID NO: 1094166 - protein, 9 aa, Homo Sapiens
SVPVFAVGN

SEQ ID NO: 1094167 - protein, 9 aa, Homo Sapiens
PASNKLPSL

SEQ ID NO: 1094168 - protein, 9 aa, Homo Sapiens
LPGSSTCAG

SEQ ID NO: 1094169 - protein, 9 aa, Homo Sapiens
QRQNFSWLE

SEQ ID NO: 1094170 - protein, 9 aa, Homo Sapiens
LCQRASYIS

SEQ ID NO: 1094171 - protein, 9 aa, Homo Sapiens
QAAPRTNFH

SEQ ID NO: 1094172 - protein, 9 aa, Homo Sapiens
SPSRVPQAL

SEQ ID NO: 1094173 - protein, 9 aa, Homo Sapiens
PGSSTCAGN

SEQ ID NO: 1094174 - protein, 9 aa, Homo Sapiens
FACNKFGTA

SEQ ID NO: 1094175 - protein, 9 aa, Homo Sapiens
TPFEVKVGI

SEQ ID NO: 1094176 - protein, 9 aa, Homo Sapiens
SSSCPQPSP

SEQ ID NO: 1094177 - protein, 9 aa, Homo Sapiens
QSTLMFKDQ

SEQ ID NO: 1094178 - protein, 9 aa, Homo Sapiens
HKEVEVFKS

SEQ ID NO: 1094179 - protein, 9 aa, Homo Sapiens
KDLDLIFMW

SEQ ID NO: 1094180 - protein, 9 aa, Homo Sapiens
YQRCAGFRA

SEQ ID NO: 1094181 - protein, 9 aa, Homo Sapiens
PSQPPAASA

SEQ ID NO: 1094182 - protein, 9 aa, Homo Sapiens
TQDFVPCSQ

SEQ ID NO: 1094183 - protein, 9 aa, Homo Sapiens
QQQSYLDSR

SEQ ID NO: 1094184 - protein, 9 aa, Homo Sapiens
DHPLTKPSS

SEQ ID NO: 1094185 - protein, 9 aa, Homo Sapiens
APMPSKTCH

SEQ ID NO: 1094186 - protein, 9 aa, Homo Sapiens
ELFLQTFEK

SEQ ID NO: 1094187 - protein, 9 aa, Homo Sapiens
RTSTGRRQR

SEQ ID NO: 1094188 - protein, 9 aa, Homo Sapiens
PILPLPQLL

SEQ ID NO: 1094189 - protein, 9 aa, Homo Sapiens
IFAHVKGQH

SEQ ID NO: 1094190 - protein, 9 aa, Homo Sapiens
RRLPILVPL

SEQ ID NO: 1094191 - protein, 9 aa, Homo Sapiens
RERERESLG

SEQ ID NO: 1094192 - protein, 9 aa, Homo Sapiens
SSRLATQPH

SEQ ID NO: 1094193 - protein, 9 aa, Homo Sapiens
QQRRRSSVF

SEQ ID NO: 1094194 - protein, 9 aa, Homo Sapiens
PGHYGDQPQ

SEQ ID NO: 1094195 - protein, 9 aa, Homo Sapiens
AAPRTNFHS

SEQ ID NO: 1094196 - protein, 9 aa, Homo Sapiens
HPSRTVALD

SEQ ID NO: 1094197 - protein, 9 aa, Homo Sapiens
DPPPATSHK

SEQ ID NO: 1094198 - protein, 9 aa, Homo Sapiens
PSGTKGRCT

SEQ ID NO: 1094199 - protein, 9 aa, Homo Sapiens
LDFDEKTDD

SEQ ID NO: 1094200 - protein, 9 aa, Homo Sapiens
NTQDFVPCS

SEQ ID NO: 1094201 - protein, 9 aa, Homo Sapiens
DLCQRASYI

SEQ ID NO: 1094202 - protein, 9 aa, Homo Sapiens
GLPAASRGS

SEQ ID NO: 1094203 - protein, 9 aa, Homo Sapiens
NKPPWYLQN

SEQ ID NO: 1094204 - protein, 9 aa, Homo Sapiens
HSSLAETVS

SEQ ID NO: 1094205 - protein, 9 aa, Homo Sapiens
MSQDDLELD

SEQ ID NO: 1094206 - protein, 9 aa, Homo Sapiens
PLPQLLLSA

SEQ ID NO: 1094207 - protein, 9 aa, Homo Sapiens
SAYLIEVEL

SEQ ID NO: 1094208 - protein, 9 aa, Homo Sapiens
DRGSSPSRV

SEQ ID NO: 1094209 - protein, 9 aa, Homo Sapiens
DQQAAPRTN

SEQ ID NO: 1094210 - protein, 9 aa, Homo Sapiens
NFHSSLAET

SEQ ID NO: 1094211 - protein, 9 aa, Homo Sapiens
SPNWPKPYV

SEQ ID NO: 1094212 - protein, 9 aa, Homo Sapiens
QAYADVPAV

SEQ ID NO: 1094213 - protein, 9 aa, Homo Sapiens
DMEEHVPEQ

SEQ ID NO: 1094214 - protein, 9 aa, Homo Sapiens
AAAEEEDAA

SEQ ID NO: 1094215 - protein, 9 aa, Homo Sapiens
KMYTTSMAM

SEQ ID NO: 1094216 - protein, 9 aa, Homo Sapiens
KPSSKRDHR

SEQ ID NO: 1094217 - protein, 9 aa, Homo Sapiens
LIFMWLFQQ

SEQ ID NO: 1094218 - protein, 9 aa, Homo Sapiens
INDALGTDE

SEQ ID NO: 1094219 - protein, 9 aa, Homo Sapiens
GRCTACHTA

SEQ ID NO: 1094220 - protein, 9 aa, Homo Sapiens
AYADVPAVL

SEQ ID NO: 1094221 - protein, 9 aa, Homo Sapiens
PPATSHKAA

SEQ ID NO: 1094222 - protein, 9 aa, Homo Sapiens
SSSQFRYQR

SEQ ID NO: 1094223 - protein, 9 aa, Homo Sapiens
AQQVEVPAG

SEQ ID NO: 1094224 - protein, 9 aa, Homo Sapiens
VQHLEHAAK

SEQ ID NO: 1094225 - protein, 9 aa, Homo Sapiens
DPATFLGLT

SEQ ID NO: 1094226 - protein, 9 aa, Homo Sapiens
KDMPEEYLS

SEQ ID NO: 1094227 - protein, 9 aa, Homo Sapiens
EPITTTLKW

SEQ ID NO: 1094228 - protein, 9 aa, Homo Sapiens
VQGPPDPGW

SEQ ID NO: 1094229 - protein, 9 aa, Homo Sapiens
VTEPPVVCS

SEQ ID NO: 1094230 - protein, 9 aa, Homo Sapiens
ELAASQQAM

SEQ ID NO: 1094231 - protein, 9 aa, Homo Sapiens
GSSPSRVPQ

SEQ ID NO: 1094232 - protein, 9 aa, Homo Sapiens
ITNETPDNC

SEQ ID NO: 1094233 - protein, 9 aa, Homo Sapiens
HSGLGSPTD

SEQ ID NO: 1094234 - protein, 9 aa, Homo Sapiens
IISYVLLHS

SEQ ID NO: 1094235 - protein, 9 aa, Homo Sapiens
LAKKGEIAK

SEQ ID NO: 1094236 - protein, 9 aa, Homo Sapiens
KKAPPHRLC

SEQ ID NO: 1094237 - protein, 9 aa, Homo Sapiens
PSSKRDHRR

SEQ ID NO: 1094238 - protein, 9 aa, Homo Sapiens
QQRQNFSWL

SEQ ID NO: 1094239 - protein, 9 aa, Homo Sapiens
TSHKAAAWT

SEQ ID NO: 1094240 - protein, 9 aa, Homo Sapiens
RGSLSSSSC

SEQ ID NO: 1094241 - protein, 9 aa, Homo Sapiens
QINDALGTD

SEQ ID NO: 1094242 - protein, 9 aa, Homo Sapiens
PPLYPSRLS

SEQ ID NO: 1094243 - protein, 9 aa, Homo Sapiens
LLDNVCIAA

SEQ ID NO: 1094244 - protein, 9 aa, Homo Sapiens
CKDLDLIFM

SEQ ID NO: 1094245 - protein, 9 aa, Homo Sapiens
PAVLAKYDD

SEQ ID NO: 1094246 - protein, 9 aa, Homo Sapiens
QRSHHEQAR

SEQ ID NO: 1094247 - protein, 9 aa, Homo Sapiens
ENVNANCLL

SEQ ID NO: 1094248 - protein, 9 aa, Homo Sapiens
LKWKQEDVS

SEQ ID NO: 1094249 - protein, 9 aa, Homo Sapiens
LDPQTNSSH

SEQ ID NO: 1094250 - protein, 9 aa, Homo Sapiens
ASSAARASA

SEQ ID NO: 1094251 - protein, 9 aa, Homo Sapiens
LTKPSSKRD

SEQ ID NO: 1094252 - protein, 9 aa, Homo Sapiens
VCSYFAQDL

SEQ ID NO: 1094253 - protein, 9 aa, Homo Sapiens
CNVIKRALV

SEQ ID NO: 1094254 - protein, 9 aa, Homo Sapiens
LAETVSLHP

SEQ ID NO: 1094255 - protein, 9 aa, Homo Sapiens
TVVPKRKPV

SEQ ID NO: 1094256 - protein, 9 aa, Homo Sapiens
DGTYGLLPS

SEQ ID NO: 1094257 - protein, 9 aa, Homo Sapiens
TAQQRRRSS

SEQ ID NO: 1094258 - protein, 9 aa, Homo Sapiens
LLPGSSTCA

SEQ ID NO: 1094259 - protein, 9 aa, Homo Sapiens
KGEIAKNLK

SEQ ID NO: 1094260 - protein, 9 aa, Homo Sapiens
SRGSPRAGA

SEQ ID NO: 1094261 - protein, 9 aa, Homo Sapiens
PRTNFHSSL

SEQ ID NO: 1094262 - protein, 9 aa, Homo Sapiens
LLSADQQAA

SEQ ID NO: 1094263 - protein, 9 aa, Homo Sapiens
VDKYMDSFG

SEQ ID NO: 1094264 - protein, 9 aa, Homo Sapiens
DDLELDYNP

SEQ ID NO: 1094265 - protein, 9 aa, Homo Sapiens
ISYVLLHSG

SEQ ID NO: 1094266 - protein, 9 aa, Homo Sapiens
SASYSSSSS

SEQ ID NO: 1094267 - protein, 9 aa, Homo Sapiens
SKDMPEEYL

SEQ ID NO: 1094268 - protein, 9 aa, Homo Sapiens
ASVPVFAVG

SEQ ID NO: 1094269 - protein, 9 aa, Homo Sapiens
ADVPAVLAK

SEQ ID NO: 1094270 - protein, 9 aa, Homo Sapiens
SSQFRYQRC

SEQ ID NO: 1094271 - protein, 9 aa, Homo Sapiens
GHPSRTVAL

SEQ ID NO: 1094272 - protein, 9 aa, Homo Sapiens
PGETQEPEE

SEQ ID NO: 1094273 - protein, 9 aa, Homo Sapiens
ACNKFGTAL

SEQ ID NO: 1094274 - protein, 9 aa, Homo Sapiens
VRPAGPGET

SEQ ID NO: 1094275 - protein, 9 aa, Homo Sapiens
TVSLHPLAP

SEQ ID NO: 1094276 - protein, 9 aa, Homo Sapiens
RYQRCAGFR

SEQ ID NO: 1094277 - protein, 9 aa, Homo Sapiens
GHYGDQPQG

SEQ ID NO: 1094278 - protein, 9 aa, Homo Sapiens
PQLLLSADQ

SEQ ID NO: 1094279 - protein, 9 aa, Homo Sapiens
QRASYISQD

SEQ ID NO: 1094280 - protein, 9 aa, Homo Sapiens
FRAARAAEP

SEQ ID NO: 1094281 - protein, 9 aa, Homo Sapiens
NVTKEELED

SEQ ID NO: 1094282 - protein, 9 aa, Homo Sapiens
SALWNITNE

SEQ ID NO: 1094283 - protein, 9 aa, Homo Sapiens
WNITNETPD

SEQ ID NO: 1094284 - protein, 9 aa, Homo Sapiens
RESLGGAGK

SEQ ID NO: 1094285 - protein, 9 aa, Homo Sapiens
PNWPKPYVE

SEQ ID NO: 1094286 - protein, 9 aa, Homo Sapiens
SCHVGTGAR

SEQ ID NO: 1094287 - protein, 9 aa, Homo Sapiens
LHYICTLKQ

SEQ ID NO: 1094288 - protein, 9 aa, Homo Sapiens
NSSHIKDEF

SEQ ID NO: 1094289 - protein, 9 aa, Homo Sapiens
MTHPPPPGT

SEQ ID NO: 1094290 - protein, 9 aa, Homo Sapiens
LGEMKKNAV

SEQ ID NO: 1094291 - protein, 9 aa, Homo Sapiens
FRYQRCAGF

SEQ ID NO: 1094292 - protein, 9 aa, Homo Sapiens
RPMDGTYGL

SEQ ID NO: 1094293 - protein, 9 aa, Homo Sapiens
RGSAFAVGS

SEQ ID NO: 1094294 - protein, 9 aa, Homo Sapiens
EFSGDRCQL

SEQ ID NO: 1094295 - protein, 9 aa, Homo Sapiens
RPSAGAPSP

SEQ ID NO: 1094296 - protein, 9 aa, Homo Sapiens
WMPLKKFTM

SEQ ID NO: 1094297 - protein, 9 aa, Homo Sapiens
WAGLTAQQR

SEQ ID NO: 1094298 - protein, 9 aa, Homo Sapiens
KDQSEELKA

SEQ ID NO: 1094299 - protein, 9 aa, Homo Sapiens
SSLAETVSL

SEQ ID NO: 1094300 - protein, 9 aa, Homo Sapiens
KSDLEDMEE

SEQ ID NO: 1094301 - protein, 9 aa, Homo Sapiens
PIIPSLGLI

SEQ ID NO: 1094302 - protein, 9 aa, Homo Sapiens
TYGLLPSGT

SEQ ID NO: 1094303 - protein, 9 aa, Homo Sapiens
VSKIYLTRL

SEQ ID NO: 1094304 - protein, 9 aa, Homo Sapiens
GTPMTHPPP

SEQ ID NO: 1094305 - protein, 9 aa, Homo Sapiens
SREAGSCHV

SEQ ID NO: 1094306 - protein, 9 aa, Homo Sapiens
VPKRKPVTL

SEQ ID NO: 1094307 - protein, 9 aa, Homo Sapiens
MSYQGLPSS

SEQ ID NO: 1094308 - protein, 9 aa, Homo Sapiens
PDPGWRTAP

SEQ ID NO: 1094309 - protein, 9 aa, Homo Sapiens
LSKMYTTSM

SEQ ID NO: 1094310 - protein, 9 aa, Homo Sapiens
FENTQDFVP

SEQ ID NO: 1094311 - protein, 9 aa, Homo Sapiens
AEAKSTVKE

SEQ ID NO: 1094312 - protein, 9 aa, Homo Sapiens
GEKPSVCNE

SEQ ID NO: 1094313 - protein, 9 aa, Homo Sapiens
MAALKKMLP

SEQ ID NO: 1094314 - protein, 9 aa, Homo Sapiens
TLRAAIPII

SEQ ID NO: 1094315 - protein, 9 aa, Homo Sapiens
RRFLFTITW

SEQ ID NO: 1094316 - protein, 9 aa, Homo Sapiens
LPQLLLSAD

SEQ ID NO: 1094317 - protein, 9 aa, Homo Sapiens
FLHYICTLK

SEQ ID NO: 1094318 - protein, 9 aa, Homo Sapiens
WLEMWFCVP

SEQ ID NO: 1094319 - protein, 9 aa, Homo Sapiens
DMPEEYLSS

SEQ ID NO: 1094320 - protein, 9 aa, Homo Sapiens
LHRNVFPGA

SEQ ID NO: 1094321 - protein, 9 aa, Homo Sapiens
SPDRGSSPS

SEQ ID NO: 1094322 - protein, 9 aa, Homo Sapiens
VSPDRGSSP

SEQ ID NO: 1094323 - protein, 9 aa, Homo Sapiens
RTNFHSSLA

SEQ ID NO: 1094324 - protein, 9 aa, Homo Sapiens
RAARAAEPE

SEQ ID NO: 1094325 - protein, 9 aa, Homo Sapiens
DQSEELKAE

SEQ ID NO: 1094326 - protein, 9 aa, Homo Sapiens
NPPLYPSRL

SEQ ID NO: 1094327 - protein, 9 aa, Homo Sapiens
PGWRTAPLK

SEQ ID NO: 1094328 - protein, 9 aa, Homo Sapiens
WSALWNITN

SEQ ID NO: 1094329 - protein, 9 aa, Homo Sapiens
PLTKPSSKR

SEQ ID NO: 1094330 - protein, 9 aa, Homo Sapiens
QWMPLKKFT

SEQ ID NO: 1094331 - protein, 9 aa, Homo Sapiens
GEYQCFACN

SEQ ID NO: 1094332 - protein, 9 aa, Homo Sapiens
PILVPLVDT

SEQ ID NO: 1094333 - protein, 9 aa, Homo Sapiens
QNFSWLEMW

SEQ ID NO: 1094334 - protein, 9 aa, Homo Sapiens
KCLSMFLHY

SEQ ID NO: 1094335 - protein, 9 aa, Homo Sapiens
LQTFEKPTQ

SEQ ID NO: 1094336 - protein, 9 aa, Homo Sapiens
DRGSAFAVG

SEQ ID NO: 1094337 - protein, 9 aa, Homo Sapiens
PQQQQLLPP

SEQ ID NO: 1094338 - protein, 9 aa, Homo Sapiens
TLLLLLLLP

SEQ ID NO: 1094339 - protein, 9 aa, Homo Sapiens
LDSRIHSGA

SEQ ID NO: 1094340 - protein, 9 aa, Homo Sapiens
IKKKLVQHL

SEQ ID NO: 1094341 - protein, 9 aa, Homo Sapiens
MSREAGSCH

SEQ ID NO: 1094342 - protein, 9 aa, Homo Sapiens
HVGTGARAR

SEQ ID NO: 1094343 - protein, 9 aa, Homo Sapiens
GDQPQGSPD

SEQ ID NO: 1094344 - protein, 9 aa, Homo Sapiens
CSYFAQDLW

SEQ ID NO: 1094345 - protein, 9 aa, Homo Sapiens
PLRGGEAQQ

SEQ ID NO: 1094346 - protein, 9 aa, Homo Sapiens
LSVDKYMDS

SEQ ID NO: 1094347 - protein, 9 aa, Homo Sapiens
FLDFDEKTD

SEQ ID NO: 1094348 - protein, 9 aa, Homo Sapiens
AARAAEPEA

SEQ ID NO: 1094349 - protein, 9 aa, Homo Sapiens
ETQEPEELA

SEQ ID NO: 1094350 - protein, 9 aa, Homo Sapiens
SRLATQPHL

SEQ ID NO: 1094351 - protein, 9 aa, Homo Sapiens
SLPLSKMYT

SEQ ID NO: 1094352 - protein, 9 aa, Homo Sapiens
LIMAALKKM

SEQ ID NO: 1094353 - protein, 9 aa, Homo Sapiens
QFRYQRCAG

SEQ ID NO: 1094354 - protein, 9 aa, Homo Sapiens
TTSMAMPIL

SEQ ID NO: 1094355 - protein, 9 aa, Homo Sapiens
GPPMARLPP

SEQ ID NO: 1094356 - protein, 9 aa, Homo Sapiens
PLSKMYTTS

SEQ ID NO: 1094357 - protein, 9 aa, Homo Sapiens
LIEVELKEQ

SEQ ID NO: 1094358 - protein, 9 aa, Homo Sapiens
SEELKAEVR

SEQ ID NO: 1094359 - protein, 9 aa, Homo Sapiens
GGHPSRTVA

SEQ ID NO: 1094360 - protein, 9 aa, Homo Sapiens
VPLVDTLGA

SEQ ID NO: 1094361 - protein, 9 aa, Homo Sapiens
EAQQVEVPA

SEQ ID NO: 1094362 - protein, 9 aa, Homo Sapiens
RIHTGEKPS

SEQ ID NO: 1094363 - protein, 9 aa, Homo Sapiens
ATRGGGHPS

SEQ ID NO: 1094364 - protein, 9 aa, Homo Sapiens
NFSWLEMWF

SEQ ID NO: 1094365 - protein, 9 aa, Homo Sapiens
LSSSSCPQP

SEQ ID NO: 1094366 - protein, 9 aa, Homo Sapiens
YLIEVELKE

SEQ ID NO: 1094367 - protein, 9 aa, Homo Sapiens
EEDAAPGAE

SEQ ID NO: 1094368 - protein, 9 aa, Homo Sapiens
EELLPGSST

SEQ ID NO: 1094369 - protein, 9 aa, Homo Sapiens
QMPIQTPRG

SEQ ID NO: 1094370 - protein, 9 aa, Homo Sapiens
ARQMPIQTP

SEQ ID NO: 1094371 - protein, 9 aa, Homo Sapiens
LPAASRGSP

SEQ ID NO: 1094372 - protein, 9 aa, Homo Sapiens
ALGRGSLSS

SEQ ID NO: 1094373 - protein, 9 aa, Homo Sapiens
VSLHPLAPM

SEQ ID NO: 1094374 - protein, 9 aa, Homo Sapiens
AEEEDAAPG

SEQ ID NO: 1094375 - protein, 9 aa, Homo Sapiens
PGTPMTHPP

SEQ ID NO: 1094376 - protein, 9 aa, Homo Sapiens
RMALDRDEK

SEQ ID NO: 1094377 - protein, 9 aa, Homo Sapiens
SAGAPSPPP

SEQ ID NO: 1094378 - protein, 9 aa, Homo Sapiens
TVKEEAKSP

SEQ ID NO: 1094379 - protein, 9 aa, Homo Sapiens
SAARASAGT

SEQ ID NO: 1094380 - protein, 9 aa, Homo Sapiens
SQARRAGVI

SEQ ID NO: 1094381 - protein, 9 aa, Homo Sapiens
PSLPLSKMY

SEQ ID NO: 1094382 - protein, 9 aa, Homo Sapiens
KKFTMTLFL

SEQ ID NO: 1094383 - protein, 9 aa, Homo Sapiens
VNANCLLDN

SEQ ID NO: 1094384 - protein, 9 aa, Homo Sapiens
LVPLVDTLG

SEQ ID NO: 1094385 - protein, 9 aa, Homo Sapiens
SGTKGRCTA

SEQ ID NO: 1094386 - protein, 9 aa, Homo Sapiens
CNKFGTALS

SEQ ID NO: 1094387 - protein, 9 aa, Homo Sapiens
RLPPGPPMA

SEQ ID NO: 1094388 - protein, 9 aa, Homo Sapiens
PSLPASNKL

SEQ ID NO: 1094389 - protein, 9 aa, Homo Sapiens
GSWGWAHPQ

SEQ ID NO: 1094390 - protein, 9 aa, Homo Sapiens
ENTQDFVPC

SEQ ID NO: 1094391 - protein, 9 aa, Homo Sapiens
TVQPEPLIQ

SEQ ID NO: 1094392 - protein, 9 aa, Homo Sapiens
FLSKTVQPE

SEQ ID NO: 1094393 - protein, 9 aa, Homo Sapiens
EVELKEQLR

SEQ ID NO: 1094394 - protein, 9 aa, Homo Sapiens
LFTITWTLS

SEQ ID NO: 1094395 - protein, 9 aa, Homo Sapiens
DSRIHSGAT

SEQ ID NO: 1094396 - protein, 9 aa, Homo Sapiens
WKQEDVSAT

SEQ ID NO: 1094397 - protein, 9 aa, Homo Sapiens
ITWTLSGQW

SEQ ID NO: 1094398 - protein, 9 aa, Homo Sapiens
SQPPAASAM

SEQ ID NO: 1094399 - protein, 9 aa, Homo Sapiens
EGEYQCFAC

SEQ ID NO: 1094400 - protein, 9 aa, Homo Sapiens
MDSFGRTLE

SEQ ID NO: 1094401 - protein, 9 aa, Homo Sapiens
WTLSGQWMP

SEQ ID NO: 1094402 - protein, 9 aa, Homo Sapiens
AASAMSGLY

SEQ ID NO: 1094403 - protein, 9 aa, Homo Sapiens
PSTSKNVTK

SEQ ID NO: 1094404 - protein, 9 aa, Homo Sapiens
RPAGPGETQ

SEQ ID NO: 1094405 - protein, 9 aa, Homo Sapiens
PSPSLPASN

SEQ ID NO: 1094406 - protein, 9 aa, Homo Sapiens
ELQAYADVP

SEQ ID NO: 1094407 - protein, 9 aa, Homo Sapiens
EVIKDLCQR

SEQ ID NO: 1094408 - protein, 9 aa, Homo Sapiens
SMAMPILPL

SEQ ID NO: 1094409 - protein, 9 aa, Homo Sapiens
RGSKMVSKI

SEQ ID NO: 1094410 - protein, 9 aa, Homo Sapiens
VKGQHKEVE

SEQ ID NO: 1094411 - protein, 9 aa, Homo Sapiens
GTDESLLNR

SEQ ID NO: 1094412 - protein, 9 aa, Homo Sapiens
KLVQHLEHA

SEQ ID NO: 1094413 - protein, 9 aa, Homo Sapiens
QNLSVDKYM

SEQ ID NO: 1094414 - protein, 9 aa, Homo Sapiens
GIEFIDPAT

SEQ ID NO: 1094415 - protein, 9 aa, Homo Sapiens
ARLPPGPPM

SEQ ID NO: 1094416 - protein, 9 aa, Homo Sapiens
YNFENTQDF

SEQ ID NO: 1094417 - protein, 9 aa, Homo Sapiens
TMGLLVTIA

SEQ ID NO: 1094418 - protein, 9 aa, Homo Sapiens
SHKAAAWTS

SEQ ID NO: 1094419 - protein, 9 aa, Homo Sapiens
KEELEDWLD

SEQ ID NO: 1094420 - protein, 9 aa, Homo Sapiens
TSAYLIEVE

SEQ ID NO: 1094421 - protein, 9 aa, Homo Sapiens
QLLLSADQQ

SEQ ID NO: 1094422 - protein, 9 aa, Homo Sapiens
LPKLPNLIT

SEQ ID NO: 1094423 - protein, 9 aa, Homo Sapiens
QVEVPAGRN

SEQ ID NO: 1094424 - protein, 9 aa, Homo Sapiens
DVPAVLAKY

SEQ ID NO: 1094425 - protein, 9 aa, Homo Sapiens
TYDFLGEMK

SEQ ID NO: 1094426 - protein, 9 aa, Homo Sapiens
PATFLGLTH

SEQ ID NO: 1094427 - protein, 9 aa, Homo Sapiens
PVFAVGNQG

SEQ ID NO: 1094428 - protein, 9 aa, Homo Sapiens
KNVTKEELE

SEQ ID NO: 1094429 - protein, 9 aa, Homo Sapiens
LIASVPVFA

SEQ ID NO: 1094430 - protein, 9 aa, Homo Sapiens
PQARQMPIQ

SEQ ID NO: 1094431 - protein, 9 aa, Homo Sapiens
TFELAASQQ

SEQ ID NO: 1094432 - protein, 9 aa, Homo Sapiens
AHVKGQHKE

SEQ ID NO: 1094433 - protein, 9 aa, Homo Sapiens
ICNVIKRAL

SEQ ID NO: 1094434 - protein, 9 aa, Homo Sapiens
SVDKYMDSF

SEQ ID NO: 1094435 - protein, 9 aa, Homo Sapiens
ADQQAAPRT

SEQ ID NO: 1094436 - protein, 9 aa, Homo Sapiens
DALGTDESL

SEQ ID NO: 1094437 - protein, 9 aa, Homo Sapiens
GSPRAGAPA

SEQ ID NO: 1094438 - protein, 9 aa, Homo Sapiens
VTLQDQHFS

SEQ ID NO: 1094439 - protein, 9 aa, Homo Sapiens
QTFEKPTQI

SEQ ID NO: 1094440 - protein, 9 aa, Homo Sapiens
QRRRSSVFP

SEQ ID NO: 1094441 - protein, 9 aa, Homo Sapiens
DHELFLQTF

SEQ ID NO: 1094442 - protein, 9 aa, Homo Sapiens
SSASYSSSS

SEQ ID NO: 1094443 - protein, 9 aa, Homo Sapiens
EDFLDFDEK

SEQ ID NO: 1094444 - protein, 9 aa, Homo Sapiens
QQQLLPPQQ

SEQ ID NO: 1094445 - protein, 9 aa, Homo Sapiens
YQCRVTQPH

SEQ ID NO: 1094446 - protein, 9 aa, Homo Sapiens
TLKWKQEDV

SEQ ID NO: 1094447 - protein, 9 aa, Homo Sapiens
STGRRQRSH

SEQ ID NO: 1094448 - protein, 9 aa, Homo Sapiens
PMSQDDLEL

SEQ ID NO: 1094449 - protein, 9 aa, Homo Sapiens
APPHRLCGR

SEQ ID NO: 1094450 - protein, 9 aa, Homo Sapiens
QGQCACLPE

SEQ ID NO: 1094451 - protein, 9 aa, Homo Sapiens
QLKCQHEEG

SEQ ID NO: 1094452 - protein, 9 aa, Homo Sapiens
GDQHVTGQD

SEQ ID NO: 1094453 - protein, 9 aa, Homo Sapiens
TAQKLTIQK

SEQ ID NO: 1094454 - protein, 9 aa, Homo Sapiens
LLGCHLFPR

SEQ ID NO: 1094455 - protein, 9 aa, Homo Sapiens
SSSYHPFKI

SEQ ID NO: 1094456 - protein, 9 aa, Homo Sapiens
FLAIHLLLS

SEQ ID NO: 1094457 - protein, 9 aa, Homo Sapiens
VAYIVAPSG

SEQ ID NO: 1094458 - protein, 9 aa, Homo Sapiens
VPPRAPASP

SEQ ID NO: 1094459 - protein, 9 aa, Homo Sapiens
VWKEVRGEW

SEQ ID NO: 1094460 - protein, 9 aa, Homo Sapiens
LQSYHQALL

SEQ ID NO: 1094461 - protein, 9 aa, Homo Sapiens
GTGSRRGCA

SEQ ID NO: 1094462 - protein, 9 aa, Homo Sapiens
NQGRDAHSS

SEQ ID NO: 1094463 - protein, 9 aa, Homo Sapiens
ALGRFRSSG

SEQ ID NO: 1094464 - protein, 9 aa, Homo Sapiens
PQRGPASPR

SEQ ID NO: 1094465 - protein, 9 aa, Homo Sapiens
PGTTPPATS

SEQ ID NO: 1094466 - protein, 9 aa, Homo Sapiens
RAAQRKSQS

SEQ ID NO: 1094467 - protein, 9 aa, Homo Sapiens
LFLLFFSSV

SEQ ID NO: 1094468 - protein, 9 aa, Homo Sapiens
ELLDLMGGL

SEQ ID NO: 1094469 - protein, 9 aa, Homo Sapiens
CVQAVVILC

SEQ ID NO: 1094470 - protein, 9 aa, Homo Sapiens
CRPAVASRS

SEQ ID NO: 1094471 - protein, 9 aa, Homo Sapiens
AYSKDSGLL

SEQ ID NO: 1094472 - protein, 9 aa, Homo Sapiens
KNHVKNGDH

SEQ ID NO: 1094473 - protein, 9 aa, Homo Sapiens
CLLVLGIAG

SEQ ID NO: 1094474 - protein, 9 aa, Homo Sapiens
QVFLFFTIF

SEQ ID NO: 1094475 - protein, 9 aa, Homo Sapiens
KENERLPRD

SEQ ID NO: 1094476 - protein, 9 aa, Homo Sapiens
TVSASLLAT

SEQ ID NO: 1094477 - protein, 9 aa, Homo Sapiens
KYNATVRNS

SEQ ID NO: 1094478 - protein, 9 aa, Homo Sapiens
AVFLLFLAV

SEQ ID NO: 1094479 - protein, 9 aa, Homo Sapiens
KGTPTEWTR

SEQ ID NO: 1094480 - protein, 9 aa, Homo Sapiens
ITLNCTLLL

SEQ ID NO: 1094481 - protein, 9 aa, Homo Sapiens
QNLLETLGE

SEQ ID NO: 1094482 - protein, 9 aa, Homo Sapiens
ACTMPPLLH

SEQ ID NO: 1094483 - protein, 9 aa, Homo Sapiens
GSPKIEVAR

SEQ ID NO: 1094484 - protein, 9 aa, Homo Sapiens
SKNIQVVVE

SEQ ID NO: 1094485 - protein, 9 aa, Homo Sapiens
LSYELQSVA

SEQ ID NO: 1094486 - protein, 9 aa, Homo Sapiens
GALVAILLY

SEQ ID NO: 1094487 - protein, 9 aa, Homo Sapiens
DRGVIDYDW

SEQ ID NO: 1094488 - protein, 9 aa, Homo Sapiens
AVMTAAGIA

SEQ ID NO: 1094489 - protein, 9 aa, Homo Sapiens
SPCLGWPLD

SEQ ID NO: 1094490 - protein, 9 aa, Homo Sapiens
TSRRTRPNR

SEQ ID NO: 1094491 - protein, 9 aa, Homo Sapiens
ANPHAWGRF

SEQ ID NO: 1094492 - protein, 9 aa, Homo Sapiens
RSLLGWARC

SEQ ID NO: 1094493 - protein, 9 aa, Homo Sapiens
RLLYVVAAD

SEQ ID NO: 1094494 - protein, 9 aa, Homo Sapiens
ESCCEPPAA

SEQ ID NO: 1094495 - protein, 9 aa, Homo Sapiens
RRYRPRGAR

SEQ ID NO: 1094496 - protein, 9 aa, Homo Sapiens
AAVTTAVLG

SEQ ID NO: 1094497 - protein, 9 aa, Homo Sapiens
MLYIVDWMD

SEQ ID NO: 1094498 - protein, 9 aa, Homo Sapiens
CEGIGCCYS

SEQ ID NO: 1094499 - protein, 9 aa, Homo Sapiens
DISPLCFSI

SEQ ID NO: 1094500 - protein, 9 aa, Homo Sapiens
SGEQIPGLL

SEQ ID NO: 1094501 - protein, 9 aa, Homo Sapiens
SHAALERYV

SEQ ID NO: 1094502 - protein, 9 aa, Homo Sapiens
KVLSLRKTQ

SEQ ID NO: 1094503 - protein, 9 aa, Homo Sapiens
STVHVTGNP

SEQ ID NO: 1094504 - protein, 9 aa, Homo Sapiens
VFPPLIPLL

SEQ ID NO: 1094505 - protein, 9 aa, Homo Sapiens
LTHAFDRYE

SEQ ID NO: 1094506 - protein, 9 aa, Homo Sapiens
VGKSCCQPV

SEQ ID NO: 1094507 - protein, 9 aa, Homo Sapiens
VGIARHSGS

SEQ ID NO: 1094508 - protein, 9 aa, Homo Sapiens
NVGNLAVRP

SEQ ID NO: 1094509 - protein, 9 aa, Homo Sapiens
SYLSYIRYG

SEQ ID NO: 1094510 - protein, 9 aa, Homo Sapiens
FRRSGSGSG

SEQ ID NO: 1094511 - protein, 9 aa, Homo Sapiens
ILCIFIRNC

SEQ ID NO: 1094512 - protein, 9 aa, Homo Sapiens
AKASGAPRL

SEQ ID NO: 1094513 - protein, 9 aa, Homo Sapiens
EEVIREGWR

SEQ ID NO: 1094514 - protein, 9 aa, Homo Sapiens
IWFIRKNKP

SEQ ID NO: 1094515 - protein, 9 aa, Homo Sapiens
PGSCPPSRA

SEQ ID NO: 1094516 - protein, 9 aa, Homo Sapiens
RSHVGPGAP

SEQ ID NO: 1094517 - protein, 9 aa, Homo Sapiens
GLTTVSHNG

SEQ ID NO: 1094518 - protein, 9 aa, Homo Sapiens
WPLQPAPPP

SEQ ID NO: 1094519 - protein, 9 aa, Homo Sapiens
PSSYLELPD

SEQ ID NO: 1094520 - protein, 9 aa, Homo Sapiens
YQWFQVDFG

SEQ ID NO: 1094521 - protein, 9 aa, Homo Sapiens
PYFVYSRVG

SEQ ID NO: 1094522 - protein, 9 aa, Homo Sapiens
PASSSLQFW

SEQ ID NO: 1094523 - protein, 9 aa, Homo Sapiens
SCGTGSRRG

SEQ ID NO: 1094524 - protein, 9 aa, Homo Sapiens
MIFSCLNRI

SEQ ID NO: 1094525 - protein, 9 aa, Homo Sapiens
LLQQAGHEA

SEQ ID NO: 1094526 - protein, 9 aa, Homo Sapiens
SSSVLDRLL

SEQ ID NO: 1094527 - protein, 9 aa, Homo Sapiens
YYLTNGIHK

SEQ ID NO: 1094528 - protein, 9 aa, Homo Sapiens
QKGSFLGEF

SEQ ID NO: 1094529 - protein, 9 aa, Homo Sapiens
SPYWMKKVK

SEQ ID NO: 1094530 - protein, 9 aa, Homo Sapiens
GIALWGERN

SEQ ID NO: 1094531 - protein, 9 aa, Homo Sapiens
NQLQPQPTW

SEQ ID NO: 1094532 - protein, 9 aa, Homo Sapiens
RERRWDRGD

SEQ ID NO: 1094533 - protein, 9 aa, Homo Sapiens
GDGKASTGV

SEQ ID NO: 1094534 - protein, 9 aa, Homo Sapiens
NTTILIKDE

SEQ ID NO: 1094535 - protein, 9 aa, Homo Sapiens
PTRSEPLRK

SEQ ID NO: 1094536 - protein, 9 aa, Homo Sapiens
GRLCAPGAP

SEQ ID NO: 1094537 - protein, 9 aa, Homo Sapiens
QGHPNYKYR

SEQ ID NO: 1094538 - protein, 9 aa, Homo Sapiens
QQKWNDMKP

SEQ ID NO: 1094539 - protein, 9 aa, Homo Sapiens
VIHQSHPCS

SEQ ID NO: 1094540 - protein, 9 aa, Homo Sapiens
GKFYETDCY

SEQ ID NO: 1094541 - protein, 9 aa, Homo Sapiens
MYVFQLFGY

SEQ ID NO: 1094542 - protein, 9 aa, Homo Sapiens
DLRMGWGGG

SEQ ID NO: 1094543 - protein, 9 aa, Homo Sapiens
FQWGESPWQ

SEQ ID NO: 1094544 - protein, 9 aa, Homo Sapiens
ILNTNSISV

SEQ ID NO: 1094545 - protein, 9 aa, Homo Sapiens
ILEIFYLKK

SEQ ID NO: 1094546 - protein, 9 aa, Homo Sapiens
AARRGGILF

SEQ ID NO: 1094547 - protein, 9 aa, Homo Sapiens
GMDQQPIMN

SEQ ID NO: 1094548 - protein, 9 aa, Homo Sapiens
PRGAVAGRN

SEQ ID NO: 1094549 - protein, 9 aa, Homo Sapiens
WDDDLGALC

SEQ ID NO: 1094550 - protein, 9 aa, Homo Sapiens
DVCNGGQIL

SEQ ID NO: 1094551 - protein, 9 aa, Homo Sapiens
LKASRMSTA

SEQ ID NO: 1094552 - protein, 9 aa, Homo Sapiens
GTAGPIGIP

SEQ ID NO: 1094553 - protein, 9 aa, Homo Sapiens
EKEEEFQDE

SEQ ID NO: 1094554 - protein, 9 aa, Homo Sapiens
HVDAPGRGE

SEQ ID NO: 1094555 - protein, 9 aa, Homo Sapiens
DTQDQLQDR

SEQ ID NO: 1094556 - protein, 9 aa, Homo Sapiens
FHPWGHHPN

SEQ ID NO: 1094557 - protein, 9 aa, Homo Sapiens
LLYVLILLI

SEQ ID NO: 1094558 - protein, 9 aa, Homo Sapiens
PASWREGCG

SEQ ID NO: 1094559 - protein, 9 aa, Homo Sapiens
LADGAHVWL

SEQ ID NO: 1094560 - protein, 9 aa, Homo Sapiens
LQERGGVAT

SEQ ID NO: 1094561 - protein, 9 aa, Homo Sapiens
GMVRLTRLL

SEQ ID NO: 1094562 - protein, 9 aa, Homo Sapiens
QPPAPSLRA

SEQ ID NO: 1094563 - protein, 9 aa, Homo Sapiens
AKCHRSLPC

SEQ ID NO: 1094564 - protein, 9 aa, Homo Sapiens
QLWARARAA

SEQ ID NO: 1094565 - protein, 9 aa, Homo Sapiens
VDKGYWIAE

SEQ ID NO: 1094566 - protein, 9 aa, Homo Sapiens
PSPQGPLFL

SEQ ID NO: 1094567 - protein, 9 aa, Homo Sapiens
CFYQRSIKE

SEQ ID NO: 1094568 - protein, 9 aa, Homo Sapiens
ISMTLLLCH

SEQ ID NO: 1094569 - protein, 9 aa, Homo Sapiens
LLRAGVNPA

SEQ ID NO: 1094570 - protein, 9 aa, Homo Sapiens
CTLAELRIL

SEQ ID NO: 1094571 - protein, 9 aa, Homo Sapiens
PAVPAAACP

SEQ ID NO: 1094572 - protein, 9 aa, Homo Sapiens
VQESWPGLW

SEQ ID NO: 1094573 - protein, 9 aa, Homo Sapiens
LAVLALLSF

SEQ ID NO: 1094574 - protein, 9 aa, Homo Sapiens
LSFTTANTV

SEQ ID NO: 1094575 - protein, 9 aa, Homo Sapiens
GGCGSTPPP

SEQ ID NO: 1094576 - protein, 9 aa, Homo Sapiens
AWGSLSNYN

SEQ ID NO: 1094577 - protein, 9 aa, Homo Sapiens
LLVYLRAAR

SEQ ID NO: 1094578 - protein, 9 aa, Homo Sapiens
VRRAAQLCG

SEQ ID NO: 1094579 - protein, 9 aa, Homo Sapiens
WCRAMTKNT

SEQ ID NO: 1094580 - protein, 9 aa, Homo Sapiens
IKENPPASE

SEQ ID NO: 1094581 - protein, 9 aa, Homo Sapiens
SKDFLPPQH

SEQ ID NO: 1094582 - protein, 9 aa, Homo Sapiens
PPARSWSAP

SEQ ID NO: 1094583 - protein, 9 aa, Homo Sapiens
ERKRKKMTA

SEQ ID NO: 1094584 - protein, 9 aa, Homo Sapiens
SLPGPCASL

SEQ ID NO: 1094585 - protein, 9 aa, Homo Sapiens
NLNLQKSSC

SEQ ID NO: 1094586 - protein, 9 aa, Homo Sapiens
LRKLAINMV

SEQ ID NO: 1094587 - protein, 9 aa, Homo Sapiens
NYEKITSCY

SEQ ID NO: 1094588 - protein, 9 aa, Homo Sapiens
ALDGSLGME

SEQ ID NO: 1094589 - protein, 9 aa, Homo Sapiens
CHDCGVAHR

SEQ ID NO: 1094590 - protein, 9 aa, Homo Sapiens
LLLLLDLPI

SEQ ID NO: 1094591 - protein, 9 aa, Homo Sapiens
VAVAAVAVA

SEQ ID NO: 1094592 - protein, 9 aa, Homo Sapiens
SFTTANTVP

SEQ ID NO: 1094593 - protein, 9 aa, Homo Sapiens
KKSDSLLQL

SEQ ID NO: 1094594 - protein, 9 aa, Homo Sapiens
GGYPAYSKD

SEQ ID NO: 1094595 - protein, 9 aa, Homo Sapiens
PPRPRPAAD

SEQ ID NO: 1094596 - protein, 9 aa, Homo Sapiens
ECLIALKKI

SEQ ID NO: 1094597 - protein, 9 aa, Homo Sapiens
RRRALPVAA

SEQ ID NO: 1094598 - protein, 9 aa, Homo Sapiens
APATYRVEG

SEQ ID NO: 1094599 - protein, 9 aa, Homo Sapiens
KNIHGVRMG

SEQ ID NO: 1094600 - protein, 9 aa, Homo Sapiens
ALGYMEAFL

SEQ ID NO: 1094601 - protein, 9 aa, Homo Sapiens
NSSLVIPSG

SEQ ID NO: 1094602 - protein, 9 aa, Homo Sapiens
RRGEQSPEA

SEQ ID NO: 1094603 - protein, 9 aa, Homo Sapiens
AGRRRPALR

SEQ ID NO: 1094604 - protein, 9 aa, Homo Sapiens
HIDLHSAPS

SEQ ID NO: 1094605 - protein, 9 aa, Homo Sapiens
HPHPTVRPW

SEQ ID NO: 1094606 - protein, 9 aa, Homo Sapiens
TPASPWPAL

SEQ ID NO: 1094607 - protein, 9 aa, Homo Sapiens
MGLEESELW

SEQ ID NO: 1094608 - protein, 9 aa, Homo Sapiens
EASQVGGTQ

SEQ ID NO: 1094609 - protein, 9 aa, Homo Sapiens
YAVATASCG

SEQ ID NO: 1094610 - protein, 9 aa, Homo Sapiens
VVHQVRPIV

SEQ ID NO: 1094611 - protein, 9 aa, Homo Sapiens
APRQTPGQA

SEQ ID NO: 1094612 - protein, 9 aa, Homo Sapiens
PLQQVGIFL

SEQ ID NO: 1094613 - protein, 9 aa, Homo Sapiens
FFCRDRVLL

SEQ ID NO: 1094614 - protein, 9 aa, Homo Sapiens
LGPAVLEPD

SEQ ID NO: 1094615 - protein, 9 aa, Homo Sapiens
SALCVLSSI

SEQ ID NO: 1094616 - protein, 9 aa, Homo Sapiens
QAWWWGTLV

SEQ ID NO: 1094617 - protein, 9 aa, Homo Sapiens
DSELAQNKE

SEQ ID NO: 1094618 - protein, 9 aa, Homo Sapiens
SADAKGSTT

SEQ ID NO: 1094619 - protein, 9 aa, Homo Sapiens
KDGPPRIEL

SEQ ID NO: 1094620 - protein, 9 aa, Homo Sapiens
SLTGTTMAT

SEQ ID NO: 1094621 - protein, 9 aa, Homo Sapiens
RQRGEMQAQ

SEQ ID NO: 1094622 - protein, 9 aa, Homo Sapiens
SCVALFKGA

SEQ ID NO: 1094623 - protein, 9 aa, Homo Sapiens
SVPVSHSLR

SEQ ID NO: 1094624 - protein, 9 aa, Homo Sapiens
YDVQKCTIY

SEQ ID NO: 1094625 - protein, 9 aa, Homo Sapiens
DSPENAPPY

SEQ ID NO: 1094626 - protein, 9 aa, Homo Sapiens
TALMAATQH

SEQ ID NO: 1094627 - protein, 9 aa, Homo Sapiens
IPVKSKNIQ

SEQ ID NO: 1094628 - protein, 9 aa, Homo Sapiens
SAHSMCKQN

SEQ ID NO: 1094629 - protein, 9 aa, Homo Sapiens
SSPSTSQTP

SEQ ID NO: 1094630 - protein, 9 aa, Homo Sapiens
HQSHPCSTS

SEQ ID NO: 1094631 - protein, 9 aa, Homo Sapiens
EARVAELPV

SEQ ID NO: 1094632 - protein, 9 aa, Homo Sapiens
EHRDHDSSL

SEQ ID NO: 1094633 - protein, 9 aa, Homo Sapiens
LKTALQPDM

SEQ ID NO: 1094634 - protein, 9 aa, Homo Sapiens
FFSRSHLDF

SEQ ID NO: 1094635 - protein, 9 aa, Homo Sapiens
LFIISQPGP

SEQ ID NO: 1094636 - protein, 9 aa, Homo Sapiens
VQCVTELAV

SEQ ID NO: 1094637 - protein, 9 aa, Homo Sapiens
VDDGLSRVC

SEQ ID NO: 1094638 - protein, 9 aa, Homo Sapiens
GLLVGIVQC

SEQ ID NO: 1094639 - protein, 9 aa, Homo Sapiens
ASAPCGLST

SEQ ID NO: 1094640 - protein, 9 aa, Homo Sapiens
FKPCGTFHH

SEQ ID NO: 1094641 - protein, 9 aa, Homo Sapiens
SRGGPGCLL

SEQ ID NO: 1094642 - protein, 9 aa, Homo Sapiens
ISSFPDEED

SEQ ID NO: 1094643 - protein, 9 aa, Homo Sapiens
PPLLFLGPL

SEQ ID NO: 1094644 - protein, 9 aa, Homo Sapiens
RWHIRSSGA

SEQ ID NO: 1094645 - protein, 9 aa, Homo Sapiens
SSVLTAEGT

SEQ ID NO: 1094646 - protein, 9 aa, Homo Sapiens
SMQAHGEQS

SEQ ID NO: 1094647 - protein, 9 aa, Homo Sapiens
GSGSGGGGT

SEQ ID NO: 1094648 - protein, 9 aa, Homo Sapiens
ATCVFVLVR

SEQ ID NO: 1094649 - protein, 9 aa, Homo Sapiens
RKGVHQAWQ

SEQ ID NO: 1094650 - protein, 9 aa, Homo Sapiens
ARPSPSQEP

SEQ ID NO: 1094651 - protein, 9 aa, Homo Sapiens
GWLLYADWP

SEQ ID NO: 1094652 - protein, 9 aa, Homo Sapiens
RALHQLKCQ

SEQ ID NO: 1094653 - protein, 9 aa, Homo Sapiens
NPYKTLQAQ

SEQ ID NO: 1094654 - protein, 9 aa, Homo Sapiens
SEDSSCLPK

SEQ ID NO: 1094655 - protein, 9 aa, Homo Sapiens
TACSTFFLV

SEQ ID NO: 1094656 - protein, 9 aa, Homo Sapiens
KYVRILAFL

SEQ ID NO: 1094657 - protein, 9 aa, Homo Sapiens
NPKRLGTGR

SEQ ID NO: 1094658 - protein, 9 aa, Homo Sapiens
SVADKALAP

SEQ ID NO: 1094659 - protein, 9 aa, Homo Sapiens
LMSDLLQQA

SEQ ID NO: 1094660 - protein, 9 aa, Homo Sapiens
PKKSYALSN

SEQ ID NO: 1094661 - protein, 9 aa, Homo Sapiens
VESFDDQHR

SEQ ID NO: 1094662 - protein, 9 aa, Homo Sapiens
NMRALFALY

SEQ ID NO: 1094663 - protein, 9 aa, Homo Sapiens
VNLLCPVIF

SEQ ID NO: 1094664 - protein, 9 aa, Homo Sapiens
IMWDPDHYG

SEQ ID NO: 1094665 - protein, 9 aa, Homo Sapiens
PARPLEVRA

SEQ ID NO: 1094666 - protein, 9 aa, Homo Sapiens
GDGKKMDLD

SEQ ID NO: 1094667 - protein, 9 aa, Homo Sapiens
CYDYKICVN

SEQ ID NO: 1094668 - protein, 9 aa, Homo Sapiens
ALMAATQHG

SEQ ID NO: 1094669 - protein, 9 aa, Homo Sapiens
LRTVDCKLK

SEQ ID NO: 1094670 - protein, 9 aa, Homo Sapiens
FLTSIIVVI

SEQ ID NO: 1094671 - protein, 9 aa, Homo Sapiens
LQLVNPHTH

SEQ ID NO: 1094672 - protein, 9 aa, Homo Sapiens
YELRSWSPG

SEQ ID NO: 1094673 - protein, 9 aa, Homo Sapiens
MFFIGFAAL

SEQ ID NO: 1094674 - protein, 9 aa, Homo Sapiens
AAPAAMRAA

SEQ ID NO: 1094675 - protein, 9 aa, Homo Sapiens
WQRRKQSSS

SEQ ID NO: 1094676 - protein, 9 aa, Homo Sapiens
LPWPFPGWL

SEQ ID NO: 1094677 - protein, 9 aa, Homo Sapiens
RPGSPRSSA

SEQ ID NO: 1094678 - protein, 9 aa, Homo Sapiens
RACLPDHVD

SEQ ID NO: 1094679 - protein, 9 aa, Homo Sapiens
SHPRASQVV

SEQ ID NO: 1094680 - protein, 9 aa, Homo Sapiens
ASCASPPCA

SEQ ID NO: 1094681 - protein, 9 aa, Homo Sapiens
WCPPSPHKV

SEQ ID NO: 1094682 - protein, 9 aa, Homo Sapiens
EIANEYKYK

SEQ ID NO: 1094683 - protein, 9 aa, Homo Sapiens
SGNVHHCFP

SEQ ID NO: 1094684 - protein, 9 aa, Homo Sapiens
RCEGDQHVT

SEQ ID NO: 1094685 - protein, 9 aa, Homo Sapiens
YHQALLRIS

SEQ ID NO: 1094686 - protein, 9 aa, Homo Sapiens
TWNVLDDQS

SEQ ID NO: 1094687 - protein, 9 aa, Homo Sapiens
LSISCPTLT

SEQ ID NO: 1094688 - protein, 9 aa, Homo Sapiens
HMQGHPNYK

SEQ ID NO: 1094689 - protein, 9 aa, Homo Sapiens
GRQHHVLQE

SEQ ID NO: 1094690 - protein, 9 aa, Homo Sapiens
GLLTSSSRE

SEQ ID NO: 1094691 - protein, 9 aa, Homo Sapiens
NLLHGKTIE

SEQ ID NO: 1094692 - protein, 9 aa, Homo Sapiens
VAALFTPPK

SEQ ID NO: 1094693 - protein, 9 aa, Homo Sapiens
KSLMTANSQ

SEQ ID NO: 1094694 - protein, 9 aa, Homo Sapiens
FLHHLHCPC

SEQ ID NO: 1094695 - protein, 9 aa, Homo Sapiens
CKESLAKDR

SEQ ID NO: 1094696 - protein, 9 aa, Homo Sapiens
ICTVLCIWC

SEQ ID NO: 1094697 - protein, 9 aa, Homo Sapiens
EKVICSSLN

SEQ ID NO: 1094698 - protein, 9 aa, Homo Sapiens
DQRRLFLYK

SEQ ID NO: 1094699 - protein, 9 aa, Homo Sapiens
INMVPFPRL

SEQ ID NO: 1094700 - protein, 9 aa, Homo Sapiens
FSELLDLMG

SEQ ID NO: 1094701 - protein, 9 aa, Homo Sapiens
RMLKQNLNL

SEQ ID NO: 1094702 - protein, 9 aa, Homo Sapiens
WVLFASKAI

SEQ ID NO: 1094703 - protein, 9 aa, Homo Sapiens
TGPGSCPPS

SEQ ID NO: 1094704 - protein, 9 aa, Homo Sapiens
LSNSSVIPH

SEQ ID NO: 1094705 - protein, 9 aa, Homo Sapiens
KQRIQNLSC

SEQ ID NO: 1094706 - protein, 9 aa, Homo Sapiens
STPTCLRTC

SEQ ID NO: 1094707 - protein, 9 aa, Homo Sapiens
KEEECLIAL

SEQ ID NO: 1094708 - protein, 9 aa, Homo Sapiens
DPTGNVRSG

SEQ ID NO: 1094709 - protein, 9 aa, Homo Sapiens
YCLLKASEP

SEQ ID NO: 1094710 - protein, 9 aa, Homo Sapiens
FAKVLPPSL

SEQ ID NO: 1094711 - protein, 9 aa, Homo Sapiens
QGIRGTISL

SEQ ID NO: 1094712 - protein, 9 aa, Homo Sapiens
KFQELWYSV

SEQ ID NO: 1094713 - protein, 9 aa, Homo Sapiens
KTLYYDVES

SEQ ID NO: 1094714 - protein, 9 aa, Homo Sapiens
DYNMDFLTL

SEQ ID NO: 1094715 - protein, 9 aa, Homo Sapiens
PGEPPGRGV

SEQ ID NO: 1094716 - protein, 9 aa, Homo Sapiens
SSGSRSLWP

SEQ ID NO: 1094717 - protein, 9 aa, Homo Sapiens
GKWLQWPHP

SEQ ID NO: 1094718 - protein, 9 aa, Homo Sapiens
AIPGGKETL

SEQ ID NO: 1094719 - protein, 9 aa, Homo Sapiens
EHCTRQFQA

SEQ ID NO: 1094720 - protein, 9 aa, Homo Sapiens
GHGCLLAYI

SEQ ID NO: 1094721 - protein, 9 aa, Homo Sapiens
AAAMVLSTD

SEQ ID NO: 1094722 - protein, 9 aa, Homo Sapiens
RREKPRREK

SEQ ID NO: 1094723 - protein, 9 aa, Homo Sapiens
LVKWKIAVD

SEQ ID NO: 1094724 - protein, 9 aa, Homo Sapiens
ISCPFQSPT

SEQ ID NO: 1094725 - protein, 9 aa, Homo Sapiens
VQKCTIYLN

SEQ ID NO: 1094726 - protein, 9 aa, Homo Sapiens
TFFCRDRVL

SEQ ID NO: 1094727 - protein, 9 aa, Homo Sapiens
ATSPLPSPH

SEQ ID NO: 1094728 - protein, 9 aa, Homo Sapiens
PLPLTSASK

SEQ ID NO: 1094729 - protein, 9 aa, Homo Sapiens
RAAQSSKRP

SEQ ID NO: 1094730 - protein, 9 aa, Homo Sapiens
TLLSTPEEQ

SEQ ID NO: 1094731 - protein, 9 aa, Homo Sapiens
WGSASCFSN

SEQ ID NO: 1094732 - protein, 9 aa, Homo Sapiens
AASETYTSK

SEQ ID NO: 1094733 - protein, 9 aa, Homo Sapiens
CCRVQDTGP

SEQ ID NO: 1094734 - protein, 9 aa, Homo Sapiens
VGGFVYRDC

SEQ ID NO: 1094735 - protein, 9 aa, Homo Sapiens
TPPPPPGWL

SEQ ID NO: 1094736 - protein, 9 aa, Homo Sapiens
KKKADRDQS

SEQ ID NO: 1094737 - protein, 9 aa, Homo Sapiens
GAAIAAPDS

SEQ ID NO: 1094738 - protein, 9 aa, Homo Sapiens
NLLCPVIFG

SEQ ID NO: 1094739 - protein, 9 aa, Homo Sapiens
FLQSKYGGS

SEQ ID NO: 1094740 - protein, 9 aa, Homo Sapiens
SSPGHPLGP

SEQ ID NO: 1094741 - protein, 9 aa, Homo Sapiens
HPNLPMRNT

SEQ ID NO: 1094742 - protein, 9 aa, Homo Sapiens
RTGLQKKQR

SEQ ID NO: 1094743 - protein, 9 aa, Homo Sapiens
DERWYTPRA

SEQ ID NO: 1094744 - protein, 9 aa, Homo Sapiens
LLPIPGSNC

SEQ ID NO: 1094745 - protein, 9 aa, Homo Sapiens
PPAPAPWLP

SEQ ID NO: 1094746 - protein, 9 aa, Homo Sapiens
ALSEGRRPD

SEQ ID NO: 1094747 - protein, 9 aa, Homo Sapiens
PVYHRNCLL

SEQ ID NO: 1094748 - protein, 9 aa, Homo Sapiens
SWARQRGEM

SEQ ID NO: 1094749 - protein, 9 aa, Homo Sapiens
FEKAKAIYF

SEQ ID NO: 1094750 - protein, 9 aa, Homo Sapiens
GSPLLSGAR

SEQ ID NO: 1094751 - protein, 9 aa, Homo Sapiens
SLKGLWTLH

SEQ ID NO: 1094752 - protein, 9 aa, Homo Sapiens
PVFPPLIPL

SEQ ID NO: 1094753 - protein, 9 aa, Homo Sapiens
VNTTSRMES

SEQ ID NO: 1094754 - protein, 9 aa, Homo Sapiens
SSLRDLLEA

SEQ ID NO: 1094755 - protein, 9 aa, Homo Sapiens
QHRNVCYCS

SEQ ID NO: 1094756 - protein, 9 aa, Homo Sapiens
VVVMEISYM

SEQ ID NO: 1094757 - protein, 9 aa, Homo Sapiens
RKSKDKKQK

SEQ ID NO: 1094758 - protein, 9 aa, Homo Sapiens
LKSSYSRYS

SEQ ID NO: 1094759 - protein, 9 aa, Homo Sapiens
KTISCNDCI

SEQ ID NO: 1094760 - protein, 9 aa, Homo Sapiens
VNIFIMAFG

SEQ ID NO: 1094761 - protein, 9 aa, Homo Sapiens
SADEKARKL

SEQ ID NO: 1094762 - protein, 9 aa, Homo Sapiens
WDMYHHDID

SEQ ID NO: 1094763 - protein, 9 aa, Homo Sapiens
DGTVLQEAV

SEQ ID NO: 1094764 - protein, 9 aa, Homo Sapiens
LRPGGTSSS

SEQ ID NO: 1094765 - protein, 9 aa, Homo Sapiens
TTLAWGILL

SEQ ID NO: 1094766 - protein, 9 aa, Homo Sapiens
LVAILLYVL

SEQ ID NO: 1094767 - protein, 9 aa, Homo Sapiens
TRAFEENRY

SEQ ID NO: 1094768 - protein, 9 aa, Homo Sapiens
AFFLVVSCW

SEQ ID NO: 1094769 - protein, 9 aa, Homo Sapiens
VWNALCRPS

SEQ ID NO: 1094770 - protein, 9 aa, Homo Sapiens
KKTVILQIV

SEQ ID NO: 1094771 - protein, 9 aa, Homo Sapiens
GETGMVHAA

SEQ ID NO: 1094772 - protein, 9 aa, Homo Sapiens
HLAVEACLR

SEQ ID NO: 1094773 - protein, 9 aa, Homo Sapiens
PSRCGSATG

SEQ ID NO: 1094774 - protein, 9 aa, Homo Sapiens
ATMDERWYT

SEQ ID NO: 1094775 - protein, 9 aa, Homo Sapiens
LVGGFVYRD

SEQ ID NO: 1094776 - protein, 9 aa, Homo Sapiens
FKGRGQILH

SEQ ID NO: 1094777 - protein, 9 aa, Homo Sapiens
VKKRKKREK

SEQ ID NO: 1094778 - protein, 9 aa, Homo Sapiens
CNESCEKRA

SEQ ID NO: 1094779 - protein, 9 aa, Homo Sapiens
VDEHESVDQ

SEQ ID NO: 1094780 - protein, 9 aa, Homo Sapiens
HHLGLLQGR

SEQ ID NO: 1094781 - protein, 9 aa, Homo Sapiens
QLLQPNKVP

SEQ ID NO: 1094782 - protein, 9 aa, Homo Sapiens
TAALCRKDW

SEQ ID NO: 1094783 - protein, 9 aa, Homo Sapiens
NLLFQKLPK

SEQ ID NO: 1094784 - protein, 9 aa, Homo Sapiens
TCSRPCCRV

SEQ ID NO: 1094785 - protein, 9 aa, Homo Sapiens
AITISLAIA

SEQ ID NO: 1094786 - protein, 9 aa, Homo Sapiens
HDKLAHPHR

SEQ ID NO: 1094787 - protein, 9 aa, Homo Sapiens
VPMWSCIVW

SEQ ID NO: 1094788 - protein, 9 aa, Homo Sapiens
CPECGRAFN

SEQ ID NO: 1094789 - protein, 9 aa, Homo Sapiens
GVKAPRNLG

SEQ ID NO: 1094790 - protein, 9 aa, Homo Sapiens
KKREEEMCD

SEQ ID NO: 1094791 - protein, 9 aa, Homo Sapiens
SKRRCGLTS

SEQ ID NO: 1094792 - protein, 9 aa, Homo Sapiens
PPVFSRPIL

SEQ ID NO: 1094793 - protein, 9 aa, Homo Sapiens
ESEDVKIWV

SEQ ID NO: 1094794 - protein, 9 aa, Homo Sapiens
GGPPRSRLA

SEQ ID NO: 1094795 - protein, 9 aa, Homo Sapiens
VLLPRLVEH

SEQ ID NO: 1094796 - protein, 9 aa, Homo Sapiens
DGMTVGVVH

SEQ ID NO: 1094797 - protein, 9 aa, Homo Sapiens
SSGLPCSWW

SEQ ID NO: 1094798 - protein, 9 aa, Homo Sapiens
VCNGGQILI

SEQ ID NO: 1094799 - protein, 9 aa, Homo Sapiens
RALRCSTTR

SEQ ID NO: 1094800 - protein, 9 aa, Homo Sapiens
SDKECTSAV

SEQ ID NO: 1094801 - protein, 9 aa, Homo Sapiens
HALTRAGLY

SEQ ID NO: 1094802 - protein, 9 aa, Homo Sapiens
GHQDHQVSA

SEQ ID NO: 1094803 - protein, 9 aa, Homo Sapiens
LLSGARGRT

SEQ ID NO: 1094804 - protein, 9 aa, Homo Sapiens
EAEAGAARR

SEQ ID NO: 1094805 - protein, 9 aa, Homo Sapiens
RLLLQEWRE

SEQ ID NO: 1094806 - protein, 9 aa, Homo Sapiens
EDFEDNHHL

SEQ ID NO: 1094807 - protein, 9 aa, Homo Sapiens
PGGKETLVT

SEQ ID NO: 1094808 - protein, 9 aa, Homo Sapiens
LPMRNTGSR

SEQ ID NO: 1094809 - protein, 9 aa, Homo Sapiens
PDEAFALPN

SEQ ID NO: 1094810 - protein, 9 aa, Homo Sapiens
ALLADESSD

SEQ ID NO: 1094811 - protein, 9 aa, Homo Sapiens
LLGLLLFKI

SEQ ID NO: 1094812 - protein, 9 aa, Homo Sapiens
PAWCMAVRS

SEQ ID NO: 1094813 - protein, 9 aa, Homo Sapiens
PRRRKKEAT

SEQ ID NO: 1094814 - protein, 9 aa, Homo Sapiens
RRHVCKQSM

SEQ ID NO: 1094815 - protein, 9 aa, Homo Sapiens
CYYNFTNRK

SEQ ID NO: 1094816 - protein, 9 aa, Homo Sapiens
MRALFALYM

SEQ ID NO: 1094817 - protein, 9 aa, Homo Sapiens
LGSWGQTDL

SEQ ID NO: 1094818 - protein, 9 aa, Homo Sapiens
WFSNLESTH

SEQ ID NO: 1094819 - protein, 9 aa, Homo Sapiens
LDDQSRGFT

SEQ ID NO: 1094820 - protein, 9 aa, Homo Sapiens
TWMTWCGWL

SEQ ID NO: 1094821 - protein, 9 aa, Homo Sapiens
AHRVRRHHL

SEQ ID NO: 1094822 - protein, 9 aa, Homo Sapiens
LRPLSLQCQ

SEQ ID NO: 1094823 - protein, 9 aa, Homo Sapiens
RKQLLSFQQ

SEQ ID NO: 1094824 - protein, 9 aa, Homo Sapiens
QEEAKEEEC

SEQ ID NO: 1094825 - protein, 9 aa, Homo Sapiens
WGESPWQVM

SEQ ID NO: 1094826 - protein, 9 aa, Homo Sapiens
KLPPAPAPW

SEQ ID NO: 1094827 - protein, 9 aa, Homo Sapiens
LTHCTFWTR

SEQ ID NO: 1094828 - protein, 9 aa, Homo Sapiens
CLSIGHPYF

SEQ ID NO: 1094829 - protein, 9 aa, Homo Sapiens
LGYLLVPAR

SEQ ID NO: 1094830 - protein, 9 aa, Homo Sapiens
EACAPGQGH

SEQ ID NO: 1094831 - protein, 9 aa, Homo Sapiens
ARGAALQTG

SEQ ID NO: 1094832 - protein, 9 aa, Homo Sapiens
DSRHYHCSG

SEQ ID NO: 1094833 - protein, 9 aa, Homo Sapiens
ASAATSRGM

SEQ ID NO: 1094834 - protein, 9 aa, Homo Sapiens
PSLCESTTG

SEQ ID NO: 1094835 - protein, 9 aa, Homo Sapiens
LYLVNLNKN

SEQ ID NO: 1094836 - protein, 9 aa, Homo Sapiens
THVDLRLAS

SEQ ID NO: 1094837 - protein, 9 aa, Homo Sapiens
QADLDYLPR

SEQ ID NO: 1094838 - protein, 9 aa, Homo Sapiens
PPPPLLFLG

SEQ ID NO: 1094839 - protein, 9 aa, Homo Sapiens
SYSGPPRRE

SEQ ID NO: 1094840 - protein, 9 aa, Homo Sapiens
EYWLGNDNI

SEQ ID NO: 1094841 - protein, 9 aa, Homo Sapiens
PEASCLFPP

SEQ ID NO: 1094842 - protein, 9 aa, Homo Sapiens
PDSVPGPPP

SEQ ID NO: 1094843 - protein, 9 aa, Homo Sapiens
GCRHSVPEA

SEQ ID NO: 1094844 - protein, 9 aa, Homo Sapiens
RVLPRSLPR

SEQ ID NO: 1094845 - protein, 9 aa, Homo Sapiens
ALFALYMSA

SEQ ID NO: 1094846 - protein, 9 aa, Homo Sapiens
QLRTVDCKL

SEQ ID NO: 1094847 - protein, 9 aa, Homo Sapiens
EKREIRCVQ

SEQ ID NO: 1094848 - protein, 9 aa, Homo Sapiens
TRLMAPVGS

SEQ ID NO: 1094849 - protein, 9 aa, Homo Sapiens
GVHNFEIDT

SEQ ID NO: 1094850 - protein, 9 aa, Homo Sapiens
AVLPDHRKF

SEQ ID NO: 1094851 - protein, 9 aa, Homo Sapiens
PRKEHSMGS

SEQ ID NO: 1094852 - protein, 9 aa, Homo Sapiens
DVQELRMAM

SEQ ID NO: 1094853 - protein, 9 aa, Homo Sapiens
MVAVKGIVK

SEQ ID NO: 1094854 - protein, 9 aa, Homo Sapiens
LMAPVGSVM

SEQ ID NO: 1094855 - protein, 9 aa, Homo Sapiens
TNWYQASKK

SEQ ID NO: 1094856 - protein, 9 aa, Homo Sapiens
SGNGTILGL

SEQ ID NO: 1094857 - protein, 9 aa, Homo Sapiens
DPTWISENP

SEQ ID NO: 1094858 - protein, 9 aa, Homo Sapiens
DMVSPEVTN

SEQ ID NO: 1094859 - protein, 9 aa, Homo Sapiens
QHIHFFLAL

SEQ ID NO: 1094860 - protein, 9 aa, Homo Sapiens
IGTILLNQT

SEQ ID NO: 1094861 - protein, 9 aa, Homo Sapiens
SSLLEMDGE

SEQ ID NO: 1094862 - protein, 9 aa, Homo Sapiens
GGVLLRPAR

SEQ ID NO: 1094863 - protein, 9 aa, Homo Sapiens
AAHGPARPL

SEQ ID NO: 1094864 - protein, 9 aa, Homo Sapiens
GALWLLSPS

SEQ ID NO: 1094865 - protein, 9 aa, Homo Sapiens
FEKGHIYTF

SEQ ID NO: 1094866 - protein, 9 aa, Homo Sapiens
TERREMREY

SEQ ID NO: 1094867 - protein, 9 aa, Homo Sapiens
QREQEWAVR

SEQ ID NO: 1094868 - protein, 9 aa, Homo Sapiens
LPTYQHSEV

SEQ ID NO: 1094869 - protein, 9 aa, Homo Sapiens
AGPAAERAG

SEQ ID NO: 1094870 - protein, 9 aa, Homo Sapiens
LDDQIQWPT

SEQ ID NO: 1094871 - protein, 9 aa, Homo Sapiens
RMPRRMQLR

SEQ ID NO: 1094872 - protein, 9 aa, Homo Sapiens
PSGTPPSPV

SEQ ID NO: 1094873 - protein, 9 aa, Homo Sapiens
FSFGSVEAE

SEQ ID NO: 1094874 - protein, 9 aa, Homo Sapiens
IQAWWWGTL

SEQ ID NO: 1094875 - protein, 9 aa, Homo Sapiens
IKWRGDFEM

SEQ ID NO: 1094876 - protein, 9 aa, Homo Sapiens
LALTAFQLL

SEQ ID NO: 1094877 - protein, 9 aa, Homo Sapiens
VADMKNSVV

SEQ ID NO: 1094878 - protein, 9 aa, Homo Sapiens
GPDSTPRGR

SEQ ID NO: 1094879 - protein, 9 aa, Homo Sapiens
AFPSPQGPL

SEQ ID NO: 1094880 - protein, 9 aa, Homo Sapiens
GELLAAAGV

SEQ ID NO: 1094881 - protein, 9 aa, Homo Sapiens
GPPPGGRAW

SEQ ID NO: 1094882 - protein, 9 aa, Homo Sapiens
PTPQNQLQP

SEQ ID NO: 1094883 - protein, 9 aa, Homo Sapiens
PDHFLEPGK

SEQ ID NO: 1094884 - protein, 9 aa, Homo Sapiens
QEILNTNSI

SEQ ID NO: 1094885 - protein, 9 aa, Homo Sapiens
IWERIKIEE

SEQ ID NO: 1094886 - protein, 9 aa, Homo Sapiens
EKLSSLRIL

SEQ ID NO: 1094887 - protein, 9 aa, Homo Sapiens
REDAEAVLS

SEQ ID NO: 1094888 - protein, 9 aa, Homo Sapiens
RGAHLNNFL

SEQ ID NO: 1094889 - protein, 9 aa, Homo Sapiens
QKFGSMPFT

SEQ ID NO: 1094890 - protein, 9 aa, Homo Sapiens
GVCDDDTVP

SEQ ID NO: 1094891 - protein, 9 aa, Homo Sapiens
YGSMQAHGE

SEQ ID NO: 1094892 - protein, 9 aa, Homo Sapiens
CSTRQTSMQ

SEQ ID NO: 1094893 - protein, 9 aa, Homo Sapiens
FLSVIVLFG

SEQ ID NO: 1094894 - protein, 9 aa, Homo Sapiens
HITKKQRND

SEQ ID NO: 1094895 - protein, 9 aa, Homo Sapiens
SPTLGRVPH

SEQ ID NO: 1094896 - protein, 9 aa, Homo Sapiens
NLIRMGMTG

SEQ ID NO: 1094897 - protein, 9 aa, Homo Sapiens
EHPGLCGGR

SEQ ID NO: 1094898 - protein, 9 aa, Homo Sapiens
WSPGCPFQA

SEQ ID NO: 1094899 - protein, 9 aa, Homo Sapiens
LQHTHCVQA

SEQ ID NO: 1094900 - protein, 9 aa, Homo Sapiens
RARKDGPPR

SEQ ID NO: 1094901 - protein, 9 aa, Homo Sapiens
SQTRVPPGR

SEQ ID NO: 1094902 - protein, 9 aa, Homo Sapiens
AGAADSAWG

SEQ ID NO: 1094903 - protein, 9 aa, Homo Sapiens
GHVDASLFQ

SEQ ID NO: 1094904 - protein, 9 aa, Homo Sapiens
VEKHMCFHN

SEQ ID NO: 1094905 - protein, 9 aa, Homo Sapiens
GSSPPGRHW

SEQ ID NO: 1094906 - protein, 9 aa, Homo Sapiens
LDALVATTI

SEQ ID NO: 1094907 - protein, 9 aa, Homo Sapiens
KQTMASDPP

SEQ ID NO: 1094908 - protein, 9 aa, Homo Sapiens
GDGQPKAVW

SEQ ID NO: 1094909 - protein, 9 aa, Homo Sapiens
IHRGAHLNN

SEQ ID NO: 1094910 - protein, 9 aa, Homo Sapiens
APHVDGERS

SEQ ID NO: 1094911 - protein, 9 aa, Homo Sapiens
RSWAPVFLD

SEQ ID NO: 1094912 - protein, 9 aa, Homo Sapiens
NISQLTRMG

SEQ ID NO: 1094913 - protein, 9 aa, Homo Sapiens
RGTISLQYK

SEQ ID NO: 1094914 - protein, 9 aa, Homo Sapiens
TEIIIVVNQ

SEQ ID NO: 1094915 - protein, 9 aa, Homo Sapiens
NAAIRDIRH

SEQ ID NO: 1094916 - protein, 9 aa, Homo Sapiens
QERGGVATP

SEQ ID NO: 1094917 - protein, 9 aa, Homo Sapiens
CLLRFSELS

SEQ ID NO: 1094918 - protein, 9 aa, Homo Sapiens
WRQGGSPVG

SEQ ID NO: 1094919 - protein, 9 aa, Homo Sapiens
DYFNIDEGT

SEQ ID NO: 1094920 - protein, 9 aa, Homo Sapiens
PPPKMPPPR

SEQ ID NO: 1094921 - protein, 9 aa, Homo Sapiens
PCASTAKSA

SEQ ID NO: 1094922 - protein, 9 aa, Homo Sapiens
ALQPDMWPK

SEQ ID NO: 1094923 - protein, 9 aa, Homo Sapiens
VNDKFIYVA

SEQ ID NO: 1094924 - protein, 9 aa, Homo Sapiens
KAHHSVLAA

SEQ ID NO: 1094925 - protein, 9 aa, Homo Sapiens
PQSCSSLNA

SEQ ID NO: 1094926 - protein, 9 aa, Homo Sapiens
GKPVDWWVM

SEQ ID NO: 1094927 - protein, 9 aa, Homo Sapiens
NSYCLMQLG

SEQ ID NO: 1094928 - protein, 9 aa, Homo Sapiens
PIKVARYRR

SEQ ID NO: 1094929 - protein, 9 aa, Homo Sapiens
AQVFAFLKG

SEQ ID NO: 1094930 - protein, 9 aa, Homo Sapiens
AQTINHSLL

SEQ ID NO: 1094931 - protein, 9 aa, Homo Sapiens
GVPSMPLIL

SEQ ID NO: 1094932 - protein, 9 aa, Homo Sapiens
SAKETMTIE

SEQ ID NO: 1094933 - protein, 9 aa, Homo Sapiens
PLFRSLLGW

SEQ ID NO: 1094934 - protein, 9 aa, Homo Sapiens
WGERNSSKF

SEQ ID NO: 1094935 - protein, 9 aa, Homo Sapiens
TGPPSNSTN

SEQ ID NO: 1094936 - protein, 9 aa, Homo Sapiens
LRIAGCRHS

SEQ ID NO: 1094937 - protein, 9 aa, Homo Sapiens
GDHQESSQP

SEQ ID NO: 1094938 - protein, 9 aa, Homo Sapiens
GRDTKAPVL

SEQ ID NO: 1094939 - protein, 9 aa, Homo Sapiens
IISQPGPSS

SEQ ID NO: 1094940 - protein, 9 aa, Homo Sapiens
SGPGRRLCT

SEQ ID NO: 1094941 - protein, 9 aa, Homo Sapiens
QSESVQRPW

SEQ ID NO: 1094942 - protein, 9 aa, Homo Sapiens
QLLCQNPEK

SEQ ID NO: 1094943 - protein, 9 aa, Homo Sapiens
GNLAVRPPP

SEQ ID NO: 1094944 - protein, 9 aa, Homo Sapiens
HGGASVPRG

SEQ ID NO: 1094945 - protein, 9 aa, Homo Sapiens
ERYGVPSPE

SEQ ID NO: 1094946 - protein, 9 aa, Homo Sapiens
YAQNRSLLV

SEQ ID NO: 1094947 - protein, 9 aa, Homo Sapiens
IKDYYRRAA

SEQ ID NO: 1094948 - protein, 9 aa, Homo Sapiens
LSVIVLFGY

SEQ ID NO: 1094949 - protein, 9 aa, Homo Sapiens
EAEDDLRGR

SEQ ID NO: 1094950 - protein, 9 aa, Homo Sapiens
ELLCVWVSS

SEQ ID NO: 1094951 - protein, 9 aa, Homo Sapiens
VLARVFSHA

SEQ ID NO: 1094952 - protein, 9 aa, Homo Sapiens
VIASGNRVI

SEQ ID NO: 1094953 - protein, 9 aa, Homo Sapiens
PLSSSPASV

SEQ ID NO: 1094954 - protein, 9 aa, Homo Sapiens
AVASRSTAP

SEQ ID NO: 1094955 - protein, 9 aa, Homo Sapiens
VTDLTACFQ

SEQ ID NO: 1094956 - protein, 9 aa, Homo Sapiens
HLMNISVSL

SEQ ID NO: 1094957 - protein, 9 aa, Homo Sapiens
TLPGEPPGR

SEQ ID NO: 1094958 - protein, 9 aa, Homo Sapiens
GRTPTTRLM

SEQ ID NO: 1094959 - protein, 9 aa, Homo Sapiens
RRWAGVLSH

SEQ ID NO: 1094960 - protein, 9 aa, Homo Sapiens
TSWPSLMLS

SEQ ID NO: 1094961 - protein, 9 aa, Homo Sapiens
LLALLVQPG

SEQ ID NO: 1094962 - protein, 9 aa, Homo Sapiens
FSPYWMKKV

SEQ ID NO: 1094963 - protein, 9 aa, Homo Sapiens
QRNPGGSPC

SEQ ID NO: 1094964 - protein, 9 aa, Homo Sapiens
RLVQSRKGV

SEQ ID NO: 1094965 - protein, 9 aa, Homo Sapiens
VLLALLVQP

SEQ ID NO: 1094966 - protein, 9 aa, Homo Sapiens
SKVSSSLGT

SEQ ID NO: 1094967 - protein, 9 aa, Homo Sapiens
RGFTAVMGD

SEQ ID NO: 1094968 - protein, 9 aa, Homo Sapiens
VMISASEDA

SEQ ID NO: 1094969 - protein, 9 aa, Homo Sapiens
LRLRFEKGH

SEQ ID NO: 1094970 - protein, 9 aa, Homo Sapiens
YILLDSSDP

SEQ ID NO: 1094971 - protein, 9 aa, Homo Sapiens
AYGYQQTYS

SEQ ID NO: 1094972 - protein, 9 aa, Homo Sapiens
SGLLTSSSR

SEQ ID NO: 1094973 - protein, 9 aa, Homo Sapiens
PPGGGRGQE

SEQ ID NO: 1094974 - protein, 9 aa, Homo Sapiens
AINMVPFPR

SEQ ID NO: 1094975 - protein, 9 aa, Homo Sapiens
PGAAASLRI

SEQ ID NO: 1094976 - protein, 9 aa, Homo Sapiens
KRLRRHLRL

SEQ ID NO: 1094977 - protein, 9 aa, Homo Sapiens
QGGSPVGDV

SEQ ID NO: 1094978 - protein, 9 aa, Homo Sapiens
PTSGPGPAS

SEQ ID NO: 1094979 - protein, 9 aa, Homo Sapiens
REKENKWES

SEQ ID NO: 1094980 - protein, 9 aa, Homo Sapiens
TAGAARART

SEQ ID NO: 1094981 - protein, 9 aa, Homo Sapiens
RPGTLPGEP

SEQ ID NO: 1094982 - protein, 9 aa, Homo Sapiens
PTASVQLEN

SEQ ID NO: 1094983 - protein, 9 aa, Homo Sapiens
KLAPPFKPQ

SEQ ID NO: 1094984 - protein, 9 aa, Homo Sapiens
VTTAVLGKT

SEQ ID NO: 1094985 - protein, 9 aa, Homo Sapiens
LSTAKSKPI

SEQ ID NO: 1094986 - protein, 9 aa, Homo Sapiens
DDQSRGFTL

SEQ ID NO: 1094987 - protein, 9 aa, Homo Sapiens
WVFSFLLVI

SEQ ID NO: 1094988 - protein, 9 aa, Homo Sapiens
CGKAFRQCT

SEQ ID NO: 1094989 - protein, 9 aa, Homo Sapiens
MPRRMQLRL

SEQ ID NO: 1094990 - protein, 9 aa, Homo Sapiens
WEFQSPLIL

SEQ ID NO: 1094991 - protein, 9 aa, Homo Sapiens
APAAVSPPR

SEQ ID NO: 1094992 - protein, 9 aa, Homo Sapiens
LAASLVVLQ

SEQ ID NO: 1094993 - protein, 9 aa, Homo Sapiens
CWRDKKQCK

SEQ ID NO: 1094994 - protein, 9 aa, Homo Sapiens
VDWWVMGII

SEQ ID NO: 1094995 - protein, 9 aa, Homo Sapiens
RQIKIIESP

SEQ ID NO: 1094996 - protein, 9 aa, Homo Sapiens
LAQAQGRLR

SEQ ID NO: 1094997 - protein, 9 aa, Homo Sapiens
CVAQAPPSC

SEQ ID NO: 1094998 - protein, 9 aa, Homo Sapiens
QTPGRGVPP

SEQ ID NO: 1094999 - protein, 9 aa, Homo Sapiens
QELRMAMKG

SEQ ID NO: 1095000 - protein, 9 aa, Homo Sapiens
VLPRSLPRV

SEQ ID NO: 1095001 - protein, 9 aa, Homo Sapiens
HQEYLKDLA

SEQ ID NO: 1095002 - protein, 9 aa, Homo Sapiens
TSRTKARVL

SEQ ID NO: 1095003 - protein, 9 aa, Homo Sapiens
TTLEVQSLR

SEQ ID NO: 1095004 - protein, 9 aa, Homo Sapiens
LDQFSNSGK

SEQ ID NO: 1095005 - protein, 9 aa, Homo Sapiens
SPLVAPRQT

SEQ ID NO: 1095006 - protein, 9 aa, Homo Sapiens
RRPEFSEVV

SEQ ID NO: 1095007 - protein, 9 aa, Homo Sapiens
LFQVRGPHF

SEQ ID NO: 1095008 - protein, 9 aa, Homo Sapiens
RMDHNVEMF

SEQ ID NO: 1095009 - protein, 9 aa, Homo Sapiens
EGYKYEQID

SEQ ID NO: 1095010 - protein, 9 aa, Homo Sapiens
LALLSAGSW

SEQ ID NO: 1095011 - protein, 9 aa, Homo Sapiens
LRVLRILYV

SEQ ID NO: 1095012 - protein, 9 aa, Homo Sapiens
FNLFCLYEN

SEQ ID NO: 1095013 - protein, 9 aa, Homo Sapiens
LYIVDWMDE

SEQ ID NO: 1095014 - protein, 9 aa, Homo Sapiens
IVVILIELL

SEQ ID NO: 1095015 - protein, 9 aa, Homo Sapiens
TCAVGVEYV

SEQ ID NO: 1095016 - protein, 9 aa, Homo Sapiens
QNTSLESYL

SEQ ID NO: 1095017 - protein, 9 aa, Homo Sapiens
LAQLLPADP

SEQ ID NO: 1095018 - protein, 9 aa, Homo Sapiens
THKRIRTAE

SEQ ID NO: 1095019 - protein, 9 aa, Homo Sapiens
EGQMGHPAE

SEQ ID NO: 1095020 - protein, 9 aa, Homo Sapiens
TPGRGVPPR

SEQ ID NO: 1095021 - protein, 9 aa, Homo Sapiens
RASSGTAAP

SEQ ID NO: 1095022 - protein, 9 aa, Homo Sapiens
VMREVKALT

SEQ ID NO: 1095023 - protein, 9 aa, Homo Sapiens
LCVQRGWTL

SEQ ID NO: 1095024 - protein, 9 aa, Homo Sapiens
IVAPSGSAA

SEQ ID NO: 1095025 - protein, 9 aa, Homo Sapiens
TPRGRTSGR

SEQ ID NO: 1095026 - protein, 9 aa, Homo Sapiens
TLHAFGRQP

SEQ ID NO: 1095027 - protein, 9 aa, Homo Sapiens
DPKLLEHGL

SEQ ID NO: 1095028 - protein, 9 aa, Homo Sapiens
CPAGGPCLD

SEQ ID NO: 1095029 - protein, 9 aa, Homo Sapiens
CSEITTASI

SEQ ID NO: 1095030 - protein, 9 aa, Homo Sapiens
DLHFPRDSP

SEQ ID NO: 1095031 - protein, 9 aa, Homo Sapiens
CVLSSIRVP

SEQ ID NO: 1095032 - protein, 9 aa, Homo Sapiens
TLCSSTPTC

SEQ ID NO: 1095033 - protein, 9 aa, Homo Sapiens
TAQEARRVH

SEQ ID NO: 1095034 - protein, 9 aa, Homo Sapiens
NPPIFHSGM

SEQ ID NO: 1095035 - protein, 9 aa, Homo Sapiens
TVRGLWPNT

SEQ ID NO: 1095036 - protein, 9 aa, Homo Sapiens
SPARLGQPT

SEQ ID NO: 1095037 - protein, 9 aa, Homo Sapiens
SPASPAHSP

SEQ ID NO: 1095038 - protein, 9 aa, Homo Sapiens
KEEEFQDES

SEQ ID NO: 1095039 - protein, 9 aa, Homo Sapiens
TKEIRVEVD

SEQ ID NO: 1095040 - protein, 9 aa, Homo Sapiens
GHSEPSMWA

SEQ ID NO: 1095041 - protein, 9 aa, Homo Sapiens
TWISENPQK

SEQ ID NO: 1095042 - protein, 9 aa, Homo Sapiens
LVEHPGLCG

SEQ ID NO: 1095043 - protein, 9 aa, Homo Sapiens
MSTCCWCMP

SEQ ID NO: 1095044 - protein, 9 aa, Homo Sapiens
RMMSPKIEV

SEQ ID NO: 1095045 - protein, 9 aa, Homo Sapiens
DRGDAWWGA

SEQ ID NO: 1095046 - protein, 9 aa, Homo Sapiens
LPLPRSLGF

SEQ ID NO: 1095047 - protein, 9 aa, Homo Sapiens
PPEGTRPSW

SEQ ID NO: 1095048 - protein, 9 aa, Homo Sapiens
ALFTPPKER

SEQ ID NO: 1095049 - protein, 9 aa, Homo Sapiens
PRRVVAALS

SEQ ID NO: 1095050 - protein, 9 aa, Homo Sapiens
TPAPVQDTA

SEQ ID NO: 1095051 - protein, 9 aa, Homo Sapiens
PQAIKLACM

SEQ ID NO: 1095052 - protein, 9 aa, Homo Sapiens
LRLSRHHRI

SEQ ID NO: 1095053 - protein, 9 aa, Homo Sapiens
GLLQGRGPQ

SEQ ID NO: 1095054 - protein, 9 aa, Homo Sapiens
VPPAAVLSL

SEQ ID NO: 1095055 - protein, 9 aa, Homo Sapiens
YSTTAFCLF

SEQ ID NO: 1095056 - protein, 9 aa, Homo Sapiens
MAFGVQKPL

SEQ ID NO: 1095057 - protein, 9 aa, Homo Sapiens
ARTCSPCSP

SEQ ID NO: 1095058 - protein, 9 aa, Homo Sapiens
ATVLTYALS

SEQ ID NO: 1095059 - protein, 9 aa, Homo Sapiens
EQHKQERKE

SEQ ID NO: 1095060 - protein, 9 aa, Homo Sapiens
NDFKHHMSQ

SEQ ID NO: 1095061 - protein, 9 aa, Homo Sapiens
DTVLLGATV

SEQ ID NO: 1095062 - protein, 9 aa, Homo Sapiens
EILILDTND

SEQ ID NO: 1095063 - protein, 9 aa, Homo Sapiens
ENAPPYSFR

SEQ ID NO: 1095064 - protein, 9 aa, Homo Sapiens
KGTEVPWPE

SEQ ID NO: 1095065 - protein, 9 aa, Homo Sapiens
PVTPAPVQD

SEQ ID NO: 1095066 - protein, 9 aa, Homo Sapiens
SCAPRPPSA

SEQ ID NO: 1095067 - protein, 9 aa, Homo Sapiens
WESRKEKRK

SEQ ID NO: 1095068 - protein, 9 aa, Homo Sapiens
ETSGNSDNL

SEQ ID NO: 1095069 - protein, 9 aa, Homo Sapiens
LPPCTVAGG

SEQ ID NO: 1095070 - protein, 9 aa, Homo Sapiens
PSLMLSCPG

SEQ ID NO: 1095071 - protein, 9 aa, Homo Sapiens
RKKKADRDQ

SEQ ID NO: 1095072 - protein, 9 aa, Homo Sapiens
CQDCGRHFH

SEQ ID NO: 1095073 - protein, 9 aa, Homo Sapiens
SPEVTNSSS

SEQ ID NO: 1095074 - protein, 9 aa, Homo Sapiens
LEEEVDINQ

SEQ ID NO: 1095075 - protein, 9 aa, Homo Sapiens
GAGRPIKRS

SEQ ID NO: 1095076 - protein, 9 aa, Homo Sapiens
GVPSGSCAP

SEQ ID NO: 1095077 - protein, 9 aa, Homo Sapiens
ILLSQSVQQ

SEQ ID NO: 1095078 - protein, 9 aa, Homo Sapiens
IVLFGYMQW

SEQ ID NO: 1095079 - protein, 9 aa, Homo Sapiens
RPCWATDCA

SEQ ID NO: 1095080 - protein, 9 aa, Homo Sapiens
LFMGYSTTA

SEQ ID NO: 1095081 - protein, 9 aa, Homo Sapiens
KIELKIQSL

SEQ ID NO: 1095082 - protein, 9 aa, Homo Sapiens
RGEMQAQHP

SEQ ID NO: 1095083 - protein, 9 aa, Homo Sapiens
NLFRLFLQQ

SEQ ID NO: 1095084 - protein, 9 aa, Homo Sapiens
GSLSGLTDS

SEQ ID NO: 1095085 - protein, 9 aa, Homo Sapiens
FGNFNLLHG

SEQ ID NO: 1095086 - protein, 9 aa, Homo Sapiens
AQKPLFFGE

SEQ ID NO: 1095087 - protein, 9 aa, Homo Sapiens
SQASETPHP

SEQ ID NO: 1095088 - protein, 9 aa, Homo Sapiens
GFSLMKDDA

SEQ ID NO: 1095089 - protein, 9 aa, Homo Sapiens
PSFCWPSGT

SEQ ID NO: 1095090 - protein, 9 aa, Homo Sapiens
GSRDLCPRE

SEQ ID NO: 1095091 - protein, 9 aa, Homo Sapiens
HAGEAGPPA

SEQ ID NO: 1095092 - protein, 9 aa, Homo Sapiens
GHAQRVGET

SEQ ID NO: 1095093 - protein, 9 aa, Homo Sapiens
QSPCPAPGP

SEQ ID NO: 1095094 - protein, 9 aa, Homo Sapiens
ECPQQLPHG

SEQ ID NO: 1095095 - protein, 9 aa, Homo Sapiens
ALGMCTNSS

SEQ ID NO: 1095096 - protein, 9 aa, Homo Sapiens
LSLPASHGD

SEQ ID NO: 1095097 - protein, 9 aa, Homo Sapiens
PRSLGFLIC

SEQ ID NO: 1095098 - protein, 9 aa, Homo Sapiens
AIYFTVDGD

SEQ ID NO: 1095099 - protein, 9 aa, Homo Sapiens
VAITPLLEN

SEQ ID NO: 1095100 - protein, 9 aa, Homo Sapiens
LFFFLFPLG

SEQ ID NO: 1095101 - protein, 9 aa, Homo Sapiens
MALRANMAS

SEQ ID NO: 1095102 - protein, 9 aa, Homo Sapiens
ACYNFIRSM

SEQ ID NO: 1095103 - protein, 9 aa, Homo Sapiens
EEVSHFEKA

SEQ ID NO: 1095104 - protein, 9 aa, Homo Sapiens
VQVTMCISA

SEQ ID NO: 1095105 - protein, 9 aa, Homo Sapiens
RRTFTKHLM

SEQ ID NO: 1095106 - protein, 9 aa, Homo Sapiens
STGSSTASA

SEQ ID NO: 1095107 - protein, 9 aa, Homo Sapiens
RAASLLFSI

SEQ ID NO: 1095108 - protein, 9 aa, Homo Sapiens
PHQSPGHLG

SEQ ID NO: 1095109 - protein, 9 aa, Homo Sapiens
MQLKALDPM

SEQ ID NO: 1095110 - protein, 9 aa, Homo Sapiens
PTYVPARQP

SEQ ID NO: 1095111 - protein, 9 aa, Homo Sapiens
EEADDEEET

SEQ ID NO: 1095112 - protein, 9 aa, Homo Sapiens
PASPIQQLV

SEQ ID NO: 1095113 - protein, 9 aa, Homo Sapiens
QFQGHREGV

SEQ ID NO: 1095114 - protein, 9 aa, Homo Sapiens
ITALGRFRS

SEQ ID NO: 1095115 - protein, 9 aa, Homo Sapiens
HGRDLPYHS

SEQ ID NO: 1095116 - protein, 9 aa, Homo Sapiens
TTANTVPTA

SEQ ID NO: 1095117 - protein, 9 aa, Homo Sapiens
NSGLWRPGT

SEQ ID NO: 1095118 - protein, 9 aa, Homo Sapiens
QSRGFTLPS

SEQ ID NO: 1095119 - protein, 9 aa, Homo Sapiens
LSPSRKRRR

SEQ ID NO: 1095120 - protein, 9 aa, Homo Sapiens
SRRPLGVSP

SEQ ID NO: 1095121 - protein, 9 aa, Homo Sapiens
ERQHHYYLG

SEQ ID NO: 1095122 - protein, 9 aa, Homo Sapiens
SYLCNESCE

SEQ ID NO: 1095123 - protein, 9 aa, Homo Sapiens
AQDDTGADD

SEQ ID NO: 1095124 - protein, 9 aa, Homo Sapiens
PGHLGLFLL

SEQ ID NO: 1095125 - protein, 9 aa, Homo Sapiens
ILFKLSCII

SEQ ID NO: 1095126 - protein, 9 aa, Homo Sapiens
DCKLKLVCG

SEQ ID NO: 1095127 - protein, 9 aa, Homo Sapiens
VWSRVVVME

SEQ ID NO: 1095128 - protein, 9 aa, Homo Sapiens
KEEARHALE

SEQ ID NO: 1095129 - protein, 9 aa, Homo Sapiens
EWEMALRVA

SEQ ID NO: 1095130 - protein, 9 aa, Homo Sapiens
YLELGITQC

SEQ ID NO: 1095131 - protein, 9 aa, Homo Sapiens
PQDPETSVD

SEQ ID NO: 1095132 - protein, 9 aa, Homo Sapiens
EPAGGQRSH

SEQ ID NO: 1095133 - protein, 9 aa, Homo Sapiens
TVFDNFFYQ

SEQ ID NO: 1095134 - protein, 9 aa, Homo Sapiens
SLLSTLSQP

SEQ ID NO: 1095135 - protein, 9 aa, Homo Sapiens
FPFNQWCLQ

SEQ ID NO: 1095136 - protein, 9 aa, Homo Sapiens
LKCALCRKV

SEQ ID NO: 1095137 - protein, 9 aa, Homo Sapiens
RTAEKFYKC

SEQ ID NO: 1095138 - protein, 9 aa, Homo Sapiens
DLRVSECEE

SEQ ID NO: 1095139 - protein, 9 aa, Homo Sapiens
WPSTSAFKT

SEQ ID NO: 1095140 - protein, 9 aa, Homo Sapiens
TSSRLARAP

SEQ ID NO: 1095141 - protein, 9 aa, Homo Sapiens
GQFHVYSEL

SEQ ID NO: 1095142 - protein, 9 aa, Homo Sapiens
CSRGTWTGP

SEQ ID NO: 1095143 - protein, 9 aa, Homo Sapiens
PHGHTDATG

SEQ ID NO: 1095144 - protein, 9 aa, Homo Sapiens
AAERAGAAR

SEQ ID NO: 1095145 - protein, 9 aa, Homo Sapiens
DKTLKSLMT

SEQ ID NO: 1095146 - protein, 9 aa, Homo Sapiens
SSMPTKQAP

SEQ ID NO: 1095147 - protein, 9 aa, Homo Sapiens
VWPSVPSST

SEQ ID NO: 1095148 - protein, 9 aa, Homo Sapiens
ESFDDQHRM

SEQ ID NO: 1095149 - protein, 9 aa, Homo Sapiens
QVGPLPCVL

SEQ ID NO: 1095150 - protein, 9 aa, Homo Sapiens
SSILSSLAT

SEQ ID NO: 1095151 - protein, 9 aa, Homo Sapiens
VVDEHESVD

SEQ ID NO: 1095152 - protein, 9 aa, Homo Sapiens
FPRVLLRFL

SEQ ID NO: 1095153 - protein, 9 aa, Homo Sapiens
GLLFKGRGQ

SEQ ID NO: 1095154 - protein, 9 aa, Homo Sapiens
RQLGQGLGV

SEQ ID NO: 1095155 - protein, 9 aa, Homo Sapiens
SRPCQLLFP

SEQ ID NO: 1095156 - protein, 9 aa, Homo Sapiens
SSVGTEPDS

SEQ ID NO: 1095157 - protein, 9 aa, Homo Sapiens
ASETYTSKI

SEQ ID NO: 1095158 - protein, 9 aa, Homo Sapiens
CTMTPVSSP

SEQ ID NO: 1095159 - protein, 9 aa, Homo Sapiens
LQMVLQWRK

SEQ ID NO: 1095160 - protein, 9 aa, Homo Sapiens
AAKNGSVKR

SEQ ID NO: 1095161 - protein, 9 aa, Homo Sapiens
LSPGACHAH

SEQ ID NO: 1095162 - protein, 9 aa, Homo Sapiens
TKSSSEPRS

SEQ ID NO: 1095163 - protein, 9 aa, Homo Sapiens
ACKVARRHN

SEQ ID NO: 1095164 - protein, 9 aa, Homo Sapiens
VALLEEEVD

SEQ ID NO: 1095165 - protein, 9 aa, Homo Sapiens
LAHPHRAAV

SEQ ID NO: 1095166 - protein, 9 aa, Homo Sapiens
KCELCSFHC

SEQ ID NO: 1095167 - protein, 9 aa, Homo Sapiens
VLVHCQVGI

SEQ ID NO: 1095168 - protein, 9 aa, Homo Sapiens
EQLGGLQQG

SEQ ID NO: 1095169 - protein, 9 aa, Homo Sapiens
WTIQKGSFL

SEQ ID NO: 1095170 - protein, 9 aa, Homo Sapiens
DDTNGEWSP

SEQ ID NO: 1095171 - protein, 9 aa, Homo Sapiens
HRSAKETMT

SEQ ID NO: 1095172 - protein, 9 aa, Homo Sapiens
HRNCLLCRR

SEQ ID NO: 1095173 - protein, 9 aa, Homo Sapiens
LRTSCGAAR

SEQ ID NO: 1095174 - protein, 9 aa, Homo Sapiens
LLDLMGGLG

SEQ ID NO: 1095175 - protein, 9 aa, Homo Sapiens
QAVQPILIL

SEQ ID NO: 1095176 - protein, 9 aa, Homo Sapiens
FNSWSTGFV

SEQ ID NO: 1095177 - protein, 9 aa, Homo Sapiens
SRLPRMPGP

SEQ ID NO: 1095178 - protein, 9 aa, Homo Sapiens
PRFCHPLAV

SEQ ID NO: 1095179 - protein, 9 aa, Homo Sapiens
LGGPKRSAR

SEQ ID NO: 1095180 - protein, 9 aa, Homo Sapiens
ATHSPEEIR

SEQ ID NO: 1095181 - protein, 9 aa, Homo Sapiens
DLPGLHTAV

SEQ ID NO: 1095182 - protein, 9 aa, Homo Sapiens
PGLQLVNPH

SEQ ID NO: 1095183 - protein, 9 aa, Homo Sapiens
KVLPPSLWA

SEQ ID NO: 1095184 - protein, 9 aa, Homo Sapiens
YTDIDLLST

SEQ ID NO: 1095185 - protein, 9 aa, Homo Sapiens
WNPSRRWRT

SEQ ID NO: 1095186 - protein, 9 aa, Homo Sapiens
RFLTTDTIK

SEQ ID NO: 1095187 - protein, 9 aa, Homo Sapiens
RLIHTVGKQ

SEQ ID NO: 1095188 - protein, 9 aa, Homo Sapiens
SRMARPKDL

SEQ ID NO: 1095189 - protein, 9 aa, Homo Sapiens
PQSAGTTSP

SEQ ID NO: 1095190 - protein, 9 aa, Homo Sapiens
TEAMKIMDH

SEQ ID NO: 1095191 - protein, 9 aa, Homo Sapiens
TFTKHLMLE

SEQ ID NO: 1095192 - protein, 9 aa, Homo Sapiens
PQPTPCAST

SEQ ID NO: 1095193 - protein, 9 aa, Homo Sapiens
MAPTIPSFC

SEQ ID NO: 1095194 - protein, 9 aa, Homo Sapiens
SLESRSSVV

SEQ ID NO: 1095195 - protein, 9 aa, Homo Sapiens
TSAASSAGS

SEQ ID NO: 1095196 - protein, 9 aa, Homo Sapiens
DQGPKGPPG

SEQ ID NO: 1095197 - protein, 9 aa, Homo Sapiens
KGHIYTFIG

SEQ ID NO: 1095198 - protein, 9 aa, Homo Sapiens
QPCTPSLCE

SEQ ID NO: 1095199 - protein, 9 aa, Homo Sapiens
DIVAVPATA

SEQ ID NO: 1095200 - protein, 9 aa, Homo Sapiens
LPKNAQMLS

SEQ ID NO: 1095201 - protein, 9 aa, Homo Sapiens
PLSLVTCLF

SEQ ID NO: 1095202 - protein, 9 aa, Homo Sapiens
NVCYCSRQP

SEQ ID NO: 1095203 - protein, 9 aa, Homo Sapiens
LGNDNISQL

SEQ ID NO: 1095204 - protein, 9 aa, Homo Sapiens
KAVPLQPPL

SEQ ID NO: 1095205 - protein, 9 aa, Homo Sapiens
LATQLKGTV

SEQ ID NO: 1095206 - protein, 9 aa, Homo Sapiens
LEALLRNST

SEQ ID NO: 1095207 - protein, 9 aa, Homo Sapiens
VQDRNLRPK

SEQ ID NO: 1095208 - protein, 9 aa, Homo Sapiens
LGLLPWARF

SEQ ID NO: 1095209 - protein, 9 aa, Homo Sapiens
CKFTEKHEW

SEQ ID NO: 1095210 - protein, 9 aa, Homo Sapiens
PEGTRPSWA

SEQ ID NO: 1095211 - protein, 9 aa, Homo Sapiens
SVEAEASYL

SEQ ID NO: 1095212 - protein, 9 aa, Homo Sapiens
SAGTTSPWP

SEQ ID NO: 1095213 - protein, 9 aa, Homo Sapiens
APGFSANPH

SEQ ID NO: 1095214 - protein, 9 aa, Homo Sapiens
LYVLKYLRC

SEQ ID NO: 1095215 - protein, 9 aa, Homo Sapiens
PPFFGRDCS

SEQ ID NO: 1095216 - protein, 9 aa, Homo Sapiens
FIMAFGVQK

SEQ ID NO: 1095217 - protein, 9 aa, Homo Sapiens
ADRGSWERH

SEQ ID NO: 1095218 - protein, 9 aa, Homo Sapiens
SNNLFSTLE

SEQ ID NO: 1095219 - protein, 9 aa, Homo Sapiens
TNGEWSPKM

SEQ ID NO: 1095220 - protein, 9 aa, Homo Sapiens
LVFFFFVWF

SEQ ID NO: 1095221 - protein, 9 aa, Homo Sapiens
RLCTVSASL

SEQ ID NO: 1095222 - protein, 9 aa, Homo Sapiens
LAIHLLLSL

SEQ ID NO: 1095223 - protein, 9 aa, Homo Sapiens
QLTPVSPLQ

SEQ ID NO: 1095224 - protein, 9 aa, Homo Sapiens
GEEDFEDNH

SEQ ID NO: 1095225 - protein, 9 aa, Homo Sapiens
KVHRNQPPH

SEQ ID NO: 1095226 - protein, 9 aa, Homo Sapiens
RWGCHHRMP

SEQ ID NO: 1095227 - protein, 9 aa, Homo Sapiens
AAIAAPDSR

SEQ ID NO: 1095228 - protein, 9 aa, Homo Sapiens
GNVHHCFPS

SEQ ID NO: 1095229 - protein, 9 aa, Homo Sapiens
EQNGATLAE

SEQ ID NO: 1095230 - protein, 9 aa, Homo Sapiens
AHQHQPPAP

SEQ ID NO: 1095231 - protein, 9 aa, Homo Sapiens
WAFGRAFCN

SEQ ID NO: 1095232 - protein, 9 aa, Homo Sapiens
ACETYISGT

SEQ ID NO: 1095233 - protein, 9 aa, Homo Sapiens
IWCFFSRPH

SEQ ID NO: 1095234 - protein, 9 aa, Homo Sapiens
SAFKTTAGP

SEQ ID NO: 1095235 - protein, 9 aa, Homo Sapiens
TVHPAVPGV

SEQ ID NO: 1095236 - protein, 9 aa, Homo Sapiens
LTSMPESAG

SEQ ID NO: 1095237 - protein, 9 aa, Homo Sapiens
VRMGLFTPD

SEQ ID NO: 1095238 - protein, 9 aa, Homo Sapiens
GKHSPICRT

SEQ ID NO: 1095239 - protein, 9 aa, Homo Sapiens
EALFYPGAL

SEQ ID NO: 1095240 - protein, 9 aa, Homo Sapiens
DVQKCTIYL

SEQ ID NO: 1095241 - protein, 9 aa, Homo Sapiens
GPESTFTTP

SEQ ID NO: 1095242 - protein, 9 aa, Homo Sapiens
PSPRAGSRR

SEQ ID NO: 1095243 - protein, 9 aa, Homo Sapiens
KLESKMKAD

SEQ ID NO: 1095244 - protein, 9 aa, Homo Sapiens
LYTSSSVLT

SEQ ID NO: 1095245 - protein, 9 aa, Homo Sapiens
RELRMGLEE

SEQ ID NO: 1095246 - protein, 9 aa, Homo Sapiens
RKATALPAC

SEQ ID NO: 1095247 - protein, 9 aa, Homo Sapiens
QHQQHQHQQ

SEQ ID NO: 1095248 - protein, 9 aa, Homo Sapiens
PVASCPAPH

SEQ ID NO: 1095249 - protein, 9 aa, Homo Sapiens
GASTSSVTA

SEQ ID NO: 1095250 - protein, 9 aa, Homo Sapiens
VKEGPVRLR

SEQ ID NO: 1095251 - protein, 9 aa, Homo Sapiens
AEARVADGE

SEQ ID NO: 1095252 - protein, 9 aa, Homo Sapiens
VPEAEAGAA

SEQ ID NO: 1095253 - protein, 9 aa, Homo Sapiens
RGCAWYLCS

SEQ ID NO: 1095254 - protein, 9 aa, Homo Sapiens
EREKENKWE

SEQ ID NO: 1095255 - protein, 9 aa, Homo Sapiens
QKWKVGKIE

SEQ ID NO: 1095256 - protein, 9 aa, Homo Sapiens
IHGVRMGLF

SEQ ID NO: 1095257 - protein, 9 aa, Homo Sapiens
ALGSASPTS

SEQ ID NO: 1095258 - protein, 9 aa, Homo Sapiens
RQGLSRLCI

SEQ ID NO: 1095259 - protein, 9 aa, Homo Sapiens
CDRDVGGHG

SEQ ID NO: 1095260 - protein, 9 aa, Homo Sapiens
RRCTQASVV

SEQ ID NO: 1095261 - protein, 9 aa, Homo Sapiens
GQVGHGVWV

SEQ ID NO: 1095262 - protein, 9 aa, Homo Sapiens
CRRPQPSKS

SEQ ID NO: 1095263 - protein, 9 aa, Homo Sapiens
LFSSEENNL

SEQ ID NO: 1095264 - protein, 9 aa, Homo Sapiens
RDFLNQCLE

SEQ ID NO: 1095265 - protein, 9 aa, Homo Sapiens
APSTPTGCG

SEQ ID NO: 1095266 - protein, 9 aa, Homo Sapiens
KDSQPLCHW

SEQ ID NO: 1095267 - protein, 9 aa, Homo Sapiens
FTNVHIKNF

SEQ ID NO: 1095268 - protein, 9 aa, Homo Sapiens
GCSPGELAW

SEQ ID NO: 1095269 - protein, 9 aa, Homo Sapiens
PPPSRPRSP

SEQ ID NO: 1095270 - protein, 9 aa, Homo Sapiens
SSRCWAGAW

SEQ ID NO: 1095271 - protein, 9 aa, Homo Sapiens
SCSPSPKKP

SEQ ID NO: 1095272 - protein, 9 aa, Homo Sapiens
IWVLFASKA

SEQ ID NO: 1095273 - protein, 9 aa, Homo Sapiens
LDFFSRSHL

SEQ ID NO: 1095274 - protein, 9 aa, Homo Sapiens
RRWRTACVS

SEQ ID NO: 1095275 - protein, 9 aa, Homo Sapiens
LPAAPPSSS

SEQ ID NO: 1095276 - protein, 9 aa, Homo Sapiens
SPERLPLSC

SEQ ID NO: 1095277 - protein, 9 aa, Homo Sapiens
PRISELTGS

SEQ ID NO: 1095278 - protein, 9 aa, Homo Sapiens
QPTASVQLE

SEQ ID NO: 1095279 - protein, 9 aa, Homo Sapiens
SDCTEIIIV

SEQ ID NO: 1095280 - protein, 9 aa, Homo Sapiens
VSLLGRFLI

SEQ ID NO: 1095281 - protein, 9 aa, Homo Sapiens
IATHSPEEI

SEQ ID NO: 1095282 - protein, 9 aa, Homo Sapiens
QIDGGITGG

SEQ ID NO: 1095283 - protein, 9 aa, Homo Sapiens
DRSVVTVTH

SEQ ID NO: 1095284 - protein, 9 aa, Homo Sapiens
DEARDRINW

SEQ ID NO: 1095285 - protein, 9 aa, Homo Sapiens
PRDWNDVQG

SEQ ID NO: 1095286 - protein, 9 aa, Homo Sapiens
SLAGSRRCC

SEQ ID NO: 1095287 - protein, 9 aa, Homo Sapiens
HAVHEELLL

SEQ ID NO: 1095288 - protein, 9 aa, Homo Sapiens
ELALVGPHA

SEQ ID NO: 1095289 - protein, 9 aa, Homo Sapiens
AQNRSLLVL

SEQ ID NO: 1095290 - protein, 9 aa, Homo Sapiens
DSATKGFSL

SEQ ID NO: 1095291 - protein, 9 aa, Homo Sapiens
MHRERNRNK

SEQ ID NO: 1095292 - protein, 9 aa, Homo Sapiens
SRGTWTGPS

SEQ ID NO: 1095293 - protein, 9 aa, Homo Sapiens
PSAFKTETS

SEQ ID NO: 1095294 - protein, 9 aa, Homo Sapiens
MPAPTPASP

SEQ ID NO: 1095295 - protein, 9 aa, Homo Sapiens
TSGRSLSCC

SEQ ID NO: 1095296 - protein, 9 aa, Homo Sapiens
RHGLYYIYA

SEQ ID NO: 1095297 - protein, 9 aa, Homo Sapiens
REKTISCND

SEQ ID NO: 1095298 - protein, 9 aa, Homo Sapiens
ESNRGVPVI

SEQ ID NO: 1095299 - protein, 9 aa, Homo Sapiens
GGLQQGDLL

SEQ ID NO: 1095300 - protein, 9 aa, Homo Sapiens
NPQKRKEHR

SEQ ID NO: 1095301 - protein, 9 aa, Homo Sapiens
TLRCPAVPA

SEQ ID NO: 1095302 - protein, 9 aa, Homo Sapiens
AVTDLTACF

SEQ ID NO: 1095303 - protein, 9 aa, Homo Sapiens
APHRSPPRA

SEQ ID NO: 1095304 - protein, 9 aa, Homo Sapiens
DHFKMKNPH

SEQ ID NO: 1095305 - protein, 9 aa, Homo Sapiens
SSLTPLTTQ

SEQ ID NO: 1095306 - protein, 9 aa, Homo Sapiens
VPSGSCAPR

SEQ ID NO: 1095307 - protein, 9 aa, Homo Sapiens
ARAPTLPTA

SEQ ID NO: 1095308 - protein, 9 aa, Homo Sapiens
MRTAKDVNQ

SEQ ID NO: 1095309 - protein, 9 aa, Homo Sapiens
LQELIDSSP

SEQ ID NO: 1095310 - protein, 9 aa, Homo Sapiens
LEDIKACTC

SEQ ID NO: 1095311 - protein, 9 aa, Homo Sapiens
AAAAWRLDE

SEQ ID NO: 1095312 - protein, 9 aa, Homo Sapiens
GLLQGKLVL

SEQ ID NO: 1095313 - protein, 9 aa, Homo Sapiens
KENTPERER

SEQ ID NO: 1095314 - protein, 9 aa, Homo Sapiens
KEATPKRSS

SEQ ID NO: 1095315 - protein, 9 aa, Homo Sapiens
NREVKSPFL

SEQ ID NO: 1095316 - protein, 9 aa, Homo Sapiens
GGRSPVWRA

SEQ ID NO: 1095317 - protein, 9 aa, Homo Sapiens
GSLILVSVS

SEQ ID NO: 1095318 - protein, 9 aa, Homo Sapiens
RMSLMPCGV

SEQ ID NO: 1095319 - protein, 9 aa, Homo Sapiens
KKVPTKKIK

SEQ ID NO: 1095320 - protein, 9 aa, Homo Sapiens
ARRRPKLQP

SEQ ID NO: 1095321 - protein, 9 aa, Homo Sapiens
FFTLMRKLK

SEQ ID NO: 1095322 - protein, 9 aa, Homo Sapiens
LDGHIVFTK

SEQ ID NO: 1095323 - protein, 9 aa, Homo Sapiens
CRPSPQCLR

SEQ ID NO: 1095324 - protein, 9 aa, Homo Sapiens
HEKREIRCV

SEQ ID NO: 1095325 - protein, 9 aa, Homo Sapiens
VVVLPEHNL

SEQ ID NO: 1095326 - protein, 9 aa, Homo Sapiens
VMEISYMRH

SEQ ID NO: 1095327 - protein, 9 aa, Homo Sapiens
ADTGLDDNI

SEQ ID NO: 1095328 - protein, 9 aa, Homo Sapiens
LVHNRVAPL

SEQ ID NO: 1095329 - protein, 9 aa, Homo Sapiens
DSSGSRSLW

SEQ ID NO: 1095330 - protein, 9 aa, Homo Sapiens
LQYLTPLII

SEQ ID NO: 1095331 - protein, 9 aa, Homo Sapiens
VPVEHLALQ

SEQ ID NO: 1095332 - protein, 9 aa, Homo Sapiens
VHYSLHFLL

SEQ ID NO: 1095333 - protein, 9 aa, Homo Sapiens
LFRSLLGWA

SEQ ID NO: 1095334 - protein, 9 aa, Homo Sapiens
ISEHWLVRI

SEQ ID NO: 1095335 - protein, 9 aa, Homo Sapiens
GGAPGSEPQ

SEQ ID NO: 1095336 - protein, 9 aa, Homo Sapiens
ARVAELPVA

SEQ ID NO: 1095337 - protein, 9 aa, Homo Sapiens
GDDLGALQS

SEQ ID NO: 1095338 - protein, 9 aa, Homo Sapiens
TCTMTPVSS

SEQ ID NO: 1095339 - protein, 9 aa, Homo Sapiens
TEALLADES

SEQ ID NO: 1095340 - protein, 9 aa, Homo Sapiens
RERTLYTWN

SEQ ID NO: 1095341 - protein, 9 aa, Homo Sapiens
IWAPLGRGI

SEQ ID NO: 1095342 - protein, 9 aa, Homo Sapiens
DRQFRAGCV

SEQ ID NO: 1095343 - protein, 9 aa, Homo Sapiens
GGARGTFHK

SEQ ID NO: 1095344 - protein, 9 aa, Homo Sapiens
LSWARQRGE

SEQ ID NO: 1095345 - protein, 9 aa, Homo Sapiens
LTRVATVDA

SEQ ID NO: 1095346 - protein, 9 aa, Homo Sapiens
LAAAGVQRV

SEQ ID NO: 1095347 - protein, 9 aa, Homo Sapiens
AASRLPRMP

SEQ ID NO: 1095348 - protein, 9 aa, Homo Sapiens
LVGMTPRDL

SEQ ID NO: 1095349 - protein, 9 aa, Homo Sapiens
GTTSSLPSC

SEQ ID NO: 1095350 - protein, 9 aa, Homo Sapiens
THWTIQKGS

SEQ ID NO: 1095351 - protein, 9 aa, Homo Sapiens
TVLSCWTWM

SEQ ID NO: 1095352 - protein, 9 aa, Homo Sapiens
PMRSKRKYR

SEQ ID NO: 1095353 - protein, 9 aa, Homo Sapiens
RHALTRAGL

SEQ ID NO: 1095354 - protein, 9 aa, Homo Sapiens
LQKENERLP

SEQ ID NO: 1095355 - protein, 9 aa, Homo Sapiens
GCHHRMPSP

SEQ ID NO: 1095356 - protein, 9 aa, Homo Sapiens
EGCIPSDKC

SEQ ID NO: 1095357 - protein, 9 aa, Homo Sapiens
DGAITDVIE

SEQ ID NO: 1095358 - protein, 9 aa, Homo Sapiens
GPLHPVPRA

SEQ ID NO: 1095359 - protein, 9 aa, Homo Sapiens
LFAGILVLI

SEQ ID NO: 1095360 - protein, 9 aa, Homo Sapiens
ANAPEGRLR

SEQ ID NO: 1095361 - protein, 9 aa, Homo Sapiens
THCTFWTRL

SEQ ID NO: 1095362 - protein, 9 aa, Homo Sapiens
LQSPGPRGF

SEQ ID NO: 1095363 - protein, 9 aa, Homo Sapiens
REALVAELA

SEQ ID NO: 1095364 - protein, 9 aa, Homo Sapiens
LVDDTNGEW

SEQ ID NO: 1095365 - protein, 9 aa, Homo Sapiens
SCICTVLCI

SEQ ID NO: 1095366 - protein, 9 aa, Homo Sapiens
FQRRKRRIY

SEQ ID NO: 1095367 - protein, 9 aa, Homo Sapiens
EGFLQREDL

SEQ ID NO: 1095368 - protein, 9 aa, Homo Sapiens
RAPTLPTAA

SEQ ID NO: 1095369 - protein, 9 aa, Homo Sapiens
TSRNCTAAL

SEQ ID NO: 1095370 - protein, 9 aa, Homo Sapiens
VPPLCLSKA

SEQ ID NO: 1095371 - protein, 9 aa, Homo Sapiens
VNNSMSKKL

SEQ ID NO: 1095372 - protein, 9 aa, Homo Sapiens
EKGHIYTFI

SEQ ID NO: 1095373 - protein, 9 aa, Homo Sapiens
APRNLGTTS

SEQ ID NO: 1095374 - protein, 9 aa, Homo Sapiens
RGGILFFVL

SEQ ID NO: 1095375 - protein, 9 aa, Homo Sapiens
ILPPPSQLP

SEQ ID NO: 1095376 - protein, 9 aa, Homo Sapiens
LPSVDPTWI

SEQ ID NO: 1095377 - protein, 9 aa, Homo Sapiens
ARNLTLVVV

SEQ ID NO: 1095378 - protein, 9 aa, Homo Sapiens
DGRRGLTER

SEQ ID NO: 1095379 - protein, 9 aa, Homo Sapiens
GMGPHVPRQ

SEQ ID NO: 1095380 - protein, 9 aa, Homo Sapiens
RHWLCPQTR

SEQ ID NO: 1095381 - protein, 9 aa, Homo Sapiens
DPDSPENAP

SEQ ID NO: 1095382 - protein, 9 aa, Homo Sapiens
MPGGASTID

SEQ ID NO: 1095383 - protein, 9 aa, Homo Sapiens
MARPKDLPR

SEQ ID NO: 1095384 - protein, 9 aa, Homo Sapiens
FSANPHAWG

SEQ ID NO: 1095385 - protein, 9 aa, Homo Sapiens
TPTLAPPET

SEQ ID NO: 1095386 - protein, 9 aa, Homo Sapiens
HQKWKVGKI

SEQ ID NO: 1095387 - protein, 9 aa, Homo Sapiens
PVKKLSRNI

SEQ ID NO: 1095388 - protein, 9 aa, Homo Sapiens
PRGPRCPPS

SEQ ID NO: 1095389 - protein, 9 aa, Homo Sapiens
GKKLVKISE

SEQ ID NO: 1095390 - protein, 9 aa, Homo Sapiens
VEIRRRIRI

SEQ ID NO: 1095391 - protein, 9 aa, Homo Sapiens
EPPGARFLA

SEQ ID NO: 1095392 - protein, 9 aa, Homo Sapiens
SFHLNFEAT

SEQ ID NO: 1095393 - protein, 9 aa, Homo Sapiens
LDLMGGLGR

SEQ ID NO: 1095394 - protein, 9 aa, Homo Sapiens
QAGGAPMLQ

SEQ ID NO: 1095395 - protein, 9 aa, Homo Sapiens
NPSRRWRTA

SEQ ID NO: 1095396 - protein, 9 aa, Homo Sapiens
TQGAMAEEE

SEQ ID NO: 1095397 - protein, 9 aa, Homo Sapiens
NPPASEKDK

SEQ ID NO: 1095398 - protein, 9 aa, Homo Sapiens
HLMCGTLAA

SEQ ID NO: 1095399 - protein, 9 aa, Homo Sapiens
VSVQVKACA

SEQ ID NO: 1095400 - protein, 9 aa, Homo Sapiens
AMRAALAGA

SEQ ID NO: 1095401 - protein, 9 aa, Homo Sapiens
RIFPQLCNS

SEQ ID NO: 1095402 - protein, 9 aa, Homo Sapiens
SYPWALMNS

SEQ ID NO: 1095403 - protein, 9 aa, Homo Sapiens
WARQRGEMQ

SEQ ID NO: 1095404 - protein, 9 aa, Homo Sapiens
EAAELEPPG

SEQ ID NO: 1095405 - protein, 9 aa, Homo Sapiens
ALTAFQLLN

SEQ ID NO: 1095406 - protein, 9 aa, Homo Sapiens
WPKGFEAQR

SEQ ID NO: 1095407 - protein, 9 aa, Homo Sapiens
STVVSMAVA

SEQ ID NO: 1095408 - protein, 9 aa, Homo Sapiens
IKEGDGAFG

SEQ ID NO: 1095409 - protein, 9 aa, Homo Sapiens
RSSAQGVSS

SEQ ID NO: 1095410 - protein, 9 aa, Homo Sapiens
GILFFVLSE

SEQ ID NO: 1095411 - protein, 9 aa, Homo Sapiens
MSQNHSRSP

SEQ ID NO: 1095412 - protein, 9 aa, Homo Sapiens
EEKMRICLL

SEQ ID NO: 1095413 - protein, 9 aa, Homo Sapiens
CLQHTHCVQ

SEQ ID NO: 1095414 - protein, 9 aa, Homo Sapiens
WLQWPHPDP

SEQ ID NO: 1095415 - protein, 9 aa, Homo Sapiens
SGTLKADKA

SEQ ID NO: 1095416 - protein, 9 aa, Homo Sapiens
MTAAGIAAI

SEQ ID NO: 1095417 - protein, 9 aa, Homo Sapiens
TGLPNITDS

SEQ ID NO: 1095418 - protein, 9 aa, Homo Sapiens
FEYTVERVL

SEQ ID NO: 1095419 - protein, 9 aa, Homo Sapiens
GQELALGLR

SEQ ID NO: 1095420 - protein, 9 aa, Homo Sapiens
PEDEDEAWW

SEQ ID NO: 1095421 - protein, 9 aa, Homo Sapiens
NLLETLGEN

SEQ ID NO: 1095422 - protein, 9 aa, Homo Sapiens
YADWPGDHQ

SEQ ID NO: 1095423 - protein, 9 aa, Homo Sapiens
GQPNTQSES

SEQ ID NO: 1095424 - protein, 9 aa, Homo Sapiens
RESERDYNM

SEQ ID NO: 1095425 - protein, 9 aa, Homo Sapiens
TTSRMESTG

SEQ ID NO: 1095426 - protein, 9 aa, Homo Sapiens
CGIQGSQPF

SEQ ID NO: 1095427 - protein, 9 aa, Homo Sapiens
SHQHRNVCY

SEQ ID NO: 1095428 - protein, 9 aa, Homo Sapiens
TAALCRAWG

SEQ ID NO: 1095429 - protein, 9 aa, Homo Sapiens
KRKAKGEEK

SEQ ID NO: 1095430 - protein, 9 aa, Homo Sapiens
SSGTAAPGP

SEQ ID NO: 1095431 - protein, 9 aa, Homo Sapiens
TVGVVHQVR

SEQ ID NO: 1095432 - protein, 9 aa, Homo Sapiens
PSQASETPH

SEQ ID NO: 1095433 - protein, 9 aa, Homo Sapiens
TSQTPLLSS

SEQ ID NO: 1095434 - protein, 9 aa, Homo Sapiens
QLGGLQQGD

SEQ ID NO: 1095435 - protein, 9 aa, Homo Sapiens
SHAPPVAEE

SEQ ID NO: 1095436 - protein, 9 aa, Homo Sapiens
FLDGHIVFT

SEQ ID NO: 1095437 - protein, 9 aa, Homo Sapiens
VIFQGIKGK

SEQ ID NO: 1095438 - protein, 9 aa, Homo Sapiens
GHTSQVLSL

SEQ ID NO: 1095439 - protein, 9 aa, Homo Sapiens
RRREEKMRI

SEQ ID NO: 1095440 - protein, 9 aa, Homo Sapiens
SGPQGHREI

SEQ ID NO: 1095441 - protein, 9 aa, Homo Sapiens
PGGGRGQEE

SEQ ID NO: 1095442 - protein, 9 aa, Homo Sapiens
KKKKRKKKN

SEQ ID NO: 1095443 - protein, 9 aa, Homo Sapiens
AHLALHSAA

SEQ ID NO: 1095444 - protein, 9 aa, Homo Sapiens
KYIKDYYRR

SEQ ID NO: 1095445 - protein, 9 aa, Homo Sapiens
MELSVVAPA

SEQ ID NO: 1095446 - protein, 9 aa, Homo Sapiens
GVTCSRPCC

SEQ ID NO: 1095447 - protein, 9 aa, Homo Sapiens
FRIRLTQVT

SEQ ID NO: 1095448 - protein, 9 aa, Homo Sapiens
SLDQFSNSG

SEQ ID NO: 1095449 - protein, 9 aa, Homo Sapiens
LYADWPGDH

SEQ ID NO: 1095450 - protein, 9 aa, Homo Sapiens
QGLLKATQN

SEQ ID NO: 1095451 - protein, 9 aa, Homo Sapiens
LDCSAESNR

SEQ ID NO: 1095452 - protein, 9 aa, Homo Sapiens
LLARFTASA

SEQ ID NO: 1095453 - protein, 9 aa, Homo Sapiens
IGTSANVVC

SEQ ID NO: 1095454 - protein, 9 aa, Homo Sapiens
ANDNLPFVL

SEQ ID NO: 1095455 - protein, 9 aa, Homo Sapiens
NLPLMIKNR

SEQ ID NO: 1095456 - protein, 9 aa, Homo Sapiens
KMKNPHLVK

SEQ ID NO: 1095457 - protein, 9 aa, Homo Sapiens
LLQPKPWQQ

SEQ ID NO: 1095458 - protein, 9 aa, Homo Sapiens
QGPLFLLFF

SEQ ID NO: 1095459 - protein, 9 aa, Homo Sapiens
RLDMPLYFS

SEQ ID NO: 1095460 - protein, 9 aa, Homo Sapiens
AWYLCSSAS

SEQ ID NO: 1095461 - protein, 9 aa, Homo Sapiens
IGQGLVGMT

SEQ ID NO: 1095462 - protein, 9 aa, Homo Sapiens
PNSLLVVLD

SEQ ID NO: 1095463 - protein, 9 aa, Homo Sapiens
HGKAAPWRE

SEQ ID NO: 1095464 - protein, 9 aa, Homo Sapiens
CKSVNTCLE

SEQ ID NO: 1095465 - protein, 9 aa, Homo Sapiens
AARASDDLR

SEQ ID NO: 1095466 - protein, 9 aa, Homo Sapiens
KEPYFVYSR

SEQ ID NO: 1095467 - protein, 9 aa, Homo Sapiens
WTCASSRGA

SEQ ID NO: 1095468 - protein, 9 aa, Homo Sapiens
TEWTRPSRF

SEQ ID NO: 1095469 - protein, 9 aa, Homo Sapiens
TLNCIGMKW

SEQ ID NO: 1095470 - protein, 9 aa, Homo Sapiens
SPQGPRILL

SEQ ID NO: 1095471 - protein, 9 aa, Homo Sapiens
TWIIPANVW

SEQ ID NO: 1095472 - protein, 9 aa, Homo Sapiens
WTPAWCMAV

SEQ ID NO: 1095473 - protein, 9 aa, Homo Sapiens
WSTISCPRP

SEQ ID NO: 1095474 - protein, 9 aa, Homo Sapiens
PWQQQPVLV

SEQ ID NO: 1095475 - protein, 9 aa, Homo Sapiens
LETLGENVF

SEQ ID NO: 1095476 - protein, 9 aa, Homo Sapiens
NFSGSVEHR

SEQ ID NO: 1095477 - protein, 9 aa, Homo Sapiens
WVQNTRILR

SEQ ID NO: 1095478 - protein, 9 aa, Homo Sapiens
RDSPSARWR

SEQ ID NO: 1095479 - protein, 9 aa, Homo Sapiens
ALHSEPADN

SEQ ID NO: 1095480 - protein, 9 aa, Homo Sapiens
LYLRTSGEP

SEQ ID NO: 1095481 - protein, 9 aa, Homo Sapiens
WPGHFLKKV

SEQ ID NO: 1095482 - protein, 9 aa, Homo Sapiens
FLQVSVHHL

SEQ ID NO: 1095483 - protein, 9 aa, Homo Sapiens
PRNLGTTSS

SEQ ID NO: 1095484 - protein, 9 aa, Homo Sapiens
SPAGLQSYH

SEQ ID NO: 1095485 - protein, 9 aa, Homo Sapiens
PKPAVHDGA

SEQ ID NO: 1095486 - protein, 9 aa, Homo Sapiens
RHPHKYRVL

SEQ ID NO: 1095487 - protein, 9 aa, Homo Sapiens
ACGAASPPA

SEQ ID NO: 1095488 - protein, 9 aa, Homo Sapiens
MDHNVEMFM

SEQ ID NO: 1095489 - protein, 9 aa, Homo Sapiens
FLDLNPVPE

SEQ ID NO: 1095490 - protein, 9 aa, Homo Sapiens
GIDGIDGDQ

SEQ ID NO: 1095491 - protein, 9 aa, Homo Sapiens
SVHPPPLGS

SEQ ID NO: 1095492 - protein, 9 aa, Homo Sapiens
TQVTKEETR

SEQ ID NO: 1095493 - protein, 9 aa, Homo Sapiens
RCPPSPRQR

SEQ ID NO: 1095494 - protein, 9 aa, Homo Sapiens
SPAELYVVL

SEQ ID NO: 1095495 - protein, 9 aa, Homo Sapiens
HAGGTGLEG

SEQ ID NO: 1095496 - protein, 9 aa, Homo Sapiens
SPCPPMPTR

SEQ ID NO: 1095497 - protein, 9 aa, Homo Sapiens
ADPDDVLMV

SEQ ID NO: 1095498 - protein, 9 aa, Homo Sapiens
YEQHTDTVG

SEQ ID NO: 1095499 - protein, 9 aa, Homo Sapiens
WPREAHRVR

SEQ ID NO: 1095500 - protein, 9 aa, Homo Sapiens
RDFRMGKRS

SEQ ID NO: 1095501 - protein, 9 aa, Homo Sapiens
ITPLLENNH

SEQ ID NO: 1095502 - protein, 9 aa, Homo Sapiens
RRPLKKWPT

SEQ ID NO: 1095503 - protein, 9 aa, Homo Sapiens
RACFLAIHL

SEQ ID NO: 1095504 - protein, 9 aa, Homo Sapiens
RAQLVCSAR

SEQ ID NO: 1095505 - protein, 9 aa, Homo Sapiens
TIRLRSSEV

SEQ ID NO: 1095506 - protein, 9 aa, Homo Sapiens
HVCKQSMGE

SEQ ID NO: 1095507 - protein, 9 aa, Homo Sapiens
PPPRPAPGW

SEQ ID NO: 1095508 - protein, 9 aa, Homo Sapiens
TALMGPRTD

SEQ ID NO: 1095509 - protein, 9 aa, Homo Sapiens
TLAPPETPG

SEQ ID NO: 1095510 - protein, 9 aa, Homo Sapiens
ERLKNPNLI

SEQ ID NO: 1095511 - protein, 9 aa, Homo Sapiens
SCSASRRTG

SEQ ID NO: 1095512 - protein, 9 aa, Homo Sapiens
SLDRNLGSP

SEQ ID NO: 1095513 - protein, 9 aa, Homo Sapiens
YGLTQGAMA

SEQ ID NO: 1095514 - protein, 9 aa, Homo Sapiens
KKKRKKKNN

SEQ ID NO: 1095515 - protein, 9 aa, Homo Sapiens
CNLMRPKHS

SEQ ID NO: 1095516 - protein, 9 aa, Homo Sapiens
NEQKARGAA

SEQ ID NO: 1095517 - protein, 9 aa, Homo Sapiens
FDKFTNMYI

SEQ ID NO: 1095518 - protein, 9 aa, Homo Sapiens
CFQRLLISK

SEQ ID NO: 1095519 - protein, 9 aa, Homo Sapiens
PLSLQCQSL

SEQ ID NO: 1095520 - protein, 9 aa, Homo Sapiens
RLLAAEYTF

SEQ ID NO: 1095521 - protein, 9 aa, Homo Sapiens
SLGFLICCL

SEQ ID NO: 1095522 - protein, 9 aa, Homo Sapiens
PFLFKVGLI

SEQ ID NO: 1095523 - protein, 9 aa, Homo Sapiens
PASPGNRGL

SEQ ID NO: 1095524 - protein, 9 aa, Homo Sapiens
CTEAPGNLR

SEQ ID NO: 1095525 - protein, 9 aa, Homo Sapiens
PEHCTRQFQ

SEQ ID NO: 1095526 - protein, 9 aa, Homo Sapiens
LAAREMALR

SEQ ID NO: 1095527 - protein, 9 aa, Homo Sapiens
LFMTKTSNM

SEQ ID NO: 1095528 - protein, 9 aa, Homo Sapiens
LQPPLPLTS

SEQ ID NO: 1095529 - protein, 9 aa, Homo Sapiens
HVIGTRVYS

SEQ ID NO: 1095530 - protein, 9 aa, Homo Sapiens
SVGSLRVLR

SEQ ID NO: 1095531 - protein, 9 aa, Homo Sapiens
ERCVAQAPP

SEQ ID NO: 1095532 - protein, 9 aa, Homo Sapiens
KNIHGNALQ

SEQ ID NO: 1095533 - protein, 9 aa, Homo Sapiens
LPSCPASAP

SEQ ID NO: 1095534 - protein, 9 aa, Homo Sapiens
HQVRPIVGP

SEQ ID NO: 1095535 - protein, 9 aa, Homo Sapiens
KPATLAQPV

SEQ ID NO: 1095536 - protein, 9 aa, Homo Sapiens
FSLLCPPTP

SEQ ID NO: 1095537 - protein, 9 aa, Homo Sapiens
PPAAPTGRP

SEQ ID NO: 1095538 - protein, 9 aa, Homo Sapiens
GSQRPPRQV

SEQ ID NO: 1095539 - protein, 9 aa, Homo Sapiens
QKWKKSDSL

SEQ ID NO: 1095540 - protein, 9 aa, Homo Sapiens
QRGPASPRR

SEQ ID NO: 1095541 - protein, 9 aa, Homo Sapiens
HVLLKYTEY

SEQ ID NO: 1095542 - protein, 9 aa, Homo Sapiens
VAILLYVLI

SEQ ID NO: 1095543 - protein, 9 aa, Homo Sapiens
LLLPEGIRC

SEQ ID NO: 1095544 - protein, 9 aa, Homo Sapiens
VCSTSSDWA

SEQ ID NO: 1095545 - protein, 9 aa, Homo Sapiens
REESIPKKS

SEQ ID NO: 1095546 - protein, 9 aa, Homo Sapiens
CIGKEQELF

SEQ ID NO: 1095547 - protein, 9 aa, Homo Sapiens
QGHREGVHR

SEQ ID NO: 1095548 - protein, 9 aa, Homo Sapiens
PRGIPDKSE

SEQ ID NO: 1095549 - protein, 9 aa, Homo Sapiens
VLMVTESSR

SEQ ID NO: 1095550 - protein, 9 aa, Homo Sapiens
SDLNPAKWL

SEQ ID NO: 1095551 - protein, 9 aa, Homo Sapiens
DLMVLVATG

SEQ ID NO: 1095552 - protein, 9 aa, Homo Sapiens
ERYFEYKSP

SEQ ID NO: 1095553 - protein, 9 aa, Homo Sapiens
TFFCNQCSM

SEQ ID NO: 1095554 - protein, 9 aa, Homo Sapiens
PHAWGRFDS

SEQ ID NO: 1095555 - protein, 9 aa, Homo Sapiens
QFPRVCMMV

SEQ ID NO: 1095556 - protein, 9 aa, Homo Sapiens
LLCFQRLLI

SEQ ID NO: 1095557 - protein, 9 aa, Homo Sapiens
FCLFMTKTS

SEQ ID NO: 1095558 - protein, 9 aa, Homo Sapiens
MGTVQRWGK

SEQ ID NO: 1095559 - protein, 9 aa, Homo Sapiens
APAAAPPPA

SEQ ID NO: 1095560 - protein, 9 aa, Homo Sapiens
NAPEGRLRK

SEQ ID NO: 1095561 - protein, 9 aa, Homo Sapiens
DQVVSLSEK

SEQ ID NO: 1095562 - protein, 9 aa, Homo Sapiens
GAHVWLLPG

SEQ ID NO: 1095563 - protein, 9 aa, Homo Sapiens
LPSAPAAAP

SEQ ID NO: 1095564 - protein, 9 aa, Homo Sapiens
WAAASEMAL

SEQ ID NO: 1095565 - protein, 9 aa, Homo Sapiens
SDLLCNPKP

SEQ ID NO: 1095566 - protein, 9 aa, Homo Sapiens
ELCQCLQRK

SEQ ID NO: 1095567 - protein, 9 aa, Homo Sapiens
PSGYMMNSS

SEQ ID NO: 1095568 - protein, 9 aa, Homo Sapiens
WPRPPCSQR

SEQ ID NO: 1095569 - protein, 9 aa, Homo Sapiens
ARATSPCTK

SEQ ID NO: 1095570 - protein, 9 aa, Homo Sapiens
PLLSGARGR

SEQ ID NO: 1095571 - protein, 9 aa, Homo Sapiens
KDTKYVRIL

SEQ ID NO: 1095572 - protein, 9 aa, Homo Sapiens
PGARNLTLV

SEQ ID NO: 1095573 - protein, 9 aa, Homo Sapiens
CLIALKKIL

SEQ ID NO: 1095574 - protein, 9 aa, Homo Sapiens
GGNERYFFE

SEQ ID NO: 1095575 - protein, 9 aa, Homo Sapiens
GLYGLTQGA

SEQ ID NO: 1095576 - protein, 9 aa, Homo Sapiens
KKNKENQKE

SEQ ID NO: 1095577 - protein, 9 aa, Homo Sapiens
PPHPVLIQH

SEQ ID NO: 1095578 - protein, 9 aa, Homo Sapiens
TSTTLAWGI

SEQ ID NO: 1095579 - protein, 9 aa, Homo Sapiens
TASGKFTCN

SEQ ID NO: 1095580 - protein, 9 aa, Homo Sapiens
AGPEDGRAP

SEQ ID NO: 1095581 - protein, 9 aa, Homo Sapiens
CASPPCAAR

SEQ ID NO: 1095582 - protein, 9 aa, Homo Sapiens
EMNKKHEAE

SEQ ID NO: 1095583 - protein, 9 aa, Homo Sapiens
IARLNKCSF

SEQ ID NO: 1095584 - protein, 9 aa, Homo Sapiens
RARQVLGLL

SEQ ID NO: 1095585 - protein, 9 aa, Homo Sapiens
PCAARASWW

SEQ ID NO: 1095586 - protein, 9 aa, Homo Sapiens
TPVSSPTAR

SEQ ID NO: 1095587 - protein, 9 aa, Homo Sapiens
ACFLAIHLL

SEQ ID NO: 1095588 - protein, 9 aa, Homo Sapiens
YCVCVLAAN

SEQ ID NO: 1095589 - protein, 9 aa, Homo Sapiens
MAVRSPSRC

SEQ ID NO: 1095590 - protein, 9 aa, Homo Sapiens
LLEEEVDIN

SEQ ID NO: 1095591 - protein, 9 aa, Homo Sapiens
SIATPEDIL

SEQ ID NO: 1095592 - protein, 9 aa, Homo Sapiens
RPGAAASLR

SEQ ID NO: 1095593 - protein, 9 aa, Homo Sapiens
ILLSSILSS

SEQ ID NO: 1095594 - protein, 9 aa, Homo Sapiens
TAPSTPTGC

SEQ ID NO: 1095595 - protein, 9 aa, Homo Sapiens
TSQVLSLTM

SEQ ID NO: 1095596 - protein, 9 aa, Homo Sapiens
NLQKSSCFQ

SEQ ID NO: 1095597 - protein, 9 aa, Homo Sapiens
DPPSGTPPS

SEQ ID NO: 1095598 - protein, 9 aa, Homo Sapiens
DTGPQPPPS

SEQ ID NO: 1095599 - protein, 9 aa, Homo Sapiens
LRGWRARKA

SEQ ID NO: 1095600 - protein, 9 aa, Homo Sapiens
PCIWQPVMD

SEQ ID NO: 1095601 - protein, 9 aa, Homo Sapiens
DGERSFRGS

SEQ ID NO: 1095602 - protein, 9 aa, Homo Sapiens
DSWDQRRHG

SEQ ID NO: 1095603 - protein, 9 aa, Homo Sapiens
PAAERAGAA

SEQ ID NO: 1095604 - protein, 9 aa, Homo Sapiens
NWDIAHMIG

SEQ ID NO: 1095605 - protein, 9 aa, Homo Sapiens
AARGCSPAG

SEQ ID NO: 1095606 - protein, 9 aa, Homo Sapiens
CFIHHYYRR

SEQ ID NO: 1095607 - protein, 9 aa, Homo Sapiens
GYKYEQIDG

SEQ ID NO: 1095608 - protein, 9 aa, Homo Sapiens
QYQHIHFFL

SEQ ID NO: 1095609 - protein, 9 aa, Homo Sapiens
YDNQKVVLL

SEQ ID NO: 1095610 - protein, 9 aa, Homo Sapiens
VAARHSGRG

SEQ ID NO: 1095611 - protein, 9 aa, Homo Sapiens
TCHLMPGPD

SEQ ID NO: 1095612 - protein, 9 aa, Homo Sapiens
RPHNRRREE

SEQ ID NO: 1095613 - protein, 9 aa, Homo Sapiens
PCLTHCTFW

SEQ ID NO: 1095614 - protein, 9 aa, Homo Sapiens
WKTEGYSGA

SEQ ID NO: 1095615 - protein, 9 aa, Homo Sapiens
PCPPLEVHL

SEQ ID NO: 1095616 - protein, 9 aa, Homo Sapiens
ITAALCRAW

SEQ ID NO: 1095617 - protein, 9 aa, Homo Sapiens
ASHRTSPVT

SEQ ID NO: 1095618 - protein, 9 aa, Homo Sapiens
NKLRTKTLQ

SEQ ID NO: 1095619 - protein, 9 aa, Homo Sapiens
SRNILEMSF

SEQ ID NO: 1095620 - protein, 9 aa, Homo Sapiens
VRSQPTASV

SEQ ID NO: 1095621 - protein, 9 aa, Homo Sapiens
RSIKEGDGA

SEQ ID NO: 1095622 - protein, 9 aa, Homo Sapiens
CTMPPLLHP

SEQ ID NO: 1095623 - protein, 9 aa, Homo Sapiens
AQSESVQRP

SEQ ID NO: 1095624 - protein, 9 aa, Homo Sapiens
NTGSRMLKQ

SEQ ID NO: 1095625 - protein, 9 aa, Homo Sapiens
YVIPLQAGQ

SEQ ID NO: 1095626 - protein, 9 aa, Homo Sapiens
HFEPHMRPK

SEQ ID NO: 1095627 - protein, 9 aa, Homo Sapiens
LRQDPPSSR

SEQ ID NO: 1095628 - protein, 9 aa, Homo Sapiens
LMTANSQEL

SEQ ID NO: 1095629 - protein, 9 aa, Homo Sapiens
HSTMKTVLK

SEQ ID NO: 1095630 - protein, 9 aa, Homo Sapiens
SGLPCSWWW

SEQ ID NO: 1095631 - protein, 9 aa, Homo Sapiens
PSSLLSPCN

SEQ ID NO: 1095632 - protein, 9 aa, Homo Sapiens
KCGKVFNQS

SEQ ID NO: 1095633 - protein, 9 aa, Homo Sapiens
EVLRTVKTK

SEQ ID NO: 1095634 - protein, 9 aa, Homo Sapiens
SSFTHCRPH

SEQ ID NO: 1095635 - protein, 9 aa, Homo Sapiens
PRHGRPAWP

SEQ ID NO: 1095636 - protein, 9 aa, Homo Sapiens
LSDVCCLTG

SEQ ID NO: 1095637 - protein, 9 aa, Homo Sapiens
AGVILLFAG

SEQ ID NO: 1095638 - protein, 9 aa, Homo Sapiens
CPRPSATSQ

SEQ ID NO: 1095639 - protein, 9 aa, Homo Sapiens
LLKLESKMK

SEQ ID NO: 1095640 - protein, 9 aa, Homo Sapiens
VNTKKEMVT

SEQ ID NO: 1095641 - protein, 9 aa, Homo Sapiens
DVESFLFYV

SEQ ID NO: 1095642 - protein, 9 aa, Homo Sapiens
HRVRRHHLG

SEQ ID NO: 1095643 - protein, 9 aa, Homo Sapiens
AAATAASAG

SEQ ID NO: 1095644 - protein, 9 aa, Homo Sapiens
SVQLENMEE

SEQ ID NO: 1095645 - protein, 9 aa, Homo Sapiens
FSNGSWWAP

SEQ ID NO: 1095646 - protein, 9 aa, Homo Sapiens
ARKGEAIRI

SEQ ID NO: 1095647 - protein, 9 aa, Homo Sapiens
RVSIDNWCW

SEQ ID NO: 1095648 - protein, 9 aa, Homo Sapiens
GSTVLFHCQ

SEQ ID NO: 1095649 - protein, 9 aa, Homo Sapiens
SKDYMYRRG

SEQ ID NO: 1095650 - protein, 9 aa, Homo Sapiens
KLKQMLNNK

SEQ ID NO: 1095651 - protein, 9 aa, Homo Sapiens
ATIRLRSSE

SEQ ID NO: 1095652 - protein, 9 aa, Homo Sapiens
RVEGGWPQV

SEQ ID NO: 1095653 - protein, 9 aa, Homo Sapiens
RLVLKRFFE

SEQ ID NO: 1095654 - protein, 9 aa, Homo Sapiens
VFGIEAVEV

SEQ ID NO: 1095655 - protein, 9 aa, Homo Sapiens
HWGAAATTL

SEQ ID NO: 1095656 - protein, 9 aa, Homo Sapiens
RSAKETMTI

SEQ ID NO: 1095657 - protein, 9 aa, Homo Sapiens
GVVILTGAH

SEQ ID NO: 1095658 - protein, 9 aa, Homo Sapiens
QVLSLTMSP

SEQ ID NO: 1095659 - protein, 9 aa, Homo Sapiens
GPCWVGPGL

SEQ ID NO: 1095660 - protein, 9 aa, Homo Sapiens
VVKFPVTIR

SEQ ID NO: 1095661 - protein, 9 aa, Homo Sapiens
RKFGWQMRA

SEQ ID NO: 1095662 - protein, 9 aa, Homo Sapiens
ISLALHTDK

SEQ ID NO: 1095663 - protein, 9 aa, Homo Sapiens
IKVARYRRP

SEQ ID NO: 1095664 - protein, 9 aa, Homo Sapiens
PHTHHLIPS

SEQ ID NO: 1095665 - protein, 9 aa, Homo Sapiens
TAQPAPKTS

SEQ ID NO: 1095666 - protein, 9 aa, Homo Sapiens
YYSSYYGGL

SEQ ID NO: 1095667 - protein, 9 aa, Homo Sapiens
LTRGPSYHG

SEQ ID NO: 1095668 - protein, 9 aa, Homo Sapiens
TYRLISTIA

SEQ ID NO: 1095669 - protein, 9 aa, Homo Sapiens
LACTAPRAG

SEQ ID NO: 1095670 - protein, 9 aa, Homo Sapiens
HLCVQRGWT

SEQ ID NO: 1095671 - protein, 9 aa, Homo Sapiens
RSHLDFSPY

SEQ ID NO: 1095672 - protein, 9 aa, Homo Sapiens
GVKKPIISV

SEQ ID NO: 1095673 - protein, 9 aa, Homo Sapiens
FKVLGVNVM

SEQ ID NO: 1095674 - protein, 9 aa, Homo Sapiens
EHPRCVTRE

SEQ ID NO: 1095675 - protein, 9 aa, Homo Sapiens
QLQDRDTEI

SEQ ID NO: 1095676 - protein, 9 aa, Homo Sapiens
REDQSLRRN

SEQ ID NO: 1095677 - protein, 9 aa, Homo Sapiens
EPVVVDAFN

SEQ ID NO: 1095678 - protein, 9 aa, Homo Sapiens
DIISLALHT

SEQ ID NO: 1095679 - protein, 9 aa, Homo Sapiens
CGASSSVHS

SEQ ID NO: 1095680 - protein, 9 aa, Homo Sapiens
GDPAGVYKT

SEQ ID NO: 1095681 - protein, 9 aa, Homo Sapiens
SIARLNKCS

SEQ ID NO: 1095682 - protein, 9 aa, Homo Sapiens
TVILQIVDH

SEQ ID NO: 1095683 - protein, 9 aa, Homo Sapiens
ATRRAVQKR

SEQ ID NO: 1095684 - protein, 9 aa, Homo Sapiens
VKLWKKGEG

SEQ ID NO: 1095685 - protein, 9 aa, Homo Sapiens
RAVQKRGLL

SEQ ID NO: 1095686 - protein, 9 aa, Homo Sapiens
TRAHLALHS

SEQ ID NO: 1095687 - protein, 9 aa, Homo Sapiens
HRKGQRRAT

SEQ ID NO: 1095688 - protein, 9 aa, Homo Sapiens
NRHFKAHHS

SEQ ID NO: 1095689 - protein, 9 aa, Homo Sapiens
DLRYANLEA

SEQ ID NO: 1095690 - protein, 9 aa, Homo Sapiens
SFLGEFHPW

SEQ ID NO: 1095691 - protein, 9 aa, Homo Sapiens
PWRLLLVAA

SEQ ID NO: 1095692 - protein, 9 aa, Homo Sapiens
HPLAVASWV

SEQ ID NO: 1095693 - protein, 9 aa, Homo Sapiens
LFKVGLIPI

SEQ ID NO: 1095694 - protein, 9 aa, Homo Sapiens
MNRGDDTPC

SEQ ID NO: 1095695 - protein, 9 aa, Homo Sapiens
RPRPVSMTF

SEQ ID NO: 1095696 - protein, 9 aa, Homo Sapiens
ERYFFENEN

SEQ ID NO: 1095697 - protein, 9 aa, Homo Sapiens
MDVSAVPMG

SEQ ID NO: 1095698 - protein, 9 aa, Homo Sapiens
PVFSRPILA

SEQ ID NO: 1095699 - protein, 9 aa, Homo Sapiens
GRCPQVLSA

SEQ ID NO: 1095700 - protein, 9 aa, Homo Sapiens
LQNPQVCLA

SEQ ID NO: 1095701 - protein, 9 aa, Homo Sapiens
SSLGTTPFS

SEQ ID NO: 1095702 - protein, 9 aa, Homo Sapiens
IGVSTVHVT

SEQ ID NO: 1095703 - protein, 9 aa, Homo Sapiens
QRPPRQVRE

SEQ ID NO: 1095704 - protein, 9 aa, Homo Sapiens
TWLSYHVLQ

SEQ ID NO: 1095705 - protein, 9 aa, Homo Sapiens
DVNQDLYRM

SEQ ID NO: 1095706 - protein, 9 aa, Homo Sapiens
ANPQLLCQN

SEQ ID NO: 1095707 - protein, 9 aa, Homo Sapiens
QRASKTVDF

SEQ ID NO: 1095708 - protein, 9 aa, Homo Sapiens
NDNLPFVLY

SEQ ID NO: 1095709 - protein, 9 aa, Homo Sapiens
LCQCDKKKE

SEQ ID NO: 1095710 - protein, 9 aa, Homo Sapiens
KDIIISDTK

SEQ ID NO: 1095711 - protein, 9 aa, Homo Sapiens
VGISRSATI

SEQ ID NO: 1095712 - protein, 9 aa, Homo Sapiens
LTSHLVKGT

SEQ ID NO: 1095713 - protein, 9 aa, Homo Sapiens
YTALGYMEA

SEQ ID NO: 1095714 - protein, 9 aa, Homo Sapiens
YSQFQYGDP

SEQ ID NO: 1095715 - protein, 9 aa, Homo Sapiens
QLMLDCWVQ

SEQ ID NO: 1095716 - protein, 9 aa, Homo Sapiens
GPLSAPPRT

SEQ ID NO: 1095717 - protein, 9 aa, Homo Sapiens
NGLENILQL

SEQ ID NO: 1095718 - protein, 9 aa, Homo Sapiens
QWAPHSAGL

SEQ ID NO: 1095719 - protein, 9 aa, Homo Sapiens
LLHQVLRKL

SEQ ID NO: 1095720 - protein, 9 aa, Homo Sapiens
GVGPQFVRC

SEQ ID NO: 1095721 - protein, 9 aa, Homo Sapiens
RRGGILFFV

SEQ ID NO: 1095722 - protein, 9 aa, Homo Sapiens
KRKKMTASQ

SEQ ID NO: 1095723 - protein, 9 aa, Homo Sapiens
DPAGVYKTY

SEQ ID NO: 1095724 - protein, 9 aa, Homo Sapiens
TSHSTGPPS

SEQ ID NO: 1095725 - protein, 9 aa, Homo Sapiens
CSRMARPKD

SEQ ID NO: 1095726 - protein, 9 aa, Homo Sapiens
MLDGAITDV

SEQ ID NO: 1095727 - protein, 9 aa, Homo Sapiens
GVSTSWGPT

SEQ ID NO: 1095728 - protein, 9 aa, Homo Sapiens
IAPPARAGP

SEQ ID NO: 1095729 - protein, 9 aa, Homo Sapiens
VNLNKNDWI

SEQ ID NO: 1095730 - protein, 9 aa, Homo Sapiens
LLPLPRSLG

SEQ ID NO: 1095731 - protein, 9 aa, Homo Sapiens
TDSARAPTL

SEQ ID NO: 1095732 - protein, 9 aa, Homo Sapiens
VYHRNCLLC

SEQ ID NO: 1095733 - protein, 9 aa, Homo Sapiens
GSSPLVRAP

SEQ ID NO: 1095734 - protein, 9 aa, Homo Sapiens
ATQLPVPEH

SEQ ID NO: 1095735 - protein, 9 aa, Homo Sapiens
LRAGVNPAA

SEQ ID NO: 1095736 - protein, 9 aa, Homo Sapiens
DLARGFRSG

SEQ ID NO: 1095737 - protein, 9 aa, Homo Sapiens
SRDLCPREP

SEQ ID NO: 1095738 - protein, 9 aa, Homo Sapiens
LARHLSFIG

SEQ ID NO: 1095739 - protein, 9 aa, Homo Sapiens
AKSATCSPG

SEQ ID NO: 1095740 - protein, 9 aa, Homo Sapiens
QGHGTCTSP

SEQ ID NO: 1095741 - protein, 9 aa, Homo Sapiens
RRWSTISCP

SEQ ID NO: 1095742 - protein, 9 aa, Homo Sapiens
PWALMNSWP

SEQ ID NO: 1095743 - protein, 9 aa, Homo Sapiens
TNDNAPQFL

SEQ ID NO: 1095744 - protein, 9 aa, Homo Sapiens
ATENHQALA

SEQ ID NO: 1095745 - protein, 9 aa, Homo Sapiens
RIELARMGS

SEQ ID NO: 1095746 - protein, 9 aa, Homo Sapiens
RIELARMGP

SEQ ID NO: 1095747 - protein, 9 aa, Homo Sapiens
KDTQDQLQD

SEQ ID NO: 1095748 - protein, 9 aa, Homo Sapiens
RKWGALWLL

SEQ ID NO: 1095749 - protein, 9 aa, Homo Sapiens
ARVDAHVVL

SEQ ID NO: 1095750 - protein, 9 aa, Homo Sapiens
RILPECFLA

SEQ ID NO: 1095751 - protein, 9 aa, Homo Sapiens
CSPAGVGGR

SEQ ID NO: 1095752 - protein, 9 aa, Homo Sapiens
RSDVEELTA

SEQ ID NO: 1095753 - protein, 9 aa, Homo Sapiens
ELRWMEAVR

SEQ ID NO: 1095754 - protein, 9 aa, Homo Sapiens
AGRGWLPQQ

SEQ ID NO: 1095755 - protein, 9 aa, Homo Sapiens
PCWATDCAL

SEQ ID NO: 1095756 - protein, 9 aa, Homo Sapiens
APGRGEGSR

SEQ ID NO: 1095757 - protein, 9 aa, Homo Sapiens
VPSMPLILE

SEQ ID NO: 1095758 - protein, 9 aa, Homo Sapiens
TYDFIIKCK

SEQ ID NO: 1095759 - protein, 9 aa, Homo Sapiens
ESGLEYYPL

SEQ ID NO: 1095760 - protein, 9 aa, Homo Sapiens
PESAGGCTT

SEQ ID NO: 1095761 - protein, 9 aa, Homo Sapiens
AGAVVWPSV

SEQ ID NO: 1095762 - protein, 9 aa, Homo Sapiens
NLTRKETPL

SEQ ID NO: 1095763 - protein, 9 aa, Homo Sapiens
RQVLGLLEG

SEQ ID NO: 1095764 - protein, 9 aa, Homo Sapiens
IQCPVCRQE

SEQ ID NO: 1095765 - protein, 9 aa, Homo Sapiens
PGSFNTKTT

SEQ ID NO: 1095766 - protein, 9 aa, Homo Sapiens
EVVAQATGE

SEQ ID NO: 1095767 - protein, 9 aa, Homo Sapiens
SYHPFKINQ

SEQ ID NO: 1095768 - protein, 9 aa, Homo Sapiens
ADKATKVGK

SEQ ID NO: 1095769 - protein, 9 aa, Homo Sapiens
DGIPRVDAL

SEQ ID NO: 1095770 - protein, 9 aa, Homo Sapiens
IRCGNGTLP

SEQ ID NO: 1095771 - protein, 9 aa, Homo Sapiens
MLYNCRNNL

SEQ ID NO: 1095772 - protein, 9 aa, Homo Sapiens
GPPRSRLAA

SEQ ID NO: 1095773 - protein, 9 aa, Homo Sapiens
YYDVESFLF

SEQ ID NO: 1095774 - protein, 9 aa, Homo Sapiens
LIRMGMTGL

SEQ ID NO: 1095775 - protein, 9 aa, Homo Sapiens
RAVHQCDRS

SEQ ID NO: 1095776 - protein, 9 aa, Homo Sapiens
DNIISDLVD

SEQ ID NO: 1095777 - protein, 9 aa, Homo Sapiens
QWPHPDPAG

SEQ ID NO: 1095778 - protein, 9 aa, Homo Sapiens
PPGRALHHA

SEQ ID NO: 1095779 - protein, 9 aa, Homo Sapiens
TAGSLVCST

SEQ ID NO: 1095780 - protein, 9 aa, Homo Sapiens
LSYLLTCLE

SEQ ID NO: 1095781 - protein, 9 aa, Homo Sapiens
FPQHHHPRI

SEQ ID NO: 1095782 - protein, 9 aa, Homo Sapiens
AGSRRCCLR

SEQ ID NO: 1095783 - protein, 9 aa, Homo Sapiens
AHLSSGQPN

SEQ ID NO: 1095784 - protein, 9 aa, Homo Sapiens
LLYGDCVVT

SEQ ID NO: 1095785 - protein, 9 aa, Homo Sapiens
MGVGWWVQN

SEQ ID NO: 1095786 - protein, 9 aa, Homo Sapiens
QSRISRETH

SEQ ID NO: 1095787 - protein, 9 aa, Homo Sapiens
LCCGKLLPL

SEQ ID NO: 1095788 - protein, 9 aa, Homo Sapiens
PLGPAVLEP

SEQ ID NO: 1095789 - protein, 9 aa, Homo Sapiens
CTIATALEY

SEQ ID NO: 1095790 - protein, 9 aa, Homo Sapiens
VLVELLLRC

SEQ ID NO: 1095791 - protein, 9 aa, Homo Sapiens
GCGSTPPPP

SEQ ID NO: 1095792 - protein, 9 aa, Homo Sapiens
LCPPLLALV

SEQ ID NO: 1095793 - protein, 9 aa, Homo Sapiens
GSEIPPPAP

SEQ ID NO: 1095794 - protein, 9 aa, Homo Sapiens
AHDLIWKMS

SEQ ID NO: 1095795 - protein, 9 aa, Homo Sapiens
AEEEQEEEA

SEQ ID NO: 1095796 - protein, 9 aa, Homo Sapiens
TFKNFGMAF

SEQ ID NO: 1095797 - protein, 9 aa, Homo Sapiens
PEALFYPGA

SEQ ID NO: 1095798 - protein, 9 aa, Homo Sapiens
NALPPTEGP

SEQ ID NO: 1095799 - protein, 9 aa, Homo Sapiens
HCQKGYLLQ

SEQ ID NO: 1095800 - protein, 9 aa, Homo Sapiens
SSKATENHQ

SEQ ID NO: 1095801 - protein, 9 aa, Homo Sapiens
QWCLQPRSL

SEQ ID NO: 1095802 - protein, 9 aa, Homo Sapiens
GPHVPRQLP

SEQ ID NO: 1095803 - protein, 9 aa, Homo Sapiens
PGRGEGSRD

SEQ ID NO: 1095804 - protein, 9 aa, Homo Sapiens
LQSADEKAR

SEQ ID NO: 1095805 - protein, 9 aa, Homo Sapiens
EMQAQHPPE

SEQ ID NO: 1095806 - protein, 9 aa, Homo Sapiens
ARHPHAPKT

SEQ ID NO: 1095807 - protein, 9 aa, Homo Sapiens
DGSASCIRC

SEQ ID NO: 1095808 - protein, 9 aa, Homo Sapiens
THGSGPGAH

SEQ ID NO: 1095809 - protein, 9 aa, Homo Sapiens
KAPRNLGTT

SEQ ID NO: 1095810 - protein, 9 aa, Homo Sapiens
PAPPAALVS

SEQ ID NO: 1095811 - protein, 9 aa, Homo Sapiens
SRRCCRVGK

SEQ ID NO: 1095812 - protein, 9 aa, Homo Sapiens
QIMEKLSEA

SEQ ID NO: 1095813 - protein, 9 aa, Homo Sapiens
LDTDANGQV

SEQ ID NO: 1095814 - protein, 9 aa, Homo Sapiens
CYCSRQPGI

SEQ ID NO: 1095815 - protein, 9 aa, Homo Sapiens
LLFPSTMQQ

SEQ ID NO: 1095816 - protein, 9 aa, Homo Sapiens
HTEYKELSG

SEQ ID NO: 1095817 - protein, 9 aa, Homo Sapiens
QQGLLKATQ

SEQ ID NO: 1095818 - protein, 9 aa, Homo Sapiens
GGWTTRYFQ

SEQ ID NO: 1095819 - protein, 9 aa, Homo Sapiens
VEHPGLCGG

SEQ ID NO: 1095820 - protein, 9 aa, Homo Sapiens
YRYHRRAPA

SEQ ID NO: 1095821 - protein, 9 aa, Homo Sapiens
HGPVGLLHM

SEQ ID NO: 1095822 - protein, 9 aa, Homo Sapiens
PMYRYHRRA

SEQ ID NO: 1095823 - protein, 9 aa, Homo Sapiens
LAIDPLLDV

SEQ ID NO: 1095824 - protein, 9 aa, Homo Sapiens
TVSVQGPGI

SEQ ID NO: 1095825 - protein, 9 aa, Homo Sapiens
GSHIWPKGF

SEQ ID NO: 1095826 - protein, 9 aa, Homo Sapiens
VDNKKTHPC

SEQ ID NO: 1095827 - protein, 9 aa, Homo Sapiens
QKVSRAGKI

SEQ ID NO: 1095828 - protein, 9 aa, Homo Sapiens
CVCWPSFSW

SEQ ID NO: 1095829 - protein, 9 aa, Homo Sapiens
NLFSTLEES

SEQ ID NO: 1095830 - protein, 9 aa, Homo Sapiens
LMKCDLRVS

SEQ ID NO: 1095831 - protein, 9 aa, Homo Sapiens
PTCSKKTQN

SEQ ID NO: 1095832 - protein, 9 aa, Homo Sapiens
VWNTASFRK

SEQ ID NO: 1095833 - protein, 9 aa, Homo Sapiens
AIEDDILPP

SEQ ID NO: 1095834 - protein, 9 aa, Homo Sapiens
PSPASACTM

SEQ ID NO: 1095835 - protein, 9 aa, Homo Sapiens
GTEVPWPEV

SEQ ID NO: 1095836 - protein, 9 aa, Homo Sapiens
LSYIRYGFE

SEQ ID NO: 1095837 - protein, 9 aa, Homo Sapiens
PQLLCQNPE

SEQ ID NO: 1095838 - protein, 9 aa, Homo Sapiens
GHTLITVAT

SEQ ID NO: 1095839 - protein, 9 aa, Homo Sapiens
EPRHGRPAW

SEQ ID NO: 1095840 - protein, 9 aa, Homo Sapiens
SADLVIWAR

SEQ ID NO: 1095841 - protein, 9 aa, Homo Sapiens
CCFPHFERL

SEQ ID NO: 1095842 - protein, 9 aa, Homo Sapiens
ALLRNSTAP

SEQ ID NO: 1095843 - protein, 9 aa, Homo Sapiens
CLLQQDKAS

SEQ ID NO: 1095844 - protein, 9 aa, Homo Sapiens
PPSRPRSPA

SEQ ID NO: 1095845 - protein, 9 aa, Homo Sapiens
LFYIFILSG

SEQ ID NO: 1095846 - protein, 9 aa, Homo Sapiens
SRLSPPEAP

SEQ ID NO: 1095847 - protein, 9 aa, Homo Sapiens
NMVPFWPPS

SEQ ID NO: 1095848 - protein, 9 aa, Homo Sapiens
VILLFAGIL

SEQ ID NO: 1095849 - protein, 9 aa, Homo Sapiens
KRKHERWHI

SEQ ID NO: 1095850 - protein, 9 aa, Homo Sapiens
EEEAMHRER

SEQ ID NO: 1095851 - protein, 9 aa, Homo Sapiens
QSMPPPPSR

SEQ ID NO: 1095852 - protein, 9 aa, Homo Sapiens
LLPYLYTSS

SEQ ID NO: 1095853 - protein, 9 aa, Homo Sapiens
SQEQKLGVW

SEQ ID NO: 1095854 - protein, 9 aa, Homo Sapiens
CPGTACSRG

SEQ ID NO: 1095855 - protein, 9 aa, Homo Sapiens
LASYPPYQA

SEQ ID NO: 1095856 - protein, 9 aa, Homo Sapiens
PVACEEARQ

SEQ ID NO: 1095857 - protein, 9 aa, Homo Sapiens
APGSEPQGP

SEQ ID NO: 1095858 - protein, 9 aa, Homo Sapiens
EELQMQLKA

SEQ ID NO: 1095859 - protein, 9 aa, Homo Sapiens
KILAVQRAS

SEQ ID NO: 1095860 - protein, 9 aa, Homo Sapiens
SCCQPVRMP

SEQ ID NO: 1095861 - protein, 9 aa, Homo Sapiens
KPETQNNQK

SEQ ID NO: 1095862 - protein, 9 aa, Homo Sapiens
RAAPAQRPR

SEQ ID NO: 1095863 - protein, 9 aa, Homo Sapiens
DLCPREPRH

SEQ ID NO: 1095864 - protein, 9 aa, Homo Sapiens
PEVTNSSSS

SEQ ID NO: 1095865 - protein, 9 aa, Homo Sapiens
CGQTGPLQR

SEQ ID NO: 1095866 - protein, 9 aa, Homo Sapiens
APGKTLPDI

SEQ ID NO: 1095867 - protein, 9 aa, Homo Sapiens
PPAALVSWK

SEQ ID NO: 1095868 - protein, 9 aa, Homo Sapiens
PWSRPGSGG

SEQ ID NO: 1095869 - protein, 9 aa, Homo Sapiens
HRDHDSSLN

SEQ ID NO: 1095870 - protein, 9 aa, Homo Sapiens
GATTAAVMT

SEQ ID NO: 1095871 - protein, 9 aa, Homo Sapiens
MSCSLLTQP

SEQ ID NO: 1095872 - protein, 9 aa, Homo Sapiens
IHKIMRMLP

SEQ ID NO: 1095873 - protein, 9 aa, Homo Sapiens
AVMIEIGTI

SEQ ID NO: 1095874 - protein, 9 aa, Homo Sapiens
RLLRLGSRW

SEQ ID NO: 1095875 - protein, 9 aa, Homo Sapiens
GMLTVIGQG

SEQ ID NO: 1095876 - protein, 9 aa, Homo Sapiens
EEVSPVSQQ

SEQ ID NO: 1095877 - protein, 9 aa, Homo Sapiens
CEGEHPRCV

SEQ ID NO: 1095878 - protein, 9 aa, Homo Sapiens
GPARPLEVR

SEQ ID NO: 1095879 - protein, 9 aa, Homo Sapiens
SPEAEVRHR

SEQ ID NO: 1095880 - protein, 9 aa, Homo Sapiens
SVIVLFGYM

SEQ ID NO: 1095881 - protein, 9 aa, Homo Sapiens
STTGVHNFE

SEQ ID NO: 1095882 - protein, 9 aa, Homo Sapiens
PPTPQNQLQ

SEQ ID NO: 1095883 - protein, 9 aa, Homo Sapiens
GKYHVARFT

SEQ ID NO: 1095884 - protein, 9 aa, Homo Sapiens
DMQFMLLFS

SEQ ID NO: 1095885 - protein, 9 aa, Homo Sapiens
DLEELKNVT

SEQ ID NO: 1095886 - protein, 9 aa, Homo Sapiens
KRKWGALWL

SEQ ID NO: 1095887 - protein, 9 aa, Homo Sapiens
DPLLDVAPV

SEQ ID NO: 1095888 - protein, 9 aa, Homo Sapiens
LPGPCASLL

SEQ ID NO: 1095889 - protein, 9 aa, Homo Sapiens
SHQKWKVGK

SEQ ID NO: 1095890 - protein, 9 aa, Homo Sapiens
PFLNYAMSS

SEQ ID NO: 1095891 - protein, 9 aa, Homo Sapiens
GPVRLREDA

SEQ ID NO: 1095892 - protein, 9 aa, Homo Sapiens
WGALMDSQQ

SEQ ID NO: 1095893 - protein, 9 aa, Homo Sapiens
FIWERIKIE

SEQ ID NO: 1095894 - protein, 9 aa, Homo Sapiens
FQVWNALCR

SEQ ID NO: 1095895 - protein, 9 aa, Homo Sapiens
RGPAGTAGP

SEQ ID NO: 1095896 - protein, 9 aa, Homo Sapiens
MAPALRGTR

SEQ ID NO: 1095897 - protein, 9 aa, Homo Sapiens
MSEFIWERI

SEQ ID NO: 1095898 - protein, 9 aa, Homo Sapiens
GAQVFAFLK

SEQ ID NO: 1095899 - protein, 9 aa, Homo Sapiens
RRWTCASSR

SEQ ID NO: 1095900 - protein, 9 aa, Homo Sapiens
FVCNVGEKG

SEQ ID NO: 1095901 - protein, 9 aa, Homo Sapiens
AQIAKKPRT

SEQ ID NO: 1095902 - protein, 9 aa, Homo Sapiens
CAVRDPIAA

SEQ ID NO: 1095903 - protein, 9 aa, Homo Sapiens
QPVDNHVGP

SEQ ID NO: 1095904 - protein, 9 aa, Homo Sapiens
PGGYPAYSK

SEQ ID NO: 1095905 - protein, 9 aa, Homo Sapiens
HAERPPGPH

SEQ ID NO: 1095906 - protein, 9 aa, Homo Sapiens
DAHLCPQQH

SEQ ID NO: 1095907 - protein, 9 aa, Homo Sapiens
QAPSQVWTA

SEQ ID NO: 1095908 - protein, 9 aa, Homo Sapiens
DGKASTGVV

SEQ ID NO: 1095909 - protein, 9 aa, Homo Sapiens
AVEACLRTH

SEQ ID NO: 1095910 - protein, 9 aa, Homo Sapiens
HHPNLPMRN

SEQ ID NO: 1095911 - protein, 9 aa, Homo Sapiens
ILLFAGILV

SEQ ID NO: 1095912 - protein, 9 aa, Homo Sapiens
SMPESAGGC

SEQ ID NO: 1095913 - protein, 9 aa, Homo Sapiens
VSIATPEDI

SEQ ID NO: 1095914 - protein, 9 aa, Homo Sapiens
QRLVREIVQ

SEQ ID NO: 1095915 - protein, 9 aa, Homo Sapiens
YSLHFLLIL

SEQ ID NO: 1095916 - protein, 9 aa, Homo Sapiens
DMMRKLRRS

SEQ ID NO: 1095917 - protein, 9 aa, Homo Sapiens
MGCWDMYHH

SEQ ID NO: 1095918 - protein, 9 aa, Homo Sapiens
VLLLHGQFQ

SEQ ID NO: 1095919 - protein, 9 aa, Homo Sapiens
APMKICTEA

SEQ ID NO: 1095920 - protein, 9 aa, Homo Sapiens
GCDRCDAGW

SEQ ID NO: 1095921 - protein, 9 aa, Homo Sapiens
YILTSMSDD

SEQ ID NO: 1095922 - protein, 9 aa, Homo Sapiens
VISFALAMG

SEQ ID NO: 1095923 - protein, 9 aa, Homo Sapiens
KHEAEFQKM

SEQ ID NO: 1095924 - protein, 9 aa, Homo Sapiens
NSRNIACIT

SEQ ID NO: 1095925 - protein, 9 aa, Homo Sapiens
IPGGKETLV

SEQ ID NO: 1095926 - protein, 9 aa, Homo Sapiens
KGVFCTSHV

SEQ ID NO: 1095927 - protein, 9 aa, Homo Sapiens
SASCFSNGS

SEQ ID NO: 1095928 - protein, 9 aa, Homo Sapiens
LNPAKWLLP

SEQ ID NO: 1095929 - protein, 9 aa, Homo Sapiens
LCPQTRRSP

SEQ ID NO: 1095930 - protein, 9 aa, Homo Sapiens
IDGDQGPKG

SEQ ID NO: 1095931 - protein, 9 aa, Homo Sapiens
PHTDYTWSF

SEQ ID NO: 1095932 - protein, 9 aa, Homo Sapiens
GKKGEGKGE

SEQ ID NO: 1095933 - protein, 9 aa, Homo Sapiens
LPPSLWAPA

SEQ ID NO: 1095934 - protein, 9 aa, Homo Sapiens
RLHCLQNTS

SEQ ID NO: 1095935 - protein, 9 aa, Homo Sapiens
QVGHGVWVG

SEQ ID NO: 1095936 - protein, 9 aa, Homo Sapiens
TKSLSRISL

SEQ ID NO: 1095937 - protein, 9 aa, Homo Sapiens
HMGTFAQIH

SEQ ID NO: 1095938 - protein, 9 aa, Homo Sapiens
PTAIGQLWE

SEQ ID NO: 1095939 - protein, 9 aa, Homo Sapiens
NTAWKTKKT

SEQ ID NO: 1095940 - protein, 9 aa, Homo Sapiens
SRPRSPASP

SEQ ID NO: 1095941 - protein, 9 aa, Homo Sapiens
PKRSSSQPV

SEQ ID NO: 1095942 - protein, 9 aa, Homo Sapiens
KQKLQAMRD

SEQ ID NO: 1095943 - protein, 9 aa, Homo Sapiens
WLDGALLAC

SEQ ID NO: 1095944 - protein, 9 aa, Homo Sapiens
FPQCTFFFL

SEQ ID NO: 1095945 - protein, 9 aa, Homo Sapiens
DPEPAGGQR

SEQ ID NO: 1095946 - protein, 9 aa, Homo Sapiens
VPARYRKPL

SEQ ID NO: 1095947 - protein, 9 aa, Homo Sapiens
LAPHPRPLQ

SEQ ID NO: 1095948 - protein, 9 aa, Homo Sapiens
MTKTSNMDL

SEQ ID NO: 1095949 - protein, 9 aa, Homo Sapiens
SCFYQRSIK

SEQ ID NO: 1095950 - protein, 9 aa, Homo Sapiens
EMSEFIWER

SEQ ID NO: 1095951 - protein, 9 aa, Homo Sapiens
LPLEIALTI

SEQ ID NO: 1095952 - protein, 9 aa, Homo Sapiens
VTPDQRKPP

SEQ ID NO: 1095953 - protein, 9 aa, Homo Sapiens
WPASGRRRT

SEQ ID NO: 1095954 - protein, 9 aa, Homo Sapiens
SPGWMASPA

SEQ ID NO: 1095955 - protein, 9 aa, Homo Sapiens
NLEQSRRPS

SEQ ID NO: 1095956 - protein, 9 aa, Homo Sapiens
ALPWGYRCE

SEQ ID NO: 1095957 - protein, 9 aa, Homo Sapiens
LAGSRRCCR

SEQ ID NO: 1095958 - protein, 9 aa, Homo Sapiens
DGDDLGALQ

SEQ ID NO: 1095959 - protein, 9 aa, Homo Sapiens
YPMSSSGLP

SEQ ID NO: 1095960 - protein, 9 aa, Homo Sapiens
YLTPLIITL

SEQ ID NO: 1095961 - protein, 9 aa, Homo Sapiens
ERLVQSRKG

SEQ ID NO: 1095962 - protein, 9 aa, Homo Sapiens
QMRASTPAP

SEQ ID NO: 1095963 - protein, 9 aa, Homo Sapiens
LDRQFRAGC

SEQ ID NO: 1095964 - protein, 9 aa, Homo Sapiens
TPYRDDCKE

SEQ ID NO: 1095965 - protein, 9 aa, Homo Sapiens
WLISAPVDK

SEQ ID NO: 1095966 - protein, 9 aa, Homo Sapiens
WVRRVLCTR

SEQ ID NO: 1095967 - protein, 9 aa, Homo Sapiens
GIHKDMIAP

SEQ ID NO: 1095968 - protein, 9 aa, Homo Sapiens
PVTLQPVTS

SEQ ID NO: 1095969 - protein, 9 aa, Homo Sapiens
RKVHNFQVW

SEQ ID NO: 1095970 - protein, 9 aa, Homo Sapiens
CRVQDTGPL

SEQ ID NO: 1095971 - protein, 9 aa, Homo Sapiens
QQACYNFIR

SEQ ID NO: 1095972 - protein, 9 aa, Homo Sapiens
PFPGWLGKG

SEQ ID NO: 1095973 - protein, 9 aa, Homo Sapiens
HLYYQDKVE

SEQ ID NO: 1095974 - protein, 9 aa, Homo Sapiens
QELRWMEAV

SEQ ID NO: 1095975 - protein, 9 aa, Homo Sapiens
LKKASSPGH

SEQ ID NO: 1095976 - protein, 9 aa, Homo Sapiens
EELTAKEVD

SEQ ID NO: 1095977 - protein, 9 aa, Homo Sapiens
GLQVTMHQP

SEQ ID NO: 1095978 - protein, 9 aa, Homo Sapiens
APCLTHCTF

SEQ ID NO: 1095979 - protein, 9 aa, Homo Sapiens
KATALPACR

SEQ ID NO: 1095980 - protein, 9 aa, Homo Sapiens
LDTNDNAPQ

SEQ ID NO: 1095981 - protein, 9 aa, Homo Sapiens
SPENAPPYS

SEQ ID NO: 1095982 - protein, 9 aa, Homo Sapiens
SRMDHNVEM

SEQ ID NO: 1095983 - protein, 9 aa, Homo Sapiens
IFWTAKCHR

SEQ ID NO: 1095984 - protein, 9 aa, Homo Sapiens
TPCASTAKS

SEQ ID NO: 1095985 - protein, 9 aa, Homo Sapiens
IAHMIGGFE

SEQ ID NO: 1095986 - protein, 9 aa, Homo Sapiens
QNDTYDVPR

SEQ ID NO: 1095987 - protein, 9 aa, Homo Sapiens
SPPQPPSEE

SEQ ID NO: 1095988 - protein, 9 aa, Homo Sapiens
KVLLLHGQF

SEQ ID NO: 1095989 - protein, 9 aa, Homo Sapiens
DKECTSAVD

SEQ ID NO: 1095990 - protein, 9 aa, Homo Sapiens
RERSVDREP

SEQ ID NO: 1095991 - protein, 9 aa, Homo Sapiens
QRCRCVCLR

SEQ ID NO: 1095992 - protein, 9 aa, Homo Sapiens
DDGQPCFRT

SEQ ID NO: 1095993 - protein, 9 aa, Homo Sapiens
KGLDSSWLP

SEQ ID NO: 1095994 - protein, 9 aa, Homo Sapiens
GSLDRNLGS

SEQ ID NO: 1095995 - protein, 9 aa, Homo Sapiens
ALECWDPTP

SEQ ID NO: 1095996 - protein, 9 aa, Homo Sapiens
HFFVTPQLF

SEQ ID NO: 1095997 - protein, 9 aa, Homo Sapiens
LGVTCSRPC

SEQ ID NO: 1095998 - protein, 9 aa, Homo Sapiens
PEEQAGGPP

SEQ ID NO: 1095999 - protein, 9 aa, Homo Sapiens
FEDNHHLYR

SEQ ID NO: 1096000 - protein, 9 aa, Homo Sapiens
VMLLRQLAN

SEQ ID NO: 1096001 - protein, 9 aa, Homo Sapiens
NHFFVTPQL

SEQ ID NO: 1096002 - protein, 9 aa, Homo Sapiens
FPFCNHGKH

SEQ ID NO: 1096003 - protein, 9 aa, Homo Sapiens
CRVGKSCCQ

SEQ ID NO: 1096004 - protein, 9 aa, Homo Sapiens
YSCIVENPQ

SEQ ID NO: 1096005 - protein, 9 aa, Homo Sapiens
DLQTACSTF

SEQ ID NO: 1096006 - protein, 9 aa, Homo Sapiens
YMEAFLGGL

SEQ ID NO: 1096007 - protein, 9 aa, Homo Sapiens
SWGPTAGAA

SEQ ID NO: 1096008 - protein, 9 aa, Homo Sapiens
ACITCTDVR

SEQ ID NO: 1096009 - protein, 9 aa, Homo Sapiens
VQRPWEKNS

SEQ ID NO: 1096010 - protein, 9 aa, Homo Sapiens
SSYLELPDL

SEQ ID NO: 1096011 - protein, 9 aa, Homo Sapiens
MDNIISDLV

SEQ ID NO: 1096012 - protein, 9 aa, Homo Sapiens
DHPTSASRV

SEQ ID NO: 1096013 - protein, 9 aa, Homo Sapiens
FLTTDTIKH

SEQ ID NO: 1096014 - protein, 9 aa, Homo Sapiens
ATGEQAPPW

SEQ ID NO: 1096015 - protein, 9 aa, Homo Sapiens
PRNIQLSIM

SEQ ID NO: 1096016 - protein, 9 aa, Homo Sapiens
ALSKKLWWT

SEQ ID NO: 1096017 - protein, 9 aa, Homo Sapiens
SKQPGSTGS

SEQ ID NO: 1096018 - protein, 9 aa, Homo Sapiens
TERNLRPLS

SEQ ID NO: 1096019 - protein, 9 aa, Homo Sapiens
DFIIKCKPL

SEQ ID NO: 1096020 - protein, 9 aa, Homo Sapiens
RQTPGQARA

SEQ ID NO: 1096021 - protein, 9 aa, Homo Sapiens
PGVQPPAPG

SEQ ID NO: 1096022 - protein, 9 aa, Homo Sapiens
ASPIQQLVW

SEQ ID NO: 1096023 - protein, 9 aa, Homo Sapiens
WAVTSPERL

SEQ ID NO: 1096024 - protein, 9 aa, Homo Sapiens
PTPQSPSWP

SEQ ID NO: 1096025 - protein, 9 aa, Homo Sapiens
MPESAGGCT

SEQ ID NO: 1096026 - protein, 9 aa, Homo Sapiens
LAKEEARHA

SEQ ID NO: 1096027 - protein, 9 aa, Homo Sapiens
LLTSSSREW

SEQ ID NO: 1096028 - protein, 9 aa, Homo Sapiens
AAAGVQRVG

SEQ ID NO: 1096029 - protein, 9 aa, Homo Sapiens
CLQLRTVDC

SEQ ID NO: 1096030 - protein, 9 aa, Homo Sapiens
HCQVGISRS

SEQ ID NO: 1096031 - protein, 9 aa, Homo Sapiens
AVVDQHPIN

SEQ ID NO: 1096032 - protein, 9 aa, Homo Sapiens
QHKQERKEL

SEQ ID NO: 1096033 - protein, 9 aa, Homo Sapiens
LTCLESAVH

SEQ ID NO: 1096034 - protein, 9 aa, Homo Sapiens
KAIYFTVDG

SEQ ID NO: 1096035 - protein, 9 aa, Homo Sapiens
IRASALCVL

SEQ ID NO: 1096036 - protein, 9 aa, Homo Sapiens
LTKLEHPGI

SEQ ID NO: 1096037 - protein, 9 aa, Homo Sapiens
TTPPATSSS

SEQ ID NO: 1096038 - protein, 9 aa, Homo Sapiens
SLGMEALGS

SEQ ID NO: 1096039 - protein, 9 aa, Homo Sapiens
AVRRCTQAS

SEQ ID NO: 1096040 - protein, 9 aa, Homo Sapiens
LSTCGCSRM

SEQ ID NO: 1096041 - protein, 9 aa, Homo Sapiens
CHWPLWRPC

SEQ ID NO: 1096042 - protein, 9 aa, Homo Sapiens
LTQLSISCP

SEQ ID NO: 1096043 - protein, 9 aa, Homo Sapiens
VFVLVRPLS

SEQ ID NO: 1096044 - protein, 9 aa, Homo Sapiens
CNPGLAELV

SEQ ID NO: 1096045 - protein, 9 aa, Homo Sapiens
KIPIGAKFK

SEQ ID NO: 1096046 - protein, 9 aa, Homo Sapiens
SIFSTWIIP

SEQ ID NO: 1096047 - protein, 9 aa, Homo Sapiens
TVRLHTPEG

SEQ ID NO: 1096048 - protein, 9 aa, Homo Sapiens
INDVPPSIF

SEQ ID NO: 1096049 - protein, 9 aa, Homo Sapiens
FVEKATFMP

SEQ ID NO: 1096050 - protein, 9 aa, Homo Sapiens
FCRDRVLLC

SEQ ID NO: 1096051 - protein, 9 aa, Homo Sapiens
RTAGSAKGA

SEQ ID NO: 1096052 - protein, 9 aa, Homo Sapiens
VVRAREALV

SEQ ID NO: 1096053 - protein, 9 aa, Homo Sapiens
KACLPLGAT

SEQ ID NO: 1096054 - protein, 9 aa, Homo Sapiens
VTASCASTG

SEQ ID NO: 1096055 - protein, 9 aa, Homo Sapiens
AGLQVTMHQ

SEQ ID NO: 1096056 - protein, 9 aa, Homo Sapiens
FFVDSSSYH

SEQ ID NO: 1096057 - protein, 9 aa, Homo Sapiens
VHHLHARLQ

SEQ ID NO: 1096058 - protein, 9 aa, Homo Sapiens
PADDDDSER

SEQ ID NO: 1096059 - protein, 9 aa, Homo Sapiens
ALTSHSTGP

SEQ ID NO: 1096060 - protein, 9 aa, Homo Sapiens
GGPCLDPAG

SEQ ID NO: 1096061 - protein, 9 aa, Homo Sapiens
AVAVAAVAV

SEQ ID NO: 1096062 - protein, 9 aa, Homo Sapiens
GCFKRPRVA

SEQ ID NO: 1096063 - protein, 9 aa, Homo Sapiens
RVEVDTKVN

SEQ ID NO: 1096064 - protein, 9 aa, Homo Sapiens
EVEIGTVVV

SEQ ID NO: 1096065 - protein, 9 aa, Homo Sapiens
QPVMDTVIL

SEQ ID NO: 1096066 - protein, 9 aa, Homo Sapiens
ICNSSPNSL

SEQ ID NO: 1096067 - protein, 9 aa, Homo Sapiens
KFTSRTKAR

SEQ ID NO: 1096068 - protein, 9 aa, Homo Sapiens
NLSLYLDRQ

SEQ ID NO: 1096069 - protein, 9 aa, Homo Sapiens
ELIPTRSEP

SEQ ID NO: 1096070 - protein, 9 aa, Homo Sapiens
SFCLFMTKT

SEQ ID NO: 1096071 - protein, 9 aa, Homo Sapiens
AAASLRIAG

SEQ ID NO: 1096072 - protein, 9 aa, Homo Sapiens
GGKDGPEST

SEQ ID NO: 1096073 - protein, 9 aa, Homo Sapiens
HLGSDVARP

SEQ ID NO: 1096074 - protein, 9 aa, Homo Sapiens
PEAEAGAAR

SEQ ID NO: 1096075 - protein, 9 aa, Homo Sapiens
SLPQGAGSP

SEQ ID NO: 1096076 - protein, 9 aa, Homo Sapiens
DQLQDRDTE

SEQ ID NO: 1096077 - protein, 9 aa, Homo Sapiens
RRRPALRLL

SEQ ID NO: 1096078 - protein, 9 aa, Homo Sapiens
PDHYGTTVP

SEQ ID NO: 1096079 - protein, 9 aa, Homo Sapiens
INFIPGLQL

SEQ ID NO: 1096080 - protein, 9 aa, Homo Sapiens
TEHEKDFLW

SEQ ID NO: 1096081 - protein, 9 aa, Homo Sapiens
IQGSQPFQE

SEQ ID NO: 1096082 - protein, 9 aa, Homo Sapiens
GTRSSLGAC

SEQ ID NO: 1096083 - protein, 9 aa, Homo Sapiens
ARVLLLPVL

SEQ ID NO: 1096084 - protein, 9 aa, Homo Sapiens
LTRERAAAA

SEQ ID NO: 1096085 - protein, 9 aa, Homo Sapiens
KKRKWGALW

SEQ ID NO: 1096086 - protein, 9 aa, Homo Sapiens
ICLRETYRL

SEQ ID NO: 1096087 - protein, 9 aa, Homo Sapiens
VRAAQKILL

SEQ ID NO: 1096088 - protein, 9 aa, Homo Sapiens
FSWTIRHCT

SEQ ID NO: 1096089 - protein, 9 aa, Homo Sapiens
CLLSGPLLV

SEQ ID NO: 1096090 - protein, 9 aa, Homo Sapiens
PTVHGLLRQ

SEQ ID NO: 1096091 - protein, 9 aa, Homo Sapiens
AVTSRQDPR

SEQ ID NO: 1096092 - protein, 9 aa, Homo Sapiens
AQLCGLKEV

SEQ ID NO: 1096093 - protein, 9 aa, Homo Sapiens
MRNTGSRML

SEQ ID NO: 1096094 - protein, 9 aa, Homo Sapiens
IPHLFLASL

SEQ ID NO: 1096095 - protein, 9 aa, Homo Sapiens
EQGSDRKKE

SEQ ID NO: 1096096 - protein, 9 aa, Homo Sapiens
RGTWTGPSV

SEQ ID NO: 1096097 - protein, 9 aa, Homo Sapiens
NPSRMDHNV

SEQ ID NO: 1096098 - protein, 9 aa, Homo Sapiens
QGSGGNERY

SEQ ID NO: 1096099 - protein, 9 aa, Homo Sapiens
EPDLHLALG

SEQ ID NO: 1096100 - protein, 9 aa, Homo Sapiens
GLLRDAIKW

SEQ ID NO: 1096101 - protein, 9 aa, Homo Sapiens
DLITFLTSI

SEQ ID NO: 1096102 - protein, 9 aa, Homo Sapiens
WPGLWPPPW

SEQ ID NO: 1096103 - protein, 9 aa, Homo Sapiens
KDQVVSLSE

SEQ ID NO: 1096104 - protein, 9 aa, Homo Sapiens
GSLLLLPEG

SEQ ID NO: 1096105 - protein, 9 aa, Homo Sapiens
AMALERCLS

SEQ ID NO: 1096106 - protein, 9 aa, Homo Sapiens
SEYALDLRS

SEQ ID NO: 1096107 - protein, 9 aa, Homo Sapiens
LGAVYTRHA

SEQ ID NO: 1096108 - protein, 9 aa, Homo Sapiens
KLIVNLLCP

SEQ ID NO: 1096109 - protein, 9 aa, Homo Sapiens
QWPTVHGLL

SEQ ID NO: 1096110 - protein, 9 aa, Homo Sapiens
GGRHTAFST

SEQ ID NO: 1096111 - protein, 9 aa, Homo Sapiens
STECSEITT

SEQ ID NO: 1096112 - protein, 9 aa, Homo Sapiens
AAQLCGLKE

SEQ ID NO: 1096113 - protein, 9 aa, Homo Sapiens
SRTSVTASL

SEQ ID NO: 1096114 - protein, 9 aa, Homo Sapiens
LSHLALEQE

SEQ ID NO: 1096115 - protein, 9 aa, Homo Sapiens
AFEENRYKF

SEQ ID NO: 1096116 - protein, 9 aa, Homo Sapiens
RGRKWRSYN

SEQ ID NO: 1096117 - protein, 9 aa, Homo Sapiens
CWDPTPQSP

SEQ ID NO: 1096118 - protein, 9 aa, Homo Sapiens
RVHHLHARL

SEQ ID NO: 1096119 - protein, 9 aa, Homo Sapiens
SRLWAAVAA

SEQ ID NO: 1096120 - protein, 9 aa, Homo Sapiens
DASAPWAKV

SEQ ID NO: 1096121 - protein, 9 aa, Homo Sapiens
SCINDVPPS

SEQ ID NO: 1096122 - protein, 9 aa, Homo Sapiens
KCFSFGSVE

SEQ ID NO: 1096123 - protein, 9 aa, Homo Sapiens
RNLRPLSLQ

SEQ ID NO: 1096124 - protein, 9 aa, Homo Sapiens
RMPACMSAP

SEQ ID NO: 1096125 - protein, 9 aa, Homo Sapiens
LFYQGPGWE

SEQ ID NO: 1096126 - protein, 9 aa, Homo Sapiens
EFWPDHFLE

SEQ ID NO: 1096127 - protein, 9 aa, Homo Sapiens
LLPLPGPAS

SEQ ID NO: 1096128 - protein, 9 aa, Homo Sapiens
VVTVDHSHV

SEQ ID NO: 1096129 - protein, 9 aa, Homo Sapiens
VVLDHHLVT

SEQ ID NO: 1096130 - protein, 9 aa, Homo Sapiens
MRASTPAPC

SEQ ID NO: 1096131 - protein, 9 aa, Homo Sapiens
LTNGIHKDM

SEQ ID NO: 1096132 - protein, 9 aa, Homo Sapiens
QVIFQGIKG

SEQ ID NO: 1096133 - protein, 9 aa, Homo Sapiens
AQLWARARA

SEQ ID NO: 1096134 - protein, 9 aa, Homo Sapiens
LWPNTIYLF

SEQ ID NO: 1096135 - protein, 9 aa, Homo Sapiens
RTRSAWGDW

SEQ ID NO: 1096136 - protein, 9 aa, Homo Sapiens
EKAKAIYFT

SEQ ID NO: 1096137 - protein, 9 aa, Homo Sapiens
ENGSQAMLY

SEQ ID NO: 1096138 - protein, 9 aa, Homo Sapiens
SQVLSLTMS

SEQ ID NO: 1096139 - protein, 9 aa, Homo Sapiens
IDTKNLYLL

SEQ ID NO: 1096140 - protein, 9 aa, Homo Sapiens
EQVPQIDQK

SEQ ID NO: 1096141 - protein, 9 aa, Homo Sapiens
VDGEPNPGV

SEQ ID NO: 1096142 - protein, 9 aa, Homo Sapiens
YIFLQNPQV

SEQ ID NO: 1096143 - protein, 9 aa, Homo Sapiens
NGATLAEDK

SEQ ID NO: 1096144 - protein, 9 aa, Homo Sapiens
NAHHAVYKQ

SEQ ID NO: 1096145 - protein, 9 aa, Homo Sapiens
TPSSSLSGQ

SEQ ID NO: 1096146 - protein, 9 aa, Homo Sapiens
RLMAPVGSV

SEQ ID NO: 1096147 - protein, 9 aa, Homo Sapiens
LRTCHLMPG

SEQ ID NO: 1096148 - protein, 9 aa, Homo Sapiens
RDSYSGPPR

SEQ ID NO: 1096149 - protein, 9 aa, Homo Sapiens
ARHSGRGPE

SEQ ID NO: 1096150 - protein, 9 aa, Homo Sapiens
KRPHSPSCS

SEQ ID NO: 1096151 - protein, 9 aa, Homo Sapiens
KPSLAASLV

SEQ ID NO: 1096152 - protein, 9 aa, Homo Sapiens
ARTSGSIAP

SEQ ID NO: 1096153 - protein, 9 aa, Homo Sapiens
RIHSAGGRH

SEQ ID NO: 1096154 - protein, 9 aa, Homo Sapiens
CPREPRHGR

SEQ ID NO: 1096155 - protein, 9 aa, Homo Sapiens
GHRVNAKMP

SEQ ID NO: 1096156 - protein, 9 aa, Homo Sapiens
CLRLSWARQ

SEQ ID NO: 1096157 - protein, 9 aa, Homo Sapiens
LRQLGKGTE

SEQ ID NO: 1096158 - protein, 9 aa, Homo Sapiens
GVGWWVQNT

SEQ ID NO: 1096159 - protein, 9 aa, Homo Sapiens
QAMANLPYK

SEQ ID NO: 1096160 - protein, 9 aa, Homo Sapiens
RSPPLWTPA

SEQ ID NO: 1096161 - protein, 9 aa, Homo Sapiens
FCISLLREW

SEQ ID NO: 1096162 - protein, 9 aa, Homo Sapiens
EDHCCRSWS

SEQ ID NO: 1096163 - protein, 9 aa, Homo Sapiens
PASRTSVTA

SEQ ID NO: 1096164 - protein, 9 aa, Homo Sapiens
CGGRWRIGG

SEQ ID NO: 1096165 - protein, 9 aa, Homo Sapiens
NWYQASKKR

SEQ ID NO: 1096166 - protein, 9 aa, Homo Sapiens
PKRAVPGSP

SEQ ID NO: 1096167 - protein, 9 aa, Homo Sapiens
VGVGPFGSV

SEQ ID NO: 1096168 - protein, 9 aa, Homo Sapiens
LKQRGEKHQ

SEQ ID NO: 1096169 - protein, 9 aa, Homo Sapiens
DLGALQSPG

SEQ ID NO: 1096170 - protein, 9 aa, Homo Sapiens
HWWRVESDE

SEQ ID NO: 1096171 - protein, 9 aa, Homo Sapiens
ARDASAPWA

SEQ ID NO: 1096172 - protein, 9 aa, Homo Sapiens
VTSRQDPRS

SEQ ID NO: 1096173 - protein, 9 aa, Homo Sapiens
AGEISAYGH

SEQ ID NO: 1096174 - protein, 9 aa, Homo Sapiens
PQCLRLSWA

SEQ ID NO: 1096175 - protein, 9 aa, Homo Sapiens
RYANLEAVN

SEQ ID NO: 1096176 - protein, 9 aa, Homo Sapiens
VTASICNSS

SEQ ID NO: 1096177 - protein, 9 aa, Homo Sapiens
VGTEPDSVE

SEQ ID NO: 1096178 - protein, 9 aa, Homo Sapiens
LARGFRSGA

SEQ ID NO: 1096179 - protein, 9 aa, Homo Sapiens
QVTMHQPVL

SEQ ID NO: 1096180 - protein, 9 aa, Homo Sapiens
PFPGHTLIT

SEQ ID NO: 1096181 - protein, 9 aa, Homo Sapiens
SHFEKAKAI

SEQ ID NO: 1096182 - protein, 9 aa, Homo Sapiens
SVDEIAYHT

SEQ ID NO: 1096183 - protein, 9 aa, Homo Sapiens
PRAKMNQQH

SEQ ID NO: 1096184 - protein, 9 aa, Homo Sapiens
PDISRISQS

SEQ ID NO: 1096185 - protein, 9 aa, Homo Sapiens
SVQSKDFLP

SEQ ID NO: 1096186 - protein, 9 aa, Homo Sapiens
SPCTKLMAK

SEQ ID NO: 1096187 - protein, 9 aa, Homo Sapiens
TIRFTVRTC

SEQ ID NO: 1096188 - protein, 9 aa, Homo Sapiens
ETWGVETLC

SEQ ID NO: 1096189 - protein, 9 aa, Homo Sapiens
ESKPEEASR

SEQ ID NO: 1096190 - protein, 9 aa, Homo Sapiens
QPPAKKNKE

SEQ ID NO: 1096191 - protein, 9 aa, Homo Sapiens
GPHGHTDAT

SEQ ID NO: 1096192 - protein, 9 aa, Homo Sapiens
WVWCMAPTI

SEQ ID NO: 1096193 - protein, 9 aa, Homo Sapiens
GCPEACAPG

SEQ ID NO: 1096194 - protein, 9 aa, Homo Sapiens
AVMPAPTPA

SEQ ID NO: 1096195 - protein, 9 aa, Homo Sapiens
LCPPTPQNQ

SEQ ID NO: 1096196 - protein, 9 aa, Homo Sapiens
LSSTLRILA

SEQ ID NO: 1096197 - protein, 9 aa, Homo Sapiens
SHSEYPMSS

SEQ ID NO: 1096198 - protein, 9 aa, Homo Sapiens
KGDFFPPEC

SEQ ID NO: 1096199 - protein, 9 aa, Homo Sapiens
LHGKTIEIG

SEQ ID NO: 1096200 - protein, 9 aa, Homo Sapiens
GVWVGAQEA

SEQ ID NO: 1096201 - protein, 9 aa, Homo Sapiens
LLSFQQICQ

SEQ ID NO: 1096202 - protein, 9 aa, Homo Sapiens
SANPHAWGR

SEQ ID NO: 1096203 - protein, 9 aa, Homo Sapiens
GAVAGRNSH

SEQ ID NO: 1096204 - protein, 9 aa, Homo Sapiens
PGHRVNAKM

SEQ ID NO: 1096205 - protein, 9 aa, Homo Sapiens
PQPGGVLLR

SEQ ID NO: 1096206 - protein, 9 aa, Homo Sapiens
SELPKPSIS

SEQ ID NO: 1096207 - protein, 9 aa, Homo Sapiens
VVGAWAAVP

SEQ ID NO: 1096208 - protein, 9 aa, Homo Sapiens
PPPGWLPRL

SEQ ID NO: 1096209 - protein, 9 aa, Homo Sapiens
YIVGRAVQK

SEQ ID NO: 1096210 - protein, 9 aa, Homo Sapiens
QPSRPTGRT

SEQ ID NO: 1096211 - protein, 9 aa, Homo Sapiens
VGSVMSCSL

SEQ ID NO: 1096212 - protein, 9 aa, Homo Sapiens
EMEVSPRGR

SEQ ID NO: 1096213 - protein, 9 aa, Homo Sapiens
NNTTVRLHT

SEQ ID NO: 1096214 - protein, 9 aa, Homo Sapiens
PHLMCGTLA

SEQ ID NO: 1096215 - protein, 9 aa, Homo Sapiens
AAAARNPKS

SEQ ID NO: 1096216 - protein, 9 aa, Homo Sapiens
LDGALLACT

SEQ ID NO: 1096217 - protein, 9 aa, Homo Sapiens
QPVTLQPVT

SEQ ID NO: 1096218 - protein, 9 aa, Homo Sapiens
DLNPAKWLL

SEQ ID NO: 1096219 - protein, 9 aa, Homo Sapiens
AVAVMPAPT

SEQ ID NO: 1096220 - protein, 9 aa, Homo Sapiens
TLLRPGGTS

SEQ ID NO: 1096221 - protein, 9 aa, Homo Sapiens
GACRPACTC

SEQ ID NO: 1096222 - protein, 9 aa, Homo Sapiens
CICTVLCIW

SEQ ID NO: 1096223 - protein, 9 aa, Homo Sapiens
VLLRFLPRV

SEQ ID NO: 1096224 - protein, 9 aa, Homo Sapiens
AHHAQEKYE

SEQ ID NO: 1096225 - protein, 9 aa, Homo Sapiens
QDYAHHAQE

SEQ ID NO: 1096226 - protein, 9 aa, Homo Sapiens
VHDGAARGC

SEQ ID NO: 1096227 - protein, 9 aa, Homo Sapiens
PSHHPSAFK

SEQ ID NO: 1096228 - protein, 9 aa, Homo Sapiens
APTIPSFCW

SEQ ID NO: 1096229 - protein, 9 aa, Homo Sapiens
SRCGSATGP

SEQ ID NO: 1096230 - protein, 9 aa, Homo Sapiens
ASGNRVIRM

SEQ ID NO: 1096231 - protein, 9 aa, Homo Sapiens
RQSPKLVLI

SEQ ID NO: 1096232 - protein, 9 aa, Homo Sapiens
PELLCVWVS

SEQ ID NO: 1096233 - protein, 9 aa, Homo Sapiens
GRPIKRSLE

SEQ ID NO: 1096234 - protein, 9 aa, Homo Sapiens
VAPVDMAAF

SEQ ID NO: 1096235 - protein, 9 aa, Homo Sapiens
SQTEILETV

SEQ ID NO: 1096236 - protein, 9 aa, Homo Sapiens
HQVSAGAPS

SEQ ID NO: 1096237 - protein, 9 aa, Homo Sapiens
REGRARVLL

SEQ ID NO: 1096238 - protein, 9 aa, Homo Sapiens
LARVFSHAA

SEQ ID NO: 1096239 - protein, 9 aa, Homo Sapiens
FYETDCYIV

SEQ ID NO: 1096240 - protein, 9 aa, Homo Sapiens
SCWTWMTWC

SEQ ID NO: 1096241 - protein, 9 aa, Homo Sapiens
IQNSLLPFA

SEQ ID NO: 1096242 - protein, 9 aa, Homo Sapiens
AQMLSRRKL

SEQ ID NO: 1096243 - protein, 9 aa, Homo Sapiens
SCFQRRKRR

SEQ ID NO: 1096244 - protein, 9 aa, Homo Sapiens
PQNIGAGRP

SEQ ID NO: 1096245 - protein, 9 aa, Homo Sapiens
YRGVRAEVF

SEQ ID NO: 1096246 - protein, 9 aa, Homo Sapiens
EDNHHLYRF

SEQ ID NO: 1096247 - protein, 9 aa, Homo Sapiens
LKTAQIAKK

SEQ ID NO: 1096248 - protein, 9 aa, Homo Sapiens
ITLNDLCLV

SEQ ID NO: 1096249 - protein, 9 aa, Homo Sapiens
TKYLWLPYP

SEQ ID NO: 1096250 - protein, 9 aa, Homo Sapiens
PTWISENPQ

SEQ ID NO: 1096251 - protein, 9 aa, Homo Sapiens
YPESKPEEA

SEQ ID NO: 1096252 - protein, 9 aa, Homo Sapiens
GCLLSGPLL

SEQ ID NO: 1096253 - protein, 9 aa, Homo Sapiens
TVPTAIGQL

SEQ ID NO: 1096254 - protein, 9 aa, Homo Sapiens
FPELLCVWV

SEQ ID NO: 1096255 - protein, 9 aa, Homo Sapiens
PCKILFTNW

SEQ ID NO: 1096256 - protein, 9 aa, Homo Sapiens
EALFFIREG

SEQ ID NO: 1096257 - protein, 9 aa, Homo Sapiens
LEYYPLLST

SEQ ID NO: 1096258 - protein, 9 aa, Homo Sapiens
VFDNFFYQE

SEQ ID NO: 1096259 - protein, 9 aa, Homo Sapiens
CETYISGTN

SEQ ID NO: 1096260 - protein, 9 aa, Homo Sapiens
WGILLMILH

SEQ ID NO: 1096261 - protein, 9 aa, Homo Sapiens
CMPGGASTI

SEQ ID NO: 1096262 - protein, 9 aa, Homo Sapiens
LNDIVAVPA

SEQ ID NO: 1096263 - protein, 9 aa, Homo Sapiens
EEATVVLEI

SEQ ID NO: 1096264 - protein, 9 aa, Homo Sapiens
FHHLAFNQP

SEQ ID NO: 1096265 - protein, 9 aa, Homo Sapiens
AAGESAGCS

SEQ ID NO: 1096266 - protein, 9 aa, Homo Sapiens
RGPVRLLLG

SEQ ID NO: 1096267 - protein, 9 aa, Homo Sapiens
EGLPRPWSR

SEQ ID NO: 1096268 - protein, 9 aa, Homo Sapiens
LFPSTMQQH

SEQ ID NO: 1096269 - protein, 9 aa, Homo Sapiens
ARQSYVIPL

SEQ ID NO: 1096270 - protein, 9 aa, Homo Sapiens
KMTASQRSK

SEQ ID NO: 1096271 - protein, 9 aa, Homo Sapiens
SPCSPTTPS

SEQ ID NO: 1096272 - protein, 9 aa, Homo Sapiens
QQDPGGVPR

SEQ ID NO: 1096273 - protein, 9 aa, Homo Sapiens
SPGTQGPLH

SEQ ID NO: 1096274 - protein, 9 aa, Homo Sapiens
KACTCFVSD

SEQ ID NO: 1096275 - protein, 9 aa, Homo Sapiens
CLPKDLSLS

SEQ ID NO: 1096276 - protein, 9 aa, Homo Sapiens
AVMRWGCHH

SEQ ID NO: 1096277 - protein, 9 aa, Homo Sapiens
VSASLLATQ

SEQ ID NO: 1096278 - protein, 9 aa, Homo Sapiens
AGAAIAAPD

SEQ ID NO: 1096279 - protein, 9 aa, Homo Sapiens
FAALVIMWQ

SEQ ID NO: 1096280 - protein, 9 aa, Homo Sapiens
KQGLGPPAP

SEQ ID NO: 1096281 - protein, 9 aa, Homo Sapiens
RRCCLRTSC

SEQ ID NO: 1096282 - protein, 9 aa, Homo Sapiens
GVAVDAQVG

SEQ ID NO: 1096283 - protein, 9 aa, Homo Sapiens
EIAEELCQC

SEQ ID NO: 1096284 - protein, 9 aa, Homo Sapiens
AGAGAAIAA

SEQ ID NO: 1096285 - protein, 9 aa, Homo Sapiens
AAVGSLGQF

SEQ ID NO: 1096286 - protein, 9 aa, Homo Sapiens
MSPKIEVAK

SEQ ID NO: 1096287 - protein, 9 aa, Homo Sapiens
RSSLGACPT

SEQ ID NO: 1096288 - protein, 9 aa, Homo Sapiens
PTPSASTHT

SEQ ID NO: 1096289 - protein, 9 aa, Homo Sapiens
KRKTAQKLT

SEQ ID NO: 1096290 - protein, 9 aa, Homo Sapiens
RGWTLGADR

SEQ ID NO: 1096291 - protein, 9 aa, Homo Sapiens
PQLCNSKED

SEQ ID NO: 1096292 - protein, 9 aa, Homo Sapiens
HLAVFLLFL

SEQ ID NO: 1096293 - protein, 9 aa, Homo Sapiens
QCLEMDVEK

SEQ ID NO: 1096294 - protein, 9 aa, Homo Sapiens
DMCTIATAL

SEQ ID NO: 1096295 - protein, 9 aa, Homo Sapiens
ERLPLSCGH

SEQ ID NO: 1096296 - protein, 9 aa, Homo Sapiens
KHSHHCSRC

SEQ ID NO: 1096297 - protein, 9 aa, Homo Sapiens
LGAQGFGAS

SEQ ID NO: 1096298 - protein, 9 aa, Homo Sapiens
ATVKEKLSS

SEQ ID NO: 1096299 - protein, 9 aa, Homo Sapiens
MVLVATGLP

SEQ ID NO: 1096300 - protein, 9 aa, Homo Sapiens
GHPNYKYRP

SEQ ID NO: 1096301 - protein, 9 aa, Homo Sapiens
PPSNSTNPE

SEQ ID NO: 1096302 - protein, 9 aa, Homo Sapiens
ENERLPRDW

SEQ ID NO: 1096303 - protein, 9 aa, Homo Sapiens
PPLPLTSAS

SEQ ID NO: 1096304 - protein, 9 aa, Homo Sapiens
LCKEVETRQ

SEQ ID NO: 1096305 - protein, 9 aa, Homo Sapiens
SFNSAVQKA

SEQ ID NO: 1096306 - protein, 9 aa, Homo Sapiens
MVSEGGARG

SEQ ID NO: 1096307 - protein, 9 aa, Homo Sapiens
PGCPFQAPA

SEQ ID NO: 1096308 - protein, 9 aa, Homo Sapiens
HSTGPPSNS

SEQ ID NO: 1096309 - protein, 9 aa, Homo Sapiens
SPTSSPSQV

SEQ ID NO: 1096310 - protein, 9 aa, Homo Sapiens
DTPQPSLPG

SEQ ID NO: 1096311 - protein, 9 aa, Homo Sapiens
GRWGPALSR

SEQ ID NO: 1096312 - protein, 9 aa, Homo Sapiens
LHLALGHAQ

SEQ ID NO: 1096313 - protein, 9 aa, Homo Sapiens
CCRSWSSDS

SEQ ID NO: 1096314 - protein, 9 aa, Homo Sapiens
QLKVRLSTG

SEQ ID NO: 1096315 - protein, 9 aa, Homo Sapiens
AQGVRGRAP

SEQ ID NO: 1096316 - protein, 9 aa, Homo Sapiens
PRRATMTCT

SEQ ID NO: 1096317 - protein, 9 aa, Homo Sapiens
RLKNPNLIQ

SEQ ID NO: 1096318 - protein, 9 aa, Homo Sapiens
IGAKFKLYI

SEQ ID NO: 1096319 - protein, 9 aa, Homo Sapiens
REWKVKFPE

SEQ ID NO: 1096320 - protein, 9 aa, Homo Sapiens
LGMAPALRG

SEQ ID NO: 1096321 - protein, 9 aa, Homo Sapiens
LEPDLHLAL

SEQ ID NO: 1096322 - protein, 9 aa, Homo Sapiens
KGNSGRPGL

SEQ ID NO: 1096323 - protein, 9 aa, Homo Sapiens
TKLEHPGIV

SEQ ID NO: 1096324 - protein, 9 aa, Homo Sapiens
TQPTQGYAQ

SEQ ID NO: 1096325 - protein, 9 aa, Homo Sapiens
VDAPGRGEG

SEQ ID NO: 1096326 - protein, 9 aa, Homo Sapiens
TQHGHEAVV

SEQ ID NO: 1096327 - protein, 9 aa, Homo Sapiens
GPAACQLCC

SEQ ID NO: 1096328 - protein, 9 aa, Homo Sapiens
TRSEPLRKK

SEQ ID NO: 1096329 - protein, 9 aa, Homo Sapiens
QVIRCPLQI

SEQ ID NO: 1096330 - protein, 9 aa, Homo Sapiens
SEGLLSFPV

SEQ ID NO: 1096331 - protein, 9 aa, Homo Sapiens
PHSPSCSPS

SEQ ID NO: 1096332 - protein, 9 aa, Homo Sapiens
RLAAASGPC

SEQ ID NO: 1096333 - protein, 9 aa, Homo Sapiens
LLFTEHFHF

SEQ ID NO: 1096334 - protein, 9 aa, Homo Sapiens
IHKDMIAPE

SEQ ID NO: 1096335 - protein, 9 aa, Homo Sapiens
ARCGRCPQV

SEQ ID NO: 1096336 - protein, 9 aa, Homo Sapiens
LFLGPLAPA

SEQ ID NO: 1096337 - protein, 9 aa, Homo Sapiens
VDEIAYHTS

SEQ ID NO: 1096338 - protein, 9 aa, Homo Sapiens
PPRKHSLRL

SEQ ID NO: 1096339 - protein, 9 aa, Homo Sapiens
NSVEKEKKT

SEQ ID NO: 1096340 - protein, 9 aa, Homo Sapiens
ENTEALLAD

SEQ ID NO: 1096341 - protein, 9 aa, Homo Sapiens
GTRWPGPFC

SEQ ID NO: 1096342 - protein, 9 aa, Homo Sapiens
HGRPAWPRE

SEQ ID NO: 1096343 - protein, 9 aa, Homo Sapiens
IPSGLTLDY

SEQ ID NO: 1096344 - protein, 9 aa, Homo Sapiens
LLETLGENV

SEQ ID NO: 1096345 - protein, 9 aa, Homo Sapiens
HEPFLQWLM

SEQ ID NO: 1096346 - protein, 9 aa, Homo Sapiens
CVSQLAFSC

SEQ ID NO: 1096347 - protein, 9 aa, Homo Sapiens
QSDKECTSA

SEQ ID NO: 1096348 - protein, 9 aa, Homo Sapiens
TGSRKASVV

SEQ ID NO: 1096349 - protein, 9 aa, Homo Sapiens
CVQALHVHL

SEQ ID NO: 1096350 - protein, 9 aa, Homo Sapiens
RSCSASRRT

SEQ ID NO: 1096351 - protein, 9 aa, Homo Sapiens
ALVAILLYV

SEQ ID NO: 1096352 - protein, 9 aa, Homo Sapiens
PGTTYCVCV

SEQ ID NO: 1096353 - protein, 9 aa, Homo Sapiens
SAASSAGSS

SEQ ID NO: 1096354 - protein, 9 aa, Homo Sapiens
ILTPYRDDC

SEQ ID NO: 1096355 - protein, 9 aa, Homo Sapiens
QPGFGGSLR

SEQ ID NO: 1096356 - protein, 9 aa, Homo Sapiens
GMYFLNGSF

SEQ ID NO: 1096357 - protein, 9 aa, Homo Sapiens
RQQHNAENA

SEQ ID NO: 1096358 - protein, 9 aa, Homo Sapiens
PARLGQPTS

SEQ ID NO: 1096359 - protein, 9 aa, Homo Sapiens
QTKGKGGRE

SEQ ID NO: 1096360 - protein, 9 aa, Homo Sapiens
PFSTVCRES

SEQ ID NO: 1096361 - protein, 9 aa, Homo Sapiens
RAPRSWPRP

SEQ ID NO: 1096362 - protein, 9 aa, Homo Sapiens
TGYVWPVCL

SEQ ID NO: 1096363 - protein, 9 aa, Homo Sapiens
PLSDSPPLQ

SEQ ID NO: 1096364 - protein, 9 aa, Homo Sapiens
PKIEVARMW

SEQ ID NO: 1096365 - protein, 9 aa, Homo Sapiens
SRGFTLPSN

SEQ ID NO: 1096366 - protein, 9 aa, Homo Sapiens
TGLPSGAIS

SEQ ID NO: 1096367 - protein, 9 aa, Homo Sapiens
RPRVALIVA

SEQ ID NO: 1096368 - protein, 9 aa, Homo Sapiens
GRHTAFSTC

SEQ ID NO: 1096369 - protein, 9 aa, Homo Sapiens
NESCEKRAC

SEQ ID NO: 1096370 - protein, 9 aa, Homo Sapiens
WDRVLEELH

SEQ ID NO: 1096371 - protein, 9 aa, Homo Sapiens
VGDVGLGVQ

SEQ ID NO: 1096372 - protein, 9 aa, Homo Sapiens
SPAAIPTQR

SEQ ID NO: 1096373 - protein, 9 aa, Homo Sapiens
LNGLLFKGR

SEQ ID NO: 1096374 - protein, 9 aa, Homo Sapiens
TCCWCMPGG

SEQ ID NO: 1096375 - protein, 9 aa, Homo Sapiens
LGVAARHSG

SEQ ID NO: 1096376 - protein, 9 aa, Homo Sapiens
DCWVQDRNL

SEQ ID NO: 1096377 - protein, 9 aa, Homo Sapiens
GEQPHAGEA

SEQ ID NO: 1096378 - protein, 9 aa, Homo Sapiens
DTVNTTSRM

SEQ ID NO: 1096379 - protein, 9 aa, Homo Sapiens
QVVRAREAL

SEQ ID NO: 1096380 - protein, 9 aa, Homo Sapiens
ADAKGSTTR

SEQ ID NO: 1096381 - protein, 9 aa, Homo Sapiens
QIVLWREYH

SEQ ID NO: 1096382 - protein, 9 aa, Homo Sapiens
LHTAVPPHE

SEQ ID NO: 1096383 - protein, 9 aa, Homo Sapiens
RIRTAEKFY

SEQ ID NO: 1096384 - protein, 9 aa, Homo Sapiens
AEVFLGLGL

SEQ ID NO: 1096385 - protein, 9 aa, Homo Sapiens
MITAALCRA

SEQ ID NO: 1096386 - protein, 9 aa, Homo Sapiens
KIKRHMPLS

SEQ ID NO: 1096387 - protein, 9 aa, Homo Sapiens
LCPREPRHG

SEQ ID NO: 1096388 - protein, 9 aa, Homo Sapiens
LILVSVSRD

SEQ ID NO: 1096389 - protein, 9 aa, Homo Sapiens
SAYGHGLVS

SEQ ID NO: 1096390 - protein, 9 aa, Homo Sapiens
SPINTFTMR

SEQ ID NO: 1096391 - protein, 9 aa, Homo Sapiens
KLNPQQALL

SEQ ID NO: 1096392 - protein, 9 aa, Homo Sapiens
CIFIRNCIL

SEQ ID NO: 1096393 - protein, 9 aa, Homo Sapiens
VVNIFIMAF

SEQ ID NO: 1096394 - protein, 9 aa, Homo Sapiens
VVDQHPINY

SEQ ID NO: 1096395 - protein, 9 aa, Homo Sapiens
SNSRKFGWQ

SEQ ID NO: 1096396 - protein, 9 aa, Homo Sapiens
GTCAVGVEY

SEQ ID NO: 1096397 - protein, 9 aa, Homo Sapiens
RSVLLAAFW

SEQ ID NO: 1096398 - protein, 9 aa, Homo Sapiens
PAPWLPMRS

SEQ ID NO: 1096399 - protein, 9 aa, Homo Sapiens
IISLALHTD

SEQ ID NO: 1096400 - protein, 9 aa, Homo Sapiens
LYMTVLEQL

SEQ ID NO: 1096401 - protein, 9 aa, Homo Sapiens
APPFKPQVT

SEQ ID NO: 1096402 - protein, 9 aa, Homo Sapiens
AILHEKREI

SEQ ID NO: 1096403 - protein, 9 aa, Homo Sapiens
ETIYIVGGV

SEQ ID NO: 1096404 - protein, 9 aa, Homo Sapiens
ELGITQCKE

SEQ ID NO: 1096405 - protein, 9 aa, Homo Sapiens
MLKQNLNLL

SEQ ID NO: 1096406 - protein, 9 aa, Homo Sapiens
YLVNLNKND

SEQ ID NO: 1096407 - protein, 9 aa, Homo Sapiens
STISCPRPS

SEQ ID NO: 1096408 - protein, 9 aa, Homo Sapiens
ILMHWWRVE

SEQ ID NO: 1096409 - protein, 9 aa, Homo Sapiens
SLAPTAAGS

SEQ ID NO: 1096410 - protein, 9 aa, Homo Sapiens
VTASLSSAR

SEQ ID NO: 1096411 - protein, 9 aa, Homo Sapiens
GSFNTKTTT

SEQ ID NO: 1096412 - protein, 9 aa, Homo Sapiens
TILIKDEAR

SEQ ID NO: 1096413 - protein, 9 aa, Homo Sapiens
VHCQVGISR

SEQ ID NO: 1096414 - protein, 9 aa, Homo Sapiens
EISAYGHGL

SEQ ID NO: 1096415 - protein, 9 aa, Homo Sapiens
YCSVDYNMP

SEQ ID NO: 1096416 - protein, 9 aa, Homo Sapiens
FCMSSTRTT

SEQ ID NO: 1096417 - protein, 9 aa, Homo Sapiens
GRREPVEPG

SEQ ID NO: 1096418 - protein, 9 aa, Homo Sapiens
RGGHPQPRP

SEQ ID NO: 1096419 - protein, 9 aa, Homo Sapiens
KTLESLSKH

SEQ ID NO: 1096420 - protein, 9 aa, Homo Sapiens
IVSRVSSVL

SEQ ID NO: 1096421 - protein, 9 aa, Homo Sapiens
PETRAHLAL

SEQ ID NO: 1096422 - protein, 9 aa, Homo Sapiens
EEEFQDESE

SEQ ID NO: 1096423 - protein, 9 aa, Homo Sapiens
LFELVARVV

SEQ ID NO: 1096424 - protein, 9 aa, Homo Sapiens
LKCGDLEEL

SEQ ID NO: 1096425 - protein, 9 aa, Homo Sapiens
RKFRRGPEP

SEQ ID NO: 1096426 - protein, 9 aa, Homo Sapiens
FRSEPTAGA

SEQ ID NO: 1096427 - protein, 9 aa, Homo Sapiens
DRTGLTTVS

SEQ ID NO: 1096428 - protein, 9 aa, Homo Sapiens
HNRVAPLLR

SEQ ID NO: 1096429 - protein, 9 aa, Homo Sapiens
DWDRFDRER

SEQ ID NO: 1096430 - protein, 9 aa, Homo Sapiens
SRLAAASGP

SEQ ID NO: 1096431 - protein, 9 aa, Homo Sapiens
KSYRMIFSC

SEQ ID NO: 1096432 - protein, 9 aa, Homo Sapiens
GKGVFCTSH

SEQ ID NO: 1096433 - protein, 9 aa, Homo Sapiens
GVLSHLALE

SEQ ID NO: 1096434 - protein, 9 aa, Homo Sapiens
PAGGQRSHV

SEQ ID NO: 1096435 - protein, 9 aa, Homo Sapiens
PAAVSPPRG

SEQ ID NO: 1096436 - protein, 9 aa, Homo Sapiens
AQSIGQVFS

SEQ ID NO: 1096437 - protein, 9 aa, Homo Sapiens
FCCRVQDTG

SEQ ID NO: 1096438 - protein, 9 aa, Homo Sapiens
TSVLSFTTA

SEQ ID NO: 1096439 - protein, 9 aa, Homo Sapiens
NHTLQRLQH

SEQ ID NO: 1096440 - protein, 9 aa, Homo Sapiens
WMLMTALSY

SEQ ID NO: 1096441 - protein, 9 aa, Homo Sapiens
WGTLVRRAL

SEQ ID NO: 1096442 - protein, 9 aa, Homo Sapiens
PQVLSAGAA

SEQ ID NO: 1096443 - protein, 9 aa, Homo Sapiens
VTVDHSHVF

SEQ ID NO: 1096444 - protein, 9 aa, Homo Sapiens
ATGHLLFPG

SEQ ID NO: 1096445 - protein, 9 aa, Homo Sapiens
CSWWWTQAT

SEQ ID NO: 1096446 - protein, 9 aa, Homo Sapiens
SPRISELTG

SEQ ID NO: 1096447 - protein, 9 aa, Homo Sapiens
AHVEALGRA

SEQ ID NO: 1096448 - protein, 9 aa, Homo Sapiens
RQLGKGTEV

SEQ ID NO: 1096449 - protein, 9 aa, Homo Sapiens
HHYYRRSPH

SEQ ID NO: 1096450 - protein, 9 aa, Homo Sapiens
NKMCQQLKG

SEQ ID NO: 1096451 - protein, 9 aa, Homo Sapiens
GVIDYDWDR

SEQ ID NO: 1096452 - protein, 9 aa, Homo Sapiens
KQAAKNGSV

SEQ ID NO: 1096453 - protein, 9 aa, Homo Sapiens
LSDFITPLH

SEQ ID NO: 1096454 - protein, 9 aa, Homo Sapiens
LDGSQRPPR

SEQ ID NO: 1096455 - protein, 9 aa, Homo Sapiens
CPSGYMMNS

SEQ ID NO: 1096456 - protein, 9 aa, Homo Sapiens
VQLENMEEA

SEQ ID NO: 1096457 - protein, 9 aa, Homo Sapiens
LCSSSTKSS

SEQ ID NO: 1096458 - protein, 9 aa, Homo Sapiens
GPRCPPSPR

SEQ ID NO: 1096459 - protein, 9 aa, Homo Sapiens
DGPRSSEGL

SEQ ID NO: 1096460 - protein, 9 aa, Homo Sapiens
ARLSYLLTC

SEQ ID NO: 1096461 - protein, 9 aa, Homo Sapiens
AVSIAQDDT

SEQ ID NO: 1096462 - protein, 9 aa, Homo Sapiens
PAGMEDPAI

SEQ ID NO: 1096463 - protein, 9 aa, Homo Sapiens
AARTSGSIA

SEQ ID NO: 1096464 - protein, 9 aa, Homo Sapiens
ALLACTAPR

SEQ ID NO: 1096465 - protein, 9 aa, Homo Sapiens
RLHMSRIHR

SEQ ID NO: 1096466 - protein, 9 aa, Homo Sapiens
WCEGEHPRC

SEQ ID NO: 1096467 - protein, 9 aa, Homo Sapiens
ITISAVSSA

SEQ ID NO: 1096468 - protein, 9 aa, Homo Sapiens
ESSQPKPAV

SEQ ID NO: 1096469 - protein, 9 aa, Homo Sapiens
RVASILGII

SEQ ID NO: 1096470 - protein, 9 aa, Homo Sapiens
EAWWQRRKQ

SEQ ID NO: 1096471 - protein, 9 aa, Homo Sapiens
SLGQFLQVS

SEQ ID NO: 1096472 - protein, 9 aa, Homo Sapiens
ADWPGDHQE

SEQ ID NO: 1096473 - protein, 9 aa, Homo Sapiens
EWSPHRPIL

SEQ ID NO: 1096474 - protein, 9 aa, Homo Sapiens
VPLAITISL

SEQ ID NO: 1096475 - protein, 9 aa, Homo Sapiens
KSSYSRYSA

SEQ ID NO: 1096476 - protein, 9 aa, Homo Sapiens
GQRCRCVCL

SEQ ID NO: 1096477 - protein, 9 aa, Homo Sapiens
DLGTVAGAT

SEQ ID NO: 1096478 - protein, 9 aa, Homo Sapiens
QALHVHLCC

SEQ ID NO: 1096479 - protein, 9 aa, Homo Sapiens
QLAFSCDLL

SEQ ID NO: 1096480 - protein, 9 aa, Homo Sapiens
KVFVPDYMR

SEQ ID NO: 1096481 - protein, 9 aa, Homo Sapiens
PSQPPSPSS

SEQ ID NO: 1096482 - protein, 9 aa, Homo Sapiens
LLADPALPV

SEQ ID NO: 1096483 - protein, 9 aa, Homo Sapiens
LMPCGVPSG

SEQ ID NO: 1096484 - protein, 9 aa, Homo Sapiens
WSRNVASRM

SEQ ID NO: 1096485 - protein, 9 aa, Homo Sapiens
VAVAAAAAA

SEQ ID NO: 1096486 - protein, 9 aa, Homo Sapiens
APDPPPRPG

SEQ ID NO: 1096487 - protein, 9 aa, Homo Sapiens
ASAQLWARA

SEQ ID NO: 1096488 - protein, 9 aa, Homo Sapiens
LRVQHMQGH

SEQ ID NO: 1096489 - protein, 9 aa, Homo Sapiens
SSLPKAIMT

SEQ ID NO: 1096490 - protein, 9 aa, Homo Sapiens
EEQAGGPPR

SEQ ID NO: 1096491 - protein, 9 aa, Homo Sapiens
LCRAWGDIS

SEQ ID NO: 1096492 - protein, 9 aa, Homo Sapiens
DKGYWIAEG

SEQ ID NO: 1096493 - protein, 9 aa, Homo Sapiens
HLDFSPYWM

SEQ ID NO: 1096494 - protein, 9 aa, Homo Sapiens
RGRDSYSGP

SEQ ID NO: 1096495 - protein, 9 aa, Homo Sapiens
KHGTMPIAI

SEQ ID NO: 1096496 - protein, 9 aa, Homo Sapiens
QELIDSSPL

SEQ ID NO: 1096497 - protein, 9 aa, Homo Sapiens
EVAKMGTPR

SEQ ID NO: 1096498 - protein, 9 aa, Homo Sapiens
HVLEEVIRE

SEQ ID NO: 1096499 - protein, 9 aa, Homo Sapiens
GPLRGWRAR

SEQ ID NO: 1096500 - protein, 9 aa, Homo Sapiens
PPADDDDSE

SEQ ID NO: 1096501 - protein, 9 aa, Homo Sapiens
ASVPRGAWA

SEQ ID NO: 1096502 - protein, 9 aa, Homo Sapiens
VSLEAQHHI

SEQ ID NO: 1096503 - protein, 9 aa, Homo Sapiens
AVQEVADGG

SEQ ID NO: 1096504 - protein, 9 aa, Homo Sapiens
QWFQVDFGN

SEQ ID NO: 1096505 - protein, 9 aa, Homo Sapiens
RSPCPPMPT

SEQ ID NO: 1096506 - protein, 9 aa, Homo Sapiens
DSPPLQDGS

SEQ ID NO: 1096507 - protein, 9 aa, Homo Sapiens
MRPKRPHQI

SEQ ID NO: 1096508 - protein, 9 aa, Homo Sapiens
NNSRKKKAD

SEQ ID NO: 1096509 - protein, 9 aa, Homo Sapiens
VEVDTKVNS

SEQ ID NO: 1096510 - protein, 9 aa, Homo Sapiens
APPRGIPDK

SEQ ID NO: 1096511 - protein, 9 aa, Homo Sapiens
AAGRWGPAL

SEQ ID NO: 1096512 - protein, 9 aa, Homo Sapiens
DYSLRVALH

SEQ ID NO: 1096513 - protein, 9 aa, Homo Sapiens
FYCDVPQAI

SEQ ID NO: 1096514 - protein, 9 aa, Homo Sapiens
RKWRSYNVH

SEQ ID NO: 1096515 - protein, 9 aa, Homo Sapiens
DWVASPPTR

SEQ ID NO: 1096516 - protein, 9 aa, Homo Sapiens
HLMPGPDSS

SEQ ID NO: 1096517 - protein, 9 aa, Homo Sapiens
PRPGSPRSS

SEQ ID NO: 1096518 - protein, 9 aa, Homo Sapiens
QLHHGGRQL

SEQ ID NO: 1096519 - protein, 9 aa, Homo Sapiens
PSGSASLMI

SEQ ID NO: 1096520 - protein, 9 aa, Homo Sapiens
NAPFCTRLN

SEQ ID NO: 1096521 - protein, 9 aa, Homo Sapiens
RPSTPASPG

SEQ ID NO: 1096522 - protein, 9 aa, Homo Sapiens
SRGTWLGRP

SEQ ID NO: 1096523 - protein, 9 aa, Homo Sapiens
EEYLERYFE

SEQ ID NO: 1096524 - protein, 9 aa, Homo Sapiens
SLRVLRGCW

SEQ ID NO: 1096525 - protein, 9 aa, Homo Sapiens
KLSENFSQH

SEQ ID NO: 1096526 - protein, 9 aa, Homo Sapiens
RGPRNIQLS

SEQ ID NO: 1096527 - protein, 9 aa, Homo Sapiens
ISGPNPVVL

SEQ ID NO: 1096528 - protein, 9 aa, Homo Sapiens
SVDQSRRAQ

SEQ ID NO: 1096529 - protein, 9 aa, Homo Sapiens
YMHNKHELT

SEQ ID NO: 1096530 - protein, 9 aa, Homo Sapiens
ESAPGLIIT

SEQ ID NO: 1096531 - protein, 9 aa, Homo Sapiens
LKEDLLYLR

SEQ ID NO: 1096532 - protein, 9 aa, Homo Sapiens
AEEAAASRL

SEQ ID NO: 1096533 - protein, 9 aa, Homo Sapiens
RQKVSSLFL

SEQ ID NO: 1096534 - protein, 9 aa, Homo Sapiens
LDAVGMDQQ

SEQ ID NO: 1096535 - protein, 9 aa, Homo Sapiens
WTPGRRGGT

SEQ ID NO: 1096536 - protein, 9 aa, Homo Sapiens
RQGGSPVGD

SEQ ID NO: 1096537 - protein, 9 aa, Homo Sapiens
QCSFFDKHI

SEQ ID NO: 1096538 - protein, 9 aa, Homo Sapiens
KATSPHLMC

SEQ ID NO: 1096539 - protein, 9 aa, Homo Sapiens
AGSPRPGPR

SEQ ID NO: 1096540 - protein, 9 aa, Homo Sapiens
LVGGQVGHG

SEQ ID NO: 1096541 - protein, 9 aa, Homo Sapiens
SASPTSSPS

SEQ ID NO: 1096542 - protein, 9 aa, Homo Sapiens
WGQTDLTVL

SEQ ID NO: 1096543 - protein, 9 aa, Homo Sapiens
ARRVPSGGL

SEQ ID NO: 1096544 - protein, 9 aa, Homo Sapiens
QPAPPPPLL

SEQ ID NO: 1096545 - protein, 9 aa, Homo Sapiens
LKYISKHHA

SEQ ID NO: 1096546 - protein, 9 aa, Homo Sapiens
LQREDLLAR

SEQ ID NO: 1096547 - protein, 9 aa, Homo Sapiens
MDMMIANSH

SEQ ID NO: 1096548 - protein, 9 aa, Homo Sapiens
EAMKIMDHI

SEQ ID NO: 1096549 - protein, 9 aa, Homo Sapiens
TTLLRPGGT

SEQ ID NO: 1096550 - protein, 9 aa, Homo Sapiens
HLMLEKHVQ

SEQ ID NO: 1096551 - protein, 9 aa, Homo Sapiens
REQHFYESL

SEQ ID NO: 1096552 - protein, 9 aa, Homo Sapiens
CKPLFYTIN

SEQ ID NO: 1096553 - protein, 9 aa, Homo Sapiens
IDQGFDPAG

SEQ ID NO: 1096554 - protein, 9 aa, Homo Sapiens
GLGLQLALF

SEQ ID NO: 1096555 - protein, 9 aa, Homo Sapiens
PTLGRVPHQ

SEQ ID NO: 1096556 - protein, 9 aa, Homo Sapiens
ILVSVSRDK

SEQ ID NO: 1096557 - protein, 9 aa, Homo Sapiens
GEGAAEPPG

SEQ ID NO: 1096558 - protein, 9 aa, Homo Sapiens
AAAVAVAAV

SEQ ID NO: 1096559 - protein, 9 aa, Homo Sapiens
TKCYMPPEV

SEQ ID NO: 1096560 - protein, 9 aa, Homo Sapiens
CHHRMPSPH

SEQ ID NO: 1096561 - protein, 9 aa, Homo Sapiens
TNGIHKDMI

SEQ ID NO: 1096562 - protein, 9 aa, Homo Sapiens
LGENVFSSP

SEQ ID NO: 1096563 - protein, 9 aa, Homo Sapiens
SIFYLCIVP

SEQ ID NO: 1096564 - protein, 9 aa, Homo Sapiens
FKRKAKGEE

SEQ ID NO: 1096565 - protein, 9 aa, Homo Sapiens
FFSDSFNSA

SEQ ID NO: 1096566 - protein, 9 aa, Homo Sapiens
VPHNAGLGY

SEQ ID NO: 1096567 - protein, 9 aa, Homo Sapiens
TPAWCMAVR

SEQ ID NO: 1096568 - protein, 9 aa, Homo Sapiens
NPAAQDGAR

SEQ ID NO: 1096569 - protein, 9 aa, Homo Sapiens
FDVKTEQVP

SEQ ID NO: 1096570 - protein, 9 aa, Homo Sapiens
AELALVGPH

SEQ ID NO: 1096571 - protein, 9 aa, Homo Sapiens
RQLSGVKKP

SEQ ID NO: 1096572 - protein, 9 aa, Homo Sapiens
CRPGAPAAV

SEQ ID NO: 1096573 - protein, 9 aa, Homo Sapiens
AEFASCSLP

SEQ ID NO: 1096574 - protein, 9 aa, Homo Sapiens
KWLLPLPGP

SEQ ID NO: 1096575 - protein, 9 aa, Homo Sapiens
PPSRQDPRT

SEQ ID NO: 1096576 - protein, 9 aa, Homo Sapiens
GQPCFRTAG

SEQ ID NO: 1096577 - protein, 9 aa, Homo Sapiens
RRRTGKKTG

SEQ ID NO: 1096578 - protein, 9 aa, Homo Sapiens
AHSPTPTSA

SEQ ID NO: 1096579 - protein, 9 aa, Homo Sapiens
FSSPSTSQT

SEQ ID NO: 1096580 - protein, 9 aa, Homo Sapiens
LRVRLPDDC

SEQ ID NO: 1096581 - protein, 9 aa, Homo Sapiens
ASQTRVPPG

SEQ ID NO: 1096582 - protein, 9 aa, Homo Sapiens
MLPTARSLH

SEQ ID NO: 1096583 - protein, 9 aa, Homo Sapiens
FWPPSHQHR

SEQ ID NO: 1096584 - protein, 9 aa, Homo Sapiens
EEEDDDQPP

SEQ ID NO: 1096585 - protein, 9 aa, Homo Sapiens
WKQSQQSLS

SEQ ID NO: 1096586 - protein, 9 aa, Homo Sapiens
WKVKFPELL

SEQ ID NO: 1096587 - protein, 9 aa, Homo Sapiens
PLPWGWLLY

SEQ ID NO: 1096588 - protein, 9 aa, Homo Sapiens
SGSIAPPAR

SEQ ID NO: 1096589 - protein, 9 aa, Homo Sapiens
RAWEWAKSM

SEQ ID NO: 1096590 - protein, 9 aa, Homo Sapiens
KKVDEKQAS

SEQ ID NO: 1096591 - protein, 9 aa, Homo Sapiens
QRTHQAQVV

SEQ ID NO: 1096592 - protein, 9 aa, Homo Sapiens
PICRTTMAF

SEQ ID NO: 1096593 - protein, 9 aa, Homo Sapiens
HTLNFEYTV

SEQ ID NO: 1096594 - protein, 9 aa, Homo Sapiens
VSLKNQPTI

SEQ ID NO: 1096595 - protein, 9 aa, Homo Sapiens
HSPTPTSAL

SEQ ID NO: 1096596 - protein, 9 aa, Homo Sapiens
FVWPPPYHP

SEQ ID NO: 1096597 - protein, 9 aa, Homo Sapiens
LQAGQVQMS

SEQ ID NO: 1096598 - protein, 9 aa, Homo Sapiens
DLLLGQRPA

SEQ ID NO: 1096599 - protein, 9 aa, Homo Sapiens
ETYRLISTI

SEQ ID NO: 1096600 - protein, 9 aa, Homo Sapiens
ILEQKFMLY

SEQ ID NO: 1096601 - protein, 9 aa, Homo Sapiens
LLLDLPILD

SEQ ID NO: 1096602 - protein, 9 aa, Homo Sapiens
GIGPLTRDA

SEQ ID NO: 1096603 - protein, 9 aa, Homo Sapiens
NSLLVVLDM

SEQ ID NO: 1096604 - protein, 9 aa, Homo Sapiens
GLQKKQRSF

SEQ ID NO: 1096605 - protein, 9 aa, Homo Sapiens
MTLLLCHWD

SEQ ID NO: 1096606 - protein, 9 aa, Homo Sapiens
PPRPGTLPG

SEQ ID NO: 1096607 - protein, 9 aa, Homo Sapiens
HVPRQLPGP

SEQ ID NO: 1096608 - protein, 9 aa, Homo Sapiens
FTLMRKLKR

SEQ ID NO: 1096609 - protein, 9 aa, Homo Sapiens
CWPSGTRSS

SEQ ID NO: 1096610 - protein, 9 aa, Homo Sapiens
DVAPVDMAA

SEQ ID NO: 1096611 - protein, 9 aa, Homo Sapiens
KEEHTFFTL

SEQ ID NO: 1096612 - protein, 9 aa, Homo Sapiens
RPCSLPRGP

SEQ ID NO: 1096613 - protein, 9 aa, Homo Sapiens
LQLRTVDCK

SEQ ID NO: 1096614 - protein, 9 aa, Homo Sapiens
AHQPSLTHH

SEQ ID NO: 1096615 - protein, 9 aa, Homo Sapiens
GSLMEGHHK

SEQ ID NO: 1096616 - protein, 9 aa, Homo Sapiens
LDDPDVKIE

SEQ ID NO: 1096617 - protein, 9 aa, Homo Sapiens
ARACFLAIH

SEQ ID NO: 1096618 - protein, 9 aa, Homo Sapiens
GAGPRGQPN

SEQ ID NO: 1096619 - protein, 9 aa, Homo Sapiens
VSPRGRSVP

SEQ ID NO: 1096620 - protein, 9 aa, Homo Sapiens
SGMLPLEIA

SEQ ID NO: 1096621 - protein, 9 aa, Homo Sapiens
AAAALRAVG

SEQ ID NO: 1096622 - protein, 9 aa, Homo Sapiens
PELEATEAG

SEQ ID NO: 1096623 - protein, 9 aa, Homo Sapiens
YGHGLVSIA

SEQ ID NO: 1096624 - protein, 9 aa, Homo Sapiens
ANEYKYKEG

SEQ ID NO: 1096625 - protein, 9 aa, Homo Sapiens
QCDRSWAPV

SEQ ID NO: 1096626 - protein, 9 aa, Homo Sapiens
IILFFFLFP

SEQ ID NO: 1096627 - protein, 9 aa, Homo Sapiens
TPAPCLTHC

SEQ ID NO: 1096628 - protein, 9 aa, Homo Sapiens
FFFVWFGLV

SEQ ID NO: 1096629 - protein, 9 aa, Homo Sapiens
HVLHAGSGP

SEQ ID NO: 1096630 - protein, 9 aa, Homo Sapiens
VNTAWKTKK

SEQ ID NO: 1096631 - protein, 9 aa, Homo Sapiens
VFPDMVFET

SEQ ID NO: 1096632 - protein, 9 aa, Homo Sapiens
AYIVAPSGS

SEQ ID NO: 1096633 - protein, 9 aa, Homo Sapiens
TYTPRHPRS

SEQ ID NO: 1096634 - protein, 9 aa, Homo Sapiens
QCKESLAKD

SEQ ID NO: 1096635 - protein, 9 aa, Homo Sapiens
LGCDRCDAG

SEQ ID NO: 1096636 - protein, 9 aa, Homo Sapiens
SGKKGEGKG

SEQ ID NO: 1096637 - protein, 9 aa, Homo Sapiens
GSTDHPTSA

SEQ ID NO: 1096638 - protein, 9 aa, Homo Sapiens
CSFFDKHIW

SEQ ID NO: 1096639 - protein, 9 aa, Homo Sapiens
PGTCHQWRC

SEQ ID NO: 1096640 - protein, 9 aa, Homo Sapiens
CYTWRRRHV

SEQ ID NO: 1096641 - protein, 9 aa, Homo Sapiens
LLINEETRV

SEQ ID NO: 1096642 - protein, 9 aa, Homo Sapiens
DILEQTATQ

SEQ ID NO: 1096643 - protein, 9 aa, Homo Sapiens
KHLMLEKHV

SEQ ID NO: 1096644 - protein, 9 aa, Homo Sapiens
YYPYSQFQY

SEQ ID NO: 1096645 - protein, 9 aa, Homo Sapiens
ARPLLEFAQ

SEQ ID NO: 1096646 - protein, 9 aa, Homo Sapiens
CPFQSPTKR

SEQ ID NO: 1096647 - protein, 9 aa, Homo Sapiens
QTVRQFQFT

SEQ ID NO: 1096648 - protein, 9 aa, Homo Sapiens
HHIAPGYNC

SEQ ID NO: 1096649 - protein, 9 aa, Homo Sapiens
HAAGPAAER

SEQ ID NO: 1096650 - protein, 9 aa, Homo Sapiens
VKFPVTIRH

SEQ ID NO: 1096651 - protein, 9 aa, Homo Sapiens
QKSHGKKSE

SEQ ID NO: 1096652 - protein, 9 aa, Homo Sapiens
IQWDIIASN

SEQ ID NO: 1096653 - protein, 9 aa, Homo Sapiens
APHSAGLSP

SEQ ID NO: 1096654 - protein, 9 aa, Homo Sapiens
SPQNIGAGR

SEQ ID NO: 1096655 - protein, 9 aa, Homo Sapiens
AVPAAPAAM

SEQ ID NO: 1096656 - protein, 9 aa, Homo Sapiens
GQDMVSPEV

SEQ ID NO: 1096657 - protein, 9 aa, Homo Sapiens
RPARCGRCP

SEQ ID NO: 1096658 - protein, 9 aa, Homo Sapiens
ELDKKYIKD

SEQ ID NO: 1096659 - protein, 9 aa, Homo Sapiens
LSKASILEE

SEQ ID NO: 1096660 - protein, 9 aa, Homo Sapiens
NAENAEEGA

SEQ ID NO: 1096661 - protein, 9 aa, Homo Sapiens
GWFPILFKL

SEQ ID NO: 1096662 - protein, 9 aa, Homo Sapiens
LENILQLGE

SEQ ID NO: 1096663 - protein, 9 aa, Homo Sapiens
ILLVMALDR

SEQ ID NO: 1096664 - protein, 9 aa, Homo Sapiens
LEGLGIAST

SEQ ID NO: 1096665 - protein, 9 aa, Homo Sapiens
PDPAGSPRP

SEQ ID NO: 1096666 - protein, 9 aa, Homo Sapiens
MKCDLRVSE

SEQ ID NO: 1096667 - protein, 9 aa, Homo Sapiens
QLRVPDTHV

SEQ ID NO: 1096668 - protein, 9 aa, Homo Sapiens
TCVPGIPDP

SEQ ID NO: 1096669 - protein, 9 aa, Homo Sapiens
SGDEQGSDR

SEQ ID NO: 1096670 - protein, 9 aa, Homo Sapiens
TTGVHNFEI

SEQ ID NO: 1096671 - protein, 9 aa, Homo Sapiens
GDAWWGAEA

SEQ ID NO: 1096672 - protein, 9 aa, Homo Sapiens
VHVTGNPKG

SEQ ID NO: 1096673 - protein, 9 aa, Homo Sapiens
YTWRRRHVC

SEQ ID NO: 1096674 - protein, 9 aa, Homo Sapiens
QAVVILCSE

SEQ ID NO: 1096675 - protein, 9 aa, Homo Sapiens
LTGTTMATP

SEQ ID NO: 1096676 - protein, 9 aa, Homo Sapiens
RAHLAVEAC

SEQ ID NO: 1096677 - protein, 9 aa, Homo Sapiens
PQFVRCRNA

SEQ ID NO: 1096678 - protein, 9 aa, Homo Sapiens
RPEVSSCGQ

SEQ ID NO: 1096679 - protein, 9 aa, Homo Sapiens
PSRRPLGVS

SEQ ID NO: 1096680 - protein, 9 aa, Homo Sapiens
GAPVPVEHL

SEQ ID NO: 1096681 - protein, 9 aa, Homo Sapiens
KAKKTAAKK

SEQ ID NO: 1096682 - protein, 9 aa, Homo Sapiens
SLLSPCNAS

SEQ ID NO: 1096683 - protein, 9 aa, Homo Sapiens
ALQGGHVDA

SEQ ID NO: 1096684 - protein, 9 aa, Homo Sapiens
EVINNTTVR

SEQ ID NO: 1096685 - protein, 9 aa, Homo Sapiens
GRAWAPQTK

SEQ ID NO: 1096686 - protein, 9 aa, Homo Sapiens
CVELNWSAF

SEQ ID NO: 1096687 - protein, 9 aa, Homo Sapiens
YHMGTFAQI

SEQ ID NO: 1096688 - protein, 9 aa, Homo Sapiens
CKLKLVCGS

SEQ ID NO: 1096689 - protein, 9 aa, Homo Sapiens
HYHALYMTV

SEQ ID NO: 1096690 - protein, 9 aa, Homo Sapiens
SGVAYIVAP

SEQ ID NO: 1096691 - protein, 9 aa, Homo Sapiens
PSHQHRNVC

SEQ ID NO: 1096692 - protein, 9 aa, Homo Sapiens
ITALMAATQ

SEQ ID NO: 1096693 - protein, 9 aa, Homo Sapiens
GPRTDSQGR

SEQ ID NO: 1096694 - protein, 9 aa, Homo Sapiens
QIYEQHTDT

SEQ ID NO: 1096695 - protein, 9 aa, Homo Sapiens
FLQQNTQGA

SEQ ID NO: 1096696 - protein, 9 aa, Homo Sapiens
TPDQRKPPN

SEQ ID NO: 1096697 - protein, 9 aa, Homo Sapiens
LPLPGPASA

SEQ ID NO: 1096698 - protein, 9 aa, Homo Sapiens
GVYTALGYM

SEQ ID NO: 1096699 - protein, 9 aa, Homo Sapiens
DTQQEAVML

SEQ ID NO: 1096700 - protein, 9 aa, Homo Sapiens
ERCLSIGHP

SEQ ID NO: 1096701 - protein, 9 aa, Homo Sapiens
ALRASLEML

SEQ ID NO: 1096702 - protein, 9 aa, Homo Sapiens
MAMKGAGTD

SEQ ID NO: 1096703 - protein, 9 aa, Homo Sapiens
GSMPFTKNP

SEQ ID NO: 1096704 - protein, 9 aa, Homo Sapiens
GNNYYSLFE

SEQ ID NO: 1096705 - protein, 9 aa, Homo Sapiens
PPGLFCGRG

SEQ ID NO: 1096706 - protein, 9 aa, Homo Sapiens
GFSLLTSHL

SEQ ID NO: 1096707 - protein, 9 aa, Homo Sapiens
TGLQKKQRS

SEQ ID NO: 1096708 - protein, 9 aa, Homo Sapiens
GPGCLLSGP

SEQ ID NO: 1096709 - protein, 9 aa, Homo Sapiens
IGNSLPQGA

SEQ ID NO: 1096710 - protein, 9 aa, Homo Sapiens
IPLSDSPPL

SEQ ID NO: 1096711 - protein, 9 aa, Homo Sapiens
ADLDYLPRT

SEQ ID NO: 1096712 - protein, 9 aa, Homo Sapiens
LALGHAQRV

SEQ ID NO: 1096713 - protein, 9 aa, Homo Sapiens
GQTDLTVLG

SEQ ID NO: 1096714 - protein, 9 aa, Homo Sapiens
ARRASPASW

SEQ ID NO: 1096715 - protein, 9 aa, Homo Sapiens
SFWELIPTR

SEQ ID NO: 1096716 - protein, 9 aa, Homo Sapiens
LKSPNTTIL

SEQ ID NO: 1096717 - protein, 9 aa, Homo Sapiens
LVIASGNRV

SEQ ID NO: 1096718 - protein, 9 aa, Homo Sapiens
SSWLPVKWT

SEQ ID NO: 1096719 - protein, 9 aa, Homo Sapiens
RGSWERHLG

SEQ ID NO: 1096720 - protein, 9 aa, Homo Sapiens
VDEGEGLDF

SEQ ID NO: 1096721 - protein, 9 aa, Homo Sapiens
RKGLDSSWL

SEQ ID NO: 1096722 - protein, 9 aa, Homo Sapiens
GYMQWVWGG

SEQ ID NO: 1096723 - protein, 9 aa, Homo Sapiens
FCNVWAAVD

SEQ ID NO: 1096724 - protein, 9 aa, Homo Sapiens
SLVLTLGQG

SEQ ID NO: 1096725 - protein, 9 aa, Homo Sapiens
FEATPYLYQ

SEQ ID NO: 1096726 - protein, 9 aa, Homo Sapiens
YDGLDAVGM

SEQ ID NO: 1096727 - protein, 9 aa, Homo Sapiens
WWGTLVRRA

SEQ ID NO: 1096728 - protein, 9 aa, Homo Sapiens
ADSRHYHCS

SEQ ID NO: 1096729 - protein, 9 aa, Homo Sapiens
HPMTPASRT

SEQ ID NO: 1096730 - protein, 9 aa, Homo Sapiens
NSLPQGAGS

SEQ ID NO: 1096731 - protein, 9 aa, Homo Sapiens
LALHTDKTL

SEQ ID NO: 1096732 - protein, 9 aa, Homo Sapiens
DDKHVAFGK

SEQ ID NO: 1096733 - protein, 9 aa, Homo Sapiens
QLLSFQQIC

SEQ ID NO: 1096734 - protein, 9 aa, Homo Sapiens
NSRKKKADR

SEQ ID NO: 1096735 - protein, 9 aa, Homo Sapiens
PWGYRCEGD

SEQ ID NO: 1096736 - protein, 9 aa, Homo Sapiens
KQERKELEE

SEQ ID NO: 1096737 - protein, 9 aa, Homo Sapiens
ATCSPGWMA

SEQ ID NO: 1096738 - protein, 9 aa, Homo Sapiens
LRREPRRGT

SEQ ID NO: 1096739 - protein, 9 aa, Homo Sapiens
SASSAWGSA

SEQ ID NO: 1096740 - protein, 9 aa, Homo Sapiens
ERWYTPRAH

SEQ ID NO: 1096741 - protein, 9 aa, Homo Sapiens
EGVHRQLCR

SEQ ID NO: 1096742 - protein, 9 aa, Homo Sapiens
QGHREIHRV

SEQ ID NO: 1096743 - protein, 9 aa, Homo Sapiens
DRPCSLPRG

SEQ ID NO: 1096744 - protein, 9 aa, Homo Sapiens
LSGSNPPIF

SEQ ID NO: 1096745 - protein, 9 aa, Homo Sapiens
AFKTETSSD

SEQ ID NO: 1096746 - protein, 9 aa, Homo Sapiens
GSRMLKQNL

SEQ ID NO: 1096747 - protein, 9 aa, Homo Sapiens
TALRRTVHP

SEQ ID NO: 1096748 - protein, 9 aa, Homo Sapiens
VPPSIFSTW

SEQ ID NO: 1096749 - protein, 9 aa, Homo Sapiens
QVFKPCGTF

SEQ ID NO: 1096750 - protein, 9 aa, Homo Sapiens
PPQPGGVLL

SEQ ID NO: 1096751 - protein, 9 aa, Homo Sapiens
VPALPQRGP

SEQ ID NO: 1096752 - protein, 9 aa, Homo Sapiens
CTNFGEQPH

SEQ ID NO: 1096753 - protein, 9 aa, Homo Sapiens
RAVRRCTQA

SEQ ID NO: 1096754 - protein, 9 aa, Homo Sapiens
RCPAVPAAA

SEQ ID NO: 1096755 - protein, 9 aa, Homo Sapiens
CGVGPQFVR

SEQ ID NO: 1096756 - protein, 9 aa, Homo Sapiens
EPSRLGGPK

SEQ ID NO: 1096757 - protein, 9 aa, Homo Sapiens
RTTALGMCT

SEQ ID NO: 1096758 - protein, 9 aa, Homo Sapiens
CGKVFNQSS

SEQ ID NO: 1096759 - protein, 9 aa, Homo Sapiens
LLTYIWSAV

SEQ ID NO: 1096760 - protein, 9 aa, Homo Sapiens
RGGQRCRCV

SEQ ID NO: 1096761 - protein, 9 aa, Homo Sapiens
PLTFRLPRN

SEQ ID NO: 1096762 - protein, 9 aa, Homo Sapiens
LQQWKRPMG

SEQ ID NO: 1096763 - protein, 9 aa, Homo Sapiens
SYNDFSFMT

SEQ ID NO: 1096764 - protein, 9 aa, Homo Sapiens
WDRGDAWWG

SEQ ID NO: 1096765 - protein, 9 aa, Homo Sapiens
SSCFQRRKR

SEQ ID NO: 1096766 - protein, 9 aa, Homo Sapiens
VLPHVDFQL

SEQ ID NO: 1096767 - protein, 9 aa, Homo Sapiens
PVRLREDAE

SEQ ID NO: 1096768 - protein, 9 aa, Homo Sapiens
YLESNGKGV

SEQ ID NO: 1096769 - protein, 9 aa, Homo Sapiens
TCCQFWSKM

SEQ ID NO: 1096770 - protein, 9 aa, Homo Sapiens
SATPEDHCC

SEQ ID NO: 1096771 - protein, 9 aa, Homo Sapiens
IPLLGDQLV

SEQ ID NO: 1096772 - protein, 9 aa, Homo Sapiens
PKDSQPLCH

SEQ ID NO: 1096773 - protein, 9 aa, Homo Sapiens
PAFPSRSHP

SEQ ID NO: 1096774 - protein, 9 aa, Homo Sapiens
PPRIELARM

SEQ ID NO: 1096775 - protein, 9 aa, Homo Sapiens
QEINDLVKW

SEQ ID NO: 1096776 - protein, 9 aa, Homo Sapiens
VAKMGTPRI

SEQ ID NO: 1096777 - protein, 9 aa, Homo Sapiens
STASAATSR

SEQ ID NO: 1096778 - protein, 9 aa, Homo Sapiens
CTFFCRDRV

SEQ ID NO: 1096779 - protein, 9 aa, Homo Sapiens
REHPHPTVR

SEQ ID NO: 1096780 - protein, 9 aa, Homo Sapiens
NFQSPPQPP

SEQ ID NO: 1096781 - protein, 9 aa, Homo Sapiens
ESLDEIYHM

SEQ ID NO: 1096782 - protein, 9 aa, Homo Sapiens
ARTTTLQRS

SEQ ID NO: 1096783 - protein, 9 aa, Homo Sapiens
LESALLSPA

SEQ ID NO: 1096784 - protein, 9 aa, Homo Sapiens
QIKIIESPE

SEQ ID NO: 1096785 - protein, 9 aa, Homo Sapiens
VASPPTRSS

SEQ ID NO: 1096786 - protein, 9 aa, Homo Sapiens
WEWAKSMTS

SEQ ID NO: 1096787 - protein, 9 aa, Homo Sapiens
LVDEGEGLD

SEQ ID NO: 1096788 - protein, 9 aa, Homo Sapiens
REKVICSSL

SEQ ID NO: 1096789 - protein, 9 aa, Homo Sapiens
ADESSDSGA

SEQ ID NO: 1096790 - protein, 9 aa, Homo Sapiens
ASRHQLMRT

SEQ ID NO: 1096791 - protein, 9 aa, Homo Sapiens
HGETGMVHA

SEQ ID NO: 1096792 - protein, 9 aa, Homo Sapiens
KNSSSSSLL

SEQ ID NO: 1096793 - protein, 9 aa, Homo Sapiens
FLSMLNDIV

SEQ ID NO: 1096794 - protein, 9 aa, Homo Sapiens
TRALRARQV

SEQ ID NO: 1096795 - protein, 9 aa, Homo Sapiens
YFVYSRVGG

SEQ ID NO: 1096796 - protein, 9 aa, Homo Sapiens
GNHLSHPPK

SEQ ID NO: 1096797 - protein, 9 aa, Homo Sapiens
LFYPGALLP

SEQ ID NO: 1096798 - protein, 9 aa, Homo Sapiens
FQVIRCPLQ

SEQ ID NO: 1096799 - protein, 9 aa, Homo Sapiens
HFHFYKRYT

SEQ ID NO: 1096800 - protein, 9 aa, Homo Sapiens
SEENNLGAN

SEQ ID NO: 1096801 - protein, 9 aa, Homo Sapiens
AGAARTSGS

SEQ ID NO: 1096802 - protein, 9 aa, Homo Sapiens
KIVPFLNYA

SEQ ID NO: 1096803 - protein, 9 aa, Homo Sapiens
HLGTRKDHP

SEQ ID NO: 1096804 - protein, 9 aa, Homo Sapiens
PADNSRGCG

SEQ ID NO: 1096805 - protein, 9 aa, Homo Sapiens
GEFHPWGHH

SEQ ID NO: 1096806 - protein, 9 aa, Homo Sapiens
APPPAPPAA

SEQ ID NO: 1096807 - protein, 9 aa, Homo Sapiens
HRPPGGGRG

SEQ ID NO: 1096808 - protein, 9 aa, Homo Sapiens
EGSVLAKKP

SEQ ID NO: 1096809 - protein, 9 aa, Homo Sapiens
TGSRRGCAW

SEQ ID NO: 1096810 - protein, 9 aa, Homo Sapiens
KSSHCLLTA

SEQ ID NO: 1096811 - protein, 9 aa, Homo Sapiens
LRHLMWMNM

SEQ ID NO: 1096812 - protein, 9 aa, Homo Sapiens
LYRSYCSTR

SEQ ID NO: 1096813 - protein, 9 aa, Homo Sapiens
AASAGAGAA

SEQ ID NO: 1096814 - protein, 9 aa, Homo Sapiens
ELKYIHSAN

SEQ ID NO: 1096815 - protein, 9 aa, Homo Sapiens
QPCFRTAGS

SEQ ID NO: 1096816 - protein, 9 aa, Homo Sapiens
RCTGLPPCT

SEQ ID NO: 1096817 - protein, 9 aa, Homo Sapiens
AGAARRSQR

SEQ ID NO: 1096818 - protein, 9 aa, Homo Sapiens
NDVMLCTGL

SEQ ID NO: 1096819 - protein, 9 aa, Homo Sapiens
YAEQNGATL

SEQ ID NO: 1096820 - protein, 9 aa, Homo Sapiens
FSTVCRESE

SEQ ID NO: 1096821 - protein, 9 aa, Homo Sapiens
LERILPECF

SEQ ID NO: 1096822 - protein, 9 aa, Homo Sapiens
RRTQLETPR

SEQ ID NO: 1096823 - protein, 9 aa, Homo Sapiens
PKDLSLSKQ

SEQ ID NO: 1096824 - protein, 9 aa, Homo Sapiens
MRPKHSHHC

SEQ ID NO: 1096825 - protein, 9 aa, Homo Sapiens
LLRTAQPKT

SEQ ID NO: 1096826 - protein, 9 aa, Homo Sapiens
RHFHQSTKL

SEQ ID NO: 1096827 - protein, 9 aa, Homo Sapiens
APQSQEEGI

SEQ ID NO: 1096828 - protein, 9 aa, Homo Sapiens
LALVGPHAR

SEQ ID NO: 1096829 - protein, 9 aa, Homo Sapiens
RPSPSQEPQ

SEQ ID NO: 1096830 - protein, 9 aa, Homo Sapiens
RKLQSADEK

SEQ ID NO: 1096831 - protein, 9 aa, Homo Sapiens
SSAQGVSSA

SEQ ID NO: 1096832 - protein, 9 aa, Homo Sapiens
HHPRIPGVA

SEQ ID NO: 1096833 - protein, 9 aa, Homo Sapiens
HAHKAGLLC

SEQ ID NO: 1096834 - protein, 9 aa, Homo Sapiens
LWNPSRRWR

SEQ ID NO: 1096835 - protein, 9 aa, Homo Sapiens
FQLFGYYSA

SEQ ID NO: 1096836 - protein, 9 aa, Homo Sapiens
DFSPYWMKK

SEQ ID NO: 1096837 - protein, 9 aa, Homo Sapiens
QDPRSQKVG

SEQ ID NO: 1096838 - protein, 9 aa, Homo Sapiens
AVMLLRQLA

SEQ ID NO: 1096839 - protein, 9 aa, Homo Sapiens
TTFLYLVNL

SEQ ID NO: 1096840 - protein, 9 aa, Homo Sapiens
TAQIQRPIQ

SEQ ID NO: 1096841 - protein, 9 aa, Homo Sapiens
FQKLPKNAQ

SEQ ID NO: 1096842 - protein, 9 aa, Homo Sapiens
IMRMLPTAR

SEQ ID NO: 1096843 - protein, 9 aa, Homo Sapiens
HFYVVMWKQ

SEQ ID NO: 1096844 - protein, 9 aa, Homo Sapiens
RSLWPPQRP

SEQ ID NO: 1096845 - protein, 9 aa, Homo Sapiens
FTVRTCVCW

SEQ ID NO: 1096846 - protein, 9 aa, Homo Sapiens
DGSNSYCLM

SEQ ID NO: 1096847 - protein, 9 aa, Homo Sapiens
PEMHLIHAR

SEQ ID NO: 1096848 - protein, 9 aa, Homo Sapiens
SVMVKYNAT

SEQ ID NO: 1096849 - protein, 9 aa, Homo Sapiens
PIPGSNCSS

SEQ ID NO: 1096850 - protein, 9 aa, Homo Sapiens
RPRCRPAVA

SEQ ID NO: 1096851 - protein, 9 aa, Homo Sapiens
TKARVLNTP

SEQ ID NO: 1096852 - protein, 9 aa, Homo Sapiens
APLGRGIFG

SEQ ID NO: 1096853 - protein, 9 aa, Homo Sapiens
LREDAEAVL

SEQ ID NO: 1096854 - protein, 9 aa, Homo Sapiens
PSGAISVPV

SEQ ID NO: 1096855 - protein, 9 aa, Homo Sapiens
GDQGPKGPP

SEQ ID NO: 1096856 - protein, 9 aa, Homo Sapiens
RTSCGAARP

SEQ ID NO: 1096857 - protein, 9 aa, Homo Sapiens
LEVYLQGWE

SEQ ID NO: 1096858 - protein, 9 aa, Homo Sapiens
LVVSCWLRY

SEQ ID NO: 1096859 - protein, 9 aa, Homo Sapiens
GQPTSPGTC

SEQ ID NO: 1096860 - protein, 9 aa, Homo Sapiens
SEPSMWAFL

SEQ ID NO: 1096861 - protein, 9 aa, Homo Sapiens
CLRTCHLMP

SEQ ID NO: 1096862 - protein, 9 aa, Homo Sapiens
LDLRYANLE

SEQ ID NO: 1096863 - protein, 9 aa, Homo Sapiens
QEGSMAHVE

SEQ ID NO: 1096864 - protein, 9 aa, Homo Sapiens
DLLCNPKPW

SEQ ID NO: 1096865 - protein, 9 aa, Homo Sapiens
PPRPAPGWR

SEQ ID NO: 1096866 - protein, 9 aa, Homo Sapiens
QLPDSVPGP

SEQ ID NO: 1096867 - protein, 9 aa, Homo Sapiens
FLFPLGYLL

SEQ ID NO: 1096868 - protein, 9 aa, Homo Sapiens
SRNCTAALC

SEQ ID NO: 1096869 - protein, 9 aa, Homo Sapiens
WFPILFKLS

SEQ ID NO: 1096870 - protein, 9 aa, Homo Sapiens
QGERCWRSC

SEQ ID NO: 1096871 - protein, 9 aa, Homo Sapiens
SAEMEKIKQ

SEQ ID NO: 1096872 - protein, 9 aa, Homo Sapiens
KPCGTFHHK

SEQ ID NO: 1096873 - protein, 9 aa, Homo Sapiens
VRQNAAIRD

SEQ ID NO: 1096874 - protein, 9 aa, Homo Sapiens
SPSPSQASE

SEQ ID NO: 1096875 - protein, 9 aa, Homo Sapiens
WRSRGTWLG

SEQ ID NO: 1096876 - protein, 9 aa, Homo Sapiens
DNFFYQERA

SEQ ID NO: 1096877 - protein, 9 aa, Homo Sapiens
HESAHSMCK

SEQ ID NO: 1096878 - protein, 9 aa, Homo Sapiens
SVPAPSICK

SEQ ID NO: 1096879 - protein, 9 aa, Homo Sapiens
QRRRQAERL

SEQ ID NO: 1096880 - protein, 9 aa, Homo Sapiens
IRGTISLQY

SEQ ID NO: 1096881 - protein, 9 aa, Homo Sapiens
NGKGVFCTS

SEQ ID NO: 1096882 - protein, 9 aa, Homo Sapiens
SHHAWPGHF

SEQ ID NO: 1096883 - protein, 9 aa, Homo Sapiens
LCIVPSEVE

SEQ ID NO: 1096884 - protein, 9 aa, Homo Sapiens
SAGAPSSKA

SEQ ID NO: 1096885 - protein, 9 aa, Homo Sapiens
HGDTSPAAI

SEQ ID NO: 1096886 - protein, 9 aa, Homo Sapiens
PAAQDGARC

SEQ ID NO: 1096887 - protein, 9 aa, Homo Sapiens
AEAGAARRS

SEQ ID NO: 1096888 - protein, 9 aa, Homo Sapiens
PSFSWTIRH

SEQ ID NO: 1096889 - protein, 9 aa, Homo Sapiens
WGHCQARCQ

SEQ ID NO: 1096890 - protein, 9 aa, Homo Sapiens
ATVGLLWFT

SEQ ID NO: 1096891 - protein, 9 aa, Homo Sapiens
PEVNAGGRR

SEQ ID NO: 1096892 - protein, 9 aa, Homo Sapiens
IKMIDQGFD

SEQ ID NO: 1096893 - protein, 9 aa, Homo Sapiens
LSGTYNCGP

SEQ ID NO: 1096894 - protein, 9 aa, Homo Sapiens
ADVADVPPL

SEQ ID NO: 1096895 - protein, 9 aa, Homo Sapiens
FVCIFVYKE

SEQ ID NO: 1096896 - protein, 9 aa, Homo Sapiens
NLSCFVWKQ

SEQ ID NO: 1096897 - protein, 9 aa, Homo Sapiens
LGPLAPAHH

SEQ ID NO: 1096898 - protein, 9 aa, Homo Sapiens
SIGQVFSVA

SEQ ID NO: 1096899 - protein, 9 aa, Homo Sapiens
PLGDTPQPS

SEQ ID NO: 1096900 - protein, 9 aa, Homo Sapiens
HSGDPAGVY

SEQ ID NO: 1096901 - protein, 9 aa, Homo Sapiens
AGASLFLHH

SEQ ID NO: 1096902 - protein, 9 aa, Homo Sapiens
ADSAWGWVR

SEQ ID NO: 1096903 - protein, 9 aa, Homo Sapiens
PILASYPPY

SEQ ID NO: 1096904 - protein, 9 aa, Homo Sapiens
EHVLEEVIR

SEQ ID NO: 1096905 - protein, 9 aa, Homo Sapiens
PPLQDGSLD

SEQ ID NO: 1096906 - protein, 9 aa, Homo Sapiens
CYMPPEVLD

SEQ ID NO: 1096907 - protein, 9 aa, Homo Sapiens
MNISVSLKN

SEQ ID NO: 1096908 - protein, 9 aa, Homo Sapiens
WQSPCPAPG

SEQ ID NO: 1096909 - protein, 9 aa, Homo Sapiens
YQQIKENPP

SEQ ID NO: 1096910 - protein, 9 aa, Homo Sapiens
VLSLRKTQA

SEQ ID NO: 1096911 - protein, 9 aa, Homo Sapiens
NSSVTTQPA

SEQ ID NO: 1096912 - protein, 9 aa, Homo Sapiens
FILSGNGTI

SEQ ID NO: 1096913 - protein, 9 aa, Homo Sapiens
TRYFQSRGP

SEQ ID NO: 1096914 - protein, 9 aa, Homo Sapiens
LDLHFPRDS

SEQ ID NO: 1096915 - protein, 9 aa, Homo Sapiens
LQVLHKACK

SEQ ID NO: 1096916 - protein, 9 aa, Homo Sapiens
AQVGPLPCV

SEQ ID NO: 1096917 - protein, 9 aa, Homo Sapiens
KVSKKRLPK

SEQ ID NO: 1096918 - protein, 9 aa, Homo Sapiens
PAHGKAAPW

SEQ ID NO: 1096919 - protein, 9 aa, Homo Sapiens
QHGRRFRSA

SEQ ID NO: 1096920 - protein, 9 aa, Homo Sapiens
VQNTRILRK

SEQ ID NO: 1096921 - protein, 9 aa, Homo Sapiens
SSINHFFVT

SEQ ID NO: 1096922 - protein, 9 aa, Homo Sapiens
QPVRMPACM

SEQ ID NO: 1096923 - protein, 9 aa, Homo Sapiens
SEGGARGTF

SEQ ID NO: 1096924 - protein, 9 aa, Homo Sapiens
FEGTCAVGV

SEQ ID NO: 1096925 - protein, 9 aa, Homo Sapiens
GWVLLPRLV

SEQ ID NO: 1096926 - protein, 9 aa, Homo Sapiens
SCQLCSSST

SEQ ID NO: 1096927 - protein, 9 aa, Homo Sapiens
RNLGSPLMS

SEQ ID NO: 1096928 - protein, 9 aa, Homo Sapiens
KNLPKALSQ

SEQ ID NO: 1096929 - protein, 9 aa, Homo Sapiens
HKYRVLIAM

SEQ ID NO: 1096930 - protein, 9 aa, Homo Sapiens
VHERCVAQA

SEQ ID NO: 1096931 - protein, 9 aa, Homo Sapiens
PGRHWLCPQ

SEQ ID NO: 1096932 - protein, 9 aa, Homo Sapiens
TEILETVEK

SEQ ID NO: 1096933 - protein, 9 aa, Homo Sapiens
QRMVPEHRA

SEQ ID NO: 1096934 - protein, 9 aa, Homo Sapiens
DTNDNAPQF

SEQ ID NO: 1096935 - protein, 9 aa, Homo Sapiens
ISPFSTVCR

SEQ ID NO: 1096936 - protein, 9 aa, Homo Sapiens
LFALYMSAS

SEQ ID NO: 1096937 - protein, 9 aa, Homo Sapiens
TLQRLQHVL

SEQ ID NO: 1096938 - protein, 9 aa, Homo Sapiens
VPTYVPARQ

SEQ ID NO: 1096939 - protein, 9 aa, Homo Sapiens
CDRSWAPVF

SEQ ID NO: 1096940 - protein, 9 aa, Homo Sapiens
YGKKLVKIS

SEQ ID NO: 1096941 - protein, 9 aa, Homo Sapiens
AALALDVAV

SEQ ID NO: 1096942 - protein, 9 aa, Homo Sapiens
SLPLPEVLL

SEQ ID NO: 1096943 - protein, 9 aa, Homo Sapiens
EGGKDGPES

SEQ ID NO: 1096944 - protein, 9 aa, Homo Sapiens
GKQGLGPPA

SEQ ID NO: 1096945 - protein, 9 aa, Homo Sapiens
PKLLEHGLV

SEQ ID NO: 1096946 - protein, 9 aa, Homo Sapiens
PSRKRRRGS

SEQ ID NO: 1096947 - protein, 9 aa, Homo Sapiens
MKCARCVCV

SEQ ID NO: 1096948 - protein, 9 aa, Homo Sapiens
SLILVSVSR

SEQ ID NO: 1096949 - protein, 9 aa, Homo Sapiens
LYTVRGLWP

SEQ ID NO: 1096950 - protein, 9 aa, Homo Sapiens
FLLFLAVWL

SEQ ID NO: 1096951 - protein, 9 aa, Homo Sapiens
PPPHNPRHQ

SEQ ID NO: 1096952 - protein, 9 aa, Homo Sapiens
HRMPSPHSG

SEQ ID NO: 1096953 - protein, 9 aa, Homo Sapiens
TRPEWSLAT

SEQ ID NO: 1096954 - protein, 9 aa, Homo Sapiens
VRGGVPDPS

SEQ ID NO: 1096955 - protein, 9 aa, Homo Sapiens
MDGEQPSSL

SEQ ID NO: 1096956 - protein, 9 aa, Homo Sapiens
QVTQPSAAR

SEQ ID NO: 1096957 - protein, 9 aa, Homo Sapiens
CGCSRMARP

SEQ ID NO: 1096958 - protein, 9 aa, Homo Sapiens
LRFEKGHIY

SEQ ID NO: 1096959 - protein, 9 aa, Homo Sapiens
PDLSSIAVL

SEQ ID NO: 1096960 - protein, 9 aa, Homo Sapiens
RSHSTEPSL

SEQ ID NO: 1096961 - protein, 9 aa, Homo Sapiens
GLQLALFYQ

SEQ ID NO: 1096962 - protein, 9 aa, Homo Sapiens
EHTFFTLMR

SEQ ID NO: 1096963 - protein, 9 aa, Homo Sapiens
GRSKPATLA

SEQ ID NO: 1096964 - protein, 9 aa, Homo Sapiens
LAEGVCDDD

SEQ ID NO: 1096965 - protein, 9 aa, Homo Sapiens
SPQCLRLSW

SEQ ID NO: 1096966 - protein, 9 aa, Homo Sapiens
EMVAVKGIV

SEQ ID NO: 1096967 - protein, 9 aa, Homo Sapiens
PPTYPCPSA

SEQ ID NO: 1096968 - protein, 9 aa, Homo Sapiens
CWDMYHHDI

SEQ ID NO: 1096969 - protein, 9 aa, Homo Sapiens
WNWHGETEG

SEQ ID NO: 1096970 - protein, 9 aa, Homo Sapiens
HLNFEATPY

SEQ ID NO: 1096971 - protein, 9 aa, Homo Sapiens
PAVTDLTAC

SEQ ID NO: 1096972 - protein, 9 aa, Homo Sapiens
LSAGSWAAF

SEQ ID NO: 1096973 - protein, 9 aa, Homo Sapiens
PTRRSLAPT

SEQ ID NO: 1096974 - protein, 9 aa, Homo Sapiens
WYTPRAHLD

SEQ ID NO: 1096975 - protein, 9 aa, Homo Sapiens
RSSALQGKV

SEQ ID NO: 1096976 - protein, 9 aa, Homo Sapiens
ASRSSGIVT

SEQ ID NO: 1096977 - protein, 9 aa, Homo Sapiens
SQREPPPRR

SEQ ID NO: 1096978 - protein, 9 aa, Homo Sapiens
GAPSSKATE

SEQ ID NO: 1096979 - protein, 9 aa, Homo Sapiens
SYHQALLRI

SEQ ID NO: 1096980 - protein, 9 aa, Homo Sapiens
STGLFQENF

SEQ ID NO: 1096981 - protein, 9 aa, Homo Sapiens
LLLPVLVQD

SEQ ID NO: 1096982 - protein, 9 aa, Homo Sapiens
ASPWPALTL

SEQ ID NO: 1096983 - protein, 9 aa, Homo Sapiens
NPVPETPVF

SEQ ID NO: 1096984 - protein, 9 aa, Homo Sapiens
EDLDLILYL

SEQ ID NO: 1096985 - protein, 9 aa, Homo Sapiens
ILILDTNDN

SEQ ID NO: 1096986 - protein, 9 aa, Homo Sapiens
HLSFIGTPY

SEQ ID NO: 1096987 - protein, 9 aa, Homo Sapiens
DMAFDRYVA

SEQ ID NO: 1096988 - protein, 9 aa, Homo Sapiens
LLKATQNDK

SEQ ID NO: 1096989 - protein, 9 aa, Homo Sapiens
GQILHRGGA

SEQ ID NO: 1096990 - protein, 9 aa, Homo Sapiens
RNVCYCSRQ

SEQ ID NO: 1096991 - protein, 9 aa, Homo Sapiens
RFPEALRLV

SEQ ID NO: 1096992 - protein, 9 aa, Homo Sapiens
VRGEWRQGG

SEQ ID NO: 1096993 - protein, 9 aa, Homo Sapiens
QRPSNSRKF

SEQ ID NO: 1096994 - protein, 9 aa, Homo Sapiens
DQAHRQKVS

SEQ ID NO: 1096995 - protein, 9 aa, Homo Sapiens
HQTSVLSFT

SEQ ID NO: 1096996 - protein, 9 aa, Homo Sapiens
DFHPVKKLS

SEQ ID NO: 1096997 - protein, 9 aa, Homo Sapiens
PACTCISMT

SEQ ID NO: 1096998 - protein, 9 aa, Homo Sapiens
YGNMFSQTT

SEQ ID NO: 1096999 - protein, 9 aa, Homo Sapiens
LKDTQDQLQ

SEQ ID NO: 1097000 - protein, 9 aa, Homo Sapiens
LPRRATMTC

SEQ ID NO: 1097001 - protein, 9 aa, Homo Sapiens
FWLISAPVD

SEQ ID NO: 1097002 - protein, 9 aa, Homo Sapiens
KVNNSMSKK

SEQ ID NO: 1097003 - protein, 9 aa, Homo Sapiens
MRLRKLQSA

SEQ ID NO: 1097004 - protein, 9 aa, Homo Sapiens
TASAATSRG

SEQ ID NO: 1097005 - protein, 9 aa, Homo Sapiens
VLAVVKIIK

SEQ ID NO: 1097006 - protein, 9 aa, Homo Sapiens
VQFKIKRHM

SEQ ID NO: 1097007 - protein, 9 aa, Homo Sapiens
AVGWPCYLT

SEQ ID NO: 1097008 - protein, 9 aa, Homo Sapiens
EGALEPHTH

SEQ ID NO: 1097009 - protein, 9 aa, Homo Sapiens
TSSSSGPWR

SEQ ID NO: 1097010 - protein, 9 aa, Homo Sapiens
PAQSESVQR

SEQ ID NO: 1097011 - protein, 9 aa, Homo Sapiens
DTSPAAIPT

SEQ ID NO: 1097012 - protein, 9 aa, Homo Sapiens
EDDDQPPKK

SEQ ID NO: 1097013 - protein, 9 aa, Homo Sapiens
MRKLRRSLR

SEQ ID NO: 1097014 - protein, 9 aa, Homo Sapiens
GGDSATTWE

SEQ ID NO: 1097015 - protein, 9 aa, Homo Sapiens
TGRTPTTRL

SEQ ID NO: 1097016 - protein, 9 aa, Homo Sapiens
AEDDLRGRE

SEQ ID NO: 1097017 - protein, 9 aa, Homo Sapiens
ERGAGLQVT

SEQ ID NO: 1097018 - protein, 9 aa, Homo Sapiens
PSTLLSTPE

SEQ ID NO: 1097019 - protein, 9 aa, Homo Sapiens
SPIQQLVWP

SEQ ID NO: 1097020 - protein, 9 aa, Homo Sapiens
LLLHGQFQG

SEQ ID NO: 1097021 - protein, 9 aa, Homo Sapiens
DLCPGASVG

SEQ ID NO: 1097022 - protein, 9 aa, Homo Sapiens
VELRKATTP

SEQ ID NO: 1097023 - protein, 9 aa, Homo Sapiens
PAEPPPRPA

SEQ ID NO: 1097024 - protein, 9 aa, Homo Sapiens
SSGPWRSRG

SEQ ID NO: 1097025 - protein, 9 aa, Homo Sapiens
GVEGVKAPR

SEQ ID NO: 1097026 - protein, 9 aa, Homo Sapiens
QPKAVWVPG

SEQ ID NO: 1097027 - protein, 9 aa, Homo Sapiens
PDWMPPPEV

SEQ ID NO: 1097028 - protein, 9 aa, Homo Sapiens
LGIASTLPG

SEQ ID NO: 1097029 - protein, 9 aa, Homo Sapiens
GYPAYSKDS

SEQ ID NO: 1097030 - protein, 9 aa, Homo Sapiens
SPSSLLSPC

SEQ ID NO: 1097031 - protein, 9 aa, Homo Sapiens
SMTTISRAT

SEQ ID NO: 1097032 - protein, 9 aa, Homo Sapiens
PAAPTGRPR

SEQ ID NO: 1097033 - protein, 9 aa, Homo Sapiens
SAQGVSSAP

SEQ ID NO: 1097034 - protein, 9 aa, Homo Sapiens
SDEQCAAAA

SEQ ID NO: 1097035 - protein, 9 aa, Homo Sapiens
DFEDNHHLY

SEQ ID NO: 1097036 - protein, 9 aa, Homo Sapiens
ADIKVIMVT

SEQ ID NO: 1097037 - protein, 9 aa, Homo Sapiens
ASLFLHHLH

SEQ ID NO: 1097038 - protein, 9 aa, Homo Sapiens
DQQGLLKAT

SEQ ID NO: 1097039 - protein, 9 aa, Homo Sapiens
QLRLIKINF

SEQ ID NO: 1097040 - protein, 9 aa, Homo Sapiens
THQAQVVFQ

SEQ ID NO: 1097041 - protein, 9 aa, Homo Sapiens
VILQIVDHF

SEQ ID NO: 1097042 - protein, 9 aa, Homo Sapiens
VDQHPINYC

SEQ ID NO: 1097043 - protein, 9 aa, Homo Sapiens
RPWLMDPKI

SEQ ID NO: 1097044 - protein, 9 aa, Homo Sapiens
PSASTHTSR

SEQ ID NO: 1097045 - protein, 9 aa, Homo Sapiens
PGGTSSSSG

SEQ ID NO: 1097046 - protein, 9 aa, Homo Sapiens
SRISRETHL

SEQ ID NO: 1097047 - protein, 9 aa, Homo Sapiens
AFSELLDLM

SEQ ID NO: 1097048 - protein, 9 aa, Homo Sapiens
SRGASCSST

SEQ ID NO: 1097049 - protein, 9 aa, Homo Sapiens
HPRIPGVAH

SEQ ID NO: 1097050 - protein, 9 aa, Homo Sapiens
VRAPNVILH

SEQ ID NO: 1097051 - protein, 9 aa, Homo Sapiens
GPLEPVVVD

SEQ ID NO: 1097052 - protein, 9 aa, Homo Sapiens
TTGTSRTTA

SEQ ID NO: 1097053 - protein, 9 aa, Homo Sapiens
CAPGQGHLC

SEQ ID NO: 1097054 - protein, 9 aa, Homo Sapiens
QGYPKEGRK

SEQ ID NO: 1097055 - protein, 9 aa, Homo Sapiens
MQKWKKSDS

SEQ ID NO: 1097056 - protein, 9 aa, Homo Sapiens
SLRDLLEAG

SEQ ID NO: 1097057 - protein, 9 aa, Homo Sapiens
KHPLTFRLP

SEQ ID NO: 1097058 - protein, 9 aa, Homo Sapiens
TYPVVLPPE

SEQ ID NO: 1097059 - protein, 9 aa, Homo Sapiens
HAAALALDV

SEQ ID NO: 1097060 - protein, 9 aa, Homo Sapiens
RRTLYLLAP

SEQ ID NO: 1097061 - protein, 9 aa, Homo Sapiens
ALHVHLCCH

SEQ ID NO: 1097062 - protein, 9 aa, Homo Sapiens
EMALPSVDP

SEQ ID NO: 1097063 - protein, 9 aa, Homo Sapiens
GPPSGPGGL

SEQ ID NO: 1097064 - protein, 9 aa, Homo Sapiens
RKKREKIIN

SEQ ID NO: 1097065 - protein, 9 aa, Homo Sapiens
VLGLLEGFL

SEQ ID NO: 1097066 - protein, 9 aa, Homo Sapiens
LGGAQAARI

SEQ ID NO: 1097067 - protein, 9 aa, Homo Sapiens
MNWVGGPGP

SEQ ID NO: 1097068 - protein, 9 aa, Homo Sapiens
QSVQQALHS

SEQ ID NO: 1097069 - protein, 9 aa, Homo Sapiens
KVWTASGQR

SEQ ID NO: 1097070 - protein, 9 aa, Homo Sapiens
RLPSLPFTG

SEQ ID NO: 1097071 - protein, 9 aa, Homo Sapiens
SLLFSIRRW

SEQ ID NO: 1097072 - protein, 9 aa, Homo Sapiens
PRRMQLRLI

SEQ ID NO: 1097073 - protein, 9 aa, Homo Sapiens
CNTFREILC

SEQ ID NO: 1097074 - protein, 9 aa, Homo Sapiens
PAPHGLWSP

SEQ ID NO: 1097075 - protein, 9 aa, Homo Sapiens
GYIEEWDLV

SEQ ID NO: 1097076 - protein, 9 aa, Homo Sapiens
YEGYKYEQI

SEQ ID NO: 1097077 - protein, 9 aa, Homo Sapiens
FLNYAMSSS

SEQ ID NO: 1097078 - protein, 9 aa, Homo Sapiens
TNSSYGGPA

SEQ ID NO: 1097079 - protein, 9 aa, Homo Sapiens
CASVHPKTY

SEQ ID NO: 1097080 - protein, 9 aa, Homo Sapiens
NGVLDFFSR

SEQ ID NO: 1097081 - protein, 9 aa, Homo Sapiens
PGSEPQGPS

SEQ ID NO: 1097082 - protein, 9 aa, Homo Sapiens
GPGEAGDGK

SEQ ID NO: 1097083 - protein, 9 aa, Homo Sapiens
NLGNNYDTA

SEQ ID NO: 1097084 - protein, 9 aa, Homo Sapiens
RTRPNRVLT

SEQ ID NO: 1097085 - protein, 9 aa, Homo Sapiens
SDLLEECLQ

SEQ ID NO: 1097086 - protein, 9 aa, Homo Sapiens
SVLLAAFWT

SEQ ID NO: 1097087 - protein, 9 aa, Homo Sapiens
ARLLLQITK

SEQ ID NO: 1097088 - protein, 9 aa, Homo Sapiens
GAGSPTLGR

SEQ ID NO: 1097089 - protein, 9 aa, Homo Sapiens
MSADHYLVV

SEQ ID NO: 1097090 - protein, 9 aa, Homo Sapiens
PANVWMLMT

SEQ ID NO: 1097091 - protein, 9 aa, Homo Sapiens
NHSLLALGG

SEQ ID NO: 1097092 - protein, 9 aa, Homo Sapiens
LAREGRARV

SEQ ID NO: 1097093 - protein, 9 aa, Homo Sapiens
SKHGIITMR

SEQ ID NO: 1097094 - protein, 9 aa, Homo Sapiens
RSQRLPWAG

SEQ ID NO: 1097095 - protein, 9 aa, Homo Sapiens
SFHGKVEKH

SEQ ID NO: 1097096 - protein, 9 aa, Homo Sapiens
TPAPASRSL

SEQ ID NO: 1097097 - protein, 9 aa, Homo Sapiens
TLYTVRGLW

SEQ ID NO: 1097098 - protein, 9 aa, Homo Sapiens
NTNSISVFQ

SEQ ID NO: 1097099 - protein, 9 aa, Homo Sapiens
DGAHVWLLP

SEQ ID NO: 1097100 - protein, 9 aa, Homo Sapiens
SACPSQFRA

SEQ ID NO: 1097101 - protein, 9 aa, Homo Sapiens
CLWDVSVQV

SEQ ID NO: 1097102 - protein, 9 aa, Homo Sapiens
RREHPHPTV

SEQ ID NO: 1097103 - protein, 9 aa, Homo Sapiens
KEARQLSGV

SEQ ID NO: 1097104 - protein, 9 aa, Homo Sapiens
TCWPRRTLY

SEQ ID NO: 1097105 - protein, 9 aa, Homo Sapiens
IGQLWECLS

SEQ ID NO: 1097106 - protein, 9 aa, Homo Sapiens
LVLSSTLRI

SEQ ID NO: 1097107 - protein, 9 aa, Homo Sapiens
ATAQIQRPI

SEQ ID NO: 1097108 - protein, 9 aa, Homo Sapiens
HGNALQTSG

SEQ ID NO: 1097109 - protein, 9 aa, Homo Sapiens
WLPMRSLGE

SEQ ID NO: 1097110 - protein, 9 aa, Homo Sapiens
YFLNGSFVS

SEQ ID NO: 1097111 - protein, 9 aa, Homo Sapiens
YFLYQILRE

SEQ ID NO: 1097112 - protein, 9 aa, Homo Sapiens
AGSLVCSTS

SEQ ID NO: 1097113 - protein, 9 aa, Homo Sapiens
AALVLRPPT

SEQ ID NO: 1097114 - protein, 9 aa, Homo Sapiens
GWLPQQGRP

SEQ ID NO: 1097115 - protein, 9 aa, Homo Sapiens
RKTQAQSIL

SEQ ID NO: 1097116 - protein, 9 aa, Homo Sapiens
LFQKLPKNA

SEQ ID NO: 1097117 - protein, 9 aa, Homo Sapiens
AGRPIKRSL

SEQ ID NO: 1097118 - protein, 9 aa, Homo Sapiens
IFHSGMLPL

SEQ ID NO: 1097119 - protein, 9 aa, Homo Sapiens
PICSKLSSA

SEQ ID NO: 1097120 - protein, 9 aa, Homo Sapiens
VSRDKTLRI

SEQ ID NO: 1097121 - protein, 9 aa, Homo Sapiens
EVDINQLTE

SEQ ID NO: 1097122 - protein, 9 aa, Homo Sapiens
LCCEGALEP

SEQ ID NO: 1097123 - protein, 9 aa, Homo Sapiens
HWCVNPSRT

SEQ ID NO: 1097124 - protein, 9 aa, Homo Sapiens
SWQYQHIHF

SEQ ID NO: 1097125 - protein, 9 aa, Homo Sapiens
LLQGKLVLL

SEQ ID NO: 1097126 - protein, 9 aa, Homo Sapiens
VAGRNSHVA

SEQ ID NO: 1097127 - protein, 9 aa, Homo Sapiens
LLSDREKVI

SEQ ID NO: 1097128 - protein, 9 aa, Homo Sapiens
AVNVNDKFI

SEQ ID NO: 1097129 - protein, 9 aa, Homo Sapiens
SSAPRPGAA

SEQ ID NO: 1097130 - protein, 9 aa, Homo Sapiens
RIIFDCSHS

SEQ ID NO: 1097131 - protein, 9 aa, Homo Sapiens
KTAQIAKKP

SEQ ID NO: 1097132 - protein, 9 aa, Homo Sapiens
AVPAETVGH

SEQ ID NO: 1097133 - protein, 9 aa, Homo Sapiens
CQLCCGKLL

SEQ ID NO: 1097134 - protein, 9 aa, Homo Sapiens
PEVVGAWAA

SEQ ID NO: 1097135 - protein, 9 aa, Homo Sapiens
VSLWMENEH

SEQ ID NO: 1097136 - protein, 9 aa, Homo Sapiens
MWLLTYVGT

SEQ ID NO: 1097137 - protein, 9 aa, Homo Sapiens
ASWQVTPDQ

SEQ ID NO: 1097138 - protein, 9 aa, Homo Sapiens
GRAVQKLQA

SEQ ID NO: 1097139 - protein, 9 aa, Homo Sapiens
NIQSSLKQK

SEQ ID NO: 1097140 - protein, 9 aa, Homo Sapiens
LIAQSIGQV

SEQ ID NO: 1097141 - protein, 9 aa, Homo Sapiens
LAFYPPHTD

SEQ ID NO: 1097142 - protein, 9 aa, Homo Sapiens
AKASREIAN

SEQ ID NO: 1097143 - protein, 9 aa, Homo Sapiens
CSPSPKKPL

SEQ ID NO: 1097144 - protein, 9 aa, Homo Sapiens
MDHVLLKYT

SEQ ID NO: 1097145 - protein, 9 aa, Homo Sapiens
HHHPRIPGV

SEQ ID NO: 1097146 - protein, 9 aa, Homo Sapiens
KCKPLFYTI

SEQ ID NO: 1097147 - protein, 9 aa, Homo Sapiens
SPPCAARAS

SEQ ID NO: 1097148 - protein, 9 aa, Homo Sapiens
LDYNPRERT

SEQ ID NO: 1097149 - protein, 9 aa, Homo Sapiens
HSRLRAWGS

SEQ ID NO: 1097150 - protein, 9 aa, Homo Sapiens
GADRGSWER

SEQ ID NO: 1097151 - protein, 9 aa, Homo Sapiens
LVLLSVTTG

SEQ ID NO: 1097152 - protein, 9 aa, Homo Sapiens
QSPSWPLQP

SEQ ID NO: 1097153 - protein, 9 aa, Homo Sapiens
RASWWPSRR

SEQ ID NO: 1097154 - protein, 9 aa, Homo Sapiens
GTQGPLHPV

SEQ ID NO: 1097155 - protein, 9 aa, Homo Sapiens
KGSLDCLLQ

SEQ ID NO: 1097156 - protein, 9 aa, Homo Sapiens
PQCTFFFLH

SEQ ID NO: 1097157 - protein, 9 aa, Homo Sapiens
LKGHTSQVL

SEQ ID NO: 1097158 - protein, 9 aa, Homo Sapiens
KEVTPYRRQ

SEQ ID NO: 1097159 - protein, 9 aa, Homo Sapiens
RTLNCIGMK

SEQ ID NO: 1097160 - protein, 9 aa, Homo Sapiens
CCRVGKSCC

SEQ ID NO: 1097161 - protein, 9 aa, Homo Sapiens
PSIFSTWII

SEQ ID NO: 1097162 - protein, 9 aa, Homo Sapiens
WGQLLLLLL

SEQ ID NO: 1097163 - protein, 9 aa, Homo Sapiens
GSPRPGPRG

SEQ ID NO: 1097164 - protein, 9 aa, Homo Sapiens
HGTMPIAIN

SEQ ID NO: 1097165 - protein, 9 aa, Homo Sapiens
GWQMRASTP

SEQ ID NO: 1097166 - protein, 9 aa, Homo Sapiens
LLREWFMEC

SEQ ID NO: 1097167 - protein, 9 aa, Homo Sapiens
EDHQSFRNT

SEQ ID NO: 1097168 - protein, 9 aa, Homo Sapiens
TSLRIFKWM

SEQ ID NO: 1097169 - protein, 9 aa, Homo Sapiens
WLLSPSRKR

SEQ ID NO: 1097170 - protein, 9 aa, Homo Sapiens
ATPTSGPGP

SEQ ID NO: 1097171 - protein, 9 aa, Homo Sapiens
CSPLRRSPP

SEQ ID NO: 1097172 - protein, 9 aa, Homo Sapiens
APGLIITTG

SEQ ID NO: 1097173 - protein, 9 aa, Homo Sapiens
ETKDTKYVR

SEQ ID NO: 1097174 - protein, 9 aa, Homo Sapiens
ERGKEIFAL

SEQ ID NO: 1097175 - protein, 9 aa, Homo Sapiens
GLVLRVLRV

SEQ ID NO: 1097176 - protein, 9 aa, Homo Sapiens
PLTMESMDA

SEQ ID NO: 1097177 - protein, 9 aa, Homo Sapiens
SPGRHEGHE

SEQ ID NO: 1097178 - protein, 9 aa, Homo Sapiens
RTTMAFLRD

SEQ ID NO: 1097179 - protein, 9 aa, Homo Sapiens
LRWMEAVRW

SEQ ID NO: 1097180 - protein, 9 aa, Homo Sapiens
RSGAKPPGV

SEQ ID NO: 1097181 - protein, 9 aa, Homo Sapiens
YLPSCYHSW

SEQ ID NO: 1097182 - protein, 9 aa, Homo Sapiens
GPGNHPERY

SEQ ID NO: 1097183 - protein, 9 aa, Homo Sapiens
LQKKQRSFA

SEQ ID NO: 1097184 - protein, 9 aa, Homo Sapiens
TMATPSWVW

SEQ ID NO: 1097185 - protein, 9 aa, Homo Sapiens
GLDLRMRGE

SEQ ID NO: 1097186 - protein, 9 aa, Homo Sapiens
VAELALVGP

SEQ ID NO: 1097187 - protein, 9 aa, Homo Sapiens
GKVLLLHGQ

SEQ ID NO: 1097188 - protein, 9 aa, Homo Sapiens
KLKRLRRHL

SEQ ID NO: 1097189 - protein, 9 aa, Homo Sapiens
LCRPSPQCL

SEQ ID NO: 1097190 - protein, 9 aa, Homo Sapiens
THTSRNCTA

SEQ ID NO: 1097191 - protein, 9 aa, Homo Sapiens
ECLSTTRKD

SEQ ID NO: 1097192 - protein, 9 aa, Homo Sapiens
ETPGLLRRE

SEQ ID NO: 1097193 - protein, 9 aa, Homo Sapiens
LETPRHVSQ

SEQ ID NO: 1097194 - protein, 9 aa, Homo Sapiens
PHTTCWPRR

SEQ ID NO: 1097195 - protein, 9 aa, Homo Sapiens
GLLHMDAHT

SEQ ID NO: 1097196 - protein, 9 aa, Homo Sapiens
RPGVKLWKK

SEQ ID NO: 1097197 - protein, 9 aa, Homo Sapiens
AWGSASCFS

SEQ ID NO: 1097198 - protein, 9 aa, Homo Sapiens
HCGSLMEGH

SEQ ID NO: 1097199 - protein, 9 aa, Homo Sapiens
RAAGRWGPA

SEQ ID NO: 1097200 - protein, 9 aa, Homo Sapiens
RNNQGRDAH

SEQ ID NO: 1097201 - protein, 9 aa, Homo Sapiens
EVDWEYFMA

SEQ ID NO: 1097202 - protein, 9 aa, Homo Sapiens
VFLFFTIFC

SEQ ID NO: 1097203 - protein, 9 aa, Homo Sapiens
CGTGSRRGC

SEQ ID NO: 1097204 - protein, 9 aa, Homo Sapiens
ARSHWGALM

SEQ ID NO: 1097205 - protein, 9 aa, Homo Sapiens
NGSQAMLYN

SEQ ID NO: 1097206 - protein, 9 aa, Homo Sapiens
RTCHLMPGP

SEQ ID NO: 1097207 - protein, 9 aa, Homo Sapiens
GEWKTGCFK

SEQ ID NO: 1097208 - protein, 9 aa, Homo Sapiens
PGWRPRSRG

SEQ ID NO: 1097209 - protein, 9 aa, Homo Sapiens
LREVLRTVK

SEQ ID NO: 1097210 - protein, 9 aa, Homo Sapiens
ELRILMELR

SEQ ID NO: 1097211 - protein, 9 aa, Homo Sapiens
LYVLILLIL

SEQ ID NO: 1097212 - protein, 9 aa, Homo Sapiens
IQVVVESFM

SEQ ID NO: 1097213 - protein, 9 aa, Homo Sapiens
MDDIIEQKS

SEQ ID NO: 1097214 - protein, 9 aa, Homo Sapiens
AKGSTTRAS

SEQ ID NO: 1097215 - protein, 9 aa, Homo Sapiens
WMFLRILEQ

SEQ ID NO: 1097216 - protein, 9 aa, Homo Sapiens
QLCGLKEVG

SEQ ID NO: 1097217 - protein, 9 aa, Homo Sapiens
HMCFHNMSD

SEQ ID NO: 1097218 - protein, 9 aa, Homo Sapiens
AVLSSEPVE

SEQ ID NO: 1097219 - protein, 9 aa, Homo Sapiens
LGVCGHLKP

SEQ ID NO: 1097220 - protein, 9 aa, Homo Sapiens
QQRNWLTVL

SEQ ID NO: 1097221 - protein, 9 aa, Homo Sapiens
DRGSWERHL

SEQ ID NO: 1097222 - protein, 9 aa, Homo Sapiens
VFNLFCLYE

SEQ ID NO: 1097223 - protein, 9 aa, Homo Sapiens
RTPSISPVE

SEQ ID NO: 1097224 - protein, 9 aa, Homo Sapiens
DSSINHFFV

SEQ ID NO: 1097225 - protein, 9 aa, Homo Sapiens
PPSGTPPSP

SEQ ID NO: 1097226 - protein, 9 aa, Homo Sapiens
EEMCDTNES

SEQ ID NO: 1097227 - protein, 9 aa, Homo Sapiens
PRRTLYLLA

SEQ ID NO: 1097228 - protein, 9 aa, Homo Sapiens
EPPAAPPAA

SEQ ID NO: 1097229 - protein, 9 aa, Homo Sapiens
ASAFDAFRS

SEQ ID NO: 1097230 - protein, 9 aa, Homo Sapiens
DDPTGNVRS

SEQ ID NO: 1097231 - protein, 9 aa, Homo Sapiens
RAHLALHSA

SEQ ID NO: 1097232 - protein, 9 aa, Homo Sapiens
SVPGPPPRP

SEQ ID NO: 1097233 - protein, 9 aa, Homo Sapiens
LCSSASSAW

SEQ ID NO: 1097234 - protein, 9 aa, Homo Sapiens
QNLSCFVWK

SEQ ID NO: 1097235 - protein, 9 aa, Homo Sapiens
VIHLLNGLL

SEQ ID NO: 1097236 - protein, 9 aa, Homo Sapiens
FPGHRVNAK

SEQ ID NO: 1097237 - protein, 9 aa, Homo Sapiens
TVVSMAVAL

SEQ ID NO: 1097238 - protein, 9 aa, Homo Sapiens
AGRGSLLLL

SEQ ID NO: 1097239 - protein, 9 aa, Homo Sapiens
VVVHELGVA

SEQ ID NO: 1097240 - protein, 9 aa, Homo Sapiens
RKAKGEEKP

SEQ ID NO: 1097241 - protein, 9 aa, Homo Sapiens
SAIGQDQRR

SEQ ID NO: 1097242 - protein, 9 aa, Homo Sapiens
RTCSQGERC

SEQ ID NO: 1097243 - protein, 9 aa, Homo Sapiens
FHTMATRTH

SEQ ID NO: 1097244 - protein, 9 aa, Homo Sapiens
QGTQARPPP

SEQ ID NO: 1097245 - protein, 9 aa, Homo Sapiens
DSDHYQWFQ

SEQ ID NO: 1097246 - protein, 9 aa, Homo Sapiens
FTASALPSP

SEQ ID NO: 1097247 - protein, 9 aa, Homo Sapiens
CSELSSVHE

SEQ ID NO: 1097248 - protein, 9 aa, Homo Sapiens
CVRGHRKGQ

SEQ ID NO: 1097249 - protein, 9 aa, Homo Sapiens
TSSSREWKV

SEQ ID NO: 1097250 - protein, 9 aa, Homo Sapiens
VLPPSLWAP

SEQ ID NO: 1097251 - protein, 9 aa, Homo Sapiens
EVIREGWRW

SEQ ID NO: 1097252 - protein, 9 aa, Homo Sapiens
ALVATTINL

SEQ ID NO: 1097253 - protein, 9 aa, Homo Sapiens
ELQSVAVGA

SEQ ID NO: 1097254 - protein, 9 aa, Homo Sapiens
SHAPQSCSS

SEQ ID NO: 1097255 - protein, 9 aa, Homo Sapiens
LYGSYPPAR

SEQ ID NO: 1097256 - protein, 9 aa, Homo Sapiens
TAGSAKGAV

SEQ ID NO: 1097257 - protein, 9 aa, Homo Sapiens
PVKSKNIQV

SEQ ID NO: 1097258 - protein, 9 aa, Homo Sapiens
LCSFHCSDR

SEQ ID NO: 1097259 - protein, 9 aa, Homo Sapiens
KTWTFYGTP

SEQ ID NO: 1097260 - protein, 9 aa, Homo Sapiens
TVGLVWVAA

SEQ ID NO: 1097261 - protein, 9 aa, Homo Sapiens
QDRNLRPKF

SEQ ID NO: 1097262 - protein, 9 aa, Homo Sapiens
LYGKKLVKI

SEQ ID NO: 1097263 - protein, 9 aa, Homo Sapiens
SGNSDNLRK

SEQ ID NO: 1097264 - protein, 9 aa, Homo Sapiens
QLAQLPDSV

SEQ ID NO: 1097265 - protein, 9 aa, Homo Sapiens
TKKEMVTSK

SEQ ID NO: 1097266 - protein, 9 aa, Homo Sapiens
LTSMSDDAL

SEQ ID NO: 1097267 - protein, 9 aa, Homo Sapiens
RPAADMQFM

SEQ ID NO: 1097268 - protein, 9 aa, Homo Sapiens
RLARAPRAS

SEQ ID NO: 1097269 - protein, 9 aa, Homo Sapiens
TVLEQLFEE

SEQ ID NO: 1097270 - protein, 9 aa, Homo Sapiens
PGAAAAWRL

SEQ ID NO: 1097271 - protein, 9 aa, Homo Sapiens
GQLPRPLPH

SEQ ID NO: 1097272 - protein, 9 aa, Homo Sapiens
QHRMSLHLH

SEQ ID NO: 1097273 - protein, 9 aa, Homo Sapiens
QQLVWPDTT

SEQ ID NO: 1097274 - protein, 9 aa, Homo Sapiens
AARPRRTRS

SEQ ID NO: 1097275 - protein, 9 aa, Homo Sapiens
DTVILYRSY

SEQ ID NO: 1097276 - protein, 9 aa, Homo Sapiens
GLWPNTIYL

SEQ ID NO: 1097277 - protein, 9 aa, Homo Sapiens
MKETLWIRR

SEQ ID NO: 1097278 - protein, 9 aa, Homo Sapiens
GGNRSICLT

SEQ ID NO: 1097279 - protein, 9 aa, Homo Sapiens
LLRQLGKGT

SEQ ID NO: 1097280 - protein, 9 aa, Homo Sapiens
PDTHVTLQQ

SEQ ID NO: 1097281 - protein, 9 aa, Homo Sapiens
PGLHTAVPP

SEQ ID NO: 1097282 - protein, 9 aa, Homo Sapiens
GEVITQQGR

SEQ ID NO: 1097283 - protein, 9 aa, Homo Sapiens
LIRASALCV

SEQ ID NO: 1097284 - protein, 9 aa, Homo Sapiens
QPKTAGAAD

SEQ ID NO: 1097285 - protein, 9 aa, Homo Sapiens
RKPLELFGK

SEQ ID NO: 1097286 - protein, 9 aa, Homo Sapiens
LGSDVARPL

SEQ ID NO: 1097287 - protein, 9 aa, Homo Sapiens
LYYQDKVEQ

SEQ ID NO: 1097288 - protein, 9 aa, Homo Sapiens
PGSPPGCTQ

SEQ ID NO: 1097289 - protein, 9 aa, Homo Sapiens
PGPHRPERG

SEQ ID NO: 1097290 - protein, 9 aa, Homo Sapiens
LLCNPKPWS

SEQ ID NO: 1097291 - protein, 9 aa, Homo Sapiens
LSLSYLMEL

SEQ ID NO: 1097292 - protein, 9 aa, Homo Sapiens
YGAISKLKN

SEQ ID NO: 1097293 - protein, 9 aa, Homo Sapiens
PHTHWTIQK

SEQ ID NO: 1097294 - protein, 9 aa, Homo Sapiens
HYYRRSPHR

SEQ ID NO: 1097295 - protein, 9 aa, Homo Sapiens
LYNCRNNLA

SEQ ID NO: 1097296 - protein, 9 aa, Homo Sapiens
FRLQDLSKL

SEQ ID NO: 1097297 - protein, 9 aa, Homo Sapiens
AAASMDHSS

SEQ ID NO: 1097298 - protein, 9 aa, Homo Sapiens
GRSLSCCPR

SEQ ID NO: 1097299 - protein, 9 aa, Homo Sapiens
ITRPGVKLW

SEQ ID NO: 1097300 - protein, 9 aa, Homo Sapiens
YGSGSGSSS

SEQ ID NO: 1097301 - protein, 9 aa, Homo Sapiens
VQELRMAMK

SEQ ID NO: 1097302 - protein, 9 aa, Homo Sapiens
KICVNCCWP

SEQ ID NO: 1097303 - protein, 9 aa, Homo Sapiens
LFESPLGGS

SEQ ID NO: 1097304 - protein, 9 aa, Homo Sapiens
KRAVPGSPP

SEQ ID NO: 1097305 - protein, 9 aa, Homo Sapiens
GSTPPPPPG

SEQ ID NO: 1097306 - protein, 9 aa, Homo Sapiens
HCEPCPAVT

SEQ ID NO: 1097307 - protein, 9 aa, Homo Sapiens
ICNLISMTL

SEQ ID NO: 1097308 - protein, 9 aa, Homo Sapiens
LLKKCSLYG

SEQ ID NO: 1097309 - protein, 9 aa, Homo Sapiens
HKDMIAPEE

SEQ ID NO: 1097310 - protein, 9 aa, Homo Sapiens
AHKAGLLCV

SEQ ID NO: 1097311 - protein, 9 aa, Homo Sapiens
PSGPGGLPI

SEQ ID NO: 1097312 - protein, 9 aa, Homo Sapiens
IPETSLSVS

SEQ ID NO: 1097313 - protein, 9 aa, Homo Sapiens
FPAVGLELL

SEQ ID NO: 1097314 - protein, 9 aa, Homo Sapiens
KQILSRVWN

SEQ ID NO: 1097315 - protein, 9 aa, Homo Sapiens
WSKMESRTL

SEQ ID NO: 1097316 - protein, 9 aa, Homo Sapiens
DEDKGTEGE

SEQ ID NO: 1097317 - protein, 9 aa, Homo Sapiens
LDMCTIATA

SEQ ID NO: 1097318 - protein, 9 aa, Homo Sapiens
IALWGERNS

SEQ ID NO: 1097319 - protein, 9 aa, Homo Sapiens
SHCLLTAHL

SEQ ID NO: 1097320 - protein, 9 aa, Homo Sapiens
LICQQQRKE

SEQ ID NO: 1097321 - protein, 9 aa, Homo Sapiens
GVRMGLFTP

SEQ ID NO: 1097322 - protein, 9 aa, Homo Sapiens
FPEALRLVL

SEQ ID NO: 1097323 - protein, 9 aa, Homo Sapiens
DIKACTCFV

SEQ ID NO: 1097324 - protein, 9 aa, Homo Sapiens
QNFQSPPQP

SEQ ID NO: 1097325 - protein, 9 aa, Homo Sapiens
APCPPLEVH

SEQ ID NO: 1097326 - protein, 9 aa, Homo Sapiens
AVHDGAARG

SEQ ID NO: 1097327 - protein, 9 aa, Homo Sapiens
TQATPAPTW

SEQ ID NO: 1097328 - protein, 9 aa, Homo Sapiens
SVHEVLSSC

SEQ ID NO: 1097329 - protein, 9 aa, Homo Sapiens
QALLYGDCV

SEQ ID NO: 1097330 - protein, 9 aa, Homo Sapiens
MGGDTAMPY

SEQ ID NO: 1097331 - protein, 9 aa, Homo Sapiens
EARQLSGVK

SEQ ID NO: 1097332 - protein, 9 aa, Homo Sapiens
IYQNANSVE

SEQ ID NO: 1097333 - protein, 9 aa, Homo Sapiens
EARRVHHLH

SEQ ID NO: 1097334 - protein, 9 aa, Homo Sapiens
SSPASVQSK

SEQ ID NO: 1097335 - protein, 9 aa, Homo Sapiens
RDCSPLRRS

SEQ ID NO: 1097336 - protein, 9 aa, Homo Sapiens
GEQIPGLLG

SEQ ID NO: 1097337 - protein, 9 aa, Homo Sapiens
VLVAGAVQE

SEQ ID NO: 1097338 - protein, 9 aa, Homo Sapiens
RRSGWTRAA

SEQ ID NO: 1097339 - protein, 9 aa, Homo Sapiens
GRKWRSYNV

SEQ ID NO: 1097340 - protein, 9 aa, Homo Sapiens
TPLTTQSWI

SEQ ID NO: 1097341 - protein, 9 aa, Homo Sapiens
RKLKQMLNN

SEQ ID NO: 1097342 - protein, 9 aa, Homo Sapiens
REFQLKVRL

SEQ ID NO: 1097343 - protein, 9 aa, Homo Sapiens
ADVAEARVA

SEQ ID NO: 1097344 - protein, 9 aa, Homo Sapiens
VADGALLRG

SEQ ID NO: 1097345 - protein, 9 aa, Homo Sapiens
AFQKSLAQL

SEQ ID NO: 1097346 - protein, 9 aa, Homo Sapiens
GARGRTGAV

SEQ ID NO: 1097347 - protein, 9 aa, Homo Sapiens
PAKKNKENQ

SEQ ID NO: 1097348 - protein, 9 aa, Homo Sapiens
ECEKCGKVF

SEQ ID NO: 1097349 - protein, 9 aa, Homo Sapiens
ACGALPLGL

SEQ ID NO: 1097350 - protein, 9 aa, Homo Sapiens
GWTLGADRG

SEQ ID NO: 1097351 - protein, 9 aa, Homo Sapiens
KPLISREQH

SEQ ID NO: 1097352 - protein, 9 aa, Homo Sapiens
AAREMALRA

SEQ ID NO: 1097353 - protein, 9 aa, Homo Sapiens
HLPVASCPA

SEQ ID NO: 1097354 - protein, 9 aa, Homo Sapiens
SQNDTYDVP

SEQ ID NO: 1097355 - protein, 9 aa, Homo Sapiens
SSHTGYHTT

SEQ ID NO: 1097356 - protein, 9 aa, Homo Sapiens
TVDHSHVFT

SEQ ID NO: 1097357 - protein, 9 aa, Homo Sapiens
CPCHLPLPW

SEQ ID NO: 1097358 - protein, 9 aa, Homo Sapiens
YQERANKKQ

SEQ ID NO: 1097359 - protein, 9 aa, Homo Sapiens
SSAHQKTPL

SEQ ID NO: 1097360 - protein, 9 aa, Homo Sapiens
VSQLAFSCD

SEQ ID NO: 1097361 - protein, 9 aa, Homo Sapiens
VGSLGQFLQ

SEQ ID NO: 1097362 - protein, 9 aa, Homo Sapiens
PAETVGHFS

SEQ ID NO: 1097363 - protein, 9 aa, Homo Sapiens
AGCRHSVPE

SEQ ID NO: 1097364 - protein, 9 aa, Homo Sapiens
SYYSSYYGG

SEQ ID NO: 1097365 - protein, 9 aa, Homo Sapiens
ERCWRSCSA

SEQ ID NO: 1097366 - protein, 9 aa, Homo Sapiens
MGYSTTAFC

SEQ ID NO: 1097367 - protein, 9 aa, Homo Sapiens
PSQVWTAAT

SEQ ID NO: 1097368 - protein, 9 aa, Homo Sapiens
FLQNPQVCL

SEQ ID NO: 1097369 - protein, 9 aa, Homo Sapiens
NLPGSTDHP

SEQ ID NO: 1097370 - protein, 9 aa, Homo Sapiens
QPTSPGTCH

SEQ ID NO: 1097371 - protein, 9 aa, Homo Sapiens
ICSLDLRMG

SEQ ID NO: 1097372 - protein, 9 aa, Homo Sapiens
GQFQGHREG

SEQ ID NO: 1097373 - protein, 9 aa, Homo Sapiens
SYGSGSGSS

SEQ ID NO: 1097374 - protein, 9 aa, Homo Sapiens
RLVREIVQD

SEQ ID NO: 1097375 - protein, 9 aa, Homo Sapiens
KASTGVVQD

SEQ ID NO: 1097376 - protein, 9 aa, Homo Sapiens
TPGARLLLQ

SEQ ID NO: 1097377 - protein, 9 aa, Homo Sapiens
NSSPNSLES

SEQ ID NO: 1097378 - protein, 9 aa, Homo Sapiens
PNVNSSVTT

SEQ ID NO: 1097379 - protein, 9 aa, Homo Sapiens
NRISPLLTI

SEQ ID NO: 1097380 - protein, 9 aa, Homo Sapiens
LWTLHAFGR

SEQ ID NO: 1097381 - protein, 9 aa, Homo Sapiens
RVLLDSLPP

SEQ ID NO: 1097382 - protein, 9 aa, Homo Sapiens
LRVSECEEI

SEQ ID NO: 1097383 - protein, 9 aa, Homo Sapiens
LSHLSRLWA

SEQ ID NO: 1097384 - protein, 9 aa, Homo Sapiens
YGYQQTYSL

SEQ ID NO: 1097385 - protein, 9 aa, Homo Sapiens
IFQEMLYIV

SEQ ID NO: 1097386 - protein, 9 aa, Homo Sapiens
VEGGWPQVS

SEQ ID NO: 1097387 - protein, 9 aa, Homo Sapiens
VRPGCRGLG

SEQ ID NO: 1097388 - protein, 9 aa, Homo Sapiens
ALLSVCKFT

SEQ ID NO: 1097389 - protein, 9 aa, Homo Sapiens
HGCLLAYIS

SEQ ID NO: 1097390 - protein, 9 aa, Homo Sapiens
AEEVGGGVG

SEQ ID NO: 1097391 - protein, 9 aa, Homo Sapiens
NLTLVVVLP

SEQ ID NO: 1097392 - protein, 9 aa, Homo Sapiens
PNPDHLPRR

SEQ ID NO: 1097393 - protein, 9 aa, Homo Sapiens
GGQVGHGVW

SEQ ID NO: 1097394 - protein, 9 aa, Homo Sapiens
GLENILQLG

SEQ ID NO: 1097395 - protein, 9 aa, Homo Sapiens
VLTHKQNYM

SEQ ID NO: 1097396 - protein, 9 aa, Homo Sapiens
AALVSWKQS

SEQ ID NO: 1097397 - protein, 9 aa, Homo Sapiens
FELVARVVS

SEQ ID NO: 1097398 - protein, 9 aa, Homo Sapiens
HRCIGKEQE

SEQ ID NO: 1097399 - protein, 9 aa, Homo Sapiens
TRKDHPGLK

SEQ ID NO: 1097400 - protein, 9 aa, Homo Sapiens
TFLQSKYGG

SEQ ID NO: 1097401 - protein, 9 aa, Homo Sapiens
IASTLPGLR

SEQ ID NO: 1097402 - protein, 9 aa, Homo Sapiens
TADVPTYKE

SEQ ID NO: 1097403 - protein, 9 aa, Homo Sapiens
PAAHGPARP

SEQ ID NO: 1097404 - protein, 9 aa, Homo Sapiens
MGTVRSNPN

SEQ ID NO: 1097405 - protein, 9 aa, Homo Sapiens
IQVFKPCGT

SEQ ID NO: 1097406 - protein, 9 aa, Homo Sapiens
SQRLWQSPC

SEQ ID NO: 1097407 - protein, 9 aa, Homo Sapiens
LPGMGPHVP

SEQ ID NO: 1097408 - protein, 9 aa, Homo Sapiens
TGLPPCTVA

SEQ ID NO: 1097409 - protein, 9 aa, Homo Sapiens
PECPQQLPH

SEQ ID NO: 1097410 - protein, 9 aa, Homo Sapiens
ALVLRPPTL

SEQ ID NO: 1097411 - protein, 9 aa, Homo Sapiens
MMSPKIEVA

SEQ ID NO: 1097412 - protein, 9 aa, Homo Sapiens
FHSGMLPLE

SEQ ID NO: 1097413 - protein, 9 aa, Homo Sapiens
NFCTFFCRD

SEQ ID NO: 1097414 - protein, 9 aa, Homo Sapiens
LDQVMDMMI

SEQ ID NO: 1097415 - protein, 9 aa, Homo Sapiens
VLQAVAAEH

SEQ ID NO: 1097416 - protein, 9 aa, Homo Sapiens
GRQLRVPDT

SEQ ID NO: 1097417 - protein, 9 aa, Homo Sapiens
YYPLLSTCC

SEQ ID NO: 1097418 - protein, 9 aa, Homo Sapiens
AVGSLGQFL

SEQ ID NO: 1097419 - protein, 9 aa, Homo Sapiens
FDPAGWVLL

SEQ ID NO: 1097420 - protein, 9 aa, Homo Sapiens
AALFTPPKE

SEQ ID NO: 1097421 - protein, 9 aa, Homo Sapiens
GLPCSWWWT

SEQ ID NO: 1097422 - protein, 9 aa, Homo Sapiens
ARRSQRLPW

SEQ ID NO: 1097423 - protein, 9 aa, Homo Sapiens
ALQRPAAHG

SEQ ID NO: 1097424 - protein, 9 aa, Homo Sapiens
TLRHLMWMN

SEQ ID NO: 1097425 - protein, 9 aa, Homo Sapiens
RVATVDADD

SEQ ID NO: 1097426 - protein, 9 aa, Homo Sapiens
TPASRTSVT

SEQ ID NO: 1097427 - protein, 9 aa, Homo Sapiens
SVISDCTEI

SEQ ID NO: 1097428 - protein, 9 aa, Homo Sapiens
ANKIVPFLN

SEQ ID NO: 1097429 - protein, 9 aa, Homo Sapiens
SKTLESLSK

SEQ ID NO: 1097430 - protein, 9 aa, Homo Sapiens
GRPYACTQC

SEQ ID NO: 1097431 - protein, 9 aa, Homo Sapiens
AALRAVGTQ

SEQ ID NO: 1097432 - protein, 9 aa, Homo Sapiens
ALRVAGAAR

SEQ ID NO: 1097433 - protein, 9 aa, Homo Sapiens
FLLILCCVV

SEQ ID NO: 1097434 - protein, 9 aa, Homo Sapiens
ALLVQPGSL

SEQ ID NO: 1097435 - protein, 9 aa, Homo Sapiens
FQIYEQHTD

SEQ ID NO: 1097436 - protein, 9 aa, Homo Sapiens
ITLIGLPWP

SEQ ID NO: 1097437 - protein, 9 aa, Homo Sapiens
WWPSRRWTC

SEQ ID NO: 1097438 - protein, 9 aa, Homo Sapiens
ATPYLYQLP

SEQ ID NO: 1097439 - protein, 9 aa, Homo Sapiens
ELFGKVFGN

SEQ ID NO: 1097440 - protein, 9 aa, Homo Sapiens
AVWVPGHED

SEQ ID NO: 1097441 - protein, 9 aa, Homo Sapiens
AGPKRAVPG

SEQ ID NO: 1097442 - protein, 9 aa, Homo Sapiens
LTVIGQGLV

SEQ ID NO: 1097443 - protein, 9 aa, Homo Sapiens
CWRSCSASR

SEQ ID NO: 1097444 - protein, 9 aa, Homo Sapiens
KSLLQAMAN

SEQ ID NO: 1097445 - protein, 9 aa, Homo Sapiens
LRMAMKGAG

SEQ ID NO: 1097446 - protein, 9 aa, Homo Sapiens
LLVRLKKNR

SEQ ID NO: 1097447 - protein, 9 aa, Homo Sapiens
NTRVGTKCY

SEQ ID NO: 1097448 - protein, 9 aa, Homo Sapiens
VQCAHLAAM

SEQ ID NO: 1097449 - protein, 9 aa, Homo Sapiens
GAHRSAKET

SEQ ID NO: 1097450 - protein, 9 aa, Homo Sapiens
AVTERREMR

SEQ ID NO: 1097451 - protein, 9 aa, Homo Sapiens
QKKQRSFAP

SEQ ID NO: 1097452 - protein, 9 aa, Homo Sapiens
FLPLTMESM

SEQ ID NO: 1097453 - protein, 9 aa, Homo Sapiens
QYRGVRAEV

SEQ ID NO: 1097454 - protein, 9 aa, Homo Sapiens
GGREVVAQA

SEQ ID NO: 1097455 - protein, 9 aa, Homo Sapiens
QKFMLYWAN

SEQ ID NO: 1097456 - protein, 9 aa, Homo Sapiens
YLLVPARYR

SEQ ID NO: 1097457 - protein, 9 aa, Homo Sapiens
SRETHLPPI

SEQ ID NO: 1097458 - protein, 9 aa, Homo Sapiens
YRVLIAMVD

SEQ ID NO: 1097459 - protein, 9 aa, Homo Sapiens
GAEGQMGHP

SEQ ID NO: 1097460 - protein, 9 aa, Homo Sapiens
VLRKLKQML

SEQ ID NO: 1097461 - protein, 9 aa, Homo Sapiens
AIKWRGDFE

SEQ ID NO: 1097462 - protein, 9 aa, Homo Sapiens
ASGSTSRRT

SEQ ID NO: 1097463 - protein, 9 aa, Homo Sapiens
MIDQGFDPA

SEQ ID NO: 1097464 - protein, 9 aa, Homo Sapiens
VGKHLGTRK

SEQ ID NO: 1097465 - protein, 9 aa, Homo Sapiens
ERAGAARAS

SEQ ID NO: 1097466 - protein, 9 aa, Homo Sapiens
EGRARVLLL

SEQ ID NO: 1097467 - protein, 9 aa, Homo Sapiens
MMRKLRRSL

SEQ ID NO: 1097468 - protein, 9 aa, Homo Sapiens
LGQFLQVSV

SEQ ID NO: 1097469 - protein, 9 aa, Homo Sapiens
ELLAWDPPP

SEQ ID NO: 1097470 - protein, 9 aa, Homo Sapiens
IKINFIPGL

SEQ ID NO: 1097471 - protein, 9 aa, Homo Sapiens
MNLLGPPSG

SEQ ID NO: 1097472 - protein, 9 aa, Homo Sapiens
HESILRARR

SEQ ID NO: 1097473 - protein, 9 aa, Homo Sapiens
IGRKKSRLP

SEQ ID NO: 1097474 - protein, 9 aa, Homo Sapiens
VLGAQVFAF

SEQ ID NO: 1097475 - protein, 9 aa, Homo Sapiens
AWRLDESLS

SEQ ID NO: 1097476 - protein, 9 aa, Homo Sapiens
FQKKSCEAS

SEQ ID NO: 1097477 - protein, 9 aa, Homo Sapiens
CMAVRSPSR

SEQ ID NO: 1097478 - protein, 9 aa, Homo Sapiens
MNMNIMSEL

SEQ ID NO: 1097479 - protein, 9 aa, Homo Sapiens
LVLMLNDME

SEQ ID NO: 1097480 - protein, 9 aa, Homo Sapiens
TLPTCSKKT

SEQ ID NO: 1097481 - protein, 9 aa, Homo Sapiens
DRSHLQGTQ

SEQ ID NO: 1097482 - protein, 9 aa, Homo Sapiens
FSHAALERY

SEQ ID NO: 1097483 - protein, 9 aa, Homo Sapiens
RSGSGSGGG

SEQ ID NO: 1097484 - protein, 9 aa, Homo Sapiens
TISLAIAAG

SEQ ID NO: 1097485 - protein, 9 aa, Homo Sapiens
SVAVGARIP

SEQ ID NO: 1097486 - protein, 9 aa, Homo Sapiens
LSCPGTACS

SEQ ID NO: 1097487 - protein, 9 aa, Homo Sapiens
RMLDGAITD

SEQ ID NO: 1097488 - protein, 9 aa, Homo Sapiens
EQIDGGITG

SEQ ID NO: 1097489 - protein, 9 aa, Homo Sapiens
RRRHVCKQS

SEQ ID NO: 1097490 - protein, 9 aa, Homo Sapiens
QCDKKKEAQ

SEQ ID NO: 1097491 - protein, 9 aa, Homo Sapiens
WLLYADWPG

SEQ ID NO: 1097492 - protein, 9 aa, Homo Sapiens
GSVRCWVKA

SEQ ID NO: 1097493 - protein, 9 aa, Homo Sapiens
GQPRGLVGC

SEQ ID NO: 1097494 - protein, 9 aa, Homo Sapiens
PMSSSGLPC

SEQ ID NO: 1097495 - protein, 9 aa, Homo Sapiens
VTTMRDFRM

SEQ ID NO: 1097496 - protein, 9 aa, Homo Sapiens
AGKTLDQVM

SEQ ID NO: 1097497 - protein, 9 aa, Homo Sapiens
GGLDLRMRG

SEQ ID NO: 1097498 - protein, 9 aa, Homo Sapiens
LCIFIRNCI

SEQ ID NO: 1097499 - protein, 9 aa, Homo Sapiens
IEEVSPVSQ

SEQ ID NO: 1097500 - protein, 9 aa, Homo Sapiens
TVLIVGCIA

SEQ ID NO: 1097501 - protein, 9 aa, Homo Sapiens
GNDNISQLT

SEQ ID NO: 1097502 - protein, 9 aa, Homo Sapiens
TIPSFCWPS

SEQ ID NO: 1097503 - protein, 9 aa, Homo Sapiens
KHSPICRTT

SEQ ID NO: 1097504 - protein, 9 aa, Homo Sapiens
IPLQAGQVQ

SEQ ID NO: 1097505 - protein, 9 aa, Homo Sapiens
LLVHNRVAP

SEQ ID NO: 1097506 - protein, 9 aa, Homo Sapiens
PAQATTPLD

SEQ ID NO: 1097507 - protein, 9 aa, Homo Sapiens
HERCVAQAP

SEQ ID NO: 1097508 - protein, 9 aa, Homo Sapiens
QEAVMLLRQ

SEQ ID NO: 1097509 - protein, 9 aa, Homo Sapiens
EEMRVLLDS

SEQ ID NO: 1097510 - protein, 9 aa, Homo Sapiens
LDLITFLTS

SEQ ID NO: 1097511 - protein, 9 aa, Homo Sapiens
RSSEGLLSF

SEQ ID NO: 1097512 - protein, 9 aa, Homo Sapiens
VPAAPAAMR

SEQ ID NO: 1097513 - protein, 9 aa, Homo Sapiens
NDTYDVPRG

SEQ ID NO: 1097514 - protein, 9 aa, Homo Sapiens
STSQTPLLS

SEQ ID NO: 1097515 - protein, 9 aa, Homo Sapiens
TDLTVLGQP

SEQ ID NO: 1097516 - protein, 9 aa, Homo Sapiens
LRAVGTQIS

SEQ ID NO: 1097517 - protein, 9 aa, Homo Sapiens
PGLLGSPLL

SEQ ID NO: 1097518 - protein, 9 aa, Homo Sapiens
APWPLLLLL

SEQ ID NO: 1097519 - protein, 9 aa, Homo Sapiens
PLMIKNRIS

SEQ ID NO: 1097520 - protein, 9 aa, Homo Sapiens
LCTVSASLL

SEQ ID NO: 1097521 - protein, 9 aa, Homo Sapiens
LVPDGAWAE

SEQ ID NO: 1097522 - protein, 9 aa, Homo Sapiens
VAAAVWASV

SEQ ID NO: 1097523 - protein, 9 aa, Homo Sapiens
LPIPGSNCS

SEQ ID NO: 1097524 - protein, 9 aa, Homo Sapiens
FKGAREHIC

SEQ ID NO: 1097525 - protein, 9 aa, Homo Sapiens
YMVSYDIPV

SEQ ID NO: 1097526 - protein, 9 aa, Homo Sapiens
RLRKLQSAD

SEQ ID NO: 1097527 - protein, 9 aa, Homo Sapiens
HSEPSMWAF

SEQ ID NO: 1097528 - protein, 9 aa, Homo Sapiens
LEATEAGAP

SEQ ID NO: 1097529 - protein, 9 aa, Homo Sapiens
LQITKRTWR

SEQ ID NO: 1097530 - protein, 9 aa, Homo Sapiens
SSGQPNTQS

SEQ ID NO: 1097531 - protein, 9 aa, Homo Sapiens
CIAAFFVDS

SEQ ID NO: 1097532 - protein, 9 aa, Homo Sapiens
QDQGVLDSE

SEQ ID NO: 1097533 - protein, 9 aa, Homo Sapiens
GVNPAARMY

SEQ ID NO: 1097534 - protein, 9 aa, Homo Sapiens
LFFVLVNLE

SEQ ID NO: 1097535 - protein, 9 aa, Homo Sapiens
TAIGQLWEC

SEQ ID NO: 1097536 - protein, 9 aa, Homo Sapiens
VNSSLVIPS

SEQ ID NO: 1097537 - protein, 9 aa, Homo Sapiens
CKMTNLQAV

SEQ ID NO: 1097538 - protein, 9 aa, Homo Sapiens
GHLCVQRGW

SEQ ID NO: 1097539 - protein, 9 aa, Homo Sapiens
DGAARGCSP

SEQ ID NO: 1097540 - protein, 9 aa, Homo Sapiens
RRALRCSTT

SEQ ID NO: 1097541 - protein, 9 aa, Homo Sapiens
CPTLTFVYL

SEQ ID NO: 1097542 - protein, 9 aa, Homo Sapiens
IRRWSTISC

SEQ ID NO: 1097543 - protein, 9 aa, Homo Sapiens
RVIRMPRRM

SEQ ID NO: 1097544 - protein, 9 aa, Homo Sapiens
LALPHLPVA

SEQ ID NO: 1097545 - protein, 9 aa, Homo Sapiens
SHSTEPSLV

SEQ ID NO: 1097546 - protein, 9 aa, Homo Sapiens
SRRTFTKHL

SEQ ID NO: 1097547 - protein, 9 aa, Homo Sapiens
QPRPSTPAS

SEQ ID NO: 1097548 - protein, 9 aa, Homo Sapiens
VRMLDGAIT

SEQ ID NO: 1097549 - protein, 9 aa, Homo Sapiens
RRTGLQKKQ

SEQ ID NO: 1097550 - protein, 9 aa, Homo Sapiens
PCTMLLPQG

SEQ ID NO: 1097551 - protein, 9 aa, Homo Sapiens
GASSCLAGV

SEQ ID NO: 1097552 - protein, 9 aa, Homo Sapiens
SSSQPVTLQ

SEQ ID NO: 1097553 - protein, 9 aa, Homo Sapiens
SEPQGPSAS

SEQ ID NO: 1097554 - protein, 9 aa, Homo Sapiens
GWGQLLLLL

SEQ ID NO: 1097555 - protein, 9 aa, Homo Sapiens
SCWLRYLTY

SEQ ID NO: 1097556 - protein, 9 aa, Homo Sapiens
IRMGMTGLV

SEQ ID NO: 1097557 - protein, 9 aa, Homo Sapiens
VIATHSPEE

SEQ ID NO: 1097558 - protein, 9 aa, Homo Sapiens
AEQREQEWA

SEQ ID NO: 1097559 - protein, 9 aa, Homo Sapiens
SPGTCHQWR

SEQ ID NO: 1097560 - protein, 9 aa, Homo Sapiens
ETHWFSNLE

SEQ ID NO: 1097561 - protein, 9 aa, Homo Sapiens
FLPRVLPRS

SEQ ID NO: 1097562 - protein, 9 aa, Homo Sapiens
GQGLGVAAR

SEQ ID NO: 1097563 - protein, 9 aa, Homo Sapiens
GIASTLPGL

SEQ ID NO: 1097564 - protein, 9 aa, Homo Sapiens
FSQARTRAG

SEQ ID NO: 1097565 - protein, 9 aa, Homo Sapiens
ALQTGPGSC

SEQ ID NO: 1097566 - protein, 9 aa, Homo Sapiens
KAMTKKRVN

SEQ ID NO: 1097567 - protein, 9 aa, Homo Sapiens
EVFDGRDTK

SEQ ID NO: 1097568 - protein, 9 aa, Homo Sapiens
PSAARTPAL

SEQ ID NO: 1097569 - protein, 9 aa, Homo Sapiens
AVRGRDSYS

SEQ ID NO: 1097570 - protein, 9 aa, Homo Sapiens
NVATSPLPS

SEQ ID NO: 1097571 - protein, 9 aa, Homo Sapiens
WAEAPGLLE

SEQ ID NO: 1097572 - protein, 9 aa, Homo Sapiens
LSTGVLPMI

SEQ ID NO: 1097573 - protein, 9 aa, Homo Sapiens
PPANPQLLC

SEQ ID NO: 1097574 - protein, 9 aa, Homo Sapiens
SVYITENNP

SEQ ID NO: 1097575 - protein, 9 aa, Homo Sapiens
QSSLLEMDG

SEQ ID NO: 1097576 - protein, 9 aa, Homo Sapiens
AQHPPEGTR

SEQ ID NO: 1097577 - protein, 9 aa, Homo Sapiens
LRLDGSQRP

SEQ ID NO: 1097578 - protein, 9 aa, Homo Sapiens
PRQLPGPHD

SEQ ID NO: 1097579 - protein, 9 aa, Homo Sapiens
KEGRKYPLP

SEQ ID NO: 1097580 - protein, 9 aa, Homo Sapiens
SSQPAQATT

SEQ ID NO: 1097581 - protein, 9 aa, Homo Sapiens
SKLTAHKVI

SEQ ID NO: 1097582 - protein, 9 aa, Homo Sapiens
IIDTKNLYL

SEQ ID NO: 1097583 - protein, 9 aa, Homo Sapiens
LPRSLGFLI

SEQ ID NO: 1097584 - protein, 9 aa, Homo Sapiens
GVAYIVAPS

SEQ ID NO: 1097585 - protein, 9 aa, Homo Sapiens
WRWGWGQLL

SEQ ID NO: 1097586 - protein, 9 aa, Homo Sapiens
LVIPSGLTL

SEQ ID NO: 1097587 - protein, 9 aa, Homo Sapiens
CACPMDKYI

SEQ ID NO: 1097588 - protein, 9 aa, Homo Sapiens
GKHLGTRKD

SEQ ID NO: 1097589 - protein, 9 aa, Homo Sapiens
GSHSEYPMS

SEQ ID NO: 1097590 - protein, 9 aa, Homo Sapiens
ATNSRNIAC

SEQ ID NO: 1097591 - protein, 9 aa, Homo Sapiens
ICTEAPGNL

SEQ ID NO: 1097592 - protein, 9 aa, Homo Sapiens
LRLQPASQT

SEQ ID NO: 1097593 - protein, 9 aa, Homo Sapiens
DEHESVDQS

SEQ ID NO: 1097594 - protein, 9 aa, Homo Sapiens
AIRYCHDCG

SEQ ID NO: 1097595 - protein, 9 aa, Homo Sapiens
VKIIQWDII

SEQ ID NO: 1097596 - protein, 9 aa, Homo Sapiens
ARRGGILFF

SEQ ID NO: 1097597 - protein, 9 aa, Homo Sapiens
IILAWAIFT

SEQ ID NO: 1097598 - protein, 9 aa, Homo Sapiens
GPSYHGRDL

SEQ ID NO: 1097599 - protein, 9 aa, Homo Sapiens
PGPCASLLS

SEQ ID NO: 1097600 - protein, 9 aa, Homo Sapiens
KETRGYGGN

SEQ ID NO: 1097601 - protein, 9 aa, Homo Sapiens
LVQSRKGVH

SEQ ID NO: 1097602 - protein, 9 aa, Homo Sapiens
VISDDQIDI

SEQ ID NO: 1097603 - protein, 9 aa, Homo Sapiens
PRTQHITWK

SEQ ID NO: 1097604 - protein, 9 aa, Homo Sapiens
CTAALCRKD

SEQ ID NO: 1097605 - protein, 9 aa, Homo Sapiens
PPRRPPPAA

SEQ ID NO: 1097606 - protein, 9 aa, Homo Sapiens
GRVRCRKTR

SEQ ID NO: 1097607 - protein, 9 aa, Homo Sapiens
PHARVDAHV

SEQ ID NO: 1097608 - protein, 9 aa, Homo Sapiens
CTAPRAGPG

SEQ ID NO: 1097609 - protein, 9 aa, Homo Sapiens
IVVNQEILN

SEQ ID NO: 1097610 - protein, 9 aa, Homo Sapiens
GVAARHSGR

SEQ ID NO: 1097611 - protein, 9 aa, Homo Sapiens
LGKTPLSQV

SEQ ID NO: 1097612 - protein, 9 aa, Homo Sapiens
AALQTGPGS

SEQ ID NO: 1097613 - protein, 9 aa, Homo Sapiens
YNPRERTLY

SEQ ID NO: 1097614 - protein, 9 aa, Homo Sapiens
PGAPVPVEH

SEQ ID NO: 1097615 - protein, 9 aa, Homo Sapiens
QYASTDMDH

SEQ ID NO: 1097616 - protein, 9 aa, Homo Sapiens
LCIDDQTVK

SEQ ID NO: 1097617 - protein, 9 aa, Homo Sapiens
QRNWLTVLS

SEQ ID NO: 1097618 - protein, 9 aa, Homo Sapiens
FTAVMGDFG

SEQ ID NO: 1097619 - protein, 9 aa, Homo Sapiens
IGNGVPSMP

SEQ ID NO: 1097620 - protein, 9 aa, Homo Sapiens
SLMEGHHKL

SEQ ID NO: 1097621 - protein, 9 aa, Homo Sapiens
SVRCWVKAE

SEQ ID NO: 1097622 - protein, 9 aa, Homo Sapiens
NIEETHWFS

SEQ ID NO: 1097623 - protein, 9 aa, Homo Sapiens
SNSSVIPHL

SEQ ID NO: 1097624 - protein, 9 aa, Homo Sapiens
IFDCSHSMA

SEQ ID NO: 1097625 - protein, 9 aa, Homo Sapiens
GALLRGLGL

SEQ ID NO: 1097626 - protein, 9 aa, Homo Sapiens
LQTGPGSCP

SEQ ID NO: 1097627 - protein, 9 aa, Homo Sapiens
SAPVDKENL

SEQ ID NO: 1097628 - protein, 9 aa, Homo Sapiens
PASALPWGY

SEQ ID NO: 1097629 - protein, 9 aa, Homo Sapiens
DAIKWRGDF

SEQ ID NO: 1097630 - protein, 9 aa, Homo Sapiens
PHRPERGPR

SEQ ID NO: 1097631 - protein, 9 aa, Homo Sapiens
GRSSAPKTR

SEQ ID NO: 1097632 - protein, 9 aa, Homo Sapiens
ETVSVQGPG

SEQ ID NO: 1097633 - protein, 9 aa, Homo Sapiens
IMCPLNPAA

SEQ ID NO: 1097634 - protein, 9 aa, Homo Sapiens
SDGCVELNW

SEQ ID NO: 1097635 - protein, 9 aa, Homo Sapiens
RTKTLQNTR

SEQ ID NO: 1097636 - protein, 9 aa, Homo Sapiens
DASLFQMAH

SEQ ID NO: 1097637 - protein, 9 aa, Homo Sapiens
KAAKAKKTA

SEQ ID NO: 1097638 - protein, 9 aa, Homo Sapiens
PKRWDILAI

SEQ ID NO: 1097639 - protein, 9 aa, Homo Sapiens
KMRICLLLG

SEQ ID NO: 1097640 - protein, 9 aa, Homo Sapiens
KVPTKKIKQ

SEQ ID NO: 1097641 - protein, 9 aa, Homo Sapiens
TYRVEGGWP

SEQ ID NO: 1097642 - protein, 9 aa, Homo Sapiens
SLDLLLCFQ

SEQ ID NO: 1097643 - protein, 9 aa, Homo Sapiens
EGTAPDYSL

SEQ ID NO: 1097644 - protein, 9 aa, Homo Sapiens
YIVDWMDEM

SEQ ID NO: 1097645 - protein, 9 aa, Homo Sapiens
RGTRRYRPR

SEQ ID NO: 1097646 - protein, 9 aa, Homo Sapiens
GYWIAEGNE

SEQ ID NO: 1097647 - protein, 9 aa, Homo Sapiens
EGCGASSSV

SEQ ID NO: 1097648 - protein, 9 aa, Homo Sapiens
PVAEEAAAS

SEQ ID NO: 1097649 - protein, 9 aa, Homo Sapiens
MQAHGEQSS

SEQ ID NO: 1097650 - protein, 9 aa, Homo Sapiens
SAFDAFRSE

SEQ ID NO: 1097651 - protein, 9 aa, Homo Sapiens
VAVPATAMP

SEQ ID NO: 1097652 - protein, 9 aa, Homo Sapiens
QNAAIRDIR

SEQ ID NO: 1097653 - protein, 9 aa, Homo Sapiens
PLELFGKVF

SEQ ID NO: 1097654 - protein, 9 aa, Homo Sapiens
RSPSRCGSA

SEQ ID NO: 1097655 - protein, 9 aa, Homo Sapiens
LLEAGKRGR

SEQ ID NO: 1097656 - protein, 9 aa, Homo Sapiens
AFKEVSLLM

SEQ ID NO: 1097657 - protein, 9 aa, Homo Sapiens
KVFGNFNLL

SEQ ID NO: 1097658 - protein, 9 aa, Homo Sapiens
RERGGALPA

SEQ ID NO: 1097659 - protein, 9 aa, Homo Sapiens
LSSVHEVLS

SEQ ID NO: 1097660 - protein, 9 aa, Homo Sapiens
SDVCCLTGS

SEQ ID NO: 1097661 - protein, 9 aa, Homo Sapiens
DHQSFRNTI

SEQ ID NO: 1097662 - protein, 9 aa, Homo Sapiens
VVILIELLI

SEQ ID NO: 1097663 - protein, 9 aa, Homo Sapiens
MTTISRATW

SEQ ID NO: 1097664 - protein, 9 aa, Homo Sapiens
ICSGFFCNA

SEQ ID NO: 1097665 - protein, 9 aa, Homo Sapiens
GAWAAVPRS

SEQ ID NO: 1097666 - protein, 9 aa, Homo Sapiens
AVWASVAAQ

SEQ ID NO: 1097667 - protein, 9 aa, Homo Sapiens
DHSTTGVHN

SEQ ID NO: 1097668 - protein, 9 aa, Homo Sapiens
EAQRAQEHR

SEQ ID NO: 1097669 - protein, 9 aa, Homo Sapiens
SRRTRPNRV

SEQ ID NO: 1097670 - protein, 9 aa, Homo Sapiens
WGHSEPSMW

SEQ ID NO: 1097671 - protein, 9 aa, Homo Sapiens
ELVARVVSF

SEQ ID NO: 1097672 - protein, 9 aa, Homo Sapiens
QKLQAQCQF

SEQ ID NO: 1097673 - protein, 9 aa, Homo Sapiens
RGARRVPSG

SEQ ID NO: 1097674 - protein, 9 aa, Homo Sapiens
LANKIVPFL

SEQ ID NO: 1097675 - protein, 9 aa, Homo Sapiens
SILSSLATP

SEQ ID NO: 1097676 - protein, 9 aa, Homo Sapiens
CNLISMTLL

SEQ ID NO: 1097677 - protein, 9 aa, Homo Sapiens
GLDDNIENE

SEQ ID NO: 1097678 - protein, 9 aa, Homo Sapiens
RREKRPAKQ

SEQ ID NO: 1097679 - protein, 9 aa, Homo Sapiens
TVDCKLKLV

SEQ ID NO: 1097680 - protein, 9 aa, Homo Sapiens
AITDVIEAQ

SEQ ID NO: 1097681 - protein, 9 aa, Homo Sapiens
CSTSSDWAV

SEQ ID NO: 1097682 - protein, 9 aa, Homo Sapiens
NYDTASGKF

SEQ ID NO: 1097683 - protein, 9 aa, Homo Sapiens
VGFSLMKDD

SEQ ID NO: 1097684 - protein, 9 aa, Homo Sapiens
TASALPSPT

SEQ ID NO: 1097685 - protein, 9 aa, Homo Sapiens
PPALPWPVT

SEQ ID NO: 1097686 - protein, 9 aa, Homo Sapiens
YSELPKPSI

SEQ ID NO: 1097687 - protein, 9 aa, Homo Sapiens
QSHTNGKNV

SEQ ID NO: 1097688 - protein, 9 aa, Homo Sapiens
LSGLTDSAR

SEQ ID NO: 1097689 - protein, 9 aa, Homo Sapiens
CGLTSMPES

SEQ ID NO: 1097690 - protein, 9 aa, Homo Sapiens
CNVWAAVDV

SEQ ID NO: 1097691 - protein, 9 aa, Homo Sapiens
LLDLPILDD

SEQ ID NO: 1097692 - protein, 9 aa, Homo Sapiens
AFPSRSHPM

SEQ ID NO: 1097693 - protein, 9 aa, Homo Sapiens
FTFKNLPKA

SEQ ID NO: 1097694 - protein, 9 aa, Homo Sapiens
DTKAPVLGR

SEQ ID NO: 1097695 - protein, 9 aa, Homo Sapiens
LLRVSEDEW

SEQ ID NO: 1097696 - protein, 9 aa, Homo Sapiens
QELAMVPVF

SEQ ID NO: 1097697 - protein, 9 aa, Homo Sapiens
EPVFEFVWP

SEQ ID NO: 1097698 - protein, 9 aa, Homo Sapiens
GCSRMARPK

SEQ ID NO: 1097699 - protein, 9 aa, Homo Sapiens
PALPWPVTP

SEQ ID NO: 1097700 - protein, 9 aa, Homo Sapiens
DDILPPPSQ

SEQ ID NO: 1097701 - protein, 9 aa, Homo Sapiens
PLKSMNLLG

SEQ ID NO: 1097702 - protein, 9 aa, Homo Sapiens
GPGRRLCTG

SEQ ID NO: 1097703 - protein, 9 aa, Homo Sapiens
ELNWSAFLE

SEQ ID NO: 1097704 - protein, 9 aa, Homo Sapiens
RPFQKKSCE

SEQ ID NO: 1097705 - protein, 9 aa, Homo Sapiens
PCNASIMCP

SEQ ID NO: 1097706 - protein, 9 aa, Homo Sapiens
YVFQLFGYY

SEQ ID NO: 1097707 - protein, 9 aa, Homo Sapiens
ATVGLVWVA

SEQ ID NO: 1097708 - protein, 9 aa, Homo Sapiens
SLLRLLQLS

SEQ ID NO: 1097709 - protein, 9 aa, Homo Sapiens
VPGVLVAGA

SEQ ID NO: 1097710 - protein, 9 aa, Homo Sapiens
HLPSAPAAA

SEQ ID NO: 1097711 - protein, 9 aa, Homo Sapiens
FRMGKRSVE

SEQ ID NO: 1097712 - protein, 9 aa, Homo Sapiens
EKNSSSSSL

SEQ ID NO: 1097713 - protein, 9 aa, Homo Sapiens
IKWLSRRLV

SEQ ID NO: 1097714 - protein, 9 aa, Homo Sapiens
TSGEPWDTE

SEQ ID NO: 1097715 - protein, 9 aa, Homo Sapiens
QGLVGMTPR

SEQ ID NO: 1097716 - protein, 9 aa, Homo Sapiens
VMGDFGLAE

SEQ ID NO: 1097717 - protein, 9 aa, Homo Sapiens
GGLGTAQLK

SEQ ID NO: 1097718 - protein, 9 aa, Homo Sapiens
PTAAPSAGA

SEQ ID NO: 1097719 - protein, 9 aa, Homo Sapiens
LSGNGTILG

SEQ ID NO: 1097720 - protein, 9 aa, Homo Sapiens
AIHLLLSLG

SEQ ID NO: 1097721 - protein, 9 aa, Homo Sapiens
PWPFPGWLG

SEQ ID NO: 1097722 - protein, 9 aa, Homo Sapiens
LSSARHPHA

SEQ ID NO: 1097723 - protein, 9 aa, Homo Sapiens
QTDLTVLGQ

SEQ ID NO: 1097724 - protein, 9 aa, Homo Sapiens
PQHHHPRIP

SEQ ID NO: 1097725 - protein, 9 aa, Homo Sapiens
QRGIALWGE

SEQ ID NO: 1097726 - protein, 9 aa, Homo Sapiens
LHRGGAPGS

SEQ ID NO: 1097727 - protein, 9 aa, Homo Sapiens
KHELTHAFD

SEQ ID NO: 1097728 - protein, 9 aa, Homo Sapiens
ALMGPRTDS

SEQ ID NO: 1097729 - protein, 9 aa, Homo Sapiens
ASPTSSPSQ

SEQ ID NO: 1097730 - protein, 9 aa, Homo Sapiens
SQPVDNHVG

SEQ ID NO: 1097731 - protein, 9 aa, Homo Sapiens
ECWDPTPQS

SEQ ID NO: 1097732 - protein, 9 aa, Homo Sapiens
TTVGNGHMA

SEQ ID NO: 1097733 - protein, 9 aa, Homo Sapiens
LGFRLQDLS

SEQ ID NO: 1097734 - protein, 9 aa, Homo Sapiens
TLAAYPQTS

SEQ ID NO: 1097735 - protein, 9 aa, Homo Sapiens
FLDRTGLTT

SEQ ID NO: 1097736 - protein, 9 aa, Homo Sapiens
FLTLRHLMW

SEQ ID NO: 1097737 - protein, 9 aa, Homo Sapiens
HGLQELRRV

SEQ ID NO: 1097738 - protein, 9 aa, Homo Sapiens
PRPWSRPGS

SEQ ID NO: 1097739 - protein, 9 aa, Homo Sapiens
RDDFLGGRE

SEQ ID NO: 1097740 - protein, 9 aa, Homo Sapiens
IIESPEDHI

SEQ ID NO: 1097741 - protein, 9 aa, Homo Sapiens
QKRNTEAMK

SEQ ID NO: 1097742 - protein, 9 aa, Homo Sapiens
VLGKTPLSQ

SEQ ID NO: 1097743 - protein, 9 aa, Homo Sapiens
DSFNSAVQK

SEQ ID NO: 1097744 - protein, 9 aa, Homo Sapiens
HNFQVWNAL

SEQ ID NO: 1097745 - protein, 9 aa, Homo Sapiens
AERLVQSRK

SEQ ID NO: 1097746 - protein, 9 aa, Homo Sapiens
NACPERRPE

SEQ ID NO: 1097747 - protein, 9 aa, Homo Sapiens
GSYNDFSFM

SEQ ID NO: 1097748 - protein, 9 aa, Homo Sapiens
GEITVSCAV

SEQ ID NO: 1097749 - protein, 9 aa, Homo Sapiens
RLWMFLRIL

SEQ ID NO: 1097750 - protein, 9 aa, Homo Sapiens
ITVATAVVL

SEQ ID NO: 1097751 - protein, 9 aa, Homo Sapiens
PKERPDLPP

SEQ ID NO: 1097752 - protein, 9 aa, Homo Sapiens
LMLSCPGTA

SEQ ID NO: 1097753 - protein, 9 aa, Homo Sapiens
KVSIATPED

SEQ ID NO: 1097754 - protein, 9 aa, Homo Sapiens
ELLNPMGTV

SEQ ID NO: 1097755 - protein, 9 aa, Homo Sapiens
VKRHGLYYI

SEQ ID NO: 1097756 - protein, 9 aa, Homo Sapiens
LHNKMCQQL

SEQ ID NO: 1097757 - protein, 9 aa, Homo Sapiens
LHHAGPEDG

SEQ ID NO: 1097758 - protein, 9 aa, Homo Sapiens
MVLSTDILT

SEQ ID NO: 1097759 - protein, 9 aa, Homo Sapiens
RVKALKKAS

SEQ ID NO: 1097760 - protein, 9 aa, Homo Sapiens
AQAPPSCIK

SEQ ID NO: 1097761 - protein, 9 aa, Homo Sapiens
WQPVMDTVI

SEQ ID NO: 1097762 - protein, 9 aa, Homo Sapiens
ETIRTLNCI

SEQ ID NO: 1097763 - protein, 9 aa, Homo Sapiens
IRCPLQIIL

SEQ ID NO: 1097764 - protein, 9 aa, Homo Sapiens
RPRVAQLLC

SEQ ID NO: 1097765 - protein, 9 aa, Homo Sapiens
PAPPPPLLF

SEQ ID NO: 1097766 - protein, 9 aa, Homo Sapiens
LLEMEVSPR

SEQ ID NO: 1097767 - protein, 9 aa, Homo Sapiens
AAGRYLCFL

SEQ ID NO: 1097768 - protein, 9 aa, Homo Sapiens
MGTFAQIHE

SEQ ID NO: 1097769 - protein, 9 aa, Homo Sapiens
SLDLRMGWG

SEQ ID NO: 1097770 - protein, 9 aa, Homo Sapiens
RSSSQPVTL

SEQ ID NO: 1097771 - protein, 9 aa, Homo Sapiens
PIFWTAKCH

SEQ ID NO: 1097772 - protein, 9 aa, Homo Sapiens
DLLVYLRAA

SEQ ID NO: 1097773 - protein, 9 aa, Homo Sapiens
SQVGGTQEV

SEQ ID NO: 1097774 - protein, 9 aa, Homo Sapiens
TKVWTASGQ

SEQ ID NO: 1097775 - protein, 9 aa, Homo Sapiens
LINEETRVS

SEQ ID NO: 1097776 - protein, 9 aa, Homo Sapiens
CASTAKSAT

SEQ ID NO: 1097777 - protein, 9 aa, Homo Sapiens
QNQLQPQPT

SEQ ID NO: 1097778 - protein, 9 aa, Homo Sapiens
RSRGTWLGR

SEQ ID NO: 1097779 - protein, 9 aa, Homo Sapiens
HKRKHERWH

SEQ ID NO: 1097780 - protein, 9 aa, Homo Sapiens
FSSQTSLPL

SEQ ID NO: 1097781 - protein, 9 aa, Homo Sapiens
LLLDQRQSP

SEQ ID NO: 1097782 - protein, 9 aa, Homo Sapiens
ERNSSKFRD

SEQ ID NO: 1097783 - protein, 9 aa, Homo Sapiens
VLSLPLPEV

SEQ ID NO: 1097784 - protein, 9 aa, Homo Sapiens
VPQAIKLAC

SEQ ID NO: 1097785 - protein, 9 aa, Homo Sapiens
IRYCHDCGV

SEQ ID NO: 1097786 - protein, 9 aa, Homo Sapiens
HFLKKVIEI

SEQ ID NO: 1097787 - protein, 9 aa, Homo Sapiens
MTKNTSMWT

SEQ ID NO: 1097788 - protein, 9 aa, Homo Sapiens
ETLGENVFS

SEQ ID NO: 1097789 - protein, 9 aa, Homo Sapiens
HELAWKTEG

SEQ ID NO: 1097790 - protein, 9 aa, Homo Sapiens
PNTQSESPP

SEQ ID NO: 1097791 - protein, 9 aa, Homo Sapiens
VGWWVQNTR

SEQ ID NO: 1097792 - protein, 9 aa, Homo Sapiens
ACQLCCGKL

SEQ ID NO: 1097793 - protein, 9 aa, Homo Sapiens
LLVAELQCS

SEQ ID NO: 1097794 - protein, 9 aa, Homo Sapiens
LNQCLEMDV

SEQ ID NO: 1097795 - protein, 9 aa, Homo Sapiens
DVDKGPKEP

SEQ ID NO: 1097796 - protein, 9 aa, Homo Sapiens
CCLWDVSVQ

SEQ ID NO: 1097797 - protein, 9 aa, Homo Sapiens
APSQVWTAA

SEQ ID NO: 1097798 - protein, 9 aa, Homo Sapiens
IQLSIMTRA

SEQ ID NO: 1097799 - protein, 9 aa, Homo Sapiens
VNSKDYMYR

SEQ ID NO: 1097800 - protein, 9 aa, Homo Sapiens
SLMLSCPGT

SEQ ID NO: 1097801 - protein, 9 aa, Homo Sapiens
LSTCCQFWS

SEQ ID NO: 1097802 - protein, 9 aa, Homo Sapiens
VHTLNFEYT

SEQ ID NO: 1097803 - protein, 9 aa, Homo Sapiens
ATFKNFGMA

SEQ ID NO: 1097804 - protein, 9 aa, Homo Sapiens
AKCLTVDEA

SEQ ID NO: 1097805 - protein, 9 aa, Homo Sapiens
THAFDRYET

SEQ ID NO: 1097806 - protein, 9 aa, Homo Sapiens
GQRMVPEHR

SEQ ID NO: 1097807 - protein, 9 aa, Homo Sapiens
RLVLMLNDM

SEQ ID NO: 1097808 - protein, 9 aa, Homo Sapiens
IKPETQNNQ

SEQ ID NO: 1097809 - protein, 9 aa, Homo Sapiens
TSQTPGRGV

SEQ ID NO: 1097810 - protein, 9 aa, Homo Sapiens
QVVVESFMQ

SEQ ID NO: 1097811 - protein, 9 aa, Homo Sapiens
QSYVIPLQA

SEQ ID NO: 1097812 - protein, 9 aa, Homo Sapiens
GWRWGWGQL

SEQ ID NO: 1097813 - protein, 9 aa, Homo Sapiens
LPWPVTPAP

SEQ ID NO: 1097814 - protein, 9 aa, Homo Sapiens
GLDALVATT

SEQ ID NO: 1097815 - protein, 9 aa, Homo Sapiens
GILLMILHP

SEQ ID NO: 1097816 - protein, 9 aa, Homo Sapiens
TWRRRHVCK

SEQ ID NO: 1097817 - protein, 9 aa, Homo Sapiens
ACTCFVSDL

SEQ ID NO: 1097818 - protein, 9 aa, Homo Sapiens
VSSSVGTEP

SEQ ID NO: 1097819 - protein, 9 aa, Homo Sapiens
PVVPALAPH

SEQ ID NO: 1097820 - protein, 9 aa, Homo Sapiens
IHELAWKTE

SEQ ID NO: 1097821 - protein, 9 aa, Homo Sapiens
NDFSFMTHT

SEQ ID NO: 1097822 - protein, 9 aa, Homo Sapiens
AGLLRAEKL

SEQ ID NO: 1097823 - protein, 9 aa, Homo Sapiens
YEQIDGGIT

SEQ ID NO: 1097824 - protein, 9 aa, Homo Sapiens
LQTACSTFF

SEQ ID NO: 1097825 - protein, 9 aa, Homo Sapiens
VQELTEFAK

SEQ ID NO: 1097826 - protein, 9 aa, Homo Sapiens
PEDHCCRSW

SEQ ID NO: 1097827 - protein, 9 aa, Homo Sapiens
LQHVLHAGS

SEQ ID NO: 1097828 - protein, 9 aa, Homo Sapiens
SMGGDTAMP

SEQ ID NO: 1097829 - protein, 9 aa, Homo Sapiens
LGKGTEVPW

SEQ ID NO: 1097830 - protein, 9 aa, Homo Sapiens
MAVALAAYK

SEQ ID NO: 1097831 - protein, 9 aa, Homo Sapiens
GRRRALPVA

SEQ ID NO: 1097832 - protein, 9 aa, Homo Sapiens
LALQRPAAH

SEQ ID NO: 1097833 - protein, 9 aa, Homo Sapiens
FQQACYNFI

SEQ ID NO: 1097834 - protein, 9 aa, Homo Sapiens
KLWWTLPQN

SEQ ID NO: 1097835 - protein, 9 aa, Homo Sapiens
RIQNLSCFV

SEQ ID NO: 1097836 - protein, 9 aa, Homo Sapiens
EPHTHHLIP

SEQ ID NO: 1097837 - protein, 9 aa, Homo Sapiens
RIRAARETR

SEQ ID NO: 1097838 - protein, 9 aa, Homo Sapiens
SPSQASETP

SEQ ID NO: 1097839 - protein, 9 aa, Homo Sapiens
RVAELPVAC

SEQ ID NO: 1097840 - protein, 9 aa, Homo Sapiens
RPPGGGRGQ

SEQ ID NO: 1097841 - protein, 9 aa, Homo Sapiens
LRILSTGVL

SEQ ID NO: 1097842 - protein, 9 aa, Homo Sapiens
QDQRRLFLY

SEQ ID NO: 1097843 - protein, 9 aa, Homo Sapiens
SLPCHWPLW

SEQ ID NO: 1097844 - protein, 9 aa, Homo Sapiens
GSRWCPPSP

SEQ ID NO: 1097845 - protein, 9 aa, Homo Sapiens
ECGCCAHCL

SEQ ID NO: 1097846 - protein, 9 aa, Homo Sapiens
ISCNDCISQ

SEQ ID NO: 1097847 - protein, 9 aa, Homo Sapiens
SDPDSPENA

SEQ ID NO: 1097848 - protein, 9 aa, Homo Sapiens
SFVEKATFM

SEQ ID NO: 1097849 - protein, 9 aa, Homo Sapiens
GCAWYLCSS

SEQ ID NO: 1097850 - protein, 9 aa, Homo Sapiens
TGSQEQKLG

SEQ ID NO: 1097851 - protein, 9 aa, Homo Sapiens
DSFVEKATF

SEQ ID NO: 1097852 - protein, 9 aa, Homo Sapiens
IPPPAPATQ

SEQ ID NO: 1097853 - protein, 9 aa, Homo Sapiens
CQLCSSSTK

SEQ ID NO: 1097854 - protein, 9 aa, Homo Sapiens
VARYRRPTV

SEQ ID NO: 1097855 - protein, 9 aa, Homo Sapiens
VQELQSHPR

SEQ ID NO: 1097856 - protein, 9 aa, Homo Sapiens
YRDDCKEGL

SEQ ID NO: 1097857 - protein, 9 aa, Homo Sapiens
WENDRGSVS

SEQ ID NO: 1097858 - protein, 9 aa, Homo Sapiens
HHLHCPCHL

SEQ ID NO: 1097859 - protein, 9 aa, Homo Sapiens
AQAQGRLRL

SEQ ID NO: 1097860 - protein, 9 aa, Homo Sapiens
CCWCMPGGA

SEQ ID NO: 1097861 - protein, 9 aa, Homo Sapiens
KTALQPDMW

SEQ ID NO: 1097862 - protein, 9 aa, Homo Sapiens
YYSLFEGTE

SEQ ID NO: 1097863 - protein, 9 aa, Homo Sapiens
EEQVWRANV

SEQ ID NO: 1097864 - protein, 9 aa, Homo Sapiens
ILGLIGLYG

SEQ ID NO: 1097865 - protein, 9 aa, Homo Sapiens
AEMEKIKQE

SEQ ID NO: 1097866 - protein, 9 aa, Homo Sapiens
FVWFGLVCF

SEQ ID NO: 1097867 - protein, 9 aa, Homo Sapiens
APVDKENLQ

SEQ ID NO: 1097868 - protein, 9 aa, Homo Sapiens
KTEQVPQID

SEQ ID NO: 1097869 - protein, 9 aa, Homo Sapiens
PASACTMPP

SEQ ID NO: 1097870 - protein, 9 aa, Homo Sapiens
QAAKNGSVK

SEQ ID NO: 1097871 - protein, 9 aa, Homo Sapiens
DHDSSLNLE

SEQ ID NO: 1097872 - protein, 9 aa, Homo Sapiens
LRMASRTCS

SEQ ID NO: 1097873 - protein, 9 aa, Homo Sapiens
PGDHQESSQ

SEQ ID NO: 1097874 - protein, 9 aa, Homo Sapiens
TTLQRSPLQ

SEQ ID NO: 1097875 - protein, 9 aa, Homo Sapiens
LFLQQNTQG

SEQ ID NO: 1097876 - protein, 9 aa, Homo Sapiens
EIDGEITVS

SEQ ID NO: 1097877 - protein, 9 aa, Homo Sapiens
SHPTFWTHT

SEQ ID NO: 1097878 - protein, 9 aa, Homo Sapiens
EERNPYKTL

SEQ ID NO: 1097879 - protein, 9 aa, Homo Sapiens
GIHKLINNG

SEQ ID NO: 1097880 - protein, 9 aa, Homo Sapiens
FQVRGPHFN

SEQ ID NO: 1097881 - protein, 9 aa, Homo Sapiens
TILLNQTAE

SEQ ID NO: 1097882 - protein, 9 aa, Homo Sapiens
DPALPVGRH

SEQ ID NO: 1097883 - protein, 9 aa, Homo Sapiens
HGSVRCWVK

SEQ ID NO: 1097884 - protein, 9 aa, Homo Sapiens
KRSARAPRS

SEQ ID NO: 1097885 - protein, 9 aa, Homo Sapiens
AQATGEQAP

SEQ ID NO: 1097886 - protein, 9 aa, Homo Sapiens
LACGALPLG

SEQ ID NO: 1097887 - protein, 9 aa, Homo Sapiens
KREIRCVQA

SEQ ID NO: 1097888 - protein, 9 aa, Homo Sapiens
GSASCFSNG

SEQ ID NO: 1097889 - protein, 9 aa, Homo Sapiens
HNKMCQQLK

SEQ ID NO: 1097890 - protein, 9 aa, Homo Sapiens
PGQARAAQR

SEQ ID NO: 1097891 - protein, 9 aa, Homo Sapiens
KHHAGTRVL

SEQ ID NO: 1097892 - protein, 9 aa, Homo Sapiens
NRSYLCNES

SEQ ID NO: 1097893 - protein, 9 aa, Homo Sapiens
KWTKVWTAS

SEQ ID NO: 1097894 - protein, 9 aa, Homo Sapiens
CLLKASEPG

SEQ ID NO: 1097895 - protein, 9 aa, Homo Sapiens
LKCQHEEGA

SEQ ID NO: 1097896 - protein, 9 aa, Homo Sapiens
PERRPEFSE

SEQ ID NO: 1097897 - protein, 9 aa, Homo Sapiens
HWATNCNDN

SEQ ID NO: 1097898 - protein, 9 aa, Homo Sapiens
AELRILMEL

SEQ ID NO: 1097899 - protein, 9 aa, Homo Sapiens
RPAVASRST

SEQ ID NO: 1097900 - protein, 9 aa, Homo Sapiens
VLLDSLPPP

SEQ ID NO: 1097901 - protein, 9 aa, Homo Sapiens
YVSYDVQKC

SEQ ID NO: 1097902 - protein, 9 aa, Homo Sapiens
DEQDKETVS

SEQ ID NO: 1097903 - protein, 9 aa, Homo Sapiens
NSSSSSLLS

SEQ ID NO: 1097904 - protein, 9 aa, Homo Sapiens
SVLGVTCSR

SEQ ID NO: 1097905 - protein, 9 aa, Homo Sapiens
SPQRRGEQS

SEQ ID NO: 1097906 - protein, 9 aa, Homo Sapiens
DGKKMDLDG

SEQ ID NO: 1097907 - protein, 9 aa, Homo Sapiens
REIRCVQAV

SEQ ID NO: 1097908 - protein, 9 aa, Homo Sapiens
SAPCCWRLW

SEQ ID NO: 1097909 - protein, 9 aa, Homo Sapiens
HGVRMGLFT

SEQ ID NO: 1097910 - protein, 9 aa, Homo Sapiens
AVLEPDLHL

SEQ ID NO: 1097911 - protein, 9 aa, Homo Sapiens
FKLIVNLLC

SEQ ID NO: 1097912 - protein, 9 aa, Homo Sapiens
LGYIEEWDL

SEQ ID NO: 1097913 - protein, 9 aa, Homo Sapiens
DTTEEKWRN

SEQ ID NO: 1097914 - protein, 9 aa, Homo Sapiens
SKAGRSQGR

SEQ ID NO: 1097915 - protein, 9 aa, Homo Sapiens
SPASSMESL

SEQ ID NO: 1097916 - protein, 9 aa, Homo Sapiens
LKSMNLLGP

SEQ ID NO: 1097917 - protein, 9 aa, Homo Sapiens
VGLGVQVLP

SEQ ID NO: 1097918 - protein, 9 aa, Homo Sapiens
AVAGPPAAE

SEQ ID NO: 1097919 - protein, 9 aa, Homo Sapiens
MWAFLLSLA

SEQ ID NO: 1097920 - protein, 9 aa, Homo Sapiens
TNSISVFQV

SEQ ID NO: 1097921 - protein, 9 aa, Homo Sapiens
RYPSQREPP

SEQ ID NO: 1097922 - protein, 9 aa, Homo Sapiens
EWFMECLMI

SEQ ID NO: 1097923 - protein, 9 aa, Homo Sapiens
FVPNNPDLA

SEQ ID NO: 1097924 - protein, 9 aa, Homo Sapiens
IDLLSTAKS

SEQ ID NO: 1097925 - protein, 9 aa, Homo Sapiens
SISVFQVIR

SEQ ID NO: 1097926 - protein, 9 aa, Homo Sapiens
FFTIFCNLS

SEQ ID NO: 1097927 - protein, 9 aa, Homo Sapiens
SGTPPSPVS

SEQ ID NO: 1097928 - protein, 9 aa, Homo Sapiens
LRVSEDEWD

SEQ ID NO: 1097929 - protein, 9 aa, Homo Sapiens
VIQCPVCRQ

SEQ ID NO: 1097930 - protein, 9 aa, Homo Sapiens
WGWGQLLLL

SEQ ID NO: 1097931 - protein, 9 aa, Homo Sapiens
SLMKCDLRV

SEQ ID NO: 1097932 - protein, 9 aa, Homo Sapiens
ARQLSGVKK

SEQ ID NO: 1097933 - protein, 9 aa, Homo Sapiens
ISRETHLPP

SEQ ID NO: 1097934 - protein, 9 aa, Homo Sapiens
HNAENAEEG

SEQ ID NO: 1097935 - protein, 9 aa, Homo Sapiens
LCFIHHYYR

SEQ ID NO: 1097936 - protein, 9 aa, Homo Sapiens
SISCPTLTF

SEQ ID NO: 1097937 - protein, 9 aa, Homo Sapiens
LVEQHKQER

SEQ ID NO: 1097938 - protein, 9 aa, Homo Sapiens
FWPGGYPAY

SEQ ID NO: 1097939 - protein, 9 aa, Homo Sapiens
NSGKGARRL

SEQ ID NO: 1097940 - protein, 9 aa, Homo Sapiens
KEQTALYRG

SEQ ID NO: 1097941 - protein, 9 aa, Homo Sapiens
CLALLSAGS

SEQ ID NO: 1097942 - protein, 9 aa, Homo Sapiens
ATTINLGDL

SEQ ID NO: 1097943 - protein, 9 aa, Homo Sapiens
EEVDINQLT

SEQ ID NO: 1097944 - protein, 9 aa, Homo Sapiens
SPPAGAVVW

SEQ ID NO: 1097945 - protein, 9 aa, Homo Sapiens
RGIALWGER

SEQ ID NO: 1097946 - protein, 9 aa, Homo Sapiens
ILDQKVEIR

SEQ ID NO: 1097947 - protein, 9 aa, Homo Sapiens
PKRPHQIAD

SEQ ID NO: 1097948 - protein, 9 aa, Homo Sapiens
WRSCSASRR

SEQ ID NO: 1097949 - protein, 9 aa, Homo Sapiens
GSEGCIPSD

SEQ ID NO: 1097950 - protein, 9 aa, Homo Sapiens
TVIGQGLVG

SEQ ID NO: 1097951 - protein, 9 aa, Homo Sapiens
PSLWAPAPA

SEQ ID NO: 1097952 - protein, 9 aa, Homo Sapiens
VDGDDLGAL

SEQ ID NO: 1097953 - protein, 9 aa, Homo Sapiens
ILLMILHPD

SEQ ID NO: 1097954 - protein, 9 aa, Homo Sapiens
GLLRAEKLR

SEQ ID NO: 1097955 - protein, 9 aa, Homo Sapiens
PPSIFSTWI

SEQ ID NO: 1097956 - protein, 9 aa, Homo Sapiens
KEVSLLMAH

SEQ ID NO: 1097957 - protein, 9 aa, Homo Sapiens
VLGIAGSGK

SEQ ID NO: 1097958 - protein, 9 aa, Homo Sapiens
HLSRLWAAV

SEQ ID NO: 1097959 - protein, 9 aa, Homo Sapiens
ELARMGPPR

SEQ ID NO: 1097960 - protein, 9 aa, Homo Sapiens
SKKLWWTLP

SEQ ID NO: 1097961 - protein, 9 aa, Homo Sapiens
EGFFAHQHQ

SEQ ID NO: 1097962 - protein, 9 aa, Homo Sapiens
IVGRAVQKL

SEQ ID NO: 1097963 - protein, 9 aa, Homo Sapiens
ERWLMGCFL

SEQ ID NO: 1097964 - protein, 9 aa, Homo Sapiens
WWAPSRSTC

SEQ ID NO: 1097965 - protein, 9 aa, Homo Sapiens
GRLPHGQLP

SEQ ID NO: 1097966 - protein, 9 aa, Homo Sapiens
EMRVLLDSL

SEQ ID NO: 1097967 - protein, 9 aa, Homo Sapiens
TLERILPEC

SEQ ID NO: 1097968 - protein, 9 aa, Homo Sapiens
IITLNCTLL

SEQ ID NO: 1097969 - protein, 9 aa, Homo Sapiens
VINNTTVRL

SEQ ID NO: 1097970 - protein, 9 aa, Homo Sapiens
KRKAMTKKR

SEQ ID NO: 1097971 - protein, 9 aa, Homo Sapiens
EETSGNSDN

SEQ ID NO: 1097972 - protein, 9 aa, Homo Sapiens
TWGVETLCG

SEQ ID NO: 1097973 - protein, 9 aa, Homo Sapiens
VRAREALVA

SEQ ID NO: 1097974 - protein, 9 aa, Homo Sapiens
QALLEMEVS

SEQ ID NO: 1097975 - protein, 9 aa, Homo Sapiens
GCRGLGPVP

SEQ ID NO: 1097976 - protein, 9 aa, Homo Sapiens
IARIQADLD

SEQ ID NO: 1097977 - protein, 9 aa, Homo Sapiens
PKVSSKDTW

SEQ ID NO: 1097978 - protein, 9 aa, Homo Sapiens
PASAPCGLS

SEQ ID NO: 1097979 - protein, 9 aa, Homo Sapiens
DVYDKKLAP

SEQ ID NO: 1097980 - protein, 9 aa, Homo Sapiens
YHHDIDCQW

SEQ ID NO: 1097981 - protein, 9 aa, Homo Sapiens
TRVSVVEPF

SEQ ID NO: 1097982 - protein, 9 aa, Homo Sapiens
SRGDCEGIG

SEQ ID NO: 1097983 - protein, 9 aa, Homo Sapiens
EHPHPTVRP

SEQ ID NO: 1097984 - protein, 9 aa, Homo Sapiens
SPRAGSRRC

SEQ ID NO: 1097985 - protein, 9 aa, Homo Sapiens
HYQWFQVDF

SEQ ID NO: 1097986 - protein, 9 aa, Homo Sapiens
EDDFLDLNP

SEQ ID NO: 1097987 - protein, 9 aa, Homo Sapiens
EESMKETLW

SEQ ID NO: 1097988 - protein, 9 aa, Homo Sapiens
TCVFVLVRP

SEQ ID NO: 1097989 - protein, 9 aa, Homo Sapiens
STTAFCLFT

SEQ ID NO: 1097990 - protein, 9 aa, Homo Sapiens
TLIGLPWPF

SEQ ID NO: 1097991 - protein, 9 aa, Homo Sapiens
EKENTPERE

SEQ ID NO: 1097992 - protein, 9 aa, Homo Sapiens
VPAQSESVQ

SEQ ID NO: 1097993 - protein, 9 aa, Homo Sapiens
MPPPPSRPR

SEQ ID NO: 1097994 - protein, 9 aa, Homo Sapiens
SLVIPSGLT

SEQ ID NO: 1097995 - protein, 9 aa, Homo Sapiens
LRRHLRLLR

SEQ ID NO: 1097996 - protein, 9 aa, Homo Sapiens
SQLHHGGRQ

SEQ ID NO: 1097997 - protein, 9 aa, Homo Sapiens
VAITLLTLG

SEQ ID NO: 1097998 - protein, 9 aa, Homo Sapiens
IYEQHTDTV

SEQ ID NO: 1097999 - protein, 9 aa, Homo Sapiens
KVICSSLNL

SEQ ID NO: 1098000 - protein, 9 aa, Homo Sapiens
PLAPAKGVE

SEQ ID NO: 1098001 - protein, 9 aa, Homo Sapiens
ASSMESLLL

SEQ ID NO: 1098002 - protein, 9 aa, Homo Sapiens
AHRSAKETM

SEQ ID NO: 1098003 - protein, 9 aa, Homo Sapiens
PLAPAHHSG

SEQ ID NO: 1098004 - protein, 9 aa, Homo Sapiens
YLWLPYPFS

SEQ ID NO: 1098005 - protein, 9 aa, Homo Sapiens
LNKCSFFMI

SEQ ID NO: 1098006 - protein, 9 aa, Homo Sapiens
ALPHLPVAS

SEQ ID NO: 1098007 - protein, 9 aa, Homo Sapiens
GLDGSSLAC

SEQ ID NO: 1098008 - protein, 9 aa, Homo Sapiens
RDVGGHGCL

SEQ ID NO: 1098009 - protein, 9 aa, Homo Sapiens
PSGTLKADK

SEQ ID NO: 1098010 - protein, 9 aa, Homo Sapiens
ESPWQVMAS

SEQ ID NO: 1098011 - protein, 9 aa, Homo Sapiens
NSPPSQPPS

SEQ ID NO: 1098012 - protein, 9 aa, Homo Sapiens
TLWIRRLGE

SEQ ID NO: 1098013 - protein, 9 aa, Homo Sapiens
FCNLSLYLD

SEQ ID NO: 1098014 - protein, 9 aa, Homo Sapiens
PASGSTSRR

SEQ ID NO: 1098015 - protein, 9 aa, Homo Sapiens
LLSSILSSL

SEQ ID NO: 1098016 - protein, 9 aa, Homo Sapiens
WKILGCDRC

SEQ ID NO: 1098017 - protein, 9 aa, Homo Sapiens
TMATRTHQE

SEQ ID NO: 1098018 - protein, 9 aa, Homo Sapiens
PWGHHPNLP

SEQ ID NO: 1098019 - protein, 9 aa, Homo Sapiens
SDPSKHLLR

SEQ ID NO: 1098020 - protein, 9 aa, Homo Sapiens
AGHMDGPHS

SEQ ID NO: 1098021 - protein, 9 aa, Homo Sapiens
RSPVWRACL

SEQ ID NO: 1098022 - protein, 9 aa, Homo Sapiens
AQLPVVRED

SEQ ID NO: 1098023 - protein, 9 aa, Homo Sapiens
SAARKSITL

SEQ ID NO: 1098024 - protein, 9 aa, Homo Sapiens
SVPSSTSSS

SEQ ID NO: 1098025 - protein, 9 aa, Homo Sapiens
QKRKEHRDH

SEQ ID NO: 1098026 - protein, 9 aa, Homo Sapiens
CQECQKKVI

SEQ ID NO: 1098027 - protein, 9 aa, Homo Sapiens
CSFFMISPT

SEQ ID NO: 1098028 - protein, 9 aa, Homo Sapiens
DQFSNSGKG

SEQ ID NO: 1098029 - protein, 9 aa, Homo Sapiens
VLSAGAARA

SEQ ID NO: 1098030 - protein, 9 aa, Homo Sapiens
MPPPGHPPR

SEQ ID NO: 1098031 - protein, 9 aa, Homo Sapiens
RLRMASRTC

SEQ ID NO: 1098032 - protein, 9 aa, Homo Sapiens
LAPPTAPDA

SEQ ID NO: 1098033 - protein, 9 aa, Homo Sapiens
TTGSVGKNL

SEQ ID NO: 1098034 - protein, 9 aa, Homo Sapiens
SEFTNVHIK

SEQ ID NO: 1098035 - protein, 9 aa, Homo Sapiens
SRAASLLFS

SEQ ID NO: 1098036 - protein, 9 aa, Homo Sapiens
CTLTWSRSS

SEQ ID NO: 1098037 - protein, 9 aa, Homo Sapiens
TPRDLGTVA

SEQ ID NO: 1098038 - protein, 9 aa, Homo Sapiens
CLLLGCHLF

SEQ ID NO: 1098039 - protein, 9 aa, Homo Sapiens
DPPHRVADP

SEQ ID NO: 1098040 - protein, 9 aa, Homo Sapiens
ASVQLENME

SEQ ID NO: 1098041 - protein, 9 aa, Homo Sapiens
ASACTMPPL

SEQ ID NO: 1098042 - protein, 9 aa, Homo Sapiens
NTEALLADE

SEQ ID NO: 1098043 - protein, 9 aa, Homo Sapiens
SKDFSHRLT

SEQ ID NO: 1098044 - protein, 9 aa, Homo Sapiens
GFILDQKVE

SEQ ID NO: 1098045 - protein, 9 aa, Homo Sapiens
MLNDIVAVP

SEQ ID NO: 1098046 - protein, 9 aa, Homo Sapiens
KKRKKKNNM

SEQ ID NO: 1098047 - protein, 9 aa, Homo Sapiens
LGEAAWSMG

SEQ ID NO: 1098048 - protein, 9 aa, Homo Sapiens
QVPQIDQKQ

SEQ ID NO: 1098049 - protein, 9 aa, Homo Sapiens
ACHAHKAGL

SEQ ID NO: 1098050 - protein, 9 aa, Homo Sapiens
ISEYALDLR

SEQ ID NO: 1098051 - protein, 9 aa, Homo Sapiens
ILVDAQKPL

SEQ ID NO: 1098052 - protein, 9 aa, Homo Sapiens
GTLYGNMFS

SEQ ID NO: 1098053 - protein, 9 aa, Homo Sapiens
HQALLRISL

SEQ ID NO: 1098054 - protein, 9 aa, Homo Sapiens
CPASAPCGL

SEQ ID NO: 1098055 - protein, 9 aa, Homo Sapiens
DHVEVVLTH

SEQ ID NO: 1098056 - protein, 9 aa, Homo Sapiens
LRNSTAPSK

SEQ ID NO: 1098057 - protein, 9 aa, Homo Sapiens
GSWWAPSRS

SEQ ID NO: 1098058 - protein, 9 aa, Homo Sapiens
LMELSVVAP

SEQ ID NO: 1098059 - protein, 9 aa, Homo Sapiens
VGLGVEEGL

SEQ ID NO: 1098060 - protein, 9 aa, Homo Sapiens
RVGETRALR

SEQ ID NO: 1098061 - protein, 9 aa, Homo Sapiens
IEVHDQKEC

SEQ ID NO: 1098062 - protein, 9 aa, Homo Sapiens
KELSGTYNC

SEQ ID NO: 1098063 - protein, 9 aa, Homo Sapiens
ERELRMGLE

SEQ ID NO: 1098064 - protein, 9 aa, Homo Sapiens
VFGSFKLEH

SEQ ID NO: 1098065 - protein, 9 aa, Homo Sapiens
APRQLGQGL

SEQ ID NO: 1098066 - protein, 9 aa, Homo Sapiens
YLSPKDSQP

SEQ ID NO: 1098067 - protein, 9 aa, Homo Sapiens
NSSPSPSPS

SEQ ID NO: 1098068 - protein, 9 aa, Homo Sapiens
QGHLCVQRG

SEQ ID NO: 1098069 - protein, 9 aa, Homo Sapiens
ERSFRGSGP

SEQ ID NO: 1098070 - protein, 9 aa, Homo Sapiens
GSQAMLYNC

SEQ ID NO: 1098071 - protein, 9 aa, Homo Sapiens
QQHQQHQHQ

SEQ ID NO: 1098072 - protein, 9 aa, Homo Sapiens
IHARKGEAI

SEQ ID NO: 1098073 - protein, 9 aa, Homo Sapiens
RSHPMTPAS

SEQ ID NO: 1098074 - protein, 9 aa, Homo Sapiens
ERPADDPLH

SEQ ID NO: 1098075 - protein, 9 aa, Homo Sapiens
SPLAPCPPL

SEQ ID NO: 1098076 - protein, 9 aa, Homo Sapiens
PGPDSSGSR

SEQ ID NO: 1098077 - protein, 9 aa, Homo Sapiens
TQGMVRLTR

SEQ ID NO: 1098078 - protein, 9 aa, Homo Sapiens
NRVAPLLRK

SEQ ID NO: 1098079 - protein, 9 aa, Homo Sapiens
SDSLLQLTC

SEQ ID NO: 1098080 - protein, 9 aa, Homo Sapiens
ARMGPPRKH

SEQ ID NO: 1098081 - protein, 9 aa, Homo Sapiens
DSGDDSDFC

SEQ ID NO: 1098082 - protein, 9 aa, Homo Sapiens
PPDRPCSLP

SEQ ID NO: 1098083 - protein, 9 aa, Homo Sapiens
HPVLIQHQH

SEQ ID NO: 1098084 - protein, 9 aa, Homo Sapiens
ILDTNDNAP

SEQ ID NO: 1098085 - protein, 9 aa, Homo Sapiens
ARVLNTPNN

SEQ ID NO: 1098086 - protein, 9 aa, Homo Sapiens
LKNQHQEDP

SEQ ID NO: 1098087 - protein, 9 aa, Homo Sapiens
CVNPSRTPG

SEQ ID NO: 1098088 - protein, 9 aa, Homo Sapiens
YTRHALTRA

SEQ ID NO: 1098089 - protein, 9 aa, Homo Sapiens
VFSVMISAS

SEQ ID NO: 1098090 - protein, 9 aa, Homo Sapiens
LLCVWVSSI

SEQ ID NO: 1098091 - protein, 9 aa, Homo Sapiens
KRKKKNNMA

SEQ ID NO: 1098092 - protein, 9 aa, Homo Sapiens
HLIHARKGE

SEQ ID NO: 1098093 - protein, 9 aa, Homo Sapiens
RVPSGGLRA

SEQ ID NO: 1098094 - protein, 9 aa, Homo Sapiens
ERLLLQEWR

SEQ ID NO: 1098095 - protein, 9 aa, Homo Sapiens
PSRRWTCAS

SEQ ID NO: 1098096 - protein, 9 aa, Homo Sapiens
FQEMLYIVD

SEQ ID NO: 1098097 - protein, 9 aa, Homo Sapiens
EKIKQELET

SEQ ID NO: 1098098 - protein, 9 aa, Homo Sapiens
PRPAADMQF

SEQ ID NO: 1098099 - protein, 9 aa, Homo Sapiens
INPTISCPF

SEQ ID NO: 1098100 - protein, 9 aa, Homo Sapiens
KASGAPRLR

SEQ ID NO: 1098101 - protein, 9 aa, Homo Sapiens
WPRRTLYLL

SEQ ID NO: 1098102 - protein, 9 aa, Homo Sapiens
GSTTRASGE

SEQ ID NO: 1098103 - protein, 9 aa, Homo Sapiens
KRRGRKWRS

SEQ ID NO: 1098104 - protein, 9 aa, Homo Sapiens
RGKEIFALK

SEQ ID NO: 1098105 - protein, 9 aa, Homo Sapiens
RGSLLLLPE

SEQ ID NO: 1098106 - protein, 9 aa, Homo Sapiens
AQKLTIQKA

SEQ ID NO: 1098107 - protein, 9 aa, Homo Sapiens
LIAPMKICT

SEQ ID NO: 1098108 - protein, 9 aa, Homo Sapiens
HLALEQERI

SEQ ID NO: 1098109 - protein, 9 aa, Homo Sapiens
LAQLPDSVP

SEQ ID NO: 1098110 - protein, 9 aa, Homo Sapiens
TALGRFRSS

SEQ ID NO: 1098111 - protein, 9 aa, Homo Sapiens
AWCMAVRSP

SEQ ID NO: 1098112 - protein, 9 aa, Homo Sapiens
RIELTRMMS

SEQ ID NO: 1098113 - protein, 9 aa, Homo Sapiens
CWPRRTLYL

SEQ ID NO: 1098114 - protein, 9 aa, Homo Sapiens
SCPGTACSR

SEQ ID NO: 1098115 - protein, 9 aa, Homo Sapiens
FAQMLSVGK

SEQ ID NO: 1098116 - protein, 9 aa, Homo Sapiens
SPPTRSSSR

SEQ ID NO: 1098117 - protein, 9 aa, Homo Sapiens
DFFSDSFNS

SEQ ID NO: 1098118 - protein, 9 aa, Homo Sapiens
PHWTFGGGK

SEQ ID NO: 1098119 - protein, 9 aa, Homo Sapiens
GPAVLEPDL

SEQ ID NO: 1098120 - protein, 9 aa, Homo Sapiens
KGTEGEDEG

SEQ ID NO: 1098121 - protein, 9 aa, Homo Sapiens
EIRVEVDTK

SEQ ID NO: 1098122 - protein, 9 aa, Homo Sapiens
VLGGCPEAC

SEQ ID NO: 1098123 - protein, 9 aa, Homo Sapiens
SEDVDKGPK

SEQ ID NO: 1098124 - protein, 9 aa, Homo Sapiens
YIVAPSGSA

SEQ ID NO: 1098125 - protein, 9 aa, Homo Sapiens
TENHQALAQ

SEQ ID NO: 1098126 - protein, 9 aa, Homo Sapiens
EDVGLLFAH

SEQ ID NO: 1098127 - protein, 9 aa, Homo Sapiens
FLLVIASGN

SEQ ID NO: 1098128 - protein, 9 aa, Homo Sapiens
AETVGHFSQ

SEQ ID NO: 1098129 - protein, 9 aa, Homo Sapiens
LPLRTPLQQ

SEQ ID NO: 1098130 - protein, 9 aa, Homo Sapiens
CAILHEKRE

SEQ ID NO: 1098131 - protein, 9 aa, Homo Sapiens
GSWERHLGH

SEQ ID NO: 1098132 - protein, 9 aa, Homo Sapiens
AGRSQGRLC

SEQ ID NO: 1098133 - protein, 9 aa, Homo Sapiens
ATTWEWEMA

SEQ ID NO: 1098134 - protein, 9 aa, Homo Sapiens
ASRTCSQGE

SEQ ID NO: 1098135 - protein, 9 aa, Homo Sapiens
SVRREFQLK

SEQ ID NO: 1098136 - protein, 9 aa, Homo Sapiens
AARIRAARE

SEQ ID NO: 1098137 - protein, 9 aa, Homo Sapiens
YPYSQFQYG

SEQ ID NO: 1098138 - protein, 9 aa, Homo Sapiens
IPGSNCSSV

SEQ ID NO: 1098139 - protein, 9 aa, Homo Sapiens
VAEEAAASR

SEQ ID NO: 1098140 - protein, 9 aa, Homo Sapiens
YVVLNDEKV

SEQ ID NO: 1098141 - protein, 9 aa, Homo Sapiens
SWLPVKWTA

SEQ ID NO: 1098142 - protein, 9 aa, Homo Sapiens
HDGAARGCS

SEQ ID NO: 1098143 - protein, 9 aa, Homo Sapiens
RAREALVAE

SEQ ID NO: 1098144 - protein, 9 aa, Homo Sapiens
SLEMLTPSG

SEQ ID NO: 1098145 - protein, 9 aa, Homo Sapiens
HREAFKTSS

SEQ ID NO: 1098146 - protein, 9 aa, Homo Sapiens
DLLQQAGHE

SEQ ID NO: 1098147 - protein, 9 aa, Homo Sapiens
VGPLPCVLP

SEQ ID NO: 1098148 - protein, 9 aa, Homo Sapiens
LMILVITAL

SEQ ID NO: 1098149 - protein, 9 aa, Homo Sapiens
QNSLLPFAN

SEQ ID NO: 1098150 - protein, 9 aa, Homo Sapiens
FFVWFGLVC

SEQ ID NO: 1098151 - protein, 9 aa, Homo Sapiens
AHKRQKAMH

SEQ ID NO: 1098152 - protein, 9 aa, Homo Sapiens
MPKRWDILA

SEQ ID NO: 1098153 - protein, 9 aa, Homo Sapiens
SLVCSTSSD

SEQ ID NO: 1098154 - protein, 9 aa, Homo Sapiens
IHLLNGLLF

SEQ ID NO: 1098155 - protein, 9 aa, Homo Sapiens
YCHDCGVAH

SEQ ID NO: 1098156 - protein, 9 aa, Homo Sapiens
EDEAWWQRR

SEQ ID NO: 1098157 - protein, 9 aa, Homo Sapiens
WTGPSVWAG

SEQ ID NO: 1098158 - protein, 9 aa, Homo Sapiens
QLKTAQIAK

SEQ ID NO: 1098159 - protein, 9 aa, Homo Sapiens
LVVVLPEHN

SEQ ID NO: 1098160 - protein, 9 aa, Homo Sapiens
HEFWPDHFL

SEQ ID NO: 1098161 - protein, 9 aa, Homo Sapiens
FYPGALLPL

SEQ ID NO: 1098162 - protein, 9 aa, Homo Sapiens
VGGRSPVWR

SEQ ID NO: 1098163 - protein, 9 aa, Homo Sapiens
AEDAYKEPY

SEQ ID NO: 1098164 - protein, 9 aa, Homo Sapiens
KDDSPPFII

SEQ ID NO: 1098165 - protein, 9 aa, Homo Sapiens
NQQRTGHQD

SEQ ID NO: 1098166 - protein, 9 aa, Homo Sapiens
TPSWVWCMA

SEQ ID NO: 1098167 - protein, 9 aa, Homo Sapiens
LKCLWEKDY

SEQ ID NO: 1098168 - protein, 9 aa, Homo Sapiens
WRACLPDHV

SEQ ID NO: 1098169 - protein, 9 aa, Homo Sapiens
LIPTRSEPL

SEQ ID NO: 1098170 - protein, 9 aa, Homo Sapiens
GQLWECLST

SEQ ID NO: 1098171 - protein, 9 aa, Homo Sapiens
LGQELALGL

SEQ ID NO: 1098172 - protein, 9 aa, Homo Sapiens
KAVGWPCYL

SEQ ID NO: 1098173 - protein, 9 aa, Homo Sapiens
VKEKLSSLR

SEQ ID NO: 1098174 - protein, 9 aa, Homo Sapiens
GEISAYGHG

SEQ ID NO: 1098175 - protein, 9 aa, Homo Sapiens
IFYLCIVPS

SEQ ID NO: 1098176 - protein, 9 aa, Homo Sapiens
FTKHLMLEK

SEQ ID NO: 1098177 - protein, 9 aa, Homo Sapiens
KGATYTPRH

SEQ ID NO: 1098178 - protein, 9 aa, Homo Sapiens
FLKSPTPPS

SEQ ID NO: 1098179 - protein, 9 aa, Homo Sapiens
WAKVVRAAQ

SEQ ID NO: 1098180 - protein, 9 aa, Homo Sapiens
LLRGLGLQL

SEQ ID NO: 1098181 - protein, 9 aa, Homo Sapiens
QVMDMMIAN

SEQ ID NO: 1098182 - protein, 9 aa, Homo Sapiens
NHQALAQAQ

SEQ ID NO: 1098183 - protein, 9 aa, Homo Sapiens
SELSLVYLL

SEQ ID NO: 1098184 - protein, 9 aa, Homo Sapiens
ASEMALPSV

SEQ ID NO: 1098185 - protein, 9 aa, Homo Sapiens
TCSSLGKNI

SEQ ID NO: 1098186 - protein, 9 aa, Homo Sapiens
IELTRMMSP

SEQ ID NO: 1098187 - protein, 9 aa, Homo Sapiens
VLPGEADLA

SEQ ID NO: 1098188 - protein, 9 aa, Homo Sapiens
LTPSGSASL

SEQ ID NO: 1098189 - protein, 9 aa, Homo Sapiens
TFLSKACLP

SEQ ID NO: 1098190 - protein, 9 aa, Homo Sapiens
AAARGASTS

SEQ ID NO: 1098191 - protein, 9 aa, Homo Sapiens
LKLESKMKA

SEQ ID NO: 1098192 - protein, 9 aa, Homo Sapiens
PLGGSGGDC

SEQ ID NO: 1098193 - protein, 9 aa, Homo Sapiens
LLMEGFLAF

SEQ ID NO: 1098194 - protein, 9 aa, Homo Sapiens
IGGLCSGER

SEQ ID NO: 1098195 - protein, 9 aa, Homo Sapiens
VWPVCLPNP

SEQ ID NO: 1098196 - protein, 9 aa, Homo Sapiens
CVEAYQDYA

SEQ ID NO: 1098197 - protein, 9 aa, Homo Sapiens
VKWKIAVDE

SEQ ID NO: 1098198 - protein, 9 aa, Homo Sapiens
GGAPMLQLP

SEQ ID NO: 1098199 - protein, 9 aa, Homo Sapiens
ESWPGLWPP

SEQ ID NO: 1098200 - protein, 9 aa, Homo Sapiens
GMGAAGRYL

SEQ ID NO: 1098201 - protein, 9 aa, Homo Sapiens
GLEPNGNAL

SEQ ID NO: 1098202 - protein, 9 aa, Homo Sapiens
QNPSRMDHN

SEQ ID NO: 1098203 - protein, 9 aa, Homo Sapiens
WDTAGQEQY

SEQ ID NO: 1098204 - protein, 9 aa, Homo Sapiens
EPCKILFTN

SEQ ID NO: 1098205 - protein, 9 aa, Homo Sapiens
HDGSNSYCL

SEQ ID NO: 1098206 - protein, 9 aa, Homo Sapiens
KRQKAMHVD

SEQ ID NO: 1098207 - protein, 9 aa, Homo Sapiens
VFEFVWPPP

SEQ ID NO: 1098208 - protein, 9 aa, Homo Sapiens
NQNMHLTEH

SEQ ID NO: 1098209 - protein, 9 aa, Homo Sapiens
MVKYNATVR

SEQ ID NO: 1098210 - protein, 9 aa, Homo Sapiens
RHGRPAWPR

SEQ ID NO: 1098211 - protein, 9 aa, Homo Sapiens
HTSQVLSLT

SEQ ID NO: 1098212 - protein, 9 aa, Homo Sapiens
TGPTTWGCW

SEQ ID NO: 1098213 - protein, 9 aa, Homo Sapiens
GYMEAFLGG

SEQ ID NO: 1098214 - protein, 9 aa, Homo Sapiens
RPRSRGTRR

SEQ ID NO: 1098215 - protein, 9 aa, Homo Sapiens
NMGSPPPHN

SEQ ID NO: 1098216 - protein, 9 aa, Homo Sapiens
ACTCISMTT

SEQ ID NO: 1098217 - protein, 9 aa, Homo Sapiens
YSVHPPPLG

SEQ ID NO: 1098218 - protein, 9 aa, Homo Sapiens
AATKSLSRI

SEQ ID NO: 1098219 - protein, 9 aa, Homo Sapiens
DMYHHDIDC

SEQ ID NO: 1098220 - protein, 9 aa, Homo Sapiens
ETLWIRRLG

SEQ ID NO: 1098221 - protein, 9 aa, Homo Sapiens
GTVQRWGKK

SEQ ID NO: 1098222 - protein, 9 aa, Homo Sapiens
PFQKKSCEA

SEQ ID NO: 1098223 - protein, 9 aa, Homo Sapiens
ELSGTYNCG

SEQ ID NO: 1098224 - protein, 9 aa, Homo Sapiens
GRALHHAGP

SEQ ID NO: 1098225 - protein, 9 aa, Homo Sapiens
KVVLLLLEK

SEQ ID NO: 1098226 - protein, 9 aa, Homo Sapiens
DRKKKKKGQ

SEQ ID NO: 1098227 - protein, 9 aa, Homo Sapiens
RIHRGAHLN

SEQ ID NO: 1098228 - protein, 9 aa, Homo Sapiens
TMPIAINRM

SEQ ID NO: 1098229 - protein, 9 aa, Homo Sapiens
QTRRSPCPP

SEQ ID NO: 1098230 - protein, 9 aa, Homo Sapiens
TPGRPWPPS

SEQ ID NO: 1098231 - protein, 9 aa, Homo Sapiens
SVTASLSSA

SEQ ID NO: 1098232 - protein, 9 aa, Homo Sapiens
KSSCFQRRK

SEQ ID NO: 1098233 - protein, 9 aa, Homo Sapiens
RKRRRGSSP

SEQ ID NO: 1098234 - protein, 9 aa, Homo Sapiens
ENPQKRKEH

SEQ ID NO: 1098235 - protein, 9 aa, Homo Sapiens
ADDPLHHTS

SEQ ID NO: 1098236 - protein, 9 aa, Homo Sapiens
QARAAQRKS

SEQ ID NO: 1098237 - protein, 9 aa, Homo Sapiens
YHGMYFLNG

SEQ ID NO: 1098238 - protein, 9 aa, Homo Sapiens
AASPPARSW

SEQ ID NO: 1098239 - protein, 9 aa, Homo Sapiens
HGKHSTMKT

SEQ ID NO: 1098240 - protein, 9 aa, Homo Sapiens
SENPQKRKE

SEQ ID NO: 1098241 - protein, 9 aa, Homo Sapiens
KALTKLEHP

SEQ ID NO: 1098242 - protein, 9 aa, Homo Sapiens
RSQGVNTLW

SEQ ID NO: 1098243 - protein, 9 aa, Homo Sapiens
AGGQRSHVG

SEQ ID NO: 1098244 - protein, 9 aa, Homo Sapiens
QKKSCEASV

SEQ ID NO: 1098245 - protein, 9 aa, Homo Sapiens
SARAPRSWP

SEQ ID NO: 1098246 - protein, 9 aa, Homo Sapiens
GPDSSGSRS

SEQ ID NO: 1098247 - protein, 9 aa, Homo Sapiens
HARKGEAIR

SEQ ID NO: 1098248 - protein, 9 aa, Homo Sapiens
LYENIEKVK

SEQ ID NO: 1098249 - protein, 9 aa, Homo Sapiens
RGASCSSTR

SEQ ID NO: 1098250 - protein, 9 aa, Homo Sapiens
SPHSGWCGT

SEQ ID NO: 1098251 - protein, 9 aa, Homo Sapiens
QIVDHFKMK

SEQ ID NO: 1098252 - protein, 9 aa, Homo Sapiens
CVLPHVDFQ

SEQ ID NO: 1098253 - protein, 9 aa, Homo Sapiens
VDADSGHNT

SEQ ID NO: 1098254 - protein, 9 aa, Homo Sapiens
TSHSGSFVP

SEQ ID NO: 1098255 - protein, 9 aa, Homo Sapiens
SSYSRYSAV

SEQ ID NO: 1098256 - protein, 9 aa, Homo Sapiens
GPKRSARAP

SEQ ID NO: 1098257 - protein, 9 aa, Homo Sapiens
NRSLLVLAP

SEQ ID NO: 1098258 - protein, 9 aa, Homo Sapiens
QMLSRRKLL

SEQ ID NO: 1098259 - protein, 9 aa, Homo Sapiens
YRMIFSCLN

SEQ ID NO: 1098260 - protein, 9 aa, Homo Sapiens
DLTVLGQPG

SEQ ID NO: 1098261 - protein, 9 aa, Homo Sapiens
SCLAGVTAP

SEQ ID NO: 1098262 - protein, 9 aa, Homo Sapiens
VWPDTTHPT

SEQ ID NO: 1098263 - protein, 9 aa, Homo Sapiens
HVGPSSFLG

SEQ ID NO: 1098264 - protein, 9 aa, Homo Sapiens
ETRSTVVSM

SEQ ID NO: 1098265 - protein, 9 aa, Homo Sapiens
KSCCQPVRM

SEQ ID NO: 1098266 - protein, 9 aa, Homo Sapiens
SAGALKPAG

SEQ ID NO: 1098267 - protein, 9 aa, Homo Sapiens
QPPPPPPAE

SEQ ID NO: 1098268 - protein, 9 aa, Homo Sapiens
PRPVSMTFL

SEQ ID NO: 1098269 - protein, 9 aa, Homo Sapiens
WCMAVRSPS

SEQ ID NO: 1098270 - protein, 9 aa, Homo Sapiens
RGRPGLPSH

SEQ ID NO: 1098271 - protein, 9 aa, Homo Sapiens
AHLLRLWMF

SEQ ID NO: 1098272 - protein, 9 aa, Homo Sapiens
LTRLLRTAQ

SEQ ID NO: 1098273 - protein, 9 aa, Homo Sapiens
LLVNMGGNR

SEQ ID NO: 1098274 - protein, 9 aa, Homo Sapiens
LEPVVVDAF

SEQ ID NO: 1098275 - protein, 9 aa, Homo Sapiens
RGCGGSFPC

SEQ ID NO: 1098276 - protein, 9 aa, Homo Sapiens
DGTLAAYPQ

SEQ ID NO: 1098277 - protein, 9 aa, Homo Sapiens
PYSQFQYGD

SEQ ID NO: 1098278 - protein, 9 aa, Homo Sapiens
DAVHVVLDH

SEQ ID NO: 1098279 - protein, 9 aa, Homo Sapiens
ILIELLISL

SEQ ID NO: 1098280 - protein, 9 aa, Homo Sapiens
QDMVSPEVT

SEQ ID NO: 1098281 - protein, 9 aa, Homo Sapiens
PCSTSVMTE

SEQ ID NO: 1098282 - protein, 9 aa, Homo Sapiens
TSVTASLSS

SEQ ID NO: 1098283 - protein, 9 aa, Homo Sapiens
CCEGALEPH

SEQ ID NO: 1098284 - protein, 9 aa, Homo Sapiens
TKNLYLLAF

SEQ ID NO: 1098285 - protein, 9 aa, Homo Sapiens
LVVCNNCNQ

SEQ ID NO: 1098286 - protein, 9 aa, Homo Sapiens
LVQDAAGRG

SEQ ID NO: 1098287 - protein, 9 aa, Homo Sapiens
GLTERPHNR

SEQ ID NO: 1098288 - protein, 9 aa, Homo Sapiens
RPVVPALAP

SEQ ID NO: 1098289 - protein, 9 aa, Homo Sapiens
PGCLLSGPL

SEQ ID NO: 1098290 - protein, 9 aa, Homo Sapiens
LSGARGRTG

SEQ ID NO: 1098291 - protein, 9 aa, Homo Sapiens
KIIESPEDH

SEQ ID NO: 1098292 - protein, 9 aa, Homo Sapiens
AWAPQTKGK

SEQ ID NO: 1098293 - protein, 9 aa, Homo Sapiens
LALKEDLLY

SEQ ID NO: 1098294 - protein, 9 aa, Homo Sapiens
HPVPRARPA

SEQ ID NO: 1098295 - protein, 9 aa, Homo Sapiens
GADVAEARV

SEQ ID NO: 1098296 - protein, 9 aa, Homo Sapiens
CKEVETRQQ

SEQ ID NO: 1098297 - protein, 9 aa, Homo Sapiens
LRDLLEAGK

SEQ ID NO: 1098298 - protein, 9 aa, Homo Sapiens
GTRKDHPGL

SEQ ID NO: 1098299 - protein, 9 aa, Homo Sapiens
AAASGPCHA

SEQ ID NO: 1098300 - protein, 9 aa, Homo Sapiens
QVGISRSAT

SEQ ID NO: 1098301 - protein, 9 aa, Homo Sapiens
RNSTAPSKD

SEQ ID NO: 1098302 - protein, 9 aa, Homo Sapiens
YKCELCSFH

SEQ ID NO: 1098303 - protein, 9 aa, Homo Sapiens
APCCWRLWP

SEQ ID NO: 1098304 - protein, 9 aa, Homo Sapiens
RRGPEPWLG

SEQ ID NO: 1098305 - protein, 9 aa, Homo Sapiens
LPHQSPGHL

SEQ ID NO: 1098306 - protein, 9 aa, Homo Sapiens
LRQIKIIES

SEQ ID NO: 1098307 - protein, 9 aa, Homo Sapiens
GWEFQSPLI

SEQ ID NO: 1098308 - protein, 9 aa, Homo Sapiens
AGESAGCSP

SEQ ID NO: 1098309 - protein, 9 aa, Homo Sapiens
PGLFCGRGN

SEQ ID NO: 1098310 - protein, 9 aa, Homo Sapiens
NIQLSIMTR

SEQ ID NO: 1098311 - protein, 9 aa, Homo Sapiens
GCWPSTSAF

SEQ ID NO: 1098312 - protein, 9 aa, Homo Sapiens
QRKPPNWQP

SEQ ID NO: 1098313 - protein, 9 aa, Homo Sapiens
GSNCSSVIM

SEQ ID NO: 1098314 - protein, 9 aa, Homo Sapiens
GHHRMGAAW

SEQ ID NO: 1098315 - protein, 9 aa, Homo Sapiens
KEDLLYLRT

SEQ ID NO: 1098316 - protein, 9 aa, Homo Sapiens
QGFGASRHC

SEQ ID NO: 1098317 - protein, 9 aa, Homo Sapiens
KWKIAVDEE

SEQ ID NO: 1098318 - protein, 9 aa, Homo Sapiens
AQVVFQVCV

SEQ ID NO: 1098319 - protein, 9 aa, Homo Sapiens
CTQCGRRFC

SEQ ID NO: 1098320 - protein, 9 aa, Homo Sapiens
SAGYNSSRY

SEQ ID NO: 1098321 - protein, 9 aa, Homo Sapiens
MCISACPSQ

SEQ ID NO: 1098322 - protein, 9 aa, Homo Sapiens
VLLSVTTGG

SEQ ID NO: 1098323 - protein, 9 aa, Homo Sapiens
SSHCLLTAH

SEQ ID NO: 1098324 - protein, 9 aa, Homo Sapiens
WYQNFQSPP

SEQ ID NO: 1098325 - protein, 9 aa, Homo Sapiens
PSVPSSTSS

SEQ ID NO: 1098326 - protein, 9 aa, Homo Sapiens
RCIGKEQEL

SEQ ID NO: 1098327 - protein, 9 aa, Homo Sapiens
CGSGNGVAG

SEQ ID NO: 1098328 - protein, 9 aa, Homo Sapiens
HCCLWDVSV

SEQ ID NO: 1098329 - protein, 9 aa, Homo Sapiens
LAPPETPGL

SEQ ID NO: 1098330 - protein, 9 aa, Homo Sapiens
AGQNSRHLH

SEQ ID NO: 1098331 - protein, 9 aa, Homo Sapiens
PGLWPPPWT

SEQ ID NO: 1098332 - protein, 9 aa, Homo Sapiens
RQRRRQAER

SEQ ID NO: 1098333 - protein, 9 aa, Homo Sapiens
RHRVIATHS

SEQ ID NO: 1098334 - protein, 9 aa, Homo Sapiens
VGPHARVDA

SEQ ID NO: 1098335 - protein, 9 aa, Homo Sapiens
EDRGFTAVM

SEQ ID NO: 1098336 - protein, 9 aa, Homo Sapiens
LMRTRPPAA

SEQ ID NO: 1098337 - protein, 9 aa, Homo Sapiens
SVTFCQQLV

SEQ ID NO: 1098338 - protein, 9 aa, Homo Sapiens
HDSSLNLEQ

SEQ ID NO: 1098339 - protein, 9 aa, Homo Sapiens
AQLLPADPL

SEQ ID NO: 1098340 - protein, 9 aa, Homo Sapiens
RQCTHLSRH

SEQ ID NO: 1098341 - protein, 9 aa, Homo Sapiens
ARSHHNDIM

SEQ ID NO: 1098342 - protein, 9 aa, Homo Sapiens
VDKENLQAL

SEQ ID NO: 1098343 - protein, 9 aa, Homo Sapiens
LSHHAWPGH

SEQ ID NO: 1098344 - protein, 9 aa, Homo Sapiens
GSPCTACHL

SEQ ID NO: 1098345 - protein, 9 aa, Homo Sapiens
QGRLCLSQA

SEQ ID NO: 1098346 - protein, 9 aa, Homo Sapiens
GLQELRRVE

SEQ ID NO: 1098347 - protein, 9 aa, Homo Sapiens
RDHRCIGKE

SEQ ID NO: 1098348 - protein, 9 aa, Homo Sapiens
DSGHNTWLS

SEQ ID NO: 1098349 - protein, 9 aa, Homo Sapiens
WGALWLLSP

SEQ ID NO: 1098350 - protein, 9 aa, Homo Sapiens
LGEFHPWGH

SEQ ID NO: 1098351 - protein, 9 aa, Homo Sapiens
TDFYVFPDM

SEQ ID NO: 1098352 - protein, 9 aa, Homo Sapiens
SPKDSQPLC

SEQ ID NO: 1098353 - protein, 9 aa, Homo Sapiens
NDCDLLVYL

SEQ ID NO: 1098354 - protein, 9 aa, Homo Sapiens
VVVDDVPVM

SEQ ID NO: 1098355 - protein, 9 aa, Homo Sapiens
GPSPLVAPR

SEQ ID NO: 1098356 - protein, 9 aa, Homo Sapiens
WTFGGGKAA

SEQ ID NO: 1098357 - protein, 9 aa, Homo Sapiens
QLCCGKLLP

SEQ ID NO: 1098358 - protein, 9 aa, Homo Sapiens
MSPPPEASC

SEQ ID NO: 1098359 - protein, 9 aa, Homo Sapiens
NGNLSKASI

SEQ ID NO: 1098360 - protein, 9 aa, Homo Sapiens
PQVTQPSAA

SEQ ID NO: 1098361 - protein, 9 aa, Homo Sapiens
CLTVDEAVQ

SEQ ID NO: 1098362 - protein, 9 aa, Homo Sapiens
APMRSKRKY

SEQ ID NO: 1098363 - protein, 9 aa, Homo Sapiens
DISETGYVW

SEQ ID NO: 1098364 - protein, 9 aa, Homo Sapiens
HCLGAEGAS

SEQ ID NO: 1098365 - protein, 9 aa, Homo Sapiens
ARQVLGLLE

SEQ ID NO: 1098366 - protein, 9 aa, Homo Sapiens
LPGEADLAD

SEQ ID NO: 1098367 - protein, 9 aa, Homo Sapiens
VAPAAMVSS

SEQ ID NO: 1098368 - protein, 9 aa, Homo Sapiens
HLTHLLGPD

SEQ ID NO: 1098369 - protein, 9 aa, Homo Sapiens
NLRLQPASQ

SEQ ID NO: 1098370 - protein, 9 aa, Homo Sapiens
ISVSLKNQP

SEQ ID NO: 1098371 - protein, 9 aa, Homo Sapiens
SSLPDKKKG

SEQ ID NO: 1098372 - protein, 9 aa, Homo Sapiens
LFLLHQVLR

SEQ ID NO: 1098373 - protein, 9 aa, Homo Sapiens
ELARMGSPK

SEQ ID NO: 1098374 - protein, 9 aa, Homo Sapiens
SYALSNKNL

SEQ ID NO: 1098375 - protein, 9 aa, Homo Sapiens
SSTASAATS

SEQ ID NO: 1098376 - protein, 9 aa, Homo Sapiens
GLLGSPLLS

SEQ ID NO: 1098377 - protein, 9 aa, Homo Sapiens
SSKDTWEIK

SEQ ID NO: 1098378 - protein, 9 aa, Homo Sapiens
DVCCLTGSE

SEQ ID NO: 1098379 - protein, 9 aa, Homo Sapiens
GPPRIELAR

SEQ ID NO: 1098380 - protein, 9 aa, Homo Sapiens
EVWEERNPY

SEQ ID NO: 1098381 - protein, 9 aa, Homo Sapiens
SRSSVVKFP

SEQ ID NO: 1098382 - protein, 9 aa, Homo Sapiens
RVRRHHLGL

SEQ ID NO: 1098383 - protein, 9 aa, Homo Sapiens
SHVGPGAPV

SEQ ID NO: 1098384 - protein, 9 aa, Homo Sapiens
PKGKLSVTF

SEQ ID NO: 1098385 - protein, 9 aa, Homo Sapiens
KLLEHGLVC

SEQ ID NO: 1098386 - protein, 9 aa, Homo Sapiens
ENILQLGEQ

SEQ ID NO: 1098387 - protein, 9 aa, Homo Sapiens
CSLHNKMCQ

SEQ ID NO: 1098388 - protein, 9 aa, Homo Sapiens
MPGPDSSGS

SEQ ID NO: 1098389 - protein, 9 aa, Homo Sapiens
CPHTSGFLC

SEQ ID NO: 1098390 - protein, 9 aa, Homo Sapiens
IELARMGPP

SEQ ID NO: 1098391 - protein, 9 aa, Homo Sapiens
AQEAVQEVA

SEQ ID NO: 1098392 - protein, 9 aa, Homo Sapiens
CRTFMPPPG

SEQ ID NO: 1098393 - protein, 9 aa, Homo Sapiens
ATPKRSSSQ

SEQ ID NO: 1098394 - protein, 9 aa, Homo Sapiens
VCLALLSAG

SEQ ID NO: 1098395 - protein, 9 aa, Homo Sapiens
GSPAELYVV

SEQ ID NO: 1098396 - protein, 9 aa, Homo Sapiens
GNQQRTGHQ

SEQ ID NO: 1098397 - protein, 9 aa, Homo Sapiens
SAPGLIITT

SEQ ID NO: 1098398 - protein, 9 aa, Homo Sapiens
ELDPPHRVA

SEQ ID NO: 1098399 - protein, 9 aa, Homo Sapiens
LSTTRKDTQ

SEQ ID NO: 1098400 - protein, 9 aa, Homo Sapiens
PAALVSWKQ

SEQ ID NO: 1098401 - protein, 9 aa, Homo Sapiens
LSVCLEQCP

SEQ ID NO: 1098402 - protein, 9 aa, Homo Sapiens
GTSALSKKL

SEQ ID NO: 1098403 - protein, 9 aa, Homo Sapiens
SRVWNTASF

SEQ ID NO: 1098404 - protein, 9 aa, Homo Sapiens
PRHQTSVLS

SEQ ID NO: 1098405 - protein, 9 aa, Homo Sapiens
LWSLTLSMA

SEQ ID NO: 1098406 - protein, 9 aa, Homo Sapiens
HSSYSVYIT

SEQ ID NO: 1098407 - protein, 9 aa, Homo Sapiens
GPNPVVLMP

SEQ ID NO: 1098408 - protein, 9 aa, Homo Sapiens
SRYSAVKYS

SEQ ID NO: 1098409 - protein, 9 aa, Homo Sapiens
PQNQLQPQP

SEQ ID NO: 1098410 - protein, 9 aa, Homo Sapiens
SPWPSPQQR

SEQ ID NO: 1098411 - protein, 9 aa, Homo Sapiens
AGLEPNGNA

SEQ ID NO: 1098412 - protein, 9 aa, Homo Sapiens
PVGSVMSCS

SEQ ID NO: 1098413 - protein, 9 aa, Homo Sapiens
CVFVLVRPL

SEQ ID NO: 1098414 - protein, 9 aa, Homo Sapiens
PNGNALPPT

SEQ ID NO: 1098415 - protein, 9 aa, Homo Sapiens
FIFFSLSSS

SEQ ID NO: 1098416 - protein, 9 aa, Homo Sapiens
KTTTSTDVG

SEQ ID NO: 1098417 - protein, 9 aa, Homo Sapiens
LSDSPPLQD

SEQ ID NO: 1098418 - protein, 9 aa, Homo Sapiens
QSSELDPPH

SEQ ID NO: 1098419 - protein, 9 aa, Homo Sapiens
KEAQAAVPA

SEQ ID NO: 1098420 - protein, 9 aa, Homo Sapiens
CFRTAGSAK

SEQ ID NO: 1098421 - protein, 9 aa, Homo Sapiens
EFTFKNLPK

SEQ ID NO: 1098422 - protein, 9 aa, Homo Sapiens
PLRGWRARK

SEQ ID NO: 1098423 - protein, 9 aa, Homo Sapiens
LVPPFLDGH

SEQ ID NO: 1098424 - protein, 9 aa, Homo Sapiens
SPVSQQSIR

SEQ ID NO: 1098425 - protein, 9 aa, Homo Sapiens
TWGCWPSTS

SEQ ID NO: 1098426 - protein, 9 aa, Homo Sapiens
NTVPTAIGQ

SEQ ID NO: 1098427 - protein, 9 aa, Homo Sapiens
LCPTPSAST

SEQ ID NO: 1098428 - protein, 9 aa, Homo Sapiens
EPTPRPRPV

SEQ ID NO: 1098429 - protein, 9 aa, Homo Sapiens
RSVPLAITI

SEQ ID NO: 1098430 - protein, 9 aa, Homo Sapiens
QKSLAQLLP

SEQ ID NO: 1098431 - protein, 9 aa, Homo Sapiens
TSIIVVILI

SEQ ID NO: 1098432 - protein, 9 aa, Homo Sapiens
PMGTVRSNP

SEQ ID NO: 1098433 - protein, 9 aa, Homo Sapiens
WRPCWATDC

SEQ ID NO: 1098434 - protein, 9 aa, Homo Sapiens
LEIALTISP

SEQ ID NO: 1098435 - protein, 9 aa, Homo Sapiens
SICNSSPNS

SEQ ID NO: 1098436 - protein, 9 aa, Homo Sapiens
VESFLFYVL

SEQ ID NO: 1098437 - protein, 9 aa, Homo Sapiens
GETRALRAR

SEQ ID NO: 1098438 - protein, 9 aa, Homo Sapiens
SLPELEATE

SEQ ID NO: 1098439 - protein, 9 aa, Homo Sapiens
LPRLVEHPG

SEQ ID NO: 1098440 - protein, 9 aa, Homo Sapiens
FSFMTHTNR

SEQ ID NO: 1098441 - protein, 9 aa, Homo Sapiens
VKYNATVRN

SEQ ID NO: 1098442 - protein, 9 aa, Homo Sapiens
VWTASGQRQ

SEQ ID NO: 1098443 - protein, 9 aa, Homo Sapiens
WDPPPGAAG

SEQ ID NO: 1098444 - protein, 9 aa, Homo Sapiens
PQWAPHSAG

SEQ ID NO: 1098445 - protein, 9 aa, Homo Sapiens
PVPVEHLAL

SEQ ID NO: 1098446 - protein, 9 aa, Homo Sapiens
RPLGVSPLA

SEQ ID NO: 1098447 - protein, 9 aa, Homo Sapiens
GMAPALRGT

SEQ ID NO: 1098448 - protein, 9 aa, Homo Sapiens
RDYNMDFLT

SEQ ID NO: 1098449 - protein, 9 aa, Homo Sapiens
ESPLGGSGG

SEQ ID NO: 1098450 - protein, 9 aa, Homo Sapiens
VTLQPVTSK

SEQ ID NO: 1098451 - protein, 9 aa, Homo Sapiens
DGPESTFTT

SEQ ID NO: 1098452 - protein, 9 aa, Homo Sapiens
PPKARRRPK

SEQ ID NO: 1098453 - protein, 9 aa, Homo Sapiens
DAWWGAEAA

SEQ ID NO: 1098454 - protein, 9 aa, Homo Sapiens
SMAVALAAY

SEQ ID NO: 1098455 - protein, 9 aa, Homo Sapiens
GHGLVSIAV

SEQ ID NO: 1098456 - protein, 9 aa, Homo Sapiens
SIKDVLQAV

SEQ ID NO: 1098457 - protein, 9 aa, Homo Sapiens
HGLYYIYAQ

SEQ ID NO: 1098458 - protein, 9 aa, Homo Sapiens
LAPAKGVEE

SEQ ID NO: 1098459 - protein, 9 aa, Homo Sapiens
PNTRVGTKC

SEQ ID NO: 1098460 - protein, 9 aa, Homo Sapiens
TVRTCVCWP

SEQ ID NO: 1098461 - protein, 9 aa, Homo Sapiens
DSLDQFSNS

SEQ ID NO: 1098462 - protein, 9 aa, Homo Sapiens
SFKLEHSAP

SEQ ID NO: 1098463 - protein, 9 aa, Homo Sapiens
LCSGERFGN

SEQ ID NO: 1098464 - protein, 9 aa, Homo Sapiens
SPICRTTMA

SEQ ID NO: 1098465 - protein, 9 aa, Homo Sapiens
QNTRILRKC

SEQ ID NO: 1098466 - protein, 9 aa, Homo Sapiens
WSMGGDTAM

SEQ ID NO: 1098467 - protein, 9 aa, Homo Sapiens
LTLGGWTTR

SEQ ID NO: 1098468 - protein, 9 aa, Homo Sapiens
GVGGRSPVW

SEQ ID NO: 1098469 - protein, 9 aa, Homo Sapiens
QHHVLQEGS

SEQ ID NO: 1098470 - protein, 9 aa, Homo Sapiens
SPKIEVARM

SEQ ID NO: 1098471 - protein, 9 aa, Homo Sapiens
QVGGTQEVE

SEQ ID NO: 1098472 - protein, 9 aa, Homo Sapiens
LQSVAVGAR

SEQ ID NO: 1098473 - protein, 9 aa, Homo Sapiens
DQRKPPNWQ

SEQ ID NO: 1098474 - protein, 9 aa, Homo Sapiens
PDSVDEIAY

SEQ ID NO: 1098475 - protein, 9 aa, Homo Sapiens
LGRGIFGQR

SEQ ID NO: 1098476 - protein, 9 aa, Homo Sapiens
GACTPAQSF

SEQ ID NO: 1098477 - protein, 9 aa, Homo Sapiens
SGARGRTGA

SEQ ID NO: 1098478 - protein, 9 aa, Homo Sapiens
SSCLPKDLS

SEQ ID NO: 1098479 - protein, 9 aa, Homo Sapiens
AHYDNQKVV

SEQ ID NO: 1098480 - protein, 9 aa, Homo Sapiens
WARCYRSCE

SEQ ID NO: 1098481 - protein, 9 aa, Homo Sapiens
LLRPGGTSS

SEQ ID NO: 1098482 - protein, 9 aa, Homo Sapiens
SWQLLQPNK

SEQ ID NO: 1098483 - protein, 9 aa, Homo Sapiens
MSAPQPTPC

SEQ ID NO: 1098484 - protein, 9 aa, Homo Sapiens
VSPLAPCPP

SEQ ID NO: 1098485 - protein, 9 aa, Homo Sapiens
AWKTEGYSG

SEQ ID NO: 1098486 - protein, 9 aa, Homo Sapiens
KRPIQEEYE

SEQ ID NO: 1098487 - protein, 9 aa, Homo Sapiens
PRPPCSQRL

SEQ ID NO: 1098488 - protein, 9 aa, Homo Sapiens
GTLFNGLTL

SEQ ID NO: 1098489 - protein, 9 aa, Homo Sapiens
MGLFTPDMA

SEQ ID NO: 1098490 - protein, 9 aa, Homo Sapiens
LRPARCGRC

SEQ ID NO: 1098491 - protein, 9 aa, Homo Sapiens
PRDLGTVAG

SEQ ID NO: 1098492 - protein, 9 aa, Homo Sapiens
EATPYLYQL

SEQ ID NO: 1098493 - protein, 9 aa, Homo Sapiens
SIPAPLEKT

SEQ ID NO: 1098494 - protein, 9 aa, Homo Sapiens
RVRGGVPDP

SEQ ID NO: 1098495 - protein, 9 aa, Homo Sapiens
SRRPVRPGC

SEQ ID NO: 1098496 - protein, 9 aa, Homo Sapiens
ALCACPMDK

SEQ ID NO: 1098497 - protein, 9 aa, Homo Sapiens
PAPSICKQI

SEQ ID NO: 1098498 - protein, 9 aa, Homo Sapiens
EVNAGGRRE

SEQ ID NO: 1098499 - protein, 9 aa, Homo Sapiens
IGVPEKKVD

SEQ ID NO: 1098500 - protein, 9 aa, Homo Sapiens
RSTVVSMAV

SEQ ID NO: 1098501 - protein, 9 aa, Homo Sapiens
LQQVIHLLN

SEQ ID NO: 1098502 - protein, 9 aa, Homo Sapiens
FRLPRNGQE

SEQ ID NO: 1098503 - protein, 9 aa, Homo Sapiens
NDVPPSIFS

SEQ ID NO: 1098504 - protein, 9 aa, Homo Sapiens
AGWVLLPRL

SEQ ID NO: 1098505 - protein, 9 aa, Homo Sapiens
GSVEHRSLI

SEQ ID NO: 1098506 - protein, 9 aa, Homo Sapiens
LAVDKGYWI

SEQ ID NO: 1098507 - protein, 9 aa, Homo Sapiens
PAPGPSPLV

SEQ ID NO: 1098508 - protein, 9 aa, Homo Sapiens
CLLTAHLLR

SEQ ID NO: 1098509 - protein, 9 aa, Homo Sapiens
QLSIMTRAS

SEQ ID NO: 1098510 - protein, 9 aa, Homo Sapiens
PPHQQDPGG

SEQ ID NO: 1098511 - protein, 9 aa, Homo Sapiens
KCSFFMISP

SEQ ID NO: 1098512 - protein, 9 aa, Homo Sapiens
SSVVKFPVT

SEQ ID NO: 1098513 - protein, 9 aa, Homo Sapiens
SQPTASVQL

SEQ ID NO: 1098514 - protein, 9 aa, Homo Sapiens
MQAQHPPEG

SEQ ID NO: 1098515 - protein, 9 aa, Homo Sapiens
LCISLLGAI

SEQ ID NO: 1098516 - protein, 9 aa, Homo Sapiens
EGHHKLFIS

SEQ ID NO: 1098517 - protein, 9 aa, Homo Sapiens
SSGSSEDSV

SEQ ID NO: 1098518 - protein, 9 aa, Homo Sapiens
PHRPPGGGR

SEQ ID NO: 1098519 - protein, 9 aa, Homo Sapiens
GSRRCCLRT

SEQ ID NO: 1098520 - protein, 9 aa, Homo Sapiens
FDPKLLEHG

SEQ ID NO: 1098521 - protein, 9 aa, Homo Sapiens
SLWAPAPAD

SEQ ID NO: 1098522 - protein, 9 aa, Homo Sapiens
QMALRANMA

SEQ ID NO: 1098523 - protein, 9 aa, Homo Sapiens
VRACQGFMG

SEQ ID NO: 1098524 - protein, 9 aa, Homo Sapiens
QKEQTALYR

SEQ ID NO: 1098525 - protein, 9 aa, Homo Sapiens
ELWYSVALV

SEQ ID NO: 1098526 - protein, 9 aa, Homo Sapiens
RKDGPPRIE

SEQ ID NO: 1098527 - protein, 9 aa, Homo Sapiens
SKDIIISDT

SEQ ID NO: 1098528 - protein, 9 aa, Homo Sapiens
GAISRSSHT

SEQ ID NO: 1098529 - protein, 9 aa, Homo Sapiens
DQHRMSLHL

SEQ ID NO: 1098530 - protein, 9 aa, Homo Sapiens
FIHHYYRRS

SEQ ID NO: 1098531 - protein, 9 aa, Homo Sapiens
GKKSETGAC

SEQ ID NO: 1098532 - protein, 9 aa, Homo Sapiens
PRPRPVSMT

SEQ ID NO: 1098533 - protein, 9 aa, Homo Sapiens
GKQSILSVC

SEQ ID NO: 1098534 - protein, 9 aa, Homo Sapiens
EWRQGGSPV

SEQ ID NO: 1098535 - protein, 9 aa, Homo Sapiens
WYLCSSASS

SEQ ID NO: 1098536 - protein, 9 aa, Homo Sapiens
VQPGSLPLL

SEQ ID NO: 1098537 - protein, 9 aa, Homo Sapiens
GHFSQARTR

SEQ ID NO: 1098538 - protein, 9 aa, Homo Sapiens
CWTWMTWCG

SEQ ID NO: 1098539 - protein, 9 aa, Homo Sapiens
KWMPVVDPQ

SEQ ID NO: 1098540 - protein, 9 aa, Homo Sapiens
ATGLPNITD

SEQ ID NO: 1098541 - protein, 9 aa, Homo Sapiens
CKLSPPSYC

SEQ ID NO: 1098542 - protein, 9 aa, Homo Sapiens
LGGCPEACA

SEQ ID NO: 1098543 - protein, 9 aa, Homo Sapiens
DTGADDWET

SEQ ID NO: 1098544 - protein, 9 aa, Homo Sapiens
ACTAPRAGP

SEQ ID NO: 1098545 - protein, 9 aa, Homo Sapiens
ALREWGHCQ

SEQ ID NO: 1098546 - protein, 9 aa, Homo Sapiens
AKWLLPLPG

SEQ ID NO: 1098547 - protein, 9 aa, Homo Sapiens
LQPNKVPEI

SEQ ID NO: 1098548 - protein, 9 aa, Homo Sapiens
ASCGTGSRR

SEQ ID NO: 1098549 - protein, 9 aa, Homo Sapiens
DTPCIWQPV

SEQ ID NO: 1098550 - protein, 9 aa, Homo Sapiens
GNRVIRMPR

SEQ ID NO: 1098551 - protein, 9 aa, Homo Sapiens
SSASSAWGS

SEQ ID NO: 1098552 - protein, 9 aa, Homo Sapiens
PPGRGVPAL

SEQ ID NO: 1098553 - protein, 9 aa, Homo Sapiens
LCLGPRDAP

SEQ ID NO: 1098554 - protein, 9 aa, Homo Sapiens
LVLAVVKII

SEQ ID NO: 1098555 - protein, 9 aa, Homo Sapiens
MASPARLGQ

SEQ ID NO: 1098556 - protein, 9 aa, Homo Sapiens
WAGVLSHLA

SEQ ID NO: 1098557 - protein, 9 aa, Homo Sapiens
SNMGSPPPH

SEQ ID NO: 1098558 - protein, 9 aa, Homo Sapiens
SASCIRCGN

SEQ ID NO: 1098559 - protein, 9 aa, Homo Sapiens
TISLQYKKE

SEQ ID NO: 1098560 - protein, 9 aa, Homo Sapiens
GYLLVPARY

SEQ ID NO: 1098561 - protein, 9 aa, Homo Sapiens
VWASAVNVN

SEQ ID NO: 1098562 - protein, 9 aa, Homo Sapiens
IITTGSVGK

SEQ ID NO: 1098563 - protein, 9 aa, Homo Sapiens
QGEVITQQG

SEQ ID NO: 1098564 - protein, 9 aa, Homo Sapiens
RNTEAMKIM

SEQ ID NO: 1098565 - protein, 9 aa, Homo Sapiens
SEGCIPSDK

SEQ ID NO: 1098566 - protein, 9 aa, Homo Sapiens
SVKIFDVCN

SEQ ID NO: 1098567 - protein, 9 aa, Homo Sapiens
ATAASAGNG

SEQ ID NO: 1098568 - protein, 9 aa, Homo Sapiens
IYIVGGVST

SEQ ID NO: 1098569 - protein, 9 aa, Homo Sapiens
EGSRDLCPR

SEQ ID NO: 1098570 - protein, 9 aa, Homo Sapiens
VCPQCGATC

SEQ ID NO: 1098571 - protein, 9 aa, Homo Sapiens
CASTGSSTA

SEQ ID NO: 1098572 - protein, 9 aa, Homo Sapiens
ERPPGPHRP

SEQ ID NO: 1098573 - protein, 9 aa, Homo Sapiens
AQGGFPLWW

SEQ ID NO: 1098574 - protein, 9 aa, Homo Sapiens
NAVMRWGCH

SEQ ID NO: 1098575 - protein, 9 aa, Homo Sapiens
PPWAAASEM

SEQ ID NO: 1098576 - protein, 9 aa, Homo Sapiens
LHTDKTLVA

SEQ ID NO: 1098577 - protein, 9 aa, Homo Sapiens
ECRTFMPPP

SEQ ID NO: 1098578 - protein, 9 aa, Homo Sapiens
LLTAHLLRL

SEQ ID NO: 1098579 - protein, 9 aa, Homo Sapiens
GAAAAWRLD

SEQ ID NO: 1098580 - protein, 9 aa, Homo Sapiens
HHVLQEGSM

SEQ ID NO: 1098581 - protein, 9 aa, Homo Sapiens
TGHLLFPGL

SEQ ID NO: 1098582 - protein, 9 aa, Homo Sapiens
VPQIDQKQF

SEQ ID NO: 1098583 - protein, 9 aa, Homo Sapiens
GPSSFLGQT

SEQ ID NO: 1098584 - protein, 9 aa, Homo Sapiens
LDGMLTVIG

SEQ ID NO: 1098585 - protein, 9 aa, Homo Sapiens
FIQIMEKLS

SEQ ID NO: 1098586 - protein, 9 aa, Homo Sapiens
EGAGPRGQP

SEQ ID NO: 1098587 - protein, 9 aa, Homo Sapiens
PILFKLSCI

SEQ ID NO: 1098588 - protein, 9 aa, Homo Sapiens
KDVLQAVAA

SEQ ID NO: 1098589 - protein, 9 aa, Homo Sapiens
SIQGLYGLT

SEQ ID NO: 1098590 - protein, 9 aa, Homo Sapiens
PQGHREIHR

SEQ ID NO: 1098591 - protein, 9 aa, Homo Sapiens
LPSGAISVP

SEQ ID NO: 1098592 - protein, 9 aa, Homo Sapiens
RKATSPHLM

SEQ ID NO: 1098593 - protein, 9 aa, Homo Sapiens
MKKREEEMC

SEQ ID NO: 1098594 - protein, 9 aa, Homo Sapiens
LLALVTQVH

SEQ ID NO: 1098595 - protein, 9 aa, Homo Sapiens
PLQIILFFF

SEQ ID NO: 1098596 - protein, 9 aa, Homo Sapiens
MFGLCRRPQ

SEQ ID NO: 1098597 - protein, 9 aa, Homo Sapiens
KCDLRVSEC

SEQ ID NO: 1098598 - protein, 9 aa, Homo Sapiens
MTEPCKILF

SEQ ID NO: 1098599 - protein, 9 aa, Homo Sapiens
TSPAAIPTQ

SEQ ID NO: 1098600 - protein, 9 aa, Homo Sapiens
SYAVATASC

SEQ ID NO: 1098601 - protein, 9 aa, Homo Sapiens
GSVAPSFSI

SEQ ID NO: 1098602 - protein, 9 aa, Homo Sapiens
QSRKGVHQA

SEQ ID NO: 1098603 - protein, 9 aa, Homo Sapiens
AAVLSSEPV

SEQ ID NO: 1098604 - protein, 9 aa, Homo Sapiens
KRRRGSSPP

SEQ ID NO: 1098605 - protein, 9 aa, Homo Sapiens
PAGPLGAPG

SEQ ID NO: 1098606 - protein, 9 aa, Homo Sapiens
SSRGASCSS

SEQ ID NO: 1098607 - protein, 9 aa, Homo Sapiens
GRAAQSSKR

SEQ ID NO: 1098608 - protein, 9 aa, Homo Sapiens
LAELVAEKI

SEQ ID NO: 1098609 - protein, 9 aa, Homo Sapiens
TGLDDNIEN

SEQ ID NO: 1098610 - protein, 9 aa, Homo Sapiens
NRVIRMPRR

SEQ ID NO: 1098611 - protein, 9 aa, Homo Sapiens
VGMDQQPIM

SEQ ID NO: 1098612 - protein, 9 aa, Homo Sapiens
WKEVRGEWR

SEQ ID NO: 1098613 - protein, 9 aa, Homo Sapiens
LNFEATPYL

SEQ ID NO: 1098614 - protein, 9 aa, Homo Sapiens
AVRPPPSGD

SEQ ID NO: 1098615 - protein, 9 aa, Homo Sapiens
APDAQAAQL

SEQ ID NO: 1098616 - protein, 9 aa, Homo Sapiens
AGPCCPSTT

SEQ ID NO: 1098617 - protein, 9 aa, Homo Sapiens
LDANDNLPF

SEQ ID NO: 1098618 - protein, 9 aa, Homo Sapiens
FYQERANKK

SEQ ID NO: 1098619 - protein, 9 aa, Homo Sapiens
VWCMAPTIP

SEQ ID NO: 1098620 - protein, 9 aa, Homo Sapiens
RLPRNGQEV

SEQ ID NO: 1098621 - protein, 9 aa, Homo Sapiens
RFLPRVLPR

SEQ ID NO: 1098622 - protein, 9 aa, Homo Sapiens
TEWLDDKHV

SEQ ID NO: 1098623 - protein, 9 aa, Homo Sapiens
VSWKQSQQS

SEQ ID NO: 1098624 - protein, 9 aa, Homo Sapiens
KLRQVGLQI

SEQ ID NO: 1098625 - protein, 9 aa, Homo Sapiens
YVLLRNAHH

SEQ ID NO: 1098626 - protein, 9 aa, Homo Sapiens
YRCEGDQHV

SEQ ID NO: 1098627 - protein, 9 aa, Homo Sapiens
CGSATGPTT

SEQ ID NO: 1098628 - protein, 9 aa, Homo Sapiens
GGPKRSARA

SEQ ID NO: 1098629 - protein, 9 aa, Homo Sapiens
KALKKASSP

SEQ ID NO: 1098630 - protein, 9 aa, Homo Sapiens
PSAGAWPRT

SEQ ID NO: 1098631 - protein, 9 aa, Homo Sapiens
ASICNSSPN

SEQ ID NO: 1098632 - protein, 9 aa, Homo Sapiens
LLAFIFFSL

SEQ ID NO: 1098633 - protein, 9 aa, Homo Sapiens
LPGPASALP

SEQ ID NO: 1098634 - protein, 9 aa, Homo Sapiens
HPQPRPSTP

SEQ ID NO: 1098635 - protein, 9 aa, Homo Sapiens
RPWPPSFSA

SEQ ID NO: 1098636 - protein, 9 aa, Homo Sapiens
WMPPPEVTL

SEQ ID NO: 1098637 - protein, 9 aa, Homo Sapiens
ASQTPAGME

SEQ ID NO: 1098638 - protein, 9 aa, Homo Sapiens
GAQAARIRA

SEQ ID NO: 1098639 - protein, 9 aa, Homo Sapiens
RHLMWMNMN

SEQ ID NO: 1098640 - protein, 9 aa, Homo Sapiens
GSISTTRYV

SEQ ID NO: 1098641 - protein, 9 aa, Homo Sapiens
YSRYSAVKY

SEQ ID NO: 1098642 - protein, 9 aa, Homo Sapiens
VPTKKIKQC

SEQ ID NO: 1098643 - protein, 9 aa, Homo Sapiens
TGEQAPPWA

SEQ ID NO: 1098644 - protein, 9 aa, Homo Sapiens
DVEELTAKE

SEQ ID NO: 1098645 - protein, 9 aa, Homo Sapiens
IREGTAPDY

SEQ ID NO: 1098646 - protein, 9 aa, Homo Sapiens
AATTLTSAA

SEQ ID NO: 1098647 - protein, 9 aa, Homo Sapiens
TKCFSFGSV

SEQ ID NO: 1098648 - protein, 9 aa, Homo Sapiens
TVKRHGLYY

SEQ ID NO: 1098649 - protein, 9 aa, Homo Sapiens
AATAASAGN

SEQ ID NO: 1098650 - protein, 9 aa, Homo Sapiens
VKGIVKLTQ

SEQ ID NO: 1098651 - protein, 9 aa, Homo Sapiens
VRPPPSGDR

SEQ ID NO: 1098652 - protein, 9 aa, Homo Sapiens
VDAQVGPLP

SEQ ID NO: 1098653 - protein, 9 aa, Homo Sapiens
ILYLVVAVA

SEQ ID NO: 1098654 - protein, 9 aa, Homo Sapiens
SFALAMGVG

SEQ ID NO: 1098655 - protein, 9 aa, Homo Sapiens
DAKGSTTRA

SEQ ID NO: 1098656 - protein, 9 aa, Homo Sapiens
LTSHSTGPP

SEQ ID NO: 1098657 - protein, 9 aa, Homo Sapiens
VHDQKECVY

SEQ ID NO: 1098658 - protein, 9 aa, Homo Sapiens
ISVPVSHSL

SEQ ID NO: 1098659 - protein, 9 aa, Homo Sapiens
EPAAARGAS

SEQ ID NO: 1098660 - protein, 9 aa, Homo Sapiens
KEKLSSLRI

SEQ ID NO: 1098661 - protein, 9 aa, Homo Sapiens
LSQAGGAPM

SEQ ID NO: 1098662 - protein, 9 aa, Homo Sapiens
TSASPMAAT

SEQ ID NO: 1098663 - protein, 9 aa, Homo Sapiens
HRDMVPQAV

SEQ ID NO: 1098664 - protein, 9 aa, Homo Sapiens
PSRPRSPAS

SEQ ID NO: 1098665 - protein, 9 aa, Homo Sapiens
STEPSLVLT

SEQ ID NO: 1098666 - protein, 9 aa, Homo Sapiens
MKADKLYLQ

SEQ ID NO: 1098667 - protein, 9 aa, Homo Sapiens
LECWDPTPQ

SEQ ID NO: 1098668 - protein, 9 aa, Homo Sapiens
QPNTQSESP

SEQ ID NO: 1098669 - protein, 9 aa, Homo Sapiens
CPEACAPGQ

SEQ ID NO: 1098670 - protein, 9 aa, Homo Sapiens
MCPLNPAAQ

SEQ ID NO: 1098671 - protein, 9 aa, Homo Sapiens
KTGASSCLA

SEQ ID NO: 1098672 - protein, 9 aa, Homo Sapiens
TRTHQEYLK

SEQ ID NO: 1098673 - protein, 9 aa, Homo Sapiens
ARAGPKRAV

SEQ ID NO: 1098674 - protein, 9 aa, Homo Sapiens
HGIITMRGL

SEQ ID NO: 1098675 - protein, 9 aa, Homo Sapiens
STPRGRTSG

SEQ ID NO: 1098676 - protein, 9 aa, Homo Sapiens
SSEDSVVEI

SEQ ID NO: 1098677 - protein, 9 aa, Homo Sapiens
GPRGQPNYL

SEQ ID NO: 1098678 - protein, 9 aa, Homo Sapiens
SLPLSSSPA

SEQ ID NO: 1098679 - protein, 9 aa, Homo Sapiens
VTALRRTVH

SEQ ID NO: 1098680 - protein, 9 aa, Homo Sapiens
QHVTGQDPE

SEQ ID NO: 1098681 - protein, 9 aa, Homo Sapiens
VRLTRHAGR

SEQ ID NO: 1098682 - protein, 9 aa, Homo Sapiens
WGPALSRPS

SEQ ID NO: 1098683 - protein, 9 aa, Homo Sapiens
KEMSEFIWE

SEQ ID NO: 1098684 - protein, 9 aa, Homo Sapiens
KLSRNILEM

SEQ ID NO: 1098685 - protein, 9 aa, Homo Sapiens
GIAGSGKTT

SEQ ID NO: 1098686 - protein, 9 aa, Homo Sapiens
GCWDMYHHD

SEQ ID NO: 1098687 - protein, 9 aa, Homo Sapiens
VLTYALSSH

SEQ ID NO: 1098688 - protein, 9 aa, Homo Sapiens
AKEEECLIA

SEQ ID NO: 1098689 - protein, 9 aa, Homo Sapiens
PSPLVAPRQ

SEQ ID NO: 1098690 - protein, 9 aa, Homo Sapiens
DLTFILLQL

SEQ ID NO: 1098691 - protein, 9 aa, Homo Sapiens
LEQSRRPSI

SEQ ID NO: 1098692 - protein, 9 aa, Homo Sapiens
WTELTALGT

SEQ ID NO: 1098693 - protein, 9 aa, Homo Sapiens
WWWGTLVRR

SEQ ID NO: 1098694 - protein, 9 aa, Homo Sapiens
CTVSASLLA

SEQ ID NO: 1098695 - protein, 9 aa, Homo Sapiens
TVCRESERD

SEQ ID NO: 1098696 - protein, 9 aa, Homo Sapiens
CKQNVVPTV

SEQ ID NO: 1098697 - protein, 9 aa, Homo Sapiens
KKGTPTEWT

SEQ ID NO: 1098698 - protein, 9 aa, Homo Sapiens
SHLDFSPYW

SEQ ID NO: 1098699 - protein, 9 aa, Homo Sapiens
LMGPRTDSQ

SEQ ID NO: 1098700 - protein, 9 aa, Homo Sapiens
FCGRGNHPK

SEQ ID NO: 1098701 - protein, 9 aa, Homo Sapiens
LHFLLILCC

SEQ ID NO: 1098702 - protein, 9 aa, Homo Sapiens
FTPPKERPD

SEQ ID NO: 1098703 - protein, 9 aa, Homo Sapiens
GNIRIWFIR

SEQ ID NO: 1098704 - protein, 9 aa, Homo Sapiens
WVASPPTRS

SEQ ID NO: 1098705 - protein, 9 aa, Homo Sapiens
IAAFFVDSS

SEQ ID NO: 1098706 - protein, 9 aa, Homo Sapiens
SLDEIYHMG

SEQ ID NO: 1098707 - protein, 9 aa, Homo Sapiens
QLHGAGFGP

SEQ ID NO: 1098708 - protein, 9 aa, Homo Sapiens
RIFKWMPVV

SEQ ID NO: 1098709 - protein, 9 aa, Homo Sapiens
CVPGIPDPG

SEQ ID NO: 1098710 - protein, 9 aa, Homo Sapiens
VCTDSAVPM

SEQ ID NO: 1098711 - protein, 9 aa, Homo Sapiens
GRGQILHRG

SEQ ID NO: 1098712 - protein, 9 aa, Homo Sapiens
VFDGRDTKA

SEQ ID NO: 1098713 - protein, 9 aa, Homo Sapiens
TTSSRLARA

SEQ ID NO: 1098714 - protein, 9 aa, Homo Sapiens
GVIGSPQRR

SEQ ID NO: 1098715 - protein, 9 aa, Homo Sapiens
SAPPRTQHI

SEQ ID NO: 1098716 - protein, 9 aa, Homo Sapiens
EPEFQSTCV

SEQ ID NO: 1098717 - protein, 9 aa, Homo Sapiens
CRKVLEDPL

SEQ ID NO: 1098718 - protein, 9 aa, Homo Sapiens
PASQTPAGM

SEQ ID NO: 1098719 - protein, 9 aa, Homo Sapiens
SVPEAEAGA

SEQ ID NO: 1098720 - protein, 9 aa, Homo Sapiens
QSAPPIRRV

SEQ ID NO: 1098721 - protein, 9 aa, Homo Sapiens
GPLPCVLPH

SEQ ID NO: 1098722 - protein, 9 aa, Homo Sapiens
LRNAHHAVY

SEQ ID NO: 1098723 - protein, 9 aa, Homo Sapiens
NSRHLHPQA

SEQ ID NO: 1098724 - protein, 9 aa, Homo Sapiens
DTGACTPAQ

SEQ ID NO: 1098725 - protein, 9 aa, Homo Sapiens
RRTRPNRVL

SEQ ID NO: 1098726 - protein, 9 aa, Homo Sapiens
QPDHSRLSP

SEQ ID NO: 1098727 - protein, 9 aa, Homo Sapiens
PPFIITNVV

SEQ ID NO: 1098728 - protein, 9 aa, Homo Sapiens
PPPAPPAAL

SEQ ID NO: 1098729 - protein, 9 aa, Homo Sapiens
PESTFTTPK

SEQ ID NO: 1098730 - protein, 9 aa, Homo Sapiens
LLPWARFQD

SEQ ID NO: 1098731 - protein, 9 aa, Homo Sapiens
EVSLWMENE

SEQ ID NO: 1098732 - protein, 9 aa, Homo Sapiens
WPLWRPCWA

SEQ ID NO: 1098733 - protein, 9 aa, Homo Sapiens
LRAEKLRPH

SEQ ID NO: 1098734 - protein, 9 aa, Homo Sapiens
AIAAPDSRR

SEQ ID NO: 1098735 - protein, 9 aa, Homo Sapiens
IAEELCQCL

SEQ ID NO: 1098736 - protein, 9 aa, Homo Sapiens
DKKLAPPFK

SEQ ID NO: 1098737 - protein, 9 aa, Homo Sapiens
AAYPPLPAA

SEQ ID NO: 1098738 - protein, 9 aa, Homo Sapiens
DSPPFIITN

SEQ ID NO: 1098739 - protein, 9 aa, Homo Sapiens
DHLPRRATM

SEQ ID NO: 1098740 - protein, 9 aa, Homo Sapiens
WLSYCLLKA

SEQ ID NO: 1098741 - protein, 9 aa, Homo Sapiens
LGATVKEKL

SEQ ID NO: 1098742 - protein, 9 aa, Homo Sapiens
NDIVAVPAT

SEQ ID NO: 1098743 - protein, 9 aa, Homo Sapiens
VARMWTPRI

SEQ ID NO: 1098744 - protein, 9 aa, Homo Sapiens
RLYNERGKE

SEQ ID NO: 1098745 - protein, 9 aa, Homo Sapiens
ACSTFFLVN

SEQ ID NO: 1098746 - protein, 9 aa, Homo Sapiens
SYTPQDPET

SEQ ID NO: 1098747 - protein, 9 aa, Homo Sapiens
VGVIQCPVC

SEQ ID NO: 1098748 - protein, 9 aa, Homo Sapiens
TPCIWQPVM

SEQ ID NO: 1098749 - protein, 9 aa, Homo Sapiens
PEKPGRVRC

SEQ ID NO: 1098750 - protein, 9 aa, Homo Sapiens
VPRQDHEHV

SEQ ID NO: 1098751 - protein, 9 aa, Homo Sapiens
VPWPEVWKE

SEQ ID NO: 1098752 - protein, 9 aa, Homo Sapiens
VQAVQPILI

SEQ ID NO: 1098753 - protein, 9 aa, Homo Sapiens
ISQPGPSSP

SEQ ID NO: 1098754 - protein, 9 aa, Homo Sapiens
KELRQDPPS

SEQ ID NO: 1098755 - protein, 9 aa, Homo Sapiens
LESKMKADK

SEQ ID NO: 1098756 - protein, 9 aa, Homo Sapiens
AVHVVLDHH

SEQ ID NO: 1098757 - protein, 9 aa, Homo Sapiens
TVKTKATQN

SEQ ID NO: 1098758 - protein, 9 aa, Homo Sapiens
DTTLEVQSL

SEQ ID NO: 1098759 - protein, 9 aa, Homo Sapiens
FGWQMRAST

SEQ ID NO: 1098760 - protein, 9 aa, Homo Sapiens
TRMMSPKIE

SEQ ID NO: 1098761 - protein, 9 aa, Homo Sapiens
LWTAGSLVC

SEQ ID NO: 1098762 - protein, 9 aa, Homo Sapiens
QTEEATVVL

SEQ ID NO: 1098763 - protein, 9 aa, Homo Sapiens
AHLGKYILC

SEQ ID NO: 1098764 - protein, 9 aa, Homo Sapiens
SSEENNLGA

SEQ ID NO: 1098765 - protein, 9 aa, Homo Sapiens
YSKDSGLLT

SEQ ID NO: 1098766 - protein, 9 aa, Homo Sapiens
CSSVIMTAK

SEQ ID NO: 1098767 - protein, 9 aa, Homo Sapiens
DHYLVVLAT

SEQ ID NO: 1098768 - protein, 9 aa, Homo Sapiens
NPQLLCQNP

SEQ ID NO: 1098769 - protein, 9 aa, Homo Sapiens
EQHTDTVGI

SEQ ID NO: 1098770 - protein, 9 aa, Homo Sapiens
PLLDVAPVD

SEQ ID NO: 1098771 - protein, 9 aa, Homo Sapiens
WRPGTCTNI

SEQ ID NO: 1098772 - protein, 9 aa, Homo Sapiens
GSKHGIITM

SEQ ID NO: 1098773 - protein, 9 aa, Homo Sapiens
MRDFRMGKR

SEQ ID NO: 1098774 - protein, 9 aa, Homo Sapiens
PRKGGAGHM

SEQ ID NO: 1098775 - protein, 9 aa, Homo Sapiens
LTAHKVIHT

SEQ ID NO: 1098776 - protein, 9 aa, Homo Sapiens
RLTRERAAA

SEQ ID NO: 1098777 - protein, 9 aa, Homo Sapiens
GEERLKNPN

SEQ ID NO: 1098778 - protein, 9 aa, Homo Sapiens
CSARAGRGS

SEQ ID NO: 1098779 - protein, 9 aa, Homo Sapiens
RKLAINMVP

SEQ ID NO: 1098780 - protein, 9 aa, Homo Sapiens
ELRKATTPI

SEQ ID NO: 1098781 - protein, 9 aa, Homo Sapiens
HLGDGKKMD

SEQ ID NO: 1098782 - protein, 9 aa, Homo Sapiens
WARAHLAVE

SEQ ID NO: 1098783 - protein, 9 aa, Homo Sapiens
REGTAPDYS

SEQ ID NO: 1098784 - protein, 9 aa, Homo Sapiens
DDVPVMLPS

SEQ ID NO: 1098785 - protein, 9 aa, Homo Sapiens
GLQQGDLLT

SEQ ID NO: 1098786 - protein, 9 aa, Homo Sapiens
TPSSYLELP

SEQ ID NO: 1098787 - protein, 9 aa, Homo Sapiens
SGVKKPIIS

SEQ ID NO: 1098788 - protein, 9 aa, Homo Sapiens
VDKGPKEPL

SEQ ID NO: 1098789 - protein, 9 aa, Homo Sapiens
VLFHCQKGY

SEQ ID NO: 1098790 - protein, 9 aa, Homo Sapiens
LQQVGIFLD

SEQ ID NO: 1098791 - protein, 9 aa, Homo Sapiens
FSNQYKAPQ

SEQ ID NO: 1098792 - protein, 9 aa, Homo Sapiens
DGLDAVGMD

SEQ ID NO: 1098793 - protein, 9 aa, Homo Sapiens
DTDANGQVT

SEQ ID NO: 1098794 - protein, 9 aa, Homo Sapiens
PASGVGEEI

SEQ ID NO: 1098795 - protein, 9 aa, Homo Sapiens
GGKHSPICR

SEQ ID NO: 1098796 - protein, 9 aa, Homo Sapiens
VLSSCVALF

SEQ ID NO: 1098797 - protein, 9 aa, Homo Sapiens
RLVEHPGLC

SEQ ID NO: 1098798 - protein, 9 aa, Homo Sapiens
VPPHLGQEP

SEQ ID NO: 1098799 - protein, 9 aa, Homo Sapiens
VKIELKIQS

SEQ ID NO: 1098800 - protein, 9 aa, Homo Sapiens
ASLDLLLCF

SEQ ID NO: 1098801 - protein, 9 aa, Homo Sapiens
LRVPDTHVT

SEQ ID NO: 1098802 - protein, 9 aa, Homo Sapiens
YETDCYIVL

SEQ ID NO: 1098803 - protein, 9 aa, Homo Sapiens
PSLTHHRNR

SEQ ID NO: 1098804 - protein, 9 aa, Homo Sapiens
AISVPVSHS

SEQ ID NO: 1098805 - protein, 9 aa, Homo Sapiens
LCQNPEKLA

SEQ ID NO: 1098806 - protein, 9 aa, Homo Sapiens
STAPSKDDA

SEQ ID NO: 1098807 - protein, 9 aa, Homo Sapiens
SKKSSHCLL

SEQ ID NO: 1098808 - protein, 9 aa, Homo Sapiens
LQLALTAFQ

SEQ ID NO: 1098809 - protein, 9 aa, Homo Sapiens
PAELYVVLN

SEQ ID NO: 1098810 - protein, 9 aa, Homo Sapiens
GLLSFPVLV

SEQ ID NO: 1098811 - protein, 9 aa, Homo Sapiens
WQGSGGNER

SEQ ID NO: 1098812 - protein, 9 aa, Homo Sapiens
YAYRRLLAA

SEQ ID NO: 1098813 - protein, 9 aa, Homo Sapiens
EPPGSYAVA

SEQ ID NO: 1098814 - protein, 9 aa, Homo Sapiens
IFIRNCILE

SEQ ID NO: 1098815 - protein, 9 aa, Homo Sapiens
PPSPSSLLS

SEQ ID NO: 1098816 - protein, 9 aa, Homo Sapiens
PAACQLCCG

SEQ ID NO: 1098817 - protein, 9 aa, Homo Sapiens
HIHFFLALY

SEQ ID NO: 1098818 - protein, 9 aa, Homo Sapiens
WEEASQVGG

SEQ ID NO: 1098819 - protein, 9 aa, Homo Sapiens
IQSSLKQKL

SEQ ID NO: 1098820 - protein, 9 aa, Homo Sapiens
DFRMGKRSV

SEQ ID NO: 1098821 - protein, 9 aa, Homo Sapiens
PTEWTRPSR

SEQ ID NO: 1098822 - protein, 9 aa, Homo Sapiens
RLCAPGAPA

SEQ ID NO: 1098823 - protein, 9 aa, Homo Sapiens
LLDSSDPSK

SEQ ID NO: 1098824 - protein, 9 aa, Homo Sapiens
TGASSCLAG

SEQ ID NO: 1098825 - protein, 9 aa, Homo Sapiens
VCMMVDSLV

SEQ ID NO: 1098826 - protein, 9 aa, Homo Sapiens
YPQTSGGVL

SEQ ID NO: 1098827 - protein, 9 aa, Homo Sapiens
NTFTMRPGT

SEQ ID NO: 1098828 - protein, 9 aa, Homo Sapiens
LRIFKWMPV

SEQ ID NO: 1098829 - protein, 9 aa, Homo Sapiens
TGQDPEPAG

SEQ ID NO: 1098830 - protein, 9 aa, Homo Sapiens
PAVHDGAAR

SEQ ID NO: 1098831 - protein, 9 aa, Homo Sapiens
VRSPSRCGS

SEQ ID NO: 1098832 - protein, 9 aa, Homo Sapiens
TPTCLRTCH

SEQ ID NO: 1098833 - protein, 9 aa, Homo Sapiens
LGNIRIWFI

SEQ ID NO: 1098834 - protein, 9 aa, Homo Sapiens
IMESAVLLD

SEQ ID NO: 1098835 - protein, 9 aa, Homo Sapiens
TFFTLMRKL

SEQ ID NO: 1098836 - protein, 9 aa, Homo Sapiens
LVWPDTTHP

SEQ ID NO: 1098837 - protein, 9 aa, Homo Sapiens
GVRALGKWL

SEQ ID NO: 1098838 - protein, 9 aa, Homo Sapiens
SSSGGGSGY

SEQ ID NO: 1098839 - protein, 9 aa, Homo Sapiens
DTKYVRILA

SEQ ID NO: 1098840 - protein, 9 aa, Homo Sapiens
RVWSRNVAS

SEQ ID NO: 1098841 - protein, 9 aa, Homo Sapiens
FTSRTKARV

SEQ ID NO: 1098842 - protein, 9 aa, Homo Sapiens
DEVWEERNP

SEQ ID NO: 1098843 - protein, 9 aa, Homo Sapiens
EVSSCGQTG

SEQ ID NO: 1098844 - protein, 9 aa, Homo Sapiens
QVRQLQEGR

SEQ ID NO: 1098845 - protein, 9 aa, Homo Sapiens
ESAHSMCKQ

SEQ ID NO: 1098846 - protein, 9 aa, Homo Sapiens
PLWWPASGR

SEQ ID NO: 1098847 - protein, 9 aa, Homo Sapiens
TQSLCFIHH

SEQ ID NO: 1098848 - protein, 9 aa, Homo Sapiens
CDKKKEAQA

SEQ ID NO: 1098849 - protein, 9 aa, Homo Sapiens
DIAHMIGGF

SEQ ID NO: 1098850 - protein, 9 aa, Homo Sapiens
HVDATVFTC

SEQ ID NO: 1098851 - protein, 9 aa, Homo Sapiens
KFLPLTMES

SEQ ID NO: 1098852 - protein, 9 aa, Homo Sapiens
GPVFPPLIP

SEQ ID NO: 1098853 - protein, 9 aa, Homo Sapiens
QDVYDKKLA

SEQ ID NO: 1098854 - protein, 9 aa, Homo Sapiens
ASTAKSATC

SEQ ID NO: 1098855 - protein, 9 aa, Homo Sapiens
PVFEFVWPP

SEQ ID NO: 1098856 - protein, 9 aa, Homo Sapiens
INDLVKWKI

SEQ ID NO: 1098857 - protein, 9 aa, Homo Sapiens
LVCSARAGR

SEQ ID NO: 1098858 - protein, 9 aa, Homo Sapiens
GGVATPGRP

SEQ ID NO: 1098859 - protein, 9 aa, Homo Sapiens
GQDLCPGAS

SEQ ID NO: 1098860 - protein, 9 aa, Homo Sapiens
VSMAVALAA

SEQ ID NO: 1098861 - protein, 9 aa, Homo Sapiens
FKNDRILEG

SEQ ID NO: 1098862 - protein, 9 aa, Homo Sapiens
PPETPGLLR

SEQ ID NO: 1098863 - protein, 9 aa, Homo Sapiens
PSWVWCMAP

SEQ ID NO: 1098864 - protein, 9 aa, Homo Sapiens
SSSRTACGA

SEQ ID NO: 1098865 - protein, 9 aa, Homo Sapiens
STPVGPVAG

SEQ ID NO: 1098866 - protein, 9 aa, Homo Sapiens
SWPLQPAPP

SEQ ID NO: 1098867 - protein, 9 aa, Homo Sapiens
TSVLGGCPE

SEQ ID NO: 1098868 - protein, 9 aa, Homo Sapiens
FLAVWLSCI

SEQ ID NO: 1098869 - protein, 9 aa, Homo Sapiens
VGMTPRDLG

SEQ ID NO: 1098870 - protein, 9 aa, Homo Sapiens
LFGDTVNTT

SEQ ID NO: 1098871 - protein, 9 aa, Homo Sapiens
CGRCMRVNM

SEQ ID NO: 1098872 - protein, 9 aa, Homo Sapiens
VIREGWRWG

SEQ ID NO: 1098873 - protein, 9 aa, Homo Sapiens
PHSAGLSPG

SEQ ID NO: 1098874 - protein, 9 aa, Homo Sapiens
LKYMVSYDI

SEQ ID NO: 1098875 - protein, 9 aa, Homo Sapiens
NSWSTGFVI

SEQ ID NO: 1098876 - protein, 9 aa, Homo Sapiens
VQPPPPPPA

SEQ ID NO: 1098877 - protein, 9 aa, Homo Sapiens
MPFTKNPEK

SEQ ID NO: 1098878 - protein, 9 aa, Homo Sapiens
WDIAHMIGG

SEQ ID NO: 1098879 - protein, 9 aa, Homo Sapiens
MSSSLPKAI

SEQ ID NO: 1098880 - protein, 9 aa, Homo Sapiens
LPHLPVASC

SEQ ID NO: 1098881 - protein, 9 aa, Homo Sapiens
AIMTSVFGL

SEQ ID NO: 1098882 - protein, 9 aa, Homo Sapiens
TLKADKATK

SEQ ID NO: 1098883 - protein, 9 aa, Homo Sapiens
ELLVNMGGN

SEQ ID NO: 1098884 - protein, 9 aa, Homo Sapiens
LKRLRRHLR

SEQ ID NO: 1098885 - protein, 9 aa, Homo Sapiens
LGYHGMYFL

SEQ ID NO: 1098886 - protein, 9 aa, Homo Sapiens
VMPAPTPAS

SEQ ID NO: 1098887 - protein, 9 aa, Homo Sapiens
IRTLNCIGM

SEQ ID NO: 1098888 - protein, 9 aa, Homo Sapiens
TRPSRFCIW

SEQ ID NO: 1098889 - protein, 9 aa, Homo Sapiens
VEAIRYCHD

SEQ ID NO: 1098890 - protein, 9 aa, Homo Sapiens
NIENEADIS

SEQ ID NO: 1098891 - protein, 9 aa, Homo Sapiens
ETGMVHAAS

SEQ ID NO: 1098892 - protein, 9 aa, Homo Sapiens
LVVKRFLTT

SEQ ID NO: 1098893 - protein, 9 aa, Homo Sapiens
SELKMVTST

SEQ ID NO: 1098894 - protein, 9 aa, Homo Sapiens
SCPPSRAAS

SEQ ID NO: 1098895 - protein, 9 aa, Homo Sapiens
RRHHLGLLQ

SEQ ID NO: 1098896 - protein, 9 aa, Homo Sapiens
ATALPACRA

SEQ ID NO: 1098897 - protein, 9 aa, Homo Sapiens
VTKYLWLPY

SEQ ID NO: 1098898 - protein, 9 aa, Homo Sapiens
PSIFYLCIV

SEQ ID NO: 1098899 - protein, 9 aa, Homo Sapiens
FLASLPSRS

SEQ ID NO: 1098900 - protein, 9 aa, Homo Sapiens
HKGLDREQA

SEQ ID NO: 1098901 - protein, 9 aa, Homo Sapiens
EIRCVQAVV

SEQ ID NO: 1098902 - protein, 9 aa, Homo Sapiens
DKGTEGEDE

SEQ ID NO: 1098903 - protein, 9 aa, Homo Sapiens
PDSPENAPP

SEQ ID NO: 1098904 - protein, 9 aa, Homo Sapiens
VVVLRLDGS

SEQ ID NO: 1098905 - protein, 9 aa, Homo Sapiens
AASEMALPS

SEQ ID NO: 1098906 - protein, 9 aa, Homo Sapiens
GMVHAASQL

SEQ ID NO: 1098907 - protein, 9 aa, Homo Sapiens
YTTQPTQGY

SEQ ID NO: 1098908 - protein, 9 aa, Homo Sapiens
PGLLRREPR

SEQ ID NO: 1098909 - protein, 9 aa, Homo Sapiens
LPDKKKGTP

SEQ ID NO: 1098910 - protein, 9 aa, Homo Sapiens
KICTEAPGN

SEQ ID NO: 1098911 - protein, 9 aa, Homo Sapiens
QQSLSLQQW

SEQ ID NO: 1098912 - protein, 9 aa, Homo Sapiens
VATVDADDG

SEQ ID NO: 1098913 - protein, 9 aa, Homo Sapiens
ENRYKFYLP

SEQ ID NO: 1098914 - protein, 9 aa, Homo Sapiens
EEQEEEAEE

SEQ ID NO: 1098915 - protein, 9 aa, Homo Sapiens
EMCDTNEST

SEQ ID NO: 1098916 - protein, 9 aa, Homo Sapiens
LSPGACRPA

SEQ ID NO: 1098917 - protein, 9 aa, Homo Sapiens
DGKYHVARF

SEQ ID NO: 1098918 - protein, 9 aa, Homo Sapiens
HYAHVIGTR

SEQ ID NO: 1098919 - protein, 9 aa, Homo Sapiens
SVIDLDTDA

SEQ ID NO: 1098920 - protein, 9 aa, Homo Sapiens
TMRPGTRHP

SEQ ID NO: 1098921 - protein, 9 aa, Homo Sapiens
CLYENIEKV

SEQ ID NO: 1098922 - protein, 9 aa, Homo Sapiens
HPHKYRVLI

SEQ ID NO: 1098923 - protein, 9 aa, Homo Sapiens
LDDNIENEA

SEQ ID NO: 1098924 - protein, 9 aa, Homo Sapiens
RCMRVNMPR

SEQ ID NO: 1098925 - protein, 9 aa, Homo Sapiens
RDRDSEKME

SEQ ID NO: 1098926 - protein, 9 aa, Homo Sapiens
GGFLKYMVS

SEQ ID NO: 1098927 - protein, 9 aa, Homo Sapiens
RMIFSCLNR

SEQ ID NO: 1098928 - protein, 9 aa, Homo Sapiens
DFYLVVCNN

SEQ ID NO: 1098929 - protein, 9 aa, Homo Sapiens
PLPGPASAL

SEQ ID NO: 1098930 - protein, 9 aa, Homo Sapiens
GWRPRSRGT

SEQ ID NO: 1098931 - protein, 9 aa, Homo Sapiens
NVNSSVTTQ

SEQ ID NO: 1098932 - protein, 9 aa, Homo Sapiens
VQRGWTLGA

SEQ ID NO: 1098933 - protein, 9 aa, Homo Sapiens
DEQGSDRKK

SEQ ID NO: 1098934 - protein, 9 aa, Homo Sapiens
DWMPPPEVT

SEQ ID NO: 1098935 - protein, 9 aa, Homo Sapiens
TAGILGLIG

SEQ ID NO: 1098936 - protein, 9 aa, Homo Sapiens
VLQELIDSS

SEQ ID NO: 1098937 - protein, 9 aa, Homo Sapiens
VFFFFVWFG

SEQ ID NO: 1098938 - protein, 9 aa, Homo Sapiens
IPANVWMLM

SEQ ID NO: 1098939 - protein, 9 aa, Homo Sapiens
TQLPVPEHL

SEQ ID NO: 1098940 - protein, 9 aa, Homo Sapiens
ELCSFHCSD

SEQ ID NO: 1098941 - protein, 9 aa, Homo Sapiens
AEEGPLEPV

SEQ ID NO: 1098942 - protein, 9 aa, Homo Sapiens
KNRISPLLT

SEQ ID NO: 1098943 - protein, 9 aa, Homo Sapiens
LRKTQAQSI

SEQ ID NO: 1098944 - protein, 9 aa, Homo Sapiens
WLCPTPSAS

SEQ ID NO: 1098945 - protein, 9 aa, Homo Sapiens
ILGIILIVA

SEQ ID NO: 1098946 - protein, 9 aa, Homo Sapiens
GRTSGRSLS

SEQ ID NO: 1098947 - protein, 9 aa, Homo Sapiens
QQWKRPMGL

SEQ ID NO: 1098948 - protein, 9 aa, Homo Sapiens
VVWPSVPSS

SEQ ID NO: 1098949 - protein, 9 aa, Homo Sapiens
GLTDSARAP

SEQ ID NO: 1098950 - protein, 9 aa, Homo Sapiens
LTERPHNRR

SEQ ID NO: 1098951 - protein, 9 aa, Homo Sapiens
LRGFQILGL

SEQ ID NO: 1098952 - protein, 9 aa, Homo Sapiens
QELTEFAKS

SEQ ID NO: 1098953 - protein, 9 aa, Homo Sapiens
LRMGWGGGA

SEQ ID NO: 1098954 - protein, 9 aa, Homo Sapiens
PGTACSRGT

SEQ ID NO: 1098955 - protein, 9 aa, Homo Sapiens
CGLSTSWPS

SEQ ID NO: 1098956 - protein, 9 aa, Homo Sapiens
SMTLLLCHW

SEQ ID NO: 1098957 - protein, 9 aa, Homo Sapiens
PPIFHSGML

SEQ ID NO: 1098958 - protein, 9 aa, Homo Sapiens
ALVPDGAWA

SEQ ID NO: 1098959 - protein, 9 aa, Homo Sapiens
EPVEPGQPP

SEQ ID NO: 1098960 - protein, 9 aa, Homo Sapiens
TTPIFFDMM

SEQ ID NO: 1098961 - protein, 9 aa, Homo Sapiens
GARSHWGAL

SEQ ID NO: 1098962 - protein, 9 aa, Homo Sapiens
VLRLDGSQR

SEQ ID NO: 1098963 - protein, 9 aa, Homo Sapiens
CLLCRRGIL

SEQ ID NO: 1098964 - protein, 9 aa, Homo Sapiens
TLAAREMAL

SEQ ID NO: 1098965 - protein, 9 aa, Homo Sapiens
DLMGGLGRF

SEQ ID NO: 1098966 - protein, 9 aa, Homo Sapiens
KQYPLSLVT

SEQ ID NO: 1098967 - protein, 9 aa, Homo Sapiens
GLCGGRWRI

SEQ ID NO: 1098968 - protein, 9 aa, Homo Sapiens
KGGAGHMDG

SEQ ID NO: 1098969 - protein, 9 aa, Homo Sapiens
LFEGTCAVG

SEQ ID NO: 1098970 - protein, 9 aa, Homo Sapiens
LLVMALDRY

SEQ ID NO: 1098971 - protein, 9 aa, Homo Sapiens
GLSRVCNGL

SEQ ID NO: 1098972 - protein, 9 aa, Homo Sapiens
PIRRVSPGQ

SEQ ID NO: 1098973 - protein, 9 aa, Homo Sapiens
VKFPELLCV

SEQ ID NO: 1098974 - protein, 9 aa, Homo Sapiens
DSVPGPPPR

SEQ ID NO: 1098975 - protein, 9 aa, Homo Sapiens
QSYHQALLR

SEQ ID NO: 1098976 - protein, 9 aa, Homo Sapiens
ILSRVWNTA

SEQ ID NO: 1098977 - protein, 9 aa, Homo Sapiens
IHGNALQTS

SEQ ID NO: 1098978 - protein, 9 aa, Homo Sapiens
AAPPPAPPA

SEQ ID NO: 1098979 - protein, 9 aa, Homo Sapiens
CPAPHRSPP

SEQ ID NO: 1098980 - protein, 9 aa, Homo Sapiens
KIEVARMWT

SEQ ID NO: 1098981 - protein, 9 aa, Homo Sapiens
IQGLYGLTQ

SEQ ID NO: 1098982 - protein, 9 aa, Homo Sapiens
ATQVDALQG

SEQ ID NO: 1098983 - protein, 9 aa, Homo Sapiens
GPHDDFVAD

SEQ ID NO: 1098984 - protein, 9 aa, Homo Sapiens
ETPLAPAKG

SEQ ID NO: 1098985 - protein, 9 aa, Homo Sapiens
SLLMAHCVV

SEQ ID NO: 1098986 - protein, 9 aa, Homo Sapiens
VMCGHCHQP

SEQ ID NO: 1098987 - protein, 9 aa, Homo Sapiens
QQPVLVELL

SEQ ID NO: 1098988 - protein, 9 aa, Homo Sapiens
ESMKETLWI

SEQ ID NO: 1098989 - protein, 9 aa, Homo Sapiens
LDLPILDDQ

SEQ ID NO: 1098990 - protein, 9 aa, Homo Sapiens
RFEKGHIYT

SEQ ID NO: 1098991 - protein, 9 aa, Homo Sapiens
SPICSKLSS

SEQ ID NO: 1098992 - protein, 9 aa, Homo Sapiens
VIRCPLQII

SEQ ID NO: 1098993 - protein, 9 aa, Homo Sapiens
LLHMDAHTD

SEQ ID NO: 1098994 - protein, 9 aa, Homo Sapiens
QAQGRLRLR

SEQ ID NO: 1098995 - protein, 9 aa, Homo Sapiens
SAFKTETSS

SEQ ID NO: 1098996 - protein, 9 aa, Homo Sapiens
RAVQKLQAQ

SEQ ID NO: 1098997 - protein, 9 aa, Homo Sapiens
EQIPGLLGS

SEQ ID NO: 1098998 - protein, 9 aa, Homo Sapiens
PVGLLHMDA

SEQ ID NO: 1098999 - protein, 9 aa, Homo Sapiens
RKGEAIRIR

SEQ ID NO: 1099000 - protein, 9 aa, Homo Sapiens
GTEKENTPE

SEQ ID NO: 1099001 - protein, 9 aa, Homo Sapiens
PEVWKEVRG

SEQ ID NO: 1099002 - protein, 9 aa, Homo Sapiens
ATGQFHVYS

SEQ ID NO: 1099003 - protein, 9 aa, Homo Sapiens
DEKQASTEL

SEQ ID NO: 1099004 - protein, 9 aa, Homo Sapiens
VAHDLIWKM

SEQ ID NO: 1099005 - protein, 9 aa, Homo Sapiens
LFRKFRRGP

SEQ ID NO: 1099006 - protein, 9 aa, Homo Sapiens
GSVLAKKPG

SEQ ID NO: 1099007 - protein, 9 aa, Homo Sapiens
SGERFGNQQ

SEQ ID NO: 1099008 - protein, 9 aa, Homo Sapiens
TRAAGRWGP

SEQ ID NO: 1099009 - protein, 9 aa, Homo Sapiens
QKENERLPR

SEQ ID NO: 1099010 - protein, 9 aa, Homo Sapiens
QKRGLLRSL

SEQ ID NO: 1099011 - protein, 9 aa, Homo Sapiens
MKQYPLSLV

SEQ ID NO: 1099012 - protein, 9 aa, Homo Sapiens
CSLLTQPSP

SEQ ID NO: 1099013 - protein, 9 aa, Homo Sapiens
SRHCWEVET

SEQ ID NO: 1099014 - protein, 9 aa, Homo Sapiens
WRPRSRGTR

SEQ ID NO: 1099015 - protein, 9 aa, Homo Sapiens
TSRTSPPAG

SEQ ID NO: 1099016 - protein, 9 aa, Homo Sapiens
TTAFCLFTW

SEQ ID NO: 1099017 - protein, 9 aa, Homo Sapiens
EMALRASLE

SEQ ID NO: 1099018 - protein, 9 aa, Homo Sapiens
GEWYQNFQS

SEQ ID NO: 1099019 - protein, 9 aa, Homo Sapiens
QWDIIASNG

SEQ ID NO: 1099020 - protein, 9 aa, Homo Sapiens
FTIFCNLSL

SEQ ID NO: 1099021 - protein, 9 aa, Homo Sapiens
PRPAPGWRP

SEQ ID NO: 1099022 - protein, 9 aa, Homo Sapiens
ACLLRFSEL

SEQ ID NO: 1099023 - protein, 9 aa, Homo Sapiens
HTTCWPRRT

SEQ ID NO: 1099024 - protein, 9 aa, Homo Sapiens
FRQCTHLSR

SEQ ID NO: 1099025 - protein, 9 aa, Homo Sapiens
GFTAVMGDF

SEQ ID NO: 1099026 - protein, 9 aa, Homo Sapiens
IPPQHGLEL

SEQ ID NO: 1099027 - protein, 9 aa, Homo Sapiens
SICKQILEE

SEQ ID NO: 1099028 - protein, 9 aa, Homo Sapiens
AARTPALIP

SEQ ID NO: 1099029 - protein, 9 aa, Homo Sapiens
QGGFPLWWP

SEQ ID NO: 1099030 - protein, 9 aa, Homo Sapiens
KCRSADIKV

SEQ ID NO: 1099031 - protein, 9 aa, Homo Sapiens
RYRKPLELF

SEQ ID NO: 1099032 - protein, 9 aa, Homo Sapiens
TLNDLCLVL

SEQ ID NO: 1099033 - protein, 9 aa, Homo Sapiens
KLQSADEKA

SEQ ID NO: 1099034 - protein, 9 aa, Homo Sapiens
PSVEKNSSS

SEQ ID NO: 1099035 - protein, 9 aa, Homo Sapiens
TLGTALMGP

SEQ ID NO: 1099036 - protein, 9 aa, Homo Sapiens
QHQPPAPSL

SEQ ID NO: 1099037 - protein, 9 aa, Homo Sapiens
GHLGDGKKM

SEQ ID NO: 1099038 - protein, 9 aa, Homo Sapiens
SVVTVTHLR

SEQ ID NO: 1099039 - protein, 9 aa, Homo Sapiens
GTYNCGPTL

SEQ ID NO: 1099040 - protein, 9 aa, Homo Sapiens
LIKINFIPG

SEQ ID NO: 1099041 - protein, 9 aa, Homo Sapiens
MKIMDHIAQ

SEQ ID NO: 1099042 - protein, 9 aa, Homo Sapiens
TAKSKPIIA

SEQ ID NO: 1099043 - protein, 9 aa, Homo Sapiens
PAADMQFML

SEQ ID NO: 1099044 - protein, 9 aa, Homo Sapiens
DGHIVFTKQ

SEQ ID NO: 1099045 - protein, 9 aa, Homo Sapiens
IVNSSLVIP

SEQ ID NO: 1099046 - protein, 9 aa, Homo Sapiens
RLLRTAQPK

SEQ ID NO: 1099047 - protein, 9 aa, Homo Sapiens
SLMILVITA

SEQ ID NO: 1099048 - protein, 9 aa, Homo Sapiens
SHIWPKGFE

SEQ ID NO: 1099049 - protein, 9 aa, Homo Sapiens
GTSSSSGPW

SEQ ID NO: 1099050 - protein, 9 aa, Homo Sapiens
VKVLSLRKT

SEQ ID NO: 1099051 - protein, 9 aa, Homo Sapiens
SSSSGPWRS

SEQ ID NO: 1099052 - protein, 9 aa, Homo Sapiens
MANLPYKGG

SEQ ID NO: 1099053 - protein, 9 aa, Homo Sapiens
SPSITSTGR

SEQ ID NO: 1099054 - protein, 9 aa, Homo Sapiens
GKLSVTFCQ

SEQ ID NO: 1099055 - protein, 9 aa, Homo Sapiens
PSCYHSWLR

SEQ ID NO: 1099056 - protein, 9 aa, Homo Sapiens
PCQLLFPST

SEQ ID NO: 1099057 - protein, 9 aa, Homo Sapiens
VWSRNVASR

SEQ ID NO: 1099058 - protein, 9 aa, Homo Sapiens
ITENNPRGA

SEQ ID NO: 1099059 - protein, 9 aa, Homo Sapiens
QRRKRRIYQ

SEQ ID NO: 1099060 - protein, 9 aa, Homo Sapiens
PQYRGVRAE

SEQ ID NO: 1099061 - protein, 9 aa, Homo Sapiens
THCRPHWTL

SEQ ID NO: 1099062 - protein, 9 aa, Homo Sapiens
DHSRLSPPE

SEQ ID NO: 1099063 - protein, 9 aa, Homo Sapiens
PVRLLLGVC

SEQ ID NO: 1099064 - protein, 9 aa, Homo Sapiens
AALVIMWQK

SEQ ID NO: 1099065 - protein, 9 aa, Homo Sapiens
LSVLGVTCS

SEQ ID NO: 1099066 - protein, 9 aa, Homo Sapiens
AEGTRWPGP

SEQ ID NO: 1099067 - protein, 9 aa, Homo Sapiens
SSFSSQTSL

SEQ ID NO: 1099068 - protein, 9 aa, Homo Sapiens
CQCLQRKER

SEQ ID NO: 1099069 - protein, 9 aa, Homo Sapiens
GFGNNYYSL

SEQ ID NO: 1099070 - protein, 9 aa, Homo Sapiens
AKVVRAAQK

SEQ ID NO: 1099071 - protein, 9 aa, Homo Sapiens
CAPGAPAVP

SEQ ID NO: 1099072 - protein, 9 aa, Homo Sapiens
GTRPSWAWP

SEQ ID NO: 1099073 - protein, 9 aa, Homo Sapiens
VPEEFHSTI

SEQ ID NO: 1099074 - protein, 9 aa, Homo Sapiens
LATKLLHIY

SEQ ID NO: 1099075 - protein, 9 aa, Homo Sapiens
QEELEGLGI

SEQ ID NO: 1099076 - protein, 9 aa, Homo Sapiens
PCHSPRICP

SEQ ID NO: 1099077 - protein, 9 aa, Homo Sapiens
ANVWMLMTA

SEQ ID NO: 1099078 - protein, 9 aa, Homo Sapiens
QRRGEQSPE

SEQ ID NO: 1099079 - protein, 9 aa, Homo Sapiens
IRCVQAVVI

SEQ ID NO: 1099080 - protein, 9 aa, Homo Sapiens
TQQEAVMLL

SEQ ID NO: 1099081 - protein, 9 aa, Homo Sapiens
FAMALERCL

SEQ ID NO: 1099082 - protein, 9 aa, Homo Sapiens
MTPVSSPTA

SEQ ID NO: 1099083 - protein, 9 aa, Homo Sapiens
LLSAGSWAA

SEQ ID NO: 1099084 - protein, 9 aa, Homo Sapiens
EEKQAAKNG

SEQ ID NO: 1099085 - protein, 9 aa, Homo Sapiens
VHQYSVHPP

SEQ ID NO: 1099086 - protein, 9 aa, Homo Sapiens
TLCVAYKRP

SEQ ID NO: 1099087 - protein, 9 aa, Homo Sapiens
VFQVCVRPG

SEQ ID NO: 1099088 - protein, 9 aa, Homo Sapiens
RPSLAGSRR

SEQ ID NO: 1099089 - protein, 9 aa, Homo Sapiens
VTWFKNDRI

SEQ ID NO: 1099090 - protein, 9 aa, Homo Sapiens
ARGAPALEC

SEQ ID NO: 1099091 - protein, 9 aa, Homo Sapiens
LTDSARAPT

SEQ ID NO: 1099092 - protein, 9 aa, Homo Sapiens
AVKVNNSMS

SEQ ID NO: 1099093 - protein, 9 aa, Homo Sapiens
GALLACTAP

SEQ ID NO: 1099094 - protein, 9 aa, Homo Sapiens
SVMISASED

SEQ ID NO: 1099095 - protein, 9 aa, Homo Sapiens
ETLKYISKH

SEQ ID NO: 1099096 - protein, 9 aa, Homo Sapiens
TCASSRGAS

SEQ ID NO: 1099097 - protein, 9 aa, Homo Sapiens
WLERGAGLQ

SEQ ID NO: 1099098 - protein, 9 aa, Homo Sapiens
CPTPSASTH

SEQ ID NO: 1099099 - protein, 9 aa, Homo Sapiens
KCLWEKDYQ

SEQ ID NO: 1099100 - protein, 9 aa, Homo Sapiens
RIRDRDSEK

SEQ ID NO: 1099101 - protein, 9 aa, Homo Sapiens
REELLKKCS

SEQ ID NO: 1099102 - protein, 9 aa, Homo Sapiens
LTAKEVDTI

SEQ ID NO: 1099103 - protein, 9 aa, Homo Sapiens
ARFTASALP

SEQ ID NO: 1099104 - protein, 9 aa, Homo Sapiens
SSEGLLSFP

SEQ ID NO: 1099105 - protein, 9 aa, Homo Sapiens
ERHLGHAGA

SEQ ID NO: 1099106 - protein, 9 aa, Homo Sapiens
RAFNQNMHL

SEQ ID NO: 1099107 - protein, 9 aa, Homo Sapiens
RSPSSNAGQ

SEQ ID NO: 1099108 - protein, 9 aa, Homo Sapiens
FALPNSLLV

SEQ ID NO: 1099109 - protein, 9 aa, Homo Sapiens
PSAGALKPA

SEQ ID NO: 1099110 - protein, 9 aa, Homo Sapiens
SNGSWWAPS

SEQ ID NO: 1099111 - protein, 9 aa, Homo Sapiens
LPGEPPGRG

SEQ ID NO: 1099112 - protein, 9 aa, Homo Sapiens
VNVNDKFIY

SEQ ID NO: 1099113 - protein, 9 aa, Homo Sapiens
SPPADDDDS

SEQ ID NO: 1099114 - protein, 9 aa, Homo Sapiens
CCLTGSEEL

SEQ ID NO: 1099115 - protein, 9 aa, Homo Sapiens
GGCPEACAP

SEQ ID NO: 1099116 - protein, 9 aa, Homo Sapiens
TSSLPSCPA

SEQ ID NO: 1099117 - protein, 9 aa, Homo Sapiens
WGYRCEGDQ

SEQ ID NO: 1099118 - protein, 9 aa, Homo Sapiens
LSTLSQPPP

SEQ ID NO: 1099119 - protein, 9 aa, Homo Sapiens
SRRCCLRTS

SEQ ID NO: 1099120 - protein, 9 aa, Homo Sapiens
DAYKEPYFV

SEQ ID NO: 1099121 - protein, 9 aa, Homo Sapiens
AFLQKFGSM

SEQ ID NO: 1099122 - protein, 9 aa, Homo Sapiens
VVGTALVSS

SEQ ID NO: 1099123 - protein, 9 aa, Homo Sapiens
APGLRGFQI

SEQ ID NO: 1099124 - protein, 9 aa, Homo Sapiens
NPQQALLYG

SEQ ID NO: 1099125 - protein, 9 aa, Homo Sapiens
IPTRSEPLR

SEQ ID NO: 1099126 - protein, 9 aa, Homo Sapiens
AFEEVWGGH

SEQ ID NO: 1099127 - protein, 9 aa, Homo Sapiens
WLRYLTYRL

SEQ ID NO: 1099128 - protein, 9 aa, Homo Sapiens
AHPHRAAVL

SEQ ID NO: 1099129 - protein, 9 aa, Homo Sapiens
HAALERYVP

SEQ ID NO: 1099130 - protein, 9 aa, Homo Sapiens
TGLVLVFLG

SEQ ID NO: 1099131 - protein, 9 aa, Homo Sapiens
KYISKHHAG

SEQ ID NO: 1099132 - protein, 9 aa, Homo Sapiens
FCLYENIEK

SEQ ID NO: 1099133 - protein, 9 aa, Homo Sapiens
WGCHHRMPS

SEQ ID NO: 1099134 - protein, 9 aa, Homo Sapiens
GAHREAFKT

SEQ ID NO: 1099135 - protein, 9 aa, Homo Sapiens
EDIKACTCF

SEQ ID NO: 1099136 - protein, 9 aa, Homo Sapiens
RLWQSPCPA

SEQ ID NO: 1099137 - protein, 9 aa, Homo Sapiens
DLLYLRTSG

SEQ ID NO: 1099138 - protein, 9 aa, Homo Sapiens
DVGGHGCLL

SEQ ID NO: 1099139 - protein, 9 aa, Homo Sapiens
ASRRTGLQK

SEQ ID NO: 1099140 - protein, 9 aa, Homo Sapiens
KKVKIIQWD

SEQ ID NO: 1099141 - protein, 9 aa, Homo Sapiens
VAGAARTSG

SEQ ID NO: 1099142 - protein, 9 aa, Homo Sapiens
ALCRPSPQC

SEQ ID NO: 1099143 - protein, 9 aa, Homo Sapiens
KVLELVLHK

SEQ ID NO: 1099144 - protein, 9 aa, Homo Sapiens
SLLLDQRQS

SEQ ID NO: 1099145 - protein, 9 aa, Homo Sapiens
PETSLSVSL

SEQ ID NO: 1099146 - protein, 9 aa, Homo Sapiens
MIKSTPVGP

SEQ ID NO: 1099147 - protein, 9 aa, Homo Sapiens
VVMEISYMR

SEQ ID NO: 1099148 - protein, 9 aa, Homo Sapiens
QRSPSSNAG

SEQ ID NO: 1099149 - protein, 9 aa, Homo Sapiens
NFQCPHTSG

SEQ ID NO: 1099150 - protein, 9 aa, Homo Sapiens
RTVHPAVPG

SEQ ID NO: 1099151 - protein, 9 aa, Homo Sapiens
AEALFFIRE

SEQ ID NO: 1099152 - protein, 9 aa, Homo Sapiens
SCDLLASQN

SEQ ID NO: 1099153 - protein, 9 aa, Homo Sapiens
AGGQGGGGL

SEQ ID NO: 1099154 - protein, 9 aa, Homo Sapiens
SSVLDRLLY

SEQ ID NO: 1099155 - protein, 9 aa, Homo Sapiens
AGPPPGGRA

SEQ ID NO: 1099156 - protein, 9 aa, Homo Sapiens
KPWQQQPVL

SEQ ID NO: 1099157 - protein, 9 aa, Homo Sapiens
APEPEETWG

SEQ ID NO: 1099158 - protein, 9 aa, Homo Sapiens
MYRYHRRAP

SEQ ID NO: 1099159 - protein, 9 aa, Homo Sapiens
HHKALQEIQ

SEQ ID NO: 1099160 - protein, 9 aa, Homo Sapiens
MSPQNIGAG

SEQ ID NO: 1099161 - protein, 9 aa, Homo Sapiens
PGSYAVATA

SEQ ID NO: 1099162 - protein, 9 aa, Homo Sapiens
RHCTLTWSR

SEQ ID NO: 1099163 - protein, 9 aa, Homo Sapiens
AFYCEKLSG

SEQ ID NO: 1099164 - protein, 9 aa, Homo Sapiens
ASPAHSPTP

SEQ ID NO: 1099165 - protein, 9 aa, Homo Sapiens
VCYCSRQPG

SEQ ID NO: 1099166 - protein, 9 aa, Homo Sapiens
TEPSLVLTL

SEQ ID NO: 1099167 - protein, 9 aa, Homo Sapiens
QPPHPVLIQ

SEQ ID NO: 1099168 - protein, 9 aa, Homo Sapiens
MSRIHRGAH

SEQ ID NO: 1099169 - protein, 9 aa, Homo Sapiens
ARSIELDMC

SEQ ID NO: 1099170 - protein, 9 aa, Homo Sapiens
RGRENGGGG

SEQ ID NO: 1099171 - protein, 9 aa, Homo Sapiens
HFHSKHGTM

SEQ ID NO: 1099172 - protein, 9 aa, Homo Sapiens
DNLPFVLYP

SEQ ID NO: 1099173 - protein, 9 aa, Homo Sapiens
RAGSRRCCL

SEQ ID NO: 1099174 - protein, 9 aa, Homo Sapiens
QTTPHWTFG

SEQ ID NO: 1099175 - protein, 9 aa, Homo Sapiens
LLSPCNASI

SEQ ID NO: 1099176 - protein, 9 aa, Homo Sapiens
KGFSLLTSH

SEQ ID NO: 1099177 - protein, 9 aa, Homo Sapiens
ARIRAARET

SEQ ID NO: 1099178 - protein, 9 aa, Homo Sapiens
EALSLSYLM

SEQ ID NO: 1099179 - protein, 9 aa, Homo Sapiens
KRRCGLTSM

SEQ ID NO: 1099180 - protein, 9 aa, Homo Sapiens
VDWEYFMAC

SEQ ID NO: 1099181 - protein, 9 aa, Homo Sapiens
PHGLWSPTP

SEQ ID NO: 1099182 - protein, 9 aa, Homo Sapiens
MPPLLHPQW

SEQ ID NO: 1099183 - protein, 9 aa, Homo Sapiens
NMIKSTPVG

SEQ ID NO: 1099184 - protein, 9 aa, Homo Sapiens
FYGTPEYVA

SEQ ID NO: 1099185 - protein, 9 aa, Homo Sapiens
RFRSSGLSA

SEQ ID NO: 1099186 - protein, 9 aa, Homo Sapiens
RWGPALSRP

SEQ ID NO: 1099187 - protein, 9 aa, Homo Sapiens
RRSQRLPWA

SEQ ID NO: 1099188 - protein, 9 aa, Homo Sapiens
DEASADLVI

SEQ ID NO: 1099189 - protein, 9 aa, Homo Sapiens
LGRAAQSSK

SEQ ID NO: 1099190 - protein, 9 aa, Homo Sapiens
PVVLMPTLS

SEQ ID NO: 1099191 - protein, 9 aa, Homo Sapiens
PLPAAPPSS

SEQ ID NO: 1099192 - protein, 9 aa, Homo Sapiens
TVDADDGEN

SEQ ID NO: 1099193 - protein, 9 aa, Homo Sapiens
LGLQLALFY

SEQ ID NO: 1099194 - protein, 9 aa, Homo Sapiens
DGLSRVCNG

SEQ ID NO: 1099195 - protein, 9 aa, Homo Sapiens
IKIIESPED

SEQ ID NO: 1099196 - protein, 9 aa, Homo Sapiens
CIRCGNGTL

SEQ ID NO: 1099197 - protein, 9 aa, Homo Sapiens
MGTNFSGSV

SEQ ID NO: 1099198 - protein, 9 aa, Homo Sapiens
NDYTWGARD

SEQ ID NO: 1099199 - protein, 9 aa, Homo Sapiens
APRLRMASR

SEQ ID NO: 1099200 - protein, 9 aa, Homo Sapiens
EPSMWAFLL

SEQ ID NO: 1099201 - protein, 9 aa, Homo Sapiens
HWTLSPQGP

SEQ ID NO: 1099202 - protein, 9 aa, Homo Sapiens
WSPTPRASV

SEQ ID NO: 1099203 - protein, 9 aa, Homo Sapiens
FSAPCCWRL

SEQ ID NO: 1099204 - protein, 9 aa, Homo Sapiens
VGPSSFLGQ

SEQ ID NO: 1099205 - protein, 9 aa, Homo Sapiens
ERGGVATPG

SEQ ID NO: 1099206 - protein, 9 aa, Homo Sapiens
LGALSLRPA

SEQ ID NO: 1099207 - protein, 9 aa, Homo Sapiens
IDLFQVRGP

SEQ ID NO: 1099208 - protein, 9 aa, Homo Sapiens
CFQRRKRRI

SEQ ID NO: 1099209 - protein, 9 aa, Homo Sapiens
ILLQLKRAK

SEQ ID NO: 1099210 - protein, 9 aa, Homo Sapiens
PLLFLGPLA

SEQ ID NO: 1099211 - protein, 9 aa, Homo Sapiens
LSAPPRTQH

SEQ ID NO: 1099212 - protein, 9 aa, Homo Sapiens
VNAGGRREP

SEQ ID NO: 1099213 - protein, 9 aa, Homo Sapiens
VFKPCGTFH

SEQ ID NO: 1099214 - protein, 9 aa, Homo Sapiens
EKGNSGRPG

SEQ ID NO: 1099215 - protein, 9 aa, Homo Sapiens
RASLEMLTP

SEQ ID NO: 1099216 - protein, 9 aa, Homo Sapiens
TISPFSTVC

SEQ ID NO: 1099217 - protein, 9 aa, Homo Sapiens
SGLLQGKLV

SEQ ID NO: 1099218 - protein, 9 aa, Homo Sapiens
ILPECFLAV

SEQ ID NO: 1099219 - protein, 9 aa, Homo Sapiens
NCNQVVKPQ

SEQ ID NO: 1099220 - protein, 9 aa, Homo Sapiens
IVIHQSHPC

SEQ ID NO: 1099221 - protein, 9 aa, Homo Sapiens
TIFCNLSLY

SEQ ID NO: 1099222 - protein, 9 aa, Homo Sapiens
QEVEIGTVV

SEQ ID NO: 1099223 - protein, 9 aa, Homo Sapiens
QTMASDPPQ

SEQ ID NO: 1099224 - protein, 9 aa, Homo Sapiens
QYRTITTAY

SEQ ID NO: 1099225 - protein, 9 aa, Homo Sapiens
VMLCTGLGV

SEQ ID NO: 1099226 - protein, 9 aa, Homo Sapiens
PRQLFLLTS

SEQ ID NO: 1099227 - protein, 9 aa, Homo Sapiens
IIKCKPLFY

SEQ ID NO: 1099228 - protein, 9 aa, Homo Sapiens
WKKSDSLLQ

SEQ ID NO: 1099229 - protein, 9 aa, Homo Sapiens
VILIELLIS

SEQ ID NO: 1099230 - protein, 9 aa, Homo Sapiens
KYMVSYDIP

SEQ ID NO: 1099231 - protein, 9 aa, Homo Sapiens
IIKKTVILQ

SEQ ID NO: 1099232 - protein, 9 aa, Homo Sapiens
NELRRPARD

SEQ ID NO: 1099233 - protein, 9 aa, Homo Sapiens
PGPHDDFVA

SEQ ID NO: 1099234 - protein, 9 aa, Homo Sapiens
WLCIDDQTV

SEQ ID NO: 1099235 - protein, 9 aa, Homo Sapiens
FKWSSKLTA

SEQ ID NO: 1099236 - protein, 9 aa, Homo Sapiens
NSISVFQVI

SEQ ID NO: 1099237 - protein, 9 aa, Homo Sapiens
YAHVIGTRV

SEQ ID NO: 1099238 - protein, 9 aa, Homo Sapiens
RPSRACDIN

SEQ ID NO: 1099239 - protein, 9 aa, Homo Sapiens
QGTLSDLLC

SEQ ID NO: 1099240 - protein, 9 aa, Homo Sapiens
ALVAELALV

SEQ ID NO: 1099241 - protein, 9 aa, Homo Sapiens
RGCSPAGVG

SEQ ID NO: 1099242 - protein, 9 aa, Homo Sapiens
MLAPPTAPD

SEQ ID NO: 1099243 - protein, 9 aa, Homo Sapiens
PGSPRSSAQ

SEQ ID NO: 1099244 - protein, 9 aa, Homo Sapiens
LDTQQEAVM

SEQ ID NO: 1099245 - protein, 9 aa, Homo Sapiens
WLLPGMGPH

SEQ ID NO: 1099246 - protein, 9 aa, Homo Sapiens
TKDTKYVRI

SEQ ID NO: 1099247 - protein, 9 aa, Homo Sapiens
CSSMPTKQA

SEQ ID NO: 1099248 - protein, 9 aa, Homo Sapiens
ALLVHNRVA

SEQ ID NO: 1099249 - protein, 9 aa, Homo Sapiens
FVGIARHSG

SEQ ID NO: 1099250 - protein, 9 aa, Homo Sapiens
RERARKDGP

SEQ ID NO: 1099251 - protein, 9 aa, Homo Sapiens
SCPRPSATS

SEQ ID NO: 1099252 - protein, 9 aa, Homo Sapiens
KENQKEQTA

SEQ ID NO: 1099253 - protein, 9 aa, Homo Sapiens
VLLGATVKE

SEQ ID NO: 1099254 - protein, 9 aa, Homo Sapiens
KVSSSLGTT

SEQ ID NO: 1099255 - protein, 9 aa, Homo Sapiens
ENDFKHHMS

SEQ ID NO: 1099256 - protein, 9 aa, Homo Sapiens
AYDETTQKF

SEQ ID NO: 1099257 - protein, 9 aa, Homo Sapiens
ELSFAPPRG

SEQ ID NO: 1099258 - protein, 9 aa, Homo Sapiens
GLPPCTVAG

SEQ ID NO: 1099259 - protein, 9 aa, Homo Sapiens
KNAQMLSRR

SEQ ID NO: 1099260 - protein, 9 aa, Homo Sapiens
LGRVPHQVQ

SEQ ID NO: 1099261 - protein, 9 aa, Homo Sapiens
KSPTPPSSS

SEQ ID NO: 1099262 - protein, 9 aa, Homo Sapiens
LEGFLQRED

SEQ ID NO: 1099263 - protein, 9 aa, Homo Sapiens
PWGWLLYAD

SEQ ID NO: 1099264 - protein, 9 aa, Homo Sapiens
LNTNSISVF

SEQ ID NO: 1099265 - protein, 9 aa, Homo Sapiens
EVYLQGWEF

SEQ ID NO: 1099266 - protein, 9 aa, Homo Sapiens
PRVALIVAS

SEQ ID NO: 1099267 - protein, 9 aa, Homo Sapiens
KYRVLIAMV

SEQ ID NO: 1099268 - protein, 9 aa, Homo Sapiens
KTTAGPCCP

SEQ ID NO: 1099269 - protein, 9 aa, Homo Sapiens
RRLFLYKIT

SEQ ID NO: 1099270 - protein, 9 aa, Homo Sapiens
RLFLYKITI

SEQ ID NO: 1099271 - protein, 9 aa, Homo Sapiens
SPCNASIMC

SEQ ID NO: 1099272 - protein, 9 aa, Homo Sapiens
WLTVLSCWT

SEQ ID NO: 1099273 - protein, 9 aa, Homo Sapiens
GSLDCLLQQ

SEQ ID NO: 1099274 - protein, 9 aa, Homo Sapiens
PAKCLTVDE

SEQ ID NO: 1099275 - protein, 9 aa, Homo Sapiens
QWRQPPGKR

SEQ ID NO: 1099276 - protein, 9 aa, Homo Sapiens
ATEVGCPAG

SEQ ID NO: 1099277 - protein, 9 aa, Homo Sapiens
THWFSNLES

SEQ ID NO: 1099278 - protein, 9 aa, Homo Sapiens
AQLATVLTY

SEQ ID NO: 1099279 - protein, 9 aa, Homo Sapiens
AGPGVEGVK

SEQ ID NO: 1099280 - protein, 9 aa, Homo Sapiens
RTPAPASRS

SEQ ID NO: 1099281 - protein, 9 aa, Homo Sapiens
MLGLCPPLL

SEQ ID NO: 1099282 - protein, 9 aa, Homo Sapiens
LYDVQELRM

SEQ ID NO: 1099283 - protein, 9 aa, Homo Sapiens
TASLSSARH

SEQ ID NO: 1099284 - protein, 9 aa, Homo Sapiens
HHAGPEDGR

SEQ ID NO: 1099285 - protein, 9 aa, Homo Sapiens
YGGNAPFCT

SEQ ID NO: 1099286 - protein, 9 aa, Homo Sapiens
PGRGVPALP

SEQ ID NO: 1099287 - protein, 9 aa, Homo Sapiens
GQARAAQRK

SEQ ID NO: 1099288 - protein, 9 aa, Homo Sapiens
RRHGTEGFE

SEQ ID NO: 1099289 - protein, 9 aa, Homo Sapiens
HNKHELTHA

SEQ ID NO: 1099290 - protein, 9 aa, Homo Sapiens
PREAHRVRR

SEQ ID NO: 1099291 - protein, 9 aa, Homo Sapiens
HGAGFGPQH

SEQ ID NO: 1099292 - protein, 9 aa, Homo Sapiens
WRLDESLSA

SEQ ID NO: 1099293 - protein, 9 aa, Homo Sapiens
LNFIRWVVD

SEQ ID NO: 1099294 - protein, 9 aa, Homo Sapiens
THQEYLKDL

SEQ ID NO: 1099295 - protein, 9 aa, Homo Sapiens
RSQPTASVQ

SEQ ID NO: 1099296 - protein, 9 aa, Homo Sapiens
QDAAGRGRA

SEQ ID NO: 1099297 - protein, 9 aa, Homo Sapiens
DDCLLQGTF

SEQ ID NO: 1099298 - protein, 9 aa, Homo Sapiens
LSMLNDIVA

SEQ ID NO: 1099299 - protein, 9 aa, Homo Sapiens
LERCLSIGH

SEQ ID NO: 1099300 - protein, 9 aa, Homo Sapiens
CTVAGGWGP

SEQ ID NO: 1099301 - protein, 9 aa, Homo Sapiens
QLWSLTLSM

SEQ ID NO: 1099302 - protein, 9 aa, Homo Sapiens
VLRTVKTKA

SEQ ID NO: 1099303 - protein, 9 aa, Homo Sapiens
LFGYYSASG

SEQ ID NO: 1099304 - protein, 9 aa, Homo Sapiens
PRREKPRRE

SEQ ID NO: 1099305 - protein, 9 aa, Homo Sapiens
LDQKVEIRR

SEQ ID NO: 1099306 - protein, 9 aa, Homo Sapiens
IDQAHRQKV

SEQ ID NO: 1099307 - protein, 9 aa, Homo Sapiens
PALDGSLGM

SEQ ID NO: 1099308 - protein, 9 aa, Homo Sapiens
SGSSSGGGS

SEQ ID NO: 1099309 - protein, 9 aa, Homo Sapiens
PFVCNVGEK

SEQ ID NO: 1099310 - protein, 9 aa, Homo Sapiens
ELCMQMLGG

SEQ ID NO: 1099311 - protein, 9 aa, Homo Sapiens
FIITNVVIE

SEQ ID NO: 1099312 - protein, 9 aa, Homo Sapiens
RRRPKLQPG

SEQ ID NO: 1099313 - protein, 9 aa, Homo Sapiens
REHVLEEVI

SEQ ID NO: 1099314 - protein, 9 aa, Homo Sapiens
PWPTHLPSA

SEQ ID NO: 1099315 - protein, 9 aa, Homo Sapiens
DGRAPRQLG

SEQ ID NO: 1099316 - protein, 9 aa, Homo Sapiens
WGAISRSSH

SEQ ID NO: 1099317 - protein, 9 aa, Homo Sapiens
QQQHQQHQH

SEQ ID NO: 1099318 - protein, 9 aa, Homo Sapiens
KAFTSILRL

SEQ ID NO: 1099319 - protein, 9 aa, Homo Sapiens
SKGSLDCLL

SEQ ID NO: 1099320 - protein, 9 aa, Homo Sapiens
GHIVFTKQP

SEQ ID NO: 1099321 - protein, 9 aa, Homo Sapiens
SAPAAAPPP

SEQ ID NO: 1099322 - protein, 9 aa, Homo Sapiens
APVPVEHLA

SEQ ID NO: 1099323 - protein, 9 aa, Homo Sapiens
LTLYGSMQA

SEQ ID NO: 1099324 - protein, 9 aa, Homo Sapiens
WLMDPKILK

SEQ ID NO: 1099325 - protein, 9 aa, Homo Sapiens
EQCAAAALA

SEQ ID NO: 1099326 - protein, 9 aa, Homo Sapiens
CMAPTIPSF

SEQ ID NO: 1099327 - protein, 9 aa, Homo Sapiens
HIKNFGGDM

SEQ ID NO: 1099328 - protein, 9 aa, Homo Sapiens
HSGSHSEYP

SEQ ID NO: 1099329 - protein, 9 aa, Homo Sapiens
AINAPVTCY

SEQ ID NO: 1099330 - protein, 9 aa, Homo Sapiens
GFLKYMVSY

SEQ ID NO: 1099331 - protein, 9 aa, Homo Sapiens
TVNLRLQPA

SEQ ID NO: 1099332 - protein, 9 aa, Homo Sapiens
TPLHSGIRD

SEQ ID NO: 1099333 - protein, 9 aa, Homo Sapiens
AVMGDFGLA

SEQ ID NO: 1099334 - protein, 9 aa, Homo Sapiens
AAKAKKTAA

SEQ ID NO: 1099335 - protein, 9 aa, Homo Sapiens
PAALREWGH

SEQ ID NO: 1099336 - protein, 9 aa, Homo Sapiens
PHLGQEPGV

SEQ ID NO: 1099337 - protein, 9 aa, Homo Sapiens
QLALFYQGP

SEQ ID NO: 1099338 - protein, 9 aa, Homo Sapiens
HITLNDLCL

SEQ ID NO: 1099339 - protein, 9 aa, Homo Sapiens
VHPPAPGVQ

SEQ ID NO: 1099340 - protein, 9 aa, Homo Sapiens
SPTPTSALA

SEQ ID NO: 1099341 - protein, 9 aa, Homo Sapiens
GYGVHQSVP

SEQ ID NO: 1099342 - protein, 9 aa, Homo Sapiens
LLPVLVQDA

SEQ ID NO: 1099343 - protein, 9 aa, Homo Sapiens
CRSKTLESL

SEQ ID NO: 1099344 - protein, 9 aa, Homo Sapiens
FRTAGSAKG

SEQ ID NO: 1099345 - protein, 9 aa, Homo Sapiens
SHFYVVMWK

SEQ ID NO: 1099346 - protein, 9 aa, Homo Sapiens
ARVFSHAAL

SEQ ID NO: 1099347 - protein, 9 aa, Homo Sapiens
ATEAGAPGS

SEQ ID NO: 1099348 - protein, 9 aa, Homo Sapiens
WGLGYHGMY

SEQ ID NO: 1099349 - protein, 9 aa, Homo Sapiens
EFGSGVVIL

SEQ ID NO: 1099350 - protein, 9 aa, Homo Sapiens
ALAQAQGRL

SEQ ID NO: 1099351 - protein, 9 aa, Homo Sapiens
RGIFGQRLE

SEQ ID NO: 1099352 - protein, 9 aa, Homo Sapiens
AATSRGMWN

SEQ ID NO: 1099353 - protein, 9 aa, Homo Sapiens
VQSRKGVHQ

SEQ ID NO: 1099354 - protein, 9 aa, Homo Sapiens
NLYLLAFKK

SEQ ID NO: 1099355 - protein, 9 aa, Homo Sapiens
DPPQPGGVL

SEQ ID NO: 1099356 - protein, 9 aa, Homo Sapiens
QTINHSLLA

SEQ ID NO: 1099357 - protein, 9 aa, Homo Sapiens
FKNFGMAFL

SEQ ID NO: 1099358 - protein, 9 aa, Homo Sapiens
VMPEEEEED

SEQ ID NO: 1099359 - protein, 9 aa, Homo Sapiens
PTHLPSAPA

SEQ ID NO: 1099360 - protein, 9 aa, Homo Sapiens
AHHAVYKQS

SEQ ID NO: 1099361 - protein, 9 aa, Homo Sapiens
TASCGTGSR

SEQ ID NO: 1099362 - protein, 9 aa, Homo Sapiens
TRERAAAAL

SEQ ID NO: 1099363 - protein, 9 aa, Homo Sapiens
RLLQLSRLI

SEQ ID NO: 1099364 - protein, 9 aa, Homo Sapiens
DPAGWVLLP

SEQ ID NO: 1099365 - protein, 9 aa, Homo Sapiens
SLSCCPRPR

SEQ ID NO: 1099366 - protein, 9 aa, Homo Sapiens
ESRTLGTAL

SEQ ID NO: 1099367 - protein, 9 aa, Homo Sapiens
IELDMCTIA

SEQ ID NO: 1099368 - protein, 9 aa, Homo Sapiens
ELALGLRQQ

SEQ ID NO: 1099369 - protein, 9 aa, Homo Sapiens
VWLLPGMGP

SEQ ID NO: 1099370 - protein, 9 aa, Homo Sapiens
DGIDGDQGP

SEQ ID NO: 1099371 - protein, 9 aa, Homo Sapiens
RVLVHCQVG

SEQ ID NO: 1099372 - protein, 9 aa, Homo Sapiens
AGRWGPALS

SEQ ID NO: 1099373 - protein, 9 aa, Homo Sapiens
SWSTGFVIH

SEQ ID NO: 1099374 - protein, 9 aa, Homo Sapiens
GHHPNLPMR

SEQ ID NO: 1099375 - protein, 9 aa, Homo Sapiens
EGAGRQHHV

SEQ ID NO: 1099376 - protein, 9 aa, Homo Sapiens
PPCTVAGGW

SEQ ID NO: 1099377 - protein, 9 aa, Homo Sapiens
FYQRSIKEG

SEQ ID NO: 1099378 - protein, 9 aa, Homo Sapiens
ILRARRGRL

SEQ ID NO: 1099379 - protein, 9 aa, Homo Sapiens
IVKLTQIVL

SEQ ID NO: 1099380 - protein, 9 aa, Homo Sapiens
ASVHPKTYP

SEQ ID NO: 1099381 - protein, 9 aa, Homo Sapiens
KNDRILEGN

SEQ ID NO: 1099382 - protein, 9 aa, Homo Sapiens
DPEDLDLIL

SEQ ID NO: 1099383 - protein, 9 aa, Homo Sapiens
STVAITLLT

SEQ ID NO: 1099384 - protein, 9 aa, Homo Sapiens
SLGLLPWAR

SEQ ID NO: 1099385 - protein, 9 aa, Homo Sapiens
RHLRLLRLG

SEQ ID NO: 1099386 - protein, 9 aa, Homo Sapiens
VGTALVSSA

SEQ ID NO: 1099387 - protein, 9 aa, Homo Sapiens
SQRARGSHI

SEQ ID NO: 1099388 - protein, 9 aa, Homo Sapiens
PCTVAGGWG

SEQ ID NO: 1099389 - protein, 9 aa, Homo Sapiens
CDDDTVPSV

SEQ ID NO: 1099390 - protein, 9 aa, Homo Sapiens
DRHGLQELR

SEQ ID NO: 1099391 - protein, 9 aa, Homo Sapiens
PKRSARAPR

SEQ ID NO: 1099392 - protein, 9 aa, Homo Sapiens
QCAAAALAS

SEQ ID NO: 1099393 - protein, 9 aa, Homo Sapiens
GRKKSRLPH

SEQ ID NO: 1099394 - protein, 9 aa, Homo Sapiens
SVSRDKTLR

SEQ ID NO: 1099395 - protein, 9 aa, Homo Sapiens
VGIQPAGPG

SEQ ID NO: 1099396 - protein, 9 aa, Homo Sapiens
KKSSHCLLT

SEQ ID NO: 1099397 - protein, 9 aa, Homo Sapiens
PPPTPSSSL

SEQ ID NO: 1099398 - protein, 9 aa, Homo Sapiens
LLNPMGTVR

SEQ ID NO: 1099399 - protein, 9 aa, Homo Sapiens
GSLGQFLQV

SEQ ID NO: 1099400 - protein, 9 aa, Homo Sapiens
FYFIQIMEK

SEQ ID NO: 1099401 - protein, 9 aa, Homo Sapiens
GGILFFVLS

SEQ ID NO: 1099402 - protein, 9 aa, Homo Sapiens
RVWNTASFR

SEQ ID NO: 1099403 - protein, 9 aa, Homo Sapiens
PCTIAAPTT

SEQ ID NO: 1099404 - protein, 9 aa, Homo Sapiens
GRVPHQVQG

SEQ ID NO: 1099405 - protein, 9 aa, Homo Sapiens
YYYLTNGIH

SEQ ID NO: 1099406 - protein, 9 aa, Homo Sapiens
PDKKKGTPT

SEQ ID NO: 1099407 - protein, 9 aa, Homo Sapiens
TSMPESAGG

SEQ ID NO: 1099408 - protein, 9 aa, Homo Sapiens
PALPQRGPA

SEQ ID NO: 1099409 - protein, 9 aa, Homo Sapiens
ASGAPRLRM

SEQ ID NO: 1099410 - protein, 9 aa, Homo Sapiens
EARHALETP

SEQ ID NO: 1099411 - protein, 9 aa, Homo Sapiens
LQGWEFQSP

SEQ ID NO: 1099412 - protein, 9 aa, Homo Sapiens
DLRLASANV

SEQ ID NO: 1099413 - protein, 9 aa, Homo Sapiens
GLPLPPPVW

SEQ ID NO: 1099414 - protein, 9 aa, Homo Sapiens
KRSSSQPVT

SEQ ID NO: 1099415 - protein, 9 aa, Homo Sapiens
LRCSTTRDR

SEQ ID NO: 1099416 - protein, 9 aa, Homo Sapiens
DESSDSGAG

SEQ ID NO: 1099417 - protein, 9 aa, Homo Sapiens
VTTQPAQTS

SEQ ID NO: 1099418 - protein, 9 aa, Homo Sapiens
ELPVACEEA

SEQ ID NO: 1099419 - protein, 9 aa, Homo Sapiens
YDSWDQRRH

SEQ ID NO: 1099420 - protein, 9 aa, Homo Sapiens
DFVADGALL

SEQ ID NO: 1099421 - protein, 9 aa, Homo Sapiens
FAQEVSLKC

SEQ ID NO: 1099422 - protein, 9 aa, Homo Sapiens
REPVDTGPQ

SEQ ID NO: 1099423 - protein, 9 aa, Homo Sapiens
LPAGPPPGG

SEQ ID NO: 1099424 - protein, 9 aa, Homo Sapiens
APPSSSSSS

SEQ ID NO: 1099425 - protein, 9 aa, Homo Sapiens
DAVGMDQQP

SEQ ID NO: 1099426 - protein, 9 aa, Homo Sapiens
DYNPRERTL

SEQ ID NO: 1099427 - protein, 9 aa, Homo Sapiens
GKVFGNFNL

SEQ ID NO: 1099428 - protein, 9 aa, Homo Sapiens
PVEHLALQR

SEQ ID NO: 1099429 - protein, 9 aa, Homo Sapiens
IHLLLSLGR

SEQ ID NO: 1099430 - protein, 9 aa, Homo Sapiens
IPGLLGSPL

SEQ ID NO: 1099431 - protein, 9 aa, Homo Sapiens
FVARQMALR

SEQ ID NO: 1099432 - protein, 9 aa, Homo Sapiens
PLSCQLCSS

SEQ ID NO: 1099433 - protein, 9 aa, Homo Sapiens
KCTIYLNIT

SEQ ID NO: 1099434 - protein, 9 aa, Homo Sapiens
YSAVKYSGS

SEQ ID NO: 1099435 - protein, 9 aa, Homo Sapiens
PGSNCSSVI

SEQ ID NO: 1099436 - protein, 9 aa, Homo Sapiens
ELAVQALQF

SEQ ID NO: 1099437 - protein, 9 aa, Homo Sapiens
LLRLWMFLR

SEQ ID NO: 1099438 - protein, 9 aa, Homo Sapiens
FSRPILASY

SEQ ID NO: 1099439 - protein, 9 aa, Homo Sapiens
GLTQGAMAE

SEQ ID NO: 1099440 - protein, 9 aa, Homo Sapiens
WPPQRPSNS

SEQ ID NO: 1099441 - protein, 9 aa, Homo Sapiens
TNFGEQPHA

SEQ ID NO: 1099442 - protein, 9 aa, Homo Sapiens
QGVPGKTSL

SEQ ID NO: 1099443 - protein, 9 aa, Homo Sapiens
LPGLHTAVP

SEQ ID NO: 1099444 - protein, 9 aa, Homo Sapiens
QTACSTFFL

SEQ ID NO: 1099445 - protein, 9 aa, Homo Sapiens
ELAMVPVFV

SEQ ID NO: 1099446 - protein, 9 aa, Homo Sapiens
SGAPRLRMA

SEQ ID NO: 1099447 - protein, 9 aa, Homo Sapiens
SHMVSEGGA

SEQ ID NO: 1099448 - protein, 9 aa, Homo Sapiens
RTSGEPWDT

SEQ ID NO: 1099449 - protein, 9 aa, Homo Sapiens
GQRSHVGPG

SEQ ID NO: 1099450 - protein, 9 aa, Homo Sapiens
YDETTQKFT

SEQ ID NO: 1099451 - protein, 9 aa, Homo Sapiens
LNLLFQKLP

SEQ ID NO: 1099452 - protein, 9 aa, Homo Sapiens
SVSLLGRFL

SEQ ID NO: 1099453 - protein, 9 aa, Homo Sapiens
ALTLGGWTT

SEQ ID NO: 1099454 - protein, 9 aa, Homo Sapiens
GWLCPTPSA

SEQ ID NO: 1099455 - protein, 9 aa, Homo Sapiens
NQQHGRRFR

SEQ ID NO: 1099456 - protein, 9 aa, Homo Sapiens
WMPVVDPQE

SEQ ID NO: 1099457 - protein, 9 aa, Homo Sapiens
DGQPKAVWV

SEQ ID NO: 1099458 - protein, 9 aa, Homo Sapiens
APDYSLRVA

SEQ ID NO: 1099459 - protein, 9 aa, Homo Sapiens
DETTQKFTF

SEQ ID NO: 1099460 - protein, 9 aa, Homo Sapiens
SEPTAGAAP

SEQ ID NO: 1099461 - protein, 9 aa, Homo Sapiens
EAIRYCHDC

SEQ ID NO: 1099462 - protein, 9 aa, Homo Sapiens
RSTRSPPLW

SEQ ID NO: 1099463 - protein, 9 aa, Homo Sapiens
TVAITLLTL

SEQ ID NO: 1099464 - protein, 9 aa, Homo Sapiens
TPHWTFGGG

SEQ ID NO: 1099465 - protein, 9 aa, Homo Sapiens
HRLWHAVHE

SEQ ID NO: 1099466 - protein, 9 aa, Homo Sapiens
ALGTLYGNM

SEQ ID NO: 1099467 - protein, 9 aa, Homo Sapiens
GIVQCAHLA

SEQ ID NO: 1099468 - protein, 9 aa, Homo Sapiens
GLARPEALF

SEQ ID NO: 1099469 - protein, 9 aa, Homo Sapiens
HPTVRPWRA

SEQ ID NO: 1099470 - protein, 9 aa, Homo Sapiens
RVSECEEIA

SEQ ID NO: 1099471 - protein, 9 aa, Homo Sapiens
MFDQAQTKI

SEQ ID NO: 1099472 - protein, 9 aa, Homo Sapiens
LCNTFREIL

SEQ ID NO: 1099473 - protein, 9 aa, Homo Sapiens
FTNWYQASK

SEQ ID NO: 1099474 - protein, 9 aa, Homo Sapiens
TRPPLLTIN

SEQ ID NO: 1099475 - protein, 9 aa, Homo Sapiens
TSWGPTAGA

SEQ ID NO: 1099476 - protein, 9 aa, Homo Sapiens
ARGFRSGAK

SEQ ID NO: 1099477 - protein, 9 aa, Homo Sapiens
AFPGHRVNA

SEQ ID NO: 1099478 - protein, 9 aa, Homo Sapiens
LPWARFQDS

SEQ ID NO: 1099479 - protein, 9 aa, Homo Sapiens
LRLRSDLLE

SEQ ID NO: 1099480 - protein, 9 aa, Homo Sapiens
EVSPVSQQS

SEQ ID NO: 1099481 - protein, 9 aa, Homo Sapiens
PGMGPHVPR

SEQ ID NO: 1099482 - protein, 9 aa, Homo Sapiens
LLCQNPEKL

SEQ ID NO: 1099483 - protein, 9 aa, Homo Sapiens
SHCGSLMEG

SEQ ID NO: 1099484 - protein, 9 aa, Homo Sapiens
RISPLLTIL

SEQ ID NO: 1099485 - protein, 9 aa, Homo Sapiens
TENNPRGAS

SEQ ID NO: 1099486 - protein, 9 aa, Homo Sapiens
TPSLCESTT

SEQ ID NO: 1099487 - protein, 9 aa, Homo Sapiens
EHSAKQHIT

SEQ ID NO: 1099488 - protein, 9 aa, Homo Sapiens
DYMRELLLE

SEQ ID NO: 1099489 - protein, 9 aa, Homo Sapiens
ATAGILGLI

SEQ ID NO: 1099490 - protein, 9 aa, Homo Sapiens
EDEWDRVLE

SEQ ID NO: 1099491 - protein, 9 aa, Homo Sapiens
PILMHWWRV

SEQ ID NO: 1099492 - protein, 9 aa, Homo Sapiens
RREFQLKVR

SEQ ID NO: 1099493 - protein, 9 aa, Homo Sapiens
VNQEILNTN

SEQ ID NO: 1099494 - protein, 9 aa, Homo Sapiens
IAYHTSVQE

SEQ ID NO: 1099495 - protein, 9 aa, Homo Sapiens
KKRVNTAWK

SEQ ID NO: 1099496 - protein, 9 aa, Homo Sapiens
GTLKADKAT

SEQ ID NO: 1099497 - protein, 9 aa, Homo Sapiens
AYHTSVQEE

SEQ ID NO: 1099498 - protein, 9 aa, Homo Sapiens
PVFSVMISA

SEQ ID NO: 1099499 - protein, 9 aa, Homo Sapiens
LLACTAPRA

SEQ ID NO: 1099500 - protein, 9 aa, Homo Sapiens
RQEEEEAMH

SEQ ID NO: 1099501 - protein, 9 aa, Homo Sapiens
QPGPSSPAG

SEQ ID NO: 1099502 - protein, 9 aa, Homo Sapiens
AKSKVSSSL

SEQ ID NO: 1099503 - protein, 9 aa, Homo Sapiens
KTIRFTVRT

SEQ ID NO: 1099504 - protein, 9 aa, Homo Sapiens
SPVNTQPTP

SEQ ID NO: 1099505 - protein, 9 aa, Homo Sapiens
LPLPEVLLP

SEQ ID NO: 1099506 - protein, 9 aa, Homo Sapiens
AMFFIGFAA

SEQ ID NO: 1099507 - protein, 9 aa, Homo Sapiens
HQSVPYGMA

SEQ ID NO: 1099508 - protein, 9 aa, Homo Sapiens
ELRMGLEES

SEQ ID NO: 1099509 - protein, 9 aa, Homo Sapiens
AAMVLSTDI

SEQ ID NO: 1099510 - protein, 9 aa, Homo Sapiens
LRLQRSPSS

SEQ ID NO: 1099511 - protein, 9 aa, Homo Sapiens
ASPPTRSSS

SEQ ID NO: 1099512 - protein, 9 aa, Homo Sapiens
YVPARQPEP

SEQ ID NO: 1099513 - protein, 9 aa, Homo Sapiens
MPEEEEEDD

SEQ ID NO: 1099514 - protein, 9 aa, Homo Sapiens
CDTNESTNT

SEQ ID NO: 1099515 - protein, 9 aa, Homo Sapiens
CSQDQGVLD

SEQ ID NO: 1099516 - protein, 9 aa, Homo Sapiens
KAGRSQGRL

SEQ ID NO: 1099517 - protein, 9 aa, Homo Sapiens
MPLSCQLCS

SEQ ID NO: 1099518 - protein, 9 aa, Homo Sapiens
FPILFKLSC

SEQ ID NO: 1099519 - protein, 9 aa, Homo Sapiens
AKMGTPRIE

SEQ ID NO: 1099520 - protein, 9 aa, Homo Sapiens
GRLDVFLHF

SEQ ID NO: 1099521 - protein, 9 aa, Homo Sapiens
DAAEALFFI

SEQ ID NO: 1099522 - protein, 9 aa, Homo Sapiens
GDFITAAAM

SEQ ID NO: 1099523 - protein, 9 aa, Homo Sapiens
ELRQDPPSS

SEQ ID NO: 1099524 - protein, 9 aa, Homo Sapiens
HNDIMLLRL

SEQ ID NO: 1099525 - protein, 9 aa, Homo Sapiens
TSLFRRSGS

SEQ ID NO: 1099526 - protein, 9 aa, Homo Sapiens
EVSLLMAHC

SEQ ID NO: 1099527 - protein, 9 aa, Homo Sapiens
PACMSAPQP

SEQ ID NO: 1099528 - protein, 9 aa, Homo Sapiens
PAGTAGPIG

SEQ ID NO: 1099529 - protein, 9 aa, Homo Sapiens
TCVAVVDQH

SEQ ID NO: 1099530 - protein, 9 aa, Homo Sapiens
PSYHGRDLP

SEQ ID NO: 1099531 - protein, 9 aa, Homo Sapiens
RETRSGRPG

SEQ ID NO: 1099532 - protein, 9 aa, Homo Sapiens
WTHTEAAHR

SEQ ID NO: 1099533 - protein, 9 aa, Homo Sapiens
PRAPDPPPR

SEQ ID NO: 1099534 - protein, 9 aa, Homo Sapiens
EVHDQKECV

SEQ ID NO: 1099535 - protein, 9 aa, Homo Sapiens
PLGRGIFGQ

SEQ ID NO: 1099536 - protein, 9 aa, Homo Sapiens
RGCWVGYEK

SEQ ID NO: 1099537 - protein, 9 aa, Homo Sapiens
TQCGRRFCR

SEQ ID NO: 1099538 - protein, 9 aa, Homo Sapiens
GGTQEVEIG

SEQ ID NO: 1099539 - protein, 9 aa, Homo Sapiens
LRTSGEPWD

SEQ ID NO: 1099540 - protein, 9 aa, Homo Sapiens
FGNQQRTGH

SEQ ID NO: 1099541 - protein, 9 aa, Homo Sapiens
NCSSVIMTA

SEQ ID NO: 1099542 - protein, 9 aa, Homo Sapiens
DTGPLDTTP

SEQ ID NO: 1099543 - protein, 9 aa, Homo Sapiens
TVRPWRADD

SEQ ID NO: 1099544 - protein, 9 aa, Homo Sapiens
MRSKRKYRK

SEQ ID NO: 1099545 - protein, 9 aa, Homo Sapiens
CALCRKVLE

SEQ ID NO: 1099546 - protein, 9 aa, Homo Sapiens
PTTRLMAPV

SEQ ID NO: 1099547 - protein, 9 aa, Homo Sapiens
QVLSAGAAR

SEQ ID NO: 1099548 - protein, 9 aa, Homo Sapiens
AEYTFAFPP

SEQ ID NO: 1099549 - protein, 9 aa, Homo Sapiens
DVADVPPLC

SEQ ID NO: 1099550 - protein, 9 aa, Homo Sapiens
DFLGGREVV

SEQ ID NO: 1099551 - protein, 9 aa, Homo Sapiens
DKITRPGVK

SEQ ID NO: 1099552 - protein, 9 aa, Homo Sapiens
ERERSVDRE

SEQ ID NO: 1099553 - protein, 9 aa, Homo Sapiens
TRGPRNIQL

SEQ ID NO: 1099554 - protein, 9 aa, Homo Sapiens
LKQNLNLLF

SEQ ID NO: 1099555 - protein, 9 aa, Homo Sapiens
PLQDGSLDR

SEQ ID NO: 1099556 - protein, 9 aa, Homo Sapiens
EINDLVKWK

SEQ ID NO: 1099557 - protein, 9 aa, Homo Sapiens
QCPVCRQEC

SEQ ID NO: 1099558 - protein, 9 aa, Homo Sapiens
RHAGRKQPP

SEQ ID NO: 1099559 - protein, 9 aa, Homo Sapiens
VCDDDTVPS

SEQ ID NO: 1099560 - protein, 9 aa, Homo Sapiens
TPPATSSSR

SEQ ID NO: 1099561 - protein, 9 aa, Homo Sapiens
GTCHQWRCS

SEQ ID NO: 1099562 - protein, 9 aa, Homo Sapiens
YLDRQFRAG

SEQ ID NO: 1099563 - protein, 9 aa, Homo Sapiens
KQRSFAPGS

SEQ ID NO: 1099564 - protein, 9 aa, Homo Sapiens
SLRKTQAQS

SEQ ID NO: 1099565 - protein, 9 aa, Homo Sapiens
KVGLIPIKS

SEQ ID NO: 1099566 - protein, 9 aa, Homo Sapiens
LTHHRNREL

SEQ ID NO: 1099567 - protein, 9 aa, Homo Sapiens
VPAETVGHF

SEQ ID NO: 1099568 - protein, 9 aa, Homo Sapiens
SAPRPGAAA

SEQ ID NO: 1099569 - protein, 9 aa, Homo Sapiens
TGLTTVSHN

SEQ ID NO: 1099570 - protein, 9 aa, Homo Sapiens
CQVGISRSA

SEQ ID NO: 1099571 - protein, 9 aa, Homo Sapiens
AAPTGRPRM

SEQ ID NO: 1099572 - protein, 9 aa, Homo Sapiens
LSSGQPNTQ

SEQ ID NO: 1099573 - protein, 9 aa, Homo Sapiens
AFQQACYNF

SEQ ID NO: 1099574 - protein, 9 aa, Homo Sapiens
VQDTGPLDT

SEQ ID NO: 1099575 - protein, 9 aa, Homo Sapiens
QLDLHFPRD

SEQ ID NO: 1099576 - protein, 9 aa, Homo Sapiens
FAGILVLIP

SEQ ID NO: 1099577 - protein, 9 aa, Homo Sapiens
DAHITKKQR

SEQ ID NO: 1099578 - protein, 9 aa, Homo Sapiens
LSLRPAPHG

SEQ ID NO: 1099579 - protein, 9 aa, Homo Sapiens
PWPSPQQRN

SEQ ID NO: 1099580 - protein, 9 aa, Homo Sapiens
NWVGGPGPG

SEQ ID NO: 1099581 - protein, 9 aa, Homo Sapiens
FPDMVFETR

SEQ ID NO: 1099582 - protein, 9 aa, Homo Sapiens
MIKNRISPL

SEQ ID NO: 1099583 - protein, 9 aa, Homo Sapiens
ARDRINWFL

SEQ ID NO: 1099584 - protein, 9 aa, Homo Sapiens
LTLEPYEWD

SEQ ID NO: 1099585 - protein, 9 aa, Homo Sapiens
CGKLLPLPR

SEQ ID NO: 1099586 - protein, 9 aa, Homo Sapiens
LPRDWNDVQ

SEQ ID NO: 1099587 - protein, 9 aa, Homo Sapiens
LMRKLKRLR

SEQ ID NO: 1099588 - protein, 9 aa, Homo Sapiens
EVRHRALSE

SEQ ID NO: 1099589 - protein, 9 aa, Homo Sapiens
WPDHFLEPG

SEQ ID NO: 1099590 - protein, 9 aa, Homo Sapiens
WDANAPEGR

SEQ ID NO: 1099591 - protein, 9 aa, Homo Sapiens
VPFWPPSHQ

SEQ ID NO: 1099592 - protein, 9 aa, Homo Sapiens
WRSYNVHHP

SEQ ID NO: 1099593 - protein, 9 aa, Homo Sapiens
RRMQLRLIK

SEQ ID NO: 1099594 - protein, 9 aa, Homo Sapiens
ILEQTATQV

SEQ ID NO: 1099595 - protein, 9 aa, Homo Sapiens
KPVDWWVMG

SEQ ID NO: 1099596 - protein, 9 aa, Homo Sapiens
WPWEVSLWM

SEQ ID NO: 1099597 - protein, 9 aa, Homo Sapiens
VVQKADSRH

SEQ ID NO: 1099598 - protein, 9 aa, Homo Sapiens
KPRVRGGVP

SEQ ID NO: 1099599 - protein, 9 aa, Homo Sapiens
LSRLCISLL

SEQ ID NO: 1099600 - protein, 9 aa, Homo Sapiens
GSTGSRKAS

SEQ ID NO: 1099601 - protein, 9 aa, Homo Sapiens
FHLNFEATP

SEQ ID NO: 1099602 - protein, 9 aa, Homo Sapiens
TYQLDVVEW

SEQ ID NO: 1099603 - protein, 9 aa, Homo Sapiens
HRAAVLRAM

SEQ ID NO: 1099604 - protein, 9 aa, Homo Sapiens
KATENHQAL

SEQ ID NO: 1099605 - protein, 9 aa, Homo Sapiens
RVLFEGTCA

SEQ ID NO: 1099606 - protein, 9 aa, Homo Sapiens
QSADEKARK

SEQ ID NO: 1099607 - protein, 9 aa, Homo Sapiens
PGNHPERYG

SEQ ID NO: 1099608 - protein, 9 aa, Homo Sapiens
ETDCYIVLK

SEQ ID NO: 1099609 - protein, 9 aa, Homo Sapiens
SSTKSSSEP

SEQ ID NO: 1099610 - protein, 9 aa, Homo Sapiens
VEHLALQRP

SEQ ID NO: 1099611 - protein, 9 aa, Homo Sapiens
SQNLLETLG

SEQ ID NO: 1099612 - protein, 9 aa, Homo Sapiens
LLLLPEGIR

SEQ ID NO: 1099613 - protein, 9 aa, Homo Sapiens
SDSFNSAVQ

SEQ ID NO: 1099614 - protein, 9 aa, Homo Sapiens
FSKDIIISD

SEQ ID NO: 1099615 - protein, 9 aa, Homo Sapiens
MRGEPLQVE

SEQ ID NO: 1099616 - protein, 9 aa, Homo Sapiens
PPALVGIQP

SEQ ID NO: 1099617 - protein, 9 aa, Homo Sapiens
SATGPTTWG

SEQ ID NO: 1099618 - protein, 9 aa, Homo Sapiens
STLLSTPEE

SEQ ID NO: 1099619 - protein, 9 aa, Homo Sapiens
DDFVADGAL

SEQ ID NO: 1099620 - protein, 9 aa, Homo Sapiens
MGVGAKVAF

SEQ ID NO: 1099621 - protein, 9 aa, Homo Sapiens
SEYPMSSSG

SEQ ID NO: 1099622 - protein, 9 aa, Homo Sapiens
GNNTFFCNQ

SEQ ID NO: 1099623 - protein, 9 aa, Homo Sapiens
SPVGDVGLG

SEQ ID NO: 1099624 - protein, 9 aa, Homo Sapiens
IGFAALVIM

SEQ ID NO: 1099625 - protein, 9 aa, Homo Sapiens
YCDVPQAIK

SEQ ID NO: 1099626 - protein, 9 aa, Homo Sapiens
GLLQPKPWQ

SEQ ID NO: 1099627 - protein, 9 aa, Homo Sapiens
EESIPKKSY

SEQ ID NO: 1099628 - protein, 9 aa, Homo Sapiens
REWFMECLM

SEQ ID NO: 1099629 - protein, 9 aa, Homo Sapiens
AAAATAASA

SEQ ID NO: 1099630 - protein, 9 aa, Homo Sapiens
EPCPAVTDL

SEQ ID NO: 1099631 - protein, 9 aa, Homo Sapiens
EWAVREQWA

SEQ ID NO: 1099632 - protein, 9 aa, Homo Sapiens
DKFTNMYIV

SEQ ID NO: 1099633 - protein, 9 aa, Homo Sapiens
QHNAENAEE

SEQ ID NO: 1099634 - protein, 9 aa, Homo Sapiens
AITPLLENN

SEQ ID NO: 1099635 - protein, 9 aa, Homo Sapiens
HLMWMNMNI

SEQ ID NO: 1099636 - protein, 9 aa, Homo Sapiens
NASIMCPLN

SEQ ID NO: 1099637 - protein, 9 aa, Homo Sapiens
QQQRKEQTL

SEQ ID NO: 1099638 - protein, 9 aa, Homo Sapiens
AGVGGRSPV

SEQ ID NO: 1099639 - protein, 9 aa, Homo Sapiens
AVAPTATLG

SEQ ID NO: 1099640 - protein, 9 aa, Homo Sapiens
DEGTKSGPL

SEQ ID NO: 1099641 - protein, 9 aa, Homo Sapiens
LEQKFMLYW

SEQ ID NO: 1099642 - protein, 9 aa, Homo Sapiens
QLIRASALC

SEQ ID NO: 1099643 - protein, 9 aa, Homo Sapiens
KKFFEKKVH

SEQ ID NO: 1099644 - protein, 9 aa, Homo Sapiens
NFEATPYLY

SEQ ID NO: 1099645 - protein, 9 aa, Homo Sapiens
REVVAQATG

SEQ ID NO: 1099646 - protein, 9 aa, Homo Sapiens
EHICLRETY

SEQ ID NO: 1099647 - protein, 9 aa, Homo Sapiens
ASSPGHPLG

SEQ ID NO: 1099648 - protein, 9 aa, Homo Sapiens
VNTQPTPLP

SEQ ID NO: 1099649 - protein, 9 aa, Homo Sapiens
LPEGIRCRP

SEQ ID NO: 1099650 - protein, 9 aa, Homo Sapiens
LPDSVPGPP

SEQ ID NO: 1099651 - protein, 9 aa, Homo Sapiens
PKARRRPKL

SEQ ID NO: 1099652 - protein, 9 aa, Homo Sapiens
QNLNLLFQK

SEQ ID NO: 1099653 - protein, 9 aa, Homo Sapiens
PVSQQSIRN

SEQ ID NO: 1099654 - protein, 9 aa, Homo Sapiens
TMGCWDMYH

SEQ ID NO: 1099655 - protein, 9 aa, Homo Sapiens
FNKMKKIDY

SEQ ID NO: 1099656 - protein, 9 aa, Homo Sapiens
AVDAQVGPL

SEQ ID NO: 1099657 - protein, 9 aa, Homo Sapiens
RPSCGRCMR

SEQ ID NO: 1099658 - protein, 9 aa, Homo Sapiens
PWPVTPAPV

SEQ ID NO: 1099659 - protein, 9 aa, Homo Sapiens
RDGQSQTVR

SEQ ID NO: 1099660 - protein, 9 aa, Homo Sapiens
QEAVAESLL

SEQ ID NO: 1099661 - protein, 9 aa, Homo Sapiens
SKAAWQITG

SEQ ID NO: 1099662 - protein, 9 aa, Homo Sapiens
GGFVYRDCQ

SEQ ID NO: 1099663 - protein, 9 aa, Homo Sapiens
AYQDYAHHA

SEQ ID NO: 1099664 - protein, 9 aa, Homo Sapiens
AVPLQPPLP

SEQ ID NO: 1099665 - protein, 9 aa, Homo Sapiens
LISAPVDKE

SEQ ID NO: 1099666 - protein, 9 aa, Homo Sapiens
AGMEDPAIQ

SEQ ID NO: 1099667 - protein, 9 aa, Homo Sapiens
YGTPEYVAP

SEQ ID NO: 1099668 - protein, 9 aa, Homo Sapiens
ARSDLNPAK

SEQ ID NO: 1099669 - protein, 9 aa, Homo Sapiens
RPAAHGPAR

SEQ ID NO: 1099670 - protein, 9 aa, Homo Sapiens
RRLLAAEYT

SEQ ID NO: 1099671 - protein, 9 aa, Homo Sapiens
FKVGLIPIK

SEQ ID NO: 1099672 - protein, 9 aa, Homo Sapiens
VKVNNSMSK

SEQ ID NO: 1099673 - protein, 9 aa, Homo Sapiens
LGSASPTSS

SEQ ID NO: 1099674 - protein, 9 aa, Homo Sapiens
AQGFGASRH

SEQ ID NO: 1099675 - protein, 9 aa, Homo Sapiens
EALGRAAQS

SEQ ID NO: 1099676 - protein, 9 aa, Homo Sapiens
QTEILETVE

SEQ ID NO: 1099677 - protein, 9 aa, Homo Sapiens
VLLLPVLVQ

SEQ ID NO: 1099678 - protein, 9 aa, Homo Sapiens
QAQVVFQVC

SEQ ID NO: 1099679 - protein, 9 aa, Homo Sapiens
ASLSSARHP

SEQ ID NO: 1099680 - protein, 9 aa, Homo Sapiens
TSSFSSQTS

SEQ ID NO: 1099681 - protein, 9 aa, Homo Sapiens
HFPRDSPSA

SEQ ID NO: 1099682 - protein, 9 aa, Homo Sapiens
TPASPGNRG

SEQ ID NO: 1099683 - protein, 9 aa, Homo Sapiens
PQGPLFLLF

SEQ ID NO: 1099684 - protein, 9 aa, Homo Sapiens
LARAPRASC

SEQ ID NO: 1099685 - protein, 9 aa, Homo Sapiens
FQELWYSVA

SEQ ID NO: 1099686 - protein, 9 aa, Homo Sapiens
SLTLSMAEL

SEQ ID NO: 1099687 - protein, 9 aa, Homo Sapiens
WTRAAGRWG

SEQ ID NO: 1099688 - protein, 9 aa, Homo Sapiens
TPSGSASLM

SEQ ID NO: 1099689 - protein, 9 aa, Homo Sapiens
ATRTHQEYL

SEQ ID NO: 1099690 - protein, 9 aa, Homo Sapiens
STSWGPTAG

SEQ ID NO: 1099691 - protein, 9 aa, Homo Sapiens
DGCVELNWS

SEQ ID NO: 1099692 - protein, 9 aa, Homo Sapiens
GKTSLKASR

SEQ ID NO: 1099693 - protein, 9 aa, Homo Sapiens
SRQDPRTAP

SEQ ID NO: 1099694 - protein, 9 aa, Homo Sapiens
WCLQPRSLL

SEQ ID NO: 1099695 - protein, 9 aa, Homo Sapiens
DVPVMLPSY

SEQ ID NO: 1099696 - protein, 9 aa, Homo Sapiens
PWREASQAA

SEQ ID NO: 1099697 - protein, 9 aa, Homo Sapiens
KMIDQGFDP

SEQ ID NO: 1099698 - protein, 9 aa, Homo Sapiens
TTMATPSWV

SEQ ID NO: 1099699 - protein, 9 aa, Homo Sapiens
ADDEEETPP

SEQ ID NO: 1099700 - protein, 9 aa, Homo Sapiens
QSQEEGILR

SEQ ID NO: 1099701 - protein, 9 aa, Homo Sapiens
EKKVDEKQA

SEQ ID NO: 1099702 - protein, 9 aa, Homo Sapiens
VDTGPQPPP

SEQ ID NO: 1099703 - protein, 9 aa, Homo Sapiens
IFILSGNGT

SEQ ID NO: 1099704 - protein, 9 aa, Homo Sapiens
EGGARGTFH

SEQ ID NO: 1099705 - protein, 9 aa, Homo Sapiens
AMLYNCRNN

SEQ ID NO: 1099706 - protein, 9 aa, Homo Sapiens
CCQPVRMPA

SEQ ID NO: 1099707 - protein, 9 aa, Homo Sapiens
ETHLPPIHL

SEQ ID NO: 1099708 - protein, 9 aa, Homo Sapiens
ASTSSVTAS

SEQ ID NO: 1099709 - protein, 9 aa, Homo Sapiens
FFEDQLHGA

SEQ ID NO: 1099710 - protein, 9 aa, Homo Sapiens
GDQLVGGQV

SEQ ID NO: 1099711 - protein, 9 aa, Homo Sapiens
DTADVPTYK

SEQ ID NO: 1099712 - protein, 9 aa, Homo Sapiens
GRWRIGGLC

SEQ ID NO: 1099713 - protein, 9 aa, Homo Sapiens
AVVHPIKVA

SEQ ID NO: 1099714 - protein, 9 aa, Homo Sapiens
WMRDGTVLQ

SEQ ID NO: 1099715 - protein, 9 aa, Homo Sapiens
TMASDPPQP

SEQ ID NO: 1099716 - protein, 9 aa, Homo Sapiens
SWAAFVEAS

SEQ ID NO: 1099717 - protein, 9 aa, Homo Sapiens
NSLPELEAT

SEQ ID NO: 1099718 - protein, 9 aa, Homo Sapiens
PSASAQLWA

SEQ ID NO: 1099719 - protein, 9 aa, Homo Sapiens
PSPSPSQAS

SEQ ID NO: 1099720 - protein, 9 aa, Homo Sapiens
TVETVQELT

SEQ ID NO: 1099721 - protein, 9 aa, Homo Sapiens
QNAWLSYCL

SEQ ID NO: 1099722 - protein, 9 aa, Homo Sapiens
PSTTCTMTP

SEQ ID NO: 1099723 - protein, 9 aa, Homo Sapiens
DHQESSQPK

SEQ ID NO: 1099724 - protein, 9 aa, Homo Sapiens
QPQPTWGCR

SEQ ID NO: 1099725 - protein, 9 aa, Homo Sapiens
LRLGSRWCP

SEQ ID NO: 1099726 - protein, 9 aa, Homo Sapiens
QTSPGRGRE

SEQ ID NO: 1099727 - protein, 9 aa, Homo Sapiens
LPLTMESMD

SEQ ID NO: 1099728 - protein, 9 aa, Homo Sapiens
VPPFLDGHI

SEQ ID NO: 1099729 - protein, 9 aa, Homo Sapiens
LDVVEWSPH

SEQ ID NO: 1099730 - protein, 9 aa, Homo Sapiens
RYLESNGKG

SEQ ID NO: 1099731 - protein, 9 aa, Homo Sapiens
DDTVPSVSS

SEQ ID NO: 1099732 - protein, 9 aa, Homo Sapiens
IVAITPLLE

SEQ ID NO: 1099733 - protein, 9 aa, Homo Sapiens
ALAPHPRPL

SEQ ID NO: 1099734 - protein, 9 aa, Homo Sapiens
MRICLLLGC

SEQ ID NO: 1099735 - protein, 9 aa, Homo Sapiens
ASVSFHHLA

SEQ ID NO: 1099736 - protein, 9 aa, Homo Sapiens
GQTGPLQRG

SEQ ID NO: 1099737 - protein, 9 aa, Homo Sapiens
ALWLLSPSR

SEQ ID NO: 1099738 - protein, 9 aa, Homo Sapiens
NFIPGLQLV

SEQ ID NO: 1099739 - protein, 9 aa, Homo Sapiens
GKCRSKTLE

SEQ ID NO: 1099740 - protein, 9 aa, Homo Sapiens
MPRPSLAGS

SEQ ID NO: 1099741 - protein, 9 aa, Homo Sapiens
GCIAIGVSI

SEQ ID NO: 1099742 - protein, 9 aa, Homo Sapiens
NLGSPLMSE

SEQ ID NO: 1099743 - protein, 9 aa, Homo Sapiens
MKRLCAVRD

SEQ ID NO: 1099744 - protein, 9 aa, Homo Sapiens
CPQQLPHGL

SEQ ID NO: 1099745 - protein, 9 aa, Homo Sapiens
DNWCWRDKK

SEQ ID NO: 1099746 - protein, 9 aa, Homo Sapiens
LLEECLQHT

SEQ ID NO: 1099747 - protein, 9 aa, Homo Sapiens
GHVEPLHGA

SEQ ID NO: 1099748 - protein, 9 aa, Homo Sapiens
NCILEIVYA

SEQ ID NO: 1099749 - protein, 9 aa, Homo Sapiens
SGHCCLWDV

SEQ ID NO: 1099750 - protein, 9 aa, Homo Sapiens
DTNGEWSPK

SEQ ID NO: 1099751 - protein, 9 aa, Homo Sapiens
HQCDRSWAP

SEQ ID NO: 1099752 - protein, 9 aa, Homo Sapiens
AVCTDSAVP

SEQ ID NO: 1099753 - protein, 9 aa, Homo Sapiens
ILYRSYCST

SEQ ID NO: 1099754 - protein, 9 aa, Homo Sapiens
PGLCGGRWR

SEQ ID NO: 1099755 - protein, 9 aa, Homo Sapiens
AQEARRVHH

SEQ ID NO: 1099756 - protein, 9 aa, Homo Sapiens
LMHPRFCHP

SEQ ID NO: 1099757 - protein, 9 aa, Homo Sapiens
ERSVDREPV

SEQ ID NO: 1099758 - protein, 9 aa, Homo Sapiens
KARRRPKLQ

SEQ ID NO: 1099759 - protein, 9 aa, Homo Sapiens
LELVLHKGL

SEQ ID NO: 1099760 - protein, 9 aa, Homo Sapiens
TDLTACFQS

SEQ ID NO: 1099761 - protein, 9 aa, Homo Sapiens
NHVGPSSFL

SEQ ID NO: 1099762 - protein, 9 aa, Homo Sapiens
SPCTACHLN

SEQ ID NO: 1099763 - protein, 9 aa, Homo Sapiens
SLKQKLQAM

SEQ ID NO: 1099764 - protein, 9 aa, Homo Sapiens
CIAIGVSIS

SEQ ID NO: 1099765 - protein, 9 aa, Homo Sapiens
RTGLTTVSH

SEQ ID NO: 1099766 - protein, 9 aa, Homo Sapiens
RHATFKNFG

SEQ ID NO: 1099767 - protein, 9 aa, Homo Sapiens
PLNPAAQDG

SEQ ID NO: 1099768 - protein, 9 aa, Homo Sapiens
TLMRKLKRL

SEQ ID NO: 1099769 - protein, 9 aa, Homo Sapiens
ISCPTLTFV

SEQ ID NO: 1099770 - protein, 9 aa, Homo Sapiens
RPLLEFAQG

SEQ ID NO: 1099771 - protein, 9 aa, Homo Sapiens
IRDRDSEKM

SEQ ID NO: 1099772 - protein, 9 aa, Homo Sapiens
HPGLCGGRW

SEQ ID NO: 1099773 - protein, 9 aa, Homo Sapiens
LILYLVVAV

SEQ ID NO: 1099774 - protein, 9 aa, Homo Sapiens
RSTARATSP

SEQ ID NO: 1099775 - protein, 9 aa, Homo Sapiens
TDCYIVLKT

SEQ ID NO: 1099776 - protein, 9 aa, Homo Sapiens
GKKVGEKLS

SEQ ID NO: 1099777 - protein, 9 aa, Homo Sapiens
PGGLPIFWT

SEQ ID NO: 1099778 - protein, 9 aa, Homo Sapiens
HPSAFKTET

SEQ ID NO: 1099779 - protein, 9 aa, Homo Sapiens
DRGFTAVMG

SEQ ID NO: 1099780 - protein, 9 aa, Homo Sapiens
DFAPGEDSG

SEQ ID NO: 1099781 - protein, 9 aa, Homo Sapiens
RGWFPILFK

SEQ ID NO: 1099782 - protein, 9 aa, Homo Sapiens
KSATCSPGW

SEQ ID NO: 1099783 - protein, 9 aa, Homo Sapiens
LTILEIFYL

SEQ ID NO: 1099784 - protein, 9 aa, Homo Sapiens
PSCPASAPC

SEQ ID NO: 1099785 - protein, 9 aa, Homo Sapiens
TKTLQNTRN

SEQ ID NO: 1099786 - protein, 9 aa, Homo Sapiens
RRATMTCTC

SEQ ID NO: 1099787 - protein, 9 aa, Homo Sapiens
GASVPRGAW

SEQ ID NO: 1099788 - protein, 9 aa, Homo Sapiens
LPCSWWWTQ

SEQ ID NO: 1099789 - protein, 9 aa, Homo Sapiens
PQKSHGKKS

SEQ ID NO: 1099790 - protein, 9 aa, Homo Sapiens
PFCMSSTRT

SEQ ID NO: 1099791 - protein, 9 aa, Homo Sapiens
AGPGAAAAW

SEQ ID NO: 1099792 - protein, 9 aa, Homo Sapiens
EYHLVLAVV

SEQ ID NO: 1099793 - protein, 9 aa, Homo Sapiens
VVSCWLRYL

SEQ ID NO: 1099794 - protein, 9 aa, Homo Sapiens
GKGTEVPWP

SEQ ID NO: 1099795 - protein, 9 aa, Homo Sapiens
RISRETHLP

SEQ ID NO: 1099796 - protein, 9 aa, Homo Sapiens
MFSQTTICR

SEQ ID NO: 1099797 - protein, 9 aa, Homo Sapiens
WKIAVDEEN

SEQ ID NO: 1099798 - protein, 9 aa, Homo Sapiens
QPPLPLTSA

SEQ ID NO: 1099799 - protein, 9 aa, Homo Sapiens
NLPMRNTGS

SEQ ID NO: 1099800 - protein, 9 aa, Homo Sapiens
PTKKIKQCL

SEQ ID NO: 1099801 - protein, 9 aa, Homo Sapiens
GTSANVVCA

SEQ ID NO: 1099802 - protein, 9 aa, Homo Sapiens
EQSPEAEVR

SEQ ID NO: 1099803 - protein, 9 aa, Homo Sapiens
QRRATLGPT

SEQ ID NO: 1099804 - protein, 9 aa, Homo Sapiens
LEEVIREGW

SEQ ID NO: 1099805 - protein, 9 aa, Homo Sapiens
NTWLSYHVL

SEQ ID NO: 1099806 - protein, 9 aa, Homo Sapiens
ALLEEEVDI

SEQ ID NO: 1099807 - protein, 9 aa, Homo Sapiens
VRQLQEGRP

SEQ ID NO: 1099808 - protein, 9 aa, Homo Sapiens
MTVLEQLFE

SEQ ID NO: 1099809 - protein, 9 aa, Homo Sapiens
FVADGALLR

SEQ ID NO: 1099810 - protein, 9 aa, Homo Sapiens
HARVDAHVV

SEQ ID NO: 1099811 - protein, 9 aa, Homo Sapiens
YLTYRLCTV

SEQ ID NO: 1099812 - protein, 9 aa, Homo Sapiens
EARDRINWF

SEQ ID NO: 1099813 - protein, 9 aa, Homo Sapiens
FIRNCILEI

SEQ ID NO: 1099814 - protein, 9 aa, Homo Sapiens
LPQQGRPAT

SEQ ID NO: 1099815 - protein, 9 aa, Homo Sapiens
VPDPSPGAT

SEQ ID NO: 1099816 - protein, 9 aa, Homo Sapiens
CSKKTQNRT

SEQ ID NO: 1099817 - protein, 9 aa, Homo Sapiens
RSVDREPVD

SEQ ID NO: 1099818 - protein, 9 aa, Homo Sapiens
GVPRQDHEH

SEQ ID NO: 1099819 - protein, 9 aa, Homo Sapiens
HQPSLTHHR

SEQ ID NO: 1099820 - protein, 9 aa, Homo Sapiens
PAPLEKTAQ

SEQ ID NO: 1099821 - protein, 9 aa, Homo Sapiens
GGPDSTPRG

SEQ ID NO: 1099822 - protein, 9 aa, Homo Sapiens
ELTHAFDRY

SEQ ID NO: 1099823 - protein, 9 aa, Homo Sapiens
RRLHGETGM

SEQ ID NO: 1099824 - protein, 9 aa, Homo Sapiens
QGRPATQLP

SEQ ID NO: 1099825 - protein, 9 aa, Homo Sapiens
CLQPRSLLL

SEQ ID NO: 1099826 - protein, 9 aa, Homo Sapiens
SCTGLPSGA

SEQ ID NO: 1099827 - protein, 9 aa, Homo Sapiens
HLCCHRSSA

SEQ ID NO: 1099828 - protein, 9 aa, Homo Sapiens
ELEPPGARF

SEQ ID NO: 1099829 - protein, 9 aa, Homo Sapiens
ATGILICQQ

SEQ ID NO: 1099830 - protein, 9 aa, Homo Sapiens
KKNRSYLCN

SEQ ID NO: 1099831 - protein, 9 aa, Homo Sapiens
RRVLCTRPP

SEQ ID NO: 1099832 - protein, 9 aa, Homo Sapiens
RRLCTGEDV

SEQ ID NO: 1099833 - protein, 9 aa, Homo Sapiens
LVCPEIVSR

SEQ ID NO: 1099834 - protein, 9 aa, Homo Sapiens
HDDFVADGA

SEQ ID NO: 1099835 - protein, 9 aa, Homo Sapiens
AVRWVQLEE

SEQ ID NO: 1099836 - protein, 9 aa, Homo Sapiens
SEITEHEKD

SEQ ID NO: 1099837 - protein, 9 aa, Homo Sapiens
ALEPHTHHL

SEQ ID NO: 1099838 - protein, 9 aa, Homo Sapiens
QHTDTVGID

SEQ ID NO: 1099839 - protein, 9 aa, Homo Sapiens
AEDPRVERL

SEQ ID NO: 1099840 - protein, 9 aa, Homo Sapiens
REPVFEFVW

SEQ ID NO: 1099841 - protein, 9 aa, Homo Sapiens
KGAREHICL

SEQ ID NO: 1099842 - protein, 9 aa, Homo Sapiens
TTINLGDLP

SEQ ID NO: 1099843 - protein, 9 aa, Homo Sapiens
LRVKALKKA

SEQ ID NO: 1099844 - protein, 9 aa, Homo Sapiens
ISVFQVIRC

SEQ ID NO: 1099845 - protein, 9 aa, Homo Sapiens
ELQVPHNAG

SEQ ID NO: 1099846 - protein, 9 aa, Homo Sapiens
MRKLKRLRR

SEQ ID NO: 1099847 - protein, 9 aa, Homo Sapiens
ARQRGEMQA

SEQ ID NO: 1099848 - protein, 9 aa, Homo Sapiens
VSPVSQQSI

SEQ ID NO: 1099849 - protein, 9 aa, Homo Sapiens
SVHPKTYPV

SEQ ID NO: 1099850 - protein, 9 aa, Homo Sapiens
ALQGKVLLL

SEQ ID NO: 1099851 - protein, 9 aa, Homo Sapiens
WTSRTSPPA

SEQ ID NO: 1099852 - protein, 9 aa, Homo Sapiens
HRMSLHLHG

SEQ ID NO: 1099853 - protein, 9 aa, Homo Sapiens
FFLFPLGYL

SEQ ID NO: 1099854 - protein, 9 aa, Homo Sapiens
TCLRTCHLM

SEQ ID NO: 1099855 - protein, 9 aa, Homo Sapiens
QKEEFCHVI

SEQ ID NO: 1099856 - protein, 9 aa, Homo Sapiens
VLCIWCFFS

SEQ ID NO: 1099857 - protein, 9 aa, Homo Sapiens
CSLDLRMGW

SEQ ID NO: 1099858 - protein, 9 aa, Homo Sapiens
TQARPPPEQ

SEQ ID NO: 1099859 - protein, 9 aa, Homo Sapiens
GKTLDQVMD

SEQ ID NO: 1099860 - protein, 9 aa, Homo Sapiens
STPPPPPGW

SEQ ID NO: 1099861 - protein, 9 aa, Homo Sapiens
MPTKQAPPS

SEQ ID NO: 1099862 - protein, 9 aa, Homo Sapiens
GAPAAVSPP

SEQ ID NO: 1099863 - protein, 9 aa, Homo Sapiens
TNFSGSVEH

SEQ ID NO: 1099864 - protein, 9 aa, Homo Sapiens
FEDQLHGAG

SEQ ID NO: 1099865 - protein, 9 aa, Homo Sapiens
SVQRPWEKN

SEQ ID NO: 1099866 - protein, 9 aa, Homo Sapiens
CPQCGATCE

SEQ ID NO: 1099867 - protein, 9 aa, Homo Sapiens
DCSAESNRG

SEQ ID NO: 1099868 - protein, 9 aa, Homo Sapiens
SSSKPSSIP

SEQ ID NO: 1099869 - protein, 9 aa, Homo Sapiens
FMGYSTTAF

SEQ ID NO: 1099870 - protein, 9 aa, Homo Sapiens
MKDDALSLK

SEQ ID NO: 1099871 - protein, 9 aa, Homo Sapiens
GPPAAEEVG

SEQ ID NO: 1099872 - protein, 9 aa, Homo Sapiens
GVSTVHVTG

SEQ ID NO: 1099873 - protein, 9 aa, Homo Sapiens
GPTTWGCWP

SEQ ID NO: 1099874 - protein, 9 aa, Homo Sapiens
VSECEEIAS

SEQ ID NO: 1099875 - protein, 9 aa, Homo Sapiens
WNACPERRP

SEQ ID NO: 1099876 - protein, 9 aa, Homo Sapiens
EIAEKNCLV

SEQ ID NO: 1099877 - protein, 9 aa, Homo Sapiens
PPCAARASW

SEQ ID NO: 1099878 - protein, 9 aa, Homo Sapiens
VRILAFLQS

SEQ ID NO: 1099879 - protein, 9 aa, Homo Sapiens
AASLLFSIR

SEQ ID NO: 1099880 - protein, 9 aa, Homo Sapiens
PLWTPAWCM

SEQ ID NO: 1099881 - protein, 9 aa, Homo Sapiens
ETLVTIDIQ

SEQ ID NO: 1099882 - protein, 9 aa, Homo Sapiens
IATNSRNIA

SEQ ID NO: 1099883 - protein, 9 aa, Homo Sapiens
WRARKATSP

SEQ ID NO: 1099884 - protein, 9 aa, Homo Sapiens
HPKTYPVVL

SEQ ID NO: 1099885 - protein, 9 aa, Homo Sapiens
AAYPQTSGG

SEQ ID NO: 1099886 - protein, 9 aa, Homo Sapiens
AHHSGSHSE

SEQ ID NO: 1099887 - protein, 9 aa, Homo Sapiens
AVPMGLLEL

SEQ ID NO: 1099888 - protein, 9 aa, Homo Sapiens
NMGGNRSIC

SEQ ID NO: 1099889 - protein, 9 aa, Homo Sapiens
LAAASGPCH

SEQ ID NO: 1099890 - protein, 9 aa, Homo Sapiens
RCGLTSMPE

SEQ ID NO: 1099891 - protein, 9 aa, Homo Sapiens
QTALYRGGQ

SEQ ID NO: 1099892 - protein, 9 aa, Homo Sapiens
EIGTILLNQ

SEQ ID NO: 1099893 - protein, 9 aa, Homo Sapiens
CLRETYRLI

SEQ ID NO: 1099894 - protein, 9 aa, Homo Sapiens
ALWGERNSS

SEQ ID NO: 1099895 - protein, 9 aa, Homo Sapiens
PPHNPRHQT

SEQ ID NO: 1099896 - protein, 9 aa, Homo Sapiens
SALGSASPT

SEQ ID NO: 1099897 - protein, 9 aa, Homo Sapiens
GRLRYPSQR

SEQ ID NO: 1099898 - protein, 9 aa, Homo Sapiens
SAGLSPGAC

SEQ ID NO: 1099899 - protein, 9 aa, Homo Sapiens
TNVHIKNFG

SEQ ID NO: 1099900 - protein, 9 aa, Homo Sapiens
DNQKVVLLL

SEQ ID NO: 1099901 - protein, 9 aa, Homo Sapiens
GGLPIFWTA

SEQ ID NO: 1099902 - protein, 9 aa, Homo Sapiens
PAGVYKTYI

SEQ ID NO: 1099903 - protein, 9 aa, Homo Sapiens
LNLEQSRRP

SEQ ID NO: 1099904 - protein, 9 aa, Homo Sapiens
CISACPSQF

SEQ ID NO: 1099905 - protein, 9 aa, Homo Sapiens
GEKPSLAAS

SEQ ID NO: 1099906 - protein, 9 aa, Homo Sapiens
PPCSQRLWQ

SEQ ID NO: 1099907 - protein, 9 aa, Homo Sapiens
TLYTWNNGH

SEQ ID NO: 1099908 - protein, 9 aa, Homo Sapiens
WPGPFCMSS

SEQ ID NO: 1099909 - protein, 9 aa, Homo Sapiens
PLTRDAHLC

SEQ ID NO: 1099910 - protein, 9 aa, Homo Sapiens
STSSSLTPL

SEQ ID NO: 1099911 - protein, 9 aa, Homo Sapiens
GAARASDDL

SEQ ID NO: 1099912 - protein, 9 aa, Homo Sapiens
PRPSATSQT

SEQ ID NO: 1099913 - protein, 9 aa, Homo Sapiens
VVILCSELS

SEQ ID NO: 1099914 - protein, 9 aa, Homo Sapiens
SNAGQNSRH

SEQ ID NO: 1099915 - protein, 9 aa, Homo Sapiens
VQEAPPFCF

SEQ ID NO: 1099916 - protein, 9 aa, Homo Sapiens
PCTPSLCES

SEQ ID NO: 1099917 - protein, 9 aa, Homo Sapiens
RRTLQLTPV

SEQ ID NO: 1099918 - protein, 9 aa, Homo Sapiens
SSQPVTLQP

SEQ ID NO: 1099919 - protein, 9 aa, Homo Sapiens
IGNTVKKAV

SEQ ID NO: 1099920 - protein, 9 aa, Homo Sapiens
PPGSYAVAT

SEQ ID NO: 1099921 - protein, 9 aa, Homo Sapiens
ATSSSRGGE

SEQ ID NO: 1099922 - protein, 9 aa, Homo Sapiens
GEPWDTERN

SEQ ID NO: 1099923 - protein, 9 aa, Homo Sapiens
EDVAALLME

SEQ ID NO: 1099924 - protein, 9 aa, Homo Sapiens
VMTAAGIAA

SEQ ID NO: 1099925 - protein, 9 aa, Homo Sapiens
SASAQLWAR

SEQ ID NO: 1099926 - protein, 9 aa, Homo Sapiens
TPRIELARM

SEQ ID NO: 1099927 - protein, 9 aa, Homo Sapiens
ALRANMASQ

SEQ ID NO: 1099928 - protein, 9 aa, Homo Sapiens
GLCYDYKIC

SEQ ID NO: 1099929 - protein, 9 aa, Homo Sapiens
PAPHRSPPR

SEQ ID NO: 1099930 - protein, 9 aa, Homo Sapiens
TQLSISCPT

SEQ ID NO: 1099931 - protein, 9 aa, Homo Sapiens
EGVKAPRNL

SEQ ID NO: 1099932 - protein, 9 aa, Homo Sapiens
KVGKIEFEG

SEQ ID NO: 1099933 - protein, 9 aa, Homo Sapiens
VARVVSFLQ

SEQ ID NO: 1099934 - protein, 9 aa, Homo Sapiens
PSPQCLRLS

SEQ ID NO: 1099935 - protein, 9 aa, Homo Sapiens
DQIQWPTVH

SEQ ID NO: 1099936 - protein, 9 aa, Homo Sapiens
AERAGAARA

SEQ ID NO: 1099937 - protein, 9 aa, Homo Sapiens
LHESAHSMC

SEQ ID NO: 1099938 - protein, 9 aa, Homo Sapiens
EGSMAHVEA

SEQ ID NO: 1099939 - protein, 9 aa, Homo Sapiens
LNKNDWIRV

SEQ ID NO: 1099940 - protein, 9 aa, Homo Sapiens
PCSLPRGPR

SEQ ID NO: 1099941 - protein, 9 aa, Homo Sapiens
RPAWPREAH

SEQ ID NO: 1099942 - protein, 9 aa, Homo Sapiens
RSFAPGSLP

SEQ ID NO: 1099943 - protein, 9 aa, Homo Sapiens
GSTSRRTRP

SEQ ID NO: 1099944 - protein, 9 aa, Homo Sapiens
VIPSGLTLD

SEQ ID NO: 1099945 - protein, 9 aa, Homo Sapiens
PIFHSGMLP

SEQ ID NO: 1099946 - protein, 9 aa, Homo Sapiens
DTASGKFTC

SEQ ID NO: 1099947 - protein, 9 aa, Homo Sapiens
NHPERYGVP

SEQ ID NO: 1099948 - protein, 9 aa, Homo Sapiens
ETGYVWPVC

SEQ ID NO: 1099949 - protein, 9 aa, Homo Sapiens
SSLPSCPAS

SEQ ID NO: 1099950 - protein, 9 aa, Homo Sapiens
GTCTNITMG

SEQ ID NO: 1099951 - protein, 9 aa, Homo Sapiens
DREVAAAVW

SEQ ID NO: 1099952 - protein, 9 aa, Homo Sapiens
SLALSSEAL

SEQ ID NO: 1099953 - protein, 9 aa, Homo Sapiens
ISLLREWFM

SEQ ID NO: 1099954 - protein, 9 aa, Homo Sapiens
AYRRLLAAE

SEQ ID NO: 1099955 - protein, 9 aa, Homo Sapiens
AELYVVLND

SEQ ID NO: 1099956 - protein, 9 aa, Homo Sapiens
TAAVMTAAG

SEQ ID NO: 1099957 - protein, 9 aa, Homo Sapiens
LNLQKSSCF

SEQ ID NO: 1099958 - protein, 9 aa, Homo Sapiens
RPGLPSHVD

SEQ ID NO: 1099959 - protein, 9 aa, Homo Sapiens
GPCASLLST

SEQ ID NO: 1099960 - protein, 9 aa, Homo Sapiens
SINHFFVTP

SEQ ID NO: 1099961 - protein, 9 aa, Homo Sapiens
HIYTFIGEV

SEQ ID NO: 1099962 - protein, 9 aa, Homo Sapiens
RWGKKVGEK

SEQ ID NO: 1099963 - protein, 9 aa, Homo Sapiens
CNAAKKDPQ

SEQ ID NO: 1099964 - protein, 9 aa, Homo Sapiens
LADPALPVG

SEQ ID NO: 1099965 - protein, 9 aa, Homo Sapiens
VVLEVVVVH

SEQ ID NO: 1099966 - protein, 9 aa, Homo Sapiens
EGAEKEEEF

SEQ ID NO: 1099967 - protein, 9 aa, Homo Sapiens
TVPMYRYHR

SEQ ID NO: 1099968 - protein, 9 aa, Homo Sapiens
VDDPTGNVR

SEQ ID NO: 1099969 - protein, 9 aa, Homo Sapiens
KWRGDFEMD

SEQ ID NO: 1099970 - protein, 9 aa, Homo Sapiens
IDTVLLGAT

SEQ ID NO: 1099971 - protein, 9 aa, Homo Sapiens
TLQQVIHLL

SEQ ID NO: 1099972 - protein, 9 aa, Homo Sapiens
CGHLKPSGE

SEQ ID NO: 1099973 - protein, 9 aa, Homo Sapiens
FSSEENNLG

SEQ ID NO: 1099974 - protein, 9 aa, Homo Sapiens
LPPRGPRAP

SEQ ID NO: 1099975 - protein, 9 aa, Homo Sapiens
THKQNYMMN

SEQ ID NO: 1099976 - protein, 9 aa, Homo Sapiens
SRLGGPKRS

SEQ ID NO: 1099977 - protein, 9 aa, Homo Sapiens
QPPPQAPSQ

SEQ ID NO: 1099978 - protein, 9 aa, Homo Sapiens
CLDPAGPLG

SEQ ID NO: 1099979 - protein, 9 aa, Homo Sapiens
FRLDMPLYF

SEQ ID NO: 1099980 - protein, 9 aa, Homo Sapiens
LRKLKQMLN

SEQ ID NO: 1099981 - protein, 9 aa, Homo Sapiens
TRYVASGIT

SEQ ID NO: 1099982 - protein, 9 aa, Homo Sapiens
AGTRVLKLS

SEQ ID NO: 1099983 - protein, 9 aa, Homo Sapiens
PGCTQGMVR

SEQ ID NO: 1099984 - protein, 9 aa, Homo Sapiens
KCHRSLPCH

SEQ ID NO: 1099985 - protein, 9 aa, Homo Sapiens
TISAVSSAL

SEQ ID NO: 1099986 - protein, 9 aa, Homo Sapiens
PSGQRMVPE

SEQ ID NO: 1099987 - protein, 9 aa, Homo Sapiens
SPGANGILG

SEQ ID NO: 1099988 - protein, 9 aa, Homo Sapiens
PGVRALGKW

SEQ ID NO: 1099989 - protein, 9 aa, Homo Sapiens
SLRVALHSE

SEQ ID NO: 1099990 - protein, 9 aa, Homo Sapiens
FKKSKKSSH

SEQ ID NO: 1099991 - protein, 9 aa, Homo Sapiens
AGSSWTPGR

SEQ ID NO: 1099992 - protein, 9 aa, Homo Sapiens
GISKVGIHK

SEQ ID NO: 1099993 - protein, 9 aa, Homo Sapiens
SVPYMSPNR

SEQ ID NO: 1099994 - protein, 9 aa, Homo Sapiens
VPLQPPLPL

SEQ ID NO: 1099995 - protein, 9 aa, Homo Sapiens
LTLRHLMWM

SEQ ID NO: 1099996 - protein, 9 aa, Homo Sapiens
PEPEETWGV

SEQ ID NO: 1099997 - protein, 9 aa, Homo Sapiens
DAKGQTEEA

SEQ ID NO: 1099998 - protein, 9 aa, Homo Sapiens
LLLCFQRLL

SEQ ID NO: 1099999 - protein, 9 aa, Homo Sapiens
STDHPTSAS

SEQ ID NO: 1100000 - protein, 9 aa, Homo Sapiens
RARGAPALE

SEQ ID NO: 1100001 - protein, 9 aa, Homo Sapiens
PPTAPDAQA

SEQ ID NO: 1100002 - protein, 9 aa, Homo Sapiens
SLMKDDALS

SEQ ID NO: 1100003 - protein, 9 aa, Homo Sapiens
LKKCSLYGK

SEQ ID NO: 1100004 - protein, 9 aa, Homo Sapiens
VSCWLRYLT

SEQ ID NO: 1100005 - protein, 9 aa, Homo Sapiens
NGVPSMPLI

SEQ ID NO: 1100006 - protein, 9 aa, Homo Sapiens
AFRSLELCN

SEQ ID NO: 1100007 - protein, 9 aa, Homo Sapiens
ARQPSRPTG

SEQ ID NO: 1100008 - protein, 9 aa, Homo Sapiens
EIQNSLLPF

SEQ ID NO: 1100009 - protein, 9 aa, Homo Sapiens
PRVAQLLCL

SEQ ID NO: 1100010 - protein, 9 aa, Homo Sapiens
GNGTLIGTS

SEQ ID NO: 1100011 - protein, 9 aa, Homo Sapiens
ARGRSSAPK

SEQ ID NO: 1100012 - protein, 9 aa, Homo Sapiens
SCGAARPRR

SEQ ID NO: 1100013 - protein, 9 aa, Homo Sapiens
QDGARCPSC

SEQ ID NO: 1100014 - protein, 9 aa, Homo Sapiens
EVSPRGRSV

SEQ ID NO: 1100015 - protein, 9 aa, Homo Sapiens
RYVASGITV

SEQ ID NO: 1100016 - protein, 9 aa, Homo Sapiens
AEKNCLVPL

SEQ ID NO: 1100017 - protein, 9 aa, Homo Sapiens
PQTSGGVLW

SEQ ID NO: 1100018 - protein, 9 aa, Homo Sapiens
GSPPGCTQG

SEQ ID NO: 1100019 - protein, 9 aa, Homo Sapiens
VLALMQKHH

SEQ ID NO: 1100020 - protein, 9 aa, Homo Sapiens
TEPCKILFT

SEQ ID NO: 1100021 - protein, 9 aa, Homo Sapiens
LKMVTSTGL

SEQ ID NO: 1100022 - protein, 9 aa, Homo Sapiens
GVCGHLKPS

SEQ ID NO: 1100023 - protein, 9 aa, Homo Sapiens
PHEFWPDHF

SEQ ID NO: 1100024 - protein, 9 aa, Homo Sapiens
RGSIPPQHG

SEQ ID NO: 1100025 - protein, 9 aa, Homo Sapiens
TPRPRPVSM

SEQ ID NO: 1100026 - protein, 9 aa, Homo Sapiens
WQQQPVLVE

SEQ ID NO: 1100027 - protein, 9 aa, Homo Sapiens
LSNNLFSTL

SEQ ID NO: 1100028 - protein, 9 aa, Homo Sapiens
AMHRERNRN

SEQ ID NO: 1100029 - protein, 9 aa, Homo Sapiens
GWLPRLTRE

SEQ ID NO: 1100030 - protein, 9 aa, Homo Sapiens
QDGSLDRNL

SEQ ID NO: 1100031 - protein, 9 aa, Homo Sapiens
DSRRTFTKH

SEQ ID NO: 1100032 - protein, 9 aa, Homo Sapiens
EAVMLLRQL

SEQ ID NO: 1100033 - protein, 9 aa, Homo Sapiens
QHHHPRIPG

SEQ ID NO: 1100034 - protein, 9 aa, Homo Sapiens
SMWAHQAVL

SEQ ID NO: 1100035 - protein, 9 aa, Homo Sapiens
HGLLRQLGK

SEQ ID NO: 1100036 - protein, 9 aa, Homo Sapiens
LLAFKKSKK

SEQ ID NO: 1100037 - protein, 9 aa, Homo Sapiens
REKIINPTI

SEQ ID NO: 1100038 - protein, 9 aa, Homo Sapiens
LDPAGPLGA

SEQ ID NO: 1100039 - protein, 9 aa, Homo Sapiens
RILEGNPAV

SEQ ID NO: 1100040 - protein, 9 aa, Homo Sapiens
LSLEELQMQ

SEQ ID NO: 1100041 - protein, 9 aa, Homo Sapiens
DIIISDTKD

SEQ ID NO: 1100042 - protein, 9 aa, Homo Sapiens
QFKIKRHMP

SEQ ID NO: 1100043 - protein, 9 aa, Homo Sapiens
VQRASKTVD

SEQ ID NO: 1100044 - protein, 9 aa, Homo Sapiens
TEQVPQIDQ

SEQ ID NO: 1100045 - protein, 9 aa, Homo Sapiens
LWDVSVQVK

SEQ ID NO: 1100046 - protein, 9 aa, Homo Sapiens
YLCSSASSA

SEQ ID NO: 1100047 - protein, 9 aa, Homo Sapiens
TLWNPSRRW

SEQ ID NO: 1100048 - protein, 9 aa, Homo Sapiens
LSVTFCQQL

SEQ ID NO: 1100049 - protein, 9 aa, Homo Sapiens
IHSAGGRHT

SEQ ID NO: 1100050 - protein, 9 aa, Homo Sapiens
LTVMSADHY

SEQ ID NO: 1100051 - protein, 9 aa, Homo Sapiens
EIPPPAPAT

SEQ ID NO: 1100052 - protein, 9 aa, Homo Sapiens
PNLIQVGHF

SEQ ID NO: 1100053 - protein, 9 aa, Homo Sapiens
RLCISLLGA

SEQ ID NO: 1100054 - protein, 9 aa, Homo Sapiens
GLGIASTLP

SEQ ID NO: 1100055 - protein, 9 aa, Homo Sapiens
ETVQELTEF

SEQ ID NO: 1100056 - protein, 9 aa, Homo Sapiens
QIPGLLGSP

SEQ ID NO: 1100057 - protein, 9 aa, Homo Sapiens
GGGGDSATT

SEQ ID NO: 1100058 - protein, 9 aa, Homo Sapiens
EAEVRHRAL

SEQ ID NO: 1100059 - protein, 9 aa, Homo Sapiens
TLAWGILLM

SEQ ID NO: 1100060 - protein, 9 aa, Homo Sapiens
GKKRKWGAL

SEQ ID NO: 1100061 - protein, 9 aa, Homo Sapiens
AAPSAGAWP

SEQ ID NO: 1100062 - protein, 9 aa, Homo Sapiens
KENKWESRK

SEQ ID NO: 1100063 - protein, 9 aa, Homo Sapiens
HLALHSAAF

SEQ ID NO: 1100064 - protein, 9 aa, Homo Sapiens
KTRTESATR

SEQ ID NO: 1100065 - protein, 9 aa, Homo Sapiens
ENHQALAQA

SEQ ID NO: 1100066 - protein, 9 aa, Homo Sapiens
LFAMALERC

SEQ ID NO: 1100067 - protein, 9 aa, Homo Sapiens
VLRRVLPRV

SEQ ID NO: 1100068 - protein, 9 aa, Homo Sapiens
LDSSDPSKH

SEQ ID NO: 1100069 - protein, 9 aa, Homo Sapiens
QLVLPGEAD

SEQ ID NO: 1100070 - protein, 9 aa, Homo Sapiens
FLHHLYYQD

SEQ ID NO: 1100071 - protein, 9 aa, Homo Sapiens
APPGFFLRL

SEQ ID NO: 1100072 - protein, 9 aa, Homo Sapiens
EYTVERVLA

SEQ ID NO: 1100073 - protein, 9 aa, Homo Sapiens
RCSTTRDRN

SEQ ID NO: 1100074 - protein, 9 aa, Homo Sapiens
RLQHVLHAG

SEQ ID NO: 1100075 - protein, 9 aa, Homo Sapiens
GVRISSFPD

SEQ ID NO: 1100076 - protein, 9 aa, Homo Sapiens
IEDDFLDLN

SEQ ID NO: 1100077 - protein, 9 aa, Homo Sapiens
RCTQASVVT

SEQ ID NO: 1100078 - protein, 9 aa, Homo Sapiens
KARGAALQT

SEQ ID NO: 1100079 - protein, 9 aa, Homo Sapiens
VPALAPHPR

SEQ ID NO: 1100080 - protein, 9 aa, Homo Sapiens
HPIKVARYR

SEQ ID NO: 1100081 - protein, 9 aa, Homo Sapiens
KSKKSSHCL

SEQ ID NO: 1100082 - protein, 9 aa, Homo Sapiens
CLTHCTFWT

SEQ ID NO: 1100083 - protein, 9 aa, Homo Sapiens
DHSGDPAGV

SEQ ID NO: 1100084 - protein, 9 aa, Homo Sapiens
LAVRPPPSG

SEQ ID NO: 1100085 - protein, 9 aa, Homo Sapiens
PELFRKFRR

SEQ ID NO: 1100086 - protein, 9 aa, Homo Sapiens
LLSFWPGGY

SEQ ID NO: 1100087 - protein, 9 aa, Homo Sapiens
SPTTPSPAS

SEQ ID NO: 1100088 - protein, 9 aa, Homo Sapiens
ALVVGTALV

SEQ ID NO: 1100089 - protein, 9 aa, Homo Sapiens
PVTCYYNFT

SEQ ID NO: 1100090 - protein, 9 aa, Homo Sapiens
KGIVKLTQI

SEQ ID NO: 1100091 - protein, 9 aa, Homo Sapiens
RHSVPEAEA

SEQ ID NO: 1100092 - protein, 9 aa, Homo Sapiens
LNYAMSSSL

SEQ ID NO: 1100093 - protein, 9 aa, Homo Sapiens
GVILLFAGI

SEQ ID NO: 1100094 - protein, 9 aa, Homo Sapiens
KNKNGGNLQ

SEQ ID NO: 1100095 - protein, 9 aa, Homo Sapiens
GSEPQGPSA

SEQ ID NO: 1100096 - protein, 9 aa, Homo Sapiens
VIKMIDQGF

SEQ ID NO: 1100097 - protein, 9 aa, Homo Sapiens
QGSDRKKED

SEQ ID NO: 1100098 - protein, 9 aa, Homo Sapiens
PDLHLALGH

SEQ ID NO: 1100099 - protein, 9 aa, Homo Sapiens
TLNFEYTVE

SEQ ID NO: 1100100 - protein, 9 aa, Homo Sapiens
GNFNLLHGK

SEQ ID NO: 1100101 - protein, 9 aa, Homo Sapiens
CRDRVLLCC

SEQ ID NO: 1100102 - protein, 9 aa, Homo Sapiens
ISVIDLDTD

SEQ ID NO: 1100103 - protein, 9 aa, Homo Sapiens
SGVVILTGA

SEQ ID NO: 1100104 - protein, 9 aa, Homo Sapiens
VVFQVCVRP

SEQ ID NO: 1100105 - protein, 9 aa, Homo Sapiens
APSAGAWPR

SEQ ID NO: 1100106 - protein, 9 aa, Homo Sapiens
NTRVIVLGV

SEQ ID NO: 1100107 - protein, 9 aa, Homo Sapiens
KFTNMYIVY

SEQ ID NO: 1100108 - protein, 9 aa, Homo Sapiens
TPPKERPDL

SEQ ID NO: 1100109 - protein, 9 aa, Homo Sapiens
QIKENPPAS

SEQ ID NO: 1100110 - protein, 9 aa, Homo Sapiens
PVCLLVLGI

SEQ ID NO: 1100111 - protein, 9 aa, Homo Sapiens
RLTRHAGRK

SEQ ID NO: 1100112 - protein, 9 aa, Homo Sapiens
LRLIKINFI

SEQ ID NO: 1100113 - protein, 9 aa, Homo Sapiens
AAVSPPRGS

SEQ ID NO: 1100114 - protein, 9 aa, Homo Sapiens
SFTHCRPHW

SEQ ID NO: 1100115 - protein, 9 aa, Homo Sapiens
WTMSPFSKT

SEQ ID NO: 1100116 - protein, 9 aa, Homo Sapiens
HHDIDCQWV

SEQ ID NO: 1100117 - protein, 9 aa, Homo Sapiens
CPLQIILFF

SEQ ID NO: 1100118 - protein, 9 aa, Homo Sapiens
LFGYMQWVW

SEQ ID NO: 1100119 - protein, 9 aa, Homo Sapiens
VLIAMVDVI

SEQ ID NO: 1100120 - protein, 9 aa, Homo Sapiens
VMVKYNATV

SEQ ID NO: 1100121 - protein, 9 aa, Homo Sapiens
PVGDVGLGV

SEQ ID NO: 1100122 - protein, 9 aa, Homo Sapiens
PPPGGRAWA

SEQ ID NO: 1100123 - protein, 9 aa, Homo Sapiens
EEFHSTILQ

SEQ ID NO: 1100124 - protein, 9 aa, Homo Sapiens
VAQLLCLGV

SEQ ID NO: 1100125 - protein, 9 aa, Homo Sapiens
EHESVDQSR

SEQ ID NO: 1100126 - protein, 9 aa, Homo Sapiens
PGCSIRERW

SEQ ID NO: 1100127 - protein, 9 aa, Homo Sapiens
VLAKEEARH

SEQ ID NO: 1100128 - protein, 9 aa, Homo Sapiens
YPWALMNSW

SEQ ID NO: 1100129 - protein, 9 aa, Homo Sapiens
IAGRSKPAT

SEQ ID NO: 1100130 - protein, 9 aa, Homo Sapiens
HSLLALGGV

SEQ ID NO: 1100131 - protein, 9 aa, Homo Sapiens
SLAQLLPAD

SEQ ID NO: 1100132 - protein, 9 aa, Homo Sapiens
EIDLFQVRG

SEQ ID NO: 1100133 - protein, 9 aa, Homo Sapiens
GAREHICLR

SEQ ID NO: 1100134 - protein, 9 aa, Homo Sapiens
ESHLGFRLQ

SEQ ID NO: 1100135 - protein, 9 aa, Homo Sapiens
PPNWQPCTP

SEQ ID NO: 1100136 - protein, 9 aa, Homo Sapiens
LCCHRSSAL

SEQ ID NO: 1100137 - protein, 9 aa, Homo Sapiens
DCEGIGCCY

SEQ ID NO: 1100138 - protein, 9 aa, Homo Sapiens
KARVLNTPN

SEQ ID NO: 1100139 - protein, 9 aa, Homo Sapiens
MQANPHYAH

SEQ ID NO: 1100140 - protein, 9 aa, Homo Sapiens
ALFYQGPGW

SEQ ID NO: 1100141 - protein, 9 aa, Homo Sapiens
LTYRLCTVS

SEQ ID NO: 1100142 - protein, 9 aa, Homo Sapiens
GQSHTNGKN

SEQ ID NO: 1100143 - protein, 9 aa, Homo Sapiens
ELRRVEELQ

SEQ ID NO: 1100144 - protein, 9 aa, Homo Sapiens
DFKHHMSQN

SEQ ID NO: 1100145 - protein, 9 aa, Homo Sapiens
DPRSQKVGE

SEQ ID NO: 1100146 - protein, 9 aa, Homo Sapiens
ASKTVDFCN

SEQ ID NO: 1100147 - protein, 9 aa, Homo Sapiens
APATQAPCM

SEQ ID NO: 1100148 - protein, 9 aa, Homo Sapiens
EIQLCKEVE

SEQ ID NO: 1100149 - protein, 9 aa, Homo Sapiens
VGGTQEVEI

SEQ ID NO: 1100150 - protein, 9 aa, Homo Sapiens
KLPKNAQML

SEQ ID NO: 1100151 - protein, 9 aa, Homo Sapiens
AGVLSHLAL

SEQ ID NO: 1100152 - protein, 9 aa, Homo Sapiens
QALLINEET

SEQ ID NO: 1100153 - protein, 9 aa, Homo Sapiens
STFTTPKFA

SEQ ID NO: 1100154 - protein, 9 aa, Homo Sapiens
VWFGLVCFL

SEQ ID NO: 1100155 - protein, 9 aa, Homo Sapiens
GYPPHQQDP

SEQ ID NO: 1100156 - protein, 9 aa, Homo Sapiens
RHYHCSGIF

SEQ ID NO: 1100157 - protein, 9 aa, Homo Sapiens
GEPPGRGVP

SEQ ID NO: 1100158 - protein, 9 aa, Homo Sapiens
MTANSQELK

SEQ ID NO: 1100159 - protein, 9 aa, Homo Sapiens
QGQRVTVMC

SEQ ID NO: 1100160 - protein, 9 aa, Homo Sapiens
ARCVCVSVP

SEQ ID NO: 1100161 - protein, 9 aa, Homo Sapiens
QTGPLQRGS

SEQ ID NO: 1100162 - protein, 9 aa, Homo Sapiens
TGTSRTTAT

SEQ ID NO: 1100163 - protein, 9 aa, Homo Sapiens
PRIKWTKVW

SEQ ID NO: 1100164 - protein, 9 aa, Homo Sapiens
SQARTRAGL

SEQ ID NO: 1100165 - protein, 9 aa, Homo Sapiens
LRDHRCIGK

SEQ ID NO: 1100166 - protein, 9 aa, Homo Sapiens
KVEIRRRIR

SEQ ID NO: 1100167 - protein, 9 aa, Homo Sapiens
HCLQNTSLE

SEQ ID NO: 1100168 - protein, 9 aa, Homo Sapiens
VQPPAPGVH

SEQ ID NO: 1100169 - protein, 9 aa, Homo Sapiens
PMKICTEAP

SEQ ID NO: 1100170 - protein, 9 aa, Homo Sapiens
RSPASPAHS

SEQ ID NO: 1100171 - protein, 9 aa, Homo Sapiens
AALARGRSS

SEQ ID NO: 1100172 - protein, 9 aa, Homo Sapiens
WIRRLGEPE

SEQ ID NO: 1100173 - protein, 9 aa, Homo Sapiens
MALERCLSI

SEQ ID NO: 1100174 - protein, 9 aa, Homo Sapiens
QNANSVEKE

SEQ ID NO: 1100175 - protein, 9 aa, Homo Sapiens
PRIPGVAHS

SEQ ID NO: 1100176 - protein, 9 aa, Homo Sapiens
KIIDTKNLY

SEQ ID NO: 1100177 - protein, 9 aa, Homo Sapiens
LLVLAPALD

SEQ ID NO: 1100178 - protein, 9 aa, Homo Sapiens
GARPRGAVA

SEQ ID NO: 1100179 - protein, 9 aa, Homo Sapiens
WRAGFQWGE

SEQ ID NO: 1100180 - protein, 9 aa, Homo Sapiens
PDQRKPPNW

SEQ ID NO: 1100181 - protein, 9 aa, Homo Sapiens
AMVPVFVDP

SEQ ID NO: 1100182 - protein, 9 aa, Homo Sapiens
TCSPGWMAS

SEQ ID NO: 1100183 - protein, 9 aa, Homo Sapiens
LLDVAPVDM

SEQ ID NO: 1100184 - protein, 9 aa, Homo Sapiens
LLFSIRRWS

SEQ ID NO: 1100185 - protein, 9 aa, Homo Sapiens
LVQPGSLPL

SEQ ID NO: 1100186 - protein, 9 aa, Homo Sapiens
EMALRVAGA

SEQ ID NO: 1100187 - protein, 9 aa, Homo Sapiens
SPGNRGLPL

SEQ ID NO: 1100188 - protein, 9 aa, Homo Sapiens
EKMRICLLL

SEQ ID NO: 1100189 - protein, 9 aa, Homo Sapiens
SALPWGYRC

SEQ ID NO: 1100190 - protein, 9 aa, Homo Sapiens
PGVIGSPQR

SEQ ID NO: 1100191 - protein, 9 aa, Homo Sapiens
SQFQYGDPG

SEQ ID NO: 1100192 - protein, 9 aa, Homo Sapiens
LLSFPVLVS

SEQ ID NO: 1100193 - protein, 9 aa, Homo Sapiens
GGRHLTHLL

SEQ ID NO: 1100194 - protein, 9 aa, Homo Sapiens
GHGVWVGAQ

SEQ ID NO: 1100195 - protein, 9 aa, Homo Sapiens
IYHMGTFAQ

SEQ ID NO: 1100196 - protein, 9 aa, Homo Sapiens
EKPWDANAP

SEQ ID NO: 1100197 - protein, 9 aa, Homo Sapiens
LNLPGSTDH

SEQ ID NO: 1100198 - protein, 9 aa, Homo Sapiens
TAVLSPVNT

SEQ ID NO: 1100199 - protein, 9 aa, Homo Sapiens
WAAFVEASS

SEQ ID NO: 1100200 - protein, 9 aa, Homo Sapiens
KKEAQAAVP

SEQ ID NO: 1100201 - protein, 9 aa, Homo Sapiens
AAEYTFAFP

SEQ ID NO: 1100202 - protein, 9 aa, Homo Sapiens
MLSCPGTAC

SEQ ID NO: 1100203 - protein, 9 aa, Homo Sapiens
AHENYEKIT

SEQ ID NO: 1100204 - protein, 9 aa, Homo Sapiens
GGAQAARIR

SEQ ID NO: 1100205 - protein, 9 aa, Homo Sapiens
SGAISVPVS

SEQ ID NO: 1100206 - protein, 9 aa, Homo Sapiens
GLEYYPLLS

SEQ ID NO: 1100207 - protein, 9 aa, Homo Sapiens
VRPWRADDI

SEQ ID NO: 1100208 - protein, 9 aa, Homo Sapiens
FGDTVNTTS

SEQ ID NO: 1100209 - protein, 9 aa, Homo Sapiens
VTSRPCQLL

SEQ ID NO: 1100210 - protein, 9 aa, Homo Sapiens
LLRREPRRG

SEQ ID NO: 1100211 - protein, 9 aa, Homo Sapiens
LQTQQLKTA

SEQ ID NO: 1100212 - protein, 9 aa, Homo Sapiens
GLWSPTPRA

SEQ ID NO: 1100213 - protein, 9 aa, Homo Sapiens
LLVQPGSLP

SEQ ID NO: 1100214 - protein, 9 aa, Homo Sapiens
QHVLHAGSG

SEQ ID NO: 1100215 - protein, 9 aa, Homo Sapiens
QAPPWAAAS

SEQ ID NO: 1100216 - protein, 9 aa, Homo Sapiens
HIVFTKQPE

SEQ ID NO: 1100217 - protein, 9 aa, Homo Sapiens
VGTLFNGLT

SEQ ID NO: 1100218 - protein, 9 aa, Homo Sapiens
RRLYNERGK

SEQ ID NO: 1100219 - protein, 9 aa, Homo Sapiens
CAARASWWP

SEQ ID NO: 1100220 - protein, 9 aa, Homo Sapiens
LPVGRHPPV

SEQ ID NO: 1100221 - protein, 9 aa, Homo Sapiens
PPHLGQEPG

SEQ ID NO: 1100222 - protein, 9 aa, Homo Sapiens
TKEIDLFQV

SEQ ID NO: 1100223 - protein, 9 aa, Homo Sapiens
KETVSVQGP

SEQ ID NO: 1100224 - protein, 9 aa, Homo Sapiens
GNMFSQTTI

SEQ ID NO: 1100225 - protein, 9 aa, Homo Sapiens
SITLWNPSR

SEQ ID NO: 1100226 - protein, 9 aa, Homo Sapiens
AAAAGVAAA

SEQ ID NO: 1100227 - protein, 9 aa, Homo Sapiens
ETMEFPEGT

SEQ ID NO: 1100228 - protein, 9 aa, Homo Sapiens
RVPHQVQGR

SEQ ID NO: 1100229 - protein, 9 aa, Homo Sapiens
PRNGQEVAV

SEQ ID NO: 1100230 - protein, 9 aa, Homo Sapiens
RAPRASCAS

SEQ ID NO: 1100231 - protein, 9 aa, Homo Sapiens
EALRLVLML

SEQ ID NO: 1100232 - protein, 9 aa, Homo Sapiens
LFFSSVISD

SEQ ID NO: 1100233 - protein, 9 aa, Homo Sapiens
FCLVFFFFV

SEQ ID NO: 1100234 - protein, 9 aa, Homo Sapiens
SFLHHLYYQ

SEQ ID NO: 1100235 - protein, 9 aa, Homo Sapiens
AGSRRCCRV

SEQ ID NO: 1100236 - protein, 9 aa, Homo Sapiens
SLFYIFILS

SEQ ID NO: 1100237 - protein, 9 aa, Homo Sapiens
TAAASMDHS

SEQ ID NO: 1100238 - protein, 9 aa, Homo Sapiens
ANSVEKEKK

SEQ ID NO: 1100239 - protein, 9 aa, Homo Sapiens
AQATTPLDS

SEQ ID NO: 1100240 - protein, 9 aa, Homo Sapiens
KKASSPGHP

SEQ ID NO: 1100241 - protein, 9 aa, Homo Sapiens
SLFLHHLHC

SEQ ID NO: 1100242 - protein, 9 aa, Homo Sapiens
SPPFIITNV

SEQ ID NO: 1100243 - protein, 9 aa, Homo Sapiens
RSLGALSLR

SEQ ID NO: 1100244 - protein, 9 aa, Homo Sapiens
VTERREMRE

SEQ ID NO: 1100245 - protein, 9 aa, Homo Sapiens
MRHGYGVHQ

SEQ ID NO: 1100246 - protein, 9 aa, Homo Sapiens
APPYSFRIT

SEQ ID NO: 1100247 - protein, 9 aa, Homo Sapiens
VVVDAFNQA

SEQ ID NO: 1100248 - protein, 9 aa, Homo Sapiens
LAGAHAAGP

SEQ ID NO: 1100249 - protein, 9 aa, Homo Sapiens
PSAPAAAPP

SEQ ID NO: 1100250 - protein, 9 aa, Homo Sapiens
PGERGPAGT

SEQ ID NO: 1100251 - protein, 9 aa, Homo Sapiens
PTGNVRSGP

SEQ ID NO: 1100252 - protein, 9 aa, Homo Sapiens
GEAGDGKAS

SEQ ID NO: 1100253 - protein, 9 aa, Homo Sapiens
PRGGHPQPR

SEQ ID NO: 1100254 - protein, 9 aa, Homo Sapiens
SCSSLNAKP

SEQ ID NO: 1100255 - protein, 9 aa, Homo Sapiens
LHSEPADNS

SEQ ID NO: 1100256 - protein, 9 aa, Homo Sapiens
ASRSLGALS

SEQ ID NO: 1100257 - protein, 9 aa, Homo Sapiens
WTAKCHRSL

SEQ ID NO: 1100258 - protein, 9 aa, Homo Sapiens
PPAGAVVWP

SEQ ID NO: 1100259 - protein, 9 aa, Homo Sapiens
ATRSTRSPP

SEQ ID NO: 1100260 - protein, 9 aa, Homo Sapiens
FRVQAVQPI

SEQ ID NO: 1100261 - protein, 9 aa, Homo Sapiens
KGELLNPMG

SEQ ID NO: 1100262 - protein, 9 aa, Homo Sapiens
GCTLAELRI

SEQ ID NO: 1100263 - protein, 9 aa, Homo Sapiens
MAYAEQNGA

SEQ ID NO: 1100264 - protein, 9 aa, Homo Sapiens
EARRHGKAE

SEQ ID NO: 1100265 - protein, 9 aa, Homo Sapiens
QNGATLAED

SEQ ID NO: 1100266 - protein, 9 aa, Homo Sapiens
SWWPSRRWT

SEQ ID NO: 1100267 - protein, 9 aa, Homo Sapiens
LLTYVGTLF

SEQ ID NO: 1100268 - protein, 9 aa, Homo Sapiens
WTPRIELTR

SEQ ID NO: 1100269 - protein, 9 aa, Homo Sapiens
SVQGPGILP

SEQ ID NO: 1100270 - protein, 9 aa, Homo Sapiens
PGWMASPAR

SEQ ID NO: 1100271 - protein, 9 aa, Homo Sapiens
FSCHFTACE

SEQ ID NO: 1100272 - protein, 9 aa, Homo Sapiens
VDGERSFRG

SEQ ID NO: 1100273 - protein, 9 aa, Homo Sapiens
PTPRPRPVS

SEQ ID NO: 1100274 - protein, 9 aa, Homo Sapiens
TVHERCVAQ

SEQ ID NO: 1100275 - protein, 9 aa, Homo Sapiens
PGPFCMSST

SEQ ID NO: 1100276 - protein, 9 aa, Homo Sapiens
GNRGLPLPP

SEQ ID NO: 1100277 - protein, 9 aa, Homo Sapiens
ILGCDRCDA

SEQ ID NO: 1100278 - protein, 9 aa, Homo Sapiens
ANPHYAHVI

SEQ ID NO: 1100279 - protein, 9 aa, Homo Sapiens
MDHSSVVQC

SEQ ID NO: 1100280 - protein, 9 aa, Homo Sapiens
GKKMDLDGM

SEQ ID NO: 1100281 - protein, 9 aa, Homo Sapiens
ASRTKQRAW

SEQ ID NO: 1100282 - protein, 9 aa, Homo Sapiens
TCAQLPPAF

SEQ ID NO: 1100283 - protein, 9 aa, Homo Sapiens
ARFTRSGGN

SEQ ID NO: 1100284 - protein, 9 aa, Homo Sapiens
DNISQLTRM

SEQ ID NO: 1100285 - protein, 9 aa, Homo Sapiens
EEDDDQPPK

SEQ ID NO: 1100286 - protein, 9 aa, Homo Sapiens
QNPEKLALK

SEQ ID NO: 1100287 - protein, 9 aa, Homo Sapiens
QNGVLDFFS

SEQ ID NO: 1100288 - protein, 9 aa, Homo Sapiens
LCPQLDKMV

SEQ ID NO: 1100289 - protein, 9 aa, Homo Sapiens
VLLCCPSWS

SEQ ID NO: 1100290 - protein, 9 aa, Homo Sapiens
KKRKQLLSF

SEQ ID NO: 1100291 - protein, 9 aa, Homo Sapiens
LQPVTSKDF

SEQ ID NO: 1100292 - protein, 9 aa, Homo Sapiens
GLCSGERFG

SEQ ID NO: 1100293 - protein, 9 aa, Homo Sapiens
DHSSVVQCL

SEQ ID NO: 1100294 - protein, 9 aa, Homo Sapiens
LAMGVGAKV

SEQ ID NO: 1100295 - protein, 9 aa, Homo Sapiens
TWTTSSRLA

SEQ ID NO: 1100296 - protein, 9 aa, Homo Sapiens
APPPPLLFL

SEQ ID NO: 1100297 - protein, 9 aa, Homo Sapiens
PAQRPRTPA

SEQ ID NO: 1100298 - protein, 9 aa, Homo Sapiens
EAHRVRRHH

SEQ ID NO: 1100299 - protein, 9 aa, Homo Sapiens
APWAKVVRA

SEQ ID NO: 1100300 - protein, 9 aa, Homo Sapiens
LPVLVQDAA

SEQ ID NO: 1100301 - protein, 9 aa, Homo Sapiens
SDREKVICS

SEQ ID NO: 1100302 - protein, 9 aa, Homo Sapiens
PSLVLTLGQ

SEQ ID NO: 1100303 - protein, 9 aa, Homo Sapiens
RSPSGQRMV

SEQ ID NO: 1100304 - protein, 9 aa, Homo Sapiens
PRPRCRPAV

SEQ ID NO: 1100305 - protein, 9 aa, Homo Sapiens
ENFEELFKV

SEQ ID NO: 1100306 - protein, 9 aa, Homo Sapiens
LSQLHHGGR

SEQ ID NO: 1100307 - protein, 9 aa, Homo Sapiens
IFIMAFGVQ

SEQ ID NO: 1100308 - protein, 9 aa, Homo Sapiens
DAALARGRS

SEQ ID NO: 1100309 - protein, 9 aa, Homo Sapiens
CFVWKQATV

SEQ ID NO: 1100310 - protein, 9 aa, Homo Sapiens
SALQGKVLL

SEQ ID NO: 1100311 - protein, 9 aa, Homo Sapiens
PARQPSRPT

SEQ ID NO: 1100312 - protein, 9 aa, Homo Sapiens
CGRHFHQST

SEQ ID NO: 1100313 - protein, 9 aa, Homo Sapiens
WELIPTRSE

SEQ ID NO: 1100314 - protein, 9 aa, Homo Sapiens
GTGLEGCRP

SEQ ID NO: 1100315 - protein, 9 aa, Homo Sapiens
PGCRGLGPV

SEQ ID NO: 1100316 - protein, 9 aa, Homo Sapiens
SAPPIRRVS

SEQ ID NO: 1100317 - protein, 9 aa, Homo Sapiens
AILLYVLIL

SEQ ID NO: 1100318 - protein, 9 aa, Homo Sapiens
QKCTIYLNI

SEQ ID NO: 1100319 - protein, 9 aa, Homo Sapiens
YGKPVDWWV

SEQ ID NO: 1100320 - protein, 9 aa, Homo Sapiens
AGEEEEEEA

SEQ ID NO: 1100321 - protein, 9 aa, Homo Sapiens
TYKEVTPYR

SEQ ID NO: 1100322 - protein, 9 aa, Homo Sapiens
VDQSRRAQA

SEQ ID NO: 1100323 - protein, 9 aa, Homo Sapiens
SRKGVHQAW

SEQ ID NO: 1100324 - protein, 9 aa, Homo Sapiens
NRNMRALFA

SEQ ID NO: 1100325 - protein, 9 aa, Homo Sapiens
YNDFSFMTH

SEQ ID NO: 1100326 - protein, 9 aa, Homo Sapiens
TWEWEMALR

SEQ ID NO: 1100327 - protein, 9 aa, Homo Sapiens
EFHPWGHHP

SEQ ID NO: 1100328 - protein, 9 aa, Homo Sapiens
AIPSDTTLE

SEQ ID NO: 1100329 - protein, 9 aa, Homo Sapiens
YVRILAFLQ

SEQ ID NO: 1100330 - protein, 9 aa, Homo Sapiens
TRKETPLAP

SEQ ID NO: 1100331 - protein, 9 aa, Homo Sapiens
TASICNSSP

SEQ ID NO: 1100332 - protein, 9 aa, Homo Sapiens
NGIHKDMIA

SEQ ID NO: 1100333 - protein, 9 aa, Homo Sapiens
IGLPWPFPG

SEQ ID NO: 1100334 - protein, 9 aa, Homo Sapiens
AVSPPRGSQ

SEQ ID NO: 1100335 - protein, 9 aa, Homo Sapiens
YIVGGVSTS

SEQ ID NO: 1100336 - protein, 9 aa, Homo Sapiens
KACKVARRH

SEQ ID NO: 1100337 - protein, 9 aa, Homo Sapiens
STCVPGIPD

SEQ ID NO: 1100338 - protein, 9 aa, Homo Sapiens
DKETVSVQG

SEQ ID NO: 1100339 - protein, 9 aa, Homo Sapiens
RRWDRGDAW

SEQ ID NO: 1100340 - protein, 9 aa, Homo Sapiens
PVWRACLPD

SEQ ID NO: 1100341 - protein, 9 aa, Homo Sapiens
SMLNDIVAV

SEQ ID NO: 1100342 - protein, 9 aa, Homo Sapiens
YQHIHFFLA

SEQ ID NO: 1100343 - protein, 9 aa, Homo Sapiens
ICQQQRKEQ

SEQ ID NO: 1100344 - protein, 9 aa, Homo Sapiens
YKEVTPYRR

SEQ ID NO: 1100345 - protein, 9 aa, Homo Sapiens
CSAESNRGV

SEQ ID NO: 1100346 - protein, 9 aa, Homo Sapiens
RQPSRPTGR

SEQ ID NO: 1100347 - protein, 9 aa, Homo Sapiens
MRVLLDSLP

SEQ ID NO: 1100348 - protein, 9 aa, Homo Sapiens
TSMWAHQAV

SEQ ID NO: 1100349 - protein, 9 aa, Homo Sapiens
GFTSRAGHV

SEQ ID NO: 1100350 - protein, 9 aa, Homo Sapiens
LPPAPAPWL

SEQ ID NO: 1100351 - protein, 9 aa, Homo Sapiens
CQCDKKKEA

SEQ ID NO: 1100352 - protein, 9 aa, Homo Sapiens
PRDSPSARW

SEQ ID NO: 1100353 - protein, 9 aa, Homo Sapiens
PPPQAPSQV

SEQ ID NO: 1100354 - protein, 9 aa, Homo Sapiens
VTCSRPCCR

SEQ ID NO: 1100355 - protein, 9 aa, Homo Sapiens
GSGVVILTG

SEQ ID NO: 1100356 - protein, 9 aa, Homo Sapiens
SVLGGCPEA

SEQ ID NO: 1100357 - protein, 9 aa, Homo Sapiens
VPGSPPGCT

SEQ ID NO: 1100358 - protein, 9 aa, Homo Sapiens
WLPVKWTAP

SEQ ID NO: 1100359 - protein, 9 aa, Homo Sapiens
GLIPIKSYV

SEQ ID NO: 1100360 - protein, 9 aa, Homo Sapiens
MESYFRLDM

SEQ ID NO: 1100361 - protein, 9 aa, Homo Sapiens
LKIPIGAKF

SEQ ID NO: 1100362 - protein, 9 aa, Homo Sapiens
SFSSQTSLP

SEQ ID NO: 1100363 - protein, 9 aa, Homo Sapiens
WLSYELQSV

SEQ ID NO: 1100364 - protein, 9 aa, Homo Sapiens
PTRARGAPA

SEQ ID NO: 1100365 - protein, 9 aa, Homo Sapiens
ALERAVRRC

SEQ ID NO: 1100366 - protein, 9 aa, Homo Sapiens
LNPAAQDGA

SEQ ID NO: 1100367 - protein, 9 aa, Homo Sapiens
CSPTTPSPA

SEQ ID NO: 1100368 - protein, 9 aa, Homo Sapiens
SGGNERYFF

SEQ ID NO: 1100369 - protein, 9 aa, Homo Sapiens
EDKGTEGED

SEQ ID NO: 1100370 - protein, 9 aa, Homo Sapiens
VSIAQDDTG

SEQ ID NO: 1100371 - protein, 9 aa, Homo Sapiens
IIVAITPLL

SEQ ID NO: 1100372 - protein, 9 aa, Homo Sapiens
RRGSSPPGR

SEQ ID NO: 1100373 - protein, 9 aa, Homo Sapiens
RVIVLGVGV

SEQ ID NO: 1100374 - protein, 9 aa, Homo Sapiens
LEMDGEQPS

SEQ ID NO: 1100375 - protein, 9 aa, Homo Sapiens
VRAEVFLGL

SEQ ID NO: 1100376 - protein, 9 aa, Homo Sapiens
TVLQEAVAE

SEQ ID NO: 1100377 - protein, 9 aa, Homo Sapiens
IMSELKMVT

SEQ ID NO: 1100378 - protein, 9 aa, Homo Sapiens
ESALLSPAS

SEQ ID NO: 1100379 - protein, 9 aa, Homo Sapiens
HSMAAQILK

SEQ ID NO: 1100380 - protein, 9 aa, Homo Sapiens
SLPKAIMTS

SEQ ID NO: 1100381 - protein, 9 aa, Homo Sapiens
CKQILEELE

SEQ ID NO: 1100382 - protein, 9 aa, Homo Sapiens
LQQKWNDMK

SEQ ID NO: 1100383 - protein, 9 aa, Homo Sapiens
NRLHCLQNT

SEQ ID NO: 1100384 - protein, 9 aa, Homo Sapiens
VGIVQCAHL

SEQ ID NO: 1100385 - protein, 9 aa, Homo Sapiens
SQAMLYNCR

SEQ ID NO: 1100386 - protein, 9 aa, Homo Sapiens
RWVLRKRPS

SEQ ID NO: 1100387 - protein, 9 aa, Homo Sapiens
DANIHELAW

SEQ ID NO: 1100388 - protein, 9 aa, Homo Sapiens
PALAPHPRP

SEQ ID NO: 1100389 - protein, 9 aa, Homo Sapiens
CNLSLYLDR

SEQ ID NO: 1100390 - protein, 9 aa, Homo Sapiens
PNLPMRNTG

SEQ ID NO: 1100391 - protein, 9 aa, Homo Sapiens
RCVAQAPPS

SEQ ID NO: 1100392 - protein, 9 aa, Homo Sapiens
NSSVIPHLF

SEQ ID NO: 1100393 - protein, 9 aa, Homo Sapiens
PYTQASLGL

SEQ ID NO: 1100394 - protein, 9 aa, Homo Sapiens
QGGGGLLQP

SEQ ID NO: 1100395 - protein, 9 aa, Homo Sapiens
DLDLILYLV

SEQ ID NO: 1100396 - protein, 9 aa, Homo Sapiens
VQQALHSGQ

SEQ ID NO: 1100397 - protein, 9 aa, Homo Sapiens
PVEPLLVRH

SEQ ID NO: 1100398 - protein, 9 aa, Homo Sapiens
HSPICRTTM

SEQ ID NO: 1100399 - protein, 9 aa, Homo Sapiens
NYSCIVENP

SEQ ID NO: 1100400 - protein, 9 aa, Homo Sapiens
LQRLQHVLH

SEQ ID NO: 1100401 - protein, 9 aa, Homo Sapiens
QLVFGIEAV

SEQ ID NO: 1100402 - protein, 9 aa, Homo Sapiens
EYALDLRSQ

SEQ ID NO: 1100403 - protein, 9 aa, Homo Sapiens
IVLGVGVFL

SEQ ID NO: 1100404 - protein, 9 aa, Homo Sapiens
VMGIILYEF

SEQ ID NO: 1100405 - protein, 9 aa, Homo Sapiens
SEIQLCKEV

SEQ ID NO: 1100406 - protein, 9 aa, Homo Sapiens
LTWSRSSFT

SEQ ID NO: 1100407 - protein, 9 aa, Homo Sapiens
PRGARRVPS

SEQ ID NO: 1100408 - protein, 9 aa, Homo Sapiens
NSRKFGWQM

SEQ ID NO: 1100409 - protein, 9 aa, Homo Sapiens
FMACFLPQR

SEQ ID NO: 1100410 - protein, 9 aa, Homo Sapiens
ARAHLAVEA

SEQ ID NO: 1100411 - protein, 9 aa, Homo Sapiens
RINWFLPGG

SEQ ID NO: 1100412 - protein, 9 aa, Homo Sapiens
RQGHGTCTS

SEQ ID NO: 1100413 - protein, 9 aa, Homo Sapiens
QIILFFFLF

SEQ ID NO: 1100414 - protein, 9 aa, Homo Sapiens
YGGPASSSL

SEQ ID NO: 1100415 - protein, 9 aa, Homo Sapiens
TLTSAASSA

SEQ ID NO: 1100416 - protein, 9 aa, Homo Sapiens
PGACRPACT

SEQ ID NO: 1100417 - protein, 9 aa, Homo Sapiens
ASPPARSWS

SEQ ID NO: 1100418 - protein, 9 aa, Homo Sapiens
ILGTPGIPG

SEQ ID NO: 1100419 - protein, 9 aa, Homo Sapiens
VYTALGYME

SEQ ID NO: 1100420 - protein, 9 aa, Homo Sapiens
VTLFALSGA

SEQ ID NO: 1100421 - protein, 9 aa, Homo Sapiens
QPPAPGVHP

SEQ ID NO: 1100422 - protein, 9 aa, Homo Sapiens
VTVTHLRPV

SEQ ID NO: 1100423 - protein, 9 aa, Homo Sapiens
TYDVPRGVQ

SEQ ID NO: 1100424 - protein, 9 aa, Homo Sapiens
THSLGGGDW

SEQ ID NO: 1100425 - protein, 9 aa, Homo Sapiens
LAAEYTFAF

SEQ ID NO: 1100426 - protein, 9 aa, Homo Sapiens
GTACSRGTW

SEQ ID NO: 1100427 - protein, 9 aa, Homo Sapiens
FLLFTEHFH

SEQ ID NO: 1100428 - protein, 9 aa, Homo Sapiens
NFNLLHGKT

SEQ ID NO: 1100429 - protein, 9 aa, Homo Sapiens
VSLKCLWEK

SEQ ID NO: 1100430 - protein, 9 aa, Homo Sapiens
QLMRTRPPA

SEQ ID NO: 1100431 - protein, 9 aa, Homo Sapiens
GEKGNSGRP

SEQ ID NO: 1100432 - protein, 9 aa, Homo Sapiens
LPQGLLAED

SEQ ID NO: 1100433 - protein, 9 aa, Homo Sapiens
YAHHAQEKY

SEQ ID NO: 1100434 - protein, 9 aa, Homo Sapiens
VPHQVQGRG

SEQ ID NO: 1100435 - protein, 9 aa, Homo Sapiens
NGKISGVNT

SEQ ID NO: 1100436 - protein, 9 aa, Homo Sapiens
FALAMGVGA

SEQ ID NO: 1100437 - protein, 9 aa, Homo Sapiens
RHMPLSKLM

SEQ ID NO: 1100438 - protein, 9 aa, Homo Sapiens
SAEGLPRPW

SEQ ID NO: 1100439 - protein, 9 aa, Homo Sapiens
HQDHQVSAG

SEQ ID NO: 1100440 - protein, 9 aa, Homo Sapiens
PEPAGGQRS

SEQ ID NO: 1100441 - protein, 9 aa, Homo Sapiens
PPSTLLSTP

SEQ ID NO: 1100442 - protein, 9 aa, Homo Sapiens
MTGLVLVFL

SEQ ID NO: 1100443 - protein, 9 aa, Homo Sapiens
YNATMDERW

SEQ ID NO: 1100444 - protein, 9 aa, Homo Sapiens
LLLDLITFL

SEQ ID NO: 1100445 - protein, 9 aa, Homo Sapiens
GQRRATLGP

SEQ ID NO: 1100446 - protein, 9 aa, Homo Sapiens
QVLHKACKV

SEQ ID NO: 1100447 - protein, 9 aa, Homo Sapiens
ERWHIRSSG

SEQ ID NO: 1100448 - protein, 9 aa, Homo Sapiens
WAHQAVLPA

SEQ ID NO: 1100449 - protein, 9 aa, Homo Sapiens
VAQAPPSCI

SEQ ID NO: 1100450 - protein, 9 aa, Homo Sapiens
DNLRKVVMK

SEQ ID NO: 1100451 - protein, 9 aa, Homo Sapiens
LRFSELSLV

SEQ ID NO: 1100452 - protein, 9 aa, Homo Sapiens
RAPGKTLPD

SEQ ID NO: 1100453 - protein, 9 aa, Homo Sapiens
SEGRRPDSN

SEQ ID NO: 1100454 - protein, 9 aa, Homo Sapiens
ADKALAPAD

SEQ ID NO: 1100455 - protein, 9 aa, Homo Sapiens
LPWVFSFLL

SEQ ID NO: 1100456 - protein, 9 aa, Homo Sapiens
QEEEAEEDL

SEQ ID NO: 1100457 - protein, 9 aa, Homo Sapiens
AALSEGRRP

SEQ ID NO: 1100458 - protein, 9 aa, Homo Sapiens
TAVMGDFGL

SEQ ID NO: 1100459 - protein, 9 aa, Homo Sapiens
QVVFQVCVR

SEQ ID NO: 1100460 - protein, 9 aa, Homo Sapiens
PGLPSHVDF

SEQ ID NO: 1100461 - protein, 9 aa, Homo Sapiens
SSHQSAPPI

SEQ ID NO: 1100462 - protein, 9 aa, Homo Sapiens
WIIPANVWM

SEQ ID NO: 1100463 - protein, 9 aa, Homo Sapiens
MASRTCSQG

SEQ ID NO: 1100464 - protein, 9 aa, Homo Sapiens
CEGDQHVTG

SEQ ID NO: 1100465 - protein, 9 aa, Homo Sapiens
NEETRVSVV

SEQ ID NO: 1100466 - protein, 9 aa, Homo Sapiens
VAAEHQDQG

SEQ ID NO: 1100467 - protein, 9 aa, Homo Sapiens
AGAHAAGPA

SEQ ID NO: 1100468 - protein, 9 aa, Homo Sapiens
PTLAPPETP

SEQ ID NO: 1100469 - protein, 9 aa, Homo Sapiens
NIMSELKMV

SEQ ID NO: 1100470 - protein, 9 aa, Homo Sapiens
KADTGLDDN

SEQ ID NO: 1100471 - protein, 9 aa, Homo Sapiens
IEAVEVVRI

SEQ ID NO: 1100472 - protein, 9 aa, Homo Sapiens
LGPLRGWRA

SEQ ID NO: 1100473 - protein, 9 aa, Homo Sapiens
SGQPNTQSE

SEQ ID NO: 1100474 - protein, 9 aa, Homo Sapiens
TTVSHNGSY

SEQ ID NO: 1100475 - protein, 9 aa, Homo Sapiens
TGPALLSVC

SEQ ID NO: 1100476 - protein, 9 aa, Homo Sapiens
SQKRNTEAM

SEQ ID NO: 1100477 - protein, 9 aa, Homo Sapiens
LAPAHHSGS

SEQ ID NO: 1100478 - protein, 9 aa, Homo Sapiens
ARHPHKYRV

SEQ ID NO: 1100479 - protein, 9 aa, Homo Sapiens
RPPSTLLST

SEQ ID NO: 1100480 - protein, 9 aa, Homo Sapiens
TSLSVSLLG

SEQ ID NO: 1100481 - protein, 9 aa, Homo Sapiens
VLQEAVAES

SEQ ID NO: 1100482 - protein, 9 aa, Homo Sapiens
LLSVCKFTE

SEQ ID NO: 1100483 - protein, 9 aa, Homo Sapiens
QLFGYYSAS

SEQ ID NO: 1100484 - protein, 9 aa, Homo Sapiens
RLRLRSDLL

SEQ ID NO: 1100485 - protein, 9 aa, Homo Sapiens
PCPSAARAG

SEQ ID NO: 1100486 - protein, 9 aa, Homo Sapiens
SLPWVFSFL

SEQ ID NO: 1100487 - protein, 9 aa, Homo Sapiens
RTLYTWNNG

SEQ ID NO: 1100488 - protein, 9 aa, Homo Sapiens
SVMSCSLLT

SEQ ID NO: 1100489 - protein, 9 aa, Homo Sapiens
MHVDATVFT

SEQ ID NO: 1100490 - protein, 9 aa, Homo Sapiens
VEYIGRKKS

SEQ ID NO: 1100491 - protein, 9 aa, Homo Sapiens
QSKYGGSVR

SEQ ID NO: 1100492 - protein, 9 aa, Homo Sapiens
RPILASYPP

SEQ ID NO: 1100493 - protein, 9 aa, Homo Sapiens
GVAGSLLPA

SEQ ID NO: 1100494 - protein, 9 aa, Homo Sapiens
WAAAAAGVA

SEQ ID NO: 1100495 - protein, 9 aa, Homo Sapiens
VVILTGAHR

SEQ ID NO: 1100496 - protein, 9 aa, Homo Sapiens
AARASWWPS

SEQ ID NO: 1100497 - protein, 9 aa, Homo Sapiens
MATPSWVWC

SEQ ID NO: 1100498 - protein, 9 aa, Homo Sapiens
GEDSGDDSD

SEQ ID NO: 1100499 - protein, 9 aa, Homo Sapiens
ASPGNRGLP

SEQ ID NO: 1100500 - protein, 9 aa, Homo Sapiens
VSLQERGGV

SEQ ID NO: 1100501 - protein, 9 aa, Homo Sapiens
PGTCTNITM

SEQ ID NO: 1100502 - protein, 9 aa, Homo Sapiens
DGRDTKAPV

SEQ ID NO: 1100503 - protein, 9 aa, Homo Sapiens
TMETHRLIH

SEQ ID NO: 1100504 - protein, 9 aa, Homo Sapiens
WAPMRSKRK

SEQ ID NO: 1100505 - protein, 9 aa, Homo Sapiens
EGIGCCYSS

SEQ ID NO: 1100506 - protein, 9 aa, Homo Sapiens
RPPGPHRPE

SEQ ID NO: 1100507 - protein, 9 aa, Homo Sapiens
LRKATTPIF

SEQ ID NO: 1100508 - protein, 9 aa, Homo Sapiens
PSRAASLLF

SEQ ID NO: 1100509 - protein, 9 aa, Homo Sapiens
WRGDFEMDV

SEQ ID NO: 1100510 - protein, 9 aa, Homo Sapiens
DVPQAIKLA

SEQ ID NO: 1100511 - protein, 9 aa, Homo Sapiens
KEEKQAAKN

SEQ ID NO: 1100512 - protein, 9 aa, Homo Sapiens
ALWTAGSLV

SEQ ID NO: 1100513 - protein, 9 aa, Homo Sapiens
ETSLSVSLL

SEQ ID NO: 1100514 - protein, 9 aa, Homo Sapiens
SRLCISLLG

SEQ ID NO: 1100515 - protein, 9 aa, Homo Sapiens
ESFLFYVLT

SEQ ID NO: 1100516 - protein, 9 aa, Homo Sapiens
KPPNWQPCT

SEQ ID NO: 1100517 - protein, 9 aa, Homo Sapiens
VDSSSYHPF

SEQ ID NO: 1100518 - protein, 9 aa, Homo Sapiens
LSDLLCNPK

SEQ ID NO: 1100519 - protein, 9 aa, Homo Sapiens
LELGITQCK

SEQ ID NO: 1100520 - protein, 9 aa, Homo Sapiens
VLLRPARCG

SEQ ID NO: 1100521 - protein, 9 aa, Homo Sapiens
TLNMIKSTP

SEQ ID NO: 1100522 - protein, 9 aa, Homo Sapiens
ELAWKTEGY

SEQ ID NO: 1100523 - protein, 9 aa, Homo Sapiens
TMDERWYTP

SEQ ID NO: 1100524 - protein, 9 aa, Homo Sapiens
MEVSPRGRS

SEQ ID NO: 1100525 - protein, 9 aa, Homo Sapiens
SVTTMRDFR

SEQ ID NO: 1100526 - protein, 9 aa, Homo Sapiens
WATIRLRSS

SEQ ID NO: 1100527 - protein, 9 aa, Homo Sapiens
CGSAARKSI

SEQ ID NO: 1100528 - protein, 9 aa, Homo Sapiens
LISREQHFY

SEQ ID NO: 1100529 - protein, 9 aa, Homo Sapiens
FQVDFGNRK

SEQ ID NO: 1100530 - protein, 9 aa, Homo Sapiens
QHTHCVQAL

SEQ ID NO: 1100531 - protein, 9 aa, Homo Sapiens
EKATFMPRR

SEQ ID NO: 1100532 - protein, 9 aa, Homo Sapiens
VRRCTQASV

SEQ ID NO: 1100533 - protein, 9 aa, Homo Sapiens
SDVARPLLE

SEQ ID NO: 1100534 - protein, 9 aa, Homo Sapiens
LDVFLHFLS

SEQ ID NO: 1100535 - protein, 9 aa, Homo Sapiens
ASLMILVIT

SEQ ID NO: 1100536 - protein, 9 aa, Homo Sapiens
SVLSFTTAN

SEQ ID NO: 1100537 - protein, 9 aa, Homo Sapiens
TSPGRGRER

SEQ ID NO: 1100538 - protein, 9 aa, Homo Sapiens
VKAPRNLGT

SEQ ID NO: 1100539 - protein, 9 aa, Homo Sapiens
GNSDNLRKV

SEQ ID NO: 1100540 - protein, 9 aa, Homo Sapiens
DHHLVTGQN

SEQ ID NO: 1100541 - protein, 9 aa, Homo Sapiens
FSLMKDDAL

SEQ ID NO: 1100542 - protein, 9 aa, Homo Sapiens
DARDGQSQT

SEQ ID NO: 1100543 - protein, 9 aa, Homo Sapiens
LAAFWTELT

SEQ ID NO: 1100544 - protein, 9 aa, Homo Sapiens
GEEEEEEAA

SEQ ID NO: 1100545 - protein, 9 aa, Homo Sapiens
QPTPCASTA

SEQ ID NO: 1100546 - protein, 9 aa, Homo Sapiens
YANLEAVNR

SEQ ID NO: 1100547 - protein, 9 aa, Homo Sapiens
WPPSHQHRN

SEQ ID NO: 1100548 - protein, 9 aa, Homo Sapiens
ARRLYNERG

SEQ ID NO: 1100549 - protein, 9 aa, Homo Sapiens
RCWVKAELH

SEQ ID NO: 1100550 - protein, 9 aa, Homo Sapiens
ATSQTPGRG

SEQ ID NO: 1100551 - protein, 9 aa, Homo Sapiens
DVKIELKIQ

SEQ ID NO: 1100552 - protein, 9 aa, Homo Sapiens
ESERDYNMD

SEQ ID NO: 1100553 - protein, 9 aa, Homo Sapiens
ATPEDILRL

SEQ ID NO: 1100554 - protein, 9 aa, Homo Sapiens
WDRFDRERR

SEQ ID NO: 1100555 - protein, 9 aa, Homo Sapiens
LPCHWPLWR

SEQ ID NO: 1100556 - protein, 9 aa, Homo Sapiens
ASLEMLTPS

SEQ ID NO: 1100557 - protein, 9 aa, Homo Sapiens
FEFVWPPPY

SEQ ID NO: 1100558 - protein, 9 aa, Homo Sapiens
DANDNLPFV

SEQ ID NO: 1100559 - protein, 9 aa, Homo Sapiens
KKKEAQAAV

SEQ ID NO: 1100560 - protein, 9 aa, Homo Sapiens
GLSRLCISL

SEQ ID NO: 1100561 - protein, 9 aa, Homo Sapiens
VRDLQTACS

SEQ ID NO: 1100562 - protein, 9 aa, Homo Sapiens
SMKETLWIR

SEQ ID NO: 1100563 - protein, 9 aa, Homo Sapiens
PCSGDEQGS

SEQ ID NO: 1100564 - protein, 9 aa, Homo Sapiens
VQHDRDMAQ

SEQ ID NO: 1100565 - protein, 9 aa, Homo Sapiens
RIPGVAHSV

SEQ ID NO: 1100566 - protein, 9 aa, Homo Sapiens
RWGWGQLLL

SEQ ID NO: 1100567 - protein, 9 aa, Homo Sapiens
PRIELTRMM

SEQ ID NO: 1100568 - protein, 9 aa, Homo Sapiens
SQSSLLEMD

SEQ ID NO: 1100569 - protein, 9 aa, Homo Sapiens
ALLMEGFLA

SEQ ID NO: 1100570 - protein, 9 aa, Homo Sapiens
ILETVEKVI

SEQ ID NO: 1100571 - protein, 9 aa, Homo Sapiens
YCEKLSGPS

SEQ ID NO: 1100572 - protein, 9 aa, Homo Sapiens
FVEASSSLT

SEQ ID NO: 1100573 - protein, 9 aa, Homo Sapiens
RGTSVLGGC

SEQ ID NO: 1100574 - protein, 9 aa, Homo Sapiens
LPKAIMTSV

SEQ ID NO: 1100575 - protein, 9 aa, Homo Sapiens
GVHRQLCRS

SEQ ID NO: 1100576 - protein, 9 aa, Homo Sapiens
VTNSSSSSF

SEQ ID NO: 1100577 - protein, 9 aa, Homo Sapiens
NRNVGNLAV

SEQ ID NO: 1100578 - protein, 9 aa, Homo Sapiens
AASLVVLQG

SEQ ID NO: 1100579 - protein, 9 aa, Homo Sapiens
TPLAPAKGV

SEQ ID NO: 1100580 - protein, 9 aa, Homo Sapiens
QSNPAKCLT

SEQ ID NO: 1100581 - protein, 9 aa, Homo Sapiens
RDLQTACST

SEQ ID NO: 1100582 - protein, 9 aa, Homo Sapiens
PQPTWGCRK

SEQ ID NO: 1100583 - protein, 9 aa, Homo Sapiens
KIIKKTVIL

SEQ ID NO: 1100584 - protein, 9 aa, Homo Sapiens
LGLFLLHQV

SEQ ID NO: 1100585 - protein, 9 aa, Homo Sapiens
SLLATQLKG

SEQ ID NO: 1100586 - protein, 9 aa, Homo Sapiens
LQAVAAEHQ

SEQ ID NO: 1100587 - protein, 9 aa, Homo Sapiens
TVGNGHMAG

SEQ ID NO: 1100588 - protein, 9 aa, Homo Sapiens
SGVNTKKEM

SEQ ID NO: 1100589 - protein, 9 aa, Homo Sapiens
WKMSPRTGD

SEQ ID NO: 1100590 - protein, 9 aa, Homo Sapiens
WEVSLWMEN

SEQ ID NO: 1100591 - protein, 9 aa, Homo Sapiens
KRKYRKFLP

SEQ ID NO: 1100592 - protein, 9 aa, Homo Sapiens
ENKWESRKE

SEQ ID NO: 1100593 - protein, 9 aa, Homo Sapiens
PEALRLVLM

SEQ ID NO: 1100594 - protein, 9 aa, Homo Sapiens
GSQNDTYDV

SEQ ID NO: 1100595 - protein, 9 aa, Homo Sapiens
RALHHAGPE

SEQ ID NO: 1100596 - protein, 9 aa, Homo Sapiens
REQEWAVRE

SEQ ID NO: 1100597 - protein, 9 aa, Homo Sapiens
CADICALGL

SEQ ID NO: 1100598 - protein, 9 aa, Homo Sapiens
DAHSSITGV

SEQ ID NO: 1100599 - protein, 9 aa, Homo Sapiens
TFLYLVNLN

SEQ ID NO: 1100600 - protein, 9 aa, Homo Sapiens
SFNTKTTTS

SEQ ID NO: 1100601 - protein, 9 aa, Homo Sapiens
TDTIKHCSD

SEQ ID NO: 1100602 - protein, 9 aa, Homo Sapiens
LKPAGPCSA

SEQ ID NO: 1100603 - protein, 9 aa, Homo Sapiens
QMVLQWRKF

SEQ ID NO: 1100604 - protein, 9 aa, Homo Sapiens
LGHAGASLF

SEQ ID NO: 1100605 - protein, 9 aa, Homo Sapiens
LDKMVRRQP

SEQ ID NO: 1100606 - protein, 9 aa, Homo Sapiens
PAVASRSTA

SEQ ID NO: 1100607 - protein, 9 aa, Homo Sapiens
LRARPPPTY

SEQ ID NO: 1100608 - protein, 9 aa, Homo Sapiens
TFMCSRPSR

SEQ ID NO: 1100609 - protein, 9 aa, Homo Sapiens
AGQEQYRTI

SEQ ID NO: 1100610 - protein, 9 aa, Homo Sapiens
PGVPGRLCA

SEQ ID NO: 1100611 - protein, 9 aa, Homo Sapiens
ASRLPRMPG

SEQ ID NO: 1100612 - protein, 9 aa, Homo Sapiens
MVTSTGLFQ

SEQ ID NO: 1100613 - protein, 9 aa, Homo Sapiens
VLKYLRCKL

SEQ ID NO: 1100614 - protein, 9 aa, Homo Sapiens
GVFCTSHVL

SEQ ID NO: 1100615 - protein, 9 aa, Homo Sapiens
SKASILEEK

SEQ ID NO: 1100616 - protein, 9 aa, Homo Sapiens
REEEMCDTN

SEQ ID NO: 1100617 - protein, 9 aa, Homo Sapiens
PPSRAASLL

SEQ ID NO: 1100618 - protein, 9 aa, Homo Sapiens
LALVTQVHK

SEQ ID NO: 1100619 - protein, 9 aa, Homo Sapiens
RPIQVQTGG

SEQ ID NO: 1100620 - protein, 9 aa, Homo Sapiens
PGHTTGTSR

SEQ ID NO: 1100621 - protein, 9 aa, Homo Sapiens
TLSPQGPRI

SEQ ID NO: 1100622 - protein, 9 aa, Homo Sapiens
PGRVRCRKT

SEQ ID NO: 1100623 - protein, 9 aa, Homo Sapiens
EAKEEECLI

SEQ ID NO: 1100624 - protein, 9 aa, Homo Sapiens
GVETLCGLK

SEQ ID NO: 1100625 - protein, 9 aa, Homo Sapiens
LPQGAGSPT

SEQ ID NO: 1100626 - protein, 9 aa, Homo Sapiens
RARTCSPCS

SEQ ID NO: 1100627 - protein, 9 aa, Homo Sapiens
TVQELTEFA

SEQ ID NO: 1100628 - protein, 9 aa, Homo Sapiens
LFFTIFCNL

SEQ ID NO: 1100629 - protein, 9 aa, Homo Sapiens
YDTASGKFT

SEQ ID NO: 1100630 - protein, 9 aa, Homo Sapiens
QSSSQPDHS

SEQ ID NO: 1100631 - protein, 9 aa, Homo Sapiens
YTSSSVLTA

SEQ ID NO: 1100632 - protein, 9 aa, Homo Sapiens
GPGGLPIFW

SEQ ID NO: 1100633 - protein, 9 aa, Homo Sapiens
WVGPGLDGG

SEQ ID NO: 1100634 - protein, 9 aa, Homo Sapiens
DNHVGPSSF

SEQ ID NO: 1100635 - protein, 9 aa, Homo Sapiens
PQQALLYGD

SEQ ID NO: 1100636 - protein, 9 aa, Homo Sapiens
ARHALETPS

SEQ ID NO: 1100637 - protein, 9 aa, Homo Sapiens
EGPLEPVVV

SEQ ID NO: 1100638 - protein, 9 aa, Homo Sapiens
EDPRVERLV

SEQ ID NO: 1100639 - protein, 9 aa, Homo Sapiens
ILSLLRLLQ

SEQ ID NO: 1100640 - protein, 9 aa, Homo Sapiens
LSGPSGAGR

SEQ ID NO: 1100641 - protein, 9 aa, Homo Sapiens
LTVLSCWTW

SEQ ID NO: 1100642 - protein, 9 aa, Homo Sapiens
AVLLDMAFD

SEQ ID NO: 1100643 - protein, 9 aa, Homo Sapiens
FLICCLSRL

SEQ ID NO: 1100644 - protein, 9 aa, Homo Sapiens
LDATLPDRP

SEQ ID NO: 1100645 - protein, 9 aa, Homo Sapiens
LPHGQLPRP

SEQ ID NO: 1100646 - protein, 9 aa, Homo Sapiens
LRYLTYRLC

SEQ ID NO: 1100647 - protein, 9 aa, Homo Sapiens
PHVPRQLPG

SEQ ID NO: 1100648 - protein, 9 aa, Homo Sapiens
FAGAVKVNN

SEQ ID NO: 1100649 - protein, 9 aa, Homo Sapiens
EKVSKKRLP

SEQ ID NO: 1100650 - protein, 9 aa, Homo Sapiens
GPVGLLHMD

SEQ ID NO: 1100651 - protein, 9 aa, Homo Sapiens
QYPLSLVTC

SEQ ID NO: 1100652 - protein, 9 aa, Homo Sapiens
GTWTGPSVW

SEQ ID NO: 1100653 - protein, 9 aa, Homo Sapiens
QIEMNKKHE

SEQ ID NO: 1100654 - protein, 9 aa, Homo Sapiens
QHSEVILFI

SEQ ID NO: 1100655 - protein, 9 aa, Homo Sapiens
SQPVTLQPV

SEQ ID NO: 1100656 - protein, 9 aa, Homo Sapiens
YEKITSCYS

SEQ ID NO: 1100657 - protein, 9 aa, Homo Sapiens
GLVGMTPRD

SEQ ID NO: 1100658 - protein, 9 aa, Homo Sapiens
HNRRREEKM

SEQ ID NO: 1100659 - protein, 9 aa, Homo Sapiens
GAPALECWD

SEQ ID NO: 1100660 - protein, 9 aa, Homo Sapiens
CARCVCVSV

SEQ ID NO: 1100661 - protein, 9 aa, Homo Sapiens
CSLPRGPRC

SEQ ID NO: 1100662 - protein, 9 aa, Homo Sapiens
ESVDQSRRA

SEQ ID NO: 1100663 - protein, 9 aa, Homo Sapiens
CLQFSKDII

SEQ ID NO: 1100664 - protein, 9 aa, Homo Sapiens
SVLDRLLYV

SEQ ID NO: 1100665 - protein, 9 aa, Homo Sapiens
HSAGGRHTA

SEQ ID NO: 1100666 - protein, 9 aa, Homo Sapiens
GYRCEGDQH

SEQ ID NO: 1100667 - protein, 9 aa, Homo Sapiens
VCENNPPGA

SEQ ID NO: 1100668 - protein, 9 aa, Homo Sapiens
RRPLGVSPL

SEQ ID NO: 1100669 - protein, 9 aa, Homo Sapiens
SVMTEPCKI

SEQ ID NO: 1100670 - protein, 9 aa, Homo Sapiens
TAGVILLFA

SEQ ID NO: 1100671 - protein, 9 aa, Homo Sapiens
KECVYEMRR

SEQ ID NO: 1100672 - protein, 9 aa, Homo Sapiens
RARVLLLPV

SEQ ID NO: 1100673 - protein, 9 aa, Homo Sapiens
EKCGKVFNQ

SEQ ID NO: 1100674 - protein, 9 aa, Homo Sapiens
ALVGPHARV

SEQ ID NO: 1100675 - protein, 9 aa, Homo Sapiens
PSLAASLVV

SEQ ID NO: 1100676 - protein, 9 aa, Homo Sapiens
RETIRTLNC

SEQ ID NO: 1100677 - protein, 9 aa, Homo Sapiens
AAPQSQEEG

SEQ ID NO: 1100678 - protein, 9 aa, Homo Sapiens
SWPRPPCSQ

SEQ ID NO: 1100679 - protein, 9 aa, Homo Sapiens
NKNKNGGNL

SEQ ID NO: 1100680 - protein, 9 aa, Homo Sapiens
ALCDRDVGG

SEQ ID NO: 1100681 - protein, 9 aa, Homo Sapiens
EQKFMLYWA

SEQ ID NO: 1100682 - protein, 9 aa, Homo Sapiens
ERLPRDWND

SEQ ID NO: 1100683 - protein, 9 aa, Homo Sapiens
TRSSLGACP

SEQ ID NO: 1100684 - protein, 9 aa, Homo Sapiens
RHLSFIGTP

SEQ ID NO: 1100685 - protein, 9 aa, Homo Sapiens
FASCSLPPD

SEQ ID NO: 1100686 - protein, 9 aa, Homo Sapiens
LCVLSSIRV

SEQ ID NO: 1100687 - protein, 9 aa, Homo Sapiens
PSWPLQPAP

SEQ ID NO: 1100688 - protein, 9 aa, Homo Sapiens
EQGGEEQRQ

SEQ ID NO: 1100689 - protein, 9 aa, Homo Sapiens
VEEIDGEIT

SEQ ID NO: 1100690 - protein, 9 aa, Homo Sapiens
NMGRPFQKK

SEQ ID NO: 1100691 - protein, 9 aa, Homo Sapiens
MAPWPLLLL

SEQ ID NO: 1100692 - protein, 9 aa, Homo Sapiens
SCPASAPCG

SEQ ID NO: 1100693 - protein, 9 aa, Homo Sapiens
PTSMWAHQA

SEQ ID NO: 1100694 - protein, 9 aa, Homo Sapiens
LGMEALGSW

SEQ ID NO: 1100695 - protein, 9 aa, Homo Sapiens
VLRPPTLWT

SEQ ID NO: 1100696 - protein, 9 aa, Homo Sapiens
PHPTVRPWR

SEQ ID NO: 1100697 - protein, 9 aa, Homo Sapiens
QLPVPEHLG

SEQ ID NO: 1100698 - protein, 9 aa, Homo Sapiens
AGALKPAGP

SEQ ID NO: 1100699 - protein, 9 aa, Homo Sapiens
HPSQTEILE

SEQ ID NO: 1100700 - protein, 9 aa, Homo Sapiens
PRERTLYTW

SEQ ID NO: 1100701 - protein, 9 aa, Homo Sapiens
KHRLWHAVH

SEQ ID NO: 1100702 - protein, 9 aa, Homo Sapiens
TLWTLCSST

SEQ ID NO: 1100703 - protein, 9 aa, Homo Sapiens
TYALSSHCP

SEQ ID NO: 1100704 - protein, 9 aa, Homo Sapiens
VLHKGLDRE

SEQ ID NO: 1100705 - protein, 9 aa, Homo Sapiens
LPSHVDFLA

SEQ ID NO: 1100706 - protein, 9 aa, Homo Sapiens
GYNSSRYIG

SEQ ID NO: 1100707 - protein, 9 aa, Homo Sapiens
PHGQLPRPL

SEQ ID NO: 1100708 - protein, 9 aa, Homo Sapiens
SSLACGALP

SEQ ID NO: 1100709 - protein, 9 aa, Homo Sapiens
CTDSAVPMW

SEQ ID NO: 1100710 - protein, 9 aa, Homo Sapiens
AHLCPQQHV

SEQ ID NO: 1100711 - protein, 9 aa, Homo Sapiens
ERNVATSPL

SEQ ID NO: 1100712 - protein, 9 aa, Homo Sapiens
FLYQILREL

SEQ ID NO: 1100713 - protein, 9 aa, Homo Sapiens
ALFYPGALL

SEQ ID NO: 1100714 - protein, 9 aa, Homo Sapiens
KLRTKTLQN

SEQ ID NO: 1100715 - protein, 9 aa, Homo Sapiens
RQHHVLQEG

SEQ ID NO: 1100716 - protein, 9 aa, Homo Sapiens
APPIRRVSP

SEQ ID NO: 1100717 - protein, 9 aa, Homo Sapiens
SFAQMLSVG

SEQ ID NO: 1100718 - protein, 9 aa, Homo Sapiens
HPLTFRLPR

SEQ ID NO: 1100719 - protein, 9 aa, Homo Sapiens
ERREMREYA

SEQ ID NO: 1100720 - protein, 9 aa, Homo Sapiens
LLPEGIRCR

SEQ ID NO: 1100721 - protein, 9 aa, Homo Sapiens
AQKILLSSI

SEQ ID NO: 1100722 - protein, 9 aa, Homo Sapiens
QSQTVRQFQ

SEQ ID NO: 1100723 - protein, 9 aa, Homo Sapiens
PECGRAFNQ

SEQ ID NO: 1100724 - protein, 9 aa, Homo Sapiens
LFCLYENIE

SEQ ID NO: 1100725 - protein, 9 aa, Homo Sapiens
AWSMGGDTA

SEQ ID NO: 1100726 - protein, 9 aa, Homo Sapiens
FSFLLVIAS

SEQ ID NO: 1100727 - protein, 9 aa, Homo Sapiens
TFPQHHHPR

SEQ ID NO: 1100728 - protein, 9 aa, Homo Sapiens
FKAHHSVLA

SEQ ID NO: 1100729 - protein, 9 aa, Homo Sapiens
IRHCTLTWS

SEQ ID NO: 1100730 - protein, 9 aa, Homo Sapiens
WAAVPRSFS

SEQ ID NO: 1100731 - protein, 9 aa, Homo Sapiens
SARGPVRLL

SEQ ID NO: 1100732 - protein, 9 aa, Homo Sapiens
LEPPGARFL

SEQ ID NO: 1100733 - protein, 9 aa, Homo Sapiens
GSSEDSVVE

SEQ ID NO: 1100734 - protein, 9 aa, Homo Sapiens
SKFRDSATK

SEQ ID NO: 1100735 - protein, 9 aa, Homo Sapiens
IIFADAFFL

SEQ ID NO: 1100736 - protein, 9 aa, Homo Sapiens
WVGGPGPGF

SEQ ID NO: 1100737 - protein, 9 aa, Homo Sapiens
NQKEQTALY

SEQ ID NO: 1100738 - protein, 9 aa, Homo Sapiens
LTLVVVLPE

SEQ ID NO: 1100739 - protein, 9 aa, Homo Sapiens
DQLHGAGFG

SEQ ID NO: 1100740 - protein, 9 aa, Homo Sapiens
LFTEHFHFY

SEQ ID NO: 1100741 - protein, 9 aa, Homo Sapiens
YPPHTDYTW

SEQ ID NO: 1100742 - protein, 9 aa, Homo Sapiens
QVREHVLEE

SEQ ID NO: 1100743 - protein, 9 aa, Homo Sapiens
EHGLVCAPE

SEQ ID NO: 1100744 - protein, 9 aa, Homo Sapiens
DLSSIAVLP

SEQ ID NO: 1100745 - protein, 9 aa, Homo Sapiens
AKNGSVKRV

SEQ ID NO: 1100746 - protein, 9 aa, Homo Sapiens
TARRASPAS

SEQ ID NO: 1100747 - protein, 9 aa, Homo Sapiens
RSLSCCPRP

SEQ ID NO: 1100748 - protein, 9 aa, Homo Sapiens
KDFSHRLTR

SEQ ID NO: 1100749 - protein, 9 aa, Homo Sapiens
AQRAQEHRA

SEQ ID NO: 1100750 - protein, 9 aa, Homo Sapiens
DSAWGWVRR

SEQ ID NO: 1100751 - protein, 9 aa, Homo Sapiens
EWTRPSRFC

SEQ ID NO: 1100752 - protein, 9 aa, Homo Sapiens
CFPHFERLL

SEQ ID NO: 1100753 - protein, 9 aa, Homo Sapiens
SKGLSGKKG

SEQ ID NO: 1100754 - protein, 9 aa, Homo Sapiens
PDSTPRGRT

SEQ ID NO: 1100755 - protein, 9 aa, Homo Sapiens
RAQGGFPLW

SEQ ID NO: 1100756 - protein, 9 aa, Homo Sapiens
RHDGSNSYC

SEQ ID NO: 1100757 - protein, 9 aa, Homo Sapiens
RFTASALPS

SEQ ID NO: 1100758 - protein, 9 aa, Homo Sapiens
LVNMGGNRS

SEQ ID NO: 1100759 - protein, 9 aa, Homo Sapiens
QEQERERSV

SEQ ID NO: 1100760 - protein, 9 aa, Homo Sapiens
PMLAPPTAP

SEQ ID NO: 1100761 - protein, 9 aa, Homo Sapiens
PASRSLGAL

SEQ ID NO: 1100762 - protein, 9 aa, Homo Sapiens
RAALAGAHA

SEQ ID NO: 1100763 - protein, 9 aa, Homo Sapiens
QQHNAENAE

SEQ ID NO: 1100764 - protein, 9 aa, Homo Sapiens
PATYRVEGG

SEQ ID NO: 1100765 - protein, 9 aa, Homo Sapiens
ICKQILEEL

SEQ ID NO: 1100766 - protein, 9 aa, Homo Sapiens
LGVAVDAQV

SEQ ID NO: 1100767 - protein, 9 aa, Homo Sapiens
RDGTVLQEA

SEQ ID NO: 1100768 - protein, 9 aa, Homo Sapiens
TYQHSEVIL

SEQ ID NO: 1100769 - protein, 9 aa, Homo Sapiens
PPPPSRPRS

SEQ ID NO: 1100770 - protein, 9 aa, Homo Sapiens
FGSMPFTKN

SEQ ID NO: 1100771 - protein, 9 aa, Homo Sapiens
KLSSLRILS

SEQ ID NO: 1100772 - protein, 9 aa, Homo Sapiens
LSPKDSQPL

SEQ ID NO: 1100773 - protein, 9 aa, Homo Sapiens
VVLRLDGSQ

SEQ ID NO: 1100774 - protein, 9 aa, Homo Sapiens
AWKTKKTSF

SEQ ID NO: 1100775 - protein, 9 aa, Homo Sapiens
MPGSEIPPP

SEQ ID NO: 1100776 - protein, 9 aa, Homo Sapiens
AQLVCSARA

SEQ ID NO: 1100777 - protein, 9 aa, Homo Sapiens
GEKGLELSP

SEQ ID NO: 1100778 - protein, 9 aa, Homo Sapiens
ENYEKITSC

SEQ ID NO: 1100779 - protein, 9 aa, Homo Sapiens
MLDCWVQDR

SEQ ID NO: 1100780 - protein, 9 aa, Homo Sapiens
NVTKYLWLP

SEQ ID NO: 1100781 - protein, 9 aa, Homo Sapiens
ASEFTNVHI

SEQ ID NO: 1100782 - protein, 9 aa, Homo Sapiens
RCGSATGPT

SEQ ID NO: 1100783 - protein, 9 aa, Homo Sapiens
EKIINPTIS

SEQ ID NO: 1100784 - protein, 9 aa, Homo Sapiens
TACETYISG

SEQ ID NO: 1100785 - protein, 9 aa, Homo Sapiens
PPPANPQLL

SEQ ID NO: 1100786 - protein, 9 aa, Homo Sapiens
LLALVVGTA

SEQ ID NO: 1100787 - protein, 9 aa, Homo Sapiens
AGILGLIGL

SEQ ID NO: 1100788 - protein, 9 aa, Homo Sapiens
FGSVEAEAS

SEQ ID NO: 1100789 - protein, 9 aa, Homo Sapiens
RSVVTVTHL

SEQ ID NO: 1100790 - protein, 9 aa, Homo Sapiens
FVDSSSYHP

SEQ ID NO: 1100791 - protein, 9 aa, Homo Sapiens
KEEFCHVIA

SEQ ID NO: 1100792 - protein, 9 aa, Homo Sapiens
VKIWVLFAS

SEQ ID NO: 1100793 - protein, 9 aa, Homo Sapiens
YIGVSTVHV

SEQ ID NO: 1100794 - protein, 9 aa, Homo Sapiens
PPECPQQLP

SEQ ID NO: 1100795 - protein, 9 aa, Homo Sapiens
PPGHPPRPH

SEQ ID NO: 1100796 - protein, 9 aa, Homo Sapiens
EAELRDHRC

SEQ ID NO: 1100797 - protein, 9 aa, Homo Sapiens
VQGHASCLS

SEQ ID NO: 1100798 - protein, 9 aa, Homo Sapiens
SGSVEHRSL

SEQ ID NO: 1100799 - protein, 9 aa, Homo Sapiens
PALECWDPT

SEQ ID NO: 1100800 - protein, 9 aa, Homo Sapiens
VNIAGRSKP

SEQ ID NO: 1100801 - protein, 9 aa, Homo Sapiens
QVIHLLNGL

SEQ ID NO: 1100802 - protein, 9 aa, Homo Sapiens
TAKCHRSLP

SEQ ID NO: 1100803 - protein, 9 aa, Homo Sapiens
KMTNLQAVQ

SEQ ID NO: 1100804 - protein, 9 aa, Homo Sapiens
MPSPHSGWC

SEQ ID NO: 1100805 - protein, 9 aa, Homo Sapiens
TTVRLHTPE

SEQ ID NO: 1100806 - protein, 9 aa, Homo Sapiens
EERRALRCS

SEQ ID NO: 1100807 - protein, 9 aa, Homo Sapiens
PRCRPAVAS

SEQ ID NO: 1100808 - protein, 9 aa, Homo Sapiens
ILTSMSDDA

SEQ ID NO: 1100809 - protein, 9 aa, Homo Sapiens
PCSQRLWQS

SEQ ID NO: 1100810 - protein, 9 aa, Homo Sapiens
LLDMAFDRY

SEQ ID NO: 1100811 - protein, 9 aa, Homo Sapiens
LQLVFGIEA

SEQ ID NO: 1100812 - protein, 9 aa, Homo Sapiens
MKVQELQSH

SEQ ID NO: 1100813 - protein, 9 aa, Homo Sapiens
PTATLGPLR

SEQ ID NO: 1100814 - protein, 9 aa, Homo Sapiens
RLVLSSTLR

SEQ ID NO: 1100815 - protein, 9 aa, Homo Sapiens
ALYMSASHI

SEQ ID NO: 1100816 - protein, 9 aa, Homo Sapiens
HSLGGGDWV

SEQ ID NO: 1100817 - protein, 9 aa, Homo Sapiens
APMLQLPGC

SEQ ID NO: 1100818 - protein, 9 aa, Homo Sapiens
PRSSEGLLS

SEQ ID NO: 1100819 - protein, 9 aa, Homo Sapiens
GIRGTISLQ

SEQ ID NO: 1100820 - protein, 9 aa, Homo Sapiens
PQQRNWLTV

SEQ ID NO: 1100821 - protein, 9 aa, Homo Sapiens
EYIGRKKSR

SEQ ID NO: 1100822 - protein, 9 aa, Homo Sapiens
SPSGQRMVP

SEQ ID NO: 1100823 - protein, 9 aa, Homo Sapiens
LDSSWLPVK

SEQ ID NO: 1100824 - protein, 9 aa, Homo Sapiens
GGHVDASLF

SEQ ID NO: 1100825 - protein, 9 aa, Homo Sapiens
YCSRQPGIH

SEQ ID NO: 1100826 - protein, 9 aa, Homo Sapiens
VDLRLASAN

SEQ ID NO: 1100827 - protein, 9 aa, Homo Sapiens
QGKLVLLSV

SEQ ID NO: 1100828 - protein, 9 aa, Homo Sapiens
LSRVCNGLE

SEQ ID NO: 1100829 - protein, 9 aa, Homo Sapiens
GTLIGTSAN

SEQ ID NO: 1100830 - protein, 9 aa, Homo Sapiens
FLNQCLEMD

SEQ ID NO: 1100831 - protein, 9 aa, Homo Sapiens
CTFFFLHKE

SEQ ID NO: 1100832 - protein, 9 aa, Homo Sapiens
GKRSTARAT

SEQ ID NO: 1100833 - protein, 9 aa, Homo Sapiens
VHLCCHRSS

SEQ ID NO: 1100834 - protein, 9 aa, Homo Sapiens
VALSLPASH

SEQ ID NO: 1100835 - protein, 9 aa, Homo Sapiens
IAQSIGQVF

SEQ ID NO: 1100836 - protein, 9 aa, Homo Sapiens
HPRFCHPLA

SEQ ID NO: 1100837 - protein, 9 aa, Homo Sapiens
LNPMGTVRS

SEQ ID NO: 1100838 - protein, 9 aa, Homo Sapiens
TASVQLENM

SEQ ID NO: 1100839 - protein, 9 aa, Homo Sapiens
HGKKSETGA

SEQ ID NO: 1100840 - protein, 9 aa, Homo Sapiens
VAAVAVAVA

SEQ ID NO: 1100841 - protein, 9 aa, Homo Sapiens
SAVPMGLLE

SEQ ID NO: 1100842 - protein, 9 aa, Homo Sapiens
LSAGYNSSR

SEQ ID NO: 1100843 - protein, 9 aa, Homo Sapiens
HGVWVGAQE

SEQ ID NO: 1100844 - protein, 9 aa, Homo Sapiens
KILLSSILS

SEQ ID NO: 1100845 - protein, 9 aa, Homo Sapiens
TASCASTGS

SEQ ID NO: 1100846 - protein, 9 aa, Homo Sapiens
KAICSGFFC

SEQ ID NO: 1100847 - protein, 9 aa, Homo Sapiens
PGFFLRLGV

SEQ ID NO: 1100848 - protein, 9 aa, Homo Sapiens
WQMRASTPA

SEQ ID NO: 1100849 - protein, 9 aa, Homo Sapiens
TDATGHLLF

SEQ ID NO: 1100850 - protein, 9 aa, Homo Sapiens
LLLGCHLFP

SEQ ID NO: 1100851 - protein, 9 aa, Homo Sapiens
IQLCKEVET

SEQ ID NO: 1100852 - protein, 9 aa, Homo Sapiens
PPAAPPAAA

SEQ ID NO: 1100853 - protein, 9 aa, Homo Sapiens
MVPFWPPSH

SEQ ID NO: 1100854 - protein, 9 aa, Homo Sapiens
LAARTTTLQ

SEQ ID NO: 1100855 - protein, 9 aa, Homo Sapiens
LSYPWALMN

SEQ ID NO: 1100856 - protein, 9 aa, Homo Sapiens
RFCRPSRAC

SEQ ID NO: 1100857 - protein, 9 aa, Homo Sapiens
WPSVPSSTS

SEQ ID NO: 1100858 - protein, 9 aa, Homo Sapiens
TPSISPVEK

SEQ ID NO: 1100859 - protein, 9 aa, Homo Sapiens
TATLGPLRG

SEQ ID NO: 1100860 - protein, 9 aa, Homo Sapiens
PRCPPSPRQ

SEQ ID NO: 1100861 - protein, 9 aa, Homo Sapiens
RMGPPRKHS

SEQ ID NO: 1100862 - protein, 9 aa, Homo Sapiens
FITPLHSGI

SEQ ID NO: 1100863 - protein, 9 aa, Homo Sapiens
SATTWEWEM

SEQ ID NO: 1100864 - protein, 9 aa, Homo Sapiens
PAPATYRVE

SEQ ID NO: 1100865 - protein, 9 aa, Homo Sapiens
VWDGYPPHQ

SEQ ID NO: 1100866 - protein, 9 aa, Homo Sapiens
VLAWARAHL

SEQ ID NO: 1100867 - protein, 9 aa, Homo Sapiens
IVQCAHLAA

SEQ ID NO: 1100868 - protein, 9 aa, Homo Sapiens
YFRLDMPLY

SEQ ID NO: 1100869 - protein, 9 aa, Homo Sapiens
SQPLCHWAV

SEQ ID NO: 1100870 - protein, 9 aa, Homo Sapiens
VSHFEKAKA

SEQ ID NO: 1100871 - protein, 9 aa, Homo Sapiens
YQILRELKY

SEQ ID NO: 1100872 - protein, 9 aa, Homo Sapiens
ENIIVAITP

SEQ ID NO: 1100873 - protein, 9 aa, Homo Sapiens
LNAVMRWGC

SEQ ID NO: 1100874 - protein, 9 aa, Homo Sapiens
SGRSLSCCP

SEQ ID NO: 1100875 - protein, 9 aa, Homo Sapiens
DTVRWAGQD

SEQ ID NO: 1100876 - protein, 9 aa, Homo Sapiens
EELCQCLQR

SEQ ID NO: 1100877 - protein, 9 aa, Homo Sapiens
HPVYHRNCL

SEQ ID NO: 1100878 - protein, 9 aa, Homo Sapiens
QFILDLQQK

SEQ ID NO: 1100879 - protein, 9 aa, Homo Sapiens
EAGGSKHGI

SEQ ID NO: 1100880 - protein, 9 aa, Homo Sapiens
NNQGRDAHS

SEQ ID NO: 1100881 - protein, 9 aa, Homo Sapiens
RRLVLKRFF

SEQ ID NO: 1100882 - protein, 9 aa, Homo Sapiens
APVGSVMSC

SEQ ID NO: 1100883 - protein, 9 aa, Homo Sapiens
SWGQTDLTV

SEQ ID NO: 1100884 - protein, 9 aa, Homo Sapiens
HPTSASRVA

SEQ ID NO: 1100885 - protein, 9 aa, Homo Sapiens
ALLYGDCVV

SEQ ID NO: 1100886 - protein, 9 aa, Homo Sapiens
VDALKNHLV

SEQ ID NO: 1100887 - protein, 9 aa, Homo Sapiens
VLDDQSRGF

SEQ ID NO: 1100888 - protein, 9 aa, Homo Sapiens
EEFCHVIAW

SEQ ID NO: 1100889 - protein, 9 aa, Homo Sapiens
GPLGAPGHE

SEQ ID NO: 1100890 - protein, 9 aa, Homo Sapiens
HKALQEIQN

SEQ ID NO: 1100891 - protein, 9 aa, Homo Sapiens
DIKVIMVTG

SEQ ID NO: 1100892 - protein, 9 aa, Homo Sapiens
GVGEEIAEA

SEQ ID NO: 1100893 - protein, 9 aa, Homo Sapiens
ETRSGRPGW

SEQ ID NO: 1100894 - protein, 9 aa, Homo Sapiens
LDCWVQDRN

SEQ ID NO: 1100895 - protein, 9 aa, Homo Sapiens
MPACMSAPQ

SEQ ID NO: 1100896 - protein, 9 aa, Homo Sapiens
VNPHTHWTI

SEQ ID NO: 1100897 - protein, 9 aa, Homo Sapiens
QQNTQGAQA

SEQ ID NO: 1100898 - protein, 9 aa, Homo Sapiens
EWCRAMTKN

SEQ ID NO: 1100899 - protein, 9 aa, Homo Sapiens
SLKCLWEKD

SEQ ID NO: 1100900 - protein, 9 aa, Homo Sapiens
PCHLPLPWG

SEQ ID NO: 1100901 - protein, 9 aa, Homo Sapiens
AAFKRKAKG

SEQ ID NO: 1100902 - protein, 9 aa, Homo Sapiens
AATLRCPAV

SEQ ID NO: 1100903 - protein, 9 aa, Homo Sapiens
ANLEAVNRA

SEQ ID NO: 1100904 - protein, 9 aa, Homo Sapiens
MKICTEAPG

SEQ ID NO: 1100905 - protein, 9 aa, Homo Sapiens
DEIYHMGTF

SEQ ID NO: 1100906 - protein, 9 aa, Homo Sapiens
RNILEMSFC

SEQ ID NO: 1100907 - protein, 9 aa, Homo Sapiens
RGPRCPPSP

SEQ ID NO: 1100908 - protein, 9 aa, Homo Sapiens
FCTFFCRDR

SEQ ID NO: 1100909 - protein, 9 aa, Homo Sapiens
IFPQLCNSK

SEQ ID NO: 1100910 - protein, 9 aa, Homo Sapiens
QPPRRPPPA

SEQ ID NO: 1100911 - protein, 9 aa, Homo Sapiens
LQGKVLLLH

SEQ ID NO: 1100912 - protein, 9 aa, Homo Sapiens
SVCENNPPG

SEQ ID NO: 1100913 - protein, 9 aa, Homo Sapiens
PERLPLSCG

SEQ ID NO: 1100914 - protein, 9 aa, Homo Sapiens
CSPCSPTTP

SEQ ID NO: 1100915 - protein, 9 aa, Homo Sapiens
HGKAEEQAV

SEQ ID NO: 1100916 - protein, 9 aa, Homo Sapiens
PGPASALPW

SEQ ID NO: 1100917 - protein, 9 aa, Homo Sapiens
REARRHGKA

SEQ ID NO: 1100918 - protein, 9 aa, Homo Sapiens
LMAKTIRFT

SEQ ID NO: 1100919 - protein, 9 aa, Homo Sapiens
DAVDNKKTH

SEQ ID NO: 1100920 - protein, 9 aa, Homo Sapiens
AHLAVEACL

SEQ ID NO: 1100921 - protein, 9 aa, Homo Sapiens
FHCQKGYLL

SEQ ID NO: 1100922 - protein, 9 aa, Homo Sapiens
VEKEKKTSV

SEQ ID NO: 1100923 - protein, 9 aa, Homo Sapiens
TVAGATAQI

SEQ ID NO: 1100924 - protein, 9 aa, Homo Sapiens
YKRPIQEEY

SEQ ID NO: 1100925 - protein, 9 aa, Homo Sapiens
EWYQNFQSP

SEQ ID NO: 1100926 - protein, 9 aa, Homo Sapiens
RPPRQVREH

SEQ ID NO: 1100927 - protein, 9 aa, Homo Sapiens
YRGGQRCRC

SEQ ID NO: 1100928 - protein, 9 aa, Homo Sapiens
NVRSGPLTG

SEQ ID NO: 1100929 - protein, 9 aa, Homo Sapiens
EEEQEEEAE

SEQ ID NO: 1100930 - protein, 9 aa, Homo Sapiens
CWCMPGGAS

SEQ ID NO: 1100931 - protein, 9 aa, Homo Sapiens
VLCTRPPLL

SEQ ID NO: 1100932 - protein, 9 aa, Homo Sapiens
IQWPTVHGL

SEQ ID NO: 1100933 - protein, 9 aa, Homo Sapiens
GKIIDTKNL

SEQ ID NO: 1100934 - protein, 9 aa, Homo Sapiens
HCPCHLPLP

SEQ ID NO: 1100935 - protein, 9 aa, Homo Sapiens
VPGKTSLKA

SEQ ID NO: 1100936 - protein, 9 aa, Homo Sapiens
TLSQPPPQA

SEQ ID NO: 1100937 - protein, 9 aa, Homo Sapiens
WSRVVVMEI

SEQ ID NO: 1100938 - protein, 9 aa, Homo Sapiens
AHREAFKTS

SEQ ID NO: 1100939 - protein, 9 aa, Homo Sapiens
GIRCRPGAP

SEQ ID NO: 1100940 - protein, 9 aa, Homo Sapiens
THLPPIHLH

SEQ ID NO: 1100941 - protein, 9 aa, Homo Sapiens
DPDVKIELK

SEQ ID NO: 1100942 - protein, 9 aa, Homo Sapiens
PSPSQEPQE

SEQ ID NO: 1100943 - protein, 9 aa, Homo Sapiens
TEAGAPGSG

SEQ ID NO: 1100944 - protein, 9 aa, Homo Sapiens
REVLRTVKT

SEQ ID NO: 1100945 - protein, 9 aa, Homo Sapiens
VAALLMEGF

SEQ ID NO: 1100946 - protein, 9 aa, Homo Sapiens
RVRCRKTRR

SEQ ID NO: 1100947 - protein, 9 aa, Homo Sapiens
PPSAGALKP

SEQ ID NO: 1100948 - protein, 9 aa, Homo Sapiens
RGSGPGRRL

SEQ ID NO: 1100949 - protein, 9 aa, Homo Sapiens
SRTLGTALM

SEQ ID NO: 1100950 - protein, 9 aa, Homo Sapiens
HRLIHTVGK

SEQ ID NO: 1100951 - protein, 9 aa, Homo Sapiens
ALRLVLMLN

SEQ ID NO: 1100952 - protein, 9 aa, Homo Sapiens
LAGVTAPST

SEQ ID NO: 1100953 - protein, 9 aa, Homo Sapiens
AMVLSTDIL

SEQ ID NO: 1100954 - protein, 9 aa, Homo Sapiens
DDDTVPSVS

SEQ ID NO: 1100955 - protein, 9 aa, Homo Sapiens
ELKMVTSTG

SEQ ID NO: 1100956 - protein, 9 aa, Homo Sapiens
HERIHSGKK

SEQ ID NO: 1100957 - protein, 9 aa, Homo Sapiens
QRQRRRQAE

SEQ ID NO: 1100958 - protein, 9 aa, Homo Sapiens
DVPPLCLSK

SEQ ID NO: 1100959 - protein, 9 aa, Homo Sapiens
WGWVRRVLC

SEQ ID NO: 1100960 - protein, 9 aa, Homo Sapiens
KLTQIVLWR

SEQ ID NO: 1100961 - protein, 9 aa, Homo Sapiens
TSSSVLTAE

SEQ ID NO: 1100962 - protein, 9 aa, Homo Sapiens
DHYGTTVPY

SEQ ID NO: 1100963 - protein, 9 aa, Homo Sapiens
GTAAPGPRP

SEQ ID NO: 1100964 - protein, 9 aa, Homo Sapiens
NHGKHSTMK

SEQ ID NO: 1100965 - protein, 9 aa, Homo Sapiens
TSPERLPLS

SEQ ID NO: 1100966 - protein, 9 aa, Homo Sapiens
RYHRRAPAT

SEQ ID NO: 1100967 - protein, 9 aa, Homo Sapiens
QIQWPTVHG

SEQ ID NO: 1100968 - protein, 9 aa, Homo Sapiens
GDVGLGVQV

SEQ ID NO: 1100969 - protein, 9 aa, Homo Sapiens
VNMPRPSLA

SEQ ID NO: 1100970 - protein, 9 aa, Homo Sapiens
QEPSRLGGP

SEQ ID NO: 1100971 - protein, 9 aa, Homo Sapiens
CLSRLLPEH

SEQ ID NO: 1100972 - protein, 9 aa, Homo Sapiens
DNSRGCGGS

SEQ ID NO: 1100973 - protein, 9 aa, Homo Sapiens
EPPPRPAPG

SEQ ID NO: 1100974 - protein, 9 aa, Homo Sapiens
RWRIGGLCS

SEQ ID NO: 1100975 - protein, 9 aa, Homo Sapiens
PEETWGVET

SEQ ID NO: 1100976 - protein, 9 aa, Homo Sapiens
LSCFVWKQA

SEQ ID NO: 1100977 - protein, 9 aa, Homo Sapiens
GSPQRRGEQ

SEQ ID NO: 1100978 - protein, 9 aa, Homo Sapiens
PALTLPCAL

SEQ ID NO: 1100979 - protein, 9 aa, Homo Sapiens
DLILYLVVA

SEQ ID NO: 1100980 - protein, 9 aa, Homo Sapiens
TVSHNGSYV

SEQ ID NO: 1100981 - protein, 9 aa, Homo Sapiens
GRDAHSSIT

SEQ ID NO: 1100982 - protein, 9 aa, Homo Sapiens
RNPGGSPCT

SEQ ID NO: 1100983 - protein, 9 aa, Homo Sapiens
WIPQSAGTT

SEQ ID NO: 1100984 - protein, 9 aa, Homo Sapiens
NHHLYRFPP

SEQ ID NO: 1100985 - protein, 9 aa, Homo Sapiens
KGRGQILHR

SEQ ID NO: 1100986 - protein, 9 aa, Homo Sapiens
CPDMMRKLR

SEQ ID NO: 1100987 - protein, 9 aa, Homo Sapiens
KNQHQEDPN

SEQ ID NO: 1100988 - protein, 9 aa, Homo Sapiens
ESEIQLCKE

SEQ ID NO: 1100989 - protein, 9 aa, Homo Sapiens
RNCILEIVY

SEQ ID NO: 1100990 - protein, 9 aa, Homo Sapiens
PVDKENLQA

SEQ ID NO: 1100991 - protein, 9 aa, Homo Sapiens
GRQTRPEWS

SEQ ID NO: 1100992 - protein, 9 aa, Homo Sapiens
PCWVGPGLD

SEQ ID NO: 1100993 - protein, 9 aa, Homo Sapiens
SLSYLMELS

SEQ ID NO: 1100994 - protein, 9 aa, Homo Sapiens
QARTRAGLV

SEQ ID NO: 1100995 - protein, 9 aa, Homo Sapiens
TSTGLFQEN

SEQ ID NO: 1100996 - protein, 9 aa, Homo Sapiens
DPLSEITEH

SEQ ID NO: 1100997 - protein, 9 aa, Homo Sapiens
ATPAPTWTT

SEQ ID NO: 1100998 - protein, 9 aa, Homo Sapiens
VARPLLEFA

SEQ ID NO: 1100999 - protein, 9 aa, Homo Sapiens
FDNFFYQER

SEQ ID NO: 1101000 - protein, 9 aa, Homo Sapiens
TSMWTSRTS

SEQ ID NO: 1101001 - protein, 9 aa, Homo Sapiens
AIKLACMDT

SEQ ID NO: 1101002 - protein, 9 aa, Homo Sapiens
DTLTVVTVD

SEQ ID NO: 1101003 - protein, 9 aa, Homo Sapiens
TKPETRAHL

SEQ ID NO: 1101004 - protein, 9 aa, Homo Sapiens
RTLQLTPVS

SEQ ID NO: 1101005 - protein, 9 aa, Homo Sapiens
ASILEEKRQ

SEQ ID NO: 1101006 - protein, 9 aa, Homo Sapiens
VPTYKEVTP

SEQ ID NO: 1101007 - protein, 9 aa, Homo Sapiens
VEAYQDYAH

SEQ ID NO: 1101008 - protein, 9 aa, Homo Sapiens
VHQSVPYGM

SEQ ID NO: 1101009 - protein, 9 aa, Homo Sapiens
PEEFHSTIL

SEQ ID NO: 1101010 - protein, 9 aa, Homo Sapiens
GHTDATGHL

SEQ ID NO: 1101011 - protein, 9 aa, Homo Sapiens
SLPSCPASA

SEQ ID NO: 1101012 - protein, 9 aa, Homo Sapiens
DIGNTVKKA

SEQ ID NO: 1101013 - protein, 9 aa, Homo Sapiens
TLGRVPHQV

SEQ ID NO: 1101014 - protein, 9 aa, Homo Sapiens
ALVTQVHKL

SEQ ID NO: 1101015 - protein, 9 aa, Homo Sapiens
RSQGRLCLS

SEQ ID NO: 1101016 - protein, 9 aa, Homo Sapiens
RDLGTVAGA

SEQ ID NO: 1101017 - protein, 9 aa, Homo Sapiens
CRSWSSDST

SEQ ID NO: 1101018 - protein, 9 aa, Homo Sapiens
PVDWWVMGI

SEQ ID NO: 1101019 - protein, 9 aa, Homo Sapiens
QFLLFTEHF

SEQ ID NO: 1101020 - protein, 9 aa, Homo Sapiens
QANPHYAHV

SEQ ID NO: 1101021 - protein, 9 aa, Homo Sapiens
LQVTMHQPV

SEQ ID NO: 1101022 - protein, 9 aa, Homo Sapiens
STTRKDTQK

SEQ ID NO: 1101023 - protein, 9 aa, Homo Sapiens
PGGRAWAPQ

SEQ ID NO: 1101024 - protein, 9 aa, Homo Sapiens
AKDVNQDLY

SEQ ID NO: 1101025 - protein, 9 aa, Homo Sapiens
CFLAVLKQK

SEQ ID NO: 1101026 - protein, 9 aa, Homo Sapiens
SWTIRHCTL

SEQ ID NO: 1101027 - protein, 9 aa, Homo Sapiens
QSVGSQNDT

SEQ ID NO: 1101028 - protein, 9 aa, Homo Sapiens
VEACLRTHG

SEQ ID NO: 1101029 - protein, 9 aa, Homo Sapiens
CAPRPPSAG

SEQ ID NO: 1101030 - protein, 9 aa, Homo Sapiens
PEKKVDEKQ

SEQ ID NO: 1101031 - protein, 9 aa, Homo Sapiens
SGSASLMIL

SEQ ID NO: 1101032 - protein, 9 aa, Homo Sapiens
LGGPATPTS

SEQ ID NO: 1101033 - protein, 9 aa, Homo Sapiens
TCISMTTIS

SEQ ID NO: 1101034 - protein, 9 aa, Homo Sapiens
RASQTRVPP

SEQ ID NO: 1101035 - protein, 9 aa, Homo Sapiens
KSAASETYT

SEQ ID NO: 1101036 - protein, 9 aa, Homo Sapiens
AAFPGHRVN

SEQ ID NO: 1101037 - protein, 9 aa, Homo Sapiens
LAITISLAI

SEQ ID NO: 1101038 - protein, 9 aa, Homo Sapiens
IVDHFKMKN

SEQ ID NO: 1101039 - protein, 9 aa, Homo Sapiens
NLNKNDWIR

SEQ ID NO: 1101040 - protein, 9 aa, Homo Sapiens
VMSCSLLTQ

SEQ ID NO: 1101041 - protein, 9 aa, Homo Sapiens
LLPEDTPPS

SEQ ID NO: 1101042 - protein, 9 aa, Homo Sapiens
TSRAGHVEP

SEQ ID NO: 1101043 - protein, 9 aa, Homo Sapiens
RWDRGDAWW

SEQ ID NO: 1101044 - protein, 9 aa, Homo Sapiens
VQSYPKKDP

SEQ ID NO: 1101045 - protein, 9 aa, Homo Sapiens
LLTILEIFY

SEQ ID NO: 1101046 - protein, 9 aa, Homo Sapiens
ELGVAVDAQ

SEQ ID NO: 1101047 - protein, 9 aa, Homo Sapiens
PCVLPHVDF

SEQ ID NO: 1101048 - protein, 9 aa, Homo Sapiens
SCASTGSST

SEQ ID NO: 1101049 - protein, 9 aa, Homo Sapiens
TISCEHPWE

SEQ ID NO: 1101050 - protein, 9 aa, Homo Sapiens
VLEEVIREG

SEQ ID NO: 1101051 - protein, 9 aa, Homo Sapiens
KQHGVQEAP

SEQ ID NO: 1101052 - protein, 9 aa, Homo Sapiens
YVRAQDWAT

SEQ ID NO: 1101053 - protein, 9 aa, Homo Sapiens
VPPGRALHH

SEQ ID NO: 1101054 - protein, 9 aa, Homo Sapiens
FEPPMPPPA

SEQ ID NO: 1101055 - protein, 9 aa, Homo Sapiens
VNTCLEKTA

SEQ ID NO: 1101056 - protein, 9 aa, Homo Sapiens
EPNGNALPP

SEQ ID NO: 1101057 - protein, 9 aa, Homo Sapiens
RWRTACVSP

SEQ ID NO: 1101058 - protein, 9 aa, Homo Sapiens
SNPPIFHSG

SEQ ID NO: 1101059 - protein, 9 aa, Homo Sapiens
EASRSSGIV

SEQ ID NO: 1101060 - protein, 9 aa, Homo Sapiens
VTAGRGWLP

SEQ ID NO: 1101061 - protein, 9 aa, Homo Sapiens
AVQKLQAQC

SEQ ID NO: 1101062 - protein, 9 aa, Homo Sapiens
IDNWCWRDK

SEQ ID NO: 1101063 - protein, 9 aa, Homo Sapiens
ISYTPQDPE

SEQ ID NO: 1101064 - protein, 9 aa, Homo Sapiens
SQTSLPLSS

SEQ ID NO: 1101065 - protein, 9 aa, Homo Sapiens
DANAPEGRL

SEQ ID NO: 1101066 - protein, 9 aa, Homo Sapiens
LLAEDPRVE

SEQ ID NO: 1101067 - protein, 9 aa, Homo Sapiens
HQHQPPAPS

SEQ ID NO: 1101068 - protein, 9 aa, Homo Sapiens
STDMDHVLL

SEQ ID NO: 1101069 - protein, 9 aa, Homo Sapiens
LTLPCALWT

SEQ ID NO: 1101070 - protein, 9 aa, Homo Sapiens
AAELEPPGA

SEQ ID NO: 1101071 - protein, 9 aa, Homo Sapiens
TVMSADHYL

SEQ ID NO: 1101072 - protein, 9 aa, Homo Sapiens
TTKPETRAH

SEQ ID NO: 1101073 - protein, 9 aa, Homo Sapiens
PHKYRVLIA

SEQ ID NO: 1101074 - protein, 9 aa, Homo Sapiens
PRPRPAADM

SEQ ID NO: 1101075 - protein, 9 aa, Homo Sapiens
MEAFLGGLA

SEQ ID NO: 1101076 - protein, 9 aa, Homo Sapiens
GDSATTWEW

SEQ ID NO: 1101077 - protein, 9 aa, Homo Sapiens
TRQGHGTCT

SEQ ID NO: 1101078 - protein, 9 aa, Homo Sapiens
SAGCSPGEL

SEQ ID NO: 1101079 - protein, 9 aa, Homo Sapiens
LKSLMTANS

SEQ ID NO: 1101080 - protein, 9 aa, Homo Sapiens
MTASQRSKR

SEQ ID NO: 1101081 - protein, 9 aa, Homo Sapiens
DHRCIGKEQ

SEQ ID NO: 1101082 - protein, 9 aa, Homo Sapiens
PLEVRACQG

SEQ ID NO: 1101083 - protein, 9 aa, Homo Sapiens
SSWTPGRRG

SEQ ID NO: 1101084 - protein, 9 aa, Homo Sapiens
GSASLMILV

SEQ ID NO: 1101085 - protein, 9 aa, Homo Sapiens
DWWVMGIIL

SEQ ID NO: 1101086 - protein, 9 aa, Homo Sapiens
FKIKRHMPL

SEQ ID NO: 1101087 - protein, 9 aa, Homo Sapiens
CVHYSLHFL

SEQ ID NO: 1101088 - protein, 9 aa, Homo Sapiens
ATTLTSAAS

SEQ ID NO: 1101089 - protein, 9 aa, Homo Sapiens
FSTWIIPAN

SEQ ID NO: 1101090 - protein, 9 aa, Homo Sapiens
AHSSITGVY

SEQ ID NO: 1101091 - protein, 9 aa, Homo Sapiens
NTMETHRLI

SEQ ID NO: 1101092 - protein, 9 aa, Homo Sapiens
PAHQPSLTH

SEQ ID NO: 1101093 - protein, 9 aa, Homo Sapiens
ASGPCHAAA

SEQ ID NO: 1101094 - protein, 9 aa, Homo Sapiens
ELLQKEEFC

SEQ ID NO: 1101095 - protein, 9 aa, Homo Sapiens
TTWGCWPST

SEQ ID NO: 1101096 - protein, 9 aa, Homo Sapiens
GLSTSWPSL

SEQ ID NO: 1101097 - protein, 9 aa, Homo Sapiens
EDVKIWVLF

SEQ ID NO: 1101098 - protein, 9 aa, Homo Sapiens
VPGSFNTKT

SEQ ID NO: 1101099 - protein, 9 aa, Homo Sapiens
PAGLQSYHQ

SEQ ID NO: 1101100 - protein, 9 aa, Homo Sapiens
PGPPWPTHL

SEQ ID NO: 1101101 - protein, 9 aa, Homo Sapiens
MYHHDIDCQ

SEQ ID NO: 1101102 - protein, 9 aa, Homo Sapiens
GPASALPWG

SEQ ID NO: 1101103 - protein, 9 aa, Homo Sapiens
AAPGPRPGS

SEQ ID NO: 1101104 - protein, 9 aa, Homo Sapiens
NALQTSGSS

SEQ ID NO: 1101105 - protein, 9 aa, Homo Sapiens
KWLSRRLVL

SEQ ID NO: 1101106 - protein, 9 aa, Homo Sapiens
QFRAGCVGH

SEQ ID NO: 1101107 - protein, 9 aa, Homo Sapiens
SQRLPWAGA

SEQ ID NO: 1101108 - protein, 9 aa, Homo Sapiens
LILVDAQKP

SEQ ID NO: 1101109 - protein, 9 aa, Homo Sapiens
TTPGHTTGT

SEQ ID NO: 1101110 - protein, 9 aa, Homo Sapiens
LGPRDAPGA

SEQ ID NO: 1101111 - protein, 9 aa, Homo Sapiens
EQVWRANVG

SEQ ID NO: 1101112 - protein, 9 aa, Homo Sapiens
TLSMAELGL

SEQ ID NO: 1101113 - protein, 9 aa, Homo Sapiens
LMCGTLAAW

SEQ ID NO: 1101114 - protein, 9 aa, Homo Sapiens
SRMLKQNLN

SEQ ID NO: 1101115 - protein, 9 aa, Homo Sapiens
GDDTPCIWQ

SEQ ID NO: 1101116 - protein, 9 aa, Homo Sapiens
FILDLQQKW

SEQ ID NO: 1101117 - protein, 9 aa, Homo Sapiens
KAMHVDATV

SEQ ID NO: 1101118 - protein, 9 aa, Homo Sapiens
HAGTRVLKL

SEQ ID NO: 1101119 - protein, 9 aa, Homo Sapiens
KEHRDHDSS

SEQ ID NO: 1101120 - protein, 9 aa, Homo Sapiens
VGPGLDGGL

SEQ ID NO: 1101121 - protein, 9 aa, Homo Sapiens
FDSGVSSSV

SEQ ID NO: 1101122 - protein, 9 aa, Homo Sapiens
SSSLTPLTT

SEQ ID NO: 1101123 - protein, 9 aa, Homo Sapiens
QEMLYIVDW

SEQ ID NO: 1101124 - protein, 9 aa, Homo Sapiens
NRRREEKMR

SEQ ID NO: 1101125 - protein, 9 aa, Homo Sapiens
APWLPMRSL

SEQ ID NO: 1101126 - protein, 9 aa, Homo Sapiens
IELKIQSLI

SEQ ID NO: 1101127 - protein, 9 aa, Homo Sapiens
HSGMLPLEI

SEQ ID NO: 1101128 - protein, 9 aa, Homo Sapiens
FSGSVEHRS

SEQ ID NO: 1101129 - protein, 9 aa, Homo Sapiens
TRSGRPGWG

SEQ ID NO: 1101130 - protein, 9 aa, Homo Sapiens
AFGGFLKYM

SEQ ID NO: 1101131 - protein, 9 aa, Homo Sapiens
GRGIFGQRL

SEQ ID NO: 1101132 - protein, 9 aa, Homo Sapiens
QLVCSARAG

SEQ ID NO: 1101133 - protein, 9 aa, Homo Sapiens
LDLNPVPET

SEQ ID NO: 1101134 - protein, 9 aa, Homo Sapiens
AVAAEHQDQ

SEQ ID NO: 1101135 - protein, 9 aa, Homo Sapiens
AQFCCRVQD

SEQ ID NO: 1101136 - protein, 9 aa, Homo Sapiens
QPVLVELLL

SEQ ID NO: 1101137 - protein, 9 aa, Homo Sapiens
GPRDAPGAA

SEQ ID NO: 1101138 - protein, 9 aa, Homo Sapiens
GTTYCVCVL

SEQ ID NO: 1101139 - protein, 9 aa, Homo Sapiens
CTPAQSFLA

SEQ ID NO: 1101140 - protein, 9 aa, Homo Sapiens
AGSPTLGRV

SEQ ID NO: 1101141 - protein, 9 aa, Homo Sapiens
RGDAWWGAE

SEQ ID NO: 1101142 - protein, 9 aa, Homo Sapiens
ELTAKEVDT

SEQ ID NO: 1101143 - protein, 9 aa, Homo Sapiens
DSTPRGRTS

SEQ ID NO: 1101144 - protein, 9 aa, Homo Sapiens
LPSCYHSWL

SEQ ID NO: 1101145 - protein, 9 aa, Homo Sapiens
MLKSPNTTI

SEQ ID NO: 1101146 - protein, 9 aa, Homo Sapiens
GLDAVGMDQ

SEQ ID NO: 1101147 - protein, 9 aa, Homo Sapiens
AARRLYNER

SEQ ID NO: 1101148 - protein, 9 aa, Homo Sapiens
LLFQKLPKN

SEQ ID NO: 1101149 - protein, 9 aa, Homo Sapiens
LMVRLTRHA

SEQ ID NO: 1101150 - protein, 9 aa, Homo Sapiens
LTTDTIKHC

SEQ ID NO: 1101151 - protein, 9 aa, Homo Sapiens
LQGKLVLLS

SEQ ID NO: 1101152 - protein, 9 aa, Homo Sapiens
SSPGRHEGH

SEQ ID NO: 1101153 - protein, 9 aa, Homo Sapiens
RASPASWQV

SEQ ID NO: 1101154 - protein, 9 aa, Homo Sapiens
DSLSPCLGW

SEQ ID NO: 1101155 - protein, 9 aa, Homo Sapiens
LGAPGHELS

SEQ ID NO: 1101156 - protein, 9 aa, Homo Sapiens
PRPGTLPGE

SEQ ID NO: 1101157 - protein, 9 aa, Homo Sapiens
QCAHLAAMD

SEQ ID NO: 1101158 - protein, 9 aa, Homo Sapiens
MDQQPIMNH

SEQ ID NO: 1101159 - protein, 9 aa, Homo Sapiens
LVNLNKNDW

SEQ ID NO: 1101160 - protein, 9 aa, Homo Sapiens
KESEIQLCK

SEQ ID NO: 1101161 - protein, 9 aa, Homo Sapiens
LMIKNRISP

SEQ ID NO: 1101162 - protein, 9 aa, Homo Sapiens
SCPAPHRSP

SEQ ID NO: 1101163 - protein, 9 aa, Homo Sapiens
ECPSGYMMN

SEQ ID NO: 1101164 - protein, 9 aa, Homo Sapiens
QDLYRMKSR

SEQ ID NO: 1101165 - protein, 9 aa, Homo Sapiens
PHPVLIQHQ

SEQ ID NO: 1101166 - protein, 9 aa, Homo Sapiens
QQTYSLPDN

SEQ ID NO: 1101167 - protein, 9 aa, Homo Sapiens
PKTYPVVLP

SEQ ID NO: 1101168 - protein, 9 aa, Homo Sapiens
GHRKGQRRA

SEQ ID NO: 1101169 - protein, 9 aa, Homo Sapiens
RHQTSVLSF

SEQ ID NO: 1101170 - protein, 9 aa, Homo Sapiens
TAAAMVLST

SEQ ID NO: 1101171 - protein, 9 aa, Homo Sapiens
SLSLQQWKR

SEQ ID NO: 1101172 - protein, 9 aa, Homo Sapiens
PRTPAPASR

SEQ ID NO: 1101173 - protein, 9 aa, Homo Sapiens
STTRYVASG

SEQ ID NO: 1101174 - protein, 9 aa, Homo Sapiens
KVSSLFLPV

SEQ ID NO: 1101175 - protein, 9 aa, Homo Sapiens
EVFLGLGLS

SEQ ID NO: 1101176 - protein, 9 aa, Homo Sapiens
YTVLIVGCI

SEQ ID NO: 1101177 - protein, 9 aa, Homo Sapiens
QPILILQDG

SEQ ID NO: 1101178 - protein, 9 aa, Homo Sapiens
SKVLELVLH

SEQ ID NO: 1101179 - protein, 9 aa, Homo Sapiens
ERNPYKTLQ

SEQ ID NO: 1101180 - protein, 9 aa, Homo Sapiens
SPSSNAGQN

SEQ ID NO: 1101181 - protein, 9 aa, Homo Sapiens
AAWRLDESL

SEQ ID NO: 1101182 - protein, 9 aa, Homo Sapiens
HTMATRTHQ

SEQ ID NO: 1101183 - protein, 9 aa, Homo Sapiens
TCVCWPSFS

SEQ ID NO: 1101184 - protein, 9 aa, Homo Sapiens
PKSKRRCGL

SEQ ID NO: 1101185 - protein, 9 aa, Homo Sapiens
MLTVIGQGL

SEQ ID NO: 1101186 - protein, 9 aa, Homo Sapiens
SGILLVMAL

SEQ ID NO: 1101187 - protein, 9 aa, Homo Sapiens
RSVKIFDVC

SEQ ID NO: 1101188 - protein, 9 aa, Homo Sapiens
RSWPRPPCS

SEQ ID NO: 1101189 - protein, 9 aa, Homo Sapiens
QMGHPAEKL

SEQ ID NO: 1101190 - protein, 9 aa, Homo Sapiens
SVVEIRMAE

SEQ ID NO: 1101191 - protein, 9 aa, Homo Sapiens
MEAVRWVQL

SEQ ID NO: 1101192 - protein, 9 aa, Homo Sapiens
PVDNHVGPS

SEQ ID NO: 1101193 - protein, 9 aa, Homo Sapiens
RMPGPPWPT

SEQ ID NO: 1101194 - protein, 9 aa, Homo Sapiens
WPVCLPNPE

SEQ ID NO: 1101195 - protein, 9 aa, Homo Sapiens
HDRDMAQGV

SEQ ID NO: 1101196 - protein, 9 aa, Homo Sapiens
QYLTPLIIT

SEQ ID NO: 1101197 - protein, 9 aa, Homo Sapiens
GVPALPQRG

SEQ ID NO: 1101198 - protein, 9 aa, Homo Sapiens
VVGQGIRGT

SEQ ID NO: 1101199 - protein, 9 aa, Homo Sapiens
THPCTMLLP

SEQ ID NO: 1101200 - protein, 9 aa, Homo Sapiens
KFYCSVDYN

SEQ ID NO: 1101201 - protein, 9 aa, Homo Sapiens
KNPNLIQVG

SEQ ID NO: 1101202 - protein, 9 aa, Homo Sapiens
LQFSKDIII

SEQ ID NO: 1101203 - protein, 9 aa, Homo Sapiens
DPPSSRCWA

SEQ ID NO: 1101204 - protein, 9 aa, Homo Sapiens
PAARRGGIL

SEQ ID NO: 1101205 - protein, 9 aa, Homo Sapiens
HTSRNCTAA

SEQ ID NO: 1101206 - protein, 9 aa, Homo Sapiens
RIGGLCSGE

SEQ ID NO: 1101207 - protein, 9 aa, Homo Sapiens
EAQHHIAPG

SEQ ID NO: 1101208 - protein, 9 aa, Homo Sapiens
SVEKNSSSS

SEQ ID NO: 1101209 - protein, 9 aa, Homo Sapiens
RYFEYKSPE

SEQ ID NO: 1101210 - protein, 9 aa, Homo Sapiens
RGARPRGAV

SEQ ID NO: 1101211 - protein, 9 aa, Homo Sapiens
TPSKQPGST

SEQ ID NO: 1101212 - protein, 9 aa, Homo Sapiens
RRPVRPGCR

SEQ ID NO: 1101213 - protein, 9 aa, Homo Sapiens
PTARRASPA

SEQ ID NO: 1101214 - protein, 9 aa, Homo Sapiens
PRPGAAASL

SEQ ID NO: 1101215 - protein, 9 aa, Homo Sapiens
RQKAMHVDA

SEQ ID NO: 1101216 - protein, 9 aa, Homo Sapiens
FLRILEQKF

SEQ ID NO: 1101217 - protein, 9 aa, Homo Sapiens
KPEEASRSS

SEQ ID NO: 1101218 - protein, 9 aa, Homo Sapiens
SIIVVILIE

SEQ ID NO: 1101219 - protein, 9 aa, Homo Sapiens
SWKQSQQSL

SEQ ID NO: 1101220 - protein, 9 aa, Homo Sapiens
GRVHWCVNP

SEQ ID NO: 1101221 - protein, 9 aa, Homo Sapiens
STCGCSRMA

SEQ ID NO: 1101222 - protein, 9 aa, Homo Sapiens
MPPPANPQL

SEQ ID NO: 1101223 - protein, 9 aa, Homo Sapiens
HSAKQHITL

SEQ ID NO: 1101224 - protein, 9 aa, Homo Sapiens
RGAGLQVTM

SEQ ID NO: 1101225 - protein, 9 aa, Homo Sapiens
VQKRGLLRS

SEQ ID NO: 1101226 - protein, 9 aa, Homo Sapiens
GCPAGGPCL

SEQ ID NO: 1101227 - protein, 9 aa, Homo Sapiens
EWDHAVVVG

SEQ ID NO: 1101228 - protein, 9 aa, Homo Sapiens
LSSCVALFK

SEQ ID NO: 1101229 - protein, 9 aa, Homo Sapiens
CSQGERCWR

SEQ ID NO: 1101230 - protein, 9 aa, Homo Sapiens
GLWTLHAFG

SEQ ID NO: 1101231 - protein, 9 aa, Homo Sapiens
VRSPSGQRM

SEQ ID NO: 1101232 - protein, 9 aa, Homo Sapiens
PQGLLAEDP

SEQ ID NO: 1101233 - protein, 9 aa, Homo Sapiens
EALVAELAL

SEQ ID NO: 1101234 - protein, 9 aa, Homo Sapiens
NFEELFKVL

SEQ ID NO: 1101235 - protein, 9 aa, Homo Sapiens
EETRVSVVE

SEQ ID NO: 1101236 - protein, 9 aa, Homo Sapiens
RPGAPAAVS

SEQ ID NO: 1101237 - protein, 9 aa, Homo Sapiens
INWFLPGGK

SEQ ID NO: 1101238 - protein, 9 aa, Homo Sapiens
PLPPPVWAV

SEQ ID NO: 1101239 - protein, 9 aa, Homo Sapiens
GHPQPRPST

SEQ ID NO: 1101240 - protein, 9 aa, Homo Sapiens
QGLSRLCIS

SEQ ID NO: 1101241 - protein, 9 aa, Homo Sapiens
VLELVLHKG

SEQ ID NO: 1101242 - protein, 9 aa, Homo Sapiens
QMLSVGKAK

SEQ ID NO: 1101243 - protein, 9 aa, Homo Sapiens
PLVAPRQTP

SEQ ID NO: 1101244 - protein, 9 aa, Homo Sapiens
RRAAQLCGL

SEQ ID NO: 1101245 - protein, 9 aa, Homo Sapiens
RGPRAPDPP

SEQ ID NO: 1101246 - protein, 9 aa, Homo Sapiens
QNRSLLVLA

SEQ ID NO: 1101247 - protein, 9 aa, Homo Sapiens
VAAGESAGC

SEQ ID NO: 1101248 - protein, 9 aa, Homo Sapiens
STRSPPLWT

SEQ ID NO: 1101249 - protein, 9 aa, Homo Sapiens
SVSARGPVR

SEQ ID NO: 1101250 - protein, 9 aa, Homo Sapiens
AARTTTLQR

SEQ ID NO: 1101251 - protein, 9 aa, Homo Sapiens
PRTDSQGRS

SEQ ID NO: 1101252 - protein, 9 aa, Homo Sapiens
SGSFVPNNP

SEQ ID NO: 1101253 - protein, 9 aa, Homo Sapiens
VGEEIAEAL

SEQ ID NO: 1101254 - protein, 9 aa, Homo Sapiens
ITISLAIAA

SEQ ID NO: 1101255 - protein, 9 aa, Homo Sapiens
GKISGVNTK

SEQ ID NO: 1101256 - protein, 9 aa, Homo Sapiens
ILTNTRVIV

SEQ ID NO: 1101257 - protein, 9 aa, Homo Sapiens
CNSSPNSLE

SEQ ID NO: 1101258 - protein, 9 aa, Homo Sapiens
TLTVVTVDH

SEQ ID NO: 1101259 - protein, 9 aa, Homo Sapiens
QRPWEKNST

SEQ ID NO: 1101260 - protein, 9 aa, Homo Sapiens
RLEDHQSFR

SEQ ID NO: 1101261 - protein, 9 aa, Homo Sapiens
PRPPSAGAL

SEQ ID NO: 1101262 - protein, 9 aa, Homo Sapiens
FMQKWKKSD

SEQ ID NO: 1101263 - protein, 9 aa, Homo Sapiens
LQDLSKLST

SEQ ID NO: 1101264 - protein, 9 aa, Homo Sapiens
LVDAQKPLF

SEQ ID NO: 1101265 - protein, 9 aa, Homo Sapiens
RQVGLQIWV

SEQ ID NO: 1101266 - protein, 9 aa, Homo Sapiens
LVLHKGLDR

SEQ ID NO: 1101267 - protein, 9 aa, Homo Sapiens
NKWESRKEK

SEQ ID NO: 1101268 - protein, 9 aa, Homo Sapiens
NALCRPSPQ

SEQ ID NO: 1101269 - protein, 9 aa, Homo Sapiens
AQGVSSAPR

SEQ ID NO: 1101270 - protein, 9 aa, Homo Sapiens
SQPPPQAPS

SEQ ID NO: 1101271 - protein, 9 aa, Homo Sapiens
SGTYNCGPT

SEQ ID NO: 1101272 - protein, 9 aa, Homo Sapiens
WKTKKTSFS

SEQ ID NO: 1101273 - protein, 9 aa, Homo Sapiens
WPSPQQRNW

SEQ ID NO: 1101274 - protein, 9 aa, Homo Sapiens
PNPGVGLGV

SEQ ID NO: 1101275 - protein, 9 aa, Homo Sapiens
AASMDHSSV

SEQ ID NO: 1101276 - protein, 9 aa, Homo Sapiens
GQFLQVSVH

SEQ ID NO: 1101277 - protein, 9 aa, Homo Sapiens
RALPVAADL

SEQ ID NO: 1101278 - protein, 9 aa, Homo Sapiens
RMRLRKLQS

SEQ ID NO: 1101279 - protein, 9 aa, Homo Sapiens
EIVSRVSSV

SEQ ID NO: 1101280 - protein, 9 aa, Homo Sapiens
NDKFIYVAQ

SEQ ID NO: 1101281 - protein, 9 aa, Homo Sapiens
GRHGSVRCW

SEQ ID NO: 1101282 - protein, 9 aa, Homo Sapiens
HPVKKLSRN

SEQ ID NO: 1101283 - protein, 9 aa, Homo Sapiens
SPCHSPRIC

SEQ ID NO: 1101284 - protein, 9 aa, Homo Sapiens
EEAMHRERN

SEQ ID NO: 1101285 - protein, 9 aa, Homo Sapiens
DQGVLDSEL

SEQ ID NO: 1101286 - protein, 9 aa, Homo Sapiens
HLFPRVLLR

SEQ ID NO: 1101287 - protein, 9 aa, Homo Sapiens
ETFLSKACL

SEQ ID NO: 1101288 - protein, 9 aa, Homo Sapiens
ALPACRAEY

SEQ ID NO: 1101289 - protein, 9 aa, Homo Sapiens
VADGEEQRR

SEQ ID NO: 1101290 - protein, 9 aa, Homo Sapiens
LFFIREGTA

SEQ ID NO: 1101291 - protein, 9 aa, Homo Sapiens
YPLLSTCCQ

SEQ ID NO: 1101292 - protein, 9 aa, Homo Sapiens
ILICQQQRK

SEQ ID NO: 1101293 - protein, 9 aa, Homo Sapiens
REKPRREKR

SEQ ID NO: 1101294 - protein, 9 aa, Homo Sapiens
FSIRRWSTI

SEQ ID NO: 1101295 - protein, 9 aa, Homo Sapiens
LVHCQVGIS

SEQ ID NO: 1101296 - protein, 9 aa, Homo Sapiens
SVSFHHLAF

SEQ ID NO: 1101297 - protein, 9 aa, Homo Sapiens
ATYTPRHPR

SEQ ID NO: 1101298 - protein, 9 aa, Homo Sapiens
GIVKLTQIV

SEQ ID NO: 1101299 - protein, 9 aa, Homo Sapiens
EAEREARRH

SEQ ID NO: 1101300 - protein, 9 aa, Homo Sapiens
VQAVVILCS

SEQ ID NO: 1101301 - protein, 9 aa, Homo Sapiens
EIHKIMRML

SEQ ID NO: 1101302 - protein, 9 aa, Homo Sapiens
QAPPSCIKT

SEQ ID NO: 1101303 - protein, 9 aa, Homo Sapiens
EGRLRYPSQ

SEQ ID NO: 1101304 - protein, 9 aa, Homo Sapiens
TERELRMGL

SEQ ID NO: 1101305 - protein, 9 aa, Homo Sapiens
RYFFENENV

SEQ ID NO: 1101306 - protein, 9 aa, Homo Sapiens
VELNWSAFL

SEQ ID NO: 1101307 - protein, 9 aa, Homo Sapiens
KCLTVDEAV

SEQ ID NO: 1101308 - protein, 9 aa, Homo Sapiens
STWIIPANV

SEQ ID NO: 1101309 - protein, 9 aa, Homo Sapiens
VVEWSPHRP

SEQ ID NO: 1101310 - protein, 9 aa, Homo Sapiens
WTLCSSTPT

SEQ ID NO: 1101311 - protein, 9 aa, Homo Sapiens
THHRNRELK

SEQ ID NO: 1101312 - protein, 9 aa, Homo Sapiens
SLAVTERRE

SEQ ID NO: 1101313 - protein, 9 aa, Homo Sapiens
APLLALPPR

SEQ ID NO: 1101314 - protein, 9 aa, Homo Sapiens
TVHVTGNPK

SEQ ID NO: 1101315 - protein, 9 aa, Homo Sapiens
FAAWKILGC

SEQ ID NO: 1101316 - protein, 9 aa, Homo Sapiens
ADEEEEADD

SEQ ID NO: 1101317 - protein, 9 aa, Homo Sapiens
CRAMTKNTS

SEQ ID NO: 1101318 - protein, 9 aa, Homo Sapiens
PWTPGQPRG

SEQ ID NO: 1101319 - protein, 9 aa, Homo Sapiens
GSPRSSAQG

SEQ ID NO: 1101320 - protein, 9 aa, Homo Sapiens
GSDRKKEDV

SEQ ID NO: 1101321 - protein, 9 aa, Homo Sapiens
EHSMGSRQP

SEQ ID NO: 1101322 - protein, 9 aa, Homo Sapiens
KIEVAKMGT

SEQ ID NO: 1101323 - protein, 9 aa, Homo Sapiens
CTNSSYGGP

SEQ ID NO: 1101324 - protein, 9 aa, Homo Sapiens
TSPHLMCGT

SEQ ID NO: 1101325 - protein, 9 aa, Homo Sapiens
PGGSPCTAC

SEQ ID NO: 1101326 - protein, 9 aa, Homo Sapiens
HYDNQKVVL

SEQ ID NO: 1101327 - protein, 9 aa, Homo Sapiens
EQYRTITTA

SEQ ID NO: 1101328 - protein, 9 aa, Homo Sapiens
RVHWCVNPS

SEQ ID NO: 1101329 - protein, 9 aa, Homo Sapiens
HVDFLAGDR

SEQ ID NO: 1101330 - protein, 9 aa, Homo Sapiens
RILMELRGA

SEQ ID NO: 1101331 - protein, 9 aa, Homo Sapiens
TWAPMRSKR

SEQ ID NO: 1101332 - protein, 9 aa, Homo Sapiens
PTSPGTCHQ

SEQ ID NO: 1101333 - protein, 9 aa, Homo Sapiens
RIGNGVPSM

SEQ ID NO: 1101334 - protein, 9 aa, Homo Sapiens
PTGRTPTTR

SEQ ID NO: 1101335 - protein, 9 aa, Homo Sapiens
DNIENEADI

SEQ ID NO: 1101336 - protein, 9 aa, Homo Sapiens
VVHPIKVAR

SEQ ID NO: 1101337 - protein, 9 aa, Homo Sapiens
CLGPRDAPG

SEQ ID NO: 1101338 - protein, 9 aa, Homo Sapiens
LLLLLLLDL

SEQ ID NO: 1101339 - protein, 9 aa, Homo Sapiens
VAVQVVRAR

SEQ ID NO: 1101340 - protein, 9 aa, Homo Sapiens
THCVQALHV

SEQ ID NO: 1101341 - protein, 9 aa, Homo Sapiens
AVQESWPGL

SEQ ID NO: 1101342 - protein, 9 aa, Homo Sapiens
IESPEDHIG

SEQ ID NO: 1101343 - protein, 9 aa, Homo Sapiens
RSHHNDIML

SEQ ID NO: 1101344 - protein, 9 aa, Homo Sapiens
PWDTERNLR

SEQ ID NO: 1101345 - protein, 9 aa, Homo Sapiens
AFHGKFYET

SEQ ID NO: 1101346 - protein, 9 aa, Homo Sapiens
VTGQDPEPA

SEQ ID NO: 1101347 - protein, 9 aa, Homo Sapiens
GNRHFKAHH

SEQ ID NO: 1101348 - protein, 9 aa, Homo Sapiens
PVTSKDFSH

SEQ ID NO: 1101349 - protein, 9 aa, Homo Sapiens
QPPKKPRHG

SEQ ID NO: 1101350 - protein, 9 aa, Homo Sapiens
ESAGCSPGE

SEQ ID NO: 1101351 - protein, 9 aa, Homo Sapiens
ARAGRGSLL

SEQ ID NO: 1101352 - protein, 9 aa, Homo Sapiens
TKSGPLISD

SEQ ID NO: 1101353 - protein, 9 aa, Homo Sapiens
SQPPSPSSL

SEQ ID NO: 1101354 - protein, 9 aa, Homo Sapiens
NLEAVNRAR

SEQ ID NO: 1101355 - protein, 9 aa, Homo Sapiens
FADAFFLVV

SEQ ID NO: 1101356 - protein, 9 aa, Homo Sapiens
LFLASLPSR

SEQ ID NO: 1101357 - protein, 9 aa, Homo Sapiens
IRFTVRTCV

SEQ ID NO: 1101358 - protein, 9 aa, Homo Sapiens
SLFSSEENN

SEQ ID NO: 1101359 - protein, 9 aa, Homo Sapiens
RPRPAADMQ

SEQ ID NO: 1101360 - protein, 9 aa, Homo Sapiens
VEKATFMPR

SEQ ID NO: 1101361 - protein, 9 aa, Homo Sapiens
IHYLHFAVT

SEQ ID NO: 1101362 - protein, 9 aa, Homo Sapiens
RQDPRSQKV

SEQ ID NO: 1101363 - protein, 9 aa, Homo Sapiens
VTHLRPVPR

SEQ ID NO: 1101364 - protein, 9 aa, Homo Sapiens
SYCLMQLGC

SEQ ID NO: 1101365 - protein, 9 aa, Homo Sapiens
GQTEEATVV

SEQ ID NO: 1101366 - protein, 9 aa, Homo Sapiens
VAVCTDSAV

SEQ ID NO: 1101367 - protein, 9 aa, Homo Sapiens
AHSMCKQNV

SEQ ID NO: 1101368 - protein, 9 aa, Homo Sapiens
SVCKFTEKH

SEQ ID NO: 1101369 - protein, 9 aa, Homo Sapiens
QVLRKLKQM

SEQ ID NO: 1101370 - protein, 9 aa, Homo Sapiens
PCPAPGPSP

SEQ ID NO: 1101371 - protein, 9 aa, Homo Sapiens
TSPPAGAVV

SEQ ID NO: 1101372 - protein, 9 aa, Homo Sapiens
IMEKLSEAM

SEQ ID NO: 1101373 - protein, 9 aa, Homo Sapiens
NQPPHPVLI

SEQ ID NO: 1101374 - protein, 9 aa, Homo Sapiens
LWMENEHVC

SEQ ID NO: 1101375 - protein, 9 aa, Homo Sapiens
CPPLEVHLH

SEQ ID NO: 1101376 - protein, 9 aa, Homo Sapiens
RSPGGLGTA

SEQ ID NO: 1101377 - protein, 9 aa, Homo Sapiens
HTHWTIQKG

SEQ ID NO: 1101378 - protein, 9 aa, Homo Sapiens
RELCMQMLG

SEQ ID NO: 1101379 - protein, 9 aa, Homo Sapiens
LRARQVLGL

SEQ ID NO: 1101380 - protein, 9 aa, Homo Sapiens
PDRPCSLPR

SEQ ID NO: 1101381 - protein, 9 aa, Homo Sapiens
YLYTSSSVL

SEQ ID NO: 1101382 - protein, 9 aa, Homo Sapiens
KTIEIGNSL

SEQ ID NO: 1101383 - protein, 9 aa, Homo Sapiens
CSIARLNKC

SEQ ID NO: 1101384 - protein, 9 aa, Homo Sapiens
MMNSSNLLC

SEQ ID NO: 1101385 - protein, 9 aa, Homo Sapiens
KLIMWDPDH

SEQ ID NO: 1101386 - protein, 9 aa, Homo Sapiens
RASHRTSPV

SEQ ID NO: 1101387 - protein, 9 aa, Homo Sapiens
RRGTSVLGG

SEQ ID NO: 1101388 - protein, 9 aa, Homo Sapiens
SAPCGLSTS

SEQ ID NO: 1101389 - protein, 9 aa, Homo Sapiens
WHIRSSGAL

SEQ ID NO: 1101390 - protein, 9 aa, Homo Sapiens
EGTRPSWAW

SEQ ID NO: 1101391 - protein, 9 aa, Homo Sapiens
FPGARSHWG

SEQ ID NO: 1101392 - protein, 9 aa, Homo Sapiens
PIFRDFLNQ

SEQ ID NO: 1101393 - protein, 9 aa, Homo Sapiens
LVYLRAARS

SEQ ID NO: 1101394 - protein, 9 aa, Homo Sapiens
VALIVASAS

SEQ ID NO: 1101395 - protein, 9 aa, Homo Sapiens
ETYISGTNC

SEQ ID NO: 1101396 - protein, 9 aa, Homo Sapiens
AGPRGQPNY

SEQ ID NO: 1101397 - protein, 9 aa, Homo Sapiens
QSPEAEVRH

SEQ ID NO: 1101398 - protein, 9 aa, Homo Sapiens
FPGSLSGLT

SEQ ID NO: 1101399 - protein, 9 aa, Homo Sapiens
RLIKINFIP

SEQ ID NO: 1101400 - protein, 9 aa, Homo Sapiens
TFILLQLKR

SEQ ID NO: 1101401 - protein, 9 aa, Homo Sapiens
LICCLSRLL

SEQ ID NO: 1101402 - protein, 9 aa, Homo Sapiens
LGLIGLYGF

SEQ ID NO: 1101403 - protein, 9 aa, Homo Sapiens
GGGGLLQPK

SEQ ID NO: 1101404 - protein, 9 aa, Homo Sapiens
LNYSCIVEN

SEQ ID NO: 1101405 - protein, 9 aa, Homo Sapiens
ATKSLSRIS

SEQ ID NO: 1101406 - protein, 9 aa, Homo Sapiens
RLHTPEGYR

SEQ ID NO: 1101407 - protein, 9 aa, Homo Sapiens
TPIFFDMMQ

SEQ ID NO: 1101408 - protein, 9 aa, Homo Sapiens
SSVISDCTE

SEQ ID NO: 1101409 - protein, 9 aa, Homo Sapiens
EKHQDGEKL

SEQ ID NO: 1101410 - protein, 9 aa, Homo Sapiens
SMWTSRTSP

SEQ ID NO: 1101411 - protein, 9 aa, Homo Sapiens
TAWKTKKTS

SEQ ID NO: 1101412 - protein, 9 aa, Homo Sapiens
YRPAARRGG

SEQ ID NO: 1101413 - protein, 9 aa, Homo Sapiens
LSIMTRASH

SEQ ID NO: 1101414 - protein, 9 aa, Homo Sapiens
DGGRHLTHL

SEQ ID NO: 1101415 - protein, 9 aa, Homo Sapiens
GPTTVGNGH

SEQ ID NO: 1101416 - protein, 9 aa, Homo Sapiens
RGRLPHGQL

SEQ ID NO: 1101417 - protein, 9 aa, Homo Sapiens
MVSYDIPVE

SEQ ID NO: 1101418 - protein, 9 aa, Homo Sapiens
LPVACEEAR

SEQ ID NO: 1101419 - protein, 9 aa, Homo Sapiens
REMALRASL

SEQ ID NO: 1101420 - protein, 9 aa, Homo Sapiens
RPADDPLHH

SEQ ID NO: 1101421 - protein, 9 aa, Homo Sapiens
YVDDGLSRV

SEQ ID NO: 1101422 - protein, 9 aa, Homo Sapiens
EAFAGAVKV

SEQ ID NO: 1101423 - protein, 9 aa, Homo Sapiens
GAALQTGPG

SEQ ID NO: 1101424 - protein, 9 aa, Homo Sapiens
DADSGHNTW

SEQ ID NO: 1101425 - protein, 9 aa, Homo Sapiens
HLVLAVVKI

SEQ ID NO: 1101426 - protein, 9 aa, Homo Sapiens
RQLRVPDTH

SEQ ID NO: 1101427 - protein, 9 aa, Homo Sapiens
LLLFIISQP

SEQ ID NO: 1101428 - protein, 9 aa, Homo Sapiens
ATDAKGQTE

SEQ ID NO: 1101429 - protein, 9 aa, Homo Sapiens
LEAGKRGRR

SEQ ID NO: 1101430 - protein, 9 aa, Homo Sapiens
VGGQVGHGV

SEQ ID NO: 1101431 - protein, 9 aa, Homo Sapiens
APKTRTESA

SEQ ID NO: 1101432 - protein, 9 aa, Homo Sapiens
SLPDKKKGT

SEQ ID NO: 1101433 - protein, 9 aa, Homo Sapiens
NRGDDTPCI

SEQ ID NO: 1101434 - protein, 9 aa, Homo Sapiens
GSNSYCLMQ

SEQ ID NO: 1101435 - protein, 9 aa, Homo Sapiens
GAGLQVTMH

SEQ ID NO: 1101436 - protein, 9 aa, Homo Sapiens
ELQCSFFDK

SEQ ID NO: 1101437 - protein, 9 aa, Homo Sapiens
IKNRISPLL

SEQ ID NO: 1101438 - protein, 9 aa, Homo Sapiens
AAQKILLSS

SEQ ID NO: 1101439 - protein, 9 aa, Homo Sapiens
ECSLHNKMC

SEQ ID NO: 1101440 - protein, 9 aa, Homo Sapiens
AWKILGCDR

SEQ ID NO: 1101441 - protein, 9 aa, Homo Sapiens
CQLLFPSTM

SEQ ID NO: 1101442 - protein, 9 aa, Homo Sapiens
RNCTAALCR

SEQ ID NO: 1101443 - protein, 9 aa, Homo Sapiens
QLPRPLPHP

SEQ ID NO: 1101444 - protein, 9 aa, Homo Sapiens
DDIIEQKSM

SEQ ID NO: 1101445 - protein, 9 aa, Homo Sapiens
TDARDGQSQ

SEQ ID NO: 1101446 - protein, 9 aa, Homo Sapiens
RPHEFWPDH

SEQ ID NO: 1101447 - protein, 9 aa, Homo Sapiens
LGLLQGRGP

SEQ ID NO: 1101448 - protein, 9 aa, Homo Sapiens
EIGTVVVLR

SEQ ID NO: 1101449 - protein, 9 aa, Homo Sapiens
WFKNDRILE

SEQ ID NO: 1101450 - protein, 9 aa, Homo Sapiens
SLRPAPHGL

SEQ ID NO: 1101451 - protein, 9 aa, Homo Sapiens
LTQPSPASA

SEQ ID NO: 1101452 - protein, 9 aa, Homo Sapiens
CEPCPAVTD

SEQ ID NO: 1101453 - protein, 9 aa, Homo Sapiens
KQGPLKSMN

SEQ ID NO: 1101454 - protein, 9 aa, Homo Sapiens
RQMALRANM

SEQ ID NO: 1101455 - protein, 9 aa, Homo Sapiens
SREIANEYK

SEQ ID NO: 1101456 - protein, 9 aa, Homo Sapiens
HQHRNVCYC

SEQ ID NO: 1101457 - protein, 9 aa, Homo Sapiens
QELQSHPRA

SEQ ID NO: 1101458 - protein, 9 aa, Homo Sapiens
EEEEAMHRE

SEQ ID NO: 1101459 - protein, 9 aa, Homo Sapiens
TQVHKLARS

SEQ ID NO: 1101460 - protein, 9 aa, Homo Sapiens
LITVATAVV

SEQ ID NO: 1101461 - protein, 9 aa, Homo Sapiens
IRAARETRS

SEQ ID NO: 1101462 - protein, 9 aa, Homo Sapiens
HVARFTRSG

SEQ ID NO: 1101463 - protein, 9 aa, Homo Sapiens
GQRVTVMCG

SEQ ID NO: 1101464 - protein, 9 aa, Homo Sapiens
RRVHHLHAR

SEQ ID NO: 1101465 - protein, 9 aa, Homo Sapiens
MLTPSGSAS

SEQ ID NO: 1101466 - protein, 9 aa, Homo Sapiens
GFLICCLSR

SEQ ID NO: 1101467 - protein, 9 aa, Homo Sapiens
RTESATRST

SEQ ID NO: 1101468 - protein, 9 aa, Homo Sapiens
WTIRHCTLT

SEQ ID NO: 1101469 - protein, 9 aa, Homo Sapiens
KKSLLQAMA

SEQ ID NO: 1101470 - protein, 9 aa, Homo Sapiens
TPTSALALP

SEQ ID NO: 1101471 - protein, 9 aa, Homo Sapiens
GPDWHWGAA

SEQ ID NO: 1101472 - protein, 9 aa, Homo Sapiens
ENGGGGDSA

SEQ ID NO: 1101473 - protein, 9 aa, Homo Sapiens
NLFKLIVNL

SEQ ID NO: 1101474 - protein, 9 aa, Homo Sapiens
RCRKTRRER

SEQ ID NO: 1101475 - protein, 9 aa, Homo Sapiens
CPPSRAASL

SEQ ID NO: 1101476 - protein, 9 aa, Homo Sapiens
CTIYLNITN

SEQ ID NO: 1101477 - protein, 9 aa, Homo Sapiens
SPSPSPSQA

SEQ ID NO: 1101478 - protein, 9 aa, Homo Sapiens
TISKLRQVG

SEQ ID NO: 1101479 - protein, 9 aa, Homo Sapiens
LVRAPNVIL

SEQ ID NO: 1101480 - protein, 9 aa, Homo Sapiens
IQSNPAKCL

SEQ ID NO: 1101481 - protein, 9 aa, Homo Sapiens
GLPSGAISV

SEQ ID NO: 1101482 - protein, 9 aa, Homo Sapiens
KWSSKLTAH

SEQ ID NO: 1101483 - protein, 9 aa, Homo Sapiens
VLSPVNTQP

SEQ ID NO: 1101484 - protein, 9 aa, Homo Sapiens
REIHRVPTQ

SEQ ID NO: 1101485 - protein, 9 aa, Homo Sapiens
VVTVTHLRP

SEQ ID NO: 1101486 - protein, 9 aa, Homo Sapiens
LTYALSSHC

SEQ ID NO: 1101487 - protein, 9 aa, Homo Sapiens
AYKEPYFVY

SEQ ID NO: 1101488 - protein, 9 aa, Homo Sapiens
ALALPHLPV

SEQ ID NO: 1101489 - protein, 9 aa, Homo Sapiens
GALQSPGPR

SEQ ID NO: 1101490 - protein, 9 aa, Homo Sapiens
IMAFGVQKP

SEQ ID NO: 1101491 - protein, 9 aa, Homo Sapiens
PEKLALKED

SEQ ID NO: 1101492 - protein, 9 aa, Homo Sapiens
WSLATGQPA

SEQ ID NO: 1101493 - protein, 9 aa, Homo Sapiens
VEPLHGAAA

SEQ ID NO: 1101494 - protein, 9 aa, Homo Sapiens
AAAVISDDQ

SEQ ID NO: 1101495 - protein, 9 aa, Homo Sapiens
RTPTTRLMA

SEQ ID NO: 1101496 - protein, 9 aa, Homo Sapiens
AAVMTAAGI

SEQ ID NO: 1101497 - protein, 9 aa, Homo Sapiens
GLPSHVDFL

SEQ ID NO: 1101498 - protein, 9 aa, Homo Sapiens
AVQGHASCL

SEQ ID NO: 1101499 - protein, 9 aa, Homo Sapiens
VPVSHSLRG

SEQ ID NO: 1101500 - protein, 9 aa, Homo Sapiens
GARLLLQIT

SEQ ID NO: 1101501 - protein, 9 aa, Homo Sapiens
KLAHPHRAA

SEQ ID NO: 1101502 - protein, 9 aa, Homo Sapiens
HYLVVLATA

SEQ ID NO: 1101503 - protein, 9 aa, Homo Sapiens
LTDTTEEKW

SEQ ID NO: 1101504 - protein, 9 aa, Homo Sapiens
TFMPPPGHP

SEQ ID NO: 1101505 - protein, 9 aa, Homo Sapiens
GVPGRLCAP

SEQ ID NO: 1101506 - protein, 9 aa, Homo Sapiens
PRVLPRSLP

SEQ ID NO: 1101507 - protein, 9 aa, Homo Sapiens
VPGRLCAPG

SEQ ID NO: 1101508 - protein, 9 aa, Homo Sapiens
NDRGSVSGP

SEQ ID NO: 1101509 - protein, 9 aa, Homo Sapiens
GAPRLRMAS

SEQ ID NO: 1101510 - protein, 9 aa, Homo Sapiens
LKPSGEQIP

SEQ ID NO: 1101511 - protein, 9 aa, Homo Sapiens
DQVKKRKKR

SEQ ID NO: 1101512 - protein, 9 aa, Homo Sapiens
QVQGRGIGP

SEQ ID NO: 1101513 - protein, 9 aa, Homo Sapiens
GPRSSEGLL

SEQ ID NO: 1101514 - protein, 9 aa, Homo Sapiens
EAVRWVQLE

SEQ ID NO: 1101515 - protein, 9 aa, Homo Sapiens
RLGQPTSPG

SEQ ID NO: 1101516 - protein, 9 aa, Homo Sapiens
WLGNDNISQ

SEQ ID NO: 1101517 - protein, 9 aa, Homo Sapiens
RSTAPSPRA

SEQ ID NO: 1101518 - protein, 9 aa, Homo Sapiens
GVNIAGRSK

SEQ ID NO: 1101519 - protein, 9 aa, Homo Sapiens
CTPSLCEST

SEQ ID NO: 1101520 - protein, 9 aa, Homo Sapiens
STPSSYLEL

SEQ ID NO: 1101521 - protein, 9 aa, Homo Sapiens
PEHLGQELA

SEQ ID NO: 1101522 - protein, 9 aa, Homo Sapiens
AALREWGHC

SEQ ID NO: 1101523 - protein, 9 aa, Homo Sapiens
LFTPPKERP

SEQ ID NO: 1101524 - protein, 9 aa, Homo Sapiens
RGASTSSVT

SEQ ID NO: 1101525 - protein, 9 aa, Homo Sapiens
RGGRQGYPK

SEQ ID NO: 1101526 - protein, 9 aa, Homo Sapiens
CPPSPRQRR

SEQ ID NO: 1101527 - protein, 9 aa, Homo Sapiens
HPWGHHPNL

SEQ ID NO: 1101528 - protein, 9 aa, Homo Sapiens
WPPSFSAPC

SEQ ID NO: 1101529 - protein, 9 aa, Homo Sapiens
GTALVSSAC

SEQ ID NO: 1101530 - protein, 9 aa, Homo Sapiens
PRYEARSHH

SEQ ID NO: 1101531 - protein, 9 aa, Homo Sapiens
VSTDTSVEA

SEQ ID NO: 1101532 - protein, 9 aa, Homo Sapiens
QTRVPPGRA

SEQ ID NO: 1101533 - protein, 9 aa, Homo Sapiens
LRGCWVGYE

SEQ ID NO: 1101534 - protein, 9 aa, Homo Sapiens
LRPPTLWTL

SEQ ID NO: 1101535 - protein, 9 aa, Homo Sapiens
QGIKGKIRA

SEQ ID NO: 1101536 - protein, 9 aa, Homo Sapiens
RKKEATPKR

SEQ ID NO: 1101537 - protein, 9 aa, Homo Sapiens
GLLRQLGKG

SEQ ID NO: 1101538 - protein, 9 aa, Homo Sapiens
NAPVTCYYN

SEQ ID NO: 1101539 - protein, 9 aa, Homo Sapiens
PSQEPQETP

SEQ ID NO: 1101540 - protein, 9 aa, Homo Sapiens
HAPQSCSSL

SEQ ID NO: 1101541 - protein, 9 aa, Homo Sapiens
TVSCAVARN

SEQ ID NO: 1101542 - protein, 9 aa, Homo Sapiens
GACHAHKAG

SEQ ID NO: 1101543 - protein, 9 aa, Homo Sapiens
VQALHVHLC

SEQ ID NO: 1101544 - protein, 9 aa, Homo Sapiens
NVHIKNFGG

SEQ ID NO: 1101545 - protein, 9 aa, Homo Sapiens
SDHYQWFQV

SEQ ID NO: 1101546 - protein, 9 aa, Homo Sapiens
NKVLPMRWV

SEQ ID NO: 1101547 - protein, 9 aa, Homo Sapiens
LQGGHVDAS

SEQ ID NO: 1101548 - protein, 9 aa, Homo Sapiens
LIPLLGDQL

SEQ ID NO: 1101549 - protein, 9 aa, Homo Sapiens
EDDDDDDPT

SEQ ID NO: 1101550 - protein, 9 aa, Homo Sapiens
SRAGHVEPL

SEQ ID NO: 1101551 - protein, 9 aa, Homo Sapiens
HGQFQGHRE

SEQ ID NO: 1101552 - protein, 9 aa, Homo Sapiens
PDGAWAEAP

SEQ ID NO: 1101553 - protein, 9 aa, Homo Sapiens
IAGSGKTTF

SEQ ID NO: 1101554 - protein, 9 aa, Homo Sapiens
MGPPRKHSL

SEQ ID NO: 1101555 - protein, 9 aa, Homo Sapiens
VWVAALALG

SEQ ID NO: 1101556 - protein, 9 aa, Homo Sapiens
KRPHQIADL

SEQ ID NO: 1101557 - protein, 9 aa, Homo Sapiens
FYIFILSGN

SEQ ID NO: 1101558 - protein, 9 aa, Homo Sapiens
TRWPGPFCM

SEQ ID NO: 1101559 - protein, 9 aa, Homo Sapiens
LLSTPEEQG

SEQ ID NO: 1101560 - protein, 9 aa, Homo Sapiens
CSPGWMASP

SEQ ID NO: 1101561 - protein, 9 aa, Homo Sapiens
WASAVNVND

SEQ ID NO: 1101562 - protein, 9 aa, Homo Sapiens
PGAPAVPAA

SEQ ID NO: 1101563 - protein, 9 aa, Homo Sapiens
TIRHCTLTW

SEQ ID NO: 1101564 - protein, 9 aa, Homo Sapiens
AELQCSFFD

SEQ ID NO: 1101565 - protein, 9 aa, Homo Sapiens
ALTAAASMD

SEQ ID NO: 1101566 - protein, 9 aa, Homo Sapiens
GGRQGYPKE

SEQ ID NO: 1101567 - protein, 9 aa, Homo Sapiens
ILLYVLILL

SEQ ID NO: 1101568 - protein, 9 aa, Homo Sapiens
QEAVQEVAD

SEQ ID NO: 1101569 - protein, 9 aa, Homo Sapiens
AVLAWARAH

SEQ ID NO: 1101570 - protein, 9 aa, Homo Sapiens
WDHAVVVGV

SEQ ID NO: 1101571 - protein, 9 aa, Homo Sapiens
DQLVGGQVG

SEQ ID NO: 1101572 - protein, 9 aa, Homo Sapiens
ENQKEQTAL

SEQ ID NO: 1101573 - protein, 9 aa, Homo Sapiens
DTAGQEQYR

SEQ ID NO: 1101574 - protein, 9 aa, Homo Sapiens
GEDVAALLM

SEQ ID NO: 1101575 - protein, 9 aa, Homo Sapiens
PVEFTFKNL

SEQ ID NO: 1101576 - protein, 9 aa, Homo Sapiens
QGPSASAQL

SEQ ID NO: 1101577 - protein, 9 aa, Homo Sapiens
NIQVVVESF

SEQ ID NO: 1101578 - protein, 9 aa, Homo Sapiens
CEPPAAPPA

SEQ ID NO: 1101579 - protein, 9 aa, Homo Sapiens
QCTHLSRHQ

SEQ ID NO: 1101580 - protein, 9 aa, Homo Sapiens
VTKEETRAS

SEQ ID NO: 1101581 - protein, 9 aa, Homo Sapiens
PLVRAPNVI

SEQ ID NO: 1101582 - protein, 9 aa, Homo Sapiens
GLRGFQILG

SEQ ID NO: 1101583 - protein, 9 aa, Homo Sapiens
KRVWSRNVA

SEQ ID NO: 1101584 - protein, 9 aa, Homo Sapiens
TFHHKFGTL

SEQ ID NO: 1101585 - protein, 9 aa, Homo Sapiens
GKQGPLKSM

SEQ ID NO: 1101586 - protein, 9 aa, Homo Sapiens
GCTQGMVRL

SEQ ID NO: 1101587 - protein, 9 aa, Homo Sapiens
RVLRVLRIL

SEQ ID NO: 1101588 - protein, 9 aa, Homo Sapiens
LLALPPRGP

SEQ ID NO: 1101589 - protein, 9 aa, Homo Sapiens
TSALALPHL

SEQ ID NO: 1101590 - protein, 9 aa, Homo Sapiens
WWRVESDEA

SEQ ID NO: 1101591 - protein, 9 aa, Homo Sapiens
FIDFVCIFV

SEQ ID NO: 1101592 - protein, 9 aa, Homo Sapiens
SGPWRSRGT

SEQ ID NO: 1101593 - protein, 9 aa, Homo Sapiens
RKKFFEKKV

SEQ ID NO: 1101594 - protein, 9 aa, Homo Sapiens
GVLDFFSRS

SEQ ID NO: 1101595 - protein, 9 aa, Homo Sapiens
LNWSAFLEP

SEQ ID NO: 1101596 - protein, 9 aa, Homo Sapiens
RYRPRGARR

SEQ ID NO: 1101597 - protein, 9 aa, Homo Sapiens
GARDASAPW

SEQ ID NO: 1101598 - protein, 9 aa, Homo Sapiens
VLRILYVMR

SEQ ID NO: 1101599 - protein, 9 aa, Homo Sapiens
TRARGAPAL

SEQ ID NO: 1101600 - protein, 9 aa, Homo Sapiens
DDEEETPPR

SEQ ID NO: 1101601 - protein, 9 aa, Homo Sapiens
ILRLPCSGD

SEQ ID NO: 1101602 - protein, 9 aa, Homo Sapiens
ERPHNRRRE

SEQ ID NO: 1101603 - protein, 9 aa, Homo Sapiens
AISRSSHTG

SEQ ID NO: 1101604 - protein, 9 aa, Homo Sapiens
LQVIFQGIK

SEQ ID NO: 1101605 - protein, 9 aa, Homo Sapiens
LVGPHARVD

SEQ ID NO: 1101606 - protein, 9 aa, Homo Sapiens
SDLVDEGEG

SEQ ID NO: 1101607 - protein, 9 aa, Homo Sapiens
GARGTFHKG

SEQ ID NO: 1101608 - protein, 9 aa, Homo Sapiens
AHKVIHTGE

SEQ ID NO: 1101609 - protein, 9 aa, Homo Sapiens
PATQAPCMM

SEQ ID NO: 1101610 - protein, 9 aa, Homo Sapiens
ARMWTPRIE

SEQ ID NO: 1101611 - protein, 9 aa, Homo Sapiens
LFRRSGSGS

SEQ ID NO: 1101612 - protein, 9 aa, Homo Sapiens
CRGLGPVPS

SEQ ID NO: 1101613 - protein, 9 aa, Homo Sapiens
MPLILERTK

SEQ ID NO: 1101614 - protein, 9 aa, Homo Sapiens
EIALTISPF

SEQ ID NO: 1101615 - protein, 9 aa, Homo Sapiens
NTSMWTSRT

SEQ ID NO: 1101616 - protein, 9 aa, Homo Sapiens
CERAHTRRF

SEQ ID NO: 1101617 - protein, 9 aa, Homo Sapiens
IANEYKYKE

SEQ ID NO: 1101618 - protein, 9 aa, Homo Sapiens
RAGHVEPLH

SEQ ID NO: 1101619 - protein, 9 aa, Homo Sapiens
TRPGVKLWK

SEQ ID NO: 1101620 - protein, 9 aa, Homo Sapiens
LGALQSPGP

SEQ ID NO: 1101621 - protein, 9 aa, Homo Sapiens
PSFAQMLSV

SEQ ID NO: 1101622 - protein, 9 aa, Homo Sapiens
SGSNPPIFH

SEQ ID NO: 1101623 - protein, 9 aa, Homo Sapiens
QWSSYLSYI

SEQ ID NO: 1101624 - protein, 9 aa, Homo Sapiens
MRGTISCEH

SEQ ID NO: 1101625 - protein, 9 aa, Homo Sapiens
GQPGVRALG

SEQ ID NO: 1101626 - protein, 9 aa, Homo Sapiens
VAELQCSFF

SEQ ID NO: 1101627 - protein, 9 aa, Homo Sapiens
QRSHVGPGA

SEQ ID NO: 1101628 - protein, 9 aa, Homo Sapiens
YGSYPPARQ

SEQ ID NO: 1101629 - protein, 9 aa, Homo Sapiens
FLFKVGLIP

SEQ ID NO: 1101630 - protein, 9 aa, Homo Sapiens
EKHMCFHNM

SEQ ID NO: 1101631 - protein, 9 aa, Homo Sapiens
EGRPSCGRC

SEQ ID NO: 1101632 - protein, 9 aa, Homo Sapiens
DQRQSPKLV

SEQ ID NO: 1101633 - protein, 9 aa, Homo Sapiens
PILDDQIQW

SEQ ID NO: 1101634 - protein, 9 aa, Homo Sapiens
VSTSWGPTA

SEQ ID NO: 1101635 - protein, 9 aa, Homo Sapiens
LDCLLQQDK

SEQ ID NO: 1101636 - protein, 9 aa, Homo Sapiens
MSYYSSYYG

SEQ ID NO: 1101637 - protein, 9 aa, Homo Sapiens
MPTRRSLAP

SEQ ID NO: 1101638 - protein, 9 aa, Homo Sapiens
REIVQDFKT

SEQ ID NO: 1101639 - protein, 9 aa, Homo Sapiens
VFSFLLVIA

SEQ ID NO: 1101640 - protein, 9 aa, Homo Sapiens
TGSRMLKQN

SEQ ID NO: 1101641 - protein, 9 aa, Homo Sapiens
APASPGRRP

SEQ ID NO: 1101642 - protein, 9 aa, Homo Sapiens
GLSPGTTYC

SEQ ID NO: 1101643 - protein, 9 aa, Homo Sapiens
QELWYSVAL

SEQ ID NO: 1101644 - protein, 9 aa, Homo Sapiens
YSVYITENN

SEQ ID NO: 1101645 - protein, 9 aa, Homo Sapiens
AQRPRTPAP

SEQ ID NO: 1101646 - protein, 9 aa, Homo Sapiens
SLEELQMQL

SEQ ID NO: 1101647 - protein, 9 aa, Homo Sapiens
STHTSRNCT

SEQ ID NO: 1101648 - protein, 9 aa, Homo Sapiens
VYEVSVCEN

SEQ ID NO: 1101649 - protein, 9 aa, Homo Sapiens
TIQKGSFLG

SEQ ID NO: 1101650 - protein, 9 aa, Homo Sapiens
LCTGLGVIR

SEQ ID NO: 1101651 - protein, 9 aa, Homo Sapiens
QKLTIQKAL

SEQ ID NO: 1101652 - protein, 9 aa, Homo Sapiens
SEFIWERIK

SEQ ID NO: 1101653 - protein, 9 aa, Homo Sapiens
RRTRSAWGD

SEQ ID NO: 1101654 - protein, 9 aa, Homo Sapiens
ADDDDSERF

SEQ ID NO: 1101655 - protein, 9 aa, Homo Sapiens
LDHHLVTGQ

SEQ ID NO: 1101656 - protein, 9 aa, Homo Sapiens
LVTIDIQHP

SEQ ID NO: 1101657 - protein, 9 aa, Homo Sapiens
SQRPPRQVR

SEQ ID NO: 1101658 - protein, 9 aa, Homo Sapiens
AEGVCDDDT

SEQ ID NO: 1101659 - protein, 9 aa, Homo Sapiens
NKVPEIQYF

SEQ ID NO: 1101660 - protein, 9 aa, Homo Sapiens
KETLVTIDI

SEQ ID NO: 1101661 - protein, 9 aa, Homo Sapiens
LAPLGPAVL

SEQ ID NO: 1101662 - protein, 9 aa, Homo Sapiens
FPDEEDRKH

SEQ ID NO: 1101663 - protein, 9 aa, Homo Sapiens
VITQQGRVE

SEQ ID NO: 1101664 - protein, 9 aa, Homo Sapiens
IDHSGDPAG

SEQ ID NO: 1101665 - protein, 9 aa, Homo Sapiens
ADGALLRGL

SEQ ID NO: 1101666 - protein, 9 aa, Homo Sapiens
SGTAAPGPR

SEQ ID NO: 1101667 - protein, 9 aa, Homo Sapiens
HQESSQPKP

SEQ ID NO: 1101668 - protein, 9 aa, Homo Sapiens
TNCNDNETF

SEQ ID NO: 1101669 - protein, 9 aa, Homo Sapiens
KECTSAVDL

SEQ ID NO: 1101670 - protein, 9 aa, Homo Sapiens
AERPPGPHR

SEQ ID NO: 1101671 - protein, 9 aa, Homo Sapiens
VASCPAPHR

SEQ ID NO: 1101672 - protein, 9 aa, Homo Sapiens
SYIRYGFEG

SEQ ID NO: 1101673 - protein, 9 aa, Homo Sapiens
WARFQDSDM

SEQ ID NO: 1101674 - protein, 9 aa, Homo Sapiens
NGISKVGIH

SEQ ID NO: 1101675 - protein, 9 aa, Homo Sapiens
KQHITLNDL

SEQ ID NO: 1101676 - protein, 9 aa, Homo Sapiens
PRMPGPPWP

SEQ ID NO: 1101677 - protein, 9 aa, Homo Sapiens
TIAAPTTTF

SEQ ID NO: 1101678 - protein, 9 aa, Homo Sapiens
CHVIAWQQG

SEQ ID NO: 1101679 - protein, 9 aa, Homo Sapiens
YENIEKVKF

SEQ ID NO: 1101680 - protein, 9 aa, Homo Sapiens
GKTLPDISR

SEQ ID NO: 1101681 - protein, 9 aa, Homo Sapiens
GYSTTAFCL

SEQ ID NO: 1101682 - protein, 9 aa, Homo Sapiens
PQRPSNSRK

SEQ ID NO: 1101683 - protein, 9 aa, Homo Sapiens
YLNFIRWVV

SEQ ID NO: 1101684 - protein, 9 aa, Homo Sapiens
KKMTASQRS

SEQ ID NO: 1101685 - protein, 9 aa, Homo Sapiens
RVIWAPLGR

SEQ ID NO: 1101686 - protein, 9 aa, Homo Sapiens
MLCTGLGVI

SEQ ID NO: 1101687 - protein, 9 aa, Homo Sapiens
LFCGRGNHP

SEQ ID NO: 1101688 - protein, 9 aa, Homo Sapiens
QVSAGAPSS

SEQ ID NO: 1101689 - protein, 9 aa, Homo Sapiens
LPLMIKNRI

SEQ ID NO: 1101690 - protein, 9 aa, Homo Sapiens
FCNAAKKDP

SEQ ID NO: 1101691 - protein, 9 aa, Homo Sapiens
SETYTSKIN

SEQ ID NO: 1101692 - protein, 9 aa, Homo Sapiens
ASPARLGQP

SEQ ID NO: 1101693 - protein, 9 aa, Homo Sapiens
CLFPPFEES

SEQ ID NO: 1101694 - protein, 9 aa, Homo Sapiens
MCTNSSYGG

SEQ ID NO: 1101695 - protein, 9 aa, Homo Sapiens
DVMRETIRT

SEQ ID NO: 1101696 - protein, 9 aa, Homo Sapiens
FTEHFHFYK

SEQ ID NO: 1101697 - protein, 9 aa, Homo Sapiens
QSELSFAPP

SEQ ID NO: 1101698 - protein, 9 aa, Homo Sapiens
STGFVIHHY

SEQ ID NO: 1101699 - protein, 9 aa, Homo Sapiens
ALLSPASSM

SEQ ID NO: 1101700 - protein, 9 aa, Homo Sapiens
DGDQGPKGP

SEQ ID NO: 1101701 - protein, 9 aa, Homo Sapiens
WCMPGGAST

SEQ ID NO: 1101702 - protein, 9 aa, Homo Sapiens
EQDKETVSV

SEQ ID NO: 1101703 - protein, 9 aa, Homo Sapiens
ARDGQSQTV

SEQ ID NO: 1101704 - protein, 9 aa, Homo Sapiens
HHAWPGHFL

SEQ ID NO: 1101705 - protein, 9 aa, Homo Sapiens
QKVSSLFLP

SEQ ID NO: 1101706 - protein, 9 aa, Homo Sapiens
VLLDMAFDR

SEQ ID NO: 1101707 - protein, 9 aa, Homo Sapiens
SYILVKNHV

SEQ ID NO: 1101708 - protein, 9 aa, Homo Sapiens
LYGNMFSQT

SEQ ID NO: 1101709 - protein, 9 aa, Homo Sapiens
LGDQLVGGQ

SEQ ID NO: 1101710 - protein, 9 aa, Homo Sapiens
IDLDTDANG

SEQ ID NO: 1101711 - protein, 9 aa, Homo Sapiens
RGGVATPGR

SEQ ID NO: 1101712 - protein, 9 aa, Homo Sapiens
RGTHVDLRL

SEQ ID NO: 1101713 - protein, 9 aa, Homo Sapiens
FWTHTEAAH

SEQ ID NO: 1101714 - protein, 9 aa, Homo Sapiens
PMVPPHLGQ

SEQ ID NO: 1101715 - protein, 9 aa, Homo Sapiens
AYPPLPAAP

SEQ ID NO: 1101716 - protein, 9 aa, Homo Sapiens
KGLSGKKGE

SEQ ID NO: 1101717 - protein, 9 aa, Homo Sapiens
LGITQCKES

SEQ ID NO: 1101718 - protein, 9 aa, Homo Sapiens
AGGSKHGII

SEQ ID NO: 1101719 - protein, 9 aa, Homo Sapiens
RNIQLSIMT

SEQ ID NO: 1101720 - protein, 9 aa, Homo Sapiens
LTSASPMAA

SEQ ID NO: 1101721 - protein, 9 aa, Homo Sapiens
SENFEELFK

SEQ ID NO: 1101722 - protein, 9 aa, Homo Sapiens
APQTTPHWT

SEQ ID NO: 1101723 - protein, 9 aa, Homo Sapiens
RAPDPPPRP

SEQ ID NO: 1101724 - protein, 9 aa, Homo Sapiens
KTGCFKRPR

SEQ ID NO: 1101725 - protein, 9 aa, Homo Sapiens
VGVVHQVRP

SEQ ID NO: 1101726 - protein, 9 aa, Homo Sapiens
VETVQELTE

SEQ ID NO: 1101727 - protein, 9 aa, Homo Sapiens
LVGIVQCAH

SEQ ID NO: 1101728 - protein, 9 aa, Homo Sapiens
SRSHPMTPA

SEQ ID NO: 1101729 - protein, 9 aa, Homo Sapiens
WLPRLTRER

SEQ ID NO: 1101730 - protein, 9 aa, Homo Sapiens
VLFGYMQWV

SEQ ID NO: 1101731 - protein, 9 aa, Homo Sapiens
GETVNLRLQ

SEQ ID NO: 1101732 - protein, 9 aa, Homo Sapiens
TTEEKWRNR

SEQ ID NO: 1101733 - protein, 9 aa, Homo Sapiens
SVAKAATKS

SEQ ID NO: 1101734 - protein, 9 aa, Homo Sapiens
SHSMAAQIL

SEQ ID NO: 1101735 - protein, 9 aa, Homo Sapiens
VVAQATGEQ

SEQ ID NO: 1101736 - protein, 9 aa, Homo Sapiens
DSTSLSAGY

SEQ ID NO: 1101737 - protein, 9 aa, Homo Sapiens
PPARQPSRP

SEQ ID NO: 1101738 - protein, 9 aa, Homo Sapiens
SEWNWHGET

SEQ ID NO: 1101739 - protein, 9 aa, Homo Sapiens
SGPGGLPIF

SEQ ID NO: 1101740 - protein, 9 aa, Homo Sapiens
AVPGSPPGC

SEQ ID NO: 1101741 - protein, 9 aa, Homo Sapiens
EFQSTCVPG

SEQ ID NO: 1101742 - protein, 9 aa, Homo Sapiens
PASWQVTPD

SEQ ID NO: 1101743 - protein, 9 aa, Homo Sapiens
RREMREYAG

SEQ ID NO: 1101744 - protein, 9 aa, Homo Sapiens
ALLSFWPGG

SEQ ID NO: 1101745 - protein, 9 aa, Homo Sapiens
VQLDLHFPR

SEQ ID NO: 1101746 - protein, 9 aa, Homo Sapiens
KKLSRNILE

SEQ ID NO: 1101747 - protein, 9 aa, Homo Sapiens
LRRVLPRVL

SEQ ID NO: 1101748 - protein, 9 aa, Homo Sapiens
CGHCHQPDM

SEQ ID NO: 1101749 - protein, 9 aa, Homo Sapiens
RPRGAVAGR

SEQ ID NO: 1101750 - protein, 9 aa, Homo Sapiens
SNMDLTFIL

SEQ ID NO: 1101751 - protein, 9 aa, Homo Sapiens
DPDHYGTTV

SEQ ID NO: 1101752 - protein, 9 aa, Homo Sapiens
TCSQGERCW

SEQ ID NO: 1101753 - protein, 9 aa, Homo Sapiens
GTILLNQTA

SEQ ID NO: 1101754 - protein, 9 aa, Homo Sapiens
ESATRSTRS

SEQ ID NO: 1101755 - protein, 9 aa, Homo Sapiens
KKTHPCTML

SEQ ID NO: 1101756 - protein, 9 aa, Homo Sapiens
PSLAGSRRC

SEQ ID NO: 1101757 - protein, 9 aa, Homo Sapiens
TGFVIHHYA

SEQ ID NO: 1101758 - protein, 9 aa, Homo Sapiens
FLCLGPRDA

SEQ ID NO: 1101759 - protein, 9 aa, Homo Sapiens
METKDTKYV

SEQ ID NO: 1101760 - protein, 9 aa, Homo Sapiens
LHHLYYQDK

SEQ ID NO: 1101761 - protein, 9 aa, Homo Sapiens
EQPHAGEAG

SEQ ID NO: 1101762 - protein, 9 aa, Homo Sapiens
STPAPCLTH

SEQ ID NO: 1101763 - protein, 9 aa, Homo Sapiens
RSAEMEKIK

SEQ ID NO: 1101764 - protein, 9 aa, Homo Sapiens
WTRPSRFCI

SEQ ID NO: 1101765 - protein, 9 aa, Homo Sapiens
SFSWTIRHC

SEQ ID NO: 1101766 - protein, 9 aa, Homo Sapiens
GNVRSGPLT

SEQ ID NO: 1101767 - protein, 9 aa, Homo Sapiens
PCGLSTSWP

SEQ ID NO: 1101768 - protein, 9 aa, Homo Sapiens
SSDPSKHLL

SEQ ID NO: 1101769 - protein, 9 aa, Homo Sapiens
KKREKIINP

SEQ ID NO: 1101770 - protein, 9 aa, Homo Sapiens
KKGKSDEQC

SEQ ID NO: 1101771 - protein, 9 aa, Homo Sapiens
LLRPARCGR

SEQ ID NO: 1101772 - protein, 9 aa, Homo Sapiens
FKLEHSAPK

SEQ ID NO: 1101773 - protein, 9 aa, Homo Sapiens
CFPSSPNEW

SEQ ID NO: 1101774 - protein, 9 aa, Homo Sapiens
LVATGLPNI

SEQ ID NO: 1101775 - protein, 9 aa, Homo Sapiens
IRTAEKFYK

SEQ ID NO: 1101776 - protein, 9 aa, Homo Sapiens
KCQHEEGAG

SEQ ID NO: 1101777 - protein, 9 aa, Homo Sapiens
PLRLQRSPS

SEQ ID NO: 1101778 - protein, 9 aa, Homo Sapiens
ISKLRQVGL

SEQ ID NO: 1101779 - protein, 9 aa, Homo Sapiens
HLPRRATMT

SEQ ID NO: 1101780 - protein, 9 aa, Homo Sapiens
TVILYRSYC

SEQ ID NO: 1101781 - protein, 9 aa, Homo Sapiens
ASAPWAKVV

SEQ ID NO: 1101782 - protein, 9 aa, Homo Sapiens
GALSLRPAP

SEQ ID NO: 1101783 - protein, 9 aa, Homo Sapiens
YSTVAITLL

SEQ ID NO: 1101784 - protein, 9 aa, Homo Sapiens
QRGEKHQDG

SEQ ID NO: 1101785 - protein, 9 aa, Homo Sapiens
PVDTGPQPP

SEQ ID NO: 1101786 - protein, 9 aa, Homo Sapiens
CGALPLGLG

SEQ ID NO: 1101787 - protein, 9 aa, Homo Sapiens
RLRSDLLEE

SEQ ID NO: 1101788 - protein, 9 aa, Homo Sapiens
GPSGTLKAD

SEQ ID NO: 1101789 - protein, 9 aa, Homo Sapiens
HEHFNSWST

SEQ ID NO: 1101790 - protein, 9 aa, Homo Sapiens
EDSGDDSDF

SEQ ID NO: 1101791 - protein, 9 aa, Homo Sapiens
TACSRGTWT

SEQ ID NO: 1101792 - protein, 9 aa, Homo Sapiens
AGGRHTAFS

SEQ ID NO: 1101793 - protein, 9 aa, Homo Sapiens
TTDTIKHCS

SEQ ID NO: 1101794 - protein, 9 aa, Homo Sapiens
PAGAVVWPS

SEQ ID NO: 1101795 - protein, 9 aa, Homo Sapiens
EILLSQSVQ

SEQ ID NO: 1101796 - protein, 9 aa, Homo Sapiens
LSLQCQSLA

SEQ ID NO: 1101797 - protein, 9 aa, Homo Sapiens
RKSQSWCLL

SEQ ID NO: 1101798 - protein, 9 aa, Homo Sapiens
SSYHPFKIN

SEQ ID NO: 1101799 - protein, 9 aa, Homo Sapiens
GPAAERAGA

SEQ ID NO: 1101800 - protein, 9 aa, Homo Sapiens
LEVRACQGF

SEQ ID NO: 1101801 - protein, 9 aa, Homo Sapiens
REAHRVRRH

SEQ ID NO: 1101802 - protein, 9 aa, Homo Sapiens
DDLRGRENG

SEQ ID NO: 1101803 - protein, 9 aa, Homo Sapiens
PASPWPALT

SEQ ID NO: 1101804 - protein, 9 aa, Homo Sapiens
NADLRKLAI

SEQ ID NO: 1101805 - protein, 9 aa, Homo Sapiens
KQNLNLLFQ

SEQ ID NO: 1101806 - protein, 9 aa, Homo Sapiens
KDGPESTFT

SEQ ID NO: 1101807 - protein, 9 aa, Homo Sapiens
CDLLASQNE

SEQ ID NO: 1101808 - protein, 9 aa, Homo Sapiens
QRSIKEGDG

SEQ ID NO: 1101809 - protein, 9 aa, Homo Sapiens
LLHGQFQGH

SEQ ID NO: 1101810 - protein, 9 aa, Homo Sapiens
LRILADLLG

SEQ ID NO: 1101811 - protein, 9 aa, Homo Sapiens
QQGRPATQL

SEQ ID NO: 1101812 - protein, 9 aa, Homo Sapiens
SSSHFYVVM

SEQ ID NO: 1101813 - protein, 9 aa, Homo Sapiens
LPDDCLLQG

SEQ ID NO: 1101814 - protein, 9 aa, Homo Sapiens
PGQGHLCVQ

SEQ ID NO: 1101815 - protein, 9 aa, Homo Sapiens
GGLCSGERF

SEQ ID NO: 1101816 - protein, 9 aa, Homo Sapiens
WLCPQTRRS

SEQ ID NO: 1101817 - protein, 9 aa, Homo Sapiens
CGKAFTSIL

SEQ ID NO: 1101818 - protein, 9 aa, Homo Sapiens
VGNLAVRPP

SEQ ID NO: 1101819 - protein, 9 aa, Homo Sapiens
LWENDRGSV

SEQ ID NO: 1101820 - protein, 9 aa, Homo Sapiens
CTQGMVRLT

SEQ ID NO: 1101821 - protein, 9 aa, Homo Sapiens
MEKLSEAMS

SEQ ID NO: 1101822 - protein, 9 aa, Homo Sapiens
HMRPKRPHQ

SEQ ID NO: 1101823 - protein, 9 aa, Homo Sapiens
RSSHTGYHT

SEQ ID NO: 1101824 - protein, 9 aa, Homo Sapiens
LQRPAAHGP

SEQ ID NO: 1101825 - protein, 9 aa, Homo Sapiens
ASSSLQFWM

SEQ ID NO: 1101826 - protein, 9 aa, Homo Sapiens
AKVLPPSLW

SEQ ID NO: 1101827 - protein, 9 aa, Homo Sapiens
ALDLRSQGV

SEQ ID NO: 1101828 - protein, 9 aa, Homo Sapiens
KPWDANAPE

SEQ ID NO: 1101829 - protein, 9 aa, Homo Sapiens
TKQRAWEWA

SEQ ID NO: 1101830 - protein, 9 aa, Homo Sapiens
EVWKEVRGE

SEQ ID NO: 1101831 - protein, 9 aa, Homo Sapiens
QEEEEAMHR

SEQ ID NO: 1101832 - protein, 9 aa, Homo Sapiens
PCPAVTDLT

SEQ ID NO: 1101833 - protein, 9 aa, Homo Sapiens
KCSLYGKKL

SEQ ID NO: 1101834 - protein, 9 aa, Homo Sapiens
AQLPPAFPS

SEQ ID NO: 1101835 - protein, 9 aa, Homo Sapiens
GTLPGEPPG

SEQ ID NO: 1101836 - protein, 9 aa, Homo Sapiens
DSARAPTLP

SEQ ID NO: 1101837 - protein, 9 aa, Homo Sapiens
LLDQRQSPK

SEQ ID NO: 1101838 - protein, 9 aa, Homo Sapiens
GSMAHVEAL

SEQ ID NO: 1101839 - protein, 9 aa, Homo Sapiens
QQHVLGAQV

SEQ ID NO: 1101840 - protein, 9 aa, Homo Sapiens
NGDDSLSPC

SEQ ID NO: 1101841 - protein, 9 aa, Homo Sapiens
LLATQLKGT

SEQ ID NO: 1101842 - protein, 9 aa, Homo Sapiens
TCSKKTQNR

SEQ ID NO: 1101843 - protein, 9 aa, Homo Sapiens
RNQPPHPVL

SEQ ID NO: 1101844 - protein, 9 aa, Homo Sapiens
ALAVRGRDS

SEQ ID NO: 1101845 - protein, 9 aa, Homo Sapiens
AKFQELWYS

SEQ ID NO: 1101846 - protein, 9 aa, Homo Sapiens
WREASQAAA

SEQ ID NO: 1101847 - protein, 9 aa, Homo Sapiens
HCCRSWSSD

SEQ ID NO: 1101848 - protein, 9 aa, Homo Sapiens
AMHVDATVF

SEQ ID NO: 1101849 - protein, 9 aa, Homo Sapiens
SLRLPSLPF

SEQ ID NO: 1101850 - protein, 9 aa, Homo Sapiens
QNIGAGRPI

SEQ ID NO: 1101851 - protein, 9 aa, Homo Sapiens
TVVQKADSR

SEQ ID NO: 1101852 - protein, 9 aa, Homo Sapiens
LEPLYSPIC

SEQ ID NO: 1101853 - protein, 9 aa, Homo Sapiens
SIAQDDTGA

SEQ ID NO: 1101854 - protein, 9 aa, Homo Sapiens
IRCRPGAPA

SEQ ID NO: 1101855 - protein, 9 aa, Homo Sapiens
TDTTEEKWR

SEQ ID NO: 1101856 - protein, 9 aa, Homo Sapiens
VSSKDTWEI

SEQ ID NO: 1101857 - protein, 9 aa, Homo Sapiens
GAPGSEPQG

SEQ ID NO: 1101858 - protein, 9 aa, Homo Sapiens
TQDQLQDRD

SEQ ID NO: 1101859 - protein, 9 aa, Homo Sapiens
WLPYPFSNK

SEQ ID NO: 1101860 - protein, 9 aa, Homo Sapiens
PCGVPSGSC

SEQ ID NO: 1101861 - protein, 9 aa, Homo Sapiens
WALMNSWPL

SEQ ID NO: 1101862 - protein, 9 aa, Homo Sapiens
PDLKCALCR

SEQ ID NO: 1101863 - protein, 9 aa, Homo Sapiens
FILLQLKRA

SEQ ID NO: 1101864 - protein, 9 aa, Homo Sapiens
QKTWTFYGT

SEQ ID NO: 1101865 - protein, 9 aa, Homo Sapiens
QDPEPAGGQ

SEQ ID NO: 1101866 - protein, 9 aa, Homo Sapiens
ISACPSQFR

SEQ ID NO: 1101867 - protein, 9 aa, Homo Sapiens
LPFVLYPLQ

SEQ ID NO: 1101868 - protein, 9 aa, Homo Sapiens
WREYHLVLA

SEQ ID NO: 1101869 - protein, 9 aa, Homo Sapiens
ITKKQRNDV

SEQ ID NO: 1101870 - protein, 9 aa, Homo Sapiens
AEELCQCLQ

SEQ ID NO: 1101871 - protein, 9 aa, Homo Sapiens
DILPPPSQL

SEQ ID NO: 1101872 - protein, 9 aa, Homo Sapiens
HVTLQQVIH

SEQ ID NO: 1101873 - protein, 9 aa, Homo Sapiens
THAGGTGLE

SEQ ID NO: 1101874 - protein, 9 aa, Homo Sapiens
VHNRVAPLL

SEQ ID NO: 1101875 - protein, 9 aa, Homo Sapiens
PPTPSSSLS

SEQ ID NO: 1101876 - protein, 9 aa, Homo Sapiens
LELFGKVFG

SEQ ID NO: 1101877 - protein, 9 aa, Homo Sapiens
VACEEARQG

SEQ ID NO: 1101878 - protein, 9 aa, Homo Sapiens
TRHAGRKQP

SEQ ID NO: 1101879 - protein, 9 aa, Homo Sapiens
MVRLTRHAG

SEQ ID NO: 1101880 - protein, 9 aa, Homo Sapiens
LGTTSSLPS

SEQ ID NO: 1101881 - protein, 9 aa, Homo Sapiens
CIPKGKLSV

SEQ ID NO: 1101882 - protein, 9 aa, Homo Sapiens
QGRLRLRSD

SEQ ID NO: 1101883 - protein, 9 aa, Homo Sapiens
EPGVIGSPQ

SEQ ID NO: 1101884 - protein, 9 aa, Homo Sapiens
SSSQPDHSR

SEQ ID NO: 1101885 - protein, 9 aa, Homo Sapiens
SEGAGPRGQ

SEQ ID NO: 1101886 - protein, 9 aa, Homo Sapiens
LPWGWLLYA

SEQ ID NO: 1101887 - protein, 9 aa, Homo Sapiens
LSPGTTYCV

SEQ ID NO: 1101888 - protein, 9 aa, Homo Sapiens
WQYQHIHFF

SEQ ID NO: 1101889 - protein, 9 aa, Homo Sapiens
YPAIEDDIL

SEQ ID NO: 1101890 - protein, 9 aa, Homo Sapiens
GSPVGDVGL

SEQ ID NO: 1101891 - protein, 9 aa, Homo Sapiens
IPTQRSPRT

SEQ ID NO: 1101892 - protein, 9 aa, Homo Sapiens
AVHQCDRSW

SEQ ID NO: 1101893 - protein, 9 aa, Homo Sapiens
TAKDVNQDL

SEQ ID NO: 1101894 - protein, 9 aa, Homo Sapiens
LGKWLQWPH

SEQ ID NO: 1101895 - protein, 9 aa, Homo Sapiens
SWPSLMLSC

SEQ ID NO: 1101896 - protein, 9 aa, Homo Sapiens
GVSSAPRPG

SEQ ID NO: 1101897 - protein, 9 aa, Homo Sapiens
HRVLIKPET

SEQ ID NO: 1101898 - protein, 9 aa, Homo Sapiens
RPVYEVSVC

SEQ ID NO: 1101899 - protein, 9 aa, Homo Sapiens
TVHGPDAHI

SEQ ID NO: 1101900 - protein, 9 aa, Homo Sapiens
ACRPACTCI

SEQ ID NO: 1101901 - protein, 9 aa, Homo Sapiens
RRSVPLAIT

SEQ ID NO: 1101902 - protein, 9 aa, Homo Sapiens
AVAPAAMVS

SEQ ID NO: 1101903 - protein, 9 aa, Homo Sapiens
LQEGRPSCG

SEQ ID NO: 1101904 - protein, 9 aa, Homo Sapiens
QVPHNAGLG

SEQ ID NO: 1101905 - protein, 9 aa, Homo Sapiens
LKADKATKV

SEQ ID NO: 1101906 - protein, 9 aa, Homo Sapiens
NSSYGGPAS

SEQ ID NO: 1101907 - protein, 9 aa, Homo Sapiens
LTSAASSAG

SEQ ID NO: 1101908 - protein, 9 aa, Homo Sapiens
RLTRGPRNI

SEQ ID NO: 1101909 - protein, 9 aa, Homo Sapiens
RKTAQKLTI

SEQ ID NO: 1101910 - protein, 9 aa, Homo Sapiens
KVKFPELLC

SEQ ID NO: 1101911 - protein, 9 aa, Homo Sapiens
TEDEDKGTE

SEQ ID NO: 1101912 - protein, 9 aa, Homo Sapiens
PPLLHPQWA

SEQ ID NO: 1101913 - protein, 9 aa, Homo Sapiens
KDSGLLTSS

SEQ ID NO: 1101914 - protein, 9 aa, Homo Sapiens
PGRRPLKKW

SEQ ID NO: 1101915 - protein, 9 aa, Homo Sapiens
TMRDFRMGK

SEQ ID NO: 1101916 - protein, 9 aa, Homo Sapiens
ALSLPASHG

SEQ ID NO: 1101917 - protein, 9 aa, Homo Sapiens
MQGHPNYKY

SEQ ID NO: 1101918 - protein, 9 aa, Homo Sapiens
VLSCWTWMT

SEQ ID NO: 1101919 - protein, 9 aa, Homo Sapiens
EYHVLQELI

SEQ ID NO: 1101920 - protein, 9 aa, Homo Sapiens
HCFPSSPNE

SEQ ID NO: 1101921 - protein, 9 aa, Homo Sapiens
HGLWSPTPR

SEQ ID NO: 1101922 - protein, 9 aa, Homo Sapiens
GASLFLHHL

SEQ ID NO: 1101923 - protein, 9 aa, Homo Sapiens
PRSQKVGEK

SEQ ID NO: 1101924 - protein, 9 aa, Homo Sapiens
IAGCRHSVP

SEQ ID NO: 1101925 - protein, 9 aa, Homo Sapiens
ARLGQPTSP

SEQ ID NO: 1101926 - protein, 9 aa, Homo Sapiens
AGKIAKPRR

SEQ ID NO: 1101927 - protein, 9 aa, Homo Sapiens
FSRSHLDFS

SEQ ID NO: 1101928 - protein, 9 aa, Homo Sapiens
LAWARAHLA

SEQ ID NO: 1101929 - protein, 9 aa, Homo Sapiens
SSSGLPCSW

SEQ ID NO: 1101930 - protein, 9 aa, Homo Sapiens
KKEATPKRS

SEQ ID NO: 1101931 - protein, 9 aa, Homo Sapiens
TLESLSKHS

SEQ ID NO: 1101932 - protein, 9 aa, Homo Sapiens
GSPLMSEFR

SEQ ID NO: 1101933 - protein, 9 aa, Homo Sapiens
TSRMESTGL

SEQ ID NO: 1101934 - protein, 9 aa, Homo Sapiens
GLFLLHQVL

SEQ ID NO: 1101935 - protein, 9 aa, Homo Sapiens
FGIEAVEVV

SEQ ID NO: 1101936 - protein, 9 aa, Homo Sapiens
HAGPEDGRA

SEQ ID NO: 1101937 - protein, 9 aa, Homo Sapiens
PARYRKPLE

SEQ ID NO: 1101938 - protein, 9 aa, Homo Sapiens
QSHPRASQV

SEQ ID NO: 1101939 - protein, 9 aa, Homo Sapiens
LIITTGSVG

SEQ ID NO: 1101940 - protein, 9 aa, Homo Sapiens
TPPFFGRDC

SEQ ID NO: 1101941 - protein, 9 aa, Homo Sapiens
APGEDSGDD

SEQ ID NO: 1101942 - protein, 9 aa, Homo Sapiens
SLRILSTGV

SEQ ID NO: 1101943 - protein, 9 aa, Homo Sapiens
ENPPASEKD

SEQ ID NO: 1101944 - protein, 9 aa, Homo Sapiens
TAATLRCPA

SEQ ID NO: 1101945 - protein, 9 aa, Homo Sapiens
PSISPVEKQ

SEQ ID NO: 1101946 - protein, 9 aa, Homo Sapiens
LARPEALFY

SEQ ID NO: 1101947 - protein, 9 aa, Homo Sapiens
PVVVDAFNQ

SEQ ID NO: 1101948 - protein, 9 aa, Homo Sapiens
HFFEDQLHG

SEQ ID NO: 1101949 - protein, 9 aa, Homo Sapiens
AACLLRFSE

SEQ ID NO: 1101950 - protein, 9 aa, Homo Sapiens
AAGPAAERA

SEQ ID NO: 1101951 - protein, 9 aa, Homo Sapiens
LPLTSASKA

SEQ ID NO: 1101952 - protein, 9 aa, Homo Sapiens
IITNVVIEL

SEQ ID NO: 1101953 - protein, 9 aa, Homo Sapiens
PTVRPWRAD

SEQ ID NO: 1101954 - protein, 9 aa, Homo Sapiens
LPPAFPSRS

SEQ ID NO: 1101955 - protein, 9 aa, Homo Sapiens
HKIMRMLPT

SEQ ID NO: 1101956 - protein, 9 aa, Homo Sapiens
PAPASRSLG

SEQ ID NO: 1101957 - protein, 9 aa, Homo Sapiens
YFIQIMEKL

SEQ ID NO: 1101958 - protein, 9 aa, Homo Sapiens
IIARIQADL

SEQ ID NO: 1101959 - protein, 9 aa, Homo Sapiens
AFKRKAKGE

SEQ ID NO: 1101960 - protein, 9 aa, Homo Sapiens
PGEAGDGKA

SEQ ID NO: 1101961 - protein, 9 aa, Homo Sapiens
QSFLAQQRH

SEQ ID NO: 1101962 - protein, 9 aa, Homo Sapiens
PATEVGCPA

SEQ ID NO: 1101963 - protein, 9 aa, Homo Sapiens
EKQAAKNGS

SEQ ID NO: 1101964 - protein, 9 aa, Homo Sapiens
HVHLCCHRS

SEQ ID NO: 1101965 - protein, 9 aa, Homo Sapiens
SHLSRLWAA

SEQ ID NO: 1101966 - protein, 9 aa, Homo Sapiens
HPVPTYVPA

SEQ ID NO: 1101967 - protein, 9 aa, Homo Sapiens
MATRTHQEY

SEQ ID NO: 1101968 - protein, 9 aa, Homo Sapiens
FEPHMRPKR

SEQ ID NO: 1101969 - protein, 9 aa, Homo Sapiens
VVAALSEGR

SEQ ID NO: 1101970 - protein, 9 aa, Homo Sapiens
RKVLEDPLT

SEQ ID NO: 1101971 - protein, 9 aa, Homo Sapiens
LGTVAGATA

SEQ ID NO: 1101972 - protein, 9 aa, Homo Sapiens
CPPVPGVPG

SEQ ID NO: 1101973 - protein, 9 aa, Homo Sapiens
KFYFIQIME

SEQ ID NO: 1101974 - protein, 9 aa, Homo Sapiens
DSQPLCHWA

SEQ ID NO: 1101975 - protein, 9 aa, Homo Sapiens
SLKQRGEKH

SEQ ID NO: 1101976 - protein, 9 aa, Homo Sapiens
LMKDDALSL

SEQ ID NO: 1101977 - protein, 9 aa, Homo Sapiens
RANMASQVH

SEQ ID NO: 1101978 - protein, 9 aa, Homo Sapiens
PLLTILEIF

SEQ ID NO: 1101979 - protein, 9 aa, Homo Sapiens
KYGGSVRQN

SEQ ID NO: 1101980 - protein, 9 aa, Homo Sapiens
SLQQWKRPM

SEQ ID NO: 1101981 - protein, 9 aa, Homo Sapiens
SKDSGLLTS

SEQ ID NO: 1101982 - protein, 9 aa, Homo Sapiens
HAQRVGETR

SEQ ID NO: 1101983 - protein, 9 aa, Homo Sapiens
VVKIIKKTV

SEQ ID NO: 1101984 - protein, 9 aa, Homo Sapiens
CIFVYKEFS

SEQ ID NO: 1101985 - protein, 9 aa, Homo Sapiens
PSPSSLLSP

SEQ ID NO: 1101986 - protein, 9 aa, Homo Sapiens
KTLKSLMTA

SEQ ID NO: 1101987 - protein, 9 aa, Homo Sapiens
PSSQLATKL

SEQ ID NO: 1101988 - protein, 9 aa, Homo Sapiens
RGRASQTRV

SEQ ID NO: 1101989 - protein, 9 aa, Homo Sapiens
LQEGSMAHV

SEQ ID NO: 1101990 - protein, 9 aa, Homo Sapiens
SKPATLAQP

SEQ ID NO: 1101991 - protein, 9 aa, Homo Sapiens
IVLWREYHL

SEQ ID NO: 1101992 - protein, 9 aa, Homo Sapiens
APCGLSTSW

SEQ ID NO: 1101993 - protein, 9 aa, Homo Sapiens
GDLEELKNV

SEQ ID NO: 1101994 - protein, 9 aa, Homo Sapiens
PKTRTESAT

SEQ ID NO: 1101995 - protein, 9 aa, Homo Sapiens
PHNPRHQTS

SEQ ID NO: 1101996 - protein, 9 aa, Homo Sapiens
PSFSAPCCW

SEQ ID NO: 1101997 - protein, 9 aa, Homo Sapiens
HLQGTQARP

SEQ ID NO: 1101998 - protein, 9 aa, Homo Sapiens
AWAAAAAGV

SEQ ID NO: 1101999 - protein, 9 aa, Homo Sapiens
PQGPSASAQ

SEQ ID NO: 1102000 - protein, 9 aa, Homo Sapiens
GVSSSVGTE

SEQ ID NO: 1102001 - protein, 9 aa, Homo Sapiens
VRLKKNRSY

SEQ ID NO: 1102002 - protein, 9 aa, Homo Sapiens
EAGAARRSQ

SEQ ID NO: 1102003 - protein, 9 aa, Homo Sapiens
RMLPTARSL

SEQ ID NO: 1102004 - protein, 9 aa, Homo Sapiens
HHPSAFKTE

SEQ ID NO: 1102005 - protein, 9 aa, Homo Sapiens
FQSTCVPGI

SEQ ID NO: 1102006 - protein, 9 aa, Homo Sapiens
RAAQKILLS

SEQ ID NO: 1102007 - protein, 9 aa, Homo Sapiens
LLRAEKLRP

SEQ ID NO: 1102008 - protein, 9 aa, Homo Sapiens
DVAEARVAD

SEQ ID NO: 1102009 - protein, 9 aa, Homo Sapiens
IQNLSCFVW

SEQ ID NO: 1102010 - protein, 9 aa, Homo Sapiens
ISPVEKQLA

SEQ ID NO: 1102011 - protein, 9 aa, Homo Sapiens
AREHICLRE

SEQ ID NO: 1102012 - protein, 9 aa, Homo Sapiens
LRTKTLQNT

SEQ ID NO: 1102013 - protein, 9 aa, Homo Sapiens
HHLYRFPPS

SEQ ID NO: 1102014 - protein, 9 aa, Homo Sapiens
VRRVLCTRP

SEQ ID NO: 1102015 - protein, 9 aa, Homo Sapiens
SPSTSQTPL

SEQ ID NO: 1102016 - protein, 9 aa, Homo Sapiens
SIMCPLNPA

SEQ ID NO: 1102017 - protein, 9 aa, Homo Sapiens
PYMDVSAVP

SEQ ID NO: 1102018 - protein, 9 aa, Homo Sapiens
AGGAPMLQL

SEQ ID NO: 1102019 - protein, 9 aa, Homo Sapiens
HSSITGVYR

SEQ ID NO: 1102020 - protein, 9 aa, Homo Sapiens
LLAREGRAR

SEQ ID NO: 1102021 - protein, 9 aa, Homo Sapiens
PRPGPRGGH

SEQ ID NO: 1102022 - protein, 9 aa, Homo Sapiens
AELVAEKIG

SEQ ID NO: 1102023 - protein, 9 aa, Homo Sapiens
RPACTCISM

SEQ ID NO: 1102024 - protein, 9 aa, Homo Sapiens
VLLRNAHHA

SEQ ID NO: 1102025 - protein, 9 aa, Homo Sapiens
CQPVRMPAC

SEQ ID NO: 1102026 - protein, 9 aa, Homo Sapiens
DLGALCACP

SEQ ID NO: 1102027 - protein, 9 aa, Homo Sapiens
CNDCISQLF

SEQ ID NO: 1102028 - protein, 9 aa, Homo Sapiens
DLDYLPRTE

SEQ ID NO: 1102029 - protein, 9 aa, Homo Sapiens
PHTSGFLCN

SEQ ID NO: 1102030 - protein, 9 aa, Homo Sapiens
LGSSPLVRA

SEQ ID NO: 1102031 - protein, 9 aa, Homo Sapiens
TRELCMQML

SEQ ID NO: 1102032 - protein, 9 aa, Homo Sapiens
TGKPKAVGW

SEQ ID NO: 1102033 - protein, 9 aa, Homo Sapiens
KVSRAGKIA

SEQ ID NO: 1102034 - protein, 9 aa, Homo Sapiens
CKILFTNWY

SEQ ID NO: 1102035 - protein, 9 aa, Homo Sapiens
HVVLEVVVV

SEQ ID NO: 1102036 - protein, 9 aa, Homo Sapiens
PLQPAPPPP

SEQ ID NO: 1102037 - protein, 9 aa, Homo Sapiens
RLPWAGAPA

SEQ ID NO: 1102038 - protein, 9 aa, Homo Sapiens
DQKVEIRRR

SEQ ID NO: 1102039 - protein, 9 aa, Homo Sapiens
LAWGILLMI

SEQ ID NO: 1102040 - protein, 9 aa, Homo Sapiens
SCCFPHFER

SEQ ID NO: 1102041 - protein, 9 aa, Homo Sapiens
ASVHQYSVH

SEQ ID NO: 1102042 - protein, 9 aa, Homo Sapiens
IHQSHPCST

SEQ ID NO: 1102043 - protein, 9 aa, Homo Sapiens
HGLVSIAVV

SEQ ID NO: 1102044 - protein, 9 aa, Homo Sapiens
VDAQKPLFF

SEQ ID NO: 1102045 - protein, 9 aa, Homo Sapiens
GTMPIAINR

SEQ ID NO: 1102046 - protein, 9 aa, Homo Sapiens
LRQGLSRLC

SEQ ID NO: 1102047 - protein, 9 aa, Homo Sapiens
SPNREVKSP

SEQ ID NO: 1102048 - protein, 9 aa, Homo Sapiens
CEHPWEVMP

SEQ ID NO: 1102049 - protein, 9 aa, Homo Sapiens
LLAEGVCDD

SEQ ID NO: 1102050 - protein, 9 aa, Homo Sapiens
TYPAIEDDI

SEQ ID NO: 1102051 - protein, 9 aa, Homo Sapiens
LQQNTQGAQ

SEQ ID NO: 1102052 - protein, 9 aa, Homo Sapiens
REVKALTKL

SEQ ID NO: 1102053 - protein, 9 aa, Homo Sapiens
FKTETSSDW

SEQ ID NO: 1102054 - protein, 9 aa, Homo Sapiens
RNPKSKRRC

SEQ ID NO: 1102055 - protein, 9 aa, Homo Sapiens
AGLQSYHQA

SEQ ID NO: 1102056 - protein, 9 aa, Homo Sapiens
QNPQVCLAL

SEQ ID NO: 1102057 - protein, 9 aa, Homo Sapiens
PQTRRSPCP

SEQ ID NO: 1102058 - protein, 9 aa, Homo Sapiens
LDMPLYFSY

SEQ ID NO: 1102059 - protein, 9 aa, Homo Sapiens
MVPVFVDPG

SEQ ID NO: 1102060 - protein, 9 aa, Homo Sapiens
LIPIKSYVF

SEQ ID NO: 1102061 - protein, 9 aa, Homo Sapiens
VHERIHSGK

SEQ ID NO: 1102062 - protein, 9 aa, Homo Sapiens
CIDDQTVKV

SEQ ID NO: 1102063 - protein, 9 aa, Homo Sapiens
KTAQKLTIQ

SEQ ID NO: 1102064 - protein, 9 aa, Homo Sapiens
CLQRKERML

SEQ ID NO: 1102065 - protein, 9 aa, Homo Sapiens
NGWLCIDDQ

SEQ ID NO: 1102066 - protein, 9 aa, Homo Sapiens
RKETPLAPA

SEQ ID NO: 1102067 - protein, 9 aa, Homo Sapiens
REMREYAGG

SEQ ID NO: 1102068 - protein, 9 aa, Homo Sapiens
EAGDGKAST

SEQ ID NO: 1102069 - protein, 9 aa, Homo Sapiens
LELCNTFRE

SEQ ID NO: 1102070 - protein, 9 aa, Homo Sapiens
GSLGMEALG

SEQ ID NO: 1102071 - protein, 9 aa, Homo Sapiens
GLLFAHLGK

SEQ ID NO: 1102072 - protein, 9 aa, Homo Sapiens
SQLAFSCDL

SEQ ID NO: 1102073 - protein, 9 aa, Homo Sapiens
RLPHGQLPR

SEQ ID NO: 1102074 - protein, 9 aa, Homo Sapiens
CSPGELAWD

SEQ ID NO: 1102075 - protein, 9 aa, Homo Sapiens
VGSLRVLRG

SEQ ID NO: 1102076 - protein, 9 aa, Homo Sapiens
PRAPASPGR

SEQ ID NO: 1102077 - protein, 9 aa, Homo Sapiens
CSGFFCNAA

SEQ ID NO: 1102078 - protein, 9 aa, Homo Sapiens
RTCSPCSPT

SEQ ID NO: 1102079 - protein, 9 aa, Homo Sapiens
DDFLDLNPV

SEQ ID NO: 1102080 - protein, 9 aa, Homo Sapiens
VKALTKLEH

SEQ ID NO: 1102081 - protein, 9 aa, Homo Sapiens
EPWRAGFQW

SEQ ID NO: 1102082 - protein, 9 aa, Homo Sapiens
KILGCDRCD

SEQ ID NO: 1102083 - protein, 9 aa, Homo Sapiens
HLGLFLLHQ

SEQ ID NO: 1102084 - protein, 9 aa, Homo Sapiens
QPPPSRQDP

SEQ ID NO: 1102085 - protein, 9 aa, Homo Sapiens
WGDWVASPP

SEQ ID NO: 1102086 - protein, 9 aa, Homo Sapiens
SKRKYRKFL

SEQ ID NO: 1102087 - protein, 9 aa, Homo Sapiens
ELSDVCCLT

SEQ ID NO: 1102088 - protein, 9 aa, Homo Sapiens
FSTLEESTF

SEQ ID NO: 1102089 - protein, 9 aa, Homo Sapiens
GDTVNTTSR

SEQ ID NO: 1102090 - protein, 9 aa, Homo Sapiens
PNREVKSPF

SEQ ID NO: 1102091 - protein, 9 aa, Homo Sapiens
SRRWTCASS

SEQ ID NO: 1102092 - protein, 9 aa, Homo Sapiens
LFPRVLLRF

SEQ ID NO: 1102093 - protein, 9 aa, Homo Sapiens
GSVKRVWSR

SEQ ID NO: 1102094 - protein, 9 aa, Homo Sapiens
GRGEAEDDL

SEQ ID NO: 1102095 - protein, 9 aa, Homo Sapiens
SPIDTVLLG

SEQ ID NO: 1102096 - protein, 9 aa, Homo Sapiens
AAEALFFIR

SEQ ID NO: 1102097 - protein, 9 aa, Homo Sapiens
CSYILLDSS

SEQ ID NO: 1102098 - protein, 9 aa, Homo Sapiens
PTKQAPPSC

SEQ ID NO: 1102099 - protein, 9 aa, Homo Sapiens
TTRYVASGI

SEQ ID NO: 1102100 - protein, 9 aa, Homo Sapiens
KQRAWEWAK

SEQ ID NO: 1102101 - protein, 9 aa, Homo Sapiens
NLNLLFQKL

SEQ ID NO: 1102102 - protein, 9 aa, Homo Sapiens
CCEPPAAPP

SEQ ID NO: 1102103 - protein, 9 aa, Homo Sapiens
TVVTVDHSH

SEQ ID NO: 1102104 - protein, 9 aa, Homo Sapiens
ETLQMVLQW

SEQ ID NO: 1102105 - protein, 9 aa, Homo Sapiens
QELALGLRQ

SEQ ID NO: 1102106 - protein, 9 aa, Homo Sapiens
VPDGAWAEA

SEQ ID NO: 1102107 - protein, 9 aa, Homo Sapiens
MWAHQAVLP

SEQ ID NO: 1102108 - protein, 9 aa, Homo Sapiens
TYRLCTVSA

SEQ ID NO: 1102109 - protein, 9 aa, Homo Sapiens
AHHSVLAAC

SEQ ID NO: 1102110 - protein, 9 aa, Homo Sapiens
DLLEECLQH

SEQ ID NO: 1102111 - protein, 9 aa, Homo Sapiens
GHFLKKVIE

SEQ ID NO: 1102112 - protein, 9 aa, Homo Sapiens
QAAQLPVVR

SEQ ID NO: 1102113 - protein, 9 aa, Homo Sapiens
RGWLPQQGR

SEQ ID NO: 1102114 - protein, 9 aa, Homo Sapiens
VGGHGCLLA

SEQ ID NO: 1102115 - protein, 9 aa, Homo Sapiens
RSAWGDWVA

SEQ ID NO: 1102116 - protein, 9 aa, Homo Sapiens
TSILRLSRH

SEQ ID NO: 1102117 - protein, 9 aa, Homo Sapiens
TPQNQLQPQ

SEQ ID NO: 1102118 - protein, 9 aa, Homo Sapiens
APSICKQIL

SEQ ID NO: 1102119 - protein, 9 aa, Homo Sapiens
KTLDQVMDM

SEQ ID NO: 1102120 - protein, 9 aa, Homo Sapiens
EWLDDKHVA

SEQ ID NO: 1102121 - protein, 9 aa, Homo Sapiens
PTFWTHTEA

SEQ ID NO: 1102122 - protein, 9 aa, Homo Sapiens
GPTAGAARA

SEQ ID NO: 1102123 - protein, 9 aa, Homo Sapiens
ETRGYGGNA

SEQ ID NO: 1102124 - protein, 9 aa, Homo Sapiens
TRSAWGDWV

SEQ ID NO: 1102125 - protein, 9 aa, Homo Sapiens
IAAPTTTFE

SEQ ID NO: 1102126 - protein, 9 aa, Homo Sapiens
MNIMSELKM

SEQ ID NO: 1102127 - protein, 9 aa, Homo Sapiens
PRICPATVI

SEQ ID NO: 1102128 - protein, 9 aa, Homo Sapiens
YLERYFEYK

SEQ ID NO: 1102129 - protein, 9 aa, Homo Sapiens
AMTKKRVNT

SEQ ID NO: 1102130 - protein, 9 aa, Homo Sapiens
CSSASSAWG

SEQ ID NO: 1102131 - protein, 9 aa, Homo Sapiens
GGPGCLLSG

SEQ ID NO: 1102132 - protein, 9 aa, Homo Sapiens
ERTLYTWNN

SEQ ID NO: 1102133 - protein, 9 aa, Homo Sapiens
RETHLPPIH

SEQ ID NO: 1102134 - protein, 9 aa, Homo Sapiens
DSSLNLEQS

SEQ ID NO: 1102135 - protein, 9 aa, Homo Sapiens
SSSTKSSSE

SEQ ID NO: 1102136 - protein, 9 aa, Homo Sapiens
EFTNVHIKN

SEQ ID NO: 1102137 - protein, 9 aa, Homo Sapiens
LFSIRRWST

SEQ ID NO: 1102138 - protein, 9 aa, Homo Sapiens
LQFWMKVQR

SEQ ID NO: 1102139 - protein, 9 aa, Homo Sapiens
DFYVFPDMV

SEQ ID NO: 1102140 - protein, 9 aa, Homo Sapiens
PCPPMPTRR

SEQ ID NO: 1102141 - protein, 9 aa, Homo Sapiens
QVGSTVLFH

SEQ ID NO: 1102142 - protein, 9 aa, Homo Sapiens
MPCGVPSGS

SEQ ID NO: 1102143 - protein, 9 aa, Homo Sapiens
RNMRALFAL

SEQ ID NO: 1102144 - protein, 9 aa, Homo Sapiens
KQLLSFQQI

SEQ ID NO: 1102145 - protein, 9 aa, Homo Sapiens
DLADGAHVW

SEQ ID NO: 1102146 - protein, 9 aa, Homo Sapiens
SAGAGAAIA

SEQ ID NO: 1102147 - protein, 9 aa, Homo Sapiens
PGEDSGDDS

SEQ ID NO: 1102148 - protein, 9 aa, Homo Sapiens
TRVIVLGVG

SEQ ID NO: 1102149 - protein, 9 aa, Homo Sapiens
IPQSAGTTS

SEQ ID NO: 1102150 - protein, 9 aa, Homo Sapiens
CTHLSRHQR

SEQ ID NO: 1102151 - protein, 9 aa, Homo Sapiens
VSQPDWMPP

SEQ ID NO: 1102152 - protein, 9 aa, Homo Sapiens
SPGHLGLFL

SEQ ID NO: 1102153 - protein, 9 aa, Homo Sapiens
WEIKTDFSL

SEQ ID NO: 1102154 - protein, 9 aa, Homo Sapiens
VHEELLLPA

SEQ ID NO: 1102155 - protein, 9 aa, Homo Sapiens
KTETSSDWD

SEQ ID NO: 1102156 - protein, 9 aa, Homo Sapiens
NVNDKFIYV

SEQ ID NO: 1102157 - protein, 9 aa, Homo Sapiens
TLGGWTTRY

SEQ ID NO: 1102158 - protein, 9 aa, Homo Sapiens
PMRSLGEPW

SEQ ID NO: 1102159 - protein, 9 aa, Homo Sapiens
VSVSRDKTL

SEQ ID NO: 1102160 - protein, 9 aa, Homo Sapiens
IKRHMPLSK

SEQ ID NO: 1102161 - protein, 9 aa, Homo Sapiens
WFMECLMIG

SEQ ID NO: 1102162 - protein, 9 aa, Homo Sapiens
HAGRKQPPV

SEQ ID NO: 1102163 - protein, 9 aa, Homo Sapiens
PAAAPRPPA

SEQ ID NO: 1102164 - protein, 9 aa, Homo Sapiens
PHNRRREEK

SEQ ID NO: 1102165 - protein, 9 aa, Homo Sapiens
GLLPWARFQ

SEQ ID NO: 1102166 - protein, 9 aa, Homo Sapiens
GLRQQHNAE

SEQ ID NO: 1102167 - protein, 9 aa, Homo Sapiens
HLALGHAQR

SEQ ID NO: 1102168 - protein, 9 aa, Homo Sapiens
ISASEDATI

SEQ ID NO: 1102169 - protein, 9 aa, Homo Sapiens
RVDAHVVLE

SEQ ID NO: 1102170 - protein, 9 aa, Homo Sapiens
WSAVTRNYS

SEQ ID NO: 1102171 - protein, 9 aa, Homo Sapiens
QRKSQSWCL

SEQ ID NO: 1102172 - protein, 9 aa, Homo Sapiens
HHLVTGQNA

SEQ ID NO: 1102173 - protein, 9 aa, Homo Sapiens
IEVAKMGTP

SEQ ID NO: 1102174 - protein, 9 aa, Homo Sapiens
GFEAQRAQE

SEQ ID NO: 1102175 - protein, 9 aa, Homo Sapiens
KTVILQIVD

SEQ ID NO: 1102176 - protein, 9 aa, Homo Sapiens
ILQIVDHFK

SEQ ID NO: 1102177 - protein, 9 aa, Homo Sapiens
NRCQSSPRI

SEQ ID NO: 1102178 - protein, 9 aa, Homo Sapiens
FKMKNPHLV

SEQ ID NO: 1102179 - protein, 9 aa, Homo Sapiens
YDVQELRMA

SEQ ID NO: 1102180 - protein, 9 aa, Homo Sapiens
TQVDALQGH

SEQ ID NO: 1102181 - protein, 9 aa, Homo Sapiens
QGVLDSELA

SEQ ID NO: 1102182 - protein, 9 aa, Homo Sapiens
YSAYTTQPT

SEQ ID NO: 1102183 - protein, 9 aa, Homo Sapiens
LCAVRDPIA

SEQ ID NO: 1102184 - protein, 9 aa, Homo Sapiens
HDCGVAHRD

SEQ ID NO: 1102185 - protein, 9 aa, Homo Sapiens
TTTSTDVGV

SEQ ID NO: 1102186 - protein, 9 aa, Homo Sapiens
AARNPKSKR

SEQ ID NO: 1102187 - protein, 9 aa, Homo Sapiens
RVTVMCGHC

SEQ ID NO: 1102188 - protein, 9 aa, Homo Sapiens
QTRPEWSLA

SEQ ID NO: 1102189 - protein, 9 aa, Homo Sapiens
QTQQLKTAQ

SEQ ID NO: 1102190 - protein, 9 aa, Homo Sapiens
LRLLQLSRL

SEQ ID NO: 1102191 - protein, 9 aa, Homo Sapiens
HRRAPATKQ

SEQ ID NO: 1102192 - protein, 9 aa, Homo Sapiens
GGAGHMDGP

SEQ ID NO: 1102193 - protein, 9 aa, Homo Sapiens
RGEGSRDLC

SEQ ID NO: 1102194 - protein, 9 aa, Homo Sapiens
AAIRDIRHV

SEQ ID NO: 1102195 - protein, 9 aa, Homo Sapiens
YQLDVVEWS

SEQ ID NO: 1102196 - protein, 9 aa, Homo Sapiens
VTVPMYRYH

SEQ ID NO: 1102197 - protein, 9 aa, Homo Sapiens
GHCCLWDVS

SEQ ID NO: 1102198 - protein, 9 aa, Homo Sapiens
FSWQLLQPN

SEQ ID NO: 1102199 - protein, 9 aa, Homo Sapiens
LNPQQALLY

SEQ ID NO: 1102200 - protein, 9 aa, Homo Sapiens
LLQPNKVPE

SEQ ID NO: 1102201 - protein, 9 aa, Homo Sapiens
DGSLGMEAL

SEQ ID NO: 1102202 - protein, 9 aa, Homo Sapiens
PLGAPGHEL

SEQ ID NO: 1102203 - protein, 9 aa, Homo Sapiens
SFCWPSGTR

SEQ ID NO: 1102204 - protein, 9 aa, Homo Sapiens
DNFQCPHTS

SEQ ID NO: 1102205 - protein, 9 aa, Homo Sapiens
RGWNACPER

SEQ ID NO: 1102206 - protein, 9 aa, Homo Sapiens
KPFVCNVGE

SEQ ID NO: 1102207 - protein, 9 aa, Homo Sapiens
PERYGVPSP

SEQ ID NO: 1102208 - protein, 9 aa, Homo Sapiens
PPLPAAPPS

SEQ ID NO: 1102209 - protein, 9 aa, Homo Sapiens
QLGEQEGKR

SEQ ID NO: 1102210 - protein, 9 aa, Homo Sapiens
PGAAGRRRP

SEQ ID NO: 1102211 - protein, 9 aa, Homo Sapiens
SSSLQFWMK

SEQ ID NO: 1102212 - protein, 9 aa, Homo Sapiens
CHSPRICPA

SEQ ID NO: 1102213 - protein, 9 aa, Homo Sapiens
SIRRWSTIS

SEQ ID NO: 1102214 - protein, 9 aa, Homo Sapiens
YKEPYFVYS

SEQ ID NO: 1102215 - protein, 9 aa, Homo Sapiens
AWGWVRRVL

SEQ ID NO: 1102216 - protein, 9 aa, Homo Sapiens
WRQPPGKRS

SEQ ID NO: 1102217 - protein, 9 aa, Homo Sapiens
EEKCPLGMA

SEQ ID NO: 1102218 - protein, 9 aa, Homo Sapiens
TSSVTASCA

SEQ ID NO: 1102219 - protein, 9 aa, Homo Sapiens
AVQVVRARE

SEQ ID NO: 1102220 - protein, 9 aa, Homo Sapiens
KDTWEIKTD

SEQ ID NO: 1102221 - protein, 9 aa, Homo Sapiens
DSSDPSKHL

SEQ ID NO: 1102222 - protein, 9 aa, Homo Sapiens
RLRAWGSLS

SEQ ID NO: 1102223 - protein, 9 aa, Homo Sapiens
IVGGVSTSW

SEQ ID NO: 1102224 - protein, 9 aa, Homo Sapiens
PATQLPVPE

SEQ ID NO: 1102225 - protein, 9 aa, Homo Sapiens
RWYTPRAHL

SEQ ID NO: 1102226 - protein, 9 aa, Homo Sapiens
QAAPQSQEE

SEQ ID NO: 1102227 - protein, 9 aa, Homo Sapiens
PPKMPPPRS

SEQ ID NO: 1102228 - protein, 9 aa, Homo Sapiens
RGQILHRGG

SEQ ID NO: 1102229 - protein, 9 aa, Homo Sapiens
VDHFKMKNP

SEQ ID NO: 1102230 - protein, 9 aa, Homo Sapiens
KGHTSQVLS

SEQ ID NO: 1102231 - protein, 9 aa, Homo Sapiens
EVARMWTPR

SEQ ID NO: 1102232 - protein, 9 aa, Homo Sapiens
HVDLRLASA

SEQ ID NO: 1102233 - protein, 9 aa, Homo Sapiens
GPPRKHSLR

SEQ ID NO: 1102234 - protein, 9 aa, Homo Sapiens
GPEDGRAPR

SEQ ID NO: 1102235 - protein, 9 aa, Homo Sapiens
PLEKTAQPA

SEQ ID NO: 1102236 - protein, 9 aa, Homo Sapiens
RHPHAPKTR

SEQ ID NO: 1102237 - protein, 9 aa, Homo Sapiens
PRQTPGQAR

SEQ ID NO: 1102238 - protein, 9 aa, Homo Sapiens
SLYLDRQFR

SEQ ID NO: 1102239 - protein, 9 aa, Homo Sapiens
LSFWPGGYP

SEQ ID NO: 1102240 - protein, 9 aa, Homo Sapiens
ISKGRGSIP

SEQ ID NO: 1102241 - protein, 9 aa, Homo Sapiens
QPPGKRSTA

SEQ ID NO: 1102242 - protein, 9 aa, Homo Sapiens
MGPWRLLLV

SEQ ID NO: 1102243 - protein, 9 aa, Homo Sapiens
SSTLRILAD

SEQ ID NO: 1102244 - protein, 9 aa, Homo Sapiens
EERLKNPNL

SEQ ID NO: 1102245 - protein, 9 aa, Homo Sapiens
SPSRRPLGV

SEQ ID NO: 1102246 - protein, 9 aa, Homo Sapiens
VRLTRLLRT

SEQ ID NO: 1102247 - protein, 9 aa, Homo Sapiens
PLWRPCWAT

SEQ ID NO: 1102248 - protein, 9 aa, Homo Sapiens
FLHFLSGLL

SEQ ID NO: 1102249 - protein, 9 aa, Homo Sapiens
DVPTYKEVT

SEQ ID NO: 1102250 - protein, 9 aa, Homo Sapiens
LRLPCSGDE

SEQ ID NO: 1102251 - protein, 9 aa, Homo Sapiens
NPCTIAAPT

SEQ ID NO: 1102252 - protein, 9 aa, Homo Sapiens
AVPAAACPP

SEQ ID NO: 1102253 - protein, 9 aa, Homo Sapiens
RPKRPHQIA

SEQ ID NO: 1102254 - protein, 9 aa, Homo Sapiens
LGVSPLAPC

SEQ ID NO: 1102255 - protein, 9 aa, Homo Sapiens
RVAQLLCLG

SEQ ID NO: 1102256 - protein, 9 aa, Homo Sapiens
RREPRRGTS

SEQ ID NO: 1102257 - protein, 9 aa, Homo Sapiens
IVPFLNYAM

SEQ ID NO: 1102258 - protein, 9 aa, Homo Sapiens
RTACGAASP

SEQ ID NO: 1102259 - protein, 9 aa, Homo Sapiens
LAFPSPQGP

SEQ ID NO: 1102260 - protein, 9 aa, Homo Sapiens
TALQPDMWP

SEQ ID NO: 1102261 - protein, 9 aa, Homo Sapiens
TLKYISKHH

SEQ ID NO: 1102262 - protein, 9 aa, Homo Sapiens
TTVETVQEL

SEQ ID NO: 1102263 - protein, 9 aa, Homo Sapiens
SPLLTILEI

SEQ ID NO: 1102264 - protein, 9 aa, Homo Sapiens
WCMAPTIPS

SEQ ID NO: 1102265 - protein, 9 aa, Homo Sapiens
EVITQQGRV

SEQ ID NO: 1102266 - protein, 9 aa, Homo Sapiens
RALSEQAAP

SEQ ID NO: 1102267 - protein, 9 aa, Homo Sapiens
ASCFSNGSW

SEQ ID NO: 1102268 - protein, 9 aa, Homo Sapiens
VFQVIRCPL

SEQ ID NO: 1102269 - protein, 9 aa, Homo Sapiens
FSNLESTHW

SEQ ID NO: 1102270 - protein, 9 aa, Homo Sapiens
LLADESSDS

SEQ ID NO: 1102271 - protein, 9 aa, Homo Sapiens
ESVMVKYNA

SEQ ID NO: 1102272 - protein, 9 aa, Homo Sapiens
TWTGPSVWA

SEQ ID NO: 1102273 - protein, 9 aa, Homo Sapiens
KVARYRRPT

SEQ ID NO: 1102274 - protein, 9 aa, Homo Sapiens
LPTAAPSAG

SEQ ID NO: 1102275 - protein, 9 aa, Homo Sapiens
CSKLSSALQ

SEQ ID NO: 1102276 - protein, 9 aa, Homo Sapiens
AKAKKTAAK

SEQ ID NO: 1102277 - protein, 9 aa, Homo Sapiens
SLLTQPSPA

SEQ ID NO: 1102278 - protein, 9 aa, Homo Sapiens
RAGFQWGES

SEQ ID NO: 1102279 - protein, 9 aa, Homo Sapiens
ARPLEVRAC

SEQ ID NO: 1102280 - protein, 9 aa, Homo Sapiens
LCQCLQRKE

SEQ ID NO: 1102281 - protein, 9 aa, Homo Sapiens
EDLLLGQRP

SEQ ID NO: 1102282 - protein, 9 aa, Homo Sapiens
LLCPQLDKM

SEQ ID NO: 1102283 - protein, 9 aa, Homo Sapiens
RSYCSTRQT

SEQ ID NO: 1102284 - protein, 9 aa, Homo Sapiens
ACDINTEQG

SEQ ID NO: 1102285 - protein, 9 aa, Homo Sapiens
GKCRSADIK

SEQ ID NO: 1102286 - protein, 9 aa, Homo Sapiens
RPGPTTVGN

SEQ ID NO: 1102287 - protein, 9 aa, Homo Sapiens
KIQAWWWGT

SEQ ID NO: 1102288 - protein, 9 aa, Homo Sapiens
SYELQSVAV

SEQ ID NO: 1102289 - protein, 9 aa, Homo Sapiens
PFQSPTKRL

SEQ ID NO: 1102290 - protein, 9 aa, Homo Sapiens
TVGLLWFTH

SEQ ID NO: 1102291 - protein, 9 aa, Homo Sapiens
QPGVRALGK

SEQ ID NO: 1102292 - protein, 9 aa, Homo Sapiens
QGKVLLLHG

SEQ ID NO: 1102293 - protein, 9 aa, Homo Sapiens
AIDQAHRQK

SEQ ID NO: 1102294 - protein, 9 aa, Homo Sapiens
KWESRKEKR

SEQ ID NO: 1102295 - protein, 9 aa, Homo Sapiens
HWTIQKGSF

SEQ ID NO: 1102296 - protein, 9 aa, Homo Sapiens
GREVVAQAT

SEQ ID NO: 1102297 - protein, 9 aa, Homo Sapiens
RETYRLIST

SEQ ID NO: 1102298 - protein, 9 aa, Homo Sapiens
PTERELRMG

SEQ ID NO: 1102299 - protein, 9 aa, Homo Sapiens
LSEGRRPDS

SEQ ID NO: 1102300 - protein, 9 aa, Homo Sapiens
PLGVSPLAP

SEQ ID NO: 1102301 - protein, 9 aa, Homo Sapiens
RKATTPIFF

SEQ ID NO: 1102302 - protein, 9 aa, Homo Sapiens
DCKEGLKFY

SEQ ID NO: 1102303 - protein, 9 aa, Homo Sapiens
TPTSGPGPA

SEQ ID NO: 1102304 - protein, 9 aa, Homo Sapiens
TTRLMAPVG

SEQ ID NO: 1102305 - protein, 9 aa, Homo Sapiens
QGMVRLTRL

SEQ ID NO: 1102306 - protein, 9 aa, Homo Sapiens
RASKTVDFC

SEQ ID NO: 1102307 - protein, 9 aa, Homo Sapiens
RWAGQDLCP

SEQ ID NO: 1102308 - protein, 9 aa, Homo Sapiens
SGPGAHREA

SEQ ID NO: 1102309 - protein, 9 aa, Homo Sapiens
LVLRPPTLW

SEQ ID NO: 1102310 - protein, 9 aa, Homo Sapiens
TTAGPCCPS

SEQ ID NO: 1102311 - protein, 9 aa, Homo Sapiens
RSRLAAASG

SEQ ID NO: 1102312 - protein, 9 aa, Homo Sapiens
AKAATKSLS

SEQ ID NO: 1102313 - protein, 9 aa, Homo Sapiens
WWQRRKQSS

SEQ ID NO: 1102314 - protein, 9 aa, Homo Sapiens
QLFLLTSAS

SEQ ID NO: 1102315 - protein, 9 aa, Homo Sapiens
FFSSPSTSQ

SEQ ID NO: 1102316 - protein, 9 aa, Homo Sapiens
DYDWDRFDR

SEQ ID NO: 1102317 - protein, 9 aa, Homo Sapiens
DYTWGARDA

SEQ ID NO: 1102318 - protein, 9 aa, Homo Sapiens
TGLEGCRPF

SEQ ID NO: 1102319 - protein, 9 aa, Homo Sapiens
TLARHLSFI

SEQ ID NO: 1102320 - protein, 9 aa, Homo Sapiens
LAVQALQFT

SEQ ID NO: 1102321 - protein, 9 aa, Homo Sapiens
NPNLIQVGH

SEQ ID NO: 1102322 - protein, 9 aa, Homo Sapiens
YPKEGRKYP

SEQ ID NO: 1102323 - protein, 9 aa, Homo Sapiens
LFSTLEEST

SEQ ID NO: 1102324 - protein, 9 aa, Homo Sapiens
PWRSRGTWL

SEQ ID NO: 1102325 - protein, 9 aa, Homo Sapiens
GGLLQPKPW

SEQ ID NO: 1102326 - protein, 9 aa, Homo Sapiens
GNERYFFEN

SEQ ID NO: 1102327 - protein, 9 aa, Homo Sapiens
LPVVREDLL

SEQ ID NO: 1102328 - protein, 9 aa, Homo Sapiens
QSPPQPPSE

SEQ ID NO: 1102329 - protein, 9 aa, Homo Sapiens
LFKGRGQIL

SEQ ID NO: 1102330 - protein, 9 aa, Homo Sapiens
ENIEKVKFM

SEQ ID NO: 1102331 - protein, 9 aa, Homo Sapiens
AGGRREPVE

SEQ ID NO: 1102332 - protein, 9 aa, Homo Sapiens
PEERRALRC

SEQ ID NO: 1102333 - protein, 9 aa, Homo Sapiens
ASCSLPPDR

SEQ ID NO: 1102334 - protein, 9 aa, Homo Sapiens
LQLKRAKKT

SEQ ID NO: 1102335 - protein, 9 aa, Homo Sapiens
WTAATLRCP

SEQ ID NO: 1102336 - protein, 9 aa, Homo Sapiens
LDVAPVDMA

SEQ ID NO: 1102337 - protein, 9 aa, Homo Sapiens
PSTSAFKTT

SEQ ID NO: 1102338 - protein, 9 aa, Homo Sapiens
QTATQVDAL

SEQ ID NO: 1102339 - protein, 9 aa, Homo Sapiens
YRLCTVSAS

SEQ ID NO: 1102340 - protein, 9 aa, Homo Sapiens
VWVGAQEAV

SEQ ID NO: 1102341 - protein, 9 aa, Homo Sapiens
ADAFFLVVS

SEQ ID NO: 1102342 - protein, 9 aa, Homo Sapiens
CQELAMVPV

SEQ ID NO: 1102343 - protein, 9 aa, Homo Sapiens
LIITLNCTL

SEQ ID NO: 1102344 - protein, 9 aa, Homo Sapiens
FPSWQYQHI

SEQ ID NO: 1102345 - protein, 9 aa, Homo Sapiens
GFDPAGWVL

SEQ ID NO: 1102346 - protein, 9 aa, Homo Sapiens
KVVRAAQKI

SEQ ID NO: 1102347 - protein, 9 aa, Homo Sapiens
DEAWWQRRK

SEQ ID NO: 1102348 - protein, 9 aa, Homo Sapiens
DSSCLPKDL

SEQ ID NO: 1102349 - protein, 9 aa, Homo Sapiens
VRALGKWLQ

SEQ ID NO: 1102350 - protein, 9 aa, Homo Sapiens
SIPPQHGLE

SEQ ID NO: 1102351 - protein, 9 aa, Homo Sapiens
FDQAQTKIQ

SEQ ID NO: 1102352 - protein, 9 aa, Homo Sapiens
KVSSKDTWE

SEQ ID NO: 1102353 - protein, 9 aa, Homo Sapiens
AAARNPKSK

SEQ ID NO: 1102354 - protein, 9 aa, Homo Sapiens
TAFQLLNLL

SEQ ID NO: 1102355 - protein, 9 aa, Homo Sapiens
RMWTPRIEL

SEQ ID NO: 1102356 - protein, 9 aa, Homo Sapiens
WNVLDDQSR

SEQ ID NO: 1102357 - protein, 9 aa, Homo Sapiens
TVVVLRLDG

SEQ ID NO: 1102358 - protein, 9 aa, Homo Sapiens
VIRMPRRMQ

SEQ ID NO: 1102359 - protein, 9 aa, Homo Sapiens
GPSASAQLW

SEQ ID NO: 1102360 - protein, 9 aa, Homo Sapiens
TLITVATAV

SEQ ID NO: 1102361 - protein, 9 aa, Homo Sapiens
YSTPSSYLE

SEQ ID NO: 1102362 - protein, 9 aa, Homo Sapiens
LAFKKSKKS

SEQ ID NO: 1102363 - protein, 9 aa, Homo Sapiens
TGHQDHQVS

SEQ ID NO: 1102364 - protein, 9 aa, Homo Sapiens
WPCSSMPTK

SEQ ID NO: 1102365 - protein, 9 aa, Homo Sapiens
ENEQKARGA

SEQ ID NO: 1102366 - protein, 9 aa, Homo Sapiens
NMPRPSLAG

SEQ ID NO: 1102367 - protein, 9 aa, Homo Sapiens
QAARIRAAR

SEQ ID NO: 1102368 - protein, 9 aa, Homo Sapiens
CGAARPRRT

SEQ ID NO: 1102369 - protein, 9 aa, Homo Sapiens
RERWLMGCF

SEQ ID NO: 1102370 - protein, 9 aa, Homo Sapiens
SCYHSWLRD

SEQ ID NO: 1102371 - protein, 9 aa, Homo Sapiens
VGPFGSVAP

SEQ ID NO: 1102372 - protein, 9 aa, Homo Sapiens
PSRSHPMTP

SEQ ID NO: 1102373 - protein, 9 aa, Homo Sapiens
QQALHSGQN

SEQ ID NO: 1102374 - protein, 9 aa, Homo Sapiens
DEDEAWWQR

SEQ ID NO: 1102375 - protein, 9 aa, Homo Sapiens
SDPPQPGGV

SEQ ID NO: 1102376 - protein, 9 aa, Homo Sapiens
DSATTWEWE

SEQ ID NO: 1102377 - protein, 9 aa, Homo Sapiens
KCGDLEELK

SEQ ID NO: 1102378 - protein, 9 aa, Homo Sapiens
AVLALLSFW

SEQ ID NO: 1102379 - protein, 9 aa, Homo Sapiens
LVWVAALAL

SEQ ID NO: 1102380 - protein, 9 aa, Homo Sapiens
AWAEAPGLL

SEQ ID NO: 1102381 - protein, 9 aa, Homo Sapiens
RRRKKEATP

SEQ ID NO: 1102382 - protein, 9 aa, Homo Sapiens
VLQWRKFLQ

SEQ ID NO: 1102383 - protein, 9 aa, Homo Sapiens
SMCKQNVVP

SEQ ID NO: 1102384 - protein, 9 aa, Homo Sapiens
ALLINEETR

SEQ ID NO: 1102385 - protein, 9 aa, Homo Sapiens
EGIRCRPGA

SEQ ID NO: 1102386 - protein, 9 aa, Homo Sapiens
TWEIKTDFS

SEQ ID NO: 1102387 - protein, 9 aa, Homo Sapiens
PLYSPICSK

SEQ ID NO: 1102388 - protein, 9 aa, Homo Sapiens
PLCLSKAAW

SEQ ID NO: 1102389 - protein, 9 aa, Homo Sapiens
AARKSITLW

SEQ ID NO: 1102390 - protein, 9 aa, Homo Sapiens
TQNNQKNKE

SEQ ID NO: 1102391 - protein, 9 aa, Homo Sapiens
SRKKKADRD

SEQ ID NO: 1102392 - protein, 9 aa, Homo Sapiens
VRSGPLTGW

SEQ ID NO: 1102393 - protein, 9 aa, Homo Sapiens
LSLQQWKRP

SEQ ID NO: 1102394 - protein, 9 aa, Homo Sapiens
LHMSRIHRG

SEQ ID NO: 1102395 - protein, 9 aa, Homo Sapiens
RLLLQITKR

SEQ ID NO: 1102396 - protein, 9 aa, Homo Sapiens
VMRWGCHHR

SEQ ID NO: 1102397 - protein, 9 aa, Homo Sapiens
PGNFCTFFC

SEQ ID NO: 1102398 - protein, 9 aa, Homo Sapiens
TVAGGWGPW

SEQ ID NO: 1102399 - protein, 9 aa, Homo Sapiens
ALTLPCALW

SEQ ID NO: 1102400 - protein, 9 aa, Homo Sapiens
LECSLHNKM

SEQ ID NO: 1102401 - protein, 9 aa, Homo Sapiens
PRREKRPAK

SEQ ID NO: 1102402 - protein, 9 aa, Homo Sapiens
KVLPMRWVL

SEQ ID NO: 1102403 - protein, 9 aa, Homo Sapiens
VLKSSYSRY

SEQ ID NO: 1102404 - protein, 9 aa, Homo Sapiens
PSPSQASET

SEQ ID NO: 1102405 - protein, 9 aa, Homo Sapiens
CSTSVMTEP

SEQ ID NO: 1102406 - protein, 9 aa, Homo Sapiens
GVQEAPPFC

SEQ ID NO: 1102407 - protein, 9 aa, Homo Sapiens
HEAEFQKMR

SEQ ID NO: 1102408 - protein, 9 aa, Homo Sapiens
EGDQHVTGQ

SEQ ID NO: 1102409 - protein, 9 aa, Homo Sapiens
AHPVPTYVP

SEQ ID NO: 1102410 - protein, 9 aa, Homo Sapiens
YLMELSVVA

SEQ ID NO: 1102411 - protein, 9 aa, Homo Sapiens
LTVVTVDHS

SEQ ID NO: 1102412 - protein, 9 aa, Homo Sapiens
QGPLHPVPR

SEQ ID NO: 1102413 - protein, 9 aa, Homo Sapiens
APTLPTAAP

SEQ ID NO: 1102414 - protein, 9 aa, Homo Sapiens
LYVVLNDEK

SEQ ID NO: 1102415 - protein, 9 aa, Homo Sapiens
QTSGGVLWD

SEQ ID NO: 1102416 - protein, 9 aa, Homo Sapiens
LSPASSMES

SEQ ID NO: 1102417 - protein, 9 aa, Homo Sapiens
MHPRFCHPL

SEQ ID NO: 1102418 - protein, 9 aa, Homo Sapiens
WFLPGGKMG

SEQ ID NO: 1102419 - protein, 9 aa, Homo Sapiens
LPHVDFQLV

SEQ ID NO: 1102420 - protein, 9 aa, Homo Sapiens
TTWEWEMAL

SEQ ID NO: 1102421 - protein, 9 aa, Homo Sapiens
WCGWLCPTP

SEQ ID NO: 1102422 - protein, 9 aa, Homo Sapiens
YQPPAKKNK

SEQ ID NO: 1102423 - protein, 9 aa, Homo Sapiens
RCRPAVASR

SEQ ID NO: 1102424 - protein, 9 aa, Homo Sapiens
WWWTQATPA

SEQ ID NO: 1102425 - protein, 9 aa, Homo Sapiens
PEGIRCRPG

SEQ ID NO: 1102426 - protein, 9 aa, Homo Sapiens
TMSPFSKTP

SEQ ID NO: 1102427 - protein, 9 aa, Homo Sapiens
GVGLGVEEG

SEQ ID NO: 1102428 - protein, 9 aa, Homo Sapiens
TDKTLVATG

SEQ ID NO: 1102429 - protein, 9 aa, Homo Sapiens
VHPSQTEIL

SEQ ID NO: 1102430 - protein, 9 aa, Homo Sapiens
VPFLNYAMS

SEQ ID NO: 1102431 - protein, 9 aa, Homo Sapiens
PPSFSAPCC

SEQ ID NO: 1102432 - protein, 9 aa, Homo Sapiens
GKQLTVKRH

SEQ ID NO: 1102433 - protein, 9 aa, Homo Sapiens
HHRMGAAWQ

SEQ ID NO: 1102434 - protein, 9 aa, Homo Sapiens
PPPVWAVLA

SEQ ID NO: 1102435 - protein, 9 aa, Homo Sapiens
TQSWIPQSA

SEQ ID NO: 1102436 - protein, 9 aa, Homo Sapiens
TWTFYGTPE

SEQ ID NO: 1102437 - protein, 9 aa, Homo Sapiens
DTYDVPRGV

SEQ ID NO: 1102438 - protein, 9 aa, Homo Sapiens
LHGQFQGHR

SEQ ID NO: 1102439 - protein, 9 aa, Homo Sapiens
VGCIAIGVS

SEQ ID NO: 1102440 - protein, 9 aa, Homo Sapiens
LHQLKCQHE

SEQ ID NO: 1102441 - protein, 9 aa, Homo Sapiens
KRLCAVRDP

SEQ ID NO: 1102442 - protein, 9 aa, Homo Sapiens
QPDWMPPPE

SEQ ID NO: 1102443 - protein, 9 aa, Homo Sapiens
RVALIVASA

SEQ ID NO: 1102444 - protein, 9 aa, Homo Sapiens
GRPGLPSHV

SEQ ID NO: 1102445 - protein, 9 aa, Homo Sapiens
NERGKEIFA

SEQ ID NO: 1102446 - protein, 9 aa, Homo Sapiens
TTCWPRRTL

SEQ ID NO: 1102447 - protein, 9 aa, Homo Sapiens
LQEAVAESL

SEQ ID NO: 1102448 - protein, 9 aa, Homo Sapiens
EFKSIKKHH

SEQ ID NO: 1102449 - protein, 9 aa, Homo Sapiens
LCDRDVGGH

SEQ ID NO: 1102450 - protein, 9 aa, Homo Sapiens
VATSPLPSP

SEQ ID NO: 1102451 - protein, 9 aa, Homo Sapiens
QILRELKYI

SEQ ID NO: 1102452 - protein, 9 aa, Homo Sapiens
KNTSMWTSR

SEQ ID NO: 1102453 - protein, 9 aa, Homo Sapiens
KHHRRERRF

SEQ ID NO: 1102454 - protein, 9 aa, Homo Sapiens
LITFLTSII

SEQ ID NO: 1102455 - protein, 9 aa, Homo Sapiens
CRINPKTGA

SEQ ID NO: 1102456 - protein, 9 aa, Homo Sapiens
FCHVIAWQQ

SEQ ID NO: 1102457 - protein, 9 aa, Homo Sapiens
NKIVPFLNY

SEQ ID NO: 1102458 - protein, 9 aa, Homo Sapiens
NGSVKRVWS

SEQ ID NO: 1102459 - protein, 9 aa, Homo Sapiens
KFPFNQWCL

SEQ ID NO: 1102460 - protein, 9 aa, Homo Sapiens
SSYGGPASS

SEQ ID NO: 1102461 - protein, 9 aa, Homo Sapiens
VRLLLGVCG

SEQ ID NO: 1102462 - protein, 9 aa, Homo Sapiens
SPSQEPQET

SEQ ID NO: 1102463 - protein, 9 aa, Homo Sapiens
PCFRTAGSA

SEQ ID NO: 1102464 - protein, 9 aa, Homo Sapiens
KWLQWPHPD

SEQ ID NO: 1102465 - protein, 9 aa, Homo Sapiens
AGAPSSKAT

SEQ ID NO: 1102466 - protein, 9 aa, Homo Sapiens
LGKCRSKTL

SEQ ID NO: 1102467 - protein, 9 aa, Homo Sapiens
ALGKWLQWP

SEQ ID NO: 1102468 - protein, 9 aa, Homo Sapiens
AHCLGAEGA

SEQ ID NO: 1102469 - protein, 9 aa, Homo Sapiens
YRVEGGWPQ

SEQ ID NO: 1102470 - protein, 9 aa, Homo Sapiens
LCLSKAAWQ

SEQ ID NO: 1102471 - protein, 9 aa, Homo Sapiens
TFYGTPEYV

SEQ ID NO: 1102472 - protein, 9 aa, Homo Sapiens
AGPLGAPGH

SEQ ID NO: 1102473 - protein, 9 aa, Homo Sapiens
SSQPDHSRL

SEQ ID NO: 1102474 - protein, 9 aa, Homo Sapiens
SVVKFPVTI

SEQ ID NO: 1102475 - protein, 9 aa, Homo Sapiens
IIFDCSHSM

SEQ ID NO: 1102476 - protein, 9 aa, Homo Sapiens
CLQNTSLES

SEQ ID NO: 1102477 - protein, 9 aa, Homo Sapiens
GKLLPLPRS

SEQ ID NO: 1102478 - protein, 9 aa, Homo Sapiens
GQDPEPAGG

SEQ ID NO: 1102479 - protein, 9 aa, Homo Sapiens
AEEGAGRQH

SEQ ID NO: 1102480 - protein, 9 aa, Homo Sapiens
SPGGLGTAQ

SEQ ID NO: 1102481 - protein, 9 aa, Homo Sapiens
KIFDVCNGG

SEQ ID NO: 1102482 - protein, 9 aa, Homo Sapiens
TQGPLHPVP

SEQ ID NO: 1102483 - protein, 9 aa, Homo Sapiens
ALPWPVTPA

SEQ ID NO: 1102484 - protein, 9 aa, Homo Sapiens
LTTQSWIPQ

SEQ ID NO: 1102485 - protein, 9 aa, Homo Sapiens
PGRRLCTGE

SEQ ID NO: 1102486 - protein, 9 aa, Homo Sapiens
ANSLDATLP

SEQ ID NO: 1102487 - protein, 9 aa, Homo Sapiens
RVNMPRPSL

SEQ ID NO: 1102488 - protein, 9 aa, Homo Sapiens
GEWRQGGSP

SEQ ID NO: 1102489 - protein, 9 aa, Homo Sapiens
ISKLKNQHQ

SEQ ID NO: 1102490 - protein, 9 aa, Homo Sapiens
FEENRYKFY

SEQ ID NO: 1102491 - protein, 9 aa, Homo Sapiens
PRPSLAGSR

SEQ ID NO: 1102492 - protein, 9 aa, Homo Sapiens
PGEADLADG

SEQ ID NO: 1102493 - protein, 9 aa, Homo Sapiens
RTFTKHLML

SEQ ID NO: 1102494 - protein, 9 aa, Homo Sapiens
LREAQTINH

SEQ ID NO: 1102495 - protein, 9 aa, Homo Sapiens
KYRKFLPLT

SEQ ID NO: 1102496 - protein, 9 aa, Homo Sapiens
NLAVRPPPS

SEQ ID NO: 1102497 - protein, 9 aa, Homo Sapiens
RGFQILGLR

SEQ ID NO: 1102498 - protein, 9 aa, Homo Sapiens
ASDPPQPGG

SEQ ID NO: 1102499 - protein, 9 aa, Homo Sapiens
MRVNMPRPS

SEQ ID NO: 1102500 - protein, 9 aa, Homo Sapiens
RQGYPKEGR

SEQ ID NO: 1102501 - protein, 9 aa, Homo Sapiens
FDVCNGGQI

SEQ ID NO: 1102502 - protein, 9 aa, Homo Sapiens
HFKAHHSVL

SEQ ID NO: 1102503 - protein, 9 aa, Homo Sapiens
RACQGFMGL

SEQ ID NO: 1102504 - protein, 9 aa, Homo Sapiens
NFEEMRVLL

SEQ ID NO: 1102505 - protein, 9 aa, Homo Sapiens
HHLYYQDKV

SEQ ID NO: 1102506 - protein, 9 aa, Homo Sapiens
QRARGSHIW

SEQ ID NO: 1102507 - protein, 9 aa, Homo Sapiens
FAKFYCSVD

SEQ ID NO: 1102508 - protein, 9 aa, Homo Sapiens
LEVVVVHEL

SEQ ID NO: 1102509 - protein, 9 aa, Homo Sapiens
TPVSPLQTA

SEQ ID NO: 1102510 - protein, 9 aa, Homo Sapiens
VHNFEIDTE

SEQ ID NO: 1102511 - protein, 9 aa, Homo Sapiens
QLATVLTYA

SEQ ID NO: 1102512 - protein, 9 aa, Homo Sapiens
SVKRVWSRN

SEQ ID NO: 1102513 - protein, 9 aa, Homo Sapiens
RTVDCKLKL

SEQ ID NO: 1102514 - protein, 9 aa, Homo Sapiens
GSFLGEFHP

SEQ ID NO: 1102515 - protein, 9 aa, Homo Sapiens
PAHHSGSHS

SEQ ID NO: 1102516 - protein, 9 aa, Homo Sapiens
PPPGAAGRR

SEQ ID NO: 1102517 - protein, 9 aa, Homo Sapiens
QFHVYSELP

SEQ ID NO: 1102518 - protein, 9 aa, Homo Sapiens
RRKKEATPK

SEQ ID NO: 1102519 - protein, 9 aa, Homo Sapiens
CLPLGATSS

SEQ ID NO: 1102520 - protein, 9 aa, Homo Sapiens
RGGVPDPSP

SEQ ID NO: 1102521 - protein, 9 aa, Homo Sapiens
VQTSPGRGR

SEQ ID NO: 1102522 - protein, 9 aa, Homo Sapiens
PWPEVWKEV

SEQ ID NO: 1102523 - protein, 9 aa, Homo Sapiens
WSLTLSMAE

SEQ ID NO: 1102524 - protein, 9 aa, Homo Sapiens
ASCLFPPFE

SEQ ID NO: 1102525 - protein, 9 aa, Homo Sapiens
VNDYTWGAR

SEQ ID NO: 1102526 - protein, 9 aa, Homo Sapiens
EQKARGAAL

SEQ ID NO: 1102527 - protein, 9 aa, Homo Sapiens
QGYSAYTTQ

SEQ ID NO: 1102528 - protein, 9 aa, Homo Sapiens
VSEGAGPRG

SEQ ID NO: 1102529 - protein, 9 aa, Homo Sapiens
LWTPAWCMA

SEQ ID NO: 1102530 - protein, 9 aa, Homo Sapiens
REREKENKW

SEQ ID NO: 1102531 - protein, 9 aa, Homo Sapiens
LRDAIKWRG

SEQ ID NO: 1102532 - protein, 9 aa, Homo Sapiens
SLAASLVVL

SEQ ID NO: 1102533 - protein, 9 aa, Homo Sapiens
LLEHGLVCA

SEQ ID NO: 1102534 - protein, 9 aa, Homo Sapiens
LGQPGVRAL

SEQ ID NO: 1102535 - protein, 9 aa, Homo Sapiens
AREALVAEL

SEQ ID NO: 1102536 - protein, 9 aa, Homo Sapiens
EIFYLKKRK

SEQ ID NO: 1102537 - protein, 9 aa, Homo Sapiens
AEEEYLERY

SEQ ID NO: 1102538 - protein, 9 aa, Homo Sapiens
LASLPSRSP

SEQ ID NO: 1102539 - protein, 9 aa, Homo Sapiens
ACVSPSITS

SEQ ID NO: 1102540 - protein, 9 aa, Homo Sapiens
RPRRTRSAW

SEQ ID NO: 1102541 - protein, 9 aa, Homo Sapiens
IGQDQRRLF

SEQ ID NO: 1102542 - protein, 9 aa, Homo Sapiens
WLIRVASIL

SEQ ID NO: 1102543 - protein, 9 aa, Homo Sapiens
SELDPPHRV

SEQ ID NO: 1102544 - protein, 9 aa, Homo Sapiens
SRLLPEHCT

SEQ ID NO: 1102545 - protein, 9 aa, Homo Sapiens
APPETPGLL

SEQ ID NO: 1102546 - protein, 9 aa, Homo Sapiens
VLIVGCIAI

SEQ ID NO: 1102547 - protein, 9 aa, Homo Sapiens
DGYPPHQQD

SEQ ID NO: 1102548 - protein, 9 aa, Homo Sapiens
LAEDPRVER

SEQ ID NO: 1102549 - protein, 9 aa, Homo Sapiens
CPLGMAPAL

SEQ ID NO: 1102550 - protein, 9 aa, Homo Sapiens
ACRAEYFDG

SEQ ID NO: 1102551 - protein, 9 aa, Homo Sapiens
VLSFTTANT

SEQ ID NO: 1102552 - protein, 9 aa, Homo Sapiens
TRHALTRAG

SEQ ID NO: 1102553 - protein, 9 aa, Homo Sapiens
ENTPERERG

SEQ ID NO: 1102554 - protein, 9 aa, Homo Sapiens
PPGWLPRLT

SEQ ID NO: 1102555 - protein, 9 aa, Homo Sapiens
AESEWNWHG

SEQ ID NO: 1102556 - protein, 9 aa, Homo Sapiens
PVLVELLLR

SEQ ID NO: 1102557 - protein, 9 aa, Homo Sapiens
KLQPGFGGS

SEQ ID NO: 1102558 - protein, 9 aa, Homo Sapiens
CHRSSALQG

SEQ ID NO: 1102559 - protein, 9 aa, Homo Sapiens
CMSAPQPTP

SEQ ID NO: 1102560 - protein, 9 aa, Homo Sapiens
GGGRGQEEK

SEQ ID NO: 1102561 - protein, 9 aa, Homo Sapiens
APGSLPWVF

SEQ ID NO: 1102562 - protein, 9 aa, Homo Sapiens
SFRGSGPGR

SEQ ID NO: 1102563 - protein, 9 aa, Homo Sapiens
DFSHRLTRG

SEQ ID NO: 1102564 - protein, 9 aa, Homo Sapiens
QATPAPTWT

SEQ ID NO: 1102565 - protein, 9 aa, Homo Sapiens
KWRSYNVHH

SEQ ID NO: 1102566 - protein, 9 aa, Homo Sapiens
GRHWLCPQT

SEQ ID NO: 1102567 - protein, 9 aa, Homo Sapiens
KRRIYQHLR

SEQ ID NO: 1102568 - protein, 9 aa, Homo Sapiens
LLVGIVQCA

SEQ ID NO: 1102569 - protein, 9 aa, Homo Sapiens
PQAVAPAAM

SEQ ID NO: 1102570 - protein, 9 aa, Homo Sapiens
QKHHRRERR

SEQ ID NO: 1102571 - protein, 9 aa, Homo Sapiens
PALLSVCKF

SEQ ID NO: 1102572 - protein, 9 aa, Homo Sapiens
WAPLGRGIF

SEQ ID NO: 1102573 - protein, 9 aa, Homo Sapiens
HIWPKGFEA

SEQ ID NO: 1102574 - protein, 9 aa, Homo Sapiens
YNSSRYIGI

SEQ ID NO: 1102575 - protein, 9 aa, Homo Sapiens
FPLWWPASG

SEQ ID NO: 1102576 - protein, 9 aa, Homo Sapiens
LVPARYRKP

SEQ ID NO: 1102577 - protein, 9 aa, Homo Sapiens
NIHGVRMGL

SEQ ID NO: 1102578 - protein, 9 aa, Homo Sapiens
AAQDGARCP

SEQ ID NO: 1102579 - protein, 9 aa, Homo Sapiens
VFSVAYQEF

SEQ ID NO: 1102580 - protein, 9 aa, Homo Sapiens
EHLGQELAL

SEQ ID NO: 1102581 - protein, 9 aa, Homo Sapiens
WNTASFRKT

SEQ ID NO: 1102582 - protein, 9 aa, Homo Sapiens
VGASDRGSL

SEQ ID NO: 1102583 - protein, 9 aa, Homo Sapiens
AAWSMGGDT

SEQ ID NO: 1102584 - protein, 9 aa, Homo Sapiens
LGHAQRVGE

SEQ ID NO: 1102585 - protein, 9 aa, Homo Sapiens
GPLAPAHHS

SEQ ID NO: 1102586 - protein, 9 aa, Homo Sapiens
DGSLDRNLG

SEQ ID NO: 1102587 - protein, 9 aa, Homo Sapiens
WTLHAFGRQ

SEQ ID NO: 1102588 - protein, 9 aa, Homo Sapiens
DEWDRVLEE

SEQ ID NO: 1102589 - protein, 9 aa, Homo Sapiens
EYFMACFLP

SEQ ID NO: 1102590 - protein, 9 aa, Homo Sapiens
FLLFFSSVI

SEQ ID NO: 1102591 - protein, 9 aa, Homo Sapiens
GAAGRYLCF

SEQ ID NO: 1102592 - protein, 9 aa, Homo Sapiens
VPTAIGQLW

SEQ ID NO: 1102593 - protein, 9 aa, Homo Sapiens
PGSEIPPPA

SEQ ID NO: 1102594 - protein, 9 aa, Homo Sapiens
PRLRMASRT

SEQ ID NO: 1102595 - protein, 9 aa, Homo Sapiens
WRRRHVCKQ

SEQ ID NO: 1102596 - protein, 9 aa, Homo Sapiens
ASSGTAAPG

SEQ ID NO: 1102597 - protein, 9 aa, Homo Sapiens
GAVAPTATL

SEQ ID NO: 1102598 - protein, 9 aa, Homo Sapiens
CDVPQAIKL

SEQ ID NO: 1102599 - protein, 9 aa, Homo Sapiens
FDDDKVSIA

SEQ ID NO: 1102600 - protein, 9 aa, Homo Sapiens
KKKGTPTEW

SEQ ID NO: 1102601 - protein, 9 aa, Homo Sapiens
RREPVEPGQ

SEQ ID NO: 1102602 - protein, 9 aa, Homo Sapiens
FFVLVNLEV

SEQ ID NO: 1102603 - protein, 9 aa, Homo Sapiens
QQGDLLTPP

SEQ ID NO: 1102604 - protein, 9 aa, Homo Sapiens
PGKRSTARA

SEQ ID NO: 1102605 - protein, 9 aa, Homo Sapiens
CSQRLWQSP

SEQ ID NO: 1102606 - protein, 9 aa, Homo Sapiens
HYSLHFLLI

SEQ ID NO: 1102607 - protein, 9 aa, Homo Sapiens
ITLLTLGSM

SEQ ID NO: 1102608 - protein, 9 aa, Homo Sapiens
LEPNGNALP

SEQ ID NO: 1102609 - protein, 9 aa, Homo Sapiens
WWVQNTRIL

SEQ ID NO: 1102610 - protein, 9 aa, Homo Sapiens
GRDSYSGPP

SEQ ID NO: 1102611 - protein, 9 aa, Homo Sapiens
AARHSGRGP

SEQ ID NO: 1102612 - protein, 9 aa, Homo Sapiens
EVRACQGFM

SEQ ID NO: 1102613 - protein, 9 aa, Homo Sapiens
LFLHHLHCP

SEQ ID NO: 1102614 - protein, 9 aa, Homo Sapiens
AETEDEDKG

SEQ ID NO: 1102615 - protein, 9 aa, Homo Sapiens
LVSLEAQHH

SEQ ID NO: 1102616 - protein, 9 aa, Homo Sapiens
NLLKTALQP

SEQ ID NO: 1102617 - protein, 9 aa, Homo Sapiens
TRTESATRS

SEQ ID NO: 1102618 - protein, 9 aa, Homo Sapiens
LAVFLLFLA

SEQ ID NO: 1102619 - protein, 9 aa, Homo Sapiens
QLSRLIRYI

SEQ ID NO: 1102620 - protein, 9 aa, Homo Sapiens
PATSSSRGG

SEQ ID NO: 1102621 - protein, 9 aa, Homo Sapiens
WEMALRVAG

SEQ ID NO: 1102622 - protein, 9 aa, Homo Sapiens
LSSLPPPKA

SEQ ID NO: 1102623 - protein, 9 aa, Homo Sapiens
LQKSSCFQR

SEQ ID NO: 1102624 - protein, 9 aa, Homo Sapiens
GQSQTVRQF

SEQ ID NO: 1102625 - protein, 9 aa, Homo Sapiens
FSCCFPHFE

SEQ ID NO: 1102626 - protein, 9 aa, Homo Sapiens
KGKLSVTFC

SEQ ID NO: 1102627 - protein, 9 aa, Homo Sapiens
FRACCRSGK

SEQ ID NO: 1102628 - protein, 9 aa, Homo Sapiens
MALPSVDPT

SEQ ID NO: 1102629 - protein, 9 aa, Homo Sapiens
TLQPVTSKD

SEQ ID NO: 1102630 - protein, 9 aa, Homo Sapiens
DDSLSPCLG

SEQ ID NO: 1102631 - protein, 9 aa, Homo Sapiens
MFLRILEQK

SEQ ID NO: 1102632 - protein, 9 aa, Homo Sapiens
PPRGIPDKS

SEQ ID NO: 1102633 - protein, 9 aa, Homo Sapiens
CDASVSFHH

SEQ ID NO: 1102634 - protein, 9 aa, Homo Sapiens
VDINQLTEF

SEQ ID NO: 1102635 - protein, 9 aa, Homo Sapiens
ARTRAGLVE

SEQ ID NO: 1102636 - protein, 9 aa, Homo Sapiens
LPCSGDEQG

SEQ ID NO: 1102637 - protein, 9 aa, Homo Sapiens
STLRILADL

SEQ ID NO: 1102638 - protein, 9 aa, Homo Sapiens
LTAFQLLNL

SEQ ID NO: 1102639 - protein, 9 aa, Homo Sapiens
EENRYKFYL

SEQ ID NO: 1102640 - protein, 9 aa, Homo Sapiens
RDDCKEGLK

SEQ ID NO: 1102641 - protein, 9 aa, Homo Sapiens
HGVQEAPPF

SEQ ID NO: 1102642 - protein, 9 aa, Homo Sapiens
GPHRPERGP

SEQ ID NO: 1102643 - protein, 9 aa, Homo Sapiens
SFAPPRGIP

SEQ ID NO: 1102644 - protein, 9 aa, Homo Sapiens
LDSLDGGMK

SEQ ID NO: 1102645 - protein, 9 aa, Homo Sapiens
SHVDFLAGD

SEQ ID NO: 1102646 - protein, 9 aa, Homo Sapiens
ESTFTTPKF

SEQ ID NO: 1102647 - protein, 9 aa, Homo Sapiens
YGVPSPECE

SEQ ID NO: 1102648 - protein, 9 aa, Homo Sapiens
IWDTAGQEQ

SEQ ID NO: 1102649 - protein, 9 aa, Homo Sapiens
PAAARGAST

SEQ ID NO: 1102650 - protein, 9 aa, Homo Sapiens
ARETRSGRP

SEQ ID NO: 1102651 - protein, 9 aa, Homo Sapiens
MFRPVVPAL

SEQ ID NO: 1102652 - protein, 9 aa, Homo Sapiens
GTAQLKENN

SEQ ID NO: 1102653 - protein, 9 aa, Homo Sapiens
ASLFQMAHF

SEQ ID NO: 1102654 - protein, 9 aa, Homo Sapiens
RGLTERPHN

SEQ ID NO: 1102655 - protein, 9 aa, Homo Sapiens
EQREQEWAV

SEQ ID NO: 1102656 - protein, 9 aa, Homo Sapiens
METFLSKAC

SEQ ID NO: 1102657 - protein, 9 aa, Homo Sapiens
SPPSVEKNS

SEQ ID NO: 1102658 - protein, 9 aa, Homo Sapiens
VLFEGTCAV

SEQ ID NO: 1102659 - protein, 9 aa, Homo Sapiens
TFLTSIIVV

SEQ ID NO: 1102660 - protein, 9 aa, Homo Sapiens
GAARRSQRL

SEQ ID NO: 1102661 - protein, 9 aa, Homo Sapiens
SHSLRGETV

SEQ ID NO: 1102662 - protein, 9 aa, Homo Sapiens
LIELLISLS

SEQ ID NO: 1102663 - protein, 9 aa, Homo Sapiens
TSPWPSPQQ

SEQ ID NO: 1102664 - protein, 9 aa, Homo Sapiens
EWDRVLEEL

SEQ ID NO: 1102665 - protein, 9 aa, Homo Sapiens
CTGLPSGAI

SEQ ID NO: 1102666 - protein, 9 aa, Homo Sapiens
FAHQHQPPA

SEQ ID NO: 1102667 - protein, 9 aa, Homo Sapiens
VGPQFVRCR

SEQ ID NO: 1102668 - protein, 9 aa, Homo Sapiens
VGCPAGGPC

SEQ ID NO: 1102669 - protein, 9 aa, Homo Sapiens
CVSPSITST

SEQ ID NO: 1102670 - protein, 9 aa, Homo Sapiens
SPQGPLFLL

SEQ ID NO: 1102671 - protein, 9 aa, Homo Sapiens
VGGVSTSWG

SEQ ID NO: 1102672 - protein, 9 aa, Homo Sapiens
KEIDLFQVR

SEQ ID NO: 1102673 - protein, 9 aa, Homo Sapiens
AWEWAKSMT

SEQ ID NO: 1102674 - protein, 9 aa, Homo Sapiens
SAGAARASD

SEQ ID NO: 1102675 - protein, 9 aa, Homo Sapiens
PPKERPDLP

SEQ ID NO: 1102676 - protein, 9 aa, Homo Sapiens
DVAVQVVRA

SEQ ID NO: 1102677 - protein, 9 aa, Homo Sapiens
AKGEEKPTR

SEQ ID NO: 1102678 - protein, 9 aa, Homo Sapiens
SPLMSEFRK

SEQ ID NO: 1102679 - protein, 9 aa, Homo Sapiens
NPHYAHVIG

SEQ ID NO: 1102680 - protein, 9 aa, Homo Sapiens
LDLRMGWGG

SEQ ID NO: 1102681 - protein, 9 aa, Homo Sapiens
VCNVGEKGL

SEQ ID NO: 1102682 - protein, 9 aa, Homo Sapiens
DCAILHEKR

SEQ ID NO: 1102683 - protein, 9 aa, Homo Sapiens
PGRHEGHEP

SEQ ID NO: 1102684 - protein, 9 aa, Homo Sapiens
RRGCAWYLC

SEQ ID NO: 1102685 - protein, 9 aa, Homo Sapiens
PTTWGCWPS

SEQ ID NO: 1102686 - protein, 9 aa, Homo Sapiens
TSANVVCAG

SEQ ID NO: 1102687 - protein, 9 aa, Homo Sapiens
IKWTKVWTA

SEQ ID NO: 1102688 - protein, 9 aa, Homo Sapiens
YLQGWEFQS

SEQ ID NO: 1102689 - protein, 9 aa, Homo Sapiens
WPVTPAPVQ

SEQ ID NO: 1102690 - protein, 9 aa, Homo Sapiens
GAAGRRRPA

SEQ ID NO: 1102691 - protein, 9 aa, Homo Sapiens
TKYVRILAF

SEQ ID NO: 1102692 - protein, 9 aa, Homo Sapiens
QRLQHVLHA

SEQ ID NO: 1102693 - protein, 9 aa, Homo Sapiens
CSSSTKSSS

SEQ ID NO: 1102694 - protein, 9 aa, Homo Sapiens
PWRAGFQWG

SEQ ID NO: 1102695 - protein, 9 aa, Homo Sapiens
VPEKKVDEK

SEQ ID NO: 1102696 - protein, 9 aa, Homo Sapiens
SGPNPVVLM

SEQ ID NO: 1102697 - protein, 9 aa, Homo Sapiens
PAPGWRPRS

SEQ ID NO: 1102698 - protein, 9 aa, Homo Sapiens
ANTVPTAIG

SEQ ID NO: 1102699 - protein, 9 aa, Homo Sapiens
PWLMDPKIL

SEQ ID NO: 1102700 - protein, 9 aa, Homo Sapiens
NGLLFKGRG

SEQ ID NO: 1102701 - protein, 9 aa, Homo Sapiens
ERFGNQQRT

SEQ ID NO: 1102702 - protein, 9 aa, Homo Sapiens
LKESEIQLC

SEQ ID NO: 1102703 - protein, 9 aa, Homo Sapiens
CGWLCPTPS

SEQ ID NO: 1102704 - protein, 9 aa, Homo Sapiens
DGEPNPGVG

SEQ ID NO: 1102705 - protein, 9 aa, Homo Sapiens
RRIYQHLRY

SEQ ID NO: 1102706 - protein, 9 aa, Homo Sapiens
KTQAQSILE

SEQ ID NO: 1102707 - protein, 9 aa, Homo Sapiens
DLHLALGHA

SEQ ID NO: 1102708 - protein, 9 aa, Homo Sapiens
LFEGTELEQ

SEQ ID NO: 1102709 - protein, 9 aa, Homo Sapiens
NANSVEKEK

SEQ ID NO: 1102710 - protein, 9 aa, Homo Sapiens
QCTTVETVQ

SEQ ID NO: 1102711 - protein, 9 aa, Homo Sapiens
LAINMVPFP

SEQ ID NO: 1102712 - protein, 9 aa, Homo Sapiens
EEDDEDGGE

SEQ ID NO: 1102713 - protein, 9 aa, Homo Sapiens
SPRSSAQGV

SEQ ID NO: 1102714 - protein, 9 aa, Homo Sapiens
PPWPTHLPS

SEQ ID NO: 1102715 - protein, 9 aa, Homo Sapiens
ALRCSTTRD

SEQ ID NO: 1102716 - protein, 9 aa, Homo Sapiens
KVDEKQAST

SEQ ID NO: 1102717 - protein, 9 aa, Homo Sapiens
QRIQNLSCF

SEQ ID NO: 1102718 - protein, 9 aa, Homo Sapiens
NKNGGNLQP

SEQ ID NO: 1102719 - protein, 9 aa, Homo Sapiens
VCGHLKPSG

SEQ ID NO: 1102720 - protein, 9 aa, Homo Sapiens
MWTPRIELT

SEQ ID NO: 1102721 - protein, 9 aa, Homo Sapiens
ASRSTAPSP

SEQ ID NO: 1102722 - protein, 9 aa, Homo Sapiens
HTEAAHRAV

SEQ ID NO: 1102723 - protein, 9 aa, Homo Sapiens
GPFCMSSTR

SEQ ID NO: 1102724 - protein, 9 aa, Homo Sapiens
IKFLFELVA

SEQ ID NO: 1102725 - protein, 9 aa, Homo Sapiens
AELPVACEE

SEQ ID NO: 1102726 - protein, 9 aa, Homo Sapiens
ASADLVIWA

SEQ ID NO: 1102727 - protein, 9 aa, Homo Sapiens
DITALMAAT

SEQ ID NO: 1102728 - protein, 9 aa, Homo Sapiens
LVSVSRDKT

SEQ ID NO: 1102729 - protein, 9 aa, Homo Sapiens
WEERNPYKT

SEQ ID NO: 1102730 - protein, 9 aa, Homo Sapiens
VAYKRPIQE

SEQ ID NO: 1102731 - protein, 9 aa, Homo Sapiens
CLRTSCGAA

SEQ ID NO: 1102732 - protein, 9 aa, Homo Sapiens
ELEGLGIAS

SEQ ID NO: 1102733 - protein, 9 aa, Homo Sapiens
HFKMKNPHL

SEQ ID NO: 1102734 - protein, 9 aa, Homo Sapiens
DLLSTAKSK

SEQ ID NO: 1102735 - protein, 9 aa, Homo Sapiens
AVLGKTPLS

SEQ ID NO: 1102736 - protein, 9 aa, Homo Sapiens
PRMSLMPCG

SEQ ID NO: 1102737 - protein, 9 aa, Homo Sapiens
AFGRAFCNV

SEQ ID NO: 1102738 - protein, 9 aa, Homo Sapiens
GAQEAVQEV

SEQ ID NO: 1102739 - protein, 9 aa, Homo Sapiens
LMPTLSPMG

SEQ ID NO: 1102740 - protein, 9 aa, Homo Sapiens
QSSPRISEL

SEQ ID NO: 1102741 - protein, 9 aa, Homo Sapiens
AFFVDSSSY

SEQ ID NO: 1102742 - protein, 9 aa, Homo Sapiens
LSLYLDRQF

SEQ ID NO: 1102743 - protein, 9 aa, Homo Sapiens
CTGLGVIRM

SEQ ID NO: 1102744 - protein, 9 aa, Homo Sapiens
GLLRTFMCS

SEQ ID NO: 1102745 - protein, 9 aa, Homo Sapiens
LYLGRVHWC

SEQ ID NO: 1102746 - protein, 9 aa, Homo Sapiens
EAVQEVADG

SEQ ID NO: 1102747 - protein, 9 aa, Homo Sapiens
FTSLGLLPW

SEQ ID NO: 1102748 - protein, 9 aa, Homo Sapiens
MREVKALTK

SEQ ID NO: 1102749 - protein, 9 aa, Homo Sapiens
VCKFTEKHE

SEQ ID NO: 1102750 - protein, 9 aa, Homo Sapiens
DDGLSRVCN

SEQ ID NO: 1102751 - protein, 9 aa, Homo Sapiens
LPPPKARRR

SEQ ID NO: 1102752 - protein, 9 aa, Homo Sapiens
ITTGSVGKN

SEQ ID NO: 1102753 - protein, 9 aa, Homo Sapiens
FSNSGKGAR

SEQ ID NO: 1102754 - protein, 9 aa, Homo Sapiens
HTDATGHLL

SEQ ID NO: 1102755 - protein, 9 aa, Homo Sapiens
LYRGGQRCR

SEQ ID NO: 1102756 - protein, 9 aa, Homo Sapiens
SGLWRPGTC

SEQ ID NO: 1102757 - protein, 9 aa, Homo Sapiens
VRISSFPDE

SEQ ID NO: 1102758 - protein, 9 aa, Homo Sapiens
PDVKIELKI

SEQ ID NO: 1102759 - protein, 9 aa, Homo Sapiens
ALSNKNLLI

SEQ ID NO: 1102760 - protein, 9 aa, Homo Sapiens
LNFEEMRVL

SEQ ID NO: 1102761 - protein, 9 aa, Homo Sapiens
GDCEGIGCC

SEQ ID NO: 1102762 - protein, 9 aa, Homo Sapiens
WAVLAWARA

SEQ ID NO: 1102763 - protein, 9 aa, Homo Sapiens
EPYEWDHAV

SEQ ID NO: 1102764 - protein, 9 aa, Homo Sapiens
PPVPGVPGR

SEQ ID NO: 1102765 - protein, 9 aa, Homo Sapiens
ILDLQQKWN

SEQ ID NO: 1102766 - protein, 9 aa, Homo Sapiens
PPEASCLFP

SEQ ID NO: 1102767 - protein, 9 aa, Homo Sapiens
GSLPWVFSF

SEQ ID NO: 1102768 - protein, 9 aa, Homo Sapiens
RPSPQCLRL

SEQ ID NO: 1102769 - protein, 9 aa, Homo Sapiens
EVMPEEEEE

SEQ ID NO: 1102770 - protein, 9 aa, Homo Sapiens
GHREGVHRQ

SEQ ID NO: 1102771 - protein, 9 aa, Homo Sapiens
NLSKASILE

SEQ ID NO: 1102772 - protein, 9 aa, Homo Sapiens
FTSILRLSR

SEQ ID NO: 1102773 - protein, 9 aa, Homo Sapiens
WPTVHGLLR

SEQ ID NO: 1102774 - protein, 9 aa, Homo Sapiens
SNKVLPMRW

SEQ ID NO: 1102775 - protein, 9 aa, Homo Sapiens
TKNTSMWTS

SEQ ID NO: 1102776 - protein, 9 aa, Homo Sapiens
MGHPAEKLS

SEQ ID NO: 1102777 - protein, 9 aa, Homo Sapiens
RRALPVAAD

SEQ ID NO: 1102778 - protein, 9 aa, Homo Sapiens
RVDALKNHL

SEQ ID NO: 1102779 - protein, 9 aa, Homo Sapiens
IEIGTILLN

SEQ ID NO: 1102780 - protein, 9 aa, Homo Sapiens
IFYLKKRKQ

SEQ ID NO: 1102781 - protein, 9 aa, Homo Sapiens
QAGLQSDKE

SEQ ID NO: 1102782 - protein, 9 aa, Homo Sapiens
KAAWQITGI

SEQ ID NO: 1102783 - protein, 9 aa, Homo Sapiens
AQIQRPIQV

SEQ ID NO: 1102784 - protein, 9 aa, Homo Sapiens
NPEKLALKE

SEQ ID NO: 1102785 - protein, 9 aa, Homo Sapiens
SKHGTMPIA

SEQ ID NO: 1102786 - protein, 9 aa, Homo Sapiens
KFRRGPEPW

SEQ ID NO: 1102787 - protein, 9 aa, Homo Sapiens
LTISPFSTV

SEQ ID NO: 1102788 - protein, 9 aa, Homo Sapiens
VDDTNGEWS

SEQ ID NO: 1102789 - protein, 9 aa, Homo Sapiens
IDGEITVSC

SEQ ID NO: 1102790 - protein, 9 aa, Homo Sapiens
HSKHGTMPI

SEQ ID NO: 1102791 - protein, 9 aa, Homo Sapiens
GGVPRQDHE

SEQ ID NO: 1102792 - protein, 9 aa, Homo Sapiens
FGGFLKYMV

SEQ ID NO: 1102793 - protein, 9 aa, Homo Sapiens
DLRGRENGG

SEQ ID NO: 1102794 - protein, 9 aa, Homo Sapiens
MTRASHRTS

SEQ ID NO: 1102795 - protein, 9 aa, Homo Sapiens
RAWAPQTKG

SEQ ID NO: 1102796 - protein, 9 aa, Homo Sapiens
HLYGSYPPA

SEQ ID NO: 1102797 - protein, 9 aa, Homo Sapiens
TAQIAKKPR

SEQ ID NO: 1102798 - protein, 9 aa, Homo Sapiens
GTTMATPSW

SEQ ID NO: 1102799 - protein, 9 aa, Homo Sapiens
AFWTELTAL

SEQ ID NO: 1102800 - protein, 9 aa, Homo Sapiens
RPSNSRKFG

SEQ ID NO: 1102801 - protein, 9 aa, Homo Sapiens
GRSQGRLCL

SEQ ID NO: 1102802 - protein, 9 aa, Homo Sapiens
LVREIVQDF

SEQ ID NO: 1102803 - protein, 9 aa, Homo Sapiens
RDLCPREPR

SEQ ID NO: 1102804 - protein, 9 aa, Homo Sapiens
WASVAAQQQ

SEQ ID NO: 1102805 - protein, 9 aa, Homo Sapiens
LQLTPVSPL

SEQ ID NO: 1102806 - protein, 9 aa, Homo Sapiens
VAVKGIVKL

SEQ ID NO: 1102807 - protein, 9 aa, Homo Sapiens
WTQATPAPT

SEQ ID NO: 1102808 - protein, 9 aa, Homo Sapiens
VASRSTAPS

SEQ ID NO: 1102809 - protein, 9 aa, Homo Sapiens
LVRSPSGQR

SEQ ID NO: 1102810 - protein, 9 aa, Homo Sapiens
HAPPVAEEA

SEQ ID NO: 1102811 - protein, 9 aa, Homo Sapiens
LTQVTKEET

SEQ ID NO: 1102812 - protein, 9 aa, Homo Sapiens
GFGASRHCW

SEQ ID NO: 1102813 - protein, 9 aa, Homo Sapiens
ADGAHVWLL

SEQ ID NO: 1102814 - protein, 9 aa, Homo Sapiens
QEVSLKCLW

SEQ ID NO: 1102815 - protein, 9 aa, Homo Sapiens
NTEAMKIMD

SEQ ID NO: 1102816 - protein, 9 aa, Homo Sapiens
LAPPFKPQV

SEQ ID NO: 1102817 - protein, 9 aa, Homo Sapiens
DQGFDPAGW

SEQ ID NO: 1102818 - protein, 9 aa, Homo Sapiens
KREKIINPT

SEQ ID NO: 1102819 - protein, 9 aa, Homo Sapiens
TISCPRPSA

SEQ ID NO: 1102820 - protein, 9 aa, Homo Sapiens
APRRSGWTR

SEQ ID NO: 1102821 - protein, 9 aa, Homo Sapiens
PSRSTCPPT

SEQ ID NO: 1102822 - protein, 9 aa, Homo Sapiens
LMAATQHGH

SEQ ID NO: 1102823 - protein, 9 aa, Homo Sapiens
KSDSLLQLT

SEQ ID NO: 1102824 - protein, 9 aa, Homo Sapiens
YEWDHAVVV

SEQ ID NO: 1102825 - protein, 9 aa, Homo Sapiens
FGSGVVILT

SEQ ID NO: 1102826 - protein, 9 aa, Homo Sapiens
DCSPLRRSP

SEQ ID NO: 1102827 - protein, 9 aa, Homo Sapiens
EKPRREKRP

SEQ ID NO: 1102828 - protein, 9 aa, Homo Sapiens
LEHGLVCAP

SEQ ID NO: 1102829 - protein, 9 aa, Homo Sapiens
MGGLGRFQV

SEQ ID NO: 1102830 - protein, 9 aa, Homo Sapiens
GIEAVEVVR

SEQ ID NO: 1102831 - protein, 9 aa, Homo Sapiens
QPFQERLLA

SEQ ID NO: 1102832 - protein, 9 aa, Homo Sapiens
LTLSMAELG

SEQ ID NO: 1102833 - protein, 9 aa, Homo Sapiens
SRSLWPPQR

SEQ ID NO: 1102834 - protein, 9 aa, Homo Sapiens
REPAEPPPR

SEQ ID NO: 1102835 - protein, 9 aa, Homo Sapiens
PREPRHGRP

SEQ ID NO: 1102836 - protein, 9 aa, Homo Sapiens
FMTHTNREG

SEQ ID NO: 1102837 - protein, 9 aa, Homo Sapiens
PPSPRQRRR

SEQ ID NO: 1102838 - protein, 9 aa, Homo Sapiens
PPSVEKNSS

SEQ ID NO: 1102839 - protein, 9 aa, Homo Sapiens
WKVGKIEFE

SEQ ID NO: 1102840 - protein, 9 aa, Homo Sapiens
GWWVQNTRI

SEQ ID NO: 1102841 - protein, 9 aa, Homo Sapiens
TAKEVDTIT

SEQ ID NO: 1102842 - protein, 9 aa, Homo Sapiens
EFASCSLPP

SEQ ID NO: 1102843 - protein, 9 aa, Homo Sapiens
SRTSPPAGA

SEQ ID NO: 1102844 - protein, 9 aa, Homo Sapiens
YRKFLPLTM

SEQ ID NO: 1102845 - protein, 9 aa, Homo Sapiens
STCCWCMPG

SEQ ID NO: 1102846 - protein, 9 aa, Homo Sapiens
LSSILSSLA

SEQ ID NO: 1102847 - protein, 9 aa, Homo Sapiens
AAQLPVVRE

SEQ ID NO: 1102848 - protein, 9 aa, Homo Sapiens
APGPSPLVA

SEQ ID NO: 1102849 - protein, 9 aa, Homo Sapiens
GTNFSGSVE

SEQ ID NO: 1102850 - protein, 9 aa, Homo Sapiens
PPPKARRRP

SEQ ID NO: 1102851 - protein, 9 aa, Homo Sapiens
SSQLATKLL

SEQ ID NO: 1102852 - protein, 9 aa, Homo Sapiens
CALWTAGSL

SEQ ID NO: 1102853 - protein, 9 aa, Homo Sapiens
SLCESTTGW

SEQ ID NO: 1102854 - protein, 9 aa, Homo Sapiens
QPTSMWAHQ

SEQ ID NO: 1102855 - protein, 9 aa, Homo Sapiens
GPLKSMNLL

SEQ ID NO: 1102856 - protein, 9 aa, Homo Sapiens
KKLVKISEI

SEQ ID NO: 1102857 - protein, 9 aa, Homo Sapiens
LTCPDMMRK

SEQ ID NO: 1102858 - protein, 9 aa, Homo Sapiens
KFLFELVAR

SEQ ID NO: 1102859 - protein, 9 aa, Homo Sapiens
VGLVWVAAL

SEQ ID NO: 1102860 - protein, 9 aa, Homo Sapiens
ERDYNMDFL

SEQ ID NO: 1102861 - protein, 9 aa, Homo Sapiens
ATGPTTWGC

SEQ ID NO: 1102862 - protein, 9 aa, Homo Sapiens
CYNFIRSMA

SEQ ID NO: 1102863 - protein, 9 aa, Homo Sapiens
VKSKNIQVV

SEQ ID NO: 1102864 - protein, 9 aa, Homo Sapiens
ALPVAADLR

SEQ ID NO: 1102865 - protein, 9 aa, Homo Sapiens
EKKVHRNQP

SEQ ID NO: 1102866 - protein, 9 aa, Homo Sapiens
RAGAARASS

SEQ ID NO: 1102867 - protein, 9 aa, Homo Sapiens
RKPPNWQPC

SEQ ID NO: 1102868 - protein, 9 aa, Homo Sapiens
PKTAGAADS

SEQ ID NO: 1102869 - protein, 9 aa, Homo Sapiens
IWARTRITK

SEQ ID NO: 1102870 - protein, 9 aa, Homo Sapiens
TPQSPSWPL

SEQ ID NO: 1102871 - protein, 9 aa, Homo Sapiens
LRLWMFLRI

SEQ ID NO: 1102872 - protein, 9 aa, Homo Sapiens
QVHKLARSP

SEQ ID NO: 1102873 - protein, 9 aa, Homo Sapiens
KGRGSIPPQ

SEQ ID NO: 1102874 - protein, 9 aa, Homo Sapiens
KYGYSTVAI

SEQ ID NO: 1102875 - protein, 9 aa, Homo Sapiens
LCGVGPQFV

SEQ ID NO: 1102876 - protein, 9 aa, Homo Sapiens
SQQSLSLQQ

SEQ ID NO: 1102877 - protein, 9 aa, Homo Sapiens
NSGPQGHRE

SEQ ID NO: 1102878 - protein, 9 aa, Homo Sapiens
RLPRMPGPP

SEQ ID NO: 1102879 - protein, 9 aa, Homo Sapiens
WYSVALVLK

SEQ ID NO: 1102880 - protein, 9 aa, Homo Sapiens
TNRLHCLQN

SEQ ID NO: 1102881 - protein, 9 aa, Homo Sapiens
LGALCACPM

SEQ ID NO: 1102882 - protein, 9 aa, Homo Sapiens
WGPTAGAAR

SEQ ID NO: 1102883 - protein, 9 aa, Homo Sapiens
RVLKLSENF

SEQ ID NO: 1102884 - protein, 9 aa, Homo Sapiens
CSTTRDRNK

SEQ ID NO: 1102885 - protein, 9 aa, Homo Sapiens
RWVVDSEDL

SEQ ID NO: 1102886 - protein, 9 aa, Homo Sapiens
ALPMVPPHL

SEQ ID NO: 1102887 - protein, 9 aa, Homo Sapiens
STAKSATCS

SEQ ID NO: 1102888 - protein, 9 aa, Homo Sapiens
PAAIPTQRS

SEQ ID NO: 1102889 - protein, 9 aa, Homo Sapiens
PPGPHRPER

SEQ ID NO: 1102890 - protein, 9 aa, Homo Sapiens
LEIAEKNCL

SEQ ID NO: 1102891 - protein, 9 aa, Homo Sapiens
FPRDSPSAR

SEQ ID NO: 1102892 - protein, 9 aa, Homo Sapiens
IEDDILPPP

SEQ ID NO: 1102893 - protein, 9 aa, Homo Sapiens
AIESGILLV

SEQ ID NO: 1102894 - protein, 9 aa, Homo Sapiens
KASSPGHPL

SEQ ID NO: 1102895 - protein, 9 aa, Homo Sapiens
CIWCFFSRP

SEQ ID NO: 1102896 - protein, 9 aa, Homo Sapiens
KLAINMVPF

SEQ ID NO: 1102897 - protein, 9 aa, Homo Sapiens
GAEKEEEFQ

SEQ ID NO: 1102898 - protein, 9 aa, Homo Sapiens
PGPSPLVAP

SEQ ID NO: 1102899 - protein, 9 aa, Homo Sapiens
QGRDAHSSI

SEQ ID NO: 1102900 - protein, 9 aa, Homo Sapiens
TQIVLWREY

SEQ ID NO: 1102901 - protein, 9 aa, Homo Sapiens
EKTISCNDC

SEQ ID NO: 1102902 - protein, 9 aa, Homo Sapiens
GGRAAPAQR

SEQ ID NO: 1102903 - protein, 9 aa, Homo Sapiens
AKGQTEEAT

SEQ ID NO: 1102904 - protein, 9 aa, Homo Sapiens
CRPHWTLSP

SEQ ID NO: 1102905 - protein, 9 aa, Homo Sapiens
TAPSKDDAD

SEQ ID NO: 1102906 - protein, 9 aa, Homo Sapiens
ALFESPLGG

SEQ ID NO: 1102907 - protein, 9 aa, Homo Sapiens
GLFCGRGNH

SEQ ID NO: 1102908 - protein, 9 aa, Homo Sapiens
LFLLTSASP

SEQ ID NO: 1102909 - protein, 9 aa, Homo Sapiens
KRFLTTDTI

SEQ ID NO: 1102910 - protein, 9 aa, Homo Sapiens
ATSPHLMCG

SEQ ID NO: 1102911 - protein, 9 aa, Homo Sapiens
GVVHQVRPI

SEQ ID NO: 1102912 - protein, 9 aa, Homo Sapiens
AIGQLWECL

SEQ ID NO: 1102913 - protein, 9 aa, Homo Sapiens
EKPFVCNVG

SEQ ID NO: 1102914 - protein, 9 aa, Homo Sapiens
LQPDMWPKS

SEQ ID NO: 1102915 - protein, 9 aa, Homo Sapiens
VAPSFSIGA

SEQ ID NO: 1102916 - protein, 9 aa, Homo Sapiens
FRGSGPGRR

SEQ ID NO: 1102917 - protein, 9 aa, Homo Sapiens
CHAAALALD

SEQ ID NO: 1102918 - protein, 9 aa, Homo Sapiens
GITQCKESL

SEQ ID NO: 1102919 - protein, 9 aa, Homo Sapiens
CPAPGPSPL

SEQ ID NO: 1102920 - protein, 9 aa, Homo Sapiens
GLVWVAALA

SEQ ID NO: 1102921 - protein, 9 aa, Homo Sapiens
LESLSKHSS

SEQ ID NO: 1102922 - protein, 9 aa, Homo Sapiens
AVLSPVNTQ

SEQ ID NO: 1102923 - protein, 9 aa, Homo Sapiens
MVHAASQLC

SEQ ID NO: 1102924 - protein, 9 aa, Homo Sapiens
HRRERRFGR

SEQ ID NO: 1102925 - protein, 9 aa, Homo Sapiens
RNVATSPLP

SEQ ID NO: 1102926 - protein, 9 aa, Homo Sapiens
ESRSSVVKF

SEQ ID NO: 1102927 - protein, 9 aa, Homo Sapiens
YLTNGIHKD

SEQ ID NO: 1102928 - protein, 9 aa, Homo Sapiens
VQKLQAQCQ

SEQ ID NO: 1102929 - protein, 9 aa, Homo Sapiens
GSIPPQHGL

SEQ ID NO: 1102930 - protein, 9 aa, Homo Sapiens
PPFLDGHIV

SEQ ID NO: 1102931 - protein, 9 aa, Homo Sapiens
QLTLEPYEW

SEQ ID NO: 1102932 - protein, 9 aa, Homo Sapiens
MSPNREVKS

SEQ ID NO: 1102933 - protein, 9 aa, Homo Sapiens
DAQKPLFFG

SEQ ID NO: 1102934 - protein, 9 aa, Homo Sapiens
YYLGYIEEW

SEQ ID NO: 1102935 - protein, 9 aa, Homo Sapiens
DGSSLACGA

SEQ ID NO: 1102936 - protein, 9 aa, Homo Sapiens
QLALTAFQL

SEQ ID NO: 1102937 - protein, 9 aa, Homo Sapiens
SNSYCLMQL

SEQ ID NO: 1102938 - protein, 9 aa, Homo Sapiens
MALRVAGAA

SEQ ID NO: 1102939 - protein, 9 aa, Homo Sapiens
LTFRLPRNG

SEQ ID NO: 1102940 - protein, 9 aa, Homo Sapiens
QKPLFFGEG

SEQ ID NO: 1102941 - protein, 9 aa, Homo Sapiens
LTSSSREWK

SEQ ID NO: 1102942 - protein, 9 aa, Homo Sapiens
SPAGVGGRS

SEQ ID NO: 1102943 - protein, 9 aa, Homo Sapiens
ATLARHLSF

SEQ ID NO: 1102944 - protein, 9 aa, Homo Sapiens
NIIVAITPL

SEQ ID NO: 1102945 - protein, 9 aa, Homo Sapiens
SNRGVPVIK

SEQ ID NO: 1102946 - protein, 9 aa, Homo Sapiens
APTWTTSSR

SEQ ID NO: 1102947 - protein, 9 aa, Homo Sapiens
LQWRKFLQM

SEQ ID NO: 1102948 - protein, 9 aa, Homo Sapiens
VMDTVILYR

SEQ ID NO: 1102949 - protein, 9 aa, Homo Sapiens
GPQGHREIH

SEQ ID NO: 1102950 - protein, 9 aa, Homo Sapiens
ATTAAVMTA

SEQ ID NO: 1102951 - protein, 9 aa, Homo Sapiens
GPFGSVAPS

SEQ ID NO: 1102952 - protein, 9 aa, Homo Sapiens
HLLNGLLFK

SEQ ID NO: 1102953 - protein, 9 aa, Homo Sapiens
EGILRLPCS

SEQ ID NO: 1102954 - protein, 9 aa, Homo Sapiens
RVQDTGPLD

SEQ ID NO: 1102955 - protein, 9 aa, Homo Sapiens
DLVKWKIAV

SEQ ID NO: 1102956 - protein, 9 aa, Homo Sapiens
VGPGAPVPV

SEQ ID NO: 1102957 - protein, 9 aa, Homo Sapiens
YPCPSAARA

SEQ ID NO: 1102958 - protein, 9 aa, Homo Sapiens
RGSSPPGRH

SEQ ID NO: 1102959 - protein, 9 aa, Homo Sapiens
PEAEVRHRA

SEQ ID NO: 1102960 - protein, 9 aa, Homo Sapiens
CTIAAPTTT

SEQ ID NO: 1102961 - protein, 9 aa, Homo Sapiens
EITEHEKDF

SEQ ID NO: 1102962 - protein, 9 aa, Homo Sapiens
CGATCERAH

SEQ ID NO: 1102963 - protein, 9 aa, Homo Sapiens
DVLQAVAAE

SEQ ID NO: 1102964 - protein, 9 aa, Homo Sapiens
KEVRGEWRQ

SEQ ID NO: 1102965 - protein, 9 aa, Homo Sapiens
QDPGGVPRQ

SEQ ID NO: 1102966 - protein, 9 aa, Homo Sapiens
LLFLAVWLS

SEQ ID NO: 1102967 - protein, 9 aa, Homo Sapiens
RVSEDEWDR

SEQ ID NO: 1102968 - protein, 9 aa, Homo Sapiens
LTRKETPLA

SEQ ID NO: 1102969 - protein, 9 aa, Homo Sapiens
HTAFSTCVS

SEQ ID NO: 1102970 - protein, 9 aa, Homo Sapiens
ILSSLATPM

SEQ ID NO: 1102971 - protein, 9 aa, Homo Sapiens
LARGRSSAP

SEQ ID NO: 1102972 - protein, 9 aa, Homo Sapiens
GFIDFVCIF

SEQ ID NO: 1102973 - protein, 9 aa, Homo Sapiens
AQGRLRLRS

SEQ ID NO: 1102974 - protein, 9 aa, Homo Sapiens
ARNPKSKRR

SEQ ID NO: 1102975 - protein, 9 aa, Homo Sapiens
IDGIDGDQG

SEQ ID NO: 1102976 - protein, 9 aa, Homo Sapiens
ECFLAVLKQ

SEQ ID NO: 1102977 - protein, 9 aa, Homo Sapiens
EARVADGEE

SEQ ID NO: 1102978 - protein, 9 aa, Homo Sapiens
RGQPNYLLS

SEQ ID NO: 1102979 - protein, 9 aa, Homo Sapiens
HNTWLSYHV

SEQ ID NO: 1102980 - protein, 9 aa, Homo Sapiens
APPAAAPRP

SEQ ID NO: 1102981 - protein, 9 aa, Homo Sapiens
GCGASSSVH

SEQ ID NO: 1102982 - protein, 9 aa, Homo Sapiens
FSVMISASE

SEQ ID NO: 1102983 - protein, 9 aa, Homo Sapiens
KCARCVCVS

SEQ ID NO: 1102984 - protein, 9 aa, Homo Sapiens
GILICQQQR

SEQ ID NO: 1102985 - protein, 9 aa, Homo Sapiens
KLALKEDLL

SEQ ID NO: 1102986 - protein, 9 aa, Homo Sapiens
ADMQFMLLF

SEQ ID NO: 1102987 - protein, 9 aa, Homo Sapiens
LLGVCGHLK

SEQ ID NO: 1102988 - protein, 9 aa, Homo Sapiens
LRRTVHPAV

SEQ ID NO: 1102989 - protein, 9 aa, Homo Sapiens
ELRSWSPGC

SEQ ID NO: 1102990 - protein, 9 aa, Homo Sapiens
EETWGVETL

SEQ ID NO: 1102991 - protein, 9 aa, Homo Sapiens
RTSPPAGAV

SEQ ID NO: 1102992 - protein, 9 aa, Homo Sapiens
KGQRRATLG

SEQ ID NO: 1102993 - protein, 9 aa, Homo Sapiens
AVGMDQQPI

SEQ ID NO: 1102994 - protein, 9 aa, Homo Sapiens
QQVIHLLNG

SEQ ID NO: 1102995 - protein, 9 aa, Homo Sapiens
ANVGAAEEE

SEQ ID NO: 1102996 - protein, 9 aa, Homo Sapiens
LSEITEHEK

SEQ ID NO: 1102997 - protein, 9 aa, Homo Sapiens
VHYQQIKEN

SEQ ID NO: 1102998 - protein, 9 aa, Homo Sapiens
GGGLLQPKP

SEQ ID NO: 1102999 - protein, 9 aa, Homo Sapiens
FLVVSCWLR

SEQ ID NO: 1103000 - protein, 9 aa, Homo Sapiens
TIRTLNCIG

SEQ ID NO: 1103001 - protein, 9 aa, Homo Sapiens
IDPEDLDLI

SEQ ID NO: 1103002 - protein, 9 aa, Homo Sapiens
KDYYRRAAS

SEQ ID NO: 1103003 - protein, 9 aa, Homo Sapiens
KHSTMKTVL

SEQ ID NO: 1103004 - protein, 9 aa, Homo Sapiens
SLPEPASGV

SEQ ID NO: 1103005 - protein, 9 aa, Homo Sapiens
QFSNSGKGA

SEQ ID NO: 1103006 - protein, 9 aa, Homo Sapiens
ATTPLDSGY

SEQ ID NO: 1103007 - protein, 9 aa, Homo Sapiens
SREWKVKFP

SEQ ID NO: 1103008 - protein, 9 aa, Homo Sapiens
CAVGVEYVK

SEQ ID NO: 1103009 - protein, 9 aa, Homo Sapiens
VVSMAVALA

SEQ ID NO: 1103010 - protein, 9 aa, Homo Sapiens
VAAAVAVAA

SEQ ID NO: 1103011 - protein, 9 aa, Homo Sapiens
LPDISRISQ

SEQ ID NO: 1103012 - protein, 9 aa, Homo Sapiens
GRRLCTGED

SEQ ID NO: 1103013 - protein, 9 aa, Homo Sapiens
GYGGNAPFC

SEQ ID NO: 1103014 - protein, 9 aa, Homo Sapiens
WPSLMLSCP

SEQ ID NO: 1103015 - protein, 9 aa, Homo Sapiens
LRRPRVAQL

SEQ ID NO: 1103016 - protein, 9 aa, Homo Sapiens
HGKVEKHMC

SEQ ID NO: 1103017 - protein, 9 aa, Homo Sapiens
DMKNSVVDR

SEQ ID NO: 1103018 - protein, 9 aa, Homo Sapiens
VEPGQPPRR

SEQ ID NO: 1103019 - protein, 9 aa, Homo Sapiens
SLCFIHHYY

SEQ ID NO: 1103020 - protein, 9 aa, Homo Sapiens
TRPWLMDPK

SEQ ID NO: 1103021 - protein, 9 aa, Homo Sapiens
LVRPLSLIL

SEQ ID NO: 1103022 - protein, 9 aa, Homo Sapiens
REPRHGRPA

SEQ ID NO: 1103023 - protein, 9 aa, Homo Sapiens
PPRSRLAAA

SEQ ID NO: 1103024 - protein, 9 aa, Homo Sapiens
APAVPAAPA

SEQ ID NO: 1103025 - protein, 9 aa, Homo Sapiens
GRHFHQSTK

SEQ ID NO: 1103026 - protein, 9 aa, Homo Sapiens
QLGKGTEVP

SEQ ID NO: 1103027 - protein, 9 aa, Homo Sapiens
LEECLQHTH

SEQ ID NO: 1103028 - protein, 9 aa, Homo Sapiens
PCSSMPTKQ

SEQ ID NO: 1103029 - protein, 9 aa, Homo Sapiens
EAQLATVLT

SEQ ID NO: 1103030 - protein, 9 aa, Homo Sapiens
ILHEKREIR

SEQ ID NO: 1103031 - protein, 9 aa, Homo Sapiens
RGLVGCPGS

SEQ ID NO: 1103032 - protein, 9 aa, Homo Sapiens
HMDAHTDTT

SEQ ID NO: 1103033 - protein, 9 aa, Homo Sapiens
DCTEIIIVV

SEQ ID NO: 1103034 - protein, 9 aa, Homo Sapiens
FVLVNLEVT

SEQ ID NO: 1103035 - protein, 9 aa, Homo Sapiens
GASDRGSLA

SEQ ID NO: 1103036 - protein, 9 aa, Homo Sapiens
VTAPSTPTG

SEQ ID NO: 1103037 - protein, 9 aa, Homo Sapiens
GPGAPVPVE

SEQ ID NO: 1103038 - protein, 9 aa, Homo Sapiens
HLCPQQHVL

SEQ ID NO: 1103039 - protein, 9 aa, Homo Sapiens
PPGRHWLCP

SEQ ID NO: 1103040 - protein, 9 aa, Homo Sapiens
FFGRDCSPL

SEQ ID NO: 1103041 - protein, 9 aa, Homo Sapiens
GTFHHKFGT

SEQ ID NO: 1103042 - protein, 9 aa, Homo Sapiens
TEYKELSGT

SEQ ID NO: 1103043 - protein, 9 aa, Homo Sapiens
MPLYFSYSH

SEQ ID NO: 1103044 - protein, 9 aa, Homo Sapiens
PGGVLLRPA

SEQ ID NO: 1103045 - protein, 9 aa, Homo Sapiens
PGAHREAFK

SEQ ID NO: 1103046 - protein, 9 aa, Homo Sapiens
CNVGEKGLE

SEQ ID NO: 1103047 - protein, 9 aa, Homo Sapiens
LCYDYKICV

SEQ ID NO: 1103048 - protein, 9 aa, Homo Sapiens
PLFLLFFSS

SEQ ID NO: 1103049 - protein, 9 aa, Homo Sapiens
QGVRGRAPS

SEQ ID NO: 1103050 - protein, 9 aa, Homo Sapiens
VRGHRKGQR

SEQ ID NO: 1103051 - protein, 9 aa, Homo Sapiens
WQPCTPSLC

SEQ ID NO: 1103052 - protein, 9 aa, Homo Sapiens
LVCSTSSDW

SEQ ID NO: 1103053 - protein, 9 aa, Homo Sapiens
GPGRVNELR

SEQ ID NO: 1103054 - protein, 9 aa, Homo Sapiens
GSTPRKEHS

SEQ ID NO: 1103055 - protein, 9 aa, Homo Sapiens
RHGTEGFER

SEQ ID NO: 1103056 - protein, 9 aa, Homo Sapiens
LTQGAMAEE

SEQ ID NO: 1103057 - protein, 9 aa, Homo Sapiens
PENAPPYSF

SEQ ID NO: 1103058 - protein, 9 aa, Homo Sapiens
RAEKLRPHL

SEQ ID NO: 1103059 - protein, 9 aa, Homo Sapiens
PRQVREHVL

SEQ ID NO: 1103060 - protein, 9 aa, Homo Sapiens
PGRGVPPRA

SEQ ID NO: 1103061 - protein, 9 aa, Homo Sapiens
RLGSRWCPP

SEQ ID NO: 1103062 - protein, 9 aa, Homo Sapiens
KLTTTYTRQ

SEQ ID NO: 1103063 - protein, 9 aa, Homo Sapiens
VEFTFKNLP

SEQ ID NO: 1103064 - protein, 9 aa, Homo Sapiens
PFWPPSHQH

SEQ ID NO: 1103065 - protein, 9 aa, Homo Sapiens
GRPATQLPV

SEQ ID NO: 1103066 - protein, 9 aa, Homo Sapiens
MDPKILKFV

SEQ ID NO: 1103067 - protein, 9 aa, Homo Sapiens
FLGPLAPAH

SEQ ID NO: 1103068 - protein, 9 aa, Homo Sapiens
PPRQVREHV

SEQ ID NO: 1103069 - protein, 9 aa, Homo Sapiens
SRGTRRYRP

SEQ ID NO: 1103070 - protein, 9 aa, Homo Sapiens
GTGRDPRQP

SEQ ID NO: 1103071 - protein, 9 aa, Homo Sapiens
PQVCLALLS

SEQ ID NO: 1103072 - protein, 9 aa, Homo Sapiens
ETQNNQKNK

SEQ ID NO: 1103073 - protein, 9 aa, Homo Sapiens
SLLVLAPAL

SEQ ID NO: 1103074 - protein, 9 aa, Homo Sapiens
SSYYGGLGY

SEQ ID NO: 1103075 - protein, 9 aa, Homo Sapiens
KSMNLLGPP

SEQ ID NO: 1103076 - protein, 9 aa, Homo Sapiens
SPPSQPPSP

SEQ ID NO: 1103077 - protein, 9 aa, Homo Sapiens
TAHENYEKI

SEQ ID NO: 1103078 - protein, 9 aa, Homo Sapiens
IKDVLQAVA

SEQ ID NO: 1103079 - protein, 9 aa, Homo Sapiens
GGNAPFCTR

SEQ ID NO: 1103080 - protein, 9 aa, Homo Sapiens
RWCPPSPHK

SEQ ID NO: 1103081 - protein, 9 aa, Homo Sapiens
DFSFMTHTN

SEQ ID NO: 1103082 - protein, 9 aa, Homo Sapiens
WPPPYHPKQ

SEQ ID NO: 1103083 - protein, 9 aa, Homo Sapiens
GGLRARPPP

SEQ ID NO: 1103084 - protein, 9 aa, Homo Sapiens
ALGHAQRVG

SEQ ID NO: 1103085 - protein, 9 aa, Homo Sapiens
RQHHYYLGY

SEQ ID NO: 1103086 - protein, 9 aa, Homo Sapiens
AGSWAAFVE

SEQ ID NO: 1103087 - protein, 9 aa, Homo Sapiens
HPHRAAVLR

SEQ ID NO: 1103088 - protein, 9 aa, Homo Sapiens
LLFLGPLAP

SEQ ID NO: 1103089 - protein, 9 aa, Homo Sapiens
VWRACLPDH

SEQ ID NO: 1103090 - protein, 9 aa, Homo Sapiens
PPAPATQAP

SEQ ID NO: 1103091 - protein, 9 aa, Homo Sapiens
TERPHNRRR

SEQ ID NO: 1103092 - protein, 9 aa, Homo Sapiens
PSDTTLEVQ

SEQ ID NO: 1103093 - protein, 9 aa, Homo Sapiens
ELEATEAGA

SEQ ID NO: 1103094 - protein, 9 aa, Homo Sapiens
VKTEQVPQI

SEQ ID NO: 1103095 - protein, 9 aa, Homo Sapiens
SYRMIFSCL

SEQ ID NO: 1103096 - protein, 9 aa, Homo Sapiens
YDYKICVNC

SEQ ID NO: 1103097 - protein, 9 aa, Homo Sapiens
VARRTQLET

SEQ ID NO: 1103098 - protein, 9 aa, Homo Sapiens
SIRERWLMG

SEQ ID NO: 1103099 - protein, 9 aa, Homo Sapiens
QSCSSLNAK

SEQ ID NO: 1103100 - protein, 9 aa, Homo Sapiens
DDLGALCAC

SEQ ID NO: 1103101 - protein, 9 aa, Homo Sapiens
RLPRDWNDV

SEQ ID NO: 1103102 - protein, 9 aa, Homo Sapiens
AAVAVAAVA

SEQ ID NO: 1103103 - protein, 9 aa, Homo Sapiens
WTTSSRLAR

SEQ ID NO: 1103104 - protein, 9 aa, Homo Sapiens
KLKNQHQED

SEQ ID NO: 1103105 - protein, 9 aa, Homo Sapiens
SIISVADKA

SEQ ID NO: 1103106 - protein, 9 aa, Homo Sapiens
QTGPGSCPP

SEQ ID NO: 1103107 - protein, 9 aa, Homo Sapiens
SYTVLIVGC

SEQ ID NO: 1103108 - protein, 9 aa, Homo Sapiens
SIELDMCTI

SEQ ID NO: 1103109 - protein, 9 aa, Homo Sapiens
FSIISVADK

SEQ ID NO: 1103110 - protein, 9 aa, Homo Sapiens
SRLRAWGSL

SEQ ID NO: 1103111 - protein, 9 aa, Homo Sapiens
VMDMMIANS

SEQ ID NO: 1103112 - protein, 9 aa, Homo Sapiens
TYIVGRAVQ

SEQ ID NO: 1103113 - protein, 9 aa, Homo Sapiens
HTLQRLQHV

SEQ ID NO: 1103114 - protein, 9 aa, Homo Sapiens
WKTGCFKRP

SEQ ID NO: 1103115 - protein, 9 aa, Homo Sapiens
TVLGQPGVR

SEQ ID NO: 1103116 - protein, 9 aa, Homo Sapiens
VGRHPPVVL

SEQ ID NO: 1103117 - protein, 9 aa, Homo Sapiens
LPIFWTAKC

SEQ ID NO: 1103118 - protein, 9 aa, Homo Sapiens
CPSTTCTMT

SEQ ID NO: 1103119 - protein, 9 aa, Homo Sapiens
LRNLNLQKS

SEQ ID NO: 1103120 - protein, 9 aa, Homo Sapiens
RQLFLLTSA

SEQ ID NO: 1103121 - protein, 9 aa, Homo Sapiens
EMLYIVDWM

SEQ ID NO: 1103122 - protein, 9 aa, Homo Sapiens
ALAGAHAAG

SEQ ID NO: 1103123 - protein, 9 aa, Homo Sapiens
PCHWPLWRP

SEQ ID NO: 1103124 - protein, 9 aa, Homo Sapiens
CTCFVSDLK

SEQ ID NO: 1103125 - protein, 9 aa, Homo Sapiens
STARATSPC

SEQ ID NO: 1103126 - protein, 9 aa, Homo Sapiens
NPKTGASSC

SEQ ID NO: 1103127 - protein, 9 aa, Homo Sapiens
GVTAPSTPT

SEQ ID NO: 1103128 - protein, 9 aa, Homo Sapiens
DSYSGPPRR

SEQ ID NO: 1103129 - protein, 9 aa, Homo Sapiens
SHHPSAFKT

SEQ ID NO: 1103130 - protein, 9 aa, Homo Sapiens
AEKLRPHLA

SEQ ID NO: 1103131 - protein, 9 aa, Homo Sapiens
GLIGLYGFI

SEQ ID NO: 1103132 - protein, 9 aa, Homo Sapiens
VDTKVNSTV

SEQ ID NO: 1103133 - protein, 9 aa, Homo Sapiens
TRVGTKCYM

SEQ ID NO: 1103134 - protein, 9 aa, Homo Sapiens
QSHPCSTSV

SEQ ID NO: 1103135 - protein, 9 aa, Homo Sapiens
AGTTSPWPS

SEQ ID NO: 1103136 - protein, 9 aa, Homo Sapiens
HQPPAPSLR

SEQ ID NO: 1103137 - protein, 9 aa, Homo Sapiens
RDLLEAGKR

SEQ ID NO: 1103138 - protein, 9 aa, Homo Sapiens
PPRAPASPG

SEQ ID NO: 1103139 - protein, 9 aa, Homo Sapiens
MGPHVPRQL

SEQ ID NO: 1103140 - protein, 9 aa, Homo Sapiens
REGCGASSS

SEQ ID NO: 1103141 - protein, 9 aa, Homo Sapiens
EQHFYESLP

SEQ ID NO: 1103142 - protein, 9 aa, Homo Sapiens
QDPETSVDA

SEQ ID NO: 1103143 - protein, 9 aa, Homo Sapiens
TGAEGQMGH

SEQ ID NO: 1103144 - protein, 9 aa, Homo Sapiens
AAPAQRPRT

SEQ ID NO: 1103145 - protein, 9 aa, Homo Sapiens
SKDKKQKRS

SEQ ID NO: 1103146 - protein, 9 aa, Homo Sapiens
RKPRVRGGV

SEQ ID NO: 1103147 - protein, 9 aa, Homo Sapiens
QRAQEHRAQ

SEQ ID NO: 1103148 - protein, 9 aa, Homo Sapiens
NPHAWGRFD

SEQ ID NO: 1103149 - protein, 9 aa, Homo Sapiens
ICLLLGCHL

SEQ ID NO: 1103150 - protein, 9 aa, Homo Sapiens
VAEARVADG

SEQ ID NO: 1103151 - protein, 9 aa, Homo Sapiens
LDGGLAVSE

SEQ ID NO: 1103152 - protein, 9 aa, Homo Sapiens
LALDVAVQV

SEQ ID NO: 1103153 - protein, 9 aa, Homo Sapiens
QQALLYGDC

SEQ ID NO: 1103154 - protein, 9 aa, Homo Sapiens
DHYQWFQVD

SEQ ID NO: 1103155 - protein, 9 aa, Homo Sapiens
TAQLKENNG

SEQ ID NO: 1103156 - protein, 9 aa, Homo Sapiens
KMDLDGMLT

SEQ ID NO: 1103157 - protein, 9 aa, Homo Sapiens
LDSELAQNK

SEQ ID NO: 1103158 - protein, 9 aa, Homo Sapiens
LGTLYGNMF

SEQ ID NO: 1103159 - protein, 9 aa, Homo Sapiens
QGGHVDASL

SEQ ID NO: 1103160 - protein, 9 aa, Homo Sapiens
VVEIRMAEG

SEQ ID NO: 1103161 - protein, 9 aa, Homo Sapiens
EQTATQVDA

SEQ ID NO: 1103162 - protein, 9 aa, Homo Sapiens
THLSRHQRI

SEQ ID NO: 1103163 - protein, 9 aa, Homo Sapiens
LTAAASMDH

SEQ ID NO: 1103164 - protein, 9 aa, Homo Sapiens
PALPVGRHP

SEQ ID NO: 1103165 - protein, 9 aa, Homo Sapiens
FTTANTVPT

SEQ ID NO: 1103166 - protein, 9 aa, Homo Sapiens
QQIKENPPA

SEQ ID NO: 1103167 - protein, 9 aa, Homo Sapiens
ASRMPLSCQ

SEQ ID NO: 1103168 - protein, 9 aa, Homo Sapiens
CTRQFQAQN

SEQ ID NO: 1103169 - protein, 9 aa, Homo Sapiens
SVPLAITIS

SEQ ID NO: 1103170 - protein, 9 aa, Homo Sapiens
HLLRLWMFL

SEQ ID NO: 1103171 - protein, 9 aa, Homo Sapiens
FEEVWGGHL

SEQ ID NO: 1103172 - protein, 9 aa, Homo Sapiens
AQLPDSVPG

SEQ ID NO: 1103173 - protein, 9 aa, Homo Sapiens
LGLLLFKIP

SEQ ID NO: 1103174 - protein, 9 aa, Homo Sapiens
AGVQRVGLP

SEQ ID NO: 1103175 - protein, 9 aa, Homo Sapiens
GTALMGPRT

SEQ ID NO: 1103176 - protein, 9 aa, Homo Sapiens
GTLSDLLCN

SEQ ID NO: 1103177 - protein, 9 aa, Homo Sapiens
GSPTLGRVP

SEQ ID NO: 1103178 - protein, 9 aa, Homo Sapiens
NTQSESPPG

SEQ ID NO: 1103179 - protein, 9 aa, Homo Sapiens
HSPRICPAT

SEQ ID NO: 1103180 - protein, 9 aa, Homo Sapiens
RWAGVLSHL

SEQ ID NO: 1103181 - protein, 9 aa, Homo Sapiens
KSKRRCGLT

SEQ ID NO: 1103182 - protein, 9 aa, Homo Sapiens
WRIGGLCSG

SEQ ID NO: 1103183 - protein, 9 aa, Homo Sapiens
RDASAPWAK

SEQ ID NO: 1103184 - protein, 9 aa, Homo Sapiens
PKPWQQQPV

SEQ ID NO: 1103185 - protein, 9 aa, Homo Sapiens
SRACDINTE

SEQ ID NO: 1103186 - protein, 9 aa, Homo Sapiens
VAGAVQESW

SEQ ID NO: 1103187 - protein, 9 aa, Homo Sapiens
ALQLALTAF

SEQ ID NO: 1103188 - protein, 9 aa, Homo Sapiens
LGRVHWCVN

SEQ ID NO: 1103189 - protein, 9 aa, Homo Sapiens
EPGQPPRRP

SEQ ID NO: 1103190 - protein, 9 aa, Homo Sapiens
YLLAFKKSK

SEQ ID NO: 1103191 - protein, 9 aa, Homo Sapiens
GVISFALAM

SEQ ID NO: 1103192 - protein, 9 aa, Homo Sapiens
GVLVAGAVQ

SEQ ID NO: 1103193 - protein, 9 aa, Homo Sapiens
PTSSPSQVD

SEQ ID NO: 1103194 - protein, 9 aa, Homo Sapiens
RNCLLCRRG

SEQ ID NO: 1103195 - protein, 9 aa, Homo Sapiens
RGAVAGRNS

SEQ ID NO: 1103196 - protein, 9 aa, Homo Sapiens
RTQSLNYSC

SEQ ID NO: 1103197 - protein, 9 aa, Homo Sapiens
RHHLGLLQG

SEQ ID NO: 1103198 - protein, 9 aa, Homo Sapiens
RRASPASWQ

SEQ ID NO: 1103199 - protein, 9 aa, Homo Sapiens
SPGRGRERG

SEQ ID NO: 1103200 - protein, 9 aa, Homo Sapiens
RDHDSSLNL

SEQ ID NO: 1103201 - protein, 9 aa, Homo Sapiens
VGLLFAHLG

SEQ ID NO: 1103202 - protein, 9 aa, Homo Sapiens
TASQRSKRR

SEQ ID NO: 1103203 - protein, 9 aa, Homo Sapiens
NKHELTHAF

SEQ ID NO: 1103204 - protein, 9 aa, Homo Sapiens
ASIMCPLNP

SEQ ID NO: 1103205 - protein, 9 aa, Homo Sapiens
LEKVSKKRL

SEQ ID NO: 1103206 - protein, 9 aa, Homo Sapiens
QTSGSSSSD

SEQ ID NO: 1103207 - protein, 9 aa, Homo Sapiens
IKNIHGVRM

SEQ ID NO: 1103208 - protein, 9 aa, Homo Sapiens
LRGSPPYTQ

SEQ ID NO: 1103209 - protein, 9 aa, Homo Sapiens
SISTTRYVA

SEQ ID NO: 1103210 - protein, 9 aa, Homo Sapiens
SSNAGQNSR

SEQ ID NO: 1103211 - protein, 9 aa, Homo Sapiens
SMAHVEALG

SEQ ID NO: 1103212 - protein, 9 aa, Homo Sapiens
QKADSRHYH

SEQ ID NO: 1103213 - protein, 9 aa, Homo Sapiens
RLRFEKGHI

SEQ ID NO: 1103214 - protein, 9 aa, Homo Sapiens
CCAHCLGAE

SEQ ID NO: 1103215 - protein, 9 aa, Homo Sapiens
ASMDHSSVV

SEQ ID NO: 1103216 - protein, 9 aa, Homo Sapiens
WRNRLYELA

SEQ ID NO: 1103217 - protein, 9 aa, Homo Sapiens
SHGKKSETG

SEQ ID NO: 1103218 - protein, 9 aa, Homo Sapiens
TKKRVNTAW

SEQ ID NO: 1103219 - protein, 9 aa, Homo Sapiens
KKVHRNQPP

SEQ ID NO: 1103220 - protein, 9 aa, Homo Sapiens
GRASQTRVP

SEQ ID NO: 1103221 - protein, 9 aa, Homo Sapiens
DLKCALCRK

SEQ ID NO: 1103222 - protein, 9 aa, Homo Sapiens
RSEPTAGAA

SEQ ID NO: 1103223 - protein, 9 aa, Homo Sapiens
DSGLLTSSS

SEQ ID NO: 1103224 - protein, 9 aa, Homo Sapiens
ALKKASSPG

SEQ ID NO: 1103225 - protein, 9 aa, Homo Sapiens
QKLQAMRDI

SEQ ID NO: 1103226 - protein, 9 aa, Homo Sapiens
EEKWRNRLY

SEQ ID NO: 1103227 - protein, 9 aa, Homo Sapiens
RRSLAPTAA

SEQ ID NO: 1103228 - protein, 9 aa, Homo Sapiens
SELLDLMGG

SEQ ID NO: 1103229 - protein, 9 aa, Homo Sapiens
PSGEQIPGL

SEQ ID NO: 1103230 - protein, 9 aa, Homo Sapiens
ATKLLHIYQ

SEQ ID NO: 1103231 - protein, 9 aa, Homo Sapiens
APMLAPPTA

SEQ ID NO: 1103232 - protein, 9 aa, Homo Sapiens
VRREFQLKV

SEQ ID NO: 1103233 - protein, 9 aa, Homo Sapiens
YKICVNCCW

SEQ ID NO: 1103234 - protein, 9 aa, Homo Sapiens
ALDVAVQVV

SEQ ID NO: 1103235 - protein, 9 aa, Homo Sapiens
PDAQAAQLP

SEQ ID NO: 1103236 - protein, 9 aa, Homo Sapiens
QPSAARTPA

SEQ ID NO: 1103237 - protein, 9 aa, Homo Sapiens
VIGQGLVGM

SEQ ID NO: 1103238 - protein, 9 aa, Homo Sapiens
SLQFWMKVQ

SEQ ID NO: 1103239 - protein, 9 aa, Homo Sapiens
ASCASTGSS

SEQ ID NO: 1103240 - protein, 9 aa, Homo Sapiens
PWEVSLWME

SEQ ID NO: 1103241 - protein, 9 aa, Homo Sapiens
EEAKEEECL

SEQ ID NO: 1103242 - protein, 9 aa, Homo Sapiens
HKQHGVQEA

SEQ ID NO: 1103243 - protein, 9 aa, Homo Sapiens
LVNPHTHWT

SEQ ID NO: 1103244 - protein, 9 aa, Homo Sapiens
RKGGAGHMD

SEQ ID NO: 1103245 - protein, 9 aa, Homo Sapiens
YDWDRFDRE

SEQ ID NO: 1103246 - protein, 9 aa, Homo Sapiens
AGAARASDD

SEQ ID NO: 1103247 - protein, 9 aa, Homo Sapiens
CTGEDVAAL

SEQ ID NO: 1103248 - protein, 9 aa, Homo Sapiens
TRVLKLSEN

SEQ ID NO: 1103249 - protein, 9 aa, Homo Sapiens
LMHWWRVES

SEQ ID NO: 1103250 - protein, 9 aa, Homo Sapiens
QAVAAEHQD

SEQ ID NO: 1103251 - protein, 9 aa, Homo Sapiens
FPSFAQMLS

SEQ ID NO: 1103252 - protein, 9 aa, Homo Sapiens
IKACTCFVS

SEQ ID NO: 1103253 - protein, 9 aa, Homo Sapiens
HRSLPCHWP

SEQ ID NO: 1103254 - protein, 9 aa, Homo Sapiens
TPAGMEDPA

SEQ ID NO: 1103255 - protein, 9 aa, Homo Sapiens
CWLRYLTYR

SEQ ID NO: 1103256 - protein, 9 aa, Homo Sapiens
SETGYVWPV

SEQ ID NO: 1103257 - protein, 9 aa, Homo Sapiens
FHFFEDQLH

SEQ ID NO: 1103258 - protein, 9 aa, Homo Sapiens
THSPEEIRG

SEQ ID NO: 1103259 - protein, 9 aa, Homo Sapiens
RVCNGLEQP

SEQ ID NO: 1103260 - protein, 9 aa, Homo Sapiens
ESKLWENDR

SEQ ID NO: 1103261 - protein, 9 aa, Homo Sapiens
PQPRPSTPA

SEQ ID NO: 1103262 - protein, 9 aa, Homo Sapiens
NTKTTTSTD

SEQ ID NO: 1103263 - protein, 9 aa, Homo Sapiens
LLPEHCTRQ

SEQ ID NO: 1103264 - protein, 9 aa, Homo Sapiens
EVPWPEVWK

SEQ ID NO: 1103265 - protein, 9 aa, Homo Sapiens
MSFCLFMTK

SEQ ID NO: 1103266 - protein, 9 aa, Homo Sapiens
HEGHEPFLQ

SEQ ID NO: 1103267 - protein, 9 aa, Homo Sapiens
ARGASTSSV

SEQ ID NO: 1103268 - protein, 9 aa, Homo Sapiens
SGPSGAGRI

SEQ ID NO: 1103269 - protein, 9 aa, Homo Sapiens
PCLDPAGPL

SEQ ID NO: 1103270 - protein, 9 aa, Homo Sapiens
KRSDVEELT

SEQ ID NO: 1103271 - protein, 9 aa, Homo Sapiens
QHHIAPGYN

SEQ ID NO: 1103272 - protein, 9 aa, Homo Sapiens
SAARTPALI

SEQ ID NO: 1103273 - protein, 9 aa, Homo Sapiens
EYPMSSSGL

SEQ ID NO: 1103274 - protein, 9 aa, Homo Sapiens
HRVIATHSP

SEQ ID NO: 1103275 - protein, 9 aa, Homo Sapiens
SPWPALTLP

SEQ ID NO: 1103276 - protein, 9 aa, Homo Sapiens
HHSGSHSEY

SEQ ID NO: 1103277 - protein, 9 aa, Homo Sapiens
NIHGNALQT

SEQ ID NO: 1103278 - protein, 9 aa, Homo Sapiens
TLFALSGAV

SEQ ID NO: 1103279 - protein, 9 aa, Homo Sapiens
VRGLWPNTI

SEQ ID NO: 1103280 - protein, 9 aa, Homo Sapiens
LFKGAREHI

SEQ ID NO: 1103281 - protein, 9 aa, Homo Sapiens
AAAAVISDD

SEQ ID NO: 1103282 - protein, 9 aa, Homo Sapiens
VEKNSSSSS

SEQ ID NO: 1103283 - protein, 9 aa, Homo Sapiens
RKHSLRLPS

SEQ ID NO: 1103284 - protein, 9 aa, Homo Sapiens
SQPFQERLL

SEQ ID NO: 1103285 - protein, 9 aa, Homo Sapiens
LADSFVEKA

SEQ ID NO: 1103286 - protein, 9 aa, Homo Sapiens
VCWPSFSWT

SEQ ID NO: 1103287 - protein, 9 aa, Homo Sapiens
LRMGLEESE

SEQ ID NO: 1103288 - protein, 9 aa, Homo Sapiens
VILYRSYCS

SEQ ID NO: 1103289 - protein, 9 aa, Homo Sapiens
GAISVPVSH

SEQ ID NO: 1103290 - protein, 9 aa, Homo Sapiens
SLFEGTELE

SEQ ID NO: 1103291 - protein, 9 aa, Homo Sapiens
SEPADNSRG

SEQ ID NO: 1103292 - protein, 9 aa, Homo Sapiens
LSSLRILST

SEQ ID NO: 1103293 - protein, 9 aa, Homo Sapiens
MEISYMRHV

SEQ ID NO: 1103294 - protein, 9 aa, Homo Sapiens
WRVESDEAR

SEQ ID NO: 1103295 - protein, 9 aa, Homo Sapiens
VLMPTLSPM

SEQ ID NO: 1103296 - protein, 9 aa, Homo Sapiens
KGSTTRASG

SEQ ID NO: 1103297 - protein, 9 aa, Homo Sapiens
PGQPRGLVG

SEQ ID NO: 1103298 - protein, 9 aa, Homo Sapiens
MACFLPQRT

SEQ ID NO: 1103299 - protein, 9 aa, Homo Sapiens
VGHFSQART

SEQ ID NO: 1103300 - protein, 9 aa, Homo Sapiens
SYCLLKASE

SEQ ID NO: 1103301 - protein, 9 aa, Homo Sapiens
GSASCIRCG

SEQ ID NO: 1103302 - protein, 9 aa, Homo Sapiens
GGSVRQNSR

SEQ ID NO: 1103303 - protein, 9 aa, Homo Sapiens
FEEMRVLLD

SEQ ID NO: 1103304 - protein, 9 aa, Homo Sapiens
VRAQDWATI

SEQ ID NO: 1103305 - protein, 9 aa, Homo Sapiens
RNVASRMPL

SEQ ID NO: 1103306 - protein, 9 aa, Homo Sapiens
EVVVVHELG

SEQ ID NO: 1103307 - protein, 9 aa, Homo Sapiens
VTVMCGHCH

SEQ ID NO: 1103308 - protein, 9 aa, Homo Sapiens
LQQGDLLTP

SEQ ID NO: 1103309 - protein, 9 aa, Homo Sapiens
GLTSMPESA

SEQ ID NO: 1103310 - protein, 9 aa, Homo Sapiens
EADDEEETP

SEQ ID NO: 1103311 - protein, 9 aa, Homo Sapiens
YTRQGHGTC

SEQ ID NO: 1103312 - protein, 9 aa, Homo Sapiens
APPTAPDAQ

SEQ ID NO: 1103313 - protein, 9 aa, Homo Sapiens
PDYMRELLL

SEQ ID NO: 1103314 - protein, 9 aa, Homo Sapiens
FYCEKLSGP

SEQ ID NO: 1103315 - protein, 9 aa, Homo Sapiens
RRSPCPPMP

SEQ ID NO: 1103316 - protein, 9 aa, Homo Sapiens
PGVLVAGAV

SEQ ID NO: 1103317 - protein, 9 aa, Homo Sapiens
EHEKDFLWS

SEQ ID NO: 1103318 - protein, 9 aa, Homo Sapiens
AKTIRFTVR

SEQ ID NO: 1103319 - protein, 9 aa, Homo Sapiens
YIWSAVTRN

SEQ ID NO: 1103320 - protein, 9 aa, Homo Sapiens
HHNPWTMSP

SEQ ID NO: 1103321 - protein, 9 aa, Homo Sapiens
DLILVDAQK

SEQ ID NO: 1103322 - protein, 9 aa, Homo Sapiens
QKEMSEFIW

SEQ ID NO: 1103323 - protein, 9 aa, Homo Sapiens
LPRMPGPPW

SEQ ID NO: 1103324 - protein, 9 aa, Homo Sapiens
CISMTTISR

SEQ ID NO: 1103325 - protein, 9 aa, Homo Sapiens
PGKTLPDIS

SEQ ID NO: 1103326 - protein, 9 aa, Homo Sapiens
SYLELPDLG

SEQ ID NO: 1103327 - protein, 9 aa, Homo Sapiens
EEGILRLPC

SEQ ID NO: 1103328 - protein, 9 aa, Homo Sapiens
PWPPSFSAP

SEQ ID NO: 1103329 - protein, 9 aa, Homo Sapiens
TSPPSVEKN

SEQ ID NO: 1103330 - protein, 9 aa, Homo Sapiens
LDGGRHLTH

SEQ ID NO: 1103331 - protein, 9 aa, Homo Sapiens
LVVGTALVS

SEQ ID NO: 1103332 - protein, 9 aa, Homo Sapiens
FRIRDRDSE

SEQ ID NO: 1103333 - protein, 9 aa, Homo Sapiens
LSPCNASIM

SEQ ID NO: 1103334 - protein, 9 aa, Homo Sapiens
ACMSAPQPT

SEQ ID NO: 1103335 - protein, 9 aa, Homo Sapiens
KLVRSPSGQ

SEQ ID NO: 1103336 - protein, 9 aa, Homo Sapiens
HHNDIMLLR

SEQ ID NO: 1103337 - protein, 9 aa, Homo Sapiens
ILAVQRASK

SEQ ID NO: 1103338 - protein, 9 aa, Homo Sapiens
MCGHCHQPD

SEQ ID NO: 1103339 - protein, 9 aa, Homo Sapiens
GATLAEDKE

SEQ ID NO: 1103340 - protein, 9 aa, Homo Sapiens
NERLPRDWN

SEQ ID NO: 1103341 - protein, 9 aa, Homo Sapiens
EMLTPSGSA

SEQ ID NO: 1103342 - protein, 9 aa, Homo Sapiens
GLGVAARHS

SEQ ID NO: 1103343 - protein, 9 aa, Homo Sapiens
SLQERGGVA

SEQ ID NO: 1103344 - protein, 9 aa, Homo Sapiens
SLPPPKARR

SEQ ID NO: 1103345 - protein, 9 aa, Homo Sapiens
KEGDGAFGR

SEQ ID NO: 1103346 - protein, 9 aa, Homo Sapiens
TINHSLLAL

SEQ ID NO: 1103347 - protein, 9 aa, Homo Sapiens
TGMVHAASQ

SEQ ID NO: 1103348 - protein, 9 aa, Homo Sapiens
SHLQGTQAR

SEQ ID NO: 1103349 - protein, 9 aa, Homo Sapiens
LDECGCCAH

SEQ ID NO: 1103350 - protein, 9 aa, Homo Sapiens
RTKQRAWEW

SEQ ID NO: 1103351 - protein, 9 aa, Homo Sapiens
PLGYLLVPA

SEQ ID NO: 1103352 - protein, 9 aa, Homo Sapiens
TECSEITTA

SEQ ID NO: 1103353 - protein, 9 aa, Homo Sapiens
FLAFPSPQG

SEQ ID NO: 1103354 - protein, 9 aa, Homo Sapiens
DDVLMVTES

SEQ ID NO: 1103355 - protein, 9 aa, Homo Sapiens
PPSVRREFQ

SEQ ID NO: 1103356 - protein, 9 aa, Homo Sapiens
DHNVEMFMN

SEQ ID NO: 1103357 - protein, 9 aa, Homo Sapiens
YLLTRVATV

SEQ ID NO: 1103358 - protein, 9 aa, Homo Sapiens
LDRNLGSPL

SEQ ID NO: 1103359 - protein, 9 aa, Homo Sapiens
NSLDATLPD

SEQ ID NO: 1103360 - protein, 9 aa, Homo Sapiens
GAISKLKNQ

SEQ ID NO: 1103361 - protein, 9 aa, Homo Sapiens
WNALCRPSP

SEQ ID NO: 1103362 - protein, 9 aa, Homo Sapiens
GSCPPSRAA

SEQ ID NO: 1103363 - protein, 9 aa, Homo Sapiens
STRTTALGM

SEQ ID NO: 1103364 - protein, 9 aa, Homo Sapiens
PPLWTPAWC

SEQ ID NO: 1103365 - protein, 9 aa, Homo Sapiens
TRRSPCPPM

SEQ ID NO: 1103366 - protein, 9 aa, Homo Sapiens
ELDSLDGGM

SEQ ID NO: 1103367 - protein, 9 aa, Homo Sapiens
VLKLSENFS

SEQ ID NO: 1103368 - protein, 9 aa, Homo Sapiens
NAWLSYCLL

SEQ ID NO: 1103369 - protein, 9 aa, Homo Sapiens
PYEWDHAVV

SEQ ID NO: 1103370 - protein, 9 aa, Homo Sapiens
EGFLAFPSP

SEQ ID NO: 1103371 - protein, 9 aa, Homo Sapiens
TAGPCCPST

SEQ ID NO: 1103372 - protein, 9 aa, Homo Sapiens
HHAVYKQSV

SEQ ID NO: 1103373 - protein, 9 aa, Homo Sapiens
GSCAPRPPS

SEQ ID NO: 1103374 - protein, 9 aa, Homo Sapiens
EGHEPFLQW

SEQ ID NO: 1103375 - protein, 9 aa, Homo Sapiens
VDCKLKLVC

SEQ ID NO: 1103376 - protein, 9 aa, Homo Sapiens
PPPAPATQA

SEQ ID NO: 1103377 - protein, 9 aa, Homo Sapiens
GATVKEKLS

SEQ ID NO: 1103378 - protein, 9 aa, Homo Sapiens
STPASPGNR

SEQ ID NO: 1103379 - protein, 9 aa, Homo Sapiens
DGNNTFFCN

SEQ ID NO: 1103380 - protein, 9 aa, Homo Sapiens
DETFAKFYC

SEQ ID NO: 1103381 - protein, 9 aa, Homo Sapiens
FITAAAMVL

SEQ ID NO: 1103382 - protein, 9 aa, Homo Sapiens
LTRHAGRKQ

SEQ ID NO: 1103383 - protein, 9 aa, Homo Sapiens
DCGVAHRDL

SEQ ID NO: 1103384 - protein, 9 aa, Homo Sapiens
SGSHSEYPM

SEQ ID NO: 1103385 - protein, 9 aa, Homo Sapiens
GLPWPFPGW

SEQ ID NO: 1103386 - protein, 9 aa, Homo Sapiens
IPKGKLSVT

SEQ ID NO: 1103387 - protein, 9 aa, Homo Sapiens
CLEKTAKEL

SEQ ID NO: 1103388 - protein, 9 aa, Homo Sapiens
HLRLLRLGS

SEQ ID NO: 1103389 - protein, 9 aa, Homo Sapiens
NDRILEGNP

SEQ ID NO: 1103390 - protein, 9 aa, Homo Sapiens
LALLVQPGS

SEQ ID NO: 1103391 - protein, 9 aa, Homo Sapiens
ADVPTYKEV

SEQ ID NO: 1103392 - protein, 9 aa, Homo Sapiens
RRGRKWRSY

SEQ ID NO: 1103393 - protein, 9 aa, Homo Sapiens
RAWGSLSNY

SEQ ID NO: 1103394 - protein, 9 aa, Homo Sapiens
MAELGLGYA

SEQ ID NO: 1103395 - protein, 9 aa, Homo Sapiens
PSCSPSPKK

SEQ ID NO: 1103396 - protein, 9 aa, Homo Sapiens
NISVSLKNQ

SEQ ID NO: 1103397 - protein, 9 aa, Homo Sapiens
TPYLYQLPN

SEQ ID NO: 1103398 - protein, 9 aa, Homo Sapiens
PYACTQCGR

SEQ ID NO: 1103399 - protein, 9 aa, Homo Sapiens
HVYSELPKP

SEQ ID NO: 1103400 - protein, 9 aa, Homo Sapiens
MTSLFRRSG

SEQ ID NO: 1103401 - protein, 9 aa, Homo Sapiens
LHEKREIRC

SEQ ID NO: 1103402 - protein, 9 aa, Homo Sapiens
RMGLFTPDM

SEQ ID NO: 1103403 - protein, 9 aa, Homo Sapiens
QNAPPGFFL

SEQ ID NO: 1103404 - protein, 9 aa, Homo Sapiens
LKSPTPPSS

SEQ ID NO: 1103405 - protein, 9 aa, Homo Sapiens
GHMDGPHSQ

SEQ ID NO: 1103406 - protein, 9 aa, Homo Sapiens
GPPWPTHLP

SEQ ID NO: 1103407 - protein, 9 aa, Homo Sapiens
LSRLLPEHC

SEQ ID NO: 1103408 - protein, 9 aa, Homo Sapiens
APEVVGAWA

SEQ ID NO: 1103409 - protein, 9 aa, Homo Sapiens
AIDPLLDVA

SEQ ID NO: 1103410 - protein, 9 aa, Homo Sapiens
TPSASTHTS

SEQ ID NO: 1103411 - protein, 9 aa, Homo Sapiens
VEGVKAPRN

SEQ ID NO: 1103412 - protein, 9 aa, Homo Sapiens
QHDKLAHPH

SEQ ID NO: 1103413 - protein, 9 aa, Homo Sapiens
MCKQNVVPT

SEQ ID NO: 1103414 - protein, 9 aa, Homo Sapiens
LFKLSCIIN

SEQ ID NO: 1103415 - protein, 9 aa, Homo Sapiens
TWSRSSFTS

SEQ ID NO: 1103416 - protein, 9 aa, Homo Sapiens
PPGGRAWAP

SEQ ID NO: 1103417 - protein, 9 aa, Homo Sapiens
RDIRHVTSD

SEQ ID NO: 1103418 - protein, 9 aa, Homo Sapiens
LRSPGGLGT

SEQ ID NO: 1103419 - protein, 9 aa, Homo Sapiens
AAVISDDQI

SEQ ID NO: 1103420 - protein, 9 aa, Homo Sapiens
LWPPQRPSN

SEQ ID NO: 1103421 - protein, 9 aa, Homo Sapiens
PAGSPRPGP

SEQ ID NO: 1103422 - protein, 9 aa, Homo Sapiens
VIDYDWDRF

SEQ ID NO: 1103423 - protein, 9 aa, Homo Sapiens
TDIDLLSTA

SEQ ID NO: 1103424 - protein, 9 aa, Homo Sapiens
FRDSATKGF

SEQ ID NO: 1103425 - protein, 9 aa, Homo Sapiens
IPSDTTLEV

SEQ ID NO: 1103426 - protein, 9 aa, Homo Sapiens
TELAVQALQ

SEQ ID NO: 1103427 - protein, 9 aa, Homo Sapiens
ARIQADLDY

SEQ ID NO: 1103428 - protein, 9 aa, Homo Sapiens
IDAVDNKKT

SEQ ID NO: 1103429 - protein, 9 aa, Homo Sapiens
LCSELSSVH

SEQ ID NO: 1103430 - protein, 9 aa, Homo Sapiens
DEEEEADDE

SEQ ID NO: 1103431 - protein, 9 aa, Homo Sapiens
LREWGHCQA

SEQ ID NO: 1103432 - protein, 9 aa, Homo Sapiens
SSQPKPAVH

SEQ ID NO: 1103433 - protein, 9 aa, Homo Sapiens
CPRPRCRPA

SEQ ID NO: 1103434 - protein, 9 aa, Homo Sapiens
AARARTCSP

SEQ ID NO: 1103435 - protein, 9 aa, Homo Sapiens
HPPAPGVQP

SEQ ID NO: 1103436 - protein, 9 aa, Homo Sapiens
VMTEPCKIL

SEQ ID NO: 1103437 - protein, 9 aa, Homo Sapiens
PAIEDDILP

SEQ ID NO: 1103438 - protein, 9 aa, Homo Sapiens
ALLSAGSWA

SEQ ID NO: 1103439 - protein, 9 aa, Homo Sapiens
TPRKEHSMG

SEQ ID NO: 1103440 - protein, 9 aa, Homo Sapiens
RAPRQLGQG

SEQ ID NO: 1103441 - protein, 9 aa, Homo Sapiens
DSLLQLTCR

SEQ ID NO: 1103442 - protein, 9 aa, Homo Sapiens
FGYYSASGT

SEQ ID NO: 1103443 - protein, 9 aa, Homo Sapiens
TSHLVKGTW

SEQ ID NO: 1103444 - protein, 9 aa, Homo Sapiens
SIAVLPDHR

SEQ ID NO: 1103445 - protein, 9 aa, Homo Sapiens
IIIVVNQEI

SEQ ID NO: 1103446 - protein, 9 aa, Homo Sapiens
MRWGCHHRM

SEQ ID NO: 1103447 - protein, 9 aa, Homo Sapiens
LDFFSDSFN

SEQ ID NO: 1103448 - protein, 9 aa, Homo Sapiens
ADSFVEKAT

SEQ ID NO: 1103449 - protein, 9 aa, Homo Sapiens
QATGEQAPP

SEQ ID NO: 1103450 - protein, 9 aa, Homo Sapiens
PKAVWVPGH

SEQ ID NO: 1103451 - protein, 9 aa, Homo Sapiens
GNLSKASIL

SEQ ID NO: 1103452 - protein, 9 aa, Homo Sapiens
CTCISMTTI

SEQ ID NO: 1103453 - protein, 9 aa, Homo Sapiens
AAASEMALP

SEQ ID NO: 1103454 - protein, 9 aa, Homo Sapiens
VWRANVGAA

SEQ ID NO: 1103455 - protein, 9 aa, Homo Sapiens
HLGQELALG

SEQ ID NO: 1103456 - protein, 9 aa, Homo Sapiens
DEAFALPNS

SEQ ID NO: 1103457 - protein, 9 aa, Homo Sapiens
LQAVQGHAS

SEQ ID NO: 1103458 - protein, 9 aa, Homo Sapiens
KLEHSAPKP

SEQ ID NO: 1103459 - protein, 9 aa, Homo Sapiens
SACTMPPLL

SEQ ID NO: 1103460 - protein, 9 aa, Homo Sapiens
RINPKTGAS

SEQ ID NO: 1103461 - protein, 9 aa, Homo Sapiens
DEEDRKHQQ

SEQ ID NO: 1103462 - protein, 9 aa, Homo Sapiens
ADLRKLAIN

SEQ ID NO: 1103463 - protein, 9 aa, Homo Sapiens
QLQPQPTWG

SEQ ID NO: 1103464 - protein, 9 aa, Homo Sapiens
CCQFWSKME

SEQ ID NO: 1103465 - protein, 9 aa, Homo Sapiens
FRRGPEPWL

SEQ ID NO: 1103466 - protein, 9 aa, Homo Sapiens
ATYRVEGGW

SEQ ID NO: 1103467 - protein, 9 aa, Homo Sapiens
KCKSVNTCL

SEQ ID NO: 1103468 - protein, 9 aa, Homo Sapiens
RHFKAHHSV

SEQ ID NO: 1103469 - protein, 9 aa, Homo Sapiens
GTPTEWTRP

SEQ ID NO: 1103470 - protein, 9 aa, Homo Sapiens
KRKSKDKKQ

SEQ ID NO: 1103471 - protein, 9 aa, Homo Sapiens
PSPASGSTS

SEQ ID NO: 1103472 - protein, 9 aa, Homo Sapiens
RERAAAALR

SEQ ID NO: 1103473 - protein, 9 aa, Homo Sapiens
SERDYNMDF

SEQ ID NO: 1103474 - protein, 9 aa, Homo Sapiens
VCLEQCPLQ

SEQ ID NO: 1103475 - protein, 9 aa, Homo Sapiens
FRKFRRGPE

SEQ ID NO: 1103476 - protein, 9 aa, Homo Sapiens
SAFKEVSLL

SEQ ID NO: 1103477 - protein, 9 aa, Homo Sapiens
GDWVASPPT

SEQ ID NO: 1103478 - protein, 9 aa, Homo Sapiens
PHVDFQLVL

SEQ ID NO: 1103479 - protein, 9 aa, Homo Sapiens
SEDSVVEIR

SEQ ID NO: 1103480 - protein, 9 aa, Homo Sapiens
GAGHMDGPH

SEQ ID NO: 1103481 - protein, 9 aa, Homo Sapiens
FWSKMESRT

SEQ ID NO: 1103482 - protein, 9 aa, Homo Sapiens
AAALRAVGT

SEQ ID NO: 1103483 - protein, 9 aa, Homo Sapiens
RTVKTKATQ

SEQ ID NO: 1103484 - protein, 9 aa, Homo Sapiens
PLRTPLQQV

SEQ ID NO: 1103485 - protein, 9 aa, Homo Sapiens
GLDSSWLPV

SEQ ID NO: 1103486 - protein, 9 aa, Homo Sapiens
AKTEWLDDK

SEQ ID NO: 1103487 - protein, 9 aa, Homo Sapiens
ISMTTISRA

SEQ ID NO: 1103488 - protein, 9 aa, Homo Sapiens
AAFFVDSSS

SEQ ID NO: 1103489 - protein, 9 aa, Homo Sapiens
SAGSSWTPG

SEQ ID NO: 1103490 - protein, 9 aa, Homo Sapiens
CDLLVYLRA

SEQ ID NO: 1103491 - protein, 9 aa, Homo Sapiens
KMVFIVNSK

SEQ ID NO: 1103492 - protein, 9 aa, Homo Sapiens
TLKSLMTAN

SEQ ID NO: 1103493 - protein, 9 aa, Homo Sapiens
GTKCYMPPE

SEQ ID NO: 1103494 - protein, 9 aa, Homo Sapiens
KETLWIRRL

SEQ ID NO: 1103495 - protein, 9 aa, Homo Sapiens
LSRVWNTAS

SEQ ID NO: 1103496 - protein, 9 aa, Homo Sapiens
QEGRPSCGR

SEQ ID NO: 1103497 - protein, 9 aa, Homo Sapiens
LLGSPLLSG

SEQ ID NO: 1103498 - protein, 9 aa, Homo Sapiens
IWFKSYRMI

SEQ ID NO: 1103499 - protein, 9 aa, Homo Sapiens
TNGKNVQPL

SEQ ID NO: 1103500 - protein, 9 aa, Homo Sapiens
GYSAYTTQP

SEQ ID NO: 1103501 - protein, 9 aa, Homo Sapiens
QILGLRSSV

SEQ ID NO: 1103502 - protein, 9 aa, Homo Sapiens
LLLQITKRT

SEQ ID NO: 1103503 - protein, 9 aa, Homo Sapiens
GHIYTFIGE

SEQ ID NO: 1103504 - protein, 9 aa, Homo Sapiens
GPGAHREAF

SEQ ID NO: 1103505 - protein, 9 aa, Homo Sapiens
SVIPHLFLA

SEQ ID NO: 1103506 - protein, 9 aa, Homo Sapiens
GVLDSELAQ

SEQ ID NO: 1103507 - protein, 9 aa, Homo Sapiens
KIEPPGLFC

SEQ ID NO: 1103508 - protein, 9 aa, Homo Sapiens
ALMQKHHRR

SEQ ID NO: 1103509 - protein, 9 aa, Homo Sapiens
EEDFEDNHH

SEQ ID NO: 1103510 - protein, 9 aa, Homo Sapiens
IEIGNSLPQ

SEQ ID NO: 1103511 - protein, 9 aa, Homo Sapiens
CCPRPRCRP

SEQ ID NO: 1103512 - protein, 9 aa, Homo Sapiens
GLLRREPRR

SEQ ID NO: 1103513 - protein, 9 aa, Homo Sapiens
DEQCAAAAL

SEQ ID NO: 1103514 - protein, 9 aa, Homo Sapiens
HTSIPRRTL

SEQ ID NO: 1103515 - protein, 9 aa, Homo Sapiens
SRTKARVLN

SEQ ID NO: 1103516 - protein, 9 aa, Homo Sapiens
EEVGGGVGG

SEQ ID NO: 1103517 - protein, 9 aa, Homo Sapiens
HTNGKNVQP

SEQ ID NO: 1103518 - protein, 9 aa, Homo Sapiens
QTPGQARAA

SEQ ID NO: 1103519 - protein, 9 aa, Homo Sapiens
KIMRMLPTA

SEQ ID NO: 1103520 - protein, 9 aa, Homo Sapiens
ADPALPVGR

SEQ ID NO: 1103521 - protein, 9 aa, Homo Sapiens
GTSVLGGCP

SEQ ID NO: 1103522 - protein, 9 aa, Homo Sapiens
TWGARDASA

SEQ ID NO: 1103523 - protein, 9 aa, Homo Sapiens
RLLKLESKM

SEQ ID NO: 1103524 - protein, 9 aa, Homo Sapiens
WEYFMACFL

SEQ ID NO: 1103525 - protein, 9 aa, Homo Sapiens
TAPSPRAGS

SEQ ID NO: 1103526 - protein, 9 aa, Homo Sapiens
FTACETYIS

SEQ ID NO: 1103527 - protein, 9 aa, Homo Sapiens
SSALQGKVL

SEQ ID NO: 1103528 - protein, 9 aa, Homo Sapiens
LPVPEHLGQ

SEQ ID NO: 1103529 - protein, 9 aa, Homo Sapiens
GKVEKHMCF

SEQ ID NO: 1103530 - protein, 9 aa, Homo Sapiens
TEFGSGVVI

SEQ ID NO: 1103531 - protein, 9 aa, Homo Sapiens
SVPRGAWAA

SEQ ID NO: 1103532 - protein, 9 aa, Homo Sapiens
DFQLVLPGE

SEQ ID NO: 1103533 - protein, 9 aa, Homo Sapiens
IFFSLSSSC

SEQ ID NO: 1103534 - protein, 9 aa, Homo Sapiens
VPQAVAPAA

SEQ ID NO: 1103535 - protein, 9 aa, Homo Sapiens
QHHYYLGYI

SEQ ID NO: 1103536 - protein, 9 aa, Homo Sapiens
EAAASRLPR

SEQ ID NO: 1103537 - protein, 9 aa, Homo Sapiens
PLAPLGPAV

SEQ ID NO: 1103538 - protein, 9 aa, Homo Sapiens
HSAGLSPGA

SEQ ID NO: 1103539 - protein, 9 aa, Homo Sapiens
SALALPHLP

SEQ ID NO: 1103540 - protein, 9 aa, Homo Sapiens
QRGEMQAQH

SEQ ID NO: 1103541 - protein, 9 aa, Homo Sapiens
RHEGHEPFL

SEQ ID NO: 1103542 - protein, 9 aa, Homo Sapiens
EIKWLSRRL

SEQ ID NO: 1103543 - protein, 9 aa, Homo Sapiens
SQDQGVLDS

SEQ ID NO: 1103544 - protein, 9 aa, Homo Sapiens
DLRSQGVNT

SEQ ID NO: 1103545 - protein, 9 aa, Homo Sapiens
PHQVQGRGI

SEQ ID NO: 1103546 - protein, 9 aa, Homo Sapiens
NLTTHKRIR

SEQ ID NO: 1103547 - protein, 9 aa, Homo Sapiens
LQPQPTWGC

SEQ ID NO: 1103548 - protein, 9 aa, Homo Sapiens
AADMQFMLL

SEQ ID NO: 1103549 - protein, 9 aa, Homo Sapiens
QVFSVAYQE

SEQ ID NO: 1103550 - protein, 9 aa, Homo Sapiens
AYYPYSQFQ

SEQ ID NO: 1103551 - protein, 9 aa, Homo Sapiens
RVGKSCCQP

SEQ ID NO: 1103552 - protein, 9 aa, Homo Sapiens
PLDGGRHLT

SEQ ID NO: 1103553 - protein, 9 aa, Homo Sapiens
RRHLRLLRL

SEQ ID NO: 1103554 - protein, 9 aa, Homo Sapiens
RLPDDCLLQ

SEQ ID NO: 1103555 - protein, 9 aa, Homo Sapiens
GVNTKKEMV

SEQ ID NO: 1103556 - protein, 9 aa, Homo Sapiens
HGHTDATGH

SEQ ID NO: 1103557 - protein, 9 aa, Homo Sapiens
KGEEKPTRK

SEQ ID NO: 1103558 - protein, 9 aa, Homo Sapiens
WPSGTRSSL

SEQ ID NO: 1103559 - protein, 9 aa, Homo Sapiens
LSPVNTQPT

SEQ ID NO: 1103560 - protein, 9 aa, Homo Sapiens
AAFVEASSS

SEQ ID NO: 1103561 - protein, 9 aa, Homo Sapiens
ILRLSRHHR

SEQ ID NO: 1103562 - protein, 9 aa, Homo Sapiens
GRFRSSGLS

SEQ ID NO: 1103563 - protein, 9 aa, Homo Sapiens
IEMNKKHEA

SEQ ID NO: 1103564 - protein, 9 aa, Homo Sapiens
TLLLCHWDG

SEQ ID NO: 1103565 - protein, 9 aa, Homo Sapiens
VATGLPNIT

SEQ ID NO: 1103566 - protein, 9 aa, Homo Sapiens
ALLRGLGLQ

SEQ ID NO: 1103567 - protein, 9 aa, Homo Sapiens
KADSRHYHC

SEQ ID NO: 1103568 - protein, 9 aa, Homo Sapiens
LDFSPYWMK

SEQ ID NO: 1103569 - protein, 9 aa, Homo Sapiens
GRHLTHLLG

SEQ ID NO: 1103570 - protein, 9 aa, Homo Sapiens
EALLRNSTA

SEQ ID NO: 1103571 - protein, 9 aa, Homo Sapiens
NWCWRDKKQ

SEQ ID NO: 1103572 - protein, 9 aa, Homo Sapiens
IVQDFKTDL

SEQ ID NO: 1103573 - protein, 9 aa, Homo Sapiens
QAAVPAETV

SEQ ID NO: 1103574 - protein, 9 aa, Homo Sapiens
LRYANLEAV

SEQ ID NO: 1103575 - protein, 9 aa, Homo Sapiens
AAKTEWLDD

SEQ ID NO: 1103576 - protein, 9 aa, Homo Sapiens
FLLHQVLRK

SEQ ID NO: 1103577 - protein, 9 aa, Homo Sapiens
SLHFLLILC

SEQ ID NO: 1103578 - protein, 9 aa, Homo Sapiens
CQLDLRYAN

SEQ ID NO: 1103579 - protein, 9 aa, Homo Sapiens
FPRVCMMVD

SEQ ID NO: 1103580 - protein, 9 aa, Homo Sapiens
LNGWLCIDD

SEQ ID NO: 1103581 - protein, 9 aa, Homo Sapiens
PRSLPRVLR

SEQ ID NO: 1103582 - protein, 9 aa, Homo Sapiens
TMEFPEGTR

SEQ ID NO: 1103583 - protein, 9 aa, Homo Sapiens
MVFETRRPQ

SEQ ID NO: 1103584 - protein, 9 aa, Homo Sapiens
VSSCGQTGP

SEQ ID NO: 1103585 - protein, 9 aa, Homo Sapiens
CRKTRRERN

SEQ ID NO: 1103586 - protein, 9 aa, Homo Sapiens
NLPFVLYPL

SEQ ID NO: 1103587 - protein, 9 aa, Homo Sapiens
WARARAATR

SEQ ID NO: 1103588 - protein, 9 aa, Homo Sapiens
TTALGMCTN

SEQ ID NO: 1103589 - protein, 9 aa, Homo Sapiens
SSTPTCLRT

SEQ ID NO: 1103590 - protein, 9 aa, Homo Sapiens
EKPGRVRCR

SEQ ID NO: 1103591 - protein, 9 aa, Homo Sapiens
LLQITKRTW

SEQ ID NO: 1103592 - protein, 9 aa, Homo Sapiens
VLSQLHHGG

SEQ ID NO: 1103593 - protein, 9 aa, Homo Sapiens
GAGRQHHVL

SEQ ID NO: 1103594 - protein, 9 aa, Homo Sapiens
RIKWTKVWT

SEQ ID NO: 1103595 - protein, 9 aa, Homo Sapiens
PVSPLQTAI

SEQ ID NO: 1103596 - protein, 9 aa, Homo Sapiens
DTAELQVPH

SEQ ID NO: 1103597 - protein, 9 aa, Homo Sapiens
IRYGFEGVI

SEQ ID NO: 1103598 - protein, 9 aa, Homo Sapiens
SFVPNNPDL

SEQ ID NO: 1103599 - protein, 9 aa, Homo Sapiens
YRSAEMEKI

SEQ ID NO: 1103600 - protein, 9 aa, Homo Sapiens
AVTSPERLP

SEQ ID NO: 1103601 - protein, 9 aa, Homo Sapiens
CLSKAAWQI

SEQ ID NO: 1103602 - protein, 9 aa, Homo Sapiens
PEWSLATGQ

SEQ ID NO: 1103603 - protein, 9 aa, Homo Sapiens
IFADAFFLV

SEQ ID NO: 1103604 - protein, 9 aa, Homo Sapiens
TVMCGHCHQ

SEQ ID NO: 1103605 - protein, 9 aa, Homo Sapiens
TLYYDVESF

SEQ ID NO: 1103606 - protein, 9 aa, Homo Sapiens
EDSSCLPKD

SEQ ID NO: 1103607 - protein, 9 aa, Homo Sapiens
RILSTGVLP

SEQ ID NO: 1103608 - protein, 9 aa, Homo Sapiens
CSHSMAAQI

SEQ ID NO: 1103609 - protein, 9 aa, Homo Sapiens
VGAQEAVQE

SEQ ID NO: 1103610 - protein, 9 aa, Homo Sapiens
TDAKGQTEE

SEQ ID NO: 1103611 - protein, 9 aa, Homo Sapiens
QWRKFLQMK

SEQ ID NO: 1103612 - protein, 9 aa, Homo Sapiens
VRGPHFNPS

SEQ ID NO: 1103613 - protein, 9 aa, Homo Sapiens
KASREIANE

SEQ ID NO: 1103614 - protein, 9 aa, Homo Sapiens
VDPTWISEN

SEQ ID NO: 1103615 - protein, 9 aa, Homo Sapiens
LGTAQLKEN

SEQ ID NO: 1103616 - protein, 9 aa, Homo Sapiens
DYAHHAQEK

SEQ ID NO: 1103617 - protein, 9 aa, Homo Sapiens
FKWMPVVDP

SEQ ID NO: 1103618 - protein, 9 aa, Homo Sapiens
VGFIDFVCI

SEQ ID NO: 1103619 - protein, 9 aa, Homo Sapiens
SEFKSIKKH

SEQ ID NO: 1103620 - protein, 9 aa, Homo Sapiens
KGKSDEQCA

SEQ ID NO: 1103621 - protein, 9 aa, Homo Sapiens
QVEAGGSKH

SEQ ID NO: 1103622 - protein, 9 aa, Homo Sapiens
ALRAVGTQI

SEQ ID NO: 1103623 - protein, 9 aa, Homo Sapiens
LQGVPGKTS

SEQ ID NO: 1103624 - protein, 9 aa, Homo Sapiens
KMKADKLYL

SEQ ID NO: 1103625 - protein, 9 aa, Homo Sapiens
SMPTKQAPP

SEQ ID NO: 1103626 - protein, 9 aa, Homo Sapiens
GNALPPTEG

SEQ ID NO: 1103627 - protein, 9 aa, Homo Sapiens
SGSCAPRPP

SEQ ID NO: 1103628 - protein, 9 aa, Homo Sapiens
ILFFFLFPL

SEQ ID NO: 1103629 - protein, 9 aa, Homo Sapiens
MDLDGMLTV

SEQ ID NO: 1103630 - protein, 9 aa, Homo Sapiens
TTSTECSEI

SEQ ID NO: 1103631 - protein, 9 aa, Homo Sapiens
NIRIWFIRK

SEQ ID NO: 1103632 - protein, 9 aa, Homo Sapiens
ILHRGGAPG

SEQ ID NO: 1103633 - protein, 9 aa, Homo Sapiens
RVLLLPVLV

SEQ ID NO: 1103634 - protein, 9 aa, Homo Sapiens
GGVRMLDGA

SEQ ID NO: 1103635 - protein, 9 aa, Homo Sapiens
TPLQQVGIF

SEQ ID NO: 1103636 - protein, 9 aa, Homo Sapiens
INAPVTCYY

SEQ ID NO: 1103637 - protein, 9 aa, Homo Sapiens
SPGCPFQAP

SEQ ID NO: 1103638 - protein, 9 aa, Homo Sapiens
TFKNLPKAL

SEQ ID NO: 1103639 - protein, 9 aa, Homo Sapiens
CTACHLNPS

SEQ ID NO: 1103640 - protein, 9 aa, Homo Sapiens
SSLNLEQSR

SEQ ID NO: 1103641 - protein, 9 aa, Homo Sapiens
HVEVVLTHK

SEQ ID NO: 1103642 - protein, 9 aa, Homo Sapiens
TESEDVKIW

SEQ ID NO: 1103643 - protein, 9 aa, Homo Sapiens
FGYMQWVWG

SEQ ID NO: 1103644 - protein, 9 aa, Homo Sapiens
GNSGRPGLP

SEQ ID NO: 1103645 - protein, 9 aa, Homo Sapiens
GAVKVNNSM

SEQ ID NO: 1103646 - protein, 9 aa, Homo Sapiens
PSATSQTPG

SEQ ID NO: 1103647 - protein, 9 aa, Homo Sapiens
LVALSLPAS

SEQ ID NO: 1103648 - protein, 9 aa, Homo Sapiens
YMSPNREVK

SEQ ID NO: 1103649 - protein, 9 aa, Homo Sapiens
YELQSVAVG

SEQ ID NO: 1103650 - protein, 9 aa, Homo Sapiens
HSLRGETVN

SEQ ID NO: 1103651 - protein, 9 aa, Homo Sapiens
PASGRRRTF

SEQ ID NO: 1103652 - protein, 9 aa, Homo Sapiens
YNMDFLTLR

SEQ ID NO: 1103653 - protein, 9 aa, Homo Sapiens
ARAPRASCA

SEQ ID NO: 1103654 - protein, 9 aa, Homo Sapiens
LLQAMANLP

SEQ ID NO: 1103655 - protein, 9 aa, Homo Sapiens
CVAVVDQHP

SEQ ID NO: 1103656 - protein, 9 aa, Homo Sapiens
ARAPRSWPR

SEQ ID NO: 1103657 - protein, 9 aa, Homo Sapiens
FFYQERANK

SEQ ID NO: 1103658 - protein, 9 aa, Homo Sapiens
KISKGRGSI

SEQ ID NO: 1103659 - protein, 9 aa, Homo Sapiens
LFLAVWLSC

SEQ ID NO: 1103660 - protein, 9 aa, Homo Sapiens
FSHRLTRGP

SEQ ID NO: 1103661 - protein, 9 aa, Homo Sapiens
GFVYRDCQS

SEQ ID NO: 1103662 - protein, 9 aa, Homo Sapiens
PRGPRAPDP

SEQ ID NO: 1103663 - protein, 9 aa, Homo Sapiens
LLGDQLVGG

SEQ ID NO: 1103664 - protein, 9 aa, Homo Sapiens
LALMQKHHR

SEQ ID NO: 1103665 - protein, 9 aa, Homo Sapiens
ICPATVIKS

SEQ ID NO: 1103666 - protein, 9 aa, Homo Sapiens
QIGATLARH

SEQ ID NO: 1103667 - protein, 9 aa, Homo Sapiens
QACYNFIRS

SEQ ID NO: 1103668 - protein, 9 aa, Homo Sapiens
LWLPYPFSN

SEQ ID NO: 1103669 - protein, 9 aa, Homo Sapiens
LWIRRLGEP

SEQ ID NO: 1103670 - protein, 9 aa, Homo Sapiens
SDGNNTFFC

SEQ ID NO: 1103671 - protein, 9 aa, Homo Sapiens
GFLAFPSPQ

SEQ ID NO: 1103672 - protein, 9 aa, Homo Sapiens
RRPKLQPGF

SEQ ID NO: 1103673 - protein, 9 aa, Homo Sapiens
IPRRTLQLT

SEQ ID NO: 1103674 - protein, 9 aa, Homo Sapiens
DCISQLFFY

SEQ ID NO: 1103675 - protein, 9 aa, Homo Sapiens
PLPCVLPHV

SEQ ID NO: 1103676 - protein, 9 aa, Homo Sapiens
VLTAEGTRW

SEQ ID NO: 1103677 - protein, 9 aa, Homo Sapiens
ISCEHPWEV

SEQ ID NO: 1103678 - protein, 9 aa, Homo Sapiens
MKFYFIQIM

SEQ ID NO: 1103679 - protein, 9 aa, Homo Sapiens
CSFHCSDRS

SEQ ID NO: 1103680 - protein, 9 aa, Homo Sapiens
RWTCASSRG

SEQ ID NO: 1103681 - protein, 9 aa, Homo Sapiens
FKEEHTFFT

SEQ ID NO: 1103682 - protein, 9 aa, Homo Sapiens
LMAHCVVTA

SEQ ID NO: 1103683 - protein, 9 aa, Homo Sapiens
GRAFCNVWA

SEQ ID NO: 1103684 - protein, 9 aa, Homo Sapiens
VAKAATKSL

SEQ ID NO: 1103685 - protein, 9 aa, Homo Sapiens
RPWSRPGSG

SEQ ID NO: 1103686 - protein, 9 aa, Homo Sapiens
STSSVTASC

SEQ ID NO: 1103687 - protein, 9 aa, Homo Sapiens
FFSSVISDC

SEQ ID NO: 1103688 - protein, 9 aa, Homo Sapiens
ETVGHFSQA

SEQ ID NO: 1103689 - protein, 9 aa, Homo Sapiens
STSSDWAVG

SEQ ID NO: 1103690 - protein, 9 aa, Homo Sapiens
LRVAGAART

SEQ ID NO: 1103691 - protein, 9 aa, Homo Sapiens
RLDVFLHFL

SEQ ID NO: 1103692 - protein, 9 aa, Homo Sapiens
CRTTMAFLR

SEQ ID NO: 1103693 - protein, 9 aa, Homo Sapiens
LQIVDHFKM

SEQ ID NO: 1103694 - protein, 9 aa, Homo Sapiens
GQNAWLSYC

SEQ ID NO: 1103695 - protein, 9 aa, Homo Sapiens
HRLTRGPRN

SEQ ID NO: 1103696 - protein, 9 aa, Homo Sapiens
DDDKVSIAT

SEQ ID NO: 1103697 - protein, 9 aa, Homo Sapiens
PSVDPTWIS

SEQ ID NO: 1103698 - protein, 9 aa, Homo Sapiens
IWSAVTRNY

SEQ ID NO: 1103699 - protein, 9 aa, Homo Sapiens
KGYWIAEGN

SEQ ID NO: 1103700 - protein, 9 aa, Homo Sapiens
YPAYSKDSG

SEQ ID NO: 1103701 - protein, 9 aa, Homo Sapiens
HTHCVQALH

SEQ ID NO: 1103702 - protein, 9 aa, Homo Sapiens
LRMRGEPLQ

SEQ ID NO: 1103703 - protein, 9 aa, Homo Sapiens
PRRTLQLTP

SEQ ID NO: 1103704 - protein, 9 aa, Homo Sapiens
LKQMLNNKL

SEQ ID NO: 1103705 - protein, 9 aa, Homo Sapiens
PIGAKFKLY

SEQ ID NO: 1103706 - protein, 9 aa, Homo Sapiens
GIQGSQPFQ

SEQ ID NO: 1103707 - protein, 9 aa, Homo Sapiens
RGLGLQLAL

SEQ ID NO: 1103708 - protein, 9 aa, Homo Sapiens
WVGAQEAVQ

SEQ ID NO: 1103709 - protein, 9 aa, Homo Sapiens
PKDDSPPFI

SEQ ID NO: 1103710 - protein, 9 aa, Homo Sapiens
SALLSPASS

SEQ ID NO: 1103711 - protein, 9 aa, Homo Sapiens
ANGNLSKAS

SEQ ID NO: 1103712 - protein, 9 aa, Homo Sapiens
IQRPIQVQT

SEQ ID NO: 1103713 - protein, 9 aa, Homo Sapiens
PKTGASSCL

SEQ ID NO: 1103714 - protein, 9 aa, Homo Sapiens
FDCSHSMAA

SEQ ID NO: 1103715 - protein, 9 aa, Homo Sapiens
EVDTKVNST

SEQ ID NO: 1103716 - protein, 9 aa, Homo Sapiens
VAELPVACE

SEQ ID NO: 1103717 - protein, 9 aa, Homo Sapiens
VQKADSRHY

SEQ ID NO: 1103718 - protein, 9 aa, Homo Sapiens
KCPLGMAPA

SEQ ID NO: 1103719 - protein, 9 aa, Homo Sapiens
NLIQVGHFL

SEQ ID NO: 1103720 - protein, 9 aa, Homo Sapiens
YASTDMDHV

SEQ ID NO: 1103721 - protein, 9 aa, Homo Sapiens
AFKKSKKSS

SEQ ID NO: 1103722 - protein, 9 aa, Homo Sapiens
PRSWPRPPC

SEQ ID NO: 1103723 - protein, 9 aa, Homo Sapiens
LPEPASGVG

SEQ ID NO: 1103724 - protein, 9 aa, Homo Sapiens
HQALAQAQG

SEQ ID NO: 1103725 - protein, 9 aa, Homo Sapiens
RGSHIWPKG

SEQ ID NO: 1103726 - protein, 9 aa, Homo Sapiens
DKVSIATPE

SEQ ID NO: 1103727 - protein, 9 aa, Homo Sapiens
FTHCRPHWT

SEQ ID NO: 1103728 - protein, 9 aa, Homo Sapiens
RAARETRSG

SEQ ID NO: 1103729 - protein, 9 aa, Homo Sapiens
RGHRKGQRR

SEQ ID NO: 1103730 - protein, 9 aa, Homo Sapiens
RDALFESPL

SEQ ID NO: 1103731 - protein, 9 aa, Homo Sapiens
DDQIQWPTV

SEQ ID NO: 1103732 - protein, 9 aa, Homo Sapiens
AQRVGETRA

SEQ ID NO: 1103733 - protein, 9 aa, Homo Sapiens
HWGALMDSQ

SEQ ID NO: 1103734 - protein, 9 aa, Homo Sapiens
ENNLGANNY

SEQ ID NO: 1103735 - protein, 9 aa, Homo Sapiens
RYLTYRLCT

SEQ ID NO: 1103736 - protein, 9 aa, Homo Sapiens
PPPLLFLGP

SEQ ID NO: 1103737 - protein, 9 aa, Homo Sapiens
SLGTTPFSS

SEQ ID NO: 1103738 - protein, 9 aa, Homo Sapiens
HKRIRTAEK

SEQ ID NO: 1103739 - protein, 9 aa, Homo Sapiens
SSSLGTTPF

SEQ ID NO: 1103740 - protein, 9 aa, Homo Sapiens
GEPWRAGFQ

SEQ ID NO: 1103741 - protein, 9 aa, Homo Sapiens
CPPMPTRRS

SEQ ID NO: 1103742 - protein, 9 aa, Homo Sapiens
AKFPFNQWC

SEQ ID NO: 1103743 - protein, 9 aa, Homo Sapiens
LPKDLSLSK

SEQ ID NO: 1103744 - protein, 9 aa, Homo Sapiens
HTAVPPHEP

SEQ ID NO: 1103745 - protein, 9 aa, Homo Sapiens
LKYLRCKLS

SEQ ID NO: 1103746 - protein, 9 aa, Homo Sapiens
SFHHLAFNQ

SEQ ID NO: 1103747 - protein, 9 aa, Homo Sapiens
WDPDHYGTT

SEQ ID NO: 1103748 - protein, 9 aa, Homo Sapiens
KNKENQKEQ

SEQ ID NO: 1103749 - protein, 9 aa, Homo Sapiens
ARAAQRKSQ

SEQ ID NO: 1103750 - protein, 9 aa, Homo Sapiens
LACIAAFFV

SEQ ID NO: 1103751 - protein, 9 aa, Homo Sapiens
TQPSAARTP

SEQ ID NO: 1103752 - protein, 9 aa, Homo Sapiens
RCCLRTSCG

SEQ ID NO: 1103753 - protein, 9 aa, Homo Sapiens
THVTLQQVI

SEQ ID NO: 1103754 - protein, 9 aa, Homo Sapiens
AWGILLMIL

SEQ ID NO: 1103755 - protein, 9 aa, Homo Sapiens
QAGGPPRSR

SEQ ID NO: 1103756 - protein, 9 aa, Homo Sapiens
LTRGPRNIQ

SEQ ID NO: 1103757 - protein, 9 aa, Homo Sapiens
GAVYTRHAL

SEQ ID NO: 1103758 - protein, 9 aa, Homo Sapiens
QLTQLSISC

SEQ ID NO: 1103759 - protein, 9 aa, Homo Sapiens
RDSLDQFSN

SEQ ID NO: 1103760 - protein, 9 aa, Homo Sapiens
TSLPLSSSP

SEQ ID NO: 1103761 - protein, 9 aa, Homo Sapiens
DFLTLRHLM

SEQ ID NO: 1103762 - protein, 9 aa, Homo Sapiens
RRHGKAEEQ

SEQ ID NO: 1103763 - protein, 9 aa, Homo Sapiens
KPAVHDGAA

SEQ ID NO: 1103764 - protein, 9 aa, Homo Sapiens
HSPSCSPSP

SEQ ID NO: 1103765 - protein, 9 aa, Homo Sapiens
GEADLADGA

SEQ ID NO: 1103766 - protein, 9 aa, Homo Sapiens
QVGLQIWVL

SEQ ID NO: 1103767 - protein, 9 aa, Homo Sapiens
ARKDGPPRI

SEQ ID NO: 1103768 - protein, 9 aa, Homo Sapiens
PPIRRVSPG

SEQ ID NO: 1103769 - protein, 9 aa, Homo Sapiens
HGSGPGAHR

SEQ ID NO: 1103770 - protein, 9 aa, Homo Sapiens
RFPGARSHW

SEQ ID NO: 1103771 - protein, 9 aa, Homo Sapiens
QSSAHQKTP

SEQ ID NO: 1103772 - protein, 9 aa, Homo Sapiens
QLETPRHVS

SEQ ID NO: 1103773 - protein, 9 aa, Homo Sapiens
PCALWTAGS

SEQ ID NO: 1103774 - protein, 9 aa, Homo Sapiens
TCLEKTAKE

SEQ ID NO: 1103775 - protein, 9 aa, Homo Sapiens
YPVVLPPET

SEQ ID NO: 1103776 - protein, 9 aa, Homo Sapiens
MDISPLCFS

SEQ ID NO: 1103777 - protein, 9 aa, Homo Sapiens
IPAPLEKTA

SEQ ID NO: 1103778 - protein, 9 aa, Homo Sapiens
TIYIVGGVS

SEQ ID NO: 1103779 - protein, 9 aa, Homo Sapiens
FWPDHFLEP

SEQ ID NO: 1103780 - protein, 9 aa, Homo Sapiens
KRIRTAEKF

SEQ ID NO: 1103781 - protein, 9 aa, Homo Sapiens
HPCSTSVMT

SEQ ID NO: 1103782 - protein, 9 aa, Homo Sapiens
SRSHLDFSP

SEQ ID NO: 1103783 - protein, 9 aa, Homo Sapiens
FFFLFPLGY

SEQ ID NO: 1103784 - protein, 9 aa, Homo Sapiens
APPWAAASE

SEQ ID NO: 1103785 - protein, 9 aa, Homo Sapiens
TVLFHCQKG

SEQ ID NO: 1103786 - protein, 9 aa, Homo Sapiens
LCACPMDKY

SEQ ID NO: 1103787 - protein, 9 aa, Homo Sapiens
RPLKKWPTP

SEQ ID NO: 1103788 - protein, 9 aa, Homo Sapiens
PSWQYQHIH

SEQ ID NO: 1103789 - protein, 9 aa, Homo Sapiens
VQPILILQD

SEQ ID NO: 1103790 - protein, 9 aa, Homo Sapiens
FGSFKLEHS

SEQ ID NO: 1103791 - protein, 9 aa, Homo Sapiens
KMESRTLGT

SEQ ID NO: 1103792 - protein, 9 aa, Homo Sapiens
ASRGGPGCL

SEQ ID NO: 1103793 - protein, 9 aa, Homo Sapiens
CEGALEPHT

SEQ ID NO: 1103794 - protein, 9 aa, Homo Sapiens
EDDILPPPS

SEQ ID NO: 1103795 - protein, 9 aa, Homo Sapiens
PRRGTSVLG

SEQ ID NO: 1103796 - protein, 9 aa, Homo Sapiens
GLGTAQLKE

SEQ ID NO: 1103797 - protein, 9 aa, Homo Sapiens
YVFPDMVFE

SEQ ID NO: 1103798 - protein, 9 aa, Homo Sapiens
MSELKMVTS

SEQ ID NO: 1103799 - protein, 9 aa, Homo Sapiens
FRSLELCNT

SEQ ID NO: 1103800 - protein, 9 aa, Homo Sapiens
YRKPLELFG

SEQ ID NO: 1103801 - protein, 9 aa, Homo Sapiens
SVTASCAST

SEQ ID NO: 1103802 - protein, 9 aa, Homo Sapiens
SCASPPCAA

SEQ ID NO: 1103803 - protein, 9 aa, Homo Sapiens
PHDDFVADG

SEQ ID NO: 1103804 - protein, 9 aa, Homo Sapiens
IPIKSYVFL

SEQ ID NO: 1103805 - protein, 9 aa, Homo Sapiens
NGNALPPTE

SEQ ID NO: 1103806 - protein, 9 aa, Homo Sapiens
SVDPTWISE

SEQ ID NO: 1103807 - protein, 9 aa, Homo Sapiens
YHKQHGVQE

SEQ ID NO: 1103808 - protein, 9 aa, Homo Sapiens
EITVSCAVA

SEQ ID NO: 1103809 - protein, 9 aa, Homo Sapiens
LMDPKILKF

SEQ ID NO: 1103810 - protein, 9 aa, Homo Sapiens
GYYSASGTT

SEQ ID NO: 1103811 - protein, 9 aa, Homo Sapiens
GTRRYRPRG

SEQ ID NO: 1103812 - protein, 9 aa, Homo Sapiens
HSGSFVPNN

SEQ ID NO: 1103813 - protein, 9 aa, Homo Sapiens
CGTFHHKFG

SEQ ID NO: 1103814 - protein, 9 aa, Homo Sapiens
FHSTILQVS

SEQ ID NO: 1103815 - protein, 9 aa, Homo Sapiens
TSKDFSHRL

SEQ ID NO: 1103816 - protein, 9 aa, Homo Sapiens
EQTALYRGG

SEQ ID NO: 1103817 - protein, 9 aa, Homo Sapiens
LFKLIVNLL

SEQ ID NO: 1103818 - protein, 9 aa, Homo Sapiens
GQGIRGTIS

SEQ ID NO: 1103819 - protein, 9 aa, Homo Sapiens
AICSGFFCN

SEQ ID NO: 1103820 - protein, 9 aa, Homo Sapiens
TISCNDCIS

SEQ ID NO: 1103821 - protein, 9 aa, Homo Sapiens
RMAMKGAGT

SEQ ID NO: 1103822 - protein, 9 aa, Homo Sapiens
TAGRGWLPQ

SEQ ID NO: 1103823 - protein, 9 aa, Homo Sapiens
QQVGVIQCP

SEQ ID NO: 1103824 - protein, 9 aa, Homo Sapiens
TRSQRARGS

SEQ ID NO: 1103825 - protein, 9 aa, Homo Sapiens
DLDTDANGQ

SEQ ID NO: 1103826 - protein, 9 aa, Homo Sapiens
GATAQIQRP

SEQ ID NO: 1103827 - protein, 9 aa, Homo Sapiens
NAGGRREPV

SEQ ID NO: 1103828 - protein, 9 aa, Homo Sapiens
TKTTTSTDV

SEQ ID NO: 1103829 - protein, 9 aa, Homo Sapiens
STTCTMTPV

SEQ ID NO: 1103830 - protein, 9 aa, Homo Sapiens
PHFERLLLQ

SEQ ID NO: 1103831 - protein, 9 aa, Homo Sapiens
HVEALGRAA

SEQ ID NO: 1103832 - protein, 9 aa, Homo Sapiens
LMVTESSRG

SEQ ID NO: 1103833 - protein, 9 aa, Homo Sapiens
AGRGRASQT

SEQ ID NO: 1103834 - protein, 9 aa, Homo Sapiens
SLLLLPEGI

SEQ ID NO: 1103835 - protein, 9 aa, Homo Sapiens
DSVVEIRMA

SEQ ID NO: 1103836 - protein, 9 aa, Homo Sapiens
HQSAPPIRR

SEQ ID NO: 1103837 - protein, 9 aa, Homo Sapiens
KADKATKVG

SEQ ID NO: 1103838 - protein, 9 aa, Homo Sapiens
LLSPASSME

SEQ ID NO: 1103839 - protein, 9 aa, Homo Sapiens
AYAEQNGAT

SEQ ID NO: 1103840 - protein, 9 aa, Homo Sapiens
RLTQVTKEE

SEQ ID NO: 1103841 - protein, 9 aa, Homo Sapiens
PVAADLRPK

SEQ ID NO: 1103842 - protein, 9 aa, Homo Sapiens
LIRVASILG

SEQ ID NO: 1103843 - protein, 9 aa, Homo Sapiens
IFVYKEFSR

SEQ ID NO: 1103844 - protein, 9 aa, Homo Sapiens
GIPRVDALK

SEQ ID NO: 1103845 - protein, 9 aa, Homo Sapiens
LVLGIAGSG

SEQ ID NO: 1103846 - protein, 9 aa, Homo Sapiens
AAFWTELTA

SEQ ID NO: 1103847 - protein, 9 aa, Homo Sapiens
FHGKFYETD

SEQ ID NO: 1103848 - protein, 9 aa, Homo Sapiens
LTFILLQLK

SEQ ID NO: 1103849 - protein, 9 aa, Homo Sapiens
ISNPKRLGT

SEQ ID NO: 1103850 - protein, 9 aa, Homo Sapiens
APSSKATEN

SEQ ID NO: 1103851 - protein, 9 aa, Homo Sapiens
PAAPAAMRA

SEQ ID NO: 1103852 - protein, 9 aa, Homo Sapiens
NKENQKEQT

SEQ ID NO: 1103853 - protein, 9 aa, Homo Sapiens
RWSTISCPR

SEQ ID NO: 1103854 - protein, 9 aa, Homo Sapiens
VKIFDVCNG

SEQ ID NO: 1103855 - protein, 9 aa, Homo Sapiens
LVLPGEADL

SEQ ID NO: 1103856 - protein, 9 aa, Homo Sapiens
VHPKTYPVV

SEQ ID NO: 1103857 - protein, 9 aa, Homo Sapiens
ADGSASCIR

SEQ ID NO: 1103858 - protein, 9 aa, Homo Sapiens
RRCCRVGKS

SEQ ID NO: 1103859 - protein, 9 aa, Homo Sapiens
QSAGTTSPW

SEQ ID NO: 1103860 - protein, 9 aa, Homo Sapiens
SSSLPKAIM

SEQ ID NO: 1103861 - protein, 9 aa, Homo Sapiens
AELRDHRCI

SEQ ID NO: 1103862 - protein, 9 aa, Homo Sapiens
STSWPSLML

SEQ ID NO: 1103863 - protein, 9 aa, Homo Sapiens
LLRLGSRWC

SEQ ID NO: 1103864 - protein, 9 aa, Homo Sapiens
SAVPMWSCI

SEQ ID NO: 1103865 - protein, 9 aa, Homo Sapiens
LQPTSMWAH

SEQ ID NO: 1103866 - protein, 9 aa, Homo Sapiens
GSGGNERYF

SEQ ID NO: 1103867 - protein, 9 aa, Homo Sapiens
AFIFFSLSS

SEQ ID NO: 1103868 - protein, 9 aa, Homo Sapiens
AQPKTAGAA

SEQ ID NO: 1103869 - protein, 9 aa, Homo Sapiens
SHTGYHTTD

SEQ ID NO: 1103870 - protein, 9 aa, Homo Sapiens
QVFAFLKGL

SEQ ID NO: 1103871 - protein, 9 aa, Homo Sapiens
GRGWLPQQG

SEQ ID NO: 1103872 - protein, 9 aa, Homo Sapiens
RGWRARKAT

SEQ ID NO: 1103873 - protein, 9 aa, Homo Sapiens
FISEHWLVR

SEQ ID NO: 1103874 - protein, 9 aa, Homo Sapiens
GALEPHTHH

SEQ ID NO: 1103875 - protein, 9 aa, Homo Sapiens
VGLQIWVLT

SEQ ID NO: 1103876 - protein, 9 aa, Homo Sapiens
FACQDCGRH

SEQ ID NO: 1103877 - protein, 9 aa, Homo Sapiens
IGCCYSSEE

SEQ ID NO: 1103878 - protein, 9 aa, Homo Sapiens
KNGGNLQPT

SEQ ID NO: 1103879 - protein, 9 aa, Homo Sapiens
LFHCQKGYL

SEQ ID NO: 1103880 - protein, 9 aa, Homo Sapiens
PRSSAQGVS

SEQ ID NO: 1103881 - protein, 9 aa, Homo Sapiens
HPPEGTRPS

SEQ ID NO: 1103882 - protein, 9 aa, Homo Sapiens
LSLRKTQAQ

SEQ ID NO: 1103883 - protein, 9 aa, Homo Sapiens
RMGMTGLVL

SEQ ID NO: 1103884 - protein, 9 aa, Homo Sapiens
TTTSTECSE

SEQ ID NO: 1103885 - protein, 9 aa, Homo Sapiens
YRPRGARRV

SEQ ID NO: 1103886 - protein, 9 aa, Homo Sapiens
PRVLLRFLP

SEQ ID NO: 1103887 - protein, 9 aa, Homo Sapiens
KQELANSLD

SEQ ID NO: 1103888 - protein, 9 aa, Homo Sapiens
GNSLPQGAG

SEQ ID NO: 1103889 - protein, 9 aa, Homo Sapiens
PAYYPYSQF

SEQ ID NO: 1103890 - protein, 9 aa, Homo Sapiens
DYYRRAASN

SEQ ID NO: 1103891 - protein, 9 aa, Homo Sapiens
PTPCASTAK

SEQ ID NO: 1103892 - protein, 9 aa, Homo Sapiens
AEPPGSYAV

SEQ ID NO: 1103893 - protein, 9 aa, Homo Sapiens
AHPLDGGRH

SEQ ID NO: 1103894 - protein, 9 aa, Homo Sapiens
PAGPPPGGR

SEQ ID NO: 1103895 - protein, 9 aa, Homo Sapiens
CPQTRRSPC

SEQ ID NO: 1103896 - protein, 9 aa, Homo Sapiens
EEIDGEITV

SEQ ID NO: 1103897 - protein, 9 aa, Homo Sapiens
EKWRNRLYE

SEQ ID NO: 1103898 - protein, 9 aa, Homo Sapiens
WAPSRSTCP

SEQ ID NO: 1103899 - protein, 9 aa, Homo Sapiens
TLGENVFSS

SEQ ID NO: 1103900 - protein, 9 aa, Homo Sapiens
TDYTWSFDD

SEQ ID NO: 1103901 - protein, 9 aa, Homo Sapiens
LQMQLKALD

SEQ ID NO: 1103902 - protein, 9 aa, Homo Sapiens
VNMGGNRSI

SEQ ID NO: 1103903 - protein, 9 aa, Homo Sapiens
GRLRLRSDL

SEQ ID NO: 1103904 - protein, 9 aa, Homo Sapiens
RARPPPTYP

SEQ ID NO: 1103905 - protein, 9 aa, Homo Sapiens
TAAGIAAIG

SEQ ID NO: 1103906 - protein, 9 aa, Homo Sapiens
EQAASEDVD

SEQ ID NO: 1103907 - protein, 9 aa, Homo Sapiens
EAFALPNSL

SEQ ID NO: 1103908 - protein, 9 aa, Homo Sapiens
PVSHSLRGE

SEQ ID NO: 1103909 - protein, 9 aa, Homo Sapiens
LVAELQCSF

SEQ ID NO: 1103910 - protein, 9 aa, Homo Sapiens
APGVQPPAP

SEQ ID NO: 1103911 - protein, 9 aa, Homo Sapiens
CPPLLALVG

SEQ ID NO: 1103912 - protein, 9 aa, Homo Sapiens
AAPPAAAPR

SEQ ID NO: 1103913 - protein, 9 aa, Homo Sapiens
PRASCASPP

SEQ ID NO: 1103914 - protein, 9 aa, Homo Sapiens
PTTVGNGHM

SEQ ID NO: 1103915 - protein, 9 aa, Homo Sapiens
KRVNTAWKT

SEQ ID NO: 1103916 - protein, 9 aa, Homo Sapiens
IEVARMWTP

SEQ ID NO: 1103917 - protein, 9 aa, Homo Sapiens
LRLASANVD

SEQ ID NO: 1103918 - protein, 9 aa, Homo Sapiens
SFSHAPPVA

SEQ ID NO: 1103919 - protein, 9 aa, Homo Sapiens
IPECPSGYM

SEQ ID NO: 1103920 - protein, 9 aa, Homo Sapiens
PGEKGNSGR

SEQ ID NO: 1103921 - protein, 9 aa, Homo Sapiens
PLLGDQLVG

SEQ ID NO: 1103922 - protein, 9 aa, Homo Sapiens
GAVQESWPG

SEQ ID NO: 1103923 - protein, 9 aa, Homo Sapiens
GLQSDKECT

SEQ ID NO: 1103924 - protein, 9 aa, Homo Sapiens
PALRLLCPP

SEQ ID NO: 1103925 - protein, 9 aa, Homo Sapiens
SSREWKVKF

SEQ ID NO: 1103926 - protein, 9 aa, Homo Sapiens
KEEKCPLGM

SEQ ID NO: 1103927 - protein, 9 aa, Homo Sapiens
LTHKQNYMM

SEQ ID NO: 1103928 - protein, 9 aa, Homo Sapiens
LWARARAAT

SEQ ID NO: 1103929 - protein, 9 aa, Homo Sapiens
KAAPWREAS

SEQ ID NO: 1103930 - protein, 9 aa, Homo Sapiens
DVARPLLEF

SEQ ID NO: 1103931 - protein, 9 aa, Homo Sapiens
GFLQREDLL

SEQ ID NO: 1103932 - protein, 9 aa, Homo Sapiens
SWWWTQATP

SEQ ID NO: 1103933 - protein, 9 aa, Homo Sapiens
RLRYPSQRE

SEQ ID NO: 1103934 - protein, 9 aa, Homo Sapiens
CFLYILTSM

SEQ ID NO: 1103935 - protein, 9 aa, Homo Sapiens
CWPSTSAFK

SEQ ID NO: 1103936 - protein, 9 aa, Homo Sapiens
RGTISCEHP

SEQ ID NO: 1103937 - protein, 9 aa, Homo Sapiens
WLPQQGRPA

SEQ ID NO: 1103938 - protein, 9 aa, Homo Sapiens
YCSTRQTSM

SEQ ID NO: 1103939 - protein, 9 aa, Homo Sapiens
RGFRSGAKP

SEQ ID NO: 1103940 - protein, 9 aa, Homo Sapiens
AVVWPSVPS

SEQ ID NO: 1103941 - protein, 9 aa, Homo Sapiens
HRGAHLNNF

SEQ ID NO: 1103942 - protein, 9 aa, Homo Sapiens
LTVLGQPGV

SEQ ID NO: 1103943 - protein, 9 aa, Homo Sapiens
SMPFTKNPE

SEQ ID NO: 1103944 - protein, 9 aa, Homo Sapiens
REKRPAKQP

SEQ ID NO: 1103945 - protein, 9 aa, Homo Sapiens
EAFISEHWL

SEQ ID NO: 1103946 - protein, 9 aa, Homo Sapiens
ATPSWVWCM

SEQ ID NO: 1103947 - protein, 9 aa, Homo Sapiens
SPSRCGSAT

SEQ ID NO: 1103948 - protein, 9 aa, Homo Sapiens
LPRSLPRVL

SEQ ID NO: 1103949 - protein, 9 aa, Homo Sapiens
WAAVAAGGA

SEQ ID NO: 1103950 - protein, 9 aa, Homo Sapiens
VVNQEILNT

SEQ ID NO: 1103951 - protein, 9 aa, Homo Sapiens
LVLDANDNL

SEQ ID NO: 1103952 - protein, 9 aa, Homo Sapiens
CAWYLCSSA

SEQ ID NO: 1103953 - protein, 9 aa, Homo Sapiens
LLTRVATVD

SEQ ID NO: 1103954 - protein, 9 aa, Homo Sapiens
LSVSLLGRF

SEQ ID NO: 1103955 - protein, 9 aa, Homo Sapiens
VALFKGARE

SEQ ID NO: 1103956 - protein, 9 aa, Homo Sapiens
TGADDWETD

SEQ ID NO: 1103957 - protein, 9 aa, Homo Sapiens
HLGLLQGRG

SEQ ID NO: 1103958 - protein, 9 aa, Homo Sapiens
TPQDPETSV

SEQ ID NO: 1103959 - protein, 9 aa, Homo Sapiens
GAARGCSPA

SEQ ID NO: 1103960 - protein, 9 aa, Homo Sapiens
GPKRAVPGS

SEQ ID NO: 1103961 - protein, 9 aa, Homo Sapiens
VISLFSAEM

SEQ ID NO: 1103962 - protein, 9 aa, Homo Sapiens
EAMHRERNR

SEQ ID NO: 1103963 - protein, 9 aa, Homo Sapiens
GGQRCRCVC

SEQ ID NO: 1103964 - protein, 9 aa, Homo Sapiens
LHGGASVPR

SEQ ID NO: 1103965 - protein, 9 aa, Homo Sapiens
LPWGYRCEG

SEQ ID NO: 1103966 - protein, 9 aa, Homo Sapiens
APTATLGPL

SEQ ID NO: 1103967 - protein, 9 aa, Homo Sapiens
LQVPHNAGL

SEQ ID NO: 1103968 - protein, 9 aa, Homo Sapiens
SLSVSLLGR

SEQ ID NO: 1103969 - protein, 9 aa, Homo Sapiens
AAVWASVAA

SEQ ID NO: 1103970 - protein, 9 aa, Homo Sapiens
SDFITPLHS

SEQ ID NO: 1103971 - protein, 9 aa, Homo Sapiens
GHAGASLFL

SEQ ID NO: 1103972 - protein, 9 aa, Homo Sapiens
YCLMQLGCL

SEQ ID NO: 1103973 - protein, 9 aa, Homo Sapiens
YLKKRKQLL

SEQ ID NO: 1103974 - protein, 9 aa, Homo Sapiens
RSSSRTACG

SEQ ID NO: 1103975 - protein, 9 aa, Homo Sapiens
QVWNALCRP

SEQ ID NO: 1103976 - protein, 9 aa, Homo Sapiens
LGIAGSGKT

SEQ ID NO: 1103977 - protein, 9 aa, Homo Sapiens
PDPPPRPGT

SEQ ID NO: 1103978 - protein, 9 aa, Homo Sapiens
AAEPPGSYA

SEQ ID NO: 1103979 - protein, 9 aa, Homo Sapiens
NIGAGRPIK

SEQ ID NO: 1103980 - protein, 9 aa, Homo Sapiens
LLSTAKSKP

SEQ ID NO: 1103981 - protein, 9 aa, Homo Sapiens
MQMLGGALG

SEQ ID NO: 1103982 - protein, 9 aa, Homo Sapiens
IDYDWDRFD

SEQ ID NO: 1103983 - protein, 9 aa, Homo Sapiens
LIVNLLCPV

SEQ ID NO: 1103984 - protein, 9 aa, Homo Sapiens
WCVNPSRTP

SEQ ID NO: 1103985 - protein, 9 aa, Homo Sapiens
AFISEHWLV

SEQ ID NO: 1103986 - protein, 9 aa, Homo Sapiens
GKAFTSILR

SEQ ID NO: 1103987 - protein, 9 aa, Homo Sapiens
PQGEVITQQ

SEQ ID NO: 1103988 - protein, 9 aa, Homo Sapiens
ELQSHPRAS

SEQ ID NO: 1103989 - protein, 9 aa, Homo Sapiens
MPIAINRMP

SEQ ID NO: 1103990 - protein, 9 aa, Homo Sapiens
TLEILILDT

SEQ ID NO: 1103991 - protein, 9 aa, Homo Sapiens
WQVMASLTG

SEQ ID NO: 1103992 - protein, 9 aa, Homo Sapiens
VNKNKNGGN

SEQ ID NO: 1103993 - protein, 9 aa, Homo Sapiens
GPGWEEASQ

SEQ ID NO: 1103994 - protein, 9 aa, Homo Sapiens
LTQVNKNKN

SEQ ID NO: 1103995 - protein, 9 aa, Homo Sapiens
PGACHAHKA

SEQ ID NO: 1103996 - protein, 9 aa, Homo Sapiens
LLVLGIAGS

SEQ ID NO: 1103997 - protein, 9 aa, Homo Sapiens
EMDGEQPSS

SEQ ID NO: 1103998 - protein, 9 aa, Homo Sapiens
PGWLPRLTR

SEQ ID NO: 1103999 - protein, 9 aa, Homo Sapiens
ALRLLCPPV

SEQ ID NO: 1104000 - protein, 9 aa, Homo Sapiens
CGRCPQVLS

SEQ ID NO: 1104001 - protein, 9 aa, Homo Sapiens
LFRLFLQQN

SEQ ID NO: 1104002 - protein, 9 aa, Homo Sapiens
FFFFVWFGL

SEQ ID NO: 1104003 - protein, 9 aa, Homo Sapiens
AAAAARNPK

SEQ ID NO: 1104004 - protein, 9 aa, Homo Sapiens
EEQRQRRRQ

SEQ ID NO: 1104005 - protein, 9 aa, Homo Sapiens
ELLLRAGVN

SEQ ID NO: 1104006 - protein, 9 aa, Homo Sapiens
NMNIMSELK

SEQ ID NO: 1104007 - protein, 9 aa, Homo Sapiens
GYMMNSSNL

SEQ ID NO: 1104008 - protein, 9 aa, Homo Sapiens
LTVKRHGLY

SEQ ID NO: 1104009 - protein, 9 aa, Homo Sapiens
FCWPSGTRS

SEQ ID NO: 1104010 - protein, 9 aa, Homo Sapiens
CVNDYTWGA

SEQ ID NO: 1104011 - protein, 9 aa, Homo Sapiens
RRCGLTSMP

SEQ ID NO: 1104012 - protein, 9 aa, Homo Sapiens
DPTERELRM

SEQ ID NO: 1104013 - protein, 9 aa, Homo Sapiens
YILVKNHVK

SEQ ID NO: 1104014 - protein, 9 aa, Homo Sapiens
PCASLLSTL

SEQ ID NO: 1104015 - protein, 9 aa, Homo Sapiens
SCFVWKQAT

SEQ ID NO: 1104016 - protein, 9 aa, Homo Sapiens
QDLCPGASV

SEQ ID NO: 1104017 - protein, 9 aa, Homo Sapiens
DGRLDVFLH

SEQ ID NO: 1104018 - protein, 9 aa, Homo Sapiens
LALPPRGPR

SEQ ID NO: 1104019 - protein, 9 aa, Homo Sapiens
VVREDLLLG

SEQ ID NO: 1104020 - protein, 9 aa, Homo Sapiens
WLLPLPGPA

SEQ ID NO: 1104021 - protein, 9 aa, Homo Sapiens
NPSDGNNTF

SEQ ID NO: 1104022 - protein, 9 aa, Homo Sapiens
VARFTRSGG

SEQ ID NO: 1104023 - protein, 9 aa, Homo Sapiens
KAKGEEKPT

SEQ ID NO: 1104024 - protein, 9 aa, Homo Sapiens
LTTHKRIRT

SEQ ID NO: 1104025 - protein, 9 aa, Homo Sapiens
SSAPKTREQ

SEQ ID NO: 1104026 - protein, 9 aa, Homo Sapiens
THLPSAPAA

SEQ ID NO: 1104027 - protein, 9 aa, Homo Sapiens
EILNTNSIS

SEQ ID NO: 1104028 - protein, 9 aa, Homo Sapiens
SRGCGGSFP

SEQ ID NO: 1104029 - protein, 9 aa, Homo Sapiens
PYRDDCKEG

SEQ ID NO: 1104030 - protein, 9 aa, Homo Sapiens
MRPGTRHPI

SEQ ID NO: 1104031 - protein, 9 aa, Homo Sapiens
ISPLCFSIL

SEQ ID NO: 1104032 - protein, 9 aa, Homo Sapiens
ATQNDKLAF

SEQ ID NO: 1104033 - protein, 9 aa, Homo Sapiens
EYYPLLSTC

SEQ ID NO: 1104034 - protein, 9 aa, Homo Sapiens
AKQHITLND

SEQ ID NO: 1104035 - protein, 9 aa, Homo Sapiens
TPSPASGST

SEQ ID NO: 1104036 - protein, 9 aa, Homo Sapiens
TSLGLLPWA

SEQ ID NO: 1104037 - protein, 9 aa, Homo Sapiens
AHGKAAPWR

SEQ ID NO: 1104038 - protein, 9 aa, Homo Sapiens
HPQWAPHSA

SEQ ID NO: 1104039 - protein, 9 aa, Homo Sapiens
GAWAAAAAG

SEQ ID NO: 1104040 - protein, 9 aa, Homo Sapiens
CIVPSEVEP

SEQ ID NO: 1104041 - protein, 9 aa, Homo Sapiens
DLLLCFQRL

SEQ ID NO: 1104042 - protein, 9 aa, Homo Sapiens
GYPKEGRKY

SEQ ID NO: 1104043 - protein, 9 aa, Homo Sapiens
LLQMFGLCR

SEQ ID NO: 1104044 - protein, 9 aa, Homo Sapiens
GKDGPESTF

SEQ ID NO: 1104045 - protein, 9 aa, Homo Sapiens
ISTTRYVAS

SEQ ID NO: 1104046 - protein, 9 aa, Homo Sapiens
DWVWDGYPP

SEQ ID NO: 1104047 - protein, 9 aa, Homo Sapiens
HAPVRTPSI

SEQ ID NO: 1104048 - protein, 9 aa, Homo Sapiens
GMEALGSWG

SEQ ID NO: 1104049 - protein, 9 aa, Homo Sapiens
LEIFYLKKR

SEQ ID NO: 1104050 - protein, 9 aa, Homo Sapiens
PTLWTLCSS

SEQ ID NO: 1104051 - protein, 9 aa, Homo Sapiens
SMAAQILKQ

SEQ ID NO: 1104052 - protein, 9 aa, Homo Sapiens
HCTRQFQAQ

SEQ ID NO: 1104053 - protein, 9 aa, Homo Sapiens
ESYFRLDMP

SEQ ID NO: 1104054 - protein, 9 aa, Homo Sapiens
DVAALLMEG

SEQ ID NO: 1104055 - protein, 9 aa, Homo Sapiens
GVPGKTSLK

SEQ ID NO: 1104056 - protein, 9 aa, Homo Sapiens
PESKPEEAS

SEQ ID NO: 1104057 - protein, 9 aa, Homo Sapiens
EEGAGRQHH

SEQ ID NO: 1104058 - protein, 9 aa, Homo Sapiens
DFFSRSHLD

SEQ ID NO: 1104059 - protein, 9 aa, Homo Sapiens
PLAVASWVS

SEQ ID NO: 1104060 - protein, 9 aa, Homo Sapiens
CLVFFFFVW

SEQ ID NO: 1104061 - protein, 9 aa, Homo Sapiens
GELLNPMGT

SEQ ID NO: 1104062 - protein, 9 aa, Homo Sapiens
INHSLLALG

SEQ ID NO: 1104063 - protein, 9 aa, Homo Sapiens
HQQHQHQQQ

SEQ ID NO: 1104064 - protein, 9 aa, Homo Sapiens
NKKTHPCTM

SEQ ID NO: 1104065 - protein, 9 aa, Homo Sapiens
ILILQDGDV

SEQ ID NO: 1104066 - protein, 9 aa, Homo Sapiens
CMQMLGGAL

SEQ ID NO: 1104067 - protein, 9 aa, Homo Sapiens
VIPLQAGQV

SEQ ID NO: 1104068 - protein, 9 aa, Homo Sapiens
SCPFQSPTK

SEQ ID NO: 1104069 - protein, 9 aa, Homo Sapiens
HTLITVATA

SEQ ID NO: 1104070 - protein, 9 aa, Homo Sapiens
HNPRHQTSV

SEQ ID NO: 1104071 - protein, 9 aa, Homo Sapiens
QCGATCERA

SEQ ID NO: 1104072 - protein, 9 aa, Homo Sapiens
VWPPPYHPK

SEQ ID NO: 1104073 - protein, 9 aa, Homo Sapiens
GVHQSVPYG

SEQ ID NO: 1104074 - protein, 9 aa, Homo Sapiens
LPASHGDTD

SEQ ID NO: 1104075 - protein, 9 aa, Homo Sapiens
RLCTGEDVA

SEQ ID NO: 1104076 - protein, 9 aa, Homo Sapiens
YIGRKKSRL

SEQ ID NO: 1104077 - protein, 9 aa, Homo Sapiens
LAELRILME

SEQ ID NO: 1104078 - protein, 9 aa, Homo Sapiens
MHNKHELTH

SEQ ID NO: 1104079 - protein, 9 aa, Homo Sapiens
GVGPFGSVA

SEQ ID NO: 1104080 - protein, 9 aa, Homo Sapiens
PQQHVLGAQ

SEQ ID NO: 1104081 - protein, 9 aa, Homo Sapiens
LTSIIVVIL

SEQ ID NO: 1104082 - protein, 9 aa, Homo Sapiens
GCVWCEGEH

SEQ ID NO: 1104083 - protein, 9 aa, Homo Sapiens
SQPKPAVHD

SEQ ID NO: 1104084 - protein, 9 aa, Homo Sapiens
CHLPLPWGW

SEQ ID NO: 1104085 - protein, 9 aa, Homo Sapiens
VPMGLLELC

SEQ ID NO: 1104086 - protein, 9 aa, Homo Sapiens
RQFRAGCVG

SEQ ID NO: 1104087 - protein, 9 aa, Homo Sapiens
LSQPPPQAP

SEQ ID NO: 1104088 - protein, 9 aa, Homo Sapiens
REGVHRQLC

SEQ ID NO: 1104089 - protein, 9 aa, Homo Sapiens
CDLRVSECE

SEQ ID NO: 1104090 - protein, 9 aa, Homo Sapiens
GPRPGSPRS

SEQ ID NO: 1104091 - protein, 9 aa, Homo Sapiens
CSSTPTCLR

SEQ ID NO: 1104092 - protein, 9 aa, Homo Sapiens
CGRGNHPKM

SEQ ID NO: 1104093 - protein, 9 aa, Homo Sapiens
VEAEASYLT

SEQ ID NO: 1104094 - protein, 9 aa, Homo Sapiens
YVWPVCLPN

SEQ ID NO: 1104095 - protein, 9 aa, Homo Sapiens
EGAAEPPGS

SEQ ID NO: 1104096 - protein, 9 aa, Homo Sapiens
HSVPEAEAG

SEQ ID NO: 1104097 - protein, 9 aa, Homo Sapiens
GKETLVTID

SEQ ID NO: 1104098 - protein, 9 aa, Homo Sapiens
DKKKGTPTE

SEQ ID NO: 1104099 - protein, 9 aa, Homo Sapiens
GGLDYLPSC

SEQ ID NO: 1104100 - protein, 9 aa, Homo Sapiens
VGLIPIKSY

SEQ ID NO: 1104101 - protein, 9 aa, Homo Sapiens
CSASRRTGL

SEQ ID NO: 1104102 - protein, 9 aa, Homo Sapiens
RPTGRTPTT

SEQ ID NO: 1104103 - protein, 9 aa, Homo Sapiens
HSAPKPRLE

SEQ ID NO: 1104104 - protein, 9 aa, Homo Sapiens
SQPDWMPPP

SEQ ID NO: 1104105 - protein, 9 aa, Homo Sapiens
RSKRKYRKF

SEQ ID NO: 1104106 - protein, 9 aa, Homo Sapiens
NLFCLYENI

SEQ ID NO: 1104107 - protein, 9 aa, Homo Sapiens
LPDHVDAPG

SEQ ID NO: 1104108 - protein, 9 aa, Homo Sapiens
LPCALWTAG

SEQ ID NO: 1104109 - protein, 9 aa, Homo Sapiens
GGTGLEGCR

SEQ ID NO: 1104110 - protein, 9 aa, Homo Sapiens
EEAFISEHW

SEQ ID NO: 1104111 - protein, 9 aa, Homo Sapiens
AAEFASCSL

SEQ ID NO: 1104112 - protein, 9 aa, Homo Sapiens
LRGLGLQLA

SEQ ID NO: 1104113 - protein, 9 aa, Homo Sapiens
GARNLTLVV

SEQ ID NO: 1104114 - protein, 9 aa, Homo Sapiens
TEEATVVLE

SEQ ID NO: 1104115 - protein, 9 aa, Homo Sapiens
LHHGGRQLR

SEQ ID NO: 1104116 - protein, 9 aa, Homo Sapiens
KSKDKKQKR

SEQ ID NO: 1104117 - protein, 9 aa, Homo Sapiens
GMCTNSSYG

SEQ ID NO: 1104118 - protein, 9 aa, Homo Sapiens
QPLCHWAVD

SEQ ID NO: 1104119 - protein, 9 aa, Homo Sapiens
VCCLTGSEE

SEQ ID NO: 1104120 - protein, 9 aa, Homo Sapiens
YWIAEGNEP

SEQ ID NO: 1104121 - protein, 9 aa, Homo Sapiens
LYNERGKEI

SEQ ID NO: 1104122 - protein, 9 aa, Homo Sapiens
APGQGHLCV

SEQ ID NO: 1104123 - protein, 9 aa, Homo Sapiens
AGFQWGESP

SEQ ID NO: 1104124 - protein, 9 aa, Homo Sapiens
GGFPLWWPA

SEQ ID NO: 1104125 - protein, 9 aa, Homo Sapiens
YGIDAYGYQ

SEQ ID NO: 1104126 - protein, 9 aa, Homo Sapiens
PHTEYKELS

SEQ ID NO: 1104127 - protein, 9 aa, Homo Sapiens
SIPRRTLQL

SEQ ID NO: 1104128 - protein, 9 aa, Homo Sapiens
GPPGEKGNS

SEQ ID NO: 1104129 - protein, 9 aa, Homo Sapiens
AGGTGLEGC

SEQ ID NO: 1104130 - protein, 9 aa, Homo Sapiens
GANGILGTP

SEQ ID NO: 1104131 - protein, 9 aa, Homo Sapiens
GILRLPCSG

SEQ ID NO: 1104132 - protein, 9 aa, Homo Sapiens
EMGTNFSGS

SEQ ID NO: 1104133 - protein, 9 aa, Homo Sapiens
ALPPRGPRA

SEQ ID NO: 1104134 - protein, 9 aa, Homo Sapiens
IAVLPDHRK

SEQ ID NO: 1104135 - protein, 9 aa, Homo Sapiens
CLMQLGCLE

SEQ ID NO: 1104136 - protein, 9 aa, Homo Sapiens
HGGRQLRVP

SEQ ID NO: 1104137 - protein, 9 aa, Homo Sapiens
RGEWRQGGS

SEQ ID NO: 1104138 - protein, 9 aa, Homo Sapiens
DIQQVGVIQ

SEQ ID NO: 1104139 - protein, 9 aa, Homo Sapiens
TPRIELTRM

SEQ ID NO: 1104140 - protein, 9 aa, Homo Sapiens
MTHTNREGV

SEQ ID NO: 1104141 - protein, 9 aa, Homo Sapiens
PPPPPGWLP

SEQ ID NO: 1104142 - protein, 9 aa, Homo Sapiens
ADLGNIRIW

SEQ ID NO: 1104143 - protein, 9 aa, Homo Sapiens
RCQSSPRIS

SEQ ID NO: 1104144 - protein, 9 aa, Homo Sapiens
PSAARAGGR

SEQ ID NO: 1104145 - protein, 9 aa, Homo Sapiens
MVDSLVNKE

SEQ ID NO: 1104146 - protein, 9 aa, Homo Sapiens
RSLAPTAAG

SEQ ID NO: 1104147 - protein, 9 aa, Homo Sapiens
LRTVKTKAT

SEQ ID NO: 1104148 - protein, 9 aa, Homo Sapiens
DFVVVDDVP

SEQ ID NO: 1104149 - protein, 9 aa, Homo Sapiens
DDTPCIWQP

SEQ ID NO: 1104150 - protein, 9 aa, Homo Sapiens
VEVVLTHKQ

SEQ ID NO: 1104151 - protein, 9 aa, Homo Sapiens
EPQGPSASA

SEQ ID NO: 1104152 - protein, 9 aa, Homo Sapiens
EKTAQPAPK

SEQ ID NO: 1104153 - protein, 9 aa, Homo Sapiens
FSSVISDCT

SEQ ID NO: 1104154 - protein, 9 aa, Homo Sapiens
RKKSRLPHQ

SEQ ID NO: 1104155 - protein, 9 aa, Homo Sapiens
VSTVHVTGN

SEQ ID NO: 1104156 - protein, 9 aa, Homo Sapiens
YLCNESCEK

SEQ ID NO: 1104157 - protein, 9 aa, Homo Sapiens
FALYMSASH

SEQ ID NO: 1104158 - protein, 9 aa, Homo Sapiens
PMPTRRSLA

SEQ ID NO: 1104159 - protein, 9 aa, Homo Sapiens
RREDQSLRR

SEQ ID NO: 1104160 - protein, 9 aa, Homo Sapiens
EQAGGPPRS

SEQ ID NO: 1104161 - protein, 9 aa, Homo Sapiens
ARPGPTTVG

SEQ ID NO: 1104162 - protein, 9 aa, Homo Sapiens
LARMGPPRK

SEQ ID NO: 1104163 - protein, 9 aa, Homo Sapiens
GTRVLKLSE

SEQ ID NO: 1104164 - protein, 9 aa, Homo Sapiens
QGVSSAPRP

SEQ ID NO: 1104165 - protein, 9 aa, Homo Sapiens
ASALPWGYR

SEQ ID NO: 1104166 - protein, 9 aa, Homo Sapiens
SSRTACGAA

SEQ ID NO: 1104167 - protein, 9 aa, Homo Sapiens
GCSPAGVGG

SEQ ID NO: 1104168 - protein, 9 aa, Homo Sapiens
SYDVQKCTI

SEQ ID NO: 1104169 - protein, 9 aa, Homo Sapiens
IRNCILEIV

SEQ ID NO: 1104170 - protein, 9 aa, Homo Sapiens
ATVDADDGE

SEQ ID NO: 1104171 - protein, 9 aa, Homo Sapiens
RRSGSGSGG

SEQ ID NO: 1104172 - protein, 9 aa, Homo Sapiens
TYTSKINIA

SEQ ID NO: 1104173 - protein, 9 aa, Homo Sapiens
EQAPPWAAA

SEQ ID NO: 1104174 - protein, 9 aa, Homo Sapiens
PCSWWWTQA

SEQ ID NO: 1104175 - protein, 9 aa, Homo Sapiens
VREIVQDFK

SEQ ID NO: 1104176 - protein, 9 aa, Homo Sapiens
QLPPAFPSR

SEQ ID NO: 1104177 - protein, 9 aa, Homo Sapiens
LTAHLLRLW

SEQ ID NO: 1104178 - protein, 9 aa, Homo Sapiens
VSSAPRPGA

SEQ ID NO: 1104179 - protein, 9 aa, Homo Sapiens
AEGQMGHPA

SEQ ID NO: 1104180 - protein, 9 aa, Homo Sapiens
EVSQPDWMP

SEQ ID NO: 1104181 - protein, 9 aa, Homo Sapiens
LVFGIEAVE

SEQ ID NO: 1104182 - protein, 9 aa, Homo Sapiens
GHLGLFLLH

SEQ ID NO: 1104183 - protein, 9 aa, Homo Sapiens
EVRGEWRQG

SEQ ID NO: 1104184 - protein, 9 aa, Homo Sapiens
SAPGLRGFQ

SEQ ID NO: 1104185 - protein, 9 aa, Homo Sapiens
LKNVGFSLM

SEQ ID NO: 1104186 - protein, 9 aa, Homo Sapiens
PSRRWRTAC

SEQ ID NO: 1104187 - protein, 9 aa, Homo Sapiens
DISRISQSM

SEQ ID NO: 1104188 - protein, 9 aa, Homo Sapiens
LWECLSTTR

SEQ ID NO: 1104189 - protein, 9 aa, Homo Sapiens
VDASLFQMA

SEQ ID NO: 1104190 - protein, 9 aa, Homo Sapiens
RTPLQQVGI

SEQ ID NO: 1104191 - protein, 9 aa, Homo Sapiens
WRLLLVAAC

SEQ ID NO: 1104192 - protein, 9 aa, Homo Sapiens
RSWSPGCPF

SEQ ID NO: 1104193 - protein, 9 aa, Homo Sapiens
KHSLRLPSL

SEQ ID NO: 1104194 - protein, 9 aa, Homo Sapiens
SYHGRDLPY

SEQ ID NO: 1104195 - protein, 9 aa, Homo Sapiens
AKPRRRKKE

SEQ ID NO: 1104196 - protein, 9 aa, Homo Sapiens
RGRTSGRSL

SEQ ID NO: 1104197 - protein, 9 aa, Homo Sapiens
ELVAEKIGE

SEQ ID NO: 1104198 - protein, 9 aa, Homo Sapiens
PSPIDTVLL

SEQ ID NO: 1104199 - protein, 9 aa, Homo Sapiens
LTTTYTRQG

SEQ ID NO: 1104200 - protein, 9 aa, Homo Sapiens
DEEETPPRQ

SEQ ID NO: 1104201 - protein, 9 aa, Homo Sapiens
STLAFQQAC

SEQ ID NO: 1104202 - protein, 9 aa, Homo Sapiens
HSTTGVHNF

SEQ ID NO: 1104203 - protein, 9 aa, Homo Sapiens
DSGVSSSVG

SEQ ID NO: 1104204 - protein, 9 aa, Homo Sapiens
GQFPRVCMM

SEQ ID NO: 1104205 - protein, 9 aa, Homo Sapiens
TSLSAGYNS

SEQ ID NO: 1104206 - protein, 9 aa, Homo Sapiens
STLPTYQHS

SEQ ID NO: 1104207 - protein, 9 aa, Homo Sapiens
EEEEDDDQP

SEQ ID NO: 1104208 - protein, 9 aa, Homo Sapiens
KDLSLSKQL

SEQ ID NO: 1104209 - protein, 9 aa, Homo Sapiens
STAKSKPII

SEQ ID NO: 1104210 - protein, 9 aa, Homo Sapiens
SIDNWCWRD

SEQ ID NO: 1104211 - protein, 9 aa, Homo Sapiens
DSFKCADIC

SEQ ID NO: 1104212 - protein, 9 aa, Homo Sapiens
SILGIILIV

SEQ ID NO: 1104213 - protein, 9 aa, Homo Sapiens
KFPELLCVW

SEQ ID NO: 1104214 - protein, 9 aa, Homo Sapiens
WLSRRLVLK

SEQ ID NO: 1104215 - protein, 9 aa, Homo Sapiens
LAVVKIIKK

SEQ ID NO: 1104216 - protein, 9 aa, Homo Sapiens
SASLLATQL

SEQ ID NO: 1104217 - protein, 9 aa, Homo Sapiens
QELRRVEEL

SEQ ID NO: 1104218 - protein, 9 aa, Homo Sapiens
NNCNQVVKP

SEQ ID NO: 1104219 - protein, 9 aa, Homo Sapiens
QRRHGTEGF

SEQ ID NO: 1104220 - protein, 9 aa, Homo Sapiens
CCHRSSALQ

SEQ ID NO: 1104221 - protein, 9 aa, Homo Sapiens
KVGIHKLIN

SEQ ID NO: 1104222 - protein, 9 aa, Homo Sapiens
YHRRAPATK

SEQ ID NO: 1104223 - protein, 9 aa, Homo Sapiens
HCRPHWTLS

SEQ ID NO: 1104224 - protein, 9 aa, Homo Sapiens
PDHVDAPGR

SEQ ID NO: 1104225 - protein, 9 aa, Homo Sapiens
GKDQVVSLS

SEQ ID NO: 1104226 - protein, 9 aa, Homo Sapiens
NVHHCFPSS

SEQ ID NO: 1104227 - protein, 9 aa, Homo Sapiens
WVAALALGL

SEQ ID NO: 1104228 - protein, 9 aa, Homo Sapiens
NPGVGLGVE

SEQ ID NO: 1104229 - protein, 9 aa, Homo Sapiens
GGSPVGDVG

SEQ ID NO: 1104230 - protein, 9 aa, Homo Sapiens
PPSHQHRNV

SEQ ID NO: 1104231 - protein, 9 aa, Homo Sapiens
IDFVCIFVY

SEQ ID NO: 1104232 - protein, 9 aa, Homo Sapiens
RANVGAAEE

SEQ ID NO: 1104233 - protein, 9 aa, Homo Sapiens
IFKWMPVVD

SEQ ID NO: 1104234 - protein, 9 aa, Homo Sapiens
CTEIIIVVN

SEQ ID NO: 1104235 - protein, 9 aa, Homo Sapiens
EDEDKGTEG

SEQ ID NO: 1104236 - protein, 9 aa, Homo Sapiens
LGGSGGDCS

SEQ ID NO: 1104237 - protein, 9 aa, Homo Sapiens
LAFIFFSLS

SEQ ID NO: 1104238 - protein, 9 aa, Homo Sapiens
LLSTCCQFW

SEQ ID NO: 1104239 - protein, 9 aa, Homo Sapiens
LPECFLAVL

SEQ ID NO: 1104240 - protein, 9 aa, Homo Sapiens
VLEPDLHLA

SEQ ID NO: 1104241 - protein, 9 aa, Homo Sapiens
IHKLINNGS

SEQ ID NO: 1104242 - protein, 9 aa, Homo Sapiens
TLGADRGSW

SEQ ID NO: 1104243 - protein, 9 aa, Homo Sapiens
ISENPQKRK

SEQ ID NO: 1104244 - protein, 9 aa, Homo Sapiens
KRHGLYYIY

SEQ ID NO: 1104245 - protein, 9 aa, Homo Sapiens
LEHSAPKPR

SEQ ID NO: 1104246 - protein, 9 aa, Homo Sapiens
QLCNSKEDK

SEQ ID NO: 1104247 - protein, 9 aa, Homo Sapiens
QPAGPGRGA

SEQ ID NO: 1104248 - protein, 9 aa, Homo Sapiens
MCFLYILTS

SEQ ID NO: 1104249 - protein, 9 aa, Homo Sapiens
HCVQALHVH

SEQ ID NO: 1104250 - protein, 9 aa, Homo Sapiens
TPTGCGSAA

SEQ ID NO: 1104251 - protein, 9 aa, Homo Sapiens
VAVGARIPF

SEQ ID NO: 1104252 - protein, 9 aa, Homo Sapiens
RSLLVLAPA

SEQ ID NO: 1104253 - protein, 9 aa, Homo Sapiens
PLLHPQWAP

SEQ ID NO: 1104254 - protein, 9 aa, Homo Sapiens
LRCKLSPPS

SEQ ID NO: 1104255 - protein, 9 aa, Homo Sapiens
AAAWRLDES

SEQ ID NO: 1104256 - protein, 9 aa, Homo Sapiens
GVLLRPARC

SEQ ID NO: 1104257 - protein, 9 aa, Homo Sapiens
SDTTLEVQS

SEQ ID NO: 1104258 - protein, 9 aa, Homo Sapiens
PPSSRCWAG

SEQ ID NO: 1104259 - protein, 9 aa, Homo Sapiens
PHLPVASCP

SEQ ID NO: 1104260 - protein, 9 aa, Homo Sapiens
RDRINWFLP

SEQ ID NO: 1104261 - protein, 9 aa, Homo Sapiens
RILEQKFML

SEQ ID NO: 1104262 - protein, 9 aa, Homo Sapiens
APPVAEEAA

SEQ ID NO: 1104263 - protein, 9 aa, Homo Sapiens
PKGFEAQRA

SEQ ID NO: 1104264 - protein, 9 aa, Homo Sapiens
LLEMDGEQP

SEQ ID NO: 1104265 - protein, 9 aa, Homo Sapiens
LQNPSRMDH

SEQ ID NO: 1104266 - protein, 9 aa, Homo Sapiens
PRTAPRRSG

SEQ ID NO: 1104267 - protein, 9 aa, Homo Sapiens
SVVDRDNSP

SEQ ID NO: 1104268 - protein, 9 aa, Homo Sapiens
ADHSTTGVH

SEQ ID NO: 1104269 - protein, 9 aa, Homo Sapiens
AFDAFRSEP

SEQ ID NO: 1104270 - protein, 9 aa, Homo Sapiens
DFLNQCLEM

SEQ ID NO: 1104271 - protein, 9 aa, Homo Sapiens
SGEKPSLAA

SEQ ID NO: 1104272 - protein, 9 aa, Homo Sapiens
LCGLKEVGE

SEQ ID NO: 1104273 - protein, 9 aa, Homo Sapiens
RDKITRPGV

SEQ ID NO: 1104274 - protein, 9 aa, Homo Sapiens
LPRNGQEVA

SEQ ID NO: 1104275 - protein, 9 aa, Homo Sapiens
FFFLHKEFL

SEQ ID NO: 1104276 - protein, 9 aa, Homo Sapiens
CGAASPPAR

SEQ ID NO: 1104277 - protein, 9 aa, Homo Sapiens
KYLRCKLSP

SEQ ID NO: 1104278 - protein, 9 aa, Homo Sapiens
QNSRHLHPQ

SEQ ID NO: 1104279 - protein, 9 aa, Homo Sapiens
NIISDLVDE

SEQ ID NO: 1104280 - protein, 9 aa, Homo Sapiens
NILEMSFCL

SEQ ID NO: 1104281 - protein, 9 aa, Homo Sapiens
APASRSLGA

SEQ ID NO: 1104282 - protein, 9 aa, Homo Sapiens
ASCIRCGNG

SEQ ID NO: 1104283 - protein, 9 aa, Homo Sapiens
CKVARRHNY

SEQ ID NO: 1104284 - protein, 9 aa, Homo Sapiens
TALPACRAE

SEQ ID NO: 1104285 - protein, 9 aa, Homo Sapiens
QEWAVREQW

SEQ ID NO: 1104286 - protein, 9 aa, Homo Sapiens
VQDFKTDLR

SEQ ID NO: 1104287 - protein, 9 aa, Homo Sapiens
EWKTGCFKR

SEQ ID NO: 1104288 - protein, 9 aa, Homo Sapiens
VAALSEGRR

SEQ ID NO: 1104289 - protein, 9 aa, Homo Sapiens
QFCCRVQDT

SEQ ID NO: 1104290 - protein, 9 aa, Homo Sapiens
AGGPPRSRL

SEQ ID NO: 1104291 - protein, 9 aa, Homo Sapiens
MGAAGRYLC

SEQ ID NO: 1104292 - protein, 9 aa, Homo Sapiens
GLGAVYTRH

SEQ ID NO: 1104293 - protein, 9 aa, Homo Sapiens
TGSSTASAA

SEQ ID NO: 1104294 - protein, 9 aa, Homo Sapiens
EPWDTERNL

SEQ ID NO: 1104295 - protein, 9 aa, Homo Sapiens
NNYYSLFEG

SEQ ID NO: 1104296 - protein, 9 aa, Homo Sapiens
PWAAASEMA

SEQ ID NO: 1104297 - protein, 9 aa, Homo Sapiens
IVVVNIFIM

SEQ ID NO: 1104298 - protein, 9 aa, Homo Sapiens
CVCVLAANR

SEQ ID NO: 1104299 - protein, 9 aa, Homo Sapiens
FYVFPDMVF

SEQ ID NO: 1104300 - protein, 9 aa, Homo Sapiens
LLLGVCGHL

SEQ ID NO: 1104301 - protein, 9 aa, Homo Sapiens
MSVSTDTSV

SEQ ID NO: 1104302 - protein, 9 aa, Homo Sapiens
HHRMPSPHS

SEQ ID NO: 1104303 - protein, 9 aa, Homo Sapiens
HLRRPRVAQ

SEQ ID NO: 1104304 - protein, 9 aa, Homo Sapiens
YSPICSKLS

SEQ ID NO: 1104305 - protein, 9 aa, Homo Sapiens
APQPTPCAS

SEQ ID NO: 1104306 - protein, 9 aa, Homo Sapiens
SMWAFLLSL

SEQ ID NO: 1104307 - protein, 9 aa, Homo Sapiens
ARYRKPLEL

SEQ ID NO: 1104308 - protein, 9 aa, Homo Sapiens
RTGHQDHQV

SEQ ID NO: 1104309 - protein, 9 aa, Homo Sapiens
TQPSPASAC

SEQ ID NO: 1104310 - protein, 9 aa, Homo Sapiens
ATPGRPWPP

SEQ ID NO: 1104311 - protein, 9 aa, Homo Sapiens
DPLHHTSIP

SEQ ID NO: 1104312 - protein, 9 aa, Homo Sapiens
VLDSELAQN

SEQ ID NO: 1104313 - protein, 9 aa, Homo Sapiens
SKLRQVGLQ

SEQ ID NO: 1104314 - protein, 9 aa, Homo Sapiens
ISFALAMGV

SEQ ID NO: 1104315 - protein, 9 aa, Homo Sapiens
MHWWRVESD

SEQ ID NO: 1104316 - protein, 9 aa, Homo Sapiens
EATEAGAPG

SEQ ID NO: 1104317 - protein, 9 aa, Homo Sapiens
HLAFNQPSP

SEQ ID NO: 1104318 - protein, 9 aa, Homo Sapiens
VHVVLDHHL

SEQ ID NO: 1104319 - protein, 9 aa, Homo Sapiens
GPWRLLLVA

SEQ ID NO: 1104320 - protein, 9 aa, Homo Sapiens
EVQVTMCIS

SEQ ID NO: 1104321 - protein, 9 aa, Homo Sapiens
FPSPQGPLF

SEQ ID NO: 1104322 - protein, 9 aa, Homo Sapiens
HPRASQVVK

SEQ ID NO: 1104323 - protein, 9 aa, Homo Sapiens
QSPKLVLII

SEQ ID NO: 1104324 - protein, 9 aa, Homo Sapiens
VEYHVLQEL

SEQ ID NO: 1104325 - protein, 9 aa, Homo Sapiens
RAVGTQISI

SEQ ID NO: 1104326 - protein, 9 aa, Homo Sapiens
GDTPQPSLP

SEQ ID NO: 1104327 - protein, 9 aa, Homo Sapiens
PFFGRDCSP

SEQ ID NO: 1104328 - protein, 9 aa, Homo Sapiens
YHLVLAVVK

SEQ ID NO: 1104329 - protein, 9 aa, Homo Sapiens
IFQGIKGKI

SEQ ID NO: 1104330 - protein, 9 aa, Homo Sapiens
GWTRAFEEN

SEQ ID NO: 1104331 - protein, 9 aa, Homo Sapiens
RSQKVGEKV

SEQ ID NO: 1104332 - protein, 9 aa, Homo Sapiens
QEFPAVGLE

SEQ ID NO: 1104333 - protein, 9 aa, Homo Sapiens
VLVRPLSLI

SEQ ID NO: 1104334 - protein, 9 aa, Homo Sapiens
MEALGSWGQ

SEQ ID NO: 1104335 - protein, 9 aa, Homo Sapiens
AMGVGAKVA

SEQ ID NO: 1104336 - protein, 9 aa, Homo Sapiens
SLDCLLQQD

SEQ ID NO: 1104337 - protein, 9 aa, Homo Sapiens
TALPMVPPH

SEQ ID NO: 1104338 - protein, 9 aa, Homo Sapiens
QWKRPMGLS

SEQ ID NO: 1104339 - protein, 9 aa, Homo Sapiens
VLEVVVVHE

SEQ ID NO: 1104340 - protein, 9 aa, Homo Sapiens
CAAAALASV

SEQ ID NO: 1104341 - protein, 9 aa, Homo Sapiens
EGEHPRCVT

SEQ ID NO: 1104342 - protein, 9 aa, Homo Sapiens
STPTGCGSA

SEQ ID NO: 1104343 - protein, 9 aa, Homo Sapiens
SCNDCISQL

SEQ ID NO: 1104344 - protein, 9 aa, Homo Sapiens
SFAPGSLPW

SEQ ID NO: 1104345 - protein, 9 aa, Homo Sapiens
IFSTWIIPA

SEQ ID NO: 1104346 - protein, 9 aa, Homo Sapiens
LKGLWTLHA

SEQ ID NO: 1104347 - protein, 9 aa, Homo Sapiens
DGALLACTA

SEQ ID NO: 1104348 - protein, 9 aa, Homo Sapiens
LRGRENGGG

SEQ ID NO: 1104349 - protein, 9 aa, Homo Sapiens
GPGLDGGLA

SEQ ID NO: 1104350 - protein, 9 aa, Homo Sapiens
ELFRKFRRG

SEQ ID NO: 1104351 - protein, 9 aa, Homo Sapiens
TDSAVPMWS

SEQ ID NO: 1104352 - protein, 9 aa, Homo Sapiens
VRWVQLEEN

SEQ ID NO: 1104353 - protein, 9 aa, Homo Sapiens
PMGLLELCA

SEQ ID NO: 1104354 - protein, 9 aa, Homo Sapiens
STTRASGEK

SEQ ID NO: 1104355 - protein, 9 aa, Homo Sapiens
CLEQCPLQL

SEQ ID NO: 1104356 - protein, 9 aa, Homo Sapiens
LEELKNVTN

SEQ ID NO: 1104357 - protein, 9 aa, Homo Sapiens
HNAGLGYLV

SEQ ID NO: 1104358 - protein, 9 aa, Homo Sapiens
VQGRGIGPL

SEQ ID NO: 1104359 - protein, 9 aa, Homo Sapiens
VKLTQIVLW

SEQ ID NO: 1104360 - protein, 9 aa, Homo Sapiens
TTLTSAASS

SEQ ID NO: 1104361 - protein, 9 aa, Homo Sapiens
TVLTYALSS

SEQ ID NO: 1104362 - protein, 9 aa, Homo Sapiens
QHDRDMAQG

SEQ ID NO: 1104363 - protein, 9 aa, Homo Sapiens
YMTVLEQLF

SEQ ID NO: 1104364 - protein, 9 aa, Homo Sapiens
DRSWAPVFL

SEQ ID NO: 1104365 - protein, 9 aa, Homo Sapiens
RGETVNLRL

SEQ ID NO: 1104366 - protein, 9 aa, Homo Sapiens
PGGVPRQDH

SEQ ID NO: 1104367 - protein, 9 aa, Homo Sapiens
LKRERNVAT

SEQ ID NO: 1104368 - protein, 9 aa, Homo Sapiens
NSDNLRKVV

SEQ ID NO: 1104369 - protein, 9 aa, Homo Sapiens
SAPWAKVVR

SEQ ID NO: 1104370 - protein, 9 aa, Homo Sapiens
VEQHKQERK

SEQ ID NO: 1104371 - protein, 9 aa, Homo Sapiens
TLQMVLQWR

SEQ ID NO: 1104372 - protein, 9 aa, Homo Sapiens
QALAQAQGR

SEQ ID NO: 1104373 - protein, 9 aa, Homo Sapiens
RWLMGCFLT

SEQ ID NO: 1104374 - protein, 9 aa, Homo Sapiens
AAKASGAPR

SEQ ID NO: 1104375 - protein, 9 aa, Homo Sapiens
RLASANVDF

SEQ ID NO: 1104376 - protein, 9 aa, Homo Sapiens
LSSIAVLPD

SEQ ID NO: 1104377 - protein, 9 aa, Homo Sapiens
SMPPPPSRP

SEQ ID NO: 1104378 - protein, 9 aa, Homo Sapiens
VAVVHPIKV

SEQ ID NO: 1104379 - protein, 9 aa, Homo Sapiens
HLGQEPGVI

SEQ ID NO: 1104380 - protein, 9 aa, Homo Sapiens
PWARFQDSD

SEQ ID NO: 1104381 - protein, 9 aa, Homo Sapiens
FTVDGDDLG

SEQ ID NO: 1104382 - protein, 9 aa, Homo Sapiens
VPSGGLRAR

SEQ ID NO: 1104383 - protein, 9 aa, Homo Sapiens
FQGIKGKIR

SEQ ID NO: 1104384 - protein, 9 aa, Homo Sapiens
VHHCFPSSP

SEQ ID NO: 1104385 - protein, 9 aa, Homo Sapiens
TEVGCPAGG

SEQ ID NO: 1104386 - protein, 9 aa, Homo Sapiens
IARHSGSQD

SEQ ID NO: 1104387 - protein, 9 aa, Homo Sapiens
SHKRKHERW

SEQ ID NO: 1104388 - protein, 9 aa, Homo Sapiens
LLPGMGPHV

SEQ ID NO: 1104389 - protein, 9 aa, Homo Sapiens
LPRGPRCPP

SEQ ID NO: 1104390 - protein, 9 aa, Homo Sapiens
WDGYPPHQQ

SEQ ID NO: 1104391 - protein, 9 aa, Homo Sapiens
DTHVTLQQV

SEQ ID NO: 1104392 - protein, 9 aa, Homo Sapiens
SSLRILSTG

SEQ ID NO: 1104393 - protein, 9 aa, Homo Sapiens
PWDANAPEG

SEQ ID NO: 1104394 - protein, 9 aa, Homo Sapiens
QVNKNKNGG

SEQ ID NO: 1104395 - protein, 9 aa, Homo Sapiens
RHTICSLDL

SEQ ID NO: 1104396 - protein, 9 aa, Homo Sapiens
NVASRMPLS

SEQ ID NO: 1104397 - protein, 9 aa, Homo Sapiens
NDNISQLTR

SEQ ID NO: 1104398 - protein, 9 aa, Homo Sapiens
NPGLAELVA

SEQ ID NO: 1104399 - protein, 9 aa, Homo Sapiens
KKQRSFAPG

SEQ ID NO: 1104400 - protein, 9 aa, Homo Sapiens
PTISCPFQS

SEQ ID NO: 1104401 - protein, 9 aa, Homo Sapiens
VLGVGVFLR

SEQ ID NO: 1104402 - protein, 9 aa, Homo Sapiens
GGEEQRQRR

SEQ ID NO: 1104403 - protein, 9 aa, Homo Sapiens
HTSGFLCND

SEQ ID NO: 1104404 - protein, 9 aa, Homo Sapiens
QDTGPLDTT

SEQ ID NO: 1104405 - protein, 9 aa, Homo Sapiens
LRAWGSLSN

SEQ ID NO: 1104406 - protein, 9 aa, Homo Sapiens
QRVGETRAL

SEQ ID NO: 1104407 - protein, 9 aa, Homo Sapiens
GRAPRQLGQ

SEQ ID NO: 1104408 - protein, 9 aa, Homo Sapiens
LWREYHLVL

SEQ ID NO: 1104409 - protein, 9 aa, Homo Sapiens
DFLDLNPVP

SEQ ID NO: 1104410 - protein, 9 aa, Homo Sapiens
SSSGPWRSR

SEQ ID NO: 1104411 - protein, 9 aa, Homo Sapiens
SAYTTQPTQ

SEQ ID NO: 1104412 - protein, 9 aa, Homo Sapiens
SQSVQQALH

SEQ ID NO: 1104413 - protein, 9 aa, Homo Sapiens
VNQDLYRMK

SEQ ID NO: 1104414 - protein, 9 aa, Homo Sapiens
SLACGALPL

SEQ ID NO: 1104415 - protein, 9 aa, Homo Sapiens
EPLYSPICS

SEQ ID NO: 1104416 - protein, 9 aa, Homo Sapiens
AIRDIRHVT

SEQ ID NO: 1104417 - protein, 9 aa, Homo Sapiens
FRPVVPALA

SEQ ID NO: 1104418 - protein, 9 aa, Homo Sapiens
RPKLQPGFG

SEQ ID NO: 1104419 - protein, 9 aa, Homo Sapiens
ITLNMIKST

SEQ ID NO: 1104420 - protein, 9 aa, Homo Sapiens
FKNLPKALS

SEQ ID NO: 1104421 - protein, 9 aa, Homo Sapiens
RGPPGEKGN

SEQ ID NO: 1104422 - protein, 9 aa, Homo Sapiens
GWEAAELEP

SEQ ID NO: 1104423 - protein, 9 aa, Homo Sapiens
SQGRLCLSQ

SEQ ID NO: 1104424 - protein, 9 aa, Homo Sapiens
QRLPWAGAP

SEQ ID NO: 1104425 - protein, 9 aa, Homo Sapiens
PSHVDFLAG

SEQ ID NO: 1104426 - protein, 9 aa, Homo Sapiens
LGAQVFAFL

SEQ ID NO: 1104427 - protein, 9 aa, Homo Sapiens
GRHEGHEPF

SEQ ID NO: 1104428 - protein, 9 aa, Homo Sapiens
EQEWAVREQ

SEQ ID NO: 1104429 - protein, 9 aa, Homo Sapiens
TCSPCSPTT

SEQ ID NO: 1104430 - protein, 9 aa, Homo Sapiens
LTATRRAVQ

SEQ ID NO: 1104431 - protein, 9 aa, Homo Sapiens
HNLTLYGSM

SEQ ID NO: 1104432 - protein, 9 aa, Homo Sapiens
GPATPTSGP

SEQ ID NO: 1104433 - protein, 9 aa, Homo Sapiens
VAGATAQIQ

SEQ ID NO: 1104434 - protein, 9 aa, Homo Sapiens
PPAAEEVGG

SEQ ID NO: 1104435 - protein, 9 aa, Homo Sapiens
LQMFGLCRR

SEQ ID NO: 1104436 - protein, 9 aa, Homo Sapiens
KPLELFGKV

SEQ ID NO: 1104437 - protein, 9 aa, Homo Sapiens
PRRTRSAWG

SEQ ID NO: 1104438 - protein, 9 aa, Homo Sapiens
HLPPIHLHR

SEQ ID NO: 1104439 - protein, 9 aa, Homo Sapiens
IGLYGFIFY

SEQ ID NO: 1104440 - protein, 9 aa, Homo Sapiens
LGIILIVAF

SEQ ID NO: 1104441 - protein, 9 aa, Homo Sapiens
LHGETGMVH

SEQ ID NO: 1104442 - protein, 9 aa, Homo Sapiens
LSKKLWWTL

SEQ ID NO: 1104443 - protein, 9 aa, Homo Sapiens
SFDKFTNMY

SEQ ID NO: 1104444 - protein, 9 aa, Homo Sapiens
VKNHVKNGD

SEQ ID NO: 1104445 - protein, 9 aa, Homo Sapiens
GTQEVEIGT

SEQ ID NO: 1104446 - protein, 9 aa, Homo Sapiens
VHIKNFGGD

SEQ ID NO: 1104447 - protein, 9 aa, Homo Sapiens
ASTLPTYQH

SEQ ID NO: 1104448 - protein, 9 aa, Homo Sapiens
HYGTTVPYT

SEQ ID NO: 1104449 - protein, 9 aa, Homo Sapiens
DAFRSEPTA

SEQ ID NO: 1104450 - protein, 9 aa, Homo Sapiens
PTPSSSLSG

SEQ ID NO: 1104451 - protein, 9 aa, Homo Sapiens
TDHPTSASR

SEQ ID NO: 1104452 - protein, 9 aa, Homo Sapiens
RKRKKMTAS

SEQ ID NO: 1104453 - protein, 9 aa, Homo Sapiens
LAVEACLRT

SEQ ID NO: 1104454 - protein, 9 aa, Homo Sapiens
YRLISTIAI

SEQ ID NO: 1104455 - protein, 9 aa, Homo Sapiens
EREARRHGK

SEQ ID NO: 1104456 - protein, 9 aa, Homo Sapiens
ITFLTSIIV

SEQ ID NO: 1104457 - protein, 9 aa, Homo Sapiens
IVNSKDYMY

SEQ ID NO: 1104458 - protein, 9 aa, Homo Sapiens
GRGGLDLRM

SEQ ID NO: 1104459 - protein, 9 aa, Homo Sapiens
STSVMTEPC

SEQ ID NO: 1104460 - protein, 9 aa, Homo Sapiens
IEPPGLFCG

SEQ ID NO: 1104461 - protein, 9 aa, Homo Sapiens
ISGVNTKKE

SEQ ID NO: 1104462 - protein, 9 aa, Homo Sapiens
SLPASHGDT

SEQ ID NO: 1104463 - protein, 9 aa, Homo Sapiens
ALSEQAAPQ

SEQ ID NO: 1104464 - protein, 9 aa, Homo Sapiens
EDDLRGREN

SEQ ID NO: 1104465 - protein, 9 aa, Homo Sapiens
NRYKFYLPP

SEQ ID NO: 1104466 - protein, 9 aa, Homo Sapiens
EETHWFSNL

SEQ ID NO: 1104467 - protein, 9 aa, Homo Sapiens
GSPPPHNPR

SEQ ID NO: 1104468 - protein, 9 aa, Homo Sapiens
DIDLLSTAK

SEQ ID NO: 1104469 - protein, 9 aa, Homo Sapiens
PSRACDINT

SEQ ID NO: 1104470 - protein, 9 aa, Homo Sapiens
QWPCSSMPT

SEQ ID NO: 1104471 - protein, 9 aa, Homo Sapiens
FGEQPHAGE

SEQ ID NO: 1104472 - protein, 9 aa, Homo Sapiens
QLVNPHTHW

SEQ ID NO: 1104473 - protein, 9 aa, Homo Sapiens
SLLEMDGEQ

SEQ ID NO: 1104474 - protein, 9 aa, Homo Sapiens
EVAAAVWAS

SEQ ID NO: 1104475 - protein, 9 aa, Homo Sapiens
PANPQLLCQ

SEQ ID NO: 1104476 - protein, 9 aa, Homo Sapiens
VIVLGVGVF

SEQ ID NO: 1104477 - protein, 9 aa, Homo Sapiens
NSSKFRDSA

SEQ ID NO: 1104478 - protein, 9 aa, Homo Sapiens
QEEGILRLP

SEQ ID NO: 1104479 - protein, 9 aa, Homo Sapiens
GPAGTAGPI

SEQ ID NO: 1104480 - protein, 9 aa, Homo Sapiens
FFEKKVHRN

SEQ ID NO: 1104481 - protein, 9 aa, Homo Sapiens
EGTCAVGVE

SEQ ID NO: 1104482 - protein, 9 aa, Homo Sapiens
GSRRGCAWY

SEQ ID NO: 1104483 - protein, 9 aa, Homo Sapiens
ATASCGTGS

SEQ ID NO: 1104484 - protein, 9 aa, Homo Sapiens
LRILMELRG

SEQ ID NO: 1104485 - protein, 9 aa, Homo Sapiens
HRNQPPHPV

SEQ ID NO: 1104486 - protein, 9 aa, Homo Sapiens
SYILLDSSD

SEQ ID NO: 1104487 - protein, 9 aa, Homo Sapiens
RVAGAARTS

SEQ ID NO: 1104488 - protein, 9 aa, Homo Sapiens
QAQTKIQAT

SEQ ID NO: 1104489 - protein, 9 aa, Homo Sapiens
AGQDLCPGA

SEQ ID NO: 1104490 - protein, 9 aa, Homo Sapiens
QQRTGHQDH

SEQ ID NO: 1104491 - protein, 9 aa, Homo Sapiens
GFRSGAKPP

SEQ ID NO: 1104492 - protein, 9 aa, Homo Sapiens
NQEILNTNS

SEQ ID NO: 1104493 - protein, 9 aa, Homo Sapiens
DVFLHFLSG

SEQ ID NO: 1104494 - protein, 9 aa, Homo Sapiens
ATQLKGTVE

SEQ ID NO: 1104495 - protein, 9 aa, Homo Sapiens
HWLCPQTRR

SEQ ID NO: 1104496 - protein, 9 aa, Homo Sapiens
VFLHFLSGL

SEQ ID NO: 1104497 - protein, 9 aa, Homo Sapiens
CEKCGKVFN

SEQ ID NO: 1104498 - protein, 9 aa, Homo Sapiens
DATGHLLFP

SEQ ID NO: 1104499 - protein, 9 aa, Homo Sapiens
ASRHCWEVE

SEQ ID NO: 1104500 - protein, 9 aa, Homo Sapiens
LWLLSPSRK

SEQ ID NO: 1104501 - protein, 9 aa, Homo Sapiens
SFNKMKKID

SEQ ID NO: 1104502 - protein, 9 aa, Homo Sapiens
YPAIPSDTT

SEQ ID NO: 1104503 - protein, 9 aa, Homo Sapiens
GWARCYRSC

SEQ ID NO: 1104504 - protein, 9 aa, Homo Sapiens
HLSSGQPNT

SEQ ID NO: 1104505 - protein, 9 aa, Homo Sapiens
QQLKTAQIA

SEQ ID NO: 1104506 - protein, 9 aa, Homo Sapiens
GRRGGTCAS

SEQ ID NO: 1104507 - protein, 9 aa, Homo Sapiens
SEPVEPLLV

SEQ ID NO: 1104508 - protein, 9 aa, Homo Sapiens
LLFKGRGQI

SEQ ID NO: 1104509 - protein, 9 aa, Homo Sapiens
RPALRLLCP

SEQ ID NO: 1104510 - protein, 9 aa, Homo Sapiens
WSTGFVIHH

SEQ ID NO: 1104511 - protein, 9 aa, Homo Sapiens
SVPEEFHST

SEQ ID NO: 1104512 - protein, 9 aa, Homo Sapiens
KNLYLLAFK

SEQ ID NO: 1104513 - protein, 9 aa, Homo Sapiens
AVVILCSEL

SEQ ID NO: 1104514 - protein, 9 aa, Homo Sapiens
PGPPSGPGG

SEQ ID NO: 1104515 - protein, 9 aa, Homo Sapiens
GGPDWHWGA

SEQ ID NO: 1104516 - protein, 9 aa, Homo Sapiens
TACVSPSIT

SEQ ID NO: 1104517 - protein, 9 aa, Homo Sapiens
FQRLVREIV

SEQ ID NO: 1104518 - protein, 9 aa, Homo Sapiens
QGLGPPAPP

SEQ ID NO: 1104519 - protein, 9 aa, Homo Sapiens
VHNFQVWNA

SEQ ID NO: 1104520 - protein, 9 aa, Homo Sapiens
DRNLGSPLM

SEQ ID NO: 1104521 - protein, 9 aa, Homo Sapiens
LPVAADLRP

SEQ ID NO: 1104522 - protein, 9 aa, Homo Sapiens
PTAGAARAR

SEQ ID NO: 1104523 - protein, 9 aa, Homo Sapiens
PSTSQTPLL

SEQ ID NO: 1104524 - protein, 9 aa, Homo Sapiens
SWWAPSRST

SEQ ID NO: 1104525 - protein, 9 aa, Homo Sapiens
NGKIIDTKN

SEQ ID NO: 1104526 - protein, 9 aa, Homo Sapiens
PESCCEPPA

SEQ ID NO: 1104527 - protein, 9 aa, Homo Sapiens
KRWDILAIV

SEQ ID NO: 1104528 - protein, 9 aa, Homo Sapiens
HAWGRFDSA

SEQ ID NO: 1104529 - protein, 9 aa, Homo Sapiens
LFGKVFGNF

SEQ ID NO: 1104530 - protein, 9 aa, Homo Sapiens
DLPILDDQI

SEQ ID NO: 1104531 - protein, 9 aa, Homo Sapiens
HSVPAPSIC

SEQ ID NO: 1104532 - protein, 9 aa, Homo Sapiens
VNPAARMYG

SEQ ID NO: 1104533 - protein, 9 aa, Homo Sapiens
VRCWVKAEL

SEQ ID NO: 1104534 - protein, 9 aa, Homo Sapiens
LCPPVPGVP

SEQ ID NO: 1104535 - protein, 9 aa, Homo Sapiens
SCLFPPFEE

SEQ ID NO: 1104536 - protein, 9 aa, Homo Sapiens
PGVKLWKKG

SEQ ID NO: 1104537 - protein, 9 aa, Homo Sapiens
NPAKWLLPL

SEQ ID NO: 1104538 - protein, 9 aa, Homo Sapiens
DLDGMLTVI

SEQ ID NO: 1104539 - protein, 9 aa, Homo Sapiens
CRAEYFDGS

SEQ ID NO: 1104540 - protein, 9 aa, Homo Sapiens
IRLTQVTKE

SEQ ID NO: 1104541 - protein, 9 aa, Homo Sapiens
RHGYGVHQS

SEQ ID NO: 1104542 - protein, 9 aa, Homo Sapiens
APWREASQA

SEQ ID NO: 1104543 - protein, 9 aa, Homo Sapiens
TYTRQGHGT

SEQ ID NO: 1104544 - protein, 9 aa, Homo Sapiens
RAFCNVWAA

SEQ ID NO: 1104545 - protein, 9 aa, Homo Sapiens
PIVNSSLVI

SEQ ID NO: 1104546 - protein, 9 aa, Homo Sapiens
QRWGKKVGE

SEQ ID NO: 1104547 - protein, 9 aa, Homo Sapiens
GFAALVIMW

SEQ ID NO: 1104548 - protein, 9 aa, Homo Sapiens
LLTSHLVKG

SEQ ID NO: 1104549 - protein, 9 aa, Homo Sapiens
TSVMTEPCK

SEQ ID NO: 1104550 - protein, 9 aa, Homo Sapiens
GGSKHGIIT

SEQ ID NO: 1104551 - protein, 9 aa, Homo Sapiens
AASEDVDKG

SEQ ID NO: 1104552 - protein, 9 aa, Homo Sapiens
PASSMESLL

SEQ ID NO: 1104553 - protein, 9 aa, Homo Sapiens
GEMQAQHPP

SEQ ID NO: 1104554 - protein, 9 aa, Homo Sapiens
ARGAESEWN

SEQ ID NO: 1104555 - protein, 9 aa, Homo Sapiens
GLHTAVPPH

SEQ ID NO: 1104556 - protein, 9 aa, Homo Sapiens
ALHHAGPED

SEQ ID NO: 1104557 - protein, 9 aa, Homo Sapiens
EGWRWGWGQ

SEQ ID NO: 1104558 - protein, 9 aa, Homo Sapiens
KRKQLLSFQ

SEQ ID NO: 1104559 - protein, 9 aa, Homo Sapiens
QHFYESLPP

SEQ ID NO: 1104560 - protein, 9 aa, Homo Sapiens
AVQPILILQ

SEQ ID NO: 1104561 - protein, 9 aa, Homo Sapiens
QGPGWEEAS

SEQ ID NO: 1104562 - protein, 9 aa, Homo Sapiens
PTYQHSEVI

SEQ ID NO: 1104563 - protein, 9 aa, Homo Sapiens
NPAKCLTVD

SEQ ID NO: 1104564 - protein, 9 aa, Homo Sapiens
LKKNRSYLC

SEQ ID NO: 1104565 - protein, 9 aa, Homo Sapiens
ILLDSSDPS

SEQ ID NO: 1104566 - protein, 9 aa, Homo Sapiens
PPLCLSKAA

SEQ ID NO: 1104567 - protein, 9 aa, Homo Sapiens
AARRSQRLP

SEQ ID NO: 1104568 - protein, 9 aa, Homo Sapiens
PETQNNQKN

SEQ ID NO: 1104569 - protein, 9 aa, Homo Sapiens
HSMCKQNVV

SEQ ID NO: 1104570 - protein, 9 aa, Homo Sapiens
IGTEKENTP

SEQ ID NO: 1104571 - protein, 9 aa, Homo Sapiens
ELQVFLFFT

SEQ ID NO: 1104572 - protein, 9 aa, Homo Sapiens
GPWRSRGTW

SEQ ID NO: 1104573 - protein, 9 aa, Homo Sapiens
GEETSGNSD

SEQ ID NO: 1104574 - protein, 9 aa, Homo Sapiens
PDEEDRKHQ

SEQ ID NO: 1104575 - protein, 9 aa, Homo Sapiens
GENVFSSPR

SEQ ID NO: 1104576 - protein, 9 aa, Homo Sapiens
LHHLHCPCH

SEQ ID NO: 1104577 - protein, 9 aa, Homo Sapiens
APSRSTCPP

SEQ ID NO: 1104578 - protein, 9 aa, Homo Sapiens
MNQQHGRRF

SEQ ID NO: 1104579 - protein, 9 aa, Homo Sapiens
NMITAALCR

SEQ ID NO: 1104580 - protein, 9 aa, Homo Sapiens
TNTRVIVLG

SEQ ID NO: 1104581 - protein, 9 aa, Homo Sapiens
SAPQPTPCA

SEQ ID NO: 1104582 - protein, 9 aa, Homo Sapiens
DAPGAAEGR

SEQ ID NO: 1104583 - protein, 9 aa, Homo Sapiens
AGAPATEVG

SEQ ID NO: 1104584 - protein, 9 aa, Homo Sapiens
ASTHTSRNC

SEQ ID NO: 1104585 - protein, 9 aa, Homo Sapiens
LLHPQWAPH

SEQ ID NO: 1104586 - protein, 9 aa, Homo Sapiens
WVVDSEDLP

SEQ ID NO: 1104587 - protein, 9 aa, Homo Sapiens
ALCRAWGDI

SEQ ID NO: 1104588 - protein, 9 aa, Homo Sapiens
AMTKNTSMW

SEQ ID NO: 1104589 - protein, 9 aa, Homo Sapiens
ILEMSFCLF

SEQ ID NO: 1104590 - protein, 9 aa, Homo Sapiens
IPKKSYALS

SEQ ID NO: 1104591 - protein, 9 aa, Homo Sapiens
LYQILRELK

SEQ ID NO: 1104592 - protein, 9 aa, Homo Sapiens
SSLPPPKAR

SEQ ID NO: 1104593 - protein, 9 aa, Homo Sapiens
GVQRVGLPG

SEQ ID NO: 1104594 - protein, 9 aa, Homo Sapiens
DRLLYVVAA

SEQ ID NO: 1104595 - protein, 9 aa, Homo Sapiens
LCRRPQPSK

SEQ ID NO: 1104596 - protein, 9 aa, Homo Sapiens
AQEHRAQLV

SEQ ID NO: 1104597 - protein, 9 aa, Homo Sapiens
AGVTAPSTP

SEQ ID NO: 1104598 - protein, 9 aa, Homo Sapiens
YPPLPAAPP

SEQ ID NO: 1104599 - protein, 9 aa, Homo Sapiens
DPPPGAAGR

SEQ ID NO: 1104600 - protein, 9 aa, Homo Sapiens
GEYWLGNDN

SEQ ID NO: 1104601 - protein, 9 aa, Homo Sapiens
KHLGTRKDH

SEQ ID NO: 1104602 - protein, 9 aa, Homo Sapiens
GWPCYLTRQ

SEQ ID NO: 1104603 - protein, 9 aa, Homo Sapiens
KPRLEDHQS

SEQ ID NO: 1104604 - protein, 9 aa, Homo Sapiens
DILRGSPPY

SEQ ID NO: 1104605 - protein, 9 aa, Homo Sapiens
MNMITAALC

SEQ ID NO: 1104606 - protein, 9 aa, Homo Sapiens
PTYPCPSAA

SEQ ID NO: 1104607 - protein, 9 aa, Homo Sapiens
LCRKVLEDP

SEQ ID NO: 1104608 - protein, 9 aa, Homo Sapiens
EPPGLFCGR

SEQ ID NO: 1104609 - protein, 9 aa, Homo Sapiens
PRGQPNYLL

SEQ ID NO: 1104610 - protein, 9 aa, Homo Sapiens
NIHELAWKT

SEQ ID NO: 1104611 - protein, 9 aa, Homo Sapiens
DEIAYHTSV

SEQ ID NO: 1104612 - protein, 9 aa, Homo Sapiens
TVLLGATVK

SEQ ID NO: 1104613 - protein, 9 aa, Homo Sapiens
CVESFDDQH

SEQ ID NO: 1104614 - protein, 9 aa, Homo Sapiens
VKALKKASS

SEQ ID NO: 1104615 - protein, 9 aa, Homo Sapiens
FERLLLQEW

SEQ ID NO: 1104616 - protein, 9 aa, Homo Sapiens
LPEHCTRQF

SEQ ID NO: 1104617 - protein, 9 aa, Homo Sapiens
PTTPSPASG

SEQ ID NO: 1104618 - protein, 9 aa, Homo Sapiens
RREELLKKC

SEQ ID NO: 1104619 - protein, 9 aa, Homo Sapiens
TRLLRTAQP

SEQ ID NO: 1104620 - protein, 9 aa, Homo Sapiens
NLMRPKHSH

SEQ ID NO: 1104621 - protein, 9 aa, Homo Sapiens
DSCQELAMV

SEQ ID NO: 1104622 - protein, 9 aa, Homo Sapiens
TPAPTWTTS

SEQ ID NO: 1104623 - protein, 9 aa, Homo Sapiens
DKKSLLQAM

SEQ ID NO: 1104624 - protein, 9 aa, Homo Sapiens
VPDTHVTLQ

SEQ ID NO: 1104625 - protein, 9 aa, Homo Sapiens
DMVPQAVAP

SEQ ID NO: 1104626 - protein, 9 aa, Homo Sapiens
DASVSFHHL

SEQ ID NO: 1104627 - protein, 9 aa, Homo Sapiens
LIHARKGEA

SEQ ID NO: 1104628 - protein, 9 aa, Homo Sapiens
QAVQGHASC

SEQ ID NO: 1104629 - protein, 9 aa, Homo Sapiens
CALGLVYWE

SEQ ID NO: 1104630 - protein, 9 aa, Homo Sapiens
VLSSEPVEP

SEQ ID NO: 1104631 - protein, 9 aa, Homo Sapiens
SRMSTASHS

SEQ ID NO: 1104632 - protein, 9 aa, Homo Sapiens
LGLLARFTA

SEQ ID NO: 1104633 - protein, 9 aa, Homo Sapiens
IREGWRWGW

SEQ ID NO: 1104634 - protein, 9 aa, Homo Sapiens
NPGGSPCTA

SEQ ID NO: 1104635 - protein, 9 aa, Homo Sapiens
AFSCDLLAS

SEQ ID NO: 1104636 - protein, 9 aa, Homo Sapiens
LSLFSSEEN

SEQ ID NO: 1104637 - protein, 9 aa, Homo Sapiens
GTRPWLMDP

SEQ ID NO: 1104638 - protein, 9 aa, Homo Sapiens
QAASEDVDK

SEQ ID NO: 1104639 - protein, 9 aa, Homo Sapiens
FGASRHCWE

SEQ ID NO: 1104640 - protein, 9 aa, Homo Sapiens
DDFLGGREV

SEQ ID NO: 1104641 - protein, 9 aa, Homo Sapiens
CHFTACETY

SEQ ID NO: 1104642 - protein, 9 aa, Homo Sapiens
TSFDKFTNM

SEQ ID NO: 1104643 - protein, 9 aa, Homo Sapiens
FLGEFHPWG

SEQ ID NO: 1104644 - protein, 9 aa, Homo Sapiens
HQDGEKLLQ

SEQ ID NO: 1104645 - protein, 9 aa, Homo Sapiens
PRLTRERAA

SEQ ID NO: 1104646 - protein, 9 aa, Homo Sapiens
SHRTSPVTP

SEQ ID NO: 1104647 - protein, 9 aa, Homo Sapiens
GAQGFGASR

SEQ ID NO: 1104648 - protein, 9 aa, Homo Sapiens
PFLDGHIVF

SEQ ID NO: 1104649 - protein, 9 aa, Homo Sapiens
YHTSVQEEF

SEQ ID NO: 1104650 - protein, 9 aa, Homo Sapiens
EKLALKEDL

SEQ ID NO: 1104651 - protein, 9 aa, Homo Sapiens
PVMDTVILY

SEQ ID NO: 1104652 - protein, 9 aa, Homo Sapiens
HQSFRNTIE

SEQ ID NO: 1104653 - protein, 9 aa, Homo Sapiens
GEHPRCVTR

SEQ ID NO: 1104654 - protein, 9 aa, Homo Sapiens
RDMVPQAVA

SEQ ID NO: 1104655 - protein, 9 aa, Homo Sapiens
SVAPSFSIG

SEQ ID NO: 1104656 - protein, 9 aa, Homo Sapiens
SLNLEQSRR

SEQ ID NO: 1104657 - protein, 9 aa, Homo Sapiens
PNWQPCTPS

SEQ ID NO: 1104658 - protein, 9 aa, Homo Sapiens
LDMAFDRYV

SEQ ID NO: 1104659 - protein, 9 aa, Homo Sapiens
RYEARSHHN

SEQ ID NO: 1104660 - protein, 9 aa, Homo Sapiens
IIQWDIIAS

SEQ ID NO: 1104661 - protein, 9 aa, Homo Sapiens
LLEKVSKKR

SEQ ID NO: 1104662 - protein, 9 aa, Homo Sapiens
SPLGGSGGD

SEQ ID NO: 1104663 - protein, 9 aa, Homo Sapiens
CNGGQILIA

SEQ ID NO: 1104664 - protein, 9 aa, Homo Sapiens
KVARRHNYF

SEQ ID NO: 1104665 - protein, 9 aa, Homo Sapiens
EEDDDDDDP

SEQ ID NO: 1104666 - protein, 9 aa, Homo Sapiens
EYKELSGTY

SEQ ID NO: 1104667 - protein, 9 aa, Homo Sapiens
LTAGVILLF

SEQ ID NO: 1104668 - protein, 9 aa, Homo Sapiens
HPVFSVMIS

SEQ ID NO: 1104669 - protein, 9 aa, Homo Sapiens
PRKHSLRLP

SEQ ID NO: 1104670 - protein, 9 aa, Homo Sapiens
ARVADGEEQ

SEQ ID NO: 1104671 - protein, 9 aa, Homo Sapiens
ASTDMDHVL

SEQ ID NO: 1104672 - protein, 9 aa, Homo Sapiens
RQVREHVLE

SEQ ID NO: 1104673 - protein, 9 aa, Homo Sapiens
HRQKVSSLF

SEQ ID NO: 1104674 - protein, 9 aa, Homo Sapiens
VQRVGLPGP

SEQ ID NO: 1104675 - protein, 9 aa, Homo Sapiens
RCPLQIILF

SEQ ID NO: 1104676 - protein, 9 aa, Homo Sapiens
HENYEKITS

SEQ ID NO: 1104677 - protein, 9 aa, Homo Sapiens
VARPGPTTV

SEQ ID NO: 1104678 - protein, 9 aa, Homo Sapiens
GMLKSPNTT

SEQ ID NO: 1104679 - protein, 9 aa, Homo Sapiens
PNKVPEIQY

SEQ ID NO: 1104680 - protein, 9 aa, Homo Sapiens
VAQATGEQA

SEQ ID NO: 1104681 - protein, 9 aa, Homo Sapiens
TSSPSQVDT

SEQ ID NO: 1104682 - protein, 9 aa, Homo Sapiens
ELSSVHEVL

SEQ ID NO: 1104683 - protein, 9 aa, Homo Sapiens
LGWARCYRS

SEQ ID NO: 1104684 - protein, 9 aa, Homo Sapiens
LLQKEEFCH

SEQ ID NO: 1104685 - protein, 9 aa, Homo Sapiens
TTYCVCVLA

SEQ ID NO: 1104686 - protein, 9 aa, Homo Sapiens
VLHKACKVA

SEQ ID NO: 1104687 - protein, 9 aa, Homo Sapiens
RVADGEEQR

SEQ ID NO: 1104688 - protein, 9 aa, Homo Sapiens
TPPSSSKPS

SEQ ID NO: 1104689 - protein, 9 aa, Homo Sapiens
THTEAAHRA

SEQ ID NO: 1104690 - protein, 9 aa, Homo Sapiens
QKECVYEMR

SEQ ID NO: 1104691 - protein, 9 aa, Homo Sapiens
GALLVHNRV

SEQ ID NO: 1104692 - protein, 9 aa, Homo Sapiens
KTEWLDDKH

SEQ ID NO: 1104693 - protein, 9 aa, Homo Sapiens
LLAAFWTEL

SEQ ID NO: 1104694 - protein, 9 aa, Homo Sapiens
TQPAQTSYL

SEQ ID NO: 1104695 - protein, 9 aa, Homo Sapiens
EYLERYFEY

SEQ ID NO: 1104696 - protein, 9 aa, Homo Sapiens
ALAMGVGAK

SEQ ID NO: 1104697 - protein, 9 aa, Homo Sapiens
HFAVTLFAL

SEQ ID NO: 1104698 - protein, 9 aa, Homo Sapiens
LISVIDLDT

SEQ ID NO: 1104699 - protein, 9 aa, Homo Sapiens
FPLGYLLVP

SEQ ID NO: 1104700 - protein, 9 aa, Homo Sapiens
SLHNKMCQQ

SEQ ID NO: 1104701 - protein, 9 aa, Homo Sapiens
SDGKYHVAR

SEQ ID NO: 1104702 - protein, 9 aa, Homo Sapiens
WAGAPATEV

SEQ ID NO: 1104703 - protein, 9 aa, Homo Sapiens
RGVPALPQR

SEQ ID NO: 1104704 - protein, 9 aa, Homo Sapiens
RCYSTPSSY

SEQ ID NO: 1104705 - protein, 9 aa, Homo Sapiens
LMTALSYPW

SEQ ID NO: 1104706 - protein, 9 aa, Homo Sapiens
WTPGQPRGL

SEQ ID NO: 1104707 - protein, 9 aa, Homo Sapiens
QILSRVWNT

SEQ ID NO: 1104708 - protein, 9 aa, Homo Sapiens
ALTKLEHPG

SEQ ID NO: 1104709 - protein, 9 aa, Homo Sapiens
CCLRTSCGA

SEQ ID NO: 1104710 - protein, 9 aa, Homo Sapiens
HVLGAQVFA

SEQ ID NO: 1104711 - protein, 9 aa, Homo Sapiens
LGQEPGVIG

SEQ ID NO: 1104712 - protein, 9 aa, Homo Sapiens
PCCPSTTCT

SEQ ID NO: 1104713 - protein, 9 aa, Homo Sapiens
TESATRSTR

SEQ ID NO: 1104714 - protein, 9 aa, Homo Sapiens
WLFMGYSTT

SEQ ID NO: 1104715 - protein, 9 aa, Homo Sapiens
HWLFMGYST

SEQ ID NO: 1104716 - protein, 9 aa, Homo Sapiens
WMTWCGWLC

SEQ ID NO: 1104717 - protein, 9 aa, Homo Sapiens
ITEHEKDFL

SEQ ID NO: 1104718 - protein, 9 aa, Homo Sapiens
PQTKGKGGR

SEQ ID NO: 1104719 - protein, 9 aa, Homo Sapiens
DAAGRGRAS

SEQ ID NO: 1104720 - protein, 9 aa, Homo Sapiens
QAVAPAAMV

SEQ ID NO: 1104721 - protein, 9 aa, Homo Sapiens
QPNKVPEIQ

SEQ ID NO: 1104722 - protein, 9 aa, Homo Sapiens
EDEDEAWWQ

SEQ ID NO: 1104723 - protein, 9 aa, Homo Sapiens
RATSPCTKL

SEQ ID NO: 1104724 - protein, 9 aa, Homo Sapiens
APRASCASP

SEQ ID NO: 1104725 - protein, 9 aa, Homo Sapiens
NPHTHWTIQ

SEQ ID NO: 1104726 - protein, 9 aa, Homo Sapiens
AKAIYFTVD

SEQ ID NO: 1104727 - protein, 9 aa, Homo Sapiens
QLLCLGVWA

SEQ ID NO: 1104728 - protein, 9 aa, Homo Sapiens
PEIVSRVSS

SEQ ID NO: 1104729 - protein, 9 aa, Homo Sapiens
SQTPGRGVP

SEQ ID NO: 1104730 - protein, 9 aa, Homo Sapiens
GRDCSPLRR

SEQ ID NO: 1104731 - protein, 9 aa, Homo Sapiens
QCVTELAVQ

SEQ ID NO: 1104732 - protein, 9 aa, Homo Sapiens
LRVLRVLRI

SEQ ID NO: 1104733 - protein, 9 aa, Homo Sapiens
GKASTGVVQ

SEQ ID NO: 1104734 - protein, 9 aa, Homo Sapiens
HTTGTSRTT

SEQ ID NO: 1104735 - protein, 9 aa, Homo Sapiens
KHLEEAFIS

SEQ ID NO: 1104736 - protein, 9 aa, Homo Sapiens
LRLGVIGFA

SEQ ID NO: 1104737 - protein, 9 aa, Homo Sapiens
VPSSTSSSL

SEQ ID NO: 1104738 - protein, 9 aa, Homo Sapiens
DALFESPLG

SEQ ID NO: 1104739 - protein, 9 aa, Homo Sapiens
CFSNGSWWA

SEQ ID NO: 1104740 - protein, 9 aa, Homo Sapiens
TPGLLRREP

SEQ ID NO: 1104741 - protein, 9 aa, Homo Sapiens
GGNGTLIGT

SEQ ID NO: 1104742 - protein, 9 aa, Homo Sapiens
RRVPSGGLR

SEQ ID NO: 1104743 - protein, 9 aa, Homo Sapiens
LWHAVHEEL

SEQ ID NO: 1104744 - protein, 9 aa, Homo Sapiens
VRLPDDCLL

SEQ ID NO: 1104745 - protein, 9 aa, Homo Sapiens
TPVGPVAGG

SEQ ID NO: 1104746 - protein, 9 aa, Homo Sapiens
IQKGSFLGE

SEQ ID NO: 1104747 - protein, 9 aa, Homo Sapiens
KTAGAADSA

SEQ ID NO: 1104748 - protein, 9 aa, Homo Sapiens
GLPIFWTAK

SEQ ID NO: 1104749 - protein, 9 aa, Homo Sapiens
RGEAEDDLR

SEQ ID NO: 1104750 - protein, 9 aa, Homo Sapiens
NPWTMSPFS

SEQ ID NO: 1104751 - protein, 9 aa, Homo Sapiens
RPLSLQCQS

SEQ ID NO: 1104752 - protein, 9 aa, Homo Sapiens
TTPSPASGS

SEQ ID NO: 1104753 - protein, 9 aa, Homo Sapiens
GSIAPPARA

SEQ ID NO: 1104754 - protein, 9 aa, Homo Sapiens
QQQQHQQHQ

SEQ ID NO: 1104755 - protein, 9 aa, Homo Sapiens
KCLQFSKDI

SEQ ID NO: 1104756 - protein, 9 aa, Homo Sapiens
VFIVNSKDY

SEQ ID NO: 1104757 - protein, 9 aa, Homo Sapiens
GGHGCLLAY

SEQ ID NO: 1104758 - protein, 9 aa, Homo Sapiens
FVSEGAGPR

SEQ ID NO: 1104759 - protein, 9 aa, Homo Sapiens
RRVVAALSE

SEQ ID NO: 1104760 - protein, 9 aa, Homo Sapiens
SIKEGDGAF

SEQ ID NO: 1104761 - protein, 9 aa, Homo Sapiens
FLYILTSMS

SEQ ID NO: 1104762 - protein, 9 aa, Homo Sapiens
VCPEIVSRV

SEQ ID NO: 1104763 - protein, 9 aa, Homo Sapiens
SKACLPLGA

SEQ ID NO: 1104764 - protein, 9 aa, Homo Sapiens
FSHAPPVAE

SEQ ID NO: 1104765 - protein, 9 aa, Homo Sapiens
RWPGPFCMS

SEQ ID NO: 1104766 - protein, 9 aa, Homo Sapiens
SRLARAPRA

SEQ ID NO: 1104767 - protein, 9 aa, Homo Sapiens
MSSTRTTAL

SEQ ID NO: 1104768 - protein, 9 aa, Homo Sapiens
SADHYLVVL

SEQ ID NO: 1104769 - protein, 9 aa, Homo Sapiens
VKKLSRNIL

SEQ ID NO: 1104770 - protein, 9 aa, Homo Sapiens
KEHSMGSRQ

SEQ ID NO: 1104771 - protein, 9 aa, Homo Sapiens
EGPVRLRED

SEQ ID NO: 1104772 - protein, 9 aa, Homo Sapiens
AGHVEPLHG

SEQ ID NO: 1104773 - protein, 9 aa, Homo Sapiens
EEECLIALK

SEQ ID NO: 1104774 - protein, 9 aa, Homo Sapiens
VSYDVQKCT

SEQ ID NO: 1104775 - protein, 9 aa, Homo Sapiens
AAQRKSQSW

SEQ ID NO: 1104776 - protein, 9 aa, Homo Sapiens
SGRQTRPEW

SEQ ID NO: 1104777 - protein, 9 aa, Homo Sapiens
VPLAPLGPA

SEQ ID NO: 1104778 - protein, 9 aa, Homo Sapiens
EVHLMNISV

SEQ ID NO: 1104779 - protein, 9 aa, Homo Sapiens
ARGPVRLLL

SEQ ID NO: 1104780 - protein, 9 aa, Homo Sapiens
GRRPLKKWP

SEQ ID NO: 1104781 - protein, 9 aa, Homo Sapiens
NVWMLMTAL

SEQ ID NO: 1104782 - protein, 9 aa, Homo Sapiens
IISDLVDEG

SEQ ID NO: 1104783 - protein, 9 aa, Homo Sapiens
YIKDYYRRA

SEQ ID NO: 1104784 - protein, 9 aa, Homo Sapiens
NPMGTVRSN

SEQ ID NO: 1104785 - protein, 9 aa, Homo Sapiens
YRRLLAAEY

SEQ ID NO: 1104786 - protein, 9 aa, Homo Sapiens
PTRSSSRTA

SEQ ID NO: 1104787 - protein, 9 aa, Homo Sapiens
RALQLALTA

SEQ ID NO: 1104788 - protein, 9 aa, Homo Sapiens
MLSVGKAKA

SEQ ID NO: 1104789 - protein, 9 aa, Homo Sapiens
LTPVSPLQT

SEQ ID NO: 1104790 - protein, 9 aa, Homo Sapiens
GPVRLLLGV

SEQ ID NO: 1104791 - protein, 9 aa, Homo Sapiens
SPWQVMASL

SEQ ID NO: 1104792 - protein, 9 aa, Homo Sapiens
TSSSRGGEP

SEQ ID NO: 1104793 - protein, 9 aa, Homo Sapiens
QNTRNPIWN

SEQ ID NO: 1104794 - protein, 9 aa, Homo Sapiens
LQGTQARPP

SEQ ID NO: 1104795 - protein, 9 aa, Homo Sapiens
SPTPPSSSK

SEQ ID NO: 1104796 - protein, 9 aa, Homo Sapiens
KRNTEAMKI

SEQ ID NO: 1104797 - protein, 9 aa, Homo Sapiens
LLHGKTIEI

SEQ ID NO: 1104798 - protein, 9 aa, Homo Sapiens
PAHSPTPTS

SEQ ID NO: 1104799 - protein, 9 aa, Homo Sapiens
VKRVWSRNV

SEQ ID NO: 1104800 - protein, 9 aa, Homo Sapiens
QGSQPFQER

SEQ ID NO: 1104801 - protein, 9 aa, Homo Sapiens
DFSIISVAD

SEQ ID NO: 1104802 - protein, 9 aa, Homo Sapiens
KTKKTSFSL

SEQ ID NO: 1104803 - protein, 9 aa, Homo Sapiens
RTAPRRSGW

SEQ ID NO: 1104804 - protein, 9 aa, Homo Sapiens
AQLLCLGVW

SEQ ID NO: 1104805 - protein, 9 aa, Homo Sapiens
RCRPGAPAA

SEQ ID NO: 1104806 - protein, 9 aa, Homo Sapiens
YLRTSGEPW

SEQ ID NO: 1104807 - protein, 9 aa, Homo Sapiens
VDFQLVLPG

SEQ ID NO: 1104808 - protein, 9 aa, Homo Sapiens
PVEPGQPPR

SEQ ID NO: 1104809 - protein, 9 aa, Homo Sapiens
LYYDVESFL

SEQ ID NO: 1104810 - protein, 9 aa, Homo Sapiens
LEPHTHHLI

SEQ ID NO: 1104811 - protein, 9 aa, Homo Sapiens
CFKRPRVAL

SEQ ID NO: 1104812 - protein, 9 aa, Homo Sapiens
MGSPPPHNP

SEQ ID NO: 1104813 - protein, 9 aa, Homo Sapiens
QELANSLDA

SEQ ID NO: 1104814 - protein, 9 aa, Homo Sapiens
PKNAQMLSR

SEQ ID NO: 1104815 - protein, 9 aa, Homo Sapiens
ATQAPCMMT

SEQ ID NO: 1104816 - protein, 9 aa, Homo Sapiens
TMTPVSSPT

SEQ ID NO: 1104817 - protein, 9 aa, Homo Sapiens
NFYCDVPQA

SEQ ID NO: 1104818 - protein, 9 aa, Homo Sapiens
SPPLQDGSL

SEQ ID NO: 1104819 - protein, 9 aa, Homo Sapiens
QDILEQTAT

SEQ ID NO: 1104820 - protein, 9 aa, Homo Sapiens
HFTACETYI

SEQ ID NO: 1104821 - protein, 9 aa, Homo Sapiens
HFLSGLLSP

SEQ ID NO: 1104822 - protein, 9 aa, Homo Sapiens
VPEHLGQEL

SEQ ID NO: 1104823 - protein, 9 aa, Homo Sapiens
EDTLTVVTV

SEQ ID NO: 1104824 - protein, 9 aa, Homo Sapiens
ALCRKVLED

SEQ ID NO: 1104825 - protein, 9 aa, Homo Sapiens
QLPVVREDL

SEQ ID NO: 1104826 - protein, 9 aa, Homo Sapiens
NMDLTFILL

SEQ ID NO: 1104827 - protein, 9 aa, Homo Sapiens
HRALSEQAA

SEQ ID NO: 1104828 - protein, 9 aa, Homo Sapiens
GKAFRQCTH

SEQ ID NO: 1104829 - protein, 9 aa, Homo Sapiens
SSSPASVQS

SEQ ID NO: 1104830 - protein, 9 aa, Homo Sapiens
SRRTGLQKK

SEQ ID NO: 1104831 - protein, 9 aa, Homo Sapiens
NGVAGSLLP

SEQ ID NO: 1104832 - protein, 9 aa, Homo Sapiens
SVGKAKADV

SEQ ID NO: 1104833 - protein, 9 aa, Homo Sapiens
SISPVEKQL

SEQ ID NO: 1104834 - protein, 9 aa, Homo Sapiens
LEIHKIMRM

SEQ ID NO: 1104835 - protein, 9 aa, Homo Sapiens
SRIHRGAHL

SEQ ID NO: 1104836 - protein, 9 aa, Homo Sapiens
GDWVWDGYP

SEQ ID NO: 1104837 - protein, 9 aa, Homo Sapiens
LHFPRDSPS

SEQ ID NO: 1104838 - protein, 9 aa, Homo Sapiens
TAGAADSAW

SEQ ID NO: 1104839 - protein, 9 aa, Homo Sapiens
NADGSASCI

SEQ ID NO: 1104840 - protein, 9 aa, Homo Sapiens
RCRCVCLRF

SEQ ID NO: 1104841 - protein, 9 aa, Homo Sapiens
SFHCSDRSN

SEQ ID NO: 1104842 - protein, 9 aa, Homo Sapiens
SSPPGRHWL

SEQ ID NO: 1104843 - protein, 9 aa, Homo Sapiens
FEAQRAQEH

SEQ ID NO: 1104844 - protein, 9 aa, Homo Sapiens
EELLKKCSL

SEQ ID NO: 1104845 - protein, 9 aa, Homo Sapiens
LSPCLGWPL

SEQ ID NO: 1104846 - protein, 9 aa, Homo Sapiens
VREDLLLGQ

SEQ ID NO: 1104847 - protein, 9 aa, Homo Sapiens
SWQVTPDQR

SEQ ID NO: 1104848 - protein, 9 aa, Homo Sapiens
GQGHLCVQR

SEQ ID NO: 1104849 - protein, 9 aa, Homo Sapiens
ASHGDTDGP

SEQ ID NO: 1104850 - protein, 9 aa, Homo Sapiens
PYMSPNREV

SEQ ID NO: 1104851 - protein, 9 aa, Homo Sapiens
STCCQFWSK

SEQ ID NO: 1104852 - protein, 9 aa, Homo Sapiens
RGLWPNTIY

SEQ ID NO: 1104853 - protein, 9 aa, Homo Sapiens
SWVWCMAPT

SEQ ID NO: 1104854 - protein, 9 aa, Homo Sapiens
RVVAALSEG

SEQ ID NO: 1104855 - protein, 9 aa, Homo Sapiens
FKSYRMIFS

SEQ ID NO: 1104856 - protein, 9 aa, Homo Sapiens
AVVAAAATA

SEQ ID NO: 1104857 - protein, 9 aa, Homo Sapiens
HRGGAPGSE

SEQ ID NO: 1104858 - protein, 9 aa, Homo Sapiens
IEMVAVKGI

SEQ ID NO: 1104859 - protein, 9 aa, Homo Sapiens
SFFDKHIWL

SEQ ID NO: 1104860 - protein, 9 aa, Homo Sapiens
GSLALSSEA

SEQ ID NO: 1104861 - protein, 9 aa, Homo Sapiens
REEAAFPGH

SEQ ID NO: 1104862 - protein, 9 aa, Homo Sapiens
TPGHTTGTS

SEQ ID NO: 1104863 - protein, 9 aa, Homo Sapiens
KRPRVALIV

SEQ ID NO: 1104864 - protein, 9 aa, Homo Sapiens
PSRLGGPKR

SEQ ID NO: 1104865 - protein, 9 aa, Homo Sapiens
HPRCVTREA

SEQ ID NO: 1104866 - protein, 9 aa, Homo Sapiens
RHGSVRCWV

SEQ ID NO: 1104867 - protein, 9 aa, Homo Sapiens
PMRWVLRKR

SEQ ID NO: 1104868 - protein, 9 aa, Homo Sapiens
KASRMSTAS

SEQ ID NO: 1104869 - protein, 9 aa, Homo Sapiens
HVGPGAPVP

SEQ ID NO: 1104870 - protein, 9 aa, Homo Sapiens
GTTPPATSS

SEQ ID NO: 1104871 - protein, 9 aa, Homo Sapiens
KAIMTSVFG

SEQ ID NO: 1104872 - protein, 9 aa, Homo Sapiens
TICSLDLRM

SEQ ID NO: 1104873 - protein, 9 aa, Homo Sapiens
CQNPEKLAL

SEQ ID NO: 1104874 - protein, 9 aa, Homo Sapiens
IRMPRRMQL

SEQ ID NO: 1104875 - protein, 9 aa, Homo Sapiens
KQPGSTGSR

SEQ ID NO: 1104876 - protein, 9 aa, Homo Sapiens
CCLSRLLPE

SEQ ID NO: 1104877 - protein, 9 aa, Homo Sapiens
VPYMSPNRE

SEQ ID NO: 1104878 - protein, 9 aa, Homo Sapiens
NRGVPVIKW

SEQ ID NO: 1104879 - protein, 9 aa, Homo Sapiens
HSEPADNSR

SEQ ID NO: 1104880 - protein, 9 aa, Homo Sapiens
CPERRPEFS

SEQ ID NO: 1104881 - protein, 9 aa, Homo Sapiens
EWGHCQARC

SEQ ID NO: 1104882 - protein, 9 aa, Homo Sapiens
ASRMSTASH

SEQ ID NO: 1104883 - protein, 9 aa, Homo Sapiens
TRDAHLCPQ

SEQ ID NO: 1104884 - protein, 9 aa, Homo Sapiens
EATPKRSSS

SEQ ID NO: 1104885 - protein, 9 aa, Homo Sapiens
QHMQGHPNY

SEQ ID NO: 1104886 - protein, 9 aa, Homo Sapiens
FLTVMSADH

SEQ ID NO: 1104887 - protein, 9 aa, Homo Sapiens
KNSVVDRDN

SEQ ID NO: 1104888 - protein, 9 aa, Homo Sapiens
QKAMHVDAT

SEQ ID NO: 1104889 - protein, 9 aa, Homo Sapiens
AGLLRTFMC

SEQ ID NO: 1104890 - protein, 9 aa, Homo Sapiens
SSYLSYIRY

SEQ ID NO: 1104891 - protein, 9 aa, Homo Sapiens
PSDGNNTFF

SEQ ID NO: 1104892 - protein, 9 aa, Homo Sapiens
VVRAAQKIL

SEQ ID NO: 1104893 - protein, 9 aa, Homo Sapiens
LAAYPQTSG

SEQ ID NO: 1104894 - protein, 9 aa, Homo Sapiens
QVTPDQRKP

SEQ ID NO: 1104895 - protein, 9 aa, Homo Sapiens
LDGAITDVI

SEQ ID NO: 1104896 - protein, 9 aa, Homo Sapiens
TAPDAQAAQ

SEQ ID NO: 1104897 - protein, 9 aa, Homo Sapiens
DSFLHHLYY

SEQ ID NO: 1104898 - protein, 9 aa, Homo Sapiens
LGDGKKMDL

SEQ ID NO: 1104899 - protein, 9 aa, Homo Sapiens
SDSDHYQWF

SEQ ID NO: 1104900 - protein, 9 aa, Homo Sapiens
SLLAFIFFS

SEQ ID NO: 1104901 - protein, 9 aa, Homo Sapiens
DFITAAAMV

SEQ ID NO: 1104902 - protein, 9 aa, Homo Sapiens
ALRARQVLG

SEQ ID NO: 1104903 - protein, 9 aa, Homo Sapiens
PQSPSWPLQ

SEQ ID NO: 1104904 - protein, 9 aa, Homo Sapiens
LSVAKAATK

SEQ ID NO: 1104905 - protein, 9 aa, Homo Sapiens
LSGVKKPII

SEQ ID NO: 1104906 - protein, 9 aa, Homo Sapiens
HLLLSLGRH

SEQ ID NO: 1104907 - protein, 9 aa, Homo Sapiens
RICNLISMT

SEQ ID NO: 1104908 - protein, 9 aa, Homo Sapiens
PSMWAFLLS

SEQ ID NO: 1104909 - protein, 9 aa, Homo Sapiens
HLGFRLQDL

SEQ ID NO: 1104910 - protein, 9 aa, Homo Sapiens
GPASWREGC

SEQ ID NO: 1104911 - protein, 9 aa, Homo Sapiens
TDTVGIDAV

SEQ ID NO: 1104912 - protein, 9 aa, Homo Sapiens
KIIQWDIIA

SEQ ID NO: 1104913 - protein, 9 aa, Homo Sapiens
GGVPDPSPG

SEQ ID NO: 1104914 - protein, 9 aa, Homo Sapiens
PPGEKGNSG

SEQ ID NO: 1104915 - protein, 9 aa, Homo Sapiens
ASWREGCGA

SEQ ID NO: 1104916 - protein, 9 aa, Homo Sapiens
KVKIIQWDI

SEQ ID NO: 1104917 - protein, 9 aa, Homo Sapiens
DYVDDGLSR

SEQ ID NO: 1104918 - protein, 9 aa, Homo Sapiens
QFWMKVQRK

SEQ ID NO: 1104919 - protein, 9 aa, Homo Sapiens
RAGVNPAAR

SEQ ID NO: 1104920 - protein, 9 aa, Homo Sapiens
AREMALRAS

SEQ ID NO: 1104921 - protein, 9 aa, Homo Sapiens
LFTAVLSPV

SEQ ID NO: 1104922 - protein, 9 aa, Homo Sapiens
AWPGHFLKK

SEQ ID NO: 1104923 - protein, 9 aa, Homo Sapiens
LLFAHLGKY

SEQ ID NO: 1104924 - protein, 9 aa, Homo Sapiens
RTACVSPSI

SEQ ID NO: 1104925 - protein, 9 aa, Homo Sapiens
LRQVGLQIW

SEQ ID NO: 1104926 - protein, 9 aa, Homo Sapiens
EENNLGANN

SEQ ID NO: 1104927 - protein, 9 aa, Homo Sapiens
HTDTVGIDA

SEQ ID NO: 1104928 - protein, 9 aa, Homo Sapiens
CWVQDRNLR

SEQ ID NO: 1104929 - protein, 9 aa, Homo Sapiens
AGGRPYACT

SEQ ID NO: 1104930 - protein, 9 aa, Homo Sapiens
FFLRLGVIG

SEQ ID NO: 1104931 - protein, 9 aa, Homo Sapiens
RVIATHSPE

SEQ ID NO: 1104932 - protein, 9 aa, Homo Sapiens
GRGSIPPQH

SEQ ID NO: 1104933 - protein, 9 aa, Homo Sapiens
PTPPSSSKP

SEQ ID NO: 1104934 - protein, 9 aa, Homo Sapiens
TFAKFYCSV

SEQ ID NO: 1104935 - protein, 9 aa, Homo Sapiens
STGAEGQMG

SEQ ID NO: 1104936 - protein, 9 aa, Homo Sapiens
QYSVHPPPL

SEQ ID NO: 1104937 - protein, 9 aa, Homo Sapiens
TEEKWRNRL

SEQ ID NO: 1104938 - protein, 9 aa, Homo Sapiens
PTPTSALAL

SEQ ID NO: 1104939 - protein, 9 aa, Homo Sapiens
SWSPGCPFQ

SEQ ID NO: 1104940 - protein, 9 aa, Homo Sapiens
ENDRGSVSG

SEQ ID NO: 1104941 - protein, 9 aa, Homo Sapiens
LGTALMGPR

SEQ ID NO: 1104942 - protein, 9 aa, Homo Sapiens
VAPLLRKTY

SEQ ID NO: 1104943 - protein, 9 aa, Homo Sapiens
TEIKWLSRR

SEQ ID NO: 1104944 - protein, 9 aa, Homo Sapiens
ASKGSLDCL

SEQ ID NO: 1104945 - protein, 9 aa, Homo Sapiens
IYFTVDGDD

SEQ ID NO: 1104946 - protein, 9 aa, Homo Sapiens
VGKIEFEGL

SEQ ID NO: 1104947 - protein, 9 aa, Homo Sapiens
ANIHELAWK

SEQ ID NO: 1104948 - protein, 9 aa, Homo Sapiens
PKLQPGFGG

SEQ ID NO: 1104949 - protein, 9 aa, Homo Sapiens
HNVEMFMNI

SEQ ID NO: 1104950 - protein, 9 aa, Homo Sapiens
FGNNYYSLF

SEQ ID NO: 1104951 - protein, 9 aa, Homo Sapiens
PIQEEYEGI

SEQ ID NO: 1104952 - protein, 9 aa, Homo Sapiens
HMSRIHRGA

SEQ ID NO: 1104953 - protein, 9 aa, Homo Sapiens
CSGDEQGSD

SEQ ID NO: 1104954 - protein, 9 aa, Homo Sapiens
IPSPIDTVL

SEQ ID NO: 1104955 - protein, 9 aa, Homo Sapiens
YHGRDLPYH

SEQ ID NO: 1104956 - protein, 9 aa, Homo Sapiens
HFHQSTKLI

SEQ ID NO: 1104957 - protein, 9 aa, Homo Sapiens
HSEYPMSSS

SEQ ID NO: 1104958 - protein, 9 aa, Homo Sapiens
DKHVAFGKV

SEQ ID NO: 1104959 - protein, 9 aa, Homo Sapiens
GGHPQPRPS

SEQ ID NO: 1104960 - protein, 9 aa, Homo Sapiens
EMREYAGGC

SEQ ID NO: 1104961 - protein, 9 aa, Homo Sapiens
ATLGPLRGW

SEQ ID NO: 1104962 - protein, 9 aa, Homo Sapiens
LRELKYIHS

SEQ ID NO: 1104963 - protein, 9 aa, Homo Sapiens
LCPQQHVLG

SEQ ID NO: 1104964 - protein, 9 aa, Homo Sapiens
QFLQVSVHH

SEQ ID NO: 1104965 - protein, 9 aa, Homo Sapiens
YEARSHHND

SEQ ID NO: 1104966 - protein, 9 aa, Homo Sapiens
EVSVCENNP

SEQ ID NO: 1104967 - protein, 9 aa, Homo Sapiens
GSSTASAAT

SEQ ID NO: 1104968 - protein, 9 aa, Homo Sapiens
PRSPASPAH

SEQ ID NO: 1104969 - protein, 9 aa, Homo Sapiens
CGRAFNQNM

SEQ ID NO: 1104970 - protein, 9 aa, Homo Sapiens
SRRLVLKRF

SEQ ID NO: 1104971 - protein, 9 aa, Homo Sapiens
LIVGCIAIG

SEQ ID NO: 1104972 - protein, 9 aa, Homo Sapiens
HLALQRPAA

SEQ ID NO: 1104973 - protein, 9 aa, Homo Sapiens
DKKYIKDYY

SEQ ID NO: 1104974 - protein, 9 aa, Homo Sapiens
AAVVAAAAT

SEQ ID NO: 1104975 - protein, 9 aa, Homo Sapiens
TSPLPSPHG

SEQ ID NO: 1104976 - protein, 9 aa, Homo Sapiens
TAGQEQYRT

SEQ ID NO: 1104977 - protein, 9 aa, Homo Sapiens
VEPLLVRHP

SEQ ID NO: 1104978 - protein, 9 aa, Homo Sapiens
PHQQDPGGV

SEQ ID NO: 1104979 - protein, 9 aa, Homo Sapiens
HSMGSRQPR

SEQ ID NO: 1104980 - protein, 9 aa, Homo Sapiens
STSLSAGYN

SEQ ID NO: 1104981 - protein, 9 aa, Homo Sapiens
LSEAPHVDG

SEQ ID NO: 1104982 - protein, 9 aa, Homo Sapiens
REVSQPDWM

SEQ ID NO: 1104983 - protein, 9 aa, Homo Sapiens
CWPSFSWTI

SEQ ID NO: 1104984 - protein, 9 aa, Homo Sapiens
LWRPCWATD

SEQ ID NO: 1104985 - protein, 9 aa, Homo Sapiens
LCNPKPWSK

SEQ ID NO: 1104986 - protein, 9 aa, Homo Sapiens
VLGVTCSRP

SEQ ID NO: 1104987 - protein, 9 aa, Homo Sapiens
TKQAPPSCV

SEQ ID NO: 1104988 - protein, 9 aa, Homo Sapiens
QGPLKSMNL

SEQ ID NO: 1104989 - protein, 9 aa, Homo Sapiens
EPAEPPPRP

SEQ ID NO: 1104990 - protein, 9 aa, Homo Sapiens
PPPEASCLF

SEQ ID NO: 1104991 - protein, 9 aa, Homo Sapiens
GPPSNSTNP

SEQ ID NO: 1104992 - protein, 9 aa, Homo Sapiens
TAPDYSLRV

SEQ ID NO: 1104993 - protein, 9 aa, Homo Sapiens
TPAQSFLAQ

SEQ ID NO: 1104994 - protein, 9 aa, Homo Sapiens
LPRVLPRSL

SEQ ID NO: 1104995 - protein, 9 aa, Homo Sapiens
RPKHSHHCS

SEQ ID NO: 1104996 - protein, 9 aa, Homo Sapiens
LSEQAAPQS

SEQ ID NO: 1104997 - protein, 9 aa, Homo Sapiens
YDVESFLFY

SEQ ID NO: 1104998 - protein, 9 aa, Homo Sapiens
RASALCVLS

SEQ ID NO: 1104999 - protein, 9 aa, Homo Sapiens
KQKRSRSTT

SEQ ID NO: 1105000 - protein, 9 aa, Homo Sapiens
KLWENDRGS

SEQ ID NO: 1105001 - protein, 9 aa, Homo Sapiens
STASHSFMA

SEQ ID NO: 1105002 - protein, 9 aa, Homo Sapiens
GLIAPMKIC

SEQ ID NO: 1105003 - protein, 9 aa, Homo Sapiens
PPHTDYTWS

SEQ ID NO: 1105004 - protein, 9 aa, Homo Sapiens
LMWMNMNIM

SEQ ID NO: 1105005 - protein, 9 aa, Homo Sapiens
DGPPRIELA

SEQ ID NO: 1105006 - protein, 9 aa, Homo Sapiens
PEVSSCGQT

SEQ ID NO: 1105007 - protein, 9 aa, Homo Sapiens
HSLVCPEIV

SEQ ID NO: 1105008 - protein, 9 aa, Homo Sapiens
IPGLQLVNP

SEQ ID NO: 1105009 - protein, 9 aa, Homo Sapiens
TSCGAARPR

SEQ ID NO: 1105010 - protein, 9 aa, Homo Sapiens
ASVQSKDFL

SEQ ID NO: 1105011 - protein, 9 aa, Homo Sapiens
TCERAHTRR

SEQ ID NO: 1105012 - protein, 9 aa, Homo Sapiens
SLSSARHPH

SEQ ID NO: 1105013 - protein, 9 aa, Homo Sapiens
RVPDTHVTL

SEQ ID NO: 1105014 - protein, 9 aa, Homo Sapiens
GRGEGSRDL

SEQ ID NO: 1105015 - protein, 9 aa, Homo Sapiens
SCGRCMRVN

SEQ ID NO: 1105016 - protein, 9 aa, Homo Sapiens
LGARPSPSQ

SEQ ID NO: 1105017 - protein, 9 aa, Homo Sapiens
TRGPSYHGR

SEQ ID NO: 1105018 - protein, 9 aa, Homo Sapiens
CQSSPRISE

SEQ ID NO: 1105019 - protein, 9 aa, Homo Sapiens
HWFSNLEST

SEQ ID NO: 1105020 - protein, 9 aa, Homo Sapiens
SLSAGYNSS

SEQ ID NO: 1105021 - protein, 9 aa, Homo Sapiens
TLEPYEWDH

SEQ ID NO: 1105022 - protein, 9 aa, Homo Sapiens
FCNHGKHST

SEQ ID NO: 1105023 - protein, 9 aa, Homo Sapiens
EADLADGAH

SEQ ID NO: 1105024 - protein, 9 aa, Homo Sapiens
GGTSSSSGP

SEQ ID NO: 1105025 - protein, 9 aa, Homo Sapiens
SVQQALHSG

SEQ ID NO: 1105026 - protein, 9 aa, Homo Sapiens
MESRTLGTA

SEQ ID NO: 1105027 - protein, 9 aa, Homo Sapiens
SKGRGSIPP

SEQ ID NO: 1105028 - protein, 9 aa, Homo Sapiens
ISRGDCEGI

SEQ ID NO: 1105029 - protein, 9 aa, Homo Sapiens
TLSDLLCNP

SEQ ID NO: 1105030 - protein, 9 aa, Homo Sapiens
SDFHPVKKL

SEQ ID NO: 1105031 - protein, 9 aa, Homo Sapiens
CRESERDYN

SEQ ID NO: 1105032 - protein, 9 aa, Homo Sapiens
ELCNTFREI

SEQ ID NO: 1105033 - protein, 9 aa, Homo Sapiens
SVNTCLEKT

SEQ ID NO: 1105034 - protein, 9 aa, Homo Sapiens
EVKALTKLE

SEQ ID NO: 1105035 - protein, 9 aa, Homo Sapiens
GCCAHCLGA

SEQ ID NO: 1105036 - protein, 9 aa, Homo Sapiens
LAFSCDLLA

SEQ ID NO: 1105037 - protein, 9 aa, Homo Sapiens
GLPRPWSRP

SEQ ID NO: 1105038 - protein, 9 aa, Homo Sapiens
QTSLPLSSS

SEQ ID NO: 1105039 - protein, 9 aa, Homo Sapiens
AKFYCSVDY

SEQ ID NO: 1105040 - protein, 9 aa, Homo Sapiens
EASCLFPPF

SEQ ID NO: 1105041 - protein, 9 aa, Homo Sapiens
NTFFCNQCS

SEQ ID NO: 1105042 - protein, 9 aa, Homo Sapiens
KPRREKRPA

SEQ ID NO: 1105043 - protein, 9 aa, Homo Sapiens
SGHNTWLSY

SEQ ID NO: 1105044 - protein, 9 aa, Homo Sapiens
TAHKVIHTG

SEQ ID NO: 1105045 - protein, 9 aa, Homo Sapiens
ASWWPSRRW

SEQ ID NO: 1105046 - protein, 9 aa, Homo Sapiens
AFKTTAGPC

SEQ ID NO: 1105047 - protein, 9 aa, Homo Sapiens
FTMRPGTRH

SEQ ID NO: 1105048 - protein, 9 aa, Homo Sapiens
GLDGGLAVS

SEQ ID NO: 1105049 - protein, 9 aa, Homo Sapiens
FPPLIPLLG

SEQ ID NO: 1105050 - protein, 9 aa, Homo Sapiens
SPFSTVCRE

SEQ ID NO: 1105051 - protein, 9 aa, Homo Sapiens
ASSAWGSAS

SEQ ID NO: 1105052 - protein, 9 aa, Homo Sapiens
PGGLGTAQL

SEQ ID NO: 1105053 - protein, 9 aa, Homo Sapiens
HYQQIKENP

SEQ ID NO: 1105054 - protein, 9 aa, Homo Sapiens
LDDKHVAFG

SEQ ID NO: 1105055 - protein, 9 aa, Homo Sapiens
NVGFSLMKD

SEQ ID NO: 1105056 - protein, 9 aa, Homo Sapiens
RGYGGNAPF

SEQ ID NO: 1105057 - protein, 9 aa, Homo Sapiens
TPLIITLNC

SEQ ID NO: 1105058 - protein, 9 aa, Homo Sapiens
KKSKKSSHC

SEQ ID NO: 1105059 - protein, 9 aa, Homo Sapiens
TRRAVQKRG

SEQ ID NO: 1105060 - protein, 9 aa, Homo Sapiens
TAVLGKTPL

SEQ ID NO: 1105061 - protein, 9 aa, Homo Sapiens
KCADICALG

SEQ ID NO: 1105062 - protein, 9 aa, Homo Sapiens
NTHAGGTGL

SEQ ID NO: 1105063 - protein, 9 aa, Homo Sapiens
RYSAVKYSG

SEQ ID NO: 1105064 - protein, 9 aa, Homo Sapiens
PENDFKHHM

SEQ ID NO: 1105065 - protein, 9 aa, Homo Sapiens
SSPLVRAPN

SEQ ID NO: 1105066 - protein, 9 aa, Homo Sapiens
RWDILAIVL

SEQ ID NO: 1105067 - protein, 9 aa, Homo Sapiens
PQKRKEHRD

SEQ ID NO: 1105068 - protein, 9 aa, Homo Sapiens
NQCLEMDVE

SEQ ID NO: 1105069 - protein, 9 aa, Homo Sapiens
HPPPLGSRE

SEQ ID NO: 1105070 - protein, 9 aa, Homo Sapiens
GTISLQYKK

SEQ ID NO: 1105071 - protein, 9 aa, Homo Sapiens
FFPPECPQQ

SEQ ID NO: 1105072 - protein, 9 aa, Homo Sapiens
AYTTQPTQG

SEQ ID NO: 1105073 - protein, 9 aa, Homo Sapiens
HLHCPCHLP

SEQ ID NO: 1105074 - protein, 9 aa, Homo Sapiens
VFQIYEQHT

SEQ ID NO: 1105075 - protein, 9 aa, Homo Sapiens
WISENPQKR

SEQ ID NO: 1105076 - protein, 9 aa, Homo Sapiens
WTTRYFQSR

SEQ ID NO: 1105077 - protein, 9 aa, Homo Sapiens
FKHHMSQNH

SEQ ID NO: 1105078 - protein, 9 aa, Homo Sapiens
QRVTVMCGH

SEQ ID NO: 1105079 - protein, 9 aa, Homo Sapiens
NAPPGFFLR

SEQ ID NO: 1105080 - protein, 9 aa, Homo Sapiens
CLGWPLDQD

SEQ ID NO: 1105081 - protein, 9 aa, Homo Sapiens
SLPRGPRCP

SEQ ID NO: 1105082 - protein, 9 aa, Homo Sapiens
GGVSTSWGP

SEQ ID NO: 1105083 - protein, 9 aa, Homo Sapiens
PLIPLLGDQ

SEQ ID NO: 1105084 - protein, 9 aa, Homo Sapiens
DQRRHGTEG

SEQ ID NO: 1105085 - protein, 9 aa, Homo Sapiens
WPEVWKEVR

SEQ ID NO: 1105086 - protein, 9 aa, Homo Sapiens
HTEFGSGVV

SEQ ID NO: 1105087 - protein, 9 aa, Homo Sapiens
LGLCPPLLA

SEQ ID NO: 1105088 - protein, 9 aa, Homo Sapiens
HHMSQNHSR

SEQ ID NO: 1105089 - protein, 9 aa, Homo Sapiens
LALLSFWPG

SEQ ID NO: 1105090 - protein, 9 aa, Homo Sapiens
RHRALSEQA

SEQ ID NO: 1105091 - protein, 9 aa, Homo Sapiens
FFLHKEFLL

SEQ ID NO: 1105092 - protein, 9 aa, Homo Sapiens
ALGRAAQSS

SEQ ID NO: 1105093 - protein, 9 aa, Homo Sapiens
EPADNSRGC

SEQ ID NO: 1105094 - protein, 9 aa, Homo Sapiens
WTLSPQGPR

SEQ ID NO: 1105095 - protein, 9 aa, Homo Sapiens
ACTQCGRRF

SEQ ID NO: 1105096 - protein, 9 aa, Homo Sapiens
RGRSSAPKT

SEQ ID NO: 1105097 - protein, 9 aa, Homo Sapiens
VVHELGVAV

SEQ ID NO: 1105098 - protein, 9 aa, Homo Sapiens
QPTWGCRKP

SEQ ID NO: 1105099 - protein, 9 aa, Homo Sapiens
HGTEGFERP

SEQ ID NO: 1105100 - protein, 9 aa, Homo Sapiens
DQAQTKIQA

SEQ ID NO: 1105101 - protein, 9 aa, Homo Sapiens
EELRQIKII

SEQ ID NO: 1105102 - protein, 9 aa, Homo Sapiens
RSADIKVIM

SEQ ID NO: 1105103 - protein, 9 aa, Homo Sapiens
GGQRSHVGP

SEQ ID NO: 1105104 - protein, 9 aa, Homo Sapiens
ESVRRAAQL

SEQ ID NO: 1105105 - protein, 9 aa, Homo Sapiens
PSTPASPGN

SEQ ID NO: 1105106 - protein, 9 aa, Homo Sapiens
SDRSHLQGT

SEQ ID NO: 1105107 - protein, 9 aa, Homo Sapiens
PPGCTQGMV

SEQ ID NO: 1105108 - protein, 9 aa, Homo Sapiens
VSPEVTNSS

SEQ ID NO: 1105109 - protein, 9 aa, Homo Sapiens
GLDYLPSCY

SEQ ID NO: 1105110 - protein, 9 aa, Homo Sapiens
APQSCSSLN

SEQ ID NO: 1105111 - protein, 9 aa, Homo Sapiens
LMGGLGRFQ

SEQ ID NO: 1105112 - protein, 9 aa, Homo Sapiens
ELANSLDAT

SEQ ID NO: 1105113 - protein, 9 aa, Homo Sapiens
CPQVLSAGA

SEQ ID NO: 1105114 - protein, 9 aa, Homo Sapiens
CMRVNMPRP

SEQ ID NO: 1105115 - protein, 9 aa, Homo Sapiens
LSKACLPLG

SEQ ID NO: 1105116 - protein, 9 aa, Homo Sapiens
RSSAPKTRE

SEQ ID NO: 1105117 - protein, 9 aa, Homo Sapiens
RVLCTRPPL

SEQ ID NO: 1105118 - protein, 9 aa, Homo Sapiens
VWMLMTALS

SEQ ID NO: 1105119 - protein, 9 aa, Homo Sapiens
GILLVMALD

SEQ ID NO: 1105120 - protein, 9 aa, Homo Sapiens
VFSRPILAS

SEQ ID NO: 1105121 - protein, 9 aa, Homo Sapiens
SLGALSLRP

SEQ ID NO: 1105122 - protein, 9 aa, Homo Sapiens
KITRPGVKL

SEQ ID NO: 1105123 - protein, 9 aa, Homo Sapiens
EEEEADDEE

SEQ ID NO: 1105124 - protein, 9 aa, Homo Sapiens
QPPSPSSLL

SEQ ID NO: 1105125 - protein, 9 aa, Homo Sapiens
RSYLCNESC

SEQ ID NO: 1105126 - protein, 9 aa, Homo Sapiens
HGKTIEIGN

SEQ ID NO: 1105127 - protein, 9 aa, Homo Sapiens
AMGVGWWVQ

SEQ ID NO: 1105128 - protein, 9 aa, Homo Sapiens
CNNCNQVVK

SEQ ID NO: 1105129 - protein, 9 aa, Homo Sapiens
KLSCIINRC

SEQ ID NO: 1105130 - protein, 9 aa, Homo Sapiens
YIFILSGNG

SEQ ID NO: 1105131 - protein, 9 aa, Homo Sapiens
PSSTSSSLT

SEQ ID NO: 1105132 - protein, 9 aa, Homo Sapiens
SLRIFKWMP

SEQ ID NO: 1105133 - protein, 9 aa, Homo Sapiens
RRLVLSSTL

SEQ ID NO: 1105134 - protein, 9 aa, Homo Sapiens
GGQGGGGLL

SEQ ID NO: 1105135 - protein, 9 aa, Homo Sapiens
AKKTAAKKK

SEQ ID NO: 1105136 - protein, 9 aa, Homo Sapiens
QEQYRTITT

SEQ ID NO: 1105137 - protein, 9 aa, Homo Sapiens
TVGHFSQAR

SEQ ID NO: 1105138 - protein, 9 aa, Homo Sapiens
TLVTIDIQH

SEQ ID NO: 1105139 - protein, 9 aa, Homo Sapiens
SSPRISELT

SEQ ID NO: 1105140 - protein, 9 aa, Homo Sapiens
VYTRHALTR

SEQ ID NO: 1105141 - protein, 9 aa, Homo Sapiens
PLLEFAQGR

SEQ ID NO: 1105142 - protein, 9 aa, Homo Sapiens
WGKKVGEKL

SEQ ID NO: 1105143 - protein, 9 aa, Homo Sapiens
ACSRGTWTG

SEQ ID NO: 1105144 - protein, 9 aa, Homo Sapiens
EPRRGTSVL

SEQ ID NO: 1105145 - protein, 9 aa, Homo Sapiens
NGILGTPGI

SEQ ID NO: 1105146 - protein, 9 aa, Homo Sapiens
RCWRSCSAS

SEQ ID NO: 1105147 - protein, 9 aa, Homo Sapiens
RTKARVLNT

SEQ ID NO: 1105148 - protein, 9 aa, Homo Sapiens
CASSRGASC

SEQ ID NO: 1105149 - protein, 9 aa, Homo Sapiens
EGRHGSVRC

SEQ ID NO: 1105150 - protein, 9 aa, Homo Sapiens
TLAELRILM

SEQ ID NO: 1105151 - protein, 9 aa, Homo Sapiens
GSPGANGIL

SEQ ID NO: 1105152 - protein, 9 aa, Homo Sapiens
MALRASLEM

SEQ ID NO: 1105153 - protein, 9 aa, Homo Sapiens
EPSLVLTLG

SEQ ID NO: 1105154 - protein, 9 aa, Homo Sapiens
PLGMAPALR

SEQ ID NO: 1105155 - protein, 9 aa, Homo Sapiens
SSSLTGTTM

SEQ ID NO: 1105156 - protein, 9 aa, Homo Sapiens
INHFFVTPQ

SEQ ID NO: 1105157 - protein, 9 aa, Homo Sapiens
LELLLRAGV

SEQ ID NO: 1105158 - protein, 9 aa, Homo Sapiens
SHWGALMDS

SEQ ID NO: 1105159 - protein, 9 aa, Homo Sapiens
HFLLILCCV

SEQ ID NO: 1105160 - protein, 9 aa, Homo Sapiens
FIIKCKPLF

SEQ ID NO: 1105161 - protein, 9 aa, Homo Sapiens
ILMELRGAE

SEQ ID NO: 1105162 - protein, 9 aa, Homo Sapiens
YYCLSDFIT

SEQ ID NO: 1105163 - protein, 9 aa, Homo Sapiens
NYPAIPSDT

SEQ ID NO: 1105164 - protein, 9 aa, Homo Sapiens
EDLLYLRTS

SEQ ID NO: 1105165 - protein, 9 aa, Homo Sapiens
ARALQLALT

SEQ ID NO: 1105166 - protein, 9 aa, Homo Sapiens
SAASETYTS

SEQ ID NO: 1105167 - protein, 9 aa, Homo Sapiens
GWTRAAGRW

SEQ ID NO: 1105168 - protein, 9 aa, Homo Sapiens
VSAGAPSSK

SEQ ID NO: 1105169 - protein, 9 aa, Homo Sapiens
MPLSKLMKA

SEQ ID NO: 1105170 - protein, 9 aa, Homo Sapiens
AGRSKPATL

SEQ ID NO: 1105171 - protein, 9 aa, Homo Sapiens
PHWTLSPQG

SEQ ID NO: 1105172 - protein, 9 aa, Homo Sapiens
CHPLAVASW

SEQ ID NO: 1105173 - protein, 9 aa, Homo Sapiens
MPPPEVTLV

SEQ ID NO: 1105174 - protein, 9 aa, Homo Sapiens
LGCHLFPRV

SEQ ID NO: 1105175 - protein, 9 aa, Homo Sapiens
PADDPLHHT

SEQ ID NO: 1105176 - protein, 9 aa, Homo Sapiens
VLPMRWVLR

SEQ ID NO: 1105177 - protein, 9 aa, Homo Sapiens
HNPWTMSPF

SEQ ID NO: 1105178 - protein, 9 aa, Homo Sapiens
GLEGCRPFA

SEQ ID NO: 1105179 - protein, 9 aa, Homo Sapiens
EMEKIKQEL

SEQ ID NO: 1105180 - protein, 9 aa, Homo Sapiens
FIPGLQLVN

SEQ ID NO: 1105181 - protein, 9 aa, Homo Sapiens
QRAWEWAKS

SEQ ID NO: 1105182 - protein, 9 aa, Homo Sapiens
APLGPAVLE

SEQ ID NO: 1105183 - protein, 9 aa, Homo Sapiens
NSRGCGGSF

SEQ ID NO: 1105184 - protein, 9 aa, Homo Sapiens
CSRQPGIHL

SEQ ID NO: 1105185 - protein, 9 aa, Homo Sapiens
EARSHHNDI

SEQ ID NO: 1105186 - protein, 9 aa, Homo Sapiens
KETPLAPAK

SEQ ID NO: 1105187 - protein, 9 aa, Homo Sapiens
SWDQRRHGT

SEQ ID NO: 1105188 - protein, 9 aa, Homo Sapiens
DPGGVPRQD

SEQ ID NO: 1105189 - protein, 9 aa, Homo Sapiens
ATQHGHEAV

SEQ ID NO: 1105190 - protein, 9 aa, Homo Sapiens
RTLGTALMG

SEQ ID NO: 1105191 - protein, 9 aa, Homo Sapiens
LGADRGSWE

SEQ ID NO: 1105192 - protein, 9 aa, Homo Sapiens
LALSSEALV

SEQ ID NO: 1105193 - protein, 9 aa, Homo Sapiens
LLQLKRAKK

SEQ ID NO: 1105194 - protein, 9 aa, Homo Sapiens
VPGPPPRPQ

SEQ ID NO: 1105195 - protein, 9 aa, Homo Sapiens
RLGGPKRSA

SEQ ID NO: 1105196 - protein, 9 aa, Homo Sapiens
IPSSQLATK

SEQ ID NO: 1105197 - protein, 9 aa, Homo Sapiens
GAARPRRTR

SEQ ID NO: 1105198 - protein, 9 aa, Homo Sapiens
TRASGEKVL

SEQ ID NO: 1105199 - protein, 9 aa, Homo Sapiens
QKCKSVNTC

SEQ ID NO: 1105200 - protein, 9 aa, Homo Sapiens
TALSYPWAL

SEQ ID NO: 1105201 - protein, 9 aa, Homo Sapiens
ARASWWPSR

SEQ ID NO: 1105202 - protein, 9 aa, Homo Sapiens
ASLRIAGCR

SEQ ID NO: 1105203 - protein, 9 aa, Homo Sapiens
GRQGYPKEG

SEQ ID NO: 1105204 - protein, 9 aa, Homo Sapiens
QLDKMVRRQ

SEQ ID NO: 1105205 - protein, 9 aa, Homo Sapiens
PPRGPRAPD

SEQ ID NO: 1105206 - protein, 9 aa, Homo Sapiens
PLAPCPPLE

SEQ ID NO: 1105207 - protein, 9 aa, Homo Sapiens
VAPRQTPGQ

SEQ ID NO: 1105208 - protein, 9 aa, Homo Sapiens
QKVVLLLLE

SEQ ID NO: 1105209 - protein, 9 aa, Homo Sapiens
CWVKAELHR

SEQ ID NO: 1105210 - protein, 9 aa, Homo Sapiens
QLGQGLGVA

SEQ ID NO: 1105211 - protein, 9 aa, Homo Sapiens
QLDVVEWSP

SEQ ID NO: 1105212 - protein, 9 aa, Homo Sapiens
STGPPSNST

SEQ ID NO: 1105213 - protein, 9 aa, Homo Sapiens
RVALHSEPA

SEQ ID NO: 1105214 - protein, 9 aa, Homo Sapiens
PCHAAALAL

SEQ ID NO: 1105215 - protein, 9 aa, Homo Sapiens
LTNTRVIVL

SEQ ID NO: 1105216 - protein, 9 aa, Homo Sapiens
HKQERKELE

SEQ ID NO: 1105217 - protein, 9 aa, Homo Sapiens
HHLHARLQR

SEQ ID NO: 1105218 - protein, 9 aa, Homo Sapiens
HGPARPLEV

SEQ ID NO: 1105219 - protein, 9 aa, Homo Sapiens
DHQVSAGAP

SEQ ID NO: 1105220 - protein, 9 aa, Homo Sapiens
IFCNLSLYL

SEQ ID NO: 1105221 - protein, 9 aa, Homo Sapiens
SEMALPSVD

SEQ ID NO: 1105222 - protein, 9 aa, Homo Sapiens
VMRETIRTL

SEQ ID NO: 1105223 - protein, 9 aa, Homo Sapiens
EPPGRGVPA

SEQ ID NO: 1105224 - protein, 9 aa, Homo Sapiens
AIGQDQRRL

SEQ ID NO: 1105225 - protein, 9 aa, Homo Sapiens
CLFMTKTSN

SEQ ID NO: 1105226 - protein, 9 aa, Homo Sapiens
KINFIPGLQ

SEQ ID NO: 1105227 - protein, 9 aa, Homo Sapiens
HVLQELIDS

SEQ ID NO: 1105228 - protein, 9 aa, Homo Sapiens
PGWEEASQV

SEQ ID NO: 1105229 - protein, 9 aa, Homo Sapiens
PLLSTCCQF

SEQ ID NO: 1105230 - protein, 9 aa, Homo Sapiens
SSPCHSPRI

SEQ ID NO: 1105231 - protein, 9 aa, Homo Sapiens
LDGSLGMEA

SEQ ID NO: 1105232 - protein, 9 aa, Homo Sapiens
HAFGRQPYF

SEQ ID NO: 1105233 - protein, 9 aa, Homo Sapiens
YFMACFLPQ

SEQ ID NO: 1105234 - protein, 9 aa, Homo Sapiens
TKHLMLEKH

SEQ ID NO: 1105235 - protein, 9 aa, Homo Sapiens
ALERCLSIG

SEQ ID NO: 1105236 - protein, 9 aa, Homo Sapiens
AVQRASKTV

SEQ ID NO: 1105237 - protein, 9 aa, Homo Sapiens
GGKETLVTI

SEQ ID NO: 1105238 - protein, 9 aa, Homo Sapiens
LSLLLDQRQ

SEQ ID NO: 1105239 - protein, 9 aa, Homo Sapiens
GNFCTFFCR

SEQ ID NO: 1105240 - protein, 9 aa, Homo Sapiens
VHWCVNPSR

SEQ ID NO: 1105241 - protein, 9 aa, Homo Sapiens
RTAKDVNQD

SEQ ID NO: 1105242 - protein, 9 aa, Homo Sapiens
FIRWVVDSE

SEQ ID NO: 1105243 - protein, 9 aa, Homo Sapiens
CRPACTCIS

SEQ ID NO: 1105244 - protein, 9 aa, Homo Sapiens
RNLGTTSSL

SEQ ID NO: 1105245 - protein, 9 aa, Homo Sapiens
LWFTHHSLF

SEQ ID NO: 1105246 - protein, 9 aa, Homo Sapiens
GRGVPPRAP

SEQ ID NO: 1105247 - protein, 9 aa, Homo Sapiens
IDAYGYQQT

SEQ ID NO: 1105248 - protein, 9 aa, Homo Sapiens
TTSPWPSPQ

SEQ ID NO: 1105249 - protein, 9 aa, Homo Sapiens
PSSKATENH

SEQ ID NO: 1105250 - protein, 9 aa, Homo Sapiens
SGLTDSARA

SEQ ID NO: 1105251 - protein, 9 aa, Homo Sapiens
TCYYNFTNR

SEQ ID NO: 1105252 - protein, 9 aa, Homo Sapiens
GLCRRPQPS

SEQ ID NO: 1105253 - protein, 9 aa, Homo Sapiens
IGATLARHL

SEQ ID NO: 1105254 - protein, 9 aa, Homo Sapiens
EGLGIASTL

SEQ ID NO: 1105255 - protein, 9 aa, Homo Sapiens
PNIEETHWF

SEQ ID NO: 1105256 - protein, 9 aa, Homo Sapiens
PKAIMTSVF

SEQ ID NO: 1105257 - protein, 9 aa, Homo Sapiens
QKARGAALQ

SEQ ID NO: 1105258 - protein, 9 aa, Homo Sapiens
ADSGHNTWL

SEQ ID NO: 1105259 - protein, 9 aa, Homo Sapiens
KIINPTISC

SEQ ID NO: 1105260 - protein, 9 aa, Homo Sapiens
PPAFPSRSH

SEQ ID NO: 1105261 - protein, 9 aa, Homo Sapiens
EVTNSSSSS

SEQ ID NO: 1105262 - protein, 9 aa, Homo Sapiens
CGSLMEGHH

SEQ ID NO: 1105263 - protein, 9 aa, Homo Sapiens
HRSSALQGK

SEQ ID NO: 1105264 - protein, 9 aa, Homo Sapiens
YALSNKNLL

SEQ ID NO: 1105265 - protein, 9 aa, Homo Sapiens
EHRAQLVCS

SEQ ID NO: 1105266 - protein, 9 aa, Homo Sapiens
GRVLVHCQV

SEQ ID NO: 1105267 - protein, 9 aa, Homo Sapiens
RSLCGVGPQ

SEQ ID NO: 1105268 - protein, 9 aa, Homo Sapiens
GDDSLSPCL

SEQ ID NO: 1105269 - protein, 9 aa, Homo Sapiens
ISAYGHGLV

SEQ ID NO: 1105270 - protein, 9 aa, Homo Sapiens
GSWGQTDLT

SEQ ID NO: 1105271 - protein, 9 aa, Homo Sapiens
GFRLQDLSK

SEQ ID NO: 1105272 - protein, 9 aa, Homo Sapiens
YQNANSVEK

SEQ ID NO: 1105273 - protein, 9 aa, Homo Sapiens
DLQQKWNDM

SEQ ID NO: 1105274 - protein, 9 aa, Homo Sapiens
CPEIVSRVS

SEQ ID NO: 1105275 - protein, 9 aa, Homo Sapiens
STSRRTRPN

SEQ ID NO: 1105276 - protein, 9 aa, Homo Sapiens
LLGWARCYR

SEQ ID NO: 1105277 - protein, 9 aa, Homo Sapiens
KCRSKTLES

SEQ ID NO: 1105278 - protein, 9 aa, Homo Sapiens
RMGKRSVEE

SEQ ID NO: 1105279 - protein, 9 aa, Homo Sapiens
SCHFTACET

SEQ ID NO: 1105280 - protein, 9 aa, Homo Sapiens
DQVMDMMIA

SEQ ID NO: 1105281 - protein, 9 aa, Homo Sapiens
HHTSIPRRT

SEQ ID NO: 1105282 - protein, 9 aa, Homo Sapiens
RIQADLDYL

SEQ ID NO: 1105283 - protein, 9 aa, Homo Sapiens
IAPMKICTE

SEQ ID NO: 1105284 - protein, 9 aa, Homo Sapiens
NWQPCTPSL

SEQ ID NO: 1105285 - protein, 9 aa, Homo Sapiens
NVTASICNS

SEQ ID NO: 1105286 - protein, 9 aa, Homo Sapiens
AEKPWDANA

SEQ ID NO: 1105287 - protein, 9 aa, Homo Sapiens
GSESKLWEN

SEQ ID NO: 1105288 - protein, 9 aa, Homo Sapiens
LLSGSNPPI

SEQ ID NO: 1105289 - protein, 9 aa, Homo Sapiens
LSSSLRDLL

SEQ ID NO: 1105290 - protein, 9 aa, Homo Sapiens
RVAPLLRKT

SEQ ID NO: 1105291 - protein, 9 aa, Homo Sapiens
RICPATVIK

SEQ ID NO: 1105292 - protein, 9 aa, Homo Sapiens
RHGLQELRR

SEQ ID NO: 1105293 - protein, 9 aa, Homo Sapiens
GAMFFIGFA

SEQ ID NO: 1105294 - protein, 9 aa, Homo Sapiens
ICSSLNLSP

SEQ ID NO: 1105295 - protein, 9 aa, Homo Sapiens
GVKLWKKGE

SEQ ID NO: 1105296 - protein, 9 aa, Homo Sapiens
CNHGKHSTM

SEQ ID NO: 1105297 - protein, 9 aa, Homo Sapiens
LPNSLLVVL

SEQ ID NO: 1105298 - protein, 9 aa, Homo Sapiens
CNASIMCPL

SEQ ID NO: 1105299 - protein, 9 aa, Homo Sapiens
RNTMETHRL

SEQ ID NO: 1105300 - protein, 9 aa, Homo Sapiens
KNVGFSLMK

SEQ ID NO: 1105301 - protein, 9 aa, Homo Sapiens
LIKPETQNN

SEQ ID NO: 1105302 - protein, 9 aa, Homo Sapiens
CGGSFPCPC

SEQ ID NO: 1105303 - protein, 9 aa, Homo Sapiens
PAAMRAALA

SEQ ID NO: 1105304 - protein, 9 aa, Homo Sapiens
AHHHNPWTM

SEQ ID NO: 1105305 - protein, 9 aa, Homo Sapiens
LNGLENILQ

SEQ ID NO: 1105306 - protein, 9 aa, Homo Sapiens
PFIITNVVI

SEQ ID NO: 1105307 - protein, 9 aa, Homo Sapiens
KSTPVGPVA

SEQ ID NO: 1105308 - protein, 9 aa, Homo Sapiens
SSYSVYITE

SEQ ID NO: 1105309 - protein, 9 aa, Homo Sapiens
RGVRAEVFL

SEQ ID NO: 1105310 - protein, 9 aa, Homo Sapiens
VICSSLNLS

SEQ ID NO: 1105311 - protein, 9 aa, Homo Sapiens
FQCPHTSGF

SEQ ID NO: 1105312 - protein, 9 aa, Homo Sapiens
EELEGLGIA

SEQ ID NO: 1105313 - protein, 9 aa, Homo Sapiens
LSPQGPRIL

SEQ ID NO: 1105314 - protein, 9 aa, Homo Sapiens
QFSKDIIIS

SEQ ID NO: 1105315 - protein, 9 aa, Homo Sapiens
RRPALRLLC

SEQ ID NO: 1105316 - protein, 9 aa, Homo Sapiens
PPMPPPANP

SEQ ID NO: 1105317 - protein, 9 aa, Homo Sapiens
VQRWGKKVG

SEQ ID NO: 1105318 - protein, 9 aa, Homo Sapiens
LDLILYLVV

SEQ ID NO: 1105319 - protein, 9 aa, Homo Sapiens
TIEIGNSLP

SEQ ID NO: 1105320 - protein, 9 aa, Homo Sapiens
TTPLDSGYE

SEQ ID NO: 1105321 - protein, 9 aa, Homo Sapiens
GEEQRQRRR

SEQ ID NO: 1105322 - protein, 9 aa, Homo Sapiens
ASDRGSLAL

SEQ ID NO: 1105323 - protein, 9 aa, Homo Sapiens
QITKRTWRK

SEQ ID NO: 1105324 - protein, 9 aa, Homo Sapiens
TKGFSLLTS

SEQ ID NO: 1105325 - protein, 9 aa, Homo Sapiens
WMENEHVCG

SEQ ID NO: 1105326 - protein, 9 aa, Homo Sapiens
LSSEPVEPL

SEQ ID NO: 1105327 - protein, 9 aa, Homo Sapiens
PPAKKNKEN

SEQ ID NO: 1105328 - protein, 9 aa, Homo Sapiens
SDSPPLQDG

SEQ ID NO: 1105329 - protein, 9 aa, Homo Sapiens
LPYLYTSSS

SEQ ID NO: 1105330 - protein, 9 aa, Homo Sapiens
KSYALSNKN

SEQ ID NO: 1105331 - protein, 9 aa, Homo Sapiens
EQRQRRRQA

SEQ ID NO: 1105332 - protein, 9 aa, Homo Sapiens
ADAAEALFF

SEQ ID NO: 1105333 - protein, 9 aa, Homo Sapiens
MLQLPGCLN

SEQ ID NO: 1105334 - protein, 9 aa, Homo Sapiens
AGLQSDKEC

SEQ ID NO: 1105335 - protein, 9 aa, Homo Sapiens
SNPKRLGTG

SEQ ID NO: 1105336 - protein, 9 aa, Homo Sapiens
LTRMMSPKI

SEQ ID NO: 1105337 - protein, 9 aa, Homo Sapiens
NIACITCTD

SEQ ID NO: 1105338 - protein, 9 aa, Homo Sapiens
VSIDNWCWR

SEQ ID NO: 1105339 - protein, 9 aa, Homo Sapiens
CSSLNAKPH

SEQ ID NO: 1105340 - protein, 9 aa, Homo Sapiens
DQKECVYEM

SEQ ID NO: 1105341 - protein, 9 aa, Homo Sapiens
NLPKALSQY

SEQ ID NO: 1105342 - protein, 9 aa, Homo Sapiens
AAGVQRVGL

SEQ ID NO: 1105343 - protein, 9 aa, Homo Sapiens
DVKTEQVPQ

SEQ ID NO: 1105344 - protein, 9 aa, Homo Sapiens
ILSVCLEQC

SEQ ID NO: 1105345 - protein, 9 aa, Homo Sapiens
ENIQSSLKQ

SEQ ID NO: 1105346 - protein, 9 aa, Homo Sapiens
HSYILVKNH

SEQ ID NO: 1105347 - protein, 9 aa, Homo Sapiens
QHGVQEAPP

SEQ ID NO: 1105348 - protein, 9 aa, Homo Sapiens
QPRGLVGCP

SEQ ID NO: 1105349 - protein, 9 aa, Homo Sapiens
VNELRRPAR

SEQ ID NO: 1105350 - protein, 9 aa, Homo Sapiens
SATRSTRSP

SEQ ID NO: 1105351 - protein, 9 aa, Homo Sapiens
ALPNSLLVV

SEQ ID NO: 1105352 - protein, 9 aa, Homo Sapiens
GSGPGRRLC

SEQ ID NO: 1105353 - protein, 9 aa, Homo Sapiens
PTAPDAQAA

SEQ ID NO: 1105354 - protein, 9 aa, Homo Sapiens
AAAAAVISD

SEQ ID NO: 1105355 - protein, 9 aa, Homo Sapiens
VYLQGWEFQ

SEQ ID NO: 1105356 - protein, 9 aa, Homo Sapiens
WPNTIYLFM

SEQ ID NO: 1105357 - protein, 9 aa, Homo Sapiens
CSGERFGNQ

SEQ ID NO: 1105358 - protein, 9 aa, Homo Sapiens
AGTAGPIGI

SEQ ID NO: 1105359 - protein, 9 aa, Homo Sapiens
DHCCRSWSS

SEQ ID NO: 1105360 - protein, 9 aa, Homo Sapiens
RKFLPLTME

SEQ ID NO: 1105361 - protein, 9 aa, Homo Sapiens
RLCAVRDPI

SEQ ID NO: 1105362 - protein, 9 aa, Homo Sapiens
TPPALVGIQ

SEQ ID NO: 1105363 - protein, 9 aa, Homo Sapiens
FGRDCSPLR

SEQ ID NO: 1105364 - protein, 9 aa, Homo Sapiens
DSSWLPVKW

SEQ ID NO: 1105365 - protein, 9 aa, Homo Sapiens
GLLAEDPRV

SEQ ID NO: 1105366 - protein, 9 aa, Homo Sapiens
TTSSLPSCP

SEQ ID NO: 1105367 - protein, 9 aa, Homo Sapiens
LQEIQNSLL

SEQ ID NO: 1105368 - protein, 9 aa, Homo Sapiens
LVIWARTRI

SEQ ID NO: 1105369 - protein, 9 aa, Homo Sapiens
YWLGNDNIS

SEQ ID NO: 1105370 - protein, 9 aa, Homo Sapiens
VIPHLFLAS

SEQ ID NO: 1105371 - protein, 9 aa, Homo Sapiens
LEDHQSFRN

SEQ ID NO: 1105372 - protein, 9 aa, Homo Sapiens
RQPPGKRST

SEQ ID NO: 1105373 - protein, 9 aa, Homo Sapiens
LHKACKVAR

SEQ ID NO: 1105374 - protein, 9 aa, Homo Sapiens
SASLDLLLC

SEQ ID NO: 1105375 - protein, 9 aa, Homo Sapiens
KKKVKIIQW

SEQ ID NO: 1105376 - protein, 9 aa, Homo Sapiens
RIAGCRHSV

SEQ ID NO: 1105377 - protein, 9 aa, Homo Sapiens
PTIPSFCWP

SEQ ID NO: 1105378 - protein, 9 aa, Homo Sapiens
RLGTGRDPR

SEQ ID NO: 1105379 - protein, 9 aa, Homo Sapiens
AARAGGRAA

SEQ ID NO: 1105380 - protein, 9 aa, Homo Sapiens
SCLPKDLSL

SEQ ID NO: 1105381 - protein, 9 aa, Homo Sapiens
APHGLWSPT

SEQ ID NO: 1105382 - protein, 9 aa, Homo Sapiens
SGSSEDSVV

SEQ ID NO: 1105383 - protein, 9 aa, Homo Sapiens
PGQPPRRPP

SEQ ID NO: 1105384 - protein, 9 aa, Homo Sapiens
MAHVEALGR

SEQ ID NO: 1105385 - protein, 9 aa, Homo Sapiens
LFPLGYLLV

SEQ ID NO: 1105386 - protein, 9 aa, Homo Sapiens
SLQFILDLQ

SEQ ID NO: 1105387 - protein, 9 aa, Homo Sapiens
TVKEKLSSL

SEQ ID NO: 1105388 - protein, 9 aa, Homo Sapiens
PWVFSFLLV

SEQ ID NO: 1105389 - protein, 9 aa, Homo Sapiens
EGVCDDDTV

SEQ ID NO: 1105390 - protein, 9 aa, Homo Sapiens
EASSSLTGT

SEQ ID NO: 1105391 - protein, 9 aa, Homo Sapiens
QERANKKQW

SEQ ID NO: 1105392 - protein, 9 aa, Homo Sapiens
GESAGCSPG

SEQ ID NO: 1105393 - protein, 9 aa, Homo Sapiens
ETEDEDKGT

SEQ ID NO: 1105394 - protein, 9 aa, Homo Sapiens
TDMDHVLLK

SEQ ID NO: 1105395 - protein, 9 aa, Homo Sapiens
TALVSSACG

SEQ ID NO: 1105396 - protein, 9 aa, Homo Sapiens
VNDCDLLVY

SEQ ID NO: 1105397 - protein, 9 aa, Homo Sapiens
MVARRTQLE

SEQ ID NO: 1105398 - protein, 9 aa, Homo Sapiens
KTYPVVLPP

SEQ ID NO: 1105399 - protein, 9 aa, Homo Sapiens
EDVDKGPKE

SEQ ID NO: 1105400 - protein, 9 aa, Homo Sapiens
EEEMCDTNE

SEQ ID NO: 1105401 - protein, 9 aa, Homo Sapiens
QSLNYSCIV

SEQ ID NO: 1105402 - protein, 9 aa, Homo Sapiens
PSVRREFQL

SEQ ID NO: 1105403 - protein, 9 aa, Homo Sapiens
PGLAELVAE

SEQ ID NO: 1105404 - protein, 9 aa, Homo Sapiens
EELFKVLGV

SEQ ID NO: 1105405 - protein, 9 aa, Homo Sapiens
QFDPKLLEH

SEQ ID NO: 1105406 - protein, 9 aa, Homo Sapiens
TVNTTSRME

SEQ ID NO: 1105407 - protein, 9 aa, Homo Sapiens
KTSNMDLTF

SEQ ID NO: 1105408 - protein, 9 aa, Homo Sapiens
PPSSSKPSS

SEQ ID NO: 1105409 - protein, 9 aa, Homo Sapiens
LAMVPVFVD

SEQ ID NO: 1105410 - protein, 9 aa, Homo Sapiens
CCGKLLPLP

SEQ ID NO: 1105411 - protein, 9 aa, Homo Sapiens
CNPKPWSKL

SEQ ID NO: 1105412 - protein, 9 aa, Homo Sapiens
IFLQNPQVC

SEQ ID NO: 1105413 - protein, 9 aa, Homo Sapiens
EALLADESS

SEQ ID NO: 1105414 - protein, 9 aa, Homo Sapiens
TTCTMTPVS

SEQ ID NO: 1105415 - protein, 9 aa, Homo Sapiens
SPASGSTSR

SEQ ID NO: 1105416 - protein, 9 aa, Homo Sapiens
LRLVLMLND

SEQ ID NO: 1105417 - protein, 9 aa, Homo Sapiens
PLPAGPPPG

SEQ ID NO: 1105418 - protein, 9 aa, Homo Sapiens
GLGYHGMYF

SEQ ID NO: 1105419 - protein, 9 aa, Homo Sapiens
SKYGGSVRQ

SEQ ID NO: 1105420 - protein, 9 aa, Homo Sapiens
SPPLWTPAW

SEQ ID NO: 1105421 - protein, 9 aa, Homo Sapiens
DCQSERLYG

SEQ ID NO: 1105422 - protein, 9 aa, Homo Sapiens
LPLSSSPAS

SEQ ID NO: 1105423 - protein, 9 aa, Homo Sapiens
HVEPLHGAA

SEQ ID NO: 1105424 - protein, 9 aa, Homo Sapiens
SEDEWDRVL

SEQ ID NO: 1105425 - protein, 9 aa, Homo Sapiens
CVWVSSIRH

SEQ ID NO: 1105426 - protein, 9 aa, Homo Sapiens
GSQPFQERL

SEQ ID NO: 1105427 - protein, 9 aa, Homo Sapiens
APALECWDP

SEQ ID NO: 1105428 - protein, 9 aa, Homo Sapiens
QRPRTPAPA

SEQ ID NO: 1105429 - protein, 9 aa, Homo Sapiens
LLFFSSVIS

SEQ ID NO: 1105430 - protein, 9 aa, Homo Sapiens
TVANDVMLC

SEQ ID NO: 1105431 - protein, 9 aa, Homo Sapiens
SRWCPPSPH

SEQ ID NO: 1105432 - protein, 9 aa, Homo Sapiens
QPKPAVHDG

SEQ ID NO: 1105433 - protein, 9 aa, Homo Sapiens
GRAFNQNMH

SEQ ID NO: 1105434 - protein, 9 aa, Homo Sapiens
SASPMAATT

SEQ ID NO: 1105435 - protein, 9 aa, Homo Sapiens
CRAWGDISG

SEQ ID NO: 1105436 - protein, 9 aa, Homo Sapiens
YHALYMTVL

SEQ ID NO: 1105437 - protein, 9 aa, Homo Sapiens
FRSLLGWAR

SEQ ID NO: 1105438 - protein, 9 aa, Homo Sapiens
GLSPGACRP

SEQ ID NO: 1105439 - protein, 9 aa, Homo Sapiens
GLSGKKGEG

SEQ ID NO: 1105440 - protein, 9 aa, Homo Sapiens
LGGGDWVWD

SEQ ID NO: 1105441 - protein, 9 aa, Homo Sapiens
RDAPGAAEG

SEQ ID NO: 1105442 - protein, 9 aa, Homo Sapiens
MWDPDHYGT

SEQ ID NO: 1105443 - protein, 9 aa, Homo Sapiens
WTASGQRQD

SEQ ID NO: 1105444 - protein, 9 aa, Homo Sapiens
TSGPGPASA

SEQ ID NO: 1105445 - protein, 9 aa, Homo Sapiens
PVGRHPPVV

SEQ ID NO: 1105446 - protein, 9 aa, Homo Sapiens
MTKKRVNTA

SEQ ID NO: 1105447 - protein, 9 aa, Homo Sapiens
AAGVAAAVA

SEQ ID NO: 1105448 - protein, 9 aa, Homo Sapiens
RSFRGSGPG

SEQ ID NO: 1105449 - protein, 9 aa, Homo Sapiens
RRALHQLKC

SEQ ID NO: 1105450 - protein, 9 aa, Homo Sapiens
FQKSLAQLL

SEQ ID NO: 1105451 - protein, 9 aa, Homo Sapiens
EKENKWESR

SEQ ID NO: 1105452 - protein, 9 aa, Homo Sapiens
EIGNSLPQG

SEQ ID NO: 1105453 - protein, 9 aa, Homo Sapiens
RMARPKDLP

SEQ ID NO: 1105454 - protein, 9 aa, Homo Sapiens
LLAARTTTL

SEQ ID NO: 1105455 - protein, 9 aa, Homo Sapiens
RPLSLILVS

SEQ ID NO: 1105456 - protein, 9 aa, Homo Sapiens
WAGQDLCPG

SEQ ID NO: 1105457 - protein, 9 aa, Homo Sapiens
WRDKKQCKS

SEQ ID NO: 1105458 - protein, 9 aa, Homo Sapiens
GQPKAVWVP

SEQ ID NO: 1105459 - protein, 9 aa, Homo Sapiens
LLGQRPADP

SEQ ID NO: 1105460 - protein, 9 aa, Homo Sapiens
VPNNPDLAK

SEQ ID NO: 1105461 - protein, 9 aa, Homo Sapiens
WRKFLQMKR

SEQ ID NO: 1105462 - protein, 9 aa, Homo Sapiens
VESDEARRC

SEQ ID NO: 1105463 - protein, 9 aa, Homo Sapiens
PLEPVVVDA

SEQ ID NO: 1105464 - protein, 9 aa, Homo Sapiens
ERAVRRCTQ

SEQ ID NO: 1105465 - protein, 9 aa, Homo Sapiens
FVVVDDVPV

SEQ ID NO: 1105466 - protein, 9 aa, Homo Sapiens
GSFVPNNPD

SEQ ID NO: 1105467 - protein, 9 aa, Homo Sapiens
LAVQRASKT

SEQ ID NO: 1105468 - protein, 9 aa, Homo Sapiens
SWIPQSAGT

SEQ ID NO: 1105469 - protein, 9 aa, Homo Sapiens
TSLKASRMS

SEQ ID NO: 1105470 - protein, 9 aa, Homo Sapiens
IVDWMDEMK

SEQ ID NO: 1105471 - protein, 9 aa, Homo Sapiens
WGHHPNLPM

SEQ ID NO: 1105472 - protein, 9 aa, Homo Sapiens
RISELTGSL

SEQ ID NO: 1105473 - protein, 9 aa, Homo Sapiens
PSPQQRNWL

SEQ ID NO: 1105474 - protein, 9 aa, Homo Sapiens
WGRRRALPV

SEQ ID NO: 1105475 - protein, 9 aa, Homo Sapiens
SLFRRSGSG

SEQ ID NO: 1105476 - protein, 9 aa, Homo Sapiens
NCTAALCRK

SEQ ID NO: 1105477 - protein, 9 aa, Homo Sapiens
QVGIFLDYD

SEQ ID NO: 1105478 - protein, 9 aa, Homo Sapiens
ASSSLTGTT

SEQ ID NO: 1105479 - protein, 9 aa, Homo Sapiens
VRWAGQDLC

SEQ ID NO: 1105480 - protein, 9 aa, Homo Sapiens
GDFFPPECP

SEQ ID NO: 1105481 - protein, 9 aa, Homo Sapiens
GQVFSVAYQ

SEQ ID NO: 1105482 - protein, 9 aa, Homo Sapiens
LLVPARYRK

SEQ ID NO: 1105483 - protein, 9 aa, Homo Sapiens
CCPSTTCTM

SEQ ID NO: 1105484 - protein, 9 aa, Homo Sapiens
HWPWEVSLW

SEQ ID NO: 1105485 - protein, 9 aa, Homo Sapiens
TFTMRPGTR

SEQ ID NO: 1105486 - protein, 9 aa, Homo Sapiens
SAPEVVGAW

SEQ ID NO: 1105487 - protein, 9 aa, Homo Sapiens
FLGGREVVA

SEQ ID NO: 1105488 - protein, 9 aa, Homo Sapiens
SSVHEVLSS

SEQ ID NO: 1105489 - protein, 9 aa, Homo Sapiens
QDLSKLSTE

SEQ ID NO: 1105490 - protein, 9 aa, Homo Sapiens
GLQLVNPHT

SEQ ID NO: 1105491 - protein, 9 aa, Homo Sapiens
TKLLHIYQQ

SEQ ID NO: 1105492 - protein, 9 aa, Homo Sapiens
RLPHQSPGH

SEQ ID NO: 1105493 - protein, 9 aa, Homo Sapiens
RYGVPSPEC

SEQ ID NO: 1105494 - protein, 9 aa, Homo Sapiens
PGARSHWGA

SEQ ID NO: 1105495 - protein, 9 aa, Homo Sapiens
FHPVFSVMI

SEQ ID NO: 1105496 - protein, 9 aa, Homo Sapiens
SIMTRASHR

SEQ ID NO: 1105497 - protein, 9 aa, Homo Sapiens
TMPPLLHPQ

SEQ ID NO: 1105498 - protein, 9 aa, Homo Sapiens
ANRCQSSPR

SEQ ID NO: 1105499 - protein, 9 aa, Homo Sapiens
GRSPVWRAC

SEQ ID NO: 1105500 - protein, 9 aa, Homo Sapiens
FQGHREGVH

SEQ ID NO: 1105501 - protein, 9 aa, Homo Sapiens
SWAPVFLDR

SEQ ID NO: 1105502 - protein, 9 aa, Homo Sapiens
YAFRSLELC

SEQ ID NO: 1105503 - protein, 9 aa, Homo Sapiens
LDKKYIKDY

SEQ ID NO: 1105504 - protein, 9 aa, Homo Sapiens
GRGVPALPQ

SEQ ID NO: 1105505 - protein, 9 aa, Homo Sapiens
VLQEGSMAH

SEQ ID NO: 1105506 - protein, 9 aa, Homo Sapiens
SHTNGKNVQ

SEQ ID NO: 1105507 - protein, 9 aa, Homo Sapiens
KGVHQAWQG

SEQ ID NO: 1105508 - protein, 9 aa, Homo Sapiens
TWCGWLCPT

SEQ ID NO: 1105509 - protein, 9 aa, Homo Sapiens
VTFCQQLVR

SEQ ID NO: 1105510 - protein, 9 aa, Homo Sapiens
ATKIQAWWW

SEQ ID NO: 1105511 - protein, 9 aa, Homo Sapiens
LVELLLRCL

SEQ ID NO: 1105512 - protein, 9 aa, Homo Sapiens
IQVQTGGRL

SEQ ID NO: 1105513 - protein, 9 aa, Homo Sapiens
CHLMPGPDS

SEQ ID NO: 1105514 - protein, 9 aa, Homo Sapiens
RMASRTCSQ

SEQ ID NO: 1105515 - protein, 9 aa, Homo Sapiens
TMCISACPS

SEQ ID NO: 1105516 - protein, 9 aa, Homo Sapiens
MSPKIEVAR

SEQ ID NO: 1105517 - protein, 9 aa, Homo Sapiens
SILRLSRHH

SEQ ID NO: 1105518 - protein, 9 aa, Homo Sapiens
DPETSVDAY

SEQ ID NO: 1105519 - protein, 9 aa, Homo Sapiens
ERRPEFSEV

SEQ ID NO: 1105520 - protein, 9 aa, Homo Sapiens
KLVLLSVTT

SEQ ID NO: 1105521 - protein, 9 aa, Homo Sapiens
QHITLNDLC

SEQ ID NO: 1105522 - protein, 9 aa, Homo Sapiens
TNSRNIACI

SEQ ID NO: 1105523 - protein, 9 aa, Homo Sapiens
GCGSAARKS

SEQ ID NO: 1105524 - protein, 9 aa, Homo Sapiens
ACIAAFFVD

SEQ ID NO: 1105525 - protein, 9 aa, Homo Sapiens
FSCDLLASQ

SEQ ID NO: 1105526 - protein, 9 aa, Homo Sapiens
GIKGKIRAG

SEQ ID NO: 1105527 - protein, 9 aa, Homo Sapiens
LLRVRLPDD

SEQ ID NO: 1105528 - protein, 9 aa, Homo Sapiens
VAVVDQHPI

SEQ ID NO: 1105529 - protein, 9 aa, Homo Sapiens
YDKKLAPPF

SEQ ID NO: 1105530 - protein, 9 aa, Homo Sapiens
FPQLCNSKE

SEQ ID NO: 1105531 - protein, 9 aa, Homo Sapiens
AARGASTSS

SEQ ID NO: 1105532 - protein, 9 aa, Homo Sapiens
YKELSGTYN

SEQ ID NO: 1105533 - protein, 9 aa, Homo Sapiens
YPPARQPSR

SEQ ID NO: 1105534 - protein, 9 aa, Homo Sapiens
TISCPFQSP

SEQ ID NO: 1105535 - protein, 9 aa, Homo Sapiens
SPPGCTQGM

SEQ ID NO: 1105536 - protein, 9 aa, Homo Sapiens
PKAVGWPCY

SEQ ID NO: 1105537 - protein, 9 aa, Homo Sapiens
LHAFGRQPY

SEQ ID NO: 1105538 - protein, 9 aa, Homo Sapiens
VHEVLSSCV

SEQ ID NO: 1105539 - protein, 9 aa, Homo Sapiens
KDVNQDLYR

SEQ ID NO: 1105540 - protein, 9 aa, Homo Sapiens
GCVELNWSA

SEQ ID NO: 1105541 - protein, 9 aa, Homo Sapiens
LTRDAHLCP

SEQ ID NO: 1105542 - protein, 9 aa, Homo Sapiens
VNLRLQPAS

SEQ ID NO: 1105543 - protein, 9 aa, Homo Sapiens
EHSAPKPRL

SEQ ID NO: 1105544 - protein, 9 aa, Homo Sapiens
TIKFLFELV

SEQ ID NO: 1105545 - protein, 9 aa, Homo Sapiens
LHQVLRKLK

SEQ ID NO: 1105546 - protein, 9 aa, Homo Sapiens
FVLVRPLSL

SEQ ID NO: 1105547 - protein, 9 aa, Homo Sapiens
QRSFAPGSL

SEQ ID NO: 1105548 - protein, 9 aa, Homo Sapiens
QGRGIGPLT

SEQ ID NO: 1105549 - protein, 9 aa, Homo Sapiens
TQCKESLAK

SEQ ID NO: 1105550 - protein, 9 aa, Homo Sapiens
TQEVEIGTV

SEQ ID NO: 1105551 - protein, 9 aa, Homo Sapiens
QLLLLLLLD

SEQ ID NO: 1105552 - protein, 9 aa, Homo Sapiens
DGMLTVIGQ

SEQ ID NO: 1105553 - protein, 9 aa, Homo Sapiens
GPDAHITKK

SEQ ID NO: 1105554 - protein, 9 aa, Homo Sapiens
SSTSSSLTP

SEQ ID NO: 1105555 - protein, 9 aa, Homo Sapiens
SGPCHAAAL

SEQ ID NO: 1105556 - protein, 9 aa, Homo Sapiens
SDRGSLALS

SEQ ID NO: 1105557 - protein, 9 aa, Homo Sapiens
DAGLEPNGN

SEQ ID NO: 1105558 - protein, 9 aa, Homo Sapiens
QERKELEEE

SEQ ID NO: 1105559 - protein, 9 aa, Homo Sapiens
QGFDPAGWV

SEQ ID NO: 1105560 - protein, 9 aa, Homo Sapiens
RACDINTEQ

SEQ ID NO: 1105561 - protein, 9 aa, Homo Sapiens
QVFSKKKKR

SEQ ID NO: 1105562 - protein, 9 aa, Homo Sapiens
IVRDLQTAC

SEQ ID NO: 1105563 - protein, 9 aa, Homo Sapiens
WWVMGIILY

SEQ ID NO: 1105564 - protein, 9 aa, Homo Sapiens
WKRPMGLSR

SEQ ID NO: 1105565 - protein, 9 aa, Homo Sapiens
TACGAASPP

SEQ ID NO: 1105566 - protein, 9 aa, Homo Sapiens
AEGLPRPWS

SEQ ID NO: 1105567 - protein, 9 aa, Homo Sapiens
YQGPGWEEA

SEQ ID NO: 1105568 - protein, 9 aa, Homo Sapiens
DFITPLHSG

SEQ ID NO: 1105569 - protein, 9 aa, Homo Sapiens
EPEETWGVE

SEQ ID NO: 1105570 - protein, 9 aa, Homo Sapiens
QVTKEETRA

SEQ ID NO: 1105571 - protein, 9 aa, Homo Sapiens
CLPDHVDAP

SEQ ID NO: 1105572 - protein, 9 aa, Homo Sapiens
AGAHRSAKE

SEQ ID NO: 1105573 - protein, 9 aa, Homo Sapiens
KRHMPLSKL

SEQ ID NO: 1105574 - protein, 9 aa, Homo Sapiens
ESEWNWHGE

SEQ ID NO: 1105575 - protein, 9 aa, Homo Sapiens
RGAPALECW

SEQ ID NO: 1105576 - protein, 9 aa, Homo Sapiens
GPHARVDAH

SEQ ID NO: 1105577 - protein, 9 aa, Homo Sapiens
PDDVLMVTE

SEQ ID NO: 1105578 - protein, 9 aa, Homo Sapiens
VCIFVYKEF

SEQ ID NO: 1105579 - protein, 9 aa, Homo Sapiens
YFEYKSPEE

SEQ ID NO: 1105580 - protein, 9 aa, Homo Sapiens
HEKDFLWSH

SEQ ID NO: 1105581 - protein, 9 aa, Homo Sapiens
YLGYIEEWD

SEQ ID NO: 1105582 - protein, 9 aa, Homo Sapiens
MLSRRKLLT

SEQ ID NO: 1105583 - protein, 9 aa, Homo Sapiens
ARKATSPHL

SEQ ID NO: 1105584 - protein, 9 aa, Homo Sapiens
VLEDIKACT

SEQ ID NO: 1105585 - protein, 9 aa, Homo Sapiens
ELKIQSLIY

SEQ ID NO: 1105586 - protein, 9 aa, Homo Sapiens
WDPTPQSPS

SEQ ID NO: 1105587 - protein, 9 aa, Homo Sapiens
CHLFPRVLL

SEQ ID NO: 1105588 - protein, 9 aa, Homo Sapiens
SRHYHCSGI

SEQ ID NO: 1105589 - protein, 9 aa, Homo Sapiens
TVQRWGKKV

SEQ ID NO: 1105590 - protein, 9 aa, Homo Sapiens
VLRVLRVLR

SEQ ID NO: 1105591 - protein, 9 aa, Homo Sapiens
DMVFETRRP

SEQ ID NO: 1105592 - protein, 9 aa, Homo Sapiens
SAWGDWVAS

SEQ ID NO: 1105593 - protein, 9 aa, Homo Sapiens
IQQLVWPDT

SEQ ID NO: 1105594 - protein, 9 aa, Homo Sapiens
TGRDPRQPG

SEQ ID NO: 1105595 - protein, 9 aa, Homo Sapiens
VKTKATQNF

SEQ ID NO: 1105596 - protein, 9 aa, Homo Sapiens
PKAAKAKKT

SEQ ID NO: 1105597 - protein, 9 aa, Homo Sapiens
LMLDCWVQD

SEQ ID NO: 1105598 - protein, 9 aa, Homo Sapiens
GDLPGLHTA

SEQ ID NO: 1105599 - protein, 9 aa, Homo Sapiens
DCLLQGTFY

SEQ ID NO: 1105600 - protein, 9 aa, Homo Sapiens
DTGLDDNIE

SEQ ID NO: 1105601 - protein, 9 aa, Homo Sapiens
AKEEARHAL

SEQ ID NO: 1105602 - protein, 9 aa, Homo Sapiens
TPLLENNHP

SEQ ID NO: 1105603 - protein, 9 aa, Homo Sapiens
HNVTKYLWL

SEQ ID NO: 1105604 - protein, 9 aa, Homo Sapiens
RLHGETGMV

SEQ ID NO: 1105605 - protein, 9 aa, Homo Sapiens
MFSCCFPHF

SEQ ID NO: 1105606 - protein, 9 aa, Homo Sapiens
GKTIEIGNS

SEQ ID NO: 1105607 - protein, 9 aa, Homo Sapiens
GERGPAGTA

SEQ ID NO: 1105608 - protein, 9 aa, Homo Sapiens
QILHRGGAP

SEQ ID NO: 1105609 - protein, 9 aa, Homo Sapiens
RPMGLSRPE

SEQ ID NO: 1105610 - protein, 9 aa, Homo Sapiens
LVKNHVKNG

SEQ ID NO: 1105611 - protein, 9 aa, Homo Sapiens
FGGPDSTPR

SEQ ID NO: 1105612 - protein, 9 aa, Homo Sapiens
EEAAASRLP

SEQ ID NO: 1105613 - protein, 9 aa, Homo Sapiens
EVGCPAGGP

SEQ ID NO: 1105614 - protein, 9 aa, Homo Sapiens
ACPERRPEF

SEQ ID NO: 1105615 - protein, 9 aa, Homo Sapiens
DMAQGVRGR

SEQ ID NO: 1105616 - protein, 9 aa, Homo Sapiens
LSYCLLKAS

SEQ ID NO: 1105617 - protein, 9 aa, Homo Sapiens
MDFLTLRHL

SEQ ID NO: 1105618 - protein, 9 aa, Homo Sapiens
PRRSGWTRA

SEQ ID NO: 1105619 - protein, 9 aa, Homo Sapiens
PSRPTGRTP

SEQ ID NO: 1105620 - protein, 9 aa, Homo Sapiens
RLPLSCGHL

SEQ ID NO: 1105621 - protein, 9 aa, Homo Sapiens
RFSELSLVY

SEQ ID NO: 1105622 - protein, 9 aa, Homo Sapiens
LYILTSMSD

SEQ ID NO: 1105623 - protein, 9 aa, Homo Sapiens
ASSCLAGVT

SEQ ID NO: 1105624 - protein, 9 aa, Homo Sapiens
YQSSSHFYV

SEQ ID NO: 1105625 - protein, 9 aa, Homo Sapiens
ALALDVAVQ

SEQ ID NO: 1105626 - protein, 9 aa, Homo Sapiens
VGSTVLFHC

SEQ ID NO: 1105627 - protein, 9 aa, Homo Sapiens
RVRLPDDCL

SEQ ID NO: 1105628 - protein, 9 aa, Homo Sapiens
IKSTPVGPV

SEQ ID NO: 1105629 - protein, 9 aa, Homo Sapiens
TATRRAVQK

SEQ ID NO: 1105630 - protein, 9 aa, Homo Sapiens
MWMNMNIMS

SEQ ID NO: 1105631 - protein, 9 aa, Homo Sapiens
WGWLLYADW

SEQ ID NO: 1105632 - protein, 9 aa, Homo Sapiens
WPTHLPSAP

SEQ ID NO: 1105633 - protein, 9 aa, Homo Sapiens
MTRELCMQM

SEQ ID NO: 1105634 - protein, 9 aa, Homo Sapiens
GPCHAAALA

SEQ ID NO: 1105635 - protein, 9 aa, Homo Sapiens
IQIMEKLSE

SEQ ID NO: 1105636 - protein, 9 aa, Homo Sapiens
ISREQHFYE

SEQ ID NO: 1105637 - protein, 9 aa, Homo Sapiens
SRAGKIAKP

SEQ ID NO: 1105638 - protein, 9 aa, Homo Sapiens
LWAPAPADG

SEQ ID NO: 1105639 - protein, 9 aa, Homo Sapiens
HEELLLPAL

SEQ ID NO: 1105640 - protein, 9 aa, Homo Sapiens
RVVVMEISY

SEQ ID NO: 1105641 - protein, 9 aa, Homo Sapiens
TGEDVAALL

SEQ ID NO: 1105642 - protein, 9 aa, Homo Sapiens
SPNTTILIK

SEQ ID NO: 1105643 - protein, 9 aa, Homo Sapiens
RMPSPHSGW

SEQ ID NO: 1105644 - protein, 9 aa, Homo Sapiens
ADHYLVVLA

SEQ ID NO: 1105645 - protein, 9 aa, Homo Sapiens
ICALGLVYW

SEQ ID NO: 1105646 - protein, 9 aa, Homo Sapiens
TWFKNDRIL

SEQ ID NO: 1105647 - protein, 9 aa, Homo Sapiens
MGTPRIELA

SEQ ID NO: 1105648 - protein, 9 aa, Homo Sapiens
SKKTQNRTG

SEQ ID NO: 1105649 - protein, 9 aa, Homo Sapiens
YFSPGQSHT

SEQ ID NO: 1105650 - protein, 9 aa, Homo Sapiens
PGHFLKKVI

SEQ ID NO: 1105651 - protein, 9 aa, Homo Sapiens
EVSLKCLWE

SEQ ID NO: 1105652 - protein, 9 aa, Homo Sapiens
MTALSYPWA

SEQ ID NO: 1105653 - protein, 9 aa, Homo Sapiens
SWPGLWPPP

SEQ ID NO: 1105654 - protein, 9 aa, Homo Sapiens
RAQDWATIR

SEQ ID NO: 1105655 - protein, 9 aa, Homo Sapiens
AESNRGVPV

SEQ ID NO: 1105656 - protein, 9 aa, Homo Sapiens
SPGQSHTNG

SEQ ID NO: 1105657 - protein, 9 aa, Homo Sapiens
HHSVLAACS

SEQ ID NO: 1105658 - protein, 9 aa, Homo Sapiens
AVDKGYWIA

SEQ ID NO: 1105659 - protein, 9 aa, Homo Sapiens
YFCGIQGSQ

SEQ ID NO: 1105660 - protein, 9 aa, Homo Sapiens
PCTKLMAKT

SEQ ID NO: 1105661 - protein, 9 aa, Homo Sapiens
SYPPARQPS

SEQ ID NO: 1105662 - protein, 9 aa, Homo Sapiens
WERHLGHAG

SEQ ID NO: 1105663 - protein, 9 aa, Homo Sapiens
LWMFLRILE

SEQ ID NO: 1105664 - protein, 9 aa, Homo Sapiens
IVNLLCPVI

SEQ ID NO: 1105665 - protein, 9 aa, Homo Sapiens
FNTKTTTST

SEQ ID NO: 1105666 - protein, 9 aa, Homo Sapiens
VDNHVGPSS

SEQ ID NO: 1105667 - protein, 9 aa, Homo Sapiens
WGVETLCGL

SEQ ID NO: 1105668 - protein, 9 aa, Homo Sapiens
LLEGFLQRE

SEQ ID NO: 1105669 - protein, 9 aa, Homo Sapiens
GKIEFEGLM

SEQ ID NO: 1105670 - protein, 9 aa, Homo Sapiens
MGPLSAPPR

SEQ ID NO: 1105671 - protein, 9 aa, Homo Sapiens
VAADLRPKG

SEQ ID NO: 1105672 - protein, 9 aa, Homo Sapiens
ILFTNWYQA

SEQ ID NO: 1105673 - protein, 9 aa, Homo Sapiens
GTPRIELAR

SEQ ID NO: 1105674 - protein, 9 aa, Homo Sapiens
FNQWCLQPR

SEQ ID NO: 1105675 - protein, 9 aa, Homo Sapiens
MMVDSLVNK

SEQ ID NO: 1105676 - protein, 9 aa, Homo Sapiens
LRTFMCSRP

SEQ ID NO: 1105677 - protein, 9 aa, Homo Sapiens
ATSPCTKLM

SEQ ID NO: 1105678 - protein, 9 aa, Homo Sapiens
RKHERWHIR

SEQ ID NO: 1105679 - protein, 9 aa, Homo Sapiens
EKLSGPSGA

SEQ ID NO: 1105680 - protein, 9 aa, Homo Sapiens
RLTRLLRTA

SEQ ID NO: 1105681 - protein, 9 aa, Homo Sapiens
EDSVVEIRM

SEQ ID NO: 1105682 - protein, 9 aa, Homo Sapiens
IRIWFIRKN

SEQ ID NO: 1105683 - protein, 9 aa, Homo Sapiens
YVLTCPDMM

SEQ ID NO: 1105684 - protein, 9 aa, Homo Sapiens
VSPSITSTG

SEQ ID NO: 1105685 - protein, 9 aa, Homo Sapiens
TGACTPAQS

SEQ ID NO: 1105686 - protein, 9 aa, Homo Sapiens
SITSTGRRG

SEQ ID NO: 1105687 - protein, 9 aa, Homo Sapiens
KLTIQKALS

SEQ ID NO: 1105688 - protein, 9 aa, Homo Sapiens
KVLARVFSH

SEQ ID NO: 1105689 - protein, 9 aa, Homo Sapiens
TLVVVLPEH

SEQ ID NO: 1105690 - protein, 9 aa, Homo Sapiens
KENPPASEK

SEQ ID NO: 1105691 - protein, 9 aa, Homo Sapiens
AWLSYCLLK

SEQ ID NO: 1105692 - protein, 9 aa, Homo Sapiens
AWAAVPRSF

SEQ ID NO: 1105693 - protein, 9 aa, Homo Sapiens
CFSFGSVEA

SEQ ID NO: 1105694 - protein, 9 aa, Homo Sapiens
SSELDPPHR

SEQ ID NO: 1105695 - protein, 9 aa, Homo Sapiens
AVHEELLLP

SEQ ID NO: 1105696 - protein, 9 aa, Homo Sapiens
LTYVGTLFN

SEQ ID NO: 1105697 - protein, 9 aa, Homo Sapiens
IELARMGSP

SEQ ID NO: 1105698 - protein, 9 aa, Homo Sapiens
LNPVPETPV

SEQ ID NO: 1105699 - protein, 9 aa, Homo Sapiens
QDHQVSAGA

SEQ ID NO: 1105700 - protein, 9 aa, Homo Sapiens
EPVEFTFKN

SEQ ID NO: 1105701 - protein, 9 aa, Homo Sapiens
LERAVRRCT

SEQ ID NO: 1105702 - protein, 9 aa, Homo Sapiens
DWEYFMACF

SEQ ID NO: 1105703 - protein, 9 aa, Homo Sapiens
DQSRGFTLP

SEQ ID NO: 1105704 - protein, 9 aa, Homo Sapiens
AAAAAAVIS

SEQ ID NO: 1105705 - protein, 9 aa, Homo Sapiens
PPQAPSQVW

SEQ ID NO: 1105706 - protein, 9 aa, Homo Sapiens
VGETRALRA

SEQ ID NO: 1105707 - protein, 9 aa, Homo Sapiens
LALVVGTAL

SEQ ID NO: 1105708 - protein, 9 aa, Homo Sapiens
GCGGSFPCP

SEQ ID NO: 1105709 - protein, 9 aa, Homo Sapiens
LPLSCGHLS

SEQ ID NO: 1105710 - protein, 9 aa, Homo Sapiens
LRQQHNAEN

SEQ ID NO: 1105711 - protein, 9 aa, Homo Sapiens
ADMKNSVVD

SEQ ID NO: 1105712 - protein, 9 aa, Homo Sapiens
RNVGNLAVR

SEQ ID NO: 1105713 - protein, 9 aa, Homo Sapiens
GLGLLARFT

SEQ ID NO: 1105714 - protein, 9 aa, Homo Sapiens
GPQFVRCRN

SEQ ID NO: 1105715 - protein, 9 aa, Homo Sapiens
TQAQSILEV

SEQ ID NO: 1105716 - protein, 9 aa, Homo Sapiens
LNMIKSTPV

SEQ ID NO: 1105717 - protein, 9 aa, Homo Sapiens
RASDDLRPL

SEQ ID NO: 1105718 - protein, 9 aa, Homo Sapiens
GYQSSSHFY

SEQ ID NO: 1105719 - protein, 9 aa, Homo Sapiens
MPVVDPQEE

SEQ ID NO: 1105720 - protein, 9 aa, Homo Sapiens
EASADLVIW

SEQ ID NO: 1105721 - protein, 9 aa, Homo Sapiens
VNLLKTALQ

SEQ ID NO: 1105722 - protein, 9 aa, Homo Sapiens
PTPASPWPA

SEQ ID NO: 1105723 - protein, 9 aa, Homo Sapiens
MGSPKIEVA

SEQ ID NO: 1105724 - protein, 9 aa, Homo Sapiens
TSPCTKLMA

SEQ ID NO: 1105725 - protein, 9 aa, Homo Sapiens
GVRAEVFLG

SEQ ID NO: 1105726 - protein, 9 aa, Homo Sapiens
MVFIVNSKD

SEQ ID NO: 1105727 - protein, 9 aa, Homo Sapiens
DRINWFLPG

SEQ ID NO: 1105728 - protein, 9 aa, Homo Sapiens
REPVEPGQP

SEQ ID NO: 1105729 - protein, 9 aa, Homo Sapiens
QCPHTSGFL

SEQ ID NO: 1105730 - protein, 9 aa, Homo Sapiens
KVQELQSHP

SEQ ID NO: 1105731 - protein, 9 aa, Homo Sapiens
TCGCSRMAR

SEQ ID NO: 1105732 - protein, 9 aa, Homo Sapiens
ILQLGEQEG

SEQ ID NO: 1105733 - protein, 9 aa, Homo Sapiens
KSVNTCLEK

SEQ ID NO: 1105734 - protein, 9 aa, Homo Sapiens
VGLLHMDAH

SEQ ID NO: 1105735 - protein, 9 aa, Homo Sapiens
AATQHGHEA

SEQ ID NO: 1105736 - protein, 9 aa, Homo Sapiens
IFRDFLNQC

SEQ ID NO: 1105737 - protein, 9 aa, Homo Sapiens
GQLLLLLLL

SEQ ID NO: 1105738 - protein, 9 aa, Homo Sapiens
RSLPRVLRR

SEQ ID NO: 1105739 - protein, 9 aa, Homo Sapiens
DWHWGAAAT

SEQ ID NO: 1105740 - protein, 9 aa, Homo Sapiens
AFNQNMHLT

SEQ ID NO: 1105741 - protein, 9 aa, Homo Sapiens
KFSNQYKAP

SEQ ID NO: 1105742 - protein, 9 aa, Homo Sapiens
PYLYTSSSV

SEQ ID NO: 1105743 - protein, 9 aa, Homo Sapiens
TAKFQELWY

SEQ ID NO: 1105744 - protein, 9 aa, Homo Sapiens
MCSRPSRQR

SEQ ID NO: 1105745 - protein, 9 aa, Homo Sapiens
PSKQPGSTG

SEQ ID NO: 1105746 - protein, 9 aa, Homo Sapiens
SSLKQKLQA

SEQ ID NO: 1105747 - protein, 9 aa, Homo Sapiens
QTPAGMEDP

SEQ ID NO: 1105748 - protein, 9 aa, Homo Sapiens
GVNDCDLLV

SEQ ID NO: 1105749 - protein, 9 aa, Homo Sapiens
PVNTQPTPL

SEQ ID NO: 1105750 - protein, 9 aa, Homo Sapiens
SAHPVPTYV

SEQ ID NO: 1105751 - protein, 9 aa, Homo Sapiens
APAAMRAAL

SEQ ID NO: 1105752 - protein, 9 aa, Homo Sapiens
IELLISLSA

SEQ ID NO: 1105753 - protein, 9 aa, Homo Sapiens
RPLEVRACQ

SEQ ID NO: 1105754 - protein, 9 aa, Homo Sapiens
SNNSRKKKA

SEQ ID NO: 1105755 - protein, 9 aa, Homo Sapiens
ATNCNDNET

SEQ ID NO: 1105756 - protein, 9 aa, Homo Sapiens
HVDGERSFR

SEQ ID NO: 1105757 - protein, 9 aa, Homo Sapiens
TAKSATCSP

SEQ ID NO: 1105758 - protein, 9 aa, Homo Sapiens
LQLALFYQG

SEQ ID NO: 1105759 - protein, 9 aa, Homo Sapiens
VIDLDTDAN

SEQ ID NO: 1105760 - protein, 9 aa, Homo Sapiens
CELCSFHCS

SEQ ID NO: 1105761 - protein, 9 aa, Homo Sapiens
DFFPPECPQ

SEQ ID NO: 1105762 - protein, 9 aa, Homo Sapiens
EYLNFIRWV

SEQ ID NO: 1105763 - protein, 9 aa, Homo Sapiens
LTQIVLWRE

SEQ ID NO: 1105764 - protein, 9 aa, Homo Sapiens
KKYIKDYYR

SEQ ID NO: 1105765 - protein, 9 aa, Homo Sapiens
VLTCPDMMR

SEQ ID NO: 1105766 - protein, 9 aa, Homo Sapiens
LPSIFYLCI

SEQ ID NO: 1105767 - protein, 9 aa, Homo Sapiens
VSARGPVRL

SEQ ID NO: 1105768 - protein, 9 aa, Homo Sapiens
HPLGDTPQP

SEQ ID NO: 1105769 - protein, 9 aa, Homo Sapiens
AEQLGGLQQ

SEQ ID NO: 1105770 - protein, 9 aa, Homo Sapiens
ESKMKADKL

SEQ ID NO: 1105771 - protein, 9 aa, Homo Sapiens
YGGSVRQNS

SEQ ID NO: 1105772 - protein, 9 aa, Homo Sapiens
SGQRMVPEH

SEQ ID NO: 1105773 - protein, 9 aa, Homo Sapiens
HREIHRVPT

SEQ ID NO: 1105774 - protein, 9 aa, Homo Sapiens
NWLTVLSCW

SEQ ID NO: 1105775 - protein, 9 aa, Homo Sapiens
HKACKVARR

SEQ ID NO: 1105776 - protein, 9 aa, Homo Sapiens
LSYLMELSV

SEQ ID NO: 1105777 - protein, 9 aa, Homo Sapiens
LAWDPPPGA

SEQ ID NO: 1105778 - protein, 9 aa, Homo Sapiens
MVPPHLGQE

SEQ ID NO: 1105779 - protein, 9 aa, Homo Sapiens
EILETVEKV

SEQ ID NO: 1105780 - protein, 9 aa, Homo Sapiens
PSHPTFWTH

SEQ ID NO: 1105781 - protein, 9 aa, Homo Sapiens
SRSLGALSL

SEQ ID NO: 1105782 - protein, 9 aa, Homo Sapiens
RLQRSPSSN

SEQ ID NO: 1105783 - protein, 9 aa, Homo Sapiens
MVTESSRGL

SEQ ID NO: 1105784 - protein, 9 aa, Homo Sapiens
PSPHSGWCG

SEQ ID NO: 1105785 - protein, 9 aa, Homo Sapiens
RPRMSLMPC

SEQ ID NO: 1105786 - protein, 9 aa, Homo Sapiens
YQRSIKEGD

SEQ ID NO: 1105787 - protein, 9 aa, Homo Sapiens
STPRKEHSM

SEQ ID NO: 1105788 - protein, 9 aa, Homo Sapiens
LDGSSLACG

SEQ ID NO: 1105789 - protein, 9 aa, Homo Sapiens
ILLNQTAEQ

SEQ ID NO: 1105790 - protein, 9 aa, Homo Sapiens
HSSSVLDRL

SEQ ID NO: 1105791 - protein, 9 aa, Homo Sapiens
YDGKDQVVS

SEQ ID NO: 1105792 - protein, 9 aa, Homo Sapiens
ACYTWRRRH

SEQ ID NO: 1105793 - protein, 9 aa, Homo Sapiens
RQSYVIPLQ

SEQ ID NO: 1105794 - protein, 9 aa, Homo Sapiens
AQAARIRAA

SEQ ID NO: 1105795 - protein, 9 aa, Homo Sapiens
GGSPCTACH

SEQ ID NO: 1105796 - protein, 9 aa, Homo Sapiens
PGRRGGTCA

SEQ ID NO: 1105797 - protein, 9 aa, Homo Sapiens
EVLLALLVQ

SEQ ID NO: 1105798 - protein, 9 aa, Homo Sapiens
QQQPVLVEL

SEQ ID NO: 1105799 - protein, 9 aa, Homo Sapiens
KQLTVKRHG

SEQ ID NO: 1105800 - protein, 9 aa, Homo Sapiens
MSTASHSFM

SEQ ID NO: 1105801 - protein, 9 aa, Homo Sapiens
QEPGVIGSP

SEQ ID NO: 1105802 - protein, 9 aa, Homo Sapiens
SGSTSRRTR

SEQ ID NO: 1105803 - protein, 9 aa, Homo Sapiens
CVWCEGEHP

SEQ ID NO: 1105804 - protein, 9 aa, Homo Sapiens
PSSSKPSSI

SEQ ID NO: 1105805 - protein, 9 aa, Homo Sapiens
LRFLPRVLP

SEQ ID NO: 1105806 - protein, 9 aa, Homo Sapiens
SMPLILERT

SEQ ID NO: 1105807 - protein, 9 aa, Homo Sapiens
TTTYTRQGH

SEQ ID NO: 1105808 - protein, 9 aa, Homo Sapiens
AFRSEPTAG

SEQ ID NO: 1105809 - protein, 9 aa, Homo Sapiens
LRTPLQQVG

SEQ ID NO: 1105810 - protein, 9 aa, Homo Sapiens
NPDHLPRRA

SEQ ID NO: 1105811 - protein, 9 aa, Homo Sapiens
ICRTTMAFL

SEQ ID NO: 1105812 - protein, 9 aa, Homo Sapiens
IEETHWFSN

SEQ ID NO: 1105813 - protein, 9 aa, Homo Sapiens
GWRARKATS

SEQ ID NO: 1105814 - protein, 9 aa, Homo Sapiens
VVDDVPVML

SEQ ID NO: 1105815 - protein, 9 aa, Homo Sapiens
IIVVILIEL

SEQ ID NO: 1105816 - protein, 9 aa, Homo Sapiens
SRHQLMRTR

SEQ ID NO: 1105817 - protein, 9 aa, Homo Sapiens
SGRGPEVNA

SEQ ID NO: 1105818 - protein, 9 aa, Homo Sapiens
SHLALEQER

SEQ ID NO: 1105819 - protein, 9 aa, Homo Sapiens
SLGEAAWSM

SEQ ID NO: 1105820 - protein, 9 aa, Homo Sapiens
RMRGTISCE

SEQ ID NO: 1105821 - protein, 9 aa, Homo Sapiens
LLRNSTAPS

SEQ ID NO: 1105822 - protein, 9 aa, Homo Sapiens
DHFLEPGKN

SEQ ID NO: 1105823 - protein, 9 aa, Homo Sapiens
SQAGGAPML

SEQ ID NO: 1105824 - protein, 9 aa, Homo Sapiens
KGKIRAGGP

SEQ ID NO: 1105825 - protein, 9 aa, Homo Sapiens
CMMVDSLVN

SEQ ID NO: 1105826 - protein, 9 aa, Homo Sapiens
CHRSLPCHW

SEQ ID NO: 1105827 - protein, 9 aa, Homo Sapiens
PDWHWGAAA

SEQ ID NO: 1105828 - protein, 9 aa, Homo Sapiens
HVVLDHHLV

SEQ ID NO: 1105829 - protein, 9 aa, Homo Sapiens
GFPGSLSGL

SEQ ID NO: 1105830 - protein, 9 aa, Homo Sapiens
RQNAAIRDI

SEQ ID NO: 1105831 - protein, 9 aa, Homo Sapiens
IWQPVMDTV

SEQ ID NO: 1105832 - protein, 9 aa, Homo Sapiens
MGPRTDSQG

SEQ ID NO: 1105833 - protein, 9 aa, Homo Sapiens
GGRAWAPQT

SEQ ID NO: 1105834 - protein, 9 aa, Homo Sapiens
HQVLRKLKQ

SEQ ID NO: 1105835 - protein, 9 aa, Homo Sapiens
LVSWKQSQQ

SEQ ID NO: 1105836 - protein, 9 aa, Homo Sapiens
QSSSHFYVV

SEQ ID NO: 1105837 - protein, 9 aa, Homo Sapiens
RGSTPRKEH

SEQ ID NO: 1105838 - protein, 9 aa, Homo Sapiens
QSVAVGARI

SEQ ID NO: 1105839 - protein, 9 aa, Homo Sapiens
LGQPTSPGT

SEQ ID NO: 1105840 - protein, 9 aa, Homo Sapiens
VWEERNPYK

SEQ ID NO: 1105841 - protein, 9 aa, Homo Sapiens
FAHLGKYIL

SEQ ID NO: 1105842 - protein, 9 aa, Homo Sapiens
SFLLVIASG

SEQ ID NO: 1105843 - protein, 9 aa, Homo Sapiens
ITQQGRVEV

SEQ ID NO: 1105844 - protein, 9 aa, Homo Sapiens
RPEWSLATG

SEQ ID NO: 1105845 - protein, 9 aa, Homo Sapiens
CYHSWLRDP

SEQ ID NO: 1105846 - protein, 9 aa, Homo Sapiens
RPWTPGQPR

SEQ ID NO: 1105847 - protein, 9 aa, Homo Sapiens
FEELFKVLG

SEQ ID NO: 1105848 - protein, 9 aa, Homo Sapiens
TTTPGHTTG

SEQ ID NO: 1105849 - protein, 9 aa, Homo Sapiens
ASCPAPHRS

SEQ ID NO: 1105850 - protein, 9 aa, Homo Sapiens
AITLLTLGS

SEQ ID NO: 1105851 - protein, 9 aa, Homo Sapiens
LDLLLCFQR

SEQ ID NO: 1105852 - protein, 9 aa, Homo Sapiens
KIKQELETM

SEQ ID NO: 1105853 - protein, 9 aa, Homo Sapiens
MDERWYTPR

SEQ ID NO: 1105854 - protein, 9 aa, Homo Sapiens
IFGSISTTR

SEQ ID NO: 1105855 - protein, 9 aa, Homo Sapiens
CYSTPSSYL

SEQ ID NO: 1105856 - protein, 9 aa, Homo Sapiens
TAPRRSGWT

SEQ ID NO: 1105857 - protein, 9 aa, Homo Sapiens
KPKAVGWPC

SEQ ID NO: 1105858 - protein, 9 aa, Homo Sapiens
IRERWLMGC

SEQ ID NO: 1105859 - protein, 9 aa, Homo Sapiens
MAPVGSVMS

SEQ ID NO: 1105860 - protein, 9 aa, Homo Sapiens
QKLPKNAQM

SEQ ID NO: 1105861 - protein, 9 aa, Homo Sapiens
STILQVSIP

SEQ ID NO: 1105862 - protein, 9 aa, Homo Sapiens
GPGSCPPSR

SEQ ID NO: 1105863 - protein, 9 aa, Homo Sapiens
PGSLPWVFS

SEQ ID NO: 1105864 - protein, 9 aa, Homo Sapiens
QFVRCRNAT

SEQ ID NO: 1105865 - protein, 9 aa, Homo Sapiens
GAAEPPGSY

SEQ ID NO: 1105866 - protein, 9 aa, Homo Sapiens
LHKGLDREQ

SEQ ID NO: 1105867 - protein, 9 aa, Homo Sapiens
AWWQRRKQS

SEQ ID NO: 1105868 - protein, 9 aa, Homo Sapiens
AHQAVLPAP

SEQ ID NO: 1105869 - protein, 9 aa, Homo Sapiens
GTLAAYPQT

SEQ ID NO: 1105870 - protein, 9 aa, Homo Sapiens
TLGPLRGWR

SEQ ID NO: 1105871 - protein, 9 aa, Homo Sapiens
IGSPQRRGE

SEQ ID NO: 1105872 - protein, 9 aa, Homo Sapiens
HTDKTLVAT

SEQ ID NO: 1105873 - protein, 9 aa, Homo Sapiens
RWMEAVRWV

SEQ ID NO: 1105874 - protein, 9 aa, Homo Sapiens
VSRAGKIAK

SEQ ID NO: 1105875 - protein, 9 aa, Homo Sapiens
HHAGTRVLK

SEQ ID NO: 1105876 - protein, 9 aa, Homo Sapiens
GNALQTSGS

SEQ ID NO: 1105877 - protein, 9 aa, Homo Sapiens
DAQAAQLPV

SEQ ID NO: 1105878 - protein, 9 aa, Homo Sapiens
DDPLHHTSI

SEQ ID NO: 1105879 - protein, 9 aa, Homo Sapiens
LCTGEDVAA

SEQ ID NO: 1105880 - protein, 9 aa, Homo Sapiens
LPTCSKKTQ

SEQ ID NO: 1105881 - protein, 9 aa, Homo Sapiens
CGVPSGSCA

SEQ ID NO: 1105882 - protein, 9 aa, Homo Sapiens
AQTKIQATM

SEQ ID NO: 1105883 - protein, 9 aa, Homo Sapiens
LPLPPPVWA

SEQ ID NO: 1105884 - protein, 9 aa, Homo Sapiens
ACLRTHGCS

SEQ ID NO: 1105885 - protein, 9 aa, Homo Sapiens
LQSHPRASQ

SEQ ID NO: 1105886 - protein, 9 aa, Homo Sapiens
GAPQTTPHW

SEQ ID NO: 1105887 - protein, 9 aa, Homo Sapiens
AACQLCCGK

SEQ ID NO: 1105888 - protein, 9 aa, Homo Sapiens
MEGFLAFPS

SEQ ID NO: 1105889 - protein, 9 aa, Homo Sapiens
PPPSRQDPR

SEQ ID NO: 1105890 - protein, 9 aa, Homo Sapiens
FGLCRRPQP

SEQ ID NO: 1105891 - protein, 9 aa, Homo Sapiens
VLSHLALEQ

SEQ ID NO: 1105892 - protein, 9 aa, Homo Sapiens
GVAAAVAVA

SEQ ID NO: 1105893 - protein, 9 aa, Homo Sapiens
PGVEGVKAP

SEQ ID NO: 1105894 - protein, 9 aa, Homo Sapiens
LARFTASAL

SEQ ID NO: 1105895 - protein, 9 aa, Homo Sapiens
TCTNITMGV

SEQ ID NO: 1105896 - protein, 9 aa, Homo Sapiens
PAAVLSLPL

SEQ ID NO: 1105897 - protein, 9 aa, Homo Sapiens
GEPNPGVGL

SEQ ID NO: 1105898 - protein, 9 aa, Homo Sapiens
LQLSRLIRY

SEQ ID NO: 1105899 - protein, 9 aa, Homo Sapiens
GGASVPRGA

SEQ ID NO: 1105900 - protein, 9 aa, Homo Sapiens
EGSKAGRSQ

SEQ ID NO: 1105901 - protein, 9 aa, Homo Sapiens
RPVRPGCRG

SEQ ID NO: 1105902 - protein, 9 aa, Homo Sapiens
FNQNMHLTE

SEQ ID NO: 1105903 - protein, 9 aa, Homo Sapiens
QRPAAHGPA

SEQ ID NO: 1105904 - protein, 9 aa, Homo Sapiens
KSITLWNPS

SEQ ID NO: 1105905 - protein, 9 aa, Homo Sapiens
GRGSLLLLP

SEQ ID NO: 1105906 - protein, 9 aa, Homo Sapiens
SLSPCLGWP

SEQ ID NO: 1105907 - protein, 9 aa, Homo Sapiens
TALGYMEAF

SEQ ID NO: 1105908 - protein, 9 aa, Homo Sapiens
HSTEPSLVL

SEQ ID NO: 1105909 - protein, 9 aa, Homo Sapiens
KYEQIDGGI

SEQ ID NO: 1105910 - protein, 9 aa, Homo Sapiens
NFEYTVERV

SEQ ID NO: 1105911 - protein, 9 aa, Homo Sapiens
LPGSTDHPT

SEQ ID NO: 1105912 - protein, 9 aa, Homo Sapiens
FVPDYMREL

SEQ ID NO: 1105913 - protein, 9 aa, Homo Sapiens
AASGPCHAA

SEQ ID NO: 1105914 - protein, 9 aa, Homo Sapiens
CPLNPAAQD

SEQ ID NO: 1105915 - protein, 9 aa, Homo Sapiens
FKRPRVALI

SEQ ID NO: 1105916 - protein, 9 aa, Homo Sapiens
EKNCLVPLA

SEQ ID NO: 1105917 - protein, 9 aa, Homo Sapiens
AAPWREASQ

SEQ ID NO: 1105918 - protein, 9 aa, Homo Sapiens
KFYETDCYI

SEQ ID NO: 1105919 - protein, 9 aa, Homo Sapiens
CQHEEGAGR

SEQ ID NO: 1105920 - protein, 9 aa, Homo Sapiens
AWWWGTLVR

SEQ ID NO: 1105921 - protein, 9 aa, Homo Sapiens
AVVKIIKKT

SEQ ID NO: 1105922 - protein, 9 aa, Homo Sapiens
CISLLREWF

SEQ ID NO: 1105923 - protein, 9 aa, Homo Sapiens
EFHSTILQV

SEQ ID NO: 1105924 - protein, 9 aa, Homo Sapiens
VDEKQASTE

SEQ ID NO: 1105925 - protein, 9 aa, Homo Sapiens
GLQSYHQAL

SEQ ID NO: 1105926 - protein, 9 aa, Homo Sapiens
PAVPAAPAA

SEQ ID NO: 1105927 - protein, 9 aa, Homo Sapiens
VEIGTVVVL

SEQ ID NO: 1105928 - protein, 9 aa, Homo Sapiens
PQGAGSPTL

SEQ ID NO: 1105929 - protein, 9 aa, Homo Sapiens
DDSPPFIIT

SEQ ID NO: 1105930 - protein, 9 aa, Homo Sapiens
PSGGLRARP

SEQ ID NO: 1105931 - protein, 9 aa, Homo Sapiens
YDNFQCPHT

SEQ ID NO: 1105932 - protein, 9 aa, Homo Sapiens
IVGCIAIGV

SEQ ID NO: 1105933 - protein, 9 aa, Homo Sapiens
HCLLTAHLL

SEQ ID NO: 1105934 - protein, 9 aa, Homo Sapiens
LQWPHPDPA

SEQ ID NO: 1105935 - protein, 9 aa, Homo Sapiens
GTKSGPLIS

SEQ ID NO: 1105936 - protein, 9 aa, Homo Sapiens
PGFSANPHA

SEQ ID NO: 1105937 - protein, 9 aa, Homo Sapiens
FYCSVDYNM

SEQ ID NO: 1105938 - protein, 9 aa, Homo Sapiens
LGTTPFSSA

SEQ ID NO: 1105939 - protein, 9 aa, Homo Sapiens
TKLMAKTIR

SEQ ID NO: 1105940 - protein, 9 aa, Homo Sapiens
RNAHHAVYK

SEQ ID NO: 1105941 - protein, 9 aa, Homo Sapiens
RVLNTPNNP

SEQ ID NO: 1105942 - protein, 9 aa, Homo Sapiens
LQLGEQEGK

SEQ ID NO: 1105943 - protein, 9 aa, Homo Sapiens
EDGRAPRQL

SEQ ID NO: 1105944 - protein, 9 aa, Homo Sapiens
KVHNFQVWN

SEQ ID NO: 1105945 - protein, 9 aa, Homo Sapiens
HALYMTVLE

SEQ ID NO: 1105946 - protein, 9 aa, Homo Sapiens
FNIDEGTKS

SEQ ID NO: 1105947 - protein, 9 aa, Homo Sapiens
YGVHQSVPY

SEQ ID NO: 1105948 - protein, 9 aa, Homo Sapiens
SPASACTMP

SEQ ID NO: 1105949 - protein, 9 aa, Homo Sapiens
QRRLFLYKI

SEQ ID NO: 1105950 - protein, 9 aa, Homo Sapiens
PLPRSLGFL

SEQ ID NO: 1105951 - protein, 9 aa, Homo Sapiens
REPRRGTSV

SEQ ID NO: 1105952 - protein, 9 aa, Homo Sapiens
PSNSRKFGW

SEQ ID NO: 1105953 - protein, 9 aa, Homo Sapiens
KSLAQLLPA

SEQ ID NO: 1105954 - protein, 9 aa, Homo Sapiens
RMGSPKIEV

SEQ ID NO: 1105955 - protein, 9 aa, Homo Sapiens
YTPQDPETS

SEQ ID NO: 1105956 - protein, 9 aa, Homo Sapiens
SNGKGVFCT

SEQ ID NO: 1105957 - protein, 9 aa, Homo Sapiens
SPHLMCGTL

SEQ ID NO: 1105958 - protein, 9 aa, Homo Sapiens
RAGRGSLLL

SEQ ID NO: 1105959 - protein, 9 aa, Homo Sapiens
ATKGFSLLT

SEQ ID NO: 1105960 - protein, 9 aa, Homo Sapiens
WTWMTWCGW

SEQ ID NO: 1105961 - protein, 9 aa, Homo Sapiens
GSYAVATAS

SEQ ID NO: 1105962 - protein, 9 aa, Homo Sapiens
QQGRVEVLN

SEQ ID NO: 1105963 - protein, 9 aa, Homo Sapiens
ADLVIWART

SEQ ID NO: 1105964 - protein, 9 aa, Homo Sapiens
LALFYQGPG

SEQ ID NO: 1105965 - protein, 9 aa, Homo Sapiens
QSILSVCLE

SEQ ID NO: 1105966 - protein, 9 aa, Homo Sapiens
REAQTINHS

SEQ ID NO: 1105967 - protein, 9 aa, Homo Sapiens
IAEKNCLVP

SEQ ID NO: 1105968 - protein, 9 aa, Homo Sapiens
VNSSVTTQP

SEQ ID NO: 1105969 - protein, 9 aa, Homo Sapiens
HHPLGDTPQ

SEQ ID NO: 1105970 - protein, 9 aa, Homo Sapiens
WATVGLVWV

SEQ ID NO: 1105971 - protein, 9 aa, Homo Sapiens
SGDDSDFCE

SEQ ID NO: 1105972 - protein, 9 aa, Homo Sapiens
PDMMRKLRR

SEQ ID NO: 1105973 - protein, 9 aa, Homo Sapiens
STSFDKFTN

SEQ ID NO: 1105974 - protein, 9 aa, Homo Sapiens
NNLGANNYD

SEQ ID NO: 1105975 - protein, 9 aa, Homo Sapiens
YHRNCLLCR

SEQ ID NO: 1105976 - protein, 9 aa, Homo Sapiens
TLYGNMFSQ

SEQ ID NO: 1105977 - protein, 9 aa, Homo Sapiens
HMSQNHSRS

SEQ ID NO: 1105978 - protein, 9 aa, Homo Sapiens
LQKEEFCHV

SEQ ID NO: 1105979 - protein, 9 aa, Homo Sapiens
VVPALAPHP

SEQ ID NO: 1105980 - protein, 9 aa, Homo Sapiens
SRHATFKNF

SEQ ID NO: 1105981 - protein, 9 aa, Homo Sapiens
KAETEDEDK

SEQ ID NO: 1105982 - protein, 9 aa, Homo Sapiens
LLRFSELSL

SEQ ID NO: 1105983 - protein, 9 aa, Homo Sapiens
LLAWDPPPG

SEQ ID NO: 1105984 - protein, 9 aa, Homo Sapiens
KASILEEKR

SEQ ID NO: 1105985 - protein, 9 aa, Homo Sapiens
AQHHIAPGY

SEQ ID NO: 1105986 - protein, 9 aa, Homo Sapiens
AVRDPIAAG

SEQ ID NO: 1105987 - protein, 9 aa, Homo Sapiens
MVSPEVTNS

SEQ ID NO: 1105988 - protein, 9 aa, Homo Sapiens
RLKDTQDQL

SEQ ID NO: 1105989 - protein, 9 aa, Homo Sapiens
PFDVKTEQV

SEQ ID NO: 1105990 - protein, 9 aa, Homo Sapiens
PCLGWPLDQ

SEQ ID NO: 1105991 - protein, 9 aa, Homo Sapiens
PWLPMRSLG

SEQ ID NO: 1105992 - protein, 9 aa, Homo Sapiens
ALPSVDPTW

SEQ ID NO: 1105993 - protein, 9 aa, Homo Sapiens
RKAMTKKRV

SEQ ID NO: 1105994 - protein, 9 aa, Homo Sapiens
AGYNSSRYI

SEQ ID NO: 1105995 - protein, 9 aa, Homo Sapiens
PQTTPHWTF

SEQ ID NO: 1105996 - protein, 9 aa, Homo Sapiens
VFSHAALER

SEQ ID NO: 1105997 - protein, 9 aa, Homo Sapiens
SSCLAGVTA

SEQ ID NO: 1105998 - protein, 9 aa, Homo Sapiens
RLRVQHMQG

SEQ ID NO: 1105999 - protein, 9 aa, Homo Sapiens
LQNTSLESY

SEQ ID NO: 1106000 - protein, 9 aa, Homo Sapiens
THSLVCPEI

SEQ ID NO: 1106001 - protein, 9 aa, Homo Sapiens
PNPVVLMPT

SEQ ID NO: 1106002 - protein, 9 aa, Homo Sapiens
TLYGSMQAH

SEQ ID NO: 1106003 - protein, 9 aa, Homo Sapiens
DLNPVPETP

SEQ ID NO: 1106004 - protein, 9 aa, Homo Sapiens
LLTCLESAV

SEQ ID NO: 1106005 - protein, 9 aa, Homo Sapiens
WRTACVSPS

SEQ ID NO: 1106006 - protein, 9 aa, Homo Sapiens
YACTQCGRR

SEQ ID NO: 1106007 - protein, 9 aa, Homo Sapiens
RAQEHRAQL

SEQ ID NO: 1106008 - protein, 9 aa, Homo Sapiens
SHRLTRGPR

SEQ ID NO: 1106009 - protein, 9 aa, Homo Sapiens
MITISAVSS

SEQ ID NO: 1106010 - protein, 9 aa, Homo Sapiens
LRTAQPKTA

SEQ ID NO: 1106011 - protein, 9 aa, Homo Sapiens
DLVDEGEGL

SEQ ID NO: 1106012 - protein, 9 aa, Homo Sapiens
ERRALRCST

SEQ ID NO: 1106013 - protein, 9 aa, Homo Sapiens
EPHMRPKRP

SEQ ID NO: 1106014 - protein, 9 aa, Homo Sapiens
EPVEPLLVR

SEQ ID NO: 1106015 - protein, 9 aa, Homo Sapiens
LRETYRLIS

SEQ ID NO: 1106016 - protein, 9 aa, Homo Sapiens
ARPRGAVAG

SEQ ID NO: 1106017 - protein, 9 aa, Homo Sapiens
HATFKNFGM

SEQ ID NO: 1106018 - protein, 9 aa, Homo Sapiens
GPASSSLQF

SEQ ID NO: 1106019 - protein, 9 aa, Homo Sapiens
SLLQAMANL

SEQ ID NO: 1106020 - protein, 9 aa, Homo Sapiens
YALDLRSQG

SEQ ID NO: 1106021 - protein, 9 aa, Homo Sapiens
ICCLSRLLP

SEQ ID NO: 1106022 - protein, 9 aa, Homo Sapiens
ARPEALFYP

SEQ ID NO: 1106023 - protein, 9 aa, Homo Sapiens
AGAARASSG

SEQ ID NO: 1106024 - protein, 9 aa, Homo Sapiens
LHCLQNTSL

SEQ ID NO: 1106025 - protein, 9 aa, Homo Sapiens
PGARLLLQI

SEQ ID NO: 1106026 - protein, 9 aa, Homo Sapiens
KILFTNWYQ

SEQ ID NO: 1106027 - protein, 9 aa, Homo Sapiens
PPPRPGTLP

SEQ ID NO: 1106028 - protein, 9 aa, Homo Sapiens
TPKRSSSQP

SEQ ID NO: 1106029 - protein, 9 aa, Homo Sapiens
RLLPEHCTR

SEQ ID NO: 1106030 - protein, 9 aa, Homo Sapiens
LQRSPSSNA

SEQ ID NO: 1106031 - protein, 9 aa, Homo Sapiens
TGNVRSGPL

SEQ ID NO: 1106032 - protein, 9 aa, Homo Sapiens
GMRHGYGVH

SEQ ID NO: 1106033 - protein, 9 aa, Homo Sapiens
PHAPKTRTE

SEQ ID NO: 1106034 - protein, 9 aa, Homo Sapiens
PASPGRRPL

SEQ ID NO: 1106035 - protein, 9 aa, Homo Sapiens
TRRYRPRGA

SEQ ID NO: 1106036 - protein, 9 aa, Homo Sapiens
HFSQARTRA

SEQ ID NO: 1106037 - protein, 9 aa, Homo Sapiens
LDEIYHMGT

SEQ ID NO: 1106038 - protein, 9 aa, Homo Sapiens
GDTSPAAIP

SEQ ID NO: 1106039 - protein, 9 aa, Homo Sapiens
TSRQDPRSQ

SEQ ID NO: 1106040 - protein, 9 aa, Homo Sapiens
PEFQSTCVP

SEQ ID NO: 1106041 - protein, 9 aa, Homo Sapiens
PGTQGPLHP

SEQ ID NO: 1106042 - protein, 9 aa, Homo Sapiens
PGRGRERGG

SEQ ID NO: 1106043 - protein, 9 aa, Homo Sapiens
SYCSTRQTS

SEQ ID NO: 1106044 - protein, 9 aa, Homo Sapiens
WSAFLEPEG

SEQ ID NO: 1106045 - protein, 9 aa, Homo Sapiens
LQPKPWQQQ

SEQ ID NO: 1106046 - protein, 9 aa, Homo Sapiens
TSIPRRTLQ

SEQ ID NO: 1106047 - protein, 9 aa, Homo Sapiens
DWATIRLRS

SEQ ID NO: 1106048 - protein, 9 aa, Homo Sapiens
AWPREAHRV

SEQ ID NO: 1106049 - protein, 9 aa, Homo Sapiens
GVRMLDGAI

SEQ ID NO: 1106050 - protein, 9 aa, Homo Sapiens
LSSSPASVQ

SEQ ID NO: 1106051 - protein, 9 aa, Homo Sapiens
INEETRVSV

SEQ ID NO: 1106052 - protein, 9 aa, Homo Sapiens
NILQLGEQE

SEQ ID NO: 1106053 - protein, 9 aa, Homo Sapiens
LLDCSAESN

SEQ ID NO: 1106054 - protein, 9 aa, Homo Sapiens
VLDRLLYVV

SEQ ID NO: 1106055 - protein, 9 aa, Homo Sapiens
RSKPATLAQ

SEQ ID NO: 1106056 - protein, 9 aa, Homo Sapiens
EGTKSGPLI

SEQ ID NO: 1106057 - protein, 9 aa, Homo Sapiens
TGQFHVYSE

SEQ ID NO: 1106058 - protein, 9 aa, Homo Sapiens
ASRTSVTAS

SEQ ID NO: 1106059 - protein, 9 aa, Homo Sapiens
ASTPAPCLT

SEQ ID NO: 1106060 - protein, 9 aa, Homo Sapiens
ERARKDGPP

SEQ ID NO: 1106061 - protein, 9 aa, Homo Sapiens
AGAVQESWP

SEQ ID NO: 1106062 - protein, 9 aa, Homo Sapiens
VSSSLGTTP

SEQ ID NO: 1106063 - protein, 9 aa, Homo Sapiens
HVDFQLVLP

SEQ ID NO: 1106064 - protein, 9 aa, Homo Sapiens
WSSKLTAHK

SEQ ID NO: 1106065 - protein, 9 aa, Homo Sapiens
YVGTLFNGL

SEQ ID NO: 1106066 - protein, 9 aa, Homo Sapiens
TYPCPSAAR

SEQ ID NO: 1106067 - protein, 9 aa, Homo Sapiens
SGNGVAGSL

SEQ ID NO: 1106068 - protein, 9 aa, Homo Sapiens
IIQSNPAKC

SEQ ID NO: 1106069 - protein, 9 aa, Homo Sapiens
ASPGRRPLK

SEQ ID NO: 1106070 - protein, 9 aa, Homo Sapiens
QQGYSAYTT

SEQ ID NO: 1106071 - protein, 9 aa, Homo Sapiens
LLLLDLPIL

SEQ ID NO: 1106072 - protein, 9 aa, Homo Sapiens
SLWMENEHV

SEQ ID NO: 1106073 - protein, 9 aa, Homo Sapiens
STVCRESER

SEQ ID NO: 1106074 - protein, 9 aa, Homo Sapiens
QQVGIFLDY

SEQ ID NO: 1106075 - protein, 9 aa, Homo Sapiens
ELCGSGNGV

SEQ ID NO: 1106076 - protein, 9 aa, Homo Sapiens
TLPTYQHSE

SEQ ID NO: 1106077 - protein, 9 aa, Homo Sapiens
PLAITISLA

SEQ ID NO: 1106078 - protein, 9 aa, Homo Sapiens
PVPGVPGRL

SEQ ID NO: 1106079 - protein, 9 aa, Homo Sapiens
RGAESEWNW

SEQ ID NO: 1106080 - protein, 9 aa, Homo Sapiens
LGDTPQPSL

SEQ ID NO: 1106081 - protein, 9 aa, Homo Sapiens
KQSQQSLSL

SEQ ID NO: 1106082 - protein, 9 aa, Homo Sapiens
PRQLGQGLG

SEQ ID NO: 1106083 - protein, 9 aa, Homo Sapiens
SVSLKNQPT

SEQ ID NO: 1106084 - protein, 9 aa, Homo Sapiens
WVLLPRLVE

SEQ ID NO: 1106085 - protein, 9 aa, Homo Sapiens
LSMAELGLG

SEQ ID NO: 1106086 - protein, 9 aa, Homo Sapiens
PKRLGTGRD

SEQ ID NO: 1106087 - protein, 9 aa, Homo Sapiens
NTKKEMVTS

SEQ ID NO: 1106088 - protein, 9 aa, Homo Sapiens
LEKTAQPAP

SEQ ID NO: 1106089 - protein, 9 aa, Homo Sapiens
RVLRGCWVG

SEQ ID NO: 1106090 - protein, 9 aa, Homo Sapiens
FSELSLVYL

SEQ ID NO: 1106091 - protein, 9 aa, Homo Sapiens
QLQEGRPSC

SEQ ID NO: 1106092 - protein, 9 aa, Homo Sapiens
TATQVDALQ

SEQ ID NO: 1106093 - protein, 9 aa, Homo Sapiens
GEKHQDGEK

SEQ ID NO: 1106094 - protein, 9 aa, Homo Sapiens
KTAQPAPKT

SEQ ID NO: 1106095 - protein, 9 aa, Homo Sapiens
RELKYIHSA

SEQ ID NO: 1106096 - protein, 9 aa, Homo Sapiens
VGEKGLELS

SEQ ID NO: 1106097 - protein, 9 aa, Homo Sapiens
EDQLHGAGF

SEQ ID NO: 1106098 - protein, 9 aa, Homo Sapiens
PSMPLILER

SEQ ID NO: 1106099 - protein, 9 aa, Homo Sapiens
SKMKADKLY

SEQ ID NO: 1106100 - protein, 9 aa, Homo Sapiens
WSPHRPILQ

SEQ ID NO: 1106101 - protein, 9 aa, Homo Sapiens
YQHSEVILF

SEQ ID NO: 1106102 - protein, 9 aa, Homo Sapiens
QLWECLSTT

SEQ ID NO: 1106103 - protein, 9 aa, Homo Sapiens
GSVEAEASY

SEQ ID NO: 1106104 - protein, 9 aa, Homo Sapiens
MCQQLKGCY

SEQ ID NO: 1106105 - protein, 9 aa, Homo Sapiens
ESIPKKSYA

SEQ ID NO: 1106106 - protein, 9 aa, Homo Sapiens
IASGNRVIR

SEQ ID NO: 1106107 - protein, 9 aa, Homo Sapiens
LVLRVLRVL

SEQ ID NO: 1106108 - protein, 9 aa, Homo Sapiens
RGEKHQDGE

SEQ ID NO: 1106109 - protein, 9 aa, Homo Sapiens
GYLLTRVAT

SEQ ID NO: 1106110 - protein, 9 aa, Homo Sapiens
SQTPLLSSL

SEQ ID NO: 1106111 - protein, 9 aa, Homo Sapiens
PPPPTPSSS

SEQ ID NO: 1106112 - protein, 9 aa, Homo Sapiens
RPGTCTNIT

SEQ ID NO: 1106113 - protein, 9 aa, Homo Sapiens
SLQCQSLAL

SEQ ID NO: 1106114 - protein, 9 aa, Homo Sapiens
DGQSQTVRQ

SEQ ID NO: 1106115 - protein, 9 aa, Homo Sapiens
EFWLISAPV

SEQ ID NO: 1106116 - protein, 9 aa, Homo Sapiens
SATCSPGWM

SEQ ID NO: 1106117 - protein, 9 aa, Homo Sapiens
RGDDTPCIW

SEQ ID NO: 1106118 - protein, 9 aa, Homo Sapiens
EEEADDEEE

SEQ ID NO: 1106119 - protein, 9 aa, Homo Sapiens
LPMRWVLRK

SEQ ID NO: 1106120 - protein, 9 aa, Homo Sapiens
MAKTIRFTV

SEQ ID NO: 1106121 - protein, 9 aa, Homo Sapiens
PAAEEVGGG

SEQ ID NO: 1106122 - protein, 9 aa, Homo Sapiens
VMIEIGTIL

SEQ ID NO: 1106123 - protein, 9 aa, Homo Sapiens
HAWPGHFLK

SEQ ID NO: 1106124 - protein, 9 aa, Homo Sapiens
DGAWAEAPG

SEQ ID NO: 1106125 - protein, 9 aa, Homo Sapiens
CENNPPGAY

SEQ ID NO: 1106126 - protein, 9 aa, Homo Sapiens
SEDVKIWVL

SEQ ID NO: 1106127 - protein, 9 aa, Homo Sapiens
FWTAKCHRS

SEQ ID NO: 1106128 - protein, 9 aa, Homo Sapiens
LCGSGNGVA

SEQ ID NO: 1106129 - protein, 9 aa, Homo Sapiens
NFGEQPHAG

SEQ ID NO: 1106130 - protein, 9 aa, Homo Sapiens
LQPAPPPPL

SEQ ID NO: 1106131 - protein, 9 aa, Homo Sapiens
CVNCCWPMD

SEQ ID NO: 1106132 - protein, 9 aa, Homo Sapiens
HCQARCQEL

SEQ ID NO: 1106133 - protein, 9 aa, Homo Sapiens
PLSEITEHE

SEQ ID NO: 1106134 - protein, 9 aa, Homo Sapiens
KIWVLFASK

SEQ ID NO: 1106135 - protein, 9 aa, Homo Sapiens
ALPQRGPAS

SEQ ID NO: 1106136 - protein, 9 aa, Homo Sapiens
TTAVLGKTP

SEQ ID NO: 1106137 - protein, 9 aa, Homo Sapiens
KKQELANSL

SEQ ID NO: 1106138 - protein, 9 aa, Homo Sapiens
PSRMDHNVE

SEQ ID NO: 1106139 - protein, 9 aa, Homo Sapiens
STAPSPRAG

SEQ ID NO: 1106140 - protein, 9 aa, Homo Sapiens
EAGAVAPTA

SEQ ID NO: 1106141 - protein, 9 aa, Homo Sapiens
VILTGAHRF

SEQ ID NO: 1106142 - protein, 9 aa, Homo Sapiens
KSPNTTILI

SEQ ID NO: 1106143 - protein, 9 aa, Homo Sapiens
RDAHSSITG

SEQ ID NO: 1106144 - protein, 9 aa, Homo Sapiens
PAGVGGRSP

SEQ ID NO: 1106145 - protein, 9 aa, Homo Sapiens
REWGHCQAR

SEQ ID NO: 1106146 - protein, 9 aa, Homo Sapiens
GLLAARTTT

SEQ ID NO: 1106147 - protein, 9 aa, Homo Sapiens
LTIQKALSD

SEQ ID NO: 1106148 - protein, 9 aa, Homo Sapiens
LLCRRGILQ

SEQ ID NO: 1106149 - protein, 9 aa, Homo Sapiens
DVKIWVLFA

SEQ ID NO: 1106150 - protein, 9 aa, Homo Sapiens
VSEDEWDRV

SEQ ID NO: 1106151 - protein, 9 aa, Homo Sapiens
VPMYRYHRR

SEQ ID NO: 1106152 - protein, 9 aa, Homo Sapiens
ILRGSPPYT

SEQ ID NO: 1106153 - protein, 9 aa, Homo Sapiens
DYKICVNCC

SEQ ID NO: 1106154 - protein, 9 aa, Homo Sapiens
SSPNSLESP

SEQ ID NO: 1106155 - protein, 9 aa, Homo Sapiens
NDLVKWKIA

SEQ ID NO: 1106156 - protein, 9 aa, Homo Sapiens
DSPSARWRC

SEQ ID NO: 1106157 - protein, 9 aa, Homo Sapiens
GTISCEHPW

SEQ ID NO: 1106158 - protein, 9 aa, Homo Sapiens
LRHRVIATH

SEQ ID NO: 1106159 - protein, 9 aa, Homo Sapiens
RMPLSCQLC

SEQ ID NO: 1106160 - protein, 9 aa, Homo Sapiens
SGSRSLWPP

SEQ ID NO: 1106161 - protein, 9 aa, Homo Sapiens
SGLEYYPLL

SEQ ID NO: 1106162 - protein, 9 aa, Homo Sapiens
ISCPRPSAT

SEQ ID NO: 1106163 - protein, 9 aa, Homo Sapiens
GGRWRIGGL

SEQ ID NO: 1106164 - protein, 9 aa, Homo Sapiens
FIVNSKDYM

SEQ ID NO: 1106165 - protein, 9 aa, Homo Sapiens
WTLGADRGS

SEQ ID NO: 1106166 - protein, 9 aa, Homo Sapiens
HRERNRNKQ

SEQ ID NO: 1106167 - protein, 9 aa, Homo Sapiens
FLYLVNLNK

SEQ ID NO: 1106168 - protein, 9 aa, Homo Sapiens
DPAGSPRPG

SEQ ID NO: 1106169 - protein, 9 aa, Homo Sapiens
SHSTGPPSN

SEQ ID NO: 1106170 - protein, 9 aa, Homo Sapiens
REVDWEYFM

SEQ ID NO: 1106171 - protein, 9 aa, Homo Sapiens
YLSYIRYGF

SEQ ID NO: 1106172 - protein, 9 aa, Homo Sapiens
ALKNHLVKE

SEQ ID NO: 1106173 - protein, 9 aa, Homo Sapiens
VHELGVAVD

SEQ ID NO: 1106174 - protein, 9 aa, Homo Sapiens
VVKRFLTTD

SEQ ID NO: 1106175 - protein, 9 aa, Homo Sapiens
LEGCRPFAK

SEQ ID NO: 1106176 - protein, 9 aa, Homo Sapiens
AHGPARPLE

SEQ ID NO: 1106177 - protein, 9 aa, Homo Sapiens
EHLALQRPA

SEQ ID NO: 1106178 - protein, 9 aa, Homo Sapiens
NTCLEKTAK

SEQ ID NO: 1106179 - protein, 9 aa, Homo Sapiens
RFCHPLAVA

SEQ ID NO: 1106180 - protein, 9 aa, Homo Sapiens
RALRARQVL

SEQ ID NO: 1106181 - protein, 9 aa, Homo Sapiens
DDPDVKIEL

SEQ ID NO: 1106182 - protein, 9 aa, Homo Sapiens
LIQKKKVPT

SEQ ID NO: 1106183 - protein, 9 aa, Homo Sapiens
TILEIFYLK

SEQ ID NO: 1106184 - protein, 9 aa, Homo Sapiens
PIDTVLLGA

SEQ ID NO: 1106185 - protein, 9 aa, Homo Sapiens
LLNFEEMRV

SEQ ID NO: 1106186 - protein, 9 aa, Homo Sapiens
RGSLALSSE

SEQ ID NO: 1106187 - protein, 9 aa, Homo Sapiens
LPMRSLGEP

SEQ ID NO: 1106188 - protein, 9 aa, Homo Sapiens
GQEQYRTIT

SEQ ID NO: 1106189 - protein, 9 aa, Homo Sapiens
PGNRGLPLP

SEQ ID NO: 1106190 - protein, 9 aa, Homo Sapiens
KLSGPSGAG

SEQ ID NO: 1106191 - protein, 9 aa, Homo Sapiens
QFWSKMESR

SEQ ID NO: 1106192 - protein, 9 aa, Homo Sapiens
RTTTLQRSP

SEQ ID NO: 1106193 - protein, 9 aa, Homo Sapiens
AAEKPWDAN

SEQ ID NO: 1106194 - protein, 9 aa, Homo Sapiens
DICALGLVY

SEQ ID NO: 1106195 - protein, 9 aa, Homo Sapiens
YVLILLILV

SEQ ID NO: 1106196 - protein, 9 aa, Homo Sapiens
CSIRERWLM

SEQ ID NO: 1106197 - protein, 9 aa, Homo Sapiens
GESPWQVMA

SEQ ID NO: 1106198 - protein, 9 aa, Homo Sapiens
MRELLLELR

SEQ ID NO: 1106199 - protein, 9 aa, Homo Sapiens
YNATVRNSI

SEQ ID NO: 1106200 - protein, 9 aa, Homo Sapiens
VANDVMLCT

SEQ ID NO: 1106201 - protein, 9 aa, Homo Sapiens
IESGILLVM

SEQ ID NO: 1106202 - protein, 9 aa, Homo Sapiens
EQEEEAEED

SEQ ID NO: 1106203 - protein, 9 aa, Homo Sapiens
GSLSNYNSS

SEQ ID NO: 1106204 - protein, 9 aa, Homo Sapiens
LVAELALVG

SEQ ID NO: 1106205 - protein, 9 aa, Homo Sapiens
ITAAAMVLS

SEQ ID NO: 1106206 - protein, 9 aa, Homo Sapiens
PPPTYPCPS

SEQ ID NO: 1106207 - protein, 9 aa, Homo Sapiens
LLRLLQLSR

SEQ ID NO: 1106208 - protein, 9 aa, Homo Sapiens
DAFFLVVSC

SEQ ID NO: 1106209 - protein, 9 aa, Homo Sapiens
RSLVEQHKQ

SEQ ID NO: 1106210 - protein, 9 aa, Homo Sapiens
RENGGGGDS

SEQ ID NO: 1106211 - protein, 9 aa, Homo Sapiens
HVLQEGSMA

SEQ ID NO: 1106212 - protein, 9 aa, Homo Sapiens
MRMLPTARS

SEQ ID NO: 1106213 - protein, 9 aa, Homo Sapiens
YSSYYGGLG

SEQ ID NO: 1106214 - protein, 9 aa, Homo Sapiens
TQQLKTAQI

SEQ ID NO: 1106215 - protein, 9 aa, Homo Sapiens
YITENNPRG

SEQ ID NO: 1106216 - protein, 9 aa, Homo Sapiens
WLDDKHVAF

SEQ ID NO: 1106217 - protein, 9 aa, Homo Sapiens
HPAVPGVTF

SEQ ID NO: 1106218 - protein, 9 aa, Homo Sapiens
HQQDPGGVP

SEQ ID NO: 1106219 - protein, 9 aa, Homo Sapiens
PGKTSLKAS

SEQ ID NO: 1106220 - protein, 9 aa, Homo Sapiens
AGAARARTC

SEQ ID NO: 1106221 - protein, 9 aa, Homo Sapiens
RRGRLPHGQ

SEQ ID NO: 1106222 - protein, 9 aa, Homo Sapiens
GCPFQAPAP

SEQ ID NO: 1106223 - protein, 9 aa, Homo Sapiens
LIGTSANVV

SEQ ID NO: 1106224 - protein, 9 aa, Homo Sapiens
FMPPPGHPP

SEQ ID NO: 1106225 - protein, 9 aa, Homo Sapiens
AAAGVAAAV

SEQ ID NO: 1106226 - protein, 9 aa, Homo Sapiens
DLLAREGRA

SEQ ID NO: 1106227 - protein, 9 aa, Homo Sapiens
LLSTLSQPP

SEQ ID NO: 1106228 - protein, 9 aa, Homo Sapiens
LLVIASGNR

SEQ ID NO: 1106229 - protein, 9 aa, Homo Sapiens
RPSATSQTP

SEQ ID NO: 1106230 - protein, 9 aa, Homo Sapiens
PDSSGSRSL

SEQ ID NO: 1106231 - protein, 9 aa, Homo Sapiens
QLVGGQVGH

SEQ ID NO: 1106232 - protein, 9 aa, Homo Sapiens
MYFLNGSFV

SEQ ID NO: 1106233 - protein, 9 aa, Homo Sapiens
WSSYLSYIR

SEQ ID NO: 1106234 - protein, 9 aa, Homo Sapiens
WPSFSWTIR

SEQ ID NO: 1106235 - protein, 9 aa, Homo Sapiens
HPDPAGSPR

SEQ ID NO: 1106236 - protein, 9 aa, Homo Sapiens
PGPTTVGNG

SEQ ID NO: 1106237 - protein, 9 aa, Homo Sapiens
IPRVDALKN

SEQ ID NO: 1106238 - protein, 9 aa, Homo Sapiens
GHREIHRVP

SEQ ID NO: 1106239 - protein, 9 aa, Homo Sapiens
AMAYAEQNG

SEQ ID NO: 1106240 - protein, 9 aa, Homo Sapiens
CTVLCIWCF

SEQ ID NO: 1106241 - protein, 9 aa, Homo Sapiens
MGDFGLAEK

SEQ ID NO: 1106242 - protein, 9 aa, Homo Sapiens
CFLAIHLLL

SEQ ID NO: 1106243 - protein, 9 aa, Homo Sapiens
SARHPHAPK

SEQ ID NO: 1106244 - protein, 9 aa, Homo Sapiens
DVVEWSPHR

SEQ ID NO: 1106245 - protein, 9 aa, Homo Sapiens
MEKIKQELE

SEQ ID NO: 1106246 - protein, 9 aa, Homo Sapiens
AVAVAVAAA

SEQ ID NO: 1106247 - protein, 9 aa, Homo Sapiens
SSSVGTEPD

SEQ ID NO: 1106248 - protein, 9 aa, Homo Sapiens
SQEEGILRL

SEQ ID NO: 1106249 - protein, 9 aa, Homo Sapiens
CVALFKGAR

SEQ ID NO: 1106250 - protein, 9 aa, Homo Sapiens
RKKKKKGQE

SEQ ID NO: 1106251 - protein, 9 aa, Homo Sapiens
FKLSCIINR

SEQ ID NO: 1106252 - protein, 9 aa, Homo Sapiens
VDHSHVFTF

SEQ ID NO: 1106253 - protein, 9 aa, Homo Sapiens
ALVGIQPAG

SEQ ID NO: 1106254 - protein, 9 aa, Homo Sapiens
SDNLRKVVM

SEQ ID NO: 1106255 - protein, 9 aa, Homo Sapiens
SCGDLPGLH

SEQ ID NO: 1106256 - protein, 9 aa, Homo Sapiens
KDRKKKKKG

SEQ ID NO: 1106257 - protein, 9 aa, Homo Sapiens
RHALETPSC

SEQ ID NO: 1106258 - protein, 9 aa, Homo Sapiens
VLVATGLPN

SEQ ID NO: 1106259 - protein, 9 aa, Homo Sapiens
LDVAVQVVR

SEQ ID NO: 1106260 - protein, 9 aa, Homo Sapiens
PQSMPPPPS

SEQ ID NO: 1106261 - protein, 9 aa, Homo Sapiens
WLLTYVGTL

SEQ ID NO: 1106262 - protein, 9 aa, Homo Sapiens
SHGDTDGPI

SEQ ID NO: 1106263 - protein, 9 aa, Homo Sapiens
ELKGHTSQV

SEQ ID NO: 1106264 - protein, 9 aa, Homo Sapiens
RVLRILYVM

SEQ ID NO: 1106265 - protein, 9 aa, Homo Sapiens
NYAMSSSLP

SEQ ID NO: 1106266 - protein, 9 aa, Homo Sapiens
SAKQHITLN

SEQ ID NO: 1106267 - protein, 9 aa, Homo Sapiens
RTPTLAPPE

SEQ ID NO: 1106268 - protein, 9 aa, Homo Sapiens
SLNYSCIVE

SEQ ID NO: 1106269 - protein, 9 aa, Homo Sapiens
CTTVETVQE

SEQ ID NO: 1106270 - protein, 9 aa, Homo Sapiens
NFIRWVVDS

SEQ ID NO: 1106271 - protein, 9 aa, Homo Sapiens
NPVVLMPTL

SEQ ID NO: 1106272 - protein, 9 aa, Homo Sapiens
SVTTQPAQT

SEQ ID NO: 1106273 - protein, 9 aa, Homo Sapiens
GAARTSGSI

SEQ ID NO: 1106274 - protein, 9 aa, Homo Sapiens
PCSPTTPSP

SEQ ID NO: 1106275 - protein, 9 aa, Homo Sapiens
ASREIANEY

SEQ ID NO: 1106276 - protein, 9 aa, Homo Sapiens
AHVIGTRVY

SEQ ID NO: 1106277 - protein, 9 aa, Homo Sapiens
ARASSGTAA

SEQ ID NO: 1106278 - protein, 9 aa, Homo Sapiens
HCTLTWSRS

SEQ ID NO: 1106279 - protein, 9 aa, Homo Sapiens
ARLKDTQDQ

SEQ ID NO: 1106280 - protein, 9 aa, Homo Sapiens
LGQGLGVAA

SEQ ID NO: 1106281 - protein, 9 aa, Homo Sapiens
SSPTARRAS

SEQ ID NO: 1106282 - protein, 9 aa, Homo Sapiens
KGQTEEATV

SEQ ID NO: 1106283 - protein, 9 aa, Homo Sapiens
LIVASASLR

SEQ ID NO: 1106284 - protein, 9 aa, Homo Sapiens
RKKMTASQR

SEQ ID NO: 1106285 - protein, 9 aa, Homo Sapiens
EHFHFYKRY

SEQ ID NO: 1106286 - protein, 9 aa, Homo Sapiens
QTKIQATME

SEQ ID NO: 1106287 - protein, 9 aa, Homo Sapiens
GAGAAIAAP

SEQ ID NO: 1106288 - protein, 9 aa, Homo Sapiens
FDDQHRMSL

SEQ ID NO: 1106289 - protein, 9 aa, Homo Sapiens
QVLGLLEGF

SEQ ID NO: 1106290 - protein, 9 aa, Homo Sapiens
CIWQPVMDT

SEQ ID NO: 1106291 - protein, 9 aa, Homo Sapiens
DPQGEVITQ

SEQ ID NO: 1106292 - protein, 9 aa, Homo Sapiens
ARGCSPAGV

SEQ ID NO: 1106293 - protein, 9 aa, Homo Sapiens
ISKHHAGTR

SEQ ID NO: 1106294 - protein, 9 aa, Homo Sapiens
PGLDALVAT

SEQ ID NO: 1106295 - protein, 9 aa, Homo Sapiens
VFLLFLAVW

SEQ ID NO: 1106296 - protein, 9 aa, Homo Sapiens
LLCPPVPGV

SEQ ID NO: 1106297 - protein, 9 aa, Homo Sapiens
RKKKNNMAA

SEQ ID NO: 1106298 - protein, 9 aa, Homo Sapiens
SRPTGRTPT

SEQ ID NO: 1106299 - protein, 9 aa, Homo Sapiens
LCMQMLGGA

SEQ ID NO: 1106300 - protein, 9 aa, Homo Sapiens
TPLDSGYEK

SEQ ID NO: 1106301 - protein, 9 aa, Homo Sapiens
LLSPSRKRR

SEQ ID NO: 1106302 - protein, 9 aa, Homo Sapiens
HVDASLFQM

SEQ ID NO: 1106303 - protein, 9 aa, Homo Sapiens
REVAAAVWA

SEQ ID NO: 1106304 - protein, 9 aa, Homo Sapiens
PCGTFHHKF

SEQ ID NO: 1106305 - protein, 9 aa, Homo Sapiens
QGWEFQSPL

SEQ ID NO: 1106306 - protein, 9 aa, Homo Sapiens
VRPLSLILV

SEQ ID NO: 1106307 - protein, 9 aa, Homo Sapiens
MASDPPQPG

SEQ ID NO: 1106308 - protein, 9 aa, Homo Sapiens
VRLHTPEGY

SEQ ID NO: 1106309 - protein, 9 aa, Homo Sapiens
EAAFPGHRV

SEQ ID NO: 1106310 - protein, 9 aa, Homo Sapiens
AGRQHHVLQ

SEQ ID NO: 1106311 - protein, 9 aa, Homo Sapiens
NAPPYSFRI

SEQ ID NO: 1106312 - protein, 9 aa, Homo Sapiens
VSFNKMKKI

SEQ ID NO: 1106313 - protein, 9 aa, Homo Sapiens
QEARRVHHL

SEQ ID NO: 1106314 - protein, 9 aa, Homo Sapiens
GAPATEVGC

SEQ ID NO: 1106315 - protein, 9 aa, Homo Sapiens
MSSSGLPCS

SEQ ID NO: 1106316 - protein, 9 aa, Homo Sapiens
KCNLMRPKH

SEQ ID NO: 1106317 - protein, 9 aa, Homo Sapiens
TTYTRQGHG

SEQ ID NO: 1106318 - protein, 9 aa, Homo Sapiens
IKKTVILQI

SEQ ID NO: 1106319 - protein, 9 aa, Homo Sapiens
NVGAAEEEL

SEQ ID NO: 1106320 - protein, 9 aa, Homo Sapiens
FPGHTLITV

SEQ ID NO: 1106321 - protein, 9 aa, Homo Sapiens
RARKATSPH

SEQ ID NO: 1106322 - protein, 9 aa, Homo Sapiens
MRWVLRKRP

SEQ ID NO: 1106323 - protein, 9 aa, Homo Sapiens
GMLPLEIAL

SEQ ID NO: 1106324 - protein, 9 aa, Homo Sapiens
HHYYLGYIE

SEQ ID NO: 1106325 - protein, 9 aa, Homo Sapiens
LGTGRDPRQ

SEQ ID NO: 1106326 - protein, 9 aa, Homo Sapiens
ALYRGGQRC

SEQ ID NO: 1106327 - protein, 9 aa, Homo Sapiens
PAWPREAHR

SEQ ID NO: 1106328 - protein, 9 aa, Homo Sapiens
KKRKKREKI

SEQ ID NO: 1106329 - protein, 9 aa, Homo Sapiens
GGRPYACTQ

SEQ ID NO: 1106330 - protein, 9 aa, Homo Sapiens
SLTPLTTQS

SEQ ID NO: 1106331 - protein, 9 aa, Homo Sapiens
LRASLEMLT

SEQ ID NO: 1106332 - protein, 9 aa, Homo Sapiens
GAARASSGT

SEQ ID NO: 1106333 - protein, 9 aa, Homo Sapiens
FGSISTTRY

SEQ ID NO: 1106334 - protein, 9 aa, Homo Sapiens
SSIAVLPDH

SEQ ID NO: 1106335 - protein, 9 aa, Homo Sapiens
SVEKEKKTS

SEQ ID NO: 1106336 - protein, 9 aa, Homo Sapiens
VHQCDRSWA

SEQ ID NO: 1106337 - protein, 9 aa, Homo Sapiens
RSDLNPAKW

SEQ ID NO: 1106338 - protein, 9 aa, Homo Sapiens
HRMGAAWQE

SEQ ID NO: 1106339 - protein, 9 aa, Homo Sapiens
PRLEDHQSF

SEQ ID NO: 1106340 - protein, 9 aa, Homo Sapiens
TVTHLRPVP

SEQ ID NO: 1106341 - protein, 9 aa, Homo Sapiens
RGGAPGSEP

SEQ ID NO: 1106342 - protein, 9 aa, Homo Sapiens
KDEVWEERN

SEQ ID NO: 1106343 - protein, 9 aa, Homo Sapiens
TGTTMATPS

SEQ ID NO: 1106344 - protein, 9 aa, Homo Sapiens
ADVPPLCLS

SEQ ID NO: 1106345 - protein, 9 aa, Homo Sapiens
SSKLTAHKV

SEQ ID NO: 1106346 - protein, 9 aa, Homo Sapiens
SGQKTWTFY

SEQ ID NO: 1106347 - protein, 9 aa, Homo Sapiens
VGHGVWVGA

SEQ ID NO: 1106348 - protein, 9 aa, Homo Sapiens
AAAAAARNP

SEQ ID NO: 1106349 - protein, 9 aa, Homo Sapiens
HESVDQSRR

SEQ ID NO: 1106350 - protein, 9 aa, Homo Sapiens
AYPQTSGGV

SEQ ID NO: 1106351 - protein, 9 aa, Homo Sapiens
GGGDSATTW

SEQ ID NO: 1106352 - protein, 9 aa, Homo Sapiens
TSAFKTTAG

SEQ ID NO: 1106353 - protein, 9 aa, Homo Sapiens
LQPGFGGSL

SEQ ID NO: 1106354 - protein, 9 aa, Homo Sapiens
NPRERTLYT

SEQ ID NO: 1106355 - protein, 9 aa, Homo Sapiens
VLDHHLVTG

SEQ ID NO: 1106356 - protein, 9 aa, Homo Sapiens
SAWGWVRRV

SEQ ID NO: 1106357 - protein, 9 aa, Homo Sapiens
LMNISVSLK

SEQ ID NO: 1106358 - protein, 9 aa, Homo Sapiens
TRRSLAPTA

SEQ ID NO: 1106359 - protein, 9 aa, Homo Sapiens
EAYQDYAHH

SEQ ID NO: 1106360 - protein, 9 aa, Homo Sapiens
SFSAPCCWR

SEQ ID NO: 1106361 - protein, 9 aa, Homo Sapiens
HSTILQVSI

SEQ ID NO: 1106362 - protein, 9 aa, Homo Sapiens
VHPIKVARY

SEQ ID NO: 1106363 - protein, 9 aa, Homo Sapiens
RIRLTQVTK

SEQ ID NO: 1106364 - protein, 9 aa, Homo Sapiens
PAAPPSSSS

SEQ ID NO: 1106365 - protein, 9 aa, Homo Sapiens
TQLKGTVED

SEQ ID NO: 1106366 - protein, 9 aa, Homo Sapiens
LVMALDRYV

SEQ ID NO: 1106367 - protein, 9 aa, Homo Sapiens
GWTTRYFQS

SEQ ID NO: 1106368 - protein, 9 aa, Homo Sapiens
ILSGNGTIL

SEQ ID NO: 1106369 - protein, 9 aa, Homo Sapiens
PPGAAGRRR

SEQ ID NO: 1106370 - protein, 9 aa, Homo Sapiens
LDGIPRVDA

SEQ ID NO: 1106371 - protein, 9 aa, Homo Sapiens
PETPGLLRR

SEQ ID NO: 1106372 - protein, 9 aa, Homo Sapiens
QLVWPDTTH

SEQ ID NO: 1106373 - protein, 9 aa, Homo Sapiens
DAQVGPLPC

SEQ ID NO: 1106374 - protein, 9 aa, Homo Sapiens
EIVQDFKTD

SEQ ID NO: 1106375 - protein, 9 aa, Homo Sapiens
KTKEIRVEV

SEQ ID NO: 1106376 - protein, 9 aa, Homo Sapiens
FPSSPNEWL

SEQ ID NO: 1106377 - protein, 9 aa, Homo Sapiens
RTSGSIAPP

SEQ ID NO: 1106378 - protein, 9 aa, Homo Sapiens
APPARAGPK

SEQ ID NO: 1106379 - protein, 9 aa, Homo Sapiens
LCSSTPTCL

SEQ ID NO: 1106380 - protein, 9 aa, Homo Sapiens
LWWPASGRR

SEQ ID NO: 1106381 - protein, 9 aa, Homo Sapiens
PLTTQSWIP

SEQ ID NO: 1106382 - protein, 9 aa, Homo Sapiens
ARARTCSPC

SEQ ID NO: 1106383 - protein, 9 aa, Homo Sapiens
PSITSTGRR

SEQ ID NO: 1106384 - protein, 9 aa, Homo Sapiens
IKCKPLFYT

SEQ ID NO: 1106385 - protein, 9 aa, Homo Sapiens
AGATAQIQR

SEQ ID NO: 1106386 - protein, 9 aa, Homo Sapiens
KFGWQMRAS

SEQ ID NO: 1106387 - protein, 9 aa, Homo Sapiens
KAKAIYFTV

SEQ ID NO: 1106388 - protein, 9 aa, Homo Sapiens
LDQRQSPKL

SEQ ID NO: 1106389 - protein, 9 aa, Homo Sapiens
LVATTINLG

SEQ ID NO: 1106390 - protein, 9 aa, Homo Sapiens
HLPLPWGWL

SEQ ID NO: 1106391 - protein, 9 aa, Homo Sapiens
GIDGDQGPK

SEQ ID NO: 1106392 - protein, 9 aa, Homo Sapiens
YIRYGFEGV

SEQ ID NO: 1106393 - protein, 9 aa, Homo Sapiens
TTQPTQGYA

SEQ ID NO: 1106394 - protein, 9 aa, Homo Sapiens
ARRVHHLHA

SEQ ID NO: 1106395 - protein, 9 aa, Homo Sapiens
RGGPGCLLS

SEQ ID NO: 1106396 - protein, 9 aa, Homo Sapiens
ARMGSPKIE

SEQ ID NO: 1106397 - protein, 9 aa, Homo Sapiens
REQAASEDV

SEQ ID NO: 1106398 - protein, 9 aa, Homo Sapiens
KRSTARATS

SEQ ID NO: 1106399 - protein, 9 aa, Homo Sapiens
SIAPPARAG

SEQ ID NO: 1106400 - protein, 9 aa, Homo Sapiens
YAMSSSLPK

SEQ ID NO: 1106401 - protein, 9 aa, Homo Sapiens
DIIEQKSML

SEQ ID NO: 1106402 - protein, 9 aa, Homo Sapiens
VFGNFNLLH

SEQ ID NO: 1106403 - protein, 9 aa, Homo Sapiens
ITPLHSGIR

SEQ ID NO: 1106404 - protein, 9 aa, Homo Sapiens
FSPGQSHTN

SEQ ID NO: 1106405 - protein, 9 aa, Homo Sapiens
AMFDQAQTK

SEQ ID NO: 1106406 - protein, 9 aa, Homo Sapiens
SLLCPPTPQ

SEQ ID NO: 1106407 - protein, 9 aa, Homo Sapiens
SPVWRACLP

SEQ ID NO: 1106408 - protein, 9 aa, Homo Sapiens
QSPGHLGLF

SEQ ID NO: 1106409 - protein, 9 aa, Homo Sapiens
LHPQWAPHS

SEQ ID NO: 1106410 - protein, 9 aa, Homo Sapiens
LPVASCPAP

SEQ ID NO: 1106411 - protein, 9 aa, Homo Sapiens
GPRAPDPPP

SEQ ID NO: 1106412 - protein, 9 aa, Homo Sapiens
VARQMALRA

SEQ ID NO: 1106413 - protein, 9 aa, Homo Sapiens
HSLRLPSLP

SEQ ID NO: 1106414 - protein, 9 aa, Homo Sapiens
LLCPPTPQN

SEQ ID NO: 1106415 - protein, 9 aa, Homo Sapiens
SLGGGDWVW

SEQ ID NO: 1106416 - protein, 9 aa, Homo Sapiens
TLQLTPVSP

SEQ ID NO: 1106417 - protein, 9 aa, Homo Sapiens
VISDCTEII

SEQ ID NO: 1106418 - protein, 9 aa, Homo Sapiens
IIVVNQEIL

SEQ ID NO: 1106419 - protein, 9 aa, Homo Sapiens
AGGPCLDPA

SEQ ID NO: 1106420 - protein, 9 aa, Homo Sapiens
DKKKEAQAA

SEQ ID NO: 1106421 - protein, 9 aa, Homo Sapiens
QVARPGPTT

SEQ ID NO: 1106422 - protein, 9 aa, Homo Sapiens
FFIREGTAP

SEQ ID NO: 1106423 - protein, 9 aa, Homo Sapiens
GSGNGVAGS

SEQ ID NO: 1106424 - protein, 9 aa, Homo Sapiens
RPVSMTFLE

SEQ ID NO: 1106425 - protein, 9 aa, Homo Sapiens
EQSRRPSIK

SEQ ID NO: 1106426 - protein, 9 aa, Homo Sapiens
HYYLGYIEE

SEQ ID NO: 1106427 - protein, 9 aa, Homo Sapiens
RPHSPSCSP

SEQ ID NO: 1106428 - protein, 9 aa, Homo Sapiens
TCLESAVHR

SEQ ID NO: 1106429 - protein, 9 aa, Homo Sapiens
AVTTAVLGK

SEQ ID NO: 1106430 - protein, 9 aa, Homo Sapiens
SSLQFWMKV

SEQ ID NO: 1106431 - protein, 9 aa, Homo Sapiens
YQNFQSPPQ

SEQ ID NO: 1106432 - protein, 9 aa, Homo Sapiens
CKEGLKFYT

SEQ ID NO: 1106433 - protein, 9 aa, Homo Sapiens
ASLLATQLK

SEQ ID NO: 1106434 - protein, 9 aa, Homo Sapiens
EDQSLRRNA

SEQ ID NO: 1106435 - protein, 9 aa, Homo Sapiens
GPALLSVCK

SEQ ID NO: 1106436 - protein, 9 aa, Homo Sapiens
VAAAATAAS

SEQ ID NO: 1106437 - protein, 9 aa, Homo Sapiens
PTGRPRMSL

SEQ ID NO: 1106438 - protein, 9 aa, Homo Sapiens
WPGGYPAYS

SEQ ID NO: 1106439 - protein, 9 aa, Homo Sapiens
GAASPPARS

SEQ ID NO: 1106440 - protein, 9 aa, Homo Sapiens
KKLAPPFKP

SEQ ID NO: 1106441 - protein, 9 aa, Homo Sapiens
PRIELARMG

SEQ ID NO: 1106442 - protein, 9 aa, Homo Sapiens
QPSLTHHRN

SEQ ID NO: 1106443 - protein, 9 aa, Homo Sapiens
AYAQNRSLL

SEQ ID NO: 1106444 - protein, 9 aa, Homo Sapiens
LKQKLQAMR

SEQ ID NO: 1106445 - protein, 9 aa, Homo Sapiens
VQSKDFLPP

SEQ ID NO: 1106446 - protein, 9 aa, Homo Sapiens
HQLKCQHEE

SEQ ID NO: 1106447 - protein, 9 aa, Homo Sapiens
ARHLSFIGT

SEQ ID NO: 1106448 - protein, 9 aa, Homo Sapiens
TPTTRLMAP

SEQ ID NO: 1106449 - protein, 9 aa, Homo Sapiens
WAPQTKGKG

SEQ ID NO: 1106450 - protein, 9 aa, Homo Sapiens
FHPVKKLSR

SEQ ID NO: 1106451 - protein, 9 aa, Homo Sapiens
LDYLPRTEN

SEQ ID NO: 1106452 - protein, 9 aa, Homo Sapiens
HQVQGRGIG

SEQ ID NO: 1106453 - protein, 9 aa, Homo Sapiens
RRGLTERPH

SEQ ID NO: 1106454 - protein, 9 aa, Homo Sapiens
CLSTTRKDT

SEQ ID NO: 1106455 - protein, 9 aa, Homo Sapiens
KKKVPTKKI

SEQ ID NO: 1106456 - protein, 9 aa, Homo Sapiens
EVELRKATT

SEQ ID NO: 1106457 - protein, 9 aa, Homo Sapiens
QSLCFIHHY

SEQ ID NO: 1106458 - protein, 9 aa, Homo Sapiens
PSQTEILET

SEQ ID NO: 1106459 - protein, 9 aa, Homo Sapiens
GVATPGRPW

SEQ ID NO: 1106460 - protein, 9 aa, Homo Sapiens
CQQQRKEQT

SEQ ID NO: 1106461 - protein, 9 aa, Homo Sapiens
AADSAWGWV

SEQ ID NO: 1106462 - protein, 9 aa, Homo Sapiens
ASALCVLSS

SEQ ID NO: 1106463 - protein, 9 aa, Homo Sapiens
EHFNSWSTG

SEQ ID NO: 1106464 - protein, 9 aa, Homo Sapiens
ARKRRGRKW

SEQ ID NO: 1106465 - protein, 9 aa, Homo Sapiens
HHGGRQLRV

SEQ ID NO: 1106466 - protein, 9 aa, Homo Sapiens
SCGQTGPLQ

SEQ ID NO: 1106467 - protein, 9 aa, Homo Sapiens
QGLLAEDPR

SEQ ID NO: 1106468 - protein, 9 aa, Homo Sapiens
YLRCKLSPP

SEQ ID NO: 1106469 - protein, 9 aa, Homo Sapiens
EAQTINHSL

SEQ ID NO: 1106470 - protein, 9 aa, Homo Sapiens
CHAHKAGLL

SEQ ID NO: 1106471 - protein, 9 aa, Homo Sapiens
VGSQNDTYD

SEQ ID NO: 1106472 - protein, 9 aa, Homo Sapiens
RGLPLPPPV

SEQ ID NO: 1106473 - protein, 9 aa, Homo Sapiens
LLTSASPMA

SEQ ID NO: 1106474 - protein, 9 aa, Homo Sapiens
CPDSFLHHL

SEQ ID NO: 1106475 - protein, 9 aa, Homo Sapiens
YFTVDGDDL

SEQ ID NO: 1106476 - protein, 9 aa, Homo Sapiens
KWRNRLYEL

SEQ ID NO: 1106477 - protein, 9 aa, Homo Sapiens
YLCIVPSEV

SEQ ID NO: 1106478 - protein, 9 aa, Homo Sapiens
QRTGHQDHQ

SEQ ID NO: 1106479 - protein, 9 aa, Homo Sapiens
LGGLQQGDL

SEQ ID NO: 1106480 - protein, 9 aa, Homo Sapiens
VPGVPGRLC

SEQ ID NO: 1106481 - protein, 9 aa, Homo Sapiens
GKSDEQCAA

SEQ ID NO: 1106482 - protein, 9 aa, Homo Sapiens
AQMLSVGKA

SEQ ID NO: 1106483 - protein, 9 aa, Homo Sapiens
IATPEDILR

SEQ ID NO: 1106484 - protein, 9 aa, Homo Sapiens
HLMSDLLQQ

SEQ ID NO: 1106485 - protein, 9 aa, Homo Sapiens
LNFEYTVER

SEQ ID NO: 1106486 - protein, 9 aa, Homo Sapiens
WATNCNDNE

SEQ ID NO: 1106487 - protein, 9 aa, Homo Sapiens
APRSWPRPP

SEQ ID NO: 1106488 - protein, 9 aa, Homo Sapiens
PAPATQAPC

SEQ ID NO: 1106489 - protein, 9 aa, Homo Sapiens
NMFSQTTIC

SEQ ID NO: 1106490 - protein, 9 aa, Homo Sapiens
SRPILASYP

SEQ ID NO: 1106491 - protein, 9 aa, Homo Sapiens
PMTPASRTS

SEQ ID NO: 1106492 - protein, 9 aa, Homo Sapiens
YHVARFTRS

SEQ ID NO: 1106493 - protein, 9 aa, Homo Sapiens
HFNSWSTGF

SEQ ID NO: 1106494 - protein, 9 aa, Homo Sapiens
GRPFQKKSC

SEQ ID NO: 1106495 - protein, 9 aa, Homo Sapiens
ELTRGPSYH

SEQ ID NO: 1106496 - protein, 9 aa, Homo Sapiens
KWGALWLLS

SEQ ID NO: 1106497 - protein, 9 aa, Homo Sapiens
HYLHFAVTL

SEQ ID NO: 1106498 - protein, 9 aa, Homo Sapiens
AHITKKQRN

SEQ ID NO: 1106499 - protein, 9 aa, Homo Sapiens
MVPQAVAPA

SEQ ID NO: 1106500 - protein, 9 aa, Homo Sapiens
LMQKHHRRE

SEQ ID NO: 1106501 - protein, 9 aa, Homo Sapiens
LLSQSVQQA

SEQ ID NO: 1106502 - protein, 9 aa, Homo Sapiens
NWHGETEGK

SEQ ID NO: 1106503 - protein, 9 aa, Homo Sapiens
QIQRPIQVQ

SEQ ID NO: 1106504 - protein, 9 aa, Homo Sapiens
RNLTLVVVL

SEQ ID NO: 1106505 - protein, 9 aa, Homo Sapiens
HEVLSSCVA

SEQ ID NO: 1106506 - protein, 9 aa, Homo Sapiens
EKQILSRVW

SEQ ID NO: 1106507 - protein, 9 aa, Homo Sapiens
GNGVAGSLL

SEQ ID NO: 1106508 - protein, 9 aa, Homo Sapiens
KKCSLYGKK

SEQ ID NO: 1106509 - protein, 9 aa, Homo Sapiens
LVTQVHKLA

SEQ ID NO: 1106510 - protein, 9 aa, Homo Sapiens
RSKTLESLS

SEQ ID NO: 1106511 - protein, 9 aa, Homo Sapiens
ALKEDLLYL

SEQ ID NO: 1106512 - protein, 9 aa, Homo Sapiens
HCSDRSNLS

SEQ ID NO: 1106513 - protein, 9 aa, Homo Sapiens
EEEVDINQL

SEQ ID NO: 1106514 - protein, 9 aa, Homo Sapiens
HMVSEGGAR

SEQ ID NO: 1106515 - protein, 9 aa, Homo Sapiens
PAGGPCLDP

SEQ ID NO: 1106516 - protein, 9 aa, Homo Sapiens
CNSKEDKEA

SEQ ID NO: 1106517 - protein, 9 aa, Homo Sapiens
RGPSYHGRD

SEQ ID NO: 1106518 - protein, 9 aa, Homo Sapiens
CQFWSKMES

SEQ ID NO: 1106519 - protein, 9 aa, Homo Sapiens
GQGLVGMTP

SEQ ID NO: 1106520 - protein, 9 aa, Homo Sapiens
LLCPVIFGH

SEQ ID NO: 1106521 - protein, 9 aa, Homo Sapiens
GLLEGFLQR

SEQ ID NO: 1106522 - protein, 9 aa, Homo Sapiens
VKRFLTTDT

SEQ ID NO: 1106523 - protein, 9 aa, Homo Sapiens
EEEDDEDGG

SEQ ID NO: 1106524 - protein, 9 aa, Homo Sapiens
IVAVPATAM

SEQ ID NO: 1106525 - protein, 9 aa, Homo Sapiens
RAEVFLGLG

SEQ ID NO: 1106526 - protein, 9 aa, Homo Sapiens
AARETRSGR

SEQ ID NO: 1106527 - protein, 9 aa, Homo Sapiens
SRTKQRAWE

SEQ ID NO: 1106528 - protein, 9 aa, Homo Sapiens
VLWREYHLV

SEQ ID NO: 1106529 - protein, 9 aa, Homo Sapiens
QPSLPGPCA

SEQ ID NO: 1106530 - protein, 9 aa, Homo Sapiens
GSVMSCSLL

SEQ ID NO: 1106531 - protein, 9 aa, Homo Sapiens
SMAELGLGY

SEQ ID NO: 1106532 - protein, 9 aa, Homo Sapiens
KWKVGKIEF

SEQ ID NO: 1106533 - protein, 9 aa, Homo Sapiens
RPHWTLSPQ

SEQ ID NO: 1106534 - protein, 9 aa, Homo Sapiens
SLWPPQRPS

SEQ ID NO: 1106535 - protein, 9 aa, Homo Sapiens
RDAIKWRGD

SEQ ID NO: 1106536 - protein, 9 aa, Homo Sapiens
AGVAAAVAV

SEQ ID NO: 1106537 - protein, 9 aa, Homo Sapiens
VPARQPEPS

SEQ ID NO: 1106538 - protein, 9 aa, Homo Sapiens
ECSEITTAS

SEQ ID NO: 1106539 - protein, 9 aa, Homo Sapiens
SSLVIPSGL

SEQ ID NO: 1106540 - protein, 9 aa, Homo Sapiens
AASSAGSSW

SEQ ID NO: 1106541 - protein, 9 aa, Homo Sapiens
RPPPAAPTG

SEQ ID NO: 1106542 - protein, 9 aa, Homo Sapiens
GATLARHLS

SEQ ID NO: 1106543 - protein, 9 aa, Homo Sapiens
KERPADDPL

SEQ ID NO: 1106544 - protein, 9 aa, Homo Sapiens
PDMVFETRR

SEQ ID NO: 1106545 - protein, 9 aa, Homo Sapiens
HTGYHTTDP

SEQ ID NO: 1106546 - protein, 9 aa, Homo Sapiens
QMFGLCRRP

SEQ ID NO: 1106547 - protein, 9 aa, Homo Sapiens
VTQVHKLAR

SEQ ID NO: 1106548 - protein, 9 aa, Homo Sapiens
PDSFLHHLY

SEQ ID NO: 1106549 - protein, 9 aa, Homo Sapiens
LHCPCHLPL

SEQ ID NO: 1106550 - protein, 9 aa, Homo Sapiens
CSLPPDRPC

SEQ ID NO: 1106551 - protein, 9 aa, Homo Sapiens
RGTWLGRPG

SEQ ID NO: 1106552 - protein, 9 aa, Homo Sapiens
GSMQAHGEQ

SEQ ID NO: 1106553 - protein, 9 aa, Homo Sapiens
SFLFYVLTK

SEQ ID NO: 1106554 - protein, 9 aa, Homo Sapiens
GKAAPWREA

SEQ ID NO: 1106555 - protein, 9 aa, Homo Sapiens
PGLRGFQIL

SEQ ID NO: 1106556 - protein, 9 aa, Homo Sapiens
VVAHDLIWK

SEQ ID NO: 1106557 - protein, 9 aa, Homo Sapiens
QRGWTLGAD

SEQ ID NO: 1106558 - protein, 9 aa, Homo Sapiens
FAPGSLPWV

SEQ ID NO: 1106559 - protein, 9 aa, Homo Sapiens
RPGCRGLGP

SEQ ID NO: 1106560 - protein, 9 aa, Homo Sapiens
GFFAHQHQP

SEQ ID NO: 1106561 - protein, 9 aa, Homo Sapiens
GSATGPTTW

SEQ ID NO: 1106562 - protein, 9 aa, Homo Sapiens
LVAPRQTPG

SEQ ID NO: 1106563 - protein, 9 aa, Homo Sapiens
HFERLLLQE

SEQ ID NO: 1106564 - protein, 9 aa, Homo Sapiens
LVITALGRF

SEQ ID NO: 1106565 - protein, 9 aa, Homo Sapiens
ILDDQIQWP

SEQ ID NO: 1106566 - protein, 9 aa, Homo Sapiens
YHVLQELID

SEQ ID NO: 1106567 - protein, 9 aa, Homo Sapiens
HPLDGGRHL

SEQ ID NO: 1106568 - protein, 9 aa, Homo Sapiens
RVCMMVDSL

SEQ ID NO: 1106569 - protein, 9 aa, Homo Sapiens
SSCGQTGPL

SEQ ID NO: 1106570 - protein, 9 aa, Homo Sapiens
TRTTALGMC

SEQ ID NO: 1106571 - protein, 9 aa, Homo Sapiens
RHSGRGPEV

SEQ ID NO: 1106572 - protein, 9 aa, Homo Sapiens
PWPALTLPC

SEQ ID NO: 1106573 - protein, 9 aa, Homo Sapiens
LWSPTPRAS

SEQ ID NO: 1106574 - protein, 9 aa, Homo Sapiens
WERIKIEED

SEQ ID NO: 1106575 - protein, 9 aa, Homo Sapiens
DHVDAPGRG

SEQ ID NO: 1106576 - protein, 9 aa, Homo Sapiens
VSEGGARGT

SEQ ID NO: 1106577 - protein, 9 aa, Homo Sapiens
NPAHQPSLT

SEQ ID NO: 1106578 - protein, 9 aa, Homo Sapiens
ERAAAALRA

SEQ ID NO: 1106579 - protein, 9 aa, Homo Sapiens
TGVHNFEID

SEQ ID NO: 1106580 - protein, 9 aa, Homo Sapiens
EEASRSSGI

SEQ ID NO: 1106581 - protein, 9 aa, Homo Sapiens
CTKLMAKTI

SEQ ID NO: 1106582 - protein, 9 aa, Homo Sapiens
WEWEMALRV

SEQ ID NO: 1106583 - protein, 9 aa, Homo Sapiens
PQQGRPATQ

SEQ ID NO: 1106584 - protein, 9 aa, Homo Sapiens
DRDMAQGVR

SEQ ID NO: 1106585 - protein, 9 aa, Homo Sapiens
GTTSPWPSP

SEQ ID NO: 1106586 - protein, 9 aa, Homo Sapiens
SSLLSPCNA

SEQ ID NO: 1106587 - protein, 9 aa, Homo Sapiens
HTFFTLMRK

SEQ ID NO: 1106588 - protein, 9 aa, Homo Sapiens
SEPEFQSTC

SEQ ID NO: 1106589 - protein, 9 aa, Homo Sapiens
RRSHAPQSC

SEQ ID NO: 1106590 - protein, 9 aa, Homo Sapiens
DGQPCFRTA

SEQ ID NO: 1106591 - protein, 9 aa, Homo Sapiens
TSGNSDNLR

SEQ ID NO: 1106592 - protein, 9 aa, Homo Sapiens
QEHRAQLVC

SEQ ID NO: 1106593 - protein, 9 aa, Homo Sapiens
SQLATKLLH

SEQ ID NO: 1106594 - protein, 9 aa, Homo Sapiens
WAVREQWAE

SEQ ID NO: 1106595 - protein, 9 aa, Homo Sapiens
VATASCGTG

SEQ ID NO: 1106596 - protein, 9 aa, Homo Sapiens
SGNRVIRMP

SEQ ID NO: 1106597 - protein, 9 aa, Homo Sapiens
HVTGQDPEP

SEQ ID NO: 1106598 - protein, 9 aa, Homo Sapiens
RTCVCWPSF

SEQ ID NO: 1106599 - protein, 9 aa, Homo Sapiens
GMSRHATFK

SEQ ID NO: 1106600 - protein, 9 aa, Homo Sapiens
FVYRDCQSE

SEQ ID NO: 1106601 - protein, 9 aa, Homo Sapiens
SVRRAAQLC

SEQ ID NO: 1106602 - protein, 9 aa, Homo Sapiens
MQSSAHQKT

SEQ ID NO: 1106603 - protein, 9 aa, Homo Sapiens
KVEKHMCFH

SEQ ID NO: 1106604 - protein, 9 aa, Homo Sapiens
HGRRFRSAK

SEQ ID NO: 1106605 - protein, 9 aa, Homo Sapiens
SLELCNTFR

SEQ ID NO: 1106606 - protein, 9 aa, Homo Sapiens
GHNTWLSYH

SEQ ID NO: 1106607 - protein, 9 aa, Homo Sapiens
ARRGRLPHG

SEQ ID NO: 1106608 - protein, 9 aa, Homo Sapiens
HENIIVAIT

SEQ ID NO: 1106609 - protein, 9 aa, Homo Sapiens
CEKLSGPSG

SEQ ID NO: 1106610 - protein, 9 aa, Homo Sapiens
DPDFVVVDD

SEQ ID NO: 1106611 - protein, 9 aa, Homo Sapiens
PAPGVQPPA

SEQ ID NO: 1106612 - protein, 9 aa, Homo Sapiens
DNKKTHPCT

SEQ ID NO: 1106613 - protein, 9 aa, Homo Sapiens
KSRLPHQSP

SEQ ID NO: 1106614 - protein, 9 aa, Homo Sapiens
LWWTLPQNF

SEQ ID NO: 1106615 - protein, 9 aa, Homo Sapiens
DKKQKRSRS

SEQ ID NO: 1106616 - protein, 9 aa, Homo Sapiens
ATPEDHCCR

SEQ ID NO: 1106617 - protein, 9 aa, Homo Sapiens
HPERYGVPS

SEQ ID NO: 1106618 - protein, 9 aa, Homo Sapiens
VALVPDGAW

SEQ ID NO: 1106619 - protein, 9 aa, Homo Sapiens
LMCFLYILT

SEQ ID NO: 1106620 - protein, 9 aa, Homo Sapiens
MLPLEIALT

SEQ ID NO: 1106621 - protein, 9 aa, Homo Sapiens
HPCTMLLPQ

SEQ ID NO: 1106622 - protein, 9 aa, Homo Sapiens
QLLFPSTMQ

SEQ ID NO: 1106623 - protein, 9 aa, Homo Sapiens
AAASRLPRM

SEQ ID NO: 1106624 - protein, 9 aa, Homo Sapiens
RPPCSQRLW

SEQ ID NO: 1106625 - protein, 9 aa, Homo Sapiens
NATMDERWY

SEQ ID NO: 1106626 - protein, 9 aa, Homo Sapiens
VGWPCYLTR

SEQ ID NO: 1106627 - protein, 9 aa, Homo Sapiens
GLCPPLLAL

SEQ ID NO: 1106628 - protein, 9 aa, Homo Sapiens
CGSTPPPPP

SEQ ID NO: 1106629 - protein, 9 aa, Homo Sapiens
TNLQAVQGH

SEQ ID NO: 1106630 - protein, 9 aa, Homo Sapiens
QPAQATTPL

SEQ ID NO: 1106631 - protein, 9 aa, Homo Sapiens
HFLEPGKNS

SEQ ID NO: 1106632 - protein, 9 aa, Homo Sapiens
EIIIVVNQE

SEQ ID NO: 1106633 - protein, 9 aa, Homo Sapiens
REIANEYKY

SEQ ID NO: 1106634 - protein, 9 aa, Homo Sapiens
TSMSDDALF

SEQ ID NO: 1106635 - protein, 9 aa, Homo Sapiens
PSTPTGCGS

SEQ ID NO: 1106636 - protein, 9 aa, Homo Sapiens
YPLSLVTCL

SEQ ID NO: 1106637 - protein, 9 aa, Homo Sapiens
MTPRDLGTV

SEQ ID NO: 1106638 - protein, 9 aa, Homo Sapiens
NIFIMAFGV

SEQ ID NO: 1106639 - protein, 9 aa, Homo Sapiens
RTFMCSRPS

SEQ ID NO: 1106640 - protein, 9 aa, Homo Sapiens
GMTPRDLGT

SEQ ID NO: 1106641 - protein, 9 aa, Homo Sapiens
RKSITLWNP

SEQ ID NO: 1106642 - protein, 9 aa, Homo Sapiens
APAPATYRV

SEQ ID NO: 1106643 - protein, 9 aa, Homo Sapiens
YLGRVHWCV

SEQ ID NO: 1106644 - protein, 9 aa, Homo Sapiens
ANGILGTPG

SEQ ID NO: 1106645 - protein, 9 aa, Homo Sapiens
AALCRAWGD

SEQ ID NO: 1106646 - protein, 9 aa, Homo Sapiens
ILEGNPAVY

SEQ ID NO: 1106647 - protein, 9 aa, Homo Sapiens
HLGKYILCC

SEQ ID NO: 1106648 - protein, 9 aa, Homo Sapiens
VQVVRAREA

SEQ ID NO: 1106649 - protein, 9 aa, Homo Sapiens
FNLLHGKTI

SEQ ID NO: 1106650 - protein, 9 aa, Homo Sapiens
STKSSSEPR

SEQ ID NO: 1106651 - protein, 9 aa, Homo Sapiens
EALERAVRR

SEQ ID NO: 1106652 - protein, 9 aa, Homo Sapiens
VAPTATLGP

SEQ ID NO: 1106653 - protein, 9 aa, Homo Sapiens
APGWRPRSR

SEQ ID NO: 1106654 - protein, 9 aa, Homo Sapiens
DLRMRGEPL

SEQ ID NO: 1106655 - protein, 9 aa, Homo Sapiens
QDWATIRLR

SEQ ID NO: 1106656 - protein, 9 aa, Homo Sapiens
GSYPPARQP

SEQ ID NO: 1106657 - protein, 9 aa, Homo Sapiens
RNWLTVLSC

SEQ ID NO: 1106658 - protein, 9 aa, Homo Sapiens
TEVPWPEVW

SEQ ID NO: 1106659 - protein, 9 aa, Homo Sapiens
HKLINNGSY

SEQ ID NO: 1106660 - protein, 9 aa, Homo Sapiens
QSWIPQSAG

SEQ ID NO: 1106661 - protein, 9 aa, Homo Sapiens
YEVSVCENN

SEQ ID NO: 1106662 - protein, 9 aa, Homo Sapiens
LKLSENFSQ

SEQ ID NO: 1106663 - protein, 9 aa, Homo Sapiens
NHVKNGDHM

SEQ ID NO: 1106664 - protein, 9 aa, Homo Sapiens
IQQVGVIQC

SEQ ID NO: 1106665 - protein, 9 aa, Homo Sapiens
LSDREKVIC

SEQ ID NO: 1106666 - protein, 9 aa, Homo Sapiens
EFQLKVRLS

SEQ ID NO: 1106667 - protein, 9 aa, Homo Sapiens
FSLLTSHLV

SEQ ID NO: 1106668 - protein, 9 aa, Homo Sapiens
ILSTGVLPM

SEQ ID NO: 1106669 - protein, 9 aa, Homo Sapiens
RAPNVILHR

SEQ ID NO: 1106670 - protein, 9 aa, Homo Sapiens
DYHKQHGVQ

SEQ ID NO: 1106671 - protein, 9 aa, Homo Sapiens
SPQQRNWLT

SEQ ID NO: 1106672 - protein, 9 aa, Homo Sapiens
YSLFEGTEL

SEQ ID NO: 1106673 - protein, 9 aa, Homo Sapiens
TLTWSRSSF

SEQ ID NO: 1106674 - protein, 9 aa, Homo Sapiens
HRNVCYCSR

SEQ ID NO: 1106675 - protein, 9 aa, Homo Sapiens
RPAPGWRPR

SEQ ID NO: 1106676 - protein, 9 aa, Homo Sapiens
SEIPPPAPA

SEQ ID NO: 1106677 - protein, 9 aa, Homo Sapiens
RVLLRFLPR

SEQ ID NO: 1106678 - protein, 9 aa, Homo Sapiens
DDCKEGLKF

SEQ ID NO: 1106679 - protein, 9 aa, Homo Sapiens
KTVFDNFFY

SEQ ID NO: 1106680 - protein, 9 aa, Homo Sapiens
ETHRLIHTV

SEQ ID NO: 1106681 - protein, 9 aa, Homo Sapiens
KNIQVVVES

SEQ ID NO: 1106682 - protein, 9 aa, Homo Sapiens
PPGKRSTAR

SEQ ID NO: 1106683 - protein, 9 aa, Homo Sapiens
TTQPAQTSY

SEQ ID NO: 1106684 - protein, 9 aa, Homo Sapiens
GTQARPPPE

SEQ ID NO: 1106685 - protein, 9 aa, Homo Sapiens
EKRPHSPSC

SEQ ID NO: 1106686 - protein, 9 aa, Homo Sapiens
LVGIQPAGP

SEQ ID NO: 1106687 - protein, 9 aa, Homo Sapiens
FLSKACLPL

SEQ ID NO: 1106688 - protein, 9 aa, Homo Sapiens
AWDPPPGAA

SEQ ID NO: 1106689 - protein, 9 aa, Homo Sapiens
WHWGAAATT

SEQ ID NO: 1106690 - protein, 9 aa, Homo Sapiens
ADLADGAHV

SEQ ID NO: 1106691 - protein, 9 aa, Homo Sapiens
DECGCCAHC

SEQ ID NO: 1106692 - protein, 9 aa, Homo Sapiens
MESVMVKYN

SEQ ID NO: 1106693 - protein, 9 aa, Homo Sapiens
DDDQPPKKP

SEQ ID NO: 1106694 - protein, 9 aa, Homo Sapiens
GYVWPVCLP

SEQ ID NO: 1106695 - protein, 9 aa, Homo Sapiens
SCQELAMVP

SEQ ID NO: 1106696 - protein, 9 aa, Homo Sapiens
CAQLPPAFP

SEQ ID NO: 1106697 - protein, 9 aa, Homo Sapiens
RVLLCCPSW

SEQ ID NO: 1106698 - protein, 9 aa, Homo Sapiens
LLKTALQPD

SEQ ID NO: 1106699 - protein, 9 aa, Homo Sapiens
IGPLTRDAH

SEQ ID NO: 1106700 - protein, 9 aa, Homo Sapiens
AVPMWSCIV

SEQ ID NO: 1106701 - protein, 9 aa, Homo Sapiens
LATVLTYAL

SEQ ID NO: 1106702 - protein, 9 aa, Homo Sapiens
TDANGQVTC

SEQ ID NO: 1106703 - protein, 9 aa, Homo Sapiens
DRVLLCCPS

SEQ ID NO: 1106704 - protein, 9 aa, Homo Sapiens
APQTKGKGG

SEQ ID NO: 1106705 - protein, 9 aa, Homo Sapiens
RCVQAVVIL

SEQ ID NO: 1106706 - protein, 9 aa, Homo Sapiens
DYQPPAKKN

SEQ ID NO: 1106707 - protein, 9 aa, Homo Sapiens
LCVAYKRPI

SEQ ID NO: 1106708 - protein, 9 aa, Homo Sapiens
VRRHHLGLL

SEQ ID NO: 1106709 - protein, 9 aa, Homo Sapiens
GDLARGFRS

SEQ ID NO: 1106710 - protein, 9 aa, Homo Sapiens
HHHNPWTMS

SEQ ID NO: 1106711 - protein, 9 aa, Homo Sapiens
LWAAVAAGG

SEQ ID NO: 1106712 - protein, 9 aa, Homo Sapiens
ALGSWGQTD

SEQ ID NO: 1106713 - protein, 9 aa, Homo Sapiens
VTSTGLFQE

SEQ ID NO: 1106714 - protein, 9 aa, Homo Sapiens
GILGTPGIP

SEQ ID NO: 1106715 - protein, 9 aa, Homo Sapiens
LEEAFISEH

SEQ ID NO: 1106716 - protein, 9 aa, Homo Sapiens
IVASASLRS

SEQ ID NO: 1106717 - protein, 9 aa, Homo Sapiens
SRVVVMEIS

SEQ ID NO: 1106718 - protein, 9 aa, Homo Sapiens
GSKAGRSQG

SEQ ID NO: 1106719 - protein, 9 aa, Homo Sapiens
DLIWKMSPR

SEQ ID NO: 1106720 - protein, 9 aa, Homo Sapiens
KDYMYRRGT

SEQ ID NO: 1106721 - protein, 9 aa, Homo Sapiens
SLYGKKLVK

SEQ ID NO: 1106722 - protein, 9 aa, Homo Sapiens
INTFTMRPG

SEQ ID NO: 1106723 - protein, 9 aa, Homo Sapiens
LLLALVTQV

SEQ ID NO: 1106724 - protein, 9 aa, Homo Sapiens
GIDAYGYQQ

SEQ ID NO: 1106725 - protein, 9 aa, Homo Sapiens
LMEGFLAFP

SEQ ID NO: 1106726 - protein, 9 aa, Homo Sapiens
AGVNPAARM

SEQ ID NO: 1106727 - protein, 9 aa, Homo Sapiens
PDFVVVDDV

SEQ ID NO: 1106728 - protein, 9 aa, Homo Sapiens
RGDCEGIGC

SEQ ID NO: 1106729 - protein, 9 aa, Homo Sapiens
PPSLWAPAP

SEQ ID NO: 1106730 - protein, 9 aa, Homo Sapiens
SPSWPLQPA

SEQ ID NO: 1106731 - protein, 9 aa, Homo Sapiens
TYDGKDQVV

SEQ ID NO: 1106732 - protein, 9 aa, Homo Sapiens
KRKEHRDHD

SEQ ID NO: 1106733 - protein, 9 aa, Homo Sapiens
GAWAEAPGL

SEQ ID NO: 1106734 - protein, 9 aa, Homo Sapiens
STGSRKASV

SEQ ID NO: 1106735 - protein, 9 aa, Homo Sapiens
GGSFPCPCH

SEQ ID NO: 1106736 - protein, 9 aa, Homo Sapiens
RISSFPDEE

SEQ ID NO: 1106737 - protein, 9 aa, Homo Sapiens
GARPSPSQE

SEQ ID NO: 1106738 - protein, 9 aa, Homo Sapiens
GERNSSKFR

SEQ ID NO: 1106739 - protein, 9 aa, Homo Sapiens
PKEGRKYPL

SEQ ID NO: 1106740 - protein, 9 aa, Homo Sapiens
GAPMLQLPG

SEQ ID NO: 1106741 - protein, 9 aa, Homo Sapiens
KSHGKKSET

SEQ ID NO: 1106742 - protein, 9 aa, Homo Sapiens
PDHLPRRAT

SEQ ID NO: 1106743 - protein, 9 aa, Homo Sapiens
PAPTWTTSS

SEQ ID NO: 1106744 - protein, 9 aa, Homo Sapiens
RPIQEEYEG

SEQ ID NO: 1106745 - protein, 9 aa, Homo Sapiens
HGPDAHITK

SEQ ID NO: 1106746 - protein, 9 aa, Homo Sapiens
PWAGAPATE

SEQ ID NO: 1106747 - protein, 9 aa, Homo Sapiens
RRAVQKRGL

SEQ ID NO: 1106748 - protein, 9 aa, Homo Sapiens
RLLALVVGT

SEQ ID NO: 1106749 - protein, 9 aa, Homo Sapiens
NPTISCPFQ

SEQ ID NO: 1106750 - protein, 9 aa, Homo Sapiens
GALCACPMD

SEQ ID NO: 1106751 - protein, 9 aa, Homo Sapiens
GNLQPTSMW

SEQ ID NO: 1106752 - protein, 9 aa, Homo Sapiens
ALEIAEKNC

SEQ ID NO: 1106753 - protein, 9 aa, Homo Sapiens
VQDAAGRGR

SEQ ID NO: 1106754 - protein, 9 aa, Homo Sapiens
GAAATTLTS

SEQ ID NO: 1106755 - protein, 9 aa, Homo Sapiens
PVPTYVPAR

SEQ ID NO: 1106756 - protein, 9 aa, Homo Sapiens
GSNPPIFHS

SEQ ID NO: 1106757 - protein, 9 aa, Homo Sapiens
TSPGTCHQW

SEQ ID NO: 1106758 - protein, 9 aa, Homo Sapiens
GERCWRSCS

SEQ ID NO: 1106759 - protein, 9 aa, Homo Sapiens
VSLLMAHCV

SEQ ID NO: 1106760 - protein, 9 aa, Homo Sapiens
LPDHRKFQG

SEQ ID NO: 1106761 - protein, 9 aa, Homo Sapiens
DRDVGGHGC

SEQ ID NO: 1106762 - protein, 9 aa, Homo Sapiens
LPILDDQIQ

SEQ ID NO: 1106763 - protein, 9 aa, Homo Sapiens
DREKVICSS

SEQ ID NO: 1106764 - protein, 9 aa, Homo Sapiens
REDLLAREG

SEQ ID NO: 1106765 - protein, 9 aa, Homo Sapiens
CPAVPAAAC

SEQ ID NO: 1106766 - protein, 9 aa, Homo Sapiens
GPRNIQLSI

SEQ ID NO: 1106767 - protein, 9 aa, Homo Sapiens
PEDLDLILY

SEQ ID NO: 1106768 - protein, 9 aa, Homo Sapiens
DGALLRGLG

SEQ ID NO: 1106769 - protein, 9 aa, Homo Sapiens
RCPQVLSAG

SEQ ID NO: 1106770 - protein, 9 aa, Homo Sapiens
PRGRTSGRS

SEQ ID NO: 1106771 - protein, 9 aa, Homo Sapiens
LADESSDSG

SEQ ID NO: 1106772 - protein, 9 aa, Homo Sapiens
KKHEAEFQK

SEQ ID NO: 1106773 - protein, 9 aa, Homo Sapiens
LRSWSPGCP

SEQ ID NO: 1106774 - protein, 9 aa, Homo Sapiens
NLGTTSSLP

SEQ ID NO: 1106775 - protein, 9 aa, Homo Sapiens
PRVCMMVDS

SEQ ID NO: 1106776 - protein, 9 aa, Homo Sapiens
LDPPHRVAD

SEQ ID NO: 1106777 - protein, 9 aa, Homo Sapiens
PGVGLGVEE

SEQ ID NO: 1106778 - protein, 9 aa, Homo Sapiens
TQVNKNKNG

SEQ ID NO: 1106779 - protein, 9 aa, Homo Sapiens
DKLAHPHRA

SEQ ID NO: 1106780 - protein, 9 aa, Homo Sapiens
WECLSTTRK

SEQ ID NO: 1106781 - protein, 9 aa, Homo Sapiens
EEHTFFTLM

SEQ ID NO: 1106782 - protein, 9 aa, Homo Sapiens
AMKIMDHIA

SEQ ID NO: 1106783 - protein, 9 aa, Homo Sapiens
KMVTSTGLF

SEQ ID NO: 1106784 - protein, 9 aa, Homo Sapiens
PRGLVGCPG

SEQ ID NO: 1106785 - protein, 9 aa, Homo Sapiens
STVLFHCQK

SEQ ID NO: 1106786 - protein, 9 aa, Homo Sapiens
FDLILVDAQ

SEQ ID NO: 1106787 - protein, 9 aa, Homo Sapiens
EFCHVIAWQ

SEQ ID NO: 1106788 - protein, 9 aa, Homo Sapiens
DGSQRPPRQ

SEQ ID NO: 1106789 - protein, 9 aa, Homo Sapiens
SMNLLGPPS

SEQ ID NO: 1106790 - protein, 9 aa, Homo Sapiens
VTCYYNFTN

SEQ ID NO: 1106791 - protein, 9 aa, Homo Sapiens
GHCQARCQE

SEQ ID NO: 1106792 - protein, 9 aa, Homo Sapiens
SRMPLSCQL

SEQ ID NO: 1106793 - protein, 9 aa, Homo Sapiens
LERYFEYKS

SEQ ID NO: 1106794 - protein, 9 aa, Homo Sapiens
SGYMMNSSN

SEQ ID NO: 1106795 - protein, 9 aa, Homo Sapiens
EPVDTGPQP

SEQ ID NO: 1106796 - protein, 9 aa, Homo Sapiens
RVLIAMVDV

SEQ ID NO: 1106797 - protein, 9 aa, Homo Sapiens
ELLAAAGVQ

SEQ ID NO: 1106798 - protein, 9 aa, Homo Sapiens
ADLMVLVAT

SEQ ID NO: 1106799 - protein, 9 aa, Homo Sapiens
AAEEVGGGV

SEQ ID NO: 1106800 - protein, 9 aa, Homo Sapiens
GRPAWPREA

SEQ ID NO: 1106801 - protein, 9 aa, Homo Sapiens
LQKFGSMPF

SEQ ID NO: 1106802 - protein, 9 aa, Homo Sapiens
SRRGCAWYL

SEQ ID NO: 1106803 - protein, 9 aa, Homo Sapiens
TKAPVLGRF

SEQ ID NO: 1106804 - protein, 9 aa, Homo Sapiens
DTWEIKTDF

SEQ ID NO: 1106805 - protein, 9 aa, Homo Sapiens
SCSLLTQPS

SEQ ID NO: 1106806 - protein, 9 aa, Homo Sapiens
NVWAAVDVL

SEQ ID NO: 1106807 - protein, 9 aa, Homo Sapiens
KKSRLPHQS

SEQ ID NO: 1106808 - protein, 9 aa, Homo Sapiens
NSTAPSKDD

SEQ ID NO: 1106809 - protein, 9 aa, Homo Sapiens
SYVIPLQAG

SEQ ID NO: 1106810 - protein, 9 aa, Homo Sapiens
DNHHLYRFP

SEQ ID NO: 1106811 - protein, 9 aa, Homo Sapiens
AAMRAALAG

SEQ ID NO: 1106812 - protein, 9 aa, Homo Sapiens
SARAGRGSL

SEQ ID NO: 1106813 - protein, 9 aa, Homo Sapiens
LQNTRNPIW

SEQ ID NO: 1106814 - protein, 9 aa, Homo Sapiens
KQSILSVCL

SEQ ID NO: 1106815 - protein, 9 aa, Homo Sapiens
LEPYEWDHA

SEQ ID NO: 1106816 - protein, 9 aa, Homo Sapiens
HLGHAGASL

SEQ ID NO: 1106817 - protein, 9 aa, Homo Sapiens
QQEAVMLLR

SEQ ID NO: 1106818 - protein, 9 aa, Homo Sapiens
QLPGPHDDF

SEQ ID NO: 1106819 - protein, 9 aa, Homo Sapiens
RLREDAEAV

SEQ ID NO: 1106820 - protein, 9 aa, Homo Sapiens
TRKVHNFQV

SEQ ID NO: 1106821 - protein, 9 aa, Homo Sapiens
GSASPTSSP

SEQ ID NO: 1106822 - protein, 9 aa, Homo Sapiens
VSFHHLAFN

SEQ ID NO: 1106823 - protein, 9 aa, Homo Sapiens
GSDVARPLL

SEQ ID NO: 1106824 - protein, 9 aa, Homo Sapiens
DDDLGALCA

SEQ ID NO: 1106825 - protein, 9 aa, Homo Sapiens
RKYRKFLPL

SEQ ID NO: 1106826 - protein, 9 aa, Homo Sapiens
KCALCRKVL

SEQ ID NO: 1106827 - protein, 9 aa, Homo Sapiens
ERNTMETHR

SEQ ID NO: 1106828 - protein, 9 aa, Homo Sapiens
LPPDRPCSL

SEQ ID NO: 1106829 - protein, 9 aa, Homo Sapiens
TAFEEVWGG

SEQ ID NO: 1106830 - protein, 9 aa, Homo Sapiens
SQPDHSRLS

SEQ ID NO: 1106831 - protein, 9 aa, Homo Sapiens
TTAAVMTAA

SEQ ID NO: 1106832 - protein, 9 aa, Homo Sapiens
TGSPAELYV

SEQ ID NO: 1106833 - protein, 9 aa, Homo Sapiens
YNERGKEIF

SEQ ID NO: 1106834 - protein, 9 aa, Homo Sapiens
TLFNGLTLL

SEQ ID NO: 1106835 - protein, 9 aa, Homo Sapiens
WPFPGWLGK

SEQ ID NO: 1106836 - protein, 9 aa, Homo Sapiens
GFSANPHAW

SEQ ID NO: 1106837 - protein, 9 aa, Homo Sapiens
YPSQREPPP

SEQ ID NO: 1106838 - protein, 9 aa, Homo Sapiens
SWREGCGAS

SEQ ID NO: 1106839 - protein, 9 aa, Homo Sapiens
SPRPGPRGG

SEQ ID NO: 1106840 - protein, 9 aa, Homo Sapiens
KRKKREKII

SEQ ID NO: 1106841 - protein, 9 aa, Homo Sapiens
ALQTSGSSS

SEQ ID NO: 1106842 - protein, 9 aa, Homo Sapiens
KKSYALSNK

SEQ ID NO: 1106843 - protein, 9 aa, Homo Sapiens
IGTVVVLRL

SEQ ID NO: 1106844 - protein, 9 aa, Homo Sapiens
TRSPPLWTP

SEQ ID NO: 1106845 - protein, 9 aa, Homo Sapiens
NVGEKGLEL

SEQ ID NO: 1106846 - protein, 9 aa, Homo Sapiens
IGQVFSVAY

SEQ ID NO: 1106847 - protein, 9 aa, Homo Sapiens
DALVATTIN

SEQ ID NO: 1106848 - protein, 9 aa, Homo Sapiens
VTPAPVQDT

SEQ ID NO: 1106849 - protein, 9 aa, Homo Sapiens
RAAAALRAV

SEQ ID NO: 1106850 - protein, 9 aa, Homo Sapiens
SLSNYNSSA

SEQ ID NO: 1106851 - protein, 9 aa, Homo Sapiens
AGCSPGELA

SEQ ID NO: 1106852 - protein, 9 aa, Homo Sapiens
NEYKYKEGY

SEQ ID NO: 1106853 - protein, 9 aa, Homo Sapiens
TTTTSTECS

SEQ ID NO: 1106854 - protein, 9 aa, Homo Sapiens
YMRELLLEL

SEQ ID NO: 1106855 - protein, 9 aa, Homo Sapiens
TALYRGGQR

SEQ ID NO: 1106856 - protein, 9 aa, Homo Sapiens
KEIRVEVDT

SEQ ID NO: 1106857 - protein, 9 aa, Homo Sapiens
ESNGKGVFC

SEQ ID NO: 1106858 - protein, 9 aa, Homo Sapiens
EECLQHTHC

SEQ ID NO: 1106859 - protein, 9 aa, Homo Sapiens
VTSPERLPL

SEQ ID NO: 1106860 - protein, 9 aa, Homo Sapiens
DRGTHVDLR

SEQ ID NO: 1106861 - protein, 9 aa, Homo Sapiens
DIRHVTSDD

SEQ ID NO: 1106862 - protein, 9 aa, Homo Sapiens
WPSRRWTCA

SEQ ID NO: 1106863 - protein, 9 aa, Homo Sapiens
SLVCPEIVS

SEQ ID NO: 1106864 - protein, 9 aa, Homo Sapiens
CLAGVTAPS

SEQ ID NO: 1106865 - protein, 9 aa, Homo Sapiens
LVAGAVQES

SEQ ID NO: 1106866 - protein, 9 aa, Homo Sapiens
PPATSSSRG

SEQ ID NO: 1106867 - protein, 9 aa, Homo Sapiens
PSGTRSSLG

SEQ ID NO: 1106868 - protein, 9 aa, Homo Sapiens
GATCERAHT

SEQ ID NO: 1106869 - protein, 9 aa, Homo Sapiens
IAQDDTGAD

SEQ ID NO: 1106870 - protein, 9 aa, Homo Sapiens
PSSRCWAGA

SEQ ID NO: 1106871 - protein, 9 aa, Homo Sapiens
APVTCYYNF

SEQ ID NO: 1106872 - protein, 9 aa, Homo Sapiens
PHAGEAGPP

SEQ ID NO: 1106873 - protein, 9 aa, Homo Sapiens
QSKDFLPPQ

SEQ ID NO: 1106874 - protein, 9 aa, Homo Sapiens
FLRLGVIGF

SEQ ID NO: 1106875 - protein, 9 aa, Homo Sapiens
GFFCNAAKK

SEQ ID NO: 1106876 - protein, 9 aa, Homo Sapiens
MTVGVVHQV

SEQ ID NO: 1106877 - protein, 9 aa, Homo Sapiens
CSTFFLVND

SEQ ID NO: 1106878 - protein, 9 aa, Homo Sapiens
RTFMPPPGH

SEQ ID NO: 1106879 - protein, 9 aa, Homo Sapiens
FCRPSRACD

SEQ ID NO: 1106880 - protein, 9 aa, Homo Sapiens
QLLTYIWSA

SEQ ID NO: 1106881 - protein, 9 aa, Homo Sapiens
MDLTFILLQ

SEQ ID NO: 1106882 - protein, 9 aa, Homo Sapiens
WFKSYRMIF

SEQ ID NO: 1106883 - protein, 9 aa, Homo Sapiens
SSCVALFKG

SEQ ID NO: 1106884 - protein, 9 aa, Homo Sapiens
RAMTKNTSM

SEQ ID NO: 1106885 - protein, 9 aa, Homo Sapiens
MRAALAGAH

SEQ ID NO: 1106886 - protein, 9 aa, Homo Sapiens
RLSWARQRG

SEQ ID NO: 1106887 - protein, 9 aa, Homo Sapiens
KRLGTGRDP

SEQ ID NO: 1106888 - protein, 9 aa, Homo Sapiens
GIARHSGSQ

SEQ ID NO: 1106889 - protein, 9 aa, Homo Sapiens
VTLQQVIHL

SEQ ID NO: 1106890 - protein, 9 aa, Homo Sapiens
VYDKKLAPP

SEQ ID NO: 1106891 - protein, 9 aa, Homo Sapiens
SNPAKCLTV

SEQ ID NO: 1106892 - protein, 9 aa, Homo Sapiens
LETVEKVIL

SEQ ID NO: 1106893 - protein, 9 aa, Homo Sapiens
LAGPGVEGV

SEQ ID NO: 1106894 - protein, 9 aa, Homo Sapiens
ARGSHIWPK

SEQ ID NO: 1106895 - protein, 9 aa, Homo Sapiens
VLDANDNLP

SEQ ID NO: 1106896 - protein, 9 aa, Homo Sapiens
ASLVVLQGS

SEQ ID NO: 1106897 - protein, 9 aa, Homo Sapiens
YYNFTNRKI

SEQ ID NO: 1106898 - protein, 9 aa, Homo Sapiens
KPSGEQIPG

SEQ ID NO: 1106899 - protein, 9 aa, Homo Sapiens
ILCSELSSV

SEQ ID NO: 1106900 - protein, 9 aa, Homo Sapiens
YVLKYLRCK

SEQ ID NO: 1106901 - protein, 9 aa, Homo Sapiens
SASRRTGLQ

SEQ ID NO: 1106902 - protein, 9 aa, Homo Sapiens
GQEPGVIGS

SEQ ID NO: 1106903 - protein, 9 aa, Homo Sapiens
LERGAGLQV

SEQ ID NO: 1106904 - protein, 9 aa, Homo Sapiens
ACTPAQSFL

SEQ ID NO: 1106905 - protein, 9 aa, Homo Sapiens
GKLVLLSVT

SEQ ID NO: 1106906 - protein, 9 aa, Homo Sapiens
LRMRGTISC

SEQ ID NO: 1106907 - protein, 9 aa, Homo Sapiens
TASRGGPGC

SEQ ID NO: 1106908 - protein, 9 aa, Homo Sapiens
RDAHLCPQQ

SEQ ID NO: 1106909 - protein, 9 aa, Homo Sapiens
PTWTTSSRL

SEQ ID NO: 1106910 - protein, 9 aa, Homo Sapiens
PLQAGQVQM

SEQ ID NO: 1106911 - protein, 9 aa, Homo Sapiens
GGPASSSLQ

SEQ ID NO: 1106912 - protein, 9 aa, Homo Sapiens
HHRRERRFG

SEQ ID NO: 1106913 - protein, 9 aa, Homo Sapiens
AKKNKENQK

SEQ ID NO: 1106914 - protein, 9 aa, Homo Sapiens
IHHYYRRSP

SEQ ID NO: 1106915 - protein, 9 aa, Homo Sapiens
RLQDLSKLS

SEQ ID NO: 1106916 - protein, 9 aa, Homo Sapiens
CRPSRACDI

SEQ ID NO: 1106917 - protein, 9 aa, Homo Sapiens
AAAAAAARN

SEQ ID NO: 1106918 - protein, 9 aa, Homo Sapiens
LSCCPRPRC

SEQ ID NO: 1106919 - protein, 9 aa, Homo Sapiens
LQAMANLPY

SEQ ID NO: 1106920 - protein, 9 aa, Homo Sapiens
VAVAVAAAA

SEQ ID NO: 1106921 - protein, 9 aa, Homo Sapiens
AVQKRGLLR

SEQ ID NO: 1106922 - protein, 9 aa, Homo Sapiens
DPPPRPGTL

SEQ ID NO: 1106923 - protein, 9 aa, Homo Sapiens
PPRTQHITW

SEQ ID NO: 1106924 - protein, 9 aa, Homo Sapiens
QLCSSSTKS

SEQ ID NO: 1106925 - protein, 9 aa, Homo Sapiens
SSEPVEPLL

SEQ ID NO: 1106926 - protein, 9 aa, Homo Sapiens
CGCCAHCLG

SEQ ID NO: 1106927 - protein, 9 aa, Homo Sapiens
YIPSSQLAT

SEQ ID NO: 1106928 - protein, 9 aa, Homo Sapiens
IFDVCNGGQ

SEQ ID NO: 1106929 - protein, 9 aa, Homo Sapiens
GQDQRRLFL

SEQ ID NO: 1106930 - protein, 9 aa, Homo Sapiens
VPAPSICKQ

SEQ ID NO: 1106931 - protein, 9 aa, Homo Sapiens
LPKALSQYG

SEQ ID NO: 1106932 - protein, 9 aa, Homo Sapiens
AAIPTQRSP

SEQ ID NO: 1106933 - protein, 9 aa, Homo Sapiens
VFQLFGYYS

SEQ ID NO: 1106934 - protein, 9 aa, Homo Sapiens
KREEEMCDT

SEQ ID NO: 1106935 - protein, 9 aa, Homo Sapiens
AAVLSLPLP

SEQ ID NO: 1106936 - protein, 9 aa, Homo Sapiens
AAWKILGCD

SEQ ID NO: 1106937 - protein, 9 aa, Homo Sapiens
RCGRCPQVL

SEQ ID NO: 1106938 - protein, 9 aa, Homo Sapiens
SAGGRHTAF

SEQ ID NO: 1106939 - protein, 9 aa, Homo Sapiens
LHSYILVKN

SEQ ID NO: 1106940 - protein, 9 aa, Homo Sapiens
AAVPAETVG

SEQ ID NO: 1106941 - protein, 9 aa, Homo Sapiens
NNYDTASGK

SEQ ID NO: 1106942 - protein, 9 aa, Homo Sapiens
FTHHSLFLH

SEQ ID NO: 1106943 - protein, 9 aa, Homo Sapiens
LSLPLPEVL

SEQ ID NO: 1106944 - protein, 9 aa, Homo Sapiens
ALKPAGPCS

SEQ ID NO: 1106945 - protein, 9 aa, Homo Sapiens
EFVWPPPYH

SEQ ID NO: 1106946 - protein, 9 aa, Homo Sapiens
MSRHATFKN

SEQ ID NO: 1106947 - protein, 9 aa, Homo Sapiens
LVLAPALDN

SEQ ID NO: 1106948 - protein, 9 aa, Homo Sapiens
GQNSRHLHP

SEQ ID NO: 1106949 - protein, 9 aa, Homo Sapiens
SYGGPASSS

SEQ ID NO: 1106950 - protein, 9 aa, Homo Sapiens
AVISDDQID

SEQ ID NO: 1106951 - protein, 9 aa, Homo Sapiens
IMTRELCMQ

SEQ ID NO: 1106952 - protein, 9 aa, Homo Sapiens
TYVPARQPE

SEQ ID NO: 1106953 - protein, 9 aa, Homo Sapiens
LCAPGAPAV

SEQ ID NO: 1106954 - protein, 9 aa, Homo Sapiens
FYLVVCNNC

SEQ ID NO: 1106955 - protein, 9 aa, Homo Sapiens
TKIQATMEE

SEQ ID NO: 1106956 - protein, 9 aa, Homo Sapiens
RICLLLGCH

SEQ ID NO: 1106957 - protein, 9 aa, Homo Sapiens
ECVYEMRRW

SEQ ID NO: 1106958 - protein, 9 aa, Homo Sapiens
YDFIIKCKP

SEQ ID NO: 1106959 - protein, 9 aa, Homo Sapiens
APGAPAVPA

SEQ ID NO: 1106960 - protein, 9 aa, Homo Sapiens
RSLPCHWPL

SEQ ID NO: 1106961 - protein, 9 aa, Homo Sapiens
APTGRPRMS

SEQ ID NO: 1106962 - protein, 9 aa, Homo Sapiens
KRPMGLSRP

SEQ ID NO: 1106963 - protein, 9 aa, Homo Sapiens
TFWTHTEAA

SEQ ID NO: 1106964 - protein, 9 aa, Homo Sapiens
VAGSLLPAF

SEQ ID NO: 1106965 - protein, 9 aa, Homo Sapiens
VKIIKKTVI

SEQ ID NO: 1106966 - protein, 9 aa, Homo Sapiens
LKKRKQLLS

SEQ ID NO: 1106967 - protein, 9 aa, Homo Sapiens
GRVNELRRP

SEQ ID NO: 1106968 - protein, 9 aa, Homo Sapiens
GRARVLLLP

SEQ ID NO: 1106969 - protein, 9 aa, Homo Sapiens
VRLREDAEA

SEQ ID NO: 1106970 - protein, 9 aa, Homo Sapiens
IRRVSPGQG

SEQ ID NO: 1106971 - protein, 9 aa, Homo Sapiens
SLTHHRNRE

SEQ ID NO: 1106972 - protein, 9 aa, Homo Sapiens
AELQVPHNA

SEQ ID NO: 1106973 - protein, 9 aa, Homo Sapiens
RHLGHAGAS

SEQ ID NO: 1106974 - protein, 9 aa, Homo Sapiens
LSFAPPRGI

SEQ ID NO: 1106975 - protein, 9 aa, Homo Sapiens
WGAAATTLT

SEQ ID NO: 1106976 - protein, 9 aa, Homo Sapiens
RGGGGGGGY

SEQ ID NO: 1106977 - protein, 9 aa, Homo Sapiens
GDEQGSDRK

SEQ ID NO: 1106978 - protein, 9 aa, Homo Sapiens
SSRLARAPR

SEQ ID NO: 1106979 - protein, 9 aa, Homo Sapiens
SPPYTQASL

SEQ ID NO: 1106980 - protein, 9 aa, Homo Sapiens
YHPFKINQN

SEQ ID NO: 1106981 - protein, 9 aa, Homo Sapiens
LWQSPCPAP

SEQ ID NO: 1106982 - protein, 9 aa, Homo Sapiens
TLRILADLL

SEQ ID NO: 1106983 - protein, 9 aa, Homo Sapiens
VQHMQGHPN

SEQ ID NO: 1106984 - protein, 9 aa, Homo Sapiens
SQPAQATTP

SEQ ID NO: 1106985 - protein, 9 aa, Homo Sapiens
AHAAGPAAE

SEQ ID NO: 1106986 - protein, 9 aa, Homo Sapiens
AVTLFALSG

SEQ ID NO: 1106987 - protein, 9 aa, Homo Sapiens
PRVRGGVPD

SEQ ID NO: 1106988 - protein, 9 aa, Homo Sapiens
NKCSFFMIS

SEQ ID NO: 1106989 - protein, 9 aa, Homo Sapiens
LANSLDATL

SEQ ID NO: 1106990 - protein, 9 aa, Homo Sapiens
GSPINTFTM

SEQ ID NO: 1106991 - protein, 9 aa, Homo Sapiens
EVSHFEKAK

SEQ ID NO: 1106992 - protein, 9 aa, Homo Sapiens
RPRTPAPAS

SEQ ID NO: 1106993 - protein, 9 aa, Homo Sapiens
KNGSVKRVW

SEQ ID NO: 1106994 - protein, 9 aa, Homo Sapiens
GPCLDPAGP

SEQ ID NO: 1106995 - protein, 9 aa, Homo Sapiens
QAMLYNCRN

SEQ ID NO: 1106996 - protein, 9 aa, Homo Sapiens
HVWLLPGMG

SEQ ID NO: 1106997 - protein, 9 aa, Homo Sapiens
FRSGAKPPG

SEQ ID NO: 1106998 - protein, 9 aa, Homo Sapiens
PPPAAPTGR

SEQ ID NO: 1106999 - protein, 9 aa, Homo Sapiens
VQALQFTTL

SEQ ID NO: 1107000 - protein, 9 aa, Homo Sapiens
SDVEELTAK

SEQ ID NO: 1107001 - protein, 9 aa, Homo Sapiens
DKALAPADL

SEQ ID NO: 1107002 - protein, 9 aa, Homo Sapiens
LSFWELIPT

SEQ ID NO: 1107003 - protein, 9 aa, Homo Sapiens
LYLDRQFRA

SEQ ID NO: 1107004 - protein, 9 aa, Homo Sapiens
SAATSRGMW

SEQ ID NO: 1107005 - protein, 9 aa, Homo Sapiens
LCFQRLLIS

SEQ ID NO: 1107006 - protein, 9 aa, Homo Sapiens
KHHMSQNHS

SEQ ID NO: 1107007 - protein, 9 aa, Homo Sapiens
GTVVVLRLD

SEQ ID NO: 1107008 - protein, 9 aa, Homo Sapiens
EAPHVDGER

SEQ ID NO: 1107009 - protein, 9 aa, Homo Sapiens
SCCEPPAAP

SEQ ID NO: 1107010 - protein, 9 aa, Homo Sapiens
RPPPTYPCP

SEQ ID NO: 1107011 - protein, 9 aa, Homo Sapiens
DLVIWARTR

SEQ ID NO: 1107012 - protein, 9 aa, Homo Sapiens
LLLLLLDLP

SEQ ID NO: 1107013 - protein, 9 aa, Homo Sapiens
CSVDYNMPR

SEQ ID NO: 1107014 - protein, 9 aa, Homo Sapiens
YMMNSSNLL

SEQ ID NO: 1107015 - protein, 9 aa, Homo Sapiens
SYLSPKDSQ

SEQ ID NO: 1107016 - protein, 9 aa, Homo Sapiens
FGKVFGNFN

SEQ ID NO: 1107017 - protein, 9 aa, Homo Sapiens
RTSGRSLSC

SEQ ID NO: 1107018 - protein, 9 aa, Homo Sapiens
WPALTLPCA

SEQ ID NO: 1107019 - protein, 9 aa, Homo Sapiens
FHCSDRSNL

SEQ ID NO: 1107020 - protein, 9 aa, Homo Sapiens
RIWFIRKNK

SEQ ID NO: 1107021 - protein, 9 aa, Homo Sapiens
GPNPDHLPR

SEQ ID NO: 1107022 - protein, 9 aa, Homo Sapiens
SLLREWFME

SEQ ID NO: 1107023 - protein, 9 aa, Homo Sapiens
METHRLIHT

SEQ ID NO: 1107024 - protein, 9 aa, Homo Sapiens
DDTGADDWE

SEQ ID NO: 1107025 - protein, 9 aa, Homo Sapiens
STSHSGSFV

SEQ ID NO: 1107026 - protein, 9 aa, Homo Sapiens
PTSALALPH

SEQ ID NO: 1107027 - protein, 9 aa, Homo Sapiens
VHKLARSPC

SEQ ID NO: 1107028 - protein, 9 aa, Homo Sapiens
GHTTGTSRT

SEQ ID NO: 1107029 - protein, 9 aa, Homo Sapiens
LESRSSVVK

SEQ ID NO: 1107030 - protein, 9 aa, Homo Sapiens
SVSTDTSVE

SEQ ID NO: 1107031 - protein, 9 aa, Homo Sapiens
ILPSIFYLC

SEQ ID NO: 1107032 - protein, 9 aa, Homo Sapiens
SCFSNGSWW

SEQ ID NO: 1107033 - protein, 9 aa, Homo Sapiens
NPELFRKFR

SEQ ID NO: 1107034 - protein, 9 aa, Homo Sapiens
LGGREVVAQ

SEQ ID NO: 1107035 - protein, 9 aa, Homo Sapiens
NVALLEEEV

SEQ ID NO: 1107036 - protein, 9 aa, Homo Sapiens
PVSSPTARR

SEQ ID NO: 1107037 - protein, 9 aa, Homo Sapiens
EQERERSVD

SEQ ID NO: 1107038 - protein, 9 aa, Homo Sapiens
SRSTAPSPR

SEQ ID NO: 1107039 - protein, 9 aa, Homo Sapiens
GRERGGALP

SEQ ID NO: 1107040 - protein, 9 aa, Homo Sapiens
PSICKQILE

SEQ ID NO: 1107041 - protein, 9 aa, Homo Sapiens
DDQHRMSLH

SEQ ID NO: 1107042 - protein, 9 aa, Homo Sapiens
STLSQPPPQ

SEQ ID NO: 1107043 - protein, 9 aa, Homo Sapiens
PWTMSPFSK

SEQ ID NO: 1107044 - protein, 9 aa, Homo Sapiens
RRKRRIYQH

SEQ ID NO: 1107045 - protein, 9 aa, Homo Sapiens
LVQSYPKKD

SEQ ID NO: 1107046 - protein, 9 aa, Homo Sapiens
QVTMCISAC

SEQ ID NO: 1107047 - protein, 9 aa, Homo Sapiens
GSGPGAHRE

SEQ ID NO: 1107048 - protein, 9 aa, Homo Sapiens
SFMTHTNRE

SEQ ID NO: 1107049 - protein, 9 aa, Homo Sapiens
LGGWTTRYF

SEQ ID NO: 1107050 - protein, 9 aa, Homo Sapiens
FWTELTALG

SEQ ID NO: 1107051 - protein, 9 aa, Homo Sapiens
SSVTTQPAQ

SEQ ID NO: 1107052 - protein, 9 aa, Homo Sapiens
LRLPSLPFT

SEQ ID NO: 1107053 - protein, 9 aa, Homo Sapiens
LYGLTQGAM

SEQ ID NO: 1107054 - protein, 9 aa, Homo Sapiens
RRTVHPAVP

SEQ ID NO: 1107055 - protein, 9 aa, Homo Sapiens
GAVVWPSVP

SEQ ID NO: 1107056 - protein, 9 aa, Homo Sapiens
SNSGPQGHR

SEQ ID NO: 1107057 - protein, 9 aa, Homo Sapiens
ACLPDHVDA

SEQ ID NO: 1107058 - protein, 9 aa, Homo Sapiens
QGLYGLTQG

SEQ ID NO: 1107059 - protein, 9 aa, Homo Sapiens
PECPSGYMM

SEQ ID NO: 1107060 - protein, 9 aa, Homo Sapiens
RVESDEARR

SEQ ID NO: 1107061 - protein, 9 aa, Homo Sapiens
CVAYKRPIQ

SEQ ID NO: 1107062 - protein, 9 aa, Homo Sapiens
SVCLEQCPL

SEQ ID NO: 1107063 - protein, 9 aa, Homo Sapiens
QPVTSKDFS

SEQ ID NO: 1107064 - protein, 9 aa, Homo Sapiens
LIWKMSPRT

SEQ ID NO: 1107065 - protein, 9 aa, Homo Sapiens
ITCSSLGKN

SEQ ID NO: 1107066 - protein, 9 aa, Homo Sapiens
CVTELAVQA

SEQ ID NO: 1107067 - protein, 9 aa, Homo Sapiens
YHSSSVLDR

SEQ ID NO: 1107068 - protein, 9 aa, Homo Sapiens
PRPSTPASP

SEQ ID NO: 1107069 - protein, 9 aa, Homo Sapiens
LGFLICCLS

SEQ ID NO: 1107070 - protein, 9 aa, Homo Sapiens
HLHEFFYPF

SEQ ID NO: 1107071 - protein, 9 aa, Homo Sapiens
ESTTGWPPS

SEQ ID NO: 1107072 - protein, 9 aa, Homo Sapiens
WDQRRHGTE

SEQ ID NO: 1107073 - protein, 9 aa, Homo Sapiens
PTLPTAAPS

SEQ ID NO: 1107074 - protein, 9 aa, Homo Sapiens
SLEAQHHIA

SEQ ID NO: 1107075 - protein, 9 aa, Homo Sapiens
PLQPPLPLT

SEQ ID NO: 1107076 - protein, 9 aa, Homo Sapiens
TFFFLHKEF

SEQ ID NO: 1107077 - protein, 9 aa, Homo Sapiens
ISDLVDEGE

SEQ ID NO: 1107078 - protein, 9 aa, Homo Sapiens
EDEEGAEKE

SEQ ID NO: 1107079 - protein, 9 aa, Homo Sapiens
VLRVLRILY

SEQ ID NO: 1107080 - protein, 9 aa, Homo Sapiens
MFVGIARHS

SEQ ID NO: 1107081 - protein, 9 aa, Homo Sapiens
RHTAFSTCV

SEQ ID NO: 1107082 - protein, 9 aa, Homo Sapiens
HRSHSTEPS

SEQ ID NO: 1107083 - protein, 9 aa, Homo Sapiens
CPQLDKMVR

SEQ ID NO: 1107084 - protein, 9 aa, Homo Sapiens
GLNGWLCID

SEQ ID NO: 1107085 - protein, 9 aa, Homo Sapiens
LAWKTEGYS

SEQ ID NO: 1107086 - protein, 9 aa, Homo Sapiens
SRNIACITC

SEQ ID NO: 1107087 - protein, 9 aa, Homo Sapiens
KTKATQNFK

SEQ ID NO: 1107088 - protein, 9 aa, Homo Sapiens
RVNTAWKTK

SEQ ID NO: 1107089 - protein, 9 aa, Homo Sapiens
INNTTVRLH

SEQ ID NO: 1107090 - protein, 9 aa, Homo Sapiens
FLFFTIFCN

SEQ ID NO: 1107091 - protein, 9 aa, Homo Sapiens
RVLRRVLPR

SEQ ID NO: 1107092 - protein, 9 aa, Homo Sapiens
LHVHLCCHR

SEQ ID NO: 1107093 - protein, 9 aa, Homo Sapiens
RTHQEYLKD

SEQ ID NO: 1107094 - protein, 9 aa, Homo Sapiens
SCEHPWEVM

SEQ ID NO: 1107095 - protein, 9 aa, Homo Sapiens
LRRPARDEG

SEQ ID NO: 1107096 - protein, 9 aa, Homo Sapiens
WGARDASAP

SEQ ID NO: 1107097 - protein, 9 aa, Homo Sapiens
AVATASCGT

SEQ ID NO: 1107098 - protein, 9 aa, Homo Sapiens
ISETGYVWP

SEQ ID NO: 1107099 - protein, 9 aa, Homo Sapiens
EAQAAVPAE

SEQ ID NO: 1107100 - protein, 9 aa, Homo Sapiens
RAAQLCGLK

SEQ ID NO: 1107101 - protein, 9 aa, Homo Sapiens
PPAPPAALV

SEQ ID NO: 1107102 - protein, 9 aa, Homo Sapiens
LPQRGPASP

SEQ ID NO: 1107103 - protein, 9 aa, Homo Sapiens
VIWAPLGRG

SEQ ID NO: 1107104 - protein, 9 aa, Homo Sapiens
SSARHPHAP

SEQ ID NO: 1107105 - protein, 9 aa, Homo Sapiens
ARASDDLRP

SEQ ID NO: 1107106 - protein, 9 aa, Homo Sapiens
WSRPGSGGG

SEQ ID NO: 1107107 - protein, 9 aa, Homo Sapiens
WQLLQPNKV

SEQ ID NO: 1107108 - protein, 9 aa, Homo Sapiens
ACAPGQGHL

SEQ ID NO: 1107109 - protein, 9 aa, Homo Sapiens
LSAGAARAS

SEQ ID NO: 1107110 - protein, 9 aa, Homo Sapiens
GRGRASQTR

SEQ ID NO: 1107111 - protein, 9 aa, Homo Sapiens
FSKKKKRKK

SEQ ID NO: 1107112 - protein, 9 aa, Homo Sapiens
GHLACFSGA

SEQ ID NO: 1107113 - protein, 9 aa, Homo Sapiens
NLSNNLFST

SEQ ID NO: 1107114 - protein, 9 aa, Homo Sapiens
ASEDVDKGP

SEQ ID NO: 1107115 - protein, 9 aa, Homo Sapiens
NIDEGTKSG

SEQ ID NO: 1107116 - protein, 9 aa, Homo Sapiens
AREGRARVL

SEQ ID NO: 1107117 - protein, 9 aa, Homo Sapiens
TTTLQRSPL

SEQ ID NO: 1107118 - protein, 9 aa, Homo Sapiens
DLGNIRIWF

SEQ ID NO: 1107119 - protein, 9 aa, Homo Sapiens
RREEKMRIC

SEQ ID NO: 1107120 - protein, 9 aa, Homo Sapiens
NIAGRSKPA

SEQ ID NO: 1107121 - protein, 9 aa, Homo Sapiens
DCSHSMAAQ

SEQ ID NO: 1107122 - protein, 9 aa, Homo Sapiens
KKQKRSRST

SEQ ID NO: 1107123 - protein, 9 aa, Homo Sapiens
QCTFFFLHK

SEQ ID NO: 1107124 - protein, 9 aa, Homo Sapiens
TDRHGLQEL

SEQ ID NO: 1107125 - protein, 9 aa, Homo Sapiens
LPRPWSRPG

SEQ ID NO: 1107126 - protein, 9 aa, Homo Sapiens
PATPTSGPG

SEQ ID NO: 1107127 - protein, 9 aa, Homo Sapiens
PHMRPKRPH

SEQ ID NO: 1107128 - protein, 9 aa, Homo Sapiens
KALQEIQNS

SEQ ID NO: 1107129 - protein, 9 aa, Homo Sapiens
EEGAEKEEE

SEQ ID NO: 1107130 - protein, 9 aa, Homo Sapiens
HMDGPHSQT

SEQ ID NO: 1107131 - protein, 9 aa, Homo Sapiens
VFVPDYMRE

SEQ ID NO: 1107132 - protein, 9 aa, Homo Sapiens
LLQLSRLIR

SEQ ID NO: 1107133 - protein, 9 aa, Homo Sapiens
YTVRGLWPN

SEQ ID NO: 1107134 - protein, 9 aa, Homo Sapiens
GHLMSDLLQ

SEQ ID NO: 1107135 - protein, 9 aa, Homo Sapiens
CTGLPPCTV

SEQ ID NO: 1107136 - protein, 9 aa, Homo Sapiens
PLSAPPRTQ

SEQ ID NO: 1107137 - protein, 9 aa, Homo Sapiens
GRPRMSLMP

SEQ ID NO: 1107138 - protein, 9 aa, Homo Sapiens
PPQRPSNSR

SEQ ID NO: 1107139 - protein, 9 aa, Homo Sapiens
DGKDQVVSL

SEQ ID NO: 1107140 - protein, 9 aa, Homo Sapiens
CSRPCCRVF

SEQ ID NO: 1107141 - protein, 9 aa, Homo Sapiens
YMDVSAVPM

SEQ ID NO: 1107142 - protein, 9 aa, Homo Sapiens
RPRSPASPA

SEQ ID NO: 1107143 - protein, 9 aa, Homo Sapiens
RGAWAAAAA

SEQ ID NO: 1107144 - protein, 9 aa, Homo Sapiens
EDLLAREGR

SEQ ID NO: 1107145 - protein, 9 aa, Homo Sapiens
TSSSLTPLT

SEQ ID NO: 1107146 - protein, 9 aa, Homo Sapiens
EGLLSFPVL

SEQ ID NO: 1107147 - protein, 9 aa, Homo Sapiens
RMSTASHSF

SEQ ID NO: 1107148 - protein, 9 aa, Homo Sapiens
FYLKKRKQL

SEQ ID NO: 1107149 - protein, 9 aa, Homo Sapiens
HSHHCSRCG

SEQ ID NO: 1107150 - protein, 9 aa, Homo Sapiens
GERSFRGSG

SEQ ID NO: 1107151 - protein, 9 aa, Homo Sapiens
GGGDWVWDG

SEQ ID NO: 1107152 - protein, 9 aa, Homo Sapiens
PILILQDGD

SEQ ID NO: 1107153 - protein, 9 aa, Homo Sapiens
QERERSVDR

SEQ ID NO: 1107154 - protein, 9 aa, Homo Sapiens
TYIWSAVTR

SEQ ID NO: 1107155 - protein, 9 aa, Homo Sapiens
RGVIDYDWD

SEQ ID NO: 1107156 - protein, 9 aa, Homo Sapiens
IPSFCWPSG

SEQ ID NO: 1107157 - protein, 9 aa, Homo Sapiens
VLRGCWVGY

SEQ ID NO: 1107158 - protein, 9 aa, Homo Sapiens
VCSARAGRG

SEQ ID NO: 1107159 - protein, 9 aa, Homo Sapiens
ELDMCTIAT

SEQ ID NO: 1107160 - protein, 9 aa, Homo Sapiens
RAKMNQQHG

SEQ ID NO: 1107161 - protein, 9 aa, Homo Sapiens
QVCLALLSA

SEQ ID NO: 1107162 - protein, 9 aa, Homo Sapiens
YPPHQQDPG

SEQ ID NO: 1107163 - protein, 9 aa, Homo Sapiens
HFEKAKAIY

SEQ ID NO: 1107164 - protein, 9 aa, Homo Sapiens
RGEQSPEAE

SEQ ID NO: 1107165 - protein, 9 aa, Homo Sapiens
SQTVRQFQF

SEQ ID NO: 1107166 - protein, 9 aa, Homo Sapiens
RRRGSSPPG

SEQ ID NO: 1107167 - protein, 9 aa, Homo Sapiens
RSGRPGWGA

SEQ ID NO: 1107168 - protein, 9 aa, Homo Sapiens
MRDGTVLQE

SEQ ID NO: 1107169 - protein, 9 aa, Homo Sapiens
PPGFFLRLG

SEQ ID NO: 1107170 - protein, 9 aa, Homo Sapiens
NQKVVLLLL

SEQ ID NO: 1107171 - protein, 9 aa, Homo Sapiens
MQKHHRRER

SEQ ID NO: 1107172 - protein, 9 aa, Homo Sapiens
VPDYMRELL

SEQ ID NO: 1107173 - protein, 9 aa, Homo Sapiens
SSSLRDLLE

SEQ ID NO: 1107174 - protein, 9 aa, Homo Sapiens
RSHLQGTQA

SEQ ID NO: 1107175 - protein, 9 aa, Homo Sapiens
EAAWSMGGD

SEQ ID NO: 1107176 - protein, 9 aa, Homo Sapiens
RSLGEPWRA

SEQ ID NO: 1107177 - protein, 9 aa, Homo Sapiens
FCHPLAVAS

SEQ ID NO: 1107178 - protein, 9 aa, Homo Sapiens
RARRGRLPH

SEQ ID NO: 1107179 - protein, 9 aa, Homo Sapiens
YQQTYSLPD

SEQ ID NO: 1107180 - protein, 9 aa, Homo Sapiens
GAAASLRIA

SEQ ID NO: 1107181 - protein, 9 aa, Homo Sapiens
AHVVLEVVV

SEQ ID NO: 1107182 - protein, 9 aa, Homo Sapiens
TSFSHAPPV

SEQ ID NO: 1107183 - protein, 9 aa, Homo Sapiens
SGVGEEIAE

SEQ ID NO: 1107184 - protein, 9 aa, Homo Sapiens
LGSRWCPPS

SEQ ID NO: 1107185 - protein, 9 aa, Homo Sapiens
EKKPRLEDH

SEQ ID NO: 1107186 - protein, 9 aa, Homo Sapiens
ALHQLKCQH

SEQ ID NO: 1107187 - protein, 9 aa, Homo Sapiens
RRPARDEGG

SEQ ID NO: 1107188 - protein, 9 aa, Homo Sapiens
HGYGVHQSV

SEQ ID NO: 1107189 - protein, 9 aa, Homo Sapiens
DKMVRRQPS

SEQ ID NO: 1107190 - protein, 9 aa, Homo Sapiens
VHPPPLGSR

SEQ ID NO: 1107191 - protein, 9 aa, Homo Sapiens
SRTACGAAS

SEQ ID NO: 1107192 - protein, 9 aa, Homo Sapiens
LDLRMRGEP

SEQ ID NO: 1107193 - protein, 9 aa, Homo Sapiens
SKVGIHKLI

SEQ ID NO: 1107194 - protein, 9 aa, Homo Sapiens
CLRTHGCSG

SEQ ID NO: 1107195 - protein, 9 aa, Homo Sapiens
EKLRPHLAK

SEQ ID NO: 1107196 - protein, 9 aa, Homo Sapiens
SKPEEASRS

SEQ ID NO: 1107197 - protein, 9 aa, Homo Sapiens
CISLLGAIA

SEQ ID NO: 1107198 - protein, 9 aa, Homo Sapiens
GSSWTPGRR

SEQ ID NO: 1107199 - protein, 9 aa, Homo Sapiens
TRVPPGRAL

SEQ ID NO: 1107200 - protein, 9 aa, Homo Sapiens
PGSLSGLTD

SEQ ID NO: 1107201 - protein, 9 aa, Homo Sapiens
DVSVQVKAC

SEQ ID NO: 1107202 - protein, 9 aa, Homo Sapiens
ELQMQLKAL

SEQ ID NO: 1107203 - protein, 9 aa, Homo Sapiens
PAVLEPDLH

SEQ ID NO: 1107204 - protein, 9 aa, Homo Sapiens
SSQTSLPLS

SEQ ID NO: 1107205 - protein, 9 aa, Homo Sapiens
RKGQRRATL

SEQ ID NO: 1107206 - protein, 9 aa, Homo Sapiens
GATYTPRHP

SEQ ID NO: 1107207 - protein, 9 aa, Homo Sapiens
LRARRGRLP

SEQ ID NO: 1107208 - protein, 9 aa, Homo Sapiens
DDQPPKKPR

SEQ ID NO: 1107209 - protein, 9 aa, Homo Sapiens
LRLSWARQR

SEQ ID NO: 1107210 - protein, 9 aa, Homo Sapiens
LLRDAIKWR

SEQ ID NO: 1107211 - protein, 9 aa, Homo Sapiens
PPSGPGGLP

SEQ ID NO: 1107212 - protein, 9 aa, Homo Sapiens
VVLMPTLSP

SEQ ID NO: 1107213 - protein, 9 aa, Homo Sapiens
PGLIITTGS

SEQ ID NO: 1107214 - protein, 9 aa, Homo Sapiens
QLCKEVETR

SEQ ID NO: 1107215 - protein, 9 aa, Homo Sapiens
SPRICPATV

SEQ ID NO: 1107216 - protein, 9 aa, Homo Sapiens
SLMTANSQE

SEQ ID NO: 1107217 - protein, 9 aa, Homo Sapiens
GKIAKPRRR

SEQ ID NO: 1107218 - protein, 9 aa, Homo Sapiens
RASTPAPCL

SEQ ID NO: 1107219 - protein, 9 aa, Homo Sapiens
GYHGMYFLN

SEQ ID NO: 1107220 - protein, 9 aa, Homo Sapiens
ETFAKFYCS

SEQ ID NO: 1107221 - protein, 9 aa, Homo Sapiens
FPHFERLLL

SEQ ID NO: 1107222 - protein, 9 aa, Homo Sapiens
FMCSRPSRQ

SEQ ID NO: 1107223 - protein, 9 aa, Homo Sapiens
RLSYLLTCL

SEQ ID NO: 1107224 - protein, 9 aa, Homo Sapiens
HAPKTRTES

SEQ ID NO: 1107225 - protein, 9 aa, Homo Sapiens
KTLQNTRNP

SEQ ID NO: 1107226 - protein, 9 aa, Homo Sapiens
CINDVPPSI

SEQ ID NO: 1107227 - protein, 9 aa, Homo Sapiens
AFAGAVKVN

SEQ ID NO: 1107228 - protein, 9 aa, Homo Sapiens
ETVNLRLQP

SEQ ID NO: 1107229 - protein, 9 aa, Homo Sapiens
ALHTDKTLV

SEQ ID NO: 1107230 - protein, 9 aa, Homo Sapiens
AEQNGATLA

SEQ ID NO: 1107231 - protein, 9 aa, Homo Sapiens
RQTRPEWSL

SEQ ID NO: 1107232 - protein, 9 aa, Homo Sapiens
VGAWAAVPR

SEQ ID NO: 1107233 - protein, 9 aa, Homo Sapiens
LLAAEYTFA

SEQ ID NO: 1107234 - protein, 9 aa, Homo Sapiens
DRGSLALSS

SEQ ID NO: 1107235 - protein, 9 aa, Homo Sapiens
RVFSHAALE

SEQ ID NO: 1107236 - protein, 9 aa, Homo Sapiens
SFKCADICA

SEQ ID NO: 1107237 - protein, 9 aa, Homo Sapiens
HDLIWKMSP

SEQ ID NO: 1107238 - protein, 9 aa, Homo Sapiens
GSWAAFVEA

SEQ ID NO: 1107239 - protein, 9 aa, Homo Sapiens
YQDYAHHAQ

SEQ ID NO: 1107240 - protein, 9 aa, Homo Sapiens
LGLLEGFLQ

SEQ ID NO: 1107241 - protein, 9 aa, Homo Sapiens
FFAHQHQPP

SEQ ID NO: 1107242 - protein, 9 aa, Homo Sapiens
ADILRGSPP

SEQ ID NO: 1107243 - protein, 9 aa, Homo Sapiens
HGQLPRPLP

SEQ ID NO: 1107244 - protein, 9 aa, Homo Sapiens
PFGSVAPSF

SEQ ID NO: 1107245 - protein, 9 aa, Homo Sapiens
KLLPLPRSL

SEQ ID NO: 1107246 - protein, 9 aa, Homo Sapiens
GAFYCEKLS

SEQ ID NO: 1107247 - protein, 9 aa, Homo Sapiens
FQLKVRLST

SEQ ID NO: 1107248 - protein, 9 aa, Homo Sapiens
EPNPGVGLG

SEQ ID NO: 1107249 - protein, 9 aa, Homo Sapiens
ERNLRPLSL

SEQ ID NO: 1107250 - protein, 9 aa, Homo Sapiens
SRNVASRMP

SEQ ID NO: 1107251 - protein, 9 aa, Homo Sapiens
GGPATPTSG

SEQ ID NO: 1107252 - protein, 9 aa, Homo Sapiens
TRSTRSPPL

SEQ ID NO: 1107253 - protein, 9 aa, Homo Sapiens
PGSTDHPTS

SEQ ID NO: 1107254 - protein, 9 aa, Homo Sapiens
VCLLVLGIA

SEQ ID NO: 1107255 - protein, 9 aa, Homo Sapiens
NTPERERGS

SEQ ID NO: 1107256 - protein, 9 aa, Homo Sapiens
VMSADHYLV

SEQ ID NO: 1107257 - protein, 9 aa, Homo Sapiens
TLIGTSANV

SEQ ID NO: 1107258 - protein, 9 aa, Homo Sapiens
HICLRETYR

SEQ ID NO: 1107259 - protein, 9 aa, Homo Sapiens
ISAPVDKEN

SEQ ID NO: 1107260 - protein, 9 aa, Homo Sapiens
WHAVHEELL

SEQ ID NO: 1107261 - protein, 9 aa, Homo Sapiens
DAYGYQQTY

SEQ ID NO: 1107262 - protein, 9 aa, Homo Sapiens
KAVWVPGHE

SEQ ID NO: 1107263 - protein, 9 aa, Homo Sapiens
ARQMALRAN

SEQ ID NO: 1107264 - protein, 9 aa, Homo Sapiens
VPRGAWAAA

SEQ ID NO: 1107265 - protein, 9 aa, Homo Sapiens
SSAWGSASC

SEQ ID NO: 1107266 - protein, 9 aa, Homo Sapiens
SSNNSRKKK

SEQ ID NO: 1107267 - protein, 9 aa, Homo Sapiens
TVRWAGQDL

SEQ ID NO: 1107268 - protein, 9 aa, Homo Sapiens
NKKHEAEFQ

SEQ ID NO: 1107269 - protein, 9 aa, Homo Sapiens
SPTARRASP

SEQ ID NO: 1107270 - protein, 9 aa, Homo Sapiens
GLWRPGTCT

SEQ ID NO: 1107271 - protein, 9 aa, Homo Sapiens
DSAVPMWSC

SEQ ID NO: 1107272 - protein, 9 aa, Homo Sapiens
TEKENTPER

SEQ ID NO: 1107273 - protein, 9 aa, Homo Sapiens
PKIEVAKMG

SEQ ID NO: 1107274 - protein, 9 aa, Homo Sapiens
GKPKAVGWP

SEQ ID NO: 1107275 - protein, 9 aa, Homo Sapiens
APVRTPSIS

SEQ ID NO: 1107276 - protein, 9 aa, Homo Sapiens
RVGTKCYMP

SEQ ID NO: 1107277 - protein, 9 aa, Homo Sapiens
LHNVTKYLW

SEQ ID NO: 1107278 - protein, 9 aa, Homo Sapiens
LSVGKAKAD

SEQ ID NO: 1107279 - protein, 9 aa, Homo Sapiens
PVRPGCRGL

SEQ ID NO: 1107280 - protein, 9 aa, Homo Sapiens
GVPPRAPAS

SEQ ID NO: 1107281 - protein, 9 aa, Homo Sapiens
QREPPPRRS

SEQ ID NO: 1107282 - protein, 9 aa, Homo Sapiens
RPRGARRVP

SEQ ID NO: 1107283 - protein, 9 aa, Homo Sapiens
PWAKVVRAA

SEQ ID NO: 1107284 - protein, 9 aa, Homo Sapiens
DVGLGVQVL

SEQ ID NO: 1107285 - protein, 9 aa, Homo Sapiens
SARAPTLPT

SEQ ID NO: 1107286 - protein, 9 aa, Homo Sapiens
LQCSFFDKH

SEQ ID NO: 1107287 - protein, 9 aa, Homo Sapiens
LDRTGLTTV

SEQ ID NO: 1107288 - protein, 9 aa, Homo Sapiens
CTRPPLLTI

SEQ ID NO: 1107289 - protein, 9 aa, Homo Sapiens
QHPPEGTRP

SEQ ID NO: 1107290 - protein, 9 aa, Homo Sapiens
QKKKVPTKK

SEQ ID NO: 1107291 - protein, 9 aa, Homo Sapiens
VITALGRFR

SEQ ID NO: 1107292 - protein, 9 aa, Homo Sapiens
AWGDWVASP

SEQ ID NO: 1107293 - protein, 9 aa, Homo Sapiens
HMPLSKLMK

SEQ ID NO: 1107294 - protein, 9 aa, Homo Sapiens
MDGPHSQTA

SEQ ID NO: 1107295 - protein, 9 aa, Homo Sapiens
LCESTTGWP

SEQ ID NO: 1107296 - protein, 9 aa, Homo Sapiens
MWTSRTSPP

SEQ ID NO: 1107297 - protein, 9 aa, Homo Sapiens
KWKKSDSLL

SEQ ID NO: 1107298 - protein, 9 aa, Homo Sapiens
PEDGRAPRQ

SEQ ID NO: 1107299 - protein, 9 aa, Homo Sapiens
SHLGFRLQD

SEQ ID NO: 1107300 - protein, 9 aa, Homo Sapiens
LSVCKFTEK

SEQ ID NO: 1107301 - protein, 9 aa, Homo Sapiens
LRYPSQREP

SEQ ID NO: 1107302 - protein, 9 aa, Homo Sapiens
KFGSMPFTK

SEQ ID NO: 1107303 - protein, 9 aa, Homo Sapiens
VAVMPAPTP

SEQ ID NO: 1107304 - protein, 9 aa, Homo Sapiens
VLLLLEKGA

SEQ ID NO: 1107305 - protein, 9 aa, Homo Sapiens
SHHNDIMLL

SEQ ID NO: 1107306 - protein, 9 aa, Homo Sapiens
LAFQQACYN

SEQ ID NO: 1107307 - protein, 9 aa, Homo Sapiens
IRWVVDSED

SEQ ID NO: 1107308 - protein, 9 aa, Homo Sapiens
AFTSILRLS

SEQ ID NO: 1107309 - protein, 9 aa, Homo Sapiens
CDINTEQGQ

SEQ ID NO: 1107310 - protein, 9 aa, Homo Sapiens
IQADLDYLP

SEQ ID NO: 1107311 - protein, 9 aa, Homo Sapiens
GNAPFCTRL

SEQ ID NO: 1107312 - protein, 9 aa, Homo Sapiens
TSRPCQLLF

SEQ ID NO: 1107313 - protein, 9 aa, Homo Sapiens
ATCERAHTR

SEQ ID NO: 1107314 - protein, 9 aa, Homo Sapiens
HFYESLPPE

SEQ ID NO: 1107315 - protein, 9 aa, Homo Sapiens
VDRSVVTVT

SEQ ID NO: 1107316 - protein, 9 aa, Homo Sapiens
ATGSPAELY

SEQ ID NO: 1107317 - protein, 9 aa, Homo Sapiens
QKSSCFQRR

SEQ ID NO: 1107318 - protein, 9 aa, Homo Sapiens
RGRERGGAL

SEQ ID NO: 1107319 - protein, 9 aa, Homo Sapiens
DPRTAPRRS

SEQ ID NO: 1107320 - protein, 9 aa, Homo Sapiens
AARASSGTA

SEQ ID NO: 1107321 - protein, 9 aa, Homo Sapiens
LILDTNDNA

SEQ ID NO: 1107322 - protein, 9 aa, Homo Sapiens
GASCSSTRW

SEQ ID NO: 1107323 - protein, 9 aa, Homo Sapiens
ISRSSHTGY

SEQ ID NO: 1107324 - protein, 9 aa, Homo Sapiens
QVVSLSEKN

SEQ ID NO: 1107325 - protein, 9 aa, Homo Sapiens
REEKMRICL

SEQ ID NO: 1107326 - protein, 9 aa, Homo Sapiens
FMTKTSNMD

SEQ ID NO: 1107327 - protein, 9 aa, Homo Sapiens
LAVRGRDSY

SEQ ID NO: 1107328 - protein, 9 aa, Homo Sapiens
LRLLRLGSR

SEQ ID NO: 1107329 - protein, 9 aa, Homo Sapiens
SFPDEEDRK

SEQ ID NO: 1107330 - protein, 9 aa, Homo Sapiens
PSCGRCMRV

SEQ ID NO: 1107331 - protein, 9 aa, Homo Sapiens
RSHWGALMD

SEQ ID NO: 1107332 - protein, 9 aa, Homo Sapiens
LLMAHCVVT

SEQ ID NO: 1107333 - protein, 9 aa, Homo Sapiens
CESTTGWPP

SEQ ID NO: 1107334 - protein, 9 aa, Homo Sapiens
QIGLNGWLC

SEQ ID NO: 1107335 - protein, 9 aa, Homo Sapiens
KYHVARFTR

SEQ ID NO: 1107336 - protein, 9 aa, Homo Sapiens
GAPAVPAAP

SEQ ID NO: 1107337 - protein, 9 aa, Homo Sapiens
YRSYCSTRQ

SEQ ID NO: 1107338 - protein, 9 aa, Homo Sapiens
TQNDKLAFP

SEQ ID NO: 1107339 - protein, 9 aa, Homo Sapiens
VGIHKLINN

SEQ ID NO: 1107340 - protein, 9 aa, Homo Sapiens
TTRASGEKV

SEQ ID NO: 1107341 - protein, 9 aa, Homo Sapiens
PECFLAVLK

SEQ ID NO: 1107342 - protein, 9 aa, Homo Sapiens
APPAALVSW

SEQ ID NO: 1107343 - protein, 9 aa, Homo Sapiens
AMANLPYKG

SEQ ID NO: 1107344 - protein, 9 aa, Homo Sapiens
VLSSTLRIL

SEQ ID NO: 1107345 - protein, 9 aa, Homo Sapiens
FIREGTAPD

SEQ ID NO: 1107346 - protein, 9 aa, Homo Sapiens
NRTQSLNYS

SEQ ID NO: 1107347 - protein, 9 aa, Homo Sapiens
LLRFLPRVL

SEQ ID NO: 1107348 - protein, 9 aa, Homo Sapiens
TAASAGNGT

SEQ ID NO: 1107349 - protein, 9 aa, Homo Sapiens
EKPSLAASL

SEQ ID NO: 1107350 - protein, 9 aa, Homo Sapiens
MCDTNESTN

SEQ ID NO: 1107351 - protein, 9 aa, Homo Sapiens
SMVGKHLGT

SEQ ID NO: 1107352 - protein, 9 aa, Homo Sapiens
MSPFSKTPL

SEQ ID NO: 1107353 - protein, 9 aa, Homo Sapiens
AENAEEGAG

SEQ ID NO: 1107354 - protein, 9 aa, Homo Sapiens
TGCFKRPRV

SEQ ID NO: 1107355 - protein, 9 aa, Homo Sapiens
LRVLRGCWV

SEQ ID NO: 1107356 - protein, 9 aa, Homo Sapiens
PTYKEVTPY

SEQ ID NO: 1107357 - protein, 9 aa, Homo Sapiens
TEHFHFYKR

SEQ ID NO: 1107358 - protein, 9 aa, Homo Sapiens
GPLTRDAHL

SEQ ID NO: 1107359 - protein, 9 aa, Homo Sapiens
ECLQHTHCV

SEQ ID NO: 1107360 - protein, 9 aa, Homo Sapiens
EDRIFPQLC

SEQ ID NO: 1107361 - protein, 9 aa, Homo Sapiens
RRPPPAAPT

SEQ ID NO: 1107362 - protein, 9 aa, Homo Sapiens
GAESEWNWH

SEQ ID NO: 1107363 - protein, 9 aa, Homo Sapiens
PQLDKMVRR

SEQ ID NO: 1107364 - protein, 9 aa, Homo Sapiens
SESVQRPWE

SEQ ID NO: 1107365 - protein, 9 aa, Homo Sapiens
AASLRIAGC

SEQ ID NO: 1107366 - protein, 9 aa, Homo Sapiens
HRAQLVCSA

SEQ ID NO: 1107367 - protein, 9 aa, Homo Sapiens
LGTRKDHPG

SEQ ID NO: 1107368 - protein, 9 aa, Homo Sapiens
KRSGVAYIV

SEQ ID NO: 1107369 - protein, 9 aa, Homo Sapiens
VTYDFIIKC

SEQ ID NO: 1107370 - protein, 9 aa, Homo Sapiens
VTQPSAART

SEQ ID NO: 1107371 - protein, 9 aa, Homo Sapiens
PPARAGPKR

SEQ ID NO: 1107372 - protein, 9 aa, Homo Sapiens
LYLLAFKKS

SEQ ID NO: 1107373 - protein, 9 aa, Homo Sapiens
AQRKSQSWC

SEQ ID NO: 1107374 - protein, 9 aa, Homo Sapiens
NDCISQLFF

SEQ ID NO: 1107375 - protein, 9 aa, Homo Sapiens
DRDSEKMER

SEQ ID NO: 1107376 - protein, 9 aa, Homo Sapiens
HWPLWRPCW

SEQ ID NO: 1107377 - protein, 9 aa, Homo Sapiens
LALGLRQQH

SEQ ID NO: 1107378 - protein, 9 aa, Homo Sapiens
SCIVENPQT

SEQ ID NO: 1107379 - protein, 9 aa, Homo Sapiens
SSTRTTALG

SEQ ID NO: 1107380 - protein, 9 aa, Homo Sapiens
VATPGRPWP

SEQ ID NO: 1107381 - protein, 9 aa, Homo Sapiens
RSLGFLICC

SEQ ID NO: 1107382 - protein, 9 aa, Homo Sapiens
ARPRRTRSA

SEQ ID NO: 1107383 - protein, 9 aa, Homo Sapiens
GSLRVLRGC

SEQ ID NO: 1107384 - protein, 9 aa, Homo Sapiens
HGLVCAPES

SEQ ID NO: 1107385 - protein, 9 aa, Homo Sapiens
QESWPGLWP

SEQ ID NO: 1107386 - protein, 9 aa, Homo Sapiens
VVDRDNSPS

SEQ ID NO: 1107387 - protein, 9 aa, Homo Sapiens
VATTINLGD

SEQ ID NO: 1107388 - protein, 9 aa, Homo Sapiens
SIYQNANSV

SEQ ID NO: 1107389 - protein, 9 aa, Homo Sapiens
GTAPDYSLR

SEQ ID NO: 1107390 - protein, 9 aa, Homo Sapiens
APRPPSAGA

SEQ ID NO: 1107391 - protein, 9 aa, Homo Sapiens
EYDNFQCPH

SEQ ID NO: 1107392 - protein, 9 aa, Homo Sapiens
LDLRSQGVN

SEQ ID NO: 1107393 - protein, 9 aa, Homo Sapiens
QLATKLLHI

SEQ ID NO: 1107394 - protein, 9 aa, Homo Sapiens
LQIILFFFL

SEQ ID NO: 1107395 - protein, 9 aa, Homo Sapiens
GAITDVIEA

SEQ ID NO: 1107396 - protein, 9 aa, Homo Sapiens
ASLLFSIRR

SEQ ID NO: 1107397 - protein, 9 aa, Homo Sapiens
TGPQPPPSR

SEQ ID NO: 1107398 - protein, 9 aa, Homo Sapiens
MVGKHLGTR

SEQ ID NO: 1107399 - protein, 9 aa, Homo Sapiens
GRPWPPSFS

SEQ ID NO: 1107400 - protein, 9 aa, Homo Sapiens
WAPHSAGLS

SEQ ID NO: 1107401 - protein, 9 aa, Homo Sapiens
WDVSVQVKA

SEQ ID NO: 1107402 - protein, 9 aa, Homo Sapiens
VASILGIIL

SEQ ID NO: 1107403 - protein, 9 aa, Homo Sapiens
PSQREPPPR

SEQ ID NO: 1107404 - protein, 9 aa, Homo Sapiens
RVNELRRPA

SEQ ID NO: 1107405 - protein, 9 aa, Homo Sapiens
RGAALQTGP

SEQ ID NO: 1107406 - protein, 9 aa, Homo Sapiens
LLNLSNNLF

SEQ ID NO: 1107407 - protein, 9 aa, Homo Sapiens
TLPCALWTA

SEQ ID NO: 1107408 - protein, 9 aa, Homo Sapiens
RLNKCSFFM

SEQ ID NO: 1107409 - protein, 9 aa, Homo Sapiens
VIGTEKENT

SEQ ID NO: 1107410 - protein, 9 aa, Homo Sapiens
FESPLGGSG

SEQ ID NO: 1107411 - protein, 9 aa, Homo Sapiens
IMTRASHRT

SEQ ID NO: 1107412 - protein, 9 aa, Homo Sapiens
SSAGSSWTP

SEQ ID NO: 1107413 - protein, 9 aa, Homo Sapiens
AAALALDVA

SEQ ID NO: 1107414 - protein, 9 aa, Homo Sapiens
SPSCSPSPK

SEQ ID NO: 1107415 - protein, 9 aa, Homo Sapiens
LRKLQSADE

SEQ ID NO: 1107416 - protein, 9 aa, Homo Sapiens
VLIKPETQN

SEQ ID NO: 1107417 - protein, 9 aa, Homo Sapiens
IIPANVWML

SEQ ID NO: 1107418 - protein, 9 aa, Homo Sapiens
LPRVLRRVL

SEQ ID NO: 1107419 - protein, 9 aa, Homo Sapiens
TMGTVQRWG

SEQ ID NO: 1107420 - protein, 9 aa, Homo Sapiens
VSKKRLPKL

SEQ ID NO: 1107421 - protein, 9 aa, Homo Sapiens
ISDCTEIII

SEQ ID NO: 1107422 - protein, 9 aa, Homo Sapiens
LSLLRLLQL

SEQ ID NO: 1107423 - protein, 9 aa, Homo Sapiens
QVKKRKKRE

SEQ ID NO: 1107424 - protein, 9 aa, Homo Sapiens
QGAGSPTLG

SEQ ID NO: 1107425 - protein, 9 aa, Homo Sapiens
RKRRIYQHL

SEQ ID NO: 1107426 - protein, 9 aa, Homo Sapiens
LRILEQKFM

SEQ ID NO: 1107427 - protein, 9 aa, Homo Sapiens
PRVDALKNH

SEQ ID NO: 1107428 - protein, 9 aa, Homo Sapiens
ALQEIQNSL

SEQ ID NO: 1107429 - protein, 9 aa, Homo Sapiens
HPINYCETG

SEQ ID NO: 1107430 - protein, 9 aa, Homo Sapiens
GILGLIGLY

SEQ ID NO: 1107431 - protein, 9 aa, Homo Sapiens
AAAAAAATV

SEQ ID NO: 1107432 - protein, 9 aa, Homo Sapiens
ELRRPARDE

SEQ ID NO: 1107433 - protein, 9 aa, Homo Sapiens
GVQPPAPGV

SEQ ID NO: 1107434 - protein, 9 aa, Homo Sapiens
ELFKVLGVN

SEQ ID NO: 1107435 - protein, 9 aa, Homo Sapiens
TIWFKSYRM

SEQ ID NO: 1107436 - protein, 9 aa, Homo Sapiens
LPWAGAPAT

SEQ ID NO: 1107437 - protein, 9 aa, Homo Sapiens
SPRGRSVPP

SEQ ID NO: 1107438 - protein, 9 aa, Homo Sapiens
EKRPAKQPL

SEQ ID NO: 1107439 - protein, 9 aa, Homo Sapiens
SPKIEVAKM

SEQ ID NO: 1107440 - protein, 9 aa, Homo Sapiens
TVLCIWCFF

SEQ ID NO: 1107441 - protein, 9 aa, Homo Sapiens
RPAARRGGI

SEQ ID NO: 1107442 - protein, 9 aa, Homo Sapiens
LSTPEEQGE

SEQ ID NO: 1107443 - protein, 9 aa, Homo Sapiens
RTSVTASLS

SEQ ID NO: 1107444 - protein, 9 aa, Homo Sapiens
LGEPWRAGF

SEQ ID NO: 1107445 - protein, 9 aa, Homo Sapiens
NLRPLSLQC

SEQ ID NO: 1107446 - protein, 9 aa, Homo Sapiens
VADVPPLCL

SEQ ID NO: 1107447 - protein, 9 aa, Homo Sapiens
TRGYGGNAP

SEQ ID NO: 1107448 - protein, 9 aa, Homo Sapiens
GGDWVWDGY

SEQ ID NO: 1107449 - protein, 9 aa, Homo Sapiens
SGEPWDTER

SEQ ID NO: 1107450 - protein, 9 aa, Homo Sapiens
TVERVLAGT

SEQ ID NO: 1107451 - protein, 9 aa, Homo Sapiens
SADIKVIMV

SEQ ID NO: 1107452 - protein, 9 aa, Homo Sapiens
SGMGAAGRY

SEQ ID NO: 1107453 - protein, 9 aa, Homo Sapiens
TGWEAAELE

SEQ ID NO: 1107454 - protein, 9 aa, Homo Sapiens
STGSQEQKL

SEQ ID NO: 1107455 - protein, 9 aa, Homo Sapiens
VSVQGPGIL

SEQ ID NO: 1107456 - protein, 9 aa, Homo Sapiens
QDDTGADDW

SEQ ID NO: 1107457 - protein, 9 aa, Homo Sapiens
THHSLFLHV

SEQ ID NO: 1107458 - protein, 9 aa, Homo Sapiens
TPERERGSV

SEQ ID NO: 1107459 - protein, 9 aa, Homo Sapiens
DRILEGNPA

SEQ ID NO: 1107460 - protein, 9 aa, Homo Sapiens
LMVARRTQL

SEQ ID NO: 1107461 - protein, 9 aa, Homo Sapiens
PLHPVPRAR

SEQ ID NO: 1107462 - protein, 9 aa, Homo Sapiens
FYQGPGWEE

SEQ ID NO: 1107463 - protein, 9 aa, Homo Sapiens
NFFYQERAN

SEQ ID NO: 1107464 - protein, 9 aa, Homo Sapiens
SQQSIRNSQ

SEQ ID NO: 1107465 - protein, 9 aa, Homo Sapiens
ELRQIKIIE

SEQ ID NO: 1107466 - protein, 9 aa, Homo Sapiens
LTHSLGGGD

SEQ ID NO: 1107467 - protein, 9 aa, Homo Sapiens
LGSPLLSGA

SEQ ID NO: 1107468 - protein, 9 aa, Homo Sapiens
LRLLCPPVP

SEQ ID NO: 1107469 - protein, 9 aa, Homo Sapiens
RCQECQKKV

SEQ ID NO: 1107470 - protein, 9 aa, Homo Sapiens
SSPSPSPSQ

SEQ ID NO: 1107471 - protein, 9 aa, Homo Sapiens
GTVLQEAVA

SEQ ID NO: 1107472 - protein, 9 aa, Homo Sapiens
PTFLQSKYG

SEQ ID NO: 1107473 - protein, 9 aa, Homo Sapiens
GNNYDTASG

SEQ ID NO: 1107474 - protein, 9 aa, Homo Sapiens
RAPASPGRR

SEQ ID NO: 1107475 - protein, 9 aa, Homo Sapiens
CRHSVPEAE

SEQ ID NO: 1107476 - protein, 9 aa, Homo Sapiens
WFQVDFGNR

SEQ ID NO: 1107477 - protein, 9 aa, Homo Sapiens
VEALGRAAQ

SEQ ID NO: 1107478 - protein, 9 aa, Homo Sapiens
ASQSSLLEM

SEQ ID NO: 1107479 - protein, 9 aa, Homo Sapiens
KKTQNRTGR

SEQ ID NO: 1107480 - protein, 9 aa, Homo Sapiens
AGAVAPTAT

SEQ ID NO: 1107481 - protein, 9 aa, Homo Sapiens
ITLWNPSRR

SEQ ID NO: 1107482 - protein, 9 aa, Homo Sapiens
WWPASGRRR

SEQ ID NO: 1107483 - protein, 9 aa, Homo Sapiens
QPKPWQQQP

SEQ ID NO: 1107484 - protein, 9 aa, Homo Sapiens
GVLEDIKAC

SEQ ID NO: 1107485 - protein, 9 aa, Homo Sapiens
MDAHTDTTD

SEQ ID NO: 1107486 - protein, 9 aa, Homo Sapiens
HKQNYMMNF

SEQ ID NO: 1107487 - protein, 9 aa, Homo Sapiens
TVWSRVVVM

SEQ ID NO: 1107488 - protein, 9 aa, Homo Sapiens
QVWTAATLR

SEQ ID NO: 1107489 - protein, 9 aa, Homo Sapiens
GKSCCQPVR

SEQ ID NO: 1107490 - protein, 9 aa, Homo Sapiens
QSLSLQQWK

SEQ ID NO: 1107491 - protein, 9 aa, Homo Sapiens
SNSGKGARR

SEQ ID NO: 1107492 - protein, 9 aa, Homo Sapiens
QTPLLSSLS

SEQ ID NO: 1107493 - protein, 9 aa, Homo Sapiens
RGHHRMGAA

SEQ ID NO: 1107494 - protein, 9 aa, Homo Sapiens
QLKRAKKTI

SEQ ID NO: 1107495 - protein, 9 aa, Homo Sapiens
GFFLRLGVI

SEQ ID NO: 1107496 - protein, 9 aa, Homo Sapiens
YSLRVALHS

SEQ ID NO: 1107497 - protein, 9 aa, Homo Sapiens
NTTVRLHTP

SEQ ID NO: 1107498 - protein, 9 aa, Homo Sapiens
AWARAHLAV

SEQ ID NO: 1107499 - protein, 9 aa, Homo Sapiens
AQAAQLPVV

SEQ ID NO: 1107500 - protein, 9 aa, Homo Sapiens
AALAGAHAA

SEQ ID NO: 1107501 - protein, 9 aa, Homo Sapiens
TNPCTIAAP

SEQ ID NO: 1107502 - protein, 9 aa, Homo Sapiens
TRSSSRTAC

SEQ ID NO: 1107503 - protein, 9 aa, Homo Sapiens
DSVDEIAYH

SEQ ID NO: 1107504 - protein, 9 aa, Homo Sapiens
KPRRRKKEA

SEQ ID NO: 1107505 - protein, 9 aa, Homo Sapiens
SRKFGWQMR

SEQ ID NO: 1107506 - protein, 9 aa, Homo Sapiens
QPGSTGSRK

SEQ ID NO: 1107507 - protein, 9 aa, Homo Sapiens
SYLLTCLES

SEQ ID NO: 1107508 - protein, 9 aa, Homo Sapiens
TPGQPRGLV

SEQ ID NO: 1107509 - protein, 9 aa, Homo Sapiens
NRGLPLPPP

SEQ ID NO: 1107510 - protein, 9 aa, Homo Sapiens
SATSQTPGR

SEQ ID NO: 1107511 - protein, 9 aa, Homo Sapiens
VGLLWFTHH

SEQ ID NO: 1107512 - protein, 9 aa, Homo Sapiens
RNLNLQKSS

SEQ ID NO: 1107513 - protein, 9 aa, Homo Sapiens
PHRAAVLRA

SEQ ID NO: 1107514 - protein, 9 aa, Homo Sapiens
ILRELKYIH

SEQ ID NO: 1107515 - protein, 9 aa, Homo Sapiens
VLGQPGVRA

SEQ ID NO: 1107516 - protein, 9 aa, Homo Sapiens
VWASVAAQQ

SEQ ID NO: 1107517 - protein, 9 aa, Homo Sapiens
THLRPVPRI

SEQ ID NO: 1107518 - protein, 9 aa, Homo Sapiens
SVHQYSVHP

SEQ ID NO: 1107519 - protein, 9 aa, Homo Sapiens
TQSLNYSCI

SEQ ID NO: 1107520 - protein, 9 aa, Homo Sapiens
KSKVSSSLG

SEQ ID NO: 1107521 - protein, 9 aa, Homo Sapiens
ASAVNVNDK

SEQ ID NO: 1107522 - protein, 9 aa, Homo Sapiens
LKNPNLIQV

SEQ ID NO: 1107523 - protein, 9 aa, Homo Sapiens
SELSFAPPR

SEQ ID NO: 1107524 - protein, 9 aa, Homo Sapiens
QLTVKRHGL

SEQ ID NO: 1107525 - protein, 9 aa, Homo Sapiens
DKGATYTPR

SEQ ID NO: 1107526 - protein, 9 aa, Homo Sapiens
VPRQLPGPH

SEQ ID NO: 1107527 - protein, 9 aa, Homo Sapiens
PPSQPPSPS

SEQ ID NO: 1107528 - protein, 9 aa, Homo Sapiens
LGNNYDTAS

SEQ ID NO: 1107529 - protein, 9 aa, Homo Sapiens
AKMNQQHGR

SEQ ID NO: 1107530 - protein, 9 aa, Homo Sapiens
FFCNAAKKD

SEQ ID NO: 1107531 - protein, 9 aa, Homo Sapiens
TPGQARAAQ

SEQ ID NO: 1107532 - protein, 9 aa, Homo Sapiens
LSGKKGEGK

SEQ ID NO: 1107533 - protein, 9 aa, Homo Sapiens
PCTACHLNP

SEQ ID NO: 1107534 - protein, 9 aa, Homo Sapiens
QLSGVKKPI

SEQ ID NO: 1107535 - protein, 9 aa, Homo Sapiens
DWPGDHQES

SEQ ID NO: 1107536 - protein, 9 aa, Homo Sapiens
LWYSVALVL

SEQ ID NO: 1107537 - protein, 9 aa, Homo Sapiens
SLALHTDKT

SEQ ID NO: 1107538 - protein, 9 aa, Homo Sapiens
VTMCISACP

SEQ ID NO: 1107539 - protein, 9 aa, Homo Sapiens
IACITCTDV

SEQ ID NO: 1107540 - protein, 9 aa, Homo Sapiens
VVLTHKQNY

SEQ ID NO: 1107541 - protein, 9 aa, Homo Sapiens
NVLDDQSRG

SEQ ID NO: 1107542 - protein, 9 aa, Homo Sapiens
LVRLKKNRS

SEQ ID NO: 1107543 - protein, 9 aa, Homo Sapiens
VLPDHRKFQ

SEQ ID NO: 1107544 - protein, 9 aa, Homo Sapiens
PDYSLRVAL

SEQ ID NO: 1107545 - protein, 9 aa, Homo Sapiens
PIQQLVWPD

SEQ ID NO: 1107546 - protein, 9 aa, Homo Sapiens
VWAVLAWAR

SEQ ID NO: 1107547 - protein, 9 aa, Homo Sapiens
FTAVLSPVN

SEQ ID NO: 1107548 - protein, 9 aa, Homo Sapiens
GLLWFTHHS

SEQ ID NO: 1107549 - protein, 9 aa, Homo Sapiens
KAAFKRKAK

SEQ ID NO: 1107550 - protein, 9 aa, Homo Sapiens
SRRWRTACV

SEQ ID NO: 1107551 - protein, 9 aa, Homo Sapiens
LDRLLYVVA

SEQ ID NO: 1107552 - protein, 9 aa, Homo Sapiens
VRTPSISPV

SEQ ID NO: 1107553 - protein, 9 aa, Homo Sapiens
DHVLLKYTE

SEQ ID NO: 1107554 - protein, 9 aa, Homo Sapiens
PRSRGTRRY

SEQ ID NO: 1107555 - protein, 9 aa, Homo Sapiens
QHPINYCET

SEQ ID NO: 1107556 - protein, 9 aa, Homo Sapiens
SAWGSASCF

SEQ ID NO: 1107557 - protein, 9 aa, Homo Sapiens
RQDPPSSRC

SEQ ID NO: 1107558 - protein, 9 aa, Homo Sapiens
DVLMVTESS

SEQ ID NO: 1107559 - protein, 9 aa, Homo Sapiens
GSRSLWPPQ

SEQ ID NO: 1107560 - protein, 9 aa, Homo Sapiens
ARGRTGAVT

SEQ ID NO: 1107561 - protein, 9 aa, Homo Sapiens
DAHVVLEVV

SEQ ID NO: 1107562 - protein, 9 aa, Homo Sapiens
RALFALYMS

SEQ ID NO: 1107563 - protein, 9 aa, Homo Sapiens
VCRESERDY

SEQ ID NO: 1107564 - protein, 9 aa, Homo Sapiens
QQQQQHQQH

SEQ ID NO: 1107565 - protein, 9 aa, Homo Sapiens
AYGHGLVSI

SEQ ID NO: 1107566 - protein, 9 aa, Homo Sapiens
TNLGNNYDT

SEQ ID NO: 1107567 - protein, 9 aa, Homo Sapiens
QLAVDKGYW

SEQ ID NO: 1107568 - protein, 9 aa, Homo Sapiens
EPPMPPPAN

SEQ ID NO: 1107569 - protein, 9 aa, Homo Sapiens
APAPWLPMR

SEQ ID NO: 1107570 - protein, 9 aa, Homo Sapiens
FLLTSASPM

SEQ ID NO: 1107571 - protein, 9 aa, Homo Sapiens
GIQPAGPGR

SEQ ID NO: 1107572 - protein, 9 aa, Homo Sapiens
WGCWPSTSA

SEQ ID NO: 1107573 - protein, 9 aa, Homo Sapiens
ALQSPGPRG

SEQ ID NO: 1107574 - protein, 9 aa, Homo Sapiens
TAGPIGIPG

SEQ ID NO: 1107575 - protein, 9 aa, Homo Sapiens
GCHLFPRVL

SEQ ID NO: 1107576 - protein, 9 aa, Homo Sapiens
LLYADWPGD

SEQ ID NO: 1107577 - protein, 9 aa, Homo Sapiens
SLPPDRPCS

SEQ ID NO: 1107578 - protein, 9 aa, Homo Sapiens
MKNSVVDRD

SEQ ID NO: 1107579 - protein, 9 aa, Homo Sapiens
PPAPGVQPP

SEQ ID NO: 1107580 - protein, 9 aa, Homo Sapiens
PYVLLRNAH

SEQ ID NO: 1107581 - protein, 9 aa, Homo Sapiens
GAARARTCS

SEQ ID NO: 1107582 - protein, 9 aa, Homo Sapiens
SPLLSGARG

SEQ ID NO: 1107583 - protein, 9 aa, Homo Sapiens
RASCASPPC

SEQ ID NO: 1107584 - protein, 9 aa, Homo Sapiens
MHLIHARKG

SEQ ID NO: 1107585 - protein, 9 aa, Homo Sapiens
SSVIPHLFL

SEQ ID NO: 1107586 - protein, 9 aa, Homo Sapiens
YTVERVLAG

SEQ ID NO: 1107587 - protein, 9 aa, Homo Sapiens
VGTKCYMPP

SEQ ID NO: 1107588 - protein, 9 aa, Homo Sapiens
YKYEQIDGG

SEQ ID NO: 1107589 - protein, 9 aa, Homo Sapiens
ASSAGSSWT

SEQ ID NO: 1107590 - protein, 9 aa, Homo Sapiens
NLTLYGSMQ

SEQ ID NO: 1107591 - protein, 9 aa, Homo Sapiens
WTRAFEENR

SEQ ID NO: 1107592 - protein, 9 aa, Homo Sapiens
QVGVIQCPV

SEQ ID NO: 1107593 - protein, 9 aa, Homo Sapiens
HTDYTWSFD

SEQ ID NO: 1107594 - protein, 9 aa, Homo Sapiens
SSSVLTAEG

SEQ ID NO: 1107595 - protein, 9 aa, Homo Sapiens
PMLQLPGCL

SEQ ID NO: 1107596 - protein, 9 aa, Homo Sapiens
YECEKCGKV

SEQ ID NO: 1107597 - protein, 9 aa, Homo Sapiens
AAVAVAVAA

SEQ ID NO: 1107598 - protein, 9 aa, Homo Sapiens
EIAYHTSVQ

SEQ ID NO: 1107599 - protein, 9 aa, Homo Sapiens
PAPAPWLPM

SEQ ID NO: 1107600 - protein, 9 aa, Homo Sapiens
SRSSHTGYH

SEQ ID NO: 1107601 - protein, 9 aa, Homo Sapiens
KNRSYLCNE

SEQ ID NO: 1107602 - protein, 9 aa, Homo Sapiens
WDTERNLRP

SEQ ID NO: 1107603 - protein, 9 aa, Homo Sapiens
VAEKIGEDY

SEQ ID NO: 1107604 - protein, 9 aa, Homo Sapiens
SWTPGRRGG

SEQ ID NO: 1107605 - protein, 9 aa, Homo Sapiens
DPTPQSPSW

SEQ ID NO: 1107606 - protein, 9 aa, Homo Sapiens
LIMTRELCM

SEQ ID NO: 1107607 - protein, 9 aa, Homo Sapiens
IINPTISCP

SEQ ID NO: 1107608 - protein, 9 aa, Homo Sapiens
RDSATKGFS

SEQ ID NO: 1107609 - protein, 9 aa, Homo Sapiens
VTSKDFSHR

SEQ ID NO: 1107610 - protein, 9 aa, Homo Sapiens
AGGRAAPAQ

SEQ ID NO: 1107611 - protein, 9 aa, Homo Sapiens
CSLYGKKLV

SEQ ID NO: 1107612 - protein, 9 aa, Homo Sapiens
RVPLAPLGP

SEQ ID NO: 1107613 - protein, 9 aa, Homo Sapiens
RARGSHIWP

SEQ ID NO: 1107614 - protein, 9 aa, Homo Sapiens
TANSQELKC

SEQ ID NO: 1107615 - protein, 9 aa, Homo Sapiens
IKGKIRAGG

SEQ ID NO: 1107616 - protein, 9 aa, Homo Sapiens
FIISQPGPS

SEQ ID NO: 1107617 - protein, 9 aa, Homo Sapiens
DLFQVRGPH

SEQ ID NO: 1107618 - protein, 9 aa, Homo Sapiens
NSVVDRDNS

SEQ ID NO: 1107619 - protein, 9 aa, Homo Sapiens
NCLLCRRGI

SEQ ID NO: 1107620 - protein, 9 aa, Homo Sapiens
IISVADKAL

SEQ ID NO: 1107621 - protein, 9 aa, Homo Sapiens
QPASQTPAG

SEQ ID NO: 1107622 - protein, 9 aa, Homo Sapiens
FPTYDGKDQ

SEQ ID NO: 1107623 - protein, 9 aa, Homo Sapiens
IIISDTKDY

SEQ ID NO: 1107624 - protein, 9 aa, Homo Sapiens
LCTRPPLLT

SEQ ID NO: 1107625 - protein, 9 aa, Homo Sapiens
TLQNTRNPI

SEQ ID NO: 1107626 - protein, 9 aa, Homo Sapiens
RLKKNRSYL

SEQ ID NO: 1107627 - protein, 9 aa, Homo Sapiens
PTAKFQELW

SEQ ID NO: 1107628 - protein, 9 aa, Homo Sapiens
FWELIPTRS

SEQ ID NO: 1107629 - protein, 9 aa, Homo Sapiens
TANTVPTAI

SEQ ID NO: 1107630 - protein, 9 aa, Homo Sapiens
HDQKECVYE

SEQ ID NO: 1107631 - protein, 9 aa, Homo Sapiens
MLMTALSYP

SEQ ID NO: 1107632 - protein, 9 aa, Homo Sapiens
ASQVGGTQE

SEQ ID NO: 1107633 - protein, 9 aa, Homo Sapiens
MNLPLMIKN

SEQ ID NO: 1107634 - protein, 9 aa, Homo Sapiens
KKPRLEDHQ

SEQ ID NO: 1107635 - protein, 9 aa, Homo Sapiens
YTSKINIAK

SEQ ID NO: 1107636 - protein, 9 aa, Homo Sapiens
PPLIPLLGD

SEQ ID NO: 1107637 - protein, 9 aa, Homo Sapiens
MVLQWRKFL

SEQ ID NO: 1107638 - protein, 9 aa, Homo Sapiens
TTHKRIRTA

SEQ ID NO: 1107639 - protein, 9 aa, Homo Sapiens
FQSPPQPPS

SEQ ID NO: 1107640 - protein, 9 aa, Homo Sapiens
VWCEGEHPR

SEQ ID NO: 1107641 - protein, 9 aa, Homo Sapiens
LQSDKECTS

SEQ ID NO: 1107642 - protein, 9 aa, Homo Sapiens
GYSTVAITL

SEQ ID NO: 1107643 - protein, 9 aa, Homo Sapiens
ESVQRPWEK

SEQ ID NO: 1107644 - protein, 9 aa, Homo Sapiens
IRDIRHVTS

SEQ ID NO: 1107645 - protein, 9 aa, Homo Sapiens
AGDGKASTG

SEQ ID NO: 1107646 - protein, 9 aa, Homo Sapiens
SFWPGGYPA

SEQ ID NO: 1107647 - protein, 9 aa, Homo Sapiens
PVRMPACMS

SEQ ID NO: 1107648 - protein, 9 aa, Homo Sapiens
RFGNQQRTG

SEQ ID NO: 1107649 - protein, 9 aa, Homo Sapiens
LREWFMECL

SEQ ID NO: 1107650 - protein, 9 aa, Homo Sapiens
EQAAPQSQE

SEQ ID NO: 1107651 - protein, 9 aa, Homo Sapiens
SRVCNGLEQ

SEQ ID NO: 1107652 - protein, 9 aa, Homo Sapiens
GVSPLAPCP

SEQ ID NO: 1107653 - protein, 9 aa, Homo Sapiens
IALTISPFS

SEQ ID NO: 1107654 - protein, 9 aa, Homo Sapiens
TRVATVDAD

SEQ ID NO: 1107655 - protein, 9 aa, Homo Sapiens
TAQPKTAGA

SEQ ID NO: 1107656 - protein, 9 aa, Homo Sapiens
KATTPIFFD

SEQ ID NO: 1107657 - protein, 9 aa, Homo Sapiens
ASGVGEEIA

SEQ ID NO: 1107658 - protein, 9 aa, Homo Sapiens
PEACAPGQG

SEQ ID NO: 1107659 - protein, 9 aa, Homo Sapiens
IQKKKVPTK

SEQ ID NO: 1107660 - protein, 9 aa, Homo Sapiens
WVMGIILYE

SEQ ID NO: 1107661 - protein, 9 aa, Homo Sapiens
GPGAAAAWR

SEQ ID NO: 1107662 - protein, 9 aa, Homo Sapiens
QDPRTAPRR

SEQ ID NO: 1107663 - protein, 9 aa, Homo Sapiens
RCKLSPPSY

SEQ ID NO: 1107664 - protein, 9 aa, Homo Sapiens
GPLFLLFFS

SEQ ID NO: 1107665 - protein, 9 aa, Homo Sapiens
REYHLVLAV

SEQ ID NO: 1107666 - protein, 9 aa, Homo Sapiens
VVVNIFIMA

SEQ ID NO: 1107667 - protein, 9 aa, Homo Sapiens
SQPGPSSPA

SEQ ID NO: 1107668 - protein, 9 aa, Homo Sapiens
VYRDCQSER

SEQ ID NO: 1107669 - protein, 9 aa, Homo Sapiens
FFLVVSCWL

SEQ ID NO: 1107670 - protein, 9 aa, Homo Sapiens
GFPSWQYQH

SEQ ID NO: 1107671 - protein, 9 aa, Homo Sapiens
PAGWVLLPR

SEQ ID NO: 1107672 - protein, 9 aa, Homo Sapiens
SGVSSSVGT

SEQ ID NO: 1107673 - protein, 9 aa, Homo Sapiens
ALYMTVLEQ

SEQ ID NO: 1107674 - protein, 9 aa, Homo Sapiens
RKEHRDHDS

SEQ ID NO: 1107675 - protein, 9 aa, Homo Sapiens
IGAGRPIKR

SEQ ID NO: 1107676 - protein, 9 aa, Homo Sapiens
QQEQERERS

SEQ ID NO: 1107677 - protein, 9 aa, Homo Sapiens
ELIQKKKVP

SEQ ID NO: 1107678 - protein, 9 aa, Homo Sapiens
HAGASLFLH

SEQ ID NO: 1107679 - protein, 9 aa, Homo Sapiens
LWGERNSSK

SEQ ID NO: 1107680 - protein, 9 aa, Homo Sapiens
LEMSFCLFM

SEQ ID NO: 1107681 - protein, 9 aa, Homo Sapiens
RPPTLWTLC

SEQ ID NO: 1107682 - protein, 9 aa, Homo Sapiens
WTKVWTASG

SEQ ID NO: 1107683 - protein, 9 aa, Homo Sapiens
RPGPRGGHP

SEQ ID NO: 1107684 - protein, 9 aa, Homo Sapiens
HKRQKAMHV

SEQ ID NO: 1107685 - protein, 9 aa, Homo Sapiens
ICVNCCWPM

SEQ ID NO: 1107686 - protein, 9 aa, Homo Sapiens
ICSKLSSAL

SEQ ID NO: 1107687 - protein, 9 aa, Homo Sapiens
WRANVGAAE

SEQ ID NO: 1107688 - protein, 9 aa, Homo Sapiens
RSDLLEECL

SEQ ID NO: 1107689 - protein, 9 aa, Homo Sapiens
LGLRQQHNA

SEQ ID NO: 1107690 - protein, 9 aa, Homo Sapiens
WCWRDKKQC

SEQ ID NO: 1107691 - protein, 9 aa, Homo Sapiens
VEELTAKEV

SEQ ID NO: 1107692 - protein, 9 aa, Homo Sapiens
NQDLYRMKS

SEQ ID NO: 1107693 - protein, 9 aa, Homo Sapiens
TTRYFQSRG

SEQ ID NO: 1107694 - protein, 9 aa, Homo Sapiens
TKEETRASL

SEQ ID NO: 1107695 - protein, 9 aa, Homo Sapiens
VGKCRSADI

SEQ ID NO: 1107696 - protein, 9 aa, Homo Sapiens
CWVGPGLDG

SEQ ID NO: 1107697 - protein, 9 aa, Homo Sapiens
WDIIASNGL

SEQ ID NO: 1107698 - protein, 9 aa, Homo Sapiens
LSCWTWMTW

SEQ ID NO: 1107699 - protein, 9 aa, Homo Sapiens
FEMGTNFSG

SEQ ID NO: 1107700 - protein, 9 aa, Homo Sapiens
KLSVTFCQQ

SEQ ID NO: 1107701 - protein, 9 aa, Homo Sapiens
HNFEIDTEG

SEQ ID NO: 1107702 - protein, 9 aa, Homo Sapiens
LIMWDPDHY

SEQ ID NO: 1107703 - protein, 9 aa, Homo Sapiens
YGYSTVAIT

SEQ ID NO: 1107704 - protein, 9 aa, Homo Sapiens
NGGGGDSAT

SEQ ID NO: 1107705 - protein, 9 aa, Homo Sapiens
TSNMDLTFI

SEQ ID NO: 1107706 - protein, 9 aa, Homo Sapiens
YLSHLSRLW

SEQ ID NO: 1107707 - protein, 9 aa, Homo Sapiens
ISKVGIHKL

SEQ ID NO: 1107708 - protein, 9 aa, Homo Sapiens
MNKKHEAEF

SEQ ID NO: 1107709 - protein, 9 aa, Homo Sapiens
LLDTQQEAV

SEQ ID NO: 1107710 - protein, 9 aa, Homo Sapiens
CPPTPQNQL

SEQ ID NO: 1107711 - protein, 9 aa, Homo Sapiens
ILVITALGR

SEQ ID NO: 1107712 - protein, 9 aa, Homo Sapiens
GGRQLRVPD

SEQ ID NO: 1107713 - protein, 9 aa, Homo Sapiens
PTYDGKDQV

SEQ ID NO: 1107714 - protein, 9 aa, Homo Sapiens
HRVNAKMPV

SEQ ID NO: 1107715 - protein, 9 aa, Homo Sapiens
RALGKWLQW

SEQ ID NO: 1107716 - protein, 9 aa, Homo Sapiens
RLLLGVCGH

SEQ ID NO: 1107717 - protein, 9 aa, Homo Sapiens
EKCPLGMAP

SEQ ID NO: 1107718 - protein, 9 aa, Homo Sapiens
TLSVLGVTC

SEQ ID NO: 1107719 - protein, 9 aa, Homo Sapiens
ASAGAGAAI

SEQ ID NO: 1107720 - protein, 9 aa, Homo Sapiens
LAPCPPLEV

SEQ ID NO: 1107721 - protein, 9 aa, Homo Sapiens
GGHLMSDLL

SEQ ID NO: 1107722 - protein, 9 aa, Homo Sapiens
PMPPPANPQ

SEQ ID NO: 1107723 - protein, 9 aa, Homo Sapiens
PLHHTSIPR

SEQ ID NO: 1107724 - protein, 9 aa, Homo Sapiens
HRVPLAPLG

SEQ ID NO: 1107725 - protein, 9 aa, Homo Sapiens
LFAHLGKYI

SEQ ID NO: 1107726 - protein, 9 aa, Homo Sapiens
DAPGRGEGS

SEQ ID NO: 1107727 - protein, 9 aa, Homo Sapiens
PDAHITKKQ

SEQ ID NO: 1107728 - protein, 9 aa, Homo Sapiens
PPPPGWLPR

SEQ ID NO: 1107729 - protein, 9 aa, Homo Sapiens
LTYIWSAVT

SEQ ID NO: 1107730 - protein, 9 aa, Homo Sapiens
SAVLLDMAF

SEQ ID NO: 1107731 - protein, 9 aa, Homo Sapiens
NNLFSTLEE

SEQ ID NO: 1107732 - protein, 9 aa, Homo Sapiens
HLEEAFISE

SEQ ID NO: 1107733 - protein, 9 aa, Homo Sapiens
MILVITALG

SEQ ID NO: 1107734 - protein, 9 aa, Homo Sapiens
EIRRRIRIL

SEQ ID NO: 1107735 - protein, 9 aa, Homo Sapiens
VIGSPQRRG

SEQ ID NO: 1107736 - protein, 9 aa, Homo Sapiens
QLKALDPMM

SEQ ID NO: 1107737 - protein, 9 aa, Homo Sapiens
QSSLKQKLQ

SEQ ID NO: 1107738 - protein, 9 aa, Homo Sapiens
RENGSQAML

SEQ ID NO: 1107739 - protein, 9 aa, Homo Sapiens
HQLMRTRPP

SEQ ID NO: 1107740 - protein, 9 aa, Homo Sapiens
VQIEMNKKH

SEQ ID NO: 1107741 - protein, 9 aa, Homo Sapiens
SAESNRGVP

SEQ ID NO: 1107742 - protein, 9 aa, Homo Sapiens
SLSGLTDSA

SEQ ID NO: 1107743 - protein, 9 aa, Homo Sapiens
AGAVKVNNS

SEQ ID NO: 1107744 - protein, 9 aa, Homo Sapiens
RLWAAVAAG

SEQ ID NO: 1107745 - protein, 9 aa, Homo Sapiens
LYGSMQAHG

SEQ ID NO: 1107746 - protein, 9 aa, Homo Sapiens
CLWEKDYQV

SEQ ID NO: 1107747 - protein, 9 aa, Homo Sapiens
SPLVRAPNV

SEQ ID NO: 1107748 - protein, 9 aa, Homo Sapiens
RSLELCNTF

SEQ ID NO: 1107749 - protein, 9 aa, Homo Sapiens
EEEYLERYF

SEQ ID NO: 1107750 - protein, 9 aa, Homo Sapiens
GVIQCPVCR

SEQ ID NO: 1107751 - protein, 9 aa, Homo Sapiens
LLWFTHHSL

SEQ ID NO: 1107752 - protein, 9 aa, Homo Sapiens
PGRLCAPGA

SEQ ID NO: 1107753 - protein, 9 aa, Homo Sapiens
ILVKNHVKN

SEQ ID NO: 1107754 - protein, 9 aa, Homo Sapiens
LEVFDGRDT

SEQ ID NO: 1107755 - protein, 9 aa, Homo Sapiens
KCYMPPEVL

SEQ ID NO: 1107756 - protein, 9 aa, Homo Sapiens
EGTRWPGPF

SEQ ID NO: 1107757 - protein, 9 aa, Homo Sapiens
GSSLACGAL

SEQ ID NO: 1107758 - protein, 9 aa, Homo Sapiens
AFALPNSLL

SEQ ID NO: 1107759 - protein, 9 aa, Homo Sapiens
GASRHCWEV

SEQ ID NO: 1107760 - protein, 9 aa, Homo Sapiens
PRGAWAAAA

SEQ ID NO: 1107761 - protein, 9 aa, Homo Sapiens
SPSRKRRRG

SEQ ID NO: 1107762 - protein, 9 aa, Homo Sapiens
VHLMNISVS

SEQ ID NO: 1107763 - protein, 9 aa, Homo Sapiens
DLLEAGKRG

SEQ ID NO: 1107764 - protein, 9 aa, Homo Sapiens
QAQHPPEGT

SEQ ID NO: 1107765 - protein, 9 aa, Homo Sapiens
PVAALFTPP

SEQ ID NO: 1107766 - protein, 9 aa, Homo Sapiens
HGKFYETDC

SEQ ID NO: 1107767 - protein, 9 aa, Homo Sapiens
WVPGHEDGV

SEQ ID NO: 1107768 - protein, 9 aa, Homo Sapiens
LLGATVKEK

SEQ ID NO: 1107769 - protein, 9 aa, Homo Sapiens
SPPARSWSA

SEQ ID NO: 1107770 - protein, 9 aa, Homo Sapiens
HERWHIRSS

SEQ ID NO: 1107771 - protein, 9 aa, Homo Sapiens
DFVCIFVYK

SEQ ID NO: 1107772 - protein, 9 aa, Homo Sapiens
PASVQSKDF

SEQ ID NO: 1107773 - protein, 9 aa, Homo Sapiens
KTSLKASRM

SEQ ID NO: 1107774 - protein, 9 aa, Homo Sapiens
YLVVCNNCN

SEQ ID NO: 1107775 - protein, 9 aa, Homo Sapiens
CLLLFIISQ

SEQ ID NO: 1107776 - protein, 9 aa, Homo Sapiens
EMSFCLFMT

SEQ ID NO: 1107777 - protein, 9 aa, Homo Sapiens
EEEQVWRAN

SEQ ID NO: 1107778 - protein, 9 aa, Homo Sapiens
NLSVAKAAT

SEQ ID NO: 1107779 - protein, 9 aa, Homo Sapiens
ARPPPTYPC

SEQ ID NO: 1107780 - protein, 9 aa, Homo Sapiens
PFCNHGKHS

SEQ ID NO: 1107781 - protein, 9 aa, Homo Sapiens
ELTRMMSPK

SEQ ID NO: 1107782 - protein, 9 aa, Homo Sapiens
GKHSTMKTV

SEQ ID NO: 1107783 - protein, 9 aa, Homo Sapiens
KEGPVRLRE

SEQ ID NO: 1107784 - protein, 9 aa, Homo Sapiens
VWTAATLRC

SEQ ID NO: 1107785 - protein, 9 aa, Homo Sapiens
ARLNKCSFF

SEQ ID NO: 1107786 - protein, 9 aa, Homo Sapiens
SRLPHQSPG

SEQ ID NO: 1107787 - protein, 9 aa, Homo Sapiens
LQDGSLDRN

SEQ ID NO: 1107788 - protein, 9 aa, Homo Sapiens
GEAGAHRSA

SEQ ID NO: 1107789 - protein, 9 aa, Homo Sapiens
EKGELLNPM

SEQ ID NO: 1107790 - protein, 9 aa, Homo Sapiens
AAAVTTAVL

SEQ ID NO: 1107791 - protein, 9 aa, Homo Sapiens
AAAAAGVAA

SEQ ID NO: 1107792 - protein, 9 aa, Homo Sapiens
IWPKGFEAQ

SEQ ID NO: 1107793 - protein, 9 aa, Homo Sapiens
GALKPAGPC

SEQ ID NO: 1107794 - protein, 9 aa, Homo Sapiens
MISASEDAT

SEQ ID NO: 1107795 - protein, 9 aa, Homo Sapiens
MGGNRSICL

SEQ ID NO: 1107796 - protein, 9 aa, Homo Sapiens
RGGLDLRMR

SEQ ID NO: 1107797 - protein, 9 aa, Homo Sapiens
VAVDAQVGP

SEQ ID NO: 1107798 - protein, 9 aa, Homo Sapiens
EALGSWGQT

SEQ ID NO: 1107799 - protein, 9 aa, Homo Sapiens
GDDSDFCES

SEQ ID NO: 1107800 - protein, 9 aa, Homo Sapiens
TTMRDFRMG

SEQ ID NO: 1107801 - protein, 9 aa, Homo Sapiens
RLQPASQTP

SEQ ID NO: 1107802 - protein, 9 aa, Homo Sapiens
DALKNHLVK

SEQ ID NO: 1107803 - protein, 9 aa, Homo Sapiens
WGSLSNYNS

SEQ ID NO: 1107804 - protein, 9 aa, Homo Sapiens
FHSKHGTMP

SEQ ID NO: 1107805 - protein, 9 aa, Homo Sapiens
SCCPRPRCR

SEQ ID NO: 1107806 - protein, 9 aa, Homo Sapiens
SYSVYITEN

SEQ ID NO: 1107807 - protein, 9 aa, Homo Sapiens
MIEIGTILL

SEQ ID NO: 1107808 - protein, 9 aa, Homo Sapiens
EEARHALET

SEQ ID NO: 1107809 - protein, 9 aa, Homo Sapiens
PHVDGERSF

SEQ ID NO: 1107810 - protein, 9 aa, Homo Sapiens
PVVREDLLL

SEQ ID NO: 1107811 - protein, 9 aa, Homo Sapiens
ASGTRPWLM

SEQ ID NO: 1107812 - protein, 9 aa, Homo Sapiens
RAGPKRAVP

SEQ ID NO: 1107813 - protein, 9 aa, Homo Sapiens
SRKRRRGSS

SEQ ID NO: 1107814 - protein, 9 aa, Homo Sapiens
SRQDPRSQK

SEQ ID NO: 1107815 - protein, 9 aa, Homo Sapiens
VGQGIRGTI

SEQ ID NO: 1107816 - protein, 9 aa, Homo Sapiens
ARTPALIPV

SEQ ID NO: 1107817 - protein, 9 aa, Homo Sapiens
ERILPECFL

SEQ ID NO: 1107818 - protein, 9 aa, Homo Sapiens
LLNGLLFKG

SEQ ID NO: 1107819 - protein, 9 aa, Homo Sapiens
LGYMEAFLG

SEQ ID NO: 1107820 - protein, 9 aa, Homo Sapiens
SATKGFSLL

SEQ ID NO: 1107821 - protein, 9 aa, Homo Sapiens
KLMAKTIRF

SEQ ID NO: 1107822 - protein, 9 aa, Homo Sapiens
CVQRGWTLG

SEQ ID NO: 1107823 - protein, 9 aa, Homo Sapiens
RPPSAGALK

SEQ ID NO: 1107824 - protein, 9 aa, Homo Sapiens
FHVYSELPK

SEQ ID NO: 1107825 - protein, 9 aa, Homo Sapiens
LTPYRDDCK

SEQ ID NO: 1107826 - protein, 9 aa, Homo Sapiens
RTCAQLPPA

SEQ ID NO: 1107827 - protein, 9 aa, Homo Sapiens
GARRVPSGG

SEQ ID NO: 1107828 - protein, 9 aa, Homo Sapiens
RSHAPQSCS

SEQ ID NO: 1107829 - protein, 9 aa, Homo Sapiens
WEAAELEPP

SEQ ID NO: 1107830 - protein, 9 aa, Homo Sapiens
NERYFFENE

SEQ ID NO: 1107831 - protein, 9 aa, Homo Sapiens
FILDQKVEI

SEQ ID NO: 1107832 - protein, 9 aa, Homo Sapiens
CAHCLGAEG

SEQ ID NO: 1107833 - protein, 9 aa, Homo Sapiens
STTLAWGIL

SEQ ID NO: 1107834 - protein, 9 aa, Homo Sapiens
GHEPFLQWL

SEQ ID NO: 1107835 - protein, 9 aa, Homo Sapiens
RMGLEESEL

SEQ ID NO: 1107836 - protein, 9 aa, Homo Sapiens
LPGPHDDFV

SEQ ID NO: 1107837 - protein, 9 aa, Homo Sapiens
AHVWLLPGM

SEQ ID NO: 1107838 - protein, 9 aa, Homo Sapiens
LHFAVTLFA

SEQ ID NO: 1107839 - protein, 9 aa, Homo Sapiens
ASILGIILI

SEQ ID NO: 1107840 - protein, 9 aa, Homo Sapiens
FYPPHTDYT

SEQ ID NO: 1107841 - protein, 9 aa, Homo Sapiens
GIGCCYSSE

SEQ ID NO: 1107842 - protein, 9 aa, Homo Sapiens
LASKGSLDC

SEQ ID NO: 1107843 - protein, 9 aa, Homo Sapiens
DQPPKKPRH

SEQ ID NO: 1107844 - protein, 9 aa, Homo Sapiens
PLIITLNCT

SEQ ID NO: 1107845 - protein, 9 aa, Homo Sapiens
RPGGTSSSS

SEQ ID NO: 1107846 - protein, 9 aa, Homo Sapiens
RPCQLLFPS

SEQ ID NO: 1107847 - protein, 9 aa, Homo Sapiens
SFGSVEAEA

SEQ ID NO: 1107848 - protein, 9 aa, Homo Sapiens
LPCVLPHVD

SEQ ID NO: 1107849 - protein, 9 aa, Homo Sapiens
SPGRRPLKK

SEQ ID NO: 1107850 - protein, 9 aa, Homo Sapiens
LRPAPHGLW

SEQ ID NO: 1107851 - protein, 9 aa, Homo Sapiens
QGPKGPPGP

SEQ ID NO: 1107852 - protein, 9 aa, Homo Sapiens
VEWSPHRPI

SEQ ID NO: 1107853 - protein, 9 aa, Homo Sapiens
AFSLLCPPT

SEQ ID NO: 1107854 - protein, 9 aa, Homo Sapiens
SLGEPWRAG

SEQ ID NO: 1107855 - protein, 9 aa, Homo Sapiens
RQLQEGRPS

SEQ ID NO: 1107856 - protein, 9 aa, Homo Sapiens
LCNSKEDKE

SEQ ID NO: 1107857 - protein, 9 aa, Homo Sapiens
PVWAVLAWA

SEQ ID NO: 1107858 - protein, 9 aa, Homo Sapiens
SCPTLTFVY

SEQ ID NO: 1107859 - protein, 9 aa, Homo Sapiens
WMNMNIMSE

SEQ ID NO: 1107860 - protein, 9 aa, Homo Sapiens
RLFLQQNTQ

SEQ ID NO: 1107861 - protein, 9 aa, Homo Sapiens
TPGRRGGTC

SEQ ID NO: 1107862 - protein, 9 aa, Homo Sapiens
ELSLVYLLF

SEQ ID NO: 1107863 - protein, 9 aa, Homo Sapiens
EWKVKFPEL

SEQ ID NO: 1107864 - protein, 9 aa, Homo Sapiens
SGTRPWLMD

SEQ ID NO: 1107865 - protein, 9 aa, Homo Sapiens
CPAVTDLTA

SEQ ID NO: 1107866 - protein, 9 aa, Homo Sapiens
VSHSLRGET

SEQ ID NO: 1107867 - protein, 9 aa, Homo Sapiens
GEAAWSMGG

SEQ ID NO: 1107868 - protein, 9 aa, Homo Sapiens
RLWHAVHEE

SEQ ID NO: 1107869 - protein, 9 aa, Homo Sapiens
APPRTQHIT

SEQ ID NO: 1107870 - protein, 9 aa, Homo Sapiens
DLRKLAINM

SEQ ID NO: 1107871 - protein, 9 aa, Homo Sapiens
LPPPVWAVL

SEQ ID NO: 1107872 - protein, 9 aa, Homo Sapiens
AQDGARCPS

SEQ ID NO: 1107873 - protein, 9 aa, Homo Sapiens
PQPSLPGPC

SEQ ID NO: 1107874 - protein, 9 aa, Homo Sapiens
PGRPWPPSF

SEQ ID NO: 1107875 - protein, 9 aa, Homo Sapiens
SKATENHQA

SEQ ID NO: 1107876 - protein, 9 aa, Homo Sapiens
GQGGGGLLQ

SEQ ID NO: 1107877 - protein, 9 aa, Homo Sapiens
RGPEVNAGG

SEQ ID NO: 1107878 - protein, 9 aa, Homo Sapiens
KSDEQCAAA

SEQ ID NO: 1107879 - protein, 9 aa, Homo Sapiens
ASSRGASCS

SEQ ID NO: 1107880 - protein, 9 aa, Homo Sapiens
SWERHLGHA

SEQ ID NO: 1107881 - protein, 9 aa, Homo Sapiens
TLDQVMDMM

SEQ ID NO: 1107882 - protein, 9 aa, Homo Sapiens
SVLTAEGTR

SEQ ID NO: 1107883 - protein, 9 aa, Homo Sapiens
KFRDSATKG

SEQ ID NO: 1107884 - protein, 9 aa, Homo Sapiens
PAPCLTHCT

SEQ ID NO: 1107885 - protein, 9 aa, Homo Sapiens
SHPCSTSVM

SEQ ID NO: 1107886 - protein, 9 aa, Homo Sapiens
LLQGVPGKT

SEQ ID NO: 1107887 - protein, 9 aa, Homo Sapiens
LDYLPSCYH

SEQ ID NO: 1107888 - protein, 9 aa, Homo Sapiens
PGRVNELRR

SEQ ID NO: 1107889 - protein, 9 aa, Homo Sapiens
LWRPGTCTN

SEQ ID NO: 1107890 - protein, 9 aa, Homo Sapiens
TKIQAWWWG

SEQ ID NO: 1107891 - protein, 9 aa, Homo Sapiens
PAYSKDSGL

SEQ ID NO: 1107892 - protein, 9 aa, Homo Sapiens
GEGSRDLCP

SEQ ID NO: 1107893 - protein, 9 aa, Homo Sapiens
CASLLSTLS

SEQ ID NO: 1107894 - protein, 9 aa, Homo Sapiens
TYVGTLFNG

SEQ ID NO: 1107895 - protein, 9 aa, Homo Sapiens
ERRWDRGDA

SEQ ID NO: 1107896 - protein, 9 aa, Homo Sapiens
TLPDISRIS

SEQ ID NO: 1107897 - protein, 9 aa, Homo Sapiens
SREQHFYES

SEQ ID NO: 1107898 - protein, 9 aa, Homo Sapiens
IAKPRRRKK

SEQ ID NO: 1107899 - protein, 9 aa, Homo Sapiens
AATGILICQ

SEQ ID NO: 1107900 - protein, 9 aa, Homo Sapiens
AVQALQFTT

SEQ ID NO: 1107901 - protein, 9 aa, Homo Sapiens
RHGKAEEQA

SEQ ID NO: 1107902 - protein, 9 aa, Homo Sapiens
PGTLPGEPP

SEQ ID NO: 1107903 - protein, 9 aa, Homo Sapiens
AGRKQPPVS

SEQ ID NO: 1107904 - protein, 9 aa, Homo Sapiens
WMEAVRWVQ

SEQ ID NO: 1107905 - protein, 9 aa, Homo Sapiens
LLLRAGVNP

SEQ ID NO: 1107906 - protein, 9 aa, Homo Sapiens
PVPEHLGQE

SEQ ID NO: 1107907 - protein, 9 aa, Homo Sapiens
VSMTFLEVN

SEQ ID NO: 1107908 - protein, 9 aa, Homo Sapiens
MAATQHGHE

SEQ ID NO: 1107909 - protein, 9 aa, Homo Sapiens
DMPLYFSYS

SEQ ID NO: 1107910 - protein, 9 aa, Homo Sapiens
KTLPDISRI

SEQ ID NO: 1107911 - protein, 9 aa, Homo Sapiens
PQAPSQVWT

SEQ ID NO: 1107912 - protein, 9 aa, Homo Sapiens
QESSQPKPA

SEQ ID NO: 1107913 - protein, 9 aa, Homo Sapiens
EWNWHGETE

SEQ ID NO: 1107914 - protein, 9 aa, Homo Sapiens
QAIKLACMD

SEQ ID NO: 1107915 - protein, 9 aa, Homo Sapiens
KHMCFHNMS

SEQ ID NO: 1107916 - protein, 9 aa, Homo Sapiens
PGRALHHAG

SEQ ID NO: 1107917 - protein, 9 aa, Homo Sapiens
HHCFPSSPN

SEQ ID NO: 1107918 - protein, 9 aa, Homo Sapiens
GTVAGATAQ

SEQ ID NO: 1107919 - protein, 9 aa, Homo Sapiens
AMSSSLPKA

SEQ ID NO: 1107920 - protein, 9 aa, Homo Sapiens
PLLALPPRG

SEQ ID NO: 1107921 - protein, 9 aa, Homo Sapiens
ASLLSTLSQ

SEQ ID NO: 1107922 - protein, 9 aa, Homo Sapiens
GTHVDLRLA

SEQ ID NO: 1107923 - protein, 9 aa, Homo Sapiens
HIAPGYNCS

SEQ ID NO: 1107924 - protein, 9 aa, Homo Sapiens
PINTFTMRP

SEQ ID NO: 1107925 - protein, 9 aa, Homo Sapiens
PLISREQHF

SEQ ID NO: 1107926 - protein, 9 aa, Homo Sapiens
HHLAFNQPS

SEQ ID NO: 1107927 - protein, 9 aa, Homo Sapiens
NSKDYMYRR

SEQ ID NO: 1107928 - protein, 9 aa, Homo Sapiens
PRVLRRVLP

SEQ ID NO: 1107929 - protein, 9 aa, Homo Sapiens
SAVNVNDKF

SEQ ID NO: 1107930 - protein, 9 aa, Homo Sapiens
EVLSSCVAL

SEQ ID NO: 1107931 - protein, 9 aa, Homo Sapiens
GRGPEVNAG

SEQ ID NO: 1107932 - protein, 9 aa, Homo Sapiens
SLLGRFLIF

SEQ ID NO: 1107933 - protein, 9 aa, Homo Sapiens
GNGVPSMPL

SEQ ID NO: 1107934 - protein, 9 aa, Homo Sapiens
TGILICQQQ

SEQ ID NO: 1107935 - protein, 9 aa, Homo Sapiens
SSVTASCAS

SEQ ID NO: 1107936 - protein, 9 aa, Homo Sapiens
RAGGRAAPA

SEQ ID NO: 1107937 - protein, 9 aa, Homo Sapiens
MTPASRTSV

SEQ ID NO: 1107938 - protein, 9 aa, Homo Sapiens
VDAHVVLEV

SEQ ID NO: 1107939 - protein, 9 aa, Homo Sapiens
QWGESPWQV

SEQ ID NO: 1107940 - protein, 9 aa, Homo Sapiens
QLSISCPTL

SEQ ID NO: 1107941 - protein, 9 aa, Homo Sapiens
RHVCKQSMG

SEQ ID NO: 1107942 - protein, 9 aa, Homo Sapiens
VWVPGHEDG

SEQ ID NO: 1107943 - protein, 9 aa, Homo Sapiens
GLLLFKIPH

SEQ ID NO: 1107944 - protein, 9 aa, Homo Sapiens
GVPEKKVDE

SEQ ID NO: 1107945 - protein, 9 aa, Homo Sapiens
EARLSYLLT

SEQ ID NO: 1107946 - protein, 9 aa, Homo Sapiens
PGPRGGHPQ

SEQ ID NO: 1107947 - protein, 9 aa, Homo Sapiens
AELEPPGAR

SEQ ID NO: 1107948 - protein, 9 aa, Homo Sapiens
GLLKATQND

SEQ ID NO: 1107949 - protein, 9 aa, Homo Sapiens
LPRLTRERA

SEQ ID NO: 1107950 - protein, 9 aa, Homo Sapiens
HALETPSCF

SEQ ID NO: 1107951 - protein, 9 aa, Homo Sapiens
ALCVLSSIR

SEQ ID NO: 1107952 - protein, 9 aa, Homo Sapiens
GRPSCGRCM

SEQ ID NO: 1107953 - protein, 9 aa, Homo Sapiens
TLLQMFGLC

SEQ ID NO: 1107954 - protein, 9 aa, Homo Sapiens
DRIFPQLCN

SEQ ID NO: 1107955 - protein, 9 aa, Homo Sapiens
QLLPADPLC

SEQ ID NO: 1107956 - protein, 9 aa, Homo Sapiens
VSQQSIRNS

SEQ ID NO: 1107957 - protein, 9 aa, Homo Sapiens
AALLMEGFL

SEQ ID NO: 1107958 - protein, 9 aa, Homo Sapiens
FLQREDLLA

SEQ ID NO: 1107959 - protein, 9 aa, Homo Sapiens
KATQNDKLA

SEQ ID NO: 1107960 - protein, 9 aa, Homo Sapiens
ATTPIFFDM

SEQ ID NO: 1107961 - protein, 9 aa, Homo Sapiens
ARGTFHKGS

SEQ ID NO: 1107962 - protein, 9 aa, Homo Sapiens
SHSGSFVPN

SEQ ID NO: 1107963 - protein, 9 aa, Homo Sapiens
SVDREPVDR

SEQ ID NO: 1107964 - protein, 9 aa, Homo Sapiens
SLVEQHKQE

SEQ ID NO: 1107965 - protein, 9 aa, Homo Sapiens
AYKRPIQEE

SEQ ID NO: 1107966 - protein, 9 aa, Homo Sapiens
GWNACPERR

SEQ ID NO: 1107967 - protein, 9 aa, Homo Sapiens
TAPAYYPYS

SEQ ID NO: 1107968 - protein, 9 aa, Homo Sapiens
DVGLLFAHL

SEQ ID NO: 1107969 - protein, 9 aa, Homo Sapiens
LCGGRWRIG

SEQ ID NO: 1107970 - protein, 9 aa, Homo Sapiens
WFIRKNKPF

SEQ ID NO: 1107971 - protein, 9 aa, Homo Sapiens
RSSVVKFPV

SEQ ID NO: 1107972 - protein, 9 aa, Homo Sapiens
LGTPGIPGR

SEQ ID NO: 1107973 - protein, 9 aa, Homo Sapiens
QPDMWPKSE

SEQ ID NO: 1107974 - protein, 9 aa, Homo Sapiens
NLAFYPPHT

SEQ ID NO: 1107975 - protein, 9 aa, Homo Sapiens
LKVFVPDYM

SEQ ID NO: 1107976 - protein, 9 aa, Homo Sapiens
KDKKQKRSR

SEQ ID NO: 1107977 - protein, 9 aa, Homo Sapiens
AEKEEEFQD

SEQ ID NO: 1107978 - protein, 9 aa, Homo Sapiens
HNSSNNSRK

SEQ ID NO: 1107979 - protein, 9 aa, Homo Sapiens
RSGVAYIVA

SEQ ID NO: 1107980 - protein, 9 aa, Homo Sapiens
ATLRCPAVP

SEQ ID NO: 1107981 - protein, 9 aa, Homo Sapiens
TLAFQQACY

SEQ ID NO: 1107982 - protein, 9 aa, Homo Sapiens
NSSNNSRKK

SEQ ID NO: 1107983 - protein, 9 aa, Homo Sapiens
SIPKKSYAL

SEQ ID NO: 1107984 - protein, 9 aa, Homo Sapiens
ARRHGKAEE

SEQ ID NO: 1107985 - protein, 9 aa, Homo Sapiens
VEASSSLTG

SEQ ID NO: 1107986 - protein, 9 aa, Homo Sapiens
PVSMTFLEV

SEQ ID NO: 1107987 - protein, 9 aa, Homo Sapiens
QPSPASACT

SEQ ID NO: 1107988 - protein, 9 aa, Homo Sapiens
KIQATMEEN

SEQ ID NO: 1107989 - protein, 9 aa, Homo Sapiens
QKRSRSTTP

SEQ ID NO: 1107990 - protein, 9 aa, Homo Sapiens
QLDLRYANL

SEQ ID NO: 1107991 - protein, 9 aa, Homo Sapiens
VYSELPKPS

SEQ ID NO: 1107992 - protein, 9 aa, Homo Sapiens
LPACRAEYF

SEQ ID NO: 1107993 - protein, 9 aa, Homo Sapiens
CVYEMRRWN

SEQ ID NO: 1107994 - protein, 9 aa, Homo Sapiens
VADKALAPA

SEQ ID NO: 1107995 - protein, 9 aa, Homo Sapiens
WPHPDPAGS

SEQ ID NO: 1107996 - protein, 9 aa, Homo Sapiens
SSTGAEGQM

SEQ ID NO: 1107997 - protein, 9 aa, Homo Sapiens
LMEGHHKLF

SEQ ID NO: 1107998 - protein, 9 aa, Homo Sapiens
WPCYLTRQK

SEQ ID NO: 1107999 - protein, 9 aa, Homo Sapiens
FKCADICAL

SEQ ID NO: 1108000 - protein, 9 aa, Homo Sapiens
FGYQSSSHF

SEQ ID NO: 1108001 - protein, 9 aa, Homo Sapiens
FLFELVARV

SEQ ID NO: 1108002 - protein, 9 aa, Homo Sapiens
WQVTPDQRK

SEQ ID NO: 1108003 - protein, 9 aa, Homo Sapiens
TCPDMMRKL

SEQ ID NO: 1108004 - protein, 9 aa, Homo Sapiens
SLLTSHLVK

SEQ ID NO: 1108005 - protein, 9 aa, Homo Sapiens
AVLSLPLPE

SEQ ID NO: 1108006 - protein, 9 aa, Homo Sapiens
HGMYFLNGS

SEQ ID NO: 1108007 - protein, 9 aa, Homo Sapiens
DDNIENEAD

SEQ ID NO: 1108008 - protein, 9 aa, Homo Sapiens
LMRPKHSHH

SEQ ID NO: 1108009 - protein, 9 aa, Homo Sapiens
LMPGPDSSG

SEQ ID NO: 1108010 - protein, 9 aa, Homo Sapiens
EFPAVGLEL

SEQ ID NO: 1108011 - protein, 9 aa, Homo Sapiens
NATVRNSIN

SEQ ID NO: 1108012 - protein, 9 aa, Homo Sapiens
APAHHSGSH

SEQ ID NO: 1108013 - protein, 9 aa, Homo Sapiens
PPMPTRRSL

SEQ ID NO: 1108014 - protein, 9 aa, Homo Sapiens
VASRMPLSC

SEQ ID NO: 1108015 - protein, 9 aa, Homo Sapiens
LLTQPSPAS

SEQ ID NO: 1108016 - protein, 9 aa, Homo Sapiens
KIAKPRRRK

SEQ ID NO: 1108017 - protein, 9 aa, Homo Sapiens
CGDLEELKN

SEQ ID NO: 1108018 - protein, 9 aa, Homo Sapiens
HSRLSPPEA

SEQ ID NO: 1108019 - protein, 9 aa, Homo Sapiens
NLQPTSMWA

SEQ ID NO: 1108020 - protein, 9 aa, Homo Sapiens
AIPTQRSPR

SEQ ID NO: 1108021 - protein, 9 aa, Homo Sapiens
SKHHAGTRV

SEQ ID NO: 1108022 - protein, 9 aa, Homo Sapiens
ETYTSKINI

SEQ ID NO: 1108023 - protein, 9 aa, Homo Sapiens
PDDCLLQGT

SEQ ID NO: 1108024 - protein, 9 aa, Homo Sapiens
GAHAAGPAA

SEQ ID NO: 1108025 - protein, 9 aa, Homo Sapiens
VLDFFSRSH

SEQ ID NO: 1108026 - protein, 9 aa, Homo Sapiens
FQLVLPGEA

SEQ ID NO: 1108027 - protein, 9 aa, Homo Sapiens
LLRNAHHAV

SEQ ID NO: 1108028 - protein, 9 aa, Homo Sapiens
PTGCGSAAR

SEQ ID NO: 1108029 - protein, 9 aa, Homo Sapiens
SYFRLDMPL

SEQ ID NO: 1108030 - protein, 9 aa, Homo Sapiens
SGFFCNAAK

SEQ ID NO: 1108031 - protein, 9 aa, Homo Sapiens
NAQMLSRRK

SEQ ID NO: 1108032 - protein, 9 aa, Homo Sapiens
EIYHMGTFA

SEQ ID NO: 1108033 - protein, 9 aa, Homo Sapiens
APAQRPRTP

SEQ ID NO: 1108034 - protein, 9 aa, Homo Sapiens
KYLWLPYPF

SEQ ID NO: 1108035 - protein, 9 aa, Homo Sapiens
SLRGETVNL

SEQ ID NO: 1108036 - protein, 9 aa, Homo Sapiens
WVLRKRPSP

SEQ ID NO: 1108037 - protein, 9 aa, Homo Sapiens
SLPRVLRRV

SEQ ID NO: 1108038 - protein, 9 aa, Homo Sapiens
SPPPEASCL

SEQ ID NO: 1108039 - protein, 9 aa, Homo Sapiens
QPGGVLLRP

SEQ ID NO: 1108040 - protein, 9 aa, Homo Sapiens
ALSLSYLME

SEQ ID NO: 1108041 - protein, 9 aa, Homo Sapiens
PRSRLAAAS

SEQ ID NO: 1108042 - protein, 9 aa, Homo Sapiens
GFQILGLRS

SEQ ID NO: 1108043 - protein, 9 aa, Homo Sapiens
LRSDLLEEC

SEQ ID NO: 1108044 - protein, 9 aa, Homo Sapiens
FYLCIVPSE

SEQ ID NO: 1108045 - protein, 9 aa, Homo Sapiens
VTELAVQAL

SEQ ID NO: 1108046 - protein, 9 aa, Homo Sapiens
RCCRVGKSC

SEQ ID NO: 1108047 - protein, 9 aa, Homo Sapiens
LCIWCFFSR

SEQ ID NO: 1108048 - protein, 9 aa, Homo Sapiens
GWMASPARL

SEQ ID NO: 1108049 - protein, 9 aa, Homo Sapiens
YFNIDEGTK

SEQ ID NO: 1108050 - protein, 9 aa, Homo Sapiens
PRAGSRRCC

SEQ ID NO: 1108051 - protein, 9 aa, Homo Sapiens
PNTTILIKD

SEQ ID NO: 1108052 - protein, 9 aa, Homo Sapiens
SQVWTAATL

SEQ ID NO: 1108053 - protein, 9 aa, Homo Sapiens
PEPASGVGE

SEQ ID NO: 1108054 - protein, 9 aa, Homo Sapiens
PVRTPSISP

SEQ ID NO: 1108055 - protein, 9 aa, Homo Sapiens
YLLTCLESA

SEQ ID NO: 1108056 - protein, 9 aa, Homo Sapiens
LTAEGTRWP

SEQ ID NO: 1108057 - protein, 9 aa, Homo Sapiens
SILRARRGR

SEQ ID NO: 1108058 - protein, 9 aa, Homo Sapiens
QEIQNSLLP

SEQ ID NO: 1108059 - protein, 9 aa, Homo Sapiens
HLFLASLPS

SEQ ID NO: 1108060 - protein, 9 aa, Homo Sapiens
TLLPYLYTS

SEQ ID NO: 1108061 - protein, 9 aa, Homo Sapiens
HPHAPKTRT

SEQ ID NO: 1108062 - protein, 9 aa, Homo Sapiens
GLLARFTAS

SEQ ID NO: 1108063 - protein, 9 aa, Homo Sapiens
WVWDGYPPH

SEQ ID NO: 1108064 - protein, 9 aa, Homo Sapiens
HPHTTCWPR

SEQ ID NO: 1108065 - protein, 9 aa, Homo Sapiens
ETRVSVVEP

SEQ ID NO: 1108066 - protein, 9 aa, Homo Sapiens
GFPLWWPAS

SEQ ID NO: 1108067 - protein, 9 aa, Homo Sapiens
LSQSVQQAL

SEQ ID NO: 1108068 - protein, 9 aa, Homo Sapiens
IFLCLGPRD

SEQ ID NO: 1108069 - protein, 9 aa, Homo Sapiens
EYEGYKYEQ

SEQ ID NO: 1108070 - protein, 9 aa, Homo Sapiens
NPQVCLALL

SEQ ID NO: 1108071 - protein, 9 aa, Homo Sapiens
TVHGLLRQL

SEQ ID NO: 1108072 - protein, 9 aa, Homo Sapiens
LPELEATEA

SEQ ID NO: 1108073 - protein, 9 aa, Homo Sapiens
RAEQREQEW

SEQ ID NO: 1108074 - protein, 9 aa, Homo Sapiens
PPPGHPPRP

SEQ ID NO: 1108075 - protein, 9 aa, Homo Sapiens
SLKASRMST

SEQ ID NO: 1108076 - protein, 9 aa, Homo Sapiens
LHPVPRARP

SEQ ID NO: 1108077 - protein, 9 aa, Homo Sapiens
LFKVLGVNV

SEQ ID NO: 1108078 - protein, 9 aa, Homo Sapiens
IRVEVDTKV

SEQ ID NO: 1108079 - protein, 9 aa, Homo Sapiens
PHNAGLGYL

SEQ ID NO: 1108080 - protein, 9 aa, Homo Sapiens
STSAFKTTA

SEQ ID NO: 1108081 - protein, 9 aa, Homo Sapiens
TQQGRVEVL

SEQ ID NO: 1108082 - protein, 9 aa, Homo Sapiens
ERIHSGKKP

SEQ ID NO: 1108083 - protein, 9 aa, Homo Sapiens
RNIACITCT

SEQ ID NO: 1108084 - protein, 9 aa, Homo Sapiens
EFIWERIKI

SEQ ID NO: 1108085 - protein, 9 aa, Homo Sapiens
LVARVVSFL

SEQ ID NO: 1108086 - protein, 9 aa, Homo Sapiens
ADICALGLV

SEQ ID NO: 1108087 - protein, 9 aa, Homo Sapiens
WAFLLSLAA

SEQ ID NO: 1108088 - protein, 9 aa, Homo Sapiens
DPAGPLGAP

SEQ ID NO: 1108089 - protein, 9 aa, Homo Sapiens
GPRGGHPQP

SEQ ID NO: 1108090 - protein, 9 aa, Homo Sapiens
TPGTTPPAT

SEQ ID NO: 1108091 - protein, 9 aa, Homo Sapiens
FPPECPQQL

SEQ ID NO: 1108092 - protein, 9 aa, Homo Sapiens
KKMDLDGML

SEQ ID NO: 1108093 - protein, 9 aa, Homo Sapiens
IPIGAKFKL

SEQ ID NO: 1108094 - protein, 9 aa, Homo Sapiens
KGFEAQRAQ

SEQ ID NO: 1108095 - protein, 9 aa, Homo Sapiens
SEAPHVDGE

SEQ ID NO: 1108096 - protein, 9 aa, Homo Sapiens
PGHTLITVA

SEQ ID NO: 1108097 - protein, 9 aa, Homo Sapiens
FDGRDTKAP

SEQ ID NO: 1108098 - protein, 9 aa, Homo Sapiens
NSGRPGLPG

SEQ ID NO: 1108099 - protein, 9 aa, Homo Sapiens
FTSRAGHVE

SEQ ID NO: 1108100 - protein, 9 aa, Homo Sapiens
APGPRPGSP

SEQ ID NO: 1108101 - protein, 9 aa, Homo Sapiens
TIQKALSDA

SEQ ID NO: 1108102 - protein, 9 aa, Homo Sapiens
VFSKKKKRK

SEQ ID NO: 1108103 - protein, 9 aa, Homo Sapiens
TRSTVVSMA

SEQ ID NO: 1108104 - protein, 9 aa, Homo Sapiens
SAQLWARAR

SEQ ID NO: 1108105 - protein, 9 aa, Homo Sapiens
EACLRTHGC

SEQ ID NO: 1108106 - protein, 9 aa, Homo Sapiens
GQMGHPAEK

SEQ ID NO: 1108107 - protein, 9 aa, Homo Sapiens
VLALLSFWP

SEQ ID NO: 1108108 - protein, 9 aa, Homo Sapiens
MKLNPQQAL

SEQ ID NO: 1108109 - protein, 9 aa, Homo Sapiens
QDQLQDRDT

SEQ ID NO: 1108110 - protein, 9 aa, Homo Sapiens
DEEGAEKEE

SEQ ID NO: 1108111 - protein, 9 aa, Homo Sapiens
NPKSKRRCG

SEQ ID NO: 1108112 - protein, 9 aa, Homo Sapiens
RGVPPRAPA

SEQ ID NO: 1108113 - protein, 9 aa, Homo Sapiens
KIEFEGLMR

SEQ ID NO: 1108114 - protein, 9 aa, Homo Sapiens
LRRVEELQN

SEQ ID NO: 1108115 - protein, 9 aa, Homo Sapiens
VLEQLFEEH

SEQ ID NO: 1108116 - protein, 9 aa, Homo Sapiens
GLEVYLQGW

SEQ ID NO: 1108117 - protein, 9 aa, Homo Sapiens
AHRQKVSSL

SEQ ID NO: 1108118 - protein, 9 aa, Homo Sapiens
ERKGLDSSW

SEQ ID NO: 1108119 - protein, 9 aa, Homo Sapiens
HELTHAFDR

SEQ ID NO: 1108120 - protein, 9 aa, Homo Sapiens
HVTGNPKGT

SEQ ID NO: 1108121 - protein, 9 aa, Homo Sapiens
SPGTTYCVC

SEQ ID NO: 1108122 - protein, 9 aa, Homo Sapiens
IKQELETMA

SEQ ID NO: 1108123 - protein, 9 aa, Homo Sapiens
SFDDQHRMS

SEQ ID NO: 1108124 - protein, 9 aa, Homo Sapiens
TAEGTRWPG

SEQ ID NO: 1108125 - protein, 9 aa, Homo Sapiens
LIGLPWPFP

SEQ ID NO: 1108126 - protein, 9 aa, Homo Sapiens
FAPPRGIPD

SEQ ID NO: 1108127 - protein, 9 aa, Homo Sapiens
AFVEASSSL

SEQ ID NO: 1108128 - protein, 9 aa, Homo Sapiens
APAYYPYSQ

SEQ ID NO: 1108129 - protein, 9 aa, Homo Sapiens
NERKRKKMT

SEQ ID NO: 1108130 - protein, 9 aa, Homo Sapiens
FSDSFNSAV

SEQ ID NO: 1108131 - protein, 9 aa, Homo Sapiens
EEAAFPGHR

SEQ ID NO: 1108132 - protein, 9 aa, Homo Sapiens
ARRTQLETP

SEQ ID NO: 1108133 - protein, 9 aa, Homo Sapiens
PTCLRTCHL

SEQ ID NO: 1108134 - protein, 9 aa, Homo Sapiens
LSRLWAAVA

SEQ ID NO: 1108135 - protein, 9 aa, Homo Sapiens
PHYAHVIGT

SEQ ID NO: 1108136 - protein, 9 aa, Homo Sapiens
DVSAVPMGL

SEQ ID NO: 1108137 - protein, 9 aa, Homo Sapiens
KISGVNTKK

SEQ ID NO: 1108138 - protein, 9 aa, Homo Sapiens
GMTVGVVHQ

SEQ ID NO: 1108139 - protein, 9 aa, Homo Sapiens
RYCHDCGVA

SEQ ID NO: 1108140 - protein, 9 aa, Homo Sapiens
QATTPLDSG

SEQ ID NO: 1108141 - protein, 9 aa, Homo Sapiens
KQRGEKHQD

SEQ ID NO: 1108142 - protein, 9 aa, Homo Sapiens
PPYTQASLG

SEQ ID NO: 1108143 - protein, 9 aa, Homo Sapiens
TLPTAAPSA

SEQ ID NO: 1108144 - protein, 9 aa, Homo Sapiens
PRPPSTLLS

SEQ ID NO: 1108145 - protein, 9 aa, Homo Sapiens
LSKAAWQIT

SEQ ID NO: 1108146 - protein, 9 aa, Homo Sapiens
LVVAHDLIW

SEQ ID NO: 1108147 - protein, 9 aa, Homo Sapiens
DTERNLRPL

SEQ ID NO: 1108148 - protein, 9 aa, Homo Sapiens
KNFGMAFLT

SEQ ID NO: 1108149 - protein, 9 aa, Homo Sapiens
DVMLCTGLG

SEQ ID NO: 1108150 - protein, 9 aa, Homo Sapiens
MGRPFQKKS

SEQ ID NO: 1108151 - protein, 9 aa, Homo Sapiens
LVAEKIGED

SEQ ID NO: 1108152 - protein, 9 aa, Homo Sapiens
KHGIITMRG

SEQ ID NO: 1108153 - protein, 9 aa, Homo Sapiens
KMNQQHGRR

SEQ ID NO: 1108154 - protein, 9 aa, Homo Sapiens
TGCGSAARK

SEQ ID NO: 1108155 - protein, 9 aa, Homo Sapiens
KTHPCTMLL

SEQ ID NO: 1108156 - protein, 9 aa, Homo Sapiens
VLMLNDMEL

SEQ ID NO: 1108157 - protein, 9 aa, Homo Sapiens
PAIPSDTTL

SEQ ID NO: 1108158 - protein, 9 aa, Homo Sapiens
LLDLITFLT

SEQ ID NO: 1108159 - protein, 9 aa, Homo Sapiens
QCLRLSWAR

SEQ ID NO: 1108160 - protein, 9 aa, Homo Sapiens
GPQPPPSRQ

SEQ ID NO: 1108161 - protein, 9 aa, Homo Sapiens
DVPPSIFST

SEQ ID NO: 1108162 - protein, 9 aa, Homo Sapiens
YRDCQSERL

SEQ ID NO: 1108163 - protein, 9 aa, Homo Sapiens
PHRSPPRAQ

SEQ ID NO: 1108164 - protein, 9 aa, Homo Sapiens
RDCQSERLY

SEQ ID NO: 1108165 - protein, 9 aa, Homo Sapiens
FCGIQGSQP

SEQ ID NO: 1108166 - protein, 9 aa, Homo Sapiens
AGPPAAEEV

SEQ ID NO: 1108167 - protein, 9 aa, Homo Sapiens
SPASVQSKD

SEQ ID NO: 1108168 - protein, 9 aa, Homo Sapiens
SPPPHNPRH

SEQ ID NO: 1108169 - protein, 9 aa, Homo Sapiens
KGLWTLHAF

SEQ ID NO: 1108170 - protein, 9 aa, Homo Sapiens
LGMCTNSSY

SEQ ID NO: 1108171 - protein, 9 aa, Homo Sapiens
GRAAPAQRP

SEQ ID NO: 1108172 - protein, 9 aa, Homo Sapiens
FKEVSLLMA

SEQ ID NO: 1108173 - protein, 9 aa, Homo Sapiens
VIVLFGYMQ

SEQ ID NO: 1108174 - protein, 9 aa, Homo Sapiens
GLAELVAEK

SEQ ID NO: 1108175 - protein, 9 aa, Homo Sapiens
DQHPINYCE

SEQ ID NO: 1108176 - protein, 9 aa, Homo Sapiens
LHMDAHTDT

SEQ ID NO: 1108177 - protein, 9 aa, Homo Sapiens
GEQSPEAEV

SEQ ID NO: 1108178 - protein, 9 aa, Homo Sapiens
IDEGTKSGP

SEQ ID NO: 1108179 - protein, 9 aa, Homo Sapiens
GGNLQPTSM

SEQ ID NO: 1108180 - protein, 9 aa, Homo Sapiens
TLQRSPLQQ

SEQ ID NO: 1108181 - protein, 9 aa, Homo Sapiens
LFTNWYQAS

SEQ ID NO: 1108182 - protein, 9 aa, Homo Sapiens
DCDLLVYLR

SEQ ID NO: 1108183 - protein, 9 aa, Homo Sapiens
LDLQQKWND

SEQ ID NO: 1108184 - protein, 9 aa, Homo Sapiens
TVDGDDLGA

SEQ ID NO: 1108185 - protein, 9 aa, Homo Sapiens
SRVLFEGTC

SEQ ID NO: 1108186 - protein, 9 aa, Homo Sapiens
SSHFYVVMW

SEQ ID NO: 1108187 - protein, 9 aa, Homo Sapiens
GRRRPALRL

SEQ ID NO: 1108188 - protein, 9 aa, Homo Sapiens
PQCGATCER

SEQ ID NO: 1108189 - protein, 9 aa, Homo Sapiens
AAPPSSSSS

SEQ ID NO: 1108190 - protein, 9 aa, Homo Sapiens
CPQQHVLGA

SEQ ID NO: 1108191 - protein, 9 aa, Homo Sapiens
NQWCLQPRS

SEQ ID NO: 1108192 - protein, 9 aa, Homo Sapiens
FAVTLFALS

SEQ ID NO: 1108193 - protein, 9 aa, Homo Sapiens
SASLMILVI

SEQ ID NO: 1108194 - protein, 9 aa, Homo Sapiens
STNRLHCLQ

SEQ ID NO: 1108195 - protein, 9 aa, Homo Sapiens
EPYFVYSRV

SEQ ID NO: 1108196 - protein, 9 aa, Homo Sapiens
VDRDNSPSS

SEQ ID NO: 1108197 - protein, 9 aa, Homo Sapiens
SAGSWAAFV

SEQ ID NO: 1108198 - protein, 9 aa, Homo Sapiens
SKMESRTLG

SEQ ID NO: 1108199 - protein, 9 aa, Homo Sapiens
ADYHKQHGV

SEQ ID NO: 1108200 - protein, 9 aa, Homo Sapiens
SALSKKLWW

SEQ ID NO: 1108201 - protein, 9 aa, Homo Sapiens
APTPASPWP

SEQ ID NO: 1108202 - protein, 9 aa, Homo Sapiens
TRASHRTSP

SEQ ID NO: 1108203 - protein, 9 aa, Homo Sapiens
RTQLETPRH

SEQ ID NO: 1108204 - protein, 9 aa, Homo Sapiens
TAELQVPHN

SEQ ID NO: 1108205 - protein, 9 aa, Homo Sapiens
SSFPDEEDR

SEQ ID NO: 1108206 - protein, 9 aa, Homo Sapiens
LRVALHSEP

SEQ ID NO: 1108207 - protein, 9 aa, Homo Sapiens
MTNLQAVQG

SEQ ID NO: 1108208 - protein, 9 aa, Homo Sapiens
SPGACRPAC

SEQ ID NO: 1108209 - protein, 9 aa, Homo Sapiens
AVKGIVKLT

SEQ ID NO: 1108210 - protein, 9 aa, Homo Sapiens
GEQAPPWAA

SEQ ID NO: 1108211 - protein, 9 aa, Homo Sapiens
RVLIKPETQ

SEQ ID NO: 1108212 - protein, 9 aa, Homo Sapiens
PEYLNFIRW

SEQ ID NO: 1108213 - protein, 9 aa, Homo Sapiens
GADPDDVLM

SEQ ID NO: 1108214 - protein, 9 aa, Homo Sapiens
RPEALFYPG

SEQ ID NO: 1108215 - protein, 9 aa, Homo Sapiens
HSPEEIRGG

SEQ ID NO: 1108216 - protein, 9 aa, Homo Sapiens
KMGTPRIEL

SEQ ID NO: 1108217 - protein, 9 aa, Homo Sapiens
AAAVWASVA

SEQ ID NO: 1108218 - protein, 9 aa, Homo Sapiens
QAHRQKVSS

SEQ ID NO: 1108219 - protein, 9 aa, Homo Sapiens
SILEEKRQL

SEQ ID NO: 1108220 - protein, 9 aa, Homo Sapiens
FRDFLNQCL

SEQ ID NO: 1108221 - protein, 9 aa, Homo Sapiens
PEVMPEEEE

SEQ ID NO: 1108222 - protein, 9 aa, Homo Sapiens
ETTTTSTEC

SEQ ID NO: 1108223 - protein, 9 aa, Homo Sapiens
QSTCVPGIP

SEQ ID NO: 1108224 - protein, 9 aa, Homo Sapiens
SPASWQVTP

SEQ ID NO: 1108225 - protein, 9 aa, Homo Sapiens
DSSSYHPFK

SEQ ID NO: 1108226 - protein, 9 aa, Homo Sapiens
RGIGPLTRD

SEQ ID NO: 1108227 - protein, 9 aa, Homo Sapiens
APSPRAGSR

SEQ ID NO: 1108228 - protein, 9 aa, Homo Sapiens
SLMPCGVPS

SEQ ID NO: 1108229 - protein, 9 aa, Homo Sapiens
KHQDGEKLL

SEQ ID NO: 1108230 - protein, 9 aa, Homo Sapiens
TTQSWIPQS

SEQ ID NO: 1108231 - protein, 9 aa, Homo Sapiens
SLLGWARCY

SEQ ID NO: 1108232 - protein, 9 aa, Homo Sapiens
AQAGLQSDK

SEQ ID NO: 1108233 - protein, 9 aa, Homo Sapiens
YKQLLTYIW

SEQ ID NO: 1108234 - protein, 9 aa, Homo Sapiens
QPGSLPLLP

SEQ ID NO: 1108235 - protein, 9 aa, Homo Sapiens
AAGRRRPAL

SEQ ID NO: 1108236 - protein, 9 aa, Homo Sapiens
FDAFRSEPT

SEQ ID NO: 1108237 - protein, 9 aa, Homo Sapiens
KPETRAHLA

SEQ ID NO: 1108238 - protein, 9 aa, Homo Sapiens
WWTQATPAP

SEQ ID NO: 1108239 - protein, 9 aa, Homo Sapiens
LTPLIITLN

SEQ ID NO: 1108240 - protein, 9 aa, Homo Sapiens
PSSNAGQNS

SEQ ID NO: 1108241 - protein, 9 aa, Homo Sapiens
AVRSPSRCG

SEQ ID NO: 1108242 - protein, 9 aa, Homo Sapiens
GSAARKSIT

SEQ ID NO: 1108243 - protein, 9 aa, Homo Sapiens
PFNQWCLQP

SEQ ID NO: 1108244 - protein, 9 aa, Homo Sapiens
PPAAAPRPP

SEQ ID NO: 1108245 - protein, 9 aa, Homo Sapiens
LEQTATQVD

SEQ ID NO: 1108246 - protein, 9 aa, Homo Sapiens
PPTRSSSRT

SEQ ID NO: 1108247 - protein, 9 aa, Homo Sapiens
LEMEVSPRG

SEQ ID NO: 1108248 - protein, 9 aa, Homo Sapiens
GCSIRERWL

SEQ ID NO: 1108249 - protein, 9 aa, Homo Sapiens
APLEKTAQP

SEQ ID NO: 1108250 - protein, 9 aa, Homo Sapiens
TARATSPCT

SEQ ID NO: 1108251 - protein, 9 aa, Homo Sapiens
GWLCIDDQT

SEQ ID NO: 1108252 - protein, 9 aa, Homo Sapiens
EKITSCYSG

SEQ ID NO: 1108253 - protein, 9 aa, Homo Sapiens
CDRCDAGWL

SEQ ID NO: 1108254 - protein, 9 aa, Homo Sapiens
AEPPPRPAP

SEQ ID NO: 1108255 - protein, 9 aa, Homo Sapiens
RGSPPYTQA

SEQ ID NO: 1108256 - protein, 9 aa, Homo Sapiens
DDLGALQSP

SEQ ID NO: 1108257 - protein, 9 aa, Homo Sapiens
PHPDPAGSP

SEQ ID NO: 1108258 - protein, 9 aa, Homo Sapiens
PPAAVLSLP

SEQ ID NO: 1108259 - protein, 9 aa, Homo Sapiens
VRGRDSYSG

SEQ ID NO: 1108260 - protein, 9 aa, Homo Sapiens
QRLWQSPCP

SEQ ID NO: 1108261 - protein, 9 aa, Homo Sapiens
VLLAAFWTE

SEQ ID NO: 1108262 - protein, 9 aa, Homo Sapiens
FKHLEEAFI

SEQ ID NO: 1108263 - protein, 9 aa, Homo Sapiens
ENAEEGAGR

SEQ ID NO: 1108264 - protein, 9 aa, Homo Sapiens
SEQAAPQSQ

SEQ ID NO: 1108265 - protein, 9 aa, Homo Sapiens
DDKVSIATP

SEQ ID NO: 1108266 - protein, 9 aa, Homo Sapiens
AAGRGRASQ

SEQ ID NO: 1108267 - protein, 9 aa, Homo Sapiens
PVLVQDAAG

SEQ ID NO: 1108268 - protein, 9 aa, Homo Sapiens
GLIITTGSV

SEQ ID NO: 1108269 - protein, 9 aa, Homo Sapiens
HQAQVVFQV

SEQ ID NO: 1108270 - protein, 9 aa, Homo Sapiens
FGSVAPSFS

SEQ ID NO: 1108271 - protein, 9 aa, Homo Sapiens
VVLLLLEKG

SEQ ID NO: 1108272 - protein, 9 aa, Homo Sapiens
LQELRRVEE

SEQ ID NO: 1108273 - protein, 9 aa, Homo Sapiens
GQPPRRPPP

SEQ ID NO: 1108274 - protein, 9 aa, Homo Sapiens
KGEAGAHRS

SEQ ID NO: 1108275 - protein, 9 aa, Homo Sapiens
TALGMCTNS

SEQ ID NO: 1108276 - protein, 9 aa, Homo Sapiens
TPTEWTRPS

SEQ ID NO: 1108277 - protein, 9 aa, Homo Sapiens
SKLKNQHQE

SEQ ID NO: 1108278 - protein, 9 aa, Homo Sapiens
SGAKPPGVS

SEQ ID NO: 1108279 - protein, 9 aa, Homo Sapiens
GRRRTGKKT

SEQ ID NO: 1108280 - protein, 9 aa, Homo Sapiens
SHQSAPPIR

SEQ ID NO: 1108281 - protein, 9 aa, Homo Sapiens
SGGLRARPP

SEQ ID NO: 1108282 - protein, 9 aa, Homo Sapiens
SGWTRAAGR

SEQ ID NO: 1108283 - protein, 9 aa, Homo Sapiens
FRLFLQQNT

SEQ ID NO: 1108284 - protein, 9 aa, Homo Sapiens
PQPPPSRQD

SEQ ID NO: 1108285 - protein, 9 aa, Homo Sapiens
ESILRARRG

SEQ ID NO: 1108286 - protein, 9 aa, Homo Sapiens
ENLIRMGMT

SEQ ID NO: 1108287 - protein, 9 aa, Homo Sapiens
NAGQNSRHL

SEQ ID NO: 1108288 - protein, 9 aa, Homo Sapiens
HPGCSIRER

SEQ ID NO: 1108289 - protein, 9 aa, Homo Sapiens
DQSRRAQAE

SEQ ID NO: 1108290 - protein, 9 aa, Homo Sapiens
REDLLLGQR

SEQ ID NO: 1108291 - protein, 9 aa, Homo Sapiens
PSLPGPCAS

SEQ ID NO: 1108292 - protein, 9 aa, Homo Sapiens
QCLQRKERM

SEQ ID NO: 1108293 - protein, 9 aa, Homo Sapiens
LQCQSLALP

SEQ ID NO: 1108294 - protein, 9 aa, Homo Sapiens
AVEVVRIGH

SEQ ID NO: 1108295 - protein, 9 aa, Homo Sapiens
RRPRVAQLL

SEQ ID NO: 1108296 - protein, 9 aa, Homo Sapiens
QRQSPKLVL

SEQ ID NO: 1108297 - protein, 9 aa, Homo Sapiens
ACLPLGATS

SEQ ID NO: 1108298 - protein, 9 aa, Homo Sapiens
YCLSDFITP

SEQ ID NO: 1108299 - protein, 9 aa, Homo Sapiens
VDDVPVMLP

SEQ ID NO: 1108300 - protein, 9 aa, Homo Sapiens
LYSPICSKL

SEQ ID NO: 1108301 - protein, 9 aa, Homo Sapiens
PEEASRSSG

SEQ ID NO: 1108302 - protein, 9 aa, Homo Sapiens
NLISMTLLL

SEQ ID NO: 1108303 - protein, 9 aa, Homo Sapiens
ELRDHRCIG

SEQ ID NO: 1108304 - protein, 9 aa, Homo Sapiens
KGSFLGEFH

SEQ ID NO: 1108305 - protein, 9 aa, Homo Sapiens
SASTHTSRN

SEQ ID NO: 1108306 - protein, 9 aa, Homo Sapiens
FHGKVEKHM

SEQ ID NO: 1108307 - protein, 9 aa, Homo Sapiens
KFFEKKVHR

SEQ ID NO: 1108308 - protein, 9 aa, Homo Sapiens
THRLIHTVG

SEQ ID NO: 1108309 - protein, 9 aa, Homo Sapiens
KAATKSLSR

SEQ ID NO: 1108310 - protein, 9 aa, Homo Sapiens
ASTGSSTAS

SEQ ID NO: 1108311 - protein, 9 aa, Homo Sapiens
CLSDFITPL

SEQ ID NO: 1108312 - protein, 9 aa, Homo Sapiens
SVGTEPDSV

SEQ ID NO: 1108313 - protein, 9 aa, Homo Sapiens
MELSDVCCL

SEQ ID NO: 1108314 - protein, 9 aa, Homo Sapiens
VSDGKYHVA

SEQ ID NO: 1108315 - protein, 9 aa, Homo Sapiens
LGSPLMSEF

SEQ ID NO: 1108316 - protein, 9 aa, Homo Sapiens
RSGWTRAAG

SEQ ID NO: 1108317 - protein, 9 aa, Homo Sapiens
KHERWHIRS

SEQ ID NO: 1108318 - protein, 9 aa, Homo Sapiens
QSIGQVFSV

SEQ ID NO: 1108319 - protein, 9 aa, Homo Sapiens
RSIELDMCT

SEQ ID NO: 1108320 - protein, 9 aa, Homo Sapiens
CPSAARAGG

SEQ ID NO: 1108321 - protein, 9 aa, Homo Sapiens
SPGACHAHK

SEQ ID NO: 1108322 - protein, 9 aa, Homo Sapiens
PGAPAAVSP

SEQ ID NO: 1108323 - protein, 9 aa, Homo Sapiens
VIWARTRIT

SEQ ID NO: 1108324 - protein, 9 aa, Homo Sapiens
TVATAVVLG

SEQ ID NO: 1108325 - protein, 9 aa, Homo Sapiens
HSEVILFIM

SEQ ID NO: 1108326 - protein, 9 aa, Homo Sapiens
VSSPTARRA

SEQ ID NO: 1108327 - protein, 9 aa, Homo Sapiens
TSGSIAPPA

SEQ ID NO: 1108328 - protein, 9 aa, Homo Sapiens
LCNESCEKR

SEQ ID NO: 1108329 - protein, 9 aa, Homo Sapiens
ALSLRPAPH

SEQ ID NO: 1108330 - protein, 9 aa, Homo Sapiens
LCVWVSSIR

SEQ ID NO: 1108331 - protein, 9 aa, Homo Sapiens
PKHSHHCSR

SEQ ID NO: 1108332 - protein, 9 aa, Homo Sapiens
LRCPAVPAA

SEQ ID NO: 1108333 - protein, 9 aa, Homo Sapiens
SILSVCLEQ

SEQ ID NO: 1108334 - protein, 9 aa, Homo Sapiens
FELQVFLFF

SEQ ID NO: 1108335 - protein, 9 aa, Homo Sapiens
PASHGDTDG

SEQ ID NO: 1108336 - protein, 9 aa, Homo Sapiens
HPFKINQNI

SEQ ID NO: 1108337 - protein, 9 aa, Homo Sapiens
GSFKLEHSA

SEQ ID NO: 1108338 - protein, 9 aa, Homo Sapiens
VHGLLRQLG

SEQ ID NO: 1108339 - protein, 9 aa, Homo Sapiens
AYIFLQNPQ

SEQ ID NO: 1108340 - protein, 9 aa, Homo Sapiens
LAVTERREM

SEQ ID NO: 1108341 - protein, 9 aa, Homo Sapiens
WPGDHQESS

SEQ ID NO: 1108342 - protein, 9 aa, Homo Sapiens
VSVCENNPP

SEQ ID NO: 1108343 - protein, 9 aa, Homo Sapiens
PRLVEHPGL

SEQ ID NO: 1108344 - protein, 9 aa, Homo Sapiens
SHPMTPASR

SEQ ID NO: 1108345 - protein, 9 aa, Homo Sapiens
SCSLPPDRP

SEQ ID NO: 1108346 - protein, 9 aa, Homo Sapiens
VLVQDAAGR

SEQ ID NO: 1108347 - protein, 9 aa, Homo Sapiens
PACRAEYFD

SEQ ID NO: 1108348 - protein, 9 aa, Homo Sapiens
MGMTGLVLV

SEQ ID NO: 1108349 - protein, 9 aa, Homo Sapiens
VAPSGSAAD

SEQ ID NO: 1108350 - protein, 9 aa, Homo Sapiens
HKAGLLCVC

SEQ ID NO: 1108351 - protein, 9 aa, Homo Sapiens
HTICSLDLR

SEQ ID NO: 1108352 - protein, 9 aa, Homo Sapiens
LSRNILEMS

SEQ ID NO: 1108353 - protein, 9 aa, Homo Sapiens
PMRNTGSRM

SEQ ID NO: 1108354 - protein, 9 aa, Homo Sapiens
LRANMASQV

SEQ ID NO: 1108355 - protein, 9 aa, Homo Sapiens
MPGPPWPTH

SEQ ID NO: 1108356 - protein, 9 aa, Homo Sapiens
VHPAVPGVT

SEQ ID NO: 1108357 - protein, 9 aa, Homo Sapiens
DYLPSCYHS

SEQ ID NO: 1108358 - protein, 9 aa, Homo Sapiens
FKTTAGPCC

SEQ ID NO: 1108359 - protein, 9 aa, Homo Sapiens
ELLKKCSLY

SEQ ID NO: 1108360 - protein, 9 aa, Homo Sapiens
PARCGRCPQ

SEQ ID NO: 1108361 - protein, 9 aa, Homo Sapiens
AFCNVWAAV

SEQ ID NO: 1108362 - protein, 9 aa, Homo Sapiens
EEGPLEPVV

SEQ ID NO: 1108363 - protein, 9 aa, Homo Sapiens
SGSLILVSV

SEQ ID NO: 1108364 - protein, 9 aa, Homo Sapiens
LHGAGFGPQ

SEQ ID NO: 1108365 - protein, 9 aa, Homo Sapiens
HLKPSGEQI

SEQ ID NO: 1108366 - protein, 9 aa, Homo Sapiens
QDPPSSRCW

SEQ ID NO: 1108367 - protein, 9 aa, Homo Sapiens
RAGKIAKPR

SEQ ID NO: 1108368 - protein, 9 aa, Homo Sapiens
RKEHSMGSR

SEQ ID NO: 1108369 - protein, 9 aa, Homo Sapiens
VSAVPMGLL

SEQ ID NO: 1108370 - protein, 9 aa, Homo Sapiens
LTPLTTQSW

SEQ ID NO: 1108371 - protein, 9 aa, Homo Sapiens
AVDNKKTHP

SEQ ID NO: 1108372 - protein, 9 aa, Homo Sapiens
LQFILDLQQ

SEQ ID NO: 1108373 - protein, 9 aa, Homo Sapiens
PSSPNEWLQ

SEQ ID NO: 1108374 - protein, 9 aa, Homo Sapiens
SKDTWEIKT

SEQ ID NO: 1108375 - protein, 9 aa, Homo Sapiens
RMQLRLIKI

SEQ ID NO: 1108376 - protein, 9 aa, Homo Sapiens
GQKTWTFYG

SEQ ID NO: 1108377 - protein, 9 aa, Homo Sapiens
MVRLTRLLR

SEQ ID NO: 1108378 - protein, 9 aa, Homo Sapiens
TQLETPRHV

SEQ ID NO: 1108379 - protein, 9 aa, Homo Sapiens
GPGVEGVKA

SEQ ID NO: 1108380 - protein, 9 aa, Homo Sapiens
LLSSLPPPK

SEQ ID NO: 1108381 - protein, 9 aa, Homo Sapiens
DQHVTGQDP

SEQ ID NO: 1108382 - protein, 9 aa, Homo Sapiens
FPSRSHPMT

SEQ ID NO: 1108383 - protein, 9 aa, Homo Sapiens
ETRAHLALH

SEQ ID NO: 1108384 - protein, 9 aa, Homo Sapiens
LGRFRSSGL

SEQ ID NO: 1108385 - protein, 9 aa, Homo Sapiens
GEAGAVAPT

SEQ ID NO: 1108386 - protein, 9 aa, Homo Sapiens
NWFLPGGKM

SEQ ID NO: 1108387 - protein, 9 aa, Homo Sapiens
RNSSKFRDS

SEQ ID NO: 1108388 - protein, 9 aa, Homo Sapiens
QHVLGAQVF

SEQ ID NO: 1108389 - protein, 9 aa, Homo Sapiens
ISPLLTILE

SEQ ID NO: 1108390 - protein, 9 aa, Homo Sapiens
GLRARPPPT

SEQ ID NO: 1108391 - protein, 9 aa, Homo Sapiens
YGKKRKWGA

SEQ ID NO: 1108392 - protein, 9 aa, Homo Sapiens
ISVADKALA

SEQ ID NO: 1108393 - protein, 9 aa, Homo Sapiens
AAATTLTSA

SEQ ID NO: 1108394 - protein, 9 aa, Homo Sapiens
ALPVGRHPP

SEQ ID NO: 1108395 - protein, 9 aa, Homo Sapiens
SESKLWEND

SEQ ID NO: 1108396 - protein, 9 aa, Homo Sapiens
NGTLIGTSA

SEQ ID NO: 1108397 - protein, 9 aa, Homo Sapiens
IDPLLDVAP

SEQ ID NO: 1108398 - protein, 9 aa, Homo Sapiens
VVCNNCNQV

SEQ ID NO: 1108399 - protein, 9 aa, Homo Sapiens
LLYLRTSGE

SEQ ID NO: 1108400 - protein, 9 aa, Homo Sapiens
PRRPPPAAP

SEQ ID NO: 1108401 - protein, 9 aa, Homo Sapiens
LLLGQRPAD

SEQ ID NO: 1108402 - protein, 9 aa, Homo Sapiens
LARMGSPKI

SEQ ID NO: 1108403 - protein, 9 aa, Homo Sapiens
ALRRTVHPA

SEQ ID NO: 1108404 - protein, 9 aa, Homo Sapiens
PDHSRLSPP

SEQ ID NO: 1108405 - protein, 9 aa, Homo Sapiens
GRRGLTERP

SEQ ID NO: 1108406 - protein, 9 aa, Homo Sapiens
VCNNCNQVV

SEQ ID NO: 1108407 - protein, 9 aa, Homo Sapiens
RERNVATSP

SEQ ID NO: 1108408 - protein, 9 aa, Homo Sapiens
VFGYQSSSH

SEQ ID NO: 1108409 - protein, 9 aa, Homo Sapiens
MRTRPPAAC

SEQ ID NO: 1108410 - protein, 9 aa, Homo Sapiens
VYITENNPR

SEQ ID NO: 1108411 - protein, 9 aa, Homo Sapiens
EVVLTHKQN

SEQ ID NO: 1108412 - protein, 9 aa, Homo Sapiens
YISKHHAGT

SEQ ID NO: 1108413 - protein, 9 aa, Homo Sapiens
MTWCGWLCP

SEQ ID NO: 1108414 - protein, 9 aa, Homo Sapiens
LLAAAGVQR

SEQ ID NO: 1108415 - protein, 9 aa, Homo Sapiens
ILASYPPYQ

SEQ ID NO: 1108416 - protein, 9 aa, Homo Sapiens
CGDLPGLHT

SEQ ID NO: 1108417 - protein, 9 aa, Homo Sapiens
FGRAFCNVW

SEQ ID NO: 1108418 - protein, 9 aa, Homo Sapiens
ERGPAGTAG

SEQ ID NO: 1108419 - protein, 9 aa, Homo Sapiens
GMTGLVLVF

SEQ ID NO: 1108420 - protein, 9 aa, Homo Sapiens
SELSSVHEV

SEQ ID NO: 1108421 - protein, 9 aa, Homo Sapiens
AEVRHRALS

SEQ ID NO: 1108422 - protein, 9 aa, Homo Sapiens
SDLLQQAGH

SEQ ID NO: 1108423 - protein, 9 aa, Homo Sapiens
ALVSWKQSQ

SEQ ID NO: 1108424 - protein, 9 aa, Homo Sapiens
HWTFGGGKA

SEQ ID NO: 1108425 - protein, 9 aa, Homo Sapiens
ALIVASASL

SEQ ID NO: 1108426 - protein, 9 aa, Homo Sapiens
RLPCSGDEQ

SEQ ID NO: 1108427 - protein, 9 aa, Homo Sapiens
DCGRHFHQS

SEQ ID NO: 1108428 - protein, 9 aa, Homo Sapiens
WTAGSLVCS

SEQ ID NO: 1108429 - protein, 9 aa, Homo Sapiens
SNCSSVIMT

SEQ ID NO: 1108430 - protein, 9 aa, Homo Sapiens
WMASPARLG

SEQ ID NO: 1108431 - protein, 9 aa, Homo Sapiens
GRGRERGGA

SEQ ID NO: 1108432 - protein, 9 aa, Homo Sapiens
GLGSSPLVR

SEQ ID NO: 1108433 - protein, 9 aa, Homo Sapiens
YTWGARDAS

SEQ ID NO: 1108434 - protein, 9 aa, Homo Sapiens
ETISKLRQV

SEQ ID NO: 1108435 - protein, 9 aa, Homo Sapiens
KRERNVATS

SEQ ID NO: 1108436 - protein, 9 aa, Homo Sapiens
QQSIRNSQK

SEQ ID NO: 1108437 - protein, 9 aa, Homo Sapiens
PLEIALTIS

SEQ ID NO: 1108438 - protein, 9 aa, Homo Sapiens
LSRRLVLKR

SEQ ID NO: 1108439 - protein, 9 aa, Homo Sapiens
RNTGSRMLK

SEQ ID NO: 1108440 - protein, 9 aa, Homo Sapiens
LWTLCSSTP

SEQ ID NO: 1108441 - protein, 9 aa, Homo Sapiens
ANDVMLCTG

SEQ ID NO: 1108442 - protein, 9 aa, Homo Sapiens
NGSWWAPSR

SEQ ID NO: 1108443 - protein, 9 aa, Homo Sapiens
QGGEEQRQR

SEQ ID NO: 1108444 - protein, 9 aa, Homo Sapiens
RPAPHGLWS

SEQ ID NO: 1108445 - protein, 9 aa, Homo Sapiens
HSVLAACST

SEQ ID NO: 1108446 - protein, 9 aa, Homo Sapiens
PAKWLLPLP

SEQ ID NO: 1108447 - protein, 9 aa, Homo Sapiens
FEKKVHRNQ

SEQ ID NO: 1108448 - protein, 9 aa, Homo Sapiens
PSGSCAPRP

SEQ ID NO: 1108449 - protein, 9 aa, Homo Sapiens
PAQSFLAQQ

SEQ ID NO: 1108450 - protein, 9 aa, Homo Sapiens
GWVRRVLCT

SEQ ID NO: 1108451 - protein, 9 aa, Homo Sapiens
KNLFRLFLQ

SEQ ID NO: 1108452 - protein, 9 aa, Homo Sapiens
KQFLLFTEH

SEQ ID NO: 1108453 - protein, 9 aa, Homo Sapiens
TSALSKKLW

SEQ ID NO: 1108454 - protein, 9 aa, Homo Sapiens
TAAPSAGAW

SEQ ID NO: 1108455 - protein, 9 aa, Homo Sapiens
VEAGGSKHG

SEQ ID NO: 1108456 - protein, 9 aa, Homo Sapiens
RPATQLPVP

SEQ ID NO: 1108457 - protein, 9 aa, Homo Sapiens
WIAEGNEPP

SEQ ID NO: 1108458 - protein, 9 aa, Homo Sapiens
RTHQAQVVF

SEQ ID NO: 1108459 - protein, 9 aa, Homo Sapiens
DTKNLYLLA

SEQ ID NO: 1108460 - protein, 9 aa, Homo Sapiens
HRPERGPRG

SEQ ID NO: 1108461 - protein, 9 aa, Homo Sapiens
GSQEQKLGV

SEQ ID NO: 1108462 - protein, 9 aa, Homo Sapiens
LSTSWPSLM

SEQ ID NO: 1108463 - protein, 9 aa, Homo Sapiens
IGLNGWLCI

SEQ ID NO: 1108464 - protein, 9 aa, Homo Sapiens
GEPAAARGA

SEQ ID NO: 1108465 - protein, 9 aa, Homo Sapiens
PASPAHSPT

SEQ ID NO: 1108466 - protein, 9 aa, Homo Sapiens
PGSTGSRKA

SEQ ID NO: 1108467 - protein, 9 aa, Homo Sapiens
ASGRRRTFP

SEQ ID NO: 1108468 - protein, 9 aa, Homo Sapiens
WREGCGASS

SEQ ID NO: 1108469 - protein, 9 aa, Homo Sapiens
ELVLHKGLD

SEQ ID NO: 1108470 - protein, 9 aa, Homo Sapiens
KAFRQCTHL

SEQ ID NO: 1108471 - protein, 9 aa, Homo Sapiens
ANPSDGNNT

SEQ ID NO: 1108472 - protein, 9 aa, Homo Sapiens
ALPQGLLAE

SEQ ID NO: 1108473 - protein, 9 aa, Homo Sapiens
TAAPGPRPG

SEQ ID NO: 1108474 - protein, 9 aa, Homo Sapiens
TSKINIAKR

SEQ ID NO: 1108475 - protein, 9 aa, Homo Sapiens
PRDAPGAAE

SEQ ID NO: 1108476 - protein, 9 aa, Homo Sapiens
RQDPRTAPR

SEQ ID NO: 1108477 - protein, 9 aa, Homo Sapiens
ALGLRQQHN

SEQ ID NO: 1108478 - protein, 9 aa, Homo Sapiens
QGLGVAARH

SEQ ID NO: 1108479 - protein, 9 aa, Homo Sapiens
RMRGEPLQV

SEQ ID NO: 1108480 - protein, 9 aa, Homo Sapiens
PIQVQTGGR

SEQ ID NO: 1108481 - protein, 9 aa, Homo Sapiens
VRTCVCWPS

SEQ ID NO: 1108482 - protein, 9 aa, Homo Sapiens
VVVVHELGV

SEQ ID NO: 1108483 - protein, 9 aa, Homo Sapiens
ITQCKESLA

SEQ ID NO: 1108484 - protein, 9 aa, Homo Sapiens
MQLRLIKIN

SEQ ID NO: 1108485 - protein, 9 aa, Homo Sapiens
LAPMLAPPT

SEQ ID NO: 1108486 - protein, 9 aa, Homo Sapiens
MSTSFDKFT

SEQ ID NO: 1108487 - protein, 9 aa, Homo Sapiens
PVYEVSVCE

SEQ ID NO: 1108488 - protein, 9 aa, Homo Sapiens
VRCRKTRRE

SEQ ID NO: 1108489 - protein, 9 aa, Homo Sapiens
VAALALGLL

SEQ ID NO: 1108490 - protein, 9 aa, Homo Sapiens
DKATKVGKD

SEQ ID NO: 1108491 - protein, 9 aa, Homo Sapiens
APRPGAAAS

SEQ ID NO: 1108492 - protein, 9 aa, Homo Sapiens
LPLPWGWLL

SEQ ID NO: 1108493 - protein, 9 aa, Homo Sapiens
RDTKAPVLG

SEQ ID NO: 1108494 - protein, 9 aa, Homo Sapiens
TTILIKDEA

SEQ ID NO: 1108495 - protein, 9 aa, Homo Sapiens
NVDDPTGNV

SEQ ID NO: 1108496 - protein, 9 aa, Homo Sapiens
RAFEENRYK

SEQ ID NO: 1108497 - protein, 9 aa, Homo Sapiens
NGGNLQPTS

SEQ ID NO: 1108498 - protein, 9 aa, Homo Sapiens
EWSLATGQP

SEQ ID NO: 1108499 - protein, 9 aa, Homo Sapiens
LLPADPLCV

SEQ ID NO: 1108500 - protein, 9 aa, Homo Sapiens
MRETIRTLN

SEQ ID NO: 1108501 - protein, 9 aa, Homo Sapiens
SYLMELSVV

SEQ ID NO: 1108502 - protein, 9 aa, Homo Sapiens
HREGVHRQL

SEQ ID NO: 1108503 - protein, 9 aa, Homo Sapiens
ASPASWQVT

SEQ ID NO: 1108504 - protein, 9 aa, Homo Sapiens
CMSSTRTTA

SEQ ID NO: 1108505 - protein, 9 aa, Homo Sapiens
ARKSITLWN

SEQ ID NO: 1108506 - protein, 9 aa, Homo Sapiens
HELGVAVDA

SEQ ID NO: 1108507 - protein, 9 aa, Homo Sapiens
GMYVFQLFG

SEQ ID NO: 1108508 - protein, 9 aa, Homo Sapiens
QPHAGEAGP

SEQ ID NO: 1108509 - protein, 9 aa, Homo Sapiens
RSQRARGSH

SEQ ID NO: 1108510 - protein, 9 aa, Homo Sapiens
MEGHHKLFI

SEQ ID NO: 1108511 - protein, 9 aa, Homo Sapiens
LMVLVATGL

SEQ ID NO: 1108512 - protein, 9 aa, Homo Sapiens
SVGSQNDTY

SEQ ID NO: 1108513 - protein, 9 aa, Homo Sapiens
MCTIATALE

SEQ ID NO: 1108514 - protein, 9 aa, Homo Sapiens
ESAVLLDMA

SEQ ID NO: 1108515 - protein, 9 aa, Homo Sapiens
TFRLPRNGQ

SEQ ID NO: 1108516 - protein, 9 aa, Homo Sapiens
LRSQGVNTL

SEQ ID NO: 1108517 - protein, 9 aa, Homo Sapiens
RVPPGRALH

SEQ ID NO: 1108518 - protein, 9 aa, Homo Sapiens
YLHFAVTLF

SEQ ID NO: 1108519 - protein, 9 aa, Homo Sapiens
AFYPPHTDY

SEQ ID NO: 1108520 - protein, 9 aa, Homo Sapiens
TTPHWTFGG

SEQ ID NO: 1108521 - protein, 9 aa, Homo Sapiens
GFQWGESPW

SEQ ID NO: 1108522 - protein, 9 aa, Homo Sapiens
VGRAVQKLQ

SEQ ID NO: 1108523 - protein, 9 aa, Homo Sapiens
QDCGRHFHQ

SEQ ID NO: 1108524 - protein, 9 aa, Homo Sapiens
NFQVWNALC

SEQ ID NO: 1108525 - protein, 9 aa, Homo Sapiens
QVRGPHFNP

SEQ ID NO: 1108526 - protein, 9 aa, Homo Sapiens
MRSLGEPWR

SEQ ID NO: 1108527 - protein, 9 aa, Homo Sapiens
RTQHITWKG

SEQ ID NO: 1108528 - protein, 9 aa, Homo Sapiens
AGVYKTYIC

SEQ ID NO: 1108529 - protein, 9 aa, Homo Sapiens
ALTISPFST

SEQ ID NO: 1108530 - protein, 9 aa, Homo Sapiens
LEMLTPSGS

SEQ ID NO: 1108531 - protein, 9 aa, Homo Sapiens
SKLWENDRG

SEQ ID NO: 1108532 - protein, 9 aa, Homo Sapiens
EAVEVVRIG

SEQ ID NO: 1108533 - protein, 9 aa, Homo Sapiens
MSLMPCGVP

SEQ ID NO: 1108534 - protein, 9 aa, Homo Sapiens
ASPPCAARA

SEQ ID NO: 1108535 - protein, 9 aa, Homo Sapiens
QRPIQVQTG

SEQ ID NO: 1108536 - protein, 9 aa, Homo Sapiens
CSRPSRQRL

SEQ ID NO: 1108537 - protein, 9 aa, Homo Sapiens
HSGRGPEVN

SEQ ID NO: 1108538 - protein, 9 aa, Homo Sapiens
VHGPDAHIT

SEQ ID NO: 1108539 - protein, 9 aa, Homo Sapiens
QGLLVGIVQ

SEQ ID NO: 1108540 - protein, 9 aa, Homo Sapiens
FAPGEDSGD

SEQ ID NO: 1108541 - protein, 9 aa, Homo Sapiens
IWKMSPRTG

SEQ ID NO: 1108542 - protein, 9 aa, Homo Sapiens
VILCSELSS

SEQ ID NO: 1108543 - protein, 9 aa, Homo Sapiens
PGPRPGSPR

SEQ ID NO: 1108544 - protein, 9 aa, Homo Sapiens
KQLLTYIWS

SEQ ID NO: 1108545 - protein, 9 aa, Homo Sapiens
HQYSVHPPP

SEQ ID NO: 1108546 - protein, 9 aa, Homo Sapiens
REVKSPFLP

SEQ ID NO: 1108547 - protein, 9 aa, Homo Sapiens
TSVPEEFHS

SEQ ID NO: 1108548 - protein, 9 aa, Homo Sapiens
LYIGVSTVH

SEQ ID NO: 1108549 - protein, 9 aa, Homo Sapiens
PSRQDPRTA

SEQ ID NO: 1108550 - protein, 9 aa, Homo Sapiens
GSSSGGGSG

SEQ ID NO: 1108551 - protein, 9 aa, Homo Sapiens
VRMPACMSA

SEQ ID NO: 1108552 - protein, 9 aa, Homo Sapiens
ALLEMEVSP

SEQ ID NO: 1108553 - protein, 9 aa, Homo Sapiens
LKATQNDKL

SEQ ID NO: 1108554 - protein, 9 aa, Homo Sapiens
STDTSVEAL

SEQ ID NO: 1108555 - protein, 9 aa, Homo Sapiens
LRGETVNLR

SEQ ID NO: 1108556 - protein, 9 aa, Homo Sapiens
RVQHMQGHP

SEQ ID NO: 1108557 - protein, 9 aa, Homo Sapiens
RLLCPPVPG

SEQ ID NO: 1108558 - protein, 9 aa, Homo Sapiens
QKVEIRRRI

SEQ ID NO: 1108559 - protein, 9 aa, Homo Sapiens
STPEEQGEL

SEQ ID NO: 1108560 - protein, 9 aa, Homo Sapiens
NAEEGAGRQ

SEQ ID NO: 1108561 - protein, 9 aa, Homo Sapiens
GRCMRVNMP

SEQ ID NO: 1108562 - protein, 9 aa, Homo Sapiens
CILEIVYAS

SEQ ID NO: 1108563 - protein, 9 aa, Homo Sapiens
QMQLKALDP

SEQ ID NO: 1108564 - protein, 9 aa, Homo Sapiens
RHQLMRTRP

SEQ ID NO: 1108565 - protein, 9 aa, Homo Sapiens
SLRIAGCRH

SEQ ID NO: 1108566 - protein, 9 aa, Homo Sapiens
GHLKPSGEQ

SEQ ID NO: 1108567 - protein, 9 aa, Homo Sapiens
APATEVGCP

SEQ ID NO: 1108568 - protein, 9 aa, Homo Sapiens
ETRALRARQ

SEQ ID NO: 1108569 - protein, 9 aa, Homo Sapiens
TPQPSLPGP

SEQ ID NO: 1108570 - protein, 9 aa, Homo Sapiens
PALVGIQPA

SEQ ID NO: 1108571 - protein, 9 aa, Homo Sapiens
SMDHSSVVQ

SEQ ID NO: 1108572 - protein, 9 aa, Homo Sapiens
RNPYKTLQA

SEQ ID NO: 1108573 - protein, 9 aa, Homo Sapiens
LLFAGILVL

SEQ ID NO: 1108574 - protein, 9 aa, Homo Sapiens
SRTCSQGER

SEQ ID NO: 1108575 - protein, 9 aa, Homo Sapiens
LSCQLCSSS

SEQ ID NO: 1108576 - protein, 9 aa, Homo Sapiens
TYCVCVLAA

SEQ ID NO: 1108577 - protein, 9 aa, Homo Sapiens
ALFFIREGT

SEQ ID NO: 1108578 - protein, 9 aa, Homo Sapiens
NTTSRMEST

SEQ ID NO: 1108579 - protein, 9 aa, Homo Sapiens
CDSCQELAM

SEQ ID NO: 1108580 - protein, 9 aa, Homo Sapiens
ALFKGAREH

SEQ ID NO: 1108581 - protein, 9 aa, Homo Sapiens
TSTECSEIT

SEQ ID NO: 1108582 - protein, 9 aa, Homo Sapiens
EECLIALKK

SEQ ID NO: 1108583 - protein, 9 aa, Homo Sapiens
NNTFFCNQC

SEQ ID NO: 1108584 - protein, 9 aa, Homo Sapiens
SVFQVIRCP

SEQ ID NO: 1108585 - protein, 9 aa, Homo Sapiens
PGANGILGT

SEQ ID NO: 1108586 - protein, 9 aa, Homo Sapiens
PGLDGGLAV

SEQ ID NO: 1108587 - protein, 9 aa, Homo Sapiens
NWSAFLEPE

SEQ ID NO: 1108588 - protein, 9 aa, Homo Sapiens
VHQVRPIVG

SEQ ID NO: 1108589 - protein, 9 aa, Homo Sapiens
PAPTPASPW

SEQ ID NO: 1108590 - protein, 9 aa, Homo Sapiens
SPAHSPTPT

SEQ ID NO: 1108591 - protein, 9 aa, Homo Sapiens
RDMAQGVRG

SEQ ID NO: 1108592 - protein, 9 aa, Homo Sapiens
NQHQEDPNN

SEQ ID NO: 1108593 - protein, 9 aa, Homo Sapiens
RKLKRLRRH

SEQ ID NO: 1108594 - protein, 9 aa, Homo Sapiens
AQAAVPAET

SEQ ID NO: 1108595 - protein, 9 aa, Homo Sapiens
LHFLSGLLS

SEQ ID NO: 1108596 - protein, 9 aa, Homo Sapiens
QTSVLSFTT

SEQ ID NO: 1108597 - protein, 9 aa, Homo Sapiens
GERFGNQQR

SEQ ID NO: 1108598 - protein, 9 aa, Homo Sapiens
WDILAIVLI

SEQ ID NO: 1108599 - protein, 9 aa, Homo Sapiens
QREDLLARE

SEQ ID NO: 1108600 - protein, 9 aa, Homo Sapiens
SGDPAGVYK

SEQ ID NO: 1108601 - protein, 9 aa, Homo Sapiens
QGDLLTPPA

SEQ ID NO: 1108602 - protein, 9 aa, Homo Sapiens
RAVPGSPPG

SEQ ID NO: 1108603 - protein, 9 aa, Homo Sapiens
LEILILDTN

SEQ ID NO: 1108604 - protein, 9 aa, Homo Sapiens
RRGGTCASS

SEQ ID NO: 1108605 - protein, 9 aa, Homo Sapiens
TPEDHCCRS

SEQ ID NO: 1108606 - protein, 9 aa, Homo Sapiens
FLKYMVSYD

SEQ ID NO: 1108607 - protein, 9 aa, Homo Sapiens
LNLSNNLFS

SEQ ID NO: 1108608 - protein, 9 aa, Homo Sapiens
LQVFLFFTI

SEQ ID NO: 1108609 - protein, 9 aa, Homo Sapiens
VRHRALSEQ

SEQ ID NO: 1108610 - protein, 9 aa, Homo Sapiens
HQSPGHLGL

SEQ ID NO: 1108611 - protein, 9 aa, Homo Sapiens
LTTVSHNGS

SEQ ID NO: 1108612 - protein, 9 aa, Homo Sapiens
LEELQMQLK

SEQ ID NO: 1108613 - protein, 9 aa, Homo Sapiens
ITVSCAVAR

SEQ ID NO: 1108614 - protein, 9 aa, Homo Sapiens
ELYVVLNDE

SEQ ID NO: 1108615 - protein, 9 aa, Homo Sapiens
LLFIISQPG

SEQ ID NO: 1108616 - protein, 9 aa, Homo Sapiens
KKLWWTLPQ

SEQ ID NO: 1108617 - protein, 9 aa, Homo Sapiens
PGQSHTNGK

SEQ ID NO: 1108618 - protein, 9 aa, Homo Sapiens
EVVGAWAAV

SEQ ID NO: 1108619 - protein, 9 aa, Homo Sapiens
INPKTGASS

SEQ ID NO: 1108620 - protein, 9 aa, Homo Sapiens
LQPASQTPA

SEQ ID NO: 1108621 - protein, 9 aa, Homo Sapiens
SCIRCGNGT

SEQ ID NO: 1108622 - protein, 9 aa, Homo Sapiens
DCLLQQDKA

SEQ ID NO: 1108623 - protein, 9 aa, Homo Sapiens
ELRMAMKGA

SEQ ID NO: 1108624 - protein, 9 aa, Homo Sapiens
RSENFEELF

SEQ ID NO: 1108625 - protein, 9 aa, Homo Sapiens
WYQASKKRK

SEQ ID NO: 1108626 - protein, 9 aa, Homo Sapiens
IQPAGPGRG

SEQ ID NO: 1108627 - protein, 9 aa, Homo Sapiens
VREHVLEEV

SEQ ID NO: 1108628 - protein, 9 aa, Homo Sapiens
TKTSNMDLT

SEQ ID NO: 1108629 - protein, 9 aa, Homo Sapiens
RHLTHLLGP

SEQ ID NO: 1108630 - protein, 9 aa, Homo Sapiens
AFRQCTHLS

SEQ ID NO: 1108631 - protein, 9 aa, Homo Sapiens
AVGKCRSAD

SEQ ID NO: 1108632 - protein, 9 aa, Homo Sapiens
RKRRGRKWR

SEQ ID NO: 1108633 - protein, 9 aa, Homo Sapiens
LLPRLVEHP

SEQ ID NO: 1108634 - protein, 9 aa, Homo Sapiens
GSRRCCRVG

SEQ ID NO: 1108635 - protein, 9 aa, Homo Sapiens
MAQGVRGRA

SEQ ID NO: 1108636 - protein, 9 aa, Homo Sapiens
SYSRYSAVK

SEQ ID NO: 1108637 - protein, 9 aa, Homo Sapiens
NPRHQTSVL

SEQ ID NO: 1108638 - protein, 9 aa, Homo Sapiens
GPCCPSTTC

SEQ ID NO: 1108639 - protein, 9 aa, Homo Sapiens
DGEITVSCA

SEQ ID NO: 1108640 - protein, 9 aa, Homo Sapiens
FLQKFGSMP

SEQ ID NO: 1108641 - protein, 9 aa, Homo Sapiens
PPVAEEAAA

SEQ ID NO: 1108642 - protein, 9 aa, Homo Sapiens
LLRTFMCSR

SEQ ID NO: 1108643 - protein, 9 aa, Homo Sapiens
LISMTLLLC

SEQ ID NO: 1108644 - protein, 9 aa, Homo Sapiens
ACQDCGRHF

SEQ ID NO: 1108645 - protein, 9 aa, Homo Sapiens
PQSQEEGIL

SEQ ID NO: 1108646 - protein, 9 aa, Homo Sapiens
WFTHHSLFL

SEQ ID NO: 1108647 - protein, 9 aa, Homo Sapiens
AQEVSLKCL

SEQ ID NO: 1108648 - protein, 9 aa, Homo Sapiens
VALHSEPAD

SEQ ID NO: 1108649 - protein, 9 aa, Homo Sapiens
GGRREPVEP

SEQ ID NO: 1108650 - protein, 9 aa, Homo Sapiens
AEREARRHG

SEQ ID NO: 1108651 - protein, 9 aa, Homo Sapiens
ALSYPWALM

SEQ ID NO: 1108652 - protein, 9 aa, Homo Sapiens
EAGAHRSAK

SEQ ID NO: 1108653 - protein, 9 aa, Homo Sapiens
VYLRAARSM

SEQ ID NO: 1108654 - protein, 9 aa, Homo Sapiens
REHICLRET

SEQ ID NO: 1108655 - protein, 9 aa, Homo Sapiens
LQSKYGGSV

SEQ ID NO: 1108656 - protein, 9 aa, Homo Sapiens
VHRNQPPHP

SEQ ID NO: 1108657 - protein, 9 aa, Homo Sapiens
DMDHVLLKY

SEQ ID NO: 1108658 - protein, 9 aa, Homo Sapiens
REGWRWGWG

SEQ ID NO: 1108659 - protein, 9 aa, Homo Sapiens
KMCQQLKGC

SEQ ID NO: 1108660 - protein, 9 aa, Homo Sapiens
KALEIAEKN

SEQ ID NO: 1108661 - protein, 9 aa, Homo Sapiens
RQLPGPHDD

SEQ ID NO: 1108662 - protein, 9 aa, Homo Sapiens
NYYSLFEGT

SEQ ID NO: 1108663 - protein, 9 aa, Homo Sapiens
EPASGVGEE

SEQ ID NO: 1108664 - protein, 9 aa, Homo Sapiens
QKILLSSIL

SEQ ID NO: 1108665 - protein, 9 aa, Homo Sapiens
SSSREWKVK

SEQ ID NO: 1108666 - protein, 9 aa, Homo Sapiens
SQTPAGMED

SEQ ID NO: 1108667 - protein, 9 aa, Homo Sapiens
GEAEDDLRG

SEQ ID NO: 1108668 - protein, 9 aa, Homo Sapiens
SLDATLPDR

SEQ ID NO: 1108669 - protein, 9 aa, Homo Sapiens
DPDDVLMVT

SEQ ID NO: 1108670 - protein, 9 aa, Homo Sapiens
CRSADIKVI

SEQ ID NO: 1108671 - protein, 9 aa, Homo Sapiens
VLGGPATPT

SEQ ID NO: 1108672 - protein, 9 aa, Homo Sapiens
PPTLWTLCS

SEQ ID NO: 1108673 - protein, 9 aa, Homo Sapiens
SSLTGTTMA

SEQ ID NO: 1108674 - protein, 9 aa, Homo Sapiens
VAGPPAAEE

SEQ ID NO: 1108675 - protein, 9 aa, Homo Sapiens
RLRRHLRLL

SEQ ID NO: 1108676 - protein, 9 aa, Homo Sapiens
NMDFLTLRH

SEQ ID NO: 1108677 - protein, 9 aa, Homo Sapiens
PWQVMASLT

SEQ ID NO: 1108678 - protein, 9 aa, Homo Sapiens
GYQQTYSLP

SEQ ID NO: 1108679 - protein, 9 aa, Homo Sapiens
RSARAPRSW

SEQ ID NO: 1108680 - protein, 9 aa, Homo Sapiens
LQTSGSSSS

SEQ ID NO: 1108681 - protein, 9 aa, Homo Sapiens
RVQAVQPIL

SEQ ID NO: 1108682 - protein, 9 aa, Homo Sapiens
EMHLIHARK

SEQ ID NO: 1108683 - protein, 9 aa, Homo Sapiens
GVPDPSPGA

SEQ ID NO: 1108684 - protein, 9 aa, Homo Sapiens
PAAPPAAAP

SEQ ID NO: 1108685 - protein, 9 aa, Homo Sapiens
HPTFWTHTE

SEQ ID NO: 1108686 - protein, 9 aa, Homo Sapiens
KSKNIQVVV

SEQ ID NO: 1108687 - protein, 9 aa, Homo Sapiens
SGTRSSLGA

SEQ ID NO: 1108688 - protein, 9 aa, Homo Sapiens
GAADSAWGW

SEQ ID NO: 1108689 - protein, 9 aa, Homo Sapiens
NLQAVQGHA

SEQ ID NO: 1108690 - protein, 9 aa, Homo Sapiens
RFTVRTCVC

SEQ ID NO: 1108691 - protein, 9 aa, Homo Sapiens
EEASQVGGT

SEQ ID NO: 1108692 - protein, 9 aa, Homo Sapiens
GPEVNAGGR

SEQ ID NO: 1108693 - protein, 9 aa, Homo Sapiens
RTAQPKTAG

SEQ ID NO: 1108694 - protein, 9 aa, Homo Sapiens
EDAYKEPYF

SEQ ID NO: 1108695 - protein, 9 aa, Homo Sapiens
GWEEASQVG

SEQ ID NO: 1108696 - protein, 9 aa, Homo Sapiens
AVYTRHALT

SEQ ID NO: 1108697 - protein, 9 aa, Homo Sapiens
SSKFRDSAT

SEQ ID NO: 1108698 - protein, 9 aa, Homo Sapiens
PHLFLASLP

SEQ ID NO: 1108699 - protein, 9 aa, Homo Sapiens
QSQQSLSLQ

SEQ ID NO: 1108700 - protein, 9 aa, Homo Sapiens
AQDWATIRL

SEQ ID NO: 1108701 - protein, 9 aa, Homo Sapiens
WTFYGTPEY

SEQ ID NO: 1108702 - protein, 9 aa, Homo Sapiens
IRVASILGI

SEQ ID NO: 1108703 - protein, 9 aa, Homo Sapiens
TGRPRMSLM

SEQ ID NO: 1108704 - protein, 9 aa, Homo Sapiens
PPVWAVLAW

SEQ ID NO: 1108705 - protein, 9 aa, Homo Sapiens
FQILGLRSS

SEQ ID NO: 1108706 - protein, 9 aa, Homo Sapiens
QQHGRRFRS

SEQ ID NO: 1108707 - protein, 9 aa, Homo Sapiens
QVWRANVGA

SEQ ID NO: 1108708 - protein, 9 aa, Homo Sapiens
GRGIGPLTR

SEQ ID NO: 1108709 - protein, 9 aa, Homo Sapiens
LPMVPPHLG

SEQ ID NO: 1108710 - protein, 9 aa, Homo Sapiens
SQGERCWRS

SEQ ID NO: 1108711 - protein, 9 aa, Homo Sapiens
VDWMDEMKV

SEQ ID NO: 1108712 - protein, 9 aa, Homo Sapiens
LESNGKGVF

SEQ ID NO: 1108713 - protein, 9 aa, Homo Sapiens
GSPPYTQAS

SEQ ID NO: 1108714 - protein, 9 aa, Homo Sapiens
LEAQHHIAP

SEQ ID NO: 1108715 - protein, 9 aa, Homo Sapiens
QDKETVSVQ

SEQ ID NO: 1108716 - protein, 9 aa, Homo Sapiens
VVAAAATAA

SEQ ID NO: 1108717 - protein, 9 aa, Homo Sapiens
MESAVLLDM

SEQ ID NO: 1108718 - protein, 9 aa, Homo Sapiens
KASEFTNVH

SEQ ID NO: 1108719 - protein, 9 aa, Homo Sapiens
RSRGTRRYR

SEQ ID NO: 1108720 - protein, 9 aa, Homo Sapiens
AGLSPGACR

SEQ ID NO: 1108721 - protein, 9 aa, Homo Sapiens
ARAGGRAAP

SEQ ID NO: 1108722 - protein, 9 aa, Homo Sapiens
VKKPIISVV

SEQ ID NO: 1108723 - protein, 9 aa, Homo Sapiens
ALARGRSSA

SEQ ID NO: 1108724 - protein, 9 aa, Homo Sapiens
AVAGRNSHV

SEQ ID NO: 1108725 - protein, 9 aa, Homo Sapiens
TAHLLRLWM

SEQ ID NO: 1108726 - protein, 9 aa, Homo Sapiens
AISKLKNQH

SEQ ID NO: 1108727 - protein, 9 aa, Homo Sapiens
RCLSIGHPY

SEQ ID NO: 1108728 - protein, 9 aa, Homo Sapiens
KPGRVRCRK

SEQ ID NO: 1108729 - protein, 9 aa, Homo Sapiens
PARAGPKRA

SEQ ID NO: 1108730 - protein, 9 aa, Homo Sapiens
GNHPERYGV

SEQ ID NO: 1108731 - protein, 9 aa, Homo Sapiens
GSLVCSTSS

SEQ ID NO: 1108732 - protein, 9 aa, Homo Sapiens
MDTVILYRS

SEQ ID NO: 1108733 - protein, 9 aa, Homo Sapiens
WVQDRNLRP

SEQ ID NO: 1108734 - protein, 9 aa, Homo Sapiens
LIGLYGFIF

SEQ ID NO: 1108735 - protein, 9 aa, Homo Sapiens
ADNSRGCGG

SEQ ID NO: 1108736 - protein, 9 aa, Homo Sapiens
SLCGVGPQF

SEQ ID NO: 1108737 - protein, 9 aa, Homo Sapiens
NKILAVQRA

SEQ ID NO: 1108738 - protein, 9 aa, Homo Sapiens
SPPGRHWLC

SEQ ID NO: 1108739 - protein, 9 aa, Homo Sapiens
SAARAGGRA

SEQ ID NO: 1108740 - protein, 9 aa, Homo Sapiens
MSDLLQQAG

SEQ ID NO: 1108741 - protein, 9 aa, Homo Sapiens
LHHTSIPRR

SEQ ID NO: 1108742 - protein, 9 aa, Homo Sapiens
PQRRGEQSP

SEQ ID NO: 1108743 - protein, 9 aa, Homo Sapiens
SWMTAIYDA

SEQ ID NO: 1108744 - protein, 9 aa, Homo Sapiens
PPCGAHGGQ

SEQ ID NO: 1108745 - protein, 9 aa, Homo Sapiens
AGKHGEMSM

SEQ ID NO: 1108746 - protein, 9 aa, Homo Sapiens
IVDTNDSDV

SEQ ID NO: 1108747 - protein, 9 aa, Homo Sapiens
LGGAGKHGE

SEQ ID NO: 1108748 - protein, 9 aa, Homo Sapiens
VQKATGKRD

SEQ ID NO: 1108749 - protein, 9 aa, Homo Sapiens
GPCSRSPSL

SEQ ID NO: 1108750 - protein, 9 aa, Homo Sapiens
SGLLGMQNL

SEQ ID NO: 1108751 - protein, 9 aa, Homo Sapiens
HSPVQSGLL

SEQ ID NO: 1108752 - protein, 9 aa, Homo Sapiens
CVGRWNYRF

SEQ ID NO: 1108753 - protein, 9 aa, Homo Sapiens
AYMRALEIQ

SEQ ID NO: 1108754 - protein, 9 aa, Homo Sapiens
KASKHFEES

SEQ ID NO: 1108755 - protein, 9 aa, Homo Sapiens
GYNVYDEKA

SEQ ID NO: 1108756 - protein, 9 aa, Homo Sapiens
GRWNYRFFY

SEQ ID NO: 1108757 - protein, 9 aa, Homo Sapiens
SPRPPVPPR

SEQ ID NO: 1108758 - protein, 9 aa, Homo Sapiens
ERERESLGG

SEQ ID NO: 1108759 - protein, 9 aa, Homo Sapiens
SIGVQAEAL

SEQ ID NO: 1108760 - protein, 9 aa, Homo Sapiens
SMAACPEAP

SEQ ID NO: 1108761 - protein, 9 aa, Homo Sapiens
MLRAQKSRN

SEQ ID NO: 1108762 - protein, 9 aa, Homo Sapiens
PPRPSPRPP

SEQ ID NO: 1108763 - protein, 9 aa, Homo Sapiens
RADIKENKD

SEQ ID NO: 1108764 - protein, 9 aa, Homo Sapiens
WEALEKVHK

SEQ ID NO: 1108765 - protein, 9 aa, Homo Sapiens
NELTCICMV

SEQ ID NO: 1108766 - protein, 9 aa, Homo Sapiens
VEGPGWLAQ

SEQ ID NO: 1108767 - protein, 9 aa, Homo Sapiens
DDLFVGLVG

SEQ ID NO: 1108768 - protein, 9 aa, Homo Sapiens
NLLKLEVKH

SEQ ID NO: 1108769 - protein, 9 aa, Homo Sapiens
SAYWEPRKL

SEQ ID NO: 1108770 - protein, 9 aa, Homo Sapiens
AGVAGDMVA

SEQ ID NO: 1108771 - protein, 9 aa, Homo Sapiens
RTSGGLFGG

SEQ ID NO: 1108772 - protein, 9 aa, Homo Sapiens
PLFVKASKH

SEQ ID NO: 1108773 - protein, 9 aa, Homo Sapiens
TMKALALLT

SEQ ID NO: 1108774 - protein, 9 aa, Homo Sapiens
LFQNGSLLV

SEQ ID NO: 1108775 - protein, 9 aa, Homo Sapiens
IRDQDGGMR

SEQ ID NO: 1108776 - protein, 9 aa, Homo Sapiens
NVYDEKAKE

SEQ ID NO: 1108777 - protein, 9 aa, Homo Sapiens
EERERERES

SEQ ID NO: 1108778 - protein, 9 aa, Homo Sapiens
EQIKVDMAI

SEQ ID NO: 1108779 - protein, 9 aa, Homo Sapiens
WEYCLSPRN

SEQ ID NO: 1108780 - protein, 9 aa, Homo Sapiens
RPGYPALLW

SEQ ID NO: 1108781 - protein, 9 aa, Homo Sapiens
RHYEEMPEY

SEQ ID NO: 1108782 - protein, 9 aa, Homo Sapiens
SPLQGEDFQ

SEQ ID NO: 1108783 - protein, 9 aa, Homo Sapiens
LEMQKGGLR

SEQ ID NO: 1108784 - protein, 9 aa, Homo Sapiens
GAHGGQQTY

SEQ ID NO: 1108785 - protein, 9 aa, Homo Sapiens
AYIYRVIQT

SEQ ID NO: 1108786 - protein, 9 aa, Homo Sapiens
IRVLLLGGD

SEQ ID NO: 1108787 - protein, 9 aa, Homo Sapiens
MDVLYIVSQ

SEQ ID NO: 1108788 - protein, 9 aa, Homo Sapiens
LEVWEALEK

SEQ ID NO: 1108789 - protein, 9 aa, Homo Sapiens
THQADCKMK

SEQ ID NO: 1108790 - protein, 9 aa, Homo Sapiens
DLFVGLVGN

SEQ ID NO: 1108791 - protein, 9 aa, Homo Sapiens
YMRALEIQP

SEQ ID NO: 1108792 - protein, 9 aa, Homo Sapiens
LRAQKSRNG

SEQ ID NO: 1108793 - protein, 9 aa, Homo Sapiens
NSSFAFHKF

SEQ ID NO: 1108794 - protein, 9 aa, Homo Sapiens
LPGSRGSPA

SEQ ID NO: 1108795 - protein, 9 aa, Homo Sapiens
ECEIRDQDG

SEQ ID NO: 1108796 - protein, 9 aa, Homo Sapiens
VGFCTLVCP

SEQ ID NO: 1108797 - protein, 9 aa, Homo Sapiens
VFVTEVKEK

SEQ ID NO: 1108798 - protein, 9 aa, Homo Sapiens
VMCHGSKIQ

SEQ ID NO: 1108799 - protein, 9 aa, Homo Sapiens
GNCVGRWNY

SEQ ID NO: 1108800 - protein, 9 aa, Homo Sapiens
KPLLSIFSQ

SEQ ID NO: 1108801 - protein, 9 aa, Homo Sapiens
VDTALFTQS

SEQ ID NO: 1108802 - protein, 9 aa, Homo Sapiens
EHEVPGHPL

SEQ ID NO: 1108803 - protein, 9 aa, Homo Sapiens
FCTLVCPLH

SEQ ID NO: 1108804 - protein, 9 aa, Homo Sapiens
KVGRYRDDE

SEQ ID NO: 1108805 - protein, 9 aa, Homo Sapiens
EPPPFKCFL

SEQ ID NO: 1108806 - protein, 9 aa, Homo Sapiens
FVKEWQLHL

SEQ ID NO: 1108807 - protein, 9 aa, Homo Sapiens
VARVPLLFS

SEQ ID NO: 1108808 - protein, 9 aa, Homo Sapiens
FSLLSVTSN

SEQ ID NO: 1108809 - protein, 9 aa, Homo Sapiens
HQADCKMKL

SEQ ID NO: 1108810 - protein, 9 aa, Homo Sapiens
DGRLGLGGQ

SEQ ID NO: 1108811 - protein, 9 aa, Homo Sapiens
KKKKGYNVY

SEQ ID NO: 1108812 - protein, 9 aa, Homo Sapiens
WTSATSSVK

SEQ ID NO: 1108813 - protein, 9 aa, Homo Sapiens
PFMKILPVN

SEQ ID NO: 1108814 - protein, 9 aa, Homo Sapiens
LEACCTDGH

SEQ ID NO: 1108815 - protein, 9 aa, Homo Sapiens
LTFFQGNHN

SEQ ID NO: 1108816 - protein, 9 aa, Homo Sapiens
AANLSRAPW

SEQ ID NO: 1108817 - protein, 9 aa, Homo Sapiens
APFLRYQER

SEQ ID NO: 1108818 - protein, 9 aa, Homo Sapiens
DVGFCTLVC

SEQ ID NO: 1108819 - protein, 9 aa, Homo Sapiens
KLVAHMEAS

SEQ ID NO: 1108820 - protein, 9 aa, Homo Sapiens
GLGGQIVHD

SEQ ID NO: 1108821 - protein, 9 aa, Homo Sapiens
LIHRSKMAQ

SEQ ID NO: 1108822 - protein, 9 aa, Homo Sapiens
GRRALSTVP

SEQ ID NO: 1108823 - protein, 9 aa, Homo Sapiens
ENGEVYQAR

SEQ ID NO: 1108824 - protein, 9 aa, Homo Sapiens
PAYEPHSPG

SEQ ID NO: 1108825 - protein, 9 aa, Homo Sapiens
EEAVEAYMR

SEQ ID NO: 1108826 - protein, 9 aa, Homo Sapiens
GEVYQARED

SEQ ID NO: 1108827 - protein, 9 aa, Homo Sapiens
CFFNFCGLD

SEQ ID NO: 1108828 - protein, 9 aa, Homo Sapiens
TPGPQVEMV

SEQ ID NO: 1108829 - protein, 9 aa, Homo Sapiens
SRAAADLEC

SEQ ID NO: 1108830 - protein, 9 aa, Homo Sapiens
VCSRTPVET

SEQ ID NO: 1108831 - protein, 9 aa, Homo Sapiens
TDLHPSVRQ

SEQ ID NO: 1108832 - protein, 9 aa, Homo Sapiens
TKKAEGSPQ

SEQ ID NO: 1108833 - protein, 9 aa, Homo Sapiens
QLQTSIGVQ

SEQ ID NO: 1108834 - protein, 9 aa, Homo Sapiens
YVPGPCSRS

SEQ ID NO: 1108835 - protein, 9 aa, Homo Sapiens
VEMVQNGSS

SEQ ID NO: 1108836 - protein, 9 aa, Homo Sapiens
EYAKLKKSK

SEQ ID NO: 1108837 - protein, 9 aa, Homo Sapiens
MLPTCFLGL

SEQ ID NO: 1108838 - protein, 9 aa, Homo Sapiens
IILIRCTML

SEQ ID NO: 1108839 - protein, 9 aa, Homo Sapiens
LGGDRLFTC

SEQ ID NO: 1108840 - protein, 9 aa, Homo Sapiens
LECFFNFCG

SEQ ID NO: 1108841 - protein, 9 aa, Homo Sapiens
GLLEVWEAL

SEQ ID NO: 1108842 - protein, 9 aa, Homo Sapiens
VKIRYDFTA

SEQ ID NO: 1108843 - protein, 9 aa, Homo Sapiens
DLELQNIAE

SEQ ID NO: 1108844 - protein, 9 aa, Homo Sapiens
GICDENRAN

SEQ ID NO: 1108845 - protein, 9 aa, Homo Sapiens
HLLHTIKDF

SEQ ID NO: 1108846 - protein, 9 aa, Homo Sapiens
EAYMRALEI

SEQ ID NO: 1108847 - protein, 9 aa, Homo Sapiens
LLTRMAFCA

SEQ ID NO: 1108848 - protein, 9 aa, Homo Sapiens
LLYLEMQKG

SEQ ID NO: 1108849 - protein, 9 aa, Homo Sapiens
KSRNGDKED

SEQ ID NO: 1108850 - protein, 9 aa, Homo Sapiens
TAANLSRAP

SEQ ID NO: 1108851 - protein, 9 aa, Homo Sapiens
LGLGGQIVH

SEQ ID NO: 1108852 - protein, 9 aa, Homo Sapiens
FIITQHHLL

SEQ ID NO: 1108853 - protein, 9 aa, Homo Sapiens
LLLGTCAAT

SEQ ID NO: 1108854 - protein, 9 aa, Homo Sapiens
VIQSPEKPH

SEQ ID NO: 1108855 - protein, 9 aa, Homo Sapiens
VSLPELEDR

SEQ ID NO: 1108856 - protein, 9 aa, Homo Sapiens
VHFYGKAEH

SEQ ID NO: 1108857 - protein, 9 aa, Homo Sapiens
SEPPPFKCF

SEQ ID NO: 1108858 - protein, 9 aa, Homo Sapiens
GTAGVAGDM

SEQ ID NO: 1108859 - protein, 9 aa, Homo Sapiens
EGPGWLAQK

SEQ ID NO: 1108860 - protein, 9 aa, Homo Sapiens
VSDRDSGMN

SEQ ID NO: 1108861 - protein, 9 aa, Homo Sapiens
QVSLPELED

SEQ ID NO: 1108862 - protein, 9 aa, Homo Sapiens
HWEYCLSPR

SEQ ID NO: 1108863 - protein, 9 aa, Homo Sapiens
EWQLHLGVS

SEQ ID NO: 1108864 - protein, 9 aa, Homo Sapiens
VVHVGGEES

SEQ ID NO: 1108865 - protein, 9 aa, Homo Sapiens
PFLRYQERS

SEQ ID NO: 1108866 - protein, 9 aa, Homo Sapiens
PVGCVIQSP

SEQ ID NO: 1108867 - protein, 9 aa, Homo Sapiens
MAWQVSLPE

SEQ ID NO: 1108868 - protein, 9 aa, Homo Sapiens
RARRRRQSY

SEQ ID NO: 1108869 - protein, 9 aa, Homo Sapiens
PVQSGLLGM

SEQ ID NO: 1108870 - protein, 9 aa, Homo Sapiens
MGISGSDIS

SEQ ID NO: 1108871 - protein, 9 aa, Homo Sapiens
YECEIRDQD

SEQ ID NO: 1108872 - protein, 9 aa, Homo Sapiens
TSGGLFGGG

SEQ ID NO: 1108873 - protein, 9 aa, Homo Sapiens
IEYAKLKKS

SEQ ID NO: 1108874 - protein, 9 aa, Homo Sapiens
IFVKEWQLH

SEQ ID NO: 1108875 - protein, 9 aa, Homo Sapiens
WQLHLGVSA

SEQ ID NO: 1108876 - protein, 9 aa, Homo Sapiens
WVGNCVGRW

SEQ ID NO: 1108877 - protein, 9 aa, Homo Sapiens
GSVDPTLWE

SEQ ID NO: 1108878 - protein, 9 aa, Homo Sapiens
TKNSELLSP

SEQ ID NO: 1108879 - protein, 9 aa, Homo Sapiens
QKATGKRDH

SEQ ID NO: 1108880 - protein, 9 aa, Homo Sapiens
VLDIANVLS

SEQ ID NO: 1108881 - protein, 9 aa, Homo Sapiens
KENKDGKSR

SEQ ID NO: 1108882 - protein, 9 aa, Homo Sapiens
TAVTNGFNS

SEQ ID NO: 1108883 - protein, 9 aa, Homo Sapiens
FAWTSATSS

SEQ ID NO: 1108884 - protein, 9 aa, Homo Sapiens
NKYYRKSSV

SEQ ID NO: 1108885 - protein, 9 aa, Homo Sapiens
VLLLGGDRL

SEQ ID NO: 1108886 - protein, 9 aa, Homo Sapiens
TSATSSVKP

SEQ ID NO: 1108887 - protein, 9 aa, Homo Sapiens
ACADITSTV

SEQ ID NO: 1108888 - protein, 9 aa, Homo Sapiens
PCEPPEVGS

SEQ ID NO: 1108889 - protein, 9 aa, Homo Sapiens
QTPFICDCH

SEQ ID NO: 1108890 - protein, 9 aa, Homo Sapiens
QSPEKPHFQ

SEQ ID NO: 1108891 - protein, 9 aa, Homo Sapiens
NPKGLLEVW

SEQ ID NO: 1108892 - protein, 9 aa, Homo Sapiens
GEEENGEVY

SEQ ID NO: 1108893 - protein, 9 aa, Homo Sapiens
SGTCHAETS

SEQ ID NO: 1108894 - protein, 9 aa, Homo Sapiens
FQGNHNDGL

SEQ ID NO: 1108895 - protein, 9 aa, Homo Sapiens
NRANDFMLR

SEQ ID NO: 1108896 - protein, 9 aa, Homo Sapiens
GSEATAANL

SEQ ID NO: 1108897 - protein, 9 aa, Homo Sapiens
ANLSRAPWS

SEQ ID NO: 1108898 - protein, 9 aa, Homo Sapiens
DELITTVEE

SEQ ID NO: 1108899 - protein, 9 aa, Homo Sapiens
GNHNDGLGN

SEQ ID NO: 1108900 - protein, 9 aa, Homo Sapiens
VHVGGEESE

SEQ ID NO: 1108901 - protein, 9 aa, Homo Sapiens
IQDDYYYHG

SEQ ID NO: 1108902 - protein, 9 aa, Homo Sapiens
LWEQQLQQE

SEQ ID NO: 1108903 - protein, 9 aa, Homo Sapiens
QSPLQGEDF

SEQ ID NO: 1108904 - protein, 9 aa, Homo Sapiens
VLLEACCTD

SEQ ID NO: 1108905 - protein, 9 aa, Homo Sapiens
LDDLFVGLV

SEQ ID NO: 1108906 - protein, 9 aa, Homo Sapiens
SCLLQGTST

SEQ ID NO: 1108907 - protein, 9 aa, Homo Sapiens
KQKKYLEQS

SEQ ID NO: 1108908 - protein, 9 aa, Homo Sapiens
ERESLGGAG

SEQ ID NO: 1108909 - protein, 9 aa, Homo Sapiens
WPEDMDVLY

SEQ ID NO: 1108910 - protein, 9 aa, Homo Sapiens
QTSIGVQAE

SEQ ID NO: 1108911 - protein, 9 aa, Homo Sapiens
HTREMLHSK

SEQ ID NO: 1108912 - protein, 9 aa, Homo Sapiens
HRSKMAQCR

SEQ ID NO: 1108913 - protein, 9 aa, Homo Sapiens
NYLSTDVGF

SEQ ID NO: 1108914 - protein, 9 aa, Homo Sapiens
PIILIRCTM

SEQ ID NO: 1108915 - protein, 9 aa, Homo Sapiens
YNVYDEKAK

SEQ ID NO: 1108916 - protein, 9 aa, Homo Sapiens
QDDYYYHGY

SEQ ID NO: 1108917 - protein, 9 aa, Homo Sapiens
ITSTVSIQL

SEQ ID NO: 1108918 - protein, 9 aa, Homo Sapiens
VCKHWEEGV

SEQ ID NO: 1108919 - protein, 9 aa, Homo Sapiens
KKYEIVTDG

SEQ ID NO: 1108920 - protein, 9 aa, Homo Sapiens
NGEVYQARE

SEQ ID NO: 1108921 - protein, 9 aa, Homo Sapiens
KKGWKWKDK

SEQ ID NO: 1108922 - protein, 9 aa, Homo Sapiens
KGVWKWITK

SEQ ID NO: 1108923 - protein, 9 aa, Homo Sapiens
KDICSQMQF

SEQ ID NO: 1108924 - protein, 9 aa, Homo Sapiens
TSSVKPQHQ

SEQ ID NO: 1108925 - protein, 9 aa, Homo Sapiens
EIRFDQLHW

SEQ ID NO: 1108926 - protein, 9 aa, Homo Sapiens
LAQTPFICD

SEQ ID NO: 1108927 - protein, 9 aa, Homo Sapiens
IANVLSHLE

SEQ ID NO: 1108928 - protein, 9 aa, Homo Sapiens
DENRANDFM

SEQ ID NO: 1108929 - protein, 9 aa, Homo Sapiens
SHLCQNGGS

SEQ ID NO: 1108930 - protein, 9 aa, Homo Sapiens
DYKDICSQM

SEQ ID NO: 1108931 - protein, 9 aa, Homo Sapiens
STKNSELLS

SEQ ID NO: 1108932 - protein, 9 aa, Homo Sapiens
FRHSVVVPC

SEQ ID NO: 1108933 - protein, 9 aa, Homo Sapiens
MAIAEETRN

SEQ ID NO: 1108934 - protein, 9 aa, Homo Sapiens
QLQGCLGAK

SEQ ID NO: 1108935 - protein, 9 aa, Homo Sapiens
KHGEMSMSM

SEQ ID NO: 1108936 - protein, 9 aa, Homo Sapiens
WKWKDKDIS

SEQ ID NO: 1108937 - protein, 9 aa, Homo Sapiens
CICMVGIED

SEQ ID NO: 1108938 - protein, 9 aa, Homo Sapiens
PGWLAQKAF

SEQ ID NO: 1108939 - protein, 9 aa, Homo Sapiens
VTDGRVRKL

SEQ ID NO: 1108940 - protein, 9 aa, Homo Sapiens
GKHGEMSMS

SEQ ID NO: 1108941 - protein, 9 aa, Homo Sapiens
DSLMAGNGA

SEQ ID NO: 1108942 - protein, 9 aa, Homo Sapiens
GPGWLAQKA
